United States Patent 9,254,311 (MODIFIED POLYNUCLEOTIDES FOR THE PRODUCTION OF PROTEINS) - sequence listing, part 21

SEQ ID NO: 44339 - DNA, 2112 bp, Artificial Sequence
  Description of Artificial Sequence: Synthetic coding sequence
atgttcgaggacgtgttcagcgacagcggcaacaccggcaacttcgataggggcaagaagcggagactgaccatcattgagtgcgggtgcgacataaacatgatgattgatcttgccaaggtggcagacctggtcctaatgttaattgacgcgagtttcggattcgagatggagatgtttgagttcttaaatatttgccaggcccacgggttccctaagattctgggggtcctgactcacctcgattcctttaagcacaacaaacagttaaagaagacaaagaagcgcctgaaacatcgtttttggacagaggtgtatcaagacaaggtaggtttaacgcacgagctcgtgcagtcactgatcagtacatacagtacaattgatgctaaaatggcatccagcagggttacccttctctctaattccaagcccctggggtcggaggccatcgataaccaaggcgtgtcacttgaatttgaccagcagcagggcagcgtgtgcccttcggagagcgaaatttatgaggccggagccgaggacaggatggctggagcccctatggcagcggccgtgcagcctgcggaagtgaccgtggaggtgggagaagatctgcacatgcatcaagtgagagatagagagatgccggaagttgtggagattcgacggtccaattgcactaaccactgcgacctgggggatacctcttcttatcacaccaaggtgagcacagtacacatcatgaaaaaaagaaacggcgggggctctcttaataactactcgagttccatcccacccacccccagtacttcccaagaagacccccagttttcagtgcctcccactgctaatactccaacccctgtatgcaaactgagcatgcggtggtctaatctgttcacgtcggaaaagggatccgatcccgacaaagagcggaaggcacctgaaaatcatgcggacaccatcggatctggccgtgccattccaataaagcagggtatgcttctcaagcggtctggcaagtggttgaaaacttggaagaagaaatatgtgaccttgtgttcgaacggtgtcctgacctactatagctcactgggcgactatatgaaaaacatccataagaaggagattgacttgaggactagcacaattaaagtacccggcaaatggccctccctcgccacatccgcctgtgccccaatcagttctagtaaatccaatggattgtccaaggacatggacaccgggctcggcgactcaatctgtttttcacctggtatcagctctaccacaagccccaagctgaacccgcctcctagccctcacgcaaataagaaaaaacacttgaagaaaaagtccacaaataattttatgattgtctccgccaccggccaaacttggcatttcgaagcaactacctacgaggagcgcgatgcttgggtgcaggcaatacagtcccagattctcgcgagcctgcagtcctgtaagtcaagcaaaagcaagtcgcagctaacatctcagtccgaggccatggctctgcagtccatccagaacatgcgcggcaatgcccattgtgtggattgtgaaacacaaaatccaaaatgggctagcctgaatctgggagtactgatgtgtattgaatgttctgggatccatcgtagcttcgggacacgcctgagccgagttcgctctcttgagctggacgactggccagtggagttgaggaaggttatgtcttctattgggaatgaacttgccaacagcatttgggaaggctccagccagggtcagaccaaaccaagcatcaagagcactagggaagaaaaggagtggtggatcaggtccaagtacgaagaaaagctcttcctggcgcccttgccatgcaccgaactgtcactgggccagcagctgctgagagcaacaaccgacgaagacttgcagactgctatcctgctgctcgcccacgggtcacgtgaggaggtgaatgaaacctgtggtgaaggagatggatgtaccgcactccacctcgcctgtcggaaagggaacgtcgtactcgaacagctgctcaccggctggacaagttggcctgaaatgcctactggcacccagagatag

SEQ ID NO: 44340 - DNA, 1977 bp, Artificial Sequence
  Description of Artificial Sequence: Synthetic coding sequence
atgggcaacatcctgacctgccgggtgcaccccagcgtgagcctggaattcgaccagcagcaaggatctgtctgtcccagcgaatccgagatctacgaagcgggcgctgaagaccgtatggctggcgctcctatggcagcagctgttcagcctgcggaggtgaccgtcgaagttggagaggaccttcacatgcatcaggtaagagatcgagagatgcctgaggcactggaatttaacctgtccgctaaccccgaagccagcaccatatttcagaggaactcgcagacagacgcgctggagtttaatagcagtgcaaatcctgaagcgtcaacgattttccagaggaattctcagacagatgtggtggagattagaaggtccaactgtacaaaccatgtgtctaccgagcgtttcagccaacagtattcctcctgctctacaatcttcctggacgactctacagcaattcaacactatttaactatgacgattatttcagttaccttggagattccccaccatatcacgcagcgcgacgccgataggtctctgagcatcccggacgagcagctgcactctttcgccgtcagcacagtccacatcatgaagaaacggaatgggggcggctctttgaataactattctagctcaataccccctacacccagcacctcccaggaggatccacagttctcagtcccccctacggctaacacccccactcccgtttgcaaactgtccatgcgttggtctaacttgtttacctcagagaaaggctctgaccctgacaaggagcggaaagcccctgaaaaccacgcagataccattggatccggacgggcgattccgattaaacagggcatgctgcttaagcgatccgggaagtggctcaaaacctggaagaaaaagtacgtgaccctctgttcaaacggggtcttaacctactacagctcccttggcgattatatgaagaatattcataaaaaagagattgatctaaggactagcactattaaagtgcctgggaagtggcccagcctcgcgaccagtgcttgcgccccgatcagcagtagtaagtccaatgggctctcgaaggatatggacaccgggttgggtgattcaatttgtttttcgcctgggatatcgagtaccacctcacctaaattgaacccacctcctagccctcacgctaacaagaaaaagcacctgaagaagaagagcacaaacaatttcatgattgtcagtgcaactggacaaacttggcacttcgaggctacaacctacgaggagcgcgacgcatgggtccaggctattcagagccaaatattggctagcttgcagagctgcaagagctctaagagcaagagtcagttaacatcacagtctgaggctatggctctgcaatctattcagaacatgagaggcaacgcacattgtgtggactgtgagactcaaaatcccaaatgggcttctctgaacctaggtgttctgatgtgcatagagtgttcggggattcataggtctttcggtaccagactgtctcgcgttcgttcattggaactcgatgattggccagtggaactgcgcaaagtaatgtcttctatcggaaatgaactggccaatagtatatgggagggaagttcccaaggacagactaaaccctctattaaatcgaccagggaggaaaaggaatggtggattcgcagcaagtacgaagagaagctgtttctggccccactgccttgcaccgagctgtctctcggccagcagcttcttagagcaacgacagacgaggaccttcagactgctatacttctcttggcacacggttccagggaggaggttaatgagacctgcggtgagggggatggttgcaccgccttgcatctggcttgtagaaaaggaaatgttgttctagagcagcttttgactggctggactagttggcctgagatgccaaccgggactcagcggtag

SEQ ID NO: 44341 - DNA, 1320 bp, Artificial Sequence
  Description of Artificial Sequence: Synthetic coding sequence
atgcggtggagcaacctgttcaccagcgagaagggcagcgaccccgataaagaacggaaggcccccgaaaaccacgcagacaccattggcagtgggagggccattcctataaaacagggaatgttgctgaagcgcagcggcaagtggctgaagacttggaagaagaagtacgtgacactttgcagcaatggggttctcacctactattccagtctgggagattatatgaaaaacatccataaaaaggaaattgaccttcaaacctcgaccattaaagttccaggtaagtggccctccctagcaaccagtgcttgtacgcccatctccacttccaagagcaacggactgtctaaagacatggacacaggtctcggagattctatttgctttagtccttcaatcagctccaccacttcaccaaaattgaaccctcctccgagcccgcacgccaataagaaaaagcatctcaagaagaagtctacaaataattttatgattgtctccgctactggccagacttggcacttcgaagcaactacctatgaggagagggacgcctgggttcaagccatccaaagccagatactagcatcgctccagagttgcgagagcagcaagagtaagtcacagctcacatcgcagtctaaggccatggccctgcagagcattcagaacatgagaggcaatgctcactgcgtcgattgcgaaacacagaaccccaagtgggccagtctgaatctcggggtgcttatgtgcatagagtgcagcggcatccatcgctccctcgggactaggctgtcccgggttagaagcctggagttggacgattggccggtcgaactaaggaaagtgatgtccagcattggaaatgacctggcaaacagcatatgggagggtagctctcagggtcaaacaaagccttctgagaaaagcacccgcgaggaaaaggagaggtggatacgcagtaagtatgaagaaaaactctttctggcccccctcccgtgtaccgaattgtcgcttggccagcaacttcttcgggctacggcggatgaggatttacaaacggcaattctgctgctagcccatggatcccgagaggaggttaacgagacatgtggagagggagacggctgcactgcgctgcatctcgcttgtcgcaagggaaatgtcgtattggctcaattattgatatggtatggcgtggatgtaatggcccgcgacgcccacggcaatacagcactcacctacgcaaggcaggcttcctcacaggaatgcataaacgtgctgctacaatacggctgccccgataagtgtgtgtag

SEQ ID NO: 44342 - DNA, 1992 bp, Artificial Sequence
  Description of Artificial Sequence: Synthetic coding sequence
atgggcaacatcctgacctgccgggtgcaccccagcgtgagcctggagttcgatcaacaacaagggtctgtttgtcctagcgagtcggaaatctatgaagctggggcaggcgatcgaatggctggggcccccatggcagccgcagttcagcccgctgaggtgacagtggaagtaggcgaggacctgcacatgcaccacgtgcgagacagagagatgcctgaagcactcgagttcaatccatccgcaaaccccgaggcttcaacaatctttcagcggaacagccagaccgacgtagtcgagatccggcgatcaaactgtactaaccatgtgtcaaccgtcaggttttctcagcagtatagtctgtgctccacaatttttctcgacgattccaccgccatacagcactacctcaccatgactattattagcgtgacccttgagattcctcatcacatcacccagagggacgccgatagaagcttgtctataccagatgagcagcttcactcttttgccgtgtccaccgtccatatcatgaagaaaaggaacggtggtgggagcctgaataattacagcagcagtataccgtccactccgagcacaagccaggaggatccccaatttagcgtacccccaacagctaacaccccgacccctgtgtgtaagcgctccatgcgttggtccaatctgttcaccagtgagaaagggagcgatcccgataaagaaaggaaagcacccgaaaaccatgccgacactatcggttccgggagggctattccaattaaacagggtatgctcctgaaacggtccggcaaatggctgaagacatggaagaagaaatacgtgacgctctgttctaacggggttcttacttactacagcagccttggtgattacatgaagaacatccacaagaaggaaattgacctgcagacttccaccatcaaggtacccggcaaatggccctcccttgctacaagcgcctgtactcctatctccacctcgaagagtaatggactcagtaaagacatggacaccggccttggtgatagtatatgtttttcaccatcaatttcttcgactacttctcccaagctgaaccccccgcctagtccgcacgcaaataagaagaaacacctcaaaaaaaagagcaccaacaactttatgatcgtatctgctaccggacagacttggcattttgaggctacaacctatgaagaaagggatgcgtgggtgcaggccattcagtcacaaatcctggctagcctccagtcctgcgaatcatccaagtctaagtctcagctgacttcccaaagtaaagctatggctctgcagtcaatccaaaatatgagaggaaacgctcactgtgtggactgcgagacccagaatcccaaatgggctagcctgaatctcggcgtcttgatgtgtatcgagtgcagcggcatacacaggtctttggggacccgactctccagagtgcgctcacttgagttagacgattggccagtagagttgcggaaagtgatgagctcaattgggaatgacttggctaatagcatttgggaaggcagcagccagggccagacaaagccatctgagaagagcacccgggaagagaaggaacggtggatccgctccaagtacgaagagaagctattcctggcacccctcccatgcacggagctgtctctcgggcaacagctattaagagctacagctgacgaggacctccagacagcgatcttgttactggctcatgggtcgagggaggaggtaaatgaaacatgcggggagggtgatggttgtactgccctgcatctcgcgtgccgcaagggcaatgtggttctggcacagcttttaatctggtatggcgtagacgtcatggcacgcgacgcgcatggaaacaccgctcttacttacgctcgccaggcttcttctcaagagtgcatcaatgtccttctacagtatggctgtcccgacaaatgcgtttag

SEQ ID NO: 44343 - DNA, 2061 bp, Artificial Sequence
  Description of Artificial Sequence: Synthetic coding sequence
atgggcaacatcctgacctgctgcgtgcaccccagcgtgagcctggaattcgatcagcagcaggggtccgtttgcccctctgaaagcgagatctatgaggcaggtgcgggagatcgcatggccggtgcgccaatggctgccgcggtacaaccggcagaggttacagtggaggtgggtgaggatcttcacatgcaccacatcagggaccaagaaatgccagaggccttagagttcagtctttccgccaatcccgaggcctccactatctttcaacgcaatagccagactgacgccctggagtttaaccccagcgccaacccagaagctagcaccatctttcagagaaactcacaaactgatgttgtcgagatccgcaggagtaattgtacaaaccacgtatccactgaaaggttcagccaacaatatagtagctgtagcacaattttcctggacgacagcactgcatcacagcattatctcacaatgaccattatttcagtgaccctcgagattcctcaccacattactcagagggatgcagaccggtccctttctatccccgacgagcagctgcactctttcgctgtatccaccgtacacatcaccaaaaacagaaatggtggcggatcactgaacaactattcgagctccattccatcgacgccaagcacatcacaggaggatcctcagttctctgtgcctcccacggcgaatactcccactccggtgtgcaaaaggagtatgcggtggtctaatctcttcacgtccgagaaggggagccaccccgacaaggaaaggaaggccccagagaaccacgccgataccatcgggagcgggcgcgccatccccatcaaacagggaatgctgctcaagaggtctggaaaatggcttaagacatggaagaaaaagtacgtaacactgtgcagtaacggcgtgctgacttactacagctctttaggagattatatgaagaacatacacaaaaaggagattgatcttagaacctctaccataaaggtgccgggtaaatggccgtctctcgccacctcggcctgtgcccctatttcttcttcaaagtctaatgggctcagcaaggacatggacaccggcctgggcgattccatttgctttagtccaagtatcagttccactacatcccctaaactaaaccctcccccatcacctcatgctaacaaaaaaaagcaccttaaaaaaaaatccacaaacaatttcatgatcgtgtcagctaccggacagacatggcacttcgaggcaacaacatatgaggagcgcgacgcttgggtgcaggctattcagtctcaaatcctcgcgagtctgcagtcgtgcgagtcaagcaagagtaagagtcagcttacctcccagagtgaggctatggctctccagtctatacagaatatgcgaggtaatgcccattgcgttgattatgagactcaaaacccaaagtgggcaagcctaaatctgggagtcctgatgtgtattgaatgttcgggcatccaccgctctctggggacaagattgagccgcgtacgctcgctcgaactagacgactggccagttgaattaagaaaggtgatgtcctcaatcggcaatgatcttgcaaactcaatctgggaggggagcagccaaggacagacaaagccctcggttaagtctacacgtgaagagaaggaacgctggataagaagtaaatatgaggagaagctgtttctcgcccctttgccttgtacggaactgagtctgggacaacacctacttagagccacggccgatgaagatctgcaaactgcaatcctgctgctggcccacggcagccgcgaggaagtgaacgaaacctgcggggagggggacggctgtaccgctctgcaccttgcatgcagaaaggggaatgtcgtgctcgcccagctattaatctggtatggggttgacgtaatggctcgcgacgcacacggcaacactgccctcacatatgcgaggcaggcaagctcccaggaatgcatcaatgttctgctgcagtatggctgcccagacgagtgtgtatag

SEQ ID NO: 44344 - DNA, 1992 bp, Artificial Sequence
  Description of Artificial Sequence: Synthetic coding sequence
atgggcaacatcctgacctgctgcgtgcaccccagcgtgagcctggaatttgatcagcagcagggcagcgtttgccctagtgaatccgagatttacgaagctggcgcaggcgaccgtatggctggtgcacccatggcggctgccgtgcaaccagcagaagtgactgtagaggtgggagaggacttacacatgcaccacatcagagatcaggagatgccagaggctctggaatttaacccttccgccaaccccgaagcaagcacaatattccagcgcaattcacagacagacgtagtcgagatcagaaggtctaattgcaccaaccatgttagtacggagcggttctctcagcagtactcgtcatgcagcacaatctttctggatgactcaaccgctagccagcattaccttaccatgactattatctcagttaccctcgagatcccccatcacatcacccaaagggatgcggatcgctctttgtccatacccgatgagcagctgcattcttttgccgtgtcaacagtccacattactaagaatcgaaacggtggcgggagcttaaataattactccagctcaatcccttcgactccatcaacctcccaagaggacccccagttcagcgttccgcctaccgccaatactcccacccccgtgtgcaaaaggtccatgaggtggtctaatttatttacttccgaaaaagggtcgcatcccgacaaggaaaggaaagctccagaaaaccacgctgatactatcggttccggaagagccataccaattaaacaaggaatgctgttaaagaggagcggtaagtggttgaagacctggaaaaaaaaatatgtgacgttatgtagcaacggcgtgcttacgtattatagcagcctgggggactacatgaagaatattcacaaaaaagagattgatctccgaacatcaactatcaaagtgcccggaaagtggccttctctggcaacaagcgcctgcgcccctatctcctcttccaagtccaatgggcttagcaaggatatggatactggcctgggcgatagcatctgcttttcgcccagcatttcaagcactacctctcctaaactgaatcctccacctagtccacatgcaaataagaaaaaacaccttaagaaaaaatccacaaacaacttcatgatcgtgtccgctacaggacagacttggcacttcgaggccacaacttacgaagagcgggacgcctgggtccaagctatccagagccagatcttggcatctctgcagtcctgtgagtccagcaagtctaagagccagttgacatcccaaagcgaggccatggctctccagtctatccagaatatgcgcgggaatgcacattgtgtagactacgagactcagaatccaaagtgggcctcccttaacttgggcgtactcatgtgcatcgaatgtagcggcatccaccggagcctcgggacacgtctaagcagggtaagatcactggaactggatgactggccggtcgaactccggaaggtgatgagctccataggcaacgacctggcaaactctatctgggagggctcttcacagggtcagacaaaaccatccgtgaaatcaacacgtgaggaaaaggagcgctggataagatcaaagtacgaagaaaagctcttcctagcacccctcccttgcacagaattatccctaggacagcatctcctcagggcaaccgctgacgaagacctgcagacagctatcttgctgctcgcacacggcagcagggaggaggttaatgaaacatgtggcgaaggagacggctgtacagcgctgcacctcgcttgtaggaagggcaatgtggttttagctcagctcttgatctggtacggcgtggacgtcatggctagagacgcacacggcaatacagccctcacatatgctcgccaggcgagctctcaggagtgcattaacgtgctcctacagtatggatgtcccgatgagtgtgtctag

SEQ ID NO: 44345 - DNA, 2061 bp, Artificial Sequence
  Description of Artificial Sequence: Synthetic coding sequence
atgggcaacatcctgacctgccgggtgcaccccagcgtgagcctggaatttgatcagcaacaggggagtgtttgtccatccgagtccgaaacctacgaggctggcgcccgtgataggatggctggggccccaatggccgcagctgtgcagcccgctgaggtaaccgtggaagtaggggaagacctccatatgcatcacgtgagggatagggaaatgcccgaagccttagaattcaatttatccgctaaccccgagagctctactattttccagcggaatagccagacagaggcgttagaattcaatcccagtgccaatccggaggcttctacgatctttcaaagaaattctcagacagacgttgtggaaattagaagaagcaactgtaccaaccatgtatctgccgtgaggttcagtcagcaatactctctttgttcaacgatcttcctggacgattccaccgccatacagcactatctcacgatgacaatcatctctgtgacactcgaaatcccacaccatatcacgcagagagatgcggatcgcacattgtctatccccgacgaacaactgcactccttcgccgtgtccaccgtccatataatgaagaagcggaatggggggggaagtttgaacaactactcctcgtcgattcctagcacccctagcacttctcaggaggatccacagttttcggtaccccctacagccaatacccccactccagtttgcaaaaggtccatgagatggtcaaatctctttacatcggaaaaggggtccgaccccgacaaggagcgaaaggccccagagaaccacgcggacactattggatctggtcgcgccatcccaattaaacaaggcatgctactgaagcgatcgggaaagtggctgaaaacctggaagaaaaaatatgtaactctgtgttcaaacgggatgttgacatattacagcagcctgggcgactatatgaagaatatccacaagaaagagatcgacctccagacgagcactattaaggtgccaggcaagtggccttccctcgccacgtcagcctgcacccctatctccagcagtaagagcaatgggctcagcaaggacatggataccggcctgggtgactccatctgcttcagtcccagcatcagcagtaccacttctccaaaactgaatcctccgcccagcccccacgctaacaagaaaaagcatcttaagaagaaatctacgaacaacttcatgatcgtatccgctacaggacagacgtggcacttcgaagcaaccacatatgaggaacgggatgcttgggtccaagccattcaatcccagattttggcctccctgcagtcctgtgaaagctcaaagtctaaatcccagctgactagccagtccgaggcaatggcacttcagtccatacagaatatgcgaggaaatgcccattgcgtggattgcgaaacacagaaccctaagtgggcatccctgaatttgggggtgctcatgtgcatcgaatgctcaggaattcatcggtccctagggccccacctgtcacgggttcgttctcttgaactggatgactggccagtcgagcttcgtaaagtaatgagttccatcgtgaacgatcttgccaattccatttgggagggcagctctcaggggcagacaaaacccagcgaaaagtcgacgcgtgaggagaaagagcgatggatccggagcaagtatgaagagaagttgtttctggcgcctctgccctgtacggaactctccctcggccagcagcttcttagggctacggccgacgaggaccttcagaccgccatccttctactagcgcacggaagctgcgaggaggtcaatgagacttgtggcgagggggatgggtgtacagccctgcacttagcgtgtagaaaagggaatgtggtgttggcacagttactaatctggtacggggttgatgtcatggcaagagacgcgcacggcaataccgcattgacatatgcacggcaagcttccagccaggaatgtataaacgttcttttgcagtacggctgtccagacgagtgtgtatag

SEQ ID NO: 44346 - DNA, 1992 bp, Artificial Sequence
  Description of Artificial Sequence: Synthetic coding sequence
atgggcaacatcctgacctgccgggtgcaccccagcgtgagcctggagttcgaccagcaacagggctccgtctgtccttctgaatctgaaacctacgaggccggtgccagggacaggatggcgggtgcccccatggctgccgcggtgcagccggctgaggtgaccgtagaggtcggcgaagatctgcatatgcatcacgtgagagatagggaaatgcccgaagcccttgaatttaatcccagtgcgaaccctgaggcttcaactatttttcaacggaactctcagacggacgtcgtcgagatccggcggtccaattgtacaaaccatgtgtccgctgtgcgcttctcccaacagtactcgctctgtagcaccatttttctcgacgattcgaccgcaattcagcattacctgaccatgactattatttccgtcaccctcgagatccctcaccacatcacacagcgggacgctgatcgcactttgtcaatccctgacgagcaactgcatagcttcgccgtgtccacggtgcatataatgaaaaaaaggaacggcgggggctcattaaacaactattctagctctatcccttctacgcccagcaccagtcaggaagacccccagttcagtgtgcctccaaccgccaacactccaaccccagtgtgcaagcgcagcatgaggtggtcaaatctgtttacctctgagaagggatcggatcccgataaagagcggaaagctccagagaaccacgctgacactatcggatccgggcgggccatccctattaagcaagggatgttgcttaaacgcagcgggaaatggctcaagacatggaaaaagaaatacgttacgctgtgtagtaacggtatgctgacctactactcctcactgggggactacatgaaaaacatacacaaaaaggagattgatctgcaaacctccacaatcaaggtgcccgggaagtggccttccttggcgacttctgcatgtaccccgatctcctcttccaagtccaatgggctttccaaggacatggacaccggactgggagacagcatctgtttcagtccaagcatttcaagcacaacctctcccaaactgaatccccccccttcaccccacgctaataaaaagaaacacttaaagaaaaaatcaaccaataatttcatgattgtgagcgctacaggccagacatggcactttgaagctacaacttacgaagaaagagacgcttgggtccaggccattcaaagccagatcctcgcgtccttgcagagctgcgagagcagcaaaagcaagagccaattgacgagtcagagcgaagccatggcgctccagtccatacagaacatgaggggcaacgctcactgtgtcgactgtgaaactcagaatcccaaatgggccagcctaaacttaggagtgctcatgtgcatagagtgctccggtattcatcggtcactgggcccccacctcagtcgggtccgatccctcgagctagatgattggccagtggagctccgcaaagtgatgtcttctatcgtgaacgatctcgccaattcgatctgggagggatcgtcacagggccagacaaagccaagtgagaaaagcacgcgggaagaaaaagaaagatggataaggtctaaatacgaggagaagctctttctcgcccctctgccttgtactgagttatccctcgggcagcaactgctgcgggccaccgcagatgaggacctgcaaaccgctattctgttgttagctcacggaagctgcgaagaagtgaacgagacgtgcggcgaaggagacggatgcacggcactgcatctggcctgtcggaagggtaacgttgttctggcgcagctcttgatttggtatggggtggacgttatggcacgggatgcacacggcaatactgctctcacctatgccaggcaagcctcttctcaggaatgtatcaatgtgcttcttcaatacgggtgccctgacgagtgcgtctag

SEQ ID NO: 44347 - DNA, 1992 bp, Artificial Sequence
  Description of Artificial Sequence: Synthetic coding sequence
atgggcaacatcctgacctgccgggtgcaccccagcgtgagcctggagttcgatcaacagcagggctccgtgtgccccagcgaatctgagatttacgaagcaggggctgaagatcgcatggctggggctcctatggcagccgcagttcagcccgccgaggtgactgtagaggtgggagaagatttgcatatgcaccatgtcagagatcgagagatgccggaagccctggaatttaacccaagcgccaacccggaggcatcgacgatttttcagcgaaattcgcagacagatgtcgtggaaatacgcaggagcaactgcaccaaccacgtgagcaccgtgcacttcagccagcagtatagtctgtgtagtactattttcctggatgactctactgccattcaacactatctgacgatgactattatctcggtgactcttgaaatccctcatcacatcacacagagagacgctgataggagcctctccattcccgacgagcagctgcacagctttgcagtttccacagttcacatcactaagaaccggaatggcggaggctcactgaacaactatagttctagtattcctagcacccccagtacctctcaagaagatccccagttcagtgttccgccgacagccaacactccgactccagtatgcaagaggagtatgcgatggagcaatctgttcaccagcgagaaggggagtgaccctgacaaagaacgtaaggcaccagagaaccacgccgacaccatagggagcggaagggcaattccaataaagcaaggcatgctcctgaagcgctccgggaaatggctcaaaacctggaagaagaaatatgtcaccctgtgctctaatggtgtactgacgtattactcatctctcggagactacatgaaatatattcataaaaaagagatcgacctgcagaccagtaccatcaaagtcccgggcaagtggccatccttagccacactagcatgtacccccatctcaagctcaaaatctgatggactctccaaggatatggacacagggctcggggatagcatctgtttctcaccatctatttcttcaacgacaatccccaagttgaacccccccccatcacctcatgctaacaaaaaaaagcatctaaaaaagaaaagtacaaacaacttcatgatcgtgagtgccactggccaaacctggcacttcgaagcaaccacatacgaagaacgcgatgcctgggtgcaagctattcagtctcagatattagcatccttacagagttgtgagtctagcaagtcgaagtcacagttaacatctcagagcgaggcaatggcattacagagcatccagaatatgaggggcaatgcccactgtgtggactgcgaaacacagaaccctaagtgggcttccctgaatctgggagtgctcatgtgtattgagtgcagcgggatacaccgctcactgggcacaaggctcagccgagtgcggtccctggagcttgatgactggcccgtggagttgcggaaggtaatgtctagcatcgggaatgacttagccaatagcatctgggaggggtccagccagggccgtacaaagcccaccgagaagtctacgcgtgaagagaaggagcgttggattcggtcgaagtatgaggaaaagctgttccttgctcccctgccctgcaccgagttgagcctcgggcaacaactcttgagggctaccgctgatgaagacctgcagaccgccattctgttgctagcgcacgggtctcgcgaagaagtaaatgagacatgtggagaaggcgacggttgtaccgcattgcacctggcttgccgcaaaggaaacgtagtgctggcacagctgctaatctggtacggcgtggacgtgatggctagagatgcccacggcaatactgccctgacgtatgcacgtcaggcaagcagtcaggaatgtatcaatgtgctcttgcagtacggctgcccagatgagtgcgtgtag

SEQ ID NO: 44348 - DNA, 1320 bp, Artificial Sequence
  Description of Artificial Sequence: Synthetic coding sequence
atgcggtggagcaacctgttcaccagcgagaagggcagcgaccccgataaggagaggaaagccccagaaaatcacgctgacaccatcggttctggccgagcaataccgatcaaacaaggaatgctcctgaagcgttcaggtaagtggttgaagacttggaaaaaaaagtatgtgaccctttgcagcaacggggttctgacttattattcttcactcggagattacatgaagaacatccataagaaagaaattgatttacaaacttccaccatcaaggtgcctgggaagtggccaagcctagccactagcgcttgcactccaattagctcttccaagtcaaatggactgtctaaagacatggatacaggacttggggactcaatttgcttctctccgtcaatctccagcactacatctcctaaactcaaccccccccctagtccccatgccaacaagaagaagcacttaaaaaaaaaatctaccaacaattttatgattgttagtgcgacaggccagacatggcacttcgaagcaactacctacgaggaaagagatgcctgggtgcaggccatccagtcacagatcctcgcctccctccagtcctgcgagtcttccaagagcaaatcccagttgacgagtcagtccgaggccatggccctgcagagtattcagaacatgcgcgggaacgctcattgtgtggattgcgaaactcagaatcctaagtgggccagcttaaacctaggggtcttgatgtgcatcgagtgctctggcatccatcactctttggggaccagactgagccgcgtgcggagtttagagctcgatgattggcccgtggagttgcggaaggttatgtcaagtataggtaacgacttggccaacagcatctgggaaggctccagtcagggacagaccaagccatcagagaagtccacccgagaggagaaggaacgctggatccgtagtaaatacgaggagaagctgtttttggccccactgccctgtacggaactgtctctcggacaacaactgctttgggccacagcggatgaggaccttcagaccgcgatcctgctgctggcacatggcagccgggaagaagtgaatgagacctgtggggagggcgacgggtgtactgccctgcatttagcatgccgtaaagggaatgtcgtgctcgcgcaactgttaatctggtacggcgttgacgttatggcgagggacgcccatggcaataccgcgctgacctatgcccgccaggccagcagtcaggagtgtattaatgtgctgctccaatacggatgtccagatgaatgcgtgtag

SEQ ID NO: 44349 - DNA, 1992 bp, Artificial Sequence
  Description of Artificial Sequence: Synthetic coding sequence
atgggcaacatcctgacctgccgggtgcaccccagcgtgagcctggagtttgatcagcagcagggtagcgtgtgcccttcggagtctgaaatatacgaggcgggcgcaggagatagaatggccggagccccaatggctgccgctgtgcagccggcggaagtcactgttgaagtaggagaggatttgcacatgcaccacgttcgcgatcgagagatgcccgaggccctggagttcaacccctccgccaaccctgaagcatctacaatctttcagagaaatagtcaaacagacgtagtggaaattcgcaggagcaactgcacaaatcacgtttccaccgttcgattttcccagcagtactccctgtgcagcactatcttcttggatgattccaccgccatacagcactatttgaccatgacaatcatctcagtcactctggagatcccgcaccatattactcaacgggatgccgacagatcactctctataccggatgagcagctgcactccttcgcggtcagcactgttcacattatgaaaaagcgcaatggaggcggcagtttgaataactactcgtctagcattcccagtactcctagtacgtcgcaagaagacccacaattctcggtgcctcctaccgcaaatacacccactcccgtttgtaagcgctcaatgcgctggtccaacttgtttacttccgaaaagggatctgaccccgataaggaaaggaaggctccagagaaccacgcagacacgattggtagtggcagggctatcccgatcaagcaagggatgctgctcaagcggagcggcaaatggttgaagacctggaaaaagaagtatgttacactctgcagcaacggagtgctgacttattacagtagcctgggagactacatgaaaaatatccataagaaggaaattgacttacagaccagcaccattaaggtaccaggtaaatggccgtcattagccacgagtgcgtgtactcctatctcctccagcaagtccaacggtctttccaaggacatggatacagggttaggcgatagcatttgcttctccccctcaatctccagtacgacatctcctaaattaaacccccccccaagccctcacgccaacaagaagaagcacctaaaaaagaagtccaccaataattttatgatcgtcagcgccaccggacagacctggcacttcgaggccaccacctatgaggagcgagatgcctgggtgcaggcaattcagagccagatccttgcttctctccagtcctgcgagtcctcgaaatccaaatcccagctgacttcccagagcgaagcgatggctctccagtccatccagaacatgcgcgggaatgcacactgtgtcgactgcgaaactcagaatcccaagtgggctagtctgaacttaggcgtgctgatgtgcattgaatgctctgggatacaccacagtcttgggaccaggttaagccgtgtgaggtcccttgagcttgacgattggccagtggaattacggaaggttatgtcctcaatcggcaatgacctggctaatagtatatgggaaggtagctctcagggacagacaaaacctagcgagaagtcgactagggaggagaaagagcggtggattagaagtaagtacgaagagaagctctttctcgcccctctgccatgcaccgagctcagcctgggccagcagctcctgtgggcgacagctgacgaagacctgcagacggcgatccttttgctagctcacggttcccgcgaagaggtcaacgagacctgcggcgagggcgacggatgtacagccctccacttagcatgtcgcaaaggcaatgtagtcctcgcccaactgctcatatggtatggcgtggatgtcatggcccgcgatgcacatggtaacactgcactcacctacgctcggcaagcttcttctcaagaatgcatcaacgtgctgctccagtacggctgtcctgatgaatgcgtgtag

SEQ ID NO: 44350 - DNA, 1992 bp, Artificial Sequence
  Description of Artificial Sequence: Synthetic coding sequence
gagctgctgcggatcagccccgacctgctggccgccgccgtgatctcagctcaggaggagcctctgactaacatccaacgggcaagcgggccaacgggccttctttggtccgtaagtctggagtttgatcagcagcaggggagcgtgtgcccttctgaatcagagatctacgaggccggggccgaggataggatggccggggccccaatggcagccgccgtacaaccggccgaagtgactgtggaagttggcgaggatcttcacatgcaccaagtgagggatcgagaaatgcccgaagccctggaatttaatttgagcgctaaccccgaagcctcaaccatttttcagagaaattcccagacggatgccttggagttcaattcatctgctaacccagaggccagcaccattttccagcgcaacagccaaacagacgtcgttgagatacggcggagtaactgcacaaaccacgttagtactgaacgctttagccagcagtactcttcttgctccactatcttcctggatgactctacagctattcagcactacctgacaatgactattatcagtgtcacactcgaaatccctcaccacatcacccagcgagatgcagacaggtccctttccatccccgatgagcagttacattccttcgctgtatccacagtgcatatcatgaagaagcggaacggagggggttcccttaacaattattcttcttccattcccccaacccccagtacatctcaggaggatccccagttcagtgttcctcctactgctaacacccctacccctgtttgcaagcgaagcatgagatggtcaaatctatttacctctgaaaagggctccgaccctgataaagagaggaaggcaccggaaaaccacgccgacaccataggtagcgggcgggcaatccctattaagcaaggaatgctgctcaaaaggtctggtaaatggctcaagacgtggaagaaaaagtatgttacactgtgctctaacggtgtcctcacctactactcatctttgggcgactatatgaagaacattcataagaaagaaatagatctccggaccagtaccatcaaagtgcctgggaaatggcctagcctggctacttctgcttgtgcccctatctcttccagcaagtccaacggcttgtcaaaggacatggatacaggcctcggcgattcgatttgcttcagccccggcataagcagcactaccagtccaaaactgaaccctccgcctagtccccatgcgaacaagaaaaagcatctgaagaaaaagagtacaaacaacttcatgattgtctcagccacgggccagacttggcactttgaggcgacgacctacgaggaaagggatgcatgggtgcaagcgattcagtctcaaagcgaagcaatggctttgcagtccattcagaacatgagaggaaatgcacattgtgtagactgcgagacacagaatcctaaatgggcctccttgaacctcggcgtcctgatgtgtattgaatgctctgggatacacaggtccttcggcacccgactaagccgagtgaggtctcttgagttggatgactggccagtggaactacgaaaagtgatgtcctcaattgggaacgagctcgctaactctatttgggagggctcctcccaggggcagacaaagccctccataaagtcaactagagaagagaaggagtggtggattcgaagtaaatatgaggagaaattgtttctggcacctctgccctgtacagagttatcgcttggtcaacagcttcttagggctacaaccgacgaagacctccagaccgccattcttcttctggctcatggcagccgggaggaagtcaacgaaacatgtggggagggagatggttgcacagcgctgcacctcgcatgtcggaagggtaacgttgtgctggaacagttgctgacgggatggaccagttggccagagatgcccaccggaacacaaagatag

SEQ ID NO: 44351 - DNA, 1047 bp, Artificial Sequence
  Description of Artificial Sequence: Synthetic coding sequence
tgagccgaggaccggatggccggcgcccccatggccgccgccgtgcagcctgctgaggtcacggttgaggtaggagaggatctgcatatgcaccaggtccgcgacagagagatgcctgaagcgctggaatttaatctgtctgccaacccagaagcttcgacaatattccagagaaatagccaaacagacgcacttgaattcaactcctccgccaatcccgaggcctctaccatctttcagcgcaactcacagaccgacgttgtggaaatccgacgctcaaattgtactaatcatgtctctacggagaggttttcccaacagtacagttcctgttccactatctttctggacgactctactgccatccaacattatctgacaatgaccattattagcgtgacactcgagattcctcaccacatcacacagcgcgatgcagaccggtcactgtccataccagacgagcaactccactcatttgccgtgagcaccgtgcacattatgaaaaaacggaacggcggaggtagtctgaacaattactcttccagtatcccgcctactccatccacaagccaggaggacccccagttcagtgtccctccaaccgccaacactcctacgccagtgtgcaaacgaagtatgagatggagtaatctattcacttccgaaaaaggcagcgaccctgacaaagagagaaaggcccccgagaatcacgctgatactatcgggagcggcagagccatccctatcaaacagggtatgctgctgaagaggtcagggaagtggctaaaaacctggaagaaaaaatacgtcaccctatgctcaaatggcgttctgacgtactacagctcgctaggcgactacatgaagaacattcacaaaaaggagattgatctgcgcacatccaccattaaggtgcccggcaaatggcccagcctggccacttcggcgtgtgcacctatcagcagctcgaaatccaacggactgtccaaagacatggataccggcctgggtgacagtatttgctttagccctgggatctcgtag

SEQ ID NO: 44352 - DNA, 2112 bp, Artificial Sequence
  Description of Artificial Sequence: Synthetic coding sequence
atgttcgaggacgtgttcagcgacagcggcaacaccggcaacttcgatcggggtaaaaagcgaaggttgactatcatcgagtgcggatgtgacatcaacatgatgattgatcttgctaaggtcgcggatctggtgctgatgttgatcgacgcctcgttcggcttcgaaatggagatgtttgagttcttaaatatctgtcaggcccacggctttcccaagatcctaggtgtcttaacacacctcgattccttcaagcacaataaacagttaaaaaaaactaagaaacgcctcaagcaccgcttctggacagaagtgtatcaggataaagtaggcctgacccacgaacttgtacagtcgctcatctcaacctacagcaccattgatgccaagatggcatcttcacgggtgacgttactatcgaactcaaaaccgttaggctcagaagccatcgataatcagggggtgagcctcgaattcgatcagcagcaaggatccgtgtgcccttctgaaagcgagatctatgaagctggcgccgaagataggatggccggtgcccccatggctgccgcagttcagcctgcggaggtcactgttgaggtaggagaggatcttcatatgcaccaagtgcgagatcgggaaatgccggaagtcgtagaaataaggagatccaactgtaccaatcactgtgacctgggagataccagttcataccacacgaaggtgtctacggtccatatcatgaaaaaacggaatggaggaggtagtttaaataattattcgtcaagcatcccaccaacccctagtaccagccaagaggatccacaattcagcgtgccaccaaccgccaacacgcccacaccagtttgcaagagatccatgagatggagcaatcttttcacttccgaaaaaggttccgacccggacaaagaaaggaaagctccagagaatcacgcagacacgattgggagcggtagggccatcccaataaaacaggggatgctgttaaaacggtctggaaaatggttgaagacttggaaaaagaaatacgtgactctttgcagcaacggcgtgttgacctattactccagcctgggagactatatgaaaaatatccataagaaggagatagatctgaggacttccaccattaaggtgccaggaaagtggcccagcctcgccactagtgcgtgtgcccctattagctcctcaaagtcaaacgggctgagcaaagacatggataccggcttaggagatagcatctgtttctctccaggtatcagctcgacaactagcccaaaactgaatccacctcccagcccccacgccaataagaaaaagcacctgaagaaaaaatcgacaaataacttcatgattgtcagcgccacaggtcaaacatggcacttcgaagccacaacatacgaggagcgcgatgcttgggtgcaggcaatccagagccagatcctggccagcctgcagagctgtaagtcgtctaaatctaaatcccaactcaccagccagagcgaagctatggccttgcagtcaattcagaatatgagaggtaacgcccactgcgtcgactgtgagacgcagaatccaaagtgggcatcactgaatttaggagtattgatgtgcatagaatgctccgggattcatagatcctttggaacccgcctttcccgagtgcggtctttagagctggacgactggccggtcgaactgagaaaggtgatgtcctctattggaaacgagttagccaatagcatttgggaaggctccagccagggtcagactaaacccagtatcaagtccacgagagaggaaaaagaatggtggattcggagtaagtatgaagagaaattgttcctggcaccgctcccctgtaccgagctctctttgggacagcagctgctgcgggctactacagatgaggacctgcaaacagccatccttctcttggcccatggaagtagggaggaggtgaacgaaacctgcggagagggcgacggatgtacggcactccatctggcttgtcgcaaaggcaacgtcgtgctcgagcaactcctgacaggctggacaagctggcccgaaatgcccaccggaactcagcggtag

SEQ ID NO: 44353 - DNA, 1977 bp, Artificial Sequence
  Description of Artificial Sequence: Synthetic coding sequence
atgggcaacatcctgacctgccgggtgcaccccagcgtgagcctggagtttgatcaacagcaaggatccgtgtgcccatccgaaagcgagatctatgaagctggtgcagaggaccggatggccggagctcccatggccgccgcagtccaacccgcagaggttactgtcgaagtgggggaagaccttcacatgcaccaggtgagggatcgagaaatgcccgaggctctcgagtttaatctgtctgccaaccccgaggcatctaccatttttcaacggaattctcagacagatgcgcttgagtttaatagctccgccaaccccgaggcatccacaatcttccagcggaatagccagaccgacgtggtcgagattcgccgatcgaactgcactaaccatgtttctactgaaagattctcccagcagtattccagctgcagcacaatattccttgacgattccaccgcaatacagcactacctgaccatgacaatcattagcgtcaccctcgaaattccgcaccacatcactcaacgggatgcagatcgctccctgtcaattcctgacgaacaattacactcctttgccgtctccacggttcacataatgaaaaaaagaaatgggggcgggagcctcaataactattccagctcgattccgcccacaccgtccacgagccaggaagatccccagttctcagttccaccaaccgccaacacgcccactcccgtgtgcaaacggtcgatgcgatggagcaacttgtttacctctgaaaaaggctccgaccccgataaagaacggaaggctcccgagaatcatgcagacaccatcggcagtggtcgggctattcccatcaagcaaggcatgctgctaaaacgcagcggcaaatggctgaagacttggaaaaagaagtacgttactctatgtagcaatggggttctgacatattattcttctcttggtgattatatgaagaacattcacaagaaggaaattgatttgagaacgagcaccatcaaagtccctggcaaatggccctccctcgcgacatctgcctgtgcacccatctctagttccaagagcaatggactgtccaaagacatggatactggcctgggtgatagcatttgtttctctcccggaatttcttccaccacgagcccgaagttaaatccccccccaagtccccacgcaaataaaaagaagcatttaaagaagaaatcaaccaataatttcatgatcgtgtctgcgaccggccagacttggcatttcgaagctacgacctacgaggagagggatgcatgggtgcaggctattcagagtcaaatcctcgccagcctgcagtcatgtaaatctagcaagtccaaatcacagcttacctcacagagtgaagcgatggcactgcaaagcatacaaaacatgcggggcaatgctcactgcgtcgattgtgagacccagaaccctaagtgggctagcctgaatcttggggtgctgatgtgcattgagtgcagtgggatccaccgcagctttggcacaagattatctagagtcagatctctggaactggacgactggccagtagaactgcgaaaagttatgtccagtataggtaacgagctggccaattctatttgggaggggtcatcgcagggccagacaaagccgtccattaagagtaccagagaagaaaaggagtggtggatacgttccaaatatgaagagaagctctttctggcaccactgccatgtaccgagcttagcctgggacagcaactcttacgcgccacaacggacgaagacctacagacagcaatccttttactcgcacacgggtctagggaggaagttaatgagacatgtggcgaaggcgatggctgtaccgccctccacctagcctgtcggaaaggaaatgtcgttctcgagcagctgttaacgggctggacatcttggcccgaaatgccaacaggaacacagcgatag

SEQ ID NO: 44354 - DNA, 4635 bp, Artificial Sequence
  Description of Artificial Sequence: Synthetic coding sequence
atggccgccccccaggacctggacatcgccgtgtggctggccaccgtgcatcttgaacagtatgctgatacgttccgcagacacggactggcaaccgccggagctgcacgagggctaggacacgaggagctcaaacaactggggatcagcgccacaggtcatcgtaaacggatcctcaggcttctgcagaccggaaccgaggagggaagtctggaccccaaaagtgactctgcgatggagccctccccctccccagcaccccaggcccagcccccaaaacctgtccccaagcctcggactgtgttcgggggccttagtggtcccgcaaccacacaaaggcccggactgtctccagctttgggcgggcctggagtctcccggtcccctgagccaagccctaggccgccccctctacccacctcttcctccgaacaaagcagtgccctcaatacagtagaaatgatgcccaattccatttactttggactcgactcccgtggcagggcccaagcagcccaggataaggcccctgattccagccagattagtgctcctaccccggctcttagacctactacagggacagtccatatcatggaccccggttgtttgtactatggagttcagcccgtggggacccctggggcacccgatcgccgcgaaagccgcggtgtgtgtcagggccgggcggagcacagactatctaggcaggacttggaagctagggaggacgcgggatatgcgtccctagaactgccaggcgactcaaccctgctctctccaactctagagacggaggaaacatcagacgatctgatctctccatacgcctcattcagcttcacggccgatcggttgactcctctactgtctggctggctggacaaactgtcacctcagggcaattacgtgtttcagcgacgcttcgttcagttcaacggcaggagcctgatgtactttgggtccgataaagacccattcccaaaaggagtaattcctttaaccgccattgaaatgactcgcagctccaaggataacaagttccaagttattactggccaacgcgtatttgttttcagaaccgagagcgaggcccagagagacatgtggtgttccacgctgcagtcctgcttgaaggagcagaggctgctgggccatccacgcccaccacaaccgcctcgacccctaagaacaggcatgcttgagttgagggggcacaaagctaaggtgtttgcggctctgtcccctggcgaactggctctgtacaaatccgaacaggctttttcccttggtataggcatttgctttatagagctccagggatgttccgtcagggagactaagtctcggtcattcgatctcctgacccctcaccggtgctttagtttcacagccgagtctggcggtgcccgacagagttgggctgctgccctgcaggaggctgtcacggagacattaagcgattacgaggtggccgaaaagatttggagtaatagggcaaatcgccagtgcgcagattgtgggtctagccggccagactgggccgcagtgaacctgggagtggttatctgcaaacagtgcgctgggcagcatcgcgcactgggcagtgggattagtaaagttcagtctctgaagctcgatacgagtgtgtggtccaacgagattgtccagctgttcatagtgctgggcaacgaccgggccaatcgattttgggctggtacactgcctccgggggaggggttacaccctgacgcaactccgggcccacgcggtgagttcatttcaaggaaatatcggctaggattgttcaggaagccccatcctcaatacccagatcatagccagctgttgcaagctctatgcgctgctgtggcccggcccaatttgctgaaaaacatgacccaactactctgcgttgaggcattcgaaggagaggagccatggttccctccggcgcccgacggcagttgtcctggcctgttgccaagcgacccgtccccaggagtgtacaatgaggtggtggtccgcgcaacttatagtggattcttatactgttctccagtaagcaacaaggccggaccctcaccacccaggagaggccgagacgcccctccgaggctttggtgcgtgctgggagctgcactcgaaatgtttgccagcgaaaatagccctgagccactcagtctgatccagccccaggacatcgtttgcctgggagtctcgcccccacctaccgacccgggcgacaggttccctttttcttttgaattgattttggccggcgggcgaatccaacatttcggcaccgatggtgctgacagccttgaggcgtggacatcagctgtcgggaaatggtttagcccattgtcatgtcaccagttgttgggacccggactgctgagactgggacggctctggttgcgcagcccatctcacaccgcgcccgctcctgggctgtggttatcggggtttgggttactcaggggcgatcacctgttcctttgtagcgctcctggtccagggccacctgcccctgaggacatggtgcacctgaggcgcctccaggaaatctctgtggtctcagccgctgataccccagataagaaggagcacctggtgctggtagagacagggcgcactctgtatctgcaaggagagggtaggttggatttcacagcatggaacgctgcaatcggaggtgccgcgggagggggcggaacagggctgcaggagcagcagatgagtcggggggatattcccatcatagtcgacgcatgtatcagttttgtcactcagcacgggctgcgcctggagggcgtgtatagaaagggcggcgcccgcgcgcgtagcctccggttgctcgccgagttccggcgcgacgctcgcagtgtgaagctgagacctggcgaacatttcgttgaagatgtaacggacaccctaaaacgattttttcgagaactcgacgacccggtcacatctgcacggctgctgccgcggtggcgtgaggctgcggaactccctcagaagaaccaaagactggagaagtacaaggatgttatcggctgtctgccaagggtcaaccgtagaactctcgccacgttgatcggccacctgtatagggtccaaaaatgcgccgccttaaaccaaatgtgcacacgtaacttggctctcctgtttgcaccatctgtgtttcagaccgacgggagaggggagcacgaggtccgtgtcttgcaggaactcatcgatggctacatatcagtttttgatatcgattccgaccaagttgctcagatcgacctggaggtctcactgattacaacttggaaggacgtacagctgtcgcaagcaggtgatctgataatggaggtctatatcgagcagcaactccccgacaactgcgttacactcaaggtaagcccgaccctgaccgccgaagagctcaccaaccaggtcctggagatgaggggtacagcagcgggcatggatctgtgggtgacctttgaaattcgagaacacggagaactagaacggccactccaccctaaggaaaaggtccttgagcaggctttgcagtggtgtcagttaccagaaccatgttcggcttccctgttgttaaagaaggtaccacttgcccaagcaggttgcctgtttactgggatccgcagagaatctcctcgggtaggcctcctacggtgccgcgaggagccaccccggttgctagggtcacggtttcaagagcgctttttcctcttacgcggacgttgccttctcctgctgaaagagaaaaaaagtagtaagccagagcgcgagtggccgctcgagggcgccaaggtctacttgggcatacgcaagaagcttaagcctcctacaccttggggcttcacattgattctggaaaagatgcatttgtatctgagctgtacagatgaggacgagatgtgggattggacaacatcaattcttaaagcacaacatgatgatcagcagcccgttgtgctaagaagacattcgtcatcggatctggcccgccagaaattcggcacaatgcctctcttgcctatacggggagatgacagcggagcgaccctgttaagtgctaaccaaacactcagacggttgcacaaccggaggactctaagcatgtttttccccatgaaaagctctcagggctctgttgaggagcaggaggagctggaggaaccagtttatgaagaaccagtctacgaggaagtgggagctttcccggaactgattcaggatacctctacttcattttctaccacccgcgaatggactgtgaagccggagaaccctctcacttctcagaagagtctagatcagcctttcctttccaaatcaagcacgctgggccaggaggaaagaccccctgaacctcccccaggaccaccatcaaaatctagccctcaggcccgggggtctttagaggaacagctcctacaggaattgtccagcctgattctgaggaagggtgaaacgacggcagggttgggctcccccagtcagccaagcagcccccagtccccatcacctacgggcctacctactcagacacccggttttcccacccagccaccatgtacaagcagccctccttcatcacaaccccttacctag

SEQ ID NO: 44355 - DNA, 1422 bp, Artificial Sequence
  Description of Artificial Sequence: Synthetic coding sequence
atggccgccccccaggacctggacatcgccgtgtggctggccaccgttcatctcgagcagtatgctgacacattccggcgacacgggctcgctaccgcaggagccgcccggggcctgggacacgaggagctcaagcagcttgggatctccgctacaggccatcgtaagcgaattttgcgcttactgcagacggggacagaagaagggtccctggatccaaagagtgattccgcaatggagccctccccatcacccgctccccaggcacagccaccgaagccagtacctaagccccgcaccgtgtttggtgggttgagtggcccggccacaacccagagaccaggcctgtctcccgctttgggcggcccgggagtgtctcgcagccccgagccatccccacgcccaccacccctgcccacttcctcttcagagcagtcttctgcgttaaatacagtggagatgatgcccaacagcatctatttcgggcttgacagcagagggcgcgcccaggctgcccaggataaagcgcctgactcaagtcaaatttccgcgcctaccccggccctaaggcccaccactggcacagtccatattatggacccggggtgcctgtattacggcgtgcagccggttgggacaccgggtgcaccagatagacgcgagtcccgcggagtgtgtcaaggtcgagcagagcaccgcctttcccgccaggatcttgaggctcgagaggatgccggatacgccagcctggagctgccaggcgactctaccctgctgtcaccaacccttgagaccgaggagacttccgatgacctgatctccccctacgcgagtttttccttcacagcagatcggctgacacccctactgagtggctggctcgataagctgagcccgcagggcaactatgtattccaacggcgtttcgtgcagtttaatgggcgaagcctcatgtacttcggatccgataaggacccttttccaaagggggtaataccacttactgccattgagatgacgaggtcttccaaagacaacaagtttcaggtgattacaggccagagggtcttcgtgtttcggacagaatccgaagcccagcgggacatgtggtgctctacattacagtcctgtctgaaggagcagcgtctgctgggtcacccgcggcctcctcagccgccaagaccactgcggacaggcatgttggagcttcggggtcacaaagccaaggtcttcgcagctctctctccaggagaactggccctctacaagagcgaacaagcgttcagcctcggcataggaatctgtttcattgagctccagggctgtagcgtgagggagaccaaatcccggtctttcgacctgcttacaccccacagatgtttcagcttcactgccgaatctgggggcgcccgccagagctag

SEQ ID NO: 44356 - DNA, 4128 bp, Artificial Sequence
  Description of Artificial Sequence: Synthetic coding sequence
atggagcccagccccagccccgccccccaggcccagccccccaagcctgtcccaaaaccaaggaccgtgtttgggggattgagcgggccagccacaacacaacggcctggactttccccagcactcggaggtccaggcgtcagtaggtcccctgaaccctcccctaggccaccacccctgcccacaagttcgtctgaacagtcttccgcattgaacactgtggagatgatgcccaattctatctatttcggcttagacagccggggcagggctcaggccgcccaagataaggctcccgactcctcgcagatctccgcacccactcctgctctgagaccaacgaccgggaccgttcatattatggaccccggatgcctgtactacggagtccagccagtgggcacccctggggcccccgacaggagggaaagtaggggcgtgtgccagggccgcgcagaacacaggctgtccagacaggacctggaggcaagagaagatgccggctacgcatctttagaattaccgggagacagtaccctgctgagtcctacacttgagacagaggaaacttccgacgatcttatctccccgtatgcttctttttcatttactgccgacaggctgactccactcttaagcggatggctggacaaattatcccctcagggcaactacgtcttccagcgtcgctttgtccagtttaacggcaggtccctcatgtacttcggcagcgacaaggatccctttcctaagggagttataccactgaccgccattgagatgacccgaagctctaaagacaacaagttccaggttatcactggacagcgcgtcttcgtgtttaggacagagagcgaagcccagcgtgatatgtggtgttcaacactgcagagctgcctgaaggagcaacggctgctcgggcatccgaggccgccacagcctccccggcccctccgcacggggatgctggagcttcgggggcacaaggcaaaggtgtttgccgccctaagccctggtgagctggcgttatataagtcagagcaggcctttagtctcgggatcggtatttgtttcatcgagctgcaggggtgttctgtgcgagagaccaagagccgcagtttcgatcttttgaccccccatagatgcttctcttttaccgccgagtccggcggggcacggcagtcctgggccgccgctctccaggaggcagttaccgagacactgtccgattatgaagtcgccgagaagatctggtcaaacagggctaatcgccagtgcgctgactgcgggagtagcaggccagactgggccgcagtcaacctgggcgtggtcatctgcaagcagtgcgcggggcagcaccgcgcgcttgggtcggggataagtaaagtgcaaagcctgaagctggacacatcagtgtggtccaatgagatcgttcagctgtttatagtgctgggcaacgaccgggcaaataggttttgggcaggcacattacccccaggtgaaggactacatcctgacgccaccccgggccctagaggggaattcatcagtcggaaataccgcttaggtttgtttcgaaagccccacccccagtacccagatcatagtcagctgctgcaggcattatgcgcagctgtagctagacctaacctgctgaaaaatatgactcagctcctgtgcgttgaggcattcgaggatccctccccaggagtgtacaatgaggtagtggttagggccacgtactctggcttcctttactgcagtccagtcagcaataaggccgggcctagcccgccaaggcgtggtcgggatgctcccccccggctgtggtgcgtcctaggggccgccctcgagatgtttgcaagcgagaacagccccgagcccttgtcactcattcaaccccaggatatcgtctgtctgggcgtgagtccgcctcccaccgatccgggtgaccggttcccctttagcttcgagcttattcttgccggcggacgcatacagcactttggtaccgatggagcagattccctggaggcctggacatctgcggtagggaagtggttctccccccttagctgccaccagctcttgggcccaggcttactccgattggggcggttgtggttgagatctccgtcacatacagctccagcccccggcctgtggcttagcggctttggcttgctgcgaggggatcatctatttctgtgttcggccccaggcccaggtccccccgcccccgaagatatggttcacctccgcagactccaggaaatctcagtggtgtccgccgccgacacccctgataaaaaggaacacctggttctagttgaaactggtcgaactctctacctccaaggtgagggaagattggacttcaccgcttggaacgccgccatcggtggagccgccggaggcggtggcactgggctacaggagcagcaaatgtcccgaggagacatcccaatcatagtggatgcatgcatctcatttgtcacccagcacgagctgccacagaagaatcagaggctagaaaaatataaggacgtgattggctgccttccacgagtgaatagacggaccctagctaccctgattgggcacctatacagagtgcaaaagtgtgccgcgttaaatcagatgtgtactcggaatttggcactgttgttcgcccctagcgttttccagaccgatgggaggggtgaacacgaggtgagagtactgcaggaattgattgatgggtacatttcggtgttcgatatcgacagcgatcaggtggcacaaatcgatttagaggtcagtctcataactacatggaaggatgtacaactctctcaggctggggatctcataatggaagtgtatatcgagcagcagctgcctgacaactgcgtgacactcaaggtcagtccgaccctgacggcagaagagctgactaaccaagtgctcgagatgcgcgggactgctgcgggcatggacctctgggtcactttcgaaataagagagcatggcgagttggagcgacctctgcatccgaaggaaaaggttcttgaacaagccctgcagtggtgccagttgcctgagccctgctcagcatctctgcttctcaagaaggttcctctcgcccaggcaggttgcttgtttacagggattcgtagagagtctccccgcgtgggtttactgcgctgtcgtgaggagccccctcgtttgctggggtcacgcttccaagaaaggttctttctgctacgtgggcggtgcttactgctcctgaaagagaagaagtcctcaaagcccgagagagagtggcctctcgagggcgcgaaggtctaccttggaatccggaagaagttgaaaccacccaccccatggggattcacgctgatattagagaagatgcatctttacctgtcttgtacagacgaagatgaaatgtgggactggacaaccagtatcctgaaagcccagcacgacgatcaacagcctgtcgtgctccgcaggcattcctcaagcgacctcgcccgtcaaaagtttggtacaatgccactgctgccgatcaggggagacgactctggagctactctgctgtctgcaaatcagaccctccggcgcttgcacaatcgcagaacactctcgatgtttttcccaatgaagtcttctcaggggtccgtcgaagagcaggaggagttagaagaaccggtctacgaggaacccgtgtacgaggaggtcggagccttccctgagctaattcaggatacctctactagcttctccacaacaagggagtggacggtgaagcccgaaaaccccctaacatcccagaagtctctggaccagccatttctgagcaagtcaagcaccctaggccaggaggagcggcccccagagcctcccccgggaccccctagtaagtcgagcccccaggcccggggctctctggaagagcagctactgcaggaactctctagtctgattctcaggaagggagagaccacagccggcctgggttcccctagccaacccagctcaccccaatcacccagtcccacaggactgccaacacagacgccagggttcccaacacagcccccttgtacctccagtccaccctcatcccaacctctgacatag

SEQ ID NO: 44357 - DNA, 3582 bp, Artificial Sequence
  Description of Artificial Sequence: Synthetic coding sequence
atgacccggagcagcaaggacaacaagttccaggtgatcaccggccagagagtgtttgttttccgcacggagtccgaagctcagagagacatgtggtgttctacgctgcaaagctgcctcaaggaacaacgtttgttgggccaccctcgtccccctcaacctccacggcccctgcggaccggaatgcttgaactcaggggccacaaggctaaagtctttgccgcgctcagcccgggtgagctcgccctttacaagtccgagcaagcattcagtctcgggattggtatctgtttcatcgaactgcaaggctgcagtgtgagggagactaagagcaggtctttcgacctcctcacccctcatagatgcttctcctttacagctgagagtggaggtgcccgccagagttgggccgcggccctgcaagaggccgtcacggaaaccctgtctgactacgaggttgctgaaaaaatctggagcaaccgcgccaatcggcagtgcgctgactgtggcagctccagacccgattgggcggctgtgaacctgggagtggtgatctgcaaacagtgcgctggacaacatcgggcattgggcagtggcatcagtaaagtccagagcctgaaactggatacatctgtgtggagtaacgagattgtacagctgttcatcgtgctcggcaacgatagggccaatcgattttgggccggcacgctgccgcccggagagggtttacaccctgatgcaactccaggtccacgtggtgagttcatatctaggaaatatcgcctgggtctgttcagaaaaccccacccccaatatccagatcatagtcagttgcttcaagcactgtgtgccgccgtggcgcggcccaacctgcttaagaacatgacacagctactgtgtgtggaagcttttgaaggcgaggaaccttggttccctccggcacctgatggctcctgtccaggactccttccatccgacccatcaccaggagtgtacaatgaagtggtcgtgcgcgccacctattccgggttcctgtactgctcccctgtgtctaacaaggccggcccgagtcctccgcggagaggaagagacgctccccctagactgtggtgtgtactaggcgccgcactggaaatgttcgcgtctgagaattcccctgagcccctcagtttgatacagccccaggatatagtgtgtttaggagtttctcccccccccaccgatcctggcgatagatttcccttctcgtttgagttgatccttgctgggggtcgcatacagcactttggaactgatggcgccgacagtctggaagcctggacaagtgccgtggggaaatggttctccccgctttcatgtcaccagcttctcggacctggactgctgcggctcggacgactgtggctgcggagtccgagtcataccgccccggctccagggttgtggctgtccggatttgggctgctccgaggggaccacttgttcctttgcagcgctccgggcccaggacctccagctccggaggacatggtgcacctgcggaggctgcaggaaatttcggtggtgagcgccgcagatactcccgacaaaaaagagcacctggtgctggtcgagacaggacgcaccctttacctgcagggggaggggcgccttgacttcaccgcctggaacgccgccatcggaggtgccgcgggcgggggaggcaccgggttacaggagcagcagatgagcagaggggacatccctattatcgtcgacgcctgtatctcttttgtcacacaacatggccttaggctcgagggcgtttatcggaaggggggggccagggctcgcagccttaggcttctggccgagtttagacgcgatgccaggagcgttaaacttcggcccggtgagcatttcgtggaagacgttactgatactctcaaaaggttttttagggagctggatgaccctgttacctcagcccgtctcctgccgaggtggagggaggccgccgaactgccgcaaaagaatcagcggctggagaaatacaaggacgtaattggctgcctgccccgagttaacagacggaccttagcaacacttattggtcacctgtacagggtacagaagtgtgctgccctgaatcagatgtgcactcgaaacctggccctgctcttcgcaccatcagtatttcagactgatggacgcggtgagcacgaggtgcgggtgttgcaggaactgatcgatggctacatctcagtattcgacattgacagtgatcaggtggcccagattgatctggaggtgagcttgattactacctggaaagacgtgcagctctcccaagccggagacctgattatggaagtgtacatcgaacagcagctgcctgacaattgtgtcaccctcaaggtttcaccaaccctgaccgctgaggaattaaccaatcaggtccttgagatgaggggaaccgctgcgggaatggatctctgggtcaccttcgagattcgagaacacggggagctcgagcggcctctgcaccccaaagagaaagtgctcgaacaggcactacagtggtgtcagctgcctgagccgtgttctgcgtccctcttgctcaagaaggtgcccctcgcccaagccgggtgtctctttacggggatccgccgcgagtccccccgggtgggactccttcggtgcagagaggagccccctaggttgctgggatccagatttcaggagcggttttttctcctgaggggcaggtgtcttttattattgaaagaaaagaaatcctcaaagcccgagcgcgaatggcccttggagggagccaaagtgtacctggggattcgaaagaaactgaaaccccccacgccatggggctttaccttaatattggaaaagatgcatttatatctgtcatgcacggacgaagacgagatgtgggactggactacatccattttaaaggcccagcatgatgaccagcagccagtagttctccgcagacactccagtagcgacttagctcggcagaagttcggtactatgcctctacttcctattcggggcgatgacagcggcgcaacactgttgagtgctaaccagaccttacccatgaagtccagccagggctccgtggaagaacaggaagaattggaggaaccagtttatgaggagccagtttacgaggaggtgggcgcatttccagagttgatacaggacacatccacttctttctccaccactagagaatggactgtgaagcctgaaaaccccctgacctcccaaaaatcactggaccagccctttctgtccaaaagcagcaccctggggcaagaagagcggccgcccgaacccccacctggcccaccaagcaagtccagtccgcaggctcggggaagcctcgaggagcagctgttacaggagctgagttcccttatccttaggaagggagaaacgaccgctggcctgggctccccctcgcagccctctagtcctcaatcaccgtcccctaccggtctccctacccagacgccaggctttcccacccaacccccatgcaccagttcccctccatcatcacagccacttacctag

SEQ ID NO: 44358 - DNA, 1116 bp, Artificial Sequence
  Description of Artificial Sequence: Synthetic coding sequence
atgctgatggccagcaccaccagcgccgtgcccggccaccccagcctgccttcactgccgagtaatagcagccaagaacgccctctggacacgagagatcccctgttagctcgagccgagctggcgctgttgagtattgtgttcgtcgctgttgcactctctaatggtcttgtccttgctgccctggcccgaaggggaagaagaggacattgggctcccatccatgtgtttatcggccacctgtgcctggccgatctggctgtggccctctttcaagtcctaccacaactggcgtggaaggcaaccgaccgatttaggggcccggacgccctgtgtcgtgccgtgaaatacttacagatggtgggaatgtacgcttctagttatatgattttggcgatgacgctcgaccggcatcgagccatatgcaggcctatgcttgcatacagacacggaagtggggcccattggaatagacctgtgctggttgcctgggcattcagcctgctgctgtcgttacctcagctgttcatttttgctcagcgtaatgtggaggggggctctggcgtgacagactgttgggcttgttttgcagagccctggggacggcgcacctatgttacatggatagcgctaatggtgttcgtggcgcctacattggggattgctgcctgccaggtcctgatctttagggagattcacgccagtttagtcccaggccctagcgagagacccggtgggcggcgtcgcgggaggcgcaccggatctccgggcgagggggcccacgtttctgccgctgttgctaaaactgtgaggatgaccctcgtgatcgtcgtggtatatgtgctctgttgggctccgttttttttggtgcagttgtgggctgcctgggacccagaagcgcctcttgagggagcacctttcgtgctgctcatgttacttgctagtctcaacagctgcacaaacccatggatctacgcatcatttagcagctccgtatcaagtgagttaagaagccttctgtgttgtgcacggggaagaacgcccccatccttaggtccacaggatgagagctgcaccaccgcttcttctagcctggcaaaggatacgtctagttag

SEQ ID NO: 44359 - DNA, 444 bp, Artificial Sequence
  Description of Artificial Sequence: Synthetic coding sequence
atgggcacccccgccagcgtggtgagcgagccccccccctggcaggcccccatcgaagctcggggaagaaaacaagcttctgccaacatttttcaggacgctgagcttctccagattcaggctctttttcagcggtcaggagaccagttagccgaagagagggcacaaattatttgggagtgtgccggtgatcatcgggtggcggaagccttgaagcgactgcggcggaaaaggccccctcgtcagaaacccctgggccattcccttcatcattgttcgaggttaagaatcctggaacctcattcagcgctggcaaacccccagagtgccactgagacagcttcatccgaacagtaccttcacagtcgcaaaaagtcagcgcgcatcagaaggaattggcggaaatccggacccactagctacctacatcaaatccgccactag

SEQ ID NO: 44360 - DNA, 1305 bp, Artificial Sequence
  Description of Artificial Sequence: Synthetic coding sequence
atggccgccagcgacaccgagcgggacggcctggcccccgagaagacttcgcccgacagagacaagaagaaagagcagtcagaagtgtccgtttcccctcgcgctagtaagcaccattattctaggagcaggagcagatctagggaacgaaaacgtaagtccgacaacgagggtaggaagcaccggtctaggtctaggtctaaggagggccgaaggcatgagagcaaggacaaaagttccaagaaacacaaaagtgaggaacacaacgataaagagcactcctccgacaagggacgagagcgactgaactccagtgaaaacggggaagatcgccataaaaggaaagaacggaaaagttcccgtgggcggtctcactcccggtcacgttcaagagagcgccggcatcggagcaggagccgcgagcgcaaaaagtccaggagccggtctagagagagaaagaagtcgcgctctagatctagagagcggaagaaaagtcgcagtcgttcccgcgaaaggaaaaggaggataaggagcaggtcacggtcccgaagcagacaccgccatcggactagatcgcgttctcggacccgctcgcggagtagggatagaaaaaagagaattgagaaaccaagacgcttctctcggtcgctgagtaggaccccatctcccccaccatttcggggaagaaacaccgccatggatgcacaagaggccctcgcccggagactggagcgggctaaaaagctgcaggaacagcgcgagaaggagatggtggaaaagcagaaacaacaagaaatcgcagctgccgccgcaactggcggctctgtcctcaacgtcgcagcgctgctggcctccggcactcaggtcacaccacagattgctatggccgctcaaatggctgccctgcaggcaaaagcactcgccgaaactggcattgccgtgccgagctattataatccggctgctgttaatcccatgaaatttgcggaacaggagaagaagaggaaaatgctttggcaggggaagaaggagggggataaaagtcagagtgccgagatttgggaaaaactgaattttggtaataaggaccaaaacgtgaagttcaggaaactcatgggaatcaagtctgaagacgaggccggctgcagcagcgtggatgaagaaagctacaagaccttgaaacaacaggaggaagtgtttcgcaatttggatgcccagtatgagatggccagaagtcagacacacacacagcgcggcatgggtctgggttttacatctagcatgcgcgggatggatgccgtgtag

SEQ ID NO: 44361 - DNA, 1161 bp, Artificial Sequence
  Description of Artificial Sequence: Synthetic coding sequence
atgaaggaggagaacaccggcgccggcgccgaggccaagcggaccaatttctttttgaaacaggggcgcagacacgaatccaaggacaaaagcagtaagaagcacaagtctgaagagcataatgacaaagaacattcttcagataaggggcgggagcgcctgaacagtagcgagaacggagaggatagacataagcgaaaggagaggaagtcctctaggggacgctcgcattcacgctccagatcacgagagaggcggcacagatctcgttccagggagaggaagaaatcgcgatctcgtagtcgcgagaggaagaaatctaggtcccggtctcgtgagagaaagaaatcaaggtcccggagtagagagaggaaacgacggattaggagcagatcccggtcacgttccagacaccggcatcgaaccagatccagatcacgaactcgaagcagaagtagagacaggaagaaacgtatcgagaagccacggcgtttctcccgctcgctcagcaggacaccctccccacctccattccggggtagaaacacagccatggatgcccaggaggccttagcaagacgattagaaagagccaaaaagctgcaggagcaaagagagaaagaaatggtcgagaaacagaagcagcaagaaattgctgcagccgcggctactggcggcagcgtgctcaatgtggcagctctgctggcttctggcacccaggtaacaccacagatcgctatggccgcccagatggctgccttgcaggcgaaagccctggcagaaaccggtatcgccgtgccgagctactataaccccgccgccgtgaatccaatgaagtttgcagaacaagagaaaaaacgcaagatgctctggcaaggaaagaaagaaggcgataaatcacagagcgctgaaatctgggagaagttgaatttcgggaacaaggatcagaacgtgaagttccgcaagctgatggggatcaagtctgaggacgaagccggttgtagtagcgttgacgaggagagttacaaaacgctgaagcaacaagaagaggtttttcggaatttggatgcccagtatgaaatggctcgcagccagactcacacccagagaggtatggggctgggcttcacctccagcatgcgggggatggacgcagtgtag

SEQ ID NO: 44362 - DNA, 1110 bp, Artificial Sequence
  Description of Artificial Sequence: Synthetic coding sequence
atggccgccagcgacaccgagcgggacggcctggcccccgagaagaccagcccagatcgcgataagaaaaaagagcaatctgaggtctctgtgtctcctagggcctccaaacaccattacagcaggtctagaagtagatccagggagcgcaaacgtaaatcagataatgagggtagaaaacatcggagccgcagtcgctcgaaggaaggacgccgccatgaatcaaaggataagagttcaaaaaagcacaagagcgaggagcacaacgataaagaacacagtagcgataaagggagggaaaggcttaactctagcgaaaatggagaagaccgacacaaaaggaaggagagaaaatctagccggggccggagccattcgcgctctcgaagcagagagaggcgacacagaagccggtcccgcgaaagaaaaaagtcacgcagtcggagccgcgagaggaaaaagtccagaagccgtagccgcgaacgcaaaaagtcgagatcccgctccagagaacgcaagagaaggattagatccagatctaggagccggagtaggcaccggcacaggacacggagcagaagccgaaccagaagcaggtccagagaccggaaaaagaggatcgagaaaccaaggaggttctctcgtagcctctccagaaccccatcaccgcctccttttaggggtaggaacacggcaatggatgcacaggaggccttggcacgcaggcttgagcgggccaagaagttacaggagcaacgcgaaaaggagatggttgagaagcaaaaacaacaggaaatcgctgcagctgcggccgctactggcggctcggtgctgaacgtcgctgctctgcttgcttcaggcactcaggtgacaccacaaatagctatggcggcgcaaatggctgcacttcaggccaaagcactagcagaaacagggatagccgtgccttcttactacaatccagcggcggttaatccaatgaagtttgccgagcaggaaaaaaagcggaagatgctgtggcaaggaaaaaaggagggatttattcccaactaccttgagattatgggcaaaattgaattctggaagcagggacaaaacgtgaaattctag

SEQ ID NO: 44363 - DNA, 333 bp, Artificial Sequence
  Description of Artificial Sequence: Synthetic coding sequence
ggcgcccggagccccggcagcacccaccagggcagcctggccagcggggttctgcccatcaaatgctcacacgtagaatttggcatgtggaagggcggaaggagtcaccccttcctcccacactcaagcagatgtgccggcagtggggggcagttggacagcatcctcccccatcaatctccagcctggggaccatggggctgcaaggatcttagttctgggttcccatccttcttgacgagcagcatactttggaagtctgctgtcgttcgggaaccacacatatcgccacaccaggctcccccgtacaaaaccagcgattgcatcacctag

SEQ ID NO: 44364 - DNA, 1104 bp, Artificial Sequence
  Description of Artificial Sequence: Synthetic coding sequence
atgggcaagagcatcccccagtacctgggccagctggacatccggaaaagcgtggtgagtctggccacgggagcaggggccatttatctcttgtataaggcaattaaggccggaattaagtgcaaacctcctctgtgcagcaactcccctatttgtatagcacgagagtgtcctgggcccggtgagcgggctctgccccaggaggcacccgcaccggaggcttctgctgtgggagggccgaagggcttggccgttgagcgcgagcgacatgggcgcgatagcggtgagcttcggcgcttgcttaacagcctggaatgtaaacaggatgagtatgcaaaaagcatgatcctccattcaatcaccaggtgcgtgtacttactcgaggcagaagcctcagcgtgcaccaccgatgacattgtgctgcttggttatatgctggacgacaaggacaattcggtgaagacccaagcattaaacacactgaaagccttctccggcatccggaaattcagacttaagatccaggagcactctattaaggtgttggagttaatttctacgatctgggataccgaactccatatagccgggctgagattactgaacaatctaccgttacccgattacgtacacccgcagctcagacgggttatgcccgctctgatggagatattacaatccgattatatcctcgcccaagttcaagctgtgagacttctgagttacttggcccagaaaaatgaccttctgtacgatattctgaactgtcaggtacactctaacttcctgaatctgttccagcccacccagtcaggtagccttttatatgaagtgttggtattcgctgagagactctccgaaggacggaacgcccctcattaccatgttgtcaaatggcactacaacgaacagagcctacacgaaagtctgtttggggaggagagcagattagctgaccgacttcttgcattggtgatacaccccgaggaagatgtccaaatccaggcctgcaaggtcattgtgagtctgcagtatccccaggatctgagagcgagaccctcatcatgccaaccttctcgttcttactttaaaaacacggaatag

SEQ ID NO: 44365 - DNA, 1023 bp, Artificial Sequence
  Description of Artificial Sequence: Synthetic coding sequence
atgggcaagagcatcccccagtacctgggccagctggacatccggaagagtgtggtgagcctcgctaccggcgccggtgcaatataccttctgtataaagcaatcaaggcggggataaagtgcaagccaccactgtgtagtaactctccaatctgcattgctagactggctgtagaaagggagcgacacggacgtgatagtggcgagctcagaagactactgaattcactggagtgcaagcaagatgagtacgctaagagcatgatcttacacagcatcactcgctgcgtttatttacttgaagccgaggcatccgcgtgcacgaccgacgacatagtgttgctggggtacatgcttgacgacaaggacaattccgtaaagactcaagctctcaacacactgaaagcattttccgggatacggaaattcagactgaagatccaggaacactccattaaggtactggagcttatatccaccatctgggatactgaactgcacatcgccggactgaggctgctcaacaatcttccccttcccgattacgtgcacccccagcttagacgagtgatgccagcccttatggagattctgcaatcggactacatcctggcacaggtgcaggccgtgaggctgctcagttatctggcacaaaaaaatgatctactgtatgacatcctcaattgtcaggtacattcgaatttcctgaatctgtttcagcctactcagtccggttctctgctgtatgaagtcctggttttcgccgagcgcctcagcgaaggcaggaacgccccccactaccatgtcgtcaaatggcattacaacgaacagtctctgcatgagagcttgtttggagaagagagcaggctggccgacaggttgctggcactcgtgatccatccagaagaggatgtacagatccaagcatgtaaagtgatcgtgtccctgcaatatccacaggacctgcgcgccaggccttctagttgccagccctcgcgcagctatttcaaaaacactgagtag

SEQ ID NO: 44366 - DNA, 993 bp, Artificial Sequence
  Description of Artificial Sequence: Synthetic coding sequence
atgggcaagagcatcccccagtacctgggccagctggacatccggaaatcagtcgtgtctctcgcaactggcgcgggagctatttaccttctgtacaaggccatcaaagcaggcatcaaatgtaagccccccctctgttctaacagtcctatctgcatcgcacggctggctgttgagcgtgagcggcatggacgcgatagcggagagctaagacgtcttcttaattcccttgaatgcaaacaggacgagtatgcaaagtctatgatcctgcacagcatcactcgctgcgtgtatctgctggaagctgaggccagcgcatgcacaacagatgatattgtgttgttgggatatatgcttgacgataaggataatagtgtcaagacccaggcactgaacacgttgaaagctttctctgggatcagaaagtttcggctgaagatccaggagcactctattaaggttcttgagcttatttctactatctgggacaccgaactgcatatcgccgggctcaggttactgaataatctgcctcttcccgactacgtgcaccctcaactacgccgggtcatgcccgccctaatggagattctccagtccgactacatactggcgcaggttcaggccgtgcgcctcctcagttaccttgctcagaagaacgatctgctgtacgatatcctgaactgccaaccgacacaaagcggttcattgctgtacgaagtcctggtatttgccgagcggcttagcgaaggtcggaatgccccccattaccacgttgttaagtggcactataatgagcaatccctccacgaatctctgttcggagaagaatcaagattagccgaccgactgctggccctggttattcatcctgaagaggacgtacagattcaagcttgtaaggtcattgtatcgctacagtacccccaagatctgcgcgcacgccctagcagttgtcagccctcacgctcctacttcaaaaacacggagtag

SEQ ID NO: 44367 - DNA, 672 bp, Artificial Sequence
  Description of Artificial Sequence: Synthetic coding sequence
atgctgagccccaacgacaagatgctgggcaagctggaccccttctaccagccttccgtgtctaaacagaagacatctgcggaaataatatccgaagcacgcaatgctctcagaactgtaagaacacagaggccattcacaccacaggaagcgcagaggaagttgtttggccctgcttcatctaggactagtgagaatagacccccgtccagtttctcattgcatgcatctagttttgaatcttccgattccaggccaatctctggaacacggctctctccattagagctgaagccaaaagtgcccgcgtctcccacacgcgaggaggactcttgctttagctttcccaagccacctgtggaccctgccaaaattcgccgggtttccaacgcgcgggctaggctcttccgagcagcctctcaaagggctctcctccctgacagatccttgccgccatcggattccaaaaaaactgtggaaagcaaggagaccgtgatgatgggcgatagtatggtcaagattaacgggatctatctgactaagtctaatgcaatctgccacctgaaaagccaccctcttcagctcaccgatgatggcggattttcagagataaaagaacaggagatgtttaagggaaccacgtccctgccctcccatctaaagaacggatag

SEQ ID NO: 44368 - DNA, 2109 bp, Artificial Sequence
  Description of Artificial Sequence: Synthetic coding sequence
atgatgggcgacagcatggtgaagatcaacggcatctacctgaccaagtcaaacgccatctgccatttaaaatctcacccactgcagttgacagacgatgggggcttctctgagatcaaagaacaggagatgttcaaaggcaccacgagtttgccatcccacttgaagaatggtggggatcagggaaagcgccatgcaagagcttcttcgtgccctagtagttccgatctttctagattgcaaaccaaagccgtgccaaaagccgacctccaagaggaggatgcagagattgaagttgatgaggttttctggaacaccaggattgtgccgattctgagagaattggaaaaagaggagaatattgagaccgtttgcgcagcctgtactcagctgcatcacgccctcgaagagggcaatatgctcggaaataagttcaaaggtcgcagtatcctcctcaagactctttgcaaacttgtggatgtgggctcggatagcttgtctctgaaactagctaaaattatactcgcacttaaggtatcacggaagaacctgctgaacgtatgcaaacttatctttaaaatctcccggaacgaaaagaacgacagtctcatccaaaatgattccatcttggagtcactattggaggtgcttcggtccgaagacctacagactaatatggaggccttcctgtattgtatgggatccattaagtttatcagtggcaatctcggatttctgaatgagatgatttctaagggggctgtggaaattctcatcaatttaatcaaacagatcaatgagaatatcaaaaaatgcggtacattcctgccaaacagcggacatcttctggtccaggtcactgccacgcttaggaacctagtggacagttccctggtgaggtctaagtttcttaacatcagcgcccttccccagctgtgcactgccatggagcagtataaaggcgacaaggacgtgtgcacaaacattgccaggatcttctccaagcttacctcttatagggactgttgcacagctctcgctagttacagcaggtgctacgctctatttctgaacctaatcaataagtaccaaaagaaacaggacctcgttgtgcgtgtggtttttatattgggcaatcttacagcaaagaataatcaagcccgtgagcaattttccaaagagaaaggctctatccagactctgctgtccttgtttcagacctttcaccagctggacttgcatagccagaagcctgtgggacagaggggagaacagcatagagcccagaggcccccttctgaggccgaggacgtacttattaagctgacccgcgtgctggccaatatcgctatccaccctggagtcggcccagtgttggccgcaaacccaggcatcgtgggactacttctcactaccttggagtataagtccctggacgactgcgaggaactcgtgatcaatgccacagccacaattaacaacctatcctactaccaagtgaagaattccattatccaagataagaagctgtacatcgcggaattgttgctgaaactacttgtcagcaataatatggacggcattctcgaagcggttcgcgtgtttgggaatttgagtcaggaccacgacgtgtgcgactttatcgtccagaacaatgtccatagattcatgatggccctgctggatgcacagcatcaggacatatgctttagtgcctgtggggtactccttaacctaacggtcgacaaagacaaacgtgttatcctgaaagagggaggtggcatcaaaaagcttgtggattgtctacgagatctggggccaactgactggcagcttgcgtgtctagtttgcaagactctctggaacttttctgagaatattaccaacgcgagcagttgttttggcaatgaagacacaaataccttactattgctgctcagtagttttctcgacgaggaactggcacttgacggctcatttgacccagacctcaagaactaccacaagctgcactgggagactgagtttaaaccagtcgcccagcagctgctgaataggatccagcggcatcacactttcctggagcccctgcctattcctagtttctag

SEQ ID NO: 44369 - DNA, 2604 bp, Artificial Sequence
  Description of Artificial Sequence: Synthetic coding sequence
atgctgagccccaacgacaagatgctgggcaagctggaccccttctatcagccttctgtttctaaacagaagacttccgctgagatcatctcagaggcccgtaacgccctgcgaacagtaaggacccagcgtccatttactccacaagaggctcaaagaaagcttttcggccctgcgagttccaggacatcagagaataggccaccttcctctttttctctacatgcttcaagttttgaatcatctgattcgcgtccaatttcagggacaagactgagcccactagagcttaaacctaaagtgccggcgtctccaaccagagaagaggattcctgcttcagtttccccaaacctcctgtggacccggcaaaaatccgtagggtgagcaacgctcgtgcccggctgttccgagcagcgtctcagcgagcccttttgcctgaccggagtctgcccccctcagatagcaaaaagacagtggaatctaaagagacagtgatgatgggtgactcgatggtgaaaataaatggcatctatctgaccaaatctaacgccatttgtcacctgaaaagccaccctttgcagttgaccgatgacggaggtttttcagagatcaaggaacaggagatgttcaaggggacaacttcccttccgtctcacctgaagaacggaggcgatcaggggaagcgtcacgccagggccagcagttgcccatcctccagtgacctgtcacgcctccagactaaagccgtccccaaagccgacctgcaggaagaggatgctgagatcgaggtggatgaagttttttggaataccagaatcgtgccgatcttacgcgaactggagaaggaggagaatatagagaccgtgtgtgctgcctgcacccagttacaccatgcattggaggagggcaatatgttagggaacaagtttaaggggagaagtattctgctgaagaccttgtgtaaattagtggacgttggctcagacagtctgagtctcaagctggcgaagatcattcttgctctgaaggtgagccgcaagaacctgctcaacgtttgcaagcttatattcaaaatctccaggaacgagaaaaatgacagtctgattcagaacgattccatcctggaaagccttctcgaagtgcttagaagcgaggatctccagaccaacatggaagctttcttgtattgcatgggcagtataaaattcatctccggaaatcttggctttcttaatgagatgatttcaaaaggcgcagtcgaaatattaattaatcttataaaacaaatcaatgaaaatatcaagaaatgtgggacatttctaccgaacagcggtcacctactggtgcaggtgacagccacactgcgcaatctagtggattccagcttggttcgaagcaagttcctaaatattagcgcactaccacagctgtgtacagcaatggaacagtacaagggagataaggatgtctgcactaacatcgcaagaattttttcaaaactgaccagttaccgcgactgctgcactgcattggcatcatattcccgttgctacgccctgttcttaaatctgattaataaataccagaagaagcaagatctggtggttcgtgtagtatttatactgggcaacttaactgccaagaacaaccaggctagggaacaatttagtaaagaaaaggggagcatccaaaccctccttagtctgtttcagacatttcaccagctcgacttacactcccagaaaccagtcggccagcgcggcgaacagcacagagcccagcgtcctcccagtgaagccgaggatgttttaataaaacttacacgggtgctcgctaatattgctatccacccaggcgtgggacccgtcttggccgccaatccaggcatagtgggcctgctgttgactactctggaatacaagagcctggacgattgcgaagagttggtaatcaacgccaccgctaccataaacaacctgtcgtattaccaggtgaaaaactcaatcattcaggacaagaaactatacattgcagagctgttgctgaaactgctcgtctccaacaatatggacggaatcctggaagccgtgcgggtgttcggaaatctgtcacaagatcacgacgtatgtgattttatagtgcagaacaacgtgcacaggttcatgatggctctgctggacgcccagcatcaggacatctgcttttctgcctgcggcgtgctgctcaacttgaccgttgataaagataagcgcgtgatattgaaagagggcggcggaatcaaaaaacttgtggattgcctgagggatctaggaccaacggattggcagttggcatgtctcgtgtgtaagaccctttggaattttagtgagaacattactaacgccagtagctgtttcggcaatgaggacaccaataccctcttattactgctgagttcctttcttgatgaggaactcgcccttgacggaagtttcgatccagatcttaaaaactatcacaagctgcactgggagaccgagttcaaaccagttgcacagcagctgttaaacaggatacagagacatcacacattcctggagcctttgccaattccttcgttttag

SEQ ID NO: 44370 - DNA, 2619 bp, Artificial Sequence
  Description of Artificial Sequence: Synthetic coding sequence
atgggcaagaagatcaagaaggaggtggagcccccccccaaggacgttttcgaccctctgatgattgaatccaaaaaagcggctactgtggtcctgatgctcaactcgccagaagaagaaatccttgcgaaagcctgcgaggcaatttataaattcgcactcaagggggaggagaataaaaccacactgctggagttaggcgcagtggaaccactgacgaagctactcacacatgaggataaaattgtgagacgaaatgcaactatgatttttggcatcctcgctagcaataacgacgtgaaaaagctgcttagggagctcgatgttatgaactccgttattgctcagttagcacctgaggaggaggttgttattcatgaattcgcttccctgtgccttgcgaacatgagcgcagagtacacctcgaaggttcagatcttcgagcatgggggcttggagcccttgatacgactgttaagctctccagatcccgacgtaaagaaaaattctatggaatgtatctacaacctggttcaggactttcagtgtagggcaaagctgcaggagttgaatgctataccaccaatactggatctgctcaagagcgaatatcccgtaatccaactgctggcattaaagacactcggagttatcgcaaatgataaagagagcaggacaatgctgcgagacaaccaaggtctggatcacctgattaagatcctggagactaaggaactgaacgacttacatatcgaagcactggccgtcattgctaattgtttggaggatatggacactatggtacagattcagcagaccggaggtctgaagaaattgctctcctttgccgagaattcaacaatccccgacatccaaaagaatgctgcgaaggctatcactaaagctgcctatgaccccgagaaccggaaactatttcacgaacaggaggtcgagaagtgcctcgtggccctcctcgggagcgaaaacgatggcacaaaaatcgctgctagccaggcaatcagtgcaatgtgcgaaaatagcggcagcaaagacttctttaacaatcagggcatcccacagctgatccagctgctgaagagcgataacgaagaagtgcgggaagccgctgccctggcacttgccaacctcacgacatgtaaccctgccaatgctaatgctgccgctgaggctgacggtattgatcctctcattaacctgctgtcatccaagagagacggcgccattgcaaacgctgcgaccgtcttgacaaacatggctatgcaggagcccctaaggctaaatatccagaatcacgacatcatgcatgccatcattagtcccctgcggagcgcaaatactgtcgtgcagagcaaagcagctctggccgtcacggcgacagcttgtgatgtagaagcccggacagaactgaggaacagtggggggctggaaccacttgtggagcttcttcgaagtaaaaacgatgaggtgaggaagcacgcatcatgggccgtgatggtgtgtgctggggatgagctcacagcaaatgagctgtgcaggctcggcgcactggacattctggaagaagtgaacgttagcgggacccgtaaaaataaattcagcgaggctgcttacaataagttactcaataataatctcagcctaaagtattcccaaacaggttacctatcaagctctaacataattaacgacggattctacgattacggccgtatcaatcctggcacaaaactgcttcctttaaaggagctctgccttcaggagcctagtgacttgcgtgcagttctcttaatcaacagcaaaagttacgtttcacctccaagctctatggaagacaaaagtgatgtagggtacggccggtctattagctcgagcagctcgttaaggaggagcagcaaggaaaaaaataagaaaaattcctaccacttttccgcggggtttggctctcctatcgaagataagagcgaaccagcatcgggaagaaacacagtcttatccaaaagcgccacgaaagaaaaagggtggcgtaaatctaaagggaagaaagaagaggagaaagtgaaagaagaggaagaggtgatggtggtcccaaaattcgtgggggagggctcctcagataaggagtggtgcccaccctctgatcccgacttctccatgtacgtttatgaagttactaagtcgattcttcctattacgaatattaaggagcagattgaggatctcgctaagtacgtcgctgagaagatggggggtaaaatcccaaaagaaaaattgccagacttcagctgggaactgcacattagcgagttaaagttccagctcaagtctaatgtgatccccattggtcacgtgaaaaaaggtatcttctaccaccgcgccctgctctttaaagccctagccgatagaatcgggatcggctgtagtctggtgcgtggcgaatatggacgagcttggaacgaagtcatgcttcagaatgattcccggaagggcgtcatcggtggacttccggccccagagatgtacgtcatcgatcttatgtttcacccgggggggctaatgaaattgagatcaagggaggccgatctgtatcggttcatctag

SEQ ID NO: 44371 - DNA, 1830 bp, Artificial Sequence
  Description of Artificial Sequence: Synthetic coding sequence
atggacaccatggtgcagatccagcagaccggcggcctgaagaagctgcttagcttcgcagaaaattccactattccagacattcagaagaatgccgcgaaggcaatcactaaggccgcttacgatcctgagaacagaaagttattccacgaacaggaggtagagaagtgtctggtagcgctcctggggtctgaaaacgatggaacaaagatcgccgcctctcaggctattagcgccatgtgtgaaaatagcggttccaaggacttttttaacaaccaggggatcccccaactcatccagcttctgaagtccgacaacgaagaggtgagggaggcagcagctctggctctggccaatctcaccacctgcaaccctgccaatgctaacgccgcagctgaggccgacgggatcgacccccttattaatctcctgagtagcaaacgcgacggcgctattgccaacgccgccactgtgctaacaaacatggctatgcaagaaccgctgaggctaaacattcaaaatcatgacataatgcacgccatcatcagccctctgcgcagtgctaatacagttgtgcagagcaaggccgctttggccgtgactgcaaccgcttgtgatgtggaagcaaggaccgaattgcggaactccggcgggctcgaacccctggtagagttgcttcgctcaaaaaatgatgaggtaagaaagcatgcatcgtgggccgtcatggtttgcgctggcgacgaactgactgcaaacgagctgtgccgactgggcgctctggatatcttggaagaagtgaatgtgtcagggacgagaaagaacaagttttctgaagctgcatacaacaaactattgaataacaatttatctctgaaatacagtcagaccggctacttgtcttctagtaatatcattaatgacggtttttacgactatggccgcattaaccccgggactaagctcctgccactgaaagagttatgtttgcaggagccctccgatttacgggctgtgctgctgattaatagcaagagttacgtttctccacctagcagtatggaggataagtcagacgtggggtatggtagaagcatctcgtcttctagctcgttgcgtcgctcgtctaaagagaagaataaaaaaaacagctaccatttctcagctggctttggcagcccaatagaggacaaatccgagcctgccagcggacgcaatacagtgctgtcgaaaagtgctacaaaggagaaaggttggcggaaatcaaaaggcaaaaaagaagaggaaaaggttaaggaggaggaggaggtcatggtcgtacccaagtttgtgggagaggggtctagtgacaaggagtggtgtcctccatctgatccagatttttcaatgtacgtatacgaggttaccaagtccatccttcccattactaatatcaaggagcagatagaagacctcgccaaatacgtggccgagaagatgggagggaaaatccccaaggagaagctgccagatttttcctgggaactccacatctcggagctcaagttccagctcaagtctaatgtcatacctattgggcatgtcaagaaagggatcttctaccaccgggccctgctgtttaaagccctggcagatagaatcgggataggctgttccctggtacgaggcgagtatggtcgagcttggaacgaggtaatgctgcagaacgacagccgcaaaggtgtcattggtggcctgcctgcacccgaaatgtacgtgatcgatctgatgttccatccaggaggcctgatgaaactgagaagtagggaagcggatctgtaccgattcatatag

SEQ ID NO: 44372 - DNA, 2067 bp, Artificial Sequence
  Description of Artificial Sequence: Synthetic coding sequence
atgggcaagaagatcaagaaggaggtggagcccccccccaaggacgtgttcgatcctctcatgattgagagcaagaaggcagccaccgtggtgcttatgttgaactcccccgaggaggaaatccttgccaaagcatgtgaggccatctacaaatttgccctcaaaggggaggaaaataagaccacgctcctggagctcggggccgtggagcctctcacaaaattgctcacacatgaagacaaaattgtacgaaggaacgcaactatgatttttgggatcctggcctctaacaatgacgtaaagaagctcctgcgggaactggatgttatgaactccgtgatcgcacagctggccccagaggaggaggttgtcatccatgaatttgcgtccttgtgtctggccaacatgagtgctgaatatacgtcaaaggtgcaaatcttcgagcatggggggctggaaccactgatcagactcctgtcttctcccgatccggacgtgaaaaaaaattcaatggagtgcatctataacctagtacaagacttccagtgtagggctaaactccaggagctgaatgcgattccccctatcctcgacttacttaagagcgagtaccccgtcatccaactgttggccctgaagaccctcggcgtgattgctaacgacaaggagagcagaactatgctacgcgataaccagggacttgatcatttgattaagatacttgagacaaaagagctgaatgacctacatattgaggccctggcagtcattgcaaactgcctggaggacatggataccatggtgcagattcaacagacgggcggtctcaaaaaattgttatcttttgctgaaaacagtacaattccagatattcagaaaaatgccgcaaaggccatcactaaagccgcgtatgatcccgaaaatagaaagctgttccacgagcaggaagtcgagaaatgtctagtggcactcttgggctcagagaatgacggcaccaagatcgcagcaagtcaggcaatttccgccatgtgtgaaaactccgggtccaaagattttttcaataatcagggtatccctcagctgatccaactcctgaaaagcgacaacgaggaggtacgagaagcggctgcgctagccctggcgaacctgacaacatgtaacccagccaacgctaacgcagccgctgaggcagatgggattgaccccctgatcaacctgcttagctccaaaagagacggtgcaattgcaaacgcagcgaccgttctaaccaacatggccatgcaggagccgctgcgtctgaatatccagaatcatgacattatgcatgctataattagccccttaaggagtgccaacactgtggtgcagagtaaagctgctttggcggtgacagccacagcttgtgacgtcgaggcacgcactgagcttcggaatagtggcgggcttgaacctttagtcgaactgctccgctccaagaacgatgaggttagaaagcacgcaagctgggcggtgatggtgtgtgctggtgacgaattgactgcaaacgaattatgcagactgggagctcttgacatcttggaggaagtgaatgtctctggcactaggaaaaacaagttcagtgaagctgcctacaacaagcttctgaataataacctgtctctaaaatattcacagactggttatttgagtagttccaacatcattaatgacggcttctacgattacgggaggataaaccccggaactaagctcctgcctcttaaggagctctgcctgcaagaaccctccgatctgcgtgcggtcctactcatcaatagcaagtcctacgtctcgccccccagctccatggaagataaatccgacgttggatacggaagatctataagctcttcgagctcactccgccgctctagtaaggaaaagaataagaaaaacagctatcatttcagtgccggattcgggtcacctatcgaagataagtcagagccggccagcggcaggaatacagtcttaagtaaatccgctaccaaggagaaaggctggtctagtctgccaacaagcaggtag

SEQ ID NO: 44373 - DNA, 2598 bp, Artificial Sequence
  Description of Artificial Sequence: Synthetic coding sequence
atgggcaagaagatcaagaaggaggtggagcccccccccaaggacgtgttcgatccactgatgattgaatccaagaaagccgcaaccgtcgtgctgatgctgaacagcccagaagaggagatcctcgccaaagcctgtgaggcaatttacaaatttgccctgaagggtgaagagaacaagactactcttctcgagctgggagccgtcgagcccctcaccaagctgctcacccatgaggacaaaattgtacggcgaaacgccacaatgatcttcggaatcctagcctcaaataatgatgtgaaaaagttactgcgggaactcgatgttatgaactctgtgatcgctcaattggcccctgaagaggaggttgtcatccacgagttcgcctctctttgtctggccaacatgagtgccgaatatacatctaaagtgcaaatatttgaacacggcggacttgaacccctcattagactgctgagtagccccgatcccgacgtcaaaaaaaactcaatggagtgcatttacaatctcgttcaagacttccagtgccgcgctaagctgcaggagcttaatgcaattccacccattctggacctcctgaaatccgagtatccggtcatccagctgctggccttgaaaactttgggtgtgattgcaaatgacaaggagtcaaggactatgctgcgggacaatcagggtttagaccatctcatcaagatcctggagacgaaggaacttaacgacctccacatcgaggctcttgcagtgattgccaactgtctggaggatatggatacaatggtgcaaatacaacagaccggagggctcaagaaactgctttcctttgccgaaaactcgactatcccggacatccaaaagaatgccgcaaaagcaatcactaaagccgcctacgatccagagaatcggaagctgttccacgaacaggaagtagaaaagtgcctcgtagccttgctggggtccgaaaacgatggcaccaaaatcgccgcctcccaggccatctcagcgatgtgcgagaactcaggctctaaagacttcttcaacaatcagggcatcccccagcttattcagctcctcaagagtgataacgaagaagtgagagaagcggccgcacttgccctggcgaaccttacgacttgcaaccctgccaacgccaacgccgcagcagaggccgatgggatcgatccattaattaacctcctctcatccaagcgagacggcgcaatcgccaatgctgccaccgttttaacaaatatggcaatgcaagagcccctccgactcaatatccagaaccacgatatcatgcacgccatcatctcgccgttgcgctctgccaataccgtggtccagtccaaggccgcactcgctgttactgccactgcatgcgatgtggaggcgcggactgaactcaggaatagcggcggcctcgagccattagtcgagctgctccggtccaagaatgacgaggtccgcaaacacgcgtcttgggctgttatggtgtgtgccggcgatgaactgacggccaatgagctctgtcggctcggcgccctcgacattttggaagaggtcaacgtgagcgggactagaaagaacaaattctccgaggccgcctacaacaaactccttaacaacaacctctcactcaagtactcgcagacaggttatctgtcttcctccaacattattaatgacggcttttacgactacggacgtataaaccctggcacaaaactgctccctctcaaggagctctgtctgcaggagcccagcgacctgcgggctgtgctgctgattaatagtaagtcatatgtaagccctcccagttccatggaggacaaatccgacgtcggatacggacggagtattagcagctcaagcagtctgcggcgctccagcaaggaaaagaacaacgccgggttcggaagcccaattgaagacaaaagcgagcctgcgagcgggaggaatacggttctaagcaagagcgcgactaaggaaaaggggtggaggaaaagcaagggaaagaaggaagaggagaaggtaaaggaggaggaagaggtcatggtggtcccgaagtttgtaggggaaggtagcagcgacaaggagtggtgcccccccagtgatccggacttttccatgtatgtgtatgaggtgactaaatcaatcctccctattaccaatattaaagagcaaatagaagatctggccaagtacgtcgcagagaaaatgggtggcaagattccaaaggaaaagctcccggatttcagctgggaattgcacataagcgaactcaagtttcagctgaagagcaacgtgattcccatcggtcatgtcaagaaaggtatcttctaccaccgggcactcctgtttaaagccctggcggacagaataggcatcgggtgcagtttggtgagaggagagtatggaagggcttggaatgaggtcatgctccagaatgacagcaggaaaggcgttatcggagggttgccagccccagaaatgtacgtgatcgatctcatgtttcacccaggcggactcatgaaactgagatcccgcgaggccgatctttaccggttcatctag

SEQ ID NO: 44374 - DNA, 1059 bp, Artificial Sequence
  Description of Artificial Sequence: Synthetic coding sequence
atgaaggagaacagcatcgccctgaacatcctgggcaagatcacccgcgacgatgatcctgaatcagagataaaaatgaaaattgctatgttactcaagcagctggacctgcatcttctgaatcacagcttgaagcacatttccctcgaaatttccctttctcctatgacggtgaagaaagacatagagttgctgaaaaggttctcaggtaagggtaatcagacggtcctggagagcatagaatacacttcagactatgagttctccaacggatgcagagctcccccctggcgccaaattagaggggagatctgctacgtgctcgtgaaaccacacgacggagagactctgtgcatcacttgctcagcagggggggttttcctgaacggggggaaaaccgacgacgaaggcgacgtgaattatgaacgaaaaggtagcatctacaaaaatctggtgacttttttgagagaaaaatctcccaagttctcagaaaatatgagcaagctgggaataagtttttcagaggaccagcaaaaggagaaagatcaactcggcaaagctcctaagaaggaggaagcggcggcattgcggaaggatatcagtggttctgacaagcgcagcctggagaaaaatcagatcaacttctggagaaatcaaatgactaagagatgggagccctcactgaattggaagacgacagtgaactacaagggaaaaggttctgccaaagaaattcaggaagacaagcataccgggaaactggagaagccccggccttccgtttctcatggccgggctcagcttctgcggaaatcagctgaaaagattgaagaaacagtgagtgatagctcttctgagtctgaggaagacgaagagccccctgaccatagacaggaggcgtccgctgacctgccaagcgagtattggcaaatacagaaactggtgaaatatttaaagcaaaaagaaacatcccagaacggacgtaacaagcgctggatccgtaagcagaacactagggtcattagatcgatgatcttcgacgtcggcaagacgtcctag

SEQ ID NO: 44375 - DNA, 3135 bp, Artificial Sequence
  Description of Artificial Sequence: Synthetic coding sequence
atgggcgtggccctgcggaagctgacccagtggaccgccgccggccacgggaccggaatcctggagattacccctcttaacgaagccattttaaaggagatcatcgtgtttgtggaatcttttatatacaaacatccccaggaggctaaattcgtcttcgtggaaccattagagtggaatacatccctggctccatctgcctttgagagtggctatgtcgtaagcgagaccacagtgaaaagcgaggaagtagacaagaacggccagcctctactttttctgtcggtccctcaaattaagattcgtagtttcggccaactgagtagacttctgctgatagccaagactggcaaattgaaggaggcccaagcctgcgtggaagcgaaccgcgacccaattgttaagatattgggctcagattataacaccatgaaggagaatagtatagcgttaaacatcctgggcaagatcacgagggacgatgaccctgagtcagagatcaagatgaaaattgcaatgctgctgaagcagctggatctgcatctgttgaatcactcccttaagcacatttccttggagatctcgttatctcctatgacggtcaagaaagacatagaacttcttaaaagattttccggcaagggcaatcagactgttcttgaatcaatcgagtatacgtctgattatgagttttccaacggctgcagagcaccaccttggcgacagatccggggcgagatttgctacgtgctcgtcaagccccacgatggcgagaccctgtgcatcacatgtagtgccggtggcgtatttctgaatgggggaaaaacggacgacgaaggagacgtaaactatgaacgcaaaggctccatatacaagaacctggttacgtttctgcgtgagaagtcacccaaattcagtgagaatatgtctaagttggggatcagcttctctgaggatcagcagaaagagaaggatcagctcggcaaagcaccgaaaaaagaggaagccgcagcactgagaaaagacatttcaggcagcgataaaaggtcgctggagaagaaccaaattaatttctggcgaaaccagatgacaaaacgttgggaacccagcttgaattggaagacaaccgtgaactataaaggcaaaggttcagccaaggaaatccaggaggacaagcataccggaaagcttgaaaagccccggccctccgtctcccacggcagagcacagctgctcagaaaaagcgccgaaaagatcgaggaaacagtaagcgacagctcttcagaatctgaggaggacgaggaacccccggatcacagacaagaggctagtgccgaccttcccagcgaatattggcagattcagaaattggtgaaatatctcaaagggggcaaccagacagcaacggtgatcgcgctgtgcagcatgagagacttcagcctggcccaggagacctgccaactcgctatacgcgacgtaggagggttagaggtgctgatcaatctcctggagactgacgaagtgaagtgcaagattggtagcctcaagatcctgaaggagatctcacataatccacagattcgccagaacatcgtggatttgggcggactccctattatggtcaacatcctcgattctccacacaagagcttgaagtgtctcgccgccgaaaccatcgcaaatgtggcaaaattcaagagagctaggagagtcgtgcggcagcacggagggatcaccaagctagtcgccctactagattgcgcacacgactccacaaagccggcccagtcctctctttatgaggccagagacgtagaggtggcccggtgcggggctcttgccctgtggtcttgctcaaaatcccatacgaataaagaagctattaggaaggctgggggcattcccctgctcgcccgcctgctgaagactagtcacgagaatatgcttatcccagtcgttgggaccctgcaagaatgcgcttctgaagaaaactatcgggccgctataaaggccgagcgaatcatcgaaaacctggtaaaaaacctaaattcagagaacgagcagttacaagagcactgtgctatggccatctatcaatgtgccgaggacaaggagacacgcgaccttgttcggttgcatggcggtctaaaaccgctggctagtcttctgaacaatacggataacaaagagaggctcgcggccgtaactggagctatctggaaatgctcaattagtaaggaaaatgtcacaaaattcagggagtataaagccatcgaaactctagtgggcctccttaccgaccagcccgaagaggttctcgtcaacgttgtcggtgcactgggggagtgttgtcaggaaagagagaacagggtgatagtgcggaagtgcggtgggatccagcccctagtgaacctactggtggggatcaatcaggctttactggtgaacgtgacaaaggccgtcggtgcctgcgcagtggaacctgaaagcatgatgatcatcgaccgcctggacggggtccgcctgctgtggtccctgctgaaaaatccgcaccccgatgtcaaggcaagtgctgcctgggccctgtgtccctgcattaagaatgccaaggacgctggtgagatggtcaggtccttcgttggggggctggagctaattgtgaacttgttaaaatctgacaacaaagaagtcctcgcgtcagtctgcgcagcaattactaatatcgcaaaagatcaggaaaacctggcagtgataaccgatcacggtgtggtccctctcttaagtaagctggctaatacaaataataacaagctgcggcaccatctggcggaagcaattagtcggtgctgcatgtggggacgcaaccgagttgctttcggcgaacacaaagctgtagcacccctggtgagatatctaaaatccaatgatacaaacgtccacagggcaacagcacaggcactgtaccagctctctgaggacgcagataattgtatcacaatgcacgagaacggggccgtgaagcttcttttggatatggttggtagccctgatcaggaccttcaagaggctgccgccggttgtattagcaacatcagacgcctagcactggcgacagaaaaggccaggtacacctag

SEQ ID NO: 44376 - DNA, 1170 bp, Artificial Sequence
  Description of Artificial Sequence: Synthetic coding sequence
ctgagccggctgctgctgatcgccaagaccggcaagctgaaggaggcacaggcttgtgtggaggccaatcgtgaccctattgtgaagatcctaggctccgattataatacgatgaaggagaatagtatagccctgaatatcctgggaaagatcacaagagacgacgatccagagagtgagatcaaaatgaagatcgccatgctgctgaaacagttggacctacatttgctgaatcatagcctcaaacacattagtttggagatttccttatctcctatgacggtcaaaaaggacatcgaattgttaaaaaggttctctggtaaaggcaatcaaactgtactggagtccatcgaatatacttccgactacgagttcagcaacggctgccgcgcgcctccctggcggcagatccgaggggagatctgctatgtcttggttaagccacacgacggagagactttgtgcataacgtgcagtgccgggggggtgtttttgaacggtgggaagaccgatgacgaaggcgacgtgaactacgagcgaaaggggagtatctataagaacctcgtgacatttctgagggaaaaatcacccaagttctctgagaacatgagcaagctcggaatctcctttagcgaggaccagcaaaaggaaaaggaccagctaggaaaagcccctaaaaaagaagaagcagcggctctcaggaaggatatttcaggctcagacaagcgcagtctggagaaaaaccagataaatttctggcgcaatcagatgacaaagcgctgggaaccttctctgaattggaaaaccacggtgaattacaagggcaagggttccgcaaaggaaatccaggaggacaaacacaccgggaagcttgaaaaaccccggccaagcgtgagccatggaagggcccagctgctgaggaagagtgcggaaaagatagaagaaacagtgtcagactccagctccgagtctgaagaagatgaagaacctcccgatcaccgtcaagaagcgtccgccgacctgccttccgagtactggcaaattcagaaactagtcaaatacctcaagcagaaagagacatcccaaaatgggcgcaacaagcggtggatcagaaaacagaacactcgtgtgattaggagcatgattttcgacgtcggcaaaacatcatag

SEQ ID NO: 44377 - DNA, 621 bp, Artificial Sequence
  Description of Artificial Sequence: Synthetic coding sequence
atgagcaagctgggcatcagcttcagcgaggaccagcagaaggagaaggatcaattgggcaaggcaccaaagaaagaggaagctgccgcgcttcgaaaggacattagcggtagtgacaagcgctcgctggagaagaaccagatcaacttctggaggaaccagatgacaaaacgatgggagccatccttgaattggaagaccacagtcaattataaaggcaagggtagtgcgaaagagatccaagaggataaacacactggaaagctcgagaagcctaggccgagcgtgtcacatgggcgggcccagctcttgcggaagtctgccgaaaaaattgaggagacagtgagcgactctagttctgaatctgaggaggatgaggaaccacctgatcacagacaggaagcatctgcagacctcccgagcgagtactggcagattcaaaagctggtcaagtatctgaaaggtggaaatcagaccgccaccgtgatagccttgtgcagtatgcgcgatttctccctcgcccaggagacctgtcagctggctataagagacgtgggcgggctggaagttctgatcatctgtctgaagcctatgaaaagtaatgtgagattagtacactag

SEQ ID NO: 44378 - DNA, 2118 bp, Artificial Sequence
  Description of Artificial Sequence: Synthetic coding sequence
atgagcaagctgggcatcagcttcagcgaggaccagcagaaggagaaggaccagctgggaaaagctcctaagaaagaggaagcggctgcattgagaaaggacatttctggctcagataaacggtccctagagaaaaaccagattaacttctggagaaaccagatgaccaagcgctgggagccgagcctaaattggaaaactaccgtgaactataaaggaaagggtagcgccaaggagatccaagaggacaaacataccggtaaactcgagaagccccgccccagcgtgagccatgggcgtgctcagttactgaggaaatcagcagagaaaatcgaggaaacagtgagtgattccagttccgaatccgaagaagacgaggaaccaccagatcacaggcaggaggcaagcgccgatctgccatccgaatactggcagatacaaaaactggtgaaatatctcaaaggagggaatcagaccgcaacggtgatcgcactgtgctcgatgagggatttctctctagcccaggagacttgccagctggccattcgagatgtcggcgggctggaagttctcatcaatctgctggaaacagatgaggtgaagtgtaagatcgggtccctcaagattcttaaggaaatatcacataatcctcagatcagacaaaacatcgttgacctgggcggcctaccgattatggtgaatattttggactcgccgcacaagtctctcaaatgtttggctgcggagaccattgccaacgtggctaaatttaagagagccagacgggtagtccggcagcacggaggcatcacaaaactagtggccctacttgactgtgcccacgactctacaaaaccagctcagagctccttgtatgaggctagagacgtagaggtcgccagatgtggcgcgctggccctgtggtcttgctcaaaaagccacacaaataaagaagcaatccgaaaggccggaggcattcccctactggcaaggctgctaaaaacaagccacgaaaatatgttaatacccgtggtcggcacgttacaggagtgtgcttcagaggaaaattaccgggctgccattaaagccgagcggattattgaaaatttggtcaagaaccttaactcggagaatgagcagctacaggagcactgcgctatggctatataccaatgtgcagaggataaagagaccagggatctggtgcgcctacacggcggactgaagcccctggcctctctgctgaataacacagataacaaagaacgacttgccgctgtcacaggggcaatttggaaatgttccattagcaaagaaaatgtgacaaagtttcgtgagtacaaggccatcgaaactttagtcggcctcctgacagaccagcccgaggaggttctcgtgaacgtagtcggggctctgggcgagtgttgtcaggaacgagaaaatcgcgttattgtgcgtaagtgtggcgggatccagccccttgttaatctgttggtgggcatcaatcaggctctcctcgtgaacgtcactaaggcagtgggcgcctgtgcggttgagcccgaatctatgatgatcatcgacagactagatggcgttcggcttctttggtcactcctgaagaacccccacccagatgtcaaggcttctgccgcatgggccctgtgcccatgtattaagaatgctaaagatgccggggaaatggtgaggtcgtttgtgggaggactagagctgatcgtcaatctgctgaaatcagataataaggaggtgctggccagcgtgtgcgccgcaataaccaacattgcgaaggatcaggagaacctggcagtgatcactgaccacggggttgtacccctactgagcaagcttgccaataccaacaacaacaagctcagacatcaccttgctgaagccatctcgcggtgctgtatgtggggcagaaatagagtagccttcggcgaacacaaagccgtggcccctctagtacgatacctgaaatctaacgataccaacgtgcaccgcgctacagctcaggccctataccagctctctgaggatgctgacaactgcatcacaatgcatgaaaacggcgcggtcaaaaagaacatttttatttcctag

SEQ ID NO: 44379 - DNA, 1839 bp, Artificial Sequence
  Description of Artificial Sequence: Synthetic coding sequence
atgcgggacttcagcctggcccaggagacctgccagctggccatccgggatgttgggggcctggaagtactgattaatctgctggagaccgatgaagtaaaatgtaagattggctccctgaagatccttaaagaaatctcccataatccacagattcgccaaaatatcgtggacctgggcggcttgccgatcatggtcaacatcctggattcaccccacaaaagtctgaagtgtctggccgcagaaaccattgccaacgtcgctaagtttaagcgggcgaggcgggtagtcaggcaacacggcgggataactaagctggtcgctttgctggactgtgcgcatgattccactaagcccgctcagtccagtctatatgaggccagagacgttgaagtagccaggtgtggggctctggctctgtggagttgttcaaagtcgcataccaacaaggaagcaatacgtaaagcaggcggtattccccttttggccaggctcctcaagacctcccacgagaacatgctgatcccagtggtgggaacactccaggagtgcgcatctgaggagaattatcgcgccgccatcaaagctgaacggatcatcgagaacctggtgaagaatctgaatagcgaaaatgagcagctgcaggagcattgcgcaatggctatctaccaatgcgcagaggacaaagaaacacgggatctggtgcggctccacgggggcctaaaacctctggccagccttctgaacaacacagacaataaggagcggctggctgccgttaccggggccatttggaaatgcagcatcagtaaggaaaatgtgaccaaattcagggaatataaagctattgagacactggtgggcctcttaaccgaccaaccggaggaggtgctggtgaacgtcgtgggcgcgttaggggaatgctgtcaggagcgggaaaatcgcgtgattgtccgcaagtgtggaggcattcagccgctagtgaatctactggtgggcattaatcaagccttgttggtcaacgtgaccaaagccgtaggcgcctgcgcagtagagccggaatccatgatgatcattgacagactggatggagtgcgtcttttatggagtttactgaaaaaccctcaccctgatgtaaaagcatccgccgcatgggctctatgtccgtgcatcaagaatgccaaagatgctggagagatggtgagaagctttgtaggtggtcttgagttaatcgtgaacctgttgaaatccgataataaagaagtgctcgcatccgtgtgtgcagctattacgaacattgctaaagaccaggagaacttggctgtgatcactgaccacggcgtcgttccactgctgtcgaaactggccaacacaaacaataacaagctccggcaccacttagctgaggctatttcgagatgctgcatgtggggaaggaatagggtggctttcggggagcacaaggccgttgccccccttgtccgatacctgaaaagtaacgataccaacgtgcacagagcgactgcacaggctttgtaccagttaagtgaggacgcagacaattgcatcactatgcatgaaaacggcgccgtaaagacagagtctcgacacgtggctagattagaatgctccgataatgacctagggtcccttcagccccctccacccgggtttaaaagattttcatgtctgtccctcctctccagttgggattattccttttactggatttggctgggaccactcacacgtatcagtcgtaaactacagctggtcgtttaccccatcagtgcaggatggctgttactccagagaagacaagacacactagagatatag

SEQ ID NO: 44380 - DNA, 2808 bp, Artificial Sequence
  Description of Artificial Sequence: Synthetic coding sequence
atggccgccgccaagcccaccctgaccgacagcctgagcttctgcttggcccagttggcggccgccgccggggaagcactaggaggcgaaaaggaccccgcaactaacgagacaccattgtccagggctctcctcgcattacggaccagacacatcaaggcagcgggtggcattgagcgttttagagccagaggggggttgcggcctctcctggcactcctacggagagcagccgccgcaggatccgcaccatctcaagctggcccagggtctgcaccgagctctgctgcctcaggtgctagctctccagcccccgcctccggccccgcccctagtgccgtatcgtctagtagccctacccctccagtgaggttgaggaagactttggacctcgctctcagcatactcgccgattgttgtactgagggggcatgtaggacagaggtgcgaaggttgggcggtatactaccactggtcaccattctccagtgcatgaagaccgatagcatacagaatagaaccgcgagagccctgggaaatctggctatggagcctgaatcttgtggtgacatacattgtgccggagctgtacctttgctggtagagtctttgacggcgtgccaagattctcaatgcctgcagagcgtggtgcgcgctctccgcaacttggccgattctccgcagcaccgactcgctctagctcagcagggtgcagttcgcccactggcggaactgcttgctactgcaccagacgctgccctcacccttgcgttggttagagctctcctggaactgtctagaggatgctcacgcgcctgtgcagagcagctgtccttaggtggtgggctgggacctttggtgagcttggcatcccatccaaagcgtgccgtgagggagggcacaattttaattttagccaacctgtgcgctcaggggcttatccgaccagccctcggtaacgccgggggtgtggaggtcctcgtcgatgaattgaggcaacgccgggaccctaatggcgccagtccaacctcccagcagcctcttgtgagagccgtttgccttttgtgcagggaggcgattaaccgagcccggctgcgtgatgcaggcgggcttgatttgctgatgggactgctgcgagaccctagggcctccgcatggcacccccggatcgtagctgccctggtaggttttctgtatgacaccggtgcactaggacggctgcaggcacttgggttagtgcccctcttggctggccagctgtgtggggaggctggggaggaggaggaggagggccgggaggcagctagttgggactttcccgaggagcggacccctgaaagagctcagggggggtcattcagatccctgaggagttggctgatcagcgagggctatgctacaggccccgatgacatctctccggactggtccccagagcagtgtcccccagaacctatggagcctgcttcccccgcacctactcccacaagtctgagggcgccacgcacgcaacggacccctggcagatctcctgccgctgccattgaggagccctgggggcgggaggggccagctcttttgctgttgagtagattttcccaggctcctgatccgtctggcgccctcgtgaccggccctgccctgtatggactcctgacatatgtaactggtgcacccggtccgccctctccccgggccctccgcatactctcccgccttacatgcaatccagcctgtttggaagccttcgtacggtcatacggtgccgcgctcctgcgcgcctggctcgtcctgggcgtggcacctgacgattggccagcccctcgcgctcgacccacccttcacagccggcaccgcgagctgggcgagcgcttgctgcagaacctgacggtgcaggctgaatcaccttttggagtgggcgctctcactcaccttttgctgtctggctcgccagaggatcgggtcgcatgcgccctcacactcccattcatctgtagaaaacccagcctctggagaaggctgcttctcgaacagggaggtcttcgattgttactcgctgccttgactcgccccgccccacatccgttgtttctgttctttgccgctgactccctatcatgcctccaggaccttgtaagtcccacagtttcaccagctgttccccaggcagtgcccatggatctagattccccgagcccttgcctgtatgagcctttgctcggccccgctcctgttccagcccctgaccttcatttcttgcttgattccgggctccagctccctgcgcaaagggctgcctcagctacagcatcacccttcttccgggccctgctgtcaggttccttcgctgaggcacagatggacctggtgcccctgagggggctttccccaggcgccgcatggccggtactgcaccacctgcacggatgccgcgggtgtggagccgccttgggacccgtcccgcctccaggacaaccactgctcgggtcagaggctgaggaggccctcgaagccgctggaaggttcttattgccgggcttggaggaggagctggaagaagctgtggggcgtatacaccttggccctcagggcggacccgagagcgtgggggaagtgttccggctgggtcggccccgcctggctgctcattgcgctaggtggacattaggatccgagcaatgcccccggaagcgtggcctagctctagtggggctcgtcgaagccgctggtgaggaggccggcccgctaacagaggccctcctcgctgtggttatgggaatcgagcttggggctagggtcccagcttag

SEQ ID NO: 44381 - DNA, 3093 bp, Artificial Sequence
  Description of Artificial Sequence: Synthetic coding sequence
atggtgaccctgggcgccggcgtgcggctgttcaccggcgtgtacccagtggttttaaaccaaattcgggcaaccagtgaggcatctgccataacaagaaccactatgccggctccagagttgaccagcacctcaagagccgaagacacccgcgacacaggcgtgcagctaagaaaacgcaagatcccacaggcacgccactctcgcaaacggcagcggaccttcagtttcaggagtttaggatccgcagccagatctggtgccgaatccgaagccagagccaaaatggctgccgccaagcccacactcaccgattcgctgtcattttgtctcgcccagctggctgcagctgctggagaagcgttgggaggcgagaaagaccccgccactaacgagacacccctatcccgcgctctgcttgcattgaggacacggcacattaaagctgcgggcgggatcgagcggttcagagccagagggggcctgagacccctcttagcgctgcttcgcagggcagccgcagccgggagcgctcccagtcaggctggccccggatcagccccctccagtgctgcaagtggggcttcgagtccggcaccggcgagtgggcccgccccttccgccgtgtcttcctctagccctacaccaccggttcggctgcggaagactctagacctggccttatcaatcctggcggattgttgtactgagggagcttgccggacggaagtcagacgtctggggggcattctcccattagtcacgatcctgcaatgcatgaagaccgactctattcagaatcggaccgctagggctctgggcaatctggccatggaaccagaatcttgcggcgatatccattgcgccggtgccgtgcccctgctggttgaatccctgaccgcttgccaggacagccaatgtctccaatccgtagtacgtgcacttcgcaaccttgccgacagtcctcagcacaggctcgccttagctcagcagggcgccgttagacccctcgccgaactattggctactgctcccgacgccgcactcactctggctctcgttagggctctattggagctcagccgtggatgttcccgcgcatgtgccgagcagttatctctaggtgggggtttagggcctctggtctctcttgcctcccacccaaagcgcgcggtccgcgagggcactattctgatcctcgcaaacctatgtgctcagggcctgataagacccgctctggggaacgccgggggggtggaagtcctcgttgatgagctccgacagcgccgggatccaaatggcgcttcccctacttcacaacaacccctcgtccgcgctgtttgcttgctgtgccgagaagcaataaatcgggcccgcttgagagatgcagggggcctcgaccttcttatggggctccttcgggatccccgcgcatccgcctggcaccctcgcattgttgcagcactggtcggtttcttgtatgacaccggcgccttgggtcggctccaagcattggggctggtgccactgctggctggccaactgtgtggggaggctggcgaggaggaagaagagggtcgtgaggcagctagctgggacttcccggaggaacgcacgcctgagcgagcacagggaggcagcttcaggtccctccgctcatggctgatatctgaaggatacgccactgggcccgatgatattagccctgattggtcgccagagcaatgcccccctgaacccatggagcctgcctcccctgcgccaactcctacttcgctgagagctcctcggactcagcgtaccccaggccggagtccggccgcagcgatcgaagaaccttgggggcgcgagggacctgcactgctgttgctgagccggttttcccaggctcccgatccctctggcgcgttggttacgggccccgccctgtatggcctgctaacctatgtaactggggctccgggccccccatcacctcgcgccctccgtatccttagccgtctaacctgcaatcctgcctgtctagaggcattcgtgagatcgtacggggccgccctgctccgcgcttggctggtgcttggagtggcccctgacgactggcccgccccccgcgcgcggcctactctccacagcagacatagggagctcggagagcggctgctacagaatcttacagtccaggctgagtcaccattcggggtgggggccctgacccacctcctgctctccggcagccctgaggaccgggtagcctgcgccttaactctcccttttatctgtcggaagccttcactttggcggcgacttcttctagagcagggtgggctgaggcttttactagcagctctgacgcgacccgccccacatcccctcttcctgttctttgccgcagattctctctcctgtctgcaggatctcgttagtccaacggtgtctccagctgtcccccaggctgtgccaatggacttggactcaccgtcaccctgcctgtatgagcccctgctggggcccgccccagtacctgcacccgatctgcattttcttctcgatagtggcctgcagttgccagcccagcgggccgcaagcgctaccgctagccccttcttccgcgctctcctttctggatcttttgctgaggcacagatggatctggtaccgctgcgaggcctttctccaggcgccgcatggcccgtgctgcatcatcttcatggctgcaggggctgtggtgctgcactcggacccgtacccccccctgggcagcctctgctcgggtctgaggctgaagaggcactcgaagccgctggtcgatttctgcttccagggctggaagaggaactggaagaggcagtggggcgcatccatctggggccacagggtgggcccgagtccgtgggcgaagtgtttcgtcttggacgcccgagactcgccgcccattgcgctagatggaccttgggctctgaacagtgcccacggaaacggggcctcgctctggtggggctcgttgaggccgctggtgaagaggccggacctcttactgaagccctgttggctgtcgtaatggggatagagctgggggccagggttcccgcttag

SEQ ID NO: 44382 - DNA, 1740 bp, Artificial Sequence
  Description of Artificial Sequence: Synthetic coding sequence
atgaagaccgacagcatccagaaccggaccgcccgggccctgggcaatctcgcgatggagccggagagctgtggggacatccactgcgctggagctgtgccactgctggtagaatcgctaactgcctgccaagactcgcaatgtttgcagtctgtggctttgggactggtcccactgctagctgggcagctatgtggtgaagcaggcgaagaggaagaggagggcagagaggcagcgtcttgggacttccctgaagagcgaactcctgaaagagcccaaggagggtcttttcgctcactcaggtcgtggctgatttcagaggggtatgcaacaggaccagacgacatctctcccgattggtccccagaacagtgtcctcccgaaccaatggagcctgccagtcccgcccccacacctacgtcactgagagctccgcgcacgcagcgcacccctggcaggagtccagccgcggcaattgaagagccctggggaagagaggggcccgccctgctgctgctaagtcgctttagccaagcccccgaccctagcggcgccctggtaaccggcccagcactgtacggcctgctgacatacgtcactggtgctccgggcccacccagcccgcgggctctgcgcattctgagtaggctgacatgcaacccagcatgtcttgaagccttcgttagaagctacggggccgcgttactccgggcgtggttggtgcttggagtggcaccggatgactggcccgccccgagggcccggccaaccctgcatagtagacacagagagctgggcgagcggttactgcagaatcttaccgtccaggcggaatcaccgttcggggttggagcacttactcatctgcttctctccggcagcccagaagatagagtagcttgtgccttgaccctcccattcatttgtaggaaaccatcactctggcgtagactgttgttggagcagggcggattgcggctacttcttgcggctctgactagaccagccccccaccctctgtttctcttcttcgcagcggattccctgagttgtcttcaggatctcgtatcacccacggtgtcccccgcggttccccaggcagtgccgatggacttagactcgccatcaccctgtttgtatgaacctctgctgggtcccgccccggttcccgcccctgacttacatttcctactggactccggcttgcagctccctgcccagagagcggcctctgccactgcttccccatttttcagggcgctgctgtctggaagtttcgctgaggctcaaatggatctcgtgccactgagggggctgagcccaggtgcagcatggccagtgctgcaccatctgcatggctgcagaggatgcggggcagcactgggtcctgtccctccccccggacagcctctactgggatctgaagccgaggaagctctggaggccgctggccgatttctcctccccggactggaagaagaactggaagaggcagttgggcggattcatcttggtccgcagggtgggccggaatccgtgggagaagtgttcagacttggccgtccacggctggcagcccattgcgcaagatggacactcggaagcgagcagtgcccgagaaaaaggggtctggccctcgtggggctggttgaggccgccggtgaggaggcgggtcccctgacagaggctttgctggcagtggtaatggggattgaactgggtgctagggttccagcatag

SEQ ID NO: 44383 - DNA, 2178 bp, Artificial Sequence
  Description of Artificial Sequence: Synthetic coding sequence
atggccgccgccaagcccaccctgaccgacagcctgagcttctgcctagcacagctcgctgccgctgctggagaagctcttgggggggagaaagatcccgccacgaacgaaaccccgctcagcagggcccttttggcattgcgcacccgccacattaaagcagcgggtggaatcgagcgcttcagggctcgtggtggtctcaggccactcttagctttactccgtcgggcagctgcagccggcagtgcccccagccaagcagggccaggctccgctccttcctccgctgccagtggtgcatcctcccctgctccggctagcggacccgctcccagcgccgtgtcctcatcttcaccaacaccccccgtccggctcaggaagactcttgatttagccctcagtatcttagcagattgttgcacggagggggcttgtcggactgaggtcaggcggcttgggggtattcttcccttggttacaatcttacaatgcatgaagaccgatagcatccaaaaccggacagcccgcgcactgggaaacctcgcaatggaacccgagagctgtggtgatatacattgtgcgggagccgtgcccctgttggtggagagccttacagcttgccaggattcccagtgcctgcaaagtgtcgttagggcactccgaaacctggccgattctccacagcaccgactcgccctggctcagcagggggcagtgcggcctctggcggagttactggcaacagccccggatgctgccctgacgcttgccctcgtgagagcccttctggagctgagtcggggctgttcaagagcatgcgcagaacagctcagccttggtggtggcttgggtccactggtgagcttggccagtcacccaaaacgggcggtgagggagggcactattctgattcttgctaatctgtgtgcacaaggactgatccggcctgccctgggtaacgcagggggagtggaggtgctagtcgacgagctccgacagagacgggacccgaacggtgcatccccaacatctcagcagccactggtcagagccgtgtgcttgctctgccgggaagctattaacagagccagactgagggacgccggaggtctcgacctgttaatggggctgctgcgggatccgcgagcctctgcctggcacccgcgcatagtggctgctctcgtcggatttctttacgataccggggccctgggtaggctacaggcacttggactggtgcctctgctcgctgggcaactgtgcggcgaagcaggggaggaagaggaggagggacgcgaagcggcctcctgggacttcccagaagagaggacccctgagcgtgctcagggggggtcctttcgatcactgaggtcatggctgataagcgaagggtatgccaccgggcccgatgacatctccccggattggagccccgaacaatgccctcctgaacctatggaaccggcgtccccagccccaacgcccaccagtttacgagcgcccagaacccaacgcaccccaggtaggtcaccagcggccgccattgaggagccttgggggagagagggacctgctctgctcttattgtcaagattctcacaagcccccgatccaagtggagctctggttactggcccagcattatacggcctgctgacttacgtcacgggggcccctggtcctccttcccccagagctttgcggatcctttccaggctgacttgtaaccccgcttgcttggaggcctttgtacgttcgtatggtgctgccctccttcgagcatggttggtgttgggggtagcgcctgatgattggcccgcccctagagcaagaccaacgctgcactcccgccaccgggagttgggagagttcccttatccccctgtgtcccttcctccctgcgaatccccttctagccccatggcttccatgggacctgaacctcacctcccaactcacttatcaagccccgccaggcccccggacaacctatcacctgaatggggaggggagcagggcgtgccagtacctccctgggctcatagacaatctagtgctgtgagcagcgcactggcattgggacctcgctacccaaattcccgttgcagtccagcacctagaatatgggcagggctgtgcttcttcccaggttctgctattgggtccgctctaagctag

SEQ ID NO: 44384 - DNA, 2904 bp, Artificial Sequence
  Description of Artificial Sequence: Synthetic coding sequence
atgcaccggccccacgtgcccggctgcgccgccatcaagttccggagcctgggatccgcagcccgttccggcgccgaatccgaggcgcgcgctaagatggccgcagccaagcctaccctgacagattcattgtcattttgtctcgcccagctggcagcagctgctggagaggcactcggaggcgaaaaggatcctgccactaacgagacccccttatcccgcgctctgttagctttacgcacccgacatattaaggctgcgggcggtatcgaacgttttagagctcggggaggtctccggcccctgttggctctgctgcggagggccgctgctgctggatctgctccatctcaggccgggccaggcagtgctccttcttccgccgccagcggcgcatctagcccagcacctgcctcgggtccagcacctagtgccgtgtccagcagtagccctaccccacctgttcgactccgcaagactcttgaccttgccctgtcgattctggctgattgctgcacagaaggagcctgtcgcaccgaagtaaggcgcctgggcggcattctccctctcgtcaccattttgcagtgtatgaagacagattccattcagaaccgaacggcacgggcgctggggaacctcgctatggagccagaatcatgtggcgatatccattgcgcaggtgccgtacctctgcttgtggagtctttaaccgcatgccaagattcgcagtgtctccagtctgtcgtaagggcactgcgtaacctggcagattcaccacagcatcgactggcattggcacaacagggcgcggtgcgacctctagcagagctcttggctactgcgcccgacgcagctctgactttagcactggttagggctctcttagaattgtcaagaggctgtagccgggcctgtgccgagcagctgagcctgggcggtggcctggggcctttagttagtctggcgagccacccaaagagggcagtgcgcgagggaacaattctcattctggcaaacctgtgcgcccaagggctgattcgtccagctctcggcaatgccggcggggtcgaagtcctggtcgatgaactgcgtcaaaggcgagatcctaacggggcctccccgacttcacaacagcctttagtgagagccgtatgcctcctttgcagagaagcaattaatagagcgcgtctgcgcgatgccggcggactcgacctgctgatgggactgctgcgggaccctagggcaagcgcttggcatccaaggatagttgccgctttagtgggcttcctctacgatacaggggcgttggggaggttacaggccctagggctggtccctctgctcgccggacagttgtgcggcgaagcaggggaggaggaagaagagggacgtgaagcagccagctgggacttccctgaggaaagaactcccgaacgtgcccaagggggttcttttcgcagcctgcgttcttggctgatatccgaaggttatgctacaggacctgatgatattagtcccgattggagcccagagcagtgcccccctgaacctatggagccagcttcaccggctcctacaccaacctcgttaagagccccgagaacccagaggacaccaggccgttcacccgcagcagcaattgaggaaccctggggacgtgagggccccgcgttgctgctactgtcccgttttagccaggccccagaccccagtggcgctttagtcactggccctgcactgtacggattgctcacctacgttactggcgctcccggtcctcctagtccccgcgctctaagaatcctaagtaggctgacttgtaatcccgcgtgcttggaggcattcgtgcggagctacggagcggccctattacgcgcctggttagtcctgggcgtggccccggacgactggccagctccccgcgcccgccctactcttcattctcgacaccgtgagctaggagagagactgctgcagaatctcacggtgcaagcagagagcccgttcggcgtgggagctctcacccatcttctcctttctggcagccctgaggaccgggtcgcttgtgcactaaccttgccatttatctgcagaaaaccctccctatggcggaggctacttctggaacagggcggattacgtttgttgcttgccgccctgactaggcctgctccccatccgttatttctgttctttgcagctgattcactaagctgccttcaagaccttgtgagtccgacagtttcacctgccgtgcctcaggccgtgcccatggacctcgattctccctcgccttgcctgtacgagcccctgctggggcctgcaccagttcctgcacctgatctgcacttcttactggatagtgggctgcagctgcccgcacagcgggccgcgtctgccacagcatcaccattctttcgtgctttgttgtccggctcattcgccgaggcccagatggacttggtcccgcttaggggactgtctcctggcgctgcctggcccgtgctgcaccacctccacggctgtcgaggatgcggagccgctcttggcccggtgccaccccccggtcagccgctactcgggtccgaagcggaggaggcactggaggccgcaggtcggtttctcttgcccggcttggaagaggaattggaagaagctgtcggtcgcatccacctgggccctcaaggagggccggagagcgttggagaagtgttcaggctcggaagaccacgactggccgcacactgcgctcgttggacactagggtctgaacagtgcccaagaaagcggggcttggccctagttggattggtcgaggcagccggagaggaagccgggcccctaacggaggcacttctcgcagtggtgatgggaattgagttaggggcccgcgtgccagcatag

SEQ ID NO: 44385 - DNA, 1431 bp, Artificial Sequence
  Description of Artificial Sequence: Synthetic coding sequence
atggtgagcaagcggatcgcccaggagaccttcgacgccgccgtgcgagagaacatagaggagttcgccatgggcccagaagaggcagttaaggaggctgtggaacagtttgagtcccagggtgtggatctatcaaacatcgtgaagacagctccaaaggtttctgctgacggctcccaggagcctactcacgacatcctgcaaatgctgtcagacctacaagagtccgttgcgtcttctcggccccaggaggtcagtgcctatctcactcgtttctgtgaccagtgtaagcaagacaaggcctgccgcttcttggcggcacaaaagggtgcctacccgataatcttcaccgcttggaagttggctaccgcaggagaccagggcctgctcctacaatctcttaatgccctctccgttcttacagacggtcaaccagatttgctcgacgcacagggattgcagctgctcgtggccaccctgacccagaatgcagacgaggccgacctgacctgctccggcattcgatgcgtgaggcacgcctgtttgaaacatgagcagaatcgccaggatctggtgaaagcgggtgtgctgcccctactgacaggcgctatcacccaccacggtcatcacacggacgtggtgagggaagcgtgctgggcactgcgtgtaatgacttttgatgatgatataagagtgcctttcgggcatgcccacaatcacgctaaaatgattgtccaggaaaacaagggcctgaaggttttgattgaggccacgaaggcattccttgacaatcccgggatcctgagtgagttatgcggcacactgtcgaggctcgctattagaaatgaattttgtcaagaagtggttgaccttgggggactgagcatcctggtcagtctgctcgcggattgtaacgaccaccagatgagagatcagagtggggtgcaagagctggtcaaacaggtcctgagcactctccgcgcaattgccggcaacgacgacgtgaaggatgcgatcgtccgagctggagggactgaaagtattgtcgccgctatgacacagcatctgacctccccccaggtgtgtgaacagtcatgcgcggcgctctgtttccttgccttgcggaagcccgacaactcccgcattatcgttgaagggggtggggccgtggcagccctccaggcgatgaaagctcatccacagaaggccggcgttcagaagcaggcttgtatgctgattagaaacctagtggctcatggacaggccttctccaagcctatattggacctgggggcggaagctttgatcatgcaagccaggtccgcccatagagactgtgaggacgtggccaaggccgccctccgagatctgggctgtcacgttgagttacgcgagctttggacaggccagcgtggtaatctggccccgtag

SEQ ID NO: 44386 - DNA, 1395 bp, Artificial Sequence
  Description of Artificial Sequence: Synthetic coding sequence
atgaccagctgccggtgcagcgtgaccagccggagcctgtggcccgctttggcccctcgacggtgtcagcataccagtcctgcctccgcccagtgtaaacaagacaaggcatgtaggtttctcgcagctcagaaaggggcttaccctattatctttaccgcctggaagcttgcgactgcaggcgatcaaggcctgctgcttcagtctctgaacgcgctgagtgtgctcacagatggccagcccgaccttctcgacgcccaaggccttcaactgttggtcgccacgcttacccagaacgcggacgaggccgacttgacctgctccggtatacgctgtgtccgccatgcgtgcctcaagcatgaacagaatcggcaagacctcgtcaaagcgggagttctccccctgctcaccggagcaattacccatcacgggcaccatactgacgttgtgagagaggcgtgctgggccctccgagttatgacattcgatgacgatattcgcgtgccatttggacacgcccataatcatgctaaaatgattgtgcaggagaacaaaggcttaaaggttcttatcgaagccactaaggcttttctagataatccaggaatactcagtgagctgtgtggcactctctctagacttgctatccggaatgaattttgccaagaggtagtcgacctggggggcctgagtattctggtttctctactggccgactgtaatgatcaccagatgagggaccagagcggtgttcaggagctcgttaaacaggtcctaagcaccttaagagccatcgcagggaacgatgatgtcaaagatgccatcgtgagagccggaggaaccgaatccatagtggccgctatgacccagcaccttacaagcccacaggtctgtgagcaaagctgtgctgccctgtgcttcctggcacttcgtaagccagacaattccagaattatcgtggagggagggggggcagtcgccgctctccaggcaatgaaggcccacccacagaaagctggtgttcaaaagcaggcatgtatgcttatccggaatctcgttgcacacagaccatctaggagccccagctggacttggggactccgccactcctcatgtaggcccgacctgcccactgtgacagtgcggacgtggccacggccaccctgcggaacctgggtggttatgtccagtagcgagtcgtgcgggcaggcgagaggggcaacctggagacatgacccacggccgagcctggtaaccctgggcgagtcttgcgactctggcatgggagtcgacccatgtcctcctctgagtcccattagtagcgtgccttttacaatgcgctccgtgttctggcaggcacttggcaaggggagcggagaaggcggtgccttgtag

SEQ ID NO: 44387 - DNA, 1431 bp, Artificial Sequence
  Description of Artificial Sequence: Synthetic coding sequence
atggtgagcaagcggatcgcccaggagaccttcgacgccgccgtgagggaaaacatcgaggagtttgcgatgggaccagaggaggccgtcaaagaggctgtcgagcagttcgagtcgcaaggagtcgatttatcaaacatcgtcaagaccgcacctaaggtttcagccgatgggtcgcaggagccaacccacgacatactgcagatgctgagcgaccttcaagagagcgttgccagttctagacctcaggaagttagtgcctatctgacaaggttctgcgatcaatgcaagcaagacaaggcttgtaggttcctagctgctcaaaagggcgcataccctataatttttaccgcttggaaattagccaccgccggtgatcaaggactgttgctgcagagtttgaatgctctgtccgtcctaacagacggccagcccgacctgctggatgcccagggcctccagctgctggtggcgacactgactcaaaatgcagatgaggcagacctgacatgcagcggcatccgctgcgtcagacatgcttgtttgaaacacgagcagaaccggcaggacctggtgaaggctggtgttctgccactgctgaccggcgcaataacccaccatggccatcataccgatgtggtgagagaggcctgctgggccctcagagttatgacattcgacgatgacatcagagtgcctttcggccacgcccacaaccatgctaagatgattgtgcaggaaaacaagggacttaaagttctgattgaggccactaaggcctttctcgacaatcctgggatactctctgaactctgcggaacactttccagactcgcaatacgcaatgagttctgtcaggaggtcgttgacctgggaggcttaagcatcttagttagtttattggcagactgcaacgaccaccaaatgagagaccaaagtggagtgcaggagctcgtgaagcaggttctcagcaccctccgggcaatcgccggcaacgacgacgttaaagacgccattgtgcgcgctggcggaaccgaaagtatcgtagccgctatgacacaacacctgacaagccctcaagtgtgcgagcagtcttgcgctgccctttgcttcctggccttacggaaaccggacaactcgaggattatcgtggagggcggcggcgccgtggcagcgctccaggcaatgaaagcccatccacagaaagctggtgtccagaagcaggcctgtatgctcatcaggaacttagtagctcacggacaagcattctccaaaccaatcctagacttgggagctgaagcccttatcatgcaggcccgctccgcccaccgtgattgtgaggacgtggcaaaggcagcactcagggatctagggtgtcacgtggagctccgggagctatggacgggccagcgtggcaatctggctccgtag

SEQ ID NO: 44388 - DNA, 1506 bp, Artificial Sequence
  Description of Artificial Sequence: Synthetic coding sequence
atgagcgagcggtgctgcagccggtacagcagcggcgccagcatcgggtgcactcctacatccacacaagctaaaatggtatcaaagcggattgctcaggagacgttcgacgcagccgtcagggaaaatattgaagagtttgctatgggcccagaggaggccgtgaaggaggccgtggagcaatttgaatcccagggtgtcgacctcagcaatattgtcaagacggcccctaaggttagcgcagatggttctcaggagcctacgcacgatatcctacagatgcttagtgatctgcaggagtccgtagcgtcctcaaggccgcaagaggtatctgcctacctgactagattctgcgatcagtgtaagcaggacaaggcatgtcggtttcttgcggctcagaaaggtgcctaccctattatctttaccgcttggaaattagcaacagccggagaccaggggcttctgctccagtccctgaacgcactgtctgtcctgacggatggccagccagacctccttgatgcacaaggactgcagctgctcgttgcgacccttactcaaaacgccgatgaggcagatctgacgtgttcgggcatcaggtgcgtgcgacacgcatgtttgaagcatgagcaaaaccggcaggatctggtgaaggccggggtactgcctctgctcactggagccattactcaccacgggcaccacacggatgtcgtcagagaggcttgctgggcgctgagagtgatgacttttgacgatgacataagggtcccctttggtcatgcacataaccacgcgaaaatgatagttcaggaaaacaagggactcaaagttctaattgaagctacaaaggcttttctggacaaccccggcattctctccgagctctgcggcaccttatccaggctcgctatcaggaacgaattctgccaggaggtagtggatttggggggtctgtccattctggtcagcctcttggccgactgtaatgaccaccaaatgcgggaccagtctggcgtgcaggagctggttaagcaggtcctgagcacactaagagctattgctggcaatgacgatgttaaagatgccattgtgcgggctggcggcacggagtccatcgtggccgcgatgactcagcacttaaccagtccccaggtgtgcgaacagtcttgcgccgccctgtgctttcttgcgctgcgtaagccggataactccagaattatcgttgaaggagggggagctgttgcggcccttcaagccatgaaagcccacccccagaaagctggagtgcagaaacaagcctgtatgctcatccgaaatctcgtggctcatggacaggcattcagcaagcccattctggacctcggagccgaagcactgattatgcaagcccggtcagcccatcgcgactgtgaggacgtggcaaaagcagccttaagggacctgggatgtcacgttgaacttcgggagctgtggactggccagagggggaatctggcgccctag

SEQ ID NO: 44389 - DNA, 1506 bp, Artificial Sequence
  Description of Artificial Sequence: Synthetic coding sequence
atgagcgagcggtgctgcagccggtacagcagcggcgccagcatcggctgtacacccacctcaactcaggccaaaatggtgtccaaaaggattgctcaggaaaccttcgacgccgctgtccgggagaacatcgaggaattcgcaatgggccccgaggaagctgtgaaggaagccgtggagcagtttgagtctcagggcgtggatctgtctaatatcgtgaagacagccccaaaggtgtctgctgatggatcacaggagccaacgcatgatatcttgcagatgttatcagatctgcaagagagcgtggcgagttcacgtcctcaagaggtgtcagcatacttaacccgattctgcgatcagtgtaagcaagataaggcctgtcgcttcctggccgctcagaaaggcgcctaccctattatcttcaccgcatggaaattggctacagctggagaccaaggacttcttcttcagagcttgaacgccctttccgtacttacagacggacagccagatctgcttgacgctcagggactccaactgttagtcgccacattgacccagaacgcagacgaagcagatctgacttgttccggtatcaggtgcgtgcgtcacgcatgtttgaagcacgagcaaaataggcaagatctggtaaaggccggagtccttcccctattgactggcgcgatcacacaccatggtcaccacacagacgtggtgagggaggcctgttgggccctccgcgtcatgacctttgacgatgatatacgcgtcccgtttggacatgcccacaaccacgcaaaaatgatcgtccaggaaaacaaggggctaaaggtgctgatagaagctaccaaggctttcttagacaatcctggtatcctgtctgaactctgcggtaccttgtccagactcgcgatcaggaacgaattctgccaggaagtggttgatctcggggggctgtccatcctggttagcctgctagccgactgtaacgatcaccagatgagagatcagagcggcgtccaggagttagttaagcaggtcctctctactctccgcgccatcgctggtaacgacgatgttaaagacgcaatcgtgcgggcaggcggtaccgagtctatagtggccgcaatgacccaacatctaacgtcgccacaggtgtgtgaacagtcctgcgcggcactgtgtttcttggccttgagaaagcccgataactcccggattatcgttgagggaggtggcgctgtggcagcccttcaggccatgaaggcgcatccacagaaagccggggttcagaagcaagcatgtatgttaatccgaaacctcgtggctcacgggcaggcgttcagcaagcccattctggatctcggagccgaagcactcatcatgcaggcgaggtccgcccaccgcgattgtgaggatgttgcgaaagccgctctcagggatttgggctgccatgtggagctgagagagctttggactggtcagagaggcaatttggcaccctag

SEQ ID NO: 44390 - DNA, 213 bp, Artificial Sequence
  Description of Artificial Sequence: Synthetic coding sequence
atggtgagcaagcggatcgcccaggagaccttcgacgccgccgtgcgcgagaacatcgaggagtttgcaatgggtccagaagaagctgttaaggaggccgtcgaacagtttgagagccaaggggtggacctctccaacatagtgaaaactgcccccaaggtgtctgctgacggatcccaagagccaacacatgacatactgcagatgctctag

SEQ ID NO: 44391 - DNA, 774 bp, Artificial Sequence
  Description of Artificial Sequence: Synthetic coding sequence
atggtgagcaagcggatcgcccaggagaccttcgacgccgccgtgcgcgaaaatatcgaggaattcgctatgggacctgaagaggccgttaaggaggctgtggaacaatttgagtctcagggagtggatctgagtaatattgtgaagacagcccctaaggtatctgccgacggcagccaggagccaacccacgacattctccagatgcttagcgaccttcaggaaagtgtggcaagctcgaggccacaagaggtgagtgcctatctgacacgattctgcgatcagtgcaagcaggacaaagcctgccgatttcttgccgcccagaagggagcatatcctatcattttcacggcctggaaactggccaccgcaggggaccaggggctcttgcttcagtcacttaacgccctttcggtcctgacagatggccagcccgacctgctcgatgcccaagggctgcagcttctggtggctaccctgactcagaacgccgatgaagctgatctcacctgtagcgggatacgctgtgttagacacgcctgtttgaaacatgagcagaacagacaggatctcgtgaaagccggggtcctgcctctgttgaccggcgccataactcatcatggtcatcacaccgatgtggttagagaggcctgctgggcactgcgcgtaatgacgttcgacgatgatataagggtcccattcggacatgctcataatcacgccaagatgatcgtgcaagaaaacaagggattgaaggttctcatcgaagcatag

SEQ ID NO: 44392 - DNA, 312 bp, Artificial Sequence
  Description of Artificial Sequence: Synthetic coding sequence
atggtgagcaagcggatcgcccaggagaccttcgacgccgccgtgcgggagaacatcgaggagtttgcgatgggtcccgaggaagccgtcaaggaggctgtagagcagttcgaaagccagggagtggatttgagcaacatagtgaaaaccgcgcccaaagtgtctgcggacgggagtcaagagcctacacacgacattcttcaaatgctctctgatttacaagagagcgtcgcatcttccaggccacaggaagtgagcgcctatctaactcgattttgcgaccaatgtaaacaagacaaagcctgtcgctag

SEQ ID NO: 44393 - DNA, 246 bp, Artificial Sequence
  Description of Artificial Sequence: Synthetic coding sequence
tgaaaggcccacccccagaaggccggcgtgcagaagcaggcctgcatgctgatccggaatctggtcgcgcatggccaggcattttccaagcctatcctggatctgggagccgaagcattgatcatgcaagccagatcagcccacagagattgcgaggatgttgctaaggctgccttgagggacctgggatgtcatgtggagttgcgggagctttggaccggtcagcgcggcaatttggctccatag

SEQ ID NO: 44394 - DNA, 93 bp, Artificial Sequence
  Description of Artificial Sequence: Synthetic coding sequence
atggtgagcaagcggatcgcccaggagaccttcgacgccgccgtgagagagaacatcgaagagttcgccatgggtccggaggaggcagtgtag

SEQ ID NO: 44395 - DNA, 486 bp, Artificial Sequence
  Description of Artificial Sequence: Synthetic coding sequence
atggtgagcaagcggatcgcccaggagaccttcgacgccgccgtgcgcgagaacattgaggaattcgccatgggccccgaggaggcggtgaaggaggcagttgagcagtttgagtcacaaggtgtggatctgtcaaatattgtcaagacggcccctaaggtgtctgctgacggtagtcaagagccaacacatgacattcttcagatgctatccgaccttcaagagtcagtggccagctcaaggccgcaggaagtgagcgcgtacttaacaagattctgcgaccagtgtaagcaggataaagcttgccgattcctggctgcccaaaagggtgcatacccaattatcttcactgcctggaagctcgccaccgcgggcgatcaaggtctgctgctccagtcactgaacgcactttccgtcctgactgatgggcagcccgacctgctcgacgcccagggtctgcaacttctcgtcgccaccttgacttag

SEQ ID NO: 44396 - DNA, 492 bp, Artificial Sequence
  Description of Artificial Sequence: Synthetic coding sequence
atgagcgagcggtgctgcagccggtacagcagcggcgccagcatcggatgtactcctactagtacgcaagccaaaatggtctctaaaagaatcgcccaggagacattcgatgccgccgtgagagaaaacatagaagaatttgccatgggcccagaggaggcggtcaaggaagcagtggagcaattcgaaagccaaggggtggatctgagcaatatagtgaaaactgcccccaaggtgtccgccgacggaagccaggagccaactcatgacatactacagatgctctcagatctgcaggaaagtgttgccagctcccgccctcaggaggttagtgcatatttgacaagattctgcgatcagtgtaaacaggataaagcttgccggttcctggctgcccaaaaaggagcttacccaatcattttcactgcctggaaactggccaccgcgggcgaccaagggctgcttctccagagtctaaatgctctttcatag

SEQ ID NO: 44397 - DNA, 780 bp, Artificial Sequence
  Description of Artificial Sequence: Synthetic coding sequence
atggtgagcaagcggatcgcccaggagaccttcgacgccgccgtgcgtgaaaatattgaggaatttgcaatgggccctgaagaggctgttaaagaggccgtggagcagtttgaaagccagggtgtcgacttgtccaacatagtgaagactgcgcccaaggtgtcagcagacggatcccaggagccaacgcatgacattctacagatgctgtccgatcttcaggagtcggtggcctccagccgtccccaagaggtgagtgcatatctgaccagattctgcgatcagtgcaagcaggacaaggcctgccggtttctcgcggcccaaaaaggtgcttaccccatcatttttaccgcctggaaattagctacagccggggatcagggcttgcttcttcagtcactcaatgcactgtcagttctaacagacggccagcctgatcttttggatgcccagggcctgcagctcctggtggccactctaactcagaacgcggatgaggccgacctgacttgctccggcataaggtgtgtacgacatgcgtgccttaaacatgagcagaatcgtcaggacctggtgaaggcaggagtgctgccactcctgacaggcgctatcacacaccacggtcaccataccgacgtggtaagggaagcctgctgggcattgagggtgatgaccttcgacgatgatataagagttccttttggtcacgcccataaccacgccaaaatgatcgtgcaggagaataaagggctcaaggtgctgattgaagctaccaaatag

SEQ ID NO: 44398 - DNA, 597 bp, Artificial Sequence
  Description of Artificial Sequence: Synthetic coding sequence
atggcccagaagcccaaggtggacccccacgtgggccggctgggctacctacaagccctggtgaccgagtttcaggagactcagagtcaggacgccaaggagcaagttttggctaatctcgccaactttgcgtacgacccgagtaattacgagtacctccgacagctgcaggtgctggacctgttcttagattccctgtcggaagagaatgaaaccctggtcgagttcgctattggcggcctgtgtaacctgtgcccagatagggctaataaagaacacattctgcatgccggcggcgtacccctaattattaactgtctcagttccccgaacgaggagacagtgctttctgccattaccaccctcatgcacctgagcccacccggccggagttttctgcccgagttaacagcgactcctgtggtacagtgcatgttgagattttctctctccgcttcagctaggttgaggaatctcgctcagatttttctggaagatttttgctctccacgacaagtcgccgaagcaagaagcagacaagctcacagcgctctgggcatcccccttcctcggtccgttgccccacggcagaggtag

SEQ ID NO: 44399 - DNA, 1158 bp, Artificial Sequence
  Description of Artificial Sequence: Synthetic coding sequence
atggaggtgaccgccagcagccggcactacgtggaccggctgttcgaccctgatcctcagaaggtcctgcagggggtcattgacatgaagaatgccgtgatcggaaacaataaacaaaaggccaatctcattgtgcttggagccgtcccccggctcctatacctcttacagcaggagacttctagcactgagctgaagactgaatgcgcagtggtcctcggctccctggctatgggcaccgagaataatgtcaagagcctgttggattgtcatattataccagctttattacaggggctactgagcccagacctgaaattcatcgaagcatgtctgagatgtctccggaccatcttcacaagccccgttacccctgaagaactgctttataccgatgccacggttataccccacctaatggcccttctgtcgcggtccagatacactcaggaatatatatgccagatcttttctcactgttgcaagggacccgatcaccaaaccatcctgttcaatcacggggcagttcagaatattgcgcacctcctgacgtctctcagctacaaagtcaggatgcaagctttaaaatgcttcagcgtgctggcatttgagaatcctcaggtcagtatgaccctggtcaacgtgctggtggatggcgaactgttgccccagatctttgtgaagatgctgcagagggataaacctattgaaatgcaattaaccagcgccaagtgtctaacctatatgtgccgggcgggggctatcagaacagacgacaattgtatagtgcttaagacgctgccctgtttagtacgtatgtgcagcaaggagaggctgctggaggagcgggttgagggtgccgaaaccctggcatacctaatcgagcctgacgtggaactgcagcgaatcgccagcataaccgaccacttgatcgctatgcttgcggattactttaagtatccgtcctcagtgagtgcaatcaccgacataaagagattggatcatgatcttaagcacgcacacgagttgaggcaagccgcctttaagctctacgccagccttggggccaatgatgaggacattaggaaaaaggtgagtctgggagagggcaggccaccagttcttaccgcctccagacagggagttaccagtacatag

SEQ ID NO: 44400 - DNA, 1992 bp, Artificial Sequence
  Description of Artificial Sequence: Synthetic coding sequence
atgagcgtgctgagcgaggtgaccgccagcagccggcactacgtggatagactgttcgatcccgacccacagaaggtcttgcagggcgtgattgacatgaagaatgccgtgatcgggaataataagcaaaaggcaaatctcatagtgcttggggccgtgccgcggttgctgtatcttcttcagcaggagacttctagcaccgaactgaaaaccgagtgcgccgtagttcttgggtctctggccatgggcactgaaaacaacgtgaagtccctgctcgattgccacataatcccagccctgttacagggcctgctcagcccagatcttaagtttatcgaagcgtgtctgcggtgcctaaggacaattttcacctctccagtaactcctgaagagcttttatataccgacgccaccgttatcccacacctaatggccttgctgtctcgatcccggtatacacaggaatatatttgtcaaatcttcagccactgttgcaagggccctgaccatcagaccattttgtttaaccacggtgcagtgcagaatatcgctcacctcctgacgtctcttagctacaaagtgaggatgcaggccctcaagtgtttctctgtgctggcattcgaaaacccacaagtctccatgacactggtgaacgtcctggtggacggagagttattaccccagatcttcgtcaagatgctacagcgggataagccgattgagatgcagctcactagtgctaagtgcctcacttatatgtgtcgcgccggggctatccgaacagacgataattgcatagtgctgaagaccctgccgtgcctagtgagaatgtgttcaaaggagcggctgttggaggagcgggttgagggcgctgaaactttagcctaccttattgagccagacgtggaacttcagcggatcgccagcatcaccgaccatctcatagcaatgttggcggattatttcaagtaccccagttcggtctccgcaattacagacatcaaacgcctcgaccacgacttgaagcacgcccacgaattacggcaggccgcctttaaactatatgcaagccttggggccaatgatgaggacatcaggaaaaagattatcgagaccgagaatatgatggatcgaatcgtgacaggccttagtgagtcctctgtgaaagtgagattggcagccgttaggtgcctccattcactgtcgaggtccgttcagcagctgcgcacctcatttcaggaccacgctgtgtggaaacccctgatgaaggtgctccagaacgcccctgacgaaatcctagttgtcgcttcatctatgctgtgcaacctgctgttggaattttctccttctaaagagcctattcttgagagcggagcggtagagctactttgcggcctgacacagagtgaaaatcccgccttgagggttaacggaatctgggccttaatgaacatggccttccaggctgagcaaaagattaaggctgatatcttacgaagcctgtccactgagcaactgtttcgcctgctgagtgactctgacctcaacgtcttgatgaagacgctgggtctgctccggaatctccttagcacacggccccacattgacaaaatcatgtctactcatgggaagcagataatgcaagccgtgacacttatcctggaaggtgagcataacattgaagtgaaggagcagacactctgcatcctcgccaacattgccgacggcacgaccgccaaggacctgatcatgaccaatgacgacatcctgcagaagattaagtactatatgggtcacagccacgtaaagctgcagctcgcagccatgttctgcattagtaatcttatctggaatgaggaggagggcagccaggaaagacaggacaagctccgcgacatggggatcgtagatattctgcataaactgtctcagtcccccgactcaaacctctgcgacaaagctaaaatggctctgcaacagtaccttgcttag

SEQ ID NO: 44401 - DNA, 597 bp, Artificial Sequence
  Description of Artificial Sequence: Synthetic coding sequence
atggcctgcctgctggagacccccatccggatgagcgtgctgagcgaggtcacagcctcttcccgacactatgtagaccggttattcgatccagaccctcaaaaggtgctgcaaggtgtcattgatatgaaaaatgctgtgattgggaacaataaacagaaggcgaatctaattgtacttggcgccgtcccacgcttgctgtacctcctccagcaagagaccagctctaccgagctgaagactgaatgtgccgtcgttttgggaagcctggcaatgggtaccgagaacaatgtcaagtctcttctcgactgtcatattattccagctcttctgcagggcctcctttccccggatctaaagttcatagaggcttgtctccgctgtctgcgcaccattttcacgtcacctgtgacacccgaagagctactgtataccgatgccaccgtcatcccccacttaatggcccttctctcacggagccgttacacacaggagtatatctgccagatcttctcacattgttgtaagggccctgatcaccagacgattctattcaatcacggggccgtacaaaatatagcccaccttctgacttag

SEQ ID NO: 44402 - DNA, 393 bp, Artificial Sequence
  Description of Artificial Sequence: Synthetic coding sequence
atgaagaacgccgtgatcggcaacaacaagcagaaggccaacctgattgtgttgggggctgtgccacgccttctttatctgttacagcaggagaccagttcaactgaactgaagaccgagtgcgcagttgtcctgggctccctggcaatgggaaccgaaaacaacgtaaaaagccttctggattgccacattatccccgccctgctccagggcctgctctctcctgatctgaaatttattgaggcatgcctgagatgtctccgcacaatttttacctcgccagtgactccggaggaactgttgtataccgacgccactgtgatcccccacctgatggccctgcttagtagaagtaggtacacccaagagtatatatgccagattttttcttag

SEQ ID NO: 44403 - DNA, 81 bp, Artificial Sequence
  Description of Artificial Sequence: Synthetic coding sequence
atggaggtgaccgccagcagccggcactacgtggaccggctgttcgaccccgatccccagaaggtgttgcaaggggtgtag

SEQ ID NO: 44404 - DNA, 2022 bp, Artificial Sequence
  Description of Artificial Sequence: Synthetic coding sequence
atggcctgcctgctggagacccccatccggatgagcgtgctgagcgaagtgacagcttcaagtcgccattacgtagatcggctgttcgaccctgacccacagaaggtattacagggcgtaattgatatgaagaacgctgtaatagggaacaacaaacaaaaagcaaacctgatcgtgcttggagccgtgcctcggttgctttatctgttgcagcaggagacctcctcaactgagcttaagaccgagtgcgcggtcgtgctgggaagcctcgcaatggggacagagaacaacgtgaagagtctcttggactgtcacataatccccgcattgctacaagggctgcttagccccgatttaaaattcatcgaagcctgtctgcggtgtcttagaaccatctttaccagtccagtgacgcctgaggagcttctctatactgatgccactgttatccctcacctgatggccctgctgagccggagtcgttacactcaggagtacatctgccagattttcagtcattgctgtaagggccctgatcatcagaccattctctttaaccatggcgctgtgcagaatattgctcacctccttacttcattgagttacaaagtccgcatgcaggctcttaagtgtttcagcgtcctagcttttgaaaatcctcaggtgtcaatgaccttggtaaatgtgctggttgacggagaactgctgccccagatttttgtgaagatgctccagagggataaacccattgagatgcagctgacctcagcaaaatgtctgacctacatgtgtagagcgggtgccatcaggacagatgacaactgcatagtccttaagacgctgccctgtctggttcgcatgtgctccaaagaacggttgcttgaggaacgggtggagggcgctgaaacgctggcgtaccttatcgagcctgacgttgaacttcaacgaatcgcatcaatcaccgaccatctgatcgcaatgctggccgactacttcaagtatccctcttcagtctcagccattaccgatatcaaacggttagatcacgatctgaagcacgcacacgagttgcgacaggccgcttttaaactttacgcctctctcggcgctaatgacgaggacatacgcaaaaaaatcatcgaaacagaaaatatgatggataggattgttacggggttgtctgaaagttccgttaaggtacgtctcgctgcagtgcggtgtcttcattcccttagtaggagcgtgcagcagttgcgcacatcgtttcaggatcatgcggtgtggaaacctttgatgaaagtgttacagaatgcccctgacgagattcttgttgtggcctcctctatgctgtgtaatctgctcctcgaattctccccctcgaaagaacccattctggaatcaggcgccgtggagttactgtgcggattaacacagtccgagaatcctgcacttcgggtgaatggcatctgggccttgatgaacatggctttccaggctgaacaaaaaattaaggctgacattctccgctcactctcaacagagcaactttttagactactctcagacagcgacctgaacgtactgatgaagacgctcggcctgctcagaaatctactgtctactaggccgcacatcgacaaaattatgtcaacccatgggaagcagattatgcaagccgtcaccttgattctggaaggtgagcataatatcgaggtgaaagagcaaaccctgtgcatcctggccaacatcgcagacggcaccaccgcaaaagatctgatcatgacaaacgatgatattctgcaaaagattaagtactacatgggccacagtcacgtcaaactccagttggccgcaatgttctgcatttccaacctaatatggaacgaagaagaaggctctcaagagcgacaggacaaattgagagacatgggaattgtggatattctgcacaaactgagccagagtccagacagtaacctttgcgacaaggccaaaatggcattgcagcagtatcttgcatag

SEQ ID NO: 44405 - DNA, 1158 bp, Artificial Sequence
  Description of Artificial Sequence: Synthetic coding sequence
atggaggtgaccgccagcagccggcactacgtggaccggctgttcgacccagatccgcagaaggtcctgcagggtgtgatcgatatgaaaaatgccgtgatcgggaataataaacagaaggccaacctgattgttttaggagcagtacctcggctgctttacctactccaacaggaaacatcgagcaccgaactgaagactgagtgcgctgtcgttctcggaagcctggccatgggcaccgagaacaacgtcaagtcgctactggattgtcacattatcccggcattgctacaggggctcttatcgccagacctgaaatttattgaggcttgcttgcgttgtctgcgcacgattttcacaagcccagtcactcctgaggagctactgtatacggatgccacggtgatacctcacctcatggctctgctatcaagatctagatatactcaggagtacatctgccagatttttagccattgctgtaaggggcccgatcaccagactatcctgttcaatcacggtgccgttcaaaatatcgcccatctgctcacaagcctctcctacaaggtcaggatgcaggcactgaagtgctttagcgtcttggctttcgaaaatccacaagtgagtatgacactagttaacgtgttggtggacggagaattgttaccccagatttttgtcaagatgctgcagagggacaagccgattgagatgcagctgacctctgctaagtgcctcacctatatgtgcagagctggagccatcagaactgatgataactgcattgtcctgaaaacgttaccttgcttagtgcgaatgtgctccaaggaaaggttgctagaagaacgagttgaaggagccgagaccctcgcatatcttatcgaacctgacgttgaattgcagcgaatcgcctccatcacggaccacctgatcgccatgctagccgactacttcaaatacccatctagtgtctccgccatcaccgacattaagcgcttggatcacgatctgaaacatgcgcatgagcttaggcaagccgcttttaaactttacgcctctcttggggcgaacgacgaggacatcagaaagaaggtgagccttggagaaggcaggccacccgtcctgaccgcgtctaggcagggggtcacatcgacttag

SEQ ID NO: 44406 - DNA, 1980 bp, Artificial Sequence
  Description of Artificial Sequence: Synthetic coding sequence
atggaggtgaccgccagcagccggcactacgtggaccggctgttcgaccccgacccacagaaagtccttcaaggggtgatcgacatgaagaatgccgtgatcggaaataataaacagaaagccaatctcatcgttctgggcgctgtacctcgactgctgtacctgctacagcaagagacttctagcacagagctaaagacagaatgtgccgtggtgcttggctctctggccatgggcaccgaaaacaacgtgaaatccctcctggattgccatatcattcctgccctgttgcagggcttactgtcacctgatctgaaatttatcgaagcctgcctgcgatgtctcaggaccatattcacctctcccgtcacgcccgaggagctcctgtataccgacgccaccgtgatacctcacctcatggccctgctgagcagaagccgctacactcaggaatacatctgccagatcttcagtcactgttgcaagggaccggaccaccagaccatccttttcaaccatggcgccgttcagaacatagcgcacttgcttacttctctgtcgtataaagtacgaatgcaggcattaaaatgttttagtgttctggccttcgaaaaccctcaggtctccatgacactggtcaacgtacttgttgacggtgagcttctcccccaaatattcgtgaaaatgttgcagagagataaaccaattgaaatgcagttaacctcggctaagtgcttgacctacatgtgtagggcaggagccatcagaacagacgataactgtattgttcttaagacacttccatgtttggtcaggatgtgtagtaaggagaggctgctggaagagcgcgtggaaggcgcagagaccctcgcctacctgatcgagcccgatgtggagttgcagagaatcgccagcataacagatcaccttattgccatgctcgctgactatttcaaatatccatctagcgtgtctgcgataacagatattaagcggctagatcacgacttgaagcacgcacatgagctccggcaggcagccttcaagctgtacgccagtctaggggccaatgacgaggatattcgcaaaaaaattattgaaaccgaaaatatgatggaccgaatcgtaaccggactgtcggaatctagcgtgaaggttcggctagcagccgtgcggtgcctgcacagtctatcgcgatcagtgcaacagctacgcacatcttttcaggaccacgccgtctggaagcccttgatgaaagtgctgcagaatgctcctgatgagatcctcgtggtggccagttcgatgctgtgtaatctgctgctggagttttcaccatccaaagagcccattttagagtctggggctgtggagctgctatgcgggttaactcagtcagagaatcccgccctgagagttaacggcatctgggcactcatgaacatggcattccaagctgaacagaagatcaaggcggatattctacggtcgctgtccactgagcagcttttccggttactgagcgattcagatttgaacgttctcatgaagaccctgggactacttcggaatctcctgagcacgcggccacatatcgacaaaatcatgtctacgcatgggaaacaaatcatgcaggcagtgacgctgatcctggagggggagcataacatagaggtcaaagaacagaccctgtgtattcttgccaacattgccgatgggaccaccgccaaggatttgattatgaccaatgatgacattctacaaaaaatcaagtattacatgggtcattcacacgtgaagctgcagttggccgctatgttctgtatttctaatctgatttggaatgaagaggagggatcacaggaacggcaagacaagttaagggatatgggcatcgtggatatcttgcataagctttcacagtctcccgatagcaacctctgtgacaaggcgaaaatggcactgcagcagtacttggcatag

SEQ ID NO: 44407 - DNA, 1896 bp, Artificial Sequence
  Description of Artificial Sequence: Synthetic coding sequence
atgaagaacgccgtgatcggcaacaacaagcagaaggccaacctgatcgtcctgggtgccgtaccccgactcctttacctgctccagcaggaaacttctagtacagaactgaaaactgaatgcgcagtggttttgggcagtctggccatgggaacagaaaacaatgtgaaaagccttctggattgtcacattattcctgccctcctgcagggcctcctgtctcccgatctgaagttcatcgaagcctgcttgagatgtctgcggactatcttcaccagcccagttacaccggaggagctgctttacacagatgcaactgtgatcccacatctcatggccctgctttctcggtcaagatacactcaggagtatatttgtcagatcttctcacactgttgcaagggccccgaccatcagacgattttgttcaatcatggagctgtgcagaatatcgcacatctcctgacttccctgtcatataaggtgcgaatgcaggctcttaagtgtttctctgtgctcgccttcgagaatccccaggtgtctatgacactggtcaatgtcttagtggacggcgagctcctgcctcagatcttcgtcaagatgctccagagggacaagccgatcgagatgcagctgacctcagccaaatgtctgacctacatgtgcagggctggagccatccgaacagacgacaattgcatcgtgctcaagactctcccgtgtcttgtgcggatgtgcagcaaagagagactgttggaggaacgcgtggaaggagcagagaccctcgcgtacctaattgagcccgacgtggagttacagagaattgcctctattactgaccacctgattgccatgctcgccgattactttaaatatcccagctctgtaagcgcaatcaccgacatcaagaggctggaccacgatctgaagcatgcccacgagctgcgtcaggccgctttcaaactgtatgcttcactgggcgcgaacgacgaggacattcggaagaagatcattgagactgaaaatatgatggacagaatagtcaccggtctcagcgaaagcagcgtgaaagttcgtttagccgccgtcagatgcctgcattcactgagtagatccgtacagcaattgaggaccagcttccaggaccatgccgtatggaaacccttaatgaaggtcctgcagaacgcccctgatgaaattttggttgtggcctcctccatgctgtgcaatctgttgttagaattctccccctcaaaggaacctatcctcgagtccggggcagtagagctgctgtgcgggctgactcaatcggagaaccctgcactgcgcgttaatggtatctgggccctgatgaatatggcctttcaagctgaacagaaaattaaggccgacattcttcgatcccttagcaccgaacagctcttccgactgctcagcgattccgacctgaacgttctgatgaaaactctcggtctcctcagaaacctgctgagtacccgacctcacattgacaagataatgtctacacacggcaaacagatcatgcaggctgtcaccctaatcctggaaggggagcacaatattgaagttaaggagcagacattatgtattctggctaatattgctgacgggactaccgcaaaggatctcatcatgactaacgatgacatactgcaaaagataaaatactacatgggccacagccatgtgaagctgcagttggccgccatgttttgtattagcaatctaatctggaatgaagaagaaggctcccaagagagacaggacaagctgcgcgatatggggatagtggacatcctgcataaactctctcagagtcctgactccaacctctgcgacaaggcaaagatggcattgcagcaatacctcgcctag

SEQ ID NO: 44408 - DNA, 1929 bp, Artificial Sequence
  Description of Artificial Sequence: Synthetic coding sequence
atggcctgcctgctggagacccccatccggatgagcgtgctgagcgaggtgacagcatcttcaagacattacgtcgaccgcctgttcgacccggaccctcagaaagtgctgcagggggtgatagacatgaaaaatgccgttattggaaataataaacagaaggccaatcttatcgtgctgggtgcagtccctcgccttctctacctgttacagcaagaaacatcttccaccgagcttaaaactgagtgtgcggtggtgcttggctcacttgccatgggaaccgaaaataatgttaagtccctcctcgactgtcacatcattccggctcttctgcaaggcttattgtcccctgacttaaagttcatcgaagcgtgcctgagatgcctgagaactatcttcacaagtcctgtgaccccagaggagctcctctatactggacccgaccaccaaacgatattgtttaaccacggcgcggtgcagaatatcgcccatttattaaccagcttgtcatataaagtgcgaatgcaagcccttaagtgtttttcagtgcttgcatttgaaaatccgcaggttagtatgaccctagtgaacgtgctcgtggacggagaactcttacctcaaatcttcgttaagatgttgcagagggacaaacccatcgagatgcagcttaccagcgcaaagtgccttacttatatgtgtagggccggcgccattcgcaccgatgacaactgtatcgtgctgaagactctcccatgcttggtaagaatgtgtagcaaggagcgtctcctggaagagcgtgtggagggtgctgaaaccctcgcgtacttgatcgaaccggacgttgaactccagaggattgcctccattacagatcacctaatcgcgatgctggccgactatttcaaatatcccagctccgtgtcagctatcactgacataaagcgccttgatcatgacttaaaacacgcgcacgagctgcggcaggctgcattcaaattgtacgcctctctcggcgctaacgatgaggatattcgcaaaaagatcatcgaaacagagaacatgatggataggattgtcacggggcttagtgaaagttctgtgaaagtccgcttggcggcggtgaggtgcctgcacagtctgtcccggtccgtgcagcaattgcgtacctcttttcaagatcatgcggtctggaagcccttgatgaaggtccttcaaaatgcaccagacgaaattttggtggtggctagcagcatgctctgtaatctcctcctggagttttcccctagcaaggagccaattctggagtctggagccgtcgagctactttgtgggctcacacaatctgagaaccctgccttgagggtgaacggaatttgggcactgatgaatatggcttttcaggccgaacagaaaatcaaagctgacatcctgaggtccctttccacagaacagctcttccggctgctgtccgatagcgacttaaacgtgctgatgaaaactctagggctcttgcgaaatttgctgagtacacggcctcatattgacaaaatcatgtctacccacgggaagcagatcatgcaagctgttaccctaatccttgaaggggaacataacattgaggtaaaggagcagaccctatgtatcctggcgaatatcgcagatggcaccacagccaaggacctgatcatgaccaatgacgatattctgcaaaagattaagtattatatgggccactctcatgtgaaacttcagcttgccgcgatgttttgcatctctaacttgatttggaacgaagaggaggggtctcaggagcggcaggataagctcagggacatggggatcgtggacattctgcacaagctttcacagtctccggattccaacttatgtgacaaagcaaaaatggctctccagcagtatctggcttag

SEQ ID NO: 44409 - DNA, 1593 bp, Artificial Sequence
  Description of Artificial Sequence: Synthetic coding sequence
taccaggacgccaccgtgatcccccacctgatggccctgctgagccggagtaggtatacacaggagtacatatgccagattttttcccattgctgcaaaggccccgatcaccaaactatcctattcaaccacggcgctgtccagaacattgcccatcttttgacttccctgtcatataaggtgagaatgcaggctttgaagtgcttctcggtgttagccttcgaaaatcctcaggtgtcgatgaccctcgtcaatgtgctagtggacggcgagctgcttccccagatcttcgtgaaaatgttacaaagggacaaaccgatcgaaatgcagttgacatcagccaagtgcctgacgtacatgtgtagagctggagccatccggacagatgataactgcattgtactgaagacactcccttgtctggttaggatgtgcagcaaggagcgcctcctagaggagagggtcgaaggagccgaaaccttggcatatttgattgaacctgatgtagagctgcagagaatcgcttctataactgatcacctcatcgccatgctcgcagattattttaagtatcctagctccgtgagcgccattacagatataaagcggctcgaccacgatctgaagcacgcacatgagctacgccaggctgcatttaagctctatgcatcactgggtgccaacgatgaggatatccgcaagaagatcattgagacagaaaacatgatggaccgcatcgttacaggcttgtcagaatcctccgtaaaggttaggttggcagccgttcgatgtctgcactcgctttcccgtagcgtgcagcaactgagaactagcttccaggaccacgccgtatggaagcctttaatgaaagtgctccagaatgcgccagacgaaatcttagtggtcgcctcaagcatgctgtgcaatctcttgctcgaattctcacctagcaaggagccaatactggagagcggcgcagtggagctgctgtgtggcctaacacagtctgaaaaccccgctctgcgagttaacggcatctgggcgcttatgaatatggcgtttcaggctgaacagaagattaaagcagatattttgcgatctcttagtaccgaacagctgtttcgattgctgagtgacagcgacttaaacgtattgatgaaaacactgggcttgctccgaaatctgctcagtacccggccacacatagataaaatcatgagtactcatggcaaacagatcatgcaggccgtgaccttgatcctcgagggagaacataacatagaagtcaaggagcagacgttgtgcattttggctaatatcgctgacgggaccactgcgaaagacttgatcatgacaaacgacgacattctccaaaagataaagtactacatgggacatagtcacgttaagttgcagctggcggctatgttttgcatctcaaacctcatctggaacgaagaggaggggtcacaagaacgacaagataagctgcgggacatggggattgttgatattcttcataagctttcccagtcacctgattctaacctatgcgacaaggctaagatggctctgcagcagtatttggcgtag

SEQ ID NO: 44410 - DNA, 1998 bp, Artificial Sequence
  Description of Artificial Sequence: Synthetic coding sequence
atgggcgacatcctggcccacgagagcgagctgctgggcctggtgaaggagtatctggattttgccgagttcgaggacacacttaagacattttccaaggaatgcaaaatcaagggaaaaccattgtgcaaaacagtgggcggtagcttcagggattctaaatcactgaccattcagaaggatctggtggccgcctttgataatggggaccagaaggttttttttgatctttgggaggagcacatcagctccagtatccgggatggggatagttttgcccagaaactcgagttctatctgcacatacacttcgctatctatcttctaaaatacagcgtgggacgtccagacaaggaggagttggacgagaaaatctcctactttaaaacctatttagaaaccaagggcgcggccctcagccagacgaccgaatttctgccattttacgccctgcctttcgtccccaatcccatggtgcacccctcctttaaagagctgtttcaggattcttggactcctgagttgaaactgaagttgattaaattcctagcactcatctcgaaggcctcaaacactccaaagctgctgacaatctataaggagaatggacagtcaaacaaagagatcctgcagcagctccaccagcaactggtggaagcagaacgtcgaagcgtgacatacctgaagaggtataataaaattcaggccgattatcacaatctcataggagtcactgctgaactcgttgactctttggaagcgaccgtctccgggaagatgattacgccagagtacctccaaagcgtctgcgttcgattgttctcaaaccagatgcgacagtcattagcccactcagtagacttcaccagaccagggacagctagcacaatgctgcgcgcctccttggcaccagtcaaactgaaggatgtccccctgctaccgtccttagactacgagaagttaaaaaaggacttgatcttggggtcagacaggctgaaagcgtttctcctgcaggcactgcggtggcggctcacaacatcacatcctggggagcagagagagaccgtattacaagcctatataagcaacgacttgctcgattgttactctcataaccaaaggtccgtgctccagttgctccactccacgtctgatgttgtgcggcaatacatggcccgtttgatcaatgcatttgccagcctggctgagggccggctgtacttagctcagaatacaaaagtactccagatgctcgaggggcggctgaaggaggaggataaggatatcatcactagagagaacgttttgggcgctctgcagaaattctcacttcgacgcccccttcagaccgcaatgattcaggacgggctgatcttttggctagttgacgtgcttaaagacccggactgtctttcagactacaccttagagtattcagtcgcccttctgatgaacctctgcctccgctctactgggaaaaacatgtgtgctaaagtcgctgggctggtactcaaggtcctcagcgatttgctgggccatgagaatcatgaaatacaaccctatgtgaatggagcgctttatagtattctttcagtgcccagcatcagagaggaagctcgcgcaatggggatggaggatattcttcggtgcttcatcaaggagggaaacgcggagatgataagacaaatcgaatttattatcaaacaacttaatagcgaggagttacctgacggcgtactcgaatctgacgatgacgaagacgaggatgatgaagaagatcacgacataatggaggccgaccttgacaaggatgagctcatccagccacagctgggcgaactatcgggagagaaactactgacaacagaataccttggaattatgaccaacacaggtaagacccgccgcaaaggtctcgcaaacgtgcaatggtccggcgacgaaccactgcaaagacctgtgacccctggcggacaccgcaatgggtacccagtttag

SEQ ID NO: 44411 - DNA, 2451 bp, Artificial Sequence
  Description of Artificial Sequence: Synthetic coding sequence
atgggcgacatcctggcccacgagagcgagctgctgggcctggtgaaggagtacctggatttcgcagaatttgaggacaccctcaagaccttcagcaaagagtgcaagattaaaggcaagccattatgtaagactgtgggcggatcatttcgtgactctaagagcctgactatccaaaaagacttagtagcagcctttgataacggggaccagaaagtattctttgatctgtgggaggaacatatctctagtagcataagagatggagatagctttgcccagaagctggagttttatctgcacattcactttgccatttacctactgaagtactcggtgggaaggcccgacaaggaagagctagacgagaaaatctcatattttaaaacctacctggagaccaagggagccgcccttagccagacgaccgagtttctgcccttctatgccttacctttcgtgccaaatcccatggtccaccctagctttaaagaattgtttcaggatagttggacacccgagctgaagctgaagctcattaagtttttggcactgatttccaaggcatcaaatactcctaagctgctgaccatctacaaagaaaacggccagtcaaataaagagattctgcagcagctacaccaacagctggttgaggcagaacgccgcagtgttacttacctaaaacggtacaataagatccaggcagactatcacaacttaatcggggtgactgcagagctggtggattcgttggaagccacagtgtctggcaaaatgatcactcctgaatatttgcaaagtgtctgcgttagactattctctaaccagatgcggcagagcctagcccacagcgtagattttacccgccctgggaccgcctctacaatgctgagagcctcattggcaccagttaagcttaaggacgtccctctgcttcccagcctggattacgaaaagctaaagaaagatctgatcctaggttccgacaggttgaaggcctttctgctgcaggcactgcgatggcgcctgactacctcacatcccggtgagcagcgtgagacagtccttcaggcttatattagcaacgacctccttgattgctattcgcataatcagcgtagtgtcctgcagttactccacagtacttccgatgttgtacggcagtacatggcacggttgatcaacgcattcgccagtctggctgagggacggctgtatctcgcgcagaacacaaaggtgctgcagatgctggaaggtcggttgaaagaagaagacaaagatattattacccgcgagaatgtcctgggggctctccaaaagttcagcctgcgtaggccgctacagacagcaatgatccaggacgggttgatcttctggctcgtagatgttcttaaggatcctgattgtttatccgattacacactggaatattctgtcgctttacttatgaatctctgtttgcggtcaactgggaagaatatgtgtgctaaagttgccggcctggtactaaaagtgttgtccgacctcttggggcacgaaaaccacgagattcaaccctacgtgaacggggccctttattcgatcttatctgtgccttccattcgcgaggaggccagagccatgggcatggaagacattctgaggtgcttcataaaggaaggcaacgcagagatgatacgccagatagagttcattatcaagcagctgaattctgaagaattgccggatggggtactagagtcagatgacgacgaggacgaagacgatgaagaggatcacgacatcatggaggccgatctggataaggatgagctgatccaaccacagttgggtgaactgtcaggtgagaagcttttgaccacagagtacctgggaattatgacaaataccggcaagacaagacgcaaaggcctggccaacgtgcagtggtccggggacgagccgctgcaacggcccgtgacacccggcggccacaggaacggatacccagtcgtggaggaccagcacacccctcctcagacagcacagcacgcccgcaacggccatccacaggccctgccagcagcccatgaagcggtctatcgtgaggggaagccatctacacccgagtcttgcgtgagtagttctagcgccatcatcgccaaacctggcgagtggctccctcgcgggcgacaagaggaacctagacccgccccgaccccccgacagcctagggaggctccccaggaccctgggaatggcgtgaccacacgagagtgtgcaagtgccttcacatgcaaaccacgggccccctgtacccctgagatgttggactggaatccccccaaagccaaggccagcgtgttggcccctctcttcagcagctgcggcccccaacaagcaagtcggcccggaagcaccgcatctagcaccaggggacttccaagtaaagaaacgcaccctaaatag

SEQ ID NO: 44412 - DNA, 501 bp, Artificial Sequence
  Description of Artificial Sequence: Synthetic coding sequence
atgggcgacatcctggcccacgagagcgagctgctgggcctggtgaaggagtacttggatttcgccgagttcgaagacaccttgaagacattctcaaaagagtgcaaaatcaaagggaagcccctttgtaaaactgtgggtggcagcttcagggactccaagagcttaacgattcagaaggatctcgtggcagcttttgataacggggatcagaaagtgtttttcgatctgtgggaggagcacataagctcctctatcagggatggggattctttcgcccagaagttggagttttacctacacattcactttgcgatctatctcttgaaatacagcgtgggtaggcctgataaagaagagctagacgagaagatttcttacttcaaaacctatctcgaaacaaagggagccgccctgagccagactacagaatttctgcccttctatgctttaccatttgtgccaaatccgatggtccatccctcttttaaagagctttag

SEQ ID NO: 44413 - DNA, 1140 bp, Artificial Sequence
  Description of Artificial Sequence: Synthetic coding sequence
atgggctacgcccggaaggtgggctgggtgaccgccggcctggtgattggggcaggggcctgctactgtatctaccgcctcactcgtgggaggaaacagaacaaggaaaaaatggcagagggtggttcaggtgacgtagacgatgctggggactgctctggcgcccggtataatgactggagcgacgacgacgacgattccaacgagtcaaaatcgatcgtgtggtaccccccatgggcacgaataggcaccgaagcaggcacacgagcccgggctcgggcaagagctcgggccactagagctcggagggctgtgcagaaacgggcatcccctaactccgacgataccgttctgagcccccaggaacttcagaaagtgttatgtctggtggaaatgagcgagaagccctacattcttgaagctgctttgattgctttgggtaataacgccgcatacgcatttaatcgggatattatcagagaccttggaggcctgcctatagttgcaaaaatcctgaacacaagagatccaattgtcaaagagaaggccctcattgttcttaacaatttgtcagtgaacgccgagaaccagcgcagactgaaggtgtacatgaaccaggtgtgcgacgatactatcaccagccgattgaactcctccgtccagttggcagggctgagactactgaccaatatgaccgtgactaatgaataccaacacatgctcgccaactcaatctccgattttttccgcctctttagcgcagggaatgaggaaaccaagctacaagtattgaagctgctattaaacctagccgaaaatccagcgatgacacgagaactgctcagagctcaggtgccgtcaagcctaggatctctcttcaacaagaaagagaacaaagaagtcattttaaagctgctggtgatatttgaaaacatcaacgacaacttcaagtgggaggagaacgaaccaacccagaaccagtttggcgaaggcagcctgttttttttcctgaaggagttccaagtatgcgctgacaaagtcctggggatcgagagtcatcacgattttctcgttaaagtaaaggtgggaaagttcatggcaaagctggcagagcatatgttccccaaatcacaagagtag

SEQ ID NO: 44414 - DNA, 1140 bp, Artificial Sequence
  Description of Artificial Sequence: Synthetic coding sequence
atgggctacgcccggaaggtgggctgggtgaccgccggcctggtgatcggagccggagcctgctattgcatctaccgattgactaggggtcgaaagcaaaacaaggagaaaatggctgaaggcgggtcaggggatgttgacgacgctggcgattgcagcggagctcggtataatgactggtccgacgatgatgacgatagcaatgagagcaaaagtattgtgtggtaccctccgtgggctaggatcggaaccgaagctggcacacgggctcgagcaagggctcgtgcacgtgcgacacgcgcccgacgcgccgtccagaaacgagcctctcccaactccgacgacactgtgttatcccctcaggaactgcagaaggtcctgtgtcttgtggagatgtccgagaagccatacatccttgaggccgccctcattgcactcggaaataacgccgcttacgcttttaatagggacatcatcagagatctcggtggactgccgattgtcgccaaaatcctcaatacccgagatcccatagtgaaggagaaggctctgatcgtcctcaataacctttctgtgaacgcagagaatcagcgacggctgaaggtgtacatgaaccaggtgtgcgacgacactattacttctcgcctaaacagcagcgtgcagttggcaggtctgcgactgctgacaaatatgaccgtgaccaacgagtatcagcacatgctggctaattctattagcgatttcttcagactgttttcagccggcaacgaggagactaaactgcaggtgctcaaactgctcttgaacctagcagagaaccctgctatgactcgtgaattactgcgcgcccaggtccccagctccctggggtctctgtttaataagaaagaaaacaaggaggttatcctgaaattgctcgtgatttttgagaatattaatgataattttaaatgggaggagaacgagcctactcaaaatcagttcggagagggctctctgttcttttttctcaaagagtttcaggtgtgtgctgacaaggtcctcgggatcgaatctcaccatgatttcctggtaaaggttaaggtggggaaatttatggccaagctggctgaacacatgttccccaaatcccaggaatag

SEQ ID NO: 44415 - DNA, 6873 bp, Artificial Sequence
  Description of Artificial Sequence: Synthetic coding sequence
atgggccggatccaggaggtgggctgggtgaccgccggcctggtgatttgggccggcacctgctactacatctacaaatttaccaaagggcgggctcagagcgtgagaaccctcgcgaggaacgggtccaccgtaaaaatggagacagtggtgggcgtgcaatcgcagacattggctatcaacgaagctgagatcaaaaccaagccgcaggtagaaatcggcgcagagactggcgcccgctccggcccaagggcagaggtggagactaaggcaactgctatcgcaattcacagggctaattctcaggccaaggctatggtgggagctgaaccggagactcagtcagagtctaaagtggtcgctgggactctagtgatgacagaagccgtcacattaactgaagtgaaagcaaaggcaagggaggtggcaatgaaagaagccgttactcagacagacgccgaggccggtaaaatagttaagaaggaagcggtgactcagacgaaagctaaagcttgggccctcgtcgctaagacggaagcgaaacgtgaagcaatgacccagaccaaggctgagacacatatcctggccgagaaggagaccgagatcaatcgtgtaatggttacgcagtctgaaaccctagccgtgcccagagaagtggccaaaatgggggctacaaacaagacaggcattgtggatgagactaagacacgcgcacttgaggaaacggtgtcagtggctaagacccagtctgaggcccggcctggcgccacagtggacgcgagagggaaccccaatggaatgtcaagggaggttgctggcgtggacatgaaatcctgtgcgcagtcccaggcagttacaaagatacagggcgatgatatgccgggaaccggggtggaggatatgggcaattgcaaaaccatgtcgagggcggagagcggagctgatacacgagcctcagcccagccacagatttttgccaagacacagaccgaggcaattccgggcgccaagattgatgcaggcggcaacacgaatgccatgtgtaaggtcggggccggagcagatgtccgggcttgcatccagccccagactgtggcaaagaaacaggccgaggtcacaagcggggcgagagtggatgggcgaggtaacacaaacgtgatttccaaagccatcactggcgcagatatgcgcgcagccgcccaacctcaggccgtggcgagcacccacgctgaggctatgagcgacgctaaggtaaagaatcggggtaacccaaatgcgatgaccaaggccggggccaaagccaatttaagagccaacagccaggtggaggcccttccggatgcaagggacaagtctagaggcaatcctaacgtgatggccaaggtgggcgatggaaccgatatgctgagctgcactcagccccagctcgttgcttctgtgcaagcagatactcttagtgacggtaagatcaaagtgaggggcaacgtgaacaccatgccaaaagagggtgctggagttgacatgaaggcccaggggatggcacagtctcaaggtgaggctctgcctaatacacgggggaaggctagaggtaaggccaaggctaaatgcaaaactgggcccgggatggacatgaaaacctgcactcaaccccaggccggcgtgaaaacccccgccgaggctctgctggattctagggtcgacggacggggcaatccaaatgccacgtcaaaggcaggcacgaaagccgatcagcgagtgtgcgggcaacctcttgtggtggccaatccccagggcgaagcgttgcctggcgctaagaacaaggtgaagggcaatccgcatacagtgctaaaggtgggcgccggggaagggacaacagacagcgcacagcccgaagccgtcgtgtcatttcagggagaggctctgcttggcactaaaaataaggtgaaaggtaatccaaatgtcgtcctcaaagccgaggtaggagaaggtgcaatgggtaccgcccagctacagataatggcctcgagtaagggggaggcccttttagattctaagaataaggttaagggtaatagcaatgcagtgtccaaggctggagctggcactgacaccacgggaagcgtccagccacagatagtcgctaattcacagggcgaggtgctgccaggggcaaagaacaagatccgtgggaatcccacaaccgtgccaaattccggggtcgggccatacaccaccgatagtgcacgcctgcaggctgtggcaaactctcagggtgaggtgttaccaggcgccaagaataaggtcaaagcgaatcttaacgccgtatccaaggcagaagccggcatgggcgctactgggtctgttcagccccaggctgtggctaactcccactgcgagacactgcctggggctaaaaacaaggtgcgcgggaattggaatgctgtttctaaggcaggtgccggcatggacacgcgcggttctgcccaaccacaggcagtcgcaaattcccaaggagaagtgcttccaggggctaaaaacaaggtgaaaggcaacccaaacgttgtgtctaaagccggcgcgagagaggacacggtcggctccactcagccccaagttctcgcgagcagccaacgggagactttgccaggggctcgaaacaaggtcaagggcaattcaaatgtcgtttctaaagcaggtgcacgagaggacactatggggtcagcccagccgcaagtggtcgccaatagccagcgagagacactgcctggcgctagaaacaaagtaaaaggcaacagtaatgccattagtaaagctgaggctggtgccggaataatgggtagtgtacaggtacaggttgtggcttcattccagggggaagtgctacctggcgccaaaaacaaggttcgcggtaactccaacgcagtccccaaggcggaagctggggccgatactgtgggatccgcacagccacaggctgttgccaattctcaatccgagacactcctgggggcccgaaataaggttaagggaaataccattgccgttccaaaggcagggaccggcgccgggacaagacacagcgcccagccccagatcgtcgcgggctcccagggggagaccctgcccggtgcaagggataaaagtatgtccacctccgaggcggaagccacagccgaagacgaagcttacgcaaaacctgaagccgaggctatgccgactagcgaatccgagggaggaagtggtacacaggcctgcagaaaaactcagccaaacattcacgactactattggaatggcattggcgtggaagactggattgcagctgagcgttggatcaagttcagattccagaccatggacggggactgggaaaattcagtatcctgggccgacgacgaaaacgaggcttccattggatcatggagtggtgcgtctgataaagccgggatcatccggagttgggccgttgcctgcgacgagacctcagtcaaaagctgggccggggcaagggccgaaaatgtggtgggaatcggaacctgggctagggccggagaacaggcatctggcggcctgtgggctgggggccagacaagcgagggtacatgggcgggcgacaaggcgtcagggggggcctggacgggcgcagaaaatcaggcctctggcggaagctgggcactggctgggaatcaggcaatcggggagctgtgggctgctggccaagcttctgatggttcatggcccggtggtcaggcctctggggtgtcctgggtaggagaggaggccattggcggaagctggacaggcgcagaaaaccaagcctccgagggatcttgggctggcgccggcgctgggaatatgtcatctgtcagctattgggccggggtagttgatcaggcaggcggcggtagctgggcgggaacctccgatcaatcaggaggagggtctaagccacggtttgaagaccaggcatcgggtgagggatcgtgggccggggccggcgggcaggcatctgggggttccatgttgggacctgaagatcagtcaagtggcagaagttgggcggatacagccgaccaggcctccggaggaagcaggctaggacatgtggaccaatccagcggcggcgcatgggccggtacccttgaccagagcggggggggctctaaacctaggtttgaaaaccaaacgacagaagaaggttcatgggcgggtgcgggcggccaggccggcggtggtagtaaagttggcccagaggaccagagctctggacggtcctgggcgaattcaggagatcaaatttcagggggattcctggtcggcattgtggatcaggccaacggagggtcatggaccggtgcaggccaccctgccagcgtcgggccaaaacctattttcgaagatcaggtctccgggcggggtagctgggcagatgctcgcgaacaagtcgtgggtgatagccggctcggcctaagagaccagtccagtggagactcttgggctgacactggcgaccaggcctctggttggttttgcgtttgtcctggtagtcagactaatggcgggtcttggggcggggcaagtggccaggacgtgggcggttctaggcctggacccactaaccagtcctcagccggctcgtgggacagtccagggagccaggtgtcggggtcttgctggacaggtgccggggccgtcgaccaagctggcggatgttctaaaccgggcttcgaggaccaggccatcggcggcggtttttggcccggcgcaggagaccagacgggagggggcagccgaccaggcagcgaggaccaatccagcggtattggctcttggggggtggccggcggccaggttctggggggagcacggccaggcccagccgatcaatcctccggcggctcgtgggcaggcaccggcaaccagtcttccggacgttcctggattggacccggcgaccaggccgtggattgctctaaacctgagtttgaagaccaggcctgcggcgggggctcttgggccggagcagggtcccaagccagtggagagagttgggctggaagccggcccggcaacgaggccattggggggagccggatggggagcgaagatcaggctactggcggatcatgggctcgaagtgaggatcaggccagcggtcggtttcaggtgagcttcgaggtagaggccaacgaaggcttttggttcggaccaggcgcagaggccgtcattggatcctggtgttggacggaagagaaggcggacatagtttcaagacctgacgacaaagacgaagccacaacggcgtctcggagtggagccggggaggaggccatgatttgtagcaggatcgaggccgaaaacaaggcctccagcgggtcttggattcgctctgaggaggtggcttacatgggtagttgcgtcggggcggaagctggagcaggcgcagaagcgggggcaggcgccgaagccggcgccggcgccggcgctgaggctggtgccgaggccggagccggcgcaggagctggaccaggcaccgagtcaggggctgggatctggagttgggacggagacgctacaacagtcgagtcacggctcggcgcaggagaagaagcgggcgtcgaatcctggaccctcgcgcgcaatgttggggaggacgagctgagtcgggagtcatccccagatatagaggaaatctccctgcggtcacttttctgggctgagtccgaaaactccaatacctttcgtagtaagagtgggaaagacgcatcgttcgagtctggagcaggtgacaacacttctattaaggataagttcgaagccgccggcggagtcgacatcgggtcttggttttgcgcagggaatgagaataccagcgaagacaaaagcgcacccaaagctaaggccaaaaaatctagtgagtcccgaggtatttacccctatatggttcccggggcaggcatgggttcttgggacggcgcgatgatctggtctgagaccaagttcgctcaccagtctgaggcatcattcccagtggaggatgaatcacggaagcagacacgaacgggggagaaaacacgtccatggtcatgccgatgcaagcatgaagccaacatggatccgagggatcttgaaaagctgatctgcatgatcgagatgactgaggaccccagtgtccatgaaatcgccaataatgccctgtataactccgccgattactcatactctcacgaagtggtccgcaatgtcgggggaataagtgtaattgagtccttgttaaataatccatatcccagtgtccggcagaaggcattgaacgccctgaacaacatcagtgtggcggccgaaaatcaccgcaaggtaaaaacgtatctcaatcaggtgtgcgaagacacagtgacctatcctcttaactcgaacgttcaattagctggattgaggctgattcggcacctaacaattaccagcgagtaccagcatatggtcaccaattatatctcggagttcttaaggcttctgacagtgggaagcggcgaaactaaggaccacgtgctaggaatgctgctgaatttctcaaaaaaccccagtatgaccaaggatctgcttatcgccaacgctcctacttccttgattaatatcttctcaaagaaggagactaaggagaacattttaaatgctctcagcctatttgagaacatcaattatcacttcaagcgaagggctaaggctttcactcaggataaattcagtaagaactccctgtactttctgttccagcggcctaaggcctgtgcgaagaagttgagagctctagccgcagagtgtaacgacccagaagtcaaggagcgggtcgaattgttgatttctaaactatag

SEQ ID NO: 44416 - DNA, 903 bp, Artificial Sequence
  Description of Artificial Sequence: Synthetic coding sequence
atgggccgggcccgggaggtgggctggatggccgccggcctgatgatcggcgccggcgcatgttattgcgtttataagctgaccattggcagagacgattccgagaaactggaggaagagggggaggaagaatgggatgacgaccaggagctcgatgaggaagagcccgatatttggtttgatttcgagacaatggccaggccatggaccgaggatggggactggactgagccaggcgcgcctggaggcacagaggatcggccctctgggggagggaaagcaaatcgggcccacccaatcaaacagaggccttttccatatgaacacaagaacacctggtcagcccagaattgtaagaatggttcctgtgtgcttgacctcagtaaatgcttattcatccaaggcaaattactatttgctgagcctaaggacgccggatttcctttttcacaggacatcaatagccatttggcaagtctcagcatggcacggaacacctccccaacccctgaccccaccgtacgtgaggccctttgcgcacccgacaatctgaacgccagcatagagtctcagggccagattaagatgtatattaacgaggtttgtagagagaccgtgtctaggtgctgcaatagcttcctgcagcaggctggactcaatttacttatatctatgaccgtcataaacaatatgctggcaaagtctgccagcgatctgaaatttcccctaatatccgaagggtcaggctgcgctaaggttcaggtcctgaaaccacttatgggtcttagtgagaaaccggttctagcaggggagctggttggagcccagatgctgtttagcttcatgagcttgttcatcagaaacggcaacagggaaattcttctcgagacacccgcaccgtag

SEQ ID NO: 44417 - DNA, 903 bp, Artificial Sequence
  Description of Artificial Sequence: Synthetic coding sequence
atgggccgggcccgggaggtgggctggatggccgccggcctgatgatcggcgctggggcctgttactgcgtgtacaagttgaccattggacgggacgacagcgaaaagctggaggaggagggagaagaagaatgggacgacgaccaggaactcgacgaggaagagccggatatctggtttgacttcgagaccatggccaggccctggactgaggatggagactggaccgagcctggcgcccctggaggtacggaggatagaccatccggcggtgggaaagctaaccgtgcccatccgattaaacagcgaccgttcccatatgaacacaagaatacatggtcagcccagaactgcaaaaatgggtcatgtgtgctcgacctcagtaaatgtctgttcattcagggcaaactgctgtttgccgaaccaaaagacgccggcttccctttttcacaggatattaactcccacctagcctcactcagcatggctcgcaacacctcgccaacgcccgatccaacagtgagggaggctctgtgtgcccctgacaacttaaatgcaagcattgagagccaaggtcagatcaagatgtacatcaatgaagtctgccgggagaccgtgtctagatgttgcaatagttttcttcaacaggcgggtcttaacctcctgatcagcatgaccgtcattaataacatgttagcaaagtctgcttccgatctgaagtttcccttaatctccgagggtagtggatgtgcaaaggtccaggtgctgaaacctctgatgggactatcagagaagcccgtcctagccggcgagttggtgggggctcagatgctcttctcctttatgtccctgttcattcgaaacgggaaccgcgagattttactggagacgccggccccatag

SEQ ID NO: 44418 - DNA, 903 bp, Artificial Sequence
  Description of Artificial Sequence: Synthetic coding sequence
atgggccgggcccgggaggtgggctggatggccgccggcctgatgatcggcgccggtgcatgctattgtgtgtataagctaactatcggacgggacgattcagagaagctggaggaggagggcgaggaggaatgggatgacgatcaggagcttgatgaagaagaaccggacatttggttcgactttgaaactatggctaggccgtggactgaggatggcgactggaccgaacctggcgcgccgggcggcacagaggatcgaccttctggaggaggtaaagcaaaccgggctcatcccatcaagcaaagaccatttccgtatgaacacaaaaatacatggtctgcgcagaattgcaaaaacggaagttgcgtgctggacctgtctaagtgcctgtttattcagggcaagctgttgtttgccgagcctaaggatgctggcttccctttctcccaagatatcaacagtcatcttgcttcgttgagcatggctcgtaatacatcccctactcctgatcccaccgtgagagaggccctctgtgctccagacaatcttaacgctagtattgaatcccagggccaaatcaagatgtatatcaatgaagtttgtcgcgaaacagtgagcaggtgctgtaatagtttcctgcagcaggcaggcctgaatttgcttattagtatgaccgtaataaacaacatgctggccaaaagtgcatctgatcttaagtttccactgatttccgaagggtcaggctgtgccaaagtccaggtgttgaaaccactcatggggctttcggagaagcccgtgttggccggtgaactggttggagcccaaatgctgttctcttttatgagtttgttcattagaaacggaaacagggagattcttctggagacccctgccccatag

SEQ ID NO: 44419 - DNA, 1677 bp, Artificial Sequence
  Description of Artificial Sequence: Synthetic coding sequence
atggtggacagcggcaccgaggcccgggcccggggcaaggccgaggctgggcttcaggacgggatttctggccctgccaccgcccgggtcaacggaaagacccaggctgaagccgtcgccgaagccgagctgaaaacagaatctgtgactcaggctaaggcaggggacggagcgatgacgagaacccataccgtgacttaccgagaggctatggcagtgaccagggaagtcattaaagtggaggacaccaccaagaccagagtgatggttgaaacaaagaccaagccactggccgagagatctatcgtgccacagactaagagcaaagctatgcccatgtctcgagtgtcaacggtgaccaaaagcgaagttaaagtagtcgctgtgatcgaggccaatatcaggtcttacgcgaagagtcacgacaaggccaacacagggtctagacctgataggcgagaggaaacaagtatcggaatgaaatcctcagatgaagacgaggagaacatatgctcatggttctggacgggtgaggaaccttctgttgggagttggttttggcccgaggaggaaacctccttgcaggtgtataaacctcttcctaagatacaagaaaagcccaaacccacccacaagcctacattgaccatcaagcagaaggtgatagcctggtcccgagcccggtatatagtgctagtgccagtggaggggggggagcagtctctacctcccgaaggcaactggactctagtggaaacactgatcgaaactccattggggatcaggcctttgactaagattcccccttatcacgggccgtactaccagaccctggcagagatcaagaaacaaatcaggcagagggagaaatatgggcctaaccctaaggcctgccactgcaaaagccgaggcttcagtctagagcccaaggaattcgataagcttgtcgccttgctgaagcttaccaaggatccttttattcacgagatcgccaccatgatcatgggtatctctccggcttacccgttcactcaagacattatccacgatgtcgggattaccgtaatgatcgagaacctggtgaacaatccgaatgtcaaggagcatcccggcgctctgtcaatggttgacgactcgagtgagtcgtcagaagaaccaaagtccggcgagtcctacatccaccaagtctgtaagggtatcatcagttgtcccttgaactcacctgtgcagctggctggcttaaagcttctcggccacttgtctataaagttcgaggaccattatgtgatcaccagttatattcctgacttcttaacgctcttaaacaaggggagcgttaagacgaaattctacgtgctgaaggtcttttcttgtctctctaaaaaccatgccaatacacgcgaactgatttctgctaaggttctctcctcgctggtagcccctttcaataagaatgagagcaaggccaatattctcaacattatcgagatcttcgaaaatatcaactttcagtttaagacaaaggcaaagctgtttacgaaagagaagttcactaagtcagagctaatttctattttccaggaagccaagcagttcggacagaaattgcaagaccttgccgagcattccgacccggaagtgagagacaaggtcatccggctcatcctaaaactgtag

SEQ ID NO: 44420 - DNA, 1677 bp, Artificial Sequence
  Description of Artificial Sequence: Synthetic coding sequence
atggtggacagcggcaccgaggcccgggcccggggcaaggccgaggcagggctgcaggacggcatctccggcccagctactgctcgcgtaaacggtaagacacaagctgaggctgtggccgaggcggaacttaagacagagtctgtgacccaagcgaaggccggtgatggggcaatgaccagaacccatacagttacttatcgggaggccatggccgtgacccgggaggttatcaaagtggaggataccaccaaaacaagagtgatggtggaaaccaagaccaaacccctcgccgagaggagcattgtgcctcagactaagtctaaggccatgccaatgagcagggtctctactgtgactaagtcagaagtgaaagttgtggcagtcatagaggctaatatcaggtcttacgcaaagtcgcacgacaaagccaacaccggaagcaggcccgaccggcgggaggaaacttcaatcggtatgaaaagcagtgacgaggacgaagaaaatatctgcagctggttctggaccggagaggagccatctgtcggatcgtggttctggccggaagaggagacatccctgcaagtgtacaagcctttgcccaaaatccaagaaaaacctaagccgactcacaagcctaccctcacaatcaagcagaaggtgatcgcctggagccgagcaaggtacatagtcctcgttcccgtcgagggtggcgagcagagccttccgcccgaggggaactggaccctggtggaaactctgatcgagactcccttggggatacgccctttgactaagatccccccttaccatggcccttattatcagacactggccgagataaagaaacaaatccgccagcgagaaaagtacgggcctaaccccaaagcctgccattgcaagtctcgaggattctctctcgagcctaaggaattcgataagctcgtcgccctgcttaagcttacgaaagatcccttcattcacgagatcgccactatgattatgggcattagcccagcctatccttttacccaggacatcatacatgatgttggcattaccgtcatgatcgagaacctggtgaataatcctaatgtgaaagagcatccaggggctctttctatggtggacgattccagcgagtcatcagaggaacccaaatctggcgagtcatacatccaccaggtgtgtaagggtatcatatcctgtccgttaaactcccccgtgcagttagccggcttgaagctactcggtcacctgagtattaagttcgaggaccattatgtaattaccagttacatcccagactttctgacactgcttaacaaagggtcagtaaagaccaaattttacgtgctcaaggttttttcctgcctatccaagaaccacgcaaatacaagggagttaatttccgctaaagtgttatctagtctcgtggccccctttaacaagaacgagtcaaaagccaatatcctgaacattatcgagatttttgaaaatataaattttcagtttaagactaaggccaagctgttcacgaaggagaagttcactaagtccgagctcatttccattttccaggaagctaaacagtttggacagaagctccaggatctcgctgaacacagtgatccagaagtccgagataaggtcatccggctgatccttaaactgtag

SEQ ID NO: 44421 - DNA, 1677 bp, Artificial Sequence
  Description of Artificial Sequence: Synthetic coding sequence
atggtggacagcggcaccgaggcccgggcccggggcaaggccgaggcagggctgcaggacggtattagcgggcctgctacagctcgcgtaaatggtaaaactcaagctgaggcagttgccgaggccgagcttaaaactgaatccgtcactcaagccaaggccggcgatggcgctatgactaggacacacaccgtcacctacagggaagctatggctgtcacccgagaggtgatcaaggtggaagacacgaccaagactagagttatggttgagacaaaaactaagcctctagccgagcgctccatagttcctcaaactaaatcaaaggccatgccaatgagccgtgtttccaccgtaacaaagtcggaggtcaaagttgtcgccgtgatcgaggctaacattaggtcctacgccaagtctcatgataaggctaataccggttcccgtccggacagaagagaggagacatccatcggaatgaagtccagtgacgaggacgaggaaaacatctgcagttggttctggaccggggaagaaccaagcgtggggagttggttttggcctgaagaagaaacttccctgcaggtgtacaaacctcttcctaagattcaggagaagccaaagcccacccataagcccacactgaccattaagcagaaggtcatcgcctggtccagggcgcgatacattgtacttgtgccagtggaaggcggcgagcaaagcctaccaccagagggcaactggaccctggtagagacattgattgagaccccactcgggattaggcctctcaccaaaatccctccataccacggcccatattaccagacgttggccgaaatcaaaaaacagatcagacagagggagaaatacggcccaaaccccaaggcgtgccattgcaaatctcgaggattcagtttggaaccgaaggaatttgataagctggtggcgctcctgaaattgactaaagacccctttatccatgagattgcaaccatgatcatgggcatatctcccgcctatccctttacccaggatatcatccacgacgttggcattactgtgatgattgaaaatttggtgaataacccaaacgtgaaggaacacccaggggccctgtcaatggtcgacgattcatctgagtcctcagaggagcccaaaagtggggaaagctacattcaccaagtgtgtaaagggatcattagttgcccgcttaactccccggttcagctggctggtttgaagcttcttgggcatctttcaatcaaattcgaagatcattatgttatcacatcatacattcccgacttcctgactttactgaacaagggatcggtcaaaacaaagttctatgtgctgaaggtattttcctgcctatccaagaatcacgccaacaccagagagctgataagtgcaaaggtgctatcctctttggtggctcccttcaataaaaatgaatccaaggccaacattctgaacatcattgagatttttgagaacattaacttccagtttaagacgaaagctaagctcttcactaaggaaaaatttactaaatccgagttgatttccatctttcaggaggctaaacagtttggccagaaactgcaggatttggcagagcattcagatcccgaggtgagggacaaagtgatccggttgatcttgaagctgtag

SEQ ID NO: 44422 - DNA, 1677 bp, Artificial Sequence
  Description of Artificial Sequence: Synthetic coding sequence
atggtggacagcggcaccgaggcccgggcccggggcaaggccgaggctggcctccaggatggaatcagtggccctgctaccgcccgcgttaacgggaaaactcaggctgaagccgtggctgaagccgagctcaaaaccgagtccgtgactcaagctaaagcgggtgatggtgcaatgacccggacacacacagtgacttatcgggaggctatggcggtgacacgggaggtaatcaaggtggaggacaccacaaaaactcgcgttatggtcgagaccaaaaccaaacccttagcagagcggtcaatcgttccccagaccaagagcaaagcaatgccaatgtcacgggtgtccactgtcacaaaaagtgaagttaaggtcgtggcagtcatcgaggctaacattcgaagctatgccaagtcacatgacaaagcaaacacaggctcacggcctgacagaagagaagagacgagtatcggcatgaagagttcagatgaggacgaagagaatatatgttcctggttttggactggagaagagccttccgtcggctcttggttttggccagaagaagagacctctctccaagtgtataagccccttcccaagatacaggaaaagcccaagccaactcataagcctactttgactattaaacagaaagtaattgcttggagcagagctcggtatatcgttctggtacctgtggagggcggtgagcagtctttgccacccgaagggaattggacgcttgttgagacgctgattgagaccccactgggaattcgcccgctcactaagatccctccctatcatggaccgtactaccagaccctggcagaaatcaaaaagcagatcaggcaacgggagaagtatggcccaaaccccaaagcctgtcattgcaaatccaggggtttttctctggagcctaaggagtttgataagctcgtcgccctcctaaaactgactaaggacccttttatccatgagattgctactatgattatgggcatctcacctgcctacccttttacccaggatatcatccatgacgtgggaatcacagtcatgattgagaacctggtcaataatcccaatgtgaaagaacaccctggagccctcagcatggttgacgatagcagcgaatcaagcgaggagccgaagagtggagagagttacatccatcaggtatgtaagggaattatttcctgccctttaaattcaccagttcaactggcaggactcaaattgttggggcatctgtctataaagtttgaagaccactacgtgataacatcctatatccccgacttccttaccctgttaaataaaggcagtgtgaagaccaaattttacgtcctgaaagtgttttcttgtttgtccaagaaccacgctaacacccgggagctcatctccgcaaaggtcctgagttcgctggtggccccattcaacaaaaatgaaagcaaagcaaacattctgaatattatcgagatctttgagaacatcaacttccagtttaagaccaaggcaaaactgtttacaaaagaaaagttcaccaagagcgaactcatcagtatcttccaggaagctaagcagttcggccaaaaacttcaggatcttgccgaacactctgatcctgaagtgcgtgataaggtgatccggctgatcctgaaattgtag

SEQ ID NO: 44423 - DNA, 1677 bp, Artificial Sequence
  Description of Artificial Sequence: Synthetic coding sequence
atggtggacagcggcaccgaggcccgggcccggggcaaggccgaggccggactgcaggacggcatttccggccctgccaccgccagagtaaatggcaaaacccaggccgaggctgttgccgaagcggagctcaagactgagtccgtgacacaagcaaaggcaggggatggtgcgatgacacgaactcacaccgtcacctacagggaagcaatggcagtcacacgagaggtgattaaggtcgaagataccactaagacccgtgtcatggtcgagaccaagactaagcccctggccgagcgctctatcgtccctcagaccaagtcaaaagcaatgcccatgagccgagtgtccacagtcaccaaatcagaggtcaaggttgtcgccgtgatcgaggcaaacatcagatcatacgcgaagagtcatgacaaagccaacactggctcgaggcccgatcggagagaagagacgagcatcggcatgaagagttccgacgaggacgaagaaaatatctgctcttggttttggaccggcgaagaaccctccgtgggaagctggttctggccagaagaagagacatcccttcaagtgtacaaacctctacctaagatccaggagaaacctaagcccacccataagcccacacttactatcaagcagaaagtgattgcttggtcacgcgccagatatattgtactcgtgccagtggaaggcggggaacagtccctgccgccagagggaaactggactctggtcgaaacattgattgaaacaccactggggatccgtccactgacaaagatccccccctatcacggaccatattaccagaccctggccgaaattaagaaacagatcaggcagcgggaaaagtatgggcctaatcccaaagcttgccattgcaagtccaggggcttctccctggaacctaaagaatttgacaaactggtggctcttctgaaattgaccaaggatccattcattcatgaaattgcaacaatgattatgggaatctcccccgcttatccctttacccaagatattattcacgatgttgggattacggtcatgattgagaacctcgtgaataatcccaacgtgaaggagcacccaggcgccctctcgatggtggatgacagctctgagtcctctgaagaacctaaatcaggagaaagctacatccatcaggtctgcaagggcattatttcttgtccactcaattctccggttcagcttgctggtctgaaactcctgggccacttgtcaatcaagttcgaagaccattacgtaatcacttcatacattcctgactttctcaccctccttaacaaaggaagcgtgaaaaccaagttctacgttttaaaggtgtttagctgccttagcaagaatcacgctaacacacgcgagttaatatctgcaaaggtcctcagctcactggttgctccatttaataagaacgaaagtaaggcaaacatccttaacattatcgagatttttgaaaacatcaactttcagttcaaaacgaaggctaaattattcaccaaagaaaaatttaccaagtccgagctgatttccatatttcaggaggccaaacaattcggccagaagctgcaagatctggccgaacattcagatcctgaggtgagggataaagtcattcggttgatcctgaagctctag

SEQ ID NO: 44424 - DNA, 633 bp, Artificial Sequence
  Description of Artificial Sequence: Synthetic coding sequence
atgttcgagagcttcaacgtgcccggcctgtacatcgccgtgcaggctgtactggccctggccgcatcatggacgagtagacaggtgggtgaaagaaccttgactggcattgtgatcgattccggtgatggcgtgactcatgtaatcccggtagctgagggctacgtgataggaagctgtatcaaacatatccccattgcaggacgggacatcacgtacttcatacagcagctgctgcgggagagggaggtcgggatcccccccgagcagagtttagagacagctaaggcaattaaagagaagtattgctatatctgccccgacatcgtgaaagaatttgcgaagtatgatgtggacccacagaagtggatcaagcagtacacaggaatcaacgccattaaccagaagaaattcgttatcgatgttggatacgagcgtttcctggggcccgagatcttcttccaccctgaattcgcaaaccctgattcaatggaaagcattagcgacgtcgtggacgaggtgatacagaactgtcccattgatgttaggagacctctttacaaaatggagcagattcctttaagctacccgcagggccatggttttcacccactgtctcctccattccattag

SEQ ID NO: 44425 - DNA, 156 bp, Artificial Sequence
  Description of Artificial Sequence: Synthetic coding sequence
atgttcgagagcttcaacgtgcccggcctgtacatcgccgtgcaggctgtccttgcccttgcagcctcttggacaagtagacaggtcggcgaacgaactctcaccggaatcgtgatagacagtggagacggggtcacacatgtgattccagtctag

SEQ ID NO: 44426 - DNA, 633 bp, Artificial Sequence
  Description of Artificial Sequence: Synthetic coding sequence
atgttcgagagcttcaacgtgcccggcctgtacatcgccgtgcaggctgtgttggcattggcagcttcatggacaagccgccaggtaggcgagaggactctcacgggcatcgtgattgatagtggcgacggagtgacacatgtgatcccggtcgccgaaggctacgttatagggagctgcattaagcacattcctattgctgggagggacattacatacttcatccaacagttgctgcgggaacgtgaggtaggcatcccccccgaacagtcacttgaaactgccaaggctatcaaagagaagtattgttacatctgccctgacatcgtgaaggagtttgcgaaatatgatgtggaccctcagaagtggattaaacagtatactggcatcaacgctatcaatcagaagaaattcgtcatcgatgtaggctacgagcgcttcttaggacccgagatcttcttccaccctgaatttgcaaaccctgacagcatggagtccattagcgacgtagtggatgaggtgatccagaattgccccatcgatgtgaggaggccactctacaagatggaacagatcccccttagttacccgcagggacacggcttccatccactatcacctccttttcattag

SEQ ID NO: 44427 - DNA, 1878 bp, Artificial Sequence
  Description of Artificial Sequence: Synthetic coding sequence
atgaccgccaccctgcggccctacctgagcgccgtgcgggccacccttcaggcagcattgtgtctcgagaacttcagttcgcaggtggtggagcgacacaataaacctgaagtcgaggtgcgtagctccaaggaactgctccttcaacctgtgactatatcccggaacgagaaagaaaaagttctgattgagggtagcataaacagtgtccgagtgtcaattgccgtaaagcaggctgacgagatcgaaaaaattctgtgtcataaattcatgcggtttatgatgatgagggccgagaatttctttattcttagaagaaagccagtcgagcagaagaaaatcttcaccatccagggatgctatcccgtgatcagatgtctactgagacgcaggggctgggtcgagaagaagatggtccatcgcagtggcccgaccctgttgccacctcagaaggatctggattcctcggcgatgggagactctgataccaccgaggatgaagatgaggacgaggacgaagagttccaacccagtcagctgtttgactttgatgatctcctcaaattcgacgacctggacggaacacacgctctgatggtggggctgtgtctgaatttaagaaatctgccctggttcgatgaggttgacgcgaattcttttttccctcgttgttattgcttaggggctgaagacgataaaaaggcctttatcggtgacaagcaacctaaaaaacaagagaagaaccccgtcctggtgagtcccgagttcgtcgacgaggctttgtgcgcatgtgaggagtacctttcaaatttagctcacatggacattgataaggatctggaagcacccctctatcttactcctgagggctggtcactgtttctccagcggtactaccaggtagtacacgaaggcgccgaactcagacatttagacacacaggtccagagatgtgaggacatccttcagcaattgcaggccgtggtgcctcagattgacatggagggcgatagaaatatctggatagtcaaacctggcgccaagagccgtggtaggggtataatgtgcatggaccatctggaagagatgcttaagctcgtcaacggcaaccctgttgtgatgaaagacggcaaatgggtggtacaaaagtacatagagaggccgctcctaattttcggtaccaagtttgatctgcgccagtggtttttggtgacggactggaatccactgaccgtgtggttttacagagactcctacattagattttcaacccaaccttttagccttaagaatctagataatagtgtgcatctttgcaataattccattcagaaacatctggagaattcttgtcacagacatcccctgctgcctccagataatatgtggagcagccagcgcttccaggcccaccttcaagagatgggcgccccaaatgcgtggtccaccattattgtacccgggatgaaggatgctgtgattcatgcactgcaaacctcacaggacaccgttcaatgtcgtaaggcatcatttgagctgtatggggccgatttcgttttcggtgaggactttcagccgtggctgattgaaatcaacgccagtcctaccatggccccgtctacggctgttaccgcaagactgtgcgctggggttcaggcagataccttgagggtggtgatcgatcggatgctggaccgcaactgcgacacaggagcattcgagctcatctataaacagcccgtgacaacatcaccagccagtaccccaagaccctcttgtttactacccatgtattctgatacccgggccaggtcgtcggacgacagtacagcctcatggtgggccctgaggccttgcaggccgcaggcccgtccctag

SEQ ID NO: 44428 - DNA, 1683 bp, Artificial Sequence
  Description of Artificial Sequence: Synthetic coding sequence
gccggcccccgggccgcctgcagcgagcccaacccctgcacccaggtggtaatgaactctcactcttacaacggttctgtggggaggcctctgggatctggtcccggagccttggggcgcgacccaccagaccccgaagcaggccaccccccacagcccccccatagcccagggctccaagtcgtggtggcaaaaagcgagccggcccgaccgagcccagggtcgcccaggggacaaccacaggaccaggatgacgatgaagacgacgaagaagatgaagctgggcggcagagagcctctggaaagccatccaatgttggccaccgcctgggacacaggcgcgccctgttcgagaaacggaaaaggctttctgattacgcactgatcttcggcatgtttggcatagtcgttatggtcacggagactgagctttcctggggcgtctatactaaagaatctctgtattcctttgcactgaagtgtctgatttctctgtcaacagctatcctcctggggctcgtggtactctaccacgccagggagatccagctgttcatggtagacaacggcgccgatgactggaggattgcgatgacctgcgaacgggtgttcctgattagcctggagttagcggtgtgtgctatccacccagtccccggtcactacagattcacatggaccgccagactggcctttacttacgcgcctagcgttgcggaggctgacgtggacgttcttctgagtatcccaatgttcctccggctatacctgctcggtagggtcatgctgctccattccaaaatctttaccgatgcgagctcacgcagtataggagctttaaacaagattacctttaatactcgatttgtgatgaagaccctcatgaccatctgtcccggcacagttctgctcgtgttctctataagtagttggattatcgccgcatggaccgtgcgcgtttgcgagcgttaccacgataaacaggaagttacttccaactttctcggggccatgtggctcatcagtatcacattcttgtcaataggttacggcgacatggttccgcatacctactgtggcaagggcgtgtgccttctgactggcatcatgggcgctggctgcactgctctggtggtagccgtagtggcacgcaagctggagcttacgaaggcggaaaagcacgttcataactttatgatggatacccagctgacaaaacgagtgaagaacgccgccgcgaacgtgttgcgggagacctggttgatctataagcatactcggctggtaaagaagcccgaccaggccagagtaagaaagcaccagcgcaagtttctgcaagctatccatcacggccgaatgcttcgcagtgtaaaaattgagcaagggaagctgaacgaccaagccaacaccctcacagacttggccaaaacacagaccgtgatgtatgatctcgttagcgagctgcacgcccagcatgaggagttagaggcccgcctagcgactctagaatccagactggacgcacttggcgcctctctccaggccttgccagggttaattgcccaagcaatccgcccgccaccacctccgttgcctccacggcctgggcctggacctcaggaccaggccgcacgttcgagcccttgccgatggactccagtcgctcccagcgactgtggttag

SEQ ID NO: 44429 - DNA, 1209 bp, Artificial Sequence
  Description of Artificial Sequence: Synthetic coding sequence
atgcggagcggcggcgtgcggagcttcgccctggagctggcccgggggcccggcggggcctaccgaggcggggagcgtctgtgcggacgcgtgctgttggaagccgcagcccccctgcgagtgagggcgctggaagttaaggcgcgcggaggcgccgccactcactggctcgaagggcgctccgttggcgtgaatgccgtttcaagcgactacgctgcagctgaaacctatcttcgccgccgacaactgctgttacgcgatactggcgagaccaccaccctgccacctggaagacatgaatttctgtttagctttcagctaccaccaaccttagtaaccagctttgagggaaagcacggatcagtccgttactgtatcaaggcgacactgcacaggccctgggtgcctgcacgaagagcccgcaaggtgttcacagtgatcgagcccgtcgacatcaacacacctgcactgcttgcccctcaggctggcgcaagggagaaggtggcacggagctggtactgtaaccgaggacttgtgtctttaagtgcaaagatcgaccgaaagggatatacacccggagaagtaattccagtctttgctgaaattgataatgggagtactagacctgtcctgcctcgtgctgcagtggttcagactcagacatttatggctcgtggggctcggaaacagaaaagagctgtggtggcctcattagcaggggaacctgttggccccgggcagagggcactgtggcaggggcgtgcgctgcgaattccaccggtgggccccagtattttgcactgccgggtacttcacgtggactacgccctcaaagtatgcgtggatatacccggaacctcaaagctgctgctggaactgcctttggtcatcgggactatccctctgcacccatttggctccaggagctcatccgtgggttcccatgccagcttcttgctggactggaggctgggcgccctacctgaaaggcccgaggctccgcccgaatatagcgaagttgtcgccgatacagaagaggcagccctggggcagtctcccttccctcttccacaggatccggacatgtccctcgaaggacctttttttgcttatatccaagagttcagatatagaccaccgcctctctacagcgaggaggatcctaaccccttgctaggcgatatgaggccccgctgtatgacatgctag

SEQ ID NO: 44430 - DNA, 1257 bp, Artificial Sequence
  Description of Artificial Sequence: Synthetic coding sequence
atgggcggcgaggccggctgcgccgccgccgtgggcgccgagggcagagtgaagagcctcggtctggtcttcgaagatgaacgtaaggggtgctattccagcggcgaaacagtggctgggcacgtcctcctggaggcctccgaaccagtggccctgcgcgctctcaggctcgaggcccaaggacgtgctactgcagcttggggacctagcacctgtcccagagcatcagcatcaactgctgctctcgcggttttctccgaggtggagtacttaaatgtgcgcctttcattgcgggagcccccagcaggcgagggcattatcttactgcagcctggcaaacacgagttcccctttaggtttcagctgccaagtgagccactcgtcacatccttcacaggcaagtatggtagcatccagtattgcgtacgggccgttctagagcgtccaaaggttccagatcagtcagtgaagcgggaactgcaggtcgtatcccatgtggatgtcaacacccccgcactgctgactccagtcttaaaaacgcaagaaaagatggtgggctgttggttcttcacatccgggcccgtgtcattatccgccaaaatagagaggaaaggctattgcaacggtgaggccattcccatctatgccgagatagagaactgtagcagccggctgatagtgcccaaggccgccatttttcagactcagacttacctcgcctccggcaagactaagactattcgccatatggttgcaaatgtcaggggcaatcacatcgcctccggcagcactgacacatggaacggtaaaaccctgaaaatccctccggtcacccccagtatcctggattgttgtataattcgtgtagactatagccttgccgtgtacatccacatcccaggagctaaaaagttaatgctcgagctacccttggtcatagggaccatcccctataacggattcggttcaagaaattctagtatagcctcccaattctccatggacatgagctggctaaccctcaccctgcccgagcaacctgaggcccctcccaattacgcagacgtggtgtcggaagaggagttcagccgacatatcccaccataccctcagcctcctaattgtgagggggaggtgtgttgccccgtcttcgcttgtatccaagagtttcgattccagcctccgccattgtatagcgaggtggatccccaccccagtgacgtcgaagagtctcagccagtcagtttcattctctag

SEQ ID NO: 44431 - DNA, 996 bp, Artificial Sequence
  Description of Artificial Sequence: Synthetic coding sequence
atgcagggcgaggccgacgcccggaccggctgcgccgagtggcagggtgagggaattattctgctgcagcctggcaagcatgaattcccgttcagattccaactgcctagtgagcccctggtgacttctttcactggtaagtacggatccattcagtactgcgtcagagccgttctagaacgcccaaaagttcctgatcagtctgttaagcgagagcttcaggtggttagccacgtggatgtgaacactcctgcgctcctaactccggtgctaaaaacacaggagaagatggtgggctgctggtttttcacatcaggaccagtgtccctgtccgccaaaatcgagcggaaggggtactgtaacggcgaagccatcccaatttatgccgagattgagaattgctcttctaggctcattgtgcctaaagccgctatcttccagacccagacttatctggccagtggaaagactaagactatcagacatatggtcgccaacgtgagggggaatcacattgcgagcggctctacagacacctggaatggtaagaccctcaaaattccaccagtgacgcctagcattctcgattgctgcatcatcagggtggactactccctcgcggtgtatatccacattccgggcgccaagaagttaatgctggaactgcctctggtgataggaacaattccttataacgggttcggctctcggaattcctcaattgcgagtcagttcagcatggatatgtcttggctgacccttaccctccctgaacagccagaggcaccaccaaattatgccgacgtcgtctctgaagaagagtttagccgccatattccaccctatccccagcccccgaattgcgagggcgaggtgtgctgtcccgtgttcgcctgcattcaggaatttcgcttccagccaccccctttgtactcagaggtggacccccatccttcagatgtggaagagtctcagcccgtttccttcatactttag

SEQ ID NO: 44432 - DNA, 1029 bp, Artificial Sequence
  Description of Artificial Sequence: Synthetic coding sequence
atgggcgaccgggaggagtgcctgagcaccccccagccccccatgagtgtggtgaaaagtattgagttagtgctgccggaggatagaatctacttggccggatcatccattaagggtcaggtcatactaacactgaatagtaccctggttgacccaatagtaaaagtcgaactggtgggcagaggctacgtcgaatggagcgaggaagctggggcttcttgcgactatagcaggaacgttatttgtaataacaaagcagattatgtgcataaaactaagacgtttcctgtggaggacaattggctatctgccgggtcccatactttcgacttccacttcaacctgcctcccagactcccttctacatttacctccaaattcggacacgtgttctattttgtgcaggcttcatgcatgggccgagaacatattttggcgaagaaaaggatgtaccttctcgttcaggggacctccacatttcacaaggagaccccttttcagaaccctttgttcgtcgaggctgaagaaaaggtgagctataactgttgcagacagggaaccgtgtgccttcaaattcagatggagcgaaacaccttcactccaggagagaaggtagtctttaccactgagattaataatcagacatcgaaatgtattaagacagtggtatttgcactgtacgcgcacatccagtatgaaggctttactccatctgcggagagacgatcccgactcgatagttcggagctgctgcggcaagaggcaaacacacctgtgacccgcttcaataccaccaaagtggtgtccacatttaatctgcctctgctgctcagcgtgtctagttcaacacaggacggggagatcatgcacacaagatacgagctggtcactacagtgcacctgccttggagtctgactagtttaaaagctaaggtacctataattatcactagtgccagtgtggattccgccatttgccagctgtccgaggacggggtactccccgtaaaccccgaccaccaaaactag

SEQ ID NO: 44433 - DNA, 843 bp, Artificial Sequence
  Description of Artificial Sequence: Synthetic coding sequence
atggagacccaccacggcatctgcagccggctgtgcaaggagagcgattcagttgttctagccgtggggtaccgtaaacttcccaaacacaaattccctgtacctgtacgggattgtttagtggcgaccattcacttcctcaaatccctggatgcctatggggtcgatcctgcgagggtggtggtatgcggggacagctttggtggagcgatcgcagccgttgtgtgtcagcaacttgtcgaccggcccgacctcccaaggatacgtgcacagattctgatttatgctattctccaggcacttgacttgcagaccccatctttccagcagagaaagaatatccctctcctcacctggagctttatttgctactgtttttttcagaatctggactttagttcatcttggcaagaagttattatgaagggagcccatctgccagccgaagtgtgggagaagtacaggaagtggctaggtccagaaaatatcccagaaaggttcaaagagcgggggtaccagcttaagcctcacgagccaatgaacgaggccgcttacctggaggtctctgtcgtgctggacgtgatgtgctcccctctgattgccgaagatgacatcgtcagtcagcttcctgaaacatgcatcgtctcttgtgagtacgacgccctgcgcgacaattccctgctgtacaaaaagaggttggaggacctaggtgtgcctgtgacatggcatcatatggaagatggcttccacggtgtgctccgcacgatagatatgagcttcttgcacttcccatgttccatgagaattctctccgctctcgttcagttcgtcaaaggactatag

SEQ ID NO: 44434 - DNA, 1053 bp, Artificial Sequence
  Description of Artificial Sequence: Synthetic coding sequence
atgatcttcgagaagctgcggatctgcagcatgccccagttcttctgcttcatgcaggacttgccgccgctgaagtacgatcctgacgtagttgtgaccgacttccgatttggaactattccggtcaagctctaccagagcaaggccagcacctgcactctgaaacctggcatagtttattatcatggtggaggtggtgttatgggctcactcaagacacaccacgggatttgttccagactctgtaaagaatcagattctgtggtgctggccgtgggttataggaagcttcctaaacacaaattcccagttcccgtgcgggactgcctggtggctacaatacacttcttaaagagcctcgacgcgtatggggtcgatccagcacgggtggtggtttgcggtgatagttttgggggcgcaattgccgctgtggtttgccagcagttggtcgaccggcctgatctgccgaggataagggcccagattttaatttacgccatcctccaggctttagacctccaaacaccctcattccaacaaaggaagaatatcccccttttgacgtggtcatttatctgctactgcttctttcagaatctcgacttctcaagcagttggcaggaggttattatgaaaggagcccatctgcctgccgaggtgtgggaaaaatacagaaagtggcttggacctgaaaatattccagagagatttaaggagagaggatatcagctcaaaccgcacgaacccatgaatgaggcagcctaccttgaggtcagtgtggtgctcgacgtgatgtgttcgcctcttattgccgaagatgacatcgtgtcccagttgccggaaacatgcattgtgtcttgtgaatatgacgctctgagggacaatagtctgctctataagaagcgcctggaggacttgggcgtcccagtgacatggcaccatatggaggatggcttccacggcgtgttacggacaattgacatgagcttcttacactttccatgcagcatgcggatacttagcgcactggtgcagttcgtcaagggcctatag

SEQ ID NO: 44435 - DNA, 1578 bp, Artificial Sequence
  Description of Artificial Sequence: Synthetic coding sequence
atgggctggctgttcctgaaggtgctgctggccggcgtgagcttcagcggattcctatacccgctggttgacttctgtatttcaggtaaaaccagaggacagaagccaaatttcgtgatcattctggccgacgacatgggatggggcgatctgggggccaattgggctgaaaccaaagataccgcaaatctggataaaatggccagcgaggggatgcggttcgtagactttcacgccgccgctagcacttgctctcctagcagggctagcttgttgacagggcggttaggccttaggaacggggtgaccaggaatttcgcagtcaccagtgtgggggggcttccactgaacgagacaaccctggccgaagtcctgcagcaggctggttacgtgacagggattataggtaaatggcacctgggccaccacggctcataccaccccaactttagaggttttgactattactttggcataccatactcccacgacatgggctgtacagacacacctgggtataaccaccctccgtgtcccgcatgcccccaaggcgacggcccctctcgaaatttgcagcgggactgctataccgatgtagcgctaccactctatgagaacctgaatattgtcgagcagccggttaatctgagcagtctggcacaaaagtacgctgagaaagccacccagtttatccagagggcttctacatccgggcgcccgtttcttctctacgtggcccttgctcacatgcacgtgccgctccccgtgactcaattgcccgctgccccgcgcggacgttccctgtatggcgcaggactctgggaaatggatagcctggtggggcagatcaaggacaaggtggatcatactgttaaggaaaatacatttctatggttcacaggcgacaacggtccctgggcgcaaaaatgcgagctggccggctccgtgggacctttcactggattttggcagacgcgccagggcggtagtcccgccaaacagacaacctgggaaggaggacaccgagttcctgccctggcatattggcccggaagggttcctgtaaatgtaacctctactgcactgctgagcgtgcttgatatattccctactgtggtggctctggcgcaggcctctctaccacaggggcggagattcgacggagtggatgttagtgaggtgttgttcggtcggtctcagcctggacaccgtgtgttgtttcaccccaattctggagccgcaggggagtttggagcactccagaccgtcagacttgagcggtacaaggccttctatataaccggcggggcgagagcatgcgacggatctaccggacccgagctgcagcataagtttccactgatcttcaaccttgaggacgacactgccgaggcagtccccctcgaaagagggggagctgagtatcaagccgtgctccctgaggtccggaaagtcctagctgatgtgctgcaggatatcgctaatgacaacatctcctcagccgactacacacaggacccaagtgttacgccctgctgcaatccctaccaaattgcctgcagatgtcaggcggcatag

SEQ ID NO: 44436 - DNA, 1932 bp, Artificial Sequence
  Description of Artificial Sequence: Synthetic coding sequence
atgtgcggcatctgctgcagcgtgaacttcagcgccgagcacttctcacaggacctgaaagaggatttgttatacaatctcaagcaacggggccccaatagcagtaaacagctgttaaagagcgatgtgaactatcaatgtttgtttagtgcacacgttctccacctgaggggagtgctaactacacagccggtcgaagatgagcgcggcaacgtatttctttggaacggtgagattttcagcgggatcaaggtcgaagccgaagagaatgatacccagattctattcaattacttgagctcttgcaaaaatgaatccgagatcctatcccttttttctgaggtgcagggcccatggtctttcatctattaccaggccagcagccattacctttggttcgggagagattttttcgggaggcggtctttgctctggcatttttccaatctaggcaaatctttctgcctgtctagtgtgggtacacagacctcagggctggccaaccaatggcaagaggttcccgcgagcggcctgttccgcattgatttaaagtccacagtgatctcaggctgcatcatactgcaactgtacccttggaagtacatctctcgcgagaatatcattgaggagaacgtgaattcactgtcccagatctcggccgacctccccgctttcgtgtccgtggtggccaatgaggcgaaactctatctggagaaaccagtggtgcctttgaatatgatgttgccacaggccgcgctggagacacattgctccaatattagtaatgtgccgccaacaagggagatccttcaggtatttctgaccgacgtgcacatgaaggaggtgatccaacaatttatcgacgtgctgtccgtcgcagtgaagaaaagagttttatgcttgcctagagacgagaatctgacggccaacgaggtgcttaaaacctgcgatagaaaggccaatgttgctatcttgtttagcgggggcattgattccatggtgatcgccacgctggcagatagacacattccgctagacgagccaatcgacctgttaaatgtggctttcatcgctgaagaaaaaacaatgcccacaactttcaatcgagaaggcaacaaacagaaaaacaagtgcgagatccctagcgaagaattctccaaagacgtcgccgccgccgcggcagatagcccgaataaacatgtcagcgtacctgaccgaattaccggacgggccgggctcaaagaattacaggcagtcagtccaagccgtatatggaattttgtagagattaatgtgagtatggaggaactccagaagctgcgcaggaccagaatttgccatcttattaggccgcttgatacagtcctggatgacagcatcggttgcgcggtgtggttcgcctctagggggataggttggctcgtcgcacaggaaggtgtgaaatcttaccaaagtaatgctaaagtggtgctcacgggcataggggctgatgagcagctcgccggctactcccgacacagagttcggttccaatcgcacggactggaaggtctcaataaagagatcatgatggagctcggtagaatttcatctcgcaacttagggcgcgacgatcgcgtgataggagaccacggcaaagaagccaggttcccgtttctggacgagaatgtcgtttcattcttgaacagccttcccatttgggagaaggccaacctcacactcccacgcgggatcggggagaagctcctgctgcgcttggctgccgttgaattgggactcactgcctccgcccttttgccaaagcgcgcgatgcagtttggcagtcgaatcgccaagatggaaaaaatcaacgagaaggcatctgataagtgcggcaggcttcagattatgtccctcgagaacttatccattgaaaaggaaacaaagctctag

SEQ ID NO: 44437 - DNA, 1857 bp, Artificial Sequence
  Description of Artificial Sequence: Synthetic coding sequence
atgtgcggcatctgctgcagcgtgaacttcagcgccgagcacttctcacaagacctcaaagaggaccttttatacaatttaaagcaacggggtcctaacagtagtaagcagttactcaagagcgacgtaaattaccagtgtctgttcagtgcccacgttctgcaccttagaggagtgctcactacacaacctgtggaggacgaacgagggaacgtgttcctctggaacggcgaaatctttagcggtataaaagtcgaggctgaggagaacgacacacagatactctttaactacctgtcttcatgtaagaacgagtctgagatactgagtttgttcagcgaagtgcaggggccttggtcctttatctattaccaggcatcttcgcactacctgtggtttggacgggatttttttgggcgccggtcattactgtggcacttttccaacctggggaaaagcttctgtttgtccagcgtcgggacccagaccagcggcttagccaatcaatggcaagaagtgcctgcatccggtctgtttaggatcgatttaaagagcaccgtgattagcggttgcatcatcctgcaactttatccctggaaatacattagccgggaaaatatcatcgaagagaatgttaatagcctcagccagatcagcgcggacctgcccgcgtttgtgagtgttgtggccaatgaagcaaaactctatctggaaaaaccagtagttccactcaacatgatgctgccccaagccgcacttgaaacccattgctctaacatcagtaacgttccaccgaccagagagattctgcaagtgtttctgaccgatgtgcacatgaaggaggtcatccaacagtttatcgacgttctgtctgtcgcagtgaagaaaagagttctgtgcctaccccgtgatgaaaacctgacagcaaatgaggtgctgaagacatgcgacagaaaagcaaacgtggccatcttgttctcgggcgggatagatagcatggtgattgcaactctcgccgacagacatatacctctagatgagcctatagatctactgaacgtggcattcatagcagaggagaaaaccatgcccaccactttcaatagggaaggcaacaagcagaaaaataagtgcgagatcccaagcgaggaattctctaaagacgtcgccgctgcagcagccgacagtcccaacaagcatgtctcagtgccggatcggatcacaggccgagccggccttaaggagctgcaggccgtgagtcctagtagaatctggaatttcgtggaaataaacgtaagcatggaggagttacaaaaattgaggcgcacacgcatatgccatttaatccgacctctggacactgtcctggacgatagtatcgggtgcgctgtatggtttgcttcaagaggtattggctggctggttgctcaagagggtgtgaaatcttatcaatcaaacgccaaggtagtccttactggaatcggcgcagacgagcagctagctggatatagtcggcatagggtaaggttccagtctcacggccttgaggggctcaataaggaaattatgatggaattgggaagaatctcttctagaaatctcggtagagacgaccgggtgataggagatcacggaaaagaggctcggttcccgttcctagatgagaacgtagtgtcttttctgaactccctgccgatatgggaaaaagccaacctgacattaccccgcggcatcggcgagaagcttctgttacggctggccgccgtggagctcggtttgactgcgtcagctctgttgccgaagagggctatgcagtttggatctcggatcgcgaaaatggaaaaaatcaacgagtag

SEQ ID NO: 44438 - DNA, 222 bp, Artificial Sequence
  Description of Artificial Sequence: Synthetic coding sequence
atgtgcggcatctgctgcagcgtgaacttcagcgccgagcacttctcacaggacctgaaggaggatctgctatacaatctgaaacagagaggtcctaactcctcaaagcagttattaaaatcagatgtcaattaccaatgtcttttctccgctcacgtgcttcaccttagaggtgtgctcacaactcagcccgtcgaggatgaaagaggaaatgtgttttag

SEQ ID NO: 44439 - DNA, 564 bp, Artificial Sequence
  Description of Artificial Sequence: Synthetic coding sequence
atggagcggagcgccttcatggagctggacgccggcagccggctggtcatgcatctgcgcgaatggccagctttactcgtgtccagcaccggctggactgagttcgaacagctcacactggatggccacaacttgccatccctggtatgtgtcatcaccggaagtgtggacctgggcgtctgtctccacatgtcctcatccgggctcgaccttccaatgaaagtcgtcgacatgtttggatgttgcctgcccgtgtgtgcggtcaatttcaagtgcctgcacgaactcgtgaagcacgaagaaaacggattggtgtttgaagattcggaggaattggctgcactccaaatgctgttcagcaactttccagacccggccgggaagttaaaccagttctggaagaatctgagagaatctcagcagctgagatgggatgaatcttgggtacaaacagtactcccgctggtgatggacatccagctgctcggacagagactgaaaccccgcgatccctgctgtccttcgaggagcttcttcagcgagtcgcagggaaagccgttttag

SEQ ID NO: 44440 - DNA, 537 bp, Artificial Sequence
  Description of Artificial Sequence: Synthetic coding sequence
atgggcgaccgggtgaagggcagcaagagccggcggcccgacctggtagtggaggtagctcacccgaagatcatccatgaatctggagctcaaatcctgcgtcacgctaacctgttaagtttgcgggtcaccatggctacacatccagacggtttccgcctggagggtcctcttgccgccgcacacagtccagggccttgtactgtattgtatgaaggtccggtgcggggcctctgtccattcgcgcctaggaacagtaataccatggccgccgccgccttggccgcacctagtcttggctttgatggtgtgatcggcgtgctggtggccgacacttcactgacagacatgcacgtggtggatgtcgagttatccggcccgcgagggccaacaggacgcagttttgcagtccataccagacgggaaaaccccgccgagcccggcgccgtaactggttcggcgacggtaactgccttctggcaatctctactggcttgctgtcagctcccatcgaggcctggcattcacctctgttag

SEQ ID NO: 44441 - DNA, 852 bp, Artificial Sequence
  Description of Artificial Sequence: Synthetic coding sequence
atggccgaccggggcccctggcgggtgggcgtggtgggctacggccgtctgggccaatccctggtcagtcggctccttgcccaggggccggagctagggctcgaactcgtgtttgtgtggaatcgagatcccggtagaatggctgggagcgtacctccctctttacagctgcaaaacctcgcagcactcggggaaagacggcccgaccttgtcgtggaagtagctcaccccaagattattcacgagagcggagcccagatactgagacacgccaatctgttggtgggaagccctagtgccctgtctgatcaaaccacagaaagacaacttctggaagccagtcaacactgggaccatgcagtttttgtcgcgcgcggcgctctgtggggtgccgaggacatccggcggctcgatgccgccggaggactcagatcactaagggtaacgatggcaacccatccggatggatttaggcttgagggccctcttgctgccgctcattccccaggaccctgtaccgtgctgtatgaggggcctgtgcgcgggctctgtccatttgctccaaggaattccaatacaatggccgctgccgccctggcagcaccttcactgggcttcgatggtgtgattggtgtgctggttgccgacacatcccttaccgacatgcacgtagtcgatgtggagttgagcgggcctcggggccccactgggcgctcgttcgccgttcacacgaggagggagaatcccgctgaaccgggcgccgtaaccggatccgccacagtaacagccttctggcagagtctcctggcatgctgtcagcttccctcacgaccgggtattcacttgtgttag

SEQ ID NO: 44442 - DNA, 1458 bp, Artificial Sequence
  Description of Artificial Sequence: Synthetic coding sequence
atgagcggccacagccccacccggggcgccatgcaggtggccatgaacgggaaggcacgaaaagaggccgttcagacagccgccaaggagctgctgaagtttgtgaataggtccccatccccattccacgcagtcgccgagtgccggaacaggctactgcaggctggcttctccgagctaaaagaaaccgagaaatggaatatcaagccagaaagcaaatatttcatgacaagaaacagtagcaccatcatcgcttttgccgtcgggggccaatacgtgccaggaaatgggtttagcctgataggggctcacactgactctccttgtctgcgcgtaaagaggcggtcccgtcggagccaagtgggttttcagcaggttggagtcgagacctatggcggaggtatttggtcaacctggttcgacagagatctcactctggccggacgggtgattgttaaatgccctacttcaggacggctggaacagcaactggtccatgttgagaggccgatcctgagaatccctcatctggctatccacctgcagaggaacataaacgagaactttggccccaatacagagatgcatctagtgccaatactcgccaccgccatacaggaagaactggagaaagggactcctgagcctgggccactgaacgctgtggacgaacgacatcatagtgtcctgatgtcactgctttgtgctcacctgggattgtcccccaaagacattgtcgaaatggaactgtgtttggccgatacacagccagtggtcctcgggggagcctacgatgagtttattttcgctcctagactggacaacctgcattcatgtttctgcgcccttcaggctttgatcgacagctgcgctggacccggatctcttgcaacggagccgcatgtgcgaatggtgacactgtatgataatgaggaggtcggctccgagtctgcacagggcgcccagtctttgctgaccgagctggtgctgcgacgcattagcgcttcttgccagcatccaacagctttcgaggaggctataccaaaatccttcatgatcagcgcagacatggcgcacgcagtgcacccaaactacctcgacaagcatgaggagaaccatcggcccctttttcataaagggccagtgatcaaggtcaacagcaagcagagatacgcaagcaatgccgtttcagaagcattgattagggaggtggccaataaggtaaaagtgccccttcaggacttgatggtgcgcaatgatacaccgtgtggtacaaccatcggcccaattctcgccagccgcctgggtttacgcgtcctcgatctagggagtccacagctggcaatgcattccatcagagaaatggcatgcacaactggtgttctgcagactcttacactgtttaaggggttctttgaactctttccttcactgtcacacaacctgttagtggactag

SEQ ID NO: 44443 - DNA, 1326 bp, Artificial Sequence
  Description of Artificial Sequence: Synthetic coding sequence
atgagcggccacagccccacccggggcgccatgcaggtggccatgaacggaaaggcccggaaggaagcggtgcaaacggccgctaaagagctgctcaagttcgtcaataggtccccaagcccattccatgccgtggccgagtgccggaataggcttctgcaggctggatttagtgaattgaaggagaccgaaaaatggaatattaagccggagagcaagtacttcatgacaagaaattccagtaccattatcgcatttgcagtaggcggccagtacgtcccggggaacggctttagcctgattggcgcccacactgattccccgtgtcttagggtcaagagaagatcccgccgctctcaagtggggtttcagcaggtcggagttgaaacctatggcggcggtatctggagcacctggttcgaccgggatctcacgttagctggtagagtgatcgtgaaatgccctacatccggccggcttgagcagcagctggtgcacgttgaacgaccaatcttaaggattccccacctcgcaattcacctccagaggaatatcaacgagaacttcggacccaacacagaaatgcaccttgttcccatcctggccactgctattcaagaggagctggaaaagggcacgcccgagccaggacccctaaatgctgttgatgagcgccaccattctgtgctgatgagccttctatgcgctcacctcggcctgtcacccaaggacatcgtggagatggagctgtgtcttgccgacactcaacccgttgtcctcggcggagcctatgacgaatttattttcgctccacggctggacaatttgcattcatgcttttgcgcactacaggccttaattgacagttgcgctggaccagggtctctggcaaccgagccacatgtgcgcatggtgactctgtacgataacgaagaggtcggtagcgagtcggctcagggcgcccagtccctgctcaccgaacttgttttgcgcaggatttcagccagctgccaacaccccaccgcctttgaggaggcgattcctaagtccttcatgatatctgcagatatggctcacgccgtccaccccaactatttagacaagcatgaggagaatcacaggcctctgttccacaaggggcctgtcatcaaggttaatagcaagcagcgatatgcctccaacgcggtgagtgaggccctgatccgcgaggtggctaacaagagtcgctccccatgcaggattagctggtccggaatgaccccacctgtggagccacctctcgacttgagctggctgttgggttggggatgtggatgttggatttag

SEQ ID NO: 44444 - DNA, 1137 bp, Artificial Sequence
  Description of Artificial Sequence: Synthetic coding sequence
ctgagcctgagcctgagcctgagcctgttcctggacgtgagcctgtctcttagcgtctccctcagtttcagcctgtcccaccctggatctacatggttcgacagggacctcacattggccggcagagtcatcgttaaatgccctacaagtggacggctggagcaacagctcgtacatgttgagcgccccattcttcgcataccacacctggctatccatctgcagcggaatatcaacgaaaacttcgggcctaatacagagatgcatctggttccaatattggctacagctattcaagaagagctagagaaaggcacgcctgagccgggacctctaaacgccgtcgacgaacgccaccacagtgttcttatgtcactgctgtgcgcacaccttggactctcccccaaagatatcgtagaaatggagctgtgcctggccgatactcagcccgttgttctcggcggcgcctacgacgaatttatttttgcccctaggcttgacaacttacatagttgcttttgtgccttgcaggcactgattgattcttgcgcgggccccggcagcctggcgactgaaccacatgtcagaatggtaactctctatgataacgaagaggtcgggagcgaatcagcccaaggcgcacagagcctgctgacagaactcgtgctccggagaatatcagcatcgtgtcagcaccccactgccttcgaagaggcaatccccaagtcctttatgatcagtgcggacatggctcacgccgtgcaccctaactacctggacaaacacgaggagaaccatcgacctctgttccataagggccccgtgattaaagtgaacagtaaacagcgttatgcttccaatgcagtctctgaggccctcattagagaagtggccaacaaggtaaaagttcccctacaggacctgatggtgcgaaatgataccccatgcggaaccaccatcgggcccatcctggcaagtcgcttagggctcagggtactggatctgggctcccctcagcttgcgatgcattcaatcagggaaatggcgtgtacgaccggagtgttacagactctcacgctgttcaagggattttttgagctatttccctcattaagtcataacctgttggttgactag

SEQ ID NO: 44445 - DNA, 1296 bp, Artificial Sequence
  Description of Artificial Sequence: Synthetic coding sequence
atggagggcgtgggcggcctgtggccctgggtgctgggcctgctgtccctgccgggggtaatcctcggagcaccgttggcctcctcttgtgccggtgcatgcgggacatcatttccagacgggttaaccccggaaggcacgcaggcttctggcgacaaggatattccagctatcaaccagggtcttatccttgaagaaacacccgagagttcatttttaatcgagggtgacatcatccgtccctctcccttccgactcctatcagccacttccaacaaatggcccatgggtgggtctggggtcgtcgaagtccccttcttgctctcctccaaatacgatgaaccctcccgccaggtgattctcgaggcactggctgagttcgaaaggagtacctgtattaggttcgtgacataccaggatcagagggatttcattagtatcattccgatgtacggatgcttcagctccgttggccgctccgggggtatgcaggtcgtgagcctggcccccacatgcctccaaaagggtcgcgggatcgtcctccacgagcttatgcatgtgctgggtttttggcatgaacataccagggcagatcgcgacagatatatccgcgtgaactggaacgagattctgcccggttttgaaatcaattttatcaaatctcagtccagtaacatgctgacaccttacgattactccagtgttatgcattatgggagattggcgtttagtcgccggggactgcccactattacccctttgtgggctccttccgtccacatcggtcagcggtggaatctgtctgcaagtgatatcacccgagtccttaagctttacggctgtagcccctctggtcccagaccccggggccgaggcagccatgctcatagtactggccggtctccagcaccagcttctttgtctctccagaggttgcttgaggctctgagcgctgaatcaagaagccccgacccgagcggatcgtcagcaggcggacagcctgttcccgcaggacccggcgagagcccccacggctgggaatcacccgccctgaagaaattatctgcagaggccagtgcaaggcaaccccagacattggcatcatccccacgctcaagacccggcgccggagctccaggagtggcacaggaacaaagctggttagctggggtgtctactaagcccaccgtcccgtcttcggaggcaggaatccaacccgtaccggtgcaagggtccccggctcttccgggcggctgcgtgccacgcaaccatttcaaaggcatgagtgaggactag

SEQ ID NO: 44446 - DNA, 2040 bp, Artificial Sequence
  Description of Artificial Sequence: Synthetic coding sequence
atgggcatccggggcctgatgagcttcgtggaggaccacagcaacgagttctttacggacctgaaactgagagatacaaaaatcgtgatcgatggctacgccctgttccacaggctttgcttttctagtaatctcgatttgagatatggaggcgattatgactctttcgcggacgttgtccaaaaattctttgaaagtctcttcgcctgtaatatatgtccttatgtggtcctagatgggggctgtgatattagtgacaagaagctaactaccttgaaagacagggctcgcgaaaagattcagatggcacacagcctcagcgtagggggctcaggatatgtctgcccgctgcttatccgggaagtttttattcaagtcctgattaagctccgggtgtgttttgtgcaatgcttttctgaggcggaccgggatatcatgacactcgctaatcattggaactgccctgtcctcagttccgatagtgacttttgtatattcgatctgaaaacgggattctgtcctttgaattcattccagtggcgaaacatgaacacaattaagggcacccagaattatatcccagccaaatgcttctctctggatgcgttctgtcaccattttagtaatatgaacaaggccttgctgcctctgtttgcagtgctgtgcggtaacgaccacgttaacctacctattatggagacgttcctgtcgaaggcaagactgccgcttggggctacaagttctaaaggccgaagacaccatcgtatcctgggattgttaaattggctgtctcactttgccaatccaacagaagctttagacaacgtgctgaagtacctgcccaaaaaagatcgagaaaacgttaaggagctgctgtgctgttccatggaagagtaccagcagtctcaggtgaaacttcaagattttttccaatgtggcacatatgtatgtcccgatgccttaaacctaggcctgcctgaatgggtattggtggcactcgccaaaggccagttatccccattcatttctgacgctctcgtactacggagaacgattctgccaacacaagttgagaacatgcaacagccaaatgcgcatcgtatctcgcagccgatccggcagattatctacggccttctgctgaacgctagcccccacttggacaagacttcctggaatgcactcccccctcagccactggcctttagcgaggttgaacgcataaacaaaaatatccgcacgtcaatcattgacgctgtggagctcgctaaggatcatagcgacctttcaagactcacagagctgagtcttaggaggcggcaaatgttgttgctcgaaaccctgaaagtgaaacagacgattctggagcccatcccgactagcttgaagctgcccatcgcagtgagctgttactggctgcagcacaccgaaacaaaagctaagcttcaccaccttcagagcttgctcctcaccatgctggtgggacctttgatcgccatcatcaactcccccggcaaagaagaactgcaagaagacggcgccaaaatgctttacgccgaatttcagagggtaaaagctcagacgaggcttggcacaagactcgatctcgacacagcccacattttctgtcagtggcagtcctgcttgcagatgggcatgtacttgaatcagttactgagtacaccactccccgagccagatctaacccgactgtactctggatccttagttcatggcttgtgtcagcagttgctagcttcaacatccgtcgaaagcttgctgagcatatgtcctgaagcaaaacagctatatgaatatctgttcaatgctacacggagttacgcgcccgcagaaatattcttgcccaaggggaggtctaacagcaagaaaaaacgacagaagaagcagaacacttcatgttccaaaaatcggggtcggaccacggcccacaccaaatgctggtacgaagggaataacaggtttggactgttgatggtggagaacctagaagagcattccgaggccagtaacattgagtag

SEQ ID NO: 44447 - DNA, 1194 bp, Artificial Sequence
  Description of Artificial Sequence: Synthetic coding sequence
atgggcatccggggcctgatgagcttcgtggaggaccacagcaacgagttttttacagatctgaagttacgcgatacaaagatcgtgatcgacggatatgctctgttccatagactgtgtttctcctcaaacctcgacctccggtacggcggtgactacgattccttcgccgatgtagtgcagaagttcttcgagagtctttttgcatgcaacatttgcccatacgtcgtgctagacggagggtgcgacatctcagacaagaaattaaccaccttaaaggatagggcaagagaaaaaattcagatggctcactccctgagtgtcgggggcagcggctatgtatgcccgctgctcatccgtgaggtgtttatccaagtcctaatcaagctaagagtctgttttgttcagtgttttagcgaggccgatcgagatattatgactcttgcaaatcactggaactgccccgtgctttcctctgatagcgatttttgcatctttgaccttaagaccggattctgcccactgaactcctttcaatggcggaatatgaacaccatcaagggcactcagaactacatacctgccaagtgtttcagcctcgatgctttttgccaccacttttccaatatgaacaaagcgttactcccactgtttgcagtgttgtgtggcaatgatcacgtgaatctgcctataatggaaacattcctcagcaaggccagattgccactgggcgccaccagctctaaaggtcggcgccatcaccggatccttggactgctgaactggctgtctcattttgccaatcccacagaggccctggataacgttctgaaatacctgccgaaaaaagatagagagaacgttaaggaactgctttgctgttccatggaggagtaccagcagagccaggtaaagctccaggacttcttccaatgtggcacgtatgtatgtccagacgctctgaacctgggtctgccagaatgggttcttgtggctctggcaaaggggcagctcagcccatttatctccgatgcacttgtactgaggagaactattctgccaacacaggttgagaatatgcaaccattggcattttctgaggtcgagaggattaataagaacattagaaccagcatcctcacagcccacaatgccagcggcgccctggattgccataaccagcagccttggtag

SEQ ID NO: 44448 - DNA, 147 bp, Artificial Sequence
  Description of Artificial Sequence: Synthetic coding sequence
atgggcatccggggcctgatgagcttcgtggaggaccacagcaacgagttcttcacagacctcaaattgcgggataccaaaatcgtaatcgatggctacgccctcttccacagactgtgcttctcatcaaatcttgacctgcgatag

SEQ ID NO: 44449 - DNA, 153 bp, Artificial Sequence
  Description of Artificial Sequence: Synthetic coding sequence
atgggcatccggggcctgatgagcttcgtggaggaccacagcaacgagttcttcactgatctgaaacttcgtgatacaaaaatcgtgatagatggatacgccctatttcacaggctctgcttctcttccaatctcgatctgcgatacggatag

SEQ ID NO: 44450 - DNA, 24 bp, Artificial Sequence
  Description of Artificial Sequence: Synthetic coding sequence
atgggcatccggggcctgatgtag

SEQ ID NO: 44451 - DNA, 255 bp, Artificial Sequence
  Description of Artificial Sequence: Synthetic coding sequence
atggagcggaagaacgaccccctgcccatcagcaccgtgggcaccagaggtaaggggccaaagagggacgagcagtaccgcatcatgtggaacgagcttgagaccctcgtcagggcccatatcaataattcagagaagcaccagagagtcctggaatgcttgatggcttgtcggtccaagcctcccgaagaggaagagcgaaaaaaagaagaagaacgaggaaaaacaaaaaggacttcacagcgtaaacagtag

SEQ ID NO: 44452 - DNA, 2121 bp, Artificial Sequence
  Description of Artificial Sequence: Synthetic coding sequence
atgaagatcttcagcgagagccacaagaccgtgttcgtggtggaccactgcccgtatatggccgagagctgtagacaacatgtggagtttgacatgctggtcaaaaatcgcacacagggaatcatccctctggcaccaatcagtaagtcactatggacatgttccgttgaatcaagtatggagtactgtagaatcatgtacgacatctttccttttaagaaactcgtgaattttatcgtgtcagatagtggagcccacgtgctgaattcctggactcaggaggaccagaatctccaagaactgatggctgctcttgccgcagtcggtccgccaaaccctagggccgaccctgaatgctgctctattctgcacggcctggtagcggccgtggagactctttgcaaaatcaccgagtaccagcacgaagcgcgcacgctgctcatggagaatgcagaacgggttggcaatcggggccggatcatctgcattacgaacgctaagagtgactcacacgtccgcatgctcgaggactgcgtccaggagaccatccacgaacataacaaattggccgcgaatagtgaccacctcatgcagattcaaaaatgtgaactggtgcttattcatacctaccctgttggcgaagatagtctggtttccgatcggtcaaaaaaagagctgtctccagttctgacttcagaagttcacagtgttcgcgccggccgccacctggcaaccaaactgaatatcctcgtgcagcagcatttcgacctggcctccaccacaattaccaacatacctatgaaggaggaacagcacgctaatacctctgcgaattatgatgtggagctcctacatcataaagatgcgcacgtcgattttctcaagagcggggacagtcacctggggggtgggtctcgggaaggaagctttaaggagaccatcacattaaagtggtgcacgcctcggactaataacatagaattgcactattgcacgggcgcctaccgcatcagccccgtggacgttaacagcagaccatcctcctgtcttacaaacttcctgctgaatggtaggagcgtgttgctggagcagccgcggaagtctggttctaaggtgatttcacacatgctgtctagccatggaggggaaatttttctccatgtgttgtcaagtagtaggtccatccttgaggatcctcccagtatttctgaaggatgcgggggccgggtcactgactataggatcacggatttcggagaatttatgcgggagaaccggctcacacccttcctagatcctcgctacaaaattgatggatccttagaagtgccgttagaaagagccaaagatcagttggaaaaacacactcggtactggcccatgataatatctcaaaccacaatatttaacatgcaagccgttgtaccattagccagtgtgattgtgaaggaaagcctgactgaggaagatgtgctgaattgtcaaaaaacaatttataatctggtggacatggagcggaaaaacgatcccctacctatatcgactgtcggtacaagaggaaaagggcccaagagggacgagcagtaccggatcatgtggaatgagctggagactctggtccgagctcatattaacaacagtgaaaagcatcagagggtattggagtgtctgatggcctgccgctctaagcccccagaggaggaggagcggaagaagagggggaggaaaagggaggataaagaggataagagcgagaaagccgtcaaggactatgagcaggagaaatcatggcaggattctgagaggcttaagggcatacttgagagaggcaaggaagagcttgctgaagctgaaatcattaaggattctcctgatagtcctgagccccccaacaaaaaaccacttgtggagatggacgagacgcctcaagtggagaaatctaagggccccgtgtcccttctgagcctttggtctaataggatcaatacagctaactcacgaaaacaccaggagttcgcgggaaggctcaatagtgtgaacaatagagccgagctttatcagcacctgaaggaagagaatggcatggagaccacagagaacgggaaggcctccagacagtag

SEQ ID NO: 44453 - DNA, 882 bp, Artificial Sequence
  Description of Artificial Sequence: Synthetic coding sequence
atggtggtgctgttctactggaacaaccacgagagccaggtgctgaagtccttagtgatttgcctggtggcaatggaggaaaggtttctacacgttctgtccagttcacgctccatcctggaagatcccccatccatctcagagggctgcggagggagagttaccgattacagaatcactgtcgtgccactggcctccgtaatcgtgaaggagtcactgactgaggaagacgttttgaactgtcaaaagactatttataatctggttgatatggagcgaaagaatgacccacttcccatatccactgttggcacgagagggaaagggcctaaaagggacgaacaataccgcatcatgtggaacgagctggaaacccttgtgcgagcccatatcaacaattctgagaaacatcagcgagtgctggagtgcctgatggcttgtcggtcaaagccgccggaagaagaggagaggaagaagcgcggtcgaaagcgggaggataaagaggacaaatccgaaaaagccgtgaaagactatgagcaggagaagagttggcaggattcggagagactgaagggaatcctggaaagagggaaggaggagttagccgaggctgaaattataaaagactctcccgacagtccagagccccccaacaaaaagcccctggtggagatggatgaaaccccacaggttgaaaaatcaaaaggtccagttagcctcctcagcctgtggagcaatagaatcaacacggcgaatagtcgaaaacatcaggagtttgctggccgcctaaactctgtgaataaccgcgcagaactgtaccaacatcttaaggaggaaaatggtatggagaccacggaaaacggaaaggcatcccggcagtag

SEQ ID NO: 44454 - DNA, 492 bp, Artificial Sequence
  Description of Artificial Sequence: Synthetic coding sequence
atgaagatcttcagcgagagccacaagaccgtgttcgtggtggaccactgcccatacatggcagaatcctgtcgacagcacgtggagttcgatatgctggtgaaaaaccggactcagggcatcattcccctcgctcccataagcaagagcctgtggacatgcagtgttgagtctagtatggaatactgtaggattatgtatgacatcttcccttttaagaagttagttaacttcatcgtaagcgatagtggcgcacacgtgctcaactcatggacacaggaagatcagaacttgcaggagctgatggctgctcttgccgcagtcgggccacctaaccccagagccgaccccgagtgctgcagtattcttcacggattagtggctgctgtggaaaccctgtgtaaaataaccgagtaccaacatgaagctcgaactctgttaatggagaatgcagagagagtcgggaatagaggacgcatcatctgtatctag

SEQ ID NO: 44455 - DNA, 375 bp, Artificial Sequence
  Description of Artificial Sequence: Synthetic coding sequence
atggccgccctggccgccgtgggcccccccaacccccgggccgaccccgaatgctgtagcatccttcatggactggttgccgccgtcgaaactctgtgcaaaattaccgaataccagcatgaggctcggacactgctgatggagaacgctgaacgagtcggcaaccggggcagaataatatgtatcaccaacgccaagagcgacagccacgttagaatgctggaggactgcgttcaggaaaccatccacgaacataacaagctcgcggccaactcggatcacttgatgcagatccagaaatgcgagctagtcctgatccatacctatcccgtgggtgaggacagtctggtgtccgaccgatctaagaaagagtag

SEQ ID NO: 44456 - DNA, 1818 bp, Artificial Sequence
  Description of Artificial Sequence: Synthetic coding sequence
atggccgccctggccgccgtgggcccccccaacccccgggccgacccggaatgttgctccatcctacacgggctggtagccgcagtcgagaccttatgtaagattacagagtatcaacacgaagcacgaactctgttaatggaaaatgctgagagagttggcaaccgcggacgaattatctgtatcaccaacgctaaaagcgactctcacgtgcgcatgctcgaggactgtgtgcaggagactatccacgagcacaacaagctggcagccaactccgaccatcttatgcagatccagaagtgcgaactggtcctgatccatacctaccccgtgggagaggactctctcgtgtccgacagatctaagaaggagctcagtccagtcctgacgtccgaggtgcacagcgttcgggccggcaggcatctcgcaaccaaactcaatatcttggtgcagcaacacttcgacctcgcgtcgacaaccatcacgaatatccccatgaaggaagaacaacacgcgaacacgagtgcaaattacgatgtggagctgctacatcacaaggatgcacacgtggacttcctgaagtccggggactctcacctggggggtgggtcacgggaggggagcttcaaggaaactattaccctcaaatggtgtacgccacgcactaataatatagaattacattactgcactggcgcctatcgcatctcccccgttgatgtaaattcacggccatcctcctgtctgacaaatttcctcctgaatggacgcagcgttctgttagaacagccaagaaagtccggctcgaaagtcatcagccacatgttgtccagtcacggaggcgagatttttctccacgtgttgtcgagcagccgatcaatcctcgaggacccaccctccatttccgaggggtgcggtgggagggtcacagattataggattaccgatttcggtgagttcatgagagaaaatcgcctgactccgttcctggacccaagatataaaattgacggtagtctggaagtgcccttggaaagagccaaggaccagttggaaaagcatacccgatactggcccatgatcattagccaaaccacaattttcaacatgcaggccgtggtgcccttagctagcgtgatcgtgaaagaatccctgactgaagaagatgtcctcaactgccagaagacaatttacaatttagttgacatggagcggaaaaatgatcctcttcctatctctacagtggggactcgaggtaaagggccaaagcgagacgagcagtaccgaattatgtggaatgagctggaaacgctagttagggcccacatcaacaattccgaaaagcatcagcgggtcctggagtgtcttatggcttgcaggtcaaaaccgcccgaggaagaggaacggaagaaacgcgggcgcaaacgggaggacaaggaggataagtcagagaaggctgtgaaagactatgagcaagaaaaatcgtggcaggattccgaacgcttgaaaggaatcctcgagaggggtaaggaagagctggcagaggcagagatcattaaagacagccccgactcaccagagcctccgaacaaaaagcccttggtggagatggacgaaactcctcaggtcgaaaagtccaaaggacccgtcagcctgctctccttgtggagcaaccgtattaacaccgccaatagccgcaagcaccaggaattcgcgggacgactgaatagcgttaacaacagggctgaactgtaccagcaccttaaagaagagaatggtatggaaacaacagagaacggcaaggcgagcaggcagtag

SEQ ID NO: 44457 - DNA, 678 bp, Artificial Sequence
  Description of Artificial Sequence: Synthetic coding sequence
atgaagatcttcagcgagagccacaagaccgtgttcgtggtggaccactgcccctatatggctgaatcttgcaggcagcacgtggagtttgatatgctggtcaaaaaccggacccaggggatcatccctcttgcccctatttctaaaagtttatggacatgtagtgtcgaatcatccatggagtattgtagaataatgtacgatatttttccatttaaaaagctggtcaattttatcgttagcgactctggggcacacgtcctgaactcatggacccaggaggaccaaaacctacaggagttgatggccgcactcgctgctgttggcccccctaacccgagggcggacccagaatgctgctctatcttgcatggtcttgtggctgcagtagagaccttgtgcaaaataaccgaataccaacacgaagccagaacactactgatggaaaacgctgagagagtgggaaatagaggcagaataatctgcatcacaaatgcaaaatctgacagtcatgtccggatgctggaggactgtgttcaggaaaccattcatgaacacaacaagctggctgccaactcagatcacctgatgcagatccagaagtgcgagctcgtgctcattcatacttatccagtgggtgaagacagtctggtgagcgatcggagtaaaaaagaatag

SEQ ID NO: 44458 - DNA, 4812 bp, Artificial Sequence
  Description of Artificial Sequence: Synthetic coding sequence
atgcgggtgaagccccagggcctggtggtgaccagcagcgccgtgtgcagttcacccgactatctgagagagccaaagtattaccccggtggcccaccaactccccgccctctactccctacccggccacccgcttccccgcccgacaaagccttcagcacccacgccttttccgagaatccccggccaccgccccgtcgcgaccccagcacaaggaggccccctgtcctagccaaaggggatgaccccttgccacccagagctgccagaccagtgtcccaggcaagatgtccaacccctgtgggcgatggatcatctagcaggaggtgttgggataacggccgcgttaacttgcgtccagttgtgcagctgatcgatatcatgaaggacctcacacggctctcgcaggatttgcagcattccggggtgcatctcgactgtggggggctgaggctttcgcgccccccagcccctcctcctggcgacctgcagtattccttctttagctccccgagtctagctaacagcattagaagccccgaggaaagggccacacctcacgccaaatctgaaaggccttctcacccgttgtacgagcctgaaccagaaccccgggattctccacagccagggcaagggcacagcccgggcgcaactgccgccgctaccggtcttccacctgaacctgaacctgactccaccgactattccgagctggcggatgcggacattctctccgagctggcttcgctcacttgccctgaggctcaactcctcgaggctcaggccctggagcccccgtcaccagagcctgagccgcagttattagacccacaaccccggttcctcgaccctcaagcgctggagccactcggggaagcccttgaactgcctcccctgcaacctctcgccgatcccctgggcctacctggactggctctccaagcactggacacattgcctgattccctggagtcccagctgctggatccccaggccctagaccccttgcctaaactgctcgatgtgcctggtcgcaggctggagccccagcaaccattgggccattgccccttagccgagcctctccggttagacctgtgttcacctcacgggccaccaggccctgaaggacacccgaagtacgccctccgccgcaccgaccggcctaagatcctgtgcagaagacgcaaagccggccgaggtagaaaagccgacgccggacctgaagggagactgctccccttgcctatgccgactggactagtagcagccctggctgagccacccccgcccccaccccccccccccccagccttgccaggccccgggcccgtctctgtgcccgaactaaaacccgagtcttcacagacacccgtcgtcagtacccgtaaaggcaaatgccggggggtaagacgcatggtggtaaaaatggctaagatccccgtcagtctcggcagaaggaataagacaacatacaaggtatcctccctaagttcatcattatctgtggaaggcaaggagttaggactcagagtgtccgccgaaccgacacctctgcttaaaatgaagaataatggccgcaatgtggttgtggtcttcccccctggagaaatgcctattattctgaaaagaaaacgaggaaggcccccgaagaatctgttgctcggcccaggaaaaccgaaagaacctgccgtcgtcgccgctgaagccgcaactgttgccgccgccaccatggcaatgccagaagttaaaaagaggcgcaggaggaagcaaaagctagctagccctcagccttcttatgcagcagatgctaacgattcgaaagctgaatatagtgacgtgttagcaaagttggcgttcctgaataggcagtcacagtgcgcaggtagatgctccccccctcggtgttggactccctcagaaccagagagtgtgcatcaggctccggacacccaatccataagtcacttcctgcacagagtgcagggctttcgccgcagaggggggaaagccggcggcttcggtggtcggggaggcggtcatgctgctaagtccgccaggtgttctttctccgacttttttgaaggcatcgggaaaaaaaagaaagtcgtggcagtcgcagcagcaggcgtgggcggtcctgggcttacggagctggggcatcccagaaaacgggggcggggagaagtggatgcagttaccggaaaacctaaacgcaaacggcgttctcgcaaaaatggaacactgtttccggaacaggtcccctccgggccaggtttcggagaggcgggcgccgaatgggccggcgataagggcggtggctgggcaccccaccacgggcatcccggcggccaggctggaagaaactgcggctttcagggcaccgaagcgcgggccttcgccagcacgggccttgagtctggagctagcggccgtgggtcatactacagcactggtgctcctagcgggcagacagaactgtcccaagagagacaaaacctgtttaccgggtatttcaggtcccttctggattccgacgattcatccgatctgctggattttgccctgagcgcatctcgccccgagtcaaggaaggcttctggaacatacgctggcccccccacaagcgccctgcctgcccagcgaggcctggccactttccctagcaggggcgccaaggcttcccctgtagctgttggctcttccggggctggcgcagacccaagctttcaaccagtgctatcggcaaggcagacctttcccccgggacgggctgcctcttacgggctcaccccggccgccagtgattgccgagcagccgagactttcccaaagcttgtgccgccaccgtccgccatggcaagaagcccaacgacacaccctcccgccaatacgtatctgccacagtatggcggttacggagcaggacagtccgtatttgctcccaccaagcccttcacagggcaggactgcgctaatagtaaagattgttccttcgcttacggatccgggaattcactcccagcaagtccatccagcgcccatagtgccggttacgctccacctcctacaggggggccttgcctgcctcctagcaaagcatccttttttagttcgtccgaaggagcccccttcagcgggtcagcccccacccctctccgatgcgactctagagcttcaacagtttcacctgggggatacatggtccccaagggtaccactgctagtgccaccagtgccgcctccgctgccagctccagttcctctagttttcaacctagtcccgaaaattgtcggcaatttgccggagcatcacagtggccctttaggcagggttatggcggcctcgactgggcatctgaagccttttcgcagctgtacaacccttccttcgactgtcacgtcagcgaaccaaacgtgattctggacatctcaaattacactcctcagaaggtgaagcagcaaaccgctgtgtccgagacttttagtgagagtagttcagactctactcaattcaatcagcccgtcgggggcggaggctttagaagagctaactctgaggctagctcttctgagggacaaagcagcctatcctctctggaaaaactgatgatggattggaatgaggccagcagcgccccagggtataactggaaccagagcgtcctctttcaatccagctcgaagcctggccgcggccggcgtaagaaagtagacctcttcgaggcgagtcacctcggattcccgacaagcgcgtccgcggccgcaagcgggtaccccagtaaacgaagcactggaccccggcagccaagaggcggaagaggcgggggagcctgctctgccaagaaggagagaggcggggcagctgctaaagctaagttcattccgaagccacaaccggtgaatcctctcttccaagattctcctgacctagggctcgactactattccggcgatagctcaatgtcacccctgccttctcaaagcagggcattcggcgtaggcgaacgcgacccctgcgactttattggcccttactcgatgaacccatcgactccgagcgatggcacttttgggcagggatttcactgcgattctccaagcctcggcgccccagagctggatggaaagcatttccccccccttgcacatccacccactgtattcgacgctgggctgcaaaaagcatacagtccaacctgtagtcctaccttaggcttcaaagaagaattgagaccccctcctacaaaactagccgcgtgcgagcctttgaaacatgggctgcaaggagcttctttgggtcacgccgccgctgcccaggcgcacttgtcgtgccgggacctgcccttagggcaaccccactacgattcaccatcctgtaaaggaacggcatattggtaccccccaggtagtgctgctaggagcccaccatacgaaggtaaggtgggtacaggcttactcgctgacttccttggacgcacagaagctgcttgccttagtgcgccccacctggcttctccacctgcaactccaaaagctgataaagagccattagaaatggcacgtccgccaggaccaccacgaggacccgccgccgcggctgccggctacggttgtcctttactctcagatctaacgctgtcccccgttcctcgggattccctgctgcctctgcaagatactgcatatagatatcccggattcatgccacaggctcaccctggactgggagggggaccaaagtccgggtttctcggccctatggccgagccacacccggaggatactttcacagtcacctctctttag

SEQ ID NO: 44459 - DNA, 4812 bp, Artificial Sequence
  Description of Artificial Sequence: Synthetic coding sequence
atgcgggtgaagccccagggcctggtggtgaccagcagcgccgtgtgttccagccccgactatttgcgcgagcccaagtattacccaggggggcctcccactccaagacctcttctgccgaccaggcctcctgcaagccctcccgataaggcttttagcacccatgcctttagcgagaatccgagacccccccctaggcgggacccttcaacaagaagaccccccgtgctggcgaagggcgatgacccccttccaccgagggcagcaagaccagtgtcacaggcccggtgtccaactccagtcggtgacggatcaagttctaggcgttgttgggacaacgggcgggtaaatctccgcccagtggtacagttgatcgatataatgaaggatctgacacggctgtctcaggatcttcagcatagtggcgtgcacctcgactgtgggggccttcggctgagcaggcccccagcaccaccacccggtgacctccagtattctttcttcagctcaccgtccttggcaaattctatacgatcacccgaggagagggccacgccacacgctaagtctgagcgtcccagtcatcctctgtacgaacctgagcctgaacctagagattctccacagcctggtcaggggcactccccaggagcaaccgcagcagccacaggattgcctccggagcccgagcccgattctaccgactattccgaactggccgatgcggacatactcagcgagttggctagcctcacttgcccggaggctcagctgctggaggcgcaagcattggagccaccaagccctgagccggagccccagctgttggatccccagcctcggtttctggacccgcaggctctagagcccctgggggaagcactcgagctgccgccccttcagcccctggccgaccctttggggcttcccggtttagctctccaggccctggatacccttccagactctctggaaagtcaactgctggatccgcaggcgctcgatccacttccaaagcttctggacgtaccagggcgccggctggagccacaacaacctctcgggcattgcccactggccgagccactccggctggatttgtgcagtccccatggccctcccgggcccgaaggccatcccaaatatgctcttcgaaggaccgaccgcccaaagatcctctgcagacgtcgcaaggctgggcggggtagaaaagcggatgccggtcccgaaggtcgccttctgcccctgcccatgccaacaggtctggtggccgcactggccgagcctccccctccccccccaccaccccctccagctttgccaggccccgggccagtttcagtccctgagttaaagcctgagagtagccagaccccagttgtctcgacaagaaaggggaagtgccggggcgtccggcgtatggtcgtgaaaatggcaaaaattcctgtgtcactcggcaggaggaataaaaccacatacaaagtgtcctccttaagctcaagcttgtccgtagagggcaaggagctcggattacgcgtgtctgccgaacccacccccttgctcaagatgaagaataacggccgcaatgttgtagtggtctttccccctggcgagatgccaattattcttaagcggaagcggggacggcccccaaagaaccttctgctgggtccaggcaagcccaaggaacctgctgttgttgctgcagaggccgcaaccgtcgctgcagccacaatggcaatgccagaggtgaagaagaggaggagacgaaagcagaagctagcgtctcctcagccatcatacgcagcagatgccaacgactccaaagccgagtatagtgatgtactggctaagctggccttccttaataggcagtcccaatgcgccgggcgatgctctccacccagatgttggaccccgtctgagccagaatctgtacaccaggctcctgacacccaatctatatctcacttcctgcatagggtccagggattccggcggcgcggagggaaggccgggggctttggaggccgcggagggggacatgccgcgaagagtgcacggtgttccttttcagactttttcgaaggaatcggtaagaagaaaaaagtagtagctgtagctgctgccggcgttggcggccccgggctcacggaactcggccacccacggaagcggggacgcggagaagtggacgccgtaaccgggaagccgaagagaaaaagaaggtctagaaaaaacggcacactgttccctgaacaggttccttcaggccctggcttcggggaggctggtgctgagtgggcaggagacaagggcggaggttgggcaccacatcacgggcatcctggcggacaggctggacgcaattgtgggtttcagggaacagaggccagggcattcgccagtaccggcctcgagtccggggcttctgggcgtggaagctattacagtacgggagccccctctggacagacagaacttagccaagaaaggcagaacctgttcactggctacttcagatctctcctggactcagatgacagcagtgaccttctggactttgccttgagcgccagccggcctgagagccggaaggcgtcaggaacttacgccggtccccccactagcgctttacccgcacaacggggccttgccacatttcctagtcgcggcgctaaggcgtcaccggtggctgtcggctcatcaggtgctggggccgacccgtcattccagcccgtgctctcagcccgacagactttcccacccggccgcgctgcttcatatggtctcacgcccgcagcttccgactgcagggcggctgagacctttccaaaacttgtgccacccccgtcagccatggcccgaagccctacgacgcatcctcctgctaacacgtatctgcctcaatatggcggctacggggcaggacagagtgttttcgccccgacgaagcctttcactggacaagattgtgcgaacagcaaggattgttcctttgcctatggtagtggtaacagcctacctgccagcccatccagtgcccattcagctgggtacgcacctccccctaccggaggcccctgtctgccgccatcgaaggcgtcctttttctctagcagcgaaggagccccattcagtggttccgctcccacccccctgcgatgtgattcacgcgcctcaaccgtgagccccgggggctatatggtccctaagggtaccacggcatctgcaacctcagccgcctctgccgcatcaagctcctcaagctcattccaaccaagccctgagaactgcagacagttcgctggggccagccaatggcccttccgccagggctacgggggcctggactgggctagcgaagctttctctcagctctacaacccaagcttcgactgtcatgtaagtgagccaaacgtgattctggatataagcaactacaccccccagaaagtgaaacagcagacagctgtctctgaaactttctctgagtcaagctccgacagcacacagttcaatcagccggtgggcggcggcggatttagaagagccaactccgaagctagctcctccgagggccaatccagcctatcatcgctggaaaagctgatgatggattggaatgaggcctcttcagcacctggttacaactggaatcagagtgttctcttccagagtagcagcaaaccaggtcgggggcgacggaaaaaagttgatctttttgaggctagccacctgggcttccccactagcgcctctgctgcagccagtggttatccttcaaaacggagtaccggacctagacagcctcgcggcggtcgcggaggcggggcctgctcggctaagaaggagcgaggcggagctgcagcgaaggccaagttcattcccaaaccacagcctgtaaatccactgtttcaagacagtcccgatctaggcttggattactactcaggggattcaagtatgagcccactgccatcacaatcccgcgcctttggagtcggggagcgtgacccttgcgatttcatcggaccttactctatgaacccctcaacccctagcgatggcacatttggccagggatttcattgtgactccccgtccttgggcgccccagaactggatggtaagcatttcccaccactcgcccaccctccaaccgtctttgacgcgggtctgcagaaggcttacagcccgacttgcagcccgaccttagggttcaaggaagagctgaggccaccacccaccaaattggccgcctgcgagcctctcaagcacggactgcagggcgcaagtctggggcacgcggctgctgcgcaggcgcacctgagctgtagagacctcccattgggccagccacattacgactccccaagctgcaaggggaccgcatactggtaccctcccggatcagcggcaaggtcccctccttacgaggggaaggtaggcacaggcctgctcgctgatttcctcggtagaacagaggcggcctgcctgtcagcgccccacctagccagccccccggccacacccaaggccgacaaggagcccctggaaatggctcggcctcccgggccaccgaggggcccggccgcagccgcagccggttacggatgtcctctgctctctgatttaactttgagtcctgttccacgggatagcttactgcctctccaggatacggcctatagataccccgggtttatgccgcaggcacatcctggactgggaggggggcccaaaagcggatttctcggacctatggccgaacctcatcccgaggacaccttcaccgtaacctctctgtag

SEQ ID NO: 44460 - DNA, 450 bp, Artificial Sequence
  Description of Artificial Sequence: Synthetic coding sequence
atgcgggtgaagccccagggcctggtggtgaccagcagcgccgtgtgttcctccccagattacttgcgggagcctaaatattaccccggcggcccacctacaccacggcctctgctgcctactcggcctccagcttctccccccgataaagcttttagcacacatgctttttccgaaaatcctcgccctcccccccggcgagacccctcaacaagacgccctccagtactggccaaaggtgatgacccactccccccacgcgcagcacgtcctgtctcccaggcacgctgtccaacccccgtcggcgacgggtcatcctcaagaagatgttgggataatgggcgggtcaacctgagacccgtggtccagctcatcgacattatgaaagatctgactcgactcagccaggatctgcagcactcaggggttcatttagactgcggaggctag

SEQ ID NO: 44461 - DNA, 1239 bp, Artificial Sequence
  Description of Artificial Sequence: Synthetic coding sequence
atggaggccctgcagaagcagcaggccgcccggctggcccagggcgtagggcctttagctcctgcgtgtcctctgctaccacctcagcctcctttgcctgatcataggacacttcaggcgcctgagggagcactgggaaatgtcggagcagaggaggaggaggatgctgaggaagatgaagagaagcgcgaagaagcaggcgctgaagaggaagccgctgaagagtcccgtcccggggcacagggaccttcttctcctagctctcagcccccaggattacatcctcacgaatggacttacgaagagcagtttaagcagctctacgaactggacgcagatcctaaacggaaagaatttctcgatgacctcttttcctttatgcagaagcgcgggactccagtgaatcgagttcccatcatggccaagcaggtgttggacctctacgctctcttccgcctggtgaccgccaagggaggtctcgtcgaggttattaatcgaaaagtgtggagagaggtaacacgagggctgtcccttcccacgaccatcacctcagccgccttcacacttcgaacacagtatatgaaatatctttacccctacgagtgtgagacaagggctctatctagccccggtgaattgcaggccgcgattgactcaaaccgtcgcgaggggagacggcaggcctatactgccacacctctctttggcctggctggcccccccccaagaggagctcaggaccctgctctgggccctggtccggctcctcctgccacacagtcctcaccaggtccagcacagggcagtacctccggtttaccagcccacgcttgtgctcagctctccccctcccctatcaaaaaagaggaatccggaatacccaatccctgcctggccctccccgtgggtcttgctcttggaccaacgagggagaaactggcccccgaggaacccccagaaaagcgcgcagtattaatgggcccaatggaccccccgcgaccttgtatgcctccatcttttctgccccgtgggaaagtgcctttgcgtgaagagaggctcgacggcccgctcaatttggcaggctctgggatttccagcattaatatggctctcgagatcaacggtgtggtgtacacgggagtcctgttcgcgagaaggcagccagttcccgcctcccaaggcccaacaaaccccgctcctccgccatctacaggccccccgtcgagcattttgccatag

SEQ ID NO: 44462 - DNA, 441 bp, Artificial Sequence
  Description of Artificial Sequence: Synthetic coding sequence
atgaccagcgagcggagccggatcccctgcctgagcgccgccgccgcagagggtacaggaaagaagcagcaggaaggcagggccatggcgactctggacagaaaagtcccgtcacccgaggcctttcttgggaaaccatggtccagttggatagacgccgcaaaacttcattgtagtgacaacgttgatcttgaggaggccggtaaagaaggcggcaaaagcagggaggtcatgcggctcaataaagaagatatgcacctgttcggacactatcctgcccatgatgacttctacttggtggtttgcagcgcttgtaatcaggtcgtaaagccacaggtttttcagtctcattgcggtaggaaacaggacaatcgccgaaacgaggggatctctaggtccgggccggagagctctcaagccatcgaaaagcaccaggtttag

SEQ ID NO: 44463 - DNA, 1602 bp, Artificial Sequence
  Description of Artificial Sequence: Synthetic coding sequence
atggacggcgccgacgagagcgagaagctggactgccagttcagcactcatcaccctcggcctctagccttttgctcttttggttccagactcatgggacgggggtactacgttttcgaccgtagatgggaccggttccggttcgccctgaactctatggtggagaaacatctcaattcccagatgtggaagcataggaacccttcacacagagccagcggaccttcacctctcttcaggacttgtctgactaaccttttatcgctctctaacattggtgcagcctgggtttccacacttgagtctgtggcccctcgctatcctctaaatctcgccgcgcaaacgcccggacctgggggcccagagccagggggcatggctgcagatggcggagtagaggacatacgtaagaaacgcaatggtcaggattcattcttctttaacaagcatctgaccctccaccaggagcctcctacccagtactcactgtcagcacgaaagatcccccctgccgccgattccccactgccctctccagccgcacatattactacaccagtgcccgctagtgtcttgcagccctttagcaatccaagtgctgtgtatttgccatccgcaccaattagtagtagattaacgtctagttacataatgacttccgcaatgttgtcaaatgccgctttcgtaacctcccctgatccctctgccctcatgagccacactactgctttccctcacgtggctgctacactgagtattatggatagcaccttcaaggccccttctgccgtttccccgatccccgccgtgatacctagcccttcccataaaccctctaagacgaagacctccaagtcctctaaagtgaaagacctgtcaactagatccgacgaaagcccctcaaacaaaaagcgcaagccacagtccagtacatcttcatcttcctccagctccagcagtagcctgcaaacctccctctcctcacccctaagcggcccacataagaagaactgtgtcttaaacgcaagcagtgctctgaattcttaccaagctgctcccccttataactctctgtccgttcacaactctaataacggcgtttccccgcttagcgctaagctagaaccctccggtagaacatcgctcccaggcggtcctgctgatatcgtgcgccaagtgggtgcagtgggcggttctagcgattcctgtccgctctcagtacccagtcttgctttacacgccggcgacctgagtctggcttcccacaacgcagtcagctcactgcctctgagttttgacaaatctgaggggaagaaaagaaaaaactcatcttcttcatcaaaagcatgcaaaataacaaaaatgcctggtatgaattcagtgcataaaaagaacccaccctccctactggcacctgtccctgaccccgtcaacagcaccagcagtaggcaggtgagagatctgctcgcccctccctcgccagcactcggaggccgagggtcgtgggccgcaccactgctttctcgagccgccccaaccggcaacacatctctgatacccgttcttgtcttccccgaggggtcatttcacccgctcctgtag

SEQ ID NO: 44464 - DNA, 2586 bp, Artificial Sequence
  Description of Artificial Sequence: Synthetic coding sequence
atgaccagcgagcggagccggatcccctgcctgagcgccgccgccgccgagggtacgggcaaaaaacaacaggaaggccgagcaatggcgacgttggaccgcaaagttccaagccccgaagccttccttgggaaaccctggtcttcatggatagatgcggccaaattacattgtagcgataacgtggatcttgaggaagctggtaaagagggtggcaaaagtcgggaagttatgagattaaacaaggaggacatgcacttgtttgggcattaccccgctcacgatgacttctatctggtcgtttgcagcgcatgtaaccaagtagtaaaaccacaagtgtttcaatcacactgcgagcgcaggcacggatccatgtgcagacctagccctagccctgtgtctcccgccagcaatccacggacttccctcgttcaggttaagacaaaagcatgcttgtccgggcaccacagcgcctcgtccacatcaaagccattcaaaacaccaaaggacaatctgctcacctcctcttcgaagcagcacaccgtttttcccgcaaaaggaagcagagataaaccatgcgttccagttcctgtggtctctttagagaagattcccaacctcgtgaaagctgatggggccaacgtgaaaatgaactccaccacaaccacagccgtttctgcgtccagcacctcctcctccgccgtgtcgacgccaccattaattaaacccgtcctgatgtctaagtctgtgcctccaagtcccgagaaaattttaaatgggaaagggatactccccaccacaatcgataaaaagcaccagaacggaacgaaaaattccaataaaccttacaggcgactttctgaaagggaatttgaccctaacaaacattgtggagtcctggatccagagaccaagaagccctgcactaggtccctgacttgtaagactcactcgctgagccaccggagagcagtgccgggacgaaaaaagcaattcgatctcctgttggcggagcacaaagccaagtctagggagaaggaggtcaaagataaggaacacctgctgacttctacacgggaaatcctaccatcacaatcaggcccagcccaggattcgctgctcggatccagcggatccagcgggcccgaacctaaggtagcctcacctgccaaaagtcgccctccaaattccgtgctcccaagaccatcgtcagcaaacagtatatccagtagcacatccagcaaccacagcggacacacccccgagcctcctctcccccccgttggcggggacctggcgtcccgcttgtcctctgatgagggagaaatggacggtgccgatgagtcagagaagttagactgtcagttctctacacatcatccccgtccacttgccttctgtagcttcggtagcaggttgatgggacgaggctattatgtgtttgatcggaggtgggatcgctttaggtttgcgcttaactcaatggtagagaaacatctgaatagccagatgtggaagaagatcccccctgctgcagattcacccctgccaagccctgccgcgcacatcactacccccgtgcccgcctcggtgctgcagcctttcagtaacccttccgcggtgtatcttcctagcgcgcccatttccagcagactcacaagtagttacatcatgacatccgcgatgctgtctaacgcagcattcgtgacctctcccgacccgagtgccctaatgtctcacacgacagcgttccctcatgtcgccgccaccttgtctatcatggattctacctttaaggcccccagcgccgtttctcccattcctgcagtgatcccctccccgagtcacaaaccgagcaagacaaaaacctcaaagtcgagcaaagtgaaagatctttctactcggagtgacgagagcccaagcaacaagaagagaaagccacagagctccaccagttcttcctcgagctcttcaagttctagtctgcagacctcactgtcgtccccactgagcgggcctcataagaagaattgcgtgctgaacgcatctagcgcgttaaactcttatcaggcagccccaccatacaattcgctctccgtgcataacagcaataacggggtctccccactgtccgctaagctggaaccaagcgggagaacatccctgcctggcggccccgctgacatcgtaagacaggtcggcgctgtgggtggaagtagcgactcctgcccactgagcgtgcctagtttggcacttcacgctggggatctttccctggcttcccacaatgcggtatcaagtctgcccctgtctttcgacaagtccgagggcaagaagcgtaagaattctagttcatctagtaaggcttgcaagattaccaagatgccaggcatgaatagcgtgcataaaaagaatcctccaagtctcttggcaccagtgcctgatcccgttaatagtacatcttcaaggcaggtaggcaagaacagctccctcgccttgtcacaatcaagcccaagttctatatcttccccaggacacagtagacagaatactaaccgcacggggaggattagaacattaccgtag

SEQ ID NO: 44465 - DNA, 2217 bp, Artificial Sequence
  Description of Artificial Sequence: Synthetic coding sequence
atgtgccggcccagccccagccccgtgagccccgccagcaacccccggacatctttagtgcaggtcaagactaaggcctgtctttccggccatcactcggcgtcttcaacttccaagccattcaagacacccaaggacaatctgctgacttccagcagtaagcagcatactgtctttccagcaaaaggcagccgcgacaaaccttgcgtaccagttccagttgttagcttggagaagatcccaaacctagtgaaggcagatggcgctaacgtgaagatgaacagcactactactactgctgtgagcgcaagttcgacgagcagttctgctgtgtccactcctccactgataaagcccgtgcttatgtctaagtcagtgccaccttctcccgagaaaatcctgaatgggaagggtattctgcctaccacaatcgacaaaaaacatcaaaacggaaccaagaactctaacaaaccctacaggcgactgagtgagagggagtttgacccgaacaagcattgcggagtgttggacccagaaaccaagaaaccctgcacacgatcactaacatgtaaaacccattcactgagtcaccggagagctgttcctggaaggaagaagcagttcgatctgctgctcgccgagcataaagccaagagccgggaaaaggaggtgaaggacaaagagcatctgctcactagcacccgcgagatcctgcccagccagagcggtcctgcccaggacagccttttgggtagctccggaagttctggcccggaaccaaaggtggcttcccctgctaaaagtcgccctcctaacagcgttttgcctcggcctagcagtgctaactctatctcgtccagcacgtcgtctaatcacagcggacacacacctgagccgcctctgccccccgtgggtggtgatctcgcctcacggctgagctcggatgagggtgaaatggacggggccgacgaatctgagaaactagactgccaattctcgactcaccaccccagaccgctggctttttgttcatttgggtcccgccttatggggcggggctactacgtgtttgacaggagatgggatcgattccgtttcgctctgaacagcatggtagagaaacatcttaattcacagatgtggaaaaaaatcccgcctgccgccgactcgccactgccaagtcctgctgcccacatcaccactcccgtacctgccagcgtgttgcagcctttttctaatccaagcgcggtgtacctgccatctgcgccaatcagttcacgcttgacctcatcatatatcatgacaagtgcaatgttgtccaacgccgctttcgtcacgtcccccgatccgtccgcactaatgtcccatactacagcgtttccacatgtagctgccaccttgagtatcatggacagcacatttaaggccccatctgccgtgtcccctatccccgccgtgataccttcaccgtcacacaagccatccaagactaaaacttcgaaaagcagcaaggtgaaggacttgtctactagatctgatgagagcccatctaataaaaagcgtaagcctcagtcctcaacctcgagttctagctcatcttcttccagcagcctccagacttccctgtcgtcaccactctcagggccgcataaaaaaaattgtgtgctcaacgcatcaagcgctctcaattcatatcaagctgctccaccctataactccctgtctgttcataattcaaacaatggagtatcacctctgtcggccaaacttgagccctccggacgtacatccctgcctggcgggcccgcagatatcgtccggcaggtgggagcagtggggggctcaagcgactcatgcccgctgagcgtgcctagtctggctcttcatgcaggcgatcttagcctggcttctcacaacgcagtgagttctctaccacttagtttcgacaagtcagaaggaaagaagagaaagaacagttcttcttccagtaaagcttgtaagatcaccaagatgccaggtatgaacagtgttcataagaaaaacccaccttctctcctggcacccgtccccgatccggtaaattccacgtcatcacggcaggttgggaagaatagctctttggccctgagccagagttcaccgtcgtcaatctcctcccccggacactccagacagaagaacactaatcgcactggccgcatccggactttgccgtag

SEQ ID NO: 44466 - DNA, 1050 bp, Artificial Sequence
  Description of Artificial Sequence: Synthetic coding sequence
atgccccggggcggcacccaggccagcagcgaggagagcgaggaggaaggcacaagcgacgacttgcatcctcctcctgactgtcactatgcgaccagacccccccgccctcaggccttctgcacattcggcagccgcctggttagccccggttgctacgtattttctagaagacttgatcgattttgttccgccttatcaagtatgctggagcgacacttaagcacccatatgtggaagaagatcccgcctgcagccgagcctccagctcatctagtgaattccccactgagtgccccgctcagtcctagttcgacagggacatgcccccgcctcccaggcccgactttacgccctgcatgtcctgcatcgatgccgcctacaaaggacaacctggtgccaagctaccccgcggggtcaccctcggtggccgccgcatgcagccaggctgagtgtatgggaggcagccaagccataacaagcccgttgcccgcaaacacgccatcaccctcattttctaaacttcctccctctaaagcgagcaagtcttccaaggggaaggacggggttgaggttgaggcccccagcaggaaacggaaactgtcaccagggcccacaacactcaagcgaacttgtatactcgagcctaccggaaaaggtaagcccagcggatgccggggactgtcggctaaaaccaaaacagccctgtccatggggctgaacggcactatggggccaagagtgaaaagagccgggccactcgattgtcgcgggagcccacaccagctccctacccctgtgaaggctagccagcttgagaaccgcggcgcagctggccatcctgccaaagcactgcccacaaattgtctctccgaagaggaggttgctaagaaacggaaaaatcttgcgacgtactgccgccccgttaaggctaaacattgtcaggccggggcgcccgccgacgtggcgtgtagtgttcgacgcaagaaacccggcccagctttagctttcgaagaaaagtgctccactttaaagagcaaggctcactag

SEQ ID NO: 44467 - DNA, 2169 bp, Artificial Sequence
  Description of Artificial Sequence: Synthetic coding sequence
atggccgtgcgggagcgggccgccgccgccatggccgccctggagaggagggtacctagcctggatgactttgccggccagtcttggagctcatgggttgaacgggcagacctacctgcagccgacggcgccgaacttgaggaatcctccaagaacaccaaaaagctcgacgcaatgactttgattaaggaagacatgagtattttcggtcactgtcccgctcatgacgacttctatctggttgtgtgtaatcattgttcccaggtagttaaaccgcaggcgttccagaagcattgtgagcgcaggcacgggcccttatccaagctctatggtagggcgccgccacccccacccgccccggctagcagccagaagtgtcatgtcgttaacggtcagggacctgcctgtagagctccaggttctacaaagaccagtagccgagagaaaggtcagggttcccgttctcgggggcatcaaccacccgagaaaacccaaaaagataacctgtgtcagcctggaggccttaccaaggacagtccaggtaagccaccaatggcgcctcccagtaaggaaccccctgggcgagaaaacattgagattattccatctgaggggtcctcccactgggccgagggtagccctcctgagaaggaaccaagtggaactcggctgcccccaaagactcaccgcaagatggcaaggaaagagtgcgacctcaaccgacagtgtggtgtgatcaaccccgaaacaaaaaaaatctgtacacggctgctaacatgcaagatccacagtgttcaccaaaggagggaagtgcagggcagagccaaagattttgatgtgctggtcgccgagctgaaggccaactccaggaagggagaaagccctaaggaaaagtctcctgggcggaaggagcaggttctggagcgaccatcacaggaactcccttcaagtgtacaggtcgtggccgccgtagcagctcctagtagcacgtttagcgtgcgggctaaacagacctatccctactgtgctttgccccggagtagggcttcctccgaaagcgaactcgatgacgaggggccttgcgggggagatggggatccgggcctctttccatttcccatgcctcggggaggcacccaggcatcgagcgaggagtccgaagaagaaggtacatcagatgacctccacccaccgcccgattgtcattacgctaccagacctcccaggccccaagcattttgtacatttgggagtcgccttgtctctcccggttgctatgtgttcagtaggagactggatcgattttgttccgccttaagtagcatgctggaacgccacctctctacccacatgtggaagaaaatacccccagcggccgagcctcccgctcaccttgtgaattcgcccctgagtgcccccctcagccccagtagtaccgggacatgcccccggctcccgggtccaaccctccgccccgcctgtcccgccagtatgcccccgaccaaagacaacctggtcccatcctatcccgccggttctcccagcgttgcggctgcttgtagccaagcagaatgtatgggcggatcccaggctatcaccagcccattaccagccaatacaccttccccaagttttagcaagctgccccctagtaaagcctcaaagagctcaaaagggaaggatggggtcgaagttgaggcccctagtcggaaaagaaagctgtctcccgggccaaccacacttaaaagaacctgcatcttagaacccactggaaagggcaaaccaagcgggtgccgaggccttagcgccaagaccaagaccgcgctctctatggggctcaatgggactatgggcccaagagttaagcgggccgggcccctggactgccgcggcagccctcaccaactccctacccccgtgaaagcaagccagttagaaaaccggggggccgcgggacaccctgctaaggccctgcctacaaattgcctaagtgaggaagaggttgccaagaagcggaaaaatctggcgacctactgccggcctgttaaggcaaagcactgtcaggctggagccccagccgatgtagcgtgttcagttagaagaaagaagcctggcccagctctagcattcgaggagaaatgttctaccctgaaaagtaaggcacactag

SEQ ID NO: 44468 - DNA, 1743 bp, Artificial Sequence
  Description of Artificial Sequence: Synthetic coding sequence
atggccgtgcgggagcgggccgccgccgccatggccgccctggagagaagagtgccatcactggatgatttcgccggtcagagctggtcttcatgggtggagcgagccgatctcccggctgccgatggtgctgagctggaagagagtagcaaaaacacaaagaaactggacgctatgacattgataaaggaagatatgtcaatctttggccactgccccgcccatgacgacttttacctcgttgtgtgtaaccactgttcccaggtggttaagcctcaggccttccaaaagcactgtgagcgacggcatggcccgctatcaaagctgtacgggcgagccccaccaccacctcccgcccccgcctcatcccaaaagtgtcatgtagtgaatggacagggcccagcttgcagagctcctgggtccacgaagacttcctcacgcgagaagggacagggcagtcgttccagaggtcaccagcccccggaaaagacccagaaggacaatctgtgtcaacctggcggtctgacaaaggatagcccaggaaagcctcctatggcccctcctagtaaagagccacctgggcgagaaaacattgagattatcccaagcgagggctccagccattgggctgaaggctcccctccggagaaggagccctcaggaacgaggctaccaccaaagacacacaggaaaatggcccgcaaagaatgcgacttaaaccgccagtgtggagtgatcaaccccgaaaccaagaaaatctgtactcggcttctcacatgtaaaatccacagcgtgcatcagagacgcgaagtacaaggaagagcgaaagatttcgacgtgctggtcgcagaattgaaggcaaactccaggaagggagaatcgccaaaagagaagtctcctggccggaaagagcaggtcctggagagaccctctcaagaactgcctagctcagtccaggtggtggccgcagtggctgccccatcgtctacattctcagtgagggccaaacagacctacccctactgtgccctaccacgctctcgtgctagttccgagagcgaactcgacgacgaggggccatgtggcggggatggcgatcctggcctcttcccttttcccatgcccaggggcggcacacaggcgtcctccgaggagtcagaggaagaagggacttcagacgaccttcacccgccaccagactgccattatgctaccagaccaccaaggcctcaagcattctgcacctttgggagccgcctagtgagtccaggttgctacgtgttttcacggcggctcgacaggttttgctctgctttgagttcaatgctggaaagacatctgagtactcacatgtggaagaagattcctcccgctgctgaaccacctgcgcacctggtgaattctcccttatctgccccactatcgcccagctctacagggacctgcccccgtcttcccggcccgacccttaggcccgcctgtcctgccagtatgcctccaaccaaagacaatttggtgccgtcttacccggcagggtctccgtccgttgccgccgcttgtagtcaggcagagtgtatgggcgagccagggtaccacctgacaacggcgtgtcagcacgcaatcccagtgctgcagcaagctgccgcattccaggggcaacaggttattcagaggcaggggcgaggaggaggaggagggccttttagcaaagctgaggtgattccatggccttaccactcttag

SEQ ID NO: 44469 - DNA, 294 bp, Artificial Sequence
  Description of Artificial Sequence: Synthetic coding sequence
atggaggagatcagcctggccaacctggacaccaacaagctggaggccattgctcaggaaatttacgtcgatctgattgaagatagttgcttaggcttttgttttgaagtacacagggctgtgaagtgtgggtacttttatctggaattcgcggagacagggtcagtgaaagattttggtatccagccggtggaggataaaggcgcctgtcgactgcctctttgttccctgccaggcgaaccaggtaacggccctgaccagcagcttcaacgcagtccaccggaattccagtag

SEQ ID NO: 44470 - DNA, 1860 bp, Artificial Sequence
  Description of Artificial Sequence: Synthetic coding sequence
atgctgctggccagcgccgtggtggtgtgggagtggctgaacgagcacggacggtggcgaccctatagccccgccgtgagtcaccacattgaagcagttgtcagagcagggcccagagccggaggatccgttgtactgggacaggtcgatagccggctagccccttatattatcgacctccaaagcatgaatcagttccgtcaggataccggaactctgcgccccgtccgcaggaactattacgacccgtcgtctgcaccgggtaagggcgtggtgtgggaatgggagaacgataacgggtcttggaccccatatgacatggaggtggggatcactattcagcatgcctacgaaaaacagcatccatggattgaccttacctcaattggattctcgtacgtaatcgactttaacacaatgggtcagattaatagacagacgcagagacagcggagggtgcgacgcaggttggatctaatatacccgatggtaacaggcacactgccgaaggcgcagtcctggcccgtgtcgccggggcctgcgacgtccccccctatgagcccctgttcttgcccacagtgtgtgctcgtgatgtccgtcaaagctgccgtcgtaaatggctccacaggaccgttgcagctcccggtgacacggaaaaacatgcctccacctggggtagttaagttgccacccctgcctggctcgggggccaaaccgctggacagcactgggactatacgcggcccactgaagactgccccgtcccaagttattcgccgtcaggcgtcatcgatgcctacagggactacaatgggatcccctgcctcccctccagggccaaatagtaaaaccggacgtgtggccttagccactctgaatcgcacaaacctacaaaggcttgctatagctcaaagtagagttctgattgccagcggggtccctaccgttccggtcaaaaatctgaacggcagctcgcccgtaaatccagctctcgccgggattacaggcatcctgatgagcgcagctggactgcccgtgtgcctgaccagacccccaaagctggtattgcacccaccacccgtttccaaatccgagatcaaaagcattccaggcgtcagtaatacctcaaggaagactaccaaaaagcaggccaagaaaggaaagacgcctgaagaagtcctgaagaagtacttacagaaagtgaggcaccctccagacgaggactgtaccatatgtatggaacgcctaaccgccccctctggctataaagggcctcagcccaccgtgaagccagatctggtcggtaagctgagtaggtgtgggcacgtataccatatttattgcctggtggctatgtacaataatgggaataaagatggctctctgcagtgccctacctgtaaaaccatatatggagttaagactggaacacaacctccaggaaaaatggagtatcatcttatccctcattccctgcccggtcatcccgactgcaaaacaatacgtatcatctacagtatccccccaggaatccagggacctgagcaccccaacccaggaaaatcatttagcgcgaggggttttccccggcattgctacctcccagacagcgagaagggacggaaagttttgaaactcttgctggtcgcatgggaccgcagactcatattcgccattgggacaagctccacaacaggtgagagtgacactgtcatctggaatgaagtccaccacaaaactgaattcggttccaatttaacgggacatggctaccccgatgcgaactacctcgacaacgtcctggcagaattagccgcccagggcatttccgaggattcaactgctcaggaaaaggactag

SEQ ID NO: 44471 - DNA, 996 bp, Artificial Sequence
  Description of Artificial Sequence: Synthetic coding sequence
atggccgtggccatggtgaagctgtgcgagcgggccggcctgcccttgttggccgccccccttcttagaagccttttgccgagagccccacagccaggtcccgcccagcccaggagcgtgcaggggcaacggtgtccagcacgccacccccccggaaacctggtatgcgaacgcggggcaggagtgaatggcgttacggctggcgctggtggacgcctgagagggctccaccggggagggcgagcgctgggctgctccgctcatcgtccgctgcacagcgcccgggtgcgccctcctgcccatctggcagcaccacctggttcctcggccaggggctgccgcttaaccgaattaggttacgccctgaatgaatggctgcaggatattaggaaaaatcagctccctgggctgctcggcggggtgggaccaatgcatagcgttgtgcaactctttcaggggtttagagatctgctctggctgcctatcgaacagtatcggaaagatggtcgactaatgcggggattacaacgtggcgccgccagcttcggatctagcactgcatctgccgcccttgagctgtcaaatagattggttcaggctatccaagccactgccgaaaccgtttacgatatactctctccagccgctcctgtcagccgctctcttcaggacaaacgcagtgcgcggaggctacggcgcgggcagcaacctgcggacctgcgcgaaggggttgccaaagcctacgatactgtgcgagagggaatcctcgacaccgctcaaaccatatgcgatgtagcctcgagaggacatgagcaaaagggcctgaccggcgccgtgggaggagtgatacgacagctgccgcctacagtggtaaagccgctgatcctggcaactgaagctacatcgtccctgttgggggggatgcggaaccaaattgttccggacgcccacaaggatcatgccttaaagtggagatctgacagtgcccaggactag

SEQ ID NO: 44472 - DNA, 5817 bp, Artificial Sequence
  Description of Artificial Sequence: Synthetic coding sequence
atgagccggtggctgtggccctggagcaactgcgtgaaggagcgggtgtgtagatatcttctgcatcattacctggggcacttcttccaagaacacctgtcactggaccagctttcactggacctgtacaaagggtccgtggcccttagagatattcacctagagatatggtccgtgaacgaagttctcgagtctatggaatctcctctggaactggtcgaaggttttgtaggctcaatcgaggtggccgtgccctgggccgccttgttgactgaccattgtaccgtacgggtgagcggcctccagctgacactccagcctaggcgtgggcccgccccgggagctgccgatagtcagagctgggccagttgtatgactacatccttacaactggcacaggagtgcctcagagatggtttgcctgaaccgtcagaaccacctcaacccttggaggggcttgagatgtttgcacaaaccatagagactgtgctcaggcgtataaaggtcacatttctggataccgtggtgcgagtagaacacagtccaggagacggcgaacgcggtgtcgcagtggaagtacgcgtgcagcgtctggagtattgcgacgaggctgtacgtgatccgagccaagcccctccagtggacgttcatcagcctccagccttcttgcataaattactccaactggctggagtcagattacactacgaggagctgcctgctcaggaagagcctccggaacctccactccagattggtagctgctccgggtatatggagcttatggttaaacttaagcagaacgaagccttcccgggacccaaactggaagtggccgggcagctgggcagcttgcacttactcctcaccccacgacagctgcagcagctgcaggaactgctatctgcagtgtctctgaccgaccacgagggcctcgccgacaagcttaacaagtctagacctcttggcgctgaagacctctggttaatcgaacaggatctgaaccaacagctgcaggctggagccgtagctgagcctctttctccagaccctctgaccaaccccttgctaaatctggacaatactgatctgtttttcagcatggccgggctaacgtccagcgttgccagcgccctgtcagagctctctttaagcgacgttgacctcgcctcctccgttaggtctgacatggccagtaggcgactgtccgcccaagcccatcccgccgggaagatggctccaaaccccctgttagatacaatgcgacccgattcactgcttaaaatgactttgggcggggtgacacttacgctactgcagacttccgccccttctagcggtcctccagacctcgccacccatttctttaccgaatttgacgcgaccaaagatggtcccttcggaagtcgagattttcaccacttgcgtcccaggtttcagcgcgcttgcccatgttcacacgtgagactgacaggaacagccgttcaactgtcttgggagttaaggactggttctagaggcaggcggacgacatccatggaggttcacttcggccaattggaggtccttgaatgtttatggcctagaggaacctctgaaccagaatacacagagatactaacctttccgggaaccctgggttcccaggcctctgccaggccgtgtgctcacctccgccatacgcagatcctacgaagagtaccaaagagccgtccccgtcggtccgtcgcttgtcattgccacagcgaactggcccttgatttggctaacttccaggccgacgttgaacttggtgcgcttgacagacttgccgctcttctcaggcttgctaccgtgcccgccgaaccaccggccggactcctcacggaaccgttacccgcgatggaacagcagacagtgttcagattatcagcccccagggcaaccttgcggctgagatttccgatagccgatctgcggcccgagcctgacccatgggctgggcaagccgtgcgggcggaacagctgcgtctagaactgagcgagccacaatttagatccgaactctctagcggtcccggccccccagtcccgacgcacttggaactgacatgctcagatttacacggcatttatgaggacggaggaaaacccccagtaccatgcctacgcgttagcaaagcactcgacccaaagtccactggcagaaagtattttctcccacaagtggtggtgactgtgaatcctcagagctccagcacccagtgggaggtagcccctgagaagggcgaagaactggagttaagcgttgaaagtccgtgtgaactgcgggagccagagcctagtcctttctctagcaaacggaccatgtacgagaccgaagagatggtgatccctggagaccccgaggagatgcgtacttttcaatccagaacgttggctttatccagatgctctttagaggtgattcttccatccgtgcacattttcctgccttctaaggaggtgtatgaaagtatatacaacagaataaataatgacctgctgatgtgggagccagcagacttactgcccactccagaccctgccgctcagccatctgggtttccaggacctagcgggttttggcacgacagctttaagatgtgcaaatcagcctttaagctggctaattgctttgacctgactccggactccgattccgatgatgaagacgctcactttttttcagtaggtgcttccgggggcccacaggcagctgccccagaggccccctcgctgcatctccagtctacattctctactttggtaacggtgctgaaagggagaatcaccgccctgtgtgaaaccaaagacgagggggggaaaaggcttgaagccgtgcacggtgaattggtcttggacatggagcatggaaccttgttcagtgtgagtcaatactgtggtcagcccggtctcggatacttttgcctggaagccgaaaaggcaactttatatcatagggcagcggttgatgattatcccctgccaagtcacttggatctgccttcgttcgctccccccgctcagctggctcccaccatttacccttcagaggaaggggttaccgagaggggtgcctctggcaggaagggacagggacgtggccctcatatgctcagcacagcggtgcggatccacctggacccacacaagaacgtgaaggagttcttggttacccttcgacttcacaaggccaccctgcgacactacatggcactgccagaacagtcctggcacagccagttgctggaattcctcgatgtgctagatgatccggtcctcggatacctgccacccactgtaattacaattctgcacacccatctattttcttgttctgtggattacagaccactctacctgccagtgagggtgttaatcactgcagaaacctttacgctctcaagtaacatcattatggacacgagtacgtttctgctgagattcattctcgacgattctgcgctttacttaagcgataaatgcgaagtggagactctggacttacgccgggactacgtgtgcgtgttagacgtcgaccttttggagttggtcatcaagacgtggaaaggaagcaccgaggggaagctgagtcagcctctgtttgaattgagatgttccaacaatgtcgtccacgtacactcttgcgcggattcttgtgccctgttggttaatttgttgcaatacgtcatgtctaccggggatctgcaccctcctccccggccacctagtcccaccgagatcgcgggacaaaagctatcagaatcaccagcaagtctgccttcctgtccaccggttgagacggcccttattaaccagcgcgacttggcagacgctttgctggacaccgaaaggtctctccgggagctggctcaacccagcggcggtcacttgcctcaggctagtcccatttccgtgtaccttttcccaggggagagaagcggcgccccaccccccagccctccagtaggagggccggcaggctctctaggaagctgtagcgaggaaaaagaggatgaaagggaagaagagggagatggagacaccctggattctgacgaattttgtatcctggatgctcctggcctgggcattccacctcgagacggcgagcccgtggtgactcagctccacccgggacccattgtcgttcgtgacggatactttagtagaccaatcggatccactgatctgctgagagccccggcccacttccccgtaccctcgaccagagtggtcctccgggaagtcagcctggtgtggcacctttatggagggcgggacttcgggcctcaccccggccatcgggccaggacgggcctttccggtccacggagctcccctagtcgctgtagcggtcctaatagaccccaaaattcttggcggacccaaggtggaagtggcaggcagcaccatgtcttaatggagattcagctgtctaaagttagctttcagcacgaagtctaccccgctgagccagccacggggccggctgctcccagccaagaacttgaggagcgccctctctccaggcaggtcttcatcgtccaggagcttgaagtaagagatagattggcctctagccagatcaataaattcctatatctgcataccagtgaacgaatgccgcgcagggcacactccaatatgctgactataaaggccctgcacgtggctccaaccaccaatttgggggggcccgaatgctgcctccgcgtcagcctaatgcctttgagacttaacgtcgaccaagacgccctgttctttctcaaggactttttcacctccctcgttgctgggatcaacccagtggtgccaggtgagacctcagctgaagcaaggcccgaaactcgggcccaaccctcctccccgcttgagggccaggccgaaggagtggagacgaccggtagccaggaagcacccggggggggtcacagtccctcaccccccgatcagcagccaatctacttcagagaatttcgctttacttctgaagtgcccatctggctagactaccacggcaagcacgtcaccatggaccaggtaggtacattcgctgggctactgatcggactcgcgcagcttaactgtagcgagcttaagctgaagaggctctgctgccgacatgggctcttgggggtggataaggtcctggggtacgcacttaatgaatggctgcaggatatcaggaaaaatcagctacctggcttgctgggaggcgtgggacccatgcactctgtggtgcagctgttccaggggttccgcgatttgctttggctcccaatcgagcagtaccgcaaggatggtcggcttatgagaggactccagaggggtgccgcctcctttgggtcttctacggcttcagccgcccttgagctgtcgaatcggctggtgcaggccatccaggccaccgccgaaacagtctatgatatactctccccagctgcacctgtgtcccgcagcctgcaggacaagcgcagcgctcgcagattgcggcgcggccagcaaccagcagatttgcgtgagggggtcgccaaggcctacgatactgttcgggagggcattttagacaccgctcagacgatttgtgacgtagcttccagggggcatgagcagaaaggactgacaggcgcagtgggtggagtgatccgacagctgccacccactgtggtgaagcccctgattctggccaccgaagcaacatcctcgctactgggcgggatgcgcaaccagatcgtaccagatgcccacaaagaccacgctctcaaatggcgtagcgatagcgcacaggactag

SEQ ID NO: 44473 - DNA, 5823 bp, Artificial Sequence
  Description of Artificial Sequence: Synthetic coding sequence
atgagccggtggctgtggccctggagcaactgcgtgaaggagcgggtgtgcaggtatctcctccaccactatctgggccacttcttccaggagcacttatctctcgatcagctctccttggatctttacaaggggtctgtggctctccgggacattcatcttgagatctggtctgtaaacgaggtgctggaaagcatggagtctcctctggagcttgttgaagggttcgtgggatcaattgaggtcgccgtgccctgggctgctctcctgaccgaccactgtaccgtgagagtttctgggctccagctcaccctacaacctcgtaggggacctgcccctggggctgccgatagtcagtcgtgggccagttgcatgaccacttcacttcagctggcgcaggagtgcctcagagatggtcttccggagccgagtgaacccccgcagcccttggagggcttagaaatgtttgctcagacgatcgagacagtgttaaggaggataaaagtgacatttctggacacagtggtgcgggttgagcattcaccaggggacggggagcgcggtgtggctgtggaggtccgagttcaacggctcgagtactgtgacgaagctgtgagagacccttcacaggctccacctgttgacgtgcaccagcccccagctttcttacacaaattgctccagctggccggggtcaggctgcattacgaagagttgccagcgcaggaagaacctcctgaaccaccattgcagatcggcagttgtagcggctacatggagctcatggtgaagctgaagcagaacgaagccttcccaggccctaaactcgaagtcgccggacagctggggtccttacatctcctcctgacacctcgtcaactgcagcagctgcaggagttgctgtccgcagtctccctcacggaccatgaaggactggccgataagttgaataaatcgcgtcccctcggggccgaggatctgtggttgatcgaacaggatctcaatcagcagctacaagctggagcagtagctgagcctctttccccggacccgctcactaacccactgctcaatttggacaacacggatctcttttttagtatggcgggcctcacctcgtccgtagcatctgccttgtcagagctgtctctctccgatgtggatttggcttcatcagtgcggtccgatatggcaagccggagattgagtgctcaggctcatccagcgggtaagatggcccccaacccccttctcgatactatgcgccctgattccctcctcaagatgacactaggaggtgtgaccctgacacttctccaaacgtcagctcctagctctggaccccctgacctggcaactcatttttttaccgagtttgacgctactaaagatgggccgtttgggagccgagatttccaccaccttcgacctagattccagcgggcctgtccgtgcagtcacgtacgtctaactggcacagcggtgcagctttcctgggaactgcgcacagggtcccggggccgtaggactaccagcatggaggtgcactttggccagttggaagtcctggagtgcttgtggccgcgcggcacaagtgaaccagaatacaccgaaatactcaccttcccaggaacattaggcagtcaagccagtgcccgaccgtgtgcacatcttcggcatacccagatactgcgacgcgtgccaaaatccagacccaggcgcagcgtagcatgtcactgtcatagcgagctggcactggaccttgcaaatttccaggcagatgtggagttgggcgctttggaccgcctggctgctctgcttaggctggcaacagtgcccgcggagccacctgccgggctgttaacagagccactgccagccatggagcagcagaccgtttttcgtctaagcgctcctcgggccactctccgcctgcggtttcccatagctgatctccgacccgaacctgacccctgggccggtcaagccgtgcgagctgagcagctaagactggagttgtctgagcctcaatttaggagcgaactatccagcggccctggcccacctgtgcccacacacctggagctcacatgtagtgacctgcatgggatctacgaggatgggggtaaacctccagtgccctgcctgcgggtgagtaaagctctggaccccaagagcacaggccggaaatatttcctgccacaagtggtggtgacggtcaacccccaaagtagcagcactcaatgggaagtggctcccgagaaaggcgaagaactagaactctcagtcgagtcgccatgcgaactgagagaaccagagccatccccattctcaagcaagcggacaatgtatgagacagaagagatggtaattccaggcgaccccgaggaaatgcggaccttccaatcgcgaacgttggccctgagccgctgctcccttgaagtgatcctgcctagcgtgcacatcttcctcccctccaaggaggtgtacgaatcaatctataaccgcatcaacaacgatctgctaatgtgggaaccagccgatcttctccctacccccgacccggccgctcagccaagtggatttccagggccatccgggttctggcatgacagtttcaaaatgtgtaagagcgccttcaagttggccaattgttttgacctgacaccagacagcgatagcgacgacgaagatgcccacttcttctctgtgggagcttccggaggcccccaagcggctgctcccgaggctccctcattgcatctgcaaagcaccttttcaactctggtgactgtgctcaaaggacgcataactgctctgtgtgagactaaagatgaaggaggtaagcggctcgaagccgttcacggcgaactggtcctggacatggagcatggtaccctcttttctgtgtcgcagtactgcggccagcccggcctcggttacttttgcttggaagctgaaaaggcaactctgtatcacagggcagctgtggatgactatccacttccatcacatcttgacctgccttctttcgcccctcctgcacagttggccccgaccatctacccgtcagaagaaggagtgaccgaaaggggggcaagcgggagaaaggggcagggccgcgggcctcacatgctgtcgacggcggtgcgaatccatttggacccacacaaaaacgtgaaagagttcctggttaccctgcgcctgcataaggcaactctgcggcactatatggctctgcctgagcaatcctggcacagtcaattgctggaatttcttgacgtgctggacgaccccgtgctgggatatctcccccctacggtgattactattctccacacacacctcttctcctgctccgtcgattatcgccctctctacctacccgttagagtgctgatcacagccgaaacattcaccctgtcttcaaatatcatcatggacaccagcacattcttactgcgcttcatactggacgacagtgccttatatctgagcgacaagtgcgaggtggagaccttggatctccgcagggactacgtctgtgtcctcgacgtagatcttttagagctggtgataaaaacttggaaggggtctaccgagggtaagctgagtcagcccctctttgagctgagatgctccaacaatgtggtgcatgttcactcttgcgccgactcctgcgctctgctggtaaatcttcttcaatatgtgatgagcaccggggatctgcacccccccccacgaccccccagtcctactgaaattgcagggcagaaagttcaattgtcagaatccccagccagccttccctcctgcccacccgtcgagactgcattaattaatcagagggacctcgctgatgctctgctggacacagaacgcagtctcagggaactggctcagcctagcgggggccatctgccccaggcctcccccatttcagtctacctgtttcccggtgagagatctggggctccaccgcctagcccaccagttggtggtccagcaggcagcctgggatcatgctctgaagagaaagaggacgagcgggaggaagaaggagacggtgatacactcgactccgacgaattttgcattttggatgctccgggattgggaatacctccaagggatggggagccagttgtaactcagctgcaccccgggccaattgtagtccgcgacggctacttttccagacctatcgggtccaccgacctgttaagagccccagcccactttccagtgccaagtacaagagtggtcttgagggaggtgagccttgtgtggcacctttatggaggacgcgattttggtccgcaccctggacatcgggctcggaccgggctgtccggtccccgcagttcaccgtctagatgttctggccccaacaggcctcagaactcctggaggacccagggcggttccgggaggcaacaccacgtgttgatggaaattcagctgtccaaggtgtccttccagcacgaagtataccccgcagaacccgccacggggcccgccgctccttctcaggagctggaggagcggccacttagtcggcaggtattcattgtacaggagctcgaagtccgtgaccgactggcctccagtcagataaacaagttcctgtatctgcatacatctgaaaggatgcctcgcagggctcactctaacatgctgactattaaagctctgcacgtcgcgccaaccacaaaccttggcggacccgaatgctgcctgagagtgagccttatgccccttcggcttaatgtcgatcaggacgctctttttttcttgaaggattttttcacaagccttgtggcaggcattaacccagtggtgcccggggaaacctccgcagaggcaagaccagagacaagggcccagcccagctccccactggagggccaggctgaaggggtggaaaccacaggctcacaggaagcccctggcggtggccattctccctccccccctgatcagcaaccaatatactttagagaattccgatttaccagtgaagtgcccatatggttggactatcacggcaaacacgtgacaatggatcaggttgggacgttcgccgggctgcttatagggctcgcccagttgaactgctcagagctcaaactaaaacggctttgttgtagacacgggctgctgggcgtcgataaggtgctcgggtacgctctgaatgaatggctgcaggatataagaaagaaccagcttcccggcctgctgggcggagtagggccaatgcattcagtagtacagctgttccagggttttagggatctgctctggctgccgattgagcagtaccgcaaggacggtcgcctgatgaggggattacagaggggggcagcttcttttggctcgtcaaccgcctcagccgccctggagctgtcgaatagattggtgcaggctattcaagcaactgcagagacggtttatgacattctttcgccagcagccccagtgtcccgctcattgcaagataaacggagcgctcgaaggttgagacgcgggcagcagcccgcagacctgagagaaggagtggccaaagcgtatgatacagtcagagagggaattctggacaccgcacagaccatctgcgatgtggcatctagaggacacgagcagaaaggacttactggggccgtgggtggagttatccggcagttgccacccacggtggttaaacctttgatcctcgccactgaagccaccagtagccttctgggggggatgcggaatcaaatcgttcccgacgctcacaaggaccatgccttaaaatggcgatcggatagtgctcaggactag

SEQ ID NO: 44474 - DNA, 6237 bp, Artificial Sequence
  Description of Artificial Sequence: Synthetic coding sequence
atgccctggcccttcagcgagagcatcaagaagcgggcctgccggtaccttctgcagcgatatctggggcattttctgcaagaaaagctgagcctggaacagctttccctggatctgtaccaaggtaccggtagcctggcccaggtgccgttagataagtggtgccttaatgagatcttggagtccgccgatgctccccttgaggtgaccgaaggattcatccagagcatctctctgagtgtcccctggggatccctgttacaggataactgcgccctggaagttagagggttggaaatggttttcaggccacggccacgccccgcaacaggcagtgaacccatgtattggagttctttcatgactagctctatgcagctcgctaaggaatgtctgtctcaaaagcttaccgatgagcagggggaggggagccagccctttgaaggactagagaaattcgctgagacaatcgaaacggtgcttcgtcgcgtgaaggttacatttatcgacaccgttctgcggattgaacatgtgccagaaaacagcaagactggcactgctctggaaatccggattgagagaacagtttattgcgacgaaacagcagacgagtcttctggtatcaacgtgcaccagcctaccgcattcgctcataagctcctacagctcagtggagtgtccttattctgggatgagttttctgcttccgcaaagagctcccccgtgtgcagtacagccccagtggagaccgaaccaaagctgtccccctcctggaacccaaagattatatacgagccgcacccacagctgaccaggaacctcccagagattgctccatcagatcccgtacagattggccgcctgataggtaggttggaactctctttgacactgaaacagaatgaggttctgccaggcgcaaaattggacgttgacgggcagatagatagcatccacctcttgctgtcaccccgccaggtgcatttgctgctcgatatgctagctgccatcgccggtccagaaaattcatctaagatcggcctggccaataaagaccgaaaaaaccgtcccatgcagcaggaagacgagtaccgcatacagatggagctcaatagatattatctgcgaaaagacagtctatctgtgggagtttcgagcgagcagtccttctatgagacagagacagcaaggacgccctctagcagagaagaggaggtgtttttctccatggcggacatggatatgagccacagcctgagcagccttcccccactgggagatccacctaatatggacctggaattgtctctcacctccacatacactaatactcccgcaggtagcccattgtcagcaactgtcctgcagccaacttggggcgaatttctagaccaccacaaagagcaaccagtgcgggggtccacatttccgagcaacctcgtccaccctacgcctctgcagaaaactagcctgccttctagatccgttagtgtagacgagtccaggccagagttgattttccggctggctgtggggacgttcagcatttctgtattacatatagatccattgtcccccccagagacatcacaaaacctgaatccactcaccccaatggccgttgcgtttttcacttgtattgagaagattgacccagcacggttttccaccgaggattttaagtcttttagggcagtctttgccgaggcatgtagccatgatcatctgcgcttcattgggactggcatcaaagtatcatacgagcaacggcagaggagtgcatcacgttatttctcgacagacatgtccattgggcagatggaatttcttgagtgcctctttccaaccgactttcacagtgtgccgccacactacacagagttgcttacatttcactcaaaggaagagacggggtcccactctcccgtttgtttacagctccactataaacacagtgaaaaccgcgggccccaagggaatcaggcaaggctgtcctctgtgccccataaagctgagctgcagataaaactgaatccggtgtgctgtgagctggacattagcattgtggaccgactgaactcattactccaacctcagaaactcgcaaccgttgaaatgatggcttcgcatatgtatacaagctacaacaaacacatatctctgcacaaagctttcactgaagtttttttggacgatagccatagtccagcaaactgtcggatctccgtgcaagtagccactcccgcgttgaatctcagcgtgcggtttccaatccccgacttacgttctgaccaagaacgggggccttggttcaaaaagtcacttcagaaagagatcctgtacctggcctttactgacctggagtttaagacagaattcattggcggcagtacccctgagcagatcaagctcgagttgactttccgtgagctgataggctcttttcaagaggagaagggagacccctcgataaagtttttccacgtgtcctccggggtagatggtgacacaactagctccgatgatttcgattggcctagaattgtgctgaagataaatcccccagctatgcactctatattagagagaattgcagccgaagaggaggaggagaatgatggacattatcaggaggaggaggaaggcggggcacacagtttgaaagatgtctgtgatttgcggaggccagcacctagcccattttcgtcacgtcgtgtgatgtttgagaatgaacagatggtcatgcctggcgaccctgtagaaatgactgagtttcaggacaaagcaatatccaactcacactatgtactagagctgacgctccccaatatctatgtcaccttacctaataagtcgttctacgagaagttgtacaacaggatattcaacgatctgctgctttgggaacccactgccccgagccctgtcgaaacctttgaaaatatctcctatgggatcggtctctcagtggccagccaactcatcaacacctttaataaagacagtttctcagccttcaagagtgcggtgcactacgacgaagagtccggaagcgaagaagagacgctgcaatactttagcaccgttgaccccaactaccgtagtcgcagaaagaaaaagcttgacagtcagaacaaaaattcccagagctttctgagcgtgctactcaacataaaccacggtctgatcgctgtgttcacagatgtgaaacaggataacggagatcttctggaaaataaacatggggaattctggctggagtttaattccggcagccttttctgcgtaacgaagtatgagggattcgatgacaagcattacatctgtcttcactcctcatcatttagtttgtaccataaaggtattgttaatggtgtcatcttgcctacagaaacccggctgccctccagcaccaggccacactggctagagcctaccatttacagctcggaggaggatggcctgtcaaagacaagctcagacggcgtgggcggggacagcctgaacatgttgtccgtggctgtgaaaatcctaagtgacaagtcagaaagcaacacgaaggagtttctaattgctgttggcctgaaaggggccacactccagcatcgaatgctcccgtcaggccttagctggcatgaacaaattctttatttccttaacatcgcagatgaacccgtcttgggatataatcccccaaccagttttacaacgttccatgtacacctttggagttgcgcgctagactacagacccctgtacctccccatccggtcactacttaccgtagagaccttttccgtgagctctagtgtggccttagataagtccagctcaactctgcgcatcatcctggacgaggctgccctgcatctgagcgataagtgtaacaccgttaccatcaatctgagcagagactacgtcagagtgatggatatgggcctgctcgagctaacaatcacagccgtcaaatcggacagcgatggcgaacaaaccgaaccacggtttgaactccattgtagctcagatgttgttcatattcggacctgcagtgactcgtgtgcagccttgatgaatctgatccaatatatcgcatcttacggagacctgcagacccctaacaaagccgacatgaaacccggcgcttttcagagacgaagcaaggttgactcttctggccgctcttcatcccgggggcccgtcctgcctgaggcggaccagcagatgttgagggatcttatgtctgatgccatggaggagatcgatatgcagcagggcacctcttcggttaagcctcaagcaaacggcgtgcttgatgaaaaatcacagattcaggagccctgttgctctgatctattcttgttcccggatgagagcggaaacgtgagccaggagagcggacccacatatgcctccttcagccatcacttcatcagtgacgccatgactggagtgcccaccgaaaacgacgacttctgtatcctatttgctcctaaggccgccatgcaggagaaggaggaggaaccagtcataaagattatggtcgatgatgccatagtgatccgagataactacttctctcttcctgttaataagaccgacacatccaaagctccgcttcacttccctatcccagtaatacggtatgtggtgaaagaggtcagccttgtgtggcacttatacggtggtaaagactttggcatcgtgccgccaacaagtccagcgaaaagctacattagccctcatagcagtccatcacacacacccaccagacacgggcggaacaccgtctgcgggggtaaaggcaggaatcacgactttcttatggagatccagctgagtaaagtgaaattccagcatgaagtgtacccaccctgtaagcctgactgcgattcctccctgtctgagcatcccgtctctcggcaggtgttcatcgtgcaggatctcgaaatccgagaccgcttggctacatctcaaatgaataagttcctgtatttatattgctctaaggaaatgccaaggaaggcacattctaatatgctgacggtgaaggccctgcacgtgtgccccgaatctggcaggtccccgcaggagtgctgcctgcgagtttccctgatgccgctccgcctcaacattgaccaggatgctctgttcttcttgaaagacttcttcacaagtctcagtgctgaagtcgagctgcaaatgacccccgacccggaggttaaaaagtccccaggcgccgatgtcacttgttccctgcctcgccaccttagtactagtaaagaacccaatttagtgatttctttcagcgggccgaagcaaccttctcagaatgattcagctaacagcgtcgaagtggttaatggaatggaggaaaaaaatttctcagcagaggaggcctcatttcgcgatcaacccgtgttcttccgtgaattcaggttcacaagtgaggtcccgatcagactcgactaccatggaaagcatgtgtctatggatcagggtacactcgctggtatcctcatcggactcgcccagctgaactgttcagaactcaagctgaagagactgagttaccgacatggcctgctcggcgtggacaaacttttttcatatgccataaccgagtggctgaacgatatcaaaaagaaccagttgcctggaatcctcggtggggtgggcccaatgcacagcctggtgcagttggtccagggcctgaaggatctggtgtggttgcccattgagcagtaccgcaaggacggacgaattgtgaggggtttccagcgaggtgcagcctcattcggtaccagtacagcaatggcggctttggagttgaccaataggatggtgcaaacgatccaggcagcagccgaaactgcttatgatatggtgtcacccggaaccctcagcatcgagcccaaaaagactaagagattcccacaccatcgactagctcaccagccagtcgacctgcgcgaaggggtggctaaggcttatagcgtggttaaagaaggaatcactgatacagcgcagactatttatgagacagctgcgagggaacacgaaagcagaggggtgaccggagctgtgggagaagtgttgaggcaaattccaccggctgtcgtgaagccacttattgttgccacagaagctacaagcaatgtgcttggaggcatgaggaaccagattcggcccgacgtacggcaggacgagtctcagaagtggcggcatggtgacgactag

SEQ ID NO: 44475 - DNA, 2214 bp, Artificial Sequence
  Description of Artificial Sequence: Synthetic coding sequence
atggaggacgccggcgaggaccccaccaccttcgccgcccacagcctgcctagtgacccgaggcttttggcaacggtcacaaatgcttatctggggaccagggtgttccatgataccctgcacgtctctggcgtgtacaacggcgccggaggtgacacacaccgggcaatgctcccaagcccactgaacgtgaggttagaggctccagctggcatgggcgagcagcttactgagactttcgccctggacaccaacactgggagctttctgcacaccttggagggacctcgattccgggctagccagtgtatttacgctcatcgtacccttccacatgtgctggcatttcgagtaagcatagctcgcttggcccctgggtcaggcccaataaccctgcttttgcgtagcgccttctcaccggaaagcccagacctggatctacaccagggcccagattttcaaggagcccgatacctttatggtcatactctgacacccgaacagcccgggggcccccagcaagaggtccacatgctctggactccagctccccctgatttgaccctcggagagggcgaggaagccaggacatgggacttcttgacagccgtgggggggtcgcaggcagaggcgcaggcctgtctcaccgaggccctgcaactccaggctcgcggggccctctacactgcgcatgcgcaggcttgggcgcagctctgggtggaatgtggcctcgacgtggtgggccctctccagttacgccaggccttaagagggtccctctattatctgctgtctgcacttccccagcctaaggcccccggatacatttgtcacggcctgtctccgggtggtctgtcaaatggttccagggaggaatgttactggggtcatgtcttttgggatcaggacctatggatgtttcccagcattctaatgtttcatcctgaggctgctcgcgccattctcgaataccggatccgaacactcgacggcgcattggaaaacgcccagaacctgggttatcagggtgcaaaattcgcctgggagtcagcagatagcggtttggaagtgtgtcctgaggacatctacggcgtccaagaggtccacgtgaacggcgctgttgtcttagcctttgagctttattatcatacaactcaagacttacaactgtttagagaggccgggggctgggacgtggttcgtgccgtcgctgaattttggtgcagcagagtagagtggtcccctcgcgaggaaaagtaccatctgaggggggtgatgtcccccgatgagtaccattccggtgtcaataactccgtgtataccaacgtgctggtgcagaactcgctcagattcgccgccgccctggcccaggacctgggactgcccattcccagccaatggctggcagttgcagacaagatcaaagttccatttgacgttgaacaaaacttccatccggaatttgatggctatgaacccggagaagtggtgaaacaggccgatgtagtgctcctggggtaccccgtgccgttttctctgagccccgacgtgcgtagaaagaacctggaaatttacgaggccgtcactagcccacagggccctgctatgacttggtcaatgttcgcagtaggttggatggaactcaaggatgcggtgagagcccgcggcttgctggaccgcagctttgccaatatggccgagccatttaaagtttggacagaaaatgccgatgggtccggggccgtgaattttctaacagggatggggggttttctgcaggccgttgttttcgggtgtacaggctttagagttacacgagccggcgtcactttcgatccagtgtgtctgtcaggtatcagtagagtgtcagtctctggcattttctaccaaggtaacaagttgaacttctctttcagcgaagattctgttacggtggaggtaacagcacgcgctggaccatgggcaccccacctagaggccgagctgtggccaagccaaagtcgactgagccttctgcctggtcacaaggttagtttcccgcgaagcgcaggccgcatccagatgtcaccacccaagcttcctggctccagttctagtgagtttcctgggcgcacattttccgatgtgagggaccccctgcagtctcctctgtgggtgactctcggaagttctagtccaacagaaagtctcactgtggacccagcttctgagtag

SEQ ID NO: 44476 - DNA, 804 bp, Artificial Sequence
  Description of Artificial Sequence: Synthetic coding sequence
atgcgggtggccgccctgatcagcggcggcaaggacagctgctacaatatgatgcagtgcattgcagccggccaccaaattgtggccttagctaacctgcggccagcggagaaccaggtagggagtgacgagctggattcttatatgtatcaaacagttgggcaccatgcaatcgacctatacgccgaggctatggctctgcctctgtaccgacgcaccatccgcggcagatctttggacacccggcaggtctacacgaaatgtgaaggagacgaagtcgaggacctttacgaacttctaaagctagtaaaggaaaaagaagaagtggaaggcattagcgtgggtgccatcctgtctgactatcagcgcattcgggtcgagaacgtgtgtaaaagattgaaccttcagcctcttgcctacctctggcagaggaaccaggaagacctccttagggagatgatctcctctaacattcaggccatgatcattaaagttgccgcactcggactggacccggataagcatctgggaaaaacactggatcagatggaaccgtatcttatcgaactatccaagaagtatggtgtccacgtctgcggcgagggaggcgaatacgaaacttttacactggattgcccattatttaaaaagaagatcatcgtggatagctcagaggtggttattcactcagccgatgccttcgctccagtggcgtaccttcggtttctggagctgcacctcgaagacaaagtctcgagcgtacctgataattacagaacgtcgaactatatctataacttttag

SEQ ID NO: 44477 - DNA, 498 bp, Artificial Sequence
  Description of Artificial Sequence: Synthetic coding sequence
atgcgggtggccgccctgatcagcggcggcaaggacagctgctacaatatgatgcaatgtatagccgctggccaccagatcgtggcactggcaaatctacgcccagccgaaaaccaagtgggaagtgacgagctggacagctatatgtaccagacggtgggacatcatgccatcgacctgtacgcagaggccatggccttgccattataccgcaggacgatccgaggaagaagtttggacactcggcaagtttacactaaatgtgagggcgatgaggttgaggatttgtacgagctgctgaaactggtgaaaggtataacacgtatgactctcctcgccgaatatgacgccctgaacttacaggattttcatatgcacttaaaagtcgggtcacaggcgattgtttacagaacacctaatgagctctgtacacactccaagttcgacaagcatacttttcctccgttcatctctgagattgcgaaatgcgaggtgtag

SEQ ID NO: 44478 - DNA, 3306 bp, Artificial Sequence
  Description of Artificial Sequence: Synthetic coding sequence
atgagcgccaaggccatcagcgagcagaccggcaaggagctgctgtataagtttatctgcactacatctgctatccagaatagattcaagtatgcccgagttacccctgacactgattgggcgaggctgctgcaagaccacccctggctgcttagtcaaaatctggttgtgaaacccgaccagctgatcaaacgcagaggaaagttaggactagtgggggtgaacctgacgctcgacggggttaaatcctggctgaaaccgagactcggtcaggaggctactgtaggcaaagctactggctttctgaagaatttcctgatagaaccgttcgtcccacatagtcaggccgaggagttctatgtctgtatctatgcaacacgggagggagactacgttctctttcaccacgaaggtggcgtcgacgttggggacgtcgatgccaaggcccagaaattattggtcggcgtggacgagaagttaaatcctgaagacataaaaaagcatttgttagtccacgcaccggaagataaaaaagagattctcgcctcattcatttcaggtctctttaatttttatgaggacttatatttcacctatttggagatcaacccactcgtggtaaccaaggacggcgtctacgttctggacctggcagccaaggtagatgcaacagctgactatatctgcaaggtgaagtggggtgatatagaattccctccaccatttggtcgggaagcctaccctgaagaggcgtatatcgcggacctcgatgctaaaagcggcgcctccctgaagctgacactcctaaaccctaagggccgcatctggactatggtcgcagggggaggagcatcagtagtttatagcgacacaatatgcgacctgggaggggtgaatgagttggccaactacggcgaatatagcggggctcccagcgagcagcaaacgtatgattacgctaaaaccattctttctctcatgacaagggagaaacaccctgatggaaagatattaataataggcggctcgatcgccaatttcaccaacgtagccgcaacctttaagggcattgtcagagcaatcagagattaccagggccctctgaaagagcacgaggtgaccattttcgttcggcgcggcggtcccaactatcaggagggcttacgggtaatgggcgaagtgggcaaaaccaccggaatccccattcacgtgttcggcacagaaacccacatgacggctattgtgggaatggccctcggccaccgacccattccaaatcaaccacctaccgcggcccatactgcaaattttctcctcaacgccagtggatccaccagcactcctgccccatccaggacagctagtttctctgagtcacgcgccgacgaagtggcgcctgctaaaaaggcaaagccagccatgccacaggattccgttccctctccacggtccctgcaggggaaaagtactacactcttctcccgacacactaaagctattgtgtggggcatgcagacacgcgcagttcagggaatgctggatttcgactacgtgtgctctcgcgatgagccctctgtggccgcaatggtatatccatttactggggatcacaagcaaaaattctattgggggcacaaggagattttgattccagtctttaaaaacatggctgatgcaatgaggaagcatccggaagtcgacgtgctgattaatttcgcctctttgagatccgcctacgacagcacaatggagaccatgaactacgctcaaatcaggacgattgccatcattgcagaaggaatccccgaagcactgaccaggaagctgattaagaaggccgatcagaagggcgtcacgatcatcggacccgccactgtgggcggcattaagcccggctgttttaaaatcggtaacacaggcggcatgctagataacattttagcatctaagttatacagacctggctcggtggcatacgtgtcccggagcggcggaatgtctaacgaactgaacaacatcatatccagaaccaccgacggcgtttacgagggcgtagctattggcggcgaccgctatcccggctctacgttcatggaccacgtgctcaggtatcaagacactcctggtgtgaagatgatcgtggttcttggcgagattggcggtaccgaggaatataagatctgcaggggaatcaaagagggtaggctaactaaacctattgtgtgctggtgcatcggcacttgcgctaccatgtttagcagcgaagtccagtttgggcatgctggcgcctgtgccaaccaagccagcgaaacggccgttgctaagaatcaggccctcaaggaggctggcgttttcgtcccacggtccttcgatgaattaggtgaaatcatccagtcagtgtacgaagatttagtcgctaatggcgtgatagtcccggctcaagaagttccaccccctactgtaccaatggactacagctgggccagggagcttggccttatacgaaaacccgcctcatttatgacatctatatgcgatgagcgagggcaggagctcatctacgctggaatgcccatcaccgaggtctttaaggaagaaatggggatcggaggtgtgctcggattattatggttccagaagagactccctaagtactcatgtcaattcattgaaatgtgtctaatggtgaccgccgaccacggacccgccgtgtctggggcccataacaccatcatttgtgcgagggcaggaaaagacctggtgtcatctctgacatctggcctgctaaccattggcgaccgtttcggcggagccctggacgctgcagccaagatgttctccaaggccttcgatagtggaataatccctatggaatttgtaaacaagatgaagaaggaggggaagctaatcatgggcatcggacatcgcgtgaaatccattaacaatcccgacatgcgagttcaaatccttaaagactacgtgcggcagcactttccagccaccccccttctcgactatgccctggaggtcgagaagatcactaccagtaagaaaccgaacctgattcttaacgtcgatgggttaatcggggtggcatttgtcgatatgctgcggaactgcgggagctttacacgggaggaggccgatgagtatatagacattggcgcactcaatgggatcttcgtgctgggtaggtcaatgggtttcattggacattacttagatcagaagaggctgaagcagggcctctacaggcacccttgggacgacatatcgtacgtgctccctgagcacatgagcatgtag

SEQ ID NO: 44479 - DNA, 288 bp, Artificial Sequence
  Description of Artificial Sequence: Synthetic coding sequence
atggcccacttcaaggacgacctgcagaccaacgtggagatcatcccaggggagagtgcacctcggaaggagagtccaaggcctccggccccaccctcttcagccgctggggtaggaggctgcagcaaccattctccatctgtacaagaatcaccactgagcccccctgcacttgcccagctgggttcggcacagcagccctctatgcgaacggagctgtcattttccgagaagaaggacacaatgattatctggcagattaccatcactgtgtggtgccagcgctag

SEQ ID NO: 44480 - DNA, 288 bp, Artificial Sequence
  Description of Artificial Sequence: Synthetic coding sequence
atggcccacttcaaggacgacctgcagaccaacgtggagatcatccccggtgagtccgcccctagaaaagagtctccccgccctcctgcccccccctctagcgcagctggcgtagggggatgctctaatcacagtccttctgtacaggagagtccgctctctccaccagcactggcccagctcggctctgctcagcaaccatctatgcgtacagagctgagcttctctgagaagaaggacacgatgatcatttggcagattacgataactgtctggtgccaaagatag

SEQ ID NO: 44481 - DNA, 1173 bp, Artificial Sequence
  Description of Artificial Sequence: Synthetic coding sequence
atgccccccagcggcctgcggctgctgcccctgctgctgcccctgctgtggctgcttgtcttaacccccggtagacccgccgccggactttctacttgcaagacgatcgacatggagttggttaaacggaaacgcatcgaggcgatcagaggtcaaatactgagcaaactacgcctggctagcccgccatctcagggtgaagtgccgccaggccctctccccgaggcagtcttggccctttacaactctacaagggaccgggtagccggtgaaagcgctgagccggagcccgagccggaggctgattattatgctaaagaagtcactagagtgcttatggtcgagacccacaatgagatttacgacaagtttaaacagtcaacccattctatatacatgttctttaatacatcagaattacgtgaggccgttcctgagccagtgctcttatctcgggctgagctccgtctcctccgcttaaagctgaaggtcgagcagcacgttgagttgtatcagaagtactctaacaactcctggaggtacctctctaaccgcctgctggccccttcagattcccctgaatggctcagctttgatgtgacaggtgtcgtgcgacagtggttgtcaaggggcggagaaatagagggatttaggctgagcgctcactgttcatgcgacagccgcgataacactctgcaggtcgatattaatggtttcactacaggtagaaggggcgatcttgccactatccacgggatgaaccggcctttcttactactcatggcgacaccattggagagggctcagcacctgcaatcaagtcggcataggagggccctagacacaaattattgcttcagtagtacggagaagaactgttgcgttagacagctgtatatcgattttaggaaggacctggggtggaagtggattcacgaaccaaaagggtatcatgcaaacttttgtctagggccctgcccatatatctggagtttggacacacaatatagcaaagtgcttgctttatacaaccaacacaaccccggcgcctcggccgctccgtgctgcgttcctcaggccctcgaacctttgccgattgtatattatgtaggtcggaagcccaaggttgaacaactgtccaacatgattgtgaggtcctgtaagtgtagctag

SEQ ID NO: 44482 - DNA, 576 bp, Artificial Sequence
  Description of Artificial Sequence: Synthetic coding sequence
atgtgggacctggtgctggaggaccggcggatgaacagcctgcggctggtggctccaatgtggaacggaagaattcgggggatacaccggctcggcgctgcagtggccccagagggcaaccagaagaaaaagcggaccattctgcaattcctgactaattatttttatgatgtcgaggcattgagggactatttgctgcagagagagatgtacaaggtgcatgagaagaacagaagttacacctggctggagaaacagcatggcccttatggagccggggccttcttcatcttgaaacaggggggcgccgtgaagttcagggacaaagagtggattaggcctgataagtacgggcacttctcccaggagttctggaatttttgtgaggtgccggtagaagcagtcgatgccggagactgtgacatcaactatgaggggctggataacctgagaacaagcgcagggtggacgtcgcggacaagtctcccctgcccgacactggcaagcctgcgctactggtggcggagatgctgtcccattgcgcggctctgggaatccactgggcttcgagcttag

SEQ ID NO: 44483 - DNA, 792 bp, Artificial Sequence
  Description of Artificial Sequence: Synthetic coding sequence
atgtgggacctggtgctggaggaccggcggatgaacagcctgcggctagttgctccgatgtggaacggtcgtattagggggatccaccggttgggggccgccgtggctccagagggtaaccagaagaaaaagaggacgatcctccagtttctcacaaactacttctatgacgtcgaggcgttgagggattacctgcttcaacgggaaatgtataaggtccacgagaagaaccgtagttatacctggctcgaaaagcagcacggcccctacggcgctggagccttcttcattctcaaacagggtggcgcggtcaagtttcgcgataaggagtggattaggccggataagtatggccacttttcacaagaattctggaacttttgcgaggttccggtggaggccgtggacgcaggggattgtgacattaattacgagggactagacaacctcctgagactcaaggagctacaaagcctgtccttacagcggtgttgccatgtggacgattggtgtcttagtcggttatatcccctagctgattcgctccaggagctctctcttgcgggctgtcctcggatttctgagagggggttggcgtgcctgcaccacttacaaaacctgcgccgattagatattagcgatcttcccgctgtgtcaaatccaggcctcacacagatactcgtggaggagatgctccctaattgcgaggtcgtgggtgttgattgggcagagggcctgaagagtggaccggaggaacagcctcgggataccgcaagccccgtgcctgcttag

SEQ ID NO: 44484 - DNA, 693 bp, Artificial Sequence
  Description of Artificial Sequence: Synthetic coding sequence
atggccgccccctgggccagcctgcggctggtggcccccatgtggaacggaagaattcggggtattcatagactcggcgccgcggtggcaccagaaggcaatcaaaagaagaaaaggacaatcctccaattcttgacgaactacttctatgacgtggaagccctgcgcgactatttgttgcaaagggagatgtataaggttcatgagaagaaccggtttagggacaaggagtggatccgccctgataagtacgggcatttttcccaggaattctggaacttctgcgaagtgccagttgaggccgtggacgcgggggattgcgacatcaattacgagggccttgataaccttcttcggcttaaggaattacagtccctcagcctgcagagatgctgccatgtggatgattggtgcctctctcgactgtacccattggccgattcactgcaagagctttcccttgcggggtgtcctaggatttctgagcgaggactggcgtgcctacatcacctacagaacctcagaagactggatatctcggacctgccggccgttagcaatccaggcttgacacaaattctggtcgaagagatgcttcctaactgcgaggtggttggagtcgactgggccgaaggcctaaagtctggcccagaagagcagcctcgggacaccgcctctcccgttcccgcctag

SEQ ID NO: 44485 - DNA, 1002 bp, Artificial Sequence
  Description of Artificial Sequence: Synthetic coding sequence
atggagctggacatccacagcgcccaggtgcccctgcccgtgggccgaggaagacacagggatgccacgcccgaaagcaaggggtccttgcaagatctaggatggagtgctgtggcccagagtcaattaaccgccaccagcacctccccggcacaggtgattccccccccccagccaaggtggtccaggactcccgggtttaagagatgtttccgtctgggactccataaagtgctgggtagtcagtcactgaggttggtggcacccatgtggaacggcaggattaggggtatccaccgcttgggggccgcagtcgctcccgaggggaatcagaagaagaagagaacaatcctccagttcttgacgaactacttttacgacgtggaagccctgagggattacttgttacagcgggaaatgtacaaggtgcatgaaaagaatagaagttacacctggcttgaaaagcagcatgggccatatggcgcgggggctttctttattttgaagcagggcggtgccgtgaagtttcgagacaaagaatggattcgacctgataagtatgggcacttttcacaggagttttggaacttttgtgaggtgcctgtcgaggccgtggatgccggcgactgtgacattaattatgagggcttggataatttactccggctgaaggagcttcagtctttgtcactgcagcgttgttgccatgtggatgactggtgtctctctcggctctatcctctggccgacagtttgcaagaactctcgctagctggatgtcccagaatctcagagcggggtctagcctgcctgcaccatcttcagaacctacggcgcctggacatttcagacctgcctgctgtctccaatccggggctcactcagatcctggtcgaagaaatgcttcctaactgcgaggtggtcggggtggactgggccgagggtctgaagtcgggccctgaggaacaaccacgggatactgcgtcacctgtgccagcatag

SEQ ID NO: 44486 - DNA, 693 bp, Artificial Sequence
  Description of Artificial Sequence: Synthetic coding sequence
atggccgccccctgggccagcctgcggctggtggcccccatgtggaacggtcgaataagaggcatacatcggctgggggctgcagtagcgccagaaggtaatcagaaaaaaaagcgaactatcttacagtttctaaccaattacttctatgatgtggaagcccttcgcgactacttgttgcagcgcgagatgtacaaggtgcacgaaaagaacaggttcagagacaaagagtggattagaccagacaagtacggtcactttagtcaagagttttggaacttctgcgaggtccccgtcgaagccgtcgacgctggggactgtgacattaactatgaaggcctggataatctgctgcggcttaaggagctccagtcccttagcctccaacggtgttgccacgtcgacgactggtgcctctcccgcctttatcctttggctgacagtctacaggaactatccctcgcaggttgcccacgcattagtgaaaggggcctggcctgtctgcatcacctgcagaatctacgccgtctggatatctcagatctaccggctgtgtcaaacccgggtctgacccagattcttgtggaagaaatgttgcctaattgtgaagttgtgggcgtggattgggccgaggggttaaagtctggtcccgaggaacaacctcgcgacaccgcctcccctgttccggcctag

SEQ ID NO: 44487 - DNA, 3663 bp, Artificial Sequence
  Description of Artificial Sequence: Synthetic coding sequence
atgggcgacatggccaacagcagcatcgagttccaccccaagccccagcagcagcgagacgtgccgcaagccggtggcttcggatgcaccctagccgaattgcgcactttgatggagctgagaggagcagaagccctccagaagattgaggaagcctatggagacgtgagcggcctgtgcaggaggctcaagacgagccctacagagggccttgccgacaacactaatgacttggaaaaacgaaggcagatctatggacagaattttattccacccaagcaacccaagacgtttttgcagctcgtgtgggaagcccttcaggacgtgactcttataattcttgaggtggcagctatcgtatccctgggcctgtcattttatgcccctccaggcgaggaatcggaagcttgtggaaatgtatcaggcggcgcagaggatgagggcgaggccgaggccgggtggatcgaaggcgctgccatactgctgtcagttatttgtgttgtactcgtgaccgccttcaacgactggagcaaagaaaaacagtttaggggcctgcagtcaagaatcgagcaggaacaaaaattcaccgttatcaggaacggccagctgctgcaggtccccgtagcagctctggtggtgggggacatcgcgcaagtgaagtacggcgatctgctcccagccgatggggtactaattcaagcgaacgatttgaaaattgacgagtccagtctcacaggagaatccgaccacgttcgcaagtccgctgacaaagatcccatgctactctcagggacacatgtgatggaggggagcggccgaatggtggtcacagctgtcggagttaattctcagaccgggattatctttaccctgctgggcgctggaggcgaagaggaagagaagaaagacaaaaaaggcaagcagcaagacggcgccatggaatcatcccagactaaagcgaaaaaacaggacggtgccgtggcaatggagatgcaacctctgaagtctgctgagggaggcgaaatggaagaacgcgaaaaaaagaaagcgaacgctcctaaaaaagaaaagagcgtactgcagggcaaacttactaagctcgccgtacagatcggaaaagcgggcctggtgatgtcggccatcaccgtgattattctcgtgttgtacttcgttatagaaaccttcgtcgtcgaagggcgaacctggcttgctgaatgcacgcctgtgtatgtgcagtatttcgtgaaattcttcatcatcggcgtgacagtgcttgtcgttgcggtgccggaagggctgccactggccgtgacaatatctttagcgtattcagttaaaaaaatgatgaaggataacaacttggtgcgccacttagacgcatgcgaaaccatggggaatgcaacggccatttgttctgataaaaccggcacgctgaccaccaatcggatgactgttgtgcagagctaccttggcgacacacactataaagagatacccgcccccagcgccttaactcccaagatcttggacctgctggttcacgcaatttctatcaattctgcatatactacaaagattctgcccccagagaaggagggggccctgccgcggcaagtcggaaataaaactgaatgcgcattgctgggattcgtgttggatttgaaacgagattttcagcccgtacgcgagcagatccccgaggataagctgtataaagtgtacacattcaatagcgtccgcaagagcatgtcaaccgtgatccgtatgccagacggagggttcaggctcttttccaaaggagcctccgagatcctgctgaagaagtgcactaatatactcaacagtaacggagagttgcgggggttccggcctcgcgacagagatgatatggtccgcaagatcattgagcctatggcctgcgatggcttgcgcaccatctgcatcgcttatagagactttagtgcggggcaggaacccgactgggacaacgaaaatgaggtagtgggagacctcacttgtattgccgtggtcgggattgaagatcctgtgcgtccagaggttcctgaggccattaggaagtgtcaaagagctggcatcaccgtgcgcatggtgactggtgacaacatcaatacggcaagggccattgctgccaaatgtggtataatccaacctggggaggattttctgtgtctcgaagggaaggagttcaataggagaatacgcaatgagaagggagagatcgagcaagaaaggctggataaggtctggcccaaactcagggtacttgccaggtcttctcctaccgataaacacacattggtaaaaggaattatcgactctacaaccggcgaacaacggcaagtggtcgcagtgacaggagatggaacaaacgacgggcccgccctgaaaaaagctgatgtgggatttgctatggggattgccggtactgacgtagccaaagaggcttcggacataattctcacagacgataattttacgagtattgtgaaggcagttatgtggggcaggaacgtctatgatagtatcagtaaatttctgcagtttcagcttaccgtaaatgtggtggcagttatagtggccttcacaggggcctgtatcacccaggatagcccccttaaagccgtgcagatgctctgggtgaacctgattatggacacattcgcctcactggcactcgctacagaacctccgaccgaaagcctcctgttgcgaaaaccgtatggacgagataaacctcttatcagccgcaccatgatgaaaaacattctgggccatgccgtgtaccagctggctatcatcttcacgttgttatttgtgggagagctgttctttgacattgacagtggacgaaacgcgcctctccacagccccccatctgagcactacacgatcatcttcaatacttttgttatgatgcagctcttcaacgagatcaatgctcgtaagatccatggagagaggaatgtgttcgacggcattttctccaatccgatattctgtacaatcgtacttggtacctttggaattcagattgttattgtgcagttcggtggtaagcccttcagttgttcaccactttctaccgaacaatggctctggtgcttgttcgtgggtgtgggcgagctggtgtggggacaagtgattgctactatccctaccagccagctaaagtgcctgaaggaagccggtcacgggcccggcaaggacgagatgacagatgaagagcttgccgaaggcgaagaggaaatcgatcacgctgagcgggaacttagacgtggccagattctgtggttccggggtctaaacaggatccaaactcaaattcgtgttgtaaaggcattccggtctagcctctacgaggggctggaaaagcctgaatcaaaaacatccatccataactttatggccaccccagagttcttaattaatgattatacccacaatatccccctgattgacgacaccgacgtcgacgagaacgaggagcggctgagggctccacccccacccagtcccaaccaaaataacaatgcaatagattcggggatctatttgactactcacgttactaagagcgctacatcctccgtgttttcatcttcaccaggatcgcctctccattccgtcgagactagtttgtag

SEQ ID NO: 44488 - DNA, 4377 bp, Artificial Sequence
  Description of Artificial Sequence: Synthetic coding sequence
atggtgaacacccggaagagcagcctgcggctgctgggcagcaagtcacccggtccaggccctggccctggggccggtgccgagcctggcgccacaggtggctcttctcacttcatttcgtcaagaactagatcctctaagaccagggccgcgagctgccccgccgcaaaagctggtgggagcggaggagctggcgttaccctggatgaggctagaaaagttgaggtcgacggcagtttatcagatagccacgttagtcccccagccaagcgtaccctcaagcagccagattcggtgtgtaaggataagtcaaaatctcggtctacaggccaacgggaagagtggaacctgagtactggacaagcaagactcacttcacagcctggtgccacattaccaaacggccactcaggactgtccctgcgcagtcaccctctgaggggggaaaagaaaggtgacggtgatctgagctgtatcaatggggacatggaggtgagaaagtcttgtcgcagtagaaaaaaccgatttgaaagtgttaaccaaagccttctcttcgaccagttagtgaactcgacagccgaagcagtgctccaggaaatggataatatcaatatacgacaaaataggcgcagcggagaggtggagcggcttaggatgtggacagacactgagttcgagaacatggatatgtacagccgggtgaagcgccgtcgcaaatcattgcgtagaaactcatacggcattcagaatcatcacgaggtgagcactgagggcgaggaggaagaatcgcaggaggaggatggcgatatcgaagtggaggaggctgagggcgaagaaaacgaccgcccctataatctccgccagcgcaaaaccgtcgatcgctaccaggctccaccgatagtgcccgctcaccagaagaagagagaaaataccctttttgatatacacaggagcccagctcgacgcagccatataagacgtaagaaacacgctatccattcctcagacactacctccagcgatgaggaacggtttgagagacggaagagcaagagcatggctagagctaggaatagatgcctgccaatgaacttccgagcagaggacctggcaagcggtatactgagagagcgcgtgaaggtaggtgcctccctggccgacgtggatccaatgaacatagacaagtccgtgcgcttcgattcaataggcggcctgagtcaccacatccacgctctcaaagagatggtggtgtttcctttgctctaccccgagatttttgagaaattcaaaatccaacctccacgtgggtgcttgttctacggtccccccggcaccggaaaaaccttagtggcccgcgcccttgcaaatgaatgtagtcagggcgacaagaaggtggccttctttatgaggaaaggagctgattgtcttagtaaatgggtcggggagtcggagaggcagcttcgactcctgttcgatcaggcgtacctgatgcgaccatcaattatattttttgacgagatcgatgggctggcccctgttaggagttcccgtcaggaccaaattcacagctccatcgtctctacactgttagccctcatggatggcttagacaatcgcggggaaattgttgttataggcgctacgaacaggctggacagcatcgaccctgccctcaggcggccgggacgatttgaccgcgagttcctcttcaacctccctgaccagaaggctagaaaacatatcctgcaaatccatacgcgtgattggaacccaaaactctcggacgccttcctgggcgaactggcagaaaaatgtgtgggctactgtggcgcggacatcaaggccctgtgtacagaggctgccctgattgctctgaggcggagatacccacagatttatgcgtcatcacataagttgcagctcgatgtgtcaagcatagtgctgagcgctcaggatttttaccacgccatgcagaatatcgtgcctgctagtcagcgagccgtgatgagctcgggtcacgccttgtctccaattattaggcctctgctcgaaaggtcctttaacaatattctggctgtattacaaaaggtgtttccccacgcggaaatcagccagtcggacaagaaagaggatattgagacgctcattctggaagacagcgaagatgagaatgccctctctatctttgaaacgaactgtcacagcgggagtcctaaaaagcagtcgagcagcgctgccatccacaagccctatctgcacttcacgatgtcgccctatcaccagcctacctcttatcgaccgcgcctattactgtccggtgaacggggaagcggacaaaccagccacctggctcccgcattgctgcatacactcgaacggtttagcgtacaccggctggacttacctgccctgtatagtgtgtctgcaaaaacaccggaagagagttgtgcccagatcttccgggaagcccgtcggacagtcccttctatagtgtacatgccacacataggagattggtgggaggccgtgagtgagaccgtacgcgctacatttctgacactgctgcaagacataccgtctttctctcctatttttctactgtccacctcggagaccatgtactccgaactgcccgaagaagtcaaatgtatatttaggattcaatacgaggaagtactctatatccagcgaccgattgaggaagaccggcggaagttctttcaagagctaattttgaaccaggccagcatggctcccccccgtcgtaaacatgcagcactttgtgccatggaggtgctccctctggcactcccttcaccacccaggcagctgagcgagagcgaaaagagtagaatggaagaccaagaagagaatacactgcgggaattacgactttttctgcgggacgtgactaagcggctggccactgataaaaggttcaacatcttcagcaagcctgtggacattgaggaagtaagcgactacctggaggtcatcaaggagcccatggatctgtctactgtgataaccaagatcgacaagcacaattacctgactgctaaggattttctgaaagacatcgacctgatttgtagtaatgcccttgagtacaatcccgataaggatccgggcgataagattatccgccacagagcttgcaccctgaaggataccgcccacgcaatcattgctgccgagctggaccccgagttcaataagctgtgcgaagaaatcaaggaagctcgcattaagaggggactgtcagtgaccagcgagcaaatcaacccacacagcacaggagcccgtaaaacagagacacgggtcgaggaggcgttccgtcacaagcaacgcaatcctatggacgtgtggcataatagcgccaacaaatgcgcctttagagtcagacggaagtctaggagacgcagccagtgggggaaaggtatcatcaagaaacgcaaggtgaacaacttaaaaaaagacgaagaagacacgaagttcgccgactatgagaaccacaccgaggaccgcaagctgctggaaaacggcgaatttgaggtctctacggattgtcacgaggagaatggcgaagaaacaggcgatctgagtatgaccaatgatgaatctagctgcgatattatggacctcgaccagggacaacgactgaacaacggcgccggcacaaaggagaattttgcgagtaccgaggaagaaagcagcaacgagagccttttagtgaactcttcatcaagtcttaatccagaacagactagtcggaaagagacctttctgaagggtaattgcctgaatggagaggcctccactgactccttcgagggtatccctgtgttagaatgccagaatggcaagctcgaagttgtctccttctgcgactccggtgacaagtgctcttcagaacagaaaattctcctggaggaccaatccaaggagaagcctgagaccagtaccgagaaccacggtgacgatctggaaaaactggaggcactggaatgttccaacaacgagaagttggagccaggtagcgacgtcgaggtaaaagacgctgaactcgataaagagggcgcatcaaaagtcaagaagtaccggaagctaatcctggagcaggccaaaacaacctcattggaattggtgcccgaagaaccatccgagcctgttcccccactcattgttgatagggaaagactaaagaagttgctcgatctcctggtcgacaaatctaacaatttagccgtggatcaactagaacgactctactctctgctctctcagtgtatttaccggcataggaaagactacgacaaatctcaactggtggaggagatggagcgaacagtgcacatgtttgaaacctttttatag

SEQ ID NO: 44489 - DNA, 639 bp, Artificial Sequence
  Description of Artificial Sequence: Synthetic coding sequence
atggaggtgcggaagagctgccggagccggaagaaccggttcgagtctgtaaaccagtccctgctattcgatcagctggttaatagtaccgccgaagcagttttgcaggagatggacaacatcaatatcagacagaaccgtcggagcggagaggtggagagactccgaatgtggactgacacagaatttgagaatatggatatgtattcacgcgtgaagcggcgaaggaagagtctgcgaaggaattcttacggaatccagaaccaccacgaggtttccactgaaggcgaggaggaggctcggacctccaaactcctgcctctggagaagatttccattgagagtcaagaagaggatggtgacatcgaagtcgaagaggccgagggagaagaaaatgacaggccttacaatctccggcaaagaaagacagttgataggtatcaggcgcccccgatcgttccagctcaccagaagaaacgtgagaataccctctttgacatccacaggagtccggctagaagaagccacatcaggcgcaagaagcacgccatccacagttcagacaccacaagcagtgacgaggagcgctttgagaggagaaaatctaaaagtatggcccgggccaggaacagaaagtag

SEQ ID NO: 44490 - DNA, 1881 bp, Artificial Sequence
  Description of Artificial Sequence: Synthetic coding sequence
atgccccacatcggcgactggtgggaggccgtgagcgagaccgtgagggcaacctttctcacgctgcttcaggacataccctcttttagtcccattttcctgctgagcaccagtgaaaccatgtattcagagctgccggaggaagtcaagtgcattttccgaattcagtacgaggaagtattgtacattcagcggcccatcgaagaggaccggcggaagttttttcaagagctgattcttaatcaggcctccatggccccccctaggcgcaagcacgctgctctgtgtgctatggaggtgctgcccctggccttgccttcccctccccgccagctcagtgagagtgagaaatcaaggatggaggaccaagaggaaaatacccttcgagaactgaggttattcctccgcgacgtgacaaaacgcctggccacagacaagcgcttcaatatcttctctaaacctgttgacatcgaggaagtgtctgactacctggaggtgataaaggaacccatggatctcagcactgtcataaccaaaatcgataaacacaactacttaaccgccaaagattttttaaaagatatcgatctgatctgctcaaacgctctcgagtataacccagacaaggatcccggcgataagattatcagacatagagcttgcaccctgaaggacactgctcacgccattatcgctgccgaattagatcctgagtttaataagctttgcgaagagataaaggaggccagaataaaacgagggctgtccgttacttcagagcagattaacccgcactcgactggcgctcggaagaccgaaaccagggtcgaagaagcatttagacataagcaaaggaaccccatggacgtgtggcataattccgcgaacaagtgtgcctttcgcgttcgtcgcaagtcgaggaggcggagtcagtggggtaaggggatcataaaaaagagaaaggtcaataaccttaaaaaggacgaggaagacaccaagtttgcggactacgaaaaccacacggaggatcgtaagttactggagaatggagaatttgaggtttccacagattgccatgaagagaatggagaggagactggtgacctgagtatgaccaacgacgaatcgagctgcgacatcatggatctggatcagggccaaagactgaacaatggggccggcactaaggagaacttcgctagtaccgaggaggaatcctccaacgaaagccttctcgttaattcgtctagctcattgaacccagaacaaaccagtagaaaggagacattcctgaaagggaactgtctgaatggagaggccagtacagattccttcgaggggatccctgtactggagtgccagaacggaaagcttgaggtggtgtctttttgcgattctggcgacaagtgttccagcgaacagaagattttactggaagaccagtccaaggaaaaacccgagaccagcacagaaaaccatggcgatgacctagagaaattagaagcactggagtgcagcaacaacgagaaattggagcccggctcagatgtggaggtgaaagacgctgagctcgacaaagaaggcgccagcaaagtcaaaaaatacagaaaactgatcttggagcaagcaaagacgacctctttagaactcgtccctgaggagccgtccgagcccgtacctcctctgattgtggacagggagcgattgaaaaagctcttggatttactcgtggataagagcaacaatttagccgtagaccagcttgagagactttattccctgctctcccagtgcatctaccggcatcgaaaagactatgataaatcccagctggtagaagagatggagcggacagtacacatgttcgagacctttctgtag

SEQ ID NO: 44491 - DNA, 1236 bp, Artificial Sequence
  Description of Artificial Sequence: Synthetic coding sequence
atgagcaaggacgccctgaacctggcccagatgcaggagcagaccctacagctagaacagcagtccaaacttaagcagctggtaaatgaggacttaaggaagcaggaggaatcagtccagaaacaccaccagacttttctggagtctattcgcgcagccggcactctgtttggggaaggattcagggcctttgtgacggaccgtgataaagttaccgccacagtggccgggctcaccctgttggctgtgggggtttactctgctaagaacgctacagcagtaactgggcgatacatcgaggcaaggctgggtaagccttcgctggtccgagaaacaagccggataaccgtgctcgaagccctgcgtcaccccatccaacaggtgtcaaggaggctgctttctagaccccaagatgttttagagggtgttgtgttgtcaccctccctcgaggccagggttagggacatcgctatcatgactaggaacataaagaagaatcggggactgtacaggcacatcctgctctacgggccacccgggacaggtaaaactctgttcgcaaagaagttggcgctgcatagcggaatggactacgcgatcatgaccggtggagatgtggcgccaatggggcgtgaaggcgtcaccgcaatgcacaaactctttgactgggctaacacaagtcggagaggattgcttctttttgtggacgaagccgatgcttttctgcgtaagcgagctactgagaagatttcagaagacctacgcgcaactctcaatgcatttctctaccggaccggtcagcattccaacaaatttatgttaatcctcgcaagttgtcatcctgagcagttcgactgggccattaacgcttgcatcgacgtgatggtccactttgacttacctggccaggaggagcgagcacggctggttaggatgtatctcaacgaatacgttctgaaaccagcaaccgaaggaaagcggagacttaagttggcacagttcgattatggacggaagtgcctggaaattgcacgcctgacagagggcatgtcatgccgcaaaatcgcccagttggcggtgtcctggcaggctaccgcgtacgcttccaaagacggcgtgttgacggaagcaatgatggacgcctgcgtgcaggacttcgtccaacagcaccagcaaatgatgagatggctgaagggggagcgacctggccccgaagacgaacaaccctccagttag

SEQ ID NO: 44492 - DNA, 2112 bp, Artificial Sequence
  Description of Artificial Sequence: Synthetic coding sequence
atggccacctgcgccgagatcctgcggagcgagttccccgagatcgacggacaggtcttcgattatgtgaccggagttttacatagtgggagcgccgatttcgaaagcgtcgacgacctggtggaggcagtcggcgaattgcttcaggaagtgagcggggactcaaaagatgatgccgggatacgggccgtgtgccagcggatggctgagccacagagccagggcaatagtcaggtcctgttagacgccccaatccagctatccaaaattaccgagaactacgactgcggcacgaaacttcccggcctcctgaaaagggagcaatcctcaactgtgaacgcaaagaagctggagaaggccgaggctcgactaaaagcgaagcaggaaaaaagatccgaaaaagataccttgaagacaagtaatccactagtcctggaagaagcatctgcctctcaggccgggtccaggaaggaatctcgcctggaatctagtgggaagaataaatcatatgatgtacgcatcgagaacttcgatgtttctttcggcgaccgcgtgctacttgctggagccgacgttaacttggcttggggacggcggtacgggctggtgggtcgcaatggactgggtaagacaacactgctgaagatgctcgccacgcgctctcttcgagtcccggcccacatctcgctgctgcatgtggagcaggaggtggccggcgatgatacccccgcactccagtcggtcttggaaagcgactcagtgcgcgaggatctgttgcggagagagagagagcttaccgctcagattgcggctggtcgggccgagggttccgaagccgccgagctggcagaaatctatgccaagctggaggaaatagaagctgataaggcccccgcccgggccagcgtgattttggcaggcctggggttcacaccgaaaatgcagcagcagccaacccgagagttctcaggaggttggaggatgcgtctagctctggctagagccctgttcgctagacccgacctcctccttctggatgagcccacgaatatgcttgacgtaagggctattctgtggctggaaaattatttgcaaacatggccttcaaccatcctggtggtgtcacacgatcggaattttctgaacgccattgcgaccgatatcattcatctgcactcacagcggctggatggttaccgcggcgatttcgagaccttcattaaatccaagcaggagcgcttactaaaccagcagagggagtatgaggcccagcaacagtatcggcagcacatccaagtctttattgatcgtttccgatacaacgccaaccgcgcgtcccaggtgcagtctaaactgaagatgctggaaaaactgccagagctgaaacctgttgacaaggagtcagaggtagttatgaagttcccagacggcttcgagaagttttctcctccaatcctgcaactggacgaagtcgatttttactacgatcccaagcacgttattttcagtcgactctctgtctcagccgatcttgagtccagaatctgcgtggtgggggagaatggcgccggaaagagcaccatgctcaagctactgctcggcgacctggctccagtcagaggcataagacacgctcataggaaccttaaaattggatatttctcccagcaccatgtggaacagctcgaccttaatgtgtctgccgttgagctcctagcgcggaagttccctggccgccccgaggaggagtatcggcaccagctcggccgctatggcattagcggtgagctcgcaatgcgcccactggcctcattgtccgggggacagaagtctcgggtggcttttgcacagatgaccatgccgtgtccaaatttttacattttggacgaacctactaatcatttggacatggaaactatagaggctctcggcagggcacttaacaatttcagaggcggagtcatattggtcagccatgacgagcgatttattaggctagtctgtcgggagctctgggtctgcgagggaggcggcgttaccagggtggagggcggattcgaccaataccgggctctgttacaggaacagtttcgccgtgaaggtttcctatag

SEQ ID NO: 44493 - DNA, 2130 bp, Artificial Sequence
  Description of Artificial Sequence: Synthetic coding sequence
atggccacctgcgccgagatcctgcggagcgagttccccgagatcgatggtcaggtgttcgactacgtcaccggggtactccactccggatcagccgatttcgaaagcgtggacgatcttgtggaggccgtcggagaactgctacaggaggtctccggcgactcaaaggacgacgctggaatacgtgccgtatgtcagcgcatgtacaacacactccgcctggccgaaccgcaaagtcaggggaatagtcaggttctgttggacgcccctattcagctctctaagatcaccgagaattacgattgtggcacaaaactgccaggcttgctgaaaagggaacagtcctctaccgtcaacgctaaaaaattggaaaaagctgaagcaagactgaaggcaaagcaggaaaaacgaagcgaaaaggacacgctaaagacttctaatccgcttgtacttgaggaggctagcgcaagccaagcgggcagcagaaaggaaagccggttagagagttcgggcaaaaataagagctacgatgtcaggatcgagaacttcgatgtgtccttcggagatcgggtccttctggcaggcgccgacgttaaccttgcctggggtcggaggtatggactggtagggcgcaatggccttgggaagactactctgcttaaaatgctcgcgaccagatctctgagagttccggcgcatattagtctcctccatgtggagcaggaggtggctggagatgacactcctgcactacagagcgttttggaatcagattctgttcgggaagacctgctgaggcgggagcgtgaacttacagcacagatcgctgctggtagagccgagggatcagaggctgctgaacttgccgaaatctacgctaaattggaagaaatcgaggctgataaagccccagctcgcgcttctgtcatcctagcaggacttggctttacacctaagatgcagcagcagcctacccgcgagttttccggcgggtggagaatgcgtctggcacttgccagggcactcttcgcgcgccccgatctcctgttgctagacgaacccaccaacatgctggacgtcagggcaatactgtggctggaaaattatctgcagacctggccgagtaccattttggtcgtatcccacgaccgcaatttcttgaatgccatcgctaccgacattattcatctgcatagccaacggttggatggctacaggggggatttcgagacatttatcaaaagtaagcaggagaggctattgaaccagcagagggagtacgaagcgcagcagcaatataggcagcatatacaagtgtttattgaccggtttcgctacaacgctaatagagcctctcaggtgcaatccaagttgaagatgctagaaaaactacccgaactgaaacccgtggataaggagtcagaggtggtaatgaaatttcctgacgggttcgagaagttctctcccccaatcctgcagctggacgaagtcgacttttattatgaccctaaacacgtgattttcagccgcctgtccgtctcagctgacctagagtctcggatctgcgtggtaggggagaatggtgcggggaagtcaacaatgctgaaactgttgttgggagacctggcccccgttcggggcatccggcatgctcataggaatctcaaaatcggctattttagccagcatcatgtggaacaactggatcttaatgtgtctgctgtggaactgttggcccgcaaatttcccggacgtccagaggaagaataccgacatcagcttggcaggtacggcatatccggggaactagcaatgcgccctctggcgagcctgtctggaggacagaaatccagggttgcctttgcccagatgacgatgccttgccccaacttttacatcctggatgagcccactaatcacttggacatggagaccatcgaagcgcttgggcgagcccttaataattttagaggtggtgtcatcctggttagccatgacgagcgcttcataaggctggtgtgcagagaactttgggtttgtgaaggcggtggagtcacaagagtggaaggaggttttgaccaatatcgtgccctgctgcaagagcagttccgccgcgaggggtttctgtag

SEQ ID NO: 44494 - DNA, 3573 bp, Artificial Sequence
  Description of Artificial Sequence: Synthetic coding sequence
atgaagacccggcagaacaaggacagcatgagcatgcggagcggccgaaagaaagaagctccaggaccaagggaggagctgcgatctcggggccgggcttctcctggaggcgtcagtactagcagttcggatgggaaggcggaaaagtcaaggcagactgctaagaaagcccgggtcgaggaggccagcactccgaaagtgaataagcagggccgctctgaggagattagcgagtccgagtctgaagaaactaatgcacctaaaaagacaaaaaccgaacaagaattgcctcgtcctcagtccccctccgatctggattctttggacggccgcagtttgaacgacgacggttcatcagatcctcgggacatcgatcaggataatcgctccacgtctcctagcatctactcaccaggatccgtcgaaaatgacagcgatagttcttcagggctgagccagggtccagccagaccataccaccctcctcctctctttcctccttccccccaaccacccgactcaaccccacgccaacctgaagcctccttcgaacctcacccttcagtaacaccgacgggataccatgctcccatggagccgccaaccagccgcatgttccaggcccccccaggcgccccaccaccgcatccacagctgtatcccggcggtacaggaggtgtgctatccggtccaccaatgggtcctaaaggtggcggggcggcgtcttctgtgggggggcctaatggagggaagcagcatcccccccctaccacgcctattagtgtatcctcttccggcgcttctggagcgcctcctacaaagcctcccaccacgcccgtggggggtggtaacctgccttctgctcctccacccgctaattttccacacgtgacgccaaacctcccacctccgccagctcttaggcctttgaacaatgcgtcagcttccccaccaggcctgggagcacaaccactcccgggccatctgccaagcccccacgccatgggtcagggcatgggcggactcccacctgggccagaaaagggcccgacattggcccccagcccccactcgctgccccctgcttcaagctcagcacccgcccctcctatgaggttcccctatagctcgagttcctcctcttcggccgcagcatcgtccagctcttcatcgtcttcctcgtccgccagtccattcccagcctctcaggcgctgcctagttatccacacagcttccctccccccacttccctgagcgtgtcgaaccagccaccgaaatatactcagccgtccctgccaagccaagccgtctggagccagggacccccgcctcctcccccctacggaagactgctggccaactcaaacgcacaccccggcccttttccaccttccacaggggcccagtcaaccgcccatcccccggtcagcactcaccaccatcatcaccagcagcagcagcagcaacagcagcaacagcagcagcagcaacagcaacaacaacagcatcatggcaacagcggtccacctcctcctggcgccttccctcaccctctggagggcgggagctcccaccacgctcatccttacgctatgtcgcccagcctcgggtctctgcgcccctatccgcccgggcctgctcacctcccccccccgcacagccaggtgtcttactctcaggccggtcctaacgggcctcctgtgtcttcctcgtccaactcatcctcttctacctctcagggttcttatccctgtagccatccatcccccagccagggcccccagggagcgccttatccgttcccccctgtgcctaccgtcacaacatccagtgctacattaagtacagtgatcgccaccgtggcctcctcacccgcaggttacaaaacggcatctccacctgggccgccgccttacggcaagagggccccctcacctggggcatacaagactgctacgcccccaggctacaaaccgggctccccgccctcttttagaactggcacaccacctggttacaggggaaccagtccgccggcgggaccaggcacctttaagccagggagccctactgtggggcccggtcccctgccccccgccgggccctcaggcctgcccagcctccctcccccccctgccgcccctgcaagcgggccacctctgagcgctacccagataaagcaggagccagctgaggaatatgagacacctgagtcccccgtgcctcctgctagatctccatccccccccccaaaggtagtagatgtcccaagccacgcgtcgcagtcagctaggtttaacaagcacctcgaccgcgggtttaactcatgtgcacggtcagacctgtattttgtgccactggagggctccaagttagccaagaaaagagcagatctcgttgaaaaggtacgcagagaagccgagcagagggccagagaggagaaggaaagagaacgggaaagggaacgggaaaaagaacgggagagggagaaggagcgggagcttgaaagaagtgttaaattggctcaggagggtcgcgcacccgtggagtgtccttccctggggcccgtgccccatcggcctccttttgaacctggaagtgctgtggctactgttcctccgtacctgggccccgatacacccgcgctgaggacactcagcgagtacgctcggccccacgtcatgtcacctgggaaccgtaaccatccgttttatgtacctctcggcgcagtcgaccctggtctcctgggctacaatgtgcccgcactgtactcttccgaccccgccgcaagagagagggagagggaagcccgtgaaagggacctacgagatagacttaagccagggttcgaagtgaaaccgagtgaactggaaccattacacggagtgccaggcccggggcttgaccctttccctagacacggagggctggctttacagcctgggccacctggacttcacccattcccatttcacccttcccttgggcccctggaacgcgagcggctcgcattggctgctgggccagctttgaggcctgatatgagttatgccgaacgactggccgccgagcggcagcatgcggaaagggtggcagcactagggaacgacccattggcaagattgcagatgctgaacgtgactccccatcaccatcagcactcccatatccacagccatctccatctccatcaacaagacgcgatacacgctgctagcgccagcgtccaccccttaattgacccattggcatcaggaagccatttaactaggatcccatatcctgctggaactcttccgaatccgctgctgcctcatccccttcacgagaatgaggtgctccgacaccagctcttcgccgcgccctacagagatctgccagcaagcctatccgcccctatgtcagccgcacatcagcttcaagcaatgcatgcccagagcgccgaacttcaacgtctagcactggaacagcagcagtggttacatgcacatcacccattacacagcgtgcccctccccgctcaggaagactactattcccatctgaagaaggagtctgacaaacctctgtag

SEQ ID NO: 44495 - DNA, 3573 bp, Artificial Sequence
  Description of Artificial Sequence: Synthetic coding sequence
atgaagacccggcagaacaaggacagcatgagcatgcggagcggccggaagaaagaggctcctggcccgcgcgaggaactgcgtagtcgcggtcgggcctcacctggtggagtgagcacatcttctagcgacggaaaggccgagaagtccagacagactgccaaaaaggccagggttgaggaggcgtccaccccaaaagtaaataagcaaggtcggagtgaggagatatccgagtcagagtcggaagagactaacgcgcctaagaagacgaagaccgaacaggagctgcccagacctcagtctccttcggacctcgatagcttggatgggcgaagtttgaatgacgatgggagcagtgacccgcgagacatagatcaagacaaccgatccacctctccctctatctactcgcctggtagcgtcgagaacgactcagatagtagttcagggctatcccagggcccagcccgcccgtatcacccccctcctctgtttccacctagcccccagccccccgacagcactccaaggcagccagaggcctctttcgagcctcatccttccgtaacgccaactgggtaccatgcacctatggagccgcccacctcaaggatgttccaggccccacctggtgcaccccccccccatccacagctctatcccggtggcacaggcggcgttctgtcaggccctcctatgggacccaaggggggtggagcagcctcttccgtgggtggccccaatggtggaaaacagcaccctccacccacaacccctatctccgtgtcctcctccggcgcatccggcgccccgccaaccaaacctccaactaccccagtgggtgggggaaatctgccctcagccccgcctccagcgaactttcctcacgtaacacctaatttgccccccccacccgctctgcggccgctgaataatgcttctgcatccccgcctgggttgggtgctcaacctctgccaggacacttaccctctccacatgccatgggccagggaatgggcgggctgcctccagggcccgaaaagggtcctacgcttgcaccctctccgcacagtctcccgcccgcatcttctagcgcgccagcacctcccatgcgttttccttattcatcgtctagctcaagttctgcagccgcaagtagctccagttctagctcttcttcaagtgctagcccatttccagcctcacaggctttacccagttatccacactcatttcccccccccacttcattatccgtctcaaaccagcccccaaagtacactcagcctagcctgccgagccaggctgtgtggagccagggaccacctccgcccccaccatacggtaggctgttggccaatagcaatgctcacccaggccccttcccaccttccacaggagcccagtccaccgcccaccctccagtttcaacccatcaccaccaccatcagcagcaacaacaacaacaacagcaacaacaacagcaacagcagcaacagcaacagcatcacggaaactcgggtccccctccgcctggtgcgttccctcatcccctggagggcggctcatcacaccacgctcacccatacgctatgtctccgtctttaggctccctcagaccttaccctcccgggcctgcccacctgccccctccgcactcccaggtgagctacagtcaggccggtccaaatggacctccagtgagctcctcttccaactccagctcatctacttcgcagggcagttacccatgcagccacccatccccctcccaaggccctcagggagctccctaccctttcccacccgttcctaccgtgacaacatccagcgcaaccttatctacggtcatcgcaaccgtcgcctcctcccctgctggttacaagacggcatctcctccggggccacccccttatggaaagagagcacctagtcctggagcctataaaactgctacacctccaggctataagccaggatctcctccttccttcagaacaggtactcctccaggatacaggggcacctcaccacctgcaggacctgggacatttaaacctggatcccctaccgtaggtccggggccactcccccccgctgggcccagtggattgccttccctgccaccaccgccggctgcccctgcctccggaccaccactctccgctactcagataaagcaggagcctgccgaggagtatgagacacccgaatccccagtcccacctgcacggtctccgagcccacctcctaaagtggtagacgtcccttcccacgcatctcagtctgcccgctttaataagcacttggatagaggcttcaacagctgcgctaggtccgatctctattttgtccctctggaaggcagtaagctggctaaaaaaagggccgatctggtagagaaagttcggcgcgaggccgagcagcgcgcccgtgaagagaaagagcgagaaagagagcgagagcgcgaaaaggagagggaaagagagaaggagcgggagttagagcgaagtgtgaaactggcacaggaggggcgagcccctgtagagtgcccatccctgggacccgttccacataggccgccattcgaacctggtagtgctgtggcaactgtcccgccataccttggccctgacacgcccgcattaagaacgctgtcagaatatgcgagacctcatgtgatgagcccaggcaatagaaaccatcccttctatgtgccactgggagcggtggatcctggattgttaggatataatgtacccgccctgtatagctcggaccccgccgctagggaaagagaacgcgaggctcgggaacgagatctccgagatagactcaagccagggtttgaagtgaaaccaagcgagctggagcccctccatggtgtgcccggacctggactggatcctttccccagacatggcggccttgcactgcagcctggcccaccgggactccaccccttcccattccatccttctttggggccactcgagagagagagactggcattggctgccgggccggcattaaggcctgacatgtcatacgccgaaaggttggctgccgaacgacagcatgctgaaagagtagcagcactgggcaatgaccctcttgcgagactccagatgttaaatgtgaccccgcaccaccatcaacactcgcacattcacagtcatctgcacctacatcagcaggatgctatccacgccgcctcggcttcagttcacccgctcatagaccctcttgcgtcagggtcccacttaaccagaattccttacccagccggcaccttgcctaacccgctattacctcacccattacacgagaacgaggtactgcgccaccaactgtttgcggccccatacagagatttgcccgcttctcttagcgcccccatgagtgcggcacatcaactccaggcaatgcacgcccagtctgccgagctccagagacttgctctcgagcagcaacagtggttgcacgcccaccaccctttgcattctgtcccactacccgcccaggaagattattattcacatctcaaaaaggagtccgataagccactctag

SEQ ID NO: 44496 - DNA, 3780 bp, Artificial Sequence
  Description of Artificial Sequence: Synthetic coding sequence
atggacggccccacccggggccacggcctgcggaagaagcggcggagccggtcacagcgtgaccgtgagaggcggagccgcgggggtttgggtgcgggtgccgccgggggaggcggggccggcagaacccgggccctgtccttagctagctcttccgggtcagacaaggaagataacggaaaaccacctagtagcgccccaagtagacccaggcccccaaggaggaagcgcagagagagcacaagcgccgaggaagacataatagacggcttcgccatgacaagctttgtcacatttgaagccctggaaaaggacgtcgctctcaagccccaggagcgggtggagaagagacagaccccattaacgaagaagaaaagggaagcattgactaatggcctgtccttccacagcaagaaatcaaggcttagtcatccgcatcattactctagcgatagggaaaatgaccgtaacctgtgtcagcatctcggtaaacgcaagaaaatgccaaaggccctccggcagctcaaacctgggcagaatagttgccgcgacagcgactccgagagcgcatccggcgagtccaaaggcttccaccggtcaagtagccgggagaggctctccgatagttccgcccctagctccctcggtaccgggtatttctgtgatagcgatagcgaccaagaagaaaaggcctcagatgctagctcagaaaagctcttcaataccgtcatagtcaacaaggaccctgaactgggagttggcacgctgccggagcacgacagtcaagacgccggacctatcgtgcctaagattagcgggctcgagaggtcgcaagagaagtctcaggactgctgcaaagaacctatttttgaacctgtggtcctcaaagatccctgtccgcaagtggctcagcccattcctcaacctcagaccgaaccccagctgcgagctcctagccctgacccagacctcgtacaaagaacagaagctcctccccaaccacccccccttagcactcaaccacctcaggggccaccagaagcacaactgcagcctgcaccgcagccgcaggtgcagaggcctcctcgcccgcagagccccacccagctcttgcatcagaatctaccaccagttcaagcacacccatccgcccaatcactgagccagcccttgagtgcctataactcatctagcctgagcctgaattccttgtctagctctaggagctccactcccgccaaaacccagccagcccccccacatatctcacatcatccctcagcctctccgttcccactcagcttgcctaaccacagccctctgcacagtttcacacctacactacagccaccagctcactctcatcatccaaatatgttcgccccacctaccgctttaccccctcccccaccactcacatctgggagccttcaggtggctgggcaccccgcaggtagcacctattcagaacaagacattctgaggcaggaattgaatacaaggttcctggccagccagtccgccgaccgaggggctagcctcgggcccccaccttatctgaggactgagttccaccagcatcagcaccaacatcagcacacccaccaacatactcaccaacacaccttcacccctttcccacacgctattcctcctaccgccattatgcctactcccgccccgcctatgtttgacaaatatcccacaaaggtcgatcctttttacaggcactctctttttcactcatacccacctgccgtttccgggatccctccaatgattccccccactgggccatttggcagtctgcagggggcctttcaaccaaaaacttctaatcccattgatgtcgctgcccgcccagggactgttcctcataccctgcttcagaaggatccgcggctgacagatccttttcgcccaatgctgcggaagccgggcaaatggtgcgcgatgcacgtccatattgcctggcagatataccatcaccaacagaaggtcaagaagcaaatgcagagcgaccctcataaactggacttcggtcttaaaccagaattcctgtcaaggccacctggccccagcctattcggagccattcaccacccacacgatttggctcgccctagtactctcttctctgcagcgggagctgctcatcctactggtaccccttttgggccacccccccatcattcaaatttcttaaacccagccgcccacctagagccatttaaccgccctagtacatttaccggcctggcagccgtgggtggcaatgctttcggaggactgggtaacccctcagttacgcccaactccatgtttggtcataaggacggaccatccgttcagaactttagtaaccctcacgagccctggaatcgactgcataggacacctccttccttccctaccccaccgccatggttgaagccaggcgagttagagcgctcggcgtctgccgctgctcatgacagggatagggacgtggataagcgggactcgagtgtgtccaaagatgacaaggaaagagagagcgtggagaaaaggcattctagccaccccagtccagcccccgtgttgccagtgaacgcactgggacatactcggtcctctactgaacagatacgggctcacctcaacaccgaggctcgggagaaggacaagcctaaggaacgtgaacgtgaccactctgagtctcggaaagacctggccgccgatgagcataaggccaaagaggggcatctgccggagaaggacggccacggacatgaaggccgcgcggccggcgaagaagcgaagcagttggctagagtgccttctccttatgtgaggacccctgttgttgagtctgcgcgaccgaatagcacctcatcacgagaagctgagccgaggaaaggggagcccgcctacgagaacccaaaaaagagttcagaagtgaaggttaaggaagagcgcaaagaagatcatgatctgccaccagaagccccgcagacgcaccgcgcgagcgaaccaccaccacctaactcttcctcctcggtgcaccccggccctctggcaagtatgcccatgactgtgggcgtgaccgggattcacccaatgaacagcatctctagtctggaccgaaccagaatgatgactcctttcatgggcatctccccactgcccggcggcgagcgctttccctacccgagtttccactgggaccctattagggacccccttcgcgacccctatcgggaacttgatattcacagaagagatccgctaggccgggatttcttgctacgcaatgatcccctgcaccgcttatcaacacccagattgtatgaggcagaccgctctttcagagatagggagccccacgattattcacatcaccaccatcatcatcaccacccactgagcgtcgatcctaggcgcgagcacgaaagaggtgggcaccttgacgaaagagagcggctacatatgctgcgggaagattacgagcacactcgtctgcactccgtgcacccagcctctctcgacggccacctccctcatccctccctgatcacccccggacttcctagcatgcattatcccagaatttctccaacggctgggaaccagaatgggttactcaacaagacacctccaacagcggctctgagtgcgccacctcctttgatttccactcttggaggtaggccggtgtccccgagacgtacaacccccttgtcagcagagataagagagcgtccgcctagtcacactctgaaagatatcgaggcaagatag

SEQ ID NO: 44497 - DNA, 801 bp, Artificial Sequence
  Description of Artificial Sequence: Synthetic coding sequence
atggacggccccacccggggccacggcctgcggaagaagcggcggagccggagccagagggatagagaacggagaagccgcggtggactcggtgccggcgcagccggtggggggggcgcaggaaggacccgcgccttgagcctggcctcttctagcggatccgataaggaagataatggaaagcccccatcaagcgcccccagtcgaccacgccctcctaggaggaaacgcagggagtccaccagcgctgaggaagatatcatagacggttttgccatgacgagcttcgtcacattcgaggcactggaaaaagacgttgctctgaagccccaggagagagtggagaagcggcagactccccttaccaagaaaaaacgagaagctctgacaaacggtctttcattccacagcaaaaagtctcggttaagccacccccaccattacagtagtgatagagagaacgacaggaatctgtgtcagcaccttggtaagcgcaagaagatgcccaaggcgctgcggcagctgaagccagggcagaattcttgtagggactcagattctgagagcgcctccggcgagagcaaagggtttcaccgcagttcatctcgcgagagattgtccgatagctctgccccgtcgagcctggggaccggttacttccgttcaggaaagatgtgccttggagaggaagcctgtctgaagtctggcaacgatatgaaaagagacgtatcaaacaccagctcgtgggcctctaaccgcgagagctttttctcgttggtgaagctcctgaaagggttctag

SEQ ID NO: 44498 - DNA, 3708 bp, Artificial Sequence
  Description of Artificial Sequence: Synthetic coding sequence
atggacggccccacccggggccacggcctgcggaagaagcggcggtcacggagccaacgagatagggaacgcaggagtaggggaggcttgggggcaggcgctgcagggggggggggcgccggaaggactcgggctctgtcactcgccagctcatctggttcagacaaggaggataatggcaaaccaccatcatcagcacctagcagaccacggcccccccggcggaaacgaagagagagtacatcagctgaggaggacataatagacgggtttgctatgacgtcttttgtgaccttcgaggcgttggaaaaggacgtggccctgaaaccgcaggagcgggtcgaaaagaggcagactcctctaactaaaaaaaaacgagaggccctcacaaatggcctttccttccacagtaagaagtcaagactcagccaccctcaccactacagtagtgacagagagaacgataggaacctatgccagcacttgggaaagcggaagaaaatgcctaaagcgctgcgccagctcaagcccggacagaattcatgtcgcgacagcgattccgaatccgcctcgggggaatcaaaaggattccacagatcttcctcacgcgagaggctttccgatagttctgcaccatcctccctggggactggctacttttgtgatagcgattccgatcaagaggagaaagcctctgatgccagtagcgagaaactcttcaatacagtgattgtaaacaaggaccccgagctcggtgtgggaactctgccagaacacgattcccaggacgccggaccaattgtacccaaaatctcggggctggagagaagtcaggagaagtctcaggattgctgcaaggaacccatcttcgaaccggtggtcctcaaagatccttgtccccaagttgcacagccaattcctcaaccacagacagaaccacagttgagggcaccaagtcctgatcccgatctagtacagagaaccgaggcccctcctcagcccccccctctgagcacacagcccccacagggcccgccagaggcccagctgcagccagcgccccagccacaagtgcagagaccccccaggccacagagtccaacgcaactactacaccagaatctcccaccagtgcaggcccatccatccgcacaaagcctcagccaaccactctctgcctacaactcctcttccctgtcgctcaatagcctttcttccagccgctctagtacacctgccaaaacacagcctgcaccccctcacattagtcaccatccctctgcctcgccattccctctcagcctccccaaccatagcccactgcattccttcacccccacgctccagccgccagctcacagccaccatcccaatatgttcgccccaccaacagcactgcccccaccacctcctctcacctctggttccctgcaggtcgcgggacacccggcagggtctacctatagcgaacaggacatcctacggcaagagctcaacaccagatttctggcgtcccagagcgcagatcggggggcctccctgggacctcccccatatctacgcactgaattccatcagcaccagcaccagcaccaacacacacatcagcacactcaccagcatacatttacccccttcccccacgccattccacctacagccatcatgcctacccctgccccccctatgtttgataagtacccaactaaagtggatcccttttaccggcattccctgtttcactcttatcctcctgcggtgagcggcattcctccaatgattccccccaccggccccttcggaagcctgcagggcgcgttccaaccaaagctaacggacccatttcgtccaatgctcaggaaaccaggcaaatggtgtgccatgcacgtgcatattgcatggcaaatataccatcaccaacaaaaggtgaaaaaacagatgcagtcagacccccataaactggacttcgggctgaagcctgaattcctttctagacccccaggaccgagtcttttcggagcaatccatcaccctcatgatctggccaggccctcaactctgttctccgccgccggagcagcccatccgactgggacaccctttggcccacctccccatcatagcaacttcctcaacccagccgctcacttggagcctttcaatcggccctctacatttaccgggctagctgctgtaggaggcaatgcttttggtggcctgggcaacccgtcagtaacacccaactccatgtttggccacaaagatggcccctctgtgcaaaacttttccaacccacatgagccctggaatcgcctccatagaactcctccctctttccccaccccacctccctggttgaaacctggagagctggagaggtccgccagcgccgctgcacatgacagagaccgcgacgttgataagcgtgactcctcggtcagcaaggacgataaagaaagagaaagcgttgagaagcgccattcatcccatccgagtcccgcccctgttttaccagtaaatgctttagggcatactcgcagttcgaccgagcaaattcgcgcccatctcaacaccgaagccagggagaaggacaaaccaaaggaacgggagcgcgatcactccgagagtaggaaagatctggctgctgatgagcataaggcgaaggagggccatttaccggagaaggatggacatggccatgagggaagggcagcgggcgaggaagcaaagcaactcgcgagggtgccctcgccctatgtccgtactcccgtggttgaatccgctcgccccaactcaacttcttcacgcgaggccgaaccaagaaagggcgaacccgcgtacgaaaatcccaagaagtccagcgaagtgaaagtcaaagaagagagaaaggaggaccacgacctgccaccagaggctccccaaacccatagggcctcagaaccaccacctccaaacagctcatccagcgtgcatcccggcccactggcctcaatgccgatgactgttggagtcaccggcatccatcctatgaattctatctctagcctcgatagaacgcgaatgatgactcccttcatggggatcagtccactgcccggcggcgaacggtttccgtatccctctttccactgggaccccatcagagaccctctgagggatccctaccgggagctagatatccaccgacgcgatccactaggacgcgattttcttttgagaaacgatccgctgcataggttgtccacccccaggctgtacgaagccgatcgttccttcagggacagggaaccccatgactactcccaccaccaccatcatcaccaccaccccctgtcggtggatcctcggagggaacatgagaggggggggcacctcgatgagagagagaggcttcatatgctccgagaagattacgagcacactcggttgcatagtgttcatccggcttccctcgacgggcacctgcctcacccgtctcttattactccagggctgccaagcatgcattacccccggataagtccgacggctggtaaccagaatggcctccttaacaagaccccacctactgctgctctgagtgccccaccacccctgattagtaccctggggggaaggccagttagccctagacggaccacgccgttatctgccgagattcgcgagcgtcctcccagccacactcttaaagatatcgaagcccggtag

SEQ ID NO: 44499 - DNA, 423 bp, Artificial Sequence
  Description of Artificial Sequence: Synthetic coding sequence
atggtgaccgccatggccctgagcaagagcaccaacagccacaagaatgcgaccgaggacctttacgaggttgacaaactcaagaaggagtgctacgagtggatcaatacctgcagctgtctgctgtcgaatataaaaggacgcaaaattaccctgctaacttatgaggagatcgagcggctgctcgaggaggaggcagtgaaggagttcattgagcctgagatcgacgaatcgttcaaagaggatgaggaggaaagcaaggaggaccgcaaattacaggaggagaacaaagagcgagccgaagaacagcctagcacttcgacggagaaagaaaaactaatcaggtttatcggcgaagatgagaacgtccacagcaagccactgtttgaaacggatgtgttgagttcctggaaaaacatttag

SEQ ID NO: 44500 - DNA, 2691 bp, Artificial Sequence
  Description of Artificial Sequence: Synthetic coding sequence
atggtggaccggagcaagctgctgcccaccagcctgcagaacgagttcatacccaaagaggtgttgctgtctctgacctatgccgcaaatgcaggaccttgtcccgagaatctcctaccacctaaaaaaattaaaacacctaagggcacgcttcctaggctggtggatcacgtctggcatcaccccgtgcgtaggaataagttcaagtatttgatcgaccatcctgtttcgctcaccggcgccggccgcgatattagttttctgtatgacgtgacgtatgccaagggccagacccgcgagaaagctgtctgtcctccccatctcgcccggagcctgcagagtcatgacggcgtgatagtacctcataaaccaaagacacttacagatactctgattcccgaggagttccacatcgtgagtagtacaggggtgtcaggcttggagtgctacgacgacaaatatacaacgttgctgaccgacagtgaaaaccgactgctgttattcccttcgatgaagcctaacaaacgcgtggaggtcgcgcagctgaatgatgttatggacacaatgcttgaaagagccggggttgaaaaccaggagtatacaggccctacaaaaatgcacaagctactgcatatcttaaagaaggaacagactatatacaatatgatattccatgagttgattcggcaagtatctgtcgattgtgctgatcggggtgagttgttgagtaaggtccgggagaggtacgtccagatgctcgatcagattgcaagacagatgatcgacttttacaaagatttggttacccagcgggtgatggaccaaagaattctggaagagttatataatttcaagcacgtgattgaggagctaactcgggaactgtgcctagtgcgcgcccacgacgtgaagctgaccaaagagacagaaaaggcccacaaggacctggctcaggctctgttgaacgccgaaaagaacgccaaaatcgtggaagaataccatgatttatataccctgcaaagggaaaggatggagaatgacatgaaaaaactagttgccgaaagagacatttggtcaagcgcgacatatgagctggcactcaaagtaatcgaaagaaatcgagttatcctcgcccgtcgactctatcttaatgaaaagggatggaacaaatacactaagcacttcataattctgctctccaacaaggatacagaggacctggccttgctgcaaaaactgacgcagaagtggcgaaacctggtcaacaagctgaagcaggaggtcgagcagatggaggagtcaacttctgagacattaaaaattgttaaagatgggttaatcaaatggcaggaattttttaacgagaaggacattctcagcccaaataaggggaatatttttaactctgtcctgctggattttaagcaatggcagaaaattctgaatgaaaagaaagaagaattcacgggcgatgtgctgctgagcaagtacgacaccttaaaaattattaagcacctgcaagaaaactgggcagacatcggacttgggatattcaaccgacacaaaagtctggagggcgaaatgccttccgagcggcagtatatggaagaaattatcaagaacatccagaagctttataaggaatacgagatccgtatcaacggggacaatgggtattccaaaatccttccaagcctaatctcgagcttggacttttgcagttttaaacttgagaatttggagttccctgacacaccactagaggagtggcaggaaatcgacgagaaaatcaacgaaatgaagtcccatctcgatattctgttaaacctcacgggcattgttcctcaacacatagacgtggatagtgtttctgtcctgcaagcttatatctttaatatgatccagcagtggttgctgaagataggcaacgaaatcaataatggtaacatcgaactgcaacaccatatggacgagctgcacatttctatgatccagtggatggttaatctcttgattttgatgatccctaacttcactgaccaagattgtctgcttaaattggaagaggaatcagcagaaaagcatgatattggggtcgctcgccttgaactggatgctatcgagttgactcgaaaactgtatcaatatagtagctacttgtcatcctgctgtaaaggcatggtaaccgctatggccctcagtaaaagcacgaactcacataagaacgcaaccgaggatctctacgaggttgacaaactcaagcagccaagtacctctactgaaaaggagaaactgatcaggtttatcggagaggatgagaatgtgcactctaagcccctcttcgagacagatgtactctcttcgtggagagagtccgccaagcagggcacgctcgcgcaaaaataccttgaagccatggcggtgatagaacatatgcaggagaaactactcgaagtagaaaacagggctcgtcaagccgaggaaaaattcgaagacgcctatgaaaaattacatcacaccctgataaagaataaggatctggaggagctggtgatgacgagtcgtaaagagtctaaggaggaaaaagagaatcaggacgaacgcgaagtaaaggaagaggaagaacagcaagaagaggaggaggtgcggtccgccgagaactcctccaagagtccaaagaagggacattag

SEQ ID NO: 44501 - DNA, 3039 bp, Artificial Sequence
  Description of Artificial Sequence: Synthetic coding sequence
atgagcctgcccaagacccccagcacccccctgaacagcaccagcacaagcgaatccaaaaagctgaaggtctccgtggctaaggagggcacacgaggtcttccagagctgaaggaaaaaaagaacatggttgaccgtagcaagctcctgcccactagtctccaaaacgagtttataccaaaagaggtgcttttaagcctgacctacgcagccaatgctggtccctgccctgagaacctcctcccccccaagaagattaagacccctaaaggcactctccccaggcttgtagatcacgtttggcatcatcccgtaagacggaacaaatttaagtatctgattgatcaccctgtgagcctcaccggggcaggtagagatatcagctttctctatgatgtaacctacgcaaaagggcagactagagaaaaagcagtgtgccctcctcatctcgcccggtcgctgcagtcccacgatggcgtgatcgtgccacacaaacctaaaacgctgaccgatactctcattccagaggagtttcacatcgtctcttctaccggggtaagcgggctggagtgttacgatgataagtatacaaccctgctgaccgattctgaaaacagacttctgctgtttccttccatgaaacctaataaacgggtcgaggtcgcccagctgaatgacgtgatggacaccatgctcgaacgggccggggtggaaaaccaggaatacaccggacccacgaagatgcataagctgctccatatactgaaaaaagaacagaccatttacaacatgatctttcatgagctcatacgacaagtctctgtggattgcgcagaccgcggcgagttgctaagcaaggtgagagaaagatacgtgcaaatgttagaccagatagcacgccagatgattgacttctataaggatcttgtgacacagcgcgtcatggaccagcgaattctggaggaactgtataatttcaaacatgtgatagaagaactcacacgagagctgtgtctcgtgcgtgcgcatgatgtgaaactcacaaaggagaccgaaaaagcccacaaagatttggcccaggcattgctgaacgccgaaaagaatgcgaaaatcgtggaggaataccacgatctctatactctgcagcgcgaaagaatggaaaacgacatgaaaaaactggttgcggaaagggatatctggagctcagctacttatgaacttgcattgaaggtgatcgagagaaatcgtgtgatactggcacgtaggctgtacctcaatgaaaaaggatggaacaagtacactaagcactttatcatcttactatcaaataaagacacagaggacttggccctattgcaaaaactgacgcaaaagtggcgcaacctcgtgaataagcttaagcaagaggtggagcagatggaagagtcaacctcagagactttgaagattgtcaaggacgggcttataaaatggcaggagtttttcaatgaaaaagatatactgtctcctaacaagggaaatatctttaatagcgtcctgctggattttaagcaatggcagaaaattcttaacgaaaagaaggaggaatttactggagacgtgctgctctcaaagtacgatacgcttaaaattatcaagcacctgcaagagaactgggctgacatcgggctgggtatcttcaaccggcacaaaagtctcgagggcgagatgccaagcgaacgccaatacatggaagaaattattaagaatattcaaaagctatacaaagaatatgaaatccgtatcaatggcgacaatggatacagtaagattctcccgtcactgatcagctcccttgacttctgttcgtttaagcttgagaaccttgagttccccgatacgccgttggaagagtggcaggagattgatgaaaaaattaacgagatgaaatcgcacttggatattctcttgaacctgactgggatcgtgccacaacatattgacgtagattctgtatctgtccttcaggcttacatatttaacatgatccaacagtggctgctgaaaatcggaaatgagatcaacaacggtaatatcgaactgcagcaccatatggacgagctgcacatcagtatgattcaatggatggtcaacttgctaatcttaatgattcctaattttacagatcaggattgcctcctaaagctggaggaggagagcgccgagaagcacgacatcggcgtagcccgcctggaactggacgccattgagctcacgagaaagctgtatcagtacagcagctatctgtcttcctgctgtaaagggatggtgaccgccatggcgttgtcgaagagcaccaactcacacaagaatgccactgaggatctctacgaagtcgataagttaaaaaaggagtgttacgaatggataaatacctgttcctgtctcctatcaaacattaagggacgtaaaatcactctgctgacctacgaagagatagaaagattgttggaggaagaagccgtgaaggaattcattgagcctgagatagacgaaagttttaaagaggacgaggaagagtctaaagaggaccgaaaactccaggaggaaaacaaagaacgggcggaggaacaaccttccacgagcacagaaaaggaaaagctcattaggttcataggggaggatgaaaatgttcactctaaacctttgtttgagacagatgttctctcctcttggcgggagtccgctaagcagggaaccctggcccagaagtacctggaagctatggccgtcatcgaacacatgcaggagaaactcctcgaagtggaaaatcgggctagacaggccgaggagaaattcgaggacgcgtatgagaaacttcaccacaccctgataaagaacaaggacctggaggaattggtcatgaccagtcgaaaggagagtaaggaagaaaaggagaaccaggatgagagggaggtaaaggaggaggaggaacagcaggaagaagaagaggttaggagtgcagagaactcctcaaagtcacccaagaaagggcattag

SEQ ID NO: 44502 - DNA, 1968 bp, Artificial Sequence
  Description of Artificial Sequence: Synthetic coding sequence
atgagcctgcccaagacccccagcacccccctgaacagcaccagcactagtgagtcaaagaagctgaaagttagtgtcgctaaggagggcacacgcggccttcccgaactcaaggagaagaaaaatatggtagaccgcagtaagctgttaccaacctcattgcagaacgaattcatccctaaagaagtcctgctgagcttgacatatgccgcaaatgctgggccctgcccagagaatctgctgccacccaagaagatcaagaccccaaagggaacacttcccagattggtcgaccacgtgtggcaccacccagtcaggcgaaataagttcaagtaccttatcgatcaccctgtaagtctaaccggcgctggtcgggacatcagttttctgtatgacgtgacctacgccaaaggccaaactcgtgaaaaagctgtttgtccccctcacttagccaggagtttacaaagtcacgatggtgttatcgttccccacaagcctaagaccctcacagacactttaatacccgaagagttccatatcgtgtcatctactggggtgtcgggtttagaatgttatgacgacaagtatactactctgcttacggactccgaaaacaggttgctgctgtttccttctatgaaacccaataagcgagtggaagtcgcccagctgaacgacgtcatggatacaatgcttgagcgcgcgggcgtggagaaccaggaatacacaggacctaccaagatgcataaactactgcacattctgaaaaaggagcaaaccatctacaacatgatctttcacgaactcatccggcaagtgagtgtagactgcgctgacagaggagaattgctgagcaaagttcgcgaacggtacgtacaaatgcttgaccagattgcccggcagatgatcgacttctataaggacctagtcacacaaagggtgatggatcagaggattttggaggaactttataactttaaacacgtgatagaagagctgacgcgagaattatgcctggtgcgcgctcacgatgtcaagctcaccaaagagacggagaaggcccacaaggacctggcacaagcccttctcaacgcggagaagaatgccaagattgtcgaagagtaccacgacctttatacccttcagcgagagcggatggaaaatgacatgaaaaaattggtggcggaaagggacatctggtcatcagctacctacgagctagcgctcaaggtgatcgaaagaaaccgggtcattctggctcgcaggctgtatctcaatgaaaaaggttggaacaaatacaccaagcacttcatcatactgctgtctaataaggatactgaggacttggctttactgcagaaacttactcagaagtggagaaacctcgtcaacaaactgaagcaagaagtggaacagatggaggagagcaccagtgagacactgaaaattgttaaggatgggttaatcaagtggcaggagtttttcaacgagaaggatatcctctccccaaataagggtaatattttcaattctgttctgttggatttcaagcagtggcagaagatcctgaacgaaaaaaaggaagaatttaccggagatgtcttactgtctaagtatgacaccctgaagattatcaagcatttacaagaaaactgggccgatattgggcttggcatttttaaccgacacaagtcactcgagggagagatgcctagcgaaagacagtacatggaggaaatcattaaaaacatccagaagctgtacaaggagtacgaaattcgtataaacggagacaatgagactggcagccaccgcgtggcacaggctggactgaagctcctcgggtcctccgaccatcctacaagtgcgccccaatcagctgggatacgggggatcattcacaggacatggccttgggtgaacttctacatcgtgtgtgaggtgactccaaagtttttccaggtgtag

SEQ ID NO: 44503 - DNA, 237 bp, Artificial Sequence
  Description of Artificial Sequence: Synthetic coding sequence
atgagcctgcccaagacccccagcacccccctgaacagcaccagcactagtgagtcaaaaaagctgaaggtctcagtggctaaagaaggaacacggggcctgccggaacttaaggaaaaaaagaatatggttgatcgtagcaagcttctcccgaccagccttcagaacgagttcatccctaaagaggtgcttctgagcctgacttacgcggctaatgctgggccctgtcccgagtag

SEQ ID NO: 44504 - DNA, 378 bp, Artificial Sequence
  Description of Artificial Sequence: Synthetic coding sequence
atgagcctgcccaagacccccagcacccccctgaacagcaccagcacttccgagagcaagaaattaaaggtgtccgtcgccaaggaaggcacacgtggattgcccgaacttaaggaaaaaaagaatatggtagaccgcagtaaactgttaccgacctccctgcagaacgagtttatccctaaggaagttctgttgtccctgacgtatgccgcgaatgccggcccatgcccagagaatctgcttccacccaagaaaattaagacacccaagggaacccttccacgcttggttgaccacgtatggcaccaccctgtgagacgtaacaagtttaagtacctgatcgaccaccctgtttctctaacaggtgccgggcgctag

SEQ ID NO: 44505 - DNA, 120 bp, Artificial Sequence
  Description of Artificial Sequence: Synthetic coding sequence
atggccgccggcgccgtgttcctggccctgagcgcccagctgctgcaagcccgactaatgaaagaagaatcccctgtcgtaagctggaggctggaacctgaagatggtacagcactgtag

SEQ ID NO: 44506 - DNA, 147 bp, Artificial Sequence
  Description of Artificial Sequence: Synthetic coding sequence
atggccgccggcgccgtgttcctggccctgagcgcccagctgctgcaggccagactcatgaaggaagtttcaccagttgtttcatggcggctggagcccgaggacggcactgctttgtccggcgtttctctgtgtcggcctgggtag

SEQ ID NO: 44507 - DNA, 582 bp, Artificial Sequence
  Description of Artificial Sequence: Synthetic coding sequence
atgcccctgccctgggactaccccgaggccccctggcggcggctgcatagctcgccaccacggccctgtccaagagctcttcagggtggcgggaggcggggtcctaaccccgaccctagaggatccaaaggcctcaaacagactgtgggtgcacttaaccccaatctacacctctggggcatttgctcctgccagtttctcctgaggtctaagggccgcgatttcgtgcactcagtgcaggaaacacattcccagctgctagggagctgggatccttgggaagagccagaggatgccgcacccgtagcccccagcgttcccgcctccggctatcccgaactgcctacacctaggagagaagttcagtctgagtcagcccaagaacccggagcacgcgacgtagaggcccagctccgccgtctgcaggaggagaggacatgtaaagtttgtctggatcgcgccgttagcattgtgttcgtgccttgcggccaccttgtgtgcgccgagtgcgcgcccggcttgcaactgtgccccatttgtagggcgcctgtgagaagtcgcgtgcggacgtttctgtcgtag

SEQ ID NO: 44508 - DNA, 7827 bp, Artificial Sequence
  Description of Artificial Sequence: Synthetic coding sequence
atggacggccgggacttcgccccccccccccacctgctgagcgagaggggcagtttaggtcaccgatccgccgccgctgctgccaggctagcacccgctggtcctgctgcccagccgccagctcattttcaacccggaaagtacttcccgtccccccttccaatggcctcacataccgggtccgcaagaaagatgggatcctgtccagctcctagcttcctaccctcctttttggaacgccctctgtaccctgcacccacaaaaacagtgtcaggtcccagtcttcgcccacccactgccgcaattcgctcacctaccccagactgcgcacaaaagtggtcccagaacgcacatgaagcaccaggctatccccggttctccggcagtctggccagtaccttcctcccagtgagtcaccttgatcaccatggaaattctaacgtgctgtatgggcagcacagattttacgggacccaaaaagataatttctatcttcggaacctgcctccccagccgacgctcctgcctgccaatcataatttccccagtgtcgcccgcgcggccccagcgcacccaatgggatcgtgttcacgggatagagaccggggagaagccggatcactgcaaaagggccctaaagacttcgacagattcctggtcggcaaggagcttggcagggaaaaggccggaaaggcagccgagggaaaggaacgaccagcggctgaggaagacggcgggaaagagagacacaaattggtgctgccagtccctgctgacggacactgccgggagggtgggcctgcccctagaggcgcctgcgagggaagacccaaacacctgacctcttgtcttctgaatacaaaagtgcttaacggagagatgggccgcgcggccctggcctcctgcgcaggcggaatgctggggaggcccggcactggcgtggtgacaagtggccgctgcgccaaggaggcggccgggccacctgaacctggccctgcattttcagagtgcctcgagcgccggcagatgttacatcacacagctagttacgctggaccaccaccaccgctgtccacagccgctgggtcttttccctgcctgcagctccacggaggaccagacggactatgccctcttcaggacaaggccccgcgagatctgaaagccagtggacccacattcgttcccagcgtgggccatctcgccgacaaaggcaggccctttcaggctgccgaggcctgtgcagtggccggagagggaaaagataggcacttagaagggacaatggcgccagatcacgccgccccctatggagtgagctacgctcatttgaaagcagaaggtaaaggggagcggagaccgggtgggtttgaggctgccttaaatccgcgcctgaaaggactcgactacctgagctcagcaggaccagaggcgagctttccagggctgcctaaaagcggcctcgacaagtcgggctatttcgagctcccaacatcctcacaggactgcgcccgccctggccatcaggaccctctggggggcaaagcaccccaggcctgttgcactctagataaaaccgttggaaaggaggcacctgccgggccccctggggcccagaaggttgctcggatccggcatcagcagcacctcatggccgctgaagtggagcagggcggcattggagctgaagcaaagagaaaatctctggagctcgcctccttgggatactcaggccctcacctgccgccatggggtgtccaagcgggccagggaactgctatggccatttcagaggagcgcaaagcaggagcctacctggaccctttcgggagcggccttcagcaggctgcactcctgcctcaagaactgccagcccccccagacgaggtgtcagctatgaaaaatctgctgaaatacagcagtcaggctctggtcgttggacagaaagctccactcgttggtctggggggattgaaggcttcatgtattcagcaggaggcaaagttcctgagcagcaaaggcccaggccagtccgagagacctgactgtgctaggagcagagaacacgacactactcatggggacggtgaagtgaggcaaccgcccgttggcattgccgtcgcgttggcgcggcagaaagacaccgtgagccggagcgaagccgcttacggaactaataccgccaggcaaggccgggccgcccccgctttcaagggcggcggtggcccacgcagcacccatgcactagatctagaagcagaagaggaacgcactaggctctgtgatgacagactcgggctggcctctagagagctcctgctgcaggactctaaagacagggtagaatttgccaggatccacccaccatccagctgcccaggggacctcgcgccacatctgatgatgcagtctggtcagctgggcggcgacccagcacctcacacacacccccaccccccatggctacctcgcacacgctcaccatcactctggatgggaggccatagctatggcctgggacaccctgccctccatcagaacctgcccccgggctttcctgcctcggtggccggccccgttccgtcggtgttcccgctgccgcaggatgcccccacacagttggtgattttgccaagtgagccgacacctcactcagcacctcatgctctggccgatgtaatggatcaggcatccctttggcctccaatgtatggagggcgaggtcccgcaagccacatgcaacatcccggacagcttcccgtttactcacggccccagctcctgagacagcaggagctgtacgccttgcagcaacagcgggccgctcagttccaacgtaagcccgaagaccagcacttggatctcgaagaacctgcccaagaaaaggcacccaaatctacgcacaagccagtggctttgacacccaccgcccccggtgctccttctccagccgccggtccaaccaagctgcccccatgctgccaccccccggaccctaaacctccagcctctagcccaacacctcctcctcggccatcagccccatgcaccttgaacgtttgccccgcgtcttcaccaggccccggtagcagggtccgtagcgccgaagaaaagaacggtgaggggcagcaatcgactgctgacatcatcacgtcagaaccagatctccctcccggttacctgcgcccaatggcgggcttgggattctcactccccagcgacgtgcattcctcgaacctagaagatcccgagacaatgcagactacagccccgggggctcaacctgagccaacccggacctttctgcccggagaaccacccccctgcagtccccgaagtctcgaagaacccggcctactgtctggcgcccgtgaagctacccaggacttggccgccacgccataccccactgaacggggcccacaaggaaaggccgctgatccttcccccctggagggccttcaggagctgcagtgtgctgccctgctggaagccggtggtccggaggctactggacaagctcactctacccaaggcggcgcgcgtgaagaaagaagtcgggaagaaggtgaacaaggccctagttccggggcaagcagccaggttttggagcagcgtgcaggctctcctggcgcccttgaagacgagggggaacagcctgccccagaggaagacgaattggaggaagatgagcttggacagcagtccatggaggacagcgaggaagactgcgggggcgctccggataactctcaccccccccgagccctaccaggcctggatgccttggtagcggctaccatcaatcttggcgacttgccctcagatagcccgcctgaccctcagcccccagctgcaagcgggcccccttctaccgtgcctctgccacacagctccggaattcatggaatcgccctgctgagcgagctggcagatctggccatccagaggcagcggagcgagaggaccgtccctgaggaggaggaagatgttctagcatttaacctacagcatctggcaacgctggccactgcttggtcactagtggaagcagccggcctggactcctccacagccccagcacagccccccactgcaaacccctgttcgggtcctcgactcacgccccggatgcaaatcctccaaaggaaagatacgtggacgcctaagaccaaaccagtttgccctcttaaggcggccattgaccggcttgacacgcaggaagtcggaatgcgggtccggcttgctgagctgcagcgtcgttacaaggaaaaacagcgtgagctggcccggcttcagagaaaacacgatcatgagagggatgagtccagccggagccccgcccgcaggggtcctgggcgacctcggaagcgcaagcatagttcgtctctaccggctccccgtccaactggacctcttccccgatcagacggcaaaaaagttaaggccgtgcgcacatccttaggcttgttatgtgcggaactccgcggcggttctggcggagagcctgctaagaagaggtctaaattggagcggtctgtgtacgcagggctgcaaactgctagcgttgaaaaggctcagtgcaagaaatctagctgtcagggaggcctggctcctagcgtcgcccaccgcgtggcccaactgaagcccaaggttaagagcaaggggttacccaccggattaagtagtttccagcaaaaagaagccacccccggcggccggatcagagagaagctgtcccgagccaaatcggcaaaggtgagtggcgccactaggcatcctcagcctaaggggcacgggtcccgagagacacctcgctgtccagcccagccaagtgtcgcggcaagccaggaagccggcagcgggtacgacagtgaggactgcgagggattgctaggcaccgaagctccaccgagagaggccggcctgctgctccatactggcgcatctgtggcagtgttggggccaagcccctcctccgttgtgaagatggaagccaaccagaaggcaaaaaaaaaaaaggaaaggcaaggactgctcggcgcatgccgactgagctccccagagtccgaagtcaagataaaacgccggagcgttaaagccaaagtgggcaccactctggagcgggcaccagggcagagacccccaggggcattaggcaaaaaaaaggcgaaaggaaaggccaaagggtccctgcgagctgagcccggagccaccccaagtcgggacgcactcttcaacccctccagagccttcgcttgcagagaagaggggtcacaactggcctccgaaagactgaaaagggctacccggaagggtaccgttttacagcccgtcttgagacggaagaatggggcgctttctataactctcgccactaggaacgccaaggccattcttggaaaagggcgaaagctctcaaaagttaaacacaaggccggaaaacagggcaagggaagagccgtgagcaggctcctagagtcctttgcagtggaggaagacttcgaatttgatgataattcaagcttctcagaagaagaggaggacgaagaagaggaagaagaagactccgggccgctgagcgctgaacagtccgcagccctggccaggtcttgcgcgatacacaaggaagacttacgcgatggcttgcctgtgctaatcccaaaggaggatagtctgctgtatgcaggctccgtgagaaccctacagccacccgacatctatagcattgtaatagaaggcgaacggggcaatcggcagcgcatatattccctggaacagctgcttcaagaggcagtgttggatgtacggccccaaagcagtagatatttacccccaggcaccagggtctgcgcctactggtcgcaaaaatctcgctgcttgtaccccggaaacgtcgtgagaggagcctccggagatgaggacgaggacttggacagtgttgtagtagaattcgatgatggtgacacgggacacattgccgttagtaacgtcaggctcctcccccctgacttcaagatacagtgtacggaaccttcacccgcgctgcttgtctcctcaagctgcaggagaactaagaaagtgtccagtgaagctcccccaccctcagaggcagctaccccctccctttcaccaaaggctcaggatggccctgaagctctgaagactcctggaaagaaatccatcagcaaggataaggccggtaaggcggaactcctgacctcaggagcaaagagtccaactggggcgtccgaccattttctcggccggagaggatcgccccttctctcctggagcgccgttgcacagaccaaacggaaggcggtggccgccgcctcgaaggggccgggcgttttgcagaacttgtttcagctgaacggaagttccaaaaagctgcgggccagagaggcgttgttccccgtgcactccgttgctactccgatctttggcaacggctttcgggccgacagcttttcctctttagccagctcgtacgccccttttgtgggaggaaccggccctggactgccacggggggcacataagctccttcgcgctaaaaaggccgaaagagtcgaagccgaaaagggaggtcgcaggagagctggaggtgagtttttagtcaagctcgatcatgaaggtgtaacatctccaaagaacaagacatgtaaagcactgctcatgggcgataaagatttctcccccaaactgggaagaccacttccttccccttcttatgtgcatcccgcactggtcggcaaagataaaaagggacgtgctcccattccaccccttcccatgggtttggccctgcgaaagtacgctgggcaggctgagtttccacttccctatgatagcgattgtcactcttcttttagtgacgaagacgaggatggccctgggctcgcggcaggagtgccatcccgatttctggcccgtctttcagtctctagtagttcctctggatcatcgacctcctcatcatccggctctgtctccactagcagcctatgctcctctgacaacgaagacagctcatatagctccgacgatgaagatcctgccctgctcctgcagacctgcctgacccaccccgttcccaccctactagcccaaccggaggcccttagatcgaagggctcaggccctcacgcccacgcccagaggtgctttctcagccgcgcgaccgtggcagggacgggggcggggtctggcccctccagtagtagtaaaagcaagttaaagaggaaggaagccctgtcattcagcaaagccaaagagctgtccagaagacaacgcccacctagtgtcgaaaatcgacctaaaatttccgcttttctgcccgcgcggcagctgtggaaatggtccggaaaccctactcaaagacgcgggatgaagggcaaagcccgaaagttgttttataaagccatcgtacggggggaagagaccctgcgcgtcggagattgcgcggtttttctctccgcggggagacctaatctgccttacatcggccgtatcgaaagtatgtgggagtcctggggcagcaacatggtcgtcaaagttaagtggttctaccatccagaggagacgaaattgggtaaacggcagtgcgacggcaaaaacgccttgtaccagtcatgtcacgaggacgagaatgacgtgcagacgatatctcacaagtgtcaggtagtcgctcgtgagcagtacgaacagatggcacgaagtcgtaaatgccaggaccgacaagatctgtattatctggccggaacctatgaccccacaacaggcaggctggtaactgccgacggcgtgcccatactgtgttag

SEQ ID NO: 44509 - DNA, 1260 bp, Artificial Sequence
  Description of Artificial Sequence: Synthetic coding sequence
atgaacaagcaccagaagcccgtgctgaccggccagcggttcaagacccgcaagagggacgagaaagagaaatttgaaccaactgtgtttcgcgacactctggtgcagggactcaacgaggccggcgatgacttggaggccgtggccaagtttcttgactccacaggtagcaggttggactatagacgatatgctgatactctttttgatatcctggtggccggtagcatgctcgccccgggggggacgaggattgacgacggagacaaaacaaaaatgactaaccattgcgtgttttccgcgaacgaagaccacgaaacgatacggaactacgcccaggtgtttaacaagttaatcagacgatataagtatctcgagaaggcattcgaagatgagatgaagaagctgcttctttttcttaaggcattcagcgaaaccgaacaaaccaagcttgcgatgctgtctggaatccttcttggcaacggcacgcttccagcaaccatattaactagtctgttcaccgacagcctagtgaaggagggaattgccgctagcttcgccgtgaagcttttcaaggcctggatggccgaaaaggatgcaaactctgtcacatcctctctccgaaaggctaacctggacaagaggttgctcgagttatttcctgtaaacagacaaagtgtggaccactttgctaagtactttacagatgctggactgaaagagctttccgacttcctcagggtccagcagtctctcgggacgcgcaaggaattgcagaaggagctccaggagcgcctcagtcaagaatgtcctattaaagaagttgtgctgtacgtaaaagaggaaatgaagcgtaatgacctgccggagactgccgtaatcggccttctgtggacctgtataatgaatgcagtggaatggaacaagaaagaggagctcgtggccgaacaagccctgaagcatctaaagcagtatgctccccttctggccgttttctcatcacagggacagtccgagctgatactgctgcaaaaagttcaggaatattgctatgataatatccacttcatgaaggccttccagaaaatcgtggtcttgttctataaggctgatgtgctcagtgaagaagcaatccttaaatggtacaaagaggcacacgtggctaaaggcaagtctgtctttttggaccagatgaagaaattcgtggagtggttgcagaacgctgaagaggagtcggagtccgaaggcgaggaaaattag

SEQ ID NO: 44510 - DNA, 1227 bp, Artificial Sequence
  Description of Artificial Sequence: Synthetic coding sequence
atgaacaagcaccagaagcccgtgctgaccggccagcggttcaagacacgcaaaagggacgaaaaagaaaaattcgaacccacagtgttcagagataccctcgtacagggactaaacgaagcgggagacgacctggaagccgtggccaagttcctggatagtacgggctcgagactggactaccggcgctatgccgacacgctcttcgatatccttgtggctggtagcatgctggcccccggtggtacacggatcgatgacggcgataaaaccaaaatgacaaatcattgtgttttctcagctaatgaagaccacgaaacaatcaggaattatgcgcaggtgtttaacaaactgatcagacgatataagtacctggagaaagccttcgaggatgaaatgaaaaagctgcttctgtttctaaaggcgttctctgagactgagcaaacaaaattagccatgctgagtgggatattgttaggtaacggcacgttacctgcgaccattctgacgtcactgttcacggatagcctggtgaaggagggaatcgcagcctctttcgctgtgaagctgttcaaagcttggatggccgagaaggacgccaacagcgtgacctcttctcttagaaaagctaacttggataaaaggctgctggagctttttcccgtgaatagacaaagtgtggatcacttcgccaaatacttcacagacgccggattgaaagaactcagcgattttttacgcgtccagcaaagcctcggtaccagaaaagagctccagaaagaacttcaggaacggctttctcaggagtgccctatcaaagaggtagttttatatgtgaaagaagagatgaagcgcaacgatctccccgagacagcggtgattggacttctgtggacatgcattatgaacgctgttgaatggaataaaaaggaggagctggtggctgaacaggcactgaaacacttaaagcagtacgctcctctgctcgccgtcttttctagccagggccaaagtgaacttatcctgctccagaaggtgcaagagtattgttatgataatattcacttcatgaaagctttccagaaaatagtggtgttgttctataaggcagacgtgctgagtgaagaagcgattctcaaatggtataaggaggcacacgtggccaaggggaaatctgtatttctggaccagatgaaaaaattcgtggaatggctgcagaacgcgtag

SEQ ID NO: 44511 - DNA, 492 bp, Artificial Sequence
  Description of Artificial Sequence: Synthetic coding sequence
atgaacaagcaccagaagcccgtgctgaccggccagcggttcaagacccgcaagcgggatgaaaaagaaaagtttgagccaactgtatttagagataccctggtccagggcctgaacgaagcgggggacgacctggaggctgtcgccaaattcctggactcgactggtagccgcttggattatcgccgatatgctgacacactttttgacatcttggtagctggaagtatgttggcacctggaggaacacggatcgacgatggggacaaaactaaaatgaccaatcattgtgtcttctcagctaacgaggatcatgagaccatcaggaattacgcccaagtattcaacaaactcatcaggagatacaaatacctggagaaggcctttgaggatgaaatgaaaaagctgcttttattcctgaaggccttctctgaaactgagcagactaaactcgctatgctgtccgggattctgctaggaaacggaacttag

SEQ ID NO: 44512 - DNA, 1260 bp, Artificial Sequence
  Description of Artificial Sequence: Synthetic coding sequence
atgaacaagcaccagaagcccgtgctgaccggccagcggttcaagacccggaaaagagatgagaaagaaaagttcgagccgactgttttcagggacacactggtgcagggactgaacgaggctggtgatgatttagaggccgttgcgaaatttctcgactcaacgggctctcggctggattacaggcgctacgcagatacactgttcgacatattggtggctggtagtatgctcgcgccaggaggaacacgaatagatgatggcgataagaccaaaatgacaaaccactgtgtgttcagcgcaaacgaggaccacgagacaatccggaactatgcacaggtcttcaataagctgatccggcgctataagtatctggaaaaggcatttgaggatgaaatgaagaaacttcttttgttcctgaaggcattctccgagacagagcagactaaactggccatgctgtcaggcatcctattggggaatggtacactccctgcaaccatactgacatcactgtttacggactctctggtcaaggaaggcatcgcggcatccttcgccgtgaaactctttaaagcctggatggccgaaaaggacgctaacagtgtgaccagctctctcagaaaagctaaccttgataaaagattgttggaactgttcccagtgaaccggcaatcagtcgatcactttgcaaagtacttcaccgacgcagggctgaaagagcttagcgatttcctacgtgtccaacagagcctaggcactaggaaggagttacagaaagaactgcaggaacggctaagccaggaatgtcctatcaaagaagttgtcctgtacgtcaaggaggaaatgaagagaaatgatttacctgagacagctgtgataggactgttgtggacttgcattatgaacgccgtagagtggaacaaaaaggaggaactggtcgccgaacaagcactgaagcacttaaagcagtacgctccattactggccgtcttcagcagccagggacagtctgagttgattctgcttcagaaagtacaggagtactgttacgataacatccactttatgaaagcatttcagaaaatcgtggtgctgttttataaggccgatgttctgtccgaggaggccatcctaaagtggtataaggaggcacatgtggccaaggggaaatcggtctttctcgaccagatgaagaagtttgtggagtggctgcaaaacgcagaggaggagagcgaatctgagggcgaggagaattag

SEQ ID NO: 44513 - DNA, 627 bp, Artificial Sequence
  Description of Artificial Sequence: Synthetic coding sequence
atgaacaagcaccagaagcccgtgctgaccggccagcggttcaagactaggaagagagacgagaaagagaagtttgaacctacagtcttccgcgacaccctggtccaaggactgaacgaagccggtgacgatctggaagctgtagccaagttcctggatagtacgggcagtcgtttagactatagaagatacgcagacaccttatttgatattctggtcgctggttcaatgctcgccccaggcggcacaagaattgacgacggagacaagactaagatgaccaaccattgcgtatttagtgccaatgaggaccacgagactatcagaaattacgcccaggttttcaacaagttgattaggcggtacaagtatctggagaaggcattcgaagatgaaatgaagaagctgctgctgttcctcaaggccttttctgagacagagcagactaaactggcaatgctctcagggatattgctgggcaacggaacattaccagccactattctcacctctctgttcaccgatagtctggtgaaggaggggatagcggctagtttcgctgtgaagttattcaaggcctggatggcagagaaggacgccaattctgtgacctcttcactgcggtag

SEQ ID NO: 44514 - DNA, 825 bp, Artificial Sequence
  Description of Artificial Sequence: Synthetic coding sequence
atgaacaagcaccagaagcccgtgctgaccggccagcggttcaagacgcgcaagagagatgagaaagaaaagtttgaacccacagtgtttcgcgacacattggtgcagggactgaacgaggccggagacgatctggaagccgtggcgaaattcctcgactccacggggtctcggttagactatcgacggtatgccgacactctgtttgatatcttagtggcaggaagcatgctagcccctggcggaacccgaatcgacgatggagacaagacaaagatgactaaccactgcgtgttcagtgccaatgaggaccacgaaacaatccgtaactacgcacaggtatttaacaagctcattaggagatataagtacctggagaaagctttcgaggatgagatgaagaaacttttactgttcctgaaagcattctcagaaactgagcagaccaaactcgccatgctcagcggaatcctgctagggaatggtacactgcccgcgacaatcttgacctcactgtttaccgactcgctggtgaaagagggaattgcagcttcttttgccgtgaagctgtttaaggcctggatggccgagaaggacgcaaattcagtaacctcctccttgcgcaaagcgaatctagacaaaagactcctcgagctctttcctgtcaataggcagtccgtcgaccatttcgcgaagtattttacagacgccggattaaaggaactcagcgatttcctgcgcgtccagcagtctctcggcacgcgtaaggaacttcaaaaggagctccaagaacgcctgagccaggagtgcccgatcaaagagtag

SEQ ID NO: 44515 - DNA, 486 bp, Artificial Sequence
  Description of Artificial Sequence: Synthetic coding sequence
atgaacaagcaccagaagcccgtgctgaccggccagcggttcaagacaaggaagcgcgacgaaaaggaaaagttcgaacccaccgttttcagggacacactggtgcaaggcctcaatgaggccggtgacgaccttgaggccgtcgccaaatttcttgattctaccggctctcgactggactataggcgatacgctgacaccctctttgacatcctcgttgctggctcaatgctggcccctgggggcacgaggatcgacgatggcgacaaaacaaagatgaccaatcactgcgtgttctccgctaatgaggatcacgaaaccatcaggaactacgcccaggtattcaataagttgatccggagatataagtatctggagaaagcattcgaggatgagatgaagaaggccctgcgcccacaccttctgtcttcattctctaaacacgggtggcaaaaaaaaatgcctaccctcttgcctagactgtag

SEQ ID NO: 44516 - DNA, 477 bp, Artificial Sequence
  Description of Artificial Sequence: Synthetic coding sequence
atgaaccaggagaagctggccaagctgcaggcccaggtgcggatcggaggaaaagggaccgcccggaggaagaagaaagtagttcataggactgctacggccgacgacaagaaacttcagagctctctgaaaaaactcgccgtcaacaacatcgctggtattgaggaagtgaacatgatcaaagacgatgggaccgtgattcacttcaacaaccctaaagtccaggctagtctgagcgctaatactttcgccataaccggccacgccgaagctaaacccattaccgaaatgctgccaggcatcttgtctcagctaggtgcggacagcctgacctctttgcgaaagctggctgaacagtttcccaggcaggtactggatagcaaggcgcctaaacccgaagacattgacgaagaggacgacgacgtgcctgacctggtagagaactttgatgaagcatctaagaatgaggccaattag

SEQ ID NO: 44517 - DNA, 303 bp, Artificial Sequence
  Description of Artificial Sequence: Synthetic coding sequence
atgatcaaggacgacggcaccgtgatccacttcaacaaccccaaggtgcaggcctccctgtctgctaacacatttgccatcaccggccacgccgaagctaaaccaattacagaaatgctgcctggcatactgtcacagctgggggctgacagcctgacctcactgcgcaaactggcggagcagttcccccgccaggtgcttgactctaaagcccctaaaccagaagacattgatgaagaggacgacgatgttcccgaccttgtcgaaaactttgacgaggcatcgaaaaacgaggcgaattag

SEQ ID NO: 44518 - DNA, 213 bp, Artificial Sequence
  Description of Artificial Sequence: Synthetic coding sequence
atggccgaggtgaagagcatgttccgggaggtgctgcccaagcagggccccctcttcgttgaggatattatgactatggtgctctgtaaacctaaattgcttccactaaagtcgctgactctggagaagctggagaaaatgcaccaggcggcgcagaatacaattcggcagcaggagatggcagagaaggatcaaaggcagatcacacattag

SEQ ID NO: 44519 - DNA, 213 bp, Artificial Sequence
  Description of Artificial Sequence: Synthetic coding sequence
atggccgaggtgaagagcatgttccgggaggtgctgcccaagcagggcccgctcttcgtcgaggatatcatgacaatggtgctctgcaaacccaagctacttccattaaagtctttgaccctggaaaaacttgaaaaaatgcaccaagctgcccagaacaccattcgccagcaggagatggccgagaaagaccaaaggcagattactcactag

SEQ ID NO: 44520 - DNA, 279 bp, Artificial Sequence
  Description of Artificial Sequence: Synthetic coding sequence
atgctgaaggccgccgccaagcggcccgagctgagcggcaagaacaccatctccaataattcagacatggctgaggtcaagtcaatgtttcgcgaggtccttccaaaacagggccctctctttgtggaggatatcatgacaatggttctctgcaaaccaaagctgctccctcttaagtcactgacgctagagaaactagagaaaatgcaccaggcagcccaaaataccatccgacagcaggaaatggctgagaaagatcagcgtcagatcactcattag

SEQ ID NO: 44521 - DNA, 204 bp, Artificial Sequence
  Description of Artificial Sequence: Synthetic coding sequence
atgctgaaggccgccgccaagcggcccgagctgagcggccccctgtttgtagaagacatcatgacaatggtgctctgtaaaccaaaactcctgccgttaaagagcttaactcttgagaagttggagaaaatgcatcaggcagcacaaaatacaatccgacagcaggaaatggccgagaaagatcagaggcagattactcattag

SEQ ID NO: 44522 - DNA, 312 bp, Artificial Sequence
  Description of Artificial Sequence: Synthetic coding sequence
atgctgaaggccgccgccaagcggcccgagctgagcggcctgctgaagttcaataactacgggatactgagtgagtcgccgctgaccagtcaaagaaccacatggcttttgtaccagtcaccctcatttatccctggctttgcgtacccctctagatgtctgaagactatcggaggcgtctataagcaggcgcgtaagaagcattatattcagcagctgcgatacggtcggtctgaggttaatgtaccaggatcaagctctaaagccagagcgacagtctgcggaagatacaacgacaacggcgctgtttag

SEQ ID NO: 44523 - DNA, 879 bp, Artificial Sequence
  Description of Artificial Sequence: Synthetic coding sequence
atggccgtgcccaccgagctggacggcggcagcgtgaaggagaccgctgctgaagaggagtcgcgcgtgctcgcccccggagctgcacctttcggaaattttccccactacagcagatttcacccacccgaacaaagactaaggctgcttcctccggagcttctgcgacagctgtttcccgaatcaccggaaaacggccctatcttgggcctcgacgtgggctgcaactccggtgacctgtccgtggcactctataagcacttcctgagtctgcccgacggcgagacgtgtagcgatgccagccgagaattcaggcttctgtgttgcgacatcgacccagtcctcgtcaagcgggcagagaaagagtgtccctttcccgacgcactcaccttcattacgctcgatttcatgaaccagcggactagaaaagtcctgttgtctagctttctcagtcaattcggccgctctgtctttgacatcggcttctgcatgagcatcactatgtggatacaccttaatcacggggatcatggactctgggaattcctggcccacctgtcctccctgtgtcattatctattggtagagcctcagccctggaaatgttacagggccgccgccaggaggctgaggaagctcggtctgcacgactttgatcattttcatagcctggctattcgcggcgacatgccaaaccagattgtgcagatccttacccaagatcacggtatggaactgatctgctgcttcgggaatacaagttgggatcggtccctgcttcttttcagagcaaagcagactattgaaacacacccgatcccagagtccctgatcgaaaaagggaaagaaaagaacaggctgagcttccagaaacagtag

SEQ ID NO: 44524 - DNA, 741 bp, Artificial Sequence
  Description of Artificial Sequence: Synthetic coding sequence
atgagcctgcagtggaccgccgtggccaccttcctgtacgccgaggtattcgttgtgctcctcctttgcattccctttattagccccaaacgatggcagaagatctttaagagcagactggttgaacttcttgtgagttatggcaatacatttttcgtggttttaatcgtgattctcgtcctcctcgttatcgatgccgtcagagagattcgcaaatacgacgacgtcaccgagaaagtcaatctgcaaaacaatccgggagcaatggagcacttccatatgaaattattcagagcccaacgaaacttatatattgccggcttctcactgctgctctcattcttgctgagacggttggtgacactcatctcacagcaggctaccctgcttgcttcaaacgaggccttcaagaagcaggcagagtccgcatccgaggcagcaaaaaaatatatggaggagaatgaccagttaaaaaagggcgctgccgttgacggcggaaaacttgacgtgggcaatgccgaggtcaaactcgaggaagagaaccggtccctaaaagcagatttgcagaagctcaaggatgaactggcgtcaaccaagcaaaaactggagaaggccgagaatcaggtcttagcaatgcgtaagcaaagcgaaggactaaccaaggagtacgatcgcctgctggaggagcacgccaagctgcaggctgcggtcgacggacccatggacaagaaggaagagtag

SEQ ID NO: 44525 - DNA, 741 bp, Artificial Sequence
  Description of Artificial Sequence: Synthetic coding sequence
atgagcctgcagtggaccgccgtggccaccttcctgtacgccgaggtgttcgtggtgctgctgctttgtattccctttattagcccaaagaggtggcagaaaattttcaagtcccggctagttgaactgctggtttcttatggtaacacttttttcgttgtcctcatagtcattctggtactcctcgtaattgacgctgtcagggagatacgcaaatacgatgatgtaacagaaaaagtgaacctccaaaacaatcccggggcaatggaacatttccatatgaagctatttagagctcagagaaacctatacattgctgggtttagcctgttgttatcatttctcctacgaaggctagtgacactgatatcgcagcaggctactctgctggcgagcaacgaagcatttaaaaaacaggctgaaagtgcctccgaggctgctaagaaatacatggaagagaatgaccagcttaaaaagggggcagctgttgacggtgggaagctcgacgtgggaaatgccgaggtaaagctagaggaagagaacagatccctgaaggcagacctgcagaaactaaaggatgaactggcgtccacgaaacagaagctcgagaaagctgaaaaccaggtgctggctatgcggaagcaaagcgagggcttgaccaaggaatacgatcggctattggaagagcatgccaagctccaggcggcagtggatgggccaatggataaaaaagaggagtag

SEQ ID NO: 44526 - DNA, 636 bp, Artificial Sequence
  Description of Artificial Sequence: Synthetic coding sequence
atggcccaggccaagatcaacgccaaggccaacgagggccggttctgtcgtagctcaagcatggctgacaggtcctcccggctactggagtctctcgaccagctcgaactacgggttgaagcactgcgcgaggccgcgaccgcagtagagcaggagaaggagattttgcttgagatgatccattcaattcagaactcacaggatatgcggcagatctccgatggcgagcgtgaagagctgaacctcactgcaaatagattaatgggccggacattaacagtagaggtttccgtggagacaatccgcaacccgcaacagcaggaatctttgaagcacgccacacggatcattgatgaagtcgtgaataagttccttgacgacctgggaaatgctaaaagccaccttatgagtctctattcagcctgcagttcagaggtcccgcatgggcctgttgatcagaagttccagtctatagtcatcgggtgcgcactggaggatcagaagaaaataaagcgacgcctggagacgcttctgaggaacattgagaattcagataaggccattaaactgctggagcattccaaaggtgcaggtagcaaaacgctccagcagaatgctgagtcgaggttcaattag

SEQ ID NO: 44527 - DNA, 327 bp, Artificial Sequence
  Description of Artificial Sequence: Synthetic coding sequence
atgccccacatgtgggtggaggccctgcgggaggccgccaccgccgtggagcaggagaaagaaatccttctggagatgattcacagtattttgaccgccaacaggttgatgggcagaaccctcactgttgaagtctccgttgaaacaattcggaatccccagcagcaggagtctctcaaacacgccacacgcatcattgacgaagttgtcaacaagtttttggatgatttagggaacgcgaagagccatctgatgtcactatatagtgcctgttcgagcgaggtaccacacggcccagtcgaccaaaagttccagtccattgtgtag

SEQ ID NO: 44528 - DNA, 537 bp, Artificial Sequence
  Description of Artificial Sequence: Synthetic coding sequence
atgccccacatgtgggtggaggccctgcgggaggccgccaccgccgtggaacaggagaaagagatcttgctcgaaatgatccacagcattcaaaacagtcaggacatgcggcagatcagtgatggcgagcgggaggaactgaatctcactgctaaccgcctcatgggtagaactctgaccgtcgaggtttcggttgagaccattcggaacccccaacagcaggaatccttaaagcacgccacaaggatcattgatgaggtggttaataaattcctggatgacctgggcaatgctaagtcacaccttatgagtctctattccgcctgttcctcagaggttccccatggccctgtagaccagaaattccagagcatcgtaattggatgtgctctcgaggaccagaagaaaattaagcgcaggttggaaactcttttgcggaatatcgagaactccgataaggctattaaacttctggagcattctaagggcgctggctccaaaactctgcagcagaacgcagagtctaggttcaactag

SEQ ID NO: 44529 - DNA, 1938 bp, Artificial Sequence
  Description of Artificial Sequence: Synthetic coding sequence
atgagcgagcggacccaggagcaggacttcgtgatcatcaccgtggatgactctgatgataacaatgactgttcgattgaaatggtagaagtgtcagagacagctgataattccaccaatgacatcgccgacgatagcacctatgtgaccgcagacaatcctacagacgatacagctactcagccgaatttccccggtggaaatgatggacaccacagacccctccagatgagttatggatcaggcagtgttactcaggcaggggttcagtggcatgaccatagctcactccagccacaacccctggggctgaagcagttcttccatctcagcttaccgagcagctgggatgaccgtagaaccccaccctgtccagtcgctcacggtgaccaaatagtgtcacaaatcaaccacccagtccacctgcgtagatatagctacaattcggaggaggttgacttcccaaaaagagggcgtttttacactcctgaagtccaatcatcgattagtccacccgccgaacgacaggaaacacacgcttgggctagcccagcagtcacaagtcttgagagcgccgcttgtcacgaacttcaggaagccgatctgtctgagtccctaagttatcctagaatcgtgtccagctccagtttgcagcaatatgtcgctcaaggcggcagtttcccctgttttggtatgccctggaatttcatatcaggtggcgctgagtcgaccaatgctgtaatttcatttgctaatgctaccacggccgttcctatggcagttttaagccgccgtgagtcttctttggccaacaacccaggtgtcgttaactacagtgccctgccagagaatgaaaacgtcggacccggcagagctctttctagtttctgctttcacccaaacctcgagtctggaccccagatgtcttatggcaccatgtcttattcaaccgagatgaaaaacaattgcgatcaggacgacgcctcagcttctgcgtgcctgacaccggacttcgccctgctaccactgaacatcctcgtgaaagtagacacgaatacagaaaatagcgtaaacaccatgaatcgaagtacactgctggacagcgatagcggacaggactcctccagctcctccgtgtgcatcccaccaaagtacggatatctgggggatccaaaacggaacgtgcgagtgctgaaaatccatctcttagcggtgcaaaacatggccaaacctaagcaggctgcatgctacttagttcgtatactgttttcaaaggagatcttaattagcagttcagttgacattcacctaaaggatagccagtctctcgaccccaacaagatggctgctctgagggaatacctcgccactaccttcccaacctgcgatctccatgagcatggcaaggactggcaagactgcatcagcggcataaactccatgatttattgtctgtgtagtgagggaaaaagtacccccaagacggtgaggaagaataagaaacggacgaaccgcgttgctagtgcctccgccgaccgcaatgaccagagggggcgcgacggcggggagggttgcagttggatgttccagccaatgaataactctaaaatgagagaaaagcgcaacctgcagccaaattctaacgccatcccagaaggtatgcgggaaccgtccacagacaaccctgaagagcctggggaggcctggtcttatttcgggcgcccatggcgcaacattcgaatgccttgcagtgtcctcacactggccaagaccaagtcttgcgcttccttaagcgctaggtacttgatacagaaactgttcaccaaggatgtactggttcagtcaaatgtatatgggaacctgaagcatggactttgcgcactcgaccccaacaaaatcagcgccctgaggggactactgcatattgagtacgtgtag

SEQ ID NO: 44530 - DNA, 2400 bp, Artificial Sequence
  Description of Artificial Sequence: Synthetic coding sequence
atgagcgagcggacccaggagcaggacttcgtgatcatcaccgtggatgactcggacgacaataatgattgcagtattgagatggtagaggtgtcagagactgccgataactctacgaatgacatcgccgacgattctacgtacgtgacagcagataaccccactgatgacacagccactcaaccaaactttccgggcggaaacgacgggcaccataggcctctccagatgagctacggcagtggttctgttacacaggccggagtgcagtggcatgaccattccagcctgcagcctcagccgctcggactgaagcagttcttccatctctcactgcccagctcatgggacgatagacggacccctccttgccctgtcgctcatggagaccagatcgtgagccaaattaatcacccagtgcatttgcggagatactcctataactcagaggaggtcgattttccaaaaaggggaagattctacaccccggaggtgcagtcttctatttctccgcccgctgagcggcaggaaactcatgcatgggcctccccagccgtgaccagcctagagtcagcagcctgtcatgaactacaggaggcggacctcagcgagagtctgagctaccctaggattgtctcctcatcgtctttacagcagtacgttgcccaaggggggagcttcccctgtttcggaatgccttggaacttcatctctggaggagctgaatccacaaacgctgtgatcagtttcgccaatgccaccaccgcagtcccaatggcagtgctctcccgaagagagtcttccctggcaaataaccccggcgtggtcaactactccgccctgcccgaaaacgaaaacgtgggtcctggcagggccctatcaagtttttgcttccaccctaacctcgagatgcctgaacgtcccgctaacagctccaaaaactccactgagaccgcgaactatccaaccctgatgggcaattacaatggccagaacaccgcaagtctttcagtgttcattcctccctacttcgccgaaaagattatccttactgagatgcccggaacgacggaaaccaatgtagagaacaatagtcagactgtatattacccagccctatcaggcaacaccagcgccccttatcctgcctccagttacctccctattacaagcaattttgaatcgggacctcagatgagctatggaaccatgagctactcgaccgagatgaaaaataattgcgaccaggacgacgccagtgcatccgcttgtttgactcccgacttcgccctgctgccgctgaacatattggtaaaagtggatacaaataccgagaattctgttaatacaatgaatagatcaaccctattggactccgactctggacaagattcctcctcctcttcagtctgcattccccccaaatatgggtacctgggtgacccgaaacggaacgtgagagttcttaaaatccatttgctggctgtacagaacatggccaaacctaaacaggctgcatgttacctggtgagaatactcttctctaaagaaatcttaatctccagctccgtagacatacatctgaaagatagtcagtctctagatccaaataagatggcagcgttgcgggaatatctggctactaccttcccaacctgcgacctgcacgagcatggaaaggattggcaggactgcatttccggcattaactccatgatctactgcctgtgcagcgaggggaagtcaaccccaaagactgtgagaaagaacaagaagagaaccaatagagtggccagtgccagcgctgatcggaatgaccagaggggccgggacggaggagaaggctgttcctggatgttccagccaatgaacaactcaaagatgcgtgagaaacgaaacctacagcccaattccaacgccatccctgagggcatgagagagccttccaccgacaatcctgaggagcccggcgaggcttggtcatactttggcaggccatggcgaaatatccgtatgccttgtagcgtccttacccttgcgaagactaaatcctgtgcaagtttgtcggccaggtatcttatccagaaactgtttaccaaggacgttctcgtccagtctaatgtgtatgggaatctcaaacatggactttgcgccttggaccctaataagatttccgctctgcgcgagtttctgcaggagaattaccctatctgcgatctttccgaaaacggccgtgactggaaatcttgcgtgacatcaataaacagcgggattagatctctgcggcatgacgtgagacgagctgaggccaggagtcagtcccttcctgcagtgaccccccctgagctggagcaagagtccaaacctggcgatcccgatgctaccgacccaagtacgtag

SEQ ID NO: 44531 - DNA, 2487 bp, Artificial Sequence
  Description of Artificial Sequence: Synthetic coding sequence
atgaacagcaccgagttcaccgaggacgtggaggaggtgctgaagagtatcactgtcaaggtagaaacagaagccgaagacgccgcgctggattgtagcgtaaattctcgcacaagcgaaaagcactcagtggattctgtgctcactgccctgcaggacagctcaaagcgcaagcagctcgtgtctgacggattgttggactctgttccaggcgtgaaaaggagaaggctgattcccgaagccctactggccggaatgcgtaaccgtgaaaactccagtccgtgtcagggaaatggggagcaggccggacggggccgatccctcggtaacgtttggcctggagaggaagaaccttgcaatgacgccaccaccccttcctataagaagccgctttacggaatttctcacaaaattatggaaaaaaagaatcctccttctggggacctcttgaacgtgtacgagctcttcgagaaggctaacgccagtaatagccccagctcgctgcgcctcttaaacgaaccacagaagagagactgcggaagcaccggcgctgggactgataacgatcctaacatctactttctgattcaaaaaatgttttatatgctcaataccttaaccagcaatatgtcacagctacactctaaggtcgacctgttatcgctagaggtatcccgtatcaagaaacaagttagtccaacggagatggtggccaaatttcagccccctccagagtatcagctcacagctgcggaactgaagcagattgtggatcagtcattaagcggaggtgacctggcctgtaggttgctcgtccagctttttcccgagctgttctccgacgttgactttagccgtgggtgcagtgcttgcgggtttgccgccaagaggaagcttgagagcttgcatctgcagctcattcggaactacgtggaggtgtactacccatcggtaaaggatactgccgtgtggcaagcagaatgcctaccacaactgaatgacttcttcagccgattctgggcccagagggaaatggaagattctcagccttcaggccaggtggcgtcctttttcgaggccgaacaggtcgatcccggacactttctggacaacaaggaccaggaggaggccctttcactcgacagaagctcaacaattgcaagcgatcacgtcgtcgacacccaggaccttaccgaatttctcgatgaagcctcttcaccaggggaattcgccgttttccttttgcatcggctgtttccagaactgtttgaccaccggaagctgggggagcagtacagttgttacggcgacggtggcaaacaagagctcgatccacagcggctgcagatcatacgaaattataccgagatctacttccctgacatgcaggaagaggaggcatggttacagcagtgcgcccagagaattaatgacgagttggaggggctggggttagacgccgggtctgaaggggatccacccagggacgattgctacgacagcagctcactaccggacgatatctcagtggtgaaagtcgaagacagctttgaaggcgagcgcccaggcagacgctcaaagaaaatctggctcgtgccaatagactttgacaaactggaaatcccccaaccagactttgaggttccaggagctgactgtcttctctcaaaggaacagttacgtagtatttatgaatcatcactgtcaattggtaacttcgcttcccgcctccttgttcacctgtttcctgaacttttcactcatgaaaacctacgaaaacagtacaactgctccggatccctgggcaagaagcaactcgatccttcccgcatcaaactgattcggcattatgttcagctactgtatccaagagcgaaaaacgaccgtgtctggacactggagtttgtgggcaaactggacgaacgatgtagacgccgcgataccgagcagcggcggtcatatcagcagcagaggaaggtccatgtcccaggacctgagtgccgcgacctgaccagttacgccattaaccccgaacggttcagagaagagttcgaagggcccccgctgcctcctgaaagatcctccaaagatttctgcaaaattccgcttgacgagctagtcgtgccctcaccggacttccctgtcccctccccgtatttgctctcagataaggaggttcgagagatcgtccagcagagtctgtcggtcggaaatttcgctgcccggcttcttgtccggctgtttcctgagctattcacggctgaaaacctgcgattgcaatacaaccattcaggtgcatgcaataagaagcagttggaccccacgcggcttaggctgattaggcactacgtagaggctgtctatcctgtcgagaagatggaggaggtgtggcattacgagtgcattccctcaatcgacgagcgatgcagaaggcccaacagaaaaaagtgcgacatcctgaagaaggctaaaaaggtcgagaaatag

SEQ ID NO: 44532 - DNA, 2487 bp, Artificial Sequence
  Description of Artificial Sequence: Synthetic coding sequence
atgaacagcaccgagttcaccgaggacgtggaggaggtgctgaagagtataacagtgaaggtagagactgaggccgaggacgctgcgctcgattgtagcgttaactctcgcacatccgagaaacacagcgtggacagcgtcctaaccgccctgcaggactcaagtaagagaaagcagctggtaagtgatggcttgctggatagtgtccccggggttaagcgacgtcggctcattccagaagctctgctggccggcatgcggaatagggagaactcctctccctgccagggcaacggggagcaggccggtaggggaagaagccttggaaacgtttggccaggggaagaggagccatgtaatgatgccacaacaccctcgtacaagaaaccactgtacggtatctcacataagatcatggaaaaaaaaaaccctccatctggtgacttgctgaacgtttacgaactattcgagaaggcaaacgccagtaactctcctagctccctgagattgctgaacgagcctcaaaagcgcgattgtggaagcactggcgctgggacagacaatgatcccaacatttacttcctaatccaaaagatgttctatatgctgaataccctgacttccaacatgagtcagctacatagcaaggtcgatttgctgtccctcgaggtgtctcgtataaaaaaacaagtgtcccctaccgaaatggtggccaagtttcagccaccccccgagtatcaactcacagctgcagagctcaagcagatcgtggatcaatctctgtccgggggtgacctggcgtgtcgcctgctggtgcagctcttccccgaactgttctcagatgttgatttttccaggggctgtagcgcctgtggatttgccgccaagaggaagctggagagccttcatctgcagctcattagaaattacgtagaggtatactaccctagtgtgaaggacactgccgtctggcaggcagaatgtttgccccagctcaatgacttcttttcaaggttctgggcccagcgtgagatggaggactcacaaccctcgggccaggtcgctagcttctttgaggcagagcaagtggatccaggacatttcttagataacaaagaccaagaagaggccctgtccctggatcgcagcagcactatcgccagcgaccatgtggtggatacacaggacctcaccgagttcctcgacgaggcgtccagtcccggagagtttgccgtgttcctgctgcatcgcttgttccccgagctatttgatcatcggaaactcggcgaacagtattcatgttatggtgacggggggaagcaggagctagacccacagcgccttcagataatccgcaattataccgagatatactttccggacatgcaggaggaagaagcctggcttcagcagtgtgcacagcggattaatgacgagctcgaagggctcgggctcgatgctgggagcgaaggcgacccaccacgtgatgactgctacgatagtagcagcctgcctgatgacatctccgtggtcaaggtggaggacagctttgaaggcgaacgcccagggaggcgtagtaaaaagatttggctggtgccaatagactttgataaactagagattcctcagccagacttcgaggtccctggagccgactgtttgctgagtaaggaacagctccggtcaatatatgagagctctttatccatcggtaacttcgcttcgaggttgctcgtccacctgttccccgagctctttacccacgagaacctgcgcaaacagtacaactgtagcggctcccttggtaagaagcagctggacccctcacggatcaaattgattcgtcattacgtgcagctgctctatccacgtgcgaagaacgatcgagtctggaccttggaatttgtaggaaagctggatgaacgttgtcggcgcagagataccgagcagcgcaggagctaccagcaacagcggaaggtgcatgtgccagggccagaatgccgcgatctcactagttacgccattaaccccgaacgcttcagagaagaattcgagggtccaccactcccaccagagcggagcagcaaagacttctgtaagataccactggacgaactggtggtgcctagccccgactttcctgtgcccagcccctatctactgagcgacaaggaagtacgcgagatcgttcaacagtctctgagcgtgggcaactttgcggcgcgacttctcgtccgcttattccccgaactgttcacagccgaaaacctgaggctacaatataaccacagcggcgcttgtaacaagaaacagcttgaccccacacggctgcgcctcattcgtcactacgtggaagccgtataccctgtggagaagatggaggaggtgtggcactacgaatgtatcccatccattgatgaacgatgccgcagacccaatcgcaagaagtgcgacatcttaaaaaaagcgaagaaggttgaaaaatag

SEQ ID NO: 44533 - DNA, 1218 bp, Artificial Sequence
  Description of Artificial Sequence: Synthetic coding sequence
atgcagcccgccgaggagggccccagcgtgcccaagatctacaagcagaggagtccatatagcgtgttgaaaacttttccatcgctcaatgttgtatcagaaagccgcatgatactggacgccttcgcccagcagtgctctcgcgtcttgtcccttctcaactgcggtggcaaactgctggattcaaaccattcccagagtatgatcagctgcgtgaagcaggaaggaagctcatacaatgaacggcaggagcattgccatatcgggaaaggcgtgcattcacagacgtccgacaatgtcgacattgaaatgcagtacatgcagcgcaaacagcagaccagcgccttcctgagagtgttcacggactcactgcagaattacttgttgtccggttccttccccacaccaaacccatcttccgcttccgaatatggacacctggccgatgtcgatcctttgagcaccagcccagtgcatacccttggaggatggacgtccccagcaacgtccgaatcccacggtcaccctagttcgagtactctgccagaggaggaggaggaggaagatgaagagggttattgccctagatgtcaggaactggagcaagaggtaatctccctccagcaggagaatgaggagctgcggcgcaagctggagagcatcccagtgccatgccaaactgtgctggactacctgaaaatggttctccagcaccacaaccagttacttatccctcagcccgccgaccagccaaccgaaggttctaaacagttattgaataattacccagtttatattacatccaaacagtgggatgaggcggtgaacagcagcaagaaagacggccggcgcttgctccgttatctaatccggttcgtgttcacgacagacgagctgaaatattcatgcggcttgggtaagaggaaacggtcagttcaatccggagagacaggcccagagcgcagaccactggatcccgtcaaggtgacctgtcttagagagttcattaggatgcactgcacttcgaacccagactggtggatgccatcagaggagcagattaataaggtgttttccgatgctgtggggcatgcccgccaaggcagagccgtcggaacctttttacacaatggcgggtcgttttacgagggaatcgatcaccaggcctcccaggatgaggtgttcaataagtcctcccaggatggaagcggagactag

SEQ ID NO: 44534 - DNA, 1605 bp, Artificial Sequence
  Description of Artificial Sequence: Synthetic coding sequence
atggaggaggagatgcagcccgccgaggagggccccagcgtgcccaagatatacaaacagaggagcccgtactccgtcttgaaaacgtttccctcaaaacggccagccctggccaagcggtatgagcgaccaacactggtggagctgccacacgtgcgcgcccccccacctccgccccccccttttgccccacacgccgcagtgtcaattagctcaagtgagccacccccgcaacagtttcaggctcaatcttcctatccacccggacccggccgagccgctgccgccgcttccagttcatcacccagttgtactcccgccacttcgcagggtcacctgaggacaccggcccaaccaccgccagcctcacctgctgcctcttcttcctcgagtttcgcggccgtggtcagatacggcccaggggcagctgccgcggctggtacagggggcaccggaagcgactctgcctcacttgagctttcagcagaaagtcgcatgattctcgacgcattcgcccaacagtgtagcagggtgctgtcactgctgaactgcggaggcaagctgttagacagcaatcactctcaaagtatgatctcatgcgtgaagcaggaggggtcctcttataacgagcgtcaggagcattgccatattgggaaaggcgtccactcccagacgtccgataatgtcgatatagagatgcagtacatgcagagaaagcagcagaccagtgcctttctccgcgtgttcaccgactcgctgcagaattatcttctgtccgggagttttccaacccctaatcccagctcagctagcgaatacggtcatcttgcagatgtggaccccctatctacatcccctgtgcatacattgggaggatggacaagccctgccactagcgagagccacgggcacccctcatctagcaccctgccagaagaagaggaggaggaagatgaagagggctactgccctcggtgccaagaactcgagcaggaggtcatttctctacagcaagagaacgaggaactgcggcgtaaactggagtcaatccccgtgccatgccagactgtgctggactacctgaagatggtgctgcaacatcataatcaactcctcatcccccagcctgctgaccaacccacagaggggagcaagcaattgttaaacaattaccccgtttacatcacctctaagcagtgggacgaagccgttaattcctccaaaaaagatggaaggcgcctactgcggtaccttatacggtttgtgttcacaacggatgagttgaaatattcctgcgggctgggaaagaggaaaaggtcagtgcaatccggcgagactggccctgaacgacggcccttggaccccgtgaaggtgacatgtctgagggagttcattaggatgcattgtacttcgaaccccgattggtggatgccttctgaagagcagattaacaaagttttctctgacgccgtgggccatgcgaggcagggcagggcggtgggcaccttcctgcacaacggcggaagcttttacgagggaattgatcaccaggcttcccaagatgaggtgttcaacaaaagcagccaagacggaagcggcgattag

SEQ ID NO: 44535 - DNA, 1314 bp, Artificial Sequence
  Description of Artificial Sequence: Synthetic coding sequence
atgcagcccgccgaggagggccccagcgtgcccaagatctacaagcagcggtccccttacagcgtgctgaagaccttcccttccaagaggcccgccctggcaaaaagatatgaacgccccacccttgtggaactgccacacgttagagccccaccccctcctcctccaccattcgcccctcatgcggctgttagcatcagcagcagcgaaccaccccctcagcagtttcaggcccagtcctcttatccaccaggcccaggacgggcagccgcagctgccagctcctcttcaccttcttgtactccagccaccagccaggggcacctccgcacgcccgcccaacccccacctgcttctcccgctgcatcctctagcagtagcttcgccgccgtagtcagatatgggcctggggccgccgctgcggcagggaccgggggcacagggagtgactctgcttctctcgaactgtccgccgagagtaggatgatcctggacgcctttgcccaacagtgcagtcgagttctgtccctacttaactgtggcggtaagctcctcgacagtaatcacagccagagtatgatttcttgtgtaaaacaggaaggaagtagctataatgagcgccaggagcattgtcacatcggcaagggcgtccatagccagacgagtgataacgtcgacatcgaaatgcagtatatgcagcgcaagcagcagacatcagcatttttacgcgtcttcactgatagcctgcagaattatttactttccggctcttttccgacccccaacccttcttctgcaagtgaatacggccacctggcagacgtcgatccgctctcaacatcccctgtccacactctggggggctggacttcccctgcgaccagcgagagccacgggcatccatcctcctccacgttacccgaggaagaggaggaggaggatgaagagggttattgtccccgctgccaggaactagaacaagaggttatctcactacagcaggaaaatgaggaactaaggaggaagctagagtctattcctgttccatgccaaaccgtcctggactacctcaaaatggtgctacaacatcataaccagttattgatcccccaacccgcagatcaaccaaccgagggctcgaagcagttactgaataactacccagtctacatcaccagcaagcagtgggacgaagcagttaactcatcgaagaaggatgggcgtcgactgctcagataccttatccggttcgtgttcactactgacgagttaaaatactcttgcggtcttgggaagcgtaaaaggattcactag

SEQ ID NO: 44536 - DNA, 570 bp, Artificial Sequence
  Description of Artificial Sequence: Synthetic coding sequence
atgcagaagatcgtgcagaccgacgagatcaccaacacccaggcctttcggaaaggcaaaaggaagaggacagaaacaatggattccgaaaacgccaattcggatatggacaaaggacagagagacccctatagcggaaatgcctttttgcctggggagtcctcgtctgaggacgaggagccacttgccgagttgagcaaagaagagttgtgcgctaaaatcaaatcccttaaagagaagcttactaatacacgcaaggaaaatagcaggctaaggcagagcttggtcatgcttcaggtgttaccacaggccgtaacacagttcgaggagctggtcggcatggccgaggcgttgcttaagggcggcggcacgatgtccacttcagcctccacgttatggcgagccaccaataacagttctcccgattcctttgcctcgacatgcagcaacagcaatagcaatagctcttcccctgtctcccttaaacctgaggaagaacatcaaaccgacgaaaaacagtttcagattgaaaaatggcaaaaccccctgttacagggaacaaagctctag

SEQ ID NO: 44537 - DNA, 390 bp, Artificial Sequence
  Description of Artificial Sequence: Synthetic coding sequence
atgcagaagatcgtgcagaccgacgagatcaccaacacccaggccttcagaaagggaaaacgcaagaggaccgagaccatggactcggagaacgccaatagcgacatggacaaaggccagagggatccctattcaggaaatgcatttctcccgggtgagtcaagcagcgaagatgaggagccccttgccgaattatcaaaggaagaattatgtgctaaaatcaaatccttaaaagagaagttgaccaatacacggaaagagaacagcagactgcggcagagcctggtcatgctccagggaaacaaactggacatcactactgaaaagacaatacttcatgggggcatgaagaccctgaatgtcgttaccacatcatcacacccggtatag

SEQ ID NO: 44538 - DNA, 840 bp, Artificial Sequence
  Description of Artificial Sequence: Synthetic coding sequence
atgcagaagatcgtgcagaccgacgagatcaccaacacccaggccttccgcaaaggcaaaaggaagaggaccgagaccatggactctgagaatgcaaactcagatatggataaaggacagagagatccttacagcgggaatgctttccttccgggcgagtcaagctcggaagatgaagagcctctggctgagctgtcaaaggaggaactgtgcgcaaaaattaagtctttaaaggagaaactgactaacactcggaaagagaacagcagactccggcagagtctggttatgctgcaggttctgccccaggccgtgacacagttcgaggagctggtggggatggccgaggccttgctgaagggcggcggtaccatgagtacgagtgcttccacgctgtggagagctacaaacaatagtagccctgacagcttcgcttcgacgtgcagtaacagcaacagcaatagctcatcgccagtctctctgaagcccgaagaagaacatcagacagatgaaaagcagtttcagattgagaaatggcaaattgcgcggtgtaacaagtccaagccacagaagtttatcaacgacttgatgcaggtgctctatacgaatgaatatatggccacgcacagtctcaccggtgccaagagcagcacatccagggataaagccgtcaagccggccatgaaccagaatgaggtgcaagagattattggagtgaccaagcaactattccctaacaccgacgacgtatcaatccggaggatgatcggccaaaaactaaacaactgcactaagaagccgaatctcagtaagaatctgaattcccaggatataaagtag

SEQ ID NO: 44539 - DNA, 321 bp, Artificial Sequence
  Description of Artificial Sequence: Synthetic coding sequence
atgcagaagatcgtgcagaccgacgagatcaccaacacccaggcctttagaaagggtaaacgcaagcggacggagaccatggacagtgaaaatgccaattctgacatggataagggccagcgtgatccctacagcggcaacgccttcttaccaggggaatccagctccgaggatgaagaacctctggcagagctttctaaggaggaactgtgcgcgaaaattaaatcattaaaagagaagttgactaacacgcgcaaagaaaattcacgactacgacaatccctggtgatgctccaggcctggtctcgcgagctgccctag

SEQ ID NO: 44540 - DNA, 390 bp, Artificial Sequence
  Description of Artificial Sequence: Synthetic coding sequence
atgcagaagatcgtgcagaccgacgagatcaccaacacccaggccttccggaaaggcaaaagaaagcggaccgagacaatggatagtgaaaacgctaactcagatatggacaagggacagagggacccctacagtggaaacgcatttctacctggcgagagcagttccgaggatgaggaacctctcgcggaactgagcaaggaagaactatgcgctaaaatcaaaagtctgaaggagaagctcactaatacccggaaggagaactccaggctccggcagtctctggttatgctgcagggcaacaagctggacatcactacggagaagacgattctacacggcgggatgaaaactctcaatgtcgttactacgtcatcacacccggtgtag

SEQ ID NO: 44541 - DNA, 546 bp, Artificial Sequence
  Description of Artificial Sequence: Synthetic coding sequence
atgctgctgccccaggccgtgacccagttcgaggagctggtgggcatggcagaggccctgctgaaaggcggcggcaccatgagcacgtctgcttcaacattgtggagagctaccaataatagctcccccgacagcttcgcctcaacctgtagcaattcaaatagcaacagctcctctcccgtgtctttgaaaccagaggaggagcaccaaacagatgagaaacagttccagatcgaaaagtggcagatcgcccgatgcaataaaagtaaaccccaaaaatttatcaacgatttgatgcaggtcctttacacaaacgaatatatggccacccacagcctgaccggggctaagagtagcacatccagagacaaggccgtgaaacccgctatgaatcagaatgaggtgcaggaaattattggtgtaaccaagcagctgtttcccaatactgatgacgttagcattcggcgcatgatcgggcagaagttgaataactgtacaaagaaacctaacctgagcaagaacttaaattcacaagacattaagtag

SEQ ID NO: 44542 - DNA, 1407 bp, Artificial Sequence
  Description of Artificial Sequence: Synthetic coding sequence
atggagatcaagaagcagatcaccggcatgcggcggctgctgaacgatagcactggcagaatttaccagcgtgttgggaaagaaggagagaaactcaaggaggaaccacaagatctagaccttgtttggccgccccggttgaattcttccgccgaggcccctcagtccctacacccctcctcacgcggggtatggaatgagctccccccccaaagtggccagtttagcgggcagtacggaacgaggagcagaaccttccaatcccagcctcatcccaccacatcgagcaatggtgagttgccagtggtcaattccagtgcgggcagcaactgttgcacctgtaactgccaaagcacactccaagccattttgcaagagcttaagacaatgcggaaactgatgcagatacaggccgtcggaacccaaaatagacaacaaccaccaatatcgttaatctgcagtcagcgcactgctgtgtcccgcaaaaggaataagaagaagaaggtgccacctaagacagtagaaccactgacagtaaaacagaagccttcagggagtgaaatggaaaagaagtctgtggtggctagcgagcttagtgctctgcaggccgcagaacatacatcacccgaggaatcaagagtcctgggatttggcattgtcctggagtccccttccagtgatcctgaagtgcagctcgctgagggctttgacgtatttatgccaaaatcccagctggactcaatacttagtaactacacgcgctccggctctcttctcttccggaaactcgtgtgtgcttttttcgatgataagaccttggccaacagcctgcccaatggcaaacgcaagaggggtctcaacgacaaccggaaaggattggaccagaatatcgtgggcgctattaaagtcttcacagagaagtattgtaccgctaatcacgtggacaagctccctgggcccagagactgggtccagattctccaggatcagatcaagctagctcgcagacgtctcaagaggggttctgccgaaattgctgattctgatgagaggctggatgggatagctctgcctcccacaggggcttgtggcggtccctgtacagtcctgcccggtggatccgccgcagtgacgctggtcctgcaatcttcccctcaaactatgagccaggagaaaggccagatggccgaaccctgggaggaacagcaccttgtgctgctgaacaatttaactagggatcgagctgaaacgggcgcactgtcacagacttcacaggacttcaaacaccattcattccttattactcaagtatccgctacactccatcatcagaggggaatcagaaacttccctactccgggaagcgcgaagtcattgaccctccacatttcctgtctgtcgctgtag

SEQ ID NO: 44543 - DNA, 1125 bp, Artificial Sequence
  Description of Artificial Sequence: Synthetic coding sequence
atggagatcaagaagcagatcaccggcatgcggcggctgctgaacgactctactggccgcatctatcagagggtagggaaagaaggcgagaagctgaaagaggaacctcaggaccttgacttagtgtggccccctaggctcaattcctcagccgaggctccgcagagtttgcacccctcctctaggggagtgtggaatgagctgcctccacagagcgggcagttttctggacaatatggaactcgatctcgaacttttcagtcacaacctcaccctaccacatccagcaacggaatggtggtaaataagcactcagagggaagccacgggggcgaactccctgtggtaaactcctcggcggggtctaactgctgcacatgtaactgtcagagcacactacaagctatactgcaggaactcaagaccatgcggaaactaatgcaaattcaggccgtaggtacccaaaaccggcagcagccacccatttcactgatctgtagccaaaggaccgccgtctcacgcaagcggaacaaaaagaagaaagtgcctccaaaaactgttgagccgttaactgtgaagcagaaaccaagcggatctgaaatggagaagaagagtgtggtggcctccgaactgagtgccttgcaggccgctgagcatacgagtcccgaggaaagcagagttcttggtttcggcattgtcctggagtcaccgtcttcggaccctgaggtccaactcgcagaaggatttgacgtgttcatgccaaaaagtcagctggactccattctgagcaattacaccagatccggctcgctacttttcaggaagcttgtttgtgccttcttcgatgacaagaccctggcaaattcgctcccaaacggtaagaggaaacgcggattgaacgataaccgaaaaggcctcgatcagaatatcgtcggggccattaaggtgttcactgaaaagtactgcactgccaaccatgtggataaactccccgggcccagagattgggtgcaaatccttcaggaccagattaagctcgcccggagacgcctaaagaggggctcagaaatcgcagatagcgacgagcggcttgatggtatcgccctgccccccactgttgtctag

SEQ ID NO: 44544 - DNA, 1281 bp, Artificial Sequence
  Description of Artificial Sequence: Synthetic coding sequence
atggagttcagcgagcggaagcggagccggaagagccagagcttcaagctcgtgtccagggattatcaccatgaagtatacaagattccggaattctcaaacgatgtgaatggtgaagccaaggaaacccagccaatattcctcggcgacgagtctatggagatcaagaagcagattactggtatgcggcggctcctgaacgattctacaggtagaatctaccaacgggtcggcaaggagggcgagaagctgaaggaggaaccacaggatctcgaccttgtatggcccccccggctcaattccagtgctgaggccccacagtccctgcaccccagctcaagaggagtgtggaacgagctgcctccgcagtctggccagttcagtgggcaatatggaacccgctcccgcaccttccaaagtcaaccccacccaacaactagctccaacggcatggtggtcaataagcatagcgaaggaagtcatggcggagagctgcctgttgtgaattcctctgcaggtagtaattgctgcacatgcaactgtcaaagcaccctgcaggccatattgcaggagcttaaaacaatgaggaagctgatgcaaatccaagccgtgggaacgcagaaccgtcagcaacctcctatcagcctgatttgcagtcagcgaacagcagtctcccgaaagagaaacaagaaaaaaaaggtgcctccaaagacagtggaaccgctaaccgtgaagcagaaaccttccggctctgaaatggagaagaagtctgtggtggcgtccgagctgagtgccctgcaagccgccgagcacacctccccagaagaatcgcgggtccttggattcggaatagtgctcgagagcccctccagcgaccccgaggtgcaactggcggagggattcgacgtcttcatgcccaaatcccaattagatagtattctgtctaattatacccggagcgggagcttactgttcaggaagctagtgtgcgcattctttgatgataagacactggcaaattccctccctaatggtaaacggaagcggggattgaacgataaccggaaaggacttgaccagaacatagtcggcgcaatcaaggtcttcactgagaaatactgcacagccaaccacgtagataagctgccagggcctagagactgggtgcagatcttgcaagaccaaatcaaactcgcaaggagacgacttaaacgcggtagtgaaatcgccgacagtgatgaaaggcttgacggcatcgcactaccccccacagtcgtttag

SEQ ID NO: 44545 - DNA, 1560 bp, Artificial Sequence
  Description of Artificial Sequence: Synthetic coding sequence
atggagttcagcgagcggaagcggagccggaagagccagagcttcaaattagttagtcgggactaccatcacgaagtatacaagatacccgaattttcaaatgatgtgaacggagaggcgaaggaaactcagcctatttttctgggcgacgagtccatggagatcaagaagcagattaccgggatgaggagactgctgaacgacagcacaggccgaatttaccagcgggttggaaaggaaggcgagaagttgaaggaggagcctcaggatctcgacctggtttggcctccacggctcaacagcagcgctgaggccccgcagtcgcttcacccctctagcagaggagtttggaacgaattgccaccccaaagtgggcagttctccggtcagtatggaacgcggagtcggacgtttcaaagccaacctcaccccactacctcaagcaatggagaacttcctgtagtaaattctagcgctggcagcaactgctgcacctgcaattgccagtccacattgcaggccatcttgcaggaactcaaaaccatgcgaaagctcatgcaaatccaggccgtgggtacccaaaataggcagcagccgcctataagcctcatctgttcacaaagaacagcagttagcaggaagaggaataaaaaaaagaaagtgccacccaagaccgtggagcctctgaccgtcaagcagaagccatccggaagtgagatggaaaaaaagtctgtggtcgcgagcgagttgtcggccctccaggctgccgagcacacttcacccgaagagagtcgcgtcttgggatttggtatagtcctggaaagtccgtccagtgaccctgaggtgcagttagccgagggattcgatgtgttcatgcccaaaagccagctggactctatcctctctaactacactcggtcaggctcactcctttttagaaagcttgtgtgcgccttctttgatgataaaaccttggccaattccctacccaatgggaaaagaaagagagggctgaacgataacaggaaaggtcttgatcagaacattgtgggcgccatcaaagtctttactgagaagtattgtaccgccaatcacgttgacaagctacccggtccacgagattgggtccagattctccaggaccagataaagctcgcgcgacggcggctgaagcgcggtagcgaaatagctgattctgatgaacgccttgatggcattgcgctaccacccaccggagcctgtgggggtccctgcacggttctgccagggggatctgccgccgtaaccctcgttctgcagtcgagcccacagaccatgagtcaagaaaagggccaaatggcggagccttgggaggagcaacatctagtcctgctgaacaatttgactcgcgacagggcagaaacaggcgcgctctcacagacctcccaggactttaaacaccacagttttctcattacccaggtgagcgcaaccttgcaccatcagagaggaattagaaatttccccaccccgggcagcgctaagtctctcacactgcacatttcgtgtcttagcctgtag

SEQ ID NO: 44546 - DNA, 354 bp, Artificial Sequence
  Description of Artificial Sequence: Synthetic coding sequence
ctggacagcatcctgagcaactacacccggagcggcagcctgctgttccggaagctggtctgtgctttttttgatgataaaacgctggcaaactccctcccgaatgggaagcggaaacgggggctaaacgataatagaaaaggccttgaccaaaatatcgtaggagctatcaaagtgtttactgagaaatactgtactgcgaaccacgtcgacaagctgccaggccctagagactgggtccagatccttcaggatcagattaagctggcacgccgcaggctgaagcgcgggagcgaaatagctgactcagatgagcgtctggatgggatcgccctccctcccacgggtaagtag

SEQ ID NO: 44547 - DNA, 3069 bp, Artificial Sequence
  Description of Artificial Sequence: Synthetic coding sequence
atgcccgacttccagcccggcgacaccaccgtgcggctggacaagcgcatgtctctgaccgccatttatgataagaggagggaaactgactacagcgataaggggtacaacctcgccttcgtttcgcaagatgaacaagaaaacagttcatttacaattctctatgaagagccactccaggaagaagacaagtatgcctcagcggaagctagacagactcagtccgttctattccacgacacaagtgcggattccatgcccgtcctcgcctgcgagaggtcggagtcaagaacagacctggtgcaccatttcgagaaaggcactaaactgggagagacatttgattccgattccagcgagatgttcctgtctgtggaggctaagcgctacaaaatatacccactggccttgagccccatttacgaggacgattcctcacaggaagatattctgagttcagaggtctcccccggccaccacggcccaaggaagagcagggattctgagaatcagtctagttccgtcctgtccctgttacagtcagtgagcgagcggctgaagatgaacttcgatgaagatgaccgtgaggctgctgatgaggaggaggaagaagaggaggccgccgtgctgcacaagggagatctgagggcaggctcaggagagcgggtgacgttccagcttcctgacccaagcattacattttacccggacgatcaggaatccgttggcatctctaagaatagctatgttatgcccaatgagccaactacaagcaaccttcaagtaggactgtggcctgagaagaccagctttctgcaaaagtctgacctgacctccaaacttcactcttctttgaaatccgcctaccatcagtacttgcaaaccagccaatcacatagctccgaaaagggcgctaggtttggcggcatctttcaagaaccagtgtctaaatattttagggttcaggactcaccagggcggttgagtcccttcatagagaacgtggataagcagactttgaggtgtaatccccggccaggaaaaatggtgatatacgatttacacgagtcgacatataagcaggaggtctattgtaacatccccgacgcaacaagctggagctttccaaacggagtgctcatcaaagttgtgaggggctgctggatcttatacgaaaaacctcactttcggggacagaaatgcgtgctggaagagggtgagaaggtgctcaacagagattggattctccaaaaccgccgccacccacagcgaaattttatcctgggatctctgaagcgggtgctgaaggattgtagtattcccgagatcgagctgttccctcaatctgatccagcatgttgccctgtgtacattcagcgtgctgtaccaaatctggaagaattaaacatatctaaaagcgtgtcattcactgtgaaatccggtgtgtggctggcctatcccgatatcaactttaagggacaagccacagtactcgaggaggaccatggattatttgaaatttctactgcagagatgaaatccctgcacccccttcagatgggcggtttaaaggtggagatgcccatgaatttaaaagtgattatctatgaaaaaccccatttccatgggcaggccaaggagttctctgagcacattgatagcgtgcctaattttctgaaaaataatggagacttccatagaatcggaagcattcgcgtgatcggaggtgtgtgggtcgcctacgagaaagaacattttaaaggccagcagttcctcctggaggagggcgacttcgaagacagtaacgcctgcggcgcgctcagcagtcccattctgtctttccggtacctgcaggccaattttatcgaaagctctgtaacgctcttcgagtctgatctggaaagcggaaaatttatagacattaccaatcaagaaatatcagacttagaagaaattggatttggctccaagactaggtcaatccacgtgaagagcggcgtgtgggtggcatatcagcaaaagttcttttgtggcgaacagtacattctggagaagggcaagtacaagtgtttcttcgactggggcggatccaacaatatcattatgagcatccggcccatccagttggagccgctgggcattaatgaacctccccacctgctcaaggccttctcaaagccaggcttccaaggcgaatgtatcgattttaccgaggagacgagcgatttaacctcacttatgccatgttcgtttaaggtgttaaggggatgctggctgctgtactaccaggaggacatgttcgtcaatcattgcgtgttggaggagggcctgtacgcagatctcacatcatgtgggtgtcccgcaagcaaggtaaagagtctcaaaccaatcgattacgtcttcgaggagccatcaatttctctgttcgcactagaacactgcgaaggccgggagctgcatctggaggaggccgtcaattctgtattaaacaaggatctccacttctacactcagagtgtctgggtgaaatccggtttgtggatcgcctatgaaggctctaatttcttagggagacagatccttctccgcccgaatgaaatcccgaattggacagccttctcacgatggaaaaccatcggcagcttgcgacctatgaaacagccagccgtgtacatcaggattaaaaatcgcgcacagggtgaatacctgactgtcaccgggtctctggccgacacccgtgcaacttccgtctgtatcagtccttattcaggtaagaatacccagatatggtattattgcaggggattattcaagagtaaagcttcggacacatgtttagacgtgattggtgggcgcgatacgccgggagcgaaggttgccctgtggaccgagcacggccaattccgtcaaaaatggcggttgaacaagaatggcaccatttcttcctatctgtcggatcagctcgtgctggacgtaaagggcggaaactattgtgataaaactcatgtcatcgtgaaccagcctcttgaaggggaggagacccagaagtgggacattgaaatactctag

SEQ ID NO: 44548 - DNA, 690 bp, Artificial Sequence
  Description of Artificial Sequence: Synthetic coding sequence
atgaacgagaagaagaaggtgttcgaggagcccagcatcagcctgttcgccctcgagcactgtgagggcagagaactacatctggaggaagcggtgaattcagtcctgaacaaagacctccatttctatacacagtctgtctgggtgaagagcggactatggatcgcttatgagggatccaacttcctgggccgtcagatcctgctccgccctaacgagatccctaattggacagccttctctcgctggaagacaatcggaagcctcaggccaatgaagcagcctgctgtttacattcgcatcaagaacagagctcaaggcgagtacctcactgtcaccggtagcttagcagacacaagggccacaagtgtttgtatcagcccctatagtggaaagaatacacaaatttggtattactgccggggcctttttaaaagtaaggccagtgacacctgcctcgatgtcataggcggacgtgacacccccggggccaaggtagctctatggacagagcacgggcagttccgtcaaaagtggagactaaataagaatggcacaatttcttcttacctgtcagatcaacttgtgttggacgtgaagggtggaaactattgcgataaaacacacgtgattgtgaatcagcctttggagggcgaggagacccagaagtgggacatcgagattttgtag

SEQ ID NO: 44549 - DNA, 396 bp, Artificial Sequence
  Description of Artificial Sequence: Synthetic coding sequence
atgaacaagaagaaggtgttcgaggagcccagcatcagcctgttcgctctggagcactgtgagggtcgcgagctgcacttggaggaggcagtgaacagtgtgctcaataaggatctgcacttctacacgcagtcagtctgggtgaagtcaggcctctggatcgcatatgagggttcaaacttcctgggacggcagatactgctgcggccgaacgagatcccaaactggacagccttctccagatggaagaccatcggatctctgaggccaatgaagcagccagccgtctacatccggatcaagaatagagctcagggagagtacctgactgtgactggctctctcgctgatacccgtgcgacatctgtttgcatctccccttattctggaaaatag

SEQ ID NO: 44550 - DNA, 9156 bp, Artificial Sequence
  Description of Artificial Sequence: Synthetic coding sequence
atggccaccaacccccagccccagccccccccccccgccccccccccgccacctcctcagcctcaacctcaacccccgcctccacccccgggtcccggagccggacctggggccggaggcgctggcggcgcgggcgcaggtgcaggcgacccccagctcgttgcaatgattgtgaatcatctaaagtcacagggactgttcgatcagttccgccgagattgcttagctgatgtggacaccaagcccgcataccagaacttgcggcagcgggtggataacttcgtggcaaatcacctggccacacatacttggagcccccatcttaataagaatcagttacgcaacaatattcggcagcaggtcctgaagagtggaatgcttgagtcagggatcgaccgtatcatcagccaggttgtggaccctaaaataaatcataccttccgcccccaggtagagaaagccgtgcacgagttcctggccacactcaaccataaagaagaggggtctgggaacaccgcccccgacgatgaaaagcctgacactagcctgatcactcagggcgtccctactccgggcccatctgccaacgtggcaaatgatgccatgtcgatcctcgaaactatcacttctctaaaccaggaggcaagcgctgcccgagcaagtaccgagacaagcaatgccaagacgtcagaacgcgccagcaagaaactcccgtctcagccaacaactgacacctctactgacaaagagagaacttccgaggacatggcagacaaagagaaaagtaccgcagacagcggaggggaaggactcgagacagctcctaagagcgaggagttctccgacttgccttgcccagtggaggaaattaagaattataccaaggagcataataatctgattctgttgaacaaagacgtgcaacaggaaagcagcgagcagaagaacaagagcacggataaaggcgagaaaaaacccgacagtaatgaaaagggcgagaggaaaaaagaaaaaaaagagaagaccgagaaaaaattcgaccactcaaagaagtcagaggatacccagaaggtaaaggacgaaaagcaggccaaggaaaaggaagtggagtccttgaagctgccatcagagaaaaactctaataaagctaagaccgtggagggcactaaggaggattttagcctcatcgactccgacgtcgacggcctgaccgatattacagtgtcgagcgtccatactagcgacctgtcatcgtttgaagaggatactgaagaggaagtcgtgacttcagacagcatggaagaaggagaaattacttctgacgacgaagagaagaacaagcagaataaaaccaagacacagaccagcgatagcagcgaaggtaagacaaagtctgtgcgccacgcctacgtgcataaaccatacttatattctaaatattacagcgacagtgacgacgagcttacagtcgagcagaggagacaaagtattgccaaggaaaaagaggaacgactgctgcggaggcaaattaatagggaaaagctggaagagaagaggaagcagaaagctgagaagaccaagagttccaaaactaagggccagggaagatccagtgtggacctggaagaaagctccacgaaaagcctagagcctaaagcagcaagaattaaggaggtcctcaaagagaggaaggtgttggagaagaaagttgcactaagcaaaaagagaaaaaaagattcgcgcaatgtcgaggagaattccaagaaaaaacagcaatacgaagaggattctaaagagactctgaaaacttctgagcattgtgaaaaagaaaagatctcctcctccaaagagctcaagcatgtacatgcaaagagcgagccaagtaagccagcccgacgactgagtgagagcctgcacgtggttgatgagaacaaaaatgaatccaagcttgaaagggaacacaaaagacggacaagcacccctgtgatcatggagggtgtacaagaggagacagacactagggacgtcaaacgccaagttgaaagatccgagatatgtaccgaggagccccaaaaacagaagtctacactcaagaatgaaaagcacctgaagaaggacgacagtgagactccacaccttaagagtctgttaaaaaaggaggtgaaatcgagcaaggaaaaacctgagcgggagaagacgccctctgaggataagctgtccgtcaaacataaatataagggagactgtatgcacaagactggggacgaaacagaactgcactccagcgaaaagggtctgaaagtagaagaaaacatccagaaacagtcgcagcagacgaaactttcatccgatgacaagaccgaaaggaagagcaaacaccggaatgagagaaaattatccgtgctcggaaaagacggtaaaccagtttcagagtatatcataaaaactgacgaaaacgtaaggaaggaaaataataaaaaagagagacggctaagcgcagagaagactaaggcagagcacaagtcacggcggagctccgatagtaagatccaaaaggattcccttggctctaagcaacacggcattaccttacaaaggcggtctgaaagctattcagaagacaaatgcgacatggacagcactaacatggattcaaacctgaaacccgaggaggtggtccacaaagagaagagaaggaccaagtcactgctcgaggagaagcttgtcctcaaatctaaaagcaaaacccagggcaaacaagttaaagtggtcgagaccgagctgcaagaaggcgcgaccaagcaggcgacgactccaaagcccgacaaggagaagaacacagaggagaatgacagtgagaaacagagaaaaagcaaagtggaggacaagccattcgaggagaccggtgtcgagccagtcctcgagactgcctcctctagtgcgcatagtactcagaaggacagtagccaccgcgcgaaattgcccttggcaaaagaaaaatacaagagcgacaaagattcaaccagtactaggctcgagcgcaagctgagtgatggacataaaagcagatctttgaagcattcaagtaaagacattaagaagaaggacgagaataaaagtgacgacaaggatggaaaggaggtagattcctcacatgaaaaagctcgagggaactcttccctcatggagaaaaagctctctcgtcggctgtgcgagaatcggcgcggtagcctcagccaggaaatggccaagggagaagagaaactggccgctaatactctgtcaacacccagcggctcttcattacagcggccaaagaaaagtggggatatgacactgatcccagaacaagagcccatggagattgactctgaaccgggcgtggagaatgtgttcgaggtgtctaagacccaggataatcgtaacaataacagtcagcaggacatagatagcgagaatatgaaacagaagacctccgccaccgtgcagaaagatgagctccggacctgtacggccgattccaaagcaaccgcccctgcctataagccgggcagaggcacgggggtgaattctaactcagaaaaacacgctgatcaccgcagcacgctgactaagaagatgcacatacagagcgcagtctcaaaaatgaaccctggagagaaggaacctatacaccgaggtaccacagaggttaatatcgattcagagacagtgcatcgtatgctgctgagcgcaccgagtgagaatgacagagtgcagaagaatctgaaaaacacagccgcggaagagcatgtcgctcagggagacgctacactcgaacatagtacaaatctcgacagttctccttcactttctagcgtgacggtggtccccttaagagagagctatgatcctgatgtcatcccactattcgacaaacgaaccgtgctggaggggagcactgcttcaacgtccccggctgaccactccgctcttcctaaccagagcctcacagtccgggaatctgaggtgctaaagacaagcgatagcaaagaagggggggaaggcttcacggtggacacccccgccaaggccagtatcactagcaaacgccacatacccgaagctcatcaggcgacccttctggatggcaaacagggtaaggtgataatgccactggggagtaagctcaccggtgttatcgttgaaaacgaaaacattaccaaagagggcggtctcgtagatatggctaagaaggagaatgaccttaatgccgaacccaatctgaaacagacaatcaaggcaacagttgagaacggaaaaaaagatgggatcgccgtggaccatgtagtaggcctgaataccgagaaatatgcggagaccgtaaaactcaaacacaagaggagcccaggaaaggtgaaagacatctccatcgacgtcgaaagacggaacgagaacagtgaggtggatacttcagcaggatcaggatcagcccctagtgttctgcatcagcgtaacggccagacagaagacgtagccacaggacccagaagagccgaaaagacttcagtcgctacctctacagagggtaaggataaagatgtgaccttgagtccggtgaaagctggccctgccaccactacttcgagcgagacgaggcagtctgaagttgcactgccttgtacgtccattgaagcagatgaggggctcattatcgggactcatagccggaacaacccccttcacgtgggggcggaagcctctgaatgcacagtttttgccgctgcggaagaaggcggagccgtcgtcacagaaggtttcgctgagagtgaaacatttctgacctctactaaggagggcgaatctggagagtgcgcagtcgccgagtcagaagatcgagcggccgacctactggctgtacacgcggttaagattgaagccaatgtgaatagcgtggtcacagaagagaaagatgacgctgtgacgtcagcgggcagcgaggagaagtgtgatggctccctaagcagggatagtgaaatcgtggagggaacgatcacctttatttccgaggtggaaagtgatggagccgttacaagtgctggcaccgagattagagcgggtagcatatctagcgaggaggtcgatggttcccagggtaatatgatgagaatggggccgaaaaaggaaaccgaggggacggttacatgcaccggagccgagggccggtcagacaatttcgtcatatgctccgtcaccggtgccgggcctcgagaagaacggatggtgactggagctggagttgttcttggcgataatgacgcgcctcccggcaccagcgcctcccaggagggggacggctctgtgaacgatggaacagagggagagagcgccgtgacctctactgggatcacagaggatggggaagggccggcctcctgtactggctctgaggattcctccgaaggcttcgccataagcagcgaaagtgaggaaaatggagaaagtgccatggacagcactgtcgccaaggagggtactaacgtgcccctggtggctgctggcccctgtgatgacgaaggtatcgtgacaagcactggggcaaaagaagaggatgaagagggcgaggacgttgttaccagcactggccgtggcaatgaaattgggcacgcatcgacttgtacaggcctcggagaggaatcagagggggtattaatttgcgaaagcgctgaaggggattctcaaatcggcacagtcgtggagcatgttgaagccgaggccggtgccgctattatgaatgcaaatgagaataacgtggattctatgtccggcacagaaaaaggatcaaaggatacggatatttgctcaagtgctaaggggatcgtcgagtcatctgtgactagcgcagtgtcgggtaaagacgaggtcacacccgtaccaggcggatgcgagggacctatgacatccgcggcttccgaccagtcggattcccagctcgagaaagtggaagacacgactattagcaccgggctcgtgggcggctcttacgatgttttggtctccggtgaagtgccagagtgcgaagtggctcatacatccccgagcgagaaagaggatgaggacattatcaccagtgtggagaacgaggagtgcgacggcctgatggcgaccaccgcctcaggcgacatcactaaccagaattctctagccggggggaaaaatcaaggcaaagtcctgatcatctcaacttctactacaaacgactacaccccccaagtgagtgccattacagatgttgaggggggcctttccgacgccctgcgcactgaggagaacatggagggcacaagagtcaccacagaggaatttgaggccccaatgcctagcgccgtgtcgggggacgacagccagttgacggcctctcggagcgaggaaaaagatgagtgtgcaatgatcagcacctctattggtgaggaattcgagcttccaatctcttctgctaccactataaagtgcgccgagagcctgcaacctgtcgcggctgccgtggaagaaagggctactggtcccgtgctgattagcaccgcagacttcgaaggtcctatgccaagcgcacccccagaagctgaaagcccactggcttcgacctccaaggaagaaaaagatgagtgcgcgttaatctctacatccattgccgaagaatgcgaagccagcgtgagcggtgtggtggtcgaatccgagaatgagcgggcgggaacagtgatggaagagaaagatggctcaggaataatctcaacctcaagcgtcgaagattgtgagggacctgtgagcagtgctgtcccacaggaggaaggagacccatctgtgacacctgctgaagagatgggtgacaccgctatgatctccacatcgacctctgaggggtgcgaagcagtcatgatcggagccgttctccaggatgaggatcgcttaaccatcaccagagtggaagatctgagcgacgctgcaataatctctacgagcacagccgaatgtatgccgatatcagcttctatcgatcgtcatgaagagaatcagctgactgccgacaacccagaaggaaatggagacctgagtgcaacagaagtgtccaaacataaagtcccaatgccttctcttattgcagagaataattgccgctgtcctgggcccgtgcgaggcgggaaggagcccggcccggttctcgccgtcagcaccgaagaaggccacaatgggccgagcgttcacaaacccagtgcgggacaaggtcatccaagcgcggtttgtgccgagaaggaggaaaagcacggcaaggagtgcccggaaatcggaccatttgccggccgaggccagaaagagtccacgctccatctgatcaacgccgaagagaagaatgtgttgcttaactccctgcaaaaggaggataaatctccggagacagggacagccggcggctcctctacagcctcctactccgccggcaggggacttgagggcaatgcaaacagcccagcccacctgcgcggcccagagcagacgagtggccagacggcgaaggaccctagtgtctccatcaggtatttggccgcggtaaacaccggcgctataaaggcagacgacatgccccccgttcaggggactgtggccgaacactcattccttccagcggaacaacagggcagcgaggacaatctgaagacttccacaaccaagtgcattacaggacaggagtctaaaatagcacccagccatacaatgattccgcctgctacctattcagttgccctgctggccccaaagtgcgagcaggacttaacaatcaagaatgactattcagggaaatggacagatcaagcttccgctgaaaaaacgggggacgataacagcacacggaaatccttcccagaagagggtgatattatggtgaccgtgtctagcgaggagaacgtctgcgacattggcaatgaggagtcccccctgaatgttctaggggggctgaagctcaaggctaacctcaaaatggaggcctacgttcccagcgaggaggagaagaacggcgaaatcctggcaccacctgaaagtctttgcggcggaaaaccatcagggatcgctgagctccaacgggagccgctgctggtgaatgaatctctgaatgtagaaaattccggcttcagaacaaacgaagaaattcattccgaatcttacaacaaaggtgaaatttcctccggaaggaaggacaacgcagaagcaatctccggccacagtgtggaagccgatcccaaagaggtggaggaagaggaaaggcatatgcccaagcgcaaaaggaagcaacactacctctcgtccgaagatgagccagacgacaaccctgacgtcctggattcgaggatcgagactgctcagaggcagtgtcctgaaacagagccacacgatacaaaggaagaaaattcacgcgacctggaagagttgcctaaaacttctagtgagactaatagcaccacaagtcgggtcatggaagagaaggacgagtactcatcgtccgagaccactggagagaagcctgaacagaatgatgatgatactattaaaagtcaggaagaggaccaacctataattattaaacggaagagaggtagacctagaaagtaccccgtggagaccacactcaagatgaaggacgatagtaaaaccgatacgggtatcgtgaccgtggagcagagtccttcttcttctaagctgaaagtgatgcagaccgatgaaagcaacaaggagactgcaaatctgcaggaaagaagcattagtaacgacgatggcgaagaaaaaattgttacctccgtgcggcgccgggggagaaagccaaaacgaagcctgacggtgtctgacgatgccgagtcctcagagccagagcgcaagcgacagaagagtgtctccgatcctgtggaagacaaaaaagaacaagagagtgacgaagaggaggaagaggaggaggaagatgagccaagcggggctaccacacgctccaccacgagaagcgaagcgcaacggagtaaaacccaactgtcaccttccattaagcgcaagagggaggtgtcccctcccggggcccgtacccgagggcagcagcgcgtagaagaagccccagtgaaaaaagctaagcggtag

SEQ ID NO: 44551 - DNA, 519 bp, Artificial Sequence
  Description of Artificial Sequence: Synthetic coding sequence
atggccgacggcggcggcggcggcagcggcggcgccggccccgcctctactcgagcttctggtggcgggggaccgatcaatccagcatctcttccacctggagatccacaattgatcgcaataatagtgggccagctgaagtctcggggactatttgactctttcaggcgggactgcaaggctgatgtcgatacaaaaccagcatatcagaatttgtcacagaaagccgataactttgtatccacacatctcgacaagcaggagtggaatccaccagcaaatgacaaccagctacatgatggtctgcggcagagcgtagttcagtccgggaggtccgaggcaggagtggacagaatatcttcacaggtcgtggatcctaagctgaaccacatcttcagaccgcagattgaacagatcatacacgaatttctcgttgcccagaaagaggcggctgttccagctttaccccccgaaccagaagggcaggatccccccgcgcctagccaggataccagttag

SEQ ID NO: 44552 - DNA, 414 bp, Artificial Sequence
  Description of Artificial Sequence: Synthetic coding sequence
atgctgagcggccggctggtgctgggcctggtgagcatggccggcagagtgtgcctgtgccagggcagcgctggaagcggtgccatcggaccagtggaggctgccatcagaaccaaattagaggaggcgctgagtcccgaggtcctcgagctcaggaacgaatctggaggccatgccgttccaccaggctcagaaacccacttccgcgtcgccgtggtctcatcgcggttcgagggactgtcccctctgcagcgccatcggttagtgcacgccgccctcgcagaggagctcggcgggccggtgcacgcactggctattcaggcccggacgcctgcccagtggcgcgagaattcgcagctcgatactagtccgccctgtctgggcgggaacaaaaaaacccttggcaccccctag

SEQ ID NO: 44553 - DNA, 459 bp, Artificial Sequence
  Description of Artificial Sequence: Synthetic coding sequence
atggccagcgccaagagcctggaccggtggaaggcccggctgctggaagggggctcaaccgcccttacctacgccctagtgagggcagaagtgtcctttcctgcggaagtggcacctgtgcggcaacagggttcagttgcaggtgcccgcgctggggttgttagcctcctcggctgtaggtcatcctggactgcggcaatggaactatcagccgaatatttacgggaaaaacttcagcgggacttagaagccgagcatgtcgaagtggaggacacaaccctgaaccggtgctcatgctccttccgcgtgctggttgtctccgcaaaattcgaaggaaaaccactgttgcaaagacacaggctcgttaatgcatgtcttgcagaggagctgccccacatccacgctttcgagcagaaaaccctgactcctgaccagtgggcccgtgagaggcaaaaatag

SEQ ID NO: 44554 - DNA, 1593 bp, Artificial Sequence
  Description of Artificial Sequence: Synthetic coding sequence
atgaccagcagcctgcagcggccctggcgggtgccctggctgccctggactatcctgctggtgtccaccgcggccgcatcgcagaaccaggagcgtctgtgcgcctttaaagacccttatcagcaggaccttgggattggcgagtcacgcattagccatgaaaatggcacgatcctgtgctccaaaggttctacttgttacggcttgtgggaaaaatctaagggtgatataaatctggtgaagcagggctgttggagccacataggtgacccccaagagtgtcactacgaagaatgcgtcgtcacaacaactcctccttctatacagaacggaacttaccgcttctgttgttgttccacggacttgtgtaatgtgaacttcactgagaactttcctcctccggataccacacctctaagtccccctcactctttcaatagggacgagaccatcatcatcgctttggcgagcgtgagcgtgcttgctgtactgattgtggcactgtgtttcgggtataggatgctgacaggagaccgaaaacaagggctgcatagcatgaatatgatggaggcggccgcaagcgagccaagcctggacctcgataaccttaaactgctcgagttaatcggccgcggacgctacggggccgtttataaggggtcccttgatgagaggccggtcgccgtgaaggtgtttagtttcgctaatcgccagaattttatcaacgagaagaatatttaccgggtgccacttatggagcacgacaatatcgctcggttcatcgtgggggacgaaagggtcaccgcagatggcaggatggaatacctcttagtgatggaatattatccaaatggaagtctttgtaagtacctgtctttgcacacatccgactgggtgtcctcttgtaggctggcacattctgtcaccagaggtttggcatacttacatactgaactgcctcgcggggatcattataagccagccatcagccaccgcgatttgaattccagaaacgtgctggtgaaaaacgacggtacttgtgttatctctgacttcgggttatcaatgagactgacagggaacaggttggtgcgtcctggcgaagaagacaacgctgccattagtgaagtgggcaccatcagatatatggcccccgaggtgttagaaggcgccgttaacctaagggactgcgaatcggcactcaagcaggtcgacatgtatgctttgggacttatttattgggagatctttatgcggtgcaccgatctattcccgggggagtccgttccagagtatcagatggccttccagacggaggtgggaaatcatccaacttttgaagatatgcaagtgctggtgagcagggaaaaacagaggcccaagttccccgaagcatggaaagaaaatagcctcgcggtgcgatccctgaaagagaccattgaggactgttgggatcaagacgctgaggcccgccttacagcccagtgcgccgaggagcggatggctgagcttatgatgatatgggaacggaacaagtctgtttcacccactgtgaaccccatgtcaacagctatgcagaacgagagaaggtag

SEQ ID NO: 44555 - DNA, 1470 bp, Artificial Sequence
  Description of Artificial Sequence: Synthetic coding sequence
atgaacaagctgagccccgtgctgctgttcctgaaccagcagaactaccaaatcgacaaggacgtagaggataaacggcaaaaagctatagaagagtttttcactaaagacgttatcgtaccatccccatggaccgaccatgagggcaagcagttgtcgcagtgtcactcttcaaagtgcacaaatatcaatagcgactctccagtcggcaaaaaactgaccattcacagcgagaaatcggacgctgcatgccagaccctgctttcgctccctgtagacttcaatttggaaaacatcctcggagattatttcagggcagacgagttcgcagatcagtcccctggcaacctcagtagctcttctctccgacggaaattgttcctagacggaaatggatctatcagcgattccctcccgagcgctagtccgggaagccctcactccggagtgcaaacctccctggagatgttctactcaatagacctctctcctgtgaaatgtcggtcccctctgcagaccccctcttccggacagttcagctcctcacctatacaggctagcgccaagaaatatagtttgggcagtatcacaagtcccagtcctatatcttccccgactttcagccccattgagttccagattggggaaacccccttgtccgaacagcgaaagtttacggtccactctccggatgcttcatccggtacaaatagtaacggaataacaaatccctgcattagatccccttacatcgacggctgctcacctatcaagaactggtcccccatgcgactgcagatgtattccggaggcactcaataccggacaagcgtgatccagatcccctttaccctggagactcagggggaggacgaggaagacaaagagaatatcccgagcactgacgtgagttcacctgctatggatgcagccgggattcacctgcgtcaatttagcaatgaagcgtcaacccatggtacccatctagtagtgacagccatgtcagtcacacaaaaccagtcttcggcatctgagaaagaactcgcccttctgcaagacgttgagcgggagaaagacaataacactgttgacatggtcgatcccatagagatcgccgatgaaaccacctggatcaaagagccggtcgataatggatcactccccatgaccgacttcgtctccgggattgcctttagtatagagaactcacatatgtgcatgtctcctttggcagaatcaagtgtgatcccctgcgaatcatctaatatccagatggatagcgggtacaatactcagaattgtggatccaacattatggacactgtcggggccgaatcttactgtaaggagagtgatgcgcagacctgcgaggtggaaagtaagtctcaggcatttaacatgaaacaggaccacaccacccagaggtgctggatgaaaacggccagcccctttcaatgcagttctccttag

SEQ ID NO: 44556 - DNA, 1680 bp, Artificial Sequence
  Description of Artificial Sequence: Synthetic coding sequence
atgggcgacgtgaaggagagcaagatgcagatcacccccgagacccctggccgcatccctgtgctgaacccgtttgaatcaccttcggattactctaatttacatgagcaaacactggcaagcccctccgtctttaagagcacgaagctaccaaccccagggaaattccggtggtcaattgaccagctggccgtgatcaaccctgtagaaattgaccccgaagatatccacagacaggcattatatttatcacattctaggatcgacaaggacgtggaagacaagcggcaaaaggccattgaagaattctttaccaaggatgtgatcgtgccttctccttggacagatcatgaggggaaacagttgagtcagtgccactcttccaaatgtactaatatcaacagcgatagtccagtgggaaagaagttgactatacactcggaaaagtccgacgccgcttgccagacattactcagtctgccagtggatttcaatcttgagaatattctaggggactactttagggccgatgagttcgcggaccagtcaccgggtaatctgagtagtagctctttaagacgtaagttgtttctcgatgggaacggcagcatctcagacagccttccaagcgccagtcccggctcaccacactctggcgtccaaacctcacttgaaatgttctacagcattgacctctctcccgttaaatgtagaagtcccttacagaccccttcctctggccagttctctagctcgccaatccaagcgtccgccaagaagtacagcctcggctccatcacgtcaccttctcccatcagctccccgacatttagcccgatcgagtttcaaatcggagagactccactgtctgagcagagaaaattcaccgtccactcaccggacgccagtagcggcacaaactccaatgggataactaatccttgtatcaggtccccatacattgacggctgctcccccataaagaactggtccccaatgcgccttcagatgtatagcggaggaacccagtaccggacaagtgtcatacagattcctttcaccctagagacccagggtgaggacgaggaggacaaagagaatattccttctacggatgtctcttcaccagccatggacgccgcgggaattcacctgagacagttcagcaatgaggcaagcacccatggcacccatcttgtcgtaacagcaatgagtgtgacccaaaaccagagcagcgcctccgagaaggaactggcgctcctgcaggacgtcgaaagagagaaggataacaatacagttgacatggtcgatcccattgagattgcagacgagacgacctggattaaagaaccagttgataacgggtcactacccatgacagatttcgtgagcggtatcgccttttcaattgaaaattcacatatgtgcatgtcgccattagccgagagctccgtgattccctgtgagtctagcaatatccaaatggacagtggctataatactcagaactgcgggagtaacattatggacacagtaggcgccgagagctattgtaaggaatccgatgcacagacttgcgaggtggagagtaaatctcaggccttcaatatgaagcaggaccatacaactcagcggtgctggatgaagacggccagtccgttccagtgttctagtccatag

SEQ ID NO: 44557 - DNA, 2007 bp, Artificial Sequence
  Description of Artificial Sequence: Synthetic coding sequence
atgaccagcaccggcaaggacggcggcgcccagcacgcccagtacgtggggccatatcgcctcgaaaaaaccctgggcaaagggcagactggtctcgtcaagcttggcgtgcactgtgtgacctgccagaaggtggcaatcaagatcgttaacagggagaagctgtcagaatccgtgcttatgaaggtcgagcgtgagatagccattcttaagctcattgaacatcctcatgtactaaaacttcacgacgtgtacgagaacaaaaaatatctgtatctggtgctcgagcacgtgtcaggcggcgagctttttgactatctcgttaagaaagggcggcttactcctaaagaagcacgtaaattttttaggcagatcatctctgccctggacttttgccacagccatagcatctgtcaccgcgacctgaagcccgaaaaccttttgttggatgagaagaataatataaggatagcagatttcggcatggcgagtctgcaggtgggagattctctgctggagacatcgtgtggatccccccactatgcctgtcccgaagtgatcagaggcgaaaagtacgacggcaggaaagccgacgtatggagttgtggcgtaatcctcttcgccctgctggtcggcgcccttccgttcgacgatgacaatttgcgccagctgctggaaaaagtgaaaagaggagtttttcatatgccccatttcatacctccagactgtcaatcacttctgagaggtatgatcgaggtggacgccgctaggagacttacccttgaacatatccagaagcacatctggtacattggaggcaagaatgagccggagcctgagcagcctattcccagaaaagtgcagatccgctcgctgcccagccttgaagacatagatccagacgtgctcgattctatgcactcattaggatgtttccgcgatcgaaataaactactgcaagatctgttgagtgaggaggaaaaccaggaaaagatgatttacttccttctgctggatcgcaaggagcggtatcccagccaggaggatgaagatctgccaccccggaacgagatagatcctcccaggaagagggtggattctccaatgctgaacaggcacgggaaacggagaccggaacgcaaaagcatggaagtactgtctgtgaccgatggcggatcaccagtgcctgctaggcgagccatcgagatggcccagcatggccagcggtctaggtctatttccggggcttcatctggcctctctacgtccccactctcttctcctcgtgtgactccccatccttctccaaggggctccccgctgcctactccaaaaggtacacccgtccatacccctaaggagagccccgctggaactccaaatcccacacccccgagtagcccttcggtcggtggagtgccttggcgggcccgccttaactccattaaaaacagcttcttgggaagcccccggtttcacagacgtaagctgcaggtacccacccccgaggagatgtccaatctgaccccagaatcttctcccgagctagctaagaagagttggttcggcaactttatctctctggagaaggaggaacagatcttcgtggtgatcaaagataagcctcttagcagtattaaggctgacattgtgcacgcctttctgtctataccttccttaagtcattcagtgatttctcagacctcattccgtgcggagtacaaagccactggcggtcccgccgtctttcaaaaaccggtgaagttccaggttgacattacctatacagaagggggcgaggctcaaaaagaaaacggcatctattctgttaccttcacactgttgtcagggccgagccgccgctttaaaagagtggtcgaaaccatccaggcccagctgttatctacccacgacccccccgccgcccagcacctaagtgatactactaattgcatggagatgatgactggccgcctgtctaagtgtggcatcatcccaaagtcctag

SEQ ID NO: 44558 - DNA, 2091 bp, Artificial Sequence
  Description of Artificial Sequence: Synthetic coding sequence
atgaccagcaccggcaaggacggcggcgcccagcacgcccagtacgtcggcccataccggctagaaaagacgctgggtaagggccagactggactggtaaagctcggtgtgcattgtgtgacctgccagaaggtcgctattaaaatcgtcaacagggagaagctgtctgagagtgtgttaatgaaggtggagcgtgaaatcgctattctgaagctcattgaacacccccatgtgctaaagttgcatgacgtctacgagaacaaaaaatacctgtatctggtgttagaacatgtgagcggtggggaactgttcgactacttagtcaagaaaggacgtttgacacccaaggaagcccgaaaattttttcgccagattatttctgcacttgacttctgtcattcacacagtatctgtcatcgtgatctgaaaccagaaaatctgttactcgacgaaaaaaataacatacgtatagccgatttcgggatggctagcctgcaggttggagacagcctcctagagaccagctgcggctcaccgcactacgcatgcccagaggttatcaggggggagaagtatgacggacgcaaagctgacgtgtggagttgtggggtgatcctgtttgcccttctggtcggggccctcccttttgacgacgataatttgcgacagttgctggagaaagtgaagcggggcgtcttccacatgcctcattttattccacccgactgtcagtcgttgctgaggggcatgattgaagtggacgcagctcgaagactcaccctcgaacacatccagaagcacatatggtatatcggaggcaagaacgaacccgaacctgaacaaccaatcccaagaaaggtgcaaatccggagcctccccagtctagaagatatcgacccggatgtcttagattctatgcattcactgggctgcttccgcgaccgcaacaaacttctacaggatctgctgtccgaggaagagaaccaggaaaagatgatttattttttgctgctcgacaggaaagagcgatatccttctcaggaggacgaggaccttccccctcggaacgaaatcgacccccctaggaaacgggtcgattctcctatgctcaataggcacggaaagaggaggccagaaagaaagagcatggaggtgttgagtgtaactgatggcggatctccagtgcctgcccgtcgggcaattgagatggcccagcacggacaatcaaaggctatgttctctaaatccctcgacatcgcggaagctcaccctcaattcagtaaggaagatcggtctcggtcaatctccggtgcatcatccgggctgagcacttctcccctctcttctccaagggtgacaccacatccttcccctcgtggatcccccctgccaacacccaaaggaaccccagttcacacacctaaggaatcaccagctggaaccccgaaccctacacctccaagcagcccctcggtggggggtgtgccttggcgggctaggctcaatagcatcaagaacagctttctgggatctccaaggttccacagacggaagttacaggtgcctactcccgaagaaatgagcaatcttacaccggagtcttctcctgagctggccaagaagtcctggtttggaaactttatcagccttgagaaggaggaacagattttcgtagtgattaaagacaagcctctcagctcaattaaggccgatattgtgcatgcatttttgtctataccgtcactgtcacactccgtaatcagccaaacctcattccgggccgagtacaaagccacaggaggcccggcagtctttcagaagccagtgaaatttcaagttgacatcacttacacagagggcggggaggcgcagaaagagaacgggatctactccgttacttttaccctcttaagtggtcctagccggagattcaaacgggtggttgaaacgattcaggctcagttgctttctacacacgatccaccggcagcacagcatcttagcgaaccgcctccccccgcccccgggttaagttggggggcagggctgaagggtcagaaagtggccacctcatacgagagttctttgtag

SEQ ID NO: 44559 - DNA, 2301 bp, Artificial Sequence
  Description of Artificial Sequence: Synthetic coding sequence
atgagccccgagggccaccccagccggtgggcccggccccggcggccctgcatctgcccgagcagcctgtgtagcccccgggaacctcggtcaggccctgcagtgggtcgtggtggagccgcacatcatcgcgtcccagccggtcatactcctggcccccagctactgcaaccacatctacacctgccgcagggccaaacatggctgtgcctccagccgtcgccagccggcctggtcaagctgggcgtccattgcgtcacctgccagaaggtcgcaattaaaatcgtgaacagagagaagttgtcggagtctgtgctcatgaaagtggagcgagagatagctatcctgaagttgattgagcacccacatgtactaaagctgcatgacgtctacgagaacaaaaaatacctatacctggtcctcgagcacgtgtctggcggcgagctgttcgactatctagtgaagaaggggcgacttacccccaaggaggccagaaaattctttcgtcagatcatcagtgctctcgatttttgccactctcattccatttgtcatcgcgaccttaagcctgagaatttgcttctggacgaaaagaataacatcaggatcgcggatttcggcatggcctcacttcaggtgggcgacagtctgctcgaaacttcttgtgggagtccgcattatgcgtgccctgaggtgattaggggcgagaaatacgatggtagaaaggccgatgtgtggagctgcggagtgattctcttcgcgctgcttgtgggtgctcttccttttgacgatgataacctcaggcagctgctagaaaaagtgaaacgaggtgtgtttcatatgcctcatttcatcccacccgattgtcaatctcttcttcgcggtatgattgaggtggacgcagctcgacgcctcaccttagaacacattcagaaacacatttggtacatcgggggtaagaacgagccggagcccgagcagccaattccaagaaaagtccagatcaggagccttccctccttggaagacatcgatccagatgtcctggacagcatgcacagcttgggatgtttcagggacaggaataagctgcttcaggacttgctctccgaagaggagaaccaagagaaaatgatatacttcctcctgctggacagaaaggaacgctatccctctcaggaggacgaggatctgcctcctagaaacgagattgacccgccgaggaaaagagttgactccccaatgctcaacaggcatggaaagaggagacctgaaaggaagtccatggaagtgctgtccgttacagatggaggtagtcccgtgcctgctagaagggccatcgagatggcccaacatgggcagaggtctcggtccatcagcggggcgagctccggcctgtctacctccccactgagtagccctagggtcacccctcatccatccccccgcggcagccccctgccaacacctaaaggaacgcccgtgcacacacccaaggaatcccctgctgggactcctaaccctactcccccctcctctccctccgttggtggagtgccttggcgcgctcggctcaacagtatcaaaaactcttttctcggatcaccccggttccatcggcggaaactacaggtaccaacacctgaggagatgagcaatctcacgccagaatcctctcccgagttagctaagaaaagttggttcggaaattttatttcgctggagaaggaggagcaaatttttgtggtgataaaagacaagccgctgtcctctataaaggcagacatagtgcacgccttcctgagcattccgagccttagccattcagtgatctcccaaacctcgttcagggccgagtataaagctactggcggccctgccgtatttcagaagcccgtgaagttccaggtcgatatcacttataccgaggggggggaggcacaaaaggaaaatggaatttattccgtcaccttcactcttctgtcaggaccttccagaagatttaagcgcgtcgtggaaacaattcaggcgcagcttctcagtacgcacgacccgccggctgctcagcatctatcagataccacaaactgtatggagatgatgaccgggcggctctctaaatgtgatgaaaaaaatggccaggccgcacaggctcccagcactccagctaaaaggtccgctcatggcccactcggggatagcgcagccgcaggcccaggacctggtggagatgccgaatacccgacggggaaagatacagccaaaatgggcccccccacagctagaagagagcagccctag

SEQ ID NO: 44560 - DNA, 2091 bp, Artificial Sequence
  Description of Artificial Sequence: Synthetic coding sequence
atgaccagcaccggcaaggacggcggcgcccagcacgcccagtacgtgggcccctacagattggagaaaacgctcggtaaagggcaaaccggcctggtgaaactaggggttcattgcgtgacctgccagaaagtcgccatcaaaatagtgaatcgcgagaagctgtctgagagcgtgttgatgaaagtagaacgcgagatagcgatcctgaaattaatcgagcatccccatgtgcttaaactgcatgacgtatatgaaaataaaaagtatttatatctggtgctggaacacgttagcgggggcgagcttttcgactatttggtaaaaaaaggaaggctgacacccaaagaagctagaaagttcttccgccagatcatatctgccttggatttctgtcattcacattcgatttgtcacagagatctgaagcctgaaaatctgttactggatgagaagaataacatcaggatcgccgattttggcatggctagcctgcaagtgggagattccttgttagaaacttcgtgtggatcaccccattacgcctgcccagaagttatcaggggagagaagtatgacggaaggaaggcagatgtgtggtcttgcggcgttattctattcgctctcctggtaggggctctgcccttcgatgacgacaacttaagacaactcctcgaaaaggtcaaaaggggtgtgtttcatatgccccacttcatcccaccagactgccagtcactgctgcgaggcatgattgaagttgatgccgctcggcgattaacgctggagcatatccagaagcacatttggtacatagggggtaaaaacgagcctgagccagagcaacctattcccagaaaggtccaaatccggtcactacctagccttgaggacatagaccccgacgtgctggactctatgcatagcctggggtgcttccgggacaggaataagcttctacaggacctgctgtctgaagaagagaatcaagaaaaaatgatatacttcctccttttagaccggaaggaacgatacccatctcaggaggatgaagacctgccacctaggaacgagatagatccaccccgcaagagagtcgacagtcccatgttaaaccgacatggaaaaaggcgccctgaaagaaagagcatggaagttttatccgtcacagatggcggttctcctgtcccagcccggcgtgcaattgaaatggcacaacatggacagtccaaagctatgttcagtaaaagccttgacatcgcagaggcccacccccagttctccaaagaagaccggtcccgcagtatctccggcgcctcctccggattgtcgacaagccccttatccagtccacgagtgacgccccacccttcgccaaggggcagcccactacccacgccaaaaggtaccccagtgcatacacctaaggagagccccgccggcactccgaaccctaccccaccatcatccccatcggtgggcggggtgccttggcgcgccagattaaatagcataaagaatagtttccttgggtcaccccgcttccaccggcgcaagctccaggtacccactcccgaggagatgtctaaccttactcctgaatcgtctcccgagctagccaaaaagagctggtttggtaattttatctctctcgagaaggaagaacaaatcttcgtcgtcattaaggataaacccctgtctagcataaaagccgacattgtgcacgcattccttagcattccctctctcagccactccgtaatctcacagaccagtttcagagctgagtacaaagcaaccggaggccctgccgtctttcagaagccagtcaaattccaggtggatatcacttacacggagggcggggaagcacaaaaggagaatggtatatattcggttacctttactcttctctcagggcctagtaggaggttcaagcgtgtggtggaaacaattcaggcacagttactgtccacgcacgaccccccagccgcacaacatctttccgagccacctccgcctgcacccgggttgagctggggcgcagggttgaaagggcagaaggtggcaacctcttatgagtcaagtctgtag

SEQ ID NO: 44561 - DNA, 2211 bp, Artificial Sequence
  Description of Artificial Sequence: Synthetic coding sequence
atgaccagcaccggcaaggacggcggcgcccagcacgcccagtacgtgggtccctacaggcttgagaaaacccttgggaagggacagaccggactggtcaagctgggcgtccactgcgtgacttgccaaaaggtggccattaaaatagtgaaccgggaaaaacttagcgagtcggtacttatgaaagtcgagcgggagatagccattctcaagctgattgagcacccacacgttttgaagctccacgacgtctatgagaataaaaagtacctgtaccttgtgctggagcacgtctccggtggggagcttttcgactatctcgtgaagaagggccggctaacacctaaggaggccaggaagttctttaggcagattatctcggccttggatttctgccactcccatagcatctgccatcgcgacttgaagcctgagaacttgctgcttgacgaaaaaaataacatccgaatagccgattttgggatggcctcactgcaggtgggcgacagtctgttggaaacatcctgcgggtctccgcattacgcttgtccagaagtgataagaggagagaagtacgacgggcgaaaagcagatgtgtggagttgcggagtaattctgttcgcacttctggttggcgctcttccttttgatgatgacaatctgcgccagctgctcgagaaggtcaaacggggagtatttcacatgccgcacttcatcccccccgactgccagagcctgctacgaggcatgatcgaggtagatgccgcccgacggctgacacttgagcacattcagaagcatatttggtatataggaggaaagaacgagcctgagccagaacagcctatcccccggaaagtccagattagatctctccccagccttgaagacatcgaccccgacgtgctggactcaatgcactctctgggatgctttcgtgatcgaaataaattgctgcaagacctactgagtgaagaggagaaccaagagaaaatgatatattttctgcttttggaccgaaaagaacgctatcctagccaggaagacgaggatcttccgccgagaaacgaaattgacccaccacgtaagcgagttgattctccgatgctgaatcgccatggaaagcgtcgcccagagcggaagtccatggaagttctttctgtgacggatggaggatcacctgtccccgcgaggagagctatcgaaatggcgcagcatggacagcgctctcgtagcatttctggagccagcagcgggctgtccacgagcccactgagcagtccccgggtaaccccccacccgagcccccgcggtagccctctgccgactcctaagggaacccctgtgcacacgccgaaagagtctccagccggtacccccaaccccaccccgcccagctcacctagtgtagggggggtcccgtggcgggcccggttaaactcgattaagaacagtttcttgggatctccccgattccacagaagaaaactgcaggttcctacccccgaagaaatgagtaatcttaccccagagagttctccagagctcgccaagaaatcttggttcggcaatttcatttctcttgagaaggaagaacagattttcgtggtgataaaggacaagccactctccagtataaaggccgacattgtgcacgcttttctctccatccctagcctctcccatagcgtaatttcccagacttccttcagagccgagtacaaggctaccggtggcccagccgtattccagaaaccagtgaagtttcaagtggatattacctacacggaaggaggcgaggcgcagaaagagaacggcatctacagtgtgacattcacccttctgtctgggccctctcggcgtttcaaacgagtggttgaaaccatccaggctcagctcctttctactcacgatccacctgctgcgcagcatctaagtgataccacaaactgtatggagatgatgactggccgactgtccaaatgcggatcacccctttccaacttcttcgacgtgatcaaacagctgttttccgatgagaaaaacggccaggctgctcaggccccaagtacacctgcgaagagatctgcgcacgggcccctgggagacagcgccgcggctggacctggacctgggggtgatgccgagtatcctaccgggaaggatactgctaagatggggccacccacagctagaagagagcagccatag

SEQ ID NO: 44562 - DNA, 2025 bp, Artificial Sequence
  Description of Artificial Sequence: Synthetic coding sequence
atgaccagcaccggcaaggacggcggcgcccagcacgcccagtacgtgggcccttaccgactcgagaagactctgggcaaagggcagaccggtctggtgaaattgggggtgcattgtgtcacctgtcagaaggtggcaatcaagatagtaaatcgcgagaaactctctgagagcgtcctcatgaaggttgagcgggagatcgcaatactgaagctcattgaacacccgcatgtgcttaaattgcacgacgtctatgaaaacaagaagtacctctacctggtgcttgagcatgtgagtggcggagaactgtttgactatctggtcaaaaagggacggctgactccaaaggaggctaggaagtttttcaggcaaattatcagcgccctcgacttttgtcactctcacagtatttgtcaccgggatttaaagccagaaaacttactgctggacgaaaagaataatattagaatagccgattttggcatggcctcactccaggtgggagactctctgttagaaactagctgcgggagtccgcactacgcctgccccgaggtgattagaggcgagaagtatgatggccgcaaggccgacgtatggagctgcggcgtaatattgttcgcgcttttggtgggggcattacccttcgatgatgacaatctccgacagctgctggaaaaagtgaagagaggagtgtttcatatgccacattttatccctcccgattgtcaaagccttctccgcggcatgatcgaagtggacgccgctcgccggcttactctggagcacatccagaagcacatttggtatatcggcgggaagaatgagcctgagcccgaacagccaattccgagaaaggtgcagatccggtcactcccaagtctcgaggatatcgatccggacgtgttagactcgatgcattcattgggttgcttccgcgacagaaataaactgttacaagacctgctaagtgaggaggaaaaccaagaaaaaatgatttatttcctacttctagatcgtaaagaacgatatcctagtcaggaagacgaggacctccctcctcgaaatgaaatagacccaccaaggaagcgggtggactctcctatgctcaatcgccatggcaagcgaaggcctgagcgtaaatctatggaagtcttatcggtgaccgacggaggaagccctgtcccagcgagacgggccattgaaatggcccaacacgggcagcgtagtagaagtattagcggggcatcaagcggactaagtactagtcccctgagctcacccagggtaactcctcacccctcacctaggggctcgccactgccaactcccaaagggaccccagtgcatacgcctaaggagtctcctgccggcactccaaaccctactcccccatcatctccaagcgtcggtggtgtaccatggcgcgcacgcctcaatagcattaaaaatagtttcctgggatccccccggtttcaccgtaggaaattacaggtccccaccccggaggagatgtctaatctgactcccgaatcatctcccgagctggcaaagaagtcttggtttggcaactttattagcctggagaaagaggaacagattttcgttgtaattaaggacaagcctttatcatctatcaaagcagacattgtacacgcctttctttccatcccgtccctgtcgcattccgtcatctcacagacgtcgttcagggccgaatataaagcaacgggaggacccgccgtcttccagaaacccgttaagttccaggtggatataacttatactgagggaggcgaggcccagaaggagaacggtatttattccgtcacatttaccctgctctccgggccctcccggcgcttcaagcgcgttgtggagacaatccaggcccagctgctaagcacccacgatcccccagctgcccagcatctcagtgaaccccctccacctgcacccggattgagctggggcgccggattgaaaggccaaaaagtagctacatcctacgagtccagcttatag

SEQ ID NO: 44563 - DNA, 1110 bp, Artificial Sequence
  Description of Artificial Sequence: Synthetic coding sequence
atgcacagcctgggctgcttccgggaccggaacaagctgctgcaggacctgcttagtgaggaagagaaccaggagaagatgatctattttctactgctggatcgaaaagaaagataccctagccaggaggatgaggacctgcctccaaggaacgagatcgatccacctcgcaagcgcgtggatagcccaatgctgaaccggcacggaaagcgcaggccagaacgcaagagcatggaggtactgagcgtgacagacggagggagccctgtgcctgcacggcgcgccattgaaatggctcaacatgggcaaaggagccgctcaatatctggcgcgtcatcaggcctcagtacgtccccgctcagctccccccgcgtcaccccccacccaagtcctcgcggctcccctcttcccacccctaaagggacaccagtgcacacccctaaggaatctcctgcgggcacgccaaacccgactccacccagcagccccagcgtggggggagtgccatggcgggccaggctgaactctatcaaaaatagctttctcggatcccccagattccacaggcgaaagctccaagttcctacccctgaggagatgagcaatctcacccccgagtcctcaccggaattggctaaaaaatcgtggttcggcaatttcatcagcctcgaaaaagaggagcagatcttcgtggtcataaaagacaagccattgtccagcatcaaagccgatattgttcatgcattcctgtcgattcccagcctcagtcacagtgttatatctcagacttcattcagggccgagtacaaagcaaccggaggaccagcagtatttcagaaaccggtgaagttccaggtcgatatcacatatactgagggtggagaggcccagaaggagaacgggatctattctgttacctttaccttattgtctggaccttcaagaagattcaaaagagttgtagaaacaattcaagcccagctcctcagtacccacgacccccccgcagctcagcatctttctgagccccctcctcctgcccctggactgtcatggggcgcgggactgaagggccagaaggttgctacctcttatgaatcatcactctag

SEQ ID NO: 44564 - DNA, 336 bp, Artificial Sequence
  Description of Artificial Sequence: Synthetic coding sequence
atggagaacgtgcccaaggagaacaaggtggtggagaaggcccccgtgcagaatgaagccccagccctcggggggggggaataccaggaaccaggcggcaatgtgaagggcgtgtgggctccgcccgctcctggcttcggagaggacgtgccgaaccgactggtggataacatcgacatgatcgatggtgatggcgacgatatggaacgcttcatggaggaaatgcgcgaattgagacggaagatcagagagctgcagcttcgttatagcctgcggattctgataggcgaccctccacatcatgaccatcatgacgaattctgcctgatgccatag

SEQ ID NO: 44565 - DNA, 336 bp, Artificial Sequence
  Description of Artificial Sequence: Synthetic coding sequence
atggagaacgtgcccaaggagaacaaggtggtggagaaggcccccgtgcagaatgaggctcccgccttgggcgggggggagtatcaagagccgggaggaaacgtgaaaggtgtttgggctcctcccgcgcccgggttcggggaggatgtacccaatcggcttgtggataatattgacatgatcgatggagacggggacgacatggaaaggtttatggaggagatgagagagctgagaaggaagatacgcgagttacaactccggtatagtctgcgaatactgatcggcgatcccccccaccacgaccatcacgatgagttctgccttatgccatag

SEQ ID NO: 44566 - DNA, 2478 bp, Artificial Sequence
  Description of Artificial Sequence: Synthetic coding sequence
atggccgccggcaagttcgccagcctgccccggaacatgcccgtgaaccatcagttccctctggcctcatcaatggatcttctgagctcccggtcccctctcgccgagcaccggcctgacgcctatcaagacgtctctattcatggtacattgccacgaaaaaaaaaaggcccaccgcccataaggagctgcgacgacttttcccacatgggcacgctgcctcattccaagtctccccgacaaaatagccccgtcacacaggatggaatccaggagtcaccttggcaagacaggcacggagagacattcactttccgggaccctcatttactcgatcctaccgttgaatatgtaaaattcagcaaagagaggcacatcatggacaggactcctgaaaagctgaagaaggaattggaggaggaactgctcctgtccagtgaggatctgcggtcccatgcgtggtatcacgggcgtatcccacggcaggtcagtgaaaacctcgttcagcgggacggggactttctggtgcgggattccctgtcctcacctggcaacttcgtcttgacatgccagtggaagaacctggcacagcactttaaaataaaccggaccgtgcttcggctgagcgaggcctatagcagggtacagtaccagttcgaaatggagtccttcgacagcatccctggtttggtcaggtgctatgtcggcaaccgcagacccatctcgcagcagtcgggcgctattatttttcagccaattaacaggacagtccccctgcgatgccttgaggagcattatggcacctcacctggtcaggcccgggaagggagtctgacaaagggccgaccggatgtggcaaaaagactgagtctcaccatgggaggcgttcaggcgagagagcagaaccttcccaggggcaatttgcttagaaataaggagaagagtggctcccagcctgcttgcctggaccacatgcaggatcgtcgggccctgtctcttaaggcccatcagtccgagtcttacctaccaattggctgtaaattgccaccacaatcgagcggggtggatacaagcccatgccccaatagccccgtttttcgtactggtagtgaacctgctttgagccccgccgtggtcaggcgcgtttcttcagatgcccgcgcaggggaggccctccgtggctccgactctcagctctgccctaagcctcctccgaagccctgcaaggttccctttcttaaggtccctagtagcccaagtgcctggctgaactcagaagctaactattgcgagcttaacccagccttcgcaacgggatgcggccggggcgccaagctgccaagttgcgcccagggctctcacactgagctgctgactgcaaagcagaacgaggcgccagggcctaggaactccggcgtcaactatctcattctggacgatgacgaccgggagaggccgtgggaaccagccgctgcgcagatggagaagggacagtgggataagggtgagtttgtaacacctctcctggaaactgtgtcttctttccgccccaacgagttcgaaagcaaattcctccccccggagaacaaacccctggagacagctatgcttaagagagctaaggaactcttcactaacaatgatcctaaagtgatagcacagcacgtgctaagcatggactgtagagtggccaggatcctgggcgtctccgaggagatgcgacggaatatgggtgtctcctctggattggaactgatcaccctgccgcatggacaccagcttcgattagacattattgagaggcataacaccatggcaatcggaatcgcggtggacatactgggatgtactgggactctagaggatcgggccgctaccctgtctaaaatcattcaggttgctgtggaactcaaggattccatgggagatctgtattccttttctgccctgatgaaggcactggaaatgccacaaatcacgagattggagaaaacttggacagccttaaggcaccagtatacacagaccgcaatcctttatgagaagcaactcaagccatttagcaagttactgcacgagggacgagagtccacatgcgtccctccaaacaacgtgtccgtgcccctgctaatgccgttggtaactctgatggagagacaagccgtcacattcgagggcaccgacatgtgggaaaagaacgaccagtcttgcgagattatgctgaatcacctggccacagccagattcatggcggaagccgctgattcttacagaatgaatgccgaaagaatcttggctgggtttcagccagacgaagagatgaatgaaatatgtaaaaccgaattccagatgcgcttactttggggcagtaaaggagcccaggtgaatcaaaccgaacgttacgagaaatttaatcaaatcctgaccgccctgagcagaaagctggaaccccccccagtgaagcaagccgagttatag

SEQ ID NO: 44567 - DNA, 2478 bp, Artificial Sequence
  Description of Artificial Sequence: Synthetic coding sequence
atggccgccggcaagttcgccagcctgccccggaacatgcccgtgaaccatcagttcccgctcgcctcttcaatggatttattatcatctagatctcctctggccgaacacaggcccgacgcctaccaggatgtgtccatacatggaaccctcccgagaaagaaaaagggcccaccaccaattcgatcgtgcgatgacttcagccatatgggaactttaccgcatagcaagtctcccaggcagaacagccccgtgacccaggacggaatccaggagtccccctggcaagacagacacggagagacgtttaccttcagagaccctcacctgttagatcccacggtggagtatgtaaagttctctaaggagcggcatatcatggataggacacccgagaagttaaagaaagagttggaggaggaacttttactgagctccgaggacctccgatcccacgcctggtatcacggaaggatcccacgtcaggtgtctgagaacctggtgcagagagacggtgatttcctggtaagagactcactctcttctccagggaatttcgttctgacttgccagtggaaaaatctggcacagcatttcaagatcaatcggacggtcttgcgcctctcagaggcctactcacgcgtgcagtaccaattcgagatggagagctttgattctatccccggcctggtcaggtgttacgtgggcaatagaaggccaatctcccagcagtctggggcgattatttttcagccaataaacaggacggttccgctccggtgcctcgaggaacactatggaacttctcctggacaagctagggaagggtctctgaccaaggggcgtcctgacgtcgcaaagcggttgagcctgaccatgggcggcgtgcaagcgcgcgagcagaaccttccacgtggtaacttgcttagaaacaaggagaagtctggttcgcagccagcatgcctcgaccatatgcaggatcgcagagccctgagcctaaaggcccatcagtcagaaagttacctgcccatcggatgcaagctgccaccacagtcgtctggcgtagatacatcaccgtgcccaaactccccagtctttcgcaccgggagcgagccagcattgagtccagcggtagtgagaagggtgagtagtgatgctcgggccggcgaagctttaagagggtcggatagtcagctgtgtcccaagcctcccccaaagccatgtaaagtgcccttcctcaaagtcccgagctcgcccagcgcctggctcaacagcgaggccaactactgtgagctgaatcccgcattcgcgactggatgtggtagaggtgccaaactccccagctgtgctcaggggtctcacaccgaactgttaactgcgaagcagaacgaagctccagggcctaggaactctggggtgaattacctgatccttgatgacgacgatagagagcggccttgggaaccagccgccgcgcaaatggagaaggggcagtgggataaaggtgagtttgtcactccgctgctggagactgtctcatcatttcgccctaacgagtttgaatctaaatttctaccacccgagaacaaaccgttagagaccgctatgctcaaaagagctaaagaattatttacaaacaatgatccgaaagttatcgctcagcacgtcctcagtatggattgtcgggtggctcgtattctgggagtgtcagaggagatgcggagaaatatgggcgtgtctagtggattggagctgatcacattaccccatgggcaccagctgaggctggacattattgagcggcacaataccatggctatcggaatcgctgtggatattctcggatgcacagggaccctggaggaccgtgcagccaccctctccaagatcattcaagtcgcagtcgaactcaaggactccatgggagatctgtacagtttttccgctctgatgaaggcacttgaaatgcctcagattaccaggttggaaaaaacatggacagcactgaggcaccagtacacccaaacagctatcctgtacgagaaacaactcaaacctttctctaagctgctgcacgaaggtcgagagagtacctgcgttccaccaaacaatgtgtctgtgccactgttgatgcccctggtaacgttgatggagcggcaggccgtgacattcgaaggaaccgatatgtgggaaaaaaatgaccagtcttgtgagataatgctcaaccacctggctactgcgcggtttatggctgaggccgccgactcttatcgaatgaatgccgagaggatcctggctggcttccagcccgacgaggagatgaacgaaatatgtaagaccgagttccaaatgcggctgttgtggggcagcaagggcgcacaagtgaaccagactgaacgttacgaaaaatttaatcagattctaacagcattgtctaggaagttagagccacccccagtaaaacaagcggagctctag

SEQ ID NO: 44568 - DNA, 2478 bp, Artificial Sequence
  Description of Artificial Sequence: Synthetic coding sequence
atggccgccggcaagttcgccagcctgccccggaacatgcccgtgaaccatcagttccctctggcctcctccatggacctcctgtcatcgcgcagccctctcgccgagcacagacctgatgcctaccaggatgtctccatccacggaactttgccgcggaaaaagaaggggcctcccccaatccggtcctgcgatgacttctcccacatgggcacactgccccacagtaaatctccgcgacagaatagtcctgtgacacaggacggtatccaagaatcaccctggcaggacagacatggggagacttttacatttagagacccccatcttttggatcccacggttgagtatgtcaaattctccaaggagcgccacattatggatcgcaccccggagaaactaaaaaaagaactggaagaggaactcctattatcctccgaagacctacgatcacatgcctggtatcacggtagaataccacgccaggtgtcggagaacctcgtgcagagagacggggatttcctcgtgagggactcactcagttccccaggaaactttgtcttgacctgtcagtggaagaacctcgcccagcactttaagataaatcgcaccgtgctgcggctcagtgaagcatattcccgtgtacagtatcagttcgaaatggagtcattcgattcaatccccgggcttgtgcgctgctacgtggggaaccggagaccaatatctcagcagtccggggcgattatctttcagcccatcaaccggaccgtaccattacgatgtctcgaggaacactacggcacatctcctggtcaagcgagggaaggaagccttacaaaggggcgccctgacgttgccaagcgcctgagccttacaatggggggagtgcaggcgcgggagcagaatctccccagaggcaatctgcttcgtaataaagagaagtccgggagccagccagcctgcctcgatcacatgcaggatcggcgggcgctttccttaaaggctcatcagtccgaatcatacctccccatcggctgtaaactgcctccccagtccagcggcgtcgataccagtccgtgtccaaattccccagtatttagaactggcagcgaaccagcattgagccctgccgtggtgcggagggtcagttcagacgctcgtgctggtgaagccctcaggggatccgactcacagttatgccctaagcctccgcccaaaccatgtaaagtccccttcctgaaagttccttcctcccccagcgcatggctgaatagcgaggccaactactgcgaattgaacccggcattcgccactgggtgtggacgtggtgcaaaacttccatcttgtgcccaaggcagccatacagaactactgactgctaagcagaacgaggcccccggcccaagaaattccggtgttaactacctgatacttgacgacgacgaccgagaacgtccctgggaacccgccgcggcccagatggaaaaagggcaatgggacaagggagagtttgtaacgcccctgctggaaaccgtgtcttcgttccgacccaatgagtttgaatccaagttcttgccacccgaaaataagccgctggaaacagcgatgctaaaaagagctaaggagttatttacaaacaacgaccctaaagtgatagcacagcatgtcctttcgatggattgccgggtcgcacggattctgggtgtgtcagaggaaatgcggaggaacatgggagtgtcgagcggactggaactgattaccttgccccatggacaccagttgcgattagacataattgaaaggcacaatactatggctattggcatcgcggtcgatatacttggatgtactggcaccctcgaggaccgggctgctactctgtctaaaattatccaggtagcggtcgagcttaaggactccatgggtgatctgtattcattctcagcactgatgaaagccctggagatgcctcaaatcacacggctcgagaaaacatggaccgcactgaggcaccaatatacgcagacagccattctgtatgaaaaacagctcaaaccattttcaaaactgctacacgagggcagggagagcacctgcgtcccaccgaataatgtgtctgtgcccttacttatgcccctcgtgacgctcatggaaagacaggccgtgacctttgagggcacagacatgtgggagaagaacgatcagtcgtgcgagattatgctgaaccacctggctacagccagattcatggccgaggcggcagacagctatcgtatgaatgcggagcggatcctcgctggtttccagcctgacgaggaaatgaacgagatttgcaaaacagaatttcagatgaggctgctttggggcagcaaaggagcacaggtgaatcaaactgaacgatatgagaaattcaatcagattttgaccgcactgtccaggaagcttgaacctcctcctgtaaagcaagctgaactatag

SEQ ID NO: 44569 - DNA, 2205 bp, Artificial Sequence
  Description of Artificial Sequence: Synthetic coding sequence
atgcccaaggagtgcagcgccttccacgccctgagcgccgccctgtgctgcttttaccacagaaagtccttcatcggagtgaagttctctaaggaacgccacattatggatcgcactcctgagaagctgaagaaggaactggaggaagaactcctgctgagctcggaagatctgcgaagtcacgcctggtaccacgggcggataccccgtcaggtttcagagaatctcgtccagagagacggcgattttttggtcagagactcgctgtcatctcctggaaactttgtgctcacgtgccagtggaagaaccttgcgcagcatttcaagattaacaggacagttctaaggttatccgaggcctattcgagagtgcagtaccagttcgaaatggagtccttcgacagtatccccgggctggtccgctgctatgtgggaaaccggcgccctataagtcaacagtcgggagctattatcttccagcccattaacagaactgtaccacttaggtgcctagaggagcattacggcacaagccccggacaggcaagagaagggtctctgaccaaaggaaggccagatgtggcaaagcgcctcagcctaacaatgggcggggtccaggcacgtgagcagaacctgccccgaggcaacctactcagaaacaaggaaaagagcggtagccaacctgcttgtcttgaccacatgcaggatcgacgcgccttgtcactaaaagcccatcagagcgagtcatatctgccaatcggatgtaagctgcccccacagtcttctggcgtggacacttccccttgccctaattcccccgtctttagaaccggatccgagccagcactgtcgccggcggtcgttagacgcgtgagttctgacgccagggcaggtgaggcgcttaggggctctgacagccaactgtgtcctaaacccccccccaagccttgcaaagtgccattcctgaaagtgccttcatccccttccgcatggcttaattccgaagccaactattgtgagcttaatcctgccttcgctactggttgtggccgaggagcaaaattgccgtcctgtgcccagggctctcataccgagctgctgacggctaagcagaacgaggcgccaggtcctcggaacagcggcgtaaactacctgatcctcgacgacgacgacagagagaggccctgggagcctgccgctgcacaaatggaaaaggggcagtgggataagggagaatttgtgacaccacttttggaaacagtcagctcatttagacctaatgagtttgaaagtaagtttctgccccccgaaaacaaaccattggagacagccatgctcaagcgagctaaggaattattcaccaacaatgaccccaaagtgatagcccagcatgtgctctctatggattgcagagtggcacgaatcctcggcgtgtcagaggagatgcggaggaacatgggcgtttcctcaggcctggagcttataaccctgccgcacgggcatcagctccggcttgacattatcgaacggcataataccatggccatcggcatagccgtagacattctggggtgtaccggtacactcgaggacagagccgccaccctatctaaaattatccaggtggccgtcgaactcaaggatagcatgggagatctctatagtttctctgccttaatgaaggcgctcgagatgcctcagatcaccagacttgaaaagacgtggacagcactacggcaccagtacacacagacagcaattctttatgaaaaacagctcaagccattctcaaaactgctacacgagggccgcgaatccacatgcgtgcctcctaataatgtttccgtgcctctcctcatgccccttgtgacactgatggaacgccaggccgtgacttttgagggcactgatatgtgggaaaaaaacgaccagagctgtgaaatcatgctcaatcatctggcaactgcccggttcatggctgaggcggccgactcttaccggatgaatgctgaaagaattctagctggtttccagcctgacgaagaaatgaatgaaatatgtaaaaccgaatttcaaatgaggttgttatggggatcaaagggagcgcaagtaaaccagactgagcggtacgaaaagtttaaccagatcctcactgcacttagcagaaagctggagccgcctcccgttaaacaggctgagctgtag

SEQ ID NO: 44570 - DNA, 1506 bp, Artificial Sequence
  Description of Artificial Sequence: Synthetic coding sequence
atgcaggaccggcgggccctgagcctgaaggcccaccagagcgagtcttatctgcctataggttgtaaactgcctccccagtcaagtggtgtggatacttcaccttgccccaactcacccgtctttagaaccggcagtgagcccgccctgagcccagctgtcgtgagaagggtgtcgtcagatgccagggctggggaggccctgcgcggatccgattctcagctgtgcccgaaacctccaccgaagccttgtaaggtaccattccttaaggttccgtccagccccagcgcttggttgaatagtgaggcaaactactgtgaactcaaccccgcgttcgctacaggatgcggtagaggagcaaaactcccaagttgcgcacagggtagtcacacagagctccttactgccaaacagaatgaggcccccggacctcgcaatagcggcgtaaattatctgattctggatgacgacgatcgcgaacgcccctgggagcctgctgccgcacagatggaaaagggacagtgggataaaggagagttcgttacacccttgctggaaaccgtgagctcgttccgtccaaatgaatttgagagcaaattcctgcctcccgaaaacaaacctctggaaacagctatgcttaaacgcgcgaaagaactctttacaaacaacgacccaaaggtgatcgcccagcatgtactgtcgatggattgtcgggtggcccggattctgggagtttccgaagaaatgcgacgcaatatgggcgtctcatctggactcgagctgataaccctccctcacggccatcagctgagattagatatcatcgaacggcataatacaatggccataggaatagccgttgacatcctgggttgtaccggcaccttggaagatcgcgctgccacccttagcaaaatcatccaggttgccgtggagctcaaggatagtatgggtgacctttactcttttagtgcactgatgaaggccctcgaaatgcctcagatcactcgcttggaaaagacctggaccgctctgcgccaccagtatacccagaccgctatcttgtacgaaaaacagctaaagccgtttagtaagttgcttcatgaaggacgcgagagcacatgcgtgcccccgaataacgtaagcgtgcccctgcttatgcccttggttaccctgatggaaagacaggcggtgacattcgaaggtaccgacatgtgggaaaagaacgaccagagctgcgagatcatgcttaaccacctagccaccgcacgattcatggccgaggccgcagactcataccgcatgaacgctgagaggattctcgccggattccagccggatgaggaaatgaacgagatttgtaagacagaatttcagatgcggctgctgtggggaagtaaaggtgcacaggttaaccaaactgagcggtacgagaaattcaatcagatcctgacagcgctatctcgaaaactagaaccaccgccggttaaacaggctgagctctag

SEQ ID NO: 44571 - DNA, 4452 bp, Artificial Sequence
  Description of Artificial Sequence: Synthetic coding sequence
atggcccccctgctgggccggaagcccttccccctggtgaagcccctccccggggaggagcccctcttcaccataccgcacacccaagaggcctttcgaacgcgggaggaatacgaggcccgactcgaaagatactccgagaggatttggacatgtaagagcaccggcagttcccagttgacccataaggaggcttgggaggaagagcaggaggtggccgagctgctgaaagaggaattccctgcgtggtatgaaaagttggtgctggagatggtgcatcataacaccgcttctctggaaaagctggtggacactgcctggcttgagatcatgacaaagtatgccgtgggcgaagaatgcgatttcgaggtgggaaaggagaaaatgctcaaggtgaagattgtgaaaatccacccactcgaaaaggtcgatgaagaggcaaccgaaaaaaaatcagatggggcatgtgacagtcctagctcagataaggaaaactcctcacaaatcgctcaggaccaccaaaaaaaagagacggtagttaaagaagacgagggaagacgcgagtctatcaacgaccgagcccggcgcagccccaggaagctcccgactagcctgaaaaagggggaacggaagtgggccccccccaagttccttcctcacaagtacgatgtgaagctgcagaacgaggacaagatcatctcaaatgtgcccgccgactccctgataagaacagagcgaccccctaacaaggaaattgtcaggtattttatcaggcataacgcgctccgcgctggaactggggagaacgctccctgggtggtcgaggatgaactcgtgaagaaatatagcttgcctagtaagttctctgattttctgctcgatccatacaaatacatgacacttaatcctagcacaaaacggaagaatactggtagccccgacagaaagcccagcaaaaaatccaagacagacaatagcagcctgtcatcaccactcaaccctaagttgtggtgccatgtgcatctcaagaagtccctctcaggaagccctctgaaggtgaagaattctaaaaatagcaagtcgcctgaagaacatctggaggagatgatgaagatgatgtcgcccaataagctccacacgaacttccacatcccaaaaaaaggcccacccgcaaagaagccaggcaaacacagcgacaagcccttgaaagcgaaaggtagaagcaagggcatcctcaacggccaaaaatctacaggcaattctaaatctcccaaaaagggcctgaaaaccccgaaaaccaagatgaaacaaatgacactgctggacatggccaaggggactcagaagatgactcgagctccgaggaacagtggtggcacccccaggacctcgagcaagccacacaaacatctgccgccagccgcccttcacctgattgcctattataaagagaataaggaccgagaggacaagagatccgctctctcatgcgtaatctctaagactgcccggcttctcagttctgaagatagggctcgccttccagaggagcttcgcagcctggtgcagaagcgatatgaactgctcgaacacaaaaagcgctgggccagtatgagcgaagagcagaggaaggaataccttaagaaaaaacgagaggaactgaagaaaaaacttaaggagaaggctaaggaacgacgtgagaaggagatgctcgagcgcctggaaaagcaaaagcgttacgaagatcaggaacttacagggaagaatctgcccgcgttcaggctggtggataccccagagggcctgccaaataccctgtttggcgatgtggcaatggtagtggagtttctgtcatgctatagtgggctgcttctgccggacgcacagtatcccattacagccgtgagcctaatggaggctctatcagcagacaagggtggattcctttacttaaacagggtgctcgtgatcctccttcagacacttctgcaagatgaaatcgcagaggactacggagagttgggtatgaaattatccgaaattcccctgactcttcattccgtgagtgaacttgtgcggctgtgtcttcgcaggtccgatgtgcaggaggagagcgagggcagcgacactgatgataataaggactccgcagcattcgaggataatgaggtccaagacgaatttcttgagaagttggaaaccagtgagtttttcgagctgacatcggaagagaaactccagattctgactgcattgtgtcatcgaatcctgatgacctacagtgttcaggatcacatggaaaccagacagcagatgagcgctgaactttggaaagagaggctggctgtcttaaaggaggaaaacgacaaaaagcgagcagagaagcagaaaagaaaagagatggaggccaagaacaaggaaaatggaaaggtcgagaacgggcttggaaagacagacagaaagaaagaaatcgtgaaattcgagccacaagtcgacaccgaagccgaggatatgatttctgccgtcaaatcccggaggcttcttgcaattcaagcgaaaaaagagagggagatccaggagagagaaatgaaagtgaagctggagagacaggctgaagaggaaaggatccggaagcataaagctgccgccgagaaggcttttcaggaaggaatcgctaaagccaaactggttatgaggcgaacccccatcggcaccgaccggaaccacaaccggtattggttattttccgacgaggttccaggcttgttcattgagaaaggctgggtgcatgattctattgattacagatttaaccaccattgcaaagaccatacggtcagtggagacgaggattactgtccaagatctaaaaaggccaatctgggcaagaatgccagcatgaatacccaacacgggaccgctactgaagttgccgttgaaactactactcctaagcagggccagaacttatggttcctgtgtgatagccagaaagagttagacgagctcctcaactgtctccaccctcaggggattagggagtctcagttaaaggagcgcctcgaaaaacgctaccaggacatcatccactctattcacctagcccgcaagccaaatctggggctgaagagctgcgatggcaaccaggagttgctcaattttctaagatccgacctgattgaagtggcgacccgattgcagaagggcgggctgggctacgtagaggaaacttccgaatttgaggctagggttatctcacttgaaaaacttaaagattttggagaatgtgtgatcgccctccaggcctccgtaattaagaaattcttacagggctttatggcccctaagcagaagcggcgcaagctgcagtcagaggactccgctaagacggaagaggtggacgaagagaagaagatggtggaggaagccaaggtagctagcgcactcgagaaatggaaaactgccatccgggaagctcagacctttagccgaatgcatgtgttgctggggatgctagatgcctgcattaagtgggatatgtctgctgagaatgccagatgcaaagtgtgtaggaaaaagggggaggacgataagctaatcctgtgcgacgagtgtaataaagcattccaccttttttgtcttcgccctgccctttatgaggttcccgacggagagtggcagtgtcccgcttgtcaacctgctacggcccgccgcaacagtagggggaggaactacacagaagagtccgcatctgaggatagcgaagacgacgagagcgacgaggaggaagaagaggaggaagaggaggaagaagaagaggactacgaagtggcgggcctgcgactgcggcctcgcaaaacaattaggggaaagcacagcgttattccccctgccgctagatcagggagacggccaggcaaaaagccccatagcactaggcgttctcagcctaaagctccacccgtcgatgacgctgaagtcgacgaactggttcttcagactaaacgctcctctcgacggcagagcctcgagctgcagaagtgcgaggagatcctccacaagattgttaaatacagattctcatggccattccgggagcccgtcacccgagacgaagctgaggactattatgacgtgattacacatcccatggatttccagacagttcaaaacaagtgcagctgcgggagttacaggagtgttcaggagtttctgacggatatgaagcaagtttttacgaacgcagaggtgtataactgtcggggaagccatgtgctcagctgcatggttaagacagaacagtgtcttgtagctctactgcacaagcatctaccaggccacccttacgtgcgccggaagaggaagaaattcccagaccgactcgcagaggatgagggcgatagcgagcctgaagcagtggggcaatcccgcgggcggagacaaaaaaagtag

SEQ ID NO: 44572 - DNA, 1506 bp, Artificial Sequence
  Description of Artificial Sequence: Synthetic coding sequence
atgaagggctaccagagcctggtgttcaacttcttcttcctgaagctgagcgctgagaatgaaagtacaccgattcaacagctgttggaacatttcctcaggcagctgcagcgcaaggacccccacggcttctttgcatttcccgtgaccgacgctattgctcccggttactccatgattatcaaacaccctatggatttcgggacaatgaaggacaagatcgttgccaacgagtacaaaagcgtgaccgagttcaaagcagattttaagctcatgtgcgataatgcgatgacctacaatcgccccgacacagtgtattataagctggcgaagaagattctccatgccgggttcaaaatgatgagcaaagagcgcttgcttgcgctaaagcgctcaatgagctttatgcaggatatggacttctcccagcaggcggctctgcttggcaacgaagacacagcggtagaagaacccgtccctgaagtggttcctgtgcaggtcgagacagcgaagaagtcgaaaaagcccagccgggaagtgatcagctgcatgtttgagccagaaggcaacgcatgctcattgaccgacagtactgcagaggagcacgtgttggcactggtcgaacacgcggctgatgaggctagggaccgtatcaatagattccttcctggcggtaagatggggtacctcaagaggaacggtgatggatcattgctttacagcgtggtgaacactgctgagcctgacgctgatgaggaagagacccatcccgtggatctgtcaagcctctcctccaagctcctgccggggtttacaaccctcggtttcaaggacgaacggcgcaacaaagttacgtttctgtcatccgccaccacagccctgtctatgcaaaataattcagtgtttggtgatctgaagagtgatgagatggagcttctctactcagcctacggagacgaaaccggcgtgcaatgtgccctgtcactgcaggaattcgttaaagacgcaggatcttacagtaaaaaagtcgtggatgatcttctcgaccaaatcacagggggcgatcactcccgtacgctgttccaacttaaacaacgcagaaatgtccctatgaaacctccggacgaggcaaaagtgggtgatacactcggcgattccagtagctccgttctcgaatttatgagcatgaaatcttaccctgacgtttccgtcgatatcagtatgctaagctctttgggaaaggttaagaaggaactggatcctgatgatagccaccttaacttggatgaaacaacgaaattactacaagatctgcacgaagcccaggctgagcgaggggggtctcggcccagttctaatctaagcagtctttctaatgctagcgagcgagaccagcatcatctgggctccccttccagactgtcagttggggagcagcctgacgtaactcacgacccttacgagtttctgcaatcacccgaacccgccgcttcagcaaagacctag

SEQ ID NO: 44573 - DNA, 561 bp, Artificial Sequence
  Description of Artificial Sequence: Synthetic coding sequence
gccgtgtgcagcctgcggctgcccagcagccccgacaagcggagcagagcaatgcaggtaaccctcattctggcagaggaggagactcatcccgtggatctgagctcacttagttccaaactcttaccgggattcacaaccctcggcttcaaagatgagcgcagaaataaagtcacctttctgtcttccgcaactaccgccctttccatgcagaataactccgtttttggtgatttaaaaagcgacgagatggagctgctctatagtgcctacggagacgagaccggagtgcaatgtgccctgtctctgcaggaatttgtgaaggacgcaggcagttattctaaaaaggtggtggatgatcttctggaccaaattaccggtggggatcactcccgcacgttatttcagctcaaacaacgcagaaatgttcccatgaaaccaccggacgaagccaaggtgggggacaccctgggagatagtagctcttcagtacttgagttcatgtcgatgaaatcataccccgatgtatcagtggacattagcatgttaagttcactctag

SEQ ID NO: 44574 - DNA, 1446 bp, Artificial Sequence
  Description of Artificial Sequence: Synthetic coding sequence
atgaagggctaccagagcctggtgttcaacttcttcttcctgaagctcagcgcagagaatgagagcacacccatacaacaactactggagcattttctaaggcaactacagaggaaggatccccatgggttctttgcatttcctgtaacagatgctattgcccccggatatagtatgatcattaaacaccctatggactttggaacaatgaaggacaagattgtggcaaacgaatacaagagcgtcaccgaattcaaagccgactttaagttaatgtgcgataacgcaatgacttacaacagaccggataccgtctattataaactagccaaaaagatcctacacgcaggattcaagatgatgtctaagcaggccgctctattgggcaacgaggacaccgcagtggaggagccggtacccgaagtggtgccagtgcaggtcgagacagcgaaaaagagtaaaaaaccctctcgtgaggttatctcttgtatgtttgagcccgagggaaacgcctgctccctcacagactctactgcggaagaacatgtgcttgcgctggtggagcacgctgctgacgaagctcgagacagaatcaatcgtttccttcctggaggaaaaatgggctatctgaaaaggaacggtgacggatctctgctgtactccgttgttaacaccgcggaacccgatgcagatgaggaggagacccatccagtagatctgtcttcattgagcagtaagttactcccaggattcactactctcggatttaaagacgagcgaagaaacaaggtcacgttcctgagtagcgccacgaccgctcttagtatgcaaaacaatagcgtgttcggtgatctgaaaagcgacgagatggagctgctttatagcgcatacggcgatgagacaggcgtgcagtgtgctctgagtctccaggagtttgtgaaggatgctggctcatattctaaaaaagtggtcgatgatctgctggatcaaataacgggaggcgatcattctaggactcttttccagctgaagcaacgccgcaacgttccgatgaagcccccagacgaggccaaagttggcgatacactgggggactcgtcttcaagcgtattggaattcatgtccatgaaaagttaccccgatgtgtccgtggacatcagtatgctcagctcgctagggaaggttaaaaaggaactggatcctgatgatagccatctgaacctggacgaaacgactaagctgctccaggatctgcacgaagcacaggcggaacgtggggggagcaggcctagttctaaccttagtagtctgtctaacgcctccgagcgagatcagcatcatcttgggagccccagcagactttcagtcggagagcagcctgacgtgactcatgacccttacgaatttctgcaaagccctgaaccagccgctagcgctaaaacctag

SEQ ID NO: 44575 - DNA, 645 bp, Artificial Sequence
  Description of Artificial Sequence: Synthetic coding sequence
atgaagggctaccagagcctggtgttcaacttcttcttcctgaagctatccgctgagaatgagagcacccccatccagcagctcctggaacactttttaagacagttacaaagaaaagaccctcatggattctttgctttccccgttaccgacgcgattgcccccggctatagcatgattatcaagcaccccatggattttggaactatgaaggacaagatcgtggccaatgagtataaatccgtgaccgagtttaaagctgacttcaaactaatgtgcgataacgcaatgacatacaatcgccctgacaccgtctactacaaactggcgaagaaaattcttcatgctggctttaagatgatgagcaagcaggccgccctgctgggtaacgaggacaccgccgtggaggaaccagttccagaagtcgtgcccgtgcaggtggaaacagcaaagaagtctaaaaagccctcccgggaagtgatttcgtgcatgtttgaaccggagggaaatgcctgcagtctgactgactctacagctgaggaacacgtgctggcccttgtggagcatgccgcggacgaggctcgcgacagaattaaccgatttctccctggcggtaagcgtcgacggccgacccggtggacttag

SEQ ID NO: 44576 - DNA, 1794 bp, Artificial Sequence
  Description of Artificial Sequence: Synthetic coding sequence
atgggcaagaagcacaagaagcacaaggccgagtggcggagcagctatgaggattatgctgacaagcccctcgaaaaaccactgaaacttgttctcaaagtcggcggaagtgaggttaccgaactttctggaagcggccatgacagttcttattacgatgatcgcagcgaccatgagcgggagcgtcacaaggagaaaaagaagaagaagaaaaagaaaagcgagaaagaaaaacacctagacgacgaggagaggcgaaagcggaaagaggaaaaaaaacggaagcgagagagagaacactgcgataccgaaggagaggccgacgactttgacccaggcaagaaagtggaggtcgagccccctcccgaccgtcctgtgcgtgcctgtcggacacagccggccgagaacgagtcaacaccaatccagcagctactggaacatttcctgcgacagctgcagcgtaaggatcctcacggctttttcgcattccccgtgactgatgcaatcgcacccggttacagtatgatcatcaagcatccaatggacttcggcacaatgaaggataagatcgtagctaacgagtacaagagcgtcacagaattcaaggcagactttaaactgatgtgtgataatgctatgacctacaacaggccagacactgtgtattacaaactcgcaaaaaagatcctccatgcaggctttaagatgatgtctaaacaggccgcgctactaggcaatgaggatacagcagtggaggaacccgtgcccgaggtcgtgcccgtgcaagtagaaactgctaagaaatccaaaaaaccatcacgggaagttatatcatgtatgttcgagcctgaggggaacgcctgctccctcaccgacagtacagctgaagagcatgtgcttgccctggtcgaacatgctgccgacgaggccagagaccgaataaatcgttttctcccgggagggaagatgggctatctgaagagaaatggagacggttccctgctgtattcagtggtcaacacagcggagccagacgccgacgaggaggaaacgcaccccgtggacttaagttccttgagcagcaagctgcttcctggattcacaaccctcgggttcaaggacgagcgtcggaataaggtgacttttcttagcagtgccacgacagccctctctatgcaaaacaacagcgtttttggagatttgaaatccgatgaaatggaattgctgtactcagcttacggagatgagaccggggtgcaatgtgctctgagcctccaggaatttgtgaaggatgccggatcatacagtaaaaaggtggtcgatgacctgctcgaccagattaccggtggggaccacagccggaccctgttccagctcaagcagagacgtaacgtccccatgaagccgcctgatgaagcaaaggtgggagacactttgggcgactctagtagtagcgtactagaatttatgtctatgaaaagctatcccgacgtctcagtggacatttccatgctcagcagcctgggtaaggtgaagaaggaactggatccggatgatagccacctaaatctggacgagaccacaaaattattacaagacctgcacgaagcccaggccgaacgagggggatcccgtccaagctccaacctgtcatcactgtccaatgcgagcgaaagggatcagcatcacctgggatcccctagccgcctctccgtgggcgagcaacccgatgtaactcatgatccttacgaatttctgcagtctcctgagccagcggcttctgcgaagacatag

SEQ ID NO: 44577 - DNA, 1635 bp, Artificial Sequence
  Description of Artificial Sequence: Synthetic coding sequence
atgatgaccggccagaccatgagcgagcggggcaccaagaagcggaagcgacgtaggaggagatctccacggcgacggagcatctggaccatgcgcaaagagggcagcgagcggaaacgtcgatccgggtcagaacggggaagcacggtaacacggagggaaagactgacaaccctgatactggggcgtcgatggcggtggtcaaggccgcaaattggccaatctgagcgcgccgggcatagccagccgaaaatgcgcgcacacttgttctccaactcatggaacaccagcagtgcctcatttagagatccccatggcttctttgcatttcccgtgacagacgcaattgctcctggatactctatgatcattaaacaccccatggacttcggcaccatgaaggataagatcgttgccaatgagtacaagagcgtaaccgagttcaaggccgacttcaagttgatgtgtgataacgctatgacctataaccgccccgacaccgtgtattacaaactcgccaaaaaaattcttcacgccggcttcaagatgatgtcaaagcaagctgccctcctggggaacgaagatactgccgtggaagagccagttcccgaagttgtgcccgtgcaggtggaaaccgccaagaaaagcaaaaaacccagtcgggaggttatatcttgcatgtttgagcccgaagggaatgcctgcagcctgacagatagcacagctgaggaacacgttctagctcttgtcgagcacgcggccgacgaggcaagggaccgcatcaaccggttcctcccaggcggcaaaatgggatatctgaaacgcaatggcgacggttcgctcctctactccgtcgtgaatactgccgaaccggatgccgatgaggaagagacccatcctgtagacttatctagcctgtcaagtaagctcctgccaggtttcacgaccctcggcttcaaagacgagaggagaaacaaggtcacttttctatcaagcgctacgactgcattatcaatgcaaaacaactccgtgtttggggaccttaagagcgatgagatggagctcctttactctgcgtatggggacgagacaggcgtgcagtgcgcgctgagcttgcaggaattcgtgaaagatgcgggatcctactccaagaaggttgtggacgatctgctcgaccagataactgggggcgaccatagccgcacactattccagctgaagcagagacgtaatgtgcccatgaaacctccggatgaggctaaagtaggagacacactgggagattcttcctctagcgtactggagtttatgtcaatgaagtcatatccagacgtcagcgttgacattagcatgctcagtagcctcggaaaagtgaaaaaggaactggaccctgatgacagtcatttaaacctcgatgagaccacaaaacttctgcaggatctgcacgaagctcaggccgagaggggagggtcccgacctagttccaatctgtcctctctcagtaacgcctccgagagagaccagcaccacctgggaagtccaagtcggcttagtgtcggcgaacagcccgacgtcactcatgacccttatgagtttctacagagccctgaaccagctgcctctgccaagacctag

SEQ ID NO: 44578 - DNA, 438 bp, Artificial Sequence
  Description of Artificial Sequence: Synthetic coding sequence
atgctgggctggatccagcccagccggcagccccagctgcgggccgcacctcccacccgcactccatctgccaaaaggtgcatcttgtgcaatttcctccccggctgttggctggtgggggatgtagctggaagtaggcagcctagcgctccccaaacactcagacagaggcagcataccagaccaccgcctcaggaaagaggctctggccgccggagcccccttcgagaagctaggcgagctaatccacacttcaagtctttccctgtgctggaggctcggggcctgccctgcggtgcccgccgtaccgggccaagaaggccagtcagggaaatgacgctgccatccgatccagaaagggcaaccctgcccaacccacggctgggtgcccctgccgtccctcggaggggaccccgttctcacggtggtcggaggtag

SEQ ID NO: 44579 - DNA, 522 bp, Artificial Sequence
  Description of Artificial Sequence: Synthetic coding sequence
atggccgagggcgaggacgtgggctggtggcggagctggctgcagcaatcatatcaagctgttaaggagaagtctagtgaagcattagagttcatgaaaagagatctcaccgaatttactcaggtggttcagcatgatacagcatgcacgatcgctgccactgcttccgtcgttaaggaaaagctggcaaccgagggttcgtcgggagctaccgagaagatgaagaaagggcttagtgattttctcggcgttatctccgatacatttgctccctcccctgataagaccatcgactgtgatgtaattaccctcatgggcacaccctctgggactgccgaaccctacgacggcaccaaggctaggttgtactctctccagagtgatcccgctacgtattgtaacgagcctgacggcccaccagaactattcgatgcttgtcagcctgagctctgggcgcagatccttgtggctccgtgttggccgtcatgggcttcagcacacacctgggagggcgccctatag

SEQ ID NO: 44580 - DNA, 1425 bp, Artificial Sequence
  Description of Artificial Sequence: Synthetic coding sequence
atggccgagggcgaggacgtgggctggtggcggagctggctgcagcagagctaccaggccgtcaaggaaaaatcctctgaagctctggagttcatgaagcgcgatctgacggagtttacccaagtcgtacagcacgacaccgcatgtacaattgccgcgaccgcttccgtcgtgaaggagaagctcgcaatagcagcctgttccaggggcgcttgcttcctgtgtcccttctctattcagaccgagggctcctcgggggccaccgaaaaaatgaagaaaggtctgagcgactttctaggcgtgattagtgacacatttgctccatccccagacaaaacaatcgactgcgacgtgatcaccctgatgggcaccccttctggtactgccgagccctacgacgggacaaaggcccggttgtattcccttcaaagcgaccccgctacctattgtaacgagcctgacggtcctcctgaactcttcgacgcctggttaagtcagttttgcttggaagaaaagaaaggcgagattagcgagcttctggtcgggtctccttcaatcagagctctctacacaaagatggtacccgctgccgtctcccattctgagttctggcaccgctatttttacaaggttcaccaattggagcaggagcaggctcggcgagatgcattaaagcagagagcagaacaatcaatatctgaggagcctgggtgggaggaggaagaagaagagctaatgggcatctcacccatcagccctaaggaggcaaaggtccccgtggccaaaatcagtacattccctgagggggagcccgggccgcagtcgccttgcgaggagaacttggtgacaagcgtcgaaccaccagctgaagtgacaccatctgaatcctctgaatctatttcacttgtgactcagattgcaaaccccgccacggcccccgaggcccgtgttcttcctaaggacctgagtcagaaactgctggaggccagcttggaggaacagggcttagctgtcgacgttggtgagaccggtcctagcccgccaatccattcaaaaccactgacgccagcaggacacaccggcggccccgagcctcgacccccagcgagggtggaaaccttgcgggaggaggcgccaacggatctgcgggttttcgaattgaatagcgacagtggcaagagcacacctagtaacaatggtaagaaaggatccagtacagacatttccgaagattgggagaaggattttgacttagatatgaccgaggaggaggtgcaaatggcactgagcaaggtcgatgccagtggagaggtaagcggcccggggggctctgagggtagcgagccaaacggccccggatgtgaatcatcccctcaacccgctcagttaagcccccaggagggtccatgttcctgtctgcgttag

SEQ ID NO: 44581 - DNA, 1110 bp, Artificial Sequence
  Description of Artificial Sequence: Synthetic coding sequence
atggccgagggcgaggacgtgggctggtggcggagctggctgcagcagtcttaccaggccgttaaggagaagagctcggaagccctggagtttatgaaacgggaccttacagagttcacccaggtggtgcagcacgacacggcatgtactatcgcggcaactgcatctgttgtgaaggagaagcttgcaaccgagggaagctccggagccaccgagaaaatgaaaaagggcctctccgactttctgggggtcattagcgatacttttgccccctcaccggacaaaaccattgattgcgacgtaataaccctaatgggcacaccatcagggacagctgagccctacgacggaacaaaagccagattgtactccctccaaagtgatccagcgacatattgtaatgaacccgacgggccgcccgaattgttcgatgcattaaagcaaagggctgagcagtccatctctgaagagcccggttgggaagaggaagaagaggaattaatggggataagtcctattagtccgaaggaagcgaaggtgcccgtcgccaaaattagtacttttcccgaaggtgaacccggtccccagagtccttgtgaagagaaccttgtcacctccgtggaacccccagcagaagtgactccttccgagtcctccgagagtatcagtttggtcactcagatcgccaatcctgcgacagctccagaggctagagttctgcctaaggacctgtcacagaaactgctggaagctagcctggaggaacaaggactggcggtggacgtcggcgagaccggccccagtccaccgattcacagtaagcctttgacccccgccggtcataccggcggcccagagccaagaccaccggcccgtgttgaaaccctccgggaagaggccccaacagacctccgcgtttttgaattgaactctgacagcggtaaatcaacccctagcaataacgggaagaagggatcaagcaccgatatatcagaggattgggaaaaggattttgacctggacatgaccgaggaggaagtccagatggcattgagcaaggtagacgcatctggcgaactagaggacgtcgagtgggaagactgggagtag

SEQ ID NO: 44582 - DNA, 1125 bp, Artificial Sequence
  Description of Artificial Sequence: Synthetic coding sequence
atggccgagggcgaggacgtgggctggtggcggagctggctgcagcagagttaccaggccgttaaggaaaaatctagcgaggctcttgaattcatgaaacgcgatctgaccgagtttacccaagttgtccaacacgatacagcgtgtaccattgcagccacagcatctgttgtaaaagagaagctcgccgccagactctattccctgcagtccgaccctgctacctactgtaatgagcccgatggacccccagagttgttcgacgcctggttgtcgcaattttgcctggaagaaaagaagggggagataagcgaactgctggttggaagtccaagcatacgtgccctctataccaagatggttccagctgctgtctctcatagtgaattttggcaccgctatttctataaggtgcatcagttagaacaggaacaggcccggagggacgctctgaaacagcgggcagagcagagcattagcgaggaacccgggtgggaggaagaagaggaagagttaatgggaatctcacctatttctccgaaagaagcgaaggttcctgttgcaaaaatctcaaccttccccgaaggtgagccagggccacagagcccttgcgaggagaacctcgtaacaagcgtcgagccccccgccgaggtaacccccagtgaatctagtgagagtatcagtctggtgacgcaaatcgcaaatcccgccacggcacctgaagcccgggttctccccaaggatctgagtcagaagctgctggaggcctcgctggaagaacagggacttgctgtggatgtcggtgaaaccggccctagccctcctattcattctaagccgctgaccccagcgggccacaccgggggcccagaacctagacccccagccagggtcgaaactttaagagaggaggcccctacagacctaagggtgttcgagttgaattctgactccggcaaatccaccccgtccaacaacgggaagaaggggtcgtccactgatatctctgaggattgggaaaaggatttcgaccttgatatgactgaagaggaagtgcaaatggctttatcaaaagttgacgcctctggcgagctcgaagacgtggaatgggaagattgggagtag

SEQ ID NO: 44583 - DNA, 1344 bp, Artificial Sequence
  Description of Artificial Sequence: Synthetic coding sequence
atggccgagggcgaggacgtgggctggtggcggagctggctgcagcagtcctatcaggctgtcaaagagaaatcctccgaggctctggagtttatgaaaagggacttgactgagtttacgcaagttgtgcagcacgacactgcttgtaccattgccgccactgcctctgtcgtaaaagaaaaactggccatcgccgcatgttcacgcggagcttgcttcctgtgcccgttcagcatccagaccgaaggaagcagtggtgcaaccgagaaaatgaagaagggcctcagtgatttcctcggggttatctcagacacttttgcaccctctccggataaaacgatcgattgtgatgtgatcacgctgatgggaactccctctggcaccgccgaaccatatgacggcactaaagctagactgtacagcctgcaatctgatcccgctacatactgcaacgagcccgacggtccacctgaattgtttgacgcctggctgagtcaattttgccttgaggagaaaaagggtgagatatctgagctgctggttgggtcgccatctatccgggctctgtacaccaaaatggtccccgccgctgtgtctcacagtgagttttggcataggtatttttataaggtccaccagctggaacaagaacaagcgaggagagatgcgctcaagcagagggcggagcagtctattagcgaggaacctggatgggaagaggaggaagaagagctaatggggatttcacctatatcccctaaggaagctaaggtccccgttgccaaaataagcaccttccctgagggagagcccggtccccagagtccctgcgaggaaaatctcgtaacctctgttgagcctccggcagaggttactcctagtgagagcagtgagtcaattagtcttgtcacccagatagccaatcctgctacggcacctgaagcccgagtattgcctaaggatctcagccaaaagctgcttgaggctagcctcgaagaacagggtcttgccgtagatgttggcgaaacaggcccatcgccccccattcattccaagcccctgacaccagccggccatacagggggacccgaacctaggccgcctgccagagttgaaaccctccgggaggaggctccgaccgaccttcgagttttcgaacttaacagcgactcagggaagtctaccccctccaacaacggaaagaaaggcagcagcactgacatcagtgaagattgggagaaggacttcgacctggatatgacagaagaagaggtacaaatggcgctgagcaaggtcgacgcttctggcgaactagaggatgttgagtgggaggactgggaatag

SEQ ID NO: 44584 - DNA, 1269 bp, Artificial Sequence
  Description of Artificial Sequence: Synthetic coding sequence
atggccgagggcgaggacgtgggctggtggcggagctggctgcagcagtcatatcaagccgtcaaggagaagtcatcagaagcactagagtttatgaaaagggatttgaccgagttcacacaggtggtgcagcatgacacagcctgcaccatcgcggccacagcaagtgttgttaaggagaagcttgccactgaggggtcatccggtgccacggaaaagatgaagaagggccttagcgactttctgggtgtgatcagcgataccttcgctccttccccggacaaaaccatcgattgcgatgttattacactaatgggaacccctagcggcacggctgaaccgtatgatgggacaaaggctaggctgtactccctgcagagtgatccggcaacgtattgtaatgagcccgatggcccaccggagcttttcgacgcgtggttgagtcagttctgcctggaggagaaaaagggagaaattagtgaactgctggtaggcagcccctcaattagagccctttacactaaaatggtgccagcagctgtcagccatagtgagttttggcaccgctacttctataaggtccatcagttggagcaggagcaggcccgaagagatgccctgaagcaacgggcagagcagagcataagcgaggagccaggatgggaagaagaagaggaggaattgatggggatcagtcccatctcccctaaagaagcaaaagtgcccgtggccaagatttctaccttccccgagggcgaacccggacctcagtctccgtgtgaggagaacctcgtgaccagtgtggagccgccagcagaggtcacaccctccgaatcgtctgaaagtatttctttagtgacgcagattgctaatcccgctacggcgccggaggcccgggttctgccgaaggacctcagccagaagctgcttgaagcatcgctggaggagcagggccttgcggtggatgtcggagaaaccggcccgtcccccccaattcacagtaaacctctgacacctgccggacacactggtggaccggaaccacgcccgccagcaagggtcgaaaccctgagggaggaagctccaaccgatttaagggtctttgagctgaattcagactcaggtaagtccacaccatcaaataacggcaagaaagagaccagatcccaatttaccgtggactttctctggaagatctccgtgactctgctcgagccattggggcagtcagccagccctctattcagcaatctgccgttcccaaggtag

SEQ ID NO: 44585 - DNA, 1293 bp, Artificial Sequence
  Description of Artificial Sequence: Synthetic coding sequence
atggccgagggcgaggacgtgggctggtggcggagctggctgcagcagagctaccaagccgtcaaggaaaagagttcagaggcattggagtttatgaaaagggacctgactgagttcacccaagttgtgcagcatgataccgcctgcactattgccgctaccgcctctgtagtaaaagagaaactagctacagaggggagttctggggctaccgagaagatgaaaaaggggctcagtgatttcctgggcgtgatctcggacaccttcgccccgtctccagataaaactatcgactgtgacgtgatcaccctcatgggaacacccagtggcaccgccgagccctacgatggcaccaaggccaggctctatagccttcaatccgatccagcaacttactgcaacgaaccggacggcccaccagagcttttcgatgcttggttgtctcaattctgcctggaagaaaaaaagggagaaatctccgaactgctggtgggatcgcctagtattagggccctgtacacaaagatggtcccagccgctgtgtcgcattcggagttttggcaccggtacttttacaaagtgcaccagcttgagcaggagcaggctagaagggatgcactgaaacagcgcgctgagcagtcaatcagcgaagagcccggttgggaggaggaagaagaagagctaatgggtattagtcctatatctccaaaagaggccaaagtgccagtggctaagatcagcactttccctgaaggagaaccaggcccgcagagtccctgcgaagagaatctggttaccagcgtcgagccacccgccgaggtgacccctagtgagtcatcagagagcatctctttggttactcaaatcgcaaaccccgccactgcacccgaggcccgggtcctcccgaaggatctctcccaaaaacttctagaagcctcactggaggagcaggggctcgcggtggacgttggagagaccgggccctccccacctatccactccaagccccttacgccagcgggccacactgggggtccagagccaaggccccccgccagagtcgaaactctgcgggaggaagctcccacagatctgagagtgtttgagctcaatagcgacagcggcaagtccacaccaagcaataatggaaaaaaaggaagtagcacagatatcagcgaggattgggaaaaggattttgacctcgatatgactgaagaagaagtgcagatggcgcttagtaaggttgatgcttccggggagcttgaggacgtagagtgggaggactgggaatag

SEQ ID NO: 44586 - DNA, 1008 bp, Artificial Sequence
  Description of Artificial Sequence: Synthetic coding sequence
atggccgagggcgaggacgtgggctggtggcggagctggctgcagcagagctatcaggcagtaaaagagaaagcaaggctgtattccctgcagtctgatcctgcaacctattgcaacgaaccggacggacctcccgagctgtttgacgcctggctcagccagttttgcctggaggagaagaagggcgagattagcgaattgctggtagggtctccgtcaatacgggctctctataccaaaatggtacccgcagccgtgtcgcacagcgagttttggcaccgttatttttacaaagtgcaccagctggagcaggagcaagctcggcgtgacgcattgaagcagcgcgccgagcaatctatcagtgaagagcctggatgggaagaggaagaggaagaactgatgggtatctcccccattagccccaaagaggccaaagttccggtggcaaaaatctccactttcccagaaggggaacctggcccccagtctccttgcgaagagaacctggtgacttctgtcgagccccccgcagaggtgactccatccgagagctcagagagtatctctttagtgacgcaaatcgccaatcccgcaactgcgcccgaagcccgtgtgttaccaaaggacctctctcagaagctcctggaagcctctctcgaggagcagggcctggccgtagatgttggggagaccggcccaagcccccccatccactcaaagcccttgacacccgccggtcataccggcggaccagaacctcgaccacccgctcgcgtcgaaactctgcgagaggaggcacccactgacttgcgtgtttttgaactgaactctgactcagggaaatcaacaccttccaacaacggaaaaaaaggctcctcgacggatatttcggaggattgggagaaggatttcgatctcgatatgacagaagaggaggtccagatggctttgtccaaggttgacgccagtggtgaacttgaagacgtggagtgggaggattgggagtag

SEQ ID NO: 44587 - DNA, 1158 bp, Artificial Sequence
  Description of Artificial Sequence: Synthetic coding sequence
atggccagcctgggccccgccgccgccggcgagcaggccagcggcgcagaagcggaaccaggccctgctggaccaccacctcctccttcgcctagcagcctcgggcccttgctgcccctgcagcgggagcccctgtataactggcaggctactaaggcgtctctgaaggaaaggttcgcctttctgtttaactctgagctcctttcggacgtgaggtttgtgctgggaaagggtaggggagccgcagctgctggaggccctcaacggataccagcccatcgcttcgttctcgccgctggttcggcggtgtttgatgcaatgtttaacggtggaatggccactacgtcagctgagatcgagctaccggatgtcgagcctgctgcctttctggcactgttgagattcctgtatagcgatgaggtacagatcggaccagaaaccgtgatgactactctctacacagcaaagaaatacgcagtaccagccctcgaggcacactgtgtcgaattccttaccaaacaccttcgcgccgacaacgccttcatgctgctaacacaagcgagactctttgatgagccccagcttgcatcactgtgcctggatacaatcgataaatctacgatggatgccatttcggcagaaggctttaccgatattgacattgatacactgtgcgcggtgctcgagagagacacactgtctattcgtgagtcccgcctctttggagccgtggtgcgttgggcggaggcagagtgccaaagacagcagctcccagttacctttggcaacaagcagaaagttttgggcaaggccctgtctctgatccggttcccattaatgacaatcgaagaattcgccgccggaccagcccagagtggcattctgtcagaccgggaggtggtcaacctgtttctgcatttcaccgttaatccaaaaccccgggtagagtacatcgatcgccccagatgttgtctccgcggaaaggaatgttgcatcaatagatttcaacaggtcgagtcacgctggggatactccggcacctctgatagaatacgcagccttaacatgaggaagagtaaaccctgggacaggatgatccccgctttggtcgtgatgggccagctgacccacagtggttcctgctctagaaatccatag

SEQ ID NO: 44588 - DNA, 1521 bp, Artificial Sequence
  Description of Artificial Sequence: Synthetic coding sequence
atgatcatgagcaacacccacaaggcccggctggagcggcgggtgacgggaagcacaaacaggtggaggctaccgaaacagccattctcaggtgacctgctttccctgagccagatgtgcaaggctctcagcatcgatttcgaagaggctttgcgcaaccccgatcgactgtgcatctcccagattcagaaattcttttttgagaactttaagaacaaagacatacagtctggggaagccgatgtgattctagagtgccttggcttcaagtgggagttacatcagcctcaactgttccagtctgaaacgctcgctaaactgtatctgaaagccctggcacaggggaccactcaccctctccgcgaactcgaggagttgctcagggcccagagcccaaagaaaacaaaagagaagagccccgctaaacggatcataatctctcttaagattaatgatccactcgtcacgaaagtcgcctttgccaccgcgctgaaaaatctctatatgagcgaagtagagataaatctcgaagacctgctcggtgtgcttgcatcagcgcatatcttacagttttcagggctgtttcagcggtgtgtcgatgtgatgatagctcggcttaagcccagcacgataaagaaattctacgaggcggggtgtaaatataaggaggagcaactgaccactggctgtgagaagtggcttgaaatgaacctggtgccccttggtggcactcagatccacctgcacaagatccctcaagacctcctgcacaaagtgctgaaaagccctcgcctcttcactttttctgagttccatctgttgaaaaccatgttgttgtgggtgttcctgcagttgaactataaaattcaggctatccctacttatgagactgtgatgactttctttaagtcatttcctgaaaattgttgttttctggatagagacattggccggagtctgcgaccactcttcctctgcctgagactccacggcatcactaaaggcaaagatcttgaggtgctccggcaccttaatttctttcctgagagctggctggaccaggtaactgtaaaccattatcatgccctggaaaacggaggcgacatggtccatctgaaggatctcaacacacaagccgtgagattcggtctcctgttcaatcaagaaaataccacttattcgaagaccatcgccctgtacggtttcttttttaaaatcaagggtctgaagcacgacaccaccagctactcgttttatatgcagcggataaaacacactgacttggaatcccctagcgccgtatatgaacataatcacgtctctttgcgggccgcccgcctggtgaaatacgaaatccgagccgaggcgctcgtcgacggaaaatggcaagagttccgaacaaatcagattaaacaaaagttcggtttgacaacgtcctcttgtaagtctcacaccctgaaaattcagacagtcggaattccaatttatgtgagtttcgcattcattttccccgccagctag

SEQ ID NO: 44589 - DNA, 1524 bp, Artificial Sequence
  Description of Artificial Sequence: Synthetic coding sequence
atgatcatgagcaacacccagcacaaggcccggctggagcggcgggtcaccgggagcaccaatcggtggaggctgcctaaacagccttttagcggagatttattgtccctttcccagatgtgtaaggccctttccattgacttcgaagaggccctacgaaaccccgatagactctgtattagtcagatccagaagttcttttttgagaactttaaaaataaagacatccagtcaggcgaagccgacgtgatcctcgaatgcctgggcttcaagtgggaactccatcagccacaactcttccagtctgagactcttgctaagttatatctgaaggccctcgcgcagggcacaacgcaccctttgcgggagttggaagaactactgagggctcagtcaccaaagaagaccaaggagaaaagccccgcaaaacgtattatcattagcttgaaaattaacgatcctctggtcaccaaagtggccttcgccacagccttgaaaaatctttatatgagcgaggttgaaattaatctggaggacctgctgggggtgctcgcctctgctcacattctgcagttttcagggctctttcagaggtgtgttgacgtcatgatcgctagacttaagccatcaaccataaaaaagttctatgaggccggttgcaaatacaaggaggaacagttaactaccggatgtgagaagtggctcgagatgaatcttgtacccctcggcggcacacagatccatctgcacaagatcccacaggatctcctgcataaggtgctcaagagtcccagactattcaccttctccgaatttcacctcctgaagactatgctgttgtgggtatttctccagctaaattacaaaatccaagctatcccgacttatgagactgttatgacgttttttaagagctttccagaaaattgctgcttcctggatagggatataggcagatctcttaggccactgtttttatgtctgcggctgcacggcataacaaaagggaaggatcttgaagtgctgagacatctcaatttttttcccgaaagctggttagatcaggtcactgtcaatcattatcatgcattagagaacggaggagatatggtccacctaaaggacctcaatacacaggccgtaaggttcggcttactgttcaaccaagaaaatacaacctattcgaagaccattgcactgtacgggttcttcttcaaaatcaagggcctgaagcacgacaccactagttacagcttctatatgcagcgcattaaacataccgacctggagtctccatcagccgtgtatgagcacaaccacgtgagcctgagagctgcccgccttgtgaaatacgagatccgggctgaggcactggtggacggtaagtggcaagaattccgtacaaatcagatcaagcagaaatttggattgacgacatcaagctgtaaaagccataccctgaagatccaaacagtaggcatccccatctacgtgagctttgcctttatatttcctgcatcctag

SEQ ID NO: 44590 - DNA, 2139 bp, Artificial Sequence
  Description of Artificial Sequence: Synthetic coding sequence
atgtgcagccccgccagccccaagatcctgtaccggaacccccggtttttgcgtttggccttcctgcagctgcatcatcagcagcagagcgacgtgttttgtgacgttctcctgcaggcagagggcgaggccgtgccggcgcactgttgcatcctctccgcttgctctccttttttcaccgagaggctggaaagagaacgccctgcacaaggtgggaaagtggtgctcgagttaggaggtctgaaaatttccactctgaggaagctggtcgacttcttgtatacttccgagatggaagtcagtcaggaagaggcccaggacgtgctttccgctgctaggcagctgcgagtgtcagagcttgagagcttgcagctagagggcggaaagttagtaaaagcccctcagggccgaaggcttaatagggaatgcctccagcccacatctgctgccccgataagcgcccgagtagtgacccccagccatcatccccacacacccttgcctacaaatcagaccccatgcccgttaggcgccattaggttgaagagtctggggaaggaagaaggtccacaggaaaacaaccgccagaatgcagataatctttccggcacacttctgcttaaacgcaaagctcgggcttgtcctaccccccaggagaagaattcttcacctagcagtcacagccaagagcccagagaaaacaagaacgacactgcacttgatccaactgtactatcccctcctagcctgtatccctcagtagataagcacctgttgccgcgcaaaataagactcagtcggagcaagcctagcccaggcatctgcacatccaaaccgtcctccatcctctctggctcttcttcagtgcctgcgacgccagggcgccgattgtggaggcagagaagcgttaataaagagacaccagaagataagcctaaacccggacgggcctcccccttacaaagtacacctaacccctccggactaggtaagactggggggagccgaaagcgatccccagaagtgagggcccccaacagtgatagcgcagaagaggggcaggtaggtcgcgttaaactgaggaagatcgttaacggaacctgttgggaagtagtccaagagactcctctcaagaacacccaagatagtccccaaatccccgaccccggtggcgacttccaggagccaagcggaacacagccttttagctccaacgaacaggagatgtcaccgactagaacagaactgtgtcaagattcccctatgtgcaccaagctccaggacatcttggttagtgctagtcacagccccgatcatcccgtggtaaagagtgaattcgagtcttctccggagctggtagaaaaagagcctatgctagctattgattgccgagagccttatgcctttgacacggcattactcgagcagccttgtgaagccgaggagtacagaataacgagcgcagccgcgacttccgagctggaagaaatcctggattttatgctatgtggatcagacattgagccaccaatcggcagtctggaatctccaggcgcagaagggtgcaggaccccaacataccacctaactgagacaggcaaaaactggatcgagggtgaggaatggtgcttgccagatatggagctgtggcctcgcgagctcaccgagcttgaaaaagaaccagccggagagaacaggggacctaccgagcttttaagtcctctagtcatgccatctgaggtgtcagaggtactgtctgtggggggcaggtggactcctgatctagaaatcacaagctctcaacccctcgacggtcaggaagataaattgttgcatgtttctagtctggacacaccccagcgcagttatggggatctgagccccccctgcagcaactgggtggagaccggtctcgaggttagtttaactactgacgaattgctttacccaagccccaaggctggaaaagaagtttccggacactccgagttactgggctctctccctgcttcaagcgaggaagaagaaattgatgttgtggactggaccgccgaagggcgcctggtgccaactactgtcccctccgtgtggcccgatccctcctccgagtccgagacagaggtcgatatcctcacatag

SEQ ID NO: 44591 - DNA, 2139 bp, Artificial Sequence
  Description of Artificial Sequence: Synthetic coding sequence
atgtgcagccccgccagccccaagatcctgtaccggaacccccggtttctgcgcttagctttcctgcagctgcatcaccagcagcagtctgacgtgttttgtgatgtgctattgcaggccgaaggcgaagcggtccctgcccattgttgtatccttagtgcctgtagccctttctttaccgaacgcctggaaagagagcgccctgcccaagggggtaaagtcgtgcttgagttgggagggctaaagatctccacattgagaaagctggtggacttcctttacactagcgaaatggaagtatctcaggaggaagcccaggacgtcctaagcgcagctcgtcagcttcgagtaagcgaactggagagccttcagttagagggcggaaagctcgtgaaagctcctcagggacggcgcctgaatagggagtgtctgcagcccacctcggcagctcctatcagcgccagggtggtcactccaagccatcatccgcatacccctttacctactaatcagaccccttgtcccctcggagccatacgtctgaaaagcctggggaaggaagaaggcccccaggaaaacaataggcaaaacgcagataacctgtccggtacacttcttctgaagaggaaagctcgcgcctgtccaacgccccaggagaaaaattcctcaccctcttcgcactctcaagagcctagagaaaataaaaacgacactgctctggaccctacagtgctctctcctccatccctgtatccctctgtcgacaagcacctcttgcctcggaagatacgcctgtctagaagtaagccttctcctggcatttgcacctctaaaccgtcatccatcctgagtggctcatcatctgtacctgcaaccccaggacggcggctgtggcggcaaaggtctgtgaacaaggagacacccgaggacaaacctaagcctgggagagcgagccccctccaatctaccccaaacccttccggcctaggaaagacagggggtagcaggaagaggtcgccggaggttagggctcctaacagtgatagcgccgaagagggtcaggtggggagggtaaagctgagaaagatcgtgaatggtacctgttgggaagtggtacaggaaacacccctcaagaacactcaggacagtcctcagattcccgaccctggtggggactttcaggagccctcgggtacccagcccttctcttctaacgagcaggagatgtctccgactagaacagagctttgccaggacagcccaatgtgcaccaagctgcaggacattctggtgagtgcctcccatagccccgaccaccccgttgtgaagtccgaattcgaatcttcacccgaactggtagagaaggagcccatgctcgccatagactgcagagaaccctacgcatttgatactgccctgctggagcagccatgtgaagctgaggagtaccgaatcaccagtgctgccgctacaagcgagttggaggagatattggacttcatgctgtgcgggagtgacatcgagccccccattggaagtctggaatcccccggcgcggagggatgtcgaacacccacataccacctgacagagacaggtaagaattggattgagggtgaagagtggtgcctgcccgacatggagctgtggccacgggaacttacagagctggagaaggaacctgccggggagaacagaggcccaacggagttgctgtcccctctcgtgatgcctagtgaagtgtccgaagtcctctcggtgggaggacgctggactccggatctggagatcaccagtagccaacctttagatgggcaggaagacaaactactgcatgtgagctcactggacactccacagcgaagctacggagacctgagccccccatgctcaaactgggtggaaactggattggaggtgtctctcactacagatgaactgttgtatccctcccctaaagccggaaaggaagtgtcggggcacagcgaattacttggaagcttacctgctagctctgaagaggaagagatagacgtggtggattggactgccgaaggacggctggttcccacaacggtcccctctgtctggccagacccatcctccgagagcgagacggaagtggacattttaacctag

SEQ ID NO: 44592 - DNA, 270 bp, Artificial Sequence
  Description of Artificial Sequence: Synthetic coding sequence
atgtgcagccccgccagccccaagatcctgtaccggaacccccggttcctgcgccttgctttcctccagctgcatcaccaacaacaatcagacgttttttgtgacgtgctgctgcaggcagagggtgaggcagtgcccgcgcactgctgtattctctccgcttgctctcccttcttcaccgaaagactcgaaagggagcggcccgcccagggcggcaaagtagttttggaattgggtggactcaaaatctccacactgaggaaattatag

SEQ ID NO: 44593 - DNA, 876 bp, Artificial Sequence
  Description of Artificial Sequence: Synthetic coding sequence
atggagcccctgggcctggtggtgcacggcaaggccgagcccttctcagccgcactccggtctctagtcaacaatccaagatacagcgatgtgtgtttcgtggtgggtcaagaacggcaagaggtattcgcccaccggtgcctcttggcttgccggtgtaacttctttcaacggctgcttggtacggagcccgggcccggagtcccgagccccgttgtattatctaccgtgcccacagaagcttttctcgctgtcttggaatttttgtataccaactcagtaaaactgtaccggcattcagttctcgaggtgctaaccgctgcggtggaatatgggctggaagaactgcgcgagttgtgtttgcagtttgtggttaaagtcctggacgtggatctcgtgtgtgaagcactgcaggtggcggtgacttttgggcttggtcagctccaagagaggtgcgttgctttcatcgaagcacactcccaggaggccctgagaaccaggggattccttgaactgagcgccgcggccctcctccccttgctacgaagtgacaagctttgcgtggatgaagccgaactagtcagggctgctaggtcgtgggcaagagtcggggccgccgtgctcgagcgtccggttgccgaagtggccgcacccgtagtgaaggaattgcgactcgcactcctggcgcccgctgaactgagcgcgctggaagaacagaaccgacaggagcctctgattccagtagagcaaatcgtggaggcatggaaatgccatgctctgcgccgcggggacgaggcacggggtgcgccctgcaggagacgcagaggcaccctgccgcgagagcatcatcgctttctggacctgtctttcaaatag

SEQ ID NO: 44594 - DNA, 489 bp, Artificial Sequence
  Description of Artificial Sequence: Synthetic coding sequence
atggagcccctgggcctggtggtgcacggcaaggccgagcccttcagcgccgcacttcggtcgttggtcaacaatccacggtattccgacgtgtgcttcgtggtcggacaggagcggcaggaggttttcgcccacaggtgcctactggcatgcaggtgcaacttctttcaacgactgttgggtactgaaccgggcccaggtgtgccatcaccagtcgtactgagtactgttcctaccgaagcattcctcgcagtccttgagttcctatacactaacagcgtcaaattgtatcggcactcggtattggaggtgttgactgctgccgtggagtatggccttgaggagcttagagaattgtgcctgcagttcgttgttaaggtgctcgacgtggatctcgtttgtgaggccctgcagcacttctggagaccacggagggcagaccaagaggtccggagatcccggcccagttggctgacacggtggccatag

SEQ ID NO: 44595 - DNA, 1386 bp, Artificial Sequence
  Description of Artificial Sequence: Synthetic coding sequence
atggccgccgacatcttcccccggaagaagcccgccaacagcagcagcactagtgtgcaacagtatcatcagcaaaatctgtctaataataacctgatacctgcccctaattggcaggggctctaccccactatccgggaacggaatgccatgatgtttaacaatgacctcatggcggatgtccacttcgtggtcgggccccccggagggactcaaagactccccgggcacaaatatgtcctggcagtggggagttccgttttccatgcaatgttctacggagagctcgccgaggataaagatgaaattcgaatcccagacgtggaaccagccgcttttctggcaatgctcaaatacatctactgcgacgagatcgacctcgccgctgatactgttctggctactctgtatgcagccaagaaatatatagtgccgcatctggcgagagcttgcgtgaatttcctagaaacgtcactcagtgctaaaaacgcctgcgtgttactgagtcaaagctgcttattcgaagaacccgatcttacccagcgatgttgggaggtgatagacgcacaggccgagctggccttgaagagcgaaggattctgcgatattgatttccagacactcgaatctattctgcggagggagaccctcaacgccaaggaaattgtcgtgttcgaggctgcattaaactgggcagaagtggaatgtcagcgccaggacctcgctctgagcatcgaaaataaacgaaaggtcctcggaaaggcactgtacctgattcgtatacccacgatggctttagacgactttgccaacggggccgctcaatccggcgtattaaccctgaatgagaccaatgacatctttctgtggtacaccgccgctaaaaaacccgaactccagtttgtgagcaaagcacggaaaggattggttcctcagcgctgtcatagatttcagagctgcgcatacaggtccaaccaatggcgctacaggggccggtgtgattcgatccagttcgccgttgacaaaagagtgtttattgcaggcttcggcctctatggatctagctgtggatcagctgaatacagcgccaagattgaactcaagcggcagggagtggttcttggccagaacttgtctaaatattttagcgacgggagctcaaatacctttcctgtgtggtttgaataccctgtgcaaatcgagcctgacacattctatacagcctctgttattcttgacggcaatgagttgtcctatttcggccaagaggggatgaccgaggtccagtgtgggaaagtgactgtgcagttccaatgttccagcgacagcaccaatggtaccggcgtgcagggcggccagatcccagaattgatcttttacgcatag

SEQ ID NO: 44596 - DNA, 1569 bp, Artificial Sequence
  Description of Artificial Sequence: Synthetic coding sequence
atggtggacgacaaggagaagaacatgaagtgcctgaccttcttcttaatgctacctgaaaccgtcaagaatcggtccaagaaatcctcaaagaaggccaacacaagtagcagttcgtcaaatagttccaagctccctcctgtgtgctacgagataattacgctgaaaaccaagaagaagaaaatggccgcagacatctttcccaggaagaaacccgccaactcctcttcaacgtccgtgcagcagtaccatcagcagaacctgagcaataacaaccttatccctgctccaaactggcagggcctctacccaactattcgggaaaggaatgccatgatgtttaataatgatctgatggcagatgtccactttgtggtggggcctccagggggcactcagaggttgcctggccacaaatacgtcctagctgtggggtccagcgtgttccacgctatgttctatggcgaactcgccgaggataaagatgaaattagaattcctgatgtggagccagccgcatttttggcaatgctcaagtacatctattgtgacgaaatcgatctcgccgcagatacagtcctggcaaccctgtacgctgccaagaagtatattgttccacacttagcccgcgcctgtgtaaacttcctcgagacttccttaagcgctaagaatgcttgcgttctgctctcacaatcttgcctctttgaggagcctgacctcacccagcggtgctgggaagtgatcgatgcgcaagctgagctggcccttaagtctgaggggttctgcgacatcgactttcagaccctggaatctattcttaggcgcgaaactctaaacgccaaagagattgtggttttcgaagccgccctgaactgggccgaagtcgaatgccaacggcaggatctcgcgctctccatcgagaataagcgaaaggtcttaggcaaagctctatacttgatacgcataccgaccatggccctcgacgacttcgctaatggagctgcccaaagcggggttttgaccctcaatgaaaccaatgacattttcctttggtacacagccgctaaaaaacccgaactgcagtttgtgagcaaagctagaaagggactggtcccccagaggtgccacaggtttcagtcttgcgcctaccgctccaatcagtggcgatatcgtgggcgctgtgacagcatccagttcgcggtagacaaacgagtgtttatcgccggcttcggcctgtatgggtcctcctgcgggagcgccgaatactcagccaaaattgagctgaagagacagggtgtggtgctgggccagaacctgtctaagtacttctccgatggaagctccaacacctttcccgtctggtttgaataccccgtacagattgaacctgacacattctatacagcttcagtcattctggacgggaatgagctcagttattttggacaggagggcatgaccgaggtgcagtgcgggaaggtcacagtacagttccagtgtagcagtgacagcacaaacgggacaggagttcagggcgggcagatcccggaacttatcttttacgcctag

SEQ ID NO: 44597 - DNA, 1386 bp, Artificial Sequence
  Description of Artificial Sequence: Synthetic coding sequence
atggccgccgacatcttcccccggaagaagcccgccaacagcagctctacgagtgttcaacagtatcatcaacaaaaccttagtaataacaacctgattcctgccccgaactggcagggactttacccgacgattcgggagagaaacgctatgatgttcaataacgacctcatggctgatgtgcattttgtggttggccctccagggggcacacagcgacttcccggtcacaagtacgtgctcgcggtcggcagtagtgtgttccacgcaatgttctacggtgagctcgcagaggataaggatgagattagaatacccgatgtcgaaccggctgcattcctggcaatgctgaaatacatttactgcgacgaaattgatctcgcagccgacactgtcctggccacgctctacgccgccaaaaaatatattgtcccacatcttgcgcgggcctgcgtgaatttcctggaaaccagccttagcgctaaaaatgcgtgtgttctgctgtcccagagttgtctcttcgaagagcccgatctcacacagcggtgctgggaggtgatcgacgctcaggctgagcttgccctgaagtctgaaggattctgtgacatcgactttcagacactagagtcaatcctcagaagagagaccctcaacgccaaggagatagtcgtgttcgaagctgcgctgaactgggctgaggtagagtgccagcgacaggatctggctttgtccatcgaaaataaaagaaaagtgctgggaaaggccctgtacttaatacgcatcccaaccatggccctcgatgatttcgctaacggagccgcgcaaagtggcgtgctcaccttaaatgaaacgaacgacattttcctctggtacactgccgcgaaaaaaccagaactccaatttgtcagtaaagcaagaaagggcctggtcccacagcggtgccacaggttccaaagctgcgcctatcgaagcaaccagtggaggtatcgcggtaggtgcgacagtatacagtttgcggtggacaagcgtgtgttcatcgccgggtttggtctctacggatcgagctgtggtagcgctgagtactcagcaaagatcgagctgaaacgccagggagttgtgctgggccagaacctcagtaagtactttagcgatggctctagtaataccttccccgtgtggttcgagtatcctgtgcaaatcgagcccgatactttttatacagcttctgtgatactggacggcaatgaactgagctattttggacaggagggtatgaccgaggtccagtgtggaaaggttactgttcagttccagtgcagcagtgactctaccaatggaactggcgtgcagggcggacagatacccgaattgatcttctacgcatag

SEQ ID NO: 44598 - DNA, 1569 bp, Artificial Sequence
  Description of Artificial Sequence: Synthetic coding sequence
atggtggacgacaaggagaagaacatgaagtgcctgaccttcttcctgatgctccccgagactgtgaagaaccgctcaaaaaaaagctccaaaaaagcaaatacgtccagtagtagtagcaatagctcaaagctgccacccgtctgctatgagatcatcacattgaaaacgaaaaagaaaaaaatggccgcagatatctttcctaggaaaaaacctgctaacagctctagtacctctgtgcagcagtatcatcagcagaatttgtctaacaataatctaatcccagcaccgaactggcaggggctttatccaactatcagggagcgtaacgcaatgatgttcaacaatgacctgatggccgacgttcactttgttgtcggccccccaggcgggacacagcggctgccgggccacaagtacgtgctcgcagttgggtctagcgtgttccatgccatgttctacggggaactagccgaagacaaggatgaaatccgcattccggatgtcgaacctgccgcctttctggcaatgttgaagtacatctactgcgatgagattgacctcgccgcagataccgtgctcgctaccctgtacgctgccaagaagtacatagtgccacatcttgcgcgagcctgtgtcaactttctggaaaccagtctgagcgccaaaaacgcctgcgtcttgctatctcaatcctgtttgttcgaggagcccgacttgacacaacgctgttgggaggtcatagatgcacaggccgagctcgctctgaagtctgaaggattctgcgatattgacttccagactcttgagtcgattctgcggcgtgaaaccctgaacgctaaagaaattgtggttttcgaggccgcgctaaattgggcagaggtcgagtgtcaaaggcaggacctagctctgtctatcgagaacaaacgcaaggtgctgggcaaggccctttacctcatccgcattcctaccatggctctagatgactttgccaatggagccgcccagtccggggtcctcaccctgaacgaaaccaacgatatatttttgtggtacaccgctgctaagaagcctgagcttcaattcgtcagcaaagcccgtaaaggtctcgtccctcagagatgtcacaggttccagtcctgtgcctatagaagtaatcagtggcgataccggggaaggtgcgattcaattcagttcgccgtggataaaagggtgtttatcgcaggcttcggcttgtacggatcaagctgtggctccgcagagtactccgcgaagatcgagctcaagcgccagggtgttgtcctggggcagaacctgtccaaatatttctccgatgggtcaagtaatacctttcccgtgtggttcgagtatcctgtgcagattgagccggataccttctataccgcctcagtgatcctagacgggaacgaattaagctatttcggtcaggaaggaatgactgaggtacagtgcgggaaggtgaccgttcaattccagtgcagtagcgactccacaaatggaactggagtgcaggggggtcaaattccagaactgatattctacgcttag

SEQ ID NO: 44599 - DNA, 411 bp, Artificial Sequence
  Description of Artificial Sequence: Synthetic coding sequence
atggccgccgacatcttcccccggaagaagcccgccaacagcagctccacctctgtacagcaataccaccagcagaacctatccaataacaacttgattcccgcgcctaattggcaggggttgtacccaactattcgagaacgtaatgcaatgatgttcaataacgatctcatggctgacgtgcattttgtggtgggtcctccaggaggaacccaaagactgcctggccataagtacgttctggctgtcggatcctccgtgtttcatgccatgttttatggagagctagccgaggacaaggacgagattaggatccctgatgttgagccagctgcctttctagccatgcttaaatatatttactgcgacgagatcgacttggccgccgatacagtgctggcaactttgtag

SEQ ID NO: 44600 - DNA, 9 bp, Artificial Sequence
  Description of Artificial Sequence: Synthetic coding sequence
atggcctag

SEQ ID NO: 44601 - DNA, 1860 bp, Artificial Sequence
  Description of Artificial Sequence: Synthetic coding sequence
atggccgccgccccccccctgagcaaggccgagtacctgaagcggtaccttagtggcgctgacgctggcgttgaccggggttccgagtctgggcgcaaacgacgaaaaaagcggcccaagcctgggggcgccggtggcaaggggatgcggatagttgatgatgatgtctcgtggacggctatctccaccaccaagctcgaaaaggaggaggaagaggacgatggggacctccctgtggtggcggagttcgtggacgaacggcccgaggaggttaaacaaatggaggccttcagatcaagcgctaagtggaagctgctgggcggtcataacgaagatctccccagtaatagacacttccgacacgacactcccgactcatctcccaggagggtcaggcacggcacacccgatccatcccccaggaaggaccgtcacgacacccctgatccatctccacgaagagccagacacgacacccctgacccctctcccctgagaggcgcccgtcacgactccgacacaagtcccccaaggcggataagacatgatagctcagatacttcaccccctagacgggcaagacatgattctccagatccaagcccgcctcggcggccgcagcacaattcaagcggcgcttccccgaggagggtccggcacgactcccctgacccctcaccaccacggcgggcgagacacggctcctccgatatctcctccccgagaagagtccacaacaatagccctgatacatccaggaggactctcggttcctctgatactcagcaactccgtcgggcacggcacgactcacccgacctcgcccctaacgtaacctatagtttaccaaggaccaaatccggaaaagccccagaaagggcctcgtctaaaaccagcccccattggaaggagagcggcgcctctcatctcagttttcccaagaatagcaagtacgaatatgacccagacatatcgcctccgcgaaagaaacaggccaagagtcactttggtgacaagaagcaattggattccaagggcgactgtcagaaggccactgactccgacctctccagtcccaggcacaaacaatcgcccggccaccaagactcggactcagacttatcccccccacggaaccgccctcggcatagaagttctgacagcgatttgagtccccccaggaggcgccaaagaacaaaaagctctgatagtgacctatctccacctcggagaagtcagccccccgggaaaaaggcggcacacatgtatagcggtgctaagaccgggctggttctgacagatattcaacgagagcaacaagaactgaaggaacaagaccaggaaacaatggcgtttgaggctgagttccaatacgccgagacagtatttagagataagtccggacgtaagaggaatcttaaactggagcggctggaacagcggcgaaaggccgaaaaagactccgaacgcgacgagctgtacgctcagtgggggaagggtctggcgcagtccaggcagcaacagcaaaatgtcgaggacgctatgaaggagatgcagaaacccctggcacggtacatagacgacgaagaccttgaccgaatgcttcgcgaacaggagcgcgagggcgaccctatggccaatttcattaagaagaacaaagctaaggagaataagaacaagaaggttagaccaagatattccgggcccgcccctccgcccaaccgttttaacatttggcctgggtatcggtgggacggcgtggaccgttccaacggctttgagcagaagaggttcgctcgcctggccagcaaaaaggcagtcgaggaactagcatataagtggtcagtggaagacatgtag

SEQ ID NO: 44602 - DNA, 1458 bp, Artificial Sequence
  Description of Artificial Sequence: Synthetic coding sequence
atggccgccgccccccccctgagcaaggccgagtacctgaagcggtatctgtctggtgcggatgctggagtggacaggggatctgaatctgggcggaagagaagaaagaagcgccccaaaccgggtggggccggcggcaagggcatgcgaatagtggacgacgacgttagctggacggcgatctctacgacaaagctggagaaagaggaagaggaagacgacggagacttaccagtagtagcagaattcgtagatgagagaccagaagaagttaaacagatggaagcatttaggtcctcggccaagtggaaactacttggcggtcacaacgaagacctcccgtcaaatcggcactttcggcatgatactccagacagttcacctagaagggtgcggcacggaacccccgatccttcgccaagaaaagaccgtcacgatacacctgatccttcacccaggcgggctagacatgataccccagacccgtcacccctcagaggagcccgacacgactcggatacatcacccccgcgcaggatcagacatgatagttcagatacctctccgcctagaagggctagacacgattcccccgatccttctcctccccgaaggccccagcacaatagctcaggggactgtcaaaaagccacagattccgatcttagcagccctaggcataaacaatctcccggacaccaggattctgattctgacctgtctccaccacgtaataggcctcggcaccggagcagcgatagcgacctcagcccaccgcggaggcgtcaacgtactaaaagtagcgatagcgacctcagcccaccaaggaggagccagcccccaggaaagaaggccgcacacatgtactcaggcgccaaaactggtctcgttttgaccgacattcagagggagcaacaagagctaaaagaacaggaccaggagaccatggcttttgaggccgaattccaatatgcagagaccgtattccgtgataaaagcggtagaaaacgcaacttaaaactggagcggctcgaacagagacggaaggctgaaaaggatagcgagagagatgaactgtatgcccaatggggcaaaggcctggctcagtcacgacaacagcagcaaaacgttgaagacgcaatgaaggagatgcagaagcccttggcaaggtacatcgacgacgaggacctggaccgaatgctgagagaacaggagcgggaaggtgacccaatggcaaattttattaagaagaacaaggctaaggagaataaaaataagaaagtacggccccgctacagcggcccggcacccccacccaaccggtttaacatctggcccggataccgctgggacggggttgatagatctaacggttttgagcaaaagcgattcgcgaggttagcatcgaagaaggcggttgaagagttggcttataaatggagcgtggaggatatgtag

SEQ ID NO: 44603 - DNA, 600 bp, Artificial Sequence
  Description of Artificial Sequence: Synthetic coding sequence
gcccccggccggctggccagccggcccccccccccccccgcccggcgctggagactcgctgcaccccggtactcttccgcaagtggcccctctggcccagcggcacgactttgcgccgaaacccagggggaagcccctcgcggaccccgtgcagtgggcgggagtggcggggctggcgaaccccgatggagtaggggtcctgcccaaagagaaagattgctgggctgttcatgctgttttccaagttttttcactgggacttgctctttccgaacatcttggagtgcattcacactggagctaacttcatctattcccgctccactgccccctcctcctgcagccttgagcctgagtcaacagcaggggaagtcccgacgcaaggaagcgtctacacccctgactccagctgaggccccggcttacagtcgcgctaggccgcgccgccaggggagtccttcagcgggacctgaggcccctttagctacggatgaacctcccccgcaaaggcggagcggaataagaggtggctctgctaatattagatctttgcagccaagctccctccgaccctcggcacatcgaggctctgccctgtag

SEQ ID NO: 44604 - DNA, 1185 bp, Artificial Sequence
  Description of Artificial Sequence: Synthetic coding sequence
atgagccggatctaccacgacggcgccctgcggaacaaggccgtgcagtcggtgcgactcccaggtgcctgggaccctgcagctcatcagggcggtaatggagtcctgctggaaggcgaactgatcgacgtgagtcgccattctatactggatacacatggacggaaagaaaggtactatgtactgtatatcagaccttcacatatacatcgccgtaagttcgatgctaaagggaacgagattgaacccaacttttccgccactcggaaggtcaatacaggatttctgatgagttcttacaaagtggaagcgaaaggggacaccgatcgattgacccccgaagccctaaaaggccttgtgaacaaacctgaactcctagccctcaccgagagtctcaccccagatcacacggtagccttttggatgccagaatcagagatggaggttatggaattggaactcggggcgggcgtgagactgaagactcggggcgatgggccattcctggactctttggccaagctcgaggctggaaccgttaccaagtgcaattttaccggagacggtaagaccggggcaagttggactgataacattatggcccagaaatgctctaaaggtgccgccgccgaaatccgggagcaaggggacggtgccgaggacgaggagtggcctgaggaaattcagcagcagattgtgcgtgagacattccatctggtgctgaaaagagacgacaacatatgcaattttctggagggaggatccctgattggcgggtcggattacaagctgatctacagacattacgcaacactgtactttgtattttgcgttgactcatccgagtcagaactcggcatcctcgatctgattcaggtcttcgtggagacccttgacaaatgcttcgagaatgtttgcgagcttgacctcatctttcacatggacaaagtgcattacatcctgcaggaagtggtgatgggcgggatggtcctcgagaccaacatgaatgagatcgtagcccagatcgaagcccagaatcgactggagaaatccgagggtggtctgtcagccgcccctgcaagagctgtgagcgccgtcaagaatattaatctgccagagataccgaggaacatcaacattggagatttaaacatcaaggtgcccaacttgtctcagttcgtgtag

SEQ ID NO: 44605 - DNA, 1176 bp, Artificial Sequence
  Description of Artificial Sequence: Synthetic coding sequence
atggccggcagcatggtgacccccctgctgtaccggcggaagctgaggccaggcgagaggaaaatgaggccggaggtcgggagggaacctgctgcccttcaacctcgccagaggcctaggagtgatcaccagttacaccgctcccctttcacagtgcccccacggacccccgcctgtagatctcccggtccctctccccccatcgccgtagcattagaagtgaaaccgcagctcgaggacgccgtgggtaagctcgctgccgaggccgttgctgtcagggtgttccccctggcagttgacgacttagagtctgatgtcctcgtgggccgccctcgggttgaagcccaggacggagagatcttggtggtcggggccggactgcaggaagtcctcgggcgaggagctctcgtcgacgaagttggagtcgaggatgtggagttggtgtcacttcacgacctcgggagatgggtcgtgaaggtggtcgtgcggttagtcgttctcgtacctctcgaagcccgagtgcatgctgttgaggaggccagactggcttggccggtattagtagggccccaggttggtcttgccggggagtggcatcttcacgcggaattgcgacttgtcctggcacacgcgttgctgggaccacctgaagaagacgtgcttggggccttagcaggagtcagcagagacctggaattactggctagagagctgcaggcactccaggtgctcatacgattccagcatgttagagtgcagtggcagctggtgcgacgggagcagccccgcgccgtgcccgccggtgtggtcgtggttcaggctctcttagaccaggttctattacacgagcatcggctggccctggcgctggctttgacggtacctgtagctgtggctctctgcagagggcgggccgtgcacctgggcctaagaggtgcggcattgagaggcggccccggtcgcggtgggcggagagtgcttcgactgcaggcggctgcaggcggactcgggctgctcctggaggacggagaacagcggcttgctctgcacgcgttgctcctgctgcagtttgtccaactgctgccgcaacatgttcttgtagcccttacgcagccgtctgcccaccgggcacgagcgatgtgggcgaggtcctgttgtcgccgcctttcccagtag

SEQ ID NO: 44606 - DNA, 1062 bp, Artificial Sequence
  Description of Artificial Sequence: Synthetic coding sequence
atgtggctgctggagaaggccggctacaaggtgggcgccgccgagcccgctgcccggtgggcaccatcaggattgttctccaagaggcgtgctcccgggccacctacgtctgcctgtcctaacgttctgactccagatcgcattcctcagttcttcatcccgccaaggctcccagatccaggcggggctgtcccagcggcccgtcgacatgtcgccggccggggacttccagcaacatgtagccttccgcacctggcaggccgtgaggggtgggccttcctgcccgagtcccctcacacccgtcgccgcgagtccctgtttcatggcccccctccagcgcccgctggcggcttgcctgccgctcaaagccgactgcacgtgtccgctcctgacttacggctttgtcgggctccagacagtgatacagcctccagtcctgactcgtcaccctttggtagccccaggcccggattaggcaggagaagggtttcacgaccacatagtctctcaccggagaaggcctcgtcggccgatacctcaccccattcgcctagaagggccgggccccccacccccccgctgtttcacctggacttcctttgttgtcagctccgtcctactagagagtccgtgttgcggctgggtccccgcggcggccagctccgactgagcaccgaataccaggccggacccgggcgcctcaggttgcggttggtgagcgccgagggcttgccacggccaagatctcggccgggaagtggcggcggagggtgttgcgtggttctgcggttacggccccgggtgcgtccgcgggaacagcagagtcgggtagttaaatgcagtgcaaacccgatcttcaacgaagacttcttttttgacgggttaggaccccctgacctcgccgcacggtcactgagagcaaaagtgcttgaccgaggcgctgggcttcgtcgggatgttctgctgggtgagtgtgagacaccccttattgcactgctgcccccccttggagggggtttaggacccgggtcatccctggcgcctacacacctttctctctag

SEQ ID NO: 44607 - DNA, 2124 bp, Artificial Sequence
  Description of Artificial Sequence: Synthetic coding sequence
atggaccccggctggggccagcgggacgtgggctgggccgccctgctcatccttttcgccgcgagtctgctgactgtgtttgcttggctgctccagtacgccaggggactgtggcttgctcgggcaagaggtgaccggggccctggaccagccctggccggggagcccgccgggtcgctccgagagttgggggtgtggagaagccttctgcgcctgcgggcaacacgcgccggggctgctgaggagcctggggttagaggattgctggcgtcactgttcgctttcaaaagttttagggagaactggcagagggcttgggttagggcactcaacgagcaagcctgtaggaacgggtcatctatccaaatcgcattcgaggaagttccccagctgccaccacgagcttccatcagccacgtgacatgcgtggaccagagcgaacatactatggttttgaggtgtcagctgagcgcagaggaagtgagattccccgtctcagtgacacagcagagccctgccgccgtgagcatggaaacataccacgtgacattgaccctgccaccaacacagttggaggtgaaccttgaagagattcctggtgagggattgcttataagttgggccttcacagaccgacctgacctgagccttacggtgctgccaaagctgcaggcgcgtgaaaggggggaagaacaggtggagctttccactatcgaagaactgatcaaggacgccatcgtgtcaacacagcccgctatgatggtgaacttacgggcatgtagcgcacccggtggactggtgccttccgaaaagccccctatgatgccccaggcccagccagctattccgaggccgaaccgcctcttcctacgccaactccgagcaagtcatctgggcaatgaactggaaggcaccgaagagttatgttgtgtagcagaacttgataaccccatgcagcaaaaatggacaaagcctgccagggcgggctccgaagtggagtggaccgaggacctagcgttagaccttgggccgcagtctcgggaacttacattaaaagtgctgagatccagctcctgcggagatacggagctgctcggccaggccaccctgcccgttggctctcctagtaggcccttgtcgcgtcggcagctgtgtcccctcacacccggccccggcaaggctctgggacctgcggccactatggcagtggaattacactatgaggagggaagcccaagaaatctgggtaccccaacatcctcaactccccgcccgagcatcaccccaactaagaaaatcgagctggatcggactattatgcctgatgggaccattgtgacaaccgtaacaactgtgcagagcaggcctcgcattgatggtaagttggactccccatcgaggagtccatccaaggtggaagttaccgagaaaacaaccacagtcctgagcgagtcaagtgggccctcgaatacatcacatagttcctctcctggggattcccatctgtccaacggtctggaccccgttgccgagaccgctattagacagctgaccgagccaagcggccgcgtggctaaaaagacgcccactaaaagatcaaccctcataatctctggtgtgtccaaggttccaatcgcacaggatgagttggccctgtctctgggctatgcagctagcttggaggcttcagtccaggatgacgcaggaactagtgggggcccctcatcgcccccttcagatccccccgcgatgtctccaggccccctcgacgccctctcgtctcccacgagcgtgcaggaggccgatgaaacaactcgtagtgacatatccgagagaccgagcgttgacgatattgagtccgaaaccgggagtacgggggccctggagaccaggagcttgaaagatcataaggtatcttttctgcggagtggtacaaagctgatctttaggcgtaggccacggcaaaaagaggccggcctgagccaatcccacgatgacctgtccaatgccaccgccaccccctccgtgaggaagaaggctgggtcctttagtaggcggttgatcaagcgcttcagcttcaaaagcaagcctaaggccaacggtaacccttctccccaactgtag

SEQ ID NO: 44608 - DNA, 840 bp, Artificial Sequence
  Description of Artificial Sequence: Synthetic coding sequence
atgatcaaccagctgaccggcaccatccaggtggcccagcggatcgatcgggatgctggcgagctgaggcagaaccccaccatctctctggaagtgctggtgaaggaccggccatacggaggacaggagaatagaatccagataacattcatcgtggaagacgtgaacgacaacccggccacatgtcagaaatttaccttcagcatcatggtaccagagcggacagccaaagggactctgctgctggatctaaacaagttttgtttcgatgatgactcagaagcacctaataacaggttcaattttaccatgccatccggcgttggttccgggagtaggtttctgcaggaccccgctggaagcggaaagattgtgctgattggcgacctcgactatgaaaatccaagtaacctggctgccggtaacaagtatacggtcataatacaagtacaagacgtggcccctccatattacaaatccaaatataacgtatatgtgtacattctgacatccccggagaacgagtttcctcttatatttgaccggccttcctacgtattcgacgttagtgagcgaaggcccgcccagggacatctaagcggaccagaagaaaagaggttgctgagtatttgtatggtaagggcagtttgccatcattttggactgcacatcgccagcggcagccctcgcgtgcccggcaggccaatcgggcagagtcacccgcagacactccccctgcaggactgggaagagcagggcacttctgttcgagaaatacctaacgaagactgccgcgaacggcgccgtggcgggaactacccggacgaacactacctctag

SEQ ID NO: 44609 - DNA, 957 bp, Artificial Sequence
  Description of Artificial Sequence: Synthetic coding sequence
tacaccgtgctggaggagctgagccccggcaccatcgtggccaacattaccgccgaggatcctgacgacgagggcttcccatcccacctgctttactccatcacgacagtcagtaagtatttcatgatcaaccagttgaccgggaccattcaggtggcccagcggatcgaccgagatgccggagagctgcgacagaaccctaccatctcccttgaggttctcgtgaaagatagaccctatggaggacaggagaataggatccagattacgtttatcgttgaagacgtgaatgataatccagccacatgtcaaaagtttacattctcaatcatggtccctgaaagaacagccaaaggaactctcctactcgacctgaataaattctgtttcgacgatgattccgaggccccaaacaatcgatttaacttcaccatgcccagcggcgttggcagtggttcccggtttctacaggacccggctggaagcgggaagattgtattgatcggagacctggactatgagaacccgagcaacttagcagcggggaacaaatacactgtcatcatacaggtgcaagacgtggcccctccttattataagaacaatgtgtacgtatatattttaacttcacccgaaaacgagtttccattgatatttgaccgtccttcctacgtgttcgatgtgtctgaacgaaggcccgcccaggggcatctgtctgggccggaagagaaacgactgctgtccatatgtatggtgagagcggtatgtcaccattttggactgcatatagcctcaggaagcccacgagtgcctggacggccaatcgggcaatcacacccacagacactgcccttacaggattgggaggaacaaggaacctccgacaaggaaagaagaaatgaggattgtagggaaaggaggcggggtgggaattaccccgacgaacattatctttag

SEQ ID NO: 44610 - DNA, 450 bp, Artificial Sequence
  Description of Artificial Sequence: Synthetic coding sequence
atgcaggaggccatcatcctgctggccctgctgggcgccatgagcggcggtgaagcactgcacctgatcctgttgcccgcgaccggcaacgtggccgagaattcgccaccaggcacatcagtccacaagtttagtgtgaagctctccgcatctttgtctccagttataccagggtttccacagattgtcaatagcaacccactgaccgaggccttccgggtgaactggctgagcgggacctattttgaagttgtaactacaggaatggagcaactggacttcgagacaggacctaacatcttcgatcttcaaatctatgtgaaagatgaggtgggggtcacagacctgcaagtgttaaccgtgcaagtgacggacgtgaacgaaccgccccagttccagggaaacctagccgaagcccgccacgaatgcactcagagctggcgaaattag

SEQ ID NO: 44611 - DNA, 2658 bp, Artificial Sequence
  Description of Artificial Sequence: Synthetic coding sequence
atgcaggaggccatcatcctgctggccctgctgggcgccatgagcggtggcgaggcacttcacctcatcctcctgccagccacggggaacgtggcggaaaacagtcccccaggtacatcagttcacaaattctcggtgaaactctccgccagtctgagcccggtcattcctgggtttccacagatcgtgaactctaacccactgaccgaagcttttcgtgtgaactggctatcgggcacatattttgaggtagtaacgaccggaatggagcagctagatttcgagaccggtcctaatatctttgacctgcagatttacgtgaaagacgaagtcggcgtcactgacttgcaggttctgactgtccaagtcacagatgtgaatgaacctccacagttccagggtaatctggccgaggggctgcacctttatatcgtggagcgagccaaccccggtttcatctaccaagtcgaggccttcgaccccgaagacacgtctcgaaacatcccattgtcctatttcctcatatctcctcctaagtcatttaggatgagtgctaatggcacactgttctccactactgagctggattttgaggcggggcacagatctttccacctgattgtggaagtgagggattctgggggacttaaggcatccacagagctccaggtcaacattgtgaacttgaatgacgaggtccccagattcacttcacccacacgggtgtacaccgtgcttgaagagctgtcgccaggtactattgtggccaacataacagccgaggacccagatgatgaggggtttccctcccatctgttgtacagtattactactgtgtcaaaatactttatgatcaatcagctcaccggcaccatccaggtcgctcagcgtatagaccgtgatgcaggggagctccgacaaaaccccacaattagcctagaggtgctcgttaaagatcgcccttacgggggccaggagaacagaattcagatcacatttatcgttgaggatgtcaacgataatccagcaacgtgccaaaaattcacattttctattatggtacccgaacgcacggcgaaggggaccctgcttctcgacctgaataagttctgcttcgatgatgactccgaggcccctaacaataggttcaattttactatgccctcaggcgtcgggtctgggagcagattcttgcaagaccccgctggcagcgggaaaatcgtccttattggcgatcttgattatgagaacccaagcaatctggcggccggaaacaagtataccgtgatcatccaggtacaggatgtcgcacctccttactacaagaataacgtgtatgtctacattctgacaagccccgagaatgaattccctttgatctttgatagaccctcttatgtgtttgacgtcagcgagagacggcctgcccggacgagagtcgggcaggttcgagctacggacaaggatcttccacagagctctttgttatactctatctcaactggcggagcctctctccagtacccaaacgtgttttggattaacccaaaaactggggagttacagctggtaactaaggtcgattgtgagacaactccaatttacattctacggatccaggctaccaataatgaggatacttcatcggtgaccgtgacagttaatattctggaggagaatgatgagaagccgatctgcactccaaacagttacttcctggctcttcccgtagacttgaaagtgggaacgaatatccaaaatttcaagctaacctgcaccgacctggattcttcacctcgcagttttcgctatagcatcggaccagggaatgttaataatcattttactttttctcctaatgccgggtcgaatgtgacacgtttattgctcacatcccgcttcgactacgccggcggttttgacaagatctgggactacaagctgctggtgtatgttactgacgacaatttaatgtccgaccggaaaaaagcggaagccctggtggagacgggcaccgttacactctccattaaagtgatcccccatccgaccactattatcacaacaacacctaggccgcgtgttacttaccaggttctgcgaaaaaacgtctactctcccagcgcctggtatgtgccattcgtgattaccctgggtagtatattgctgctgggactgctggtgtatttggtcgtgttacttgcaaaagcaatccaccgccactgcccgtgtaagacaggcaagaacaaggaacccctgaagaagaagacggagaccaagactgccgaacgggatgttgttgtcgagaccatccaaatgaataccattttcgacggtgaagccatcgaccccgtgaccggtgagacatatgagttcaattctaagaccggagcacggaagtggaaggatccccttacccagatgccaaagtggaaagaaagtagtcatcagggagctgcgccgcgtagggtgacggccggtgagggcatgggcagcctgcgttcagcaaactgggaggaggatgagttatccggaaaggcctgggcagaagacgctggtctcgggagcaggaacgagggcgggaagttaggcaaccccaaaaatcggaacccagcatttatgaatagggcctaccccaagcctcatccaggtaaatag

SEQ ID NO: 44612 - DNA, 945 bp, Artificial Sequence
  Description of Artificial Sequence: Synthetic coding sequence
atgagcgccgccgaggccggcggcgtgttccaccgggcccggggcaggacacttgccgcctttccggccgagaaggagtcagagtggaaaggccccttttacttcatactgggcgccgatcctcagtttggtctgatcaaagcctggtccacaggggactgtgacaacgggggagatgagtgggagcaggaaatccgtctgacagaacaggccgtacaggccattaataagctcaatccgaagcctaagttctttgtcctttgcggggacctcatccacgccatgcccgggaagccatggaggaccgagcagaccgaggacttgaaacgagtccttagggcagtcgatcgcgccattcctctggtgcttgtgtctggcaaccatgacatagggaatacccccaccgccgagacagttgaggagttctgccggacgtggggcgacgactatttttccttctgggtaggaggcgtacttttcctggttcttaatagccagttctatgaaaatccttcaaagtgtccctctctgaaacaggcccaagatcagtggttagatgagcagctttcgattgctcggcaacggcattgtcagcacgccatcgttttccagcacatcccacttttcctggagtcaatcgacgaagatgatgattattacttcaacttgtccaaatcaacaagaaaaaagctcgcggataagtttatccatgccggtgtgaaggtggtgttttctggtcactaccataggaacgccggagggacatatcaaaacctggatatggtggttagctctgccattgggtgccaactagggcgggacccccacgggctgcgagtcgtggtcgtgacagcggaaaaaattgttcatcgctactattcacttgacgagctgtctgagaagggaatcgaagatgacctcatggacttgatcaagaagaaatag

SEQ ID NO: 44613 - DNA, 519 bp, Artificial Sequence
  Description of Artificial Sequence: Synthetic coding sequence
atgagcgccgccgaggccggcggcgtgttccaccgggcccggggcagaactctcgcagcatttccggctgaaaaggaatccgagtggaagggccccttttactttatcctgggcgccgacccgcaattcggactgatcaaggcttggtccacaggggattgtgacaacggaggtgacgaatgggagcaggagatccggttgactgagcaggctgtccaagccatcaacaagctgaatccgaaaccaaaattctttgtgctgtgcggtgatctaattcacgcaatgccaggcgttaaggtggtgttctcggggcactaccacagaaatgctgggggcacctaccagaaccttgacatggtagtgagctccgccatcggctgccagctcggtagagatcctcatggtctgagggttgtggtagttacagcagagaagatcgtgcaccgttactacagtctggatgaactgtccgagaaaggtatcgaagatgatctgatggacttgatcaaaaaaaaatag

SEQ ID NO: 44614 - DNA, 426 bp, Artificial Sequence
  Description of Artificial Sequence: Synthetic coding sequence
atgggcttccagaagttcagccccttcctggccctgagcatcctggtcctcttgcaggccggatcacttcatgccgccccgttcaggtccgctctcgaaagtagccccgcggatcctgccactctgtcggaagatgaggcgcggttgttactggcagctctggtccaggattatgtccaaatgaaggcaagcgaactggagcaggaacaagagcgcgaagggtctagtctcgactctcctcggtcgaagcgttgcggcaacttatccacttgtatgttgggaacatatacacaggacttcaataagtttcatacctttccccagacggcaattggcgttggagcccctgggaagaagagggacatgtcatcagacctggaaagagaccaccgcccgcacgtcagcatgccacagaatgctaactag

SEQ ID NO: 44615 - DNA, 564 bp, Artificial Sequence
  Description of Artificial Sequence: Synthetic coding sequence
atgggcaacaagcagaccatcttcaccgaggagcagctggacaactaccaggactgtaccttttttaataaaaaagatatcctgaagctccactcacggttctacgagctggctcccaacctggtgccaatggactacagaaaatccccaattgtgcacgttcctatgtcgcttattatacaaatgcccgaattgagggagaatccatttaaagagaggatcgtggctgccttctctgaggacggcgaggggaatttaaccttcaacgacttcgtggacatgttttcagtcctgtgcgagtcggcacccagagagctcaaggcaaattatgcttttaagatttatgatttcaataccgataactttatttgtaaggaggatttggagctcactttagcccggctgactaagtcggaactcgacgaagaagaagtggtcttggtctgcgataaggtgattgaggaagcggacctggacggagacggcaagttaggcttcgccgacttcgaagacatgatcgcaaaggcccctgactttttaagtaccttccacatcaggatctag

SEQ ID NO: 44616 - DNA, 564 bp, Artificial Sequence
  Description of Artificial Sequence: Synthetic coding sequence
atgggcaacaagcagaccgtgttcacccacgagcagctggaggcctaccaagattgcaccttcttcacccgtaaggaaatcatgcgcctgttctatcgttatcaggacctggctccccagctggttccacttgattacaccacctgtcctgatgtgaaggtgccctatgagcttatcgggagtatgcctgaattgaaggataatccgttccggcagagaatagcccaggtgttttcagaagacggggatggacacatgaccctcgataactttcttgacatgttctcagtgatgtccgaaatggccccacgggacctgaaagcttactatgccttcaagatttatgactttaacaacgacgattatatatgcgcatgggatttggaacagactgtaactaaactgactagaggaggcttgtcagcagaggaagttagcctggtgtgcgaaaaggtgctcgacgaggcagacggggaccatgacgggcgcctgtcactagaggatttccagaacatgattctcagagcacccgactttctgtccacgttccacattaggatctag

SEQ ID NO: 44617 - DNA, 417 bp, Artificial Sequence
  Description of Artificial Sequence: Synthetic coding sequence
atgggcaacaagcagaccgtgttcacccacgagcagctggaggcctaccaagataacccattccggcagcgcatcgctcaggtcttttccgaggatggggatgggcacatgacccttgataatttcttggatatgttctcagtcatgtcagaaatggcaccccgcgatcttaaggcttattatgcattcaaaatttacgacttcaacaacgacgactatatatgtgcttgggatttggaacagactgtcacaaaacttacccgagggggactctccgccgaagaggttagcctggtgtgcgagaaagtgttggacgaggccgacggagaccatgatgggcgcttatcgctcgaagactttcagaacatgattctgcgagccccagatttcctttccacctttcatatccgaatctag

SEQ ID NO: 44618 - DNA, 93 bp, Artificial Sequence
  Description of Artificial Sequence: Synthetic coding sequence
atgggcaacaagcagaccgtgttcacccacgagcagctggaggcctatcaggactgtaccttttttacccgtaaagagattatgcggttttag

SEQ ID NO: 44619 - DNA, 558 bp, Artificial Sequence
  Description of Artificial Sequence: Synthetic coding sequence
atgggccagtgcctgcggtaccagatgcactgggaggacctggaggagtaccaagctctgacttttctgactcggaatgagattctgtgtattcacgacacatttctgaagctttgccctccaggcaagtattataaagaggccacactgacaatggatcaagtgtccagtctccccgcattacgggtaaatcctttcagagatcggatttgtcgagtcttttcgcacaagggcatgttcagctttgaggacgttctggggatggcttccgtgttctctgagcaggcatgtcccagtcttaaaattgaatatgctttccgtatctacgacttcaacgaaaacggattcattgacgaagaagacctgcagcgaattatcttgcggttgctgaatagcgacgatatgtctgaagatctattgatggatctgacaaaccacgtgctgagcgagagcgatttggacaacgataatatgctgtctttttctgagtttgagcacgccatggctaagtcaccagattttatgaactccttcaggattcatttttggggctgttag

SEQ ID NO: 44620 - DNA, 450 bp, Artificial Sequence
  Description of Artificial Sequence: Synthetic coding sequence
atggccgccgagcacctgctgcccggccccccccccagcctggccgatttcaggttggaagcaggcgggaaaggtaccgagagagggtccggaagctcaaagcccaccggaagctctagaggaccaaggatggcaaagtttctttctcaggaccagattaacgatgggaacggggagcttgatttttccaccttcctcacaatcatgcacatgcagatcaagcaagaggatcccaagaaggaaatactactggccatgctgatggtcgataaggaaaaaaagggctacgttatggctagtgacctgcggtccaaactgacatcccttggggagaaactcactcacaaggaggtggatgacctgttcagggaagcagatatcgagcccaacggcaaagtgaagtatgatgagtttattcataaaataacactgccagggcgtgactactag

SEQ ID NO: 44621 - DNA, 591 bp, Artificial Sequence
  Description of Artificial Sequence: Synthetic coding sequence
atggccgccgagcacctgctgcccggccccccccccagcctggccgacttccgacttgaagccggggggaaagggactgagagggggtccgggtcaagcaaacctacggggtcatccagagggccgcgcatggcaaagtttcttagtcaggatcagataaacgagtataaagaatgtttttcactgtatgataaacagcagcgaggaaaaattaaagccacagatctgatggtggcaatgcgctgtttgggcgctagcccaacacctggtgaagtgcagcgacacctccaaacacacggaatcgatggaaacggggagttggatttcagtacattcctgacaatcatgcacatgcagatcaaacaagaggatccaaaaaaagaaatccttctcgcgatgcttatggtggacaaagagaaaaaaggctatgtaatggcatccgatctccggagcaagctcacctctttgggcgaaaagctgacgcataaggaggtcgacgatctcttccgcgaagctgacattgaacctaatggcaaggtgaaatatgatgagttcatacacaagattaccctgcctggccgcgactattag

SEQ ID NO: 44622 - DNA, 363 bp, Artificial Sequence
  Description of Artificial Sequence: Synthetic coding sequence
atggtggccatgcggtgcctgggcgccagccccacccccggcgaggtgcagagacacttgcagacccacggcatcgatggaaatggagaactcgacttttccacattcctcacaatcatgcatatgcagattaagcaagaggatccgaaaaaggaaattctgttggccatgctgatggtggataaggagaaaaagggttacgtcatggctagcgacctcagaagcaagctaactagcctaggtgaaaagctgacccacaaagaggtggatgacctgttcagagaggcagacatcgaacccaatggtaaggtgaaatacgacgagttcatacacaaaatcactctgcccggcagagactactag

SEQ ID NO: 44623 - DNA, 441 bp, Artificial Sequence
  Description of Artificial Sequence: Synthetic coding sequence
atggccggcgagctgacccccgaggaggaggcccagtacaagaaggctttttccgccgttgacaccgacgggaatgggaccattaatgcccaggaactgggagcggccttaaaggccaccggaaaaaatctttccgaggcccagttgcgaaaactgataagcgaagtagactcggacggggacggagaaattagcttccaggaatttctcactgcagctaagaaggcccgcgccggactcgaagacctccaggtggctttccgagctttcgaccaagatggagatggtcatataacagtggacgagctccgtcgggctatggcaggcctcggccagccactgccccaggaggagttggacgctatgattagggaggcggatgtggatcaagatggaagagttaattatgaagagtttgctaggatgctggcgcaggagtag

SEQ ID NO: 44624 - DNA, 2010 bp, Artificial Sequence
  Description of Artificial Sequence: Synthetic coding sequence
atggcctactaccaggagcccagcgtggagaccagcatcatcaagtttaaggaccaggactttacaacactgagggatcactgcctttcaatgggcagaactttcaaggacgagacgtttcctgccgccgactccagcatcggccagaagttgctacaggagaagcggttgagtaacgtgatctggaaacgccctcaggatctgcccggcgggccccctcactttattctggacgacatatcccgctttgatatccaacaaggtggagctgcagactgctggtttcttgctgctctgggtagcctgacacagaacccacagtacagacagaaaatcttgatggtgcagtccttcagccaccagtatgctggcatctttagattccggttttggcagtgcggccagtgggtcgaagtggttatagacgatcggctgccagttcagggtgataaatgtctattcgttaggccccgacaccaaaatcaggaattttggccatgtctgctcgagaaagcatatgccaaattactgggctcctattccgatctgcattacgggttccttgaagatgcactggtggatctcaccgggggagttattacaaacatacacctgcacagctcccctgttgacctcgttaaagcagtgaaaactgccaccaaggcagggagtctcataacgtgtgccacaccaagcggccccaccgataccgcgcaggccatggaaaatggtctggttagcctccacgcatacaccgtgaccggggcagagcaaatccaataccgcaggggctgggaggagattatttccctgtggaacccgtggggctggggtgaggcagagtggaggggccggtggtctgacggatcccaggaatgggaggaaacatgcgatccacgcaagtcccaattgcataaaaaacgcgaagacggagagttttggatgtcctgccaagattttcaacagaaatttatcgccatgtttatctgctccgagatccccataaccctggaccatggcaacacgctacacgaaggttggagccagatcatgttccggaagcaggtgatacttggaaatacagccggaggtccgaggaacgacgcccaattcaacttcagcgtccaggagccgatggagggaacaaacgtcgtagtgtgtgtaaccgtcgctgtcacgcccagcaatctcaaagctgaggacgccaaatttcccttggacttccaggtcatattggcaggaagccagcggtttagggagaaattccccccagtgtttttctcgtcatttagaaatactgtccagtcctccaacaataaattccgccgtaactttacaatgacatatcacttgtccccgggcaactatgtagtggtggcccaaaccagacgaaaaagtgccgagtttctgctgcgtatctttttaaaaatgccagattctgatcggcatctgtcatctcactttaacctcaggatgaagggcagcccttccgagcacggatcacagcagagtatatttaaccggtacgcccagcagcgactggatattgacgcgacacagctgcagggcctactcaatcaggagctgctcactgggcccccgggagacatgttctccctcgatgaatgcaggtccttagtagcccttatggaactcaaagttaatggcagactggatcaggaggaattcgctcggctctggaaaaggctcgtgcactaccagcacgtgtttcaaaaggtgcagactagtccaggcgtgctactatctagtgatctctggaaggccattgagaatacagatttcctgaggggcatttttatctctcgggagctacttcatcttgttacactacggtacagcgactctgtgggccgcgtgagcttcccctcactggtttgtttcctgatgagactggaagccatggccaagaccttcaggaacctgtctaaggacggtaaagggctatacctgacagaaatggaatggatgtccctcgttatgtacaattag

SEQ ID NO: 44625 - DNA, 2010 bp, Artificial Sequence
  Description of Artificial Sequence: Synthetic coding sequence
atggcctactaccaggagcccagcgtggagaccagcatcatcaagttcaaggaccaagacttcaccacactaagggatcattgtttatccatgggacgaacatttaaagacgagacctttccagcagcagactcatctatcggacagaaactgctgcaggagaaaaggctttcaaatgtaatttggaagcggcctcaggatttgcctggggggccacctcattttatcctggacgacatttctaggttcgatatccaacaagggggcgctgctgactgctggtttctggcagcactcggctctcttacgcagaatccacagtatcggcagaagatattgatggtgcaatccttctcacaccagtacgccggcatttttcgttttagattttggcaatgcggccagtgggtcgaagttgtgatcgatgaccgtctgccggtgcaaggagacaagtgtctgtttgttcgcccacggcaccagaatcaggagttctggccatgtctgctagagaaagcctacgcaaagctcttgggatcatactcggacttacattacgggttcctggaggatgctctggtagatctgaccggcggagtgatcactaatattcacctccattccagccctgtcgacctggttaaagcagtgaaaacggccacaaaagccggtagtctgataacatgtgcaacaccatcgggccccacagataccgcccaagccatggagaatggcctcgtctccctccacgcatatacggtaacaggggctgagcagattcagtatcgtaggggatgggaggaaattatctccttatggaatccctggggatggggggaagcagagtggcgcggccggtggtctgatggtagccaagagtgggaggagacttgcgaccccagaaagtctcagcttcacaagaagagagaagatggcgagttttggatgagctgtcaggattttcagcagaaattcatcgctatgttcatttgcagcgagatccccatcacgctggaccatggcaacactttgcacgaaggctggagccagatcatgttcagaaagcaggtcattctgggcaacacagctggcggaccaaggaatgacgcgcagttcaattttagtgtccaggaacctatggaggggacaaatgtagtggtttgtgtcaccgttgcagtcacaccctccaacttgaaggccgaggacgcaaaatttccattagatttccaagtaatcctcacaagcgtacaacgtttccgcgagaagtttccaccagtgtttttctctagttttcgaaatactgtgcagtcgagtaacaataagttcagacggaacttcaccatgacgtaccacttgtcccccgggaactacgtggtggtagcccagacgcgcagaaagtccgccgaatttctgttgagaatttttttgaagatgcccgactccgataggcacctctcctctcactttaacttgcgtatgaaaggctctccaagcgagcatgggagccagcagtccatttttaaccgttatgctcagcaaaggcttgacatcgatgccacccaactgcaggggctgctcaaccaggaactgctgacaggacccccaggagacatgttctccctcgacgaatgtagatccttggttgccctgatggagctgaaggtcaacggaaggcttgaccaggaggagtttgcccgattatggaagcgcttggtgcactatcagcatgtgtttcaaaaggttcagaccagccctggcgttctgttaagctctgacctgtggaaggctatagagaacactgactttctgcgcggaatctttatttcaagagaactgctgcaccttgtaacacttcgatacagcgatagcgttggacgggtatccttcccctcattggtctgcttcctcatgcgcttagaggcaatggctaaaacttttcgaaatttgtctaaggacggaaagggactctacttgactgaaatggaatggatgtcacttgtaatgtataactag

SEQ ID NO: 44626 - DNA, 2055 bp, Artificial Sequence
  Description of Artificial Sequence: Synthetic coding sequence
atgagcctgtggccccccttccggtgccggtggaagctggccccccgatactcgcgcagagccagtcctcagcagccccagcaggattttgaagccctgctcgctgaatgtttgaggaatggctgcctatttgaagacaccagtttccccgccacgctcagctctattggcagcgggagtctgctgcaaaagctcccccctcggctgcagtggaagaggccgccggaactgcatagtaatccccagttttatttcgccaaggcaaagcggcttgacttatgtcagggcatagttggggattgctggttcctcgcagccttgcaagccctggcactgcaccaagatatactgtcccgcgtggttcctctaaaccaaagcttcaccgagaagtatgcaggtatcttccgattctggttctggcactacgggaactgggtgcccgtcgtgatcgacgaccgtttgccagtgaatgaagccggccagttggtgttcgtgtcttctacatacaagaacctcttctggggcgcattgcttgaaaaggcttacgcaaagttatctggcagctacgaagacctgcagagcggccaggtttcggaagccctggtcgatttcaccgggggagtgactatgacaatcaatctggcagaggctcacgggaatctctgggacattctcatcgaggcaacctataataggactctcatcggctgtcagacccactctggggagaaaatcctcgaaaatggactggtggaaggacatgcttacaccctaaccgggatccgcaaggtgacatgtaaacataggccagaatacctcgtgaaactgagaaacccctggggaaaggtggaatggaagggggattggagcgactcatcatctaagtgggagctcctgagtcccaaagagaaaatccttcttctgcgcaaggataacgacggtgagttctggatgacccttcaggatttcaagacccatttcgttctattagtgatttgcaaactcaccccagggctcttatctcaagaggccgcccagaaatggacatacactatgagagagggaagatgggagaagcgcagcacagcaggggggcagcgacagttgctgcaagataccttctggaagaaccctcagttccttctgagtgtatggagaccggaagaagggcgtcgctcgttgcggccttgtagtgtacttgtgagcctccttcagaagcctagacataggtgtcggaagcgaaagcccctgctcgcaattggcttctatctgtatcgaatgaacaaatatcacgacgatcagcgtcgactcccccccgagttttttcagcgcaacacgcccctgtctcagccagacaggttcctcaaagagaaggaggtgtctcaggaactctgcctcgagcccggcacgtacctgattgttccctgcattctcgaagctcatcagaagtctgaatttgtcttgagggtgttctcccgaaaacacatattctacgaaatcggttcgaacagtggtgttgtgttcagcaaagagatcgaggaccaaaacgagagacaagacgaattcttcaccaaattctttgaaaagcatcccgagattaatgccgtgcagttgcagaacttactgaaccagatgacatggtccagcctgggatcacggcagccattctttagtctcgaggcatgccaagggattttggccctgctggacttgaacgcgtcaggaaccatgagtatccaagagttccgagacctttggaaacaactcaaactgagccagaaggtcttccacaagcaagacagaggctctggctacttaaactgggaacagcttcacgccgcaatgagagaagctggaatcatgttgagcgacgatgtgtgccagttgatgttaatccgctacggcggccctcggctccagatggactttgtttcttttatccacctgatgttaagggtggaaaacatggaggatgtgttccagaatcttacgcaggacggaaagggaatctacctgcagaaaccagaatggatgatgatggccttatattcttag

SEQ ID NO: 44627 - DNA, 2055 bp, Artificial Sequence
  Description of Artificial Sequence: Synthetic coding sequence
atgagcctgtggccccccttccggtgccggtggaagctggcccccagatactcacgcagagccagtccgcagcagccgcagcaggacttcgaagccttgctggccgagtgtttgcgcaatggttgccttttcgaggacacaagctttcctgcaacactgagcagcatcggttctggcagcttactgcaaaaactcccccctcgcctacagtggaaaaggcctccggaactccactcgaaccctcagttctacttcgccaaggccaaaaggctcgacttgtgccagggaattgttggagattgttggttcctggcagccctacaggccctggctctgcatcaggacatcctgtcccgggtcgtgccattgaatcagtctttcacagagaagtatgcaggaattttccggttctggttttggcattacggcaattgggtgcccgtggtgatagacgaccgactacctgtcaatgaagcagggcagttagttttcgtcagcagcacctataagaatctcttctggggcgccctgcttgaaaaggcatacgccaaactcagcgggagctacgaggatcttcaaagtgggcaggtctctgaagcgctagtggattttactggcggagtaacgatgaccatcaatctcgctgaggcccatggtaatctgtgggatattctaattgaagcaacctataacaggacattgatcgggtgccagactcatagcggagaaaagattctagaaaacggactagtggaggggcacgcttatactctaacggggatccggaaggtcacttgtaaacataggccggagtatttggtgaagctgcgtaatccctggggcaaagtcgaatggaaaggtgattggagcgatagttcctccaagtgggagctgttgagtcctaaagagaaaatcttgcttcttcgtaaagacaacgacggagaattctggatgaccctgcaggactttaagactcatttcgtactgctggttatttgtaagttgacacccggattgctgagtcaagaggccgctcaaaagtggacttacacaatgcgggaggggagatgggagaaacggagcaccgctggcggtcaacggcagctgctgcaagacaccttttggaagaaccctcaatttctactgtccgtatggaggccagaagaggggcgccggagtctgagaccatgtagtgtgctcgtctctttactgcaaaagccccgccatagatgtcgaaaaagaaagcccctgttggccataggattctacctatatcgggtcgcaaaataccacgatgaccagcgaaggctgcctcccgaattcttccagcggaataccccacttagccagcctgatcggttcctaaaagagaaggaggtgtcccaggaattgtgtttagagcccggcacatatttaattgtgccctgtattctcgaagcacaccagaaatcagagttcgtcttaagggtcttctctcgcaagcatattttttacgagattggttctaattccggtgtggttttctctaaggaaattgaggaccagaatgaaaggcaggacgagttttttaccaaatttttcgaaaagcaccctgagatcaacgcggtgcagctgcagaatctcctgaaccagatgacgtggtcaagcctcgggagtcgccagcccttcttcagtttggaggcatgccagggtattctagcactcctcgatcttaatgccagcggcactatgagcatccaggagtttagagatctgtggaagcagctaaagctgtcacagaaggtgtttcacaaacaggacaggggctcaggatatttgaactgggagcaactgcacgccgccatgcgggaggccggcataatgctgtctgatgacgtgtgccagctaatgttgatccgttatggaggacccagattacagatggattttgtgtcatttattcacttaatgctaagggtggagaacatggaggatgtgttccagaacctgacacaggatgggaaggggatttatctacaaaaacctgagtggatgatgatggcgctttactcttag

SEQ ID NO: 44628 - DNA, 2046 bp, Artificial Sequence
  Description of Artificial Sequence: Synthetic coding sequence
atggccgcccaggccgccggcgtgagccggcagcgggccgccacccagggtctgggtagtaaccagaacgccttgaaatatctgggccaagattttaagacactaaggcaacagtgccttgattcgggagttctgtttaaagatcccgagttccccgcgtgccctagcgccctgggttataaagatctcggacccggatccccccaaactcagggcattatctggaagcggcccactgagctgtgtccatcaccccagttcattgtgggtggagctactcgcaccgacatatgccagggggggctcggcgattgctggctgctggccgccatcgctagtctgacgctcaacgaggaacttctatatcgcgtagtgcctagggatcaggacttccaggagaattatgctggcatcttccacttccagttttggcagtacggagagtgggttgaagtcgtgatcgatgaccggctgcctacgaaaaacgggcagcttctttttctccatagcgagcagggaaatgaattctggagcgcactgctggagaaggcatacgccaaactcaacgggtgctatgaagctctcgccggcggtagtaccgtggaaggcttcgaagattttaccggaggtatctccgaattctatgatctgaagaaacctccagcaaacctatatcagataatccggaaagcactttgtgctggctcactgctggggtgtagcatcgatgtctcttccgcagcagaggcagaagcgataacctctcagaaactggtgaagagtcacgcatacagtgtgaccggggtggaggaggtgaatttccaggggcaccccgaaaagcttataagactcaggaacccttggggcgaagtggagtggtctggagcatggagcgacgatgctagtcctgtgatatcgccgagcgccgagggatgtagggtgaagcataccactatgaggtctatgtcacaaatgtccttatctgatttcgtcaggcagttcagccggttggagatttgtaacctcagtcccgattcactgtcctctgaggaggtgcataagtggaacctcgtcctgtttaacggccattggactcgcgggtcaaccgcgggcggatgccagaattatccagctacttattggaccaacccacagttcaaaatccgcttggacgaggtggatgaagatcaagaggagtctatcggggaaccctgttgtactgtccttcttgggcttatgcaaaaaaatcggagatggaggaagcgcattgggcaaggtatgctcagtattggatacgcagtgtaccaagtgctcctgtgttggtacactcttgacgtgctgggactgaacatcctagcaagccattgttcaacatctttcctgcttttagaagaggccagcctgctactatacattcctctgccagtggcgctgcttaggttccgggatagtttcctttggttaaatacccgccgcttgaggcgcatttgtccgcaagcttgtcacgacgcactgcccttctggcagagacccagcagcgtgcctcacccttggatggtcagcctagaagtcttttataggggtggcagctttccacacctgcagatgatccgcttccccctgcctttctcacgtactgatattaaatttgacgggttcaatattaacacttgccgggaaatgatctctctgttggactccaatggaactggtaccctgggagccgtggagttcaagactttatggctaaagattcaaaagtacttggagatctactgggagactgactacaaccattctggcactatagatgcccatgaaatgcgcactgctttacgaaaggccggctttacactcaactctcaggttcaacagacgatagccctgcggtacgcctgtagtaaactgggcatcaattttgattcttttgtggcttgtatgattaggcttgaaaccctatttaagctgttctcactccttgatgaagacaaagacggaatggtgcagctgagtcttgcggagtggctctgctgcgttcttgtgtag

SEQ ID NO: 44629 - DNA, 1146 bp, Artificial Sequence
  Description of Artificial Sequence: Synthetic coding sequence
atggccgcccaggccgccggcgtgagccggcagcgggccgccacccaggggttgggcagcaatcagaacgcccttaaatatctcggccaggacttcaagactttaagacagcagtgtcttgacagcggcgtgctgttcaaggatcctgagtttcctgcttgcccttctgccctggggtacaaagatctgggtcccggaagccctcagactcagggtatcatttggaagaggcccactgaactgtgcccatcgccccagttcatagtcggaggggctacacggaccgacatatgtcagggcgggctgggcgattgttggctcttggctgccattgcctccctgacactcaatgaagagctcctctatcgggtggtccctcgggatcaggacttccaagagaattatgcaggaatttttcatttccaattctggcagtacggcgagtgggtggaagtggtaattgatgaccggctgcccacaaagaatggccagctcttgtttctccatagcgagcagggcaatgagttctggtccgcccttctagagaaagcttatgctaaactcaatggatgctacgaggctctcgccgggggttccacagtagagggctttgaagatttcaccggaggaatctctgaattttacgacctcaaaaaacctccagcgaatctgtaccagattatacggaaagccttatgcgccggttccttactggggtgtagtattgatgtgagcagcgccgcagaggctgaagcgatcacgtcccagaagctggtaaagtctcacgcgtactctgtgactggagttgaggaggtgaattttcagggtcatccagagaagttgatcagactgaggaacccctggggagaggtggaatggtccggagcttggagcgacgatgcccccgaatggaatcacatagatcccagacgcaaagaggaactcgacaagaaggtcgaagatggcgagttctggatgagcttgagcgatttcgtgaggcagttcagtaggctggagatttgcaacctttctccagactctctgagctctgaggaggtgcataagtggaatcttgttctctttaacggtcactggacccgagggtcaactgccggggggtgccagaactacccaggcagctcttag

SEQ ID NO: 44630 - DNA, 1314 bp, Artificial Sequence
  Description of Artificial Sequence: Synthetic coding sequence
atggccgcccaggccgccggcgtgagccggcagcgggccgccacccaaggacttggatcaaatcaaaatgcactcaagtacctgggacaggactttaagactttgagacaacagtgcctcgacagcggggttttgtttaaagatcctgagttcccagcttgcccaagtgccctcgggtataaggatctggggcctggctctccccagacacaggggatcatatggaagaggcccaccgagctgtgcccttcccctcaatttattgtgggcggagccactcgaacagacatctgccagggtggcttaggagactgttggcttcttgccgcgatcgcctctctcaccctcaatgaagagttactgtatagagttgtgcctcgcgaccaggacttccaagaaaattatgcaggtatcttccacttccagttttggcaatatggggagtgggtggaagtggtcatagatgatcgcttgccaacaaagaacggccaattattgttcctccacagtgagcaaggcaacgagttttggagtgctctgttggagaaggcttatgccaaactgaacggatgctatgaggccctggcgggcggctctaccgtggaaggtttcgaagactttaccgggggtattagcgagttttatgatcttaagaagccccccgctaacctgtaccaaattattagaaaagccctgtgtgcaggctcactcctcggctgcagcattgatgtatccagcgccgccgaagcagaggccataacctctcagaaattggttaagtcgcatgcatactcagtgacgggcgttgaggaggtgaattttcaaggccatcccgagaagcttattcgactccgaaacccctggggggaggtcgaatggagcggtgcttggtcagacgatgcccccgagtggaaccatatagatccgcggaggaaggaggaacttgataagaaagtggaagacggtgagttctggatgtctttgagtgatttcgtgcgacaattctcccgactcgagatttgtaacctgtcccccgatagcttgtcatccgaggaggtccacaagtggaacctcgtgctatttaacggacattggacacgtggcagcacagctgggggatgccagaactacccagcaacatactggacgaaccctcagtttaagatcaggctggatgaagtggatgaggatcaggaagaatcgatcggggagccatgttgcacagtgctcctgggtctgatgcaaaaaaaccggcgctggaggaagcgcattggacagggaatgctgtccatagggtatgcggtgtatcaatag

SEQ ID NO: 44631 - DNA, 2151 bp, Artificial Sequence
  Description of Artificial Sequence: Synthetic coding sequence
atgagcggcagcaagaagaagaaggtgaccaaggccgagcggctgaaacttctacaagaagaggaggaacgcaggctaaaagaagaagaggaggctcggctcaaatatgagaaggaagaaatggaaagattggagattcagcgcatcgagaaggaaaaatggcatcggcttgaggcaaaagatctcgaacgtcgcaatgaggagcttgaggagctgtacctactcgaacgctgcttccccgaagctgagaagctgaagcaagaaacaaaacttctctcgcaatggaagcattacattcagtgcgacggctcgcctgatcccagcgtcgcccaagaaatgaatacctttatctctttgtggaaggaaaagaccaacgaaacctttgaagaggttattgagaaaagcaaggtggtgctcaacctcatcgagaagttgaagtttattctgctggagactcccccatgcgatctgcaggataagaacataatacagtaccaggagtccatccttcagttgcaggagctgcttcatctgaaattcggagtagccacagaaatactgttgaaacaagccagcacattggccgatttagattctggcaacatggaaaaggtcataaaggatgagaatgtcacactttacgtgtgggcaaatcttaagaagaatcctcggcaccggtctgtgcggttttcagaaacacagatcggcttcgagattcctcgaattctggccactagcgatattgcggttaggcttctccacacccactatgatcacgtcagtgctctgcatcccgtgtccactccatccaaagagtatacttctgccgtcaccgaactggtaaaggatgacgtaaaaaacgtcgagaaagcgattagcaaggaggtggaggaagaatcaaaacagcaagaacggggatcacacttgatacaggaggaggaaataaaggtcgaggaggagcaaggtgatatagaagttaagatgtccagcgcggaggaggaatctgaagcaattaaatgtgagcgcgaaatgaaagtgctcagcgaaaccgtgagcgccgcacagcttctgttagtcgaaaactcatccgagaagcctgacttctttgaggacaatgtggtcgacttatgccagtttaccaccctgggtggggtgtatcacctggatattcttgagctgcctcctcagtgcaaaccggtcaaagggtggatgatcgtggagatcctgaaagaagggctgcagaagtatacttatccgccagagaccaccgaagagtttgaaactgaaaacgcctttcctccaatagaggttacactcgaagttcacgagaacgtgatctttttcgaagaccccgtggtggtccgatgggacgcagaaggcaagcactggcgaactgatggaatcagcaatgtgtcttataagccaaaggagaggttggtgacattcagcctggacacttttggccccgtgacactgatccaggacgctcatatcaacatgccttaccagagctgggaactgcggccgctggacgtaaataaagtcctactcaccgtaaccacagtgttcactgaaatccaaatccagattaaggaaaacctgtgtatgctgtcttctattaaacttaaggataaaaagcacatcagcatcttagagggaacctggatgactcccattccattcatcattgccctaaaggaggcaggcttgaatatttttcccacacggcatagccatttttacgtcatcataaacaacaaggtgccactggtggaagtaaaggcctacagacagatggccttacttagctctgccttcgcttttggttggtctaaatggaatctactttgcaattcaactaaagttgtcttcaaggttcgggagcacttgaccgaggcatgtacggagaatcctaattgggcgttactgatgttttctggcgatagagcacaaagactgaaaatcaaagaagaatccgaagcattcagcgaggcattgaaggaggagacagagtttcactccaccctctaccatatggttaaggacttcgcaagtgaagaagccatggagaaggtgcgaagtagtaattgtcagttcgtcaacagcgtctgccacatgctcttgtctactcgccttctttcttatagctag

SEQ ID NO: 44632 - DNA, 2073 bp, Artificial Sequence
  Description of Artificial Sequence: Synthetic coding sequence
atgcggcagaccggcggcggcgccaccaccgacagcgccagccccgtgctgaataacgtcattaagagccagagttacttcaccgctaaaagagttggccttggtaacaatagttacttaggagtgggcaggccctccagtcagcagtggctgagcctcccgggccccggcgggcagggcccaaaagccaaaaaaagtggatccaagaagaagaaagtcactaaggccgagcgcctcaaattactgcaggaggaggaagagcgcaggctcaaggaagaggaggaggctcgcctgaagtatgagaaggaagagatggaaaggttagagattcaacggatcgagaaggaaaagtggcaccgcttagaggctaaggatctcgagagaaggaacgaggagttggaggagttgtatctgctggagagatgcttccccgaagccgaaaagttgaagcaagagaccaaactcctgtctcagtggaaacattatattcaatgcgacggatcacctgacccctcagtggcgcaagaaatgaacaccttcatttccctatggaaagaaaagactaacgaaaccttcgaggaagttatcgagaaaagtaaggttgtcctgaacctgattgagaagctgaagttcatcttgctcgaaaccccaccatgcgacctacaggacaagaacataatccagtatcaggagagcatcctgcagttgcaggagctgctgcaccttaagttcggggtcgctacggagatcctgcttaaacaggcttccacactggccgacttggattctggcaatatggagaaggtgatcaaagacgaaaacgtaaccctatatgtctgggcaaatttgaaaaagaacccgaggcatagatctgttcgtttctcagagacgcagattggcttcgaaatccctcgcatattggcaacctccgacatcgcagtccgtctgctccatacccactacgaccatgtgtccgctctccaccctgtgagtaccccgagtaaggaatatactagtgctgtgaccgagctagtgaaagatgacgtcaagaatgtggaaaaagctatctctaaggaggtggaggaggaatcaaagcagcaggaacggggctcccacctgatacaggaggaagagatcaaggtagaagaagagcagggagacattgaggtgaagatgagcagcgctgaggaagagtccgaggcgataaagtgtgagcgtgagatgaaggtcctgagcgagactgtgagcgcagctcagctgctcctggttgaaaacagctcggaaaagccagatttcttcgaagataacgttgtggatttgtgccagtttacaacgctcggaggggtgtaccacttggacattctggagctgccccctcaatgtaagcccgtgaagggttggatgatcgtggagatactgaaagaggggctgcaaaagtatacctaccctcctgagaccacggaagagtttgaaacggagaacgcctttcccccaatcgaagtaactctggaggttcacgagaacgtcatttttttcgaggaccccgttgttgtgaggtgggacgccgagggaaagcactggaggactgacggcatatccaacgtgtcctacaaaccgaaggagaggctcgttacttttagtctggatacttttgggcccgtgacgctgatacaggatgcccacattaatatgccctatcagtcctgggagctgcgacccctggacgttaataaggttcttctgacggtcaccacagtttttacagagatccagattcagataaaggagaacctatgtatgctaagcagcatcaaactaaaggataaaaagcatatcagcatcctcgagggcacctggatgacacccataccgttcataattgccctgaaggaagccggcctaaatatcttccccacacggcacagccatttttacgtaatcataaataacaaggtacccctggtggaggtgaaggcttacaggcagatggcactcctctccagcgcatttgctttcgggtggagtaagtggaatctcctctgcaactcaaccaaagtggtcttcaaatggtag

SEQ ID NO: 44633 - DNA, 1311 bp, Artificial Sequence
  Description of Artificial Sequence: Synthetic coding sequence
atggagcggctggagatccagcggatcgagaaggagaagtggcaccggctggaagctaaggacctagagcgacgaaatgaagaactggaggagctctacttgctggaaagatgtttccccgaagctgaaaagctgaaacaggagaccaaattgctaagtcagtggaagcattatatccagtgcgatggaagcccagacccatccgtagcacaggaaatgaatacctttatttcactttggaaggaatacacatccgctgtgaccgaactggtgaaagatgatgttaaaaatgtggagaaagccatctccaaggaggtggaggaggaatcaaaacaacaggagagaggatcacacctgattcaggaagaagaaatcaaggtggaagaggaacaaggcgatatcgaggttaaaatgagtagcgccgaggaggaaagcgaggccatcaaatgcgagagagagatgaaggtgctatcagagacagtatcagctgctcagctactgcttgtggagaattcatccgagaaacctgacttttttgaagacaacgtggtggacctgtgtcagtttacaactttgggaggtgtgtatcacctagatatcctcgagttaccccctcagtgtaagcctgtgaaggggtggatgattgtggagatcctcaaagagggcctgcaaaaatacacttacccccccgaaacgaccgaggaattcgagacagagaatgctttccctccgatcgaagtgacacttgaggtacatgagaacgtgatcttcttcgaggatcctgtggtggtgcgctgggatgccgagggcaagcactggaggaccgatggcatctcaaacgtgtcatacaagcctaaggagcggctcgtcacgttctctttggacactttcgggcctgtgactcttatacaggatgctcacatcaacatgccatatcagagctgggaattacgtcccctagacgtgaacaaagtacttcttactgtcaccacagtctttacagagatacagatacagattaaagagaacctgtgcatgctctcatccatcaaattgaaggacaaaaagcacataagcattttggaagggacttggatgacccctatcccgtttatcattgccctgaaggaggccgggctcaacatctttccaacgaggcatagtcatttctacgtcattataaataataaggtacccctggttgaggtgaaggcttaccgtcaaatggccttgctgtcatccgccttcgcttttgggtggagcaagtggaacctcctttgtaactctaccaaggtggtgtttaaatggtag

SEQ ID NO: 44634 - DNA, 2169 bp, Artificial Sequence
  Description of Artificial Sequence: Synthetic coding sequence
atgggccccaaggccaagaagagcggcagcaagaagaagaaggtgaccaaagcggaacgtctgaagctcctacaggaagaggaagaaagaaggctaaaagaggaagaggaagccaggctgaagtacgagaaagaggaaatggagcggttggagatccagcgcatcgagaaagaaaagtggcacagactggaggccaaggacctcgagcgccgcaacgaggagctcgaagaattatacctgctggagcgttgtttcccagaagctgagaagctgaaacaggagacaaaacttctgagtcaatggaagcattatattcaatgcgatggctcccccgatccctctgtggcccaggagatgaatacctttatctctctgtggaaggaaaagacgaatgaaacgtttgaggaagttatcgaaaagtcaaaggtggttctgaaccttatagaaaagctgaaattcattctgctggagactccaccatgtgacctgcaggataagaacattattcagtatcaagaatctatcctccagctccaggaactactgcatttgaagttcggcgtcgcgactgagattctgctaaaacaggccagtactttggccgatctggacagtgggaacatggaaaaagtgatcaaggatgagaacgtaacactttacgtttgggccaatttgaaaaagaacccccgacatcggagcgtgcgatttagtgagactcagatcggcttcgaaattcctcgcatcctggctacttctgacatagccgtgcgtctgctgcacactcactatgaccacgtgagtgcactgcaccctgtgtccactcccagcaaggagtacacatcagccgtgacagaactcgtgaaggatgatgtcaaaaatgttgagaaagcaatctctaaagaagttgaagaggagtcaaagcaacaggaacgcggatcacacctcatccaggaggaggagataaaagtggaggaggaacagggcgacatagaagttaagatgtcctctgcagaggaggagtccgaggccatcaagtgcgagagggagatgaaggttctgtcagagaccgtctcagctgctcagttgctgctggtggagaactcctccgaaaaacccgatttctttgaagataacgtggtggatctgtgtcagttcaccacactggggggggtctatcaccttgacatactagagctaccaccccagtgcaagcccgtcaaggggtggatgatcgtggagattctgaaggagggcctacagaagtacacctatcctcccgagactactgaagagtttgaaactgaaaacgccttcccccctattgaggtaactctggaagtgcacgagaatgtcatattcttcgaggaccctgtagttgtgcgctgggacgcagagggtaaacattggcggactgatggcattagcaacgtttcttacaaaccaaaggaaaggctcgtgaccttctctcttgataccttcgggccagtgaccctgatccaggacgcccacattaatatgccttatcagtcctgggagcttcgtccactggacgtgaacaaagttctgctcactgtcacgactgtgtttaccgaaattcaaattcagattaaggagaacctctgtatgctctcatcaattaagctcaaagataagaagcatattagcattctggaaggcacttggatgacaccaattccattcattatcgcgctgaaggaggcaggcctcaacatttttcctactcggcactctcatttctatgtcatcatcaataacaaagttcccctggtcgaggtcaaggcctacaggcagatggccctgctctcttctgcattcgcctttggctggagcaagtggaacctattgtgcaacagtaccaaggtcgtgttcaaagtccgcgaacacttgactgaagcgtgcacagagaatccaaattgggctctgctgatgttttctggtgatcgggcccagaggctcaagatcaaagaagaatcagaggccttttcggaagccttgaaggaggaaacagaattccatagtacactctaccatatggttaaagattttgcgagtgaagaagcaatggagaaagtacgttcgagcaattgccaattcgtgaactccgtctgccacatgctgttatctacccgcctgctttcctactcttag

SEQ ID NO: 44635 - DNA, 2031 bp, Artificial Sequence
  Description of Artificial Sequence: Synthetic coding sequence
atggagcggctggagatccagcggatcgagaaggagaagtggcaccggcttgaggccaaagatttagagcggcgaaacgaagaattggaagagctctatctccttgagcggtgtttccccgaggccgagaagctgaagcaggagacaaagttgcttagccagtggaaacattatatccaatgtgacggttcgccagatccttctgtcgcacaggagatgaatactttcatcagtctgtggaaagaaaagactaacgaaacattcgaagaggtcattgagaaatcgaaggtggttctcaatttgatcgagaaactcaaatttatcctcctggagacacccccttgcgatttgcaggataagaatatcatccaatatcaggaatccattttacagttacaggaactgctccacctaaaattcggggtagctaccgaaatcctactaaaacaggccagcactctggccgacttagacagcggtaacatggagaaggtgattaaagatgaaaacgtgacactgtatgtctgggcaaatctgaaaaagaatcctcggcacaggagcgtacgtttttcagagacacagatcggttttgagattccccgtatacttgcgacctcagacatcgcagtacggctgctacacactcactacgatcacgtgtctgctctgcacccagttagcacacccagcaaggaatacacctctgctgtcacggagctagtgaaggacgatgttaagaatgtggagaaagccataagcaaagaggtggaggaggagtccaagcagcaggaacgcggatctcaccttattcaggaggaggagatcaaggtagaggaagaacagggcgatattgaagttaaaatgtcatcggccgaggaagagagtgaagccattaagtgcgaacgggagatgaaggtgctgagcgaaaccgtcagtgctgcccagttgctcctggtggagaattcatcagaaaaacctgatttcttcgaggataacgtcgtggatctgtgccagtttaccacattggggggtgtttatcatctagacatactggagcttccacctcaatgtaaacctgtcaaaggctggatgatcgtggagattctcaaggaggggttgcaaaagtacacataccctcctgaaaccactgaagagttcgaaaccgaaaacgcctttccacctatcgaggttaccctggaggtgcatgaaaacgttatatttttcgaagatcctgtcgtggtccgatgggacgccgaagggaagcattggcgaactgatggaatctctaacgtcagctacaaacccaaagagcggcttgttacattttctttggatacctttggccctgtcacgttgatccaagacgcccatattaacatgccatatcagagttgggagctccgacctctagacgtcaataaggttctgctgacggtgacaacagtgtttaccgaaatccagatccagatcaaggaaaatttatgtatgttgagctctattaagctgaaggataaaaagcacatatcaatattagaagggacgtggatgactcccattccatttatcatcgccctcaaagaggctgggctcaacatctttcccacgaggcacagccacttttacgtgataatcaataacaaagtgcccctggtggaagtgaaggcgtaccgtcagatggcattgctcagctcagcttttgcatttgggtggagtaaatggaacctactctgtaattctaccaaggtagttttcaaggtgagagaacacctcaccgaggcttgtactgagaatccaaattgggcactgttgatgttcagcggtgatcgtgctcagcggctcaaaatcaaagaggaatccgaagccttctctgaggctctcaaagaggagaccgagttccatagcactctctaccacatggttaaggatttcgcttcagaagaggctatggaaaaggtcaggtcttcgaattgccagttcgtcaactccgtatgtcacatgctgttgtctacgaggctcttgagctacagctag

SEQ ID NO: 44636 - DNA, 1458 bp, Artificial Sequence
  Description of Artificial Sequence: Synthetic coding sequence
atgggccccaaggccaagaagagcggcagcaagaagaagaaggtgacaaaggcggagaggctcaaattactgcaggaggaagaggagcgccgtctgaaagaggaagaagaagcccgcctcaaatacgagaaagaagaaatggaacggctggaaatacaacgcattgaaaaagaaaagtggcaccgcctagaggcgaaagacctggaaagaaggaacgaggagcttgaagaattgtatctgttggaaagatgttttcctgaggccgagaaactgaaacaagagactaagctccttagtcaatggaagcactatatccaatgcgatggctctccggacccgtctgtggcgcaggagatgaacaccttcatttcgctgtggaaagagaagacaaacgaaacgttcgaggaagtcattgaaaaatccaaggtggtgctgaatctcattgagaaactgaaattcatcctgcttgagacccccccgtgtgatttgcaagacaagaatattatacagtaccaggaaagtatcctgcaactgcaggagcttctgcacctaaaattcggagtggccacggagatactgttgaagcaagcatcaacgctcgccgatctggattctggcaacatggagaaggtcattaaggatgaaaacgtgaccttgtacgtgtgggctaacctgaagaagaacccccgacacaggtccgttaggttttcggaaacccagattggtttcgaaataccccggatcctggccacatctgatatcgccgtcaggcttcttcacacccactatgatcatgtaagtgctctgcaccccgtgagcactccatccaaggagtacaccagtgccgtaactgagctggtgaaggatgacgtgaagaacgtggaaaaggctatcagtaaagaggttgaggaggagtccaagcagcaggaaaggggctcacacttgattcaggaggaggaaataaaggtggaagaggagcagggcgacatagaggtcaagatgtcgagcgccgaagaagaaagcgaagcaatcaaatgtgagagagagatgaaggtgctatctgagacagtcagcgctgctcagctgttgctcgtggaaaactcctcagagaagcccgatttctttgaggacaatgtagtcgatctgtgccaatttacaaccttaggcggggtgtaccacttggacatacttgaattaccaccacagtgcaaacccgtgaaaggctggatgatcgtggaaatactgaaggaggggttacagaaatacacataccccccagaaacaacagaggaattcgagactgagaatgctttccccccaatagaagtgaccttagaggtgcacgagaatgtcatcttcttcgaggatcctgtggtcgtgcgatggatgctgaaagtgaatatcggtgaactgatggcctccgcgatgtatcccactaatcagaagaaggacctttag

SEQ ID NO: 44637 - DNA, 1545 bp, Artificial Sequence
  Description of Artificial Sequence: Synthetic coding sequence
atgaacaccttcatcagcctgtggaaggagaagaccaacgagacctttgaagaggtgattgagaagagtaaagtggtgctgaatttaattgaaaagctcaagtttatcctcctcgaaactccaccttgcgacttgcaggataaaaatatcattcagtaccaggagtcgatcctacaactccaagaactgttgcacttaaaattcggagtcgccaccgagatattgttgaagcaggcatcaactctggcagatctggattcaggcaacatggagaaagtcattaaggacgagaacgtgacactgtatgtctgggccaacctcaagaaaaaccctcggcaccgatctgtgcgcttttccgaaacccagataggatttgaaatcccacggatcttagcaacttctgatattgccgtgcgtctccttcatacacactacgaccacgtgagtgcactacatccagtaagcacaccaagcaaagaatacactagtgccgtgactgaactggttaaggatgacgtgaagaatgtcgagaaagcgatctcaaaagaggtcgaggaagaatccaagcaacaggagcgcgggtctcatctaatccaagaggaggaaattaaggtggaggaggaacagggcgatatcgaggttaagatgagttccgcggaagaagagtccgaggctattaagtgtgaaagagagatgaaagtcctttctgagactgtctcagctgcccagctgctgttggtggaaaactcttccgaaaaaccggacttttttgaggataacgtagttgatctgtgccagtttacgacgctgggcggagtatatcacctcgacatcctggaattgcctccgcagtgcaagccagtgaaggggtggatgatcgtggaaatactgaaagaagggctccagaagtacacctaccctcccgagacaacagaggagtttgagaccgaaaacgctttccctcccatcgaggtgaccctcgaggtgcacgaaaatgtgattttctttgaggaccccgtggtggtgcgctgggacgcagagggcaaacattggcggactgacgggatctctaatgtgagttataaaccgaaagaaagactcgtaactttcagcctagatactttcggcccggttaccctcattcaagatgctcacattaacatgccctatcagagctgggagttgaggcccctggatgtaaataaggtgctgctgacggtcacaacagtattcactgagatacaaatccagatcaaggagaacctatgtatgctgagttccattaagctgaaggataaaaaacatatttcaatcctggagggcacttggatgaccccaataccattcattatagcgctgaaggaagcgggcttgaatatatttcctacacggcattcccacttttacgttatcataaataataaggtaccattggtagaggttaaagcctatcggcagatggccctcctctccagcgcatttgcgttcggctggtccaagtggaacctgctctgtaacagcaccaaagtggttttcaaatggtag

SEQ ID NO: 44638 - DNA, 279 bp, Artificial Sequence
  Description of Artificial Sequence: Synthetic coding sequence
atggagcggctggagatccagcggatcgagaaggagaagtggcaccgacttgaggcgaaggatctggagcggaggaatgaagagctcgaggagctctacctgctggaacgctgtttccctgaggccgaaaagctcaaacaggagaccaagctactgtctcaatggaagcactacatccagtgcgatggttcacctgatccctctgtggcacaggagatgaatacctttataagcctgtggaaggaaaagacgaatgaaacattcgaggaagtaatctag

SEQ ID NO: 44639 - DNA, 1974 bp, Artificial Sequence
  Description of Artificial Sequence: Synthetic coding sequence
atggacctggagcggcggaacgaggagctggaggagctgtacctgttggaaagatgctttccagaggcagagaaactgaaacaggagaccaaactgctgtcacagtggaaacactacattcagtgtgacggaagtcccgatcctagcgtggcccaggagatgaacacattcattagcctttggaaggagaagacaaacgaaacctttgaagaagtgatcgagaagtctaaagtggtgctaaacctcatcgagaagctgaagtttatcctgttggagacaccgccatgcgacttgcaggataagaacatcattcagtaccaggaatcaatcctccagctccaagaattgcttcatcttaaattcggagtcgctaccgaaattctcctcaagcaggctagcacactggccgatctggattccggcaacatggaaaaagtgatcaaagacgaaaacgttaccctctacgtctgggctaacttgaagaagaatccacgccaccgatcagtgcgcttctccgagacccagatcggtttcgagatcccccgaattctggctacgtctgacattgcagtccgcctgctgcatacccactacgaccatgtctcggctctacatcctgtgtcaactccaagcaaggagtacacttcagccgtgacagaactcgtgaaggacgacgtaaagaacgtggagaaagccatatcgaaagaggttgaggaggagagtaagcagcaggagcgcgggtcgcacctgatccaggaagaggagatcaaagtggaagaggagcagggcgatattgaagtaaagatgagtagtgccgaagaagaaagtgaggccatcaagtgtgaaagggaaatgaaagtcttgagcgagacagtgagcgccgcccagctcctgctggtagagaattcaagcgaaaagcctgatttttttgaagacaatgtcgtggacctgtgtcagtttacaactctgggcggagtataccacctggacattcttgagcttccgccccaatgtaaacctgtgaaaggatggatgattgtcgagattttaaaagaaggcttgcagaagtacacttaccctccagagacaaccgaggaattcgagaccgagaacgccttcccacccatagaggtcactttggaggtccatgaaaacgtaatcttttttgaagatccagttgtggtgagatgggatgcagaagggaagcactggcgcacagacggaatctccaacgtgtcgtataaaccaaaggaaaggctggtgaccttttccttggacaccttcggacctgtgactttgatccaagatgctcacatcaacatgccctaccaaagctgggagctaagacctctagatgtcaataaggtcctgctgacagtgactaccgtgttcacggagattcagattcagatcaaggagaacctgtgtatgctttcgtccattaagctgaaagacaagaaacacattagtatccttgagggcacatggatgacgccgataccgtttatcatagcactcaaagaggcaggcttgaacatattccccacgcggcattcccatttctacgtgatcattaataataaggtgcccctcgtcgaagttaaggcttatcgccagatggctttgctgagctcagccttcgcatttgggtggtcaaaatggaatctgttatgcaacagtacaaaagtggtgttcaaggtacgcgagcatctcacggaggcatgtaccgaaaaccctaactgggctctcctcatgttcagcggggatcgcgcacagaggctgaaaatcaaggaagaaagcgaagctttctcagaggcgctgaaggaggaaacagaattccatagtaccttgtaccacatggtcaaggactttgcctcggaagaggccatggagaaagtgcgtagtagtaattgccaatttgtgaattcagtctgtcacatgctgctttcaactagactgctgtcttattcctag

SEQ ID NO: 44640 - DNA, 411 bp, Artificial Sequence
  Description of Artificial Sequence: Synthetic coding sequence
atgatgcacaccaccagctaccggcggctgagccccccccacctgacggaccaaccttccgcctattcacacacccaccgcacattctcccacttctcatgtggatcccagcctgcggctcagcgactacacgtggagctgtggaatgccgacctgcagtccgagttcttatgcccatgtctgggactgactttgtaccttacctgcaatccccagctcgggaagcgaaagttctgttcacacagcagcgaggacatgtctaaaatggtgtcccggcggaacgtcaaggactcgcatgaggtgagcggttccctgcaggccactctccaggtaatctcattcagctttccgtttctccttcatacctgcagtcatccactgagtcaccccacctccggccagcgtagatag

SEQ ID NO: 44641 - DNA, 570 bp, Artificial Sequence
  Description of Artificial Sequence: Synthetic coding sequence
atgaccgacaagaccgagaaggtggccgtggaccccgagaccgtgttcaaaagacctagagagtgcgactccccttcgtaccagaaaaggcagcgaatggccttactcgcacgaaagcagggagcgggtgatagcctgatcgctgggtctgctatgtcaaaggaaaagaagcttatgactggccacgctatccctcctagccagttagatagccagatagatgactttaccggctttagcaaggatagaatgatgcaaaaaccgggctctaacgcccctgtgggcgggaatgtgacgtccagtttcagcggagacgatctcgagtgtcgcgagactgcctcctcccctaaaagtcagcgcgagattaatgccgatatcaaaagaaaattggtgaaagaactacgatgtgtgggccaaaagtacgagaagattttcgaaatgctggagggcgtgcagggccccactgctgtgcgtaagcggttcttcgagtctatcattaaggaagcagccaggtgcatgcgccgcgattttgttaaacatttaaagaaaaagctgaaacgaatgatctag

SEQ ID NO: 44642 - DNA, 867 bp, Artificial Sequence
  Description of Artificial Sequence: Synthetic coding sequence
atgagcgccaccggcgaccggcaccccacccagggcgaccaggaggcaccagtcagtcaggaaggagctcaggcagaggccgcaggagccggcaatcaggagggaggcgattctgggcccgattcaagcgacgtggtgcctgcggctgaagtcgtgggcgtcgcgggcccggtagaaggactcggagaggaggagggcgaacaggccgctggcctcgccgctgtgccacgcggcggcagcgcagaggaagactcagatatcggtcccgcaaccgaggaggaggaggaagaagaagggaacgaagcggccaatttcgacttagccgtcgtggcgaggagataccccgcaagcggcatacactttgttttgctcgacatggtccacagtctactccatcggttgagccataacgatcacattctcatcgagaataggcaactttccagactgatggtcgggcctcacgccgcagcccggaacctgtggggaaatttgcccccactcctgctgccacagaggctaggagccggcgcagctgctcgtgcaggcgaggggctgggcctcatacaagaggccgccagtgtgccagagcccgccgtgcctgccgacctggccgaaatggcgagggaaccagccgaggaagccgctgaggagaaattatctgaggaggccacagaggagcctgacgctgaagagcctgctacggaagagccaacggctcaggaggccaccgcccctgaggaggtcaccaaaagtcagcccgaaaagtgggatgaggaggcccaagacgccgcaggtgaagaggaaaaagagcaggagaaggagaaggatgctgaaaacaaggtgaagaattcgaagggcacttag

SEQ ID NO: 44643 - DNA, 867 bp, Artificial Sequence
  Description of Artificial Sequence: Synthetic coding sequence
atgagcgccaccggcgaccggcaccccacccagggcgaccaggaggcacccgttagtcaagaaggagcacaggcagaggctgctggtgctgggaatcaggaaggcggcgacagcggcccagatagcagtgatgtcgtgcccgccgccgaggtcgtgggcgtcgcaggcccagtcgagggcttgggtgaggaagagggggaacaggctgccgggctagcggccgtgccccggggtggttctgccgaagaagattcagatattgggcctgccactgaggaagaggaagaagaggaggggaacgaagccgccaacttcgacctggcagtggtcgccaggaggtacccggcgtctgggattcacttcgtcctgttggacatggttcattcgctccttcatcgactgagccataatgaccatatcttgattgagaatagacagctgtcccgcctgatggtgggcccgcacgcagccgccaggaacttatggggcaacttgccccccctgttgctgccacaaaggctaggggctggggccgccgcgagggcgggagagggccttggcctcatccaggaggccgcttcggttcctgaaccagctgtccctgcagatcttgccgagatggcccgagaacctgccgaggaagccgctgaagaaaaattgtccgaagaggctacagaggagcccgatgccgaggagcccgcaacagaggagccaactgcacaggaagcaacagcccccgaagaagtcaccaaaagccagcccgaaaagtgggatgaggaggcccaagacgctgctggggaggaggaaaaagagcaagaaaaggagaaggacgccgaaaataaagtaaaaaactctaagggcacttag

SEQ ID NO: 44644 - DNA, 495 bp, Artificial Sequence
  Description of Artificial Sequence: Synthetic coding sequence
atgggcgacctgcccggcctggtgcggctgagcatcgccctgcggatccagcctaacgatggccccgtcttctataaggtggacggccagcggtttgggcaaaaccgaacaattaaactgctaacgggatcctcatacaaggtcgaggttaagatcaagccatctactcttcaggtcgagaatatttcaattggcggggtgctggttccgttagaactcaagtccaaagagcccgatggggatcgtgtcgtgtacaccgggacgtacgacactgagggggtaacaccaactaaaagcggcgaacggcagcccatacagatcacaatgccattcaccgacattggcacctttgagacagtctggcaggttaaattttacaactaccacaagcgggatcactgtcagtggggttccccattttcggtgattgagtatgaatgtaagcccaacgaaaccagatccctgatgtgggtgaacaaagagtcctttttgtag

SEQ ID NO: 44645 - DNA, 387 bp, Artificial Sequence
  Description of Artificial Sequence: Synthetic coding sequence
atgggcgacctgcccggcctggtgcggctgagcatcgccctgcggatccagcccaatgacggaccagtgttttacaaagtggatggccagcgtttcggacaaaacaggactattaagctcctgacaggctccagttacaaggtcgaggtgaagatcaaaccatctacactgcaggttgaaaatataagtatcgggggcgtgctggtcccactggagctaaagtcaaaagaacccgatggtgaccgggtagtatacactggcacctacgacacagaaggcgtgaccccgactaagagcggcgagaggcagcctatacagatcactatgcccgagtgtttggagcaaagaccccaggaaatatctctgacctacgagtgcgaggaatag

SEQ ID NO: 44646 - DNA, 279 bp, Artificial Sequence
  Description of Artificial Sequence: Synthetic coding sequence
atgaacgactacaagctggaggaggaccccgtgaccaaggagcggacttttaaaagattcgccccacgaaagggcgataaaatataccaagagtttaagaagttatacttttacagcgatgcctacagaccgttgaaatttgcatgtgagaccattatagaggagtatgaggacgaaattagctcgttaattgcccaggagacgcattatctcgctgataaattgtgcagtgagaagtcagacttgtgtgagacgagcgccaaccacacagagctgtag

SEQ ID NO: 44647 - DNA, 3141 bp, Artificial Sequence
  Description of Artificial Sequence: Synthetic coding sequence
atgcagaagcccagcggcctgaagccccccggccggggcggcaagcacagctcacccatggggaggacctccaccgggtcagcatcatctagtgctgcagtggccgccagttccaaagagggtagtcccctgcacaagcagtccagcgggccgagttcgtctcctgccgcggctgccgccccagagaaacccgggcctaaagccgccgaggttggagatgattttctgggggacttcgtggtcggcgaaagagtgtgggtcaacggtgtgaagcccggtgtagtacagtatctcggagagacacaatttgcaccaggccaatgggcaggagtggtgctggatgaccctgttgggaaaaacgatggcgccgtggggggagtgcggtacttcgaatgccctgctctgcagggcattttcacacgcccgagcaaactcaccagacagcctacggccgagggctctggcagcgacgctcacagcgtggagtctctgacagctcaaaacctcagtttgcactcaggcacggccacaccccctctgacgtcaagggtgattcctttaagggagagcgtcctgaactcgagcgtgaagaccggaaatgagagtgggagcaatctgagtgacagcgggtccgttaagagaggagagaaagatctgcgtctgggagacagagtgctagtgggaggtacaaaaacgggggtggtgcgctatgtcggagaaaccgacttcgcaaagggtgaatggtgtggggtggaactcgatgagcctttaggtaaaaacgacggcgcagtcgccgggactcgctacttccagtgtccaccaaaattcgggttgttcgctcccatccacaaggtgatcaggatagggtttcccagcacgtccccagctaaggcgaagaagacaaaaaggatggctatgggagtgagcgctcttacccacagcccaagttctagctccatcagttccgtgagtagtgtggcctccagcgtgggaggtcgccctagtcggagcggactgctgacagaaacatccagtcgctatgcaagaaaaatttcgggcacgacagccctccaggaagctttgaaggagaaacagcaacacatagaacaactgctggctgagcgggacctcgagcgggccgaagtggctaaagctaccagccatatatgcgaggtggagaaggagatcgcactactgaaggcacagcacgaacagtacgttgccgaagctgaggagaagcttcagcgggctcggttactcgttgagtccgtgcgaaaagaaaaagttgacctgtcgaatcagctggaggaagagcgtagaaaagtggaggatctccagtttcgagtggaagaggaatcaatcacaaaaggagatttggaaactcagacacagttggaacatgcccgcattggggaactggagcagtcgcttctactcgaaaaggcacaggccgagaggttgctgagggaactggcggataaccgactcactacagtcgcagaaaaatccagggtgctgcaacttgaagaagaactgacgttgaggagaggggagatcgaggagctacaacaatgtctcctgcatagcggcccccctcccccggatcacccagacgctgccgaaatcctcaggctcagagaacgccttctgagcgctagtaaggaacaccagcgagaatccggcgtgctgagggataaatatgagaaagcacttaaggcatatcaagctgaagtggacaaactgcgtgccgccaacgagaaatacgcccaagaggttgccggcctgaaagataaggtgcagcaggctaccagcgaaaacatggggctgatggacaattggaagtccaagctcgacagcttggcgtccgatcatcagaaaagcctggaggacttaaaggcgactctgaactcaggtcccggtgcgcagcagaaagagattggagagctgaaggcagtcatggagggaataaagatggagcaccagctggagcttggcaatctccaggcaaagcatgatctggagaccgcaatgcatgtcaaggaaaaggaagcgctgagagaaaaactgcaggaggcgcaggaagaactcgccgggctccaaagacactggagggcacagctggaagtgcaagccagccagcaccgtctggaactgcaagaagcgcaagaccaacgtcgagacgcagaactcagggttcacgaactcgagaaattagatgtcgaataccggggccaagctcaagctatcgagttcttgaaggagcaaatttctctggcggagaagaaaatgttagactacgaaaggctccagcgggccgaagcccaggggaagcaggaagtagagtctctgcgggaaaaactcctcgtcgccgagaatagactgcaggccgtcgaagctttatgctcctcccagcacacgcacatgatcgaatccaatgatattagcgaggaaaccattagaacaaaagaaactgtcgagggattacaggacaagctgaacaaaagggacaaagaggtcacagctctgacgtctcagacagagatgcttcgggcacaggtgtcggccttagagtctaagtgtaagtccggagagaagaaggttgacgccctgctgaaggagaagcgacgactggaggcagagctagagaccgtgtcaagaaaaacacacgacgcctctggacagctcgtgctgatctcccaggagctcttaagaaaggaaagatccctgaacgagctgcgcgtgctcctgttggaggcgaaccggcacagtccaggccctgaaagagatctgagcagggaggtccacaaggcagaatggagaatcaaggaacagaagctgaaggatgacatacggggcctgagagagaaactaacaggcctggataaggaaaagtctcttagtgatcaaagaagatattccttgatcgacagaagtagtgccccagaactgctgaggttgcagcaccaactcatgtctactgaggacgctctcagagacgccctagaccaggctcaacaggtggagaagctcatggaggccatgagatcctgcccagataaagcccaaaccataggtaatagtggcagcgccaatgggatccaccagcaggacaaggctcagaaacaagaggataagcattag

SEQ ID NO: 44648 - DNA, 2118 bp, Artificial Sequence
  Description of Artificial Sequence: Synthetic coding sequence
atgaccatcgaggacctgcccgacttccccctggagggcaaccccctctttggtaggtacccctttattttttctgcttccgacactcctgtcattttttctatctcagcagcccccatgccgagcgactgcgagttttccttttttgatcccaacgacgcgagctgccaggaaatcctgtttgatcccaaaacctcagtgagcgaactgttcgccatcctgaggcagtgggtgccccaggtacagcagaatattgacatcatcgggaacgagatcctgaagaggggctgcaatgtgaatgatcgcgatggactcacagacatgacgctgcttcattacacatgcaagtcgggcgcacacggtataggcgatgtcgagaccgccgttaagtttgccacacagttaattgacctcggcgctgacattagtctgcgctctagatggactaacatgaatgccctgcactatgccgcctatttcgatgtgcctgaattgatcagggtaattttaaagaccagtaaaccaaaggatgttgatgctacatgttctgacttcaattttggcacagccctacacatcgctgcgtataacttgtgtgccggagccgtaaaatgtcttctggaacaaggcgcaaacccggcctttaggaatgacaaaggtcagatccctgccgatgtggtacctgatcctgtggatatgcccctagagatggctgatgcagcggctaccgcgaaggagataaagcagatgctgttggatgccgttcccttgtcctgtaatatcagcaaggccatgttaccaaattacgatcacgtcaccggcaaggccatgctcacctcgctaggcctcaagctcggggacagagtggtcattgctggccagaaagtgggaaccctgcgtttttgtggtaccaccgagtttgctagcggtcaatgggctggcatcgaactcgacgagccagaaggcaagaacaacgggtcagtgggaaaggtgcagtatttcaaatgtgcaccaaagtatggtattttcgcccctctctctaaaatctcaaaggctaaaggccgacggaaaaacatcactcacacaccatcaacaaaagccgccgtgcccctgatcagatcgcagaagattgacgtagcacacgttaccagcaaggtcaacaccgggttaatgacatccaaaaaagactcagcctcggagtcaaccttaagcctgccccccggagaggagctcaagacagtaactgagaaagatgttgcacttctcggatccgtcagctcgtgctcctccacttcgtccctggaacatcgccagtcgtacccgaaaaaacaaaacgctatctcctctaataaaaagaccatgtccaagagccccagcctgtctagccgtgcctcagccggccttaacagcagcgccacttccactgcaaataacagcagatgcgaaggtgaattgcgcctgggcgagcgtgtgttagtcgtggggcagaggttgggcacaataaggtttttcggcactacgaatttcgcgccagggtactggtacgggatagagttggagaaacctcatgggaagaatgacggtagtgtaggcggagtgcagtacttctcttgtagtccaaggtatggcattttcgcccctccctcacgcgtccagagagtgacggactcattggataccctttccgagatttccagtaataagcagaatcacagctacccagggttccgcagatctttctcaactacctccgcttcatctcagaaggaaatcaaccggcgaaatgctttctcaaagagcaaagctgccctcaggcgctcttggtcaagcacaccaaccgccgggggcatagagggttcagttaagctccacgaggggtctcaggtgctactgacctctagcaacgagatgggtacagttcgatatgtgggtcctactgatttcgcgtccggcatttggctgggattagagctgagatctgccaaaggtaaaaatgatgggtctgtcggtgacaagcgttattttacatgcaagcccaatcacggcgtgctggtgcggccatcaagagtgacatacaggggaatcaatggtagcaagctcgtcgatgagaactgttag

SEQ ID NO: 44649 - DNA, 2172 bp, Artificial Sequence
  Description of Artificial Sequence: Synthetic coding sequence
aagatgaccatcgaggacctgcccgacttccccctggagggcaaccctctttttggaaggtacccctttatcttctccgcctcagacacaccagtgattttctccatctcggctgcccccatgcctagcgactgtgagttcagcttctttgatcctaacgacgcctcatgtcaggaaattctctttgatccgaaaacaagtgtatccgagctgttcgcaattcttaggcagtgggtgcctcaggtacagcagaacatcgacataattggaaacgagatcctcaaaaggggatgcaacgtaaacgaccgggacgggttgacagacatgacactactccattatacttgtaagtcaggcgcacacgggataggggacgtggagactgcagtaaagttcgcgactcagttaatcgacctgggcgctgacattagtttgcgatcgcggtggactaatatgaacgccttgcattacgctgcctatttcgatgtccctgaacttatccgcgtgatcttaaagacatccaagcccaaggatgtggatgctacatgctcagatttcaactttggcacagcactccacattgccgcttacaacctctgcgctggagccgtgaagtgcctgctcgagcagggtgcaaatccggcattccggaacgataaaggccaaattcccgcggacgtagtccctgatcctgtcgacatgcccctcgagatggcggacgccgctgcaaccgctaaggagattaagcagatgctgttggacgctgttccgctcagctgtaacatcagtaaggccatgctgcctaactacgatcacgttactggaaaagctatgcttacgtctctaggtttgaagcttggggatcgggtcgtcatagcaggccagaaagtaggaaccctgaggttctgcgggacaaccgagtttgcatccgggcagtgggctggtatcgaactggacgaaccagagggcaagaacaatggctcagtgggcaaggtccaatatttcaagtgtgccccaaaatatggcatcttcgctcctctatccaaaatttccaaagctaaggggagacggaagaacatcacacacactccttcaacgaaggcagccgtacctttaattcgatctcagaaaatagacgtagcccacgtcacctccaaggtgaatactgggttaatgacctctaaaaaggactccgcgagtgagtctacactatcgctgccccccggagaggaactgaagaccgtaaccgagaaggacgtagccctgctcgggtcggtatctagttgcagtagtacatcaagtctcgagcatcggcaatcttaccccaagaagcagaatgccatctcatctaacaagaagactatgagcaagtcaccttcgctgtctagtcgcgcctccgccggcatatatggcttttttaaccaagctttcctcgtttttttcattttggtgtgcctgtttgagtttttgtctaatatatactctaattctcggtgtgaaggcgagcttagacttggggaaagggtgctggtggttgggcagcggctcggcaccatcagattttttggaaccaccaatttcgcccctgggtactggtacgggatcgaacttgaaaagccccacgggaagaatgatggttccgtcgggggggttcagtatttctcttgctccccgcggtacggaattttcgcgcccccctccagagtgcaaagggtgacagattcactggacaccctaagcgagatctcatccaacaaacaaaatcatagctatccagggttccgcagatcttttagcacaacttcagcctcctcccagaaagaaattaatcgcagaaatgcctttagtaagtctaaggctgccctgcgccgaagctggtccagcacacccacagcgggagggattgagggatctgtcaagctacacgagggatcacaagtgctcttaacttcatccaacgagatggggacggttcgatatgtcgggcctacagattttgcgtcagggatatggctgggccttgaattgcggtcagccaaaggaaagaatgatgggagtgtaggagacaagcgttacttcacttgcaagccgaaccatggggtcctagtgaggccatcacgggttacctatagagggatcaacggctcaaagctggtcgatgagaactgttag

SEQ ID NO: 44650 - DNA, 2124 bp, Artificial Sequence
  Description of Artificial Sequence: Synthetic coding sequence
atgaccatcgaggacctgcccgacttccccctggagggcaaccccctgtttgggcggtatccgtttatcttcagcgcttcagatactccagtaatttttagcatcagtgcagcaccgatgccctctgattgtgagtttagtttctttgatcctaatgacgcctcttgccaagagatccttttcgatcccaagaccagcgtttcggagctcttcgctattcttcggcagtgggtgcctcaagtccagcaaaatatcgatatcattggaaacgagattcttaaaagaggctgtaatgtgaacgatcgcgatggtctgacagacatgacactgcttcactacacctgtaagtcgggcgcacacggcattggagacgtcgaaaccgcagttaaatttgccacccaactgatcgacttaggcgctgacataagtcttcgttctcggtggacaaacatgaacgcacttcactacgctgcttattttgatgtgccggaacttattcgtgtgattctgaaaacatcaaaacctaaggacgttgacgcaacctgcagtgactttaattttggaaccgccctccacattgctgcttataacctttgcgcaggcgcagttaagtgtttgctggaacagggggcaaatccagccttccgaaatgataaaggccagattcctgccgacgtggttcccgacccagtggatatgcccttagagatggctgacgcggcggctaccgcaaaggagattaagcagatgctgcttgatgcggtgccacttagttgtaacatctctaaggcaatgctccccaattatgatcacgttaccggaaaagccatgctcacatccctggggctgaaactcggagatcgcgtggtaatcgccgggcagaaggttggtacgttacggttctgtggcacaacggaattcgcaagcggccagtgggccggtatcgagttagacgagcctgagggtaaaaacaatggaagcgttggaaaagttcagtacttcaagtgtgctccaaagtatggcatctttgccccgctctctaagatttcaaaagcaaagggtagacgcaagaacattacacacactccatccacgaaagccgccgttccactgatccggagccagaaaatcgatgtagcccacgttacttccaaggtcaacactggcctgatgacgtctaaaaaggattccgcctcagagagtaccctcagtctgccccccggagaggagttaaagacagtgactgaaaaagatgtcgcgttgctggggagcgtaagctcttgtagcagtaccagctcgcttgagcaccggcagtcgtaccctaaaaagcagaatgccatttccagcaacaagaaaacaatgagcaagtctcccagcctgtccagtcgtgccagtgctggactgaattcaagcgccacctcaacagccaacaattcgcgatgtgaaggggagctgcgcctcggcgaacgggtgctggtggtgggtcagcggctggggacaatccggtttttcggaaccactaactttgcccccgtcctgggatactggtatgggattgagctggagaagccgcacgggaaaaatgacggaagtgtggggggagtccagtacttttcatgttcccctagatatggcatcttcgcgcccccatctagggtgcagagagtgactgactctctggacaccttaagtgaaatctccagtaataagcagaaccactcctatccaggctttagacggtcattttccactaccagcgcttcctcccagaaagagatcaatagaagaaacgcgttctccaaatcaaaggcagccctcaggagatcctggtcctctactcccactgccggagggatcgaagggagtgtgaagctgcacgagggaagccaggttctgctgaccagcagcaacgagatgggcactgttcgttatgtcggtcctaccgactttgccagcgggatatggctggggctcgagctccgaagtgctaagggtaagaacgatggcagcgtgggtgacaagaggtacttcacctgcaagccaaaccacggagttctcgtgaggcccagccgagttacctaccgcggcataaacggtagtaagttagtcgatgaaaactgttag

SEQ ID NO: 44651 - DNA, 2118 bp, Artificial Sequence
  Description of Artificial Sequence: Synthetic coding sequence
atgaccatcgaggacctgcccgacttccccctggagggcaaccccctgttcggccggtaccctttcatcttttccgcttctgatactcccgtgatcttctccatttccgcagctccaatgccaagcgattgcgagttttccttcttcgacccgaatgatgcgagttgtcaggagatcctgtttgaccccaagacaagcgttagtgagctgtttgcaatcttgcgccagtgggtcccgcaggtgcagcagaacatagacattatcggcaatgaaatattgaagcgtgggtgcaatgtcaatgatagggatggattaaccgacatgacattactgcactatacttgcaagtcgggagcccatgggatcggtgatgtggaaactgccgtgaagtttgccacccagttaatcgatctgggggccgacattagccttcgctccaggtggaccaatatgaacgcgttacactacgctgcctattttgacgttcccgagcttattcgggttattctgaaaacatccaagcccaaagacgtcgacgccacctgctccgattttaacttcggtaccgcacttcacatagcagcttacaacctgtgcgcgggtgcggtaaaatgtctactggaacagggtgctaacccagccttccggaatgataaaggccaaatccccgccgacgtggtccctgaccccgtagatatgccgctggagatggcggatgcagctgccacagcgaaagaaattaagcagatgcttttggacgctgtccccttgtcctgtaatatttccaaggctatgttgcctaactacgatcacgtgactggaaaggccatgctgacatcattgggactgaagctgggtgatcgggtcgttatcgccggacagaaggtcggaacactccggttttgcggtaccaccgaatttgcttccggacagtgggcagggatcgaattagacgagcccgagggaaagaacaatggctcagttggcaaagtccagtattttaagtgtgctcccaagtatggcatctttgcaccactgtctaaaatcagcaaagctaaaggacgacgcaagaacatcacccataccccctctacaaaggccgccgtccccctgatccggtcccagaagatcgatgtagctcatgtcacctccaaggtcaacacggggttgatgacaagcaagaaagacagcgccagtgagagtacattgtccctccccccaggtgaggaactgaagacagttactgagaaagatgtggcactgttgggatccgtgagctcttgtagtagtactagttccctggagcaccgccagagctacccaaaaaaacagaatgctattagtagtaacaagaagacaatgtcaaagtctccctctcttagttcaagggcgtccgcaggcctgaattccagcgcgacctcaacggccaacaacagcaggtgcgagggcgaacttcgactgggtgagagagtgctggtagtgggacagaggctgggtactattcgattcttcgggaccacaaatttcgctcctgggtactggtacggtattgagctggaaaaaccgcatggtaagaatgacggtagcgtggggggcgtccagtacttttcttgttcccccaggtacgggatttttgcaccaccttccagggtccagagagttactgatagccttgatacacttagtgagatctcatctaacaagcagaatcactcctatccgggtttccgacgctccttctctaccacatctgcgtcctcccagaaagaaatcaacaggagaaatgctttctcaaaatcaaaagccgccctgcgccgctcatggtcttccacccccaccgcgggcggtattgaaggtagtgttaagttgcacgaaggatcccaggtactgctaacctcctctaatgagatgggcactgtgcgctatgtcggacccacagatttcgccagtgggatttggttaggactggagctacgatctgccaagggcaagaatgacgggagcgtgggggacaaaagatatttcacatgtaagccaaaccacggtgtattagtgcgacctagtcgcgtgacctataggggcatcaacggttccaaacttgtcgacgagaattgttag

SEQ ID NO: 44652 - DNA, 645 bp, Artificial Sequence
  Description of Artificial Sequence: Synthetic coding sequence
atgaccatcgaggacctgcccgacttccccctggagggcaaccccctctttggtcgctatcctttcattttctcagcgagcgacactcccgtgatattctccatttcagccgctccaatgccatccgattgtgaatttagtttcttcgaccccaatgatgcttcctgccaggagatcttgtttgatcccaagacaagcgtgtcagaacttttcgccatattacgacagtgggtaccgcaagttcagcagaacatagatattattgggaacgagattttgaagcgggggtgtaacgtaaatgacagggacgggctgactgacatgacgctgctgcactacacatgtaagagcggcgctcacggaataggagacgtagagacagcagttaaatttgccacgcagctcatcgacctcggggcagatatctccctcaggtcaaggtggactaacatgaatgctctgcactacgccgcatactttgatgtgccggagctgatccgggttatattgaaaacctccaagccaaaagacgtcgacgctacatgctctgattttaacttcggcactgccctgcatattgccgcctacaacctgtgtgcaggagccgttaagtgtctgcttgaacagggagctaacccggcctag

SEQ ID NO: 44653 - DNA, 1998 bp, Artificial Sequence
  Description of Artificial Sequence: Synthetic coding sequence
atgcagcggcggaagcagaagcagaagaacctgaacgagagccactacctctgtatgctgcttcagagcgaactaagcgagttctcattttttgaccccaacgacgccagctgccaagagattcttttcgaccccaagacatctgtctctgagctcttcgccatccttagacagtgggtgccacaggtgcagcagaacattgacatcattggcaatgagatactgaagcgtggatgcaacgttaacgacagggacggtttgacggatatgacattattacattacacgtgtaagtcaggcgctcatggcatcggcgatgtcgagacagcagtcaaatttgcgactcaacttatagacctgggcgccgacatctcccttcgctcacgatggacaaatatgaatgcactccactatgctgcctacttcgatgtaccggagttgatccgcgtcatcctgaaaacctccaaaccaaaggatgttgacgccacgtgttctgattttaactttgggactgccctacacattgccgcatataatctgtgcgcaggagctgtcaagtgtcttttggaacaaggagccaatccagcgttccggaatgacaaggggcaaataccagccgacgtggtccctgacccggtggatatgcctctggaaatggcagatgctgccgccaccgccaaagaaattaagcagatgctgctggacgccgtgccgctgtcatgcaacatatcaaaagccatgttgcccaactacgatcatgtaacaggcaaggctatgctaacatctctgggcttgaagttaggagacagagtcgtgattgcaggccagaaggtggggactcttaggttttgcgggaccacggagtttgccagcggtcagtgggctgggatcgagcttgatgaacctgaggggaagaacaatggatctgtgggtaaagtgcagtattttaagtgcgcaccgaagtatggaatctttgcccctctgtccaaaatatccaaggccaaaggacgtaggaaaaacatcacgcacacgccatctacaaaggccgcggtgccattaattaggagccagaaaatcgatgtggctcatgtgactagtaaagtgaacaccggcctgatgacatctaagaaagactctgcttcagaatctactctctcactcccccccggggaggagctgaaaaccgtcacagaaaaggacgtagctcttctgggttccgtttcttctaataagaagactatgagcaagtcaccatctctcagcagccgtgcatccgctgggctcaatagctctgccacatccaccgccaataattccagatgcgagggagaactccgcctgggcgagcgggtattggtggtgggccagcgcctgggaaccatacggttttttggaactactaattttgcccccgggtactggtacgggatagagctggaaaaaccgcatggcaagaatgatggttcagtgggaggagtacagtattttagctgcagccctcgctacggcattttcgcgcctcctagccgcgtccagagagtcaccgacagcctggacactctttctgagatttcctcaaacaaacagaatcacagttacccaggattccggaggtccttctcaactacgagtgcctcaagccagaaggaaattaatcgacgtaacgctttctcaaagtcaaaggctgcgctaagaaggagctggagctctacccctacagcgggcggaattgaaggatcagttaagctgcacgaggggagccaggtcctgttaaccagctccaatgagatggggacagttaggtatgtaggacccacagattttgcctcgggcatctggctcgggttggagttaagatccgctaaaggcaagaatgacggcagtgtgggggataagcggtactttacttgcaagccgaaccacggggtactggtgcgaccctcacgcgtcacttatcgagggattaacggctccaagctggtcgacgaaaactgctag

SEQ ID NO: 44654 - DNA, 1173 bp, Artificial Sequence
  Description of Artificial Sequence: Synthetic coding sequence
atggtgacccgggccggcgccggcaccgccgtggccggcgccgtggtggtggccttgctgtcagccgctttagccctttatggaccccctctcgacgctgtcctcgagcgcgccttttcgttgaggaaggctcattcaattaaagatatggagaacacattacagctggtaagaaacatcatccctcctttgagttccactaagcataagggacaggacgggcgcatcggcgtagtggggggatgtcaggagtacacgggagccccttactttgcagcaatttctgcccttaaggtcggagccgatctctcccacgtattctgcgccagcgctgccgctcctgtgataaaggcatattcccctgaacttatcgtacaccctgttcttgactctccaaacgctgttcatgaggtggagaagtggctgccccggctccacgccctggtagttggaccagggctcggacgcgacgacgccttacttcgtaacgtacaaggcattctggaagtgagtaaggccagggatattccagttgtcattgatgccgacggcctctggctggttgcccagcagccagctttgatacacggttatagaaaagcagtcctcacacccaaccacgttgaattctctaggttgtatgatgctgtgcttagaggtcctatggactccgatgattcccacggaagcgtcttgagattgagtcaagcattgggaaacgttactgtggttcaaaaaggggaacgagacatactgtccaatggacaacaggtccttgtatgcagtcaggaggggagctcaaggaggtgtgggggccagggtgacctgctttccggatctcttggagttcttgtccattgggccctgctcgcagggccccagaagaccaatggcggaataagtgacttgaagttaactatctggggacccgaaatcgagaccggtgtgaaaaccagggcgcagggctcctgtggtccccggactaccacacccacttctccccatttgctgctttccccctccccacaagtccagccctcacccggaggtcgtgtctggcgactcctgtctcatcaagccgtccagccaccctccctaccggaggcacggtctctccatcatcacctgaggcatgaccggcgtggcggtggtagacttcagcaggctctttag

SEQ ID NO: 44655 - DNA, 366 bp, Artificial Sequence
  Description of Artificial Sequence: Synthetic coding sequence
atggccctgggcccccggtgcggcgccatccgggcctgccggcgggttttggaacgggctttcagcctgcggaaggcacattcaatcaaagatatggagaataccctgcagctcgtgagaaatattatcccacctctatcttccactaaacacaaaggccaagatggacggatcggcgtcgttggagggtgccaggatgattctccaaatgctgtgcatgaagttgaaaaatggctgcctcggctccatgccttggttgtgggcccgggcctcgggagggatgatgcattattgcgtaacgtacagggcatcctggaggtgtccaaagccagagatatccccgttgtcatcgatgctgtgagttag

SEQ ID NO: 44656 - DNA, 714 bp, Artificial Sequence
  Description of Artificial Sequence: Synthetic coding sequence
atgctgcccgacggccccggcagcagcctgtggggcaaccccggcctgcaaacctcggattctccaaatgctgttcatgaagttgagaaatggctcccccgactgcatgccctggtcgtcggacctggcctcggccgggacgatgccctacttcggaacgtgcaaggcattttggaagtctccaaggctcgagacatcccggtggttatagatgcggatggtctctggctggtcgcccaacagcctgcacttatccatggttaccggaaagctgtcctgaccccaaaccatgtggaattttctaggctttacgatgcggtgctgcgcggccccatggacagtgacgactcacacggatccgttctgagattgtcacaggccttgggtaacgtgacggttgttcagaagggcgaaagggacatattgtcgaacgggcagcaagtgctggtttgcagtcaggagggaagctccaggaggtgtgggggccagggggacctactgtccggttccctcggcgttttggtccattgggcactgttggcaggaccacagaagaccaatggctcaagtcctctgctcgttgccgcatttggtgcctgctctttaaccaggcagtgtaaccatcaggctttccagaaacacggcaggagtacaaccacctctgacatgatcgctgaggtgggtgcagccttctccaaactgtttgagacgtag

SEQ ID NO: 44657 - DNA, 972 bp, Artificial Sequence
  Description of Artificial Sequence: Synthetic coding sequence
atggccctgggcccccggtgcggcgccatccgggcctgccggcgggtgctggagagggcattctccctccgcaaggcccattctatcaaagacatggaaaacacactgcaactggtgcgcaatatcatccctcccctgagcagcacaaaacacaaagggcaggacgggagaatcggggtggttggaggatgtcaggagtataccggagcgccctatttcgctgccataagcgcactgaaagttggcgcggaccttagtcacgttttctgtgcatctgccgcagccccagttatcaaggcatacagtcctgagctgatagtgcacccagtgctcgacagtccaaatgccgtgcatgaggtggagaagtggttgccccgcctccatgccctggtcgtgggccctgggcttggaagggatgacgccctactgagaaatgtgcagggaatcctggaggtatcaaaagctagagatattcccgtagtcatcgacgcggatgggctgtggctcgtggcccaacagcctgccctgatccatgggtaccggaaggccgtattgacgcccaatcatgtagagttctcccgtctctacgacgccgtgctcaggggcccaatggactcggacgattcacatggatctgtgttgaggctttcacaagccctcggaaatgtcacggtggtccagaaaggggagagggacattttaagcaacgggcagcaagtactggtgtgttctcaggagggaagctcaaggagatgcggcggacagggggacctgctgtctgggagcctcggtgtgctcgtgcattgggccctgctagcaggcccccaaaaaacaaacggctccagccctctgctcgtggctgcctttggtgcatgttctctgacacggcagtgcaaccatcaggcatttcagaagcacggggcctgccagatcttcaacttatctataaactggctgcccctgaggatttag

SEQ ID NO: 44658 - DNA, 651 bp, Artificial Sequence
  Description of Artificial Sequence: Synthetic coding sequence
atggccgtgttccccgccaccgcccggggccagctgggcatccggaacgccgcccgatggccatgggtgctggcagtcggccaaagtggcctggccgacgaggggatactggaagtcagtaaggcaagggatattcctgttgttattgacgctgatggattatggctggtagcccagcagcctgctcttattcacgggtatagaaaagcggttcttacccccaaccacgtagaatttagtagactgtatgatgctgttctgcggggtccaatggattcagacgacagccacggctcagtactcagacttagtcaggccctgggaaacgtgactgtcgttcagaaaggtgagcgagacattctgtctaacggtcagcaagtgctggtgtgctcccaagagggtagctccagacgatgcggggggcagggcgatttactctccggctcactgggcgtgctggtgcactgggcactcctggcgggaccccagaagacaaacggctcatccccgctgctggttgccgctttcggggcatgttcacttactcggcagtgcaatcaccaggcgttccagaaacatggtagatctaccacaacctccgatatgatcgcagaagtcggagctgctttttccaaacttttcgagacatag

SEQ ID NO: 44659 - DNA, 789 bp, Artificial Sequence
  Description of Artificial Sequence: Synthetic coding sequence
atgagccggctgagctggggctaccgggagcacaacggccccatccactggaaagagtttttccctattgccgacggcgatcaacagagtccaatcgagataaaaacaaaagaagtgaagtacgatagtagcctgagacctctaagcataaaatatgacccgagttctgcaaagatcatatctaatagcggtcatagtttcaacgtggacttcgatgacacagagaacaagtccgtgttgcggggcggccccctcacggggtcgtaccgactgcgtcaagtgcacctgcactggggatctgctgacgaccacggtagcgaacatattgtcgatggagtgtcttacgccgcagagttacatgttgtgcattggaatagcgacaaatacccatccttcgtcgaagccgcccatgaacccgatgggctcgcggtgctgggcgtgtttctgcagatcggagaacctaactcccaactacagaagatcaccgacacccttgattcaatcaaggaaaaaggcaaacagacgcgctttaccaacttcgatctcctgagcttgcttccacccagctgggattattggacctaccctggctccctcaccgtacctccactcctggagagtgttacatggattgttctcaagcagcccataaacattagcagccagcagctcgctaagtttcgctccctgctttgtacagcagagggtgaagctgctgcctttctggtgagcaaccatcgacccccccagcctctcaaagggagaaaagtgcgggcctcattccactag

SEQ ID NO: 44660 - DNA, 1311 bp, Artificial Sequence
  Description of Artificial Sequence: Synthetic coding sequence
atgcagggcacccccggcggcggcacccggcccggccccagccccgttgaccgtaggaccttacttgtattctcgttcatattggctgccgcccttggccaaatgaatttcaccggcgatcaagtcctgagggtgttggccaaggacgaaaaacaactgtcacttctgggcgacctggagggcctgaaacctcaaaaggttgacttctggagaggtcctgctcggccgtccctgcctgttgacatgcgagtcccttttagtgaactcaaagacattaaagcgtacctagaatctcatggccttgcctattccattatgataaaggacatacaggtgctgctcgacgaagaaagacaggccatggctaaatcaagaagactcgagcggagtactaacagtttttcatactcctcatatcataccctagaggaaatttactcttggatcgacaatttcgtgatggagcattccgacattgtgtctaaaatccagatcggaaatagcttcgaaaaccagtctatcctcgtgctgaaattctcaacaggaggaagtcgacaccctgccatctggattgataccgggattcacagtcgcgaatggatcacacacgctaccgggatctggactgccaacaagatcgtgtctgactatggaaaggaccgggtcctcacagacatcttgaatgctatggacattttcatcgagctggtcaccaaccctgacggcttcgcttttacacatagcatgaataggttgtggcgcaagaacaagagcattcgacccggaattttctgcatcggggttgaccttaacagaaattggaagtccggctttgggggtaatggcagtaatagcaacccctgtagtgagacatatcatgggcccagcccgcagtcagagcccgaggttgcggccattgtgaacttcattaccgcccatggcaacttcaaggccctgatcagcatccatagttactcgcagatgctgatgtacccttacggaaggctgctcgaaccagtctctaaccaacgggaactgtacgatctggctaaggatgccgtcgaagctctctataaagttcatgggatagaatatatcttcggtagtattagtaccactctgtacgtcgcgagcgggatcaccgtggactgggcatacgattcaggtatcaaatatgccttttcgtttgagcttcgggatactggtcagtacggatttttgctgcctgctacccagatcatcccaactgctcaggaaacctggatggcattaagaaccattatggaacatactttgaatcacccttactag

SEQ ID NO: 44661 - DNA, 1311 bp, Artificial Sequence
  Description of Artificial Sequence: Synthetic coding sequence
atgcagggcacccccggcggcggcacccggcccggccccagccccgttgatcgcagaacgctcttggtgttcagcttcattctggccgccgcccttggccagatgaattttacaggagatcaggttttgagagtacttgcaaaggacgaaaagcagttaagccttctcggcgacttggagggcctcaaaccccagaaggtggacttctggcgcgggcccgcgaggcctagtctgcctgtggacatgagggtcccctttagcgagctgaaggacatcaaggcatacctcgagtctcatggcctcgcatactcaatcatgatcaaagatatacaagtgctgcttgatgaggagagacaagcaatggctaagagcaggagactggagcggtctaccaactcatttagctattcctcctatcataccttggaagaaatttactcttggatcgacaactttgtcatggaacactcagacatcgtttccaaaatacaaataggtaattccttcgaaaatcaatctattctggtgttaaaattctctactggtggatcccgccatccagcgatctggatcgacactggaattcattcccgagaatggattacgcatgccaccggcatatggacagccaataaaattgtatccgattatggaaaagatagggtcctgacggatattctaaatgcgatggatatattcatcgaactggttacaaatcctgatggcttcgctttcactcacagcatgaacagactctggcgcaaaaataagagcattcgcccaggcattttttgcatcggggtggatctcaatcggaactggaagagcggatttggcggcaacggatctaattccaacccttgcagtgagacttatcacgggccatctcctcagagtgagccagaggtcgcagcaattgttaacttcatcaccgctcacggaaatttcaaggccctaattagtattcatagctacagtcagatgctcatgtatccgtacggaaggcttctcgagccagtttctaatcaacgggaactctacgatctggcaaaggatgctgttgaggccttgtacaaggttcatggaattgaatacattttcggttctatcagcaccacactttatgttgcatcaggcattaccgttgactgggcctacgactctggcattaagtatgccttctcttttgagctacgggacacaggtcagtacggcttcctgctgcctgctactcagatcattccgactgcacaggagacatggatggccctgaggaccataatggagcacactctcaaccatccatactag

SEQ ID NO: 44662 - DNA, 2196 bp, Artificial Sequence
  Description of Artificial Sequence: Synthetic coding sequence
atgagccggcccggcaccgccacccccgccctggccctggtgctgctggctgtgaccctggccggagtgggggcccagggggccgctctggaagaccccgactattacggtcaggagatctggtcgcgagaaccctactatgctcggcctgagcccgaattagagaccttttctccccccctccccgccgggccaggcgaggaatgggaaaggaggcctcaggagccgagacccccaaagagggccaccaagcctaaaaaggctcccaaaagagaaaagtccgcccccgagccacccccacccgggaaacacagtaataagaaggtgatgcggacaaagtcctctgagaaagccgctaacgacgaccactccgtgcgagttgccagggaggatgttagggagagttgccctcctctgggcctggagacactgaagatcactgacttccagctgcatgctagcactgttaagcgttacgggcttggggcccacagagggaggctgaacatccaggccgggattaacgaaaacgacttttacgatggcgcctggtgcgcgggcagaaatgatctgcagcagtggattgaagttgatgctcgcagactgacgaggtttaccggggtaattacccaaggccggaacagtctgtggttaagtgactgggtgacgtcttacaaagtcatggtttctaatgacagccatacttgggttactgtgaaaaacggtagcggagatatgatctttgaggggaactctgagaaggaaattcccgtgcttaatgaacttcccgtccccatggtggcacggtacattaggatcaaccctcagtcatggttcgacaatgggtccatctgcatgcgcatggagatcctggggtgcccactgccagatcctaacaactattaccatcggcgcaatgaaatgacaactacagatgacctcgatttcaagcaccacaactataaggagatgaggcagcttatgaaggtcgtcaacgagatgtgtcccaatattacccgaatatacaatattggcaagtcccatcaagggcttaaattatatgctgtggaaatctccgaccatccgggagaacatgaggtaggagagcctgagttccactatatcgccggcgcccatggaaatgaggttctaggaagagagctcctactgctcttggtccagttcgtatgtcaagaatatctggcccgcaacgctcgcatcgtgcacctcgtggaggagacacgaatacacgtgctgcctagccttaaccccgatggttacgagaaggcatatgagggggggtctgagcttggaggatggagtttgggacggtggactcacgacgggatcgatattaataataatttcccggatctcaacacgctcctctctgaaaatgctacagtggccgccgaaacccgggcggtgatcgcctggatggagaaaatccctttcgttctgggcggcaacctgcagggcggcgaattagtggttgcatatccgtatgacttggtcaggtctccgtggaagacccaggagcacactcccactcctgatgatcatgtgttccggtggctggcctatagttatgcctctacacacagactcatgactgatgctaggaggcgcgtctgtcataccgaagactttcaaaaggaggaaggcacggtgaacggagcgtcctggcataccgtggcaggctcccttaatgacttttcatacctgcatacgaactgtttcgagctttcgatttatgtgggatgtgacaaataccctcatgagtcccagcttcctgaggaatgggagaacaaccgtgaatctttgatagttttcatggagcaggttcatagggggatcaagggccttgttcgcgattctcatggaaaagggattcctaacgctatcatctccgtggaaggaatcaaccatgacatacgcaccgcgaacgacggcgactactggcgcctgctaaaccctggcgagtacgtggtcaccgcaaaagctgaaggctttaccgcctcgaccaagaactgcatggtaggctacgatatgggcgccacaagatgcgatttcaccctctctaagactaatatggctcgtattcgtgagataatggagaaattcggaaagcagcctgtatctctgcctgcaagacgactgaagcttcgtggacaaaaacgccgccagcgcggatag

SEQ ID NO: 44663 - DNA, 1770 bp, Artificial Sequence
  Description of Artificial Sequence: Synthetic coding sequence
ctggagatccaggccggcatcaacgagaacgacttctacgacggcgcctggtgcgccggaaggaacgacttacagcaatggatagaggtggacgcccggagactcacaaggttcaccggtgtgataactcaagggagaaactcgctctggctgagcgactgggtaacaagctacaaggtgatggtcagcaatgatagccacacctgggtgacagtcaagaacggtagcggggacatgattttcgaaggaaactcggaaaaggaaatcccagtgctgaatgagctgcccgttcctatggttgcccggtacattcgcattaatccccagagttggtttgacaacggctctatttgtatgcggatggagatccttgggtgcccgctccctgatccaaacaactactaccatcggcggaatgagatgacaaccaccgacgatctggattttaagcatcataattacaaggaaatgaggcagttgatgaaggtcgtgaatgagatgtgccccaacattactcggatctataatattggtaaaagtcaccaggggcttaagctctacgccgtcgaaatatccgatcaccccggagagcacgaagttggtgagcccgaattccattatatcgctggagcccatggaaacgaggtcctggggagagaactgcttctgctgctcgtgcagtttgtctgccaggagtacctggcacggaacgcccgcattgtccacctcgttgaagaaaccaggatccatgtactgcctagcctaaatcctgatggctatgagaaagcttatgagggcggatccgagttgggcggatggagcttggggcgttggacgcatgatgggatcgacattaataacaactttccggatctgaacactctgctctgggaggccgaggatagacaaaatgtgcctcgcaaagtgccaaaccactacattgctatcccagagtggtttctgtctgaaaatgccaccgtggccgccgaaacacgagcagttatagcctggatggagaagattccatttgttctgggcggaaatctgcagggtggcgagctggtggtggcctacccctatgacttggtgcgcagcccatggaagactcaggagcacacccctacacctgatgaccatgtgtttcggtggctcgcatactcttatgcttccactcaccgactcatgaccgacgcacggcggagagtttgccataccgaggacttccaaaaggaggaggggactgtgaacggcgcctcctggcacaccgttgctggaagcttgaatgacttcagttaccttcatacaaattgctttgagctgagcatctacgtgggctgcgataaataccctcatgagagccagcttccagaggagtgggaaaataatcgcgaatcattgattgttttcatggaacaggtgcaccgcggtattaagggcctggtgcgcgatagtcacggtaaaggaatcccaaacgccattatcagtgttgaggggattaatcacgacatccggacagcgaacgatggcgactactggagactgttgaaccctggagagtacgtcgtgacagcaaaagccgagggcttcacagcctcaacaaaaaactgcatggtgggttatgacatgggtgcgactagatgtgactttaccttgagtaagacaaacatggctaggatcagagagataatggaaaagttcgggaagcagccggtgtcacttcctgccaggaggctgaaacttcgaggtcagaagcgcaggcagcggggttag

SEQ ID NO: 44664 - DNA, 1464 bp, Artificial Sequence
  Description of Artificial Sequence: Synthetic coding sequence
atgagcgacctgctgagcatctacagcgcccccgtggtggtgagcacagtcttgcacatcacaatcgtgttccccattcttcagataaggaaactgcggctcgggcgtgttcacaaattgccgcgagtcctggaggttggcaattctggcacaatgagtagggcgtacacctttttctttctgagatggaattcgatggcactgaccgggtattcctggctgctgctgagtgcgaccttcctgaacgtaggcgcagaaatcagtatcacactcgagccagcgcagcctagcgaaggagataatgtcaccctcgttgtacatgggctgtccggcgagctcttggcctacagctggtacgccgggccaactctctctgtttcatacctcgtggctagctatatagtgtccaccggcgatgaaactcctggcccagcacatacaggtagggaagcagtgcgccccgacggcagcctggatattcagggtattcttccacgccactcaggaacctacatcctccagacttttaatagacagctccagacagaggtgggttatgggcatgtgcaggtgcacgagattctagcccaacctactgttctggccaattccactgctctggtggagagaagagatactctgcgtttaatgtgttcatctccatctcctacagccgaggtgaggtggtttttcaacggcggtgcactgccggtcgcattgcggcttggactcagtccagatggaagagtgcttgcccgacacggcataaggagggaggaagccggggcttatcagtgcgaagtttggaacccggtgtccgtgagtagaagtgagcccataaacctgaccgtttacttcggacccgaacgcgtcgctattttacaagatagtactactaggacaggatgtacaattaaagtagattttaacacaagtctgactctctggtgtgtgagccgctcttgtccggagcctgaatatgtgtggacatttaacggtcaggccctgaagaacgggcaagatcacctcaacatcagtagtatgacagccgcacaggaaggcacctacacctgcattgctaagaataccaaaacccttctgtccggaagcgccagtgtcgttgttaagctgtctgccgctgccgttgcaacaatgattgtgccagttccgacaaagccaaccgagggccaggacgtgacactcactgtccaagggtaccccaaggatcttctggtctacgcatggtaccgtggcccggcctccgagccaaacagactgttatctcagctgcccagcggcacttggattgccggaccagcacacactggccgcgaggtcggcttccccaattgtagcctcttggttcagaaacttaacctcactgatacagggaggtacacattgaaaacggtcactgtccagggcaaaacagaaacactcgaagtggaactgcaagtggcttag

SEQ ID NO: 44665 - DNA, 1278 bp, Artificial Sequence
  Description of Artificial Sequence: Synthetic coding sequence
atggccctgaccggctacagctggctgctgctgagcgccaccttcttgaatgtgggcgcagagattagtatcaccctggagccagcccagccaagcgaaggtgacaatgtgactctcgtggtgcacggcctgagcggagagctgcttgcttactcctggtatgccggacccacactgagtgtatcttacctcgtggcatcctatatcgtctctaccggcgatgaaacccctggacccgcccacactgggcgcgaagcagtaagacctgatggctcccttgacatccagggaattctgcctagacactctggtacctatattctccagactttcaatagacagctgcaaaccgaagtcggctacggacatgtccaagtccacgaaatactggcgcagccaacagttctcgccaactccactgctctagttgaaaggcgggataccttgcggctgatgtgcagcagtccttctccaaccgcagaggtgaggtggttcttcaatggaggagccctgcccgtggcactgagacttggattaagccccgatgggagagtcctggcccgccacggaatccgccgggaggaagctggggcctaccaatgcgaagtctggaatcctgtgtccgtttctagatccgaaccaattaacctaacagtgtactttggacctgagagagttgctatccttcaagactcgaccactagaactggttgcactatcaaagtggactttaacacaagtcttaccttgtggtgcgtctcaaggtcttgtcccgaaccagaatatgtctggaccttcaacggccaagcactgaagaatggacaggatcaccttaatatctctagtatgactgctgcacaggaaggcacttatacatgcattgcaaagaatacaaaaacactgctgtcaggctccgcaagtgtggtcgtcaaattgagtgcagccgccgtggcgacaatgattgtcccggtccctactaagccaaccgagggtcaggacgtgacactaactgtccaggggtaccctaaagatctgctggtgtacgcctggtaccggggaccagccagcgagccaaatcgtcttttgtcccagctgccctccggcacatggatcgctggtcccgcccatacaggccgcgaggtggggttccccaactgcagtctgctggttcaaaagctgaatctgactgacaccggacgatataccttgaagacggtcacagtccagggtaagacggagacactggaagtcgaactgcaagttgcgccccttggctag

SEQ ID NO: 44666 - DNA, 1092 bp, Artificial Sequence
  Description of Artificial Sequence: Synthetic coding sequence
atggacctgagccggccccggtggagcctgtggcggcgggtgttcctcatggcaagcttgctggcctgcggcatttgccaggccagtggacaaatttttattactcaaacattgggaattaagggatacaggaccgtcgtagcactggacaaggtgcctgaagacgtgcaggaatatagttggtactggggtgccaatgattccgcaggcaatatgattatcagccataaaccccctagcgcccagcagcccgggcctatgtacaccggccgtgaacgtgtgaatagagaaggatcattgctgattagaccaaccgctttgaatgacacaggaaactatactgtccgcgtagtcgccggaaatgagactcagcgggcaacaggatggctcgaagtgctggagctgggaagcaacctggggatctcagtcaatgcgtctagcctagtggagaacatggacagcgttgctgccgactgcctcacaaacgttacaaatatcacatggtatgtgaacgatgtccccacttcatcctcggaccggatgaccatttctcccgacggcaagactctggtaatcctgagggtctcccggtatgatcgaaccatccagtgtatgatcgaatcctttcctgaaatttttcaaagatccgagcgcatttcactgacagtggcatacggacctgactacgtgctgctccgttccaacccagatgattttaatggaattgtgactgctgagatcggtagccaggtcgagatggaatgtatctgttactcttttttagacctgaagtatcactggattcataacgggtcactcctgaatttttccgacgccaagatgaatctgagttcgctcgcatgggaacagatgggaagataccgttgtacagttgaaaacccagttacccagctgattatgtatatggacgtgcgtattcaggcccctcacgaatgcccacttcctagcggcatactgcccgtcgtccacagggatttctccatctcgggttcaatggtaatgtttctaataatgctgactgttctgggcggagtatatatctgtggcgtgctcatccacgctctgatttag

SEQ ID NO: 44667 - DNA, 1197 bp, Artificial Sequence
  Description of Artificial Sequence: Synthetic coding sequence
atggaggtgagcggctgccccacccccgccggccagagcgccccctggggaggaaaggccgctctgaaggcaggaaggagagaccgacagccgttgtgtcaggaaacacaggtgctggagggggccgaagaggtcgctgtgagcttggaaggccccttgctactggaagaccctcgccagctcatggatctgtctcgccctcgctggagcctctggaggagagtgttccttatggccagcctactcgcgtgtggcatctgtcaggcttcgggacagatcttcataactcaaacgctgggaatcaaggggtaccgaaccgttgtcgctttggataaagtgccggaagacgtgcaagagtactcttggtactggggagcgaacgatagcgctggcaatatgattatttcccataaacccccctcagctcagcaaccaggcccaatgtacacaggcagagaacgggtgaatagagaagggtcactgctcatccgccccacagccttgaatgatactggaaactacactgtgcgcgttgtggccggaaacgagactcaacgagcgactggctggctggaggttctggaacttggctctaacctcggcatttccgttaatgctagttccctggttgaaaatatggattctgttgcagccgactgcctgacaaacgttactaatatcacctggtacgttaatgatgttcccacctcttcttctgacagaatgaccattagccccgacgggaagaccctcgtgattctcagggtctcgaggtacgatcgcaccatccagtgtatgatcgaaagttttcccgaaatcttccagaggtccgaacgtatttctctgactgtcgcctatggcccagattacgtgcttctacggtcaaatccagacgatttcaatggcattgtcaccgctgaaattgggtcacaagtggagatggaatgcatctgctactccttcttagatctgaaatatcactggattcacaacggttcgctgttaaacttttccgatgcaaagatgaacctttcttcattagcctgggagcagatgggccggtatagatgcactgtggaaaaccccgtcacccagctgatcatgtacatggacgtgcgcatacaggcgcctcacgagtgcagtagctctccaccaggatcttgtttcgctcatcttccggcaagtatgccttgttag

SEQ ID NO: 44668 - DNA, 705 bp, Artificial Sequence
  Description of Artificial Sequence: Synthetic coding sequence
atggagaagtgcaagggcaccagccggatggccggcaccaccagcgccgatgtgaagatgagcagctccgaagaggtgagctggatttcatggttttgcggactgcggggcaatgagtttttttgcgaagtggacgaggactatatccaagataagttcaacctgactgggctgaatgaacaggtgccccattatcggcaggccctggatatgattctggatctagaacctgacgaagagctcgaagataatccaaatcagtctgatctcatcgaacaggccgccgagatgctatatggtctcatccacgctcggtatatattaactaaccggggtattgcgcaaatgctcgagaagtaccaacaaggagattttggctattgtcctcgggtctactgcgaaaaccagcccatgctcccaatcggactgtccgacatccccggagaagccatggtgaaattgtattgccccaaatgcatggacgtctacaccccaaagtcctctaggcaccaccacaccgacggcgcttattttggtaccggctttcctcatatgctgtttatggtccaccccgagtataggccgaaacgcccggctaatcagtttgtgcctagactgtatggatttaagatccatcctatggcataccagctgcagttgcaggcagcgagcaatttcaaatctcccgtcaagactataagatag

SEQ ID NO: 44669 - DNA, 294 bp, Artificial Sequence
  Description of Artificial Sequence: Synthetic coding sequence
atggccgacaaggtgctgaaggagaagcggaagctgttcatccactccatgggagagggcaccattaatggtctcctggacgagttgctgcagaccagggtcctgaatcaagaagagatggaaaaggtgaaacgggaaaatgctaccgtcatggacaaaaccagggcactgatcgattccgtgatccctaaaggggctcaagcatgccagatatgcatcacctacatttgcgaggaggattcctatctcgccgagactctgggtttgtcagctggacccatccctggtaattag

SEQ ID NO: 44670 - DNA, 594 bp, Artificial Sequence
  Description of Artificial Sequence: Synthetic coding sequence
atggccgacaaggtgctgaaggagaagcggaagctgttcatccactctatgggagaaggaaccataaacgggcttctggatgagctgctgcaaaccagagtgctgaatcaggaggagatggaaaaagtgaagcgcgaaaatgcaaccgtgatggataaaactagagccctgattgactctgtgatacccaagggagcccaggcctgccaaatttgtattacgtacatatgtgaagaagactcttacttagccgagacccttggcctgagtgctgcactgcaggctgtgcaggataacccagccatgcccacctgcagcagtcccgaaggtagaatcaaactatgcttcctggaggacgctcagcggatctggaaacaaaaacttcagcggtgtcatgtgcagaacactatcattaaatggagcgagaggtatacttcaggttccttcgagatgcagtggctcttcctgcggactaactttattgagagattctggcgtaacatcctcctgttgcccctccataaaggttccttataccctagaattcccggcttaggcaaagagttacaaaccgggacgcataaactgtcttag

SEQ ID NO: 44671 - DNA, 294 bp, Artificial Sequence
  Description of Artificial Sequence: Synthetic coding sequence
atggccgacaaggtgctgaaggagaagcggaagctgttcatccacagtatgggcgaggggactatcaatggactgctggacgaactgctgcaaacccgggttttgaatcaggaagagatggaaaaggtgaagcgggaaaatgcaactgtgatggataagactagagccctcattgacagcgtcatacccaaaggggcccaggcttgccaaatttgcatcacctatatctgcgaagaagactcttacctggctgaaactctgggattgtccgccggcccaattccaggcaactag

SEQ ID NO: 44672 - DNA, 273 bp, Artificial Sequence
  Description of Artificial Sequence: Synthetic coding sequence
atggccgaccagctgctgcggaagaagcggcggatcttcatccacagtgtgggggctggcactatcaacgctctgttagactgcctgcttgaggacgaggtcatcagtcaagaagacatgaacaaagtgcgggacgagaacgatacagtgatggacaaagccagggtcctgatagacctcgtcacgggcaaagggcctaagtcttgctgtaaattcataaaacatctatgcgaagaggacccgcagctcgcctctaagatgggcctccactag

SEQ ID NO: 44673 - DNA, 672 bp, Artificial Sequence
  Description of Artificial Sequence: Synthetic coding sequence
atggccctgagcgtgcccctgctgtacagcctggtgcgggccatctcagaagctggggcgcctcccggcagcgccgggccattgttgctgcagccacagagacaccgcgccgctggctgcttccttggaacatgtctcgacttgctggactctttcacattagtggaattgatgctcgagggacgcgtgccccttccggcgcacctcagatacctgctgattgctgtgtatttcttgacacttgcttcccccgtcctgtggttgtatgagctcaatgcggccgccgcagccgccgcgtcgtggggtcaggcttcaggtcccggttcctgtagcaggttactgcgtctgctgggagggtgtctcgtggatgtgccgcttcttgccctgaggtgtttgctcgtggtaagctaccagcaaccactgtcaatcttcatgttgaagaatctttttttcctgggctgtcggggcctggaagcccttgaggggtgttgggatcggggtaaccgagcgtccccgagtagggcccgtggaggctacggcgcccccccaagtgctcccccgccaccgccccctccaccacagggaggcagccagttgggacattgtatttcagagaacgagggcggggcccatgggtacgtgaatacactggctgttgcctctcagaattag

SEQ ID NO: 44674 - DNA, 1737 bp, Artificial Sequence
  Description of Artificial Sequence: Synthetic coding sequence
atgcggcccgccctgggccacccccggagcgtgagcagcgccagcggctcttttccccccccaccagcagcagcccggctgcagcccctgttcctgaggggcggctctttcagaggtagacggggatccggagactcctccacgtccacttctacttcacgcgggggagggggcgggaggagaggcggaggaggcggatccccctcgtcttctactggggccgaaagggaggacgacgatgaatcgctgagcgtgtctaagccactggtccctaacgccgcccttctaggtcctcccgcccaggtgggagcacccgcaggaccggcgccggtggcctttagcagtagcgctgcaacctccagtagcaccagcacacctacatcttcttgttccatgaccgccgccgatttcggagggggcgccgcagcaggcgccgtaggcggcccaggatcgagaagtgccgggggagctggcgggactgggaccgggtccggagcctcctgttgcccttgttgctgctgctgcggatgccccgataggcccgggcggcggggtcgccgccggggctgcgctccctctccccggtgccgatggggctatcaggcactgagcgtggtgctgctcctagcccaaggcggtcttctggacctctacctgatcgcagtgacagacctgtattggtgcagttggatagctactgacctcgtcgtggtggttggctgggcgatatttttcgccaaaaactcacgcgggcgacggggtggcgccgcatccggtgcacacaaccatcacttgcatcatcaccatgccgcccctcctctacacttgcctgcaccatctgcggctaccgccggcgccaaagcaagaggcgcccgaggaggagctgggggggctggtggtggcctgggcgcagcggccgcggccggcgaattcgcctttgcatacctagcctggctcatatattccatcgctttcactcctaaagttgtgcttattctgggcacctctatactggacctcatcgagctcagagccccattcggaacaactggcttcaggctcacaatggcactttcagtgccacttctgtatagtctcgttcgcgctatttcggaggccggagcccctccaggctccgccggccctctcctactgcagccacaacggcacagagctgccggttgttttctgggtacgtgtttggatctcttggattcctttacattggtggaactgatgctggagggcagggtgccactgcccgcacatctgcgatacctgcttattgccgtgtactttctgacactagccagtccggtcctctggctctatgagctcaatgccgccgctgccgccgccgcttcttggggccaggcctccggccccggatcctgctctcggttgttgcgcctgttaggaggctgtctcgtggatgtaccacttctcgcactcagatgcctgttagtggtcagttaccagcagcctcttagcatctttatgttgaaaaaccttttttttctgggatgcagaggactggaagctttagaaggctgctgggatagaggcaacagagcatcgccaagcagagcccgcggagggtacggggcccccccttctgccccccctccacctcctccaccacctcaggggggcagccagcttgggcactgcataagcgaaaacgaagggggggcgcacggctacgttaataccctggctgtcgccagtcagaactag

SEQ ID NO: 44675 - DNA, 2262 bp, Artificial Sequence
  Description of Artificial Sequence: Synthetic coding sequence
atggccgacaagcggaagctgcagggcgagatcgaccggtgcctgaagaaagtttcagagggggtggagcagtttgaggacatatggcaaaaattgcacaacgcagctaacgccaatcagaaggagaagtacgaagcggacttgaaaaaagaaattaaaaaattgcagcggctcagggatcagatcaagacgtgggtcgcctccaacgaaatcaaggataagaggcagctaatcgacaaccggaagctcatcgagacgcaaatggagcgcttcaaggtcgtcgaacgagagaccaaaactaaagcatactccaaggaaggcctgggcttggcccagaaagtcgatcccgctcaaaaagagaaggaagaggttggtcagtggctgaccaacactattgacaccctgaatatgcaggtcgatcaatttgagagcgaggttgaatcactcagcgtgcagactcgcaagaaaaagggggataaagataaacaagacaggatcgaaggattaaagagacacatagagaagcacagatatcacgtgcgtatgctagagaccatcctccgcatgctggataacgacagcatactggtcgacgccatccggaaaatcaaggacgacgttgaatattacgtcgacagttcccaggacccggattttgaagagaacgaatttctgtatgacgacttggacctggaggatattcctcaggcccttgtggccacctctccgccctctcactcccacatggaggatgaaatctttaatcagtcctcttcaaccccaacctccacgacatccagttctccaatcccaccttcaccagctaactgcacgacagagaactctgaggatgacaaaaagcggggtcgctccacagactcagaggtgagccagagtccagccaagaacggcagcaaaccagtgcacagcaatcagcatccccagagtcctgcagtgccccccacctatccttccggaccaccccctgccgccagtgccctgtccactacgcccggaaacaacggggtgccggcgcccgccgcccccccaagcgccctgggccccaaggcaagtccggccccctcccacaatagcggcactcccgctccctacgcacaggctgttgcaccccccgcaccatcaggaccctcgacaacgcagcccagacctccctcggtccagccctccggcggcggaggagggggcagtggcggtggtggtagcagtagcagctcaaactcttcggccgggggcggcgctggaaagcagaatggagccacaagttattccagtgtggtggccgactcacccgccgaggtggccctgtcaagttccggcgggaataacgcctcaagtcaggccctgggcccccccagcgggccccataacccgccaccgtcaacctctaaggaaccatcagctgccgcacctactggcgcagggggcgtagcacccggctctggcaataattcgggcgggccatctctgctggttcctctgccggtaaatccccccagtagccctaccccttcattttctgacgccaaagcagctggggccctgctcaatgggcccccccagtttagcacagcgcctgagattaaagctcctgaacccctgtcgagcctaaaatccatggcagaacgagccgccatatctagcgggatagaggatccagtgccaacactgcacctgaccgagcgagatattatcctgagttccacctcagcacctcctgcctcagctcaaccacctctccagctgtctgaagttaatatccccctatcactgggggtatgtcctctcggtccagtgcccctgacaaaggagcagctctaccagcaagcaatggaggaggccgcttggcatcacatgccacaccccagcgactctgaacggattcgtcaatacctcccacgaaacccatgtcctacccctccatatcatcaccagatgccaccaccacacagtgacactgtagaattctaccagcggctttccactgaaacccttttttttatattttactatcttgaaggcacgaaagctcagtacttggctgcgaaagcactcaaaaagcagagctggcggtttcacacaaaatacatgatgtggttccaaaggcacgaggagccgaagactatcacagacgaattcgagcaggggacctacatttactttgactacgagaagtggggtcagcgtaagaaagaaggcttcacgtttgagtacaggtacttggaggaccgcgacctccagtag

SEQ ID NO: 44676 - DNA, 2262 bp, Artificial Sequence
  Description of Artificial Sequence: Synthetic coding sequence
atggccgacaagcggaagctgcagggcgagatcgaccggtgcctgaaaaaagtgtcggagggtgtggaacaattcgaggatatctggcaaaaactccataacgccgccaatgctaaccagaaggaaaaatatgaagccgatctgaaaaaggagatcaaaaagctccagaggttgcgggatcaaattaaaacttgggtcgcgtctaatgaaattaaggataaaaggcagcttatcgataacagaaaactcatcgagactcagatggagcggttcaaggtggtagaaagggagaccaaaactaaggcgtactccaaggagggactgggactggcccagaaggtcgatcccgcccaaaaagagaaggaagaagttggtcagtggctaactaacacaatcgatacattgaacatgcaggtcgaccagtttgaaagcgaggtggaatccctgtctgtgcagactagaaagaaaaagggggacaaggataagcaggataggatagagggtttgaagaggcatatcgagaagcatcgttatcacgtgaggatgttggaaacaattctgaggatgctggacaacgatagcatactagtggatgccatcagaaagatcaaggatgacgtggagtattatgtcgactcctctcaggatccggattttgaggagaacgagttcctctatgatgatctcgatctagaggatataccgcaggctctagtagccacttcacctccaagtcactcccacatggaagacgagatcttcaaccaatcatcaagcacacctaccagcacaactagttcaagtccaatccccccctctcccgccaactgcacaactgaaaatagcgaagatgacaaaaagcgtgggcgaagcacagattccgaagtctcacaatccccagctaaaaatggatctaagccagtgcatagcaaccagcacccacaatccccggctgtgccacctacgtacccatctgggccacctcctgcagcttcagccctctccaccactccagggaataacggggttcctgcacctgccgcgcccccaagcgccctgggccctaaagcatcccctgccccttctcacaactcaggcacccccgcgccttatgcacaggccgtcgcaccacctgcaccgagtggcccgtcaacgactcagcccaggccgccttccgtacagccttccggtgggggcggtggaggaagtggtggtggcgggtctagtagcagctcgaactcatcagccggtggaggcgctggaaagcagaacggagccacctcttactcctctgtcgtcgccgacagccccgccgaggtggctctttctagctctggtgggaataacgcatcctcccaagcgctggggccgccatcaggcccacataacccgcctccctccacatccaaggaaccctcagcagccgcaccaacgggcgccggcggtgtcgcccctggatctggtaacaacagcggcggtccctcacttctggtgcctcttcctgtgaaccctccctccagtccaaccccctcattttcagacgccaaggccgctggggctctgcttaacggccctccccagttcagcacagcacctgagataaaagcccctgagcctctgagcagcctgaagtccatggccgaaagagctgctatatcaagcggtatcgaagatccagtaccaaccctgcatctgacggagagggatatcattctgagctctacatctgcaccaccagcctccgcccagccacccctgcaattaagcgaagtgaacataccattatcccttggggtttgtccgctgggccccgttcccctcactaaggagcaactgtaccagcaggcgatggaggaagctgcctggcaccacatgccacatccgtcggactccgagcggatcaggcaatacttgccaaggaatccctgtccaactccgccatatcaccaccagatgccgccacctcattccgacacagtggaattttatcaacgactgagcacagagacgctgtttttcatcttttattatctagagggcaccaaggctcaatacctggcggccaaggcactcaaaaaacaatcttggcggttccacaccaagtacatgatgtggttccagcggcatgaggaacccaagacgattaccgacgagttcgagcagggcacatacatatactttgactacgagaaatggggccagagaaagaaagaggggttcacttttgagtatcgctacctggaggacagggatctgcagtag

SEQ ID NO: 44677 - DNA, 2262 bp, Artificial Sequence
  Description of Artificial Sequence: Synthetic coding sequence
atggccgacaagcggaagctgcagggcgagatcgaccggtgcctgaagaaagtgtctgagggagtagagcagttcgaagacatttggcagaagttacataatgcggcgaatgccaatcagaaggagaagtatgaggctgacttaaagaaggagatcaagaaattgcaacggctgagagatcagataaagacatgggtcgcttccaatgagataaaagacaagcgacagctgatagataacagaaaactcattgaaacacagatggagagattcaaggtggtggaaagggagactaagacgaaggcttattcgaaagagggcttgggtttagcgcagaaggtggatccggcccagaaagagaaagaggaggtggggcagtggctgaccaacactattgataccctgaatatgcaggtcgaccagttcgaatccgaggtcgagtccctgtcggtgcaaacaagaaaaaagaaaggagacaaggacaaacaagacagaatcgaggggctgaagcgtcatatcgagaagcatcgctaccacgtgcggatgctggagacaatattacggatgttggacaatgattccatcttagtagatgcgattagaaaaatcaaggatgacgttgaatattacgttgactctagccaggaccctgacttcgaggaaaatgagtttctttatgatgacctcgacctcgaagacatcccacaggctttggtggcaacctccccaccttcgcactcacatatggaagatgaaatcttcaatcaaagcagtagcacacccacttctacaacatcaagttctccaatcccaccgagtcctgccaattgtacaactgagaattcagaggatgacaaaaagcggggacgaagcactgattcggaagtgagtcagtcacctgccaagaacggaagcaagcctgttcacagcaatcaacatccccagtcaccggccgtaccgccaacatatccgagcggcccccccccagccgctagtgcactgagcaccacgcccggcaataacggcgtgcccgcccccgctgcccctcctagtgcgctgggccctaaagcctcacccgctccctcccacaattctggcactccagctccctacgcccaagccgtggccccaccagccccaagtgggccatctacaacccagccaaggcctcccagtgtgcagccctccggcggcggcgggggaggatctggaggaggaggaagtagttcttcatctaattcatcagcggggggaggagcaggaaaacagaatggtgctacatcttacagcagcgtggtcgccgatagtccggccgaggtagcgttgtcatccagtggaggcaacaatgcttcatcacaggctctcggcccgccatcaggcccccataatccgccaccctcaacttcaaaggagccttctgcggcagcaccaaccggcgcgggaggggtcgctcccggctccggtaataattcaggaggtccgagcctcctggtccctctgccggtgaaccctccatcttctccaaccccttctttctctgatgccaaagccgccggggctctgctgaatgggcctccacagttctccaccgcccctgagataaaggctccggaacccttgtccagcctgaaatccatggccgaaagggccgccattagctctggtatcgaggaccctgtacctacacttcatttaaccgagagagacatcatcttatccagcacgtccgcccccccagcctctgcgcagcccccactgcagttatcagaggttaacatcccgctgagtctgggagtgtgcccccttggaccggtccctttgacaaaggaacagctgtatcagcaggcaatggaggaggccgcttggcatcacatgccccacccaagcgactctgagaggataaggcagtatctgcctcggaatccttgtcctacacccccctaccaccaccaaatgccgcctcctcacagcgacaccgttgagttctaccagagactaagcacggaaacattgttctttattttctactatctcgagggaacaaaggcccaatacctggcagcaaaagctcttaagaaacaatcttggcgctttcacaccaaatacatgatgtggttccagcgacacgaagaaccgaaaacgattaccgacgaatttgaacagggcacctacatctacttcgattatgagaaatggggccagagaaaaaaggaggggttcacgttcgaatatcgctaccttgaggatcgtgacctacagtag

SEQ ID NO: 44678 - DNA, 2262 bp, Artificial Sequence
  Description of Artificial Sequence: Synthetic coding sequence
atggccgacaagcggaagctgcagggcgagatcgaccggtgcctgaagaaagttagcgaaggcgttgagcaatttgaggacatatggcagaagttgcacaacgcagctaacgccaaccagaaggagaaatatgaggctgatctaaagaaagagattaaaaagctgcaaaggcttagagaccaaatcaagacatgggtggcttcaaacgagataaaggacaaaagacagttaattgacaataggaagctgattgaaacccagatggagagattcaaagtcgtcgaacgcgagaccaaaaccaaagcttactctaaagagggactaggattggcgcaaaaggtcgatcctgcccaaaaagagaaagaagaggtcgggcagtggttgactaacacaatcgacaccctgaacatgcaggtggatcagtttgaatccgaagtggaatcactctctgttcagactcggaagaagaagggcgataaagataagcaggatagaatagaaggcctaaagcgacacatagaaaaacacaggtatcatgtccggatgctcgagaccatactgcgtatgcttgataacgacagcatcctcgtggatgccatacggaagataaaggatgacgtggaatattatgttgactcctcacaagacccagactttgaagaaaatgagttcctgtacgacgatctcgacctcgaagatatccctcaagctctggtggcgaccagccccccctcacattcccacatggaagacgaaatattcaatcagtcttcatcaacccctacgagcaccacatctagtagcccgatccctcctagccctgccaattgcacaacagaaaactcggaagacgataaaaaaagaggaagaagcaccgacagtgaagtgtctcagtcacctgccaagaacgggtccaagcccgtgcatagcaatcaacaccctcaatctccagcggtgccgccaacctatccatccggacccccacccgccgcctcagctcttagtacaaccccagggaacaacggggtgccagctccagctgcgcctcctagcgcgctgggacccaaggcgtccccagccccctcacataacagtggaacacccgcgccctatgcgcaggcagtggcgccccccgccccatcagggcccagtactacccagccgaggccaccaagcgtgcagccctccggaggcggcgggggaggatctggcggcggcgggagctcctcatcttctaattcttcagccggaggtggggccgggaagcaaaatggtgccacaagctatagcagtgttgttgccgacagtccggctgaggtggcactgagctcctcaggggggaataacgctagttcccaggcactaggcccacctagtggtccgcacaacccaccgccaagcaccagcaaagagccttcagctgctgcccccactggggctgggggtgtggcacctggatccggcaataacagcgggggaccatccctgttagtgccgctaccagttaatcctcctagtagtcctactccctcctttagcgacgcaaaggcggctggagcactgctgaatggacccccacaattctccactgctcccgaaatcaaggcaccagagccactctcatcgctgaagtccatggccgaacgagcagcaattagctcaggtatcgaggaccctgtgcctaccttacacctgaccgagagggacattattctgtccagcacatccgctcctcccgcatccgcccagccgccactccagttatccgaagtgaacatccctctcagtctcggagtgtgccccttgggtcccgttcccctgaccaaagagcagctttatcagcaggccatggaggaggccgcctggcaccacatgccgcacccttcagattccgaaaggattcgccaatatctgcctcgtaacccatgccccacaccaccttatcatcatcagatgcccccacctcactcagacactgtggagttctatcaacggttgagcacagaaacactcttctttattttctactacctggagggcactaaagctcagtatttagcagccaaagccctgaagaaacagtcatggagattccatactaaatacatgatgtggttccagcgccatgaagaacctaaaacaatcaccgacgaattcgagcaaggaacctacatctattttgactatgagaagtggggccagagaaagaaagagggattcacattcgagtatcggtacctcgaagaccgcgacctccagtag

SEQ ID NO: 44679 - DNA, 2262 bp, Artificial Sequence
  Description of Artificial Sequence: Synthetic coding sequence
atggccgacaagcggaagctgcagggcgagatcgaccggtgcctgaagaaggtgagcgagggagttgagcagttcgaagatatttggcagaagctgcacaacgccgccaacgctaatcaaaaggagaaatatgaggccgacctgaagaaagagattaaaaagcttcagaggctgcgggatcagataaagacatgggtggcgtccaatgaaattaaagataagagacaactgattgataatagaaagctcattgagacccagatggagcgctttaaagtggtggagagggagacaaaaacaaaagcttatagtaaggaagggctgggtctggcccagaaagtcgatccagcccagaaagaaaaagaggaagtcggccagtggctgacaaataccatcgatacacttaacatgcaggtcgaccagttcgaatccgaggtcgagtccctcagtgttcaaacacggaagaaaaaaggtgacaaagataagcaagaccgaattgagggcttgaagcgccatatcgagaaacatagatatcatgtgcggatgctggaaacaatcttgaggatgttagataatgattccatcctagtagacgcaataagaaaaataaaagacgatgtggaatactatgtggattcatcgcaggatcccgacttcgaggaaaatgaattcctgtacgacgatctggacctagaggacattccccaagctctggtcgcaacatcccctcctagccactctcacatggaagatgagatctttaatcaatcctcgtctacaccaacgtcaaccacatccagtagcccgattccgcccagtcccgccaactgcaccacggagaattcagaggacgacaagaagagaggtagatccactgatagcgaggtaagccagtccccagctaagaatggatccaagcctgtgcactctaaccagcaccctcagagtcctgcagtgcctccaacctacccgagcggacctcctcctgccgcctcggccctgtccaccactcctgggaataatggggtccctgcccccgccgcaccaccttccgcccttggtcctaaggcttctcccgcccccagccataattctggcacacctgccccttatgcccaagcagttgccccccctgcccccagcggtccctctactactcaacccagacctccatctgtacagccatctgggggcggcggaggggggtcgggtggtggcggcagctccagctccagcaacagctccgccgggggcggagccggtaagcagaatggcgctacctcgtattcatcagttgtggcagattctcctgccgaggtcgctctgtctagttccggcggcaacaatgcctcctcccaggccctgggaccgccctctggcccccataacccacctcccagcacttcaaaagagccatcagccgcagcccctacaggagctggtggagttgcaccaggttcaggcaataactctggtggaccctcactgctcgtcccccttcccgtgaatcctcctagctcccccactccttctttctccgatgctaaagctgctggggcactgctcaacgggcccccacagtttagcacagcaccagaaattaaagctcccgaacctctgagctctttaaaatccatggcggaacgtgccgcaatctcttcaggaatagaagatcccgtccccactcttcatttaaccgagagggacatcatcttatccagcacctccgcaccaccggcttctgcccaacctccccttcagctaagtgaagttaatattcccctaagtttgggtgtttgcccactgggccccgtgcccctaaccaaagaacagttgtaccagcaggctatggaggaagcagcttggcaccatatgccccatccaagtgacagtgagcgcatcagacagtacttgcctagaaatccatgcccaacccctccctaccatcaccagatgcccccaccccactccgacaccgtggagttttatcagaggcttagcaccgagaccctctttttcattttctattatctagagggcactaaagctcaataccttgcagccaaggccctcaaaaagcagagctggcgctttcatacaaagtatatgatgtggtttcaaagacacgaggaaccaaagaccatcacagacgagtttgaacagggcacctacatctacttcgactacgagaagtggggtcaacgaaagaaggagggtttcaccttcgaatacagatacctggaggacagggatcttcagtag

SEQ ID NO: 44680 - DNA, 2262 bp, Artificial Sequence
  Description of Artificial Sequence: Synthetic coding sequence
atggccgacaagcggaagctgcagggcgagatcgaccggtgcctgaaaaaagtcagcgagggtgtcgagcagtttgaggatatctggcaaaaattacacaatgccgcaaacgcaaaccagaaggagaaatacgaagccgaccttaagaaggagatcaaaaaactgcaacggctcagagatcaaatcaaaacctgggtggcgtctaacgaaattaaggataagcggcaattaattgacaatagaaaattgattgaaacacagatggagaggtttaaagtcgttgaacgcgaaaccaaaacgaaggcgtacagcaaggagggtctgggcctcgctcagaaagttgatcctgctcagaaggagaaagaggaggtcggccaatggcttaccaacacaatcgataccctcaatatgcaggtggatcaattcgagtccgaggtggaatccttgtcggtccagacacggaaaaagaaaggagataaagacaagcaggatcgaatagaaggacttaaacgccacattgaaaaacacaggtaccatgttcgcatgctagaaacaatcttgaggatgctcgataacgactctatcctggtggatgcgatccggaaaataaaggacgacgtggaatattacgtcgatagctctcaggatcctgacttcgaagaaaatgaatttctgtacgacgatttggatctggaagatatcccacaggcattggtggctaccagccccccaagtcacagccacatggaggacgagatttttaaccagtcctcaagcacaccaacaagcaccactagttctagcccaatacctccaagtccggctaactgtacaaccgaaaattctgaggatgacaaaaaaaggggaagaagcacggactcagaagtgagccagtctcccgccaagaatgggtctaagcccgtccattctaaccagcacccgcagtctccagccgttccccctacctacccgtccggtcctccccccgcagcatcagccttgagcaccacaccagggaacaatggcgttcccgcccctgctgctccacccagcgcactgggaccaaaagcaagccccgctcctagccacaattcgggcactcccgcgccttatgcccaggctgtcgccccacccgcccctagcggaccgtccaccacacagcctcgccccccgtccgtccaaccctctggcggaggaggaggcggaagcggtggcggaggatcctcaagctcaagcaacagctctgcaggagggggcgctggtaagcagaatggggcgacaagctattctagcgtggtggcggactcaccagcagaagtggccctcagttcatcgggcggaaacaacgcatccagccaggcgctgggacctccctccggaccacataatccacctccgagtaccagcaaggagcccagtgctgccgctccaaccggagcaggcggcgtcgcccccgggagtggcaacaatagcgggggcccctctctgctggtgccattgcctgttaatcctcccagcagcccgacccctagcttttctgacgctaaagcggctggtgcactgttgaacggacctccccagttctctaccgcacccgaaatcaaagcacctgaacccctgtcctctctcaagtccatggctgaaagggctgctatcagcagcgggatagaagatcctgttcccacactacatcttaccgagcgtgacatcattctatctagcaccagtgcaccacccgccagcgctcagccacccctccagctcagcgaggttaatatcccactgagtcttggtgtctgcccactggggcctgtgccactgactaaggagcagctgtaccagcaagccatggaggaagcagcctggcaccacatgccccacccctcagacagcgagcgtattaggcagtacctgcctcgaaatccctgcccaactcccccctaccaccaccagatgccacctccgcactcagacaccgtggagttctatcagcgattgtcaaccgaaacactcttcttcattttttactatctggaaggaaccaaggctcaatatttagccgccaaggccttgaagaagcaatcctggagatttcacaccaagtacatgatgtggttccagagacacgaggaacccaaaacgatcactgacgagttcgagcagggcacgtacatctattttgactatgaaaagtgggggcagcggaaaaaggagggttttacgtttgagtaccggtacctggaagatagggaccttcagtag

SEQ ID NO: 44681 - DNA, 2262 bp, Artificial Sequence
  Description of Artificial Sequence: Synthetic coding sequence
atggccgacaagcggaagctgcagggcgagatcgaccggtgcctgaagaaggtaagtgaaggtgtcgagcaattcgaagatatatggcaaaaactgcataatgccgccaacgctaaccagaaggaaaagtatgaggccgacttgaaaaaggagatcaaaaaactgcagagactgcgagaccagatcaaaacctgggtggctagtaatgaaattaaggacaaacggcagttaatagacaatcgcaagctgatcgagacacaaatggaaaggttcaaagtggttgagcgagaaacaaaaacaaaggcatactccaaggaaggccttgggctggcccaaaaggtggacccagctcagaaagagaaggaagaggtgggccaatggcttacaaataccatcgataccctgaatatgcaagttgatcaattcgaaagcgaagttgagtctttatcagtgcagacaaggaagaagaagggggacaaagacaaacaggatcgcatcgaaggactaaagagacacatcgaaaagcacagatatcacgttcgtatgctcgaaaccatactgagaatgttggataatgactctattcttgtggatgctatccgaaaaattaaggacgacgttgaatactatgtagattcctcgcaggaccccgactttgaggagaatgaattcctgtacgacgatttagaccttgaggacattccccaggctctcgtggcgacctctcccccttctcatagtcatatggaggatgaaatctttaatcagagttcttcaacaccaactagtaccacctcctcttctccaattcctcctagtcccgcgaactgcaccactgagaattctgaggacgataagaaaaggggacgaagtactgactctgaagtcagtcaaagtcccgctaagaacggctcaaaaccagtacacagtaatcagcacccacagtcaccagccgtgccccctacatatccgagtgggcctcctcctgccgccagcgctctgtccactacgcctggcaataatggcgtcccagcccctgctgccccgccctcagctctggggccaaaggcgtccccagccccatcccataatagcggtacacctgctccatacgcccaggctgtggcacccccggccccctctggcccttcaactacacagccacgcccaccatccgtgcaaccatccggggggggcgggggtgggtcaggaggtggagggagctcttctagcagcaactcaagcgcaggagggggggcgggcaaacagaacggagcgacttcttatagctctgtcgttgccgactcacctgcagaggttgccctatccagctccgggggaaataatgctagcagtcaagctctcggtcccccttctggccctcacaaccccccacccagtacaagcaaggagccaagtgcagctgccccaactggtgccggcggagtcgcacctgggagcggaaacaatagcggtgggccttcattacttgtgcctcttccggtaaatccccccagctctcccacgcccagcttttcagatgcgaaagctgcaggcgcactcttgaatggtcctcctcagttctcaactgctcccgagataaaagccccagaacctcttagttcccttaaatcaatggcagaaagagctgccatctccagcggtattgaggatcctgtgccaaccttgcatcttacggagcgggacataatcttaagctcaacctccgccccccccgctagcgcacagccaccactgcagctttcggaggtcaacatccctctgagtctgggcgtttgtccactcggcccagttcctttaacaaaagaacaactgtatcagcaagctatggaggaggccgcatggcatcacatgccacatccgtccgatagcgaacgaatccgccagtacttgccgcggaatccatgcccaacaccaccataccatcaccagatgccacccccccatagcgacaccgtcgagttttatcagcgactctccactgaaactttattcttcattttctactacctggagggcacaaaagcccagtacctggcagccaaagctctcaaaaaacagtcctggagattccacacgaaatacatgatgtggttccagcgtcacgaggaacccaaaacaattaccgatgagtttgagcaaggtacttacatttattttgactacgaaaagtggggccagcgcaagaaggaaggttttactttcgagtatcgttacttggaagatagggaccttcagtag

SEQ ID NO: 44682 - DNA, 810 bp, Artificial Sequence
  Description of Artificial Sequence: Synthetic coding sequence
atggagcggctggtgatccggatgcccttcagccacctgagcacctactccctcgtgtgggtgatggctgccgttgttctgtgcacagcacaggtgcaggttgtgactcaggacgagagagaacagctttatacgccagcttctctgaaatgtagtcttcaaaatgcacaggaagctctgatcgttacctggcagaaaaagaaagctgtgtctccagagaatatggtgaccttcagtgagaatcacggcgtcgtcattcagcccgcctataaggataaaatcaatatcactcagctggggctgcagaatagtactattacgttctggaatatcaccctggaagacgaggggtgttacatgtgtctcttcaacacattcgggttcggcaagatctccggaactgcgtgcctcactgtgtacgtgcagccaatcgtttccttgcactataagttcagcgaggatcacctgaacattacctgttccgccaccgcaagaccggcaccaatggtcttttggaaagttccaagaagcggtattgagaacagcactgtgactctttctcaccccaacggtactacttctgtgacatcaattctgcatatcaaagatcctaaaaaccaagtggggaaagaagtgatttgccaggtcctgcacctcggtaccgttactgactttaagcaaactgtgaacaaagggtattggtttagcgtgccgttgctgctgtccattgtgtcactggtgattcttctggtactgatttctatacttttgtactggaagcgtcacagaaaccaggaccgcgaaccatag

SEQ ID NO: 44683 - DNA, 885 bp, Artificial Sequence
  Description of Artificial Sequence: Synthetic coding sequence
atggagcggctgaccctgacccggaccatcggcggccccctgctgactgctaccctactgggcaagaccacaattaatgactaccaggttatcagaatgccttttagtcacctgtccacttattcactggtgtgggtgatggcggccgtcgtgttatgtaccgcgcaggttcaggttgtgactcaggacgaaagagagcaactttatacccccgcgtctctcaagtgctctctgcaaaatgcccaagaggctctgattgtaacttggcagaagaaaaaagccgtgtcccccgagaatatggtgactttctccgaaaaccatggagtggtgattcagcctgcctataaagataaaatcaatattacccagctgggactgcagaactcgaccattaccttttggaacattaccctggaagacgagggatgttacatgtgtctgttcaataccttcggcttcggcaagatatcaggtacggcttgcctgactgtgtacgtacagcccatcgtatccttgcattacaagttttctgaggaccatctcaacatcacctgctcagccacagctcggcctgcaccgatggtgttctggaaggtacccaggtctggcatcgaaaattccacggtcactctatctcaccctaatggaacgacgtctgtcacctcaatcctgcatatcaaggaccctaaaaatcaagtgggaaaggaagtgatatgccaagtgctgcacctgggaacagtaacggattttaagcagaccgttaacaagggatactggttcagtgtgcccctattgctgtctattgtctccctggtcatccttctggtgctaatttctatcctcctgtattggaaacggcacagaaaccaggatcgggaaccttag

SEQ ID NO: 44684 - DNA, 1377 bp, Artificial Sequence
  Description of Artificial Sequence: Synthetic coding sequence
atgaaccggggcgtgcccttccggcacctgctgctggtgctgcagctcgcgttactgccggcagcaactcaaggaaagaaggtggtgctcggaaagaaaggtgacactgtggagctgacctgcacagcctcacagaaaaaatccatccaattccattggaaaaactccaatcaaatcaaaattctcggtaaccaggggtcattcttaactaaaggccctagtaagctcaatgaccgagccgattctcgtcgatcactgtgggatcagggcaactttcccctcatcatcaagaatcttaaaatagaggactccgatacatatatctgcgaggtggaagaccagaaggaagaggtgcagctgctggttttcggcctgaccgccaactcggatacccacctccttcaaggccagagcctgaccctgacccttgaatccccccccgggagcagcccgagcgtccagtgtcggtctcctcgggggaaaaatattcagggcgggaaaacactctccgtttcacagctggagctgcaggactccggcacttggacgtgcaccgtgctgcagaatcagaaaaaggtagaatttaagattgacattgttgtcctggcattccagaaggctagtagcatcgtctataagaaagaaggggaacaagtggagttctcgttccctttggctttcaccgtagagaagctgactggtagcggggaactgtggtggcaggcagagagggcaagcagctcaaagtcatggataaccttcgacttgaagaataaggaggtgagtgtcaagcgggtgacccaagatcctaaactacagatgggaaaaaagctacctcttcatctgacattgccccaggccttgccacagtacgccggaagcgggaacttgacgctggccttggaggccaagaccgggaagctgcaccaggaggtcaaccttgtggtaatgcgggctacccagctacaaaaaaacctgacctgtgaggtgtgggggccaaccagtccaaaattgatgttgagccttaagctcgagaacaaggaggccaaagtgagtaagcgtgagaaagccgtttgggtgctgaaccctgaagctggcatgtggcagtgtttgttatccgactccggccaggtgttgctcgaatcaaacattaaggttctgcccacctggtccacaccggtacagccgatggctcttatcgtgctcgggggcgtggccggcctcctgctgttcatcggcctcggcatttttttctgcgttcgttgccgacatcggcgtaggcaggcagagaggatgagccagataaagcgcctcctgagtgagaagaaaacatgtcagtgcccacatcggttccaaaagacttgctccccaatctag

SEQ ID NO: 44685 - DNA, 789 bp, Artificial Sequence
  Description of Artificial Sequence: Synthetic coding sequence
atggtggcctggcggagcgccttcctggtgtgcctggccttcagcctggccacactggttcaaaggggcagtggcgattttgacgattttaatttagaagatgctgtcaaggaaacatcttcagtgaagcagccgtgggatcacaccactacaacgactaccaaccggccgggaactactagggcgcctgccaagccacccgggtctgggctggaccttgcagatgccctggatgaccaggacgacggccgtaggaagcccgggatcggtgggagggagagatggaatcacgttactaccactacaaagaggcccgtaacaactagagcccccgccaacacccttggcaatgattttgatcttgccgatgctctggatgatcgtaacgacagggacgacggaagacgtaagcccatcgccggcggcggtggattttctgataaagacctggaggatattgtgggcggcggagagtacaagccagataaggggaaaggggatggccgctacggatccaatgacgacccgggctcggggatggtcgccgagccgggaacaattgctggggtggcatcagccctcgccatggctcttataggggccgtgtcctcctatatttcttatcagcagaaaaagttttgcttttccatccagcaggggctaaacgctgactacgtgaaaggggagaatctggaggccgtcgtgtgcgaggaaccacaggtgaagtacagcacactccatacacagtccgccgagcccccccccccacctgaacccgctaggatctag

SEQ ID NO: 44686 - DNA, 1437 bp, Artificial Sequence
  Description of Artificial Sequence: Synthetic coding sequence
atggccgccgccgccgccggcggcgcccccggccccgcccccggccccgcagggccgccgccgccagcagcccccacaagcgcagcgcgagctccgcctcaggccctccgcagacggggagactcgcgccgaagacaggcggccctcttttttcttaacaatatttcattggacggtagacctccatctctggggcccggcggtgaaaagcctccaccaccacccgctgaagccagggaaccgcccgcccctccgccccctgaacccccaaccggcctgccggctcgcactcccgcaccccagggcctgctgtcgccgacacaggtgcccactggtctcggacttgacggacaacggcagcgtaaacgcgtcactagtcagaggtgttccctggagttcctggaagacgccgtcggttgtgctcctgcgcagcgaactaagcatacgtctgggtcaccacgtcacaaagggttgaaaaagactcatttcatcaaaaatatgcggcagtacgatacacggaattcaagaattgtgctgatctgcgccaagagaagcttatgcgcagcattcagtgtcctcccttacggggaaggattgagaattagcgacctgcgggttgactcccagaagcagcggcatccttcaggaggcgtaagtgtgtcttcggaaatggtatttgaactcgagggggttgagctcggagcagacgggaaggtagtttcctacgccaaatttttatacccaacaaatgctcttgttacccacaagtccgattctcatggtttgcttcccacccctcgcccatccgttcctagaactctgccaggttcaagacataaaccagcccctactaagtccgctcctgcttctaccgaactggggtctgatgtgggcgacacattggagtacaaccccaacctgttggatgatccccaatggccctgcggaaaacacaagagagtgctgatctttgcctcctacatgactactgtgatcgaatatgtcaagccatccgacttaaaaaaggacatgaacgaaacctttagggagaagtttcctcatgtgaaactgaccctgagtaagattaggtctctgaagagggagatgcgtagtctttcagaggaatgcagcctggaaccggtgaccgttgctatggcctacgtctatttcgaaaagctggtgctccagggcaagctctcaaagcagaacaggaaactctgcgccggagcatgcgtactgctggctgcaaagatctcaagcgatctgcggaagagcggtgttacacagcttatagacaagcttgaggagcggtttagatttaatcgtcgtgacttaattggattcgaatttactgtcctcgttgccttggagttggcgctttatctgcctgagaatcaggtgctgccacactaccggcgcctgacacagcaattttag

SEQ ID NO: 44687 - DNA, 801 bp, Artificial Sequence
  Description of Artificial Sequence: Synthetic coding sequence
gaccgggcccacctgtgccaggccgtgcccgtgcggggcctgctgggtcctgccttgtgggggcgccccgccgaccaggttgtctcctacgctaaattcctgtatcccacaaacgctctggttacacataagagcgatagccatgggctgctgcctacgccccggccctccgttccgaggacccttcctgggtcacgccacaagcctgcacctaccaagtcagcccctgcttcgaccgagctgggcagcgacgtcggcgataccctcgaatacaacccgaacctgctcgacgatccccagtggccatgcggcaagcacaaacgcgttttgatctttgcttcttacatgaccaccgtgatcgagtacgtgaagccatctgatctcaagaaggatatgaacgagacttttagagagaaatttcctcacgttaagctcaccctttctaaaattcgaagccttaagagggagatgcgtagtctgagcgaggaatgttccctagaacctgttaccgtcgccatggcttatgtgtacttcgagaagctggttttgcaggggaagctctcaaagcagaataggaagctgtgtgccggcgcttgcgtattactggccgccaaaatctcctccgacctgcgcaaatccggagttactcaactgatagataaactggaggagagatttaggttcaaccggagggatcttatagggttcgaatttactgtacttgtggcactagagctcgccctttatctgcccgaaaatcaggtcttaccacactaccggaggctgacccagcagttctag

SEQ ID NO: 44688 - DNA, 777 bp, Artificial Sequence
  Description of Artificial Sequence: Synthetic coding sequence
tgacaccaggagcagcaggaccgggcccacctgtgccaggccgtgcctgtaaggggcctgttgggacctgccctgtgggggagacccgctgatcaagttgtgtcctatgccaagttcttgtaccctactaatgcactcgtgacacacaagtcagactcacatgggttgctgcccacacctcgccccagtgtccctcgtacacttccgggcagcaggcacaagccggcacccacaaagagcgcccccgcctccaccgaactcggcagcgacgtgggcgacacactggagtacaatccgaatttactggatgatccccaatggccttgtgggaagcacaaaagagtactcatctttgcctcatatatgactactgtgatcgaatacgtgaagccgagcgaccttaagaaggacatgaacgaaactttccgcgagaaatttccacatgtgaagctgactctgtcaaaaattcggagtctcaagcgcgaaatgcgctctttgagcgaagagtgtagcctcgaaccggtgaccgtagccatggcctacgtgtattttgagaagttggtattgcaggggaagctgtccaagcagaataggaagctctgtgcaggggcttgtgtgctgctggcggccaagattagctcggacctgcgtaaatccggcgtgacacagctaatcgataagctcgaggaaagatttcgttttaataggcgcgacttgatcggcttcgagttcaccgtgctggtcgcactagaactggctctgtatttacctgaatag

SEQ ID NO: 44689 - DNA, 258 bp, Artificial Sequence
  Description of Artificial Sequence: Synthetic coding sequence
atggtgggcggcgaggccgccgccgccgtggaggagctggtgagcggggttcgacaggccgccgattttgctgaacagtttcgctcttattccgaaagtgaaaaacaatggaaagcacgcatggagtttattctgaggcatctgccggattatagggacccgcccgacggatcgggcagattggatcagctcttatctctgtccatggtgtgggctaatcacttatttctaggctgttcgcctagaggccctaagtag

SEQ ID NO: 44690 - DNA, 351 bp, Artificial Sequence
  Description of Artificial Sequence: Synthetic coding sequence
atggtgggcggcgaggccgccgccgccgtggaggagctggtgagcggcgtgaggcaggccgctgattttgcggagcagtttcggtcctatagcgagtcagagaaacagtggaaagcccgcatggagttcatcctgaggcacctccccgattatagggatccacctgacggcagcggtagactggatcaactactgtctctgtctatggtgtgggctaatcatctctttctgggctgcagctacaacaaggatctgttggataaggtgatggagatggctgacggaatcgaggtcgaggacctgcctcagtttaccaccagatcagagctaatgaaaaaacatcagagctag

SEQ ID NO: 44691 - DNA, 372 bp, Artificial Sequence
  Description of Artificial Sequence: Synthetic coding sequence
atgagcagcggcggcagccccggctgcctgcggctggccgagggctgccccaatcaccgggcctgggtgaggtggaaccggaggcaaccccactcggcattcctaatcgcctcacatttgtttttaagcgtgttagtgtggtttaactcgtttcaaggattagagttggaaagcgaaaatccgaggcatctgctgtggaacgtgtgccttgtcgttctcgtttgccccagcagttctctggcctgtcgctttcaggtctatcagcgcactttctgctcggtggagtctcatcggactaaacgtaagattcttcaactgtttgccaatattctgccttacctgtataaacagccatatacaaaaaagcactag

SEQ ID NO: 44692 - DNA, 396 bp, Artificial Sequence
  Description of Artificial Sequence: Synthetic coding sequence
atgggccccgccgcccggccccggcggttcgtgcccggcccccccggggatgccaccaccttggagctttatactaaagtctgcttgccacggaagagatggcggctgccactcgggcgtctggcgaggagccccaggcttcaagcccctagagtgagagccggtagctcccactcgtgcaaggaagccgccaagtatgtgtttcagacattccatggcagtaagttgtcagcttccataaaacgttccggggtcagaggtaaatctatccttgggataagtatgcagatgaatggccctgggtttcagttgcgtagcggctttccacccctgagggctgagttggcaccaagccacgccagacccgaggcctccgggcggtgtccaggcggctag

SEQ ID NO: 44693 - DNA, 438 bp, Artificial Sequence
  Description of Artificial Sequence: Synthetic coding sequence
atgggcctgaagagccacgtgctgcccgcccccaacagccagggccaaggcagcctttgcattttcgtgtacgtgaccagttatatggactacatccagctgcagggtaaggaaaacttggattgctcaggacttaataagcagaagatagtgtttcctcattctatggattccggagacgggtggctcatggtgttggttcagcagctacatgagggacgcggacacgtcctggacccattcgctctaatttctgtgctggtgacttcttggtctcaggacggttgttgtatccccaaaaaccacgtttgcgtgcagggccgaagaggcggtggcaggggtagggctaaactggccggccctgtaactttttaccaaaaagttaagcctaggcaaaagtccgtgtcttgtagtcttcccctccatattttcacctag

SEQ ID NO: 44694 - DNA, 387 bp, Artificial Sequence
  Description of Artificial Sequence: Synthetic coding sequence
atgctgcaggaggccctgaccgaggccagcttcctgaagctggtgatttttttcttttttttttcatttctgagaaggtctttagccctctccccccgtctggagtgtagtggggcaatatctgcccactgtaatctgaggcttctgggctccagctatagtcttgccagcgcctcaagagtaagcggtattacaggtagcagacatcatgcgcagttgtttttcgtttttctggtcgagactggtttccaccatatcggtcaagctggcttggagctcctgacctctggagatcccccaacctctgcctcacagagcgtgggcatcaccggggtgagtcatagagcccagcagatgcgcataatcttcatctttattaagctgtag

SEQ ID NO: 44695 - DNA, 597 bp, Artificial Sequence
  Description of Artificial Sequence: Synthetic coding sequence
atgaccctgaaggagcacgccgccttcaagcacctgttcaacaaggcccaccttgccccgcccctaatccacctgaccctgtctggtcactccacatgcttccgcgaacaccgggtaggggggaaagtgatcgatcagcaacatcctaaagcagaggagagttttctggtgcagaataaaatggagtctccaatgtcaacgttcttctattcacggcacggtaataacctcatctccctgtccttcccacatatctctccatttagcatcccacagaatcgccactgccaccatgggttgttttctatgtcgtgctgggtgaggctccctgatggagtggccgcagggcagagggggagctctctgcctaggcgcgggggaagagccgaggcccccccgacgagccggaccggtagacgcccaggaggaggtgccccacactttcccgacagggtggctgcaggacggagagggtcaagtttacttaggaggggggggtgttgggctgagggccttttgacctctcaaacaggcagaccggggagagatgccccacacctgccggacggcgtggctgctggccaaaggtgtagttag

SEQ ID NO: 44696 - DNA, 450 bp, Artificial Sequence
  Description of Artificial Sequence: Synthetic coding sequence
atgcaggagatccacgagaaggtgctgaacgaggtggtgggcgccatgatgtaccacaccttctccctgacaagagaggatctggagaacttcaaagcacttcgggtgattgtccaggtcgggagtgggtacgacaacgtcgctattaaagcagccggggagctggagattgccgtgtgttctatcccttctgcagccgttgaagagaccgcagacagtaccactggacacattttgaatttgtattggggcaaccgctccctgtatcaggctcttcgggaaggaactagggtgcagtcggtcgagcagattggagaggtggcctcagttaaggcaaggattcgcggggaaatcttgggactgatcggatttggacgtacccagcaggaggtggctgtcagggctaaagccttcgccggttgggatagagccgtacccggctgtgcttag

SEQ ID NO: 44697 - DNA, 381 bp, Artificial Sequence
  Description of Artificial Sequence: Synthetic coding sequence
atgggcctgcccgcccccagcctgcacgccaccagcaccctgcggcccgatcagttctctccccatacaaatcctagtctcagtttaccttgcctcaaatcttttcctgtatcactgtggccctggggaagggcttctctgctgtgccatctctcacggttgtttgtctgtcaccgtcctctgacaccaacgtcacaggcaccaaatatgttcagctgcgtgtcctcttctctgactctcgccgcttccagcgcctggcccgcctcacatcttccaatttctcactcgcctttcctcccgccgcacctgctcaggagccagctgagcgtgacatcatcacgtgaacccaggctgagcttacctcttcaactaggacaatag

SEQ ID NO: 44698 - DNA, 1548 bp, Artificial Sequence
  Description of Artificial Sequence: Synthetic coding sequence
atggagtggaagctggagcggaccgccccccggcgggtgcggaccgaagaggagatgctgtgggaatctatcatgagagttctaagcaaagatctgaaacagaagaggtcacaggattcagctaatgtactggattctgtgaacgctacttacagtgatttcaaatcaaactttgccaagagactgtcggccgaggtaccagtggctagctctcctattactaccaggtggcaacaatctcagacacgcgctctgtcttccgactccttcggagaggaacagtcaaccacatatctgcctgaggccagcggctctgtgctgaagactccaccagaaaaggagacattgactctgggaagcagaaaggagcaactcaaaacccccagcaaaggaatctctgaaacatccaacagcgccttgcatttctgtaaagccccccatgccatggatcgcgactggaaagaatcagtggcctccaaagggcagaaatgcctgaaacaattgtttgttactcagaatgtggtacagcaggcaaacggaaagatgcagctatgcgaacagagcgagtgtgtctggaaggggtgtaaagatggcgttcgcgatgaatcatttcacctgaagtcatccggtgatatcaatgattctatcttacagccagaggtgaaaatccatataactggcttacgcaatgattactatctcaacatcttagactggagtttccagaaccttgtggctattgcgctaggttcagcagtgtatatctggaatggggagaaccataatggtattgagaatattgatttgtccctcacgtgtaactacatatcttcggtatcctggattaaagagggtacctgcctggctgtagggacctctgaaggtgaggtgcaactatgggacgtcgtgacaaagaagagacttcgtaacatgctcggtcatctctccgttgtgggcgctttgtcttggaatcactttattctgtcttctggatcgaggctcggtcgtgtctatcaccacgacgtgcgagttgcccagcatcacgttggcacacttcgtcataaacaggccgtttgcgcccttaagtggtcccccgacggcaggctcctctcttccgggtgtagtgatggcctgttaacaatctggcctcacgatcctggagctagcgcccaggggcagccattgaaggtgattacccagagcacagccgtcaaggcaatggactggtgcccctggcagtcaggtgtcttggccatcgggggcggcatgaaggacggccgtctgcacatcctcgacattaacgccgggaagtccattcagaccccctcaacaaattcccagatatgctcgctgatatggctcccaaaaactaaggagattgcaaccggccagggaaccccaaagaacgacgtgacggtctggacatgccccactgtctcgcggagtgggcaccgggggagagttctccacctgtccttgtcaccggaccagactcgggtgttctcagccgccgctgatggcacagcatccgtttggaactgttattag

SEQ ID NO: 44699 - DNA, 1434 bp, Artificial Sequence
  Description of Artificial Sequence: Synthetic coding sequence
atggagtggaagctggagcggaccgccccccggcgggtgcggaccgaggaggaaatgctttgggagtccattatgagggtgttgtccaaagaccttaagcagaagcgatcacaagactcggctaacgtactggactccgtcaacgcaacctactcagacttcaaatcaaacttcgccaagaggctctccgcagaagtgccagtcgcaagcagtccaatcactacacggtggcagcagtcacagaccagggccctttctagcgactcctttggggaggaacagtccaccacctacctgccagaggcctctggctccgtcctcaagacacctccggaaaaggaaaccctgactctgggctctcgcaaggagcagctcaaaacaccctctaagggtattagtgagaccagtaatagtgcactgcatttttgtaaagcacctcatgcgatggatcgcgattggaaggagagtgtcgcctcgaaaggccagaagtgcttgaagcaattgttcgttacacaaaatgtagtgcagcaggctaatggcaaaatgcagctctgcgaacaaagtgaatgtgtgtggaagggatgtaaggacggagtacgcgatgaatccttccatctcaagagctccggggacataaatgactcgatattacagccagaggttaaaattcacatcacgggtctccgaaacgattactatcttaatattctcgattggagttttcagaatcttgtagccatcgcgctgggctccgccgtctacatctggaatggagagaaccataacggtatcgaaaatattgatctcagcttgacttgcaattatatctcatccgtgtcatggattaaagagggaacctgccttgctgtggggacatctgagggcgaagtgcagttgtgggacgtcgttaccaagaaacgcctgcggaacatgctgggccatctgtccgttgttggcgcccttagctggaaccactttatactgagcagtggatcaagactaggcagggtctaccatcacgatgtcagggttgcccagcatcacgttgggaccttacggcataagcaggcggtgtgcgccctgaagtggagccccgatgggcgtctgttatcttccgggtgttcggatggcctgttgacgatttggcctcatgacccaggggcgagtgctcaaggccaacccctaaaagttatcacgcagtcaacagccgtcaagatttgttctttgatctggctgccaaagaccaaggagattgctaccgggcagggtacacccaaaaacgacgttactgtatggacctgtccaaccgtgagccgctccggagggttctttggccaccggggacgtgtacttcatctttcgctgtctccggaccagacaagagttttctcggccgccgccgatgggactgcctcagtttggaattgctactag

SEQ ID NO: 44700 - DNA, 579 bp, Artificial Sequence
  Description of Artificial Sequence: Synthetic coding sequence
atggagtggaagctggagcggaccgccccccggcgggtgcggaccgaggaagaaatgttatgggtacttgattctgtcaatgcgacttacagcgacttcaagagcaattttgcaaagcggctgtccgcagaggtcccagtcgcctcctcccccatcacaactcgctggcagcagtctcagaccagggcgctgagtagcgactcttttggggaagagcagtcaacaacttatctgcccgaagcatctggttctgtgctcaaaacgcccccagagaaggaaacattgacccttggaagtcggaaggagcagttgaaaactccatccaaagggatctctgaaacctctaattccgcactgcatttctgtaaggccccccatgccatggatagagactggaaggagtctgtcgcatccaaaggccagaagtgtctaaagcaactctttgtcacacagaacgtcgtacagcaggccaatggtaaaatgcagttgtgcgaacagtctgagtgtgtctggaaggaccattttagcggttctatgaagaagcgatttgaacaggaagacgtgggcggaaaagactag

SEQ ID NO: 44701 - DNA, 1119 bp, Artificial Sequence
  Description of Artificial Sequence: Synthetic coding sequence
atggagtggaagctggagcggaccgccccccggcgggtgcggaccgaagaagaaatgctgtgggaaagcattatgcgcgttctgtccaaggacctaaagcagaagaggagccaagattcagctaatgtgctcgatagcgtcaatgccacgtattccgattttaaatcaaatttcgctaagcgactgtcagccgaggttcccgtggcctccagcccaattacaaccagatggcagcagagccagacccgcgcattgtctagcgactcctttggagaggagcaaagcactacatatctccccgaagcttcgggctccgttctcaagactccaccagagaaggagacgctcacgttgggtagcaggaaggagcagctgaagactcctagcaaaggcattagcgaaacatccaattctgcccttcacttctgtaaagctccacacgccatggatcgagactggaaggaaagtgtcgcaagtaagggccagaaatgtctgaagcagctgtttgtgacccagaacgtcgtgcaacaggccaacgggaagatgcagctgtgtgagcagtcagaatgtgtatggaaaggttgcaaggatggagtccgggacgagagcttccatctgaagtcatctggagacataaatgatagcattctgcaaccagaggtgaagattcatattactggcctgcgtaatgactactaccttaatattcttgattggtcctttcagaaccttgtcgctatcgcactagggtccgcagtatatatttggaacggggagaatcataacggaatcgagaatatagacctaagcctaacctgcaactacatttcctccgtgagctggataaaagaaggaacttgccttgctgtgggcaccagtgagggggaagttcagctatgggatgtggtaactaaaaaacgtcttcgtaacatgctgggccatctcagtgtcgtgggagctctttcttggaatcacttcatcttgagccggctcgaattttcgggggtaataagtgcccattgcaacctgcacctgccatcctcctgggactataggcgtcccccaccctgcctggtgggccaggactggggggttttcataatcaccatgttcggctag

SEQ ID NO: 44702 - DNA, 1560 bp, Artificial Sequence
  Description of Artificial Sequence: Synthetic coding sequence
atggagtggaagctggagcggaccgccccccggcgggtgcggaccgaggaagaaatgctctgggaatccataatgcgagtgctgtcgaaggatttgaagcagaagagaagccaggactctgcaaatgtgctcgatagcgtcaatgctacttattcagacttcaagagtaactttgcaaaacgactgagcgctgaagtgcccgtagcaagcagtccaattaccactaggtggcagcagagccagactagggctctgtcctcggatagcttcggcgaggaacagagcacgacttacctgccagaggccagcggatcagtgctcaagactccaccagaaaaagagacactgacactcgggtccaggaaagaacagctgaaaacccccagcaaagggattagcgagaccagcaactccgcactgcacttttgtaaagctccacacgctatggacagagattggaaagagtctgtggcctcaaagggccaaaaatgcttgaagcagcttttcgtgacgcagaatgttgtgcagcaggcaaatgggaaaatgcagctctgcgaacagagcgaatgcgtttggaagggttgcaaagatggtgtgcgtgacgagtcattccatcttaagagcagcggggatattaacgatagtattttgcaacctgaggtgaagatccatatcactggactgaggaatgattattacctgaacattctcgattggagttttcaaaaccttgtagcaatcgcacttggatccgccgtttatatctggaacggcgaaaatcataatggaatcgagaatattgacctctcgctgacttgcaattacatctcatccgtgagctggataaaggagggaacctgtcttgcagtcggaacctctgagggagaggtgcagctttgggatgtcgtgacgaagaagaggctacgcaatatgctgggtcacctgtcagtggtcggcgccctgagttggaaccatttcatcctaagttccggtagccgcctcggacgggtgtaccaccatgatgttagggtcgcacagcatcacgttggcactctgagacacaagcaggcagtgtgtgcattaaagtggagtcccgatggtaggctgttaagcagtggctgtagcgacggcctcctgaccatttggccccatgacccaggcgctagcgcacagggccagcccctaaaagtcatcacacagtccaccgcggtcaaagctatggactggtgcccttggcagagcggtgtcctggcaatcggcggtggtatgaaagacggtcggctgcacatcttggacattaatgccggcaagtccatccagacacccagcacaaatagtcagatatgcagcttgatatggttacctaagaccaaggagatagctaccggccaagggaccccaaagaacgacgtgactgtgtggacctgtcccacagtcagcaggagtggggggttctttggacatagggggagagttctgcatctgagcttgtctcccgaccagacacgagtcttttccgctgccgccgatgggaccgcatctgtttggaattgttactag

SEQ ID NO: 44703 - DNA, 807 bp, Artificial Sequence
  Description of Artificial Sequence: Synthetic coding sequence
atgggcagcgccaagagcgtgcccgtgacccccgcccggcccccccctcataacaagcacctggcacgtgttgccgacccacgatccccgtctgccggcattctaagaacccctattcaggtggagtccagccctcagccaggcctgccggccggcgagcaacttgagggtctgaaacacgcacaggacagcgatccgaggagtcctacgctgggcattgcacggacacctatgaaaacttcttccggtgatcctccttcaccactcgtgaagcagctatcagaggtgtttgaaacggaggacagcaaaagcaacctgcccccagaacccgtgctcccacctgaggccccactttcttctgagctcgacctccccttggggacccagctgtccgtcgaagagcaaatgccaccctggaaccaaaccgagttccccagcaaacaggtcttttcaaaggaagaagcacggcagcccactgagacacccgttgctagtcaatcctcggataaaccgagtcgagacccggagacaccccggtccagcggatcaatgcgaaatcggtggaaacctaacagttccaaggttttaggccgttcccccttgacaattcttcaggacgataatagccctgggaccctgacactgcggcaggggaagaggcccagcccgctatctgagaatgtttccgaattgaaagagggagccatcttgggcaccggccgtctgcttaagacaggtggacgagcctgggagcagggacaagaccatgacaaagagaaccagcattttcccctagtggaaagttag

SEQ ID NO: 44704 - DNA, 435 bp, Artificial Sequence
  Description of Artificial Sequence: Synthetic coding sequence
atggccttcaccttcgccgccttctgctacatgctggccctgctgttgacagccgccctgatattctttgcaatctggcacatcatcgccttcgatgagctgaagacagactacaagaatccaatcgatcagtgtaataccctaaatccccttgtcttgcccgaatatcttatccacgcattcttctgtgtcatgttcctgtgcgccgcggaatggctgaccctcggactgaacatgccgctcctcgcctatcatatttggaggtacatgagtcggcctgtcatgagcggccctggcctttacgacccaaccactattatgaacgcagacatcctggcttattgtcagaaggagggctggtgtaagctggcattctacctgctggcttttttttattatttgtacggcatgatttatgtactggtttccagttag

SEQ ID NO: 44705 - DNA, 225 bp, Artificial Sequence
  Description of Artificial Sequence: Synthetic coding sequence
atgaagttccaggagtgccacagcgaggtgatgcggcacggccagaagatctacccatctcatcatcgcatcgagatggcggtcgaaatcgctagcctgaagtgccaacactcttccattaatcagagtcccacacggaagaattcaaactccacaaccggctggttgctgtgggatctgctcatgggaataggtaattccggatctaacgttgtgttgacttag

SEQ ID NO: 44706 - DNA, 750 bp, Artificial Sequence
  Description of Artificial Sequence: Synthetic coding sequence
atgaccaccgccgtggagcggaagtacatcaacatccggaagcggttagaccagctgggctacaggcagaccctgactgtggagtgcctacccctggtcgaaaagcttttctcggatttggtccacacaacagagtctctgaggcagtctaagctctcagctgtgaaagccgagaaggagagtgcgaacttcgactttgtcctcgagccttacaagctggaaaacgcacggctttctagagagaacaatgagctttacctcgaactgatgaagctgagagaacactctgaccagcatgtgaaagagctgaaaacgtccctgaagaagtgtgcacgcgaaacggctgaccttaaatttctgaacaatcagtatgcgcacaagcttaagttattggagaaagagagcaaggcaaaaaacgaaagaattcaacaactccaggaaaagaacctgcacgcagtggtgcagaccccaggagggaagaagcgctctattgcattcagacgtcagagaatgcagatcgatgagccagtgcccccttctgaggtgtcctcctaccccgttcctcagcccgacgacccttatatcgcggaccttctgcaggtggcagataacagaattcaggaactccagcaagaggtgcaccaacttcaggagaaacttgccatgatggagtcgggagtgagggactactctaagcaggttgggtttctgtttacttgtatagtgggtatcgagattgggatgttgtag

SEQ ID NO: 44707 - DNA, 165 bp, Artificial Sequence
  Description of Artificial Sequence: Synthetic coding sequence
atgagcctgcggcggcacatcggcaaccccgagtacctgatgaagcgaatcccccaaaatccccgctaccagcacatcaaatccagactcgacacaggcgcttgtgtttacctgacttctagtccagctttacctgactgtgcaatgaatggactctgtttctag

SEQ ID NO: 44708 - DNA, 411 bp, Artificial Sequence
  Description of Artificial Sequence: Synthetic coding sequence
atgctgagcagcttcaacgagtggttctggcaggaccggttctggttgcctcccaatgtcacctggaccgaacttgaggaccgagacggcagagtatacccacatccacaggacctcttggccgccctgcccctcgccctggtgttactcgctatgagattggcgtttgagcgcttcattggcctccctctgtctcggtggctgggggttcgcgatcagacccggcgccaggttaagcccaatgccactctcgaaaaacacttcctgaccgagggacaccggcccaaagagccccagctctctcttctggcagctcagtgtgggctcacactgcagcagacccaaagatggttccgacggcgccgaaaccaggaccgcccacagctcacaaaaaagttctgtgaggcttag

SEQ ID NO: 44709 - DNA, 1398 bp, Artificial Sequence
  Description of Artificial Sequence: Synthetic coding sequence
atgcggcgggccgccggcatggaggacttcagcgccgaggaggaggagtcatggtatgatcagcaggaccttgaacaggaccttcacctggcagccgaactcggcaagacccttctggagagaaataaggagctggaagggtcactccaacagatgtactcaaccaacgaggaacaagtgcaggaaatagaatacttaacaaaacaactggacacacttaggcacgtgaatgaacaacatgctaaggtgtacgaacagttggacctgacagctcgcgacctcgagctcacgaaccatcggctcgttcttgaatctaaggctgctcagcaaaaaatacacggccttactgagacaatcgaacggctgcaggctcaggtggaggagctgcaggcgcaggttgagcaacttaggggtctagagcagcttagagtgctgagagaaaaacgtgagcgacgcagaacgattcatacctttccatgcctgaaggaactgtgtaccagccctcgctgcaaagacgccttccgtttgcactctagtagcctggagctggggcctcgaccccttgaacaggaaaatgagaggctgcagaccttagtcggtgctctaagatctcaggtgtcacaggagaggcaacgcaaagagagggctgagcgcgaatacactgccgtgcttcaggaatatagtgagctagagaggcagctctgtgagatggaggcatgccgtctcagagtgcaagagctcgaggccgaactcctggaactccagcagatgaaacaagcgaaaacctatctgttgggccctgacgatcatctcgctgaggccttgctagctcccctgacccaggccccagaagctgacgatcctcaacctgggagaggggatgatctaggcgcacaggatggagtgtcaagtcctgcggcaagccctgggcacgtcgtgaggaaatcttgttcagacacagccctgaacgccatcgtggccaaggaccccgctagcaggcatgcaggaaatcttacactgcacgcaaactccgttaggaagaggggcatgagcatccttagagaggtggacgaacagtaccatgcattactggagaaatatgaagagctgctctctaagtgccggcaacatggggctggggtaagacacgccggagtacaaaccagtcgcccaatttcccgcgacagcagctggcgggacctccgcggcggcgaggaaggacaaggtgaggtgaaggccggagagaagtctctgtcgcagcatgtggaggccgtcgataaaagactggagcagtctcagcccgagtacaaggccctattcaaggagattttctcgcgtatacagaagactaaggctgatatcaatgccacgaaagtgaagacccactcttcaaaatag

SEQ ID NO: 44710 - DNA, 555 bp, Artificial Sequence
  Description of Artificial Sequence: Synthetic coding sequence
atgtgggtgttcggctacggcagcctgatctggaaggtggacttcccctatcaagataagcttgtgggctacattacgaactatagtagacggttttggcaggggtcaactgatcatcgaggagttccggggaagccaggcagggtggtgaccctggtcgaagatcctgccggttgcgtgtggggcgttgcatataggctgccagtcggaaaggaggaggaagttaaggcctacctggatttccgtgaaaaggggggttatagaacgaccacggtgatcttctaccccaaagatccgaccaccaagcctttttcagtgctgctttatattggcacttgtgataacccagactacctgggtcccgcacccctggaggacatcgcagaacagattttcaatgccgcagggccatctggacggaacaccgaatacctgtttgaactcgccaactcgatccggaacttagttcccgaagaagcggacgagcatctctttgccctcgaaaagttggtgaaggagcgcctcgagggtaaacagaacctgaattgcatatag

SEQ ID NO: 44711 - DNA, 285 bp, Artificial Sequence
  Description of Artificial Sequence: Synthetic coding sequence
atgatgggcctgagcctggccagcgccgtgctgctggccagcctgctctcactacatctggggaccgccactaggggttctgatattagcaagacctgctgctttcaatatagccacaaacccctaccctggacttgggttcgtagctatgaatttacaagtaattcctgtagccagagagccgtcatcttcacgactaaaagaggcaagaaggtgtgcacccatcccagaaagaaatgggtccagaaatacatcagtctgttgaaaacaccgaagcagctctag

SEQ ID NO: 44712 - DNA, 729 bp, Artificial Sequence
  Description of Artificial Sequence: Synthetic coding sequence
atgtgggccagccgggaccacctgcccgagcccgacctgggcgacgcagcccctcctgggagcccctcctcgttctggacttcaggtttgccgaggcaggagcgttccaccagccgacagcgctcaagggggagcccaagctcaacatgtgtcccttacaaggttcatgctcttgcgacattcgaatgcagcgcaacatcccacgcttctaggctgtggcaaactctccagcaattctgggcggaccacattagtcgaccgttttccccccggcggcccccgcttaggcgcatgccatccctgtctaccttttacctgttagatcacaacacaagacaggccgagctaggactcgcctatggcgcaccttgtatgcggttgagcaatcaggccttcgtcttcaggggagggcggtggaccacggagagccagctcgccaggactcgctcgccgttactttcccggacagcctgggggtggaaggcccaagtgcagagatcaaaatcccaagttcttctggaagagaataactatctgaagctacaacaggaactgcttatcgacatgcttacagagactatggcgagaatgcatctgctggagaagcagcggaatcccgaggttatccccactgcggccgctcgtgccggacaacgtaaaatgcggaagcgtgccggcgcaagtgcaggtgttttaatgatacagccatgtgcccttgactcacagtag

SEQ ID NO: 44713 - DNA, 237 bp, Artificial Sequence
  Description of Artificial Sequence: Synthetic coding sequence
atgagcgccaccaccgcctgctggcccgccttcaccgtgctgggcgaagccaggggggaccaggtggactggtccaggctgtaccgagataccggacttgtgaagatgagtagaaagccccgcgcttcaagcccattctcaaacaatcatccgtcaaccccaaagagatttccacgccaacctaagcgcgagaaaggcccagtcaaagaagttccgggaactaagggtagcccttag

SEQ ID NO: 44714 - DNA, 222 bp, Artificial Sequence
  Description of Artificial Sequence: Synthetic coding sequence
atgagcgccaccaccgcctgctggcccgccttcaccgtgctgggcgaagctaggggcgatcaggtcgattggagccgcttataccgtgatacggggttggtgaagatgagcagaaagcccagagcctcttctccatttagtaataatcatcctagcacaccaaaacgtcgggggagggggaaacaccctttgataccagggccagaagccctgtctaagtag

SEQ ID NO: 44715 - DNA, 237 bp, Artificial Sequence
  Description of Artificial Sequence: Synthetic coding sequence
atgagcgccaccaccgcctgctggcccgccttcaccgtgctgggcgaagccagaggggatcaagtggactggtcccggctgtaccgagataccgggctggtgaagatgtccaggaaaccccgcgcctcctctcctttcagcaacaaccacccctctacacccaagaggttcccccggcagccaaagcgagagaaaggtccagtaaaggaagtacccggcactaagggctccccctag

SEQ ID NO: 44716 - DNA, 333 bp, Artificial Sequence
  Description of Artificial Sequence: Synthetic coding sequence
atgtggatgggcctgatccagctggtggagggcgtgaagcggaaggatcagggttttctggagaaagagttctatcataaaactaatatcaaaatgcggtgtgagttcctggcatgctggcccgctttcaccgttctcggcgaggcatggcgagaccaagtggactggtctcgactgctccgcgatgccgggttagtcaaaatgtcaaggaagccccgggcatcgtcccccttgagtaataatcatccccctacaccaaaacgctttccccggcaacccggcagggaaaaaggcccgattaaggaggttcctggtaccaaagggagcccttag

SEQ ID NO: 44717 - DNA, 492 bp, Artificial Sequence
  Description of Artificial Sequence: Synthetic coding sequence
atgagcaagggcctgctgctgctgctgctgctgagcatgggcggcacatgggcaagcaaagagcctttaaggcccaggtgcagaccaattaacgcaacactcgccgttgaaaaggaaggctgccctgtgtgcattacagtcaacacaacaatttgcgcgggatactgccctactatgactcgcgtgttgcaaggcgtcctgccagcactgccacaggtggtttgtaactatagagacgtccgctttgagagcatccggctgcctgggtgtccgcggggagtgaaccccgtcgtcagttatgcagtcgccctgtcctgtcaatgcgcactgtgcagacggtcaacaactgactgtgggggcccaaaggaccacccactcacatgtgatgatccacgttttcaggcttcatcttcttctaaggcaccccctccctctctcccttccccctctcgactgcctggcccaagcgatacaccgattttaccgcagtag

SEQ ID NO: 44718 - DNA, 417 bp, Artificial Sequence
  Description of Artificial Sequence: Synthetic coding sequence
atgagcaagggcctgctgctgctgctgctgctgagcatgggcggcacctgggctagtaaagagcctctcaggccacgatgcaggcctatcaacgcaaccctggcagtggaaaaagaggggtgtcctgtttgcataaccgtgaatacaactatttgcgcaggatattgtccaacaatgactagagtacttcaaggggtgctgcctgccctccctcaggttgtgtgcaactacagggacgtgagatttgagtcaatccgattgcccgggtgtcctcgcggtgtgaatcctgtcgtcagctacgccgtggccctgagctgtcagtgtgctctgtgccggaggagtaccacagactgtggtgggcccaaggaccacccactaacatgcgaccctcctctgccaggccttctatttttgtag

SEQ ID NO: 44719 - DNA, 492 bp, Artificial Sequence
  Description of Artificial Sequence: Synthetic coding sequence
atgttccagggcctgctgctgctgctgctgctgagcatgggcggcacttgggctagtcgagagatgctccgcccccgctgccggcccattaacgcaactttggcggtagagaaagagggatgccccgtgtgcattaccgtgaacactactatctgcgctgggtactgccccactatgactcgcgtgctccagggagtgctgcccgccctgccacaagtcgtgtgcaattaccgtgacgttcggtttgagagtataaggctgcccggatgtccccggggcgttaacccggttgtgtcctacgccgtagcattgtcttgccaatgcgccttatgccggcgctccaccacagattgtggaggaccgaaagaccatcctcttacgtgcgacgacccacggttccaggcgagcagcagcagcaaggcgccccctccgtccctcccatctccctccaggctgccgggcccatctgatacaccaattctgccgcagtag

SEQ ID NO: 44720 - DNA, 498 bp, Artificial Sequence
  Description of Artificial Sequence: Synthetic coding sequence
atggagatgttccagggcctgctgctgctgctgctgctgagcatgggagggacttgggcctcaagggaaatgcttaggccacgttgtcgcccaattaacgccaccctggctgtggaaaaggaagggtgtccagtgtgtataacagtcaacaccaccatatgcgcaggttactgcccaactatgacccgcgtgcttcagggtgttctgcccgccttgccccaggtagtgtgcaattatcgggatgtccgattcgaatccatccggctgcccggctgtcccaggggggtgaatccggtggtgtcctatgcagtcgccctaagttgccagtgcgccctttgcaggagaagtactacagactgcggtggacctaaggatcacccgctgacatgcgacgacccgagatttcaggcaagttcttccagcaaggctcccccccctagcctgccctcccccagtcgtctccctggcccatccgatactccaatactgccacagtag

SEQ ID NO: 44721 - DNA, 189 bp, Artificial Sequence
  Description of Artificial Sequence: Synthetic coding sequence
atggccagcaacaagaccaccctgcagaagatgggcaagaagcagaatggcaagtctaaaaaagtggaggaggccgaaccagaagaatttgtagtggaaaaagtgctggaccggcgggtcgtcaacggcaaggtcgagtactttcttaagtggaaaggatttactgacgccgataatacatgggaatag

SEQ ID NO: 44722 - DNA, 2082 bp, Artificial Sequence
  Description of Artificial Sequence: Synthetic coding sequence
atggagcgggccggcgccaccagccggggcggccaggcccccggctttttgttgagactccatactgagggtcgggccgaggctgcccgagtgcaggagcaggatctgaggcaatggggactgactgcttctgagctccataagctgttacagccctttctcttacggagggttaaagctgaagtggcaaccgaactgccaaagaagaccgaagtcgtgatttaccacggcatgtcagccctgcagaagaaatactataaggcgatcctgatgaaggacctggacgccttcgaaaatgagactgcaaaaaaggtcaaactgcagaatatcctgtcccagttacgcaagtgcgtagaccatccgtacttgttcgatggggtggagcctgaaccctttgaggtgggagaccaccttacggaagcatcaggcaaactacatctcctggacaagttgctggcatttctgtacagtggggggcatagagtgttgttattttcacagatgacgcagatgctggatatcctacaggactacatggactatagaggatattcttacgaaagggtggacggttccgtccggggcgaggaaagacatttggccatcaagaactttggccagcagccaatcttcgtgtttctcctaagtacaagggccggaggtgtcggaatgaacctgaccgcagctgacacggtgattttcgtcgacagcgattttaacccgcaaaacgacttacaggccgccgctcgtgctcaccgcataggccaaaataagtctgtaaaagtgattaggctcataggtcgcgacaccgtggaagaaattgtttaccggaaagcagccagcaagctacagctgaccaacatgattatcgaaggcgggcacttcacccttggcgcccagaaacctgctgccgacgccgacctgcagttatcggagattcttaagtttggcctggacaagttgctcgccagcgaggggtcaactatggacgagatcgacctcgagtcaattctgggtgaaaccaaggacgggcagtgggtgtctgatgcactccccgcggccgaaggaggatctcgagaccaggaagaaggtaaaaaccacatgtaccttttcgagggcaaggattactcaaaagaaccctctaaggaagatcgcaagagtttcgaacagctcgtaaatctgcaaaaaacccttctggaaaaagctagtcaggagggacggagcctgaggaataagggttccgtcctgatccctggcctagtagagggttctacaaaaaggaagcgcgtactctcccccgaagagctggaggatcgccagaagaagcgtcaagaggccgccgcgaagaggagacgcctcatagaggagaagaagcggcagaaagaagaagccgaacacaagaaaaaaatggcatggtgggaatcaaacaactaccaatctttttgcctcccatctgaggagagtgagcctgaagacctggagaatggcgaggagtccagtgctgagttggactatcaggacccggacgcaactagcctgaaatacgtctcgggggatgtaactcaccctcaggcaggagcagaagatgccctaatcgtacactgtgtagacgacagtggacattggggccgtggaggactgtttacagccttggagaagaggtcggccgagcccaggaagatctacgagcttgctgggaaaatgaaggacttgagcctggggggagtactcctgtttccagtcgacgataaagagagtcgaaataaaggacaagacttgttggcgctgatcgtggcacaacacagggatcgttcgaatgtgctgtctggaataaagatggccgccctggaggaaggactcaagaaaatctttctcgccgctaagaagaaaaaagccagcgtgcacctccctaggatcggacacgcaactaagggctttaactggtacgggaccgaaaggctgattcggaaacacctggcagctcgcgggatccctacttatatttattactttcctcgcagtaaatcagctgtgcttcactcacaatcatcgagtagctcttcaagacaattagtgccatag

SEQ ID NO: 44723 - DNA, 1851 bp, Artificial Sequence
  Description of Artificial Sequence: Synthetic coding sequence
atgagcgccctgcagaagaagtactacaaggccatcctgatgaaggacttagacgcctttgagaacgagaccgctaaaaaggtgaagctccaaaacatactgagccagttacggaaatgcgtggaccacccctatctcttcgatggcgtcgagccagagccattcgaggttggcgatcatctgacagaagcaagcgggaagttgcatctgctggacaaactgctggccttcctgtattccgggggccatcgcgtgctgttgttctctcaaatgacgcagatgctcgatatactgcaagactatatggattacagaggatatagctatgagcgcgtggacgggtcagtcaggggagaggagaggcatttggccattaaaaactttggacaacaacccatcttcgtgttcttgctgtctaccagggccggtggagtcgggatgaacttgactgcggccgacaccgtgatcttcgtcgacagtgacttcaacccccaaaatgatctgcaggcagcagcccgggcacacaggattgggcagaacaagtctgtgaaagtgattagactgatcggtcgggacacagtcgaagagattgtgtatagaaaggccgcctcgaaactgcaattgaccaatatgataatcgagggaggtcatttcaccctgggggcccagaagcctgcagctgacgccgacctccagctctctgaaatccttaagtttggtctggacaagttactggcttctgaagggtcaactatggatgagattgaccttgagtccattctgggagaaacaaaggacggccagtgggtctccgatgctcttccagccgccgaggggggctcccgcgaccaggaggagggaaagaatcatatgtacctctttgaaggcaaggattatagcaaagaacctagtaaggaagaccgcaagtccttcgagcagctcgtgaacttgcagaagactcttttggagaaggctagccaggaaggacgatccctgagaaataagggaagcgtgctgatccccgggcttgtcgagggctctacgaagcgcaaacgggtacttagccctgaagaacttgaggacagacagaaaaaacgacaggaggccgcggccaaaaggaggcgacttatcgaagagaagaagaggcagaaggaagaagcagaacacaaaaagaagatggcatggtgggagagcaacaattaccagagcttttgtcttccatccgaggagtccgaacctgaagatctagagaacggagaagaaagcagtgcagagctggattaccaagaccccgacgccactagcctaaaatacgtttccggggacgttacgcatccccaagcaggggcagaagatgctctgatagtgcactgcgtggacgatagcgggcattgggggcgtggcggacttttcacagcacttgagaaaaggagcgctgagcctcgcaaaatttacgagctcgccggaaaaatgaaagatcttagtcttggcggagtcttgctgtttcccgtggacgataaagagagccgcaataaaggacaggacctgctagcactcattgtggcgcagcatcgcgatagatctaatgtgcttagtggcatcaagatggccgccctcgaggaaggactaaagaagatttttcttgccgccaaaaaaaagaaagcatcggtccacctgccacgcattggtcacgccaccaaagggtttaactggtacgggacagaacgtctaattcgcaagcacctggcggctcgcgggatacccacctatatttattactttcctcgaagtaagtctgccgtcttgcatagtcagtcctcttcaagttcctcaaggcagctcgtcccgtag

SEQ ID NO: 44724 - DNA, 2694 bp, Artificial Sequence
  Description of Artificial Sequence: Synthetic coding sequence
atggagcgggccggcgccaccagccggggcggccaggcccccggcttcctcttacgcctgcatacggagggacgagcagaggccgcccgcgttcaagaacaggaccttcggcaatggggactgactgggatccatttgaggtcctatcagctggaaggcgtcaactggctggcccagcggttccactgccaaaatggttgtatcctgggcgacgagatggggttaggcaagacatgccagaccatcgctctgttcatttacctggctggtcgcctgaacgatgaaggcccatttctgatactgtgcccgttgtcggttttgtcgaactggaaggaggagatgcagagattcgcgcctggcctatcatgcgttacttatgcgggagataaagaagaacgcgcctgcctccagcaggatctgaagcaagagagccggttccacgtgctgctgaccacttatgaaatctgcttaaaagacgcatcattcctcaagagcttcccctggagcgtgctggttgtcgatgaagcccaccggctgaagaatcagtcctcactgctgcacaagacactgtccgagttttcggttgtgttctcattgctgcttactggcacccctatccagaatagccttcaggagctttacagtttgcttagcttcgtggagccagacttattttctaaagaagaggtcggtgatttcattcagagatatcaggacattgaaaaggagagtgagtctgccagtgagctccacaagctcttgcagccgtttttgttgaggcgcgtgaaggccgaggtggccacagagctgcccaaaaagactgaggtggtgatataccacgggatgtcagccttacaaaagaaatactataaagctatcctcatgaaagatttggacgcattcgagaacgaaactgccaaaaaagttaagcttcagaacattctctcacagttgaggaagtgcgtcgaccacccctacctgttcgacggcgtggagcctgagcctttcgaagtcggggatcacctgactgaggccagcggtaaacttcatctgctggataaactgctggcttttttatacagcggtggccaccgcgttttactcttctcccagatgacacagatgttggacattctgcaggattacatggactaccgaggttatagttacgagcgtgttgatggatccgtaagaggtgaggaacggcatctggcaataaagaacttcggacagcagcctatctttgtgttccttttatccactcgcgctgggggagtgggtatgaacttaacggctgctgacaccgtgatctttgtggacagtgacttcaaccctcagaacgatctgcaagcagctgctcgcgcccaccggatcggacagaataaatcagtcaaggtgatcagactgattgggagagataccgtagaggaaattgtataccgaaaagcagcatctaagttacagctgaccaacatgattatcgaaggcggacacttcactctgggcgctcaaaagccggccgccgatgcggacctacagctcagtgagattctgaaattcgggctggataagcttctggcctccgaggggtccactatggatgaaatcgatcttgagagcattctgggggaaactaaagatggccagtgggtgtcagacgctctgcccgctgccgaaggaggatctcgcgaccaagaggaaggtaaaaaccacatgtatttgtttgaaggcaaggattattcaaaagaacccagtaaagaggaccggaagtcgtttgaacagctggtgaacttgcagaaaaccctgctggagaaagcgtctcaggaaggtcggagcctgaggaataaaggcagcgttcttattcctgggttggtcgaaggctccaccaagcggaaacgcgtgttgagtcccgaggagctcgaagaccggcagaagaaaaggcaggaagccgctgccaaaaggcgcagactaattgaagagaagaagaggcagaaggaagaagccgagcataaaaagaaaatggcgtggtgggagagcaacaactaccagtccttctgtctgccttctgaggagtctgagccagaggacctggaaaacggagaagagagtagcgctgagttagactatcaagaccctgatgctacctcactgaagtacgtgagtggcgacgttactcatccgcaggcaggagcagaggatgcgctgattgttcactgcgtagacgacagtgggcattggggaaggggggggctttttacagctcttgagaagaggagtgccgaacctcggaaaatctatgaactggcgggtaaaatgaaagatctaagcctcggcggagttctgcttttccctgtggatgataaggagtctcgaaataagggacaggacctactcgcgcttattgtggcccagcatcgtgataggtccaatgtactcagcggcatcaagatggctgcacttgaggaggggctgaagaaaatttttctggctgccaagaaaaagaaagccagtgtccacctgcccaggatcggccacgccactaaagggttcaactggtatggaactgagcgcctgataaggaagcaccttgccgctcggggtattccaacgtacatttactattttccccgaagtaagtctgcagtcctgcactcccagagctcaagtagcagcagtcgacagctggttccatag

SEQ ID NO: 44725 - DNA, 1983 bp, Artificial Sequence
  Description of Artificial Sequence: Synthetic coding sequence
atggaggccctgatggcccggggcgccctgaccggccccctgcgggctctctgcctcctgggatgtctgctcagccacgccgccgctgccccaagccccattatcaagttccctggcgacgtggcgccaaaaaccgacaaggagttagccgttcagtatctcaatacattctatgggtgcccgaaagaatcctgcaaccttttcgtgttaaaggataccctgaagaagatgcaaaaatttttcggattgccacagacaggcgatctggaccaaaatacaatcgagaccatgagaaaacctcgctgtggtaatcccgacgtcgcgaattataatttcttcccgcggaaacctaaatgggacaagaatcagatcacatacagaatcatcggctacacccctgacctggatcctgaaactgtggatgacgcttttgccagagcatttcaggtgtggtcggacgttacacccctgcgattttctagaattcatgacggagaagccgatatcatgattaacttcgggcgctgggaacacggcgatggctacccctttgatggtaaagatggcctcctggcacatgcatttgcccctggcactggagtagggggtgatagccatttcgacgacgatgagctctggaccctaggcgaggggcaggttgtgagggtaaaatacggtaatgccgatggcgaatattgcaagttcccattcttgttcaacggaaaggagtacaattcttgcacggacactggacgcagcgacggcttcctgtggtgcagcacgacctataatttcgagaaggatgggaagtatggtttctgcccccacgaagccctgttcaccatgggcggcaacgcagaagggcaaccctgcaaatttcctttccgttttcaaggcaccagttacgactcctgtaccacagaaggaagaactgacggataccgctggtgtggtacaaccgaggactatgaccgtgataagaaatatggcttttgccccgagacagctatgtcaacagtgggcggtaacagcgagggagctccctgcgtgtttccctttacattcttgggtaataaatacgaatcttgtactagcgcgggcagaagcgatggtaagatgtggtgcgctactactgcgaattacgatgatgaccgcaaatgggggttttgcccggaccaggggtatagcctgttcctggttgccgcccacgagttcggacatgcaatggggctggagcacagccaggatcctggcgcattgatggctcctatttatacgtacactaaaaatttccgactcagtcaggatgacatcaaaggtatacaagagctctacggagcctctcccgacattgacctgggaactggcccgacccccacgctcgggcccgtgacccccgaaatatgcaaacaagacatcgtctttgatggcatagcccaaatccgtggtgagattttcttcttcaaagatcgtttcatatggcgtacggtaacgcctcgggataaacccatggggccacttctggtggccacattttggcctgagctgccagagaagatcgacgcagtatatgaggccccgcaggaagagaaagcagtgtttttcgccggaaatgagtactggatctactccgcttccacgttggaacgcggctatccgaagcccctaaccagtctcggccttcctccagacgtccaaagagtcgacgcagcgtttaactggagcaagaataaaaagacatacatattcgcaggggataagttttggaggtacaatgaagttaagaagaaaatggatcctggtttccctaaactgatcgccgatgcatggaatgccatcccagacaacctggacgctgtggtagacttgcagggcggcggccactcatactttttcaaaggtgcgtattatttgaagctggagaatcagtcccttaagtctgtcaaattcggctcgatcaagtccgactggctcggctgctag

SEQ ID NO: 44726 - DNA, 8646 bp, Artificial Sequence
  Description of Artificial Sequence: Synthetic coding sequence
atgaccgaccccatgatggacttcttcgacgacgccaacctgttcggagaaaccctggagggtctgagtgacgacgcctttgtgcaacccgggccagtgagccttgtcgacgaactgaacctcggcgccgaattcgagcccctccacatcgactctctgaaccatgtacagggaaccccaacccatcagaagatgactgattttgagcagttgaatcagttcgacagcattaagtttcaccacgtgaaccagtcatttgggtcacctgcagaacacgtgctatctccacattctcagtttaattgctcacccattcatccccagaatcagcctaacgggctgtttccagatgtttcagatggatccccaatgtggggtcaccagacggctaccaccatctccaaccagaacggttccccctttcatcagcagggccactctcatagcatgcatcagaacaagtcttttgtcgcccatcacgattttgccctgttccaggctaatgagcagcagacacagtgtacgtcccttagatcgcagcaaaaccggaacaatttgaaccccggccaaaacagtctgtcccagtcgaagaactttatgaatgtgtcaggtccacacagggttaatgtgaaccacccgcctcagatgactaatgctagcaactctcagcagtcgatttctatgcagcagtttagccagacctctaacccctctgcccacttccataaatgcagtagccatcaggaaggcaatttcaatgggccatcccctaacatgacaagctgctcagtgtcaaacagccagcagttctcttctcattattcattctcatctaatcacatcagtccaaacagtctcctccagtcctctgccgtcctcgcctcaaatcacacgaaccagacgctgtctgattttacgggtagtaacagtttcagtcctcataggggcatcaaacaggagtctactcagcacattctcaatccaaacaccagtcttaactccaataattttcagatcctccactcaagtcatccacaaggcaactactcgaactcaaagctaagccccgtgcacatgaacttccctgatcccgttgatagtggcacgcagatgggccattttaatgatcatgtggagacgaacggcttcagctccctggaggagaacctgctgcaccaggttgaaagccagaccgaaccattcaccggcttggatccggaggatttgcttcaagaagggctcctccctcactttgacgagagtacttttggtcaagacaactcctcacacattctggatcacgatctcgacagacagttcactagccatctagtcacacggccaagtgacatggctcagacacagctgcaaagccaggctcgttcatggcatagtagttttagcaatcaccagcatctccatgacaggaaccatttgtgcttgcagagacagcctccgtcaagcaaaaagtccgacggatcgggcacttacaccaaactgcagaacacccaggttcgggtcatgtccgaaaagaagcagaggaagaaagtcgagagtgaaagtaagcaggaaaaggccaaccgtattatttcggaagcaatagctaaagctaaagagagaggtgaacggaatatccctagggtgatgtctcccgaaaatttcccgactgcttctgtcgaaggtaaggaggagaagaagggaagacgcatgaagtccaagcccaaggataaggactcaaagaagaccaagacttgctccaagctgaaggaaaagactaaaattggaaaattaattataactttgggaaaaaagcaaaagagaaaaaacgaatctagcgacgaaattagtgatgcagagcagatgccccagcatactctgaaagaccaagactctcagaagcgtcgttctaataggcagattaaaaggaaaaagtacgccgaagatatagagggcaaacaaagcgaagaggaggtgaaaggcagcatgaagattaagaagaacagtgcccccttgccaggcgagcagccccttcagctctttgtggagaacccaagtgaggaagacgccgctattgtcgacaaaatactgagttcaaggacagttaaaaaagaaatcagtcccggcgtcatgatcgacacggaagaatttttcgtaaaatacaaaaattattcctatctgcactgcgaatgggccacagaggagcagcttctgaaggataaaaggattcagcagaaaatcaagagatttaaactacgccaggcacaaagagcacatttctttgcagacatggaagaggaaccttttaatcccgattacgtggaggtagatcgtgttctggaggtttcgttttgcgaggacaaggacacgggagaaccagtgatctactacttggtgaagtggtgctctttgccgtatgaggatagcacttgggaactgaaagaggatgtcgatctggccaaaattgaagagtttgagcagttgcaggcctcaagaccagatactcggagattagatcgaccgcccagcaatatctggaaaaagatagaccaatccagagattataaaaacgggaatcagcttcgagaataccaattggaagggctgaactggcttctgttcaattggtataaccggcgcaactgcatactggccgatgaaatggggctcggtaagacgatacaaagtatcaccttcctctacgaaattctgttaactggcatcagagggccttttctgatcatcgcacccctgtctacaattgccaactgggagagggaattcaggacttggacagacatcaacgtagtcgtttaccacgggtccctcattagccggcagatgattcagcagtatgagatgtacttcagggacagtcaagggagaataattcgtggagcctaccggttccaggcgatcattacaacctttgaaatgatcttagggggctgcggtgaactaaacgcaatcgagtggagatgcgtgatcatagatgaggcccaccggctgaaaaataaaaattgcaaactgttagagggattgaagctgatgaatttggaacataaggtgctgctgactggaactccactgcaaaacacagttgaggagttattctctctgctgcactttttagagcccctcagattcccctcggaaagcacatttatgcaggaattcggcgatctgaaaactgaagaacaggttcagaagctgcaggcgattctgaagcctatgatgctgcgcagacttaaggaagatgtggaaaaaaagctggcacccaaagaggagacaataatcgaagttgagctcacaaatatccagaagaagtactatcgggccatcctcgagaagaacttttcctttttaagcaaaggcgctggccagactaacgtccccaacctcgtgaataccatgatggagcttaggaagtgctgtaatcacccttacctcattaaaggcgcagaggagaaaatcctaggggagtttcgagacacatacaaccctgctgcctccgattttcacctgcaagcgatgatacaaagcgctggtaagcttgtgttaatagacaagctgctgcctaaaatgaaagctggcgggcataaggtgctgatctttagccagatggtccgctgcctggacatcttggaagactacttaattcataaaaggtatctgtacgagcggatcgatggaagggtgcgcggaaacctccgtcaggccgctatcgaccgattttctaagccagactcagatcgttttgtctttctcctgtgtaccagggcaggggggttgggcatcaacctcactgcggcagacacctgcatcatcttcgactccgactggaatccacagaatgatttgcaagcccaagcccgttgtcaccggattggacagaataaagcggtcaaagtttaccgcctggtcacacgaaacagttacgagagggaaatgtttgatagagctagcctcaagttaggactcgacaaggcggttctccagagtatgtccggcagagagagcaatgttgggggcatccagcaactttctaagaaggagattgaggacctcttgagacgcggtgcatatggggccattatggaagaggaggatgaggggtccaagttctgcgaagaggacattgaccaaattctcctccgacgcacaaagacaatcactatcgagagtgaaggcagaggatccaccttcgccaaggcctcctttgtggcttctggcaaccgcacggatatcagccttgacgaccctaatttctggcagaagtgggctaagaaagccgagatcgacatcgaggccatcagcggacgaaattcactcgtgatagatacccccaggatcaggaaacagacccgcccattctctgctaccaaggacgaattagctgaactgtctgaggcagaatcggaaggcgacgagaagcctaagttgcggaggccatgtgacaggtctaatggttatgggcgcaccgaatgctttcgcgtggagaaaaatttactcgtttacgggtggggccgatggcgagagattctctcccatggccggtttaagcgtcagctgaacgaacacgacgtcgagataatttgccgggccctgctggcctattgccttgtacactaccggggcgacgagaaaattaaaggctttatttgggatctaatcaccccaacagaagacggccagacgcgagagcttcaaaatcaccttggactgtccgcgcctgtgcccagagggagaaaggggaagaaggtcaagacacagacttcctcattcgacattcagaaagccgaatggctgaggaagtacaaccccgagcagctcctgcaggacgaaggttataaaaagcatataaagcaccattgcaataaagttctgctgcgtgttcgcatgttgtactatctgaagcaagaagttatcggcaatgagtgtcagaaggtcttcgatggagtggatgcatccgatattgacgtctgggtgcctgaaccggaccactctgaggtgcccgctgaatggtgggattttgacgcagataaaagcctgctgatcggtgtattcaaacacggctacgagaagtataataccatcagggccgacccggccctctgtttcttggagcgagtcggaaagcccgacgagaaagccgtggccgccgagcagcgagctaatgactacatggatggagacgtggaggatcctgagtataaaccggccccagctatattcaaggatgatatcgaggatgacgtcagctctcctggggatctggtgatcgccgatggcgacggccagctgatggaaggtgacaaagtatattggcccactcaatctgccctgactacaaggctccgaagactcatcacggcatatcagcgaactaacaagaacagacaaatacagcagattcagcccacattctccgtacccacctcagtgatgcagcccatctatgaggaagctactctcaaccctaaaatggccgccaagattgagagacagcagcggtggaccagacgcgaggaagccgacttttaccgggtggtctccacatttggcgtcgtcttcgaccctgaccgcggccagtttgactggaccaagtttagggcaatggcacgattgcataaaaagacggatgattcccttgagaagtacctgtacgctttcatgtccatgtgcagaagggtttgtcgtttgccgtcaaaagaggaactggtagatccaaatatttttattcagcctatcacggaggagagggcttcacgaaccttgtacagaatcgaattgttgaggaaggtgcgcgagcaagcactgcggcacccacaactgtttgagagattgaagctctgccatccgaatcctgacctgcctgtgtggtgggagtgcggtcctcatgacagggatctgctgatcggagcggcaaagcatggagtgtctaggactgactatcatatactcagagatcccgagctgtctttcatggcggcccagcgaaactattcccaatcaaagatggcacactcccgtacaagcactccgctgctgcagcagtaccaagtggctctgagcgcctcgccattgacctctctgcccagattgctggatgctaagggcatcatcctggaggaaatgaaggtaaaatcggagaacttgaaggaggaaccgcagagctcagaagaggaatctatgtcctccgtggagactagaaccctgatcaaatccgagccggtcagcccaaagaatggcgttcttccccaggccaccggggatcaaaagagcggcggcaaatgtgaaaccgacaggaggatggtcgcagctagaacagagcccctgacacccaaccccgctagcaaaaagcccagagttcataagaggggtagcgagagttcatccgactctgacagtgattccgagagatcaagctgttcttctcggtcgtcaagctcatccagttcttcatcgtgcagtcactctcgctccggttcttccagttcgtcttcatcatcatgctccagtgcctcttcctcttcctcgagtagtacgtcatcctcttcttctagctcatcttcctctagcgaggagagtgattctgatgaagaagaggcccagaaacgcgagtccaccacccatatgaaagcctatgacgaggaaagtgtggcatcactgtcaaccactcaggatgagacccaggactctttccagatgaacaatgggacaccagagagcgcctatatcctgcagggcgggtatatgctcgctgcctcatactggcccaaggatagagtcatgattaatagactcgattcaatctgtcagaccgtgctgaaaggaaagtggcctagcgcgaggcggagctatgacgccaacacagttgcctccttttatacaaccaaactcctcgattcacctggggcagctaccgagtacagcgaccccagcgtgccgacacctccaggtgcgggcgtcaaggaagagcacgaccagagcactcaaatgtctaaagagggagggctgaagctgacattccaaaagcaaggtctcgctcagaagcggcccttcgatggcgaagacggtgcattagggcaacagcagtacctaacacggctgagggaattgcagagcgctagcgaaacatctttggtgaactttccaaagtccatacccgtgagtggaacctccatccagcccaccctgggagcaaacggtgtcattctcgataaccaaccaattgtgaaaaaaaggcgcggacgacgaaagaatgtcgagggtgtcgatattttttttttcaatcgaaataagcctccaaaccacgtgtccctgggactgaccagctcccagatctccacaggcattaatcccgccctgagctatacacaaccccagggcatccccgacactgagtccccagtgcccgtgatcaatttgaaggacggcacccggttggctggcgacgatgcacctaagcgaaaggatctggagaagtggctgaaagagcatcctggttatgtcgaggatctgggcgcttttatcccaaggatgcagctccacgagggaaggcctaaacagaaaagacaccgatgcaggaatccaaacaaactggacgttaattctctcaccggagaagagcgagtgcaactgatcaatcgtcgtaacgcccgtaaagtcggcggcgcctttgccccccctcttaaggacttgtgtaggttcttgaaggaaaattctgagtatggcgtggcacctgagtggggagacgtggtcaaacagagcggcttcctgccagaaagtatgtatgaacgcatccttactgggcccgttgtaagagaggaggttagcagacggggccggaggccaaaaagcgggatcgctaaggccactgctgccgctgccgccgccagcgccaccagtgtgtccggcaatcccctgctcgccaatggacttctgcccggtgtggatttaacaactctgcaggccctacagcaaaacctccagaacctgcagtcccttcaggttacagccggcctcatgggaatgccaacggggctaccgagtggaggtgaagctaaaaatatggcggctatgttcccaatgctgttatctgggatggctgggctgcccaacctgttggggatgggaggcctcctgaccaagcctaccgagagtggcacagaggacaaaaagggctccgattccaaggaatcagagggtaagactgagcgtacggaatctcagtcctccgaaaacggaggtgaaaacagcgtctcatccagtcccagcacttcttcaacagccgccttgaacacggcagctgcagccaatcccctcgccctgaatccgctgcttttaagtaatatcctctatcccgggatgctgctgactccaggattgaatttgcatatcccaacactgagtcagagtaatacctttgatgtccagaataagaacagcgatcttggcagttctaaatctgtagaagtcaaagaggaggatagtcgtattaaggatcaggaggataagggggggactgagccctctcctcttaacgagaattcgacagacgaaggcagcgagaaggcagacgcttccagtgggtcagacagcacctcatcttctagtgaggatagcgactcaagtaacgaagattag

SEQ ID NO: 44727 - DNA, 8649 bp, Artificial Sequence
  Description of Artificial Sequence: Synthetic coding sequence
atgaccgaccccatgatggacttcttcgacgacgccaacctgttcggtgagacactggaaggcctgagcgacgacgctttcgtgcagccggggccagtgagtttggtcgacgagctcaacctgggggctgagtttgaacccctgcacatagacagtctgaaccacgtgcagggcacccctacccaccagaagatgaccgattttgagcagctgaatcagttcgattccatcaagtttcaccatgttaaccagtcatttgggagcccagccgagcacgtcctctcgcctcactcacaatttaactgttcacctatacatccccaaaaccagcctaatggtctattccctgatgttagtgacggctcacccatgtggggccatcagacggcaaccacaatttctaaccagaacggatccccctttcaccagcagggccattctcacagcatgcaccagaacaaaagctttgtggcccatcatgattttgctctttttcaggcaaatgaacagcagactcaatgcactagcctgaggtcccaacaaaatagaaataatcttaatccaggacagaatagcctgtctcagtccaagaatttcatgaatgtcagcggtcctcacagagtaaacgtgaaccacccccctcagatgacaaatgccagcaacagccagcagtctatctccatgcaacaatttagtcagactagcaaccctagcgcccacttccataagtgcagcagccatcaggaaggaaactttaatgggccgtcacctaacatgacaagctgcagcgtttccaactcccagcagttctcctcccactactcatttagtagcaaccacatcagccctaattcgctgctgcagtcctcagccgtcctagctagcaaccataccaaccagacgctgagcgatttcacaggatccaacagtttcagcccccatagaggcatcaaacaggagtctacgcagcacatcctgaaccctaataccagcctgaacagtaataattttcagatcctgcactcttcgcacccacaaggtaattacagcaactccaagctgagcccagtgcacatgaatttcccggatcccgttgactctgggactcaaatgggacattttaatgatcacgtggaaacaaatggattcagcagcctggaggaaaacctcttacaccaggtggagtcccagaccgaacccttcactgggctggatcctgaggacctgctgcaggaaggcttgcttccccactttgacgagtcaacctttggccaggacaattcatctcacatcctcgatcacgacctggaccgccaattcaccagtcatcttgtcacccgtccttctgatatggcgcagactcagctgcagtctcaggcgcgcagttggcactcctctttctccaaccatcagcatctccacgaccggaatcatctgtgtctgcagaggcagcccccaagcagcaagaagtcagacggttctggcacatacaccaaattacagaacacccaggtgagggtcatgtctgaaaagaaacagagaaagaaggtggaatccgagagcaaacaagagaaggcgaatcgcatcatcagtgaagccatagcgaaggccaaagaaaggggagagcgaaatatccccagagtgatgtcacctgagaactttccaaccgcctcagtggaaggaaaagaagaaaagaaaggccgtcggatgaagagtaagccgaaggacaaggacagtaagaagacgaaaacatgtagtaagctgaaggaaaagactaagataggaaaactcatcattaccctgggaaagaagcaaaaacggaagaacgagagctcagatgaaatctctgacgccgagcaaatgcctcagcacacactgaaagaccaggactcgcagaagcgacggtcaaatagacagatcaaaaggaaaaaatacgcggaggatatcgaggggaagcagtcagaggaggaagtgaaaggttccatgaagataaagaagaatagcgcaccgcttcctggagagcagcccctgcaactgttcgtagagaacccatcagaggaggacgccgcaattgttgataagatcttatcctcacgaacagtgaaaaaggagatttccccaggcgtcatgatagacacagaagagttctttgtgaaatataaaaactacagctacctgcactgcgagtgggctaccgaggagcagctccttaaggacaaaaggattcagcagaagatcaagcggtttaaactccgacaggcccagcgcgctcacttctttgctgacatggaggaagaaccgttcaaccctgactacgtggaagttgaccgcgtgcttgaggtgagcttctgtgaagacaaggataccggcgaaccggtaatttattacttagtgaagtggtgctcactcccttatgaggatagtacatgggagctgaaggaggatgtggacctggctaaaatcgaagaatttgaacagctgcaggccagcaggcctgatacacgtcgattagatagaccaccgtcaaacatctggaaaaagattgatcagagtagagattacaagaatggaaatcaacttagagagtatcaactcgaaggactaaactggctcttgtttaactggtacaaccgaagaaactgtatactggctgacgagatggggttaggcaaaacaatccaaagcataaccttcctgtatgagatcttgctcacaggtattcgggggccttttctcatcatagcccctctctcgaccattgccaattgggaacgagagtttcgtacttggactgatattaatgtcgtcgtatatcacggctctctcatcagcaggcagatgattcaacaatacgagatgtactttagggacagtcagggacgaatcatacggggcgcctaccggtttcaagcaattattaccacattcgagatgattctgggtggctgtggtgagttaaatgccatcgaatggcgatgcgtcatcattgacgaagctcatcgactcaagaacaagaactgcaagctgctcgagggccttaagctgatgaacttggaacacaaggtgctccttaccggtacccccctccagaatactgtggaggaactcttttccttgctacatttcttggagcccctgaggttcccatccgagagcacgtttatgcaagaattcggggacctgaagacagaggagcaggtacaaaagctacaggcaatcctcaagcctatgatgctccgcagactaaaggaggatgtcgagaagaagctggcccccaaagaggagaccatcatcgaggtcgagcttacaaatatccagaaaaaatactaccgagccatcctagagaaaaatttttccttcctttcaaagggggctggccaaacaaacgtgcctaatctggtgaatacaatgatggagctgagaaagtgctgcaatcacccatatttaatcaagggcgccgaggaaaagatcctgggagagttccgggacacatacaatccagccgcaagcgattttcacctgcaagcaatgattcaatccgccggtaaattggtgctcatcgacaaattgctccccaagatgaaagcaggaggccataaagtactgatctttagtcagatggttaggtgcctggacatcctcgaagattatctcattcacaagagatacctgtatgaacgcattgacggaagggtgagggggaatctgcggcaggccgcaatcgatcgcttttctaagcccgactcagataggttcgttttcttgctttgtaccagggctgggggtctggggatcaacctcactgccgcagacacatgcatcatcttcgattcagattggaaccctcaaaacgatctgcaggcgcaggcccgctgccaccgcatcggccaaaataaagccgtcaaggtttatagactggttactcgaaattcctatgagcgggagatgtttgatcgggctagcttaaagctaggtttagataaggccgttctgcagtctatgagtgggagggagagtaacgtcggtgggattcagcaacttagcaaaaaagagatcgaggacctcctgaggcgcggcgcctatggggcgataatggaagaagaggacgagggatctaaattctgcgaggaggatatcgatcaaattttactgcggcgaacaaagacgataactatcgagagtgagggtagaggttcgacttttgcaaaggcttcattcgtggctagtggcaatcggacagacatcagcctggacgaccccaacttttggcagaaatgggcaaaaaaagctgagattgacattgaagcaatcagcggaaggaactcgttggtgattgatactccccgcatccggaagcagacgcgtccttttagcgccaccaaagatgagctggcagagctgtctgaagctgaatccgaaggggacgagaagcccaaactgcggaggccttgtgacaggtcaaatgggtacggaaggaccgagtgttttcgcgtggagaaaaatctactggtgtatggctgggggcgctggcgggaaattctgagccacggccgattcaaaagacaactaaacgagcatgatgtagagatcatttgtcgggctctgctggcatactgcctggtacactatcgaggcgacgagaagatcaagggctttatttgggaccttatcactccaaccgaggatgggcagacccgtgaactacagaaccaccttgggctgagtgcccctgttcctagaggcagaaaaggcaagaaagtgaaaacacagaccagcagctttgatatccaaaaagctgagtggcttcggaagtacaacccggagcaactgttgcaggacgaagggtacaagaagcacatcaaacaccactgtaataaagtacttctgagagttcggatgctttattatctcaaacaggaagtcatcgggaacgagtgtcaaaaggtgtttgacggcgtggacgcttccgatatagacgtttgggtaccagaacccgatcattccgaggtgcctgccgaatggtgggacttcgatgctgacaaatccctgctcataggtgtctttaagcacggctatgagaagtacaacaccatccgggccgacccagcgctttgctttctcgaacgggttggaaagcccgacgaaaaggctgtggccgctgagcagcgcgccaatgactacatggacggcgatgtggaggacccagaatacaagcccgcacccgcaatcttcaaagacgacatcgaagacgatgtgagctctccaggtgatcttgtcatcgccgatggagatgggcagcttatggagggtgacaaagtatattggcccacccaaagcgctctgacaacccggttgagaaggctaattaccgcctatcaacggacgaacaagaaccggcagatacagcagattcagcccacctttagcgtgccaacctccgtaatgcaacccatctatgaggaagctaccttgaaccctaagatggctgccaagatagagcgtcagcagcgctggacaagacgggaagaggccgatttctatcgggtagtgtcgacatttggcgtggtgtttgaccccgaccgcgggcagttcgactggactaagttcagggctatggccaggctgcataagaaaactgacgattcactagagaagtacctgtacgcgtttatgtcaatgtgccggcgagtgtgccgcctccctagcaaggaggaacttgtggacccgaacatcttcatacagcccataactgaggaaagagccagcaggaccttatacagaatcgaacttcttcgaaaggtgcgggagcaagctctacgccacccccagctttttgaaagattgaagctctgccaccccaaccccgacctgcccgtgtggtgggaatgtgggccccacgatagggacttactgatcggcgccgccaaacatggagtctcaagaaccgattaccacatcttacgagacccagagctctcctttatggcggcccagcgtaactatagccagtctaaaatggcccatagtcgtacctctacacccctgctgcagcagtaccaggtcgccctgagcgcctcaccactgacctcactcccaaggctcctggatgccaagggcatcattctggaggagatgaaagtgaaatccgaaaaccttaaggaagagccccaaagctcagaggaggagagcatgagttcggttgaaacacggaccctcataaaaagcgagcctgtctcgcccaaaaacggggtactaccgcaggccactggcgaccagaagtcgggtggcaagtgtgagaccgacagacgcatggtcgccgcgcgcacggaacctctcactccgaaccctgcgtcaaagaaaccgcgagtccacaagcgtggaagcgagtctagctcagattctgacagcgacagtgagcggtccagttgctcttcccggagttccagctcctccagctcatcctcttgctctcatagcaggtcaggaagctcaagcagtagttcttccagctgcagctcggctagctcatcctctagttcatccacttcaagcagctcctcctcctcaagttcctcgtccgaagagtcggattctgatgaggaagaggcacaaaaaagggcagagagcacgacgcacatgaaggcgtatgacgaggaatccgttgcttctctctccactacccaggacgagacccaggattctttccagatgaacaacggcactcctgaatccgcttatatcctgcagggaggctacatgctggcagcctcctactggcccaaagatcgcgtgatgatcaatcgtttggactcaatctgccagaccgtgctgaagggcaaatggccctcagcaagacgaagctatgacgcaaatacggtggccagcttctacacaacaaagctccttgactctcccggtgccgccaccgagtattccgatccctctgtaccaaccccacctggcgccggcgtcaaagaagagcacgaccagagcacacagatgtcaaaggaagggggtctgaagctgactttccagaagcagggcctcgcgcagaagagaccattcgacggggaagacggcgccctcgggcagcagcaatacctgacccgtcttagggaactgcagtcagccagtgagactagccttgtcaatttcccaaagtctatccctgtgtccggcacctccattcagcccacactcggggccaacggagtcatcctggataaccaacccattgttaaaaaacgcagagggaggcggaagaacgttgagggtgttgacatatttttcttcaaccggaataagccacccaatcacgtctctctgggcctgacatcttcccagatctccacgggcattaacccagccctaagttatactcagccccagggcatccctgatactgaatccccagtacccgtcatcaatctcaaagacggaacacgcctggccggagacgatgctcctaaacgaaaggatctagagaaatggctgaaggaacaccccggttatgtggaagatctgggtgcttttattccacgcatgcagttacacgaagggcgcccgaaacaaaaacgtcatcgctgccgcaacccaaacaaactggacgtgaactctttaactggcgaggagcgggtgcagcttattaacaggcgcaacgcgagaaaagtgggaggtgcgtttgctccaccccttaaggacctctgtaggttccttaaagagaactccgagtatggggtagctcctgagtggggtgatgtggttaagcagtcaggatttctgcctgagtccatgtatgaacgcatcttgaccggtccggtggttcgggaagaggtatcccgacggggccgcagacccaagtccggaatcgcaaaagctaccgccgctgcggcggccgcttccgctacttctgtcagtggaaatcccctgctggctaatggcctgctgcctggagttgatttgacgacactccaagcactgcagcagaacctgcagaacctgcaatcactgcaggtcactgctggactaatgggtatgcccaccggactcccctccggaggagaggccaaaaacatggctgcgatgtttcccatgctgctaagcggcatggccgggttgcccaacctgctggggatgggagggttgctgaccaagcccactgagagcggaacagaggataaaaagggatcagactccaaggaaagtgaggggaagactgaacgcaccgaaagtcaatcaagtgagaacggaggcgagaactctgtcagctcctccccaagcacaagttccacagcagctctgaacacagcagctgccgccaacccgctggcgctgaatccccttctactatctaacatcctttaccccgggatgctcctgacacccgggctcaacttacatattcccacacttagccaaagcaacacctttgatgtgcaaaacaaaaattcagatcttggaagtagtaagtccgttgaggtcaaggaggaagactccagaattaaggatcaggaggataaggggggcacagagccttccccactgaatgagaactccactgatgagggctcggaaaaggctgatgcgagctctggctccgacagtactagctctagctcggaagacagtgacagctctaatgaggactag

SEQ ID NO: 44728 - DNA, 2892 bp, Artificial Sequence
  Description of Artificial Sequence: Synthetic coding sequence
atgctgtactacctgaagcaggaggtgatcggcaacgagtgccagaaggtgttcgacggagtggacgctagcgatatagatgtgtgggttccagaaccggatcattcagaagttcccgcagagtggtgggacttcgatgcagataaatctctcctgatcggtgtgttcaaacacggctatgaaaaatacaatacgattcgcgcggatcctgctctgtgctttctggagcgagtcgggaagcccgacgagaaggcagttgccgccgagcaacgggccaacgactacatggacggggacgttgaggatccagagtacaaacctgcacctgctatctttaaggatgatatcgaggacgatgtgtcgtcccccggtgatcttgttatcgcagatggggatggccaactgatggagggtgataaggtttactggcccacacagtcggcgctgactacgaggctccgaagactcattaccgcatatcaaagaaccaataagaaccgccagattcagcagattcaaccaaccttcagcgtaccaacctcagtaatgcagccgatttacgaggaggctaccctcaaccccaagatggcggccaaaattgagcgccagcagcgttggacacgcagggaggaggcggacttctacagagtggtatccacatttggcgtggtgtttgatccagaccgcggtcagttcgactggacgaaattcagggccatggctagactccacaaaaaaacggatgattctttagagaaatacctttacgcattcatgtctatgtgtcggcgtgtgtgccgtttaccttctaaagaggagtcaacaacacatatgaaggcctacgacgaggaatccgttgcttccctcagcacaacccaggacgaaactcaggattcctttcaaatgaataacggcacaccggagtccgcctacattcttcaaggcggatacatgctagcagcctcctattggccaaaggatcgggtgatgatcaacagacttgacagtatttgtcagactgtcttaaagggaaagtggccctctgctcggcgttcatacgatgcaaacacagtcgcctccttttatactacaaaactgcttgattcacccggcgcggcaacagaatattcagaccctagcgtcccgacgccaccgggcgcaggcgtcaaagaggagcatgatcaatctacacagatgtctaaagtgaagaagcatgtacgggagaaagaattcaccgtaaagattaaagacgaaggagggcttaagctgacttttcaaaagcaaggcctcgctcagaagcgacctttcgatggtgaggatggcgccctgggacagcagcagtatctaaccagactccgggagcttcagtccgcctccgaaaccagcttggtaaatttccccaaatccatccccgtgtctgggacgtcaattcagcctacactcggtgccaatggagtaattctggacaatcagccaattgtgaagaagcgccggggccgtcgcaagaacgtggaaggggtggatatcttcttctttaatcgcaacaagcctcctaaccatgtttcactggggctcacttctagtcagatcagcactgggatcaatccagctttgagttacactcagccccaaggaatccccgatacagagtccccagtgccagtcattaacctgaaggatggaacaagactggccggagatgacgctccaaagaggaaggacctcgaaaagtggttgaaagagcatccaggctatgtggaggatttaggggcattcatcccacggatgcaactgcatgagggccggcccaaacagaaacgtcaccggtgccgaaatcccaataagctagatgttaacagcctgacaggcgaggaacgtgttcagctgatcaatcgccgtaacgctcggaaagtgggcggtgccttcgcaccgcccctgaaagatctgtgccggttccttaaggaaaactctgaatatggcgtagcacctgaatggggggacgtggtcaaacagtccggcttcttgcctgagtccatgtatgagcgcatcctaactggcccggtcgttagggaggaagtctctcggagagggcgccgacccaagagcgggatcgccaaggctaccgctgctgctgctgcagcctctgctacgtctgtatccggcaatcccctgcttgcgaatggacttcttcccggcgtggacctcacaacactgcaagccctccagcaaaacttacagaatctccagtccttacaggttaccgctggactgatggggatgcccactgggttgccatcagggggggaggctaaaaacatggccgctatgtttcccatgctactgagtggaatggcaggcctgcccaatctactgggaatggggggactcttgactaagcctacggagtcaggaacagaagataaaaaaggtagcgactccaaagaatctgaggggaaaacagaacgtaccgaatcacagtcttctgaaaacggtggcgaaaactctgtgtcctcatctccctcaactagttctactgcagcgctaaacaccgcagctgcagccaacccgctcgctctgaacccgctactcctcagcaatatactctacccggggatgctgctgacccccggcttgaacctccatatccccacattgtcccaatccaataccttcgacgtccaaaataagaactcggatctgggatcctcgaagtcagtggaggtgaaggaagaagacagccggatcaaggatcaggaagacaaaggaggtacggagccctctcctcttaatgaaaacagtactgatgagggaagtgagaaagcagacgcttctagcggcagcgattccacatcatcgtcgagtgaggattctgatagcagtaacgaagattag

SEQ ID NO: 44729 - DNA, 8646 bp, Artificial Sequence
  Description of Artificial Sequence: Synthetic coding sequence
atgaccgaccccatgatggacttcttcgacgacgccaacctgttcggggagacgcttgaaggactgagtgacgacgccttcgtgcagccgggcccagtttctttggtggatgagctgaatctcggagctgagtttgaacctctccacatcgactccttaaaccacgtgcagggcacacccactcatcagaagatgacagacttcgagcagctgaatcagtttgactctatcaagttccaccatgtgaaccagtcattcggaagccctgctgaacacgtcctgtcaccccacagtcagttcaattgcagccctattcatccacagaaccagccaaatggtctctttcctgacgtgtccgacggatcccctatgtggggacaccagactgcaaccacgatctccaatcagaacgggtctcctttccaccagcaaggacatagtcatagtatgcaccagaataaatctttcgtcgcacatcacgattttgccctgtttcaggctaatgagcagcagacccagtgtacaagcctccggtctcagcaaaacagaaataatctgaatcccggtcagaatagcttgtcacagtcaaagaactttatgaatgtgagcgggccacaccgggtgaatgtaaatcatcctccacagatgacaaacgcctcgaatagtcagcagagcatctccatgcagcagttctctcagacttctaaccctagtgcgcacttccacaaatgctcatcccaccaggagggaaatttcaatgggcctagtccgaatatgacctcttgctcagtgtcaaactcccaacagttttccagccactatagtttctctagcaaccatatatcccctaacagtttgttgcaaagctctgccgtattagccagtaatcacaccaaccagaccctgagcgacttcacaggctcgaattccttctccccccacagaggcattaaacaggaatcaactcaacacattctgaaccccaatacatccttgaatagtaataatttccagatccttcactcatctcaccctcagggcaactattctaattctaagctgagccctgtgcacatgaattttcccgatcccgtggatagcggaactcagatgggccattttaacgatcacgtggaaaccaacggattttcctccctcgaagaaaatcttcttcaccaggtggagtcacaaactgaaccgttcacagggctggatccggaggatctgctgcaagagggcctcttgccacatttcgatgaatcaacattcggccaagacaacagcagccacattctggatcatgatctcgaccgacaatttactagtcaccttgtgacacggccatccgatatggcccagacacagcttcagtctcaggccagaagctggcacagctctttttccaatcatcagcatctgcacgaccggaatcatctctgtctgcagcggcaacctccatcttccaagaagagcgacggaagcggtacttacacgaagcttcagaatacccaggttcgagtgatgtccgagaaaaagcagcgcaagaaggtagaatctgaatcgaagcaggagaaggctaacaggattatctcggaagctatcgcgaaagctaaggaacggggagagagaaacatcccccgggtgatgtctcccgaaaacttccctacagcatcggtagaaggaaaagaggaaaagaagggacgccggatgaaaagcaagccgaaagacaaagattccaagaagacaaaaacttgctcaaaactgaaagagaaaacaaaaattggtaagctcataattacattaggcaagaaacagaagcggaagaacgagtcatccgacgaaatcagcgacgccgaacaaatgcctcagcatactttgaaggatcaggatagccagaaacggaggagcaacagacagattaagcggaaaaagtacgccgaagatatcgaaggcaagcagtcagaagaggaggtcaaagggtccatgaagatcaaaaagaactctgcaccactgcctggcgagcagccactgcagctgtttgtcgaaaacccttccgaagaggacgctgcaatcgtggacaaaattctgagctctaggactgttaagaaagaaatttcacccggcgttatgatcgacaccgaagaattctttgtcaaatacaagaattactcgtatctacactgtgaatgggctaccgaagaacaactcctaaaagacaaacgcatccagcagaaaataaaacgcttcaagctccggcaggcgcaaagagcccatttttttgccgacatggaagaggaaccattcaacccggattacgtcgaagtggaccgagttttagaagtaagcttttgtgaagataaggacacaggggagcctgtgatctattacttggtgaaatggtgcagtctcccgtacgaggattcaacctgggagttgaaagaagacgtcgatctcgcgaagattgaggagtttgagcaactgcaagcctcccgcccagacactaggaggttagacagacctccaagtaatatttggaaaaagatcgaccagagcagagactacaagaatggaaaccagcttagagagtaccagctagaaggtctgaattggctgttattcaattggtacaatcggagaaactgtattctggctgacgagatgggtctggggaaaactatccagagcattaccttcctgtatgagatcttgctcaccggaatccggggtccgtttctcattatagcccccctgtcaacaattgctaattgggagcgcgagttccgaacctggactgatatcaacgtggtcgtgtaccatgggtctctcatatcccgacagatgatacagcaatacgagatgtacttcagggattctcagggcagaattattcgaggcgcctatagatttcaagcaatcatcaccaccttcgaaatgatcctgggcgggtgcggtgagctaaacgccatagagtggcggtgcgtaattatcgacgaggcccataggctgaagaataagaactgcaagctcctggagggcctgaaactaatgaacctggagcacaaggtccttctgacaggaacccctctgcagaatacagtggaagagctgtttagcctcctgcactttctggagcctctccgattcccgtccgaatccacattcatgcaagaattcggggacttgaagacagaggaacaggtgcagaaactgcaggctattttgaaacccatgatgctgcgccgcttgaaagaagatgtggaaaagaaacttgcacccaaggaagagaccatcatcgaggtggagttaaccaacatccagaagaagtactatagggcaattctggaaaaaaacttcagcttcctatctaagggtgccggccaaacaaatgtcccaaacctcgttaatacgatgatggagctacggaaatgttgcaatcatccctatcttatcaagggcgccgaagaaaagatcctcggagagtttcgagatacgtacaatcctgcggcttcagactttcatcttcaggcaatgattcagtcagccggtaagctggtgttgattgataagttgctcccgaagatgaaggccggtggccataaagtcctgatcttcagccagatggtaaggtgccttgacatcctggaggactatttaatacacaaaaggtacctctatgaacggattgacggacgcgtccggggtaacctcagacaggcagctatcgacagattctctaagccagattctgacagattcgtattcctactgtgcacacgagccggcggcctaggtataaatctgaccgccgcagatacttgcatcatcttcgatagtgactggaaccctcagaacgacctccaggctcaggctaggtgtcatcgcattgggcagaataaggctgtcaaggtgtaccgcctggtcactcgaaacagttacgaacgagaaatgttcgaccgggcatccttgaaactggggcttgacaaggcagtcttacagtctatgagtggaagagagagtaatgtgggtggaatccagcaactcagcaaaaaggagattgaggatctcctgcgcaggggcgcctacggcgctatcatggaagaagaagacgagggttctaaattctgtgaggaagatatcgaccagatcctactgcgtcgcacaaagacaattactatcgagtctgagggccgcggttcgactttcgctaaggcgtctttcgtggctagtggaaaccgcacggacatctcacttgacgaccccaacttctggcagaaatgggcaaagaaggcagaaatcgacatagaggccatttctggtcggaacagtctggttatcgacactccccgaatcagaaaacagacccgtcctttctcagcaacgaaggatgagcttgctgaactgtcagaggccgagtcggaaggcgacgagaaaccaaagctgaggagaccgtgcgatagaagtaacgggtatggtagaacagagtgctttagagtggaaaagaacttgcttgtgtacgggtggggaagatggcgtgaaatcctttcccacggacgcttcaaaaggcagctaaatgagcacgacgtcgagatcatctgccgggccctcctggcatactgcctggtacactatagaggcgacgaaaagatcaaaggattcatctgggacttgatcacgcccaccgaagacggtcagacccgcgaattacagaaccatctcgggctgtctgcacccgtcccacgtggaagaaagggaaaaaaggttaagacgcagacgagttcgtttgacattcagaaagcagaatggctcaggaagtataaccctgagcagctgctccaggacgaaggatacaaaaagcacataaaacatcattgcaataaggtcctactgcgggtgcgaatgctgtattatctgaagcaggaggttataggcaatgagtgtcagaaggttttcgacggtgtggacgccagtgacatcgatgtctgggtgccagagcctgaccacagcgaggtgcccgccgagtggtgggactttgatgcagacaagtctttactgattggagtgtttaaacacggctacgagaaatataacactattagggcagacccggcactgtgtttcctggaacgggtgggcaagcccgacgagaaagccgttgccgctgagcagcgggcaaacgattatatggatggagacgtggaagaccccgaatacaagccggcgccggccattttcaaggacgacattgaggacgatgtatccagcccaggagatctggttatcgcagatggggacgggcagctaatggaaggggacaaggtgtactggcccacgcaatcagccttgaccacaaggttgcgaaggctgatcaccgcataccaaagaaccaataaaaatcggcagatccagcagattcagcccacattctccgttcctacctccgtgatgcagcctatctacgaagaggccactctgaaccctaagatggcggccaagatcgaacgacagcagcgctggaccagaagagaagaagctgatttttatagggtagtgagcacctttggtgtcgtctttgaccccgatcgaggacagtttgactggaccaagttcagagccatggcgcgtttacacaagaaaactgacgatagcctggaaaagtatttgtacgcatttatgtccatgtgcaggcgtgtctgccggctccctagcaaggaggaattagtcgaccccaacatctttatccagcccattacggaggaacgcgcctctaggactctataccgcatagagctgctgcgtaaagtgcgggagcaggcactgagacaccctcagctgtttgagcgcctgaagctatgtcaccctaaccctgacctgcctgtgtggtgggagtgcggtcctcacgatcgcgacttattaatcggcgcagcaaaacatggggtgagtcgtaccgattatcatatccttagagatccagaactgagttttatggctgcgcaacggaactactcgcagtcgaagatggcccattcccgcacatctacccccctcctacagcagtatcaggtggccctgagcgcttcccctttgacctcattaccccgcctgcttgacgctaaggggattatcctggaagagatgaaggtgaaatcagagaatctcaaggaagagccacagagtagcgaggaggagagtatgagttccgtggagacacgtacactgattaagtctgagcctgtcagccccaagaatggcgtgctcccgcaggctacaggtgatcaaaaaagcggcggtaagtgtgaaactgaccgcaggatggtggctgctaggaccgaaccactgacccccaatccagctagcaagaagccccgggtgcataaaagaggatctgaatcaagctctgattccgactcagactctgagagatcatcgtgcagcagccgcagttcttcctcgtcttcctctagctcatgcagccacagtcgctccggtagctcatcctcttcatccagtagctgctccagcgcaagctctagttcctccagctccaccagctcgtcatcctcctcatcatcttcatcgtccgaagagtctgactccgatgaagaagaggcccaaaaacgcgagagcacaactcacatgaaggcttacgatgaggaaagtgtcgccagtctaagcacgacacaggacgagacccaagactctttccagatgaacaacggtaccccagagagcgcatatattttacagggcggctacatgctcgcggcctcttactggcccaaggatcgggtgatgatcaatcgtctggatagcatttgccagactgtgctaaaagggaagtggccttcggcgcgacgctcttacgatgcaaacactgtggcgagcttctatacgacaaagcttttggactccccaggggcagctactgaatactccgaccccagcgtcccgacccccccaggggcaggggtgaaagaagaacatgatcagagtactcagatgagtaaagagggtggcttgaaactgacattccagaagcagggcctcgctcagaagcgcccttttgacggagaggacggcgctctcggccagcagcaatacctaacccgattacgcgaacttcagagcgcatctgaaacttccttggtgaatttccctaagtccattccagtgagtggaacatccatacagcctacccttggggccaatggtgtcatacttgacaaccagcccattgttaagaaacggcgcgggcgacgcaagaatgtggaaggagtggatattttcttctttaacagaaacaaaccaccaaatcatgtgagcttgggcctgacctccagccagatatcaaccggaattaacccagcccttagttacacccagccacaaggaatccccgataccgagagtcctgtccctgtgattaatctgaaggatggcaccagactggctggcgatgatgcccctaagaggaaggacctcgagaaatggttgaaggaacacccgggatatgttgaggatctcggcgcttttatccctcgcatgcagctgcacgaggggcggccaaagcaaaagcgacatcgctgtaggaatccaaataaactggatgttaactcgctgacaggcgaggagcgggtccagctcatcaacaggcggaatgctcgcaaggtcggaggtgcttttgctcctccacttaaagacttgtgcagatttctaaaagaaaattccgaatacggggtagcaccagagtggggcgatgtcgtcaaacagagtggcttcctgcctgaaagtatgtacgagagaatactaaccggcccggtcgtacgcgaggaggtatcccggcgtggaaggcggcccaagagcggaatcgctaaggccactgccgctgcagcagctgcatcggcaacgtctgtatctggtaatccattgctggcgaacgggttgctgccaggagtggatctgacaacccttcaagcactccagcaaaatctgcaaaaccttcagagcctgcaggtaacggccggattgatgggcatgcccaccgggttaccatccgggggggaggctaagaatatggccgcaatgttccccatgctcctctcagggatggcagggctgccgaaccttctgggcatgggcggcctcctcaccaaacccactgaatcggggactgaagataagaaaggcagcgacagcaaagaatccgagggtaagacagagaggaccgagtcgcagtcaagcgaaaacggcggcgagaattccgtgtcgtcttcacccagtacaagctcgactgcagcattgaacacagcggctgcggctaatccactagcactgaaccctctgctgctgtctaatatcctatacccaggcatgctgctaacgcccggcttaaatctgcatatacccacgctgtcgcagtcaaatactttcgatgtacagaacaaaaatagcgacctgggatcctcaaagagtgtagaggtcaaagaagaggatagccgcataaaagatcaggaagataagggggggactgagccttccccgttgaacgagaatagcaccgatgagggctctgaaaaggccgatgcatccagcggctctgacagcacgtcttctagttccgaggattctgatagctcaaatgaggactag

SEQ ID NO: 44730 - DNA, 444 bp, Artificial Sequence
  Description of Artificial Sequence: Synthetic coding sequence
atgaccgccatccggctgcgggagttcatcgagcggcggcccgtgattccccctagcatttttattgcccaccagggccgggacgtccagggctactatcccgggcaactggcacggctccatttcgaccatagcgctaagagggctcctaggcccctgatcgatctcacaattcctcccaagacaaaatatcattaccaaccccagttagaccagcagaccctgatcaggtacatttgcctacgccgccattccaagcccgccgaaccctggtacaaagagacaacctaccgaagggactatagtctgcctttttatgagatagactggaaccagaagcttgccaccgtgagcctgaacccaagaccccttaattccctgcccgagctttattgttgtgaggagcgtagttcttttgaacgaaacgcctttaaacttaagtag

SEQ ID NO: 44731 - DNA, 348 bp, Artificial Sequence
  Description of Artificial Sequence: Synthetic coding sequence
atgaccgccatccggctgcgggagttcatcgagcggcggcccgtgattcctccctccatattcatcgcacaccagggccgagatgtccagggctattaccccgggcagctagccaggctgcattttgaccactcagccaaaagagccccccggcattccaagcctgcggaaccttggtacaaggagaccacataccggcgagactactcccttcctttttacgaaatcgattggaaccagaagctggcgactgtttcactgaacccacgtcctttaaattctctgcccgagttgtactgttgtgaggagcggtctagctttgaacgtaacgcctttaaattaaaatag

SEQ ID NO: 44732 - DNA, 552 bp, Artificial Sequence
  Description of Artificial Sequence: Synthetic coding sequence
atggagaagcgggagctgaaggccagcgtgcccaagttcgacaagattccgtggcttagtgaagcaagcctggttaataagcctctagtgcttagcctcccacgtcgctacccccataccagcgcaacttttcttacctcttccaagaaaaacatgaatttgcctattctattccaggtccctgatgtcttgtccaaagccaggcgaaaccagtgcgattcaatgttgctgaggaaccagcagctgtgcagtacatgccaggagatgaaaatggtgcagccccggactatgaaaatccccgacgaccccaaagcctctttcgaaaactgcatgtcataccgcatgagtctacaccaaccaaaatttcagaccaccccagagccgtttcacgacgacatccctacggaatctatacactataggctgccaattctgggaccccggaccgccgttttccacggccttctgacggaagcgtacaaaacacttaaagaacggcaacggtcaagccttcccaggaaagagccgatcggcaagacaacacgacagtag

SEQ ID NO: 44733 - DNA, 1992 bp, Artificial Sequence
  Description of Artificial Sequence: Synthetic coding sequence
atgctgcagatgcccaagctgaacgagatcccccccggccgggccggtaggcgcgaagcgagaggggaaggccgctggcctggacagaccggacctgaggccgccaggctcgaatggagggctcagggacaggcagggggggccagggctccatgggatagttgggggagctcaaggttgcccacccagcctggacctggctggagtcgctgtcccccgtccttgctgtgcgccttgtccttccaaaagtcaaccatggagtccaaggacgaggtttccgataccgacagtggtattattctacagagcggaccagattcccctgtgtccccaatgaaagagctaacacacgccgtgcataaacagcaacgcgctctggaggctagactggaggcatgtcttgaggagctgcgacgcctgtgccttcgtgaagcggagcttaccggaacgctgcccgccgaatacccactgaagcctggcgaaaaagctcccaaagttcggaggcggatcggagccgcatacaagctcgacgactgggcgttgcatagagaggacccactgtcctcactggaacggcagctggctctacagcttcaaatcacagaggctgcaagaagactctgtctggaagagaatttgagcaggcaggcccgccgccagcgaaagcactccatgctacaggaagagaagaaattgcaagagctccagcgatgtctggtcgagcggagaaggaattcggagccccctccagcggcggccctgccattgggcagagagttatccgcctccgacgatagcagcctctcagacggcctcctcctcgaagaggaagagtctcaggtccccaaaccacccccagagtcccctgctcctccctcgcgccctcttcccccccaaacactggaaggcctacagcctacagggcccgaggcgggctctcccgagcgggcccccgtgcagaactccccttggaaggagaccagcctcgatcacccgtatgagaaacccaggaaaagcagcgaaccttggtcggagtcttctagcccggctaccactccccaggatggccccagtgcatcctccctttggctcctcgaaccagcctcgtatcatgtggtaccaattcgtggagtacctgggcaatggcaagggcggaccagcgccccagccaccccagaaattcagggaaggaggggacagagtcagagcttacgtgtcgattcatttcgggctgggccagagggaagggggagaagcgcctttcctagacgtcgcccaactcattacactgtcacggtgccggactcctgctttcccgccactaagccccccctcccacacgccgcgtgccattcctgttccgaggacagtgggtctgacgtctccagtatttctcatcctacttccccaggttcatcttcccccgacatttcctttctgcaacccctaagtcctcccaaaactcatagacaccggggggcctgggtgcccgccgggagtagggagcttgtggcccaccatccgaagctcctgctgccccctggatacttcccggcagggcgctatgtggtcgtggctgaatctccactgcctccaggcgaatgggagctgcgacgcgctgctccaggcccagcctacgaagaagaagggaccccacttagatatcaacggctggtaccttctcggtcgcgtatcgtgaggaccccgtcacttaaggattctcccgcaggccgtggactgagtaaggcagccgtctcagaagagctgaaatggtggcatgaacgggcaaggctgcgatccactaggccacactccctcgatcgtcagggggccttccgagtgcgaagcctgcccttaggacgcgagggctttgggcgcgcacttgggccccgggcccaggtgccaacggtgtgcgttttgcgcagatcccctgatggggctcccgtgcaagtgttcgtgccggaaaagggcgagataatcagtcaggtgtag

SEQ ID NO: 44734 - DNA, 1737 bp, Artificial Sequence
  Description of Artificial Sequence: Synthetic coding sequence
atggagagcaaggacgaggtgagcgacaccgacagcggcatcatcttgcagtccggtcctgatagtcctgtgtcacccatgaaggaactaacccacgcagtgcacaagcagcagcgcgctttggaggctcgactggaagcctgtttggaagaactccgtagactgtgccttcgggaagccgagctgactggtacactgcccgctgaatatccacttaaaccgggcgaaaaggcccctaaagtgaggaggagaatcggagccgcctataaacttgacgactgggccttacaccgggaagaccccttaagtagcctcgaaaggcaactcgctctgcagctgcagatcactgaggccgcgcggagactgtgcctcgaggaaaatttgtccaggcaggccaggcggcaaaggaagcacagcatgctgcaagaagagaaaaagttgcaggaactgcaaaggtgccttgtcgaacggcgcaggaacagtgaaccgccacctgctgcagccttgccactcgggagagagctaagtgcatcagatgactcttccctgtctgatggactactgctggaagaggaagagtcccaagtgcccaaacctccaccagagagcccagcacccccctctcggcccttgcccccccagacgcttgagggcctccaaccgactgggcctgaagccggcagtcctgagcgagcgcccgtacagaactcaccatggaaggagacgagcctcgatcacccgtacgaaaagccaagaaagtctagcgaaccatggtcagaaagtagttctccagctactacgccacaggatggtcccagcgcttcttcactctggctgctagaaccagcatcgtaccatgtggtgcctatccgcggcgtccccggacagtggcagggtcgcacttctgcccccgcaactccagagatccagggacgaaggggccagtcgcagtcactgcgtgtggattcgttcagggctggccccgaaggccgggggcggagtgcatttccacggaggcgacccacccactacacggtcacagtaccagacagctgcttccccgctacaaaacctccactaccccacgctgcctgccacagttgtagtgaggatagcggctccgatgtttcgagtatctcccaccccacgtccccagggtcctccagccccgacattagctttctccaaccgctctctccaccaaagactcacagacacagaggggcttgggtacctgccggatctagagagctcgttgcgcaccacccaaaattgcttctgccacctggctattttcctgctggccgctacgttgtggtggctgagagtcctctacctccgggcgagtgggaactgagacgggcagctccaggacctgcctacgaagaggaggggacccctcttaggtaccagcgcctagtaccaagtcgctcgaggatagtaagaacgccttccttgaaggactctcctgccggaaggggactgtcgaaggccgccgtcagcgaagaactgaagtggtggcacgaaagggcaagactgcgtagcaccagaccccacagcctggaccgacagggcgcctttcgcgtgcgaagtctgccactgggacgcgagggtttcggcagggccctcggtcctcgcgcccaggtacccactgtttgtgtgctgaggcgcagcccagatggggccccggtgcaggttttcgtgccggagaagggcgagatcatttcacaggtctag

SEQ ID NO: 44735 - DNA, 372 bp, Artificial Sequence
  Description of Artificial Sequence: Synthetic coding sequence
atggagagcaaggacgaggtgagcgacaccgacagcggcatcatcctgcagtcagggcccgactctcccgtgagcccaatgaaggaactaacgcacgccgttcataaacagcaacgcgccctggaggcgcgattggaggcatgtcttgaggaactgcggcggctgtgcctgagggaggctgagctgaccggaacgctgccagccgaatatccactcaagccaggcgagaaggccccaaaggtgcgcagacgtattggcgccgcttacaagcttgatgactgggccttgcacagggaggacccgttgagttccctggaacgccagctggctctccagctgcagattactgaggctgcccgtagactttgttag

SEQ ID NO: 44736 - DNA, 123 bp, Artificial Sequence
  Description of Artificial Sequence: Synthetic coding sequence
atggagagcaaggacgaggtgagcgacaccgacagcggcatcatcctccagagtgggcccgacagtccggtgagtccaatgaaagaactgacccacgcagtacacaagcagcaacgcgcgtag

SEQ ID NO: 44737 - DNA, 612 bp, Artificial Sequence
  Description of Artificial Sequence: Synthetic coding sequence
atgacccaggaccggcccctgctggccgtgcaggaggccctgaagaaatgcttcccagtggtggaagaacagcagggactctggcagtccgccctgagagattgccagccgctgcttagcagcctgtcgaatctggctgaacagctgcaggccgcccaaaatttacgctttgaagacgtgccagcactgcgcgccttccctgatttgaaagagagactccggagaaagcagttagtggccggggacatcgtcctggataagctaggtgagcggttggcaattttactaaaagttagagatatggtttccagtcacgtcgagagagtgtttcagatctatgagcagcacgctgacactgtagggattgacgccgtcctccagccttctgctgtgtctccaagcgtggcagatatgctagaatggctgcaggatatagagcgccactaccgcaaatcctacctgaagaggaaatatttgttgtcctctatccagtggggagacctggcaaatatccaggcgctgcccaaggcatgggatcgcatctccaaagacgagcaccaggacctggtacaggacatcctgctgaatgtctccttctttcttgaggagtag

SEQ ID NO: 44738 - DNA, 909 bp, Artificial Sequence
  Description of Artificial Sequence: Synthetic coding sequence
atggagcggcacatggtgcggggccagctgtacaagcacttcgacctggagcgaaaaaatgctaaacaggcggaggctaggttggatcagaggcttcagcggctgaaggtaatatgtctttatcacgtaaagctcttgacttgggagcagagacagttgcagaaggaacttcagagactccagcaggccgaaacaatgaaaaagaaattctcatcttatctaggaaatggctttcagaagaggcccgaggacgttttagtcttctcacctcaggggcggcagaaacatcgcgcgcctcaggccaaaaagatgagggccctggctactcgtatggctcaggatacatgcaaatccaagtctcaggtcccccctagccacgatgcaggtttgaaagatccaatgaagagcaagaaacaacccttgagccagaacaaccgtactgcctgctttattaaagaacaaccccaagcccaggaaaaagacagcgtgaatccatccaaggacgtcgacccctccaaagggatatccgttccgtgtcagaatcaagaagtatcgacaaataccatagagcaagggccatcatcatcacccgcatcagattccgggatggcctgcgccgacgaaacgaggtctaaagacgtcgcccttaagccggacggaaataccggtaagcagattccgccgaagcacatggagtgcgccggcagtttcgagggcgagtttacaaaacccacttttcttgaactgttgagtaaagcacgaaacgctcattacctgagacatcgggtgccgcctgaatccgaaaggttgttgagtatcggtgagatcttcggccatggagaaagctcttcgagcagagcaggaaaagagtgtgaaaacagagtaccttcaaagttcctgccactgtag

SEQ ID NO: 44739 - DNA, 708 bp, Artificial Sequence
  Description of Artificial Sequence: Synthetic coding sequence
atggtgcggggccagctgtacaagcacttcgacctggagcggaagaacgccaaacaagctgaagccaggttggaccagcgcctccagcgacttaaggtgatctgtctgtaccacgtgaagctgttaacgtgggaacaacggcagttgcagaaagagctgcagcgcttacagcaggaaaccatgaaaaaaaaatttagctcttacttgggcaatggcttccagaaaagaccagaagacgtacttgtattctctcctcagggcagacagaaacaccgggctccccaggcaaagaaaatgagggcccttgccactcgcatggctcaggacacgtgcaagagtaaaagtcaggtgcctcctagtcatgatgcagggctaaaggaccccatgaagtcaaaaaagcaacccctgagtcaaaataaccgcacggcatgttttataaaagaacagccccaggcgcaagagaaggactcggtgaacccttcaaaggacgtcgatccgtctaaaggcatttcggttccttgtcagaaccaagaagtgtccaccaatacaatcgagcaaggccccatcagcagcgcccaaccgcttgcgtttaatggcgagaccatcctctatagcgaacggaacactagaaaccttctgcctccaacgctgtccagtatgaagcagtcaaatcggggcaggcaagcgatctcagatcggactgattag

SEQ ID NO: 44740 - DNA, 786 bp, Artificial Sequence
  Description of Artificial Sequence: Synthetic coding sequence
atggagaacttcagcctgctgagcatcagcggcccccccatcagcagcagcgccctttccgcttttcccgatattatgtttagcagagctacgtccctgcccgatatcgcaaaaacagccgtaccaactgaggcctccagtcccgcacaggcactgccaccccagtatcagtctataattgtacgccagggaatacagaacaccgccctatccccagactgttcactgggcgacacgcagcacggtgaaaaacttaggcgtaactgtactatctaccgcccttggttttccccatatagctactttgtgtgcgccgacaaggaatctcagcttgaggcctatgattttccagaggtgcaacaagacgagggaaagtgggacaattgcctgtccgaagatatggcagaaaacatttgctcgtccagttcgtctccggagaacacctgtccgagggaagctaccaaaaaaagtcgccatggactggactcaattacaagtcaggacattctcatggccagtagatggcatcccgctcagcagaatggctataagtgcgtggcctgttgtcggatgtacccaactctggacttcctcaaatcccacattaagcgcggctttagggaggggtttagttgtaaagtgtactatcgcaagttgaaggccctctggtcaaaggagcaaaaagctcgcttgggagatcgccttagctcgggatcatgccaggctttcaactcacccgcggagcaccttcgccagatagggggggaggcttatctgtgtctctag

SEQ ID NO: 44741 - DNA, 1527 bp, Artificial Sequence
  Description of Artificial Sequence: Synthetic coding sequence
atgaacgagaacaaggacaccgacagcaagaagagcgaggagtacgaggatgattttgagaaggacctcgaatggcttattaacgagaatgagaagtccgacgcctctattattgagatggcctgcgagaaagaggagaacatcaaccaggatctgaaggagaatgaaacggtgatggagcatacaaagagacattcagatccagacaaatcactacaggacgaggtctcacctcgtagaaacgacatcatctcagtgcctggaatccaacctctggaccctatatccgattcagatagtgagaacagcttccaggagtcgaaactcgagagtcaaaaagacctggaagaggaggaagatgaggaggtccggcgctatatcatggagaaaattgtgcaggcgaacaagctcttgcagaaccaggaaccagttaacgacaaacgagaacgtaagctcaagtttaaggatcagctggtcgatttggaggttcctcctctggaagacactaccacattcaaaaactacttcgagaatgaacgaaacatgtttgggaagctgtcacaactgtgcatctcaaacgatttcggtcaggaagacgtgctgctgtccctgaccaacgggtcttgcgaggagaataaagatagaacgatcctggtcgagagagatggaaagtttgagctgctgaatctccaggacattgcttcccaggggttcctgcctcctatcaacaacgccaactccaccgaaaacgatccacagcagttactgccacggagctccaatagctctgttagcggtaccaagaaggaagactctaccgcaaaaatccacgcagttacccatagctccaccggggagccgctggcctatatagcccaaccaccactgaatagaaaaacctgtcccagcagtgccgtcaacagcgaccggagcaagggcaatggaaagtccaatcatcgaacccagtctgctcatatttcccccgtgacttccacgtattgtctgtcccctcggcagaaggaactgcagaagcagttggaagagaagcgggagaagctgaaacgtgaagaggagcgtagaaaaatcgaggaagagaaggagaagaaaagggaaaatgacatcgtgtttaaagcctggttacaaaagaaacgtgagcaggtgctcgagatgcggcggatccagcgggcgaaggaaatcgaggatatgaattctagggaaaatcgtgatcctcagcaagcttttcgcctgtggctgaaaaagaagcacgaagagcaaatgaaagagaggcagaccgaggaattgcgtaagcaagaggaatgtttgttcttcctgaagggaacggaagggcgcgagagagcttttaaacaatggttgcgtcggaagaggatggagaagatggcggagcagcaggcagtcagggaacgaaccagacagctccgactggaggccaaacggtccaaacagctccaacatcacctgtacatgtctgaggccaagccttttagattcacagatcattataactag

SEQ ID NO: 44742 - DNA, 1530 bp, Artificial Sequence
  Description of Artificial Sequence: Synthetic coding sequence
atgaacgagaacaaggacaccgacagcaagaagagcgaggagtacgaggacgattttgaaaaggatcttgagtggctgataaatgagaacgaaaaatccgatgctagtatcatagaaatggcctgcgagaaggaggagaatataaatcaggacctcaaggaaaacgaaactgttatggaacataccaagagacacagtgacccagataaatcccttcaggacgaagtgtctccaaggcgcaacgatattatctccgtgccaggaatccaaccccttgaccctattagcgattctgatagcgaaaactcattccaggaaagcaagctggagtctcagaaggacctggaagaagaggaagacgaggaggtgcgaaggtatatcatggagaagattgtgcaggcgaacaagctcctccagaatcaggagccagttaatgataagcgggaacgtaagctcaaattcaaggatcagctagtcgatctggaggtccccccactcgaggacactacaacatttaagaactactttgagaacgaaagaaacatgtttggcaagctgtcacagctgtgtatcagtaacgatttcggacaggaggatgtgctgcttagcctgactaatgggtcatgtgaggaaaataaagatcggactattcttgtggagcgagacggaaagttcgagctgctgaacctccaggatattgcatcccaggggttcctaccaccaattaataatgccaattccactgagaatgatccccagcagctgctgcctaggtcatctaatagttctgtgtccggcacaaagaaggaggatagcactgcaaaaattcacgccgtgacacactcgagtaccggagagcccctagcttacattgcacagccacctctaaatcgcaaaacttgtcctagcagtgccgtgaactctgacagaagtaaggggaatgggaagagcaaccacaggacacagagcgctcatattagtccagtgacctcaacttactgtctgagccccaggcagaaggagctgcagaaacagttggaggaaaaaagagagaagttgaagcgagaagaggagcgcaggaagattgaagaagagaaagagaagaagcgcgagaacgacatcgtatttaaagcgtggttacaaaagaaaagggaacaggttcttgaaatgagacgcatccagagggccaaagagatcgaggacatgaattcaaggcaagaaaatcgtgaccctcagcaggctttcaggctttggctgaagaaaaaacacgaagaacaaatgaaggagaggcagaccgaggagctgcgcaagcaggaggagtgtctgtttttcctcaagggcactgagggcagagagagggctttcaagcaatggctgcgccggaaacgcatggagaaaatggcagaacaacaggctgttcgcgaacgcacacggcagctgagactggaagcgaaacggagcaaacaattgcagcatcatctatacatgtccgaagccaaaccttttcggtttacagaccactataattag

SEQ ID NO: 44743 - DNA, 1071 bp, Artificial Sequence
  Description of Artificial Sequence: Synthetic coding sequence
atgaacgagaacaaggacaccgacagcaagaagagcgaggagtacgaagacgatttcgaaaaagatttagaatggttgatcaatgagaacgaaaaatccgatgcctccattatcgagatggcttgcgagaaggaagagaacattaaccaagaccttaaggagaatgagacagttatggagcacactaaaaggcacagtgacccagacaagtcactacaggatgaagtttcccccagacggaatgacatcatatctgtgcccgggatccagcccctagaccccattagtgattcggattcggaaaattcattccaagaatcgaaacttgagagtcagaaggacctagaagaagaagaggacgaagaggtgcggcgatatattatggagaagattgtacaagccaacaagctgctacagaatcaggaaccagtgaatgacaagcgggaacgcaaactgaagttcaaggaccaactcgtggatttggaggtaccccccctggaggacaccacaactttcaagaactattttgagaatgagagaaacatgttcgggaagttgtctcagctgtgtatcagtaatgattttgggcaggaggatgtattactgagcctgaccaacggctcctgcgaggagaacaaggaccggacaattttagttgagagagacggcaaattcgaattattgaatctccaggacattgctagccagggcttcctgccccccattaacaacgcaaacagtacagaaaatgacccacagcagctgctgcctcgcagcagtaatagctcagtgagcggaactaaaaaggaagattccactgcaaagatccacgcagtgacacattcctcgacgggggagccattagcctatatcgctcaaccccccctcaacaggaaaacttgcccaagctccgccgtcaattcggacagatctaagggcaatggtaaaagcaatcacaggacccaaagtgcccacattagcccagtgaccagcacctattgtttgtccccccgacagaaggagctgcagaaacaattggaggagaagagagagaagctgaagagagagtag

SEQ ID NO: 44744 - DNA, 1527 bp, Artificial Sequence
  Description of Artificial Sequence: Synthetic coding sequence
atgaacgagaacaaggacaccgacagcaagaagagcgaggagtacgaggatgacttcgaaaaggatcttgagtggttgatcaacgaaaacgagaaaagcgacgcgagcatcatcgaaatggcctgtgaaaaggaggagaacatcaaccaggacctgaaggagaatgaaaccgtcatggaacatacaaagcggcactccgatcctgataaaagtctccaagacgaggtgtcaccacggcggaacgacatcatctccgtgcccgggatccagcctctggatcccatatccgattccgatagcgaaaatagtttccaagagtccaaattagaatcccaaaaggatttagaagaagaggaggacgaggaagtgcggcgctacattatggaaaagatagtgcaggccaataagcttcttcaaaaccaagagccggtgaacgataagcgagagaggaagctcaaattcaaggaccaactggtcgacctggaagtgcctccccttgaggacacaaccacattcaagaattactttgagaatgagaggaatatgtttgggaaacttagtcagttatgcatttctaatgacttcggccaagaggacgtgcttttgtccttgacaaacggcagctgtgaggagaacaaggatcggacgatcctggtggagcgggacggtaagtttgagctgctcaacttgcaggatatcgcgtcccagggctttctgcctcccattaacaacgctaactctaccgagaatgacccacagcagttactgccacgttcgagcaattcgtctgtgtcgggtacaaaaaaagaggactctactgccaagattcatgccgttacccactccagcacaggcgagcctttggcgtacattgcgcagcctcccttgaacagaaagacttgtccctcctctgccgtgaactctgacagatctaaagggaacggcaagagcaatcatcggacgcagagtgcccacatctcaccagtcaccagcacctactgcttgagtccccggcagaaggagctgcaaaaacaactcgaggaaaaaagagagaaattgaagagggaggaagaaaggcggaagattgaagaagagaaggagaagaaacgcgaaaacgacatcgtgttcaaggcttggctgcagaaaaaaagagaacaggtcctagagatgcgcagaatccagcgggccaaggaaattgaagatatgaactccagagagaatagggatcctcagcaggcgtttcgactgtggctcaagaagaaacatgaagaacagatgaaggagcgccagacagaagaattgaggaagcaggaagaatgcttgttttttttgaaaggcactgagggaagagagcgcgccttcaagcagtggctcagaagaaaacggatggaaaaaatggcagagcaacaggctgtgcgcgagcggactcggcagctccgtttggaagcaaagcggtctaaacaattgcaacaccacctctacatgagtgaggcgaagccctttaggtttaccgaccactacaactag

SEQ ID NO: 44745 - DNA, 429 bp, Artificial Sequence
  Description of Artificial Sequence: Synthetic coding sequence
atgaccgtgggcgcccggctgcggagcaaggccgagagcagcctgctacgacgaggtccgagaggtcggggaaggactgagggcgatgaagaggcggccgccatcctggaacacctggaatacgctgatgaggccgaggcggcagcagagagtggcacgtctgctgcagatgaaagaggcccaggaaccaggggcgcacgccgcgttcacttcgccctgctgccagagcgttacgaacccttggaggaacccgcccccagcgaacagcctaggaaacgttaccgccgcaagttgaagaaatatggtaaaaacgtgggaaaagtgattataaagggctgcagatatgtggtgattggcctccagggcttcgcagccgcgtattccgccccattcgctgtggctacgtccgtggttagctttgtccggtag

SEQ ID NO: 44746 - DNA, 333 bp, Artificial Sequence
  Description of Artificial Sequence: Synthetic coding sequence
atggagtggggccccggcagcgactggagccggggcgaggccgccggagtcgacaggggcaaggccgggctgggccttggtggcagaccacccccacagcctcctagagaagaacgggcacaacagttactggacgcagtcgaacagagacaacggcagctgctcgacaccattgctgcctgtgaagagatgttacgacagttgggtcgtagacgcccagaacccgccggcggcgggaacgtgtctgccaagcccggggcaccgcctcagcccgctgttagcgcaaggggtggtttcccaaaggacgctggagacggtgctgccgagccctag

SEQ ID NO: 44747 - DNA, 144 bp, Artificial Sequence
  Description of Artificial Sequence: Synthetic coding sequence
atgctgcggcagctgggccggcggcggcccgagcccgccggcggcgggaacgtttccgcaaaacctggagcccccccccagcccgccgttagcgcccgaggcggcttcccaaaagacgccggcgatggtgccgccgaaccatag

SEQ ID NO: 44748 - DNA, 480 bp, Artificial Sequence
  Description of Artificial Sequence: Synthetic coding sequence
atgggccccggcctgcggctggtgaccggcgtgcggggcggcccctctgggcgtgaagaaggcgcttggcccagagcatctgctggacctgatcgcctatctctcgccctgtccagggctgggcggctacctgcctggacggctggccggagaggctggggatctgcaggaggccaccctcacagtagaccgggtcgtagcgcccccagttcttgttggactcgctggtcctctggatctgggtcatcatggaccccaagccagcctgcccggcggtgctacggatcctgggctgcgggtgccagatccaggctggtggctgggacatctcagcccaatcttgagcgcccaccttcacgccttagtccaccggaggcagcgttccagcgcatgttggcaatggagcttcgttcgccagatcatcccagagccgagtatcccgatttctcgccatcaccaggacccgttgccggcctgtag

SEQ ID NO: 44749 - DNA, 144 bp, Artificial Sequence
  Description of Artificial Sequence: Synthetic coding sequence
atgctgcggcagctgggccggcggcggcccgagcccgccggcggcgggaacgtttcagcaaagcctggcgcccctcctcaaccagctgtctctgcccgggggggctttccaaaggacgcgggcgacggtgcggccgagccttag

SEQ ID NO: 44750 - DNA, 483 bp, Artificial Sequence
  Description of Artificial Sequence: Synthetic coding sequence
atgggcaagatcgccctgcagctgaaggccaccctggagaacatcacaaaccttcgccccgtgggcgaagatttcaggtggtatctcaagatgaaatgcgggaactgcggcgagattagcgataaatggcagtacatcaggctgatggattccgttgcgctgaaaggggggcgcggctccgcttcaatggtgcaaaagtgtaaactgtgtgcaagggaaaatagcattgagatccttagcagcacgataaagccctacaatgccgaagataatgagaatttcaaaacaattgtggagttcgaatgccgaggcctggagcccgtggatttccagccccaagcgggcttcgctgctgagggcgttgaatcagggacagccttctctgacatcaacctgcaggaaaaagactggacagactacgacgagaaagcccaggagtctgttgggatctatgaggtcacccaccagtttgtgaaatgctag

SEQ ID NO: 44751 - DNA, 414 bp, Artificial Sequence
  Description of Artificial Sequence: Synthetic coding sequence
atgggcaagatcgccctgcagctgaaggccaccctggagaacatcactaacctgcgacctgttggggaagactttaggtggtatctgaaggacagtgtcgcactgaaagggggcagaggaagtgccagcatggtgcaaaagtgcaagctgtgcgctcgcgaaaacagcattgagattctgtcttctaccatcaagccgtacaacgctgaagataatgaaaacttcaagacaattgtcgaattcgagtgccgcggcctggaacccgtggactttcagcctctcggcctgcttctcaaggtgtggagccaaggccaaccgtcagtgacattgatctgtagaagacgaaccggcctgactatgatgaaacggccaagatctctctgggagtcgatgcgcagtccgacctccttatag

SEQ ID NO: 44752 - DNA, 624 bp, Artificial Sequence
  Description of Artificial Sequence: Synthetic coding sequence
atggacgacgacctgatgctggccctgcggctgcaggaggagtggaatctccaagaggccgaacgggatcacgctcaggagtcactctcactcgtggacgcatcctgggaattagtcgacccaacacctgatttgcaggcactgtttgtgcagtttaatgaccagtttttttggggacagctagaagcagtagaggtcaaatggagcgtgcgcatgacactgtgcgccggaatctgttcttatgaggggaagggtgggatgtgcagcatcagactgagcgagccccttctgaagttgagacctcggaaggacctcgtggaggtgtaccataccttccacgacgaagtggatgagtataggcgccactggtggagatgcaatggcccctgtcagcacagacccccatactacggatacgtgaaacgtgctaccaatagagaaccgagcgcccatgactattggtgggccgagcaccagaagacttgtggagggacttacataaagatcaaagagccggaaaactactctaaaaagggtaaggggaaggcgaaactaggcaaagaaccagtcttagccgcagagaataaaggcacttttgtgtacatcctgctgattttcatgtag

SEQ ID NO: 44753 - DNA, 1470 bp, Artificial Sequence
  Description of Artificial Sequence: Synthetic coding sequence
atggacgacgacctgatgctggccctgcggctgcaggaggagtggaatttgcaggaggctgaacgagatcacgcccaggaatcactaagtctggtggacgcatcctgggaattggtagatcccaccccagatctgcaagctctttttgtgcaatttaacgaccagttcttctggggacagctcgaggctgtggaagtgaagtggagtgttaggatgaccctgtgcgccggaatatgctcttatgaaggaaaaggaggaatgtgtagtatccggcttagtgagcctctgctgaaattgcggccacggaaagatctggtggaaaccctgttgcacgagatgatccacgcgtatttgtttgttaccaacaatgataaagaccgagagggccacggacctgagttctgcaaacacatgcaccgtattaactctcttacgggtgccaacatcaccgtatatcacacatttcacgacgaggtggatgaatatcgaagacattggtggagatgtaatggcccttgtcagcacaggcctccatactatgggtacgttaaaagagccacaaatagggagcctagcgcccatgattactggtgggcagaacaccaaaagacgtgtggagggacttatatcaaaatcaaagagccagagaattacagcaagaagggcaaggggaaggctaagctaggtaaagagccagtgctggccgctgagaacaaagacaaaccaaacaggggcgaagcacagctcgttatccctttcagtggaaagggttacgtactgggggaaactagcaacctgccttcccccggcaagctaattaccagccatgctatcaataaaacccaagacctcctgaaccagaaccattcggccaacgctgtccgccctaactctaaaatcaaggttaagtttgagcagaatgggtcatcaaagaactctcacctggtgtcccctgccgtgtctaactctcatcaaaatgttctgagcaattacttcccacgagtaagctttgcaaaccagaaggcctttcggggcgtgaatggctctccccggatctcagtgacagtgggtaacatccccaagaatagcgtctcaagcagctctcagaggagagtaagctcctctaagatctccctcaggaattcatccaaggtgaccgagagcgcgagcgtaatgccctcacaggacgtttcaggcagcgaagacacatttcccaacaagcgcccccgcctcgaggacaaaactgtgtttgacaacttcttcattaaaaaggaacaaatcaaatcttcagggaatgacccaaagtactctacaactacggcgcaaaacagttccagcagctcatcccagtctaaaatggtgaactgtcccgtgtgtcagaatgaagtcctggagtcacagatcaatgaacacctggattggtgtctcgaaggtgatagtatcaaggtgaagagcgaggagagcttatag

SEQ ID NO: 44754 - DNA, 564 bp, Artificial Sequence
  Description of Artificial Sequence: Synthetic coding sequence
atgaagaagaccctgctgcacgagatgatccacgcctacctgttcgtcaccaacaatgacaaggaccgtgagggacatggccccgaattttgcaagcacatgcataggatcaactctctgacgggggcgaacatcacagtgtatcatacattccacgacgaggtcgatgaatatcgacgccactggtggaggtgcaacggaccttgtcagcatcgacctccgtactacggatacgtcaagcgcgccaccaatcgcgagccttccgctcatgactattggtgggcagaacaccagaagacatgcgggggaacatacatcaaaattaaagagcctgaaaactactccaaaaaagggaagggtaaggccaaactgggcaaagaaccagtgctggccgctgaaaataaggataagcctaatcggggagaggcccagctggtgatccctttctccggaaaggggtacgtgttaggcgaaacatccaatctgcccagtccaggcaaattgattaccagccacgcaattaacaagacacaagatttgttgaaccagaaccatagtgcgtag

SEQ ID NO: 44755 - DNA, 753 bp, Artificial Sequence
  Description of Artificial Sequence: Synthetic coding sequence
atggacgacgacctgatgctggccctgcggctgcaggaggagtggaatctccaggaggcagaaagggatcacgctcaggagtcactgtcgctggtggatgcaagctgggagctggtcgatcctacacctgatttgcaggcccttttcgttcagttcaatgatcagttcttctggggtcaattggaggccgtggaggtcaagtggtcggttcgcatgacgctctgcgcaggtatttgcagttacgaaggtaaggggggcatgtgttcaattaggctaagcgagccgttgctcaagctaagacctagaaaggatctggtagaaacactgctgcatgagatgatccacgcctacctatttgtgactaataatgacaaagaccgcgaggggcacgggcctgaattttgcaagcacatgcacaggataaactcactgactggagccaatataacggtgtatcacacattccacgacgaggtggacgaataccggcgccattggtggcggtgcaatgggccgtgtcagcaccgaccgccttactatgggtatgtcaaacgggctactaacagggagccctcagcccacgattactggtgggccgagcaccagaagacctgcggcggcacctatatcaagattaaggagccagagaactacagcaaaaaagggaaagggaaagctaagctcggaaaagagcccgtactggcagctgagaacaaaggcacgttcgtttatatactcctgatctttatgtag

SEQ ID NO: 44756 - DNA, 585 bp, Artificial Sequence
  Description of Artificial Sequence: Synthetic coding sequence
atggacgacgacctgatgctggccctgcggctgcaggaggagtggaatctgcaggaggctgagcgagatcatgcccaggagtctctgtcgctagtggatgcgagttgggagctagtagaccctacaccggatctgcaggctctttttgtccagttcaatgaccagttcttttggggacaattagaggccgttgaggtcaagtggtccgtgagaatgaccctatgcgcagggatctgtagttatgaaggtaagggtgggatgtgctccatacgtttatccgagccccttctcaaattgcgccctcgaaaggacttggttgaggtctaccacacatttcatgatgaagtggatgaatataggcggcactggtggcggtgcaacggaccttgtcagcatagaccaccttactatggatatgtcaaacgagccaccaaccgcgagccaagtgcccacgactactggtgggcagaacatcagaaaacttgcggtggaacctacataaaaatcaaagagccagaaaattacaaaaagagacaaagaaaaggaaagacgcgcaaaggtacatctatcggcagacgggaatag

SEQ ID NO: 44757 - DNA, 2472 bp, Artificial Sequence
  Description of Artificial Sequence: Synthetic coding sequence
atgtggggcagccccgccctggcctgggccgtgtggctggcctgcgttcagcccacagtctttccatggtccctgtcgtttcgtagtgacaccgataagccaagtagtgcggccgaagtcctaacggaggccagctcttgctggacagatactgtagagtgtttcagcgattacatgactctttggatacctcgttctcatgtagaaggattacgacggtggttagcccggactctgcacctgcccggcacctggagaagtcctgatcacttggattcctctctcgctaaatgcggttactttctgcacttggcaagtgacggcgactttctcttcagagtccagtattccgcatgtttcgttcagaaggagaaagctaactatagattagaaatcagaatttttcagaagggggtgatgggcttagaacggtcagatcgctacattatgaagtgcccaatgttacgcagccgactcggtcaggagagcgtgcattgtggtcccatgtttattcaagtgagccgccctctgcccctctggagggacaacagacaaacaccatggttactctccctgcggggggagttggttgcaagcctggaagatgcaagcctcatgggactctacgtggacatgaacgcgacaactgtcactgtgcagtcacccaggcaggggttgctgcaaaggtgggaggttcttaacacctcagcagagctcctgcctctgtggttggtgagcggccatcacgcctactcacttgaggctgcctgcccaccggtgtcatttcagccagaaagcgaagtactggttcacattcccaagcagaggcttggtctggtgaagcggggatcttacattgaggagacacttagcttgcgttttctcagagtccaccagtccaatatcttcatggttacagaaaacaaggatttcgttgttgtttccatacctgccgccggcgtactgcaggtccaaaggtgtcaggaagtcggtggaactcccggaacacaggcattctaccgcgttgatctgagtcttgaatttgccgagatggctgcgcccgttttatggacggtagaaagctttttccagtgcgtgggaagtgggactgaatcccccgcctctacggctgccttgagaacgacaccctcaccaccaagcccgggtccagaaacccccccagcaggggttccaccggccgcctcttcccaagtctgggccgccggaccagccgcccaggagtggctttctagagatctgcttcatcgcccaagtgatgcgcttgccaaaaagggccttgggcctttccttcagaccgctaaacctgcgcgccgtggccagacctccgcttccatcctccctcgcgtggtgcaggcccagcggggaccacaaccacccccaggcgaagctggaatacccggtcatcccaccccccccgcaaccctaccatcagagcccgttgagggcgtccaagcaagcccttggagacctcgaccagtcctccctacacatcctgccctgacactacccgtttcatccgacgcttcaagcccaagtccacctgctcccagacctgaacgtcctgagagcctgctggttagcggcccatccgtgacgctgaccgagggtctcggtacagtacgcccagaacaggaccccgcaaagtctcctggatcccctttgctacttcgaggcttgtctagtggcgacgtcgccgctcccgagcctattatgggtgaacccgggcaagcttccgaggaattccagcctcttgcccggccttggagagcaacactggccgccgaagaactggtgagccaccggtcccctggagaaccacaggagacttgctccggcacggaggttgagcgccccaggcagacagggcctggactcccccgggagggcgcccgtggccacatggatctttcatcatctgagccgagccaagacattgaaggccctgggttatcaattcttcctgccagagacgccacatttagcaccccttccgtgaggcagcctgatccctccgcttggctgtcctccggcccagaactgaccgggatgccacgggtccggctggctgcccctctggccgtcttgcccatggagccgttgccgccagaaccggtgaggccagccgcactgctgacgcctgaggccagtagtgtcggtgggcccgaccaggcccggtacctggagagcgccccaggatggcctgtcggtcaggaggaatggggcgtagcgcacacatcatctcctccatcaactcaaacactgagcctgtgggctccaaccggggtgcttcttcctagcctggtagaactggaatatcctttccaggctggtcggggggcgagtttgcagcaggagctgaccgagcccacactggcgctctctgccgagtcacatagaccccctgagctccaggatagcgtcgaaggtctgtccgaacggccatcgaggtag

SEQ ID NO: 44758 - DNA, 1971 bp, Artificial Sequence
  Description of Artificial Sequence: Synthetic coding sequence
atgaagtgccccatgctgcggagccggctgggccaggagagcgtgcactgtggtcccatgtttatccaggtcagcaggcctctgcctctgtggagggacaaccggcaaacaccttggctcctctctctgaggggtgagctggtcgcttccctagaagacgcctcactgatggggttatatgtcgatatgaacgccaccacagtgaccgtccagagtccgcggcagggcctgctacaaagatgggaggtcagcggcggccagcaagcccttccaggcgtgtcttttcagcccgaatccgaagtgcttgtgcatatcccaaagcaacgcctgggattggtaaagagaggctcctacattgaggaaaccttaagtctgcgctttttacgggtccaccaaagcaacatcttcatggttactgaaaataaagatttcgtcgttgtatctatcccagcagcaggggtgctgcaggtgcaaagatgccaggaagtcggaggcacccctgggacccaagctttctatcgggtggacttgtcactggagtttgctgaaatggctgcaccagttctttggaccgttgagagcttttttcagtgtgtggggtccgggaccgagagtccagcctcaactgccgcactcagaacgacaccttcacctcccagtcccggacccgagacacccccagccggcgttcctcccgctgcatcatcgcaagtttgggccgccggaccagctgctcaggaatggttatccagagatcttctgcatcgaccgtctgacgcactagcaaagaagggccttggtcctttcctccagaccgccaagccagcccgaagaggccaaacttctgcatcaatcttgcctagggtggttcaggcccagagaggtccacagccacccccgggtgaggccgggatcccagggcatcccacaccaccagccactcttccatctgagcctgtggagggagtgcaagcaagtccctggaggccgaggcctgtcctccccactcaccctgccctgaccttgccagtgtcaagtgatgcctcgtcacctagcccacccgccccgaggcccgagcgacctgaaagcctactcgtgagtggcccttccgtcacattgacagaaggattaggaacggtgcgccctgagcaggatcccgccaagagccccggtagccccctgctgttacgtggcctttcttctggggatgtggccgctccagaaccaatcatgggagagccaggccaggcgtcagaggaattccaaccgctcgcaaggccttggagagcaactctggctgcagaagaactggttagccacaggagcccaggcgagccccaagagacctgcagcgggacggaagtcgaaaggccacgccaaaccggccctggcctgccgcgcgaaggtgcacgtggacatatggacctgagctcctcagagccttcccaagacatcgaaggcccaggtttatcgatccttccggccagggacgctacattcagcactccttccgtgcgccaacccgatccaagcgcctggctctcgtccgggccagaactgacaggaatgccacgggtgagactggcagcgcctctggccgtgctgccaatggagcctctgcctcccgagcctgtgcgacctgctgccctactgaccccagaggcttcttcggtcggtggtcccgatcaagctcgttatcttgagtcggcccctggatggcctgtgggccaagaggaatggggagttgcacacacgtcctcaccccccagtacccagacactgagcctctgggccccaacgggagtgctgctgccatccctagtcgagctggagtacccgtttcaggcagggaggggcgcctctcttcagcaggagctgacagaacccacactcgccctgtcggccgagtcacaccggccccctgagctgcaagatagtgtcgaaggactgtctgaaaggcccagtaggtag

SEQ ID NO: 44759 - DNA, 1722 bp, Artificial Sequence
  Description of Artificial Sequence: Synthetic coding sequence
atgctgacccggaaccccaagaccaagagcagcctgcagatcctgcaggattcagttaagtggcatcacatggcccacaaggtcaactccctacttgatgcttattcagggctgctcagcaacgagtcaatgattctagctgtgaatagtagcttcgtggatcctcttcttcagttcgaaagccagctgaagatcatcgagtcatcttttgggatgcttgttgtgatgccttcccttgataaggtaaaagaaatgggttcctcctacgagtacattgaggatatggaaaacctgtaccataacatattaaatatctacgagaacatccttacgtctctggttagcaaggatctttataaattacagatactgaaggaaatgctcgtttggatgagcaaggactccagttacttgcaggaacgcatcatggtgattataaacaaagtgctacgcttcaccgtcacaaaagtccggaagtatataagcgtcgatgctccctgtctaggcctgcttgcagctgaattatctctgctgtgttcacatgaagacccttcgatagtgaagcaggcctccctgggcatgtgccacttactgtacatcgcacgatgccagaatgacattgggactaataagcctacaaacggcaaatcccactccctgcagttccccagctctgatgtggagttcctaccaaaagaattccagcaggatgagtctaagattgcccaacgcgtcggtcagactctgctacccccactactcacagattttgtccaatcattgttgatgaaactgtcttcaccagacgataagattgcatctgatgccgcctcgattcttatcttcaccctggagtttcacgctgagaaagtcaccatggtctctaagatcgttgatgctatatatcggcagctttgcgacaacaactgtatgaaggacgtgatgctgcaagtgatcacccttctgacctgtacctccccaaagaaagtcattttccagctcatggattatcccgtgccggctgacgataccctgatacagatgtggaaagcagcctgttcccaggccagcgtcgccccgcatgttctgaagacaatcttgttaatcctgaagggaaagcctggggagatggaggatactgtgaccgaaggaaaaaggttcagcctggatattaccaacctgatgccattagctgcctgccaggcattgtgcactttcctacctctcggatcttaccggaaagccgtggcccagtactttccacagttgttgactacactgatgttccaggtgttctataacagtgagctcaaacctatcttaaaagatcgcgcactgtacgcacaggatgcccttagagttctgctaaactgttcaggcttgcagcaggtcgacattaccctgatgaaggagaacttctgggaccaactttcagaagatctctgctattaccatggagtgtgctttattgcaaagacactatcggagtataactttcctcagtttcccgagacgctgtcatacctctacaagctgtccgtggaaggccctcgtagaagcgaagatactgtcatcgtcctgattttcctaacggaagtgagctttgtagactgcgagcaactttgctcccattttctgtttcttcccaagttcaagtccaaatttcaattcctggtgagcctgcccttgaacgtcggatcgtatcaagacctgcgctcttag

SEQ ID NO: 44760 - DNA, 2586 bp, Artificial Sequence
  Description of Artificial Sequence: Synthetic coding sequence
atgctgacccggaaccccaagaccaagagcagcctgcagatcctgcaggattccgtcaaatggcatcatatggctcataaggtgaactctctgctcgacgcatattctggtcttctgagcaacgagtctatgattcttgcagtaaattcgagcttcgtggacccattactgcaattcgagtcccaacttaagattattgagtcgtcctttggaatgttagtcgtgatgcctagcctggataaagtcaaagagatgggaagcagttatgaatacatcgaggacatggaaaatctttatcacaacatacttaatatttatgaaaatatcctgacgagcctagtcagcaaggatctgtacaagcttcagatccttaaggaaatgttagtttggatgtcgaaagattcatcttacctgcaggaacggattatggtgatcatcaataaggtccttagattcactgtgactaaggttcggaagtacatctctgtggatgctccatgcttggggctgctcgcagctgagctctctttgttatgtagtcatgaggatccatctatcgtgaagcaggcctccttgggcatgtgccacctgttatacatagccaggtgtcagaatgacataggcacaaacaagcctaccaacggcaagtcgcacagtctgcagttcccttcaagcgatgtggagttcttgcctaaagaatttcagcaggacgagagcaagatcgcccagcgggtggggcagacactcctgccgcccctgcttacagatttcgtgcagagcctcctgatgaagctatccagccccgatgataaaatagccagtgacgccgccagtatactaatcttcacactggaattccatgcagagaaagttactatggtttctaagatcgtggacgccatctatcggcagctgtgtgacaacaactgcatgaaagacgtgatgcttcaggttataacacttttgacctgtaccagcccaaaaaaggtaatctttcaactcatggattatccagtccctgctgatgacaccctgatccaaatgtggaaggcagcttgttcacaggcaagcgtagctccgcacgtgctgaaaaccatacttcttatcctgaaagggaaaccgggcgaaatggaagacaccgtcacagaaggcaaacggtttagcctggacatcacaaatcttatgcctctggctgcctgtcaagccctgtgcacattcctgccactcggttcttatagaaaggccgtggcgcagtattttccacagcttctaactacattaatgttccaagtcttctacaactccgagcttaaacccatcttgaaggaccgtgccctgtacgctcaggacgcactgcgcgtactgctaaactgttccggactacaacaggtcgacatcacactaatgaaggagaatttctgggaccaactctccgaagatctctgctactatcacggcgtgtgcttcatcgcgaagactctgtcagagtataattttccccagtttcctgagacgctttcgtacctctacaaactctctgtggagggccctagacggtccgaagacactgtaattgtgctgatcttcctgactgagcttttgaataactttttcaaagaccccttgccagaagaatttctggtccttttcatcaactggatcaacgactccaaccctgttgtatcccggctgattctacacagaatcgtacacatgtctccaatcatcaacaaaaccgaaaatgtctccagcatcctaatcgctattcttgacgcctttctcagtaaggacgacaacgtggtcctgcaggccctgctgacgcttaggcgattactgaatgagttggacaaggtcacatactcccttggaacacgaatcggctcatcatattgtactctgatggatcatatcaatggcgggatccgtagtatggccatcaggcattttggccagcttgtcagagatatgagacaatacacctggatggtgaacgacgtagtgctagagggccttgtgcctctcattcttttcttggaggatgacgataaacgggtggcagaagcctgcaagtatacactcaagatctgcacctcacagctgaaatggtcaacctctcgcctgctgaaagatgagaattacagcttcgaaatggtagtcctgaatatctgcaacaatctgattatttcccaccgcaactacattacagacctgaccagcgatacccttcgcttcctgtggtcgccccgtacctatcttaagagggcgtctgtaatattaatagggtacctcgccaagagtggcggccacctgttgctgagggacgagatcgaggtcatgcttgatgtgatcgaaaggttgctccgcgacgaagatcctatgatcaagcagctggctgagataacatatgatattttcaaaaaaaaggcccataagcttacctctgcccccttgaaacaaaacttccaaaagttactcaaactgttttatatcaagaagttgaagccactttacaactataactctccgaacggtcaaatagacagtcccaccgactctaaggatgttaaaaatgataaggctttgtag

SEQ ID NO: 44761 - DNA, 564 bp, Artificial Sequence
  Description of Artificial Sequence: Synthetic coding sequence
tgaatgcccctggccgcctgccaggccctgtgcaccttcctgcccctgggctcataccggaaggccgttgcccagtatttccctcagctcctgaccaccctgatgtttcaagtcttctacaacagcgagctgaaacccatcctcaaggatcgggcactgtacgcccaagacgccctgagggtactgctgaactgcagtggcttgcagcaggtggatataactctgatgaaggagaatttctgggatcagttgtccgaggatttgtgttattaccatggggtttgtttcatagcaaagactcttagtgaatacaactttcctcagttccctgagacactgtcatacctctacaagctgtcagtggaggggcctcgccgcagcgaagatactgttatcgtgttgatcttcctgacggagcttctgaacaacttctttaaagatcctctccccgaggaattcctggtcctctttattaattggatcaatgacagcaatcctgtggtgagccggctaatccttcataggatcgtccatatgtctcccattataaacaaggtggactag

SEQ ID NO: 44762 - DNA, 750 bp, Artificial Sequence
  Description of Artificial Sequence: Synthetic coding sequence
atgcgggtggacagcagcgccgaccccaccatgagccaggagcaggggcctggctccagcacccctccaagtagtcccaccctgctggatgcactcttgcagaatctttacgactttgggggcactgagggcgagaccgaacaaaagaaaatcattaagaaacgggaaaacaagaagcgcgacgtcatggcctctgcggcccttgcagccgaaccgtctcctctccctggctccctgattaggggccagagaaagtccgcatccagtttcttcaaagaactgcgcgaggagcgccactgcgccccttctggaacacccacaggccctgagatcctggccgccgctgtgcctcctagttctcttaagaataatagggaacaggtggaagtcgtagagtttcattccaataagaaaagaaagttgactccagaccacaataagaataccaaacaagcgaatcctagcgtgttagaacgagatgtcgacactcaggagtttaaccttgagaaggcaagactagaagtccatagatttggcataaccggatacggcaagggaaaagagcggattctggagcaggaacgtgccatcatgttgggggcgaagcctcctaaaaaaagctatgtcaactacaaggtcctccaagaacagattaaagaaaagaaagctgcaaaagaggaggaaaaaaggctagcccaggagacggatatctttaaaaaaaagaagcgaaaaggacaggaagataggtag

SEQ ID NO: 44763 - DNA, 792 bp, Artificial Sequence
  Description of Artificial Sequence: Synthetic coding sequence
atgagccaggagcagggccccggcagcagcaccccccccagcagcccaacccttttggacgccctactgcagaatctatacgacttcggtggtacggaaggtgagacagagcaaaagaaaattataaagaaaagggagaataaaaagagggatgttatggcatccgccgccctcgccgccgaacctagcccgttgcccggctccctcatcaggggacagcggaagtcagccagcagcttctttaaagagctccgcgaggagcgtcactgcgcacccagcggcactcctacgggacctgagattctggccgctgctgttccgccctcctccctgaaaaacaatcgggagcaggtggaggtcgtggagtttcatagtaataaaaagaggaagttgacgccagaccacaataagaacacgaaagcgcggttggaggtgcacagattcggcattacaggttacgggaaaggcaaggaaagaatcttagagcaggagcgggccatcatgcttggagccaagccccctaaaaagtcctacgtgaattacaaggtgctacaggaacagatcaaggaaaaaaaggccgctaaggaggaggagaagaggcttgcccaggaaaccgacattttcaagaagaaaaagaggaagggacaggaggacaggaagtccaagaagaagtctgctccatctattctgtctaatgggaggatcggacaggtggggaagtttaaaaacggcacactcatcctgtcccccgtagacataaagaagatcaactcctcccgggtcgctaagtag

SEQ ID NO: 44764 - DNA, 882 bp, Artificial Sequence
  Description of Artificial Sequence: Synthetic coding sequence
atgcgggtggacagcagcgccgaccccaccatgagccaggagcaggggcctgggtcctcaactccaccgagcagtcctaccctactggacgccctcttgcaaaacctttacgatttcggcgggactgaaggggagacagaacaaaaaaagattataaagaagagagagaacaagaagagagatgtcatggcttctgctgcattggccgctgaaccatctccactgcctggcagcctgattaggggacaacgcaagagcgcttcctccttcttcaaggaattgagggaggagaggcactgtgccccgtccgggaccccaactggacctgagattctcgctgccgccgtcccaccttcatcactaaaaaacaatcgcgaacaggtggaagtggtggagtttcacagtaataagaaacggaagctcacccccgatcataacaaaaacactaaacaggctaacccatcagtgttggagagggacgtggatacgcaagaattcaatctcgagaaagcccgactggaggtgcataggttcggaattaccgggtacgggaagggcaaagagcggatactcgagcaagaaagggctattatgttgggtgcaaagcctccgaagaagtcatatgtgaactataaagtgctccaggagcagattaaggaaaaaaaagccgctaaagaagaagagaagaggcttgcccaagagacggatatattcaaaaaaaaaaagcgcaaaggtcaggaagatagaaaaagtaagaagaagtccgctccatctatcctgtctaacggacgaatcgggcaggtgggcaagttcaaaaacgggaccctaatactctccccagtggatattaagaagataaacagttcccgcgtagccaaatag

SEQ ID NO: 44765 - DNA, 879 bp, Artificial Sequence
  Description of Artificial Sequence: Synthetic coding sequence
atgcgggtggacagcagcgccgaccccaccatgagccaggagcagggtcccggaagctctacgcccccctccagtcccaccctgctagacgccctactgcagaatttgtatgacttcggaggtacggaaggagaaactgagcagaagaagatcattaaaaagagggagaacaagaagcgagacgtgatggcaagcgctgcactcgctgccgagcctagtcccctgccagggtctttgattcggggccaacggaagtccgcaagctcttttttcaaggaactccgggaagagcggcattgtgcaccatccggcacacccacaggtccagaaattctcgcggccgctgttcccccttctagcctgaaaaacaatagagaacaagtggaagtcgttgaattccacagcaataagaagcggaaactaacaccggaccacaacaaaaacactaaggcaaatccctctgtgctggagagggatgttgacacacaggaattcaacttagagaaagctaggctggaggtgcaccggtttggtatcacgggttacggaaaaggaaaggaaaggatcctagagcaggagcgggcaattatgctgggtgctaaaccccctaagaagtcatacgttaattataaggtcttgcaggagcaaatcaaagaaaagaaggctgccaaggaagaggaaaaaagactcgcccaagaaacagacatttttaagaagaagaaacgcaaggggcaggaagacaggaagtccaagaagaaatctgccccgtcaatcctttccaacggacgaataggacaggtagggaagtttaagaacggcaccctcattttgagccccgtggatattaagaaaattaatagcagtagggtggccaagtag

SEQ ID NO: 44766 - DNA, 771 bp, Artificial Sequence
  Description of Artificial Sequence: Synthetic coding sequence
ggcagcagcaccccccccagcagccccaccctgctggacgccctgctgcagaacttatacgacttcgggggtaccgaaggtgagaccgaacaaaagaaaatcatcaagaagcgggagaacaagaagcgggacgtaatggccagtgccgctctggccgcagagccttctccactgcctggtagcctgatcaggggacagagaaaatccgcatcaagcttctttaaagaacttagagaggaacggcactgtgcgccctctggcacccctacaggacctgagattctggctgcagctgttccaccctcatccctgaagaacaaccgggagcaggtggaggttgtggagttccattctaataagaagcggaagctgaccccagatcataataagaataccaaagctcgcctggaagtccacaggttcgggatcactggatatggcaaaggaaaagagcggatcctggaacaggagcgggccatcatgcttggggcaaagccacctaagaaatcttacgtgaactacaaggtcctccaggagcaaatcaaggagaaaaaggcagctaaggaagaagagaaaagacttgcacaagaaacagatattttcaagaaaaagaagagaaagggacaggaagacaggaaaagcaaaaagaaatcagccccaagtatcctgtcaaacgggagaatcggtcaggttggaaaattcaagaatggaacgcttattttaagccccgtggacataaagaaaattaattctagccgcgtggcaaagtag

SEQ ID NO: 44767 - DNA, 438 bp, Artificial Sequence
  Description of Artificial Sequence: Synthetic coding sequence
tgacggcggggcgccggcgtgcggagcggctgcgccagccgggcctgctcgggcgccctcggcggacggggcccaggagagtctctttttgcccaatatccccgtcgggctgaggggaggcgggaaaagcagcaggtgacagagcagaggaatggctggccaagccagagctggagttgttgttgtagcacatgttcccccaataagtgcagttatattctcatgacccagtgcatcgggtctcgagagatggaattatctgcagagtggcctgggtgtagcgttaacatgaaggccaccaaaactgcacgaggcagtgaactgattctttccttagggagcttttctggaagagccgggcaacgcagaaggcctcccccaggacatcaggacggcagtgatacgcggggacttcggcgtgtccaactggccctgtag

SEQ ID NO: 44768 - DNA, 303 bp, Artificial Sequence
  Description of Artificial Sequence: Synthetic coding sequence
atgacccacagcggctggcagggcagcggcggcgccggccccggccctagggcccctgcaaggtccagatgtaggcccggtttgcccagccttccctgcaggccaaatccactagaagcccggggttgtggtagtgcactacgtccctgggatctggccgcaaggacccctatcccctgcttttgcgatcacagttgggcgctggggaaactgctggggccaaagagacgcgagggccgcaagggaagtgagcgacgccgacgggggcccggcggccagcagcctcagcctgccgaggaatag

SEQ ID NO: 44769 - DNA, 1074 bp, Artificial Sequence
  Description of Artificial Sequence: Synthetic coding sequence
atgcggcggaccggccccgaggaggaggcctgcggcgtgtggctggacgccgccgcactgaaacggcgaaaagtgcagacgcacctgatcaagccgggaacaaaaatgctgactttactgcctggcgagcgcaaggccaacatttattttacacagaggcgagcaccatccaccgggattcaccagagatctatcgcctctttttttacgcttcagcccggtaaaacgaacggttccgatcagaagtctgtgagttctcacactgagtcacaaattaataaagagagcaaaaagaacgctacacagctagaccatctcatccctggtttagcacacgactgcatggcctcccccttagctacatctaccacagcggatatacaggaggccgggctttcacctcagtccctccagacctctggtcaccatcgtatgaagactccattttccactgaactttcactgttgcagcctgacacaccagactgcgcaggagacagtcacaccccattagccttttcgtttaccgaggatctggagtcttcctgccttcttgatcgcaaggaagagaagggcgattctgccaggaaatgggagtggctccacgagtccaaaaagaactaccagtccatggaaaagcacaccaagctcccaggtgataaatgttgccagcccctggggaagacaaaactggagagaaaagtgagtgctaaagaaaatcggcaagctcctgtgttactccagacatatcgcgaatcttggaacggagagaacatcgagtccgtcaaacagagccgcagccctgttagcgtcttctcttgggacaatgaaaaaaatgataaagactcctggagtcaactcttcacagaggattcccaggggcagagagtgatagcacacaacaccagagcgcccttccaagatgtcaccaacaattggaattgggacttagggccttttccaaattccccgtgggctcagtgtcaggaggacggcccaacccagaatcttaaacccgacctgctttttacacaggatagtgaaggtaatcaggtaatcagacatcagttttag

SEQ ID NO: 44770 - DNA, 1116 bp, Artificial Sequence
  Description of Artificial Sequence: Synthetic coding sequence
atgcggcggaccggccccgaggaggaggcctgcggcgtgtggctggacgccgcggcgctcaaacgaagaaaagtgcaaacccacctcataaagccgggaaccaagatgctgacattgcttcccggcgagaggaaggcaaacatttatttcactcagcgaagagcgcctagcacaggcattcatcagcgcagcatcgcatcctttttcacactacagcccggtaagaccaacggctccgaccagaagtcggtcagcagccacaccgagagtcaaattaacaaggagagtaagaaaaatgccactcaactggaccatctcatcccaggtctggcacacgactgtatggcctccccactggccacctccacgactgccgacatccaagaagcgggactgtctccccagtcgcttcagactagcgggcaccatcggatgaagactcccttttcgacagagctgtcactgcttcagcctgacactcccgactgtgctggagattcacacacgcccctggcatttagctttaccgaggatctcgagagtagttgcttgctagatagaaaagaggaaaagggggattccgcccggaaatgggagtggctccacgaatcaaaaaagaattatcagagcatggaaaagcatacaaagctccccggcgacaaatgttgtcagccactcggcaagacaaagttggaacgcaaggtcagcgcaaaggagaaccggcaggcccccgtgctcctacaaacttacagggagtcttggaacggggagaatatagagtctgtgaagcagtcaaggtcacccgtgagcgtctttagctgggataatgagaagaatgataaggactcctggagtcagctctttactgaagacagccaggggcagcgtgtgattgcgcacaacacaagagctccatttcaagatgtgactaacaactggaactgggatctgggaccattccccaactcaccatgggcccaatgtcaggaggatggacccacacagaacttaaagcccgacctgctattcactcaggacagcgaagtccaagcgcttgcatgtcagcaggattgctgtagacgaagtatcctcaaaagacagaaacacctgaggtag

SEQ ID NO: 44771 - DNA, 297 bp, Artificial Sequence
  Description of Artificial Sequence: Synthetic coding sequence
atggccctgaagaccagcctgggcagcgtgcagttcatggagcagttctgttggccacatctgagatcattctgtgaaacctgcgtgggcagctggtccattcaaatgcggcagcaccaccatcagtcaagctttccagggtctctaccccaggaaacaaatctgaccctcaaagtgtgtaagccccaggcgcctcagaaactggaccctacactgagcagttgtttctttatagagtcctgcggcgcgcaggtccctgtggaaggctcccgccgagagacatcaatcactgtgtag

SEQ ID NO: 44772 - DNA, 390 bp, Artificial Sequence
  Description of Artificial Sequence: Synthetic coding sequence
atgtggctgtggcaggacatccagtgctgccccgccccccccagcgcacctccgagagccttagagccaggcagagcaccacctccaccgggggagggattaggggcgggcattcccagtctgtccccaccacagaaaaaacctcagtccgtgggcatatgtgtgcgccaaaagggaaggcagaaggcaggacttgagaagggaaacagaaagaaagagctccgccaagcgaactgtccttccttaagacctcagagaaagggcgccgatacccgtcgtctgcccagggaaacacggcccacaaagaaacgcacagcagcagcccaacccttcctgcagttatggaatccagctccacatacaagcaatggccggactggcgacctctag

SEQ ID NO: 44773 - DNA, 243 bp, Artificial Sequence
  Description of Artificial Sequence: Synthetic coding sequence
atggccgagaagatcctggagaagctggacgtgctggacaagcaggccgagattattctggcccggagaaccaaaatcaatagactgcaaagcgagggacggaaaaccacaatggcaatccctcttacattcgattttcagcttgagttcgaagaagcgttggccacgagcgcgtctaaggccatctcaaagattaaggaagacaaaagctgcagcattaccaaaagcaaaatcagcgagtag

SEQ ID NO: 44774 - DNA, 243 bp, Artificial Sequence
  Description of Artificial Sequence: Synthetic coding sequence
atggccgagaagatcctggagaagctggacgtgctggacaagcaggcagaaatcatcctggctaggaggacgaaaataaatcgactgcagtccgaaggcagaaagactaccatggctattcccctaacatttgattttcagttggagtttgaagaggctttagcgacaagtgcatccaaggctatctccaagatcaaagaagacaagtcttgctctattaccaaatcaaagatttccaattag

SEQ ID NO: 44775 - DNA, 846 bp, Artificial Sequence
  Description of Artificial Sequence: Synthetic coding sequence
atggccgagaagatcctggagaagctggacgtgctggacaagcaggcagaaataatcctcgctaggcgaactaaaatcaacaggctacaatcagagggaaggaaaacaactatggctatcccactgacctttgacttccaattagagtttgaggaggcattggctacttctgcttccaaagccatctccaagatcaaagaagacaaaagctgctctataaccaaaagtaagatgcacgtcagcttcaaatgtgagcctgagcctaggaagagcaacttcgagaaatccaacttgaggcctttctttatccagacgaatgttaaaaacaaagaatccgaaagcacggagcctgtggaggagcatttaaagtcccggtctatcagaccctacctttatctcaaagatacgactgagatggaaaatgcaggtcctttaaatgtattgtattcccaacaccggcaggcatgtcggagaagtcttgggtccaccgatttctcgccaatgttcaacattcagagcaatgctcacaaaaaagaaaaggacagcactctgttcactgctcaaatagagaagaagccccggaagcccctggattcagtggggttgctggaaggtgaccgaaacaagcgcaaaaagtcaccgcagatgaacgattttaacatcaaagaaaataaatctgtcagaaactatcagttatcaaaatacagatcagtaagaaagaagtctctcttgcccctgtgttttgaggatgaactgaaaaacccccacgccaagatcgttaatgtgagccctaccaaaaccgtgacttcacatatggagcagaaggacacaaatcccatcatttag

SEQ ID NO: 44776 - DNA, 1203 bp, Artificial Sequence
  Description of Artificial Sequence: Synthetic coding sequence
atggccgagaagatcctggagaagctggacgtgctggacaagcaggccgagattattctggcccgccggactaaaattaatagattacagagcgaaggccgcaagacaacaatggctatcccactaacctttgatttccagctggagttcgaggaggccctggccacgtcagcctccaaagcaatttctaaaattaaagaggacaagtcctgcagtataacgaaatctaagatgcatgtgagctttaagtgcgagcccgaaccaaggaaatccaactttgaaaagtctaatctgcggccctttttcattcagactaacgttaagaataaggaatcagagagtacggctcaaattgagaagaagcctcgaaaacctctggactccgtgggcttgctcgagggcgaccggaataaacgaaaaaagagcccccagatgaatgacttcaacattaaggagaataagtccgtgaggaactatcaactgtctaaatatagatctgtgcggaagaagagtctgctacccctgtgtttcgaggatgagttaaaaaatccccatgcaaagatcgtaaatgtctctcccactaagacggtgacctctcacatggaacagaaagatacaaatcccattattttccacgacactgaatatgtgcgcatgctcttactgactaaaaatcggttttcctcccaccccctagaaaacgagaacatctacccacataagcgaacaaatttcatactcgagcgcaactgcgagatactgaagtccattatagggaatcagtcaatctcactgtttaaaccacagaagacgatgccaacagtgcagagaaaggatatccagatcccaatgtcttttaaagccggccacacaactgttgatgataagcttaaaaagaaaactaataagcagacactcgagaacagatcatggaatactctgtataacttctcacagaatttctcaagcctgacgaagcaatttgttggctacctcgataaggcagtgatccacgaaatgtcagcccagaccggtaaatttgagagaatgttttctgctgggaagcctaccagcatccctacttctagtgcactgcccgtgaagtgctactctaagcccttcaaatatatatacgagctgaacaacgttacccccctggacaatttgctcaatttgagcaacgaaattctcaacgcatcttag

SEQ ID NO: 44777 - DNA, 1203 bp, Artificial Sequence
  Description of Artificial Sequence: Synthetic coding sequence
atggccgagaagatcctggagaagctggacgtgctggacaagcaggccgaaatcatattggccagaaggacaaaaataaacagactccaatcagagggcagaaagactacaatggcaataccccttacttttgattttcaactggagtttgaagaggccctggctaccagtgcctcaaaggccatctccaagattaaggaagacaaaagttgtagtatcactaaatcaaagatgcatgtttctttcaaatgtgaaccagaacccagaaaatctaacttcgagaagagtaacctccgtcccttctttatacagaccaacgttaaaaacaaagaatctgaatcaacagcccaaatagagaaaaaacccagaaaaccccttgatagcgtcggcctactggagggcgaccgaaacaaacggaaaaagtccccgcagatgaatgacttcaacattaaagaaaataaaagtgtcagaaactatcagctcagcaaataccggtctgtgcggaaaaagtcactattgcccttatgttttgaggatgaactgaaaaacccacatgctaagatcgtgaatgttagcccgaccaaaactgtcaccagtcatatggagcaaaaagacaccaacccaattatctttcatgataccgagtatgtgcggatgttgcttctcaccaaaaacagattcagttctcatcctctggaaaacgaaaatatttaccctcacaaacggaccaactttatcctggagaggaactgcgagatcctcaagtctatcattgggaaccaaagtatctcactgtttaaacctcagaaaacgatgccgactgtgcagcggaaagacattcagattcccatgtctttcaaggctgggcatacaactgtggatgacaagctgaagaagaaaaccaataagcagacattggaaaaccgtagttggaacaccctctataatttttctcaaaacttttcgtccttgacgaaacagtttgtggggtatctggataaggcagtaattcacgagatgtcagcccagacaggtaaatttgaacgcatgttttcagccggaaagccaacctccattcctactagttctgccctaccagtgaaatgttatagcaagcccttcaagtatatatatgaactgaacaacgttactccgttggataaccttctgaacttgagcaacgaaatcttgaacgcttcttag

SEQ ID NO: 44778 - DNA, 846 bp, Artificial Sequence
  Description of Artificial Sequence: Synthetic coding sequence
atggccgagaagatcctggagaagctggacgtgctggacaagcaggccgaaatcattctcgcaaggcgaactaagatcaaccggctccagtctgaaggccgcaagactacaatggcgatacctctgacgttcgacttccagctcgaattcgaggaagctcttgcaacatcggcgtcaaaagcaatatccaaaattaaagaggacaagtcctgttctattacaaagtctaaaatgcacgtatcgttcaagtgtgagcctgagcctcgcaagtctaattttgagaagtccaatctgcggcctttttttatccaaacaaacgtgaaaaataaggaaagcgaaagcacagagcccgtagaagaacacctgaagagtaggagcatcaggccatatctatacctgaaggataccacagaaatggaaaacgctgggcccctgaacgttctgtatagccagcaccggcaagcatgccggaggtctctgggatccacggactttagccccatgttcaatatccagtccaatgcccacaaaaaggaaaaagacagtactctgttcaccgcacaaatcgaaaaaaaaccccgaaagcctcttgattcggtaggcctgctggagggagatcggaataagcgtaagaaaagtccccaaatgaacgactttaatattaaagagaataagtccgtccggaattatcagctgagcaaatatcggagcgtaaggaaaaaaagcttgctgcccctgtgcttcgaagatgagctcaagaacccgcatgccaaaattgtgaatgtctctccaactaagaccgtcacaagccacatggaacagaaagatacgaatcctatcatttag

SEQ ID NO: 44779 - DNA, 1203 bp, Artificial Sequence
  Description of Artificial Sequence: Synthetic coding sequence
atggccgagaagatcctggagaagctggacgtgctggacaagcaggcggagatcattttggctaggcggaccaagattaacaggctgcaaagcgagggcaggaagaccaccatggcaattcccctcacctttgactttcaactcgagtttgaagaggccctggccacaagcgcttccaaggccatcagcaagattaaggaagacaaaagctgctccataactaaatctaaaatgcacgtttcttttaagtgtgagccagaacctaggaagagcaactttgaaaagtccaatctgcgtcctttctttatccaaacgaacgtaaaaaacaaggaatccgaaagcacggctcagattgagaaaaagccacgcaagcccctggactctgtcggtctactcgagggggatcgcaacaagcgtaaaaaatcacctcaaatgaacgatttcaacatcaaagagaataagtctgtcagaaactatcagctatctaaatatcgaagcgtacgtaagaagtcgctgctcccgctttgtttcgaggatgagctgaaaaacccccacgcaaaaatagtgaacgtgtctccgaccaaaaccgtaacatctcacatggagcaaaaagacaccaaccctatcatttttcacgataccgaatatgttagaatgcttttattgacgaaaaacaggttctctagccaccccctagaaaatgagaacatctacccccataagagaaccaacttcatcctggagaggaattgcgagatattaaagagcatcatcggtaaccagagcatctccttgttcaagccgcagaagacaatgccaactgtccagcggaaagatattcagatccctatgtctttcaaagccgggcatactacggtggatgataagctgaaaaaaaagacaaataaacagaccttggaaaatcgctcatggaacaccttgtacaatttcagtcaaaacttctctagcctaacaaagcagtttgtcggttacttagacaaagccgttatccatgaaatgtctgcccaaactggaaaatttgaacggatgttctcagcgggaaaacctacaagcatcccaaccagtagcgctcttcccgttaaatgctattccaagccatttaagtacatatatgagcttaataacgtgacgcctcttgacaacctgctcaatttaagtaacgaaatcctaaacgcctcttag

SEQ ID NO: 44780 - DNA, 477 bp, Artificial Sequence
  Description of Artificial Sequence: Synthetic coding sequence
atgcggcggagcctgcgggccggcaagcggcggcagaccgccggcaagagtaaaagtcctcctaaggtgccaatcgttattcaggatgactcactacccgccggtccacccccccagatccgaatactgaagcgccccacttctaacggggtggtttccagtcccaactcaaccagccgacccaccctgcccgtgaagtcgctcgcacaacgagaggccgagtatgccgaggcacgaaaacgtatactgggcagcgcttcacctgaggaggagcaggaaaaacccatactcgacaggcccaccaggatcagccagcccgaggattctcgcctacaaactgcgcagattaacgctggtaagaagcggtgtcgccgctgctgtagacatagactgcttggacgccctccaagggttgctctgccctggcagacagctggcttagagcaacgcgaacgtcctgacctgttggccctatag

SEQ ID NO: 44781 - DNA, 459 bp, Artificial Sequence
  Description of Artificial Sequence: Synthetic coding sequence
atggaggacgaggaggtggccgagagctgggaggaggccgccgacagcggcgagatcgacagacggttggaaaaaaaactgaagattacacagaaggagagcaggaaatcaaagtctccacccaaggtaccaatcgttatccaagatgacagcctcccagcaggaccccctccacaaatcaggatattaaagcgcccgacttcaaatggcgtcgtgagctcaccaaacagtacatctcggcccacactccccgtgaaatcgcttgctcagagggaggctgagtatgcagaagcaagaaaacggattctcggatcagcaagccccgaggaggagcaggaaaaacccattcttgaccgaccaaccaggatatcgcagccagaggactctagacagcccaataatgtgatcagacaaccgctgggtccagatggaagccagggattcaaacagcgtcgatag

SEQ ID NO: 44782 - DNA, 402 bp, Artificial Sequence
  Description of Artificial Sequence: Synthetic coding sequence
atgcggcggagcctgcgggccggcaagcggcggcagaccgccggccgaaagtccaagtcccctccgaaagtcccaatagttattcaggacgactccctgccagccggaccaccccctcagatccggatcctgaagcgcccaacgtcgaacggcgttgtgagctcgcctaactccacctcacgccctacgttgcccgttaaaagcctggcacagagagaagcggaatacgcagaggcgcggaagagaatcctaggcagtgccagtcccgaggaggaacaagagaagcccatcttggataggccgaccaggatttctcaaccagaggatagtaggcagcccaacaatgtgatacggcagcctcttgggccagacggtagccaaggttttaaacagcgcaggtag

SEQ ID NO: 44783 - DNA, 423 bp, Artificial Sequence
  Description of Artificial Sequence: Synthetic coding sequence
atggaggacgaggaggtggccgagagctgggaggaggccgccgactccggggaaatagacaggcgcctcgaaaagaaattaaaaatcacccagaaagagtcccgtaaatccaagtctcccccgaaggtgccgatcgtgattcaggacgatagcttgcccgcgggccctcctccgcagatccgcatccttaagagacccacttctaacggggtggtgagttcaccgaactcaacatcccggcctactctgcccgttaaaagccttgctcagcgggaggctgagtacgctgaagccaggaagagaatcctgggctctgctagccctgaggaggagcaggagaaaccaatcctggacaggccaaccagaatcagccagccggaagatagccgtcaacctaacaacgttatccggcagagacgatag

SEQ ID NO: 44784 - DNA, 480 bp, Artificial Sequence
  Description of Artificial Sequence: Synthetic coding sequence
atgagctacgaggtggccaccgccctggagaaccggagccacaaggtccggtatagtgattcagtagagaatggtagcataatattctctctgtctggcgtcgcgtttctcctaatggacaccaaggaatgtttattatctaccgaggagatatttctggctaaaatcgaaaagtttattaacatccaccagaattcctttctggtgctgagcgccgctttgcatggaccggaggagtggaagttgatgttccgaatccagcagaggtttcttgggtgtaatctacgtatccttccagttcacaacactgtcaacgctattaacctgatgtgtaccattgccaaaaccaccagtaaaccttatattgactctatctgttacaggatgattacggcaaaagcctatatcattgagcagagtcctgtctggaagacgctgcaaaaaataaaactcaattccgactctgtcaatccaaactag

SEQ ID NO: 44785 - DNA, 543 bp, Artificial Sequence
  Description of Artificial Sequence: Synthetic coding sequence
atggccgagagcggcaaggagaagatcaagtggaccaccaccatcatcatatcttcctccctgaaaagttacgaggtggcaaccgctctggaaaatcgttcccacaaggtgcgttattctgactctgttgaaaacgggtccattatcttttcactgtccggtgtcgcctttctgcttatggatacgaaggaatgtctgctcagcaccgaagaaatcttccttgctaaaatcgaaaaatttataaatattcaccagaactcattcttagtgctgtccgcggcactgcacggccccgaagaatggaagctgatgttccggatccagcagcgattcttaggatgcaatctaagaatcctccccgttcataacacggtaaacgccattaatctgatgtgcacgatcgccaaaacaacctctaagccttatattgatagcatctgttataggatgatcacagccaaggcctatattattgaacaaagcccggtgtggaaaacactccagaaaattaaacttaattctgactctgtgaatccaaactag

SEQ ID NO: 44786 - DNA, 813 bp, Artificial Sequence
  Description of Artificial Sequence: Synthetic coding sequence
atgcagggcaacaacctgcagccccccagcccccggcccctggagtgttggagcctgcatcgcgaggctcctcagcgcacagaggcttcgcggacacatccttccccatttctcgcacttcccgggagccatagaaccgctaaccaggcccaggtcgtgccaggactggtgcatcatccccaagagaatactcagcgcttgaggatccgagcgggcttatctcctttcccacgcgcccgcctggcggccatcggcagcacgcatggccacagatgggttcccggaatatgtttgcccagatgcctgtgccctgcaagctgtgcgctgcatgcttgcccaccccattgcaataacgctgaagcacattcctggttgaggctcggaggaccactgcaatcccgaagcgtcgaacaccagcagcatgcctgtggatggggttgggtaacccatgcgacttatggcgaaaggggcacctcccaggcggccgagcgacagaggattgcccataccagggcccttagtgtgggaaactgtccgcgctcacactttcagtgtgaattcagctctatttcaaaatggtcggaaggtacaggcaccttctcaccacgtccgagagccgttaagtctggagtgggcgggcagcctagtccccacatacggattacgtggcggagctgtactaccctgacttccaagccttgttctcgggcaatcactcccgaatgtgtggtgggatggagtcgcaggtccaggcactggtacagcgacatgaggactggagagtgccagggtctttcccctataaccaggtag

SEQ ID NO: 44787 - DNA, 333 bp, Artificial Sequence
  Description of Artificial Sequence: Synthetic coding sequence
atgacctaccccccccaccgggccttcagccggagcgacgtgccctaccccctgttaagctcaccagttcagtggcctctaagcctcgttgtgggagatacaagcaccaggtggcctcagcagccatcagctctcgaatctgattgtcctggaccaagccatccgtgccttgcagggctcctaggacccatgcatccagttgacatccccttgtctaccgctcttcacagcaaacaccagcgacgcctgactcaatgcgttttgatggtgcagagcccctctaagcagaggtccctgtacctgttgaataagaagatcccccatgatgcctag

SEQ ID NO: 44788 - DNA, 408 bp, Artificial Sequence
  Description of Artificial Sequence: Synthetic coding sequence
atgggcaactacctgctgcggaagctgagctgcctgggcgagaaccagaaaaaacctaaaaaagggaatccagacgaagaaagaaaacgacaggaaatgacaaccttcgagcggaagctccaagaccaagataagaagagccaagaagtgtcgagtaccagtaatcaggagaatgagaatgggagcggctccgaggaagtgtgttatacagtgattaatcatatcccccatcagcggagctcactctctagtaacgatgatggctatgaaaacatagactccctaacgcgaaaggtgagacagttcagagaacgatctgaaactgaatatgcactcctccggacttcagtcagccgcccctgctcttgcacacatgaacacgactatgaagttgtttttccgcactag

SEQ ID NO: 44789 - DNA, 348 bp, Artificial Sequence
  Description of Artificial Sequence: Synthetic coding sequence
atgggcaactacctgctgcggaagctgcggcaggagatgaccacctttgaacgaaagctgcaggatcaggataagaaaagtcaagaagtcagttcaaccagcaaccaagagaatgagaacggttcgggtagcgaggaagtgtgttacactgtaatcaaccacatccctcaccagaggtcttccttgtcttccaacgacgatgggtatgagaatatcgacagcctgactcggaaagtgaggcagtttagagagcgaagcgagactgaatatgccctgctgcgtacatcagtgagtagaccgtgttcctgcacccacgaacatgattatgaagtggtcttcccacactag

SEQ ID NO: 44790 - DNA, 402 bp, Artificial Sequence
  Description of Artificial Sequence: Synthetic coding sequence
atggtgatgctggaggacagcaacagcagcaccggctgcggcgccaggaactgtgtcgagtgcctggttttcctgagcgtgttgggctgccagtcagagaggaaaggacagatgcggacccagcaggctggcaggtggcttcgagcgggcagggaggccagctccgagacaaatcctgaagggacgcttattcttgactttcaaagccccgaacttccgttagccgctagggggtggcaggaacatgagcctgtcgttcgctgtaatgttttgccacacgctttctcctcttggtgctttgggcaaaatttccccaaatggagtgaaacccaagaacttaggaatcgggtgactgtgaaacgctgggagattattagctgtgaaaactcgggggagagctag

SEQ ID NO: 44791 - DNA, 348 bp, Artificial Sequence
  Description of Artificial Sequence: Synthetic coding sequence
atgggcaactacctgctgcggaagctgcggcaggagatgaccacctttgagcgcaagctgcaggaccaagacaagaagagccaggaggtgagctctaccagcaaccaggaaaatgagaatgggtctggaagtgaggaagtctgctatacggttattaaccatatccctcatcagcggtccagcttaagctccaatgatgatggctacgaaaatatcgattccctgaccaggaaagtgcgccagtttagggagcgcagtgaaaccgaatacgccctcctgcgcacgtcagtaagtaggccctgttcatgtacacacgagcatgattatgaagtagtgttcccacactag

SEQ ID NO: 44792 - DNA, 243 bp, Artificial Sequence
  Description of Artificial Sequence: Synthetic coding sequence
atgggcaactacctgctgcggaagctgagctgcctgggcgagaaccaaaagaagccgaagaagggcaacccagacgaggagcgcaagcgacaggagatgaccacctttgagcggaagctgcaggatcaggacaagaagagtcaggaggtgtcttctacttccaaccaagaaaacgagaatggctccggtagtgaagaagtgtgctataccgttataaatcacattccccatcagcggagctag

SEQ ID NO: 44793 - DNA, 348 bp, Artificial Sequence
  Description of Artificial Sequence: Synthetic coding sequence
atgggcaactacctgctgcggaagctgcggcaggagatgaccaccttcgagcggaagctgcaggatcaggacaagaagtctcaggaggtatcgtccacatccaaccaggagaatgaaaacggctcagggagcgaagaagtgtgctacacagtcatcaatcacatcccacatcagagatcgtccctctccagtaatgacgacggttacgaaaacatagattcactcacccgaaaggtacgccagttccgagagagaagtgaaacagagtacgcactgcttcggacaagcgtttcaagaccctgtagctgtactcatgaacacgactacgaagtggtctttcctcattag

SEQ ID NO: 44794 - DNA, 585 bp, Artificial Sequence
  Description of Artificial Sequence: Synthetic coding sequence
atgttcctgaccgccgtgaacccccagcccctgagcacccccagctggcagatcgagacaaaatatagcacaaaagtactgaccggtaattggatggaggaacgacggaaatttacgcgcgacacagacaagactccgcagagcatctataggaaggagtatatcccatttcctgatcaccgccccgaccaaattagccggtggtacggaaaacggaaggtagaggggctgccatacaaacacctgatcacccaccatcaggaaccccctcacagatatctcatcagcacatatgatgatcattacaaccggcacggctataatcctgggctgccacctttacgcacttggaatgggcagaaactgctatggctccccgagaaaagtgacttccccttgcttgctcctcccacaaactatgggctgtatgaacagctaaagcagagacagctgactccgaaggccggcctgaagcagtctacatatacctcttcatacccccggccccctctttgcgcaatgagctggagggaacacgccgtgcccgtgcctcctcaccgtttacaccctttccctcatttctag

SEQ ID NO: 44795 - DNA, 471 bp, Artificial Sequence
  Description of Artificial Sequence: Synthetic coding sequence
atgttcctgaccgccgtgaacccccagcccctgagcacccccagctggcagatcgagactaagtactcgactaaagtgttgaccgggaattggatggaagaaaggcgcaaaggtctgccatacaaacatttgattacacaccatcaggaacctccgcacagatacctaatctccacgtatgatgaccactataataggcatggttacaaccccggcttgccccccctccgaacctggaatggccagaaactcctgtggctgccggagaaatctgactttcccctgctggctcctcctaccaactatggactttatgagcagctgaagcagcggcagctgactcctaaagccggactcaagcagtctacatatacctcctcctatcctcgcccgcccttgtgtgccatgtcttggcgtgaacacgcagtcccagtccctccacatagactacacccatttccgcacttttag

SEQ ID NO: 44796 - DNA, 4422 bp, Artificial Sequence
  Description of Artificial Sequence: Synthetic coding sequence
atgacccggatgagctgcccctggggcagctaccagtgggagcccggagcctgcccagcggcaccgcgcggcattggcggcggcgatatggctggaggaattcctgatgttcgcgggcttcaggaagcggcccttggtgctggcaggtctcaggaagaggcgaggctggtggaagaggctcagacccccgtcatgctgccacaagacagcgggcagagggtagaggaggtgccgggagatctgatggcgaagcgtatgagtctcatactgcacgttcagaagctcccctgggaccacgtcccttgcctgcgaaggacgcggcagaacctgtatcaggatgtaggaggacatgctcatggctcgggactgggcggggctaagcgtggtgccgcccggtcagcactcagacggcccctaccaccggccacctgcagacctgccggaattgtgagcggaccctcccctcgacttgactcgaaccccacaggagcacacttgatcaagcagacacggcccctgacagtggaatggactaaggatacacccgtgcccgagcctatggaactgcgctccgacgcttcacacaaggagaacgtaagccctaagcccgctgcacttcctaagccagggaaacggttgaagcagcggcgtttccgaaggagcctagggatcggtctcagcgggcggcacgaccagtgggtgccagggtgccaagtcgagcgcggggggcccgcggccacaccatctccgggagccgttctggatcaggaaccatgccgggtccagacaaacctcgcctcaccaggaccaaggctcggcctcgctttaaaggacaccacagggcaactggttaacagttctttttggcaacagtctaacctccaatcccttgcccgaaggagacagggaaaagcacgggagttcgccatccaacaatctaatctgagtattaatgaaacgtcatccccgcacctgtgtcctgagcccggcggctcgtccggccctcacaaactaccctgggggcctctcctgtcccaggagccgttggcaagaccatcgagttgccttagacagtccggcctcccggcacccggtaccccctccggtgactttcgtccaactgaggcattcgctcctcttgacggacatacgcaaccaggtctgagatcctggggaggactcggaagctggcgctctcgcctggtcggtgagccactcacccttgaggatcttgctgtgccatcacaaaatcagactcaagccccgtcccgggctgctgtgcatcagctccttgccagtgttcactgtttggcacaggaggctgctcggttacggtgtcaggctcctcaggaaccccctgcgtggggggtttctccaaaacagaaaggagaggaaggtgcacccagggagagagttcatagagaggaggagcgaacagcatttcacctgagtgacactgttcccgcgtcctcagcctcaaagaacaaagctcagaatatcaccgcccccgaatccgaggctatttgttggcagctgctgagtcgctgcttcaggtcttggaggcatctcgtgaagcggcagcgagaacctgccgccgccgccgtggccctcggtcgttggcagctactgagaaagtgtctacaagctctgtggctgcgggaggcccagctcgaagcagcttgggggcaatacaccaaggtcctgttggtccgtagcttcagggaggtgtccggcctccaagtgggacccggcggccgggtaaagcaatgcccaggaagtctccgggaggaggagatcgcccagcggcttttaagccacccacggcagagaaccgactctaggcacgaaagagtccaaatattgcaggcactgcagcttgcggtattttttctttggtgtcaacaaaaaaagcgggctcggcaggagcgagaaacactcaggaaagccactagagctacacagaggactgggagcttccctcaagcttggcattccactgcggccggggttgcgtgggttgctccactttcaccccagcatcagcgcgcatggttgtgtagatgtttcggcgcctggcagcagtttgtgcaaaggggctctaggtaccgtgatcacctggcagatcgaaggaccggtactctgcgcaaatgtctggaacagtgggtccgtatgaagcagctccgagaatcagacggtgccaaagtgacccagttatcgctatgtcgacagaaagccggccgcgaggcagtgtataccgccgggcccggagcatgcggcttgggggcggtcggtcaggctcaggggcaacaagaacagggcagaggctcacttcaggacgcttgttggaccttggcactttgctgggcactgcttttatggaaaatgcggctcttccagcgacagtgggccaactcttttttccaggggctacaacagaggatgctccaacgctctcttcgctggtggcatcttcgagccctaggaccagatgctactagtagttgtacaaagaccccaagtgccctggagcccctttcctcttccacactgcaggattcgctggaaaaagtacccagggcgccaaccctgcccgacacccttcaaggatccctgctctgggccgctggccagagacagcagggccagtgtctgctcttgtggcaggctcgggcccagcagtttcagggcacagcaaggtggtatcagcataccaggcaacgacgcatcttcctgtcctggtcccgttgggcaactgcacagtgggcgtggcgagagctagcttcccatagggcatgggacaggacatgtcgcgccgtgctagggttgtggcgccaaaggctgttgcagtcacgtcttgttgaatggtgggctcaagagagggggtggcgccttgcccgggatgccctgtgccattggcactcttgttggcagggccagcagtttctccacgaaaaatgtcagacatgggtacaagtccacctgcaaggccttcaaaaggtggtattccggagttggcagcaggccgcggcccatcagcgctgtaccgtgacacgccctgaacagttgctgctacagtcatattttcaagcttggtgtgaggtcgtgagagacaccggcgtcctgagggcccagcatcaagctttccaggatggcttacgtaggcgggccctcggagcagtgtttgctacttggagggaagctcaggaggtggccgccggagcccaggagcagagggtggctcaggctagtctcgcccgttggcgctcttgtggccagcaggggcaggaagatggccagcaaaagaaagcccgcgcgcctcaggcttttccggcttggccagttgctccaggcatgcaccacgaggctcagcagcaggctggggagtcagctggggcccaggcggctcagtgttggacctggtgttgggcgctgtgggtgcacgagagctgtaggggacaggtgagccgcgctcacgctagctggaagcctcgagcatgggtcctggaagccagcgtgcagtctgccgttcgaggtggagtgcagagagctatactaacacaacttaggccagccgaactacggcggttcttaagaaccgtgcagcttagggtccggcttggactgcccggagccggcaaaactaggtcctgttggacccaggctactgaactggtcccccctgcgccgagcctgcagtgttccctgggcggacgacggaagcccagggggacggcatgggcccagaggtgtagggagcacagtttgtgccccgctttccaactgtggccccagtggccgggacagtcatcttgggtgcccggtctgcccttgtggactcgagatcagggaccccgagcccactcctccccggaacccagggcttgcaaggcccagtctaaggcccacaaacgccgcctgcgcgcccggtcatgccgcatcctggaaaaacaggctcaggcgcacggttccgctctccttctcgccctgaaaggacatgacgctctgggccaccaggaagaggtgcccgctgcaccagttccccgagggactgcctctcgggctgctggcttccccgctggtcaagtgccaggttcaggcatggctgctctggggggatgcccaagagggcgtgccgcaggcgccgacccagcgcagggcgtcgcccccgagatgggcttagctgacgtcgtcgcagcggatcccgcaacggcctcagggtctgcagtcaccgcggcgggcagatgggcattcaaaaagtggcatcaacgactagccgctaggtcgcctaggaggggagcagcatctagccccaggccatggtccaaaccaggtccgaaaggtccagaatcagggcaagaggccgccagagccccccgggggtggggcctcggtgctgaacatggcgcgcagctccagctctag

SEQ ID NO: 44797 - DNA, 732 bp, Artificial Sequence
  Description of Artificial Sequence: Synthetic coding sequence
cggagcgacgccagccacaaggagaacgtgagccccaagcccgccgctctgccgaagcctgagcaaaggaggtttaggcggtccttagggattggtctatcaggaagacatgaccagtgggtgcctggttgccaggtggaaagagggggcccagcggctactccgtctccaggcgctgtgctggaccaggagccttgtcgcgtgcagaccaatctcgcatctcctggcccacgactgggactcgccctgaaggacacaaccggccagctggtgaactcctccttctggcagcagagcaacttgcagagtcttgcccgtagacggcaaggtaaagccagggagttcgcgatccagcagtctaatctttctatcaacgaaacaagctctccccatctgtgcccagagcccggtggcagttccggaccccataagttgccatggggcccactattgtcacaagaacctcttgccagaccctcgtcgtgcctcagacagtctggactgcccgcccctgggactcccagtggcgacttccggccgacagaagcttttgctccgcttgatggccacacccagccaggcctccggagctggggcggccttggaagctggcgatcacggctcgtgggcgagcctttaaccctagaagacctggctgtcccgtcccagaaccaaacacaggccccaagtcgagcagctgttcatcagctcttggcctcgaccttagggtag

SEQ ID NO: 44798 - DNA, 2187 bp, Artificial Sequence
  Description of Artificial Sequence: Synthetic coding sequence
atggagggcgagggcgtgcggaacttcaaggagctgcgggccaagtttcaaaacctggacgccccgccgctccccggcccaattaaattccccgctggcgtttcgccaaaaggggatattgggggaacacagagcacccagattctggctaacggcaaaccactatcatccaaccacaaacagaggactccttattgctcctctagcgagtcccagcctctgcagccacaaaaaataaaactcgctcagaagtctgaaattcccaagtgctcaaattcccccggtcccttaggaaaaagcacagtgtgcagcgcaacctcctcccagaaggcttccctccttctagaggtgacccagtccaacgttgagattattacaaaagagaaagtgatggtggccaatagtttcaggaataagctgtggaactgggagaaagtgtccagccagaagagtgagatgagctcagcattactactggccaactatggtagcaaggccattcatttggagggacagaagggcatggggctgactccagaagagcctcgtaaaaagcttgagacaaagggcgcacagactctgccatcacagaaacacgtggtcgctcctaaaatcctgcacaacgtgagtgaggaccctagcttcgtgataagccaacacatcagaaaatcttgggagaaccctccacccgaacggagtccagctagcagcccatgtcagcctatctatgagtgcgagctggcttctcaggcaccagaaaaacaacctgacgtcaggcatcaccatctccctaagactaaacctctgccatccatcgattcccttggccctcctccaccaaaacctagtcggccacccatcgtaaatctgcaggcctttcagcgacagcctgctgccgtgccgaaaacccaaggggaggttacagtggaagaaggttccctgtctcccgagcgtcttttcaacgctgagttcgaggaacctcacaattacgaggccactatttcttacctgaggcatagcgggaactccattaacctctgcactgcaaaggaaatcgccgaccccacttatgaggtcgggatagaagaactgcagaagcccgggaagaatttcccatatccagaaccgtccgctaagcacgaagataaaaaaatgaaagagaaacagccatgcgagctgaaaccaaagaacaccgagaaggagccatacagcaatcacgtgttcaaggtggatgcctgtgaaggcacacctgagaaaatccagatgacaaatgtgcatactggcaggagaaatatgttagccggtaagcaggaagcaatgattgatatcatccagactaatccatgccccgaagggcctaagctggctagacactcacaggggcactgcggtcacctcgaggtgctggagtctaccaaggagactcccgacctgggcgtttctaagacctccagtatcagtgaagagatatacgacgacgtggagtattctagaaaggaggtcccgaaactgaattattcctcctccctggcgtcctccagtgaagagaacagggagctgtacgaagatgtatacaaaaccaaaaacaattatcccaagatagatctggatggaaaagaagcactgaagaggctgcaacaattcttcaagaaggagaaggacaggtttaagattaaaaagacaaagtctaaggaaaacctctctgcgtttagcatcttacttccagacctggagctgaaatcccaagaagtgatcatttacgatgatgtggacctgtctgaaaaggagtcaaaggacgaagacaagctcaagatgtggaaaccaaagttccttacacctaaagagaagaaagaaaagaatggggcagaggagtccgagagcttttcccctcgcaacttctttaagactaaaaagcagaatctcgagaagaataggatgaaacgcgaagaaaagctattccgggagcggttcaagtacgacaaagagatcatcgtaatcaatacagcagtcgcctgctccaacaatagtcggaatgggatatttgatctgcctatcagccccggtgaggagttggaagttattgacacgaccgagcagaacttggttatatgcagaaatagtaaaggaaaatatgggtatgtgctgatcgagcatctggacttcaagcaccaatcgtggtccccttag

SEQ ID NO: 44799 - DNA, 2091 bp, Artificial Sequence
  Description of Artificial Sequence: Synthetic coding sequence
atgcccacccaggacggccagctgcggcggcccgcccggccccccggccctagagcctggatggaacctagaggaggcggctcctctcagtttagttcttgtccggggcccgcaagtagtggcgatcagatgcagaggctcctgcagggaccagctccgaggcctcccggcgagccccccggctctcccaagagccccggacattcgacaggctcccaaagaccacccgactctcccggcgcaccgcctagatccccctcaagaaagaagcgaagagctgtgggcgccaaggggggcggccataccggcgcaagtgcatctgcccagacaggtagccccctgcttccagcagcatcacccgagacggccaagctcatggctaaagcggggcaggaagagctgggacccggtcccgctggagcacccgagccgggtcctaggtcgcccgtgcaggaagacagaccagggccaggcctgggcctgagtacacctgtgccagtgaccgagcagggcacggatcagatccgtactccccgcagggcaaagcttcacactgtatctacaaccgtatgggaggccctgccggacgtaagtcgtgctaaatccgatatggccgtctcaactccagcgagcgaaccccagccagacagagacatggcggtctcaacacccgcatctgaaccacagtcagaccgcgatatggctgtgtccactccagctagcgaaccacagcctgacaccgacatggccgtatcaacacccgcctcagagccccagccagatagagatatggctgtctcaatcccagctagtaagccacagagcgataccgctgtttccactcctgcaagcgaaccccaatcttccgtggccctgtcaacacctatttcaaaaccacagctcgacacagacgtcgccgtgtccacccctgcctctaagcacggtctggacgtggcattgcctactgccggacccgtggccaagctcgaggtggcttcctctcctcctgtctctgaggcggtgccccgaatgaccgagtcctcgggcctggtgagcacaccagtgcctagggcggatgccgccgggcttgcctggccaccaactcggagagccggccctgacgtggtggagatggaggctgttgtttctgagccctctgctggcgcccctggatgctgttctggagccccggccttgggcctgacccaggtccctcgcaagaaaaaagtccgcttcagcgtggccggcccatccccaaataaaccaggctctggccaggcttcggcccgaccctccgctccacagactgcaacaggcgctcacggcgggcctggggcctgggaggcagtggctgttggtcctcgtcctcaccaaccacgcatcctgaagcacttgcctcgccccccaccatctgcagtaacgcgagtcggcccgggaagttcctttgctgtgaccttgccagaggcctatgaatttttcttctgcgataccattgaggaaaacgaagaggccgaagcggcagctgctgggcaagatccagctggagtccagtggcctgacatgtgtgagtttttctttcccgacgtaggagctcaaaggagtcgccggcgtggcagtcccgagcccctcccacgcgcagacccagtgccagcacccatacctggggatcctgtacccatttcaatcccagaggtgtacgagcacttcttcttcggggaggacaggctggagggcgttctgggcccagccgtcccgcttccactgcaggccttagagcccccacgtagtgcaagcgagggggctggacctggcacgcccctgaaaccagccgtcgtggaaaggctgcatctggcccttcgccgggccggcgaactgcggggaccagtgccttcttttgccttttcacagaatgacatgtgcttggtgtttgtagctttcgccacctgggccgtacgcacatctgaccctcatacacccgacgcctggaaaaccgcactgctggccaatgtaggtaccatttctgctatacggtatttcagacgccaggtgggccagggacggcgcagtcattctccttcaccttcaagttag

SEQ ID NO: 44800 - DNA, 1197 bp, Artificial Sequence
  Description of Artificial Sequence: Synthetic coding sequence
atgccccggcccggccacccccggcccgccagcggccccccccggctgggtccttgggagcggccaacagagttgtgcttagagacttacgacaagccacctcaaccgccaccttctaggaggacacgccgacctgaccccaaagacccagggcatcacggccctgagagcatcacattcatcagcggctccgccgagcctgctcttgagtcccccacttgttgcctgctgtggagaccctgggtgtgggaatggtgtagagcagcattttgttttcgcagatgccgggattgtctccagcgctgtggtgcatgtgtgcgcggatgcagtccatgtctgtctaccgaggacagcaccgagggaaccgccgaggccaactgggctaaggaacacaatggggtgcccccctcccctgatagagctcctccttctagacgtgatggacagaggctaaaatctactatgggctccagtttcagttacccagacgtgaaacttaaagggatccctgtgtacccctaccccagggccacatccccagccccagacgccgattcttgctgtaaggagccgctggctgacccacctcccatgagacattctctgccttccacatttgccagttcaccccgaggttccgaggagtattactcctttcacgaatccgacctggatctgcctgaaatggggagtggatcaatgtcatcacgggagattgatgtgctgatctttaaaaaattaactgagctatttagcgttcatcagatagatgagctggccaagtgcacgtcagataccgtgtttctcgagaaaacatctaaaatcagcgacttaatctctagtataacccaggactatcatctggacgagcaagacgccgaaggacgactcgtgaggggcatcatcagaatcagcactcgaaagagcagagccaggccacagacctctgaaggccgctcaaccagggctgctgcccctaccgctgctgcccccgactcaggccacgagacaatggtgggttcaggcctgtcccaggacgagctcacagtccagattagccaggaaacgactgccgatgcaattgcaaggaagctgcgcccgtatggggcacctgggtacccagcgagccacgactcctcttttcaggggactgacacagactcatccggggctccgctgctacaagtctattgctag

SEQ ID NO: 44801 - DNA, 624 bp, Artificial Sequence
  Description of Artificial Sequence: Synthetic coding sequence
atgccccggcccggccacccccggcccgccagcggccccccccggttaggtccttgggagcggcccacagaactgtgcctggaaacctatgacaaacccccccagccaccaccctctcgacggactcgaaggccggaccctaaagaccctgggcaccatggaccagagtcaattactttcatcagtggatcagccgaacccgctcttgaatctcctacttgccttttgcgcactccactgagaggtcttctgaaaccgacagggccaagatccacaatggagtgtccgccagcactaattgtgcaccccccagcaggcggcatggcaagtggatcctcccagccttgggcggctgcttcagctactccaatgctgtcaagtaaagccagtctatgcatcccaactcgggggccaccacctcaacctctgatgagaactcctgccgcccggagccattggcctatcccccatccctgcgacacagcatgccccgcacccttacccgtcgttctggtcgcccctcggtccactatcctcagtatgagtcgaacatggacttgtcgtagatgggccgtggctccatgtcgcgccgaaaaactgatgtgcagctctagtcggagttag

SEQ ID NO: 44802 - DNA, 4593 bp, Artificial Sequence
  Description of Artificial Sequence: Synthetic coding sequence
atgagccacagccaccccgccggcctgctggccgcctacaacagcctcatggacaagcacctcgctggctactttaacaatacacgaatacgccgccatctgttgaggtctgggctgatcactaggagtggccgaatcctgtctgagaaggagtataagcttaatatgatgaaaagggatcatcagaagtatataagagaatgcttggcgcaggcaattttccataaagtgctggacatggagagatatcaccagctggaaatcaaaaagaagcttgagactctggccaggaaagagaggatccaacggttcaagggtgagcacacgcgccgatctgtggagaataacatgcccattctgtcgcctcaccctcctgttggccctaagagcaatagagggcactccgttttagtggatgaaggacacagctcacctctcgcactcactgctccacgcccgtacacagccccaggcaatatgcagcctcccataagactacagcctttaccaagtaatcctgccgtggaaactgtgccaaaggtcaccagccggtcacggagtaagacaagcctgttggagaatgaggccctgtttcccatcggtggcaaaaaggccgtgatgaagttccgaaactccataggaaattcacagaggatgaactcttaccagctgcctaatatcaatagttacatgatgcccatccccccccctctcccacccactggcaagattactcgggagaatagaagtgaaacatggagaaggcgccgattcagaccaactacagcaccaaacgggttggaaccactgctcaccaaggactccaggagaatacataaaacaagcctccactctaatgcagcgatcactatgatttacctgggcaagaatgtccacctgtcctccgataacccggatttcagggacgaaatcaaggtgtaccagcaacattgcgggggagaaaacctctgcgtctacaaaggcaagttgctggaaaaagaaacttttcaattcatctcaaaaagacatcatggatttcccttcagcctcacctttttcctcaacggcatgcaggtgaatagactatcgtcgtgttgtgagtataaacatcggaaaggatcacggctcggtggaaagcgcggctacttcggatttgtgtgtgtggagagatccagtccatgctataagtgcattatcgccatgggcttggataagaaacctagtctccccaagtcccgcaaagagaagtccactgagaagggtgaagagctgaaaaaggcagaaggcaaagttcgaaaggaaagagagtacgtcatcccaaaacgcaacgagatcaaagagaacaaaacatccgtaagcgccaagttcagtgctcaagagattaagaccgggctcaaggaagtagtgacggccgtggaagaaatgacatctaaggggaagccaggacaggaagttctcgaggacgaccaggagaatactctaaaatacgaatacgaagaggactttgaggttgacgaagagaagcaaggggaaaagagcaatgaagagggtcaagccgatgtacaaatgaacggcatcccacagagtcctcttgacgacaagaaggacaatttggatcccgagaaagagtccgagacgtcctcacaaaaggcgcccgatgcaagggacaatgtgaaggacgagaacgacggctgttcagaatccgagctcgaggaagacaaacaagacatgaagaccgcatctagtacctcctctcgatcccatccatactccagcgactctgaggatgagtctgccgtgggcgaccgagaggctcacacagactcctccacggacgaatccgcgagacgaagttcctcgcaggagttatccgaaaatgataaacctcggaagagtcaccttcccattgaagaatccctggaaattgagattgaggaccaggagattaccaaggcagacgtggagaccaagcccatgccgatagacgaatccttcgagaatgtgcttaaagagggtactgagaaaggaacccaggaaatcgcagagggcctgtcagaaaagtcaggaaaacacgtttccgcagaggaaaaagagaaggataaatccaaactctgggaagaatccaccgctcaagtgaaagacaagaaggccggcctgcccggattggaagagggcggcaaggactcgttgccactcgcttatgtgctcgcactgggtgcccctacaatgaacttcatggttgacgagaccgccgccataaactcaaacaaggagtcccagcagctagtgcaaaagacgtacactcttgaaaaaaaggaagccatggaggaagacgaggcaccgcagcatcgtgatgcagacatagtgcagggtaaaggcgaggccgccttatggggcgaagccggtgccgtgcacgaagccccactgagggcctggaagcctaccgccgaacagcctgaacttgctgaggagtttacagagaaacgggaaatcccacctggtattgagcggggcgctgaaggggccgccgaggccgagggcgtgcggcgattaggtgaggggggatcggatcctatcggtcaggccgcagcaaaggacgctgttggcttgagtaaagacgaggcccctgagaagcaggctctgatgctcaccgtcttggaaaccgataaagccgcctctgaaggagagcaaggactggagaaggctgttctcgcgaatgaagctgccgcattgaacctagagcacctgcacgaagtggcagcattacgggaggcagccacatctgaagaaggggaggcagaaggaggtgtcgcggtgagtgatgtgggggagtccgaggaagaggcatctattgatctcgaagacactgggcctatggaggacaccgcctccaagcgcgaggacgggagtgaagaggcaattctggggggagaggaacccgctaaggaaaggaaagaagtgatgaggactgagacacggctgtcgccatttaccggggaggccgaggctagccggatgcaagtcagtgaagggtcccccgaagaggggagcttggccaaagaggccttcctctgcaaagaggatgtggagggtgaggaaatggtcaccgaggctgaagccaatagggaagacgaccgcaaagaaattctcccaaaagaactggacctggcccgggaacgccgtaaagcagagaggcccaaaacatccttacgaaagactgacagcgagcgagaagaggtcactcgggccaatgccctgaaagacgaggatgccttcaaggaggaacagaaactcaaagcggaagaaggagagacagaaactgaggtccgggccgaggaggaaacaaaggctcctccgaatgaaatggggagcgatgcagaaaatgaggctcccgttgaggcatccgagctttcggacaacccggggctccttggggaagatagcctaaaagagacggttgtgccaattttcgaagccacacctggcttcgaaaagtcattagagaacatcaccgccctcaggaaggaaggaggaggtgagagactgtcagaagcacgagatacagagcacaaggatcgggaggaactaagctcacgcgagaacagggctctgaaggaaggccatagacaggacggcgagggtgctctggctgcaccggaggctgaacccgcagggaaggtccaggcccccgagggccttattcctgccaccgggcaagccgaggaacttgcggctaaggatcatgattcttgtgcagggctcgaggggagggccgaaggacagggtggggtcgacgtggttctccggactcaggaagctgtggccgaggaagaccccataatggccgaaaagttcagggaagaagcggtcgatgaggacccagaagaggaggaagataaggagtgcacattggaaacagaggccatgcaggaccggaatagcgaaggggacggagacatggagggagagggcaatacccaaaagaatgaaggcatgggcggcggacgggtggttgcagttgaagtgctgcacggggggggggagaccgctgagacagcagctgaagagagagaggttcttgctggctcagagactgcagaagagaaaactatcgccaacaaagcgagcagcttcagtgacgtggctgaggaggagacctggcaccagcaagacgagttagtggggaagaccgccgctgccggcaaggtcgttgtggaggagctggcacgctccggggaggaggtgcctgccgccgaagaaatgacagtcacctatactaccgaagctggggttggcacgccaggcgctctggaacggaagacttctgggttggggcaggaacaggaggagggctcggaggggcaggaggctgccaccggatccggcgacggacgccaagaaacgggtgcggctgagaagttccgacttggcctgtcaagagaaggcgagcgcgaactctccccagaatccctgcaggccatggccaccctccctgtaaagccagacttcacggagacacgagaaaaacaacaacacatggtgcaaggggaatccgaaacggcagacgtgagtccaaacaatgtccaagtgtag

SEQ ID NO: 44803 - DNA, 1602 bp, Artificial Sequence
  Description of Artificial Sequence: Synthetic coding sequence
atgctggccaagggcaagaaggccgtgatgaagttccggaacagcatcggcaactcccagagaatgaattcttatcagctcccaaatatcaacagctacatgatgcccatccctcccccactgccgcctaccgggaagattacacgggaaaaccggagcgaaacttggcgccgcagacgctttagaccaacgacggcacctaatggccttgagccgctactgacaaaggactcccggcggatccataagactagtttgcactctaatgccgctatcaccatgatatatctcggcaagaatgttcacctgtcaagcgataaccctgacttccgcgatgaaatcaaagtctaccagcaacactgcggcggcgagaatctgtgcgtctacaaaggcaagcttttggaaaaggagacctttcagttcattagtaagaggcatcatgggtttcctttctccctcacattctttttaaatgggatgcaggtaaatcgtctaagcagttgctgtgagtacaagcaccggaaaggaagccggctcggcgggaaacgaggttattttggcttcgtgtgtgtcgagcgctctagcccctgctataagtgtatcatcgctatgggattggataaaaaaccaagcctgcctaagtcgcggaaggaaaaaagtaccgaaaaaggggaagagcttaaaaaagctgaaggcaaggtgagaaaagagcgggagtacgtgataccaaaacgtaacgagattaaggagaataagacctcagtgtccgcaaagttctctgcccaggaaatcaagacaggattgaaggaagtggttacagccgtggaagaaatgacttccaaaggcaagccgggacaagaggtgctggaggatgaccaggagaatacccttaaatacgaatacgaggaagacttcgaagtggacgaggaaaagcagggcgaaaaatccaacgaggaagggcaagcagacgtccaaatgaatggcataccccagtcaccattagacgataagaaggacaacctagaccctgaaaaggagtctgaaacatcctcgcagaaggctcctgacgcccgagataatgtcaaggatgagaacgacggatgttccgagagtgagctcgaagaagataagcaggatatgaagacggctagttctactagttctcggagtcatccatactcctctgacagcgaggacgagagcgctgtaggggatcgggaggctcacactgactcctcaacagatgaaagcgcgcgcaggagcagctctcaggagcttagcgagaacgataagcctaggaaaagccacctgcccatcgaagagagcctcgaaattgagatcgaagatcaggagatcacaaaagccgacgtggagactaagccgatgcctatagatgaatcttttgagaacgtgctcaaggaaggtacagaaaaaggcactcaggaaatcgcagaaggcctctccgagaagtccgggaagcatgtatctgccgaggagaaggagaaagataagtccaaactttgggaggaatccaccgcacaggtgaaggataaaaaggcgggtctgcccgggttagaggagggtggcaaatacggccgctag

SEQ ID NO: 44804 - DNA, 732 bp, Artificial Sequence
  Description of Artificial Sequence: Synthetic coding sequence
atgcggagccggaagctgaccggcgccgtgcggagcagcgcccggctcaaagctcgctcttgttccgctgccagacttgctagtgcccaagaagtggccgggagtacaagtgccaagaccgcttgtctgacgtcgagttcccataaagccactgatacccgcaccagcaagaagtttaagtgcgacaaaggtcatctagtgaagagcgaactccaaaagctggttccgaaaaatgacagcgcaagcctgcctaaagtcactcccgaaacaccctgcgaaaacgaatttgctgaaggcagcgccttgttgccagggtccgaggctggcgtctctgtacagcagggggccgcctctctgccactaggtggatgtcgggtggtgtccgacagtcgactggccaaaacaagggacggacttagcgttcccaaacattccgcagggtccggagccgaagagagtaactccagttcgaccgtgcaaaagcaaaacgaaccagggctccagacggaggacgtgcagaagcctcccctgcagatggacaattcagtattcttggacgacgatagtaatcagccaatgccagtaagtaggttttttggcaacgtcgagttaatgcaggacttgccacctgcttcctcttcatgtcccagcatgagcagaagagagtttagaaagatgcatttccgcgcaaaggacgacgacgatgatgacgacgatgacgctgagatgtag

SEQ ID NO: 44805 - DNA, 1245 bp, Artificial Sequence
  Description of Artificial Sequence: Synthetic coding sequence
atgcgggagagccaggacgccgccggcgcccacggctggaaccgggttggatcaaccgccacaaaatggtttaccggagccccctttggagtgcagagccaccgatttgatattagcgccgtttaccctaattggaagaaattttcaacattcacggaggccccatactctaccagatactcaacccaagtatcccacattgggccgggcacttattcttccaaggaaacctgtttctccaaaaagaaattaatgaaggaggtggacacgggatgggcgaaagcccaggaagctactcggctcacacaactacctcatttccagtaccaagcaatcatgaaggaaaaaaggctgaaggaacagaagctggggccaggatcttacaaccttaaggacttccttgagcagctccgcgagaagccatgcagcacccgtggactgctttcctcaggcgaggtgcgatttaggggtctaacggggaattactacccagggccgggtaattacggagagaaaggcaacccatacacaaaactggaagagaacgcatggaataggtcccactccgagggcctgatgtgtaggatgtctaacaaaccacatcctcgaccataccaaggatccggactcggccccggcacatacttcttcaaatcagacctggagacatatgtagctagaagtgtcggcacaagaggcccgtacgacacgttctctggggacagaagcaagcccctaccatacggccattacagtatgcagaagaaaaagccccgggagctgatgaatttcaagagttttgtggaggagcttaatagccaccataataagaagcatggggtcttctctaagttgccccggaatccgaagactcctaccgagagaatctactgggccaacctgtcccagtgcccacgaacactggccacatctgggcccagcttctggctgccccaagaaaaaaagtgcaagccggtaaaccaacccccattcttgttgacatccaagggaagcggagccaaggcctgtcagatgattatgggatcctggaatccagtgggggtgggaaggtacctaaacacttggctaatggagactaaggatagaaggcagagatatcgctcccttttcttgagtggaagtaagagatacctgagcgacctggctcgagacatgctgatgcagattagactgttttgttggaaggggcttgaggtgataaactttgggctcagccccatgtag

SEQ ID NO: 44806 - DNA, 1257 bp, Artificial Sequence
  Description of Artificial Sequence: Synthetic coding sequence
atgcgggagagccaggacgccgccggcgcccacggctggaaccgggttgggtcaacagctactaagtggtttacaggagccccattcggagtgcagagccacagattcgatatctccgccgtgtacccaaattggaaaaaatttagtactttcacggaggcaccctattctacccgttactcaactcaagtgagtcacatcggcccaggcacttattcttctaaagaaacctgcttcagcaaaaaaaaacttatgaaagaggtagacactgggtgggctaaagcacaagaggctaccagattgacgcagttgccacacttccagtaccaggccattatgaaagagaagcggctgaaagagcaaaagctcggtcccggttcgtataacctcaaagatttcctggaacagttgcgagagaaaccttgcagcactcgtggacttctgtcctctggggaagtccggttcagaggactgaccggaaattattacccaggtcccggaaactatggcgagaagggaaacccatatactaagttagaggagaacgcctggaaccgaagccactctgaagggctgatgtgcagaatgagtaacaagccacatccgaggccttaccaaggaagcgggctgggccctggaacatatttctttaaatctgaccttgagacctacgtagctcggagtgttggaactcggggtccctatgacacattcagtggggatcggtccaagcctctgccatacggccactattcaatgcaaaagaaaaagcctcgagaacttatgaactttaaatctttcgtggaggagctgaacagccaccataacaaaaagcacggggtgttcagcaagctgccgcggaacccgaaaactcccacagagagaatttactgggccaacctcagccagtgtccccgcactctggcaacctccggcccctctttctggctgccacaggagaaaaagtgcaaacctgtgaaccaaccaccattcctattaacctctaagggtagcggggccaaggcctgccagatgattatggggagttggaaccccgtaggagtcggtagatacctaaatacttggttaatggagacaaaagacagacgccagagataccggagcctatttctttcagggagtaaaagatacttgtcagatctggcccgagacatgttaatgcaggaacgcattacccctttcactaagggaaagtgtcctccaaccgttgactataattccgaccctacaccctag

SEQ ID NO: 44807 - DNA, 372 bp, Artificial Sequence
  Description of Artificial Sequence: Synthetic coding sequence
atgctgggccccaacgcccaggtgaccgtggtggtggcccagcccggcccggaccacttggaccatctcctgctcgacacccagcactgtcagcattcatcgtgtggatcggctgcctgtacccagctgacttgggtcccctgcctggggggttcacataaagccagcatcaaaatgtctgctcaggccgtggtttctactgaagccccttgggaacggccttgtttccaggcacacctggggtgtctgcagaatagtgtcctgtgctcatgcagaatggagggattcagtctcttcctcgcaatgctatggggcggcgtcggggagctgccatctgatccgcgaggccatcttcagttcctcgctacctag

SEQ ID NO: 44808 - DNA, 372 bp, Artificial Sequence
  Description of Artificial Sequence: Synthetic coding sequence
atgctgggccccaacgcccaggtgaccgtggtggtggcccagcccgggccggatcacctggatcacctgcttctggatacacaacactgccagcactcaagttgcgggagcgcggcatgtacccagctgacctgggtgccatgtctcggaggcagccataaagcttcaattaaaatgagcgcacaggccgtagtgtccaccgaggccccctgggagcggccctgtttccaggcccacctggggtgcctccaaaactctgtgttgtgttcctgtcggatggagggattttcgctgttcctcgccatgctgtggggcggtgtaggggagctgccatcagacccgcgagggcatctgcaatttcttgccacctag

SEQ ID NO: 44809 - DNA, 306 bp, Artificial Sequence
  Description of Artificial Sequence: Synthetic coding sequence
atgagcgtggagaagatgaccaaggtggaggagagcttccagaaggctatgggactgaaaaaaactgtcgacagatggagaaacagccacactcattgtctctggcaaatggcactgggacagcggaggaacccatatgccactctgagaatgcaggataccatggtccaggagctcgcgctggccaagaaacagctgctcatggttagacaggctgccctgcatcagctgttcgagaaggagcaccaacagtaccaacaagaacttaatcagatgggaaaggctttttatgtggagcgcttctag

SEQ ID NO: 44810 - DNA, 534 bp, Artificial Sequence
  Description of Artificial Sequence: Synthetic coding sequence
atggccaccaactacagcgccaaccagtacgagaaggccttcagcagcaaatacctccagaactggagccccactaaaccaacaaaagaatcaatttcctctcacgagggatacacgcagatcatcgcaaatgatagagggcacctgttgccctccgtgccccggtccaaggctaatccatggggctcatttatgggcacctggcagatgcctctgaagattccccctgctcgagttacccttacctctcgaaccacggccggcgccgcatccttgactaagtggattcaaaagaatcccgacctactgaaggcaagcaacggtctgtgcccagagattcttggaaaaccccacgaccctgactctcaaaagaagctgagaaaaaagagtatcaccaagaccgtacaacaggccaggagtcccacaattattccatcctctcctgccgcaaaccttaatagccccgatgagttacagtccagtcaccccagtgccggccacacgccaggcccgcagcgtcctgcaaaaagctag

SEQ ID NO: 44811 - DNA, 510 bp, Artificial Sequence
  Description of Artificial Sequence: Synthetic coding sequence
atgccccccacccgggaccccttccagcagcccaccctggacaacgacgactcatatctgggtgaattgcgggcgagcaagaagctcccttacaagaaccccactcacctcgcccagcaacaggagccgtggtctcgactgaactcaacacccaccattacatccatgcgcagggatgcatactactttgaccccgagattcccaaggatgaccttgatttcagactcgcggctctctataatcatcacacagggacatttaagaataaatcagagattctgctcaatcagaaaactacacaggatacctaccgaactaagattcagttccctggcgaatttcttactccccctacaccaccaattacttttcttgccaacatcaggcactggattaaccctaagaaagagtccattcacagtatccaaggcagtatcgtctcgcctcatacagcagccaccaacggtgggtatagccgaaaaaaagacggtggtttcttctctacttag

SEQ ID NO: 44812 - DNA, 474 bp, Artificial Sequence
  Description of Artificial Sequence: Synthetic coding sequence
atggagcggagccccagccggcggcggcggctggaggaggcccccaagttgccatacaagaaccccacgcaccttgcccagcagcaagaaccatggtcacgactcaactcgacacccaccattactagcatgcggcgagatgcttactactttgaccctgagatacccaaagacgacctggactttagattagcggcattgtataatcatcacacaggcacattcaagaacaaaagcgagattctgttgaaccaaaaaacgacgcaggacacgtacaggacaaagatccaatttcctggggaattcctcactccgcccaccccacccataactttcctagccaacattaggcactggattaacccaaaaaaggagagcatccactcaattcagggaagcattgtgagcccgcacaccgctgcaacgaatggcgggtacagcagaaaaaaggacggaggtttttttagcacatag

SEQ ID NO: 44813 - DNA, 381 bp, Artificial Sequence
  Description of Artificial Sequence: Synthetic coding sequence
atgcccagcagcaccctgacctgcaagcccttcgacctgaagcagaggtcctcgaggagaggcccgaagtcgaccgcctcagcttcgccgcgcagctgtttgaagccgtcttgtggaaaacaggtgtgtctcctgctgagtgtgcgtcggtctcagtctctcgctcaccccggccgagactctacacgggtgctcagctatcagcagacctcttcagacgctgtgagtcagtataaacacaccggaaaggttgaagaactttacggtctgaggctttcttggctttcacaggcacagtttctgctggcacaggacaaaacggcctacgctgtcaaaagtgttgtgctgcctgcctctaaccacaagaccaaagggcagtag

SEQ ID NO: 44814 - DNA, 216 bp, Artificial Sequence
  Description of Artificial Sequence: Synthetic coding sequence
atgcccagcagcaccctgacctgcaagcccttcgacctgaagcagcgctcatcaagaagaggccctaagagcacggcctctgccagcccgaggtcctggattctgtctcagaatccaaaggcccaatcttcccacgaaaagacctcaggcaagccaaagtttcgagaagttcttcagaatactaaccagtactcaagcaaattcagcaggtcctag

SEQ ID NO: 44815 - DNA, 282 bp, Artificial Sequence
  Description of Artificial Sequence: Synthetic coding sequence
atgaccaacaccaaggaccccaagcgggccatggagagcaccctggccacttcaaactctgccactggacctgtcaccttcagtcatgtgtttggtcagcagtgccagctgatgcaggctgcggtccaatccctgcacaccctaaatgatcagatttcacattttattgtgaccaagtcaaaagctctggaggaagacaaagatccctttttgccgaccgaaaaggagaccttgaagtcttccatgatactcatgcggcacctgcttatggacgcccaatag

SEQ ID NO: 44816 - DNA, 984 bp, Artificial Sequence
  Description of Artificial Sequence: Synthetic coding sequence
atggccagcatggccgccgccatcgccgccagccggagcgccgtgatgagtggtaacaggcctttggatgatcgtgaaagaaagcgattcacatacttcagctcactatcccccatggctcggaaaatcatgcaggacaaggagaagatcagagagaagtatggacccgaatgggctcgcctgccaccggctcaacaggatgaaatcatcgaccgatgtctcgtgggaccacgagccccagctcctcgggacccgggagactctgaggagttgaccaggttcccaggactgaggggacccacggggcagaaagtggtgcgcttcggtgacgaggacctcacttggcaggacgaacactcagctccatttagttgggaaacgaagtcacagatggaattctcgatatctgccctgagtatccaggagccaagcaatggcactgcagcttctgaacctcgcccattgagcaaagccagccaagggtcccaagctttaaagagtagccaaggctcaagaagcagtagtttggatgcattaggtccaacccgcaaagaggaggaggcttccttctggaagatcaatgccgagcgaagccggggcgaaggtcctgaagcggagtttcagagcctgactcctagccagatcaagagtatggaaaaaggggaaaaagtgctacccccctgctaccggcaggaacccgctccaaaagatagagaggcaaaggtagagcgtccatctaccctccgccaggaacagagacctctgcctaacgtgtccacagagcgggagcggccacagccagtgcaggctttcagtagcgcactgcacgaggccgccccatctcagctggagggcaagctgccctcgcccgatgtgagacaagacgatggggaagacactctcttctctgagcctaagtttgcacaggttagtagttccaatgtggtgttgaagactgggttcgatttcctggataattggtag

SEQ ID NO: 44817 - DNA, 870 bp, Artificial Sequence
  Description of Artificial Sequence: Synthetic coding sequence
atggcccggaagatcatgcaggacaaggagaagatccgggagaagtatgggcctgaatgggctcgcctgcctcctgcgcagcaggatgaaatcatagatcgctgcctggtcggccccagagcccccgcccccagagatcccggggactccgaagagttgactagattcccaggactgaggggacctaccggccaaaaagttgtacgcttcggcgatgaggacctcacgtggcaagacgagcattccgcaccattcagttgggagactaaaagtcagatggagtttagcatcagcgctttgtctattcaggagccttctaacggcacggcagccagcgagccaaggccccttagcaaagcttcccaggggtcccaagctttgaagtcttctcagggctcaagatctagcagcctggacgcgctcggtccaacgcgcaaggaagaggaggcctcattctggaagattaacgccgagcgatcgcggggagaagggccggaggctgagtttcagagtctcacaccctcacaaattaaaagcatggaaaagggggagaaagtgcttcctccgtgctataggcaagagcccgcccccaaggacagggaggcaaaggtagaacgcccctccaccctacgccaagaacagaggcccctgccaaacgtatctactgaacgtgagcgccctcaacccgtgcaagccttcagttcagccttgcacgaggccgcccctagtcagttggaagggaaactccccagcccagacgtgaggcaggacgacggcgaagatactcttttcagcgagccgaaattcgcacaggtgagtagtagcaacgtggtcttgaaaacagggttcgacttcctcgacaattggtag

SEQ ID NO: 44818 - DNA, 594 bp, Artificial Sequence
  Description of Artificial Sequence: Synthetic coding sequence
atggagttcagcatcagcgccctgagcatccaggagcccagcaacggcactgctgctagtgagccacgtcccctgtccaaagcctctcagggcagtcaggctttgaagtcttctcagggatctcgtagctcttccttagatgcgctgggccctacacgcaaagaggaggaggcatctttctggaaaataaacgcagaaagatctaggggggaaggacccgaggctgagtttcagtcgctcactccgtcacagattaaatccatggagaaaggcgaaaaggtgctgcccccatgttatagacaggagccggctcccaaggacagggaggctaaggtcgagagaccctctacactccggcaggagcagaggcctctcccaaatgtatcaacagaaagagaaaggcctcaaccagtgcaggccttttcctctgccctgcacgaagccgcaccaagtcagcttgagggaaaactgccgtcccctgacgtcagacaagacgatggcgaggacaccctctttagcgaacccaagtttgctcaagtctcctcttcaaatgttgtgctgaaaaccggatttgacttcctggacaattggtag

SEQ ID NO: 44819 - DNA, 504 bp, Artificial Sequence
  Description of Artificial Sequence: Synthetic coding sequence
atgcccagccagagcgcctgccccgtgctgagcaccgcccccggcacaccgtgcgacttgagaaagcacctgcttaacatggtgtctgaggagaagcgaagcccgcaactcagcgcaaaaacttggcgcaggggcctacgtctccagaaacggcgtaatgccctgtttctcccagaaggagacatctgcgtggtgggcagtaccagcggggcccgggctttgatccccgagacgtcaaaactggagaggagcggaaccgtaattgcctactgcaatctggaattgttggcttcatccgatccccctgtgtgggcaagccagtccactggaatgacagggatgagctaccgatctcagccccagctggggttcaaatcaactcctccagcccacagttctgtatttcaccattctgtgaaagccccaaaagaggatcaggcacaggaggctgcttcgcgcccacttacctcccaggacgggtggaatcctaatattaagaagtag

SEQ ID NO: 44820 - DNA, 864 bp, Artificial Sequence
  Description of Artificial Sequence: Synthetic coding sequence
atgaacgccctggccaacatccccgacgtgcccgtgaagtaccggaagaacgacataccagggcccggtttctacaacgttatccaccagtcaccagtgtctaactccgtttccctgagtaagaagggcacttgcatgttcccatctatgtgcgcgcgtctcgataccatcatctcaaagtacccggcagcaaatgcctatacaatccccagcgattttatttcaaagagggacttctcaaacagttgttcctccatgttccagctgccgtctttcatgaaggcgctgaagtttgagactcctgcccccaactattacaacgccagtgttagctgctgcaagcaacgtaacaacgtttgcacgagagctgggtttatgagcaagacacaaaggggttcctttgcttttgccgataaaggaccacctccagggcattacgacatcaacgagtcacttgttaagcagtctccgaacaccctgatgagctgttttaaaagcaagacaaaccggggtctgaagctcactagcactggacctggcccagggtattataacccctctgattgcaccaaggtccccaagaagaccctatttcccaagaaccccatcctcaatttttcagcccagcccagtcccctcccgccaaaaccgcccttcccaggtccaggtcaatatgaaatagttgattaccttggcccccgcaaacactttatctcatctgcctctttcgtatctaacacatctaggtggactgctgctcctccacagccaggcctgccagggccagcaacttacaagcccgagcttccgggtaagcagagtttcctgtataacgaagataagaagtggatcccagttctgtag

SEQ ID NO: 44821 - DNA, 1005 bp, Artificial Sequence
  Description of Artificial Sequence: Synthetic coding sequence
atggacaacagcgcccagaagaacgagcggaccggcaagcaccccagacgcgcctctgaggtccagaaaggctttacagccgcgtacccaactcagagttcaatccctttcaagtcccaggcatccgttatcccagaatccgagaaaaaaggttttaactcacaggctaagcgtttcccacacaagaagaatgacattcctggcccggggttttataacgtcatccaccagtctccagtgtccaattccgttagcctctctaagaaaggtacttgcatgttccctagcatgtgcgctaggctcgatacaattatttctaaataccccgcagccaacgcctatacaatcccttctgatttcatctccaagcgtgatttctccaattcttgttctagtatgtttcagctcccaagctttatgaaggcgttgaaattcgaaactccggcccctaattattacaatgctagcgtgagttgctgcaagcagcgcaacaatgtctgcacacgggctggatttatgagtaagactcagcgcggcagcttcgccttcgccgataagggacctccacctggacattacgacatcaatgaaagtctagtgaagcagtcaccgaacacactgatgagctgtttcaaaagtaagacaaaccgggggttgaaactgaccagtacaggcccaggaccaggctattataatcctagcgattgtactaaggtgcctaagaaaactctatttccaaaaaaccccatcctgaacttttctgcccaaccaagtcccctgcccccaaagccaccgttcccaggccctggccagtatgaaatcgttgattacctgggccccaggaagcatttcatctcctctgcttctttcgtgagtaatacatcaagatggacggcagctcctccacagcccggattgcccggacctgctacctataaacccgaactcccaggaaagcagtcgtttctgtacaacgaggacaagaaatggatccccgtgctctag

SEQ ID NO: 44822 - DNA, 510 bp, Artificial Sequence
  Description of Artificial Sequence: Synthetic coding sequence
atgtgcgcccggctggacaccatcatcagcaagtaccccgccgccaacgcctacacaatcccgtccgattttatttccaagagagattttagcaattcttgcagctctatgtttcagctgccatcattcatgaaagccctaaaattcgaaacacctgcaccaaattactacaacgcttctgtgagctgttgtaagcagcggaacaacgtatgcacccgggctggcttcatgagcaaaacccagcgggggtcctttgcctttgccgacaaaggccctccgcctggccattatgacataaacgagtccttggtgaaacagagccccaacacactgatgagttgtttcaagtcaaaaaccaaccgagggttgaagttgacatctactgggcccgggcctggttattataacccgtctgactgcacaaaggtccctaagaagactctcttcccaggcggatcgaaggcttctgatctcgctggccacctgcctaagagcactcaacccacctag

SEQ ID NO: 44823 - DNA, 1005 bp, Artificial Sequence
  Description of Artificial Sequence: Synthetic coding sequence
atggacaacagcgcccagaagaacgagcggaccggcaagcacccccggcgtgccagcgaagtgcagaagggctttaccgctgcttacccaactcagagcagtattcccttcaagtcacaggcctcagtcatccctgaaagcgaaaagaagggttttaattcacaagctaaacggtttccacacaagaagaatgacattccggggccgggcttttataatgtcatccaccaatcccctgtttctaactcggtttccctctccaagaaaggtacgtgtatgtttcccagcatgtgcgcaaggctggacaccatcatttcaaaataccccgcggcaaatgcctatacaattccttctgattttatttccaagagggatttctccaacagctgcagcagtatgttccagctgccaagttttatgaaagcgttgaagtttgaaacacctgctcctaattactataatgcctctgtgtcttgctgcaagcaacgaaataacgtttgtacgagggctgggttcatgtcaaaaactcagaggggatcctttgcatttgccgacaagggacccccccccgggcattacgacatcaacgagagcttagtcaaacagtctcccaatacactcatgtcttgctttaaaagtaagacgaaccgggggctgaagctcacatcgacaggtccaggccccggctactacaatccatctgattgtactaaggtcccaaaaaagactctgtttcccaagaacccaatcctcaattttagcgcccagccctccccccttcctcctaaaccaccattcccagggcctgggcagtacgaaatcgtcgattatttaggaccacgtaagcatttcatttcgagtgccagtttcgtaagcaatacgagtaggtggacagctgccccgccccagcccggactgcctggaccggccacctacaaaccggagctgcctggcaaacaatccttcctgtacaatgaagacaagaagtggatcccagtgttatag

SEQ ID NO: 44824 - DNA, 435 bp, Artificial Sequence
  Description of Artificial Sequence: Synthetic coding sequence
tgattcaccgccgcctaccccacccagagcagcatccccttcaagtctcaggcctcagtaataccagagtctgagaaaaagggctttaatagccaagccaagcgatttccccacaagaagaatgatataccgggccccggattctacaacgtgatccaccaatcccctgtgagtaattcagtgagcctgagtaaaaaaggcacctgcatgttcccttcgatgtgcgctaggttagatacaatcattagtaaataccctgcggcaaatgcatatacaatcccctcagactttataagtaagcgggatttttccaattcctgtagctcgatgtttcagttaccttcttttatgaaagctttgaagttcgagacccctgcccctaattactataatgtgcggactctgccaatgttggcgaagtacaggtcaaattag

SEQ ID NO: 44825 - DNA, 1152 bp, Artificial Sequence
  Description of Artificial Sequence: Synthetic coding sequence
atggacaacagcgcccagaagaacgagcggaccggcaagcaccccaggagggcaagcgaggtccaaaaaggattcacggctgcgtatccaactcagtctagcatcccattcaagagtcaggcgtctgtcattcccgaaagcgaaaaaaagggattcaattcgcaggcaaaaagattcccacataaaaaaaacgatatcccaggtcccggcttctacaatgtgatccaccaatctcctgtttccaacagcgtttctctgagtaaaaaggggacatgtatgtttcccagcatgtgcgctcggttggacactatcattagtaagtaccccgcagcaaacgcatacaccatcccctctgacttcatatctaagagagatttttccaattcctgtagctcaatgttccagctgccttcgttcatgtctaaaactcaacggggctccttcgccttcgccgacaaagggcctccacccggacactacgatatcaacgaaagtctcgtgaagcaatctccaaatacgctgatgagttgtttcaaatctaagactaatagaggcctgaaactcacctccactggtcctggtccaggttattacaacccatccgattgcacaaaggttcccaaaaaaacgttatttccgaaaaaccccatactgaacttttcagcccagccatccccactgccacccaagcccgcctggcctagctatgtgcaggctagagcaagcagaaaagcggttttacctctgcaaagaggacaggagatggaccccggaagtgtgggcatgtcacacaaggtgaaagaaaactcatcacatcagccaacacttcctagtgtcccccgcacctttctgcgtcgccgcccaattatgtccgtggccgcggataacttaggagggggaagcactactcttgcctggcatccgtccaggacggccgccattgcattcgttctttcatggcgccattgttcgttagagactagcccccagcctcaccgcttgcaatggcttcccgagcagaaaggaggtgttgaccgcgccccatggctccttcctcacgctcccatccaagctgcatttcgccatgatagtctgcctcagaccgagggaacgcccgaagcacagacttcaagaaggatttcacctccctag

SEQ ID NO: 44826 - DNA, 507 bp, Artificial Sequence
  Description of Artificial Sequence: Synthetic coding sequence
tgcgcccggctggacaccatcatcagcaagtaccccgccgccaacgcctataccattccctctgatttcatttccaagagagacttttcaaactcctgctcctctatgttccagttgcctagttttatgaaggctctgaaatttgagacaccggcccctaattactataacgcaagtgtatcttgctgcaagcagaggaataatgtctgtacccgggcaggctttatgagcaaaactcaacggggtagtttcgctttcgctgataagggtcccccaccagggcactacgacattaacgagagcctggtcaagcagagcccaaacacccttatgagttgctttaagtcgaagacgaacagagggcttaagctcaccagcactgggccgggacctgggtactataacccttcagattgcaccaaggtgcctaaaaagaccctgtttcccggcgggtccaaggcaagcgacctggccggtcatttacccaagtccactcagccaacgtag

SEQ ID NO: 44827 - DNA, 864 bp, Artificial Sequence
  Description of Artificial Sequence: Synthetic coding sequence
atgaacgccctggccaacatccccgacgtgcccgtgaagtaccggaagaacgacataccaggtccaggtttctacaatgtgatccatcagtctcctgtgagcaattctgtcagcttgagtaaaaagggaacgtgcatgttcccaagcatgtgcgctcgtctggacactatcatctcgaagtacccggccgccaatgcatacaccataccatcagactttatctccaagagggatttctcaaacagttgctcttctatgttccagctcccctcattcatgaaagcgctgaaatttgagaccccggcccctaattattacaacgcttctgtgagctgttgtaagcagaggaataatgtgtgtactcgcgcaggcttcatgtctaagacgcagagaggttctttcgcttttgctgataaaggccctcctccagggcactacgatattaatgagtctctcgtcaaacaatctccgaacactctcatgtcatgcttcaagagcaagactaacagagggctgaagctgacgtcaaccgggcccggccctggctattataacccctcggactgtactaaggtgcccaaaaagacgctgttccccaagaatcccatcttaaacttctcagcccagccctcaccattgccccctaagccccccttccccggaccaggccaatatgagatcgtcgactacctgggacccaggaagcattttatttcatccgccagctttgtgtccaacacaagccgctggaccgcagccccaccccaaccaggactcccgggccctgctacttacaagcctgagttaccaggcaaacagtcttttctctataatgaagacaagaagtggatccccgttctgtag

SEQ ID NO: 44828 - DNA, 708 bp, Artificial Sequence
  Description of Artificial Sequence: Synthetic coding sequence
atgggcatgctggcccccggccccctgcagggccggcggccccggaaaggacataagggtcaggaagatgcggtagctccggggtgtaaagccagcggtcgtggttctagagtgactcacttactcgggtaccctacacagaacgtctcccgcagcttacgccgtaagtacgctccccccccttgtgggggccccgaggacgttgcactggctccctgtacagcggctgctgcatgtgaggccgggccaagccctgtatacgttaaggttaaatcggcagaacccgccgattgtgccgagggcccagtgcaatgcaagaacgggctgctggtctcgagcccacattgtgaagagccctgcgcccatagttgtgctcaccccggtctccctccgcatttggtgcacaaattgcccctgtcttatcttcagactcaggacaccgacgcagcaagtcgccgaattaatgcccctctcgctgctggatggtcatggctgaggctgtggctagtaactctcgcttctggtgtagacttcccacaggtctcagcctggatgcgcgccttgccaagccctgattgtccaggacttcgtacgactggcgaacagatgcaaaagctgctgctgaaggaaaataaggttaaaactagaaagtctaagcgccggagtggagaaggatctcacctgacaaccagcatcttggaacaatag

SEQ ID NO: 44829 - DNA, 366 bp, Artificial Sequence
  Description of Artificial Sequence: Synthetic coding sequence
atgggctgcgccagcgccaagcacgtggccaccgtgcagaacgaggaggaggcacagaaggggaaaaattaccagaacggtgatgtgtttggcgacgagtatcgcataaagcctgtagaggaggtgaaatacatgaaaaatggagccgaagaagaacaaaagattgccgcacgcaaccaggagaaccttgagaaatcggcttcgagtaacgtgagacttaaaactaacaaagaggtgccggggttagtgcaccaaccccgcgccaatatgcacatttcagagtcgcagcaggagttctttagaatgctggacgagaaaatcgagaaaggccgggattactgttctgaggaagaagatatcacctag

SEQ ID NO: 44830 - DNA, 264 bp, Artificial Sequence
  Description of Artificial Sequence: Synthetic coding sequence
accggcaaccaccacagcaccttctgcctgcacgagttcgactacagccggctgctctgcatactggagaaatttctctgcgatacagaaaaatcagcctcatcaaatgtgaggctcaagactaacaaagaggttccgggcctggtgcatcagcctagagcaaatatgcacatctcagaatcacaacaggagttttttagaatgttggatgaaaaaatagagaaaggtcgtgattattgttccgaggaggaagacatcacctag

SEQ ID NO: 44831 - DNA, 279 bp, Artificial Sequence
  Description of Artificial Sequence: Synthetic coding sequence
atgtggcccgtgttctggaccgtggtgcggacctacgccccctacgtaacctttcctgtagcctttgtcgttggggccgtgggctaccatttggagtggtttatccggggaaaagacccacagccagttgaagaggagaagtcgatttccgagagaagggaagaccgaaagctggacgaactcctgggtaaagatcacactcaggtcgtctctctcaaagacaaactggaatttgcccccaaggcagtgcttaatcgcaatcgcccagaaaaaaattag

SEQ ID NO: 44832 - DNA, 279 bp, Artificial Sequence
  Description of Artificial Sequence: Synthetic coding sequence
atgtggcccgtgttctggaccgtggtgcggacctacgccccctacgtaaccttcccagtggcattcgtcgtgggcgccgtgggttaccatctggagtggtttattcgaggtaaggatccccagccagtcgaggaggagaagtcgatctctgagcgccgggaggacagaaaactcgacgaacttctgggcaaagaccatactcaggtggtgtctcttaaggataaactggagtttgcgcctaaggcagtcttgaaccggaacaggcctgagaaaaattag

SEQ ID NO: 44833 - DNA, 279 bp, Artificial Sequence
  Description of Artificial Sequence: Synthetic coding sequence
atgtggcccgtgttctggaccgtggtgcggacctacgccccctacgtgacattccccgtcgcatttgtggtgggtgccgtgggctaccatctggagtggttcatccggggaaaggatcctcagcccgtcgaagaagagaaaagcataagcgaacggcgggaagatagaaaattagacgagctgctgggcaaagaccatacacaagttgttagcttaaaagacaaactcgaatttgctcccaaggccgtgttgaatagaaaccgccctgagaagaactag

SEQ ID NO: 44834 - DNA, 279 bp, Artificial Sequence
  Description of Artificial Sequence: Synthetic coding sequence
atgtggcccgtgttctggaccgtggtgcggacctacgccccctacgttacctttcctgtggcttttgttgtgggcgccgtggggtaccacctcgagtggttcattcggggtaaagatcctcagcctgttgaggaagagaaaagtatcagcgagcgcagggaggatcgcaagcttgacgaacttttggggaaagaccatacacaagtcgtgtccttgaaagacaagttggagttcgctcccaaggccgtgcttaacagaaaccgtccagagaagaactag

SEQ ID NO: 44835 - DNA, 279 bp, Artificial Sequence
  Description of Artificial Sequence: Synthetic coding sequence
atgtggcccgtgttctggaccgtggtgcggacctacgccccctacgtcacgtttcccgtggcattcgtggtgggcgccgtgggctatcatcttgagtggtttatacgcggcaaagacccacaacctgtcgaggaagagaagtccatatccgaaaggagagaagaccgtaaactggatgaactgctgggcaaggatcacactcaggtggtgtcccttaaggataagttagagtttgccccaaaagccgtcctcaaccggaatagacctgagaaaaactag

SEQ ID NO: 44836 - DNA, 381 bp, Artificial Sequence
  Description of Artificial Sequence: Synthetic coding sequence
atgctggccgtgcccgtgcggctgaaggtgggcagccggaagcccgaatggggcacgaaccggttgacctcctgccccgccaaggatccgttagatagaaggttgcaaaacctgcgagatagagagagggtgcctgaacctcagcggtcattgcgacccggagtgcaggaagactcgagagaacacggccaggtcccagaagtcagtgaccctcaagtcgatttggagtttgtggacctgcaagctaaacccagataccgtagactgatactaaagactcagattcctgaagcatcagattctcaggcagcacagaaacctcaggcccatcggcagatccccgagactacagaggcgggacgagaaaccacatccaattag

SEQ ID NO: 44837 - DNA, 690 bp, Artificial Sequence
  Description of Artificial Sequence: Synthetic coding sequence
atgttcgccatccagcccggcctggccgagggcggccagttcctgggggatcccccgccagggctgtgccaacccgagctgcagcctgatagcaatagcaactttatggcctctgccaaagacgctaacgagaactggcacggcatgcctggtagagttgagcccatcctcagaagatcttcgtcagaatctccatctgataatcaggctttccaagctcctggctcccctgaagagggtgtcagatctccccctgagggggctgaaatccccggcgcagaacctgagaaaatgggtggggcagggactgtctgtagtcctctggaggacaatggctacgcctcctcttccctgtctatcgattcccgctcttcaagccccgaacccgcatgtgggacgccccgtggccctggaccgccagatcccctactgccttcagttgctcaggctgtgcagcaccttcaagtgcaggaacgctacaaagagcaggaaaaagaaaagcatcacgtgcacctggtgatgtaccgccgcctggccctgcttcagtggatccgcgggctgcagcatcagctgattgaccagcaagctcgcctgcaggagagctttgacaccatcctggacaataggaaggaattgatcaggtgtcttcagcagcgcgctgctccatccaggcctcaggatcaggcatag

SEQ ID NO: 44838 - DNA, 600 bp, Artificial Sequence
  Description of Artificial Sequence: Synthetic coding sequence
atgttcgccatccagcccggcctggccgagggcggccagttcctgggcgatccacctccaggtttatgtcagcctgagctacagcccgacagcaacagtaacttcatggcttctgcaaaagacgcaaacgagaattggcacggcatgccagggcgagtggaaccaattttgagaaggtctagttccgaaagccctagtgacaaccaggcattccaagcaccggggagccctcttgaggacaatgggtacgcatcatcaagcctctccatagacagccggagcagctcccctgaaccagcttgcggaacaccgagggggccaggccctcccgatcccttattgcctagcgtggcccaggctgtccagcacttacaggtccaggagaggtacaaagagcaagagaaagagaaacaccacgtacatcttgtaatgtacaggcggttggcccttcttcagtggatccgaggtctccagcatcagcttatcgatcaacaggctaggctgcaggagtccttcgacaccatactggacaaccgaaaggaacttatccggtgtctccagcagcgtgccgcaccttcccgaccacaggaccaagcgtag

SEQ ID NO: 44839 - DNA, 321 bp, Artificial Sequence
  Description of Artificial Sequence: Synthetic coding sequence
atgcccgacgcccagttccaccggatcatggccagcgagaagctgtcttttattcgggtacaggaaaacgaatatagtctgaacagcgtccgcgcctccggctttcagagagtgctgaacctcctggaatctagtctgttgtggttgtacctgccaactaccgaaaacctgctttgctcctctcctcgcctgagtggtgatcccacaggctacgccgatcctcctccccagaaccataggaggaggcagagccgatctaccccacgcttacctgggccgggccagctattgtcttccaggaccaggaccctcgaaggttag

SEQ ID NO: 44840 - DNA, 2289 bp, Artificial Sequence
  Description of Artificial Sequence: Synthetic coding sequence
atggaggacgacggcagcctgctgcccgaggacgagctgctggccgatgcactcctgcttgaggatgaaagagacgaacttgaagaccccgaattcgacataaagtgcctgctgcaggaagcagaggacgatgtcgatcccggacactctagctctgtcaaggaattagacactgatgcagataagttgaagaaaaagaccgccgaggatagaacccaggcctttcatctcagacagaatctgtcagccctcgataagatgcacgaagagcaggagttgttcaccgaaaagatgcgcggcgagcttcgcgcttgtcgccagcgccgcgatctgattgataagcaacaagaggctgtggctgcggagattgccacagaggaggaagcaggcaatatggccgccgttggtcggctgcaggctgtctcccgcaggctgttcgcagagctggaaaatgaacgggatctgcagtcaagaaccgaggccgtgctcaaagaatccgagaacacaatgtggcacattgaaatccaggagggcaggctggaggcatttcgcacggccgatcgggaggaggttgaggctactggcagacgactccaggtgagggccgcagagcagctttgcagggagcaagaagcgctgggtaaggtagagcggaaccgcctcctgcgcatccggaagtcactgaatacccagaaggagctgggactcagacaccagaagttgctagaggatgctaggaagaatcacaaggtggcggtgagattcctgaaggcctccctgggacgcatccgcgagcaggaaaagaaggaggagatggagtgtcacgagtatatgaggagacgcatggatgccgtagtggctcttaagggatcgatcagcgccaacagggacacgctgcgaaagttccaagcttgggaccgcgcaaaggctgaactcgccgagcaacgcgtgcaggctgagaagaaggcaatccttgcccagggccgcgacgcatttagacaccttgtacatcagcggaggagacaggaacttgaggcgcagaagcgagccttcgaggaggagcagaagctgcgaaagcaggagatcatctcccgcatcctcaaggaggaagctgaggaggaaaagcggaagaaacagcatccgcccacctccgcacggcatcgcttgactctgcgagataagacttggaactatatctcggacttctgcaagaagactactgtgcctaccaacacgtacacactggattatgaggcagcagcaggtcccgggccatctcgactgttggaagtggtctctagcgagcttatacagggggacccgggggctagctccgaggaggaaacactcgccgaacctgagatcagcggcctgtggaacgaggactataagccgtatcaggttcccaaagaggatgtcgatagaaagcccgtcggaggcactaagatggataaggacattctggaaaggaccgtggagcggctgcggagccgggtggtgcataaacaggttgtgtggggcagagagtttcagggccgtcctttcaacagtaaacctgagttgttgcactttcaggacttcgatatcgggaaggtgtacaagaaaaaaataaccctggtgaataccacttacacaattaactactgcaaattggtaggagtcgaagagcacctgagagatttcattcatgtggattttgaccccccaggaccgctcagtgcggggatgagctgtgaggtgctggttactttcaagcccatgattaataaggacctggagggcaacatctcctttctggctcagacaggcgaatttagcgtaccactcaagtgtagcacaaagaagtgctcactgtctttagataaggagctaatcgatttcggctcttacgtggttggcgagacaacgtcgcgcacaatcacactgaccaacgttggagggctgggcacaacatttaagttcctccctgcctccgagccttgtgaaatggacgatagccagagcgctcttaaactcagcagtctcctgacctacgaggacaagtctctatatgacaaggccgcgacatctttttcagaacagcagctcgaaggcacggagtcctcgcaggccgacatgcagagtcgcaaggagctggagaagctcgataaggagcaggaggaggaacagcctgcaggggagcccggctgccaggccaagcctggctgggctggcggagagggactccgggcggcctttcagggagccgagggcccgagaggcggcctggagtctagggagttttcatag

SEQ ID NO: 44841 - DNA, 306 bp, Artificial Sequence
  Description of Artificial Sequence: Synthetic coding sequence
atggaggacgacggcagcctgctgcccgaggacgagctgctggccgacgcacttctgctggaagacgaaagggacgagctggaagatccagagttcgacataaagtgcctgctgcaggaagccgaggacgatgtggacccaggacacagcagcagcgtcaaggagcttgacactgatgccgataagctcaaaaaaaagacagcggaggacaggactcaggcgtttcatctgagacaaaaccttagcgccctagacaagatgcacgaggaacaagagctgtttaccgagaagatgagcgtaagctag

SEQ ID NO: 44842 - DNA, 516 bp, Artificial Sequence
  Description of Artificial Sequence: Synthetic coding sequence
atgttcgagaacctgaacaccgccctgacccccaagctgcaggccagcagatccttcccccatcttagtaagcccgtggcccccggttccgccccactcggcagcggcgagcctggagggccgggtctgtgggtgggctcctctcaacatctgaagaacctgggcaaggctatgggggccaaagtcaatgacttcctgaggagaaaggaaccatccagcctcgggtctgtcggggtgaccgagatcaacaaaacagcaggcgctcagctggcaagcggaactgacgctgcccctgaagcctggcttgaggacgagcgcagcgtgctccaggaaacgtttcctcggttagatccaccacccccaatcacgcgtaagagaaccccaagggcgctcaagaccacccaagatatgctcatatcatcgcagcccgttctcagttccctggagtacgggacggagccctcacccggccaggctcaggattcagcccccaccgcgcaacccgatgtgccttag

SEQ ID NO: 44843 - DNA, 948 bp, Artificial Sequence
  Description of Artificial Sequence: Synthetic coding sequence
atgctggtgctggtggcccaggccggcggcgacaccctgaaggtgactgggcactatgtgaaatgcgtgttcctgctgtttgtgagccacctgctatctgagccactctccaggacagtagatcatgggatgttcgagaatcttaatactgccttgacacctaaactccaggcttcacgctccttccctcatcttagtaagcctgtcgccccgggcagtgcccctctgggttccggggaacctggaggacccgggctctgggtggggtcttcacaacaccttaaaaacctcggaaaggccatgggcgctaaggtgaatgattttctcaggaggaaggagcctagctctctggggtctgtgggtgtgactgaaattaacaagacagcgggcgcacagttggccagtggaaccgatgccgctcctgaggcttggttagaagacgagagatccgtgttgcaagagacattcccacgcttagatcccccccctcccatcacgaggaagaggactccccgcgccctaaagaccacgcaggacatgctgatttcaagtcagccagtgttaagctctctggaatacggcaccgagccaagccctgggcaggcacaggactctgcccccaccgctcagcccgatgtccctgctgatgcgtctcagccagaagccactatggaacgcgaggagagggggaaagtgctccctaatggcgaggtgagcttatctgtaccagatttaatccataaagactcacaagatgaatctaagctgaaaatgacagaatgcagaagggcatcgtcacccagtctcatagagaggaacggctttaaactgtctctaagccccattagcctcgccgaatcatgggaggacgggtcgccgccacctcaggcacgcacttcatccctggacaatgagggtccacacccggacttgctgtctttcgaatag

SEQ ID NO: 44844 - DNA, 819 bp, Artificial Sequence
  Description of Artificial Sequence: Synthetic coding sequence
atgttcgagaacctgaacaccgccctgacccccaagctgcaggcctctcggagcttcccacacctttctaaaccagtggctcccgggtcagcaccactgggcagcggagagccaggaggacctggactttgggtgggaagcagtcagcatttgaaaaatctgggaaaagccatgggcgccaaagtcaatgactttctgcgccgtaaggagccaagcagcctcgggtctgtaggagtgactgaaatcaacaagactgcaggagcccagctggcgagcggcaccgacgccgcgccagaagcgtggctggaagacgagagatccgtgttacaggagactttccctcgcctggaccctccaccgccaattaccaggaaacgtacacccagagccctaaaaactactcaagacatgctcatcagcagccagcccgtgctgagttccctggagtacggcactgagccgagtcctggacaagctcaggactccgctccaactgcacagcctgatgtacccgcagatgcctcccagcctgaggcaacaatggagcgagaagaaagaggcaaagtgcttcctaatggtgaggtgtcgttgagcgtacccgacttgatacacaaggacagccaggacgagagtaagctgaagatgactgagtgccggagagcttcaagcccatccctcatcgagcgtaatggctttaagctgagcctgagccctataagtctcgccgagtcgtgggaagacgggagcccccctccccaggctagaaccagtagcctcgacaacgagggaccccacccggatctgcttagttttgagtag

SEQ ID NO: 44845 - DNA, 297 bp, Artificial Sequence
  Description of Artificial Sequence: Synthetic coding sequence
atggccagcatcaaccggaccatcgagatcatgaagaagcacggcgtaagcaagcaacacctgctggaagagatcaataagaagcgggagtccaattgtctggtggaacgtagtaatcaggtgtctctgttgagagttcagaagcgccacttcccagacgcgtatcaatcattcaccgataccaccaccaaggaaccggtccctaactctggtcgcagctcatggatcaaactctccctgcttgcccacatggagcgcaagcactttccccccaaaaataatgccatttttggatag

SEQ ID NO: 44846 - DNA, 1323 bp, Artificial Sequence
  Description of Artificial Sequence: Synthetic coding sequence
atgaccagcatcaaggagcaggccgccatcagccggctgctgagcttcctgcaggaatgggacaacgcaggcaaagtggctaggtctcacatactggataaattcattgagaccaaccaggggaagaccgctcccgaacttgaacaggagtttagtcagggcgcgtcactgtttctggtgagactcacaacttctttgcgcattacatacatgaccgattcttgcctggagaagctgttgcggtctattgggatcttcctctctgctgtgagctcaaaccggtacctcattgagttcttggaagtgggcggcgtgcttacactgctggaaattctcgggctcgagaaaattaaggaagaagccaagaaggaaagtgtgaagctgttgcaggtcattgctaatagcggacgaacttataaagagttgatttgcgagagctacggagtacgcagcatcgccgagtttctcgcaaaaagcaagtcggaggaaacccaagaagaagtccaggtgctgctggacagccttgtacatggaaaccctaagtaccagaatcaggtgtataagggcctgatcgccctgctgccatgcgagagccctaaggctcagcagctatcacttcagaccctgcggaccgcccagccaattattgggactacgcacccttcaatcgtggattgcgtgctaaaggtccttggtactatgcatttagaagtgcagtacgaggctatcgaactcattaaggacctggttggatatgacgtgcgacaagcactcctgaaagggctggtggccttgctgatcccaagtgtcaaagagatcagcaagctgcaagctaaaatcctctcagatccaagtgtactccaactcacaccaagcctacccatgttcctgcagcaggccgccgctgctaaagcaatcggggtgctggcaaggaatgatatgtctatagccgaagaattgctctacctgcgggtcgtgaggggcctgatggctgccatgggtaatactgatcattccaattcccagcggttggcctctctgacgcttgaatgttttgtgcaaatgtttcctttggtggctgagcatgttcgtaaatgcatgggggaggaactctaccagctgttcctaagcaacgctgaggacctgtatatgaaaattgactcaattcaggccgacatactggccgcgaacaccgtgaatgttacaaaagccctgtgcctgcatggtagtagctacagcatgaacacgctctatggtagtcgggatagcgcgcagatggcgtatttgacccacttcgaggaggatgtggagtccaaagaatag

SEQ ID NO: 44847 - DNA, 1323 bp, Artificial Sequence
  Description of Artificial Sequence: Synthetic coding sequence
atgaccagcatcaaggagcaggccgccatcagccggctgctgagcttccttcaggagtgggacaacgccggcaaggtcgctcgaagtcatatactggacaaattcattgaaaccaaccagggcaagactgcccccgagctggagcaggagtttagtcaaggcgcctctctgttcttggtcaggctgacgacctcactgcgcattacctatatgacggattcctgcctagaaaaattactgcggtctatcgggatcttcctatccgctgtctcttcaaatcggtacctgatcgagtttctggaagtgggcggagtactgacgctgttggaaatacttggcctagagaaaatcaaggaggaagctaagaaggaatccgtgaaacttctgcaggttatcgccaacagtgggaggacatacaaagagctcatctgcgagtcctacggcgtccgctccatagccgagttcctcgcgaagtcaaagtccgaggagactcaggaagaggtgcaggtgttgctggacagtttagttcatggaaatccaaaatatcagaaccaggtgtataaaggtttgatcgcactgttaccctgcgagagtcctaaagctcagcaactgagtctgcagactttgcggaccgctcaacctattattggcaccacccacccctctatcgtggattgtgtgctaaaggtactggggacaatgcatctggaagtccagtatgaagccatcgaattgatcaaagatcttgtgggttatgacgttaggcaagcactgctgaagggactcgttgccctgctgattccatcagtaaaggaaatttctaaactccaggccaagatactgtcagatcctagcgttctgcagttaacgcccagcctccctatgtttctacagcaggcggcagctgcaaaggcgatcggcgttctggcccgtaatgatatgtcgatagcagaggagctcctctatctgagggtcgtgcgtgggctcatggccgccatgggtaatacagatcatagtaattcccagcgtctcgcttccctgaccctcgagtgtttcgtgcaaatgtttcctcttgtggcagagcacgtgaggaagtgtatgggtgaagagctgtaccaactgttcttgagtaatgctgaagatctgtacatgaagatcgacagtattcaggccgacatcctggccgccaatactgtgaatgttactaaagcactgtgcctacatggttcctcttacagcatgaacacgctgtatggctcccgcgactccgcccagatggcttatctgacacatttcgaagaggacgtggaaagcaaagagtag

SEQ ID NO: 44848 - DNA, 714 bp, Artificial Sequence
  Description of Artificial Sequence: Synthetic coding sequence
atgggcctgtgcaccctgcagcccctgggccccccccggaagagctctacctcttgtggcacgtggactgcttctggccttccttctttaggccacctgcccagacgcctcagactagccttcgatttcctagagccccgcgcacgcgggcagcgaggcgggagtggcggatgccagtcaacaagagcagcagaacgcacccggcccccccacccacctaacgctgtgttgctgctccagcccgagccgtccctaacctgggcccagggccgcggctgtcggggacacttcaggagcctccctgcagctgctagtcggtccggatcaaggacactgcggtgtgcttcatcagataggtccctgagggagcagaagcagcgccgggccggccccgaccctacaccctctcccgccccacctcccgcagggccaagacctagtcccggatccttgggaccatctgcgccggctgccccgcggaccgcacgtggcgcgtacgaactgcaggggggagcctcccaggatggacccggccaggcagcggtcggcgcgacaccaaccaccggaccgggtacaggtggcgaaggtgctctgctgggttgcgggtccgggaggacacccccgacgagcgctacctggagaaggcggctactgccggcggaagtccctcccggtgctgcagctgcaaatttcccggaaagggagcgcctgtag

SEQ ID NO: 44849 - DNA, 681 bp, Artificial Sequence
  Description of Artificial Sequence: Synthetic coding sequence
atgcgggccccccccctgctgctgctgctggccgcctgcgcccccccgccgtgcgcagccgccgcacctacaccccctgggtgggagcccacgcccgatgccccatggtgcccatataaggtcctaccagaaggacccgaagccgggggcggccgactatgtttccggagtccagctcgcggatttcgatgccaagccccagggtgtgtactgcacgcccccgcaggccgctccctcagagccagcgtactgagaaacaggtctgtgctgctgcagtggcgtttggccccggcggcagcccgtcgagttagagctttcgcgttaaactgctcctggcggggggcttacaccagatttccttgtgaaagagtgctgctgggagctagctgtagggactaccttctgcccgacgtacatgattccgtgctgtatcgcctttgcttgcagccgttgcctctcagagccgggccagctgccgccgccccggagaccccagagcccgccgagtgcgtagaattcaccgctgagccagccggtatgcaggatatagtggtcgcaatgaccgctgtgggcgggtccatctgcgtcatgctcgtagtaatctgtctgctcgtggcctacataacggaaaacctgatgaggcccgcgctcgcccgccctggcctgcggaggcatccatag

SEQ ID NO: 44850 - DNA, 792 bp, Artificial Sequence
  Description of Artificial Sequence: Synthetic coding sequence
atgttcggcagcagccggggcggcgtgcggggcggccaggaccagttcaactgggaggacgttaagacggataagcagagggagaattatcttggcaacagcctcatggcccccgtgggtagatggcaaaaagggagggatttgacttggtatgccaagggccgcgccccgtgcgcaggtccatccagagaggaggagttggcagccgttagagaggccgaaagagaagccctcctcgcagcgctggggtataagaacgttaaaaagcaacctaccgggctaagtaaggaggactttgcagaagtatgcaaaagggagggaggagatcctgaggagaagggtgtggatcggttgctgggcctggggtcagctagcggttcagtgggcagagtcgccatgtcacgggaggataaggaggccgccaaattgggcctgagcgtctttacacaccatagggtcgagagcggcggcccgggaacatctgcggcatctgcccggcgcaaacctagggccgaggaccagactgaatccagttgtgaatctcacaggaaatcaaagaaggaaaagaaaaagaagaagaagcgaaaacacaagaaagaaaagaagaaaaaggacaaggaacaccgaagaccagctgaagcgacatcttctcccacaagcccagagcgtccaagacaccatcaccatgatagcgacagcaactccccttgttgtaaaaggaggaagagaggacattcaggcgatcgtaggagtcctagccgccggtggcatgacaggggatctgaagcttag

SEQ ID NO: 44851 - DNA, 1545 bp, Artificial Sequence
  Description of Artificial Sequence: Synthetic coding sequence
atggagcccgtgcccctgcaggacttcgtgcgggccctggaccccgcttctctaccacgagtgctgcgagtctgtagcggcgtgtacttcgaggggagcatctacgaaatctccggcaatgagtgttgtctgtcaaccggagacttgataaaggtgacccaggttcggctgcagaaggtggtatgtgaaaatccaaaaacatcacagacaatggaacttgcccctaactttcagggctactttactcccttgaatacaccccaatcttatgaaacattggaagagctggtgtcagcgaccacacagagcagcaaacagctcccaacctgctttatgagcacacacaggatcgttactgaaggccgcgtggtgacagaggatcagctgttaatgctcgaggccgttgttatgcatctcggtataaggagtgcaagatgtgtgctgggcatggagggtcagcaagtgatcttacatctcccgctgtctcagaagggccctttttggacttgggagccaagtgcccccaggaccctgttgcaggtgctgcaggacccagcgctgaaagacctagtgcttacttgtcctactttaccttggcactccctaattctgcgcccccagtacgagatccaggccataatgcacatgaggaggaccatcgtgaagatcccttccacgctggaggtcgatgtggaggatgtcacagcatcaagtcgccacgtgcacttcattaagcccctcttactgagtgaagtgcttgcttgggagggaccctttcccctgagcatggagatcctcgaaagattgtccgatcaggctggggaagatgaagaggaagagtgcaaagaggaggccgagagcccagaacgggtcctgctcccttttcacttcccgggatcctttgtagaggagatgtctgattcgcggcgttacagtcttgccgacttaacagcccagttttccctcccttgtgaggtcaaggtggtggctaaggatacatctcaccccaccgacccactgacatcattcttgggcctgcgccttgaggagaaaattacagagccttttctggtggtttctttggacagcgagccaggcatgtgtttcgaaatacctcctaggtggctggatctcaccgtggtgaaagccaagggtcagccagatctgccagaagggagccttccaatcgccactgtggaggaactgaccgatacattctattacaggctcaggaagctgccggcctgcgagatccaggccccaccgcctaggccccctaagaaccaggggctaagcaagcaacgacggcatagttctgagggcggagtgaagagctcccaggtgctgggtttgcaacagcacgcacggctgccaaaacccaaggcaaagacactgccagagtttataaaggacgggagcagcacctacagtaagattccagcgcatcgtaagggacacagacccgcaaaaccccaaaggcaggaccttgatgacgacgagcacgattatgaagagattctagaacaattccaaaaaacaatctag

SEQ ID NO: 44852 - DNA, 1932 bp, Artificial Sequence
  Description of Artificial Sequence: Synthetic coding sequence
atggagcccgtgcccctgcaggacttcgtgcgggccctggaccccgcatcattgccccgcgtgctacgggtgtgcagcggggtgtatttcgagggatcaatctacgaaatttccggaaatgaatgttgcctaagtacgggcgacctgataaaagtaactcaggtgcggttgcagaaagtagtatgcgaaaatccaaaaacttctcaaactatggaactggcacccaactttcagggatatttcacaccattgaatactccccaaagctatgagactctggaagaattggtgtctgcaacaacacaaagcagtaagcaacttccaacctgctttatgtctacacaccggatagtaaccgagggtcgagtggtgaccgaggaccaattgctgatgctcgaagccgtggtcatgcatctgggtatacgtagcgcccggtgcgtacttggtatggaaggacaacaagtcatactgcatctgcctctgtcccagaaaggtcctttttggacatgggaaccctccgctccaagaacgctcctccaggtactgcaggacccagccctcaaggatctagttctcacctgcccaacactgccatggcattccctgattcttagaccacagtatgaaattcaagccatcatgcacatgcggaggactattgttaaaatcccctccacacttgaagtagatgtcgaggatgtcactgcttcatctcgccacgtccacttcataaaacctttattactgtccgaggtcctcgcatgggagggccctttccccctctccatggagatcttggaagtgcccgagggccgtcccattttcctttccccatgggtgggtagtcttcaaaagggccaacgcctatgcgtctatggacttgcctccccgccttggagagtactggcaagctccaaaggacgaaaagtgcccaggcacttcctcgtctcaggaggctatcaggggaagctgagaaggagaccccgcgaatttcccaccgcttacgatctattaggcgctttccagccgggacgccctctgcgcgtcgtcgcgacaaaagactgcgagggtgagcgggaggagaaccccgaattcactagtttggccgtgggcgataggcttgaggtcctgggcccgggacaagcacatggcgcccaaggatccgacgtcgatgttctggtctgtcagcgcttgtccgaccaggccggagaggatgaagaagaagagtgtaaggaagaggcggagtccccagagagagttctgctaccatttcatttcccgggatcttttgttgaggagatgagtgatagtcggcggtactcactggccgatctgacagcacagtttagtctgccctgcgaggtgaaggtggtagcgaaagacaccagccaccctactgacccactgacctcatttttaggattacgtcttgaggaaaagatcactgaacctttccttgtcgtgagcctagactcagaacccggaatgtgctttgaaatcccccctaggtggcttgacctgacagtggtgaaagccaagggccagcccgacctgccggagggtagtcttcccatagcgacagtggaagagttgaccgacacgttctactataggcttcgaaaactgcccgcatgtgagattcaggccccacccccgagacctccaaaaaaccaaggtctcagcaaacagcggcgccatagttcagagggtggtgtgaagagttcacaagtcctcggactacagcagcacgctaggctcccgaagccaaaagctaaaaccttacccgaatttattaaagacgggtcaagcacctactccaaaatccccgctcataggaagggccaccgtcccgctaagcctcagcgccaggacctggacgacgacgaacacgactatgaggagatcctggagcaattccagaaaacgatctag

SEQ ID NO: 44853 - DNA, 783 bp, Artificial Sequence
  Description of Artificial Sequence: Synthetic coding sequence
atggagcccgtgcccctgcaggacttcgtgcgggccctggaccccgcttcactgcctcgcgtcctgcgggtgtgtagtggcgtctatttcgaaggatctatctacgaaatttcaggaaacgaatgctgcctgtccacgggcgacctgattaaggtgacccaggtaaggctgcagaaggtggtgtgcgagaatccaaaaacctcccagacaatggagctagcccctaacttccaaggatactttacacctctgaacacgccacagtcttatgagacactggaggagttggtttctgctacaactcagagcagtaagcagctccccacatgttttatgtctacgcataggatagttaccgagggccgggtggtgactgaggaccagttactaatgctcgaggcagttgtcatgcatttgggaatccgatccgcccgttgcgtgcttggaatggaggggcagcaagtgatcttgcacctacctctttctcagaaaggacccttctggacctgggagccatcggcaccaaggacattgctacaggtcttgcaggatccagctctgaaggatctggtgctgacctgccctacactaccctggcatagtctaattctccggcctcagtatgaaatccaagcaattatgcacatcttctcctccttacgcatcgcagctacgcggtctgccgcccagacacagggggaggacctggcaagagtgcaccagggatggttgcagtacgtgcagcaggacagctgcccacaggaggggccacaggctcggtag

SEQ ID NO: 44854 - DNA, 372 bp, Artificial Sequence
  Description of Artificial Sequence: Synthetic coding sequence
atggagcccgtgcccctgcaggacttcgtgcgggccctggaccccgcctcgttaccacgagtgttaagagtttgctccggagtatattttgagggcagcatctacgagatcagcgggaacgagtgttgtctcagcacaggcgacttaatcaaggtgacacaggtaagactgcagaaagtcgtttgtgaaaacccaaaaacttctcaaacaatggaactcgcgccaaacttccaggtgttctcaagccttcgcatagctgctacaagatctgcagcccagacacagggcgaagacctcgctagggtccaccagggttggctgcagtatgtgcagcaagacagctgtcctcaggagggaccccaggcccggtag

SEQ ID NO: 44855 - DNA, 402 bp, Artificial Sequence
  Description of Artificial Sequence: Synthetic coding sequence
atggagcccgtgcccctgcaggacttcgtgcgggccctggaccccgcttcactacccagagtactgagagtgtgctcaggtgtgtatttcgaagggtacttcacgcccctgaatacccctcagagctacgagactttggaagagttagtctctgcgaccacgcaaagttcaaagcaactccctacctgtttcatgtccacccacaggatagttacagagggtagagtggtcacagaggaccagctcttgatgcttgaggcagtggtgatgcacctcgggatccgttccgctagatgtgttctggggatggagggtcagcaagtgatactccacctgccattgtcacagaaaggccctttttggacctgggagcctagcgcccctcggacactcctgcaatag

SEQ ID NO: 44856 - DNA, 744 bp, Artificial Sequence
  Description of Artificial Sequence: Synthetic coding sequence
atggagcccgtgcccctgcaggacttcgtgcgggccctggaccccgccagcttacccagggtgctgcgggtatgctctggagtttattttgaggggagcatctacgaaatttcaggaaacgagtgttgcctgtctaccggcgacctgatcaaggtgacacaggtcagactgcagaaagttgtgtgtgaaaatccgaagactagtcagacgatggaactggctcccaacttccaggtccgacgcaccattgtgaagatccctagtacactcgaagtggacgttgaggatgtaactgcaagttcgagacacgtgcactttataaagccccttctcctgagcgaagtgctggcctgggaaggacctttccccctgtccatggagatcctggaggtgcctgaaggccgcccaatattcctgtcaccatgggtcggaagcctacaaaagggacagagactgtgcgtgtatggactggccagcccaccatggcgggtacttgccagtagcaagggtaggaaggtgcctcgccatttcctggtgtccggaggataccaaggtaagctgcggcgcagaccacgggaattcccaactgcgtacgaccttctaggagcctttcagccaggtagaccgttacgcgtggtcgctacgaaagactgcgaaggcgagcgtgaagaaaaccccgaatttacctccctagccgtcggcgatcgacttgaagtgctcggcccaggccaagcccacggatag

SEQ ID NO: 44857 - DNA, 1176 bp, Artificial Sequence
  Description of Artificial Sequence: Synthetic coding sequence
tgaacctgcttcatgagcacccaccggatcgtgaccgagggccgggtagtgactgaggaccaattgcttatgttggaagccgtcgtcatgcatcttggcatcaggtcagctagatgcgtgctgggtatggaggggcagcaggtaattctccacctgccgctgtctcagaaagggcccttttggacctgggagcctagcgcgccaagaacactcctacaggtcctgcaggatcccgccctcaaagatctggtgctgacctgtcctacactaccctggcactccctaatacttagacctcagtatgaaatacaggcaatcatgcacatgcggaggactattgtaaaaattccaagtaccctggaggtggatgtcgaggatgttaccgctagcagtaggcacgtgcatttcatcaaacccctgctgctctcagaaagattgagcgaccaagccggggaggacgaggaggaggagtgcaaggaggaggccgagtcacccgaaagggtgctgctgccattccattttcctggttccttcgtggaggaaatgagcgatagccggagatactccctggctgatctgacagctcaatttagcctgccatgcgaagtcaaggtcgtcgctaaagacacctcacatcctaccgatccccttacttcattcctgggactgaggttggaggaaaagataaccgagccgtttctcgtggtgagcctcgactcggaacccgggatgtgcttcgaaattcccccaagatggctggacctgacggtggtcaaagccaaaggacagccggatctaccagagggcagcctccctatcgccaccgtcgaggagctaacagacactttctactatcgcctacggaaacttcccgcatgcgagattcaggcccctcccccccggcctcccaaaaaccagggcctgagcaagcagaggcggcactctagtgaaggtggcgttaagagtagtcaagtgctgggcctccagcaacatgcccggctaccaaagcctaaagccaaaactctgcccgaattcatcaaggacggctccagcacttattctaaaattccagcccacaggaaaggccatagacctgcaaaaccccagaggcaggacttggacgatgatgaacacgactatgaggaaattttagaacaatttcagaaaaccatctag

SEQ ID NO: 44858 - DNA, 600 bp, Artificial Sequence
  Description of Artificial Sequence: Synthetic coding sequence
atggaggacgccgccgcccccggccggaccgagggcgtgctggagcggcagggggcaccgccggccgccgggcagggaggggcactcgtggagctgaccccgactcccggcgggctagctctggtctcgccgtaccacacccatagagccggcgatccattagacctagtggctttagcagagcaggttcagaaagccgacgagttcattagagccaacgctacaaacaagctgaccgttatcgcagagcagattcaacacttgcaggaacaagccaggaaggtgcttgaggatgcgcatcgggatgcaaacctccaccatgtggcttgtaacattgtcaaaaaaccaggcaacatatactacctttacaagagagagtccggccagcagtacttcagcatcatttctcccaaagagtggggcaccagttgccctcacgattttctcggtgcttataagctacaacacgacctgtcctggactccttacgaagatattgaaaaacaggacgcgaagattagcatgatggacacactgctctcccagagcgttgccctgcctccctgtaccgagccaaacttccagggactgacacattag

SEQ ID NO: 44859 - DNA, 336 bp, Artificial Sequence
  Description of Artificial Sequence: Synthetic coding sequence
tgaagcgccctgctgctgggcgtggacggcctgctgagcggcatcctggcaattatttatgtaagcgctgcatcctttcacctgtgtttctacagccccggtgtcccatcaacttataaaggcctcccgtgcccgtacgcatcgtgcatcttggcgagcactagcctcctcacaaaagggaacagattcattctttgctgcatggcttccctcatgattctcttcatgatggaccaatcctattatccgtatgacaagatcctggaaagcgagaactggaaaaagctggtgtacattggaggtcaatttagatttattatcggatggaatttctag

SEQ ID NO: 44860 - DNA, 690 bp, Artificial Sequence
  Description of Artificial Sequence: Synthetic coding sequence
aagggcaccagcttcttcctgagccacgaccagagccacagccagatcaacgaagtgagttggaaggacgtgactagcgccctcagccttgccaatatggttcttgggttattcagtattatcttctcctttagtcgcaaatgtcattatgcttccagaatgctcttggtatctttcctcctggatatggctgtcagagctatgacaagccacattaacatttgcagcaagctcggggcagaacttaacgatttcgctgtcttcaccacctttggcctggccagcgcactgctgctcggcgttgatggcttgctctcaggaattctggcgattatttatgtgagcgctgcatcattccacctgtgtttttactcacccggcgttccctccacatataagggtctcccctgcccctatgcctcctgcatccttgcctccacctccctactgacaaaagggaatagattcatactttgctgtatggcatccctgatgatcctttttatgatggatcagagctattacccttatgacaaaatcctagaatccgagaactggaagaagctggtctacataggaggcgtaatcatgcttttcttttcacccttgtccctttccgcgttctactgccttatgtggagcctgtcttatatcttttttcccgacgccctgtgggggaaagccgcatag

SEQ ID NO: 44861 - DNA, 699 bp, Artificial Sequence
  Description of Artificial Sequence: Synthetic coding sequence
tgattcttcctgagccacgaccagagccacagccagatcaacgaggtgagctggaaagacgtgactagtgctctgtctctggccaacatggtcctgggcctgttttctataatatttagcttctctcgaaagtgccactacgccagtcgaatgctgctggtgagttttttgctggacatggcagttcgagcgatgacgtctcatatcaacatatgtagtaaattaggcgcggaactcaacgatttcgccgtcttcacgacctttggcctcgctagcgccctccttctgggagttgatggactgttgagcggaatcctggccatcatctacgtttcggccgcttcctttcacttgtgtttttatagccctggcgtcccctcaacatacaagggcctcccctgtccatatgcgtcatgcatcctcgcaagcacttctctcctaaccaaaggcaacaggtttatcttgtgctgcatggctagccttatgattctcttcatgatggaccagagttactacccgtatgataaaatactggagtccgagaactggaagaagctcgtatatatcggaggcgtgataatgctgtttttctctcccttgtcgctttccgcgttttactgcctcatgtggagcttgagttacatttttttccccgacgccctttggggcaaagcggcctgtctcagccctcagcattag

SEQ ID NO: 44862 - DNA, 1158 bp, Artificial Sequence
  Description of Artificial Sequence: Synthetic coding sequence
atggacagccccagcagcgtgagcagctacagcagctacagcctgtcatcctctttcccaacaagccccgttaacagtgacttcgggttcccctccgattctgaaagagaagataagggcgctcacgggcctcgtccagacaccgtcgggcagcgggggggctccaggcccagtccgggccccatcagatgcagacaccgctctaaggtctctgggaatcaacatactcctagccaccctaaacagagaggttccgcttcccctatggccggaagcggagcaaagaggagcagagacggcgaactcgagacaagtctcaacacccaaggatgcactaccgagggagacctgttgttcgctcagaaatgcaaggagctgcagggctttatcccccctcttaccgacttgctaaatgggctcaaaatggggcggttcgaaaggggactgagtagcttccagcagagtgtggccatggacaggatccagagaattgtcggcgttttacagaagccccagatgggcgagaggtatcttggcaccctgctgcaggtggagggcatgttaaagacctggtttccacagatcgcagcacagaagtcttcactgggtggaggcaagcaccagttgaccaagcacttcccctctcaccattccgactccgccgcctcatcgccggcctcacccatggagaagatggatcagactcagctgggccatctggctcttaagcctaaacagccgtggcacttaacacagtggccagccatgaacctgacttggatccatacaactcctatctgcaatcctcctctttcttcacctggcacgatatcattttcccatgggccattaggcacaggcaccgggattggagtaatattgttcttacaacacggcgtccagccctttacacatagcgcccccaccacgcctgtccctccaaccacggcttcccccgtgattcccggtgagcccatgaaactgtcgggagaggggccccgttgctattccctgcctgtgacactgcccagcgactggtcatatacactcagccctcccagtcttcccactctcgcacgtaagatgaccatcggccacagggaacagcaacgatcacacccacccgtggcggccgatgcacatctgctgaatctctag

SEQ ID NO: 44863 - DNA, 1158 bp, Artificial Sequence
  Description of Artificial Sequence: Synthetic coding sequence
atggacagccccagcagcgtgagcagctacagcagctacagcctgagctcgagtttccccacaagccctgtgaattccgatttcggatttccctccgattcagaacgagaggataagggagcacatggccctcgccccgataccgttggccagcgaggcggaagtcgacccagccccggtcctattagatgccgccatagaagcaaggtctccggaaatcagcacaccccctcccatccgaagcagcgggggtctgcctctccaatggctggctctggtgcaaagagatctcgggacggagagcttgaaacgagtcttaatactcagggatgcactacagagggggatctgctgttcgctcaaaaatgcaaggaacttcagggcttcattcctccccttacggaccttttaaatggactgaaaatgggacgctttgaacgcggcttgagttcctttcagcagtcagtcgccatggatcgcatccaacggattgttggtgtgcttcagaagccacagatgggcgagcgatacctaggcaccctgttacaagtcgagggaatgctgaaaacgtggttcccacagatcgcggcgcagaagagcagtttgggcgggggaaaacaccagctgaccaagcactttccaagccatcattccgatagcgctgcctcctcccccgcaagtcctatggaaaaaatggatcaaacccagttgggacacctcgccctcaaacctaagcagccatggcaccttacccagtggcctgctatgaacctcacttggatccacactactcctatctgcaaccctcccctctcatcccctgggacaatctctttttctcatggccctctcgggacaggtaccggcattggagtcattctattccttcagcacggcgttcaacctttcactcattcagcaccaacaacccctgtgccccccacaaccgcatcaccagtcatcccgggggaacccatgaagttaagtggtgaagggccacgctgctacagtcttccagtgacactcccttctgattggagctatacattgtcacctccatccttgcccaccctcgcaagaaagatgaccataggacacagggagcagcaaagaagccatcctcccgtggcagctgatgcgcacctgctgaatctttag

SEQ ID NO: 44864 - DNA, 1158 bp, Artificial Sequence
  Description of Artificial Sequence: Synthetic coding sequence
atggacagccccagcagcgtgagcagctacagcagctacagcctgagctccagctttcccacatcccccgtgaactcagacttcggttttcccagcgatagcgagcgagaggacaagggagcccacggaccgagacctgataccgtcggccaaagaggcggaagtcgcccaagcccaggaccaattcggtgtaggcataggagcaaggtgtccggaaatcagcacaccccctcccaccccaaacagagagggagcgctagccctatggccggtagtggcgctaaaagatccagggatggcgagctcgaaacatccttgaatacacaagggtgtacgaccgaaggggatctgctgtttgcacagaaatgcaaggagcttcaggggttcataccccctttgacagatctgctaaacggcctgaaaatggggaggttcgagcgaggtttgagctctttccagcagtccgtggccatggacagaatccagaggatagtaggagtgctccagaaacctcagatgggcgaacgttacctgggcacactgctccaggtggagggaatgctgaaaacttggttcccccaaatcgccgcccagaagagttcgttggggggcgggaagcatcagctcaccaaacactttcccagccaccactcagattcagccgcatcctctcctgcttctcccatggagaagatggatcagacccagctggggcatctggctctgaagcccaagcagccatggcacctgacacagtggccggccatgaatctgacctggatccacacaacccctatatgcaacccaccactgtctagcccaggcacaatctccttttcacacgggcctttggggactggcactggtataggtgtcatcctatttctccagcacggcgtgcagccattcactcacagcgctccgaccaccccggtcccacctaccaccgcatcaccggtcattccaggcgagccaatgaagctttctggcgaggggccccgctgctactctctccccgtaactctcccaagcgattggagctacaccctctccccgccaagcctgccaacgctggcccgcaagatgaccattgggcacagagaacaacagcggagtcaccctccggtggccgcggacgctcatttgttgaacttgtag

SEQ ID NO: 44865 - DNA, 504 bp, Artificial Sequence
  Description of Artificial Sequence: Synthetic coding sequence
atggccgccgaggagaaggaccccctgagctacttcgccgcctacggttcctctagctccgggtcctcagacgaagaagacaatatcgagcctgaggaaaccagtcgccgcacacctgaccctgctaaaagtgctggcggctgccgaaacaaagcggaaaaaagactgcctggccccgacgaactgttccgctccgtcacgaggcccgcgtttctgtataacccactgaacaaacagatcgactgggagaggcacgtcgttaaggcacccgaggaaccgccgaaagagttcaagatatggaagtccaattacgtccctccacccgagacctataccacggagaagaagcccccaccaccagaactggacatggcaatcaagtggtccaatatctatgaggacaacggagacgatgcacctcagaatgcaaaaaaggctcggctactgcccgaaggcgaagagactttagagtccgcgctggaggatctagagatccaaaattag

SEQ ID NO: 44866 - DNA, 549 bp, Artificial Sequence
  Description of Artificial Sequence: Synthetic coding sequence
atggccgccgaggagaaggaccccctgagctacttcgccgcctacgggtcctcctcaagtgggtccagcgacgaagaggataatatcgagcccgaggagaccagccgcagaactcccgaccctgccaagtccgctgggggttgtagaaataaagctgaaaagcgcctgccaggtccagatgagctattcaggtcagtcaccaggccagcatttttgtataatcctcttaataaacaaattgactgggagcgtcacgtcgtgaaggctcccgaagaacccccaaaggaatttaaaatctggaagtctaactacgttccaccacctgaaacctataccactgaaaaaaagcctccaccaccagagcttgacatggctatcaaatggtcgaatatctacgaggacaacggggacgacgctccccagaatgccaagaaagctcgtctgttgcccgaaggggaagaaacccttgaatcggacgacgaaaaggatgagcacacttctaagaaaagaaaagtggagcctggcgagcccgctaagaagaaaaagtag

SEQ ID NO: 44867 - DNA, 438 bp, Artificial Sequence
  Description of Artificial Sequence: Synthetic coding sequence
atggccgcccggcagatctgggcccggaccggcgccgccctgtgcaggcagcctagcgccgcgcccccccctgcacctttatgggtgcgcgcaggcttccgtcaacagttgagcctaacgttgtgccccgctaatgagggcaactgtgggggcagcgctccttctaccccgggtcgtcctgaacgggccgccaggccaagtgttagcgaagagcttacagccgctgagagacagatcgcggagctgcatgccgcagcctgtgccgcaggacagctgaactatgtcgatccagcaaccgggtatgtcgtactcacacagattgctcacctgcagcggggagagtgctgcggcagcgcttgtcggcactgcccctatggacaggtgaacgtcaaggacccaagcaaaaaaaagcaatttaacagctatttttatgtctag

SEQ ID NO: 44868 - DNA, 396 bp, Artificial Sequence
  Description of Artificial Sequence: Synthetic coding sequence
atggacgtgctgttcgtggccatcttcgccgtgcccctgatcctgggtcaagagtacgaagatgaggagcgcctgggggaggacgagtactaccaggtagtatattattacactgtgaccccctcctacgatgacttctcagcagactttacgatcgactattcaatcttcgagtccgaagatcggctgaacaggctagacaaagatatcacagaggcgattgagaccactataagcctagagactgctagagctgaccatcctaagcctgttacagtcaagcctgtgacgacggagccctctcctgatttgaacgacgctgtgtctagcctgcgatctcccattcccctgctcttatcttgcgcatttgtgcaggtcggaatgtactttatgtag

SEQ ID NO: 44869 - DNA, 1356 bp, Artificial Sequence
  Description of Artificial Sequence: Synthetic coding sequence
atggccgaggccgccgccctggtgtggatccggggccccggcttcgggtgtaaggctgtgagatgcgccagcggacgatgcacggtcagggacttcattcacaggcattgccaggaccagaatgtccccgtcgagaacttttttgtcaagtgtaatggggctctgataaacaccagcgacactgtgcaacatggtgcagtctatagcctggaacctcgcctctgcggtgggaaaggcggctttggctcgatgctccgcgctctgggcgcccagatcgagaagacgactaatagggaagcctgcagggacttgagtggcagacgcctgagggatgttaaccacgaaaaggctatggccgagtgggttaagcagcaggccgagcgcgaagcagagaaagaacagaagcgcctggagcgtctgcagcgcaagctggtggaaccaaagcactgctttactagccctgattaccagcagcaatgccacgagatggctgaaaggctggaggactccgtgctgaaaggaatgcaggcagcctcttccaagatggtcagtgccgagatcagcgaaaatcgcaaaaggcagtggcctaccaagtcccagactgacaggggcgccagtgccgggaagcggagatgcttttggttggggatggagggacttgagaccgcggagggctcaaactctgagagctcagacgatgacagcgaggaggcccccagtacctcgggtatggggttccacgcgcctaagatagggtctaatggcgtggagatggctgccaaatttccctccggcagtcagagagctcgtgtggtcaacaccgatcatggatctccagagcagctccagattccagtgactgactcaggcaggcacatcttagaagacagctgtgccgagttgggagagtcgaaagaacatatggagtctagaatggtgacagagactgaggagactcaggagaagaaagccgagtctaaggagcccatcgaggaagaaccaacgggagcaggcctgaacaaggacaaagagactgaagaacgaacggacggcgagagagtggccgaggtggcccccgaagaacgggagaatgtagccgtggcaaagctgcaggaaagtcagcctggtaacgcggtgattgacaaagaaactattgaccttctggccttcacaagcgtagcagagttggagctgctgggtctggagaaactgaagtgcgaactgatggcccttggcttgaagtgcgggggcactctgcaggagagggcggctcggcttttttccgtaagagggctggcgaaggagcagattgacccggccctatttgctaagccgctgaagggcaagaaaaagtag

SEQ ID NO: 44870 - DNA, 1071 bp, Artificial Sequence
  Description of Artificial Sequence: Synthetic coding sequence
atggagcacagcctgacccccgtgacccagtgcagcatggagctgtttatagtatggaaccctgattttgccgtagaaaaggaggtgctagacttgtgttctgaacatcttgtgctgaggctgagaaggcagcctatcgagaagttagttgaacctaaacactgctttacatctcctgattaccagcagcaatgccacgagatggcggagcgcctggaggattcagtgcttaagggaatgcaagcagcatcttctaagatggtgtcggccgaaatttctgaaaatcggaaaagacagtggcctaccaagtctcagactgaccgaggcgcctctgcaggtaaacgccggtgcttctggcttgggatggaaggcttggaaactgcggagggatccaacagtgagtcctccgatgatgactcagaggaggcaccttctacatcgggaatggggtttcacgcgcctaagatcgggagtaacggggttgagatggccgcgaagttccctagtggctcacagcgcgccagggtggtgaacactgatcacggtagtccagaacagctgcagatacccgtcacagatagtggacgacacatcttagaagactcatgtgcagaactcggcgaatctaaagagcatatggagagccggatggttactgagactgaggagacccaggaaaagaaggctgagagtaaggagccaatcgaagaggaaccaaccggggctggactgaataaagacaaggaaactgaggagcggaccgacggcgagcgggtggccgaagtagcccccgaggaaagggaaaatgtggcagtggccaagctgcaggaaagccaaccaggcaacgccgtgatcgacaaggagacaatcgacctgctcgcctttacatccgttgcagaattagaacttctcggccttgaaaaactcaaatgcgaattgatggcactgggcttgaaatgcggtgggactcttcaagaaagagcggcacggctgttctccgttcggggattagccaaagagcagatcgatccagctttattcgccaagcctctgaagggcaagaaaaagtag

SEQ ID NO: 44871 - DNA, 1320 bp, Artificial Sequence
  Description of Artificial Sequence: Synthetic coding sequence
atggccgaggccgccgccctggtgtggatccggggccccggcttcggctgtaaagctgtgcggtgcgcttccgggagatgcactgttagggactttatccaccgtcattgccaagatcagaacgtacctgtggagaatttcttcgtgaaatgccatggagccgtgtacagtttggaacccaggttgtgtggaggcaaaggaggctttgggtccatgctcagggccctgggggcacagatagagaaaaccacaaatagggaggcttgtcgcgacctttctggacgccgcctaagggacgtgaaccatgagaaggcaatggccgagtgggtgaagcaacaggctgagcgggaggccgaaaaggaacagaagcgacttgagaggctccaaagaaagcttgttgagccaaagcactgctttacctcgcctgactatcagcagcagtgccacgaaatggctgagagactggaagactctgtgctgaagggtatgcaggcagctagcagcaagatggtgagcgctgagatctcggagaaccgtaaacgacagtggccaacaaagtcccaaactgacagaggtgcctctgccggaaagaggcggtgtttctggctgggaatggaaggcctggagactgccgagggctcaaacagtgaatcctccgatgacgactcggaagaggctccgtccacgagtggaatgggcttccacgccccaaagattgggagcaacggagtcgagatggccgcgaagtttcctagtggctctcagcgggccagagtggtgaataccgaccatggaagtccagagcagttgcagatcccagtcacagactctggacgccatatcctggaagactcgtgtgcagagctgggtgagtccaaagagcatatggagtccagaatggtgactgagaccgaggagacccaagagaagaaggctgagtccaaggagcccattgaggaggaacccacaggcgcaggcctgaacaaggacaaggagaccgaagaaagaacagatggagaaagggtggccgaagtcgctccagaggagagggaaaacgtggccgtcgccaaattgcaggagagtcaaccgggtaacgctgttatagacaaagaaaccatagatttgctcgccttcacctcagtggctgagttggagctgttgggactcgagaagctgaaatgcgagctcatggcactgggcctaaagtgtgggggcaccttgcaggaacgcgccgcccggctgttcagtgtacgtgggctggcaaaagaacaaatcgatcccgctttgttcgccaaacctttaaagggcaagaaaaaatag

SEQ ID NO: 44872 - DNA, 873 bp, Artificial Sequence
  Description of Artificial Sequence: Synthetic coding sequence
atgagcaactacgtgaacgacatgtggcccggcagcccccaggagaaggattccccatccacaagccggagtggagggtctagtaggctgtcctcccggtcaaggagccgaagtttcagccgcagcagccgttcccattcccgagtgagctctcgcttctcaagtagaagtcggcgctcaaagagtagaagtaggtccagaaggcgtcaccagcgcaagtaccgtagatacagtagatcatatagcagatcacgttctaggagtcggagccgcaggtacagggagcggaggtatggctttaccaggcgctattatcgctcaccctcccgttaccggtctcgcagtcgaagcaggagcaggtcccggggacggtcctactgtggtcgcgcctacgctatcgctcggggccaaaggtactacggtttcgggaggaccgtgtatccagaggaacatagcaggtggagggatcgcagtagaactcggtccaggagtcgtacccccttccggctttccgaaaaagataggatggagttgctggaaatagctaagacaaatgccgcaaaggccctagggaccaccaatattgatctcccagcaagcctgaggaccgtgccctccgccaaggaaacttctcggggaataggagtctcttctaacggggctaaacctgaattgtctgaaaaggtgaccgaggacgggactaggaatcccaatgagaagccaacccagcagaggtccattgcatttagctctaacaattcggtggcgaagcccatccaaaaatccgccaaagccgcaactgaagaagcttcgtccagatcacccaaaattgaccagaaaaaaagcccatacggactgtggattcctatttag

SEQ ID NO: 44873 - DNA, 876 bp, Artificial Sequence
  Description of Artificial Sequence: Synthetic coding sequence
atgtggcccggcagcccccaggagaaggacagccccagcaccagccgatcaggcggctcttcccgactcagcagccggagtagatcccggtcatttagcaggagctctagatcgcacagcagggtttcaagcagattctcttcgcggagtcgccgctcaaagtccagatctagatcaaggcggaggcaccagcggaagtaccgtcgatactctcgctcctattcacggtcccggagcaggtcaagatcccgccgctaccgggaaagaaggtacggtttcaccaggagatattacaggtcccccagccgttatagaagccgctcgaggtccagaagcagatcccgaggccgcagctattgcggacgtgcgtacgccatcgcgagaggacaacggtactatggctttgggaggacagtgtacccagaagagcactcacggtggcgtgaccggagtcggactcgaagcagaagcaggacaccattcagattgagtgaaaaggatcggatggaactgcttgagatcgccaagaccaatgctgctaaggcattggggactacgaacatagacctccccgctagcttgcggactgtcccatcagcgaaagagaccagccgtggcatcgatattgacgaggaaaatttgctagtcatcgatacctgggcaaaggcctcagagctttcggagaaagtgaccgaggatggtacccgcaatccgaatgagaagcccacccaacagcgcagcattgccttctcctccaataatagtgtcgccaagcctattcaaaaatcggctaaggccgcaaccgaggaagcttcatccagatctccaaagatcgaccaaaagaagagtccttatgggctctggattcctatatag

SEQ ID NO: 44874 - DNA, 681 bp, Artificial Sequence
  Description of Artificial Sequence: Synthetic coding sequence
atgagcaactacgtgaacgacatgtggcccggcagcccccaggagaaggactcaccctcgacctccagatccggtgggtcctctcggctcagctcccgaagcagaagccggtcttttagtcgtagctcaaggtctcattcgcgggtgtcttcccgcttttctagccgctctcggcgctccaagagtagaagtaggtcacgaaggcgacatcagcgaaagtacaggagatacagcaggtcttactcgagatcaagaagtcgaagccggagccggcggtacagagagcggcgttacgggttcacccgaagatactacagatctcccagcagatatagaagtagatctagatctcgttctcgttctcgagggagatcgtattgcggaagggcctacgccatcgctaggggccagaggtattacggctttggccggacagtttaccctgaagaacatagcagatggcgtgaccgatcccgaactcggagtcggagcagaacaccattcaggctcagcgaaaaagatagaatggaattgctggaaatagctaaaactaacgcagctaaggccctgggcacaactaatatcgacctcccagccagcttgagaactgtgccaagcgcgaaggagacatctcgcggcatcggggtgagctctaacggtgcaaagccggagaaatcctag

SEQ ID NO: 44875 - DNA, 525 bp, Artificial Sequence
  Description of Artificial Sequence: Synthetic coding sequence
atgagcaactacgtgaacgacatgtggcccggcagcccccaggagaaggactcaccatccacctctcgtagcggcggctcatctagattgtcctctagatcaagatcccgctctttctctcgctcaagcaggtctcatagcagagtgtcatcacggttctcatcccgatctcggcgcagcaagtctaggtctcgttcaaggcgtagacaccagcggaaataccgtagaactgtgtacccggaagagcattcaaggtggagggacaggagtagaacacggtctaggtccaggacacctttccgcttgtcggagaaggacagaatggaactcctggaaatagcaaagacgaacgcggcaaaggctctcggtaccacaaatattgacctgcctgcctccctcagaacagttccttcagccaaagaaacaagtaggggtatcggagtttccagcaatggagccaaacccgaggtttccattctggggctttctgagcagaacttccagaaagccaattgtcaaatttag

SEQ ID NO: 44876 - DNA, 510 bp, Artificial Sequence
  Description of Artificial Sequence: Synthetic coding sequence
atggcccccagcgaggacccccgggactggcgggccaacctgaagggcacgatcagggaaactgggctggagacctctagcggcggaaagttagcaggccatcagaagacagttcccaccgcacatcttacctttgtgatcgattgcacccatggcaagcagttgtctctggcagcaactgctagtccccctcaggctccgtctccaaaccgggggctcgtgaccccacccatgaagacctacatagtgttttgcggtgaaaactggcctcatctgacacgggtgacacctatgggaggtggctgtctcgctcaagcgcgggccactcttcccctttgcagagggagtgtggcatcggcgtcctttccagtaagcccactctgcccccaggaggttcccgaggcaaaaggtaaaccagttaaagccgctccagtccggagttctacatggggcactgttaaagactctctaaaagccttgtcatcttgtgtttgcggtcaagccgactag

SEQ ID NO: 44877 - DNA, 1872 bp, Artificial Sequence
  Description of Artificial Sequence: Synthetic coding sequence
atggccggcttcagccacttcagccagcccccctaccgggacctgtgggaacccccgcgccccggcggagagcgagagtcgacgcagcgcctcggtggacagagaagcggggcagacagtactgcctgctctcgtgcagggacacctggtgcagaatccgaggccggagcgtgttggctgcaccctcattgttctttcacgccgcgacctaggagaaggggctgcagtgatagtctgcgggggtccagatcgctgtcagacgtcgctcgccgtcctcttgagcgatcaaggaaacaccgcccaagatcacgccggctggaagacgcctggggagagacaggcacaaaaccacgcccagcctggcagccccagactcagttacccccacagagaccccagccatgcccccattatcctctggcccagggtgattcgccgcctccctgcccaggcggggctggtacacctctgagcggaactttcagagtcgagaaagcccagggcggcgaccagtgggcggttccattaggacgccaccttggccggtggagtccatccagcgtgcctagtgagcggtcttcagtgccgtctcagaagttcaaacgccatagcgcctgtgtgtgcgcgcagaaacgcgacagttcagaccaagtagagtctctagcttcccgcgactcccagcccctcgcctctagtaaggaaatgcggtctccacacacacaggttctgaagtctaaactggaagaggtagttgtctcttcacaggatcagcagatcgttgctctcgtgttgactaggctaaagaaggcacagagaatacgggaattgcaacagcaggccgccaaagcctgggaggagttaaaacggagcgatcagaaggtgcaaatgaccctggaaagagagcggcggttgctcctgcgccagtcacaggagcagtggcaggagaaagaacagcgaaaaacactccaatccccggaacaacgaggcttgcgcagggattcacaacgaaagaatgtacctcccggcgagagcagatggaaagaacagccagaagatcaggagtccccccgtcaggagaagctggagaaggctcgcgctcaggcagaacatcggaagcaatgccaggtgcgccgcctccgcgagcaggagaagatgctaagaaaccttcgggagcagcatagtctgcagctgcagcgcagattggtggaagcctgcaggaagaggcatcttcacgcagtggaagggcagaagaaggtccaggatacaaacttatccagtctcattaattatcaggcgcggaaagtgctcatggattgccaggctaaggcagaagagctcctgaggcaactttccctcgagcagagttttcaaagatcccaggaaatacatcaaggactgaggaaggagcgccagcgtgaactacgagaaaaagcccaaaaagaggaagagcaactgcaacaggccagatggcgggctggcgagtcagaagagcaacggaaaatgcggaagcgaatccttgtggagcttgccgacgagaagatcagacaagcgcgaagccatgtgcacaagacaaccagggacaaagtccagcacctgcgagagctgaatcacttaagggagaagaatcatcatatcctgaagctcaaggcggaaaaagaggagaaatgtcacatcgaaggtatcaaagaggccataaagaaaaaagagcagagagttcaacacataagccagggcaaagaccctaacttccaggaatttcagaagttaccgcaggcatctcgcagagaggaaagagcacctccaaattccagccttgatcagatggttttggaggctcagcttcgcgcttgccagcagaacaggggctattag

SEQ ID NO: 44878 - DNA, 753 bp, Artificial Sequence
  Description of Artificial Sequence: Synthetic coding sequence
atgtgcgaccagcagaagcagccccagttcccccccagctgcgtgaaaggatctggactcggagccggacagggcagcaatggggcttcagtaaaatgtccagtgccttgccagactcagaccgtgtgcgtgaccgggccagccccctgccctacacagacctatgtgaagtatcaggtgccttgtcagacgcagacgtacgtaaaatgtccagcgccttgtcagcgtacctacgtgaagtaccctactccttgtcagacttatgtcaaatgcccagcaccttgtcagaccacttacgtgaaatgccccaccccgtgtcagacatacgtgaaatgccccgcgccctgccagatgacctatatcaagagccccgctccatgtcagactcagacctgctacgtccagggcgcgtctccctgccagtcctattatgtgcaggctccagcttccggctcgacctcccagtactgcgttactgacccttgctccgccccatgttctacatcttactgttgtctagcccccaggacgttcggggtctctcccctgaggcggtggatacagcgcccccagaattgcaacactggatcctccggctgctgcgagaattcaggtagctcaggctgctgcggttcaggcgggtgtggctgttcatgcggttgtgggtcctccggttgctgctgcttgggcataatacctatgaggtcccgaggaccggcgtgttgtgatcatgaggatgactgctgctgttag

SEQ ID NO: 44879 - DNA, 753 bp, Artificial Sequence
  Description of Artificial Sequence: Synthetic coding sequence
atgtgcgaccagcagaagcagccccagttcccccccagctgcgtgaaaggctctggcctaggtgccggccagggctccaacggggcttcagtgaaatgtcctgtcccctgccagacccaaacagtttgtgtcactggcccagccccttgcccaactcaaacctacgtgaaataccaggtgccgtgtcagacgcagacctatgttaaatgccccgctccctgccaaagaacttatgttaagtatcctacaccttgtcagacatacgtgaagtgcccagcaccatgtcagactacctatgtcaaatgtcccaccccatgtcagacttacgtgaaatgtccagccccctgtcagatgacttacatcaagagccccgccccatgccagacgcagacctgttatgttcagggggcatccccttgtcagtcctactatgtacaggctccagcttcaggttcaacgtcgcagtactgtgttacagatccctgcagtgccccctgtagcacctcctactgttgtttggctcctaggacatttggggttagcccactcaggcgctggatccagaggcctcaaaactgcaatacgggcagttccggatgctgcgagaactctgggtcttcgggctgctgcggtagcggcgggtgcggatgcagctgcgggtgtggaagctctggatgctgctgtttggggatcatcccaatgcgctccagggggccagcttgctgcgatcacgaggatgattgctgctgttag

SEQ ID NO: 44880 - DNA, 810 bp, Artificial Sequence
  Description of Artificial Sequence: Synthetic coding sequence
atgctgctgctggacctgatgagcagccccagcccccagctgctggttgcagctgcccagcagactctgggtatggggaaacgtaggtcccccccacaggctatttgcttgcaccttgctggcgaggtactggcggtggctcgaggtttaaaacccgctgtcttgtatgactgtaattgcgcgggcgcctccgaactccagtcatacctggaagaactcaaggggctcgggttcttgacctttggactgcacattcttgagattggtgagaacagcctgatcgtgtcccccgagcacgtgtgccagcatctggagcaggtcctgctggggactatcgcttttgtggatgtgtcctcatgtcagcggcatccttccgtgtgtagcttggaccagctgcaagacctgaaggcactagtagcggaaatcataactcacttgcagggcttacaaagggacctatccctggccgtgtcctactcaaggttacattcaagcgattggaatctctgcaccgtatttgggatattgctgggctaccctgttccctataccttccatcttaaccagggcgacgataactgtctggctctcaccccccttcgggtgttcacagcaaggatctcctggctgctcggacagccaccaatccttctctacagtttcagcgttcccgagagcctgttcccagggctccgtgacattctaaatacttgggagaaggacctgagaactagattccgcacccaaaatgattttgccgatctgagtatctcttccgaaatcgtcacgcttcctgcagtcgcactgtag

SEQ ID NO: 44881 - DNA, 552 bp, Artificial Sequence
  Description of Artificial Sequence: Synthetic coding sequence
atgcggggcagcgtggagtgcacctggggctggggccactgcgcccccagtcccctgttgctgtggacgttgttgctgtttgccgctccttttgggctgttgggcgaaaaaacccgtcaacttttggaattcgactctaccaacgtgagcgacaccgctgccaaacctttgggccgcccttaccctccctacagtctggctgacttttcttggaataacattacagacagcctggaccccgctaccttatctgccacttttcaggggcaccctatgaatgatccaacgaggacgttcgccaatggctccctcgctttcagggtccaagctttcagtagaagttctagacccgcgcagccaccaagattactgcataccgccgacacttgccaactagaggtggccctaatcggggcctctccaagaggaaatcgatccctctttggcctggaggtggcaacactgggtcaaggcccagactgcccatcaatgcaagagcagcactcaattgatgacgaatatgcccccgcggtctttcagaggcgtgattag

SEQ ID NO: 44882 - DNA, 852 bp, Artificial Sequence
  Description of Artificial Sequence: Synthetic coding sequence
atgtgcggccccgagcacctgctgtgctgccccaaggacctggccatgttccctcgacaactttccctgacagcatgtctgcccggaacacctgtatcacataaatgtcatcacatttggttgtgggtgggcgtgcccgcttggcatcctagggcttccagatgcgggggcgctcagcctagttcgtggctccggcagaaggccgcccgggccttttggctcagcttacccgcagccaaactgcgtcatcacagctcccgctggctcaggcgaagtggcgccttctcctccggttcaactcttaaaccccctcccagcccttccccagcccctttgtgccacgcagacaacctgcggacgggtcgaaccagaccgtcaggaggaagaccgtggttcctcttggggggagacgagcgagagcggctgtgggccgaacttctcaggaccgttagtccagaattaattctggatcatgaggttcccagcttgccagccttccctggtcaagagccacgctgtggacctgagcctacggaagtattcacagttggtcccaaaacgtttagctggacccccttccccccggacctctgggggcctggtcggagctatcgattattgcatggcgccggggggcacttggagtccccagcacggagccttccacagaggccagcacctgacccttgtcgagcccccagggttgagcagcagccatctgttgaaggggcagctgcactcagatcatgccccatgtgtcaaaaagagttcgctccccgactgactcagctcgacgtggatagccacctggcgcagtgcttggccgagtccaccgaggacgtgacttggtag

SEQ ID NO: 44883 - DNA, 543 bp, Artificial Sequence
  Description of Artificial Sequence: Synthetic coding sequence
atggaggccgcccggcggccccggctgggcctgagccggcggcggcccagaccagcaggcggacccagcggcggccgaccgtggttcctcctgggaggcgatgagcgcgaacgactttgggccgagctacttcgcacagtcagccccgaactgatcctggatcatgaagtgccatcgttaccagccttccctggtcaggagccccggtgtggacctgagcccacagaagtgtttaccgtgggccctaaaacattcagttggaccccatttcctccggacctttggggtccgggccgatcgtacaggctgctgcatggcgctggcggccacctggagtcccctgctcgctctttgccacagagacctgctccggatccctgccgggctccacgagtggagcagcagccttctgtcgaaggcgctgcagccttgcgctcctgtcctatgtgtcaaaaggagttcgcgccacggctcacccaactggatgtagattcccacttggcccaatgtctcgccgagtcaaccgaagatgtgacctggtag

SEQ ID NO: 44884 - DNA, 444 bp, Artificial Sequence
  Description of Artificial Sequence: Synthetic coding sequence
atggaggcctggggcctgtgcgcctggccccggggcctgcggggcaattttcatacttgtgcaccgggcctgactcagaggcacgaggtggcgaggccccctctccctggcagctccgaagacgggtctgccacacccgatacttggcagttggccgctctaccattggggtctctttccagtggccagctctgtctccatctccgagggacttccacccccgcacccacatgcgtgccgctcgcccctaagctccctccctacgtctgggtggcgagcgagatgtggggaaggcggcattcacgtaagaaaggtatacggggggcttctacttcaagcgagcacttcattcctcaagatgctacaagaagcctgtcgtggaggtccagaagcgtgcacagagtgctgtttccctggaagatgtgcacactggagaccgcttag

SEQ ID NO: 44885 - DNA, 339 bp, Artificial Sequence
  Description of Artificial Sequence: Synthetic coding sequence
atggaggccgcccggcggccccggctgggcctgagccggcggcggccccgacccgccggcggaagcccaggcgcagctcggtcacccctgaaatctagtctttcagacccacgaccgtttcccggccacccattccggaggacctgcggcgccagggcagtccctacaggttgttttaccggacaagaaggcacttggaatccacctccagggccgtgcccatctgcgagacaccttattcccgctgggcctcctggctggtcttcttccaggctgtggcgggtgcccagaccatgcgcagccgcaccatgcgcgaggcgctcatctcccccaggctag

SEQ ID NO: 44886 - DNA, 588 bp, Artificial Sequence
  Description of Artificial Sequence: Synthetic coding sequence
tgagaggccgcccggcggccccggctgggcctgagccggcggcggccgcgccctgctggaggtccgtcaggtgggcgcccttggttcctgctggggggagatgaacgcgaaagactctgggccgagctcctacggacagtgtcaccagaactcattttggaccacgaggtaccaagcctgccagcttttcctgggcaggaaccaaggtgcggacccgagccgacagaggtttttactgttgggcctaagaccttctcttggacccccttccccccagatctgtggggcccgggtagatcctatcggctccttcacggcgcaggcggacacctggagtcccccgccagatctttgcctcagcgcccggctccggacccttgcagagcccccagagtcgagcagcaaccctcggtggagggcgccgccgcgctgaggtcctgccccatgtgccagaaggaatttgcgccgcgcagcaagaatagttcgggtatgcggcgtcacagatctcccaagcttgccgccaataataacaacaataaacgtaagggccgcgctcgctggctcactccagtaattccggccctgtag

SEQ ID NO: 44887 - DNA, 1641 bp, Artificial Sequence
  Description of Artificial Sequence: Synthetic coding sequence
atgagcagcgcctggaagaccccccggggcagcgacgccatgcccgagattatggtcaagattatcgggagtaagcattttcaatacctggtggaaaagccaaagatcaaggaaaatgactctctcaagaccgagacccagactatgcaccagaaacccatgactgacaatgctagacagatgagtagggatacgcctgtgccgattaacttcacagatcagcaaacaacagacaaccccgacgacgtgaaagagaagaagcaccccgaaaacaatcagaaaagtgagaataaccagaagctgctgaccggcgcaaatagttctcgcttcctcgacggaaatatcccgagccaggccaacgtgcactgctcttcagtacctacaggtgatcaaagtctctcctatgtgcacggcatcccgcggcgcaaacttagagactggagtctcgaacagatggtgaggggtagttccgatcagccagaagatatcggacagtcccccagcgggaccaccaacgaggatgcttttctgctcgctctggtgaggagagagcttaaaagtagaccactatcatccaacctcctggagaaacttcagaaagagttaaaaatcctggaccctatctcaagcggcttcctgttgcagtcacagctcagcaggttatttctcaagcatgaggtcccattacagttgccaacagttaagatcttgtgtcagcgcttcagcaaacggggaagtcctgaaatggtgaactacgaaaagttgctctggttccttaactctgctgcgagcgattacccgcaacaaaacaaggcggctgctgacttaagaaaaacggagtcacatggaactcactctcagtctacccctccgcagcatagcagctcgcagcccgaagtgaaccggtctctgctggagatcctcaaaatggccctccggaccaccaatggccggctgaatatagataacctgaacttaagttttcggaaagaagatcggtcgtttagtggctgcctgcctctccccaaagtgagggctatctgtggtaagcacgggctctatctgaccctgagcctgctcgagaccctgctcaatcaccaggacctagggtaccagaacgagatcaagtggcagaattttgtggagatgttgaccagagcaagtagtgacctgcttagtgacctacccactggcaagaatgaaaaaaaggcccccgcaccgcccatggagcccgaggtgcctgagatgagtcagagcaagaccgaacatatgaaaacgcctgaagaagaactccagcccgaatcttcaccagctgagacatcagcttgcaaggaccccctaaagcccttgaagatccgaccagtcagtcagcctttcgtaaatcctgctgtgaagaataaagctgaggagtgcgagacttggatcgatagatttcgcaagttggagaacgctttgtacctatgtgatctatctaatacaggggttctggaaaaggagcgagcacgtcgattgatacacaattataacttaatttataacttatcattaagtccgcagaaaatcgatcaagctctgcgtaggttccgaagcggtgagaatatgctacttgagccagctttgagatacctgaaagagctatag

SEQ ID NO: 44888 - DNA, 543 bp, Artificial Sequence
  Description of Artificial Sequence: Synthetic coding sequence
atgagccggggctgcagcagcgacctgcggttccacacctggctgggccttcgcatgctgaaaaacattatcgcagtggcattattaatgctgggaaaaaatgagaaaaaggcaccagctccccctatggagccggaggttcctgaaatgagccagtctaagaccgagcacatgaaaacaccagaagaagaattacagcccgagagctctcctgctgaaacatcagcttgcaaggaccccctgaaacctcttaaaatccgtcctgtgagccagcctttcgtgaaccctgcagtaaaaaacaaagccgaggaatgcgaaacctggatcgaccgctttcggaaacttgagaatgccctgtatctgtgtgacctcagcaatactggagtacttgaaaaggagagggcccgtcggctgattcacaattacaatttaatctacaatctcagtttgagtcctcaaaaaatagaccaagcgctgagaagatttaggagcggcgagaatatgctgcttgaacccgccttgaggtacctaaaagaactctag

SEQ ID NO: 44889 - DNA, 714 bp, Artificial Sequence
  Description of Artificial Sequence: Synthetic coding sequence
atgagcagcgcctggaagaccccccggggcagcgacgccatgcccgaaatcatggtgaagataatagggtctaaacattttcagtacctggtcgaaaaaccaaaaataaaggagaatgactctttgaagaccgagacgcagacaatgcaccagaagccgatgaccgataatgctcgccaaatgagtcgcgatactccggtcccaattaatttcacagaccaacagactactgataaccccgatgacgtgaaagaaaagaaacatcccgagaacaatcaaaaatccgagaacaaccagaaactactgactggtgccaactcaagtcgattcctggacggtaatgtgagagcaatctgcggcaaacacggcctgtacctgactttaagtcttttggagactctcctgaaccaccaagacctgggctatcagaacgaaattaaatggcaaaacttcgtcgagatgctcacaagagccagcagcgatctgctgagtgatctacccaccggcaaaaacgagaaaaaggctcctgccccaccaatggaaccagaggtgcctgagatgtcccaaagcaagaccgagcatatgaaaacacccgaagaggagttgcagcccgaaagtagcccggcggagactagtgcctgtaaggatcctctcaagccactcaagatacggcccgtcagtcagccttttgttaaccctgcggtgaagaattag

SEQ ID NO: 44890 - DNA, 276 bp, Artificial Sequence
  Description of Artificial Sequence: Synthetic coding sequence
atggtgtgctacctgtactgggagaccttccccagcatcagccacctgctaaaaataaccctctccgccagggactgccacgtgtgcggtctcaacctatttattttcatggacccggtggaaaatcaagccctccaccctgtgatcatggctctaattcttatgccctcgctccattgctttggaaatatccttattcttctttttcttaagtcccctgcacaactcttctgtcgtatgtctgtagacctcgccctcctgttcccacataaatag

SEQ ID NO: 44891 - DNA, 264 bp, Artificial Sequence
  Description of Artificial Sequence: Synthetic coding sequence
atggagcggaacaccatctacaccggctggctgcagagcaacctgattttagacccagtagaaaaccaggccctccacccggtgatcatggctctaattctgatgccaagcctgcattgttttggcaacatcctgattctgctcttcctgaagtcgccagctcagttgttttgtcgaatcgggagatttgaaacaggggaagagaagacccgacggagagagggttcagacgtaaccactgaagccgccattggggtcatgtag

SEQ ID NO: 44892 - DNA, 447 bp, Artificial Sequence
  Description of Artificial Sequence: Synthetic coding sequence
atgcccggcggcgacaccacccccgaggaggccgccgcccccagctgtgcgggctataatcccggtttactcctgtttagagcacaaaaagcccagggagcttgcgtcaccagcactgaaggggcctggccacgccgcgcctctgctttgtacggcggtcgcaaaatgaggtgtggcgaatctggcgccggacccgatcctaggagtaactctgcagaagtgagcagctcacagccagccctggcctcaaaatctcaatcgaagtggggcccgactagcaacaatcctagaggcgcccttacaaccaccgagttcgagatggccggcaatagatcccagaatatcaaacacaaacaaacagccctcattgcaatccctatgagcagccaaactccacgcatgctgggtagaccacggaaccagggccagctgtatccacagccttag

SEQ ID NO: 44893 - DNA, 627 bp, Artificial Sequence
  Description of Artificial Sequence: Synthetic coding sequence
atggacttcagcatcatccagtacagcaagttcatgaccctgctggctatgtcccttcagaatttaaagacgctgcatatgagcctggaggagtcaatcaaatggctgggcgaggtgatggccgagatcggacctactcactcacagaagagtgaggattggaatatcttcgacgtcaaacaagcaaatgctataattgactatctgaaaatttccttatttcagcactataaattatacgaattcatgttttacagcgcacgtgaggaaattgttataggaactgaacaggtaatcgaggtagtcaagtcggcgtgtggtcccttcccaaatccactcgaggagggaattagctttgacatctattctacattcattgagcctcctacaatcctggataccgagatgaagaggctggatcaggagcaggggcctgaagagtcacaacccgagacagacacaagcgatatggacccgctggtcggtttcaccatcgaggatgtgaaatcggtgctggatcaagtcacagatgatatactcatcggcatacagacagagattaacgagaagctgcagattcaggaggaagcttttaatgcccgcattgagaaacttaaaaaggcctag

SEQ ID NO: 44894 - DNA, 255 bp, Artificial Sequence
  Description of Artificial Sequence: Synthetic coding sequence
tgagccgaccccggcggcaaccacgcccggatcggcgccctgcacatgtcattagaggagagcataaaatggctaggtgaggtcatggccgaaataggacctacacatagtcagaagtctgaagactggaacattttcgatgtcaagcaggctaacgccattatcgactatttgaaaattagccttttccagcattataagctgtatgaatttatgttctatagcgccagagaggagatcgtcatcgggacatag

SEQ ID NO: 44895 - DNA, 597 bp, Artificial Sequence
  Description of Artificial Sequence: Synthetic coding sequence
atggagagcagccggtgggacaaggacccccccggcgagcggcggccccagcagagccagcactggcggtcatgtggggtgggcggcgccggtgaagcgactagaggtggtctattccctgtgccttttccatcaggtgacagctggcccgaggttactcagcattggatgaggttccagggtcaggggccatggtgcccaggtctttggactacgccagcccatagtcactgcaagcctcaaactggagcagttgataacgcgtcaccaagacagccccatgcccccgatcagcacgagaagaatgcagggcgacagcatctacatctgtggtctctcgcttgcccaccttggcttcacagcatccctcatatcaaaggcaccattctgtcagaggcactatccggctttctggtgagtgaccgcaggaccaaaaccgtcgcaggcctacgttggctatggctaaggaaagaagccacacccactgcatcccgaacaacgctcagctctagcctggcgccccgcgggagaggcgtaaacactctcggaagagggggatgtacactcatggtgctgtcttcggacctgtgtgactag

SEQ ID NO: 44896 - DNA, 666 bp, Artificial Sequence
  Description of Artificial Sequence: Synthetic coding sequence
atggagagcagccggtgggacaaggacccccccggcgagcggcggcctcagcaaagccagcactggagggcaagggatcacggggccaggggctgtggaccccgccagcccaccgccaccgcctccccacggccgggactatggattacaccggctcatgggtcgcacacaccacaaacaaatacaaggcggactcaggccgataatatttttatatacgagtcatggctgattcaccacggaacacaaatgagcagtgtcctcccccagcctcctctcgtgcggggaccctggcacaacacaaactctccatgggactcatgggccagccgaggcaaactgcgtgtttgtccatgccgtaccccccggctccactctagcgggtgtttttcctcaaaggctgggaccgctctctccccctccttaccagtccccgggttgcgccctcagcctcctttcttacagaagcccctgtcaatcctcgcgccagctacacctcctgcattggtcagccctacacctcctaagttgagccccggacagctcagcccgcactcagttaacgtgcattggggccctcagggccacctacatctgccccggtctggtaccacagtcctgcacgcctatctccagacattatcttcacccgccagccatcaatag

SEQ ID NO: 44897 - DNA, 681 bp, Artificial Sequence
  Description of Artificial Sequence: Synthetic coding sequence
atggccggcctggtggtgcggggcacccaggtgagctacatcggccaggactgccgtgaaatccctgaacatcttgggagagattgtggccatttcgcgaagcggctggacctgtccttcaacctgctgcgcagcctggagggtctgtccgctttcagatcccttgaagagttaatactcgataataatcaacttggtgatgatttggtgctgccaggcctgcccaggctccatactttaacactgaataagaaccgcattaccgatttggagaatcttctggaccacttggctgaagttacaccagccctggagtacctgtcacttttgggcaatgtcgcctgcccaaatgaattggtgtctttggagaaggatgaagaagattataaacgataccgctgcttcgtgctgtacaagctaccgaatttgaagtttctagatgcccagaaagttactagacaagagagagaagaggcactggtgcggggcgtctttatgaaggtggtgaaaccaaaggctagttcggaggacgtggcatcatctcctgagcgacattatactccactgccaagtgcgagccgtgagctgaccagccatcagggggtgttgggcaagtgccggtacgtgtattatggcaagaactctgaaggaaaccggttcattcgagatgaccagctgtag

SEQ ID NO: 44898 - DNA, 597 bp, Artificial Sequence
  Description of Artificial Sequence: Synthetic coding sequence
atggagaagtacctgagcctgagcggcaaccacagcagcaacaagcgtagtctcgaagggttgtctgctttcagatctctcgaagaactaattttggataataaccaattgggtgatgacctggttctgccaggactaccccggctgcatacgctgactctgaacaagaatagaatcactgatctggaaaacctacttgatcacctcgccgaagtgacccccgccctggagtacctgagcctattggggaacgtggcctgccccaatgaattggtctcactggagaaggacgaggaagactataagcgatatcgctgttttgtactttataaactgcccaaccttaagttccttgatgcccagaaggtcaccaggcaggagcgggaagaggcccttgtccggggagtgttcatgaaggtcgtgaagccgaaggcaagcagcgaagatgtggcctcttctccggaaaggcattacaccccactaccaagcgcatctcgagaactgacgagccaccaaggcgttctaggcaagtgtcggtatgtgtattatgggaaaaacagtgaaggaaatcgctttatcagggatgatcagctctag

SEQ ID NO: 44899 - DNA, 438 bp, Artificial Sequence
  Description of Artificial Sequence: Synthetic coding sequence
atggagagcatggcccccgagatcagcgaggacatcggctgccccttagcgtacatgcgcgagagtgtgtgcgcgcttctcatcaaccagtcgtttttttcttgcgtggccgaaatgtatataccagatatgaatcgacctggcaaagctgagcggcgagctgagaaaggactgcggcctccccgtaagctggttggcgagactcgtaggttgcagtcctggcctactctcgccaggtggttaagaagagtctctttcagcctgtataagcccccaattcaggctgctcccgagcccgatcccggtaattgggccaagtcacctagactttcgcttggacctgaaggtataaccaaaggtaaacacggtttcaaatttcaggggataaaagagaaattcaatgtgtcgaagaaagtgctgaaaatgacatttctttag

SEQ ID NO: 44900 - DNA, 240 bp, Artificial Sequence
  Description of Artificial Sequence: Synthetic coding sequence
atggccaagagcgagcggcggatctacagcatggagagcatggcccctgagatatctgaggatattggttgtcccctggcttatatgcgcgaatccgtgtgcgcgttacttataaaccagtccttcttctcttgtgtggccgagatgtacattccagatatgaataggctcgaggaaaggaccgcagctctgtatccgatcggactggttcggcagaatggtgagcctagacgagcctag

SEQ ID NO: 44901 - DNA, 468 bp, Artificial Sequence
  Description of Artificial Sequence: Synthetic coding sequence
atggccaagagcgagcggcggatctacagcatggagagcatggcccctgagatctcagaagacattggctgccctctggcttatatgcgagagtccgtgtgcgcacttctgataaaccagtcatttttcagctgcgttgcagagatgtatatccctgacatgaacagaccgggaaaggccgagaggagggccgagaaggggttaagacctccccgtaaactagtgggcgaaactcgcagactacaatcctggcctacactggctcgttggctcaggcgcgtgtccttctccctttataagcctcccatccaggccgcacctgaaccagatccgggcaattgggccaaaagcccacggctttccctcggccctgaagggatcacaaaaggcaagcatgggttcaaattccaggggattaaggagaagtttaatgtgtcaaagaaagtcttaaagatgacttttttgtag

SEQ ID NO: 44902 - DNA, 411 bp, Artificial Sequence
  Description of Artificial Sequence: Synthetic coding sequence
atgcagagccgggagcccagcggctggcggaccgccgagcggcggcgcgggtggaggtgcagaggcgtgcctacgccttccggagatcgcggccctggcgccgcacgtccagcagctcggggtggagctggagaaaccaccggacagcaacgacccctgcaggtgcccggagcgtcagcagcagcagcccgcacacggctgttacggtggcatcaccgggtaccgtcgccccgggctacgcgcagccctggttctatccggaggacctctccctgttccggaggccccgatcggcctgagcggcctgaatgcgcagacgcgtgctgctacttattggacccttttactctccccctgattcaggactttttccgtggctgcgccgcgagcgacttcgatagaagggactag

SEQ ID NO: 44903 - DNA, 285 bp, Artificial Sequence
  Description of Artificial Sequence: Synthetic coding sequence
atgttcacccggcacaccctgttccggcagttcgccgtgctggccgatactagtttcaattatatcaaggtcaaacccctactagttcagtcaaggacgactatgaccgcaataagcagctcctcacactgcacaagcagtattgatgggaagcatgtcgatgtggtgtctgatcaagctgctcttcagctgtctcccaagggtaagctcagcgagagcccgaaagaagagagtcttgaagagccctcaatgcgtcagtcaagcccagccgagaccgtcgactag

SEQ ID NO: 44904 - DNA, 285 bp, Artificial Sequence
  Description of Artificial Sequence: Synthetic coding sequence
atgttcacccggcacaccctgttccggcagttcgccgtgctggccgatacctcattcaactacatcaaagtcaagccgctgttagttcagtccagaactaccatgaccgccatatcatcctcaagtcactgcacctctagcattgatggaaaacacgtggacgttgtctccgaccaagccgcgctccagctatcccccaaaggcaagctatctgaatcccctaaggaggagtccctcgaggagcccagcatgcgccagtcatcgcccgccgagactgtagattag

SEQ ID NO: 44905 - DNA, 168 bp, Artificial Sequence
  Description of Artificial Sequence: Synthetic coding sequence
atggccagcaagggcctgcaggacctgaagcagcaggtggagggcaccgcacaagaagcagccatggatcagctcgctaagacaacacaagagactatcgacaaaacagccaatcaggcctcagacaccttcagcggcatcggaaaaaaatttggtctgcttaaatag

SEQ ID NO: 44906 - DNA, 231 bp, Artificial Sequence
  Description of Artificial Sequence: Synthetic coding sequence
atggccagcaagggcctgcaggacctgaagcagcaggtggagggcacggcccaggaagccgtctcggccgcaggagctgctgcccagcaggtagtggaccaggccacagaggccggacagaaggcaatggatcagctggcgaagacaactcaggaaacaatagacaagaccgctaaccaagcttctgatactttttctggcattgggaagaaattcggcttgctgaaatag

SEQ ID NO: 44907 - DNA, 117 bp, Artificial Sequence
  Description of Artificial Sequence: Synthetic coding sequence
atggccagcaagggcctgcaggacctgaagcagcaggtggagggcactgcgcaggaagccgccatggaccagctcgctaagactacccaggaaacaatcgacaagaccgctaactag

SEQ ID NO: 44908 - DNA, 636 bp, Artificial Sequence
  Description of Artificial Sequence: Synthetic coding sequence
atgagcgagaccgaccacatcgccagcaccagcagcgacaagaacgtaggcaaaacccccgagctgaaggaggatagctgcaaccttttcagtgggaacgagtccagtaagctggagaatgagtctaagttgctttctctcaatacggacaaaacactgtgtcagcctaacgaacacaataatcggatcgaagcacaggaaaattatattcccgatcatggtggaggcgaggacagttgcgctaagaccgacactggtagcgaaaattctgagcaaatcgcaaactttccttccggaaactttgctaagcatatcagcaagacaaatgagacggagcaaaaggtgactcagattctggttgaactccgatctagcaccttcccagaatccgcaaatgagaagacgtactcagagtcaccttatgatactgattgcacaaaaaagtttatctcaaaaattaaaagcgtctccgcatcagaggacctactcgaggaaatcgagagcgagttgctttccactgagtttgccgagcaccgcgtgcctaatggaatgaataagggcgagcacgcgcttgtgctcttcgagaagtgcgtccaagacaagtacctccaacaggagcatataattaaaaagtag

SEQ ID NO: 44909 - DNA, 636 bp, Artificial Sequence
  Description of Artificial Sequence: Synthetic coding sequence
atgagcgagaccgaccacatcgccagcaccagcagcgacaagaacgtcggcaaaacccctgagttgaaggaggactcctgtaacctctttagcgggaatgaatccagcaaactcgaaaacgagtctaaattgctctcattgaatacagacaaaaccctctgccaacccaacgaacataacaatcgaatcgaagcacaggaaaactacattcccgaccacggagggggtgaagactcctgcgccaagaccgacacaggctcggagaactccgaacaaatagccaattttccatccggcaactttgcaaagcacattagtaaaaccaacgagacagaacagaaagtgactcagatcctggtggagctgcgctcctccacgtttcccgaatcagcgaacgagaagacatacagcgagtctccatacgacacagattgtacaaagaagttcatctctaagatcaagtctgtgtccgccagtgaggatctgctggaggagattgagagcgagttgctatccacagagttcgcagaacacagggtgcctaacggtatgaataagggagagcacgccctggtacttttcgagaagtgtgtgcaggacaagtacctgcagcaggagcacataatcaaaaaatag

SEQ ID NO: 44910 - DNA, 2697 bp, Artificial Sequence
  Description of Artificial Sequence: Synthetic coding sequence
atgagcgagaccgaccacatcgccagcaccagcagcgacaagaacgtggggaagacccctgagcttaaagaggattcttgcaatttattcagcgggaacgaatcaagtaagttggaaaacgagagcaagctgctgagcctgaataccgataagactttatgccagcctaacgaacacaataatagaattgaagctcaagagaactacatccctgatcatggcgggggagaggatagttgtgcgaagactgatacgggaagcgagaacagcgaacagatcgcgaattttccgtccggcaatttcgcaaaacacatcagcaaaacaaacgaaactgagcagaaggtgacccagattcttgtcgaactgaggagctctacatttcccgagtctgccaacgagaaaacttactctgagagtccgtacgataccgattgcactaaaaaatttatttccaagattaagagcgttagcgcctctgaagatctgttggaagaaatagaaagcgaactcttgagtacagagtttgccgaacatcgcgtgccaaacggcatgaacaaaggagaacacgccctcgtgctttttgaaaagtgcgtccaagataagtatttgcagcaggagcatataattaagaagctcataaaggaaaacaagaagcaccaggagctgttcgttgacatttgttctgaaaaagacaatctgcgggaggaactgaagaaaagaactgagacagagaagcagcacatgaacacaatcaagcagttagagtctcgcatagaggagttgaacaaggaggtgaaagctagtcgtgaccagcttatcgcacaagacgtaacagcaaagaacgccgtccagcagctgcacaaggagatggcccagcggatggagcaagccaataagaagtgtgaagaggcccgacaggagaaggaggccatggtgatgaagtacgtgcgaggggaaaaagagtccctggatcttcggaaggagaaggagacccttgagaagaaactcagagatgccaacaaagaacttgaaaaaaacacaaataaaataaaacagctgtcacaagagaaggggcgactccaccagttatacgaaacaaaagagggcgaaacaacaaggctgattcgagaaatagataagttaaaagaggatatcaacagccatgtcatcaaagttaaatgggcccagaacaagctcaaagcagaaatggactcccataaagaaaccaaggacaagctaaaagagactacaactaaactcacacaggcaaaggaggaggctgaccagatccgaaaaaactgccaggatatgataaagacgtaccaggagtcagaggagattaaatcaaacgagctggatgccaaactgcgggtaaccaagggagagcttgagaagcagatgcaggagaagtctgatcagctggagatgcatcacgctaaaattaaggagctcgaggacttaaagcggacttttaaggaaggcatggatgagctgcgcacgctacgcacaaaggtgaaatgtctggaggacgaaaggctacggacagaggatgagctaagcaaatacaaagaaatcatcaataggcagaaagctgagatccagaacttgctggacaaagtaaaaaccgccgaccaacttcaagaacaactgcaaaggggcaagcaagagatcgagaacctgaaagaggaagtggagtctttgaattccttaatcaacgatctccagaaggacatcgaggggtctcggaaacgagagagcgagctgctcctctttactgaacgccttacttccaagaatgctcagctccagtctgagagcaactctcttcagagtcagtttgacaaggttagctgctctgagtctcagctgcaaagtcagtgcgaacagatgaagcagactaacattaacctggaatctagattactgaaagaggaggaactgaggaaagaggaggtgcagacactgcaagcagagctggcctgtaggcagaccgaggtcaaggcgctgtccacgcaagtggaggagctgaaggacgaactcgtgactcagaggcgaaaacatgcgagttccataaaagaccttacgaaacaactacagcaggcccggcgcaagctggaccaggttgagtcaggctcttacgataaagaggtttctagtatgggttctaggagcagttctagtgggtcactgaacgctcggtcctcagccgaggacagaagtcccgaaaacaccggctcctccgttgcggtcgacaatttccctcaggtggataaggcaatgctgatcgaacgaatcgttcgtctgcaaaaagcacatgctcggaagaatgaaaagattgagttcatggaggaccatatcaagcagctcgttgaggagattcgcaagaaaacaaaaatcattcagagctacatcttaagagaagaatctggcacattgtctagcgaggcaagcgatttcaataaggtgcacttatcccgtcgcggtggcatcatggcttcactttacacctctcacccagccgacaacggcctgacattggagctgtcactcgaaatcaaccgcaaactgcaggcagtgctcgaggacacactccttaagaacatcactctaaaagagaacctgcagactctgggaactgaaattgagcgcctgatcaagcaccagcacgaacttgaacagagaacaaaaaagacctag

SEQ ID NO: 44911 - DNA, 1311 bp, Artificial Sequence
  Description of Artificial Sequence: Synthetic coding sequence
tgacggctgatccgggagatcgacaagctgaaggaggacatcaacagccacgtgattaaagtcaagtgggcccaaaataaattgaaggcggagatggacagtcataaagaaacaaaagataaactgaaggagacaacaactaagctgacacaagcaaaggaggaggccgatcagatcaggaaaaactgccaagacatgatcaagacatatcaggagtcggaagaaatcaagtcaaacgagctcgatgcgaaactcagggtcaccaaaggcgagctcgagaaacagatgcaggaaaagtcagatcagttggagatgcaccatgccaagattaaagaactggaagatctgaagcgcaccttcaaggaaggcatggacgaacttaggaccctccgcactaaggtgaagtgcctggaggacgaacgcttacggaccgaggatgagctgagcaaatacaaagagataattaaccgtcagaaggccgaaattcaaaatctcctggacaaagtaaaaaccgctgaccaactgcaggagcagctacagcgcggtaaacaggagatcgaaaatctaaaggaagaggttgaaagtctgaactctctcatcaacgatctccagaaagacatcgaagggtccaggaagcgagagtctgagcttctattatttacggaacgactcacgtccaaaaacgctcagctacagtctgaaagcaactccctgcaatctcagttcgacaaagtatcatgtagtgagagccaattacagtcccagtgtgaacagatgaaacaaaccaatataaatctagaatcccgtcttcttaaagaagaagagctgagaaaggaggaggtccagactcttcaggctgagctcgcatgcagacagaccgaagtcaaggctctctcaacacaggtggaggagcttaaagacgaattagtgacacagaggcggaaacatgcatcgtctatcaaagatctgacgaaacagctgcagcaggcccggcggaaattagaccaggtcgagtcaggatcatatgataaagaggtctcttccatgggctcaaggtcctcatctagtgggtcgcttaacgccaggagcagcgctgaggaccgaagccctgaaaataccgggagttcggtggcagtggataacttcccacaggtagacaaagccatgctgattgagcgaatcgtgcgactgcagaaggctcacgctagaaagaatgagaaaatcgagtttatggaagaccacataaaacagctggtggaagagatcaggaagaaaacgaagaaaatttataagcatctggagcagaagtag

SEQ ID NO: 44912 - DNA, 3015 bp, Artificial Sequence
  Description of Artificial Sequence: Synthetic coding sequence
gtgggctgcgtgagccaccggggcctgttcctgcccctgctggccggctggactccactgtggaagagctggcctttatcacaatcgtcatccagcttggtccgcgcttggcccgaggcctggatttctggccgaaagaagtcctggatctctagccagaacatctggatccgaattttgttattatccttggacaacttggtaacatgcggaaatcaaaagcgcgaatattctaagaatacccaatatagcccccggtgtaagactaagatcaggtcgaggttcgaagaactccaaagcgagctcgtcccagtgtcaatgtctgagactgaccacattgcaagcacgtcgtccgacaagaatgttgggaaaactcctgagctgaaggaagactcctgcaatttgtttagcgggaatgagtcctccaagttggagaacgagtcaaagttactgtcactgaatactgacaagactctttgccaaccaaacgagcataataatcggatcgaagcccaggaaaactatatccccgaccacggcggcggagaagattcttgcgccaaaacagacactggctccgaaaactccgaacagatcgccaacttcccatcaggcaattttgccaagcacatctccaaaaccaacgagaccgaacagaaagtgactcagatcctggtagagctcagatcaagtactttccctgagtcagcaaacgagaaaacttactcagaaagtccatacgatactgattgtactaaaaagttcataagcaagatcaagagcgtctccgctagcgaagacctcctggaggaaattgagtcagaactgctgagcacagaattcgccgagcatcgggttcccaacggcatgaataagggcgagcacgctctcgtgttatttgagaagtgtgtacaggacaagtacctccagcaggaacatatcattaagaaactgataaaggagaataaaaaacaccaggagctgttcgtggacatctgttccgagaaagataatctccgcgaagaactgaaaaagagaaccgaaacggagaagcaacacatgaacacgatcaaacagttggaatctaggattgaagagttaaacaaagaggtgaaagcctcacgagaccagctcatcgctcaagacgtcaccgccaagaacgcggtccaacagctgcataaagaaatggctcagcgaatggagcaggccaataaaaagtgtgaagaagcccggcaggagaaagaagctatggtgatgaaatacgtacgaggcgagaaggagtccctggatctccgcaaagagaaggagactctcgaaaagaaactgagggatgctaacaaggaactggagaaaaatactaataaaataaagcagttgtctcaggagaagggaaggctgcatcagctctatgaaaccaaggagggagagaccactcgtctcattagagagatcgataagctgaaagaagatatcaatagccacgtgatcaaggttaagtgggcccagaataaactgaaggcggagatggactcgcataaggaaaccaaggataagctgaaagaaactaccactaagctgacccaggccaaggaggaagcagatcagattcggaagaactgccaggatatgatcaaaacgtaccaggaaagcgaagagatcaagtctaatgagttagatgcgaagctgcgggtgaccaagggggaactggagaaacagatgcaggaaaagtcagatcaactggagatgcatcatgctaaaatcaaagaactcgaagatctgaagagaacatttaaagaggggatggatgagcttaggaccctgcgcacaaaggtgaaatgtttggaagatgaaagattgaggacagaggacgaactgtctaaatataaggagataatcaaccggcagaaggccgagattcaaaacctgttagataaagttaagacagccgatcagctccaggaacagctgcaaaggggtaaacaggagatagaaaatctaaaggaagaagtggagagtctgaactcactgattaacgacctgcaaaaagacatcgagggctctcgcaagcgcgagagtgaattactgttatttacagagaggctcacctccaaaaatgctcaactacagtccgagtccaatagcctgcaatcgcagtttgacaaagtttcctgcagcgagtctcagcttcagagtcagtgcgagcagatgaagcagacgaatatcaacttagagagtcgattgctgaaagaggaggaacttcgtaaggaagaggtacagacgttacaggcagagttagcttgcaggcagactgaggtgaaggcactgtctacccaggtggaggagctgaaagacgaactggtgacccagcgccggaagcatgcatccagtattaaggatcttaccaagcagctccagcaagcccgaagaaagctcgatcaggtcgaaagtggctcatatgacaaggaagtcagttctatgggctctcgctcatcttcctccggttcactcaacgctaggagcagtgcggaagatagaagccccgagaataccgggagttccgttgcggttgacaactttcctcaggttgataaggctatgctgatagagagaatagtgcgtctgcagaaagcccatgcgcggaaaaacgagaagatagagtttatggaggatcacattaaacaactcgtggaggaaatcaggaaaaagaccaagataattcaatcttatattctgcgggaagagagtggaacgctgagctcggaggccagtgatttcaacaaagtccatctgtccagaagaggggggatcatggcttcactatacacaagtcatcccgccgataacggacttacactcgagctcagtctcgagatcaatagaaagttgcaggcagtgttggaggatacgctgttgaagaatataactcttaaggagaacctgcagactctgggaacagaaattgaacgcctgattaagcatcagcacgagctagaacagcggaccaaaaaaacatag

SEQ ID NO: 44913 - DNA, 1218 bp, Artificial Sequence
  Description of Artificial Sequence: Synthetic coding sequence
atggacagccacaaggagaccaaggacaagctgaaggagaccaccactaagctgacccaggccaaggaagaagccgaccagataagaaagaactgccaggatatgataaagacgtatcaagaatctgaagaaatcaaatccaacgagcttgatgcaaaactgcgagtcacaaaaggcgagctggaaaaacaaatgcaagagaaatctgaccaacttgaaatgcatcatgcaaagatcaaagaactggaggatctgaagcggacttttaaagaagggatggatgagttacggactctgcggacgaaggttaagtgcctcgaagatgaaaggttgcgcaccgaggacgaactgtccaagtataaggagattatcaaccgccagaaggctgaaattcagaatctcctcgataaggtgaagaccgcggatcagctccaggagcagctgcagcgcggtaagcaggagatcgagaatctgaaggaagaagtggaaagtttaaatagccttataaatgacttgcagaaagacatcgaaggaagccgcaaacgcgaatctgaactgctgttattcacagaacggctgacatccaagaatgctcagcttcagagtgagtctaactccctgcagtcccaattcgacaaggtcagctgctctgagagtcaactccagtcacaatgtgaacagatgaagcagacgaacattaacctcgagagccggctgcttaaggaggaggagctgagaaaagaggaggtgcaaacattacaagccgaactcgcatgtcgccagacagaagtgaaggctctttccacccaagtagaggaactgaaggacgaactagtgactcaaaggaggaagcacgcaagctctatcaaagatctcacaaagcagctgcagcaggctcgcaggaagctcgaccaggttgagtctggatcttacgacaaagaggtgtcatctatgggttcccgctcctccagctcaggtagtctgaacgctcgctcctcagccgaggacaggtcacccgaaaacacaggcagctccgtggccgtggacaatttcccacaagttgacaaagcgatgttgattgaaaggattgtgaggcttcagaaagcgcatgctcggaagaatgagaaaatcgagtttatggaagaccatataaaacagctggttgaggagatccggaagaagactaagaaaatctataagcacctagagcagaagtag

SEQ ID NO: 44914 - DNA, 3744 bp, Artificial Sequence
  Description of Artificial Sequence: Synthetic coding sequence
atgcagagcagcgccctggtggagagcctgatcaccgtgaagatggctgctgaaaactccgaggaaggcaatacttgtatcattccccagagaaacctgtttaaggctctcagtgaagaggcatggaattccggatttatgggtaacagcagtagaacagccgacaaagagaatactctgcaatgtccaaaaaccccgttaagacaggatctagaggccaatgaacaagacgcccgacccaagcaggagaaccaccttcacagtctcggacgaaataaggttgggtatcacctccacccaagcgacaaggggcagttcgaccattccaaggacggttggcttggtccaggccccatgccagcagtccacaaagcggccaacggccacagcagaacgaagatgatcagcacctccattaaaacagcacgtaagtccaagagagcctcgggcctgcgcattaatgattatgataaccagtgcgacgttgtatatattagccagcccattaccgaatgccattttgaaaatcagaaatctatcctcagctccagaaagactgcgagaaagtccactcgagggtactttttcaacggtgattgttgcgaactgcctactgtgcggacacttgcgagaaatctacactcacaggagaaggcatcttgctcggccctggcctcagaggcagtgttcactccaaagcaaactctgactatcccagccccaagacatacagtcgatgtccagctccccagggaggacaatcccgaggagcccagtaaggagattacttcccacgaggaggggggaggggacgttagccctcggaaagagcctcaagaacccgaggtatgtccgacaaagattaaacccaatctgtcttcgtctccgagaagtgaagagactacggcttccagcctagtctggccactgcctgcacatctccccgaggaagacctcccagagggaggttccacagtctccgccccgactgcctccgggatgtcttcaccggagcacaaccagccgccggtggcactgctggacactgaggaaatgtctgtaccacaggattgccatctcctccccagtacagagagtttttcagggggggtaagcgaggacgtcatctcaagaccacacagccctcctgagatcgtttcaagggaggagtctccccagtgcagcgaaaatcagtcatcacccatgggcctggagccccccatgagcctagggaaagccgaggacaaccaatccataagtgctgaggtggaaagtggagatactcaggagctcaatgtcgacccactgttgaaggaatcatctactttcaccgacgagaacccttccgagaccgaggagagtgaggcagctggggggatcggcaagctcgagggagaggacggagacgtcaagtgcctgtccgaaaaggatacgtacgataccagtatcgacagcctggaagagaatctcgataagaagaagaaaggcaagaaattcccggaggccagcgatagatgtctgcgcagtcagttgtctgactctagtagcgccgatcggtgcctgaggaatcagagttccgatagttccagtgcatgcctcgagatcaaagtccctaagaaccctagcgcaaagcgctctaagaaggaggggcatcctggaggaacaactccaaaggggcttctgcctgactctttccatacggagacgctggaagatactgagaaaccttccgttaatgaaaggccttccgaaaaagatgcagagcaggaaggtgaagggggtggcatcatcacccgacagacgctcaagaatatgctcgataaagaagttaaggaactgcggggcgaaatttttccttcccgggatccaataactacggctggccagccactgccaggggaaagattagaaatctacgtgcaatccaagatggacgagaaaaacgcacacattccaagcgaatctatcgcttgtaagagggatccggagcaagctaaagaggaacctgggcacataccaacccagcacgtggaggaagcagtgaacgaggtggacaacgagaacacccagcagaaggatgatgagtccgacgccccgtgttctagcctgggcctgtcgagcagcggttccggggacgctgctcgcgccccgaaatccgtgccacgacccaaacggctgactagttctacgtataatctgaggcacgcccactccctgggtagtcttgacgcgtctaaggtcacctccgaaaaggaggctgcccaggtcaacccaataatgcctaaagaaaatggcgcctctgaatcaggtgacccccttgatgaagatgacgttgataccgtggtggacgaacagcctaaatttatggagtggtgtgctgaggaagagaaccaggaattgatcgcaaacttcaacgcccaatatatgaaagtgcagaaaggttggatccagctggagaaagaaggacagccaactccacgagcacggaacaaatcagataagctcaaagagatctggaagagtaaaaagagaagcaggaagtgccgtagcagcttggagtctcagaaatgtagccctgttcagatgctgttcatgaccaattttaagctgagtaacgtctgcaagtggttcctggaaaccaccgagactaggtctttggtaatagtgaagaagctgaacactcgcctaccgggcgatgtcccccctgtgaagcatcctctgcagaagtatgcaccaagctcgctctatccgtcttcactgcaagcggagcgcctgaagaaacacttaaagaaattcccaggcgctacccccgccaagaacaattggaaaatgcagaagctgtgggcaaagttcagggagaatcccgaccaggtcgagccagaggacggcagcgacgtgagtcctggacctaattccgaggatagcatagaagaggtcaaggaggaccgtaactctcacccccctgcaaacctccctacgcctgccagcacgagaattctgcgaaagtactcgaacatccgggggaagctgagagcccagcagcgacttattaaaaatgagaagatggagtgcccagatgccttggcggttgagtccaagccctcacggaagtcagtgtgtatcaacccccttatgtcaccaaagctcgcgctccaggtagatgctgacggattccccgtcaagcctaagtccacagaaggtatgaagggcaggaaagggaaacaggtgtcggagatacttccgaaggctgaagtacagtccaagaggaagcgcactgagggctcttcccctccggacagcaagaacaagggtcctacagtgaaggcatccaaagaaaaacacgctgacggtgcaacaaagacccccgctgctaaaaggccagccgctcgtgatcggtccagccagccgcctaagaagacctctttgaaagaaaacaaggtgaagatacctaagaagagcgctggaaaatcgtgtcctccctcacgaaaggaaaaggaaaacaccaataagcgtccgtcccagtcaatcgcatccgagaccctgacgaaacccgccaaacagaagggcgctggcgaatcaagttcccggccccagaaggccaccaatcgaaagcagagctccggtaaaacccgcgcgcgcccgtcaaccaaaacacccgagtcaagcgctgcccaacggaaacggaagctgaaagctaaactggactgttcccatagcaaacggcgacgactggatgctaaatag

SEQ ID NO: 44915 - DNA, 2970 bp, Artificial Sequence
  Description of Artificial Sequence: Synthetic coding sequence
cagcccatcaccgagtgccacttcgagaaccagaagagcatcctgtccagccggaaaactgcacggaaaagtacaagggggtactttttcaacggtgattgttgcgaacttcctactgtgcgaactttggcacgtaacctgcacagtcaggagaaagccagctgttccgccctcgccagcgaagctgtgttcacccctaagcagactttgaccattccagcccccagacacactgtcgatgttcagctgccccgtgaggataatcctgaagaaccatcaaaagagataacgagccatgaagagggtgggggagatgtgagtcctaggaaggagcctcaggagccagaggtgtgtcctactaagatcaagcctaacctgagcagctcaccccgctcagaggagaccaccgcgtcctctctcgtgtggcccctaccagcgcatctccctgaggaggacttgcccgaaggtggcagtaccgtgtctgcgcctacagctagcggcatgtcaagtccagagcacaatcagccgccagtggctttgctcgacaccgaggaaatgtccgtaccacaggattgtcatttattaccctctaccgaaagtttcagcggcggtgtgtccgaggatgtgatctcgcgaccacacagcccgcctgagatcgtctctagagaagaaagtccacagtgcagcgagaaccaatcctcaccgatgggactggagccgcctatgtccctgggcaaggccgaggataatcagtccatcagcgccgaggtggaatctggcgacacccaggaactgaatgtggacccactcttgaaagagtctagcactttcacagacgagaacccttccgaaaccgaagagagcgaggctgccggcggtatcggaaagcttgagggtgaagatggggacgtgaagtgcttaagcgagaaagatacctacgacacaagcatagattcacttgaagaaaaccttgacaaaaagaagaagggaaaaaaattccctgaagcaagcgaccgctgccttaggtctcagttatccgacagcagtagcgccgacaggtgcttaagaaatcagtcatctgacagttcttccgcctgcctcgagatcaaggtcccgaagaacccaagtgcaaaaagatctaaaaaggagggtcatcccggaggaacgacaccaaaaggccttttgcccgatagtttccacactgagacacttgaggataccgagaagcccagtgttaatgaacgaccatctgaaaaggacgcagaacaggaaggggaaggaggaggcatcatcactcgccaaaccctgaaaaacatgcttgataaggaagttaaggaactgcgtggagaaatcttcccctcccgggaccctattacaaccgcaggtcaacccctcccaggcgagcgcctggaaatctacgtgcagtctaagatggatgagaagaatgcacatatcccttcagagtctatagcgtgcaaaagagaccccgagcaagccaaggaagaaccgggccatatcccaacacaacacgtagaagaagctgtcaatgaggttgacaacgaaaatacacagcagaaagatgatgagagtgacgctccctgttcatccttgggcctctcctccagtggtagtggggacgcagctcgcgcacccaaatcagtgcctagaccaaagcgactgacaagctctacatacaatttgagacatgcacactccttggggtcccttgacgcaagcaaagtcacatcggagaaagaagcagcacaggttaaccccattatgcctaaggaaaacggcgcgagcgaaagcggagatccactggacgaagatgacgtggacacggtggtcgacgagcagccgaagtttatggagtggtgcgcagaggaggaaaaccaggaactaattgctaatttcaatgcgcagtacatgaaggtgcaaaaaggctggatacaactggaaaaggagggccagccaactcctagagcgaggaataagtccgataagttaaaagaaatttggaaatctaagaagcgatctcgcaagtgtagatcaagccttgaatctcagaagtgtagtccagttcaaatgctctttatgaccaattttaagcttagtaatgtctgcaagtggttcttggagacaacagagacacggtccctagttatcgtcaagaagctgaacactagactccccggggatgtaccccccgtgaaacatcctctgcagaagtacgctcctagtagcctgtacccaagctcactgcaggccgagagactcaaaaagcatctgaagaagttccctggggctacacccgctaagaacaattggaaaatgcagaaactatgggcgaaatttagagagaatcccgaccaggtggagcccgaggacgggagcgacgtctcccctgggccaaacagcgaggactctatcgaggaggtgaaggaagatagaaatagccaccctcctgcaaatctgccaacgcccgccagcacgcggattctgaggaaatacagtaacattaggggaaagctgcgtgcacagcagcgtctgatcaaaaacgagaaaatggaatgtcccgacgcactcgctgtggagagcaagcccagtcgcaagtcagtgtgcattaacccacttatgtctcccaagctggcactgcaggtggacgctgacggttttcccgtgaagccaaaaagtaccgagggcatgaaggggcgcaaggggaaacaggtcagtgagatcctcccaaaagctgaggtgcagtccaagaggaagcgaactgagggaagttcccctcctgattcaaagaacaaggggcccacagtgaaagcttcgaaggagaagcacgccgatggagcgaccaaaacccctgcagccaaacggcctgcggccagagaccggagcagccaaccaccaaagaagacgagcctcaaggagaacaaggtcaaaatccccaaaaaaaaggaaaaatag

SEQ ID NO: 44916 - DNA, 1008 bp, Artificial Sequence
  Description of Artificial Sequence: Synthetic coding sequence
atgatccgggagtggaagaacgactgccagcggatcgagaagcagcgggcaagtgacactatggttcaggagcgaaagaacgaaaagcctgtgcggatttttaataccaacagttctttccaggaccaggcccccacatgttgtcaggaggacctgtctagcgccagcccgttgcgaatatggagtaagttctatcggagcgaccctagaattgcactgggaaagtatagccctttagagaaggagatccttagattgggtggcatccacaccatcgcagctcggaggttactcgcctataaacaggaggaagaatgtagaatgctgaaggagttgcaactgctatctcccgattataagcaggccatggaatataaaaaaaagcactcatccccctgtgccatttgcgttcccctagagaagatctggaccgctaaggttattgctccactcgaagcctttaagatgccccagcgggaacaagtaaacgtaagtaaacacatcgaaagaatgagacttgccagagccctaggcaatcatcagccactcccgtacattgagcgcttcactagatctagcttcctgtccggtgtcggccttgggccaatggcaaaaaataaggcacgtaggaaagaggataactacgatacccacaattgcgatgatgccaatcaggacaaaaaggaagaggccgagggaaagaacacaaaacggcgagaaattaagatgaatgtggttttcaaatccaaggaacctaaaaagtgcctcacttatcatggaaacgaccgcaaatcctttctgccagcaaagaagcctgaaagaagcatcgccggcctcaccaacaggaacctattctgcattagcgaattccctggcgatcttatgctgatgaaccaggactttatatctaggagagatcacttctcggatctcgtgaagacctatagcctggaggaggagtcaatctggaaggagcggatgcggaaggcaacgccgtaccactattag

SEQ ID NO: 44917 - DNA, 480 bp, Artificial Sequence
  Description of Artificial Sequence: Synthetic coding sequence
tgatgccagcggatcgagaagcagcgggccagcgacaccatggtgcaggagcgaaagaatgaaaagcccgtgaggatctttaacaccaactcatcattccaagatcaagcaccgacctgctgccaggaggacttgtcttctgcgagtcctctgcggatttggagtaaattttacaggtcggaccctaggatagccttaggcaaatactctccattagaaaaagagattctgagactgggtggcatccacacaatcgcagcccggcgcttgctcgcctacaaacaggaggaggaatgccgcatgttgaaggaattacagctcctttctcctgactacaagcaggccatggagtacaagaagaagcattcttcaccatgcgctatctgtgtgcctctggagaagatctggactgccaaagtaatcgcccccttagaggcctttaagatgccacagcgcgagcagaattccttggtgacatag

SEQ ID NO: 44918 - DNA, 561 bp, Artificial Sequence
  Description of Artificial Sequence: Synthetic coding sequence
atgaccaagggccggcggttcaacccccccagcgacaaggacggccgatggttcccacatatcggtctgacccagaaaacaccagaatccatcacctccgccacctcaaaggagcctcagagccctcacctgcctagacaggccgaaggaaaattgccccctatctacaaggtaagagaaaaacaggcagtgaacaaccaatttcccttcagcgtacatgacaaccggcactccctcgagaatagcggatgttatcttgactccggcttgggtaggaaaaagattagcccagacaagcgccagcatgtctctcggaatttcaacttgtgggcctgtgattacgtgccgtcttgcctggacggcttctcaaataatcagatttcttatgtgtacaaggaggcaatggtggtaagctcatttaggaggttcccccgctgctacaaagagatatggaacgcgttcacattccttcctgagaggagttacacggaagtgctgaagaagaagcccaaggttagatttactgtcgataaaaaggttgtgagttccctggagtcctag

SEQ ID NO: 44919 - DNA, 405 bp, Artificial Sequence
  Description of Artificial Sequence: Synthetic coding sequence
atggtggccctgaagggcgtgcccgccctgctgagccccgagctgttgtatgcacttgctcggatgggccacggggatgaaattgtgctggctgacctgaattttcctgcttcctcgatctgtcagtgcggacccatggagattcgtgcagatgggctgggcattcctcagctcctggaggccgttcttaagttgctccccctggacacctacgtagaaagtcccgcggctgtgatggagttagtaccgtccgacaaagagaggggcctgcagactcccgtatggacagagtacgaatccattctgaggcgcgcaggttgcgtgcgggccctggccaaaattgagcgcttcgagttctatgagcgagctaagaaggcgtttgccgttgtggccacaggctgttag

SEQ ID NO: 44920 - DNA, 330 bp, Artificial Sequence
  Description of Artificial Sequence: Synthetic coding sequence
atggagatccgggccgacggcctgggcatcccccagctgctggaggccgtgctgaaactgctgcctttagacacctacgtggagtcccccgctgcagtcatggagttggttcccagcgataaggaaagaggcctgcagacccccgtgtggacagaatatgaaagtatcctgcgcagagccgggtgtgtcagggcactggccaagattgaaagattcgagttttacgaaagagccaaaaaggccttcgctgtggtcgccaccggcgagacagctctctacggcaacctcattttacgcaagggcgttctagccctcaaccctctcctttag

SEQ ID NO: 44921 - DNA, 465 bp, Artificial Sequence
  Description of Artificial Sequence: Synthetic coding sequence
atggtggccctgaagggcgtgcccgccctgctgagccccgagctgctgtacgcgctggccagaatgggtcacggagatgaaatagtgctcgccgatctgaacttccccgcatcaagcatttgtcagtgcgggcccatggaaatccgagcggatggcctgggaattccgcagctgttggaggctgtgctgaaactcctacccttagacacctacgtggagtctcccgctgccgttatggaattagtcccgtcagataaggagcggggcttgcagacaccagtgtggactgagtatgagagcattctgcgccgcgctggttgtgtgcgcgccttagccaaaattgagcggtttgaattttatgagagagccaagaaagccttcgctgtggtggctacaggcgaaactgctctttacgggaatctgatacttcgcaaaggggtactggcattaaaccccttactgtag

SEQ ID NO: 44922 - DNA, 333 bp, Artificial Sequence
  Description of Artificial Sequence: Synthetic coding sequence
atgggccacggcgacgagatcggcctgggcatcccccagctgctggaagccgtcttaaaactgttgccattggatacctatgtcgagagtcctgctgcagttatggaactagtcccttctgacaaggaacgcggcctccaaacacccgtctggaccgaatatgagagcatcctgcgacgggctggctgcgtgagagccctggctaaaatagagcggttcgaattttatgaacgggctaagaaagcgttcgcagtggtcgccacgggcgaaaccgcactctacggcaaccttatcctcagaaagggagttctggctttgaacccactactgtag

SEQ ID NO: 44923 - DNA, 519 bp, Artificial Sequence
  Description of Artificial Sequence: Synthetic coding sequence
atgaaccactgcatccagttcagcccccagagcctgcagcggtggttgatactaccctgttatgatctcaagctcccgatctgggcgaacaccactgagttctgccctcacggcccccgacgcgcatctcaagacccccaactgctggcgtggctcccagaccagagcctagaggtgagcttggagctgtacgactggaattctatgacattcacactttttctggagactgtagagccggtggccgtggaatcagaggggtctggcatcttctcttttgtgtggcagcagctcattttccccgccgaggccagatggtgttttagttgggcccaggattgcggcctcgatggctcgttccccggctccgctcacacagagccattcgggaaagccgctgccgggcagggttccgtggccggcaaagaagccaagaaggctggtccaggattccatcgccagcttctgtacctccagtttcagaagcgctgtctcttcaactaccccgaactcctttag

SEQ ID NO: 44924 - DNA, 480 bp, Artificial Sequence
  Description of Artificial Sequence: Synthetic coding sequence
atgaacctgggcgtgagcatgctgcggatcctgttcctgctggacgtgggcggtgcccaggttctggctacgggaaagactcctggagctgaaatcgatttcaaatacgctctgattggcactgccgtgggcgttgccattagcgctggcttcttggctctgaagatttgcatgattcgacgacatctcttcgacgacgattctagtgatctcaaaagcacccccggcggactctccgataccatacccttaaaaaagagggcccctcgggcacacgtcttacgcgatgggccagccttagggcctctacacctgctgttttctgtaatcggcatgctctttgcccggaagttgcaggcctctaccctgttcagctttaaatctctcttgcaatgtcaccactgtatcatggagggactcttcaaggctaagccccagtttctgcagaaggtgagttgcaagagtgaccatctgtcttag

SEQ ID NO: 44925 - DNA, 354 bp, Artificial Sequence
  Description of Artificial Sequence: Synthetic coding sequence
atgctgcggatcctgttcctgctggacgtgggcggcgcccaggtgcttgcgaccggaaaaacccctggagctgaaattgactttaagtacgcccttatcgggacagctgtgggcgtagctatatccgccggttttttagcgttaaaaatttgcatgatccggcggcatctgtttgacgacgactcttcggatctgaagtccacccctggaggactgagcggggagacaacaattagccctaaagcgagtgggcagatttgtgcaaactctcccacgacagaaagcgagaaattccccaagatctgtctgctgacatcccggaacgatttcagcttttgtcaccagagcggttag

SEQ ID NO: 44926 - DNA, 519 bp, Artificial Sequence
  Description of Artificial Sequence: Synthetic coding sequence
atgaacctgggcgtgagcatgctgcggatcctgttcctgctggacgtgggcggcgctcaagttctggctaccgggaaaactcccggggccgaaatcgacttcaagtatgccctcatcggcacagccgtgggagtggccatttcagcaggctttctggcgttgaagatttgtatgattcggcgccatctgttcgatgacgactctagcgacttgaaaagtacacctggaggattgagcgatacaattccattaaaaaagcgcgcaccaagagcacacgtgctgcgggacggacccgccctgggaccgctacatctgcttttctccgtgatcggcatgttgtttgccaggaagctacaggctagcactttattcagttttaagagtctgttgcagtgtcatcattgtataatggaaggcctgtttaaggcaaaaccacagttccttcagaaacacctcgcccggagcgttcagatccaccaacttcagaaagtgaagtccttccccaaatatgcttactag

SEQ ID NO: 44927 - DNA, 390 bp, Artificial Sequence
  Description of Artificial Sequence: Synthetic coding sequence
atgaacctgggcgtgagcatgctgcggatcctgttcctgctggacgtcggtggagctcaggtgctggcaacaggcaaaacacccggggcggagatagacttcaaatacgcacttattggaacagctgtcggcgtggccatcagtgccgggttccttgccttgaagatctgtatgataaggcgacatctgttcgatgatgacagttccgatctgaagagcacccctggcgggctgagcgatacaatacccctgaagaaacgagcccccagaaaactccaggctagcaccttattctccttcaaatcccttctgcagtgccatcactgcattatggaaggtctcttcaaggcaaagccacagtttcttcaaaagcgctgcacgggcgattag

SEQ ID NO: 44928 - DNA, 348 bp, Artificial Sequence
  Description of Artificial Sequence: Synthetic coding sequence
cggatcctgttcctgctggacgtgggcggcgcccaggtgctggccacagggaagacccctggagctgaaatcgattttaaatacgccctgatcggaactgccgttggggtagccatcagtgccgggttccttgccttgaaaatatgcatgatcaggagacacctctttgacgacgactcatccgacctgaaaagcacacctggtgggctgagcggcgagacaactatcagcccaaaggcgagtggccagatctgcgccaatagtcctactactgaatcagagaaattcccgaaaatctgtctgctaaccagccgcaacgatttctcattctgccaccagtccgggtag

SEQ ID NO: 44929 - DNA, 771 bp, Artificial Sequence
  Description of Artificial Sequence: Synthetic coding sequence
atgagcgaggagatggacaacatcaccgccgaggagatcatcgacaagcacttgcagaaggatctcgacgccgaggaaaaccaaaacgttgctaagacactcagaggcaaggttcgggagaaactgaagattagtaagataaacaagggagaaaagagttccacggaacaactgatcgacagtgagatccatcagcgaagcaaactcagtccccagacggaggtttccctcgacgaatctttaagcttcttcatattgtcaggcgaggaaggctcagcactcggcaaatctagtgagcaacggcccgtgaacagatcttatcccaagtgcttctccctcggggtgaacctgcagaacgtagctgaatccgaagaggaggaattcatgaaggaattcatactcaccgatattttgaaggtgaaggctgcagactatgaggacgatcaggagcagataaaaaaacagaaagcaaacatttttgtaccctcctcatctcctgtggtcaaccagaggaaactgcccaaggacatgatgcctcgtatccttgaggacgaaggcttctacatacagcgaaaacctgagatctataaaaagacgtgtaacaaaatggagaacaggctgctgaaactcgaggaggcaaaatgttggttcggggagagtggggagatcatgtctttgcccacaccaattaagcaatcatggaattttcggctgaatgtgaggaaagaaccactaaacccacttctcaagacaatttatcgcaagctttag

SEQ ID NO: 44930 - DNA, 531 bp, Artificial Sequence
  Description of Artificial Sequence: Synthetic coding sequence
atgggcgtgcagatgagcgaggagatggacaacatcaccgccgaggagatcatcgacaaacacctgcagaaagaccttgatgcagaagaaaaccagaacgtagcaaagactctaagagggaaggtgagggagaagctgaagatcagcaagattaacaaaggagagaaatcgtctactgaacagctgatcgactccgagatacatcagagatcgaagctgtctcctcagacagaagtttccctggacgagtcattaagtttttttatattaagtggcgaggaggggtctgcactgggcaaatcctccgagcagcggccagtgaatagaagctatcctaaatgtttcagtcttggtgttaatctacaaaacgtggccgagtctgaggaggaagaattcatgaaggaatttatcctcactgatatccttaaagtgaaggcagccgattacgaggacgatcaggagcagatcaagaaacagaaagctaacattttcgtcccatccagctctccgggcaatatcctctcccagtag

SEQ ID NO: 44931 - DNA, 2337 bp, Artificial Sequence
  Description of Artificial Sequence: Synthetic coding sequence
atgcagcaggagagcgagcggtgccgggtgcgggcccggcggcccgatatggcactgtacgtacctaaggcgaggcggggagcggtgctgctcaaaacaggggacgaggaggaatcctgcggatcaccaaactccgtggtgaaagaaaagcagaaggaatcctccctctctcaaaaggaagtttttaaagacaagccagaagcgagaagactgaacattaatcctgaccgcaaagagcataactgtcgagaggagaaaaagtcaagcaccaagctccggatggatacttgcctccagaagaccaaccgggtgtgctcaaaaagagggaccaccgaatcgaaggaagtgctgtcacaggggcagcagcaaggtgcaccgaacgcgggcgtcatcacaaatgcccccctccagagacatttcaagccaaagaaagtcgagtgtttagaggtggagactaccgatgtgaccgggcatgaacggatcctgctcagtcaagcttgtctagaaatatctgaggcccaggttccctcaaagccttttcaaaatgtggagttctgcgatttttcaaggcacgagcctgatggagaggcttttgaggacaaagacctggagggacgtatcgagaccgatactaaagttctcgagattctgtacgagttcccccgtgttttcagcagtgtgatgaagcctgaaaacatgattgtgccgatcaagctgagctctgactctgagatcgtgcaacagtccatgcagacaagtgacgggattttgaatccttcctctggcgggattaccaccacatccgtgccgggaagtcctgatggagtctttgaccaaacttgtgtggatttcgaggtggagtcggttggtggtattgccaattccactggattcatcctggaccaaaaagacaccgatagtatacccgccactatgggacacatcagcctgagcgaatcaaccaacgataccgtaagccctgtcatgattagagagtgtgagaaaaatgattctaccgctgatgagttgcacgttaagcacgaacctccagatactgccgtgcttgcgcacgagacacaccgagatagcgggttcaaaaatgtcggggacatcacgaataaggcgtgcatgatggatacaacgggaatgtcatgcagtgaccatgtcaccgtggactcaccgtatgtggtggccgtgcggatagccgacgagacgtctatcaacactcggtcttttagcaaattcgtgggcatgagtgccgacgccacccccctgcatgttgcaaggagcggcaacgacacagaagatttcagtaacccatctgcctgttctgacatatacggtgagtctatctccagtcattttaccgagagcactggcaagctgattgagtccctgtcagattgtgcgtcctcactgccaattaagaagattgctggcagcaactacaacacatttctggactctgaattgagcatgttgaacggaaccaaggtgctttccgattcagccgttggaatagaccttgggagcaccggtgatacaacagaagcactgcacgagttgcggaccgctgaagaattcaagacagaagagcaagacgatagcgggagcattgaatttggtgtgagcttccccgatagagaatcaagtagtatggaaacatcgattgaaccaaaggctacggagaccagtcacaccgagggaataacagctatcgaagaatcttgggaatcaatgttcaatgacgacggtgactgtctcgatcccagattgctccaggagctgtccggcaatactaagagcagagaatcgattcaggaaccgaggtctgactactacaaccacgaggtacccgatatcgatctctctgattgcgaatttccacatgttatcgaaatctatgacttcccccaagaatttcataccgaagatctgttgcgcgtcttttgttcttatcaaaaaaaaggttttgatatcaagtgggtggatgacactcatgccctgggcgtgttttcatcccctattacagctcgagatgccctggggataaaacatactatggtgaagatccgtcctttatcccaggccactagggcagcaaaggcaaaggcgagggcttacgccgaatttcttcagcctgcaaaggaaaggcccgaaacatccgcagcactggccaggcgattggtgatctctgcactgggggttcggtcgaaacagtccaaaaccgagagagaagcagaattaaagaagctgcaggaagccagggaaagaaaaaggttagaggccaaacaaagggaggacatttgggaaggaagagaccagagcacagtctag

SEQ ID NO: 44932 - DNA, 585 bp, Artificial Sequence
  Description of Artificial Sequence: Synthetic coding sequence
atgcacatcaagcccgagaaccactgcagcaagctgagcggcaacacaaagtcacgggaatccatacaagagccaagatctgactactataatcacgaggtgcctgatattgatctttctgactgcgagttcccgcatgttatcgaaatctacgactttccacaggagttccacaccgaggatttgctgcgtgttttttgcagctaccagaaaaaaggctttgacattaagtgggtggacgacacccacgcccttggagtattttcaagccctatcacagctagagacgctctggggataaagcacaccatggtgaaaattagacccctgtcgcaggctaccagagccgcgaaggctaaagccagggcatatgctgaattcctgcagccagctaaggagcgacccgagacctctgcagctctagcccggcgcttagtcattagcgccctgggggttaggagcaagcagtctaagacagagagagaggcggaactgaaaaaactccaggaagcaagggaaagaaagcgactggaagccaaacaacgagaggatatatgggagggaagagatcagagtacagtctag

SEQ ID NO: 44933 - DNA, 2337 bp, Artificial Sequence
  Description of Artificial Sequence: Synthetic coding sequence
atgcagcaggagagcgagcggtgccgggtgcgggcccggcggcccgatatggcactgtacgtgcccaaagctaggaggggagcagtgctcctcaagacaggggatgaggaggaatcttgtggtagccccaacagtgttgtgaaagagaaacagaaggaaagcagcctcagtcagaaggaagttttcaaggataaaccagaagcgcgccgactcaacatcaaccccgatcgcaaggaacacaattgccgagaggagaaaaaatctagcactaaattgcgcatggatacgtgcctacagaagaccaatcgcgtctgtagcaaacgaggaacaaccgagagcaaagaagtactatctcaggggcagcagcagggtgctcctaacgccggggtgattacaaatgctcctctacagcgacactttaaacctaaaaaggtcgaatgcttggaggtggaaaccacagatgtcactggacacgaacggattcttctcagccaggcttgtctagagattagcgaggcccaggtgccctcaaaaccgttccagaatgtggagttctgtgactttagtaggcacgaaccagatggcgaggccttcgaagataaggaccttgaaggacgtatagagacagacaccaaggtactagagatcctctatgaattcccgcgcgtgttcagtagtgtaatgaagcctgagaatatgatcgttcccattaagttgagctccgactctgagattgttcagcagtctatgcagacaagcgacggtatactgaaccctagctcaggaggtattactacaactagtgttcctggcagtcctgatggagtttttgatcagacctgcgtggattttgaggtagagtccgtagggggcatagccaactccacaggctttatcctggatcagaaagatacagacagcattccagctactatgggccatatcagcttgtcagagtcaactaacgacactgtgtcacccgtgatgatccgagaatgtgagaagaacgacagcaccgccgacgaattgcatgtgaagcatgagcccccggacactgccgtgttggctcatgagacgcatagagatagcggatttaaaaatgtgggtgacattactaacaaggcctgcatgatggacactactggaatgtcttgttccgaccacgttactgtggactctccgtacgtggtggcggtgcggatcgccgacgagacctccatcaatacgagatccttcagcaaattcgttgggatgagtgccgatgctacacccctgcatgtggctcgctcgggtaatgacacagaggacttcagtaacccttcagcctgtagtgatatctatggcgaaagcataagttcccattttacagaatctactggcaagcttatcgaaagcctgtctgactgcgccagtagcctgccgataaagaagatcgcgggatccaattataatacttttttagactcggaactgtctatgttaaatggtaccaaggttctatccgactccgccgtgggtattgatttaggctccactggcgacacgacagaggctctccatgagctgcgaacagctgaggagtttaagactgaggagcaggatgattcaggatcgatagagttcggcgtgtctttccccgaccgggaaagttcctccatggaaaccagtatcgaacccaaagctacggagacttcgcacacggaaggcattaccgctatcgaagaatcctgggagtctatgttcaacgacgatggagactgtctggacccacgactgctccaggagttgtccggaaacaccaagtctcgagaatcaattcaagagccacggtctgattactataaccatgaagtgccagacattgatttatcagattgtgaattcccacatgtgatcgagatttatgatttcccgcaggaatttcacacggaggatttgctccgagtcttttgcagctaccagaagaagggcttcgacatcaaatgggtggacgatacacacgcactaggcgtgttctcttcccccatcactgctcgggatgctctcggcatcaagcatactatggtgaaaataaggccacttagtcaggccactcgcgcagccaaagctaaagcccgcgcatacgctgagtttctccagccggccaaagagaggccggaaacatcggccgctctggccaggaggcttgttattagcgccctgggagtccgcagcaaacagtcaaagacagaaagggaagcagaattaaaaaagctgcaggaggctcgcgagcgcaaacgattggaagctaaacagcgcgaggacatctgggaggggagggatcagtctactgtatag

SEQ ID NO: 44934 - DNA, 555 bp, Artificial Sequence
  Description of Artificial Sequence: Synthetic coding sequence
atgctgagcggcaacaccaagagccgggagagcatccaggagccccggagtgattattacaatcacgaggtacctgacatcgacctgtctgactgtgaattcccccatgtaatcgagatatacgacttcccacaggagtttcatacagaggacctcctgcgcgtgttttgctcctaccagaaaaaggggtttgatattaagtgggtcgatgacacgcacgcgcttggcgtgtttagttctccaattacagcccgtgatgctctggggatcaagcacaccatggtcaaaatccgacccctgtcgcaggctactcgcgctgccaaggcaaaggccagagcgtatgcagaattcctgcaacccgctaaggaaaggcctgagacatcagccgctctggcaaggcgcctggtgattagcgctttgggcgttagatccaagcagagtaaaaccgaacgtgaggctgagctgaagaaactgcaagaagctcgcgaacggaagagactggaggccaagcaaagggaagatatctgggaggggagagaccagtctaccgtctag

SEQ ID NO: 44935 - DNA, 984 bp, Artificial Sequence
  Description of Artificial Sequence: Synthetic coding sequence
atgcagcaggagagcgagcggtgccgggtgcgggcccggcggcccgatatggccttatacgtgcctaaggctcggcgtggcgcggtcttgctcaagaccggagatgaggaagagtcctgcgggtcccctaattcagtggtgaaagagaagcagaaggagagctcacttagtcagaaagaagtctttaaagataaaccggaagctaggcgcctgaatatcaatccagatcggaaggagcacaactgtcgcgaggagaagaaaagctcaaccaagctgcggatggatacgtgcctgcagaagacgaacagggtgtgtagtaaaagggggactaccgagtcaaaggaagtgttgtctcagggacaacagcaaggggcccctaacgccggcgttataaccaatgctccactgcagcggcacttcaaaccgaaaaaggtggaatgtctcgaagtggaaaccactgacgtgacaggccatgagaggatcctgctgagccaagcctgccttgaaatctctgaagcacaggtccctagtaaaccatttcaaaacgttgaattctgcgatttctctcgccacgaacccgacggggaggcgtttgaggacaaagatctggaggggagaatagagaccgacaccaaggttctggagattctgtatgaattcccaagagtcttttctagtgtgatgaagcccgagaatatgattgtcccaattaagttgtcaagcgactccgagattgttcagcagtctatgcagacatcggacggcattctcaatccatctagcgggggtatcacaaccacttccgtcccaggcagccctgacggcgtgttcgatcaaacttgcgtggactttgaagttgaaagcgttggagggattgccaattcaacaggcttcatactcgaccagaagattcagattccttttttgcagctatgggtgacatcgctgtgtcagcgggctcagatgacgttactagtgcaatag

SEQ ID NO: 44936 - DNA, 558 bp, Artificial Sequence
  Description of Artificial Sequence: Synthetic coding sequence
cagaagctgagcggcaacaccaagagccgggagagcatccaggagccccgaagtgactactacaatcatgaggttcctgacatcgacctcagcgattgtgagtttcctcacgtgatagaaatttacgactttccccaggagtttcacacagaagacctccttcgcgtgttttgctcataccagaaaaaaggcttcgatatcaaatgggtggacgacacacatgcactcggcgtgttcagctcccccatcactgcgagagatgctttgggtattaaacacaccatggtaaaaatcagacccctctcgcaagctacaagggctgccaaagctaaagctcgggcatatgctgagttcctccagccggcaaaagaacgaccagaaacaagtgctgcgttggcacgccggctggttatctctgctctcggggtaaggtctaaacagtccaaaaccgagcgcgaggcggagctgaagaagttgcaggaagctcgtgagcgtaagagactcgaagcaaaacaacgggaagacatttgggaaggtcgggaccagagcactgtttag

SEQ ID NO: 44937 - DNA, 321 bp, Artificial Sequence
  Description of Artificial Sequence: Synthetic coding sequence
atgatggccaccggcacccccgagagccaggcccggttcggccagtctgtgaaaggcttactcactgaaaaggtgaccacctgtggaaccgatgtgattgcgctaaccaagcaggtgcttaaagggtctcgatcatccgaactattgggccaggccgcccgaaatatggtgttgcaagaagacgctatactgcatagcgaagattcccttagaaaaatggccataattaccacacacctgcagtaccaacaagaggccattcaaaaaaatgtggagcagtccagtgacctccaagaccaactgaatcatctactgaagtag

SEQ ID NO: 44938 - DNA, 321 bp, Artificial Sequence
  Description of Artificial Sequence: Synthetic coding sequence
atgatggccaccggcacccccgagagccaggcccggttcggccagtccgtcaaggggctgctgactgagaaggtaacaacctgcgggacagacgtgatcgccttgactaagcaggtgctgaaagggtctcgctcgagcgagttgctgggacaagccgccaggaatatggtcctccaggaggatgcaattctccattccgaagattcccttcggaagatggccatcataacaactcatctgcagtatcaacaggaggccattcagaagaatgtggaacagtcctccgatttgcaggaccaacttaatcatcttctaaagtag

SEQ ID NO: 44939 - DNA, 387 bp, Artificial Sequence
  Description of Artificial Sequence: Synthetic coding sequence
atgaagcacaagtacaacaccctgagctggtacaagaaggagcggtcgacacaactgagaagatttatcgttcatcagcccgaggtcgggcttttctttttcctccgggacgtcgtgtacaattatatcactgagaagactacctgccggtgtccacttacccaggaacgtccatgtgatacaggtggaaaattcgggcgcatatggatttgccagcccgaagagctcggcaaaatgcagatctggatctgccaaccggaggagttggggaaaatgcagattgacaagaataggactatggttcagcagatgtggtacatctggtacggcggactggatactagcaccaatagccttctgccaatactggtgcgtgggatggcatag

SEQ ID NO: 44940 - DNA, 387 bp, Artificial Sequence
  Description of Artificial Sequence: Synthetic coding sequence
atgaagcacaagtacaacaccctgagctggtacaagaaggagcggagtacacagctgaggcgcttcattgtgcaccagccggaagtagggctcttttttttccttcgggacgtggtgtataactatatcactgaaaaaactacctgcagatgccctttgacccaggagagaccctgcgatacaggcggaaagttcgggagaatctggatttgtcagccagaggaactggggaagatgcaaatctggatatgccagcctgaggagctgggcaagatgcaaattgataagaataggacgatggtgcagcaaatgtggtatatttggtatggaggactagatacatccaccaattccttgctcccgattctggtccggggaatggcatag

SEQ ID NO: 44941 - DNA, 387 bp, Artificial Sequence
  Description of Artificial Sequence: Synthetic coding sequence
atgaagcacaagtacaacaccctgagctggtacaagaaggagcggagcacccaactaaggaggtttatcgtgcaccaacctgaggtgggactcttcttcttcctgcgggatgtcgtgtataattacatcacggaaaaaaccacgtgccgatgtcctctgactcaggaacggccttgtgatactggtggtaagtttggccgaatctggatttgccaacctgaggaactgggtaaaatgcagatctggatctgccagccagaagaactcgggaagatgcagatagacaagaatcggacgatggtgcagcaaatgtggtacatctggtatggtggcctcgatacatccaccaacagcttgctcccgattcttgtgcgagggatggcctag

SEQ ID NO: 44942 - DNA, 912 bp, Artificial Sequence
  Description of Artificial Sequence: Synthetic coding sequence
atggaggagagcatggaggaggaggagggcggcagctacgaggccatgatggacgaccagaatcacaacaactgggaggccgccgtggacggctttcgacagcccctcccacctccccccccccctagctctatcccagcccccgcccgcgagccacctggggggcagctgctggccgttcccgctgtgtcagtagatagaaagggacccaaggaggggctgcccatgggcccacagcctcctcccgaggctaatggggtcattatgatgctcaagtcttgcgatgcagcggcagccgtggctaaggccgcccccgcccccacggcctcgagcacaatcaatattaacacatcaacctccaaattcctgatgaacgtcatcacgatagaagactacaagtcgacatattggccaaagcttgacggggcgattgatcagctcctgacacagtcccccggtgactacatccctatctcttacgagcagatctacagctgtgtttacaaatgtgtgtgtcagcaacactcagaacagatgtactccgacctgatcaagaaaattaccaatcacctggagagagtatcaaaggaacttcaggcttcccccccagatctgtatatcgaacggtttaacattgccctggggcagtacatgggagcccttcagagcatagtgccgctttttatatacatgaataagttctatattgaaaccaagttgaaccgggatctaaaagatgacctgattaagctatttacggaacacgtggctgagaaacacatttacagccttatgccacttttgctggaagctcagagcactccattccaggttaccccatctaccatggcgaacattgtcaaggggctatataccctgagacccgtctctcagaactttacagcagtgtag

SEQ ID NO: 44943 - DNA, 1110 bp, Artificial Sequence
  Description of Artificial Sequence: Synthetic coding sequence
atggaggagagcatggaggaggaggagggcggcagctacgaggccatgatggacgaccagaatcataataattgggaggccgcggttgatggattccggcagccactgccacctcctccccctcccagcagtattcctgctcctgccagagagcccccgggaggtcaactcctcgccgtgcccgccgtcagtgttgacaggaaggggcctaaagagggcctgcccatgggcccccagcccccacccgaggccaatggcgtgattatgatgttgaagagctgtgacgcagctgctgccgtcgccaaagccgccccagcaccaaccgcctccagcacaatcaacatcaacacgagcacctctaaatttttaatgaacgttataacaattgaggactataagtctacatattggccaaagcttgatggtgccatcgaccaattactgacacaatcaccaggcgactatattcccatctcatacgagcagatctatagctgtgtctataagtgcgtgtgtcagcagcattcagaacagatgtacagcgatctcatcaagaagatcaccaaccacctggaacgggtttctaaggaacttcaagccagcccccccgacctttatattgaacgcttcaatattgcgctcggacagtacatgggcgctctccagagcattgtccctctattcatatatatgaataaattttacattgaaaccaagttaaacagagacctcaaggatgaccttatcaaactcttcactgagcatgtggctgagaagcatatctatagccttatgccattgctgctggaggctcagtcgactccgttccaagtcaccccatccaccatggctaacatcgtgaagggtctctatactctgcgtccagaatgggttcagatggcgcccaccttattctccaaatttattcctaacatcctgccccccgcagttgaatctgagctgagcgagtatgccgctcaggatcagaaattccagagggagctgattcagaatggattcacgcgaggggaccaatcccggaagcgggcaggcgacgaattggcctacaactcaagttctgcatgcgcttcatcgcgaggatatcgttag

SEQ ID NO: 44944 - DNA, 741 bp, Artificial Sequence
  Description of Artificial Sequence: Synthetic coding sequence
atgaacgtgatcaccatcgaggactacaagagcacctactggcccaaacttgacggagccatcgaccaattgttgacccaatctccgggcgattacatccctatctcgtacgaacaaatctactcatgcgtgtacaaatgcgtgtgccagcagcatagtgagcagatgtactcggacctgatcaaaaagattactaaccatctggaaagagtgtctaaggagttgcaggcttccccacctgatttatatattgagagattcaacattgccctcggccagtacatgggggccctgcaatctattgtgccactttttatctatatgaataaattctatatcgagactaaattaaatagggatttgaaagatgaccttatcaaactgttcactgaacatgtggccgagaaacacatttactcgctgatgccactgttgctggaggcccagagcacgccgttccaggtgacgccctctacaatggccaatatagtgaaggggttgtatactctgcggccagaatgggtgcaaatggctcccaccctgttctccaagttcattccaaacatccttccacccgccgtggaaagtgaattgtcagagtacgcggctcaggatcagaaattccagcgagagttgattcagaatggttttaccagaggggatcaaagtcggaagcgagctggcgatgagttggcgtacaattcctcttcagcatgtgcatctagtagaggctacaggtag

SEQ ID NO: 44945 - DNA, 543 bp, Artificial Sequence
  Description of Artificial Sequence: Synthetic coding sequence
atgaccaccacccccgtgctgagccggttcgccagcccccccgacctctatatcgaacggttcaatatcgcactcggccagtatatgggagcgttacagagcattgtacccctgtttatttacatgaataagttctatatcgaaaccaaactgaacagggatttgaaagacgacctcattaaactgtttactgagcatgtggcagaaaaacacatctattcgctgatgcctcttctactagaagcgcagagtacaccatttcaggtgacccctagcacaatggcaaatattgttaaaggcctgtacacattgcgaccggaatgggtccaaatggctccaacgctcttctccaaattcatccctaatattctgccgcctgctgtcgaatccgagctgtcagaatacgctgctcaggaccagaaatttcagcgtgaactgatacaaaacggcttcacacgaggtgatcaaagcagaaaaagagccggagacgagctggcttataacagctccagtgcctgcgcgtcatcgcgcggataccgctag

SEQ ID NO: 44946 - DNA, 1308 bp, Artificial Sequence
  Description of Artificial Sequence: Synthetic coding sequence
atgcccgtgacccaccggaagagcgacgccagcgacatgaacagcgacacatccccttcatgccggctacgggcgttctcccgcgggggtagcctcgaatcgcgaagcagcagctctcgatcccggtcatttacgttagatgacgagagcctgaagtacctgacacacgaagagaaagacgtcctgctgttctttgaagagacaattgactccctcgatgaagattttgaagagccggttctgtgcgatgggggcgtttgctgcctgtgctcacccagcctggaagagtctactagctctccttctgagccagaggatgttattgatctcgtgcagcccgcacccggggcaggcgaggctgaagggctccctgaggggacgcaggcagccggcccggctcccgccggaaaggaacacaggaaacaggacgcggagacgccaccccctcctgacccaccagccccagagaccttactcgctcctccgcccctcccttccacgccagatccccctcgccgggagctgcgcgccccgtctcctcctgtcgaacatcctcgcctcctgagaagcgtaccaaccccgctcgttatggcccagaagataagcgaacgcatggcgggcaacgaggcactttccccaacttcaccctttcgtgaagggcgtcctggcgagtggcgcacacccgctgcacgcggtcctcgatctggggaccctggacccggacccagtcaccctgcacagcccaaagccccccgattcccctctaatatcattgtgaccaatggggctgcccgggagccccgtagaacactctccagagcagccgtgagtgtgcaagaaaggcgagctcaggtcctggctactatccatggtcatgctggcgcatttcctgctgctggtgatgcaggggagggcgcccctgggggcggatcctcacccgagcgagtggctagagggcggggtttgccaggccctgctgagtcgctcagggctgggggtcaggctccaagaggacctgctctagccaacgggtttcccagcgcccatgaggcgttgaagtcagctccatcatccttcgcccccgctggcaaaagcctgtgctttaggccaggccccgcactcccgtccactagagcccgccaaagttttcctggtcccagacaacccaacggcgcccaggactggcgaagggccgactctctgcctaggccgcagggtatcaccgttcagtttgctggcaggggatccagcgaagaagcacggcgcgaagctttgagaaaactgggcttgctgagggagtcaagttag

SEQ ID NO: 44947 - DNA, 720 bp, Artificial Sequence
  Description of Artificial Sequence: Synthetic coding sequence
atggcccagaagatcagcgagcggatggccggcaacgaggccctgagcccaactagcccgtttagagaaggcaggcctggggaatggaggacacctgccgctcgggggcccaggagcggagatcccgggcccggtcccagccatcctgctcagcctaaggctccccgctttcccagtaacataatcgtcactaatggtgctgcaagggagccacgtcgcacactgagccgcgccgccgtgagcgtgcaagagagacgagctcaggtgttggcaacaattcacggccatgcaggcgccttccctgccgcgggagacgccggcgagggagcacccgggggaggctcttccccggagcgcgtggcaagagggcgaggtctccccgggccagccgaaagcctgagggccggtggtcaggcacctagggggcctgcactggccaatggttttccttccgcgcatgaagccctgaagtctgccccatcatccttcgcgcctgcgggcaagagcttatgctttcgacccggccctgctcttccctctacccgggcaaggcaaagcttccccgggcctcggcaacccaatggagctcaggattggcggagagcggactccctgcctcggccgcagggcattactgttcaattcgccgggaggggctctagtgaggaggcacgacgggaagctctcaggaagctgggcctgctgagagagtcctcatag

SEQ ID NO: 44948 - DNA, 1029 bp, Artificial Sequence
  Description of Artificial Sequence: Synthetic coding sequence
atgcccgtgacccaccggaagagcgacgccagcgacatgaacagcgacacgtcgcccagctgtagactgcgggcattttccagaggtggctccctcgagtctcgctccagctcctcacgcagccggtccttcaccctggatgacgaaagtctgaagtatttaacccacgaggagaaggatgtgctgctcttctttgaagagacaattgactcactagatgaggacttcgaagagcccgtcttatgcgatgggggggtatgttgtctctgctccccttctctcgaagaaagcaccagctcccctagcgaaccggaagacgtgattgaccttgtgcagcccgcaccaggagcgggcgaggccgaggggctacctgagggtactcaggcggcgggccccgctccggccggcaaagagcacaggaagcaggacgccgagaccccccccccccccgatcccccagctcctgagactctcttagcacccccacccttaccctctacaccagaccccccaagacgtgagctcagagcaccaagccctccagtcgaacacccccgcttgctcagatctgtgccaacgccgctggtgatggctcagaaaatctctgaacggatggcggggaacgaagcgctctctccaacatctcctttccgggaggggcggcctggcgagtggcggacccctgctgcacgggggcccaggagcggtgatcccggtccgggaccatctcatccccctgctctcgccaatggcttcccgagcgcccacgaggctctcaagtccgcaccctccagctttgctcccgcagggaagagcctgtgtttccgtcccggtcccgccttacctagcacacgggcaaggcagagctttccgggcccacgtcagcctaacggggcccaggactggcgcagagccgatagcctcccacgcccccagggcattaccgtgcagttcgcaggccggggttcatcggaggaagccagacgagaggctctgcggaagctggggctgcttcgggagagctcatag

SEQ ID NO: 44949 - DNA, 1026 bp, Artificial Sequence
  Description of Artificial Sequence: Synthetic coding sequence
atgcccgtgacccaccggaagagcgacgccagcgacatgaacagcgatacctctccgtcctgccgcctgcgtgcctttagtaggggcggaagccttgaatcacgatcctctagtagtcgctcccggtcgtttacactggatgacgagtctctcaagtacctcacccacgaggagaaggacgtgcttctgttcttcgaggaaacgatcgattccctcgatgaggacttcgaagagcctgtgctttgcgatggcggagtgtgctgcctgtgtagtcccagcctggaagagagtactagctccccaagtgagcctgaagatgtaatcgatctcgtccagcccgcacccggcgccggagaggccgaaggactgccagaggggactcaggctgctggacctgctccagctggcaaagagcaccgcaagcaggacgccgagaccccacctcccccagatccacctgcaccagaaacccttctcgcaccaccaccactgcccagcactccggacccacccagaagagagctcagggctccatctcccccggtcgagcacccccgcctgttgcgaagtgtcccaacacctttggtcatggcccagaaaattagtgaacggatggctggaaatgaagcgctttcacccacatctccttttagggaagggagacccggggagtggcggactccggcagctaggggtcccaggagcggggacccaggtcctggcccctcccacccggctttagccaatggcttcccgagtgctcacgaggccctgaagtcggcaccaagttctttcgcaccagctggaaagagcctctgctttcgaccaggccccgcactgccctcaacgagagcccgtcagagctttcccggccccaggcagcccaacggcgctcaggattggcggcgcgctgattccctgccgcgccctcagggtattacagttcagttcgctggcagagggagttccgaagaagctcgtagggaagctctgagaaagctagggttgctgcgtgagagttcttag

SEQ ID NO: 44950 - DNA, 258 bp, Artificial Sequence
  Description of Artificial Sequence: Synthetic coding sequence
atgcccgtgacccaccggaagagcgacgccagcgacatgaacagcgatactagcccctcttgccggctgagggccttttcacgaggcggaagcctggaatctcgctcaagcagcagcagatcccggagcttcacccttgatgacgagagccttaaatatcttactcacgaggaaaaagatgttttgctgttttttgaagagacgattgacagtttggatgaggattttgaagaacccgtcctttgcgacggcggctag

SEQ ID NO: 44951 - DNA, 282 bp, Artificial Sequence
  Description of Artificial Sequence: Synthetic coding sequence
atgcccaagaacgccgtggtgatcctgcggtacggcccctacagcgcagctggattgcccgtggagcatcatacatttcgccttcagggattacaagccgtgctggccatcgatgggcatgaagtgatcctagagaagatcgaagattggaatgtggttgaactcatggtgaatgaagaggttatcttccactgtaacatcaaggacctggagttcggaggagatggaaaactcgatccactgtgcgagaaggctaggattgccgtgctcaacgcttactag

SEQ ID NO: 44952 - DNA, 474 bp, Artificial Sequence
  Description of Artificial Sequence: Synthetic coding sequence
atgcccaagaacgccgtggtgatcctgcggtacggcccctacagcgcagcaggtcttccagtagagcatcatactttccgtctacaaggactacaagccgtactggccatcgacggtcatgaagtgatcttggagaaaattgaggactggaatgtagttgagttaatggtgaacgaagaggttatcttccattgcaatatcaaagacctcgagttcgggaaacttactccttcctcggacaagcggacaacgagttctagccgactgacgttccaccagctaagctccccttgtagaatgaaggtgagcccactgcagcaatttccacaaaagactcaggacctgacctgcacagtcttggcccagattggctcttgtatacatttccagacgaatttgtgcgacctcggctggccaggcctcgaccatatgctgatatctggtttagagaagaggggtactcagccgtactag

SEQ ID NO: 44953 - DNA, 282 bp, Artificial Sequence
  Description of Artificial Sequence: Synthetic coding sequence
atgcccaagaacgccgtggtgatcctgcggtacggcccctacagcgcagccggtctgcctgtggaacaccataccttccgcttgcagggtctgcaggctgtattggccatcgacggtcatgaggtgattctggagaagatcgaagattggaatgtggtcgagctaatggtaaatgaggaagttatttttcattgtaacatcaaagatcttgagttcggcaagccctttggagatgcatccagtcagcaatttgcaagctcagaggaatctctcaatttctag

SEQ ID NO: 44954 - DNA, 474 bp, Artificial Sequence
  Description of Artificial Sequence: Synthetic coding sequence
atgcccaagaacgccgtggtgatcctgcggtacggcccctacagcgccgctgggcttccagtggagcatcatacatttcggttgcaaggactgcaagcagtcctcgcgattgatgggcacgaggttatactggagaagatagaggattggaatgtcgtagaattgatggtcaatgaagaggttatcttccactgcaatataaaagacctggagtttggtaagctcaccccttctagtgacaagaggactacgtcgtcctcgagactgacgttccatcaactgtcctctccctgtaggatgaaagtgtctcctctccagcaattcccgcagaaaactcaggatttgacatgtactgtgctcgcccagataggcagctgtatacattttcagaccaatctatgtgatctaggttggccaggcttagaccatatgctgatctccggcttagaaaagcgtgggacccagccttattag

SEQ ID NO: 44955 - DNA, 456 bp, Artificial Sequence
  Description of Artificial Sequence: Synthetic coding sequence
atgttcctgcacctggacagccacagcagcctggagcggaccaagcctacagtagtgggagtagacacacatatggagctcgacgaggtccactgttgcccagggcgcgattccggaggaggcttcatcaaggggccaatgctccagggtttgcagggcgaaggcaagctggctccaattcccaagcctactctcccatccccctcaagactcacactttttgtgtctagtagccagatggaagatcatgggtttcctgcacgacgaaatggcttgacccaagctagttttatttatcagatgccagccgggtgggggagtcctggaggcttatttctgccctgtcagcccgtcccaacccctgtggttctgaaacctcctctgcctccatgcccaatctcctggggcgaatcagggccagccgtggacggtatcagacgaactcccgccccttag

SEQ ID NO: 44956 - DNA, 456 bp, Artificial Sequence
  Description of Artificial Sequence: Synthetic coding sequence
atgttcctgcacctggacagccacagcagcctggagcggaccaagcccaccgtcgtgggcgtggacacccacatggaattagatgaagtccactgttgtccaggccgtgattctggggggggcttcataaaaggacctatgctccaaggtctgcagggcgaaggcaaattagccccgattcctaaaccaacccttcccagtccatcaaggctcacactcttcgtttctagttctcagatggaagaccacggcttccccgccagaagaaatggcctgacacaggcctcgttcatctatcagatgcccgctggctgggggagtcctggggggctgtttttaccctgccagccagtacccacccctgtggttttaaagccgcccctcccgccatgtcctatatcttggggggaaagcgggcccgccgttgacgggatacgccggacccccgctccatag

SEQ ID NO: 44957 - DNA, 558 bp, Artificial Sequence
  Description of Artificial Sequence: Synthetic coding sequence
atgatggccctggtgcgggaccggcgggcccactacgtgatgagcatcgttattagatgggtgcactgcttttccagttccctgcgaggcacctttggcacacggtgggaagccatgaaagccaaagccaccgagctcagggtgtgctgcgcccgcagaaagcgggaagcccgggagtttaagcctccacagatgagaggtagcactagactgaatatttctgatgacctgaaaatcggatttttttccacagaccacgcgacccagacggacagcagcgagatcctctctgtcaaggagttgtcaagttcaacacagaaactggcacagatgatgaaatcgctgcaggttgatttcggatttttgaagcagctcctgcaactcaagtttgaagatcgccttaaagaggagtctctgagtctgttcaccattctccatgatcggatcttggagatagagaagcattaccaacagaacgaagataagatgaggaaatcgttcaaccagcagttagcagacgcaattgctgttataaagggcatgtaccagcctttgtag

SEQ ID NO: 44958 - DNA, 891 bp, Artificial Sequence
  Description of Artificial Sequence: Synthetic coding sequence
ggccggaagatcatggagggcctggaggccagcatcgagcagttccagttcaatcccaggctgaatatctcggatgacctgaaaattggatttttttcaacggaccacgcaacgcagaccgatagtagtgaaatactgtccgtcaaggaactaagctcatcaacccagaagttagcccagatgatgaaatctctgcaggtggactttgggtttctgaaacagttactacagctgaagtttgaggatagactgaaagaagaatcactctctctattcactattctgcatgatcgcatcctggaaatcgagaagcattatcagcagaacgaggacaagatgaggaaatcttttaatcagcagctggctgacgccatcgccgtgatcaaaggcatgtatcagcagttcttcgaagtggaagaagagaacgtatctctgcaggacgcctcaaccgtcaagacgaacattctgctccgtaagcttaaggagaaggaggaggtgatcaaagagttgaaagaagagctcgaccagtataaagatttcgggttccataagatggagtcttttgctaaggagacctcgtcaccaaaaagcaatctggagaaagagaacctggaatataaggtggagaatgagaggctcctccagattatatcggagctcgaagaggaaatacagatcaacctgaaagaaaattctggattggaggacgagcttatcagcatgaaagaaatggcggaaaaagaccacaagactatacaaaaattaatggactctcgggataggctgcgtgaggaattgcactatgagaagtcactggttcaggacgtcatcaataaacaaaaagaagataaggagatgagaaaaaagtatggcagcctgtcggtgaagtag

SEQ ID NO: 44959 - DNA, 1887 bp, Artificial Sequence
  Description of Artificial Sequence: Synthetic coding sequence
atgaccgaggagcagacctaccaggccgccgagaagagccaggcccacaacgaagtccctaacgaaagactcgtggttgaacaccaggagtcgctcagcaagactaaactgcagattaaaaagcaggagacctccaccgagcaacctctgactacccctgacaaggagccaaatgagaatctgattctgcgtcaccaggactctatgtccaaatccgagatgcaagtcaaagagcaacggacccttaaaggtcagcggattatcacacatgatgaggagcctggcaagaatctcgtgctcgagcatcaggactcggtgtccaaactggaaatgcagattgagaagacaaagaaactgccaagagaaaagaggcacagcacccacgacgaggaatccggcgaaaatcccatgctgaagcaccaggattctgtgagcaaaatacaggtgcagctggagatccaagaaacatccgaaggagagggcagaagcatcccagacaagaacagtatgttcgtccaccaggacagtgtttcaaagcttcagatgcaagaaaagaagaaaatcacacctggccgagaacgccgcaacacacgaattgtagtgccgaatgaaaacgtgatctccgtgcaccaggactctaaatccaagctccagatgcaagaaaaaaaacagatcaatagcggcgtcgagcgtcataagactttccctctagagattaaaaagaaggatatcagcctggagcacctgctgcccgaagagaaggttcttctctcccggagtgaaagccagactaaaaaactgcaggcaaaagtaacctcccgaaagaagactgatattgagtcactgcggggtgccctgggacggaggcttttgaatgacgaattcaagacacaatcgaagtcatttcccggaccagatatagaacaacttacagacgccttcggacgggatattttgaaggatgaattcaagacccgtagcaagtcgctcccggagactgacgaaaggcttcatagcaccaccgaaagagggacgattaacgacgcaataaaaacccagctaaaacggaagtcctacccagaaacagtgctcaagcatttgaaaggcgtcaatggtaaggacataatcaaacacctgatcaacattcagagcaaaagccacggggaaacagataaaaatttttttgcatacgctacaggcagagggcttatgaaagagagcaccactacacagctaaaatcacatcctgaaacagataaggagttcctggcagatgctatcggtaggggcatcatcatcggaccgatcaccacgcagttgaagtcacaccgggagacagataaagaactgttaaaggatgcgatcggccgtgatatcatcaagggtccaatcagcgcgcaactgaagtcccatcaagagacggacgtggaaccgctcactaacgccatcggatcttcaaagacaattggggaaatcaaaactcagctccggacccactacgacgtgaatctcttcaagaataaagatatgtccgtgcagcgccaggaaggaatatttacacggagtatcaccccatccaagtttcctaccaaggtcataaacctctctccttttgagaacaaagaagaaacctacgagtacagtagcccttacgtgaccgcccccagcaaggctatctaccgcacctatagagccggcccatcattcagcaaggacatccacctgccgttgctgaaccaattaccaagcggacattctaaggtggtaactctgagtcagaagactatagagtttaccctccccaccgtgacaaacactgtgggcaaaccgacatacaaagtgctgcacgcggccgcgcgcaagagcgtgccacacccctacttctag

SEQ ID NO: 44960 - DNA, 2079 bp, Artificial Sequence
  Description of Artificial Sequence: Synthetic coding sequence
atgaccgaggagcagacctaccaggccgccgagaagagccaggcccacaatgaggtgccgaatgagagactcgtggtggaacatcaggagtcactctcaaagacgaaacttcaaataaaaaagcaggaaacttcaacagagcaacctctgacaactcccgacaaggaaccaaacgagaacctcatcttaagacatcaggactccatgtcgaaatctgagatgcaggttaaagaacagcggacgctgaaaggccaacgaataataactcacgacgaagaaccggggaagaacttggtgctggagcatcaggactccgtttccaagctcgaaatgcagattgagaaaacaaaaaaacttccaagagagaaaagacacagcactcacgacgaggagtctggcgaaaatcccatgctgaagcaccaggactctgtgtccaaaattcaggtgcagctggaaattcaggaaacttccgaaggcgaagggagaagtatccccgataagaactcgatgttcgtgcaccaggactcagtgtctaagttgcaaatgcaggaaaaaaaaaaaatcactcctggtagagaacggcgaaacactcggattgtagtgccaaatgagaatgtgatcagcgtccaccaggactccaagagtaagctgcaaatgcaggaaaagaagcagatcaactctggagttgaaagacataaaactttccctctcgagataaaaaaaaaggatatcagcctcgaacacctgctgcccgaggagaaggtgcttctcagccgtagcgaatcacagaccaaaaaacttcaagcaaaggtgacctcccgcaaaataaagaatgaagccgcaagcgagctgcccgatactgccgagaaccttccagccatgtacccatccatctcggatttgataatccagtttgacttgaataaggtcgtggagacggacattgagagtttacgcggagcactgggacgtcggctgcttaatgatgaattcaagactcaaagcaagtcatttccaggcccagacatcgaacagttgaccgacgctttcggtcgcgacatcctcaaagacgagtttaagacccgatctaaatccctgcccgagacagacgagcggcttcacagtactacggagcgcggcaccattaacgatgccattaagacccagttgaagcgcaaaagttatcctgagacagtcctaaaacatcttaagggggtgaacggcaaagatatcatcaagcatctgataaatattcagtccaaatctcacggcgaaaccgacaaagagcacttggcagacgacacagggaggggcattatcaagggttcaattaatgcccagctcaagggtcaccagaaaacggataagaatttcttcgcatacgccacggggcgcggacttatgaaggaaagcactaccacccagctcaagtcccacccggaaacagataaagagttcctcgcggacgcaattgggcgaggaataatcatcggccccatcactacacaactgaaatctcaccgggagaccgacaaagagcttctgaaagacgctattggaagagatataattaaagggcctatatccgcccagttgaagagccatcaggagactgatgtggaacctctgactaacgccatagggtcatccaaaaccatcggcgagatcaagactcagctaaggacacactacgatgttaatctgttcaagaataaagatatgagcgtgcaacgtcaggaagggattttcacccgatctatcactcccagcaagtttcccaccaaagttattaacctgtctccctttgaaaacaaagaggaaacatatgagtattcctccccctatgtgacggccccaagcaaagccatctacaggacctatagggcgggccctagcttctccaaggacatccatttgcctctgctgaaccagcttccatctgggcatagtaaagttgtgactctctcccagaagaccattgagtttacccttcccacagtcaccaacaccgtgggcaagcccacttataaggttctacacgctgctgcacgtaaaagcgtacctcacccctatttctag

SEQ ID NO: 44961 - DNA, 1815 bp, Artificial Sequence
  Description of Artificial Sequence: Synthetic coding sequence
gcccacaacgaggtgcccaacgagcggctggtggtggagcaccaggaatctctttccaaaactaaactgcaaattaagaagcaggagaccagtactgagcagcctctcaccactccagataaagagccgaacgagaatctaattctgcggcaccaggatagcatgagtaagtctgagatgcaggtgaaggaacagcgcacgctgaaaggacagaggatcattacccacgatgaggaaagcggcgaaaacccgatgctgaagcatcaggattccgtctctaagatacaggtacagctggaaatccaggaaacatccgagggtgaggggaggtctatacctgataaaaacagtatgttcgtgcaccaagattctgtttccaagctgcagatgcaagagaaaaaaaaaattacacccgggcgcgagcgcagaaacacacggattgtggttccgaacgagaacgtcatttcggttcatcaggactcaaagagcaagttacagatgcaggaaaagaagcagattaattcaggcgtggagcgccataagactttcccactagagatcaagaaaaaggacatctcactggaacatctcctgcccgaggaaaaggtgctcttatctagatcggaatcccaaacgaaaaaactccaggctaaggtgacatctcggaaaaagactgacatagagtctctcagaggggccctgggacggaggctcctcaacgacgagttcaaaacccagagcaaaagcttcccagggcccgatatcgagcaactgaccgatgccttcggaagggacatcttgaaagatgaatttaaaacccggtctaaatctctcccagagacagatgagaggctgcacagcacaacggagagaggcacgattaacgacgccatcaaaacgcagctgaaacgcaagagttatcccgaaacagtcctgaagcacctcaagggggtgaatggtaaggacattatcaaacacctgataaacatacagtcaaagtcgcacggggaaacagacaaggagcacctcgctgacgataccggccgcggcatcatcaagggctcgattaatgcgcagcttaagggacaccagaagaccgataagaattttttcgcgtacgccaccggtaggggacttatgaaagagagcaccacaactcagctgaagagccaccctgaaactgataaggagtttcttgccgatgctatcggccgcggcatcatcatcgggccaattacgacccagctaaagtcacatcgtgagactgacaaggagctgttgaaggatgctattggcagagacatcattaaaggaccaatctccgctcagcttaaaagtcaccaggagaccgacgtcgagcccctgacaaatgctattggttcaagcaagactatcggagaaattaagacacagctgcgtacccactatgacgtaaacctgttcaagaataaagatatgagtgtccagagacaggaggggattttcactaggtcaataacaccgagcaagttccctacgaaagtaatcaatctgagccccttcgagaacaaggaggaaacctacgagtatagtagcccttatgtgacagccccctctaaagccatttatcgaacatatcgtgcaggaccatcgttcagtaaggacattcatctgcccctgctgaaccagctcccaagcgggcatagcaaagtggttaccctgagccaaaagacgatcgaatttacattgcctacagtgacgaatactgtcggtaagccaacatacaaggtcttgcacgcagcagctagaaagagtgtgccccacccgtacttttag

SEQ ID NO: 44962 - DNA, 2160 bp, Artificial Sequence
  Description of Artificial Sequence: Synthetic coding sequence
atgatgcagggcaacaagaagtgcaccgacgccttcagcgacagctcgtcaatcggctctgtgctcgacgacgctgatagagaggtctcctcgctgacagatcgggcctttcgctctttgtgcatatccgaggacaccagctttcacgattcgtacctggcggtttcccccgacataacaaggcaggtgtttggcacgttccaccaacgtacagtgggccatacacagcgaaaatctgggatctggtcacagctgccctctcagggcactgagcacagcggatgggcagccactttccagcagctgcctaagtatgtgcagggcgaggagaaatatccgaagacatcccctccccccacaccagtacaacggaggctcgaggtacccgtttctggtctgcgatctagtaataagcctgtatcgaaagtttctacgttgatcaagagcttcgacagaacggaaagccagcggtgcgaatcacgtcccactgctagtaaaccgcccgcgttgaagaaccctcctaagtttgcacccttaccagagaactccgtcaatttttgctttgactctgccttcttgactgtacgcagggtgcccgctgaggttagtaatacacatcagaacagttatcaacctggcaggaagcatggggaacaggagtctagtaagaatcccgagatggcttgtcatggcagttcctcattcctccccgccgcaaatgatacagcaaccctgtgcgagtcaaagttcccgtccccacatcacaaacctgtaaccggcgaaccagggcggggcaagggtacatttttacacagcgagaattcagcgttcgagagttggaacgcacaccagccaaagctcctggagcgcaaggatacggcaggcacggttcccgagtctaaagctcccaaacattacggcgacaccaccctcctgagggagccttgtcctccggaacgaaccgttagcccttgtcaagtgcaagcgtcatgctcccaggaagaaaatcggctggcagccggcgccctctccaccagcataccatggggctgcagagatcctggagcacaagtttttgccgtggagggaaaggccccttccagccagccagattcacaggaaaagccggcccagcctccttggaggaaaccgaagaccggcaagaagggcaaggagagcttacaagatacactcgaggaaaagacgcagaccaaccaacgcgggccaccactgtacaccaaacataatccacaggaacagttctccgaaaataacgctcttgatttgccagtggaacccaacgagcattatgacccgcctttcaacatttccaagctgctcacacccatcatcccctctaaacatgctctcgattcagcagacagccaacccgcagagcgtactccctccccccccggtcagctaaacggctatcaggagaaggagcccagcgaatgtcagtcacgagattcctataaaagcaaggcaccttccctcttgttcaatctgaaggatgtaagaaaaagagtaaaaagcacatactcctcttctcctttgctgaaagtcctggatgaaaagacccggggcaaagtcgatggaaaacaagaacccgtcagtaacggggtgatcttgcctaatggactggaagagtctccacccaatgagctgagcaaggagcgccccgccgacgatccgacagcatcccatatcaatcctcagaaggatcctacggccgacccaagcgagccaagtgccgattcctacttaaccctctctaccgcgcctactatcgctaaggctccattctacgtgaatggagaggcagcagaaagaagctcttatgaaaacaaagaggttgagggagagctagaaatgggccctgcaggcagcagctggtgcccagactcgcgcgaacatcgaccgagaaagcatctgtcactaagattatgtaacagggatcctgaacctggcggggctactgaaaaaatgaaaactcatcagctggagaatgggctaagccgatccgtatcacaagagactgaaccagaacgggaagccggtctgcagaacactcatacgcatacacatactcatacccatacgcatgatcaccagcacattttgagcttgtttagatcaattaaatccaggaggcagtag

SEQ ID NO: 44963 - DNA, 4308 bp, Artificial Sequence
  Description of Artificial Sequence: Synthetic coding sequence
atgatgcagggcaacaagaagtgcaccgacgccttcagcgacagctcatccattgggagcgtgctggacgacgctgatcgtgaggtctcatctttgaccgaccgagctttcaggagtttgtgcattagcgaagataccagctttcacgacagctacctggcagtgagtcctgacatcacgcgccaggttttcgggaccttccaccagaggaccgtggggcacacccaaagaaaaagcggcatctggagccagctgcccagccagggcacggagcattcagggtgggcagcaacctttcaacagttgccgaagtatgtacagggtgaggagaaatatcccaaaacaagtccccctccaacccctgtccaacgtcgcctggaggtgcccgtgtccgggctcaggagctccaacaagcctgtgtctaaggtgagcaccctaataaagagctttgacagaactgagtctcagaggtgcgagagtaggcccaccgccagtaaacctcctgcattaaagaatcctcctaagttcgcccctctgcccgaaaattccgtcaatttctgcttcgactctgcttttctgacagtgagaagagtgccagctgaagtcagtaacacccaccagaattcctatcaaccagggcgcaaacacggtgaacaagagtcctcgaagaaccccgaaatggcctgccacggatcaagtagctttctccccgctgccaatgatactgctacactgtgcgaatctaaattccctagtccgcatcataagcccgtgactggggagcctgggcgaggcaaggggacctttctgcattccgagaattctgcatttgaatcatggaacgctcaccaaccaaagttgctggagcgcaaggacaccgctggaactgtgcctgaatcgaaagcacccaagcattatggagatacaactctgctcagagagccttgtccacccgaacgcactgtctcaccctgtcaagtgcaagcgagttgttctcaggaggagaaccgtctagccgctggagctctgagcaccagcatcccctggggctgcagggatccgggggcccaggtgtttgccgtggagggcaaagcaccaagtagccagccggattcccaggaaaaaccagcccaaccgccttggagaaaaccaaagacaggaaaaaagggcaaagagtctttgcaggacaccttagaagagaagacacaaacgaaccagagaggtccgcctctttatacgaagcacaacccccaagagcagttctctgagaataatgctctggatctgcctgtggaaccaaatgagcactacgatcccccctttaatattagcaagctcttgactcccatcatccccagcaagcacgcactggattccgctgacagtcagcccgcagagcgtaccccttcacctcccgggcagctgaacggatatcaggagaaagaaccctccgagtgtcagtcccgcgacagttataagtcgaaggcgccttcacttctcttcaatcttaaagatgtccgaaaacgggtgaaatctacatatagctcctcacccttgttgaaagtgctggatgaaaagacgagggggaaagtggacggcaagcaggagccggtatcgaacggtgtgatcctgcccaacggtttggaagagtcacctcctaacgaactgtccaaggaaaggcccgctgatgatccaaccgcctctcacatcaatcctcagaaggatcctacagctgatcccagcgagcccagtgccgacagttatcttaccctctcaactgcccccaccatcgcgaaggctccattttacgtaaacggcgaagccgctgaacgatcctcctacgaaaacaaggaggtcgaaggagaattagaaatgggacccgcaggatcttcatggtgtcctgatagcagagaacatcgcccccggaagcacctgagcctgaggctgtgtaatcgagaccccgagccggggggagcgaccgagaaaatgaaaactcatcaattagagaatgggttgagtagaagtgtgtcgcaggagacagagcccgagagagaggctggactgcagaatacacacttaaatcagaagtttttccccggaccactttctccagaggaggaggatgtgttttacagcgacagccagagcgatttcatgccgtccctgaagggcaaggccaaattctctaccagttcctccgatcagtcatttgccagcttcgatgaccagcaaaaaatgtggttcacggaaaaccagcgggaggatcgcaggaaagacgtgagcgccggtgattctcaaaaggacgagaaggaaaacgtcatgcgaaaggatgagctgcagtattgcgccttgagtaatggtcatgcgtgtctggaaaaccgcagccagggggaagccctgcagcgcgagcgtgaatcagtgtccggtgggcgaaccagaaaagcaagcgctgaagaggccaacttccggggttcgtggataggggaaaacaagggcaccactttcagccaggctaaggatctgactcctagcccctctagtgctagcaatcggcacatgcttttcacgattaaagacaacacgttacgagccacgcctgtgatcaaaccgattatgctcccattgctgcgcaccatgtcactagaagactctctctcctccggacataaggaggaggagctaccccgaccagagtggggagaggatcctggcttttgcgcacccgagaatcaagacattctaggaacatcaactccaaccaatacacgggggaccagggtgaaatgcatggcgaatgaggtgatggaagatcccggtcaaggctccagtatggctcggatggaggcctcacagcccgcacctaagggcaactttccgtccatgccactggtgggtgagggagatcgcgtaaaggctcccccagacgcggcccctggcctggtggccagcaactgcaagtccggaagtgcagactcaggcaagctggctgccccctggcacattcctactatagcccttcccgagggagacatagaggaccaaccaccgccctggcagcctgagaattgctgggaagaacagacgcctggattcaaatcgcattttctcagtaccccccgagcaggcccacccggcagacggctggttccctccgagcgggcaaacagtccaaatcctggaagccccggggagtctagtgcatgtagcccggcagcgagcaacatatgggaggaatcttcccaggccccaggcggcccggaactcctgcccgaagagccaaatcaagcctctccatgggcgagttcctctcccgcacgagtcaccagaagagaggacctgacacatgccctggtctgggaaggcggaagtgatcccctcttagagctatcagctgaagatttacggactctatcccctcgaggttctttgttggacgtggcaacttcaccagctggtacctcagggagattggagttgcctgcccaactagagcggaccgcatctaaaccgccggccgtgcccccaaaaaccgagaaggccctcagaagagccaagaagttagcttcgaagcgcaggaaaaccgatcaggcacaggaaaagcatggcgagagccaagaaggtaagccatgtccggaagaccttgagcagacacagcaacgccccctgtgcccgcgcgaacgcccccgccacaacttccctgtggttcgctccctgccaccccccgtgcaccggcactccgtgtccggcttctccgaacctgtcggtagacgcccaggcggtcctcagagtctgactcctctgccagcttatcccgcgacacagaaggtactccaggacccccagagcggagaatactttgtgttcgacctgccactgcaggtgaaaatcaaaacgttctacgaccccgaaaccggtaagtatgttaaagtctccatacctagcagcgaaggcgccagtccagaacctccacctccggacgcgcttgcagccccttatgtcttgtatcctgggttccagccagtgccagtcaccgctctgatgccactccgctgtagtagtcagctctcagcccctacgtttttgcggcagggaccacgcgcctctgcagccagggcgagaacacagagcgtccatgaaagtggcctgcagctagatccaggaccccatggggattgcacgccacacagcgccgggcagcgcccacacggccctcctcagtcgccaggggaggagggggtggaggcgcccggactgggcatcataagcaccgacgacctggaagacttcgcaaccgaaggcataagctag

SEQ ID NO: 44964 - DNA, 480 bp, Artificial Sequence
  Description of Artificial Sequence: Synthetic coding sequence
cccatgcggcaccggaagaaggccgccgacaagaacctgccctgcaggcctcttgtatgtgctgtcctggatttgatggtggaatttatcgtgacacacatgatgaaggagtttcctatggatctgtacatccgctgcatccaggtggtgcataagctgttatgctatcagaagaagtgccgagtgagactgcattatacctggagggagctttggtccgcactcattaacctcctgaaattcctgatgagcaatgaaaccgtgctgctggccaagcacaacatcttcaccctggctctaatgattgtcaatttgtttaatatgttcatcacctatggagatacttttctccctacacccagctcctacgacgagttgtattatgaaatcatccggatgcaccagtccttcgacaacctgtactcgatggaaccatctagcaccactctcacacctaaactatctcccacccttctttag

SEQ ID NO: 44965 - DNA, 597 bp, Artificial Sequence
  Description of Artificial Sequence: Synthetic coding sequence
atggagagctacttcttcaaggagaccagccacgagagcgtggactcaagtaaggaggaaccacagactcttccagaaacccaggacggcgacctacacctgcaggagcagggatcagggatcgattggtgtctttctcctgctgatgtcgaggctcagaccacaaatgatcagaagggtaacattcctgatgagagccaggtcgagaagctgaacgtgttcctctccccccccgatgttattaattacctggccctcaccgaagcaaccggccgcatctgtgtcagccagtgggaaggcccacctcgcttaggctgtattttctgccatggtgatcacctgttagccgtgaacgacctgaagcctcaaagtctggaagaggtctctcttttcctgacccgttcgatccaaaaggagaaactcaaactgaccatcgggagaattccaaattccgaaacttttcacgctgcaagctgtatgtgcccatcaaaatgccagtcagccgctccttctcaacttgacaagcctcgtctgaatcgagcaccaaagaggtcacccgccattaaaaagtcccaacaaaagggggccagagagtag

SEQ ID NO: 44966 - DNA, 1092 bp, Artificial Sequence
  Description of Artificial Sequence: Synthetic coding sequence
atggagcccaagccccagaagagccccggcaagcagttcaccttcagctacgaaaatgaagtgtgtaaacaagattacttcatcaagagccctccttcacagctcttctccagcgtgacaagttggaagaagcgcttttttatcctgtcaaaagctggcgaaaagagcttctcgctgtcatactacaaggaccaccaccaccgtggaagtatagagattgatcagaacagcagcgttgaagttgggatctcctctcaagagaaaatgcagagcgtccagaagatgttcaaatgccatcctgacgaagtaatgtctatccgaacaaccaatcgggaatactttctcataggccacgatcgcgagaagattaaggattgggtgagcttcatgtctagcttccggcaggatattaaggctacccagcaaaacaccgaggaagagctttcactgggaaacaaaagaaccctgttctattccagccccctcctcgggccctccagtactagtgaagccgtggggtctagcagtccccgcaatggattgcaagataaacacctcatggaacagtctagtccaggctttcgccagacgcatctgcaggatcttagtgaggctacccaggacgtgaaggaagaaaatcattatttaacgcctcggagcgtgcttctggagcttgataatatcatcgcctcaagcgactcaggggaatctatagagaccgatggaccggaccaggtgtctggcagaattgagtgccactacgagcctatggaaagttacttcttcaaagagaccagccacgagtccgtggattcgagcaaagaagagccccagacgctgcccgagacccaagatggggacctgcatctgcaggagcagggctctgggattgattggtgcctgagccccgctgacgtggaagcacagactactaatgaccagaaaggttccgcttcattgacagtcgtgcaattgagcatcctcattaataacatacctgacgagagtcaggtagagaagctgaatgtgtttctgtcacctcccgatgtgatcaattacctcgctctgaccgaggctacggggagaatctag

SEQ ID NO: 44967 - DNA, 849 bp, Artificial Sequence
  Description of Artificial Sequence: Synthetic coding sequence
atggagcagagcagccccggcttccggcagacccacctgcaggacctttccgaggctacccaagacgtgaaagaagaaaaccactacctgacccccagaagcgtattattagagttggataacatcatcgccagcagcgactcaggtgaaagcattgaaactgacggccctgaccaagtttccgggaggatcgagtgccactacgagcccatggagtcttacttcttcaaagaaacctctcacgagtctgtcgattcatcaaaggaagaaccacagaccctgccagagacacaagacggggatttacacctgcaagagcagggcagcggcatcgactggtgcctatcccccgccgacgtcgaggcacagacaacgaatgatcagaaaggttcagcgtctctgaccgtggttcagctgagcatcttaattaataatatccctgatgagtcccaggtggagaagctgaatgtgttcctctctccacctgacgttattaactacctagctctgaccgaggcaactggacggatctgcgtgtcccagtgggaaggacctcctcggctgggatgcatattctgccatggagatcacctcctcgctgttaacgacttaaagccgcagtccttggaggaggtgtcactctttttgacaaggagcatacagaaagaaaaactcaagttaaccattggccgcatacccaactctgagacatttcatgccgcctcgtgcatgtgcccaagtaaatgtcagtcagccgccccctcacagctcgacaagccaagactgaatagagctcccaagcggagtcctgcgatcaagaagagccagcagaaaggtgcacgggagtag

SEQ ID NO: 44968 - DNA, 1398 bp, Artificial Sequence
  Description of Artificial Sequence: Synthetic coding sequence
atggccggcggcaagcagttcaccttcagctacgagaacgaggtgtgtaaacaggattacttcatcaaatctcctccttcccagctcttttcctctgtaactagctggaagaaacggttcttcattctgagcaaagcaggagaaaaatccttctccctgtcgtactacaaagaccatcatcataggggaagcatcgagatagatcagaactcatctgttgaggtcggcatatcttctcaggagaaaatgcaaagtgttcaaaaaatgtttaaatgtcaccccgacgaagtgatgagtatacgcactaccaatcgagagtactttcttattggacatgatagagagaaaattaaggactgggtgtcatttatgtcctcttttagacaggacatcaaggccacgcagcagaacacggaggaggaactgtcactcggcaataagagaaccctgttctacagctccccactgctgggaccgagtagcactagcgaagctgtcggatccagcagcccgcggaacggacttcaagacaagcatctgatggagcagagcagccctgggttccggcaaactcatctccaagatcttagtgaggctactcaggacgtaaaggaagagaatcactatctgacgcctcgatccgtactcctggagctcgacaacatcattgcttccagtgatagtggggagagcatcgagacggatggcccagaccaagttagtgggaggatcgagtgccactacgagccaatggaaagctatttcttcaaagaaacaagtcacgagagtgtcgattccagcaaagaagaaccccagacgctaccggaaacccaggacggggatctgcacctccaggaacaggggtccgggatcgactggtgcctgtccccagccgacgtcgaagctcagactactaacgatcagaagggcaacattcctgacgaatcccaggtggagaagctgaatgtgttcctgagccccccggatgtcatcaattacttggctctcaccgaggcaacaggccgcatctgcgtgagccagtgggagggtcctccaaggctgggttgcattttctgtcatggagatcatctgctggctgtcaatgaccttaaacctcagagcttagaggaggtctccctcttcctgacgaggtctatacaaaaggaagactccttcagaatcctttcctatcaggtagcattcggagaggggaccgagctccgagaccgggcccctgggtttaggacctccgacagacatgacgtcgccaagagagcctgtatggagagcgactggtgtcgcgactccaaaaccgcaccctccacaaatctgtgtctatctttcttgttttgcaagattatgactaacgacggcgctggctgctggataattaaatag

SEQ ID NO: 44969 - DNA, 1101 bp, Artificial Sequence
  Description of Artificial Sequence: Synthetic coding sequence
atgcagagcgtgcagaagatgttcaagtgccaccccgacgaggtgatgtccattaggacaacaaatagagagtatttcctgatcggtcatgaccgggagaagatcaaagactgggttagctttatgtcgtcgttccgccaggacattaaagcaacgcagcagaacacggaagaagagctaagccttggcaacaagagaacactgttctatagctcacccctgctgggcccgtcatccacctctgaggccgtgggctcaagctcacctagaaacgggctgcaggataaacacctcatggaacaaagtagccccggatttcggcagacgcatctgcaggacctctccgaagcaactcaggacgtcaaagaggaaaaccactatttgactccccgctctgtccttctggagttggacaatatcatcgcctcctcagactccggtgaatccatagaaacagatgggcctgatcaggtgtcagggcgtatcgaatgccactacgagcctatggagtcatatttcttcaaggaaacctcacacgagagtgtcgattccagcaaggaggagccccaaactctgcctgaaacccaggacggggaccttcatctccaagaacagggcagtgggattgactggtgtctgagcccagctgatgttgaagcccagacaactaatgatcaaaagggtaatatcccagatgagtcccaggtggagaagctcaacgtgtttttgtcacctccagacgttataaactatcttgcactgaccgaggctaccggcaggatatgtgtttcacagtgggagggacctcccagattggggtgcattttttgtcacggtgatcatttactggctgtaaacgatctcaagccacagtctctcgaagaagtcagcctttttctgacccgcagcattcagaaagagaaactgaaactgacaattggccggatccccaacagcgagacttttcacgccgcaagttgcatgtgcccatctaaatgtcagagcgcagccccttcacagctggacaaaccacgccttaaccgagcacctaagcggagccccgccatcaaaaagagccagcagaaaggtgcccgagagtag

SEQ ID NO: 44970 - DNA, 591 bp, Artificial Sequence
  Description of Artificial Sequence: Synthetic coding sequence
tgacaggagcagggcagcggcatcgactggtgcctgagccccgccgacgtggaggcccagactacgaacgaccagaaagggtctgccagccttaccgtggtgcaactgtctattctgattaacaatatcccagatgagagccaggtagagaagcttaacgtgttcctctcgcctcccgatgtcatcaactatttggccctcacggaggccacagggcgcatctgtgtgtcccagtgggaaggcccacctcgcctgggatgcatcttttgtcacggcgaccacctactcgcggttaacgaccttaaaccccaatctcttgaagaggtctccctcttcctcaccagatcgattcagaaggaagattcattccggattctctcttaccaggtggcatttggtgaggggaccgaactaagagatcgggctccaggctttcgtacaagcgatcggcacgacgtagccaaaagggcctgcatggagagcgactggtgtcgcgacagcaaaacagcccctagtactaacttatgcctgtcttttttgttttgtaaaatcatgacaaatgatggagctggctgctggatcataaagtag

SEQ ID NO: 44971 - DNA, 465 bp, Artificial Sequence
  Description of Artificial Sequence: Synthetic coding sequence
atggagcccagcaagaccttcatgcggaacctgcccatcacccccggctattctggcttcgtgcctttcttaagctgtcagggcatgtctaaggaagacgatatgaatcactgcgtgaagactttccaggagaagacacaaagatacaaagaacagcttagagagctgtgctgtgccgtggctactgcccccaaactgaagcccgtgaactccgaggagaccgtgctacaggccctccaccagtacaacctgcaatatcacccccttattctggaatgcaaatacgtgaagaagccgctgcaggaaccgccaatccctggatgggctggctatcttcctagggctaaggtgacagaatttggatgtggaacccgctacactgtcatggctaagaattgctacaaagatttccttgaaattactgagcgggccaagaaggcccatctgaagccgtatgaagaatag

SEQ ID NO: 44972 - DNA, 693 bp, Artificial Sequence
  Description of Artificial Sequence: Synthetic coding sequence
atggagcccagcaagaccttcatgcggaacctgcccatcacccccgggtacagcgggtttgttcccttcttatcttgccagggaatgagcaaagaagacgatatgaatcactgtgtcaaaacatttcaggagaaaactcaaagatacaaggagcagctgagggagctgtgctgcgccgtggccacagctcccaaactgaagccagtcaacagcgaggagactgtgctgcaagcgctccaccagtacaaccttcagtatcatccactcatcctcgaatgtaaatacgtgaagaagccactccaagaaccacccatacccggctgggccggctatcttcctagagccaaggtaacggaatttggttgcggcactcgttatactgtcatggcaaagaattgttacaaggatttcctcgagatcactgaaagagccaagaaggcacacctgaagccatacgaggagatctacggtgtgagctctacgaagaccagtgccccatctccaaaagtgcttcagcatgaggagctgctgcccaagtaccccgacttttccatacctgacggtagttgtccagcgctcggacgtccacttagggaggaccctaagacaccccttacctgcggttgtgctcagagaccctcgattccctgttctggcaagatgtatctggagccacttagcagtgccaagtag

SEQ ID NO: 44973 - DNA, 387 bp, Artificial Sequence
  Description of Artificial Sequence: Synthetic coding sequence
atggcctggcgggtgcccggcgtgcggcccgccagcaccttcttccctcaggtgcttagggctagttccgagctgcccaaccgtttgcctgaggggagtactgtgggtcctaaacccgactccagctgggaggctggcagtcagggaaactggggcctgacaagttcaggcgcaggccaggatagcagcgctcagaaactcggaattctttccgttcagatcagcttgaaaatatggacatgggaaaagcccagcggttggggacatctccatgccgcagtcactggtgccagttgctgtagccccctgtcccagggcggggctatttgtctcgtgaccgcgccacaggacaaaccggattgttcgccctgcacgtccggccactag

SEQ ID NO: 44974 - DNA, 1338 bp, Artificial Sequence
  Description of Artificial Sequence: Synthetic coding sequence
atggagacccggaccgaggacggcggcctgacccggcggcccaccctggcttcatcatgggatgtggccggcggggccttgacacacagcctgctgcttacccgcgccggcctggggccgggcgattttgattgggaggaacttcttgctccgccagccccaggccaagacttggtaatccttaaacggaaccacaacaacaaggatgaaaatccttgcttcctttatctacgctgtggccccgacgggggcgaagagattgcctcgatcgggattctctcaagtgccaggaatatggaggtctatctgggggaagagtattgtggcaccagtcgaggtaagaatgtctgcacagtcctggacgacagtgaacatgagaaaatcattctgtacaagaagaaccttaagcttgagtcttctacacatgcatgtaagattaaactattgagctttggcgaacgccagtgtgtatttatatccaaggtcgtcgtccatatgagatccgtgtttgctaacagctccacctcctctccggcgttggggagtagaatcgacctggataaggtgcagacaatcatggagagtatgggctctaagttgagcccaggagcccagcagttgatggacatggtgcgttgccaacagcggaactgtatcccaatcggagagcagttgcagtccgtgctggggaatagcgggtacaaacacatgattggacttcagtcatcgagcaccctcggaaccctgaataaaagctcttctacacccttccctttccgcaccggactgacgtcgggaaacgtgaccgagaatctgcagacctacatcgacaagtccactcagcttccaggaggcgagaattccaccaagctggatgaatgcaaggtgatgcctcagaaccatagttttttggagaacgacctgaaaaatgcaatggcgtcttttctcccaaaaaaggtaagcgacaacagtaatatccccaatagtgagcttctgccttttcttcaaaatctgtgctcccaggtgaaccacttacacgtgggaaacaagactgagtgccaagaaaacataaccaaacacggggagaggatacttggtgttggcatggaggaacagagtatctgcagctatctcgagaagattctgtctaaaaacatggaactgatggaaaagaagttaatggactatattgaccagaggattcatgagctacaggagcatatcgatgacaaaattgcgctgttgttggacctcctgcagaatcctaactctccgccaaccggaatcccactgcgccattatgactctggcgagcggctgtctaatggcgagaggtag

SEQ ID NO: 44975 - DNA, 438 bp, Artificial Sequence
  Description of Artificial Sequence: Synthetic coding sequence
atgtggagcttcctgcccggcgccgagagcgtgagcatgggccccgtgcctggggtgtcttccctgggagcctgttggactcatgaccaagattccggtcgcgcggaagacagacctcaggctccccgaatcacacagtatacttgggttttatcattcctcttcactgagaagccgcaaacaaggtccacgagcccaatatctcatcagggccagcctcagactacaagagcattgtcccttagacaaccccagcacccttccgctccggccagcggcagaccccgtcctcctcactcatccggtcccgacctggcagaggcagcaccagtggttgaccaggcctcccaggcagccggccgcgcgagctcaggattggggctttgggaacaagcctccgttagccagggctttcgaaacgctgctttcgaggcctag

SEQ ID NO: 44976 - DNA, 438 bp, Artificial Sequence
  Description of Artificial Sequence: Synthetic coding sequence
atgtggagcttcctgcccggcgccgagagcgtgagcatgggccccgtgcctggggtcagcagcctaggggcttgttggactcatgatcaggatagtggacgcgcagaagatcgtcctcaggcgcctcgcataactcagtacacttgggtactttcctttctatttactgaaaagccacagactcgctccactagccctatcagccatcaggggcaaccccagaccactcgggcactgagtttgcggcaacctcagcacccttctgcccccgcttcaggacgccctcgtccaccccatagttcaggtccagatcttgcagaggccgctccagttgttgaccaagcaagccaagcagcgggccgggcttcctcggggctgggtttgtgggagcaagccagcgttagtcagggctttcgtaatgccgcctttgaggcatag

SEQ ID NO: 44977 - DNA, 774 bp, Artificial Sequence
  Description of Artificial Sequence: Synthetic coding sequence
atggagcggagcaacgccgccaccaagtgcggcgaggagccccggtcggggtcccggcgtctaccaaaagcagagggcgataaatcagggagtgcgggcgcaccttccaagaattcatccaggctcggtgggcgcccctgcatgtgcaccgcaggacgaaggcctaatcgggccagcggccgtcggaggcgatcctgtagccccgctccaacttggcccccactgtgctgttacccacaatccagaccaacggctagcgcggccggacccggcgcatgtatgagggcaagcggcagaccccacggcaacacaacagcttccactgccccaccccggcacccccgcccccgacgacccggaggccctgcactgcggcccacgccaaggccttgcgccgggccagcaccacctcccgcgtcgcgcgattgtcgttgtcggcgcccacgtcgctggccccgggcagggcggagaggcagacgtgcaggagcttgtaagcctagttgcgctggcgcggcttggagcgcccggggggcacctctgtgcagttaccggactagctgtgctgggtcctgtggagcaagaacggccccaacccccgcgccgacctgcgccagcccgtctgcggccgcaagctcctgctgcagaaggagacgcgcgtgttcatctccaaccaccgcatggtccggcgcttgtggggctgggcccactgccgctaccgcggctcagccaggtaaacccaggtctgccgccgcaccagggagagctagggcctag

SEQ ID NO: 44978 - DNA, 777 bp, Artificial Sequence
  Description of Artificial Sequence: Synthetic coding sequence
atgagcctggagagcctgttccagcacatcatcttcaccgagcaccaggctgaagagagtaggaggctgatgagagaggtcagaagtgagattacccgttgccgtgaaaagatcaagaaggccactgaggagttaaatgaggagaaaattaagttggaatcgaaagtacagcagttctttgaaaaatcattttttctgcaactgctgaaagcacacgaaaatgccttagaaaaacagtactccgaaatcacaaaccatagaaacatgttgttgcagaccttcgaggccattaagaagcaaatgattgaagaggaggataaatttattaaagagattactgactttaacaacgactatgaaatcaccaaaaagcgcgagctgctaatgaaggagaacgtgaagattgaaatttccgacctggaaaaccaggcaaatatgttgaaatctgagatgaagagtatggagcatgactcaagccaactgaatgaacttcagaagcagaagtccgaattgatccaagagctgttcacccttcagcggaagctgaaagtatttgaggatgaggagaacgaatccatctgtacaaccaaatacctggaggctgaaaaaatcaagatctccgaaaaaccccaaaacgataccgagtgtcttcgcctgaagaaagaactcgaactttataaggaggacgatatggagtccgtctatgaagcattacagacagaaattgaatttctggagttgaccctggcccagaaagacctgcaggagtccaagtag

SEQ ID NO: 44979 - DNA, 543 bp, Artificial Sequence
  Description of Artificial Sequence: Synthetic coding sequence
atgagcctggagagcctgttccagcacatcatcttcaccgagcaccaggcagaggagtccaggagactgatgcgcgaagtcagatctgagatcactaggtgtagggagaagattaagaaggcaaccgaggagctcaatgaggaaaagattaaattggaaagtaaggtccagcagtttttcgaaaaatccttctttctgcaacttttaaaggcccacgaaaatgccctggaaaagcaatactccgaaatcaccaaccatagaaatatgttactgcagacttttgaggccattaagaagcaaatgatcgaggaggaggataagtttatcaaggaaatcaccgatttcaacaatgattacgagatcaccaagaaacgtgaattactgatgaaagagaacgtaaaaattgagataagtgatctggagaatcaggccaacatgttgaagtctgaccgcctcaaaaaggagcttgagctgtacaaggaagacgacatggaatccgtatacgaagccttacagactgagatcgagttcctggagttgtag

SEQ ID NO: 44980 - DNA, 1404 bp, Artificial Sequence
  Description of Artificial Sequence: Synthetic coding sequence
atggagagcagcaccggcccccggatgcccctgctgaagtactgctctgtggcaacctccctcaaagctcctggatgggatggggccgcccctccatgggatctgtcttttacctaccccttcgctctgcaggccccttggttaaccggacacaaaccattagcccggcatgctagctcatgcccctgtctgcacgtcgcagatcccgcctggcaggggccagggtggttgggtcgcgcgggagatgcagcaaacacctgggtgcttgcacgaagagaggcagatgggttctactaccgagcgcaaattaaggccactccagagctggagagacaaggcgtgctgcttgtcgaatttgaagcccccctggtggctggacccaagctgccagcccagcaacagagggtggttctggaggaggacgtgatccccctctcacccagcgtcggctactcactaagacctggggacaaggtgttggcgctctgggagccaggccaacagcagtacggtcccggtacagtgctgctgggtctggaaatgcgcgacccccagcgggcctctaaggaaaaggagatcacagttcacttctggaacggcaaagccgctaaagttccgttaggcggcgttcagtctgtgtctctcactatatggaagaaagcagtggaaaggctgcacaagagcttcaccagggaacatccaagaccactccactgggcaccctgctgtagcttactgggtccgattactggacggattaccaacgagttgcctccagatgccccctttctgtgccccctttgtcatcaccatgcctgctgccagctgctgtgccagggatgtctgtgtggttgccccccatgcgggacaacgtggtggcctttgaccaggacctcggaggtcatggcacgtgagctgccggagcttgaacccacagcccagttgctccctctggaaggaccaaaagaagagaaagtcgcgatgcatgctccgttggcggtttcttcaagctcatcttcctcctgtgagcaggacggggtcgagaacgacctcgagatgggcccaccccaaaggctgatggtgaatagtgccgttaatacagatccaatttttctggagatgcctctgagacagtccggcctctgtcagccagagtggcgttactggaagcggaatggtcccgagccttgcctgggaaaacctgggacgcgatacagtaatatctgtaaggaggaaaaagatcataagcagcagcgcgcacagacagcagtggttggaacgaccaaggaactggtgtcgaaagccactcacatgaaacccccccggacaccccctggtgaagccgaacataggaaaaggagtcagtcactggcaatttgccagtggaacaaaaacagtcggtag

SEQ ID NO: 44981 - DNA, 1215 bp, Artificial Sequence
  Description of Artificial Sequence: Synthetic coding sequence
atggagagcagcaccggcccccggatgcccctgctgaagtactgctctgttgcaacatccctcaaagcccctgggtgggacggtgcggctccaccttgggatctcagttttacatatcccttcgctcttcaggctccctggcttacaggccacaagccgctcgcacggcatgcaagctcctgtccctgtctacatgtagctgatcctgcctggcaggggcctggttggttgggcagagccggagatgcagccaatacctgggtgctggcccgccgtgaagcagacggcttttattacagggctcagatcaaggccacccccgagctggaacggcagggcgttctcttggtggagtttgaagctccactggtggcaggccccaagttaccagcccagcagcagagggtcgtgctggaggaggatgtcattcccttaagcccctctgtgggatattctctacgccccggggacaaagttctcgcgctgtgggaacctggccagcagcagtacggacccggcacagtcctgctgggacttgagatgagagacccacaaagggcgtctaaagagaaggagattaccgtccatttctggaatgggaaggccgccaaagtgccattgggcggcgtacagtctgtgagtctgaccatttggaagaaggccgtagagcggctgcataaaagttttacaagagaacatcctaggcccctgcactgggccccttgctgttctctgctggggcctatcaccgggagaattacaaatgagttgccgcccgacgccccctttctgtgccctctatgtcaccaccacgcgtgctgccagctgctgtgtcagggttgtttgtgcggatgtcccccatgtggtaccacctggtggcccttgaccagaacatcagaggtcatggcccgggagctcccagaacttgagccgacagctcagcttcttcctcttgaaggtcccaaggaggagaaggtggccatgcacgctcccctggctgtctcctccagtagctcatccagttgcgaacaggacggagtggagaatgacttagaaatgggtccacctcaaagactgatggtaaacagtgctgtgaataccgaccccatcttcttagaaatgccccttagacaatcaggcctgtgtcaaccggagtggcgctattggaaacgtaatgggcccgagccctgcctgggaaagccagggaaagagtag

SEQ ID NO: 44982 - DNA, 369 bp, Artificial Sequence
  Description of Artificial Sequence: Synthetic coding sequence
  Description of Combined DNA/RNA Molecule: Synthetic coding sequence
atggccccccggggccggaagcggaaggccgaggccgccgtggtggcagttgccgaaaaacgggagaagttggcaaacggcggagaaggcatggaggaagcaacggttgtgatagaacactgcactagtugacgcgtgtatggcaggaacgctgccgccttgtcccaagcactgcggctggaggccccagaacttcctgttaaggtgaacccaaccaagcccagacgcggaagctttgaagtgacattgctgaggcccgacggtagctcggccgagctctggacaggaatcaagaagggtcctccacggaagcttaagtttcctgaaccacaggaggtggtggaggagttgaaaaagtacttatcatag

SEQ ID NO: 44983 - DNA, 285 bp, Artificial Sequence
  Description of Artificial Sequence: Synthetic coding sequence
  Description of Combined DNA/RNA Molecule: Synthetic coding sequence
tgaggcatggaggaggccaccgtggtgatcgagcactgcaccagcugaagagtgtatggaagaaacgccgctgcattgagccaggcactgcggctggaagctccagagcttcctgtaaaagttaatccaacaaaacctcgacggggatcgttcgaggttaccctactccgcccagacggttccagcgctgagttgtggactgggattaagaaagggcctccccggaaattaaagttccccgagcctcaggaggtcgtggaggagttaaaaaagtatttgtcatag

SEQ ID NO: 44984 - DNA, 369 bp, Artificial Sequence
  Description of Artificial Sequence: Synthetic coding sequence
  Description of Combined DNA/RNA Molecule: Synthetic coding sequence
atggccccccggggccggaagcggaaggccgaggccgccgtggtggctgttgctgaaaaacgggagaagcttgctaacggaggtgaaggtatggaagaggccaccgtggtgatcgagcactgtacctcgugacgcgtttatgggaggaatgccgctgctctgtcccaggcgctcaggctggaagcacccgagctgcccgtaaaggtcaatcctacaaaacctcgtcgaggctctttcgaggtaactttgttgaggcctgacgggagttcagctgaactctggaccggaatcaaaaaggggccaccccggaagctcaaattccccgaaccgcaggaagtggttgaggaacttaagaaatacctatcttag

SEQ ID NO: 44985 - DNA, 1905 bp, Artificial Sequence
  Description of Artificial Sequence: Synthetic coding sequence
atgcggtggctgcggcccgccggccggcggcgggagcaggagagcgttagtggtcacctgggacctccggcaggggccccagctgcgcctgaaacacctacttgcctccctgacaccacccctcaccccgccccagtagtttgcagtgccgatccccagctagctcttgagagcctggacccacgaaccttgagactgctctggcgccagcgggagctcgagatccaagcactcagatgggctattcaaaacggcgaggatgctcggctctgccacatcctcgaggaggtagccgggctgccacccaagagaagtagccactcccaggaaaaattgctgcagaatcaggtccaaaagttaattcaagagttgaaggagcagaaagagcgcgcccagtgggagaaagaacacctggaagagcgcttgctgcaaacaacccgcaccctgcaggagatggaagctgaactgcagaatctgcagaagtcttgtttgctccagttagcgcgttcctcctgggtgggaagaatgctcagatcccagacagggtcagtggaggtggtcaccgcagaaacactgatggatccgagcgaccttagtgaaaatatacaagctcctactggcgaaggcttcagactcgaagacgtggattggaatagtgtggccagacggtatcccaacttgttcacaaacatggagcctagcagtaagcaaaagcagcctaggccgtggccccagctcgatactggtagtccagaatcgtctggaaagcactccgagagacaccacaaaactgtggaatggggatcactgccctgtttaaacacatcctctagcggcggcgctgactccgactcatcctcttgccgccctggcctgccgtccttcgtgcaagtaattggccatccaccaagggaccatcgtgccagctccgaacaggcacttgtgcaagccgggtcgtattcacgagattctgaagacctgcagaaaactcatagtccgaggcacggcgagcctgtgctctctccacagccctgtacagatcccgaccattggagtccagaactgctgcaatcccccaccggcctgaaaattgtcgcagtttcttgccgtgagaaattcgtccgtatcttcaatccaagccaggagtctacggccgacttaagtggcatggtgcttaagcaactggtccggggattcccagagcgtctatatcgcttcccaccgggtactctgctggctcccagacatcacgtgactgtttggggcgaggcaaccaggtcagccaagaagccgctgagggccagctcatccagagagcccgtcccgctgttaagtatcagggggtgtgccacactgctcctcagccctaaaggggaagtactaagcgagcaccgtatcccgagaagggaaactcctgcaccgagagtcttcgcagatggaactgacctgagcatcgatcggtttccactgccagaagccggcccaggtgccgacacccgcaaaccccctcggcctccacgcccactccgcaaaggtcgcgtgcgggaaccgagagtgtcgagacggaggcccgggaccaggggcttactgcctccggtgtcttctgggaaattgttccacgcacgtgagggacccgccaggccagagaaccccgaaatcccagcaccacagcaccttccggcaatccccggagacccgactctgccctcgcctccagcagaagccgggctcggcctggaggactgcagactgcagaaggaacacagggtccgcgtgtgccgcaagagcgtcgacaggtcttgccccctcgtggccctgtcagtccagaacactgccgaaagccgtttcggcttcagattcctttcatgtctgccagtgaccgccgatacttgtcgcggggcctag

SEQ ID NO: 44986 - DNA, 477 bp, Artificial Sequence
  Description of Artificial Sequence: Synthetic coding sequence
atggacctggccagcgagatcaccagcgccacccagaccagcagcctctgcagctctgggcgcgggcacgccggctacccggcaccaggaattgtcgcccacgggtttgagacccatggtaccgccagggttgcacaggggcacttactccctccttgtctactaccaccgccccagatgcctgtactggcagccctgagagatctctctagacgaggctccacctccagtagccgtagtccttcgagaccggtgtctacttccgcctcaaagccttgcttaccagcatcctgccttggtgaaacatggtccatatcaatcaatctcgtcggctcctccggccatctgcagagtcccggcgcccaacgcgacgcccagagggagacaggctgcctcgggcctagctggctcccacatcatcaaggaagagacgaagagctttctctctcgcactctgcacagggcgaagaattctag

SEQ ID NO: 44987 - DNA, 477 bp, Artificial Sequence
  Description of Artificial Sequence: Synthetic coding sequence
atggacctggccagcgagatcaccagcgccacccagaccagcagcttatgctcatccggtcggggccacgccgggtatcctgctccagggatagttgcacacggtttcgagacacacgggacagccagagtagcccagggccaccttttacctccttgcctcctgcccccccctcagatgcccgtgctcgccgctctgagggatctttctcggcgcggatcgactagctcctccaggtctccttccaggccagtgtcaaccagtgcttccaagccgtgtctgccggccagctgcctaggtgaaacgtggtctatcagcatcaatctggtcggcagttcgggacacctacaatctccaggtgcccaaagggacgcccagcgcgaaacagggtgcctgggccccagctggctaccacatcatcaaggacgtgatgaagagctgtccctctcacactccgctcagggagaagagttttag

SEQ ID NO: 44988 - DNA, 87 bp, Artificial Sequence
  Description of Artificial Sequence: Synthetic coding sequence
atggacctggccagcgagatcaccagcgccacccagaccagcagcctttgctccagcggcagagggcatgctgggtaccctgcatag

SEQ ID NO: 44989 - DNA, 477 bp, Artificial Sequence
  Description of Artificial Sequence: Synthetic coding sequence
atggacctggccagcgagatcaccagcgccacccagaccagcagcctctgtagttcaggccggggacacgcaggatatcccgcaccaggaattgtagcccacggttttgaaacccacggaacagctcgcgtcgcccagggacatttactgcctccatgtttgttgccccctccccagatgccagttctggcggccctcagagatctgtctcggcgcggatctacctcttcttcgcggagtccatctcggcccgtatcaacatcagcttcaaagccctgcctccctgctagctgtctcggcgagacatggagtattagtataaaccttgtgggaagcagtggccatctgcagtccccaggagcccagcgggatgcacaacgcgagacaggatgcctggggcccagttggctcccacatcaccaaggccgcgacgaagagttatccctctcacacagcgcccagggcgaggagttctag

SEQ ID NO: 44990 - DNA, 423 bp, Artificial Sequence
  Description of Artificial Sequence: Synthetic coding sequence
atgaagggccaggagggcatccggggcgagggctgcaccgaccccgagatcaaggctagcccacagatgtgggccgcacggttccgcggaatgcgcagccggttcagtccccttttctcgcaggcaactgaaatgggacctagggttagcgccggatggtgtctcagcgggggtggtaggaaggttagctccctgcagggcgatttccctcctggaggcttttgggcacttagtaatgacagtgccctgtcgctaccgccactgtctctgcctcaccctcaccctctgaggccgccgggactgggagtcaatgagtttacgcagggcttacaccctcccctccacccagcggctagcgtttttcagacttgtttctatcgcaaaccacattactgcagtacactgcggccgacaaccacctag

SEQ ID NO: 44991 - DNA, 654 bp, Artificial Sequence
  Description of Artificial Sequence: Synthetic coding sequence
atggccctggtgcaggccctggtgccccgggagcgggagcccaagctatccattttgcagatggatagaggggatccgcagcattcaagtcactggtgtcccgaaagggaaaaagtgaagttgttgaccttaaagcccagagagaccagcaaaaacattctaatcaatttctatcgagccttcaacctggataaggacgtctttattcatcaggccaatcaccctctcaccgtgcctagcagtgtggtgatgggtgataacggccacacactggccgaggatgacaaacggccgtgttttagggttcttccctgctatctggagcgcgtgtcaagtggcatatctatttcctggattagcgcacctctcccagtgggtgccatgaagcaccagcttctttgtgatctcatggatttgattactttaagcttctggctggcaggccagtgtatgtcactgaaggccactaacatgcaacattgcaaatgcagcatagcaacaagtgactgggctatagaactggatcgtaccgactacaagaccctgccctccgagtattccatactggctctgttacaggtgttcgctggtaaaaattgcatggatcgcgtactcctgcacgtggacgtgaactatctcaagtcccttccctag

SEQ ID NO: 44992 - DNA, 1002 bp, Artificial Sequence
  Description of Artificial Sequence: Synthetic coding sequence
atgctggtgggcacccccaacctgctgaccctggacgaggccgacgcaacgtggacactcatcaaggacaaagtcatcgaggagcacttcggccccaacgccgtcgcagtgcccttcttatccgatgccgcatgctatgatctcctgggcgtcctggtcaagcagtcacgaccggcccatacccgactagccctccctggccgccagggtagaagggccctgaaaccagttggcccactgccctcattactcgaacaggctggctctgaaggagcatttgcccactgtactcgggaatacagtccgaatggacgtgccgaacgggcgtatgaagagaccagaatgttggatgggcaaccctgcaagatcagactacacatgggcgacctccggaagaaagtcgcttttctgttgttaccccctggacaggttagtttgcagcaaacgctgccctggctgagatccacccactccatctacgtgatttaccaggtgttcagttgcagttggttgcaattgggccttacatcaacggccagagaaccgcagttgctcaggttgttaagatctctgccagtggcctttagctgcctcaagttctcactccagtctaagggcgtgctcgggccgcaaaaacccttgaccaaggatccgcttccacatggcgcaaattgggtccgccccaatctcagcatcatgcccccgctcgcccctacctcagctcccgccgacacgacagaagctgcagatgtgcccccgcctgtgccagcccctcctactccccctccacaggaaggacccgaggacaagcccacgcggttcagctataaaggcaggaaccctttctggagaggtccgcaaatcctgtcagagaattggttattctctccacgctcaccccctccaggggcccagggaggtgggccacgggaccccgatgggcatagtatgtctctgccactcctgcaggggctcagctccgagtttgactctgacgactag

SEQ ID NO: 44993 - DNA, 792 bp, Artificial Sequence
  Description of Artificial Sequence: Synthetic coding sequence
atggccctggtgcccggccggagcaaggaggacggcctgtggaccaggaatagccctggaagcagccagcacccagagtctccgaggctgcctaatccactctgggaccgtggcaagatcggcaaggtggagggacaccagcacatccaggatttttcccagaagtcacatctcccctctatcgtggtggagagttctgaggttaacgaggaaagcggtgacctgcacctgcctcacgaggagctcctccttttaactgatggcgaggaagaggacgccgaagcgttttttcaggaccagtctgaagaacctggctgggcgtggtctcctcaggacccaaggtcacccctgcgcacatttaacgccgggctatcatggggccaggatcaggacgaggaggacgcctgttggattctggaggataccgcgtgcttagaggcgactaatcattgccccttttgggattctaccgggtctagggtgtgcagatctgggttcgtggagtatagtcacttactaccgcctaattccttcgagggagcagaggaggaggcagtgcagacaccggctggcgtggaatccggggctgcaagcgaagcccctggcggaagaggctgcgacaggcccagggccgatcacgccgctccaccccaggaagccggggtccaatgcacttgtcagcactataccgtgagagaggaggcgcagaaaacgcctcccgcggacccggcttgccccgaacgcgaagacagccacggcagcggctctccattcaaggcctctcaggactag

SEQ ID NO: 44994 - DNA, 870 bp, Artificial Sequence
  Description of Artificial Sequence: Synthetic coding sequence
atggccctggtgcccggccggagcaaggaggacggcctgtggaccagaaattctccaggatcctcccagcaccctgagagtccaagacttcctaatccattgtgggatagaggaaagatcgggaaggtggaggggcaccagcacattcaggtgtctacgagttccgcatgcgtttggcagttggcgtacccgccggtgtggccaaacctgccagcagttcccatacaggacttctcacagaagtcccacctccccagcatagtcgtggaatcgtctgaagtaaacgaagagtccggcgatttacatctgccgcatgaagaactcctactcctgacagacggagaggaggaagacgccgaggccttcttccaggatcagagcgaggagcctggatgggcatggagccctcaggatcctagatcacctttacggaccttcaatgccgggctttcttggggccaagatcaggacgaagaggatgcctgttggattctggaagatacagcatgtttggaagccacaaatcattgccccttctgggacagcaccggatcccgggtatgtcgatcaggcttcgtggaatattcccatttattgcctcccaattcctttgagggagctgaggaagaggccgtgcagactcctgccggagttgagtcaggtgccgcctccgaggccccagggggtcggggttgcgatcggccacgggcggaccacgctgctccaccccaggaagctggagtccagtgcacatgccagcattacaccgttagagaagaggcgcagaagacccccccagccgatcccgcctgccccgagcgagaggactcacatgggagcggatccccctttaaggcatcccaagattag

SEQ ID NO: 44995 - DNA, 249 bp, Artificial Sequence
  Description of Artificial Sequence: Synthetic coding sequence
atggccctggtgcccggccggagcaaggaggacggcctgtggacccgtaacagcccgggatcctcccagcaccccgaatcacctagactgcctaacccgctttgggaccgaggtaagattggaaaagtggagggtcatcagcatattcaggacttcagtcaaaaatctcatctcccgagcattgttgtggagagcagcgaggtcaatgaagaatccggtgaccttcaccttccacacgaagagttgtag

SEQ ID NO: 44996 - DNA, 792 bp, Artificial Sequence
  Description of Artificial Sequence: Synthetic coding sequence
atggccctggtgcccggccggagcaaggaggacggcctgtggacccgtaatagcccaggttctagtcagcacccagagtctccacgcttgcctaaccccctgtgggatcgcggcaagattgggaaagtcgaaggccaccagcatattcaggacttcagtcagaagtctcaccttcctagtatcgttgttgagtcttctgaggttaacgaagaatccggagaccttcatctccctcatgaggagctgttgctcctcacagacggggaggaggaggacgccgaggcattcttccaggatcagtctgaagagcccgggtgggcctggagccctcaagatccgaggagcccgcttcgcaccttcaacgcagggctgtcctgggggcaggaccaggatgaggaagatgcttgttggattcttgaagacaccgcatgtctggaagctactaaccattgcccattctgggacagcactggtagccgggtgtgcaggagcgggttcgtcgagtactctcatttgctacctccaaattccttcgagggagcagaggaagaggccgtgcagacaccggcaggagttgaatctggcgccgcgtctgaggcccctggtgggcgagggtgtgaccgccctcgcgctgaccacgccgcccctcctcaagaggctggggtgcagtgcacatgccagcattacaccgtgagggaagaggcacagaagaccccccccgccgatcctgcatgtccagaaagagaagatagtcacggatctggaagtccttttaaagcttcccaagattag

SEQ ID NO: 44997 - DNA, 996 bp, Artificial Sequence
  Description of Artificial Sequence: Synthetic coding sequence
atgctgagccccgagcggctggccctgcccgactacgagtacctggcccaaagacatgtcctgacttacatggaggacgcggtgtgccagctcctagaaaacagggaggacattagccagtatgggatcgcacgcttttttactgagtatttcaactctgtgtgtcaaggcacacatatcctgttcagagagtttagtttcgtccaagccaccccccataatcgtgtgtcctttcttagagccttctggcgctgtttccgtacagtgggcaagaacggcgacttgttgactatgaaggaataccactgcctactccagctcctgtgccccgactttcccttggagttgacgcaaaaggctgccaggattgttcttatggacgatgcaatggactgcttgatgtcgttcagtgactttctttttgcctttcagatccagttctattatagcgaatttctggactcagtggcggccatttacgaggacctcctctccgggaaaaatcccaacactgtcatcgtgcctaccagctcctctggacaacacaggcagagaccagcccttggtggtgctggtacactggagggtgtggaagctagcctcttttatcagtgtctcgaaaatctgtgcgaccgacacaagtactcttgtcctccaccagcgttggtgaaggaggcactgtctaacgtacagagactgactttttacgggtttctaatggccctttctaaacacaggggaattaaccaggccctgggggctctgcccgacaaaggcgacttaatgcacgaccccgctatggacgaggagttagaaaggctgttggcacaggtgcctgggcttgtcaactcggtgaccgcttcgcctgaagcttcctgccttcctagccgcacacccccacgcgttggttccccttggcggcctctccatcactctcgcaaggtggacggagagtcggacggcagcacggaggagactgacgagagtgagacatag

SEQ ID NO: 44998 - DNA, 1014 bp, Artificial Sequence
  Description of Artificial Sequence: Synthetic coding sequence
atgctgagccccgagcggctggccctgcccgactacgagtacctggcgcagaggcacgtgctgacctatatggaggacgccgtctgccagctcctggagaacagggaggatattagtcagtacgggatcgcgaggtttttcactgagtattttaattccgtttgtcaaggaactcacatcctttttagagagttcagttttgtgcaagctactccacataatagagtcagctttctccgtgctttctggaggtgctttcgcaccgtagggaaaaacggagacttactgaccatgaaggaataccactgcctgctgcagctcctgtgcccggatttccccctggagttaactcagaaggccgcccgcatcgtcctgatggacgatgcaatggactgtctgatgtcatttagcgactttcttttcgcgttccaaattcaattctactattccgagtttctagattccgtcgcggccatctacgaggacctgctgtcaggcaagaatcccaacacagtcatcgtccccacatcctcctccggacaacatcgccagcggccagcgttaggaggggccgggaccctcgagggagtagaagcaagcctgttctaccagtgcctggagaatctttgcgatagacacaagtacagctgccccccgcccgcattggtgaaggaggccctttcaaacgtgcagagattgaccttctacggatttttgatggctcttagtaaacaccgtggaatcaatcaagcgctgggggccctgcctgacaaaggcgatctgatgcatgaccccgccatggacgaggaacttgaaaggctccttctccccttcttccgcctcgctcaggtccctggcttggtgaacagcgtgacagcaagtccagaggcttcctgcctgccttcgaggacccccccccgggtcggatcaccctggaggcccctccatcatagccggaaggttgacggcgagagcgacggaagcacagaagagacagatgagtccgaaacctag

SEQ ID NO: 44999 - DNA, 825 bp, Artificial Sequence
  Description of Artificial Sequence: Synthetic coding sequence
atgctgagccccgagcggctggccctgcccgactacgagtacctggcccaacggcatgtcttgacttatatggaagacgccgtttgccagctgctggagaatagagaggacatttctcagtacggtattgctcggttctttaccgagtattttaactcggtctgtcaggggactcacattctgttcagggaattttcatttgtgcaggcgaccccccacaatagggtaagttttctgcgcgcattttggagatgttttcggacagtggggaaaaatggagacttgctgaccatgaaggagtatcattgtcttttgcagctcctctgtccagattttcccctggagctcactcagaaggctgctcgaatcgtgctcatggacgatgccatggactgtctgatgtctttttccgattttttattcgccttccagatccagttttactatagtgagttcctggattccgtagccgccatatatgaagacctgttgagcggaaagaatccaaatacagtgatcgtgcctactagttcctccggccagcataggcagcgacctgcactgggtggggccgggacactagaaggggtagaggcgagccttttttatcaatgcctagagaatctttgcgacagacataaatatagttgtccacctccagcccttgttaaggaggcactaagcaatgttcaacgcctgacgttctatgggttcctgatggctctttcaaaacaccgtggtattaatcaggccctcggcgccctgccggacaagggcgacctcatgcatgacccagcaatggacgaagagctggaaaggctgtag

SEQ ID NO: 45000 - DNA, 705 bp, Artificial Sequence
  Description of Artificial Sequence: Synthetic coding sequence
atgaaggagtaccactgcctgctgcagctgctgtgccccgacttccccctggaactgactcagaaagccgcaaggatcgtccttatggacgatgcgatggattgcttaatgtccttttcagattttctgttcgcattccagatccagttctactattctgagtttctggactctgtggctgccatttatgaggacctcctgtccggcaagaatccaaacactgtgattgtaccaaccagctctagcgggcagcatcgccagcggccagcccttgggggggctggtacccttgaaggcgtggaggcttcccttttttaccagtgtctggagaacctgtgcgatagacacaaatattcttgtcctcctcctgccttagtgaaagaagctctttctaacgtgcagagactgacgttctatggctttctgatggccctgagcaagcaccgagggatcaatcaagccttgggagccctgcctgacaaaggcgacctcatgcacgatcctgccatggatgaggagctggagagactgctggcccaggtcccagggttggtcaacagtgtgaccgccagccccgaggcctcctgcctcccatcacgaacacccccccgagtggggagtccttggaggccactacaccacagcagaaaggtcgacggggagtccgatggaagcaccgaagaaactgacgagagcgagacctag

SEQ ID NO: 45001 - DNA, 744 bp, Artificial Sequence
  Description of Artificial Sequence: Synthetic coding sequence
atggagctgcccggcagcagcctgaacaacctgctgaccatgaaggaataccactgtctgcttcagctgctctgtcccgacttccctttagagcttacacagaaagccgcgaggatcgttttgatggacgacgctatggattgcttaatgtctttcagcgacttcttgtttgccttccaaatccagttctactactcagagtttttagacagtgtggccgccatatacgaggacctgctgagtgggaaaaatcccaataccgtgatcgtcccaacgagttcaagtggccagcatcggcagagacccgcactaggaggcgctgggactttggagggagtggaagccagtttgttttaccagtgcttggagaacttgtgcgacagacacaagtattcttgtccaccaccggcactcgtcaaagaggctctcagtaatgtccagaggctaaccttttatggctttttgatggctctgtctaaacatcggggtataaaccaggctctgggagccctccccgacaagggcgatctcatgcacgacccagctatggatgaagaactggaacgactgctggcacaggtccctggtttagtgaattcagtgaccgctagcccagaggcctcttgtttgccctctaggaccccccctcgggtggggtccccatggcgtccattacaccattcaagaaaggtggatggcgaatcggatggaagcactgaagagaccgatgagagcgaaacttag

SEQ ID NO: 45002 - DNA, 981 bp, Artificial Sequence
  Description of Artificial Sequence: Synthetic coding sequence
atgctgagccccgagcggctggccctgcccgactacgagtacctggctcagcgtcacgttctgacatatatggaagatgctgtctgtcagcttctagagaatagagaggacatctcacagtacgggattgcccggttttttacagagtactttaacagcgtatgccagggaactcatattctctttagagaattttctttcgtgcaggccacaccgcataaccgagtctccttcctccgcgcattttggcgttgctttagaactgtaggcaagaatggggatttgttaacgatgaaggagtaccactgtcttttgcagctgctttgccccgattttcccctagaactcacccagaaggcagcacggatcgttctgatggacgacgcaatggattgcctcatgtcttttagcgatttccttttcgccttccagattcagttttactactcagagttcctggacagcgtggcagctatttatgaagacctcctgagcggcaagaatcccaacaccgtgattgttccgacaagttcttcaggacagcataggcagcggcctgcactcggcggtgccggaacactggagggcgtggaggccagtctgttctaccagtgcctcgagaatctgtgtgatagacataagtatagctgtcccccgccagcactggtgaaggaagccctgagcaacgttcagcggttaaccttctacggatttctcatggccttgtcaaagcatcgcggtattaaccaagcactaggcgcacttccagacaagggcgacttaatgcatgacccagccatggacgaggagcttgagagattggtggtgcggagtaagctccatcgtacctctcgacagcatcgggctaaggagccaggagcctttggctttcagagaagggaaaagcaggaggccttagaaagagtctcaagtgctagtgtgcctactccataccattatcggtgggagcccagggagtag

SEQ ID NO: 45003 - DNA, 732 bp, Artificial Sequence
  Description of Artificial Sequence: Synthetic coding sequence
atggccgccagcagcatcagcagcccctggggcaagcacgtgttcaaagcaattctgatggtcctagttgcactgatattattgcacagcgcactcgcacagtcccggcgggattttgcacccccaggccaacagaaacgcgaggcgcccgtcgacgtgttgacccagattggccgctcagtgagaggcacactggacgcctggataggccctgaaacaatgcacctggtaagcgagtctagttcccaggtgctgtgggcaatcagcagtgcgatttcggtggccttctttgctctgtccggcatcgccgcccagctcctgaatgcgttaggcctagccggtgattacctcgctcaggggctcaagctgagccccggacaggttcagacctttcttctatggggcgctggcgctttggtggtctattggctgctcagcctactgctggggctggtgttggctctgctgggacgaattctctgggggttgaaacttgtgatcttcctggccgggttcgtcgctttgatgcgatccgtaccagatccatctacaagggccctgctgctgctggcattgttgattctttatgctctactgtccaggctcacaggttcacgcgctagcggcgcccaactggaggccaaggtcagagggctggaacgacaggtcgaagagctcagatggcgccagaggcgcgcggctaaaggcgctaggtccgtggaagaagaatag

SEQ ID NO: 45004 - DNA, 366 bp, Artificial Sequence
  Description of Artificial Sequence: Synthetic coding sequence
atgagcaccctgttccccagcctgttcccccgggtgaccgagaccttgtggttcaacctggaccgcccttgcgtggaggaaaccgagctccaacagcaggaacagcagcatcaagcttggctgcaatccatcgcagagaaagataacaatctggtgcctataggcaagccggccagcgaacactacgatgacgaagaagaggaagacgacgaggatgacgaggattctgaagaagacagtgaagacgatgaggatatgcaggatatggacgagatgaatgattacaacgagagtccagacgacggtgaagtaaatgaagtggacatggagggcaatgaacaggaccaagatcaatggatgatttag

SEQ ID NO: 45005 - DNA, 366 bp, Artificial Sequence
  Description of Artificial Sequence: Synthetic coding sequence
atgagcaccctgttccccagcctgttcccccgggtgaccgagaccctctggttcaacctagacagaccatgtgttgaggagactgaattacagcaacaagagcagcagcaccaagcctggttgcagtccatcgccgagaaagataacaacctagtccccatcggcaaaccggcctctgagcattacgacgatgaggaagaagaagacgatgaagacgacgaggattccgaggaagactccgaggatgatgaagacatgcaagacatggatgagatgaacgactataacgagtcgccggacgatggcgaggtgaacgaggtagatatggagggcaacgaacaggaccaggatcagtggatgatctag

SEQ ID NO: 45006 - DNA, 366 bp, Artificial Sequence
  Description of Artificial Sequence: Synthetic coding sequence
atgagcaccctgttccccagcctgttcccccgggtgaccgagaccctttggtttaatctagaccgtccctgcgttgaagagactgaactgcagcagcaggaacagcagcatcaggcctggctccagtccattgcagaaaaggataacaacctggtgcccatcggcaagccggcctctgaacattatgacgatgaagaggaggaggacgacgaggatgacgaggactctgaagaggacagcgaagatgatgaggatatgcaggatatggatgaaatgaatgactacaatgaatcaccagatgatggggaggtcaatgaagtagacatggaagggaatgaacaagatcaagaccaatggatgatttag

SEQ ID NO: 45007 - DNA, 366 bp, Artificial Sequence
  Description of Artificial Sequence: Synthetic coding sequence
atgagcaccctgttccccagcctgttcccccgggtgaccgagaccctgtggttcaatctggatagaccatgtgttgaggagactgaactgcagcaacaggagcagcagcaccaggcctggctgcagagtattgctgagaaggacaacaacctcgtgcctatcgggaagcccgcctctgaacattacgatgacgaggaggaagaggatgacgaagacgacgaggattcagaggaagactctgaggacgatgaagacatgcaggacatggatgagatgaatgactacaatgagtcaccagatgatggtgaggtgaatgaggtggacatggaaggtaatgagcaggaccaggatcagtggatgatctag

SEQ ID NO: 45008 - DNA, 138 bp, Artificial Sequence
  Description of Artificial Sequence: Synthetic coding sequence
atgagcaccctgttccccagcctgttcccccgggtgaccgagaccttgtggttcaatctggatcggccctgcgtggaagagacagaattgcaacagcaggaacagcagcaccaggcctggcttcagtctattgcgtag

SEQ ID NO: 45009 - DNA, 366 bp, Artificial Sequence
  Description of Artificial Sequence: Synthetic coding sequence
atgagcaccctgttccccagcctgttcccccgggtgaccgagaccttgtggttcaatctcgacagaccatgtgtcgaagaaacagagttacagcaacaggaacagcagcaccaagcatggctgcagagtatcgctgagaaagataacaatctcgtgccaatagggaaaccagcctcagagcattatgacgatgaggaagaagaagatgacgaggacgatgaagattctgaggaagactctgaggatgatgaggacatgcaggacatggatgagatgaacgattacaacgagtcccccgacgatggcgaagtcaatgaggtagatatggagggaaacgaacaggaccaggaccaatggatgatatag

SEQ ID NO: 45010 - DNA, 198 bp, Artificial Sequence
  Description of Artificial Sequence: Synthetic coding sequence
atgagcaccctgttccccagcctgttcccccgggtgaccgagaccctgtggtttaatctggaccggccttgtgtggaagaaacagagctgcagcagcaagagcagcaacatcaggcctggctccaaagtatcgcagagaaggataacaacctggtcccaatcggcaaacccgccagcgaacactacgacgacgaatag

SEQ ID NO: 45011 - DNA, 366 bp, Artificial Sequence
  Description of Artificial Sequence: Synthetic coding sequence
atgagcaccctgttccccagcctgttcccccgggtgaccgagaccctctggttcaatctcgaccggccctgtgtggaggaaaccgagctgcagcagcaggaacagcaacaccaggcatggctgcagagcatagcagagaaggacaacaatctggtgccaatcgggaagcctgccagcgagcattacgacgatgaggaggaagaagatgacgaggatgatgaggattcagaggaggattctgaagacgacgaggatatgcaggatatggatgaaatgaatgattacaacgaatcccctgacgatggagaagttaacgaggtggacatggaagggaatgagcaggatcaggaccaatggatgatttag

SEQ ID NO: 45012 - DNA, 372 bp, Artificial Sequence
  Description of Artificial Sequence: Synthetic coding sequence
atgggcaaccgggtgtgctgcggcggcagctggagctgccccagcactttccagaagaaaaagaagacaggttcgcagacacgacggactctcaaacctcagcctcagcagctgcaacaaaacttgcccaagggtcacgagacaacggggcatacgtatgaacgggtcctgcaacagcaaggatcccaagaaagaagcccgggtctaatgtccgaggattccaatttacattacgcagacatccaggtgtgttcccggccccatgccagggaggtgaaacacgtacacctggaaaacgcaaccgaatatgccacgctgaggtttccacaggccacaccccgatatgatagcaagaacggaacactagtgtag

SEQ ID NO: 45013 - DNA, 135 bp, Artificial Sequence
  Description of Artificial Sequence: Synthetic coding sequence
atgggcaaccgggtgtgctgcggcggcagctggagctgccccagcacctttcaaaagaaaaagaaaacggggtctcagactcgcagaactcttaaaccgcaaccacagcagctgcagcagaatttacccaaatag

SEQ ID NO: 45014 - DNA, 711 bp, Artificial Sequence
  Description of Artificial Sequence: Synthetic coding sequence
atgcccggcagccccgtgaccagcggctactacggcgtgcggcggagcttcttgagcgactccgacttccacaactcaaaacagttctccaacgacgtttataccagctctgtgggtaagccgtttccttgtgagagttcagctggccagtctcacgccgccttgctagagccttatttcccacaggagccgtacggggattataggcctcctgccttgacacccaacgcaggcagtcttttctcagcctcccctctgcctcctcttctaccccccccttttccaggcgatcccgctcatttcttatttcgcgatagttgggagcagactctgcccgacggcctgagtcaacccgaccctgtatccgcagacgccctgttaaccctcccgcctagcacttcttgcctaagtcagctcgagtccggctctatcgcccagcatcggggctcgtcttgggggtcttccttagcaggggcacagtcctactcattacacgctcttgaagacctccatcacaccccaggctacccgacccctccaccctatcctttcacaccgtttatgacagtgtccaatgatctgcctccgaaagtcggcccccttagtccggacgaggaggccgacacaggctcactgcacgatcccagcccctgggtcaaggaagatggcagcattgcctggggaagttacgagtgccgaagggcctactag

SEQ ID NO: 45015 - DNA, 366 bp, Artificial Sequence
  Description of Artificial Sequence: Synthetic coding sequence
atgatgcggagcatcttcctgccccaccggaagctgatctgcagccgaagaggccatttggaccccagaggctgggaggaagacgaaaagatcttggtccccgatgccatccctacactgccaccatatgtgtttatccggacagaccaggcatgtgtgaaagtctatcccggcttcgtcttgattcgcaacggcaagacccacagacatcggggggactgccatgaggaagaggtatgcgctcaccgtacactggaaactggagggatggcctgccatgtgggcccccacggggaaggtccttccctgtggggtttttgggggtcctggaaacaggtgctattcttcctccccgtggaccactag

SEQ ID NO: 45016 - DNA, 879 bp, Artificial Sequence
  Description of Artificial Sequence: Synthetic coding sequence
atgagccggatccccctgggcaaggtgctgctgcggaacgtgatccgccacacagatgcacacaacaagattcaggaggagtctgacatgtggaagatccgcgagctcgagaaacagatggaggacgcttacagaggcacaaaaaggaaaatgttgccttccagctcctcgcggatgcgcagtgacggtttcgacgaggaaagccagagatattactggagacccaagaatgagattagcggcacgctggaagacgacttcttaaaggctaaatcatggaacaagaagttttacgactacgaggcgaacatgcccgacagatggggccacagcggctacaaggaactgtacccagaggaatttgaaactgattcagatcaacaagatatcactaacggaaagaagacgtcaccgcaggtcaagtcttccacacacgagagccggaaacacaaaaaatcaaagaaaagccacaaaaagaaacagaagaagagatctcacaaaaaacagaagaagagcaagaaggaggccactgacatcaccgccgacagctcatcagagttttcagaggagacaggcgccagcggtacaaggaagggcaagcagcctcataaaagaaagaagaaaagcaggaagaagagcctgaagaaacccgccctgttcttggaggcggagagtaatacctcacattccgatgattccgcctcttcttcctctgaagagtctgaggaacgcgatacaaagaaaactaaacgcaagaaacgcgaaaagaaagcccatacctccgttgcaaataatgagatccaagagaggaccaacaagaggactaattggaaggtcgctacagatgaacggtcagcagaatcctcagaagatgactag

SEQ ID NO: 45017 - DNA, 882 bp, Artificial Sequence
  Description of Artificial Sequence: Synthetic coding sequence
atgagccggatccccctgggcaaggtgctgctgcggaacgtgatcagacatacagatgcccataataaaatccaggaggaatccgacatgtggaaaataagagagctggagaagcagatggaagacgcatatagaggcactaaacgaaagatgctgccgtcaagcagctcaagaatgcgaagcgatggattcgatgaggagtctcagcgatactactggaggccaaagaacgagatttctggtacactcgaagacgactttctgaaagctaaaagctggaacaagaaattctatgattacgaggctaacatgcctgatcgatggggccacagcggctacaaggagctgtaccctgaggagttcgagactgattcatctgaccagcaggatatcactaacggcaaaaagacaagtccacaggtgaagtcgtctacgcatgaatcacgtaaacacaagaagtcgaaaaagtctcacaagaagaagcagaagaagcgcagccacaagaagcagaaaaagagtaaaaaagaggccactgacattactgccgacagttcctcagagttctcagaagagactggcgcgagtggaacgcgcaaaggcaagcagccccacaagagaaaaaaaaagtcccgcaaaaaaagcctgaagaagcccgcattgtttctggaagccgagagcaataccagtcatagcgatgattccgcttcttcgagcagcgaggagagcgaagagcgggatacgaaaaagactaagcggaagaagcgagagaaaaaagctcacacgagcgtcgctaataacgagatccaggagcggactaacaagcgcacgaactggaaagtggccaccgacgaacgctccgcggagtcttctgaggatgattag

SEQ ID NO: 45018 - DNA, 444 bp, Artificial Sequence
  Description of Artificial Sequence: Synthetic coding sequence
atgaaccccgccaacacccggagccagcggaaccccaccaagaagcagaaaaagcgctcccacaaaaaacagaagaaaagtaaaaaagaagccactgacatcactgctgactccagttctgagttttcagaagagaccggtgcaagcggtacacggaagggaaagcaacctcataaaaggaaaaaaaagagtcgaaaaaaatctcttaaaaagccagctttgtttttagaggccgaatctaacacgtcccattcagatgacagtgccagcagcagttctgaagagagtgaagagagggacacaaaaaaaaccaaaagaaagaaaagagagaaaaaagcccacaccagcgtcgccaacaacgagattcaagaacggactaataagcggactaattggaaagtcgccaccgacgagcgaagcgccgaatctagtgaggatgattag

SEQ ID NO: 45019 - DNA, 879 bp, Artificial Sequence
  Description of Artificial Sequence: Synthetic coding sequence
atgagccggatccccctgggcaaggtgctgctgcggaacgtgatcaggcacacagacgcacacaacaaaattcaggaagaaagcgatatgtggaaaatcagggagctggagaagcagatggaagatgcctaccgcggcaccaagagaaagatgctccccagttcaagtagcaggatgagaagtgatggattcgacgaggagtcacagcgatattattggcgccctaaaaatgagatttccggaacgctggaagatgatttcttgaaggccaagtcctggaacaaaaagttttacgattacgaagccaacatgccagacagatgggggcacagcggatacaaggagctttatcccgaagagttcgagacagattccgaccagcaagatattacaaacggcaagaaaactagcccacaggtgaaaagttccacccatgagtcccggaagcacaagaagtcaaaaaaatcacataaaaaaaaacagaaaaagcgctctcacaaaaagcagaaaaagtctaaaaaggaagctacagacattacggccgattcaagctccgagtttagcgaggagacgggtgccagtgggacccgcaaggggaaacaacctcataaacggaagaagaagtcccggaaaaagagtttgaagaagcccgctctattcctagaggcagaaagcaatacctcccactcagacgacagtgccagcagcagctcggaggaaagcgaggagagggatactaagaagactaagagaaagaagagggagaagaaggcccacacgtcggtggccaataatgagatacaggagcgcactaacaaacgaaccaactggaaagttgctaccgacgagcgtagcgcggagtcaagcgaggacgactag

SEQ ID NO: 45020 - DNA, 648 bp, Artificial Sequence
  Description of Artificial Sequence: Synthetic coding sequence
atgtggaagatccgggagctggagaagcagatggaggacgcctaccgaggaactaaaagaaagatgctgccatcatcctccagcaggatgcgatcagatggattcgatgaggagtctcagaggtattattggaggccaaaaaacgaaatttccgggaccctagaagatgatttcctcaaggcgaagtcttggaacaaaaagttctacgattacgaggcgaacatgcccgataggtggggccactccggctacaaggagttgtatccagaagagttcgaaactgacagctcagaccagcaggacattacgaacgggaagaaaacaagccctcaagtcaagtcttcgactcacgaatctcgcaaacacaagaagagcaaaaagtcgcataaaaaaaagcagaaaaaacggagtcacaagaagcagaagaagtccaagaaggaggctactgacatcaccgccgattccagctcagaatttagcgaggaaactggcgcctcagggaccagaaaaggcaagcaaccccacaagcgcaagaagaagtctagaaagaagtccctaaaaaaacccgccctgttccttgaggcggaatcgaacactagccacagtgacgatagcgcctcttctagctctgaggaaagcgaggagtag

SEQ ID NO: 45021 - DNA, 276 bp, Artificial Sequence
  Description of Artificial Sequence: Synthetic coding sequence
atgagccggatccccctgggcaaggtgctgctgcggaacgtgatcaggcatactgatgcccataacaagatacaggaagagagcgatatgtggaagattagggagttggaaaagcagatggaagatgcctatcggggcactaaaagaaaaatgctgccttccagtagtagtcggatgcggtcagacgggtttgacgaagagtcccaacgttactattggcgacccaagaacgagatctcaggaacgttggaagatgatttcctaaaagctaaatag

SEQ ID NO: 45022 - DNA, 795 bp, Artificial Sequence
  Description of Artificial Sequence: Synthetic coding sequence
atgtggaagatccgggagctggagaagcagatggaggacgcctacaggggtacaaagaggaaaatgctgccgtctagcagctcgcgaatgcgatcggatgggtttgacgaagagagtcaacgctactattggcgcccaaagaatgaaatttccggcacgcttgaagacgattttctcaaggcaaagtcctggaataagaaattttacgattatgaggctaatatgcctgaccgctggggccattccgggtataaagaattgtaccccgaagagttcgaaacagactcaagtgaccagcaggatatcactaatggcaagaaaacgtcgcctcaggtgaagtcatccacacacgaaagtcggaaacacaagaagagtaaaaagtcgcataagaaaaaacagaaaaaacggtcccacaagaaacagaagaaatccaagaaggaagcaacggacatcactgctgacagtagcagcgaatttagtgaggaaacgggagcctccggaacgcgcaagggcaaacagccacacaagcgcaagaagaagtcgcgtaagaagtctctgaagaagccggcgctgttcctcgaagctgagtccaataccagccatagcgatgactctgcctccagctccagcgaagagtcagaggagagggataccaagaagaccaagaggaaaaaacgcgaaaagaaggcccatacgtcagtcgcgaataacgaaattcaagagcggacaaacaagcggacaaattggaaggttgccacagatgaacggagtgccgagagctctgaggacgattag

SEQ ID NO: 45023 - DNA, 879 bp, Artificial Sequence
  Description of Artificial Sequence: Synthetic coding sequence
atgagccggatccccctgggcaaggtgctgctgcggaacgtgatccgacacacagacgcccacaataaaattcaagaagagtccgatatgtggaagatcagagaacttgagaagcagatggaagacgcctacaggggaactaaacgtaagatgctgcccagctcatcttcaaggatgagatctgacggcttcgatgaagagagccagcgatactactggcgaccaaagaatgagatatctggtacactggaggatgacttcttgaaagcaaaatcctggaataaaaagttctatgattacgaggcaaacatgcccgataggtggggccactccggttacaaggaactgtaccctgaggagttcgaaacggatagcgaccaacaggacattacgaacgggaaaaaaacatctcctcaggtgaaatccagcacccatgaaagcaggaaacataaaaaatctaagaaatctcacaaaaaaaaacagaagaagaggagccataagaagcagaaaaagtctaagaaagaggcaactgacattacagctgacagtagctcagaattcagcgaggagacaggcgcttccgggacgcggaagggcaaacaaccccacaagagaaaaaaaaagagtcgtaaaaagagcctcaaaaaaccagcgcttttcctggaggcagagtcgaatacctcacacagcgatgactccgcatcctcctcttctgaagagagcgaggaaagagatacgaaaaagacgaaacgaaagaagcgagagaagaaggctcatacctcagtggcaaacaatgagattcaagagagaaccaataagcggaccaactggaaggtggcaactgatgagcgcagtgcagagtcctctgaggacgactag

SEQ ID NO: 45024 - DNA, 1167 bp, Artificial Sequence
  Description of Artificial Sequence: Synthetic coding sequence
atgaagaccctgatcgccgcctacagcggcgtgctgcggggcgagcggcaggccgaggctgatagatctcagcgatctcacggaggcccagcactgagccgggaaggctcaggtcgctgggggactgggagttcaatcctctcggcactgcaggatctcttctccgttacgtggctgaataggtccaaggtcgagaagcaactccaagtgatctctgtgctccaatgggtactgtcctttcttgttctgggcgtagcttgttccgcgatcctgatgtacatcttctgcacagattgctggctaattgcagttctctacttcacatggctagtgttcgactggaatacccctaagaaaggcggccgaaggtctcagtgggtgaggaattgggctgtgtggaggtatttccgagactactttccaatccaactggtaaaaactcacaacctactcacaacacgcaattatatattcggataccatccccacggcatcatgggtctaggcgccttctgcaactttagtactgaagccacagaagtctcgaaaaaatttccaggaatccgtccttacctggcaactctggcgggaaactttaggatgcctgttctccgggagtatttgatgagcggtggtatttgccctgtgtccagggacactatcgactacttgcttagcaaaaacggaagcgggaatgcaatcatcatcgtggttggaggagccgccgagtccctgagtagcatgcctggaaaaaacgccgttaccttgcgcaatagaaaaggattcgtcaaactggctcttaggcacggagctgacctcgtgcccatctacagctttggcgaaaatgaggtgtacaaacaggtcatttttgaagagggatcctggggtcggtgggtgcagaaaaaattccaaaaatatatcggttttgccccttgtatttttcatgggcggggcttgttcagctcagatacctggggactcgtcccgtattctaagcctataacaacagtagtgggcgaaccgatcacaatcccaaagcttgagcatcccacccagcaagacatagatctgtatcacactatgtatatggaggctctggttaagctgttcgataagcataagacaaaattcggtctgcccgaaactgaggtcctggaagtgaactag

SEQ ID NO: 45025 - DNA, 420 bp, Artificial Sequence
  Description of Artificial Sequence: Synthetic coding sequence
atgggcgccggcaagaaggagcacaccggccggctggtgatcggcgatcataagtctacctcccacttccgaaccggcgaagaagacaaaaagattaatgaggaactggagtcccagtatcagcagtcaatggactcgaaactgtccgggaggtaccgtagacactgcgggctgggattctcggaggtggaagatcacgacggcgagggcgatgttgccggggacgatgacgatgatgatgatgattctcctgacccagagtctcctgatgactctgagtcagattccgaaagtgagaaagaggagtcagcagaagagcttcaggcagccgaacaccctgacgaggtggaggaccccaaaaacaagaaagatgccaagagcaactataaaatgatgttcgtcaaaagtagtggctcttag

SEQ ID NO: 45026 - DNA, 1524 bp, Artificial Sequence
  Description of Artificial Sequence: Synthetic coding sequence
atggccgccccctgcggcagcgagctgcccgccaacagccccctgaagattcccaaaatggaggtgctgtctcccgcctctcccgggggcctttcagatggcaatccatccctctctgacccttcaacccctcggggggcatccccactaggccccggcagtgctgccgggagcggagcagctgcaagcggaggattgggcctgggcctgggaggtcgctcagctgcatcttcctctgtaagcttctctcctggcggcggtggcggaggcgccgcagccgccgcggctgcggcatgtagggggatgtcctggaccccagccgagactaacgcactgatcgctgtgtggggcaatgaaagactggtcgaggcccgctatcagcagctggagggcgctggcactgtgtttggaagcaaagctcccgggccagccatgtatgaaagagtgtcacgcgccctggctgagctgggttatgagagaacaccttcccaatgtcgtgagcgcatcaaggagctcgaatctgacgggagcacaatggaagattactctcaagaggattggggcaaccactcacaggatttacacgggtacccaacggaccaggagttggacgaaatccccgtgaccaaacgaactcttaaaattaaacaggaaagttctgaggaggcccagaagagagatatcatgcagaacattgtgcagattctggaaagcgtccaattaaagtgggagttgtttcaatcttggacggatttttcccgcctgcatctgtccaataagctggcaatatttggaatcggctacaacacccggtggaaagaggacattcgataccactacgcagaaattagttcacaggtcccactgggcaagcgcctgagagagtattttaattctgagaagcccgaggggcggattattatgacaagggtacagaaaatgaactggaaaaacgtctactacaagttcctcgagattactatatccgaggcacgttgtctggagctgcatatggaaattgactggatccccattgctcactctaagccgactggcggaaatgtggtgcagtatctgttgcccggcggaatacccaaatcccctggcctatacgcaattggttacgaagaatgcatcgagcggcccctcagcccccacatggagcagtcatcactggacccggggaaggaaggccgagtggacttggagaccctcagtgcacaagccagcctccaggtggagattgaacccacccggataatttattgttacttagggattgctgaggtgcggaccctgcagcagtgcttattcttgcacttccaggccaacaccaagaccttcagcaaagattgggtggggatcaatggctttctcagccagaactgcatcgtagatcccggcgttagccccaagtccatatatattaagttcgttgaagtggaaagagattttctctctgctgggtcccttgtggagtgcctggaaaaagcaatcggctatcctttaaagttcaacaactag

SEQ ID NO: 45027 - DNA, 1680 bp, Artificial Sequence
  Description of Artificial Sequence: Synthetic coding sequence
atggccgccccctgcggcagcgagctgcccgccaacagccccctgaaaattcctaaaatggaggtactgtctccggcatcccccggtggactgtccgacggaaatccctctttgtctgacccctcgacccctcgcggcgcctcaccgttggggcccgggtccgccgccggctctggcgctgctgcgagtggaggtctaggcctgggcctggggggaagatccgcagcttctagttcagtttctttctctccagggggtgggggcggaggagcagccgctgctgccgccgccgcctgtagggggatgtcctggaccccggctgaaacaaacgccctgatcgcagtctgggggaacgaaagactagtggaagcacgttatcagcagttggagggcgccggcaccgtctttgggagcaaagctcccggacccgcaatgtacgaacgcgtcagtagagctctggctgaactgggctatgagagaacgcccagccagtgtagagaacgaatcaagacgctacgccgttgttacagtagggtgaaggaacatggcgtgggaaaacggaaatcctcgtatacatttgagcagctcgaacaagtcttcggccagggtgggtgggatgctcagccttgccagcccgtgttgatcaacagctccggtttataccaggagttagagtctgacgggagcacaatggaagattactcgcaagaagactggggtaaccattctcaggacctgcacgggtaccctaccgaccaagagctggatgagattccggtgaccaagagaacactcaaaatcaagcaggaatctagcgaagaagcgcagaagagggatattatgcaaaatatcgtacagatcttggagtctgtccagctgaagtgggagctctttcagtcctggacggacttctccagacttcatctgtcaaataagttagctatttttgggatcggttacaatactaggtggaaggaagatataagataccactacgccgaaatttctagtcaggtacctttgggaaaaaggctgagagagtatttcaattcagaaaaacccgagggccggatcataatgactcgtgtgcagaaaatgaattggaagaatgtctattacaagttcctagagatcacaatctccgaggcaagatgtctcgagctgcacatggaaattgattggatccccatcgcccattctaaacctaccgggggaaacgtcgttcagtatctcttgcccggagggatccccaagtcaccaggcttatacgccataggctatgaagagtgtattgaacgcccactctcacctcacatggaacaaagtagtttggatcccggcaaagaggggcgggtggaccttgagaccttgtctgctcaggcctccctacaggtagaaatcgaacccactaggataatttattgctatctcggaattgcagaggtgcgcacactccagcagtgtctcttcctacactttcaggctaacacaaaaaccttctcgaaggattgggtaggaatcaacggtttcctgtcccagaattgcattgtggacccgggcgtgtctcccaaaagcatatacattaagtttgtggaagttgagagggacttcctgtccgcagggagtctggtggaatgcttagaaaaagccatcggttaccctctgaagttcaacaattag

SEQ ID NO: 45028 - DNA, 990 bp, Artificial Sequence
  Description of Artificial Sequence: Synthetic coding sequence
atggaggactacagccaggaggactggggcaaccacagccaggacctgcacggctatcccacggaccaggaattggatgaaataccggtgacgaagaggacgcttaagatcaagcaagaatcatcagaagaggcccaaaaacgcgacataatgcagaacatcgttcagatacttgagtccgtgcagctgaagtgggagctgttccaatcttggacagacttctcaaggctgcacctgtccaataagctggctatcttcggcatcggatacaataccagatggaaagaagatatccggtaccactacgccgagatctcttctcaggtgccgctgggtaagaggctgagagagtatttcaacagcgagaagcccgaaggccgaattattatgactagagtccaaaaaatgaattggaagaacgtctactataagtttctggaaatcaccattagcgaagctagatgtttagaattgcacatggagatcgattggatacccatcgctcattccaaacccacaggtggaaacgtggtacagtacctgctcccaggagggatcccgaagtcccccggcttgtacgccataggttacgaagagtgcattgaaaggccgctgtccccacacatggagcagtcttctttggaccctggtaaggaggggagggtcgatttggagacgctctccgcccaggcaagcctgcaggtggagatcgagcctacacgcatcatttactgttatctaggtatcgctgaagtacgcactctgcaacagtgcctctttctacattttcaggctaatacaaagacttttagtaaagattgggttggtattaacgggttcctgtctcagaattgtattgtggatccgggcgtctcccctaagtcaatctacattaaatttgtagaggtcgagcgggactttctgtctgcgggatctctggtggaatgcctagaaaaggctattgggtatccactgaaattcaataattag

SEQ ID NO: 45029 - DNA, 1182 bp, Artificial Sequence
  Description of Artificial Sequence: Synthetic coding sequence
atgtggtggcgggtgctgagcctgctggcctggttccccctgcaggaggcttccctgaccaaccataccgagacaattactgtagaggagggccagacactgactctgaagtgtgtcacatccttgcgcaaaaattctagcctgcagtggctgactccctcggggttcacgatttttctgaatgagtatcccgctttgaagaacagcaagtatcagctgctgcaccactccgctaaccagctgtcgataaccgtgcctaacgttaccttacaggacgaaggcgtgtataaatgcctgcactacagcgacagcgtgtctactaaagaagtgaaagtgattgtactcgccactcccttcaagccgattcttgaagcctctgtcatccgcaagcagaacggcgaagagcacgtcgtcctcatgtgctctacaatgcggtccaagcctccaccacagatcacctggctcttgggaaacagtatggaagtatccggtgggacactgcacgaattcgaaactgacgggaaaaaatgtaacaccacttcaactctgattattcatacatacgggaaaaactctacagtggattgcattattaggcacagaggactgcaaggtaggaaattggttgctcccttcagattcgaggacctagtgaccgacgaagaaacagcttcggatgctctcgaacggaatagcttgtccagccaggacccccagcaaccgacaagtacggtgtccgtgactgaagatagctctaccagtgaaatcgataaggaggagaaggaacagacaactcaagacccagacctaacaactgaggccaatcctcagtacttagggctggccaggaagaagtccgggatcctcctgctgaccttggtatcattcctaatctttatcctctttattattgtccaactatttattatgaaacttcggaaagctcacgttatatggaaaaaggagaacgaggtttctgagcacacactcgagtcttaccgctcacgatccaacaacgaggagacatcaagcgaagaaaaaaacggacaatccagccaccccatgcgatgtatgaactatattacgaaactttattctgaggcgaaaaccaagaggaaggaaaacgtgcagcactcaaagctggaggaaaaacacatccaggtgcctgagtcaatcgtatag

SEQ ID NO: 45030 - DNA, 924 bp, Artificial Sequence
  Description of Artificial Sequence: Synthetic coding sequence
atgagcaagcggaagctgatccccaagctgagcatccagagccccgtgttgcacacgaatctgaatgtgcaatccacacaccctccattgaagaaggaggacctgcatagaatttccaaagattccttggagtccgactccgagtccctgacccaggagatcatgtgccactccgagttcgacgatcgtatcaggggtaatggaatggaaccagactccctggacgaggaagagagtcccagatggggcagcctgcatgaaatggaggaggaggcttcgggaaaagccgcgcagatggctagggaacaaaatcaccacacatgggaccagggcgccaataacagacagcagcctattgaggacaagtacagtgacctgcggtacgacccgaattggaaatccaaaaaagaggagggccaactcctcagcgttgaggcgctgccggagagcacagatagctctctggagaacctccctttggctccactatacccttcacaagagaccagcatggaactgtcgggtggcaagggcgaacagaaggagtcaccccaatccgctgcaagcctgctcgggtctgagttcctttcccccaactacgagcacggtgccagacgatccaagccattctccgaattatcagattcagatctggaggaaaaatcctcatccctgtctccatatgttaaaagcagttctagccacaatgaagtgtttcttcccggatccagggggccaaggaggcggaaatcaaagcaacatttcgtggagaagaacaagctcactttgggcctgccgacacccaaaaccgactcctatctccaactccataacaagaagcgaggcgagtcacaccccgagcaggtcatcctgcgtgtcaactctctgccaagagacgggtttaagaccttctggtcccagtag

SEQ ID NO: 45031 - DNA, 2337 bp, Artificial Sequence
  Description of Artificial Sequence: Synthetic coding sequence
atgagcaagcggaagctgatccccaagctgagcatccagagccccgtgctgcataccaacttgaatgtccagtccacacatccccccctgaagaaggaggacttgcaccgcatcagcaaggattctctggaaagcgattccgaatcactgacgcaggaaattatgtgtcatagtgaatttgacgatcgcataaggggaaacggtatggagcctgacagtcttgatgaagaagagagccctagatggggatctttgcatgagatggaggaggaagccagtggaaaagcagcacagatggcgagggaacagaatcaccacacctgggaccagggcgcgaacaacagacagcagccaatcgaagataagtatagcgacctgcggtacgaccctaactggaaatcgaagaaagaggaaggccaactgctttcagtggaggccttgcctgagtcaaccgacagcagcctagaaaatctcccactggctcccctgtacccttcccaggagacttcgatggagctctccggcggcaagggcgaacagaaggagagccctcagtccgctgcaagtctgctggggtcggagtttctctcccccaattacgagcacggagcccgccgcagcaaacctttttccgagctcagcgactctgaccttgaggagaaatccagctccctatcgccctatgtcaagagcagctccagccacaacgaagtgttcctccctggttcgcgggggcccaggagacggaagagtaaacaacacttcgtcgaaaaaaacaagctgacccttggtcttcctacaccaaagaccgactcctacctgcagttgcacaacaaaaagcgcggagagtctcaccctgaacaaatatcttacccagtgcgcgtcacagacaagacttcaatccaaaacgccaaggagatggagaatgccgcaattgatcctgaagataagtggcatcagcgtgcccagcagctgaagaattatcaggaacattggagccagtacgaaagcaccaagtcgagtaacgtgccccggggccagcctagtgatatggtgaacgatcaccagccctctcgtcggccggcaaaactaaagatccgcaaacagtgcaaacatcagaatgggctaaagtcaagcactaccgaggaggtcaccgcctctcagggtaaccaaaataatcccccacgtcagcagcaaaatcagaacaaaccactggacacgagcaccaaacccgaatctattgtgattatgcatgcctcaaataacgacgtgcaggccagcagagcactcaggagtcataacctgaaggaaacctccaacacattcgcgccccctaagcaagctttcgacaaggtactgagtaagaatagcactgggtgcgattccggcctgaatgttaataaagagcgaggccacaaagaccaggaagaaaaaaggtttagttatcaacagctacacacattgagcgacatggacttaaacaacctgaacgaactatctaagagacatgtgctgctctcccagaagggctctcagtttgtttaccatattaacacccacggttcaactaagaataaaaaacagttgaaacagccatacacagaaaccaaatatcgaaatttagagatgctttggaagttccattcctcctcagactcacaaacagttcgcgccagccccgattcgtggctcacccaaataatggagcagcaccagcaggctctggtgcaacttacggacgtccaaccctccgaaggtgccctaagttccgtgacattgccgccaatcctgtcaagagtggagtcagaatcgcagctatccagtgagagaagccaacgcaaccaagtgaaaatttcacgatcaaactccgaaggctatctgttccagctagaaaaaggcaaaaaacacaagaagcggagtagcagtaaaaacaccaagctcaagggttaccagaagcgggatgtcaaacttggaggactcggcccagattttgaaagtatacgggataagacgcagaaactgattcagcagaaagagtacgctaaacaggttaaggagtataacatgaaaaccctctcaattctttccaagccacagaccgagaagacgcagaaaaaaagcgccatacccagacagaaagccctggaatatgccaagacaatcccgaaaccaaagccatccaatcttacacaccaggcctctaaagagcagaagaaccccacatacgctgggaaagaggagtccctgcccgagatttccctcttggaaatcttacagaataggcatgagcgtgaaaagcaagcagttgccgctttcaaggtgctccacatcgtctag

SEQ ID NO: 45032 - DNA, 942 bp, Artificial Sequence
  Description of Artificial Sequence: Synthetic coding sequence
atgccctggaaggaggagagcgagttcaccaagcaggacaaggccgcacgggtcattcagcaggcatggaagtcctttctgaatgtcgccatattccagcactttaagtccctgatcgatttacggcggcagggtgaaccacggcagatagtcaagtacatcaacccaaaggaagccgaattgctagacgccgccgcaggtattcatgtcaggtttcgtctgggcggtgtgaagttcccgcctgacatctattacaagatttttacccatcgacctatcgaggatctgtgcgccaattcacccagaaactatgcaaagttgcccgccaagcacactagccacaacaagaatgatcacctgcaggaagaggaccactctggctggtaccacaggatcgaaaacaacggatggcgccccgtttcagacactttctggctctccaccgatggaatggtggtggaagacaagaaagagtctgagttccacttctcgaaacttaagaggcgccaagatcttgaaaagaaacggaagctgcgcaaaatagaatggatgcggcaaatgtattattcaggctctctagaagcaaaatctactcaccacgaaacactcggactgatccacactgccacaaagggtcttattagagctttcgaggatggaggcatagattcagttatggagtgggaggtggacgaggtacttaattggactaatacactaaacttcgatgaatacatcgcatcctggaaggaaattgctacttccaattcttccgctaattttaagggatttcggttcaatcaagcccagaagaacatttacaattacggcggcgacatttccaagatgcagatgggcatccctgacgacacttactacgagaacgtctatcaggaaccgaacgtgaccagacttactccagactccacttacggcctctag

SEQ ID NO: 45033 - DNA, 942 bp, Artificial Sequence
  Description of Artificial Sequence: Synthetic coding sequence
atgccctggaaggaggagagcgagttcaccaagcaggacaaggccgctcgcgtgatccagcaggcttggaagtctttcctgaatgtagccatcttccagcactttaaaagcctgattgacctccgccggcaaggggagccccgccagatcgttaaatacataaatcccaaagaagctgagcttctggatgctgccgccggcatccatgtgagattccgcctaggaggcgtgaaattcccaccggacatctactataagattttcacacaccggcccattgaagatctctgcgccaactcccctcgaaattacgccaagctcccagctaagcatacttcccacaataaaaatgaccacctacaggaagaagaccacagcggttggtaccacagaattgaaaataacggatggcgcccagtgagtgatactttctggctctctaccgacggcatggttgttgaagacaagaaggaaagtgagtttcatttctcaaaattgaaacggcggcaagacctagaaaaaaaacgcaagctcaggaaaattgagtggatgcgccaaatgtactactcaggatccttagaggcaaaatctactcatcatgaaaccctcggactcatccatacggcgaccaagggactgattagagccttcgaggatgggggtatcgactccgtgatggagtgggaggtggacgaagtactcaattggaccaatacgctgaactttgacgagtacatagcgagctggaaggagatagccacttccaattcaagcgctaactttaaaggcttccggtttaatcaagctcagaaaaatatctataactacggcggggacatttcgaagatgcagatgggcattccagatgatacctattacgagaacgtgtatcaggaaccaaatgtgacacggttgacccccgactcaacttacgggctgtag

SEQ ID NO: 45034 - DNA, 369 bp, Artificial Sequence
  Description of Artificial Sequence: Synthetic coding sequence
atgaccagccccgagatcgccagcctgagctggggccagatgaaggtgaaggggtcaaataccacctacaaagactgcaaggtgtggcccggcggcagcagaacctgggactggcgcgagactggaaccgaacattcccctggcgtgcagccagctgacgtaaaggaagtggtggagaagggcgtccaaaccctcgtcattggccgaggaatgtctgaagcacttaaggtgccatctagcacagtggaatacttaaaaaaacacgggattgacgtgcgtgtactccaaacagaacaggccgttaaagagtacaatgctttggtcgcccaaggcgtcagagtagggggcgtgtttcactctacctgctag

SEQ ID NO: 45035 - DNA, 369 bp, Artificial Sequence
  Description of Artificial Sequence: Synthetic coding sequence
atgaccagccccgagatcgccagcctgagctggggccagatgaaggtaaagggaagcaatactacatataaggactgtaaggtctggcctggcggaagtagaacatgggattggcgagagacaggaacagagcactctcccggcgtgcagccagcagatgttaaagaagtggtcgaaaagggtgtccaaactctggttattggaaggggcatgtccgaagctttgaaggtccccagcagcacagtcgaatacctcaagaaacatggaatcgacgttcgggtattgcagaccgaacaggctgtgaaggagtataacgcactcgtcgctcaaggcgtgagggtgggcggagtgtttcattccacatgctag

SEQ ID NO: 45036 - DNA, 882 bp, Artificial Sequence
  Description of Artificial Sequence: Synthetic coding sequence
atggccgccgccgccgccgccgccgtggccggcgtgggccggggcgggggaggagcagagccgagacaggaaaggtcacgtgcccgcggatgggctggggtcgaaagatccgaagggcgctcgcgcatggagcccggagaggagctggaagaggaggggtcaccaggcggaagggaagacggcttcaccgctgaacacctagcagcagaggcaatggccgctgacatggacccatggctggtgtttgacgccaggaccacccccgcgaccgagctggacgcctggttagcaaaatacccccccagtcaggttacaaggtacggtgatcctgggtcgcccaactccgagcccgtaggatggattgctgtgtatggccaggggtactctcctaattcaggggatgtgcaaggcttacaggcggcatgggaagctttacagacctctgggcggccaatcacccccggaacactcagacagcttgccattacccaccacgtcctcagcgggaagtggctgatgcatctcgctcctggatttaagcttgaccatgcttgggcaggaatcgcgagggccgtggttgagggtcaactgcaggtagcgaaggtctctcctcgcgccaaagagggcggtcgccaggttatttgcgtgtatacggacgacttcacagaccgattgggtgtcctggaggcagacagtgctattagggcggcggggatcaaatgtctcctaacctacaaacccgacgtctacacatatttggggatataccgcgcaaatcgttggcacctatgccccacactgtatgaaagccgcttccaactcggagggagcgccagggggagcagagtgttggacagggcgaacaatgtcgaactcacctag

SEQ ID NO: 45037 - DNA, 879 bp, Artificial Sequence
  Description of Artificial Sequence: Synthetic coding sequence
atggccgccgccgccgccgccgccgtggccggcgtgggccggggcgggggaggcgccgagcctaggcaagagagaagtagggcgaggggctgggcaggagtggagagatccgagggacgaagaatggaacccggcgaggaactcgaagaagagggatcacccggaggccgcgaagatgggtttactgctgaacacctcgccgctgaggcaatggcagctgacatggacccatggctggtattcgatgcacggacaacaccagccacagagttagacgcgtggcttgccaaatacccacctagtcaagttacccgatacggagaccccgggagccccaacagcgaacctgtaggatggatcgccgtgtacggtcaaggttattcacccaattcaggagatgtgcaaggtctgcaagctgcctgggaggcattacagacaagcggtcgcccaatcacaccgggaacgctgagacagctggccattacccaccacgtgttgtcaggaaaatggctcatgcatctggcccccggtttcaaactggaccacgcctgggccggcatcgcgcgggctgtggtggagggccaactgcaggttgcaaaagtttcgcctagggcgaaggaagggggtcggcaggtgatctgcgtctataccgacgattttacagataggctgggggtcctggaagctgactcagccatcagagcagcgggcataaagtgcctgctcacctataaaccagacgtttatacatatcttgggatttaccgggctaaccgatggcatctgtgtccaaccttgtatgagagcagattccagttgggcggatcagctcgcggctctcgggtcctcgacagggccaataatgtggagttaacctag

SEQ ID NO: 45038 - DNA, 165 bp, Artificial Sequence
  Description of Artificial Sequence: Synthetic coding sequence
atgctgggccggatcaaggcccaggccttcggcttcgaccagacctttcagagctatagaaaggacgacttcgttatgggcttcttccagagacccaaatgctattctcaattcgaagtaacctttcggttcttctggaccatggatcatatcaggttctgctag

SEQ ID NO: 45039 - DNA, 804 bp, Artificial Sequence
  Description of Artificial Sequence: Synthetic coding sequence
atggccaccggcgagctgggcgacctgggcggctactacttccggttcctccctcagaaaacgttccagagcctatcctctaaagagatcaccagcagacttcggcagtggtccatgctgggccgtataaaggcacaggccttcgggtttgatcaaacttttcagtcttacaggaaggacgattttgttatggccttcttcaaagaccccaacgttatccccaacctgaagttactgagcgacagctccggacaatggatcattctgggcacagaagtgaagaaaatcgaagccatcaacgttccatgcacccaactgtccatgtcttttttccaccggctctatgacgaggacatcgttcgggactccggccacatcgtgaaatgtctggacagtttctgtgatccctttttgatttcggacgaactgagacgggtgctgctggtggaggactctgaaaagtacgaaattttctctcagcctgatagagaggagttcctattctgtctgtttaagcatctgtgccttgggggggccttatgtcaatatgaggatgtaatctccccttatctggaaacaaccaagctcatctacaaggacctcgtgtccgtgaggaaaaatccccagacgaaaaagatccaaattacatcatccgtgtttaaagttagtgcatatgacagtgcaggaatgtgctacccctctgccaagaaccatgaacagacattttcctatttcattgtcgacccaatccggcgccacctccatgtcctgtatcactgctacggagtaggcgacatgtcttag

SEQ ID NO: 45040 - DNA, 300 bp, Artificial Sequence
  Description of Artificial Sequence: Synthetic coding sequence
atggccaccggcgagctgggcgacctgggcggctactacttccggttcttgccacagaaaactttccagtcactgtctagtaaagagatcacctcccggttgcgtcaatggtcaatgctcgggaggattaaagctcaagcctttggtttcgatcaaactttccaatcctacaggaaggacgacttcgtaatggctttctttaaagatcccaatgtaatccctaatctcaagctgctcagcgactcctctggtcagtggatcattttggggttcgcatcagggcgactcagaaagatctag

SEQ ID NO: 45041 - DNA, 444 bp, Artificial Sequence
  Description of Artificial Sequence: Synthetic coding sequence
atggccctgaacaacgtgagcctgagcagcggcgaccagcggagccgcgtggcctatcgcagctcacacggcgatctgcgccctcgggcctcagccctcgcaatggtctcgggtgatgggtttttggtctccaggcccgaggcgatccatctgggaccacgacaggcagtgcgcccttctgtacgagccgagtcccggcgggtcgacggaggaggaagatcccctcgcgaacccgatggcagaggccggtcacggcaagcccgcttcagtccttatcccatccctgcagtggagccagacctccttcgaagtgtgttgcagcagagactcatagccctgggtgttaccacctggactctaaagctgtccgagagcgctacgccagatctgcgttggtgctcaacctgcagtcacagcaatatttttgagatattagtgatttag

SEQ ID NO: 45042 - DNA, 756 bp, Artificial Sequence
  Description of Artificial Sequence: Synthetic coding sequence
atgacccagctgcccgagctgggcctgcggagccccaacaacaagagcccaacagggccccaccccctggagcacctgctggcccggttacttaagaggaggaggcgctctacactgatgtcatcaccccggtccttgctgtgcagtatctcaggcccgggctcacacctcctcagtacccacccgattctgtgccactccgtgtaccagccgccgcagcctgctagcagaccccaggctaaacgttatcagggcctgctgcctgtgccgcttgcgcctcaccctttgtgtctgtctggccagctctacttacctaatattccatgtactgtcattgacggttgcggaccagtcattagccacctcaagctgaccatgtatccctggggtctacctccctctcacctgggctcctcctcccctttctcagctaacatggagcagtgggactactataagagtcagacccgcttcgcccccttcttgccggagagcttttgtggctcgcctctcccatctgagcaaagcagccgccccttcggcctggcatttaaggtactctgtgcagccacttgccagcctccccaatttcaactgttatggctgtgcccatataagctcgacctgcatcagaggatatgtctcccccctaatctagcgctagtgctattaggcgcactgtggacaagccccccacccggatcctttctgcagccaccatacaataggccatataagctgtataaaacaaactag

SEQ ID NO: 45043 - DNA, 756 bp, Artificial Sequence
  Description of Artificial Sequence: Synthetic coding sequence
atgacccagctgcccgagctgggcctgcggagccccaacaacaagtcaccgacaggcccgcacccactcgaacatcttttggcgagattgctgaagaggaggcgtcgctctaccctcatgtcatcaccgcgatccctcttatgcagcattagcggacccggctcacatctgctgagcactcaccccatcctctgtcattccgtctaccagccaccccagccagcatcccgacctcaggccaagcgctaccagggcctattgccagtgccattggccccccacccattatgcctctctgggcagctatatttacccaacattccctgtacagtcatcgacgggtgcggtcctgtcatcagccacctgaaattgaccatgtatccttggggcctgccccccagtcacctgggtagcagttctccattctcagctaacatggaacagtgggactactataagagccagacgcggtttgctccgtttctcccagagtcattttgcggctcaccacttccctcagagcaaagctcccgcccctttggtttagcatttaaggtgctgtgtgccgccacctgtcaacccccacagtttcagctgctgtggctgtgcccctataaactggatctgcatcagcgaatttgtctaccacctaatctcgccctggtgctgttgggcgctctctggacttcgccaccccctgggagctttctgcaaccaccctacaaccggccctacaagctctataaaactaactag

SEQ ID NO: 45044 - DNA, 666 bp, Artificial Sequence
  Description of Artificial Sequence: Synthetic coding sequence
atgagcgcccacatgagcggcctggagatcatggacgaggaccagctgattaaagatgttttagacaagtttttaaattgccacgagcagacttacgacgaggaattcctgaacacatttacccatctcagccaagaggaccatgtaagcaagagaggcgtgtttgggaccgattccagcgagaacatcttcaccagtgctaaagtgacccacaaaaacgaggcagatgactaccacctcagaaataagacaatattcctgagaacctctagccagtgcttagaggagcaggtggacaacttccttgacttagaggatttagacatggacgaggaaattaagccacagatgagcgaagacctgctcctactacctggggaggtggaacaggacgtgagcacatcaattcccagctgtatcccgttcgtggcccagccacccacgtgcgaggtgaaacccaagcccagcgtgaaacggatggacaaacagacagaagagatactgggcgatgaagtacagttattttctctggacgaagagtttgactacgacaacgtgatgctgacatctaagttctctcctgctgaaatagaaaacatcaaagagctgtgtaaacagcagaagaggaaggatacaagcccagatctggaaaagagttgcgattag

SEQ ID NO: 45045 - DNA, 444 bp, Artificial Sequence
  Description of Artificial Sequence: Synthetic coding sequence
atgagcgcccacatgagcggcctggagatcatggacgaggaccagctgatcaaagacgtactggataagtttcttaactgccacgaacagacatacgacgaagagttcttgaacacctttacgcaccttagccaggatctgctattgctgccaggcgaagttgagcaagacgtgtcaacatctatcccctcctgcattccatttgttgcgcaaccgcccacatgtgaggttaaacccaaaccctctgttaagagaatggataaacaaaccgaagagattctaggcgatgaggtgcagctgttttctcttgacgaggagtttgattacgataacgtcatgctgacttccaagttctctcccgccgagatcgagaacataaaggaattatgtaagcagcagaaacggaaagatacgtctcccgacttggagaagtcgtgcgattag

SEQ ID NO: 45046 - DNA, 504 bp, Artificial Sequence
  Description of Artificial Sequence: Synthetic coding sequence
atgagcgcccacatgagcggcctggagatcatggacgaggaccagctgataaaggacgtactggacaagttcttgaattgccatgagcaaacctacgacgaggaatttctgaacacatttacccatctgtcacaggaggatcacgttagtaaaagaggtgtcttcggaaccgattctagtgaaaacatattcactagtgcgaaggttactcacaaaaacgaggccgatgattaccatctccggaataagaccatctttcttcgcactagctctcagtgcttggaggaacaggtcgacaatttcctcgacctggaagacttagatatggacgaggaaatcaaaccacagatgagcgaagacctgctgctgctgcccggggaggttgagcaggatgtctccactagcattcctagctgcattccgtttgtggcccagcctccaacatgcgaagtgaagcccaaacctagtgtgaagcggatggacaaacaaaccgaagagagctag

SEQ ID NO: 45047 - DNA, 273 bp, Artificial Sequence
  Description of Artificial Sequence: Synthetic coding sequence
atgagcgcccacatgagcggcctggagatcatggacgaggaccagttgattaaagacgtcctcgacaaattcttaaactgccacgagcagacctacgatgaggagttcctcaatacgtttacacacctgtctcaagacctcttactgcttcccggggaggtggagcaggacgtctcgacctcgatcccctcatgtattccctttgtggcccaacctccgacctgcgaggtgaagccaaagcctagcgttaagcgaatggataaacagacttag

SEQ ID NO: 45048 - DNA, 252 bp, Artificial Sequence
  Description of Artificial Sequence: Synthetic coding sequence
atgagcgcccacatgagcggcctggagatcatggacgaggaccagctgatcaaagacgtactagacaagtttctgaattgccatgagcagacttacgacgaggaattcctcaatacctttacacacctgagccaggaggatcatgtttctaaacgcggcgtgttcgggaccgattcaagcgagaatatctttaccagtgccaaggtcacgcacaagaatgaagccgacgactatcacttgagaaataaatag

SEQ ID NO: 45049 - DNA, 543 bp, Artificial Sequence
  Description of Artificial Sequence: Synthetic coding sequence
atgagcgcccacatgagcggcctggagatcatggacgaggaccagctgatcaaggatgttttagacaagtttcttaactgccacgaacagacttacgacgaggagttcctaaacacatttacacacttgtcacaggaggaccatgtcagcaagaggggcgtcttcggtactgatagttcagagaatatcttcacatctgctaaagtgacacacaaaaacgaggccgacgactatcatctgcgcaacaagaccattttcttacgcactagcagtcagtgtctggaagagcaggttgacaacttccttgacctagaggacctcgacatggacgaagagatcaagccacagatgtcagaagatctgttgcttctcccaggggaggtagagcaggacgtcagcacatctatccccagctgtatcccattcgttgcccagcctcccacctgtgaggtcaaacccaagccctctgtgaaacgtatggataagcagactgaagaaattttgggggatgaggtacagctcttcagtttggacgaggagtag

SEQ ID NO: 45050 - DNA, 360 bp, Artificial Sequence
  Description of Artificial Sequence: Synthetic coding sequence
atgagcgcccacatgagcggcctggagatcatggacgaggaccagttgattaaagatgtgctggacaaattcttaaactgccacgagcagacttatgatgaggaatttcttaacacatttactcatctgtcccaggaagaccatgtgtctaaaaggggtgtgttcgggaccgacagtagcgagaatatcttcacatccgctaaggtgacccacaaaaatgaagcagacgattaccatttaaggaacaaaactatcttcttgaggacctctagccagtgtctcgaagagcaggtagacaattttttggacctggaagacttggatatggatgaggagatcaagcctcagatgtcagagtag

SEQ ID NO: 45051 - DNA, 444 bp, Artificial Sequence
  Description of Artificial Sequence: Synthetic coding sequence
atgagcgcccacatgagcggcctggagatcatggacgaggaccagctgatcaaagacgtgctcgacaaatttctcaattgccatgaacaaacgtacgacgaggagttcctgaatacattcacacacttgtcccaagacttgctgctgctgccgggcgaagttgaacaggatgtttccaccagcattcccagttgcataccgttcgtcgcacagcccccaacctgtgaggtcaagccaaaacccagcgtaaaacggatggacaagcagaccgaggagatactcggcgacgaagtgcagctcttcagtctagatgaggaattcgactacgacaacgtgatgttgacttctaagttcagtcccgctgaaatcgaaaatatcaaggaactctgtaaacaacagaagcggaaggataccagtccagacttggagaaaagctgcgactag

SEQ ID NO: 45052 - DNA, 1461 bp, Artificial Sequence
  Description of Artificial Sequence: Synthetic coding sequence
atggtggccagcgccggcagcctgttcggcggcatggtgctgaagaagttcctcaaggaaatccagagcatccttccagggatctccgctaagctcacctggactagcgaggagggctcatactcacaggacatgacaggcgttacgccctttcagatgatctttgaggtggatgaaaagccgcgtacactcatgactgattgtctggttattaagcactttctgcgcaagatcattatggtgcatcccaaggtgcggtttcatttcagcgtgaaggtgaatgggatcctgtctactgagatctttggggtcgaaaatgagcccaccctcaacttgggcaatggcatcgctctgctcgtcgatagccaacactatgtatcaagacccaattttggcactatcgagagccactgttcccggatacaccccgtccttgggcatcctgttatgctgttcatccccgaagacgtcgccggaatggacctgctgggggagcttatcctgacacccgccgctgcactgtgccccagccccaaagtgtcgagtaaccagctgaacaggatttccagtgtatccattttcctgtacggacccctcggtctcccccttatactgtcaacatgggagcagccgatgacgacgttcttcaaagacacctcctctctggtggactggaagaaataccacctgtgcatgattccgaacttagatctcaacctagacagggacttggtcctgcctgacgttagctaccaggtcgagagcagcgaggaagaccagagccagacgatggatccgcaaggccagactttgctgttgtttctgttcgttgacttccacagcgccttccccgttcagcagatggagatatggggcgtttatacattactgactacccacctgaatgccatcttagtcgagtctcatagcgttgttcagggttcaatccagttcactgtggacaaggtgttggagcagcatcaccaagctgctaaggctgctgacacacaggaattccgcacgaagctccacaaagtgtttagagagatcacacagcaccagtttctgcaccattgttcctgtgaggtcaaacagcagttgacactcgagaagaaagacagcgcccagggcactgaggatgcgcccgacaattcttccctggaattacttgccgatacatctggccaggcggagaacaagaggctgaaacgcggaagtccccgaatcgaggagatgcgtgcgctcaggtcagcccgggccccctcccctagtgaagcggcacctcggaggcctgaggctacggccgctccgttaactcctcgggggcgggagcatcgtgaggcccacgggagggcactggctccagggcgggctagcctggggtctcgcctggaggatgtgctgtggctgcaggaagtgagcaacctcagcgagtggctgagcccgtctccaggcccctag

SEQ ID NO: 45053 - DNA, 2034 bp, Artificial Sequence
  Description of Artificial Sequence: Synthetic coding sequence
atgggcagccggtgccgggcctgggcctggacccgggcctgggccctcgctgaattccaggctcgagctgaggagggtgctgcagccgccgcggcagcagccggcgggtacccgtctacaggccgctgcagatgttctctgcgcggaatggagggcacagccgtcgcagtctttgagatactcaggttcctcatcatccactggaaatgtgatattgatgtgtctaagggggctctattagaagggcagctggttatctccatagaaggactgaacagcaagcaccaggctaatgccctgcactgcgtcactactagatggtccttaacacttctccctcgcccagagtgttctggcgcggtaagtgcccattgcaacctgcaccttccaggctcatctgacagccacgcttctgttcctcgggtcgcagggattacagacgcccatcatcacgcatggttgattatggttgcttccgcagggtccctttttgggggaatggtccttaaaaaatttcttaaggagatccagtcaatcctgcccgggatcagcgctaagctgacgtggacttctgaggaaggctcctattcccaggatatgactggggtgactccctttcagatgatttttgaagttgacgaaaagcctcgaacattgatgacagactgtctagtgatcaagcattttcttcgcaaaatcataatggttcaccccaaagtcaggttccacttctcagttaaggtaaatgggattctgtcaacagagatttttggagtggaaaatgagccaacccttaacctcgggaatggtatcgctctattggtcgatagccaacattatgttagaccaaatttcgggaccatcgaatcccattgctcaaggatacaccccgttcttggccacccggtgatgctgttcatccctgaagacgtggccggaatggatctcctgggcgagttaattctgacccctgcggctgccttgtgcccctcccccaaggtctcctctaaccagctgaaccgaatctcatcagtcagcatatttctgtatggtcccctgggtctgcccctgatactttccacatgggagcagccaatgacgactttttttaaggatacttccagtctggtcgactggaaaaagtaccatctatgtatgatccctaacctggacctaaacctggaccgcgatctggtcctgccagatgtctcatatcaagtcgagtcctccgaggaagaccagtctcagacgatggatccccaggggcagacactgctgttgtttttgttcgtggactttcactctgcctttccggtgcagcagatggaaatttggggtgtttacacactgttaaccacccatcttaacgccatcctagtagaatctcattcagtggtgcaggggtccatccaattcacagtcgataaggtgctcgagcagcaccaccaggcagccaaggcacagcagaagttacaggcgagcctcagcgtcgccgtcaattcgatcatgtcaatcttgactggctctacacggtcttcatttcgaaagatgtgcctgcagactctgcaggccgctgacactcaggaattcaggactaagctgcacaaggtctttcgagagattacacaacaccagttcctgcatcactgctcatgtgaggtcaagcagcaattaaccctggagaaaaaagacagcgctcagggcaccgaggacgcgcctgataatagctcactggagcttctagccgatactagtggtcaggccgagaacaagcgactgaaaagaggatctccacgaatcgaggaaatgcgagccctgagaagtgcaagagcccctagcccttccgaggcagccccgcggcgtcccgaggctactgctgccccccttacaccccggggtcgggagcatcgggaagcccacggaagggcgctggcccccggtcgcgcgtccctcggttctcggctggaagatgtgctgtggctgcaggaagtaagcaatctaagcgaatggttgtctccttctcccgggccatag

SEQ ID NO: 45054 - DNA, 1536 bp, Artificial Sequence
  Description of Artificial Sequence: Synthetic coding sequence
atggtgctgaagaagttcctgaaggagatccagagcatcctgcccggcatcagtgcaaagctcacctggacgtctgaggaggggtcttattcacaggacatgactggcgttacccctttccagatgattttcgaagtcgatgaaaagccaaggacacttatgactgactgcctggtgataaaacacttcctccggaaaattatcatggtgcaccctaaggtcagattccatttctcagtaaaggtcaatggcattttgtctaccgagattttcggtgttgagaatgagcctaccctgaacctggggaacggcattgccctgctagtggatagccagcattacgtgagtcggcctaattttgggacgatcgaatcccactgttcaagaattcatcctgtgttgggccacccagtgatgctttttattcccgaagatgtcgctggtatggatcttttaggggaactcattctgacccccgccgccgctctttgcccgagccccaaagtgtccagcaaccagctcaatcggatcagtagtgtgtctatctttttgtacgggccactgggcctgcctttaattcttagtacctgggagcagccaatgacgactttttttaaagatacatccagcctggtcgattggaagaaatatcacctgtgcatgattccaaatcttgatttaaacctggaccgcgacctcgtcctgcccgacgtgtcgtaccaggtggagtccagcgaggaggatcagagccagaccatggaccctcaggggcaaacccttttgctgtttctctttgtcgacttccattcggcattccctgtgcagcagatggaaatttggggggtctacacacttctcacaacacatttaaacgccatcctggttgagtctcacagcgtcgtccagggatccatccagttcacagtggacaaagtgctggagcagcaccaccaggctgctaaagcacagcagaaacttcaggcctctctgagcgtggctgtcaacagcataatgagtatcctgaccggctcaactcggagtagctttcgcaagatgtgtttgcagaccctacaagcagccgatacacaggagtttagaacaaaactacacaaagtattccgcgagattacacaacatcagtttctgcaccattgctcttgtgaggtcaagcagttgacccttgaaaagaaagacagcgctcagggaacagaggacgctcccgacaactcttccctggagctcctggcggatacatccggccaggcagagaacaagcggctcaaacgaggctcaccacggatagaagagatgagagctctccgtagcgcaagggccccaagccctagcgaggctgcacctcgccgccctgaagctactgccgcacccctgacacccagagggcgcgagcaccgggaggcacatggtagggccctggcgcccggccgggcctcattgggctccaggctggaggacgtgttatggcttcaagaagttagcaacttgagtgagtggctgtcgcctagcccgggaccttag

SEQ ID NO: 45055 - DNA, 1146 bp, Artificial Sequence
  Description of Artificial Sequence: Synthetic coding sequence
atggccctgaaggccgagggcgccgccctggactgcttcgaggtgacactcaagtgcgaagaaggggaagatgaggaagaagcgatggtcgtggccgtgattccccgaccagaacccatgttaagagtgactcagcaagaaaagaccccgcctccgagaccctctccattagaggctgggtccgatggctgtgaagaacctaagcagcaggtaagctgggagcaagaattcctggttggctcttctcctggcgggtcaggcagagcactgtgtatggtgtgtggtgctgagattcgggcacccagcgcagacaccgcccgctcccacatccttgagcagcatccccacaccctggatctgtcccccagtgaaaaatccaacattctggaggcatggagcgagggggtagccctcctgcaagacgtgagggcggagcagccctcaccaccaaactccgacagcggccaggatgcgcatcccgaccccgatgccaaccctgatgctgcgcggatgcctgctgagatagttgttttgctagactcagaggacaatccatcactaccgaagcgttctcgcccgcgcggcctccgcccacttgaattacctgctgtgcccgcgacagaacccggaaacaagaagcctcgcggacaacgctggaaggagccaccaggtgaggagcccgtgcgtaagaaacgcggccgacctatgaccaaaaacttagaccccgacccggaaccgcccagtccagacagccccacagagaccttcgccgcccccgcagaagtgaggcacttcacagacgggtcgttccccgcagggtttgttttacaactcttcagccacacgcagcttcgcggccccgactccaaagatagtcctaaagaccgcgaggtggctgaaggcgggttgccccgcgccgagtccccttcccccgctccacctcccggtcttaggggtaccctggacctgcaggtgatacgcgtccgaatggaggagcccccggcagtgtcactcctgcaagattggtcccgtcacccacaagggactaagcgcgttggggcgggggacactagcgactggccaactgtcctgtccgagtcctcaacaacagtggctggcaagcccgagaaagggaacggcgtgtag

SEQ ID NO: 45056 - DNA, 651 bp, Artificial Sequence
  Description of Artificial Sequence: Synthetic coding sequence
atgagcctgaagcccttcacctaccccttccccgagacccggttcctacatgctggcccaaatgtctataaatttaagataagatacgggaagtccattcgaggagaagagatagagaacaaagaggttattacccaagagctcgaggactctgtgagggtggttctgggcaacttagataatctccagccttttgcaaccgaacatttcattgtgtttccatacaaatccaagtgggagcgagtctcccacctgaagttcaagcacggtgagatcatactgattccgtatccatttgtgttcactctgtacgtggagatgaaatggtttcatgagaatctgtctcctggaaagcccatcagtgatagtccactgggtctggtgccagtcgagaaaaaagccgtgggcgccgtaatgagaaaacggaagcacatggacgagccttcttccccgtcccggccaggactggacagaatcgggaaagagaaaccgaataaggattgcagacgcctgtggcccctgatatctctcatgagtcgtaacaagattctgtcaggggacacggcatgccagggagagctgtctcatccctgctctaccactcacctgcacctacggtctgaacagcctcccgcatctctcgggttctag

SEQ ID NO: 45057 - DNA, 651 bp, Artificial Sequence
  Description of Artificial Sequence: Synthetic coding sequence
atgagcctgaagcccttcacctaccccttccccgagacccggttcctgcacgccggcccaaacgtgtacaaatttaaaatccggtatgggaaaagtatccggggagaagagatagagaacaaggaagtgataactcaggagctggaggactctgttcgggtcgttctgggcaaccttgacaatctgcaacccttcgcaaccgagcactttatcgtgttcccatacaagagcaagtgggaacgggtgagtcacctgaagtttaagcatggcgaaatcatcctgatcccgtacccttttgtgttcacattatatgtcgagatgaaatggttccacgaaaacctctcacccggcaaaccaatctccgacagccctttaggccttgtccccgtggaaaaaaaagccgtgggggctgttatgcgtaagcgtaagcatatggatgagccaagcagccccagcagacccggtctggatagaatcggaaaggaaaagccaaacaaagattgccgccgtctatggccgctaatctcgctgatgagcagaaataagatcttatcaggggatactgcttgtcagggggagctctcccatccctgctcgactacacatctgcatctgaggtccgagcagccaccagcttcactcgggttttag

SEQ ID NO: 45058 - DNA, 447 bp, Artificial Sequence
  Description of Artificial Sequence: Synthetic coding sequence
atgaagtggttccacgagaacctgagccccggcaagcccatcagcgactccccgttagggctggtgcctgtcgaaaaaaaggccgtgggtgcagtgatgcgcaaacgcaaacatatggatgaacccagttccccatcccgtcccggcctggatcgcgcgaagatcggaacttccagtcagggcccatctaagaaaaaacctcccgtggaaacaaggcgcaatcgtgagcggaagactcagcagggactgcaggaaactttggcaagcgacattacagacgtgcagaaacaggactccgagtggggccattctctgcctggacggatcgtaccccctctccagcataactcaccacctcccaaggaacgcgccgcaacaggtttctttggcttcctcagctcattgttccctttccgttatttctttagaaagagcagtcattcttag

SEQ ID NO: 45059 - DNA, 348 bp, Artificial Sequence
  Description of Artificial Sequence: Synthetic coding sequence
atgggcaccggcctgcggagccagagcctgcgggagccccggcccagttatggaaaactgcaggaaccttggggtaggcctcaagaaggccaactaaggagagccctcagcctccgtcagggacaagaaaaatctcgatcgcaaggtcttgaacggggaacagagggccctgacgccactgcccaagagagggttccagggtccctgggcgataccgagcagctcatccaagcacagcgacgcgggtcccgttggtggctaaggaggtaccagcaggtgaggagaaggtgggagtcgtttgtggcaatcttcccctcagtgactcttagccagcctgctagtccatag

SEQ ID NO: 45060 - DNA, 510 bp, Artificial Sequence
  Description of Artificial Sequence: Synthetic coding sequence
atggagaccggccccagcgaggagcccagcggccggaaggagagccaggaaatgtgcccacccgggctgctcgtgtttgctggatctagcgagcaggatgctaacttggcgaaacagttctggatctccgccagcatgtatccccccagcgaaagccagttagtgctgcggagggattcttcacagcgtcttccggtcgcccgacccagaagatctagggggtcagaaaactcacattcatcccagagttttcatcttgcaagcaacaaaaatagggatattttcgccgaagcactcaagatccaagagtctgaagagaaggtcaagtacctgcagaaagctaaaacccgcgaagagattctgcagctgctgcgaaagcagagggaggaacgaatctccaaggaactcatctctctgccttataagccaaaggccaaggaacacaaggctaagaaggtggtttctgagagtgacaaagaggatcaggaggaagtaaagaccttggattag

SEQ ID NO: 45061 - DNA, 537 bp, Artificial Sequence
  Description of Artificial Sequence: Synthetic coding sequence
atggagaccggccccagcgaggagcccagcggccggaaggagagccaggaaatgtgcccacctggtctgctggtcttcgctgggagttcggaacaagatgctaatttagctaaacagttctggatttccgccagcatgtaccccccatcggaatcacagctagttctgagacgcgattctagccaacggctacccgttgctaggccccggcgctctcgtggttctgagaattcacacagttcgcagtccttccaccttgcaagcaataagaatcgggacatttttgctgaagccctgaagatccaggaatccgaggaaaaggtgaaatacctgcaaaagacccggtcccactctgtaacacagaacgaagtgcaatggcacgaccacggaagtttacaaccccagttatctcggattcaagctaaaacgcgagaagaaatcttacaattgctgcggaagcagcgagaggagagaatctcgaaggagcttattagtctcccttataaaccaaaggctaaagagcacaaggccaaatag

SEQ ID NO: 45062 - DNA, 1440 bp, Artificial Sequence
  Description of Artificial Sequence: Synthetic coding sequence
atgctgatcagcgccgccagcatggcccccgaggtgtgcggccccagcctccaggggacacctggaccacccccacccctgctacctaagccaggaaaagacaacctccgtctccagaagctcctcagaaaagccgcacgcaaaaagatgatgggaggcactcacctggctcctccacgggcctttcggacgtcattgtctcctgtttccgaggccagtcatgaccaagaggtgactgcgccacacgctgcagagggaccacatcctgcagaggcacctcggctccccgaggcccccagacctgccgaggccccacgcatggtggccgccttgccgcgttccccccatacacccatcattcaccacgtagcatcccctttgcagaagtctacttttagcattgggctgactcaacgccggattctagccgcgcagttccgcgcaatgggcccccaagtggtggcctcagcacctgaacctacaaggccaccttctggcttcgtgcccgtgtccggtgggggcggaacacacgtgacccaggttcacatccagctggcaccttctcctcacaatgggacgcctgaacctccgcgtaccgcgcccgaggtaggatctaacagccaggacggtgatgcaacgccctcgcccccaagggcacaacctttggttccagttgctcatatccgacccttgcccaccactgtgcaggccgcctccccgttgcccgaggagccaccagtccctaggcccccaccaggcttccaggctagcgttcctagagaggcttcagcccgagtagttgtccctattgcaccgacctgccgaagcttggaatcttctccacattctctggtccccatgggtcctgggagggagcatctagaagaaccgcccatggccggacccgcggccgaggctgaaagagtgagctcacctgcatgggcctctagcccaaccccaccttccggaccgcatccttgccccgtgcctaaggttgctccaaagccaaggcttagtgggtggacatggttaaaaaaacaactgctggaggaagctccagaaccaccctgccccgagcccaggcagtctctggagcctgaggttccaactcccacagagcaggaagtgcccgcccccactgaacaggaggtgcccgcactgactgctccacgggcccctgcctctcggacctcccggatgtgggacgccgtcctctacaggatgagtgtagcggaagcccagggtagactggccggccctagtggaggggagcacacccctgcttcccttactaggctcccattcttgtacaggccgcgattcaatgccagaaagctccaggaagccacccgaccccctcctacagtgcggagcattcttgaactgtcgccacagcccaagaatttcaaccggaccgccacaggctggcggctgcagtag

SEQ ID NO: 45063 - DNA, 582 bp, Artificial Sequence
  Description of Artificial Sequence: Synthetic coding sequence
atgcccaagggccggcggggcagccacagccccaccatgagccagcgcagcgctcctcccttgtactttcccagtttatacgataggggaatttctagttcgcccctgtccgatttcaatatttggaaaaagctgttcgtgccactaaaggccggtggtgccccagttggcggagccgcaggcgctcgcagtttgagtcaagcactgcccgctccagccccccctccccctcctcccccaggcctgggacctagctccgagcgaccatggccttctccttggccaagcggtcttgcctccataccatacgaaccactgcgttttttctacagcccgcccccaggcccagaagtggtggcttcaccattggtgccctgtccttcaactccccggctagcttcagcctcccatccggaggagctctgtgagcttgagatccgcattaaagagcttgagctgctgaccattactggggacgggttcgattcacagtcatacacttttctgaaagcactgaaggacgaaaaactgcagggccttaagacaaagcagccaggcaaaaaatccgctagcctttcctag

SEQ ID NO: 45064 - DNA, 555 bp, Artificial Sequence
  Description of Artificial Sequence: Synthetic coding sequence
atgcccaagggccggcggggcagccacagccccaccatgagccagcggtccgctccaccgctctattttcctagtctgtatgacaggggtatttcaagttcccctctcagcgattttaacatctggaagaagctcttcgtgcctctgaaggctggcggcgcccctgtgggcggagcggcaggcgcaagatcactctctcaggctcttccggcccctgcacctccccctccacctcctcccggcttaggcccgtcttctgagcggccctggccctcaccctggccgagtggtctggcatctatcccatacgagccgcttcgattcttctacagtccaccccctggacccgaggtggtggcctcccctctcgtgccatgcccatctacacctagactggccagtgcatcacatcccgaggaactgtgcgaactggagattaggatcaaggaactcgaactgctcacgattacaggagacggcttcgatagtcagtcctttctgggactgtggacgacatgtgcagacgccggccgtatcccccagccaacatcatag

SEQ ID NO: 45065 - DNA, 375 bp, Artificial Sequence
  Description of Artificial Sequence: Synthetic coding sequence
atggagagctgcagcgtggcccaggccggcgtgctgaccagcccctttatgtggaggtggacaggcatggccggggcactttccgcgctcgataacacaattgaggacgatgcagacgaccagctaccttgtggcgaaggacgtcccgggtgggtgcgcggagaactccttggctcccaaggggtctgcaaagattcaaaggatttattcgtgccaacatcttcctccctgtatggctgcttttgcgtggggttggttagcggtatggcaatttctgtgctgttgttagcttctgactttcggaaactggacttttccagaccagaaccctgtttcgagaaggaggctagcctctggttcgtagctcagcattag

SEQ ID NO: 45066 - DNA, 375 bp, Artificial Sequence
  Description of Artificial Sequence: Synthetic coding sequence
atggagagctgcagcgtggcccaggccggcgtgctgaccagcccctttatgtggagatggaccggaatggccggtgcgctatcagcactggataacacaatcgaagacgacgccgacgatcagctgccttgtggtgaaggcaggccgggctgggtgagaggcgagctgctgggcagccagggggtttgcaaagactccaaggatctgtttgtgcctactagtagcagcctgtacggttgtttctgtgttggtctggtgtctggaatggctatatccgttctcctgctcgcctccgactttcgcaagctcgatttttccaggcccgagccatgctttgagaaggaagccagtctgtggttcgttgctcagcattag

SEQ ID NO: 45067 - DNA, 375 bp, Artificial Sequence
  Description of Artificial Sequence: Synthetic coding sequence
atggagagctgcagcgtggcccaggccggcgtgctgaccagcccctttatgtggcgttggactgggatggctggagccctgagcgctctggataacaccatcgaggatgacgcggacgaccagctgccctgcggagaggggagaccagggtgggtgcggggcgaactgctgggctctcagggggtatgcaaggatagcaaggacctgttcgtacccaccagttcatccctttatggctgcttttgtgtgggcctagtatctggcatggctatctccgttctgctcttagcctctgacttcagaaaattggacttcagtagaccggagccctgcttcgaaaaggaagcatcgctgtggtttgtcgcccaacactag

SEQ ID NO: 45068 - DNA, 465 bp, Artificial Sequence
  Description of Artificial Sequence: Synthetic coding sequence
atgcaccccgagcccctgctgaacagcacccagagcgccccccaccattttcctgattcctttcaggccacacccttttgttttaatcagtctctcatcccagggtcaccgtccaactcgagcatcctgagcggaagtctggattatagttacagccctgtccaactgccaagctacgcccccgagaattacaactcaccggcctccttggatactcggacgtgtggctatccgcctgaggaccatagctatcagcacctgtcctcccatgcccaatatagctgcttcagctccgccaccacaagtatttgttactgtgcttcctgtgaggcagaagatttagacgctctccaggccgcagagtatttttacccatctactgactgtgtcgactttgccccttccgctgccgccaccagcgacttttacaagcgcgaaaccaactgtgatatttgttattcatag

SEQ ID NO: 45069 - DNA, 465 bp, Artificial Sequence
  Description of Artificial Sequence: Synthetic coding sequence
atgcaccccgagcccctgctgaacagcacccagagcgccccccaccactttcccgattcatttcaggcaactcccttttgctttaaccaatcactgatacccgggtccccatcgaattccagcatcctctcagggtcgcttgattacagctacagcccggtgcagcttccatcatatgcacccgagaactataatagtccggcgagcctggacacacggacttgcggctacccacctgaagaccacagttatcagcatctttcgtcccacgcacaatatagttgtttcagcagcgctaccacctccatctgttattgtgccagctgtgaggcagaggacctcgacgccctgcaagccgcggaatacttttatcccagtaccgactgtgtcgacttcgcaccatctgcagcagctacgagcgacttttataagagagaaacgaactgtgatatttgctactcatag

SEQ ID NO: 45070 - DNA, 324 bp, Artificial Sequence
  Description of Artificial Sequence: Synthetic coding sequence
atgcaccccgagcccctgctgaacagcacccagagcgccccccaccatttccctgattcttttcaggccactccattttgttttaaccagagtctgattcctggttcgcccagcaattctagtattcttagcggctccctagattattcatacagtcctgtgcagctgccaagttacgcccccgagaattataattccccagcaagcttggacacacggacttgcggatacccccccgaggaccatagctatcagcacctttcgagccacgcacaatattcatgcttcagttccgctaccacttccatttgttactgcgcttag

SEQ ID NO: 45071 - DNA, 1308 bp, Artificial Sequence
  Description of Artificial Sequence: Synthetic coding sequence
atgggcaacaagcagccccagaaggtgaccgtgcccaccggcaccgctctccagggcgttgtgctaatcgtgtcaaccttgcatcagcccgggggctggatttgtgggaaggatccttgttgctcccttcgcccactaagcaatagcgttcaaaatgccctggcgtgtaagtccaagcaagactaccaagccgggatactttttaaaactcgcgctttcatctcacgtgactgcggcagtgatgccgcagaagatagtgcttccaaaggtgagacatataccttaactctggagcataaaggcgccggggagggagatttacggccccggggccagcctggctggtgcagattgggcgacccaaggcgcgacagcgccagaccagtggccgcgattgaggggccttgtccaggcgccgcccgcgcttcgcgggttctgagggggcgggggttttctagaaatccacgagggcgtggcctgccgtccggagctggatggcgtggagccggtggtgccggtgagggtgccgtcacgttccctgagagacggggggatgtgagacgtaagggcgccggccgggcccgctttaagtggcacagtttgtctagtgaactgagggcagtgtgggctgctgccggttatatttccagagagcctggtcgcaggggcgcagatggcgacagcagcggcggcgaacggcttggcgcacgccgcaattctgcaccacgtgccccctgcccacctacaggaccgccagcaagacctccaagcagaggggcaccagcccgggccagagaagggcggcgtcatccggctgctgatctggaccctcctcccggcgaacctccagccgctgcctcccggggagcccctgcacaaagacccccaagtgagtctcctggcgccccccccccgggaccagccgatgccggcggggctatggcggctaagccaggtgagctgatgggaatctgttcctcctaccaagccgtcatgccccatttcgtttgccttgcagacgagttcccccagcccgtccgccccgctaagctgcccaagggaagggggcgtctgagaaggcccaggcaatcgaggtttaaaacacaaccagtaacattcgacgaaatccaggaggtcgaggaggagggcgtctctccaatggaggaggagaaggccaaaaagtctttcctccagagtctcgagtgtctgagacgttctacacagtctctgtccctgcagagggaacaactgtcctcctgtaagctaaggaattcactcgactcttcagactctgacagcgctctatag

SEQ ID NO: 45072 - DNA, 1254 bp, Artificial Sequence
  Description of Artificial Sequence: Synthetic coding sequence
atggccttcgccgtgatccgggcccagagccgggtgggcagccgggggctttataagccaagggcatggccacctaggggccggcgacgtcagcagaggcgccgcgcgcccagatccgcagcagagcagagaccaccttcacccgtgccacctgatggttccgctagacctcccgcattgcctcggtccgcagggcctggaccccgcggccccccgcccccgcgctctcgctttggaagccccgcccgccgtgcacccggttgttgtctccccggcggacccggcgctgcagcagctttgggcgaaccgcgcagacccgccgctagaccacgccgacggcgccgcaggcatggacggcaggccagaagagctgacgggcacctgctccagcttccaggcggcgatgcagctttaagggtgcccggccggcgggtgcccgccgcccgcgcagcacgccaggctgcacagggacctggacctgccgctgcagccgctcctgtttccctgcaggatgctgcgggcgatttgaggagagatcctggcggggggggggggggtggggtgccacatggcggcggcgagggccaggaagtggttcctgccgagcccggtgtgccggccccacagcacgctgaacctgtagccgcggccggggcagcacagcagctgcagactgaggagcagcccggactccagcgcctaaggcttggacccgttcgcggggctgcacgcggcggagacgctcgggtgcgtgggccaagaggtgacaggagggtcaatcctgaaagcgcgcgggcccttttgcccggcgacccacagggcccagggactgccgcacctcgggccctgggactccctccccgttgtgagccggtcggggctccgttggccgccctagccctggccagagaacgccgtgagaggggcaggtttcccaggccttgcaagtgcttatttttcaactcttcccagtgtgagctgtgttgcgaatgtgttcggggcggcgccccggccttatctagaaggagggtcgccaccccctgtccatgccccatggtttgtaattccgactttgcccaccggagcaccgtgcctccaagcgcgcacccattcacacttacccctaccctttctctgaacaccttcatcattgtgagacgcggacgctgggacttcggcagatccgccgctgccactgcatctggtggtctgatcttcatcttcgctctccgttggctgaaggctttcatctag

SEQ ID NO: 45073 - DNA, 822 bp, Artificial Sequence
  Description of Artificial Sequence: Synthetic coding sequence
atgctgggccagctgctgccccacaccgcccggggcctgggcgccgccgagatgccgggacaaggcccggggtctgactggacagagagatcgagtagcgctgaaccacctgcagtggcaggtaccgaaggaggcggcggagggtcagcaggctactcctgctaccagaattcaaagggaagcgatcggattaaggatggttacaaggttaacagccacatcgccaagcttcaggagttgtggaaaacaccacagaatcagactattcatcttagcaaaagcatgatggaggcctcttttttcaagcatccagatctaacaaccggccagaaacggtatctgtgttctattgcgaagatctacaatgccaactatctcaaaatgctgatgaaacggcagtatatgcatgtacttcagcactcctcacagaagccaggggtgttgacccaccacaggtcccgactcagctcccgttattcacagaaacagcattatccctgtacgacgtggaggcatcagctggagcgtgaagatagtggatctagcgacattgcagcagcgagcgcacctgagatgcttatacagcacagcctgtggcgcccagtgcgcaataaggaaggaatcaaaactggatatgcttccaaaacaagatgcaaatcgctgaaaatctttcggcgaccaaggaagctgtttatgcagacggttagcagtgatgattccgagagccacatgtcagaggagaagaaggaggaggacctgttgaataatttcatgcagtctatgtccatcgaggaacagggtgagcacctgatgctgacatag

SEQ ID NO: 45074 - DNA, 1812 bp, Artificial Sequence
  Description of Artificial Sequence: Synthetic coding sequence
atggccgccagctgccccctgcccgtgacccccgacctgcccaccttgcgcgccaagctgcagggcctcctgcagttcttacgcgatgcattgtcaatatctaatgctcataccgtggacttctacacagaatcagtgtgggaggagctcgttgacctgccaccagagaccgtgttagccgctctccgcaaatctgctagcgagaccgaagcactcccgtccgaaacacgccccctggttgaagccgagtgggaggctggaatgaccgatttccctaagatcttctgcgaaaccagccagaaattggtgtccgtggaagcgtttgcattggctgcgaagtactactcagtgcagaatctgggaatctgcacaccttttgagcagctattggttgccctgaggggtaaccagaaccaaagaatcggcgagaaccagaaagctgttgagttcatgaacatgaaaaagtcccatgaagtgcaagctatgtctgaactcatcagtagcatcgccgactattatggaatcaaacaagtaattgatttgggttcagggaagggctatctgtcatctttccttagtctgaagtacgggctgaaggtatacggcatcgactcctccaacacgaacacacatggggccgaggagcgtaaccgaaagctgaaaaaacactggaaattatgtcacgcccagtcccggctggacgtgaacggcctcgcccttaagatggctaaagagcgtaaagtccagaataaagtgaagaataaagctgataccgaagaggtcttcaataattcacctactaatcaagaaaagatgccaacatccgccatcctgcccgacttcagtggctctgttatcagcaacatacgcaaccagatggaaaccttgcatagccagccccaccaggaggagaatttgtgtttcgagaatagcttcagtctaataaacctgctgccaatcaatgccgtggaacccacctcttcacagcagattcctaaccgggagacatccgaagctaataaggagcgcagaaagatgacaagtaagagtagcgagtctaatatttatagtcccttgacatccttcattaccgccgattcggaactgcatgacattataaaagacctggaagattgcctgatggtcgggctgcacacatgcggcgatctggccccaaatactttgaggatctttaccagtaatagcgaaatcaaaggggtctgcagcgttggctgttgctatcacctgctctccgaagaattcgaaaaccaacataaagagcgcacgcaagagaaatgggggtttcctatgtgtcattacctcaaagaggaaagatggtgttgcgggagaaacgcccggatgagcgcatgtttggcgctagagcgcgtggccgctgggcaggggttacctacggaatctctgttctatagagcagtgttgcaggacatcatcaaggactgctacggcattaccaaatgcgatagacatgtgggcaagatttactctaagtgtagctcctttctggattatgtgaggcgttctctgaagaagttgggcctcgatgagagcaaactgcccgaaaaaattatcatgaattactatgagaagtacaagcctcgcatgaatgagctggaggcattcaatatgctgaaggtggtgctggccccctgcattgaaactctgatccttctggaccgcctatgctatctcaaggagcaggaggatatcgcttggtccgccctggtgaagctgttcgatcccgtgaagtcaccccggtgctacgcagttatcgctttaaaaaagcaacagtag

SEQ ID NO: 45075 - DNA, 828 bp, Artificial Sequence
  Description of Artificial Sequence: Synthetic coding sequence
atggccttctgcgccctgaccatcgtggccctgtacatcctgagcctgaaagatcaggaccgaagggttccgaatttaccaccctctaacatcacaagtagccaggagcctgcgctcctgcctactgcaagtagctccgcacctaacacatctttggttacaacacctgccagtctgcaagtaccagagatcaccttctgtgagatcctcccctgccaagaaacttactgttgcccaatcaggggcatgaaggaagtgagctcgtcacctgtgcagcgccagtctgaagaaaaagagttccaccaaaggcgctggtccgaggacaaatctaaaagcgtgctcgcccggaatgcgctcagtggtcccgactgggagagtgactggattgacaccaccatatcaagcatccagataatggagatacagcagatcatcgaccaccaatactgcattcaatctctacagtgcggttccgggaattacaactataacatcccagtaaacaagcacacaccaacaaatgtcaaattttccctagaaatcaacacaaccgagccactgattgtctttcagtgcaaattcactctcgggaatatctgtttccacagcaaaaggggcacgaagggcctcgaatctcaccgagagatcagccaggaaatgactcaggggtatcagcacatctggtctttgccagtggctccctttagcgatagcatgttccatttccgcgtggccgcacccgacctggccgattgctctacagacccctattttgccggtatcttttttactgattacttcttttacttctaccggcgctgtgcatag

SEQ ID NO: 45076 - DNA, 978 bp, Artificial Sequence
  Description of Artificial Sequence: Synthetic coding sequence
atgaagcggctgggcagcgtgcagcggaagatgccctgcgtgttcgtcactgaagtaaaggaagagccgtcgtccaagagagagcaccaaccctttaaggtactcgccaccgaaacagtgtcccataaagctttagatgcagatatatatagcgccatccccactgaaaaagttgacggcacatgttgctacgtgacaacatacaaagaccagccctacctctgggcaaggcttgatagaaagcccaacaagcaggctgagaaacgtttcaagaactttctgcattccaaggaaaacccgaaggagtttttctggaacgtagaagaggattttaaacccgctcccgagtgctggatcccggcgaaagagactgagcagattaatggcaatccagtacccgacgaaaatggacacattcccgggtgggtccctgtggagaagaataataaacaatactgttggcattcaagtgtcgttaactatgaatttgaaattgcactggtactcaagcaccaccccgatgattcaggactcttggagatctccgctgtcccactcagtgacctgctggagcagactctcgagctgatcggcacaaacataaacggaaatccttacggcctgggctcaaagaagcacccactccatctgttgatcccgcatggcgcctttcaaatcaggaatctgccttcgcttaaacacaacgatctggtctcttggttcgaagattgcaaggagggtaaaattgagggcatcgtatggcactgctcagatgggtgtttgatcaaagtgcacaggcaccacctgggactctgttggccaattcccgacacgtacatgaattcacgtccagtgattataaacatgaatttaaataaatgcgattcagctttcgacatcaaatgtctctttaaccatttccttaaaattgataatcagaaattcgtgcggttaaaagatatcatctttgatgtgtag

SEQ ID NO: 45077 - DNA, 1359 bp, Artificial Sequence
  Description of Artificial Sequence: Synthetic coding sequence
atgctggcctgcctgcagcggacccagaacgcccccggccagcacctggcctgtccctccaaaagtctcgaacttcgtaagtgcgaagccgttgctagcgcaatgcactcctcccgatacccctcacccgctgaattagacgcatacgccgagaaggtggctaacagcccgctgtctattaagatctttccgactaacatcagagtgccccagcacaagcacctgtctcgcaccgtgaacggttatgacaccagcggccaaagatactccccttacccacaacacaccgcagggtaccagggactcctggcaatagtgaaagccgctgtgtctagctcttccactgccgcacctgctggccccgctaagtctgtgctgaaaagtgcagaaggtaaacgaactaagttgagcccagctgcagtccaggtgggcattgctccctacccagtgccctctaccctggggcccttggcataccccaagccccccgaggccccagcccctcccccgggactccccgccgcagccactgcggcatcagtcatccctctgccaggtcggggtctgccattgcccccttctaacttgccttctattcactctctgctttatcagctgaaccagcagtgtcaggcccctggcgctgctccccccgcgtgccaaggcatggcaattccccacccgtcacccgccaagcatggtcccgttccttcctttccttctatggcctatagcgctgctgcaggcctacctgactgccggaagggaacggagctcggtcaaggggcgacccaggcccttacactggcaggcgccgccaaacccgccggctacgctgacagtggtttggattatctgctctggcctcaaaaaccccctcctccaccccctcagccgctgcgcgcgtactctggtagcactgtcgcctcaaagtcacctgaagcctgtggtgggagggcctacgaaagggcttcagggtccccattgaactgcggcgtaggtctgccaaccagcttcacagtggggcaatatttcgcagccccttggaattctgtgctcgtgaccccaacatccgactgttacaaccctgccgcagcagtagtcgtcactgagctcggcccgggcgccgcgagggaactggccggcccccctgcagacgccctgagtggcctcccaagcaagtcagtgtgcaatacatccgtcctgtccagttccttacagtcattggagtatctgattaacgatattcgccccccatgcataaaagaacagatgctaggtaaagggtacgagacagtagcagtccctaggctgctggaccaccagcacgcccatattcgcctgcctgtttaccggtag

SEQ ID NO: 45078 - DNA, 1359 bp, Artificial Sequence
  Description of Artificial Sequence: Synthetic coding sequence
atgctggcctgcctgcagcggacccagaacgcccccggccagcacctggcctgccctagtaagagcctggaacttcgtaagtgcgaggccgtggctagtgcaatgcactcatcccggtaccctagcccggcagagctggatgcctatgcggaaaaggtggccaattctcctctgagtatcaaaatcttcccaaccaacatccgcgtgccccagcacaagcatctctcacggaccgtgaacgggtacgacaccagcggccagcgctacagtccatacccacagcacaccgctggctatcagggactgttggctatcgtgaaagcagctgtgtcttctagtagcaccgctgctcccgcaggccccgccaagtcggtgctcaaatctgccgaaggcaaacgcaccaaattgtctcccgccgccgtccaggtaggaattgccccttaccccgttcccagtaccctggggcccctggcatatcccaagcctcccgaagcaccggcccctccacctggcttaccagctgccgcaacggctgcctccgtgatccctttaccaggaaggggcctccccctgcccccctccaacctaccctcaatccacagcctgttataccagttaaatcagcagtgccaggccccaggtgccgctccccccgcctgtcaaggtatggccatcccccacccctcaccagcaaaacatgggcccgtgccttcctttccctcaatggcttacagcgcagccgccggcctccctgattgcaggaaaggcacagagctcgggcaaggcgctactcaggcactaacactcgccggcgctgctaagccagccggctatgctgatagtggactggactatctcctgtggcctcagaaaccccctcccccgccccctcaacctttaagagcgtatagtggctcaacagtagcatccaagagcccggaagcctgcggtggtcgcgcatatgagagggcctctggctctcccttgaattgtggcgtggggctgccaactagctttaccgtcggccaatacttcgctgccccatggaactcagttctggttactccaaccagcgactgttataacccagcagctgcagtcgtcgttaccgagctgggtcccggggccgcaagagaactcgccgggccgccagccgacgccctgagcggcctgccgagcaaatccgtttgcaacacctctgtattgagttcctcattacagtcactggaatatctgattaacgatatcagacctccttgcattaaagagcaaatgttagggaaaggctatgagaccgtggccgtccctcgactcctggaccatcaacacgctcatatcagattgccggtatatcggtag

SEQ ID NO: 45079 - DNA, 5244 bp, Artificial Sequence
  Description of Artificial Sequence: Synthetic coding sequence
atgaactggaacgagaagcccaagagcgccaccctgccccccctgtacccgaaaagccagcctcctttccttcatcagtcgttgataaatcagataaccactacctcccagtcaagcttcagctaccccggcagcaaccaggaggcctgcatgtatccaggaaattctaatcccatctcccagccactcttaaacattcagaattaccctcagcaaatttcggtctccgatatgcataatgggacggttgtggcgagccacactagcgtcgagcggatcacctacgccaacgtgaacggacctaagcagttgactcataacctgcagatgtcctccggtgtgacgcaaaacgtatggttaaacagccctatgagaaatccagtacactcccacatcggagccacagtgagtcaccagacggatttcggggccaatgtgccaaatatgcctgccttacagtctcaactaattacaagtgatacttattctatgcagatgcaaatgatcccatccaattccactcgcctcccagtagcatatcaggggaatcagggcctcaatcaatccttttcggagcagcaggtggattggacccagcagtgtatctccaaaggtctcacctaccccgactatcggccaccccctaagttgtacagatactcccctcaatcctttttacccgactccaccatccaaaagcagaatttcatcccgcacacaagcttacaggttaagaactcccagctcctcaacagtgtactgaccttaccatcacggcagacctctgcagtgccatctcagcagtatgccacacagacagataagaggccccccccccctccgtacaactgcagatatggatcccaaccgctacagagcacccagcatataactaaacatctgtccatggaggtgccccagtctcgagagatgctgagcagcgagatcagaacctccttccaacagcagtggcaaaatccgaacgaaaacgttagcacaatcgggaactttacaaatctcaaagtgaataccaatagcaagcagcctttcaacagcccaattagatcttccgtagatggcgtgcaaacactggcccagactaacgaggagaagatcatggatagctgcaaccctacatccaaccaggttctggacacatctgtggctaaggagaagctggttcgggacattaaaacgctcgtcgagattaagcaaaaattctctgaactcgctcggaagattaaaatcaacaaggacctgctgatggcggcgggatgcatcaaaatgactaatacctcgtatagcgagcccgcccagaactctaaattgtccctcaaacaaactgctaaaatacagagtggtccccagataacaccagttatgcccgagaacgctgagcgccaaacccccaccgttgttgagagtgccgagactaataaaacacaatgcatgctcaattccgacatccaggaggttaactgtcgacgctttaaccaggtagacagcgtgcttcctaaccccgtatactcggagaaacgcccaatgcctgactctagccacgacgtaaaggtcctcacttctaaaacctcagccgtggagatgacccaagcagtcttgaacacgcaactcagctccgagaacgtaactaaggttgagcagaactctcctgccgtctgcgagactatatccgttccaaagtccatgagtacagaggagtataagtccaagatccaaaatgaaaacatgcttctgttggctctcctgtcgcaggctcgtaagactcagaaaactgtactgaaggatgccaatcagacaatacaggatagcaaaccagacagttgtgagatgaaccctaatacgcagatgacaggcaaccaactgaacctgaagaacatggaaacaccaagcacgagtaatgtaagtggtagggttttggataactcattttgttcggggcaggagtcctcgaccaaaggaatgcccgcaaagtcagatagctcatgctccatggaggttctggccacttgcctcagcttgtggaagaagcaacccagcgatacagccaaagaaaaggaatgtgataaactcaggactaatacaaccgccgtaggcatatctaaaccagctaatatccatgtgaagtctccgtgtagcgtagtgggcaacagtaacagtcagaataaaatctcaaatccttctcagcaaacagctctgtcaatggtaatgcacaactacgaatcaagcggaatcaacataacaaagggcacagagctgcaaatcgcggtagtatcccctctcgtcctcagcgaggtgaaaacgttgagcgtgaaaggaatcacaccagctgtcctaccagagaccgtatatccagtgattaaagagggctcagtatgtagtctccagaatcagctcgctgaaaatgctaaagcaaccgcagctctgaaggtcgacgtgtctggacctgtcgcttcaaccgccacttcaaccaagatattccccctgacccaaaaagagaagcaaaatgagagcacaaacggtaactctgaagtcacccctaatgtgaatcagggcaaacacaacaagttagagtccgccattcacagccccatgaatgaccagcagatctcccaggaaagtaggaattccacagtggttagttcagatacactgcagatagataacatctgctccctggtggagggcgacacatcttataattctcaaattgcaaaaatcttttccagcttgccactcaaaatggtagagccccagaagccctccctgccaaatcagcaggggattgggagccgagaacccgaaaagcaattggacaacaccacggagaataaggatttcggatttcagaaggataaacctgtccagtgtactgatgtctctcataaaatctgtgatcagtcaaaaagcgaaccccccctggaatcctcattcaacaatctggagactaacagggttatcctcgaaaagtcctctctggagcatgcaacggaaaaaagcaccgctaatgacacttgcagttcggcagcaatccaggaagacatatacccacaagaaatcgacgcctcttccaattacactccacaagaccctgcgcgaaatgagattcacagcgataaggcaccagtcttgtacctccacgatcagttgagcgagctgctcaaggaattcccatatggaatcgaagcagtgaacacaagagaggggagcgttggccaacagaccacctaccaaactagtgaggaccagactgctgataagacaagctcagactcaaaagaccctgccgaccagatacagataaccatactcagctctgagcagatgaaagagatatttcccgagcaagatgaccaaccttacgtagtggataaactcgccgagccccagaaggaggaacccataacagaggtcgttagtcaatgtgacttgcaggcgcctgctgccggacagagccgagattcagtgattctggattccgagaaagatgatattcattgttgtgcactaggatggctgagtatggtgtacgaaggcgtaccacagtgccagtgcaactcgatcaagaacagtagctctgaagaggagaaacaaaaagaacagtgctctcccttggacaccaactcctgtaaacaaggggaaagaacatccgacagagacgtgactgtagtgcagtttaaatcacttgttaacaatcctaagacaccacctgatggaaagtcacactttcccgaactgcaggatgactcacgcaaagacactcctaagactaaacacaaatcacttcctcgaacagagcaagaactcgtggccggacagttctcctccaaatgcgataagcttaacccactgcagaaccacaagcgaaagaaattacgctttcatgaagtgacattccacagcagtaacaagatgacagcctcttacgagcaagcctcccaggagactaggcagaagaaacatgtaacccaaaatagccggccgctgaaaacaaaaacggccttcctaccaaataaggatgtctacaagaagcacagtagtctgggccagtctttaagtccagaaaagattaagttaaaattgaagtctgtttcattcaaacagaaacgaaagctggatcaggggaacgtactggacatggaggtcaaaaagaaaaaacacgacaagcaagaacagaagggctccgttggcgccacgttcaaattgggcgatagcctgagtaatcccaacgagcgagctatagtgaaagaaaagatggtctctaacaccaaaagtgtcgacacgaaagccagctccagcaagttcagtagaatcctgaccccaaaagaatacttacagagacagaagcataaggaagccctctcaaataaagcaagcaaaaagatctgcgtcaagaatgtcccctgcgacagtgagcatatgaggccaagcaagctggctgtgcaggtggaatcttgtggaaaaagcaatgaaaaacactcctccggcgtacagactagtaaggaatctttaaacgggcttacaagccacgggaagaatcttaaaatacatcattcgcaagagagcaagacatataacatcctcaggaacgtcaaagagaaggtgggaggcaagcagcccgacaagatttggatcgacaagaccaagttggataaattgacgaatattagtaatgaagcgcagttctcgcaaatgccaccccaggtaaaggatcagaagaagctgtatttaaaccgggtcggcttcaagtgcacagagagagagtcaatctctctaaccaagctggaaagcagtccgcgaaagctgcataaagataagcggcaggaaaacaaacacaaaaccttcctgccagtcaaaggcaataccgagaagtccaacatgctggaatttaagttgtgcccagatattctcctcaaaaacacaaattctgtggaagagcggaaggacgtgaagcctcaccctcggaaagagcaagcacctcttcaggtatcaggcatcaagtccactaaggaggactggctgaaattcgtggcaaccaagaagcggacacagaaagactctcaggaacgcgataacgtcaacagtcgtctctccaaacgctcgttctcagccgatgggttcgagatgttacagaatccggtgaaagatagcaaagagatgtttcagacctacaagcagatgtacctggaaaaacggagtcggagcctggggagcagtcctgttaagtag

SEQ ID NO: 45080 - DNA, 2028 bp, Artificial Sequence
  Description of Artificial Sequence: Synthetic coding sequence
atgaactggaacgagaagcccaagagcgccaccctgccccccctgtatcccaagtctcagcctcccttcctacaccagtctctgatcaatcaaatcaccaccacttcccagagctccttctcttatcctggctccaaccaggaggcttgcatgtacccaggaaattccaatcccattagccagcctctgcttaacattcagaactacccccaacagatatccgtcagcgatatgcacaacgggactgtggtggcttcacacacctccgtggaaaggataacctacgctaacgttaacggacccaaacagctcacgcataacttgcaaatgtcgtccggtgtgactcagaatgtttggcttaattcacccatgagaaacccggtgcattcccacatcggtgcaaccgttagccaccagacagacttcggagccaatgtgccaaatatgcctgccctgcagagccagctgataacctctgatacgtacagcatgcaaatgcaaatgattcctagtaatagcactcggcttccggtcgcttatcagggtaatcaaggcttgaatcaaagttttagcgaacagcaggtggactggactcagcagtgtatttccaaaggactgacctaccccgattatcggccacctcctaaactgtatagatattcaccacagtcctttcttcctgatagcaccatccagaaacaaaatttcatcccacacacatctctgcaggtgaaaaacagccagctgctcaactcagtgctgacactgccctcccgccaaacctcagccgtcccatcgcagcagtacgccacacaaaccgataagcgtcctccccctcccccatacaactgcaggtacggtagccaacccctgcagtctacccagcacattaccaagcacctgtctatggaggtgccccagagtcgcgaaatgctgtccagcgaaattcgtacttcttttcaacagcagtggcagaaccctaacgagaacgtcagcaccatcgggaatttcaccaatctgaaagtaaacactaactctaaacaaccctttaattcccccataaggtcttcggtggacggcgtgcaaacactggctcaaaccaatgaggagaaaatcatggacagctgcaatcccacgtctaaccaggtgcttgatacttcagttgctaaggaaaaactcgtgagggacattaaaacgctggttgagattaagcaaaagtttagcgagctagcccgtaaaattaagattaataaggatctgttgatggctgcaggatgtattaaaatgacgaatacttcctatagtgaacctgctcagaattccaagctctcactcaagcaaacggccaagattcaatctggtccacaaataacccccgtcatgccggaaaacgcggaacgacagacccctacagttgtcgaatccgccgaaaccaacaaaacacaatgcatgctcaattcagacattcaagaggtgaactgcagacgcttcaaccaggtggactcagttctgcccaatcctgtgtattccgagaagcgccccatgccggacagctctcatgatgtgaaggtcttgacatcaaaaacttccgccgttgaaatgactcaggctgttctgaatacccagctgtctagcgagaacgtgacgaaggtggaacaaaactcccccgctgtatgcgaaacgattagtgtgcctaagagtatgtctactgaagagtataaatctaagattcagaatgaaaatatgcttttattagcccttctgagtcaagcaagaaaaactcaaaagacagtcttgaaagacgccaaccagacgatccaggactcgaaaccagacagctgcgagatgaacccaaacacccaaatgactggcaatcagttaaatctgaagaatatggaaacaccaagcaccagtaacgtgtctggacgggtgttggataacagtttttgctctgggcaagagtcctcaaccaaagggatgcctgctaagtctgacagcagctgcagcatggaagtgttggctacatag

SEQ ID NO: 45081 - DNA, 108 bp, Artificial Sequence
  Description of Artificial Sequence: Synthetic coding sequence
atgaactggaacgagaagcccaagagcgccaccctgccccccctgtatcccaagtctcaaccccctttcctccaccaatctctgattaaccaaatcaccacaacctag

SEQ ID NO: 45082 - DNA, 417 bp, Artificial Sequence
  Description of Artificial Sequence: Synthetic coding sequence
atggagcggttcctgaacagcaaggcccggcggctgggcagctgcagtcacccagcgttctatctcctgtgcgtaccagatgaagatacctcttgttcaacaatttacctccctctcaagagacgagccgatcccgaccagctgttttccgacctgcttggaggcacccagcgcctgtggtcaaataggttcggcaacgaggagagcttccctggcagggtgcgggccctggtggatacattctgttggatcgcacgcgcgccacccctaggaaatccccttagactggaagagcggatcgcctggcgcattcagagacttaaatccggtcagacagccctcatcgagaaaaaaaagcaaaaaattgaggaagatgtgcggcatcagtgtcagcaaacaacgtgcgaccgctgttag

SEQ ID NO: 45083 - DNA, 417 bp, Artificial Sequence
  Description of Artificial Sequence: Synthetic coding sequence
atggagcggttcctgaacagcaaggcccggcggctgggcagctgctctcaccctgccttttacttactttgcgttcccgacgaagacacatcttgcagtaccatctacttgccccttaaaaggagggccgatccagatcagttgttcagcgatctattgggcggaactcagcggctttggagcaaccgcttcggtaatgaagagtctttcccgggccgggtaagggccctggtggataccttttgctggatagctcgggctcctcctctgggtaatccgctccgattggaggaaagaattgcctggcgcatccagcggctaaaaagcggtcagacagctctcatcgaaaaaaagaaacagaaaatcgaagaggatgtcaggcaccagtgccagcaaaccacatgcgaccgctgctag

SEQ ID NO: 45084 - DNA, 1659 bp, Artificial Sequence
  Description of Artificial Sequence: Synthetic coding sequence
atgaagaagaaccgggagcggttctgcaaccgggagcgggagttcgtgtataaatttaaagttgggagccagtgcttggagttgcgggttccactgaagttccctgtgcaggagaacgccagccatctgcatggcagacttatgctactacactccctgccctgttttatcgagaaagacctgaaggaagcgttgacacaattcattgaggaggaaagtttatctgactacgacagggatgccgaagcgagcctggctgcagtgaagtccggcgaagtcgatctccaccagctggcctcgacttgggccaaagcatacgcagagaccaccctcgaacatgctcgcccggaggagccctcttgggacgaagattttgcagacgtgtaccacgacctaatccattctcccgcctcagaaaccctgctcaacttagaacataactatttcgtctcaatctctgaacttataggcgagagagacgttgagttgaagaagttgcgcgaaaggcagggcatagagatggaaaaagtcatgcaggagcttgggaagtctctgaccgaccaggacgtcaacagcttagccgcccagcacttcgagagccagcaggatcttgaaaacaagtggagtaatgagttgaaacaatctacagcaattcaaaaacaagagtaccaggaatgggtcattaaactgcaccaggacctgaaaaatccaaataattcttctttgagcgaagaaattaaggtgcaaccaagccagtttagagagagcgtggaggctattggccggatttatgaagaacagcgtaaattggaagaaagttttaccatccatttgggcgcccagctgaaaacgatgcacaacctccgtctgctgcgagctgatatgctggacttctgcaaacacaagaggaatcaccgctccggcgttaaacttcatagactacagaccgcactctcgctctatagtacatcactgtgtggcctggtactgctggtcgacaaccggattaacagttattctggtattaagagggactttgcaaccgtgtgccaggaatgcaccgacttccactttcctcgcattgaggaacaattagaggtggtgcagcaggttgtgctctacgcccgaacccagcgcaggagtaaactaaaggagtcattggattccgggaaccagaatgggggcaacgatgacaaaacaaaaaacgccgagcggaattacttaaatgtgttgcctggagagttctacatcaccaggcattcaaatctcagcgagatccacgttgcatttcacctgtgtgtcgacgatcacgtgaaatcaggcaatattacggcccgtgaccccgccatcatgggcctccgaaatattcttaaggtctgctgtacccatgacataacaaccatcagcataccccttttactggtgcacgacatgtcggaagagatgacaatcccctggtgtctgaggagagcggagctggtttttaagtgcgtgaaaggctttatgatggaaatggcaagctgggatggcggcattagccgaactgttcaattcctggtaccccaatccatttcggaggagatgttttaccaactgagcaacatgctgccccagatcttccgggtgagttctactctcaccctgaccagtaaacattag

SEQ ID NO: 45085 - DNA, 1659 bp, Artificial Sequence
  Description of Artificial Sequence: Synthetic coding sequence
atgaagaagaaccgggagcggttctgcaaccgggagcgggagttcgtctacaaattcaaggtggggagtcagtgtctggaactcagagtgcctctcaaatttcctgtgcaggagaacgctagccatctgcatggaagactcatgctactgcacagcctcccttgcttcatcgaaaaggacctgaaagaagccttgacacagtttatagaggaagagtctctatctgattatgaccgagatgctgaagcctcccttgccgctgtgaaatcaggcgaagttgacctgcatcagctggcttccacttgggcgaaggcatatgcagaaacaactctcgagcatgccaggcctgaggagccctcctgggatgaagatttcgcagatgtatatcacgatctgattcacagtcccgccagtgagacacttctgaaccttgagcataattattttgtgtctatctctgaattgattggagagcgcgacgtagagctaaagaagctacgagaacgacaaggcattgaaatggagaaggtcatgcaggagctgggcaaatcgcttacggaccaggacgtgaattcactcgccgcccagcatttcgagagccagcaggatcttgaaaataagtggagcaatgagttaaaacaaagcacagcgattcagaaacaggagtaccaagagtgggtgattaagctgcaccaagacctgaagaaccccaataatagctcgctcagcgaagaaataaaggtgcagccaagccagtttagggagtctgttgaagcaatcgggcgaatctatgaagagcagaggaaacttgaagagtccttcacgatccacctaggcgcgcagctgaagacaatgcataatctgcgattgttaagagccgatatgctggatttctgcaaacataagcggaaccatcggagtggcgttaaactgcaccgtctgcagacagccctctctctttactctacgagtctgtgcggcctggtgctacttgtggacaaccggatcaatagttacagcggcatcaaacgggactttgcaactgtgtgtcaggaatgcactgactttcactttcccaggattgaggaacaactcgaagtggttcagcaagtggtgctttacgcccggactcaaaggcgatcaaagctcaaagaaagcctggattccggcaatcagaatggaggcaacgacgacaagactaagaacgcagagcgaaactacctcaacgtgctaccaggtgagttttacattacacggcattccaatctatcagagatccacgtggccttccacctgtgcgtggacgaccacgtaaagtccggaaacatcaccgcccgggatccagctatcatgggcctccgtaacatcctgaaggtgtgctgcacccatgatattactacaatctccataccgttgctgctcgtgcacgacatgagtgaagagatgaccatcccttggtgtcttagaagggcggagctggtgttcaagtgtgtgaagggcttcatgatggagatggcatcatgggatgggggcatttctaggaccgtccagttcctggtgccacaaagcatatccgaagaaatgttctaccagttatccaacatgctgccccagatctttcgggtgtcaagcaccctcaccctcaccagcaaacactag

SEQ ID NO: 45086 - DNA, 1959 bp, Artificial Sequence
  Description of Artificial Sequence: Synthetic coding sequence
atgaactgggtgggcggcagccggagccgggtgctgatcaagcaggaacgtcgcaagcagaaagaatatttcgagaagcatagattaaagtcaaagatgaaatccctgggggtgctgagtcctgtcaaaaacagcgccgtttccctagacattctgaatttatacatggtcaatcaaatttcctgtaagaaaaagattcctgaaaccgtccggaaacctacccacgtcaatatgaaccgggatattaagatgcccctgagaaagcataacctggaacttactatgagcccacattgtgtcccatccaaactgtgtctggacgatacagagaccaatgtaaattgccaacgtctttctagtaaggaagatcttggtcctgtgcagagccaaggcatggacagctactcaatgctgcacccgcagtttagcaaaattgaaaactgttcttttactccctcttccttctccgtcgagcttccaagcaatagacacatctccaaattaaatttcacaagcggtatcgcgccaactcctcagaagcttgcttatgagaaaaaacagaatgatcagaggtccaccgttaactgtagcgacagtctactgtcaaaactgaacaaatctcaggatgtcttctctccttcccataagaccacccgcttcggcactctttttgagcgcttaaattcactggggaaccggaatctccttaccaaatcgcctgccgtcatcatggacgaggactgtaggtctaccgacgaaattcgacagtccgattatattaccgaaaaacacagcatccagcatatctgggggaaaaacggcaaggaagtttccaatttcctcgaggacgtgaatcagagcactcccaacctgctgtctgaaaactgtgattccttcgtgtctcaaaatatgatcaacgtgctaaatatcgatgaacagaggatcaaaaaaaccttcaacaagtgtgattacgattccatgggggacacttgcgtggtcacatcctccgataaaaaccatgtcactgaccgctgtatccgaaacatctttacggtgcctgagctgacattcagcaattccacacttaacaaaacgtcatatcccgagaaatgccagcccaacaagaaataccaacgggagtataacaagaacgaaagaaacgacttatccacctcttttgagaatgattattacccgtcaagcagcgagcggaaggaaaagttcgagaatgactaccaagaaaaaactccccagaaatccattcagaagtatccggccaattctatgggcaatatcccaagtgaagagctacattcaaaacaatcatgggatttcggcctggacgagatactgatggaggagggaggcatttatagcctgaaatctaagcgcatctctaccaaaaagatttcgctggactcggctcagagttcacggtctaccagctactcaccgcgccccaccgattcgtgcttttcctcatctagcgacctccccagtgaagacgaggaccagataagccagcagattgaagacagtaaccgcatgacgataaagaccaaagaaaaaatgaataacttctatgtggaaaggatggccaagttgtctggggaccgcatcgtcaagaatgacgataaaatccacaaacagaatgagaatttctaccaattttcggtcaagaataataccgaccagtttccgcagctgcagtgcaattctgcgcatatcctgcagaataagaccaacgacaactgtgtgctgcaggctgcccgttgcgacgccggaattcaaactgagtccgaatctgtgatggaggaaaagctggacgtggccatccagtgcgacttaatctcgaagtgtacctgccgcagcgatgtcagcctgtgcaacctggaaaggtgttctggaaatatcaaagccgacacaacaggtggtcaggagattcataagaacaactag

SEQ ID NO: 45087 - DNA, 1185 bp, Artificial Sequence
  Description of Artificial Sequence: Synthetic coding sequence
atgaaccgggacatcaagatgcccctgcggaagcacaacctggagctgaccatgtccccccattgcgtgccaagtaaactttgtcttgacgacactgagacgaacgtgaactgtcagaggttgagttccaaggaggacttgggccctgttcaaagtcagggaatggactcctatagtatgctccatcctcagttctcaaaaatcgagaactgttcattcacgcccagcagtttctcagtggaactccccagtaacaggcatatttctaagctgaacttcacctcaggcattgcccctacaccccagaaattggcatacgaaaagaaacagaatgaccagcggagtactgtgaattgcagcgatagcctgctgagcaaattgaacaaatcacaggacgtcttttcaccttcccacaagaccactcggttcggaaccctgtttgagcggctcaactcattaggaaaccgcaacctactgacaaagtcccccgcagtgataatggacgaagactgcagatcaactgatgagatacgccagtcagattacatcaccgagaaacattccattcagcatatatggggcaagaacggaaaggaggtcagtaactttctggaggatgtgaatcaatccaccccgaacctgctcagtgaaaattgtgattcgtttgtctcacagaacatgattaatgtactgaacattgatgagcagcggattaagaagacatttaataagtgtgactacgattccatgggagatacatgcgtagtcacctcgtctgataagaaccatgtcacagatcggtgtatccgaaatattttcactgtccctgagctcacatttagcaactccactttgaacaaaacgagctatcccgaaaaatgccagcccaataagaagtaccaacgcgagtataataagaatgaacgaaacgacctcagtacgtcgttcgaaaatgattactacccatcaagctctgagcgtaaggagaagttcgagaatgactaccaagaaaaaacaccacaaaaaagtattcagaaatacccagcaaatagtatttggtgtacaaagtgcagcgagtttaaggtcatttttactctcatccactacgtgctcatgttaaatctgttcttgaaatccctgaggactgcattccaagcatttctcaataacgatctgcagttgtag

SEQ ID NO: 45088 - DNA, 324 bp, Artificial Sequence
  Description of Artificial Sequence: Synthetic coding sequence
atgagcaccgtgatctgcatgaagcagcgggaggaggagttcctgttgacaatcagaccatttgccaataggatgcaaaaatccccctgttatatcccgatcgtgtcctcggctactttgtgggataggtctactccttcagctaaacatattccttgttacgagaggacctctgtgccatgctcccgttttatcaatcatatgaaaaacttcagtgaatcccctaagttcaggtctctgcattttctgaacttccctggctcacaccacggccaggccactcaaaagttacaaggggcaatggtgctgcacctcgaggaatag

SEQ ID NO: 45089 - DNA, 1083 bp, Artificial Sequence
  Description of Artificial Sequence: Synthetic coding sequence
atgagcaccgtgatctgcatgaagcagcgggaggaggagttcctgcttacaattagaccattcgctaaccgcatgcagaaaagcccctgctacatacctatcgtcagcagcgccaccctctgggaccggtctacgccctcagcaaaacacatcccttgctacgaaagaacctcagtgccatgttcacggtttatcaaccatatgaaaaattttagtgagagtcccaaattccgcagccttcacttcctgaatttccccgttttccctgagcgcacacaaaacagcatggcatgtaagaggctcctgcatacctgccagtacatagtgccccggtgttccgttagcacagtttcattcgatgaagaaagttatgaagagttccgctcatcaccagccccaagctctgagactgacgaggccccgctaatatttacagcccgtggagaaaccgaggagagggctagaggtgcaccaaaacaggcatggaattcttcctttctcgaacagctggtgaaaaagccaaattgggctcatagcgtgaatcccgttcatttagaggctcagggtatccacatcagtcgccatacacgaccaaaaggacagcccttgtcctctccgaaaaagaactcgggttctgcagcacgacctagcacggccataggcttgtgccgaaggagtcagactcctggggccctgcagtcaaccggaccctccaataccgaattggagccagaggaacgcatggcagtaccggccggtgctcaggctcacccggatgacattcagtctcgcctcttgggtgcgtccgggaaccctgtgggtaaaggagcggtcgccatggcgcctgaaatgttgccgaaacatcctcacacccccagggatcgccggccccaggctgacacttccttgcatggcaacctcgccggcgctcctctgcctctgctggcaggagcgagtacacattttccttccaagcgactcatcaaagtctgttccagcgccccgccccgccccactcgtaggtttcacaccgtctgcagccaggcccttagcagaccagtagtgaacgcccatttacactag

SEQ ID NO: 45090 - DNA, 1083 bp, Artificial Sequence
  Description of Artificial Sequence: Synthetic coding sequence
atgagcaccgtgatctgcatgaagcagcgggaggaggagttcctgcttactattaggccctttgccaatagaatgcaaaaaagtccttgttacattcctatcgtgagctctgcaactctgtgggatcgctcaaccccctcagcaaagcacattccttgctatgagaggacaagtgtgccttgttctcggttcatcaaccacatgaaaaactttagcgaaagccctaagtttaggtcactccatttcttgaacttcccggtgtttcctgagcggacccagaattccatggcttgcaagcgcctcctgcatacctgccagtatatcgttcctaggtgcagcgtgagcaccgtgagcttcgacgaagaatcatacgaagaatttaggtcttcgcccgctccaagtagcgagaccgatgaagcgccgctcattttcacggctcggggtgaaacggaggaacgtgcgcgaggcgccccaaagcaagcctggaattcttctttcctggagcagctggtgaaaaaacctaactgggcacactctgtgaacccagtgcatctggaagcccaggggatacacatatcacggcacactaggcccaagggccaaccactgtctagcccaaagaagaactccggctctgctgctcgtcctagcactgccataggtttatgccgcaggagtcagacccccggtgcactccaatccacgggccctagcaatacagagctggaaccagaagagaggatggccgtgcctgctggcgcccaggcacacccggacgatattcagtcgagactgctgggtgccagtggaaatccagtcggtaaaggtgcagtggctatggcgccagagatgctacccaaacacccccatacccctcgcgatcgccgcccacaggccgataccagcctgcatggcaatctggctggagcccctttgccactcctggccggcgccagtactcactttccttccaaaaggctgattaaggtgtgttcttcagcacctccaagacctaccagacgatttcacacagtgtgttcccaagccctgtccagacccgtagtcaacgcccatctgcactag

SEQ ID NO: 45091 - DNA, 624 bp, Artificial Sequence
  Description of Artificial Sequence: Synthetic coding sequence
atgagcaccgtgatctgcatgaagcagcgggaggaggagttcctgctcacaattcggcccttcgccaatcggatgcagaagagcccctgctatattcccatcgtgagctctgcaaccctatgggaccggtctacccctagcgctaagcatattccctgttatgagcgcaccagtgtgccctgctctcgatttataaaccacatgaagaacttctctgagtctcctaagttcaggagcctgcacttcctcaatttcccagtgttcccagaacggacccaaaattctatggcctgcaagcggctactccacacctgtcagtacatagtgcccaggtgttctgtgtctacagtaagctttgacgaagagagctacgaggaattccgctctagccctgcccccagttccgagaccgacgaagcgcctttaattttcacggctaggggcgaaaccgaggaaagggcgcgcggcgccccaaagcaggcttggaactcatcattcttagaacagctcgtgaagaagccaaattgggctcactccgtgaaccccgtccaccttgaggcccagggaatccatattagcaggcacacccgcccaaagggtcaacccctgtcttcacctaagtag

SEQ ID NO: 45092 - DNA, 558 bp, Artificial Sequence
  Description of Artificial Sequence: Synthetic coding sequence
atggaggtgcacggcaagcccaaggccagccccagctgcagcagcccgacacgcgactctagtggtgtgccagtttcaaaagaactgctcacagcgggtagcgacggccggggcggcatatgggacagactgctcatcaattcacagcccaaaagtagaaagacctccaccttgcagaccgttagaatcgaaaggtcccctctgcttgaccaagtgcagacgttcctgccacaaatggcgagagctaacgagaagctgaggaaggaaatggccgcggcacccccaggccgcttcaacatcgaaaacatcgatggcccgcactcaaaagttatccagatggatgtcgccctgtttgagatgaatcaatcggacagcaaagaggtggactcctctgaagaaagcagtcaggattcaagcgaaaatagttctgagagcgaagacgaagacgatagcatcccaagtgaggtgactatcgataatatcaagctgcccaactctgaggggggcaagggaaagatcgaggtgctggattcacctgcatccaaaaaaaagaagtag

SEQ ID NO: 45093 - DNA, 1245 bp, Artificial Sequence
  Description of Artificial Sequence: Synthetic coding sequence
atggagatgcagcagaactgcagcatcagctgcttctgggagacccagccgctgggttgtgtcaaaataagctgcatcttctatcattcaaaaccaaggaatataaatggcctttttttacccccctcgtccaatatcacccttcaaaaggaaatccaggagggcattccactgcagtcgcagtcacaggagcctctgaagccccaggagaacatctcacgccccattcatcacccattggtactgaagacgaatttcgaagaggaggaggaagtagatgagcagaatgatgcctcttctctgtggactaagaccccagaggagatcgaggaaaagagggcaatcaaagagatgtgttacaagtctggagaatattatagattccacactccccctgatattctgtctagtaagtcaatgactcctacggctgagaagcagctcgagaagccactcgaaaatgggagcgaactgcaggaaggcgactcccttacagtgccaactaagctttctcagtatgaaagacagggggaaattaagacatcactgcacggaaaacccaagaccgacatcgcagcgtttgagaatggaggtggcgactgctacgttccacaaagggtcatttttttgggggtggatgagtccgaggctctcaccgaagagaaggaaatcacaatttcaaaatgctccaataccaaagacaacaaggacagcccccaccccaaacatagcctaacaacaaggctggtgcccacaactcatgtgttgaacgctacagaaaacatttccatgaagtgtagggaggacccaagcagtatgaacgatgtgcagcctgtgaaaaaaccacacttcaagggtgtgaagaagagaaaatggatttatgatgaaccccagaactttccaaatagtgggatgcagagggctgtgcaagcgccaaggccccagaacaagatgtcctatcataggaataacaagaaccggaacgcagaaaacgcatcatacatacatgtgcagcgcgatgctgtccgcaccgtggctttaaacgccccttcccgtagtaggccaacccacggatcttacaacaaggtacatgcgaacagggagcccaaacctaacctgtcccccgataaatacacctcaacctcctacaatgactcagcttggagaaagcgaatccctttttctaagacctattcgaagagcgaaaagatttaccccgaacctaggagaaacgggtctaagtag

SEQ ID NO: 45094 - DNA, 294 bp, Artificial Sequence
  Description of Artificial Sequence: Synthetic coding sequence
atggagatgcagcagaactgcagcatcagctgcttctgggagacccaacccttggggtgtgttaaaatctcgtgtattttttaccatagcaaacccagaaatataaacgggctgttccttcccccttcttctaacataacgcttcaaaaagagattcaagaaggaatcccactgcagagccaatcacaggaacccctgaagccccaagaaaatatatccagaccaattcatcaccctctggtgctgaaaactaactttgaagaggaggaagaggtcgatgagcagaacggttag

SEQ ID NO: 45095 - DNA, 384 bp, Artificial Sequence
  Description of Artificial Sequence: Synthetic coding sequence
atggcccagcacccctgccaggaccaggagcagaaggtggagatgacttccaagcaacagcgaagcacctcgatcgaagagacgatgaggccccaggaaaagcaggtgaccataaccgagacattatgggaccaagtgctgactgtgttcaaggatatccagaaggagctgcaagaagacgcccgaatcagggggatgtcgaactgcagcatgacaccaatgaccagcgcacccagaacaggaagcatccggccacctgattcactgatgacacccaagctccgccgtctacaattctcctcaggcgagcagccatcagggggaagaatccacaatttgaaaacccagctctttagtcagtctgcctactacccaggaccctag

SEQ ID NO: 45096 - DNA, 384 bp, Artificial Sequence
  Description of Artificial Sequence: Synthetic coding sequence
atggcccagcacccctgccaggaccaggagcagaaggtggagatgacttctaagcaacagcggagcacctccattgaggagaccatgaggccacaggagaaacaagtcacaattaccgaaactttatgggatcaagtactaacggtctttaaagatatacagaaagagcttcaggaggatgctcgcatccgaggaatgtctaactgttcgatgacccctatgacaagcgctcctcggaccggctctattaggccaccggactccctcatgacgcccaaattacgccgattgcaattcagctcgggggaacaaccatccggcggacggattcataacctcaagacccagctgtttagccaatctgcatattaccctgggccctag

SEQ ID NO: 45097 - DNA, 1389 bp, Artificial Sequence
  Description of Artificial Sequence: Synthetic coding sequence
atggccagccccctgcccagcggcttccccgcccggcggaacagccgcctggatgtgtttctgaggcgacaccttcctcccgaagtctacgacgccgtgagggcgtacgagccatgcatcgtggtgtctaactccgagaaccatatcctgaaatacgtggtgctgtctgaccgactggtgtacctgacagaaaacccacctaaatccatacggagggtcgtagccctgagggacgtggttgcaatcgacctgatagacgactatccagagtttttgagcagccctgacagggagatttcacagcacatcagaatcatatatagctcaactgtcttaaagaaggaatgtaagaaatccaattctgtacgaaagttcctgtttccctttcaccacaccaaagctaacaacaagaaggtgaaagaagaaaaaaacgggctcgccttctggaggtctaaggagtccaggtccctcaaagaaagcccattaagatccgaggagaaaattaaacacttcagccagttgaagtcagagctattccttaaagataattcccttcgcagaatcttgtcactcctgatggagctcaaagtggctgctcaaaaaaactttattctgaaacgactgttttggaaaacttcggatctgttttacttcattgttaataagttacacgaatacttaccagagagccgcgacaaaaacgccttgcagaaccaaagtcagcgagtggacgaactagtagcctgcatcgaaatcatccaaaccctggtcctgatgttcagggagaccgagaccgagagtagccggttgaatactctggccgctaagaagggtgccctgtttaatttactcgttatactaatatcggagccccaaattcccaaaagttgtccagtctttgatatccagcttgtagcagattccgcccttgtgaggatgtcatttgatgccgaattgcagaagctgattttggagtatacaaacacagctacggcactcctgtacgaaattctgctcgtgttccaacagggaaacttggggctcgggagcactaagttcgccatctcctggatcatgagcttccttcagtcctgtccaccaatcattacttttgtggcaagcattgtcaaacaggtggtccgagggctgtcagcaagctttcagctgctcagtccttgtcaggccgttctcctctaccagcagttctacatcctgaagtcttgcctgagacactcccgtacgctggcagagtacataaggaataactacagagaggaatttagatattttatccatatgcccgccttgcagaagagattacccctttgctatcccattactcagcccaccatccaattgttccatgaggtactgaagttggtggagtag

SEQ ID NO: 45098 - DNA, 1878 bp, Artificial Sequence
  Description of Artificial Sequence: Synthetic coding sequence
atggccagccccctgcccagcggcttccccgcccggcggaacagcaggctggatgtgtttctcaggagacacctcccaccagaagtgtacgacgcggtgagagcatacgaaccatgcatagtagtgagcaattctgagaatcatattctgaagtatgttgtgcttagcgatcgtttggtgtacctaactgagaatccaccgaagagtatacgccgcgttgttgcacttcgggatgtggtggcaattgacttaattgatgattatcccgagttcttaagctcccctgaccgggagatctcacagcacatacgcattatctattcctccaccgttctgaagaaagagtgcaagaagagtaacagcgtgcggaaattcctctttccatttcaccacaccaaggccaataataaaaaagtgaaggaagagaagaacggcctggctttttggcggagtaaagaatcaagatcactcaaagaatccattctgcccgatagggaccagcaagagagctcaacccctagtaaagatagcacgctttgtccccgtcccggtctgaagaaactttccctgcatgggcagggtgcctttcggcctctgccctccccttcacggagaagtagccagagcgcacctaccacaggaaaggctgtgagtgaaccgagctgcacaaccaatacaaaagagccacagggactccccgaccacaacagtatatccgaaataccatttaagtgtaatggaaatggtaatgaattttatctcggcaacagcttgttggacagtccttctcagagcaactccaaccttgagaagaaggaatcagagctacatctgtatgttatctccaccacatcttctatctttctccacctcaagagtagctggaataactacattatcgttaaggcaaccctactgcaggaccccttttacgcctcagaattctcacccgctatagggtctcagaagccatataggtccgaggagaaaataaagcatttcagtcagctcaagagcgaactctttctgaaagataactcgctaaggagaattctgtcactgctgatggaactaaaggtagcagcccagaagaattttattctgaaacgcttgttctggaaaacttctgacctgttctatttcatcgtcaataagctgcacgagtatctcccagagagtagagataaaaatgccctgcagaatcaatctcagagagtggacgaacttgtcgcatgtatagaaatcattcaaacgttggtgctgatgttccgggaaaccgagacagaatccagccgcctcaacaccctcgccgcaaagaaaggtgctctgttcaatctgcttgttatcctgatcagcgaaccccaaattccaaaatcgtgccctgtattcgacattcagcttgtggcagatagtgccctggtacggatgtctttcgacgctgaactgcagaaattaatactggagtacacaaatacagctactgcgctgttatacgaaatccttttggtgttccagcagggaaatctcggtctggggagtacaaaattcgccatcagttggatcatgagcttcctccaatcatgcccccctatcattacatttgtggcatctatcgtcaaacaggtagtgcgcggactgtccgccagtttccagctgctcagcccatgccaggccgtactactgtaccagcagttttacatcctgaagtcctgccttcgccatagcagaaccttggccgagtacataagaaacaattatcgcgaggaattccgctactttatccatatgcccgcgctacaaaagagactccccttatgttaccctatcacacagccaactatacaactttttcatgaggtcctaaaattagtggagtag

SEQ ID NO: 45099 - DNA, 2328 bp, Artificial Sequence
  Description of Artificial Sequence: Synthetic coding sequence
ggcttcctgatccaccccctggtggtggccctgcagcagccccccctcccggtactcccccctttacctctgccgccacctcccccacctcccccctacggcagacttctcgcaaatagcaacgcacaccctggacctttccccccatccactggtgcgcaatctaccgcacatccacccgttagcacccaccaccaccatcatcagcagcagcaacaacagcagcagcagcagcagcagcagcagcagcagcaacaacagcatcatggcaattcaggcccaccacctccgggagcattcccacaccctttggagggcgggagcagtcaccacgcgcacccctacgctatgtcaccgagcttaggctcactaagaccataccctcctggccccgctcatttgccaccccctcatagtcaagtgtcctatagtcaggccgggcccaatggacctcccgtgtcttccagtagtaatagttcaagcagtacaagccaagggagctatccatgcagtcatcccagcccctcccagggtcctcagggcgcaccctatccctttcctcccgtgcctaccgtgaccactagcagcgcaactctttccactgtgatagcaacagtggcttcatcccccgccggctataaaactgcatcacctcccgggcctcctccctacggcaaaagagcgccttccccaggcgcctataaaaccgcaaccccacccggttataagcctggctcccccccatcattcaggacaggcacaccacccggatatcgcggaacctccccacctgccgggcccggtacctttaaacccggctcacccaccgtcggccccggtcctctgcctcccgcaggccccagtgggcttccttctctccctccgccacctgccgctccggcaagtggcccccccctttccgctactcagatcaagcaagagcccgccgaggagtatgagacccccgaatctccagtgccccccgctaggtcgccgtcgccgcctcctaaggtcgtggatgttccttcccacgccagccagtctgctcggtttaataaacacttggataggggcttcaattcttgtgctagaagtgatctgtattttgtccccctggaaggctctaagctcgccaaaaaaagagcagacttagtcgagaaggtgaggcgtgaggctgaacagagggctcgggaggaaaaagagcgagaaagagaaagggaaagagagaaagagcgggagagggagaaagaaagagaattagagcgttccgtcaaactcgcacaggaagggcgtgcaccggtggagtgcccgagtttagggcccgttccacaccgtccaccttttgagcctgggtctgccgtagctactgtgcccccttatctgggccccgatactccggctctgaggacactatctgaatacgcaagaccacatgtcatgtctccgggaaacagaaatcacccattctatgtgcccttgggggccgtggatcccggcctcctcggctataatgtccccgctctgtactcttccgatcctgctgcaagagagcgggaaagggaagcccgtgaacgggatttaagggaccgccttaagccagggtttgaggtaaagccatcagagctggagcccctgcacggtgtgcccggtcctggcctggacccattcccccgccacggagggctggctctccagcctggcccaccaggtctgcaccccttccctttccaccctagcctcggtcccctggagagagaacggctagcgctagctgccgggcctgccctccggcctgacatgagctatgcggagcgccttgcagcggaaaggcagcacgccgagcgcgtggccgctcttggaaacgatcctctggcccgcctgcagatgctaaacgtgacaccacatcatcaccagcactcccacatccattcacacctgcatctccatcagcaggacgccattcatgctgcatccgcaagcgtgcatcccctgatagacccactggcatcagggtcgcatctgacaaggatcccttaccctgcgggcaccctgcccaatcctctcctgcctcatccattgcacgaaaacgaagttttaagacaccagctctttgctgctccttatagagatttacctgcctcactgtccgcccctatgagtgccgcacaccaactacaggcgatgcacgctcagtctgcggaactccagcggttggccctcgagcaacaacagtggctgcatgcccaccatcctctgcactcagtgccattgccggcccaggaggactactactcgcatctcaagaaggaaagcgacaaacctctttag

SEQ ID NO: 45100 - DNA, 738 bp, Artificial Sequence
  Description of Artificial Sequence: Synthetic coding sequence
atgagcagcgagagcgagaaggacaaggagcggctgatccaggccgcaaagatgttcttctttcatgtgcaggacttagcctcagttatcaacaccctgacggagcttttcagccgcagcatgaatacacagatcctattgatggccgtgaagaacaattcatatatcaaggacttttttgaacagatgctcaagattttcaaggagatgcagtccgttgtagatgcgaggcatgataagatacaaaaagaatctctttgttcgaaggtcgccatggccatgtgctcagtagtccagaagtccaccaatgttgaggagctccatcagtctgccaaagaggtcttcaaaagcgcacacacaccagtgattatctcagtcctaaactccagcaacatcctgggttcacttgagtcatccttatctcacctcatgaagtttcccattatgaacctgcagctctccgacttttacacagaagacaccaaagaacagagcgatgtaacaacttcagagcggacaagaagtccgcccggatcatccaaaacgacaatgattgacacactcaagaaactgcaagacgtccttaagaccgaagattctaagaatcctaccaaatccgccgctgacctacttgagcagatcgtcaaagccatgggaccaatcctggagatcctgcaaaaagccatcaaaacgatggagatgaatatatctgtcttcaaaaaggcctctgacaagtag

SEQ ID NO: 45101 - DNA, 396 bp, Artificial Sequence
  Description of Artificial Sequence: Synthetic coding sequence
atgggcggcaagagcgccgtgcggcaccagctggtgctggactgccctcgagaggctgcctcctcagcccccgcgctgagacctttaggcgcagccgcaacgtcccgcgccgcaccgctggcaccattgcctgccccttcaccacgctgggggctcggctgcggtcgggtcagatatcccgggccccatcctaggagagcagttgagcctgccgccggccctctcagtgctcccatcatcgctggagggcatccggctgaggctgctgcggggagtgctaagcagcagcctcgccacagcagagaagttccgcgccctccagtgccacagcatccctcaggtaactctagatctgccctgcaggaggcaaaaaccgagcagactaaaacaccttag

SEQ ID NO: 45102 - DNA, 2418 bp, Artificial Sequence
  Description of Artificial Sequence: Synthetic coding sequence
atggccgcccagggcagccccagcagcagccccagcgacgacagcacaacatccggcagcctgcctgaattgccgccaacttctaccgcaacctccagaagccccccagaatctaagggatcatccagatcttctctcctgcagtggacgtgccctgaggattccctgccacttgctgtgttttacggacctctggatgcgaagaaccccctgctcgcatcatgcgaaaaagagatacaagaactgctgggctttatgcgcaagaaaaaggcgctggcaactacagaagaggaaaaacatgagttccgaagacgatgtgccacctcactgttcaatatctggactaaatacgctccccgtttgcctgctgactactataacgagaaactgctgaaagtgggtgattccctgtgccagatgaaggaatataagctcgccctgctccaatgttatgggcgctacttacagcagtttaacaccaacttcgacgaaaacaaagtcgatgtcacacagttcaaggccacgtttttccccaaaggtttcaaggacaagacagctgggttgacattccacgcactgagtggaaagaacatgtgcaattaccagctcgtgtgcgatagcgacgagaaccttaagaacaaagagagtgtggttcaatgtctgcacatcctgtcatcactaaggctgatcatgcaagttgcactccctcaggagcacctttgttggatcatttttaacgggaccatatatatctacacgatctgtagaaagctgatggtaatcggccaaagctccaaagctttggagtaccttttgtgggcgagtatgtgtatggaaagcctggtcccgctcttatccttgagatacttgacgtggagggcaacgctctacacagctgtgtgtcagtgttgttacgactgtcatgccgggattcatggggaagcgtttgccagacgcgccctggcgaaaattgacgagctccgtcagctggaattaatgtcctcaagcaagtcccaggaggaaagcaggaggtattttcgtgaggccacaatgaaaatggccgtgatgatctttaaaagaggcgtgtttgaaagcaggcggaagaacaaggctgtgttccggccaaaaattcgcatcaatttgcgggaagtgcaaaccctgtcatggcctcgcacagtcaccgagcgattgctggatgaaatgtttgacagcacagcttctcagttcctcgccgtgctggaggccctctcagactccaatcggaggatccttcagactggacccattgtgacagacgaggtggagattcatgacgtggtttcagagctctttatggccggcaaggaacttctgattatgagcaacataggcgcggatgggatgctggactttccgaagacatcactgctggagctcatgatcggacggaaggatgtgatctcagtcgatgcagctgtcaagtttattaaactggcctttacgtatgaagaatggagtcttttcgagtcttcagcggtccatcttatctacttcctgcaaagacaagatgatcctgagtctaagaaagcagagaaagaccttacacttctcattgcgatggagcctctgataaatgttaagagaaacaagggactcatcttcccactcgaaaattataaggaggggcaaagcacccaaatctatttaaaaaagatcgcagtccacgatacatgcctgaaaacctgcggctattcagaggacatctttcacctggcggccaccctgtatgtgtgtgtgtgcacagccccgcaggacgtgcagcccgataaggaaattgtcgtggacacaatcatgttcctctggcagaaatgtaaactgggaatccagcgtcttaatatttctaggaatgactatgctaagtttacgcaaaagatttccaccaataagtggatttatctgttatggcagataaatgaagttatacattgttataagatggaggacattgatattgtggtggtggccgaagtgaccttacgtcttagtgagatcttagaatccctcggctctcctgggcggaagttcaagcagagtctggatgtccccttacgtgaagggaccaacaaattcccaggagcaccaaagggcattactgagattctgccaatactgcagaagaatcctgtagaacagctcctttttgcgtacaaactactggatcgcgcaattgggggcatcaacttgaattgtatgttaacttccctgcccaatggtagtagcgtgatagaccattgttatgccaagcgcacacaccacatagatggtgatacatacaagccactggccagcaattcatttatgatggacctgcatttggaactgatacaggcccagcacaggatcgctgttgtgcttctggacaaactgcagggatcctag

SEQ ID NO: 45103 - DNA, 3594 bp, Artificial Sequence
  Description of Artificial Sequence: Synthetic coding sequence
atgagcgacgagaacatgagcaagacccagaccgtgtacgacagcgattcccagagtgggtcctcggctaaggaaaaagacaggggtgccaacctctgcgtgatggaccacttcatgaaaattttcttgtactgtagacgcgctatggttctggcccatcggggcggctattggaccctgttacagaactgttgtagggctctatggaactttactcaggaactgcaaatcttactcaagcaagctgtggatctggacaagaccttcccgattagtcaagacgggttcctttgcacaagcgtcctgcccttttaccttggggcagagctgttaatcgatatgctgatccaacttcaaaatacttctagcatcaaacctatcgaagacaaaggtgaattcagcgtaccctcctgctatggcaacatcaagaatgataatggtgggtccagcctgacatttgaacaccctcttgacgatgttaatgtggtagacctgaagtggatccacgacttcgtattaaagtccctggaggtcctctatcaggtagagaaatgggagactctggtgagtctcgccatccagtttaacactgtgagccatgaaagatacaccgaacaggtcaccccactcttagtttacgcccagaggcagcttcttctgcgcattcaaaaattcaaggggcctgacataacccagcaaccatgtgcaaggtacgaggccgagtacggggagaagatcacatgtaggaattttattgggaagcaattgaaaatcaacagtagtaccatagaagcaacatccaactgcacggaccttctgaaaatgctgatatcatcggagtacagccgcgctaaggctctcgtgtgcgtcccagtggacgttaccgatacactgcgctgttttcgcgaaaccctcgagaagagtaagtaccacaatcggtctataagacattctcgaaaacttttgtcacttttcctcgcccagacacaggacgtcctccaggccagtaaccagaggtccctgaaagtgcaggccttgcacagcttaggatcattgttgatttttgcggagaaaaaacgggctgcatttaagtgttggtgtcaggcgctcgatgatatttttcggaaacccgacgtcttacacacctggaaagaatttgggcccagtctcacaaatgttacaaatagccattccccaccaggattcaaggattactcggaagagtttctctccagggtaggcatctgggggtgccttcagggggccgtgattagcgccaagatcgctcaatttatcaagtccttgaacgtcgagaagaaaacagactgctgcattctttcagctctactgtttcaaggccttttgaggactaccttgccacatccgaaggcggagagatgttacgctcagtacgagattacccaactcctccccgggattgaactttttagcgacagatacagggctgacatttgcagcgtaatcgcctcgttatactatattattagggagcttcatttcgtgaggcagaatttgattgtgctccccttgcttgccttgtatcagtatttcgtaagtgggatctgtcaagatatcacccgaaacttagaagcacgaattctgaagatagaggttctcattgatcttcgattcttttcagaagctttttacgaaatttctcagattttctatggaaaaaatatgccctgtcctatccccgcaggttataaggcaaccggaaagatgaaaattttccagtccttcgatagcggtaagctgctgacctcaaaggagaacatccaagccattgacgaattgagaaataagggactcccagccgtcctggtcaccattgggcagccacacttgctcaacaaattcaattttgttaaagcttattttttcctgagcgtggccgcgaccattaactgcgtgcccgagaacaaattcaaaacagtgataacaaataagagcaagcccaacctccccaatctagaggagatctattctaaggacgacggtagctccttctacaatctgacgaagctgaaggacgagatcacccttagcatgctaaagagcatgctgctgatggaagcagaggataggctgaacttcctgctctccgaggttgagcagaaaacactgtcccaatgtagcgccggagagctggagatcgtggtggaagctagattacagctggctgcggtggcgctccaacggcacagagcagcctacagcgcagctatcgttttctctactctaaccctactgcaggatagcaagttgtttgagaagaaagtcgtccaggacgacaccgagaatcccgtgtcccccggtacctctgtgaccgaaaacaaggacgacagcgagtttctcgaccctatcagcctgaacgctagagaatatttcaatattcatctttggctccgatgtagattggctctggtcacagcctttgtcgcccaaatccacggcattggtattgtgaaggaggacgacatgactgactgtctgtctctcatcaacgaagtgtgcatggaggctaagtcagctggcgacactgaactgcaggcggagtttctgacacaagccgtcattctcggattgcaagagaaacacctgaaagccgatatcatgaccaacctgcaggatattatccatctcttggagggtaacgagtttatctccccacaatcacgtttgacgctggccaggagcctcgtcctgctcgacgacctcactaaggccgagaaattcaaagagtctcccagcagcaagaccggaaagctcaatcttttgacacgggcccacagcatcttgacagaacaaatgctggccttcggggagaccattgagtttcggagcagcaatacgaaatatgccaacccgctccaacccctcaagaatatttacctcccccatgtgatgctcctagcaaaaatcaagatgcgcatcggtcatacagtcgctaagcaagtatattacaaaaacaaacggaaggacccttctaagtggctgcccgcactgcatctgtttgacgttgcgctgaagttatgtcgtaccacggctgtggaggagcatgaagttgaagccgagatccttttccagaagggtaagattgaaagacaaatcctcatggaagagaagtccccctcttttcagctggagtccttatatgaggcgatccagctgtccctgaagaatgaccagaacagcggactcatccgtgatagttatctggaaatggccttactatatttccacctgaagaagccgaagatcaagatttccggttcccccttaacgctgaagccgcctctgaggagaagcagttccgtgaaggagactagcgctaataagtttgagatgtacagctcactcgcctggatcgcgatcagagccgctgcccaagtgtccgaggcagtcctggccattaaccttctcatcggcaagaagaatactaggatgcataaagttaaccaggtggcgctgcctaatattccggaatttgcagcgctggatttgctctctagctacacagactatctgctcggcatgttcggatgcctgcatatcatgcagaaaaattag

SEQ ID NO: 45104 - DNA, 1338 bp, Artificial Sequence
  Description of Artificial Sequence: Synthetic coding sequence
atgggcgagagcatccccctggccgcccccgtgcccgtggagcaggcagtgttggagacgttcttcagccacctcggaatcttcagttatgataaggccaaggataacgtggagaaggagagagaggccaacaagagcgctggtggtagctggctgtcattgctcgcagctctggctcacctggcagccgctgaaaaggtgtatcactccctgacatatctgggccagaagctcgggggccagtcctttttctcgagaaaggactccatcagaactatttacacatccctgcacaatgaattgaagaaggtcgtgactggcaggggcgcattaggggggacagccccgcatgtggaggagttgctctcccacctctccgagcagctatgtttcttcgtgcaggccagaatggaaatggctgatttctacgaaaagatgtacacactgtctacacagaagttcatcaatgccgaagagcttgtaggccttctggatgcgattatgaaaaaatatagcagtcgcttccatcatcctattctatccccactcgaatcttcttttcaactggaggtggacgtgttgtgccaccttctcaaggcccaggcccaggtgtccgaatggaagtttcttccctctttggtcaacttacacagcgcgcacacaaaactacagacatggggccagattttcgagaagcagagagagacaaaaaagcacttattcggcggacagagccagaaggcagtacagccaccacacctttttctgtggctaatgaaacttaaaaacatgctgctggctaagttttctttttatttccatgaggccctatctcgccagacgactgcttccgaaatgaaaactttgaccgccaaagcaaacccagacttttttggtaagatttcctcgttcatccggaaatacgatgcagcgaacgtttctctcattttcgacaatcgaggaagcgaaagtttccagggtcatggttaccaccacccccacagttatcgcgaggctcctaaaggggtcgaccagtaccctgccgtggtctcactaccttccgatagaccagtgatgcattggcccaacgttatcatgattatgactgataggacatccgatctcaattcattagagaaagtggtgcacttctacgacgacaaggtacagtctacctacttcctgacgcggcctgagccgcatttcaccatcgttataatattcgaatccaaaaagagtgaacgggatagccatttcatcagctttttgaacgaggtgtccctggctcttaagaaccctaaggtcttcgcctcgttgaaacccggagctaagggctag

SEQ ID NO: 45105 - DNA, 1032 bp, Artificial Sequence
  Description of Artificial Sequence: Synthetic coding sequence
atggccctgacccccaccaacctgaacaacaagatgagcctgcagatgaagatggactgtcaggagcagcaattgactaagaagaacaacggattctttcagaaacttaatgtgacggaaggcgccatgcaggatttgctgaaggagattatcaaggtcgaccacatcctcgaccgaagcgacgacgaggatgatatctctagcgagaacccacagacagattttctgcataaaggcatgctggagttagaggctgagcacgaccaggatctgtctaagcaggacaaacaggagacagatgtcgacgaagaccctcaggccagtactagcctccagttcagcaaaaagaacctactggaactgtgtctgaagggaatgttcctgaaacttaattactggaacacaaagataggtcttcaggttaaagaactgggggccgattacattgatggcaccgaaaaaatagacaatattattaagaaaattaatgtgacagagaatacagtgaagtctttactgaaggacatgttgacattgaaaggacaaatagagaagctcgaggacagaggattagatctcgatcagggaaccagtacggaggtgaacacatgtaatgaagtatatgagctcaagaaaaaagtcatcgaaaggctggaggacctgtgtaagaacgtggagttactgagtgccaaactgcggatgtaccagatggaagccgaagacaccgactctcattcaagcgaagagatcgataccgaggagatggaggcccttctgcctcaggctcccgcgtcatttctcgtgcagaagagcccaccccgcaataccgcctggaagagagcgctccgaatcttcattatgttcgacgtgctgaccgtcaccgggttgctgtgttatattctgttctttggagccacctttcttttcgaacgggtattgttgcggatgcttggctgcagaaccacctgggacttgagggaaatgagggaaccctttctgaatctcgaggtcgaagcactgctgccgagctag

SEQ ID NO: 45106 - DNA, 1032 bp, Artificial Sequence
  Description of Artificial Sequence: Synthetic coding sequence
atggccctgacccccaccaacctgaacaacaagatgagcctgcagatgaaaatggattgtcaggagcagcaactgactaaaaagaacaatggcttcttccagaagttgaacgttaccgaaggagccatgcaggacctcctaaaagaaatcataaaggttgatcatattctggaccgcagcgacgatgaggacgatatctcctcggagaatccccaaacagactttctacataaagggatgctggaactcgaagctgaacatgatcaagacctgtccaaacaggataagcaggaaaccgacgtggacgaggatccccaagcctccacctctttgcaattctccaaaaagaacctgttagagctgtgcctgaaaggcatgtttcttaagctcaattactggaacacaaaaatcggcctgcaggtgaaggagttgggggccgactacattgacggtaccgaaaaaatcgacaatattattaaaaaaattaacgtcactgaaaatacagttaagtcgttgttgaaggatatgttgaccctgaagggccagatagaaaaactcgaagatcgggggctggacctggaccagggcacatcaaccgaggtaaatacctgtaatgaagtgtatgagttaaagaagaaagtgatagaacgcctagaagatctttgcaaaaatgttgagctgttgtctgcaaaattgcgcatgtatcagatggaggcagaagacactgactcccacagctctgaagaaatcgacacggaggagatggaagcactgctgccacaagcccctgcctcatttctggtacagaaatccccgcctcgcaacactgcatggaaacgggccctgcgcattttcatcatgttcgacgtgctcaccgtgacaggtctgctgtgttacattttattttttggagctaccttcctatttgaaagggtgcttctgcgaatgttggggtgtcggacaacctgggacctgagggaaatgcgagagccttttctcaacttggaggtggaggccctcctgccatcctag

SEQ ID NO: 45107 - DNA, 906 bp, Artificial Sequence
  Description of Artificial Sequence: Synthetic coding sequence
atggcctacagcagcagcaacagcgacatcgaggacgacagcagcaaatctaattccaacttatcactcagtgtgggatacttcccttgtgaagatactccatgtgaggataccacaagttgggaagacgcacccagtaaagggccaagcatccacttcctccctccggtgcagggagcctggggcactgagagaatcgggagacgaatgaagcgccaggaccaaattcaggatgagcctgagcagttctgcaaacttagtatattcctcgcctgggacgtggacattgggtccgacaatacagatagcagggctaacaggctgctgaacggggacaacttatggatcgataaattgccaaaggagaggacaaagctaagtgttggtaaattgaacaacctagtgcaggaattccagatcttcctggaaaacctgaaagatgacgacgccgtattccctgaaaccgcacagcaggactttcagcttagtagtgggtcgccaccggaaatggtccaggtcagtcatcaggaatatgacgcctgccaggatctgccaaaatgtaaacctcccgaaaacaaggatgttatgctgaaagggcacgaattggctgaaatgatcagccaggcgacagcaagccagcgcacttccgcgcccgagatatcttctatcctctcagagcagcccgagaaggacgataccccctcacacactcaggctcagtgctgtctgaattttggctgggcttttagttggctgagacaaaggatcctgccaagtcttttgaggcgagatcatcccgtcaacgctacaaagtcaccacatcgctctgccccaactaaacgcctctttcaccgggggaagcgcatccagccccaggagacacttgagcttgggcatcctatctag

SEQ ID NO: 45108 - DNA, 810 bp, Artificial Sequence
  Description of Artificial Sequence: Synthetic coding sequence
atggcctacagcagcagcaacagcgacatcgaggacgacagcagcaagtctaatagcaatctgtcactgtccgttggctactttccttgcgaggataccccatgcgaggataccacctcatgggaggatgcgcccagcaaggggccaagcatccacttcttacccccagtccagggcgcctgggggactgagcggattggccgcaggatgaagcggcaggatcagatacaagatgagccagagcaattttgcaagctgagcatctttctggcttgggacgtggacattggctcggacaataccgacagccgggctaacagactgctgaacggagacaatctgtggatcgataaactgccaaaggagcgcacaaagctctccgtgggcaaacttaacaacttggtgcaggagtttcagatcttcctagagaacctaaaagacgacgacgccgttttcccggaaaccgcccaacaagactttcagctctcttctggcagcccccctgaaatggtccagatgatttcacaagccactgcaagccagaggacctccgcccccgagatttcctccatcctcagcgaacagcctgaaaaggacgacaccccaagccacactcaggcccaatgttgcctgaattttggctgggccttttcatggcttaggcagcggatcctgcccagcctgctacggcgggaccatcctgtgaacgctaccaagagccctcataggagcgctcctacgaaacgtctgttccacaggggaaagcgcatccagccacaggaaaccctagaactggggcaccccatttag

SEQ ID NO: 45109 - DNA, 573 bp, Artificial Sequence
  Description of Artificial Sequence: Synthetic coding sequence
atggagaagaccgagagcttctgccccgaggtgcccccccaggactgtggggcctcgccaagaccgtctctcaggtctctccccaaaaatcaaggatcccttctgcagtttgatagacaagcccctggccgcatttcaacctcacccactttgcggaggttgcggacccgcggatgtgggaccagacaggatgcatggcaggtgaccacctggggcagctggggagcacctgtaggcttcccttgctacctgtccaagtctctcccgggatctccaaaagatagctctcacctcctgtctcccctgagactgcatagccgtcttacaagcgagccagaacgggcattaaacgcagcagactcactagagccacagacacggcctacagacaaataccttcctccggaactccagcccgtgaatgagggatcactccaccaggcatcactcaggcaacaagaaggccatttcctgccctcccctaccctgcgccatccctctccccaaggcgaggagctgcacccctcaaggtgtgtctgtatctacttccttcgatgctatgatatatgctag

SEQ ID NO: 45110 - DNA, 522 bp, Artificial Sequence
  Description of Artificial Sequence: Synthetic coding sequence
atggagaagaccgagagcttctgccccgaggtgcccccccaggactgcggggccagcccaagacccagccttagatcgctgccgaagaaccagggttccctgctgcagtttgacagacaagcgccagggcggatttctacgagccccactttgcgcagactgcgaaccaggggttgcgggacaagacaagatgcttggcaggtgaccacttggggaagttggggcgcaccagtgggattcccatgttacctgagcaaaagcctgccaggcagccctaaagactcctcccatctcttgagcccgctgcgactacacagcaggcttacgtctgaaccagaacgggcactaaatgccgccgactctttggaaccccaaacaagacctactgataagtacttgccgccagagctccagcctgttaacgagggcagcttgcatcaagccagcctgcgccagcaggagggtcactttctgcccagccccacattgagacacccgtcaccgcaggtgacacagctgtag

SEQ ID NO: 45111 - DNA, 192 bp, Artificial Sequence
  Description of Artificial Sequence: Synthetic coding sequence
atgggctgcggcaacagcaccgccaccagcgccggcgccggccagggccctgccggcgccgctaaagatgtcaccgaggagagcgtcacagaagacgacaaacggcgaaactacggaggagtatatgttgggctaccctcggaggctgtgaacatggtgagcagccagactaaaaccgtacgaaaaaattag

SEQ ID NO: 45112 - DNA, 408 bp, Artificial Sequence
  Description of Artificial Sequence: Synthetic coding sequence
atgttccagaacctgcagggcaccttcgagaaggagatcggcaagattatcccattcactattgcctttaaaagagccgaggcagttgaacccgatgggtgcgtgcaaagttggcgctgctgcctcccatgcgatttaggccaggcgagcaggtttattcacacaaccgtgtgctcagctatccgttggcgttcctgtaagggggaacgaaattttgctgagcgacacattctgcccgctgagctggaggaacaaagcaatcacgccggtatggggccaatattgccagcaatgcccagcgtggacgggaaccacttccagcatccagctggggattgtcatccttatggcatcctctgtttgcaagctcattctgcctctgtcacagcccggcaggttctgcagtag

SEQ ID NO: 45113 - DNA, 438 bp, Artificial Sequence
  Description of Artificial Sequence: Synthetic coding sequence
atgatccccaagctggccaccccccgggacatcagcctgctggtgattaaagaggcttcatccagggcccggaacaatatccagatcttggaccctctcgaccacattgcacgcctcaccaactacaccttgacttcttgtttttctagcaataaagtacctaccatgcctggctccctgcccactggcagcaagcagggaaacgtgcagacactcgactccatcaggtggatgcccgcaactcctgtgcccgcccccgagtgccatcaaaagtatgctatttccaccgagaccgcttttccaacacttagtaccttcatgaacaccgagaagtctgtgaagggcagcaacgccgattttaccaagcgcaacccgcggtggcgctttctgctgggaatctactgtagcttacaccacgccatgaccatcttcatctag

SEQ ID NO: 45114 - DNA, 870 bp, Artificial Sequence
  Description of Artificial Sequence: Synthetic coding sequence
atggagcagcccggcccccgggcccccgaccccagcctgtgccaccataacctgcagcccactgacgacccaaattgggacagttatgctacaactatgcgcacagcctttacgcccaaaacaggggctgtgccggcgctgatcaggcagaacggaattcggcggttgggatacacatatagtctttccgaccctatcctgaatcaaactcagtattcagacgaatatacttggaagagtcatagcaaggaggacctgataaagacagagaccagtcgagggatcaaatcacataagtcccacctcaacgaggacatcttcttgtggacgcttcctcactgtcagcagaccggcactttgaagaactgcctgccttggaaaataccagcatctatgaaggaagtgaacaaggctctgtctaaccaatttatttccctcacaaagagggattttgtagaccgatcgaaggctcaaaaaattaagaagtcaagtcacctgagtcttgagtggaaaaagttgctacctcaaccaccagacaccgagtttcgaagaaattaccagatcccggcaaaaatccctgaattgcaggacttttcctttaagtacgggtgttattcatccctgcccgtagccagtcagggccttgttccatctgtcctgcattcctatttgcgcaaccaagaacacacgaagaagcaaaccacttaccagtctgattatgataaaacatatccagacttcttaatgctcctcaacagtttcacctcaagtcaggtcaaggagtacctccagagtctatcttacaaggataggcagatcattgatcgtttcatccgcacccactgtgatactaataagaagaaaaagtag

SEQ ID NO: 45115 - DNA, 561 bp, Artificial Sequence
  Description of Artificial Sequence: Synthetic coding sequence
atgaacctgccccacctgatgagcctggccagccacctggccagccacggattcttctgcttacggtttacatgtaagggcctgaacatcgtccatcgcattaaagcatacaagtcagtcctcaactaccttaagacctctggcgagtacaagcttgccggtgtgtttctcggcggaagatcaatgggatctcgggctgcagccagtgtgatgtgccatatcgagcccgacgacggcgacgacttcgtccgcggccttatatgtatttcataccctctgcaccatccaaaacaacaacataaactgcgtgacgaggacttgttccgcctgaaggaaccagttctcttcgtctcgggatctgctgatgagatgtgcgagaagaatctcctcgaaaaagttgcacaaaaaatgcaggctccccacaagatccactggatcgagaaagctaatcattcaatggccgtcaagggaaggtcaactaacgacgtgttcaaggagattaatacgcagatcctattctggattcaggaaatcactgagatggataagaaatgccactag

SEQ ID NO: 45116 - DNA, 561 bp, Artificial Sequence
  Description of Artificial Sequence: Synthetic coding sequence
atgaacctgccccacctgatgagcctggccagccacctggccagccacggtttcttttgcctgcgctttacttgtaaaggtttaaacatcgtgcaccgaatcaaggcttataaatctgtactgaactacctcaagacctccggagaatacaaacttgccggagtgttcctgggaggtcggagcatgggctctcgcgcagctgcctccgtgatgtgccacattgagccggacgacggcgatgactttgtgcgaggcctcatctgcattagttatcctctccaccaccctaagcagcagcataaacttagggacgaggacctctttagactcaaagagccagttctatttgtctccgggagcgccgacgagatgtgtgaaaagaacctccttgagaaggttgcccagaagatgcaggccccccacaagatccattggattgagaaggccaaccactcgatggcggtaaagggtcgctccaccaatgacgtgtttaaggagatcaacactcagatcctattctggatacaggagatcactgagatggataagaagtgtcactag

SEQ ID NO: 45117 - DNA, 684 bp, Artificial Sequence
  Description of Artificial Sequence: Synthetic coding sequence
atgagccacaccgaggtgaagctgaagatccccttcggcaacaagctcctggatgccgtttgtcttgtgcctaataagtcattaacatatgggataatcttaacccacggggctagcggtgacatgaatctgccacatctcatgtctctggcaagccatttggcaagtcacggcttcttctgtttgcggttcacctgcaaaggactcaatatcgtgcatcgaattaaggcctataagagtgttctgaactatctaaagaccagcggggaatataagctggctggagttttccttggcgggcgtagtatgggcagcagggccgctgcatctgtgatgtgtcatattgaacctgacgacggcgatgactttgtgcgtggtctcatttgcatctcctacccactgcaccatcctaagcagcagcataagttgcgcgacgaagatctgtttagactaaaagaacctgtactgtttgtctccgggtccgctgatgaaatgtgtgagaaaaacttactcgagaaggtggcgcagaaaatgcaggcgccacacaaaatacattggattgagaaagccaaccactccatggctgtcaagggccggtcaaccaacgatgtgtttaaggagattaatacccaaatcctgttctggatccaggaaataaccgaaatggacaaaaagtgccactag

SEQ ID NO: 45118 - DNA, 420 bp, Artificial Sequence
  Description of Artificial Sequence: Synthetic coding sequence
atgggccagaactggaagcggcagcagaagctgtggaacgtgccccagcttccattcatccgggtgccaccaagcatctacgacacttccctgctgaaagctttgaatcagggacaacagagatacttttatagcatcatgcgcatttacaactctagaccccagtgggaagccctgcagacacgttatattcattctcttcaacaccagcaactcctgggatatatcactcagagggaggcactgtcctatgcactcgttctgcgggactctaccaagagggcttccgcaaaggtcgcccctcaacgaaccatcccacgaaaaacttctgccatgacccggagatgccctagcgtcttacctgtgtcggtggtcctccccagggctcagagtaaacggagacaggtcttaagaaactag

SEQ ID NO: 45119 - DNA, 420 bp, Artificial Sequence
  Description of Artificial Sequence: Synthetic coding sequence
atgggccagaactggaagcggcagcagaagctgtggaacgtgccccagcttccattcattagagttcccccatccatttacgacacttccctgcttaaagctttgaaccagggtcaacagcgttatttctattcaatcatgagaatttacaatagtagaccacaatgggaggctctgcagaccagatacatccacagcttacagcatcaacaacttctgggctatataacacaacgagaagcgctgtcttatgccttagtgttgagggactctaccaaaagagcatccgccaaggtggcaccacagaggacgattccacggaaaaccagcgccatgacaaggaggtgtcccagcgtgctgccggtgagcgtggtcctgccgcgggcccaatctaaacgtcggcaggttctgaggaattag

SEQ ID NO: 45120 - DNA, 912 bp, Artificial Sequence
  Description of Artificial Sequence: Synthetic coding sequence
atggccggcgccgcctgcgagcccgtggcccggcccagcctgaccagcattagctctggcgaattacggagcttgtggacatgtgactgcgaacttgccctcttgccactggctcagctgttacgcctacaaccaggtgcctttcaactgtccggcgaccaactcgtcgtagcaaggcctggcgagccggcagcagcaagaggcggttttaacgtgttcggcgacggcctggtccgactggacggacaattatacagactgtctagctacattaagaggtacgtggaacttacaaattactgcgactataaggactatagggagacaatccttagtaagcccatgctcttcttcattaatgtgcagaccaaaaaagacacctctaaggaaaggacctacgcctttcttgtgaacacgagacaccccaaaattagacggcagatcgaacaggggatggacatggttatctcctccgtgattggtgaaagctataggttgcagtttgactttcaagaagcagtgaaaaactttttcccccctggcaacgaggtcgtcaatggggaaaatctgagtttcgcctacgaatttaaagccgacgctttgtttgatttcttttactggttcgggctctctaactccgtggttaaggttaatggaaaggtcctgaatctctcttcaacttccccagaaaagaaggagacaatcaaactcttcttggaaaaaatgagcgagccactgatacgccggtcctcttttagcgacagaaagtttagtgtgaccagtcggggaagtatcgatgatgtgttcaactgtaacttatctccccgctcaagcctgaccgagcctttgctggcagaactgccgtttcctagcgtccttgaatccgaagaaactccaaatcaattcatttag

SEQ ID NO: 45121 - DNA, 366 bp, Artificial Sequence
  Description of Artificial Sequence: Synthetic coding sequence
atgaacagccccgaggcccggctgtgcgtggcccagtgccgggactcctaccccggttgccagcctctcaaggataccagagcgtgggccagcagcctgaagatggatccagccggcctggagggagggcctcgtgacgaaagtcgtgatgagccaccaattagagcacaagcagccagttgggatcagcctcaggggtgtctcacttacaaaggtaggcgctccgcatccggtactcagaaacagttgcaactccctgatactttgtcttccctgctctgttggcggggtgctataatggtgtacatcaaggtcactgttcagacggatgattcgaataaactgctgtccctcctataccgatag

SEQ ID NO: 45122 - DNA, 3495 bp, Artificial Sequence
  Description of Artificial Sequence: Synthetic coding sequence
atggccctgttccccgccttcgccggcctgagcgaggcccccgacggggggtcgtcgcggaaagaattagactggttgagcaacccttctttctgcgtcggaagcatcacttctctgtctcagcagacggaggcggcgcctgcccacgtctctgagggcctccccctcacacgttcacacctcaaatccgagagttccgatgaaagcgataccaacaagaagctcaaacagacctccaggaaaaagaagaaagagaagaaaaagaagaggaaacatcaacatcacaagaagacaaaaagaaaacatggaccttcatcgtctagccgcagcgaaaccgacacagactcagagaaggacaagccctctaggggtgtggggggatctaagaaggagtcagaggagcctaatcagggaaacaacgcggccgccgacaccgggcatcgcttcgtatggcttgaagatattcaggcagtgaccggcgagaccttcagaaccgataagaaaccagatccggccaattgggagtataagtcactctataggggcgacattgccagatacaaaagaaagggcgacagttgtctgggcattaaccccaaaaagcaatgtatttcttgggagggtaccagtaccgaaaagaagcactccaggaagcaggtagaacgatattttaccaaaaagtccgtgggactaatgaacatcgacggagtggcaatttcttctaaaactgaacctccttcctccgaacccatctctttcatccccgtgaaggatctagaagatgcggctccagttaccacctggttgaaccctctcgggatctacgatcaaagtacaacccattggcttcagggccagggtccacccgaacaagaatcaaagcagccagacgcccaaccggacagtgaaagcgctgctctaaaagccaaggtggaggagttcaaccggcgagtgagagagaacccaagagatacccaactgtggatggcctttgtcgccttccaggatgaagtcatgaagtcaccggggctatatgctatcgaagagggagagcaggaaaaacgaaagaggtccctgaaactgatattggagaaaaagcttgctatcctcgagagggcgatcgagagcaaccagtcttcagttgacttgaagttggcaaagctgaaactgtgtacggagttttgggagccaagtactctggtgaaagaatggcaaaagctgatctttctgcaccctaacaatacagccctctggcaaaagtacttacttttctgtcaatctcagttttcaacattctcgatttccaagattcactcactctacggcaagtgtctgtccaccctgtcagcggtgaaagatgggagtattctatctcatcctgccctcccagggacagaggaagcgatgtttgcgctgtttctccaacagtgccactttctgagacaggcaggccacagcgagaaggctatcagccttttccaagcaatggtggattttacgttttttaaacctgattctgttaaggatctccccacaaagggacaggttgagttctttgaacctttctgggattctggtgaacctagggcaggggagaaaggagctcgtggatggaaagcctggatgcatcagcaagagcggggaggctgggtcgtcatcaatcccgacgaagatgacgacgaacccgaggaggatgaccaagagattaaagataagactctgccacgatggcagatctggctggctgccgaaagatcccgcgatcagcgtcattggcgcccctggaggccggacaagaccaaaaaacaaactgaggaggactgcgaggaccccgagaggcaagtcctgtttgatgacattggccagagtctcattcgactgtctagccacgatctgcagttccagctggtggaggctttcctgcaatttttgggagtgccatcaggattcacacccccagcgagctgtctttacctcgccatggacgaaaactcaattttcgataatggcctttacgatgagaaacctctgaccttcttcaatccactgttctctggcgcctcctgcgtagggcgcatggaccgccttgggtacccccggtggaccaggggccagaatcgtgaaggcgaagagttcatccgtaacgtttttcaccttgttatgccccttttctctggcaaggaaaaatcacagctgtgcttttcatggctccagtatgaaattgccaaggtgatttggtgcctgcacaccaagaataagaagcggctcaaatctcagggcaagaactgcaagaaattggcgaagaacctcttgaaggaaccagaaaactgtaacaatttctgcctttggaagcaatacgcgcatctggagtggctcctgggtaacactgaggatgcccggaaagtatttgacaccgccctcgggatggccggaagtagggaactcaaggacagcgacctttgtgagctgtccctcctttacgctgaactcgaggttgaactgagccccgaggttcggagagccgcaacagccagggctgtgcacatcctcacaaaacttaccgaaagttcaccatatggtccatatacagggcaggtgctcgctgttcatatcctcaaggccaggaaggcatacgaacatgcactgcaggactgcctaggggatagttgcgtgagtaaccccgctcctacagatagctgcagcaggctgatctctctggcaaaatgctttatgttatttcagtacctaacaatcggaatagacgctgcagtacagatctacgagcaggtgttcgcaaagctgaattctagtgtgtttccagagggatcaggcgagggcgacagtgcaagctctcaatcctggacctccgtcttggaggcgataactctgatgcacacgtctcttctgcggttccacatgaaagtttccgtgtatcctttggctcctctgcgagaagcgctctctcaggccctcaaactttaccccgggaaccaggtactctggcggagttacgtacagatccagaataagagtcactctgccagcaagacccgccgctttttcgacaccattactagatcagctaaacctctcgagccgtggctgttcgccatagaggccgaaaagcttaggaaaagattggtggaaacagtccagaggctagatggacgggagatccacgctacaatccccgagactggattaatgcacaggatccaggccctatttgaaaatgcgatgagatcagatagcgggtcgcaatgtccattgttatggaggatgtatctgaatttcctggtgtcactcggcaataaggaaaggagtaaaggtgtgttctacaaagcgctccagaactgtccatgggccaaggtgctctatctggatgctgtggagtacttccctgatgagatgcaggagattttagatctgatgactgaaaaagagctgcgagtgagactgcctcttgaagagctggaactcttactagaggattag

SEQ ID NO: 45123 - DNA, 2802 bp, Artificial Sequence
  Description of Artificial Sequence: Synthetic coding sequence
atgaacatcgacggcgtggccatcagcagcaagaccgagccccccagtagcgagcccatctcatttattccagtgaaggacctggaagatgcagccccagtcacaacctggctaaatcctctgggtatttacgaccagagtactactcactggctccaaggacagggccctcctgagcaggagagtaaacaaccagacgcccagcctgatagcgagtccgccgccttaaaagccaaagtcgaggaattcaacagaagagtgcgagagaatccacgggatacacaactgtggatggcgtttgtggcctttcaggacgaggttatgaagtcgcctggcctgtacgctattgaagagggcgagcaagaaaaaaggaagagatccctcaagttgattctggaaaaaaagttggccatcctggaacgcgccattgagtccaaccagtcaagtgttgatctgaagctggcaaagctcaagctgtgtaccgaattttgggagcccagcaccttggttaaagagtggcagaagctgatctttttgcacccaaataacactgcgctctggcagaaatacctgctgttttgtcaatctcagtttagcactttctccatttctaaaattcactcattatacgggaagtgtctgagcaccttaagtgccgtcaaggacggcagtatcctctcccaccctgctctaccagggaccgaggaggccatgtttgccctctttttgcagcagtgccacttcttacgacaggccggccattctgaaaaggctataagtctattccaggcaatggtggacttcaccttttttaagcctgattccgtgaaggatctgcccacaaaaggtcaggtggagttcttcgaaccattttgggattccggtgagccacgcgcaggcgaaaaaggagcccggggttggaaagcttggatgcaccaacaggaacgagggggatgggtagttatcaatcccgatgaggatgatgatgaacctgaggaggatgaccaggaaatcaaggataaaactctgcctcggtggcagatctggctggccgccgagcgctctcgggaccagagacactggaggccctggcgcccagacaagacgaaaaagcagaccgaagaagattgcgaagaccctgagagacaagtgctgtttgatgacatcggccaatcactgattcggctcagttcacatgacctgcagtttcagctggtggaagcattcctgcagttcttaggcgtgcccagtggcttcacaccccccgctagctgcctgtacttggccatggatgagaattccatatttgataacggactctacgatgagaagcccctgactttctttaacccattgttctccggtgctagttgtgttggccgcatggacaggttgggctacccccggtggaccaggggacagaatcgggaaggagaagagttcattaggaatgtctttcatctggttatgccgctgtttagcggcaaggagaaatcgcaattgtgttttagctggctacaatacgagatcgctaaggtgatctggtgcttgcacaccaaaaataagaagcgactgaagtctcagggcaaaaattgtaagaagctggcgaaaaatctgttgaaagagccggaaaattgcaataacttttgtctgtggaagcaatacgctcatctggaatggttactgggtaatacagaggacgcaagaaaggtctttgacaccgccctaggcatggcaggctcccgcgaattgaaggattcggatctttgcgaactgtctctgttgtacgccgagctggaggtcgagctgtcgccagaggtgcgccgcgcagcaactgccagagccgtgcacatcctaaccaagctaaccgagagctcaccctacggcccgtacacggggcaggtgctggccgttcacattcttaaggcgagaaaggcttatgagcacgctttgcaagactgtctgggagactcatgcgtgtcaaaccccgcaccaactgatagttgttcaagactcatctccctggctaaatgttttatgcttttccaatatctgaccatcggaattgacgctgcagtccagatatacgaacaggtatttgccaaactgaactcctccgttttccccgagggctccggggagggcgactccgcatcatcacagtcttggacgtctgtgctggaagccatcaccttgatgcacacctcactgcttcgcttccacatgaaagtgtccgtgtaccccctggctcctttaagagaagccttaagccaggccctgaaactgtatccaggcaatcaggtcctatggcggtcatacgtacagatccagaacaaatcacattccgccagcaaaactcgcagattctttgacacaatcacccgaagcgcgaagcccttggagccgtggctctttgctattgaggctgagaaattgagaaagaggctggtggagaccgtccaaaggctggacggccgggagatacacgcaaccattcccgagacagggctgatgcaccgcattcaggctttgttcgagaatgctatgaggtctgactcgggctcccagtgtccgcttttgtggcgcatgtacctaaattttttggtgtccctcggaaacaaggaacgcagcaaaggagtcttctataaggcactgcagaactgcccttgggcaaaggtgctatacctggacgccgttgagtacttccccgacgagatgcaagagattttagacctcatgaccgaaaaggagctgagagtgcggctgcctttagaggaacttgagctcctcttagaggattag

SEQ ID NO: 45124 - DNA, 744 bp, Artificial Sequence
  Description of Artificial Sequence: Synthetic coding sequence
atgagcggcaaggaccggatcgagatcttccccagccggatggcccagacaattatgaaggcgcgcctcaagggggcccagacaggccgaaaccttcttaaaaaaaaatccgacgcactcaccctgcgctttcggcaaattcttaagaagatcatcgaaaccaaaatgctcatgggggaagtcatgcgagaggcggcgttcagcttagccgaggcaaagtttacggccggcgacttttcgactacagttatccaaaacgtgaacaaggcgcaagtgaaaatccgcgctaaaaaggacaacgtggctggagtcactttgcctgtcttcgagcattatcacgagggtaccgactcatatgagctgaccggcctggctagagggggcgaacagctcgcgaaattaaagcgaaactacgccaaggcggtcgaactgcttgtagagctggcgtcccttcaaacatctttcgtgactctcgacgaggcaatcaaaatcaccaacagacgcgtgaacgccatcgagcacgtcataatcccgcggattgagcgcacattggcttatataatcaccgaattagacgaaagagagcgtgaggaattttaccgactgaagaagatccaggagaagaagaagatactgaaagaaaagtccgagaaggatttggagcagcgaagggccgccggcgaagttctggaaccagccaacctcttagccgaagagaaggatgaggacctgctatttgagtag

SEQ ID NO: 45125 - DNA, 1449 bp, Artificial Sequence
  Description of Artificial Sequence: Synthetic coding sequence
atggacgagctggtgcacgacctggccagcgccctggagcagaccagtgaacaaaacaagctgggtgagttatgggaagaaatggctctttcccctcggcagcaacgtaggcagctgcgtaagcgacgcggtcggaagaggagaagcgatttcacccacttggccgagcacacatgttgctactccgaagcctccgaaagctctctagatgaggcaacaaaggactgtcgtgaggtggcaccggtgacaaattttagcgacagtgacgacacgatggttgctaaaagacatccagcactgaacgccattgtaaagagtaaacagcacagttggcatgagtccgattctttcacagagaatgccccttgccgccccctgcggcgccgcagaaaagtgaagcgtgtgacatcggaggtggccgcaagtctacagcagaaactcaaggtctccgattggtcttacgaaaggggctgcaggtttaagtctgccaagaaacagcgtctatcccgctggaaagagaataccccctggacatcctcaggccacggcctctgcgagtcggctgaaaaccgaactttcctctcaaagaccggacgcaaagagcgcatggaatgtgagactgatgaacagaaacaggggagcgatgagaacatgtctgaatgtgaaacttcaagtgtgtgttcatcctcggacactgggctgtttacaaatgacgaagggagacagggcgatgacgagcagtccgactggttttacgagggcgaatgcgtgcctggcttcaccgttccaaacttgctccccaaatgggctccagaccattgctctgaggtcgaaagaatggatagcggcctggacaagttttctgattcaacattcctgcttccttcacgtcctgcacagcgcggttatcatacaagactcaacagactcccgggagcagcagctcgatgtctgagaaagggtcggagacgactagttggcaaggaaacttccattaacaccctgggcaccgaacgcatcagccacatcatttctgacccgcgtcagaaagagaagaacaaagcactcgctagtgactttccccacataagcgcctgtgcccacgagtttaaccccctgtcccctctttattcattggacgtactggctgacgcctctcaccggcgctgctctccggctcactgctccgctcgacaggctaatgtgcactggggaccaccatgtagccgagacatcaaaaggaagcgtaagcccgtggctaccgcgtccttgagctcacccagcgccgtgcatatggacgcagttgaaccgactacgcccgcctcacaggcgccaaaaagcccctcctcagagtggctggttagaacaagcgccgccgaaaaggctaccgatgctaccaccgctacctttttcaaaatgcctcaggagaagagtccgggctattcctag

SEQ ID NO: 45126 - DNA, 1434 bp, Artificial Sequence
  Description of Artificial Sequence: Synthetic coding sequence
atggacgagctggtgcacgacctggccagcgccctggagcagaccagcgagcagaacaaactcggagagctttgggaagagatggcgttatctcccaggcagcagaggaggcagctccgcaagcgccgcggacggaagaggcggtctgattttacacacctggcagagcatacatgttgttattccgaggcaagcgagagcagcttagatgaagccaccaaggactgccgcgaggtcgcgcctgtgaccaactttagcgattctgatgatacaatggtggcaaagcgccacccggctttaaacgcaatcgtgaagtctaaacaacactcgtggcacgaaagcgattcattcacagagaatgctccttgccggccgctccggaggaggaggaaggtcaagagggtcacctctgaagtggctgcctctctgcagcagaagttgaaagtttctgattggtcctatgagcgaggctgtcgctttaagagtgcaaagaaacagaggctaagtcgctggaaagaaaatacaccctggacatccagcggacacggtttgtgtgagtctgctgagaaccgaacatttctgtcaaagaccgggcgaaaagaaaggatggagtgtgagaccgacgaacaaaaacagggtagcgacgagaacatgtccgaatgtgaaacatcctccgtctgtagctctagcgacaccggcttgtttactaatgacgaggggcgccagggagacgacgagcagagcgactggttctacgagggcgagtgcgtcccagggttcacggtacccaaccttttaccaaaatgggcccctgatcactgttctgaggtcgaacgcatggattctgggctggataagttctcagatagtacattcctcctgccatcgagacctgctcagcgcggctaccatacgcgcttgaataggcttcctggcgctgcggcgcgctgtctccgaaaaggcaggcgccgcctggtcggtaaggaaactagcattaatacactcggaaccgagcggatctcgcacattatctccgaccctcggcagaaggacttttggcttccaagtgccggaaagcgcgaacgcaaccagttcaaccccctttcaccactctatagccttgatgttttggccgatgcaagtcatagacgatgcagtcctgcccactgttctgccagacaggccaacgtgcattggggccccccctgtagcagggacattaagcgcaagcgcaaaccggtagccactgcatcccttagctcccccagcgcggttcatatggacgccgtggaaccaaccacacctgcatcccaagctccaaaaagccccagtagtgagtggttggtgcggacaagtgctgcagaaaaagccactgacgccacaaccgccaccttcttcaagatgcctcaggaaaaatcacctggttattcttag

SEQ ID NO: 45127 - DNA, 1344 bp, Artificial Sequence
  Description of Artificial Sequence: Synthetic coding sequence
atggacgagctggtgcacgacctggccagcgccctggagcagacctcagagcagaacaagctgggcgagctatgggaggagatggccctgagcccacggcaacagaggcggcagctcaggaagaggagaggtcgaaagagaagaagcgatttcactcacctggccgaacatacatgttgctactctgaggcgagcgagtcgagcctggacgaagcgactaaggactgccgggaggtggctcctgttactaacttctccgatagcgatgatacaatggtcgccaaacgccatcctgctctcaatgccatcgtcaagtccaagcagcacagctggcacgagtcggactcttttaccgaaaatgcaccatgccggccacttaggcgacgaaggaaagtcaagcgagtgacctcagaggtggcagcatcccttcagcagaagctgaaggtctcagactggtcatacgagcggggctgtcgatttaagtccgcaaaaaaacaaaggctgagcaggtggaaggagaatactccatggacctcaagcggtcacggtctgtgtgaaagcgccgagaataggacgttcctttccaagactggccgcaaagaaagaatggaatgcgaaacagatgagcaaaaacaagggagcgacgagaatatgtcagagtgtgagactagctcagtgtgctctagtagtgatacaggtctgttcaccaatgacgaggggagacaaggcgatgatgaacaaagtgactggttttatgagggtgagtgtgtgccagggtttacggtgccaaacctgctgcctaagtgggcccctgaccactgttccgaagtggagaggatggattcaggtttggacaagttctccgactccacgttcttactccccagtcgtccagcccagagaggctaccacaccagacttaatagactccctggagcagctgcaagatgcctgaggaaaggcaggcgaagactggttgggaaagagaccagtattaacactctggggaccgaaagaataagccacatcattaccctcggtaggaaaatttccggctatcatcaacttgggaaagagaatgagatcagctccataccttgtctgcccttcaccccctggatgtttcttcctatgttgttgacagaaggtgttcaccagcatacagctctccctgaccggcagatgtacacaggggaccaccatgtgcatgtgacctctagaggcagcgggaaccagtggccacaacatttgtgccttgctcccgtgcagttcacatggatgcagtggtctcagccccaccagcatcataagcccccaaaccatccggcactgagcggatggtag

SEQ ID NO: 45128 - DNA, 1056 bp, Artificial Sequence
  Description of Artificial Sequence: Synthetic coding sequence
atggacgagctggtgcacgacctggccagcgccctggagcagacctcggagcagaacaaactcggcgaactgtgggaggagatggccctgtcccccagacagcaacgccgtcagttgcgaaagaggaggggtcggaaacggagatcagatttcacccacctggcagaacacacctgttgttacagtgaggcctcagagtcttcgctcgacgaagcgaccaaggattgcagggaggtggcgcctgtgacgaatttttcagactccgatgacactatggtagccaaaagacacccggcgctcaatgccattgttaaatcgaaacagcacagctggcacgaatctgatagttttaccgagaacgccccatgcagaccactgcgaaggcgccggaaggttaaaagggtaacaagtgaagttgctgcaagcctacagcagaagctgaaagtctccgattggtcatacgagagagggtgcagattcaaatccgccaaaaagcagagattgagtaggtggaaagaaaacaccccatggacttcatcaggacacgggctgtgtgagtccgcagagaaccgtaccttcctgtcaaagacgggaaggaaggagaggatggagtgcgaaaccgacgagcagaaacaaggatcagacgagaacatgtcagagtgcgagacaagttctgtgtgttcctcctctgacaccggtctgttcactaatgatgaaggccgtcaaggcgacgatgaacaaagcgactggttctatgaaggagagtgcgtgcccggcttcaccgtccctaatctgcttcccaagtgggcccctgaccactgttccgaggttgagaggatggactcaggcttggataagtttagcgattctacctttttgttaccaagcagacctgcgcaaagagggtaccacacccgcctgaatcgcctgccgggggcagcagctcgctgtctgcgcaaaggcaggagacggctggttggcaaagttatccctctcaccgtgagcttggctcaatggggggacaatataccctatgggagctgtgtgagctattag

SEQ ID NO: 45129 - DNA, 1056 bp, Artificial Sequence
  Description of Artificial Sequence: Synthetic coding sequence
atggacgagctggtgcacgacctggccagcgccctggagcagaccagtgaacagaacaaactcggagaactttgggaagaaatggcgctgagtccccgccagcagcgccggcaactccggaagcgtagaggtcgcaaacggcggtcagattttacccatctggccgagcatacttgttgctacagtgaggctagtgagagctcactggacgaggccactaaagattgcagggaagtggcgcctgttaccaacttcagtgattctgacgatactatggtggccaagcgacaccctgcccttaatgctatcgtaaagagcaagcaacacagttggcacgagtcagattcgttcaccgagaacgccccctgtagacctctacggcgacgtaggaaggtgaaacgcgttacatccgaagttgcagcatctctgcagcagaaactgaaggtcagtgactggagctacgagaggggttgcagatttaagtccgctaaaaaacagagactatctagatggaaggagaacacaccctggacttcttccgggcatggtctttgtgagtctgccgagaaccgcacctttctgtccaagactggacggaaagagcgcatggagtgtgaaacagacgaacaaaagcaaggtagtgacgagaacatgagtgaatgcgagacgtcttctgtctgctcaagctctgacacaggcttgtttaccaacgacgagggcagacagggcgatgatgaacaaagtgattggttctacgaaggcgaatgcgtgcctggattcaccgtgcctaatctgcttcccaaatgggcgccagaccattgtagtgaagtggagcgaatggacagtggcctggacaaattctccgacagcacctttttgttgccttctagacccgctcaacgagggtaccatacgcggctgaatcggctgccgggggctgccgccaggtgcctgcgtaagggtagaaggagactggtggggaaggtgatccccctgaccgtgtctcttgcccagtggggcgacaatatcccatacggatcatgcgtttcatattag

SEQ ID NO: 45130 - DNA, 423 bp, Artificial Sequence
  Description of Artificial Sequence: Synthetic coding sequence
atgcccctggagagcagcagcagcatgcccctgagcttccccagcctcctgcctagcgtaccacacaatacaaacccaagcccacctttaatgtcctatataacctctcaggagatgaaatgtatcctccactggtttgccaattggtcaggcccccagagagaacgattccttgaggatttggtagctaaggccgtgcccgaaaagctccaaccactgctggactcgctcgagcagctgtccgtgagcggagccgaccggcctcctagcatttttgagtgtcagctgcatctgtgggaccagtggtttcggggctgggctgaacaggagaggaacgaattcgtgcggcaactcgagttctccgagcctgacttcgtggcgaaattctaccaagccgtcgcagcaaccgcgggaaaggactag

SEQ ID NO: 45131 - DNA, 423 bp, Artificial Sequence
  Description of Artificial Sequence: Synthetic coding sequence
atgcccctggagagcagcagcagcatgcccctgagcttccccagcctgctcccatcagttcctcacaacactaatcctagtcctccccttatgtcttatatcacttcacaggagatgaagtgcatcctccattggttcgcaaattggtcgggaccgcaaagggaacggtttttagaagacctcgttgccaaagctgttcctgagaaactgcagccgcttctggactcactggagcagctgtcagttagcggtgctgatcgtccaccttctattttcgaatgccagctgcacctctgggatcagtggtttcgaggatgggccgagcaggagcgtaacgaattcgtgagacagttagaattttcagagcccgatttcgtggccaagttctatcaggctgttgcggctaccgcagggaaggactag

SEQ ID NO: 45132 - DNA, 303 bp, Artificial Sequence
  Description of Artificial Sequence: Synthetic coding sequence
atggagctgctgggcgagtacgtgggccaggagggcaagccccagaagcttcgagtttcttgtgaggctccgggcgatggagaccctttccaggggctcttgtcaggtgtcgcccaaatgaaggatatggtgacagaactctttgacccactcgtgcagggcgaggtccaacaccgggtcgcagcagcccctgatgaagacctggacggtgacgacgaagatgacgcggaagatgaaaacaacatcgacaaccggactaacttcgacggaccttctgctaagcggccaaaaacgccctcttag

SEQ ID NO: 45133 - DNA, 1065 bp, Artificial Sequence
  Description of Artificial Sequence: Synthetic coding sequence
atggagagcgccctggccgtgccccggctgcccccccacgaccccggcacacccgtgctctcggtagtcgacatgcataccgggggagaacctctcagaatcgtcctggctggatgccctgaggtgagcgggcccacactactggccaaaagacggtatatgcggcagcatctggatcacgtacggaggagattgatgttcgagccacggggccatcgagatatgtacggcgctgtgttggtcccttcggagcttccagacgctcacttgggcgtactgttcctccataacgaaggctacagtagtatgtgcggccacgccgtgctggctctgggacgattcgccttggattttgggctggtgcccgcaccaccagctgggactagagaagctcgagtgaacatccactgcccatgcggattggtgacagcattcgtagcttgcgaagacgggaggtcccacggcccggttcgatttcacagcgtaccggcctttgtgctggctacagatttgatggtggacgtgccagggcacgggaaggtgatggtggatatcgcctatgggggagctttctatgcctttgtcacagccgagaagctggggttggacatctgttccgctaagacccgagatctcgtcgacgccgccagcgccgtcacagaggccgtcaaggcgcagttcaagattaatcatcctgacagcgaggatttggccttcctgtatggaaccatactcaccgatggcaaggacgcatacacgaaagagcctacaactaatatttgcgtctttgcagacgaacaggtggatcgatccccaactggctcaggcgtgaccgctcggattgccttacagtatcacaagggattgctggaacttaaccaaatgagagcattcaaaagctccgctactggtagcgtttttacagggaaggccgtcagggaggccaaatgtggggactttaaggccgttatcgtggaagtgtctggacaggcccactataccggtacagcctcattcattatagaggacgatgatccgttacgcgacggctttcttctaaaatag

SEQ ID NO: 45134 - DNA, 267 bp, Artificial Sequence
  Description of Artificial Sequence: Synthetic coding sequence
atggccagctgcaccaaccggggcggcctgcccgagaagcacagctcatccaaggtgagttcccatgcccagatgattcagaaagcagtggatttcctggacttgctgatcggccatctgtctaaattttcccccgtgcttatagtttttcagttttcaccacttggctttttggtccggcagagctctgccgacaacgtgcagtttctgtcattcgcgccctccctcatactgccgtcagggaccggaaactggctggtttggtag

SEQ ID NO: 45135 - DNA, 903 bp, Artificial Sequence
  Description of Artificial Sequence: Synthetic coding sequence
atggactggttccactgcaaccagtgcttccggaaggacggcgcccacttttttgtgacatcctgtggacacatcttttgtaagaagtgcgtcaccttagagaagtgcgccgtgtgcgggactgcttgtaagcacttggcactcagtgataatcttaaaccgcaagagaaaatgtttttcaaaagcccggtggaaacggccctccagtattttagtcacattagccaggtttggtcctttcagaaaaagcaaacggacctgctgatcgccttctacaagcatcgaattactaaactcgaaaccgcgatgcaggaagctcaacaagcactggtcagtcaagacaaggagttgagcgtgctgaggaaggagaacggcgagttgaagaaatttctagcaatccttaaagaaagcccatctcgttaccaggggtcacgctctattacgccacggccggtgggaattactagcccatcccagagcgtaaccccaaggccttcatttcagcactcctctcaagtggtctcccgcagctcttcagccgaatcaattccctatcgggaagctggattcggcagtctcgggcagggcggaagggggcttcaaggaaggcgaaccccccgcgattcctacaatgagacaccgtcacctgccagcacccactccctcagctatcgcactagttcggcatcttcaggacagggcatcttttcctttagaccttccccaaacgggcactctggacataccagagtcttaaccccaaacaactttgctcaacgggaaagcacgaccactcttgagtctctcccctcgttccagctcccagtattgcagaccctttaccaacagcgacggcacatgggcttgccatctggacgtgaagcatggacaacttctaggtag

SEQ ID NO: 45136 - DNA, 567 bp, Artificial Sequence
  Description of Artificial Sequence: Synthetic coding sequence
atggaggacgagcggagcttcagcgacatctgcggcggccggctggccttgcagcgccgatactattctccgtcgtgccgggaattttgcctttcctgtccccggctgagcttgaggtctctgactgccgtgacctgtacggtgtggctggcggcttacggcctcttcacactttgcgagaattctatgatactgagtgctgctatatttatcactcttctagggctccttggttatttgcacttcgtgaaaatcgatcaggagaccctcttaatcattgactcattgggaatccagatgacgtcctcttatgccagtggtaaggagtcaacaacgttcattgaaatggggaaggtaaaggacatcgtgattaatgaagcgatctatatgcaaaaggtaatctattatttatgtattcttctcaaagatccggtggaaccacatggcatatcacaggtcgtcccagtgttccagtccgcaaagcctcggctcgactgcctgatagaagtatatagatcctgccaggaaatcctagcacaccagaaagctacatctacctcaccctag

SEQ ID NO: 45137 - DNA, 1467 bp, Artificial Sequence
  Description of Artificial Sequence: Synthetic coding sequence
atgcacatccagttccccagcaagcccaccctgccccgggcctgctgggaaggccgtattacagctggcagtccagggatgccccccgatgagatcgagattgaaccagtgagacagtcatccgacaagatgctgtattgcgaagcagaatcaccacctacagtcgaaaaagttaagccggcaagagagaactccgagacagatcttgaaattgaagacgatgaaaagttctttactaccggccaaaaagagctgtatctggaggcctgtaaactgatgggcgtggtgcccgtctcatacttcatccgcaatatggaggaatcttatgtcaatcttaatcaccacggcttggggcctcggggcacaaaagcaattgccatcgctcttgtgtccaatatggctgtaactaagctcgagctggaagataactgcatcatggaagaaggggtgctcagtttggtcgagatgctgcaggagaactattacctgcaagagatgaatatcagcaataatcatttgggcctggagggagcgcgaattatctcagatttcttcgaaagaaactctagctcaatttggtctctcgaactctcggggaatgattttaaggaagactccgccgcgctcctctgccaagccctcagcaccaattatcagataaagaagctggatctcagccacaaccagttttcagacgtgggtggtgagcaccttggccagatgctggccattaatgtggggctgacttctctcgatctgtcatggaataactttcacacccggggagctgtggctttgtgtaacgggctgcggggaaacgttacactcaccaaactggatctaagcatgaacggattcgggaatgaggtagcactggcgttgggcgaagtgctgcgtctgaatcggtgtttggtgtacctggatatcggaggcaacgacattggcaatgagggcgccagcaaaatatctaaagggcttgaatctaatgagtcactaagggtgctcaagctctttctgaacccaatcaacatggatggtgcaatcctgctgatcctcgccatcaaaaggaatccaaagagtcggatggaagaactcgatatctccaacgtgctggtctcagaacagttcatgaagacactcgacggcgtctatgccgtgcatccacagctggacgtcgtgtttaaagcagtgcagggactcagtccaaaaaagactattttccttttgaccaacccgatgaagctcattcagagttacgctgatcagcacaagattaccattgttgatttcttcaaatccctcaaccctacggggactatgaagatgtctgtggatgagtttcagaaggtcatgattgagcagaacaaagtgccactgaatcaatatcaggttcgcgaggtgatcaagaaactggacgaaaaaactggcatggtgaatttttcctttctcaacactatgaaaccttag

SEQ ID NO: 45138 - DNA, 561 bp, Artificial Sequence
  Description of Artificial Sequence: Synthetic coding sequence
atggacaacgacaagcccctgcagcccgagaccgaggacgagatcgagatagaacctgtgagacagtcctccgacaagatgctctattgcgaggccgaatcaccgccaactgtcgagaaagttaaacctgctcgagagaacagcgagactgatctggaaattgaagatgacgagaagttctttacgacagggcagaaagagctttatcttgaagcatgtaagctgatgggagtcgtgccggtgagctactttattcgtaatatggaagagtcgtatgtgaacctgaaccatcatggtctagggccccggggaacgaaggcgattgcaattgctctggtttccaatatggctgtcaccaagctggaactcgaggataactgcatcatggaggagggggtgcttagtctggtggaaatgctgcaagaaaattattacttgcaagaaatgaacataagtaataaccatctaggacttgagggagccaggattatctcggactttttcgagagaaacagctcatctatatggtccttggaactgtcagatcagttgcctaactag

SEQ ID NO: 45139 - DNA, 654 bp, Artificial Sequence
  Description of Artificial Sequence: Synthetic coding sequence
atggaggaccgggccggcgagcaggagcaggagcggcacagcctgcgactggagaagctgcaacactgggcccgtcaccgccagtcaggacatctccttgtactcgccgtgtctcagttatggctggctgtagttgtagtgccgctagccgttagcgtggcgtgcctgaactctgattgccacatggccactgccctgcccttaggtcctggtgcctcgggtttgcttaccgggactgtaaccctggaactcaggcgcgctcctaggttgtggaaggttcgggccatgatgatcttcaacactttcaaccttatcctagggttcatcgtagtggtcgttgaagtcatgaagaccgctctgggacctgcccctaccgcttcttcccaacacgcagggctcctggtgttggaactttccgccgaagcctttaccctgggtggtgttcttgtgtccgtgcacgcgctctttcttctgtctcaacgtaagcccggttgttgccgctcacaaagcctgcactatcaggaactccaggaagggttttcagagttggaagaagtgccaggcctcgagaatgggcctaccgttgctagcacgggtgccaacgaaagggtagggcagagggagcagacgcgggctgccctcctgcctccctag

SEQ ID NO: 45140 - DNA, 654 bp, Artificial Sequence
  Description of Artificial Sequence: Synthetic coding sequence
atggaggaccgggccggcgagcaggagcaggagcggcacagcctgagattagagaagctccaacactgggctaggcatagacagtctggacacctgctggtcctggctgtatcccaactgtggctcgccgtggtcgtggtacctctggctgtatcagttgcctgtttgaattcagactgccacatggccacagctctgccccttggtccaggagcgagcggcctgctgacagggaccgttacgttagagcttcgaagggctcccagactgtggaaagtgcgagccatgatgatttttaacacattcaacctgatccttgggttcattgtggtggtagtcgaagtgatgaaaaccgcactgggtcccgcacccactgccagctcccaacatgcaggactcctagtgctggaactctctgcggaggcattcacgctaggtggggtcctcgtgagtgtgcatgcgctgtttctgctctctcaacgaaagccagggtgttgtagatcccagagtctccattaccaggagttgcaggaaggatttagtgaactggaggaggtgccggggctcgagaacggccccacagtcgcctcaactggagccaatgagcgcgtggggcagcgtgagcaaacacgggctgcactcctaccgccatag

SEQ ID NO: 45141 - DNA, 378 bp, Artificial Sequence
  Description of Artificial Sequence: Synthetic coding sequence
atgcaccggaaggagcccggcgcccggctggaggccacccggggcgccgcccgcccccataaacagggcacaaagccgatgatcacccgcccgtcagtgtcccagttgggtgaggggaagtgtccaagctcccaacatttgcaatcgctgaggcacaacaaacagcatgctctgacactcactaaagctaggtgctgcggtgagtgcagtacatgtttttgtacagaggagaagagtgaatgccaacggcacgaggagacttctccaggcagttgtaatcatcaaatcatgagtgccagtacaatttccgccttctgcgccacgccgagattcaagcagctgttcaagggtacggtggagcagatgtcccagatgtag

SEQ ID NO: 45142 - DNA, 228 bp, Artificial Sequence
  Description of Artificial Sequence: Synthetic coding sequence
atgcaccggaaggagcccggcgcccggctggaggccacccggggcgctgcccggccccataaacaggggactaaacccatgattacccgcccctctgtctctcagctaggagaaggcaaatgcccaagctctcaacatctgcaaagtctacggcataacaagcagcacgcactgacactgacaaaagcacgctgctgcggagagtgcagtacctgcttttgcacatag

SEQ ID NO: 45143 - DNA, 369 bp, Artificial Sequence
  Description of Artificial Sequence: Synthetic coding sequence
atgggccgggagatgaagaagaccggcaccccccggcccttccggatagaggaccctaatcagcagccaacctggcatgaccaacctgagatgggcagccactacttcgcccaagctgggctggaactgttggggtcaagcaacccccctgcctcagcctctcaatctgctggcatcacaggcgtgtcccactgtgcgcgcccgggcgaacatgatcttaatcacaccgtgtttcaggtgaaggatagcactttcctacggcacctcgagtccgaccggccagagttcaagtcttgcctgcctccccatttcactgagccctctgtgtcactctccacaagtgaggggtgtgaggacgccatgggctag

SEQ ID NO: 45144 - DNA, 279 bp, Artificial Sequence
  Description of Artificial Sequence: Synthetic coding sequence
atgggcagccactacttcgcccaggccggcctggagctgctgggcagcagcaatcccccagcgtctgccagtcagagcgccggaatcacaggggtttcacactgcgcaaggcctggagaacacgacctcaaccatactgtattccaggtcaaggatagcacattcctcagacacctagaatctgaccggccagagttcaaaagttgcctgcccccccactttacagaaccttccgtgtcgttgtctacttcagaaggctgcgaagatgccatgggctag

SEQ ID NO: 45145 - DNA, 114 bp, Artificial Sequence
  Description of Artificial Sequence: Synthetic coding sequence
atgggccgggagatgaagaagaccggcaccccccggcccttccggatcgaggatccaaatcagcagcccacttggcatgaccagcctggaaccgagtctgtgttctggttgtag

SEQ ID NO: 45146 - DNA, 324 bp, Artificial Sequence
  Description of Artificial Sequence: Synthetic coding sequence
atgaccggccggatggccaccctggagaagagccacagcagcgcctgctggaggaaaaggtcttcaagaacctgcgtggaacctgaccgaacccaggacgccattcatgagccaagaggtctgagccggagtcataccgtgttaaggcatcgccacttcgtcttcctcccactgagcagcggcgcccatcccagcgtccctccacggcgtaagaattgcgcaatgaaaaatggaaagctactgcgatcctgtagctccgtcaggagggccgctgacaaactggactgggggcggttcttcctccaggatctacaatctgtctag

SEQ ID NO: 45147 - DNA, 1911 bp, Artificial Sequence
  Description of Artificial Sequence: Synthetic coding sequence
atgggccagggcccccggagcccccacaaggtgggccggcggttccccgcaggcggaaaacggggccggggcgcgaaggggtctggccgcccgctacccggacgtaagcgccagccctggcccccccctgacggcaggtcagagcccgcccccgacagccacccacacctttctccggaagccttaggttattttcgtcgcgccttgagtgcactcaaagaggctccagaaaccggggaggagagggacctcatggttcacaacattatgaaagaagttgagacacaggctctggctctgtctacaaatcggacggggtccgaaatgctgcaggagctgctgggattcagtcccctcaagccattgtgtagggtgtgggccgccttgcggtctaatttgagaacagtagcctgtcaccgttgcggcgttcatgtgctccagtccgccctgcttcagctgcctagactgctgggatccgcggccgaagaggaggaagaggaggaggaagacggtaaagacggcccgaccgagacactggaagaactggtgttgggactggctgctgaggtgtgcgatgactttttggtgtactgcggggacacccatggttccttcgttgtacgcacactactgcaggtcctgggagggacaatcctcgagagcgagcgtgcgcggccgagggggtcccaatcatcggaggcgcagaagactcccgcgcaggaatgcaaaccagctgatttcgaggtgccagaaacatttctgaaccggctgcaagacctgagtagcagtttccttaaggatattgcagtttttattacagacaagatcagctcattctgtctgcaagtggccctgcaagtgctgcatagaaagttgccccagttctgtgctcacctgtgcaacgctgttattggctatctgtccacacgcggatcctcagtggacggttctcccttgctgctcttcctgcgcgaccagactagttctcggctcttagagcaggtgttgcttgtgcttgaacctccacggctgcagagcctgtttgaagaacacctccagggccagctgcagaccctggctgcacatccgatagcaaactttccattgcagcgcctcctggacgcagtgacaacaccggaactgttatcacccgtgttcgaagagttatcccctgtgctggaggccgtcttagcacaggggcatcccggcgttgtgatcgcactagtcggggcatgtcgccgcgtgggtgcctatcaggcaaaggtactgcagctgctcctggaagcgttccactgtgccgagcctagcagccgccaagtggcatgcgtccccctgttcgctacattaatggcctatgaagtgtactacgggctcaccgaagaggagggggccgttccggccgaacaccaggtggcaatggcggccgcacgggcattaggggatgtaacggtcctggggtccctccttctccaacatctgttgcactttagcacaccaggcttggtcctgcggagcctgggcgcattgaccgggcctcaactcctgagcctggctcagagtccagcagggagtcacgtgcttgatgccattctgaccagccctagtgtgactagaaaactcagaaggcgcgtactccagaacctgaagggccagtatgtggcattggcttgtagtcgccacggtagtcgggtgctggatgcaatctggagcggcgccgccttgagagccaggaaggagattgccgctgagctgggagagcagaaccaggaactaatacgagatcctttcggccaccacgtagcgcgaaacgtagccctgacaactttcctgaagcgacgggaggcttgggagcagcagcagggcgccgtggccaaacgcaggcgcgcactgaactcaatcctggaggactag

SEQ ID NO: 45148 - DNA, 564 bp, Artificial Sequence
  Description of Artificial Sequence: Synthetic coding sequence
atggcctacgaggtgtactacggcctgaccgaggaggagggcgccgtgcctgccgaacatcaggtagctatggccgcagcacgagctctgggcgacgttacggtgctgggctcattacttctgcagcacttgttgcatttttcaacaccagggctggtgctgcgctctctcggggcgctcaccggaccccagctactgtcactggcacagtcgccagcaggctcccatgtcctcgacgctatcttgactagtccatctgtcacccgaaagctacggaggcgagttcttcaaaatcttaaaggacagtacgttgcactggcttgctcaaggcatggttcgcgggtcctagatgcaatctggagcggtgcggctttaagagctcggaaggagatcgctgccgaactgggagagcagaatcaagaactgattcgggatccctttggccatcatgtcgcacgaaatgtggcacttaccacttttctgaagcgaagggaggcctgggaacagcagcagggcgccgttgccaagagacgccgagcacttaatagtatcctggaagactag

SEQ ID NO: 45149 - DNA, 504 bp, Artificial Sequence
  Description of Artificial Sequence: Synthetic coding sequence
atggagctgagcagcatgaagatctgcgccgccatccccaccagcagggctctacctgaagtggtaagacgcatgcctagaaaaagaatttccggtttggaatggctgttgcagcaggatcctggcttttcccttgtgaatacagtgaaggcaggtatgataattagttttccatccaacaacatttattccagcgtgtgttgctgtcagtccgaaatttttaagtatgagttctcaaattccaaaaagagctcatggatccaggaggaacgccacctcggcaaaaacaatgtgctgtattctgcccatgatgtttcacctgaaaaggtgacaagcgctctcaagaaaacgaataagcagacaacaaccatcaataacttccccctgcagtacctccctggttccaagctgctcgacaggtttctcagccttagccgcagcctcttatgtctcaacagctggagctcatcattgccgcttgccccccaggtcaagaaaaagtag

SEQ ID NO: 45150 - DNA, 933 bp, Artificial Sequence
  Description of Artificial Sequence: Synthetic coding sequence
atgaagaccctgttcgaggagatcaaggccagcatcaagaacaactacaatcaggaccggtctttctgccgacccgtgctcccctggggcggcgtgttcaccataaaagctggcagaaaggcagtcagttgtacacctctgtatgttgagataaggctgaaaaatacttgcacaatcgacgggttcctgatgctgctatacgtcattctgaacgaaaacgagaattttccaagagagcttagcctgcattttggtcgcgagttcgtggactgcttcctgtacctgatggatacatattctttcacaaccgtgaaattgctatggatctgggataagatggagaagcagcagtataagagtgaggtacacaaggctagcttgatcatcgacttgtttggcaatgagcacgacaattttacgaagaacctcgaaaatctcatgtctactatccaagagtcctactgcagtaattggcggtgcccaacccgggtacaggaggaccaacagaggacaattaatattaatcctcctcaggagatccctcacgggaatctgataaggctggccgtgaatgaactgttctgttcaaaaatcgagctctgcgaagagcacggctgcggcggccttcgagaattttctcagagaattttctgtcacggggctccccccttcgtagttcttaacatgcagcactggaagtccgaagacctcgcatatgtgccctattacctggatctgagcgatcacaaatacctcctggaaggggccactttgtttaacaaggaagaacaccattacagtgccgcattccaaataggtggacattggatgcactacgacggcctgaggaatgtgaacttgattctgctgaataaacccccagagttcctcctgctttcctccctcgtgtacatcagagcaactgaaaaatag

SEQ ID NO: 45151 - DNA, 2487 bp, Artificial Sequence
  Description of Artificial Sequence: Synthetic coding sequence
atggccctgagcccctggacccccggcctgggcgccggcgagaagctcgtgcaggcagctgcagtatctactggacccagcctggaactctgcaccttgccatctacactagggtcttctgttgcggtggaagcccttgagcagttgtttgtggtcgaacagtccctccagtctgattattttaaatgtaacgaagaagctaaaatattcctgaaggacatcgccgtggcagttaagaaattggaggaaatgagaaaggctaccatcgacctgcttgaaattgagagcatggaattaaacaaactctactatttattggaaaccctccccaattccatcaaacgagagcttgaggagtgcgtccgggatgcccggaggttgaatctgttcgagattaatactatcaagatgcggattacaagaaccgaaaacgaaatcgaactactaaaaaagaaaattactgacctaacaaaatacaatgaagctctgggggagaagcaagaggagttggctaggaagcacgcgcgttttgtgctgtcactgaaccagacaatggaaaagaaagccaccacaaccgtctacatcaacgagacctatacaaagattaatctgaaacgagaagatatcgccctccagaaaaagtgcatccaggaggctgaagaattaatggagaaggagagagccgagtacctcattagaaagcaggagctcaccgcccagattaacgaattcgagaatacacgcgaggtaaagcggatggaaacctatcagaaaaaaaaagagctcgacaagctgcaaactaaaatgagcaaaattaaagaaacggtcaccgtttccgccgctgtgctcagcgatcataacctcgaaattgctcggttacatgagtcaatcagatattgggaacaggaggttagtgaattaaaaaaagacttggccatcctggaagctaagctgtgttttttcaccgataacaaagaaaaacttgatgacatcagcaatgatgagaaaaacgagttcttgaacaagattaagcagttggttgagacactgcacgcagcacgtatggagtataaagatctccgggagaaaatgaaaactcttgctaggcagtataagattgtactgagcgaggaagagaaggcttttctgcagaagcagaaaattcatgacgagaaccagaaacagcttaccttcatctcccaaaaagaatactttctgtctcagaaaagagtagatatcaaaaacatggaagaaggcctgatcaccctccaggagttacagcaggccaccaagaccgtgtaccagcaacaaatcaagattttaagtgccaaccttgagcgggaatctcagcgctgtgtcattactcagtggaaaatggcctgtctgcggaagaaacacgcccggtggacagccaaaattaaggcagaaattcaagcaattactgaaaagattcagaatgctgaggtgagacggattgagctgctcaacgagacctcatttaggcagcaggagatttccggctttgtagcacaaatagaaaaactaactaccgaactgaaggaagaagaaaaggcattcgtgaataaagagaagatgctcatgaaggaactgagcaagtacgaagaaatcttcgtaaaagaaactcaaatcaacaaagagaaagaggaggaactggttgagtacctgccccagctacaggtggccgagcaggaatacaaggagaaaaggagaaaacttgaagaactttccaacataataacagcacagaggcaggaggaggatttacttaacaatcacatctttttgtttaccagggatttctcacggtatatttctaatatggaagatgtaaagcaagagctccagcagcttagggaccaggaatccaaaaagaataaagaccattttgagaccttgaagaatctggagaatggattctacattaatgaccaaaaggctgatctgctgctgctggagaataagaagctgaaggagtatattctgtatctcaaaaacaacatcgaaaaatatagggaaggtcaggaagcactcatgcacacaagctcagacctctccaggcagctgattgcacaagaagcgcagtataaagacttatgggcagaatttcaaaccaccgttaaaattctggtggataatggagaggagactttacaggacatcaataatttgaccgataaactcagggagcgcgatgaaaaaatgcaacacgttagtacctggttgcgcggatctctcgaggggctgcgtctgctcgttgaacaagagagccctatggatcttttgtcaaagcaacagcttagggcccttctggtgacatcgaaggaggaaaagacctgccagctgagcgatcttgtaatccctaactacgctacaaatattcagttgaacatcgatacgtaccttggactcaatacacttgtggtcttatctaactcagctttccacttacgggaattctctcgttag

SEQ ID NO: 45152 - DNA, 2382 bp, Artificial Sequence
  Description of Artificial Sequence: Synthetic coding sequence
atggccctgagcccctggacccccggcctgggcgccggcgagaagctcgtccaggcggccgcagttagtacggggccaagtttagaactctgtactctgcctagcacacttggctcatctgtggctgtagaagcattggaacaactgttcgtggtggagcagagtctgcagtcagattattttaaatgcaatgaagaagccaagatctttctaaaagacattgcagtcgcagtcaaaaagctcgaggagatgcggaaggccaccattgacctgctcgaaatcgaaagtatggagctgaacaagctgtactacttgctggagaccctgccaaacagtataaaacgcgagctggaagaatgtgtgagagacgcgcggagactcaacttgtttgaaattaatacgattaaaatgagaattactcgcacggaaaatgagatcgagctgctgaaaaaaaagatcaccgacctgaccaagtataacgaagcccttggtgaaaagcaggaggagttggcccgaaagcacgcacgctttgtgctttctctcaatcagacgatggaaaaaaaagctacaaccacggtatacatcaacgagacctataccaagatcaatctgaaacgggaagacattgccctgcagaagaagtgtatacaagaagctgaggagctcatggaaaaggaaagagcagaatatcttatccggaagcaggaactgactgcacaaatcaatgagtttgaaaatacacgcgaggttaaacgcatggagacttatcagaagaaaaaagaactagataagctccagactaagatgtcaaagatcaaggaaaccgtaacagtgagcgccgctgtgctcagtgatcacaacctcgagattgcacggttgcatgagagtatccgatattgggagcaggaggtctcagagctgaaaaaagaccttgctattctggaagccaagctctgttttttcaccgacaataaagagaaacttgatgacatttctaacgatgagaaaaatgagtttttgaacaaaattaagcagctggttgagaccctgcacgcagcaagaatggagtataaagacctccgcgagaagatgaaaaccctggccaggcagtacaaaatagtcctgagcgaggaagagaaggccttccttcagaagcagaagatccacgatgagaatcagaagcagctcacatttattagccagaaagaatactttttatcccagaaaagagtcgacattaagaatatggaggagggtctgattacgcttcaggagctgcaacaggcaacaaagacagtatatcagcagcaaatcaagattctctcggcgaatctcgagagggaatctcagagatgcgtgattacccagtggaaaatggcatgtctcaggaagaaacatgctcgttggaccgccaagatcaaggccgagattcaggctataacagagaagattcaaaatgctgaggtgcggcggatcgaactgctgaatgaaacatcgtttaggcagcaagagataagcggcttcgtcgcccagatcgaaaagctgactacggagctgaaggaagaggaaaaagcgtttgtcaacaaggagaaaatgcttatgaaggagttgagcaagtacgaggaaatctttgtgaaggagactcaaatcaataaggagaaggaggaggagctagttgagtatctgccccagctgcaggtggcagagcaagagtacaaagagaagagacggaagctagaagagctcagtaatatcatcactgcacagaggcaggaggaagacctcttgaataatcatatttttctgttcacaagggatttttctagatacatcagcaacatggaggacgtgaagcaggagctgcaacagttacgagaccaagagagcaagaaaaataaagatcattttgaaaccctgaaaaatttagagaacggattttatattaacgaccaaaaggctgatctgctgctgctcgaaaacaagaaattgaaagagtacatcctgtatctaaaaaacaatattgagaagtatagagaaggccaggaagctctaatgcataccagctctgacctttctaggcagttgatcgcacaggaagctcaatataaagacctatgggccgagttccagactacagtaaagattttggtggataatggggaggaaacactgcaggatatcaacaatctgactgataaactgcgggagagggacgagaagatgcagcatgtctccacttggttgagaggatcacttgaaggactgcggttgcttgttgaacaggagagccccatggatctgctaaaaaaaaagaagcacatacgtacacgcgtgcactttcctgtagtcaaatgtaccgagaagaacactctaactaagtag

SEQ ID NO: 45153 - DNA, 1764 bp, Artificial Sequence
  Description of Artificial Sequence: Synthetic coding sequence
atgaacgacagcctgttcgtgagcctggaccggctgctgctggagttcgtctttcagtatgaacaggacatctccaccaaggaggagatgatccagcgcataaataagtgctgtgaggatattaaagagaacaaagtgacaatttgtaggatacatgaaaccatcaatgcaacggatgaagagatcgatcattactgtaagcattctgaggaaattaaggataactgtcgcaactggaaacctacctgcgacgttttccgaaagcacgaagactatatgcaggaccagttcacagtgtatcaaggcactgtcgagaaagataaggagatgtaccatgattatatctgccagtacaaagaggtgttaaagcagtatcagttaaagtactcggagacccctttttcgcgggagtactacgaaaaaaagcgagagcacgaagagattcagagcagagtgctcgcctgcactgaacaactcaaaatgaacgagacaatttttatgaaatttcgcgtgcctgccccatttcccagccttaccaagtggacgctcaacatcgtgaatctacgttgtgagacccaagacatcctcaagcatgcctctaacctcaccaaatcttcctccgaacttaagaaggaagtagacgagatggagattgaaatcaactacctaaatcaacagatctccagacataatgagacaaaggccctttccgagacactggaggaaaagaataagaataccgaaaaccgaaaggagctgaaagagcggatattcggtaaggacgagcacgttctgacactcaataaaacccaaagctcacagttgttcctgccttacgaatcacagaagttagtgcgtcctataaagatgcattcatcggaacccagagtagccgacatcaaagaagaatcatcagcaaaacagtcaaagctcgctaacatagacttccgacagaaggaaaacgacacccagatcttcaacgactctgccgtggacaaccactcaaaatgttcacatattacaactattacttcaagtcagaagttcatgcaggttaggctactgaccccccagaaacaatcaaactccaatcagtggtccgagaagggtgacaaggatgcagagtatggggacaaaggaacagtgcgacaggtgagggaaagcaaatgcacaagtcaggccatttacacagaacactttggcaaaagcgtggagaacgatagcgacgaggtggaggagagagcggaaaacttcccacggaccagtgaaattccaatcttcttgggcacgcctaaggccgtgaaagcaccagaatcgctcgagaagatcaaattcccaaaaacaccacctttcgagatcaataggaatagaaacgccgtgcccgaggttcaaacagagaaggagagcccagggctgtccttcctaatgtcatacacatctcgaagccccgggcttaacctttttgactcttcagtgtttgacacagagatcagcagcgatcaatttaatgaacactattctgctcgtaaccttaacccactctcatccgaacaggaaattggaaatctgctggaaaagcctgagggtgaagacgggtttactttctcgttcccaagcgatacatccactcatacatttggggctggcaaagatgacttttcctttccctttagttttgggcaagggcagaatagcatccctagttcctccctgaaaggattttcgagtagttctcagaacacgacccaattcacttttttttag

SEQ ID NO: 45154 - DNA, 267 bp, Artificial Sequence
  Description of Artificial Sequence: Synthetic coding sequence
atgaacgacagcctgttcgtgagcctggaccggctgctgctggagttcgtcttccaatacgagcaagatatctccacgaaagaagagatgatacagaggataaacaaatgctgtgaagatattaaggaaaacaaagtcacaatttgcagaatacacgagacaatcaatgcaactgacgaggagatcgaccactattgcaaacatagtgaggagatcaaagataactgcaggaactggaaacctacttgtgatgtattccgcaagtag

SEQ ID NO: 45155 - DNA, 1590 bp, Artificial Sequence
  Description of Artificial Sequence: Synthetic coding sequence
atgcccagcaagggcaaggacaagaagaagggcaagagcaagggcaaggataccaaaaagctgataaagacggatgagagtgtggtagacagagccaaggccaatgcctctttgtgggaggcaaggctggaggtgaccgaattgtctaggatcaagtatcgcgacaccagccggatactcgcaaaaagcaatgaggatctgaagaaaaaacagtgtaaaatggagaaggatattatgtccgtgctgtcctatctgaaaaagcaagaccaggaaaaggacaacatgattgagaagctgaaacagcagctgaatgaaaccaaagagaaggcacaggaagagaaggataagctggaacagaagtatacccgccagattaatgagctggagggccagttccatcagaaggcgaaggaaatcggtatgatccacaccgaactgaaagcagtaaggcagttccagaaacggaaaattcaagtggagagggagctagatgacttgaaggaaaatttgcggaacactgagagaatccatcaggagaccctgcggaggctggagtccaggttcttcgaggaaaagcataggctcgagcaggaggccgagaaaaagatcatcatgttggccgagcgcgcccatcatgaggcaatcgtgcagctaaacgacgcaggacgcaacgtttttaaggaaaatgactatctccaaaaagccttagcctatcacttaaaagagaccgatgctctccaaaagaacagccagaaactccaggagtcacacactctgctgctgcatcagaaggagatcaatgatctgctcgtgaaggaaaagataatgcagctcgtccaacagagatctcagattcaaaccctccagaagaaagtggttaatctggagactgccttgtcctacatgacaaaggaattcgagtctgaagtccttaagctgcagcagcacgcgatgattgaaaaccaggcgggtcaggtggaaatcgacaaactccagcacttactccaaatgaaggatcgagagatgaacagagtcaaaaaactggccaaaaacatcctggacgagaggactgaagtggagcggttcttcctggatgcattacatcaggtgaaacaacagattctcatttctagaaagcattataaacagattgctcaggcagcctttaatctcaaaatgcgggcagcctgcactggccgtaccgaataccctaagattcgaacctttgatggccgcgagcactccactaactcagtgaatcaagaccttttggaggcagaaaaatggacccatatcgaggggaatgtggatatcggggatctgacttgggaacagaaggagaaggttctacgactgctgttcgcaaagatgaatggatgtcccagtagaaaatataatcagagctctcggccacccgtgccggattatgtagtgtcagatagtggagagactaaggagtttggcgacgaaagtaaactccaagataagatatttattacacagcagatcgctatctctgattcctccggagaagtagtcctcccaacaatcccaaaagagccccaggaaagcgatactggtaccttttag

SEQ ID NO: 45156 - DNA, 798 bp, Artificial Sequence
  Description of Artificial Sequence: Synthetic coding sequence
atgcagctggtgcagcagcggagccagatccagaccctgcagaagaaggtggtgaacctggaaacagccctaagttatatgacaaaggagttcgaatccgaggtgctgaagttgcaacagcacgcaatgatagaaaaccaggccggtcaggtcgagatcgacaaattacagcacctactccaaatgaaggatcgggagatgaaccgcgttaaaaagttagccaagaacattttggatgagcgcaccgaagtcgaacgcttctttttagatgctctgcatcaggtcaagcagcaaatcttgatcagtcggaaacattataagcagattgcccaggcagcttttaacctcaaaatgagagcagcttgcacgggacggacagagtacccaaaaataagaacctttgacggccgtgagcactccaccaacagcgtgaaccaagacctcctagaggcggaaaagtggacacacattgaaggcaacgttgatattggtgacctgacttgggagcagaaagagaaggtacttagattgcttttcgccaaaatgaacggctgtcccagtagaaagtacaatcaatcctcccggccacctgtgcctgactacgtagtgagtgatagcggggaaaccaaagagttcggagacgaaagcaagctgcaagataaaatcttcatcactcaacagattgctatctctgattcatctggtgaggtcgtcctccccaccattcctaaagaaccacaggaatccgacacatctactcagaagcctagcgatgaaaacttctccactagttattag

SEQ ID NO: 45157 - DNA, 384 bp, Artificial Sequence
  Description of Artificial Sequence: Synthetic coding sequence
atgcccaccatgtggcggatgctgcaccaggccctgaagctgcggcggcggacagtgctggccgggcaggaaatctcttacgtcttacccgttatgttcgttgtgtccgaggaggattctaaccgtgatgtgtttctggtggccggctaccgacacctggagtttggggagcgtatcgcgatttggggctcttcaatgcagcacgttgaacgtcgtcgatggccattagacagcattcaaaaacggatgggtcagagctttacgggatgggcagaagaagcggccccaggtatgaagactaaaaaagaatacgccgagataggggtgaagccacgccaaaacgcctgtgaaatgtgccccgggatgatcctgagcaccacctag

SEQ ID NO: 45158 - DNA, 978 bp, Artificial Sequence
  Description of Artificial Sequence: Synthetic coding sequence
atgcagggccggcgggagctgggcggcgagcccctgagcgacctgcaagaggaggcagcgagtgcttccttgagggtggcgcccgaacgtctctccgacgactctttagagtggcggaggacctgtcccgacctactgctgagcgatgggaaggccagcattagcatgcctagagaaggcggctcgacttgtactgccaggtgtcccgatcccggtgagcacagtagcacctggggtgagttcgaagggttcagagagagttcagctaagtcgggccaattctcacagtctctcgagttgctggaggggcccactgagccccagcccccccgcaccacgagcgctcctaaagaatgctccagtcatcagccatgccaaggtggaccatgggtgacaggcactagtgccgtccccccctctgaacccatcctgtcttatgaaaatattcttaaatgcgccttccaagagatcaccgtgcaacaggcagcagaggacgtatcgacaatcgaccactttcttgagattagttccgaagagaagcccggggttgagagagtgcataagctctgtaacgaatcccgtaagctctggagagcactccagtcaatccacacaaccagcacctcccagcgcctgtggagcgagagcaggtgccaggagaacttcttcttggtgctgggcatcgacgcagcacaaaaaaatctctctggcggtcagggacacattatggaagactgcgatctgaaggagcccgaaggtctcctgaccgtttcgagcttttgtctgcagcattgcaaggctctgatacaaactaagctatctggtccccccggtagtaaacaaggacgactaatgacgtgctcgagatttctgaagacaccttcctgcggcggcggccagcatatcactattccaagaaaacgaatgttcactccgcgcaagctgaagcttaccctctttaatagcgacgtgtgttag

SEQ ID NO: 45159 - DNA, 1065 bp, Artificial Sequence
  Description of Artificial Sequence: Synthetic coding sequence
atgagcggccagcggggcgactgggtgcagaccagcgccctgtggcagctcctgttcagggttctctcacccctgcccgccggcaatgccctggcttcccttgcactggaagtgcaagctcgtctggtcaaaagtgctctttgttcacaggggtaccctaggttggcgcttgcccagctgccagaagatggatcgcagggcagtcgcgagcttcttcttgcactcagctggttgctagctcggggtcctgtgccagagcagatgttggcccaggcgcgggtccccctgggtgacgagatgaccgtgtgtcagtgcgaggctttagcttctcccgggcccccggctcctcatatggaggcggagggtccagttgacgttaggcacgtgcagtggttgatgggtaagcttcggtttcgatggaggcagttagtgtcatctcaacaggagcagtgtgccttgctgagcaagctgctgagaactcttgagcgggagaaccagcggctggaggctgtgctcgcctggcgcaggagcgagctggtattttggcgatggatggataccgtcctgggcacctgtgctccagaagttcctgccgccgcaagccagcccaccttcctgccctgggtccccgaaaggggcggcggggaactagatcttgtggttcgagaattacaggccttggaggaagagctaagagaggcagccgagcggaggagggccgcatgggaagctaaggcaggcggctgcgggcgcgggcccgagtggagcgccgccaggcgggcctcacgtgaggccgtagagaaagagttaggcgcgctgcagcagtgttgggaaagagatggtgggcctgctcagccccacggtccccacaggctcgtgcgacgcgaagacggagccgcgggcgaccgcgacttgcgagccgccgttgtgatcaggaccttgaggtcccaggaggcttgcctggaggccgtgcttagaaggcttcagggccagtgccgtcaggaattggcccgtttggtcggggctcgccctgggctcatttggattcctcctcccgggagatag

SEQ ID NO: 45160 - DNA, 1059 bp, Artificial Sequence
  Description of Artificial Sequence: Synthetic coding sequence
atgagcggccagcggggcgactggaccagcgccctgtggcagctgttatttcgcgtgctgtctccccttcctgccgggaacgccctcgcctcactggccctcgaagtgcaggccagattggtcaagtccgccctgtgctcacagggttacccacgactggccctggcccagctgccggaggacggctcgcaagggagccgcgaactgctgctggccctaagctggctgttagcccggggacccgtaccagagcagatgctggcacaggccagggtgcccctgggagacgaaatgaccgtttgccaatgcgaggcgctggcaagtccaggtccccctgccccacacatggaagctgaagggcctgttgatgttaggcatgtgcagtggctaatgggaaagctgaggttcagatggagacaactggtatcctcacaacaagagcaatgcgctctgctgtcaaagcttctgaggactctggaaagagaaaaccagagacttgaggcagtgctggcctggcggcggtctgaactcgtgttctggaggtggatggacacagtcctgggcacatgcgctcccgaggtacccgccgccgcctcccagcccacctttctcccttgggttccagagcgcggtggcggtgagctggatctagtagttcgggaacttcaggccctggaggaggagctgagggaggcggcggagcgtcgccgggctgcatgggaggctaaagctggagggtgtggcaggggccccgagtggtccgcggcgcggcgtgccagtcgcgaggctgtggagaaggagctgggcgctctgcagcagtgctgggaaagagacggcggaccggcgcaacctcatgggcctcatcgcctggtaaggcgcgaagatggtgctgctggagatcgcgatctaagggcagcagtcgtgataaggactctgcggtcccaggaagcatgcctggaagcagtgctcaggcggctgcaaggccagtgccgccaggagcttgcccgcctggtgggtgcccggcccgggctgatttggattcccccgccaggccggtag

SEQ ID NO: 45161 - DNA, 1182 bp, Artificial Sequence
  Description of Artificial Sequence: Synthetic coding sequence
atgggccggcggcggcagcgggtggaccccgccgccggcgcccgggccggtgctttacccgaagctatagcagcgctctcaaggagtctgccaagtggaccctctccagagatattccgccgagctaaatttgatagaccagaggccacctctgccctgtggcagctgctgttccgcgtcctcagccccctgcccgcaggaaacgccttggcttccctggcattggaggtgcaggcgaggttggtgaaatccgccctgtgcagtcagggctacccccgactggcactggcgcaactgcccgaagacggctcccaggggagtcgggagctgcttctggcactgagctggctcctagcacgaggacctgtaccggagcagatgctggcgcaggccagagtgcccctcggagatgaaatgaccgtgtgccagtgcgaggcactcgcatccccaggaccaccagcaccccacatggaggctgagggcccagttgacgtgcgacatgtccaatggctgatgggcaagctacgctttcgatggcgccaacttgttagcagccagcaggagcagtgtgcactcctgtctaaattactgagaaccttggagcgtgagaatcagcgactcgaagctgtgctggcctggcggcgctccgagttggtgttctggaggtggatggacaccgtgctggggacttgtgccccggaggtgcctgccgcggcgtctcagcccacttttctaccctgggtgcccgagaggggtggcggagaactagacctggttgtgcgcgagcttcaggctctggaggaagaattgagggaggctgctgagcgcagacgggcagcttgggaggctaaggccgggggctgtggccgaggaccagaatggtcggcagccaggagggctagtcgcgaagctgttgagaaagaactaggcgcactgcagcagtgctgggagcgggacggaggccctgctcagcctcatggacctcatcggcttgtgcggcgagaggacggggctgccggagaccgtgatctgcgcgccgccgtcgtgatcaggacgctgagaagccaggaagcatgtttggaagcagtgctcagaaggctgcagggccagtgcagacaggagctggccaggcttgtgggtgccagacctggactgatttggatccccccacccggtaggtag

SEQ ID NO: 45162 - DNA, 1281 bp, Artificial Sequence
  Description of Artificial Sequence: Synthetic coding sequence
atgggccggcggcggcagcgggtggaccccgccgccggcgcccgggctggagccctgccggaagccattgcagccctgtcacggtccctgcccagcggcccttccccggaaatttttcgcagagcaaagttcgatcggccggaggccacctcagctttgtggcagcttctctttcgcgtgctatcccccctgccggcagggaacgccctagcgtcattggcactcgaggttcaggcaagacttgtaaaaagcgccctttgctcacaggggtatcctaggctggctttggctcagctgcccgaggacggatcccagggctccagagaactactgctagctttaagctggctgctggctcggggccccgtcccagaacaaatgctggcacaggcccgggtgcccctaggagatgaaatgaccgtatgtcaatgtgaagcccttgcttctcctggtcccccggcacctcatatggaggccgaaggcccagtagacgtccgacatgttcagtggctgatgggaaagctccgcttcagatggcgacaactggtgtctagccaacaggaacagtgcgccttgctatctaaaatccatctctatacacgggggtgtcactcggatcagagcttgtcccacctgtctgtgactgaagcggagatgctcagggatcctgaggggggccaacaactgctgagaaccttagagagggagaatcaacgcctggaggctgtgctggcttggcgccgctccgagctggttttttggagatggatggataccgtgctgggcacatgtgcccctgaagtgcccgccgcagcgagtcagcctacttttttaccctgggtccctgagcgcgggggcggagagctcgatctggtggtgcgggaacttcaggccttggaggaagaattaagagaagcagccgagcgccgaagagccgcatgggaagcgaaagccggaggatgcggcagaggacccgaatggtctgcagccagacgcgcttccagggaggccgtggaaaaggaactcggggccttacagcaatgctgggaaagagacggtggacctgctcaacctcatggaccccataggctggtgcggcgggaggacggcgccgctggcgaccgggatctgagggctgcagttgtaattcgcacactgaggtcacaggaggcttgtttagaagccgtattaaggcggctccaaggccagtgtcgccaggaactcgcccgtcttgtgggcgctcggcccggcctgatctggatcccccccccagggcgctag

SEQ ID NO: 45163 - DNA, 1488 bp, Artificial Sequence
  Description of Artificial Sequence: Synthetic coding sequence
atgggccggcggcggcagcgggtggaccccgccgccggcgcccgggctggggcactgccagaagccattgccgctttatcacggagcctgccctcaggcccaagtccggagatttttaggcgtgcgaagtttgataggccggaggctacgagtgctctttggcagctgttgttcagagtgttgtctcctctgccggctggcaacgccttggcctctctggccttggaggtgcaggctcgtctggtcaagtctgccctgtgctcacagggctatccaagacttgccttagcccagctccccgaggatggaagccaggggtctcgggaattattgctcgctctgtcgtggctcctagcccgcggacctgttcctgaacagatgttggcacaagctagggtgcccttaggagacgagatgacagtatgccaatgtgaggcactggcttcaccaggcccaccagctccacacatggaggccgagggccctgtagacgtgagacacgtacaatggctgatgggcaagctgcgctttcgttggcgacaactggtgtcaagccagcaggagcagtgcgccctgttgtcaaaaatacacctgtacacacggggctgtcattctgaccagagcctctctcacttgagcgtcaccgaggcagagatgctgcgcgaccccgaagggggccagcaggtctcaggagccggcgcagcccagaacctcgacctggcctaccccaaatgcctgcacagtttttgtacgccaggcatgggtccccgcactttctggaatgatttatggttggtatgcgagcagcccgggctgctgcccggtgactgggctgctccattggaccccggcggcgcaagtgcttgctccctgttgagcccattccgtgctcttctaagaacgctggagagagaaaaccagaggcttgaagcggtcctcgcctggcggaggagcgaactggtgttttggagatggatggatactgtgctgggtacatgcgcccctgaggtacccgcagctgcatctcaacctactttcctcccctgggtgccagaacggggaggaggagaattagatttggtggtccgggagctgcaggccctggaggaagagctcagagaggccgccgagcgccgccgcgccgcatgggaagccaaagctgggggctgtgggcgaggccctgaatggtccgctgcccgccgggcaagcagagaggccgtggagaaggagctgggcgcacttcagcagtgctgggagagggacgggggtcctgcgcaaccccacggtccacataggctggttcggagagaggacggcgctgccggggatagggatctccgagcggctgtggtgattcggacccttcgttctcaagaagcatgcctcgaagcggttctcaggcgcctgcaaggccagtgtcggcaggaattggctaggctcgtcggggctcgaccgggattgatttggattccacccccaggccgctag

SEQ ID NO: 45164 - DNA, 1059 bp, Artificial Sequence
  Description of Artificial Sequence: Synthetic coding sequence
atgagcggccagcggggcgactggaccagcgccctgtggcagctgctcttcagggtgctctcacctctacctgccggaaacgcgctggcctccctggctctggaggtgcaagcccgcttggtcaaatcagctctttgcagccagggctacccacgcctcgcattggctcagctgcccgaggatggtagccagggttctagggagctcctgttggcgctaagctggctgctcgcccgcggaccagtgcctgaacagatgctggctcaggcccgggtgcccctcggagacgagatgaccgtttgccagtgcgaagccctcgcctctcccggtcctcctgccccccacatggaagcagagggccctgtcgacgttcggcacgtccagtggctgatgggaaagttaagatttagatggcgccagcttgtcagtagccagcaggagcagtgtgcactgttgtctaaactcctgaggacactggaaagggagaaccaacggttagaggcggtactggcgtggcggcggtctgagctggtgttttggcggtggatggatacggtgttgggcacttgcgcccccgaagtgccagctgctgcttctcagcccacctttctgccttgggtgcctgaacggggtggcggagagctggacctagtagtgagggagctgcaggccctagaggaggagctgcgcgaggctgctgaaaggcggagagccgcttgggaagcaaaggccggggggtgtggtcgaggcccagagtggagtgccgcccgtagagcctcccgggaagccgttgagaaagagctgggagcgcttcagcagtgttgggagagggatggaggtcccgctcaacctcatggcccccatcgactcgtgcgtagggaggatggggctgccggcgatcgcgatctgcgcgcagcagtggtgatcagaacacttaggtcccaggaggcatgcctcgaagctgtcctgcggcgacttcagggccaatgcaggcaggagttggccaggctggtcggcgccagacccggattgatctggatcccccctcctggtcgctag

SEQ ID NO: 45165 - DNA, 474 bp, Artificial Sequence
  Description of Artificial Sequence: Synthetic coding sequence
atgctggcccaggcccgggtgcccctgggcgacgagatgaccgtgtgtcaatgtgaggcactcgcctcccccgggccacccgcccctcatatggaggcagagggaccggtagacgtgcggcacgttcagtggctgatgggaaagctccgctttagatggcgacaactagtgagttcacagcaggagcagtgcgctttgctgtcgaagattcacttatacacacgcggctgtcacagtgatcagagcctgtcgcatttgagtgtgacagaagcagagatgctaagggatcccgagggcgggcagcagctccttcgaactctggaaagagagaatcaacggcttgaagccgtccttgcctggcggagatccgaactagtcttctggcgctggatggatacagttcttgggacctgcgccccggaggtcccagcagccgcctctcagcccacttttctgccatgggtacccgagtag

SEQ ID NO: 45166 - DNA, 243 bp, Artificial Sequence
  Description of Artificial Sequence: Synthetic coding sequence
atgagcggccagcggggcgactggaccagcgccctgtggcagctgctgtttcgggtactgagccctctcccagctgggaatgcactggcttccttagccctcgaagtccaagcgaggttggtgaagagcgctctgtgctcgcaaggatatcctcgactcgccttggcccaattgcctgaagacgggagccaagggagccgggagcttttgctggctttgtcctggttactggcacgggggtag

SEQ ID NO: 45167 - DNA, 333 bp, Artificial Sequence
  Description of Artificial Sequence: Synthetic coding sequence
atgagcggccagcggggcgactggaccagcgccctgtggcagctgctgttccgcgttctgagtccacttcccgcgggtaatgcgctagcctcactggccctcgaagtgcaggctcgacttgtcaagtctgcactgtgttctcagggataccccagactcgctctcgcccagttgcccgaagacggaagtcagggcagcagagaactgcttctggctctcagctggctgcttgctcgtggtcccgtacctgagcagatgttagcacaggcaagggtgcctttgggcgatgagatgactgtgtgtcaatgtgaggcgctagcctccccgggctag

SEQ ID NO: 45168 - DNA, 747 bp, Artificial Sequence
  Description of Artificial Sequence: Synthetic coding sequence
atgctggcccaggcccgggtgcccctgggcgacgagatgaccgtgtgtcagatccatttatacaccagaggctgtcatagtgatcaatccctcagccacctctccgtgaccgaggcggagatgctgagagatcccgagggcggtcagcagctccttcgaactctggagcgtgagaaccagcgcctggaagccgtgctcgcatggaggagatctgaactcgtcttttggaggtggatggatactgtgttgggcacgtgcgcccctgaggttcccgcagccgcctctcagccaactttcctgccctgggttccggagagagggggaggcgagctggaccttgttgttagagagcttcaagctctcgaggaggaactgcgggaagccgctgagcggagacgcgccgcttgggaagctaaagctggtgggtgtggacgcggacctgagtggtctgccgccaggcgggcctcaagggaggctgtggaaaaggaattaggcgcgctgcagcagtgttgggagagagatgggggtccagcgcagccccacggtccccatagactggtacggagggaagatggcgcggctggcgatagagacctgcgcgcagccgtggtgatacgaaccttgcggtcccaggaggcctgcctggaagcagtgttgcgcagactccagggacagtgcaggcaagagttggccaggcttgtcggtgcaagaccaggactcatttggattccacccccaggacgatag

SEQ ID NO: 45169 - DNA, 165 bp, Artificial Sequence
  Description of Artificial Sequence: Synthetic coding sequence
atgctggcccaggcccgggtgcccctgggcgacgagatgaccgtgtgccaatgtgaggcattagcctccccggggcctcctgcaccccatatggaagccgaaggtcccgtagacgtacgacacgtgcagtggctcatgggaaagctgagattcaggtggaggtag

SEQ ID NO: 45170 - DNA, 597 bp, Artificial Sequence
  Description of Artificial Sequence: Synthetic coding sequence
atggccaccgccgagcccagcggccgggccctgcggctgagcaccccaggtcctcgcccttcaggagcaagggaccgggcgccgggggccgccggccccccctccggacagattggtaatcgcgcactccgtctcggagagaggacacctgccgccgtcgaaaagcgcggcccctatatggtgacccgggccccgagtattcaggcgaaactgcagaagcatcgggacctggcaaaggccgtgctgcgcagaaaaggcatgctgggagcctccccaaatcgccctgatagctctggtaagcggtcggtcaagtttaacaaggggtacactgccttgagccagtcaccagacgagaacttggtttctctcgacagcgatagcgacggcgagttgggaagtcgttactcctctggttactcatccgcagagcaggtgaatcaggacgtgagccggcagctgctgcaagacggataccacctggacgagatacctgacgacgaggacctcgacttaattcccccgaagcctatggcctcttccacttgctcctgttgctggtgttgcctcggagatagcagttcttgtacccttcaatag

SEQ ID NO: 45171 - DNA, 447 bp, Artificial Sequence
  Description of Artificial Sequence: Synthetic coding sequence
atggccaccgccgagcccagcggccgggccctgcggctgagcaccccagggccaagacctagcggcgccagagacagggcaccaggggctgccgggcccccatcagggcaaatcggcaatagagctttgcgccttggagagcgtacacctgctgcggtggagaaacgggggccctacatggtaacacgcgccccatccatccaggctaaattgcagaagcaccgcgacctagctaaggccgtgttgcggcgaaaaggtatgctgggggcctcgccaaaccggcccgactccagtgggaaaaggtcagtaaagtttaacaaggggtatacggccctgtcacaaagccctgatgaaaaccttgtgtccctcgattctgaccggcccttcatgtatattccaggccctttcagctccgaacagtaccccttccctggatggctcggctag

SEQ ID NO: 45172 - DNA, 906 bp, Artificial Sequence
  Description of Artificial Sequence: Synthetic coding sequence
atggcccagaacgtgtacggccccggcgtgcggatcggcaactggaatgaagatgtttacttagaagaagagctcatgaaggactttctcgagaaaagggataagggcaaactcctgattcaaaggagtcgacggcttaagcagaatcttctgcgaccaatgcagctgtccgtgacagaggatggctatattcattatggcgataaggttatgcttgtaaatcccgatgaccccgacactgaggccgacgtgtttctgagaggtgacctgtcactgtgtatgacgccagacgagattcagagtcatttgaaggacgaactagaagtcccttgcggattgagcgctgtccaggcaaaaactcctattgggaggaacactttcatcattctgtctgtgcacagagacgcaacaggccaagtcctgcgctatggacaggatttttgcctgggaatcactggtggctttgataataagatgctgtatctctccagcgaccaccgtacccttctcaaatcctcaaaacgcagttggctgcaggaggtgtatctgactgatgaagtaagccacgtcaactgctggcaggccgctttccccgatccccagctacgcctggaatatgaagggttcccagtcccagccaatgccaagatcctgatcaaccactgccacactaacaggggtctggcggcccacaggcacttattcctgtcaacctacttcggtaaggaggcagaagtggtggctcatacttacttggatagccatagagtggagaaacccaggaatcactggatgctggttaccggcaatccccgggatgcctccagtagcatgctggacttgcccaaacctccaactgaagacactagagctatggagcaggctatgggcctggatactcaatag

SEQ ID NO: 45173 - DNA, 600 bp, Artificial Sequence
  Description of Artificial Sequence: Synthetic coding sequence
atgaaggacttcctggagaagcgggacaagggcaagctgctgatccaacggagccgtagactcaaacagaacctgctgcggccgatgcagctttcagtcactgaggacggctatatccattacggtgataaggtcatgttggtgaatcccgacgatccagataccgaggcagatgtattcctgcggggggatttgagcttgtgtatgactcccgacgaaatccagagccatcttaaagatgaattagaggtgccctgcggtctgtctgcggtccaggccaaaaccccaattggccgtaatacctttatcatcctctcagtgcaccgcgacgccaccggccaggttctgcggtacgggcaggatttttgccttgggataaccggcggttttgacaataagatgctatatctgtccagcgatcaccgcaccctgttgaagtcaagtaagagatcctggttgcaagaagtctacttgacggacgaggtgagccacgtaaactgctggaatatgaaggcttccccaagcagacagatgttgaagttcagctctataactgtgactcagatcggggattggcagccaactggaattttcagctag

SEQ ID NO: 45174 - DNA, 537 bp, Artificial Sequence
  Description of Artificial Sequence: Synthetic coding sequence
atgaacaagcggaccagcgtggacgccagcaaggaggacctgcaccctgcagatccccagtctggggaaggcgtgcctcctaatagaaagaatacgaagacatccccccgcggggaaggaactgctccgccattcagtgcaaggccttgcgtctggacattatgtgagatgctcagcattctggccctggtgggcgttttacacccattctatcgatccaataatcaagtctaccagaaactgaaaacgcacctcagatgccagtccagccgggttgacgggttgatgcttaagccgaccctcttgaccccctcccagctcaagtctcctgaaggtcatctaattctgcccacattcaaccatctcgtcattcggcacatccttgatccaaaacagatattctgcgtggccgacgtctgcacagactgtaaattcaactgtggttctatcgagcggcaccagaagagacacctcatgagagtgtcacaggattgggagcatctgatcaggtacaggaatcagatttgcctgtcgtag

SEQ ID NO: 45175 - DNA, 1527 bp, Artificial Sequence
  Description of Artificial Sequence: Synthetic coding sequence
atggccggccagcggacctgccagcggcggagcagccgggccggccccggaaagatgcaggagcctcccaaaagtatcgaagaattcctgaagttccaaaactgggattactggccaagagagattcacttccgagacgacgacaagtggtcatgcacgcttaaaaaaattaaagaagattctagttttgtaagtatttatacccacctgtgggaaaacgtccccagaatttttgaggcgctgctcattatggagtcaaaactgaaggagtattctttaatcctgcagaaccatacctctgagatatttaagtggaagtcaatgatttctgagacgagttcttatcgcaagcttgagcgttacggtgagttcttaaaaaagtatcacaagaagaaaaaaatcatgctttcggacgagatggaaacagagaagaacatcgagggttgttcctttactggtttcaaggctaatgaactgacacaactcccacgtcatctggatgcagagcagatctatctgttcattctcaaggcccacaactttgatgagcgcgtatttaaaatctggaagacccactttctgtcagaagctagtatcgccctcctccatgactctttctggtggtggtttctccataagtttaggcccgaccgcgagaaccaggattgtttgtttgaccgaattagcgaatcctatgtcaccttgttcatgagtatccctctgtccaggaaggacgcattcttccagatctacccagattgtctcgcacaggcaatctatgcgacctttcacgaagccttccccgagtcaagttatctgttcaatgatgagttcaaggaagatctggggaataatatctttctgtggtgctccgggctcaagcctcagaagggattttggattcactggaagctgaaagaattgtcaaccactacaatccatggttctaagaaggctcccgcgaaatcggtgaaggagcgcatcgctgattctcaggaacatataagtacgagcattgacttcaatatcatcaagatcctgaataaccctagggcctacacactgcctatctccaaagaagaatcccgcttgagccgccttgcaacaaaatctcattactcctccacaggcccagaatttaatagggtcctatttaactttggcggccagagcccattaattctgtattacttgaaaatgcacgagttggcaggcattagcaaagcccctaaaaagactaagataaaactaactaagatcttccaggaacctctaccggctccaacctaccgcgatgtcatcaaggaagccaagagacagttcgccaggaaccagaaagactttcggatactccaggccaaagcaacaaagaaaccccatgaggttaagcaagacttcgaaaagtttctgcataagttacgcagtgaagccgaaatagagcgcgagtgtgtcgcttctctgtcttccagctccagctcgagcccatcttccacggacaactacaactttgaggaggaagaatactag

SEQ ID NO: 45176 - DNA, 912 bp, Artificial Sequence
  Description of Artificial Sequence: Synthetic coding sequence
atggccggccagcggacctgccagcggcggagcagccgggccggccctggtaagatgcaggagccacctaagtcaattgaggaatttttgaaattccagaactgggattactggccacgcgagattcacttccgagacgatgataagtggtcttgtacattaaagaagatcaaagaggacagctcctttgtgtcgatttatacacacctttgggaaaacgttcccaggatctttgaggccctgctgataatggagagcaaattgaaggagtatagcctgattctgcaaaaccacaccagcgagatctttaagtggaaatccatgatttccgaaacaagctcttaccggaagctcgagcggtatggcgagtttctgaagaagtatcataagaaaaagaaaattatgctgtcagacgaaatggagaccgaaaagaatattgaggggtgtagctttacaggttttaaggcaaacgaactcacacagctgccccgtcacctggacgctgaacaaatttacctgttcatcttaaaagcccataacttcgatgaacgcgtgttcaagatctggaaaacacacttcctgagcgaagcgagtatcgctctcctgcatgactccttctggtggtggtttctgcataaattcaggatctaccctgactgccttgctcaagccatatacgccacgtttcacgaagctttccctgagtccagttacctttttaatgatgagttcaaggaagacttgggcaataatatttttctgtggtgttccgggctgaaaccccagaagggtttttggattcattggaaactaaaggagcttagcaccaccacgattcacggctctaagaaagcgcctgcaaagtcagtgaaagagagaatcgccgattcccaggaacacattagtacttag

SEQ ID NO: 45177 - DNA, 549 bp, Artificial Sequence
  Description of Artificial Sequence: Synthetic coding sequence
atggccggccagcggacctgccagcggcggagcagccgggccggcccaggaaagatgcaagaacctccgaagagcattgaggaatttctgaaattccaaaactgggactattggcctagagagattcactttcgggacgacgacaaatggagctgcactctgaagaaaatcaaggaagactcatcctttgtttccatctacacacacttatgggagaatgtgccacgaattttcgaagcgctgttgatcatggagtccaaattgaaggagtacagcctcattttacaaaaccacactagtgagatctttaagtggaagtcaatgatttcagagacctcaagctaccgcaaactggagagatacggcgaattcctgaagaagtaccacaagaaaaagaagattatgctttctgacgaaatggagacggagaaaaacatcgaagggtgttccttcaccggattcaaagccaacgaactgactcaactgccacggcacctcgacgctgaacagatttaccttttcattcttaaagcccacaacttcgattag

SEQ ID NO: 45178 - DNA, 915 bp, Artificial Sequence
  Description of Artificial Sequence: Synthetic coding sequence
atggccggccagcggacctgccagcggcggagcagccgggccggcccagggaagatgcaggagcctccaaagagtattgaggagttcctgaagttccagaattgggactattggccccgcgagatacatttccgcgacgatgacaaatggagctgcacactcaagaagatcaaggaggatagctcctttgtctcaatttatacacatctctgggaaaacgtcccccgaatattcgaagctctccttattatggagtccaagctgaaggaatatagcctgatcctccagaatcacacctctgagatctttaagtggaaatcgatgatttctgaaacctcatcctatcgtaagctcgagcggtatggcgaattcctgaaaaagtatcacaagaaaaagaagatcatgctgagcgacgagatggaaacggagaagaacattgagggttgcagttttacaggcttcaaggctaacgagctaacacagttgccccggcacctggacgcagaacagatctaccttttcattcttaaagctcacaacttcgacgaacgcgtgttcaagatctggaaaacccacttcctctcagaggccagcatcgcacttctccatgactccttttggtggtggttccttcacaagtttaggatctaccctgattgcctggcccaggccatatacgccaccttccacgaggcctttcccgagagtagctatctgttcaacgacgaattcaaagaggatctcggaaacaacattttcctgtggtgcagcggacttaaacctcaaaaaggattctggatacactggaagttaaaagaactctccaccactactatccatggatctaagaaggcacccgcaaagtctgttaaagaacggattgccgactcgcaggagcatatttcaacgtcatag

SEQ ID NO: 45179 - DNA, 393 bp, Artificial Sequence
  Description of Artificial Sequence: Synthetic coding sequence
atgccccggcccgccagcgagagctggagccccatccagagccggattcccgcttataaagccgtcagtcatctaaggttacttcccactgctaactcaccctctgggtcaaaccagcctaccaatccaaaccgggcccagcatccagagggccctcaatctagggaaggggccacttcacccgttttagcctccctagaaccacctacaccaactgatttgccctcagccagggcgcgtcctagagtccccgctgagtctgggccagggtggctgcataaggcccgaagacctacgcgtggtattctacgggacgtcctgcgccatcgcggagtgcctgcacagcctcggccggccccaggggcccaccaactgtccagccccagctcttag

SEQ ID NO: 45180 - DNA, 681 bp, Artificial Sequence
  Description of Artificial Sequence: Synthetic coding sequence
atgagccggatctaccacgacggcgccctgcggaacaaggccgtgcagagtgtgcggctgcccggggcatgggatcccgcagctcaccagggagggaatggagtgctgttggagggcgagctcatcgatgtgagtaggcatagtatcctcgacacgcacggccgtaaggagagatattacgtgttgtatatccgaccgagtcatatccatcgcaggaaattcgatgccaaaggcaacgagattgagcccaacttcagtgcaacaaggaaagtaaatactggcttccttatgtcttcttacaaagtggaggccaagggggacacagacagactgacacccgaagcacttaagggtctcgttaataaaccggagctgctggccctgaccgagagtctgactccagatcacacagtcgctttctggatgccagaatccgagatggaagtgatggaattagagctcggcgctggagttcgcctcaaaacaagaggcgatggcccctttctcgactctctagcaaaattagaagccggcaccgttactaagtgtaatttcaccggtgacggaaagactggcgcctcatggaccgacaacatcatggctcaaaaatgttctaagggcgccgctgccgagatcagggagcagggtgacggagcggaggacgaagaatgggatgactag

SEQ ID NO: 45181 - DNA, 3144 bp, Artificial Sequence
  Description of Artificial Sequence: Synthetic coding sequence
atggccgagaagcggcccctgcggaccctgggccccgtgatgtacggcaaactgccaaggctggagaccgactccggattggaacattcacttcctcacagtgtcggaaaccaggacccatgtacatacaaagggagctatttctcctgtcctatggcaggcactcctaaagccgagagcgagcaattggcgagttggacaccctatcctccattgtattctaccggaatggctggcccaccgttgcaggccgacaatcttctcacgaactgtctattctacaggagcccggcagaagggccggagaaaatgcaggactccagcccggtcgaattactgccgttctctccacaggcacattcttacccaggtccacctcttgcagcaccaaagcccgtttatcggaatcccctgtgctatggcctgtccacatgtttaggcgaaggagcagtgaagcgtcccctggatgtggactggaccctggctacaggtcccttactccctagcgccgaccccccgtgcagcctggctcccgccccctcaaaggggcagactctcgacggcacatttctgcgcggcgttcccgccgaaggatcctctaaggacagctctggctccttctctccatgccagccattccttgaaaagtaccaaactattcattccaccggctttttggcctcccggtataccggcccttatccgcggaacagcaagcaggccatgtctgaaggaccctcatcaccttggacccaacttgcacaacccttagggcccccttgccaggatactggccctacccattaccctccaccccatcacccccctccccatcctccccaggcccttccctgcccccctgcctgtagacaccccgagaaacagggttcctactccccagctttgcccttgcagccactcggcggccataagggtaccggataccaagccgggggcctggggagtccatacctgaggcagcaggctgcacaggccccatatatcccccccttggggctggatgcttacccttatccatctgctccgctgccagctccatcccctggcttgaaactggaacctccactaacaccacgttgtcctttggatttcgctccccagacattgtctttcccatatgctagggatgacctgtccctttacggagcttcccccggtctgggcggcaccccaccatcccagaacaacgtgcgggccgtacctcaacctggagcatttcagcgggcatgtcagcccttacccgccagccagccctgttccgagccagtgcgccctgcccaggaagcggaagaaaagacttggctgccgtcatgtcggaaagagaaactgcaaccaagactgagcgagcattcgggcccaccgatagtcatccgtgactcccccgttccgtgcactccgcccgctctccccccttgtgctagggagtgtcagagccttccccagaaagagggtgctcgaccgcccagcagtcctccaatgccggtaatcgataatgtgttctccctagcgccatatagggattatcttgacgtgccggcgccggaagccacaacagaacccgacagtgcgaccgcagagccggacagtgctcctgcgactagcgaaggccaagacaaagggtgcagagggacattgccagcgcaagaaggcccatcaggctctaagccgttgcgcggatccttaaaagaggaggtcgccttagaccttagcgtgagaaagccaaccgccgaggctagtccagtcaaggccagtagatcagtggagcacgctaaaccaactgctgctatggacgttccagacgtgggcaacatggtgtctgacctgcccgggctcaaaaaaatcgacaccgaagcccccgggctgccaggtgtcccggtgacaacagacgccatgcccagaactaactttcactcttcggtcgcgtttatgtttaggaagttcaagattctccggccagcgccactcccggccgcggtggtgccgagcacccccacgtcagcgcctgcccctactcagcctgcccctacgcccacaagcggaccaatcgggctccggatccttgcacagcagccgctgagtgtaacttgcttctcccttgcactgccctccccccctgctgttgccgtcgcaagcccagctccggccccagctccctcaccggccccagcccgggctcaagctccggcctctgcgcgcgatccagccccagcccctgccccagtggccggaccagcacctgcttcaaccagcgcacccggcgatagcctggaacagcatttcacagggctccacgcctcgctctgcgatgctatttctggcagcgtcgcccactcacctccagaaaaactgagggagtggttggagaccgctgggccctggggacaggccgcctggcaggattgccagggagtgcagggtctgctggctaaactgctgtctcaactgcagcgttttgatcgtacccatcgctgtcccttcccccacgtggtcagggcaggagctatatttgttccaatacacttggtcaaagagcgattattccctagactgccaccagccagcgtcgatcatgtattgcaggaacaccgggtggagcttcgccccaccactttgtctgaggagagggcccttagggagcttgccctcccagggtgtactagtcgtatgcttaagctattggccctgcgacagctgcccgatatttatcctgacctactggggctgcagtggagagattgtgtgcgacggcaactgggggattttgatactgaggccggggcggtcagttcttcggagccaaccgtagcacggggcgagcccgaaagccttgctttggcccagaagtctcccgcccctaaggtgagaaaacctggtagaaaaccgcctacaccaggcccagagaaggcggaggcagccgctggcgaagagtcatgcggggcgagcccaactcctgctacatcggcaagcccacctggaccgacactgaaagcccgttttagatccctcctggaaactgcttggctgaacggactcgccctgccaacatgggggcacaagtcatctcggcccgaccagcccagcccctgccctcagttgcttgactcccaaagccatcacctctag

SEQ ID NO: 45182 - DNA, 3144 bp, Artificial Sequence
  Description of Artificial Sequence: Synthetic coding sequence
atggccgagaagcggcccctgcggaccctgggccccgtgatgtacggtaaactcccacgactcgaaacggatagtggcctcgaacattccttaccccactctgttggaaatcaggacccttgcacatataaaggcagttattttagctgtccgatggctggtacaccaaaagccgaaagtgaacagctggctagttggacgccctacccccctttgtacagcaccggcatggctggcccacctctgcaagctgacaatctcctgacaaactgcttgttttatcgaagccccgccgagggccctgagaagatgcaggactctagtcccgttgaactgcttccctttagcccgcaagcgcattcctatccaggccctcccctcgcagctccaaaaccagtgtaccgcaatccactgtgttatggcctcagcacctgtctgggagagggtgcagtcaagcgcccactggacgtggattggactctggcaacaggtccacttttgcccagcgcagacccaccctgctctctggcccctgccccttccaaagggcagacgcttgacggaactttcttacggggggtgcccgccgagggcagctcaaaagactcttccgggagctttagcccatgccagccattcctggagaagtaccagactatccactcgactggatttctggcaagtaggtacaccggtccctatccaagaaacagcaaacaagccatgtctgagggccctagctccccatggactcagttggctcagcctctcggccctccctgccaggacacaggtcctacgcactatccgcccccccatcaccctcccccgcacccccctcaggctctcccgtgtccccccgcctgccgacaccccgagaagcaaggttcttacagcccagccctcccactccagcccctgggaggacacaagggaactggataccaggccggtggcctgggctctccatatttaagacagcaagcggcccaagcgccgtacattcctcctctgggactcgacgcctatccatatccaagcgcacctctgccggctcccagccccggcctgaaattggagccccccctgacaccaagatgtcctttggatttcgcgcctcaaactctgtccttcccttatgctagggacgatctctcattgtacggtgcctcacccggcttgggaggtacgccccctagccaaaacaacgtgagggccgtgccccaacctggagctttccagcgtgcgtgtcagcccctccctgccagccaaccctgtagcgagccagtaagaccagctcaggaagcggaggagaagacttggctcccttcttgccgaaaagagaaactgcaacctaggctgagtgagcattccgggcccccaattgttatccgagacagcccagtaccctgtaccccacctgccctgccaccttgtgcccgtgagtgccagtctctcccacagaaggaaggtgctcgcccccctagctctcctccaatgccagtgatcgataatgttttcagcctggccccttatagggactacctcgatgttcctgcaccagaagccaccacagaaccagactcagcaaccgccgagcccgattctgcaccagccacctctgagggacaggataagggctgtagaggaacgttacctgcccaggagggccccagcggctctaagcccctgcgcgggagtcttaaggaggaagttgccttggacctgagtgtccggaaaccaacagccgaggccagtccagtgaaagcaagccggtctgtggaacacgctaaacccaccgccgccatggatgtccccgatgtgggcaacatggtcagcgacttacccggactgaagaaaatcgacaccgaggctccagggctgccaggggtccctgtcactactgacgccatgccccgaactaacttccacagttccgtcgcctttatgttcaggaagtttaagattctgcgcccagcccccctaccagctgcagtcgtccccagcacaccaacctctgcccctgcccccacacagcctgcgccaactccaacctctggccctataggactgcgaatcctggcgcaacagcctctcagcgtgacatgcttctcgcttgcattgccatcccctcccgcagtggctgtcgcatcaccagcacctgccccagccccgtcacctgctcccgctcgcgctcaggcccccgcatctgccagggaccccgcgccagccccagccccggtcgctgggcctgcccctgccagtacatccgcgccgggcgatagtcttgaacagcactttaccgggctgcacgcttcactgtgcgatgctattagtggtagtgtggcccactctccacctgagaaactgagagaatggctggaaacagccggaccctggggccaggccgcctggcaggattgccaaggcgtccagggtttgctggctaagttgctttcccaactgcaaaggtttgaccgcacgcaccgctgcccattcccccacgtagtgagggcaggcgccattttcgtacccatccacctagtgaaggagcgccttttcccaaggctgcctcctgccagcgtagatcatgtgctgcaggagcaccgcgtcgagttgcgtcccaccactttgtctgaggagcgggccctgagagagctggcactgcctggatgtacatcacgaatgctgaaactcctggccttacgacagctgccggatatttatcccgacttgttgggtctgcagtggagggattgcgtgcggcggcaactcggcgacttcgacacagaggctggagccgtgtcatctagtgaacccaccgtggcgaggggggaaccagaatccctggcgctggcccagaagtcacctgcccctaaggttcggaaacccggaaggaagcccccaacaccaggaccagagaaggccgaagcagcagccggagaggaaagttgtggagcgtctcctactccagctacgagcgccagtccacctggtcccactttgaaggccagattccgcagcttgctcgaaaccgcctggttgaacgggctagcattgccaacatgggggcataaaagtagcaggccagaccaaccatccccctgcccacagcttttagattctcagtcacaccatctgtag

SEQ ID NO: 45183 - DNA, 1338 bp, Artificial Sequence
  Description of Artificial Sequence: Synthetic coding sequence
atggacgtgcccgacgtgggcaacatggtgagcgacctgcccggcctgaagaaaatagacacagaagctccgggccttccgggggtgcctgtcacaaccgacgccatgccccgtacgaatttccactctagcgtcgcctttatgttccgtaagtttaagatccttcgacctgcacccctgcctgccgcagtagtcccctccactccaacaagcgctcctgccccaactcaaccagcgcccacaccaacctctgggccaatcggcttgcggattctggctcagcagccactgagcgttacttgtttttctctagctcttccttcacctcctgccgtggcggtggcctcccccgcgcctgccccggcaccgagcccggctccagccagagcccaggccccagcaagcgcccgggatcctgcacctgcccccgcccccgttgcaggccccgctcctgcttctacatccgcccccggcgattctctggaacagcacttcacaggattacacgcatcactgtgtgacgctatctccggttctgtggcgcattccccacctgaaaaactccgggagtggctggagacggccggcccatgggggcaggccgcctggcaggattgccaaggagtccaaggcctcctggcaaaacttctgtctcagctacagcggtttgacagaacccaccgctgcccgtttcctcacgtcgtaagagctggcgccatctttgtccctattcacctcgtgaaggaacggctcttcccaaggctcccacctgcctcggtcgaccacgtgttgcaagaacatagagttgaacttaggccaactacactgtccgaggagagggcgctgcgggaactggcactgccaggatgtacttcaaggatgttgaaactgctggccctgcgacagctgcctgacatctacccggatctactcgggctccaatggcgggactgtgtcagaaggcaactcggggacttcgacaccgaagcaggcgccgtcagctcctctgagcctacggttgcacgcggtgagcccgagagtctcgcccttgctcagaaaagcccagctccgaaggtccgaaaacctggccggaaaccccccacacccggtcccgagaaggccgaggctgccgcaggtgaggagagctgtggcgcatcacccacacccgctacaagtgcttcaccgccagggccaactctcaaggctaggttccgtagtctgcttgaaacagcgtggcttaacgggctcgctctgccaacatggggtcataagtcctcccgtcccgaccagccatcaccctgcccacaactgttggatagccagtcccatcacctgtag

SEQ ID NO: 45184 - DNA, 381 bp, Artificial Sequence
  Description of Artificial Sequence: Synthetic coding sequence
atgcccaagaaggccggcgccaccaccaagggcaagagccagagcaaggagcccgaacgcccgttgcccccactaggcccagtcgctgtggacccgaaagggtgtgtcacgatcgctatacacgccaaacccgggagtaaacagaatgcagtgactgaccttaccgccgaggccgtgaatgtcgcaatcgccgccccgccgagcgaaggcgaagccaacgcagaactctgccgttacttgtctaaggtacttgagctccggaagtctgacgtcgtgctggacaagggggggaaaagtcgggagaaagttgtgaagctgttggcgtccacgactccggaagaaatattggagaagctcaagaaggaggctaaaaaaacgtag

SEQ ID NO: 45185 - DNA, 504 bp, Artificial Sequence
  Description of Artificial Sequence: Synthetic coding sequence
atgctgcggctgcggagcggcctgcggcacctgcgggccacccccaatactcgcggctccgcaaggttgctttgcgctgagatgccaaagaaggcaggggctaccaccaaggggaaatctcaaagcaaagagccagagcgcccactgcctcccttgggacctgtcgccgtggacccaaagggatgtgtgaccatcgcaatccacgctaagcctgggtctaagcagaatgctgtgactgatctgactgccgaagccgttaatgtcgccatcgccgctcccccctcagaaggtgaggctaacgctgaactctgcagatatttaagtaaagtgttggagctgcgcaaaagcgatgtggttttggataagaccgggtcttgttatatcgcacaggcaggactagaacttcttgcatcttccgacttgcctgcctccgctagccagtccgctgggatcaccggcgtgtcgcatcacacacagcctgccctgctcttgatctctctatag

SEQ ID NO: 45186 - DNA, 462 bp, Artificial Sequence
  Description of Artificial Sequence: Synthetic coding sequence
atgctgcggctgcggagcggcctgcggcacctgcgggccacccccaatacccgcggttccgcccgcttactgtgtgccgaaatgccgaaaaaggcaggcgcgactactaagggaaagtcccagagtaaagagccagagagacccctgccccctctgggacccgtcgccgtcgatcccaaagggtgtgttaccattgcaattcatgcaaaacctggctccaaacaaaacgcggttaccgacctgaccgccgaggccgttaatgttgccattgctgcgcccccatctgaaggggaggccaatgccgagctttgtcggtacctgtctaaggtgctcgaactacgcaagtcagacgtcgtcttagataaaggcggcaaatctcgggagaaagtagtgaagttgctcgcaagcaccacaccagaagagatcttggagaagctaaaaaaggaagctaagaagacttag

SEQ ID NO: 45187 - DNA, 450 bp, Artificial Sequence
  Description of Artificial Sequence: Synthetic coding sequence
atgctgcggctgcggagcggcctgcggcacctgcgggccacccccaatactcgaggatcggcaagactcttgtgcgcagagatgccgaaaaaggccggagccacaacaaaaggcaagtctcagtcgaaggagcctgagcggccccttccccccttgggacctgtagctgtcgaccccaagggatgtgtaacaatcgctattcacgccaagcccgggtcaaaacaaaatgcggtcaccgacttgaccgctgaagctgtgaatgtggccatcgcagccccaccctccgaaggcgaagccaacgccgagttgtgtcggtacttatcaaaagtcctcgagttacgaaaatcagatgtggttcttgacaagctttgctatagcatcccccagcagttagaggaaactcaagaaggagtctccggtatacccgataccccctgtcacttcttgtag

SEQ ID NO: 45188 - DNA, 552 bp, Artificial Sequence
  Description of Artificial Sequence: Synthetic coding sequence
atggcccggctgatcctggagcggttcctgcaggagcacgaggagacccccccttcgaaatccatcattaacagtatgctgcgcgacccctctcagatccctgacggcgtgctggccaatcaggtctaccagtgtattgtgaatgattgctgctacgggccactagtcgactgtatcaaacacgctattggccacgagcatgaggtcttgcttcgggacctgcttcttgagaagaatctttcattccttgatgaagaccagctgagagctaaggggtatgacaagacaccagatttcattctgcaggtacccgtcgctgtagaggggcacattattcactggatcgagtctaaggcctcctttggggacgagtgtagccatcacgcttatcttcacgatcagttttggagctattggaataggtttggtccgggtctggtcatctactggtacggattcattcaggagcttgactgcaatcgcgagcggggcatactgctaaaggcttgcttcccgactaacattgtaactctatgtcattccatcgcctag

SEQ ID NO: 45189 - DNA, 846 bp, Artificial Sequence
  Description of Artificial Sequence: Synthetic coding sequence
atgatcctgaccaaggcccagtacgacgagatcgcccagtgcctggtcagtgtgcctcccacacgccaatcgctcagaaaactgaagcaacgctttcccagccaaagccaggctactctgctgtcgattttctctcaggagtatcagaagcacatcaaacggacacacgcaaaacaccacacaagcgaggctatcgagagctattatcagcgttatttgaacggggtggtcaagaatggggccgcccctgttttgttggatctggcaaatgaagtagactacgccccaagcctgatggctcgactcatattagagcggtttctccaagaacatgaggagactccacctagcaagagcattattaactccatgctccgggatcctagtcagattcccgacggcgtgctcgctaaccaggtctatcaatgtattgtaaatgattgttgttacggtccgcttgtggactgcattaaacacgcaattgggcacgaacacgaggtcctgctgagagacctgctgcttgagaagaatctttcgtttctcgatgaggatcagctgcgcgcaaagggctatgacaagactcccgactttattctgcaagtccctgtggcagtcgaaggtcatataattcactggattgaaagcaaggcgtcattcggggatgaatgttctcaccatgcatacctccacgatcaattctggtcatactggaatcgattcgggcctggtttggtcatttactggtatgggtttatccaagagctggactgtaatcgagaacgcggcatcctccttaaggcctgcttccccaccaacatcgtgacgctatgtcattcaattgcatag

SEQ ID NO: 45190 - DNA, 552 bp, Artificial Sequence
  Description of Artificial Sequence: Synthetic coding sequence
atggcccggctgatcctggagcggttcctgcaggagcacgaggagacgcctccaagcaagtcaatcataaattcaatgcttagagatccttcacagattcctgatggagtgcttgctaaccaggtgtaccaatgtattgtgaacgactgttgctacggcccacttgtcgactgtattaaacacgcaattggccacgagcatgaggtgctgcttagagacctgctgctggaaaagaacctctcttttctcgacgaagatcaacttcgtgctaagggatacgacaagacacccgatttcatcctgcaagtgccagtagcagtggagggacatataattcattggatcgagtccaaagcgtctttcggcgatgagtgttctcaccacgcctacctgcatgatcagttctggagttattggaatcgctttggacctgggctcgtgatctactggtatgggttcatacaggaactcgactgtaacagggaaagagggattctgcttaaggcatgctttcccactaatatagtcaccctctgccactcaattgcatag

SEQ ID NO: 45191 - DNA, 663 bp, Artificial Sequence
  Description of Artificial Sequence: Synthetic coding sequence
atgttccagggccagcggggctggttctgcggcagcgtgagccaggatctgcgccaattctgggtggcagaaggaggaactattagtgacccacgcgccgccgattttttattctcatgcgacgcatctcaccctgatacattgcgaatttatcagtcactggactatatcgaggacaatgcaacggtctttcatgcctattacctgagtgcagtcgccaacgctaaaatcaaaaatagcgtggccttgggccacttcattcttcccccagcatgtttgcagaaagagataaggcgaaaaatcggatcatttatttgggaacaggatcagcacttcctcattgaaaagcacgatgaggtgacccctaatgagatcaaaacccttcgcgagaactcagaactggccacagagcataagaaggagctctccaagtctcccgaaaaacatttcattcgcactcctgtggtggagaaacagatgtactttcctttgcagaactatcccgtgaataacatggtcactggatacatttcaattgacgctatgaaaaaattcctcggagagctccatgacttcatccccggtacctcaggttatttggcctaccacgttcaaaacgagatcaatatgtccgcaatcaaaaacaagcttaaacgcaagtag

SEQ ID NO: 45192 - DNA, 1557 bp, Artificial Sequence
  Description of Artificial Sequence: Synthetic coding sequence
atgcccaccgtggtggtgatggacgtgagcctgagcatgacccggccggtgagcattgaggggtcagaagagtatcaacgcaagcacctggcagctcacggtctgactatgctgtttgagcacatggcaaccaattataagctggaatttacagccttagtggtattttcgtccctgtgggaactcatggtgccttttactcgcgactataacactttacaggaggctttaagtaacatggacgactacgacaagacctgtttggaatccgctctggtgggtgtgtgcaacattgtccagcaggagtgggggggcgctataccttgccaagttgtcctggttactgacggctgtctggggatcggccgcggcagcctgagacactccctcgctactcaaaaccagcggtccgagagtaatcgatttccactaccttttccctttccaagcaagctctatatcatgtgtatggccaatctggaagagttgcaatccacagactccttggagtgtttggaaagactcattgacttgaacaacggggaaggacagatcttcacaattgatgggcctttgtgtctgaaaaacgtgcagtcaatgtttggcaagctaattgacctggcgtatacccccttccacgcagtccttaaatgcgggcacctgacggcagacgtgcaggtgtttcccaggcctgagccttttgtggtggacgaagaaatcgaccccatacccaaagtgataaacactgacctggagattgtcggatttattgatatcgcagacattagctctcctcccgtcctttccaggcatcttgtgctgcctatcgcgcttaataaggagggcgatgaggtgggcaccggtatcaccgatgataacgaggacgagaattctgccaaccagatcgccggcaagattcctaacttctgtgtgctcctccacgggagcctcaaggtggagggaatggtggccatcgtgcagcttggcccagagtggcacgggatgctgtacagccaggccgattctaaaaagaagagcaacctcatgatgtctctttttgaacccggccccgagcccttgccttggttgggcaaaatggcccagttaggccctatctctgatgcaaaagaaaacccctatggggaagacgacaataagagcccattcccactgcaaccgaagaataaacggtcatatgctcaaaacgttacagtgtggatcaagccttccggcctccagacagacgttcaaaagatcctgcggaacgcccggaaactaccagagaagacccaaaccttctataaggaactgaatagactgagaaaggctgcactggcttttggcttcctcgacttgcttaagggcgtagcggacatgctagaacgcgagtgtacactcctccccgagacagctcaccccgatgccgcatttcagctcacacacgccgcccagcagctcaagctcgcaagcaccggaacgtctgaatatgctgcctacgaccagaacatcacgcccttgcacaccgacttttctggtagttctaccgagcgtatatag

SEQ ID NO: 45193 - DNA, 1557 bp, Artificial Sequence
  Description of Artificial Sequence: Synthetic coding sequence
atgcccaccgtggtggtgatggacgtgagcctgagcatgacccggcctgtttctattgaaggctccgaggaataccaacgcaaacacctggctgcccatgggctgacgatgctgtttgaacacatggccacaaattataagcttgagtttaccgccctcgtggtttttagtagtctttgggaactgatggtccccttcacccgcgattataataccctgcaagaggctcttagcaacatggatgactatgataagacttgccttgagtccgctctggtaggcgtgtgtaatatcgttcagcaggagtggggtggcgcaattccgtgtcaggtggtgttagtaaccgatgggtgcctcggtattggccgggggagcttacgccactcattggctacgcaaaaccagagaagtgaatccaatcgattcccgcttccctttcccttcccctcgaaactatatattatgtgtatggccaaccttgaggagttacaaagcacagattccttggaatgcctagagaggctcattgacctgaataatggcgaagggcagattttcacaatcgatgggcctctgtgtctcaagaatgtgcagtcaatgttcggtaaactgatcgatctcgcttatacaccttttcatgcagtgttaaaatgtggccatttaaccgctgatgttcaggtcttcccacggcctgagcctttcgtagtggacgaagaaatagatcccattccgaaagtcattaacaccgatctggagattgttggctttatcgacatcgctgacatctctagcccccctgtgttatcaagacatctagtgttaccaatagctcttaacaaggaaggagatgaagttggcaccgggataaccgacgataatgaggacgaaaattcggcgaaccagattgcagggaagatcccaaatttttgtgtactgcttcacggcagtctgaaggtcgaagggatggttgccatcgtgcagttgggccccgagtggcatggcatgctctactctcaagccgactcgaaaaagaagtctaacctaatgatgagccttttcgaaccagggcccgaaccattgccctggctggggaaaatggctcagcttggccccataagcgatgctaaggagaacccttacggggaggacgataataagtctccgttccccctgcagccaaagaacaaacgtagttatgcacagaatgtgacggtgtggatcaaaccaagcggccttcagacagatgtgcagaagatcctgagaaatgctaggaaactgcccgaaaagacccagacattttacaaagagctgaataggttgcggaaagcagccttggcttttgggttcctcgacctgctgaagggggttgctgatatgctagagagagaatgcactttgctccccgagacagcccatcctgatgccgcttttcagctgactcatgccgcccaacagctaaaactggccagcactggtacgagcgagtatgctgcctacgatcagaacattactcctcttcacaccgacttcagcggttcttctactgagcgcatctag

SEQ ID NO: 45194 - DNA, 1386 bp, Artificial Sequence
  Description of Artificial Sequence: Synthetic coding sequence
atgcccaccgagagcctgtgccggcggaccgtgagcggcgacggccacggggaggccttgagcaacatggatgactatgataaaacctgtctcgagagtgccctagtgggcgtctgtaatatcgttcagcaggagtggggcggtgctataccttgtcaagttgtgcttgttaccgacggatgtctcgggatcgggagaggatccctgcgacattctttggcaacacagaatcagcgatctgaatccaatagattccccctcccattcccctttcccagtaaactgtacatcatgtgtatggctaatttagaggagttgcagtctacagactccctggaatgtctggagcgattgattgacctgaataatggcgaaggacagatcttcaccatcgatggaccactttgcctcaaaaatgtccagagcatgttcgggaaacttatcgatctggcctatacacccttccacgccgtactgaagtgtgggcacctgaccgctgatgtacaagtgttcccgagaccggaaccgttcgtcgtggacgaagagatagacccaatcccaaaggtgattaacacagatttggagatcgtaggcttcatcgacattgctgatattagctctcccccagtccttagccgccatcttgtcctgcccatcgccttaaataaggagggcgacgaagtgggtacgggtatcactgatgataacgaggacgaaaactcagctaatcaaattgcaggaaaaatcccgaatttttgcgtcctcctccatggctcgctgaaagttgaaggcatggtggcaatcgttcagcttggtcctgagtggcatggcatgctgtactctcaggccgattccaagaagaagtctaacctcatgatgagcttattcgagccgggccctgagccgttgccctggttgggtaagatggcacagctgggccccataagtgatgctaaagaaaacccctatggcgaggatgacaataagagtccgttcccacttcagccgaagaataagcgcagttacgcacagaacgtgaccgtgtggattaaaccctcagggctacagacggatgtgcagaaaattcttcgcaacgctcggaaacttcccgagaaaactcagactttctataaggaactgaacagactgaggaaagccgctctggcattcggcttcctcgatttgctcaaaggagtcgccgacatgctagaacgagaatgtacccttctgccagagacagcccaccccgatgccgcctttcaacttactcatgctgcgcagcaattaaagctggcctccaccggcacttccgaatacgctgcttatgaccagaacatcacaccgctacacactgatttttccggctcctcgacagagcggatctag

SEQ ID NO: 45195 - DNA, 1320 bp, Artificial Sequence
  Description of Artificial Sequence: Synthetic coding sequence
atggacgactacgacaagacctgcctggagagcgccctggtgggcgtgtgcaatatcgtccaacaagagtggggcggggcaatcccatgccaggtcgtgctagtgacagacggctgcctcgggataggtcgaggctccctgcgccactctctggccacgcaaaaccaacgcagtgagagcaaccgatttcctttgcctttccctttccctagtaaactgtacatcatgtgcatggcaaacctggaagaactccagagcaccgacagtctcgagtgcctcgagcgcctcatcgacctgaacaatggggaaggccagatcttcaccatcgacggaccactttgcctgaaaaacgtccaaagcatgttcgggaagttgattgacttagcttacacaccatttcatgccgtgctgaaatgtggccacctgacagccgacgtgcaggtgtttcctcggcccgagcccttcgtcgtagatgaggagattgaccccatccctaaggttataaataccgacctggaaatcgtcgggtttatcgatatcgctgacatttccagcccaccagtgctcagtagacatcttgtcttacctattgccctaaacaaggagggggatgaagtgggtactggcatcacagatgacaacgaggacgagaatagcgctaaccagattgctggcaaaattcccaatttctgtgtgctcttgcacggttcactgaaggtcgagggcatggtggccatagtgcaactggggccggagtggcacggaatgctgtactcacaagcggactcaaagaaaaagagtaatctcatgatgagcttgtttgaacccgggccagaaccgctcccgtggttggggaaaatggctcagttgggcccaataagcgatgccaaggaaaacccctacggggaggacgacaataagtccccctttccactgcagcctaaaaacaagagaagttacgctcagaatgtgaccgtgtggatcaaaccatcaggcctgcagacggacgtccagaagatactgcgaaatgctaggaagcttccagaaaaaactcagactttttacaaagagctgaataggttgcgcaaggcagcactagcttttggatttcttgatcttctgaagggcgtcgctgatatgctcgagcgggaatgtaccctcctccccgagactgctcacccagacgctgcattccagctcacacatgctgcccagcagctgaagctcgcctctacaggcacgtcagagtatgctgcttacgatcagaatataaccccgctccatactgacttttctggaagctctacagaaagaatttag

SEQ ID NO: 45196 - DNA, 1449 bp, Artificial Sequence
  Description of Artificial Sequence: Synthetic coding sequence
atgcccaccgtggtggtgatggacgtgagcctgagcatgacccggcccgtcagtattgaagggagcgaggagtaccaacgcaagcatttggcagctcatgggctgacgatgcttttcgagcacatggccaccaattacaaactggagttcacagctctggtggtgttctcctctctttgggaactgatggttccatttacaagagactacaatacactccaggtcgtgctcgtgactgacggctgcctgggcatcgggcggggatcgctacgtcattcactggcgacccagaatcagagaagcgagtccaaccggtttcctcttccgttcccttttccaagcaagctgtacatcatgtgcatggccaatctcgaggagttgcagtccactgattcgttggagtgtctggagaggctgatcgatctgaacaacggcgagggccaaatcttcactattgacggccccctctgtcttaaaaacgtgcaaagcatgtttggcaaattgatcgacctggcctatactccctttcacgccgtactcaagtgcggacacctgacagccgacgtccaggtatttccgcgccccgaaccattcgttgtggacgaggagatcgatccgatacctaaggtaatcaacactgatctggagatcgttggatttatagacattgctgacatcagcagcccgccagtgttatcccgacacttagtactgcccatcgcccttaacaaagaaggggatgaggtaggaactggaataaccgatgataacgaggatgagaatagcgctaatcagatcgctgggaagatccccaacttctgtgttctgctgcatggcagccttaaggttgagggaatggtggcaattgtgcaactgggaccagaatggcatggcatgttatattctcaagccgactcaaagaagaagtcaaatctgatgatgagcctgtttgagccaggccccgagccccttccatggttgggcaaaatggcacagctcggtccgattagtgacgctaaggaaaatccttacggggaagacgataacaagtcaccattccctctacagccaaaaaacaagcggtcttatgctcaaaatgttacggtctggatcaagcctagtggcctgcagactgatgtccagaaaattcttcgaaacgcaaggaagcttccagagaagactcagaccttctacaaagaactgaacaggctgaggaaagcagcactcgccttcggattcctggacctgttaaagggcgttgccgacatgctggagcgcgagtgtactttgctcccggagaccgcccaccccgacgctgcctttcaacttactcatgcagcacagcagctgaaattagcatcaactgggacttccgagtacgccgcctacgatcaaaatattacaccattgcacaccgatttttctggaagttctacagagcggatatag

SEQ ID NO: 45197 - DNA, 774 bp, Artificial Sequence
  Description of Artificial Sequence: Synthetic coding sequence
atgcccctggcctgcgagcaccccgtgggcgtgagcagcagcgtgggtaatgccggacgtgcaggggtagggactcaggcttggggaacgaccgagaggacccagcatcctggacctgcccagcactgtccgtgcggtctgcgcgtcttcgtcttgcaggagaagcgtgtggttagtaggaattgggcacgggggacctgcggcccgagggtgaccaatgaaatgctggaagatgaggacgcagaagaccatggggggacattttgcctaggagagttggtggaacttgctgtgaccatggaaaacaaggctgagggcaagaggatcgtatctgaaaagccaactcgggcccgcaatcagggtattgaaggttctcccgggggccgggtgactaggtcacctcccacccaagtagctatttcctctgacagcgccaggaaggggtcttgggaaccctggagccgccccgtgggggaacccccggaagccgggtgggactacgcacaatggaagcaggagagagaacagatcgatcttgctcgcctggctcggcatcgcgacgcccagggggattggaggaggccatgggacctggataaggctaaatcaactctccaagattgtagccaactgcggggtgagggccccgcccgggccggcagccggcggggtgagcccactcctacttcctctcttccaagtctggccctgtttattttccatcccctggtgctcagcttcctgtgcttgctggtttcatactttcagtcatag

SEQ ID NO: 45198 - DNA, 975 bp, Artificial Sequence
  Description of Artificial Sequence: Synthetic coding sequence
atgcggcaccgggagggcagctgggagccctggagccggcccgtgggggaacctcctgaagccggatgggattacgcacagtggaagcaagaaagagaacagatcgatctcgcccgcctggccagacatagggacgcgcagggtgattggcggcgcccttgggacctggataaagccaagtctaccctgcaggattgcagccagctgcgtggagaggggccagccagagccgggtcaaggcgggggccccggagccaccagaagctgcagccgccccccctgctgccggacgggaagggaagagggggacaggcgtcccggccctcggtagcccccgcgaccgggtcaaaggctcgaggaaaagaacgactcactggcagggccaggagatgggatatgaaggaagacaaagaagagctggaagggcaggagggaagccagtccacgcgcgaaacaccaagtgaagaagaacaggcccagaaacagtctggcatggaacagggacgtctgggttccgcccctgctgcctctcctgccttggcttctcccgaagggccaaaaggcgaaagcgtcgcctctacagccagcagcgtaccttgtagtccccaagagccggacctagccccactggatctgtctctgggaggagcaggaatccccgggcctcgtgagtcgggatgcgtcctgggtctgcgtccaggggcccaggagagtcccgtctcctggccagagggtagcaagcagcagcctctgggatggtcgaaccatcaagccgagctggaggtgcagacctgccccgagccccagcgcggagcggggctcccagagccaggcgaagacagatctggcaaatcaggagcccagcaggggctggccccccgaagccggcctacacgtgggggctcacagagatcccgaggaacagccggcgtcagacgtaggacaggtaggcccggccccgccgggcggtgttag

SEQ ID NO: 45199 - DNA, 1605 bp, Artificial Sequence
  Description of Artificial Sequence: Synthetic coding sequence
atgatcagctgcgccgagcagcggagccggcagggcgaggccggccggggtcctgcccccgtcgcgcctgcgttcctgccactttggctgccccggggttgttcgggcatcctcagcgtccctgcagtggctatgcatagcgcaggcacaccaagggccgaaagcccaatgtccaggcaggaaaaagatgctgagctggaccgccgcatagtggctctccgaaaaaaaaatcaggccttattgagacgctaccaggaaatccaagaagatcgccgacaagccgaacagggaggcatggcagtcaccacgcctgccctgctgcaacctgatggcctgactgtaaccatcagccaggtgccaggagagaaaagggtcgtttctcggaactgggcccgtggtacttgcggcccacgcgtgacgaatgaaatgcttgaagacgaagacgccgaagatcacgggggcacgttttgcttgggcgaattggtagaactggccgtcacaatggagaataaggcagaaggtaagcggatcgtgtcagagaagcctacgagagcccggaaccaaggaattgaagggtcccccgggggtcgcgtgactcgatcacccccaacccaagtagccatctcctctgattctgcccggaaaggatcctgggagccttggtctcgccccgttggggaacctcccgaggcaggttgggattatgcccagtggaagcaggagcgcgaacaaattgacttggcccgcctggcccgacatagagatgctcagggcgactggaggcgcccgtgggatctggacaaggcaaaaagtaccctgcaggactgctcccagttacgtggcgaggggcctgcccgcgcagggtcgcgaagaggaccccgatcacatcaaaaactccagccaccccccctgctgcccgacggaaagggaaggggcggacaggcctctaggcctagtgttgccccggcaacaggcagcaaggcgagggggaaggagcgactgaccgggcgagcccgccggtgggacatgaaagaggacaaagaggagctggagggccaggagggctcgcagagcacacgggagacccccagtgaggaggaacaggctcaaaagcaaagtgggatggaacagggacgccttgggtcggcaccggcggcatccccagctctggcgtccccggaggggcctaagggtgagtccgttgccagtactgccagttctgtgccctgctctccgcaggagccagacctagctccccttgaccttagccttggcggagccggcatccccggtcctagggaatctggctgcgtcctcggactccggcctggagcccaggagtcacccgtgtcctggcctgaggggtccaagcagcagcctctggggtggtcaaaccaccaagctgagttggaggtgcagacctgtcccgagcctcagcgcggtgctgggctgcccgagcctggggaggatcgctccggaaaatccggtgctcaacaggggcttgcacctcggagcagacccacaaggggtggctctcagcgcagtcgagggacggctggggtacggcgacgcaccggccgcccggggccagcaggaaggtgttag

SEQ ID NO: 45200 - DNA, 540 bp, Artificial Sequence
  Description of Artificial Sequence: Synthetic coding sequence
atggagctgcagggcgcccaggaggacctgggcatcagcctgagctcccccagacggaaccatgagactaggcccggcagtaaagctaagggccgaagctccatatgtttgcaggcaagcgtgtggatggcaggagggaaattgaggctgcgggcctcagagcatctgacccaagggcatcagcaggagttacgcgactggaacttaggagaggatgcctcacttctgtttagtaaatccccattcggagccggcaaacttatccaggctcccgcccatgtgttcagacagtgttgggtacagggtaacgcctggatatcctgtatcaccaagtttgactcaaagcgctcgccagaggttgcctcatctccatcatatctgacagtcccaagaaggtcgccactgcccgtgtttctgcgtccttccgatagatgcgtctgtggcggctgctaccttggaaagtcaacacggcgcagggcctgtcagagtctgctgagcgaccccctcggtgtaacatttccgacccagacccgcccttag

SEQ ID NO: 45201 - DNA, 552 bp, Artificial Sequence
  Description of Artificial Sequence: Synthetic coding sequence
atggaggtgaagttcatcaccggcaagcacggcggccggcggccccagagggccgagccccaacgaatctgtagagctttatggcttaccccatggcccagcctgatcctgaagctgctgtcttggattattctgagcaacctttttctacacctccgggccacacaccacatgactgagctgcctctgcgattcctttatattgcactgtcagagatgactttcagggagcagacttcacaccagatcatccagcagatgtcgctcagcaacaaactcgagcagaatcaactatacggggaagtgatcaataaggaaaccgataaccccgtcatctcttccgggctgactctgctcttcgcccagaaaccacagagtccggggtggaagaacatgtcctccaccaagcgcgtgtgtactatcctggctgactcctgcagagctcaagcacacgccgctgaccggggcgagcggggtcattttggggtccagattttgcaccactttatcgaggtgtttaatgtgatggctgttcggtccaatccattttag

SEQ ID NO: 45202 - DNA, 552 bp, Artificial Sequence
  Description of Artificial Sequence: Synthetic coding sequence
atggaggtgaagttcatcaccggcaagcacggcggccggcggccccagagggccgagccacagcgcatctgtcgggctttgtggctgacaccctggccgagtcttatcctaaaactcttgagttggataatcttgtccaatctattcctccacctcagggccacccaccatatgaccgagttgcctttgcgattcctttatatcgctctctcagaaatgacattcagggagcagactagtcatcaaataattcaacaaatgagtttaagcaataagctcgaacagaatcagttatacggggaggtgattaataaagagacagacaaccccgtgataagttcggggttaactctgctgtttgcccaaaaaccccagtcaccaggttggaaaaacatgtccagtacaaagcgtgtgtgcaccattcttgcagacagctgccgtgcacaggcccacgccgcagacagaggggagcgtggacacttcggcgtgcagatccttcatcattttatcgaggtgttcaacgtcatggctgtgagatctaacccattctag

SEQ ID NO: 45203 - DNA, 486 bp, Artificial Sequence
  Description of Artificial Sequence: Synthetic coding sequence
atgccccgggccggccgggcccccgccgagggcggccccgcccccggtacccgcagttcacgttgccttcgcccccggccactggcgtggagaagactcgtgccgaatttcggggcgtgggccccccggaagggagccgcccgcgtgggcaggcccgttctgtcccctcgtacaagcggagctgccggtgaacctacctgcggggccggctcaccagggaccctggaagaaggagtggcctccggtcgcactcggcgtaggacacagagcgctggtgaggttgcaaagtgcaggtggggtctcggccaggagcctctttgtcctagaggagcagtgttattgaactcgttctcaccgcctgcctggccccaatttccgcccgccttgagacttagagctctagcctggccacaaccccggggtccagcctgcgggagcacagcacagtggcccccccggggggacccgacctggaggatctcttag

SEQ ID NO: 45204 - DNA, 558 bp, Artificial Sequence
  Description of Artificial Sequence: Synthetic coding sequence
atgaagatgttcgagagcgccgacagcaccgccacccggagcggccaggatttgtgggccgagatttgttcatgtctgcctaacccagaacaggaagatggagccaacaatgccttctccgatagcttcgtggacagttgcccggagggcgagggacaaagggaggtcgccgatttcgcggtgcagccagctgtgaaaccgtgggctcctctgcaggactcagaagtttatcttgcatccctcgaaaaaaaattgaggcgtattaaggggctgaatcaggaagttacctcaaaggatatgcttcgcacacttgcacaggcaaagaaagaatgttgggatagattcttacaggaaaagctggcctcagagttctttgtagacggactcgatagtgacgagagcactttggagcattttaagcgctggcttcagccagataaagtcgccgtgtctaccgaggaggtacagtacctaattccacccgagtcgcaggtggagaaacctgtggccgaggatgagcctgctgcgggggacaagcctgccgcggccgaacagtag

SEQ ID NO: 45205 - DNA, 558 bp, Artificial Sequence
  Description of Artificial Sequence: Synthetic coding sequence
atgaagatgttcgagagcgccgacagcaccgccacccggagcggccaagacttatgggccgaaatttgttcatgtttacctaaccccgagcaggaagacggagcgaacaatgcattttctgatagcttcgtggattcctgcccggagggtgaaggtcagcgcgaggtggcagattttgccgtgcagccagcggtgaaaccctgggctccattgcaagatagcgaggtatatttggcttccctggaaaagaagcttcgcagaattaaaggattaaatcaggaggtgacatctaaggacatgttaaggaccctagcccaggcaaagaaagagtgttgggaccgctttctccaggaaaagctcgcttcagaattcttcgtggacggtctcgactccgacgagtccacattggagcacttcaaaaggtggttgcagccggacaaagtcgctgtttctaccgaggaagtgcagtaccttattcctcccgaaagtcaggtcgaaaaacctgtagcagaagatgagcctgccgcgggcgacaaacccgcagcagctgaacagtag

SEQ ID NO: 45206 - DNA, 585 bp, Artificial Sequence
  Description of Artificial Sequence: Synthetic coding sequence
atgcggggcagcggcctgcggttccagatgaagatgttcgagagcgccgatagcactgctacaagaagcgggcaggatctgtgggcagaaatatgcagttgtttgcctaaccctgaacaggaagacggcgcgaacaacgcattttcagatagcttcgtggatagttgccccgagggcgaagggcagcgcgaagtcgcagacttcgcggtgcagccagctgtgaagccctgggctccactgcaggatagcgaggtttaccttgccagtctggaaaaaaagctgcgcagaattaagggactgaaccaagaggttacaagtaaagatatgttgagaactttagcccaagccaagaaggaatgttgggatagattcctgcaggagaagcttgccagtgagttttttgtggatgggctggacagcgacgagtccaccctggagcactttaagcggtggctccagccggataaggttgcagtttctaccgaagaggtccaatacctgatccctcctgagtcccaggtggaaaaacccgttgccgaggatgagcccgcggcaggcgacaagcccgctgcagccgagcagtag

SEQ ID NO: 45207 - DNA, 405 bp, Artificial Sequence
  Description of Artificial Sequence: Synthetic coding sequence
atgaagatgttcgagagcgccgacagcaccgccacccggagcggccaagacctctgggcagaaatatgctcttgccttcccaatccagagcaggaagacggcgcaaataatgccttcagcgatagcttcgttgattcttgtcctgagggcgagggccagcgcgaagtggctgactttgcagtgcagcccgccgtgaaaccatgggcccccttgcaggattctgaggtgtacttggcctctcttgaaaagaagttacgccgaataaaaggcctcaatcaagaggtgacctcaaaagatatgttgagaacactggcgcaggcaaaaaaagagtgttgggaccggttcctccaggagaaactcgctagcgaatttttcgtggatggactggactccgacgaaaggtag

SEQ ID NO: 45208 - DNA, 513 bp, Artificial Sequence
  Description of Artificial Sequence: Synthetic coding sequence
atgaagatgttcgagagcgccgacagcaccgccacccggagcggccaggatctgtgggccgagatctgcagctgtctcccaaaccctgaacaggaagacggggccaataatgccttctcagactcatttgttgactcatgtccagagggcgagggccagagagaagtagccgactttgctgtgcagcctgccgtcaaaccttgggcgccactgcaggacagcgaagtctacctggcctctttagaaaagaaactgagacgcatcaagggcctcaaccaagaggttaccagcaaagacatgctgcggactctagcacaagccaagaaggagtgctgggatagattcttgcaagaaaaactggcgtctgagtttttcgtcgatgggctggacagcgacgagagcacactggagcatttcaagcggtggctgcaacccgacaaagttgcagtgtcaacggaggaggttcagtatctcatcccccccgagagccaggtagagaagccagtcgcttag

SEQ ID NO: 45209 - DNA, 882 bp, Artificial Sequence
  Description of Artificial Sequence: Synthetic coding sequence
atgaacatccggggcgcccccgacctgggccagcccagcgacgaccccagctctggcggtgaaagggagcggatcaggcaacgcatgaagatggtgatcggacaacttgagggcatcctgcgtgagctgaaagaggtggctaaggaattacgtgaggtggtttctcagattgataagctgacatctgactttgattttgagctggagccagacgattggactacagcaaccgtcagttcaactagctcaagtgataaggccggcatgggcgggccctttgatttagggcaccttgacttcatgacggcagacatcctgtctgactcctgggagttctgctctttcctagacgtcagcacgccaagtgactcggtggacggacccgaatccacccgcccgggggctgggccagactacaggctgatgaacggaggtaccccgataccaaacggtccacgggttgagacccccgacagcagttccgaggaggcatttggagcaggaccaaccgtgaagagccagttgccgcagagaacccctggtactcgagaaagagtacggttcagcgacaaggtgctgtaccatgcactgtgctgcgacgatgaagagggggacggagaacaggaggtcgaggaggaagaggtaggactgccaccagagcccgcgcatacggaagcgcacgcggggccccacaaaccatcccctgccccgtataagtcccgaagatcccctttgacatcccgtcattccggatctaccttagcccccgagcagactcgtcgtgtgacgcggaatagcagcacgcagacggttagcgacaaatcaacccagacagtgcttccctatacagcaacaaggcagaaagccaggggaaaaaattag

SEQ ID NO: 45210 - DNA, 882 bp, Artificial Sequence
  Description of Artificial Sequence: Synthetic coding sequence
atgaacatccggggcgcccccgacctgggccagcccagcgacgacccctctagtggaggggagcgggagaggattcggcagcgtatgaagatggtgatcggtcagctggaaggcatcctgcgcgaactgaaggaggttgccaaggagttacgggaagtagtttcccaaattgataagctgactagcgattttgatttcgagctcgaaccagacgactggaccactgctaccgtatcctcaacaagtagcagcgacaaggctggcatgggcgggccctttgacttggggcatctggacttcatgacagccgatatcttgagtgacagttgggagttctgctcatttctagatgtgagtactccctcagattctgtcgatggacctgaaagtacacggccaggggctggccctgattacagactgatgaacggcggcaccccgatacctaatggcccacgcgtggaaacacccgattcctcaagtgaagaggcatttggggctggccccactgtgaaaagtcagctcccacagcggactcccggcacgagagaacgtgtgcgtttctctgacaaggtactgtatcacgccctttgctgtgacgatgaggaaggagacggagagcaggaggttgaggaggaggaagtaggactgcctcccgagccagcccacacagaagctcacgctggaccccacaaaccttcacccgccccatataaatctcggcggtctccgctcacctctagacacagtggctctaccctggcacctgagcaaacaagaagggtgacaagaaacagctcaacccagactgtgagcgacaaaagcacgcaaacggttcttccatacacagcgaccaggcaaaaagcccgcggaaaaaattag

SEQ ID NO: 45211 - DNA, 801 bp, Artificial Sequence
  Description of Artificial Sequence: Synthetic coding sequence
atggccgaggccggcaaggtgcccctgagcctgggcctgaccggcggagaggctgcagagtggccgctgcagcgctacgctaggtgtattccttccaatacaagagacccccccgggccttgcctcgaggccggaaccgccccttgtcccacctggaaggttttcgatagcaacgaagagtccggatatcttgtcctcacaattgtaatcagcgggcattttttcatcttccagggtcaaacattgctcgagggcttcagtttgattgggagcaaagattggctgaagatcgttaggcgcgtggattgtcttctttttgggacgacaattaaagataaaagcaggttattccgggtgcagttcagtggtgaatccaaggaacaggccttagagcactgctgctcatgtgtccaaaagctcgctcagtacattactgtacaggtgccggacgggaacatccaggaactgcagcttatacctggcccaccaagggctaccgagtcccaggggaaagacagcgccaagtccgtcccccgccagccaggctctcatcagcactctgaacaacaacaggtttgtgtgacagccggcactggggcgccagatgggcgtactagtctcacccaactcgcgcagacactgctcgcctccgaggagctgccacacgtatatgagcagtccgcctggggagctgaagagttgggtcctttcctgaggctgtgtttaatggatcaaaacttccctgctttcgtcgaggaggttgaaaaagagctgaagaaactcgcgggactccgaaattag

SEQ ID NO: 45212 - DNA, 390 bp, Artificial Sequence
  Description of Artificial Sequence: Synthetic coding sequence
atgcggcggcggggcgagatcgacatggccaccgagggcgacgtggaactggaacttgagaccgagacctcaggtcctgaacgtcctcccgagaagcctagaaagcacgattctggcgctgcggatttggaaagagtgacagattatgcggaggaaaaagagatccagagtagcaaccttgagacggcaatgtcagtgatcggggacaggagatcacgagagcagaaagctaagcaggaacgagaaaaggaactagccaaagtcaccataaaaaaagaggatttggagctgattatgaccgagatggagatttcaagagctgcagctgaaagatcccttcgtgagcatatggggaacgttgtggaagcccttatcgcacttactaactag

SEQ ID NO: 45213 - DNA, 390 bp, Artificial Sequence
  Description of Artificial Sequence: Synthetic coding sequence
atgcggcggcggggcgagatcgacatggccaccgagggcgacgtggaactagagttagagaccgagactagtggaccagagagacctcctgagaaaccccgaaagcacgatagcggcgctgccgacttggaacgagtgaccgattacgccgaggagaaagaaattcagagtagcaatctagagacagctatgagtgtaatcggcgacaggcgcagccgcgagcagaaggctaagcaggagcgtgaaaaggaactggccaaagtcacgatcaaaaaagaagatctggaactgataatgactgagatggaaatcagtagagctgcagcagagcggtcccttagagagcatatggggaatgtcgtagaggctctcattgccctgaccaattag

SEQ ID NO: 45214 - DNA, 1716 bp, Artificial Sequence
  Description of Artificial Sequence: Synthetic coding sequence
atgagccgggaggccggcagctgccgggtgggcaccggcgcccgggcccgctctcgtaaacccaagaagcctcactacatcccgcgcccctggggtaagccctacaactataaatgttttcaatgccccttcacctgcttggaaaagagccacctgtataaccatatgaagtatagtctgtgcaaggattccctgtctcttttactggattcacccgattgggcatgtcggcggggatcaaccacaccacgaccacacgccccaacgccagatcgccctggagagagcgacccagggcggcagcctcaaggagcgcggcccaccggcgccgctcccgcccctgacctagttgttgccgacatccatagcttacactgtggcggaggcccgaagtcaagggcgaaaggctctccaggtcccccccctcccgtggctcgcgccacccgcaaaggccccggaccatcgggcctcctgccagagagttggaagcctggaatgggcggagaccccaggggagtgggcgcaggtgacatggcctcagctggccccgaaggatcggtcccatgttaccccccgcccgcccccggcgagttcccggaagcccattccctccacctgtccttgctcggggttaactaccctctgtcacctggactcttctcatacctgggcccctcactggccgccgcagcccacgttccttttttggcctcagcaagtcctttattgccacccgcaaccgcatttcctgccgtccagcccccccagcgtccaaccccagcaccaagactgtattatcctttgctgctggagcacaccctgggactccccgccggtaaagccgcccttgccaaggctcccgtgagcccacgaagtccatctggcacacccgcccctgggttgttgaaggtccccgtgcccggactcggaccttggcctcgggtaacaccgcgggacccaggacaggagggagagttggaaagggcggctcagagcgacccaaggcgccgcctaagcctggggtctcgcctcgagctccccaaagcatccccttctcttacgagattttgttcacgttcaagcttacctaccggcagctcggtcatgctgtggccggaggacggcgatccgggcggcccggagacccctggcccggaagggcccctgccactccagccccgcggacccgtccccggttcccccgaacacgtgggcgaagacctgactagagctctcggtgactatgcaagagtggagcagagactgggccagttggggcctgccggtggcttggcacctagacctttgagggagcagctcggtaagattcgcctcgagcttctcacaattcatcaagccctcgaacaagccgtgaggccacccgacgcaccactggatctttcggtaaaacgcgcccccgcaaaaggcccccaggccctgggtgaagcatgggggcgaccagaactggggcctgtgctgaccggaggaacccccgaacccccagggatgctgggcccagccgcgccccagcccttctccggccataccaccaaatgcgaggctgacagtagcgtgccaccgcccgggctgccactcgcagctccggacgatccggtcatcccaggatccggatgggggacctgtgtagccacccgctctagtcagacccctgaagctgtctgcggactccagtccccgcagggcgccgaggtgtag

SEQ ID NO: 45215 - DNA, 615 bp, Artificial Sequence
  Description of Artificial Sequence: Synthetic coding sequence
atgctggtggccgccgccgccgagcggaacaaggaccccatcctgcacgtgttaagacaatacctcgaccccgctcagcgtggtgtgagagtgctggaagtggccagcggaagcggccagcatgctgcgcattttgctcgagctttccccctagctgaatggcagccctcagacgttgaccagcgatgccttgattccatcgctgctactacacaggcacagggactgacgaacgtgaaggcaccacttcacctcgacgttacctgggggtgggaacattggggtgggatattaccccagagtctggacctcctgctatgtattaacatggcgcatgtgagcccactgcggtgtaccgaagggctgttccgggcagccggtcaccttctcaagccacgcgctttgctaattacatatggaccctatgctatcaatggtaaaatttcacctcagagcaatgtagactttgatttgatgctccggtgcaggaatcctgagtggggcctgcgcgacactgctctgctggaggatttggggaaggcaagtggccttctgttggaacgcatggtcgatatgcctgcaaataacaagtgcctgatatttcggaagaactag

SEQ ID NO: 45216 - DNA, 324 bp, Artificial Sequence
  Description of Artificial Sequence: Synthetic coding sequence
atgctggtggccgccgccgccgagcggaacaaggaccccatcctgcacgtcctgagacaatatctggacccggcccagagaggcgtacgggtcctagaagtggctagcggttccggacagcatgccgcccatttcgctcgagccttcccactggcagaatggcagccatcagatgttgatcagaggtgtcttgaccgaaacccggaatggggcctccgagatacagctctgctggaggatctcggcaaggcctccgggctattactggaaaggatggttgacatgcccgcaaataataaatgcctgatcttccggaaaaattag

SEQ ID NO: 45217 - DNA, 384 bp, Artificial Sequence
  Description of Artificial Sequence: Synthetic coding sequence
atgctggtggccgccgccgccgagcggaacaaggaccccatcctgcacgtgctgcggcagtacctggatccagcacagcgcggggtgcgggttttggaggttgcctccggttcgggccagcatgcagcccattttgcccgggcgttcccgctcgccgagtggcagcccagcgacgtggaccagcggtgcctcgatagaggcagctcagagcagcaggatacctgctctaaccctggaccatgctcgagcccaactggcaacccagaatggggccttcgtgacacagctctgctggaagacttgggtaaggcctccggcctcctgctggagagaatggttgacatgccggctaataataaatgtttgatttttcgtaagaactag

SEQ ID NO: 45218 - DNA, 558 bp, Artificial Sequence
  Description of Artificial Sequence: Synthetic coding sequence
atgctggtggccgccgccgccgagcggaacaaggaccccatcctgcatgttctccgacagtatctggaccctgcccagcggggagttcgagttcttgaagtggcttctggatcaggccagcatgctgcccactttgcccgtgctttccccttggctgagtggcaaccctcggacgttgatcaacggtgcctcgacagtatcgccgccacaacgcaggcacaggggttgacaaacgtgaaggcccccctgcatctggacgtgacatggggatgggaacattggggaggaattctgccccagagccttgatctcctactatgcatcaatatggctcacgtgagtcccctgcgctgtacggaggagccaagaatgggcgccagcggtcactctccgccaggtggcccagggaaaggccagtggcccgcacccggggaggacggcggtcacgcctcccaacagcagatgccggacctccctgagaagcttagtccctctttcacgccagctcatctgcacccctgtaggaggctttgcgaagcacgcactctccccccgtag

SEQ ID NO: 45219 - DNA, 618 bp, Artificial Sequence
  Description of Artificial Sequence: Synthetic coding sequence
atgctggtggccgccgccgccgagcggaacaaggaccccatcctgcatgtactcagacaatatctggatccggcccagaggggtgtcagagtactggaggttgcttctggcagtgggcagcacgctgcacacttcgcccgagcttttcctcttgctgagtggcagccatccgatgttgaccaacgctgtttggattcaattgctgcgacaacacaggcacaaggactgaccaacgtcaaagcgccacttcacctggacgtaacttggggctgggaacattggggcggcatcctcccgcagtcccttgacctcctgctttgcattaacatggcccacgtatcaccattacgctgcacggaaggcttgtttcgtgccgccgggcatctattgaagccccgagccctgctaattacgtacggggaaccccgaatgggcgccagcgggcattctccccccgggggacctggcaagggccaatggccggctccaggggaggatggcggacacgcctcacagcagcagatgcctgacctgcccgagaaactctccccttcatttacccctgctcacttacatccttgccggcgcctgtgcgaagcccggaccctgcccccatag

SEQ ID NO: 45220 - DNA, 939 bp, Artificial Sequence
  Description of Artificial Sequence: Synthetic coding sequence
atgggccggcggcgggccgcccggggccccggcgccgagggcggcagacctcgccatttgccgacaaggagtctggaagcattcgcagaagaggtaggggccgctctccaagcttcagtagagcccggagcagctgacggcgaggggggaccaggaccagccgctctgccctgtacactggccatgtgggagctgggccattgtgatcccagaaggtgcaccggtagaaaattagcccgactggggttagtgcgctgcctgcgcctgggacatcgctttgggggtttagtgctgtctcccgtaggtaagcagtacgcatctcccgctgatcgacagctcgttgcccagagcggagtcgcagttatcgactgttcctgggcccggctcgatgaaacgccctttgggaagatgcgtggttcccacttgaggttactgccttacttggtggccgccaatcctgttaactacggtcgaccttaccgtctgtcctgtgtggaggcgtttgccgccacattttgcattgtaggttttccagatctggcagtgatcttgctaagaaaatttaaatggggcaaggggtttctagatctcaatcgccagcttttggataagtatgccgcatgtggatcccccgaagaggtgttacaggccgagcaggaattcctggccaacgccaaagaatcaccccaggaagaggagattgatccattcgatgtggactctggaagggagttcggcaacccgaatagacctgtggcctccacacgcctgcccagcgataccgatgactctgatgcaagtgaggacccagggccgggggcagaaaggggcggggcctcaagctcctgttgcgaagaggagcagacacagggacggggcgctgaggcccgggcccccgccgaagtatggaaagggattaaaaagaggcagagagattag

SEQ ID NO: 45221 - DNA, 615 bp, Artificial Sequence
  Description of Artificial Sequence: Synthetic coding sequence
atggagctgaagcagagcctgagcacccacctggaggccgagaagcctctgcgacggtatggcgctgtggaagaaacagcgtggaaaaccgagcgcctggggaggaaccagctggatatcatttcaatggccgaaaccacaatgatgccagaagagatagaactcgagatggcaaaaatacagcgcctgagagaagtattggttcgacgcgaatctgaactgcgctttatgatggatgacattcaactctgtaaggacattatggacctgaaacaggaactgcagaacctggttgctatccccgagaaagaaaaaactaagctccagaaacaacgggaggacgagctcattcagaaaattcacaagctcgtgcagaagcgcgatttcctggtcgatgatgctgaggtggaacgtctcagggaacaggaagaggacaaagaaatggcagattttctccgaatcaagttgaagcctctggataaggtcaccaagtcaccagcttcatcacgcgccgagaagaaggctgagcctcccccctctaagccaactgtagcaaagacagggttagcactcattaaggactgctgcggagctacgcagtgtaacattatgtag

SEQ ID NO: 45222 - DNA, 564 bp, Artificial Sequence
  Description of Artificial Sequence: Synthetic coding sequence
atgtggggcgacctgaccgagaccggctgcatgggccggcggagcgctaagaaggatcagctggacataatttctatggctgaaactactatgatgccagaggagattgagttagaaatggccaaaattcagcgtctcagggaagtcctggtgcgacgcgagagcgaactcaggtttatgatggatgacatacaactgtgcaaggatattatggacctaaaacaggagctgcaaaacctcgtggccataccagaaaaagaaaaaacgaagttgcagaagcagagagaagacgagctgatccagaaaatccacaagctggtacaaaaacgcgatttcctggtagatgatgcagaagtcgaaaggctcagagagcaggaggaagataaagagatggcggactttctgcgtatcaaactgaagccgctggataaggtaactaagagccccgcaagctcgcgcgctgaaaaaaaagccgagccaccaccttccaagcctacagttgctaaaacgggcctcgctctgataaaggactgctgcggggccacccaatgtaacatcatgtag

SEQ ID NO: 45223 - DNA, 1188 bp, Artificial Sequence
  Description of Artificial Sequence: Synthetic coding sequence
atggacctgtgccagaagaacgagaccgacctggagaacgccgagaacaatgagattcagtttacagaagagaccgagccaacttacacctgccccgacgggaaatctgaaaaaaatcacgtttattgtttgttggatgtgagtgacattactctcgaacaggacgagaaggctaaggaatttataatcggaaccgggtgggaggaagctgtgcaggggtgggggaggacatcccccgcggcgtgtatatggccaagaaagataccaaagaaagccagagttggcgaaggcgcttgctccgactgcctggtctgtgtgaatctgagtcattggtctctccagactaaaccgcccactgagggcgggcccgagaaagaccaatcttctccatctcaaacacaggctgcccctcagggaccttctaccgcttcaagagctatctcagacatatgcttccctacctactttagagctgaaaagaaatctcttcagatcaaggaatttatctggtgcaataaagattgggccatccctggtacaaataggggtaaggcatccggaaatccctcagggggcgcccatcgtggtctctccattcccggaccgctcaccagcagggcattgctagtactcccccccttgaaagcctcattgtctaatgctcttgacgttctgggaaagaaatccaaaaacagcttcttgcaatccgaggaaaaggtccttgatgtggagaaagacgggtgcgttgcctatgcttacggcctgaagacagctgacggtaaaggtgagaagagagcctctgagctggcaaaacatcccatggtgaacgacacgccaagtagcccctctcctgctgcccagatctcgctgctgactgatcctgagcagagatgccttcactggtcactgctttccgagaagaacctagcctgtcctccggacccttcgaacgtgaggtatctggccgccttacagcttttgcagaaaagaggcgtacagtcttacaaatcaaagttcaaagccaaggagcccagatctcccgtgatcaccagaaagcatgtgctgccgaaagccaagcaggaaaaccgaccacagatgctggaaacgaaggtgttcccaaggcctgtcctgccgtcgcttacagtgtctagagtcatcattcccgtctctactcaccggattctgtag

SEQ ID NO: 45224 - DNA, 1167 bp, Artificial Sequence
  Description of Artificial Sequence: Synthetic coding sequence
atggacctgtgccagaagaacgagaccgacctggagaacgccgagaacaacgaaatccagttcacagaggaaaccgaacccacctacacctgcccggacgggaaatccgagaagaaccacgtctactgtctcctggatgtgtctgacatcacactggagcaggacgagaaggccaaggagtttataatcggcacaggctgggaggaagcagtacaggggtggggcagaacctcacctgcggcttgcatttggccaagaaaaattcctaagaaggctcgagtgggagagggtgcttgctctgactgtctggtgtgcgtcaatttatcccattggtctctgcagacaaagcctcctaccgagggtgggcccgagaaggatcaatcttcaccatcacagacccaagccgccccccagggcccatctacggcaagccgggctatttccgacatctgttttccaacctacttccgtgccgaaaaaaagagcctgcaaataaaggagttcatctggtgcaacaaggactgggccatcccgggcaccaaccggggaaaggcaagcggcaaccccagcgggggggcacaccggggattgagcatcccagggccattgacttcccgggccctgctcgtgctgccccctctaaaggcatcgctgagcaacgctttggacgtgctgggcaagaaatccaaaaattcctttctgcagtccgaggaaaaggtcttggatgtagagaaggatggttgtgtggcttatgcttatgggttgaagacggctgacggaaagggtgagaagcgggcatcagaactggcgaagcaccctatggtcaacgacacacccagttctccatcaccggccgcccaaattagtctgctgaccgacccggagcagaggtgcctgcattggagcctgttgagcgaaaagaatctggcctgcccaccagatccttctaatgttaggtatctagccgcactgcagctacttcaaaagcgcggcgtccagagctacaagtcgaaattcaaggccaaagaaccccgctctccagtcatcacgcggaagcacgtcctcccaaaagccaagcaagagaatcgcccccagatgctcgagacgaaagtgttcccccgacctgtcttaccatccctgactcaccgtaaaaaaaaaatcaagtag

SEQ ID NO: 45225 - DNA, 369 bp, Artificial Sequence
  Description of Artificial Sequence: Synthetic coding sequence
atggtgaacgacacccccagcagccccagccccgccgcccagatctccctcttaactgatcccgaacagagatgcctgcattggtccttactctccgagaagaacctcgcctgccccccggatccgtctaacgttcggtatctcgcagcccttcagctgttacagaaacggggcgtgcagtcatacaaatctaaatttaaagctaaagagccccgttcacccgtgatcactagaaaacacgtgctcccgaaggcaaagcaggaaaaccggccccagatgctggaaactaaagtgttcccccggccagtgttgccctccttgaccgtgtccagggtgataatcccagtctctactcaccggatcttgtag

SEQ ID NO: 45226 - DNA, 504 bp, Artificial Sequence
  Description of Artificial Sequence: Synthetic coding sequence
atggacaagctgaccatcatcagcggctgcctgttcctggccgccgacatctttgcaatcgcaagtatcgctaatcctgactggattaatacgggggagtctgctggcgctttgaccgtgggactagtgaggcagtgtcagacaattcacggtcgggaccgcacctgtattccccccagactgccacctgaatgggtgaccactctgttcttcattattatgggtatcatctcccttaccgttacgtgtggcctcctggttgcatcccactggagacgcgaggccactaaatatgccaggtggatagctttcactggcatgattctcttctgtatggctgcacttatttttccgatcgggttttatattaacgaggttggcggacagccgtacaaattgcctaataacactgtcgtcggaagctcatacgttctgttcgtgctgtccatatttttcactatcgtaggacttctcttcgcagggaaagtttgtctgcctggctag

SEQ ID NO: 45227 - DNA, 420 bp, Artificial Sequence
  Description of Artificial Sequence: Synthetic coding sequence
atggtgacccacgccgccggcgcccggaccttctgcgaggagcagaaaaaaggaagtacatacagtgttccaaagtctaaggaaaaacttatggaaaaacattcacaggaggcgcgccaggccgaccgggaaagcgagaaaccagtcgatagccttcatcctggcgccggtactgccaagcacccaccacccgctgcctcattagaagagaagcctgacgttaagcaaaagtctagccgaaagaaggttgtggtgccacaaatcattatcacaagggcctctaacgaaacgttggtaagctgcagttccagtggaagcgatcagcagagaacaatacgtgagccagaagactggggtccttacaggcgccataggaacccaagtacagcagacgcctataactctcatctgaaagaatag

SEQ ID NO: 45228 - DNA, 423 bp, Artificial Sequence
  Description of Artificial Sequence: Synthetic coding sequence
atgggcctgagcaagagcaaggagaagccccggaagggcgaggagcagaaaaagggcagcacttactccgttccaaagagcaaagagaaactgatggagaagcattcccaggaggctagacaggccgatcgcgagtctgaaaaacccgtcgactccctgcatccaggcgcggggactgccaaacatcccccccctgcagcttccctcgaagaaaaacccgacgtcaaacagaagagcagcagaaaaaaggtggtggtgccccagatcatcatcactcgcgcctccaatgagaccctggtttcttgttcctccagcggatcagaccaacaacgcacgatccgggaacccgaggactgggggccatacagacgccaccgaaatccatctacagccgatgcctataactcccatctgaaagaatag

SEQ ID NO: 45229 - DNA, 1302 bp, Artificial Sequence
  Description of Artificial Sequence: Synthetic coding sequence
atgctgcccgccggctgcagccggcggctggtggccgagctgcagggggccctggacgcgtgtgcccagagacagctccaactcgagcaaagcttaagggtttgcagacgactattacacgcatgggaaccaactgggacaagagctctgaagcctcctcctgggccagaaacaaacggagaggatcctttgcctgcgtgtacccccagcccacaggacttgaaggaacttgaatttttgacccaagccctggaaaaagctgtacgcgttcgaagaggaatcacaaaggcaggcgaacgggataaggctcctagcctcaagtcaagaagtattgtcaccagtagcgggacgacagcaagtgcgccaccacatagtcccggccaggcaggaggccacgcaagcgatactcggcccaccaaggggctacgccagacaactgtgccagccaaggggcacccagagcgacgcctcttgtcagtcggcgatgggacccgtgttggcatgggggccaggacccccaggccgggagctgggctgagagaccaacagatggccccaagcgccgcaccccaggctcccgaggcctttactctcaaagaaaaaggccatctgttaaggctccccgctgccttcagaaaagccgcatcgcagaattcatcgctatgggcacagctcagctccacgcagacaagtgatagcactgacgctgctgccgctaaaacacagttcctgcaaaatatgcagacagctagcggcgggccacagcctcgattatctgcagtggaagttgaagctgaagccggaagactcaggaaggcgtgttccctgcttcggctcagaatgagagaagaattgtctgctgcacctatggattggatgcaggaatataggtgtcttctgacactcgaaggcttgcaggccatggtcgggcagtgcctgcaccgtctccaggagctgcgagctgccgtagctgagcagccgcctcgcccctgtcctgttggacgacctccaggcgcctcaccctcatgtggggggcgtgcagaacctgcttggtcacctcagctcttggtgtacagctccactcaggagttgcagaccttggctgctctgaagctcagggttgcggtattagaccagcaaattcatctggaaaaggtgttgatggccgagctcttacccctcgtgagtgccgctcagcctcagggacctccatggctcgccctgtgccgcgctgtgcattctctgctgtgcgagggaggagccagggtattaacaatactgagggacgaacccgctgtgtag

SEQ ID NO: 45230 - DNA, 1119 bp, Artificial Sequence
  Description of Artificial Sequence: Synthetic coding sequence
atggcccccgcccccccccccgccgccagcttcagccccagcgaggtgcagcgtcggttggcagcaggggcatgttgggtcaggaggggggccagattgtatgatcttagctcgttcgtccgccaccatcccgggggcgagcagctgttaagggctagggcaggccaggacatatctgctgacctggacggccctccacaccgacactccgcgaacgcgcgtcgctggctggaacagtactacgtaggagaattaagaggggaacagcaggggtctatggagaatgagcccgttgccctcgaagagacccagaaaaccgatccagcgatggagcccaggttcaaggtggtagattgggacaaggacttggtcgactggcgcaagcccttgctttggcaggtgggacatctcggtgagaaatacgatgagtgggtgcaccagcccgttaccagacccatcaggctttttcattctgatctgattgagggactttcaaagaccgtctggtactccgttccgatcatatgggtgcccctcgttctttatctgagctggagttattatcgcacgtttgctcaggggaacgtcaggttattcaccagctttacgaccgaatatactgtagcagtgcccaagagcatgtttccagggctattcatgctgggcacattcttgtggtcgctcattgagtatctgatacaccggtttctattccatatgaagccaccttcagattcttattatctcataatgttgcacttcgtgatgcacggtcagcaccataaagcgccttttgacggcagtcgattagtgttcccacctgtccccgcctcactggtcataggggttttctatctttgcatgcagcttatactgcccgaagcggtaggggggacagtgttcgctggaggactcctgggatacgtcttatacgacatgactcactattatcttcattttggaagtccccataagggtagctatctgtatagcctgaaagctcaccacgtgaaacatcactttgctcaccagaagagcgggttcggcattagtacaaaactgtgggactattgcttccacacgctgacacccgagaagccccacttaaaaacacaatag

SEQ ID NO: 45231 - DNA, 1317 bp, Artificial Sequence
  Description of Artificial Sequence: Synthetic coding sequence
atgctgctgtgccccgcccagaagaccgtgttccggctgcagctgaccactgctgctcaatgcttgtgggtgtacctgcgtgacaaacaggtggtagtttttttagcgtaccctacccgggcccctggacggaacaacggtgtgacaagcttgcattggcccgatccaacactgagcttatcttggacgcaagaggcctacacagaatatctgcgatcaatccattacatctcacaggtgctgttggaggaagtggagaccacaaaggaggctggggagacagtaccaccagacacctcaaagatgttgaaactagcacaacagtgcctcgaacgcgctcagtccacagctgcaaagctggggaaaacgagactgaaacccactatgcctgccgcggcccccattccgcaacccgcaggccgccataggagagtctattccgatgaaggcggaaaactatccccattcttaccaccagagatcttccagaaactgcagggcgcggagtcgcaatcgtgcaaaaaggaactcacccctctggaggaagcctcgttgcaaaaccagaaacttaaggctgcctatgaggccagaatggcccgccttgacccatcccaagcaatgcaaaagaccagtttgaccttgtctcttcagcgtcagatgatggagaatctggtgattgcgaaggctcgtgaagaaacactccaacgtaaaatggaagaacgaagactcagactccaggaggccgccaacaggcgcttctgtagtcaagtggccctgacacctgaggagcgcgaacaacgcgcactctatgctgcgattctggaatatgaacaagaccacgattggccgaagcattggaaagccaagctaaaaaggaatccaggggacctatctctggtaacatccttggtttcgcatttactcagcctgcccgaccaccccatagcacagctgttacgaagactgcaatgttccgtatatagcgccctttacccagccgtctcgcgggcagccgcacctgcacctgggtgctgccccccgacaccaaacccagggtccagaagattgcggccaagtcagtccctgcactgcatgctgtctccccctgaaccctcagctgctcctaggcctcaggatagcccccctaccccccctttgcagccaggcccttggggtctcccacatccctggggaactccacacctggactgccaaacacgcaccgcacgaagccggacatggagtagcagttggggaagattatccggacgagcaggagcagtgggctactcccggtcgccatcatgttcttcttag

SEQ ID NO: 45232 - DNA, 1896 bp, Artificial Sequence
  Description of Artificial Sequence: Synthetic coding sequence
atggccgccgccgccggcgacggcaccgtgaagcccctgcagagcgcaatgaagctcgccaacggtgcgatcgagttggataccggaaacaggccaagggaggcctacacagagtatctgaggtcaatacactacatcagtcaggttctattagaggaggttgaaaccactaaagaggccggagaaaccgtgccccctgacacgagcaagatgcttaaactggcgcagcagtgcctcgagcgcgcacaatccactgccgccaaactcgggaaaaccaggctcaaacccacaatgccagcagctgccccaatcccgcagcctgctgggcgccacaggcgggtgtactctgacgagggaggaaagttgtccccattcttgcccccagaaatctttcagaagctgcagggcgccgaatcgcagtcttgcaagaaagaattaaccccactggaggaggcctctctgcagaaccagaagctgaaagccgcgtacgaagcccggatggccagactggacccctcccaggctatgcagaaaacttccttaacactctctctccaaagacagatgatggagaacctggtgatcgccaaagcccgcgaggaaactcttcagagaaaaatggaggagcgccgcctgcgtcttcaggaagctgccaatagaaggttctgttctcaagtggccctgacaccggaagagcgggagcaacgagccctgtacgctgctattcttgaatatgagcaagatcatgactggcccaagcactggaaagccaagctcaaaagaaatcccggcgacctgagcctggtgacaagtctggtcagtcatttgttatccctaccagaccatcctatcgcacaactgctccggcgcctgcagtgttctgtctattctgcattatatcctgccgttagccgggctgcggctcctgcccctggatgttgtccgcccactccaaaccccggatcgagaaggttacgcccttcacagagtttgcactgcatgttgtcccccccagagcccagcgcggcccctagacctcaagattcccctccgacccctcctctgcagcctgggccagttggcagtccttctcctctgggcgatacggccagcggcctgcccgacaaggattcatcattcgaggatctggagcaatttctgggcacctctgagagacagggtagaggcaggggagtccaacccgaaccccaattgcagcagctaaagacagcagtcgaagaaatccacaatgcagtcgataggcttcttagcctgaccctactggctttcgaaggtctcaacactgcggccagcaaagacagatgtttggcttgcatcgaggaaccctttttctcacccctgtggcccctcctgcttgcattatacagaagcgttcatagggccagagaggccgcgctcagtcgtagcatggaattgtatcgtaatgcaccaccgaccgccattggtatcccaactaaacttcttcctcagaatcccgaagcaaaaggcgctaccggttacccctactgcgcggcagcacaggaactcggactgttggtattagagagctgcccacaaaaaaagttagaatgcatagtgcgcactctcagaattatttgcgtctgcgcagaagattactgtcccacaccagaagccacgccgcaggctggacctccacccattgcagcagcagctatcggcgctgacgacctgcttcctattctgagtttcgtcgtgctgaggagcgggctccctcagttagtgtccgaatgcgctgccctggaagagtttatccacgagggctacctcataggggaggaggggtattgcctgacatccttgcagtctgctctgtcatatgtcgaactcttacctcggggaggtctggctaagtag

SEQ ID NO: 45233 - DNA, 1563 bp, Artificial Sequence
  Description of Artificial Sequence: Synthetic coding sequence
atggccagcaacgacaagggcatggcccccagcctgggcagcccctgggcttctcagatggggccgtgggacgcgattctgaaggcagttaaggaccagctccccagtttggactcagattcgcctctgtccgattacggcgaggaggaactctttattttccagaggaatcagacctccctgatccctgacctgtctgaagagttggcagaagaccccgcggacggagataagtcaagggcgtgggtagcagcagccgaagagtctttgcccgaacctgttctggtccccgctgaactggctaccgagcctggctgcagacaaaatacacggaccaaagatgcctctagtcaggagggtcgcgatccgggtcgtccttttgagtcctcaggcgaggtgtctgcattgcttggcatggccgaggagccacccaggtggctggagggagatctgggcagtctttcatttaacactaaaggatcccaagggcctccatgggatcctcaggccgaagcgacgctgtcgtgtcacgaaggagatcccaaggcagagcccctttcaactgcatcccaggagagtgtgaatcgccgtgcacttcgtcaagagaggcgtaagatgattgagacagacatcctccaaaaggtaaccagggatgcctgtggacccacgtcctcggataaggggggagtcaaagaggctccttgtcacgcagcagagtccgccccccgatctaaaatgccactggtggagcctcccgagggcccacctgtgctgagtctccaacaactggaggcttgggatctggacgacatcctccaaagtttggcgggacaagaagataatcagggtaaccgagcccccgggactgtgtggtgggctgctgaccaccggcaggtgcaggaccggatggtaccctctgcgcacaaccgcctgatggagcaattggctctgctatgtactacacagagtaaagccagcgcgtgcgcaagaaaagtaccagccgatacaccccaagatactaaagaggccgattcaggctcccgctgcgcaagccgcaagcagggaagccaggcaggacctggccctcagctggcccagggcatgcgcctaaacgccgagtcaccaacaatatttatcgacctgagacagatggaactgccagatcacctgtctcctgaatcgagttcccattcttctagcgatagcgaggaagaggaggaagaggaaatggctgcactaggtgacgctgagggcgcctctccaagctcactaggcttgagaacctgtactgggaaatcacaacttcttcagcagctccgtgccttccagaaggggacagctcaaccagagcttcctgcctctaagggacctgcaggtggtagggcccaagctcccgaggatactgccgggagtcggacaggccgcaagcagcatatgaagctttgtgcaaagggacaaagcgcacaagctcggctccccagaggaagacctcgcgccctgggcgatgtccctgagccaggagcagcccgagaagctctgatgcccccattggagcagttgtag

SEQ ID NO: 45234 - DNA, 828 bp, Artificial Sequence
  Description of Artificial Sequence: Synthetic coding sequence
atgcccctggtggagccccccgagggcccccccgtgctgagcctgcaacagttggaggcctgggatctggatgacattctgcaaagtctggccggccaggaagataatcaaggcaacagggcgcccggcacagtgtggtgggctgccgatcaccggcaggtgcaggaccggatggtgccctccgcccacaataggctgatggaacaactggcactcctctgtactacccagagcaaggcatctgcctgcgcccgcaaggtgccagccgatacgccccaggacaccaaggaggctgattccggttccaggtgcgcttcgcgcaaacaggggagtcaggcaggccccggcccccagctggcccagggtatgcgactgaacgccgaatcacctactatttttatcgatttgagacaaatggaactgcctgaccacctctcccctgagtccagttctcatagctcctcagattctgaggaggaggaggaagaggagatggccgccctcggcgatgcagagggcgcttccccttcgtctctgggactccgaacgtgcacagggaagtcacagctgctgcagcaactccgagcctttcagaagggcaccgcccaaccggagttgcccgcatcgaaaggaccagccggcggccgcgctcaggcacctgaggacaccgccgggagccgcaccgggcgaaagcagcacatgaagctgtgtgccaaggggcagtcagctcaggccaggcttcccagaggccggcctcgcgcgttgggggatgtacccgagccgggcgccgctagagaggctcttatgccacctctggaacagctgtag

SEQ ID NO: 45235 - DNA, 828 bp, Artificial Sequence
  Description of Artificial Sequence: Synthetic coding sequence
atggaggagcggaaggaggagggcgaggccgagatccaggagcacgggcccgagcactggtttagtaagtgggagaggcagtgcctcgccgaggcagagcaggacgagcagctcccaccggaactgcaggaagaagcagctgccgcagcccagcctgaacacaaacagcaaaagctgtggcatttgtttcagaatagcgccacggcagttgctcagttgtataaggatagagtctgtcagcagccgggactgagcctgtgggtgccttttcagaatgccgccactgccgtgaccaatctctacaaggaatctgtggatacacaccagaggtctttcgatattggaatacagattggttaccagagaaggaataaagacgtcttggcttgggttaagaagaggcggcgcactatcagacgcgaagacctgatttctttcctgtgtggaaaagttcccccccccagaaacagccgcgcccctccccggctgactgtagtttcgcccaatagggccacttcgacggaaacatcttcatccgtcgaaacagatctgcaacccttcagagaggccatcgcgctgcatggcctgagcggcgcaatggcatcaatctcagttcgaagcagtactcccggcagccccactcacgtgagctcggggtctaatgcatctaggaggcggaatggattgcacgatgtggatctcaacaccttcatcagtgaggagatggcactgcacctggacaacggaggaacacgtaaacgcacttcagctcagtgtggtgacgtgatcaccgattctccgacacacaaaagaaacagaatgatttag

SEQ ID NO: 45236 - DNA, 798 bp, Artificial Sequence
  Description of Artificial Sequence: Synthetic coding sequence
atgagcgagcagcagatggacctgaaggacctgatgcccaccaagcgcaaatatatgtggaaaaccgccgaggaccggaggatgagcgacttgacatgtgttctggaatggctcgagcgcaggcaggggaaaaagaaacaggcccccgagaaacagaaaccaaaagtggtgacagtattgaaacgcaataaaaaaaaagaggaaaaaaaagggaagggcctcatgacagcccgcgggggcaataggcgcgataccgagacatcgcaacaagcgttaggcaagagatttagaaaggacgccgcgtcgtacaggtcactctatggtgttgaacaaaaaggaaagcacctgtccatggtgcccggaagctatatcaaggacggtcctaagaaatctgacactgacattaaggacgccgttgaccctgaaagtacccagcgcccaaacccatttcgtcgtcagtcaatagtgctggatcctatgctacaagagggcacatttaattcccagcgagccacctttattagggattggtcaaataagatgccagatatggcttatgaaagaaagctgaaatctctcatggaaaaaagtacagagcctaagatggagactatgcgaatgctcaaacctgaagaagtgctgtcttgtagatatctgcgcttgtccaaggagaacatacgcaccttgcttaagctctgcaaagacgcaggaatgaatgtagatatccatccccatatggtggaggaggacatcgatgccaagaaagtgttcaccggcataccttcgatggccttatag

SEQ ID NO: 45237 - DNA, 687 bp, Artificial Sequence
  Description of Artificial Sequence: Synthetic coding sequence
atggagcccgccagctgctgcgccgagcggcccaagcccggccccacaggcgtgaagactaaaccctcctgtggaggatggcgagcggtgagtctcttattgctgctgttactcctggttcttgccgcagtgggagtcgtagccggtggtctgctcggcagcgcccagggaccgccaaagcccaggctccagaccctgagaatgacgctgccctcacctcatatgccacggcctaaccaaaccattctagtggacgtggcgaggaatgccgcgaccatcacagttacacctccacagagcaatcacagctgggcagtgctgttcgatggccaatccggctgcatctgttacagacccgaggagcatcaggtctgcttcttgcgcctgatggaggacagcgatagagaaacactccgcctgctggtggacaccagcaaggtacaggaagcttgggtgccaagtcaggacacccaccacacccaagagctgttagctgtccagggcagcctggaggtggacccggctcaagcaggggcgctggttcagcgtctgtgtatgcggacacccatttattgggccagacgcgcagaggggccccgccggcagcgactgatctacctgtgtattgacatttgcttcccatctaacatctgcgtgtccgtctgtttctattacttgcccgactag

SEQ ID NO: 45238 - DNA, 582 bp, Artificial Sequence
  Description of Artificial Sequence: Synthetic coding sequence
atgttcaagaacaccttccagagcggcttcctgagcatcctgtacagcatcggatctaagcctctgcagatttgggacaagaaggtccgcaatggccacatcaagcgaatcactgacaacgacatacaatcactcgtgctggaaattgaaggcacaaacgtatcaaccacttatatcacttgtccagctgaccctaagaagacactggggatcaaactcccatttcttgttatgattattaagaacctaaaaaagtattttaccttcgaagttcaggtgttggacgacaaaaacgttcgcagacgctttagggcatctaactaccaatctacaacacgggttaaacccttcatctgcaccatgcctatgaggctcgatgatggttggaaccaaatccaattcaatctactggatttcactaggagagcctatggtacaaattatattgaaacattgagggtgcagattcatgccaactgtagaatccgcagggtgtatttctcggaccgtctctattccgaggacgaactgccagccgaattcaagctttatttacctgtgcagaacaaggctaagcaatag

SEQ ID NO: 45239 - DNA, 444 bp, Artificial Sequence
  Description of Artificial Sequence: Synthetic coding sequence
atgatcgtgagccggtacggcctggtgggctgcgacgccggccaggtccgcccgaaagtggaactttcattgcctgctttcctcgcgctccccaagaaagagtttaaggacaagccagaggtagaggaaaacaatctgatcgaggaggccgtttggcagacctctctgaagattccgcttcctcaagctcaagtgcgtgagcgaggcggtgggtccgccggcatctccgctgcccaccccagccagctctgcacggccggcgtgcggccctctagtgccctgcgcgctagccgtcccggctggtcactccagaccgccgctcttcaagaaccaactggcgcggatagcttcttgcctaggtctcataagactgcagtggatctgcactccgctcgaattcccctctatatccacaccaagtgcctgttgatggagagcgtgtag

SEQ ID NO: 45240 - DNA, 954 bp, Artificial Sequence
  Description of Artificial Sequence: Synthetic coding sequence
atggccagcgccggcgccgagcggcggcccggcgtgcaggaggccactgtcgtgggtcaaggacaactgaccgaggagccaggttccgcacagacttcagagtgccctgtcgctggtgatcagtttctggttcctgcccacgaggcccgaggcacacagtctgaggaccaacggccggcgggggctgcctccgagtctgagctccaggaggagggcccaaagcttggagaggaacgtcctaagccacacgcaggcgccctggaagagaggggcccgagacccgtggtgagtatagtcagaccaagacacgggcccaaacgcaagccggtgaagtctctgagcctgccgggccttagagcacacctcaaggcggaggccgagttgccgcccaagttgcctctgcaggaagaggaacctgaggacagtcagtccgaaccttctccgtctgccaaacagcataagaaagctaagaagagaaagtctcttggcgcgcctgtgctgcacgccgtggcatccatggtgtctgcgccactggagacccttaggctggagcgcaaggcacagcgtctccgtccactttatcagtacgtgaattactgcaacccggaattaaaccaggccggcaagggagacggagaggccgaggttgaagccgaagcagagctagctcccgtacctgaggagggtggtgttgaacaacttcaggctctgctgcccctggctggagagctagggccaggtttggcactgccttgccccagccccctagtgaccccaacacatgcactggcgccactgggtgaagaagctggagaagaaccaggagggttaccatctcttggagtgtcagaccacaaagccgaggttgataaatcaacgcaggttgacatcgacaagatgctctcggtgtgtacggctccactggtgccaccgctttccccacagtataaatag

SEQ ID NO: 45241 - DNA, 465 bp, Artificial Sequence
  Description of Artificial Sequence: Synthetic coding sequence
atgagcgccacccgggccaagaaggtgaagatggccaccaagagctgccccgagtgtgatcagcaggtgccagttgcctgcaagtcatgcccctgcgggtacatctttattagccgtaagctgctgaacgctaagcactccgaaaagtctcccccttctaccgaaaacaaacatgaagccaagcgtagacgcactgaacgagtcagaagggagaagatcaactctacagttaacaaagatctagagaacagaaagaggagccggtcaaactctcactccgatcacataaggagaggaagggggaggcctaaaagtgcatcagccaagaagcatgaagaggagcgggaaaaacaggaaaaggaaattgacatctatgcaaacctgagcgatgagaaagccttcgtgttcagtgtggcactggctgagattaatcggaagattattaaccagagactgattttgtag

SEQ ID NO: 45242 - DNA, 282 bp, Artificial Sequence
  Description of Artificial Sequence: Synthetic coding sequence
atgagcgccacccgggccaagaaggtgaagatggccaccaagagctgtcccgagtgtgatcagcaagtgcctgttgcgtgtaaatcatgcccatgcggatacattttcatttcccgcaaactccttaacgctaaacattccgaaaaaagtcctccctcaactgagaagcaggagaaggaaatcgacatttatgcaaatctgtcggatgagaaggcttttgtcttttcagtggccctggccgagattaatagaaagattattaaccaacggctgatcctctag

SEQ ID NO: 45243 - DNA, 576 bp, Artificial Sequence
  Description of Artificial Sequence: Synthetic coding sequence
tgagagcagggccccgccgcccccaagagctggctgctgctgcccaccacattggcgttacacggttccctggatgctgtgtcgcaggcccaaggacgacccggccaccctgatgccccacctaatatctatgagggtgggttggggagcccgcagccacaatgtccatcagctcaaggctccaagcccaagaatttcaggctgagacatctacgtggactaggactgtaccttgaatcacatccaccacctaccggacagtgtgaaagccactggctcggccgactaatggcgggcggatgtttgcctcagcctgagggcacagcgtgggccctggacctcccgcaggggactcttgggccccgtaactccctgtgcagcgcactgctcgaagcccgcctcccacgcgattctctgggatcctccgctagctcgtcctccatggaccccgataagggagccctaccacagccctcccccagcagacttcggcctaaaaggtcttggggaacctgggaggaggccatgtgccccctgtgcaagaggactcgctcgggagcccttgagcgtccttag

SEQ ID NO: 45244 - DNA, 996 bp, Artificial Sequence
  Description of Artificial Sequence: Synthetic coding sequence
atgctgaaccggaagaccagccacttcctgggcatgcgggtgcagagtgaactcgagcacctctccgagctccgtagggaagcaggcaaggaccgttccagcgtccatggctccgctgcaagaacgagagcttctgtcaggacgcagtggaccaccgcggcggctgctaaagccgacgaagatccaggggccaacctttttcccccccctctgcctcggccgcgtatctgtatgtggaagtaccttgacgtccatagcatgcatcagttggagaaaaccacaaatgccgagatgagggaggttttggcagagttgttggagttagggtgcccggagcagagtctgcgggatgccatcacgcttgatcttttctgtcacgctcttatcttttgtcggcagcaaggcttttccctcgaacagacctcagccgcttgtgccttattgcaggatttgcacaaggcctgcattgccacccccctggggaacgtggaggagtgctatcggtactttacttcagtactgttttgccacggagtgcgcaggcctccctttagcattgacctgttcaaggaggagcaactgcttgctctggaggactacgtggtgaacacctacttcaggcactttaagctgtacaagtacgtattcacgcctcaggtgaggcttgacctctccctgacgtacatgggcttgcaacctccgaagttgtggccagaatccgagacagaaaaggaggaatccaaagagatggaggagcaagccgttacacctcaaaaagaagaactcgaaaccgtcgccccgcccgaacctgaacccagtcatatccacgtgctgagagcctatataaagacgcaagttaataaagagcttgaacagttgcaggggctcgtggaagagcggttaaaggcatcggaagagcggctttcctccaaacttactgccttagagcggccgtttcagcttcctccgggtaaggggaagtcaaagaccaaatag

SEQ ID NO: 45245 - DNA, 534 bp, Artificial Sequence
  Description of Artificial Sequence: Synthetic coding sequence
atgctgaaccggaagaccagccacttcctgggcatgcgggtgcagagtgaacttgagcacttgtccgaactcaggagggaagcaggtaaagataggagtagtgttcatggaagcgccgccaggacccgggcttctgtgcgcacacagtggacaacagccgcagcagcaaaagctgacgaggaccctggtgccaatctgttccccccgcccctgcccaggcctcgcatctgcatgtggaagtatctcgacgtgcactcgatgcatcagcttgaaaagacaactaatgcggaaatgcgagaagttctggcggagctcctggagctgggatgccctgagcagtctctgcgggacgccatcacattggatctgttttgtcacgccctgatcttctgtcgtcaacaggggttttcactggaacagacatcagccgcctgtgcgcttctccaggatctgcacaaagcctgcatcggagagagaggtcagctgcctgggttaagtccacgcgaaaaacggaatagagcatggcacaaatag

SEQ ID NO: 45246 - DNA, 720 bp, Artificial Sequence
  Description of Artificial Sequence: Synthetic coding sequence
atgcgggccagccggagcccccccagcccccggcggtgccaccaccaccacgaagccactggggcggcaagcggcgcggctgcaggaggaccaggggctggctgtgtgggcctgtgcaggttagccctcaccccttccgcccaggatgggcgaaactcaacattccagacttataagaaagaggtctgtttgccacggcactccatgcaccctggaccatgggctatatgttgcgagtgtcagactaggtttggtggccgcctgccggtgtctcgggtggaagcagctctgccatactgggtgcctctgtcactgcggccaaggaaacagtcccagaagacggtccagttccccatccctcagaccgccaagatgtgtccgtgtctgtgccaccggtttggtgggagactccccatgcctcgagaccaggccgtgatgccatactgggtacctcaggtcctgaggagtcagcagcagatcgtgcgccgccagcagtcccttaaaggtattcaggccccgctccttgatgcttgttgctggcacaattgttggagaatctgcggggacgaatgtctgctatcgaagttccaacagctacaagcaccatatcaggatcagctgccagcgccggccgctagactcttacctttaggactgctcacactgctgcaggctatcccacgagtgattatggctataaggcagtgtttcggtgtttag

SEQ ID NO: 45247 - DNA, 3426 bp, Artificial Sequence
  Description of Artificial Sequence: Synthetic coding sequence
atgagcttcagcctgaccttcaccgagctggccaacatcgccatcccccagtgcggtgtgctgaactttaaagctctccaccttctgctccatgggatcctcgagcatattcatatggctgagcttaaaaaggtcctgtcaggagatgaagacttcttacagacttcacaggtcgtcataatgccgcgagaaggagacgcgcagcctattctgaaccccatgaagagactgagtaacgtatttgatcatgtcgtcagccggcttgacaaattggaaaaccagttggcactgttgcaggatttgcctagcaccgcacagctcctcgaagcttcacagggcacagcacggcctgtgcaggacctgtggcatctcattaagctacggaagatggtcgaagggcacgacgaagtcatggcgaagtcgatgcagacactgcaggacttgcttacggatctccacgctttgcaggttacgataactgcacttaggaaggaggtggatatgttaaagaatatgcttgataaagtgcacccagaacggatggacatcttcgcggaagattttaaaatccagaattggaaaatggttgcgctgcagcgcgaagttgcctctctgcaaaacaaattcaaaacgattcctaagacagaggacatggttctatggtctggattgcacgatgccatgtttacgagcgaaatcggatcttcccctctcgacctgtggcaaagcgttgaacaactgcccgaggcagccctggctcagactacgaaatatctggaggccaccagagcaattcaggtatccgagcccgtgcagaacccccagctcctgcagaccgtctggcactacgaggtgcctgagctgctgcctgaggggtcatccgcgcaggcagtctccctctccagggctcaggaacccgcacagccacccgccctcacacccgagagcgctcctggatgcacgaccgagttcgcgcccggccccgcacccggcacagaaccagtccctggtctggagcttggcttggaattggagcctgtaccagcactaggccctgttccaggtcccagcgtgacgcctggatcactgccagccccctggccggtgctgggaccagtgccagcaccaggtgcacagcctcctcctctcggcgattggcctgcccttcctcgcaggtggccgctgcctcagggatggccccgggtgggatcatggccactgtgggacctaggcgtgctacggcccacacagccacagccgtcgcgagcacctccccccgcgacagaatttggaagcctttggccccgcccgctccagccatatcaatcaaggcagggggaggctctgcagctggctgccgttcaggtcaagggcgaggagaacgatgtgcctagcctacgcggactgagagagagggcaaggaaggatggggcacccaaggataggactaggaaagacggagtgccgaaagatcgcgggggcaaggatgtggatcccaaggatagagctcataaagacgatgtgcctaaggatcgaggcggaaaggacgtggatccaaaggatagagcccataaagatgatgtgccgaaggacagaggaggcaaggacggggatcccaaagatcgtgtgggaaaggatggagcacctaaagaggcccaaccaaaagcccctcagtcggcactccaccgactgaagaccaccgcagccatagccgccgctgccgccgccgcctacgctgccgccacatcaagcgcagctcaggctgccaaagtggctgccaaatttgtgaaggatgcccctgccactaagatggctgctatcgccacggacacggcggccgctggtccactcggtgtttttgcagatgtgctcggtgccggcccctctcgtggtgcaaccgagagccagatccttggcgacgattctgaaatctatgaaattctgtccccctcatactccgcagcttcaatcggaccagatcctgcactttcacaggcgatggtggccaccaagcaagctatgtcccccgaagacaaaaagcgcgctgtgaagtatagtatgagccatatcgcccagataccagttaagcacgacagccttaaagaagagtttgcccagttatcgtgtaacctgaaccagcgactgtcctacctggctaacatgggcggcccctcctctttaggaaccaccgtggacattctccaaaagaagattgggagtctgcagaagtctcgtttaaaggaagaagaattagaacgcatttggggaaaccagatcgaaatgatgaaggatcgatacatcacactggacaaagccgtggagaatcttcagatcaggatggatgaattcaagaccctccaggcccagatcaaacgtctggagatgaataaagtaaacaagtccactatggaagaggaactcagggagaaggcagaccgttccgctttagctgggaaagcctcccgggttgacctcgagacagtggcccttgaactcaatgaaatgattcaggggatattgtttaaggtgacaatccacgaggatagttggaaaaaagccatggaggaactgtcaaaagacgtcaataccaagctggtgcacagcgatttggaccccctgaaaaaagagatggaggaagtatggaaaattgtgcgcaagttgctgatcgaagggctccggctagatcctgattccgcggctggtttccggaggaaactgttcaaaagggttaaatgtatttcatgtgacaggccggtggagatgatgaccggccctcagctcatcacgatacgaaaagcccatctactcagtaggctgaggccggctagtgccaattcctgcgagtacctgcagcggcagcagatgcgggaacaacagtggcttcagttacaggacctcgggatccaagaagattgccagcaggactggggggacggacctcagaacgccaccagtctgaaatgtaagagctgtaacctgctcaccctttatccctatggcgatcctcacgtaatagattacgattctgcagaagtggatattctcggagtggacggcatcctttataaaggacgcgtgaatagtcagcgaggggcgcagccactggccgtggccaaggaactggcagcagtaaaagctccgagcccgccctcccagagtttatacgatcgggtgcactcctcggccttattcggggctatctgcccccccttatgtccaaggtcgtccgcatgctcagctgcgtcaggccctcaccttactatgcccgcaagacccccctcattgccgcctcttttactgctccctccacttattccctccttgcgagaccctcaacaggctccaggcagtactagacttagtcgggctccacatatcgagagtcgcgttggtagaaaacccccggaggagcccgcaaatccttag

SEQ ID NO: 45248 - DNA, 495 bp, Artificial Sequence
  Description of Artificial Sequence: Synthetic coding sequence
atggccagcgcccggggcgccaagcagagcagcccccgggtgggcaccacccgctatacggaaaccagcactgtgcgggtggagacctccagccatcgggttgagacaagcagccggcgtgtggaaacgtcccagaggaggagcgaaggtccatccctaagtccatctggcaaacgtctgcctaggattttggaggccagtagcagacatgtggaatcgagttctcagcgaacagaaactacatctcgccacgtgcgggcatcctcattaagagtcgaaacaagcctacattgcgcggagtcaccaacacccaggcctagcaggccgcccgctaggacaaagaaacggcccgatgaaatgctattgcccaaagggcatcagggcgcccgcgccctgtcccaggatagaaaggccagcagttgccagccagcctcccagctcccgggagggccaataatcttcggattcatggagactaaccacaaatctatgtag

SEQ ID NO: 45249 - DNA, 504 bp, Artificial Sequence
  Description of Artificial Sequence: Synthetic coding sequence
atgttcgacttcagcttccccacccccgccagcgccggcacccggatggggcccgcctcatgtggaggtcgttctctgcaccttcctcagctcaggttcagcagagtcgatgccaccgccgtgactgatgtcccttttcagagaatgcacgcaccccaccgagcacccgaggtcttttgttcacgttcaagcagaggagccggacgtgggcatcctacccccactccgagggtaaggtgggcactagcaggtaaccaaccaagatgctgcgctcagctgctaagcggcagggggggctctggcgcacagttgagggcaggttgggtgcgcggggccgctgttggcaatttgtttatcctgctgctcggcaaagaagacggagaagaagaaggtacggtattaagctactcgagcatggtgcacatttctaatataaccggcatagtagggaccacagtaagccgaacaaaacctgccctggtgcttatggaactcacattttag

SEQ ID NO: 45250 - DNA, 339 bp, Artificial Sequence
  Description of Artificial Sequence: Synthetic coding sequence
atggcccacagcgccgccgccgtgcccctgggcgccctggagcagtgtccaatcagagtggagcacgacaggaggcgtaggcagttcactgtgaggctgaacggctgccacgaccgggcagtactgctttacgagtacgtaggcaaaaggatcgttgacttgcaacacacagaggttcccgacgcctaccgcggccgggggatcgctaaacatctggcaaaagcagccctagatttcgttgtggaggaagatctgaaggcccacttgacttgttggtacatacagaagtatgtcaaggagaaccccctcccacagtatttagagcgtctgcagccgtag

SEQ ID NO: 45251 - DNA, 2478 bp, Artificial Sequence
  Description of Artificial Sequence: Synthetic coding sequence
atggaggtgcggcggggcgacacctgcccccggccccaccccagcgggctcagggaggaaggactggaacccaaagttgcctttccaggaggagctaacaggtgttggaatctgggagcggatgccggatccagactgacagatgtttttggaagtgtgatgttaaccggttcagctagtttctatgattgctatactagccaatcggaggataacgtggatctgaggcagacttacaccccgtttagctccacagagtactcaagcagcgtagatagttctctcttctgtgctccgtggagcacctacggagacgatatcaagcaaccctcgaattcccagataagtatcaaaaatcgtatccagaccgaaagaaacgactacgggagcgagaccgacctgtatggactggtttccaacattttagaggagcaagataagagccagccctacttcgctgaagggacatgttcgtccaacctcaaatctgtctggcccatgaacacgtctagattcgcagatcatcacgacctgctgactgaaacgaaaaggcctattgacacggtgatatctcagcaggccttttattctgacgagagcgtctcagccatggaaaaacaatacctgcgcaacagcaatctcaccccgcagcagaagatcgacgaactgcaccacggcttcaccggactggacctggaggagcagtggatgtaccctagccgcagtgaccactctaattgccataacatacagaccaacgatactgccaaaaccacattccaggaatatcccctgatcaaaaattgctttacgcctcagaccggactgtcggacatcatgaaggagtctggcgtggacatctaccactacggtcgcgacaggatctgtactaaaggcttggaagcacctctccagcagaagcgggccgagatgttcctgtcacaatttaaccggtacaacgagaacgtggactactgtcgttaccccgaatatgtgcaccccaataaagccaagctaaataaatgctcaaacttttctgtgcaggattctaagaagctcgcaaacggtacccccgaaaccccaaccgtcgaggcagacacgtatacaaaattgttccaggtgaagccggctaaccagaaaaagatggaggagaccatccctgatcaacagaacttcacattccccaagaccacacctcacctgacggagaagcagttcgccaaagaagctgtgttcactgctgattttggtctaacgagtgaatatggactgaaaccccatacagcttgccctgcaaatgacttcgctaacgtcacagagaagcagcaatttgcgaagcctgacccacctcactctgaatatttcaagtcagtgaacctgctcagcaatagtgcaacatcgtcaggcggtatcaacctcaatcggcctacttggatgaacgtgcagacaaagaacaacactcctatcccttacagaaatcaggggaacttaatgaagctcaattcacacctctcggcagcttcaaaggggagtaaccattcgagtgattttcctcaactgtcgagcaccaatctgacaccgaactccaatctgtttcagaaatattgtcaggaaaacccttccgctttctcatcgtttgacttcagttacagcggggcagagcgcatccaatcagtgaatcacatcgaagggttgaccaagcccggcgaggagaatctgttcaaactcgttactgacaaaaaaatcaagcagcccaatggcttttgtgataactacagcgcccagaagtacggaattatcgaaaatgtgaacaagcataatttccaagcaaaaccccagtccggacactacgatccggaggaagggccaaagcacttggatggactcagtcaaaatacttaccaggacctgttggagtctcaggggcactcaaactcccatcgaaccaggggtggtgataattctagagtgaaccgcacgcaggtaagctgcttttctaataactacatgatgggagatctgcggcataaccagtgttttcaacagctcggcagcaacgggttcccgcttaggagcacccatccctttggccacagcgtcgtgccacttttggacagctacgacctactatcttacgacgacctgtcacatttgtatccctacttcaacatgatgtacggggacaactctttctccgggctgatgccgacattcgggttccagcgccctatcaaaactcgctctggccctgccagtgagctccatattcggctggaagagtgctgtgagcagtggagggcccttgaaaaagagcgtaaaaagactgaactggccctggctaagaactatcccggaaagaaagtgtcttctactaataacaccccagttccaagactgacgtcaaatccatctagagtggaccgactgattgtcgacgaactccgtgaactggcgcgcgtcagctgtaagaacaggtag

SEQ ID NO: 45252 - DNA, 2859 bp, Artificial Sequence
  Description of Artificial Sequence: Synthetic coding sequence
atggaggtgcggcggggcgacacctgcccccggccccaccccagcggcctacgcgaggaaggactggaaccaaaggtagcctttcctgggggcgccaacaggtgctggaacctgggcgctgatgccggcagtaggctcacagatgtgttcgggtcagttatgctcaccgggagcgcctcgttttatgactgctacacatcgcaaagtgaggacaatgtggacttgagacaaacctacacaccgttttccagtacggagtacagctcttccgttgattcttcgcttttttgcgccccgtggagtacgtacggggacgatattaagcagccaagcaacagccagatttccatcaagaatagaatacagaccgaacgtaatgattatggaagtgaaactgacctgtatggtctggtgagtaatatattagaagaacaggacaaaagtcagccgtattttgccgagggcacatgcagttcgaatctgaagtccgtgtggcccatgaacacctcaaggttcgcagatcatcacgatctcctgactgagacgaaacgccctatcgatacagtgatctctcaacaagccttctactccgatgaatcggtgtcagcgatggagaagcaatatctccggaacagcaatctcacgccacagcagaagatcgatgagcttcaccatgggtttaccggccttgatctcgaggagcagtggatgtacccatctcggtccgatcatagtaattgccacaacattcagaccaatgataccgcgaaaaccacttttcaagagtaccctctgataaagaattgctttactccccagacaggcttgtccgatattatgaaggagtccggtgtggatatttaccactacggtcgcgatagaatatgtaccaagggcctcgaagccccacttcagcagaaacgggctgagatgtttttaagccaattcaatcgttacaatgagaacgtggattactgccgatatccagagtatgtacatccaaacaaggccaagctaaacaagtgttccaacttttccgtccaggattctaagaaacttgccaacggcaccccagaaaccccaactgtggaggcagacacgtatacaaaactgtttcaagttaaacctgccaaccagaagaagatggaagagacaattccagaccaacagaactttacgtttcccaagacaaccccacacctgaccgagaagcagtttgcaaaagaggctgtctttactgctgatttcggcttaaccagtgaatatggcctgaagccacacactgcgtgccctgccaatgacttcgctaacgtgaccgagaagcagcagtttgcaaagcctgatcctccccactccgagtatttcaagagcgtcaaccttctctcaaattccgcgacaagcagcggcggcattaatctgaaccgacctacctggatgaatgtgcagactaaaaataatactccaatcccatatagaaaccagggaaacctcatgaagttaaactcacatctgagtgccgcgtccaaaggctccaatcattcttccgactttccgcagttgtcctccaccaatctgactccaaatagtaatctatttcagaagtactgtcaggagaatccctcagcttttagctcctttgacttcagctacagtggagccgagcgcattcaatctgtgaaccacatcgagggcttaactaagcctggcgaagagaacctgttcaaactggttacagacaagaaaataaagcagcctaatgggttctgcgataattatagcgcacagaagtatggaatcattgaaaacgtgaataaacacaacttccaggctaagccgcaatccggacactatgacccagaagaagggcccaagcatttagatggtctgtctcaaaatacctaccaggacctgcttgagagtcagggtcattcaaattcccaccgcacaagggggggagacaattccagagtgaatcgtacacaggtgtcctgtttcagtaacaactacatgatgggtgatttgcggcataaccagtgcttccagcagctgggctcgaacggctttcccctccgctctacccatccctttggacattccgtcgtgccattattggattcctacgacctgctatcatacgatgacctgagccacctctatccttacttcaatatgatgtacggggacaatagcttttcagggctcatgccaaccttcggcttccagagaccgatcaaaacaagaagtggtccggcgagcgagcttcacatacgcctagaggaatgctgcgagcagtggagagccctggaaaaggagcgcaaaaaaaccgagctggcgttggcaaaaaattatcccggcaagaaggtgtctagtacaaataacacgcctgttccaaggctgacctctaacccgagtcgcgtagatcgtttaattgtcgacgaacttagagaactggcccgcgtcgtgacattgctgggaaagatggagcgcctgcgttctagcctcctgcatgcatccatctccacggctttagatcgccacttggagtccattcacatagtgcagagtagaagaaaagatgagatcgtgaatgcttccaatcggcagagacagggcgtgcctaggtgtcaggacgacagggacgtgtttgcgctggcctcagcgatcaaagagatgtgtgtcgccactagaaaaacccggactgccctatggtgtgcgctccaaatgacactaccaaaaacagcctcaacagccgacgttgtaaaacctctgcaggacacggttaactgtgaagacaaggtgcacgagagcatcaattcctctaacccaatgaaccaacgcggagagaccaataagcattag

SEQ ID NO: 45253 - DNA, 1980 bp, Artificial Sequence
  Description of Artificial Sequence: Synthetic coding sequence
atgaacaccagccggttcgccgaccaccacgacctgctgaccgagactaagcgacccatcgatactgtcataagccaacaagctttctatagcgatgagtcagtatccgcaatggaaaagcagtacctgcgcaactctaacttgacaccacagcagaagattgacgagcttcaccacggattcaccggcctggacctggaagaacaatggatgtatcccagtaggagcgatcactccaactgtcataacattcagaccaatgataccgccaagacaaccttccaagagtatccattgatcaaaaactgtttcacgccccagactgggctttccgatattatgaaagagagtggcgttgatatctatcattatggaagggataggatttgcacgaagggactggaagctcccctgcaacagaagagggcagaaatgtttctttctcagtttaatcgttacaacgagaacgtggactattgcagataccccgagtatgtccatccaaataaagccaagctgaacaagtgctcgaatttcagcgtgcaagatagcaagaaattggctaacgggaccccagaaacgcctaccgttgaggcagatacatacacaaagctattccaggtcaagcctgcaaaccagaaaaaaatggaagaaaccatccccgatcagcagaacttcactttccccaaaactacaccacaccttacagagaagcagtttgcaaaagaagccgtgtttacagctgattttggtcttacttcagaatatggtctcaaaccacatacagcgtgccctgccaatgatttcgccaatgttacggaaaagcagcaattcgcaaagccggatccgccacattctgaatactttaagtctgtaaacttgttgtcaaacagcgctacaagctctggcggtatcaatctgaacaggcctacatggatgaatgtgcagacaaaaaataatacgccaatcccttacagaaaccagggcaacctcatgaaattgaacagccatctttctgccgcctccaaaggatcaaaccatagttccgattttcctcagctctcgagcacaaatctgacgcctaattcaaatctgttccagaaatactgccaggagaatccctccgcgttcagctcgtttgacttctcatactcaggagccgaaaggattcagtccgtgaaccatatagagggactcacaaaacctggcgaagagaacctgtttaaactggtgaccgataagaagataaaacagccaaatggcttctgcgacaactattccgcgcaaaagtacgggattatcgaaaatgtgaacaagcacaattttcaggccaagcctcaaagcggccactatgatcctgaagaggggccgaaacatctggatggcttgtcgcagaatacataccaagacttactggaaagtcagggccattccaatagtcaccggacacgaggaggcgacaatagtagggttaacaggacacaggtcagttgctttagcaacaattacatgatgggagatctccgccacaatcagtgctttcagcaattgggctccaacgggttcccgttgagatctacccacccttttgggcactctgtggtacccctgctcgattcatatgatttgctgagctatgacgacctgagccatctgtacccctatttcaatatgatgtatggggataattccttctctggcctcatgcctacctttggtttccaacgacccatcaaaacccgatcaggacccgcctcagaactccacattcggctcgaggagtgttgcgagcaatggagggctctggaaaaggaacgtaaaaaaacagaacttgccctggccaagaactatccaggcaagaaggtgagctctacaaacaacacgccagtgcctcgccttacaagtaatcccagcagggtggataggctgatagtggacgaattgagggagctggctagagtctcttgcaaaaaccggtag

SEQ ID NO: 45254 - DNA, 492 bp, Artificial Sequence
  Description of Artificial Sequence: Synthetic coding sequence
atgaacaccagccggttcgccgaccaccacgacctgctgaccgagaccaaaaggccaattgatacagtcatctcccagcaggcattttattcggatgagtcagtatcggccatggagaaacagtatctcagaaatagcaatttgacaccccagcaaaagatcgacgagctccatcacggattcaccggcttagacctggaggaacagtggatgtatccaagtaggagcgatcattccaattgccacaacatccagactaatgacaccgccaaaaccacatttcaggagtatcccctaatcaagaactgtttcactccacagacagggctcagcgatattatgaaggagagtggtgtcgacatctaccactatggcagagatcgcatctgtacaaaaggtctggaagcacccctccaacaaaaaagggccgagatgtttttgtcccagtttaacagatacaacgaaaatgtagattactgtcgctacccttag

SEQ ID NO: 45255 - DNA, 390 bp, Artificial Sequence
  Description of Artificial Sequence: Synthetic coding sequence
atgaacaccagccggttcgccgaccaccacgacctgctgaccgagaccaagcgacctatcgacacagtgataagccagcaggctttctactccgacgagtcggtctcagccatggagaaacagtacctccgcaactcgaatctgacaccgcaacaaaaaatagacgaacttcaccacggattcacagggctggatttggaggaacagtggatgtacccaagtcgctccgaccattctaattgccacaacatacagactaacgacacagcaaaaaccacctttcaggagtacccactgattaagaattgcttcaccccacagactggactgtctgatatcatgaaggagagtggtgtcgatatataccattatggtcgggacaggatctag

SEQ ID NO: 45256 - DNA, 495 bp, Artificial Sequence
  Description of Artificial Sequence: Synthetic coding sequence
atgaacaacagcctggactacctggcctaccccgtgatcgtgagcaatcacaggcagagtactacctttcggaagaagcttgacttcggtcactacgtaagtcacaaaaaccgcatacagattgccaaacctacagtggacaccaaaccacccgtggcccacaccaatcacatcctcaaactctcaaagttacagggggagcagaagaaaataaacaaaattgagtacgagaacaagcagctatgtcagaagatcgccaatgctcaccggggcccggccaaagttgattgctggaacgagtactttagcaagtctcttaacagagaaacacgaaacagagaattagtgcgcatcacgatggagaaccagggcattctcaaacggctggttgaccgcaagccccactacgacaggagagcttcagagattgactggcagaatagtaggcgctatatcaggaacaccacaaggtatctgctgagccagaacgagtag

SEQ ID NO: 45257 - DNA, 573 bp, Artificial Sequence
  Description of Artificial Sequence: Synthetic coding sequence
atgaagggcacccccagcagcctggacaccctgatgtggatctaccactttcattcatctactgaggtcgctctgcagccaccccttctctcttctctcgagctgtcagtcgctgctgcacatgagtatctggaacagcgatttcgtgagttaaaatccttggaacctcccgaaccgaaaatgcagggcatgctgcctgctccaaaaccaaccctcggcctcgttctgcgggaggcaacagcgagcctcgtttcttttggaaccaccttattagagatcagtgcgctatggctgcagcaagaggcgcgtcgcctggacggttctgccggccccgcgccggacgggcgagatcccggcgccgctctgtcccgggtagcccaagccgctgggcagggggttcgtcaggccggggcagcagtcggcgccagcgctcgcttgctggtgcaaggggcctggctgtgcctttgcggcaggggactccagggctccgcatcctttctgcgtcagtcgcagcagcagctgggtttgggaatcccgggagagcccgtgtcctccggccacggcgtcagttag

SEQ ID NO: 45258 - DNA, 237 bp, Artificial Sequence
  Description of Artificial Sequence: Synthetic coding sequence
atggcccccctgcccggcgccgagctggtgcggcggcccctgcagctgtaccgttatctgcttcggtgctgtcagcagctccctactaagggcatccagcaacactacaagcacgccgtgcggcagtcgtttcgtgtgcattcggacgaagacaatcccgaaagaattcaacagattatcaaacgcgccattgaggatgcagactggataatgaataagtacaagaaacaaaattag

SEQ ID NO: 45259 - DNA, 189 bp, Artificial Sequence
  Description of Artificial Sequence: Synthetic coding sequence
atggaccagctggtgttcaaggagaccatctggaacgacgccttctggcagaacccctgggatcagggcggtctcgcagtgataattctttttatcacagctgtgctcctcctgatattattcgcaatagtgttcgggctgttgacctcgacagagaatacacagtgcgaggctggcgaggaggagtag

SEQ ID NO: 45260 - DNA, 903 bp, Artificial Sequence
  Description of Artificial Sequence: Synthetic coding sequence
atgtgcgcccggggccaggtgggccggggcacccagctgcggaccggccgaccttgctcccaagtgccaggatcacgatggagacccgaaagattgttgcgcagacagagggctggagggcgtcccagtcggcctcatcccgcccgggcgcgcccaggcttgtcactccctgccacactgttaggaagtagagcggccgctgccgtccctctgcctcttccccccgcccttgctccaggagatcccgcaatgcctgtgcgcaccgagtgccctcccccagcaggagcctccgccgccagcgcggcctctctgatcccaccccccccaattaatacacagcagcctggggtcgctacttcgcttctctatagcgggtctaaatttagaggccatcagaaaagcaaggggaattcctacgatgttgaggtggtgttgcaacacgtggatactgggaacagctacctgtgcgggtacctcaagatcaaggggctgacagaggagtaccctacattaaccacctttttcgaaggcgaaatcatctctaaaaagcatccctttttgactaggaaatgggacgctgatgaggacgtagataggaagcactgggggaagttcctggctttctaccaatatgcaaagagttttaattccgacgatttcgactacgaagagcttaagaacggcgactacgtgtttatgcgttggaaggaacagtttcttgtgcctgaccatactatcaaggatatcagtggcgcatcctttgccggtttctactatatctgttttcagaagtccgccgcatctatcgaggggtactactaccatcggagctccgagtggtatcagtctttaaacttgacgcacgttcccgagcattctgcaccaatatacgagttccgctag

SEQ ID NO: 45261 - DNA, 681 bp, Artificial Sequence
  Description of Artificial Sequence: Synthetic coding sequence
atgcccgtgcggaccgagtgccccccccccgccggcgccagcgccgctagcgcggcttcccttattcccccaccacctattaacacacaacaaccaggagtggccacgtcactcttgtattccggatctaagtttcgtggccatcaaaaatccaaggggaatagttatgatgtggaggtggttctgcagcatgtcgataccgggaactcctacctgtgcggctacttgaagattaaaggcctgactgaagaatacccaacgcttacgaccttcttcgaaggtgaaattatttccaagaaacaccctttcctaacccgcaaatgggacgccgatgaggacgtggataggaaacactggaatattggaagataccttgatctccagacgctgctggattggacagaaactttttgggtgcgggaagaactccggcggccacccctggtactcgcctgtgaagtgtggctcagtcagggggcagagccaatggaatgtttcctcctccagcaatttgtagccgcttttgtcgtccttagcatttcgcccaactttcaccatagctggagaacccctcggtttcctagaggcacaccgggagctctttactgcacctgggtgtgccttcggtttaccatgagtaatactctccacctaggatgtcatttttttataattaactag

SEQ ID NO: 45262 - DNA, 1155 bp, Artificial Sequence
  Description of Artificial Sequence: Synthetic coding sequence
atgggcgtgaccggcgcccacggcttcccctgctgcggcaagggctctgtggaggttgccgaaatgcgcgacgacctcagtcagcatcagattcaggaggagcaggaactggaagccgatatgctggagcagaagccccaactccaggtcgacctagatcttgacccagacccggaccccgaccctgagctggaaatcggccaggtgccggctctcctcgagtccgagctctatcccgccctgaagctggaggccgaacttgatacagaggcgaattccaacgaggaaagcgattttgaggagccaatgcagttagtctgtaaaatcgaaagcgtgcacagcaatatgggcctgccaactccgcagacattccgcccctggtcactgaattctaactgtcgttcattcacagaagaaaaccatgtgtctgcatgtcatcactctatatctgcccagacgagcaaacacctgttctgggcaaacaagctgattcaggcaagtgagcactccttacagcgcgccatcaacatgcagttaaacaatgggtccgccgggcagccaatcaggagccccttacgcgaagctatccctacaaacgcactgtgttcagaagaacagctgcagatacccgatgcacactcagccccccctaccaccagttcgcaagcccccagcccactgttgagtagtgatttaccaccccccattgatctcacagaacttattaccttcgcttccagcctggccatggcatcaagctcacgaatggacctgccttcacttgagcacatgatgaaggcaccaccacaggaggctctggagccgtcgaccgagccgcttcttaccacagtggaggagcgagaacccgagaatcacgccgaaacgctgcctgagaaacctcgagaagcccgggccccacttaagagttggtctcaagaggacaaaaattttgcacagtcctacttcgattttagtaagcccggcataaaaagggccacaatcaagggccagatccagctgttgcagccgcccgcgacctccccacttcttcagggttcaaaggaggactccgtgcctccggggaaagagaaagagaatcccttgctggttaaaattcactttaaactgagcgccccaactatccccgagaagtag

SEQ ID NO: 45263 - DNA, 1092 bp, Artificial Sequence
  Description of Artificial Sequence: Synthetic coding sequence
atgcgggacgacctgagccagcaccagatccaggaggagcaggagctggaagctgacatgcttgaacagaagcctcaactgcaagttgacctagaccttgatcccgaccctgatccagaccccgagctcgagattggacaggttccagctcttctcgaatccgagctttaccctgctctgaagttggaggcagagctggatacagaggctaattccaacgaggagtccgatttcgaagaacccatgcaactggtgtgtaaaatcgagagtgtccattccaatatgggcctgccaacaccccaaaccttcagaccctggtccctgaacagcaactgcagatcattcacagaggaaaaccatgtgtccgcttgccaccacagcatctcggctcagaccagcaaacacctattttgggccaacaaattgatccaagcttcagagcattcgctgcagcgggcaatcaatatgcaactgaacaacggctccgccgggcagcccattaggtcacctctgcgcgaagcaattcccaccaatgccctgtgctcagaggagcagctgcagatccctgatgctcattcagctccacccacaacaagctcacaagcccccagcccactgctctcctccgacctccccccgcctatagacctgaccgagctcattacctttgccagctcactcgctatggcatcctctagccgcatggaccttcctagtctggagcatatgatgaaggcaccaccccaagaggcgctggagccttccaccgaaccacttttaacaaccgtggaagaaagagagcctgagaatcacgctgagaccctgcctgaaaaacctagagaagcgcgggctccccttaagtcgtggtcacaggaagataagaatttcgctcaatcgtactttgatttttcaaagcctggaattaaacgcgctacaataaagggacagatacaacttctccaaccccctgctaccagccctctgctgcagggcagtaaggaggactctgttcctccaggtaaggaaaaagagaaccctctgcttgtgaaaatccacttcaagcttagtgcgcctactatccctgagaaatag

SEQ ID NO: 45264 - DNA, 1713 bp, Artificial Sequence
  Description of Artificial Sequence: Synthetic coding sequence
atggtgaagaccaacaagcccggcgccaaggtggccgtgagcgcccagagagggagcgaggtgacgaccaacacaagtcctcaacaggggcacggttacgtgttggcctcctcacaccgatcggcagctgtgtctctcaaccctagccatcgccgttcggaggcagcacatccgaccacccctcacagcgcctctgactaccctaggtcggtttctttacagagcggtcccggccactacgccgtgccaacgcccaggggacccgagacaggtccccgcacagagagcagccgacatagctccccacacctaaagtctcagaagacccagaccctggcgtcacacgcctcttcaaggcagtggaaagtgagtcccccacgagaggaggccgcgaggaggggtagcgaatctaaatccggccgggaagtgggacatcacgccagttccatacctgacgcgaagtctacccatcagctgtcatttcaagaccagaaaaataacctacagagccagattcttgaagacgaccccccttccaaggttcagaatcctcagggcgttcgggtccccagaaggatcctttcctatcctaaagatgaagctgtgcagaccgagccaattcagcgtatcaccactactagcgagatccggtcccctcgatcaccttcgttactcgagcatggtagctcctgtgtgagtgccgattatcaaacagcgcagaggagagtcccagttgaggaatctgagactgggccatatggcccgatcccttcaaagcccaaggccttgtaccgaaatatgaatctcgactcgttactgaaactgtccgtgctgaaagatagtgacggggtccaccgtgtttccgccagggttgatccggagtcattacataagtacagtgcttatccagagacgaaaccaagcgcgaaggtgctggtgagcagtcaggttgaatccaacgtaaggaccccaatccgtggaaatagtgaagtaggcaggagggttactatctctcctggagtgcagtccgtcgagccgacccatcatgttaccgtccccagcgtctctgagggctctcacaaaagcagtatgttcgtgaccccagaacctatctataagcagcaaacccaaaagccgcctgaaattacatatatgtcgcagggccccaccccccgctacccggagctgagccagaagcccagtattcatgcggagctggaactcacccccagacctttgcccccccgctccctgcctcggtatggacctgatagttcttggtggccccttctaaatccggaagtcgaaacccctcagtcccagctgacgacccccgacttcgaacctaaatgctcacccagtctggacctcctcttatccggtttcaagattgactcatcgccattctgtgaggacctgaagttccagagagagaaagcatcattgtctcccccgtcccccccaaaagagttccccagttgggctcctctgagcgaggtcccccaaacaccaaagcacacttgtaagcagcccatccaaagattcaccgcgttctttctggacgtctcggaggaaatgtacaacagggtgatctggtggctcaaagggctgtgcttttcccttctctgggcccactgtggtagcttgggggacgggaggactggcgaagagtggcatttgtgcatttaccgtgcagggtctttccggcggtag

SEQ ID NO: 45265 - DNA, 1029 bp, Artificial Sequence
  Description of Artificial Sequence: Synthetic coding sequence
atggacgacaagcccaaccccgaggccctgagcgacagcagcgagaggctcttctcattcggagtgattgccgatgtgcagtttgctgacctggaggatggcttcaattttcaggggactagacgcagatactaccggcactccctattacaccttcagggggccattgaagactggaataatgagagttctatgccttgttgtgtgctccaactgggcgatatcatcgatggctataatgcgcagtacaacgcttccaaaaagtcactagaactggtaatggatatgtttaaaaggctgaaagtccctgtacatcatacctggggtaaccatgagttctacaatttcagtagagagtacttgactcatagcaagcttaacactaagttcttggaagatcagattgtgcatcaccccgaaacaatgccctccgaagactactatgcttaccacttcgtgccattcccaaagtttaggttcatactgctggatgcttacgatttgtccgtcctcggcgtcgatcagtcaagtcccaagtacgagcagtgtatgaagattcttagagagcacaatcctaatacggagctaaacagcccccagggactctcagaaccacagtttgtgcagttcaacggcggtttctctcaggagcaattgaactggctgaacgaggtgttgaccttcagcgacacaaatcaggaaaaggttgtgatcgtcagccacctgcctatatatccagatgcctcggacaacgtctgcttggcatggaattatcgtgatgcactcgccgtgatttggtcgcacgaatgtgtcgtatgcttttttgcgggccacactcacgacggaggctatagcgaagatccattcggggtctaccacgtgaatctggaaggagtcatagaaacagcccctgacagtcaggcttttgggacagtccatgtctaccccgataaaatgatgctgaaaggcagaggacgggtgccagacagaatcatgaactacaaaaaggagcgagcctttcattgttag

SEQ ID NO: 45266 - DNA, 525 bp, Artificial Sequence
  Description of Artificial Sequence: Synthetic coding sequence
atggacaagcacggcgtgaagacccccctgtggaagaaggagaccgaagagctgcgcgccgaggacgctgagcaggaggagggcaaagaaggctccgaagacgaggacgaagataatcaacggcctcttgaagacagcgcgactgaaggggaagaaccccccagggtggcagaggagggtgaaggaagggaacgtcgaagtgtttcctattgccctttgagacaggagagtagcacccaacaagtcgccctcctccggagagcagattctggattctggggctggctggggccacttgctctcctgggtggcttaacagcacccacagataggaaaagaagcctgccagaggaaccttgtgtccttgaaatccggcgccgccctcctcgccgaggtggttgtgcatgttgtgaactccttttctgtaaaaaatgtcggtctctgcattcacatccagcgtatgtcgcacactgcgtgttagaccacccagacctgggaaaagccggcgctgcaggtaactcttag

SEQ ID NO: 45267 - DNA, 666 bp, Artificial Sequence
  Description of Artificial Sequence: Synthetic coding sequence
atgggcgagaagagccggcggaagggccccgccccccggcacgccgatggtaagcttggtagaacgtgtgatcacccctatgccccttggtcatttactcctagctctcgtgcaccaacagcttgggtccgccccccatgtcctgtttgggcctcacgcctgcaagaacattcccctgaaccacgtagggccagagctccgcctacccgtcgggctcaagctgccctatacgcacccgcactaagattgcgagatcatctggacaggttttctattctcatgacgtcatgcacctcctggttgcaggccccacaggcccctgggttgtgcagggatgaacagtctagccgcatctccgtgccgcagctgagtggcgcacccatactgctgccagacttggaaggaactaagctgagtaactttcaagagtccagtcctctgccccacaagcatgagagaaaagacaagcggtccacgccggaggaggaagggcggtctgcgcctgaaaaaattatccaaagcttaaagctttgccccggcggtcatcgtccagcctctctgtcctctgggtgccccgcggggtgtcgactgtctttcaatctgccccccagcatgctgttgtctgtgcagaagtgttgcatgcccagcagtctcaaaacatgctag

SEQ ID NO: 45268 - DNA, 1566 bp, Artificial Sequence
  Description of Artificial Sequence: Synthetic coding sequence
atggcctgcagcctgcagaagctgttcgccgtggaggaggagttcgaagacgaagatttcctgtcagcagtcgaggatgcagagaacagattcacgggttctctgcccgtcaacgcaggacgtctccgtcctgtgtcaagccggccccaggaaaccgtgcaggcccaatccagtagactgctgttgcttcaccctacggcgccaagcgaagcgctgggcctccctgacctcgacctctgtctcccagcctccagcaccccctctgccgatagtagaccttcatgtattggagctgctccgcttcggcccgtcagcacctccagctcttggatcggaaaccaacggcgagttactgtgaccgaggttctcagggaaaccgccaggcctcagtcctctgcactgcaccccctgctgacatttgagtctcagcagcagcaggtgggcgggtttgagggtccagagcaagatgagttcgataaagtactcgcatctatggagctcgaggaaccagggatggagctggaatgtggggtctcctccgaggccattcctattctccccgcccaacagcgggaaggatctgtactggccaagaaggccagggtggtagacctgagtgggtcatgccagaaaggccctgtcccggctatccacaaagctggtattatgtcagcacaggacgagtccctcgaccctgtcattcagtgcaggacgccacgaccgcctctgagacctggggctgtggggcatcttccagtacccacagctttgaccgttcctacgcagcagctgcactgggaggtttgtcctcaacggtcaccagtacaagctttgcagcctctccaggccgcccgtggaactatccagtctagtccacagaacaggttcccctgtcagccttttcagtcacccagctcatggcttagcggcaaagcccatctgcctcgtccccgaactcctaactccagctgttcaaccccatctaggacctcatcagggctctttcccagaatacctctgcaaccacaagcccccgtgtcttctattggcagccctgtgggaactccgaaaggcccccagggggcccttcaaacgccaattgtgaccaatcacctcgtgcagttggttaccgccgctagtcggacaccgcagcagccaacccacccctcaacgcgtgccaaaactcggagatttcccggccctgctggcattctcccgcatcaggctgctcttaagcagcttccccgcaataaggtacccaatatggctgtgatgattaagtctctcacaagatcaactatggatgcatctgtagtgttcaaggatcctacaggagagatgcagggcactgtgcatcggttgctgttggaaacctgccagaatgaattgaaacctggaagtgttcttctgttgaagcaaattggtgtgtttagcccctcactgagaaaccattatctcaatgtgacgcccaacaatctggttcacatctactcgcctgattctggagatggtagcttcctcaagccatcccagcccttcccgaaaatgacatggatggattcatag

SEQ ID NO: 45269 - DNA, 414 bp, Artificial Sequence
  Description of Artificial Sequence: Synthetic coding sequence
atggcctgcagcctgcagaagctgttcgccgtggaggaggagttcgaggatgaagactttctctctgcagtcgaagatgctgagaatcggtttacggggagtctgcccgtgaacgccgggaggctaaggccagtgtcaagccgcccccaggagacagtgcaggcacagtcctcgaggcttttgctgcttcatccaacagcccctagtgaggcacttggattgcctgatctggatctctgcctaccagcctcctccaccccctctgccgattcgaggccttcatgcattggggctgctcccctgcgccccgtgagcacctccaactgccttaactcatcccattccgctactccactgggctcactgtcagccacactgccttgctcctcaacctcagcctccccatcctgttag

SEQ ID NO: 45270 - DNA, 1944 bp, Artificial Sequence
  Description of Artificial Sequence: Synthetic coding sequence
atggcctgcagcctgcagaagctgttcgccgtggaggaggagttcgaggacgaggacttcctgagcgcggttgaggatgccgaaaaccgcttcacaggctcacttcccgtgaatgccggacggctccgccccgttagttccaggccccaggagactgtccaagctcaaagctcacgtctgcttctcctacatcccaccgccccctccgaggccctggggttacctgatctggacctgtgcctccccgcaagctcaacaccttcagcggacagcaggccctcttgtatcggggccgcacctttgcgccccgtgtctacttcgtcctcttggattggtaaccagcggagggttacagtgaccgaagtgctgagggagacagcccgcccccagtcaagcgccctgcaccccttactgacgtttgaaagccaacagcagcaagtgggcgggtttgagggccctgagcaagatgaattcgacaaagtacttgcctccatggaactggaggaacctggaatggaattagagtgtggagtctcgagtgaagccatccccattctgcctgcacagcagcgtgagggctccgttctggcaaaaaaagcccgtgtggtggacctgtcagggtcttgtcaaaaggggcctgttcccgccattcataaagcaggaatcatgtccgcacaggacgagagtttagaccctgtaatccaatgtaggacaccccggccacctcttcgccctggcgcagttgggcacctgcctgtccctaccgcactgacagttcccactcagcaacttcattgggaagtatgtcctcaacgaagcccagttcaagcattgcagccattgcaagctgccaggggcaccatacagagttcacctcaaaatcgcttcccttgccagccttttcagtccccttcttcttggttgtctggcaaggcccatttaccgcggcccaggacccccaactcatcctgttcaaccccgagccggacctcctcaggattattccctcggatcccgctccagccacaagctccagtaagcagcatcggatcccccgtgggtacgccaaagggtccacagggggctcttcaaacaccgatcgtgaccaaccatctggtacagctggtaacggccgcttctagaacaccacagcaacctacgcacccctccactcgagctaaaacccgaaggtttcctggtcctgccggcatcttaccacatcagcagagcggtagatctcttgaagacattatggtgagcgcccctcaaacacctactcacggtgcactcgccaaatttcagaccgagatcgtggccagcagtcaagccagcgtggaagaggacttcggacggggaccttggctaacaatgaaaagcaccctgggccttgacgaaagggatccttcatgcttcctctgcacttacagcatagtgatggttttgcgtaagcaggccgccttgaagcaattgccgagaaataaggtgccaaatatggccgtcatgatcaagagcttgacacggagcacaatggacgcctcagtggtgttcaaggatcccaccggcgaaatgcagggaacggttcatcggctgctgctcgagacatgccaaaatgagctgaagcccgggtctgtgcttctgttgaagcagatcggggtgttctccccatctcttcggaatcattacctgaatgttactcccaataacctggtgcacatttatagccctgactcaggcgatgggtcttttctaaagccgtcacaaccattccccaaggactccggatcttttcagcacgacgtcgctgctaaacctgaggaagggttcagaactgcacagaacctcgaggctgaggctagcccagaggaggaattgccggaggccgacgacctggatggactgttgtctgagctccctgaagattttttttgcggcactagctcttag

SEQ ID NO: 45271 - DNA, 2922 bp, Artificial Sequence
  Description of Artificial Sequence: Synthetic coding sequence
atggagaccaaggtgcacctgttctgccaggccgaggagaacatcgatctgctagacgacggctcgaattctttcgcgaccgacctctcaagtgggaccataaatcacaaaaaatacatcaagttctcaaagaccatagaaaaagagatctctcctgagattcggtctctgtctcccgagtacaagaagatctttgagacctccattatcttctgcggagaagaaaagtcaagcgatttttccggggaaaaaaaggttggacgtaaaagtcttcaggtccagcagcattccaaacggacagagattatcccaccctttctgaaattgtccaaagagaaggtgaccagaaaggaaaactccctatgtaaattaccaaaccagtacagcgtgcacaaaacctccagccccctgtgcacatctagcgctatcacgagggagaaagaaatgttaagtaatctgtatatgacattgtacgacgaggtgacccatgggtaccttcatagtaaagaattgagcgcactgcataaggcatgcaaaatcttttctaaaatccgatcagggaagatatacgtgaatgatctgccagtcatcctgtgtatcctccgcatatccatcagtgatctcgagatgcgacaggctctcaaaacagttgacatcgacgcctttcaggacgccctaaagatattctgccgtattaaaggaggtagagtctccaccgacgatgttttcgctgtcctggactccatgggcatccccatcaacagagaaattttagaagaggttaccaagcacacatacatcgatagcaatcatatggtggatattggggacataatttttaccctgaatgaacttcaggagcagtatgaggacgtgagtataacagaaggaagccctctgaacgagataacttcagatcggaaactgagttccgtggccggctgttacctgaaatataagaaaaagaatagcctctcttctaagcttcctgagccttcaatatccaaaaagcttaacaaaaaaagcaaccagtattacagtaaaatcatggagaacgacgatctggaatccaagcgccccaagaatacctggcagattagaaaattcttgggaggtgtgggttcctccaacgtgggggtccaggaaccctattccaagaacggtattaacttcaaaaaacattccgagaaaggagaaattcacgattctaaatcaaagccacaaagtttgaagtcttccacaagcctgagcaagtctcttgataagagtgatattagctccattcctaaactgcagaagcccgcggtccgaaaacatagttccttgcagaaacaggtgtcctctactgagaaaaccgctatcagcaccctggaaaatttctgcgaggccatcagcaagcttcaagaaaactacatagctgctgaagagctccagtcgatattgccatcaaccggtatcaatttactcgatgaggagttccagaaaatcgtgacagatacctcccgtaacgagaatggcatggtcgagctcgacgatttcgtcaatgccctagcaaaggagagatcctttcccgagtgtaatgcactacctggtgtgataaaagccattgacaagattaaagataaaaacgtggattatgaggatctgaatacttgcctccagaatttcgggatttatctgtcaaaacccgaattcaaaaaaattaccgagttaactgaggccggcgagacaaagaaggtgaactttaaggaattcatcgacacgatgatgagtaataccgagtgtttctccgagaagctcgtgctgcccgacgctatcgagaccttagatgatctccggaaagagactatgtccgtctctgatctctggaataccctgtcaagcctcaattcaaacttgaaaaaggatgagttcctagccgctctcgaactggtgacggtagacgagggggataaggtgcaattcgaagagtttgctaaggtcgtcaggaacatgagagatgcggcccgccttgaagagctgcaggaagtagtcctcgccgcagaccttctggagggtgacatgatcgccggcaaaaatttagaagacttccttcgcaatgtgggaatcaagtccccaaaagaggaagtcgagaagattctccagagtgattttgtgagtgaagataacatggtgaacatcaaagactgtatgcgggctttaagagatacccaaaagttctcaaattacatcgacttcaggaaagaggcttctaatctgaaactgcccaaagtaaacgaaattaaagaggctgccaacattttgtctcatgtggacaatggaaagatcggcattcccgatctggaacacgcactcaagtgccttaacgtgaatctgactgaagaagatttcaacgaagccttgaactgttgtaatgtctctgataatatggaggtcgaccttaaggactttctgatgaagatgaaggagtccccacattttcagaaatccaaagccacccagatcctgctggctacgactcaaatcctgcagaacgacctggtcgatgtatccgacctgaagacccttctgatggacaaagatctgcacaccgccaatgccatcctgactgtgatgctgagacacgtgccagagcacgaatctgggaaggtctctatacaagagtttatgacaaagttatcagatatcctgactattccaaaggccgctggtaaattctacttgatctgtacgtattgtccagatttggagaggcaggcagtggtgtacatgctcaagaccattcaagatagtatagtgaaagcgcaagtgtccaagaagcagtataacatgaatatcaaacagcacaagatttcattacataacttctgtctgaactccaaagctaatatcgctaaacttaatcccaactccaagttttag

SEQ ID NO: 45272 - DNA, 1596 bp, Artificial Sequence
  Description of Artificial Sequence: Synthetic coding sequence
atggagaccaaggtgcacctgttctgccaggccgaggagaacatcgacctgctggatgacggaagcaactccttcgctacggatttatcttccgggaccatcaaccacaagaaatatataaagtttagcaaaaccatcgaaaaggagatttcacctgagattcgcagtctgagcccggaatacaagaagatctttgagacgagtattatattttgcggagaggagaagtcatcagacttctcaggggagaagaaggttggtcggaagagtctacaggtacagcaacactctaaacggacagagattataccgccttttctgaagctatcgaaggagaaagttactcggaaagagaatagcctctgtaagttaccaaatcaatactcagtacataagacaagctcacctttgtgtactagcagtgctatcacgcgagagaaagagatgctgtccaacctatacatgaccctttatgacgaagtgactcatggataccttcactccaaggagctgtccgcttttcaggatgcactgaagattttttgtcggatcaaaggcggaagggttagcaccgacgacgtattcgcagtcctagacagcatggggatccccatcaatagggaaatcctagaggaggtcaccaagcacacttatattgattctaatcacatggtagacattggagacattatctttaccctgaacgagctccaggagcaatatgaagacgtgagtattaccgaaggaagccccctgaatgagattacctccgacagaaagctgtcaagtgttgccggatgttacctaaaatacaagaaaaaaaatagccttagctccaagctgccggaaccgtccatatcaaaaaagctgaataaaaagtccaaccagtattatagcaaaataatggagaatgatgaccttgaaagcaaacgacctaaaaacacatggcagattcggaaatttctggggggggtcgggtcatccaatgttggggtacaggagccttactccaagaatggcatcaattttaaaaagcattctgaaaagggggagatacatgattctaaatctaagccacagtcacttaagagctctacgtctctcagtaaatctctggacaagtctgatatttccagcatccccaagcttcagaagcccgcagtcagaaaacatagcagcctccagaagcaagtgagctccaccgaaaagactgcgatatcaaccctcgagaatttctgcgaggccattagtaagctgcaagaaaactacatcgctgccgaggaactgcagagtatcctacctagcaccggaattaatctgctggatgaggagtttcagaaaattgtcaccgacacatcacgaaacgaaaacggcatggtcgaactggacgacttcgtgaatgcccttgctaaagagcggtcgttcccggagtgcaacgccctgcctggagtgattaaagctatcgacaaaatcaaagataaaaatgtcgactacgaggacctcaacacatgcctgcagaactttggaatttacctctccaaacccgagttcaagaagattacggaacttaccgaagcaggagagaccaaaaaatag

SEQ ID NO: 45273 - DNA, 162 bp, Artificial Sequence
  Description of Artificial Sequence: Synthetic coding sequence
atggagaccaaggtgcacctgttctgccaggccgaggagaacatcgaccttctggatgatgggagtaattccttcgccacagatctcagctcaggcaccattaatcacaaaaagtacatcaagttcagcaagaccatcgaaaaggagatctcccctgagtag

SEQ ID NO: 45274 - DNA, 114 bp, Artificial Sequence
  Description of Artificial Sequence: Synthetic coding sequence
atggagaccaaggtgcacctgttctgccaggccgaggagaacatcgacctgctggatgacggaagcaactcctttgcaaccgacctgtccagtggaacaatcaaccacaaatag

SEQ ID NO: 45275 - DNA, 228 bp, Artificial Sequence
  Description of Artificial Sequence: Synthetic coding sequence
atgaaccggctgtacctgacccccgacggcttcttcttccgggtgcacatgctcgcactggattcatcatcttgtaacaaaccctgtccggagttcaagccaggtatcgagaccgacctgaacgacgccgcctatgtgttatacaccacagtgtgcaacgtcggcgctaccgcacgcgctgtgggcaggccagcttttttttgggaaaggtgggaaacgatgacttag

SEQ ID NO: 45276 - DNA, 294 bp, Artificial Sequence
  Description of Artificial Sequence: Synthetic coding sequence
atgaaccggctgtacctgacccccgacggcttcttcttccgggtgcacatgctcgctctggactcctcgagttgtaataagccttgccccgagtttaaaccaggatcacgatacatcgtcatggggcatatataccacaaaagacggcagctgccaacagccttactccaggtgctgcgtggccggttacgcccaggggatggcttgctcagatcctccagcagttacgtgaagaggttcaaccgcaagagagagggtcagatacaaggggccatccatacccagtgcatatag

SEQ ID NO: 45277 - DNA, 228 bp, Artificial Sequence
  Description of Artificial Sequence: Synthetic coding sequence
atgaaccggctgtacctgacccccgacggcttcttcttccgggtgcacatgctagcactggattccagctcttgcaacaaaccctgcccagagttcaagcctgggattgagaccgacctaaatgatgctgcctacgttctttacacgacagtctgcaacgtgggcgcgactgctagggcggtgggacgcccagcctttttctgggagaggtgggagactatgacctag

SEQ ID NO: 45278 - DNA, 228 bp, Artificial Sequence
  Description of Artificial Sequence: Synthetic coding sequence
atgaaccggctgtacctgacccccgacggcttcttcttccgggtgcatatgttagcactcgattctagctcttgtaataagccatgccctgaatttaagcccggcatcgagaccgaccttaatgatgcggcctacgttctgtatactaccgtgtgcaacgtcggcgctacggcacgagcagtaggtaggcccgcgtttttctgggaaagatgggagacaatgacttag

SEQ ID NO: 45279 - DNA, 1689 bp, Artificial Sequence
  Description of Artificial Sequence: Synthetic coding sequence
atgctggcctgcctgcccggccccggcgacctgagcttccagctgctgagccacacgcagatgaacacaggactgcagaagtgggacaccactcaaaaaatgcgaaccgcccactatcctacacctgccgaactagacgcctacgccaaaaaggtcgccaacaatcccctcacaattaagattttccccaattctgtaaaggtcccccagcgcaaacacgtaagacggaccgtgaacggcctggacacatctgcgcagaggtactcaccttaccctacgcaggctgcaaccaaagcaggcttgcttgccatcgtcaaggtacccgcaaaaagtattctaaaggatttcgacggtacacgcgcgcgattactgccagaggcaatcatgaatcctccagtggcaccctacgccaccgtggcaccaagtaccctcgcccacccccaagcgcaggcactggccaggcagcaggccctgcagcatgctcagacgctggcacatgccccaccccagacactccaacatccccagggcattcctccacctcaggctttaagtcatccccagagcctccagcagccccaggggctaggccaccctcagccaatggcacagacgcaggggctggtgcacccccaggcactggcacaccaaggcctgcaacatccacacaacccgctcctgcatggtgggcgtaaaatgcctgatagtgacgcccccccgaacgtgaccgtgtcaaccagcactatcccgttgagtatggctgccaccctccagcacagtcagcccccagatctcagcagtatagtgcaccagattaatcaattttgccagacccgggccggtatctcgacaacatcggtctgtgaagggcagattgctaacccatcccccatctcccgttctctgctgattaacgccagtacgcgggtatcaactcattcagttccaacccctatgccctcctgtgtggttaatcctatggagcacactcacgccgctactgcggccctgccagccgccggccccgtgaatctgcccaccggaatcagccgcgtgcctactgggtatccctctgatctcaagcccgtcacttggaatcagcatcagctcgcacacctgcagcagatgtgcagcgaagcaagcgggacccccgctccaggattgacaggaaagcacgccgcgggccgcgagctcgccggaccaggctttgttgggaaggcgcccgcgtatccacaggaattgtgcctggcgcaatcatttcacctgaaacccccactggaaaaaccaacccctagccctcccgtgaacggaatggccgcccccctcgcatacccgaacggccattacttccagcccctgtggaacaatatccttcccacccccaacagcgactccagtggatcacaggatctagctatgccgtttcacggaggccagccaactggagctccactggactgcgcagctgccccaggggcacattatagagctggaaccgggggaggtcctgtcgcctctcagaattcacttatgcaaaccgtggattacctctcaggagactttcagcaagcatgctttcgcgagcagtcgctggccatgctgtcaaaggcccacagggcccctggaaatcgggccccggaccccaccgagtctaggtctctccacatacagcacccaggataccgatag

SEQ ID NO: 45280 - DNA, 1689 bp, Artificial Sequence
  Description of Artificial Sequence: Synthetic coding sequence
atgctggcctgcctgcccggccccggcgacctgagcttccagctgctcagccatacacaaatgaacaccggtctccagaagtgggatacaacacagaagatgcgcactgctcattaccctacacccgccgagttggacgcatacgctaagaaggttgccaataaccctctgacaattaagattttccccaacagtgtcaaggtgccccagagaaagcacgtccggaggaccgtgaatgggctggacacatccgcacagcgctactcgccatacccaacacaggccgccacaaaagcaggactgctggctatcgtgaaggtaccagccaagtcaattcttaaggactttgacggaacccgtgcgagactcctgcccgaagcaattatgaaccctcccgtcgccccttacgcaacggtggctccctcaaccctggctcacccccaggcccaggccctggcgcggcagcaggctctgcagcacgctcagaccctcgcacacgctccccctcagactttgcagcaccctcagggtataccacctccccaggcactcagtcatcctcagtccctgcaacagccacaagggctgggccacccccagccgatggctcagacacaaggacttgtgcacccacaggcactggctcatcaggggctgcagcaccctcataatcctttgttgcacgggggcagaaaaatgcccgacagcgacgcccctccaaacgtcacagtgtcaacgtcgaccatccccctttccatggctgctactctacagcactcccagcccccagatctctcaagcatagtgcatcagatcaatcaattctgccaaaccagggcaggtataagcacaacatcggtgtgcgaaggtcagattgccaacccatctcctatatcacggtccctgctgataaacgcctctacccgcgtctcaactcatagcgtcccaacccccatgccgagctgcgtggtcaatcctatggaacatactcacgccgctacggctgccctgcctgccgccggccctgtgaaccttccgaccgggatctctcgagttccaaccggttacccatccgacctgaagccggttacgtggaatcagcatcagttagcccatctccagcagatgtgctcggaggcctccggaacacctgcccctggactcactgggaagcacgctgccggacgagagcttgccgggcctgggttcgtagggaaagctcccgcttaccctcaagaactttgtctcgctcagagtttccacctgaagccccctctggagaaacccactccttctccacccgtgaatggcatggcagctccgcttgcataccccaacgggcactactttcaacctttgtggaacaacatcttacccacgcccaattccgacagtagcggttctcaggatctcgcaatgcctttccacgggggtcaaccaacgggcgctcctttagattgtgccgcagcacctggcgcccattaccgcgcaggtactggcgggggaccggtggcatcccagaactcactgatgcagaccgtggattacctgtctggagacttccagcaggcctgctttagggagcagtcactcgccatgctaagtaaggctcatcgcgctccgggaaacagggctcctgaccctacggaaagtaggtccctccacattcagcaccccggctatagatag

SEQ ID NO: 45281 - DNA, 711 bp, Artificial Sequence
  Description of Artificial Sequence: Synthetic coding sequence
atggaggccagcgacggccagggcggcgagggcgacaagcccctggaacaagtgactaatgtcagttgtctggaaactagctctagcgcctcacctgctcgcgacagcctgatgagacatgccaagggactggaccaggacaccttcaagacctgtaaggagtatttgcggccactcaagaagttcctgaggaaattacacctgcctagagatctgccccaaaagaagaaactcaagtacatgaaacagtccctggtagttcttggcgatcacattaacacttttttgcagcactactgccaggcatgggaaatcaagcactggcggaaaatgctgtggcgatttatttctctgtttagcgaactggaggcaaaacagcttagaaggctatataaatatactaagagttcccagcctgcgaagttcctcgtgactttctgcgctagtgacgcccctgagcgcagcttgctggcggacagagaggactcactgcccaaactgtgccatgcctggggtctccactcgaacataagcgggatgaaagaacgactttcaaacatgcaaactccaggccagggctctccactgccgggtcagccacggtcccaggatcacgtgaagaaggactccttgcgggagctgtctcaaaaacctaaacttaagcggaagaggattaaggaggcccccgagacgcccgaaaccgaaccatag

SEQ ID NO: 45282 - DNA, 582 bp, Artificial Sequence
  Description of Artificial Sequence: Synthetic coding sequence
atgagcggcccccccagcgccccccagggcgccctggccgcccccagatcgccagctgttagaagaaaggggctgcaggcacccagttggggttcaccgggtcgaccggccgcacactctccttgggcgtgcgggccaccccactggggccctcaaagaggcccaaggaacgctgccgctgccagaccaggaccccgcagtaggtggcacaagcggtgtgccgccgcttgcggcgcttgtgcacgcccacctggtcatcagctccagcctcccggggccggtgccccccaacccggcgtggcatgctcttatctgggtcctcggccacagaggaccccctgtagtgcccagagccgcccaggttggtgtgcaggaccccggcggaggcacgccccgggcactgagccacacgttgctcccgggagggctcctcctcctagagctggggcgagccctggaagccgccttttgcccggaagtccctcattactgctgccagcagccacatggaggacgtggggccaggagagcaaggtattgagaaagatcttgaaggcctgggatccattctctctactctag

SEQ ID NO: 45283 - DNA, 1713 bp, Artificial Sequence
  Description of Artificial Sequence: Synthetic coding sequence
atggcctacgagaagagcaccgacatcagcgacgtgagccggagcatgttcttgtacccctggctcgagtacccagacaaaaccaaagagttgagaaaggccatggctcctgtacatctgccactgtcatgctatcagatgcccaaggaggagttcccaccaagcccagagtgttggcgtcagcacccgagcaaacccaattctgttccatactgttactttaagaagccggaaatttatactcactggcatgatctgtacgaccagagagaagagagggaagccgaaaagatgctgcgcaaaatgcgcgacgactgccgctacatcaaagaagtacatcagacccacatcaagatgtttcatcttccgatgtctaaactcaccattaagtcagagatgcgctcccggccactcgagcccacgcaggatccgcttaaatggcagagattaagggaattaacgaagagcttggagtcgccgcgggaagacgaacagttctacgctgcccaggcccttggttgtctgagaatcagcgacaagtttgtgatggaggcgcttcaacaggtggcccagaccggacctgagaaagttaagtatgaggcatatcgcacactggccatcctggggtgtctgaacaagcacgtgatacgggccctgatcaaacaattaaaggagaagaatgagggtcagcgaatggaaacactgactggccttaggatggcactgaactcctgggctgcagtgagcaaggataagaggacgcaggtcggggacgaaggtaaactcgtgcctgtgctgcagactctcataaagaagtctagctccgaggcgtcgctggaagcggcattatgcttgggttttttaaggccgtgttctaatatggtgcaggaatttctcctgcagtgtctttgtcagggcctgaaaacgcagcgcatgaaagcccttaggatgttagttaaggtcatgcacgtccatagcgcccccgtgatcaaggcaatcttagatcagttatgctcttccagcgtactggaggaccgtttcgaagcgacccagatgctgaagacaattgggcttgagcagatacaggcacaaggactcgaagagttgacatttaatctactaaggaggaagactcacaacgaacctttcctcgcggttagacaagccgtagcccagaccgtcgaagaattaaaactcaagcctacgatgatgaacctggtggaagcccagttgatgaatccagacgcgactgcaagacaggaggccgtcatctcccttggtgttttgggcatcaggagccctcaggtctttcatcttttgctggatctgctggatgccgagaatcaccaagcagttaagaagagcctgcaagagacattgatcctgtgtgcgtctatagacccctggatccaaaacaagctcaaaaacaaagtgctctctgtgtatgaggccccaaagacaaacgtaaaagccgagcccactcggtttcaaaaagaaccagagaaccccgaggagctgaccattcaggatttcagattagcaaaactcaatcccctattcattgcaaagtcaattaccaaggtaggacagaagaagacacccgccttccctccatgctgcagcaagccaaggaagcataggccccaggtgattgggccttggcagcctaggatcaaaaaacaattgcgcgtgctcgcagaaatagcaaaatag

SEQ ID NO: 45284 - DNA, 1422 bp, Artificial Sequence
  Description of Artificial Sequence: Synthetic coding sequence
atgctgcccggccccgccctgcggggccccggccccgcccagtaccagagaccggggatgagccctggaaaccggatgcctatggcactcgcaggggggactccgtgttggttacctatctggtgctctagctccgctagtacttggcacgcaacacaccacgacggctccatccccaagactcccgcatgcgccccacaaccacctatgcctgcccagagacgggggctcaagagaaggaagatggccgacaaggtgctaccacaacggattagggagctcgtgccagaatctcaggcgtatatggatttactggcctttgagaggaaactggaccagacaatagcccgaaagcggatggagatccaggaggctatcaagaaacctttgacccagaaaaggaagctgcggatctatatttctaatactttctctcccagcaaagcagagggtgattctgccggcacagctggaacccccggtggaacacctgcaggggacaaagttgccagctgggaactacgggtggaaggtaaactgctggatgaccctagcaagcagaagaggaaattctcctccttcttcaagtctctcgtcatcgagctggataaagagctctacggcccagataaccatctagtcgagtggcatcgaatgcctactacacaggaaactgatggatttcaggtgaaacgcccaggcgatctcaacgtgaaatgcaccctcctgctcatgctcgatcatcagcccccccagtacaagctggatcccaggctggcccgactgcttggcgtgcacacacagaccagggctgcaatcatgcaggccctctggctttacataaagcacaaccagctgcaggatggccatgaaagggagtacattaattgtaatcggtactttcggcagatcttctcttgcggccgactccggtttagtgaaatccccatgaaactggccgggctgttgcagcacccagaccctatcgtgataaaccatgtcatcagcgtggaccctaatgatcagaagaaaaccgcctgctacgacatcgacgttgaggtcgacgaccctttgaaagctcagatgtctaactttctggcgagcacgacaaatcagcaggagattgcctcactcgatgtcaaaattcatgagacgatcgagagtatcaatcagttgaagacccagagggatttcatgttatctttttccaccgatccgcaggactttattcaggagtggctgcggagtcaacgtcgcgaccttaaaatcattactgatgtcatcggcaatccagaagaggaacggcgtgccgctttctaccaccagccttgggctcaagaggccgtcgggaggcacatatttgccaaggtgcagcagaggaggcaggagctcgaacaagtgctgggaatcaggctgacttag

SEQ ID NO: 45285 - DNA, 570 bp, Artificial Sequence
  Description of Artificial Sequence: Synthetic coding sequence
atggccagcggcgccggcggcagctggggccggagccccccccagagcgccgttccaacaccgtgggttactttcctgcagcccttgagctgggcagtccccccagcacccccgcagcccggcagagtaaaggaggatcttctcgagctcatgatgctgcagaacgcacagatgcaccagctcctgctttcccggttggttgccggtgcactgcagcctaggccagcgtccccttgcccacaggtttacctggaggtgccccaggaggagcctgaggaagaggaggaggagatggatgtccgggagaaaggccccctcgtgttccatcatcactatttgccctacctcatgcccagtcccggagccctgctcccttggcccgcacctttctttcccactcccgcctgccagccatatctgcaggatgtcccccgcatccagcattgcccagctagtcgagagcgtgaggtacgggcggttccaccgccccccccaccgtcagctacgggcactgtcggagcggatgtgccccctgctagcgactattatgacgcagaatccttgctgtag

SEQ ID NO: 45286 - DNA, 711 bp, Artificial Sequence
  Description of Artificial Sequence: Synthetic coding sequence
atggccagcggcgccggcggcagctggggccggagccccccccagtcggcggttcccacaccctgggtcacatttcttcagccattgagctgggccgtgcctcctgcaccgccccagccaggccgggtcaaggaggacttgctggagcttatgatgcttcagaatgcacagatgcatcaacttctactgtcaaggttggtcgccggggctctgcagccacggcccgcaagcccctgtccccaggtatacctggaggtaccgcaggaagagcctgaagaagaggaggaggagatggacgtgagggagaaaggaccccttgtgttccatcaccactacctgccctatctgatgccctcacccggagccctattgccctggcctgctcccttctttccaacccctgcttgccagccctatttgcaggacgtgccccggatacagcattgtccagcgtcccgtgaacgagagaccactatgatgccacgggcgtcatacgaggaccgcccaagaccctgggagctccaccagcttcccgcattagataccgcacccgaacctcctccggcgcctttgctgtccacacccagatgtccatggctggccgtattactcacaccgagcacctctgcacggcctagttcccccggcgaaatttccccttgcccgacgcccatgtcatcttggaccgggagaatttgtgctgtggtgtag

SEQ ID NO: 45287 - DNA, 420 bp, Artificial Sequence
  Description of Artificial Sequence: Synthetic coding sequence
atgatgctgcagaacgcccagatgcaccagctgctgctgagccggctggtcgccggggcattgcagccacgaccggcttcaccttgcccccaggtctatctagaggtacctcaggaggagcctgaagaggaggaggaagaaatggatgtcagggaaaagggaccactggtcttccaccaccactatttaccctacctcatgccttcgcccggcgcgcttcttccctggccagctcctttttttcccactccagcgtgccagccatacctgcaggacgtcccgaggatacagcattgccccgccagcagggaaagggaggttagagctgtcccaccacctcccccaccaagtgcaaccgggacggttggggctgatgtccctcctgcctccgactactatgatgccgaatccctgctttag

SEQ ID NO: 45288 - DNA, 297 bp, Artificial Sequence
  Description of Artificial Sequence: Synthetic coding sequence
atggccagcggcgccggcggcagctggggccggagccccccccagtcggccgtgcctaccccgtgggttacattcttgcagcccctcagttgggctgtgccccccgcaccaccccagcccggacgagttaaagaagatctcctagagctgatgatgctccagaacgcccagatgcatcagcttcttctaagcagactcgtggctggtgctctccagccccgccctgctagcccttgccctcaagagagctgtgcccctacaccaaccccacaatgtcaccgagattgcgggtgttag

SEQ ID NO: 45289 - DNA, 1506 bp, Artificial Sequence
  Description of Artificial Sequence: Synthetic coding sequence
atggagaaccagctgtggcacaacaccgtgcggtgctgcaaccagtatcaagaatccccccatgacgcagaggacatcctgctattgctcctgggacttattgtgttggtaaacatcggaattaatgtggcaaccatgatgtggcacggtctgcagaacgccctagacaagatgattgactgggcgacccagaagaatgagatccaggcttcagagtcgcctccgtctgggcctccagataaggcgcaggacgtccatatccactgcattctggacccagtgcaggtcaagatgagcagacccacccagtattcctcattctcctgccatcatttcagcaaccaccatagcagctctctgctccgctgtgttcgtcgcaggaggaggcgccatagaaggtgccgccgccggtgctgcaaccaccagcagcggccccagaactaccgacagatcccccactcccactccgtcttccggaaccctcaccggtctcagaagatgagccagcttcatagagtgcccttcttcgaccaagaagacccagatagctatctggaggaggaagacaacctgcctttcccttaccctaagtacccacggcggggctggggagggttctaccagcgtgcaggtcttccttctaatgtggggctgtggggacatcaggggggaattttggccagcttgcctcccccttctctgtacctttctccagagctacggtgcatgcctaaaagagtggaagcacggtcggaattgcgcctccagtcctacggccggcacggatcgcagagccggttgtgggggaacgtcgaagcggagcaatgggcttcctcaccacctcctccacaccggctgcctccaaatccttcatgggttcctgttggccacagtccatatccttctgttggatggatgctgtacgactcatgggaccaacgacgcagaggaacagaaggattcgaaaggcctcccgctagcgtgtctaggaatgcccgacccgaggcccagggatgcagggaacaccacagtcctcagtcccaccaacagtcactcctcggtcatgcatacggtcagagccaccggtccccccatcccagtacagagcctctgggatacagcagtcaggaccctcgggaagttcggaggcgggctgccgattgggccgaggctctcccagcttggcggcctttgacgacttcagccagcctgaccgtgcttgatgaagcgagccatcagcggaccccagccccaagttcagtcctggtgccccacagttcacagccctggcccaaggtgcaagccgccgatcccgcaccgccccccacgatgtttgtaccactgtctcgcaatcccggtggaaacgccaattaccaggtgtacgattccctcgaactgaagagacaggtgcagaagtccagagcacggtcttccagtctcccccctgctagcacttccaccttgcgccccagcctgcaccgatcgcaaaccgagaaattaaactag

SEQ ID NO: 45290 - DNA, 1812 bp, Artificial Sequence
  Description of Artificial Sequence: Synthetic coding sequence
atgagcggctacagcagcgaccgggaccggggccgggaccggggcttcggggcccctcgatttggcggctctagggcaggtcctctgtccggaaagaagttcggcaatccaggcgagaaactggtgaagaagaaaaacttctaccaagagcatccggacctggcccggcgcacagcccaggaggttgagacctaccgcagatcaaaggagatcacagttcgagggcacaactgtcctaagccagtactgaatttttatgaggcaaactttcctgccaatgtcatggatgtcattgctaggcagaactttacagagcccacagctatccaggcacagggctggcccgtggcccttagtgggctggacatggttggggttgcacaaacgggtagcggtaagactctctcctatcttctacccgccatcgtccacatcaatcaccagccttttctggaaagaggtgatgggccaatttgcctggtgttagctccaacgagagagctggctcagcaggtgcagcaggtagcggcggaatactgccgagcctgccggttaaagtcaacttgtatatacggaggagcccccaaaggacctcagatccgggacctggagagaggtgtggaaatctgcatcgcgacgcctgggcgcctgattgatttcctggaatgtggcaaaaccaatctaagacgtacaacttatctggtgctggatgaggccgaccggatgctcgacatgggatttgagccacagatccggaaaattgtggaccagattcgcccagatcgacagacactcatgtggagcgctacgtggcctaaggaggtgcgtcagctggccgaagactttcttaaagactacatacatatcaatatcggcgccttagagctgagcgccaaccacaatattcttcagatagtagacgtgtgccacgatgtggagaaggacgagaagctgatccgtctgatggaggaaatcatgtctgaaaaagaaaacaagacaattgtgttcgtcgagaccaaacgacgatgcgatgagctgacacgcaagatgagaagggacgggtggcccgctatgggaattcacggagataagtctcagcaagagagggattgggtattgaatgagttcaagcatggaaaggccccgatactaattgccactgatgtggcctctcggggtctggacgtggaggatgtgaagtttgttatcaattatgattacccaaatagctcagaggactacattcaccgaatcggaagaacagctcggtctacaaaaaccgggacagcatatacattttttacacctaataacatcaagcaggtgtcggatctcattagtgtcctcagggaggccaatcaagctattaatcctaagttactgcagctggtggaggaccgcggctccggaaggtcaagagggcgaggcggcatgaaagacgatagaagggaccgttatagcgctggaaaaagagggggtttcaacaccttccgcgaccgcgaaaactacgaccggggctattcgtccttgctgaaaagggattttggagccaagacccaaaacggggtgtatagcgctgcaaactatactaatgggtctttcggatctaatttcgtgtccgcaggcatacagaccagctttaggaccggaaatcccaccggcacatatcagaatgggtatgattccactcagcagtatgggtcgaacgtccctaacatgcataacgggatgaaccagcaagcttacgcgtatcccgcaacggcagccgctcctatgatcgggtatccaatgccaactggttatagtcaatag

SEQ ID NO: 45291 - DNA, 1191 bp, Artificial Sequence
  Description of Artificial Sequence: Synthetic coding sequence
atgctgcccagcctgcaggagagcatggacggcgacgagaaggagctagaaagttctgaagaagggggctccgccgaggaaaggagacttgaacccccatctagctcgcactattgtctctactcataccgcggcagcaggctggcccaacagaggggggactctgaggacggatccccttctgggaccaacgccgagacaccttccggagatgacttcagcctgagcctggccgatacaaacctgccatccgaggtagaaccagagctgaggtccttcattgcgaagcgcctgtctcggggggcggtgttcgaaggcctggggaacgttgccagcgtggaactgaagattccgggataccgcgtcggctgttactactgcttgttccagaacgagaagctgctgcccgaaactgtgacaattgatagcgagaggaacccttccgaatacgtggtgtgcttcctcggaggctcagagaaaggattggagttgtttaggctggaactggataagtatattcagggtctaaaaaacaatatgaactgtgaagcaagaggtctcgaatctcatatcaagagttatctctcatcctggttcgaagacgttgtgtgtcccatccagcgcgtcgtattgctgtttcaggagaaactcacctttttgctgcacgctgctctaagctatacccccgtggaggtcaaggaatcagatgaaaagactaagagagacatcaacagatttctttctgtggctagcctgcaggggttaatccacgagggaacaatgacctccttatgtatggccatgactgaagaacagcataagagtgttgtcatcgactgctcgtccagccaacctcagttttgtaacgccggttctaataggttctgtgaagactggatgcaggcctttctaaatggggccaaaggtggaaacccctttctgtttcggcaggttctagagaattttaaactcaaggccatccaggataccaataaccttaagcgctttatacgacaggctgagatgaatcattacgccctttttaaatgctatatgttcctcaaaaattgtggctcaggggacatactcctgaagatcgtgaaggtagagcacgaagaaatgcccgaggccaagaatgtcattgcagtgttagaagaatttatgaaggaagcacttgaccagagcttttag

SEQ ID NO: 45292 - DNA, 732 bp, Artificial Sequence
  Description of Artificial Sequence: Synthetic coding sequence
atggacgagctggccctgagcttcagcctgacctgcctgctgcccgaaaatcgcgcctcactgagccctagccagccactctcgttccagtgcctgaaagccccggcaacacttacatgggaggacgagaagcaacagcgatggggacagccccacggtccagtgagctctccccttctaggagaccaccgatgcctggtgccatttcgggatttgaacccatcaagcgaagttaacacagccaatctgctggagagtcccagcagtctcctgctcactagctgctatatttgctcttatttttcattctatatacttggagaaaaaaggtgccacagtctgaaacgcttgaggtattccgtatgctgcaaggtctgccccaacttctgcgcttgcggcaaagagaatgtttctggaaccggccaagtgtgtacaggcgttcatgtcggagccaaagaacaggaagagcccggcggcacccaggctttgcggagctgcggcatctattgtctggaggaaaggactgataaggccagccacgaagaatgccgggagcgttctactttgggccggccacagtgcactgggcttacaccctcactggcaggcgagtctccctgcccccgactgctgccagggtcaccgaccgtccgccaccttatcgctagtagttgccctggcttgtcagacccattaccactgccccctggtaccttaccattgggctcttag

SEQ ID NO: 45293 - DNA, 732 bp, Artificial Sequence
  Description of Artificial Sequence: Synthetic coding sequence
atggacgagctggccctgagcttcagcctgacctgcctgctgcccgagaaccgtgcctccctgagtcctagccagccattgagctttcaatgcttgaaagcgccagcaacgttgacgtgggaggacgaaaagcagcagcgctgggggcagccgcacggccctgtgtccagcccacttctgggagatcatcgctgcttggttccctttcgagacctgaatccaagctcagaagttaatactgccaatctgctggagtcaccttcttccctcctgctgacaagttgctatatctgtagctatttcagcttctatatcttgggagagaagaggtgtcattcactgaaaagactgcgctatagtgtgtgctgtaaggtatgtccaaatttttgtgcctgcggcaaggagaacgtgtctgggaccgggcaggtatgcacaggcgtccatgtcggcgccaaggagcaggaagagcccgggggaactcaggcactccggtcttgcggtatttactgcctggaagagcggactgataaagcaagccatgaagagtgcagggagaggagtacactgggcagaccacagtgtacaggcctcactccaagtctcgcaggggaatctccttgtccccgtctgctccctggatcaccaaccgtcaggcacctcattgccagcagctgccccggcctctctgaccctcttcccctgcctccagggactcttccactcgggtcctag

SEQ ID NO: 45294 - DNA, 117 bp, Artificial Sequence
  Description of Artificial Sequence: Synthetic coding sequence
atggacgagctggccctgagcttcagcctgacctgcctgctgcccgaaaatcgagcgtcactgagccctagtcagcccctgtctttccaatgtctcaaggcaccagctaccctgtag

SEQ ID NO: 45295 - DNA, 756 bp, Artificial Sequence
  Description of Artificial Sequence: Synthetic coding sequence
atgggccggcccctggagggccagcccctgcgggccctggacctgtatcccgaaccagcctttcttcggtcggggaaggaccccaagtcatcacccgcctcttccccctcctttgcagtcctgggacccgaggtaaggtccacgggagggcaggctgggtctcgtaggagaccttccgcaccttgttcccaggatcgcgccgctgcagaaggtgcccccgctcttcttggcgggtctccgtcctctggcagtccaggtcacccccccggctccgcctttggcgtggaagccgggtgtcgcgccctgaacgtcagcgagcatgctagaggtggattcgctctaggactcccctttggcctgagcggaggcgcttacctttttctgctccttgatggtgccggagaccccaaaccgacgcccgaagcacctatctccagcgcagatggtagggcctggttcccctcggaatcttcgtggcagctgcctcagctcccggccgggtccacctctggctctgagcctcgggcccgccctggtctgggcccccgtcagttgctgaccggccctcgcgacggcgccgctggccaggggcctgggcggggtcttactgcccgcctgggcagggagcgcgagatcgactgtggtccccggcaggccggccacggcggaaccgccaccgacactgggagggctgggagtggcgcgagacaccgtccgccccgggaccgcggtacacccggactaaggactcactag

SEQ ID NO: 45296 - DNA, 435 bp, Artificial Sequence
  Description of Artificial Sequence: Synthetic coding sequence
atgacccggatgacccggcccctgaagagccacgtgcaggtggtgccatcgacactcatgtggcagtcgcaggcgcggacgcagcccgctccactttgctgtaaactgctgacaccccgatggctgcctctgctgttgcccacgcaccctcacagtcattgtctagctgggcatctcttctttcctgcccggtactcatgcagctccgaatggaagcagcagcttacttgccatctgtgtgtaacagacagcgccccgccccggcacactggtgtcgtcgtatccgaacacttgagacggaccgagaaactgtttttcactatcctctctccaaaccagtctaagcctttcaaaacatggaaaatgcttaaggccaccatccctatcttcgtttgctttcttttgaacttagctcagaacccacggcccctctag

SEQ ID NO: 45297 - DNA, 1023 bp, Artificial Sequence
  Description of Artificial Sequence: Synthetic coding sequence
atgaagtacggcaaccccaactacggcggcatgaagggcatcctgtccaattcctggaaacgccggtatcattcccgtcggatccagagggatgtgatcaagaagagggcccttatcggagatgatgtggggctgacgagctataagcataggcactcgggacttgtgaatgtgcccgaggaaccgatagaggaagaagaagaagaggaggaagaagaggaagaagaggaagaagaggaccaggatatggacgcagatgatcgcgtggtagtagaataccacgaggagctgcccgccttgaagcaaccacgcgagagatccgcatcccggagaagctcagcgagttcctccgattccgacgagatggattacgatttagagttgaagatgatctctaccccttctccaaagaagagtatgaaaatgacgatgtacgcagatgaggtcgaatcacagttgaaaaacatccgcaatagtatgcgagcagactcagtatcatcctccaacattaagaatcgcattgggaataaactccccccagagaagttcgctgacgtgcgtcacctactggacgagaaaagacagcattctaggccgcggccccccgtttcatcaacaaagtctgacattcgacaacgcttaggaaagcgtccccactcgcctgaaaaagctttcagctccaatccagtcgttcgtagggagccttcttctgacgtgcactcgaggctgggagtccccaggcaggatagtaaaggtttatatgccgacacacgtgagaaaaaaagcggaaatctttggactcggctggggagcgcgcccaaaacgaaggagaagaataccaaaaaggtggatcaccgagccccgggcgcagaggaggacgattccgagctgcagcgggcttggggtgccctgatcaaggaaaaggaacaatctagacagaaaaagtctcggctcgataatctgccctctcttcaaattgaagtcagccgcgagagctcaagcggcagcgaagcggagtcctag

SEQ ID NO: 45298 - DNA, 1863 bp, Artificial Sequence
  Description of Artificial Sequence: Synthetic coding sequence
atggccgccgtgcggggcctgcgggtgagcgtgaaggccgaggccccagctggccccgcactcgggctgccctccccagaagcagagagcggggtagatcgaggcgaacctgagcccatggaggtcgaagaaggtgagctggaaattgtacccgtgaggaggagcctaaaggagctgatccctgatacgtctcgccggtacgaaaataaggctggctcatttattaccggaatagacgtaacttcgaaagaggcgatcgagaagaaggagcagagggcgaagcggttccacttcagaagtgaggtgaatctcgctcagcggaatgttgctcttgatagggacatgatgaaaaaagccattcctaaagttaggctcgaaactatctatatatgtggggtcgatgaaatgtcaactcaggatgtgttcagttacttcaaagagtaccccccagcgcacattgagtggctggacgatacttcctgcaacgtggtgtggctcgatgaaatgaccgcaacaagggccctcatcaacatgtcatcgttgccagcacaggataagatccgttcccgggatgccagtgaggataagtcggctgagaaaaggaaaaaagataagcaggaggattcttcagacgacgacgaggcagaggagggggaagttgaggacgagaactcatcagatgtggagctggacacactttcacaggttgaggaagagtccctgcttcggaacgatctcagacctgcaaataagcttgctaagggcaatagactcttcatgagatttgccacaaaggacgataagaaggagctgggcgctgctcgtaggtcacagtactacatgaaatatgggaatccgaactacggcggcatgaaaggcatcttgtcaaatagctggaagcggcgataccacagtcgacgaattcagcgagatgtaatcaaaaaacgtgccctcatcggggacgatgtgggcctgacttcctacaaacaccgtcacagtggcctggtgaatgttccagaggaacctattgaggaggaggaagaagaggaagaagaagaagaagaggaggaagaggaagaccaggatatggacgccgacgaccgagtggtggtggagtatcacgaggaattgccggctctcaaacagccacgggagcggtctgcgagccggagatcgtctgcgtcctcgtccgatagcgatgagatggactatgacctggaacttaagatgatctctacaccaagtccaaaaaaatctatgaagatgacaatgtatgccgatgaagtcgagtcacaacttaaaaacataagaaactctatgcgggctgactccgtgagctcctctaacattaagaaccgaatcgggaataaattgccacccgaaaaattcgctgatgtgcggcatcttctggacgaaaaacggcagcacagcaggcctcggcccccagtctcctctaccaagtctgatattagacaacgtctcggcaaacgtcctcattctcctgaaaaggcttttagttccaatcccgttgtgcgccgcgaacctagttccgatgtacacagcaggctgggtgttccgcgccaggactcaaagggtttatatgccgatactcgcgaaaaaaaaagcgggaatttatggacacgcctaggcagtgcccctaagacaaaggagaaaaacaccaaaaaagtggatcacagagcacccggggccgaagaagatgattctgaattacagcgagcctggggggctttgattaaagagaaggaacaaagcaggcagaaaaaatcccgactcgacaacctccccagcttgcagatagaagtttcacgggagtccagctccgggtctgaagctgaatcatag

SEQ ID NO: 45299 - DNA, 1140 bp, Artificial Sequence
  Description of Artificial Sequence: Synthetic coding sequence
atggagaccctgtgccccgccccccggctggccgtgcccgccagcccaagagggagcccatgctctcccactcctcgcaagccatgtagagggacccaggaattcagccccctatgtctgagagctctggctttttgtgccctcgcaaaaccgcgggccagttcgctcggtccagggccaggcgagctcgctgctagaagccccgtgctccggggtcctcaggcccccttacgtcctggaggctgggcgcccgatggcctgaagcacctgtgggccccaacgggtcggccgggggttcctaatactgctgccggtgaggatgccgatgtagccgcctgtccccgacggggtgaggaggaagaaggtggaggggggtttcctcattttggtgtcagaagctgcgcaccccccggtcggtgtccagccccaccgcatccgagagagtcaacgacctcttttgcatctgcacccccgagacctgcacccggtttggagccacaaaggggccctgctgcttccccgccgcaggagccctcatctagacctccgagcccaccggctggactgtctacagagcccgccggacccggaacagcacctagaccattcctgcctggccagcctgccgaagtggacggaaatcccccacctgctgcccctgaagcccccgcagccagcccgtccaccgcaagccctgcccccgctgccccaggcgacctgcgtcaagagcattttgatcgtctcatcaggaggagtaagctgtggtgttacgccaaggggttcgctctcgatactccaagccttcgccggggccccgagagaccgcccgccaagggcccggcaaggggtgccgccaaaaagagaagattgcccgctcctccaccaaggactgcacaaccgagaagaccagcccctacactgccaacaacatccacctttagcctgctcaactgcttcccatgtcctcccgccttggtggtcggcgaggatggcgatttaaaacccgcttcttctctgcggctacagggggactccaagcctcctcccgcacaccctctgtggaggtggcagatgggtgggccggcggtaccagagcccccgggcttgaaattttggggaatcaacatggacgaatcctag

SEQ ID NO: 45300 - DNA, 1272 bp, Artificial Sequence
  Description of Artificial Sequence: Synthetic coding sequence
atggagacccggggccccggcctggccgtgcgggccgagagccggcgtctggtggggataggaccaagagcgcctcccggtcgtgtgggcttgcaaccatccggcaggttggatcgacgaggcggcgccgggacaatgggatacaaagacaacgatggggaagaggaagaacgcgaggggggggcggccggccctcggggatccaggctcccccccatcacgggcggtgcgtccgagctggccaaacgcaaggtgaaaaagaaaaaacgaaaaaagaagacaaaagggtcaggcaagggtgacgataagcaccagagccagtccctcaagtcacagccactatcttcttcattccatgatattctgagcccgtgcaaggaacgaggtcccaaacctgaacatcggcagtctaaggttgagaagaagcatctgccatcggacagctccacggtctctttgcccgacttcgccgagattgagaacctggctaaccggattaacgaaagcctcaggtgggacggcatcctggctgatccggaagctgaaaaggagaggattaggatctacaagctcaataggcgcaagcgctatcggtgcttggctctcaagggcttccaccccgatcccgaagctctgaaggggttccacccggaccctgatgcactcaaaggcttccacccagaccctgaggcattgaagggttttcatccagatcctgaggccctcaagggaattcaccctgatcctgaggccctcaaaggtttccaccctgatcctgaggcgctgaaagggttccatcctgaccccgaagccttaaaaggctttcacacagaccccgaagcactgaaaggattccacattgacccagaagcactcaagggatttcacccagacccgaaggccttgaaaggcttccatcctgaccctaaggccctgaaaggctttcacactgaccccgaggccctcaaggggttccatccagaccccaaagccctcaagggctttcaccccgatcctgaagcactgaagggctttcacccagacccggaggcactgaaaggctttcacccagaccctgaggctttaaaggggttccacacagacccaaacgctgaggaagcccccgagaatctcccctacctgagcgataaagacggctcctccagccatagacagcccacatccaaggcagagtgtccaaatctgtgctttgaaggaaacctgactcctaagctgctacactctgatttggccccaactctgctggagtag

SEQ ID NO: 45301 - DNA, 465 bp, Artificial Sequence
  Description of Artificial Sequence: Synthetic coding sequence
atggcctacctgagcgagtgccggctgcggctggagaagggcttcatcctcgacggtgtggctgtgtctaccgctgctcgtgcctacggccggtctcgtcccaaactgtggagcgctattccaccatataatgctcagcaggactatcatgcaaggagctattttcaaagccacgtggtgcctccacttttaaggaagactgaccaggatcatggtggtactggaagggatgggtggattgtcgattacatccacatattcggccagggtcagcgctacctgaacagacgcaattgggcaggcacagggcacagtctccaacaggtcaccggtcatgaccactacaacgcagacctcaaaccaattgacggatttaatggccgcttcggctacaggcggaatactccagccttacgccagagcactagcgttttcggagaagtaacccatttccccctcttctag

SEQ ID NO: 45302 - DNA, 798 bp, Artificial Sequence
  Description of Artificial Sequence: Synthetic coding sequence
atgggcctgcccggcctgttctgcctggccgtgctggccgccagctccttcagcaaggcaagggaggaagagattacccctgtagtctctatcgcctataaggtgttggaagtgtttccgaaaggcagatgggtgctgatcacgtgttgcgcccctcagcctccccctcctattacctactctttatgtggtacaaaaaacattaaagtggcaaaaaaagtcgtgaagacccacgagcccgctagtttcaacctgaatgtcactctgaaatcaagtccggatctgctaacttacttctgttgggcctcttctacaagtggcgcacatgtggacagcgccagactgcagatgcactgggaattgtggtctaaacccgtttccgaactccgcgctaacttcacattgcaggatagaggggccggtcccagagtggaaatgatttgccaggcgagctcgggctctcccccaattactaactcactcattgggaaggacggccaggtgcatttgcaacagcgtccttgccaccgtcaacccgccaacttcagctttctgccatcgcagacctctgactggttttggtgtcaagccgctaacaatgcaaatgtgcaacattccgctctgacagttgtcccccctggaggagatcagaaaatggaggactggcaggggcccctggaatcccctatcctggccctgcctctttaccgcagtacgcgccgcctctctgaggaagaatttggtggtttcagaatcggcaatggggaagtgaggggccggaaggccgccgcaatgtag

SEQ ID NO: 45303 - DNA, 903 bp, Artificial Sequence
  Description of Artificial Sequence: Synthetic coding sequence
atgagccggcccggcatcgtggagagctacgagatcacccccgtggtttcaattgcctacaaggtgcttgaggtgtttcctaagggtaggtgggtgctgatcacctgttgcgcacctcagcctccccccccaataacctactcgctttgtggcaccaaaaacattaaagtcgccaaaaaagtcgtgaaaactcatgagcctgcgtccttcaatctgaatgtgactttgaaatcctctcctgacctgctgacgtacttttgctgggcctcctccacaagcggcgcgcacgtcgatagcgcacgcctgcaaatgcactgggagctctggtcaaagcccgtgtccgaacttagagctaacttcactctgcaggaccggggggcaggcccgagggtagaaatgatttgccaagcatcctctggttccccaccaatcacaaattcactcatcggtaaagacggacaggtacatttgcaacagcgaccttgccacaggcaaccggctaacttttcctttctgccatcccaaactagcgactggttttggtgtcaggccgcgaataatgccaatgtgcagcatagtgccctgaccgtggtgccacccggtgagcgcgcactggggttccctgagggacaactcgccctgctgtgtagagaaggcgcttccgtgcaggacacgggtagatgggaagtgggtcagctctaccccgctaccgctgagtctagggaagggacgggtgggaatcacgcacatcccggcccatgtttgaaggaggctcaaccttcatgcctgcggcccctgcccggtgggcttcccagggcacccaccatcgtactcgtagggtccctcgccagcactgctgccatcacatcgagaatgctggggtggacaacttgggcccgctag

SEQ ID NO: 45304 - DNA, 399 bp, Artificial Sequence
  Description of Artificial Sequence: Synthetic coding sequence
atggtgaagaagttcaaggacagcaagagcgtgctgctgatcacctgcaaaacttgtaaccgaacggttaaacaccacggcaagtctcggtcgttcgtgtctacactcaaatcaaatcccgctacacccacctcaaagttaagcctgaagactccagagcgccggaccgccaacccaaaccatgatatgagtggctcgaaagggaagtcacccgcttctgtcttccgtaccccgaccagcggccaatctgtgagcacttgcagtagcaaaaacaccagcaaaacgaaaaagcactttagtcagttaaagatgctcctgtcccagaacgagagtcaaaaaatccccaaggtggattttaggaattttctgagcagcttaaaggggggcctgctcaagtag

SEQ ID NO: 45305 - DNA, 663 bp, Artificial Sequence
  Description of Artificial Sequence: Synthetic coding sequence
atgcggcagaagcactacctggaggccgccgcccggggcctgcacgatagttgcccaggccaggcccggtatctgttgtgggcatatacttcctctcacgacgataagtctactttcgaagaaacttgtccctattgctttcagttgcttgtgcttgacaatagccgggtaagactgaagcccaaggctaggctgactcccaagatccaaaaattgctgaatcgcgaggcccggaactacactctctcttttaaggaggctaagatggtgaagaagtttaaggactccaagtccgttctgctcattacttgcaaaacttgtaatcgcaccgtaaaacaccacggcaaaagtcgctcctttgtcagtaccttgaaaagcaatccagctaccccgacctccaaactgagccttaagacccctgaacgccgcaccgccaaccctaaccacgatatgtctggctccaagggcaaaagcccagcaagtgtttttagaacaccaacatccggacagagtgtgtcaacctgctcatcaaaaaatacgtcgaaaaccaagaaacacttctcccagctaaagatgctactgtcacagaacgagtcccagaaaattccgaaagtggacttcagaaatttcttgagtagcctgaaaggcggcctgcttaagtag

SEQ ID NO: 45306 - DNA, 663 bp, Artificial Sequence
  Description of Artificial Sequence: Synthetic coding sequence
atgcggcagaagcactacctggaggccgccgcccggggcctgcacgacagttgccccggccaggctagatacctcctgtgggcttatacttcatcccatgacgacaaatctaccttcgaggaaacctgcccttattgtttccagcttctggttcttgataattccagagtccggctgaagccaaaagctcgtctgacgcccaaaattcagaaacttctcaaccgtgaagcccggaattatactctgagtttcaaggaagccaaaatggtgaaaaagtttaaggatagtaaatctgtcctgctgataacatgcaagacctgcaacagaaccgttaaacaccacggcaagagcaggtcatttgtctccactcttaagtcaaatcccgccacccctacttcaaagttgtcactaaagactccagagaggcgcaccgcaaaccctaaccatgacatgtccgggagcaaaggaaaaagccccgccagtgtgttcaggacccccacctcaggtcagagcgtatccacctgtagtagcaaaaacacctcaaaaactaagaagcatttctctcagctcaagatgctcctaagccaaaacgaatcccaaaaaatccctaaggtcgactttcgcaactttctttcctcactaaaaggaggtctgctaaagtag

SEQ ID NO: 45307 - DNA, 1212 bp, Artificial Sequence
  Description of Artificial Sequence: Synthetic coding sequence
atgaagatggaggaggccgtgggcaaggtggaggagctgatcgagagcgaagcacctcctaaagcctcagaacaggagacagcgaaagaggaggatggatcagtggagttggaaagtcaggttcagaaagacggggtggccgatagcaccgttatttctagcatgccttgcttgctcatggagctgagaagagactcttccgaatcccagttagcatcaaccgaatccgataagccaaccaccggaagagtgtatgagtcagacagcagcaaccactgtatgttgtcacccagctccagcggccacctggccgactccgacactctatcctccgccgaagagaacgagccatcccaagccgaaactgccgtggaaggggacccttccggggtatccggcgccaccgtgggacgcaagtctcgtaggtcacgctctgagtccgagacttctaccatggcagctaagaaaaatcgacagtcgagcgacaaacagaatggcagggtggccaaagtgaagggccatagatcccagaagcataaagaaaggatcagactgctgcggcaaaaacgtgaagccgctgctagaaaaaagtataacctgctacaggacagcagcacaagtgattccgatctaacgtgtgactcatccacttctagttccgacgatgatgaagaagtgtcgggttcgtcaaaaacgattaccgctgaaatccccgatggtcctcctgtggttgcacactacgacatgagcgataccaatagcgatccggaagttgtgaatgtggacaatctcttagccgccgcagtagtgcaggagcactccaattccgttggtgggcaggacacaggagccacctggagaacatcaggccttctggaggaattaaatgcggaggctggccatctcgacccaggatttctagctagtgacaaaacgagcggcaatgcgcccctgaatgaggagatcaatatagcttccagtgatagcgaggttgaaatcgtgggggtgcaggagcatgcccggtgcgtgcatccaagggggggcgtgatccagtcagtgagttcatggaagcacggctctggaacccaatacgtctccactaggcaaacacagagctggacagcagttactccccaacagacttgggcgtcccccgctgaggtagtggatctcaccctggacgaagatagtagacgcaagtaccttttatag

SEQ ID NO: 45308 - DNA, 1029 bp, Artificial Sequence
  Description of Artificial Sequence: Synthetic coding sequence
atgaagatggaggaggccgtgggcaaggtggaggagctgatcgagagcgaagcccccccaaaagctagcgaacaggagactgccaaagaagaagatgggtcagtggaactggagtcccaggtacagaaggatggagtagcagactcaaccgtcatcagctcgatgccttgtctgcttatggagttgcgtcgagactccagtgaaagccagcttgccagtaccgagagtgataaacctacgacaggaagagtctacgaatcagattctagcaatcactgtatgctaagcccatcgtcttccggccacctagccgattcagataccctaagtagcgcggaggagaatgagccaagccaggcggaaacagccgtggagggggaccccagtggagtgagtggggccaccgtagggcgcaaatcacgacggtccaggagcgagagtgaaacaagcacaatggccgcaaagaagaataggcagagctctgataaacagaacggccgcgtcgccaaggtgaagggtcatcgatcccagaaacataaagaacgcatcagattgctccggcagaagagagaggccgccgccaggaagaagtataatctgctccaggactcatccactagtgactcggacctgacctgcgactcttcaacatcatcctccgacgatgacgaggaagtgtctggcagcagtaaaactataaccgcagaaatccccggtcatctggatccaggctttctggcctccgataagactagtgggaacgccccattaaacgaagagattaacattgccagctctgattcggaagtggagatcgtcggagtgcaggaacacgcacgttgcgttcacccaaggggaggcgttatacagtctgtatccagttggaagcacgggtctgggacccagtatgttagcaccagacagactcagtcctggactgccgtgactccccagcaaacctgggcatctcccgccgaggtcgtggatcttactctggacgaagactcaagacgaaaatacctgctgtag

SEQ ID NO: 45309 - DNA, 231 bp, Artificial Sequence
  Description of Artificial Sequence: Synthetic coding sequence
atggtgtgcatcccctgcatcgtgatccccgtgctgctgtggatctataaaaagttcctcgaaccatacatttatccactggtctcaccgttcgtgtcccggatctggcccaaaaaagcgattcaggaaagtaatgatacaaataagggcaaagtcaacttcaagggagcagatatgaatggtctgccaacgaagggcccaacagaaatttgcgacaaaaagaaagactag

SEQ ID NO: 45310 - DNA, 231 bp, Artificial Sequence
  Description of Artificial Sequence: Synthetic coding sequence
atggtgtgcatcccctgcatcgtgatccccgtgctgctgtggatctataagaagttccttgaaccctatatctacccgctggttagcccctttgtgtcccggatctggccgaagaaagcaattcaggagagcaacgacacaaacaaggggaaagtcaacttcaagggagctgacatgaacggcctgccaaccaagggacccacagagatctgtgacaaaaagaaggactag

SEQ ID NO: 45311 - DNA, 2490 bp, Artificial Sequence
  Description of Artificial Sequence: Synthetic coding sequence
atgaccgagaacaagaccgtgagcagcagcagcacccgggacgaccaaaccaatatcggcctgacctgccaggaagtgaaggccctgagggagaaagcttggtccagaaccaatgaagggaatgctatgagtcagagtctggtcctctatggagcctcaaaggaaaactcggagggctttcacgaaagtaagatgactaacaccgagggcgttaacaaagggatctactttagctacccttgcaggcggcactcttgtgctgtcgtcaatatacctgccccttgcgtgaataagatgataagccacattcaggacgtggagagtaagatccaggaacacctcaagcggttcgagacgtcttttgaagaatggtctcgcacctcttccaccaaggacttgaaagaagattggtcggtaaccacacctgtgaaagaagtcaaaccaggggaaaaacgggatgagaagtgtcccgaacttaagcaggagatggaaaccctcctgagtgaagccatacggttgattaaatccctggaaactgatcgggcagatgccgaagaagcactcaaacagcagcgaagccggaagaacatgataaacatgaagattgactcctggtccgtgtggaaactccaagaactgcctctggccgtccaaaaagagcacgaggcatacctaagtgacgtgatcgaattgcagtggcacttagaggataaagcaaaccagctgcagcactttgagaagcagaagaccgaactcgaggaggccaacgccaagattcaggcggatattgactatatgaatgagcacgggcccctgttggactctaaacagaaccaggagctccaagaccttaaaaatcactacaagaaaaagatggaggtcatggaccttcatcgaaaagtgaacgaagagctggaagaagccctggaagcctgcgagaatgctaggttgaaagcgcagcagattaaggaggaaattgacaaagacatttatcaagatgaaaagaccatagaggcgtacaagagggagatctaccagctgaattcgctgttcgatcactactctagctcagtgatcaacgttaatactaacatcgaggaaaaggaggaggaagtgactgaggccatccgagaaacaaaatccagtaagaatgaactgcactccctgagtaagatgctagaggacctgcggcgtgtgtatgatcagctcacctggaaacaaaaatcccatgagaaccaatatctcgaagcagtcaatgatttctatgccgcaaaaaagacctgggacatcgagttgagcgacgtcgccaaagatttcagcgccataagtctcgcatgtacaaagctgaccgaagacaacaaaaaactcgaaatcgatataaataagatcactgttaaaaccaatgagtcaattaggaagaagtcgaaatacgagagtgagattaaatatctgaccattatgaaactcaagaatgacaaacacctcaagaatatttataaagaagcttatcgtattggaaccttatttcatttgaccaagcacaagaccgacgaaatggaagacaaaattgctgaggtcagacgaaagttcaagggacgtgaggagttcctgaagaaactgacccaaggggaggtggccgccggaatggtgttacagaaaaagctgtactctatatatgaagttcaggctcttgagcgtaaggagctgattaaaaaccgcgccatctgcgcaatgtctctggccgaactgcaggaacctctcctgcagctggaggacgaggccgaacgcatccgctcactggacaaagagcacagtgtgtccaagcgttccgctatctttaaggatcttgaggctactaaatctaagactatgatattttacgcaaagattaacgagctaaacgaagagctgaaagccaaagaagaggaaaagaaatcatttgaccagaccctcgagatcctcaagaataaatttattaccatgcgcttcaagcgggagcacgcccagactgtgttcgatcactacatgcaagagaaaaaggattgcgaggagcgaatcttcgaagaagaccagcgcttcagggttctgctggctgttcgccagaagaccctccaggatactcagaagattatagccgactccctcgaagagaatctgcgtctggcacaagaataccagcagctgcagataacttttctcaaggaaaaagacaactatttcaacatctatgacaaacaactgtccttggacacctcaattagagacaaaaagcagctttgtcagcttcagcgcagaatgcatacactgtggcaggaacatttcaaactcgtcgtgctgttctcgcaaatgaggcttgcaaacttccaaaccgactcccaggagtcaattcagaagattctggcagtccaagaggaatcttccaacctaatgcagcacattttgggattcttccagacactgaccgacgggacatgcgaaaacgacggctag

SEQ ID NO: 45312 - DNA, 2604 bp, Artificial Sequence
  Description of Artificial Sequence: Synthetic coding sequence
atgaccgagaacaagaccgtgagcagcagcagcacccgggacgaccagaccaacatcggcctcacctgccaggaggtcaaggcactccgcgagaaagcctggtccaggacaaacgaaggcaacgctatgagccagtctctcgtactgtacggggcctcgaaagaaaacagtgaaggtttccacgaaagtaaaatgacgaatacggaaggggtgaacaaagggatttacttcagctatccttgcagaaggcattcctgcgcggtcgtgaacatccctgccccttgcgtcaacaagatgatctcgcacatccaggatgtagagagtaagattcaagagcatttaaagcgtttcgaaacatcatttgaagaatggtcacgtactagtagcaccaaagatcttaaggaagattggagcgttacaacacccgtgaaggaagttaagccaggcgaaaaaagggatgagaaatgtcccgaactgaaacaggagatggagactctgttgagcgaggcgatccggctcatcaaatctctcgagaccgaccgggcggacgctgaagaggcactgaagcagcagcgatctcgtaagaatatgatcaacatgaagattgactcatggagcgtgtggaaacttcaggagctgcctctcgcggtgcagaaggaacatgaagcgtatctttctgacgtgatcgaactgcagtggcacctggaggacaaggcgaaccagctgcagcatttcgagaaacagaagaccgaacttgaagaagcaaatgccaagatccaagcggacatcgattacatgaatgagcacggaccactgctggacagcaagcagaaccaggagctccaggatctcaagaaccactacaagaagaagatggaagtgatggatttacacaggaaagtaaacgaggaattggaggaagccctagaggcatgcgaaaacgctagactcaaggcgcagcaaattaaagaagagatcgataaagacatatatcaggacgagaaaactatagaagcttacaagcgggagatttaccaactaaatagcctcttcgatcactacagctccagtgttattaacgttaataccaacatcgaagagaaggaggaggaagtcaccgaggcgattcgggaaacaaaatcaagtaaaaatgaactgcactccctgtccaagatgctggaggacctacgccgcgtatacgatcagttaacatggaagcagaagtctcacgagaaccagtaccttgaggctgtgaacgacttttacgccgccaaaaaaacttgggacatcgagctgtcggacgtcgccaaggacttcagcgcaatctccctggcatgcaccaagctgaccgaggacaacaagaagttggaaatcgatattaataaaatcaccgtaaagactaatgaatcaatccggaaaaaaagcaaatatgagagtgagatcaagtacctgacgatcatgaagctgaagaatgacaaacacctgaagaacatttataaggaggcataccgaattggtaccctttttcatctgaccaaacacaaaacagacgaaatggaggacaagatagcagaggtgagaagaaagttcaaaggacgggaggagtttcttaagaaactaacacagggagaggtcgctgccggtatggttttacagaagaaactttattctatctacgaagtgcaggcattggagcgaaaggaactgatcaagaacagggctatatgcgccatgtctctggctgagcttcaggaacccttgctgcagctggaagacgaagccgaaaggatccggtccctagataaagagcacagcgtcatgcttaacaatatcatagaccaaaaggatctaattaggagaaaggttggtaaggtcaagaaaaaactcaggaaaaagggaaagaaaacactcgacgcccttatcgaaactgaaagcaaacgctccgcaatatttaaggacctcgaagccaccaaatcaaaaacaatgattttctacgccaaaattaacgaattgaacgaagagctcaaggccaaagaggaggagaaaaaaagcttcgaccagacccttgaaatcctcaagaataaatttataactatgcgctttaagcgggagcacgcgcagactgtgttcgaccactacatgcaagagaaaaaggattgcgaagaaaggattttcgaagaagatcagcgctttagggtgcttctggcagtaaggcagaaaactctgcaggatactcaaaaaatcatcgccgattcactagaagagaacctacgacttgcgcaagagtaccagcaactgcagatcacattcttaaaagaaaaagataattattttaacatctacgacaagcagctgtccctggacaccagcattagggacaaaaagcagttgtgtcagttgcaaagacgcatgcacaccttgtggcaggagcactttaaactcgtagtgctgttctctcagatgcgtctggcaaatttccagaccgacagccaggagtcaattcagaaaattctggcagtccaggaggagagttcgaacctgatgcagcatatattgggcttctttcagacactgacagacgggacttgtgagaacgacggttag

SEQ ID NO: 45313 - DNA, 894 bp, Artificial Sequence
  Description of Artificial Sequence: Synthetic coding sequence
atgaccgagaacaagaccgtgagcagcagcagcacccgggacgaccagacgaacatagggctcacctgtcaggaggtgaaagcattgcgagagaaggcctggtctaggacaaacgagggtaatgccatgtcccagagtcttgtcctgtacggcgcaagcaaagaaaactccgaagggtttcatgaatccaagatgaccaatacagagggtgttaataaagggatctattttagttacccctgtaggaggcactcctgtgccgtggtgaacatccctgcaccctgcgtcaataaaatgataagccacatccaagatgtggagtctaaaatacaagaacatcttaaacggttcgaaacgtcattcgaagagtggtccaggacatcttcaactaaagatttgaaggaggattggagcgtcaccactcctgtgaaagaggtgaagcccggagagaaaagagacgagaagtgccccgaactcaaacaagaaatggaaaccctgctgagcgaagccatccgactgatcaaatccttagagactgatcgagctgatgccgaggaagccctcaagcaacagaggagccgcaagaatatgattaatatgaagattgattcatggagcgtgtggaaacttcaggaactgccgctggccgtacagaaagagcatgaggcctacctatccgacgtgattgagttgcaatggcatctcgaagataaggcaaaccagctgcagcatttcgagaaacagaaaacagaactggaagaggctaacgctaagatccaagccgacatcgactacatgaacgagcacggacctctgctggatagcaaacaaaaccaggaactccaggatttgaaaaatcactacaagaagaagatcaagaagaagaaaaaatag

SEQ ID NO: 45314 - DNA, 2454 bp, Artificial Sequence
  Description of Artificial Sequence: Synthetic coding sequence
atgaccgagaacaagaccgtgagcagcagcagcacccgggacgaccaaaccaacatcggtctaacctgccaggaagtcaaggcactgcgcgagaaagcctggtctagaaccaacgagggaaacgccatgtctcagagtcttgtcctttacggcgcctcaaaagagaacagcgaaggcttccacgagtctaagatgactaacactgaaggcgtgaacaaaggtatctacttttcttacccctgtcgccggcactcgtgcgccgtggttaatataccagcaccttgcgtaaataaaatgatttcgcatattcaggatgtcgaatctaagatacaggaacacttgaagagatttgaaacaagcttcgaggagtggtcgcgcacatcttccaccaaggacttaaaggaggattggtccgtcacgactccagtgaaggaggttaaacctggagaaaaacgggacgaaaaatgtccagaactgaagcaggagatggagactcttctgagcgaagccataaggctcattaagagcctggagacagaccgcgccgacgccgaggaggccctgaagcagcagagatcccggaaaaatatgatcaacatgaaaattgacagctggagcgtttggaagttacaagagctcccattggccgtgcagaaagagcacgaagcctatctgtccgacgtgatcgaattgcagtggcatctcgaagacaaggcgaaccagctgcagcattttgagaagcagaagacagaactggaggaggccaacgcaaagattcaggcagacatagattacatgaacgagcatggcccgctcctagacagcaaacagaaccaggaactccaggaccttaaaaaccattataaaaaaaagatggaggtaatggatctccatcggaaagtcaatgaggagctcgaggaggccctggaggcatgtgagaatgcgcgcctgaaagcccagcagatcaaagaagaaattgacaaggatatctaccaagatgaaaaaactattgaggcttataagagagaaatctaccagctcaattcgttatttgaccattacagctctagcgtgataaacgttaatacaaacatcgaggagaaagaggaagaagtaaccgaagccattcgggaaacgaagagctctaaaaacgagttgcatagcttgtcaaaaatgctagaagacctgaggcgggtttacgaccagttaacctggaaacaaaagagtcatgagaatcagtatctggaagcagtgaatgatttttatgctgctaagaaaacttgggacattgaactgtcagatgtggcaaaagatttcagcgcaatcagtcttgcctgcacaaagctgaccgaggacaacaaaaagttggaaattgacataaacaaaataaccgtaaagaccaacgaatcaatacgcaagaagtcaaagtatgagtcagagattaaatacctgacaattatgaagctcaagaatgacaaacacctgaaaaacatttataaagaggcctatagaataggaaccctctttcatctgaccaagcataagacagacgagatggaggacaagattgctgaggtgcgaagaaagttcaaaggccgggaagaattccttaaaaagcttacccagggagaggtcgctgcagggatggtgctccaaaaaaaattgtatagcatctacgaggtgcaagccctggagagaaaggaactcattaagaaccgtgctatatgtgctatgagtctggccgaactgcaggagcccctgctgcaactcgaagacgaggcggagaggatccggtccctcgataaggaacattccgtgatgctgaacaatatcatcgaccagaaggacctgatacgacgcaaggtgggcaaggtaaaaaaaaagctacggaaaaagggaaaaaagactctcgacgcgctgattgaaacagagtctaaaagaagtgcaatctttaaagacttagaagcgacaaagtctaaaaccatgatcttctatgccaagattaacgaattgaatgaggagctgaaggccaaagaggaggagaagaaatcatttgaccagactctggagattctgaagaataaattcatcacaatgcgctttaaacgtgaacacgctcagactgtgttcgatcattacatgcaggaaaaaaaagactgtgaggaacgcatcttcgaagaagaccagaggttccgcgtgctattggctgtgcgacagaaaacattacaggacacgcaactgtgtcagttgcaacggcgcatgcacacactatggcaagaacacttcaaactcgtggttctgttttcccagatgaggctcgccaattttcaaactgactctcaagagagcattcagaagatcctggccgtgcaggaggagtcttcaaatctaatgcagcatattctgggcttctttcaaaccctcaccgacggcacatgcgagaacgatggctag

SEQ ID NO: 45315 - DNA, 2604 bp, Artificial Sequence
  Description of Artificial Sequence: Synthetic coding sequence
atgaccgagaacaagaccgtgagcagcagcagcacccgggacgaccagactaacataggactgacatgtcaggaagtaaaggccttacgggagaaggcttggagcagaactaatgaggggaacgccatgagccagagcctcgtattgtatggggctagcaaagagaatagcgaagggtttcacgagagcaagatgactaatactgagggggtgaataagggtatctattttagttatccatgtcgacgtcacagctgtgcagttgtgaatatcccggcaccttgtgttaacaaaatgatctcacatatacaggacgtggagagcaaaatccaggagcaccttaagcgcttcgagacatccttcgaggaatggagccgcacgtcatcgacaaaagatttgaaggaggactggtccgtgacgacacccgtgaaggaggttaaacctggggagaaaagagatgagaagtgtcccgagctgaagcaagagatggaaacactgctgtccgaggccattagactcattaagagcctggagacggatagagccgatgcagaggaagcgctgaagcagcagcgctcccggaaaaacatgatcaatatgaaaatagacagctggtcagtttggaagctccaggaattaccactggctgtgcagaaggagcatgaggcgtacctgtcggatgttattgagctccagtggcacctggaagacaaggccaatcaactgcaacattttgagaagcaaaaaacagaactggaagaagctaacgccaagatccaggccgacattgattatatgaacgagcacggcccactcctggactcgaagcagaaccaggagctccaagatctgaagaaccattataagaagaaaatggaagtgatggacttgcatagaaaagttaatgaggaactggaggaggcactcgaggcatgcgaaaatgctcgacttaaggcccagcagattaaggaggaaattgataaagacatctaccaggacgagaaaaccattgaagcttataaaagggaaatttaccaattaaattccctctttgaccactattcttcgagcgtgataaatgtaaataccaacatcgaagaaaaagaagaagaagtgacagaggccatccgggaaactaaatcctcaaagaacgagctgcattccttgagtaagatgctagaggacctgcgtagagtgtacgaccaactcacatggaaacaaaagtcccacgagaatcagtacctcgaggcagtaaacgatttctatgcggccaagaagacctgggatattgaactgagcgacgtggccaaggactttagtgctatctcacttgcctgcacaaagctgaccgaggacaacaagaagctcgagatagacatcaataaaataacggtgaaaactaatgagtctatcaggaaaaagtccaagtacgagtccgagatcaagtatctcacaattatgaaattaaagaacgacaaacatctcaaaaacatctataaagaggcctaccgaatcgggactctcttccatttaaccaagcataagacggatgaaatggaagataaaattgctgaggtgcggaggaagttcaagggccgagaagagttcttaaagaaactgactcagggggaagtcgctgcgggcatggtgctgcaaaaaaagctgtattcaatctacgaagtacaagctttagagcgtaaagagctcatcaagaacagagctatatgcgcaatgagtctagcagagctgcaggaacccctgctgcagctagaagatgaggcggaacgaatcaggagtctagataaagagcactctgtcatgctgaataatatcatcgatcagaaagatctcatcaggaggaaggttggcaaagtgaaaaaaaagctccgtaaaaagggaaaaaaaactctggatgcattaattgagaccgagagcaagcggtccgccattttcaaggacctggaagctacaaagtcaaaaaccatgattttctacgccaagattaacgaattgaacgaagagctgaaggccaaggaagaggaaaaaaagtccttcgatcagactctggaaatactcaagaacaagtttattactatgaggtttaaaagagaacatgcgcaaactgttttcgatcattacatgcaggagaagaaggactgtgaagaacgcatcttcgaggaagatcaaagattccgagtcctgctggcagtgagacagaagacactacaagatacccagaagattatcgccgattctctcgaagagaacctgaggttggcccaggaatatcaacagctgcagatcacgttcctcaaagaaaaagataactacttcaacatctacgacaaacagctctccctggacacctctatacgcgacaagaagcagctgtgccagttgcagaggaggatgcacaccttgtggcaagaacacttcaaattggtggtgctgttctctcaaatgcggctggccaattttcagacagatagccaggaatccattcaaaagatcctggccgtacaagaagaaagctcaaatttgatgcagcatatcctgggttttttccagaccctgacagacggcacgtgcgaaaacgatggctag

SEQ ID NO: 45316 - DNA, 2676 bp, Artificial Sequence
  Description of Artificial Sequence: Synthetic coding sequence
atgaccgagaacaagaccgtgagcagcagcagcacccgggacgaccagaccaatataggactgacatgccaggaggttaaagcactgagggagaaagcatggagtcgcacaaatgaaggcaacgcaatgtcacagagtctggttttatatggggccagtaaggagaatagtgagggcttccacgagtcaaaaatgaccaatacggagggagtgaacaaaggaatttatttcagttatccttgccggcggcactcctgcgccgtcgttaacattcccgccccgtgtgtcaacaaaatgattagtcacattcaggacgttgaaagcaagattcaggagcacctgaagagattcgagacttctttcgaggaatggtccaggaccagctcaaccaaagacctgaaagaagattggtcagttacgacacctgttaaagaagttaagcctggcgaaaaaagggatgaaaaatgccctgaacttaagcaagagatggaaaccctgctgtctgaagccatacgcttgatcaaatcattggagactgacagggctgacgccgaggaagcactgaagcagcagcgctctcgcaagaacatgataaacatgaagattgactcatggagtgtgtggaagctccaagagctccctctcgcggtgcagaaagagcacgaggcatatctatctgatgtcattgaacttcaatggcacctggaagacaaggctaatcagcttcaacacttcgaaaaacagaaaaccgagctggaggaggcaaatgctaaaatccaagcggacattgattatatgaacgagcacggccctctgctagattctaaacagaatcaagagctgcaggacctgaagaaccattataaaaagaagatggaggttatggacctccaccggaaagtcaatgaggagcttgaggaggcccttgaggcgtgtgagaatgcaaggttgaaagcccagcaaataaaagaggaaatcgacaaagacatttaccaggacgaaaaaactatagaagcctacaaaagggagatataccaactgaattctctgtttgatcactactctagctctgtcattaacgtgaacaccaacattgaggaaaaggaagaggaagtgacggaagctatccgcgagactaaatcttctaaaaatgaactgcatagcctgagcaaaatgcttgaggatctaagacgagtgtatgaccagctgacatggaagcagaaatcacacgaaaatcagtatctggaggcagtaaacgacttctacgctgctaaaaaaacatgggatatagaactgtcagatgttgccaaggacttctctgccatcagtttggcttgtactaagctcaccgaagacaacaaaaaactggagattgatatcaacaagattacagtgaagacaaacgagagtattaggaagaagtcaaaatatgaatctgaaatcaagtacctcaccatcatgaagttgaaaaatgataaacacctgaagaatatttataaagaagcctaccgcatcgggactcttttccacctgacaaagcataaaacagacgagatggaggataaaatagccgaagttcgtcgcaagtttaagggaagggaagagtttctgaaaaagcttacacagggcgaagtggcggccggcatggttcttcagaaaaagttgtacagtatttatgaagttcaggcattggagcgcaaagaactgattaaaaatagggccatctgtgccatgtctctcgccgagctgcaggagcctcttctgcagttggaggatgaggccgaacgtatccgatcgctagataaggagcacagcgtcatgttaaataatataatcgatcagaaggacttgatcagaagaaaggtggggaaggtcaagaaaaaactccgcaagaaaggcaagaagaccctggatgccctgatcgagaccgaaagcaagaggtctgccatctttaaagatctggaagctaccaaatccaagacaatgatcttctatgcaaagattaacgagctcaatgaggagttgaaggccaaggaggaagagaaaaagtcctttgaccagacactggaaatccttaagaacaagtttatcaccatgcggttcaaacgagagcacgctcagacagtcttcgaccattacatgcaggagaaaaaggattgtgaagagagaatcttcgaggaggaccagcgcttccgggtgttgctggccgtcaggcaaaaaaccttgcaggatacccagaaaatcattgcagacagtctagaggaaaacctccgccttgcacaagagtatcaacagttacagataactttcctgaaggagaaagataactactttaacatctatgacaaacagctgagcctggacacaagcatccgagataagaagcaggttgctggattcttgcccaagaaactgcctaattctctgcctattatcagcgacgagctgtccaactttcagctgtgtcagctgcagaggaggatgcacactctgtggcaggagcactttaaactggtcgtgctttttagccagatgcggctggctaattttcagaccgactcccaggaatctatacaaaagattctggcagtgcaggaggagtcctctaatctgatgcagcacattctgggctttttccagactttaactgatggcacctgcgagaacgacgggtag

SEQ ID NO: 45317 - DNA, 210 bp, Artificial Sequence
  Description of Artificial Sequence: Synthetic coding sequence
atggtgttcgcccccggcgagaagcccggcaacgagcccgaggaggtcaaactacagaatgccagcaagcagatcgtgcaaaatgccattctgcaggcagtgcagcaggtttcccaggaatcccaacgccgcgaggaaagaatcagtgacaaccgtgatcacatacaactgggggttggggagctgacaaagaagcacgagaagaagtag

SEQ ID NO: 45318 - DNA, 372 bp, Artificial Sequence
  Description of Artificial Sequence: Synthetic coding sequence
atgacccccgccagcggcgccaccgccagcctgggccggctgcgggctcgccccaggtcgcgctgggatgctgcctatcttccggccgttgctgctgtgtgtgtggccagagccagccacgtgcccaacggcacactgcgattcggagtttgcaaggcaaggaggacaatgaggccactgccaagaagaatcgaagtgaggaccaagcgcggtcctcagagaccggcagcaccagaaagatccccacaaccccggctgcccccaagcaggcatcccagccgcagaggtccccgaagacacctttcgggctgtagcgcccccgcctgcagaatccccacaggatgcagatgcccatgcggtaggccctcatag

SEQ ID NO: 45319 - DNA, 2058 bp, Artificial Sequence
  Description of Artificial Sequence: Synthetic coding sequence
atgaacgacagccggcagcagagcctgttcttcatcaccctgcccgatctcaataaactctgtgcggtacggattattttaagcaataaagtcgccgacaccgaaattagaacaattcaaatgaagatgtgcaggcagctgctattcctgcaccaggacatactcaccagccccgtctctggcatcctaaatcagatctgggtggtgatggcaataccattttacaaagcccggaagcttaacgcttacgttgaaaagtacggagctaagatggaagcaccccagcgggtcattcctgtcattttacagaactgtctttcatactccttcatggcccggctcgctcccgcatggaatcgtactggccacctccttatacaaggccgcgacttcctcagccagatggggaagcaatccgctgtggtcttgaacatcaacgtaaccgagacgcaggtttgtctgagcatagaggcttgtaccattagactgcctgcccccgaacttaaggagtttgagatctctcagagcatcattaaagatttccacgcgaataaacatgccgtgattgagcgacactccattctctcgaattggtgctatgtgttaccttctatgaaaatgggtcagattatcaacatcttccatgcaattcccgcagcttgcccttttcattcgtacggcgattttcagcgccactgggacgcactctatggctataaactgccaggagactgtgggaagatcaaaatctactgcaatatctattttaagatgttaggtgaaaggactttcacttatcctctctcttgcatccgctcacaaccaatgcaattctttcctcgcgtggactctgaagtggtgctgaaatcttttctgagtgacctcaaatccaagctgccacacatttgcgggttcccgattaagatgacctccaaaccctgttactatacccaggagctaactaaaccgaacattcaggaacataaagtaaagcctcctaacctgacaacaaagaagatgctgcgggccagcttgacgcaggccacttccaggaagcccgcatgcgcacagtctctgctgccatgtagcgtggcggtggatcataaagtcgagctgagcgtatcccagccaacatctgggatttttagcgctctccacttacagccagagtcagtgcagggcagaaagaaatccctgagcatccgcgccccccaggtgcacagcgaagtgttaatgccgaatagaggcaacacacaggtccaacacactaatctgagcagccagtccaacattacacccaagtttgtccccgtcttcaagaatcggttgctacagatgaataagaacacttccgtgcttggtagcccaaagcgtaaacagcatgacgtgactcagagcaaattgttcagtctcaaaacaagcatgattcaacacgacaagttgaacctcggacctgctattaaaaatcggtattcatctaatattcagatgcaagcggctaacaatcttaatcaagaaaactcgcggccgctgcaggaaaaaaataccgagtccagcgaaaacatgacaaagtttccaagctcacggggaaaatccaccgttagtctgaataaaaataagcagctttctaactcagcagtgtttgtggtgtcaaataacaatctaggcgtggtcaaaagcgccgtagacttccagatgaaaggcaaagaaaatctaaccgggaagggtatcactcaaatactggggaaatcgcacgggagtttgaagctcaaacgacagcctcacatcttcgaaagcgacggggaaactgaagatcccagactgctgcagcaacaaagcgaaaaccaggctaaggaagtgggaacctccgaccacagactgatcgtcagtaaaattgctcaccgatccaaaaggaagctctgccctgagtcatctaagacaagtaaaaaacaccacagtgatactgttcattatgggcagagttcgagcagcaagaaacagatccttgattcagataagtccaagctaaagaaatcactgattattcacaacgcctag

SEQ ID NO: 45320 - DNA, 1974 bp, Artificial Sequence
  Description of Artificial Sequence: Synthetic coding sequence
atgggcgaggaggactactacctggagctgtgcgagcggcccgtgcagttcgagaaggcaaaccccgtcaattgcgtcttctttgatgaggctaacaagcaagtattcgcagtacggagcggcggcgcaacaggtgtagtcgtgaaggggccagatgaccggaatcccataagcttcaggatggacgacaagggtgaggtgaagtgcataaaattttcactggaaaacaagatccttgctgtccagaggacatccaagacagtggacttctgcaatttcatacccgataatagccaattggagtatacccaagaatgtaaaacaaaaaatgctaatatcttaggattctgctggactagctctactgagattgtttttattactgaccagggtattgagttctaccaggtgctgccagaaaaacgatctttaaaactcctgaagtcacataaccttaatgtgaattggtacatgtactgtccagaatccgcagtgatcctcctgtcaacaactgtgttggaaaacgttctgcagccattccatttcagggcaggcactatgtccaagcttccaaagttcgagatcgagctacctgctgctccaaagagtacaaaacctagcctctccgaaagagacattgctatggccacgatctacgggcagctgtatgttctcttcttgagacatcatagtcggacctcgaatagcactggggcagaggttgtgctgtaccacctgcccagggaaggcgcctgcaagaaaatgcacatcttaaagctcaaccggacgggcaaattcgcccttaacgtagtcgacaatctagttgtggtgcatcaccaggacacggagacatcagtcatttttgatattaagctccgtggcgaattcgatggctctgtgacatttcaccatcctgtgctgcccgctcgctcaatccagccctaccagatacccattacaggccctgccgccgtaactagtcagtctccagtcccttgcaaactgtattcaagctcatggatagtgtttcagcctgatataatcatttccgcaagccaggggtatctatggaaccttcaagttaaactcgaacccatcgtgaatctccttcccgataaggggcgcctgatggactttcttttgcagagaaaggaatgcaagatggtgatattgtcggtttgctctcaaatgttgagcgaatcagaccgggccagcctccccgtcatcgctactgtgtttgacaaactcaatcacgagtacaaaaagtacctggacgccgaacaatcgtatgccatggccgtggaggccggccagagcaggagcagtccgttattgaagcgacccgtgcgaacgcaggccgtcctggaccaatccgacgtgtacacacacgtgctaagcgcgttcgtggagaagaaggagatgccccacaaatttgtgattgcggtgctgatggagtatattagaagcctaaatcaatttcagatcgcggtgcagcactatttgcacgagctggttatcaaaacgctcgtacagcataacttgttctatatgctccatcagttcctgcaataccacgttctcagtgatagcaagcccctggcttgcctcctgctctcactagagtcattttacccccccgctcaccaattatcattggacatgctcaaacgcctgtccactgctaacgacgagatagtagaggttcttctgtccaagcatcaggtcttggctgctctgaggtttatccgcggtattggcggacacgataacatctcagcaaggaaattccttgatgctgccaaacagacggaggataacatgctgttctatacaatatttcgattctttgagcagaggaatcaacgcctccgaggcagtccaaattttacaccaggggaacattgtgaagagcacgtggcatttttcaagcagattttcggcgaccaggcactgatgcgcccgaccacattttag

SEQ ID NO: 45321 - DNA, 1830 bp, Artificial Sequence
  Description of Artificial Sequence: Synthetic coding sequence
atgggcgaggaggactactacctggagctgtgcgagcggcccgtgcagtttgagaaagccaacccagtaaattgtgtgttttttgacgaggcaaacaagcaggtattcgccgtgcgcagtggaggagcaacaggagttgtcgtgaagggacccgatgatcgcaaccctatttcgtttaggatggacgataagggcgaggtgaaatgtattaaattttctctggaaaataagatcttggcagtgcagcggacttccaagactgtggtgttgcctgaaaagagaagcttgaaactgctaaagtcccacaatttaaatgtaaactggtatatgtattgtccggaaagcgccgtcatactactgtccacaacagtgctggagaatgtgctgcaacccttccactttcgcgctggtacaatgtcaaaactgcctaagttcgagatcgaactccctgcagcccccaagagtacaaagccttctctgagtgagcgggacatcgccatggccacaatatatgggcagctctatgtgttatttctgcgccaccacagccgcacttcgaacagcaccggcgctgaagtggtgttatatcacctgcccagagagggggcctgcaagaaaatgcatatcctgaagctgaaccggactggtaagttcgccctcaacgttgtggacaacctcgtggtggtccaccaccaagacaccgagacatctgtgatcttcgatatcaaactgaggggtgaattcgatgggtccgttacttttcaccatccagtcctgcccgcacggagtattcaaccgtaccaaattccaattaccggccccgccgccgttaccagtcagtcccctgtcccttgcaagctctatagctcttcatggatcgtatttcaacccgacatcatcatttctgctagccagggctatctgtggaacctgcaagtgaagctggaacccatcgtgaatctgcttcccgacaaggggcggcttatggacttcctgctgcagagaaaggaatgtaagatggtaatcctatcggtctgctctcaaatgcttagcgagagcgatcgtgcctcattgcccgttattgctactgtttttgacaaactcaatcacgaatataagaaatacttggacgccgaacagtcctatgcaatggccgtggaggcgggacagtcccggagctcaccactgttgaagcggcctgtaagaacgcaggcggtacttgaccagtcagacgtttacacacacgtcctttctgcttttgtggaaaagaaggaaatgccgcacaagtttgtcatcgctgtcctgatggaatatataagaagcctaaatcagttccagatcgctgttcagcactacttgcacgaattagtgataaagactctcgtgcagcataacctattttatatgctccaccagtttttgcaataccatgtgctgtcagattctaagccactggcctgcctgctccttagtctggagtccttctaccctcccgcccatcagctcagcctagacatgttgaaacgcctttccacagccaacgacgaaattgtagaggtacttctctctaaacatcaagtgctcgccgccctgaggtttatccggggtattggtggtcacgataacatctcagcccgtaaattccttgacgctgccaaacagaccgaggacaatatgcttttctatactatctttcggtttttcgagcagcgcaatcagaggctaagaggtagtccaaatttcaccccaggcgagcactgtgaggagcatgtggctttcttcaaacaaatctttggcgatcaggctctcatgcgtccgactacattttag

SEQ ID NO: 45322 - DNA, 1503 bp, Artificial Sequence
  Description of Artificial Sequence: Synthetic coding sequence
atgtactgccccgagagcgccgtgatcctgctgagcaccaccgtgttggagaatgtgctacagccttttcatttccgagccggtaccatgtcgaaattgccaaaattcgaaattgaactcccggccgctcccaagtcaacgaaaccctcactgagcgagagagacatagcaatggcgacaatatacggccaactgtacgtgctgtttcttagacatcacagtcgtactagcaacagtacaggggcagaagtggtcctataccacctccccagagagggcgcatgcaagaagatgcacatcctcaaattgaatcgcaccggcaaatttgcactcaacgtggtagacaatcttgtggttgtgcaccatcaggatacagagacgtccgtgattttcgacatcaagttaaggggtgagtttgacggctcagtaacattccatcacccagtcctgccagcccgcagtattcagccttaccaaattcccatcacaggcccggctgccgtcacctctcagtcgccagtgccttgtaagctgtattctagctcatggattgtgttccagcccgacatcattatatccgcttctcaaggctatctgtggaatcttcaggtgaaactggagcccatcgttaacctcctcccagacaaagggaggctaatggactttttgttgcagaggaaggagtgcaagatggttattctgtcagtgtgctcacaaatgctttcagagagcgacagagcttctttgcctgttatagctactgtgtttgacaagctaaaccacgaatataagaaatacttagacgctgaacaatcctatgccatggccgttgaagcaggacagtccaggtcctcgcccctactcaaaaggccagtgcggactcaagcggtcctcgatcaatctgatgtctacactcacgttctctctgcctttgtagagaagaaagagatgcctcacaaatttgtgattgctgtcttgatggaatatatccgatcactcaaccagtttcagatcgctgtgcagcattatctgcatgaactcgttataaaaacacttgttcagcacaacttgttctacatgctgcaccagtttctccagtatcacgtgctgagtgactctaagcctctcgcatgtctactgctatctctagaatctttctacccacccgcccaccaactgtctctcgatatgctgaaaaggctaagtaccgccaacgatgagatagtggaggtcttgttgtctaaacatcaggtcttggcagcccttcggtttatccgggggattggaggtcacgacaatataagcgcccgcaagttccttgatgcagccaagcaaaccgaagacaatatgctcttctacaccattttcaggttcttcgagcagaggaaccagcgcttgcggggctcccctaattttacacctggagagcactgtgaggaacacgtcgccttctttaagcagatctttggcgaccaagcactgatgagaccaacaacattttag

SEQ ID NO: 45323 - DNA, 1359 bp, Artificial Sequence
  Description of Artificial Sequence: Synthetic coding sequence
atgtactgccccgagagcgccgtgatcctgctgagcaccaccgtgctggaaaacgtgctgcaacctttccacttccgggccgggacaatgagcaaattaccgaaattcgaaattgagctccccgccgcaccgaagtcgaccaaaccttctctgtccgagcgggacatagccatggccaccatctatggccagttgtatgtactgtttctgcgtcaccactccagaacttccaatagcactggggcagaagtggtcctctatcatctgcctcgagagggggcctgtaagaagatgcatatacttaagctgaacaggaccgggaagtttgctctgaatgttgtcgacaacctcgtggtagttcaccatcaagatacggagactagcgtcatcttcgatattaagctccggggggagttcgacggctcagttacatttcatcacccagtgctgcccgcaagaagtatccagccctatcaaatacctatcacggggcccgctgccgtcacttcccaatcccctgtcccctgcaagttatattccagtagttggatcgtgtttcagccagacatcatcattagtgcctcacagggctacctgtggaatcttcaggtgaagttagaacctatcgtgaatctgctgcctgataagggaagactcatggatttcctgctgcagcggaaggagtgcaagatggtcattcttagcgtctgctcacagatgttgagcgaatctgatcgtgcctctctgcccgtgatcgcgacagttttcgacaagctgaatcatgagtataaaaaatacttggacgccgagcaatcctatgccatggctgtggaggcaggccagtctcgaagttccccgcttctgaagcggcccgtcaggacccaggctgtcctggaccagagcgacgtatacacccacgtgctgtccgcattcgtggagaagaaagagatgccgcataagtttgtgatcgctgtcctaatggagtatattagatccttgaaccagtttcagattgccgtgcagcactacctgcacgagctggtgatcaagaccctcgtgcagcacaacctgttctatatgttacatcagtttctacagtaccatgtattgagtgacagcaagccccttgcttgtctgttactctctttggagtctttctacccacctgcgcaccagctgagtctcgatatgctgaaaatgctgcagtctagactaaaaacaacttgtttctcaatacaatacagcgcattcctgaactctgagaccagcgtttgtgagggcgcaccaatatcccaccaggggaatacagtaaagaacatgctgcttttttccaatcgcttcttggagacaaaactatag

SEQ ID NO: 45324 - DNA, 711 bp, Artificial Sequence
  Description of Artificial Sequence: Synthetic coding sequence
atggcccggcccctggtgcccagcagccagaaggccctgctgctggaactcaaggggctgcaagaggaacctgtagaggggttcagggttactctggtggacgaaggggacctgtataactgggaggttgctatctttggcccaccgaacacgtactatgagggtgggtacttcaaggcaagacttaaatttcctatcgattatccttattcccctcccgctttccgctttcttacgaagatgtggcatcctaacatctatgaaacgggagatgtatgcatatccattctgcatccacctgtcgacgacccgcagtctggggagctgccatccgagaggtggaatcccactcagaatgtgagaacaattttactatccgtcatctctctcctgaatgagcctaacacatttagtccagccaacgttgacgcaagcgtgatgtatcgcaagtggaaggaatctaaaggcaaagatagagaatacaccgacattattcgtaaacaagtactgggcacaaaggtagacgcagaaagagatggggtaaaagtgcctacaacgctggcggaatattgcgtcaaaacaaaggcaccggcaccggatgaaggtagcgatctcttttacgatgattactacgaggacggggaagtggaggaagaggctgactcgtgtttcggcgatgatgaagatgatagtggtacggaagagtcttag

SEQ ID NO: 45325 - DNA, 486 bp, Artificial Sequence
  Description of Artificial Sequence: Synthetic coding sequence
atgggcagcaaggccaagaagcgggtgctgctgcccacccggcccgccccccccacggtggagcagattcttgaggatgttaggggtgccccagcggaagaccccgtgttcacaatcctggcaccagaagatcctcccgtccctttccgcatgatggaagacgccgaggcaccaggagagcagctgtatcaacagagtagggcatatgtcgctgccaaccagaggctgcagcaggccggcaatgtccctagactccccccacaggccgaccttagcggtcctgctggcctgggatccgcccaagggggccttcaccctggatttccttggggcagcgtgggccctagattggcttttactggatcccaaccgacctgggttctgacccaggcccccctgttgatgttgggactgcggttcataagacggctgattcatgccgaactagtgggtcccactcagttggccccatcatgcgtgacatag

SEQ ID NO: 45326 - DNA, 477 bp, Artificial Sequence
  Description of Artificial Sequence: Synthetic coding sequence
atgggcagcaaggccaagaagcgggtgctgctgcccacccggcccgcccctccaaccgtggaacagatcctggaagacgtgcgcggagcccccgctgaggacccagtgttcactattctggccccagagggccggggatcccccgtgcccggaaagtccggccctgaaactcctgccgctagagggcgggagcgatcgactcccctgacgccagatcccaccccctgggaaccgccccagcatggtcatgatcctcccgtgccattccggatgatggaagacgcggaggcccctggggaacagctgtatcagcaatcaagagcgtatgtggccgcaaaccagcgcttgcaacaggccgggaatgtgttgaggcaacgctgtgagctcctgcagagagcaggcgaggacctggagcgtgaggtggcccagatgaaacaggccgcactgcccgctgcagaggccgctagctccggatag

SEQ ID NO: 45327 - DNA, 357 bp, Artificial Sequence
  Description of Artificial Sequence: Synthetic coding sequence
atgggcagcaaggccaagaagcgggtgctgctgcccacccggcccgctcccccgactgtggagcaaatcctggaggacgtaaggggagctccagctgaagacccagtcttcactattctggcccccgaggaccctcctgtcccttttcgaatgatggaggacgcggaagccccgggtgagcagctgtaccagcaatcaagagcatacgttgcagcaaatcagagattgcagcaggctggcaacgtgttgcggcagcgctgcgagctgctccagcgtgcaggagaggatctcgagagagaggtagcccagatgaaacaagctgccctgcccgccgcagaggctgcatcctctgggtag

SEQ ID NO: 45328 - DNA, 507 bp, Artificial Sequence
  Description of Artificial Sequence: Synthetic coding sequence
atgctgcccgccgccctgctgcggcggcccggcctgggccggctggtccggcacgcaagggcctacgctgaggccgccgctgcccctgcggcagccagcggccccaaccagatgagcttcacatttgcttccccaacgcaagtcttctttaacggtgccaatgtccggcaagtggatgtgcctactctgaccggcgcctttggaatattggccgcacatgtcccaaccctccaagtgttgagacctgggctggtagtggtccacgcagaggatggcactacatccaaatacttcgtgagttctgggagcatcgcagtgaacgcagacagcagcgtgcagctgctggccgaagaggcagtcactcttgatatgttggatcttggagctgccaaagccaatctggagaaggcccaggccgagttggtgggaactgccgacgaggcaacaagagccgaaattcagatcaggatcgaggcgaacgaggctctcgtcaaggcactggaatag

SEQ ID NO: 45329 - DNA, 1422 bp, Artificial Sequence
  Description of Artificial Sequence: Synthetic coding sequence
atgagcagccccgagccccccaccgagccccccgagcccgacaaccctacatggagcacccaaccaacttacagcaatttgggtcagattcgcgcccatctccttccttcgaaggcttgtaggctgcggactccaggcagcctttcaactaaccctgagcctctccccccaccattgccaaagaagatactgacccgaacacagtctctgcccacgcgtcgcaccttgcacccgagttccattcaggtccagcctccacgccgtcctttcctagggtcccacagcgttgacaagtcccaggctgccgtcggccctgcatgtcttcccgctgagttaaccttcggacccgctgacgctcccctgggcctttcactgcgcgatttacactcccccgaggctgtgcatacagcattagcagccagacagctgcaaggcttgcgaaccatctatgctaggctgcgagcccgccttatggggggccatccaggaccatgtcaccccggccactccttcagactactagactcatcaccatgcgctgaaagcggagatgcactttactaccgggtcgttagggctcacgaagacgcctggcatatcctggtggctaaggtccctaagcccggggccgatgtccctcatccttggggcctcgaattgcaagcctctctgagcccacactttaatcttcaaggcctgtgcgggttagttccggaaggcaccctgccgggagcgccgtggaggggagctgtggccttagctgcggaagttcccgaaagaactgttgcccagtggttagccgaagcctgcacccagcctcccgaggagttcgtgtgggccgtcgccttgttgctcctgcagctctccgctgcgctaaaattccttgaggcctggggggcagcactggtcgagctcaggccagagaacctgctgttggtcgccccccggggctgtgcaaccactgggccgcctagactgttacttacagactttgggcgtgtgtgcctccagcctcccggtccccctggatcacctggcccacatgctccccagctggggtcattactccgagccctcctgagcctcgccgcccctagtactacaccgctggctgccggactcgaattgctggccgcacagctgaccaggctccggccctcagccagcagaacaaggggggcactgcaggctctcctctgggggccaggacctgagcttcgtggcagaggcgcccccctggggccatggctgagagccctgggcccatggctaagagtccggcggggattgttggtgttacgcctcgctgagcgggctgccggcggcgaggcaccaagccttgaagactggctgtgttgtgagtacctagccgaggccacagaatcttcgatgggtcaggcactggccctattgtgggattag

SEQ ID NO: 45330 - DNA, 228 bp, Artificial Sequence
  Description of Artificial Sequence: Synthetic coding sequence
atgatcggcgacatcctgctgttcggcaccctgctgatgaacgccggcgcagtgctcaacttcaaactcaagaagaaagatactcagggctttggggaggaatctcgcgaaccgagcacaggcgataacatccgcgagtttttactgtccctccgctattttaggatattcatcgcgttatggaacatcttcatgatgttctgcatgatagtattattcggatcctag

SEQ ID NO: 45331 - DNA, 531 bp, Artificial Sequence
  Description of Artificial Sequence: Synthetic coding sequence
atggccgcccggggccggcgggccgagccccagggccgggaggcccccgggcccgcgggaggcgggggcggcggctccagatgggcggaatccggatctggcacctctcccgagtccggagacgaggaggtcagcggtgccgggtcttctcctgtctctggcggggtcaaccttttcgctaacgacggatcattcttggagctcttcaagaggaagatggaggaggagcaaaggcagcgtcaagaggagccaccacctggcccacaacgcccagaccagtcggctgccgccgccggtcccggcgatccgaagaggaagggtgggccagggtcaacattgtcattcgttggaaaaagacggggagggaacaagctggctctcaagaccggcattgtggcaaagaagcagaagaccgaggacgaagtgctcacctccaagggggatgcatgggcaaagtacatggccgaggtcaaaaagtataaagcccaccagtgtggcgacgatgacaagactcgtcctctggtcaaatag

SEQ ID NO: 45332 - DNA, 1518 bp, Artificial Sequence
  Description of Artificial Sequence: Synthetic coding sequence
atggccaccggcgccctgctgccctgcagccggccctgccccatgagccggctggattttctcaaggctagtcatttttccctgggccctgatctgcggcttcatgaaggaacgatgcgcactacatcccaccgcgacttcgcctatcccgctgccacccgagaacccccttctttgcagccccccccagccctcctattcccaatggacccccgctgggatcgggaggagagagttagtgaggcgcacagggcatttcctccacctagcactccaccatgggagctgctgcaggcccaagcgcgggaaaggactctggctatgcaggctggcaacttgcacctgcatgaggatgcccatgccggcatcggcctcagcaacgcgcatgccgcctatggctggccagaactgcccgctcgcacaagagagaggattcggggtgcgcggctcatcttcgaccgcgactcgctgcctccaggcgatcgcgataaactgagaatcccccccacgacacaccaggccctgttcccgccccacgatgcacgcccacagccacgagccccgagctgtcacctgggcggacctaacacactgaagtgggactacaccaggcaggatggcacttcttaccagaggcagttccaagcgctcccaggccctcccgcgttgcgatgcaagcgggcctcaagtggagttgaactgggagactgcaagatcagttatggaagcacctgcagcgaacagaagcaggcctaccgaccacaggacctccccgaagatcgctacgacaaggctcaggcaacggctcacatccattgtgtcaacatccggcctggcgacgggctgttcagagatcggactaccaaggctgaacacttctacgctcgcgaacccgaacctttcgtgctccaccacgatcaaacacccgagtcacacattttgaaggggaactggtgccccggccccggctcactggatacattcatgcagtacttttatggacaacctcccccacctacgcagcctcctagtagacatgttccccacgagaagctgcagtcccatgttactctcggtgaacccaagttgctgaaaagatttttcaaaactactatggggtccgattactgccccagcgagtggaggcaggtgcagaaggctcccaatcttcacctccaacagtcatacttgccaagaggcacaggcgagttcgactttcttacaatgaaccagaagatgcttaagccccatcgtaccccacccgccccagtgactgaggaaatgttacagagatgtaagtattcacatatggagcctcccctgggcgggttgcgattcttctcgacgcagtacaaagatgaatttccattcaaatatcaaggacccgcagcattacggctgaaaaatccccaggaaggttttgtccccttaggaaccccgcaccagcggggatgtagagaaaagatcgatcccctggtgccccagccacccatgtacttatgtccgtcacagcagtag

SEQ ID NO: 45333 - DNA, 672 bp, Artificial Sequence
  Description of Artificial Sequence: Synthetic coding sequence
atggccaccggcgccctgctgccctgcagccggccctgccccatgtccagattggacttcctgaaagccagtcacttttcgctcgggcccgacctgcgcctccacgaaggaactatgcgaacgacatcacacagggattttgcttaccccgcggctacgcgggaaccaccctcactccagccacccccggccctgctcttcccgatggatccaagatgggatagggaggagcgagtctcagaagctcacagagcgtttccccctcccagcactcctccctgggagctactacaggcacaggcaagggagcgaactcttgcgatgcaggcggggaacctgcatctccacgaagacgcacacgccgggatcggactcagcaatgcccatgccgcttacggttggcctgagctgcctgcccgcacacgagaacgtattcgcggagcaagactgatcttcgaccgtgacagcctcccacccggtgaccgtgacaaactgcgaatccctccaaccactcaccaggcattattcccaccacatgatgccaggccccagccccgggccccctcctgccatttaggcgggcccaatactttaaaatgggactatacaagacaggatggaacatcgtaccagaggcaattccaagctttacccgggccacccgctctttag

SEQ ID NO: 45334 - DNA, 579 bp, Artificial Sequence
  Description of Artificial Sequence: Synthetic coding sequence
atggccaccggcgccctgctgccctgcagccggccctgccccatgtcacgactggactttttgaaagcctctcacttcagcctgggacccgatctgcgattgcacgaggggacgatgcggaccacctcccaccgcgatttcgcatacccagctgccactcgggagcctccctctctgcagccaccaccagcgttgctgttcccaatggatcctcggtgggatcgcgaggaacgggttagcgaggcccaccgggctttccctcccccctccacccctccatgggagttgctccaggctcaggcccgggagcgcaccctcgcgatgcaggctggcaatttacacttacacgaggatgctcacgccggcatagggttgtctaatgcacacgccgcctacggatggcctgaactccctgcaaggaccagggagagaatccgcggggctagattgatctttgatcgggattcccttcctcccggcgacagggacaagctgagaatccctcctaccacccaccaggcactgtttcccccccacgatgcacgccctcagcccagagccccttcttgtcacctgtag

SEQ ID NO: 45335 - DNA, 1269 bp, Artificial Sequence
  Description of Artificial Sequence: Synthetic coding sequence
atggtgatggccgccctgagcctggtggccgcctgctggggccgggcggctgctgatgaatcggtccagctgccggcggcgccggggagcagcgtgcgcgcaagggaaactatggtgagtgtgaccatggccactagcgagtggattcagttctttaaggaggcagggatccccccaggccctgcagtgaactatgcagtgatgttcgttgataataggattcagaaaagcatgcttctagatcttaataaggaaatcatgaacgaactgggtgttactgttgtgggggatatcatcgctatcctgaaacatgcaaaagtggtccataggcaagatatgtgcaaggccgccactgagtctgtcccttgtagccctagcccactcgccggcgagattagacggggaacttccgctgcttcacggatgattaccaactccctgaaccacgattctccccccagcactcctcctcggcggcccgacacatcaacaagtaaaatcagcgttaccgtgtccaacaagatggccgctaagagcgctaaggctactgctgcacttgcccgccgagaagaggagtccctcgcagtgcccgctaagaggcggagggttacagctgaaatggaaggaaagtatgtgattaacatgccaaaaggaacaacaccccgaaccagaaaaatccttgagcagcagcaggctgcgaaaggcttacacaggacttcagtttttgacagactaggtgcggaaacaaaagccgataccaccaccgggtccaaaccgacaggtgtgttctctagactgggtgccaccccagaaactgatgaagatctcgcgtgggattccgacaatgattcctcgtcctcagtgttgcagtatgctggggtactgaagaaactgggccgcggacccgcaaaggcatcaccacagcccgccttgactgttaaggccaaggccacctcgagtgccactaccgccgccgccccaacgctgagaaggctggccttaagttcccggagtggcttggagcggaagcctgagtcgctgagtaaggtctcaataatcaagaggttaggcgccgccgctcttgtgcctgaagcccaagactcccaggtgacgtccacaaagagcaagagcagtgcggaggttaaagttaccattaaaaggactctggtagggccccgcggctcttcttcgtctgagggcctcggggctcagatggaccatgcagggaccgtctcagtttttaagcggctgggacgcaggacattttag

SEQ ID NO: 45336 - DNA, 1068 bp, Artificial Sequence
  Description of Artificial Sequence: Synthetic coding sequence
atgttcgtggacaaccggatccagaagagcatgctgctggacctgaataaagagataatgaatgagctgggagtaaccgttgtaggagacataatagcaattctgaaacacgcgaaagtggttcataggcaagacatgtgtaaggctgcgactgagtccgtgccctgtagcccaagccccctggccggagagatcagaagaggcacttctgcagccagcagaatgattactaatagcttgaatcacgattctcctccctccactcctccccgacggcccgacacgtctacatcaaagataagcgtaaccgtatcaaataaaatggcagcaaaaagtgcaaaagcgaccgccgctcttgccagaagagaggaggaatcactggctgtgccagctaagagacgacgggttactgccgaaatggaaggcaagtatgtcattaatatgcctaagggtactacacctagaaccaggaagattttggaacagcagcaagctgccaagggcttgcacaggacgtccgtattcgatcgcctgggggccgaaactaaggcagataccacaacagggtctaaacccactggcgtgttttcgagactaggtgcaacacctgaaaccgatgaggacctcgcatgggactccgataatgattctagctcttcagttctccagtacgcaggcgttttaaagaaattagggagaggtcccgctaaggcatctccacagccagccttgacggtgaaagccaaggccactagctcagcaaccaccgccgcggccccgacgttgaggcggctggcactatcgagccggagcggtctcgagagaaagcccgaatccctctctaaagtttcaattataaagcgactcggtgccgccgccttggtgcctgaagcccaggacagccaggtcactagtaccaagagcaagtcatcagcagaagtgaaagtgacgataaagagaacccttgtgggtcctagagggagtagctccagtgagggcctgggagcccagatggaccacgccggcaccgtgagtgtgttcaaaagactggggcgaaggacattttag

SEQ ID NO: 45337 - DNA, 1269 bp, Artificial Sequence
  Description of Artificial Sequence: Synthetic coding sequence
atggtgatggccgccctgagcctggtggccgcctgctggggccgggcggctgctgatgagtccgtccaattgcctgccgccccaggcagctctgttagagcaagagaaaccatggtttcggtaaccatggctacctcagagtggattcagttttttaaggaagctggtatacctccagggcccgccgtaaactacgcggtcatgtttgttgacaatcgcatacagaagtcaatgttgctggacctcaacaaagaaattatgaacgaactcggtgtcacggttgttggcgacataattgctattctcaagcatgcaaaggtcgttcaccgacaggatatgtgtaaagctgctaccgagagtgtgccgtgctcaccgagccccctggcgggggaaatcagaagaggaactagtgcagcctctagaatgattacgaattccctgaaccacgactcccctccttccaccccaccacgaagacccgataccagcacatcaaaaatatccgtgacagtgtctaacaagatggccgccaagagcgccaaggccacagcggccctggctcgacgtgaagaggaatcccttgccgtcccggccaaaaggcgcagggtgacagcagagatggaaggcaaatacgtgataaatatgcccaaagggactacgccaagaacaagaaagattctggagcagcagcaggcggcaaaagggcttcaccgcacctccgtgttcgatcgtctcggagcagaaactaaggcagacaccacaacaggatctaagccaactggagtattttcgcggctgggcgccacacccgaaaccgatgaagatctggcgtgggactctgataacgattcaagctcttccgtcctacaatacgctggtgtgttgaaaaaactgggcagagggcccgccaaagcctcacctcagcctgctctcacagtgaaggcaaaggccaccagttctgcaacaacggccgctgccccaaccttacgtcgtcttgctttgtcttccaggtcaggcttggaaagaaagcctgagtctctcagcaaagtatccataatcaagcgtctcggcgccgcagccctggttcctgaggcccaagatagccaagtaacgagcacgaagtctaagtctagtgccgaagtcaaggtgactattaagcgcactctcgtgggaccacggggctcaagttcgtccgagggactaggcgcacagatggatcacgcagggacagtctccgtcttcaagaggctgggcagacgaactttttag

SEQ ID NO: 45338 - DNA, 354 bp, Artificial Sequence
  Description of Artificial Sequence: Synthetic coding sequence
atgaccgtgctggaggccgtgctggagatccaggccatcaccggctctcgtcttctgtccatggtgcccgggcccgcccggccaccaggatcatgctgggacccgacacagtgcacccggacctggcttctctctcacacgccacggagacgctggatcagtggactaccaagagcctcctgccgcctcggcgaggagccacccccactcccttattgtgaccaggcttatggagaggaactctcaatccgtcaccgcgaaacctgggcctggctcagcaggacagacactgcctggcccggcgcacccggagtcaagcaggcccggattctgggtgagctgttgctggtgtag

SEQ ID NO: 45339 - DNA, 354 bp, Artificial Sequence
  Description of Artificial Sequence: Synthetic coding sequence
atgaccgtgctggaggccgtgctggagatccaggccatcaccggcagcaggttactgtccatggtgcctggccctgcacgtccacccggaagctgctgggacccgacccaatgcacgcgaacttggctcctcagccatacccccagaaggcgatggatatcggggctaccgcgagccagctgcaggctcggtgaggaaccaccccctcttccttattgcgatcaggcctatggcgaggagctatctattcgccaccgcgagacttgggcctggttatcccgtaccgacactgcttggcctggcgcccctggagtgaagcaggctagaatactgggcgaattgctactcgtgtag

SEQ ID NO: 45340 - DNA, 1827 bp, Artificial Sequence
  Description of Artificial Sequence: Synthetic coding sequence
atgctgcccctgctggacagcagcaagcgggccggcaccctgggctcgggatgtggcgttccaagggttcattctgctgctctaagccgagaggagggcgccagtcgggacatatggcgaatcaaggtctgggccagagttatgacaaccccagctggctcggggagcgggtttggctcagtgtcatggtgggggttgagccccgcccttgatcttcaggcagagcgcgacgccacggtggatgcccttcctactaccatggttccccagcccgcggtgattctgccaggaccccctgtcgatccagacagccaagcagatacagttcactccaatccggagctcgatgtccttctgctaggttccgttgacggtcgccaccttctcaggaccctcagccgcgctaaattctggccccggcgcagattcaacttctttgtgttggaaaataacttggaagcggtggccaggcacatgctgatcttctctctggcgctggaagagcctgaaaagatggggctacaggaaagatctgagacgtttttggaagtgtggggtaacgctctgcttcgtccacccgttgctgctttcgttcgggcgcaggccgaccttctcgcccacctggtgcctgagcccgacagactcgaagaacagttgccctggctgagcctaagggcactgaagtttagagagagggacgcgcttgaggccgtgtttagattctgggccggcggcgagaaagggcctcaagccttccctatgtctcgtctgtgggacagccgactccggcattatctcgggagtcggtacgacgctaggaggggtgtgagcgattgggacctcagaatgaaactgcacgaccgaggggcccaggtcatccacccccaggagttccgccggtggcgcgatacgggcgtggcctttgaattgagggactcttcagcctaccacgttcctaacaggaccctggcaagcggtcggctattgtcgtatcgtggagagcgggttgcagcgcgcggatactggggagacattgcaacaggaccatttgtggctttcggcattgaagccgatgatgaaagcctgctgagaacatccaatggacagccagtgaagacagccggggagatcactcaacacaacgttacggaactgctccgtgacgtagcagcttggggccgggctcgagctactgggggtgacctcgaagaacagcagcacgccgagggatcaccagaacccggaactccagcccctacccctgagagcttcacagtgcacttcctgccactcgattcagcacagacacttcaccataaaagctgctacaatggcaggtttcagcttctatacgttgcatgcgggatggtccaccttctgattcctgagctcggagcctgtgtggcgcctgggggcaacctgatagtcgagctcgccagatacctcgtagatgtgaggcaggaacaattgcaggggtttaataccagggtgagagagctggcccaggccgcggggttcgcaccccagacaggtgcaaggccatcagaaactttcgcacgtttttgcaaaagccaggagtccgcccttgggaatactgtcccagccgtagaacctgggacccctcctctggatatactggctcaacctctggaggcctctaatcctgccctagagggcttaacccagcctttacagggcggcacccctcactgtgaaccttgccagctcccatccgaaagccctggatccctctcagaggtcctggcccagcctcagggtgcccttgcaccacctaactgtgaatcagattccaagaccggggtgtag

SEQ ID NO: 45341 - DNA, 1767 bp, Artificial Sequence
  Description of Artificial Sequence: Synthetic coding sequence
atgctgcccctgctggacagcagcaagcgggccggcaccctgggctccggatgcggcgtgccccgggtgcacagcgcggcgctcagtcgcgaggagggggcgtctagggatatctggaggattaaggtgtgggcccgcgtcatgaccacgcctgctggaagtggcagcggattcggatctgtgagctggtgggggctgtcacctgctttggatctgcaggccgagtcgcctccagtcgaccctgacagccaagccgataccgtgcacagcaatcccgagctggacgtcctgttgttaggctcagtggatggacgtcatttactgcggaccctgtctcgggccaaattctggccccgtcggagatttaatttttttgtgctggaaaacaacctggaggccgtggccaggcacatgttaatcttttccctggctcttgaggaaccagagaagatgggacttcaagaacgcagcgaaacttttctggaggtgtggggaaacgctctgttgcggccacccgtcgccgcatttgttagagctcaggcagacctattggctcatcttgtgcctgaaccagaccggttagaagagcagctgccctggctgtcacttcgggcactgaagtttcgagagcgggatgcgcttgaggccgtgttcaggttctgggcagggggtgaaaagggcccccaggcatttcctatgtcccgcctctgggattcacgcctgcggcattacctgggatccaggtacgatgcaagaaggggagtgagtgattgggatctgcgtatgaagttgcatgacaggggggcccaagtgattcacccacaggagtttcgccgctggcgcgatacaggggtggcttttgaattacgagatagctcggcatatcatgtaccaaaccgaactctagcctcaggccggctgctgagttaccggggcgaacgtgttgcagccaggggctactggggagatatagcaaccggaccctttgtagcctttgggatcgaggcggatgacgagagcttgcttaggactagtaatggtcagccggttaagaccgcaggagaaataacgcagcacaatgtgaccgaactcctgcgagatgttgccgcatgggggcgggctcgagcaaccggaggagacttggaggagcagcagcatgccgaagggtcacctgagccaggaacaccagccgccccaacccctgagtcattcacagtgcactttctgcccttagattctgcacaaacccttcaccataagtcatgctacaatgggcgttttcagctgctgtatgtggcatgtggaatggttcatttactgatacctgaattgggggcatgcgtggcacctggtgggaatctcattgtggagttagccagatatctggtagacgtcagacaagagcagttgcagggctttaatacaagagtgagagaattagctcaggccgccggtttcgcgcctcaaacaggagccaggccaagcgaaactttcgcccggttctgcaagtcacaggaatcagcgctgggcaataccgttccggcagtcgagccagggacaccacccctggacatcctcgcccagcccttggaagcttccaatccagcactagaggggctgacgcaaccacttcagggaggtacaccgcactgcgaaccttgtcagctgcctagcgaatcacccggtagtctgagtgaggtgctcgcgcagccacagggtgctcttgctccccctaattgcgagtccgacagtaaaacaggcgtttag

SEQ ID NO: 45342 - DNA, 1464 bp, Artificial Sequence
  Description of Artificial Sequence: Synthetic coding sequence
atgaagatgcgggcccagatccccgagagcctgcgggaggagggcattgaaatcctcaaaccacagttttttgtcctggaaaacaacctggaggcagtggcccgccatatgctgatcttctccttggccctggaggagcccgaaaaaatgggcctccaggagcgaagcgaaactttcctcgaggtgtggggaaatgctctcttaaggcctcctgtggctgcttttgtgagggcacaagccgatctgctagcccatctggtgcccgagcctgatcggctggaagagcagttgccatggttgtctctccgcgcactcaagttcagggaaagagacgcgctggaagctgtgtttcggttttgggcggggggcgagaagggccctcaggccttccctatgagccggttgtgggactctcgcttgaggcactatctcgggagcagatacgacgccaggcggggagtgagcgattgggatcttcgcatgaaactgcacgacagaggcgcacaggtcattcatcctcaggagttccggcggtggcgcgacacaggggtggctttcgagctgagggactccagtgcctaccacgtccctaatcgcacgttggcgagcgggcggctcctttcctatcgaggggaacgcgttgctgcacggggctattggggagacattgcgactggacccttcgttgcttttgggatcgaagcagacgatgagtctctcctcagaacatcaaatggacagccagtgaagactgccggggaaattacacagcacaacgtcaccgagctgctaagagatgtggccgcctggggccgagcacgagccacaggcggagatcttgaggaacagcagcacgcagagggatctcccgagccgggaactcctgccgcccccacccccgaatccttcacagtgcacttcctgccacttgactccgctcagacgctgcaccacaagagttgctacaatggcaggttccagcttctttacgtcgcatgtggaatggttcatctcctgattcccgagctcggggcctgtgtggccccaggtggcaacctcatcgttgagttggcccggtacctggtggatgtgaggcaagaacagctgcagggctttaatacacgagtgagagagctggcccaagccgcgggctttgcaccacagaccggggcccggccatctgaaacattcgcaagattctgcaagagccaggagtccgccttgggaaataccgtaccggctgtggagccaggcacccccccactagatatcctcgcccagccactcgaggccagcaatccagccctagaagggctgactcagccactccagggaggcactccacactgcgaaccctgccagctaccttcagagagtcctggcagcttgtcagaggttctggcccaacctcagggtgcccttgcgcccccaaactgtgagagtgattctaaaactggtgtatag

SEQ ID NO: 45343 - DNA, 783 bp, Artificial Sequence
  Description of Artificial Sequence: Synthetic coding sequence
atggccgccgccgccctgcggcggttctggagccggcggcgggccgaagcaggagacgctgtggttgcaaaacctggcgtgtgggcaagattgggtagttgggctagagctctgttacgcgactatgctgaggcctgccgcgacgcttccgctgaggctagggcccgtcctggcagagctgccgtttacgtgggccttctggggggggcagccgcgtgctttaccctggcaccttctgagggcgccttcgaggaggcactgctcgaagcctccggcacactgctactgctggctcccgcgactcggaatagagagtccgaagctttcgtccaacgtttgctgtggttgcgcgggagggggcggctccggtacgtcaatcttggtttatgttcgctcgtgtacgaggcacctttcgatgctcaggcctccctctatcaggcaaggtgtaggtacctgcagcctcggtggaccgactttccagggcgggtgctggatgttgggttcgtcggtcgatggtgggtacttggtgcatggatgcgtgattgcgatatcaacgatgatgaattcttgcatctgccagcccacctaagggttgtgggccctcagcaactgcacagtgaaacaaacgaacgattgtttgatgagaagtataaacccgttgtcctgaccgacgaccaggtggatcaagcactctgggaagagcaggtgcttcagaaggaaaagaaagaccgcctagccttgtcccaggcgcattccctcgtgcaagcggaagcgccaagatag

SEQ ID NO: 45344 - DNA, 1005 bp, Artificial Sequence
  Description of Artificial Sequence: Synthetic coding sequence
atgaagccccccccccggcggcgggccgcccccgcccggtacctgggagaagtcaccgggccagccacttggtctgctcgggagaaaaggcagttagtgcgcctgctgcaagctaggcaaggacaacctgagcccgacgccacagagcttgcgcgcgaattgcgtggccgtagcgaggccgaaattagggtgtttcttcagcagttgaaggggagggttgctcgcgaggccatacagaaagtgcaccctggcgggctgcaaggacctcgcagacgcgaagcccagcccccggcacctattgaagtgtggaccgacctggctgaaaaaattacaggccccctggaagaggcccttgcagtggcatttagccaagtgttgactattgcagccaccgaaccggttacactgttgcattccaagcctccaaagcctacacaggctcggggcaaacccctgctgctttccgcgcctggaggtcaggaggaccccgctccagagataccttcatcagcccctgccgccccctcctccgcaccccggactccagaccccgccccagagaagcccagcgaaagctcagctggccccagcaccgaggaagacttcgccgtggattttgaaaaaatttataaatacctatcatcagtgtccagaagtggccgttcacctgagttgtctgccgctgagtccgctgtggtgctggatctcctgatgagtctcccagaagagctgcccctgcttccatgtaccgcactggtcgagcatatgacagaaacttatctgaggctcaccgcccctcagccaattccagccggcgggagcctgggccctgcggccgagggtgacggggcgggaagtaaagccccagaagagaccccacctgcaaccgagaaggctgagcactccgagctgaaatctccttggcaggccgcgggaatctgtccccttaatccttttctcgtgcccctggagttgctgggtcgggcagccacaccagcaagatag

SEQ ID NO: 45345 - DNA, 300 bp, Artificial Sequence
  Description of Artificial Sequence: Synthetic coding sequence
atggcccagggccagcggaagttccaggcccacaagcccgccaagagcaagacagctgcagctgccagcgaaaagaatcgaggccctcggaaaggagggcgggtgatagcacctaaaaaggcaagggtagtgcagcagcaaaagctgaagaagaaccttgaggtgggaattaggaagaagatagagcatgacgtagtcatgaaggcttcatctagtctgccgaaaaaattggcactgttgaaagcaccagcaaaaaagaaaggcgccgctgcggcaactagttccaagacgccttcctag

SEQ ID NO: 45346 - DNA, 420 bp, Artificial Sequence
  Description of Artificial Sequence: Synthetic coding sequence
atgcgggccggcggcctggtggacggccggtacagccccgtggccccccagtggcggccccctggggagacacacacaggcggccatggcaagcggctccatggccctggccgggacgtattatctacatcctatgatgaagatttcaatcacgaaccatgccagcgcaaaggccacaaagctcactgggccgtttcagccggcgtgctactaggggtccgcgccgtcccctcactgggctatacggaagacccagagctgcctggactatttcatccagtgctcggaaccccatgtcagcctccttctctgcccgaggaaggctcccccggcgccgtctatctgctgtccaaacaaggcaagtcttggcattaccagctctgggactatgaccagggtccacccctcagcagccattag

SEQ ID NO: 45347 - DNA, 1056 bp, Artificial Sequence
  Description of Artificial Sequence: Synthetic coding sequence
atgaccagcccctgcagcccccccctgaagccccccatcagcccccccaagaccccagtgccccaagcatcaagcattcccagtccacctttgcctccatctcccctggacttctctgcgctgccctcacctccctggagccagcagaccccggttcctcctcccctgcccctccctcctccccctgcagctacgggcccggccccaagacacgtgttcggcctggaaaagagtcagttgttgaaggaggccttcgataaggcaggacccgtgcccaaagggcgcgaagacgttaagcgcctccttaagctccacaaagacaggttccgcggtgaccttaggtggattctcttctgtgccgacttaccttccctaatccaggaaggcccccagtgcggcctcgtggctctctggatggccgggaccttgctaagtccaccctccggtgtgcctcttgagcggctgatcagagtggctaccgagcgaggctacacagcccagggcgaaatgtttagcgtcgccgatatgggacgcctcgcccaggaagttcttgggtgtcaggccaagctgctctcaggcggcctcggaggccctaatcgagatctggtactgcagcatctggtcactggacatcctttgcttatcccatacgacgaggacttcaatcacgagccctgtcagaggaagggccacaaggcccactgggctgtctccgcaggggtgctgttgggtgttagggccgttccctcactgggatatactgaagatcccgagctacccgggttattccacccagtgctcgggactccttgccagcccccatcattacccgaggaaggctccccgggagccgtgtacctgctcagtaagcaagggaaaagctggcattaccaactgtgggactacgatcaggttagagagtctaacttgcagttaactgacttttccccatccagagcaacagatggacgtgtctacgtcgtgcccgttggaggagtgagagctggtttatgcggccaggcccttctgctgacaccacaggactgctctcattag

SEQ ID NO: 45348 - DNA, 1440 bp, Artificial Sequence
  Description of Artificial Sequence: Synthetic coding sequence
atggaccggagcctgcccgtgttcagcatccaggacagccccttcggtgacgcccctctggggcgctcacactattggccatctcagtcccagacttggtgtcccaaaacactgagtccatcccgcagtcaaagatcccggcttcctcaggcacccaaagccctggcaaccggcccaaattcgcctgaacttttcgaagaaagctggcccagcagctcgggaacccccagtctgccatccacaactgagggtcagatgtgggcctccccggccccaaccctgatcgactccggtgactcggtggttgccaagtacatcaataggttcagacaggctcaaccgacttctcgagaagaaaggcagcccgccgggcccacacctgcagacttttggtggctccagtctgactcacccgacccgtcttcccagtccgctgccgcaggcgccaacaaaccggaaggccgccctcacacggcagtccccaccgccgttaatgtgacctcggcgtcccacgcagtggccccgcttcaggagatcaagcagaacctccacacctggaactcctctttgctggatctcgagactctgtcattgcaatcccgggcagctaggctgctgaagaggtccaaggcctctatctcatctagctcctccctaagtccttccgacgcttccacaagtagcttccctacctcaagcgacggcttatcaccgttctccgagacttttatcccagactcctctaaggggctgggacctagggcccccgccagccctgcacccgcacaggcacaaactccaactccggcccccgctcctgcctcctctcaggcacccctgcgtccggaggatgacattctctaccaatggcgccagagaaggaagctggaacaggcccaggggagcaagggcgaccgcgcctgggtcccaccattgacccccgcgctccgtacgttggccgagtctttgaaggctaaagcgctcccccctgccgccggaagcgtcattcgcaagtccgaggccaccccatccccaggggcatgtttacagccagaggtgcccctctccccagccgaacaagccaccactgtcaaggcctcgccccctgcatttcaggtcggctctcctgaggcactggccccccctcctccagccgccgatcacgcaccatctgaagccctcctggcccaggccctgctattgcaggccgccgaggattccgacggatcggaatttcaggacgaccctgtgctacaggtccttagggcacacagggcggagctcagtcgccagaaaagggaagctgacgctcgcctgtccttcctgttagaccaggcagaagacctgggatcctggtcaccacccgccggatctccacctcggtctccgaggcggctccttcggagagaaggtgattccctagaggcccgaagattatag

SEQ ID NO: 45349 - DNA, 330 bp, Artificial Sequence
  Description of Artificial Sequence: Synthetic coding sequence
atgtgggccagccccgcccccaccctgatcgacagcggcgacagcgtcgtggccaaatatattaatcggtttaggcaggcacagcctactagccgagaagagcgacagcctgcagggccaacccccgccgatttttggtggttacagtcagatagccctgaccccagcagtcagtctgcggctgctggagccaacaagcccgaggggcgcccccacactgccgtccccacagcagtgaacgtgactagtgcctcacatgctgttgcacctctgcaggagataaagcaggtaacgtcgcccttcaccccatctctcggctgcttgaactag

SEQ ID NO: 45350 - DNA, 1914 bp, Artificial Sequence
  Description of Artificial Sequence: Synthetic coding sequence
atgaccaagcggaagaagctgcggaccagcggcgagggcctgtgcccacccaagccactgaaaaatcccaggctgggagacttttacggagacccacagtcctccatgctaggttgcctgcaccacccggaggagccagagggaaagcttggcccagtgccctcaactcagcagcacggcgaagaaccaggcaaagctgtgtctagctcccccgacgaggagacaggcagcccatgtcggctgcttagacagcctgagaaagagcctgctcctttgcctccgagccagaattcgttcggaagatttgtcccacagttcgccaagagcagaaaaaccgttactagaaaagaggagatgaaagatgaggaccgtggatctggcgccttttcattggaaaccattgccgagtcttctgcccagtctccgggctgccagctgctcgttgaaaccctgggcgtacccctgcaagaggcgacagaactgggagacccaacacaggcagacagtgcccgcccagaacagtcttctcagagcccggtgcaagcggttcccggttcaggagactcacagcctgacgacccaccagaccggggaacaggcctaagcgcaagtcagagagcctcacaagaccacctgtccgaacagggggcagatgactccaagcccgaaaccgatcgcgttccgggggacggggggcagaaagaacacctgccttcaattgatagcgaaggagagaagccggatcgcggcgctccccaggagggtggagcccagaggacggccggagctggcttaccgggaggaccacaggaggagggcgacggggtaccatgcacccctgcgtcagcccccaccagcggccctgctcctgggctgggacccgcttcctggtgtctagagcctgggtcagttgcacagggttcccccgatcctcagcagaccccatccaggatgggcagggagggagagggcacacattcttccctcgggtgcagttcactgggcatggtcgtgatagctgacctctccactgaccctaccgagctggaagagcgggctttagaggtcgccgggcccgatggccaggccagcgcaattagccccgcctcacccagaaggaaggctgccgatggcgggcatcgccgggctctacctgggtgcacatcccttacaggggaaaccacaggggagagcggcgaggcaggacaggacggaaagccgcccggggacgtgttggtcgggccaaccgcttctttggcactcgcacccggatcaggggaatccatgatgggagccggggactcgggtcatgcttccccggataccggaccctgcgtcaaccagaaacaggaacctggtccagctcaggaggaggctgagctgggtggacaaaatctggaacgcgacttggaaggattcagggttagcccgcaggcctccgtcgtgctggaacaccgcgagatcgctgacgaccccttgcaagagcccggcgcacagcaaggtattccagatactactagtgaactggccggccaacgggaccacttaccccactcagctgatcaggggacttgggccgatagcctggccgtggaattggattttctgttagactctcagatccaggatgccctagacgcctccgattttgaggccccccctgagcagttgttcccctctggaaataagcctggaccatgctggccggggccatcttctcatgccaacggtgaccccgttgccgttgccaaggctcagcccagccggctgattatgggaacacaccgtgatttagaagcctttaaacgccttaattacagaaagacaaagctggggggaaaggctcctttgccttacccctctaaagggccgggaaacatccccagaggggatccaccgtggcgcgagttatag

SEQ ID NO: 45351 - DNA, 2007 bp, Artificial Sequence
  Description of Artificial Sequence: Synthetic coding sequence
atgaccaagcggaagaagctgcggaccagcggcgagggcctgtgcccacctaaacctctgaagaacccccgtttaggcgatttttacggcgacccgcagagcagcatgctcggttgtcttcaccaccctgaagaaccggaaggaaagctcggaccagttccatcaacacagcagcatggagaggaacctgggaaggctgtttcctccagccccgacgaagagaccggctcaccttgtcgactgctaaggcagcccgaaaaagagcccgctccgctgccaccctctcagaactcatttggacgatttgtgcctcagttcgcaaagtctcgaaagacagtgactaggaaggaggaaatgaaagatgaagatcgcggcagtggggcctttagcctcgagactattgccgaatcctctgctcagtcgccaggctgccagctgctcgtggagactctcggcgttcctctgcaagaagctaccgagctcggcgatcctacccaggctgatagcgctcgcccagaacaaagctcgcagagccctgtacaggctgtacctggtagtggggactctcagccagatgacccaccagatcgcggaactgggctgagtgcctcgcagagagccagtcaggaccacctgtcagagcaaggtgctgacgattctaaaccagaaacggatcgcgtccccggggatggcgggcagaaagagcacttaccatctatcgattccgagggcgagaagccagacagaggggcacctcaagaagggggcgcacagaggactgcgggagccggcctgcctggtggccctcaggaagaaggagatggtgtgccttgcaccccggcttccgcccctaccagtggcccagcacccgggctgggcccagcctcatggtgtctagagccaggtagcgtggcccagggaagccccgatccccaacagacgccaagccgaatgggtcgcgagggagagggaacccattcttcactgggatgctcctctctcgggatggtcgtcatcgccgatctttctaccgatcctactgagctagaggaaagggcattggaagtggctggtcctgatggacaggcaagtgcaatctcccccgcctcccctcgtagaaaggcagctgatggcggacatcgccgtgctcttcctggctgcacgagcttgaccggagaaaccactggcgaatcgggtgaggctggccaggatggcaaaccccctggagacgtattagttggaccaacagcctcgctagcccttgctcctgggagtggggagtcaatgatgggtgctggggactctggccatgcctctccggacaccggaccatgcgtaaatcaaaaacaggagcctggtccggcccaggaagaggcagaactgggagggcaaaatctggaaagagacctcgaaggctttcgggtgtcgcctcaggccagtgtggtcctcgagcaccgcgaaatcgcggacgacccgctgcaggagcccggtgcacagcaaggtatcccagacacaacatctgaacttgccgggcagagggaccatctgccacactctgcagaccaggggacctgggcagatagtttggccgtcgagctggactttctgctggattcccaaattcaagatgcactggacgcaagcgatttcgaggctccacctgagcagctgtttccgtctggcaataagcccggcccttgttggccagggccctccagccacgctaatggagatcccgtggccgtggccaaagcgcagccccgcacttttgtcggaattcaggcttccgaagccagtcggatggaggatgctaccaatgttgtccgggggctcattgttgagttgtcaaatctgaacagactgattatgggaactcatagagacctggaggcgtttaagcggttaaactacaggaaaacgaagctgggtggcaaggcacctctgccctacccgagcaaaggaccaggcaacatcccacggggcgatcccccttggagagaattatag

SEQ ID NO: 45352 - DNA, 606 bp, Artificial Sequence
  Description of Artificial Sequence: Synthetic coding sequence
atgatcaccgagaccgccgccgagcccaccgtgcccgccgtgcccgccgccgaggaagccaccgaggcccgcgggagagaagagcctgcctggccttggaaggatgcaccaataaggacactcgttcagcggattcaccaattgcaggctgaacgcgcacagggtttccgccgtctggaagagtggctcgctcccgtacagggcctaagagcctgggggcgtggactgcgggtacccacttgtcggcgcggtcaccggcagtatctgcggtcagggccagattatgattttgcccgctataggtcaactgtacacggtgtcactcaggcattcgccgccgcctcacgggaggttctggccgtagaagccgagctgggcggaccacggcgccagccacttctggccggccacgttagaagtctgcaggaattagagcagacacgcctcggaacagtcgccttgctacagctaatggaaaccccggagctggctgggcaggaagacgccgtgaggatgcaacaactgaagatgaaagtgatcaagaccatggaagccatttcggaagtgttgcaggatttacgtttcgatgcagaatctgctgagtag

SEQ ID NO: 45353 - DNA, 540 bp, Artificial Sequence
  Description of Artificial Sequence: Synthetic coding sequence
atgatcaccgagaccgccgccgagcccaccgtgcccgccgtgcccgctgctgaagaagctaccgaagctagaggacgggaggagcctgcgtggccatggaaagacgctcccatccgcaccttggtgcagcgcatccaccagctccaggccgaacgggcccaaggctttagacgcctagaggaagggcatagacagtacctgcgcagtggccccgattatgattttgcaaggtatagaagcactgttcatggtgtgactcaggcctttgcggctgctagcagggaagtgctggccgtggaggcagaactgggggggccaaggcgccagcccctgcttgctggccacgttcgtagcctgcaggaactcgagcaaacacgactgggcacagtagcgttattgcagttgatggagacaccggaactggccggccaggaggatgccgttcggatgcaacaacttaaaatgaaggtcattaaaacaatggaggcgataagtgaagtcctccaagacctacgcttcgatgcggagtccgcggagtag

SEQ ID NO: 45354 - DNA, 876 bp, Artificial Sequence
  Description of Artificial Sequence: Synthetic coding sequence
atgagccaggagggcgtggagctggagaagagcgtgcggcggctgagggagaagtttcacgggaaggtctcctccaaaaaggctggtgccttaatgcggaagttcggttcggatcatacaggcgtcggcagatccatcgtgtacggagtgaagcagaaggacggtcaggagctgagcaatgacctggatgcgcaggatccccctgaagatatgaagcaggaccgcgacatacaggccgtggccacaagcctgctgcctttgactgaagcaaaccttcggatgttccagcgggcacaggatgatctaattcccgccgtggaccgacaattcgcatgcagtagctgtgatcatgtttggtggcggcgagtgcctcaacgcaaagaggtgagtagatgcaggaagtgtcgtaaacggtatgagcccgtccccgccgacaaaatgtgggggctggctgaatttcactgtccaaaatgtcgacataacttcagaggctgggcccaaatgggatctccatccccctgctacggttgcggcttccccgtgtatcctacccggattctgccccctaggtgggatcgcgacccggacaggaggtcaactcacacacactcctgctcggcagcagattgttataatcggcgggaaccgcatgtgcccgggaccagttgcgctcatcctaagtcccgaaaacagaaccacctcccaaaagtcctgcatccttccaaccctcacatttcttccggcagcacagtggctacttgtttatctcaggggggcctgttggaggacctcgataatctgatcttagaggatcttaaagaggaggaagaggaagaagaggaggtggaggacgaggaaggcggcccccgcgagtag

SEQ ID NO: 45355 - DNA, 723 bp, Artificial Sequence
  Description of Artificial Sequence: Synthetic coding sequence
atgagccagcaccagcaggcctgcggcatctgccggcaggaggacccaccggaagatatgaagcaagatcgggacatccaggccgtcgctacttcactattgcccttgacagaggctaacctgcgcatgttccagcgggctcaagacgatctcattccagcagtcgacaggcagttcgcctgttcctcctgtgatcacgtctggtggaggagggtgccgcaacgcaaggaggtgtcccgatgtagaaagtgtcgcaagcgctatgagcccgtccctgcggacaaaatgtggggcctggccgagtttcactgcccgaagtgccggcacaatttccggggttgggctcagatggggagcccctccccatgttacgggtgtggttttccagtgtacccaactaggatcctgccacctcgttgggacagggaccccgaccggcgcagtactcacacccattcctgtagtgccgccgactgctataacaggcgtgagccacatgtaccaggcacctcatgcgcgcatcctaagagtcggaaacaaaaccaccttcctaaggtcctgcacccctccaatcctcacatctcctcaggctccactgtggctacttgtcttagtcaggggggactgctggaggacctggataacctcattttggaggatctgaaggaagaggaggaggaagaggaagaagttgaggacgaagaaggtggcccccgagaatag

SEQ ID NO: 45356 - DNA, 1884 bp, Artificial Sequence
  Description of Artificial Sequence: Synthetic coding sequence
atggagcggcccgagcccccccccggcaccgccgccggccaggaggagcaggagctgagggaacgcgcgtttttctcgtgggcggaattttctcggttcttcgatgcttggtgccagcagcgtctcgctttgttcttcgtaaagagttccatgcacctggcccgctgtagatgggcatccgctcctcccctgtatacgctcatcgacgtcctcaaatatagttacgtccgacttgtgtgtaaagacgttcgtgctccatctcggccggccgtggggccacctcagccaggatgccctgcgttcattatcgtgaagctttccccactcagagataggctcgtagtgacagagtgccagctcacacacagccaccccgcttgccccctcgagttcgcatactatttcaggccaggccacctgctggctaacgcctgccttcccgtgagaactacaaacaagatcagcaagcaattcgtggcgccagcagacgtccggcgcctgcttagttattgcaaaggacgagatcacggcgtactagacgctctgcatgtgctagagggactgtttcgcacagacccagaggcgaaggtcaaacttgtatttgtggaggaccaggcggtggtggagaccgtattctttcttacaagccgcactagggctctgctgagacggtttccacgcatgctgttagtggaccggttgccaggtctgcagggcgcacttgaccttcttgcggtcctgtgtgtggacggcagtggcagagcaaggcaggcggcttgctgcgttgctcggcctggcactccctcgctcctacggtttgccttggcctcgttgttgcagtccgctcctgatgttaagggtcgagtgcggtgtctgaccgctggtcctgaggtagccgcccagttaccagctgtccgtcaattgctcccgtgtgcccgggttcagatatgcagggcacagggactggagacactcttctctaaggctcaggaactcggaggagcgggtagagaggatcctggtctgtggagcagattgtgcagactggcaggcgcttcctctcctgcagcgtatgacgaggctttagccgagctgcatgcccacggtcctgccgcattcgtagattattttgaaaggaattgggagccccgtcgtgacatgtgggtacgattccgcgcttttgaagctgccagagatctggatgcatgtgctctggtacgtggacaccggcggaggctgttgcgcaggctgagccctagcagaggggtcgctcagtgcttgagggacctggtagcgatgcaatgggccgacgctgccggcgaggcagttcccgagggcccagatggtgggggcccatggctggaggatgagccaggccggggggctcagggtgagaatgagcgcgttcgcgggcttgaaacgggagactggggcggtgctccaaaagaaggctctatctggaggggggcccagatggagaaggagtgggcaagagcccttgaaacaagagattggggtggtgcccagttcgagggggaaaaggggagagcattgcagattcgggattggcgcggcggccgcctcgagaaccagaaaccacgcggcttagagggaggggtccttagggggtctaagctggaaaagggccatttgagagggcccgagatcagggactggcggggaccccaactggagggagaaaaagactggggcctagagggttatgtgtggcgcggctctcagctggaagatcaggctctccgtgggttggaaggctacacttggcgggtggctcagttggaggatcggcggtctacgacagacctgaggggtacacagttcgactatgagcgggggaaaggtgagagtaccgaagaccgatag

SEQ ID NO: 45357 - DNA, 393 bp, Artificial Sequence
  Description of Artificial Sequence: Synthetic coding sequence
atggagctgtggcggcagctgaaccaggccggcctggtgccccccggtctgggaccgccccctcaggccctgcgggaggtctccccagtggagatcccaggccagaccctgcggaccgcgggggccgatacgggcggagcatgcgacagcttgttgtggatcagggaagagctcgggaaccttcgaagggttgatgtgcagctcctggggcagctgtgctccctgggcttagagatgggggctctcagagaggaactggtcaccatccttgaggaggaagaagaatccagcaaggaggaggaagaggaccaggagccccagagaaaacaagaggaggagcacctggaggcttgcccagccccccacccaccagacttcgaaatgatgatttag

SEQ ID NO: 45358 - DNA, 630 bp, Artificial Sequence
  Description of Artificial Sequence: Synthetic coding sequence
atgcagaccctgcggcaggaggccgcccggccctgcatccccagcgggaccctggaagccagttttccagcccccctgtactccgatgattacctgagcctggagggctctagatggccaccggcgatccgacaggcaacgcgatggaaatacacaccaatgggaagggatgcagctggccaactgtggtacacagggctgacgaacagcgacgcttgggaggcatggtataatttgccaagagcacccgccagcccattcagagaggcttacaatcgatggcattcatgctaccagcatcgggagtgcagtatgcctagcgcttatacccagcacttgagagaaacagcttggcacgatcccatcgtgcccgcccagtatcaagcaccttccacaagatgggggtctgctctctggaaggatcgaccaataaggggaaaagagtatgtgctgaaccgcaatcgctacggtgtcgagccactgtggagggcttctgattacgtgccctctttgtccgcacctcaacgaccaccaggaactacgcaaaattatcgcgagtgggtactggagccatactgcccttccacctgtcagcggtctccgccctccttgactccgactccacgctag

SEQ ID NO: 45359 - DNA, 390 bp, Artificial Sequence
  Description of Artificial Sequence: Synthetic coding sequence
atgcggctgaaggtgggcttccagggcggcggctgcttccggaaggacgccttgtgcttggaggggggcgtatccgccaggtgggcccgggccccccactctgcacccctgaggcccccaagagaactgcacgcggcgccgccccccgcaactcccacacagactgtggtgaggccagccggatttccgagacgaactcggcttatggtacggtcagcccctcccacacagcgccctccgaccgggagcgggtgtgttagcggcctgtggcgaaaggggctgggactgcggcctcagactctcctcagggtggggagtgtcgtcctgtcttctgcacccgccttacggccgagattagggccctgtctgagaccacctccttccgattag

SEQ ID NO: 45360 - DNA, 222 bp, Artificial Sequence
  Description of Artificial Sequence: Synthetic coding sequence
atgggcgtgaagctggagatcttccggatgatcatctacctgacctttccggtggccatgttctgggtgagtaaccaggctgaatggtttgaagatgacgttatacagcggaagagggagctgtggcctcctgaaaagctgcaggagatcgaggagtttaaggaacgactgcggaagagaagagaagagaagctgttaagggatgcccaacagaacagttag

SEQ ID NO: 45361 - DNA, 5955 bp, Artificial Sequence
  Description of Artificial Sequence: Synthetic coding sequence
atggagctgacccccggcgcccagcagcagggcatcaactaccaggagcttacatctggttggcaggatgtaaaaagcatgatgctggtcccagagcccactcgcaaatttcccagcggcccactccttacctctgtgcgtttctctaacctgtccccagagtcccagcagcaggatgtaaaatctctggaattcaccgtggaaccgaaactccagtctgtgaaacatgtaaagctgtcaagcgtctctctgcagcaaacaataaaaagcgttgaactggcccctgggtctctaccccagcgggtcaagtatggtgagcagacaccccggaccaactaccagattatggaatcctccgagttgatacctagaccaggacaccaatttgcaaaatatgctgaaatgatcccacaacccaagtatcaaatccctaagtcagccaacttgatttcgattcccatataccacgccaccgaaagctccgagatggctcagggactggcatacaagggaatagatactgtagaaaagtcagtcggcctcacacctaagttgacagggcgggctaaggagtcacttggtatgctcttgcagcctgacctgcaagtcccgaaattcgtcgacctgacccccatggttcgagaccagggctccaagtttctgggcctcacgccagagaagagctatcaaattttggagacaatggaacttctctctcagagtcgtcctagagtcaaggacgtgggcgagctgtatatgaagcctctgcaacagacagtcgagtatgaaggtatcaccccggaactgaaacactacttcactgaggctatggggcttactgccgaggcacgtatacaagccaacgaattctttggtatgaccccgaaacccacaagtcaggccacaggatttgccgagcgtagcccccgcctgtgccctcagaatctggagtgcgtggaagtgatctcagaaaaacgtctgcagggcgaagagagtgtcgtgctgatccctaaatctctgcaccacgtccccgactctgcctctgggatgaccccaggcctaggacatcgtgtgccagaatctgtcgaattaacgagcaaatctggcgtgcaggtagagaagacgctgcagttgactccaaaaccccagcaccatgtgggatcgcctgggattatcagcggtctaggtcatcaggtacccgagagcgttaacttaacctgtaaacagtggttacaaatggaagaaagtcttgaagtccctctaaaacagacatctcaggtaattggtcatgaagagagcgtagaactcacgtctgaggcaaggcagcaccgagaagtgtcaatggggctgacaaagtccaagaatcaatccatgaagtcaccaggcactacgccgggtcccctgggccggatcgtggaatttatgcggatttctcctgagccgcttgaccaggtgacggaatctgcgcgcacccagctccaagttgcccagagtgaggaggttatactgatagacgtgcccaaggtcgtgcagtctgtgaaagtcacccccgggcctccattccaaatcgtaaagtctgttactatacccaggcccaccccacagatggtggagtacatcgagctcacccctaaactgcagtacgtccgcccttccgaacaccacacaggcccctgcctgcaggatgtcaagagcacaaagctgatcaccaaacctaaacatcaaatcctcgagacggtggagttgacaggatttcagattgtgaagacaatgttgatacccgggccctccctccaaattgtgaagtctgaagagctagctcctgggccgataccgcaggtcgtcgagcctatcggggtggcactggaaagcggaatagaagcgatcaactgtgtggaccttctaccaaggccccacctgcaggaactcattgtgccagccgaactaactccatccccttgcactcaggtgaaaagtgccgaactcacatctccgcagacctctccattcgaagaacatacgattttgactcataagcaggggctccaagccgttaaatccaccgtcattaaaaccgagccgcccaaggtgatggaaacagaagatctcaacctcggccacgtgtgccaaaaccgagactgtcagaagttgaccagcgaagagttacaggtgggcacggacttcagccggtttttacagagttccagtactacactgatcagctcctccgtgcgtacggcatccgagctgggcgggttatgggatagcggcattcaggaggtgtcacgggccctggatattaagaatcccggcaccgatattcttcagccagaggagacgtatatcgaccccaccatgatccagagtctcactttcccattagctctgcacaaccagtcttccgacaaaaccgcgaacattgttgaaaatccctgccccgagatccttggtgttgatgtgattagtaaggagactactaagcggaaacaaatggaggaactcgagaatagcctgcagagacatctccctcagagctggaggagtcggagccgcaccttccaagccgagagtggcgtgcaaaaaggtctgattaaatcctttccaggccgccagcacaacgtatgggagtcacacgcttggcgtcagagactgcccaggaagtatctatccaccatgctgatgctgggaaacatcctggggacgacaatggagagaaagctgtgtagccagacctcgctcgccgagagggcgaccgcggatacgtgccagagtattcaaaatctgtttggcatcccggccgagctcatggagccctctcagtcactgcctgagaagggcccggtgacaatctctcaaccctccgtagtgaagaattacattcagaggcataccttttatcatgggcacaaaaaacgaatggcactgagaatctggacacgggggtctaccagcagtattattcaacaatatagtgggacacgagtgcgcatcaagaagacaaactccactttcaacggtatatcccaagaggtgattcagcacatgccagtcagctgtgcgggcggccagttgcccgtactagtgaagagcgaatcatccctgagcattttctacgatcgggaggatctggttccgatggaagagtccgaggactcacagtccgacagccagacacgcatctctgaaagtcagcactcacttaagcccaattacttatcacaggctaagaccgatttttccgagcagttccagctcctcgaggacttgcagttgaagattgcagccaagctgctccgctcccaaattcccccggacgtaccccccccactggcctcaggcttagtgctgaagtaccccatatgtctgcaatgtggacgatgcagcggcctcaactgtcaccacaagctccagactacaagtgggccctatttgctgatctatccgcagctccatctggtaagaacacccgaagggcacggggaggttagactacatctcggctttagactgcgcattggaaaacggagtcagatctccaagtatagagaaagagatcgacctgttatcagaagaagcccgatctcacccagccagaggaaggccaagatctacacccaggcttcgaagtctcctacctccacaatcgatctgcaatcagggccgtctcagtctcctgcccctgttcaggtatacatcaggcgaggacagcgcagtcggccagacctagtggagaagactaaaacaagagcccccgggcattacgagtttactcaggtgcataatctgcccgaaagcgattctgagagcactcagaatgaaaagcgagccaaagttagaaccaagaaaacctccgactcaaaatacccaatgaaaaggattacgaagaggcttagaaaacatcggaagttctacacaaacagtcggacaactatagagtccccaagtcgggaattggccgctcatctcaggcggaaacggatcggggcgacccaaacatcgaccgctagcctgaaacggcagcctaaaaaacccagccagcccaagtttatgcagttgcttttccagtctctgaaaagggcttttcagaccgcccaccgcgtcattgccagtgtggggaggaaaccggtagacggaacgcgccctgacaatctgtgggcctctaagaactactaccctaaacaaaatgcaagagactactgtctgccctccagcatcaaacgggataagcggagcgcagacaagctcacacctgccggcagcaccatcaagcaggaagacatactctggggcggaacagtccaatgccgctctgcccagcagccccgccgggcttacagtttccagccacgtcctctgaggcttcctaaacccacggattctcaatctggcatcgccttccagacagcctctgtgggccagcctctgcgcacagtacagaaggattccagttcacgctccaaaaagaatttctatcggaatgagacttcctcacaagagtcgaagaacttatctacacctgggactagagtccaggctcggggtcggatcctcccaggttcccccgtgaagaggacttggcaccgacatctcaaagataagcttacgcacaaggaacataaccacccttcattttacagggagcggaccccccggggcccttctgaacgtaccagacataacccatcatggaggaatcacaggagtccctctgaacgaagccaaaggtcttccctggaacggcggcaccactccccgagtcagcgcagccattgttctccaagtcgaaagaaccattcgtcccctagtgaacggtcttggcggtcaccctcgcagagaaatcattgtagcccccctgagcggtcctgtcactctctctccgagagagggctgcattccccatctcaacgatctcacagagggccatcgcaacgaaggcaccatagcccttctgagaggagtcataggtcaccctccgagagaagccacaggtcgagcagcgaaaggcgtcatagaagtccttctcagaggagtcaccgaggcccaagtgagaggagccattgttctcccagcgaaagacgtcacagatctccatctcagagaagccatcgcggtccgtctgagaggcgccaccattcaccttctaagaggtcacacagatcgcccgcacgccgctcccatcggagtccttcggagagatcccaccacagcccctcagagaggagtcatcatagtccgtcagagcgcagacaccacagtccttctgagaggtcacattgctccccgagtgaacggtctcactgttcaccttccgaaaggagacaccgttccccttccgaaaggcggcaccattctccttctgaaaaaagccatcacagtccatccgagaggtcacaccacagcccatccgagcgtcgacgacattctcccttagaaagatctcgacatagcttactggagagatcacacaggagcccctcagaaaggaggtctcaccgcagtttcgaacgcagccacaggcgtatcagtgaacgctcgcatagtccctcagaaaaaagtcatttgagtcccctggagcgtagcaggtgttccccaagtgagcgtaggggacatagcagtagcggtaagacctgccactcccctagcgagcgctcacacaggagcccctcggggatgcgccagggcagaaccagtgaacgatcacaccgctcctcctgtgaaagaactcgccatagtcccagcgagatgaggcccggtagaccatcagggcggaaccactgcagccccagtgaacggtctagaagatctcctcttaaagagggcctgaagtattcatttcctggggagcgaccctcacattctttgagtcgcgacttcaaaaaccagacaactctgctcggaaccacgcataagaatcccaaggcaggccaggtctggcgccctgaggctacaaggtag

SEQ ID NO: 45362 - DNA, 612 bp, Artificial Sequence
  Description of Artificial Sequence: Synthetic coding sequence
atgaccgtgaagtggaagcagctgagcgcccccgccagcggcgccgagatccaacgatttccagtgcccgctgtggagcccgtgccagcgcccggtgcagacagtccaccagggaccgctctggagttggaggaggcccctgagcccagctgtcggtgccctggaaccgcacaggaccaaccaagtgaggaactgcctgactttatggcacctccggtggagccccccgcctctgcacttgaacttaaggtctggctggagcttgaggtggcggagcgcggtggtcagcacagttctagtcaacagcttccacactgttcccagtcatgggcacagtggaagctctggaggcagagaccaggctttgccatctgggcacctctgccccactggcgcgggacaagcttgattcaacagtcctcatctccagccgctgaggggccagcggcaacagcggcaggagctgtgtgcctgcccgccggcggcgctggcgagcaggagaaggaaccagtcagcagaggctcatctcggtcttcttgcagtcaaagaagaccgcccccacctggtatggaagtgtgcccccaactagggatctgggcaatttgcccatag

SEQ ID NO: 45363 - DNA, 630 bp, Artificial Sequence
  Description of Artificial Sequence: Synthetic coding sequence
atgttcgtgcggcccgagagcggcgagcagggccccgagaccctggcgccagcatccggagctgagatacagcgctttcctgtgcccgctgtggagcccgtcccagccccaggagcagattccccgcctgggaccgccctcgagttggaggaggctcctgaaccctcttgtagatgtccgggtacagctcaggatcagcccagcgaagaactgccagactttatggcccctccggtagaaccacctgcgagcgctcttgagctgaaagtttggcttgagctggaagttgccgaacggggaggacagcattcatcctctcagcagcttccacattgctcccagagctgggctcaatggaagctgtggcgccagcgtccaggttttgcaatttgggctccactgccacactggcgggggaccagcctgatccagcagtcctcttcacccgctgcagagggtccagctgctacagcggctggagccgtctgtctgcctgccgggggcgccggagagcaagagaaagagcccgtgtcaagaggttcctctagaagcagctgctctcagaggaggcctccaccccccggaatggaggtatgccctcaactgggaatatgggcaatctgtccctag

SEQ ID NO: 45364 - DNA, 1725 bp, Artificial Sequence
  Description of Artificial Sequence: Synthetic coding sequence
atggagcccaacagcctgcggaccaaggtgcccgccttcctgagcgatcttggcaaggccacgctgagagggataagaaaatgtcccagatgcggcacctataatgggactcggggtttgtcttgtaaaaacaagacctgtggcacaatttttcgctacggagctagaaaacagccttcagtagaagcagtcaaaatcatcactgggtcagatttacaggtgtatagtgtgcggcagcgagaccgcggccctgactatcgatgcttcgtggagctgggcgtgagcgagactaccattcaaacagtggacggaaccattatcacacagctctcgtccggccgatgctacgttcctagctgtcttaaggctgccactcagggcgtggttgaaaatcaatgtcaacatatcaaactcgctgtcaattgtcaggccgaagcaacgcccttgactttaaaatcatcggttctgaatgcgatgcaggcgagtccagaaaccaaacagacgatatggcaactagccaccgagcccaccggacccctggtccagcgcataaccaagaatatcctcgtggtgaaatgcaaggcctcccagaaacactcacttggctacctccatacctccttcgtgcagaaggttagtggcaaatcattacctgaaagaagattcttctgctcctgtcagacactgaagtctcacaaaagtaacgcatccaaagacgagactgcacagaggtgcattcatttctttgcttgtatctgtgcattcgcgtcagatgagacgctcgcccaggagttctcagactttttgaattttgattcatccggtcttaaagagataattgtgccacagttagggtgccacagtgaatccacggtgagcgcctgcgagtctactgcgtccaagtccaagaagaggcggaaagacgaagtcagcggcgcacagatgaattcctcactgctgccacaggatgccgtgagcagcaaccttaggaaatctggcctgaaaaagcctgtagtcgcttcaagtctgaagcgacaggcctgcggccaactgctagacgaggcccaagtgacattgagctttcaagattggctggccagcgttacggagcgtattcaccaaaccatgcattaccagttcgacggtaaaccggaaccccttgtgttccatattccccagagttttttcgatgccctgcagcagcggatatctattggatccgctaaaaagcgactgccaaatagcaccaccgctttcgtgcggaaggatgccctacccctcgggaccttctcgaagtacacctggcacattaccaatatacttcaagtgaagcagatccttgataccccggagatgccccttgagatcactaggagtttcatccagaacagggacggaacctatgagctgttcaagtgtccaaaggtcgaagtggagtcgatcgccgaaacatatgggcgcattgagaaacaaccggtcctgcgtccactcgaactcaagaccttcctcaaggtgggtaacacctccccggaccaaaaggaaccaaccccattcatcattgagtggattcctgatattttaccacaatcaaagatcggcgagttgcgaatcaagtttgaatatgggcaccatcgcaacggacacgttgctgagtatcaggaccaacgcccgcccctggatcagcctctggagttggcgcccctgacgaccatcacgtttccctag

SEQ ID NO: 45365 - DNA, 69 bp, Artificial Sequence
  Description of Artificial Sequence: Synthetic coding sequence
atggagcccaacagcctgcggaccaaggtgcccgccttcctgagcgacctaggtaaagccacactctag

SEQ ID NO: 45366 - DNA, 480 bp, Artificial Sequence
  Description of Artificial Sequence: Synthetic coding sequence
atggagcccaacagcctgcggaccaaggtgcccgccttcctgagcgacctcgggaaagcaaccttgcgcggcattcggaagtgtccacggtgcggaacctacaacggcacaagagggctgagttgtaaaaacaaaacatgtggcaccatatttcggtacggagcccgaaaacagccgtccgtggaggccgtgaagattatcacggggagcgatctgcaggtatattccgtccgccagcgggacagagggcccgactaccggtgcttcgtggagctgggagtctctgagaccaccattcagacagtcgacggcacaatcataacacagttatcgagcggacgctgttatgttcccagctgtctgaaagcagccactcaaggcgtcgtagagaatcagtgtcagcacatcaagttagcagtcaattgtcaggccgaggcgacaccactaacccttaaatcctcggtcctgaacgccatgtag

SEQ ID NO: 45367 - DNA, 387 bp, Artificial Sequence
  Description of Artificial Sequence: Synthetic coding sequence
atggagcccaacagcctgcggaccaaggtgcccgccttcctgagcgatctcgggaaggctacactccggggcattaggaaatgtccccggtgcggaacctacaacgggactcgcggacttagctgtaagaacaaaacatgtgggactattttccgctacggggcaagaaaacaacctagtgtagaagcagtgaagattataaccggctccgacctccaggtctacagtgtcagacagagagaccgcggacccgactaccgctgcttcgtggaacttggcgtgtccgagaccaccattcagactgtggacgggacgataattactcagctctcttccggacgctgctacgtgccctcctgtctgaaagcggcaacacagggcgtgtag

SEQ ID NO: 45368 - DNA, 1725 bp, Artificial Sequence
  Description of Artificial Sequence: Synthetic coding sequence
atggagcccaacagcctgcggaccaaggtgcccgccttcctgagcgacctgggaaaggcaacattaagaggtattaggaaatgtcccaggtgtggtacatacaatggcaccagaggactgtcatgcaaaaacaaaacttgcggcactatcttccggtatggtgcaagaaagcagccctctgtggaggccgtgaagatcattaccggcagcgacctacaggtctactcagtacggcaaagagatcgcgggcctgactataggtgcttcgtggagctgggcgtatccgaaaccaccattcagacagtggacggcacaattatcacacagctgtcatcaggacgctgctatgtgccaagctgcctgaaagctgcaacgcagggagtggtggagaatcaatgtcagcacattaaactggccgtaaactgtcaagctgaagcaactccccttactctcaaaagttctgtcctaaatgccatgcaggcatctccagagacgaaacagaccatatggcaactggcgaccgaacccactggcccgctggtgcagcgcataaccaaaaacatccttgtggtgaagtgcaaggcgagtcagaaacactctctgggttatctgcacacttccttcgtccagaaggtgtccgggaagagcctgccggagagaagattcttctgttcttgtcaaacattaaagtcacataagtcaaacgcctctaaagacgagacagcccagcggtgcatacatttcttcgcgtgtatatgcgctttcgcctccgatgagacgctggcgcaagagttctccgacttcctcaacttcgattctagtggactgaaggagatcattgtgcctcaacttggttgtcattccgagagcaccgtatctgcttgcgaatccacagcttccaaaagcaagaaacgcaggaaggacgaagtatctggagctcagatgaattcttccttactgccccaggacgctgtcagcagcaacctgcggaaatccggacttaaaaagcccgtggtggcctcttcgcttaaacgacaggcatgtggccagctcctggatgaagctcaggtcaccctatcttttcaggattggctggcctccgtgacagagagaatacaccagacgatgcattatcaatttgatgggaagcccgagccattggtgttccacattccccagagcttcttcgatgccctgcagcagagaatctcgatagggtccgccaaaaaaaggttgcccaatagtaccaccgctttcgttaggaaagatgcgcttccgctgggtaccttctcgaaatatacttggcacattaccaatatcctgcaggtaaagcagattttggacacgccagagatgcccctggaaatcaccaggtctttcatccagaatcgtgatggaacatatgaacttttcaaatgccctaaagtggaagttgagtcaatcgccgaaacttacggcaggattgaaaaacagcctgttctcaggccccttgagttgaagacattccttaaagtggggaacacttcccccgatcaaaaagagcctactccattcatcatcgagtggattcccgatatcttaccccagtccaagatcggagagttgaggataaaattcgagtatggacatcatcgcaatggacacgtcgcggagtaccaagaccagcgtccccctttagatcagccgcttgaactggctcctctgaccaccataacctttccatag

SEQ ID NO: 45369 - DNA, 180 bp, Artificial Sequence
  Description of Artificial Sequence: Synthetic coding sequence
atggagcccaacagcctgcggaccaaggtgcccgccttcctgagcgacttgggcaaagcaacactgcgagggattagaaaatgcccaagatgcggcacttacaacggaaccaggggattatcctgcaaaaacaagacctgcgggactatatttcgttatggcgcccgcaaacagccatag

SEQ ID NO: 45370 - DNA, 183 bp, Artificial Sequence
  Description of Artificial Sequence: Synthetic coding sequence
atggagcccaacagcctgcggaccaaggtgcccgccttcctgagcgatcttggtaaggcaactctgcggggcatcagaaaatgccctcggtgcggcacctacaatggcacacgcgggttgagttgtaaaaacaaaacttgtggaactattttccggtatggagctaggaaacaaccttcctag

SEQ ID NO: 45371 - DNA, 96 bp, Artificial Sequence
  Description of Artificial Sequence: Synthetic coding sequence
atggagcccaacagcctgcggaccaaggtgcccgccttcctgagcgatttgggaaaggctaccctccggggaatacgcaagtgcccacgatgttag

SEQ ID NO: 45372 - DNA, 507 bp, Artificial Sequence
  Description of Artificial Sequence: Synthetic coding sequence
atggagcccaacagcctgcggaccaaggtgcccgccttcctgagcgacttaggaaaggccacactccgggggattcgaaaatgccctcgttgcgggacttataacgggactcgggggctgtcctgtaaaaacaaaacctgtggaaccatctttcggtatggtgcaaggaagcagccgtctgttgaagccgtcaaaattattaccggctccgatcttcaagtttattcggttcggcagagagacaggggaccagactatcgctgcttcgtggagctgggtgtatcggaaacaaccattcagacagtggatgggacaattatcactcaactgtcctcagggaggtgctatgtgccttcttgcctaaaagctgcaacacagggagtcgtggagaaccagtgtcaacacattaagctggcagtgaattgtcaagctgaagctacgcccctcactctaaagtcatctgtgctcaacgcgatgcaggcctcaccagaaacaaaacagacttag

SEQ ID NO: 45373 - DNA, 339 bp, Artificial Sequence
  Description of Artificial Sequence: Synthetic coding sequence
atggagcccaacagcctgcggaccaaggtgcccgccttcctgagcgatctcggcaaggccacacttcgaggaatacgcaagtgcccccgctgtggcacatataacggcaccagaggactctcatgcaagaataagacctgcggcacgattttccgctacggagcgcggaagcagccctcagtggaagcagtgaagatcataacggggagcgacttacaggtatactccgtgaggcagcgagatcgaggaccggactaccgctgctttgtagaactgggcgtgtctgaaaccacaattcagacagtggacggcacaataattactcagctgagcagttag

SEQ ID NO: 45374 - DNA, 978 bp, Artificial Sequence
  Description of Artificial Sequence: Synthetic coding sequence
atggacagcgagctgaaggaggagatccccgtgcacgaggagttcatactctgtgggggggctgaaactcaggtgctcaaatgtggcccctggaccgatctcttccatgaccagagtgtgaagcggccgaagctgctgatcttcatcattcccggaaaccccgggttctccgccttttacgtcccattcgccaaagcactttacagtctcaccaacaggagatttcccgtctggacaatttcccacgcaggccatgccctggctcccaaagataaaaagatcctgactaccagtgaggatagcaacgcccaggagattaaggatatttatggtttaaatggacagattgagcataaacttgccttcctcaggacgcacgtgcccaaggacatgaaattagtactcatcggacactccatcggcagctacttcacgctgcagatgttgaagcgtgtgcccgagctgcccgttattagagcttttcttctatttccgactattgaacggatgtccgagagtccaaacggtcggatagctacacctctcctgtgctggttcagatacgtgttatatgttacagggtacttgctcctgaagccatgtcccgagacaattaaatctttgcttatccgccgaggtctgcaggtgatgaatctggagaatgaattttctccactgaatattttggagcctttttgtttagccaatgccgcttatctgggcgggcaggaaatgatggaggtggttaaacgcgacgatgagacaatcaaagagcacctgtgtaagctgacattctattacggcacaatcgacccttggtgccccaaggagtattacgaggatattaagaaggactttccagagggagatatacggctgtgtgagaagaatatcccccacgctttcattacacattttaatcaggagatggctgacatgatcgccgattcactgaaagacgacctttcaaaaatgtag

SEQ ID NO: 45375 - DNA, 834 bp, Artificial Sequence
  Description of Artificial Sequence: Synthetic coding sequence
atggacagcgagctgaaggaggagatccccgtgcacgaggagttcattctgtgtggtggcgcggaaacccaggtacttaaatgcggaccttggacggatctctttcacgaccagagtgtcaaaaggcctaaattgctgatttttatcattccagatagtaacgctcaggaaattaaggacatctacggattaaacggccagattgaacataagctcgcgttcctccgaacccatgttcctaaagatatgaaattggttttgattgggcattctattgggtcctacttcactctccaaatgctgaaacgcgtgcctgaacttcctgttattcgagcgtttctgctctttccaacaattgagaggatgtccgagtcccccaatgggcgaatagcgacccctctgctgtgttggtttcggtacgtgctttatgtgaccgggtacctcctgctgaaaccctgtcccgagaccattaaaagccttttgatccgcagaggactgcaggtgatgaatctggaaaatgaatttagccccctaaatattttggaacccttctgtttggccaacgccgcgtatttgggtgggcaggaaatgatggaagttgtcaagcgggacgacgagacaatcaaggagcatctgtgcaaactgacattttattatggaactatcgacccctggtgtccaaaggagtactacgaggatattaaaaaggactttccagagggggatatcagactgtgtgagaaaaacatacctcacgccttcatcacgcactttaatcaggagatggccgatatgattgccgatagtttaaaggacgacctgagtaaaatgtag

SEQ ID NO: 45376 - DNA, 501 bp, Artificial Sequence
  Description of Artificial Sequence: Synthetic coding sequence
atggacagcgagctgaaggaggagatccccgtgcacgaggagttcatcctctgcggaggtgctgagacccaagtgctgaagtgtgggccttggactgacctattccatgaccagtcagtcaagcgcccaaagctactgatttttataattccaggaaaccctggattttcagccttttatgttcccttcgcaaaggctctgtacagccttaccaaccgtagatttcccgtatggacaatttcccatgctggccatgcactggcaccgaaagataagaagatcctgacaacctcagaggacagcaacgcccaagaaataaaggacatatacggcctgaacgggcaaattgagcataagcttgcctttctgcgcacccatgttccgaaggacatgaaactcgttctcatcggtcatagcataggcagttacttcacactgcagatgttaaagagagtgcctgaacttccgctgatgctgcctactcttggcgctaaaaaatag

SEQ ID NO: 45377 - DNA, 588 bp, Artificial Sequence
  Description of Artificial Sequence: Synthetic coding sequence
atgaagctggtgctgatcggccacagcatcggcagctacttcaccttgcagatgctcaaaagggttcctgagctcccagtgatcagagcatttttgctctttcccaccattgaaagaatgtcagaaagtcctaacggacgcatagccacccccctgctgtgctggttcagatacgtgctttacgtgacaggctaccttttgctgaaaccttgcccagagacaataaagtctctcctgatcaggcgcgggctgcaggttatgaatctggagaacgagttttcaccactcaacattctcgagcctttttgtctagccaacgccgcctatttgggggggcaagaaatgatggaagtggtgaagcgggatgatgaaacaattaaggagcatctgtgcaagctcaccttctattatgggaccatcgatccctggtgtcccaaagagtattacgaagacattaagaaggactttccggaaggagacattagactgtgcgagaagaacataccgcacgcctttatcactcacttcaaccaagagatggctgacatgattgctgatagcctcaaggacgatctttcaaagatgtag

SEQ ID NO: 45378 - DNA, 2166 bp, Artificial Sequence
  Description of Artificial Sequence: Synthetic coding sequence
atggagctgggcaagggcaagctgctgcggaccggcctgaacgcccttcatcaggctgtccatcctattcatggacttgcttggaccgacggcaatcaagtagtcctgaccgatctgagactgcactcaggggaagtgaagtttggcgacagtaaggtcatcggtcagtttgaatgtgtttgcggtctctcatgggctccccccgtagccgacgacacaccagttctgctggcagtccagcacgaaaagcatgtcacggtctggcagctctgtccgtcccccatggagagctctaagtggctgactagccaaacgtgcgagatacgcggatccctcccaattctcccccagggctgcgtgtggcatcctaaatgtgcaattttgacagtgttgaccgcacaggatgtgtctattttccccaacgtgcacagcgatgactctcaagttaaggccgatattaacacacagggacgaatccactgcgcatgctggacgcaagacggactccggttggtcgtcgctgtgggaagttctctgcatagctatatatgggactcagctcagaagacgcttcaccgctgttctagctgtctggttttcgatgtggattctcatgtctgtagcatcactgccactgtggattctcaggtggctatcgccacggaactacctctggataagatttgtggtttgaatgcctccgagactttcaacattccgccaaattccaaagatatgactccctacgccctgccagttatcggagaggtgcggtctatggacaaggaggccactgacagtgagactaactccgaagttagtgtttcgtcctcttacctggagccattggatctgacccatatccactttaaccagcataaatccgagggcaatagcttgatatgcctccgtaaaaaggactacctcaccggcactggccaagattcttcacatctcgtgctggtcacgttcaagaaagctgtgacaatgactagaaaggtgaccatcccggggattctcgttcccgatctgatcgcctttaacctcaaagctcacgtggtggcagtggcctctaatacctgcaatatcatcttgatttacagcgtcatccccagttccgtgcctaacatccaacagattcgactggagaataccgagcggcccaaagggatttgcttcttgacagatcagctgctgctgattctagtgggcaagcaaaaattgacagatacaacatttcttccctcctctaaaagcgatcagtatgctatcagcctaattgtacgtgagatcatgctggaggaagaaccatccatcacatccggagaatcacagaccacatatagcacattcagcgctcccctgaacaaggccaacaggaagaaacttatcgagagcctatcccccgatttctgtcaccagaataagggcctgttgctgaccgtgaacaccagctcccagaatggcaggcccggtagaacgctcatcaaagaaatccagtctccactgtcatccatctgtgatgggtcaattgcactggacgcagagccggttactcagccagccagcttgccccgacattctagtactcctgatcatacttctactctagagccacctcgcctcccacagcgcaagaatctgcaaagtgagaaagagacatatcagctgagtaaggaagtggagattctgagtagaaatctcgtcgagatgcaacgatgcctgagcgaattgaccaacaggctgcacaatgggaaaaaatccagctctgtgtatccgctgtcacaggacctaccatatgtccatataatctaccaaaagccctattacttgggacccgtggtggagaagcgagcggtgctcctttgtgacggcaagctgcgcctgagcacggtgcaacagactttcggtctgagcctgatcgaaatgctgcacgatagtcactggattcttctgtccgccgactcggagggtttcataccgcttacgtttactgccacccaggaaatcatcattcgagatggcagtctgagcagatctgacgtgtttagagattcattttcccacagtccaggtgctgtgagcagtctgaaggtctttaccggactggccgcaccaagcctagatacaacaggctgttgcaaccatgtggatggtatggcatag

SEQ ID NO: 45379 - DNA, 525 bp, Artificial Sequence
  Description of Artificial Sequence: Synthetic coding sequence
atggagctgggcaagggcaagctgctgcggaccggcctgaacgccctccaccaggctgtgcaccccattcacgggctcgcttggaccgatggtaaccaggtagtgctgaccgacctccgactgcattcaggcgaagtcaagtttggcgactctaaggtgatcggccagttcgagtgtgtatgcggcttaagctgggccccgcctgtagctgacgatactcccgtgctgctggcggtccaacacgagaagcacgtgaccgtctggcaactgtgccccagcccgatggagagcagtaaatggttaacatcccagacatgtgagattagaggatccctccccattctcccccagggatgcgtatggcacccgaagtgcgcaatcctgacagtgctaacggcacaggatgtctcaattttccctaacgtgcattccgacgactctcaagtcaaggccgatattaatactcaaggccggatccattgtgcctgctggactcaggacggcttaaggcttgtggtcgcttag

SEQ ID NO: 45380 - DNA, 1869 bp, Artificial Sequence
  Description of Artificial Sequence: Synthetic coding sequence
atggagctgggcaagggcaagctgctgcggaccggcctgaacgccctgcatcaagccgtacacccgattcatggcctcgcttggaccgatggcaatcaggtagtgctgacagatctgcgtcttcattccggagaggtcaaattcggtgattctaaagtgatcggtcagtttgagtgcgtgtgcggcctgtcgtgggccccgccggtggctgatgacaccccggtgctgttagccgtgcagcacgagaaacacgtgactgtttggcagttgtgcccgtcccctatggaatcatcaaaatggttgacatcccagacttgcgagattcggggaagtttacccatattgccccaggggtgcgtatggcaccccaagtgtgcgatccttacagtgctaaccgcacaggacgtgagcatattccccaacgtacacagtgatgacagtcaggtcaaagccgacattaatacgcaagggcgaatccactgtgcatgctggacgcaagacggactcaggctggtggtcgcggttggcagcagtctgcattcatatatttgggactcagcccagaaaactctgcatcggtgcagttcttgtctcgtgttcgacgtggattcacacgtttgctccataacagccaccgttgacagccaggtcgctatcgcaactgagctgcccctagacaaaatctgtggattaaacgcctctgaaacgttcaacatcccaccaaacagcaaagacatgacgccgtatgctctccccgtcattggcgaggtccgctcgatggacaaggaggcgacggactctgagacaaacagcgaagtatctgtgagtagcagttatctggagcccctggaccttacgcatattcactttaatcagcataagtccgaaggcaattcccttatttgtcttaggaagaaggattaccttactggaactggccaagacagtagtcatttggtgttggtaactttcaaaaaggccgtgacaatgacaaggaaggtgactatccctggcatcctagttcctgacttgatagccttcaatttaaaagcacatgtggttgccgttgcaagcaatacgtgtaacatcatccttatttattcagtcatcccctcatcagtccccaacatccagcagatccgtcttgaaaacaccgaaaggcctaaaggaatctgcttccttacagaccaactcctgcttatcctggtcggaaagcagaaactcactgacacaacttttctcccgtcctctaaatccgaccagtatgctatcagcttgatcgtgcgagaaatcatgctggaagaggagccgagcatcacttccggcgaaagccagacaacgtacagtaccttctctgcgcctctgaataaggccaataggaaaaagctgatcgagtcactcagccctgatttttgccatcagaacaaaggactcttgctgacggtgaatacttcatcccaaaatggtcggcccggaaggacattgatcaaagagattcagagtcccctgtcaagcatatgtgatggtagtattgctctggatgccgaaccagtcacccagcccgcgagcctccctcgccactcctctacgccagatcacacaagtacgctggaacctccgcggctgccccagaggaagaacttgcaatccgaaaaggagacctatcagctctccaaggaggttgaaatccttagtaggaatctcgtggaaatgcagaggtgccttagcgagctgactaatagattacataatgggaaaaagagcagcagcgtttacccattgtcacaggatctcccatatgtccacattatctaccagattcctacaggatttttctccctgctcactgtgcgggccctgagcagatag

SEQ ID NO: 45381 - DNA, 480 bp, Artificial Sequence
  Description of Artificial Sequence: Synthetic coding sequence
atggagagccggcccagcggccggcagcacgccagcgagggcgacggagatcagtctccaacacagtgtgccggaatgaggtcatccggcagaagcgaccagccttacgttctcaaaggcaatcctctcctgctcagggtccgctgctatagcggctgtgctagcgggagcggccgtcagctgcagctgtctgtattccaggacctcaatcagttctcacattgcagggtttggcgcagccctgctttaatagtgaaaggggaacctccatggtgttcccagcaggatacccagagtcccttccagaccggaaccccactggaacgtccatgttttcggatgaaactgtccggctgggaactgaccaagaacgcccagagagcactagggtccaagcttcagcacattctgtctctggacagtacccaggcctgcggagcgggcggtccaacaatattacggccacccagggctccatag

SEQ ID NO: 45382 - DNA, 699 bp, Artificial Sequence
  Description of Artificial Sequence: Synthetic coding sequence
atggccggcgacgtgggcggccggagctgcaccgacagcgagctgttgctgcaccctgaactgctgtcacaggaatttctactgctgactctggaacaaaagaatatagctgtcgagaccgacgttcgcgttaataaagactctttaaccgatctgtacgtacagcacgccatccctctgccacaacgcgatctccctaagaaccgatggggaaaaatgatggaaaagaagagggagcagcacgaaataaagaatgagacgaagaggagtagcaccgtggatggcctgagaaagcggcctttaatcgtgttcgatgggtcctcgacttcaaccagtattaaggtaaaaaagacggagaatggtgataacgacaggctcaagccccctccacaggcctcattcacctccaatgcttttcggaaactttcaaactcatcgtccagcgtctcgcctcttatactgtcttcaaatctcccagtcaataataaaaccgaacacaacaataatgatgcgaaacagaatcatgatttaacccaccgaaagagtccaagcggcccggtgaagagcccccccctttctcccgtggggacaaccccggttaagctcaagagagccgctcctaaagaagaggcagaggccatgaacaacctgaagccccctcaggctaaaaggaagatccagcacgtcacgtggccatag

SEQ ID NO: 45383 - DNA, 687 bp, Artificial Sequence
  Description of Artificial Sequence: Synthetic coding sequence
atgcggcggctgcgggtgaccacccacgccagcctgcggcccagcacgtcgctacctcagaggttcctgagaggcgcactgtgggtagccgattgggggttactggccactaccatggccggggacgtcggtgggcggtcatgcaccgatagcgaactcctgctgcatcctgagctgctctcccaagagtttttgctgctaaccctagaacagaaaaacatcgctgtggaaactgatgtcagggttaacaaagatagcctgactgacctgtatgtgcagcacgccattcccctcccccagcgggatctgcccaagaatcggtggggcaaaatgatggaaaagaaacgcgagcagcacgaaatcaaaaatgaaaccaaaagatcatctactgtggacggacttagaaaacgccctttaattgtgtttgatggctcttctactagtacttctattaaggtcaagaaaacagagaatggagacaacgacagactgaagccacctccccaaaaccatgacctgacacacaggaaatctccctcagggccagtgaaatccccaccactgtcccccgtgggcacaacaccggtgaagctaaagagagcagcccccaaggaggaagccgaagccatgaacaatcttaaacctccacaggccaagcggaaaatccagcacgtgacctggccatag

SEQ ID NO: 45384 - DNA, 489 bp, Artificial Sequence
  Description of Artificial Sequence: Synthetic coding sequence
atgggcagccaccccacccccggcctgcagcggaccaccagcgccggctacagactcccacctaccaggccccctgctagcgtgtccccagccgctagggggggcccaatggctagtcgcggcctcgcgggggggtgccaagcccctcaggcattaaaagcccaacgggttgcacaaggtgctgcttgcgatggcgtccagcaggaccagctttggcgggagctcctggaagcggaacggcgtggacaacagaggtggattcagaattggtcatttcttaaagattacgaccccatgggtaataaaaaagagccggagaagctgccagatcacgttccactttttagcgacacagtaccaagcagcaccaatcaagtggtcggatctaggttggacacccccctgggtcagacgctgatccggatggacttcttcttcaccgaaggtgcaaggaaaaagaaactcgaggaccagatgcagccaatctag

SEQ ID NO: 45385 - DNA, 489 bp, Artificial Sequence
  Description of Artificial Sequence: Synthetic coding sequence
atgggcagccaccccacccccggcctgcagcggaccaccagcgccggctatcgccttccccctactcggccccctgcctccgtaagcccagctgcacgaggcggacccatggcgagcaggggcctggcagggggctgccaagcaccacaggccctcaaagctcaacgagttgctcagggggccgcttgtgacggagttcagcaggatcagttgtggcgggaactgttggaggcagagcggaggggccagcagcggtggatacaaaattggtcattcctcaaggactatgaccccatgggcaacaaaaaagagccagagaaattacctgaccatgtcccattattctccgatactgtgccatcaagcactaaccaggtagttggaagcaggctcgacacccctctcggccagacactaatacgaatggactttttctttacggaaggggcgagaaagaaaaaactggaggatcagatgcagcctatttag

SEQ ID NO: 45386 - DNA, 1239 bp, Artificial Sequence
  Description of Artificial Sequence: Synthetic coding sequence
atgctgccccagaacaaggaccaggtgctgccccagaccagcgtgctccctggacggccaacctgggggtttagccaactggttgacagtagcccgcataacctgcagcccctcagcccacaccaaggcctcccccccagccaacccccgttcagtagcactcagagcaggaggccaagttctccaccccctgcaagcccaagtccaggattccagttcggcagctgcgactccaattctgatttcgccccccatccatacagtccctcgttgccaagttctcctacattctttcaccagaactatctgtctctgccgcgtccgcgagcaagttcacctagcaaccattggttgtatccaagtcctccgctgaccccttccttttcccctagccagccccaaaattcctccttgccacattcgccttgtcagagtccgtctcaccccgaggagctgcacagctccacactgaccagcccaggacccagccctccctcacatcggttgcacagtaatagacagacttggcgctggcaccagtacagggataccgggtctgggtctccaggagtcgtggagagatgtgtgcccagcgaaaaggacccggcgcagttcagggaccccggggcactcgctcaggcccttgtcgtgcagctgggtcaccgtcggatagcgcatgatctgcgcctcctccttctgcagcacctgtggctgggccgaacgggtcaagccccggtggtcgaatatcccatttgtttggtttgtctgcgaccgcgtagcccaagctgtccattgcctaggtatcgcacaggcccccggctgctagcttttccccagctacttccctgcgtgcagggccaggagagtgggcctcttcggattggcatagggtttggactgcgattacctcagggtcaggccagggctctgcatctgcttccagaaaagagacctaaagaggccggtccccaagggaaggccactcaggcctgcggccaccagctcccagccagccagcctcctgcagcccaggcgcgagccgatccagtaccaggcaccccttcccaaacccgatcttttcggtccgcgggactgcagtcccctaatagcccccgatgctttagcggaccgccccctagagcgcccaaacaggtgacgacatccctgaaaccacggccttgcccaggaccaaaaaggcctgtaagcctcgagttgatattacagaagagcagtgtatag

SEQ ID NO: 45387 - DNA, 897 bp, Artificial Sequence
  Description of Artificial Sequence: Synthetic coding sequence
atggacaccggcgtgtggggctggggcgccgccgcctgccggtgggggccagccgagcgggctgccggctcactcaacgcagcctccctaagggaagaacaactccacctctcacttctggtgtcaagcggttggagaaccatctcattccacgtcgttccggtggtccgccggaaactgggtgctcctgctctagagggagttcaacagatgcccggattccccgaagggtctctccgtcgtatcctgtcgcagggcgtcgatctcgtaccagcgtccgcacaattatggaggacttcaactgattaccttttaactaggcttctgggcgagctcggctccctgcagggccatcggcttgattccctgtcaattctggatagagttaatcatgaaagttggcgggactccggacaaacagacgggctcacatttgggcacttgaagatggtgctgctttgggcctccgtgctgttcctagcacctgaagattgggctgagctccagggcgcagtctatcgcttgctagtggttctcctgtgttgtcttgcaacgcggaagctgccccactttctccatcctcagagaaacctcctccagggatctggactggacctgggggccatttaccagcgcgtggagggcttcgcgagccaaccggaagccgcacttaggatccacgctacccatctgggcaggtctccacctccccggattggatcaggccttaaggcgctactgcaacttccagcgtctgaccctacatactgggcaaccgcatactttgacgtgcttcttgacaaattccaggtcttcaatattcaggataaggaccgaataagcgccatgcagagtatattccaaaaaactagaactctcggcggcgaggagtcgtag

SEQ ID NO: 45388 - DNA, 1344 bp, Artificial Sequence
  Description of Artificial Sequence: Synthetic coding sequence
atgcccgcccccgccctgcccaccagcgccatggccgtgcaggtgcccctgtggcatcattacctgcaggctataagatcacgggaggccccccgtgcacaggattttcagcgagccgaaaacgtcctcttaactgtcctggaacgtgtgcatgcactggaccccaggtttattgttgactactcacgaggactcgaggcattccaattcgctttgagatcttcagaagatcccatggatatggaagtccctctatgggtcgacgcagaagccctcttgattgaggagccagaggccacacaacccgaggatggacttgagctctgtcatctcggcgtgcctcgggagggggcaggcttggagaggtggaccaccgaagatactttcaccgcttcgagcgaaggcgacgcaaagtgtcgaggccatattgtcccttcgaaagtactgtgcgttttgaaggacctcctggtggctgccattgtgcactgtaagcaccatagtctgatcgcccctggtagcctgaatgccgccagcctgcgcgaggagcaactccacctgtctttgttggtaagctctggctggagaactatttcctttcatgtcgtgccagtcgttcgccgcaaactgggagcacctgctctggagggggtacaacagatgcccgggtttcctgagggcagtttgcgccgtatactgtcccagggcgttgatctcgtccccgcttctgcgcagctctggaggacatcaacagattatctgctcacaagactgttgggagaattaggctccctacagggacataggctcgattcactgagcattcttgatagggttaatcacgaaagttggcgtgattccggccaaaccgacggattgacctttggacacctgaagatggtgttactttgggcttcagtgctgtttctggctccagaggattgggcagaactccagggcgctgtttaccgcctgttagttgtgcttctgtgctgtctggcgacacgcaagctaccccatttcttacatccgcagcgtaacctacttcaaggctccggtctcgacctgggcgctatctaccaacgggttgaggggtttgcgagtcagccggaagcagccctccgtattcatgccacgcaccttggcagatcccctcctccccgaattggctctggccttaaggctctgctccagctgcctgccagcgacccaacctactgggcaactgcttacttcgacgtactcttggataagttccaggtgtttaacattcaagataaagaccgtatcagtgcaatgcagtcaatctttcagaaaaccaggacactcggtggcgaagaatcttag

SEQ ID NO: 45389 - DNA, 840 bp, Artificial Sequence
  Description of Artificial Sequence: Synthetic coding sequence
atggacaccggcagcctgaacgccgccagcctgcgggaggagcagctgcacctctcccttcttgtctcctccggatggcgtactatctcttttcacgttgtcccagtagtacggcgcaagctcggggccccagctctggaaggagtgcagcagatgcctggctttcctgagggctccctgagacgcattttgtcccagggagttgatctcgttcctgcttccgcacagctttggagaacatcaacggattacctcctgaccaggttattaggggagctggggtcactacagggccacaggcttgattctctgtctattttagaccgcgtgaaccacgaatcttggcgcgactcaggccagacagatggactgacattcggccacctcaagatggtgctcctctgggcgagcgttctctttttggctccagaggactgggctgagctgcaaggcgccgtataccggctgctcgttgtcctgctttgctgtctcgccacacggaagctgccccacttccttcacccacagcgaaatctgctacagggctcagggctcgatctcggtgcaatttaccagcgcgtagagggatttgcatcccagcctgaggccgccctcaggatccacgcaacacacctcggacgcagcccacctcctcgaatcggctccggtctgaaggcactgctgcaactccctgctagcgaccccacctactgggccacagcctactttgatgtgttgcttgataaattccaggtttttaacatacaggacaaagacaggatcagtgccatgcagagcattttccaaaaaactaggaccctgggcggtgaggagtcctag

SEQ ID NO: 45390 - DNA, 402 bp, Artificial Sequence
  Description of Artificial Sequence: Synthetic coding sequence
atgcccgcccccgccctgcccaccagcgccatggccgtgcaggtgccactgtggcatcattatcttcaagccattaggtctcgtgaggcaccccgagcacaagatttccagcgcgctgagaacgttctgctgacagtactcgagcgcgtgcatgctctggatcccaggtttattgtcgactactcgagaggactggaagccttccagttcgcactccggtctagtgaggacccgatggacatggaggtacctctctgggtcgatgctgaagcccttctgatcgaggagcccgaggccacacagcctgaagacgggcttgaactgtgtcatttaggcgttcccagggagggcgccgggctcgaaaggtggactaccgaagatacttttacagctagttcctag

SEQ ID NO: 45391 - DNA, 2889 bp, Artificial Sequence
  Description of Artificial Sequence: Synthetic coding sequence
atgatcagcacccgggtgatggacatcaagctgcgggaggccgccgaaggtctgggcgaagactccacaggcaagaaaaaatctaaatttaagacctttaagaagttcttcgggaagaagaagcggaaggagagcccatccagtaccggcagcagcacctggaaacaatcccagactcgtaacgaggtcatcgcgatcgagtccggacctgtgggctatgatagcgaagatgaattggaggagagtcgaggcactctcggctcccgtgcactgagccatgactccattttcatcccagagtccgggcaggatgccacccgccctgttcgagtcttctctcaggagaacgtatgcgatcggatcaaagcgttacagctcaagatccagtgcaacgtgaagatgggcccccccccccctcccggaggcctgccagcaaaacgcggggaggatgccggcatgtcaagtgaggacgacggcttaccacgatctccacccgagatgtcacttctgcatgacgtgggacctggaaccaccattaaggtgtcagtggtaagtcccgatcacgtttcagatagcactgtaagcgctcgaatttccgataatagcctggcacctgtcgctgacttttcttaccctgcagagtcttcaagttgtctggataactctgctgccaagcacaaattacaggtcaagcctcggaaccaacggagctcaaaaatgaggaggctctcatctcgcgcacaatccgaaagcctcagcgaccttacgtgtacccctgaggaagaggagaacgaggagaagcccctgctggaagtcagccccgaagaacgcccgtcctcaggccagcaggacgtagctccagatcgaggcccagaacccggcccccccgcaccgctccctcctcccggcggagcccgggcgaggagggcccgtttacaacattcaagtgccctaactgcttcagttgaggagggaggcgtacctggggaggaccccagctcacgccccgcgacacccgagctcgccgagcctgaatccgcacctacactccgcgtggagccaccttctccaccggaggggccaccaaacccaggccccgatggcgggaaacaggatggagaggccccacccgcgggcccatgcgctccagctaccgacaaggccgaggaagtggtctgcgcaccagaggacgtcgctagcccctttcccaccgctatccccgagggcgataccaccccacctgaaaccgacccagctgctacctccgaagcaccgtctgctcgcgatggcccggagaggagcgtgccaaaagaggcagaaccaaccccccccgtcctgcccgacgaagagaaaggaccgcccggccctgcacccgagcctgaaagggaagccgagacggaacccgaaagaggggctggcacagaaccggaacggatcggcaccgagccgtctaccgcgcccgctccttctccgccagcgccgaaatcgtgcctaaagcacagacccgctgcggcatcagagggtcccgccgcttcaccaccattagctgcagcagaatctccacccgttgagcctgggccaggttctctggacgccgaggcggccgcaccagaacgccccaaagctgaacgagccgaagcacctcccgcaggagcggagcgcgctgctcccgaaaggaaagctgagcgaggaggcgcagaactgagaggcgctaaaaagttctccgtcagttcctgccgagccagaccacggcccggggtctcaaggccactcgaacgggcaagtggtcgacttccattggcgaggtctggccccgtgtggagatccgaggccgccttggacgatctgcaggggctgcccgaaccacagcacgccaaaccaggcccaaggaaactcgccgagagagggccgcaagatagtggggaccgcgctgccagcccagcgggaccccgaaaaagtccccaggaagccgccgccgcacccggaactcgtgagccttgtcctgctgctcaggagccggcaccttcggaagatcggaatcccttccctgtgaaactgagatcaacgtctctgagtctaaagtaccgcgacggggcttcccaagaagtgaaaggagtcaagcggtactctgccgaagtcagactggagaggtcacttaccgtacttccgaaggaggagaagtgtcctcttggaactgctccagccctccgcggcaccagggctccatccgaccagggaaaaggcaaggcgagacccccggagcccctgagctccaaacctccactgccccgcaaacccctactgcaaagctttacattgccccaccaacctgcccctcctgacgccggaccaggcgaacgagaaccccgaaaggaaccccggacggccgagaaacgccccttgaggaggggggccgagaaatcactaccaccagctgccacgggacctggagccgatggtcagccagcgccgccttggatcacagtcacaaggcaaaaaaggcgtggcactctagaccaaccccctaaccaggaagacaagcctggtgccagaaccttaaaaagcgagcctggaaagcaggcaaaggtcccagagaggggccaggaaccagttaagcaggcagattttgtgagaagtaagagctttttgattacaccagtgaagccagccgtcgatagaaaacagggcgctaaactgaacttcaaggaggggctgcagcggggtatttctctgtcccaccaaaatctggctcagtctgcggtgatgatggagaaggagctgcatcaacttaaacgtgccagttatgctagcactgatcagccatcgtggatggaactggctcgcaagaaatcccaggcctggtccgatatgccgcagatcattaaatag

SEQ ID NO: 45392 - DNA, 1188 bp, Artificial Sequence
  Description of Artificial Sequence: Synthetic coding sequence
atggccctgcccggctaccccctgggcaacgtggacgacagccggtccaaggatagcccagctggagagccccaggggcaggtccctctgaccgcagatgttctggccgtctcctcctcagtggcgagcacggactggcaggacatcgaccaggcaagcttcaagacagccacacccagggcaatcagtacttcaggagataaggataaaagtgcagtcgtacctgagcatggacagaaaaccccacgcaagattactccacttttgcctagtcagaacccctcccctctgcaagtatctatgtcactgcaaaaccccgcctgggaccgccaggtccaggacgcaaggacttcacagagcttggtcgttttcccgagtcatctcttgggcaaggacaaaatgtctcagatggcctccgtaccggaacgtgaacccgaatccgcaccaagtgctccctctgcggagctccagagtacacagcacatggaagctcaaccggtcgagagcgacgccgatcacgtcacggctggtgccaatggacagcacggcccacaggctgcttcaactacgaagtcagctgaggagaaggctgaacacccaaaggctccccacccagaagcagaagctctcccctcagatgaaagccccgtggctatgggcgccaacgtggtggactcgctgggtgacctgcaaacatggtttttcccaccacctcccgccgggagcgtcagtcctagccctggtcctcacgaggtcgccctcgggcgaagaccgctggactcctctctgtacacggccagcgaggaaaattcatatatgagaagtatgacttccttactggaccgaggcgaaggaagcatttcttccttggcagatatcctcgtgtggtctgagaccaccatgggaatggctattgccacaggattccttgatagcggacattctactgtggcagatctattgcactcatccggcccatccctacgatctgtgccatccctggtgggtagcgtgagttctgctttctcatctgggcttgtgtccggtacgagcagcgcactgagaaccatcactcgcgttttagagaccgttgaacagaggacagtcgagggaatccgtagcgccatgcggtaccttacctcccacctcacaccacgacaggctcaggccgaccccaactacgactag

SEQ ID NO: 45393 - DNA, 534 bp, Artificial Sequence
  Description of Artificial Sequence: Synthetic coding sequence
atggaccagcccgccgtggccaccgccagcaccagcatccgggaggatcttgtaggaggagaatcttttataaccgcatcaaagcccgcacagaaaacctcctcctttgaacgcgaaggctggtggcgtattgccctgaccgatacaccaatccccgggacttaccacctcaaaacctttatcgaggaatcccttctaaaccccgtgattgcgacatataactttaaaaacgaaggtaggaaaaaaccgccgctcgttcagaggaacaaccctgttctgaacgaccttccacaatacatgcctcctgactttctcgacctcctgaagaaacaggtggccacatactccttcaaggacaaacccagacccagcccatcaacgttggtggataaggatcaatccctccagttgtccccggggcagtataatgtgctgcccgcccctgtccccaagtatgcttcccggagttgcgtgttccggtccactgttcagcgatttcctaccacatatttcatccctgtctccattatgtag

SEQ ID NO: 45394 - DNA, 747 bp, Artificial Sequence
  Description of Artificial Sequence: Synthetic coding sequence
atggaccagcccgccgtggccaccgccagcaccagcatccgggaggacctcgtcggcggagaaagctttatcactgcaagtaagcctgcccagaaaactagttctttcgagcgagagggctggtggcgcatcgcccttactgacacgcctattccgggtacctaccacctcaaaacattcatcgaagaaagcctcttgaaccccgtaattgctacatacaatttcaaaaatgaagggcggaagaagcctcccctggtacagagaaataacccggtgcttaatgacctcccacagtacatgccacccgacttccttgacttgctcaagaagcaggttgccacctactctttcaaagacaaacctcgcccatccccttctactctggtggacaaagatcagtcactgcagttaagcccagggcagtacaatgttctgccagcccccgttcctaaatatgcgagtcgctcttgcgttttccgctcaactgttcagcggttcccaaccacctatttcatcccccacgaggggcctggtcccggccattacaatgtgaagatgcctccaacatcaagcgtgacctcgtgctttcagagcagggtgccccgctttctgccctcatgtagcaaaacaccgggccccggggcatacaccaccttgcggcagtttccgaaacaatcccctaccatagccaaaatgggccaggagcactctcttttcttcaataataataattggttactgaagtag

SEQ ID NO: 45395 - DNA, 1164 bp, Artificial Sequence
  Description of Artificial Sequence: Synthetic coding sequence
atgagcagcaaggtgtacagcaccggcagccgggccaaggaccaccaacctagcggcccagaatgccttccactgcctgaagctaatgctgaagccatcgattttctgagcagtctacacaaggaagagctccagatgctctttttttccgagacactcgctatggtgtcggacaccggcgaaccccagggggaattgaccattgaggtgcagagaggcaaatatcaggagaagctggggatgctgacctactgtcttttcgtccacgcctccagtaggggctttttggataaaatgctgtgtggtaatagcctgctgggctacctcagtgaaaagctggaactgatggaacagcattcgcaggacttcattaagttcctgatacttcctatggagaggaagatgtctctgctgaagcaggatgatcagctggccgtgactaggagcattaaggagggcgaagaagttaagaccggggtcaccagcttcccttggtccagcatcaagggattcatcagcgaggccgcgaacttggtccttctgagggttatggcctggcgcagaatggttcctagcaatgcccgttttctgactttggatacagaggggaagctgtgttatctgacctatcagaatttgggctttcagaccattcaggtggatcaccaacaggccgaagttttcatcgtagagcagactgtgcacgctgaagagggcattcctatgtcctgccagtactatctccttagtgatggccacctggccaagcgcatccaagtggggtcgcccgggtgttgcattattacaaagatgcccatccttcgggaggaagatgaaatagagcctagacccgtgtttgaaaaaaagccactggtttgggaggaagatatggagctgtattctaagtttcttgaccggaaagaggagttgcgcctcgggcacgcatcctatctaagacagcatcccgaagctcatgctctgatctcggactttctgttatttcttctgctgcggcagcccgaggacgtggtgacattcgccgccgaattcttcggtcccttcgacccgtggcgcccaagcagccccgcactggggagttctcaccgaccgaatcctttccgctccttagagccggaaggagatgccagaagcggcgcagcttag

SEQ ID NO: 45396 - DNA, 1761 bp, Artificial Sequence
  Description of Artificial Sequence: Synthetic coding sequence
atgagcgtgcaccagatccggaagcacgccgtgctgccccccatcatttgcaggtccgataaggaattcctagagagcgtacagcgatacatcattacagaaactgaaagactcgggtgctccgaagaaggtcctgcagacgaatattatattatctacagaaatgtttttgacaaagtcatcgagcacataacagcctataagtctatcctcaccagtatcaagaaggagtacgatgccttcatcgaaacaatcaaaaaagacaggaggactaccttttgtttacatgggaaacttaagggcctggctgccgaaccgacggccctggtttactatcgcaaacgcacaatccaacttgaagcgaagatgcgtattatagagagcaactcatctaagattcagagtcaaatcgatcacatcaaacagtgccgagccgagtatgacactaaggaggttaagtattgcacattttccaaggatcctagcaaaccgatccccggaatgaccctgcaggagtccatgaatctggatgctctaaccaaatatatgaaacacctcgaggacaagtatgcagagattaagcaggctatgctcatcaagtatgttcccgctcagcggaaggcggatctcgatgaagaaatgatcgtgctcctcaagcgcagagacgtggccgaaaatctgaataaaaagttacaattttgccaccagcgactgcagatcatctcgcaggcccttagcagctgggtcaaaagtgacatgagcagtccgttccaggatttcgttgaacagattcagaaaactaagtacttgcagggcgatcagggcatcgtagaggaactgatggaggacgatcccagacgcgccaaagaagcggagattatgttgcattacattgagcgatttaatgaattgatctctctaggcgagtatgagaaggcggcatgttacgccgcaaattcaccacgccggatcctgaggaatatcggaaccatgaacacattcaaagcggtgggaaaaatcagaggaaagccgctgcctctcctcctgttcttcgaggctttgtttattactagtcacgctttcccttgcccagtcgatgctgcgctcacgctggaggggatcaaatgcggcttatccgagaagcgtctggatttagtaacaaattgggttacccaggaacggctgacattcagtgaggaggctggggacgttatttgcgattacggcgagcaggatacatataataaagcaaagtgcctagctctggctcaaattgtttactccgagtgtggcctccacaagaaagcaatactttgcttgtgcaagcagggtcaaactcatcgggtcatggagtatatccagcagctgaaggactttaccaccgatgatttgttgcaactgctaatgagttgcccgcaggtggagcttatacagtgtttaaccaaagagcttaatgagaagcagcctagcctctctttcggtctagcgatcctgcatctgttttccgcggatatgaagaaggtgggcatcaagctgcttcaggaaattaataaaggcggtattgatgccgtggaatcattgatgataaatgactctttctgtagtattgaaaaatggcaggaagtggctaacatttgttcacagaacgggtttgataagttgagtaacgacattacaagcattttacggagccaagcagccgttaccgaaatctccgaggaagacgatgccgtgaatctgatggaacacgtgttctggtag

SEQ ID NO: 45397 - DNA, 141 bp, Artificial Sequence
  Description of Artificial Sequence: Synthetic coding sequence
atgagcgtgcaccagatccggaagcacgccgtgctgccccccatcatatgccgatctgacaaagagtttctggaatcagtgcagagatatatcatcacagagacagagcgactgggctgctctgaggaaggcccggcttag

SEQ ID NO: 45398 - DNA, 414 bp, Artificial Sequence
  Description of Artificial Sequence: Synthetic coding sequence
atggagtacatccagcagctgaaggacttcaccaccgacgacctgctgcagctgctgatgtcctgcccccaagtggagttaatccagtgtctgaccaaggagctcaacgagaagcagccaagcttgtcattcggccttgctattcttcatctgttctcagccgatatgaaaaaggtaggaattaaactgctgcaagagatcaataagggtggcatagacgccgtggaatctttgatgatcaatgactctttctgctcaatagaaaaatggcaagaagttgctaatatctgcagccagaatggctttgataagttgtctaatgacatcacttcaatactccggagccaggcagctgttactgagataagcgaggaagacgatgcagtgaatctaatggaacacgtgttttggtag

SEQ ID NO: 45399 - DNA, 1761 bp, Artificial Sequence
  Description of Artificial Sequence: Synthetic coding sequence
atgagcgtgcaccagatccggaagcacgccgtgctgccccccatcatatgcagatcagacaaagagttcctcgaatcagttcaaaggtacatcattaccgagacagaaaggctagggtgcagcgaggagggaccagctgacgagtattacatcatctaccgcaatgtctttgataaggtgatagaacacatcacagcatacaagagtattctaacatccatcaaaaaagaatatgacgccttcatcgaaaccatcaagaaggaccgccgcaccaccttctgtttgcatggtaagttgaagggcctggccgccgaacccactgccttggtatactataggaagagaaccattcagctggaggccaaaatgcgtataatcgagtcaaacagctcaaagatccaatcgcagattgatcacataaagcaatgccgcgcagagtacgacacaaaggaagtcaagtactgcacattctccaaggatccaagcaagcctatccctggcatgactctgcaggaatccatgaatctggacgctttgaccaagtatatgaaacatctggaggacaagtacgcagaaatcaaacaggcaatgctgatcaaatacgtgcccgcccagagaaaagccgacttagacgaagagatgatagtgctcttaaaacggagggacgtcgcggagaacctgaacaagaaactgcagttctgtcaccaaaggctccagatcatttcacaggctctttctagctgggtgaagtcggatatgagctccccattccaggactttgttgaacagatccaaaagaccaaatatttacagggagatcaaggcatcgtcgaagaacttatggaggacgatcccagacgcgcgaaggaggccgagatcatgctacactacatagaacggtttaacgagttgatctcattgggggagtatgaaaaggctgcctgctacgccgcaaactctccacgcagaatactaagaaatattggcacaatgaatacattcaaggcagtcggcaaaattagggggaagcccctgcccctgcttctgttcttcgaggccttgttcataacatctcatgctttcccctgcccagtcgacgccgcactgaccctcgagggcattaagtgcggactgagcgagaagaggctagatttggtaactaattgggttacgcaagaacggctgaccttttcagaggaagccggcgacgtcatctgcgattatggggagcaggatacctacaataaggctaagtgcctcgccctcgcgcaaatcgtttatagcgaatgcggccttcataagaaagctattctctgtctttgcaagcagggccagactcatagagtgatggaatacatccaacagctgaaggacttcacgaccgacgacctcctgcagttactgatgtcatgccctcaagtggagctgattcagtgtctgacaaaggagctaaacgagaagcaaccttcactctctttcggactagccatccttcacttattttcggcagatatgaagaaagtgggtattaagctactgcaggaaataaataagggcgggatcgatgctgtcgaaagcctgatgattaacgactccttttgcagtatcgagaaatggcaggaggtggctaatatctgctcccaaaatggttttgacaagctgtctaacgatatcacgtcaattctgcgatcacaagccgctgtcacagaaatatctgaagaagatgatgctgtgaacctgatggagcatgttttctggtag

SEQ ID NO: 45400 - DNA, 54 bp, Artificial Sequence
  Description of Artificial Sequence: Synthetic coding sequence
atgagcgtgcaccagatccggaagcacgccgtgctgccccccatcatttgctag

SEQ ID NO: 45401 - DNA, 243 bp, Artificial Sequence
  Description of Artificial Sequence: Synthetic coding sequence
atgagcgtgcaccagatccggaagcacgccgtgctgccccccatcatttgtagatcggacaaagagtttctcgaatccgtccagaggtatataatcacggagacagagcgccttggttgctctgaggaggggcccgccgacgaatattatatcatttaccggaatgtcttcgacaaggtgatagaacacatcactgcgtataaaagtatccttactagcattaagaaagaatacgacgcctag

SEQ ID NO: 45402 - DNA, 501 bp, Artificial Sequence
  Description of Artificial Sequence: Synthetic coding sequence
atggaggccggcccccacccccggcccggccactgctgcaagcccggcggccgactcgacatgaatcatggctttgtccatcatattaggcgaaatcaaatagcccgggatgactacgacaaaaaagtgaagcaggccgccaaagagaaagtgaggcggagacatacacccgctcctacccggccgcggaaaccagatctgcaggtgtatctcccccggcatcgtgacgtgtctgcccatccccgtaatccggattatgaggaaagtggggaatctagctcatctggcggctctgaacttgagccatccggccaccagctgttttgtcttgaatacgaggctgattctggagaggttacgtctgtcatcgtctaccagggcgacgaccccggaaaagtgagtgaaaaggtatctgcccacactcccttggatccacctatgcgtgaggccctcaagctgcgcattcaggaagagattgctaagcggcagagccagcactag

SEQ ID NO: 45403 - DNA, 384 bp, Artificial Sequence
  Description of Artificial Sequence: Synthetic coding sequence
atggaggccggcccccacccccggcccggccactgctgcaagcccggaggcaggctggatatgaaccacggatttgtgcaccacattcggcggaatcaaattgcccgcgatgattacgacaagaaggtgaaacaagcggctaaagagaaggttcgacgccgacacactccggctcctacacgtccacggaagcctgacttacaggtgtacctaccgcggcacaggggggaggctgctcgcccagcctgtctacagccggctcgatcgagctgcaacgccttgcctttctccataggcaaaaatcactttcttctgctgcgcttcagttccagtcggctcttccctgagcccccaccgcaaaggtcccaaatttctgccgagtag

SEQ ID NO: 45404 - DNA, 606 bp, Artificial Sequence
  Description of Artificial Sequence: Synthetic coding sequence
atggccagccggagcgccggcaccctgctgaccgagttcaacgccgcctatgtgccacccggactcatgcccggctaccagggccacgtacccaccgtggcctttagcttcggggcaccttatgggacaaccactctgaaatattttcaagaccacaggaaccgtgccatggaaaaaagccacacacctttcagtcagggcggacattttccaaccattttttccacaaaccccaatcttcttctgatggaaagagctagtacacgggacagatggctgcataaaccaagctacaccagatttaacttggattctcatcgaagcaccgagctcacgaacttctaccagatggtccagcagcaccgtaagtattaccaggataaaacagggaccgtgcctcgggtcccttattttgctatgcccgttcgcgagcccgagcgctacccgctgccgaccgtgctgccaccactgtgcccaaaaaaaaagtggcatcttttaagactcgctccagaaaacctcaaaacttaccaaacattccccagtggcaagcgagtgagtccacaggagagaaaaaaacgtgattgctacttcgagtttagagcttag

SEQ ID NO: 45405 - DNA, 348 bp, Artificial Sequence
  Description of Artificial Sequence: Synthetic coding sequence
atgcaggtgatgaacctgaacgtgcccatgcggcccggcatcctggtccagagacaatccaaagaggtcttggccactccactggagaacagaagggatatggaggcggaggaagaaaatcagattaatgagaaacaggaacctgagaacgccggagagactgggcaggaggaagatgatggcctacagaaaatccacaccagcgtgacgcgtacgccatcagtggtggagagccagaagaggcccctaaagggcgtaactttcagtcgagaggtcatcgtggtggatctgggaaacgagtaccccaccccaagaagttacactcgcgaacataaggaaagaaaatag

SEQ ID NO: 45406 - DNA, 585 bp, Artificial Sequence
  Description of Artificial Sequence: Synthetic coding sequence
atgagcctgctggccaagcccatgagcttcgagaccaccgccatcactttcttcattatcctcctaatctgcctaatctgcatcctgctacttctggtggtctttctgtacaagtgcttccagggcaggaagggaaaggaaaccaaaaaggtgccatgcacagacgcaaacggtggagtggattgcgccgccgccaaagtcgttacctctaaccccgaagaccacgaacgaatattaatgcaagtgatgaacttaaacgtaccaatgagaccagggatattggtgcagcgacaatcaaaggaagtgctcgccacccccctcgagaacaggagggacatggaggccgaggaggagaaccagattaatgaaaagcaggagcccgagaatgccggagaaactggtcaggaagaagacgacggacttcaaaaaatccataccagcgtgacccggacccccagcgtggtggagtctcagaaaagaccattaaagggcgtcacttttagcagggaagtcatcgtggttgatctcggaaacgagtacccgactccaagaagctacacgcgagagcacaaggagagaaagtag

SEQ ID NO: 45407 - DNA, 381 bp, Artificial Sequence
  Description of Artificial Sequence: Synthetic coding sequence
atggcccccggcgaggtgaccatcaccgtgcggctgatccggagctttgagcatcgcaacttcaaacctgtcgtctaccacggtgtgaacctggatcagactgtgaaggagtttatcgtgtttctgaaacaggatatccccctcaggaccaatctgcctcccccctttcggaattataaatacgatgctctgaagatcatccaccaggcacataaatcaaaaacaaatgagttggtgctgtcgctagaagacgatgaacggctgctgctgaaagaagattctacactcaaagctgctgggattgcttccgaaactgagatagcattcttttgtgaggaggattataaaaattacaaagcaaatcccattagttcctggtag

SEQ ID NO: 45408 - DNA, 381 bp, Artificial Sequence
  Description of Artificial Sequence: Synthetic coding sequence
atggcccccggcgaggtgaccatcaccgtgcggctgatccggagcttcgagcatagaaatttcaaacccgtggtatatcatggggtgaacctggatcagacggtaaaggaattcattgtctttttaaaacaagacatacccctaagaactaatttgcccccgccttttagaaactacaagtatgacgcccttaagattattcatcaagctcataagtcaaaaaccaacgagctagtcctgtcactggaggacgatgaacgtctcctgttaaaagaggactctaccctgaaagccgcaggtattgcaagtgaaactgaaatcgccttcttctgcgaggaggactataagaattataaagccaatccaatcagctcctggtag

SEQ ID NO: 45409 - DNA, 381 bp, Artificial Sequence
  Description of Artificial Sequence: Synthetic coding sequence
atggcccccggcgaggtgaccatcaccgtgcggctgatccggagcttcgaacataggaattttaagcccgtggtctaccatggcgtcaacctggatcaaactgtgaaggaatttatcgtgttcctgaaacaggatataccccttaggacaaacctacccccgcccttccggaattacaagtatgacgctttgaagattatccatcaagcacataaaagcaaaaccaacgaactagtcctgagccttgaggatgacgaaagattactcttgaaagaagacagcactctgaaggctgccgggatcgcaagtgagacggaaatcgccttcttctgcgaagaggactataaaaattacaaggcaaaccctatttcatcctggtag

SEQ ID NO: 45410 - DNA, 381 bp, Artificial Sequence
  Description of Artificial Sequence: Synthetic coding sequence
atggcccccggcgaggtgaccatcaccgtgcggctgatccggagctttgagcatcggaactttaagcccgttgtgtaccatggggtgaacctggatcaaacagtcaaagaatttatcgtctttctcaaacaggacatacccctccgcaccaacctgcccccgcccttccgtaactacaaatacgacgccctaaagatcatccaccaagcccataagtccaagaccaacgaactagtgctatcccttgaggatgatgagcggttgctactcaaagaggatagtactctgaaggctgccggcatcgccagtgaaactgaaatcgcctttttctgtgaggaggactacaagaattataaagcgaatcctattagcagctggtag

SEQ ID NO: 45411 - DNA, 1659 bp, Artificial Sequence
  Description of Artificial Sequence: Synthetic coding sequence
atggacaccagcagcgagatgctggtgcggttcggccggcggtgcggacgcgctaaggaaagcacggaaattcgcaattccgaagaggatcaggttttatacttgccgctgttaccgagtaaggtcgatctccaacaggtaacaattataccacacgacgagtggaagaggatacaggatagcctagatcgcctcacgcgcgaagctgcttgtctgagggctgagcgcaaagccaagaaggaaatgcatctgaggtcacaggaggtcgttaagcactggacaaatacctatgccggcatgaaagagcagaagctagaggctaagaagaaacgggacgaggaaatcgaggctgagcgacagatactggacctcgaagaagaaatttacaagcagggaaagcggaaaaaggccattgagaatgctaagcagtatcagttttaccagacggagcgcgttaagaactttcactctggattactcctctcgcgcgtgatgaaagaacgggatgctcaaatcgagtttaggaaaagcaagattaagagtgataaaaaatgggaggaacaactgaagctgaacatcgagaaggcttttaaggaagagcaggaaaaagctgagaaacggcacagagagagggtggcgctagctaaagaccacttgaaacagattaaagagcatgaggaggaagaagagaggagaaagaaatatgaggagaaagatgcagaggaaatcaagagacagaatgctctttatgagattgaaatgcgtaaaaagcttgaaaagaagcgtgaggagatgcacgaaagtcggaggcgttttcttgagcatatgcaggataaacatataatcaaagccgtcgagcagcaacagcaagaggaagaagatgaaaagatgcgaaagtttattaaagccaaaaagcggctgatccagatgggcaaagagaaggaggccgagacacatagactgatggaaaaacgaagggaacggattcacaacttcctgagtgaactgctgaaggaaaagctggataacgaggatatgataattgcgcgggacattgcggaggcagaggccgaatgggaaaaaagagagcgggaaaaggatgagaagaataaagcggaattaaaaacaatcgccgagtacagggccattgtgatgaagaataaagaagaagaagaacgccaacggaagattgaagctaaagagcagctgttggccgttatgaaggcagaccagattttttgggaacacgaaaaggaaaaaaaatgtaaagctgataaagagcatcaggaagtacaagacgcgcacatccaacaaatggccaagaataagtttaatgcaaaacaggccaaacaggccgaactagattattgtcggcttactgaggcactggtcgctgaaaaggagaaggagttccaagactacgccagagaggtcatagaactcgaatccgaaacaaccaacaaatacatttacccactggtgaaggccgtgcaggagggccccggcggcggaagaggcccagtgttcgttgacaggggcgggttacggcccagttatcaggccaacgacgtgaccggggtccaactccctttctataactcacaggggcctaaatacaacttccagaaatctaagcgccgcctgggattcacctggtag

SEQ ID NO: 45412 - DNA, 2679 bp, Artificial Sequence
  Description of Artificial Sequence: Synthetic coding sequence
atgcactggctggccagcgccacccagaccagcgccagcatcgtgagctcttccctcctgtcagccgtcgacgtgtcatcaagcctgacaatgtctgaatacttccagaatacctcgctgccgggcaccgcaaactcgcgacagttttcgctgccggtggtgagcaatgcagcattcctgaccggatcgatctccaatttctcccgagctagcgctcctgctatatcttcagcctggctgcagccttccgcttcagggacctcctttcaaccactgatgggatccgcatacttgtaccaacacagcagcacgacaatgctatcaggcgtcacaggccagtctcatatttgcactagcgccgcatcatacccaggagtgtttgaatgggattcgacagcaagcacggtcaagaaatccagctccttgcgggacttcactgtcactgtgattgaccagaacactgcagtgtcaagtatgtctatgaccgcccaatactataaaaccagcgatactaacaccatggtgcctctctatccgagcctgtccgcgtctcttgtccagggtaccttgactcagattcccaaccagcagggtcacaatctgtctctcccctgtcaaattggctcacaagtttactattacaatcaggggacccttggaccgcagctgtcttgcctgcaatcttatggcagtgtgtcttacaccgggtatagggcctccgcacatcagcctgaaatggtgatggtcttgaaggaagtgcagcccactaatgtgttaccccctgtgtccacttctgggatgtactattcagtatcatcccaacccattactgagacctcagtgcaggtgatggaaactagtctgggtatggacacctctctcgggctgcagagcccttcacagactttctgcctcccccagactcctgagttttccaaatccttcagcagccgcaacacccagacccttgagtctaatcccagtccagaactaggcgatatttccattacccctgtgcagagccccacaaatctgctgactctttctcccgctccatcccaggaaaagaatgaaaacgagaacctagatgaaataaaaactaacttaagcaggaatcaggaccccccgcttctccccgtggaaatccccgatatccaccctcttctggcatgtattgatcctttgggccaggaggagcaaccaggaagcgagaatgcaaacctacggaataaatctctgagcctggaagatcagggcatcttcgagaacggcattgaaagcagttccgatttggccgacattacaacatgggtggaagacacttatctcccacctattttctcttcactgcaggacctcgaccaacccgaaaagtcatgcgtcattaagggccattcagatcaagtcaggaagaacaagcacaaggcctcagaaccaatccagggcgccccgaaagcaaaaattcaaccaaagaaccctgagtgcttactggagagggaggtggttgttggtagcgctactgtttccaattctgcttccgtgaataaagccaaacactcttccaacaagccgcataaagccgccagcagcaggatcagcaaaacaaaaagtcatggtcaagagaaaaccaagggcaaccgcaagaacagctctaagaagtctgaagagtctaagcagtctgggaaaaaagtcaaggtggaagagaaacaaaccattccgaatatgaaacgcaagaagaatcaacctgaactgagccagaaaacgctcaagaaaccccggtcctccctggggatgcacatgctggagagcgtacaggtgttccacgctttgggcaaaaaaatcgacatgaagacaggctttagctcaagccggactcttggtagctcatcaaacacgcaaaacaggcaaccgtttcctgcgctaaaaccatggttagatatccaacatgagggaaagggacccgagaagatccaggtcaaggcgcagaagttggacggaagtgctgagaaggagtgcacttctccgtcacatagtgaattacccccacccggcaaagtgaaactgattcctttacccttcctaaccctggaccagccccaagcgcgccatgtgtcgcgccgccctaatcccctcgcttcccgccgacctgcagtcgcctatccagctcggccagatagcactaacagcgctcagagtaacgctgtcaatccaagtcgcccagctcccacaaatacctcactcaccgggccagccacacccgcacagcctatcagtgccaaagctacacagcccagtagcgccaaccccacccaacctactgtgccacagtcagctgcctctagacctagcgcctacaaaacatcaagctgctcatccctgcaaagggaacctgtgagtaccgcagtcacgagcttgcgctctctaccaaagcctcagaatcaattccttatacaggattttagccttcagccgcgcccttggcggaagccaacagtgcccgagcctgtgatgtcaacacctattaccgaagaacagagacccgagagagaagctatgaaaagaaaagcccaacaggagcgcgaaaacgcagctaaatacacctcattaggcaaggtccagttcttcatagaaagagaacgcgatatggaaatagcagagtattacggctacactatatag

SEQ ID NO: 45413 - DNA, 2769 bp, Artificial Sequence
  Description of Artificial Sequence: Synthetic coding sequence
atgcactggctggccagcgccacccagaccagcgccagcatcgtgagttcctccctcctcagcgccgtcgatgtcagctcctctttaaccatgtcggagtacttccagaatacaagtttgccaggtacagccaactcacgccaattttctctccccgtagtgtctaacgccgcatttctgaccggaagcatatccaacttctcaagagcctccgctccggccatctcatccgcctggctacagcccagcgcctctggtacatcattccagcccctaatggggagtgcctacctatatcagcactcctcgactaccatgctctctggagtgaccggtcaatcgcacatctgcacctcagcagcctcttatcccggggttttcgagtgggactctacggcatctactgtgaagaagagctcatctcttcgcgatttcacggtcactgttatcgatcagaatacggcggtgagtagcatgtccatgacagcgcagtactataagaccagcgacactaataccatggtccctctatatcctagtctcagcgcatccttggtacagggaacactaactcaaataccaaaccagcaggggcataacctgtcactaccatgccaaatcgggagccaggtgtattattacaatcagggcaccttgggacctcagctctcttgcttgcagtcctatggatcagtctcatacacaggttaccgggcatctgcccatcagcccgaaatggtgatggtgctcaaagaggtgcaaccgactaacgtcttgcctcctgtcagtacgtcaggtatgtattactcagtgtcatcccagcccataaccgagacatctgtgcaggtgatggagacctcgcttggaatggataccagcctcggcctacagagtccctcacagacattctgtctgccccaaaccccggagttttctaagagcttcagctctcggaacacccagaccctagagagtaacccatcacccgaattaggggatatctctattaccccagtccaaagccctactaatctgctcaccctgagcccagctccctcccaggaaaagaatgagaacgaaaacttagacgaaattaagacgaatcttagcaagccattagatgtgcaccaaatcttgattggcaaccaggatccacctctcctgcctgtcgaaatccccgacatccaccccctgctggcttgtatcgacccacttggccaggaagagcagcccgggtctgagaacgcaaacctccgcaacaaaagcttatctctcgaagaccaggggatcttcgagaatggaattgaaagttcctccgatttagccgatatcacaacttgggtcgaggacacatacttaccccctatattctcttctttgcaggatctggaccaacctgaatcaccttcagccaagaaagctaaggacacctctgccattaaagtgaatcaggtccaggagaaaagttgtgtaatcaagggccactccgaccaggtgaggaaaaataagcacaaggcgtccgagccaatccaaggggcaccgaaagccaaaatccagccaaaaaaccccgaatgcctcctcgaaagggaagttgtcgtggggagtgccacagtgtcaaattccgcctcagtgaataaggctaagcatagttccaacaaacctcacaaggcagcatccagccgaattagcaaaactaagtcgcatggccaggagaagaccaaaggaaatcgcaaaaacagctcaaagaaaagcgaagagtccaagcaatccggaaagaaggttaaagtggaagagaagcagaccatcccaaatatgaaaagaaagaagaaccagccggaactctcccagaaaactttgaagaaaccgaggtcctccctgggaatgcacatgcttgaatccgtccaggtgtttcacgccctcgggaaaaaaatcgacatgaaaaccggtttctcttcaagtcggacactgggttcctcgagtaacacccaaaataggcagccattccccgctctcaagccctggttagatatccagcacgaaggcaagggcccagaaaagatccaagtgaaagctcagaaactcgatggcagtgcggagaaagagtgtacaagcccgtcacatagcgaactgccacctcctggcaaagtgaaactcatccccttgcctttcctgacgttggatcagcctcaagcacgccacgtatctcgacggcccaatccactcgcgagccggagaccagctgtcgcttatccagctcgccccgactccactaacagtgcccaatccaacgccgtgaacccctcacggccggcacccaccaacactagcctgacaggccctgccacacccgcccaacctatttctgccaaagcaacccaaccttccagcgccaaccctactcaacccacagttccccaatccgcggcctcccgaccatccgcttataaaactagtagctgtagctctctgcagcgagaacccgtctcgaccgccgtcacctcccttcgatcactaccaaaaccacagaaccagtttctgatccaggacttttccctccagcctaggccatggagaaagcctaccgtgcccgagcctgtgatgtccacaccaataactgaggagcaacgaccagaaagggaggccatgaagaggaaggcccagcaagaacgtgagaacgccgcaaagtatacgtcgttggggaaggtgcagtttttcattgaacgggagagggatatggagatcgcggagtattatggctatacgatttag

SEQ ID NO: 45414 - DNA, 582 bp, Artificial Sequence
  Description of Artificial Sequence: Synthetic coding sequence
atggagcggcggctgatcaagaaggagatgaagaagctgctgggcgactacatcggcatccgactcagagagaacgaattcgaccctaagggcagacgccagctgactttcctggacgacatggcccactacgatctcgcaattagcgttgcccttcaatggttggacccatccgaggacttgacctggctggaatgggaagagttaaagatcccactccacggaagaccaatctatcctaataggagggagcgagaagcaatgattcttagctcatatgcaggcatcctgatgaactctatccccatcgaggaagtgtttaaaatctatggagccgacagtagcgcagatagcggaacaattaaggtacctcgtgtgagttcactctgtttatcattacatccgttcgctatgctgaccgctccgaaggcagcggcatacgctcgcaagcagtccgtgaaatcccggaaggttaccaccaataagaacgcgacttctatctctgccaaggaagctaacgccaccgagtggaagagtagccagagattctctgacacccagccaaagcacaaagtgacctag

SEQ ID NO: 45415 - DNA, 201 bp, Artificial Sequence
  Description of Artificial Sequence: Synthetic coding sequence
atggagcggcggctgatcaagaaggagatgaagaagctgctgggcgactacatcggtattaggcttcgagagaacgaatttgaccccaaaggcagaaggcagctgacattccttgacgatatggcgcactacgaccttgccatctctgttgcgcttcagtggctcgatccttctgaagatttgacctggctggaatggtag

SEQ ID NO: 45416 - DNA, 1767 bp, Artificial Sequence
  Description of Artificial Sequence: Synthetic coding sequence
atggagatgcagagccccatcgtgcagcggcaggagcggcaggtgcgcgatcgcggtgtgacgaggtcgaaagcggagaaggtcagaccccctacagtaccggttccacaggtggacattgtgcccggcaggctctcagaggccgagtggatggcccttacggcgctagaagagggtgaggacgtggtgggagacattctagcggaccttttggcgcgggtaatggattccgcgtttaaggtgtatcttactcagcagtgtataccttttaccatcagtcaggctagggaggctatgcttcagattactgagtggaggtttctggctcgggacgagggagagtccgccgtagccgaggaccccacctggggggaggacgaggagccgagtgcatgcacaacggactcttgggcccaagggagtgtgccagtcctccacgcctcaaccagcgaaggtttggaaaactttcagggcgaggacccaggtggcgtggacaggattccattggggcgaagctggatgggacgtgggtcccaagagcagatggaatcttgggagccttcacctcagttaagggtaaccagcgccccccccccgacatccgagctttttcaggaagctggccccggaggcccagtggaagaagcagatggccagtccagggggctaagctccgcaggatccctgtctgcttctttccagctgtcagtcgaagaggcacctgccgatgatgctgacccctcgcttgatccttaccttgtcgcctccccccaagcatcaactggtcgcgggcaccccctagggtttcacctgtccttggaagacctgtactgttgcatgccccagctggacgcggccggggaccgcctggagctccgttctgagggagttccatgtatcgcctccggggtgctggtgtcttatcccagcgtgggaggagcgacccggcctagtgccagttgccagcaacagcgggctggacactcagacgtgaggctctctgcccatcatcaccggatgagaagaaaggccgctgtcaagcggctggatcctgctcgtctgccatgtcactgggtaagacctttagccgaagtactcgtcccagactcacagacacggcctttagaagcctatagggggagacagagaggtgaaaagacaaaggccagagcagaaccacaggcacttggtccaggcactcgggtgtcccctgccgcctttttccctctgcggccgggaatcccgttccgagatcttgacagcggcccagcgttgctcttccctacactgaacctggggctgtctagccccagtctggagtcaaagttgcctctccctaactcaagaattaggtttttaaccactcatcctgtgctgcctgatgtcgcccgcagtagaagcccaaagctgtggccttccgtccgctggcccagcggttgggaggggaaagccgagctccttggggaactgtgggctggcagaacacgggtcccacctcagggtctggagctggctgacagagaaggacaggatcccggacgttggccgcgtacaactccacccgtgttggaggcaactagccaggtgatgtggaagcctgtgttgctgcctgaagcactcaagctcgcccctggggtcagtatgtggaaccggagcacacaggtcttattaagttccggtgtgcccgagcaggaagataaggaaggctcgacgtttccccccgtcgagcaacacccgatccaaaccggagcgcccaaaccgagatag

SEQ ID NO: 45417 - DNA, 63 bp, Artificial Sequence
  Description of Artificial Sequence: Synthetic coding sequence
atggccagctgcctggccctgcggatggccctgctgctggtgagcggagtactggccccttag

SEQ ID NO: 45418 - DNA, 453 bp, Artificial Sequence
  Description of Artificial Sequence: Synthetic coding sequence
atggaggactacgccctgaccttcggcatcaaccccttcatcgccctgatgatacaaccgattgtgactatgactgtggtagataatcaaggcctcggccttccagttgatatccagcacaaggcaaagcctagccccaaggcgagccagatgctgccccctgatctgggccccccttccttccagaatctattgagtccctcagagaagttagagccctgggatcctggaatgcgaaagcttacagtgcaaacttgtgggttgacttttatccacccagcggggcatggactgtgccacccgacggctgaagcatccgccgaaacattgtcttctaccgccttaaacaggcctagtgttagagaaggtgcttgcaatgaaaaaagtaccgaaaataaaaaacctcaggattcagtgctgtggtcacattcccgttggtttcagggaaactag

SEQ ID NO: 45419 - DNA, 291 bp, Artificial Sequence
  Description of Artificial Sequence: Synthetic coding sequence
atggaggactacgccctgaccttcggcatcaaccccttcatcgccttgatgatccagccaatagtcaccatgaccgtggtcgacaaccagggcttgggtttaccggtggacatccaacacaaagccaagccctcccctaaagccagtcagatgcttcccccggatctggggcctccatcctttcagaactgctttacttgtcgaacggcacccagcctagtcatggtgctgagctggaagagcggggtgcgccgggaagttcccgtccacccgtcatatgcaaaatattag

SEQ ID NO: 45420 - DNA, 621 bp, Artificial Sequence
  Description of Artificial Sequence: Synthetic coding sequence
atggccgccaccaagaccgccagctacgacgagcacttccggcccgagaagctccgggaatggcccgagcctgaaagtgtgagcctaatggaagtgctggcacgggaagatatcgatgaggcagtctgtgcgatcctgttcaaggagaatagtattgtaaaagtgaccgtgccaccctttgtcgacccattattccaacggcagcaggaggtagacgaggaacgaagaaccgggcttcagtgtgaaactggaaagcgtcacagcattaaagaacttgaggagatcgagaaagccagactgcacgcatccagcccgtacttcacattcactagccattgcgtcataccgaaagagtggcacaaagccagcgcaagggcccggagtaaaacgtataaatatagcccagagaagctgatctacgccgataagaaacagaaacgcaaagagaagaagactgcggatctctcccaggcagcattcgagagacagttcctgagtagtaagctgagccagaagaataaggtgggggaaagaaaagggctggtctcacggggcctcggaagaggctggcatgccgggctttgttccactcatgaacaacatatcctcgtaccagagtag

SEQ ID NO: 45421 - DNA, 288 bp, Artificial Sequence
  Description of Artificial Sequence: Synthetic coding sequence
atgggctgcatgaagagcaagcagaccttccccttccccaccatctacgagggtgagaaacagcacgaatctgaggaaccctttatgcctgaagagaggtgcctgccgaggatggcctccccagtgaacgtcaaagaggaggtcaaagagcccccaggcactaataccgttatcctggagtatgctcatcgactatcacaagacatcctctgcgatgcccttcagcaatgggcttgcaataacatcaagtaccacgacataccatatattgagagcgaaggtccatag

SEQ ID NO: 45422 - DNA, 288 bp, Artificial Sequence
  Description of Artificial Sequence: Synthetic coding sequence
atgggctgcatgaagagcaagcagaccttccccttccccaccatctacgaaggggagaagcaacatgaatccgaagagcccttcatgccagaggagaggtgcctaccccgcatggcatctcctgtgaacgttaaggaggaagttaaagagcctcccgggaccaataccgttattctcgagtacgcacatcggcttagtcaagatatcctctgcgatgcactccagcagtgggcctgcaataatatcaaatatcacgacataccctacatcgagtcagagggaccgtag

SEQ ID NO: 45423 - DNA, 204 bp, Artificial Sequence
  Description of Artificial Sequence: Synthetic coding sequence
atgggctgcatgaagagcaagcagaccttccccttccccaccatctatgagggcgaaaagcaacatgagtcagaggagccctttatgccggaggagaggtgcctacctcgcatggcgtctcccgtgaacgtaaaagaggaggtgaaagagcccccagggactaatacagtgatccttgagtacgctcatcgactatctcagtag

SEQ ID NO: 45424 - DNA, 288 bp, Artificial Sequence
  Description of Artificial Sequence: Synthetic coding sequence
atgggctgcatgaagagcaagcagaccttccccttccccaccatctacgagggcgagaagcagcacgagagcgaggagccctttatgcccgaagaaagatgcctccctcggatggcctctccggtcaatgtaaaggaggaggtgaaggagcctcctggaaccaacacagttatactggaatacgcgcacaggctgtcgcaggatatcctatgcgatgcacttcagcagtgggcttgcaataatatcaagtatcatgatataccttacatagagagcgaaggcccctag

SEQ ID NO: 45425 - DNA, 288 bp, Artificial Sequence
  Description of Artificial Sequence: Synthetic coding sequence
atgggctgcatgaagagcaagcagaccttccccttccccaccatctacgagggtgagaagcagcacgagtcagaagagccttttatgccagaagagcgctgtcttccccgaatggcgtctccagttaacgtgaaagaagaagtgaaggaaccacctggaacgaacaccgtcattttagaatatgctcatcggttgtcccaagatatcctgtgcgatgcccttcagcagtgggcctgtaacaacatcaagtaccacgacattccttacatcgaatccgaaggcccctag

SEQ ID NO: 45426 - DNA, 93 bp, Artificial Sequence
  Description of Artificial Sequence: Synthetic coding sequence
atgggctgcatgaagagcaagcagaccttccccttccccaccatctacgaaggggaaaagcagcatgagtccgaagagccatttatgccctag

SEQ ID NO: 45427 - DNA, 396 bp, Artificial Sequence
  Description of Artificial Sequence: Synthetic coding sequence
atggtgcggatgagccggcccctgttcctggactgggcctggcggcctctatgcagtccatcgcagtctctcccattaacttacggccccgaggggtggatactgcagtggaagggtacttgtagacagcaaacagcacttcattgcccgttcgattttccgcaggcgcctctgagaggaaggcataccctgagccaggtaccgaacaaaggacatgaaaaggccagtgctgtgcaactccctgaaaaacaaggaacagaccagtctaggcgggggccaacatcggccgtgacaaaggcccggacatcttatccagagtccgagaccttcatcgtgtatctctgttcttacttctggaattccagcaagggagtgtacatgtcaggctccacctag

SEQ ID NO: 45428 - DNA, 879 bp, Artificial Sequence
  Description of Artificial Sequence: Synthetic coding sequence
atgaagagcgaggccaaggacggcgaggaggagagcctgcagaccgcgtttaagaaactccgggtggacgctagcggttccgttgcctctctctccgtcggcgagggcacaggtgtgcgtgccccggtgaggacagcaacagatgatacgaaacccaagaccacctgtgcttctaaagactcctggcacggtagtacacgcaaatcctcgcgtggtgccgtgaggacacagaggcggagaaggagtaagagcccagtcctacaccccccaaagtttatacactgttcaaccatcgcttctagcagctcctctcaactgaaacataaaagccagacggattcacctgacgggagctctggactaggaatctcatcccctaaggaatttagtgccggggaatcctcaacatcactggatgcaaatcataccggcgccgtggtcgaacccctgcgcacgtccgttcccaggcttccttcggaaagcaaaaaggaagactctagcgacgcaacacaagtgccccaggcctcgctgaaggctagtgacctctcggactttcaatcggttagcaaactgaatcagggaaaaccttgcacatgcataggaaaggaatgccagtgtaaacgctggcatgatatggaagtgtactccttcagcggactgcagtcagtgccacctttggcacccgagcggcggtctacactggaggactactcccagtccctgcatgcccggacactcagcggtagtccccgcagctgctctgagcaggccagagtgttcgtggatgacgttacgatagaagacctttccggatatatggagtactatctgtacatccccaaaaagatgtcccatatggccgagatgatgtacacttag

SEQ ID NO: 45429 - DNA, 879 bp, Artificial Sequence
  Description of Artificial Sequence: Synthetic coding sequence
atgaagagcgaggccaaggacggcgaggaggagagcctgcagaccgctttcaaaaaactacgggtggatgcttctgggagtgtggcttcacttagtgtgggagagggtacaggggttagagctcctgtaaggaccgccactgacgacactaaaccaaagacaacatgtgcgtccaaagactcctggcacggctccacacgtaagtccagccgcggtgcagtccggacacagcggcgtcgcaggtctaaatcgcccgtgctccacccgcccaaatttatccattgcagcactatcgcaagttccagctcttctcaactcaagcacaaaagccaaacggatagccccgatggcagcagcggtctgggaatttcctctcccaaagaattctcagcaggggagagctcaacctcactggacgcaaaccatacaggtgccgtggtagagccacttagaacaagtgtcccgagattgccctctgagagtaaaaaagaggatagctccgacgcaactcaggttccgcaagcctcacttaaagcctccgatctctccgacttccaatctgtgagcaagctgaatcagggaaagccttgtacgtgtatcggtaaagagtgtcagtgtaagaggtggcacgacatggaggtatattctttttctggacttcaatccgttcctcccctggccccagaaagaaggtcaactttggaagattacagccaatcgttacacgcacgtaccctcagtggcagtccgcgctcatgcagcgaacaggccagggtatttgtggacgacgtcacgattgaagacctatccggctatatggagtactatctatatatcccgaagaagatgtcacatatggccgagatgatgtacacctag

SEQ ID NO: 45430 - DNA, 528 bp, Artificial Sequence
  Description of Artificial Sequence: Synthetic coding sequence
atgggccaggtggtgtacgtgcccgtgaagaccggcagcggcgccgatggcctgagcgaaccggaggggattagtcttaaaagggtcgccgttgttgaggatttctttgacatcatctactccatgcacgtagagtcctctgccgaacccgggaaggccccaaagcatgccggacaaaagaaaacctatcgggctatcgccgagacttacgccttcctgcccagggaggcggtgacaaggtttcttatgtcgtgtaccgagtgtcagaagcgtatgcatttcaattcaaacgggctggagccgaaggagaacgaacctccatctccgttggtgtcgggcatcatcgactacaatatgccacttacatctacctatttaaagcagatgaagctccgcgtgatgaacagtcaggaacagtgtctcccaagcggtgcagaggacatcatgtccggaggccctacactcgaagcagccgaatttgatgatttgattgggaaatgcctccccgatcggccaatcgccgagtag

SEQ ID NO: 45431 - DNA, 276 bp, Artificial Sequence
  Description of Artificial Sequence: Synthetic coding sequence
atgagcgacagcacctggatgagcgccgacccccacctggccagctctctgagtccttcacaagacgagaggatgagatctccgcagaatctgcactctcaggaggacgggccccaccgcctgtctcacttgtcacagggactcaacatcatttgcagccttgatacatcccttcgcgcccggaatcctcgcgtttcagcagaaaggaatgacttcagtttccgcggtcgtagtagatgcgtaacatccaacagtctggccaaggatggctactag

SEQ ID NO: 45432 - DNA, 1311 bp, Artificial Sequence
  Description of Artificial Sequence: Synthetic coding sequence
atgagcgacagcacctggatgagcgccgacccccacctggccagcagcctttcaccgtcccaggacgagcggatgaggagccctcaaaacctgcatagccaggaggatgatgacagtagttctgagtctgggtccggaaacggcagctcaactctcaacccatctacttcgtcttccacacagggcgaccccgcatttcccgaaatgaatggcaatggcgcagtagcacccatggacttcacgacagccgctgaggatcaacctattaacttatgcgacaagctaccgccagctacagcgttaggaaccgcctcctaccctagcgatggctgtggcgccgacggtctacgatcgcgagtaaagtacggcgtgaaaaccaccccagagtcccctccctacagctccggttcctacgactccatcaaaaccgaagtcagcgggtgcccggaagacctgaccgtgggccgcgctccaacggcagatgacgacgacgacgaccacgatgaccacgaggacaacgataagatgaacgattccgaagggatggatccagagcggttgaaagcgttcaacatgtttgtgagactgtttgtggacgagaacttggatagaatggtgcctatcagcaaacaacctaaagagaagattcaggcaatcattgaaagctgcagcaggcagttccccgaattccaggaaagggcccggaaaaggatccgaacctacctcaaaagctgcaggcggatgaaaaaaaatggaatggagatgactcgccctacccccccccacctgacatctgccatggctgaaaatatactggcggccgcttgtgaatctgagacccgcaaagctgccaaacggatgagactggagatttatcagtccagccaggacgagccaattgccctcgacaagcagcactcaagagactctgccgctattacccatagcacgtatagtctccccgcttcgtcatacagccaagatcccgtttacgcaaacgggggtctgaactactcgtaccgaggatacggcgccctgtctagcaacctccagcctccggcctcactgcagacgggcaatcacagcaacggtcccaccgacctctcaatgaagggcggcgccagcaccaccagtactacacccactccaacaccatcctcaacctctacatctagaccagtgcctaccgcccagctgagcccaaccgaaatttcagccgtgcgccaacttattgcagggtaccgagagtcagccgcctttctgttacgtagcgccgacgagttagagaacctcatattgcagcagaactag

SEQ ID NO: 45433 - DNA, 246 bp, Artificial Sequence
  Description of Artificial Sequence: Synthetic coding sequence
atgagctgcaccgagtgccagaagcggatgcacttcaacagcaacggcctggagccaaaagagaacgagcctccatccccactcgtcagtggaattatcgactacaacatgcctctgacctctacctacctgaaacagatgaagctaagggtgatgaactcgcaagagcagccgtcatctctcagtccagccccaggtttcgtgaacaccgtgatcactgtactgatttgtgcacacgaggagtag

SEQ ID NO: 45434 - DNA, 342 bp, Artificial Sequence
  Description of Artificial Sequence: Synthetic coding sequence
atgaagctgcgggtgatgaacagccaggagcaggacgagaccagcgtcagtagtgaagattttgacatgtctgattcgacatggatgtctgcggacccgcacttagccagcagtcttagcccttcccaggatgaaaggatgcggtcgccacagaatctgcactctcaggaggatggacctcatcgcctgtcccatctctcacaggggctaaacatcatctgcagcctcgacacctcattgcgcgcacgaaacccccgggtatctgctgagaggaacgatttctcctttcgtggacggtctcggtgtgttacaagcaattccctggccaaagacggctactag

SEQ ID NO: 45435 - DNA, 468 bp, Artificial Sequence
  Description of Artificial Sequence: Synthetic coding sequence
atgcacgtggagagcagcgccgagcccggcaaggcccccaagcacgcaggtcagaaaaagacataccgtgccatcgctgaaacatacgcatttctgccccgggaggcagtaacccgtttcctgatgagttgtactgagtgtcagaagaggatgcacttcaactcaaacggattggaacctaaggaaaacgagcccccatcgcctctggtgagcggcattattgattataatatgcctctaacttccacctaccttaagcagatgaagctccgtgtgatgaacagccaggagcaggacgaaacttccgtctcatctgaagatttcgacatgtccgatagcacctggatgtctgctgaccctcatctcgcgtccagcctgtccccaagccaagatgagaggatgcgctcaccacagaatctccattcccaggaagatgggggcgtctgtctgcaaggtcctacagcatag

SEQ ID NO: 45436 - DNA, 1197 bp, Artificial Sequence
  Description of Artificial Sequence: Synthetic coding sequence
atgagcgacagcacctggatgagcgccgacccccacctggccagcagcctatctccttcgcaagatgagcggatgagatcaccacagaacttacactcccaagaggatgatgatagctcatcagaatctggttccggaaatggaagcagtaccctcaaccccagtacctcatctagtacccagggcgaccccgcattcccagagatgaatggaaacggagccgtcgcaccaatggacttcacaactgccgcagaagatcagccgataaacctctgcgataaactcccacctgcaacagctctgggcactgcatcttacccatccgacgggtgcggagccgacgggctccgatccagagtcaagtacggtgttaagactactcctgagtcaccgccctacagctcaggatcctacgatagcattaaaaccgaggtctcaggatgccccgaggatctgacagtgggacgtgcgcctacagccgatgatgatgacgacgatcatgatgaccacgaagataacgataaaatgaacgacagcgagggcatggaccctgaacggctgaaggcattcaacatgtttgttcgactgttcgtggacgagaatctggataggatggtgccaatttctaaacagcctaaggaaaagattcaagcaatcatcgaatcctgctcacggcaatttccggagtttcaggagagggctaggaaacggatacgcacgtacctgaaatcttgccgccgtatgaaaaagaacggcatggagatgacccggccaacaccccctcacctgacctccgccatggccgagaacatcctcgccgcagcctgcgaaagcgagactcgcaaagccgcgaaacgcatgagactcgaaatctaccagtcctcacaggacgaacctatcgccctcgataaacagcatagccgggacagcgccgccattacacacagtacgtattccctgcccgcttcctcctatagccaggatcccgtgtacgccaatggcggcctgaattacagttataggggatatggcgcgctgtcaagtaatttgcagccccctgcaagccttcagaccgggaaccactctaatgggccaactgatctgtctatgaagggtggtgcatccaccacatccaccacccctacccctagattgggcgccccacttactagacgttggggctgttcatcggtttag

SEQ ID NO: 45437 - DNA, 231 bp, Artificial Sequence
  Description of Artificial Sequence: Synthetic coding sequence
tgacagaagcggatgcacttcaacagcaacggcctggagcccaaggaaaacgagcccccaagtcctctcgtgtctggaatcattgattacaatatgcctcttactagcacttacttgaagcagatgaagctgagagtgatgaactcccaggaacagccctcgtccctgtctcccgccccaggctttgtcaacaccgtgatcactgttcttatctgcgcacatgaagaatag

SEQ ID NO: 45438 - DNA, 648 bp, Artificial Sequence
  Description of Artificial Sequence: Synthetic coding sequence
atgcggggcctgcggtggcggtacacccggctgcccagccaggtggaagatactctcagcggtgaggaaggaaatgaggaggaagaggaggaggaggcagcgcccgaccccgccgctgctccagaagacccaactgtgccccagttaaccgaagcctcccaggtcttatctgcttcagagatcagacagttgtctttccatttccccccacgggtgaccgggcatccatggtctctggtgttttgcacttctagagacggatttagtctccagtcgttgtacaggagaatggagggatgttccggtcccgtgcttctggtccttcgtgaccaggatggccagattttcggcgccttctcctcctccgcgatcagactcagtaagggcttttatgggactggcgagacctttttattcagttttagccctcagttgaaggtctttaaatggacgggatcaaactctttctttgtcaagggagatttggattccttaatgatgggcagcggatcaggaaggtttggcttgtggctggatggtgatttatttcggggaggcagcagcccctgtccgacttttaacaacgaggtcctggctcgacaggaacagttttgtatccaggaattagaggcctggctgctgagttag

SEQ ID NO: 45439 - DNA, 3210 bp, Artificial Sequence
  Description of Artificial Sequence: Synthetic coding sequence
tgagtggccggcacccccaccagcagccagcccagcttcggcccctcaatccgggaacgcccatctcagagtctgtgcccctgcccctgtcctgctggcgaaggggatccagcatggcctgcactggagaggaggctggtgacatcccgcggtagacagccgtctccgcagtcacatgcacagctgttgactcgtaggaggcactcatcggaacaagtcccgcccgagagcgagccaagagcggactttcggtccggcaagtggctgcaggaacctgccacaggggacgcccgggactcgaggcaggctctgcgggccagaatgtcgagcaagcatagaatttgtagtcaggaggaggtggtcatcccctgcgcatacgattccgattctgaatccgttgacctggaacttagtaaccttgaaattatcaaaaaaggctcttcaagtatcgagctgactgacttggatatccccgatatacccggcctccattgtgaacctctatcacattctccaaggcatctgacgcaacaggaccctctgtccgaggcaatcgtcgaaaagctgattcaaagtattcaaaaggtgtttaacggggagcttaagggagagctagaaaagctcaagttcctgggggatttgagctccctaagccaggccttaccgtatgatgaaacggcaaaatcatttatacattcccacattgctgacatcgtgcacactcttaacgttttggtccaggaggagagacctcactcactcagcagttccatgagacaggaggtctttgttaccattgcggatttgagctatcaggacgtccacttgctgctcggatccgaagatagggcagagttgttctcactgaccattaagtcgataataactcttccctccgtgcggactctgacacagattcaagaaattatgcccaatggcacatgtaatactgaatgcctataccgacagacctttcaggctttttccgaaatgcttcagtccttggtggtgaaggatccccatctggagaacctggatactataattaagcatctggtaccctggctgcagtccgtcaaagaccatgagcgcgaaagggcaaccgccagtatggcccaggtactgaagtgtctgagcaagcatctcaatctgaagttacccttacgctttcagcgactcgggcacctggtggcgctgatggccctgctgtgtggcgatcctcaggagaaggtggccgaggaagccgctgagggaattcactctctgctgcacataactctcagactgaaatatattacccacgacaaaaaagaccagcagaacctgaaaagagcacttacaaagtgtcgcgaatttctggagcttcactccagtgccgccaaatgcttctataattgtcccttccgcatcgctcaggtgttcgaggggttcctggacagcaatgaactatgccagttcattatgacaacattcgatactcttaagactttaaaacatccctgtatccaaaggtcagcgggggagctgctcttaacccttgccaagaacaccgaaagccagtttgaaaaagtccctgagataatgggggtcatttgcgcccagctttctatcatatcgcaaccacgcgtgagacaacaaatcattaacaccgtctccctcttcatctctaggccaaagtacacggacattgtcctctcttttctactgtgccatccggtgccttacaatcgacacctggctgaagtgtggcggatgttgtccgttgaactgccctctactacttggatactctggcggctgcttcgaaagctgcagaagtgtcataacgagcctgcccaagagaaaatggcttacgttgcagtcgctgccactgacgccctatacgaggtgttcctgggcaatcggttaagagccgccaccttcaggctattcccccaactcctcatgacgctgttaattcagatacatcatagtattggactgactatgagcgatgtggacataccttctgggctctataccgagcaggaagtgccaagtgaggtaacccccttgtgttttgccatgcaggcgactaagactcttctactgagaacctgttgtcttcaggagttcaatatcatggaaaagaacaaagggtgggctctgttgggaggcaaggacggccacctgcaggggcttttcctgcttgctaatgcactgttggaaagaaaccagcttcttgcgcagaaagttatgtatctcctggtacccctcctgaaccggggaaacgacaagcacaagttaacttcagcgggctttttcgtggaactgctgagaagtcccgtggctaaacgacttcctagcatttactcggtagcccgcttcaaagactggctgcaagacggtaaccaccttttcagaattctcggactgcgagggttatacaacctggtgggccaccaggaaatgagggaggatatcaaaagtctgttgccatacatagtggatagcctccgggagaccgacgagaaaattgtgctgagcgcaatccagatacttctccagttagtgcgcactatggactttacaacactggcggctatgatgcgcacactcttcagcctgtttggcgacgtgaggtccgacgtgcaccggttttctgtcaccctgttcggggccgccattaagagtgtcaagaaccctgacaaaaaatctatagaaaaccaggttctggacagtttggtaccattattgctatattcgcaagatgagaacgatgcagtcgccgaagaaagccgccaagtcctgaccatttgcgcccagtttcttaagtggaaactgcctcaggaggtttattctaaagacccgtggcatattaaaccaactgaggctggcactatctgtcggttcttcgaaaagaagtgtaaagggaagatcaacatcttggagcagactctcatgtactctaaaaacccaaagcttccaatcaggagatcagccgtactgttcgtcggtttgctgagcaagtacatggaccataatgaacttcggcgtatgggcacagactggatcgaagatgacctgcgggatctcctttgcgatccggagccctcactgtgtatcattgccagccagactctcctgcttgtgcagatggctcgggccgaacccaagcctaagcagcgagtcaactggctgcagaaactgatgggtaggtcaagtgcgtag

SEQ ID NO: 45440 - DNA, 1890 bp, Artificial Sequence
  Description of Artificial Sequence: Synthetic coding sequence
tgacagccccggcaggtggccggcacccccaccagcagccagcccagcttcgggccttcaattagagagagaccttcacagagtttgtgtccttgcccttgtcctgccggcgaaggcgaccccgcttggcccgcgctggaacggaggctagtgacttcccgtggacgccagcccagtcctcagagccatgcgcagcttcttacccgaaggaggcattctagcgaacaggtcccccctgaatctgaaccaagggctgattttaggagcggcaaatggctgcaagagccggccaccggcgatgcacgagactcacgccaggccttacgagcacggatgagcagtaaacataggatctgctctcaggaagaggtggtgattccatgtgcatacgattcagacagcgagagtgtagatctggaacttagcaatctcgaaatcatcaaaaaaggctcaagttctatcgagcttaccgacctggacatacccgatatccccggcctccattgtgaacctctgtctcactctcctcgccatctaacccagcaagatcccctaagcgaggctattgtcgaaaagctgattcagtctatccagaaagtctttaatggtgaactaaagggagaacttgagaagttgaaatttctgggcgacctctccagcctttcacaggcccttccttacgatgaaacagcgaaatcatttatacatagtcacatcgcagatatcgtccataccttaaacgtcctcgtgcaggaggagaggccacacagtctttcatccagcatgcgacaggaggtgtttgttactattgctgacctctcttatcaggacgtccacttacttctcggctcggaggaccgcgccgaactgttcagcctcaccatcaagtccattattactctgccctccgttcgcactctcacacagatccaggagatcatgccaaacggaacctgtaataccgagtgcttgtaccgccagacgtttcaggcctttagcgagatgctgcagagcctggtggtcaaggatccacatctggagaatctggacactatcataaaacatttagtcccctggctacagagtgtgaaagaccacgaacgcgaaagggccacagcctctatggcccaggtcctgaaatgtctgtccaaacaccttaacctgaagctgccccttcgctttcaacggctggggcatctggttgcactaatggcgctgctgtgcggagacccccaagagaaagtggccgaggaggcggccgaggggatccatagcttattgcatatcactctgaggctcaagtacatcacacatgataagaaagatcagcagaatctaaaacgcgccctgaccaagtgcagagagtttcttgaattacactcatcagcagccaaatgcttttacaattgtccatttcgaatcgcccaagtgttcgaagggttccttgactccaatgagctgtgtcagttcattatgaccacttttgacaccctcaagacgttgaaacacccatgcatccagagatcagccggggaactgctcttgaccctggctaaaaacactgagtcccagttcgagaaggtccctgagatcatgggggtgatatgcgctcagttaagcattatttcccagccgagagttaggcagcagatcatcaacaccgtgagcttgtttatttctcggcctaaatacacagatatcgtattgtcttttttactgtgtcaccctgtgccctacaacagacatctcgccgaggtctggaggatgctctccgtggaactgccctccacaacatggatcctgtggcgacttctgaggaagctgcagaagtgtcataatgaacctgcgcaggagaaaatggcatacgtggcagtagctgtgagtccatag

SEQ ID NO: 45441 - DNA, 3129 bp, Artificial Sequence
  Description of Artificial Sequence: Synthetic coding sequence
atgcccctgagccggcggggccggggcagccggctggccggcagcagagccgcaacatcgaacctgccacgtgcgacagctctctctcccaagcatgcccagttgttaaccagacgaagacactcctcagagcaggtgccacctgagtccgagcctagagctgatttccggtcaggaaaatggctccaagagccagctacaggcgacgccagggattccaggcaggccctacgagcacggatgtcctccaagcatagaatttgcagccaagaggaagtcgtcattccttgcgcgtatgactcggactctgaatcagtcgacctggagctgtcaaacctggaaatcattaaaaagggttcaagttctatagaactgaccgatttagacatccccgatattcctgggcttcactgcgagccactgtcccatagccccaggcatcttacacagcaagaccccctaagtgaagcaattgtggagaagctgattcaatcaatccagaaagtatttaacggcgaactcaaaggcgaattggagaagctgaaatttcttggagatctctcctcactctcccaggcacttccctacgatgagacagcaaagagctttattcattctcacatcgccgatattgttcacactttgaacgtactcgtgcaggaggagcgccctcacagtctttcttcctccatgcggcaggaggtgttcgtgaccatcgccgacctttcctaccaggatgtccaccttctgctaggtagtgaggaccgcgcagaactcttcagcttaacaatcaagtctattatcactcttccgtccgtgaggaccctgactcagattcaagaaattatgcctaatggaacatgtaacactgagtgcctgtatcgacaaacttttcaagcattttccgagatgttacagtctctggtagtaaaggacccacatctggagaaccttgatactattattaagcatcttgtcccttggctgcagagtgtgaaagatcacgaaagggagcgggcaacagcctctatggctcaggtgctcaagtgtttgagtaagcacctcaatttgaaacttcccctgaggtttcaaagactcggccacctagtggctctcatggccctgctctgtggtgatcctcaagagaaagtggctgaggaagctgccgaggggatacacagtcttctgcatattacattaaggcttaaatacattactcacgataaaaaagatcaacaaaacctgaagagggccctgaccaagtgccgtgagttccttgagttgcacagcagcgccgccaagtgtttttataactgccccttcaggatcgcacaggtgttcgaagggttccttgactctaacgagttatgtcagtttattatgactacctttgatactctgaagactttgaaacacccttgtatccaacggtctgctggagagcttttacttactctggcaaaaaacactgagtcacagtttgagaaggtccccgagattatgggcgtgatttgtgcacagctgtctatcatttcacagccacgagttcggcagcagatcataaacacagtaagcttatttatctctaggcctaagtacacagatatcgtcttatcctttctgctctgccaccccgttccctataatagacacctggccgaggtctggcgaatgctctccgtagagttgccttccactacatggattctctggcgcctcctgagaaagttgcagaagtgccataacgaaccagctcaggagaagatggcatacgtagctgtcgctgcaacagacgctctgtatgaggtattcctaggaaataggttacgagcagcaacattccggctcttcccccagctgctaatgactttactgatacaaattcaccattctattggccttaccatgtccgacgtggacataccctctggactctacactgaacaggaggttccatctgaggtcacaccgctgtgcttcgccatgcaggcaacaaaaactctcctgttgcgcacatgctgtctgcaggagtttaacattatggagaagaacaagggatgggctctgttgggtggcaaggatggccatttgcaggggctgtttttgctcgctaatgctctcctcgagcgcaatcagctgctggcccagaaagtgatgtacctgcttgttcccctgctgaatcgcggaaatgataaacataagttaaccagcgccggcttctttgtggagttacttcggagtcctgtggccaagaggctccccagcatatacagtgtggcacggtttaaggattggttacaggatggcaatcatctcttccggattctgggccttcgcggtttgtataacttggtaggacaccaggagatgcgggaggatattaaaagtctgctcccatacatcgtcgactccttaagggaaacagatgaaaaaatcgtactgtctgcaattcaaatcctcttgcagctggtgaggaccatggattttactacattagcagctatgatgagaactctcttctctcttttcggggatgtgcggtccgatgtacaccggttctccgtgacactatttggtgcagccattaagagtgttaagaaccccgacaaaaagtcaattgagaaccaggttctagacagcctggtacctcttctactgtatagtcaggatgaaaatgatgcagtggcagaggaaagcagacaggtgctgaccatttgcgcccagtttttgaaatggaagctgccgcaggaggtttactctaaagacccatggcacatcaagcccactgaggcgggcacgatctgtcgcttctttgagaaaaaatgtaagggtaagataaatattttggagcagacacttatgtactccaaaaacccaaagcttcccatacgacgcagtgcagtgcttttcgtaggcctactgtctaaatacatggatcacaacgaactcaggcgcatgggcacagattggattgaggacgaccttcgcgacctcctgtgtgacccagagcctagtttatgcatcatcgcatcccagaccctgctactggttcagatggccagggctgagccaaagccgaagcagagggttaattggctccaaaagctgatggggcgctcatctgcttag

SEQ ID NO: 45442 - DNA, 2013 bp, Artificial Sequence
  Description of Artificial Sequence: Synthetic coding sequence
tgatgcaacaccgagtgcctgtaccggcagaccttccaggccttcagcgagatgctgcagtcattggtggtgaaggaccctcatctggagaatctggacaccatcattaaactgccactaaggttccagcggctcgggcatctggtggcactaatggctctgctctgtggcgatccacaggaaaaggttgcagaagaggctgccgaaggaattcactcccttctccatatcaccctgcggctgaaatacatcacgcacgataaaaaggatcaacagaacttaaagagagctctcactaaatgccgtgaatttttagaattgcacagctcagcggcaaagtgcttctataactgcccgtttagaatagcccaggtgccagagattatgggggtgatatgcgcacagctttctatcatcagtcagcctagggttaggcagcagattatcaacaccgtctcgctgttcatcagtaggccgaagtataccgacattgtactctcctttctgctatgccatcctgttccttacaaccgccatctggctgaggtttggcggatgctatccgtcgaactaccttccacaacttggatcctgtggcgactgcttagaaaactgcagaaatgtcataacgagcccgctcaggaaaagatggcttacgttgcagtcgcagcgactgatgcactgtacgaggttttcctaggaaatcggttaagagcagccactttcaggctcttccctcagctgctgatgacgctgctgatccagattcatcattctatcggcttaaccatgtcagacgtggacatccctagcgggctgtacaccgaacaggaagtgccaagcgaggtgactcccttgtgcttcgctatgcaagccaccaagacccttttactgcggacgtgctgcctgcaagagtttaatattatggaaaagaacaagggatgggctctgttagggggaaaggatggtcatcttcaggggctgttcctcctcgccaacgccctgcttgagaggaaccagttgcttgctcagaaagtgatgtacctgctggtgcctctcctgaataggggaaatgataaacataagcttacaagcgctggattttttgtggaactcttgagatcccctgtggccaaacgcttaccctccatatacagtgtggcccgcttcaaagattggcttcaggatggcaatcacctgttccgcatcttaggcttgcggggactgtataacctggtggggcaccaagaaatgagagaggatatcaaaagcttgctgccttacattgttgatagtctccgcgagaccgacgagaaaattgttctaagtgcaattcagatcctgctccagctggtgcggaccatggatttcacaaccttggctgctatgatgcgcacactcttctccctcttcggagacgtaaggagtgacgtgcacagattctccgttactctcttcggagcagcgatcaaatccgtaaaaaatcccgataaaaagtccatagagaaccaggtattggactctcttgtgcccttactgctgtactctcaggatgaaaacgacgctgtagcggaggagtcccggcaagtcctcaccatttgtgcccagtttcttaagtggaagcttcctcaggaggtctattcaaaagacccctggcacatcaagccgacagaggccggcactatctgcagattctttgagaagaagtgcaagggtaaaattaacattttggagcagacattgatgtactccaagaatccaaagttaccaattaggcgctccgccgtcttgtttgtcgggctgctctccaaatatatggatcacaatgagctcagaaggatgggcactgactggatagaggacgacttaagggatctgttgtgtgaccccgagcctagcctctgcattatagccagtcagactctactgctggttcagatggctcgcgcagagcccaagcctaaacaacgcgtaaactggctccagaaactgatggggagatcaagcgcctag

SEQ ID NO: 45443 - DNA, 1803 bp, Artificial Sequence
  Description of Artificial Sequence: Synthetic coding sequence
tgacaccccagcccccggcaccagccccggcaggtggccggcacccccaccagcagccagcctagtttcgggccctctatccgcgagagaccctctcagtccctatgcccctgtccttgccccgcgggcgagggggaccctgcttggcccgctcttgagagaagactcgtgacgtccagagggcgccaaccatctccccaaagtcatgcccagctgctcacacgacggcgacacagctcagaacaggtgcctcctgagagcgagccaagagcggattttcgatcaggcaaatggctacaggagccggccacgggggatgccagggacagtcgtcaggcccttcgggcccgcatgtcttcgaaacacaggatctgctcacaggaggaggtcgttattccatgcgcttatgacagcgacagtgagtccgttgatctggagctgagtaacctcgagatcatcaagaaagggtcttccagtattgagctaactgatctcgacatcccagacataccaggtcttcattgtgagcccctgtcccactcccctcggcacctcacacagcaagacccgctttccgaagctatcgttgaaaaactgatccagtcaatccagaaggtcttcaacggtgaattgaaaggcgaattggaaaagctaaaatttctgggagatttgagcagcctgagccaagcactgccctatgatgaaacggctaaatcatttatccactcacatattgctgatatagtgcacacgctcaatgtactggtgcaagaggaacggccacatagtctatctagttcaatgcgccaggaagtgtttgtgaccatcgcggatctgtcctatcaggatgtgcatctgctactgggctccgaagatagagcggagttattcagcctgacaattaagtctataataactctgccatccgttcgcacactaacccagattcaagagattatgccaaacggcacatgcaatacagaatgtttgtaccggcaaacatttcaggcattcagcgaaatgctccagagtctggtagtcaaggatccccatctagaaaacctcgacaccattatcaaacttcccctgcggttccagcgactgggccatctcgtcgccctgatggcgcttctgtgtggagacccgcaggaaaaggttgcagaagaagctgccgaaggaattcattcgcttctgcacattacccttcgactcaaatacataactcatgacaagaaagatcagcagaaccttaaacgggccctcaccaaatgtcgcgaatttctggagttgcactcgtctgctgctaagtgcttctacaactgcccctttcgcatcgctcaagtgttcgaagggtttcttgatagcaacgaactgtgccaatttattatgaccacctttgacaccctaaagacactgaagcacccttgcatccagcgatccgcaggcgagttgttattaaccctcgccaaaaacactgagagtcagttcgaaaaggtcccagaaatcatgggggttatatgcgcccagctaagtattatttcgcagccccgggttagacaacagatcatcaatacagtcagcttgtttatatcccgaccaaaatacacggacatcgtcctcagctttctgctttgccacccagtgccatacaatcgccatctcgctgaagtgtggcggatgctaagcgtggagctaccttccacaacatggatactctggaggttacttaggaagctgcagaaatgtcacaacgaacccgctcaggaaaagatggcatacgtggccgtggcagtgagcccatag

SEQ ID NO: 45444 - DNA, 75 bp, Artificial Sequence
  Description of Artificial Sequence: Synthetic coding sequence
atgcggcaggaggtgttcgtgaccatcgccgacctgagctaccaggatgtgcacctgctgcttgggagtgagtag

SEQ ID NO: 45445 - DNA, 105 bp, Artificial Sequence
  Description of Artificial Sequence: Synthetic coding sequence
atgcggcaggaggtgttcgtgaccatcgccgacctgagctaccaggatgtgcatcttctgctgggtagcgaggacagggcagaactgttctccctgactatctag

SEQ ID NO: 45446 - DNA, 2799 bp, Artificial Sequence
  Description of Artificial Sequence: Synthetic coding sequence
gccggcagccgggccgccaccagcaccagccggggcgccctgagccagtcacatgcccagctcttgaccagaagacgccatagtagcgagcaggtacctcccgaatctgagccacgagccgacttccgtagcgggaaatggttgcaggaaccggccaccggcgatgcaagggattctagacaggcattgcgtgcacgaatgagcagcaagcacagaatttgtagtcaggaagaagtcgtgataccctgtgcctacgacagtgacagtgagagcgtggatttggaactgagcaatctggaaatcatcaaaaaaggtagctcaagtatcgagctgaccgacttggacatccccgacatcccgggattgcactgtgagccattgagtcatagccctaggcacctcacacagcaggatcccctgtcagaggctattgtcgagaaacttatccagtccattcagaaagtttttaacggcgagctgaagggcgagctggagaaactcaaatttctgggagatctcagtagcctgagtcaggcgctgccatatgatgaaaccgctaagagcttcatacactcgcacatcgctgatatcgtccatactctgaacgtgctcgtccaggaggaacgaccccattccctgtctagcagcatgcgccaggaggtgttcgtcaccattgcagatctcagctaccaggatgtccatctgttacttggctctgaggatcgtgccgagttgttttccctgacgatcaaatccatcattacattaccaagtgtcagaaccctcacgcagatccaggaaatcatgcccaatggaacatgcaacactgagtgcctgtaccgtcagacttttcaagctttctcagagatgctccagagcctggtcgttaaagatccacacctggagaacctggatacgatcatcaagcaccttgtgccatggctgcaatctgtaaaggaccatgagcgggagagggcaacagctagcatggcccaagttctaaagtgcctgtctaagcacttaaacctgaagctgcccctgcgatttcagcgattgggccacctggtagccctgatggcgcttctctgtggcgaccctcaagaaaaagtggcagaagaagccgcagagggcattcacagcctgctgcacattactctgagattgaagtatattacccatgacaaaaaagatcagcagaatctcaagagggcattgaccaaatgtcgcgaatttctcgaacttcactcctcagccgccaagtgtttttacaattgcccgttcagaatcgcccaggtctttgaggggttcttggactcgaatgagttatgccagttcatcatgactacttttgataccctaaagacccttaagcacccttgtatccaacggtcagccggcgagttactgttgacactggctaaaaacacagagagccagttcgagaaagtgccagaaataatgggggtgatctgtgcccagcttagcattatcagtcagccccgcgtcagacagcaaatcattaacacggtgagcttgttcatttcccggcctaaatatacagatatcgtgttgtccttcttactctgtcatccagtgccatacaatcggcatcttgccgaggtgtggaggatgctttctgtggagctcccaagcaccacatggatcttgtggaggctactcaggaaactgcagaagtgccacaatgagcctgcacaggagaagatggcttatgttgctgtcgcggcaaccgacgcactctacgaagtgttcctgggtaaccgactgagagctgccaccttccggctgttcccccagctgctaatgacactcttaattcagatacaccatagcataggcctgacaatgtccgacgtggacattccgagcgggctgtatactgagcaggaggtgccttccgaggtgaccccactgtgtttcgccatgcaggcaacaaagacgcttctgctgaggacgtgttgccttcaggagtttaacattatggaaaagaacaagggatgggcgttactgggtggcaaagacgggcaccttcaaggcctattcttgctggccaatgccctgctggaacgaaatcagctgttggcccagaaagtgatgtatctgctagtacccctgttgaatagagggaatgacaaacataagctcacaagcgccgggttctttgtggaactcctacgatccccagttgccaagagactaccctcaatctactccgtggctaggttcaaggattggctgcaggacggaaatcacctcttcaggatcctgggcctcagaggcctgtataacctggtcgggcaccaagaaatgagggaagacattaagtctctcctcccttatatcgtggattccctgcgggagacagatgagaaaatagtcttgtccgctattcagatactgttacaactcgtccggactatggattttaccactctggcagccatgatgcggaccctgtttagtttgtttggagacgtgcggagcgacgtgcaccgattcagcgtgacattgttcggggcagccattaagagtgtcaagaaccccgacaagaaatcaatagaaaatcaggtgctggacagtctcgtgcccctcctcctatactcacaagacgagaatgacgctgtggcagaagaaagccgccaggtcctcactatttgtgcccagttcttgaaatggaaacttcctcaggaggtgtacagcaaagatccttggcacataaagcccacggaggccggaaccatttgtaggttcttcgggaagaaggtgcagggagagaattag

SEQ ID NO: 45447 - DNA, 462 bp, Artificial Sequence
  Description of Artificial Sequence: Synthetic coding sequence
atgggcaactacagcagccacaagcggaccaaggcccccaagcaggctcgaaaagagagaccagcagacatggataaagcatggtggaagtcctttctgaatcacctgaccagaaagaagcctgccaccagaatcgtgctcatccttcccctcgacaagcgccagccgttagctaacgcagggcaacgtattgactacgccagcggagccggtctgggttcacccgctgcgcctagactgaggggcgccggcgagggatccgagcgggaacccagaatgcctgtcttgctgctcctccgcagacaggaggccaggcgcccggaggagggcggagctcgagctgccctgtcgtggccacgcttgttatctagattccgtagtcctgggaaagccccgcgagaagcggggccagctgaggagcagcctcgaaaaagatgccgctgtcctcggccacagctctag

SEQ ID NO: 45448 - DNA, 1995 bp, Artificial Sequence
  Description of Artificial Sequence: Synthetic coding sequence
atggagagcttcatggagagcctgaaccggctgaaggagatccacgaaaaagaagtcctgggtctgcaaaacaaactcctcgagctcaattccgagcggtgtcgggatgcccaacgaatcgaggagcttttcagcaaaaatcatcagctgagggaacaacagaaaactctaaaagagaaccttagggtgctggaaaaccgccttcgcgccggactctgcgatcggtgcatggtgacccaggagttagcgcggaaacggcaacaggaattcgaatcctcccacttgcagaacctgcagcgcatttttattctcaccaacgaaatgaatggcctcaaggaagaaaacgagactctgaaggaggaggtcaagcgtttacggggactcggcgaccgtccaaagccgcgcgccaaggaggggacttcagacccaccctcacccttactgctgccatcccctggagggtggaaggcaatcactgagaagcctccaggtggtcatgaggaggccgaggaagaccaccaaggagtggggttgagaggcgaggagaaaccagctggacataggacatcccccgtggccaaaatttcgcccggggccacactgccagaatcaagggctcccgatatgagccctcagcgaatatccaatcagttacatgggactattgcggtggtcagacccgggagccaggcctgtcccgcagatcgcggtccagcgaacggaactcctccgcctctgcccgctaggtcgagccccccttcccccgcatatgaacggggactaagcctggacagctttttgagggccagcaggccctccgccatgacgcacgaggccccaaagctctcccccaaagtggatcgactgtgtctcctaaacaggcctctgagcctccatctgcagagccctcattcgagcccattggcccctgctgcggccccatccgaccccagactccaggacctcaaggcacgggaggcagaggcatgggaagaacccactgagctcctaggcctcccctctgcacttgctgggatgcaagacctcagacttgaaggcgctttgcacttacttctggcccagcagcaactgcgcgcccgggcgcgcgcaggatcggtgagacccaggggccagcccacgcccggcgagatgctgccaagcttgcccgtgggctccgactccgagggtccagaaaatgaaggaaccagggccgctctcgctgccgccggactcagtggaggtaggcatacccagcctgcggggccaggacgcgctcagcggacagaggccgcggccacacaggattgcgctctggacaagcccctggacctctccgagtgggggagggccaggggccaggatactcctaagccagcaggccaacatggctctctgtcaccagccgccgcacacaccgcatcgccagagccgcctactcagagcgggcctttgactcgatccccccaggccctctccaacggcacaaagggcaccagagtgccggaacaggaggaggcctcaacacccatggaccctagcaggccgctcccagggagtcagctctccttgtcaagtccagggtctacggaagatgaggacaccggcagacccctgccccctccacacccacaaccaccaccacatccacaaccacctgacttagatgggcatccagaaccgagtaaggcggaagtgcttcgtccagagagcgacgagcttgatgaaaccgacaccccaggcagcgaagtgggactttcatcacaggcggaggctacaactagcacaacaggcgagggaccagagtgcatttgcacccaggagcacggccagggccctcctcgaaagcgaaagcgcgcctcagagcctggcgataaggcctcaaaaaaaccttctcggggacgtcggaagctgactgccacagaggggcctggaagtccccgggatgccgaagatcacagcccctccccaaactcctcaccttgggaggaaacctag

SEQ ID NO: 45449 - DNA, 1719 bp, Artificial Sequence
  Description of Artificial Sequence: Synthetic coding sequence
atgcggcggcacatggtgacctacgcctggcagctgctgaagaaggagctcggactgtaccaactggctatggacatcattattatgatccgcgtgtgcaagatgtttagacaggggttgaggggcttcagagagtaccaaatcatagagacggcacattggaaacacccaatcttttccttttgggataaaaaaatgcaatctcgggtgacttttgatacaatggactttatcgctgaggaagggcacttcccccccaaggccatccagatcatgcagaaaaagccctcatggcggactgaggacgagatccaggccgtgtgcaacattttacaggtgttagactcctacagaaattatgctgaacccctacagttgctgctggccaaggttatgaggtttgagcggtttggacggaggcgtgtgattatcaagaaaggccagaaggggaacagtttctacttcatttatctgggaactgtcgcgatcaccaaagacgaggacggctcctcggcattccttgatccacaccctaagttgttgcataagggatcatgtttcggtgagatggatgtgttacacgcatcagtccgcaggagtactattgtgtgcatggaggagacagaatttctggtggtggaccgggaagacttcttcgccaataagcttgatcaggaggttcagaaggatgcacagtatagattcgagtttttcagaaaaatggagctgtttgcgtcatggtcagatgaaaagctgtggcagctcgtcgccatggctaagatcgaaagatttagctacggtcaactgatttcaaaggactttggcgaaagcccttttataatgtttatcagcaagggctcctgtgaagtgctgagactgctcgatctgggagcctctccatcttacagaagatggatctggcagcaccttgaactaatcgacggacggccgctcaaaacccatctttcagagtattcacccatggaaaggttcaaggagttccagatcaaatcctaccccctacaagacttcagcagtctgaagcttccgcacctgaagaaagcgtggggactgcagggaactagcttcagccgtaagattcggacctctggggatactcttcctaaaatgctggggcccaagatccaaagtaggccggcccagagtattaaatgtgcgatgatcaatattaaaccaggagagctgcccaaggaggccgcggtgggggcctacgtgaaggtacacactgttgagcagggcgagattttagcttttttgcctgagggcgagtgtgacacacgccccttgatccttatgagcctagggaatgagctgatacgcatccggaaagaaatattttatgagctcatagacaacgacgacgaaatgattaaaaagctgctgaaattgaatatcgctttccccagcgacgaagatatgtgtcagaaatttttacagcagaactcctggaacatctttcgtaaagatttactgcagttgctggttgagccgtgccagtcccagctgtttactccaaatcgtccaaagaagcgcgagatttacaatcctaaatctgtggtgctggatttgtgcagcatcaataaaaccactaagcctaggtatcctatctttatggcaccgcagaagtatttgccgccccttaggattgtacaggcgattaaagcgcctaggtataaaatcagagaattgttagcctag

SEQ ID NO: 45450 - DNA, 1731 bp, Artificial Sequence
  Description of Artificial Sequence: Synthetic coding sequence
atgcggcggcacatggtgacctacgcctggcagctgctgaagaaggagctcggcctgtatcagctggccatggacatcattatcatgattagggtgtgtaaaatgttcaggcaaggcttgaggggctttcgagagtaccagatcattgagaccgcccactggaagcatcccatatttagtttctgggacaagaagatgcagtcacgggtcacctttgatacaatggatttcatcgccgaagaggggcactttccccccaaggcaattcagattatgcaaaagaagccaagttggcgaacagaggacgagatccaagcggtctgcaatatcttacaggtgttagactcatatcgcaactatgccgagcccttacaactcttattagccaaggtgatgcggtttgagcggtttggtcggagaagggtgattattaagaaagggcagaaaggcaacagcttctactttatctatttgggaacggtggcaattacgaaagacgaagacggctcttctgccttcctggatccacatcccaagcttcttcacaagggctcctgctttggtgagatggacgttctgcatgctagcgttagaaggtcaactattgtgtgcatggaggaaactgagtttcttgtggttgacagagaagattttttcgctaataagctggaccaggaagtgcagaaggatgcgcaatacagattcgagtttttcaggaaaatggagctcttcgcctcatggtctgacgaaaagctgtggcaacttgtagccatggccaagatagaaaggttctcatacggccaactcatcagcaaggacttcggggagtcacctttcatcatgttcatatctaaaggatcttgtgaggtcctgcgactgttggacctgggcgcgagtccctcctatcgccggtggatttggcaacatctggagctaattgatggacggcctctgaagacccatctctccgaatatagtccaatggagcgattcaaagagttccagatcaagagttacccactccaggacttctcaagcctgaagttgccacacctgaagaaggcttggggtctgcagggaacaagtttcagccgaaaaatcagaacttcgggcgataccttgccgaaaatgctagggcctaagattcaatcaaggccggcacaaagtattaaatgtgcgatgattaacattaagcccggagagctccctaaagaagccgctgtgggcgcctacgtaaaagtccacaccgtggaacaaggggagatcctaggactgcaccaggcctttttaccagaaggtgagtgtgacacgcggccattgatcctgatgtccctgggcaacgagctgattcgcatccgcaaagagatcttttacgaactgattgacaatgatgatgaaatgatcaagaagctcctgaaattgaacatcgcgtttcccagtgacgaggacatgtgccagaagttcctgcagcagaactcgtggaacatcttccgcaaggatttgcttcagctcctggtggaaccgtgccagtcccagctattcacgccgaacagaccgaagaaacgtgaaatttataacccgaagagtgttgtcctggatttgtgcagtataaataagaccaccaagccaagataccccatatttatggcccctcagaaatatttgccaccactgcggattgtgcaagcaattaaagcgcctcgttataagattagggaattgctggcatag

SEQ ID NO: 45451 - DNA, 1272 bp, Artificial Sequence
  Description of Artificial Sequence: Synthetic coding sequence
atgcggcggcacatggtgacctacgcctggcagctgctgaagaaggaattgggcctctaccaactggccatggacatcataatcatgattagggtttgtaaaatgtttaggcagggcctgagaggattccgcgagtaccagataatcgagactgcacactggaagcatccgatctttagcttttgggataaaaaaatgcagtcccgggtgactttcgataccatggactttattgcagaggaaggccactttcctccaaaagctatccagatcatgcagaagaaacccagttggcgcactgaggacgaaatccaagctgtgtgtaatatactgcaggttcttgattcctatcgcaattacgccgagcctctccaacttttactcgctaaggtcatgagatttgagagattcgggagacggagggtgatcataaagaaaggccagaagggtaactcgttctacttcatctatttggggaccgtcgctattaccaaggacgaggatgggagttcagcatttctggacccacaccctaaactcctgcacaagggctcatgcttcggtgaaatggacgtgttacacgcatcggtgaggcggagcacaatcgtgtgtatggaggaaacagaatttctcgtggtggacagggaggactttttcgctaacaaactggatcaggaagtgcagaaggatgcacagtacaggtttgagttttttaggaaaatggaactgtttgcatcctggtctgatgaaaaattatggcagctggtggccatggccaagatcgaaaggtttagctacggtcagctgatatctaaagacttcggtgagtccccattcatcatgttcatttccaagggctcatgtgaggtgctgcggttgttagatctgggggcctccccatcctacagaaggtggatttggcagcatctggagttaattgatggccggccacttaagactcacctgagcgaatactcccctatggagcggtttaaagagtttcagatcaagtcctatcctctgcaagatttctctagtctgaagctccctcacctcaagaaagcctgggggctgcagggcactagcttctccagaaagatccgtacctccggtgacacactgccaaagatgctgggacccaaaatacaaagtcggcctgcccagtcaataaaatgtgccatgattaacattaagcccggtgagttgcctaaagaggccgccgtgggagcctacgtcaaggtgcacacagtggagcagggagaaattctttag

SEQ ID NO: 45452 - DNA, 1302 bp, Artificial Sequence
  Description of Artificial Sequence: Synthetic coding sequence
atggagtacgaggtgaagaagggcaagaagggcttcgtgagccccattaggcgcctggtgttccccaaggccggacggagagcggcatgtagaagctctgtgtccaggagaccccttcacagcatgcccctttacccacccgattacctgatcgacccccagattttgctgtgtgactatctcgaaaaggaggtcaagtttctgggccacctgacatgggtgacgtccagcttgaatccgtccagcagggacgagctgctgcagctgctggacaccgcccgtcaactaaaggagctgccgctcaaaacgacagcggaacaggacagtatcctgtctttgagtgctagatgcctgctcttgacctggcgtgataacgaagagttgatccttcgcatccctacacatgagattgccgcagccagctacctccaggacgatgctttgcacctgctggttcttaaaaccgggctgggcgtggatccagtccctgctggagtggatgcaagtcccgggggcgctggccgagaccctggcccacctggtggcgctcccgaaaaaaggcgtgtcggcactgccgagcgaaggcacactatttgcagtctcgattggaggatgggatgggggggcggggcagccgaagctcgggctggcggcggcggagggggatctctcgaacgacagagagcaggagccagagcttctgggtcatgggaacgtcggcagacattcagcggatcctgggaaaggcggcacggcggaggcggaggagggggcggagccggcaagccaggaggtagctgggagagaagacaggcaggatctggcggaggtggtagttgggagaggcgtcatcctggccccaaccccttggaccctcaggatcccagccctgatgcgtactgtaatctggtgattctcgctgtcgctaaccgggacgcagcagaagagtcatgtgccctgatatgtcaggtgttccagatcatttatggtgatcagtcaatcgagtgtgtggatagagctggctaccactatacttccacgcccgagcgcccctggttgtgttctaggatcatggcccctcgtaccccactgaaacatgttacagcggcgcgcccccatctgctcagcatggcgcctacagccgcagccgcgaccactgctgtgtgggcatggtcaagctaccggataacctggtcgagatgcggggttagctggggaccaagccgatcatcatccttgcggtgttgttgtggtagcactggatggggctgtccctcacgaacgatcgctcaagcctgttag

SEQ ID NO: 45453 - DNA, 1716 bp, Artificial Sequence
  Description of Artificial Sequence: Synthetic coding sequence
atggagtacgaggtgaagaagggcaagaagggcttcgtgagccccattcgccgcctggtttttcccaaggcaggacggcgggcagcctgccgatccagtgtctcccgccggcctctacacagcatgccgctctacccccctgattatctcatagatcctcaaatcctactctgcgattatttggagaaggaggttaaattcctgggccatctcacgtgggtcactagctctctgaaccccagctctcgggacgagctcctgcagctgttggacactgcccgccagttaaaggagctgccattaaagactaccgctgaacaggattctattctctcacttagcgcccgctgcctcctcctcacatggagggataatgaagagttaatcctgcgaattcccactcatgagatcgctgcagccagctacctacaagatgatgctctccacctgctggtgctgaagaccggcctgggggtggacccagtgcccgcaggagtggatgcctcacccgggggagccggaagggacccaggccctcccggcggcgccccagagaaaagacgggtgggaactgccgagcggcgacacacaatctgttcattagactggcgcatgggttggggcgggggtgctgccgaggctagggccggcggcggagggggtggctcgctcgagcggcagagggctggcgccagagccagcggcagctgggaacggcgacaaacgtttagtgggtcctgggaacggcgccacggtgggggcggagggggtggcggggccggcaagcctggtggctcttgggaaaggcgacaggctggctccggaggaggaggctcttgggaaaggcgacaccctggccccaatcctttggacccccaggaccccagtcctgacgcgtattgtaatctggtgatcctggctgttgctaatagggatgcagccgaagagtcttgcgcacttatctgccaggttttccagattatttacggcgaccagtccatcgaatgcgtggaccgggccggttatcactacacgtccacaccggagaggccttggctctgctcacgctccgaatcctgtcacaccgacggaacctacgcttatgatgcagacttttcctgctgctctagtttcaacggtagtcaagacacctttgaagcctgctattccggcacgtccacccccagcttccatgggtctcactgctccggctccgatcacagcagcctgggattggagcaactgcaggactacatggtcacactgcgatctaagcttggaccactagagattcagcaatttgctatgttactgcgggagtataggctggggcttcctatccaagactattgtacgggcctcctgaaactgtacggcgacaggcgcaagttcctacttttgggcatgagaccctttattcccgaccaagacatcggttactttgaaggctttctagaaggggtgggcattcgcgagggaggcatcttgacagactcgttcgggagaattaaacggtcaatgtcctcaaccagcgccagcgctgtgaggtcctatgacggcgcagctcagcggcctgaggcccaggcttttcataggttgctagcagatattacgcatgacatcgaggccctggctcccgatgacgacgatgacgacgaggatgagccgagagggtcaagaggcgggtccgacgcagcagaagataactatctgtag

SEQ ID NO: 45454 - DNA, 708 bp, Artificial Sequence
  Description of Artificial Sequence: Synthetic coding sequence
atggagtacgaggtgaagaagggcaagaagggcttcgtgagccccataagacgccttgtgttccccaaagcgggacggagggcagcctgccggagttctgtgtcaaggaggcccttgcactccatgccgctatatcctcccgattacctgatagaccctcagatcttactctgtgattacctcgaaaaagaggtgaagttcctcggccacctgacttgggtcacatctagcttaaacccctcctcccgggacgagttactgcagttactagacactgctcggcagctaaaagaactgcccctgaagaccacagcggaacaggattcaattttatcattgagcgcccggtgcctgctgctcacttggcgtgacaatgaagaacttattctgcgcatccctacgcacgagattgcggctgcaagctacttgcaagatgatgccttacacttactcgttctcaagactggactgggagtcgacccagtgcctgccggagtagatgcttcaccagggggcgctggccgagatcccgggccgccaggtggcgcccccgaaaagagacgtgtcggaaccgcagagagacggcacaccatctgttccctcgattggcgtatgggctggggcggaggtgctgcagaagctccgacaagatctactcggcgaacgcctgctcctacccccaccgctacatggtccagctggctgtag

SEQ ID NO: 45455 - DNA, 975 bp, Artificial Sequence
  Description of Artificial Sequence: Synthetic coding sequence
gagcggcggcacggcggcggcggcggcggcggcggcgccggcaagcctggcgggtcctgggagaggcgccaggccggctcaggggggggtggcagttgggagagaaggcacccagggcctaatccattggacccccaagacccgtctcccgacgcctattgcaacctggtgattttggcagtggcaaaccgtgacgcagccgaagagtcatgtgccctcatctgtcaggtcttccaaatcatctacggcgatcaaagtatcgaatgtgttgaccgcgccggctatcactatacctccactcccgagcgtccctggctgtgcagtcgctctgagagctgccacactgatggcacatacgcatatgatgctgatttcagttgttgtagctctttcaacggcagtcaggacacattcgaagcatgctactccggtacgtcaacaccatcatttcacggttcacactgctctgggtctgaccactcgtccctgggcttggaacagctgcaggactatatggtgactttgaggagtaaacttggccctttagagatccagcaatttgcaatgttactgagagagtaccgcctgggactcccaatccaggattactgcactggcctgctcaaactctatggcgatcgtaggaagtttttgcttcttggcatgaggccatttatccctgatcaggacataggatacttcgagggattcctggagggcgtggggatcagagaggggggcatactcaccgactcctttggaagaatcaaaagaagtatgagtagtacctccgcttctgccgtgcgatcttacgatggagctgcgcagagacctgaagcccaggcttttcaccgcctcttggctgatatcacccacgacatagaagcactcgccccagacgatgatgacgatgacgaggacgagccacgggggagccggggcgggagcgacgcagctgaggacaattatttatag

SEQ ID NO: 45456 - DNA, 300 bp, Artificial Sequence
  Description of Artificial Sequence: Synthetic coding sequence
atggacaccggcagccgggaggccgccttcacccgggacctgcccaggaagccggctgacgcgcaagtgtccccggagatgagcattacacacaaggagaaagagaatgcccatttgaaggaaatcctgctgtttgttaacgccgaggccttttcgcagccccaacctcacagtgcaccggtttgcgaagggcagcagctcaccggtaaattttcgacatcagtgcttacacgggcaggcggggatgcgtccccttgctcctgggagaggctgctctgttatgggtggtcccactgctag

SEQ ID NO: 45457 - DNA, 300 bp, Artificial Sequence
  Description of Artificial Sequence: Synthetic coding sequence
atggacaccggcagccgggaggccgccttcacccgggacctgcccagaaaacctgcggatgctcaggtttcccccgagatgtcaatcactcacaaagagaaagagaacgcacatctgaaagaaattctgctgttcgtcaatgccgaggcattcagccagccacagcctcacagcgctccagtctgcgagggtcaacaattgacaggaaaattctccacctcagtgctcacacgtgctggtggcgatgcttctccttgtagttgggaacgcttgttgtgctacggctggtcgcattgctag

SEQ ID NO: 45458 - DNA, 354 bp, Artificial Sequence
  Description of Artificial Sequence: Synthetic coding sequence
atgcccagctgcagctgcgccctgatggccccctgcggccccgccgctggacccgccgccgtcgaacgcacacagcaagtcgccaggggcgaacctggctccgctaggggccaactacaagtatctccagagatgtccatcacacacaaggagaaggagaacgcacacctgaaagagattctgctgttcgtcaatgctgaggcattttcacaaccgcagccgcacagtgcacccgtatgtgagggtcagcagctgactggaaagttttccacttctgtgctgacccgtgccgggggcgatgcgtctccatgctcctgggaacgacttctgtgctatgggtggtcccattgctag

SEQ ID NO: 45459 - DNA, 450 bp, Artificial Sequence
  Description of Artificial Sequence: Synthetic coding sequence
atgctgagcggcccccaccccagccccaccttccggcccaacccctgcccatggccttgcctgcactcactatggatggaaatctctcctactcagttgtgctttctgagccccgggccatcccctcagagtcctagttgttgcttccagggcatgaattccggatccgaactcggaaagttgtggcggaaattgttcaaaggtattccccgcctgtccgtgagccatttcgatttctactgcggtacttgtgttttacttggtcgacctcagatcccccaggggtcatctctgggcaacgatattgatcagtatccagtagtgttcagaaacgctagcgatcagggctcatggatgcagctggaaatgctgttgagaaagctgagcgacctggtctggaccagcgacgcgttatccgataaaattctcgaggacgggctagtgccctag

SEQ ID NO: 45460 - DNA, 609 bp, Artificial Sequence
  Description of Artificial Sequence: Synthetic coding sequence
atgaagcggtggcagatcttcgtgctgtgggtgttctgggtgctgattttgtggctgatgactccttacctggatctgaccccagaatccgccccacaggagaaacgtatgtacctggtgccacagcattgcgattgtccttggttctcttccggcaaatgtgggtgtccctcggagaccctgaactgttcctcctgccatcacacagccgacgagtggaattggctggacgcatgtagtagaaaaaccatggggtacctgatgcgaactcgcgaaagcatgacttccgatacagtgctctggtggttggggatgaattcaggcagtgagctgggaaagttatggaggaagctcttcaaaggcattccacggctctctgtctctcactttgacttctactgtggcacctgcgtcttgctggggcgtccacagatccctcaaggcagctcactgggaaacgatattgatcagtatccggttgtctttcggaacgcaagtgaccaaggctcgtggatgcagctggagatgctgctgagaaagttaagcgacttggtgtggacatcagatgcgctctcagataagatacttgaggacggccttgtgccctag

SEQ ID NO: 45461 - DNA, 1152 bp, Artificial Sequence
  Description of Artificial Sequence: Synthetic coding sequence
atgaacgccggccccagctggaacaaggtgcagcacagcaagaactccagcggtaaacggcaaagcaaatctcaggttcctcacgcttctagccagccccgaagtagtcttaccgccgtgacgcagccaacagaggaaaagctgaaagaaagcatctctccagaagcacgtcgaaagagaaaccctctaggcagtcgttgtcaaggggcatcgggcaacaaattatttctcgattttcaatcaatgaagatcataaaagaaaacgcggatgaggactccgccagtgatttgagtgacagtgagcggatacccatcccgccgagtcccttaacccctcccgacctgaatctcagagctgaagagatagacccagtctattttgatctgcaccccggacagggacacacaaagccagaatactattatcctaactttctcccctctccatttagttcttgggatctgagagacatggcgttgctccttaacgctgaaaataaaacagaagccgtaccccgagtcgggggccttctcggaaagtacatcgatcggctcatacagctggaatggctacaagtacagaccgttcagtgcgagaaagctaagggaggaaaggctcgcccaccgactgctccgggcacctccggggccttgaaaagtcctggcaggagcaaacttatcgcctctgccttgagtaaacccctgccgcatcaagagggagcgagcaaaagtggaccttcacggaaaaaagcctttcaccacgaagaaatccaccccagtcattacgcttttgagaccagcccgcgacccatcgacgtgttgggcggcacccgattctgctctcagagacaaactctggaaatgaggacagaagagaaaaaaaagaagtctagcaaaagtacgaagctgcagcgatgggatctatccggaagtggctcaagctcgaaggtcgagacatctggccacattcgtgtgcccaagcaggccgccgttatccttgacagcgcagactcctgtaaggcctccaagactcaggcacatgcgcatccacgtaagaaaggaaaggcagagagctgcggccacgccaccgtaagctcagaaaagaagttaaaaaccaacggggttaagcagaacacgtacaagcttaaatag

SEQ ID NO: 45462 - DNA, 1152 bp, Artificial Sequence
  Description of Artificial Sequence: Synthetic coding sequence
atgaacgccggccccagctggaacaaggtgcagcacagcaagaactcgtctgggaaacgacagtcgaagtctcaggtgcctcatgcttcctcccagccacggtcctctctcaccgccgttacacagcctaccgaggagaaacttaaagaatcaatttccccagaggcccggaggaagagaaacccactggggagcagatgtcagggcgcatcaggcaataaactctttctggacttccagtccatgaagattataaaagagaacgctgatgaggattccgcctccgacttaagcgactctgaacggattcctattccgccttccccccttaccccacccgacctcaaccttagggctgaggaaatagatcccgtctattttgacttgcaccctggccaggggcacactaagcccgaatattactaccccaatttcctgcccagccccttctcttcctgggacctgcgcgacatggctctgctcctgaacgcagagaataaaaccgaggccgtgcctcgcgtagggggccttctaggcaaatatattgatagactgattcagctcgagtggttgcaagtccagacagttcaatgcgaaaaagctaagggaggcaaagcccggccccccacagccccaggtacctcaggtgccctcaagagcccaggcagatctaaactcatagcttccgctctcagcaaacctctccctcatcaggagggagcatctaaatcaggaccgtccaggaagaaagcctttcatcatgaggagatccatccgtcacactatgccttcgaaacctccccacgaccaatagacgtgctgggtgggacacgcttctgtagtcagcggcagactctggaaatgagaacggaggaaaagaagaaaaaatcctcaaagagcacaaaacttcagcgctgggacctctcaggcagcgggagttcctctaaagttgaaacatctggccacattagagtccccaagcaggctgccgtgatcctggactctgccgatagttgtaaggcatcgaaaacacaggcccacgcgcatccacgcaaaaagggtaaggccgaaagttgtggacacgcgactgtgtcctctgagaagaagctcaagactaacggggtgaagcagaacacatataagttaaaatag

SEQ ID NO: 45463 - DNA, 147 bp, Artificial Sequence
  Description of Artificial Sequence: Synthetic coding sequence
atgaacgccggccccagctggaacaaggtgcagcacagcaagaacagttctgggaagcgccagagtaagagccaggtgcctcacgccagtagccaacctagatcctccctgacggccgtgacacaacccacggaagaaaagctgtag

SEQ ID NO: 45464 - DNA, 153 bp, Artificial Sequence
  Description of Artificial Sequence: Synthetic coding sequence
atggacatcctgctggacctgggctggcacttcagcaactgcgacgaagatactttctattcgccggttcagaacactgaaggcgaccttctgttctttgatcacaacctcaaaaccgacagggggcatgtcgagagatcagttatggactag

SEQ ID NO: 45465 - DNA, 126 bp, Artificial Sequence
  Description of Artificial Sequence: Synthetic coding sequence
gacctgggctggcacttcagcaactgcgacgaggacaccttctactctccagtccagaataccgaaggcgacctcctcttttttgatcataatctgaaaaccgaccgggggcatgtcgagaggtag

SEQ ID NO: 45466 - DNA, 957 bp, Artificial Sequence
  Description of Artificial Sequence: Synthetic coding sequence
atgagcacccacgtggccggcctgggcctggacaagatgaagctgggaaacccacagagctttctcgaccaggaagaagctgacgaccaacagcttttagagcccgaagcatggaaaacctacaccgaacggcggaatgctttgagagaattcctgacctctgacttgagtccccatcttttgaaacgccatcacgcccgaatgcagttgctcaggaaatgctcctattatatcgaagtactgcctaagcacttggctttaggcgaccagaaccctctggttctgcctagtgcgctctttcagcttatcgacccttggaaatttcaacggatgaagaaagtgggtacggcccaaactaaaattcagctgctgttacttggtgacttgttagaacaacttgaccatggcagagcagagctggacgccctgttgcggagtcctgatcctagaccttttttggccgactgggccctggtcgagcggagactggctgatgttagtgctgttatggactctttcttgactatgatggtgccaggccgcctacacgtgaagcacagacttgttagcgatgtgtcagcaacgaagatcccacatatatggcttatgctctcgacaaagatgccagtggtctttgacaggaaggcaagcgccgcccaccaagattgggccaggctaagatggtttgtgacaatccaacccgcgacatcggagcaatatgagctcaggttccggctgctagatccccgaacacaacaggagtgtgcccagtgtggtgtcatccccgtggccgcgtgtacattcgacgttcggaaccttttgcctaaccgctcctacaaattcacgataaaaagagccgaaacttctactttggtgtacgagccctggcgggactccctgaccctccatacaaagcctgagccactggagggccctgccctgagtcattctgtgtag

SEQ ID NO: 45467 - DNA, 957 bp, Artificial Sequence
  Description of Artificial Sequence: Synthetic coding sequence
atgagcacccacgtggccggcctgggcctggacaagatgaagctgggcaacccacagtcctttctcgaccaggaagaggcagacgaccagcagctcctcgagcccgaagcgtggaaaacctataccgagcgccgcaacgccctgcgggagttcttgaccagtgacctgagcccacatctgctgaagcggcatcacgcccgaatgcagctgttgagaaaatgctcatactatattgaagtcttgccaaaacacttggccctcggcgatcaaaacccgctcgtcctgcccagcgccctgttccaactgatcgacccttggaagttccagcggatgaagaaggtgggcactgcacagacaaagattcagctcttgttattaggggatctgctagaacagctggaccacggccgagctgaactggacgcgttattacgttcacccgatccacgacccttccttgccgactgggccctcgtggagcgaagactggctgatgtctctgccgttatggactcattcctgactatgatggtacccggcagacttcacgtgaagcacaggctcgtgagtgatgtcagtgccaccaagatcccccacatttggttaatgctgagcactaagatgcctgttgttttcgacagaaaagcatccgccgcgcatcaggattgggccagacttcgttggtttgtcaccatccaacctgcaaccagcgagcaatatgaattgagattcagactgctggatccgaggacacagcaggaatgtgctcagtgcggagttatccccgttgccgcttgtaccttcgacgtgcgcaacttgcttcctaatagatcttacaagtttaccatcaagagggccgagaccagtaccctggtttatgagccttggcgcgatagtctcacattgcacactaaacccgaaccacttgaaggacccgctctgtcccactctgtatag

SEQ ID NO: 45468 - DNA, 618 bp, Artificial Sequence
  Description of Artificial Sequence: Synthetic coding sequence
atggccgcccgggacgccaccagcggcagcctgagcgaggagagctctgctcttgaccttccatctgcatgtgatatcagggactacgtcttgcaggggccctcacaggaggctaattctgaagctttcagctccctagagttccactcttttccctattctagcgacgttgatccagacacctccaacctcaacatagagcagaataatagctggaccgccgaaaatttctggctagaccctgcagtaaagggccagtccgagaaggaggaggacgatggcctccgcaaatcactggacagattctatgaaatgtttgggcatccccagcccggcagcgctaacagtctctctgcctcagtttgtaagtgcctcagtcagaaaatcactcagctgcgcgggcaggagagccaaaagtacgctctaagatcatttcaaatggcccgtgtaatcttcaatcgggacggatgttccgtcctccagcgtcactcccgggacactcacttctatcctctcgaggagggttctacctcactggacgacgaaaaacctaatcccggcttgagcaaggatattactcactttctactacagcaaaacgtgatgaaagacctgtag

SEQ ID NO: 45469 - DNA, 456 bp, Artificial Sequence
  Description of Artificial Sequence: Synthetic coding sequence
atggccgcccgggacgccaccagcggcagcctgagcgaggagagcagcgcacttgacctgccttccgcatgcgatatccgcgactatgtgttacaggggccttctcaggaggcaaatagtgaggccttttcctccttggagtttcattccttcccatactcgtctgatgttgatcctgatacctcgaacctcaacatagagcagaacaactcctggactgccgaaaacttttggcttgatccagccgtgaaagggcagtctgagaaggaggaggatgatggactccggaagtctctagacagattttacgaaatgtttggccaccctcagccaggctcagctaactccttgtctgcgagcgtgtgcaagtgtctttcacagaaaattactcaactgcgggggcaggagagccaaaagtatgccctgcgacagcagaacgtgatgaaagacttatag

SEQ ID NO: 45470 - DNA, 189 bp, Artificial Sequence
  Description of Artificial Sequence: Synthetic coding sequence
atggccgcccgggacgccaccagcggcagcctgagcgaggagagcagtgcgcttgatcttccctccgcttgtgacatccgtgattatgtactccaagggccaagccaggaagcgaactcggaggccttctcttcactggagttccactcttttccttacagcagtgacgttgatccggccgatctgtag

SEQ ID NO: 45471 - DNA, 603 bp, Artificial Sequence
  Description of Artificial Sequence: Synthetic coding sequence
atggagagccacagctgcagccccagctggagcaccatgaccatctccgcacactgtaatctgcggctgccgtctgcctctcaaagcgtaggcatcactggcgtgagccaccacatatggcctcggatcttttatatgacaatggctgcaagggatgccacttccggaagtctctctgaagagtcaagtgcactggacctgcccagcgcttgcgatatccgggactacgtcctacagggaccatcacaggaagcgaactctgaggctttctcaagtttggagttccacagcttcccatactctagtgatgtggaccccgatactagtaacctcaacatcgaacaaaataatagttggaccgcggaaaacttttggctagatccggcggtgaaaggccagtctgagaaggaagaggatgacggcctgcgcaaatcgttagaccgcttttatgagatgtttggccaccctcagcctggctcagccaacagccttagcgcatctgtgtgcaagtgcttgagtcaaaaaattactcagcttaggggacaagaatcgcaaaagtacgcacttcgttcctttcagatggccagggtgatctttaactag

SEQ ID NO: 45472 - DNA, 366 bp, Artificial Sequence
  Description of Artificial Sequence: Synthetic coding sequence
atggccgcccgggacgccaccagcggcagcctgagcgaggagagctcggctcttgacttaccctcagcttgcgacatccgcgactacgtgctccagggacccagccaggaggcaaactccgaggcatttagttccctggagttccacagctttccctactctagcgatgtggatcctgacacttctaacctgaatatagagcaaaataattcctggacagcagagaacttctggctcgatcccgctgtgaaagggcaaagcgagaaggaagaggatgatggcttaagaaagtccctcgacagattttacgagatgttcgggcatccccagcccggctctgcgaactccctctctgcttctgtgtag

SEQ ID NO: 45473 - DNA, 321 bp, Artificial Sequence
  Description of Artificial Sequence: Synthetic coding sequence
atggaggtgtgcagctgctgccccggctggagcgccaccgtgagcgctcactgcaatcttagattcgctagctctacaagccagagcgcaggaatcaccgggatgtctcaatgtgcttggccaactttcaccttcctcaccatggccgccagagatgcaacctccggatcgctgtctgaggagagtagtgcgctcgatctgccaagcgcctgcgacattcgagactacgtgctgcaggggccaagccaggaagccaattccgaagcgttctcttcgcttgaatttcacagctttccctactcgtccgacgtcgatccttag

SEQ ID NO: 45474 - DNA, 381 bp, Artificial Sequence
  Description of Artificial Sequence: Synthetic coding sequence
atggtggccctgttccagcacagcccctactggcaggccgacggctacggccactcacatcgacttaagtgtcagcactttaaacaacacaggcagtacaacgacaagctggagatatctagcaatctgggtcctcagtttaatgcactgctgaacatcctcttaaacatcgtgcacccaaccttatcccatgataccaggcggtccaaggggttaaagatcgagggcctgcttcagagccgagagctggggaactcatggacagtgacaatgtgcatttgggtccttaaagcactgcaaagcagcgctccaaacaaacctctcgattggctggatcccatgccatgtttccagaatctcttggcccgcggtaccccttag

SEQ ID NO: 45475 - DNA, 723 bp, Artificial Sequence
  Description of Artificial Sequence: Synthetic coding sequence
atgcccccccccgccaaggagggcggccggaagggcccccgggagcgatcgggcaaaagtgcccctggcacagcccagggcgaagaacgggccaaaggagcccctgctactgagccccctaagcccggctgggcgctcacccctcaaggcctggcagccatgctgcccgcacaaaggcatagacatctgctatttggcgacttgcttgaagacgtcggggcggcagcctcaacctttccatgtggtagcgtggagcccgggtatagaatgcccgaccctcgtccatggacgcaatcgttagaactgccggccgagaggcaaaatcgactcttaggcgtccttaaagctgcagaggccagaggtagggtgagggccttaagactccgctacacccggatgcgcgccgaggagatcgcattgctaattcaaaggcaaaaaagcgcccgcgctgccattaggctggaactgtttctgccacctcagctgaaaccagcaaggatccctgacccacttgatcggcaggaagtgcagacctcaccgggccgggggggcgaacgcgggggcgctttgccagcaagcgcccacgccggacctcaaccactctctccagcagccgaggctcggggtgaccacccgggcggggagcgtggctggcatcatttgccagccgtgaccgcaacggagtcagtgcggagggctcccgcctcccacatcaagttgtag

SEQ ID NO: 45476 - DNA, 369 bp, Artificial Sequence
  Description of Artificial Sequence: Synthetic coding sequence
atgtacaagagcaagatcccccgggcccagaaccaggtgagcgtgaaggttaccccgaagaacactgagatgaagatcgcagaagaaccttctcctagcctcggacagacactagaatggctgcgtaaggaactgagcgagatgcagattcaggaccagtctctacttctgacattgcgccacctacatagcgtactcgaggagctgcgcgccgactcagctcattgggaagacgctcgatcctcaggcggaacgagtcctatacgcgctcgtgccggttctgaggggcgagggtgtcaacctgtctgttcccggggccttgcccagttgctgagaggagaggactctcgacgtagctcactgccttag

SEQ ID NO: 45477 - DNA, 3714 bp, Artificial Sequence
  Description of Artificial Sequence: Synthetic coding sequence
atgagcgtgctgaccagcccccggggcaaggtggaggtggtgcactgtaggagaaccgaatcacaggatgtctattgtataaaatctctcattcggaaatttacatgtaagctgtttggcaagctgaacatcatttaccttctcgaaaaagccaatctggccgtcactctgtgcaatgataaggaagagattatggcccaagcaacctttctggactatcctaactggaacgtcgcgaagcaggatgactgggtaagtgtgtttcgggaactagattccgatatcccctgcactccccttaataccttgtttatgcacttgtttgtagcagtggatgaatactctgtgggctgttgtaaggaaatcctacgcactgtatacaaagcagtaccagagttacacttcatctttctaattgtgccatcatacatgagtcttggttccaccctgattacggtgtttgatcaggtcggtaacataccgtgcctcacttatgaggaggacttcgcagttcacatctgtcatcgtcatagtcactatccacagcttcacgtgcgcaaggcccgggtggaggaccatgatgatttgatgccaatttttatgaggtatgacacaatcctgaaggaaacctacggcgagtacttccttgccgagctcatcgaagcccaggacgaggaaaaccacgctgttgtctgcgaagttgagggcacagccgtcggatttatgtcagtctgcagtcgggtcaatatgcaattgcttcatgaatgcttcgatttaggaccattccacggcctctgcttcccacatcccgacgatgtcctggagagcccccaggacctctccgtgagaagatcacaagacgctgagctcagatcctcaagtcagggcagtcagaaaatcgtcgaggaactgcaggaacccgtgtcccctgatacaatggaaaatattcagggaaatatcgccagggaagctgcttcagaagaagctttaacagcagtgcagagtggaaatgtgtctgaacccgaggacattgagaagctttccgacatctcaacaggttatgcacaataccaccacgtgtcttctcgctcactggcatctctcgtgttaccagaggagcctgtccacttccggccaatctatcgtggtgccagtgctgctttctgtatccaactgttctgtatcgatgaaaagtatgaagcccggtcactcgacttcatgaactttgtgttctccttgttttctgataagaacttctgtgtgattagtctacctcatctgacgccagagttctttctcatacagaacttcgtgaagatggtaccatttaacacctgcacattagagcaggacctgtatgtgtttcacagagctggtctattgaagagcattaacatccggtttgctacactgttggacacccctggggtcgagaatctcgtgagcaccctgatgcttaataagagcatcttagaagaccttgatcgttacaacaaggcccggaaggatccagacggaacactgcttcaagccttcgtggcagaagtggccgagcaaattgttggaatcgcagttatacggaatgaaatggatatcgagtatatcaggagccactacaacatcgaggactttatctacttttcacatcaccagagggaggaacacggacacatgcaccactttgctcttaaccctatcttccgacattatactaaattcttcctgaaagagatcctgcgactaggctttaagtcatgtctgtactatcgcgtgtatcccaagtctcgggaggggaaatttcagaatccttatgcacactctctcacgtcagcactgcactatctcgtgccggtgaggccgagacgacagatagtctatccgctggagaagctaggcattaacgcaccttctaaagccgtgagtaaggacccaatgagctacgccttgaaccatactaacaggaaactaacactcgagccgaagataacagttaacgccaagattatcgtggttggcgctagctccgtaggaatctctttcctcgagacactggtattttgttcacacatgaagttcaataacttgacactgatatccacacacggcctcccaggcaagaagctcctggacacggagcagcgcaagtttctggcaagcgatcattgtttcaatgacaaggactacgcattaatgtcactatgcagttgggtgaacgtggtggtcggacgaatgaccgggatcgacagggccgcgaaacatgtcgtcctctccactgacgagatcgtgccttatgatcatctgatcttatgcacgggtcagcagtaccaggtcccctgtccaactgaggccgacatatctcaacaccttacaaacagagaagtaccaaattcctctcagcgaagatatactggtaaggtcccatgcaaccattttacactcaacgaagaggaagactgttttaaagccctgatttggattaggaacaatagcattaccacggagggtaatataattgtctatgggaacactatcgatacttataccactgtggagactctcctgaatctcggcgtatccgggtctcggatccacctggtccagcccccacccgcctcaactattacttgcatcaacaactacagcgtggagagcgccgtggcggacgctcttggtgccgcaggggtaaccatgtatcgcgacgccattctggctcaatggaacgacggtttacaccccgatccaatttattctgcctcctttactacgccaaccaaaccgtttaggctgcagtgttcaatgttcttttccttctgcgaaaagaatgtggattacgagactttcaaggccttgaacgatgcatgcctggtgtacgatagtcgactcgtgatcgacactaattttcacaccaatgacattgcaataagggctgccgggtcactcactaaattttcaaatcggtactatagcaatgagtggacccattcgaacttttcaagtaaagagatcggcttccagctcgcggcagcaatgttacacttgtttgatcctacgctcgagcctgtgacggaaccgcctgccaacctcgatcggctgattcccatgtacaagggagcaaagattcagggcggaatactgcccgggtcctaccattatttgcacatagctaaacctgctattcccacccctctggaagtacagatggcccagccaaattacggactggaactggtcacaggctcagcaaagaacggaacttattttagaatccatattaacaagtacaaaatggtggaaaccattacatgtctgtctcgggaaccatttcctgcgagtaactatattcgtctctttggacagcatgagcagctacttaacaacctctgcgcccgctatgacgaaaatcttattacagatttgtatagttacttcacagagccctggtgtctggccctgttccacgacaggtttatcgatttgaggaaggaactaaggcagatcctggccagtaaagaggaggaggatcttccttccatcgagcagctcgctcatcagatagaggacgaagagatcaatccaacagagaagcctcgacagtatctgaaacgggtgttcgaagaaagtatatataaaaccctcgtagagaggtccaccttggactatttgcattacaaccgttatcatttacctatgtacgcttggccaggtatcgtgtag

SEQ ID NO: 45478 - DNA, 765 bp, Artificial Sequence
  Description of Artificial Sequence: Synthetic coding sequence
atgaacttcgtgttcagcctgttcagcgacaagaacttctgcgtgattagcttgccccatctgacacccgaattcttcctgatacagaattttgttaaaatggtgcctttcaatacatgcacactggaacaggacttgtatgttttccatagagctggtctcctgaaaagtattaacatccgattcgcgactttgctggatacgccaggtgtggaaaacttagtctctaccctgatgctcaataagagcatactggaggacctcgaccggtataataaggcgcggaaggaccctgacattgaatacatccgctcccattataatatcgaagactttatttactttagtcaccatcagcgggaggaacacgggcacatgcaccactttgctctgaaccctatatttagacattacaccaagtttttcctgaaagaaatcctccgcctcggatttaaatcatgtctttattatagggtctaccccaaatcgcgggagggaaagtttcagaacccatatgcccactccctcacatcagcactacattacctggttccagtgcgcccgcggcggcaaatcgtgtaccctttagagaaattaggcatcaacgcaccatcaaaggcagtgagcaaggaccccatgtcctacgccctaaaccatacaaaccggaaacttacccttgagcccaaaatcaccgtcaacgccaagatcatagtggtcggcgcctcaagtgtggggatctcatttctggaaaccctcgttttctag

SEQ ID NO: 45479 - DNA, 3534 bp, Artificial Sequence
  Description of Artificial Sequence: Synthetic coding sequence
atgagcgtgctgaccagcccccggggcaaggtggaggtggtgcactgtcgaaggacagagagccaagacgtatattgcatcaaaagtctgataagaaagttcacatgcaagctgtttgggaaactgaacatcatttacctgctggaaaaggcgaatttagcagtcactctgtgcaacgacaaggaagagatcatggcccaggccaccttcttggattatcctaattggaatgtagccaaacaagatgattgggtctcggtgtttcgggagcttgatagtgatataccgtgtacaccccttaacacgctatttatgcacctatttgtggccgtggacgaatatagtgtcgggtgttgcaaagagatcttgagaacagtttataaggccgtgcctgaactgcattttattttcctcatcgttccaagctatatgtcccttggctctactctgattacagtgtttgaccaagtgggtaatattccatgtctgacatatgaagaggactttgcggtccacatttgtcaccgccacagccattacccccagcttcacgttcgcaaagcacgagttgaggaccacgacgacttgatgccaatattcatgcggtatgacacaattctgaaggagacctatggggaatattttctggcagaactgatcgaggcgcaggatgaggaaaaccacgcagtcgtgtgtgaggtggaagggacagcggtgggcttcatgagcgtctgttcacgggtgaatatgcagctccttcatgagtgcttcgatctgggaccgttccatggtctgtgcttcccccaccccgacgatgtgctagagagccctcaggacctgtcggtgcgccgaagtcaagacgcagaactgcggtcaagctcccaagggtcccagaaaatagtggaagagctgcaggagccagtaagtcctgataccatggagaatatccagggtaacatagccagggaggccgcatccgaagaagccctcaccgccgtgcagtccggtaacgtgagtgaaccagaatcattggatttcatgaattttgtcttctcgttattcagtgacaaaaatttttgtgtaatctccctgccacacctgactccagagttcttccttatccagaatttcgtcaaaatggttcccttcaacacatgcacattggagcaggatctttatgtcttccatcgcgctggactgctcaagtccatcaatattcggttcgccaccctgctggacactccaggcgtcgagaacctggtttccacattaatgttgaacaaatcgattttggaggacctggatcgatataacaaggcaagaaaagaccctgatggtacactcctgcaggctttcgtggcggaggtcgccgagcagattgtaggtattgctgtgatccgcaacgagatggacattgaatatatccggtcccactataatatcgaggactttatctacttctcacaccaccagagggaagagcacggtcacatgcaccatttcgccctgaatcccattttccggcattacacgaaattctttctgaaggaaattttgcgcctggggttcaaatcctgtttgtattaccgagtttaccctaaatccagggaagggaagttccagaacccgtatgctcactctctgacgagcgccctgcactaccttgtcccagtgaggcccagacgtcagattgtgtaccccctggagaagttgggcattaatgccccctcaaaggccgtaagtaaggatccaatgtcctacgcacttaaccataccaaccggaaactaaccctggagcccaaaattacagtcaacgcgaagattatcgtggtaggggcgtcctcggtcggaatcagtttcctggagaccctggtcttttgcagtcatatgaaattcaataatttgactctcatctccactcacggactgccaggcaagaagctgctggatacagagcaacgaaagttcctcgcctccgatcattgttttaatgataaagactatgctctgatgagcctgtgttcctgggtcaatgtggtggtcggtcgcatgacaggcatcgatcgcgccgccaaacacgtggtgctgtctactgatgaaatagtcccgtatgatcacctcatcctgtgcacagggcaacagtaccaagtgccatgcccaacagaagccgacatcagtcagcacttgactaaccgcgaagtccctaattcatcacagcggaggtataccggcaaagtaccctgtaatcacttcactttaaacgaagaggaggattgcttcaaggccctgatctggattagaaacaatagtattacaactgaaggcaatattattgtttacgggaatacaatcgatacctatacgaccgtcgaaacccttctgaatctgggagtctctggaagcagaattcacctagtccagccacctcccgcgagcactatcacttgcatcaataactattccgtggagagtgccgtggccgatgcgctcggcgccgctggcgtaaccatgtatcgggacgccatcctggcccagtggaacgacggcctgcaccctgacccaatctactctgcatcctttactacccccacaaagccatttaggttacagtgctcaatgttcttctccttttgcgagaaaaacgtggactacgaaacattcaaagctctcaatgacgcctgtctcgtttatgactcccgtctcgtcattgataccaatttccacacgaacgacatcgccatcagagccgccggtagcctgactaaattctcaaaccggtattattcaaatgaatggacacactcgaatttttccagtaaagagatcggatttcagctcgccgctgcgatgctccatctgttcgatcccaccctagagcctgtgaccgagccccccgccaacctcgaccgcttaataccaatgtacaagggggcaaagatccagggggggatactgcccgggtcatatcattatttgcacatcgcaaaacctgctattcccacgcctctggaagtgcaaatggcacaaccaaactacgggcttgaacttgttacagggagtgccaagaacggtacttacttccgcatccacataaataagtataagatggtggagacgatcacgtgtctgagccgagaacccttccctgcaagcaattatatccgcctgttcggccagcatgagcagctcctgaacaatctttgtgctcgatacgacgagaacctgatcaccgatctgtacagctatttcaccgagccatggtgcctggccctttttcacgatagattcatcgaccttcgcaaggaacttcgacaaattctggcctctaaggaagaggaagacttgccgtcaattgaacagttagctcaccagattgaggacgaagaaatcaacccaaccgagaagcccaggcaatatctcaagcgtgtgtttgaggaatctatctataagacgctagttgagaggtccacgctggactacctgcactacaacaggtatcatctgcctatgtacgcctggcccggcatcgtatag

SEQ ID NO: 45480 - DNA, 603 bp, Artificial Sequence
  Description of Artificial Sequence: Synthetic coding sequence
atgagctacgccctgaaccacaccaaccggaagctgaccctggagcctaaaataaccgttaacgcgaagataattgttgtgggcgcaagttctgtcggaattagctttcttgagacgctcgttttttgctctcatatgaaattcaataatcttacacttattagcacacacggactcccaggaaagaagctacttgacaccgagcagaggaagtttttggcctccgatcactgctttaacgacaaggattacgccctgatgtcattatgtagctgggttaacgtcgtcgttgggaggatgactggaattgaccgagccgcaaagcatgttgtgctgtctacagacgaaattgtcccgtacgatcacctgattttatgcactggacagcaatatcaggtcccctgccctactgaagcagatattagtcagcacctgaccaacagagaggtcccgaactctagccaacggagatacacgggcaaggtgccttgtaaccattttacactcaacgaggaagaagattgctttaaggctctgatatggattcgaaacaacagcattacaactgaggatggcggaagagcgtccgtgctgttctgttag

SEQ ID NO: 45481 - DNA, 438 bp, Artificial Sequence
  Description of Artificial Sequence: Synthetic coding sequence
ggcctgcgggagagcctgttccggaccccccggttcggctgcttctcgatctttccaaggcgcatcagggtggaagtcgaggggaccgctgtgggatttatgtcggtttgttctcgagtgaacatgcagctgcttcatgagtgctttgacctaggtcctttccatggtctgtgctttccacacccagatgatgtcctcgaatccccacaagacttatcagtgcgcaggagccaggatgccgagctccggagctcttcccagggctcccaaaagattgtcgaagagctccaggagcctgtcagccccgacaccatggagaacatacaggggaacatcgccagagaggcagcttctgaggaggccctaacggcagtgcaatccggtaacgtgagtgagccggaagtcgcaggcttttacgagttttgcttccagtcgtag

SEQ ID NO: 45482 - DNA, 570 bp, Artificial Sequence
  Description of Artificial Sequence: Synthetic coding sequence
atgagcgtgctgaccagcccccggggcaaggtggaggtggtgcactgtcggaggacagagtcacaggatgtgtactgcattaagagcctgattaggaagtttacctgcaaactgttcgggaaactcaatataatctatcttttagaaaaggccaacttggctgtgaccttgtgcaacgacaaggaggaaatcatggcacaggctaccttcctcgactaccccaactggaatgtggccaaacaggatgattgggtatccgtgtttcgcgaactggactccgacattccttgcaccccactaaatacgctgtttatgcacctttttgtagctgtggacgaatattcagttggatgctgtaaagaaatcctgcggacggtgtacaaagccgtgcccgagctgcactttatattcctgattgtgccttcctacatgagccttggatccactctgatcacggtattcgaccaggttggcaatattccctgccttacttatgaagaagactttgccgtccatatatgtcacaggcatagtcattaccctcagctgcatgtgcgcaaggcccggtag

SEQ ID NO: 45483 - DNA, 1413 bp, Artificial Sequence
  Description of Artificial Sequence: Synthetic coding sequence
atgagcgtgctgaccagcccccggggcaaggtggaggtggtgcactgtcgtagaacggaatcacaggacgtgtattgcatcaagagtctgatccgtaagttcacctgtaagcttttcggcaagctcaatataatctacttgctcgagaaggcaaatctcgcagtcactctctgcaacgacaaggaagagattatggcccaggctaccttcttggattatcctaattggaacgtcgcaaaacaagatgactgggtgtccgttttcagggagctcgactctgacatcccctgcacgccgctgaatacgctcttcatgcatttgttcgtcgccgttgacgaatactccgtggggtgttgtaaggaaatcctgaggaccgtttataaagccgtgcccgagttgcatttcatattcttgatcgtccctagctacatgagcttggggtcaacccttatcaccgtctttgaccaggtcggcaatataccgtgtctgacctacgaggaagacttcgcagttcatatctgtcatcgccattctcattaccctcagctgcatgtccggaaagctagggtggaagatcacgacgatttgatgcccatctttatgcggtacgatactatcctgaaagaaacatacggggagtactttttggctgagctgattgaagcacaggatgaggagaaccacgccgtggtgtgtgaagtcgaaggaaccgctgtcggttttatgtccgtttgtagtagagttaatatgcagctgttacatgaatgtttcgacctgggcccctttcatggcttgtgctttccacaccccgatgacgtgttggaaagcccacaggacctgagcgtgcgtaggagccaggacgcggagcttaggagtagcagccagggatcccagaaaatcgtcgaagagctgcaggaaccggtgtctcctgatactatggaaaatattcagggtaacattgccagagaagcagcctcagaagaagccctgacagctgtgcagagcggaaatgtgtctgagccggaagacatcgaaaaactgtccgatatttccacaggatatgcgcagtatcaccacgtctcaagtcgctctcttgcttctctggtgcttccggaagaacctgtacacttcagaccgatttacaggggagcttccgctgcattttgcatccagctattctgcatcgatgagaagtacgaggcccggtcacttgactttatgaactttgtgtttagtctattttccgacaagaatttttgtgtgatcagtttgcctcatttgaccccagagtttttccttattcaaaacttcgtcaaaatggtacccttcaatacctgtactctcgagcaggacctctatgtatttcatagagccgggctgctaaaaaatatttgccttggtaggagcagctag

SEQ ID NO: 45484 - DNA, 963 bp, Artificial Sequence
  Description of Artificial Sequence: Synthetic coding sequence
atgagctacgccctgaaccacaccaaccggaagctgaccctggagcccaaaataacagtaaatgcaaaaattatcgtggtgggtgcctcttctgtaggtatctccttcttggagacattagtgttctgcagtcacatgaagttcaataatctcacgctgatctccacccatgggctccctggaaaaaagctgttagataccgaacagcggaagtttctggccagcgaccactgctttaacgataaagattacgctctcatgtcgctttgtagctgggttaatgtggtggtgggcaggatgaccggaattgatcgggccgccaaacatgtggtgctgtcaacggatgagatcgttccatacgaccaccttattctgtgtaccggccaacagtaccaggtgccttgtcctactgaagctgacatcagccagcatttgacaaatagggaggtgcctaattcctcacagcgtaggtacacaggcaaggtaccatgtaaccacttcactcttaacgaagaggaggattgttttaaggcccttatctggataagaaataatagcattacaaccgaaggtaacataatcgtttacggcaataccatcgatacatataccactgtcgaaacactgctgaacctgggagtcagtggatcgcgtatacatctcgttcagccgccgcccgctagcactattacttgcatcaacaactatagtgtggaaagcgctgtggcggatgctctaggagcagctggtgtgacaatgtacagagatgccattcttgctcagtggaatgacggcctgcaccctgatccgatatatagtgcttcgtttaccacgcccacaaagccattccgacttcagtgcagtggcgccttcttcctcgggctgacaatcatctgcatcttgccaagtctcccatttcaactgccttggcgatataaatggcactctcttattatggtgtag

SEQ ID NO: 45485 - DNA, 3612 bp, Artificial Sequence
  Description of Artificial Sequence: Synthetic coding sequence
atgagcgtgctgaccagcccccggggcaaggtggaggtggtgcactgccggaggactgaaagccaggacgtatattgcattaagtcacttatccgcaagtttacatgcaagctgttcggaaaactgaacattatttatctccttgagaaggctaatctagcagtcacactatgcaatgacaaagaggaaatcatggctcaggccactttcctggactatcccaactggaacgtggcaaagcaggatgactgggtgagtgtatttcgcgagctggattcagatatcccttgtacaccactcaatacactgttcatgcatctctttgtggctgtcgacgagtatagcgtgggatgctgcaaagagatcctgagaactgtttacaaggctgttccagaactgcatttcattttccttatagtcccaagctatatgtccctcggatctacactcattacggtatttgaccaagtcgggaatatcccatgcctgacgtatgaagaagatttcgccgtgcacatctgtcacagacactcacactatccacagcttcatgtgaggaaagctcgcgtagaggaccatgacgatttaatgcctatcttcatgaggtatgataccattcttaaagagacatacggagaatactttctggccgagctcatcgaagctcaggatgaggagaatcacgccgttgtatgcgaggtcgaaggaaccgctgtaggcttcatgtccgtatgttctcgggttaacatgcagctgttgcacgagtgttttgacctgggacccttccacggactgtgttttcctcatcccgatgatgtcctcgaaagtccgcaggacctgtctgtgaggcggagccaggacgcagagcttaggtcatccagtcagggctctcagaagatcgttgaagagctacaagaacccgtttcacccgatacaatggagaacatacagggcaatatcgccagagaggcagcgtcagaagaggctctgactgccgtgcagagtggtaacgtgagcgaaccagaggatatcgagaagctcagcgatataagcactggctacgcacaataccaccacgtgtccagccggtctttggctagtttggtactgccggaagagcctgtacacttccgacctatttaccgcggagcctcggcggcattttgcattcagctgttctgtattgacgagaaatatgaagcaaggtctttagactttatgaacttcgttttctccttgttctccaattttgtaaaaatggttcctttcaatacctgtacactcgagcaggatctttacgtttttcacagagcaggccttctcaaatccattaatattcgtttcgccaccctgctagacaccccaggcgtcgagaacctggtatccaccttgatgcttaacaagagcatactggaagacttagatagatataacaaagccagaaaagacccagatggtacactgcttcaagccttcgtcgccgaggtggccgagcagattgttggcatcgctgtgataagaaacgaaatggacatagagtatataagatcacattacaatattgaagacttcatatactttagccaccaccagcgggaggagcatggacatatgcatcactttgctctcaaccctattttcagacactataccaagttcttcctcaaagagatcctgcggcttggattcaagagctgtctgtactaccgggtgtaccctaaatctagagagggaaagttccaaaacccctacgcacattcactgacctctgccttacactatctggtgccagtccgacctagacgacagattgtgtaccccctggagaagttgggtatcaacgctcctagcaaggccgtctccaaagacccaatgtcatatgctctgaatcacacgaaccggaagttgactttagagccaaagattaccgtgaacgccaagataatcgtggtgggggcttcctcggtgggcatttctttcctcgagacattggttttctgctcacacatgaaatttaataaccttactcttatcagcactcacggcttgcctggcaaaaaactgttggatacagaacagcgaaagtttctggcatccgatcactgcttcaatgacaaagactacgccttaatgagcctctgcagttgggtcaatgttgtggtcgggagaatgacaggcatcgatcgggcagcaaaacatgtcgtgctgagcacagacgagatagtgccctatgaccacttgatcttgtgtaccgggcagcagtatcaggtaccgtgtcctaccgaggcggatatttcacagcacttgacgaacagggaggtgcctaacagcagtcagagacgctatacaggtaaagttccatgcaaccacttcaccctcaatgaggaggaggactgttttaaggctctgatatggatacgcaacaattctattacaacagaggggaacataatcgtgtatggcaatacaatcgacacatatactaccgtggaaactctcctgaacttgggcgtgtcaggaagcaggataaacaactattctgttgaatccgccgtggctgatgctctgggcgccgctggagttactatgtatagggacgccattctagctcagtggaatgacgggcttcatcccgaccctatctacagcgcatcctttacgacgccaaccaaaccattccggctacaatgctccatgtttttctccttctgcgaaaaaaacgtggactatgaaacgttcaaagccctgaatgacgcatgccttgtctacgattctcgcctggtgattgacaccaactttcacaccaacgacatcgccatccgcgctgctgggtccttgacgaaattttcaaataggtactattcaaacgaatggacacatagcaatttttcctctaaagaaattggttttcagctggcagccgcaatgctacacctttttgatcctaccttggagcccgtgactgaaccacctgctaacttagaccggctaatacctatgtataaaggcgcgaagatacaggggggcattctgccggggtcctatcattacctgcacatcgctaagccagcaattcctacgcctctggaagttcagatggcccagcccaactacgggctagaactggtaacaggctccgctaagaacggtacatactttcgcattcatatcaataagtataagatggtagaaaccatcacctgtctctcgcgtgaaccgttcccagcttcaaactacattcgcctcttcggtcaacatgagcagctactgaacaacctgtgcgccagatacgacgaaaatcttatcaccgatctctacagctacttcaccgaaccttggtgccttgctctgtttcatgaccggtttattgacctaagaaaggagttgagacaaatacttgcctctaaggaagaagaggatctcccttctattgagcaattggcgcatcaaatcgaggatgaggagattaatcccacagaaaagcccagacagtacctgaagcgcgtttttgaagaaagtatttacaaaacactggtggaacgctccacattagactacttacattacaatcggtatcaccttccgatgtacgcttggcccggcatcgtatag

SEQ ID NO: 45486 - DNA, 603 bp, Artificial Sequence
  Description of Artificial Sequence: Synthetic coding sequence
atgagctacgccctgaaccacaccaaccggaagctgaccctggagccgaaaatcaccgtgaacgcgaagattatcgtagtcggagcttcatcagttggcatcagttttctggaaacactggttttctgctctcacatgaaatttaacaacttaactctgatcagcacacacggccttccggggaaaaaactgctggacacagagcagagaaaatttctggcttctgaccactgctttaatgataaggactacgccctgatgtccctttgtagctgggtcaacgtagtcgtgggccgtatgactggcattgatagggctgctaagcacgttgtcttatccacagatgagatcgttccatacgaccacctcatcctctgtaccggacagcaataccaggtaccctgccctacagaggccgatatttctcagcatcttaccaacagagaggtgcccaacagctcccagcgccggtataccgggaaggtgccgtgcaatcacttcacactgaatgaggaagaggactgtttcaaggccctgatttggattagaaacaattctatcacaaccgaggacggagggagggcctccgtgctcttttgttag

SEQ ID NO: 45487 - DNA, 1413 bp, Artificial Sequence
  Description of Artificial Sequence: Synthetic coding sequence
atgagcgtgctgaccagcccccggggcaaggtggaggtggtgcactgtcgcagaaccgagtctcaagatgtgtattgtatcaaatccctcattaggaaattcacatgcaagcttttcggaaaacttaatatcatctacctcctggagaaggccaacttggctgtgactctctgtaatgacaaggaggagatcatggcgcaggcaaccttcctcgattaccctaattggaatgtcgccaaacaggatgattgggtgagtgtgttccgcgagttggattccgatatcccctgcacaccgctcaacacactgttcatgcacctgtttgtagcagtcgacgaatatagtgtcggctgttgcaaggagatcctgagaacagtgtacaaggccgtgcctgagctgcacttcatctttctcatcgttcctagctacatgtctctcgggagcacattgatcacggtctttgaccaggtggggaacataccttgcctaacctatgaggaagactttgcagtgcatatctgtcatagacattcccattatccccagctgcatgtccgtaaggcaagagtcgaggatcatgatgatctcatgcctatttttatgaggtatgatacaatcttaaaagaaacttatggcgaatattttctagccgaattgatagaggcacaggacgaagagaaccatgccgttgtgtgtgaagtggagggaacagccgtggggttcatgtcagtttgttctagagtaaacatgcagctcttacatgagtgcttcgaccttggtccttttcacggtttatgtttcccccacccggatgacgtgctggagtccccgcaggatctcagtgtacgcagatcacaagatgctgagctacgctccagttctcaggggtctcagaagattgttgaagaactccaggaacctgtcagccccgatacgatggaaaacatacagggaaatatcgctcgggaagctgcgagcgaagaagccctgacagctgtacagagcgggaatgttagcgaacctgaggacattgagaagctgtccgatatttctaccgggtacgcacaatatcatcatgtgagcagcagatcactcgcttctctggtgctgcctgaagagcctgtacacttccgtcccatttacaggggtgcctcagcagccttctgcattcagctcttttgcattgatgagaagtatgaggctagatccctcgactttatgaactttgtattttctttgttcagcgataagaacttctgcgtcatttcattacctcacctcactccagaattcttcctgatacagaatttcgttaagatggtcccttttaacacttgcacgctggagcaggatctgtatgtgtttcacagggcaggccttctgaaaaatatttgtctcggtaggtcttcttag

SEQ ID NO: 45488 - DNA, 408 bp, Artificial Sequence
  Description of Artificial Sequence: Synthetic coding sequence
atgagcgtgctgaccagcccccggggcaaggtggaggtggtgcactgtcgcaggaccgaatctcaggatgtctattgtatcaaatccctgatccgaaagtttacatgcaagttgtttggaaagcttaatattatttatctattagagaaagcaaatctggctgtgacactctgtaacgataaggaggagataatggcacaggccacattccttgactatcccaactggaatgtagccaagcaggatgattgggtgagtgtcttccgtgaactggactccgacattccttgtactcccctcaatacgctttttatgcaccttttcgtagccgtcgatgaatattccgtggggtgctgcaaggagatcctgcggacggtgtacaaggccgtgcctgaattgcatttctag

SEQ ID NO: 45489 - DNA, 1467 bp, Artificial Sequence
  Description of Artificial Sequence: Synthetic coding sequence
atggagcccttcctgcggcggcggctggccttcctgagcttcttctgggacaagatttggccagccggcggggaacccgatcacggtacgccaggctcattggatccgaataccgatcccgtcccgactctgcccgctgagccctgttcaccatttcctcagctgtttctcgccctatatgattttaccgcccgctgcggcggtgagctgagcgtgcgtcgcggagatcggctgtgcgctttggaggagggcggtggttacattttcgcgaggcgactctctggtcagccgagtgcgggacttgttccgatcactcacgtcgccaaagcctcgccggagaccttgagcgaccagccatggtatttctccggcgttagccggactcaggcgcagcagcttctgttgagcccaccaaacgagccaggcgcttttctgattcgcccatctgaatcgtccctgggagggtactccctgagcgttcgtgcacaggctaaggtttgccattaccgggtgagtatggctgcggatgggtctctgtatctgcaaaaaggcagactctttcctggtttggaggagctgctcacatattacaaagccaattggaaactgatccagaatcccttgctgcagccatgtatgccccaaaaagcaccccgccaggatgtttgggaaagaccgcatagtgaatttgccctgggccgtaagcttggggaaggctacttcggcgaggtgtgggagggcctgtggctggggagcctgcccgtggccataaaggtcattaaaagcgcaaacatgaagctgacagatctcgcgaaggagatccaaacgttgaagggcctgcgtcacgagagattgatccgattgcatgctgtgtgctccggaggcgagccagtatacatagttacggagctgatgagaaaggggaacctgcaggcctttctcggaacacctgaaggtcgcgcactacgcctgccaccccttctgggatttgcttgtcaagttgccgaaggcatgagctacttggaggagcagcgtgtggtccacagggatctcgctgcccgtaatgtgctggttgatgacggccttgcgtgtaaggtcgccgacttcggcctggcacggctactcaaagacgatatctatagtccaagtagcagctcaaaaattcctgtgaagtggactgcacctgaggctgccaattaccgggtattttcccaaaaaagcgacgtttggtctttcggcgtgctcttgcatgaagtgttcacctacgggcagtgcccttacgaaggcatgacaaaccatgagacactgcaacaaattatgcggggctatagactcccacgcccagctgcttgtcccgcagaagtgtacgtgttgatgctggagtgctggcggagctccccagaagagagaccctcatttgctacgctcagggaaaaacttcatgccatccaccggtgccacccatag

SEQ ID NO: 45490 - DNA, 402 bp, Artificial Sequence
  Description of Artificial Sequence: Synthetic coding sequence
atggccgccgccaacaagggcaacaagccccgggtgcggagcatccgctttgctgcaggccatgacgccgagggatcccacagccatgttcatttcgatgaaaagcttcacgattcggtggtgatggtgacacaggagtcagacagcagcttcctggtgaaggtgggttttctgaagatattgcatcgctacgaaattacctttactctaccaccagtacatcgtctctccaaggacgtgcgggaggcacccgtgccctctttgcatttgaagctgttaagcgtcgtcccagttcctgaggacaggcaccatggcacccctatgctcctcgacggcgtcaaatgcgtgggcgcagagctggagtatgatagtgagcactcagactggcatggcttcgactag

SEQ ID NO: 45491 - DNA, 525 bp, Artificial Sequence
  Description of Artificial Sequence: Synthetic coding sequence
atggccgccgccaacaagggcaacaagccccgggtgcggagcatcaggtttgctgcgggccacgacgcagagggttcccattcccatgttcattttgacgaaaaacttcacgactccgtagtgatggtgacccaggagagcgactcatcctttctggtgaaggttggctttctaaaaattctacacaggtatgaaattacctttacactgcccccagttcatcggctcagcaaagacgtgagggaggcccccgtgcctagccttcacctgaaactactatctgtagtgcctgtacctgaagggtactccgtaaaatgcgagtatagcgctcataaagaaggcgtgctgaaagaggaaattctgttagcctgtgaaggaggaactggaacatgcgtgcgggtgaccgtgcaagccagagtcatggacagacatcacgggactcccatgctcttggatggagttaaatgtgtaggcgccgagctcgagtatgacagcgagcactctgattggcacgggtttgattag

SEQ ID NO: 45492 - DNA, 525 bp, Artificial Sequence
  Description of Artificial Sequence: Synthetic coding sequence
atggccgccgccaacaagggcaacaagccccgggtgcggagcatcaggttcgccgcaggccacgacgctgagggttcacacagccatgttcatttcgatgagaagctccatgactctgtcgtgatggtgacgcaggagtccgacagtagttttctcgtgaaggttggatttttgaaaatcctgcacagatatgagattactttcacactcccaccagtgcatcgcctctctaaggatgtgcgagaggccccagtccctagtctgcatttaaagctgctgagtgtagtacccgttcctgaggggtactctgtgaagtgtgaatattccgctcataaggagggggtcctgaaggaagagatcctgctggcttgtgagggaggtacaggaacctgtgttcgagtgactgtgcaagccagagtaatggatcgccaccatggaactcccatgctgctcgacggagtgaagtgtgtgggggccgaattagagtatgactcagaacattctgactggcatggttttgactag

SEQ ID NO: 45493 - DNA, 384 bp, Artificial Sequence
  Description of Artificial Sequence: Synthetic coding sequence
tgaaacaagccccgggtgcggagcatccggttcgccgccggccacgatgccgagggcagccactcccacgttcacttcgatgaaaaattgcatgactccgtggtgatggtgacacaggagtccgatagttcatttttagtcaaagtggggttcttaaagattctgcaccgatacgaaattacctttacgttgcctcctgttcacaggctatcgaaagacgtcagggaggcacctgtacccagtttgcacctcaaactgctctctgttgtgccagtcccagaggaccgacaccatgggacgcctatgttgctggacggcgttaagtgtgtaggcgctgagcttgaatatgactctgaacactctgactggcatggattcgactag

SEQ ID NO: 45494 - DNA, 603 bp, Artificial Sequence
  Description of Artificial Sequence: Synthetic coding sequence
atggtgcacgccttcctgatccacaccctgcgggcccccaacaccgaggacacaggactgtgccgtgttttgtattcgtgtgtgttcggagcagagaagtcgcccgacgaccccaggccccacggggccgagcgcgatcgcctactaagaaaggagcagatccttgctgtcgctcggcaagttgagtctatgtgccgcctccaacaacaggcttctggacggcccccaatggacttgcaaccgcaatctagtgatgagcaagtccctctccacgaggcaccaaggggggcatttagactcgctgcggagaacccctttcaagagcccaggacagtcgtctggctaggtgtgctgagcctagggtttgcattggtcctagatgctcacgagaatctgctgttggccgagggcacactgcgtctcctgacccggcttctgctggatcacctgagacttcttgccccctcaacttctttgctgctaagagccgacagaattgagggcatccttactcggttcctgccccacggacagctactgttcttaaatgatcagtttgtgcagggtctagagaaggaattcagtgcggcgtggcctaggtag

SEQ ID NO: 45495 - DNA, 603 bp, Artificial Sequence
  Description of Artificial Sequence: Synthetic coding sequence
atggtgcacgccttcctgatccacaccctgcgggcccccaacaccgaggacacagggctgtgtcgggtcctgtactcttgcgtgttcggagctgaaaaatcaccggacgatcctcgcccccatggtgccgagagggacagattactgcgaaaagaacagatcctggcggtggctaggcaagttgagtctatgtgcagactgcagcagcaggcaagtgggcgcccgcccatggatctgcagcctcagtccagcgacgagcaggtgccccttcatgaggccccaagaggcgccttccggctggctgccgaaaaccccttccaggagcccagaactgtggtgtggttgggagtgctgtccctgggttttgctttagtgctggacgcccacgagaacttgttattggctgaggggaccctgaggttgttgacacgcttgctgctcgatcacttgcggctgcttgcaccaagtacctcgctacttctacgtgcagatcggatagagggtattctgaccaggttccttccccatggtcaactgcttttcctgaacgaccaatttgtgcagggactggagaaagaatttagtgccgcgtggccacgctag

SEQ ID NO: 45496 - DNA, 180 bp, Artificial Sequence
  Description of Artificial Sequence: Synthetic coding sequence
atggtgcacgccttcctgatccacaccctgcgggcccccaacaccgaagatactgggctgtgccgagtcctgtacagctgcgtgtttggcgcagagaagagccccgatgatcccaggccacatggggccgagcgcgataggttgctgcgtaaagaacaaattctggcagttgcaaggtag

SEQ ID NO: 45497 - DNA, 261 bp, Artificial Sequence
  Description of Artificial Sequence: Synthetic coding sequence
atggtgcacgccttcctgatccacaccctgcgggcccccaacaccgaagacacgggcctctgtagagttctctattcttgtgtttttggtgctgagaagtctccagatgatccacggccgcatggggccgaacgtgaccgcctcctgcgtaaagaacagatactggccgttgctaggcaagtggaaagtatgtgccggcttcagcagcaggcatctgggcgcccgcccatggacctgcaaccacagtccagcgatgagtag

SEQ ID NO: 45498 - DNA, 1155 bp, Artificial Sequence
  Description of Artificial Sequence: Synthetic coding sequence
atggccgccgtgcagatggaccccgagctggccaagcggctgttcttcgagggggccacagttgtcattcttaacatgcccaaggggacggagttcggcatcgactacaacagctgggaagtgggcccaaagttcagaggggtcaagatgatacctcctggcatccattttttacactatagctctgttgacaaagctaaccccaaagaagtcggcccgagaatgggtttctttctcagtctgcatcaacgcggtctgactgtcctgcgttggagcaccctgagggaggaggttgatttatccccagcccccgagagtgaggtcgaggccatgcgggcaaaccttcaagagttagatcagttccttggaccttacccttacgccaccctgaaaaagtggatttcattaacgaattttataagcgaggctactgtggaaaagcttcagccagaaaatcgccagatctgcgcctttagcgatgtgctgcctgtcctgtctatgaaacacactaaagatcgcgtaggccagaacctaccacggtgtggtattgaatgcaagtcttatcaggagggcctggccaggttaccagagatgaagccaagagctgggacagaaataaggttcagtgaactgccaacccagatgtttcccgagggggctacccccgccgagatcaccaagcacagcatggacttgtcatacgctctggagactgtcctgaacaagcagtttccttctagtccacaagatgtgctgggtgagctccaattcgcattcgtttgctttttgctggggaacgtctacgaggcttttgagcactggaaaagactgctaaaccttctgtgtcgcagcgaagctgcaatgatgaaacaccacacattatacataaacctcatcagcatcctgtatcatcagcttggcgagattcctgccgatttctttgtcgacattgtgtcacaagataatttcctgacctctaccctacaagtgttcttttcgtcagcctgttctatcgctgtcgatgcgacacttcggaaaaaagcagagaaattccaggcccatctgacaaaaaaatttagatgggacttcgccgcggagcccgaagattgcgctcctgtggtggtggaattgcccgaagggattgagatggggtag

SEQ ID NO: 45499 - DNA, 1155 bp, Artificial Sequence
  Description of Artificial Sequence: Synthetic coding sequence
atggccgccgtgcagatggaccccgagctggccaagcggctgttcttcgagggcgccacggtagttatcctaaatatgcctaaagggaccgagttcgggattgactacaattcttgggaggtgggaccaaagtttcgtggagttaagatgatccctcccgggattcactttcttcattactccagcgtcgataaggccaatccaaaggaggtggggcccaggatgggtttcttccttagtctgcaccaaaggggacttaccgtccttcgatggtccactctgagggaagaggtggacctgtcacccgctccagagtccgaggtggaggcaatgcgggcaaatcttcaggagctggaccagtttctaggcccttacccctatgcgactctcaaaaagtggatctctcttaccaacttcatctcggaagcaaccgttgagaaactgcagcccgagaatagacagatctgcgccttctccgatgtgctaccagttcttagcatgaagcatacgaaggacagggttggtcagaacctgccccggtgcggtatcgagtgtaagtcctatcaagagggcctcgctcgattgcccgagatgaaacctagggctgggacggagatcaggtttagtgagttgcccactcagatgtttcctgagggagctacccccgccgagataacaaaacactcgatggatctctcctatgcactagaaacagtattgaacaagcagttcccgtcatccccccaggacgtgctcggcgaactacagtttgcttttgtctgctttctcctcggcaatgtgtacgaagcgtttgaacactggaagaggcttctcaacctgctgtgccggtctgaggccgcaatgatgaagcaccacacactgtatatcaaccttattagcatcctgtatcaccagctcggagaaatcccggccgatttcttcgttgatattgtgagccaggacaacttcttgacaagcacgttgcaagttttcttttcttcagcatgctcaatcgccgtggatgctacattaagaaaaaaggctgaaaagttccaagctcatcttaccaagaaattcaggtgggattttgctgctgagccagaggattgtgctcctgtggttgtcgaattgccagagggaatcgaaatgggatag

SEQ ID NO: 45500 - DNA, 921 bp, Artificial Sequence
  Description of Artificial Sequence: Synthetic coding sequence
atgggctgcgacggcggcaccatccccaagcggcacgagctggtgaaagggcctaagaaagtggagaaggtcgacaaggatgccgagttggtcgctcagtggaattattgtacactgtcgcaggagatcctcagacggccaatcgttgcctgcgaactaggcaggctgtacaacaaggatgccgtaatcgaatttttgcttgacaaaagtgctgagaaagccctgggaaaggcagcgtctcatatcaagtcaatcaaaaacgtaacagaactcaagctttcagacaaccccgcatgggaaggtgataaggggaacaccaagggggataaacatgatgacctgcagcgcgcccgattcatctgcccagtggtaggcctggagatgaatggcaggcatcgcttttgctttttgcgatgctgcggatgcgtgttttctgaaagggctctcaaggagataaaggccgaggtatgccatacgtgcggcgccgcctttcaggaggatgatgtcatcatgctgaatggcactaaagaggacgtggacgtgctgaagactcgcatggaggagcggcgtttaagagccaaactcgagaaaaagacaaagaaaccaaaggccgctgaatcagtgagtaagcccgacgtttctgaagaagcaccagggccaagtaaagtaaagacaggtaagcctgaagaagccagcctggacagtcgggaaaaaaaaaccaacctcgcacccaagtcaacggctatgaatgaatcatctagtggaaaagctggtaagcctccctgcggagcgaccaagcgttctattgcggattcagaggaatccgaagcttataaatccttgttcactactcacagcagcgccaagcggtcaaaggaagaatccgcacactgggtgacacacacgagctactgtttttag

SEQ ID NO: 45501 - DNA, 1011 bp, Artificial Sequence
  Description of Artificial Sequence: Synthetic coding sequence
atgggctgcgacggcggcaccatccccaagcggcacgagctggtgaaggggcctaagaaagtggaaaagatctggcatcttaagaatggtaaagagtggtgttctctccattccgaggggaagaacaaaaacggcaaggaatgggatatggagtacgatgtggataaagatgccgaactggtcgcacaatggaactactgcaccctgtctcaggaaatcctgcgcaggccaatcgtcgcctgcgaacttgggaggctgtataataaagatgctgtgatcgaatttctattggataagtccgccgagaaggccctaggaaaggcagcttctcacatcaaatccatcaaaaatgtgacggagctgaagttatccgataaccctgcgtgggagggggataaggggaacactaagggcgacaagcacgacgatcttcagcgggcaaggttcatatgcccagtggtggggctggagatgaacggcaggcacaggttttgctttctaagatgttgtggatgcgttttcagcgaaagagcccttaaggaaataaaggccgaggtgtgccatacatgtggggccgccttccaggaagacgatgtcatcatgctgaatgggacaaaggaagatgtcgacgtcttgaaaaccaggatggaagagcgtaggcttagagctaaactggagaagaaaaccaaaaaacctaaggccgctgagtctgtttccaaacccgatgtctcagaggaagcgcctggcccctctaaggtcaagacagggaaacccgaagaggcctcgctggatagcagggagaaaaagactaatctggcccccaaatctactgctatgaatgagtcatcgtccggaaaggcagggaaacctccttgcggggctactaaacgtagcatcgctgactcggaggagagcgaagcctataaatctctgtttactactcattcttctgctaagcgatctaaagaggaatccgctcactgggtgacccatacatcctactgtttctag

SEQ ID NO: 45502 - DNA, 129 bp, Artificial Sequence
  Description of Artificial Sequence: Synthetic coding sequence
atgggctgcgacggcggcaccatccccaagcggcacgagctggtgaaaggtcctaagaaagtggaaaaagccattattggcggcctcctggatggagcctggtctcccgaaaccccttcacaggattag

SEQ ID NO: 45503 - DNA, 456 bp, Artificial Sequence
  Description of Artificial Sequence: Synthetic coding sequence
atgttccaggtgttcaagccccacgccggcgaggactacaagtacccacgagaaaccgagactatatggagccacccatatgtagtagaaggctctcataaaagccccctcgagtccctcagcctccacggctgcctggcagccatggccccctctataactagtagtgaggatagctcgccgagccagcgcgacaaaaaagacctgagtctagatctgcttctcacccggaagaagagatctcaggggctgcattggtcacactggcaggggctgaatcacatgagtattcgcatacatactccagagcagggctctcctagtctggggcagaactggtcatggggcaatcgtaaagaaaagggagttgctcagaggcaagtgcctactacaggaacacactctttttttcactgtacgagtgagggaaacaaggagaagccgcaccatttctag

SEQ ID NO: 45504 - DNA, 471 bp, Artificial Sequence
  Description of Artificial Sequence: Synthetic coding sequence
atgtggaagcggagcgaccaccagcccaagatcaaggccgaggacggacctctggtcggacaatttgaggtgctgggctcagtgccggagcccgccatgcctcatccactcgagctttctgaattcgagagcttcccggtgttccaagatattcgtctacatattcgggaggtcggcgcgcagctggtgaagaaggtcaacgccgtgttccaactcgatataacaaaaaacgggaagacaattcttcggtggactattgacctaaaaaatggtagtggcgatatgtaccctggaccggctaggcttccagctgacactgtatttactattcccgagagcgtattcatggaactggtccttggaaaaatgaatccccagaaagcgtttttggccggcaagtttaaagtgagtggtaaagttctgctttcctggaagttggagagagtattcaaagactgggcaaaattttag

SEQ ID NO: 45505 - DNA, 414 bp, Artificial Sequence
  Description of Artificial Sequence: Synthetic coding sequence
atggcccagaagcccctgagcaccgccgccgccgagcggatgaacttggttggacaggatgagatctggaagtatagacttaaggcagagtcagaggctcgacaaaactggccacaaaattggggcttcctgactacgccatttgaggaacttataaagtgcgaagaagatctccccacacccaagcccaaaattgaattacccgagcggttccgcatcaggccagtcactcctgtcgagaagtacattaaggtgttccccagtccccccgtcccgcagaccactcaaggttttatcgggtggagatccgccgtcccgggactcaataagtgtttagaacttgatgacgccattaggagttgcaaaggcgccttcgcacgcgaactatgctggccaaaacagggagtgcactag

SEQ ID NO: 45506 - DNA, 1227 bp, Artificial Sequence
  Description of Artificial Sequence: Synthetic coding sequence
atggccagcaagaagttcgccgtgaagtgcggcaacttcgccgtgttggtagatctgcacatccttccacagggatcaaacaaagatacgagctggttctctgaacagaaaaaagaagaagtgtgcctacttcttaaggaaaccatcgatagtcgagttcaagagtacctggaggtgcgcaagcagcaccgtccatctaacgctgagttcacacgctcaaaccccttatctctgaaaggctacggcttccaaattacagcttattttttgaagcgtgggattagactaagatgcattcggagcactcagaatgctgagctttgcgtttttcctgatcggtttgttgtctgcgtctcccagttggcattctcaagggatttacttgcttcacaaaacgaggatttgacggagcgggtactgcatggggtgtcggactacttcgcagagtgtgcagagtcaagtctgcccccctctgcaaagctccgccgcaatgccctcaaagaaatcgtcaagaggacagagaccaaatctagcgtaacaagtaagagtcagactcgtcgtgataccgtcgaaactagcagcgatagcgtgatcgctgagattgcacggagaagaaacgatgggcaggcgtcctcttcccccccatctgagtcaatgggccaggccaaggattctatcaaggccgccgagagtcattggggccttcccgtccagaagctggagaaagtgaatcaaacacaacctgaagatacatctggccaacagaagccacacccaggagagcggttgaagacgggtcttttgagcaggagccccgtgtgcagctgcgagtccgcctctccgtgccctaagcagagcccgcgcgttgccaaaactcagcagaaacgcaggaactgcagttctgccgaggactttgatcatcatgggagggtgtcgctcggcagcgatcgattggtgccaagagaaattatcgtcgagaagtccaaagcggtgagggttctccctgcttcagagctcagtgatcccggcctgctgctgaagcaggatctcgctaaaaccacctctaaggaagaattacatgtgttggagagtttgtccagccgccatttaatgaagaacaatccgggacaggctcagcagaccgggctggcaacgaataccgagagattgtccactattcaaaactcccccacaaagaaacggaagaaatacgagaggggccactag

SEQ ID NO: 45507 - DNA, 1092 bp, Artificial Sequence
  Description of Artificial Sequence: Synthetic coding sequence
atggcccacgtgctgcagaagcccaagcacagcggcacccacagcatcgtccaggagttccaggtgccagattacgtaccgtggcagcagtctaagcaagaaactaagccatcaacccttcctccagtgcaacaggcaaacagcctgcacacaagcaagatgaaaactctcacaagagttcagcctgtatttcatttcaaacctaccaccgtggtgactagctgccaacctaagaaccctcgcgaacttcaccgccgacggaagctggatccgggtaaaatgcatgccaaaatctggctaatgaagacatctctccgatctggccgtgccgcgcttagggagctgcggagccgtgagaattttctgtcaaaacttaatcgcgagcttattgaaactatccaggagatggagaatagtaccacattgcatgtgagagcactgttgcagcagcaggacacactagcgaccattattgacattcttgagtacagtaataagaagcggctgcagcagctaaagtcagagcttcaagagtgggaggaaaagaaaaaatgtaaaatgagttatctggaacagcaggccgagcagttgaatgcgaagattgaaaagactcaggaagaggtcaattttctctccacttacatggatcatgagtactctatcaaatccgtgcagatttccacccttatgcgccaacttcagcaggtgaaggactcccagcaagatgagcttgatgatttaggcgagatgaggagaaaagtgttagagagtttgtccgacaagatccagaagaaaaaaaaaaagatattgagcagcgtcgttgcagaaacccagcgaccctacgaagaagccttgctccagaaaatgtgggagtcccaggactttctcaaatgtatgcagcgcttcagagagatcattgatcagtttgaagagaacatgccagtgttgcgagctgaggttgaggagctgcaggcccaaactcgcgaaccaagagaggtgatttttgaggacgttttgcttagacgtcccaagtgtacccctgatatggacgtgattctgaacatcccagtggaagagcctctgccattctag

SEQ ID NO: 45508 - DNA, 987 bp, Artificial Sequence
  Description of Artificial Sequence: Synthetic coding sequence
atggaggtgctgagcctgcccaacagcttccagacccaggccctgtgggacagcttgcactccccaggagtacccggctcagtgtttcatttcaagccaactaccgtggtcactagctgccaacccaagaaccctagagaattgcacaggcggcggaaattggatcctggcaaaatgcatgccaagatctggctgatgaagacatctctgcggtcagggagggccgcactcagagaactgcggtcacgcgagaattttctgagcaaactgaaccgcgaactgatcgaaacaatccaagagatggagaattccactacccttcacgtaagggccctcttacaacaacaagacacccttgcaacaataattgatatcttagagtactccaacaaaaaaagacttcagcagctgaagtccgaactgcaggagtgggaagagaaaaaaaagtgcaaaatgtcctatttggagcagcaggccgagcagcttaatgccaagatcgagaagacacaggaggaagttaacttcctgagcacgtatatggaccacgaatattccatcaagagcgtccagatttctacactaatgcggcagctgcaacaagttaaggattctcaacaggacgagctggacgatttgggcgagatgagaagaaaggtattggagagtctttcagataagattcagaaaaagaaaaagaagatcctgagctccgtggtggccgagactcaacggccttacgaggaggccttgctgcaaaaaatgtgggaatcacaggattttttgaaatgcatgcagcggtttagggaaattatcgaccaattcgaagaaaacatgcctgtccttagagctgaggttgaggagttacaagcacagacacgagagccacgagaggtgatttttgaggacgtactgctcagacgccctaaatgcacaccagacatggacgtaattttgaacataccagttgaagagcctctgcctttctag

SEQ ID NO: 45509 - DNA, 771 bp, Artificial Sequence
  Description of Artificial Sequence: Synthetic coding sequence
atgagctacaagatgttccacttcaagcccaccaccgtggtgacctcttgtcaacctaaaaacccccgcgaactccaccggagaaggaaattagacccagggaaaatgcacgccaagatttggcttatgaagacaagccttcggtccggacgtgctgccctgagagagctgcgtagtcgggaaaattttctgtccaaactgaacagagagttaatcgaaaccatccaggagatggagaatagtacgacgcttcacgtgcgagcactcttgcagcagcaggatactctggccactattatcgatatccttgaatacagcaataaaaaacggctgcaacaactgaagtccgaactgcaggaatgggaggaaaaaaagaagtgtaaaatgtcatacctggagcagcaggccgagcaattgaacgcaaagatcgagaagacccaggaggaagtgaatttcctttcaacttacatggaccatgaatatagcataaaatctgtccagatcagcactctcatgcgacagctgcagcaagttaaggattctcagcaggacgaacttgatgatctgggtgaaatgaggcggaaggtgctggaatctctgagtgacaagatccaaaagaagaagaagaagatccttagctctgtggtggccgagacacaaagaccctacgaggaagctctattacagaaaatgtgggagtctcaggacttcctgaagtgtatgcagagatttcgggaggtgaggggacagggcaggtggtggagcctctag

SEQ ID NO: 45510 - DNA, 186 bp, Artificial Sequence
  Description of Artificial Sequence: Synthetic coding sequence
atgggccgggccgacaccccccggcacccccccccccccgccgccggatttggtgtccaccggggtgcttttctcatccctgtggctcttcgagtcctgctcgccggacgcacccctagacccttcactcccgggctcgcagatccaagaagactgggtccccggagagttcaggctgctcagtag

SEQ ID NO: 45511 - DNA, 225 bp, Artificial Sequence
  Description of Artificial Sequence: Synthetic coding sequence
atggagcgggcccagtgcctgcggaagggcatcctgagcttcgagcgaagtctggaacagagatctttgatccttagcccaagattagagtacagtggcgcgatcaccgctcactgttccctcgatctgcttgacagcacaaatcccccagcatctgctttttgggtggttgaaactaccgacactgaggatgagagggaaaagaaacgggaaatcaccgagtag

SEQ ID NO: 45512 - DNA, 240 bp, Artificial Sequence
  Description of Artificial Sequence: Synthetic coding sequence
atgcaccacgtgcggcagctgatgatgcccatctgccccatggccctgaacagtaccacctcatcaagtacaacttttggagcctttagaataatgaccctgaacgtcgaagaatgggcaacagcctggaaggtacttatcctgcttgaagctgcggtggaggaggagaaaagaagtgaggaaaaaaggattctcgtatgtggcacgtgcggcacccggagttctcaaaagaatctctag

SEQ ID NO: 45513 - DNA, 240 bp, Artificial Sequence
  Description of Artificial Sequence: Synthetic coding sequence
atgcaccacgtgcggcagctgatgatgcccatctgccccatggccctaaattctacaacttctagttccacaaccttcggggcgtttcggattatgacactcaacgttgaggagtgggctacggcctggaaagtgctgatcctgctggaggcggcagttgaggaggagaaaaggagtgaggagaagcggattctggtgtgtgggacatgcggtacacgctcaagtcagaagaacttatag

SEQ ID NO: 45514 - DNA, 327 bp, Artificial Sequence
  Description of Artificial Sequence: Synthetic coding sequence
atgctggccaagggcgccgaggagggccggagcggcggcccccggcctgccattaccctgcccgggtctcttcattttacctgtgacttaaagacatctccctactgtcttacccgggcggaacttatggaacatctgccactccgggtagcagtgcactccatgagcccatgtcaccgttcctgtttctgtggggaactgaagaggggccatccctggaataccccccaggtctcctccttcccatctagcactaccagtctcagtcattcctgcaccacctctcaccttgactgttcccagcaggtcgagtcgggctcgaaatag

SEQ ID NO: 45515 - DNA, 327 bp, Artificial Sequence
  Description of Artificial Sequence: Synthetic coding sequence
atgctggccaagggcgccgaggagggccggagcggcggcccccggcctgctataactttgcctgggtctctgcattttacttgcgatctgaagacttctccatattgtcttacccgcgcagagttaatggagcacctgcctctgcgcgtcgccgtgcatagcatgtccccctgtcatcgtagctgcttctgtggcgaacttaagcggggccacccttggaatactccgcaggtgagctcattcccctcttctactaccagcttgagccattcttgtaccacatcccacctggactgctcacaacaggtggaatcaggctctaaatag

SEQ ID NO: 45516 - DNA, 969 bp, Artificial Sequence
  Description of Artificial Sequence: Synthetic coding sequence
atggcccggagccggctgcccgccaccagcctgcggaagccctggaagctggataggcagaagctgcccagccccgacagtggacattcgttgctctgtggctggagcccggggggaaaggcccggccagcaggcaacaccggagcctgggcacctgcagagcagtttttcccggcttctaacagaactagggaaggtggcggcctgtggcctcctctaccattgcaaagctccccagcagcgcctacgatgttagatagttccgctgctgagcaggttacgcggctcacgctcaaactgcttggacagaagctggagcaagaacggcaaaatgtcgaaggcggccctgagggactacatcttgaacctgggaacgaggaccgtcctgatgacgctctgcagaccgcattgaagcgaaggcgggatctgctgcaacggctgagggagcagcatcttctggacgaactgagtcgggcccaggcctggtcgggtccctcacgtggcgcactcggctctgccctgcctccagagctgccacctactggcattctgccaaccgcaagtccgagtcccctcgctcctgaccctccgaggattatcttgccaaccgtccctcagcctccggcgacaataatacaacaattgccacagcaacctctgatcgcgcagatcccacccccacaagctttccccacccagcgcagtggctccataaaggaagacatggtagagctgctcctgctgcagaacgcccaggtgcaccagctcgtactgcagaattggatgcttaaggctttgccacccgcccttcaggacccacctcatgtgcccccgagagtaccacgggcagcgaggccccgattgcctgctgttcaccatcatcatcaccaccatcatgcagtttggcccccaggggcagcaaccgtcctacagccggcgccttcactgtggacccccgggcccccctag

SEQ ID NO: 45517 - DNA, 288 bp, Artificial Sequence
  Description of Artificial Sequence: Synthetic coding sequence
atgctggacagcagcgccgccgagcaggtgacccggctgaccctgaagctgcttgggcagaagctcgagcaggagcggcagaatgtggagggcgggccagaagggctccacctggagcctggcaacgaagatcgacctgacgacgccctgcagactgcccttaaacgaagaagagacctgcttcagcgactcagagaggctacccttatgcacattaccctcgagggctcaagctcccacggacaccctgctcggcggggagcgtgtacttggccacggctggcttag

SEQ ID NO: 45518 - DNA, 855 bp, Artificial Sequence
  Description of Artificial Sequence: Synthetic coding sequence
ggcaaggcccggcccgccggcaacaccggcgcctgggcccccgccgagcaatttttccccgccagtaataggacgcgagaaggtgggggcctatggccaccactacctttacagtcaagccctgcggcccctactatgcttgatagctcagcagcagaacaggtgacccgccttacccttaagttgctcggacaaaagctggagcaggagcggcaaaatgtggagggaggccctgaagggttgcatctggagccaggaaacgaggaccggcctgatgatgctctgcagacggcactaaagagacgaagagatctgcttcagcgcctcagggagcaacacctgctggacgagctgagtcgggcacaggcatggtccgggccttccaggggggctctcggcagcgccctgcccccggaacttccccctactggaattctcccaacagcttccccctcccctctcgctcccgacccgccaagaattatcttacccacagtgccacagccgccggccaccatcattcaacagctgcctcagcaacccttgatcgcccagatacctccgcctcaggcatttcctacccagcgatcaggaagtatcaaagaagatatggtggaactgttactactccagaatgcccaagtccaccaactggtgctgcagaactggatgctcaaggcattgccccctgccctacaagatcctccccatgttcccccccgggtgccaagagcggcccgcccaaggttgccggctgtccatcaccatcatcaccatcatcacgcagtctggcctcctggagcagccacagttttacagccagctccaagtctatggacaccaggacccccatag

SEQ ID NO: 45519 - DNA, 660 bp, Artificial Sequence
  Description of Artificial Sequence: Synthetic coding sequence
atggccccccccagccggcactgcctgctgctgatcagcaccctgggcgtgtttgccctcaactgttttactaagggtcagaaaaacagtacactaattttcacccgtgagaatacaatccggaattgctcttgcagtgccgatattagggactgtgactattccctcgctaacctgatgtgcaactgcaaaacagtgctgccactggccgtcgaacgcactagctacaacggacaccttactatttggtttactgatacatccgcgctcggacacctcctcaatttcactcttgtgcaggatctcaaactgtccctgtgctccactaataccctgcccactgaatatctcgccatctgtgggctgaagcgcctgcgaataaacatggaggccaaacaccctttcccagaacagtcactgctcattcactctggcggtgattcagactctcgggaaaagccaatgtggttacacaaggggtggcagccatgcatgtatatcagtttcctggatatggccctttttaaccgcgactcagcgttcaagtcatattccattgagaatgtgacatctatagcaaacaacttcccggatttctcttactttcgcacctttcccatgcccagcaacaagtcctacgttgttacattcatttactag

SEQ ID NO: 45520 - DNA, 660 bp, Artificial Sequence
  Description of Artificial Sequence: Synthetic coding sequence
atggccccccccagccggcactgcctgctgctgatcagcaccctgggcgttttcgcactcaactgttttacgaagggacagaaaaactctactcttatcttcactcgcgagaatacaataaggaattgtagctgcagtgctgatatcagggattgtgactacagtctcgccaatttgatgtgcaactgcaaaacggtgctacctctggcagtcgaaaggacctcctacaatggccacctgacgatatggtttaccgatacttctgctctcggccacctcctcaactttactcttgtgcaagacctcaagctgtcactgtgctctaccaatactcttcccaccgagtatcttgccatctgtggcctaaagagacttaggattaacatggaagctaaacatcccttccctgagcagtctcttctcatccactcaggcggggactctgacagcagagaaaaacccatgtggttacacaagggatggcagccttgtatgtatatttcttttctcgacatggccctcttcaatcgcgacagtgccttcaaaagctattctatcgagaatgtgacctctattgcgaacaacttccccgacttctcttactttaggaccttccctatgccttctaacaaatcctatgtggtgaccttcatctactag

SEQ ID NO: 45521 - DNA, 660 bp, Artificial Sequence
  Description of Artificial Sequence: Synthetic coding sequence
atggccccccccagccggcactgcctgctgctgatcagcaccctgggagtgtttgccctcaattgttttacaaagggtcagaaaaactctaccttaatttttactcgggaaaataccattaggaattgctcatgctccgccgatattagggactgtgactattccctcgcaaaccttatgtgcaattgcaaaacagtactgcctcttgctgtagagcgcacatcgtacaacggccacctcaccatttggttcacagacacctccgccctgggccacttacttaactttactctcgtacaggatctgaaattaagcctgtgctccacaaacacgctacccacagaatatctcgctatttgcgggctgaaaaggttacgcattaacatggaggccaaacatcccttcccagagcaatcgctgctgatccattcaggcggggatagcgacagtcgggaaaagcccatgtggcttcacaaaggctggcagccatgcatgtatataagctttctggacatggctctgttcaaccgggattccgcttttaaatcctacagtatcgagaacgtcacttcaatcgctaataatttccctgacttcagctactttcgaacattccccatgccttcaaataaaagctacgtcgttacatttatttattag

SEQ ID NO: 45522 - DNA, 660 bp, Artificial Sequence
  Description of Artificial Sequence: Synthetic coding sequence
atggccccccccagccggcactgcctgctgctgatcagcaccctgggtgtttttgctcttaattgttttactaaggggcagaaaaactcaacgctgatattcactcgggaaaacacgatcaggaattgttcatgctctgcagacatcagggactgtgactatagcctagccaatttgatgtgtaactgtaaaaccgtcttgccgctcgcagttgagagaacctcttacaatggccaccttacaatttggttcactgacacttctgctctcggacatctgttaaacttcactctggtccaagatttaaagctttccttatgctccaccaacacgcttcccacagagtatctggccatctgcggcctgaagcggctccgtatcaacatggaagcaaaacatcccttccctgagcaaagcctgctgatccactccggtggtgacagtgatagtcgggagaaacctatgtggttacataagggctggcaaccatgcatgtatatttcctttttggacatggccctttttaatagggactcagcattcaagagttactctatagaaaatgtgacttctatcgctaacaattttcccgacttctcatactttcgaactttcccgatgcccagcaacaaaagctacgtggtcacattcatttattag

SEQ ID NO: 45523 - DNA, 198 bp, Artificial Sequence
  Description of Artificial Sequence: Synthetic coding sequence
atgggcaacccccggctgccccggctgctgtgcgccctgaagttctcgggctttttaagcaatattcgaggcccgctcgccggcgaggacggaatgggagatacacagctggctagagtgagagactccgccctcaaaacaccctggagacccgctccatgcccccctccagctcattccctggatgattggaagtag

SEQ ID NO: 45524 - DNA, 894 bp, Artificial Sequence
  Description of Artificial Sequence: Synthetic coding sequence
atgaacgaggaggagcagttcgtgaacatcgacctgaacgacgacaatatatgcagcgtatgcaagcttgggaccgacaaagaaaccctgagcttttgccacatttgctttgaacttaatatcgagggcgttcctaaatccgacctcctccacactaagagcttgcggggccacaaagattgtttcgaaaagtatcatttaatcgccaaccaggggtgtcccagatccaaactatctaagtccacctatgaagaggtcaagacaattctgtctaagaaaattaattggatcgtgcagtacgctcagaataaagacctggattcagattccgaatgctctaaaaatccccaacatcatttattcaatttcagacacaagcctgaagagaagctgctgcctcagttcgatagccaggtcccgaaatactcagctaaatggattgacggatcagctggagggatatcaaactgcacccagcgtatcctggagcaacgggagaacactgatttcggcctaagtatgctacaagactccggcgccactctttgtcgaaattccgtgctgtggccccattcacacaaccaggcccaaaagaaagaggaaaccatatcatccccagaagctaacgttcagactcagcaccctcactacagccgggaagagctcaattcgatgacccttggagaggtagaacagctcaacgccaagcttctgcagcagatacaggaagtgtttgaggaactaacacatcaggtccaggaaaaagacagtctcgctagccaacttcacgtcaggcatgttgccatcgagcagctcctcaagaattgttctaaactgccttgtttgcaggtgggtcgcactggcatgaaaagtcatcttcctattaacaactag

SEQ ID NO: 45525 - DNA, 891 bp, Artificial Sequence
  Description of Artificial Sequence: Synthetic coding sequence
atgaacgaggaggagcagttcgtgaacatcgacctgaacgacgacaacatatgctcagtttgcaaactggggactgataaagagacgctttctttttgtcacatatgctttgaactaaatatcgaaggtgtgcctaaatctgatttgcttcatacaaagtctctgcggggccacaaggactgtttcgagaagtatcacttaatcgccaatcagggctgtccaagaagcaagctctctaaaagtacttacgaagaggtcaaaaccatcttgtcgaagaagattaattggattgtacagtatgcccagaataaggatctggattcagactccgagtgcagcaaaaatccacagcatcacctgttcaatttcaggcacaagccagaggagaagctgctgccgcagttcgattcacaggttccgaaatattccgcgaagtggatcgacggcagcgctgggggcatctcaaattgcacgcagaggattttagaacaacgcgagaacacggactttggcttgtcaatgctgcaagacagtggggccacactctgtcgtaatagcgtgttatggccacatagtcataatcaggcgcagaagaaggaggaaaccatttctagccccgaggcaaatgtacaaacacagcacccacattatagccgggaagagttgaactcaatgacattaggagaagtcgagcagctgaacgccaaactgcttcaacagatccaggttttcgaagagcttacacaccaggtgcaggaaaaggattctctggccagtcaacttcatgtccgacacgtggcaattgaacagctcctaaagaattgctctaaactgccctgccttcaggtgggaaggactggcatgaagagtcacttaccaatcaataactag

SEQ ID NO: 45526 - DNA, 729 bp, Artificial Sequence
  Description of Artificial Sequence: Synthetic coding sequence
atgaacgaggaggagcagttcgtgaacatcgacctgaacgacgacaacatctgttcagtctgcaaactggggacagacaaggagacattatcgttctgtcatatttgcttcgagctcaatatagagggcgtgcccaaaagtgatctccttcacactaaatcccttagaggtcataaggattgtttcgaaaagtaccatctgattgccaaccagggctgccccaggtctaaactgagcaaaagcacgtatgaggaagtgaaaaccattttatccaagaaaatcaattggatcgtgcagtatgcccaaaataaagatctggattcagactctgagtgctccaagaacccgcagcatcatttgtttaattttcgtcacaagccggaagaaaagctgctaccacaattcgactctcaggtcccaaagtattcggctaaatggatcgatggctcagctgggggcatatcaaactgcactcagagaattcttgagcagagagaaaatactgattttggtttgtcaatgctacaggactccggagccaccttgtgccgaaactcggtattatggcctcactcccacaatcaggcccagaagaaagaggagacgatctcgagtccagaagcaaacgttcagactcagcatccacactactctagggaagagctcaatagcatgactctcggcgaagtggaacaactaaacgccaagctactccaacagatccagtag

SEQ ID NO: 45527 - DNA, 666 bp, Artificial Sequence
  Description of Artificial Sequence: Synthetic coding sequence
atgaacgaggaggagcagttcgtgaacatcgacctgaacgacgacaatatctgttctgtatgtaagctgggcaccgacaaggaaactctctctttttgtcacatttgcttcgaactaaatattgagggcgttcccaagtcagacctgcttcatacgaagagcctccggggccataaagattgctttgaaaaataccacctgatagccaaccagggatgcccccggagcaagctgagcaaaagtacttacgaggaggtgaagacgattctaagcaagaaaattaactggattgtacagtacgcccagaacaaggaccttgactccgactctgagtgtagcaagaatccccagcaccacctttttaacttcaggcataaaccggaagaaaaactcttgccgcaatttgatagtcaggtgccgaagtattctgctaaatggattgatggaagtgccgggggtatcagtaactgcacacaacgcatcctcgaacagagggagaatacagattttggtttatcaatgctgcaggactccggggccacgctgtgccggaactctgttctgtggccccatagccacaatcaggcacaaaagaaagaggaaacgatctccagtcccgaagctaatgtccagacacagcaccctcactatagccgggaggaatag

SEQ ID NO: 45528 - DNA, 723 bp, Artificial Sequence
  Description of Artificial Sequence: Synthetic coding sequence
atgcggaccgaggccgaggccgccggcccccccctggagcccggcgactttgtgcaactccccgtcccagtgattcagcagctgtaccactgggattgtggcctagcgtgctccagaatggtgctcaggtaccttggtcagctggatgatagcgagtttgagcgcgccctgcagaaactccagctgactagaagtatctggacaattgacttggcctatctaatgcaccacttcggagtccggcacagattttgtacccagacactgggcgtggacaagggatataagaatcagtccttctatcgtaaacactttgacaccgaagagacgcgggtgaaccagctttttgctcaggcgaaggcatgtaaagtgctcgtcgaaaagtgcactgtatcggtgaaagacattcaagcccatctcgcgcagggtcacgtcgccattgtcctggtcaattcaggggttttgcattgcgacctatgttccagccccgtcaagtactgttgctttaccccttccggacaccactgtttctgccgcacacccgactaccaaggccacttcatcgtgctgcggggctataaccgcgcaacagggtgcatcttttataacaaccccgcctacgctgatccggggatgtgctctaccagtatctcgaattttgaagaagcccggacaagctatggtaccgatgaagatatcctctttgtctacctcgactcatag

SEQ ID NO: 45529 - DNA, 384 bp, Artificial Sequence
  Description of Artificial Sequence: Synthetic coding sequence
atgcggaccgaggccgaggccgccggcccccccctggagcccggcgactttgtgcaactgccagtgccagttatccagcagctctaccactgggattgcggcctggcttgctcaaggatggttttgaggtatttgggccagctggatgacagcgagttcgaacgcgcactgcagaaactccaacttacaaggagcatctggaccattgacctggcttacttaatgcatcacttcggggtacgccaccgcttttgtacccagaccctcggtgtggataagggctacaaaaaccaaagtttctatcgcaaacacttcgacaccgaagaaacgagggtgaaccagttgttcgcccaggctaaggcttgtaaagtgttagtggagtag

SEQ ID NO: 45530 - DNA, 429 bp, Artificial Sequence
  Description of Artificial Sequence: Synthetic coding sequence
atgttcatcaaggtgatgttcggcgccggctgcagcgtgctggtgaacacaagctgcaggttggtcaaccttacagcccacttgagacagaaagctggcctgccgccggacgctaccattgctctgctggccgaggacgggaacctggtgtcgttggaagaggatcttaaggaaggagcaagtcgggcgcagaccatgggtaactcactactgaaagaaagggccatctacgtgctcgtccgaattatttccaaagttgcacaggaaggtgaagatatggcttccacccgctatgaatctttactggagaacttggacgaccactacccggagcttgctggggccaatcgacaacaacccagcaggactcctctggccgagagcggcatcgctgagaaattacatcagcaggagggtcagggacagtag

SEQ ID NO: 45531 - DNA, 429 bp, Artificial Sequence
  Description of Artificial Sequence: Synthetic coding sequence
atgttcatcaaggtgatgttcggcgccggctgcagcgtgctggtgaatacgtcttgtcggctggtgaacctgaccgctcatctgcgccaaaaagccggcctccctccagatgccactattgccctgctagccgaagatgggaatctggtgtcattggaggaggacctcaaagagggtgcctctagggcccagacgatggggaacagccttctgaaagagcgcgccatatatgtcctggtcaggattatttcaaaagtggctcaagagggcgaggatatggcctccaccaggtacgaatccctccttgaaaatttggacgaccattaccctgaactggccggcgccaaccgccagcagccttctagaacacccttggcggagtctggtatcgctgagaagcttcatcagcaggaagggcagggtccttag

SEQ ID NO: 45532 - DNA, 447 bp, Artificial Sequence
  Description of Artificial Sequence: Synthetic coding sequence
atgttcatcaaggtgatgttcggcgccggctgcagcgtgctggtgaatacttcatgtcgattggtgaaccttaccgcacatctccggcaaaaggccgggttgccccccgatgccactatcgcactgttggcggaagatggtaacttggtatccttggaagaagatctgaaggagggcgctagccgcgcccaaactatgggaaattccctcctgaaggagagggccatctacgtcctggtgagaataatcaaaggagaggatatggccagtacgagatacgagagtctgctcgaaaacttagacgatcattaccctgagcttgctgaggaactccggcggctctcaggcctaagctccgtggggcataattggcgtaaaagaatgggcacccggcgcggtaggcatgagcagtcgccgaccagcaggccacggaagggaccagactag

SEQ ID NO: 45533 - DNA, 654 bp, Artificial Sequence
  Description of Artificial Sequence: Synthetic coding sequence
atggccagccagaagcagatggaggtggtgaccaagggcaccggcttcaggaggcgccctaaaactattacatatacccccgggacttgcgaattgctaagagtcatgatgaaggagagcaaactcacgaatatccagcagcggcacattatggacattatgaagagaggggacgccctcccactgcagtgcagccccacgtccagccagagagtgctgccttccaaacagattgcgagcccaatttatctccctcctatcctggctgccagaccccacttgaggccagccaacatgtgtcaagctaacggggcctactccagagagcagtttaaaccccaagcgacacgagatctagaaaaggagaagcaacgtcttcagaatatttttgcgactggtaaggacatggaagaacggaagaggaaagctccccccgccagacagaaggcccctgcgccagaactcgaccggtttgaggaactcgtaaaagagatacaggaacgaaaagaatttcttgccgatatggaggccctgggccaaggaaagcaatataggggtattatcctggcagagatctcccagaaattaagggagatggaggacattgatcacaggcgttccgaggagctgaggaaagggctggccactacctag

SEQ ID NO: 45534 - DNA, 654 bp, Artificial Sequence
  Description of Artificial Sequence: Synthetic coding sequence
atggccagccagaagcagatggaggtggtgaccaagggcaccggctttaggcggagacccaaaaccattacttacacacctggtacctgcgagttacttcgggtgatgatgaaagagagcaaactcacaaatatacagcagcgacatatcatggatattatgaagagaggcgatgccctgccattacaatgtagtcccacttcttcgcagcgggtgctgccgtcgaagcaaatagcgtcccctatttatctgcctcccatcctcgctgctcgccctcacctgaggcccgctaatatgtgccaggctaacggcgcttactctcgcgagcagttcaaacctcaggctaccagagatttagagaaggagaagcagcgcctccagaacatcttcgccactggaaaggacatggaggaacgaaaacggaaggctccccctgcccgccagaaagctcctgctcccgaactcgatcgctttgaagaattagtcaaagagatccaggagcgcaaggagtttcttgcggacatggaagcactaggccagggcaaacaatacagggggatcatcctggctgagatatcccagaaacttcgggagatggaggacatagaccaccgacgaagtgaggagctccggaaaggtctggcaactacatag

SEQ ID NO: 45535 - DNA, 654 bp, Artificial Sequence
  Description of Artificial Sequence: Synthetic coding sequence
atggccagccagaagcagatggaggtggtgaccaagggcaccggctttaggcgcaggcctaaaaccataacctacacacctggaacatgtgaacttctgcgagtgatgatgaaagaatcaaaattgaccaacatccagcagaggcacataatggatataatgaaaaggggtgacgctctcccgttgcagtgttctcctacctctagtcagagggtcttacctagcaagcagattgcctctcccatttatcttccacctatcctggccgcgcggccccatttgaggcctgctaacatgtgtcaggctaatggcgcatattctcgagaacagtttaaaccccaggccacgcgcgacttggagaaagaaaagcagaggcttcagaacatctttgcaactgggaaggacatggaagagaggaaacgtaaagccccacctgcacgtcagaaggcacccgcccctgagctggacagattcgaggaactggtgaaagagattcaggagcggaaagagttcctggctgatatggaagccctaggccagggaaaacaatataggggaattatcctggccgaaatctcccagaaacttcgggagatggaagatatcgatcacaggcggtctgaagaactgagaaagggcctggccacgacttag

SEQ ID NO: 45536 - DNA, 489 bp, Artificial Sequence
  Description of Artificial Sequence: Synthetic coding sequence
atggccagccagaagcagatggaggtggtgaccaagggcaccggctttcggagaagacctaaaacaatcacctacaccccaggcacctgtgagctattgagagtcatgatgaaggagagcaagttgaccaatatacagcagaggcatatcatggacattatgaagaggggagacgcactacctcttcagtgctctcccacctccagtcaaagagtactgccctctaagcaaatcgccagccccatttacctgccgcccatcttggccgccagaccacacctgagacccgcgaatatgtgccaggcaaacggcgcctacagtagggaacagttcaagcctcaggccacgagggatttggaaaaggaaaaacagcgactgcagaacatcttcgctactgggaaagatatggaagaacgaaaacggaaggcaccccccgctaggcagaaggcacctgctcccgaactggacagatttgaggaactagtctag

SEQ ID NO: 45537 - DNA, 363 bp, Artificial Sequence
  Description of Artificial Sequence: Synthetic coding sequence
atggccagccagaagcagatggaggtggtgaccaagggcaccggcttccggcgccgtcctaaaactatcacctacaccccagggacctgtgaactgctgagagttatgatgaaagaatcaaagcttacaaacattcagcaacgacacatcatggatattatgaagaggggcgacgcgctcccactgcagtgctcccctacctcatctcaaagagtgctgccctctaagcagatagcttcacctatctatctcccacccatcctggccgcccggcctcacctgagacctgccaacatgtgccaagccaacggggcctatagccgggaacaatttaaaccccaggcaacccgcgaccttgagtag

SEQ ID NO: 45538 - DNA, 417 bp, Artificial Sequence
  Description of Artificial Sequence: Synthetic coding sequence
atgcccgccagcgccaccgccgcctggcactgcccccccctgtgcttgcctccccttccggcctctgcccccacctcacccccaaatcctgcgactaggccagctcccggacccggaagaagagctcggtgtccccagagtgcacacccagcacccacacgcggtgccttaacgttctgggctccagggagctggccaagagttctccttgtgcctcggtccccaggcccggtcctgcgcgcgccaaggctgcctcaccctgccgctcgggccaggaggcgcgcctggcacggcgcgagactgcctggatccccagcccgggcgggtcggacctttcaacgcggattagtttcgaactcctgggctcacgccatctttctacctcgtccccccaatgtgcttgagcttcaggtgtag

SEQ ID NO: 45539 - DNA, 417 bp, Artificial Sequence
  Description of Artificial Sequence: Synthetic coding sequence
atgcccgccagcgccaccgccgcctggcactgcccccccctgtgcctgcccccacttcctgcctcggctccaacgagtccaccaaatcccgcaacgcggcccgccccaggacctggtagacgggcacggtgtcctcagtctgcccatcctgcccctacccggggtgcattgactttctgggccccagggagctggccaagggtcttgctggtgccgcgtagcccgggtcccgtcctgcgcgcccccaggttgccccatccagctgcccgagccagaagacgggcttggcacggggccagactacccggatctccagctcgggccggcaggaccttccaacgagggctggtgagcaattcatgggcccacgctatattcctgccacggccccccaatgtgctggaactgcaggtttag

SEQ ID NO: 45540 - DNA, 1095 bp, Artificial Sequence
  Description of Artificial Sequence: Synthetic coding sequence
atgccccggggccggtgccggcagcagggcccccggatccccatctgggccgccgccaactatgcgaacgcacacccctggcaacagatggataaggcaagcccaggcgttgcttacacgccgctggtcgacccttggattgaacgaccttgctgcggagacacagtgtgtgtgcggacgaccatggaacagaaatctacagcctccggcacctgcgggggcaagcctgctgagcgtggtcccctggctggccacatgccctccagtagacctcacagggtggacttttgttgggtcccaggctcagatcccggcacctttgacgggtccccttggctgctggatcgcttcttggcacagttgggagattacatgtccttccatttcgagcactatcaggataatatcagcagagtctgcgagatcctcaggcgtctgactggcagggcgcaagcttgggccgctccatatcttgatggggatctgcctctgcccgatgactatgagttgttttgtcaagatctgaaagaggtagtgcaggatcccaattcttttgctgagtaccatgccgtggtgacatgccctctgccactcgcctcttcccaacttccagtggccccgcagctgcccgtggtgcgacagtacctcgccaggttcttggagggccttgcccttgacatggggaccgccccccggagtctgcctgcagcaatggctactcctgctgtttccgggagcaatagcgttagtagaagcgctttgtttgagcagcagctgaccaaggagtcaacacccggtccgaaagagccgccggtgcttccgtcctccacatgcagctccaaaccagggccggtagaacccgcctcatcgcagccagaggaggctgcacccaccccagtgccccgtctgagcgagagtgccaatccacccgcacaacgacctgatcccgcgcatcctggaggccctaagccacagaagaccgaggaagaggtgctggagacagagggcgatcaggaggtctccctcggcacaccccaggaggtggtcgaggcccccgagaccccgggggagccacctctgtccccaggtttctag

SEQ ID NO: 45541 - DNA, 1095 bp, Artificial Sequence
  Description of Artificial Sequence: Synthetic coding sequence
atgccccggggccggtgccggcagcagggcccccggatccccatctgggcagcagctaactatgctaatgcacacccatggcagcaaatggacaaggcctcacctggcgtggcgtatacaccgctggtcgacccctggattgagcgtccttgttgtggagacactgtctgcgtgcgaaccacaatggaacagaagtccactgcttctggcacttgtggaggaaaacctgccgaacggggtcccttggcggggcatatgccttcctcaaggccacacagagtggatttctgttgggtccctgggtcagacccgggtaccttcgacgggagtccttggcttctggataggttcctggcccagctaggggattatatgagctttcattttgagcactaccaagataatatatctcgggtctgtgagatcttgcgacgcctgacaggtcgagcacaggcctgggccgccccttacctagacggggaccttcccctgcccgatgactacgagttattttgccaggatctcaaggaggtggttcaggatcccaatagttttgccgagtaccatgccgtcgtgacctgtcccctgcctcttgcatcatcacaactgcccgttgcccctcagctacccgtggttcgacagtacctggccaggtttcttgagggcctcgcgctcgacatgggcaccgctcccaggagccttcccgccgccatggccacccctgccgtgtcaggctccaactcagtctccagaagtgctttatttgagcagcagctgactaaagagtcaacccctggacctaaagagcctcctgtcctcccaagctccacgtgttcatctaaaccaggaccagttgagcctgcttcaagccagcccgaagaagcagcacccacccccgtccctagattaagcgagagtgcaaaccctcctgcccagcgtcctgatcccgcccaccccggaggacccaagccgcagaagacagaggaagaggtactggaaacagagggggatcaagaagtctccctgggaacgccccaggaggtggtggaggcgccagagacccccggagaaccaccactgagccccggcttttag

SEQ ID NO: 45542 - DNA, 1095 bp, Artificial Sequence
  Description of Artificial Sequence: Synthetic coding sequence
atgccccggggccggtgccggcagcagggcccccggatccccatctgggccgccgctaactatgcaaatgcccacccttggcaacagatggataaggcgagccctggggtagcatacactccgctcgtagacccctggattgaaagaccatgttgcggggataccgtctgtgtcagaacgactatggagcagaagagtaccgcttccggcacctgtggtggtaaacctgcggagcgggggccgttggcgggccacatgccttcgtctcgtccccatagagttgatttttgttgggtgccgggcagcgatcccgggacttttgacgggtccccctggctactggataggtttctggctcagctgggcgactatatgtcattccacttcgagcactaccaggacaacattagcagagtctgcgaaattctccgaaggctgacaggtcgtgcacaagcctgggcagccccatacctcgatggagaccttccactcccagatgactacgagcttttctgccaggatctcaaggaggtggtccaggacccaaactcgtttgctgaataccacgctgtggttacgtgccccttgccactggcaagttcacaactccctgtcgcgccacagctccctgtagtccgacaatacctggcccgtttccttgagggactggctctggacatgggtacagccccccggagtttaccagcggctatggccactccagcagtaagcggtagtaattcggtgtccaggtcagctctgtttgagcagcagctcaccaaggaaagcacccctggtcccaaggagcccccggttttaccatcatccacctgttcttcaaaaccggggcccgtagagccagcctcgagccaaccagaggaggcagcccctacacctgtaccacgactgtccgagagtgcgaaccctcccgcccagcgcccagaccctgcacatccaggcgggccaaagcctcagaagactgaggaagaggtgctcgaaactgagggcgaccaggaggtctcactgggtacgccccaagaggtagttgaagctcccgagaccccaggggagcctccattgtcacctggcttttag

SEQ ID NO: 45543 - DNA, 318 bp, Artificial Sequence
  Description of Artificial Sequence: Synthetic coding sequence
atgggcgagaccgagggcaagaaggacgaggccgactacaagcggctccagacatttcctctggtgcgccacagcgacatgcccgaagagatgcgggtggagaccatggagctctgtgtaacagcatgcgagaagttttcaaataataacgagtcggccgcaaaaatgattaaggagaccatggataagaagtttggcagctcctggcacgtggtcattggtgagggatttggtttcgaaatcacacatgaggtgaaaaaccttttgtacctttactttggagggaccttagcagtgtgcgtgtggaaatgtagctag

SEQ ID NO: 45544 - DNA, 843 bp, Artificial Sequence
  Description of Artificial Sequence: Synthetic coding sequence
atggagctgggccacggcgccggcaccaccaccttcacccgggcccacctaaacgacaaagagggccaacaggacctggacccttggaaagctgcctatagcagcttggacacatccaaatttaagaaccaggggctgtcaagccctcagcctctgccgctgggggcttcagctcagggaagctctctggggcagtgccacctcaaggaaatacccccccctcctccaactgctgcctcgagggactccctggggatggaccctcagagtcggagcttgaagaacgctggcagccgaagctccagtcgggagaacagggcaacaagcggcgagggcgcccagccgtgtcagggaaccgacgacgggcctagcctgggagcccaagaccaaaggagtacccctactaaccagaagggctcaattatccccaacaacatcaggcataaatttggctcgaacgtagtcgaccagttagtctccgaagaacaggcacagaaggccattgatgaagtctttgaaggtcagaagagagcatcctcctggccctcacgcactcagaaccccgttgaaatctcatctgtgttctccgactattacgatttagggtacaatatgaggtctaacctgttccgcggagcagctgaggagaccaagagcctcatgaaagcaagctacacaccagaggttatagagaaatctgttagggatcttgaacactggcacggcagaaaaactgatgacctcggtagatggcatcagaagaacgctatgaacttgaacctgcagaaagccctggaggaaaagtacggcgagaactccaagagcaagtcatctaagtactag

SEQ ID NO: 45545 - DNA, 588 bp, Artificial Sequence
  Description of Artificial Sequence: Synthetic coding sequence
atggacccccagagccggagcctgaagaacgccggcagccggagcagttctagggagaaccgtgctacgtctggggagggtgctcaaccttgtcagggcacagatgatgggcctagtctcggcgcgcaagaccagaggtctaccccaacaaatcagaaaggttctataattccaaacaacatcagacataagtttgggagcaacgtggttgaccagctggtgagcgaagaacaggctcagaaggctattgatgaggttttcgagggccagaaacgggcttcttcatggccttcacgcacccagaatccagtagaaatttcttctgtgttcagcgactattacgatctgggctacaatatgcgatccaatctgttcaggggtgcagctgaagagaccaagtccctgatgaaagcatcttatactcctgaggtgatcgaaaagtctgtacgcgatctcgagcattggcacgggcggaaaactgatgatttgggccgctggcaccagaagaatgcgatgaacctgaacctacaaaaggctttggaagaaaagtatggggagaactccaaaagcaagtccagcaaatattag

SEQ ID NO: 45546 - DNA, 843 bp, Artificial Sequence
  Description of Artificial Sequence: Synthetic coding sequence
atggagctgggccacggcgccggcaccaccaccttcacccgggcccacctgaatgacaaggaggggcagcaagacttagacccatggaaagcggcctacagttccctcgatactagtaagtttaaaaatcaaggcttatccagtccacagccgctccctctgggcgcctccgctcaagggtcatcactcggacaatgccacctcaaggaaatcccacctccaccgccgaccgccgcttccagagatagcttagggatggatccacaaagcaggtcccttaaaaatgctgggagcaggagctccagccgggaaaacagagcgacctctggcgagggcgcccagccctgtcagggaactgacgacggtccttccttgggcgcccaggaccaaaggagcacacctacaaaccagaaggggtcaatcatccccaacaacatcagacacaagtttggcagtaatgtcgtggatcaactcgtgtcagaagagcaggcgcaaaaggcgatcgatgaggtcttcgagggccaaaagagagcttcctcctggcctagtagaactcaaaacccggttgagatttctagcgttttttctgactattatgacctagggtacaatatgaggtccaacttgtttcggggcgctgccgaagaaacaaagtctctaatgaaagcctcctataccccagaggtgattgaaaagtcggtgcgggacctggaacattggcacggccggaaaactgatgacctgggcaggtggcatcagaaaaacgccatgaatttgaatcttcaaaaggctcttgaggaaaaatacggcgaaaactccaaaagcaagagctccaaatactag

SEQ ID NO: 45547 - DNA, 552 bp, Artificial Sequence
  Description of Artificial Sequence: Synthetic coding sequence
atgatcgtgttccccgagaccagccagccccggttcctgtacagccttcaaaactacgcagtgagagatgggctggggacaatcctcagaggcggagccgaggaagggtcctatgataactggccccacacccgtaagagctgggggcccctctccccgggacaccagcgtgagttatggacacagcccgatccttggactgaagtgctctccggacataaaggggacgccggtgcctgcggctgctgctgtttctgttctcagtttatcaatgcgcggtgtgctcatcccctctgtcttgctaggggcctggaccggcgggcctccgaagagatgccaattctgcaggccctgtgcctgctgcccaaagagaacctgcatgacgctagtagacgcgtccatagaggccgcggcgaggaaaacgtggagtggactggagatctacaccctgcacagctggggagaggagggcgtccagagatttgtcactccctagaggccattgctctggtgaccaaagcgcgtcaccgaaaaacaaacactactttttag

SEQ ID NO: 45548 - DNA, 1089 bp, Artificial Sequence
  Description of Artificial Sequence: Synthetic coding sequence
atgtgcaccgtggacgtggagggcttcgacgacgtgggcgagaccctgtctgacgcagtgcgtgatgggctcggcacaatcttacgggggggtgctgaggagggctcatacgataactggccccacacaagaaagtcatggggacccctgtccccaggacaccagcgtgaattgtggacacagccagacccatggacggaggttttatctggacacaaaggagatgctggggcttgcgggtgctgttgtttctgctcccaatttattaatgcaaggtgcgcccaccctctctgcctggcccggggtctcgaccgtcgcgccagtgaggagatgcctattttgcaggcgctgtgcctgttgccgaaagtgtccacaccgtccattactgtgttatcaccgcaacggagcgcggccccctcgataacggtgccatcaccacaaagatccgcagctccaagcattaccgttcctagcccccagcgctccgcccccagagcctcattatgtccgccccacaaaggccagcatcccgaacaccactgtgctctgcctcccaagggccagcatccagagcatcattgtgcgcttcctaccaaagtttcaactccatcaatcaccgtgccctccccccagcggagcccccagatgtccttgagctctgctgccaggggatcaaataccgacgtggccggactttccgtaggcgaatggcctggctggcagctttggggagagggtcaggatggagcccaacaacgccctcatctgccatctggtgggagtggagccggtgttgccccacaacggctccctaaatctcgtgcatgcatcttgtgctcacggcacggagctcagggcccatgggtcaccggccgcagcgtaagtcacagccattgtcctatccaaggcctgctggacctccagcgtcccgatctcggtaccgactggggtcgcactcgaccattatgcaccccgcaagatttgtgcggcggacgcccactcccctctacttggggtgtgaccatgcacttgatacattgtctgtcagtgtcgctgagcctgtgcctgagtttgagccattgcgtgtag

SEQ ID NO: 45549 - DNA, 429 bp, Artificial Sequence
  Description of Artificial Sequence: Synthetic coding sequence
atgtgccggtgcagcctggtgctgctgagcgtggaccacgaggtgcctttctcctcattttttatcggctggcggactgagggccgtgcctggagggccggtcggcctgatatggccgatggatccggttggcaaccaccacggccctgtgaggcctaccgggccgaatggaaactgtgtcggtctgcaaggcacttcctccatcactattacgttcatggggaacggcccgcttgtgaacaatggcagcgcgatttggccagctgcagagactgggaggaacgcaggaatgcggaggctcagcagtccctctgtgaatcggagcgggcgagagtgcgtgcagcgcgcaagcatattctggtctgggcccctcgacagagcccccctcccgattggcacctacctcttcctcaggagaaagatgaatag

SEQ ID NO: 45550 - DNA, 318 bp, Artificial Sequence
  Description of Artificial Sequence: Synthetic coding sequence
atggccgacggcagcggctggcagcccccccggccctgcgaggcctaccgagcagagtggaagctgtgtaggtctgcccgtcacttcctgcaccactactacgttcatggcgagcggcctgcttgtgaacagtggcaaagagatctggcatcttgcagagactgggaagaaaggcggaacgccgaggctcaacagtcgctgtgtgaatcagaacgcgcaagagtaagagccgcccgtaagcacatcctggtgtgggccccacgacagtcccccccaccagattggcatctccctctgccacaggagaaggatgaatag

SEQ ID NO: 45551 - DNA, 354 bp, Artificial Sequence
  Description of Artificial Sequence: Synthetic coding sequence
atgtgccggtgcagcctggtgctgctgagcgtggaccacgaggtgccattcagttccttctttataggctggcggactgaagggcgggcctggcgcgcaggccgacctgacatggccgatggttctggatggcagccacccaggccctgcgaggcctacagagcggagtggaagctgtgtagatcagccaggcactttttacaccactactacgtgcatggcgagcggccagcttgcgaacagtggcaacgggacctggctagctgccgtgactgggaggaaaggagaaatgccgaagcacaggtgttaagcgtcgtcgcgcatacatgcaatttaagctatttaggaggatag

SEQ ID NO: 45552 - DNA, 756 bp, Artificial Sequence
  Description of Artificial Sequence: Synthetic coding sequence
atgggcagcaagctgacctgctgcctgggccccagcggcggcctgaattgtgattgttgccgacccgatgtggggccttgtcatgagtgtgaaatcccggagacggtggctgccaccgcaccagcttccacaaccgccaagccagctaaacttgacctgaaggccaagaaggctcagttgatgcaatacctctcgctgccaaagactccgaagatgttgaaaatgtcaaaaggcttagacgcaaggtctaagcgctggctgaagatcatctggcggaggcacggcatctggccactggagaatatcggcccaacagaagacgtccaagcatctgctcacgggggggtggaagagaatatgaccagtgacattgagatccccgaggctaagcacgatcacaggccaacggaagacgtgcaggttagtgctcacggaggggtagaagaaaatataacttcagatatcgagatctccgaggccaaacatgaccaccatttggtggaggacttatctgagagtctgtccgtttgcctcgaggatttcatgacgtcagacctgtccgaatcgttaagtgtgtccttggaagatttcatgacttcggggcttagcgaatcactttccgtgtcattggaggatctcatgactcctgagatggcaaaggagcggtatgaggactacctctgttgggtgaagatggcccgatcaagattgaatgagcccatctccagccaggtcctaggcctgcttagactttag

SEQ ID NO: 45553 - DNA, 690 bp, Artificial Sequence
  Description of Artificial Sequence: Synthetic coding sequence
atgggcaacatcctgacctgctgcatcaacagccactgcggctggcccaggggaaaagatgccccttgttatgaatctgacacggacatatacgaaactgttgccgcggcgacgtccgagagtacaaccgtggaacctggaaagcttgacgtaggggctacagaaggccaggacctgcagcacatttccaatcaaaaaatgcctactggtcctcccgaagacaggctgtccttgaaatttttgccaagcagcgaagaggataatgatgatgccaagatactaccatcacctgtgcaaggatcatccgaggataatttatccctggtctgtttaccccgcagcgaagacgacgactgtgacgatgatgatgatgacgacgcgcagattcttcctagtagggtgcagggaggatgctatcgcttcgattcttccagctgttcaagcgaggacaatctctccctggtgtgcctgccacgctcggaagatgatgattgtgatgatgatgatgatgatgcgcagattctcccatcgcctgttcaggcttgctctgaggactcattgttcctcagatgttcactgcgccacaaggacgaggaggaggaagacgacgacgacattcacatcaccgcgcgcatcgaatccgatttgactctggagtcactcagtgatgaggaaatccatccaggatag

SEQ ID NO: 45554 - DNA, 480 bp, Artificial Sequence
  Description of Artificial Sequence: Synthetic coding sequence
atggagcaggactggcagcccggcgaggaggtgacccccggccccgaaccttgctccaaaggacaagcgccactctatccaattgtacacgttactgagctgaaacacaccgaccccaatttcccctctaattcaaacgctgtggggaccagctctggctggaaccgaatcggcaccggttgctcacatacgtgggactggagattctcttgtacccagcaggcactgttgccgttactcggagcctgggaatggtccattgataccgaagctgggggtggcaggcgagagcagtcacagaagccatgctccaacggtgggccagcagccgccggcgaagggagagtgttgcctagcccctgctttccatggtctacttgccaggcggcaattcacaaagtctgccggtggcaggggtgtacaaggcccgccctgttagcacctagtctcgccacccttaaagaacacagctatccatag

SEQ ID NO: 45555 - DNA, 480 bp, Artificial Sequence
  Description of Artificial Sequence: Synthetic coding sequence
atggagcaggactggcagcccggcgaggaggtgacccccggccccgaaccatgctctaaaggacaggcacccctataccctattgtccacgtaacagagctaaaacataccgaccccaattttccctcaaattccaatgccgtcggaacctcttccggatggaaccgaattggcaccggctgttcgcacacatgggattggaggttcagctgtacgcagcaggccctgctgcccctgctcggtgcttgggagtggtcaatcgacaccgaggccggcggcggtcgaagagagcagtctcagaaaccctgttctaatggagggcctgcagctgcaggggaaggccgggtgctcccatcaccctgctttccatggtccacttgccaagccgccatacacaaagtctgtagatggcagggatgcaccagaccagcacttcttgcaccaagtttagctactcttaaagaacactcatacccgtag

SEQ ID NO: 45556 - DNA, 669 bp, Artificial Sequence
  Description of Artificial Sequence: Synthetic coding sequence
atggccctgagcgccgagaccgagagccacatctaccgggccctgcggacagcttcaggcgctgctgctcacctggtggccttgggcttcaccatctttgttgctgtgctagctagacctggcagttccctcttctcatggcatccggtgctcatgagccttgccttttcttttctcatgacagaagctctgcttgtattttcacccgagagctccctattgcatagcctctccaggaagggcagggcaagatgccactgggttcttcagctacttgccctattatgcgctttgttaggtctggggctggtaatactgcacaaggaacagttgggaaaggctcatctggtgacaaggcatggacaggctggactcctagccgtactgtgggcaggacttcaatgctccggcggcgtggggctcctatatccaaagttgctgccccggtggcccctggccaaactcaagctttatcacgcgacttctggcctcgtcggataccttctaggctcggcttccctgctgctcggaatgtgcagtctatggttcaccgcatctgtgaccggcgccgcctggtatcttgccgtcctgtgtcccgttctcaccagtttagtgattatgaatcaagtgagtaacgcctatttgtatagaaaacgcatccagccttag

SEQ ID NO: 45557 - DNA, 387 bp, Artificial Sequence
  Description of Artificial Sequence: Synthetic coding sequence
atgaccagcctgttcgcccaggagatccggctgagcaagcggcacgaagagattgtgagccagcgtctcatgctgcttcaacagatggaaaacaagctgggagaccagcataccgaaaaggcctcacagctccaaactgttgagaccgcctttaagaggaacctgtctctactaaaagatatcgaggcggccgagaaaagcctgcagacccgcatccacccgctgcctcgcccagaagtggttagtctggagaccaggtactgggcttccgttgaagagtatattccaaaatgggagcagtttctcctgggcagagcaccctatccattcgcagtggagaatcagaatgaggcagaaaataccatccagaacgaggcccagagatag

SEQ ID NO: 45558 - DNA, 192 bp, Artificial Sequence
  Description of Artificial Sequence: Synthetic coding sequence
atgaccagcctgttcgcccaggagatccggctgagcaagcggcacgaagagatcgtctcacagaggttgatgttattgcagcaaatggaaaacaagctcggggaccagcacaccgagaaagcatcccagctccagacagtggagaccgcgttcaagaggaacttatcactgttaaaagatattgaagcgtag

SEQ ID NO: 45559 - DNA, 387 bp, Artificial Sequence
  Description of Artificial Sequence: Synthetic coding sequence
atgaccagcctgttcgcccaggagatccggctgagcaagcggcacgaggagattgtatcgcagaggctcatgctattgcagcagatggagaataaactgggcgatcagcatactgagaaggccagccagctgcagacagtggaaacggctttcaaacggaatctttctttactgaaagatattgaggcggcagagaagtctctccaaacgcggattcatcctctgcctaggcctgaggtggtctcgcttgaaacccgctactgggcctctgtcgaggagtacatacctaaatgggagcagttcctattgggaagggccccctatcccttcgccgtagagaaccagaacgaggcagagaacacgatccagaacgaagcccaacggtag

SEQ ID NO: 45560 - DNA, 387 bp, Artificial Sequence
  Description of Artificial Sequence: Synthetic coding sequence
atgaccagcctgttcgcccaggagatccggctgagcaagcggcacgaggaaatagtctcccagagactgatgctcttgcagcagatggaaaacaaactcggcgatcagcataccgagaaagcgtcccagcttcaaaccgtggagacagcttttaagcgtaatctcagcctcctcaaagacattgaggccgcagaaaaatccctgcagacacgcatccacccactgccaagacccgaagtcgtctctttagaaactagatactgggcctccgtcgaggagtacatacctaagtgggagcagtttttgctcggccgggccccttacccatttgccgtggagaaccagaatgaggcagagaataccatccaaaacgaggcccaacgttag

SEQ ID NO: 45561 - DNA, 885 bp, Artificial Sequence
  Description of Artificial Sequence: Synthetic coding sequence
atgaccaagggcgacttcatcgacgaggaggtggaggacatgtaccttgttgactttactcagaaaatcatcgataaacgaaaggaaatggaagccagcggagcccaccgagactcgcagaaagccggggaggggacaactatgaggaagactttcctaagagaacgcagtctcctaccaaagacccctgtgaagaatggctggattacttggaccttgtggggagtcccgggtctgtacgagaaggatctgcctgatctccttgagatggacaagaacctccaagggcgtctgttcatatcattgctgatgaagacacttctgtcggaggatatgaggaaggagctccagcgccagcagtgggaggaagaggagcgggaagccctgaaacggccaatggggcctgtgcactacgaggatattcgtgagaatgacggggatgtgattgggcccctgccaccagaacccgaggccgtccccactcctcggccagccgcccaaagcagcaaagtggaagtgatcgtccaggaacgaaaagatactaaaccgggcgtgcctcacatacgagagtgggaccgggggaaagagttttcctttggttactggagcaagagacagtctgatctcagggccgaaagagaccccgaatttgctcctcccagtgattacttcgttggccagaagcgaacaggcttctcctccagtcaggcctggtccaggcccggtcccgctcagtctgatccagggcagtgccccgaccagtctcacggccccagtccagaacacaccagtcccacccctgcccccgataaccccccgcaggctcctaccgttacatttaagacacttgatgatatgatcagctattataagcaggttacttag

SEQ ID NO: 45562 - DNA, 1404 bp, Artificial Sequence
  Description of Artificial Sequence: Synthetic coding sequence
atggaccggcggaagaagcccctggacgtgaccgccagcagcctggtggatctaaaggcagaactctttagaaaacaagaggagtttaaacaggagaagctcctcaaagattccggggtgttcggtaaaccgaagaccactaacaagaaacccagcatatggtctaagcagaatgtgggggtgtctaacagagcggaaaaggacgccgaacagaagattgaggagcaaaagactctcgataaggcacgggaaaagctagaggagaaagctaagctgtatgaaaaaatgaccaagggggattttatcgatgaagaggttgaagatatgtaccttgtcgatttcacccagaaaattatcgataagagaaaagagatggaggccagtggggctcaccgtgatagccagaaagccggcgagagagacgatgacgaagaaaatttaccagaaggggagataccgcctcctcaagaccccagcgaagaatgggttgactacgtggattccctgggtcggtctcgccggtgcatgcgcaaagatctacccgacctgttggagatggacaagaatctgcagggcaggctgtttatttcccctgccaacgagaagacactgttatcagaggacatgagaaaggagctgcagagacagcaatgggaggaggaggaacgcgaggccctgaaacggcctatggggccagtgcattacgaggatatacgggaaaatgaggctcgacagctgggcgtagggtactttgcattcgcccgggacaaggagcttcggaataagcagatgaagaccctggaaatgctaagagaacaaaccaccgatcagcgcacaaaaagagagaatatcaaggaaaaaagaaaggctatcctcgaggccagactagccaaactgagacaaaagaaaatgaaaaaaagtaaagagggcggcactgaggaggagaatcgcgacggggatgtgataggaccactccccccagagccagaggccgtgccgacccccaggccggcagctcagagctcaaaagtggaggtaatagtgcaggaaagaaaagacaccaaaccaggggtgccacacattagagagtgggacagagggaaggagttcagctttgggtattggagcaagcggcagtccgacctccgggctgagcgcgaccccgaattcgcccccccatccgactattttgtgggacagaagaggactggcttctcgtcttctcaggcatggtcccgtcctggacccgcccagtctgatccaggccagtgtcctgaccagagccatggccccagtcccgagcacacctcaccaacccctgcgcctgataaccccccacaggcaccgacagttaccttcaaaactctggatgacatgatcagctactacaaacaggtcacctag

SEQ ID NO: 45563 - DNA, 426 bp, Artificial Sequence
  Description of Artificial Sequence: Synthetic coding sequence
atggacagcagcgcctgcaagaagagccaccagagcaagaagtggagaatccaagctcaggagaatttcgctaaaaagttcccataccgcctaagttggctcactgaacccgaccccgagcccctccagccatgggaggttacgaacgacagcaacacggttcagttgccattgcagaagagacttgtacctacccgttctatccctgtgagaggacttggagccccggacttcacttctccctcagggagctgcccagcccctctccctgcaccctccccccctcctctgtgtaatttatgggagctgaagctattgtcacgtagatttccaagacagttggctttcctcctgtccacacgacatactgaggctgcctgtccacagacttccaaagcagccggcttgagcagaggactcagctag

SEQ ID NO: 45564 - DNA, 534 bp, Artificial Sequence
  Description of Artificial Sequence: Synthetic coding sequence
atggccggctaccagctgtggagcccctggacccccctggacgagtcctttcagtggttgcgacataccaccccaacaccctcctctaaacaccccttcaaggcgagtccttgtttcccccacaccccttccgacctcgaggttcagttatgcttccaggaggtaacgctcgtgttggacagccccttcctggagtcgggagtaagccctaaacttccctgccacacgtctgagcttagaactatgaacaataagggtcttgtccggaaaccccagcccatccggttgtctggtgtggactctgtgttcggacgcgtaatcaccgcccaaccacctaagtggactggtacgttcagagtgtccgacaagagcgctttctgcaagattatcagtagagaacatcagtggcccataggactgaaagaaccccagatccagatgacggtgaccatgtgtaagcagatgctgcgctccatactccttctctatgctacctataagaagtgtaccttcgccctgcagcactcaaagtag

SEQ ID NO: 45565 - DNA, 534 bp, Artificial Sequence
  Description of Artificial Sequence: Synthetic coding sequence
atggccggctaccagctgtggagcccctggacccccctggacgagagcttccagtggttaagacacactacgcccacccctagttccaaacatcctttcaaagcctcgccatgtttccctcacacaccatccgatcttgaagtacagctgtgttttcaggaagtgacattggtgttggatagccccttcctggagtcaggtgtgtctccaaaactcccctgtcacacaagcgagctaagaactatgaacaacaagggcctcgttaggaaaccacaacccattagactatcaggtgtagactctgttttcggtagagtgattaccgctcagcccccaaagtggaccggcacattccgtgttagtgataagtctgccttctgtaagatcatcagtcgcgagcatcagtggccaattggcctcaaggaaccacaaatccaaatgaccgttactatgtgtaagcaaatgttgcgatctatattgcttttatacgctacctacaagaagtgcaccttcgcattgcaacactccaagtag

SEQ ID NO: 45566 - DNA, 1719 bp, Artificial Sequence
  Description of Artificial Sequence: Synthetic coding sequence
atggacgacgactacgaggcctaccacagcctgttcctgagcctgctgggcctatgtccttctaagactccaatcaacgagaacgcgccagtgtttgatcctgaacccgtcattgcccactgtttcaagcaattccaacagaaagattttcgactgcctcaaacgcggagaaggatcatcatggttcccaggaaggaggatcaaacaccgcttaatcctgcgtcgcagccccaagccccccccaaacctattccgtcttttaaagtgctggaagccagagacatccaggagcagccagaagatcggaagacatggctgtcccagaggagtaaactaaggcaggagctcgaatcatttggggacgtcaaaaggtggctcgaaaacaagccttcaattacgcctagcgaggcaaaggtcctgcatatgattcacgaggagcagtcagcgcaaccaaacgcttctcaggctactaccaggacaactaggaagaaagcccctcgcctttcgagactttcgcgccaaatggtgccgcaactgcagttaccggaaccccccgcgctgagtgtgatgtacagctatctccactcacgcaagatcaaaatccttgagatctttcataaggttggacagggcgaaaaccagcgtattacacgagaggagttcatcgcagcagtaaaggcagtgggggtgccgctgaagaaccaggaggtggaagatatcgtgatctacctctcgtccctgggaaaacacaacaccatcacgatggacattctggccaacacatacaaacagtggtccatggcacagcagcgcagtagcttggctactgctagagagcactatattctcgccaagcatagggacagcctcaagggccccctgaagaaacaagaggtcgattctgcccctcaactgcccaaagtggatctcctgactgtgcccgccgtggacacgcagatggaaacccgaccaatgaccctcgaagagatggaggaggtggggaagaggtaccgcgagcggcagcggcagcataagctgacaattccaagcattcagtatacagagcagtgccatctggtgaggtgtggcaatcggcacttcgacgagcattgcctaccttccacgattcacggagacatgagagagctgatcgactctgccagacggcataatttcctcgtttacctccaatgttggaagctgtgtaaaagctatggcttaccgctcactgaggatatcctgatgaaagctctgttatacccaggcgataaaatcatttttcagatggataaagtatgtcccatccgacagccaggaggatattactccgactggaaagtgttctctcccaacttggccctcctgcggagtcagggtccgggcaagagcaagaggaccgacaagaaaaccccgaagaaatcgaaaaaaatgcggttcaaggaattcgaggagttcacgcgtaagttgaaggtcaaacgcagcagtggcctccagcagacgcaccccaacagtttttggccaggccacctcctagataaactccaattgtatctgccaaccgtggcaacagatcgaagcctggccctgttttcctgcgtgcagcatcaaccacacgtctatccggccacctaccatccagaccactggtggcctctgaggaacaaaaattatatgacccacgcccattatgatgcagcaaaagtgtactacatcaactag

SEQ ID NO: 45567 - DNA, 1719 bp, Artificial Sequence
  Description of Artificial Sequence: Synthetic coding sequence
atggacgacgactacgaggcctaccacagcctgttcctgagcctgttaggcctctgcccaagcaaaactcccattaacgaaaatgccccggtatttgaccctgagcctgtgatcgcgcactgtttcaaacaatttcagcaaaaagacttccggctcccccaaactcgcagacgtatcataatggttccccgaaaggaagaccagacgcctctgaaccctgcctctcagccgcaagcacccccaaagccgatcccctcattcaaggtgctggaggccagggatattcaggagcagcccgaggaccgaaaaacttggctgagccaacgatcaaaacttcgtcaggagctggagtcctttggagatgtgaagcgatggcttgagaacaaacccagtatcacccctagcgaggccaaagtgctccacatgatccatgaggagcaatccgcgcagcctaatgcctcccaggcaaccacaagaacaactcgcaagaaagccccacgtctttcccggttgtcaagacagatggtgccccaactgcagctgcccgaaccgcctgcgctatctgtgatgtactcctacttgcattctaggaaaatcaaaatcctggagatcttccacaaggttgggcagggcgagaaccaaaggatcacaagagaagagttcatcgctgccgtaaaagcggtgggtgttcccctgaaaaaccaggaggtggaggacatcgtgatttacctttcttcgctcggcaagcacaacaccatcaccatggacatccttgcaaacacctataaacaatggtcgatggcacagcagagaagttcgcttgctaccgcacgggaacactatatcttggccaaacacagggatagcctcaagggccccctcaagaaacaggaagtcgacagcgctccgcagttgcccaaagtggacctgctaactgtgcccgctgttgacactcaaatggaaacgcgacccatgaccttggaggagatggaagaggtggggaaaagatatagggagcgccagcgccaacacaaactcaccattccaagcatacaatacacagagcagtgccatctggtccggtgtggaaaccggcacttcgatgaacactgtctcccttccaccatccatggggatatgcgcgaactcattgatagtgctaggaggcacaattttttggtctatctgcagtgttggaaactctgcaaatcgtatgggctacctctgactgaggacatcttaatgaaagcactcctctatccgggggataaaatcatctttcagatggataaagtctgccctattcggcagcccggtggctactatagcgactggaaggtgttctcccctaacttagcactgttacgttcacagggaccgggtaagagtaagcgcacagacaaaaagactcccaaaaaatctaagaagatgcgctttaaagagttcgaagaattcacacgaaaacttaaggtgaagcgctccagcggtttacagcagacacaccctaattccttttggccaggtcacctcctggataagctgcaactttacctgcctactgtggcgacagatagatccctcgcgctgttctcatgcgttcagcaccagccacatgtttaccctgcaacatatcatccggaccactggtggcccctgcggaacaaaaactacatgacccacgctcactatgatgcagccaaagtgtactacattaactag

SEQ ID NO: 45568 - DNA, 840 bp, Artificial Sequence
  Description of Artificial Sequence: Synthetic coding sequence
atggccgacgacctgggcgacgagtggtgggagaaccagcccaccggcgcggggagctcaccagaggcttcggacggcgaaggggagggagatacagaagtcatgcagcaggagaccgtccctgtgccagtaccaagcgaaaaaaccaagcagcccaaagagtgctttcttattcagccaaaggaacgaaaagaaaacactactaagactagaaaaaggcggaagaaaaaaataactgacgtgctggccaagtccgagcctaagccaggtctgcctgaggacttgcaaaaacttatgaaagactactactcttcccgccgcctggtgattgagctcgaagagttaaatctgccagactcctgctttctgaaggctaatgatctcacccattcactgagttcttacctcaaggaaatatgtcctaagtgggtcaagttacggaagaatcactcagagaagaagtctgtcctcatgctgattatttgtagcagcgcagtgcgcgccctggagttgattcgctcgatgaccgccttcagaggcgacggaaaagtgattaagttatttgcgaaacacatcaaagtacaagcgcaggttaagctgttagagaagcgggtggtccatcttggtgtggggactccaggaagaataaaagaactcgtgaaacaggggggactgaatctgagcccattgaagttcctagtcttcgactggaactggcgcgaccaaaagctccgaaggatgatggacatccctgagattcggaaggaggtgttcgagctcctggaaatgggagtcctgtccctttgcaaaagcgagtctctgaagctgggactgttttag

SEQ ID NO: 45569 - DNA, 450 bp, Artificial Sequence
  Description of Artificial Sequence: Synthetic coding sequence
atgaaggaggccctgcaccagatcgtggtgcggtgcagcgagctggtgagctcaacgtccctgcctaggctatcagtatctcgcctgcagggaccgcctgatagccagccccttgggaccctcgggcaggggggctggaaactgctgggaattgtcgggtcactcgctccagaaaccctgggggggctgggcaccgagttcggaccatgtacccaccctttaccttttgatatggtccgcgaacgagagcgggatgatgaacttcggcaaggctggctattacagtgcccccagtgtgcccggacacttctctgccactgtggacctttcctcacacccccaagccaaacatcttcaagcgggtttcagctctgctctttgaagccgagtggctctcttgtgaccgcaacagaaccactgtctaacttcgccttttcttacttcccctag

SEQ ID NO: 45570 - DNA, 1611 bp, Artificial Sequence
  Description of Artificial Sequence: Synthetic coding sequence
atggaggagcccccccaggaggccctggccgagcccctgaagcacgaaagtcccgctgcaccctcctcggccggacacactaagggccaggaagaggatgatcaaaagaaccaggctgagaggaaagctgacaatcataccgcccaccggattgccgaccagactgcattaagggtaccttcccaggccgaaagttccattttctctcaagctacaaacggcgtcgctgaacagaacgggcatagtacacctggtcaagctgggcgcagggcttccaatcccgccgatgtttctgacctcagagccgacgatcaggttaaccagacacctagcgaacagactaaggggaaagcttccagccaagcaaacaatgtgcagcatgaacaatccgatggtcaggtgtcagggctcacagaggaaaggacggcggaacagactgaaaggaggttgcccacacaggccgagcgccgcaccagcgggcagatcgacggccgcctcgctatgccatcagaccagcgcgggtctcgccagacagaccatcgcatggcaggtcagagcgaacgccgcgctagcgaacagatggaccgtcggatgtctggagaagcggaacggagaacctctgaacagatcactcatcggctcagtaagcttagtgaacgcagaccatccgtccaaattgatagtggatcctccgtgccttccgaccagagtccgagtgtacagattgactctggcagttcagtaccgtccgaccaaaggcctagcgtacaaatcgatcgacggatgagtggcaaggttaggcgcagatcgtcggaaaagacagactatcggctggctggactagccgatcccggaaccagcgaacaaacggatctgagattgtacggcctggtcgatcataagaccagcgtcaaaacacaccatcaagtatacggacaagcaactgagctggccgagcatcaggctatcgaccaggctcacagcaacgctgatcaaccgcctgtggataacgcccattataccgaatccgaccagactgatcatctagcagaccgacaagccaatcacaaagatcagttgtcatattatgagacacgcggtcaaagtgaagatcgcatcttcccacagttaggcaactccaaggaggataaagaggccgactatagagtgcaaccttgcaaattcgaagactcgcaggtggacctcaactccaaaccgtccgtggagatggaaacacaaaacgctaccactattcccccttacaatcccgtggacgcccgtttcacctcaaacttccaggccaaggaccaggctctgtttcctagattaccgtccatttccagcaagcttaattacacatcaagccaggaaaagacccaagccatagtcaccaagtcagatgagttctcagagattgaccaggggaaggggtaccacatcagaaaccagacttacagaagattccccagcatcgtgtatgaggacccataccaggtctctctgcaatatatggagaaacaccatatcctgcaaatatttcagcagattaccgagaacttggtttacgaaaaaccagaagacccactgaattttatgctgtgtcaggtttag

SEQ ID NO: 45571 - DNA, 1062 bp, Artificial Sequence
  Description of Artificial Sequence: Synthetic coding sequence
atgcccagccccgtgggcctgctgcgggccctgcccctgccctggcctcagttcctggcttgtaccctgcggcggctggccgggccaagagagtctactggtcctagccaaaagccacccccactctgcagcgtaccatgcagggtacctgccatgaccgaggaggttgcacgggaggcccttctctcctttgtggattctaaatgttgctattcctccaccgtcgccggggacctggtgattcaggaactgaagagacagactctttgccgctacagactggagacgtttagcgaaagcaggatcagcgaatggaccttccagccctttacaaaccacagcgtggatggacctcagagaggtgcctcccctcgcctttgggatatcaaagttcaaggacccccaatgtttcaagaagacacaagaaagttccaggtcccccattcttccctggtgaaagagtgccacaagtgccatggacgcggtaggtacaaatgttctggctgccacggtgcaggcactgtccgatgccctagctgctgtggagctaagaggaaagctaaacagagcaggaggtgccagttgtgcgctggttctgggcgcaggagatgcagcacctgcagtggtaggggcaacaaaacctgtgcgacttgcaagggagagaaaaagttactgcatttcatacaactggtaattatgtggaaaaactccctgtttgagtttgtcagcgagcaccgactcaattgtccgcgagagctccttgctaaggctaagggagagaatctgtttaaagatgaaaattccgtggtctaccctattgtggacttcccactcagggacatttcacttgcttctcaacgggggatcgcagagcattccgcggcactggcaagccgggcacgggttctgcaacagcgccagaccatagaactaatcccgctgaccgaggtgcattattggtatcagggcaaaacatatgtttattatatttacggtacagaccaccaggtctatgccgtagattaccccgaacgatactgctgtggctgtactattgtatag

SEQ ID NO: 45572 - DNA, 1062 bp, Artificial Sequence
  Description of Artificial Sequence: Synthetic coding sequence
atgcccagccccgtgggcctgctgcgggccctgcccctgccctggccacagtttctggcctgcactttgcgccgactggcaggcccaagagagtctaccgggccgtcacagaagcctcctcccctgtgttctgtgccatgtagggtcccggcaatgaccgaagaagtcgcacgagaagcgctcctctctttcgtcgattccaaatgctgctatagttccaccgtggccggcgatctcgtcatccaggaactgaagagacagaccctgtgccgttaccgcctggagactttttcagagtctagaatatccgagtggacctttcagccattcactaaccacagcgttgatggtccccaaaggggcgcctcgcctcgcctctgggacataaaggtacaggggcccccaatgttccaggaagacacgagaaaatttcaagtgccccacagctctttagtgaaagaatgtcacaagtgtcatggccgtggcagatataaatgcagtgggtgtcacggcgcaggaactgtgaggtgcccttcatgctgcggggctaaacggaaagccaagcaatcgaggcgatgccaactatgtgctgggagcgggcggcgcagatgctccacatgcagcggccgagggaataaaacttgtgccacatgcaagggggagaagaagttgctccatttcattcagctagtgattatgtggaagaactctctattcgaatttgtgtctgagcacagactgaactgtcctcgtgaacttctagcgaaggctaaaggagagaatctgtttaaagatgaaaactctgtcgtctaccccatcgtggattttcctctgcgcgatatctcattagcatcccagaggggtatcgcagagcattccgcggcactggcgtcacgcgcaagagttctccagcagcgccaaaccattgagctgatcccgctcactgaggtgcactactggtaccagggcaagacctacgtgtactatatttatgggaccgatcaccaggtgtatgccgtggactacccagagagatactgttgcggatgtaccattgtgtag

SEQ ID NO: 45573 - DNA, 948 bp, Artificial Sequence
  Description of Artificial Sequence: Synthetic coding sequence
atgcccagccccgtgggcctgctgcgggccctgcccctgccctggccccagttcctcgcttgtacccttcgacggctggccggcccgcgtgaaagtactgggccaagccagaaaccacctccattatgttctgttccctgccgtgtgccagcgatgaccgaagaagtcgcaagagaggcacttttatcgtttgtcgactccaagtgctgttactcctccacagtagccggtgatctggtgattcaggagctgaagaggcaaaccttgtgcagatatagattggagaccttctctgagagccgtatatctgagtggactttccagcctttcactaaccatagcgtcgacggtccacagcgtggagcttctcccagactctgggatataaaggtacaaggaccccccatgtttcaagaggatacaagaaagttccaggtgccccactcctctctggtgaaagagtgccacaaatgccatggcaggggcaggtataagtgttccggctgccatggcgcaggcactgtaaggtgtccctcttgttgtggagcgaagcgcaaggcgaaacaatcaagacggtgtcagttatgtgcgggttcggggcggcgacggtgtagcacgtgcagcggtcgcgggaataagacctgcgccacctgtaaaggcgagaagaagctgctccatttcattcaattggttattatgtggaaaaactcgctgttcgaattcgtgagcgagcaccggctaaactgccctcgggaactgttggcaaaggctaaaggagagaatctgttcaaggatgagaactccgtggtgtaccccatagtggacttccctttgagagacatcagtctggcctctcaaaggggaatcgcggagcattcagccgcgttggcctcccgggcccgggtgcttcagcaggtttcccaaggcggaggtgcgatttggctgtag

SEQ ID NO: 45574 - DNA, 1128 bp, Artificial Sequence
  Description of Artificial Sequence: Synthetic coding sequence
atggaccgggacctgaacgaggacgacagcgtggtggacctgagcttcgaggccgaaagccccctggcaccacccacagagctcctggagcggttaccctcctacgactggctactacagggtggacggggtcaaattttctttccgccactcgaggctcccggcagacctcaggagcagcgctcctggccttctttcctcgagcaccgcgttccagccatgactgaagaggtggcccgcgaagctctgctctccttcgtcgactcaaagtgctgctattcttccaccgttgccggcgacctcgtcatccaggaactgaagcgccagactttgtgcaggtatagactggaaactttttcagaatcccgcattagtgaatggacgttccagccgttcaccaaccactcagttgatggtcctcagcgtggcgcctctccccgcctgtgggacataaaggtgcagggccctccaatgtttcaggaggacacaagaaaattccaggtgccgcattcaagcctggtcaaggagtgtcataaatgccatggacggggaagatacaaatgctccgggtgccatggtgctgggacggtacgatgtcctagctgctgtggcgcaaagcggaaagcaaagcagtccaggaggtgtcagttgtgcgccggttccggccgccggagatgttccacttgttcaggacggggcaataagacctgcgccacatgtaaaggcgagaaaaagcttctccactttatccagcttgtgatcatgtggaaaaactccctcttcgaatttgtgtcagagcaccggctgaactgtcctagagagcttctggctaaagcaaaaggggagaatctcttcaaggacgagaacagtgtggtatatccaatcgtggacttccccctccgggatatatcactggcatcacagagagggattgcagagcactcggcagcactggcttcccgtgccagggttctgcaacagcgtcagactatcgagttgattcccttgacagaggtacactattggtatcagggaaagacatatgtgtattatatttacgggacagatcatcaggtctacgctgtggactacccagaacgatattgctgtggatgtactatcgtgtag

SEQ ID NO: 45575 - DNA, 498 bp, Artificial Sequence
  Description of Artificial Sequence: Synthetic coding sequence
atgcaggccgagaccatcctggagggcctggaggccggcctgccccaggctgtatctagcgggctctctctagtgcctgccccagggttagttctcacctgtttatcggctccttccggacctggggggatggctctggagccgccgccaacaaccctgcgcaaggcctttctggcacagagcacattactagagagcaccctagaaggagccccagagtgggcagctccccaccccgaggaacagagacggtcccccccagcctgttctcagcacaccccgccgttgcctagtactcctaccggaccaccaccatgtagtcccggcggtaaccatccgttgtgtgctctgtccggtcgcggaggaggacgctgcagcatcccaagcctctccagcagctcaactttttcattgtttagctccggctgctggaatccccgtgtcaagctgagggtccgaaagagtcagagtcagggtcgagccggtcagctgatctag

SEQ ID NO: 45576 - DNA, 1065 bp, Artificial Sequence
  Description of Artificial Sequence: Synthetic coding sequence
atgtgcggccggaccagctgccacctgccccgggacgtgctgacccgggcctgtgcgtaccaggaccgaagaggccagcagcggttacccgagtggcgagaccctgacaagtattgtccctcctataataaatccccccagagcaactccccagtgctgcttagcaggctgcattttgaaaaggacgcagattccagcgagagaatcatcgcgcctatgaggtgggggcttgttccatcctggttcaaggaatccgacccaagcaaactccaattcaataccaccaactgtcgctcggatactgtgatggaaaagagatcattcaaagtgcccctgggaaaggggcggaggtgcgtcgtcctcgccgatggcttctacgagtggcagcggtgccagggcacaaatcagaggcagccgtatttcatctacttcccacagatcaaaaccgagaagtccggatccatcggcgccgccgatagccccgagaattgggagaaggtttgggataattggcgcctgctaaccatggccgggatctttgactgctgggagccccccgaggggggagacgtgctgtattcgtatactattattacggtagactcatgcaagggactgtccgatatccaccaccgaatgcccgcgattctggacggagaagaggctgtctctaagtggctggattttggtgaggtgtctacacaagaagcattgaagctgatacatcctaccgagaacattacctttcacgcggtgtcctccgtagtgaataactctaggaacaacacacctgagtgtctagcgcccgttgacctggtggtaaagaaagaattacgagcatctggcagctctcaaaggatgctacagtggttggccactaagtcccctaagaaggaggattcaaagactccccagaaggaggagagtgatgttccccagtggagttcccagtttctacagaagtcaccactcccgaccaagcggggaacagcagggttgctggaacagtggctcaagcgcgagaaggaggaagagcccgtggccaagcgaccttactctcaatag

SEQ ID NO: 45577 - DNA, 1065 bp, Artificial Sequence
  Description of Artificial Sequence: Synthetic coding sequence
atgtgcggccggaccagctgccacctgccccgggacgtgctgacccgcgcttgtgcgtatcaagaccgaaggggacagcaaaggctcccagaatggcgcgatcctgacaagtattgtcctagctacaacaagtcacctcaaagcaattcacccgtgctcctcagccgcctgcattttgaaaaggacgctgacagctccgaacggattatcgccccaatgaggtggggcctggtcccttcttggtttaaagagagtgatccttctaaactgcagtttaacactaccaactgtaggagtgataccgtaatggagaaacgatcctttaaggtgcctctgggaaaggggagacgttgtgtggtgttagccgatggtttttacgagtggcagcgctgccagggcactaatcaacgccagccctactttatttacttcccccaaattaagactgaaaaatcaggctccattggagccgcagactcacctgaaaactgggaaaaagtctgggacaactggcgcctcctgaccatggccgggatatttgactgttgggagccccccgaggggggagacgtcttatactcttacacgatcattaccgttgattcatgtaaaggcctctccgatattcaccaccgaatgccagctatactcgatggagaggaagccgttagtaagtggctggatttcggcgaggtctccacgcaggaagctctgaaacttatacatcccacagaaaacattacattccacgcagtgagtagcgtggtcaataattctagaaacaatactccggaatgtctcgcccccgttgacctcgtggtgaagaaagagttgagggcttcaggaagcagccagcgtatgctccagtggctcgcgacgaagagcccaaagaaagaagattctaaaacaccacaaaaggaagaatcagacgttcctcagtggtccagccaattcctccagaaatccccactgcccacgaagcgcggtaccgctggacttctggagcagtggctaaaacgagagaaggaggaggaacctgtggccaagagaccatattctcaatag

SEQ ID NO: 45578 - DNA, 1065 bp, Artificial Sequence
  Description of Artificial Sequence: Synthetic coding sequence
atgtgcggccggaccagctgccacctgccccgggacgtgctgacccgggcatgtgcataccaagaccgcaggggacaacagcgcttgcctgagtggcgtgaccccgacaaatactgtccctcatacaataagtccccccagtctaacagcccagtgttactcagtcgtctgcacttcgagaaagacgccgacagttcggagcgcatcatcgcaccaatgaggtggggactcgtaccttcttggtttaaagaaagtgacccgtcaaagcttcaatttaatactaccaactgcaggtccgacacggtcatggaaaagcggtccttcaaggtgccactgggcaaaggccgacgttgcgtggtactcgcggatggtttctatgaatggcagaggtgccaaggtacaaatcagaggcagccctattttatttacttcccgcagataaagacggaaaaaagtggaagcatcggggctgctgattcaccagagaactgggagaaagtgtgggacaactggaggctgcttactatggcagggattttcgactgttgggagccaccggaagggggggacgttctttatagttacacaatcattacagtcgacagctgcaaaggtcttagcgatatccaccacagaatgccggctatcttggacggcgaagaagccgtgtctaagtggctcgatttcggcgaggtctccacacaggaggcgctcaagctgatccacccaactgagaacattacttttcacgccgttagctccgtggtgaataacagcagaaacaacacgcctgaatgtcttgcacctgttgacctcgtggttaagaaggaactccgtgcttccggctcatctcagaggatgctacagtggctcgctaccaaatcacctaaaaaggaggactccaagactccgcagaaggaggagtccgatgtgccccaatggtctagccagttcctgcagaaatcccccctccctacaaagaggggtacagcagggctcctagaacagtggctcaaacgcgagaaggaagaagaaccagtggcgaagcgcccctattcacaatag

SEQ ID NO: 45579 - DNA, 990 bp, Artificial Sequence
  Description of Artificial Sequence: Synthetic coding sequence
atggagatgagcggcctgagcttcagcgagatggagggctgccggaacctgcttggcttgctggataatgacgagattatggcattatgtgataccgtgaccaacagactcgtgcaacctcaggatcgacaggatgccgtccacgcgattttggcctatagtcaatccgcggaggaactcttacgccgcaggaaggtgcatagagaggttatcttcaagtacctcgccacccagggcattgtgattcctccagctactgaaaagcataacctgattcagcacgctaaagactattggcagaagcagccgcagcttaagttaaaggaaacccccgaacctgtgaccaaaacagaagacatacatctattccagcaacaagtgaaggaggacaaaaaggcagaaaaagtggatttccgtcgcctgggagaggaattctgccactggtttttcggactgctcaacagccagaacccatttctcggtccgccccaggatgagtggggaccacaacacttttggcacgacgtgaagctccggttttactacaacacaagtgaacagaacgtgatggattaccatggggctgagatagtgagtcttcggttactgtctctcgttaaggaggagttcctttttctctccccgaacctcgattcccacgggttaaagtgtgcttctagtccacacggcctggtgatggtgggcgtggcgggaacagtgcatcgaggcaatacctgcctgggaatctttgagcagatcttcggcctgattagatgccccttcgttgaaaacacctggaagataaaatttatcaatttaaagattatgggggagtcgagtctggccccaggaacattacccaagcccagtgtcaaatttgaacagagtgatctggaagccttttataacgtcatcactgtttgcggcaccaatgaggtcaggcacaacgtaaagcaagcttcagacagtgggactggcgatcaagtctag

SEQ ID NO: 45580 - DNA, 879 bp, Artificial Sequence
  Description of Artificial Sequence: Synthetic coding sequence
atggcccagccccagctgtacctgcccgagcccttcaagatcgcctaccggaaggtcgggcagtgcaggagattccaacagctgaagaaaaagaatggtagctttaaaaggaaagggattgaaaggtggcacagagctgtaagcactaacctgctgaagcaaaacgtcttggtccccaaagaagaatccagttccgactctgatatgggattccacgaaagccagcagaatcagaaatcaaacttgaagactaaagtgaaaaccgccttcggtcgcatgttgtcatataaatataggagcaaaccggcgtgtgcctcacaggaagggagcacagaccacaaagaggccctgctgtctaacacacaatctctccttcctaggatagtcaaagaattttcaagccctaagctttttaccgccaagatgaggaagttatctgagaacgccacaattcaactggacgtggttgaggccgagactgaggagatcactcaggggaatacactcttacgcgcccgcaggacgacaaaacgacttagcgttacttcactgcccagcggccttcagaagggaccctactcaccaaagaaacgacctcacttccctgctcttaaaaagaagaaaaggggaatggagaatatcctgagaaagtccgacctaaccgtcgggaagttacagatgcaggtcgacgacctgatagaaaccgtcaccgacaagtccatgaagctgctggcccagagacacgccgagctgcagcagtgcgagttcttgggagatgaaatccttcagtccagtaaacagttccaaagaatcagcaagcgcacaatgcggaagtacaagctgaagaacatgaccactaaaggacctggggacagctag

SEQ ID NO: 45581 - DNA, 357 bp, Artificial Sequence
  Description of Artificial Sequence: Synthetic coding sequence
atgaaggtggtgggcaactaccgggtgaacaccgccaacagcagcactgacacttcaggcgaacatctcacctgcctccggtcacaactgttcgtcgcgtacaggaatggccgagtagacgaggccgtgagtctggggtttcttgactgctggatcggcggagatttgactaatttcaaaggatgctatcttaccaaccagctgcctatccagatttttactgcaatcttcgatatgaacacagatgttattatcctctctcagttcatgtactaccgtctgaaaaatcaaaaaaagaagatatccgaagaagacttgagaaaggagctgcatttctgctgtttacattggccttag

SEQ ID NO: 45582 - DNA, 402 bp, Artificial Sequence
  Description of Artificial Sequence: Synthetic coding sequence
atgaaggtggtgggcaactaccgggtgaacaccgccaacagcagcactgatacgagcggcgagcacctgacgtgtctacggagtcaactgttcgttgcctaccggaacggcagggtcgacgaagcagtttccctgggtttcctggattgctggatcggaggggacctgacaaactttaagggttgttacctgaccaatcagctacccattcaggacattcccacatccgtcattcagcggttacaccatcaacgcgagtctcagatcgtgacactgggatcccctctgccttgtatctatcccatatttttccagatctctgaaatatctatgccaggctattattcatgcctatgccatacaaccattaatacgtctaagagaagatttatactcacctag

SEQ ID NO: 45583 - DNA, 408 bp, Artificial Sequence
  Description of Artificial Sequence: Synthetic coding sequence
atgaaggtggtgggcaactaccgggtgaacaccgccaacagcagcaccgatacctcaggcgagcatctcacttgcctgcgcagtcagctgttcgttgcctaccgaaatggacgagtagatgaggcagtaagcttgggcttcctggactgctggataggcggcgacctgaccaacttcaaggggtgctacctgacaaatcaattacctatccagatcttcacagccatttttgacatgaatactgacgtgataatactgagccagttcatgtattatcggctgaagaatcaaaaaaaaaagatgatttttcagccccaactgttcaaagactcaatcactagagaaaaagtgaggctgtccctgtggggtgttctgtgccctgtgtatatcccatatagtttcaggtag

SEQ ID NO: 45584 - DNA, 729 bp, Artificial Sequence
  Description of Artificial Sequence: Synthetic coding sequence
atgggcaccggcgccagcgagaagcaggccgagcagaaggtgcggcgggcttttgaggcatctgaagaggctcacggcaccttggcagcaagcacgccctgggtagccatgggctccgcctatgggagttgcacctgtctgggcgcgcaacccgtgaccgacttagccctatggcctgtgatatacagctgcatgggcttcagcccgcaggcatatccagccttttgggcttacccatgggttctttatggggggtacctgtggatggggtaccctcctccagcagccctggtacccagtgtgtggctgtattggcggggtgccagcagctttgatccccttattgggtccccttatctggcagctcttgctcctaacctcttcccgtttcccatgaagttccccccaacttactcactggctagcccgacgctggggggggccacgagctcgcattgcccacaggtggggtgctggacacctgcatcctctgccccgcgtgcggcggttgagggcccatctagaggagctccatatctgaagacatgcaaagcacccccatccgagtgggccagtagattcggcatttgggccccattaccctgttgcagttcggagctccgacccttgccaccctcacctatagaggattcacagctggatcccggatgcagtcgcagctcttctaggtccccatgccgcgctagaaggcggctgtttgaatgttag

SEQ ID NO: 45585 - DNA, 804 bp, Artificial Sequence
  Description of Artificial Sequence: Synthetic coding sequence
atgcactacatcaagacctggagcctgctgggcgagatgagcgagaaactgcggagatgccgcaaggaactgaccgctgctatcgatcgggccttcgaaggcgtaagctactcccaggaatgcacgggacagcagcgactggaactctctgccgcccccctgtctttttcattgcctgtacatagactgctctgtaggcgccatccactggcggcttgctcttctgccgcgcctttcgcggcagtcccatgtgcaccggagaacgagaaccctgcctttgccacaaaccacgcccccgtgaacgcaaaaccgcacgctctctgtccagaacgaaaacctctcaccagcaaggaaaatgttttgatgcattcctccatactggcacctgagcgcgagtcctggcggaccgcaggagagggcgagaactggagaaaagagaatctgcgcaaggacatggagagggatctgaaggccgacagcaacatgcctttaaataattcaagtcaagaggttacaaaggatttgctggacatgatcgaccacacgtccatcagaacaattgaagagctggccggcaaaattgagttcgaaaatgagctgaaccatatgtgcggccactgccaagattcccctttcaaggaggaggcatgggcccttctgatggacaaatcgcctcaaaaggccacagacgctgaccccggcagtctaaaacaggcatttgatgaccataatatcgtggaaacggtactggatcttgaagaagactataatgtgatgaccagcttcaagtatcagatcgaatag

SEQ ID NO: 45586 - DNA, 432 bp, Artificial Sequence
  Description of Artificial Sequence: Synthetic coding sequence
atggccacccccctggacaactgcctgcggcccttccccgaccccatggtaaaggtgacagccgaaaccaagaaaatatccgaggtttcgagttacgtctctgcaaataacaaaaagaactcattttggggttccgggttgctgtaccccgtggctttactccgctgccaagactgctgggccgggcaccagacccacgtgctctctaaggagttcactagttatttcagctcaggcgctgggagggaagcccagcatcagcctagcgcagtgctcggatccctgatttggctgaggcgcgtgtacctgctgagagccatggtggtccatggagggtcacagccttgccaaaggtggctggtgattcgcatggaggttggcggccatccgtcctttccaggacacgcgtggttgaccttccacctgaactag

SEQ ID NO: 45587 - DNA, 1692 bp, Artificial Sequence
  Description of Artificial Sequence: Synthetic coding sequence
atgatcaagcggaagatctggtgcaacctgtgcatcgacctggtggcgttcacctccgagatctttaaaggagccgtgtttcagtccctagacgggattgttgtctccgcaaactgcaaactcagaaaaatctttaccttaaagagtaaaccgcaggacaccgcagataaggatgccgtctacggcgtgcctttcagcacggatgaacccaccgatatcattccacgcagctgccagctcatgaccgacgtgcctcacgtgactcaactcttgaatatgaccaaactcagacagactgagataaagttcggtggtcatccccttagatcagccgaatccgaccagttcatcaaccgcggtacgtccatcacgcgaaattccaagaatcaagatgtgtgtcacatcgcattcgggtcgaaggtccttggtccaccccctctgagtggtcgccggaataacatgaagatatctagcgagacagtccgctctgttgggagtaagaacaaccggagctgccagccttctactgtcgagaaatgcgtgaatggaactgagatgagcgcactcctgatccccgagagcgaggagcaggggaataaggagaatatccatcagatcaaacaaaccgtgcccatccacgcggctaacctacatattatgcatccccaccccccgcaggaaccttcagctgacaaaaacaacaacagacgtcggcttcggctgaagtcaacttcacgggaacggaccgagacccccagtggatccagttccgggaataaccgcattgaagacaaagcaagtacaatcttgactactgtgtcccagcagggggccgagctgctgaattcaggaacccttgggccccagagccccgaccagtctgacgaatggatatttccggagaacgccgaccatatctcttatcttgcaagtagccgccagagcctcctcctgggcgacgactcatgcaatccttcccacctttggttggaggccagcaaggagagcgagcacgatcagcaggcagaggagtcccagtccgtgccgaaggatatcttcactttcagctcacggcctcgctcagcacctcatgggaagacacagaccatgtcaccagaagagctgtccttcattcttgatctcaaagaagacaactctgtcactagccgagatacccagtcagaggatgacttttatggtggggactccagcgaagaagagtacgattggcgaaattaccagccctctcagatgtcagagagcgaactgcaaatgctggcctcattgcggtggcaacagaacgaagaactcgaggacgcagggaccagtcatggactcagcgccagccaagtagataattgcaacgtttctatcagtacctcatccgacgataccacgacatggaactcatgcttgcccccccccgtgaaccaggggaggcactaccagaaagaaatgaaccccccatctccatcaaacccccgcgattggcttaatatgctgtcaccacccatcgtgccaccaagccagcaaccagcagaacaaagacctgatagctgcgagtctttgtcggttcaaggagaggaggatctgtcagttgaggaagacgaagaggtccttacgcttttgtacgatccctgtttaaattgctacttcgatcctcagactggaaagtactacgaactcgtctag

SEQ ID NO: 45588 - DNA, 717 bp, Artificial Sequence
  Description of Artificial Sequence: Synthetic coding sequence
atgagcggcttccccgagaacgccgaccacatcagctacctggcctctagcaggcaatcattacttctgggtgatgacagttgcaatccctcccacctatggcttgaggccagtaaggaatcggagcacgatcaacaggcagaagagtctcagtcagtgcctaaagatatattcacattcagttcaaggccacggtctgctccccacggtaagacacagactatgtcacctgaggaactctccttcatcctcgacttaaaagaggacaacagcgtaaccagtagggatactcaaagcgaggatgacttttacggaggagactcttctgaggagggaaaccatagtattcagggctcccgaggaccgacgacagggccctctgagttgactcagctgactcttgagagtcttctgggtaaggctgctaaacgaaccagtaaggaatatctgcggtctgcttacacagaagcaggcgctactgaatcccaggacagtagcatggagcagattgaccgcaataacttcgaaatgtcactcctcccgactacgtgcctgtctcccaccgggcggaggtgcggctcttgtcagaagactccggaacccgtgatcaaggcaaaggacctgagtgcgcaacaagtccccgcaagccttaataaaacctctcttaaagagatctcaggtgagaggctgagttctatccccgaggcctctgagtag

SEQ ID NO: 45589 - DNA, 2070 bp, Artificial Sequence
  Description of Artificial Sequence: Synthetic coding sequence
atgatcaagcggaagatctggtgcaacctgtgcatcgacctggtggccttcacatccgagatttttaagggagctgtgtttcagtctttggacgggattgtggtttctgctaactgtaagctgaggaaaatttttacactcaagagcaaaccccaggacacagctgacaaagacgccgtatacggtgtgcccttctccacagacgaaccgactgacataataccgaggagttgtcagctcatgactgatgtgccccacgtcacacagcttttaaatatgacgaaactccgtcagacagagataaaatttggaggccatcctctcagaagtgcagaatctgaccagtttatcaatagaggaacctctattactcgaaacagcaagaaccaagacgtatgtcacattgcctttggatcaaaagttttgggaccaccgccattgtccggtaggcggaataacatgaaaatttcctctgaaaccgttagaagcgttgggagtaaaaacaatagaagttgccaaccaagtactgtcgaaaaatgtgtgaacggtacagagatgtctgccctcctaattcctgagtctgaagaacagggcaacaaagagaacatacaccagattaaacaaactgttccgatacatgccgccaacctccacataatgcacccccatcccccacaggaaccatccgctgataagaataacaacaggagacgattaagattaaagagtacatcacgtgagcgcacggagacaccttcagggtctagctccgggaataatcgtattgaggacaaagccagcactatccttacaaccgtgagccagcaaggggccgagctcttgaattcaggcaccctgggcccccagtcgcccgaccagagtgacgaatggatttttcccgagaatgccgaccacatttcataccttgcttcaagtaggcagtctctccttctgggcgatgatagttgcaatccgagccacctgtggctcgaggcaagcaaggaatctgaacatgaccagcaggccgaagagtcccagtcggtgcctaaagatatctttacttttagtagtcgaccccgtagcgcacctcatggcaagacccaaacaatgagcccagaagaacttagttttatcctagacctgaaagaagacaacagcgtgactagtcgagacacccagtcagaagatgatttttacgggggtgatagctcagaggaggggaaccatagtatccagggcagccgtggccctaccacgggcccttcagagctcacacaactaaccctcgaatccttgctcggcaaggcagcaaagagaactagtaaagagtatctgcgttccgcatacaccgaagcaggcgccactgaaagccaggacagcagtatggagcagatagatcgtaacaacttcgagatgagcctactcccaactacttgtctgtcccctacgggacgccggtgcgggtcatgccaaaagaccccagagccagttattaaagctaaggatctgtccgcccagcaagtaccagctagtctaaataaaacgtcattgaaagagatcagcggcgaaaggctttcaagcatccccgaggcctcagaatatgattggaggaattaccagccatctcagatgtccgagtctgagctccagatgctcgcgtctttaagatggcagcagaatgaggaactggaggacgctggcaccagccatggcctttctgccagccaggtcgataactgcaatgtctctatttcgacctcttcagacgatacaaccacatggaactcttgcctgccaccacccgtgaatcaaggtagacattaccagaaggagatgaatccaccatctccttctaaccctagagactggctgaacatgttgtcacctcccattgtgccaccttcgcagcaacccgctgagcaaagacctgacagctgtgagagtctgtcagttcagggagaagaggacctttccgtggaagaagacgaagaggtgttgacactgttatacgatccctgtctaaattgctacttcgacccacagacaggaaagtattacgagctggtgtag

SEQ ID NO: 45590 - DNA, 753 bp, Artificial Sequence
  Description of Artificial Sequence: Synthetic coding sequence
atgagcgccgccgccagccccgccagcgagcggggctggaagagcgagaaactggacgaggcccaggcattggcgcgctcctgtgccgctcggagacctgactttcagccctgtgacggactgtcaatctgcgcaacccactcacacggtaagtgttttaaactgcattggtgttgtcacctcgggtggtgtcattgcaaatacatgtatcagccaatgactcccgtcgagcaattaccaagtaccgagattcccgcgaggccacgcgaacccacaaatacaatccagattagcgtttctttaacggagcatttccttaaatttgctagtgtgtttcaacctcccctcccaccagatagcccccgctattgcatgatatcagatctctttatcgacaattaccaggttaaatgcatcaatggaaagatgtgctacgtgcaaaagcagccggcccctcacagccacagaatgtccccagaggaggtgtccgcacatgacgcgctaatcagcaaagagagtaacacgccaaaaattgaccattgcagttcaccctcatcgagcgaggatagcgggatcaacgccataggggcccactatgttgagtcctgcgacgaagatactgaggaaggcgccgagttgtctagcgaagaggattacagcccagaatcgtcttgggagcccgatgagtgcaccctgctgagcccttcacagtcagacttggaggtaatagagactatcgagaccaccgtgtag

SEQ ID NO: 45591 - DNA, 528 bp, Artificial Sequence
  Description of Artificial Sequence: Synthetic coding sequence
atgacccggacccccgtgggcagcgcccggacccggcccaagccccggaagttagggccacaaaggggtaaggcactgcaggcttcgtcaagactctccgaatctcccgcacttgtgaaaaagcggatgcccgacgcctgtacattgggccgcgcaggcataggactacccaaaatgtgcctgcacatggctgtgaggcactccaaggcccagaaaaccgggccaggaatcctccagcaacggcagaagccaccggcgccacgcgcatctggagggccagctctcctgggaaaaaggaggggctgttcagaagcgggaagcgcaagtctcgagcctctctcaagttcacgggccgcagcgggatgcttaaaccaggtgcccttgagtccctttctcgcagggcctcggaataccaggagactccccgcccccgagagagagaggatcgaactggctgcaacattgtgtctggagggctggcctttacgctgtttggccagtaaaggcaagctgcactgtgtgtactag

SEQ ID NO: 45592 - DNA, 492 bp, Artificial Sequence
  Description of Artificial Sequence: Synthetic coding sequence
atgcagagcgtggacagcatgctgggcaccgtgggcggctgcggcgggggtgaagccgcttccaccttctctaaagatccatccgggtgttgcgttggcaacgactgcagagacggaggacgagggttggagcggcgccacggaaggtggagtcggggggagggtggcgagagcggactttgttctgggggtcagatggcaagcgagatcgagtactgggacggccttgcaatttcagtgatggaggtagagaaagcctttgggagtacaaatgtgctgtggaagactgaacccttctccctctgggcctgcactgctgcatgccccccaagcctctcaccgactctgctggctctaggcctaccacgggacggcaaagaattggcagaacagggttcactgtggactgttttggaacctggtggcgactggtctcattctcagtcgcagctgggaacccctggccgagggaaaggcgcacttggcttttag

SEQ ID NO: 45593 - DNA, 801 bp, Artificial Sequence
  Description of Artificial Sequence: Synthetic coding sequence
atgttcgtggagctgaacaacctgctgaacaccacccccgaccgggccgagcaggggaaactgaccctactctgtgacgctaagactgatgggtcctttctggtgcaccacttcctgtcattttacctgaaggcaaattgcaaggtgtgtttcgttgctttgatccagtccttttctcattactccattgtgggacaaaaattgggagtgtccctgacgatggcgagggagagagggcagctggtgtttctcgaaggtctgaagtcagctgtggacgtcgtcttccaggcccagaaagagccacaccctctccagttcttaagagaggctaatgcaggtaacctaaagcccttgtttgagttcgtgcgtgaggccctgaaaccagttgactctggggaggctagatggacttatccagtactgctggtggatgatctgtccgtgcttctgtccttagggatgggcgcagtcgccgtgctggacttcatacactactgccgtgcgacggtgtgttgggagctgaaggggaatatggtggttctggtgcacgactctggtgatgctgaggacgaagagaatgatattctgctgaatgggcttagtcatcagtctcacttaattctgcgtgccgaggggctggcaactggattctgtagagatgtgcatgggcaactaaggattctgtggcgacggccctcccagccagctgtccacagagaccagtcatttacatatcagtataagatccaggataagtccgtgtcattttttgctaagggtatgtcacctgcagttctttag

SEQ ID NO: 45594 - DNA, 729 bp, Artificial Sequence
  Description of Artificial Sequence: Synthetic coding sequence
atgttcgtggagctgaacaacctgctgaacaccacccccgaccgggccgaacaggggaaattaaccctcttgtgtgacgccaaaaccgatggtagctttctggtgcaccacttcctttccttctatctgaaaggagtctccctgacaatggcacgagaacggggccagctggtgtttctggaggggctgaagagcgcggtggacgtagtttttcaggcacagaaagagccccaccctttacaatttctgcgggaggccaatgccggcaatctcaagccattattcgaattcgtcagagaagctttgaaacccgtcgactccggtgaggcccgttggacctacccagttttgttagtggacgatctgagcgtgctgttgagccttggaatgggcgccgtggccgtgctcgatttcatacattattgtcgcgcaaccgtgtgttgggagctgaaaggcaatatggtggtgctagtccatgattccggggacgccgaggacgaggagaacgacatcctgttgaacggcttgtcccaccagagccatttaattctccgcgctgaaggcttagcaacaggcttttgcagagacgtacatggccaactgcgcattttgtggcggcggccatctcagcctgccgttcatagggaccagagcttcacttaccagtacaaaatacaggacaaaagtgtctcattcttcgcaaagggcatgtctccggctgtgctgtag

SEQ ID NO: 45595 - DNA, 303 bp, Artificial Sequence
  Description of Artificial Sequence: Synthetic coding sequence
atgcacgtgtgcgacctgcagaagctggtgcggatccagctggcctttaccacttttccctggatgttttcctgtcacctcctgcctacccctgagcttagctcaaagcgtaaccagtgccttctttacaagaccagcgggtgtttaacccaaatgcctatcctttacggtcaccctgctacactgcttaaggattacatcctgcaggccattttgcaacctggcaagaagatccaggggggaaccgagatccagcggggatcctttgccaaccaatatcagacagacgcaagtcacctctag

SEQ ID NO: 45596 - DNA, 744 bp, Artificial Sequence
  Description of Artificial Sequence: Synthetic coding sequence
atgtggggccccggcgtgaccgccgagggcctgagcgtggcccccgcccctccacctctgctgcctctgctgctcctgctggccctggccctggttgcaccgtctcgcggtgggggagggtgcgccgagcttgcttgcggtgagagagagcgatgctgtgatgccactaatgctaccgctgtgagatgttgtaagttaccattgcatgcatttttagataacgtcggctggttcgtacggaagctttcaggactccttatcctcttggtgctgttcgcaattggctattttctgcagaggattatttgcccttcccctaggaggtacccccgggggcaggcaagaccaggccagagacccggaccacccggcggcgcaggcccactcgggggtgcaggcccacccgatgatgatgacgactcaccagccctcctccgggacgaagctgctgctggatcgcaagacagtttgctggattccggaggaggtgggagagggcgaggcggaggtggacggtccgacccttcttgtgcctccgaacatgagatgagggtggttagccccgtgttccttcagttaccatcatatgaggaggtcaagtatctgcctacttacgaagagtcaatgaggttacagcaactctctcccggcgaagtcgtgctcccagtttcggtgttagggcggcctcgaggtggagtcgcagccgaacctgatggtggagaaggtcgttacccactgatctag

SEQ ID NO: 45597 - DNA, 1080 bp, Artificial Sequence
  Description of Artificial Sequence: Synthetic coding sequence
atgaacctgaacccccccaccagcgccctgcagatcgagggcaagggaagccacatcatggctcggaacgtcagctgctttttagtccggcacactcctcatcctagacgtgtctgccatattaaaggactcaataacatcccaatctgcacagtcaacgacgatgagaacgcttttggaactctttggggtgtcggacagtccaactatttagagaaaaatcgcatcccttttgccaactgtagctatccttcatcgacagctgtacaagagagtcctgttcgtggtatgtcaccagcccctaatggggctaaagtgcccccgcggccccatagcgagccctccagaaagattaaggagtgttttaagacttcttctgaaaaccctctcgttattaagaaggaggagataaaagcgaagcggcccccgagccctcccaaggcctgcagcacgccaggcagctgttcatccggcatgacctcaacgaaaaacgacgtgaaggctaacactatttgtatcccgaattaccttgatcaagaaatcaaaatcctggcgaagctgtgttctatcttgcatactgactcgctcgcggaggtgcttcagtggttgcttcatgctacctccaaggaaaaagagtgggtgagtgccctgatacattccgagctggctgaaattaaccttctgactcaccaccggcgtaatacctctatggagcccgccgcagagaccgggaagccacccaccgtaaagtcccctcccactgtaaaactgccaccgaacttcacagccaaaagcaaggtgctcaccagagatacagagggagatcagccaactagggtcagctcacagggaagcgaggaaaataaggaggtgcctaaggaggccgagcacaagccacctctgcttatccggaggaacaatatgaagataccagtagccgagtacttttccaagcccaatagtccaccccgtcctaatacgcaagagtcaggaagtgctaagcccgtgtcagcacgcagcatccaagaatacaatctctgtccacagcgtgcgtgttatccgagcacacatcggcgttag

SEQ ID NO: 45598 - DNA, 945 bp, Artificial Sequence
  Description of Artificial Sequence: Synthetic coding sequence
atgggctgccggtgctgcaagatcatccagagctacctgttcgaccccgtgcaagttccttcccccggatacgtgaacgaggtgaattcctgcaagctggacgaggatgacaccgacaagctgaaagggaagtggagcagcgaggtcctggtgcagaagaacgacccccaacggcaagggtctaagaaaacagagagtagttccaggacggcagacccatgggaaccctgctggccgcaccaaggcccgcttccccagggggacgctggcggggagcatcacgcctgtggcgtgaacggcatagggccagcagccacaccccagccgaccgggaactccagtccaacccaggacgaccgtggtagctgggccagcactgctaatacagtgccccctacccagccgttcctggagggcggaggtacacgcaaacaggattgcgtgctgctggcatcagaagggacccaagtgatgcgaaacggcgattcacgggcccccagtgaagccgagtcttttgcactggaggtgcaggaccacgtattccaaatcccagccccagattatcttcaacattggggcccggctggcgataatgttgaccacaatgaaaaggactgcgtgttcaaaaatcacacagaggatgaatccctggagggcatccagccacctgtgggagagcatggactgaacactccctttagcgtccgcagatcctgggattccttaaacgaagatgtggagacagaagtgctgtctatttgctttaatgaaaaaggcccggtccacgcaatgcccgtggtcgactctggcaataggcaggaagacacacacggctctgacggcgacggagatggagagattgtagatgaagacgctgcagtagccgaggccctagccgccttggaggccgcgaccgccggtgaagacctcgacgaaaccgactag

SEQ ID NO: 45599 - DNA, 945 bp, Artificial Sequence
  Description of Artificial Sequence: Synthetic coding sequence
atgggctgccggtgctgcaagatcatccagagctacctgttcgaccctgtacaggttccgagtccgggatacgtgaacgaggtcaactcgtgcaaactggatgaggacgacaccgataagctcaaggggaagtggtcaagcgaagtgctagtccaaaaaaacgacccccagcgccagggcagcaagaaaaccgagtcttcctccagaacagccgacccctgggagccgtgctggccccaccagggcccgctaccccagggggacgcgggtggtgaacatcacgcctgtggagtgaacgggatcggtcccgcagctacacctcagcctacaggaaactctagccccacacaggacgaccggggatcctgggcttcaactgcgaacacagttccaccaacccagcccttcctcgaaggcggaggaactaggaaacaggactgcgttctacttgctagcgaaggcactcaagtgatgcgtaatggagattctagagctcctagcgaagcagaaagcttcgccttggaagtccaggaccacgtcttccagattcccgccccggactatctgcagcattgggggccagccggcgacaacgtagatcacaacgaaaaggactgtgtgttcaagaatcacaccgaggatgagtctctggagggaattcaacctcctgttggtgagcatgggttgaacacaccattttctgttcgcaggagttgggactctcttaatgaagatgtggagacagaagtcctttcaatctgcttcaacgagaaaggccctgtccacgccatgcccgtggtggattcaggcaaccggcaggaggacacccatggatcagacggggacggcgacggggaaatcgtcgacgaagacgccgccgtagccgaagcgttagccgctctcgaggccgctaccgccggtgaggacctggacgagactgactag

SEQ ID NO: 45600 - DNA, 702 bp, Artificial Sequence
  Description of Artificial Sequence: Synthetic coding sequence
atggaccaggaggagggcctgaaggccctggacaacatcgtgacccagtttaacgcctatgaagacttcctcgacagccagattacaactgtggacctttactacctcgaagatgaaaccctagcccgccagctcgtagaattaggctaccggggcaccggggaacgggtgaaacgcgaggacttcgaggcgcgtaaagctgccatagaaattgctcgactggctgaacgggcccagcaaaaaactctgacatcagcgggcaaggacctgcaggataacttcctgactgcccttgctatgcgggaggaggacaaccggtctggcaagttatcttctgttatcttcatacgggatcgaaacagccatggccaggagatatccggctacatcgattacgctcatcggttaaaaacagaggactttgaggtctattttaccggcaagaagaggctgctgcccagacctactgacatatctttttacaattgggacgccgacatcgccgtgagcaattcctcaccaaactatcaggtgatcgcagataacccagaaggtttgctattccgctataagagggataggaaaattctcaacgttgatcccaaggcccagccaggtgacaatagcacacgaatcacaatcctgaccgaattgtacgtgcaggctgtcatcttcgaccatattagccgccggaaaacatag

SEQ ID NO: 45601 - DNA, 753 bp, Artificial Sequence
  Description of Artificial Sequence: Synthetic coding sequence
atggaccaggaggagggcctgaaggccctggacaacatcgtgacccagtttaatgcatacgaggacttcctggattctcagattactacagtggacctctattacctggaggacgagacccttgccaggcagcttgttgagcttggctacagggggacaggcgagcgagttaaacgcgaagacttcgaagccaggaaagccgccatcgaaattgctaggctggcagagcgagcacaacagaaaactcttacaagcgccggcaaagatttacaagataattttctcacagcattggctatgcgcgaggaggataatagatccggcaagttgtccctgaaccagcaggagaccgatgctgcacacattctgaagaaacagcttgcgtcggtcatctttatccgcgacagaaattctcacggacaggaaattagtggctacatagattatgctcaccggctaaaaaccgaggactttgaggtgtacttcactggcaaaaaaaggcttttaccacggcctactgatatttctttttataactgggatgctgatatcgcagtgagcaacagctctcccaactaccaggtgatcgcagacaaccctgaaggcctgctgtttaggtataaacgcgatcggaagatcctcaacgtggatcccaaagctcagcctggcgacaacagcacccgaataacaatactgactgaactgtacgtacaggctgttattttcgatcacatctcaagacggaagacgtag

SEQ ID NO: 45602 - DNA, 600 bp, Artificial Sequence
  Description of Artificial Sequence: Synthetic coding sequence
atggacttcaagatcgagcacacctgggacggcttccccgtgaagcacgaacccgtttttatcagactcaatcctggcgacagaggcgtgatgatggacatatctgccccgttctttagagaccctcccgctccactcggtgagccgggcaagccattcaacgagttgtgggattatgaggtcgttgaggccttcttccttaatgacataactgagcaatatctcgaagtggagctatgccctcatggacagcacttggtcctgctactgtcagggaggaggaatgtttggaagcaggaactgcctctgtctttcagaatgagccgaggtgagaccaaatgggagggcaaggcctatttgccctggtcatactttcctcctaatgtgaccaaatttaattccttcgctattcacggctccaaggacaaaaggagttatgaagccctgtatccagtcccccagcatgagctccagcaggggcagaaacctgattttcactgcttagagtacttcaagagcttcaactttaacaccttgctgggcgaggagtggaagcagccggaatctgacctttggttgatcgagaagtgtgacatctag

SEQ ID NO: 45603 - DNA, 600 bp, Artificial Sequence
  Description of Artificial Sequence: Synthetic coding sequence
atggacttcaagatcgagcacacctgggacggcttccccgtgaagcacgagcctgtgttcatacgcctgaacccaggtgacaggggcgtgatgatggacatctccgcaccattcttccgggacccaccagcccctttgggtgaaccaggtaagccatttaatgaactgtgggattacgaggtggtggaagcattttttctgaacgatatcactgaacagtaccttgaggttgaactgtgtccacacgggcagcatctcgttcttttactgtccggtagaaggaatgtatggaaacaggaattgccactgtcatttagaatgagtcggggtgagactaagtgggagggcaaggcctatctgccttggtcttacttcccccctaacgttacgaaattcaatagctttgccatacacgggagcaaagataaaaggtcctacgaggcactgtaccctgttccccagcatgagctgcagcagggtcagaaacctgacttccactgccttgaatatttcaagagctttaatttcaataccctgctaggcgaggagtggaagcagcccgagagcgacctgtggcttatcgaaaagtgtgacatctag

SEQ ID NO: 45604 - DNA, 195 bp, Artificial Sequence
  Description of Artificial Sequence: Synthetic coding sequence
atggacttcaagatcgagcacacctgggacggcttccccgtgaagcacgagccagtcttcatccggctgaatccaggggatagaggtgttatgatggacatctctgccccattctttcgggatccgcctgctccccttggagaaccaggaaaacctttcaacgaattgtgggactatgaggtggtggaggcctag

SEQ ID NO: 45605 - DNA, 354 bp, Artificial Sequence
  Description of Artificial Sequence: Synthetic coding sequence
atggcctacggcgtgccccggaagaacaccgtgaagaccatcctgcgaggaagttgttataacgtccaagagccatgggacatcgctctactggcaaaaacttggtccacaaatttagctaacattaaattgccctttcttgaggagatatccttcggaggtagtgtgcagctgaccaaatgcaccactattaaggacggccttcttcccagtgcggaaagcattaagctggagagggagtacgaggtgaaacggctgtgtaaactaaaatgccaggagaatacgtcaaaagaaattcagttgttgctccgggaaagacccgcgggcctccgtcggcccctgcctagcaagtag

SEQ ID NO: 45606 - DNA, 354 bp, Artificial Sequence
  Description of Artificial Sequence: Synthetic coding sequence
atggcctacggcgtgccccggaagaacaccgtgaagaccatcctgcgcggcagttgctataatgtccaagaaccttgggatattgcactactggccaaaacctggtcaactaatcttgcaaatattaaactgcccttcttagaagagatcagcttcggcggttccgttcaactgacgaagtgtaccacaatcaaggacggactgcttccatcggccgaaagtattaaattggaaagagagtatgaggttaaaaggttgtgtaagctgaagtgtcaggaaaatacaagtaaggagattcagctgctcctgagggaaagacccgccggcctgcgaaggcccctcccgagcaagtag

SEQ ID NO: 45607 - DNA, 246 bp, Artificial Sequence
  Description of Artificial Sequence: Synthetic coding sequence
atggcctacggcgtgccccggaagaacaccgtgaagaccatcctgcgaggctcctgctacaacgtccaggagccgtgggacatcgcactgctggcgaagacatggtccaccaatttagcgaacattaaactcccattcctggaggagatcagcttcggtggcagcgttcaactgactaagtgtaccaccatcaaggatggacttttgcccagcgccgaaagcatcaagctcgaaagagagtactag

SEQ ID NO: 45608 - DNA, 342 bp, Artificial Sequence
  Description of Artificial Sequence: Synthetic coding sequence
atggcctacggcgtgccccggaagaacaccgtgaagaccatcctgcgcggaagctgttataacgtccaagagccttgggatattgcccttctggccaagacctggtcaactaatctggctaacattaaactccccttcctggaggagatatccttcggcggaagcgttcagcttacaaagtgtacaaccatcaaagacggcttactgcccagtgcagaatcaatcaagctcgaacgcgaatatgaggtaaagagactgtgtaaattgaaatgtcaggaaaacacctctaaggaaatccagttgctgctccgcgaacgacccgccggtcttaggaggccgtag

SEQ ID NO: 45609 - DNA, 1380 bp, Artificial Sequence
  Description of Artificial Sequence: Synthetic coding sequence
atgtacgaccgggccccccggctgctgaagctggccgagggcggctccacggaagctcatgtgggtcccggcagttatcaagtgccttttttgaagcaacaggcaacaggatccaatgcccccttcctttccctaactgcacgtgagtcgaccttcacaatcgcaagcagcattgaaaaggcagtcccagggccgggtcattacaatgtgtcagaggcacagaagatcagtcgatcccccaccctgacacgttcagtggacgtacccagtataccctcatgtggaaaatcttatgggtaccacattaacgatgatggttccataatcaagtgtttccctcccgcctgcgactcaacgctggggccagcatactacaagccccagttcgacgtgtctaacgccacactaaaatacaagggtattcattttggtaacagctctgggcggcaggagctccccaagaagagtggccccggtccaggtcaatacgatatcgttcagaagaaaacaagttactatgagaatgtcaacattaagagagatcagcagcagaattattgcagcttcattccccgcttgtatgaaatcattgtcctgcaggagaagaaaaagagatttttacccatgaaatcaattacaccggcacccggcacttacaacgagccccgtacggcactcaaatccctgaagaaaaccagcggcctcaagaacattccatttgggcaatctgctgtgaggttcacacaggacatcagaacagaagagatgcccggtcccggtttctataacgtcctgaacaataccataatcgcctctgtcagaaatatatgttccaagaagcagaaaaagagtgcatttggctctagcgtgcccagaacgttcttttccgtccaaaaggaagcttgtgctacccccggacctgcagattatcaggagttttggcatagtcagggagtgggcatcagcgatgagttgcccaacttaacgaataaatacgctgcattcctgagccgggcaaagcggacgatgaaggtgcccgatatggtaatcccagctccaggcagctatgacgttcacaagtcttacgaaatgtcccaggtcaagcacaaatatatgccccccaggtccctggtcgctaagagaaaacatgcttcgtttcttagtgccacccccagatgcctggagaaggtgacagatgggcccggaccagctgcctacaacccggtactgcgaaaaagctgccccattccattattcgtgaaagccagtaagcggtttgaggaaagtaaagaaattaccccaggcccggccacttacgaaatcagtcaggaaaaaaaaaagggcaatttaattggagagatggcagctgatatcatgtag

SEQ ID NO: 45610 - DNA, 603 bp, Artificial Sequence
  Description of Artificial Sequence: Synthetic coding sequence
atgaccagcgccgagaccgccagccgggccgccgagagcggcggcacccctgttagaccgtgttcccggccgcacagagccccctcgccggccgcccccagtcgcccgggcgcgcccgctgctggccccagaaaactcctggtcccgggtctcccttgtctggtccgcggcggttggccgtggacgcgaccagattccagcccattccgcccagctgccaggcccagaatgtcccctcatagatcacccgctgttgcccgcagatgtggtcgcccacgcaggcgtgacccccgccgccgccggaccccggcgctccctcgcccctggccaggccggggcggacctgggcggagcctcctgcaccgtcacctctttattcaacaacttctacgaacatgctggcctgccttgccgcgtgatcgaaccccagcccctggaggaacaatgcctggggccgcactggcaggtccaggaagacaggcctctggttctcctgcacctcagtcagaaggagctcctccacgtccatggacacctctccagccaggcttgcaccatcgcccgccatcctcttcatccggactactgtcttccttcttttag

SEQ ID NO: 45611 - DNA, 474 bp, Artificial Sequence
  Description of Artificial Sequence: Synthetic coding sequence
atggagggctgcgccgtgcggcggggcagctgccccctgctgcccggcccgagcgcctggcgggccagcccagctggatgggctggcagggccaagcttcgcagttggtgcagagcgtccggccttcctaacagaccttacacactcacgggcgggcggcacggaagcgttagcctgctccgtcacccgggcactaccacattcgtgcagcaaaggtccctccatcaaagttgggaaaaaaggatcgtgttctcagcttgccctgtgtcaagatcctggtgccccgagcggaactttagcggttcaatcccggctgtgacccccccaaagttgcccgggcactcaaaatctgaggggcctcccgggaaggtgcgcaagcggactacgatccgttcacagccattattcgtgacccgcacccggggcttcgggtctgccgttgggtggttgccgcttggatctcctgtcctgtag

SEQ ID NO: 45612 - DNA, 561 bp, Artificial Sequence
  Description of Artificial Sequence: Synthetic coding sequence
atgtggctggtggagtgcaccggccgggacctgaccggcctgagctgtctgctgtccatggatcgtcaacctcgtagaagacaacacgttgccggctgtcgagacgtacctcctccacttcctcaaggtagctggggacaaacaagtcctaggcattctatcctgtgcagtaaaagcggctgcgatctgctgggaggaggcgaatacaatggcgaaacgtcaggagaggaatttctggcccctgcgtggacatgtagggcccagcaagccgcaacgtggctgtccgtgcagcagacctctcacaaagctctgggcccagccggaggagcggctatgtcctctaagctctcacctgaggaacagtttctgagtagaattcactttttgcgcacattcatgtgtagtgtcgcaggggcggagttaccgggcatcccgcaggcgacagagaacggtgagggctgtcgccccgcaagagaccccgcctctagcccttcatccctgagcatggcctctgtttatacacagtgcagcagtgcccagcttgtaagtgcgctgtcttag

SEQ ID NO: 45613 - DNA, 612 bp, Artificial Sequence
  Description of Artificial Sequence: Synthetic coding sequence
atgcccaaggcccccaagggcaagagcgccggccgggagaagaaggtgatccacccctatagccggaaagctgcacagatcacacgagaggctcacaagcaagaaaagaaggagaaacttaaaaacgagaaggccctccggctgaacctggtcggcgaaaagctccagtggtttcagaatcacctagacccgcagaagaaaaggtacagtaagaaggatgcctgcgaactgatcgagagatatttgaatcggtttagttctgagctcgagcagatagagttgcataacagcattcgagatcgacagggcaggagacactgttctagggagaccgtaattaaacagacgatggagcgggagcgccaacaattcgagggttatgggttggagattccagacattctcaacgcctctaacctcaagacatttcgtgaatgggatttcgatctgaagaagttaccaaacatcaaaatgcgcaaaatatgtgcgaacgatgcaatcccgaagacttgcaagcgaaagacgattatcaccgtcgaccaagacctgggagaattagagctaaacgatgaatcaagcgattcagacgaggagatgacagctgtcgcatag

SEQ ID NO: 45614 - DNA, 837 bp, Artificial Sequence
  Description of Artificial Sequence: Synthetic coding sequence
atggtgcggggcgccggccccggccccagcctgagcgccctgagccaccccacgggagccagcggaatggccgctgcggagggtcctggttatctggtgagcccccaggccgagaaacatagacgggctcgcaactggaccgatgctgagatgcgaggtttaatgctagtgtgggaggaattttttgacgaattgaagcagaccaagcgcaatgctaaagtgtacgaaaagatggcaagcaagctgtttgagatgacaggggagcgcagactgggcgaggagattaagatcaagatcactaatatgacctttcagtaccgcaaattgaagtgtatgactgactccgagtctgcccctccagattggccctattacctggccattgacggaattctggcgaaagtaccagagagctgtgacggaaaacttcccgatagtcagccgcctgggccatccacgtctcagacggaagctagcctgagtccacctgctaagtcgacaccgctgtacttcccatataatcagtgctcctacgaaggcagattcgaagacgatcggtctgattcttcatctagcttgctctctctcaagttccgatctgaggagcgccctgtcaaaaaaagaaaggtccagtcttgtcatcttcaaaagaaacagttgaggctcctcgaagctatggttgaagaacagaggcgactgagtagggccgtggaagagacctgcagggaggttaggcgggtgctggatcagcaacacattcttcaggtacagagcctccagctacaagaacgaatgatgtccctgctcgaaaggataatcacaaagagttctgtatag

SEQ ID NO: 45615 - DNA, 561 bp, Artificial Sequence
  Description of Artificial Sequence: Synthetic coding sequence
atggccagcgtgagctaccagaagcccaccagcaccaccgtgggcaagcagatgatctttacggggcccgattacatcaaagactacctgcctaagattcatcagcacacaagctatgttggagagcagcacctggctctggaaaagacaggcgatctgaggtacctctggaggcccgcaagtaatcggtccctccccgccaagtataaacacgaatatgtctccgaaatcggctggcgcataccacaatacaactttatcaataaatcccgcctggggtcgggcttccacatcaaatatgaagagttgtcccaggcttccttagactctatcacccaccggtatcagaacccttggcaacccaagccccatgtcttagacatgcagggtaagcagtctagagctagtttcgcttggcacatgagcgccttcgaggataccgaccagcggaacagtaaatgggcaatactggtccgccagtgcaagtctagcttacctcgggctagtaagcctccaaaactgccgaaactgcccaagaaagaaaaaaaaaggaagcattag

SEQ ID NO: 45616 - DNA, 342 bp, Artificial Sequence
  Description of Artificial Sequence: Synthetic coding sequence
atggccgaccccgaggagctgcaggtgagcagccccccccccccccctcctagttcaccgagcagcagcgatgccagcgccgcatcatcacccggtgggcctgtgagcctgggatggcccgtgccttcaaggtccagcgggcccacagtggatcagctggaagaggtcgaactgcagatcggggatgccgcttttagccttaccaagctgctggaggctactagcgctgtgagcgcgcaagtggaggagctggcattcaagtgcaccgagaacgcccgcttcctgaagacctggcgcgacctgctgaaggaaggatacgattcacttaagcccgatgattag

SEQ ID NO: 45617 - DNA, 930 bp, Artificial Sequence
  Description of Artificial Sequence: Synthetic coding sequence
atgcccgccgagggcggcaagaccgacatggagcggatcggcctgtttagtgaaatggaatacatcactgtgggcgacaagtacgtcagtcagtttaaccggccatttaacgaggcagcctccaagaacaagcagatgctgcctgggggcagtaaggagatgtctgatctgcaagcaggctatttcgaccctcacttcgtgagaatttttgagggcgaaggttacatcaacctcaaccaggtaaggcggcgagacatggtggaagccgccaaaaaaaaccttggaaaggccttcttgccgtcaaacggggagaagaagccatgtggcctgggctcttattacggcaccattgggggtccggtgccttttttctcagcccagagcaagcctagggaaaagtacaaagctcctggtaaaaatctctacaccaaccccggcaaaaaaggaaccggctacgggtacgccaatattaccatcgggaagcagttttctcattctgcagacttctatgacgcagcaaaactcaagtacaagaaagcgaatgaggagcaccaccgcctgctgaagggggccccctttaagctgaatctgcatcctcgcgactactttgatgccaatccctacttctctgaggaatccctgccaccaatcaagaaagaagaaaagaagaaaaccatttctaacacctttaaaccaagtagccccggaaagaaaccggggggtatgaaggctggaacatttgatccatacccctcacatagtgctgacccctacgtcgcgaagctcgctaatatcagcggaaaggacgataaaatcttccaccccccctctggaccaaagtcaagaccagtcgaatctatcatgactctaaacgtaagaagggcgctgaactcaaaaaactacaagacttcctcagtgccatcttactag

SEQ ID NO: 45618 - DNA, 486 bp, Artificial Sequence
  Description of Artificial Sequence: Synthetic coding sequence
atgcccgccgagggcggcaagaccgacatggagcggatcggcctgttttcagagatggaatacataaccgtgggcgacaaatacgtgtcacagttcaatcggcctttcaatgaagcagcctccaagaataaacagatgctacccggaggatctaaggaaatgtctgatcttcaggccggctacttcgatccccattttgtgcggatttttgagggtgagggatacatcaaccttaatcaggtgcggcgtcgagatatggtggaagccgccaagaagaatctgggtaaagcgtttttgccctcgaacggggaaaaaaagccctgcggactgggatcatactacgggacaatcgggggtcctgtcccatttttctctgcccagtctaaacccagagaaaagtacaaggctccaggcaaaaacctttatacaaacccaggaaaaaaaggaactggttacggatatgccaatattactattggtaaatag

SEQ ID NO: 45619 - DNA, 537 bp, Artificial Sequence
  Description of Artificial Sequence: Synthetic coding sequence
atgcccgccgagggcggcaagaccgacatggagcggatcggcctgttttcagaaatggagtatattactgtgggtgataaatacgtctcacagttcaaccggcccttcaatgaggctgctagtaagaacaagcagatgctacccggcggctctaaggaaatgagtgatctccaggctggctacttcgatccacatttcgtgaggatttttgagggcgaaggatacatcaacctgaaccaggtcaggcgtcgtgacatggtagaagctgcaaaaaaaaatcttgggaaagcttttctgccgtccaacggggagaagaagccatgtggcctgggcagctactacggaacgattggaggccctgtgcccttcttctcagcacagtccaagcctagagaaaagtataaggcacctgggaagaacctgtacaccaatcctggaaagaaagggacaggctatggatatgctaacattaccattggaaaacagttctcccactccgccgacttttacgacgctgccaagctcaagtacaagtag

SEQ ID NO: 45620 - DNA, 831 bp, Artificial Sequence
  Description of Artificial Sequence: Synthetic coding sequence
atgctgcgggacagcgaggccgaggtgaccgaggaggacccccggctgcgagcccagcagttgcaccatcgcgtgcttacactccagtgtcagcttcgcgaccagggtgccgctcaccaggccagtctggacgaggcgacgcgcttacaggaggagctgcaggccaaactcgaagaactccaaaagaagcaacatgaagcaaagctggcggtcacaccactgaaagcgaagatcgctagccttgtacgcaagtgtcgcgagcgcaataggctcatcacgcacttgttgcaggagctgcatagacatgggctggggaaccttcttctttctgagttggcccagaatatgctcaatgatgtcgctctggctgagtacactgcaacttttcttgcgcccggtgtacccgagacctcacaccatctggacgtgaaatccgagatgacagccgcccttagggctcagacttatctgcttaatccggaaatggatagcgtgcttcaatcatcgttaagctctgagagttggccgatccctgaacctgaatggcctgcccagactgcccaactcgattcactaaagctcccactttctcttgtgagtacactagatccgggcacttgcctcgccgccgttactgtcgagcccgggctcccggcccagcgcttgcaagagaaaggaggaatgccatgtcctgcacttcaagttgacaacgtgccagccccctccgagctgctgagccctgcacggatcctcgctttccatcaagaactccgccagtccatttgctcaaacagtcaggtacataagtctcctttggaactggaaatgtag

SEQ ID NO: 45621 - DNA, 2253 bp, Artificial Sequence
  Description of Artificial Sequence: Synthetic coding sequence
atgctgttcttcgccggcgagaccggcctgcccctgttcccccggtttgccctttctgttgagggtgctgagccaactgaccacggccatcctcaagccgttagtaaagggcacaacaggtgtgccctgacaatcgacgagttggcccaggatgtggaggcctgcttccagcagctgagtactcttcagcccggaagtcggggttggcagtgctcagcttcagcctgccggggcgaaaattggagcttcgctcagaagtggcattctggctgggagcgagcccacagccaacaggtctggggcaactgggggatttgtagcaacgaagaggccaagagcaaggaaagtggcgagggagacaagccaggcaaaaccacggctctggggacgtctgaggtgcccgggaacccaggtacactaccccattgggatgaggcatctccaaacccaccacagggcccggcagagccttggggggccctcgagcgagtccgcagcagatttcaccagctgatctctgggcttaaaaagcagaggtcccagattttgcacgataatacgaaactgcatggagaccaggagcggttccatgagcgcgtgtgtgccctggagcgagaaagggagagagaggttacaaagatatctagactggaacgggacaatcatcgcctcgtgggcgacatctcccaactgaaaaaagaattggatcagtacctgcaggcgatttcagacttagaggactgcaacggcaagtcttactgcaaaattctagagcttgaggaagaaaacgagacactgaaggggaacctgggccagctgcagaaggctacttccgagtcagtgagaaaatcgaaggacactatggaacaggtgactcttgaaaactggaagctgcagactttgatctcagaactaggggtcagttacaaggagctgatcaaggatatcgtcctgggaatcgaagacatgatccgtgcgctgtcaggcgaaaacgaacatctcctgaggagagtgcatgtactcgagcgcgaagtcacccttcaacgaagtaccgatcaggggcggctggtacggggtagggagcacctgcaggggaaagcaaaaatgcatgcccttgataaagaggtgcaagttacccctctcaccgggcagctactcagcagagcctgtggcccacccctggaagaggaaatgagccttgcggctggtcagactggcccatcaacgggcacaggtaatagccgccgaggcgccgatagtccacctcccagtttggtatggaggaacactggcgtcgctaacgctctccaaggaaacgtcagcggtgctgaggtaaaggaggcacatcttgaaaaggaggagaagcgcccaaggtgcagcgttgcccaaggccaagccctttcctctctctcaaatggccccatgctgcgcgatagtgaggcagaggtgactgaagaggatccccgactgcgggcacagcagctacaccacagggtgctgaccctgcagtgccagcttagggaccaaggggccgcacaccaggcctctcttgatgaggccaccaggcttcaggaagaactgcaggcaaagctggaggagttgcagaaaaaacaacacgaggctaagctggcagtgacaccattgaaggccaagatagcctcactggtgcgcaaatgccgggagagaaatcgactgattacccacctcctccaggagttgcatcggcacgggctgggaaacctgcttcttagcgaactagcccagaacatgttaaacgacgtcgctcttgccgagtataccgcaacatttttggcgcccggcgttccagaaacttcccatcacttggacgtgaagagtgaaatgaccgccgccctacgcgcccagacctacctcttgaaccccgagatggactcagtgcttcagtccagtctcagttctgaaagctggcccatacccgaacccgagtggcctgctcagaccgcacagctcgactcactgaagctccctctttccctcgtgtcaacactggaccctgggacttgtctggccgccgtgacggtggagcctggcttgccggcacaaagactccaggagaagggagggatgccttgtccagctttgcaggtagacaacgttcccgctccctctgagttgttgagcccggcgagaatcctcgccttccatcaagagctccgacagtcaatctgcagtaattctcaggtccacaaaagccccctcgagctcgaaatgtag

SEQ ID NO: 45622 - DNA, 609 bp, Artificial Sequence
  Description of Artificial Sequence: Synthetic coding sequence
atgagccactacttctacctgaccccccagatcctgctgcccttctcgccgctgacaagccaggaattcgacctgatcagacggaaggctggggccagttggcaggatgagaccagatggagcgattcttcagttaccacatacaccggctcatatcgtaaaaaacagcttgacaaaagcatgtgctcgcagttctctttccgtgcggggcagcatgagcctgaatgcaagcagatgtccctcacaaacagttctgcatgtcacttactctgctgggctggtactcaagagacaacggacatcaagggcctttttcctgacattacccgcccctttaaaaagtcgttcgacgtgaagcacggcgtcgcccaccagatctgggatttcggcgactgctttccgaccccaccgaattacgggaaatactgcgtccggcccaagaagccagcacaggaggctctgatcaactactcccgcagggggaagggagtgctgaaacatctgcacggcaggtgcgactcagagtcaaaggtgtgtagctccgaggattctgaggctgataggtactccgactatgggtggggagggccaagttccccttttaactag

SEQ ID NO: 45623 - DNA, 489 bp, Artificial Sequence
  Description of Artificial Sequence: Synthetic coding sequence
tgagacagcagcgtgaccacctacaccggcagctaccggaagaagcagctggataagtctatgtgctctcagttcagttttagggcagggcaacacgaacccgagtgtaaacaaatgtcactcacgaactcgtccgcctgccacctgttatgctgggctggcacccaagaaacaactgacataaaagggttattccccgatatcacaagaccttttaagaagtcattcgatgttaaacacggagtggctcaccagatttgggacttcggcgactgttttcctaccccgccgaactacggaaaatactgtgtgcggccaaagaagcctgctcaggaggcgctgataaactacagtagaaggggaaaaggggttctgaagcacctccacggtagatgcgactctgagagtaaagtctgttcttctgaggactcagaagcagatcggtacagcgactatgggtggggggggccgtcatccccgtttaactag

SEQ ID NO: 45624 - DNA, 507 bp, Artificial Sequence
  Description of Artificial Sequence: Synthetic coding sequence
atggtgaaggaggtgtggcgggtgctgcgggaggagcccggccggagaaaagaatccagacagaatagggcgcgtggcaatagggtccagcaaaatagtagcaatttaaatccaaccccagctccaggcccccactccaccgagtccagggggcgacgccgcgctggcagtgaagctccaccggtgcccggaagtgagtccttgagcactagttcagagcgaggacatggccctgcagttggaaatctcgtgtcggaaagcgccggacggagcgcaggtcaggggagccccgggcctgatgccatgagccggaatttgaggaccgccctgatcttcgggggctttatttcgctgatcggcgcggcattttacccaatctacttcaggcctctaatgcgtctggaagagtataagaaggagcaggcaatcaatcgggccggcattgtgcaggaagacgtgcagccccccggtctgaaagtgtggagcgatccctttggacggaagtag

SEQ ID NO: 45625 - DNA, 204 bp, Artificial Sequence
  Description of Artificial Sequence: Synthetic coding sequence
atgagccggaacctgcggaccgccctgatcttcggcggcttcatcagcctcattggagctgctttctacccaatctacttccgccccttaatgcgccttgaggagtacaaaaaggaacaggcgatcaaccgagctgggattgtgcaggaagatgtccagccccctggactgaaggtatggtcagacccattcggccgtaaatag

SEQ ID NO: 45626 - DNA, 282 bp, Artificial Sequence
  Description of Artificial Sequence: Synthetic coding sequence
atggacacccagaagcagatccacaagacccacaacagcaagaaccagttctttacaatcttctttttcctcagtgtggagtttgggaaggaaggtacgcgaaagaatttttacctccttctgtcaatcggccactacgggcggaaaagccggcgggccgatctgggtactgccgatactgcagacaagactgagcccgagtgctttgcagccagctggacttttgatccaaaccctagtgtaactgtgtccggcgcccattccaccgccgtacatcagtag

SEQ ID NO: 45627 - DNA, 477 bp, Artificial Sequence
  Description of Artificial Sequence: Synthetic coding sequence
atgcccgagccccccacccccagcgtgggcagctgcgccgcccgggcaagccgcatgagcgcggctccttgtagccgcgccccttcaccgatagatcacccgagggccgaggagtgcggccgggcagctcgagattggcaggctgcaccccccgcagcacccgtgagagaccccctcggagaagcttcatgggcccctgaaagcggcgaggacatggaaaatctttatgtccagctcaaactgcaaagcgttggaacctgtttcaatagggaggaactaccatccgttcttcaaggtgaagaattgggagctacctctgtaactaataagcctggcctgtctgccatgagaaaggagaccgaccagcaagtgggagagagaaagctcacatattgtggcgaccaagttactctgttcaccgaccaagcactgagccagattctgagtagtgaggaaggcaggatcaaggtgatgtag

SEQ ID NO: 45628 - DNA, 1329 bp, Artificial Sequence
  Description of Artificial Sequence: Synthetic coding sequence
atgagcgacagcgccggcggccgggccggcctgcggcggtaccccaagctgcccgtgtgggtggtggaagatcaccaggaagttctcccattcatataccgtgccattggatcgaagcacctccctgccagcaacgtatcctttctgcattttgacagtcacccagatctgctaatccctgttaatatgcccgcagacacggtctttgataaggagactctgttcggcgaattgagtattgagaattggatcatgcccgccgtttacgccgggcatttttcccacgtgatttggttccatccaacttgggcacaacagatccgtgaggggcgtcaccatttcctagtggggaaggatactagtacaactacaatacgtgtcacttctacagatcactacttcctgtctgacggattgtatgtgcctgaagaccagctggaaaaccagaaacccctccagttggacgtgatcatggtcaagccatacaagttgtgtaacaaccaagaggaaaatgacgccgtatcctccgccaagaagccgaaattagcattggaagattctgaaaatacggcctcaaccaactgtgatagttcttctgagggtctcgaaaaggacacagctacacaacggagtgatcagacctgcttggagccatcttgtagttgttcttcagagaaccaggagtgtcagacagcggcttcaactggagaaatcttagagatcctcaagaaaggaaaggcctttgtgttggatatcgacctggattttttctccgtgaaaaacccttttaaagaaatgttcacccaggaggagtacaaaatactgcaggaactttatcagttcaagaaacctggcacaaacctcaccgaggaggatctggtggatatagtggatacccggattcatcagcttgaggatctggaagccaccttcgctgacctgtgtgatggagacgacgaagagacagtacagagatgggctagtaaccctggcatggagagccttgtgccactggtgcaatctctgaagaaacgcatggaagtccccgactacgaaatggttcatcaggccgggctaacctgcgattactcagaactgcctcaccacatatccaccgaacaggagattgagtgcctgatacagagcgtgcactacctcctaaagaatttaccaaatccgaccttggtgaccatagccagatcttcactggacgattactgcccatcagaccaggtggatacgattcaagagaaagtcctgaatatgttacgggccctgtacggcaacctggatctgcaggtctacgcagcagagtcccctccaagttag

SEQ ID NO: 45629 - DNA, 492 bp, Artificial Sequence
  Description of Artificial Sequence: Synthetic coding sequence
atggaggtgcccgactacgagatgttccccgccagcagcagcagcccatctgaaactacatctgcctggatcagtctcagtatgtcactcagcgctttctggtccaagccttttaacaaaagtctgggaagcagtaaactgagcaacatttcactcccctcgtcggaacctagtaagctttttcagcccctgcccgtccctaagctgcttccacattttcaggtgcaccaggcagggttgacgtgcgactactccgagctgccacatcacatctcaacagaacaagaaattgaatgtctgattcagtcagtgcactatctgttgaaaaacctcccaaatccgacactggttactatagctcgctctagtctggatgattactgcccgagcgaccaagtggacaccatccaggagaaagtgcttaatatgttgcgagctctgtacgggaacctggacctgcaggtatacgcagctgagagtcctccttcctag

SEQ ID NO: 45630 - DNA, 534 bp, Artificial Sequence
  Description of Artificial Sequence: Synthetic coding sequence
ctggtgagccaggaggagtacaagatcctgcaggagctgtaccagtttaagaagccaggcacgaacttgactgaggaagacctggtggacattgttgatacccggattcatcagctcgaggacttggaagcaaccttcgcagacctatgcgatggagacgatgaggagaccgtgcagcggtgggcctccaacccaggaatggagtccctggtgcccctggtgcagagcctgaagaagagaatggaggtgccagactacgaaatggtgcatcaagccggactgacctgcgattactccgagctcccccaccacatctcaacagaacaggagatcgaatgccttattcagtcggtccattacctcctcaagaacctgccaaatcccactctcgtgaccatagcgcggagtagcctggatgattactgccccagcgatcaggtagacaccatacaggaaaaggtgctcaatatgcttagggcactgtacgggaatctggatctgcaagtttacgctgcagaatcacctccctcttag

SEQ ID NO: 45631 - DNA, 567 bp, Artificial Sequence
  Description of Artificial Sequence: Synthetic coding sequence
atgatgcaccccgtggccagcagcaaccccgccttctgcggccccggaaagccatcttgcttaaacgaggacgccatgagagcagcagaccaatttgacatctactcatcccagcaaagtaaatacagccacaccgttaatcataagcccatggtgtgtcaaagacaagaccctttaaatgagactcatctccagactacatctggacgatccattgagattaaagacgagttaaaaaagaagaagaatttaaacagatcagggaagcggggccggccctccggaacgaccaaatccgctggctatcgcacctctacgggaaggcctcttggaacaaccaaggccgcagggttcaagactagtccagggcgccccctgggcactacaaaggccgccggctataaggttagccctgggaggccccctgggtcaattaaggcactaagtaggctggctgacctgggctacggttgtggcacggccgcgttcccctaccctatgatgcacggacgtgcagtccacggggtggaagagacctcgtcagaggtgaagcctccaaacgagtag

SEQ ID NO: 45632 - DNA, 567 bp, Artificial Sequence
  Description of Artificial Sequence: Synthetic coding sequence
atgatgcaccccgtggccagcagcaaccccgccttctgcggccccgggaaaccctcctgtcttaacgaagatgcaatgagagcagcagaccagttcgatatatattctagtcagcaatctaagtactctcacacagtaaatcataagcccatggtatgccagcggcaggacccgctcaatgagacccacctgcagaccacttcagggagaagcattgaaatcaaggacgaactcaagaagaaaaaaaacctcaataggagcggcaaaagaggtcgcccctcggggaccaccaaaagtgccggctatcgcacatccaccgggcggccattgggcacaacaaaggctgccggcttcaagacgtccccaggccgcccacttggcaccaccaaggcggcgggctacaaagtgagccctggaaggcccccaggcagcattaaagccttgtcgcgtttggccgatctcggatacggctgtggcacagcagcctttccataccctatgatgcatggacgagccgtccacggcgtggaagagaccagttcagaagtgaaaccaccaaatgagtag

SEQ ID NO: 45633 - DNA, 567 bp, Artificial Sequence
  Description of Artificial Sequence: Synthetic coding sequence
atgatgcaccccgtggccagcagcaaccccgccttctgcggccccgggaaaccctcctgcctcaatgaagacgctatgcgggccgccgatcagtttgatatttacagtagccagcagtcgaagtattcgcataccgtcaaccacaaacctatggtgtgccagcgacaagaccctctcaatgagacccatctccagactactagtggaagaagcatcgaaatcaaggacgaactgaaaaagaaaaagaacctcaaccggagcggaaagagggggagacccagtggcaccacaaagtccgccggataccgcacatcaacaggtagacccctgggcaccaccaaagcagcggggttcaaaacatctcctgggcggccacttggaacaactaaggccgctggatataaggttagtccaggcagaccgccagggagtattaaggcgctgtctcgcctcgccgatctgggctacggttgtggcacagccgctttcccgtaccctatgatgcatggcagagcggttcacggagtggaagagactagttcagaagtgaaacccccaaatgaatag

SEQ ID NO: 45634 - DNA, 24 bp, Artificial Sequence
  Description of Artificial Sequence: Synthetic coding sequence
atgatgcaccccgtggccagctag

SEQ ID NO: 45635 - DNA, 1002 bp, Artificial Sequence
  Description of Artificial Sequence: Synthetic coding sequence
atgccccggagcttcgagcaggtgatcatcctgaagaagtggttcctcaaaccatataagggacagacccttcccgggcgggtcctgttcctgagatacgtggttcagactttggaggacgatttccagcagacgctgcgccggcagaggcagcatctccagcagtccattgccaatatggttctctcttgcgacaaacagccccataacgtgagagacgtgattaaatggctcgtgaaggccgtcactgaggacgggctcacccagcctcctaacgggaaccaaacatcttcaggtaccggcatcctgaaggccagtagcagccatccttcttcccagcccaacttaacgaagaatacgaaccaactgatcgtgtgccaactacaacgaatgttaagcatcgctgtggaggtggatcggacgccaacctgctcaagcaataagattgctgaaatgatgtttggatttgtgttggatattccagagcgtagccagagagagatgttcttcaccacaatggagtcccaccttcttcggtgtaaggttcttgaaattattttcctccactcatgcgaaacccctaccaggctacccctgagcttagctcaggctttatacttcctaaacaatagtacgtccctgttgaaatgtcagagcgacaagagccaatggcagacctgggacgaactggtagaacatctgcagtttctactttccagttaccagcacgtgctgcgtgagcaccttcgatcgagcgttatcgatcgtaaggacttaatcatcaagcgcatcaagcccaaaccacaacagggggatgacattactgtggtggatgttgagaagcagattgaggcatttcgctcacgactgattcagatgctaggggaaccactggtccctcagttgcaggacaaagtccatctcctcaagcttttattgttttatgccgccgacttaaacccagacgcagaaccgttccaaaagggatggtccggtagctag

SEQ ID NO: 45636 - DNA, 1374 bp, Artificial Sequence
  Description of Artificial Sequence: Synthetic coding sequence
atggaggacttcatcgtgatcagcgacgacagcggcagcgagagctcgggaggtgcccgtcccggccgctctcgccgcccccgaagggcactgagcagaacctccggcgcccttccacgccggaccgtgaataagggccagaaactggagccgatcccccatcggcggctcagaatggttaccaatacaatcgaagagaactttccactgggcacagtgcaattcttgatggattttgtatcaccacagcactaccccccacgcgaaattgtcgcccacattatacagaagatcctcctctctggcagtgaaaccgtggacgtgctgaaggaagcctacatgttactgatgaaaatacagcagcttcatcctgctaacgctaaaaccgtggaatgggattggaaattgctgacttatgtcatggaagaggagggccagactctgccaggccgcgtcttgttcctgagatatgtcgtgcagaccctcgaggacgactttcagcaaacactgcgccggcagagacaacacctccaacagagcattgctaatatggttctgagttgtgacaaacagccacataacgttagagacgtgatcaagtggctcgtcaaagccgtgactgaggatggcctaacacagcccccaaatgggaaccaaacctcctctggtaccggaatcctcaaggctagctcttcccacccctcatcccagccaaaccttactaagaacacgaatcagcttattgtatgtcaactccagcggatgctgtctattgctgtggaggtggatagaacccctacctgtagctctaacaagatagccgaaatgatgttcgggtttgttctggatatcccggagaggagccagcgggagatgttcttcaccacgatggaatcacatctacttcgttgcaaggtcctagaaataatcttcctacacagctgcgaaactcccacccgactgcctctgtccttggctcaggccctgtattttctcaacaactccaccagtttattaaagtgccagtctgataaaagccaatggcagacatgggacgagctagtagagcacctgcagttcctgttatccagctaccagcacgtcctgcgtgaacatctcagaagttcagtgatcgacagaaaagaccttatcatcaaaagaattaagccaaaaccacagcaaggagatgatatcactgtagttgatgtggagaagcaaatagaggccttccggtctagactcatccagatgctaggtgagccactagtccctcagttgcaagacaaagtgcatttgctcaaattgcttttgttctacgcagccgatctgaatcccgatgcagagccctttcagaagggttggtctggaagctag

SEQ ID NO: 45637 - DNA, 978 bp, Artificial Sequence
  Description of Artificial Sequence: Synthetic coding sequence
atggagggccacgtggaccggagcagccagcccaccgcccggcggataatcaattcagatccagtcgatcttgatttggtcgaggagaacacattcgtcgggccacccccggcaacaagcattagtggcggaagcgtgtacccaacagagcccaactgctcttctgcaacattcacgggtaatttgtcgttcctggctagcctccagctaagcagtgacgtttcgagtctgtctcctacaagcaacaactcgcgcagcagctccagtagctccaatcaaaaagccccgcttccctgcccacaacaagatgtaagccgcccgcctcaggctctgccatgccccctccgacctctgccttgcccaccgcgggcctcaccatgtccaccacgagcttcatcatgcccccccagggcattgtcctgtccttcacaaacaatgcaatgtcagctgcccgctctcacccaccccccccaggaggtgccgtgtcctcggcagaatatcccaggcccaccacaggattccctgggtcttccacaggacgtgccggggctgccccagagtattctccacccccaggacgtcgcttatctgcaggatatgcctcgttcccccggcgatgtgcctcagagcccaagcgacgtatccccttcgcccgacgcaccccagagccccggtggaatgccgcatcttccaggtgatgtgctgcacagccccggcgacatgccccattcttccggagatgtgacgcacagtccccgtgacatcccgcacctgccaggagatcgcccagacttcactcagaatgatgtgcagaaccgcgatatgccaatggacatctctgcccttagctcaccaagctgcagcccaacatggggtacagaacaggacagcgttaaaaaaaagaaaaagaagaagaggaaggaaatacctcctaatttcctcctttttaatttatacaggaccagggttaaaaactag

SEQ ID NO: 45638 - DNA, 1836 bp, Artificial Sequence
  Description of Artificial Sequence: Synthetic coding sequence
atggaggacttcatcgtgatcagcgacgacagcggcagcgagagctctgggggcgctcggcctggtcgttctcgccgccctaggcgagccctgtctcgcacgtctggcgcactgccgaggcgaacggtggactttatagacctaacccgagagacaagacccaggacaaaggaccggtcaggactctatgtgattgatctgacaagagcagagggcgagaaccggcccatcgctacactggacctgactctcgaacctgttactcccagccagaaagagcctactagcctgcaaacctgcgccagtttatcgggtaaagcggtgatggagggacacgtagataggtctagtcagcctacggccaggagaatcattaattccgatccagtggacttggacctggtcgaagagaatacattcgttggtcctccgcccgccacaagcatttctggcgggtcagtatatcctacggagccaaactgtagttcggctacattcactggcaatttatctttcctagcatcgctccagttgagtagcgatgtctcgagcctgtcacccacctcaaataattctagatcaagcagctctagctctaaccaaaaagctcccctcccctgtccccaacaggatgtctcgaggcccccacaggccctcccatgtccactgaggcctcttccgtgccccccccgcgcttcaccctgcccacctcgtgctagctcatgtcctccaagagctctgagttgcccatctcagaccatgcagtgccaactccctgctctgacacacccacctcaggaagttccgtgtcctcgccagaacatccctggccccccccaggattctctggggttaccgcaagacgtgccagggctgccacagtccatcctccatccacaagatgttgcctacctccaggatatgcctcggtcgcccggagatgtaccgcagtcgccaagcgacgtaagtccatctcctgacgccccacagtcccccggagggatgccacatttgcccggagacgtgttgcattctccaggagacatgcctcactcctctggcgatgtcacccacagccctcgagatatcccccatttgccaggagatagaccagattttacccagaatgacgtccagaaccgtgacatgccaatggacatctctgcactgagctctccttcttgctctccatcaccccagagtgaaactcctctggaaaaagtgccctggctgtcagtcatggaaactcccgctcgcaaggaaattagcctgagcgaaccagcgaagccggggtccgcccacgtgcagtcacgcacacctcagggcggcttgtacaataggccttgtctccatagattgaagtatttcttacgaccgcccgtccaccacctgtttttccaaacactgatccctgacaaggatacgcgcgaaaataaaggacaaaaactggaaccaatcccgcaccgcagacttcgcatggtaacaaatactatcgaggagaatttcccactcggcaccgtccagttcctcatggatttcgtctcccctcaacactaccctccgagggaaattgtggcccatataattcagaagatcctcctaagcggctctgagacggtagatgttcttaaagaggcttacatgctgttgatgaagatccagcagctgcaccctgccaacgccaaaaccgtcgaatgggactggaagctgttgacttatgtgatggaagaggagcccgctgagtgtttaagactgcaggctcgagcaaccacccctgactggttttggtggcgacggggcttcgctgtattggcaggccccgttagttcgccctag

SEQ ID NO: 45639 - DNA, 1374 bp, Artificial Sequence
  Description of Artificial Sequence: Synthetic coding sequence
atggaggacttcatcgtgatcagcgacgacagcggcagcgagagcagcggtggggcaagacctgggagatcaaggcgacctcggagagcacttagcagaaccagtggggcacttccaagaagaacagtaaataagggtcaaaaactggaacctattccacatagacggttgcgaatggtcactaatacaatcgaggagaactttcccctagggacggtgcaatttttgatggattttgtcagcccacaacactaccctccacgtgagatcgttgcccacattatccagaagatactgctctcaggctctgaaacggtggacgtgctgaaggaagcctatatgttgctgatgaaaatccaacagttgcatcctgccaatgctaagactgtggagtgggactggaagctgttgacgtacgtgatggaggaggaggggcagaccctgcctggacgtgtgttgttcctacggtatgtggtgcagaccctggaagatgactttcagcagaccctcagaaggcagagacaacatttacagcaaagtattgctaatatggtgctttcttgcgataagcagccccataacgtcagggacgtaatcaaatggctcgtaaaagcggtgacagaagacggccttacccagccgcccaatgggaaccaaacaagctccggcaccggaatacttaaagctagcagcagtcaccccagcagtcagcccaacttaactaagaataccaatcagctcattgtgtgccaattgcaacgtatgctgtcgatagctgtggaagtcgaccgcacccctacctgcagctctaataaaatcgcggaaatgatgtttggattcgtgctcgacatccctgagaggtcccagagggaaatgttctttaccactatggaaagccacttgctgagatgtaaggtactggagataatctttctccattcctgtgagacccctacacgacttccattaagtttagctcaagccctgtacttcttgaataactccacatccctactgaaatgtcagtccgacaagagccagtggcagacatgggacgagctggtggagcatcttcagttccttctctctagctaccagcacgtgttacgggagcacttgcgctccagcgtgatcgataggaaggacttgattatcaagagaatcaagcccaagccccagcagggcgacgacatcacagtggtggacgtggaaaagcagatcgaggcatttaggagcaggctcatccagatgctaggcgaaccactggtcccccagctacaggataaggtgcatctgctcaagttactgctgttttacgctgccgacctcaatcccgatgccgaaccattccagaaggggtggtccggtagctag

SEQ ID NO: 45640 - DNA, 2619 bp, Artificial Sequence
  Description of Artificial Sequence: Synthetic coding sequence
atggcccccgccagcgccagcggcgaggacctgcggaagctgcccactatggctgaggtcaacggcgagcaggatttcattgacctcactcgagagacccgtccgagaacgaaggatagaagcgggctgtatgtcatcgatcttacgcgtgccgagggtgagaaccgccccatcgcaacgctcgatctgactctggagccagtaacgcccagccagaaggaacccactagcttgcagacatgcgcaagcctgagcggaaaagcagtcatggaaggtcatgtggatcgctcgagccaacccacagcccgccgcatcatcaacagtgaccctgtggatctggacttagtcgaggagaatactttcgtgggaccaccgccagcaactagcatttccggaggtagtgtctacccaaccgagccgaactgttcaagtgctaccttcaccgggaatctgagtttcttagcttcactgcagctttccagcgatgtaagcagcctttcaccaacatctaacaactcgagaagttcatcttcttcgagcaaccaaaaggctccattgccctgtccccagcaggacgtcagccggcccccccaggccctgccatgccccctgcgacctttgccatgtccgcctagggcgagcccgtgcccgccacgtgcctctagctgtcccccccgtgccctttcatgtcctagtcagaccatgcagtgccagctgcctgcgctcacccacccaccccaggaagtgccatgcccacgacagaacattccagggcctccccaagattctctggggctgcctcaggacgtcccaggactgcctcaatctatcctgcacccccaagatgtcgcctatctacaagacatgccacgcagccccggggatgtgccccagtcaccttctgacgtctccccatccccagacgcaccccagtcccctggcggcatgccacacctgccaggggacgtcctccactctcccggcgacatgcctcactcttctggtgatgtcacacactctccccgggatattccacacctgcctggcgacaggcccgattttacacagaacgacgtgcagaatcgcgatatgcccatggacatctctgcactgagcagtccatcttgtagcccatcccctcagagcgagacaccactggagaaggtcccttggctcagtgtgatggagacccccgcacgcaaggagatctctctgagcgagccggctaagcctgggtctgcacacgtgcaatcacggacaccacaggggggcctctacaatcggccttgtctgcacagacttaaatatttcctaagacccccagtgcaccatttgttttttcagaccttaatccccgataaggacactagggaaaataaaggccagaagctggagcctattccacatcgaagactcagaatggtgacaaataccatcgaagaaaattttcccttgggtactgtgcaattcctgatggatttcgtgtctccacagcactaccctccacgcgagattgtggcccatataattcaaaagatcctgctttctggatcggaaacagtcgatgtgttgaaggaggcttacatgttattgatgaagatacagcagttgcatccagccaacgcgaaaaccgtcgagtgggactggaagcttctgacctatgtgatggaggaggaaggccagacattacccggtagagtgctgttcttacgatacgtggtacagacactggaagacgactttcagcaaaccctgaggcgccagcgacaacacctgcagcagtctattgctaacatggttctgagctgtgataaacagccacataatgttcgcgacgtgattaaatggctggtgaaggctgtaaccgaagatggcctgactcagcctccgaacggtaaccaaacttcctccgggactggtattctgaaggcctcatcatcccacccttctagccagccaaatctgacaaagaatactaatcagttgatcgtgtgccaacttcagcggatgttgtctatcgcagttgaagttgatcggacacccacttgcagctcaaataagatagcggaaatgatgtttgggttcgtgttagatatccctgaacgatcccaaagagagatgtttttcaccacgatggaatcccacctgctcagatgtaaggtgttagaaatcatttttcttcactcatgtgagaccccaaccaggttgccccttagtttggcgcaggccctgtactttttgaataattccacttcgctgctcaagtgtcagagcgacaaatctcagtggcagacttgggacgagctggtggaacatttacagtttctgttgtccagttatcagcatgtactgcgggagcatttgaggagtagcgttattgataggaaggacctcataatcaagaggataaagccgaagccccaacagggtgatgacatcacagtggtcgatgttgagaaacaaatcgaggcttttcgatctcgcctgattcaaatgcttggcgagccgctggttccacagctacaagacaaggtccatctgctgaaactgctgctgttttacgctgcagacttgaatccggatgctgaacctttccagaagggatggagtggctcttag

SEQ ID NO: 45641 - DNA, 291 bp, Artificial Sequence
  Description of Artificial Sequence: Synthetic coding sequence
atgaccccctgcctggagagcttctgccagcgggccaaggactgcaagcagaatatcccgctgcctttcctgatccaggattggccactgagcgaaagcaaaccccaagggcaggatttttggacacctcagccattacaggctgcagcccctagtcacgaatttcagcaagtcgccctgcatcccgcacgaactcgattggctagtcggccccaaggcggtagactgatgtcatcacgagaagtggggcttcgagcgcccaggtgctcatgcgggaaaagaaaacgttag

SEQ ID NO: 45642 - DNA, 291 bp, Artificial Sequence
  Description of Artificial Sequence: Synthetic coding sequence
atgaccccctgcctggagagcttctgccagcgggccaaggactgcaaacagaatatacccctgccctttctgattcaggactggccattaagcgaatccaaaccacagggccaggatttttggacaccacagcccctgcaggctgccgctcctagccacgagtttcagcaagtggccctgcatcctgctaggactcgattagcaagtaggccccagggcgggcgactaatgtccagccgggaagtcgggctccgggccccaagatgctcttgtggaaaacgcaaacgctag

SEQ ID NO: 45643 - DNA, 621 bp, Artificial Sequence
  Description of Artificial Sequence: Synthetic coding sequence
atggaggtggacatcaacggcgagagccggagcaccctgaccacccttccattccctggtgctgaagctaactctccagggaaagctgaagccgagaagcctaggtgctctagtacaccctgtagccccatgagacggactgtctcaggctaccagatcttgcacatggattccaattacctggtcggcttcacgactggcgaggagcttctgaaactggctcagaagtgcacaggcggagaggagtctaaggcggaggctatgccgtccctgcgcagtaagcaacttgatgcaggtttagcgcgcagctccaggctgtacaagacaagatcgaggtactaccagccttacgaaatcccggctgtgaacggacgcagacggcggcggatgccttcttctggcgacaagtgtaccaaatcacttccttacgagccatataaggccctccatggacccctgccactctgtctgcttaagggcaagagagcacattctaagtccctggattacctcaatttagataagatgatcaaggagcctgcagacacagaggtgctgcagtaccagttgcaacatcttacactcagaggggatcgcgtatttgcaaggaacaacacctag

SEQ ID NO: 45644 - DNA, 621 bp, Artificial Sequence
  Description of Artificial Sequence: Synthetic coding sequence
atggaggtggacatcaacggcgagagccggagcaccctgaccaccctgccgttccccggggccgaagccaactcaccaggaaaggccgaggctgagaaacctaggtgctcctccacaccctgtagccctatgcgcaggacggttagcgggtaccagatcctgcacatggattctaattatctggtgggtttcactacaggggaggagctactgaaactggcgcagaaatgcacggggggggaggaatctaaggccgaggcaatgccttcattacgctcgaaacagttggacgcaggtctcgcccgtagttcacgactctataagacacggagtcggtactaccagccttacgagattcccgccgtgaatgggagacggaggcggcgtatgccctcttctggggacaagtgtaccaaaagtttgccctacgaaccctataaagcccttcatgggcctttacctctttgtctgctaaagggtaagagggctcatagcaaatcactcgattacctgaatttggataagatgatcaaagagcctgcggataccgaggttctgcagtaccagttgcagcatcttacactccgtggtgatagagtgtttgcccggaacaatacatag

SEQ ID NO: 45645 - DNA, 621 bp, Artificial Sequence
  Description of Artificial Sequence: Synthetic coding sequence
atggaggtggacatcaacggcgagagccggagcaccctgaccaccctccctttcccaggggcggaggctaactccccagggaaggccgaagccgagaagccgcggtgcagtagcacaccatgcagccccatgcgccgcaccgtctccggctatcagattttgcacatggactccaactatctggttggttttaccactggtgaagagctgttgaaactggctcagaagtgcaccggcggggaggagtcaaaagctgaggccatgccttcactgagaagtaagcagctggatgcaggattagccaggagtagccgcttgtacaagaccaggtctagatactaccaaccatatgaaatcccggccgttaacgggaggcggaggagaaggatgcctagcagtggggataaatgtactaagtcattgccatacgaaccatataaggccctgcacggcccacttcctctctgcctgctgaaaggaaagcgggctcacagtaaatctctcgattatcttaacctggacaaaatgattaaggagccggccgatacggaggttctgcagtaccaactgcagcatcttacactgcgcggcgaccgggttttcgcaaggaacaatacctag

SEQ ID NO: 45646 - DNA, 621 bp, Artificial Sequence
  Description of Artificial Sequence: Synthetic coding sequence
atggaggtggacatcaacggcgagagccggagcaccctgaccaccctgccattccccggggccgaagcaaattctccggggaaggcagaagctgagaagcctcgatgctccagcaccccttgcagccccatgaggcgcactgtctctggctaccagatattgcatatggacagtaactacctggtcgggtttactaccggcgaagaattgctgaaactcgcacagaaatgcaccggtggtgaggagtctaaagccgaggcaatgccttcattacggtcgaaacaactagatgcagggctcgccagatcgtctcgattatataagacccggagccgctactaccagccgtacgagatacccgccgtaaacggaaggcgcagacggcgaatgccatcaagcggggataaatgtacaaagagtttgccgtacgaaccatacaaggcactgcacggacctctgcctctctgtctcctaaagggtaagagggcccacagcaagtcactggactatttaaatctagacaaaatgatcaaggagcccgcagacacagaggtgctgcagtaccagctgcaacacctgaccctgagaggggatcgggtgttcgctcggaacaacacgtag

SEQ ID NO: 45647 - DNA, 294 bp, Artificial Sequence
  Description of Artificial Sequence: Synthetic coding sequence
atgaaccaggagaacccccccccctaccccggccccggccccaccgccccgtacccaccataccccccgcagcctatgggaccgggccccatggggggaccatacccaccaccccagggctacccataccagggctatcctcagtatggatggcagggcggaccccaggagccaccaaaaactacagtctacgtggttgaggaccagcgacgcgatgagcttggacccagtacttgtctcaccgcttgttggaccgccctgtgttgctgttgcctttgggatatgctgacctag

SEQ ID NO: 45648 - DNA, 1917 bp, Artificial Sequence
  Description of Artificial Sequence: Synthetic coding sequence
atggccgccgagctgcggatgatcctgtacgaggacgacagcgtgcaggtgcaatacgtggacgggtctactctgcaattgagcccctgcggcaccgaattcttgtttgagaagtccccccctgtgagcgcccacccattggagcagcctgagcggataagacagcgcacccacttcgtcataagcacttatcgggaacagctccagagagcgctggacttccggaattccagtgcaacttgccctttcttaagcgaaactattatccctagtgagaggaaaaagcacatttttatcgacattacagaggttagatggccctcattggatactgatggaacaatgatttatatggagagtgggatagtgaaaataacttcactggacgggcatgcatacctgtgtctgccccgttctcaacacgagtttaccgtgcactttttgtgcaaggtgtcgcaaaaatctgattccagcgccgtactgtctgagacgaacaacaaggctccaaaagataagctagttgaaaaaacgggcaagatttgtattagaggaaaccttccaggccagcgactgaagaataaggaaaacgagtttcattgtcagattatgaaatctaaagagactctgaaaaaaatgtcctgtgtgaacggaacagagggcagagaagaactcccatccccaggcacgaaacatacctgtgtgtatacttgggtgaaacagtgctggtccgttgcagcctgtccggaggaatggaaatacccactgtccctggccctccactttcataacaaaattagcaatatgtcaaaaattgatgcacatatcactcagagccgcttcctaacgtctgacatctcagaggagcgcggtaaggtagttagcgtcctaccccgggcgctttcgctctcctgtcccgtccctcatctacaccgttggaacttttgtgacagtctgctgcagcgtcagagcgatgagtacagctatccagagttggtaaagatggtgtggtataagggggtcacttaccgtctcactcatcagaatatgaattcaatcgaaatttattcgggtgacggatccgtgtttaagtcagagggcgcatacttcgggaattattttacttactactctatccaggagggcagcggaaagagagaagaaaagacctattctgtaaataacctgccccccgataggccagggtccccttttacagtcggctcacttattaagcaagccacgaggatcctgcagcattgcgtaaaaatgaggctatcgctcagccacaactatcgcatctgttgctggaagatggtgcccggaatcaatgacagtaatatcctgccactggtcctcaaggaatctctaatcccctctgtcgggcgattcttggcctattccgatgataaggtccacgccatcttcctggacggtattaccctgacgctcaactggaatttctcttcccccattgagaaaaggcaggtcaaccagggtctaaatttagggtggtgtaaactgacttttcctgacggccaggaacagcttatccagatcgagcatcccgaaccctatgaaaggtatgtgacgacagtcacaagctggtgtcgccgccttacccagacatccccgcgcgaaatgcctacccactctagttcatccgtgctgcaggagaactggtctgtcgccagcgaattagagaaaatacaaaagttcaacctactattagaaaactctggcatattgaaccagattagcaacaaaaaaaatgagcagcagagctttgatcactacaaacccggctcctcagaaactctcctgggtgaagtcaatgaaaatagggtttctatcgccctcaaaaagacaagcgagatccttcatgatattgattgcctcctgtcgaattcaaaaaagtag

SEQ ID NO: 45649 - DNA, 900 bp, Artificial Sequence
  Description of Artificial Sequence: Synthetic coding sequence
atgcccggccggctgctgcggggcctgtggcagcggtggcggcggtataaatacagatttgtgccctggattgctttaaatctgagccataatccaaggaccctcagatatgtgccagaggaatccaaagataaggttatctcagacgaagacgtgttggggacgctcttgaaagtgtttcaggcactgtttctgaacgacttcaacaagcagtccgaaattctctccatgttgcctgaaagcgtgaagagcaagtaccaggatctactagcagtcgagcaccagggagtcaagctgctggaaaaccggcaccagcaacagtcaacgtttaagcctgaagagattctctataagactttggggttcagtgtcgcacaggctaccagtagtctcatcagtgcaggtaaaggcgtatttgtgacaaagggactggtgcctaagggagctgtcgtgtctatgtaccccggcacagtgtaccagaaatatgagcccatatttttccagtcaataggcaatccatttatctttaggtgtctagacggcgtccttatcgacgggaacgataagggaatctcgaaagtcgtgtataggtcctgcaacggcagggaccgactgggaccactgaaaatgtcagactctacctggctgacctctgagattcacaacccactcgccgtgggccagtatgtcaataactgttctaacgatcgtgcggccaatgtgtgctatcaagaatttgatgtgcctgcagtgtttcccattgagctgaaacaatatctaccgaacattgcctacagttatgataaacagtctcccttaagatgtgtcgtgttggtcgcccttcgtgatatcaatcagggggaggagttgttctcaaactactacactatcgtttcttag

SEQ ID NO: 45650 - DNA, 816 bp, Artificial Sequence
  Description of Artificial Sequence: Synthetic coding sequence
atgcccggccggctgctgcggggcctgtggcagcggtggcggcggtacaaatatagattcgtcccctggatcgctctgaacctgtcccacaatcccaggaccctccgctacgtgcctgaggagagtaaagataaagtgatatcggacgaagatgtcctagggacacttctcaaggtgtttcaagccttgtttctcaacgatttcaataagcaaagtgagattctgagcatgcttcccgagtccgtcaaatcaaagtaccaagatcttctcgctgttgaacaccagggcgtaaagctcctcgagaatagacatcagcaacagagtaccttcaagcccgaggagatcctgtacaagacactgggcttcagcgttgcccaggccactagctctctgatctcggcgggaaaaggcgtgtttgtgacaaagggtctggttccaaaaggcgcggtagtatcaatgtatccaggcacagtatatcagaaatatgaacccatatttttccaatccattggaaacccatttattttccgttgtctggacggggtcttgatagacgggaatgacaagggcatttccaaagtggtttatcgtagctgcaacggaagagatcgtctcggacccctgaaaatgtctgattccacctggctgaccagtgagatacataaccctctcgctgtgggtcagtacgtgaataactgcagtaacgatcgtgcagctaatgtctgttatcaggagtttgatgtccccgccgtgttccccatcgaactcaagcagtatcttcctaatattgcctacagctatgataagcagagatag

SEQ ID NO: 45651 - DNA, 582 bp, Artificial Sequence
  Description of Artificial Sequence: Synthetic coding sequence
atggagcagcacttcctgggctgcgtgaagcgggcctgggacagcgcggaggtcgcgccggaaccccagcctccccctatcgtcagttccgaggataggggaccctggccgctgccattgtacccagtgttgggcgaatacagcctggacagctgcgacctgggcttgctcagtagcccctgctggcgcctccctggagtatattggcagaacggcctgtcacccggcgtccaatccacactggagccctccaccgctaagcctaccgaattttcttggcctggcacccagaagcagcaggaagcaccggtcgaggaggtgggacaggccgaagaaccagatcgactgagactccagcaattgccatggtcaagccccctccatccttgggaccgtcaacaggacaccgaggtttgcgacagtgggtgtttactcgaacggaggcacccacctgccctgcagccctggagacacttacccgggttttctgactgtctggaatggatacttcgtgttggtttcgctgcatttagcgtcctgtgggcatgctgttcccggatttgcggtgccaagcagccatag

SEQ ID NO: 45652 - DNA, 1920 bp, Artificial Sequence
  Description of Artificial Sequence: Synthetic coding sequence
atgccccagcccagcgtgagcggcatggacccccccttcggcgacgccttcagatctcacactttcagtgagcagacacttatgtcgacagatctactggctaattccagtgatccagacttcatgtatgagctggaccgggaaatgaactatcagcaaaacccacgcgacaattttctgtcattagaggactgtaaagacatcgagaatttagaatctttcacagacgtgctggacaatgagggagctctcacttccaattgggagcagtgggacacatactgtgaagatctgactaagtacaccaaattgaccagctgtgacatttggggaaccaaggaagtggactatctaggcctcgacgatttttctagcccttatcaggacgaagaagtgataagcaagactccaacactcgcccagctgaatagtgaggattcacagagcgtgagcgacagcctctactacccagactccctcttcagtgttaagcagaatccacttccttcctcattccccgggaaaaagattacttcaagagccgctgctcccgtctgttcatcaaagaccctgcaggcagaagtgcctctgagcgactgcgtgcagaaggcgtcaaagccaaccagcagcacacaaattatggtcaagacaaatatgtaccacaacgaaaaggtgaactttcacgttgagtgtaaggattacgtgaagaaagccaaggttaagattaatccagtccagcaaagccggccactcctgagtcagatccacacggatgcagctaaagagaatacatgctattgtggcgccgttgccaaacgccaggaaaaaaagggtatggagcccctgcagggtcacgctacacccgctcttcctttcaaggaaacccaagaactattgctttcccctctaccacaagaaggacctggcagtctcgcagccggagaatcttcgagcctgagcgctagtacatctgtgtcggactcctctcagaagaaggaagagcacaattactccctgtttgtgtctgacaatctcggggaacagccaacaaagtgctcacctgaagaggatgaagaagatgaggaggatgtggacgacgaggaccacgacgagggatttggttctgagcacgagctctccgaaaacgaagaggaagaggaggaggaggaggattacgaggacgacaaggatgatgatatttccgatactttctcagaacctggttatgagaatgactccgtggaagatttgaaggaggtcacatcaatttcgtcaaggaaaagaggcaaaagaaggtacttctgggaatactctgaacagctaacgccatcacagcaggagaggatgttacggccctctgagtggaaccgcgacactctgcccagcaatatgtatcagaagaatggcctgcaccatggcaagtatgctgttaaaaagtctagaagaacagatgtggaagatcttaccccaaaccccaagaagctattgcagattggtaacgagctgcggaaattgaacaaggtcatcagtgacttgactccagtttccgaactcccgctcactgcgaggcctagaagtcgcaaggagaagaataagctggcatccagggcctgtaggttgaagaagaaggcccagtacgaggcaaacaaggtcaaattatggggccttaacacagagtatgacaacctgctatttgtcatcaatagtatcaagcaagagatcgtgaaccgcgtgcaaaacccacgggacgagagagggccgaatatgggccaaaaactcgaaattctgatcaaggatacacttgggctgcccgtcgccggtcagacgagcgaatttgtgaatcaagtgctcgagaaaaccgccgaaggaaaccctactggaggtcttgtgggccttagaatccccacttcgaaagtatag

SEQ ID NO: 45653 - DNA, 1920 bp, Artificial Sequence
  Description of Artificial Sequence: Synthetic coding sequence
atccccaagcccagcgtgagcggcatggacccccccttcggcgacgccttcagaagtcacaccttctctgagcagaccctcatgtctactgacctgctggctaactcatctgaccctgatttcatgtatgaattagatagagagatgaattaccagcagaaccctcgagataacttcctgtctctggaggattgtaaagacatcgaaaatctggaaagcttcaccgatgttctagataacgagggcgctctgacgtctaattgggaacagtgggacacatactgtgaagacctgactaaatacacaaagttgactagctgtgacatctgggggaccaaagaggtggattatctgggactggatgatttttcttcgccctaccaggatgaggaagtgatttctaagacacccacattagctcaactcaattccgaggactcacaaagcgtcagcgacagcttgtattatccagacagcctgttctccgtaaagcaaaatccactaccaagctcgttcccgggaaaaaagatcacaagccgcgctgccgcccccgtctgcagctccaaaaccttgcaagcagaagtacctctaagcgactgcgtgcaaaaagcatccaaacccaccagctcaacacagattatggtcaaaacaaatatgtatcacaacgaaaaggttaactttcacgtcgaatgcaaagattatgtaaaaaaggccaaggtcaagatcaacccagtgcaacagtcgagacctctcctttctcagatccacacagacgccgcgaaggagaatacttgctactgcggagcagtggcgaaaaggcaagagaaaaaaggtatggagccattgcagggacacgccacccccgccctgccctttaaagagacccaggagctgctcttgtcgcccctgcctcaggagggaccaggtagtttggcagctggggaatcgtcatccttgtctgctagcacgagcgtgagtgatagcagccagaaaaaagaagaacacaactacagcctttttgtgtcagacaatctgggggagcagcctacaaagtgctcaccagaagaagacgaggaagacgaagaggacgtggatgacgaggaccacgacgagggctttggctctgaacatgaactgtcagagaatgaagaagaggaagaggaagaggaagactacgaggacgacaaggatgacgacatttctgatacattttctgaaccaggttatgaaaacgattccgtagaggatcttaaggaggtcacatccattagtagtaggaagcgcggaaaaagacgatatttctgggaatatagcgaacaacttaccccatcgcagcaggagcggatgctgagacccagcgaatggaacagagatacactgccatcgaatatgtatcaaaagaacgggttacaccatggtaaatatgctgtaaaaaaatcccgcaggaccgacgtcgaggatctgaccccaaatcctaaaaagctgctgcagataggcaacgagctgcggaaactgaacaaggtcatctccgacctgaccccagtcagcgagcttccactcaccgcccgtcctcgttcaagaaaggagaaaaataagttagctagccgagcttgccgcttgaagaagaaggcccagtacgaggccaacaaggtgaagctgtggggactaaatacggaatacgataatctgctgttcgtgatcaatagtattaagcaggaaatcgttaatcgggtccagaaccctagggacgaaaggggccccaatatggggcagaagctcgagatcctgattaaggacaccctaggactgccggtggcaggtcagacctctgaatttgtgaatcaggtgctggagaagactgccgaggggaaccctaccggagggttagtcggcctgagaatccccacttcaaaggtgtag

SEQ ID NO: 45654 - DNA, 1254 bp, Artificial Sequence
  Description of Artificial Sequence: Synthetic coding sequence
atgccccagcccagcgtgagcggcatggacccccccttcggcgacgctttccgtagtcacacattttcagagcagacactcatgtcaacggacctgctggctaacagcagtgacccagattttatgtacgagttagatagagagatgaattatcaacagaatcctagagataattttctatcccttgaggattgtaaggacattgaaaatctggagagtttcacagacgtcttggataacgagggcgctcttacctctaattgggagcaatgggatacttactgcgaggacctgacaaagtacacaaagctgaccagctgcgacatctggggcaccaaggaggttgactacctgggattggatgatttctcaagtccgtatcaggacgaagaggttatctctaagactcccactctggcacagctgaactccgaggattctcagtcagtctctgactcgttatactatcccgattccctgttttccgtcaagcagaatcccttgccctcttcttttcctgggaaaaagataacctccagggccgcagcacccgtctgttcgagcaaaacgttgcaggctgaggtacctctaagcgactgtgtccagaaggcctcaaaacccacttcaagtactcagatcatggtaaaaactaacatgtatcacaacgagaaagtgaactttcacgttgagtgcaaggattacgtgaagaaagccaaggttaaaattaacccggtacaacagtcaaggccactcctgtcccaaatccacacagacgccgcgaaggagaacacctgttactgcggggccgtcgctaagaggcaagaaaagaaaggtatggaaccccttcagggtcatgccacacccgccctgccgttcaaggaaacccaggaactgttgctttctccccttcctcaagagggacctggcagcctggctgccggcgaaagctcttccctatctgcttccacctcggtgtccgattcatcacaaaaaaaggaagagcataattattcattattcgtcagcgataatcttggagagcagcccaccaagtgttcgcccgaggaagatgaagaagacgaagaggacgttgacgatgaagaccacgatgaggggtttggctctgaacacgagttgagcgagaacgaggaggaagaggaagaggaggaggattacgaggatgataaggacgacgatattagtgacaccttctcagagccaggcataattatgttggctagtcttcccgattag

SEQ ID NO: 45655 - DNA, 1254 bp, Artificial Sequence
  Description of Artificial Sequence: Synthetic coding sequence
atgccccagcccagcgtgagcggcatggacccccccttcggcgacgctttcagatcgcacacattttccgagcagactctcatgtccacggacctactagcaaactcatcagacccagattttatgtacgaacttgacagagaaatgaactatcagcagaatccgcgagataatttccttagtcttgaggactgcaaagacattgaaaatttggagtctttcactgatgttctggataacgagggggctctgacatcaaactgggagcagtgggacacttactgtgaggaccttaccaaatatacaaagctgacatcttgcgatatctgggggactaaggaggtggactatctaggcttagacgacttcagttctccttaccaggatgaggaggtgatctctaaaactccgactctggcccagctcaactctgaggactcccagtccgtctctgacagcttgtattaccccgattctcttttttctgtcaagcagaacccgctgccatctagcttccccggcaaaaaaatcacatcccgcgccgccgctcctgtgtgttccagtaagactctgcaggccgaggtgccgctgtcagattgcgtgcagaaggcttccaagccaaccagcagcactcagatcatggtcaagactaacatgtatcacaacgaaaaggtgaattttcatgtcgaatgcaaggattatgtcaagaaagccaaggtgaagattaatcccgtgcagcagtcacggcctctgctgagccagatacacacagacgctgccaaggagaatacctgttattgcggcgccgtggctaaacggcaagaaaagaaggggatggagccactgcagggacacgccacacctgcactcccgtttaaggagactcaggagttactgctgagtcctctgccccaggaaggccccggtagtctggctgctggagagtcttcttcattgtccgccagtacgagcgtgtctgattcctcacagaagaaagaagaacacaactattctctcttcgtgtccgataatctcggcgagcagcccaccaaatgtagtcccgaagaagacgaagaagacgaggaggatgtggacgacgaggaccatgatgaaggatttggatcagagcatgaactgtccgagaatgaagaggaagaagaggaggaggaggattacgaggatgacaaggatgatgacatctcagacacatttagtgagccaggcattatcatgctggcgagtcttcctgattag

SEQ ID NO: 45656 - DNA, 81 bp, Artificial Sequence
  Description of Artificial Sequence: Synthetic coding sequence
atgccccagcccagcgtgagcggcatggacccccccttcggcgacgccttccgctcccacaccttctcggaacaaacctag

SEQ ID NO: 45657 - DNA, 1962 bp, Artificial Sequence
  Description of Artificial Sequence: Synthetic coding sequence
atgccccagcccagcgtgagcggcatggacccccccttcggcgacgcctttcgctcacatactttcagtgaacagacgctcatgtccactgacttactggccaactcttcagatcccgactttatgtacgagctcgacagagaaatgaactatcagcaaaacccacgcgataattttttaagcttagaagactgtaaagacatcgaaaacctcgagtccttcacggacgtcttagacaatgagggcgccttgacctctaattgggagcagtgggacacatattgcgaggacctcaccaagtacaccaagcttacctcctgcgatatctgggggacaaaggaggtcgattatctgggacttgacgactttagcagcccgtaccaggacgaagaagtgatatctaagacgcccactcttgcccagctgaattctgaggattcacagtcagtgagtgattctctatattatcccgacagcctgttcagcgtgaagcagaacccactcccatcctcattccctgggaagaagattaccagccgagcagccgcccctgtgtgtagtagcaaaacccttcaagctgaggtaccactcagcgactgcgtgcagaaagcatccaagccgacatcatcgactcagattatggttaagacgaacatgtaccataacgagaaggtcaatttccacgtcgagtgtaaggactacgttaaaaaagccaaagttaaaatcaacccagtgcagcagagtcgccccttgctttcccagatccacactgatgctgcgaaggaaaacacttgttactgcggcgctgtggccaaaagacaggaaaagaagggcatggagccactgcagggtcatgctaccccagcactaccatttaaggagacccaggaactgctccttagccctctgccccaggaaggccccggaagtttggccgcaggcgagtcttcaagtttatctgcctctacttccgtatccgattcatcgcagaaaaaagaggagcacaactacagcttgttcgttagtgacaatctgggagaacaacccacgaagtgcagccccgaagaggatgaagaggacgaggaggacgtcgatgacgaagaccacgacgagggattcggatccgaacacgagttaagcgagaacgaggaggaggaagaggaggaggaagattatgaagacgataaagatgacgatatttccgacacttttagtgaacctggttatgagaatgattcggtggaagatcttaaggaggtaacctcaatctcttctcggaagcggggaaagagacgatacttttgggaatatagtgagcaactcacaccatcccagcaggaaaggatgctgagacccagtgaatggaatcgtgacaccttgccgtcaaatatgtatcagaagaacggcctgcatcacggaaagtatgctgtgaagaagtcccgacggactgatgtggaggatctgactccgaacccgaagaaacttctccagatcggcaatgaattgcggaaacttaataaagtcatttcagatctgactccagtctccgaactccccctgactgccagaccccggagtaggaaggagaaaaacaagttagcctccagagcttgcagactgaagaagaaagctcagtatgaggcgaataaggtaaaattgtgggggcttaacactgaatacgacaacttattgtttgtgataaactccataaagcaggagattgtgaatcgcgtccaaaatccaagagacgaacggggaccgaacatgggccagaagctggaaatcctgatcaaggatacattaggcctgcccgtcgcaggtcagactagcgagtttgttaaccaagttctggagaagaccgctgagggcaatccaaccgggggcctggttttctggggcaactcaaagaccgggaacattctatacgatgagaatccaaatgagaaaaaacaggatatttag

SEQ ID NO: 45658 - DNA, 1926 bp, Artificial Sequence
  Description of Artificial Sequence: Synthetic coding sequence
atgccccagcccagcgtgagcggcatggacccccccttcggcgacgcctttcgttctcataccttctcagagcaaacattaatgtcaacagacttgctcgccaatagctccgaccccgatttcatgtacgaattagatagagagatgaattatcaacagaatccacgggacaattttctgagcctcgaggactgtaaggacatcgagaacctggaaagcttcactgacgtgttggacaatgaaggcgctcttacctcaaattgggagcaatgggatacctactgcgaagacctgactaaatatactaaactcacttcttgcgacatctggggaactaaggaggttgactacctaggtctggatgatttctcaagcccctatcaggacgaagaagtgatctcaaaaactcctacattagcccagctcaatagcgaggactcccaatccgtcagcgactctttatactatccagactcgctttttagtgttaagcaaaacccgctaccaagcagtttccccgggaaaaaaataacctctcgtgctgccgcaccagtctgtagctcaaaaaccctgcaggctgaagtccctctgtccgactgcgtacagaaggcatctaagccaacgagctcgacacagataatggtgaagaccaatatgtaccacaatgagaaggtgaactttcacgtagaatgcaaggactacgttaagaaagcaaaggtgaagatcaatccagtgcagcagtcccgccctctgctctcccagatacacaccgatgcggctaaagagaacacatgctactgcggtgctgtagctaagagacaggaaaagaaggggatggaacctctacagggtcacgccactccagcgctgccgttcaaggaaacccaggaactgctgctgtctcccttgccccaagagggccccggctccctggccgccggtgagtcaagctcccttagcgcatcgacctccgtatccgattctagccagaaaaaagaggaacacaattactcactctttgtttctgacaacctgggcgagcaaccaactaagtgtagcccggaggaggacgaggaagatgaggaagacgtggatgatgaggatcacgacgagggtttcggcagtgaacatgaattgagtgagaacgaggaggaggaggaggaagaggaggattatgaggacgataaagatgatgacatcagtgacactttcagtgagccaggctacgagaatgattccgtggaggatctgaaagaggtgaccagcatctccagtcgcaagagggggaagaggaggtacttttgggagtactccgagcaattgacccccagccagcaggaacgcatgctcagacctagtgagtggaacagggacactctgccgtctaatatgtaccagaaaaacggtctccatcatggcagcggcaaatacgctgttaagaaatccaggcgcaccgacgtcgaggacctaacaccaaatccaaagaagctgctgcaaatagggaacgaattgcgcaaattaaacaaggttatctccgaccttacaccggtgtctgagcttcccctcactgcacgaccgagatcaaggaaggagaagaacaagctagcgtctcgggcctgccgcctaaaaaagaaggctcagtatgaggcaaacaaagtaaaactttggggactgaatacagaatatgataatctgctcttcgtgattaattcaatcaaacaagagattgttaatagggtccagaatccacgagacgaaaggggccccaacatgggtcaaaaactagagatccttattaaagacacccttggcctgccagttgccgggcagacaagcgagttcgtgaaccaggtcctcgagaagacagccgaagggaatcctacaggaggcctggtgggacttcggataccaacttccaaagtctag

SEQ ID NO: 45659 - DNA, 6288 bp, Artificial Sequence
  Description of Artificial Sequence: Synthetic coding sequence
atggccgacgccgacatcctgagcgagaccttccagctgctgatcgacagtgccaaggatttctctaagcgcctctggggattggtgcctttcggcttgtaccttcctgctcctccattgtattgccctcagcccgctatactcagcgaggaggacggagatgatctgctgctcaaagccgagaaaaacaaccgccagaaggttagtggaattcttcagcgcgtgctgctcttattccgagccgcccagtgctctttcccagtggctcagtggtacatcttacaacttcgatgggcacgaaaggtgatgcagaaaattcgtatgaaaggaagcctgccttctctgtctcccttccctcagtcgctgctgaattactgcaaagggggtatagcatttttccgccctggagcagccggcgaccataagctggacgaagtatctatacgggcgattgggtgcttccgcgaactgtgtgccctgtgttggatgttgcatgtgcgtgacaagctgagttacagttgccgccagtaccagaaggctcgcgaaaacgtgaagggtgagaaagatctggaagtggagtttgactcgtgcatgatcgaacactgcctgtcggcagttgaatgggcctataggatgctgcccttctcacgtttctttaatatggaagaacttattcaggatatcatactttccctgatcggcgagttgcctcccatccggaaagtggccgagatttttgtgaaggccttcccctaccccgaagatgttagggtacctctcagagacaaataccatagtctacaccaacgcctgaggcattgcgttgttaaaggcccacagactgaagaaatgatgagcgttgttatgcacagcatccaaaaagtgcgagtgaaggccctaaagcgcgtgcagaggaatattggctcttttgaggttaacatatgggagccgatcgaggaggagaagccagacgaagccccgggcgtcgatagatacagcctggggaccagcctgtctcgctccaccctgactgaattaggcgacagtgtcgttcactcagacgctgatacattcagcgaggctctgtctgtcgaggagaagagccggatcaatatttaccaaagaaacgctcctaatcatatggaactcacgagcatccataagcctaccgacaagcgtaaaatgtgtaaccagaaagaaaacccaaccaaaaaggaagaccacgagaagctgagtcagaacacacttcctgtcatcggagtctgggaattcgagcgtgatgatgatgagtacattaagtttctcgacctgttcctctcatatattttagagcgcgaccttccctatagccgagacgctgatattccattcctgacctccttctctggcaagttgcgggagcacgagctcaattccctactcttcgacgtgcataccactctcaagaggcatcagagcaagacaaagtcccagaacgtttttcgagccggaagctgttttgtggtagcgcctgagagttacgagtcggaaaaatcttctagcttaaatgatgaatacgggatgcacctcgagaaccagaaactgagttcatctgtcttagtaaaccagggcatcaaaccattccttcaatatccgagcaatgaagtgaacaaaaacgagggtatgtcagggctattcggcctgaagcagcgcagcatttataaaatacaggacgacacgagggagaaatgcctgatccagcgctcgtctaatcatattttttggacaccgaaatctatcaagactagacgctgtatctttaaggccattcaatgcaacgatattaaccctcaggaagacctgccattggccctgaatacattcggctcaattgggaggctgctcgaatggatgatcaggtggagcaacagacggttgctgtgtgattctggaataaccgagagtagctcagagtattcaccggtgatccgggtcaaaacctctaccgccgccatactgacatcgctgtggcttctggagcagccctatttcgccacctataaagccaagaacgctataatcaaaatggttgagaatcgcgataccggatgccagattggtcccaatattgaaagggagagcaaatccgacgccggaggctccgtggccgtcgctacaccgggcggcactgaagagcggaacggccagaacaaatcatgccagaatattctcaagatgcccacggaggccaaaaatccagacatcaaggaaattaacgacgatatcatttccataacacacaacaccaagaaagaatttattgatattgacgaaaacctgctagaggtggaggcctttaccgaggaagaaatggacatgcatatttccgattacgaggaagatattgaagaaagcgtgggcggattccgatccccgtcacttgccatatgcatgatgactcttccccagcagcttgaagaagaattcaccgaagaggtccagtgccagcgggaagaaccccttgaaactatcatggaagagaaatcaacagaacaaaaaggcatgattgaggccttctctcaccctgggcacaccaccccgcagagcatgcaggtagatacctcctcagaaatttcttccgcacagatctcaacctacaaggaaaagagttcttccgtgcctctcttgatcagtaatggggtaaatgtggcctcccaacccccggcaccaacccctcagaagacccagcgaaatgaatttacagcacaactgccagattgtagcgaaagtgttcgccagatgctacaggacgagatgttcaaattggtgcagttacagcagattaactttatgtcactcatgcagattgtggggtcaagcttcgccaacctccctgacacgcagcagctcgtacagcagtcccagagcgtacatctcggagaatcacaggagtctaaccttaggggatgcggagatgtcgaggatagcaataaaaacttgaaggagaggttcttcatcaaaccccaatctatgggcgagaacgccagggagccccgcaagaactcccctcactgccacgaaggtacaattcctagtggccaaaattcaacaggaaacgttcagaacgtgccccacggtagcattcccctgtgtcagttgaatgggcaaccccgcaagaaggggcccatcccttcttctcagaatctcccgtctactagcttctaccccgccccagctggtaacacacatctctacttgttgagcacaccgagtgtggtgcagaaggctccaagactgattcctcacgctaaaactttcagtcccggcgacggcttccctctgttgcagttcaaaagcaaacaagagtttcagccgctctttctacacacgggttcgatcccccaagtcccattccgcccactgccccagccccgagaggcatggggtctctctgactccttccagcccgccctgccccaacgggcggctcagacaacgcctgcctcccacctcaacgttagccaatacaatacagaggctagaaagaaagaagtggagcagaagacatgggcagaaacagttataacagagatcccaaatcacgtgaatctcgatcagtacgtggggcaagagaatctgaccccacaacaagacagcagcgtgttcattaaacctgagaagctttttgacgtgaaacccgggacactggaaatctccccccatcacagcttcggccttcccctcctgtatcttccattgaagccgcctaacatgttccccagtactagtcgggcaagtattaccgttccttcaacgcctattcaaccaattgccgaggagcgcaagtacccaagactgagcctactccatagtcatctgagccccgaaaatcggtgcaagaagacacagttgatcccgctggaaaatctgatcgccttcaaacagtctcagcagaaactgacacacaacctgttcgagcagggcgatgccggacacctccaactgcttaaggtgaagatcgagccaccagaggtgagacaaggaaaagactccaaaaagagacagcgtcgtcgggccgaaaaggaactacaagagaaaagatgtgagaagctgcgcaggaaacccaatgtaacatttagacctgagaacagcattatcaacaacgacgattcggaaataataaaaaagcctaaggaacagcaggagcactgtgggtctcatcctctggatgacttcgacgtaccgttcgaaatgcttcaagacgacaacacctcagctggcctgcatttcatggcttctgtgaaaaaaaaagctatcgggtctcaagacgccagcactaataccgacccagagcacgagcctctgaccgcacctcaactactagttcctgatgtgtaccttaatctcaagctgagcagcgaaatgtctgaaaaaccatggagccccagtatcccacacaccgtgacgaatcttgtcgggcacacatacatcaatgtgatcgacatcgaggctaacgacttgctgcaggaactccccgtgagggaagaacctagcaacgataacgtgattaagcagcagtcagaccacctcgctgtgccttcgtctgctgagctgcattacatggccgcatcagtgacaaacgccgttcctcctcacaatttcaaatcacaaggcttgccaaaaccggagttccgcttcaagggacagagtaccaaatcagattctgcagaagactatttgctttggaagagattacagggcgttagcgcggcctgccccgctccctcctctgctgcccatcagctcgagcacctctctgctaagttgcagaagattgatgaacagttactagctatacaaaacattgctgagaatatcgagcaagactttcctaaacctgaaatgctggaccttcactgcgataaaatagggccggtagatcacatcgaattttccagcggtcctgagttcaagaagacattagcttccaagacaataagtataagcgaagaggtgaggtttctcacacatatggacgaagaggaccagtccgacaaaaaggaaaccagcgaaccagagttttcaattacagagaattacagtggtcagaaaacatgtgtgtttcccacagcggatagcgctgttagcttgtcttcatcgtccgaccagaatacgaccagccctggtatgaactccagcgacgagctgtgcgagagtgtttctgtccaccccttgcaaatgaccggactgacggatatcgctgacatcattgacgaccttatcatcaaggacggtgtcagcagcgaagaactgggactcaccgagcaggcgatggggacctctagaatccagcattacagtggccgacacagccagcgcacagacaaagaacgacgagagatccaggcctggatgaagcgcaagcgaaaggaaagaatggctaaatacctgaacgagctggcagaaaagcgtggacaagagcatgatcctttctgtccacgcagcaatcccctgtatatgacttcaagggagatccgcctgagacagaagatgaaacacgagaaggacaggctgctgctttctgagcactacagtcgcagaatcagccaggcctacgggctcatgaacgaactcttatcagaaagcgtccaattgcctaccttacctcagaaaccactccctaataagcctagcccgacccagagttcatcgtgccaacattgccccagccctagaggtgagaatcagcatggtcactccttccttatcaacagaccaggcaaagtgaagtatatgtcaaagccatcctacatccataagcgcaaatcttttggtcagccccaggggtcgccttggccacatggaaccgcaacctttacaattcagaagaaggctggcggggctaaagctgcggttaggaaagccacccagtctcccgttacgtttcagaaaggtagcaatgcgccctgccattctttgcagcacacaaaaaagcacggctctgccgggctcgcaccacaaacgaaacaggtgtgcgttgaatatgagagggaagaaactgttgtcagcccttggacaattccatctgagatacataagattttacacgagtcgcacaactctttattgcaggacctgtcccctactgaggaggaagagcccgagcacccttttggtgtgggaggagtggacagcgtctctgagagcacgggtagcattctctctaaattggattggaatgctatagaggatatggtagcctccgtggaagatcagggcctgtccgtgcactgggcactcgacctgtag

SEQ ID NO: 45660 - DNA, 5442 bp, Artificial Sequence
  Description of Artificial Sequence: Synthetic coding sequence
atggccgacgccgacatcctgagcgagaccttccagctgctgatcgatagcgcgaaggacttttcaaaacgcttgtggggtctcgtgcccttcgggctctacctccccgcaccacctctgtattgcccgcagcccgctattctgagcgaggaggacggtgacgatttactcttaaaggctgaaaaaaacaatcgccagaaggtgtcagggattcttcagcgcgtgcttctcctgtttcgggccgctcaatgtagtttcccggtggctcagtggtacatccttcagctgaggtgggctagaaaagtaatgcaaaagattagaatgaaagggtcacttccaagtctgtccccatttccccagtcactactcaactactgtaaaggaggaattgccttcttcaggcccggcgctgctggcgaccacaaactggatgaggtgtcaatacgtgccatcggatgctttcgcgaactatgcgccttgtgttggatgttgcacgtccgagacaaattgtcatatagctgccgtcagtatcagaaagccagagaaaatgttaagggggaaaaggatctggaagtggaattcgattcatgcatgatagagcattgcctgtctgccgtggaatgggcttaccgcatgttgccattctccagattttttaacatggaggagctgatccaggatatcattctctccctgattggggaattgccgcctatcagaaaagtagccgaaatttttgttaaggccttcccctatccagaggacgttcgggtgccgctacgtgacaaatatcacagcctccaccaacggctgcgccattgcgtcgttaaaggcccccagaccgaagaaatgatgagtgtcgtgatgcattccattcagaaggtcagggttaaggcgttgaaacgggttcagcgtaacatcggctcttttgaggtgaatatctgggaacccattgaagaggagaaaccagacgaagcccctggagttgaccgctactcacttggcacatccctctcgcggagtaccttaacagagttaggggactcagtggttcattctgacgcggacaccttcagcgaggcactatcagtggaggagaagagtcgaattaatatctaccagcgcaatgcacctaaccatatggagctgacctccatacacaaaccaaccgataaaagaaagatgtgcaatcagaaggagaacccgactaaaaaggaagatcacgaaaaattgagccagaatacccttccggtcattggtgtctgggagttcgaacgtgacgatgacgagtacattaagttcctcgacctgtttctgagttatatcctggaaagagatctaccatatagcagggatgccgatattcccttccttacgtcattctcaggtaaattgagggagcatgaactcaattcacttctgttcgacgtacacacaaccctgaagagacaccagagcaagaccaaaagtcaaaacgtgttccgcgccggctcttgttttgttgttgcgcccgagtcctacgaatcggagaaatcctcgtcactgaacgatgaatatggaatgcatttggagaaccagaaactgagttcctccgttttagtaaatcagggcataaagccattcctccaatatccaagcaatgaagtcaacaaaaacgagggcatgagcggtctgtttggcctgaagcaacgctcaatctataaaatccaggatgataccagagagaaatgtctcattcagcgatcctcaaatcacatcttctggacgcccaagagcattaagactcggaggtgtatctttaaggctatccagtgcaatgacattaatccccaggaggacctccccctggctctgaatacttttggttccatcggccggctgcttgaatggatgattagatggtcaaacagacggcttctgtgcgactcaggcatcacagagagttcctcggagtatagccccgtgattcgggtgaaaacctcaacggctgcaatcctgacgtcactgtggctgcttgagcaaccatatttcgccacatacaaggccaaaaacgccattattaaaatggtggagaatagggacaccggatgccagatcggccccaatattgagcgcgaatctaagagcgacgccgggggttcagtagctgtagctacccctggggggacagaggagagaaacggccaaaacaagtcttgccagaatattctaaagatgcctacagaggccaaaaaccctgatattaaggaaatcaacgatgacatcatatccatcactcacaatacgaagaaggagtttattgacattgacgagaatttactcgaggtagaggcgttcactgaggaggagatggatatgcacatatctgattacgaagaagatattgaggaatccgtgggaggctttcggtctccctctctcgcgatctgtatgatgacactgccacagcagctcgaggaggagtttacagaagaggtacagtgtcagcgggaagaaccgctcgaaaccatcatggaagaaaaaagcacggaacagaaaggcatgatagaagcattcagccaccctggccataccaccccccagagcatgcaggttgatacctcctcagaaatcagctctgcccaaatctctacctacaaggaaaagtctagctctgtccctctgctcatcagcaacggcgtgaatgtggcctcacagcctcctgcccccactccacaaaagacacagaggaacgagtttaccgcccagctaccagattgtagtgaaagcgtgcggcagatgctgcaagacgaaatgtttaagctggtccagttgcagcagattaactttatgagtttgatgcaaatcgtaggctcctcatttgccaatctccctgacacacaacagctagtgcagcaatcgcaatccgtgcaccttggagagtcacaggaaagcaacctcaggggctgcggcgacgtggaggatagcaataaaaatctaaaagaacgcttttttattaaacctcagtccatgggagaaaatgcccgagaacctcggaagaattcgccccactgccatgagggtaccattcccagtggtcagaattctacaggcaacgtgcagaacgtcccacacggtagcattccactgtgccaacttaatggccagcccaggaaaaagggacccattccatcgtcccagaaccttccttccacttctttctaccctgctccagccggtaacacccacctgtatctgctgtcaacaccctcggtggttcagaaggcacctaggctgatccctcatgcaaaaacgttctcaccaggcgacggctttcccctgcttcagttcaaatctaaacaggaatttcaaccacttttccttcataccggtagtataccacaggtcccgtttcggcctttgccccaaccacgcgaagcttgggggctgagcgactcttttcagccagccttaccccagcgggcagctcagacaacgcctgcgagccacctcaacgtgagccagtacaataccgaggcccgtaagaaagaggtggaacagaagacatgggctgagacagtaattactgagatcccaaatcacgtgaacctggaccaatacgttggccaggaaaacctgactccgcaacaggattcaagcgtgttcataaagccagaaaagctcttcgacgtcaagcccggaacgcttgaaatctcaccccaccactctttcggactcccgctattatacttaccccttaagcctcctaatatgttcccctctacgtcccgggcctcaattaccgtgcccagcacccccattcagcctattgccgaagaacggaaataccctaggctgagcctcctacacagccatctgtctcctgaaaaccgttgcaagaaaacccagttgatcccacttgagaacctgatcgctttcaagcagagtcagcagaaattgacgcataaccttttcgagcaaggagacgcaggtcacttgcaattactgaaggtcaagatcgaaccaccagaggtgcggcagggaaaggactctaagaagcgtcagcggagacgcgccgaaaaggaacttcaagagaagcgatgcgaaaaactgcgccgtaagccaaacgtcacttttaggccagagaattccatcataaataacgacgactcagagattattaagaagcccaaggagcagcaggagcactgcggttcacatccacttgacgacttcgacgtgccctttgaaatgttacaggacgacaatacatcagccggcctacacttcatggccagcgtaaaaaaaaaagccataggctcccaggacgcctctactaacactgacccggagcatgaacctctgacagcaccgcaactcctggttcccgatgtgtacctcaacctgaaactatccagcgaaatgagcgaaaagccatggtccccctccattcctcacacagttacgaacttggtgggtcacacgtacatcaacgtgatcgacattgaagccaatgatctgcttcaagagctgccagtgcgcgaggaacccagtaatgacaatgtcattaagcagcagtcagaccacctggcagtgccaagctccgccgaactacactacatggcagcttccgttacaaatgctgtccctcctcacaatttcaagtctcaagaagttaccccagcatgtctggacggaaaaagtttacgtgccggcattacagaagttaaggagcctagcgtgacttcccccactccctccgatattcagcaaaataaaggattgcctaaacctgagtttaggtttaaaggccagagcaccaaatcagactctgctgaggactacctgctgtggaaacgcctgcagggagtcagcgctgcctgcccggctcccagctctgccgcccatcaactcgagcacctgtctgctaaactccagaaaatagatgagcagctgctggccatccagaatatagccgaaaatatcgaacaggattttcccaagcctgaaatgctggatttacattgcgataagataggcccagtggaccatattgagttctctagcgggccggagtttaagaagaccctcgctagcaagaccatctctatctcagaggaggtgcgctttttgactcacatggacgaggaagaccagagtgacaagaaagagacctccgaacccgaattctccattacagagaactattcagggcagaaaacgtgtgtttttccaaccgcagacagcgctgtgagcctgtcttcaagttcagaccagaacacaacctctccgggcatgaactcttcggacgaactctgtgagtcagtgtccgtgcatccactccagatgaccggtttaaccgacattgccgatataatcgacgaccttatcatcaaagatggagtctcatccgaggaactggggctcaccgaacaggcaatgggaaccagtagattcagttag

SEQ ID NO: 45661 - DNA, 9594 bp, Artificial Sequence
  Description of Artificial Sequence: Synthetic coding sequence
atggagatccggctggagatcctgaccagcaccggcatcaagcagaaaaagccttggccccgcgtgtcctggctgggcaaagagaaagaggccgtgtttctcctggacgacaagttcatcaacgaaatcaacctgttgagcggtaaaattaagaaaaagattccatcattgcaacctttccttaaagacgtcattgtgcttaccactagctcaaacgacgcctggcttgccggagtgttaaccactggtgagttatttctctggaataaggaccaggactgtcttaagaccataccgattaccgagaaacccaaagaaatgataaaggcgactgtagcctcctctttaaggttatacctttacgtgtccggcaacgggaaacgcatagtgctaataacaccctctggatgcattttcctgtgggagtatcttgagctcaagaatattctatccagcaagagtctgtctctggcaggtaggtggtcccaggtcattcctgaagaagcagtgctgttaccttccacagaagacaaggaagccgtggtgaacgccgtttttatcaaaaatgagctcttcggagattgttgcctatgcagcttcactttctactcaggcgaatgcttaaaactgaccttcttggctatccggtggcatgagaatgttttcactagcgtgcgcagcttaccctaccatgttcactgggcccagcaggactgccatctttgttcacttatccctaagtgtgaaagcgtgaaatcaagaggcgcactgatatctgccttcagtcgggatggcctgactctggctgtcactttgaaccagaaagatcctaaggctacccaggttctgtttattaacactctgaatttcgtgactttgtgcgggagcctgaagggatgttccaataagtcccccgtggtgccagcgaccttaattcggtcatactgggttggagatattagctggactcatgactctctttttctggcgtgcatgctgaagaggggatctttggtactgctcacatgccagggtgagcttttgacactgatcacatttgggtgctctatagaatttggtcctgccgaatttatcccactgcaccctttgatcacataccgcccacaacaatttacgttccaagactcaaataatagtgtcgattcctctgctagtgattctgatccgatgcgtcagaggttttccattaaagcccatagtagacttccttatctcgtgatatcagacgggtacatggtcactaccttgcgcttcttggacagcttgtcaccaagtgtacacatgcgctctctgcttctagacagcacacagaggttggaaaaaatataccagagcgtgatcctgtcaaagcccaagggaaagggattgaacctgaggagcctgaatagcctacggtcttctcttctagagcaccaggggaacgaaagcagcgctgactttaccgtgcctaaattcctgcaggccgaggagacaataaacgagaatgctgcggacttccaagacttcgaggctgaagagaccaacgagggcaggcacttcccagataacctatgcccgttttggaacaagcgggatgacgtactgtgttcaagcatgaaggagggccgtctggagtttgcctctatgttcgatactattcatgcaaaggacgactccgaagagaccgaccggaccatcaccgaactgcactccatacagaagtccctattagccgcatggaccatcggcattagcaaaaccgtgactgaaaaaaatcttatgctgaactatatagtcgtttgtatcacccacttcttctatatccttcaatttattaagtgcccatttcccaagctcgacctggtgctgagcaagtcgtcacggcacaatgcttggatcctatgcattttccagttgtttcatcaatgtctttctatccactattgggatatccggtataaacaggatgtggggcacctgattaagctgacttccaatacagtgaagctgctgttgactcagcagcaaaaaggccagcttttctctgagaaactcctggcctgtttctatctattgaaaatggtggccgataatttgaacggcgtgtacatcctccagccagaagtaatctctgcaagtgccgacgggtctaagattacagcccaggactccctggtcgtacccatattccaaatgtttcaggacagtggattccagaaaaactggagctggaacagtttcttcaagatccacccccaggtggtgaacccagtccagcagcctggtcacagactccttatcctttggcgtatcttgtacaaaaagaccctatggtaccaggcccagttgaaccgccgggtacctgaggctgattcacagctgacagagaagatgacccacgaggctagtactgtcaagtcactgctgtgtcacctccaagccaatctccagagtacaggggattgcttgaatcagactttagaactgaagagcattaacggagaagaatgttttctgctcggatcatacgagaagtccgttcaactatggaaaaaggctctccaggagatcgaagagaaaggcggaaggagaacctatttcttgcagattagatattacctatctcttctgtattgtcatctgtatagctacaatctcaatgatgcgcaagggctgtgtgaccagcttgcccgcgagatcctgaggtggtcacaactgccagtcaaggagaataaagatttttctggagctgctaagagccacttcgagtgcggtatggtgggaggagtgcatccggaggcagccgtccgcgtagtccagtccatggccaggttcatggccgcatatttcacgaaccaacagctctgtatactgccaccccatcatgtcaacgtgttgcctcctcttcacatcaagaccgaacagagtttccggttgattcctctgcaacattccaaagttgcatcagtggtgagagaccagaacctcagcaatgtctggaccgtagaatatgccctcgagctgctctttatcggcgggttggtgcccgaggcagtctggttagcctataagttgggcgattggaagacctctgtgagcataggggtcgcctttcagctgttctgcaaaagggacagcaatttcatgaggtctaagaagaagagtttgaacctgccgctgaggatgaccccagcacagatttttcaggaaaaactccagtgtgtactggggcagccagctagcctggaggccaaaaatgagatggggagcaagtataagcagtttactgatcccatcgaggaggaggatgctaatttactcttcgggagcgttcaggaagtcctgaaggcgagcgttatggctgacgcagatattctgagtgaaacctttcaactgttgattgactccgcaaaagatttctccaagcggttatgggggctcgtgccttttggcctctacttacctgctcctcccctgtactgtcctcaaccagcgatactgtctgaagaagacggcgatgacttactgctgaaagccgagaagaacaataggcagaaggtctcaggcatcctccagcgtgtgcttttgttgtttcgtgccgcacaatgctcttttcctgtcgcacagtggtacattctgcaactgcgctgggcacggaaagtgatgcagaagatcaggatgaaagggtcactgccatcactgtctccttttccgcagtccctgctcaactactgcaaagggggaattgctttttttcgaccaggagctgcgggggaccataaattagacgaagtttctatccgggctataggctgcttccgcgagctgtgcgctctttgttggatgctccatgttcgagacaagctttcctacagctgcagacaatatcagaaggctcgtgaaaacgtaaagggtgagaaagatctggaggtggagttcgactcctgcatgatcgaacactgcctctctgccgtcgaatgggcttatcggatgctgccctttagccgcttcttcaacatggaagaactcatccaggatataatcttgagcctgatcggcgagctgcccccaatccgtaaggttgccgaaattttcgtgaaagcttttccatatcccgaggacgttcgcgttccactgcgtgataagtatcatagcctacatcagcgcttgcgacattgtgtcgtcaaaggaccacagactgaggaaatgatgtctgttgtcatgcactcaattcagaaagtccgcgtgaaggccctgaagcgtgtccaacgcaacatcggtagcttcgaggttaatatctgggagcctatcgaggaggaaaaacccgatgaggcaccaggagtcgataggtacagtctggggacgagtctgtctcggagtacattgacggaattgggggattctgtagtacacagcgatgctgacacattctccgaagctctcagtgtcgaagagaagagtaggatcaacatttaccaacggaatgcacccaaccatatggaactaacaagcattcacaagcccacagacaaaaggaaaatgtgcaatcagaaggaaaatccaactaaaaaggaggatcacgagaaattgtcacaaaacactctgcctgttattggggtatgggagttcgagcgcgacgatgacgaatacataaaatttctagatcttttcctgtcttatattctggaacgggatttaccctattccagggacgcagacatcccgtttctgacaagtttctcaggaaaactccgagagcatgaactgaatagtctgctgttcgacgttcatactaccttgaagagacaccaaagcaagacgaagtcccaaaatgtgttccgggccggctcctgctttgtggtcgcacccgaaagctatgaatcagagaaaagtagctcgctcaacgacgagtacggaatgcacctagaaaatcaaaagctgtcatcctccgtgctagtcaatcagggcataaaacctttccttcaatatccctccaacgaagtgaataaaaacgaaggcatgtctgggctttttgggttgaaacagaggtccatctacaagatacaggatgacacgcgtgaaaagtgtctaattcagcgcagttctaaccacatattctggacacctaagtctatcaagactcgcaggtgcattttcaaggcgatccagtgtaacgatataaacccgcaagaagatcttcctctggctctgaacacctttggttcaattggtcggctgctcgagtggatgattaggtggagtaacaggcggctactgtgcgactccggcattaccgagtcctcctctgagtacagtccagtgatcagggtgaagacctctactgcagccatcctgacctcattatggctgctcgagcagccctattttgccacatacaaggctaagaacgccattataaagatggttgaaaacagggataccggttgccaaattggacccaacatcgagcgtgaaagtaagagcgatgctggagggtccgtcgccgtggcaactcccggcggcactgaggaacgaaacgggcagaacaaaagctgtcaaaacatactaaatcgtatgcctaccgaagccaagaatcctgatatcaaagaaatcaacgacgatatcattagtatcactcataatacaaaaaaagagttcatcgatattgacgaaaatcttctagaagtagaggcatttacggaagaggagatggacatgcatatcagcgactacgaggaagacatcgaggaatcagtgggcggcttccggtcacccagcttggccatctgcatgatgacactaccccaacagctggaagaggaatttactgaggaggtgcagtgtcagcgggaagagcctctagaaaccattatggaagagaagagtaccgagcagaaaggcatgatcgaggctttctctcatcccgggcacacgacgccacagtctatgcaagttgacacttcgtccgaaattagtagcgctcagatttcaacatacaaggagaaatcaagctcggtgccacttctcattagcaacggtgtgaacgtggcttctcaacccccagcacccaccccacagaagacccagcgaaatgaattcaccgcacaactgcctgactgctcagaatcagtgcggcagatgctgcaggacgaaatgtttaagctggtgcaactgcagcaaattaacttcatgagtttaatgcagattgtgggctcgagttttgccaaccttcctgatacacaacaactggtccagcagagccaatctgttcatctcggagagtcacaggaaagtaatctccgggggtgcggagatgtcgaagattccaacaaaaacctgaaggagcgcttctttattaaaccacagtctatgggcgagaatgctcgggagcccagaaaaaacagtccccactgtcacgaaggaacaatcccaagcgggcagaactctactggaaatgtgcagaatgtgccacacggaagcatccctctttgtcaactgaatggccagccgcggaaaaaagggccgatccccagttcccagaatttgcccagcacttccttttaccctgcacctgcaggcaatacgcacctatatttactgagtaccccatctgtggtccagaaagccccacgactgattccccacgctaagactttcagtcccggcgatggtttcccattgctccaattcaaatcaaagcaagaatttcaacctcttttcctgcacacgggctccatcccccaggtgcctttcaggcctctgcctcagccacgggaggcatggggcctctcagactcatttcagccagccttgccccagagagcagcccagactacccccgccagtcaccttaacgtctcacaatacaacaccgaggctcgcaaaaaagaggtcgagcagaaaacttgggctgagactgtgataactgagattcctaatcatgtcaatctcgaccagtacgtaggccaagagaatctcactccccagcaggatagctccgttttcatcaagcccgaaaagttattcgacgtgaaaccgggcaccctggagattagtccccaccattctttcggcttgccactgctgtatttgcctctgaagcccccaaacatgtttcccagtacatcccgggcttctattaccgtgccatccacacccatccagcctatagccgaggaacggaagtacccaagactgagcctcttacattctcacctctcccccgagaacagatgcaaaaagacccagttgattcctctggagaaccttattgcgttcaaacaaagtcaacagaagttgacacacaatttgtttgagcagggcgacgctggacatctacagctgctgaaggtgaagatcgaacctcccgaagtgagacagggaaaggacagcaagaagcgccagcggaggagggccgaaaaggagttgcaggaaaaacgatgtgaaaaactgcggcgcaagccaaacgtgacttttagacccgaaaactctatcataaacaatgatgatagcgagatcattaagaaacccaaagagcagcaggaacattgtggaagccaccctctggatgacttcgacgtaccgtttgaaatgctgcaagatgacaacacttctgcaggacttcatttcatggcttctgtgaagaagaaggcaatcgggagtcaagacgcctcgacaaacactgaccccgaacacgagcctcttacagcaccccagctgctggtccccgacgtctatcttaacctcaaactgagctccgagatgtcagagaaaccctggagcccaagcatcccccacacagtaactaacctggaactgcctgtgagagaggagccgtccaacgataacgtgatcaagcaacagtctgaccacctggcagtgccctcatctgccgaactgcattacatggcagcctctgtgaccaatgccgtccccccacacaatttcaagtcccaaggcttaccaaaaccagaattccgattcaaaggacagtctactaagtccgattcagccgaggactatctgctgtggaagaggctccagggggttagtgcggcctgcccagctccatcctctgccgcacatcagctggaacacctgtccgcgaaattgcaaaagatcgatgaacagctgctagccatacagaatatcgccgagaacatcgaacaagatttcccaaaacccgagatgctggatcttcactgcgacaagattggacctgtggatcatatcgaattctcaagcggcccagaatttaaaaaaaccctggctagtaagactatcagcatcagcgaagaagtgcgattcttgactcacatggatgaagaagaccagagtgacaaaaaggagacaagcgaaccagagtttagcatcactgagaattactctggccagaagacatgtgtctttccgacggctgattccgcagtttcattgtcatcctcttccgatcagaataccacgagccccggaatgaattcatctgacgaactctgcgagagcgtgtctgtgcaccctctgcagatgacagggctgacagacatcgcagacataatcgatgacctgattatcaaggacggggtgagtagtgaagagcttggcctcactgaacaggccatgggaacgtcacgaatccagcactacagcgggcgtcatagccagagaacggacaaggaaagacgcgagattcaggcatggatgaagaggaagaggaaagagcgcatggccaagtatttgaatgagctggctgaaaagagaggccaagaacacgatccattctgtccacgtagtaatccactgtatatgacttctcgagaaatcagactgcgccagaagatgaagcatgagaaggatcggctcttactgtcagaacattactcaaggagaatcagtcaagcgtatggactcatgaatgagctcctgtctgagtcagtccagctgcctacactcccccagaagcctcttcccaacaaaccgagccccactcagtcatcatcatgccaacattgcccttctccaaggggcgagaatcaacatggccactcctttcttataaatcggccgggaaaagtcaagtatatgtccaaacccagttacatccacaaacggaagtcttttggtcagccacagggaagcccgtggcctcacgggaccgccacgttcacaattcaaaagaaagccggcggcgccaaagcagccgtgaggaaggccacccaaagtcccgtcacatttcagaagggcagtaatgctccctgccattccctgcagcatacaaaaaaacacggctccgccgggcttgcaccacaaaccaagcaggtgtgcgtggaatatgaacgagaggagacggtcgtctcgccgtggacgattccttccgaaatccataaaatattacacgagagtcataacagtctactgcaggatctttctccaactgaagaagaggagcctgaacatccgtttggagtaggaggtgtcgattctgtcagtgagtctactggctcgatactgtccaagctggactggaatgccatcgaagacatggtggccagcgtggaggatcaaggcttgagcgttcattgggccttggacctgtag

SEQ ID NO: 45662 - DNA, 9594 bp, Artificial Sequence
  Description of Artificial Sequence: Synthetic coding sequence
atggagatccggctggagatcctgaccagcaccggcatcaagcagaaaaaaccctggcctagagtcagttggctcggaaaagagaaggaggccgtttttctactcgatgacaagttcatcaacgaaatcaatctcctctccggtaaaattaagaagaagattcccagcctgcagccgttcctcaaagatgtcatcgtgcttacgacttcgtctaacgacgcctggcttgctggtgtcctgaccaccggcgagctatttctgtggaacaaagatcaggattgtctcaagaccatccccatcaccgagaagccaaaggagatgatcaaagccactgtagcatcctctctcaggctgtacctgtacgtgtctggtaatggtaaaaggatcgtgcttatcaccccttccggctgtatttttttgtgggagtacctcgagctgaaaaacatcttgtctagcaaatctttgtcattggcgggtagatggagccaggtcatccccgaagaggccgtcctattgccatcaaccgaagataaagaggctgtcgtgaatgctgtgttcatcaaaaatgagttattcggagactgctgtttgtgttccttcacattctactcaggggaatgcctgaagctcacattcctggctatcagatggcacgagaacgtttttacaagcgttagaagcttgccttatcatgtgcactgggcacagcaagactgtcatctgtgctccctgatccctaagtgtgaatccgtcaaaagtaggggggctctcataagtgccttttcccgagacggtctgaccctagcagtcaccctgaatcagaaggatcccaaggccacccaggtgttattcatcaatactctgaatttcgtgacactttgcggctctttaaaaggctgttcaaataagagccctgttgtgcccgctacccttattcgcagttattgggtcggcgacatcagctggacgcatgattcattatttttggcatgcatgcttaagagaggttccctggttctcttgacttgtcagggagagttgctgaccctaataacatttggatgtagtattgagtttggaccagcagagtttatacccttgcatcccctgattacgtaccgccctcagcagttcactttccaggattctaacaacagcgtggattcttccgcctctgatagcgaccccatgagacagcggttcagtattaaggcccactcgcggcttccctacttggtaatctccgacgggtacatggtgactaccctgcgatttctagattctcttagccccagtgtgcacatgaggtccctgcttctcgactccactcagcggttggagaaaatctaccagtctgtgatactgtccaaacccaaaggtaaagggttgaacctgcgaagccttaacagcctgcgcagctcactgctcgagcaccaaggtaacgaaagctcagccgacttcacagttccgaaattcctccaggcagaggaaacgattaatgagaacgcagcagacttccaggactttgaagcggaagagactaacgagggcagacatttcccggataacctgtgccccttttggaataaacgggatgatgtcctttgtagctctatgaaagaggggaggctcgaattcgcatcaatgttcgatacgatacatgccaaggatgactccgaggaaacagatcggactatcaccgagctgcacagcattcaaaagtcccttctagctgcgtggactattgggatttccaaaactgtcacagaaaaaaaccttatgctgaactacatcgttgtttgcatcacgcatttcttctacatattgcagtttatcaagtgtccattccctaagctggacctggttctgagtaagtcttcgagacacaatgcctggatcctgtgcatttttcagctcttccaccagtgcctgtctattcattactgggacattcgctataaacaagatgtaggacacctaattaagctgaccagtaatacggtaaagctgctcctaactcagcaacaaaaagggcagcttttctcagaaaaactccttgcctgtttctacctgctgaagatggtagccgataaccttaacggtgtgtatatcctgcagcctgaggtgattagtgcaagtgctgatgggagcaaaattactgctcaggactctctagtggtgccaatttttcaaatgttccaggattctgggttccaaaagaattggtcctggaactcctttttcaagatccatccccaggtggtgaatcccgtgcagcagcccggccaccggctactgattctgtggagaatcctgtataagaaaacactgtggtaccaggcacaactgaaccggagggtccccgaggcggactcccagctgactgaaaagatgacgcatgaggcctcaactgtgaaatccctgctgtgtcacttgcaggccaatctgcagtcaacaggagactgcctgaatcaaactctcgagcttaagagtattaatggcgaggagtgcttccttctggggtcttacgaaaaatctgtacaactgtggaagaaagcactacaggagatcgaagaaaagggagggagaaggacatactttctacagatccgctattacctaagcttgttgtactgccatttatatagctacaacctgaatgatgcccaggggctgtgtgatcagttggctagagaaattttgagatggtcacaattgcctgtgaaagaaaacaaggatttcagtggggccgctaaaagtcatttcgaatgtggcatggtgggcggggtgcatccggaggcagcagtaagggtggtgcagagcatggcccgcttcatggccgcctatttcacaaaccagcaactgtgtatactgccgccacatcatgtgaacgtgttacctccactgcatataaagactgaacagtcgttccgattaattcctctgcaacatagtaaagtggcctccgtagtaagggaccaaaacctctccaatgtctggactgtggagtatgccctcgagttactgtttattggggggctggtccccgaggcggtatggctagcgtataagctgggcgattggaaaacttcagtttcgattggcgttgcctttcagctcttctgcaagcgcgacagcaacttcatgcgatctaaaaagaaaagcctcaatcttccacttaggatgaccccagctcagatcttccaggagaagcttcagtgcgtcctagggcaacccgccagtctggaagcaaaaaacgagatgggatctaagtacaaacaatttaccgatccaatcgaagaagaggatgctaacctgttatttggatctgttcaggaggtgttaaaagcctctgtaatggccgatgctgacatcctcagcgagacattccaacttctgattgactcagctaaggactttagcaaacgcctgtggggactagtccctttcggattatacctcccagccccgcccctttactgtccacagccagctatcctctctgaggaagatggggacgatttattactgaaggctgaaaagaataaccgtcagaaagtgagcggcatcctgcagcgggtgctgctgctgttccgtgccgcccaatgttctttcccagttgcccaatggtatatccttcagctgcgttgggcgcggaaggtgatgcaaaaaattcgcatgaagggctcactgccaagtctaagtccctttccccaatctctgctcaactactgcaaggggggcattgccttttttcggccaggggcggcgggtgatcacaagctcgatgaggtaagcattcgagccattggctgctttcgcgagctgtgtgctttgtgctggatgctgcacgtgcgtgataagctctcttatagctgtcgccaatatcagaaggcacgagaaaatgtgaagggagaaaaggacttggaagtggaattcgactcctgcatgatagaacactgtctgagcgcagtcgaatgggcctaccgaatgctgcccttctcccgtttcttcaatatggaagagctgattcaggatatcattcttagtttgattggagagttaccccctatccgcaaggtcgctgagatctttgtgaaagcattcccttaccccgaagacgtccgagttccacttagagacaaataccactccctgcatcagagattgaggcactgcgtggtgaaaggaccgcaaacagaggaaatgatgagcgtggtcatgcattctattcaaaaggttagagtcaaagccctcaaacgcgtgcagaggaatatcggcagcttcgaggtaaacatttgggagcctatcgaagaggaaaaaccagacgaggcccctggagttgatagatattccctgggcacatctttgtcccgttccacattaacagagttaggcgacagtgtggtgcattcagacgccgacactttcagtgaagcattgtctgtggaggagaagagcagaatcaatatatatcagcggaacgccccaaaccacatggaactcacgtcaattcacaagcccacagataagcggaagatgtgcaaccagaaggaaaatcccacaaagaaagaagaccacgagaagcttagccaaaacacactgcctgtcatcggtgtctgggagttcgaacgcgacgatgatgagtatatcaagtttctcgacctgttcttgagttatattctggagagggatttgccatattccagagacgccgacattccattcctgacaagttttagcgggaaactccgggaacacgaacttaacagtctgcttttcgatgtccacacaaccctaaagcggcatcagagcaagaccaaatcacaaaacgtgttccgggccggatcttgcttcgtggtggctcctgagtcgtacgagagcgagaaatctagttctttgaacgacgaatatggtatgcatttggaaaaccagaaactcagtagttctgttctcgtcaatcagggcataaaaccttttctccagtatccatcaaacgaggtaaacaagaacgagggcatgagtggcctttttgggctcaagcagagatccatatataagatccaggatgacacccgggaaaaatgcttaatacagaggagtagtaatcacatattttggacgcctaaatctataaaaacacgccggtgtatcttcaaggccatccagtgcaatgacatcaatccacaggaggatttgcctctggccttaaacacctttggttcgattggaagactgctggagtggatgattcgctggtcgaatcgccggctgctgtgtgacagcggtataacagagtcatctagtgagtactcgcctgtcataagggtgaagacctccacagctgccatccttacctccctgtggctcctggaacagccatattttgcgacatacaaggcaaagaatgcaatcatcaaaatggtggagaacagagacaccggctgccagattgggccaaacattgagcgtgaatctaaaagcgatgctggtggttcggtcgcagtcgccactccaggaggcactgaggagcgaaatgggcagaacaagtcctgccagaatatccttaatagaatgcctaccgaagcaaaaaatccggatatcaaagagattaacgatgacatcatttccatcactcacaatactaaaaaagaatttatcgatattgatgagaacctcttagaagtcgaggcttttacagaggaagaaatggacatgcatataagcgattatgaagaagacatcgaagagtcagtggggggctttagaagcccgtcgttggccatctgcatgatgactcttccccagcagctggaagaagagttcacagaggaagtgcagtgccagcgcgaggagccccttgagaccattatggaggagaaaagcacagaacagaaaggtatgatcgaagctttctcccatccaggccacacaactccgcagagcatgcaggttgacactagttctgaaataagttcggcgcaaatatccacctataaggagaaatcttccagcgtgcctctcctgatttcaaatggagtgaacgtggcaagtcagcctccagcccctactccacagaagacacaaaggaacgagtttactgcccagctcccggactgtagcgagtcagtgaggcagatgctgcaagatgagatgtttaagctggtccagctgcagcagattaacttcatgagcctcatgcaaatcgtgggctcctcattcgccaaccttccggacacccagcagttagtgcagcagtctcaaagtgttcacttaggggaatcacaggagagcaacctgaggggttgtggcgatgttgaggactcaaataagaacctgaaggagagattttttattaaaccccaaagcatgggggaaaatgcacgtgaacctcgtaaaaacagtcctcattgtcacgaggggactattccgagcggccagaattccaccggtaacgttcagaatgtgccacatggctctatccctttgtgccaactgaatggtcagcctcgcaagaagggcccaatccctagttcacagaatttgccttctacaagcttctatcctgctcctgccggcaacacccacctgtacctgcttagcacaccgagcgtggtccagaaggcccccaggctcatcccccatgccaaaaccttttcaccgggtgacggcttccccttgctccagttcaagagcaagcaggaatttcaaccattgtttttgcacaccggatcgattcctcaggtgcccttcaggcccctgcctcagcccagggaagcatggggcctctcagattcgtttcaaccagcattaccgcagagggcagctcagaccactccagcatctcatctgaacgtcagccagtataataccgaggcgagaaaaaaggaagtggaacagaagacctgggcagagacagtcattaccgagattcccaaccatgtgaacctggaccagtatgtgggccaggagaacctcactccacaacaagacagctcggtgtttatcaagcccgagaaattgttcgacgtgaagccaggcacgctggaaatcagcccccatcactcttttggacttcctttactctaccttcctttaaagccccccaatatgtttccctccaccagtagggccagcattactgtcccatccacccccatccaacccatcgcagaagagagaaagtaccccagactatcactgctgcattctcatctctctcccgagaaccgctgcaagaagactcagctcattccattagagaaccttatcgccttcaagcagagccaacagaaactgacccataatctgtttgaacaaggcgacgcaggccatctgcagctgttgaaggtgaaaattgaacccccagaggtgcgccaaggcaaggattctaagaaaagacagcgccggcgggccgaaaaagaactgcaggagaaacggtgcgagaaactgaggcgcaaaccgaacgtcacatttcgaccggaaaacagcatcatcaacaatgatgattcggagatcatcaaaaaaccaaaggaacagcaggagcattgtggatctcacccacttgatgacttcgacgtccccttcgaaatgctccaagatgacaatacttctgcaggactgcacttcatggcatctgtgaagaagaaggcgatcggatcccaggatgccagtaccaatacggacccagaacacgagcctttgacggccccccagctcctggtgcctgacgtttatttgaacctcaagctgtctagtgagatgtctgagaagccatggtctccttcaataccacataccgtgaccaacctagaactgccagtcagagaggagccaagcaacgacaatgtgatcaagcagcagagcgaccatttagctgtcccctcaagtgccgaattacactacatggctgcatctgtgaccaacgccgtacctcctcataattttaaatctcagggcctgccaaaaccggagtttagatttaagggacagtccacaaagtctgattcggcagaagactacttactctggaaaagactgcagggtgtgtcggccgcctgccccgcccccagctcggcagctcaccagctggagcatttgtccgcgaaactgcaaaaaatagacgaacaactcctagccatccaaaacattgctgagaatattgagcaagacttcccaaagcccgagatgctagatttgcactgcgataaaattggccccgtggaccatattgagtttagctccggacctgagttcaagaagactcttgccagcaagaccatctcgatcagcgaggaggtgagattcctaacccatatggacgaagaggaccaaagcgacaagaaagaaacaagcgagccagagttttcaattacggagaactatagcggtcagaagacatgcgtttttcccacagctgattctgcggtctcacttagtagcagctccgaccagaatactacgtcccccggtatgaacagctccgacgagctgtgtgagagtgttagcgtgcatccactgcagatgactggtctgaccgacattgccgatattatagacgatttgattattaaggatggggtgagctccgaggaactgggactcactgagcaggccatggggacatccaggatacagcactatagcggcaggcactcccaacgcaccgataaagagcggcgggagatccaggcctggatgaaacgcaagcgcaaggagcgcatggctaagtacctgaacgaactggcagagaaacggggtcaggagcacgatccgttttgtccaaggtccaatcccctttatatgacatctagagagatccgcctgcggcagaagatgaaacacgaaaaagatcgacttcttctgtcagaacactactccagacgtatcagtcaagcgtatgggcttatgaacgagctgctgagtgagtccgtacagctaccgacgttgcctcagaaaccactaccaaacaaacctagccctacacagtcgagctcttgccaacattgtccatccccgcggggcgagaaccagcacggtcactccttcctaatcaatcgccctggcaaagtcaagtatatgtctaagcccagctacatccacaagaggaaatccttcggacaaccacagggctctccttggccccatggtacagcaacatttaccatccagaagaaggcagggggagcaaaggctgctgtccgcaaggcaacccaatctccggtcacattccagaaaggtagtaacgcgccttgtcacagccttcagcataccaagaagcacggaagcgcgggtctggccccccaaacaaaacaggtatgcgtggagtacgagcgggaggaaaccgtggtaagcccctggacaatccccagtgagatccataagattctgcatgaatcacataactccttgctgcaagacttgtctcccaccgaagaagaagagccagaacacccattcggtgtcggcggggtggactcggtgagcgagagcaccggctccatcctctcaaagctggactggaacgcaatagaggatatggtcgccagtgtggaagaccagggattgtccgtccactgggccttagacctgtag

SEQ ID NO: 45663 - DNA, 1725 bp, Artificial Sequence
  Description of Artificial Sequence: Synthetic coding sequence
atggccaccctggtggtgaacaagctgggcgccggcgtggacagcgggcgtcagggcagccgtggcaccgctgttgtgaaggtcctggagtgtggtgtgtgcgaggacgtgttttcccttcagggggataaagtgccaagactgctcctatgcggtcatacagtgtgtcatgactgtctgaccagacttcccttgcacggacgagcaatcagatgccccttcgatcgacaggtgacggatctgggagatagtggtgtatgggggcttaaaaagaatttcgctctgctggagctgttggagcgactccagaatggtcccattggccagtacggcgcggccgaggaatccatcgggattagtggcgagagcattatccgctgcgatgaggatgaggcacacttggcttcagtctactgcaccgtctgcgctacccacctgtgttcggaatgctcacaagttacacacagcaccaaaaccttagctaagcaccgtcgggtgccccttgctgacaagccacacgagaagacaatgtgtagccagcaccaggtgcatgctattgaattcgtctgcctcgaagagggatgccagaccagcccactgatgtgttgtgtctgtaaagaatacggcaagcaccaggggcacaagcacagtgttctggagcccgaagctaaccagatccgcgcgtcgatcctcgacatggctcactgcatcagaacgtttactgaggagattagcgactatagtcgcaagttagtgggcatcgtccagcacatagaaggtggggagcagatcgtcgaggacgggatcgggatggcccatacagaacatgtgcccgggactgcagaaaatgcccgctcatgcattcgtgcctatttctatgacctgcatgagactctgtgccggcaagaggagatggcactgagtgtggtggacgcccacgtcagggagaagctgatctggctgaggcaacagcaagaagatatgaccatcttacttagcgaagtgtccgccgcctgtctgcactgtgagaagacactacaacaggatgactgtcgggtggtgctcgctaaacaagagatcacccgccttttggagactttacagaaacagcagcagcagttcactgaagtagctgaccatattcagcttgacgcctcaatccctgtgaccttcaccaaggataatagagtgcacatcggccccaaaatggaaatcagagttgtcacacttggcctggacggggcaggcaagacaacaatactgtttaaactaaagcaggacgaattcatgcagcctattcctaccattggctttaacgtggaaaccgttgagtataaaaatctcaaattcacaatatgggatgtgggtgggaagcataagctccgccccctctggaaacactactacctgaatacccaggccgtagtgttcgtcgtggacagctcccacagagatcgcatctctgaagcacattccgaactcgccaaactgttgacagagaaggagttacgagacgccctgctcctgatattcgccaataaacaggatgttgctggcgccctcagcgtggaagagatcaccgagctcctgtccctgcataagctgtgctgcgggcgaagctggtatatccaagggtgtgacgcccggtcgggaatggggctgtatgaagggctggactggctgagcagacaacttgttgcggccggcgtattggacgtcgcctag

SEQ ID NO: 45664 - DNA, 1254 bp, Artificial Sequence
  Description of Artificial Sequence: Synthetic coding sequence
atggaggtgaacccccccaagcaggagcacctgctggccctgaaggtaatgagactgacaaagcccacactttttactaacatccctgtcacttgtgaggaaaaagatctaccaggcgatttgttcaaccagctgatgcgggatgatccaagcacggtcaatggggccgaagttctgatgctgggagagatgctgacactgccccagaatttcggcaatatcttccttggtgagaccttctccagttacatcagtgtccataatgattcgaaccaggtggtcaaagatattcttgttaaggctgatctccagacgtcctcccagcgcctcaatctgtcggcctcaaacgcagctgtggccgagctgaagcctgattgctgcattgatgatgttattcaccatgaggtcaaagagattggcacacacattctggtgtgtgccgtatcatacactacacaggcgggtgaaaagatgtactttcgaaaatttttcaagtttcaagtccttaagccgctggatgtaaagaccaagttttacaatgcggagagtgacttatcgtctgttactgatgaagtgttcctggaggcccagatacagaacatgacaacatctcctatgttcatggagaaggtaagcttggaaccttctatcatgtacaatgtcacagaacttaactccgtcagccaggccggcgaatgcgtgtccacatttgggtctcgtgcttatctgcagcctatggatactcggcagtacctgtactgtctgaagccaaaaaatgaattcgccgaaaaagcagggattatcaaaggggtcactgtcattggcaagctggatatcgtctggaagaccaacctaggagagcggggccgtctccagacatcacagctacagcggatggctccgggctatggagatgtgcgcctctccttggaggccatcccggacacagtgaatctcgaggaaccattccatatcacatgcaaaattaccaactgctcagagcgtactatggatctcgtcctggagatgtgtaacacaaactccattcactggtgcggcatctccggaagacaactgggaaaactccatccatctagctccctgtgcctcgcgctgacccttctctcttctgtccagggacttcagtccatcagtggattgagattgaccgatacgttcttaaagcgaacctatgagtatgacgacatcgcacaagtttgtgtggtgagtagcgcaataaaggtggagtcatag

SEQ ID NO: 45665 - DNA, 1239 bp, Artificial Sequence
  Description of Artificial Sequence: Synthetic coding sequence
atggaggtgaacccccccaagcaggagcacctgctggccctgaaggtgatgaggctgactaagccgaccttatttaccaacataccagtcacctgcgaggagaaagacctgccaggcgacctgtttaatcagctgatgcgtgatgatcccagcaccgtcaacggcgcagaagtgttgatgctgggggaaatgctcaccctgccccaaaatttcggaaatattttcctgggtgaaactttcagtagttatatcagcgtccataatgacagcaatcaggtagtgaaggatatcctggtcaaagcagacctacagacaagctctcagaggctgaaccttagtgcctccaacgctgccgttgccgaactgaagcccgactgctgtatcgatgatgtcatccatcatgaagtgaaagagatcgggacacatatcctcgtgtgcgccgtgagctacacaacccaggccggcgaaaaaatgtactttaggaagtttttcaaatttcaagtcttaaagcccttagatgtcaagaccaaattttataacgccgaaactgacgaagtctttttggaggcacagattcagaacatgaccacctcaccaatgtttatggagaaagtgtcccttgaaccaagcattatgtacaatgtcactgagttaaatagcgtgagtcaggcgggtgaatgtgtaagtactttcggcagcagggcgtacttacaaccgatggacactcgccagtacctgtattgcctgaaacccaagaacgaatttgctgagaaagccgggattatcaaaggggtgaccgtgattgggaaactggatattgtatggaaaaccaacctgggcgagcgagggagactacaaacatctcaactgcagcggatggcccccggttacggtgacgtgaggttgtccctggaggctatacctgacacagtcaacctggaagaaccttttcatatcacctgtaaaatcacaaactgttcatctgagcggacaatggacctggtgctcgaaatgtgcaacacaaacagtatccattggtgcggtatttcaggccgacagctggggaagctccatccgagctcgagcttgtgcctggccctgacacttctgtcctctgtccaaggcctgcaaagcatctctggcctgcgactgaccgacactttcctgaagcggacctacgagtatgatgatattgctcaagtgtgtgttgttagctcagcaattaaggttgagagctag

SEQ ID NO: 45666 - DNA, 1260 bp, Artificial Sequence
  Description of Artificial Sequence: Synthetic coding sequence
atggaggtgaacccccccaagcaggagcacctgctggccctgaaggttatgcgtcttactaaacctaccctcttcaccaatataccggtgacatgcgaggagaaggacctccctggtgatttgtttaatcagctaatgcgggatgatccctcaacagtgaatggggccgaagtccttatgctgggagagatgcttactctgccccagaacttcggtaacatattcctgggcgaaacattctcttcctacataagtgtccataatgattctaaccaagttgtaaaagatatcctggtgaaggctgacctacaaacctcaagccagaggctgaacttgagtgcttctaacgcagcggtggctgagctgaaacccgattgctgcattgatgacgtgattcatcatgaggtcaaggaaattgggacacacatcctggtctgtgccgtgtcttacacaacgcaggcaggcgagaaaatgtacttccgcaagttctttaaattccaggttctgaagccactggacgttaagacaaagttttacaacgctgaaaagcagattgccaatgtaactaccgatgaggtgttcttagaggcccagatccagaatatgaccacctcacctatgttcatggagaaagtcagtctggaaccaagcatcatgtataacgtgactgagttaaattccgtgtcccaagctggagagtgcgtctctactttcggcagcagggcatacctccagcctatggatacgagacagtacctgtattgtctcaaacccaagaacgagttcgccgagaaggctggcatcatcaaaggagtcaccgtgataggaaaactggacatcgtctggaaaactaatcttggcgagaggggtcggttgcagacatctcagctccagcgaatggcccctgggtatggtgatgtgcggctttccctcgaggctatccccgatactgttaatttggaggaacctttccacatcacgtgcaaaatcaccaactgttcgagcgagcggacaatggatcttgtcttagagatgtgtaatacaaatagtatccactggtgtggcataagcgggaggcagctgggcaagcttcacccctcttcaagcctttgtctcgcgctcactctccttagttccgttcagggtttacagagtattagtggtctgcggcttacggataccttcctgaaacgaacttacgagtatgatgacattgcccaggtgtgtgtggttagctcagctatcaaggtggaaagctag

SEQ ID NO: 45667 - DNA, 1257 bp, Artificial Sequence
  Description of Artificial Sequence: Synthetic coding sequence
atggaggtgaacccccccaagcaggagcacctgctggccctgaaggttatgagattaaccaagcccactctgttcactaacattccagtcacctgcgaagaaaaagaccttcccggagacctctttaatcagctgatgcgagatgacccaagtaccgtgaacggcgccgaagtgcttatgctgggcgaaatgctgactttgccccagaatttcgggaacatattcctgggggagacctttagcagctatatcagcgtgcacaacgactccaaccaggtggtgaaggacatcttagtcaaggcagatctgcagacatcttcccagcgattaaacctctcggctagcaacgctgctgtggctgagcttaaacccgactgttgcatagatgacgtcatccatcatgaggtaaaagaaatcggaacccatatcttggtttgcgctgtgtcttacacaacacaggccggagagaagatgtatttccggaaatttttcaagtttcaagtgctgaagcccttggacgtgaagacgaaattctacaatgcagaaagcgacttgtctagcgtgacagacgaagtctttctcgaagcgcagatccaaaatatgaccacatcacctatgttcatggagaaggtctctttagagccatccataatgtacaatgtaactgagctgaattctgtctctcaggctggcgaatgcgtgtccacattcgggagccgtgcctatcttcagcccatggacactcggcagtacctgtactgcctcaaaccaaagaacgagtttgcagaaaaggcaggcatcatcaagggtgtgaccgttatcgggaaattagacattgtctggaagaccaacctgggagaaagaggcagactgcagaccagccagctacaacgcatggcccctggctatggagacgtgaggctttcccttgaggccatcccagatacagtcaacctcgaagaaccatttcatattacctgcaagatcactaattgtagctctgagcggactatggatctggtcctggaaatgtgcaacacaaattctatccattggtgtggcattagcggccggcaacttggaaaactgcatcctagtagctcattgtgcctggctctgaccctcctatcttctgttcaaggccttcagtccatatccgggctgagactcactgatacatttttgaaaaggacctacgagtacgatgatatcgcccaggtgtgtgtcgttagctccgccataaaggttgagtcctag

SEQ ID NO: 45668 - DNA, 1032 bp, Artificial Sequence
  Description of Artificial Sequence: Synthetic coding sequence
atggccagcctgcagcggagccgggtgctgcggtgctgcagctgccgcttgttccaagcacaccaggtgaagaagtcagtgaaatggacgtgtaaggcttgcggcgagaaacaatcttttctccaggcctatggtgaaggctcgggggctgactgtcgcagacacgtccagaagctcaatctgctccaaggccaggtgagtgaactgcccctacgttcactggaggagaccgtcagcgcaagtgaagaggaaaacgtggggcaccaacaagctggtaacgtgaagcagcaagagaagagccaacccagcgagtcacgctggcttaaatatttggagaaggattcgcaggaactggagctcgagggtaccggggtttgtttctcgaaacaaccttcttctaaaatggaggagccgggtccccgattcagtcaggacctgccccgcaaaagaaagtggtcgagaagcacagttcagcctccctgctcgaggggcgttcaggatagcggcggcagcgaagttgcatggggcccgcagaagggccaggccgggctgacctggaaagtgaaacagggttctagcccctgcctgcaggagaattctgctgattgctccgcgggcgaactccgcggaccaggtaaagagttgtggtcacctatccagcaagtgaccgccacaagttcaaaatgggcccagtttgtgctgcccccacgcaagagcagccacgtcgattccgagcagccgcggagtcttcagcgggacccccgcccagccgggccggcccaggcaaaacaggggacccccagggcacaggcctccagagagggactgtcccgccctacggcggcagtgcaactgccaagagctacccatccagttacgtcagggtctgaaagaccctgcgggaaaacctcttgggatgccagaaccccctgggccgagggtgggcctcttgtgcttgaagcacaaaaccctcgcccgactcgactgtgcgacttgttcataacaggcgaggacttcgatgatgatgtatag

SEQ ID NO: 45669 - DNA, 867 bp, Artificial Sequence
  Description of Artificial Sequence: Synthetic coding sequence
atggccagcctgcagcggagccgggtgctgcggtgctgcagctgcaggcttttccaagcccaccaggttaagaaaagcgtgaagtggacgtgtaaggcctgtggggagaaacagtctttccttcaggaaaagagccagccgagcgaatccagatggctcaaatacttagagaaagattctcaagaactcgagctggaaggtacaggtgtgtgttttagcaaacaacccagttccaagatggaggagccaggcccccggttttcacaggacctgcctaggaagaggaagtggtctcggagtacagttcagcctccttgcagtcgcggtgtccaggatagcggcggcagcgaggtagcttggggaccccaaaaaggccaagccggcctgacatggaaggtgaagcaggggtcatccccctgtctacaggaaaacagtgccgactgctcagctggagagttacgaggtcccggcaaggaactgtggagtcccattcaacaggtcaccgccacctctagcaagtgggcgcagttcgtgctcccccccagaaagtcctcgcatgtggatagcgaacagcccaggtcacttcaacgcgatcctagacccgctgggcccgcccaagccaagcagggaacccctagagcacaggctagccgcgagggcctttccaggcccacagccgctgtgcaattgcccagagccactcacccagtcacctcagggtctgaacgaccttgtggaaaaacctcttgggatgcacggacaccttgggccgaagggggccctttggttctggaagcacaaaatcctagacccacccgactttgtgacctgtttataacaggcgaggacttcgatgacgacgtgtag

SEQ ID NO: 45670 - DNA, 816 bp, Artificial Sequence
  Description of Artificial Sequence: Synthetic coding sequence
atgcagagcgcccgggcctggctgcccggcgactgcaccagccgggacggggtggcatccgccttttcaggagcaactctgctgcaactgcctcccctcccaggcgctccaggtaaaaaggagtgtcaggtcgacatgcagtcactgtggcgggaggccgtgctgtttgccgaatttccccggcacggcgccccagcctcagagttgcctgtgcctagcggatcagaaatggacggcgctgagagcgggaaggcttatggtgaagggtcaggtgctgactgccgccgtcacgtccaaaagttgaaccttctgcagggccaagtgagcgagcttcccctccgttctcttgaagagaccgtgagcgcttcagaggaggaaaatgtaggacatcagcaggctggaaacgtcaagcaacaagagaagtctcagccaagcgagtctcggtggctgaaatatctggagaaagattcacaagaactggagctggaggggaccggagtatgtttctccaagcagccgagtagcaaaatggaagagcctggacctagattctctcaagatcttcctcgcaaacgcaaatggtctcgttctactgtccagcctccttgcagccgaggcgtgcaggatagcggcggcagcgaggtggcttggggacctcagaagggtcaggcaggactgacgtggaaggtcaaacaaggcagcagcccttgcctccaagagaactctgcggactgtagcgctggggagctgagaggccctggcaaagaactctggagtcctatccagcaagatgggtacaaggagatcctgttttag

SEQ ID NO: 45671 - DNA, 531 bp, Artificial Sequence
  Description of Artificial Sequence: Synthetic coding sequence
atggccgccgccggccggggccgggagcaggacagcgcccggttcgtgtacgtaactcggtttggcagccaccagtgctctggcgtactgcagctaggcggtcgaggtgcccagggactctggggacaaggacccggagcaggatgcagacaggaaaagccgagggaagccatggcagtcgccggagtccaaggcggcagcgaactccctcttgggtcacagctgagagtgccgactaccccgggggttgaggccgctgcttccgccagttcccaactgagagccagccgggtacagtccggaacacgccagtctgcaagagcgggcctgattcagaaggacgctgcgaagaaatatgacttccctatcccgttgaacgaagccagtaaaattatgaagaaaaaaaaaaaagttctggtgtggaaccgagtttacaaggtaataagtcgtatgttggaggagaatgagaagtaccggcacaggctcaagtgtcagaggctgagctcggagtccagcaattatacgcgctag

SEQ ID NO: 45672 - DNA, 405 bp, Artificial Sequence
  Description of Artificial Sequence: Synthetic coding sequence
atggccagcggcaaggacacctgccccaccctgcccaagctgaccaataactgctccgatgagtccttgtataaatccgcaaacaaatacgaagagattcacctgccccgcttttctttgaaacagggcatgatacctcggaggtatgtcatgccttggaaagagaatatgatttttcgcaatgtgaacctgaagcaagcagaggtctgtggcattcatactgggcccctcgaagattcactctttctcaatcatagtgagcgcctttgtcatggagaagaccggaaggtcgtgttccaaaaggggccaccagagattaagattgctgatatgccactgcactctccactctccaggtatcagagcactgtcatatctcacggattccgccgccggcttgtgtag

SEQ ID NO: 45673 - DNA, 444 bp, Artificial Sequence
  Description of Artificial Sequence: Synthetic coding sequence
atggaggacgacgaggaggagaccaccgccagcaccctgcggggcaagcccaggccaccaccagtgagtgcccagtctgcattcagctacatcccaccccggagactagaccctaaggagcatagctactattatagacccgcacgcaccggaatcatctccctctacgactgcatcttcaaaaggaggttggattacgaccaaaaactccaccgcgacgacagagagcacgctaaatccttgggactgcacgtaaatgaggaggagcaggagcgccccgtaggagtgctgacgagctccgtatacggcaaaaggatcaatcaacctattgagcccctgaaccgggacttcggcagagccaaccatgttcaggctgatttctaccggaagaacgacatcccctcactcaaagaacctggctttggtcacatagcccctagctag

SEQ ID NO: 45674 - DNA, 471 bp, Artificial Sequence
  Description of Artificial Sequence: Synthetic coding sequence
atggccacccagcaggtggacagccggcggcaggtggccgccgagcaggtggcagcccaactgcttgagagacgccggggatcccattgtgacgatgagaaacagacccttctggcactcctcattctcgtcctctatctttctaccgagatctggggcagttcatgggaggtctctgagcgaataagggaatgtaactattatcaaaatttggcagttccacagggcctagaataccagaccaacgaaccttccgaagagccaataaaaacaatccgtaattggctgaaggagaaactgcacgtgttctcagagaaactggaggaggaagtgcagcaactggaacagctagcttgggatctggagctgtggttagatgcccttctcggggagccccatcaggaggaacattgcagcacctataaaagtcacctacatctagaacacgaggtgtccatacgcgatcactag

SEQ ID NO: 45675 - DNA, 885 bp, Artificial Sequence
  Description of Artificial Sequence: Synthetic coding sequence
atggccgccgccgtgagcagcgtggtgcggcgggtggaggagctgggagatctggcccaggctcacatccaacagcttagtgaggcagccggagaggatgatcacttcctgatccgcgctagcgctgcacttgagaagctcaaactgctttgcggagaggagaaagagtgcagtaaccccagcaatctgctggagctgtatactcaagctatcctggatatgacctatttcgaggagaataaactggtcgatgaggattttccagaggattctagcagtcagaaagtgaaggaacttatctccttcctgagcgagccagagatcctagtcaaggagaataacatgcatccaaagcattgcaacctgctgggagacgaactgcttgaatgcctctcctggcggcgcggcgccctcctctatatgtactgccacagtctcaccaagcgaagagagtggcttctgaggaaatcctctttgctgaaaaagtacctcctcgacggcatctcttatctgctgcaaatgctgaactataggtgccccatccagctgaatgagggagtgagcttccaggatctcgacacagcaaagctgctttctgctgggatcttctccgacatccacctgctcgccatgatgtactccggcgaaatgtgttattggggcagtaagtactgcgcagatcagcagcccgagaatcacgaggtcgacacctccgtttccggagccggatgtaccacatacaaggagcctctggatttcagggaagtcggggagaaaatcctgaagaaatacgtttccgtgtgcgaggggccgctgaaagaacaggagtggaataccactaacgccaagcaaatcttgaatttttttcatcaccgctgtaactag

SEQ ID NO: 45676 - DNA, 480 bp, Artificial Sequence
  Description of Artificial Sequence: Synthetic coding sequence
atgacccagcccacccggcccagcgtgacctgcgaccagggcagcagcacgataggtggtactgcagcacaagcgactacctctagcagtgctacttccgggtctaactaccagagagacaggcttggccgaagacccgaaattggcgtgggggggcaaccccaaatatgttttcctcgaccccgatctgcgcagcagccagtccttttctcactcatgaattcaagcgaggccgcaatgaagaagacattacccaaaagccatctgtcacgcgtaattatccacgataatcgcattacccagaggatttatgaaatggaggtgtctgccctagagaagacaaaaaagaaaattagtcactactacgaacatctgaaaaaaaagtttatgaccgagcagctcagaaagcttggcaggtggagagaggagagtgtaaactctaatagataccttacattcggaatccctccacctgtgtag

SEQ ID NO: 45677 - DNA, 1785 bp, Artificial Sequence
  Description of Artificial Sequence: Synthetic coding sequence
atgagcaagaagcggaagtgggacgacgactacgtgcggtactggtttacctgtacaactgaggtcgatgggacccaacgccctcagtgcgtgctctgcaactcagtcttctccaatgccgacctgcgccccagcaagctatctgaccacttcaacaggcagcacgggggggtggcgggccatgacctcaactcccttaaacatatgcccgccccctccgaccagtcagagacgctcaaagcctttggcgtagcgtcgcatgaggatacactgctgcaagccagttaccagttcgcttacctgtgtgctaaggagaagaacccccacacagtagcggaaaagctcgtcaagccgtgcgcattggagatagctcagatcgtcctgggtccggacgcccagaagaagcttcagcaggtgcccctgtccgacgatgtaatccacagtaggattgacgaaatgagtcaagatatattgcaacaagtgcttgaggacattaaagctagccctctgaaggtgggcatccagctggctgaaaccaccgatatggacgactgctcccagttgatggcctttgttcggtacatcaaagagagagagatcgttgaagagtttttgttctgtgagcctcttcagctttctatgaaagggattgatgtctttaacctctttagagacttctttctgaaacacaagatcgctttagatgtgtgcggaagtgtatgcacagatggagccagcagtatgttaggagagaattcagagtttgtggcttatgtgaagaaagagattccacacattgtcgtcacacactgcctcctaaatccacatgcattagtgattaagacactgccaacgaaactgagggatgcgcttttcacggtcgttcgggtcattaactttatcaaaggaagggcaccgaaccataggcttttccaggcattctttgaagagattggtattgagtacagcgtccttctgttccataccgagatgagatggttgtcccggggccagatcctcacacacattttcgaaatgtatgaggaaatcaatcagttcctgcatcataaatcctcaaatctggttgacggctttgagaacaaggagtttaaaatacatctcgcgtacctcgccgacctgtttaagcatttgaatgaactgtctgcatcaatgcaaaggacgggtatgaacacagtgtccgcccgggaaaaactttccgcattcgtgaggaagtttcctttctggcagaaaagaattgagaaaaggaatttcaccaacttcccttttctcgaggagataatcgtgtccgacaacgaggggatcttcatagctgctgagatcactctgcatctgcaacagctctccaacttctttcacggttatttttcaatcggcgatcttaacgaggcgtctaaatggatcctggatccgttcctttttaatatagatttcgttgacgatagctacttaatgaagaatgatctcgccgaactgagggcttcaggccagatcctcatggagtttgaaacgatgaaactcgaggacttttggtgcgcacagttcactgccttccccaatttagcaaaaacggcattagagatcctgatgcctttcgctacaacatacttatgtgaacttggattctccagcctactgcactttaaaacaaaaagtcgatcttgcttcaacttaagcgacgacatccgcgtggccatttctaagaaagtgccacgcttctcagacattatcgaacagaaactgcagctgcaacagaagtccctctag

SEQ ID NO: 45678 - DNA, 1785 bp, Artificial Sequence
  Description of Artificial Sequence: Synthetic coding sequence
atgagcaagaagcggaagtgggacgacgactacgtgcggtactggtttacatgcacaaccgaggttgacggcacgcagcggccgcaatgtgttctatgcaactctgtgttttctaatgctgatttaagaccttcgaagttgagtgatcattttaatcggcaacacgggggtgtcgctggccacgacctgaattcgctcaaacatatgcccgccccttctgatcagagtgagacacttaaggcattcggtgtggcgtcccatgaagacaccctgctacaggcctcgtaccaatttgcctatctatgcgctaaggagaaaaatccacacactgtggctgagaaactggtgaaaccatgtgctctggaaattgcgcaaatagtcttaggcccagatgctcagaaaaaactgcagcaggttcccttaagcgacgatgtcatacattctcgtatcgacgaaatgagccaggatatcttgcaacaggtacttgaagacatcaaggctagtcctctcaaagttggcatccagctggccgaaactacagacatggacgattgctctcagttgatggcgttcgtgaggtacattaaagagcgcgagattgttgaagaatttctgttctgcgagccgctccagttgagcatgaaggggattgacgttttcaatctctttcgggatttctttctgaaacacaagatcgccttagacgtgtgcgggagcgtttgtacggacggggcctcctcaatgctaggtgaaaatagcgagtttgtggcgtatgtcaaaaaagagatcccacacatcgtggtcactcattgtctactgaaccctcatgctctggtgatcaaaacactccctacgaagctcagggacgccctttttacggttgtgcgggttattaacttcatcaaagggcgggcacccaaccatcggctgtttcaagcctttttcgaagaaattggaatcgagtactccgtgctcttatttcacactgaaatgcggtggctttctcgtgggcagatacttacgcatatctttgaaatgtacgaggagatcaaccagttcttgcaccataagtcatccaacttggtggacggattcgaaaacaaggaatttaagatacacttagcctacctggctgacctgttcaaacatttgaatgaacttagcgcaagtatgcaacgcaccggtatgaataccgtgagcgcccgggaaaaactatcggcattcgtgcgcaaatttcccttctggcagaagcgcattgagaagagaaactttaccaatttcccattccttgaggagatcatagtgagtgataacgagggaatttttattgctgccgagatcacactacacctccagcagctgtcaaatttttttcacggatacttctctattggcgatctaaacgaggcttcaaagtggatattggatccttttctgtttaacattgactttgtggatgacagttacctcatgaagaatgacctcgcggaactgagggccagcggccagatcctgatggaattcgagacaatgaaattggaggacttctggtgtgctcagtttacagccttccccaacctggctaagaccgctctagagatactgatgcctttcgcaacaacttacctgtgcgagttaggctttagcagcctgctgcactttaaaacaaagagccgttcttgctttaatctttcagatgatatacgggttgcaatcagcaagaaggtgccgagattctcggatattattgagcagaagctgcaacttcagcagaaatcattatag

SEQ ID NO: 45679 - DNA, 309 bp, Artificial Sequence
  Description of Artificial Sequence: Synthetic coding sequence
atgcgggagatcgccgagatcctgcccgcccaggagaaggtggaggctcgcatcgacctgaaaatggggaaaaagagggtaacggaccacaaattgaacgtggataaggtcattaagaacataaacacaatatcttctgagctgaagaaaattaaggagctctcacagttgttgctgtgcgatcttatcctccactttaatcatcctatcaaaacagagaatcttgcggaagccgaaagaaacaacccattattcgaggagtccaaaatttccgacgtatctttagtctctaattctttctctatctag

SEQ ID NO: 45680 - DNA, 309 bp, Artificial Sequence
  Description of Artificial Sequence: Synthetic coding sequence
atgcgggagatcgccgagatcctgcccgcccaggagaaggtggaggcgcgaattgacttgaagatgggaaagaagcgcgtgaccgaccacaaactgaacgtcgacaaggttattaaaaacatcaatacgatcagcagtgagctaaagaaaataaaagaactgtcacagctgctcctctgcgatttaattctgcacttcaatcacccaattaaaacagagaacctcgccgaagccgagcggaacaaccctctatttgaggagtccaagattagtgacgtctccctggtaagtaattctttctcaatctag

SEQ ID NO: 45681 - DNA, 834 bp, Artificial Sequence
  Description of Artificial Sequence: Synthetic coding sequence
atgccccgggcccagctgcccgaggacagcagcgccgtggacatggacattttatttcccctggatagcgttatcggtaccgaactctgtccctctcccattcctcagattatccactttgtcttatttgtcgtgttttccctggtgattctgattatactgaggctttacatcccgcgggaaccctcctctgtgccacccagggaagaagacagcgaaaatgaccaggctgaagtcggcgagtggttgagaattggcaataaatacatcacactcaaggattaccggattcttctgaaggaacttgagaatctggagatttacacttttctgagtaagaagtgtctaaagaagctgtctcgggaaggcagcagtcatcaccttccgcggcaggtcaggccaggtccagtgtataagcctgccccggctcggaatcacagaccccgcgggggtagaggcaaagcaagccctacttccttccacgtgtctcctcgcgcaccgcttgctccccttgcctctatgccgagctcagtgcctaagacaagcgttgagtcccttgggagtccctcatctctgtcttcttccaaacccagggaaccactgtgccccctgaaacatccgtctcaccagcccccagccagcaccctcagccctaaccccaccagttccacagaaagcctgggtgaaacgccgcacgccgggagatggcgacagggttcccgtttcccacagcccggctgtgcgaacgctgccggccgcatccgccatcaaaaccccaggcattcgcatgggcaccgcatttcagacatccacgaacagctgggcataagctag

SEQ ID NO: 45682 - DNA, 348 bp, Artificial Sequence
  Description of Artificial Sequence: Synthetic coding sequence
atgctgtggttccagggcaacagcatgcagctggcccggagcagcttcggtctctttttacggaactgtagtgctagcaagactacactccccgttctcaccttgttcaccaaagacccatgtccgctttgcgacgaggccaaagaagtcctgaaaccctatgaaaacaggtttattttacaggaggtgaacatcacccttccagaaaattctgtctggtatgagaggtataaatttgacatcccagtgtttcacctgaatggccagtttctgatgatgcatcgagtgaacacctcaaaactggagaagcagctattgaaactcgagcagcagtccaccggtggctag

SEQ ID NO: 45683 - DNA, 417 bp, Artificial Sequence
  Description of Artificial Sequence: Synthetic coding sequence
atgctgtggttccagggcaacagcatgcagctggcccggagcagctttggcctgttcctgagaaactgctcagcctcaaaaactacccttcctgtcctcacactatttaccaaagatccctgccctctgtgcgacgaagcaaaagaagtcttgaaaccttacgagaatcggcaaccatataaggaccagaagcttcctggtacaagacgccggcggagtccctcctctcccagccatccccacatggcctcccaatctggaaagcgatataacttaactttgaaccaagtgctgtccttcgattacgacatgggattggatgctccaaagactatcagttccgactgcggcgccttctactgcctgcggatgtttaagtcacctgacatgacgtgctgtttctatcctaagcaatag

SEQ ID NO: 45684 - DNA, 3048 bp, Artificial Sequence
  Description of Artificial Sequence: Synthetic coding sequence
atgctgaccgccctggccccccccgccctgcccggcatcccccggcaactgcctacagcaccagccagaagacaggatagtagcggctcttcaggatcttactacaccgcccctggctcccctgagcccccagacgttggtcctgacgctaaaggacccgcaaactggccatgggtcgctccaggccgcggagctggcgcccagccgagactatcagtctccgcacagaattccaggcagcggcacggacccggtagtggattcccgaggggtcccgggagcgggccgcggcctccccagccgcaactgcgaactctccccagcggcgagatggaggtgatcttcggtgtcggcccattattcggctgcagtggggctgacgatcgcgaagcacaacagcagtttaccgagccggctttcataagtcccctcccgcccggaccagcttcacctgccgccgtccccagacagtcccaggtacctgacggtggttcccgatgggctacatatctggagcttcgcccaaggggcccatcccccgcagcccctgcccagtttgaatgtgtcgaggtggcactcgaagagggcgcagcgcctgctagacctaggaccgtgcccaagcgacagatagaactcagacccaggccacagagtccaccgcgcgccgccggcgcgccacggccacgcctcttgctgaggactggcagtttagacgagtccttgggaccactacaggctgccgccggattcgtccaaacagcgttagctcgcaaactgtcacccgaggcacctgcgccttccagtgccactttcggatctacaggccgatccgaacccgagacgagggaaaccgccagaagcacacacgtcgtgctggagaaagccaagagcagaccacttcgggtacgtgacaacagtgcccccgccaaggccccccgtccttggccctccctgagagaacgggccatccggcgtgacaagccagctcccgggactgagcctctggggcctgtctcttcctcgatttttctgcaatccgaggaaaagatccaagaagcgaggaagacacgcttcccccgggaagcacctgatagaacagttcaacgcgcacgatcacccccattcgagtgtaggataccatcagaggtcccatcacgcgcggtcaggccccggtctcccagccctcccagacagacacctaacggcgctgtgcggggtcctagatgtccgagccctcaaaacttgtctccttgggatcgaactactagacgcgtgagctcgccactctttcccgaggcatcatccgaatgggagaaccaaaaccctgccgtagaggaaactgtaagcaggcgatccccctccccaccaatcttatcacagtggaaccagtgcgttgctggcgagcgttcacctagcttggaagcgccttccttgtgggagatcccccacagtgccgttgcagatgcagtcgagccccgctcttcaccctcacccccggcattcttcccttgggaagcccctgaccgccctataggcacttggggaccctcaccccaggaaacatgggatcccatgggaccaggcagtagcatcgcctttacgcaggaggcacagaatggactcacccaggaggaattagcgcctcctacaccctccgctcctggtacacccgaacccaccgaaatgcaatcaccctctacccgggagatctccgaccttgccttcggcgggagccagcagtcgcctgaggtggccgcccctgagccgccgggaagtcatcccgtggggaccctcgatgcagataagtgcccagaggtgcttggccctggtgaggcggcgtcaggacggcctagaatggcgatccctcgacctagggatgtgcgcaaactggtgaagactacatacgcacctggcttccccgccggtgctcaggggtcgggcttaccagcaccacctgccgacccatgtggggaggaggggggtgagtctaagactcaggaacctccagcactgggacctcctgcccctgctcactacacctctgtgttcatcaaagatttccttccggtggtccctcacccatacgaacctcctgagccatcattcgataccgttgctagggacgcttcacagcctaacggcgtgctgcgcagaagggccgaaaacagtacagccaagccgttcaagcgtactgaaataaggctgccaggcgccctcgcactggggcgacgcccagaagtcacatcacgcgtccgcgctagggggccagggggggaaaatagagacgtggaggctcagagactggtacccgatggtgacgggcggaccagccctcttggtggcgcacgcagtagtagccaaaggtcccctgtggggcccgctggggtccgttctccgagaccaggatctcctcagatgcaggcatcacctagtccgggaattgcccctaagcccaagaccccgccgaccgccccggaacccgctgccgccgtgcaggccccactgccccgtgaaccactggcactggcaggcaggactgcacccgcccaacctcgcgctgccagcgccccccccactgataggagcccgcagagcccgagccagggcgctcgcagacagccaggtgctgcccccctcggcaaggtgctagttgacccagagtctggacgctattatttcgtggaggcacccagacagcctagactgcgggtgctctttgatcccgaatcaggtcagtacgtggaggtgctgctgcccccatctagcccaggacctccccatcgggtgtacacccccttggccctgggacttggactctaccctccagcctacggtcccataccatccctctctttgcctccaagtcctggccctcaggctctgggctctcctcagctgccgtgggtgtccgaagccggacccctcgacgggacctactacctcccagttagtgggacgcctaatccagctccccctttgctgctgtgcgcaccaccgtcctcaagcgggcctacgcagcccgggaaggggtccctgtttcctctgtag

SEQ ID NO: 45685 - DNA, 1689 bp, Artificial Sequence
  Description of Artificial Sequence: Synthetic coding sequence
atgaccgtgctggagatcaccctggccgtgatcctgaccctgctgggcctggccatacttgccattttgctgacccggtgggcaagacgcaagcaatctgagatgtatatcagccgctatagcagcgagcagtctgcccgactcttggactacgaggatggtcgtgggtccaggcacgcctactctactcagagtgacacttcctatgacaatcgcgagaggtccaagcgggactacaccccttccaccaactcattggcgctctcaaggagctctatcgctctcccccaaggatcaatgtcttcaattaagtgcctacagaccaccgaggaaccaccttcccgcacagcaggagcaatgatgcagtttaccgcccctatacctggggctaccggcccaattaagctatcccagaagactattgtccagacgctgggccccattgtccagtatcctgggagcaatgtccgcagtcacccccatacgattaccggcccaccctccgcccccaggggcccccctatggcaccaatcatcatttcgcagaggaccgcgtctcagctcgctgccccaattaggatccctcaggtccacaccatggattccagtggcaaaatcacactgacgcctgtagtgatcctcacaggttacatggatgaggagctggccaaaaaaagttgctcaaagatccagattttaaaatgcggcggtacagcgcgaagccaaaattctcgcgaggagaataaagaggccctcaagaacgacatcattttcaccaactcagtcgagtccctgaaaagtgcccacataaaggagccagaacgcgaagggaaggggacagatcttgagaaagacaagattggcatggaggtcaaggtggattcagacgccggcatcccaaaaaggcaagaaactcaactaaaaatatctgagatgagcatcccgcagggccagggtgcacaaattaagaagtcagtgtctgacgttcctcgtggccaggaaagtcaagtgaagaagtctgagtcgggcgtaccaaagggacaggaagctcaagtgacgaagtccggcctggtcgtgctgaaaggccaggaggcacaggtggagaaatcagagatgggcgtgcctaggagacaagaatctcaggtgaagaaatcccagagcggcgtttccaaaggtcaggaggctcaggtcaagaaacgggagtctgtagtactcaaaggccaggaagctcaggtagagaaatccgaattgaaggtgcccaaaggtcaggagggccaggtggagaaaacagaggctgacgtgccaaaagagcaggaagtgcaagagaaaaaaagcgaagccggcgtccttaagggccccgagtcccaggttaaaaacacagaggtctccgtgcctgaaactctggagtcccaggtaaaaaaatcagaatcaggggtactgaagggccaggaggcccaggagaaaaaagaatcattcgaagacaaaggtaataatgataaagagaaggagcgcgacgccgagaaggatccaaataagaaggaaaaaggcgacaaaaacaccaagggcgataaaggcaaggataaggtcaaggggaaaagagaatcagagattaacggcgaaaagtcaaaggggtcaaaaagggcaaaggctaacaccggcagaaaatataacaaaaaagtggaagaatag

SEQ ID NO: 45686 - DNA, 1692 bp, Artificial Sequence
  Description of Artificial Sequence: Synthetic coding sequence
atgaccgtgctggagatcaccctggccgtgatcctgaccctgctggggctggcaattctcgccatcctgctgacaaggtgggcacggcgcaagcagtctgagatgtatatctcacgttattcgtctgagcagtccgctagattactggactatgaggacggtcgtggctctcggcacgcctatagtacgcagtcggatacaagctacgataaccgtgagcggtctaagcgggattatacgccgtccaccaactctttagtttcaatggcctccaagttctcattgggtcagacagagttaatactcctgcttatgtgttttatcttagcattatccaggagctcgattgggagcatcaagtgcctgcaaactaccgaggagccacctagcagaacagccggcgcgatgatgcagttcaccgccccaatccctggagctactgggccaatcaagctcagccagaagacgatcgtgcagactctgggcccaatcgtacagtatccaggctccaacgctggtccccccagtgctcctcgcgggccgcccatggcacccatcataatttcccagcgcacggcacgcattccacaggttcacaccatggactcatccggcaaaattacactgacccccgtagtcatactgactggctatatggatgaagagcttgcaaagaagagttgcagtaagatccagattcttaagtgcggaggcactgccaggtcccagaatagtcgggaggaaaataaagaagccctcaagaatgacatcatatttaccaactctgtcgagtccctgaagtcagcacacattaaagagccggagcgcgagggaaaaggcacggacctcgagaaagacaagattgggatggaggtcaaggtggacagcgatgccggtatccctaagagacaggagacccagctgaaaatttcagaaatgtccatcccacaaggtcagggtgctcagatcaagaagagtgtgagcgacgttcctagaggtcaggagtctcaagtgaaaaaatctgagagcggcgtgcccaagggacaggaggcacaggttaccaagagcggacttgtcgtcctgaaaggccaggaagcacaggtggagaagagcgaaatgggggtgccgagacggcaagagagtcaggtgaaaaagtcacagagtggggtgagtaagggtcaggaagctcaggttaagaagcgggagagcgtggttttgaaggggcaggaggcccaggtcgaaaaatccgagctcaaggtcccgaaggggcaagaaggacaagtggagaaaacggaagccgatgtgccaaaggagcaggaggttcaggagaaaaaatccgaggcgggagtgcttaaaggaccagagtcacaggttaaaaacaccgaggtgtccgtgcctgagactttagagtctcaggttaagaaaagtgaatctggtgtgcttaaggggcaggaggctcaggaaaaaaaagaaagctttgaggacaaggggaacaatgacaaagaaaaagagcgagatgccgagaaggatccaaataaaaaggagaaaggtgacaagaacacgaagggtgacaaaggtaaagataaggttaaggggaagagagaatcagaaattaacggcgagaaatcgaagggctccaaacgtgcaaaggctaacactggccggaagtacaacaaaaaagtagaggaatag

SEQ ID NO: 45687 - DNA, 582 bp, Artificial Sequence
  Description of Artificial Sequence: Synthetic coding sequence
atgaccgtgctggagatcaccctggccgtgatcctgaccctgctgggattggccattctggcaatcctgttgacccgatgggccagacggaagcagagcgagatgcacatctcacgttactcaagcgaacagtcagcccggctccttgattacgaggatggacggggctctcggcacgcttactccacccaatctgatacgtcgtgtgacaaccgggaaaggtctaaacgcgactatacaccatccactaatagtttagtgagcatggcgtcaaaattctcactcgggcagactgagctcatactcctgctaatgtgtttcattctcgctctttctagatcctcgatcggcagtattaagtgcctccagactacagaagaattaccatcaagaaccgcaggagctatgatgcagttcaccgccccaatcccgggcgctacagggcccattaagttaagccagaagacaatcgtccaaactcctggaccaatcgtccaatatcctggccccaatgcaggtcccccctccgcaccgaggggccctccgatggcccccattataataagccagcgtacagcctag

SEQ ID NO: 45688 - DNA, 579 bp, Artificial Sequence
  Description of Artificial Sequence: Synthetic coding sequence
atgaccgtgctggagatcaccctggccgtgatcctgaccctgctgggcctcgctatcctggctattttgctaacccgatgggcgagaaggaagcaatctgagatgcatattagtaggtactcaagcgagcagtctgctcgccttctggactacgaagacgggagaggaagcaggcacgcttattcgactcagtcagacactagctgcgataaccgtgaacgatccaagcgggattataccccctccactaactctcttgccctcagcagaagttctattgccctgccacaagggagcatgtctagcatcaaatgtttgcaaactactgaagagctgccttccagaactgcgggggcgatgatgcagttcaccgcacctataccaggcgccacagggcccatcaaattatcccaaaagaccatcgtccagaccccgggtccgatcgttcagtatcccggccccaatgtacgttcacatccacatacaatcacaggaccgccatctgctcctagaggcccacccatggctcctattattatcagccaacgaaccgccagccagcttgctgctccgatttag

SEQ ID NO: 45689 - DNA, 579 bp, Artificial Sequence
  Description of Artificial Sequence: Synthetic coding sequence
atgaccgtgctggagatcaccctggccgtgatcctgaccctgctgggactcgcgatccttgcaattttgctgactaggtgggctcgacggaagcagtctgaaatgcacatcagccggtactcaagcgaacaaagcgcccggttgctggactacgaagacggtcgcgggagccggcacgcctacagtacccagtccgatacatcctgcgataatcgggagagatccaaaagagactatacacccagcacaaactccctggcactatcaaggtcatcaatcgccctgccccaaggcagcatgtccagcatcaagtgcctgcaaactacagaagagcttcctagcagaacagccggggccatgatgcagtttaccgctcctatcccaggggcgaccggccctatcaagctctcccagaagacaatcgtgcaaacccctggacctatcgtgcagtaccccggacctaatgtcagaagtcaccctcatactattactggtcccccttctgcaccaagggggccccctatggctcctatcatcatttcgcaacgcacggcctcgcagctggccgcaccaatatag

SEQ ID NO: 45690 - DNA, 1689 bp, Artificial Sequence
  Description of Artificial Sequence: Synthetic coding sequence
atgaccgtgctggagatcaccctggccgtgatcctgaccctgctgggtctggcaatcttggctattctgctaaccaggtgggctcggaggaagcaatccgaaatgtacatctccagatatagtagcgagcaatcagcccgattattagattatgaggatggtcggggaagccgccacgcctatagtacccagtcagacacctcgtatgataatagagaaaggagtaaacgtgattatactccctcaaccaacagtctcgctctcagccggagctcaatagctctgccacagggatcgatgtcctctatcaagtgcctgcaaaccacagaggagccaccgtcacggaccgccggagcaatgatgcagttcactgcaccaattccaggggcaaccggaccgatcaagctgagccaaaagaccattgtccagacgctcggccccatcgtgcagtacccaggcagcaatgtgagatcgcacccccataccatcactggccctccatctgcccctaggggtccccctatggcgccaatcatcattagccagagaaccgccagccaactggccgcgcctatccggatcccacaggtgcacacaatggattcttccggaaagatcacactgacaccggtggttatactgacaggctacatggacgaggagctagccaagaagagctgttctaaaatacagattcttaagtgcggcggaacggctcgctctcagaattcaagagaagagaataaggaagccctgaaaaacgatatcatctttactaattcggtcgagtctcttaagagcgctcatatcaaagaaccagagcgagagggcaagggcaccgatctcgaaaaagacaagattggaatggaagttaaagtggactccgacgcagggatacctaaacggcaagaaactcaactgaaaatctccgagatgtctgttccccagggtcaaggcgcacagataaaaaagtctgtgtctgacgttccaaggggccaggaatcccaggtgaaaaaatccgaaagtggcgtgccaaaaggccaggaagcccaagtcactaagtcaggactggttgtgttgaagggacaggaggcccaggtggaaaaaagcgaaatgggagttccccgcaggcaggaaagccaggtcaaaaaatcacagtcgggcgtctctaaagggcaggaagcccaggtcaagaaacgggaatcagtagtactcaaagggcaagaggctcaggttgaaaagtctgagttaaaggtgcctaagggtcaggaggggcaggttgagaagacagaggccgacgtccctaaggaacaggaggtgcaagagaaaaaaagcgaagccggcgtgctgaaaggtccagagagtcaggtgaaaaacacagaagtgagtgtcccagagaccctggagtcgcaggtcaagaagtcggaatccggtgtccttaaaggccaggaagcacaggaaaaaaaggaatcatttgaggacaaaggaaataacgacaaagagaaggagcgggatgcagagaaagatccgaacaagaaggagaagggagacaaaaacaccaaaggggacaaaggtaaggacaaggtgaagggcaagagagagtccgagatcaacggcgagaagtccaaaggctctaaaagggctaaggctaacactggcaggaagtataacaaaaaggtggaggaatag

SEQ ID NO: 45691 - DNA, 582 bp, Artificial Sequence
  Description of Artificial Sequence: Synthetic coding sequence
atgaccgtgctggagatcaccctggccgtgatcctgaccctgctgggcctggctattttagctatcctcctaacgagatgggcaaggcgcaagcaatctgaaatgcacatctctcgctattcatcggagcagagcgcgcggcttctggactacgaggacggcaggggctctcgccatgcctactccacacagtccgacactagctgtgacaatagggagaggtcgaaacgagactacacacctagcactaattccttggtgtctatggctagtaagttttcactggggcagacggaactcatactacttctaatgtgtttcatcctggctctgtcacggtcaagcattggctctattaaatgcctgcaaacgactgaagagctgccctcaagaaccgcaggagcaatgatgcaattcactgctccaatccctggagccactggtccgatcaagctgagtcaaaagactattgtgcagacgcccggaccgatcgttcagtacccaggccccaacgccggacccccaagtgcccccaggggccctcccatggctccgataattatatctcagcgaactgcgtag

SEQ ID NO: 45692 - DNA, 1689 bp, Artificial Sequence
  Description of Artificial Sequence: Synthetic coding sequence
atgaccgtgctggagatcaccctggccgtgatcctgaccctgctgggtctggccatcttagctatcctgctgacaaggtgggcgcgaagaaagcagtcggaaatgtatatttcccgatacagtagcgagcagtcagcacgcctacttgattacgaggatggcagaggctcgcgtcatgcctacagtactcagtcagatacctcatatgataatcgcgagcgcagtaagcgggattataccccatcaactaattctttggctctctctcgttcctccatcgctctgcctcagggctctatgagctctattaagtgtctgcagactacggaggaaccgcctagtcggactgcaggcgcgatgatgcagttcaccgcacccatccccggagctaccggcccgtttaagctttcacagaagacgattgtgcaaaccctcggtcccatcgtgcaataccctggttctaacgtccgttcacatccccacactataaccggcccaccctcagcacctcgaggccctcccatggctccgattatcattagtcagcgcaccgcatctcagctggctgctccgatccgaatcccccaggtgcatacaatggatagctcaggcaaaattactctgacacctgtggtgatactcactggatatatggacgaggaactggcaaaaaagtcttgctccaaaatccagatactcaaatgcggcggaactgcccgttctcaaaactcccgggaggagaataaagaagccctgaaaaatgacatcattttcaccaacagcgtcgagagcctcaaatcagcgcacatcaaggaaccagagcgtgagggaaaggggaccgatctggaaaaggacaagataggaatggaggtgaaagttgatagtgatgccggcatccccaagagacaggagactcagttaaagatctcagagatgagcgtgccccaaggccagggggcccaaatcaaaaaatctgttagcgatgttccaagagggcaggaaagccaggtcaaaaagtccgagagcggcgtaccaaaagggcaggaggcacaggtgacaaagtccggactggtcgtcctgaagggccaggaggcacaggtggagaaatcggaaatgggcgtgcccaggaggcaggagagtcaagtcaaaaagtcccaatccggcgtgagcaaagggcaggaggctcaagtaaagcagagagagtcagtcgtgctcaagggccaggaggctcaggttgagaagtcagagctgaaagtacctaagggacaggaggggcaggtggagaaaaccgaagcggacgtgccgaaggaacaagaagtccaggaaaagaaatccgaggccggggtgttgaagggccccgagtctcaggtgaagaatacggaggttagtgttccggaaaccctggagtctcaagtgaaaaagagcgagtcgggtgttctgaagggccaggaggcgcaggagaaaaaagaaagttttgaagataagggcaacaatgataaagaaaaggaacgcgacgctgagaaagatccgaataaaaaggagaagggcgataagaatactaagggcgataaaggtaaggataaggttaaggggaagagggaatcggagatcaacggggagaagtcgaaaggttcaaaacgcgcaaaagctaatacaggaagaaaatacaataagaaggtcgaggaatag

SEQ ID NO: 45693 - DNA, 1692 bp, Artificial Sequence
  Description of Artificial Sequence: Synthetic coding sequence
atgaccgtgctggagatcaccctggccgtgatcctgaccctgctgggactcgccattctggccatcctgttgacccgctgggctcgccggaagcagtctgagatgtatatctccagatactcttccgagcagagtgccaggctcctggactatgaagatggtcgggggagtcgccatgcctactccactcagtcggacaccagctacgataacagagaaaggtctaaaagagactacactccgtctaccaattctttagtcagcatggcctccaagtttagcctgggccagacggagttgatcctgctgctgatgtgtttcatcctggctttgtccagatctagcattggtagtatcaaatgcttgcaaacaaccgaagaacccccctccaggaccgctggagcgatgatgcagttcacagcacccatacctggggccaccggacctataaaactatcccagaagactattgttcagacactggggcctatcgttcagtaccctgggagtaatgccgggccacctagcgcgcctcgcggtccaccaatggcacctataatcatctcgcaaaggaccgcacgcatcccccaggtacatactatggactcctccgggaaaatcacgctcacccccgtcgtcattctgacaggttacatggacgaggagctggccaaaaaatcttgctcaaagatacagatcttgaagtgtggaggaaccgctaggtcacagaattccagggaagaaaacaaggaagctctgaagaatgatatcatttttaccaactctgtggagagcttgaaatcggcccatattaaggaaccagagcgtgagggcaaagggacagatctggaaaaggataagattggtatggaggttaaagtcgactctgatgccggcatacccaaacggcaggagacccaactaaagattagtgaaatgagcgtgcctcaaggacagggtgctcagattaagaaatcagtttcggacgtgcctcggggtcaagaaagccaggtgaaaaagagcgagtcgggagttcccaaggggcaggaagcacaggtcaccaagtctgggctcgttgtccttaagggccaggaagcccaggttgagaagtcagaaatgggggtcccacgaaggcaggagtcccaagtcaaaaaatctcagtctggcgtctctaagggccaggaggcacaggtcaagaaacgggagagcgtcgtactcaaaggccaggaggcacaggttgaaaagtccgaactgaaggtgccaaagggccaggaaggacaggtggaaaagaccgaggcagacgtccccaaggagcaggaagtgcaggagaaaaaatctgaggccggggttctgaaaggacctgaaagccaggtgaaaaatactgaagttagtgtcccggagacactggagagtcaggtcaagaagagcgagtcaggcgtgctaaaaggccaagaagcccaggaaaagaaggaatcttttgaggacaaaggaaacaacgataaggagaaagagcgggacgcggagaaggaccctaataagaaagagaagggcgacaaaaacaccaagggtgacaagggtaaggataaggtgaaggggaagagagagtcagagattaacggtgagaagtccaagggaagcaaacgcgccaaagctaatactgggagaaagtataataaaaaggtggaagagtag

SEQ ID NO: 45694 - DNA, 1692 bp, Artificial Sequence
  Description of Artificial Sequence: Synthetic coding sequence
atgaccgtgctggagatcaccctggccgtgatcctgaccctgctgggcctggctattctcgcaattctactcacacgatgggcacgaagaaagcagtctgagatgtatatctcccgctattcctccgaacagagcgcccgacttttggattacgaggacggcagggggagccggcatgcctattccactcagtccgatactagttatgacaaccgcgagaggagtaagagggactatactccatccacgaactcattagtttctatggccagcaagttctcccttggccagactgaactcatactccttctgatgtgctttattctcgccctgagccgctcctccatcggcagcattaagtgtctgcagacaacggaggaacctccatcccgcaccgctggggccatgatgcagttcactgcccctatccccggagccaccgggccctttaaactgtctcagaagaccatcgtccagacccttgggcccattgtgcaatatccgggcagcaatgcagggccaccctcagctcctagggggcctcctatggctcccattataatctcccagcggacggctcggattccacaggtgcataccatggactcatccgggaagatcactctgacaccggtcgtcatcttaaccggttacatggacgaggaacttgcgaaaaagagctgctctaagattcagatccttaaatgcggtggcaccgcccgaagccaaaacagccgagaggaaaataaggaggccttaaagaatgatataatctttaccaacagcgtggagtctctcaaaagcgcgcacattaaagagccagagagggagggaaaaggtaccgatctcgaaaaggacaagatcggtatggaggttaaagtagattcggacgccggtatcccaaagcggcaagagactcagctgaagatcagtgagatgagcgtacctcaggggcagggggctcagataaaaaagagtgtgagtgacgtgccccgcggtcaagagagccaggtcaagaaatccgagagtggagttcccaagggccaggaagcacaggtaacgaagtccggtttggtggtcctgaaggggcaggaagcacaggtggaaaagtccgaaatgggagttcctcgccgacaggagtcccaggtgaagaagtctcaatccggagtcagcaaaggacaggaagctcaggttaaacaaagggagtccgtggtgctgaaggggcaggaagcccaagtggagaaatctgagttgaaggtgccaaagggccaggaaggccaggtggagaaaaccgaggctgatgttcctaaggaacaagaggtacaggagaagaaaagtgaagcgggggttctgaagggacccgaaagtcaagtgaagaacacagaagtgagcgtaccagagacgctggaatcgcaggtcaagaaaagcgaatctggggtcctgaaaggccaggaggctcaggaaaaaaaggagtcttttgaagacaaaggcaacaacgacaaggaaaaggaacgggatgcagaaaaggaccccaataagaaggagaaaggggacaagaacacgaagggagataagggaaaagacaaggtgaagggcaagcgagaatccgagatcaatggagagaaatctaaaggctcaaagagggcgaaagccaacaccgggcggaagtacaacaagaaggtggaggagtag

SEQ ID NO: 45695 - DNA, 1689 bp, Artificial Sequence
  Description of Artificial Sequence: Synthetic coding sequence
atgaccgtgctggagatcaccctggccgtgatcctgaccctgctgggattggcgatcctggctattctgttaacaaggtgggcccggcggaaacagagcgagatgcacatctctcgctactcctccgagcagtctgcccgcctgctggattatgaggatggaagagggtctcgccacgcgtactcaacgcagtccgacacgtcctgcgacaatcgggagcgtagtaaaagagactacacaccgtccactaactcattggccttatctaggtcttctatcgcacttccacagggatccatgagcagcatcaagtgcctacagacaaccgaagaactgccatccagaaccgccggtgctatgatgcaatttacagccccaattccaggggccacaggtccaatcaaattatcacagaaaactattgtacagacaccgggtccaatagtccagtatcctggtcccaatgtacggagccatcctcacaccatcaccggacccccttctgctcccaggggcccacctatggctcctattattatttcccagcgtacagcaagtcagctggctgccccaattcgcattccccaggttcacacgatggattcctccgggaaaatcactttaacacctgtggtgattctcaccggctacatggatgaagagctggccaaaaagccatgctccaaaattcaaatacttaagtgtggcggcaccgctcggtcacagaattcgcgagaggagaataaggaggccctgaagaacgacattatcttcaccaactctgtcgagtccctgaagtctgcccatatcaaagaaccggagcgggagggaaaagggacagacttggagaaagataagatcggcatggaagttaaggtagattctgacgctggtataccgaaacgacaagagacccaactgaagatctctgaaatgtctatacctcaaggccaaggtgcccagattaagaagtccgtgagcgacgtccccagggggcaggaaagccaggtcaagaagtccgaaagcggggtgcctaagggccaggaggctcaagtgacgaaatccggactggtggtccttaagggccaggaggctcaggttgagaagagtgaaatgggggtgcccagacgtcaggaaagccaagtgaagaagagccagtctggagtgagcaaaggccaggaagctcaggtaaagaagcgagagagcgttgtgctgaaaggacaggaggcccaagttgagaaatctgagttgaaggtgcccaaaggccaggaaggccaggtggagaagactgaggcagatgttcccaaagagcaggaagtccaagagaaaaagtcagaggcaggagtccttaaggggcccgagtcacaggttaaaaataccgaggtctctgtccctgaaacactggaatcccaagtgaagaaatcagaatctggggtgttgaaggggcaggaggcacaggaaaagaaggaaagcttcgaagataaggggaacaatgacaaggagaaggagcgcgacgccgagaaggaccccaataaaaaggagaaaggggacaaaaacacgaagggagataaggggaaagacaaggtaaaggggaaaagagagtccgagataaacggggaaaagtccaaggggtccaagcgggcaaaggctaataccggtcggaagtacaacaagaaggtggaagagtag

SEQ ID NO: 45696 - DNA, 1692 bp, Artificial Sequence
  Description of Artificial Sequence: Synthetic coding sequence
atgaccgtgctggagatcaccctggccgtgatcctgaccctgctgggactggctatcctggcaatccttttaacccgctgggccaggcgaaagcagtcagaaatgcacatttctcgctatagttccgagcaaagcgcacggttactggactatgaggatggacggggttctaggcacgcctacagtactcaatcagacacttcttgtgataacagggagcgctctaagcgagactatacaccttcaactaacagtctcgtgagcatggcgtctaagttttctttaggccagaccgagctgatcttgctgcttatgtgctttattttagccctgtcaaggtcttcaattgggtcaatcaaatgcttacagactacagaggaactaccttcacgcactgccggtgccatgatgcagtttacggcaccaatcccgggcgccacaggccccatcaagctttcccagaaaaccattgtgcagacacccggccccattgtacagtatccaggcccaaatgcgggacccccctcagcacccagaggccctccaatggctccaataataatctcccagcgcacagcaaggattccccaggtccacactatggactcttctggaaagatcacactgacccccgtagttattctcacaggatacatggatgaggagttggcgaagaaaccatgcagtaagattcagattctgaagtgcggcgggaccgctagatcgcagaattctcgtgaagagaataaagaggcccttaaaaacgatatcatttttaccaacagcgtagagtcactgaagtccgctcacattaaggagcctgaacgagaaggtaaaggcaccgacctcgagaaagacaaaatcgggatggaggtgaaagtagatagcgatgcagggatccctaagagacaggaaactcagttgaaaatcagcgagatgtccattccacaggggcagggcgcccagatcaagaagtccgtgtccgacgtgccgcgcggtcaagagtcccaggtaaaaaagagcgagagtggcgttcccaagggccaggaggcacaggtgaccaaaagcgggctggttgtgctgaagggtcaagaggcacaggtggaaaagtctgaaatgggggtgccccgacgtcaggagagccaggttaaaaagtcccagtcaggggtctctaaggggcaggaagcccaggtgaaaaagagagaatcagttgttctgaaaggtcaggaagcacaggtcgaaaaatccgagctgaaggtcccaaagggacaggaggggcaggtggaaaagacagaggccgacgtgcctaaagagcaggaagtgcaagagaagaagagtgaagctggagtgctgaagggcccggaaagccaggtgaaaaacactgaggtctccgtacccgagacgttagaatcacaggttaagaagtcggagtcaggagtgctcaagggacaagaagctcaggagaaaaaagagagttttgaagataagggaaacaatgacaaagaaaaggaacgcgacgcagagaaggacccaaacaagaaggaaaagggggacaagaacacaaagggggataagggcaaggacaaagtcaaggggaagagagagtctgagatcaatggagagaaaagcaagggcagtaagagggccaaagcaaatacgggacggaagtataataaaaaggtcgaagagtag

SEQ ID NO: 45697 - DNA, 1644 bp, Artificial Sequence
  Description of Artificial Sequence: Synthetic coding sequence
atgaccgtgctggagatcaccctggccgtgatcctgaccctgctgggactcgcaattttggcaatcctcctgacgcgttgggctcgccgcaagcaatctgaaatgcacatttctagatacagtagcgaacagtcagctagactactagactacgaagatggccgtgggtcacgccacgcctattcgacacaaagcgaacgctctaagagagactacacaccatctactaatagtctggctctctcaaggtcgtcaattgcattaccccagggctcaatgagctcaattaagtgcctccagacaaccgaggaactaccctcccgcacggccggtgcaatgatgcagtttaccgctcccattcccggggccactggccccatcaagctcagccagaaaaccatcgtacagacacccggcccaattgttcagtatcctggtccaaacgcaggaccaccaagcgctcctcgtggccccccaatggcgcccattataatcagtcagagaacagccagccagttagctgcaccgatcaggattccgcaggtccacacaatggactccagcggcaagataacactcactccggtagtgattcttaccggctacatggacgaagaactcgcaaaaaagccttgttccaagatacagatcttaaaatgtggcggaactgctcggtcccagaactctcgtgaggagaacaaggaagccttaaaaaatgacatcatcttcacaaacagcgtcgagtctctgaagtctgcacatattaaggaacctgagcgggaaggcaagggtactgatctggagaaggataaaattggaatggaagtcaaagtcgacagcgacgccggcataccaaagcgtcaggaaacccagctcaagatatccgagatgagtattccgcagggccagggtgcacagattaaaaaatccgtaagcgatgtgcctagaggacaagaaagtcaagtcaagaaaagcgagtcgggtgtgcctaaagggcaggaggcgcaggtaaccaaatcagggctggttgttttgaaggggcaggaggcacaagtggagaaatctgagatgggagtaccaagacgtcaggagtcccaggtgaagaaatcacagagcggcgtttcaaaaggccaggaggcacaggtaaagaaacgggagagcgtcgttctcaaaggacaggaagcccaggtcgagaaaagcgagctgaaggttccaaagggtcaggagggccaggtagagaagacagaggccgatgtgcccaaggaacaggaagtgcaggaaaaaaagagcgaggcaggtgtgctaaaagggcctgagtcccaagttaagaacacagaagtttccgttcccgaaactctggagtcccaggtgaaaaagtccgaatcgggggtgttgaagggccaggaagctcaggagaaaaaagagagtttcgaggacaaaggaaacaacgacaaggagaaggagcgggacgcagagaaagatccaaataaaaaggaaaaaggagataaaaatacgaagggggataaagggaaggacaaagtgaaaggcaagcgtgagtctgaaattaacggtgaaaagtccaagggctccaaaagagcaaaggctaatacaggacgcaagtacaataagaaggtcgaggagtag

SEQ ID NO: 45698 - DNA, 189 bp, Artificial Sequence
  Description of Artificial Sequence: Synthetic coding sequence
atgctgcaggtggtgcaggagggcaaccccgcccccttcatcatcaacacagtcaaaagaggcaggagagacagagaaaggcagaggaccccatgggcacctcatccactcgggttccaaggcaggcgctatatctacgagtccccaaatcaccggggaaaagacagtagtttcctggcccagaaatag

SEQ ID NO: 45699 - DNA, 189 bp, Artificial Sequence
  Description of Artificial Sequence: Synthetic coding sequence
atgctgcaggtggtgcaggagggcaaccccgcccccttcatcatcaatacagttaaaaggggaaggcgagacagggagagacagcgcacaccctgggcccctcaccctctgggcttccaaggcagaaggtacatctatgagagccctaaccatcgaggaaaggacagcagctttttggctcagaagtag

SEQ ID NO: 45700 - DNA, 189 bp, Artificial Sequence
  Description of Artificial Sequence: Synthetic coding sequence
atgctgcaggtggtgcaggagggcaaccccgcccccttcatcatcaatacagtaaaaagagggcggagggatagggaacggcaacgaacaccttgggccccccatcctctcggctttcaagggcggcgctatatttacgaatctcctaatcaccggggtaaagactctagcttcctggcccagaagtag

SEQ ID NO: 45701 - DNA, 189 bp, Artificial Sequence
  Description of Artificial Sequence: Synthetic coding sequence
atgctgcaggtggtgcaggagggcaaccccgcccccttcatcatcaacactgtgaagcgtggaagacgcgatcgagaaaggcaacgcactccatgggcaccccatccacttggatttcaggagcggcgctacatatacgaatccccaaatcaccgggggaaagacagtagcttcctggcacagaagtag

SEQ ID NO: 45702 - DNA, 189 bp, Artificial Sequence
  Description of Artificial Sequence: Synthetic coding sequence
atgctgcaggtggtgcaggagggcaaccccgcccccttcatcatcaacaccgtgaaacgaggacgtcgtgaccgagagcggcagcgaaccccttgggcacctcacccactggggttccaggagcgtagatacatatatgaatcaccaaatcaccgaggaaaggacagcagcttcttggcccagaagtag

SEQ ID NO: 45703 - DNA, 189 bp, Artificial Sequence
  Description of Artificial Sequence: Synthetic coding sequence
atgctgcaggtggtgcaggagggcaaccccgcccccttcatcatcaataccgtgaagcggggaagaagagatagggagcgtcagcggactccctgggcaccacatccattgggattccaggaacgcaggtacatctacgagagccccaatcaccggggaaaagactcatcctttctggctcagaagtag

SEQ ID NO: 45704 - DNA, 708 bp, Artificial Sequence
  Description of Artificial Sequence: Synthetic coding sequence
atgcacgagcacgccacccccgtgaccagcgcctacggcgagcggcacgaagaactgatcaacctcgggtcacccgattctcatacaattagcgagggccagaagtccagtgtgacttcaaagaccacacgaaaggggaaggaaaagtcaagtgaaaaggaaaagactgctaaagagaagcaggctcctaggtttgagccccagatcagtaccgtgcacccccagcaggaggatcccaacaagccatattggatcttacgactcgtaacagaacacaacgagagcgagctcttcgaggtaaagaaagatacagagagggcagacgagatccgggcgatgaagcaggcatgggaaaccactgaacctggcagggctattaaagcttctcaggccagattacactacctgagtgggttcatcaagaagacgagcgacgcggagagtcctccaataagtgaaagtcaaacaaagcctaaggaagaggtcgagactgctgcccggggggtcaaagagcccaacagcaaaaacagtgcagggtctgagagtaaagaaatgacacagactggtagcggcagtgctgtgtggaagaagtggcaattgacaaaaggactccgggatgtagcaaagagtactagctccgagagcggcggggtcagctccccgggaaaggaagagcgggaacagtccactagaaaggagaatatctag

SEQ ID NO: 45705 - DNA, 2142 bp, Artificial Sequence
  Description of Artificial Sequence: Synthetic coding sequence
accgacgagcagaccgacttcggcctgggcgacgcccaccagagcgacggcctgaatttggagagggagattgtctcgcagactacagccacccaggaaaaatcacaagaagaactgccaacgacaaataactccgtcagcaaggagatctggctcgacttcgaggacttttgtgtctgcttccagaacatatatatttttcacaaaccaagttcatactgtctcaattttcaaaagtcagagttcaagtttagcgaagagagggtgtcttattatctgttcgtggattctctgaaaccaatcgaactgcttgtttgtttttccgccctcgtgcggtggggagagtatggagccctgacgaaggattctccacctattgaacccgggttgttgacagcagagacattttcatggaaatctctgaagccggggagtctggttctcaaaatccatacctacgccaccaaggccacagttgtgcgcctcccagtgggccgccacatgctgctctttaatgcatatagcccagtgggacatagtatacacatctgctctatggtgagtttcgtgatcggcgatgaacacgtcgtcctgccaaacttcgaaccagagagctgtcgctttaccgagcagtctcttctgattatgaaggctatcgggaacgttattgctaatttcaaagacaaaggaaaactgtctgccgccctgaaagatctgcagaccgcccattaccctgtcccattccacgacaaagagctgacggctcagcacttccgcgtattccacctttcgctgtggagactgatgaaaaaagtccaaatcactaaaccacctcctaactttaagtttgcctttagggctatggttctcgatctggaacttctaaactccagtctggaggaagtgagccttgtggaatggctcgatgtgaaatattgcatgccaacctccgataaggagtactccgcggaagaagttgcagccgccatcaagatccaggcaatgtggcggggcacatatgtgcgtcttctgatgaaggctcgcatcccagataccaaagagaatatctcagtggcagatactctccaaaaggtgtgggcagtgctcgagatgaacctggagcagtacgcagtgagcttgctccgactaatgtttaagtctaagtgtaaatccctggaatcctatccctgctaccaggacgaagagaccaaaatcgcttttgccgactacactgtgacataccaagagcaacccccaaattcttggttcattgtgttcagggaaacgttccttgtacaccaggacatgattctggtccctaaagtgtacaccacactgccaatttgcatcttgcacatagtgaataatgacacaatggaacaggttccgaaagttttccaaaaggtcgtgccttatttgtataccaaaaacaagaaaggatacactttcgtggctgaggctttcacaggggatacctacgtggcagcgagcagatggaagcttcggctgattgggtcttccgcccctctgccttgcctgtcaagggacagcccatgtaactcgtttgccataaaggaaattagggactattacatccccaacgataagaagatattgttcagatactctgtgaaggtgctgaccccacagcccgccacgatacaagtgagaacatccaagccagacgctttcatcaagctacaggtgttggagaatgaagagaccatggtctcgagcacagggaagggtcaggccattatccctgcttttcattttctgaagtccgaaaaaggactttccagccagagctacggtgaacgccacgaagaattgatcaacctggggtccccagattctcatactattagtgagggacagaaaagctctgtgacaagtaaaacaaccaggaaaggaaaagaaaagagctcagagaaagaaaaaacagccaaggaaaaacaggcccctagattcgagccgcagatctctacggtgcatcctcagcaagaggacccaaataaaccctattggattctccggttgctgcgcctagtctgtattaccctcgcgggcagcctgcgcaagcatcttatgttgcgcgttcgtctgtacctaaaagccaagttgaaccagaagaagaaatag

SEQ ID NO: 45706 - DNA, 5004 bp, Artificial Sequence
  Description of Artificial Sequence: Synthetic coding sequence
atggccagcaagcagaccaagaagaaggaggtgcaccggatcaactccgcccacggctcggacaagtccaaagacttttatccttttggctccaacgtgcaatccggctcaacagagcagaagaagggcaaatttccactgtggccagaatggagcgaagccgacataaattccgagaaatgggacgcgggaaagggtgcaaaggagaaagacaaaacaggaaagtctccggtgttccacttcttcgaagatcctgaaggcaaaattgaattgccaccctccctgaaaatatattcatggaaaagaccgcaggacattctttttagccagaccccagtggtcgtgaagaatgagatcaccttcgacctgttctccgccaatgaacatctgctttgcagcgagttgatgcgctggatcatatcagaaatatacgctgtgtggaagatctttaacgggggaatactctccaattatttcaaaggaacttccggcgagcccccccttttaccgtggaagccttgggagcacatctactcactgtgcaaagccgttaaggggcatatgccactcttcaatagttacggaaagtatgtggtaaaactgtactggatgggctgctggcgtaaaatcactatagacgacttcttgccattcgacgaggacaacaacctcctgctgcccgccactacctacgagttcgagctttggccaatgttgctgagcaaagctataattaaactggccaacatcgacattcatgtagccgatagacgtgagcttggagagtttactgtgatacacgctctgacaggttggctacccgaggtgatcagtctgcatccaggttatatggacaaggtctgggagctcctgaaagaaattttacctgaattcaagctgtccgatgaagcctcctcagaatcgaaaattgccgtattagattctaaattgaaagaacctggcaaggaggggaaggaaggtaaagaaataaaagatggcaaagaggttaaggacgtgaaagaattcaagcctgagtcttcactgactactctgaaggcgcctgagaagagcgataaggtgcccaaggaaaaagccgacgccagagatattggaaaaaagcgctcaaaagatggcgagaaggagaagtttaaattctctctgcacggaagtaggcctagttcagaggtccagtactcagtgcagagcctctctgattgttcaagtgccattcaaacttcccatatggtagtttacgctacattcacgcccttgtacttattcgagaacaaaatctttagcttagaaaagatggcggactcagctgagaagctcagagagtatggcctgagccatatttgctcacacccggtgctggtgacccgttcccggagctgtcccctggtggccccccctaagccaccgccgctcccaccgtggaaactgatcagacagaaaaaggaaaccgtcattaccgacgaggcccaggaactcatcgtgaaaaaacccgaacggttcttggagatttcaagtcccttcctgaactatcgcatgacccccttcacgatccctacagagatgcacttcgtgcgctcccttattaagaagggcatccctcctggttccgacctcccaagcgtgagcgaaacggacgagacagcaacgcactcacagacggatctttcgcaaattactaaggcgacttcccagggcaacacagcctcacaggtgattttaggaaaaggcaccgacgagcagaccgacttcggtcttggggatgctcaccagtctgacgggttgaaccttgagcgcgagattgtgtcccagactacagcaacccaggagaaaagtcaggaggagttaccaaccaccaacaattccgtaagcaaggagatctggttagatttcgaagatttttgcgtgtgcttccagaatatatacattttccataagccttcatcctattgtctgaatttccagaaatcagagtttaagttttcagaagagcgagttagttattacctgttcgtggatagcctgaaacctatcgaactactcgtgtgcttcagtgctctcgtgagatggggtgaatatggcgcattgaccaaggatagccctccgatcgagcccgggctactgactgccgaaactttctcctggaagtccctgaagcccgggagtctggtccttaagatacacacctacgctacgaaggccactgtggtgcggctaccggtaggaagacacatgttgcttttcaatgcctactctcctgtcggccactcaatccatatctgctcaatggtttccttcgtaattggcgacgagcacgtggtgcttcctaactttgaacccgagtcatgccgattcacggaacaaagtttgctgatcatgaaggcaatcggcaacgtcattgctaatttcaaagataaggggaagctgtcagccgcactgaaagatttgcagacagctcattatcccgtgcctttccacgacaaagagctaacggcccagcattttcgtgtcttccacctttccctttggagactcatgaagaaagtgcaaatcaccaagccacctccaaactttaagtttgcgtttcgggcgatggtgctggacttggaactactcaattcatcactagaagaagtcagtctggtagagtggctcgatgttaagtattgcatgcccacctccgacaaagagtattcggccgaggaagtagccgcagcgatcaagattcaggccatgtggaggggaacctatgtgaggctgcttatgaaggcaaggatccccgatacgaaggaaaatatatccgttgccgacacactgcaaaaggtgtgggctgtgctggagatgaacctcgaacagtatgccgtgtcattgctaaggctcatgtttaagagcaagtgcaaaagtctggaatcttacccatgttatcaggacgaggagacaaaaatcgcatttgccgactacacagtcacataccaagagcagcccccaaacagctggttcatcgtgtttagggagacctttttagtgcaccaggacatgatactggtgcccaaggtgtataccacgttgcctatctgcatcctgcacattgtcaataacgacactatggaacaagtccctaaagtgttccagaaggtggtaccctacttatataccaagaataaaaagggatataccttcgtggctgaggcctttactggagacacatatgttgctgcatcaagatggaagttgaggctgatagggtcctctgcccccctgccgtgtctaagccgagatagcccctgcaattctttcgccatcaaagagatcagggactactacatccccaacgataaaaagatcctgttccgctattccgtgaaggtcttgactccgcagccggcaactatccaggtgcggacctctaaacccgatgctttcataaagctccaggtactggaaaatgaggagacaatggtgtcgagtacagggaagggacaagccatcatccccgccttccactttttgaaatctgagaaaggactgtcaagccagtccagtaaacacatcttaagtttccatagcgcatccaaaaaggaacaggaagtgtacgtgaagaagaaagccgcccaggggattcagaagtctcccaagggtcgggccgtgagtgctattcaggatatcgggctgccacttgtcgaagaagaaaccaccagtacccccactcgtgaagattcttcaagtacaccactgcagaattataagtacatcatccaatgttctgttctatacaattcatggcccctgaccgagagccaactgacattcgtccaggccctgaaagacctgaaaaagtccaacacaaaagcttatggcgagcgccatgaggagttgatcaacctcggctccccagacagccatactatttctgaggggcagaagagctccgtgacttccaagaccactcgaaaaggcaaggagaagagtagcgaaaaggagaagaccgccaaggagaaacaggcccctaggtttgaaccacagatcagcaccgtgcacccacaacaagaggatcctaacaaaccttactggattctgcgcctcgtgacagaacataatgagagcgaacttttcgaggtaaaaaaagatactgagagagccgacgagatccgtgcgatgaagcaggcatgggagactacagaacctgggcgggccattaaagcctcacaggcccgcctgcactatctctccgggtttatcaaaaaaacatccgacgcagagtccccaccaattagtgaatcccagaccaaaccgaaggaagaggtcgagactgcagcgcgaggggttaaagaaccaaattcgaaaaacagtgcagggtcggagtctaaagagatgacccagactggaagcggaagcgctgtgtggaaaaagtggcaactgactaaagggctgcgggacgttgcgaaaagtacgtccagcgaatcaggtggtgtgagtagccctggtaaggaggagagagagcaatccacccgcaaagaaaacatccaaaccggccccagaacaagaagcccaactattttggagacgtccccgaggctaatccgtaaggctttggaattcatggacctatcacagtacgtgaggaagaccgataccgatccgctgctgcagaccgatgagcttaatcagcagcaggcaatgcagaaagctgaggagattcatcagtttcgacagcaccgcaccagagtcctctctattcggaacatagatcaagaggagcgcctgaaactgaaagacgaggtgctggatatgtacaaagagatgcaggatagcctcgacgaagctaggcagaaaattttcgacatccgggaggaatacaggaacaagcttctggaggccgagcacctgaagttagaaaccctggccgcccaagaagcagcaatgaaactggagaccgagaaaatgactcccgctccagacactcaaaagaaaaaaaagggcaagaaaaagtag

SEQ ID NO: 45707 - DNA, 153 bp, Artificial Sequence
  Description of Artificial Sequence: Synthetic coding sequence
atgctgcggagcaccttcaccgtgcactggaccaccatcctgggcatctgtcgccccattaagcccatatataagagccaagcctgccctctgtccgagaaacgaaatgctgacaatcacctggtctctgaagacaacaccttcaaagtgtag

SEQ ID NO: 45708 - DNA, 297 bp, Artificial Sequence
  Description of Artificial Sequence: Synthetic coding sequence
atgctgcggagcaccttcaccgtgcactggaccaccatcctgggcatttgccggcccatcaaaccaatctacaaatctcaggcttgccccctgtccgaaaaacggaacgccgataaccacctcgtgtcggaggacaatacattcaaagagcctgaacggtacatctcttctagctgcgttctgacatccatactatatctgggtgagaagacatttagcttccgcacgctgatcagcccgcgcggtatgaaactggttgaaatacttcagcagccgtcccttacaatggtggcttag

SEQ ID NO: 45709 - DNA, 246 bp, Artificial Sequence
  Description of Artificial Sequence: Synthetic coding sequence
atgaacgtggaccacgaggtgaacctgctggtggaggagatccacaggttgggctcaaagaatgcagacggaaagttgagtgtgaagtttggggttctgtttagagatgacaaatgtgctaatttgtttgaagcactagtcggtacactgaaggcagccaaaagaagaaaaatcgtgacataccccggcgaactgctcttgcagggcgtccatgatgacgtcgacatcattctcctccaggattag

SEQ ID NO: 45710 - DNA, 204 bp, Artificial Sequence
  Description of Artificial Sequence: Synthetic coding sequence
atgaacgtggaccacgaggtgaacctgctggtggaggagatccacagactgggttcaaaatccaagtatctgaccgagatcgaatattttagttggctatacctcggcactggagagactggcatgctggagaagccaatgaagggcagccccagagcaagcggccacaggtcaggcagtagtgcccactctccgaggctgtag

SEQ ID NO: 45711 - DNA, 1374 bp, Artificial Sequence
  Description of Artificial Sequence: Synthetic coding sequence
atggaccggagcctgcggaacgtgctggtggtgagcttcggcttcctactactgttcacggcatacggagggctccagtcactgcagagttcgctgtacagcgaggagggtctgggcgtgaccgctctttctaccctatatggaggcatgctccttagcagcatgttcctgcccccacttcttatcgagagactcgggtgtaaaggtactatcatcctgtccatgtgtgggtatgtggcgttctccgtgggcaatttttttgcgagttggtacaccctaatcccaacttcgattctgcttggtctaggcgcagccccactttggtccgctcagtgtacctatcttacgattacaggcaatactcatgcagagaaggccggaaaacgcggaaaagacatggtgaaccagtatttcggcattttttttctgatttttcaaagtagcggcgtgtggggaaacctgattagcagccttgtgtttggtcagactccgagccaagagaccctgccagaagaacagctcactagctgcggggcttcagactgcctaatggctacgacaacaactaactctacacaaagaccatcccagcagctggtgtacactctgttggggatttatacaggaagcggcgtgctggctgtcctgatgattgccgcatttctacagcccatcagagacgtgcaacgtgagtccgagggcgaaaagaagtcagtgcccttctggtcaacactgctctcaaccttcaagctttacagagacaagcgactttgcttactcatcctgctgccactgtactccgggttgcagcaaggcttcctaagctcagaatacaccagaagttacgtgacatgcactctgggtatacaatttgtgggctacgtgatgatatgcttcagcgccactgacgccctttgcagtgttctgtacggtaaggtgtctcaatacacgggtcgcgcagtgttatatgttctgggtgcagtcacacacgtaagttgcatgattgctctcttgctctggcgtcccagggcggatcacttagctgttttctttgtgttcagcgggttatggggcgttgcagatgccgtctggcagactcagaataacgctctgtacggggtgctctttgagaaaagtaaggaggcggcattcgccaactaccggctatgggaggctctagggttcgttatcgcctttggttatagcatgtttctgtgcgtgcacgtgaaactctatatactgctgggagtcctgtccctcactatggtggcttacggtctcgtggaatgtgtggagagtaaaaacccgatccggccacacgcacccggccaggtgaatcaagccgaggacgaggaaatccagacgaaaatgtag

SEQ ID NO: 45712 - DNA, 912 bp, Artificial Sequence
  Description of Artificial Sequence: Synthetic coding sequence
atgaaggaggccctggcccacttcaccatccacaccgccctggtgccctccgaagctcaggatactcctctgttccgctacctgaacccgcaggcctcactgagtcacaccagcgaggaagattttttacccgtcgaggcagtgagagagggcaaggaagagaagaagggaggtcctcccggccgggggcctcctggatggcgcaggagggaggaattaagactgcctgacctgaaggtgctgtgttatcaggaagccgggtcccgcggaactcgcgaccgacaccattatgtctcctcttaccttgccggcgccactagcgccgaccgctatcggatgttcttacggttccagaaagaggtgctggccaaacaggacttgctcaaaaatgattttaccggttcaaaggctgctgccggtcacgagcgtaagcttcagcaagaattgcagaagatctgcacctgcagcccccagcaattcaatcgcctgcacgtctttggcaaagtattcgaagacatttgcaacagttccttaattttcggagacctcctgaagaaggtcaaagatgaatacgagctgtatatggcgacattactcgagtcacagcccgctgctcagtatgaagctctgttagcccagctgaaggcattgggacagcgaccagtaaagactgcagacatggacctcgctcgcgaggagctgcggatgctcgtcacagctacaaaagccgcactcgagcagaatgatcgactgcgctccgagcttgagatggaggtcgccctgctgcagtctgcgaaggagcgcagtgggcggtgcctgtgtgatgttctgccatacgggtgcttcgctgtgacattcatcatttccgccgctgccgtgtggttaccggtctgtcaactcggaaggtgctag

SEQ ID NO: 45713 - DNA, 174 bp, Artificial Sequence
  Description of Artificial Sequence: Synthetic coding sequence
atgggcaccgccgtgggcccccaccacagccccgccccccacgacagtgccctacctgctagattgcttacttcagactttccatacggacgttcatgtcagattgagcaggtgaagtatagcgtacccgacacaggcctttttcagcactgggagggcagcattccaacctag

SEQ ID NO: 45714 - DNA, 174 bp, Artificial Sequence
  Description of Artificial Sequence: Synthetic coding sequence
atgggcaccgccgtgggcccccaccacagccccgccccccacgacagcgcgctccctgcgaggctcttgacaagtgatttcccatacggtcgaagctgtcagattgaacaggtcaaatactcggttcccgatacaggactgttccagcactgggaaggcagtatacccacttag

SEQ ID NO: 45715 - DNA, 462 bp, Artificial Sequence
  Description of Artificial Sequence: Synthetic coding sequence
atggccgccgccctggccctggtggccggcgtgctgagcggcgccgtgctgccgctttggtcggctctaccacagtataagaaaaagatcactgaccgctgtttccaccacagcgaatgctatagtggttgctgtctgatggatttggattccggcggtgcattttgtgccccgcgggcaaggataacgatgatttgcctgccccagtggctcgaactattcaaaggcagggaccgaatcatctttatctatgaggcaccgacaccgagcctggtatcagcgcataaccaaggcagctaccaacatcacttacctctgcccgacgggctggacgtgcacatccagggtctcgacgtttttccccctgtcccctacgacctagaagaagatgccggctggtcactgcttccgtgggggcacaggccatggctgcccccaacctgttccaaatcaagctcctag

SEQ ID NO: 45716 - DNA, 546 bp, Artificial Sequence
  Description of Artificial Sequence: Synthetic coding sequence
atgtaccagcccagccggggcgccgcccggcggctgggcccctgcttgcgcgcctatcaagcccgcccgcagctgcctaaactctttctgcagtcccacgattattctctgtactccctcgatgttgaattcataaatgagatcctaaacattcggactaagggaaggacttggtacatcctgtctctgacgctatgccggttcctggcatggaactattttgctcatctgcgcttggaggtgctgcagctcacccgccaccccgagaactggactctgcaggcgagatggcggcttgtggggctccccgtgcatctgctatttctgcggttctacaaacgcgataaagatgaacactatcgcacatacgacgcctacagcacattttacctcaactcatcagggcttatttgccgacaccggttagacaaacttatgccatcccactctccgccaactcctgtgaagaagttactggtgggcgcgctggtggccctgggactgtctgagcccgaaccagatttaaatctctgctctaagccttag

SEQ ID NO: 45717 - DNA, 948 bp, Artificial Sequence
  Description of Artificial Sequence: Synthetic coding sequence
atgtaccagcccagccggggcgccgcccggcggctgggcccctgcctccgcgcctatcaagcccgcccccaggatcaactgtaccctggcactctccctttcccaccattgtggccgcactctactaccactacctctcccagttctcccctgttctggagtccgctgcctccaagattacctacccaacgcctcccccaagtcccacctctgccattgccccagatccaagcccttagttccgcttgggtcgtcctccccccagggaagggagaggaaggccctggtcccgaactccattcagggtgtttagacggcctgaggtctctctttgaggggccaccttgcccttacccaggtgcatggatcccttttcaggtgcccggtaccgcccatccgtccccagccaccccttctggagacccatcgatggaggaacatttgagcgtgatgtatgagagactgcgacaggagctgcctaagttgttccttcagtcacacgactacagcctatacagtcttgacgttgagtttataaacgagattctgaacattcgaacaaagggccgaacctggtacattctgtcccttactctgtgcagatttttggcctggaattatttcgctcaccttagactagaggttttgcagctgaccagacatcctgagaattggactctgcaggcaagatggaggctggtagggttacccgtgcaccttctcttcttacgcttctacaagcgggataaagacgaacactacagaacatacgatgcttactccaccttctatctgaattcttctgggctgatttgtcgccatcgactggataagcttatgccctcccattcaccacccactcctgtaaagaagcttctggtgggggcattggtcgctctgggactgtctgaacccgagcctgatttgaacctttgttcaaaaccttag

SEQ ID NO: 45718 - DNA, 1302 bp, Artificial Sequence
  Description of Artificial Sequence: Synthetic coding sequence
ctgcccacctgcgccctgcagcgggtggaccggctgggcgtggccggtgccggcggacgcagatgccgcgcatgcagggcacggaccagtgtacttccagggcttcgagcagtgcgaagagggcagggtcaggctgccggccgggtttgcgtggcacctgactctccccgcctgccagtccctcggggcgacctgaaaggccgaggcagagagatccgttccccagctgcggccccgagtagaagctctcctgcacaaacccggcccgccggacggccgcagcagcctgcaagactggcgctaggtgagcgctcctggcaggaaggacgacccgtgtgcaccagatttggtcctctgagacccggttggcaagacggacatgccccaagccgagatggggcgtctcgaacgccttcaggcaccgaggaccagttgtacccggggacactgccatttcccccactctggccccactctacgacaaccacatcaccttcaagtcctctcttctggtctcctctgccaccgagactgccaactcagcggcttcctcaagttcctccactccctttgccccagattcaggcactgagctcagcctgggtcgtgctgcctccaggaaagggggaggagggcccagggccagaactgcacagtggttgcttagacgggcttcgatccctctttgagggtccaccttgtccatacccaggagcatggatacctttccaggtgcccggcacggcccacccaagccccgccacccctagtggcgatccctccatggaggagcatttaagcgtgatgtacgagcggctccgacaggagctcccaaagctcttcttgcaatctcacgattattccctgtacagcctggatgtggagttcattaatgaaatcctgaatatcaggaccaagggcagaacttggtatattctgtctctgactctgtgtcgttttctggcttggaattactttgctcatcttagactggaggtcttgcagcttacccgccaccccgaaaattggactcttcaagctcggtggcgactcgtcggactgccagtccacttactcttcctacgtttctacaaaagagacaaagacgaacattataggacctacgacgcgtattctacgttttacctgaacagtagcgggttgatttgtcgccataggctggacaagttgatgccttcgcacagcccccccacacctgtaaaaaagctcctggttggggccctcgtggcattaggccttagtgagccggaacccgacctcaatttgtgtagcaagccctag

SEQ ID NO: 45719 - DNA, 546 bp, Artificial Sequence
  Description of Artificial Sequence: Synthetic coding sequence
atgtaccagcccagccggggcgccgcccggcggctgggcccctgcttgagggcttatcaagcccgtccacagctccctaagctttttttacagtcccatgactattcgctttattctctcgacgtggagttcatcaatgaaattctgaatatacgcaccaaaggaagaacctggtacatcctgtccctgactctctgcagatttctagcctggaattactttgctcatcttaggctggaagtgctgcaactgaccagacaccccgagaactggacgcttcaggctcggtggcgcctcgtcgggctcccggtccacctgttgttccttaggttttacaaacgtgacaaggacgagcattacagaacatacgacgcctattcaaccttctatcttaacagctccggcctgatttgcaggcatcgactggacaagctgatgccttcacactctcccccaacacccgtcaagaagctgctggtcggagccctggttgccctgggactgtctgagcctgagcctgatctgaacttgtgcagcaaaccgtag

SEQ ID NO: 45720 - DNA, 546 bp, Artificial Sequence
  Description of Artificial Sequence: Synthetic coding sequence
atgtaccagcccagccggggcgccgcccggcggctgggcccctgcctgagagcctaccaggcacgcccacagctgcctaaactctttttgcagagccatgattactcactctattcactggatgtggagttcattaacgaaatcctgaatattcggacaaaggggaggacgtggtacatcttatctctcactttgtgcaggttcttggcgtggaactatttcgctcatcttagactggaagtcttgcaattgacacgacatcccgagaattggaccctgcaggcgcgttggaggttggttggccttcctgtgcacttgttattccttcgtttttacaaacgcgacaaggacgagcactaccggacatatgacgcatacagcaccttctatttgaactcttctggcttaatttgtcgtcaccgcctcgataagctcatgcccagtcacagtcctcccaccccggtgaaaaagctcctggtaggggctctggtcgctttgggtctaagcgagcccgagcccgatctcaacctgtgtagcaagccctag

SEQ ID NO: 45721 - DNA, 546 bp, Artificial Sequence
  Description of Artificial Sequence: Synthetic coding sequence
atgtaccagcccagccggggcgccgcccggcggctgggcccctgcttacgtgcttaccaggcgcgcccgcaactccccaaattattcctccagtcccatgactattccctgtattctctggacgtggagtttataaatgagatattgaatattcgcactaaaggtaggacttggtacatcctgtcccttactctctgccggtttttggcatggaactacttcgcccatctgcgcctagaagtacttcaactcacgagacatcccgaaaattggactttgcaggccaggtggagactggtcggactccctgtgcacctgctcttcctgcgcttctacaaaagggacaaggatgagcactacagaacctacgatgcttacagcacattctatctgaatagttctggtctcatttgtaggcataggctggataaattaatgcctagccactcaccccctaccccagtgaagaagctcttggtgggagcattagttgccctcggcctgtccgagcccgagccagatctgaatctctgctctaaaccatag

SEQ ID NO: 45722 - DNA, 948 bp, Artificial Sequence
  Description of Artificial Sequence: Synthetic coding sequence
atgtaccagcccagccggggcgccgcccggcggctgggcccctgcctccgggcctaccaggcgaggccacaggaccaactgtacccaggcacactgccatttccaccgctgtggcctcattcaactacgaccactagcccatcatccccccttttttggagtcccctccctccgcgcctccccacccagagactgccccaggtcccacctctgcctttgccacagatccaggccctgtcttcagcttgggtagtgctgcctcctgggaagggggaggaaggccccggaccagagttgcactccggctgcctggatggactccggtcactgttcgaaggccctccctgcccttatcctggtgcctggataccattccaggtacctggaacagcacacccctcccccgccactccttccggagaccctagtatggaggaacatttatccgtgatgtacgaaagacttagacaggaactacccaaattgtttttacagtcccatgactactctctgtacagcctagacgttgagtttataaacgagatcctgaatatccgcactaaagggagaacctggtacatcttgtcattgactctgtgccgattccttgcatggaattactttgcacacctgcggttggaggtgttgcagctgacccgccatccagagaactggaccctacaagcccgctggcggctggttggactacccgtccacctgctatttcttcgcttttataaaagggacaaggacgagcattaccggacttatgacgcctatagcaccttttatctgaattctagcggcctcatctgcagacaccgactcgacaaactgatgccttcccactcaccccccacacccgtcaaaaagctgctggtgggggctctggtcgcgctcggcctgagtgagcctgagcccgatttaaacctctgcagtaaaccttag

SEQ ID NO: 45723 - DNA, 948 bp, Artificial Sequence
  Description of Artificial Sequence: Synthetic coding sequence
atgtaccagcccagccggggcgccgcccggcggctgggcccctgcctgcgtgcgtatcaagccagaccacaagaccaactctaccctggaactctgccatttcctcctctctggccacattccactaccacaacttctcccagttcaccattattctggagccccctgcctccacggctgcccactcagagactcccccaggtccccccgttgcccttaccccagattcaggcgctgagttccgcgtgggtcgtgcttccacctggcaagggggaggagggccctgggcctgagttacacagcgggtgcttagatggcctgagaagtctgttcgagggaccaccgtgcccatatcctggtgcttggatccccttccaagtgcccggcacggctcatccctcgccggcaacgccgtctggggacccatccatggaggaacacctgtctgttatgtatgaaaggctgcgccaggaactgcctaaactgttcctccaaagccatgactacagcttgtattcactggacgtggagtttatcaacgagattcttaacatccggaccaaaggcagaacctggtacatacttagcttaacactgtgccgtttcctggcttggaactacttcgcccatctccgactcgaagtcctacagctcacgcgccatcctgaaaattggactctccaggctaggtggaggctcgtgggcctccccgttcacctgctttttctaagattctataaacgcgacaaggacgaacactatcggacttatgacgcttactcgactttctacttgaacagcagtggactgatatgccggcaccgattagacaagctcatgccaagtcactctcccccaacacccgtgaaaaagctactggtgggggccctagtggccctcggcctgagcgagcccgagcctgaccttaacctgtgtagcaaaccttag

SEQ ID NO: 45724 - DNA, 1302 bp, Artificial Sequence
  Description of Artificial Sequence: Synthetic coding sequence
ctgcccacctgcgccctgcagcgggtggaccggctgggcgtggccggggcaggtggaagacgttgcagagcctgtagagcaagaacgtccgtgctgcctgggctccgagctgtaagacgggggcaagggcaggctgccggcagagtgtgcgtcgcgcctgattccccacggctgccagtgccccgcggtgatttgaaaggtagaggtagggagatacgaagcccagccgccgccccaagccgatcgagcccagcccagacgagaccagctggtcggccccagcagccagcaaggcttgctctgggtgagcgctcttggcaagaagggcgcccagtttgtacaaggttcggtccactgcgccccgggtggcaggatggccacgcacccagccgggacggggcatctaggaccccctctggcacagaagaccaactgtatcccggcaccctgccatttcctccactgtggcctcacagcacaactaccactagccccagctctcccctgttctggagtccgctgccaccccgtctccccacccagaggcttccccaggtgcctccactgcccctgccacagattcaggctctgagctcagcatgggtggtcctccctccaggcaagggggaggaggggcctgggcctgagctccatagtggttgtcttgacggactccgctctctttttgagggacctccttgcccctacccaggggcatggattccctttcaggtcccaggcaccgcccatccatcaccggccacaccatccggagatccatcgatggaggaacatttgtctgtcatgtacgagcgactgcgtcaggagctccccaaactcttcctccaaagtcatgattatagcctgtactcccttgacgtcgagtttatcaacgagatcctcaatattagaacgaagggccgcacatggtacatcctctcgctcacgttgtgtaggtttctcgcgtggaactactttgcccatttacgtctggaagtgcttcagcttactagacatcctgagaattggacattgcaagcccgctggagattagtcggcttacctgtgcacctcctattcctgcggttctataaaagagacaaagatgaacattaccggacatacgacgcctactccaccttttacctcaacagttctggcctcatctgccgccatcgtctggacaaattgatgcctagtcattcccctcccacccctgtcaaaaaactgctcgtcggagccctggtggcgctgggtctgtccgaacccgaaccggacctcaatttgtgctctaagccatag

SEQ ID NO: 45725 - DNA, 948 bp, Artificial Sequence
  Description of Artificial Sequence: Synthetic coding sequence
atgtaccagcccagccggggcgccgcccggcggctgggcccctgcctccgcgcctaccaagctcggcctcaggatcagctgtatcctggaacactgcctttcccccctctgtggccgcacagcaccactacgacatctccctcttcccctctattctggtccccactgcctccccgtctgcctactcagcggctaccccaagtgccaccacttcctctcccccagatccaggctctgtctagtgcgtgggttgtgctgccgcccggtaaaggcgaggaggggccgggccctgagctgcacagtggttgtctggatgggctccgcagtcttttcgaaggaccaccctgcccctatccaggtgcgtggatccccttccaggtccccggaaccgctcacccatcaccagctacacccagcggcgatccaagcatggaagaacatctgtctgtcatgtatgagcgtctgaggcaagaactgccaaagctgtttctccaaagccacgattattccctctacagcctcgacgtagaatttatcaacgagatactgaacatccgcaccaaaggtcggacttggtacattctgtctctgaccctttgtagatttctcgcgtggaactatttcgctcacctaaggctggaggtccttcaacttactcggcatcctgagaattggaccttacaagctaggtggaggttagtgggccttccagttcacctgctctttttgcgtttctacaaaagggataaagacgagcattacagaacatacgatgcttactccactttttatctgaattccagcggattgatctgcaggcaccgactggataaactcatgcccagccacagccctcccacgcctgtcaaaaaactcttagtcggcgccctggtggctctcggtctgtcagaaccagagccggatctgaacctttgttccaaaccctag

SEQ ID NO: 45726 - DNA, 948 bp, Artificial Sequence
  Description of Artificial Sequence: Synthetic coding sequence
atgtaccagcccagccggggcgccgcccggcggctgggcccctgcctgcgcgcttatcaggccaggcctcaagatcaactgtaccctggaacactaccattcccaccactgtggccccactcaaccaccacgacaagcccctcttcccctctgttttggtctccgctgcctccgaggcttcctactcaaaggttaccccaagttccacccctgcctttacctcaaatccaggccttaagctcagcttgggtcgttctgccccctggcaagggggaggaagggcctgggccagaactgcacagcggatgtttggacggcctgaggagcctctttgaggggccaccctgtccctatcctggggcatggataccatttcaggttcccgggacggcccacccttcacccgcgacgccaagcggcgatcctagtatggaggaacatctgagtgtcatgtatgaacggcttcgccaggagttgccaaaactgtttcttcagtctcacgattacagtctgtattcactggacgtagaattcatcaatgagatactgaatatcaggacaaaagggcgtacatggtacatactgtctctcacgctctgccgtttcctagcatggaactacttcgcccacctccggctggaggttctgcagctgaccaggcatccagagaattggacactacaagcgaggtggcggctcgtgggtttgcccgtgcatctcctctttctgagattctataagcgggataaagacgaacattaccggacatatgatgcctactctacattctacctgaacagcagcggcctgatatgtcgccaccgcctggataaactcatgccgagccattctccccctactccagtcaagaagctgttagtgggggcgttggttgcactgggcctgtcagaacctgaaccggatttgaatctttgctcaaagccctag

SEQ ID NO: 45727 - DNA, 1302 bp, Artificial Sequence
  Description of Artificial Sequence: Synthetic coding sequence
ctgcccacctgcgccctgcagcgggtggaccggctgggcgtggccggggcagggggccgccgctgccgggcttgccgggcccgcacatcggtgcttcccggcctgagggccgtaagaagaggacagggacaggcggctggtcgggtctgcgtagcccccgattcacctcgcctgcccgtgccccggggagacctcaagggccggggcagagagattaggtctcccgctgcagctcctagcaggtcctccccagcacagacacgacctgctggacggccacagcaaccagcacgccttgccctaggcgagagatcttggcaggagggacgcccagtgtgcacccggttcggccccctccggcctgggtggcaggacgggcatgctcccagtcgagatggtgcctctcggacgccaagtgggaccgaagaccagttgtatccaggtacactaccattcccgcctctttggccccactctacgaccactacctcccctagctcacccctcttctggagtcccctcccaccgcgactgccaacccagagactgccacaggttccccctctacccttgcctcagatacaggctctgtcttccgcctgggtggttctgccaccaggaaaaggagaggaaggcccaggacccgagcttcactccggctgcctggatggtcttagaagcctgtttgagggccccccctgcccttaccccggggcttggatcccttttcaggtgccagggactgctcatcctagtccggctactccgtccggcgatccaagcatggaggagcatctaagcgtgatgtatgagcgcctccgccaagaacttcctaagctctttctgcagtcccatgactacagtttgtactccctcgacgtggagttcataaatgagattcttaacattcggactaaaggcagaacatggtatatcctgtccctgacgctatgccgattcttggcctggaattactttgcacacctccgtctcgaagttcttcagcttacacggcacccggagaactggaccctacaggcacgttggcggctggttgggctgcccgtgcacctcctgttcttgcgcttttacaagcgtgacaaagatgagcattaccgtacctacgatgcatactctactttctatctgaacagcagtggcctcatctgcaggcatagactcgataagcttatgcccagccacagccctcctacccccgttaaaaagcttctggttggagccctcgtcgcactcggcctgtctgaacccgaacccgacctgaatttatgcagcaaaccctag

SEQ ID NO: 45728 - DNA, 1302 bp, Artificial Sequence
  Description of Artificial Sequence: Synthetic coding sequence
ctgcccacctgcgccctgcagcgggtggaccggctgggcgtggccggcgctggcggacggaggtgtagagcgtgtcgggctcggacgagcgtgctccctggcttgagagctgtgcgacgggggcagggccaggccgcaggtcgagtctgtgtcgcaccagacagcccgcgacttcccgtaccccggggtgatttgaagggtcgcggccgagaaattcgctcgcctgccgcagctccctcccgaagttctcctgcccagacacggcccgcggggcgtcctcaacagcccgcaagactggccctcggtgaacgaagttggcaagagggacgacctgtgtgcactcgctttggcccactcagaccgggctggcaggacggccacgctccatctagagacggcgcctcgcgaaccccctctggcaccgaggaccaactatatccaggcaccctcccctttccccctctgtggcctcactctaccacaacaacgagccccagtagcccactgttttggtcccccctgccaccaagactgccaacccaacgcttaccccaggtgccccctctccccttgccccaaattcaggccctcagcagtgcctgggtggttctgccaccaggaaagggtgaggagggccccggcccggaattgcactctgggtgcctcgacgggttacggtccctgtttgaaggaccaccttgcccttaccctggcgcctggattccgtttcaggttccaggaactgctcacccttcccccgcaacgcctagtggagatccgtccatggaggagcatttgtcagtgatgtacgaacggcttagacaggagctgccaaagctgttcttgcagtctcacgattatagcctgtactcactggatgttgagttcatcaatgagattctaaacatccgcacaaagggtaggacatggtatatacttagcctcacactctgcaggttccttgcatggaactatttcgcacatctccgactcgaggtgttacagttgaccaggcatcccgaaaattggaccctacaggctagatggcgcctggtcggtctgccggtgcaccttcttttcctgcgcttctacaagagggacaaggatgagcattacaggacctatgacgcttactctaccttctacctgaactctagcggtctgatatgccgacatcgtcttgacaagctgatgcctagtcacagcccacctactcctgtgaagaagctcctggtgggagcactggtcgccctaggactctcggaaccagagcccgacttgaacttatgtagcaagccatag

SEQ ID NO: 45729 - DNA, 948 bp, Artificial Sequence
  Description of Artificial Sequence: Synthetic coding sequence
atgtaccagcccagccggggcgccgcccggcggctgggcccctgcttgcgagcctaccaggcacgtccacaagatcagctgtatcccgggacactgcccttccctccgctttggccacattctactacaaccacttccccaagctcaccccttttttggtccccactcccgcctcggctgcctacccaacgcctgcctcaggttcctcccctcccgctgccccagatacaagccctgagtagcgcctgggtggtgcttccacctgggaagggcgaggaagggccgggccctgaactgcacagcggatgcctggatggactccgcagtcttttcgaaggcccaccctgtccctaccctggcgcttggatcccgttccaggtacctgggacagcgcatcccagtccagccacaccatccggcgacccatcaatggaagagcacctctcagtgatgtacgagcgcctgcgccaagagctacccaagctcttcttgcaaagccacgattactctctctacagcctcgacgtggagtttattaatgagatcctgaatatccgcacaaagggcagaacctggtatattctctcgttgaccctgtgtaggtttctcgcttggaactattttgctcatctgaggctggaggttctacagttgacaagacacccagagaactggacccttcaagcgagatggcggctcgttggccttcccgttcatttgctttttctgaggttctataagagggacaaggacgaacattatcgaacatacgacgcctactcaaccttttacctcaactccagcggcctcatctgtcgtcatagattggacaagcttatgcccagtcactcacctcccacacctgtaaagaagcttcttgtgggcgcactggttgctcttggcctgagcgagcctgagccagatctgaatctttgtagtaaaccatag

SEQ ID NO: 45730 - DNA, 1302 bp, Artificial Sequence
  Description of Artificial Sequence: Synthetic coding sequence
ctgcccacctgcgccctgcagcgggtggaccggctgggcgtggccgaggccgggggtcggaggtgccgggcctgtcgtgcacgcacatcagtgctgccaggcttgcgggccgtacggagaggccaggggcaggccgccggacgcgtctgtgtggctccagactctccaaggctgccagtacctaggggggatctgaagggacgcggcagggagattaggtcccctgccgcggcaccttctaggagcagtcccgcccagacaaggcccgcaggccgccctcagcagccggcacggctcgcccttggcgaaaggtcttggcaagaggggcgcccagtgtgtacccgttttggtcctctgaggccaggatggcaagatggacacgcgccaagtcgggacggagcttctcggactcccagtggcacagaggaccagctttaccctgggacactgcccttccctcccctctggcctcatagcacaactactacttctcccagcagcccactgttttggtcacccttgcccccaagattgcctactcagcgcctcccacaagtgcccccgctccccctgcctcaaatccaggcactctcttcggcttgggtggtccttccacctggcaagggcgaggaaggtccaggcccagaattacactccggctgcttggatggcctccgatccctcttcgaaggcccaccctgtccatatccaggcgcatggatcccttttcaagtgcctggcaccgcgcatcccagtcccgccactcccagcggggatccaagcatggaagagcatctgagcgtcatgtacgagagacttcggcaggagctgcccaaactgttcctgcagtcacatgactattctctctacagcctggacgttgagtttatcaacgaaattttgaacattcggacaaagggaaggacttggtatatcctcagtcttaccttgtgtcggttccttgcatggaattacttcgcccatttgcgtttagaagttcttcagctgactcgtcaccccgaaaactggaccttgcaagccaggtggagactggtaggcctgcccgtccacctgctcttcctccggttttataagagggataaagacgagcactacaggacttacgatgcatattctaccttctacctgaactcatctgggcttatctgcagacacaggttggacaaattgatgccatcccacagcccgccaacacctgtgaaaaagctcctagttggcgccctggtagccttaggattatccgaacctgagccagatttgaacttgtgttctaagccctag

SEQ ID NO: 45731 - DNA, 1302 bp, Artificial Sequence
  Description of Artificial Sequence: Synthetic coding sequence
ctgcccacctgcgccctgcagcgggtggaccggctgggcgtggccggagccgggggtaggagatgtcgagcctgtcgggccaggacgtccgtcctgcctggactgcgtgcagtgaggagggggcagggccaggctgccggaagggtgtgcgtagctccggatagtccgaggcttccagtgccgcggggagacctgaaggggagggggcgagagattcgaagccctgcagcagctccgtcaaggtcctcccccgctcagacccgccccgctggccgcccccagcagccagcccggctggccctcggagagcggtcatggcaagaggggaggccagtgtgtacgagattcggcccccttcgcccaggttggcaagatgggcatgccccatctcgagacggagcttcccgcacaccatccggtaccgaggaccagctgtatcctggtacactgcccttcccacccctgtggccccattcaacaactacaacctctccgagctctccactcttttggtccccgctaccccccagattgccaacgcaacgcctgcctcaggtcccaccgcttcccctgccacagattcaggcgttgtcatcagcctgggtggtcctccctcctgggaagggggaggaagggccaggacccgaactgcatagcggatgccttgatgggctgcggtcactgtttgaggggcctccgtgcccttaccctggggcatggattcctttccaggtacctggcaccgctcatcccagccctgccacaccttcgggcgacccttcaatggaagaacacttgagcgtgatgtatgagaggctccgtcaggaactgccaaagttattcctacagagccacgactacagtttgtactcacttgacgtggagtttattaatgagatactgaatatacgcacaaagggtcgtacatggtacatactgtcactgactttgtgccgatttctggcatggaattatttcgcccatttgagactggaggttctgcaactgactcgccatcccgagaattggactctccaggccagatggcggctggtgggcttgccagtgcatctgctgttcctccgcttctataagcgggacaaggatgaacactatcgcacttatgacgcctactccacgttttacctgaatagttccggacttatttgtcgtcataggctggataaactgatgccttcccattctccccctaccccagtgaaaaagctcctggtcggggccctggtggccttggggctttctgagcctgagccggatctgaatttgtgttctaaaccatag

SEQ ID NO: 45732 - DNA, 546 bp, Artificial Sequence
  Description of Artificial Sequence: Synthetic coding sequence
atgtaccagcccagccggggcgccgcccggcggctgggcccctgccttcgcgcctaccaggccaggcctcagctcccaaagttgtttctccagtcacatgattactcactgtatagcctagacgtcgaatttatcaacgaaattctgaatatcaggaccaagggaagaacctggtacatactgagcctgaccctatgtcgcttcttagcctggaactatttcgcacatctgcgccttgaggttctgcagttgactcggcatcctgagaactggacactccaggccagatggcggttggttggactgcccgttcatctgctctttttacgcttctacaagcgggacaaagatgagcactataggacgtacgatgcttattccacgttttatctgaattccagcggattgatttgtcggcaccgcctagacaagctgatgcccagtcactcccctcccaccccggtaaagaagctcctggtcggagccctggtagctctggggctttccgagccagaacctgatctcaatctctgcagcaagccctag

SEQ ID NO: 45733 - DNA, 546 bp, Artificial Sequence
  Description of Artificial Sequence: Synthetic coding sequence
atgtaccagcccagccggggcgccgcccggcggctgggcccctgcttgcgggcctaccaagcgcgcccacaattgccaaaactctttctgcaaagtcatgactattcactgtactccttagatgtggaatttattaatgagatacttaatattagaaccaagggtcgaacatggtacatcctgagtctgacgctgtgtcgctttctggcttggaactatttcgcccatctccgactcgaggtgttacaactcaccaggcaccctgaaaattggacattacaggccaggtggcgcctcgtcggcctgcccgtccacctgctgtttttgagattctacaaaagagataaagacgagcactatcggacatacgatgcttacagcaccttctatctgaactctagtgggctgatatgtaggcatagacttgataagctgatgccctcccatagtccacccactcccgtaaagaagttattagttggtgccctcgtggctctgggattgagcgagccagaacccgacctaaacctgtgtagtaagccttag

SEQ ID NO: 45734 - DNA, 1491 bp, Artificial Sequence
  Description of Artificial Sequence: Synthetic coding sequence
atgtaccagcccagccggggcgccgcccggcggctgggcccctgcctacgggcttatcaggctcgccctcaggtgtcaggaggggaagagggcggtagaagaggagggggagaacgcccaagcagtaagccagtgagaggcgccgaaagagccctaggaagtgcacaagcacagcgccatccacctccactgcctacttgtgctctgcagagagtcgataggttgggagtcgccggggccggcggcagaaggtgcagggcctgtagggcacgcacatccgttctgcctgggctaagggcggtgcgtagaggacagggccaggccgcaggccgagtgtgcgtagcccccgactcccctaggctgccagttcctagaggcgacctgaagggccgcgggagggaaatacgtagcccagcagcagcccctagccggtcgagcccagcccagacccgaccggcaggtaggccccagcagccagctcgtctcgccctgggtgagcggagctggcaggagggccggcccgtctgtacaagatttggacccttgcggcctggttggcaagatggtcacgcccctagcagagacggagcatcccgaactccgagtgggactgaagatcaactgtatcccgggacactgccgttcccacccctttggccgcatagcaccacaacaacaagcccgagcagtcccctcttctggagtcccttacccccgcgcttaccgacccagaggctgcctcaggtccccccactgccattgccccagatccaggctctttcgagcgcatgggtggtgctgccaccagggaagggagaggaagggcccggtccggagctgcactcgggatgtttagacggactacgtagcctgttcgaaggccccccttgcccgtatcccggagcctggattccattccaggtgcctgggactgcacacccatcgcccgcgacaccttctggggacccaagcatggaggagcacttatcggttatgtacgaacgcctgcgccaggagttgcctaaactctttcttcaatcccacgactactccctctacagcctggacgtggagttcataaacgagatcctgaacatcaggacaaaggggcgaacttggtacatcctgagccttactctgtgtcggttcctagcttggaattattttgctcacttgcgacttgaagttcttcagctaacaagacaccccgagaattggacattgcaagctcgttggcgcctggtcggcctaccagttcacttgttatttctccgtttttacaaacgggataaggacgaacactataggacttacgatgcgtacagcaccttctacctcaactcaagtggtctgatctgtaggcaccgcttagataagctgatgcctagtcattctcctcccacacccgttaaaaaactcctcgtcggtgcccttgttgccttggggttatctgagccagagccagacctaaatctgtgcagcaaaccctag

SEQ ID NO: 45735 - DNA, 1491 bp, Artificial Sequence
  Description of Artificial Sequence: Synthetic coding sequence
atgtaccagcccagccggggcgccgcccggcggctgggcccctgcctgagagcctaccaggcccgtccgcaggtctctggcggggaagaaggaggaagacgcggcggcggtgagaggccgtcctctaaacctgtaagaggagcagagagggccttgggaagtgcccaggctcagaggcatcctccaccgctgcctacttgtgcattgcaacgggtggataggctaggagtcgcaggtgcaggagggcgtagatgccgggcctgcagggccaggactagcgtgctcccaggattaagagctgtacgtagagggcaaggtcaggctgccggcagagtttgcgtggccccggacagtccccgcctgcccgttcctagaggagatttaaaaggcaggggacgggaaatccgctcccctgccgctgccccaagtcggagctcccccgcccaaacccgcccagctggtcggccccaacagccagccagactcgccctgggggaacggtcctggcaggagggtcgaccagtatgcacccggtttggaccactgaggcccggttggcaggatgggcacgccccaagtagggacggcgcaagcaggacgccaagcggcacagaagatcaactctatcctggtactctacccttcccacccctgtggcctcactctactaccaccacctcccccagctctccacttttttggagcccgctgccccctagactgcccacacaacggctcccccaagttcctcctctcccacttccccagatccaggccttgtccagcgcatgggtagtccttccaccaggcaaaggcgaggaaggccccggccctgagcttcatagcgggtgtctagatgggctgcgttcactttttgaggggcctccatgcccctacccaggcgcctggatcccttttcaggtcccaggcaccgctcatcctagcccggcaacaccttcaggcgatccaagcatggaggaacacctctccgtgatgtacgagcgactgcggcaggaattgccaaagctgtttctgcagtcacacgattacagcttgtattccctggacgtggaattcataaacgagatcctgaatataaggaccaagggcagaacttggtacattctgagtctgactctctgccgcttcctggcttggaattacttcgcgcacttgcggctggaggtactacagctaacacggcaccctgaaaattggactttacaggcccgctggaggctggtaggcctgcccgttcatttactctttttacgcttttacaagcgcgacaaggacgagcactacaggacttatgatgcctattctactttttaccttaactcctcagggctgatctgcagacataggctcgataaactcatgccttctcatagcccccctactcctgtcaagaaactactggtgggcgctcttgtcgcactgggcctgtccgagcccgagccggacctgaacctgtgtagtaaaccctag

SEQ ID NO: 45736 - DNA, 1491 bp, Artificial Sequence
  Description of Artificial Sequence: Synthetic coding sequence
atgtaccagcccagccggggcgccgcccggcggctgggcccctgcctgcgtgcctaccaggcccggcctcaagttagcgggggggaggaaggcggtcgtagaggcggcggcgagcgtccgagctctaagcctgtgcgcggcgcagaacgcgctctggggtcggctcaggcccagagacatcctcctccgctgcccacgtgtgccttgcaaagggtcgaccgtctgggagtggccggagctggcggaagaaggtgtcgggcctgtcgggcgaggactagcgttcttccaggattgagagccgtgaggaggggccaggggcaggccgctgggagggtgtgcgtggctcccgactcgccgcgactgcccgtgccgaggggggatctaaaaggccggggacgagagattagaagccctgctgccgcaccctctagaagctctccggcccagacacgtcctgctggcaggccccagcagccagcgcgtctcgctcttggggagcgttcctggcaagaaggccgacccgtttgcaccagattcggtccactgcgaccaggctggcaggatggccacgctcctagccgcgacggggcatcaagaacacctagtgggacagaggatcaactctaccccgggactctaccctttccccccctctggccacacagtaccacaactacctcacctagcagcccactcttttggagtcccctgcctcctcgcctgccgacacaacggctccctcaggtgccgccgctgccactaccccagattcaggcactgtctagcgcttgggtcgtgctaccgcccggcaaaggtgaggaggggcctggccccgaactgcactctggttgcctcgatggcctgagatcgctattcgagggtcccccctgtccttacccaggggcttggatcccatttcaggtgcctgggaccgcccacccttctccggccacaccgtccggcgatccgagcatggaagagcatcttagcgtgatgtatgagcgcctgcgtcaagagctccctaagctgttcctgcagtcgcacgattactccctttacagccttgatgtcgagttcattaacgaaatccttaatatacggaccaagggccgaacgtggtatatcttgtccttgaccctctgtcgcttcctcgcttggaactatttcgctcacctgcgcctggaagtgttacaactcacccgacatcctgagaactggacattacaggcccgctggcgactcgtgggattgccggtgcacctgctgtttctgcgcttttataagcgcgacaaggatgagcactatcgaacatacgatgcatattccaccttctacctgaattcaagtggcttaatttgcagacaccggctggataagctgatgccatcccattccccacctacccccgtgaaaaaattactggtgggcgcacttgtcgctttgggactctccgaaccagagcctgatcttaacctgtgttccaaaccatag

SEQ ID NO: 45737 - DNA, 1491 bp, Artificial Sequence
  Description of Artificial Sequence: Synthetic coding sequence
atgtaccagcccagccggggcgccgcccggcggctgggcccctgccttagggcctaccaggcccggccgcaggtatctggcggagaggaggggggaaggaggggcggcggggaaaggccatccagcaagccagtacggggcgctgagagggccctcggttcagcccaagctcagcggcatccgcccccattgccgacctgcgctctgcagcgagtggatcggctgggggtcgctggcgcgggcggtcggagatgccgagcctgccgcgctcggacttcagtgctccccggcctccgtgcagtgagaaggggacaggggcaggctgctggccgggtctgtgtggcgccagacagtcctaggctgccggtgcccaggggagatcttaaggggcggggacgggagatcagaagccccgcagctgcaccctcacgctccagcccggctcagacacggccggccgggcgcccccagcagccggcccgtctggctctgggagaacgctcatggcaggaggggcggcccgtgtgcactcgatttggtccgctccgccccggatggcaggacggacacgctccctcacgtgatggagctagtcgaaccccaagcggaacagaggaccagctataccccggaacccttccattcccgcctctgtggccacacagtaccacaaccacatcaccaagttcccccttgttctggagtcccctgcccccacgcctgcctacacaaaggttgccacaggttccacctctgccactgccacagattcaggcgctgtcatctgcgtgggtggtgctgcctccaggcaagggcgaggaaggtcctggccctgagctgcatagtggctgtctcgatggtttacggagcctgtttgagggcccaccatgtccataccccggcgcatggattcctttccaagtgcccggaaccgcacaccccagccccgccacgccatcgggggatccaagcatggaggagcacttgagcgttatgtatgagcggcttcgtcaggagctcccaaaactgtttctgcagtctcacgattacagcctctactcacttgacgtcgagtttattaacgagatcttgaatataaggacaaagggcagaacatggtatatcctgtccctgaccttatgtcgcttcctcgcttggaattacttcgcccacttgcgcctggaagtgctgcagttgactaggcatcccgagaactggactctgcaagctagatggcgccttgttggacttccagtgcatctactgtttctccgattttataagcgggacaaggacgagcattatcgtacctacgatgcttactcaacattttatctgaattccagtggcctgatttgcagacaccgtttagataagttaatgccatcacattcgcccccgacgcccgtgaagaagttactggtcggtgctctggtggcattgggtctgagtgaacctgagcccgatctcaacttatgcagtaagccctag

SEQ ID NO: 45738 - DNA, 1491 bp, Artificial Sequence
  Description of Artificial Sequence: Synthetic coding sequence
atgtaccagcccagccggggcgccgcccggcggctgggcccctgcttgcgagcatatcaggctcggcctcaggtctccgggggagaagaggggggtcgtcgcggggggggagagagaccttcttccaaaccagttcggggtgccgagcgggccctgggctcagcacaggcccagaggcaccccccacctcttccgacctgcgcactacagagagttgacaggctgggcgtggctgaggccggcggtcgcaggtgtcgagcgtgtagggctaggacgtctgtgctgcctggtctgcgggctgtgcggcgaggccaaggacaggccgccggacgggtgtgtgtcgctccggactccccaagattgccagtccccagaggagacttaaagggcagaggtagggagatacgcagcccagcagctgctccttctcgcagttcccccgctcagacccgccccgccggcagaccgcagcagcccgcaagactggcactgggggagaggagctggcaggagggaagacccgtttgtaccagatttggtccccttagaccaggatggcaggacggacacgccccctcaagagatggcgcgtctcggactccttccggcacagaagaccagctgtaccctgggaccctgcctttcccacccctgtggccacattcgacgacaacaacctcaccatcaagcccactgttctggagcccactcccaccacgtttgcccacacagaggctccctcaggtcccacctctgccactaccgcaaattcaggctttgtcatccgcatgggtcgtattgccaccggggaaaggagaagaagggccaggccccgaacttcacagtggctgcctagacgggctccggagtttattcgagggaccaccttgtccataccccggagcatggattcctttccaagtgcctggaaccgcacacccgagtcccgcgacaccatctggggacccatccatggaggaacatctttcagtgatgtatgagagacttcggcaggaattaccaaaattgtttctccagagccacgattattcactgtattcactggatgtggaatttattaatgaaatattaaatatcaggacaaaaggacgcacctggtacatcctgtccctgaccctctgtcgcttcctggcctggaactactttgcacaccttcggctggaagtcctgcagcttactcgtcatcctgaaaactggacccttcaggcccgctggcgacttgtgggcctgccggtccacttactcttcctcaggttttataaacgggataaagatgaacattaccgcacttacgacgcctacagcacgttttatctgaactcttctggtctgatctgccgccataggcttgacaagttgatgcccagccacagcccgcccactcctgtgaaaaaactgctggtaggtgccctcgttgctcttggtcttagtgaaccagaacccgatctgaacctgtgctccaagccctag

SEQ ID NO: 45739 - DNA, 1491 bp, Artificial Sequence
  Description of Artificial Sequence: Synthetic coding sequence
atgtaccagcccagccggggcgccgcccggcggctgggcccctgcctaagggcgtatcaagcacgcccgcaagtaagtggaggtgaggagggcggacgccgggggggcggtgaacgcccatctagcaagcctgtcaggggggcggagcgcgctctgggctcagcccaggcccagagacaccccccacccctgcccacgtgcgcgttacagcgggtggataggctcggagtggccggggccggaggaaggcggtgtcgcgcctgccgcgcacggacatccgtattgcctggactaagagctgttagacgggggcagggtcaggccgctggaagagtatgcgttgcacctgattcaccacgactcccggtgcctcgcggggacctcaaagggagagggagagaaattaggtctcctgcggctgctcccagtcggtcgtccccggcccaaacgagaccggcgggacggcctcaacagcctgctcgattggcccttggggagcgtagttggcaggaaggaaggccagtgtgtactagattcgggccacttagacccggatggcaggacggccacgcaccatcacgggatggggccagccgaactccaagcggcacagaggatcaactgtatccaggtactttacccttccctccactctggccccacagcacaactaccaccagtcctagttcacccctgttttggagccccctgcctccacggttgcccacgcagcgactaccccaggtcccgcctctccccctcccacagatccaggccctgagtagcgcctgggtagttctgcctccgggaaagggggaggaaggacccggaccggaacttcattctgggtgtctggacggcttgagaagtctctttgagggacccccctgcccttatcccggcgcctggatcccctttcaagttcctggaacagcccatccctccccggccacgcccagcggcgatcccagcatggaggaacatctcagtgtgatgtacgaacgactccgccaggagcttcctaagttattccttcagagccacgattattcactctactctcttgacgtagagttcattaatgaaatcctcaatatccggaccaaaggcaggacctggtatattctgtcactaacgctgtgccggtttctggcttggaactattttgctcacctccgtctcgaggtgctacagcttactagacacccagagaactggactctgcaggcccgatggcgactggtggggctaccggtgcatctcctatttttacgcttctacaaacgtgataaggatgagcactataggacatacgacgcatactccactttctacctgaactcgtcagggctgatctgtcgacatagactggacaagttgatgccgagccacagcccgccaactccggtgaagaagctgctggtgggggctttggtcgctctgggtctctccgagccagagcctgatctgaacttgtgctcgaaaccatag

SEQ ID NO: 45740 - DNA, 735 bp, Artificial Sequence
  Description of Artificial Sequence: Synthetic coding sequence
atgaacgaccccttcgcccggatggagacccggggcccccagggcgccgccaatccgatggacagctcccgatccctcggagatctcggtccctttcctcgcgaggttgggaggggagcacccttggctcccggcgcaaggaatcccgccacggcaggagccagtagatctcagggaggtggccacgaagaccggacagccgatagagcactgggcccgcgtgccggagaagagctggaccgtgagtcttgggttagagagaaggtgctgttccttctccatccagaacggtggctcggcacccgtggcgacccagcaagagaggaagtggcgggtgccgaggacttaccacacgctggcggcgaggaccacggtgaagagcctaattatccctcagtcttccagcgtcagaagcgcatctcaggacggagagtggctccacctcgcgacgcggccgatccgcccaaatatgtactcgtgcgtgtggaagactaccaagtgacacaagaagttctgcaaacctcatgggctaagggacgaatgacaacccggaccgaggaacattttgtaactgcattgacttttcgctcttcgcgcgaggggcaacccggggaaaggtgggggccggcggagtccagagcactgcaggcaaggaccggagctagccgtgtgcacgccgcaggacgccgagtttctccgtcacccggtacgtggctggaggagatcaagctgtag

SEQ ID NO: 45741 - DNA, 1527 bp, Artificial Sequence
  Description of Artificial Sequence: Synthetic coding sequence
atgggccggcggaacgagaactgcgccaacagcctgcgggtgagcaatatctcacaggagaacctcagccattggaacctggattcagaggttccagtgtccgagaataagaatttgcctgccggcagggatggcgcagccggcggcaaaataaataaaaattacctcgaaattcccgttgagcagctgatgctggagcctaatctctctgtgcactcacaaaaatctacccaaaactcaaagcagggcatatttcagctgtggaattgcccactcaatgaagggagcactattgaaaagcgtgagttcaagaagagttctgttgagactgggtttaatgttattaaccaccccatcagagtgtttacactcaaccaccctctgaccattgctagcgtggacaagcaggtaggaccttatcctggccttcccatgcctcttggcttgtgctggccttacgccgatggagacttcttcaaaaaccgtaacgaaattcacgtgagtagctgtagtacgattgaaaacaacgatggcgagaccctaccagctcctaattggaacctcaagcatggcaattcgtccgtagaagagaattttaccgatgagtctgacctgagtgagaacgagaagactaacgacacgctgctgtcatacttcaaaaaagtggatcttaatcttaagccagagaccatcaagaatgtcgaagagcccttcaccgaagaacccaacgaggtgttcccctatccggacttccttcccccgccattcagtgctctggatttgcacaacctggccctaagcaaaagcgataattggaaagtaaccgtggacccagcggaaacaagcgtcgaacacctcataacccggcttctggaactggaaaggctccagcacatgacaatccaaaaggagcgaccccgcctgcagactaccttctgtacacccgcagtgacggagagaccaagctctagcaaggccactcctaaagttagacagccaaaactgtgtgatagcttgtctctgcagatcccctgtgtggacaagagtcaggagaaatcgaaaaataattcgggttcttgcaagctcgagcaaaacgcactcaagaggaactggagtaatgcaggaaaatacaggtggaattctcgtcccctgagtctgaaatcaagctcaactcccaaacaactcattgagacgtacgacaaaaatcccaagagttcaatcttaagcccttgccaagaattatcgttcaagcccactatcggtcatactaaccagtccatggtcaagatggtgtcaacaaggtgcctgccctggcgcagtcctatgcccgtcagtccaatacctcttacctttcctgaaaatcagaaagaggagattaaggcacccaagcggaacttcggcacaaagaagaaactgtaccggcaaaacatcgtgctgaatagacccttttccatccagaaactcaactgtctgtctccatccctgattgccaaagataaatgctgtagtccaattgaacagaagtag

SEQ ID NO: 45742 - DNA, 1068 bp, Artificial Sequence
  Description of Artificial Sequence: Synthetic coding sequence
atgctgatggagttcttcaagaaccggaacgagatccacgtgagctcttgcagcacgattgagaataacgatggggaaactctgccggcgccgaactggaacctcaagcatggcaactcatctgttgaagagaacttcacagatgaatccgacctgtccgaaaacgagaagactaacgatacattattaagctacttcaaaaaggtcgacctgaacctgaagcccgaaacaatcaaaaacgtggaggagccttttaccgaggagccaaatgaggtattcccatatcctgattttctgccaccccctttcagcgcgctcgatctgcacaatttagccctgtctaaaagtgataattggaaagtgacggtagacccggctgaaacttccgtcgagcacctgattacacggttgctggagctggaacggctgcagcatatgaccatccaaaaggagcggccacggcttcagaccacgttttgtacccctgctgtgaccgaacggcccagttccagcaaagctacccccaaggtccggcagcccaagctctgcgactctctcagtctgcagattccttgcgtggataaatcacaggagaagtcgaaaaacaacagcggtagctgcaaactagagcagaacgccttgaagcgcaattggagcaacgccgggaagtacaggtggaattctagacccttgtccctgaaaagttcatccaccccaaagcaactcattgaaacctacgataagaatcctaagtcctcgatactgtctccttgtcaagagctttctttcaaacctaccatcggccataccaatcaaagtatggtgaagatggtatctactcggtgtctgccctggcgctcccccatgcccgtttcccctatccccctgacatttccggagaatcagaaggaagaaatcaaggccccaaagaggaactttgggactaaaaaaaaactgtatcgccagaatattgtgctgaacagaccgttcagcatacagaagctgaattgtctgtctccgagcctgattgctaaggacaaatgttgttctccaatagagcagaaatag

SEQ ID NO: 45743 - DNA, 978 bp, Artificial Sequence
  Description of Artificial Sequence: Synthetic coding sequence
atgcagggccgggtggccggcagctgcgcccccctgggcctgctgctcgtatgccttcatctgccgggtctgttcgctcgttctattggggttgtggaagaaaaggtaagtcagaacttcggcaccgaccttccccaactaggtcaaccctcctcaactggtccaagcaacagcgagcacccccagcccgcattagatcctcggtcaaacgatctcgcccgtgtgcctttgaaactgagcgttccgccgtcagatggattccctcctgccggagggagcgctgttcagcgctggccaccctcctgggggctgccggccatggactcttggccgccagaggatccatggcagatgatggccgccgccgccgaagatcgactgggcgaagccctgccagaggaattgtcgtatctgtcttcagccgccgcactcgcgcccggtagcggtccactgccaggggagtcatcaccagatgctacggggttgtccccggaagccagtttgctgcaccaagattctgagtcacgcagactgccacgttcaaatagtctgggtgccggaggcaagatcctctcccagagaccaccctggagtctgattcacagagttctcccagaccacccctggggtaccctgaaccccagtgtcagctggggggggggtgggcccgggactgggtggggaactcgccccatgccccatcctgagggcatatgggggatcaacaatcagcctcccggcacaagctgggggaacatcaaccgttacccaggaggctcttggggtaacatcaacaggtaccccggtggatcgtggggcaatattaataggtaccctgggggctcatgggggaatattcacctttatcctggcataaacaatccgttcccacctggcgtgctgagaccccctggctcttcttggaatatcccggccggcttccctaaccctccatctccacgactgcagtggggctag

SEQ ID NO: 45744 - DNA, 978 bp, Artificial Sequence
  Description of Artificial Sequence: Synthetic coding sequence
atgcagggccgggtggccggcagctgcgcccccctgggcctgctgttggtttgcctgcatttacctgggctttttgctagatcaatcggggtagtggaggagaaggtctcccagaattttgggacgaacctgccacaattaggtcagccttccagcaccggcccctctaactcagagcatcctcaacccgccctggaccctagatcgaacgacctcgcacgggtgcccctcaagctttctgtgccgcccagcgatggctttccgcccgcgggcggttccgcagtgcagaggtggccaccttcttggggactgcccgccatggactcgtggcctcctgaggatccttggcagatgatggccgctgctgctgaagatcgtttaggcgaggccctgcccgaggagctgtcatatctgtcgtctgcggcggcattagctcccggatccggaccattacccggggaaagttcacctgacgctactggcttgagccctgaagcctctctgctgcaccaggattctgagtctaggcggctcccaaggtcaaactctttgggagccggcggtaaaattcttagtcagcggcctccttggtctctaatccatagagtgttgcctgaccatccttgggggaccttgaacccctctgtctcatggggcggcggggggcctggcaccggatggggcaccaggccaatgccccatcctgagggcatctggggaatcaataaccaacctccgggaacaagttggggcaatatcaataggtatcctggaggcagctgggggaacataaataggtatccgggtggttcttggggaaatatcaacaggtaccccggcggtagctggggaaacattcacttgtatcccgggataaacaacccttttcccccaggagtgctccgaccaccaggaagctcgtggaacataccggcaggattccccaacccacctagtccccgcctgcaatggggctag

SEQ ID NO: 45745 - DNA, 612 bp, Artificial Sequence
  Description of Artificial Sequence: Synthetic coding sequence
atgtaccagaacatggacgacgagatgaagcgggagcacctggccgccgagcaacggatggttcaccggatccaacgaataatgatggaatgtcaccgtgagaaagtggaagctgtggaaaaagcgcgagcagaagagcgccatatcgctcaggaagcaattcaggcccaaaagtcaaaagcagtggaggaaatagtaaacactggcgtgacagtcatcaaggacgagaagacttcagtggccaggcttatgagagagaaggagcatgaaatgagcatcttgtacggaatcgcacagcgccagaggcaggaggaggtacaggaagtcctgcaggaggccgagaaaacgcatcaggccacattgggcaacatgatggataagctggcaaacacacagggggagcttctttctatcgccaaacagctcggaattatgaccaattggaaagatttccttgaggaagagctgcaggagacaaggatggcgtttcagaagtacatcaactatacattccctaagttatcccccggacatgcagactttattttacctgagcgtaagaaaacacctagcaaccttgtgatcaaggaaaacaagactaccctagactag

SEQ ID NO: 45746 - DNA, 990 bp, Artificial Sequence
  Description of Artificial Sequence: Synthetic coding sequence
atgatccggaacagcgactacaagaacttcgtgtgctgcgccgtgtgcaacaagattatccctcctgccccctttgggaagacattcaaaagaatacacgaatataagccgctgaagacgcgattctatacccacaaagacatccttgacatcggagcgaatatcctgaaaaaggaagagcagtttcaggaggacatcctgcgggagcacatcgccaaggctgaggccgaagtctgggctcaggcgaacgaaaggcaaaagcaagcggtagagaaagccctcgaggaagccaacgatcggcacaaaattgagatccagatcctcaaagaggaacaccagaaggacttacaagaggtgactgccaagacgaagacggagatgtatcaaaatatggacgatgaaatgaaaagggagcaccttgctgccgagcagcgcatggttcaccgcattcagcgaatcatgatggaatgtcatcgggagaaggttgaggcagtagaaaaggctagggctgaggaaagacacatcgcacaggaagccatccaggcccagaagtctaaagcagtggaagaaatcgtcaataccggtgttaccgtgatcaaagatgagaaaaccagcgtcgctcgactgatgagagagaaggagcatgagatgtccatcctttacgggatcgcccagcgacagaggcaagaggaggttcaggaggtgctccaggaggcagaaaagacccaccaggctactcttggcaatatgatggacaaactcgcgaatacgcagggtgagctgctgagtatagcaaaacagctgggcataatgaccaattggaaggacttcctggaggaggagttgcaggaaacccggatggcctttcagaaatatattaattatacctttcctaaactgtctcccggacacgcagactttatcctgcctgaaagaaagaagactccctcaaacctggtcataaaggagaataaaaccactttagactag

SEQ ID NO: 45747 - DNA, 231 bp, Artificial Sequence
  Description of Artificial Sequence: Synthetic coding sequence
atgagccacctgcccgccgtgagccccgtgttcttccagctgcccgccccccaccctcccactgtgttgagaccacagctgggactgcatccaaacccagaatgtgaccgtgagaagatgtcagtccgagaccacgatcctgaagtcctcacccgcaactcggcctgtaaaccaaggggacagctctcgggtcatttgctgaagccacgcgcacccctggaagccgcctag

SEQ ID NO: 45748 - DNA, 180 bp, Artificial Sequence
  Description of Artificial Sequence: Synthetic coding sequence
atgagccacctgcccgccgtgagccccgtgttcttccagctgcccgcccctcatcctcccaccgtcctacgccctcagttgggtctgcaccccaaccccgaatgtgatcgcgagaaaatgtcagtaagggaccacgaccccgaggtactcacgaggaatagcggatcactgcaggcgtag

SEQ ID NO: 45749 - DNA, 1869 bp, Artificial Sequence
  Description of Artificial Sequence: Synthetic coding sequence
atgccccccacccaggccgagagcgtgatccggagcatcatccgggagattggacaagaatgcgctgcacacggggaaatagtctctgagaccctgatagccttcatggttaaggccgtggtgctggatccttcaaatggatttaatatggacagaactcttatgaagagtgacgttcagaatctcgttaagctttgcatgacacgacttttagacaccaagaatccatcactggacacgatcaaaatgcaggtctattttgatatgaattataccaacagagtcgagttcctcgaagagcatcacagagtgctggagtctagacttggatccgtcacacgagagattacggataaccgagcgtgtgcaaaagaagaactcgaaagcctgtaccgaaagatcatatcttacgtccttcttcgctctgggctgggcagcccgactgatattaagaccgtgagggaagtgaccgcggcactgcaatccgtgttcccacaggcagaactgggaacctttttgaccttgtccaaaaaggataaagagcggcagctgaaagaactgactatgattgtcactggcatccggttatttaaccgggactgcggcaagggcggggaaggaatcgatgacctgcccgccgtccttcacgtggctatcccagctacaatgcagcacatcgactaccagctggagaccgctaggagccaagtgtacagatatacagctatcctcgagaaggcggcgaacgaccctcttatgcgcgctgagttacagccgtatatgctcaaggaagccctgtacaacatccgtcaatacgaggtatttttgcaaataattctttccgacatcattacaggagcgcaggaggtggaaatgatgacaaagcagttgggagcccatctggagcaactgaagatgaccatcaagtctaaaatagctgtgcctacctcgcaggtcttcccaatcttcatcgctctgtctaccctgtggacctccctgcaggatgagaccatagttgtgggcgtgctgtctaacctgttcacccacattcaaccgtttctgggtgcacatgaactgtatttccccgagcgcgtgatgcagtgtcacctaaacggggccaccgttaaaaccgacgtgtgcagaatgaaggaacacatggaggacagagtgaacgtggccgacttccgcaaactggagtggttattcccagaaaccacagcaaatttcgacaagcttctcatccagtatcgcgggttctgcgcttatacctttgccgccaccgatggtttgctactgcccgggaatcctgccatcggcattttaaaatataaggaaaagtattatactttcaattctaaagacgccgcttactcgttcgccgaaaaccccgagcactatatcgatattgtgcgggagaaggccaaaaagaataccgagctgattcaactcctggagctgcaccaacaattcgaaacatttattccgtatagccaaatgagagatgccgacaaacactatattaaaccaatcactaaatgtgagtctagtacacagaccaatacccacatcctcccgccaaccatcgtgcgatcttatgaatggaacgagtgggaactccgtcggaaggccatcaagctggctaacttaaggcaaaaagtgacacattctgtccagaccgatctttctcacctccgtagggagaattgcagccaggtataccctcccaaggacacatcaacacagagtatgagagaggatagcactggggtgccccggcctcaaatctatttagccggactccgaggcggcaagtcggagatcacggatgaggtgaaggtgaacctgacgagggacgttgatgagacctag

SEQ ID NO: 45750 - DNA, 759 bp, Artificial Sequence
  Description of Artificial Sequence: Synthetic coding sequence
atgccccccacccaggccgagagcgtgatccggagcatcatccgggaaatcggacaggaatgcgccgctcacggagaaatcgtttccgagaccttgattgccttcatggtaaaggcagtcgtgctggacccctcaaatgggttcaacatggaccgaacattaatgaaaagcgacgtccagaacctcgtcaaactctgcatgacccgtctgctggataccaagaacccatcactggacacaatcaaaatgcaggtctacttcgacatgaactacaccaatagagtggaatttctcgaggaacatcacagagtactggaatctaggctgggctccgtaacccgggaaatcacggataatagagcttgcgctaaggaagaactcgagtccctatatcgcaagatcattagctatgtgctgctgcggtcagggttgggctctccaacggatatcaaaaccgtgagagaggtaacggcggccctgcaatcggtgttcccgcaggccgaactcgggacatttctgaccctcagcaagaaggataaagaaagacagcttaaggagctcacaatgatcgttacagggattcggctgttcaaccgggattgcgggaaagggggagaggggattgacgacctcccagccgtcctgcacgtcgctatccccgcaactatgcaacacatagactaccaactggaaacagctagaagccaggtgtaccgctatacagcgatcctggaaaaggcagcaaatgaccctttgtag

SEQ ID NO: 45751 - DNA, 1230 bp, Artificial Sequence
  Description of Artificial Sequence: Synthetic coding sequence
atgcactggggcgtgggcttcgccagcagccggccctgcgtggtggacctctcctggaaccagtccatttcatttttcggttggtgggccggaagcgaagagccattcagcttctatggtgacattatcgcctttcccctgcaggattatggaggtattatggccggcctcgggtccgatccatggtggaagaagacattgtacctgacagggggcgctcttctcgccgccgccgcatatcttctgcacgagctacttgtgatccgcaaacagcaggagattgactccaaagacgcaatcattctccaccagttcgcacgcccaaacaatggtgtgccatccctttccccattttgccttaaaatggagacttatctgcgaatggccgatttgccctatcagaactactttgggggaaagttatcagctcaggggaagatgccatggatcgagtacaaccacgagaaggttagcggaactgagtttatcatagattttctggaggagaaacttggcgtaaacttgaacaaaaacctgggtccccatgaacgagccatctcaagagctgtgacaaagatggtggaagagcacttctattggacattggcttactgccaatgggtggacaatctgaatgagacacgtaaaatgctgagtttgagcggtgggggacccttcagcaatctcctccgttgggtggtgtgccatattacaaaaggaatagtgaagcgcgaaatgcacggccatggcatagggagattctccgaggaagaaatttatatgctgatggagaaggacatgaggagcctcgccggccttcttggggataagaaatatataatgggccccaaattgtccactcttgatgcaaccgtgttcgggcacctggcccaggccatgtggacactccctggtactcggcccgagaggctgatcaagggggagctcatcaatctggcgatgtattgtgaaaggatccgtagaaagttctggcccgagtggcaccacgacgacgataataccatctatgaaagcgaagaaagttcggaaggttctaagactcatacacctttgctggatttctccttttactcccggacagagactttcgaagacgagggcgctgaaaactctttctccagaactcccgataccgatttcacaggccattccctcttcgattccgacgtagacatggacgactatacagaccacgagcagtgtaaatag

SEQ ID NO: 45752 - DNA, 390 bp, Artificial Sequence
  Description of Artificial Sequence: Synthetic coding sequence
atgggccccaagctgagcaccctggacgccaccgtgttcggccacttggcacaggccatgtggactctgcccgggacgcgacctgagcgccttataaagggagagttaattaatcttgctatgtactgcgagaggattcggagaaaattttggcctgagtggcaccacgacgatgacaatactatttacgagagtgaagagtccagcgaggggagcaagacgcacacacctctactggacttctctttttactcgaggaccgagaccttcgaagacgagggtgcggagaacagtttcagcagaacgccggacacagacttcacagggcatagcctgtttgacagtgacgttgatatggatgattatactgatcatgaacagtgtaagtag

SEQ ID NO: 45753 - DNA, 384 bp, Artificial Sequence
  Description of Artificial Sequence: Synthetic coding sequence
atgatctaccccctggacctgttccggaacatcccctggaagcaggggaagtgtttcgcctcactgagtcctgaaggggagcgagccttcgatggaatggaaccactatgccagccaggggcgcgaccggcgttacgagggttacagcacgcttcagactgctaccgactgctgagtcctcccggaagcgggcttgtgggcacgaatccaagcgtgccggcccccagtccacactgcggttgttgtcaagcctggtcaatatcaagctttacattcactggccctactccgttcaagataaattccgaccaggctaccccctgccacctccgatcgcctgagaccatctttcgccagcgggaaataagtaatgaggcgttttag

SEQ ID NO: 45754 - DNA, 432 bp, Artificial Sequence
  Description of Artificial Sequence: Synthetic coding sequence
atggccagcggccccctgggccccggcgcccggcccacccggctgcacccacctttccccccccctgcccacattaaacctggagctccccctggagagaatcccgaattgagcggcttggaacggatcttggcgaggcaccagctccctaaagaaataaatctgacccccaagccaaaccgcatgcctccgtggaagcgcaaaatcatcaacaatgtgaccgacggctggaagaaatgtcatttgcttaaacgaaatactaaggagccccctatgtcaacaattgtggtgcgcaagctgatccagaaaaatgttccccgcagacacagcctccgaaacacatccagaaagttgaggaatctgcctactaccgcgaaaggtactcagacaggtaaaagccaatgcctcttgggtatatctgagcctacttag

SEQ ID NO: 45755 - DNA, 387 bp, Artificial Sequence
  Description of Artificial Sequence: Synthetic coding sequence
atgctgagcaacctgcacgagctgctgcccaaccacctgatggagaccttatactccaggaagtccgaggaagacaaaaagaagtgcgagaaccccgaactgagcgggttggaaaggatcctagccagacatcagctgcccaaagaaatcaacctgacccctaaaccaaataggatgcctccctggaagagaaagataatcaataatgtaactgatggttggaaaaagtgccatttgctgaaacgcaacacaaaggagccccctatgtcgactattgtggtgagaaaactcattcagaagaacgttcctcggcgacattccctgaggaatacgagcagaaagctgaggaacctgcctaccaccgccaaaggaacacagacggagtag

SEQ ID NO: 45756 - DNA, 591 bp, Artificial Sequence
  Description of Artificial Sequence: Synthetic coding sequence
atgctgagcaacctgcacgagctgctgcccaaccacctgatggagaccctctatagtagaaaaagcgaagaggataaaaaaaaatgcgaaaatcctgaactgtccggattggaacgtattcttgctcgccatcagctgccgaaggagataaacctgacaccaaaacccaatcgcatgcctccttggaagcgaaaaatcatcaacaacgtgaccgacggatggaagaagtgccatctactgaagaggaataccaaagaaccccctatgtctaccatcgtggtaaggtggctgaaaaaaaatatgcagccaaccgaggacttgaaaagtgtcatctgccgactgtccgccttcggccctatacagtccgccactgtctgtgggcgacagtccgcaatcgtggcgtttaaagatatgacgtccgcgtgtaacgctgtgagtgcattccagagcaggacaccaggaaccatgttccagtgcagctggcaacaacggttcatgtccaaagacaaaacctactcaaagaagtgtactcagaagacgcaaccaaaagaatacaaacaggaaactgaaaagccagctaataacagttag

SEQ ID NO: 45757 - DNA, 423 bp, Artificial Sequence
  Description of Artificial Sequence: Synthetic coding sequence
atgctgagcaacctgcacgagctgctgcccaaccacctgatggagactctctacagccggaaaagcgaggaggacaaaaaaaaatgtgagaatcctgagctgtccgggcttgagcgcatcctggcccgacatcagctgcctaaagagattaacctcaccccaaagccaaacaggatgcccccgtggaaaagaaagatcattaataatgtgaccgatggatggaagaagtgccacctgctcaaacggaatactaaagagccccccatgtctacaattgttgtgcgaaagctcattcagaagaatgtccccagaagacacagcttgcgcaatactagccgcaaactgcgcaaccttcccactaccgcaaaggggacccaaacaggaaagtcacagtgcttacttggtattagcgaacccacctag

SEQ ID NO: 45758 - DNA, 1326 bp, Artificial Sequence
  Description of Artificial Sequence: Synthetic coding sequence
atggccgtggtgcccgccagcctgagcggccaggacgtgggcagctttgcctacttgactattaaggaccgcatcccccagattttgaccaaggtgattgatacgctgcaccgacataagtccgaattctttgagaaacacggtgaggagggcgttgaagccgaaaagaaagctatttcactgctttccaaattgcgcaatgagctccagaccgacaagcctttcatacctttggtcgaaaagttcgtggacacagacatttggaaccagtaccttgagtatcaacagtccctcctgaacgaaagcgatgggaagtcacggtggttttacagcccatggttattagtagagtgctacatgtacaggcgtattcatgaggctatcatacagtcaccgccaatcgactacttcgacgtatttaaggagtccaaagaacaaaatttctacggatcccaggaaagcatcatcgcattgtgcactcatctacagcagctgatccgaaccattgaagatctggatgagaatcagttaaaagacgagtttttcaagctcttgcagatcagtctctggggtaataagtgcgatctgagcctgagcggaggagaatccagtagtcagaacaccaatgttcttaacagcctggaggacctaaaaccattcatcttattaaacgatatggagcacctgtggtctctgctgtctaactgcaagaagactcgggagaaggcctcagccacacgtgtgtatatagttctggataactccggttttgaactggtaactgatctaatattagcagacttcctcttaagctcagagttagcgaccgaagtgcatttctacggcaaaacaattccatggtttgtgtccgacaccacgatacacgacttcaattggctcatcgaacaggtaaaacatagtaatcacaagtggatgagtaagtgcggagccgactgggaggagtatatcaagatggggaaatgggtctaccataaccatatcttctggacacttccacatgagtattgtgccatgccccaggtggcccccgatctctacgccgagctgcagaaagcacacctcatccttttcaaaggagacctaaattaccgtaagctgaccggtgatagaaaatgggagttttcagtccccttccatcaggctctaaacgggtttcatccagcccctttgtgcaccatcagaactctcaaggccgaaattcaagtggggctgcagccaggccaaggggaacagcttctcgctagcgaacctagttggtggacgactggcaagtatgggatcttccagtatgacggccctctgtag

SEQ ID NO: 45759 - DNA, 969 bp, Artificial Sequence
  Description of Artificial Sequence: Synthetic coding sequence
atgtaccggcggatccacgaggccatcatccagagcccccccatcgactactttgacgtgttcaaagagtcaaaggagcagaatttctacggcagtcaggaaagcataatagccctgtgcactcatctccaacagctgattagaaccatcgaagacctggatgaaaaccaacttaaggatgaatttttcaaactattgcagatcagcttgtggggcaacaaatgcgatctgtccctctccgggggcgagagctctagtcagaatacaaatgttctcaatagcctggaagaccttaaaccctttatcttactcaacgatatggaacacctgtggtccctgctgagtaattgtaagaagactcgtgaaaaagcatccgcgaccagggtatatatcgttctggataatagtggcttcgaactggtaaccgatcttatcctcgcggacttcctgctgagctccgaattggccactgaggtccacttttacgggaagaccatcccctggtttgtcagcgacaccaccatccacgattttaactggttgatcgagcaagtgaagcatagcaatcataagtggatgtccaagtgcggagcagactgggaagaatacattaaaatggggaaatgggtataccataatcacatcttctggaccctgcctcatgaatattgtgccatgccacaggtcgctcccgacctgtatgcagagcttcagaaagcccatttgatacttttcaagggcgacctgaactacaggaaactaacaggagatagaaaatgggaattcagcgtacccttccatcaggccctcaacggattccatcctgcccctttgtgtaccattcggacactgaaagcagaaattcaggtcggcttgcagcccggacagggggagcagctcctagcgtccgagccatcttggtggactacaggaaaatacgggatcttccaatacgatggaccactctag

SEQ ID NO: 45760 - DNA, 1959 bp, Artificial Sequence
  Description of Artificial Sequence: Synthetic coding sequence
atggagaacccccggtgcccccggcggcccctggccgagaagaaggcaagaagcctggatagaccacaagctccagggaaaggctccgaatcctgggattgccactggctctctcttcccacggccccgagtaggaaagctctgcattggacaacttccgactgggccagacactccgattcccccgcaccaagtgctgaagcacattgtacaactgcggctgcacccactcctgaggaaaccggggatttcctgccttctgaacagcgccctagccaggacacaaagaaaggatggctgaagactatgctgaacttcttcgttcggactgggcccgaggagccccgcgagaaagccagcagacgaccacgaggaaaagaaggaataagccagcatccagagccccttgaggcggccggggagccagctctgcgcaagaaagctcaccatgataaaaagcctagtcggaagaaacagggccataagaagcacgccgccgaggtcactaaagcagctcaggaccaggaagctcgcggtagagaggagggtctgtctaaagcagccgctgcccttcgatccggcgaggcagatttgggccccgcgagacggggcggcgaggattcagatcaccagtcttttctgatcaaagtggatggaactggcgctctggatgtgagccctcacgcaaccgggcatcagcaggaagaggagttaaaaaaacctgatcaggacgccatcattcagatgatagtggaactgctgaagcgcgttggcgatcagtgggaggaggaacagtccctggcatctcaacttggggtggccctccctaatcctgccccagccgtgcgtaagaagtcccaagagaagaaaacgtcgctgaagcggacctcaaagactaatcctaaaaaacacggttccgaagaggcgaagagaggtgcagccgatgtctcgagcccggaggcctggccccccaagaaatcaagtttcttacccctgtgcgtgtctgggcaccgcccctcaatcagctcgtcctatgggctagaggagcccaaagtccaggaagctccttctactgaggccggcgcccccgggccaagcgtgcttccgacacccagtgaatctcaagagccgggcgaagaactccccctcgatagagctagtgagtataaggagttcattcagaagatcatttccatgttgcaagatgctgaggaacagcagggagaggaacagcctcaggtgcagcaggaggaagtcggagtggaaaaccctgcaccccattgcagacgcaagagtcaagagaaacgttcgtcgtttcggcgcgccttctatcataagaaacacacgtccaaagaaccaagacgcgccggcgcagcaggcgcagccagccctgaagctcgccggcctaagcgcccctctttcttgccgctctgtgtggggggacaccgacccagcacaagttcctccctcgatccagaggacctcgaatgccgtgaacccctccctgcggaaggcgaaccggttgtaatcagcgaggccccctctcaagcaagaggtcatactcctgaaggtgctcctcagctgtccggcgcttgtgagagcaaggagatcataattcagaagctcgtggccctgctccaggaagtcgatggtcaactgggtcagcaaattcgcagacacccctccttcaaacggtttttttatgaattttccgattccagcctgtcaaaattggtcgctacacttcggagccaggtggcccactcctcaaaactggatcggaaccgtgcaagacggttgtatcaattcgatgtgtctctggccaacaaatttgccgggtctaatagtcacgccatgtgcatacttatggggcttagagaccactacaattgcacgcagtttccctacagggaggaccaacctaacatcacatcccccaaagttgagagccctgattag

SEQ ID NO: 45761 - DNA, 729 bp, Artificial Sequence
  Description of Artificial Sequence: Synthetic coding sequence
atgatgcccctggccgaggccggcgccctggcccagggcggcggcccatcagccactgagtgggcctgcatcctgcgcagaaaaacccccagacacaaacagcctaccttacttatggtacgagcctctagaagaagcggcaaaacatccgccgtattgaaggcaggccgacagtccgtatctgggagaaagaatagcacctcaaaggacctcgtcaccctcggagcttcctcactacgagaggagcgtgggcatccactgcaccccaggcataggaaagccgtgcacttacggaccagaggtaggacccgtggctgggtgcagacactggcaagaatgtcaaggaggactcgcggacccgtcgagcgggctgccgccgcggctgcggccgccgcgggaggcgacgctgggcatgctcccttccccccacctcctgcagccgatggtgcacgtgcacccagatcgcccgggcaagtgaccccgcggggcctgcggctgaggctgccaaggagagagtctctattaagaggcctgtgccgccctctcaggccacttttaggattccgagaatctgacagcgcaaagcccgccagtcttagactgctgcaacataccccgtctgctagaaggaactaccgcatagcaggagcgcgactaatgcgatccaactatcccccacctctgtcatctgcagcccttcggggagctggtccaacacgccgaaattag

SEQ ID NO: 45762 - DNA, 318 bp, Artificial Sequence
  Description of Artificial Sequence: Synthetic coding sequence
atgatgcccctggccgaggccggcgccctggcccagggcggcggcccctctgcaaccgagtgggcctgcatcctccgccgccttctccggaaggaaggggtggacggaggcctgttcagtccggaagacccccaggcccaggcagcccacctaaccgacgggcaaagcatacaaaagaaatggcaggacttctcttgcccacagagcaggaagacagagtgtttctggcaaaaagaacagcacaagcaaagaagcggcaatccgcgatgtctgcaattcgaaggcggagagcggactcccccacctccccagacttag

SEQ ID NO: 45763 - DNA, 243 bp, Artificial Sequence
  Description of Artificial Sequence: Synthetic coding sequence
atgcccttccagttcggcacccagccccggcggttccccgtggaggggggtgactcttcaattgagctcgaacctgggttgagcagctctgcagcttgcaatgggaaggagatgtccccaactaggcaactgcgacgctgccctggcagtcactgcctcacaatcacagacgtccccgtaaccgtctatgcgaccacccggaagcctccagcacagagcagcaaagagatgcatcctaagtag

SEQ ID NO: 45764 - DNA, 306 bp, Artificial Sequence
  Description of Artificial Sequence: Synthetic coding sequence
atggagcggccccggagcccccagtgcagcgcccccgccagcgcctccgcctctgtcaccttggcccagctcctccaactagtgcagcaggggcaagagcttcctggcctagagaagcgccacattgcagctatccacggagagccgaccgcctcaaggctgccccggcgccccaagccctgggaagctgccgctttggcggaaagtctgcctccccccaccttaaggatcggtactgcacccgccgagccggggctcgtcgaggccgctacagctccatcatcatggcacactgtgggcccatag

SEQ ID NO: 45765 - DNA, 276 bp, Artificial Sequence
  Description of Artificial Sequence: Synthetic coding sequence
atgtggcacagcgtgggcctgaccctgctggtgttcgtggccacccttttgatagtgctcctgcttatggtatgtggctggtatttcgtgtggcacctgttcctaagtaagtttaaatttctgcgtgagctggtgggcgacaccggcagtcaggagggagaccacgagccttccgggtcagagactgaagaggatacaagcagcagtccgcaccgtatacgcagtgcacggcaaaggagggcgcctgctgacgagggtcacagacctctgacttag

SEQ ID NO: 45766 - DNA, 582 bp, Artificial Sequence
  Description of Artificial Sequence: Synthetic coding sequence
atggccgtgttcctgcagctgctgcccctgctgctgagccgggcccaagggaaccccggcgcatcattggacggccgccccggcgacagggtgaacctctcatgcggcggcgtttcacaccccatccggtgggtatgggcccccagcttcccagcctgcaaaggactctcgaagggcagacggcctattctatgggcgtcctccagcgggactccaactgttccacccctccagccgttcgtcggtagactgcgaagtctggacagcggaattcgccgattggagcttttattaagtgcaggggattccggaacctttttctgcaaaggtaggcacgaggacgagtcccgcacagtgcttcatgtgctcggagacaggacttattgcaaagcacctggaccaacgcacgccctatcccctccccacagcagcacctgcgaaaatcgagccccagaggctagcaagggagggagggcacaggacagcagagggcctgggccggggaccgagcccgcactgtgcggatctggcccatcctccccacagcaggctcctccagccgtgcattctggtccatgctag

SEQ ID NO: 45767 - DNA, 594 bp, Artificial Sequence
  Description of Artificial Sequence: Synthetic coding sequence
atggccgtgttcctgcagctgctgcccctgctgctgagccgggcccaagggaatccgggagcctccctcgacggaagacctggagaccgggttaacctctcttgtgggggagttagtcatccaatacgctgggtgtgggcaccttcattccccgcgtgcaaaggactgagcaaggggagaagaccaattctctgggcctcatcctccggtacgcccacggtcccacctcttcaaccttttgtgggacggttaagatctctcgattctggaatcaggagactcgagcttctgctctccgcgggggactccgggacgttcttctgtaagggtcgacatgaagacgagtcacgcacggttctccacgtcctgggtgaccgcacatactgcaaggctcctgggcctactcacgcccctttggtgaaaaccgagcctcagcgccccgtgaaagaagaagagcccaaaatccctggtgacttagaccaggaaccctcattgctgtatgcagatctggaccacctggctctcagtaggccacgcaggctgagtactgctgatccagcagacgcctccacaatctacgcagtcgtagtttag

SEQ ID NO: 45768 - DNA, 714 bp, Artificial Sequence
  Description of Artificial Sequence: Synthetic coding sequence
atggccgtgttcctgcagctgctgcccctgctgctgagccgggcccagggaaaccccggcgccagcctcgacggcaggccaggggacagagtgaacctgagctgcggaggggtgtctcaccctatacgctgggtgtgggctccgtcctttcccgcgtgtaagggattaagcaaaggcaggcggccaattctgtgggcgtctagtagcggaaccccaactgtccctcccctacagccattcgttggtaggctgcgcagtctggattctggcataagacggttagagctgctgctgtccgccggcgattctggaacatttttctgcaagggacgacatgaagacgagagcagaacagtgctgcacgtactcggagataggacctactgcaaggcgcccggcccaacccatggtagcgtgtatcctcagctgttaattcccctgctgggggccggattagtactgggcctgggagccctgggtttagtttggtggcttcatcgtcgattgcctcctcagccaatcgggcccttaccaaggtttgccctgtcacccccacattcttccacatgtgagaatagagcgcccgaggccagtaagggtggccgcgctcaagacagtcgtggccccggtcctggaactgagcccgctctgtgtggttcaggcccttcttcgccgcagcaggcccctccggcagttcactcaggcccttgttag

SEQ ID NO: 45769 - DNA, 726 bp, Artificial Sequence
  Description of Artificial Sequence: Synthetic coding sequence
atggccgtgttcctgcagctgctgcccctgctgctgagccgggcccagggaaatccgggcgcctcactcgacgggaggccaggcgaccgggtgaatcttagctgtggtggggtgagccatcccatcagatgggtgtgggctccgtcattccccgcttgcaaaggattgagcaaaggtagaagaccaattctgtgggccagcagttctgggacgcccaccgtgccacccctgcaacccttcgtgggaaggctacggagcttggacagtgggattaggagattggaactattgttgtcagccggtgatagcggcacattcttttgcaagggtcgccatgaggatgagtcacgcaccgtgctgcacgtgcttggagatcgaacctactgcaaagcccccggccctacgcacggaagtgtgtatccccagctgctgatccccttgctgggcgccggtcttgtgttggggctgggcgccctggggcttgtatggtggttgcatagacgactgcctccacagccgatcggccctctcccaaggttcgccccactcgtaaagacggaacctcagcgaccagtgaaagaggaggaacctaagatccccggtgatctggaccaagagccctctttactgtatgcagatctcgaccaccttgcactcagccggcctagacgcctcagcaccgcagacccagctgatgcgagcaccatctatgctgtggtggtatag

SEQ ID NO: 45770 - DNA, 654 bp, Artificial Sequence
  Description of Artificial Sequence: Synthetic coding sequence
atggccgtgttcctgcagctgctgcccctgctgctgagccgggcccaaggtaaccccggcgcctccttagacggccgaccaggcgacagagtgaacctgtcctgcggcggcgtcagccatccgatccgctgggtatgggcgcccagttttccagcctgtaaggggctctctaaagggcgccgccctatcctatgggcatcatcatccggaactcccacagtgcccccgctgcagccattcgtggggagactgagaagcctcgattctggcatacgaaggctggagctgctcctctccgccggcgactcaggcactttcttttgcaagggacgccacgaagatgaaagtcggactgtactgcacgtcttaggtgatagaacctattgcaaggctcccggaccaacccacggtgcctgccccaggaatagactggatcattctctggatttactgtgcccgcctcacatcgctcccctggttaagacagagccccagaggcccgtgaaagaagaggaacctaagatccccggggatctcgatcaggagcccagcttattatacgcagacctcgatcacctggccctaagtaggcctcggcgattaagcacagcagatccggccgatgcctctaccatctacgcggttgttgtttag

SEQ ID NO: 45771 - DNA, 885 bp, Artificial Sequence
  Description of Artificial Sequence: Synthetic coding sequence
atgttcctgcggcggctgggcggctggctgccccggccctggggcagaaggaagcccatgcggccagacccgccctacccggagcctaggagagtagacagctcatccgagaacagtggaagtgactgggactctgcccccgagaccatggaggatgtgggacatcctaaaaccaaggacagcggagcactgcgcgtcagtcgtgctgccagcgaaccttcaaaggaggagccgcaggtggagcaactggggagcaagcggatggatagtttaaagtgggaccaaccaatatctagcacccaagagagcggacgactggaggcaggtggggcatctcctaagctgcgatgggaccatgtggacagcggaggtacccgtagaccgggggtttcacctgagggtgggcttagtgtacccggacccggggctccactggagaagccaggtaggcgggaaaaactcctcggctggttgcggggggagcccggtgctccctctcggtacctgggagggcctgaggaatgtttgcagattagcactaatctgacactacacctgctggagctcctggcctctgccctgttggccctgtgttcccgaccactgcgcgccgcattagatacgctcgggctgcgcggcccactgggtctttggcttcatgggctcttgagcttcctggccgctctacacggcctacacgctgtcctgagtttactgaccgcccacccactgcatttcgcctgtctcttcggcctgcttcaggccttagtgcttgctgtgtcattacgtgagcccaatggcgacgaagccgcgactgattgggagtccgagggcttagagcgcgagggagaggagcagaggggtgacccaggtaaaggcctctag

SEQ ID NO: 45772 - DNA, 885 bp, Artificial Sequence
  Description of Artificial Sequence: Synthetic coding sequence
atgttcctgcggcggctgggcggctggctgccccggccctggggccgcaggaaacctatgaggcctgatcccccctatcctgaaccccgtagagtcgactcatccagcgagaattcgggatctgactgggacagtgcgcccgagactatggaggatgtgggtcatcccaaaaccaaagactctggggccctgcgggtgagcagggccgcatctgagccctccaaggaggaacctcaggtggagcaactaggtagcaagaggatggacagcctcaagtgggatcaacccatctcaagcacgcaggagtctggtcgactggaagctggaggagcaagccccaaattaagatgggatcacgtggacagcggcggcaccagacggcccggggtgtccccagaaggaggactgtccgtgcccgggcctggggctcctctggaaaagccggggagacgagaaaagctgctgggctggctgaggggagagccaggggcaccctcacgctatttgggcggccccgaagagtgtctgcagatcagtacgaatttgaccctccacctgctggagctcttggccagcgccctgctggcactgtgtagtaggccgcttcgggcagccctcgacacactgggcctcagaggtcccttgggtttatggctacacgggttgttgtctttcctcgctgccctgcacggactccacgcagtgctgtcccttcttacagcccatcccctgcactttgcctgtctatttggccttcttcaggcattggtgctagctgtcagcctgcgggagcctaacggagacgaggcagccacagactgggagtcggagggcctggagcgcgagggcgaggagcagagaggagatcccggaaagggtctttag

SEQ ID NO: 45773 - DNA, 885 bp, Artificial Sequence
  Description of Artificial Sequence: Synthetic coding sequence
atgttcctgcggcggctgggcggctggctgccccggccctggggcagaaggaagcctatgaggccagatcctccttaccccgagcctcgtagagtcgacagttctagtgagaattcgggatcggattgggactcagcccccgaaactatggaggatgttggccaccctaaaaccaaagattcgggggcactgagagtgagcggggcggccagcgaacctagcaaagaggaaccgcaggttgagcagttggggtctaagcggatggatagcctaaagtgggatcagcctatctcctccacccaggaatccggaaggctcgaagcagggggggcctctcccaaactgcggtgggaccacgttgactccggcgggacccgtcgccctggagtgagccccgagggaggacttagcgtgcccggtcctggagcccccctggagaagcccggcaggagggaaaagttgctcggatggttgcggggagaacctggagcaccatccaggtacctcgggggtccagaggagtgcctgcagatttccaccaacctaacgcttcatttgctggagctgttagcctccgccctgctggccctgtgttctcggccgctgcgagccgcactcgataccttgggattgcgagggcccttgggcctgtggctgcacggtctgctgagctttctggctgccttacatggattgcacgccgtgctgtccctgttgaccgctcatcctttgcatttcgcttgcctcttcggtctgctccaggctttagttctggccgtcagtctgagggagcccaacggagacgaggccgccacagactgggaaagtgagggtttggaacgcgagggggaagagcagcgcggcgaccctgggaagggtttgtag

SEQ ID NO: 45774 - DNA, 885 bp, Artificial Sequence
  Description of Artificial Sequence: Synthetic coding sequence
atgttcctgcggcggctgggcggctggctgccccggccctggggcagacggaaacctatgcgtccagatcccccatatcccgaaccaagaagggtcgacagcagtagtgagaacagcggaagcgactgggattcagcgcccgaaacgatggaggatgtgggacaccccaagacaaaggattccggcgcgctgcgggtcagtcgggccgccagcgaacccagtaaggaggagccgcaggtggaacagttaggaagtaaaagaatggattcgttgaagtgggatcagccaatcagttctacccaagaatccggacgtttggaggctgggggcgcgtcccccaagttgaggtgggaccatgtggactctgggggcactcggagacctggtgtttctcccgaaggcgggcttagtgtgcctgggccgggtgcacccctcgaaaagccgggtcgccgtgaaaagttgcttggctggctgcgaggtgaaccaggcgccccttcaagatacctaggagggcccgaggagtgcctgcagatatctaccaaccttacactgcacttactggaacttctcgcgtccgcactgcttgcgctatgctctaggcccctcagggctgccttggacacactgggacttagaggacccctcggactctggctgcacggtctgctgtccttcctggccgcacttcatggactgcacgccgtgctctctttgctgacagctcatccactgcacttcgcctgtcttttcggcctgctgcaggccctggttctggccgtatcattacgcgaacccaacggcgatgaagcagctactgattgggagtccgagggactggaacgggagggtgaggaacagagaggggacccaggtaagggactatag

SEQ ID NO: 45775 - DNA, 885 bp, Artificial Sequence
  Description of Artificial Sequence: Synthetic coding sequence
atgttcctgcggcggctgggcggctggctgccccggccctggggcagacgaaaaccgatgagacccgatccaccctaccccgaaccgagaagggtcgattctagcagcgaaaatagcggtagtgactgggatagtgcccccgaaacaatggaagatgtcggtcatccaaagacaaaggactccggcgccctccgcgtaagccgagcagcctctgagccaagcaaagaggaacctcaggtggagcagctgggatccaagaggatggattctctgaaatgggaccagcccatttcaagcacacaagagtctgggcgattagaagctgggggcgctagcccgaaactgcggtgggatcatgtggattccggcggtaccaggagacccggagtgagtccagaggggggcctctctgtccctggcccaggcgcccctctggagaaacccggccggcgcgaaaaactccttggatggctcaggggcgagcctggggctccgagtcgttacttggggggccctgaggaatgtctgcaaatctcgacgaaccttaccctgcaccttcttgaactgctcgcgtctgcgctgctggccctttgctctcggcccctcagggccgcgctggacaccctgggcctcagggggccacttggtctttggttgcatggtctcctgtcctttctggcagccttgcatggcctgcacgccgtgctcagcctcctgaccgcacaccccctgcattttgcttgcctgttcggtctgcttcaggccctggtgctggccgtaagtctccgagagcccaacggggacgaggccgcaactgactgggaaagcgaaggcctagaaagagagggggaagagcagcgtggcgatccaggcaagggtctttag

SEQ ID NO: 45776 - DNA, 885 bp, Artificial Sequence
  Description of Artificial Sequence: Synthetic coding sequence
atgttcctgcggcggctgggcggctggctgccccggccctggggccgccggaagccgatgagacccgacccaccctacccagagcccagaagggtggattctagcagcgagaattcgggctctgactgggactccgcccccgagacaatggaggatgtgggccatccaaaaactaaagacagtggggccctccgcgtgagcagggctgcctctgagccttcaaaggaggaaccacaggttgagcagctgggatctaagcggatggatagtctgaaatgggaccagcccatttcctcaacacaagagagcggaagactagaggccggcggggccagtccaaaacttagatgggaccatgtagatagcggaggtacccggcggccaggtgtctcccccgaaggcggcctgagcgtgcctgggcctggcgctcctcttgagaagcctggacgaagagagaagctactggggtggttgcggggcgaacctggcgcccctagtaggtacttaggcgggccagaggaatgcttacaaatctccacgaacctgactcttcacttgctcgagttactggctagcgctctgttggcgctctgcagcagaccgcttagagctgccttggatacccttgggctgcgtgggcctctgggtctctggctccacggactgctcagtttcctggctgctctgcatggcctgcacgccgtgctcagccttctgactgcacatccgctacactttgcatgcttgtttggactccttcaggctctagtgctggcagtgtccctgcgcgaacctaacggcgacgaggccgccacggactgggagagcgaaggcctggagcgggagggcgaggaacagcggggagaccccgggaagggcctgtag

SEQ ID NO: 45777 - DNA, 885 bp, Artificial Sequence
  Description of Artificial Sequence: Synthetic coding sequence
atgttcctgcggcggctgggcggctggctgccccggccctggggccggcggaagcccatgcgtccggaccccccttatccagaaccccgccgtgttgacagtagtagtgaaaacagtggcagcgactgggattctgcccccgagacaatggaggacgtcgggcatccaaagacaaaagacagcggcgcgttgcgcgtctctggggctgcatctgagcccagcaaggaggagcctcaggtggagcagctagggagcaagcgcatggacagtctgaagtgggaccagccaatttcgtccacacaagagtctgggcgcctggaggccggtggtgcctccccgaaactgagatgggaccacgtggactcaggaggcacccgtcgaccgggagtttcccctgaagggggtctgtcggtccccgggcccggggcgccgctggagaaaccagggcgcagggagaagctccttggatggcttcggggagagcccggcgcgccatctagatatctaggaggacccgaagaatgtctacagatcagcactaacctcactctccacctccttgaactgctcgccagcgcccttctggcactgtgttcacgcccgctgagagcagcgcttgacaccttagggctcaggggacctttgggtctctggttacacgggcttctgtcctttctggcggcattgcacggcttgcacgccgtattgtctcttttgacggcccaccccctgcactttgcctgtttattcgggctattacaagccctggtgctggccgtgtcgctgcgggagccaaacggggacgaagctgctacagactgggagtcagaggggctcgaacgggaaggagaggagcaaaggggcgaccccggaaaaggcctttag

SEQ ID NO: 45778 - DNA, 936 bp, Artificial Sequence
  Description of Artificial Sequence: Synthetic coding sequence
atgttcctgcggcggctgggcggctggctgccccggccctggggcaggagaaaaccaatgcgtcccgatcctccatatcccgaaccacggagggtggattcatcaagcgagaactccggctccgactgggactcagcccctgagaccatggaggacgttggccaccctaaaaccaaggacagtggagccctgagagtgtccggggcggcctcggagcccagcaaggaggaaccgcaggtcgagcaattaggttcaaagcgaatggacagcctcaaatgggaccaaccaatttccagtacccaggagagtggaaggttggaggctggcggagcttctccgaagctccgctgggaccatgtggacagtggcggcactcggagaccgggagttagccctgagggcggcctttccgtccctggccccggagcgcccctcgaaaagcccgggaggagggaaaagctgctgggatggctaaggggcgagcccggagccccctcacggtatctgggtggacccgaggagtgtttgcagataagtacaaacttgaccttgcatctcctcgagttgttggcttccgccctgttggcgttgtgttccagaccattgcgagcagccctcgatacactcggactgcggggccctctcggcctgtggttgcatggacttcttagcttcctagctgctctgcatggcctccatgcggtcttgtcgctcctgaccgctcaccctctgcattttgcatgtctgtttggacttctgcaagctctcgttttagctgtgagtggaagccccatggggatgcggaggccactgacagggcgcgtgaggggctggagaggaaaggtaagaagtaggggggagacacgggaaagaggttgcgatcgtggcgttggtgccaaaggagaagaatctgtcggattcagacggaaggtttag

SEQ ID NO: 45779 - DNA, 228 bp, Artificial Sequence
  Description of Artificial Sequence: Synthetic coding sequence
atggagcggagcttcgtgtggctgagctgcctggacagcgacagctgtaatctgaccttcaggttgggcgaggttgagtctcacgcctgcagtccatctctcctctggaacctcttgacccaatacctacctcctggcgctgggcacattctgaggacctataacttcccagtactaagttgcgtgtccagctgccacctgatcgggggcaagatgccagaaaactag

SEQ ID NO: 45780 - DNA, 228 bp, Artificial Sequence
  Description of Artificial Sequence: Synthetic coding sequence
atggagcggagcttcgtgtggctgagctgcctggacagcgacagctgcaatttgacattcagattaggggaggtcgagagccacgcatgcagcccctccttgttgtggaatctgcttacccagtatctgcccccaggtgctggccacatcctccgcacatacaatttcccggttctgtcctgcgtgtcaagctgtcacttgatcggtggcaagatgcccgaaaactag

SEQ ID NO: 45781 - DNA, 378 bp, Artificial Sequence
  Description of Artificial Sequence: Synthetic coding sequence
atgcgggtggtgatggcccggctgctgagcgagggcgagcagggcattccaactgcttgcgccgctttcgcacaacagccagcagggccacggcggggcctggccggagttggagaaggagggccccagtgtagctgggtcaattatcgctgtactctggagtttctagttagcctgctgggtaccgacctggccagaggaaggggcaattcagcctctggccccaccgcccccgccgactccaaacagctcatgaatagtggttctcccgccagagacaatgccccttctcagagattctgcactaacctgtccgaaggactccgttttggcatttcccctagttggcgggaagccctttacggctgtcacgcatag

SEQ ID NO: 45782 - DNA, 228 bp, Artificial Sequence
  Description of Artificial Sequence: Synthetic coding sequence
atggagcggagcttcgtgtggctgagctgcctggacagcgacagctgcaatttgactttccgcttgggagaggtcgagtcccacgcctgttcaccgagtctgctttggaatcttctgactcaatatttacctccaggtgccggccatattcttcggacgtataatttccccgtgctctcgtgcgtgtctagttgccatctgatcgggggcaagatgcccgagaattag

SEQ ID NO: 45783 - DNA, 228 bp, Artificial Sequence
  Description of Artificial Sequence: Synthetic coding sequence
atggagcggagcttcgtgtggctgagctgcctggacagcgacagctgtaatctgacctttcggttaggcgaagtggagtcgcacgcatgcagccccagcttgttgtggaacctgctgacgcagtatctcccaccgggcgctggtcacattttgagaacttataacttcccagtactcagttgtgtatccagctgccatctaatcggcggaaaaatgccagaaaactag

SEQ ID NO: 45784 - DNA, 228 bp, Artificial Sequence
  Description of Artificial Sequence: Synthetic coding sequence
atggagcggagcttcgtgtggctgagctgcctggacagcgacagctgtaacctaaccttccgactaggggaagtggagagtcatgcttgcagccccagtctcctgtggaatctcttgacccagtatctaccaccgggcgcaggtcacatacttagaacatacaactttcccgttctgagctgcgtgagttcttgccatctgattggaggtaagatgcccgaaaattag

SEQ ID NO: 45785 - DNA, 228 bp, Artificial Sequence
  Description of Artificial Sequence: Synthetic coding sequence
atggagcggagcttcgtgtggctgagctgcctggacagcgacagctgcaacctaactttcagattgggcgaggtcgagagtcacgcctgtagtccgtcattgctctggaatctgcttacccagtacctcccaccaggcgcaggacatattctgcggacctacaactttcctgtgctctcatgcgtaagcagttgccatttgattgggggaaaaatgcccgagaactag

SEQ ID NO: 45786 - DNA, 228 bp, Artificial Sequence
  Description of Artificial Sequence: Synthetic coding sequence
atggagcggagcttcgtgtggctgagctgcctggacagcgacagctgcaacctgacttttcggctgggagaggtcgaaagtcacgcctgctccccctctctgctgtggaatctgttaacccagtacctccctcccggggcaggtcacattcttaggacttataacttcccggtgcttagttgcgtcagttcttgtcaccttatcggcgggaagatgccagagaattag

SEQ ID NO: 45787 - DNA, 228 bp, Artificial Sequence
  Description of Artificial Sequence: Synthetic coding sequence
atggagcggagcttcgtgtggctgagctgcctggacagcgacagctgcaatcttacgttccgtttgggggaggtggaatcccatgcttgctccccgtctctgctctggaatctgctaacgcaatacctcccccccggggccggccatatattaagaacttataatttccccgtgcttagttgtgtttcttcttgtcacctgattggaggaaagatgcccgagaattag

SEQ ID NO: 45788 - DNA, 228 bp, Artificial Sequence
  Description of Artificial Sequence: Synthetic coding sequence
atggagcggagcttcgtgtggctgagctgcctggacagcgacagctgcaatcttacattccggttgggcgaagtggagtctcacgcttgctcacctagtttgctgtggaacctgctgacacagtacttacctccgggagccggccatatcctgcggacctacaattttcccgtcttgtcatgcgtttcctcatgccacttgattggtgggaagatgccagaaaactag

SEQ ID NO: 45789 - DNA, 228 bp, Artificial Sequence
  Description of Artificial Sequence: Synthetic coding sequence
atggagcggagcttcgtgtggctgagctgcctggacagcgacagctgcaacctaacctttaggcttggagaggtggaaagccatgcttgttctccatcccttctctggaacttacttacgcagtatctcccacccggggctgggcacatcctgcggacgtacaatttccccgtgctttcctgcgtgtcttcgtgtcacctcattggggggaagatgcccgagaattag

SEQ ID NO: 45790 - DNA, 228 bp, Artificial Sequence
  Description of Artificial Sequence: Synthetic coding sequence
atggagcggagcttcgtgtggctgagctgcctggacagcgacagctgtaacctgacctttcggctcggtgaagtcgagagtcatgcttgttctccgtcgctgctgtggaacctgctcactcaataccttccgcccggggcagggcatattttacgtacttacaatttccccgttctaagttgcgtgtcttcgtgccacctcattgggggcaaaatgcccgaaaactag

SEQ ID NO: 45791 - DNA, 228 bp, Artificial Sequence
  Description of Artificial Sequence: Synthetic coding sequence
atggagcggagcttcgtgtggctgagctgcctggacagcgacagctgtaacctcactttcagattaggggaggtcgagagccacgcgtgcagccccagtctgctctggaacctgctcacacagtacctgcctccgggagctggccatattctacggacttataattttccagttctctcttgcgtttcttcctgccatctgattggcggaaagatgcctgagaactag

SEQ ID NO: 45792 - DNA, 228 bp, Artificial Sequence
  Description of Artificial Sequence: Synthetic coding sequence
atggagcggagcttcgtgtggctgagctgcctggacagcgacagctgtaacctgacatttcggttgggggaagtagaatcccacgcatgttctcctagtctgttgtggaacttgcttacccagtatctgcctcccggtgcagggcatatcttgcgaacttataactttcccgttttgagttgcgtgtcctcttgccatcttattggcgggaagatgccagaaaactag

SEQ ID NO: 45793 - DNA, 228 bp, Artificial Sequence
  Description of Artificial Sequence: Synthetic coding sequence
atggagcggagcttcgtgtggctgagctgcctggacagcgacagctgcaatcttacatttcggctgggcgaagtggagtcccatgcctgtagcccgtccctattgtggaacttgctgacacagtaccttcctcccggcgcgggacacatcttaaggacttataatttcccagtgctgtcttgtgtgtcatcttgtcatttgatcgggggaaagatgcccgaaaactag

SEQ ID NO: 45794 - DNA, 228 bp, Artificial Sequence
  Description of Artificial Sequence: Synthetic coding sequence
atggagcggagcttcgtgtggctgagctgcctggacagcgacagctgcaatctgacatttcgactgggagaggtggaatcacacgcttgcagtcccagtttactgtggaacctgctcacacaatacctaccccctggggccggccacatccttcgcacatacaacttccccgttctctcatgtgtgagctcttgccatctgatagggggtaaaatgcctgaaaactag

SEQ ID NO: 45795 - DNA, 228 bp, Artificial Sequence
  Description of Artificial Sequence: Synthetic coding sequence
atggagcggagcttcgtgtggctgagctgcctggacagcgacagctgcaacctgactttccgactcggcgaggttgagtctcatgcatgctccccttcactgctctggaatctgctcacccagtatctgcctccaggggccggtcatatcctgcgtacatacaacttccctgtgttgagttgcgtttcatcctgccacctgataggagggaaaatgcccgaaaactag

SEQ ID NO: 45796 - DNA, 228 bp, Artificial Sequence
  Description of Artificial Sequence: Synthetic coding sequence
atggagcggagcttcgtgtggctgagctgcctggacagcgacagctgcaatctgaccttcaggttgggagaggtagagagtcacgcctgtagccctagtctcctttggaacctgctgactcaatatctgcctcctggcgctggacatatacttaggacctacaattttcctgtgctatcttgtgtgtcatcctgccacctgattggggggaaaatgcctgagaactag

SEQ ID NO: 45797 - DNA, 228 bp, Artificial Sequence
  Description of Artificial Sequence: Synthetic coding sequence
atggagcggagcttcgtgtggctgagctgcctggacagcgacagctgtaatctcactttccggctcggcgaggtcgagtctcacgcttgctcgccatcactgctgtggaatttgctgacccagtatctgccccctggtgccggccacatacttcgaacatataatttcccagttttgtcctgcgtgagttcgtgccacctgatcggcgggaagatgcccgaaaattag

SEQ ID NO: 45798 - DNA, 228 bp, Artificial Sequence
  Description of Artificial Sequence: Synthetic coding sequence
atggagcggagcttcgtgtggctgagctgcctggacagcgacagctgcaaccttactttcagactcggagaggtggagagccacgcatgttccccgtctctcctgtggaatttactgacccaatatcttcctcccggcgccgggcatattttacgcacatataacttccctgtcctgagttgcgtctcatcttgccacctcataggtggcaaaatgccagaaaactag

SEQ ID NO: 45799 - DNA, 228 bp, Artificial Sequence
  Description of Artificial Sequence: Synthetic coding sequence
atggagcggagcttcgtgtggctgagctgcctggacagcgacagctgcaacctcacgttcagattaggcgaagtcgaatctcacgcgtgcagccccagcttactgtggaacttgctgacccagtacctcccgcccggcgccggacatatcctccggacttataactttcccgtgctttcttgtgtgagttcctgccatctgattggcgggaagatgcctgagaattag

SEQ ID NO: 45800 - DNA, 228 bp, Artificial Sequence
  Description of Artificial Sequence: Synthetic coding sequence
atggagcggagcttcgtgtggctgagctgcctggacagcgacagctgcaatctcacatttcgccttggcgaggttgagagtcatgcctgttccccctctctgctgtggaatctgcttacccagtatctccctcccggcgccgggcacattttgagaacctacaactttccagtgctcagttgcgttagctcctgtcacctgataggtggcaagatgccagagaactag

SEQ ID NO: 45801 - DNA, 228 bp, Artificial Sequence
  Description of Artificial Sequence: Synthetic coding sequence
atggagcggagcttcgtgtggctgagctgcctggacagcgacagctgcaacctgacattcaggttaggtgaggtagaaagtcatgcttgttcgccatcccttttatggaacctgctgactcagtacctccctcctggagccggacatattctcagaacgtataattttcccgtgctcagttgcgtgagttcatgtcaccttatcggtggtaagatgcccgaaaactag

SEQ ID NO: 45802 - DNA, 228 bp, Artificial Sequence
  Description of Artificial Sequence: Synthetic coding sequence
atggagcggagcttcgtgtggctgagctgcctggacagcgacagctgcaacttgacattccggttgggcgaggtcgagagccacgcctgtagcccaagcctgctgtggaatctgctcacccagtatctcccaccaggagccggtcatatactgaggacctacaatttcccagtgctctcttgtgtgagctcatgtcatcttatcggtggaaagatgcctgagaattag

SEQ ID NO: 45803 - DNA, 228 bp, Artificial Sequence
  Description of Artificial Sequence: Synthetic coding sequence
atggagcggagcttcgtgtggctgagctgcctggacagcgacagctgtaacctgacatttcggttgggtgaagtcgagagtcacgcttgcagtccatcgctgctatggaacctcttgacccaatacctgcctccaggcgcggggcacatacttcgaacatataacttccccgtgctgagctgcgtgtcctcttgtcacctgattggaggtaaaatgcctgagaattag

SEQ ID NO: 45804 - DNA, 228 bp, Artificial Sequence
  Description of Artificial Sequence: Synthetic coding sequence
atggagcggagcttcgtgtggctgagctgcctggacagcgacagctgtaacctgacttttaggctgggtgaggtggagtcacatgcttgttcaccatccctgttatggaacctcttgacccagtatctgccaccaggcgctggacatatacttcgcacctataacttcccggtgctgtcttgcgtatcgtcttgccatttaataggaggaaagatgcccgagaattag

SEQ ID NO: 45805 - DNA, 228 bp, Artificial Sequence
  Description of Artificial Sequence: Synthetic coding sequence
atggagcggagcttcgtgtggctgagctgcctggacagcgacagctgtaacctgacattccgattgggcgaagtggagagtcacgcctgtagcccatctctcttatggaatctcctgacacagtatctcccacctggggccggccatatcctgaggacatataactttcctgttctcagttgtgtaagcagctgccacctgattggaggtaagatgccagagaactag

SEQ ID NO: 45806 - DNA, 228 bp, Artificial Sequence
  Description of Artificial Sequence: Synthetic coding sequence
atggagcggagcttcgtgtggctgagctgcctggacagcgacagctgcaatctgacattcagactcggagaagttgaatctcatgcatgttcgccatctctcctctggaatttgctcactcagtacctgcctcccggagcaggccacattttacggacttataactttcctgtcctctcttgcgtatcatcttgccacttaatcggggggaagatgcccgagaactag

SEQ ID NO: 45807 - DNA, 228 bp, Artificial Sequence
  Description of Artificial Sequence: Synthetic coding sequence
atggagcggagcttcgtgtggctgagctgcctggacagcgacagctgtaatctcaccttcagactgggagaagtcgagagccacgcttgtagcccgagcttactctggaacttactgacccagtacctgccaccgggcgcgggccatattctgcggacctacaatttccccgtcctaagttgtgtatccagctgtcatctcattggaggaaagatgccagaaaattag

SEQ ID NO: 45808 - DNA, 228 bp, Artificial Sequence
  Description of Artificial Sequence: Synthetic coding sequence
atggagcggagcttcgtgtggctgagctgcctggacagcgacagctgtaatttgacatttcggctcggggaggttgaatctcacgcctgctctccaagtctcctgtggaacctgttgacacagtacctcccacccggcgctgggcacatcttacggacatacaatttcccagttctgtcatgcgttagttcttgccacctaattggaggaaaaatgcccgaaaactag

SEQ ID NO: 45809 - DNA, 228 bp, Artificial Sequence
  Description of Artificial Sequence: Synthetic coding sequence
atggagcggagcttcgtgtggctgagctgcctggacagcgacagctgcaacctgacattcagattgggcgaagtcgagtcccacgcttgcagtccatccctgctgtggaacttgctcactcagtatttgccccccggcgcaggccacatccttagaacctacaattttcctgttctcagctgcgtgtcatcatgtcacctgataggtggaaaaatgcctgaaaattag

SEQ ID NO: 45810 - DNA, 228 bp, Artificial Sequence
  Description of Artificial Sequence: Synthetic coding sequence
atggagcggagcttcgtgtggctgagctgcctggacagcgacagctgcaacctgactttccggctcggcgaagtcgaatcacacgcatgctcccctagcctcctatggaacctgctcacccagtaccttccccccggcgcgggacatattttacgaacttacaattttcctgtgttgtcgtgtgtatcctcatgccatctcatcggagggaaaatgcctgaaaactag

SEQ ID NO: 45811 - DNA, 228 bp, Artificial Sequence
  Description of Artificial Sequence: Synthetic coding sequence
atggagcggagcttcgtgtggctgagctgcctggacagcgacagctgtaatctgacatttcgcttgggagaggtggaaagtcacgcctgctctcccagtctgctctggaatttgctgacacaatatctcccaccaggagccgggcatatattaagaacctataacttcccggtgcttagctgtgtgtcttcgtgccacttgataggtggcaagatgccagagaattag

SEQ ID NO: 45812 - DNA, 228 bp, Artificial Sequence
  Description of Artificial Sequence: Synthetic coding sequence
atggagcggagcttcgtgtggctgagctgcctggacagcgacagctgcaatttaaccttccgcctcggagaagttgaatcgcatgcttgctcccctagcctgttatggaatctcctgactcagtacctgcctcctggggccggccacatcttacggacgtacaattttccagtcctgagttgcgtgtcttcttgccacctgattggcggtaagatgccagaaaattag

SEQ ID NO: 45813 - DNA, 228 bp, Artificial Sequence
  Description of Artificial Sequence: Synthetic coding sequence
atggagcggagcttcgtgtggctgagctgcctggacagcgacagctgcaatctaaccttcagacttggagaagtcgagtcacatgcttgctctccatcactgctgtggaatttacttacgcaatacctccctcctggtgcaggacacattctgaggacatacaacttcccggtcctgtcatgcgtctcaagctgtcacttgatcggaggcaaaatgccagaaaattag

SEQ ID NO: 45814 - DNA, 228 bp, Artificial Sequence
  Description of Artificial Sequence: Synthetic coding sequence
atggagcggagcttcgtgtggctgagctgcctggacagcgacagctgcaacctgacattccggctgggcgaggttgagtcacacgcttgtagtccatctcttttgtggaatctacttacgcagtatctgccaccaggtgcgggccatattctgaggacgtataatttccctgtgctgagctgtgtgtcaagctgccacttaattggtgggaagatgcctgagaattag

SEQ ID NO: 45815 - DNA, 228 bp, Artificial Sequence
  Description of Artificial Sequence: Synthetic coding sequence
atggagcggagcttcgtgtggctgagctgcctggacagcgacagctgcaatctcacatttcggctcggagaggtggagtctcatgcctgctctccctcacttctttggaatcttctgactcagtacctgcctccaggagccggacatatcctacggacttacaattttcccgtactttcctgtgtgagttcatgtcacttgatcgggggaaagatgcctgagaactag

SEQ ID NO: 45816 - DNA, 228 bp, Artificial Sequence
  Description of Artificial Sequence: Synthetic coding sequence
atggagcggagcttcgtgtggctgagctgcctggacagcgacagctgcaatctcaccttcagactgggagaagtcgaatctcatgcctgcagccctagtctgttatggaatctgctgacccagtaccttccacccggtgccggccacattctgagaacctacaattttccggtgctttcatgcgttagcagttgtcacctgataggaggtaaaatgcccgagaactag

SEQ ID NO: 45817 - DNA, 228 bp, Artificial Sequence
  Description of Artificial Sequence: Synthetic coding sequence
atggagcggagcttcgtgtggctgagctgcctggacagcgacagctgcaatctgacattcaggctcggcgaggtggaatcccacgcgtgcagtccttccttgctatggaacttgctcactcagtatctgccacccggagcagggcatattttgcggacatataactttcccgtcctcagctgcgtcagctcgtgccacctgatcggcggaaagatgcccgaaaactag

SEQ ID NO: 45818 - DNA, 228 bp, Artificial Sequence
  Description of Artificial Sequence: Synthetic coding sequence
atggagcggagcttcgtgtggctgagctgcctggacagcgacagctgtaatcttactttccggcttggagaagtggagtctcacgcctgctctcctagcttgctgtggaatctgctcacgcaatatctgccaccaggcgccggacatatattgcggacctacaatttcccagtcctgagttgcgtgtcttcttgccacctgattggtggcaaaatgccagaaaactag

SEQ ID NO: 45819 - DNA, 228 bp, Artificial Sequence
  Description of Artificial Sequence: Synthetic coding sequence
atggagcggagcttcgtgtggctgagctgcctggacagcgacagctgtaatctgacattccgcttaggagaggtggagtcccacgcctgtagtccctctctgctgtggaaccttctcactcagtatctgcctccgggagccggccacatcctgagaacttataattttccagttttatcttgcgttagcagctgccacctaattgggggtaagatgcccgagaactag

SEQ ID NO: 45820 - DNA, 228 bp, Artificial Sequence
  Description of Artificial Sequence: Synthetic coding sequence
atggagcggagcttcgtgtggctgagctgcctggacagcgacagctgtaacctgacatttagattgggggaggtcgaatcacatgcatgttccccctcattgctttggaacctcctgacgcagtacctgcctcccggcgccggtcacatcctgagaacatacaacttccctgtgttaagctgtgtaagctcttgtcatttgatcggaggtaaaatgcctgagaattag

SEQ ID NO: 45821 - DNA, 228 bp, Artificial Sequence
  Description of Artificial Sequence: Synthetic coding sequence
atggagcggagcttcgtgtggctgagctgcctggacagcgacagctgtaatctgacctttagactaggagaagtagagtctcacgcttgttctccctccttgttgtggaaccttcttacccagtatctacccccaggcgctgggcatattcttcggacttacaattttccggttctgtcttgtgtgagttcatgtcacctgatcggcggtaaaatgccagaaaactag

SEQ ID NO: 45822 - DNA, 228 bp, Artificial Sequence
  Description of Artificial Sequence: Synthetic coding sequence
atggagcggagcttcgtgtggctgagctgcctggacagcgacagctgcaatctaacctttaggctgggagaggtcgaaagccacgcctgttctccctcactgttgtggaatctgctcacccaatacttgcctcccggagcaggacatatcctgcgcacatataacttcccggtactgagctgcgtgtcttcctgccaccttatcggaggaaaaatgccagagaactag

SEQ ID NO: 45823 - DNA, 228 bp, Artificial Sequence
  Description of Artificial Sequence: Synthetic coding sequence
atggagcggagcttcgtgtggctgagctgcctggacagcgacagctgcaatctgacctttcgcctgggcgaggtcgagtcacacgcttgctccccctccctcctgtggaacctgttgacgcagtacctccctcctggcgccggccacatactgaggacttacaatttcccagtgctgagttgtgtgagttcatgccatctgattgggggaaaaatgcccgaaaactag

SEQ ID NO: 45824 - DNA, 228 bp, Artificial Sequence
  Description of Artificial Sequence: Synthetic coding sequence
atggagcggagcttcgtgtggctgagctgcctggacagcgacagctgcaatctgaccttcaggctaggagaggtcgagtctcacgcttgctcaccttccctgctttggaacctcctgactcagtatttaccccccggagcggggcatattctacgcacctacaacttccctgtgttaagttgtgtctccagctgtcacctgattggcggaaaaatgcccgaaaactag

SEQ ID NO: 45825 - DNA, 297 bp, Artificial Sequence
  Description of Artificial Sequence: Synthetic coding sequence
atgcgggtggtgatggcccggctgctgagcgagggcgagcagggcatcccaaccgcatgcgctgcttttgctcagcagccagcagggcctcgccgtggactcgctggggtgggtgagggcggcccccagtgcagctgggtgaactataggtgtacgttagaatttctggtctccctcttaggaaccgatctggccagaggcagaggcaacagtgcaagcggcccaacagcccctgccgatagtaaacagttgtcatgcaagacctttatcgccgtcctgtctctatctaaggagtag

SEQ ID NO: 45826 - DNA, 378 bp, Artificial Sequence
  Description of Artificial Sequence: Synthetic coding sequence
atgcgggtggtgatggcccggctgctgagcgagggcgagcagggcattccgactgcctgtgcagcttttgctcaacaacccgcaggacctaggcgtggtctagcaggagtgggggagggtggaccacaatgttcttgggtgaattaccgttgtaccctcgagtttcttgtcagcttacttggcacggacctggcgcggggaaggggaaatagtgcgtccggtccaacagcaccggccgacagtaagcagttaatgaattccggctcacccgccagggataacgctccaagccagaggttctgtaccaatctcagtgaggggttaagattcggcataagcccatcttggagggaagctctctatgggtgtcatgcatag

SEQ ID NO: 45827 - DNA, 297 bp, Artificial Sequence
  Description of Artificial Sequence: Synthetic coding sequence
atgcgggtggtgatggcccggctgctgagcgagggcgagcagggcatccccaccgcgtgcgctgccttcgctcagcagcccgccgggccgagacgtggccttgcgggcgtgggagagggaggcccacagtgcagctgggtgaactacagatgtaccctcgagtttctcgttagtctgttagggactgatcttgcacgaggtagggggaacagtgcctcaggacccacagcccccgcagacagtaaacagctgagttgcaaaactttcatcgcggtgctgagtctgtctaaggagtag

SEQ ID NO: 45828 - DNA, 378 bp, Artificial Sequence
  Description of Artificial Sequence: Synthetic coding sequence
atgcgggtggtgatggcccggctgctgagcgagggcgagcagggcattccaaccgcctgcgctgcatttgcccaacaacctgccggcccacggagggggctggcgggagtcggcgaaggcggcccacaatgctcatgggttaattataggtgcaccctggagttccttgtgagtctgcttgggactgacctggcgaggggcaggggtaactcagccagcggaccaacagcccccgccgatagtaagcaactgatgaattccggctctccggcccgtgataatgctccctcacagaggttttgcaccaatctttccgaaggcctccggttcggcattagccccagttggcgagaggcactctacgggtgccacgcctag

SEQ ID NO: 45829 - DNA, 297 bp, Artificial Sequence
  Description of Artificial Sequence: Synthetic coding sequence
atgcgggtggtgatggcccggctgctgagcgagggcgagcagggcattcccacggcctgcgccgcctttgctcaacaacctgcaggcccacggcgtggattggccggcgtcggagaggggggtccacagtgctcttgggtaaactataggtgtaccttagagtttctggtcagtctgctgggcacggacttggctcgcgggaggggcaactcagcgagtgggcccacagcccccgctgactccaaacagctgtcatgtaaaaccttcattgctgtattaagtttaagtaaggaatag

SEQ ID NO: 45830 - DNA, 297 bp, Artificial Sequence
  Description of Artificial Sequence: Synthetic coding sequence
atgcgggtggtgatggcccggctgctgagcgagggcgagcagggcattcccaccgcttgtgctgcgttcgcccagcagccagcaggaccgcggaggggcctggccggcgtgggcgaaggggggccacagtgcagctgggttaactaccggtgtactctggaattcctggttagcctgctggggacagacctggcacgagggagaggtaatagcgctagcggtcccaccgcccctgctgactctaaacagctgtcttgcaaaacctttatagctgtactctcactgagcaaggagtag

SEQ ID NO: 45831 - DNA, 378 bp, Artificial Sequence
  Description of Artificial Sequence: Synthetic coding sequence
atgcgggtggtgatggcccggctgctgagcgagggcgagcagggcattcctaccgcctgcgcagcattcgcacagcagccggccggcccacgaagaggcctcgcaggtgtgggagaaggtgggccccaatgctcctgggttaactatagatgcacgctggagttcttggtgagcctgctggggacagacctggctcggggtagggggaattctgccagcggaccaaccgctcccgctgattctaagcagcttatgaacagcggtagtcctgccagggataacgctccctctcagaggttctgcacaaacttgtccgaaggcctccgattcggcatctccccatcttggagagaggccctctacgggtgccatgcgtag

SEQ ID NO: 45832 - DNA, 378 bp, Artificial Sequence
  Description of Artificial Sequence: Synthetic coding sequence
atgcgggtggtgatggcccggctgctgagcgagggcgagcagggcatcccgactgcatgcgcagcctttgcacagcaacctgccggccctaggagaggactggccggtgtgggagaaggcggccctcagtgctcatgggtgaattatcggtgtacattagaatttttagtgtctctgctgggtaccgacctagctagaggtagggggaatagtgcctctgggcctacggccccggctgatagtaaacagctcatgaacagcggaagcccagcacgggataatgcaccttcgcagagattttgtaccaacctctcggagggcttgcgatttggaatctccccaagttggcgtgaggcgctatacggatgtcacgcttag

SEQ ID NO: 45833 - DNA, 297 bp, Artificial Sequence
  Description of Artificial Sequence: Synthetic coding sequence
atgcgggtggtgatggcccggctgctgagcgagggcgagcagggcatcccgactgcctgcgctgcctttgcacaacagccagcaggaccgagacggggactcgcgggcgtgggagaggggggacctcagtgctcttgggtcaattaccgctgtactctagagtttctcgtgagccttctgggaacggatctggctaggggtagaggcaattcagcatctgggcccaccgcccctgccgatagcaagcagcttagctgtaaaactttcatcgcagtactgtcactgtcaaaggaatag

SEQ ID NO: 45834 - DNA, 459 bp, Artificial Sequence
  Description of Artificial Sequence: Synthetic coding sequence
atggcccagcccgagagcagcgccgacttcggcatcgcccagcagaacaattactattgctactggcaatctctcccttcggccatccgcgtaaaacaggagtttcagccaagccagagttaccggtacggaaactggtatgctaggcaacatggaagttacctgctgtccgggtactcgtacgggtgcgccgtggatggcaacggaaaggactgctttagcgcgcatgagaccccggagcacaccgctggaacattggttatgcccaaggagactacgccattggcggagaaccaggacgaggaccctctggaggatccgcatctgcatctgaacatcgaggagagtaaccaagaattcatggtgaagtcagaggaattgtacgattctctgatgaattgccattggcagcccctcgacacagtgcatagtgagatccctgacgaaacgccgaagtag

SEQ ID NO: 45835 - DNA, 198 bp, Artificial Sequence
  Description of Artificial Sequence: Synthetic coding sequence
atgcccaaggagaccacccccctggccgagaaccaggacgaggaccccttagaggaccctcatctgcacctcaatatcgaagagagcaatcaggagttcatggtgaaaagcgaagagctgtatgattctttgatgaattgccattggcaaccgcttgatacagtgcattccgagatccccgacgagacccctaagtag

SEQ ID NO: 45836 - DNA, 603 bp, Artificial Sequence
  Description of Artificial Sequence: Synthetic coding sequence
atgagcgagaacctgagcgaccccgtgagccccgtggtgcggaagaaaaagagtgccctctttgaagtttccgaagtaattccagtgatgaccaacaattacgaagagaacatcctgaagggcgtaagggatagctcttacagcctcgaatcttcccttgaactgttgcaaaaggacgtggtgcaactccacgctcctcgctatcaatccatgcgtagagacgtgatcgggtgtactcaggaaatggatttcatcctctggcccaggaacgacatagaaaagattgtatgtctgctgttcagcaggtggaaggagtcagatgaaccctttaggcccgtacaggcaaaatttgagttccaccacggagactacgagaagcaatttctccatgtgctgtctaggaaagacaagactggaatagtagttaataacccaaatcaaagcgttttcctgtttattgaccgccagcacctgcagacccctaaaaataaggctaccatttttaagctgtgttcaatttgcctgtacctgccacaggaacaactcacacactgggcagtgggaactatcgaggatcaccttcgcccgtatatgcctgaatag

SEQ ID NO: 45837 - DNA, 690 bp, Artificial Sequence
  Description of Artificial Sequence: Synthetic coding sequence
atgggcgaccccaacagccggaagaagcaggccctgaaccggctgcgcgcccagctcagaaagaagaaagagtccctcgccgatcagtttgattttaagatgtatattgcttttgtcttcaaggaaaagaagaagaaatccgcactgttcgaagtttccgaggtaatacctgtgatgaccaacaactacgaagaaaatatcttaaagggagtcagggactcgagctactcgctggagagcagcctcgaactgctgcagaaagacgtcgtgcagctgcacgcgccccgctaccagtcaatgagaagagacgttattggatgcacccaagagatggatttcatcctctggcctcggaatgacatcgagaagattgtgtgtttactcttctcaaggtggaaagagagcgacgaaccatttcgacctgtccaggccaagttcgagtttcatcacggggactatgagaagcagttccttcacgtgctctcccggaaagataaaaccgggattgtggtcaacaaccctaaccaaagtgtttttctgttcatcgaccgacagcacctgcaaacgcctaaaaataaagctactatctttaaattgtgcagtatctgcctgtatttgccccaggaacagcttacgcactgggccgtcggcaccatcgaggatcacctacgtccttatatgccggaatag

SEQ ID NO: 45838 - DNA, 516 bp, Artificial Sequence
  Description of Artificial Sequence: Synthetic coding sequence
atgaccaacaactacgaggagaacatcctgaagggcgtgcgggacagctcctattcacttgaaagctcattggagctgctgcagaaggatgtggtccagctgcacgctccacggtatcagtctatgcggagggatgttataggctgcacccaggaaatggatttcattctctggccccggaatgacatagagaaaatcgtgtgcctccttttctcgcgatggaaggagtctgatgagccctttagacccgtgcaggctaagttcgagttccaccacggagactatgagaagcaattcttacacgttctctcccggaaggataaaaccgggattgttgtgaataaccctaaccaaagtgttttcctcttcatcgaccggcaacacttacagactcccaagaataaagcaacgatattcaagttgtgttccatctgcctctatctgccccaggaacaattaacccattgggcagtgggaacaattgaggaccacttgcgtccctacatgcctgagtag

SEQ ID NO: 45839 - DNA, 669 bp, Artificial Sequence
  Description of Artificial Sequence: Synthetic coding sequence
atggccggcgccgagcccttcctggccgacggcaaccaggagctgttcccgtgcgaggtctgcggcagaagattcgccgccgacgttttggaaaggcatggtcccatctgcaagaaactgtttaacagaaagaggaagcccttctcaagcctcaagcagcgactccaagggacagatatcccaaccgtcaaaaaaacccctcaaagcaaatccccacccgtgcgtaaaagcaactggcgccagcaacatgaggattttattaacgccattcgatctgcaaaacagtgtatgttagcgattaaggagggccggcccctgcctcccccacccccgcccagcctcaaccccgactatatccaaagaccctattgtatgagacgcttcaacgagagcgcagccgaaaggcacaccaatttctgtaaagatcagtcttctaggcgtgtgttcaatccagcccagactgccgcgaagctggcgtcccgggctcagggccgggctcagatggggccaaaaaaggagccgactgtaacatccgcggtgggggcactcctgcagaacagagtgttggttgcaacaaacgaggtcccgacaaaatccggactcgctatggaccccgcaagcggcgctaagctccgccaggggttttccaaatctagcaaaaaagattag

SEQ ID NO: 45840 - DNA, 465 bp, Artificial Sequence
  Description of Artificial Sequence: Synthetic coding sequence
tgaggcaaccaggagctgttcccctgcgaggtgtgcggccggcggtttgctgccgatgtcctcgaaagacacggtcccatctgtaaaaagctctttaacagaaaaagaaagccattcagcagcttgaagcagagattgcaaggcacagacataccgacggtgaagaagacgccccagagcaagtcgcccccagtgcggaagagcaactggcgtcagcagcacgaggacttcattaacgctatccgtagtgcgaaacagtgtatgctggccattaaggagggaaggccactgcctcccccaccacccccctctctgaatcctgactatatccagcggccgtattgtatgcgaagattcaacgaaagtgcagccgaacggcatactaacttctgtaaagatcagagtagccgtagagtcttcaatccggctcagaccgcggccaagctggcctcaagggctcaatag

SEQ ID NO: 45841 - DNA, 348 bp, Artificial Sequence
  Description of Artificial Sequence: Synthetic coding sequence
cccccccccccccccagcctgaaccccgactacatccagcggccctactgtatgcggagatttaacgaaagcgccgcagagcggcataccaacttctgtaaggaccagtcctctcggagagtgttcaaccctgctcagactgcagccaaacttgctagcagggcccaaggcagggcccagatgggtccgaaaaaggagccaacagtgacatctgccgttggcgccctcttgcaaaatcgggttcttgtggcaacgaacgaagtgcctactaaatccggactggcgatggatcccgcctcaggagcaaagctgagacagggttttagtaaatcctcaaagaaagactag

SEQ ID NO: 45842 - DNA, 381 bp, Artificial Sequence
  Description of Artificial Sequence: Synthetic coding sequence
atgctggccatcaaggagggccggcccctgcccccccccccccccccgtctctgaaccctgattatatccagagaccttactgcatgcgccgcttcaatgaaagtgccgccgaaagacacacgaatttctgtaaggaccagtcttccaggcgggtctttaatccagctcagacagctgcgaaactggcctcccgagcgcagggtcgagcacagatggggcccaagaaagagccgactgtaacaagcgccgttggtgcacttctccagaatcgcgtcctcgtggcgacaaacgaagtccctacaaagagcggcctggccatggatcccgcgagtggtgctaaattgaggcaggggttctcaaagagctccaagaaggattag

SEQ ID NO: 45843 - DNA, 2148 bp, Artificial Sequence
  Description of Artificial Sequence: Synthetic coding sequence
atgagcctggactgcaccagccacatcgccctgggcgccgccagccccgcccccgaagagacatacgatcatctttctgaagtacctgtgacacgtgagcagctgaaccactatagaaatgtcgcccagaatgcccgctctgaacttgccgccaccctagttaaatttgaatgcgcacagtccgagcttcaggatttgcggagcaagatgttgtccaaggaggtgtcgtgccaagagcttaaggccgagatggagagctacaaagaaaataacgcccggaagagctcactcttgacatctttgcgggaccgggtgcaggagttagaggaagagtctgccgcattaagcactagcaagatccgaaccgagattaccgcccatgccgccattaaagaaaaccaagagctcaaaaaaaaggtagtggaactgaatgaaaaactgcagaaatgctctaaggagaacgaggaaaataagaagcaggtaagtaaaaattgcagaaagcatgaggagttcctgacgcaactccgcgactgtttggacccagacgagaggaacgacaaagctagcgacgaagacttgatcctaaagttgcgggatctgcggaaggagaacgagttcgtgaagggtcagattgtgatccttgaggagaccataaatgtacatgagatggaagctaaggctagtagggagacaatcatgagacttgctagcgaggttaatcgcgagcagaagaaagctgcctcctgtactgaggaaaaggagaaactgaaccaagatctgctgtccgccgtggaggccaaagaggcgttggagcgcgaggttaagatcttccaggaaagacttctagcaggtcagcaggtgtgggatgcgagcaagcaggaagtcagtttgctgaaaaaaagctcctcggagctggagaagagcctcaaggccagtcaggacgctgtcactacatctcaatcccagtatttctctttccgcgaaaaaatcgccgcgctgctgcgcgggagactgagcatgactgggtctacagaggatactatccttgagaagatccgggagatggacagtcgcgaagagagtagggatcgaatggtgagccagctggaagctcagattagtgagttggtagaacagcttggcaaggagtcagggtttcaccagaaggccttacagagagctcagaaggccgaaaatatgcttgagactcttcaggggcagctcacccatctggaagccgaactggtttctggaggcgtactgagggataatctgaattttgagaaacagaaatatctaaagtttctcgatcaactttcgcagaagatgaaactagaccaaatggcagctgaattggggttcgatatgcgattggatgtggttctggcacggacagaacagctcgtacgcttagaatccaatgccgtgatcgaaaacaaaactatagcccacaatcttcaaagaaagttgaagacccagaaagaacgcctggagtcaaaagaactgcacatgagcctgctcagacaaaaaattgcacagttggaagaggaaaagcaggcgcgtactgctttagtggttgagagagataatgctcacttgactatccggaatttacagaaaaaggtagaaaggctgcagaaggagctgaatacctgccgtgatctgcatactgagttgaaagctaaattggcagacacgaacgagcttaaaatcaagacgctggagcaaacaaaagcaattgaagacctgaacaaatcacgggaccagttggagaagatgaaagagaaggccgaaaaaaaactcatgtctgtaaagtctgagcttgacacaactgagcacgaggcgaaggagaacaaggagagggcgaggaatatgattgaggtcgtgacaagcgagatgaaaactcttaagaaatcactcgaggaggccgagaaaagggaaaagcagctggccgattttcgggaggtggtcagccagatgctgggactgaacgtgaccagcctggccttacccgattacgaaataataaagtgtctggaaagactggttcactcccaccagcatcatttcgtcacttgcgcctgcctcaaggacgtaaccaccggccaggagaggcacccacagggacatttacaactgctccactag

SEQ ID NO: 45844 - DNA, 2169 bp, Artificial Sequence
  Description of Artificial Sequence: Synthetic coding sequence
atgagcctggactgcaccagccacatcgccctgggcgccgccagccctgcccctgaagagacatacgaccacctgtccgaggtgcctgtgacgcgggaacagctcaaccattaccgcaatgtggcccaaaatgctcgctctgagctcgccgcaaccctggtaaaattcgaatgcgcgcaaagcgaactgcaggacctgaggagtaaaatgctgtccaaggaggtgagctgtcaagagttaaaagccgagatggaatcctataaggagaacaacgctagaaagagcagcctgttgaccagtctgcgtgaccgcgtgcaggaactcgaggaggaaagtgcagcactcagcacgagcaagattcggaccgaaataactgcccacgctgccataaaagagaatcaagagttaaagaagaaggtggtggaacttaatgagaagctgcagaaatgttcaaaagagaacgaggagaacaaaaagcaagtttccaaaaattgtcgcaagcacgaggagtttttgacacaactacgtgattgtctggacccggacgagcgaaatgataaggcaagcgatgaggatctcattctgaagctgagggatctacggaaagaaaacgaattcgtgaagggccaaatcgtgattcttgaggaaacgatcaacgttcacgaaatggaggccaaggcctcacgggagacaataatgcgtttagccagtgaggtcaacagagagcaaaaaaaagccgcatcctgcaccgaagagaaggagaagcttaatcaggatctcttgtctgccgttgaggctaaggaggccttggagcgtgaggtgaaaatcttccaggagaggctcctagccgggcaacaggtttgggacgcatccaagcaggaggtaagtctacttaaaaaaagcagttctgaattggagaagagtctcaaggcctcccaagatgcagtcaccacgagtcagtcccagtatttctccttcagagaaaaaatagccgcgctccttcgtgggcggctgtccatgaccggctcaacagaggacacaatactggagaaaatcagggagatggattcacgggaggaaagtagggataggatggtcagccaactggaagcccagatatcagagctcgtggagcagctgggaaaggagtccggattccaccagaaggcattacaaagagctcagaaggctgagaatatgctggagacattgcaaggccagctgacccatttggaggccgagctcgtctctggtggagtgttgcgtgataaccttaactttgaaaagcagaagtatctgaagttcctagaccagctcagccagaagatgaagctggaccaaatggccgccgagttgggattcgatatgcggcttgacgtagtgctcgcccgcacggagcaactcgttcgcctcgaatccaatgccgtgattgaaaataagacaatagcgcacaatttacagcgtaagttgaagacccagaaagaacggctggaatcgaaagaactacatatgagcctcttgaggcaaaagatagctcaactggaggaagagaaacaggccagaaccgccttagtggtggagcgggataacgcccacctgaccatacgcaacctgcagaagaaagtagaacgcttgcagaaagaactaaacacctgtcgcgatttgcacactgagttaaaagcgaagttggctgacactaacgaattgaaagcgtcagcttggctgcattttattaagaccctggaacagaccaaggctatcgaagatctgaacaaatcccgggaccagcttgaaaaaatgaaagaaaaagccgagaaaaaactgatgtccgtgaagtctgagcttgatactacagaacacgaagctaaagagaacaaggaaagggctcgtaatatgatagaggttgtcacctctgagatgaagacgctcaagaaatctctggaagaagctgaaaagcgtgagaagcagctggccgattttcgggaagttgtctctcagatgctggggctcaatgttacatccctcgccctacccgactatgagataataaagtgcctggaaagactggtgcacagtcaccaacaccacttcgtgacatgcgcttgtctgaaggacgtgactacaggccaggagcgccacccgcaggggcaccttcagttgctccactag

SEQ ID NO: 45845 - DNA, 378 bp, Artificial Sequence
  Description of Artificial Sequence: Synthetic coding sequence
atgaagaacgaggagcactgccccggcagcttcttcctgtgcaagattagggagtgcgtgcttaactatcgtttccagcttcagcacccaggtttccagcattatctgcagagcagcgggaggagggacaggggcagaagcgaggataagaagccactggaagcgggtgtgtggtgttgggaccgcggtgggtgggacgggtcttctagggcagttcatctcttgtttcgcggggtcgcccatccatcactgtatctgtttccacgggaggaccctcccaggctgctcttccccaggctgtcactgctggtctgcgaacagttctggtgctactctgccactctgctcctcgcaccactccctgcctcaacgtgttag

SEQ ID NO: 45846 - DNA, 609 bp, Artificial Sequence
  Description of Artificial Sequence: Synthetic coding sequence
atgaacgccgccgtgccccccgagcaggcccacagctgcggctggggcacggagggatgcccttgtctcagaagcacagccattcgccagaccttcttccctggtggcgaccagttccagcgggatggtggcttggcaatgttacccatcctcgtttcaaaattcctggcatccagcgacccacctgtgtctgttcctgaaatgctaggattgcaaaatagatggcgtggtatgaagaacgaggaacattgcccgggtagtttcttcctctgtaagattcgtgagtgcgtgctcaactatcgatttcaactccagcaccccggcttccagcactatttgcagagctcaggcaggagggatcggggaagaagcgaagataagaaaccccttgaagcgggcgtctggtgttgggatcgtggcggctgggatggttcctcccgcgctgtccatcttctattccgaggagtagctcaccctagcttgtacctctttccgcgggaagacccccccaggttactattccctaggctctcccttctggtttgtgaacagttttggtgttactctgcgacacttctgctggcgcctcttccagcaagcacttgctag

SEQ ID NO: 45847 - DNA, 1266 bp, Artificial Sequence
  Description of Artificial Sequence: Synthetic coding sequence
atgagcgcccacagcatgctgtgcgagcggatcgccatcgccaaggagctgatcaagagagccgagagcctctcaagaagcaggaaaggtgggatcgaaggaggagccaaactctgcagtaagctgaaggccgagctcaagttcttacagaaagtggaggccggaaaagtggctatcaaggagagccacctgcagtcaacgaatctcacacatttaagagccattgtggaatccgcagagaacctggaggaggttgtctcagtactacacgtcttcggatacaccgatacgctaggggagaagcagactcttgttgtggacgtagtggctaatggaggccacacctgggttaaggcaatcgggcgcaaggctgaagctctgcataatatctggctcggacgaggccaatacggcgacaaatctattatcgaacaggcagaggattttcttcaggctagccatcagcagccagtacagtactctaatcctcatataatctttgctttctacaactcggtgtcatcccctatggctgagaagctaaaggaaatggggatcagtgttaggggggacatagttgccgtgaacgcccttctggatcatccagaggagctccagccgtccgagtctgagtcggatgacgaaggccctgagttattgcaagtgactagagttgaccgagaaaacattttggctagcgtcgcgttcccgaccgagattaaggtggatgtgtgtaaacgggtgaatctagatattactactctcataacttacgtgagcgcattatcttatggcggctgccatttcatttttaaggaaaaagttctgactgaacaggctgagcaggagcgaaaggagcaggtgctccctcagcttgaagcattcatgaaggacaaggaactcttcgcctgcgaatcagctgtgaaagactttcagagcatccttgatacgctgggaggcccaggtgagagggaaagagccacagtgcttattaagagaataaacgttgtccctgatcagccctccgaacgagcgctgagacttgtggccagcagtaagatcaattccagaagtctcacgattttcggaaccggcgacaccctgaaggccatcaccatgaccgcgaattccgggttcgtgcgggctgctaacaaccagggtgtcaagttctccgtgttcattcatcagccccgggcactgaccgaatccaaagaggctttggctacacctctcccaaaggactatacaaccgatagcgaacattag

SEQ ID NO: 45848 - DNA, 537 bp, Artificial Sequence
  Description of Artificial Sequence: Synthetic coding sequence
atgagcgcccacagcatgctgtgcgagcggatcgccatcgccaaggaattgattaaacgggctgagagtctcagtcggtcccggaaaggcggtatcgagggtggggccaaactgtgttcaaagctgaaggctgagctgaagtttctacagaaggttgaggccggcaaggtcgctatcaaagaaagccatctacagtctaccaatcttacacacctgcgcgcaattgtcgaaagcgctgaaaatcttgaggaggttgtctctgtcctccatgttttcggctacacagacacgctcggagagaagcaaacactggtcgtggatgtggttgctaatggaggacacacatgggtcaaagccatcggccgcaaggctgaggctctgcacaatatttggctgggccgcggccaatatggggacaagtcaatcatagagcaggctgaagatttcctccaggcgtcccaccaacagcctgtacaatatagcaatcctcatatcatctttgctttctataactccgtaagctccccaatggcttag

SEQ ID NO: 45849 - DNA, 1440 bp, Artificial Sequence
  Description of Artificial Sequence: Synthetic coding sequence
atgcaggaggtgcccgaggccgccggcctggcccgggtggagcccccgagaagatcatccggcgtcggcgctgcccggcttcgctttcccggaggttctcgcccattgcgcgcacgggcctgcgtgttggctctggcagtgttagcacttcccgagcgtaacaacgccgactccatgtccgcccactccatgttgtgcgaacggatcgccatagccaaagagctcattaaaagggctgaatcgctgtcacgcagcaggaaagggggcatcgagggtggagccaagctttgctctaagctaaaggctgagctgaagttcttacagaaggttgaggcgggcaaagtcgccataaaagagtcccacttgcagagtacaaacttgacacatttgagggctattgtcgaatcggcagagaacctggaagaggtggtgtctgtcctccatgtctttggatacacagatacactgggggaaaagcaaaccttggttgtcgatgtggtcgccaatggggggcacacatgggttaaggccatcggccgcaaagccgaagccctgcataatatctggctggggaggggtcagtacggcgacaagtccattattgagcaagccgaggactttctgcaggcatcccatcagcagcctgtacagtacagcaacccccacatcatcttcgccttttataactccgttagtagccccatggcggagaagctgaaagaaatgggtatttctgttcgcggagatattgtagccgtcaatgccttgctggaccatcccgaggaattgcagccatcagaaagcgaaagcgatgacgaggggcccgagcttttacaggtgacgcgagtggatagagaaaatatccttgcatctgtcgcttttcccactgaaattaaagtcgacgtgtgcaagcgcgtgaacctggacatcactaccctaatcacttacgtgagcgcgctgtcttacggggggtgccatttcatcttcaaagaaaaagtgctcaccgagcaagccgagcaggagcgaaaagagcaggtcctgccgcagttggaggccttcatgaaagataaagaattgttcgcttgcgagtccgcagtgaaagattttcagagcattctggacactctgggaggcccaggagaacgtgaaagggccaccgttttaattaaaagaataaatgtagtccccgaccagccctcagaaagggcccttcgcctggtcgccagttcaaagattaattccaggagcttgactatcttcggcactggggatacgcttaaggcaattactatgaccgctaatagcgggtttgtaagagctgctaataatcagggcgtcaagttttcagtgtttattcatcagccacgggccttgactgaatcaaaagaggctctggccacccctcttcctaaagactacaccactgacagtgagcactag

SEQ ID NO: 45850 - DNA, 258 bp, Artificial Sequence
  Description of Artificial Sequence: Synthetic coding sequence
atgagcgcccacagcatgctgtgcgagcggatcgccatcgccaaggaattgataaagagagcagaatctctcagcagaagcaggaaggggggaatcgagggcggggctaaattgtgcagtaagctgaaggccgagctgaaatttctgcagaaggtggaagccggaaaggtagctatcaaagagtcccatctgcagtcaactaatctgacccaccttcgggctatcgttgagtctgccgagaatctggaggaggtttag

SEQ ID NO: 45851 - DNA, 1266 bp, Artificial Sequence
  Description of Artificial Sequence: Synthetic coding sequence
atgagcgcccacagcatgctgtgcgagcggatcgccatcgccaaggagttgataaaacgtgccgaatctctgtcacgttctcggaagggaggaattgagggtggggctaagttgtgcagtaagctcaaagcagagctcaagtttctacagaaggtggaggccggaaaggtggcaataaaggagtcacaccttcagtcaactaatctcactcatcttcgggcgattgtagagagtgcagaaaacctggaggaggtggttagcgtgctccacgtattcgggtacacagacacattgggagagaagcagaccttggttgtggacgtcgtagctaatggtggacatacttgggttaaagcgatcggccggaaagcagaagccttgcacaatatctggctgggcagaggccagtatggggacaagtccattatcgagcaagctgaagactttctgcaggcctcccaccagcagccggtgcagtactccaatccccacattatctttgccttctataattccgtgagttcacctatggctgaaaagctgaaggaaatggggatatcagtgcgaggagacattgtcgctgtgaacgccctgctcgaccaccccgaggagcttcagccgtcggaatctgagtcagatgatgagggacctgagctccttcaggtgactagggtggaccgagaaaacatcctggcatcagtggctttccctaccgaaatcaaggttgacgtctgcaagcgggtcaacctcgacattaccactcttatcacctacgtctcagcacttagctatggaggttgtcacttcatcttcaaggaaaaagtgctaacagaacaagcagagcaggagagaaaggaacaggtgctgccccagttagaggcattcatgaaagataaggagctgttcgcctgtgagagtgctgtcaaagatttccagtcaattctcgataccctgggggggcccggggagagggagagagcaacagtgctgataaagcgaatcaacgtcgttcccgaccagccttcagagcgggcattgagactggttgcaagctctaagatcaactcgcgcagccttaccatttttggtacaggcgacacgctcaaagctatcaccatgacggcaaatagcgggttcgtgcgggccgcgaataaccagggggtgaaattcagcgtgttcattcaccagcctcgagccctgacggagagtaaagaagctttggctacgccccttcctaaggattatacgacggactcagaacactag

SEQ ID NO: 45852 - DNA, 1266 bp, Artificial Sequence
  Description of Artificial Sequence: Synthetic coding sequence
atgagcgcccacagcatgctgtgcgagcggatcgccatcgccaaggagctgatcaagagagcggaaagtctcagccgatcacgtaaggggggcatcgagggcggcgccaagctttgctccaagctgaaggcggagctaaagttccttcaaaaggtggaggccggcaaagtcgcaataaaagagtcacatctgcagagtaccaacttaactcacctccgtgccatcgtcgagagtgctgagaacctggaggaagtcgtgtccgtcttgcatgtctttggatataccgatacactcggtgagaaacagacacttgttgtggacgttgtcgccaatggcggtcatacctgggtgaaagctattggccgaaaggccgaggcactgcacaacatttggcttgggaggggacaatatggcgataagtcgatcatcgaacaggccgaagattttcttcaagccagtcaccaacagccagtccagtatagtaatccccatatcatttttgcgttctacaatagcgtgagctcgccaatggcggaaaaacttaaagagatgggtattagcgtgagaggtgacatcgtggctgtgaacgccttgcttgatcatcctgaggaactccagccctccgaatccgagtccgacgacgagggcccagaattactacaggtgacacgcgtggaccgcgagaacatacttgcctcggtcgccttcccaacggagattaaagtggatgtgtgcaagcgcgttaacctggacataactaccttaattacctatgtctcagctttgtcttacggtggctgtcacttcatttttaaagaaaaggtgctcactgaacaggcagaacaggagcggaaagaacaagtgctgccacagttagaggcctttatgaaagataaagagctctttgcctgcgaatccgcagttaaggactttcagtctattttggataccctgggggggcctggcgagagagaacgcgcaacagtcctaatcaaaagaattaacgtggtgcccgaccagccttctgagcgtgccctacgcctggtcgccagctcgaaaattaattcccgctcactcacgatcttcgggactggagacacactgaaggccattaccatgaccgccaattccgggtttgtgcgtgcagccaacaaccagggagtcaagttctctgtctttattcaccagcctcgcgcgctgacagaatcaaaagaggctctggcgacaccattgcctaaggattacaccactgactcggagcactag

SEQ ID NO: 45853 - DNA, 1350 bp, Artificial Sequence
  Description of Artificial Sequence: Synthetic coding sequence
atgagcgacatccggcacagcctgctgcggcgggacgccctgagcgccgctaaagaagtgctctaccacctggacatatacttttcttcccagctccaatcagcgccacttcctatcgtcgacaaaggacctgtggaactgctggaagagttcgtgttccaagtcccaaaagaacgctctgctcagccaaagcggctaaattccctgcaggaattgcagctactcgaaatcatgtgcaattacttccaggaacagacaaaggatagcgtgcgccaaatcatattctcatctctgttctcgcctcagggcaataaggccgatgattcaaggatgagcctgctggggaagttagtctcaatggccgtcgcggtatgtcgcatccccgtcctggaatgtgcagccagctggctccaaagaacaccagttgtgtactgtgttcgtctggcgaaggccctggtcgacgattactgctgtttagtccccggaagtattcagactctgaagcaaatcttctctgcttcaccaaggttttgttgtcagtttatcacctctgttactgcactttacgacctgagcagcgacgatttgataccgccaatggatctgttggaaatgatagttacttggatcttcgaggatccaaggctcatccttattacgtttctgaacacacccatagcggctaatctcccaattggctttttagagctgacccctttagtcggtctaatccgctggtgcgtgaaagcaccactggcctacaaacgcaaaaagaagcccccactgtcaaacggccatgtctctaataaagtgaccaaagatcccggagtgggcatggatcgggactctcatcttctgtactctaaactccacctcagtgtcctacaggtactgatgaccctgcaacttcacctcacggagaaaaatctgtatggccggttagggcttattctgttcgaccatatggtccccctggtggaggaaatcaatcgactcgctgacgaacttaacccattgaatgcctcacaagaaatcgagctgtccctggacagactagctcaggccctgcaggtggcaatggcatctggtgctctgttgtgtacacgagatgatctcaggaccttatgttctaggctgcctcacaacaatttactacagcttgtgatttccggccccgtgcagcagtctcctcatgccgccctcccccctggtttctacccacacattcacaccccccccctgggatatggagctgtaccagcccatcccgctgcgcaccccgctctccctacccatcccgggcataccttcatctccggcgtcacattcccatttaggcctattagatag

SEQ ID NO: 45854 - DNA, 1059 bp, Artificial Sequence
  Description of Artificial Sequence: Synthetic coding sequence
atgagcgacatccggcacagcctgctgcggcgggacgccctgagcgctgcaaaggaagtgttatatcacttggatatctatttttcgagccagctacagtcagctccactgccgattgttgataaagggcccgtggagctccttgaagaatttgtctttcaggttccgaaggagcgatctgcccagcccaaggagcagactaaagactctgttaggcagatcatattctcctccttattctccccccagggaaataaggcagacgatagtcgaatgagccttttaggaaaacttgtttcaatggcagtcgctgtctgtagaattcccgttttggagtgcgcagcatcttggcttcagcgaacgccggtggtatattgcgttaggctcgcaaaggccctggtagatgactattgttgtctggtaccaggtagcattcagactcttaaacagatattcagcgcgtctccgagattttgctgccagtttatcaccagcgttacggcattgtacgatctgagctcagatgatttgattcccccaatggatcttttggagatgatcgtgacctggatctttgaagaccctagtgttttgcaggtcttgatgacattgcaacttcaccttacggaaaaaaatctttacggtcggctcggcctaattctgtttgatcacatggtgcctctggtcgaggagataaaccgcctggctgacgagctgaatcccctgaacgccagccaggagatagaactgtccctagaccggctggcccaggcattgcaggttgccatggcgtccggggctctgttgtgtacccgagacgatctccgcacactctgcagtcggctgcctcacaacaatctcctccagcttgtgatttccggtcctgtccagcagtcacctcatgccgctctgccccccgggttctaccctcacatacacactccaccactggggtacggagctgtccctgcccatcccgcagctcaccctgcgctgccaacgcatccaggacacacatttatctcaggtgtcaccttcccattccggccaatccgatag

SEQ ID NO: 45855 - DNA, 711 bp, Artificial Sequence
  Description of Artificial Sequence: Synthetic coding sequence
atggtggtgcgggaggccagcgccgcccaggccagcctgagccaggttttaccacagttaagatacctacacatctttctagagcaggtgcatacacattttcaggaacagtctgtcggggagagaggcgccgctattcagttggctgaagggcttgctcgacagctctgcacagactgtcaactcaataaactcttctatagagaggaatttgtattggctactcttctcgacccgtgttttaaaggcaaaattgaagctatcctgccctgggggccgactgacattgaccattggaagcaggtgctcgtctataaagtgaaggaaattcgagtctctgaatattctctcaacagcccctctccactgcagtcacctcgagggctttgcgtagaccctacccgtgttgcaaaatcatccggtgtggagggccgcagccaaggggaaccactgcaatccagcagccacagcggcgcattcctgctcgcacagcgggaaaagggcttgttggagagcatggggctgcttgccagcgagcggtccgggggatccttgtctactaagtctcactgggcctcaatcatcgttaaaaagtacctgtgggagaacgagaccgttggagcgcaggatgatccacttgcttactgggagaagaagcgcgaggcctggccccctagcatttgcctcactcctcaccggtctctcctgtag

SEQ ID NO: 45856 - DNA, 1773 bp, Artificial Sequence
  Description of Artificial Sequence: Synthetic coding sequence
atggaggtgatccacggccggccctactgctgccgggagctggagggagctgatatcctgtccaacaccttttactctaatgagctgcataacccccttcaaaccgtgacccggcccacggctagcgaggatcggtatcaggaactgcgcgaatctctccagcagtgcaggttgccctggggcgctgaaagggaatatggcggcattattccaatttccttacctgaagatcatagacccaaatacgagcccccccgcgtgatggggaaaggccatcagcactatggatttggtggggagacatggccaaggaagctgcccgtggaacagttttattatctgacacagaacaaaaagtccgatgtgtatgggaatgacagtctcatcccaaaacctccgaactcaacagtcggtgaaatttgtttaccttaccctatagaacacccatatcacacccatatatgtcgcggcgctatgtttccaacctttacatctccggaagatctgtatactggcattaaggctcgaacccaacaaccctttccacctacagtgcccacgaaagcctacgactcaacagtgttgaagaccagagggaatccctatcggtatgagctgatcgatatcccgatggactctaagaaaaaagccctaacctggccggggcaaggcgtatactatgacttccctcggggagtggagaagaacaaaccagtgttctaccccaaacctcctaaaacttttgccccgaacacaagtctgaactcttgggaccccatttgctccgctaaggaagctaatatccagcggaatctggagaggtcccattggctgacttcctatacacatgactttacaggcctaggccctatggatcctctggagttggacgactatcatgagaaaatggtggccgaattgacacggaagatcggctttgatccagagccacaagaaaaattccacccggttttcaaaccacctcgccccctggagggtcggatcgcccgtctgattcagaaccgtaggagccttgaggctattgtccagcagcgcccacggagttgtccagattgcactcctagggtgttgtgtaattttcatacgtttgtgccttcaagcaaagagatggttgctctgtccgataacattccggccggcgtgactcacaagaatcaggacatagaggagaagattatagaggaacagagtctgctctccacttatgagctcccttcttgttatcccacaaaggatctcacttccatctacgatattaagccattccccaaaatcacagacacaaaaaagaccgaggacctctattggcgccagcagagtctgaaaacacagccaaccccttattgtaaacctgaccattggatccattatgaaaaccttaaaagcccattgagagatcagtacaacatgtgccccgaccccgtgagcctgagtaagcctagtgtgctgcagaacaaacaagacactgaagcctttacgctcgaacattttctcagcaagcctgaggaagagctattcctcaacatggaaaacaatgaggagaccaggcccgtcctgggctggatacccagggctggagtcaccaagcctcagacaaacttgctggagctcaaaaatagcttttctaagacaggggctcagaagaggttccacaagtctattctggaggatcacaaagacctgcgcgataatgaacattcggggatgaagcatcagttctacggtcataatagctattacttctacaactag

SEQ ID NO: 45857 - DNA, 1773 bp, Artificial Sequence
  Description of Artificial Sequence: Synthetic coding sequence
atggaggtgatccacggccggccctactgctgccgggagctggagggcgccgacattctatctaatacattttactctaacgagcttcataatcccctccagaccgtcacgcgccccaccgccagcgaggaccgataccaggaactcagggaatcgctccagcaatgcaggctcccatggggggctgaacgcgagtacggcgggataatcccgatttctctgccggaggaccaccgacccaagtacgagccaccacgagtcatgggtaaagggcatcagcattatggattcggcggtgagacttggccaaggaaactgcctgtggagcagttttattatctgacccagaacaagaagtctgacgtgtacggtaacgactctctgattccaaaacctcccaactccacagtcggcgaaatatgcctaccatatccgatcgagcacccttaccacacccatatctgtcgtggggccatgtttcctaccttcactagccccgaggacctctacactggcatcaaagccagaacacaacaaccattcccccctactgtgccgacaaaggcctacgattccacggttctgaaaacaagaggaaacccctaccgctatgaactgatcgatatccctatggattcaaaaaagaaagccctgacgtggccaggtcagggcgtgtattacgatttccctcgtggagtagagaagaataagccggtgttctatcccaagccccctaagacatttgcacctaatacgtccctcaatagctgggatccaatttgttctgctaaggaggccaacatccaacgcaacctcgaaaggagccattggcttaccagctacacccacgatttcacaggcctggggcctatggatcccctggaactcgacgactaccatgagaagatggtcgcagagctgacccgtaagatcgggttcgatcctgagcctcaggagaaattccatccagtgttcaaacctcctagaccactggagggccgcatcgcccgactgatccaaaaccgaagatccttagaagcgatagtccagcagaggccacgaagttgtcctgattgcacacctcgcgtgctgtgcaactttcatacttttgtgcctagctctaaagaaatggtggcgctttcagataatattcccgcaggcgtgacacataaaaatcaggatattgaagagaagattatagaggagcagtctctcctgtctacttatgagctgccttcctgctaccctactaaggatttaacatccatttacgatatcaagcctttccctaagatcacagacacaaaaaagacagaagatctatattggcggcagcaatccctcaaaactcagccaactccatactgcaagcccgatcattggattcactacgaaaacctgaagtctccgctccgcgatcagtacaatatgtgccccgacccggtctctctttctaaaccaagtgtactgcagaataaacaggatactgaagcgttcacgctggaacattttctatccaagcccgaggaggagctgtttctcaatatggagaataacgaagaaacgagacctgtactgggctggatcccacgggccggggtaaccaaaccccaaactaaccttctggaactgaaaaatagctttagcaaaacgggagcccaaaagcgatttcacaagtccatcctcgaagaccacaaagatctcagagataatgaacactctggaatgaagcatcagttttatgggcataacagttactacttttataactag

SEQ ID NO: 45858 - DNA, 348 bp, Artificial Sequence
  Description of Artificial Sequence: Synthetic coding sequence
atggaggtgatccacggccggccctactgctgccgggagctggagggcgctgatatcctgtctaacaccttttattccaatgagcttcataatccactccagaccgtgacaagacccactgcgtcagaggatcggtaccaggaactgcgtgagagcctccaacagtgccggcttccatggggcgctgaacgagagtacggcggcattatccccatttcccttcccgaggatcacagacctaagtatgaaccaccccgagtgatggggaaaggacaccaacactacgggtttggtggtgaaacatggccccgaaagctccctgtagaacagttttattatctgacctag

SEQ ID NO: 45859 - DNA, 462 bp, Artificial Sequence
  Description of Artificial Sequence: Synthetic coding sequence
atggaggtgatccacggccggccctactgctgccgggagctggagggtgcggacatcctatccaacaccttctattctaacgaactccacaatccccttcagactgtcacaagaccaaccgcctcagaagatagataccaggagctgcgtgaatctttacagcagtgccgcctaccatggggcgccgagagagagtacggcggcataataccaatatccctccccgaggaccaccggcctaaatacgaacctccaagagttatgggcaaaggacaccaacactacgggtttggcggggagacatggcctcgcaagctgccggtggaacagttctactatctcacgcagaataaaaagagcgatgtgtatggaaatgattccctgatccctaaacctccaaactcaacggtaggtgagatttgcctcccttacccaatcgaacacccgtatcacacccactag

SEQ ID NO: 45860 - DNA, 279 bp, Artificial Sequence
  Description of Artificial Sequence: Synthetic coding sequence
atggaggtgatccacggccggccctactgctgccgggagctggagggcgctgatatcttgagcaatactttttacagtaacgagttacacaatccgctgcagaccgtcaccagacccacggctagtgaagatcgataccaggaactgcgcgaatccctgcagcagtgtcggctcccctggggggccgagagagaatacggtggcatcatcccaatctcacttccagaagatcatcgtcccaagtacgaaccaccacgagtcatgggtaaaggccattag

SEQ ID NO: 45861 - DNA, 534 bp, Artificial Sequence
  Description of Artificial Sequence: Synthetic coding sequence
atgcaggtggaggtgcagagcctgagcctggaggagtgcccctggagattgccaggccctcaatgcgagtgcgaagccttgctgccttcaggcgccaggagaaggatagacctacgactatccggacgggccgtcgcggtgtgggttcatgtgcggggtggccccgggcagttcaacctgagttacgcaacaggccgacataagaagccaaacccacaccagaatatgaaccggggcatggaattcatcgcccccgtaagcgcaccaacaaaaagtggagccccatggcatttccttagtcaggggcctacagatgcacagagagccgtgcggatccggcccggcacgaggatgggtctttcctctgaccctgtggtgggcaccttgtcctcatcttacctggatctcctgacactaagctataagccaggccgcacagtgacaagctcctacctgaacgttaggggacatgaggtgcgtaagctgcagaattccgttgaggccacaagaataagtcgcacagactcaagctag

SEQ ID NO: 45862 - DNA, 396 bp, Artificial Sequence
  Description of Artificial Sequence: Synthetic coding sequence
atggacttccagcagctggccgacgtggccgagaagtggtgcagcaacactccctttgaactgattgccaccgaggagacagagagacgaatggacttctacgcggaccctggagtcagtttctatgttttgtgccccgacaatggatgcggggataatttccatgtctggagcgagagcgaagactgccttccatttttgcagctcgcgcaggactacatctcttcctgtggcaagaaaactctgcatgaagttctcgaaaaagtgttcaagagtttcagaccacttcttggcctgcccgacgcagacgatgatgccttcgaggagtacagtgccgatgtagaggaagaagagcctgaagctgaccatccacagatgggtgtttcgcagcagtag

SEQ ID NO: 45863 - DNA, 297 bp, Artificial Sequence
  Description of Artificial Sequence: Synthetic coding sequence
atggccacccactgccccctgtactgcgtgggcgccgacctgatgatgaatcgggcaggagaacatgtctggtctgagtctgaggattgccttccattccttcagctggcccaggattacatctcatcctgcggtaagaagaccctccatgaggtgctggagaaggtatttaaaagctttaggcctctgctcgggctcccagatgctgacgatgacgcctttgaagaatatagcgctgacgtggaggaggaggagcccgaagccgaccacccccaaatgggcgtgtcccagcagtag

SEQ ID NO: 45864 - DNA, 396 bp, Artificial Sequence
  Description of Artificial Sequence: Synthetic coding sequence
atggacttccagcagctggccgacgtggccgagaagtggtgcagcaatacacctttcgagcttattgcaacagaggagactgagcgtcgtatggatttctatgcagatcctggggtgtccttttacgtactttgccctgataacggatgtggggataacttccacgtgtggtcagagagcgaagactgcctgccattcttacagttggctcaagattacatctcatcctgcggtaaaaagaccctacatgaggtcttagagaaggtgtttaaatcttttagacctttgcttggcctgccagacgccgacgatgatgccttcgaggagtactccgcggacgtggaagaggaggagccggaggccgatcatccccaaatgggggtgtcccagcagtag

SEQ ID NO: 45865 - DNA, 297 bp, Artificial Sequence
  Description of Artificial Sequence: Synthetic coding sequence
atggccacccactgccccctgtactgcgtgggcgccgacctgatgatgaaccgggctggagaacacgtctggtctgaatccgaagactgcctgccgtttctccagttggctcaggattacattagtagctgcggtaagaagacactccacgaagtactcgagaaggtgttcaagagttttcggccgttgctgggtctgccagatgcggacgatgacgcctttgaggagtatagcgctgatgtcgaggaagaagaacctgaagcggatcacccccagatgggtgtgtcacagcagtag

SEQ ID NO: 45866 - DNA, 600 bp, Artificial Sequence
  Description of Artificial Sequence: Synthetic coding sequence
atgcacaagaagagcggcttcgagaaccagatgcggctgtgctggcgccgcccttgtggaaacgaggaaaggtgctctgtgtgctggtctctcttcctgccacccgggaagcagctatgcgaggaggagcgccgagccatgcaagccgccctggatagcgtggtctgtcacactcccctgaacaacttaggcttcagtagaaagggctcagcccttaccttcagtgtcgccttccaggctctcagaaccgggttattcgaacacatgaagcttaaactgcaatttaccgcgtctgtgagtcatcctcctcctgaggcaagaccgctgtctcgcaaatcctcaccttccagccctgcggtgagagacctggtggagaggcaccaggcttcactcggaagatcacagagcttcagccaccagcagccttccaggtcgcaccttatgcgttcaggatctgtcatggagagaagagcaatcacaccgcccgtggctagcccagtgggccggcctctctaccttcccccagacaaagccgttctctctcttgataagatagccaaacgagaatgtaaagtgttggtcgttgaaccggtgaagtag

SEQ ID NO: 45867 - DNA, 1743 bp, Artificial Sequence
  Description of Artificial Sequence: Synthetic coding sequence
atggagagccagtgcgactacagcatgtacttccccgccgtgcccttaccacctagggccgagctagccggagaccccgggaggtatagggcacttccacgaagaaaccacttatacctgggagaaacagtgagattcttgctggtgcttagatgccgaggcggggcaggtagcgggactggcggtggccccggactgggtagtcgtggcgcctgggcagaactcgccacagcactcgcggctttggcaagcgtgtcggctgggggcggcatgcccggcggcggcggtgctggggatcaagactccgaaccacctggtggtggcgaccccggcggaggcggcctgtttcgaggatgttctccccttcttacacatggcccgggtcctgccaccagcggaggtgcaaccaccctgccagtggaggaacctatagtgtcaacagacgaggttattttcccactgactgtatctctcgaccggctaccccctggcactcccaaggctaaaattgtcgtgactgtctggaagcgtgaaattgaagcccccgaagtccgcgaccaggggtacctgaggctgctgcagacccggtccccgggagaaacttttcgcggcgagcagtccgctttcaaggcacaggtgtctacgctgctcacactcctcccacctcccgtgctgcgatgtaggcagttcaccgtggccggtaagcacctgactgttcttaaagttttaaactcctcttcacaggaagagatcagtatctgggacattcgtatacttcctaatttcaatgcctcctacttacctgtgatgcccgatggttcagtgcttctcgtggataacgtgtgtcatcagtcaggcgaagtctctatgggcagtttttgtcgattgccagggacaagtggctgctttccatgcccgcttaacgccctggaagagcataacttcctgttccaactgcgcggcggggaacagcctcctcctggagccaaggagggcttagaggtgcccctgatcgccgttgttcagtggagcacccccaaactaccattcacccagtccatatatactcactacaggctcccttctgtcagactcgacagaccatgtttcgtcatgacggcgagttgtaaatcacccgtcaggacctatgagcgattcacagtgacctacaccctgctcaacaatctgcaagatttcctggccgtccggctggtgtggacacccgagcacgcacaggccgggaaacagctttgcgaggaggagaggagagcgatgcaggcagcgctggactccgtggtgtgtcacactccactcaacaatctgggtttctcaaggaagggatccgcacttacttttagtgtggcgttccaagcgctccggaccggccttttcgaactctcgcagcatatgaagctcaagttacagtttactgcttcagtgagccaccctccacccgaggcccggccgctatccaggaaatcctcgcccagctcaccggcggtccgggatctagttgagagacaccaggcctctctgggacggagccaatcttttagccatcagcaaccttctaggtcacacctgatgcggtctggaagcgtgatggagcgaagggccatcacaccacctgtggcctcaccagtcggtagacctctgtacttaccccctgacaaggcagttctgtcactggacaaaatagcaaagagagagtgtaaggttctcgttgtagagccggtcaaatag

SEQ ID NO: 45868 - DNA, 897 bp, Artificial Sequence
  Description of Artificial Sequence: Synthetic coding sequence
atggagcggctgaccctgcccctgggcggcgccgccgccgtggacgaatacctcgagtacagacggattgttggcgaggatgacggggggaaactgtttacacccgaagaatacgaggagtacaagagaaaagttctccccttgcgcctgcagaaccgcctgttcgtgtcttggcgcagccctaccggcatggattgcaagctggttggccccgagaccctgtgtttctgcacacatcgctacaagcaacacaaaacagatttagaggcgattccacagcagtgcccgatcgatctaccctgccaggttactggctgtcagtgtcgcgcttatctgtatgttcccctaaatgggtctcagccgattcggtgcaggtgtaagcattttgctgaccagcatagcgccgcgcctggatttacatgtaacacttgttcgaagtgttccggattccactcttgtttcacatgcgcctgcggacagcctgcttacgcccatgataccgttgtcgaaacaaaacaggaaaggctggctcaagagaaacctgtcggccaggacataccatacgccgcaatgggcggcttgaccggattctcctctctggccgagggatacatgcgcctggatgactccggaatcggagtaccttcagtagaatttttggagtcacctatcactgccgtggatagccccttcttgaaggctttccaagcctcttcctcttcctccccagaaaccctcaccgacgtggggaccagcagtcaggtgagtagcttgcggaggcccgaagaggatgacatggcattttttgaaagaaggtaccaagagagaatgaaaatggagaaggcagctaagtggaagggaaaagcccctctgccctccgccacaaaaccatcttag

SEQ ID NO: 45869 - DNA, 789 bp, Artificial Sequence
  Description of Artificial Sequence: Synthetic coding sequence
atggagcggctgaccctgcccctgggcggcgccgccgccgtggacgagtacctggagtaccgacgcattgtcggtgaagacgacggagggaaactcttcactccagaggagtatgaggaatataaaaggaaggtcctgcccctaagactccaaaaccgtctgttcgtgtcttggagatctcccacgggcatggattgtaaactggtgggacccgaaactctctgtttttgcacgcatcgttataagcagcacaaaacagacctggaagcgattccgcaacagtgccccatcgatctgccttgccaggtgacagggtgtcagtgtcgggcctatctctacgtgcccttaaacggctcacaaccaataagatgccgctgcaaacatttcgccgaccagcacagtgccgcccccggtttcacatgtaatacctgctcaaagtgcagcggattccactcctgctttacctgtgcttgcggccagccagcctacgcccatgacaccgtcgttgaaaccaagcaggagcggttggcccaggaaaaacccgtggggcaggatatcccatacgcggccatgggcggcctaactggattctcctccttggctgaagggtacatgagactggatgatagtggaatcgtgggaacttcatctcaggtgtcaagcttaaggcggcccgaggaagatgatatggcattctttgagagacgctaccaggaaaggatgaaaatggaaaaggcagccaaatggaagggcaaagccccattgccctctgcaacaaagccatcttag

SEQ ID NO: 45870 - DNA, 615 bp, Artificial Sequence
  Description of Artificial Sequence: Synthetic coding sequence
atggagcggctgaccctgcccctgggcggcgccgccgccgtggacgagtatctcgaatacaggagatataagcagcacaagactgacctcgaagccatccctcaacagtgtccaatcgaccttccttgccaggttacaggctgtcagtgccgcgcctacttatatgtgcccctgaacggttcacagcctatccgatgtagatgcaaacacttcgccgatcagcatagcgccgctcctggctttacatgcaacacctgcagtaagtgcagtggtttccatagttgctttacctgtgcctgcggccagccagcctacgcacacgacaccgtagttgaaacgaaacaggagcgactcgctcaagaaaaacccgtggggcaggatattccttatgctgctatggggggccttacggggttcagtagcctggcagaaggctacatgcggctcgacgatagtggaattgttggcactagtagtcaggtgtccagcctgcgcagaccagaggaggacgatatggctttcttcgagcggcgttatcaagaaagaatgaagatggagaaggcagccaagtggaagggtaaagctccattgccatccgccacaaagcctagttag

SEQ ID NO: 45871 - DNA, 585 bp, Artificial Sequence
  Description of Artificial Sequence: Synthetic coding sequence
atggccaagcagaagcggaaggtgcccgaggtgaccgagaagaagaataaaaagctcaaaaaagcgtcggccgaaggaccccttttgggaccagaagcagctccaagcggggaaggcgctggcagtaagggagaagctgtcctgaggccaggcttggacgccgagcccgagctgtctcccgaagagcagcgcgtgcttgagcgcaaattgaagaaggagcgcaagaaagaggaacggcaaaggttacgcgaggctggcctggtcgcccaacatccccccgccaggcgctccggcgcggaactagcgctagactatctgtgtaggtgggcccagaaacacaaaaattggcggttccagaagactcgacagacctggctcttgctccacatgtacgacagcgataaggtccccgacgagcactttagtacattacttgcttacctggaaggtctacagggacgcgctagggaattgaccgtacaaaaggccgaggccctcatgcgagagctggacgaagagggatcggatccaccacttcctgggcgggctcaacggataagacaagtgctgcagctgctaagctag

SEQ ID NO: 45872 - DNA, 585 bp, Artificial Sequence
  Description of Artificial Sequence: Synthetic coding sequence
atggccaagcagaagcggaaggtgcccgaggtgaccgagaagaagaacaagaaactgaagaaggcttctgcagagggccccttgctgggccctgaggcagcaccaagtggggaaggtgccgggagtaagggagaagccgttctccgacccggactcgacgcggagcccgaactcagccctgaagaacaacgtgtgttggagcgcaagttaaaaaaagagaggaagaaagaggagcgtcaaagactcagggaggccggtctagttgcccagcaccccccagctcgccgatctggagcagaactggccctggactatctctgccgctgggctcagaaacacaagaactggaggtttcagaagacacgacagacctggctgctattgcatatgtatgattccgataaggtgcccgatgaacacttctccacccttctggcatacctggaaggactgcaaggacgcgccagagagctgacggttcaaaaagctgaggccctcatgcgagagctagacgaagagggaagtgacccgcccctaccgggacgtgcccagcgcattaggcaggtgttacagctgctgtcctag

SEQ ID NO: 45873 - DNA, 585 bp, Artificial Sequence
  Description of Artificial Sequence: Synthetic coding sequence
atggccaagcagaagcggaaggtgcccgaggtgaccgagaagaagaacaagaaacttaaaaaagcctccgccgaggggcccttgctgggccccgaagccgccccgtccggggagggagcaggatcgaagggcgaagccgtgctccgacccgggctggacgcagagcccgagttgagcccagaggagcagagggtacttgagcgtaaattgaaaaaggaacggaagaaagaggagcgccagcggcttagggaggctggactcgtggcccagcatcccccagccaggagaagtggtgccgaattagccctggattatctgtgccggtgggcgcagaagcacaagaactggaggttccaaaaaacaaggcagacttggctcctgctgcacatgtacgattctgacaaggtacctgacgagcacttcagcactctgttagcctatctcgaggggctgcaggggcgcgccagagagctgaccgtgcagaaggccgaggcactgatgagggagttggacgaggaggggagtgatcctcctctgccagggagagcccaacggatcagacaagtccttcagttgctttcctag

SEQ ID NO: 45874 - DNA, 579 bp, Artificial Sequence
  Description of Artificial Sequence: Synthetic coding sequence
atggccaagcagaagcggaaggtgcccgaggtgaccgagaagaagaacaaaaaattgaaaaaggcgagtgccgagggccctctgctaggccctgaagccgcgccgtctggagagggggccggatctaagggggaggccgttctgcggcctggcctggatgctgaaccagagctttcccctgaggagcaaagagtcctggagcgaaagttgaaaaaagagcgcaagaaggaggagaggcagaggctgcgtgaggccgggctagtcgcccagcatccacctgcacgtcgatccggtgctgaactggccctggactacttgtgcaggtgggcccaaaagcacaaaaactggcggtttcaaaagacgcggcagacctggttactgctacacatgtacgattccgacaaggtgcctgacgaacatttttcaacactgctcgcatacttggagggtctgcaggggagagcacgggagctcaccgtccaaaaggcggaagccttaatgcgggaactggacgaggagggcagcgatcctcctcttcccggcagagcccaacgcattcggcaagtcctgcagttgtag

SEQ ID NO: 45875 - DNA, 888 bp, Artificial Sequence
  Description of Artificial Sequence: Synthetic coding sequence
atgcggaacaccagcaaggagctgcagggcgccacccaccggtacgcaccgtgcgactggtactaccacgtccccgtgaaacggtctgagaaagcagttgatgcaccacccgcatcccaaattcccggcctgagcaacctgggtgattctcacagcgagaaccttcccggaacccgccgctactggattaaagaaaccgattccgagtatgtcaagttggctaaacagggtggaaggccagatctgctgaagcactttgccccaggtacacgaaaagggagtccggtggcgtacagtctccccgactggtacattcatcattccaaaccacctaccgcatctcagcaagaggtccgggccgtgtccatgcccgactacatggtccacgaggaatttaatcctgaccaggccaatggctcatatgcttcccgacgcggcccattcgattttgacatgaaaaccgtgtggcagcgtgaggcagaggagctcgaaaaggagaagaaaaaactccgcctccctgcaatagacagtaagtacctgtctaaagccggaacccctctggggcctaagaatcctgctggaagtagattaagctttccccccgtacccgggcaaaaaaacagttctcctactaacttctctaaacttatctccaacggctataaagatgagtggctccagcaacagcaaagggctgatagcgataaacgcacgccgaaaacctcaagggctagcgtactcagccaatctccccgcgatctggaaggcccccaggacgcagctcgcctgcaggacgcagaagcctctgaaggcccagaagatacgcctgaatcgagccagtctcctgaggagagtgtaagcgcatccacccctgctgagctcaagtag

SEQ ID NO: 45876 - DNA, 888 bp, Artificial Sequence
  Description of Artificial Sequence: Synthetic coding sequence
atgcggaacaccagcaaggagctgcagggcgccacccaccggtacgcaccctgtgattggtattatcatgtgcctgtaaagaggagcgaaaaagctgtcgatgccccaccagccagtcagatcccgggtctcagtaacctgggtgactcacactccgagaacctgcccggcacccgccggtattggatcaaagaaactgatagcgagtatgtgaagttagccaagcagggaggacggcctgatttgcttaaacacttcgcccccgggacgcgaaagggctcacccgtggcatattccctgccggactggtatatccaccattcgaagccgcctaccgcgagccagcaggaggtgcgcgcggtcagtatgcctgattacatggtccacgaagaattcaatcccgatcaggctaacgggtcgtacgcgagccggcgggggcctttcgatttcgacatgaagaccgtttggcaacgcgaggccgaagagctggagaaagaaaaaaagaaactgaggctgccagcaattgatagcaaatacctatccaaggctgggacgccactcggtccgaagaatcctgccggtagcagactgtcgtttccaccagtacccggccaaaagaactcatctcccaccaacttttccaagctgatcagcaatggatataaggacgagtggctgcagcagcagcagcgtgctgacagcgacaagaggactcctaaaacgagtagggcctctgtgttatcccagagcccaagggatctggaaggtccccaggatgccgctcgattgcaggacgcagaagcctctgagggcccagaggatacacccgaatcaaatacttgccccgaggagagtgtcagcgcctcaacccccgccgaacttaaatag

SEQ ID NO: 45877 - DNA, 462 bp, Artificial Sequence
  Description of Artificial Sequence: Synthetic coding sequence
atgcccgactacatggtgcacgaggagttcaaccccgaccaggccaacggcagctacgcttccagaagaggacccttcgattttgacatgaaaaccgtgtggcagagggaagccgaagagttggagaaggagaagaagaaactgcgcttgcccgcaatagattccaagtacttgagcaaagcaggaacccccttagggcccaagaaccctgccggttcacgtctgagtttcccgcccgtgaatggctataaagacgagtggcttcaacagcagcaacgggccgactccgacaaaagaacccccaaaacttccagagcgagtgtcctgtctcaatcaccacgagatctcgaaggaccacaggacgctgcccggctccaggatgcggaggccagcgagggacctgaggacacccctggtcctgaggagagcgtgtccgcttccacaccagcagagctgaagtag

SEQ ID NO: 45878 - DNA, 300 bp, Artificial Sequence
  Description of Artificial Sequence: Synthetic coding sequence
atgaccagcgccctgacccagggcctggagcggatccccgaccagctgggttacctagtcctctccgagggagccgttctagctagttccggtgatctagagaacgatgaacaggctgcctctgctatcagtgaactagtgtctaccgcatgcggctttagattgcatcgaggaatgaatgtcccttttaaacggctgtccgtagtgttcggcgagcacactcttcttgtcacagttagcgggcagagggtgttcgtcgtcaagaggcagaacagaggcagggaaccaattgacgtttag

SEQ ID NO: 45879 - DNA, 1218 bp, Artificial Sequence
  Description of Artificial Sequence: Synthetic coding sequence
atggagcccggcgccggcggccggaacaccgcccgggcccagcgggccggaagtccaaatacacctccaccccgagagcaggaacgtaagctggaacaggagaaactgtcaggcgtggttaagtctgtgcaccgccggctccgcaaaaagtaccgcgaagtgggagacttcgataagatatggagagaacactgcgaggacgaggagactctttgcgagtatgccgtcgctatgaagaatctcgcagacaaccactgggcaaagacgtgtgagggagaaggccgtatagaatggtgttgctcagtatgtcgggagtacttccaaaatggcggcaaacgtaaggctctcgagaaggatgagaagagggccgttctcgcaaccaagacgacgcctgccctaaatatgcatgagtctagtcagcttgaaggccacctgaccaacctgtcgttcaccaatccagaattcataacggagctcctgcaggcttccgggaaaattaggctcctcgatgtgggcagttgttttaacccatttctcaagtttgaggagtttcttacggtggggattgacattgtgcccgcagttgagagtgtgtataagtgtgatttcctgaacctgcaattacagcagccactgcagctggcccaggacgccattgatgcctttttaaaacaattaaaaaacccgatcgactccttgcctggagagctgtttcatgttgttgtgttcagtctcctactgagttattttccctcaccataccagaggtggatatgctgcaagaaagctcacgaactgctcgtgctgaatgggcttctcctgataatcactcctgacagctcccatcagaatcggcacgctatgatgatgaagtcatggaaaattgccatcgagagcctggggttcaaacggtttaaatacagcaagttcagccacatgcatctcatggctttccgtaagattagcttgaagaccacttctgatttggtgtccagaaattaccccggaatgctgtatatcccccaagattttaacagcatcgaggacgaggagtattctaatccctcctgctacgtgcgctccgatatcgaggacgaacagttagcctacgggtttaccgaattgccagatgcaccctatgacagcgattctggtgaatcacaggcttcaagtatcccattttacgaactggaggatcccattctcctactcagctag

SEQ ID NO: 45880 - DNA, 1059 bp, Artificial Sequence
  Description of Artificial Sequence: Synthetic coding sequence
atgggcgacttcgacaagatctggcgggagcactgcgaggacgaggaaaccttatgtgagtatgcagttgccatgaagaacttagcagacaatcactgggcgaagacgtgcgaaggagagggaagaattgagtggtgctgtagcgtgtgccgggagtacttccaaaatgggggtaaaagaaaggccctcgaaaaagacgaaaagagagcagtcctggcaaccaaaacaactccagctttgaacatgcacgaaagctcacagctagaaggacatctgacaaacctatctttcaccaaccctgagtttatcaccgagttattacaggccagtggtaagataagactgctggacgtaggcagttgtttcaacccctttctcaagttcgaagagtttctcacagttgggatcgatatcgtacctgccgtggagtctgtttataagtgtgactttctgaatctgcagttgcagcaacctctacagctggctcaggatgccattgacgctttcctgaagcaactgaagaaccctatcgactccctgccgggggaactctttcatgtggtggtctttagcctgctgctttcctattttccatctccctaccagcgatggatatgttgtaaaaaagctcacgaactgctagtgctcaatgggcttttattgatcatcactccagactcatcacaccagaaccgacacgctatgatgatgaaaagctggaagatcgcaattgagtccctgggattcaagagatttaaatactcgaagttctctcatatgcatctgatggcattccggaagattagtttaaagacaacatctgacttggtcagccgcaattacccaggaatgctgtatattccgcaggacttcaattccatcgaggacgaagaatatagtaatccaagctgctatgtgcgcagcgacatagaggatgagcagctcgcatatggatttaccgagctccctgacgcaccttatgactccgacagcggcgaaagccaggctagctccatccccttctatgagctcgaggaccccattttactgttgtcatag

SEQ ID NO: 45881 - DNA, 621 bp, Artificial Sequence
  Description of Artificial Sequence: Synthetic coding sequence
atggtggtggtgatgaagttcttccggtgggtgcggcgggcctggcagagaataatcagctgggtgttcttctggcgtcagaagattaagcctaccatctcaggacatccagattcaaagaaacatagccttaagaaaatggagaagactctgcaggtggtcgaaacattgagacttgtggaactgccaaaggaggcaaaacctaaactaggcgaaagtccagagctcgctgacccttgcgttctcgccaaaacgaccgaggaaacggaagtggagcttggtcagcagggtcagagtctgttgcagcttccccggactgctgtgaagtccgtgtctactctgatggtctccgcccttcagtctggatggcaaatgtgttcctggaagagctcagtttctagcgcctccgttagttcacaggtccgaacacaaagtccattaaagacgcctgaagccgaactcctgtgggaggtgtacctcgtgctgtgggctgtaaggaagcacttaaggcggttgtaccgacgccaggagcggcaccgcagacaccacgtgcggtgtcatgccgcaccccgcccaaatcctgctcaaagtttgaaactggacgcccagtctcctctgtag

SEQ ID NO: 45882 - DNA, 762 bp, Artificial Sequence
  Description of Artificial Sequence: Synthetic coding sequence
atgagcttcagcgtgcacaaccagaagggcagcaagcggcccctgcctctggagccactcttatttcttcaggtgcctcgctcaaactatctccacttccaggaggagaagcagaggcttcatctgaagaagtttcttctcgacagaatgtttcttgttgccaagatccaggcaaacgtcgagcgtaaagacgtagcggattattacgagcagatgttccagtcagtgctgaaacatcacctgggggaagcggtgactgggctactgttaatataccccacaagtattctccacattctggagagcagctccgacaccctatacaaggtactccttgactatatcggtcacgtgaaagacgagaccgtcttttttattcaacagatgaaaatcattgtgatctcacataacatccccatgaggctgttcatgcagtggcacgtctctgtcatcaaagtccctgtgatgtatctcgacgacgtgactcagtcacaaagtctgaaggaggtgattaccgacttcctgacgcagacgcataagcttagcctgtatttgtgccaaacaatgaaagtgggcacaaagggccccggagataatctgcaccaggtggctccagacctactgcttcctgaacagattataaaatacctttgtaagtctgaggagtttatggatcctgccacattcatcaatatgtacaacaggccaattcacattacgctggattccgaggtggtttggcctgcgccaagcaggttttag

SEQ ID NO: 45883 - DNA, 2688 bp, Artificial Sequence
  Description of Artificial Sequence: Synthetic coding sequence
atgtggaccgaggaggccggcgccaccgccgaggcccaggagagcggtattcggaataagtcctcgagttcctctcagatccctgtggtgggggtagtgaccgaggacgatgaagctcaggatgtgtttaaacctatggatctgaacagggtcatcaaactcctcgaggagaccgacaaagatggactcgaggaaaagcaactcaaattcgtcaagaaacttgttcagtgttaccagaatggattgcccctgcgggatctggcacagatatttaagatcctgaatctttgctcaggcaagattaagaaccaaccacgattcattgaatctgcttacgatattatcaagctgtgcggactccccttcctgaagaaaaaggtttcagacgagattacttatgccgaggacacagctaactcgatcgccctgctgggagacttaatgaaaatcccctcatctgagctgcgtatccagatctgtaaatgtatcgtggacttctatcatgccgaaccccccaagaaacatattcctggctatcagcaggcctcaagctcttataagatacaaatggccgaagttgggggcctagctaagactatggttcagtccatgacgctactcgagaatcagcttgtcgaaaaactgtgggtgttaaaggtcctgcagcacctttcaacgtccgaagtaaattgcacgatcatgatgaaggcccaagccgccagcgggatatgcactcacctcaatgatccagatccatcgggccaactcctgttccgatcctccgaaattctgtggaatctcctcgaaaaaagttcaaaggaagaagtgattcagcagctatcaaatcttgagtgcttactggcactgaaagaggtgtttaaaaacctctttatgagggggttcagccactacgaccgccagctgcgcaacgatatcctcgttattacaaccatcatcgcccagaatccggaggcccccatgattgaatgcggatttacaaaagacctaatcctgtttgctacattcaacgaggtaaagtcccaaaacctgctggttaaaggcctaaaacttagtaacagctacgaggattttgagctgaaaaaactgttgttcaatgtgatcgttattctgtgtaaagacctgcccacagtccagctgctcatcgacggtaaggtcatcctggcattgtttacctacgtaaagaaaccagagaagcagaagattattgactggtccgccgcccagcatgaggaattacagctgcacgcgatcgcaactctgtcttccgtcgccccgcttctgatcgaggaatatatgagctgtcagggcaatgccagggtactcgcattcctggaatggtgcgaatccgaagacccattcttctctcatgggaattcctttcatggcacaggtggaaggggaaataaattcgcccagatgcggtacagcctgaggctcctgcgcgcagtggtgtaccttgaggacgagaccgtgaacaaagacctgtgtgagaaggggaccatccagcagatgatcggcatcttcaaaaacattatctcaaaacctaacgagaaggaggaggccattgttctggaaattcaatcggacatcctgctgattctgtctggactgtgtgagaaccacattcaacggaaggagatcttcggcaccgaaggagtggatatcgttttgcacgttatgaaaacagacccgcgcaaactccaatccggcctcgggtataatgtactcctgttctctacattggactccatctggtgttgtatactgggctgctacccttctgaagactattttctcgagaaagaaggaatctttctcctcttggatcttctggctctcaaccaaaagaaattctgtaacttgatactggggataatggtggagttttgtgacaatcccaagacagcggcccacgttaatgcatggcagggtaagaaggaccaaactgcggcctctcttctgattaagctctggcggaaagaggagaaggagctcggagttaagcgtgacaagaacggcaaaattattgactttgagaatttgcccgggttgagtgctgaagatttcgtcactctatgcattatccaccgttacttggattttaagattggggaaatatggaacgaaatctatgaagaaataaagctggaaaaactgcgcccagtgacaacggacaagaaggccttggaagcgatcaccaccgcttcagagaacatcgggaagatggtcgcgagcctgcagtcggacattatcgagagccaggcttgccaagatatgcagaatgaacagaaagtctatgcgaagattcaggctacgcataaacaacgggaattagccaataagtcatgggaggattttctggcgcgtaccagcaacgccaagacactgaaaaaggccaagtcactgcaggaaaaggcaattgaggcgtcacgctaccacaaaagaccccaaaacgcaatctttcatcagacgcacatcaagggcctcaacaccaccgtgccgtcaggcggcgttgtgaccgttgaatccacgccggcgcgacttgtggggggtccattagtggacactgacattgccctgaaaaaactgcccattaggggaggagcccttcagagggtgaaggccgtgaaaatcgtggatgccccgaaaaagagcatccccacctag

SEQ ID NO: 45884 - DNA, 2826 bp, Artificial Sequence
  Description of Artificial Sequence: Synthetic coding sequence
atgtggaccgaggaggccggcgccaccgccgaggcccaggagagcggaatcaggaacaagagttcctcctctagtcagatccccgtcgtgggcgtggttaccgaggatgatgaagcgcaggacgtattcaagccaatggaccttaaccgggtgataaagcttctggaagaaacggacaaggatggactggaagagaaacagttgaagttcgttaaaaagctggtgcaatgttatcagaatggcttgcccctacgagatctcgcccagatcttcaagattttgaacctgtgttccggcaagatcaagaatcagcccagatttatcgagtccgcatatgacatcattaagctgtgcggtctgcccttcctgaaaaagaaggtgtccgatgagattacatacgctgaagatactgccaacagcatagccctgttaggcgacctgatgaagattccgtcctccgagctccgcattcaaatctgcaagtgtatcgtcgacttttatcatgctgagccccccaagaagcatatacccgggtaccagcaggcttcctcctcttacaagatacagatggcggaggtgggaggcctggcgaagacaatggtccaaagcatgacactgcttgagaaccagctggtggagaaactctgggtgcttaaggtgttgcagcatctgtctacttctgaggtcaattgtacaatcatgatgaaggcgcaggcagctagcgggatctgtacacacctcaacgatccagacccaagcggacagctgctgttcaggagcagtgaaatattatggaatctgcttgaaaagtcctccaaagaggaagtgattcagcaactcagtaacctggagtgccttcttgctctgaaggaggtttttaaaaacctcttcatgcgcggcttctctcactatgacagacaactgcgcaacgacatcctggtgatcaccacaataattgcccagaacccagaggcccctatgatcgagtgcgggttcacaaaggacttgatactctttgccacctttaatgaggtgaaatctcaaaatcttctcgtgaagggcctgaagctgagtaattcctatgaagacttcgaacttaagaaacttctttttaatgtcattgtgattctctgtaaggatctgcccactgtgcagcttttaatcgatggtaaggtcatcctggcactctttacatatgtgaagaaacccgagaaacagaagatcatcgactggtcagcagcccaacacgaggagctccaactgcacgcaattgccaccttatcttctgtggcacccctgctgattgaagaatatatgtcttgccaggggaacgcccgtgttcttgccttcctggaatggtgtgaatccgaggaccctttctttagccacggaaactcctttcatgggactggcggacgtggcaataagtttgcccagatgaggtactccctcaggctactcagagctgtcgtgtatctggaggatgagaccgtgaataaggatctgtgtgaaaaggggacaatccagcaaatgatcggtatctttaagaacattatcagtaagcctaatgagaaagaggaagctatcgtgctcgaaatacaaagcgacatactgcttatactgtcaggcctctgtgagaaccatatacagcgaaaggaaatcttcggaacggaaggtgttgacattgtgctgcatgtgatgaagacagacccacgcaagcttcagagcggcttaggctataacgttctcttatttagcacgttggattccatctggtgctgcatcctgggctgttacccaagcgaggactactttttggagaaggaaggtattttcttgctgctagatttactagccctgaaccagaagaagttttgcaatctgatcctaggaatcatggtggaattttgcgacaaccctaagaccgccgcgcacgtaaacgcttggcaaggcaaaaaggaccaaaccgccgcctcactgctgataaagctctggaggaaggaagagaaagaactgggggtaaaacgtgacaaaaatggcaagattatcgacacaaagaaaccactctttacctctttccaggaagagcagaagattatacctctgcccgccaactgcccaagtatagccgtcatggatgtgtcagaaaacattagggcaaaaatctatgctatcctgggcaagctcgacttcgagaacctgcctggcctgtccgcagaagactttgtgacactgtgcattatccaccggtacctggattttaagattggggagatctggaacgagatctacgaggaaattaagttggaaaaactacgcccagttactaccgacaaaaaggcactggaagcgatcaccaccgcctctgaaaacattggtaaaatggttgcttctcttcagagcgacatcattgaaagccaagcatgtcaggatatgcagaacgagcagaaggtgtacgccaagatacaagcgacacataaacagcgggagctagctaacaagtcatgggaggatttcctggctaggacctctaacgctaagaccctgaagaaagccaaaagtctccaggagaaagctattgaggccagccgttaccataagaggcctcaaaacgccattttccatcagacgcacataaagggactcaatacgactgtgcccagcggtggagtcgtaaccgtggaaagcactcctgccagactcgtgggaggacctttagtcgacacagatattgctttaaagaagttacccatccgggggggcgctctccagcgagtcaaagcggtgaaaatcgtggacgcgcctaagaaatctatcccaacttag

SEQ ID NO: 45885 - DNA, 1437 bp, Artificial Sequence
  Description of Artificial Sequence: Synthetic coding sequence
gagctgcagctgcacgccatcgccaccctgagcagcgtggcccccctactcattgaagagtatatgagctgccaggggaacgcccgagtgttggcattcctggagtggtgcgagtctgaagacccatttttcagtcacgggaatagtttccacggcacgggcggtagaggaaataaattcgcccagatgcgctactcccttcgactgctgagagctgtagtatacctggaggatgaaaccgtgaacaaggatctctgtgagaaggggacgattcagcagatgattggcatctttaaaaatattattagtaagccaaatgagaaggaagaagctatcgtcctcgagatacagagtgatattctgttgattttgtctgggctgtgcgagaaccacatccagaggaaggagatcttcggcacagaaggtgttgatatagtcctgcacgttatgaagactgaccctcggaaacttcagtctggtctggggtacaacgtgctcttgttcagcacactcgactccatctggtgctgcattctgggctgttacccctctgaagattacttcttagagaaagaaggaatttttctgttgttagacctgctggcgctgaatcaaaaaaaattttgcaatctcatcttaggaatcatggttgaattttgcgacaacccaaaaacagcagcccatgtgaacgcctggcagggaaagaaggatcagaccgccgcatcactgctcatcaagctgtggcgcaaggaggaaaaggagcttggagtgaagcgtgataaaaatggaaagattattgattttgaaaacctgccagggctcagcgccgaggacttcgttaccctttgcatcatccatagatatctagactttaagatcggtgagatctggaatgagatatatgaggagattaaactcgagaagctgaggcctgtcacaacagacaaaaaagctctcgaggctatcaccacagcctcagaaaacattggtaagatggtggcatcactgcagtcagacatcattgagagccaggcctgtcaggatatgcagaacgaacagaaagtttatgctaagatccaagctacccataagcagagagagctggccaacaaatcatgggaggatttcctagccagaacctctaacgccaagactttgaagaaggcaaaaagtctccaagaaaaggccatcgaagccagcagatatcacaagagaccacagaacgccatctttcaccaaacacacataaagggcttgaataccacagtgccctcaggaggcgtagttacggtcgagtctacacccgcccgtttagtgggaggacctttggtggacaccgacatagcactgaaaaagttgccaatcagggggggcgcgctacagcgcgttaaggcagttaagatagtcgatgctccgaaaaagtcaataccaacttag

SEQ ID NO: 45886 - DNA, 2772 bp, Artificial Sequence
  Description of Artificial Sequence: Synthetic coding sequence
atgtggaccgaggaggccggcgccaccgccgaggcccaggagagcgggatccgcaataagtcgtcatcctcatcccagattcccgtggtgggcgtcgtcacagaggacgacgaagctcaggacgtgttcaaaccaatggatctcaacagagtgatcaaactgctggaagagactgataaggatggtctagaagagaaacagctgaagttcgtcaagaagctcgtacaatgttaccagaacggtctaccgcttcgcgatttggcgcagatcttcaagatcctgaacctctgttccggcaagatcaaaaaccagccgagattcatcgagtccgcatatgatatcatcaagctatgcggcctccctttcctgaaaaagaaagtatccgatgagattacatatgctgaagacactgccaactccatagccttattaggcgacttgatgaagatcccatcaagcgaactaaggatccagatatgctaccagcaggcgtcttcgtcatacaagattcagatggcagaggtagggggtctggccaagacaatggtgcagagtatgaccctgctcgaaaaccaactcgttgagaaactttgggttctcaaagtgttgcagcatctcagtaccagcgaagtcaactgcacaatcatgatgaaggcccaagcagcttctggaatatgcacccacctcaacgacccagaccctagtggtcagctgctcttccggtccagtgagatcctgtggaacctgctggagaaatcaagcaaggaggaagtgatccagcagttgagtaatttagagtgtttgttggcccttaaggaagtgttcaaaaacctcttcatgaggggattttctcactatgacaggcagctgcggaatgatattctcgtcatcacgactatcatcgcacagaacccggaagcccccatgatcgaatgcggctttaccaaggacctaatcctgtttgctacatttaacgaggtcaagtctcagaacctcttagttaagggcctcaaactatctaatagctacgaggattttgaactgaaaaaactgctgttcaatgtgattgtgattctgtgcaaggatctccccaccgttcagcttcttattgatggtaaggtaatcctggccctttttacatacgtgaaaaagcctgagaagcagaagattatcgactggagtgccgcacagcacgaagagctccagctgcacgcaattgctactctctcctctgtcgcacccctcttgatcgaggagtacatgtcttgccaaggcaatgccagggtgttggcctttctggaatggtgtgaaagcgaggacccattcttctcccatggaaattcatttcacggcactggagggagagggaataaatttgcgcagatgcggtactccctgaggctcttgcgtgccgtggtctatcttgaagatgaaaccgtcaataaagatttgtgtgagaagggaaccatccagcagatgattgggatattcaagaatatcatatccaagcctaacgagaaagaagaagccatcgtgctagagatacaatctgacatcctgttgatcctcagcgggttgtgcgaaaaccacattcaacggaaggaaatcttcgggacagagggggttgacatcgtccttcatgtgatgaaaacagatccaagaaagctgcagagtggactcggttacaacgtcttactgttttctacactggacagtatttggtgctgcatcttagggtgctacccttcagaggattacttcttggagaaagagggcattttccttctgctcgatcttttagctctgaatcagaagaaattttgcaacctgatcttaggtattatggtagagttctgtgacaatcccaagaccgccgcacatgtcaatgcttggcaaggaaagaaagatcagacagccgcatcactgctgattaagctctggcgcaaagaagagaaagagctgggtgtgaagagggacaagaacggaaagataatagacacgaagaaacctcttttcacttcctttcaggaggaacagaagatcattccactaccagcgaactgtccctccatcgctgttatggatgtgtccgaaaatatccgcgccaaaatttatgctatcttgggtaaactcgatttcgagaacctccccggactaagcgcggaagattttgtgactctgtgcattattcaccggtacttagattttaagataggcgagatttggaatgaaatttatgaagaaattaaactggagaagcttagaccagtcacaaccgataagaaagccctcgaggctattaccacagctagcgaaaatatcggcaagatggtagcgtccttacagagtgacataatcgagtcacaggcttgtcaggacatgcaaaatgaacagaaagtgtacgcaaagatacaagccacccacaaacaacgggaactagctaacaagtcttgggaggactttctcgctcgtacatctaacgccaagaccctgaagaaggcaaagagcctacaggagaaggcaatcgaggcctctcgctatcataaaagaccccagaacgctatatttcaccagacccacatcaaggggctgaataccacggtcccgtccggcggggttgtgacagtagaatcgacacccgcccgtcttgtggggggcccactcgtggataccgatatagcgctgaagaaacttcccattcgaggaggagccctgcagcgcgtgaaggcagtgaaaatagtggacgcccccaaaaagagtattccgacgtag

SEQ ID NO: 45887 - DNA, 456 bp, Artificial Sequence
  Description of Artificial Sequence: Synthetic coding sequence
atgcggatggcccccaccgagagcaccgagggccggcggctgtggcccgggcccagagagggcggctctgggaaagagacaacctcagagaagttgtctaatctgccccgaccccactcctattcacctaagcgcgccgacgccgagagtttcaggggcgtgccagcggcatttaagaaatgtagggaagtgttccgggcatgttgggggtcccgagagctcttgtttttgttcaaagccatctcggaagcgggtccagcgcagaactcgtgcggaatcaccctcgagaaagctggtgggctggaggatacagggagtcattggttgagttgggctcggtgtaaagtgctttacatcaacggcttcacggacccgtggaaggatgcacaggcgtggattctgattgtgtcttgcaaaaagggcaaaggtacgccagagcgggaaggccgaaactag

SEQ ID NO: 45888 - DNA, 510 bp, Artificial Sequence
  Description of Artificial Sequence: Synthetic coding sequence
atgggcagctgcggctgggccctgacccagagcgactggtgccccttcaaaaagcggaaacggcaccaaagatgtgctcattctgagacgagacacatgaggacccagagacagggtggatatctgcaagcacgtgaaaggggtctcggcgaggcaaatcctgcatatgctctgatcctggacttccagccccctgaactgcagaacttgtcagagatgggcataaaccacgaattaggttatagcagcattatccccatgatgaaacgtgcatttagcgcatgtggtacactgggcttgatcatgagtggaattttcgataaccccggccctattaaaaatacattaaagaaagctttcaccatgttatggagtttcaccgtgtatactagactggagagtctgcgggtcgcactgagcaacgaggagatggtgccctttatctttcacctgaagactcagacagccaatatgttgtccggcccaatctctaccccgatgctgctgtag

SEQ ID NO: 45889 - DNA, 1317 bp, Artificial Sequence
  Description of Artificial Sequence: Synthetic coding sequence
atggacgtggagatccaggacacccccggcaagatcagcatcagcaaacgtagcatcctaagcggtactgtcgaaaatatcgattatccccactattgtgatctgcttcgcaaaatgaacatgcctttcgtgaaaggactggagaacaggcataattacgggagatttgaaaaaaagtgtaatcccgctttcctgaagtttcatccctacccgccctccgtcctgccagattatcacttgcacgatccataccccccaccatatgggccacattatccgctattcccgctgcgggacgacgtgaccctgggagactcctgctcaggcttcatgtctcctggcggcgacgcagacctgaatcctggtattggccgcactataccaaccttagttgacttttcagatgtcaagcctcaacatagagtaccacgcccagacactggttttcagaccacaataaaacggcaaaagattcttagtgaggaactgcaacagaaccgtcggtggaactcacgcgaggtgcccgacatcagcatccgcgcccgtctaggagggtggacctcccctctcaaggttaccccactgcaaccccatcacgaaggccggtctcttagccacatctttactttcgatgaagaggcaacatgtacggacgagggcgagccactcgtacagacgaataaaaagtgtaacgcaaaagattccttttacaaatctagtacccagaaagcttacgaagatgtcccctgggataaaatgctccctcctaaactggtgccagaagagaccacattggaaaaaaccgctgatcccatctcacagtgtttcaccctcaagcgatacaagggtgtgcccgctatcacacagatggtcggtgagttgtgggacagattccagaccagatcttttctcgccccagttaagccaatcaacttcgtgagctcctcctctagatcaaaatacatccctctgtacaccggtcacgttcagagcacaaatgcagacgacgtcgacaatcctctcggggatatcgccagccttgcgaagcagcgctacagtaagcccctttacacgaatacaagtcgtgcagcaaatattcctggatacactggcaaggtccactttactgcgacccaccccgctaatagcaacatcccctcaaccactccaagtccagacagtgagctgcatagggtgttccagaaagaaatggccgttgatctgtttcggcaccaggcccccctgagtcggctggtgaccaccgtgcgaccgtacaacccatttaataagaaagataaggaaaccatcgactactag

SEQ ID NO: 45890 - DNA, 144 bp, Artificial Sequence
  Description of Artificial Sequence: Synthetic coding sequence
atgctgcagttcctgctgggcttcaccctgggcaacgtggtgggcatgtatctcgcacagaattacgacatccccaatctagccaaaaagctcgaggagattaagaaggacctcgatgcgaagaaaaaaccccctagcgcctag

SEQ ID NO: 45891 - DNA, 315 bp, Artificial Sequence
  Description of Artificial Sequence: Synthetic coding sequence
atgggccggagcccctgcttcttcaagagcttcaagggcaagctgcacaaagacaggtcccccgatccatcaactctggcaagcccacaccctagtacagaggcgcggagacccgtggaagccggctctgcagaatggacatggggctggatgaagagactccccccagccagcttgagtcctggcatcgcgatgtcctgttacagtggggattctatgctgcaaaaatacaaggtgaagaacgcttatcgtctgcattggcagggtagggaagagccaggtgcaagcacgttcgcatcacttgtgttccaatag

SEQ ID NO: 45892 - DNA, 315 bp, Artificial Sequence
  Description of Artificial Sequence: Synthetic coding sequence
atgggccggagcccctgcttcttcaagagcttcaagggcaagctgcacaaggacaggagcccagacccctccaccctggcatctccccacccatccacagaagcaagacgaccagtcgaagccggctctgccgaatggacctggggttggatgaagcgattgcccccagctagcctttccccaggtatagctatgagctgttattctggcgactctatgctccaaaagtataaagtgaaaaatgcgtataggctgcattggcagggaagagaggaacctggcgcatctactttcgccagcctcgtgttccagtag

SEQ ID NO: 45893 - DNA, 255 bp, Artificial Sequence
  Description of Artificial Sequence: Synthetic coding sequence
atggccagcgtgcccagcatcggctgcctgctggcccggaaccagtactatagaaagtcctctgtaagtagtgtttcttcacttacgagtagcgactctgtcaattttatcgatgatgacaagcctcagcaggggctgcctgaggtcgcagagagcacctggtggtttaaaagcttctttcattccgaaccagttctgagcaatgttagaattaaagatctgagtgcaacaggaagcctgagtgggagaagttag

SEQ ID NO: 45894 - DNA, 246 bp, Artificial Sequence
  Description of Artificial Sequence: Synthetic coding sequence
atggccagcgtgcccagcatcggctgcctgctggcccggaaccagtactacagaaagtccagcgtgagctccgtctctagcctgacgagctctgacagtgtcaacttcatagacgacgataagccacagcagggattgcccgaggtggctgagagcacgtggtggttcaagtcattttttcattctgaacctgtgctgagcaacgtgaggataaaggatctaagcgccaccggcatgaattcatag

SEQ ID NO: 45895 - DNA, 399 bp, Artificial Sequence
  Description of Artificial Sequence: Synthetic coding sequence
atggccgagaagccccaccagaacagctgcaacagcgtgcggcagctgtttaagaccaagcagctggtgacacacagagatagaggatcctgcacgcaccgcgcgcagggtttattggctgcgaggaccacagccctccagcggagtcccctgcagcaggaaatttgggaaagtacaacagcacttaatctgccctccgcactggccccccagggccttactgcaaaggatgcccacttcctgggagatacagatcccatccaagaaggcgctagggatcatgcagccggcggaccctttcaggaccggcaggctagcgttgctgctcagacactatcgtgggagagaggccaggggttctccagacaccacggtaatcacctactctactcccactag

SEQ ID NO: 45896 - DNA, 690 bp, Artificial Sequence
  Description of Artificial Sequence: Synthetic coding sequence
atggccgccctgggccacctggccggcgaggccgccgccgcccccggtccgggtacaccatgtgcgtcacgaggggcccgccttcccggccctgtgagctctgctcgaaatccgtctacggtctgcctctgtccagagcagcccacttgtagcaatgccgactcacgagctcatccacttggcgacgagggaggcacagcgtctaaaaagcagaaaaacaaaaagaaaactcgcaaccgagcctctgtggccaatggcggagaaaaagcctcggagaaattggctcccgaggaggtccccctgtcagcggaagcccaggcccaacaactcgcccaggaactggcctggtgcgtcgagcagctggaactgggtctcaaacggcaaaaacctacccccaagcagaaggaacaggctatcggcgccatcagaacgctgaggagtaaaagaactccattaccccgaaaaagacaactgatgcattccctattcggcgactatcgggctcagatggaggctgaatggcgtgaggccttgagggccctgcgcgccgcagcctatagcgcacaggtgcagcctgttgacggtgcaacccgcaaaaaatctcagcgtgtgtgtaggccgcggtctatatggcgggcgaaggcaactctggatatgcctgacgaagagttcaggttcaattttttctag

SEQ ID NO: 45897 - DNA, 606 bp, Artificial Sequence
  Description of Artificial Sequence: Synthetic coding sequence
atggagaacggcttcaccatgtgccagaccggccggcagcaccccgtcgcctgcgggctgcaccttagcggaggcaaggaggaccttaacgacctaaggatggagggggtgactacactcgttccatcggggtctaaatttaatcagggcagaccaacatacccagcagagccgcaggccaaagtgaccctgaacatttgttctcggtgtgcacgactgcagggggacaacctagaggagcgtactgaggaaagcctcccaatcctgcattctcccgatgaaaagatccccgattctttcgactccctgcctggtacagaggaggccctgatggaggagggcgatgagttcgaaaaggccagcaagttaacaggaccgggggaagcaagcagcggagtggggcactcactgaaaaactatatggaggaggatgagtcattaaagcagcttcaggttgtacatcaaccttggatcctgccatccgacacggagtcagaaggcgtggaagcggagcaggagaagcacttattgaaccaaaatctgtgcggatgggatagcgaattttgcatctttcacaccctcgccagcttcctgatttataaatag

SEQ ID NO: 45898 - DNA, 1284 bp, Artificial Sequence
  Description of Artificial Sequence: Synthetic coding sequence
atgaccaagctgatcaccgagacccccgaccagcccatccccttcctgattgaccacctgcagagtaaacaggggaataggggacagctgcagaggacactgtccggttccgcagctctttgggcggagtccgaaaaaagcgaatccaaaggcacccgacgagattttaggtcatatgataaaccatggcaacttaatgcaaaaaaaccgaaaaaatctaagtctgatttagcagttagcaatatttcaccgccctctcctgattccaagagtctgccgcgttcggtcgagcaccctaagtggaactggcgcaccaagccacaatcaagagattttgacgagctgaatcacattcttcaagaatctaaaaaactcggcaaagccctggaaaatctttctagatcaattgctatcagtgatgagctggataaagagacggtgacctttaatagttctctgcttaggcctcgcgtgattggagagtggattggtcgggaggagaatgacgcggatccccttgccgcagagatgctgcagccaccaataccccgctcaaaaaatgatcagtgggaaagcgaggatagcggaagcagcccagcgggcagtttaaaaatggagcctaaaaacaaggggcttaagcagcagcagcagcaacacaagaagttgctggcagctatgctgtctcaagattcattcgagtcaattcatagccccaccccttcagtaacagaagaggacattgacaacgaggacgatgctatggaactcctggaagacctcaacgacctccgcatggagggggtgaccacgctagtaccaagtggttccaagttcaaccagggtaggcctacgtacccagccgagcctcaggccaaagtaacccttaatatttgttctcgatgcgctcgcctgcagggggataatctagaagagagaaccgaagagagtctacctatcctgcattctccagacgagaagatccccgactcttttgactctctaccgggaactgaggaagcactgatggaggagggcgacgagtttgagaaggccagcaaactaactgggcccggagaagcaagctctggcgtcggacatagtctgaagaattatatggaggaagatgaatccctgaaacagctgcaggttgtgcatcagccctggattctgccgagcgatacagaatctgagggggtggaggccgagcaggaaaagcgttccgcggaccttctgctgtgtgtgccgtgtagctcctgtccaacgctggtgtacagcgggttgtag

SEQ ID NO: 45899 - DNA, 864 bp, Artificial Sequence
  Description of Artificial Sequence: Synthetic coding sequence
atggccagccacccccagacccggatccaggcctacctggagaagaataagataggcccactgttcgaagagctcatgacaaaactcatcacggagacacctgaccaacccatcccattcctgattgatcaccttcagagcaagcagggaaatcggggtcagttgcaaagaactttgtccgggtcagccgcgttgtgggccgaatccgaaaaaagcgagtcaaaggggacgagacgggatttcaggtcctacgataagccttggcaactgaatgccaagaagcccaaaaagtcaaagagcgacctcgctgtctcaaatatctctcctccctcacctgatagcaagtctctgcctaggtcagtggagcaccctaagtggaactggcgaacaaaacctcagtccagagattttgacgaactgaaccacatcttgcaggagtctaagaaactgggcaaggcactggaaaacctgagccgcagtatcgcaatcagtgacgagctcgacaaagagaccgttacctttaatagctcactgcttcgtccacgagtgataggcgagtggataggccgggaggaaaacgacgcggatcctttggcagcagagatgttgcagccacccatccccagatcaaaaaatgatcaatgggagagcgaggacagcggtagttcaccagcgggcagcctgaagatggaacccaaaaataagggcttgaagcaacagcagcagcagcacaagaaattgctcgcagccatgttgagtcaggactccttcgaatccatacacagtccgacaccatccgtcactgaggaggatatagacaacgaggacgatgctatggaactgctgggaaatttcaaaaactag

SEQ ID NO: 45900 - DNA, 1617 bp, Artificial Sequence
  Description of Artificial Sequence: Synthetic coding sequence
atgagcagccccctggccagcgagctgagcgagctggccgccctgaggcccggatttaggttatctgccccgcatgcaagagtagcgccacgagccgctacacatgcgagaggacgcggccgcgcttctcatgccggacagcccagactgagatcttcttgtcctggaccctcccctggtaaaaggcgggtcgtgccttctggaggcgcacagccccgagtgttgcctgcgctgtcgtctcggtcccatctatttccgatggcttcccatccgcagacgcgcattcaggcctaccttgaaaaaaataaaatcggtcctctgtttgaagaactcatgacaaagcttattactgaaacgcccgaccagcccattccattcctgatcgatcaccttcagtccaagcagggtaatcggggccagcttcaacggactctctcagggagcgccgccctgtgggcagaatcagaaaaaagcgagtccaaaggcacccgacgggactttagatcctacgataagccttggcagctgaacgccaagaaacctaagaagtcaaaatccgacctagctgtatccaatatctcccccccaagtccagacagtaaatctctgccgagaagcgtcgaacaccctaaatggaactggcggaccaagcctcagtccagggactttgacgagctgaatcatatcctccaagaaagtaaaaaacttggcaaagcattagaaaatctgtcccggagcatcgcaatctcagatgagctcgataaagaaacagttacttttaacagcagcttactgcgcccgcgagtaatcggagagtggattgggagagaggagaatgacgcagacccccttgcagctgagatgctgcagccccccattcctcgcagcaaaaatgaccaatgggagagtgaggatagcggctcttcccccgcaggaagtctcaaaatggaaccaaagaataaaggcttgaaacagcaacagcagcagcataagaagctactggcagcaatgctctctcaggattcgtttgagagtatccatagtccaactcctagcgtgacggaggaagatatcgacaacgaggatgatgccatggaactcctagaggatttgaatgatctgagaatggagggggttacaaccctggttccttctgggtcgaaattcaaccagggcagacccacctatccggcggagccccaggcaaaggtgaccttgaacatctgcagccggtgtgcgagactgcagggagacaatcttgaggaacgaacggaagaatctctccccatcctacacagtcccgacgagaaaattccagatagcttcgatagcctgccaggcaccgaggaagccctgatggaggaaggcgacgagtttgagaaggcaagtaagctgaccggacccggcgaggctagctcaggggtgggccactccttgaaaaactatatggaagaagacgagtccctgaagcagctccaggtggtgcaccagccttggatcctgcctagtgataccgagtcagaaggtgtggaagctgagcaggagaagcgttcagctgacctcctcctatgtgttccctgctcctcatgccccaccctggtctactcaggattatag

SEQ ID NO: 45901 - DNA, 390 bp, Artificial Sequence
  Description of Artificial Sequence: Synthetic coding sequence
atggccagccacccccagacccggatccaggcctacctggagaagaataaaattggacccctgttcgaggagctgatgaccaaactgatcactgagacgcccgatcagccaatcccttttttgatcgaccacctccaaagtaagcaaggaaatcgcggtcagttgcagaggactctaagtggatcagccgctctgtgggccgagtccgaaaagtctgaaagcaaaggaactcggcgggactttcgatcctatgacaagccctggcagttgaacgctaaaaaaccaaagaagagcaagtctgacttagccgtgagtaatatttcgcctccctctccagactccaaatcctgtaaggaagtatcctactcaaatgctattcaaagtatgtag

SEQ ID NO: 45902 - DNA, 1359 bp, Artificial Sequence
  Description of Artificial Sequence: Synthetic coding sequence
atggccagccacccccagacccggatccaggcctacctggagaagaacaaaattggtcccctctttgaggagttgatgactaaactaatcacggagacccccgatcagccgatcccttttcttatcgaccacttgcaaagcaagcagggcaacaggggacaactgcaacgtaccctgagcggatctgccgcgctttgggcagaatcagagaagtccgaatcaaaggggacgcggagggatttccgaagttacgataagccctggcagttaaacgccaaaaagcccaaaaagtcaaagtccgacctggctgtgtccaacatttcacctccgtccccagatagtaaaagcctgccccgaagtgtcgagcacccgaagtggaattggagaactaaacctcagtcacgagattttgatgagctgaatcatattctacaggagagtaagaagctcgggaaagctctggagaaccttagtcgatctatcgcgatttccgacgaattggacaaagagacagtcaccttcaactcttcactgctgcggcccagggttatcggggagtggatcggccgcgaggagaatgatgcagatccacttgctgcagaaatgctccagcctcccattccccggagtaagaacgatcagtgggagagtgaggattcagggtcttcacctgcgggatcattgaaaatggagccaaagaacaagggtttgaaacagcagcagcaacagcacaaaaagctcctggccgcaatgctgagccaggattcttttgagtccatccattcacctacaccaagtgtgacagaagaagacatcgacaacgaagatgacgcgatggaactcctggaagacctgaatgatctacgcatggaaggcgttacaacactcgtccccagcggtagtaagttcaatcaggggagaccgacttacccagcggagccgcaagccaaggtcacgttgaatatttgttcacgctgtgccaggctgcagggggataacctggaggagcggactgaagagtcactaccaatccttcattctcccgacgagaagatccccgacagctttgactcactgccgggcactgaagaagcccttatggaagaaggggatgagtttgaaaaggccagcaagctaacaggccccggtgaggcgtcttcaggagtgggtcatagtctgaaaaactacatggaagaggacgaatccctgaaacagctgcaggtggttcaccagccctggatactccccagcgatactgaaagcgaaggggtcgaagccgagcaggagaagcgcagtgcagatctgctgctctgcgtgccctgttccagttgccccacccttgtttacagcggcctatag

SEQ ID NO: 45903 - DNA, 624 bp, Artificial Sequence
  Description of Artificial Sequence: Synthetic coding sequence
atggccgaggacctggacgagctgctggacgaggtggagagcaagttctgcactcctgacctcctgagacggggaatggtggaacagcctaaggggtgtggggggggtacccactcatcagacaggaaccaggccaaggctaaggagaccctgcgcagcactgaaacattcaagaaagaagacgatctggactcgctgattaacgaaatcctagaagaacctaatctggacaagaagccttcaaagctgaagagcaagtctagcggaaatacttctgtaagggcctccatcgagggcctgggaaagtcctgctctcccgtttatctcggagggtcctccatcccctgtggcattggcacaaatatctcttggcgtgcatgcgatcacctgcggtgtatcgcctgcgactttcttgtggtcagctacgacgattacatgtgggacaagtcttgcgactacctgttttttcgaaacaatatgcctgaattccataagctgaaggcaaagctgattaaaaagaaagggactcgcgcttatgcttgccaatgctcttggcgcactatagaagaggtaaccgaccttcagaccgatcaccaactgcgctgggtgtgcggaaaacactag

SEQ ID NO: 45904 - DNA, 309 bp, Artificial Sequence
  Description of Artificial Sequence: Synthetic coding sequence
atggcccaggacttcagccagcacccccagaccggcatcatccggaggcatcgtttttactctccaaaaccactgtcaaccaccccacgaggtcagtcttttctgctgagcagacaggcaaaagtggccacttgggatccaatgctttcacccgattttcaacccaagtcggcctttaaactcacgtggactgcccagcctccttgcttgtctgtgacaccgtctcaaggtcagacctttcacccaaattcaccggaaggggagttgccgcctgacctgacagagaatacctgtccttcacaagcctag

SEQ ID NO: 45905 - DNA, 558 bp, Artificial Sequence
  Description of Artificial Sequence: Synthetic coding sequence
atgtggaagctgggccggggccgggtgctgctggacgagccccccgaggaggaggacggtctccgaggaggccctcctccagcagccgccgccgccgcccaggcccaggtccagggagcctcatttaggggttggaaggaggtgacctcgctctttaacaaagatgatgagcaacacctgctggagcggtgcaaatctcccaaatccaaaggcaccaacctccgccttaaagaggaactgaaggctgagaagaagagcggattctgggacaaccttgttttgaagcagaacattcagtctaaaaagcctgatgaaatcgaggggtgggagccgcccaaactggcccttgaggatatcagtgccgaccctgaagatacagttggcggtcacccatcatggtcagggtgggaagatgacgctaaaggatctacaaaatacactagcttggcctcaagcgccaatagtagccgctggtcacttagggctgccggccgcttggtgtctattaggcgtcaatctaaggggcatctcactgacagccctgaagaggcagaatag

SEQ ID NO: 45906 - DNA, 597 bp, Artificial Sequence
  Description of Artificial Sequence: Synthetic coding sequence
atgtggaagctgggccggggccgggtgctgctggacgagccccccgaggaggaagacggccttcgtgggggccctcctcctgccgctgctgctgctgcccaggcacaagtacagggcgcttcttttagaggttggaaagaggtcacgagcctgttcaacaaagatgacgaacagcacctgctagagagatgtaagtccccaaagagcaaaggcacgaacctgcgcctcaaagaggagctaaaagcagaaaagaagtctgggttttgggataaccttgtgcttaaacagaatatccagagtaagaagcctgacgaaatagaggggtgggaaccccctaaactggctcttgaggacatttccgccgaccccgaggacacggtgggcggccacccatcctggtctggctgggaggatgacgcaaaggggtccaccaagtacacttctctcgccagttccgcaaactctagcagatggagcctacgggcagccggccggctgataaaagaggtttggataaacttttcccaacttattatctcattccgaaagcattgccttgctcactatcgagagctgaggctgtgtatcaagtattag

SEQ ID NO: 45907 - DNA, 597 bp, Artificial Sequence
  Description of Artificial Sequence: Synthetic coding sequence
atgtggaagctgggccggggccgggtgctgctggacgagccccccgaagaggaggatggtcttcgaggcggccccccaccggcagctgcggcggctgcacaagctcaggtccagggtgcatcctttcggggctggaaagaagtcacaagtctgtttaataaagatgacgagcagcaccttttggagaggtgtaaaagtccaaagtcaaagggtacaaacctccgcctgaaagaagagctaaaggcagagaagaaatccggcttttgggataatctcgttttgaaacagaatattcagtcgaagaagccggatgagatcgaaggatgggagccaccgaagcttgcactggaggatatcagcgccgatcccgaagacacagtgggaggccacccttcctggtcaggatgggaagatgacgcaaaagggtctacaaaatacacttctctcgcatctagcgcgaactcgagccgctggagcttaagagctgccgggagactcattaaggaggtgtggatcaacttttcccaactgatcatcagctttcgcaagcactgcctggcccactatcgcgagctccgcctttgcattaaatactag

SEQ ID NO: 45908 - DNA, 480 bp, Artificial Sequence
  Description of Artificial Sequence: Synthetic coding sequence
atgcggaagaacgagagctacctgaaccagcccgccccccccatccctattcccaccctgtcgctcatgggagggtgtcgggaacattttgagaatcactggaaggggagggctaggtggctcatgcccgtcattcccgctctgtgggaggctaaagctggccgctccccagaagtgcggtcttctaaacccgcctggcctacctggagaaacccgatcttcacaaaaaataccaagattagccaagtccttgagttgttcctgaattatcagtccttgatctgtgccctcgaaaagcagaaacgacagaagggaagtctggcaatattttgttggtccttccagggggggtgcgttagtaagcggcctgatgtccccagcctgaaaagccagaaaccaaagagaaagcgaatcacagggagaaaacggctgtccaaaggcttttggagtctcttattttcgaacttaggtcgcttttag

SEQ ID NO: 45909 - DNA, 480 bp, Artificial Sequence
  Description of Artificial Sequence: Synthetic coding sequence
atgcggaagaacgagagctacctgaaccagcccgccccccccatcccaatccccacccttagccttatgggcgggtgtcgcgagcactttgaaaatcactggaaaggaagagccagatggttaatgccggtcatccccgccttgtgggaggccaaggcaggccgatcgccggaggttcgatctagcaaacccgcctggcccacctggcggaatcccatctttacaaaaaacactaagattagtcaagtgttggaattgttccttaattaccagagtctaatatgcgcgttggagaaacagaagcgccagaaaggctcacttgctatcttctgctggtcctttcagggcgggtgcgtttctaagaggccagatgttccatccctcaagagtcagaagccaaagcgcaaaaggatcacgggacggaaaagactctcgaagggcttctggtccctgttgttttctaacctgggcaggttttag

SEQ ID NO: 45910 - DNA, 1899 bp, Artificial Sequence
  Description of Artificial Sequence: Synthetic coding sequence
atgagcaacctgaagatgaaggaggccgccctgatctacctggaccggtcaggtgggcttcagaaatttatagacgattgcaaatactataacgactcaaagcagtcgtacgccgtgtatagattcaagattctcatcaacccatcagatgtggttgagcttgatgccgagctgggtaatcacattctgcaccagccattgaaagctgctgaagtgttccaaagcgtctgttttattgccgtgaaaacactctcccttatcggccaattgcagaccgaaactcaaatcaatatcgtcttgaaacttacccacctcccgccgctgcctagttacggactcgacctctgtgagtttcctctggactatacctcccagcggttttacatgatgcaggggattgtgatagctatgactactatcaccaaatacactcagggagcccggttcctgtgcagcgatgaggcttgtcccctttcaaaggggtttcagtacatcagggtccacgtgcccggggctacagagtcggccactattagaaacgatttcctttgtaacctgtgtgccagctcccttcaggaagatcgcaagttccgtgttctaggagacaaacagattgtcgagattatcgctacaaaagctctgcgggctttccaaggatactcgaataatcaaccctttcgattccaaagtctgaccatctttttgagagatgaatccgtcaacaagatgaacattggaaatgagtacaagattatcggcatccctacctgcgttaagacatcccagacagccgtgtgcattgaggccaactcaataacgttctgtaacagtaaggtgccatcgggaatctctgataatttccgctgtctgttgtcattgacttcctctagctgctggaagtttactgccatacttgcaaatatcttcgcatcccagatcaccccaccagggacttacaatcttctgaagttatgcctattgatgtctctggtacagacgactgatcggaataaggaattggaagactgtttggacatactcattatcacaagcgacaccctgctgatcgatcggttgctgaatttcagcataaatctggtgccaagaggaatacgccacctggtgtcaaccgagatattccctactttatccaggaataagtatgggacgggtgctgtgagcatccaggcaggatcggcgctcctggcaaagggtgggatctgttttatcggcgatttggcctcccacaagaaggataaactggagcagctacagacagtgctggaatctcggagcataacagtgtacatcccaggtaagaaatttggcgaggatatcgaccagcaaatgacattccctgtgcaatgtagtttctggagcttcgtggatgtcgatagcagctcgagacggaacgcacagaaaatcaatactctcatcggtcagatggactgctctttaatccccgccaaccttgtagaggcctttggtttgttaattaactgcaacgagagcagtccatgtcaccctttcttacccacagtgcagcacactctaaataaagccatcaaccccgaaggcctgttctacgcagcctcccgccagttcaccaccgaagactttgagaaacttctggcgttcgcaaaaaacctgaatgtggaattttcacttgaggcggagcggatgacgcacggttattatctagcttcaaggagaattaggaccgggtcggtgtgcgggtctaagctgtccgcctctgccttgaagtatctggtgttcctaagtgaggcccatgctaggctgaatctgcgcaacaaggtgctgaaggaagatgtgctaattgctgcactcttatttgaaacctcacttacccttaagtacggaaatgaactgaattactag

SEQ ID NO: 45911 - DNA, 1002 bp, Artificial Sequence
  Description of Artificial Sequence: Synthetic coding sequence
atgatgcagggcatcgtgatcgccatgaccaccatcaccaagtacacgcaaggcgcaaggtttctgtgctcagacgaagcatgtcctctaagtaaagggttccaatacatcagagtccacgtgcccggggctaccgagtctgctaccatacgtaatgatttcttatgtaacctgtgcgcctcctccctccaggaagacaggaaattccgagtcctcggagacaaacagatcgtggagatcatcgccaccaaggccctccgtgcctttcagggatacagcaacaaccagcccttccgttttcaatcgctgaccatatttctgcgcgacgagagtgtgaacaaaatgaacataggtaatgagtacaagattatcggcattcctacatgtgtgaagacatcacagaccgccgtctgcatcgaagccaactctattacattctgtaactcaaaggtgcccagcggcattagtgataatttccgctgcctgctgtccttgacttcttccagctgctggaaattcacagccatcctagcgaatatatttgccagtcagatcaccccacccggcacttacaatctgctcaagttgtgcctgttaatgtcacttgtccaaacgacggataggaataaagaattggaagactgtctggatatactgataatcaccagtgacacacttctgattgatcgactgttaaacttctctatcaacctcgttccccggggcatccggcacctggtctcgaccgaaatctttccaaccctgtccaggaacaagtatggcacaggtgccgtgtctatccaggctgggtcagcacttttagccaagggcggtatatgctttattggcgacttggctagccacaaaaaggacaagttggagcagctacaaacagtcctcgaaagccgcagcatcacagtgtacatccccggaaagaagttcggagaggacatcgatcaacagatgaccttccccagcgtccagttcttggttttctgctag

SEQ ID NO: 45912 - DNA, 1773 bp, Artificial Sequence
  Description of Artificial Sequence: Synthetic coding sequence
atgagcaacctgaagatgaaggaggccgccctgatctacctggacaggtccgggggactgcagaagtttatcgatgattgcaagtactataacgattccaagcagtcttacgctgtctaccggttcaagatcctgatcaacccctccgatgttgtggagctggacgccgagctgggcaaccacatcttacaccagccccttaaggctgctgaggtcttccaatcggtgtgcttcattgccgtgaaaacgctctcactgattggccagctacagactgaaactcaaatcaacattgtgcttaagcttacgcaccttccccctctgcctagctatggcttggatttatgcgaattcccgcttgattacactagtcagcgcttttacatgatgcaggggatcgtgatcgcaatgaccaccattacaaagtatacacagggcgcccggttcctgtgttccgacgaggcatgtccactttcaaaggggttccagtacattagggtccatgtgcctggcgccaccgagtccgctaccatccggaatgacttcctgtgcaatctctgtgccagtagcctccaggaggatcgaaaatttagagttctgggtgacaagcagatcgtagaaatcattgctacgaaagctctaagagcttttcagggttatagtaacaatcagccgttccggttccaaagccttactatctttttgagggacgaatcagtgaataaaatgaatataggcaatgaatacaagattatcggtatccctacctgcgtgaagacgagtcagaccgctgtctgcatcgaagctaatagtatcactttttgtaatagtaaggtgccaagcggaatctccgataacttccgttgcctgctgagtctcaccagcagcagttgttggaagttcacggcaatcctggctaacatcttcgcatctcagatcacgccccctgggacctacaacctgttaaaactgtgcttactgatgagcctggtgcagaccactgataggaataaggagttggaggactgcctagacatactcattattacatcagacaccctgttgatagaccggctgctgaacttcagtataaacctcgtccctcggggaattcgccatctggtgagtacagaaatctttcccacccttagtcggaacaagtatggcacaggcgctgtgtcaattcaggctgggtccgccttattagctaaaggaggcatctgcttcatcggagatctggctagccacaaaaaagataagcttgaacagctccaaacggttctggaaagccgctctattaccgtgtatatacctgggaaaaagttcggagaggacattgatcagcagatgacttttcccgtccaatgctcattttggagcttcgtggatgtggactccagctcacggaggaacgcacagaagatcaatacccttattggtcagatggactgttctttaattccagctaatctggtggaagcatttggactcctgattaactgcaatgagtccagcccatgccatccctttctgcccactgtgcaacataccctgaataaagccattaacccggaggggctgttttatgcagcctctcgacagtttaccacggaggatttcgaaaagctgctggcgttcgctaagaatctgaacgtcgagttttctcttgaagcagaacggatgacccatggatactatttggctagtcgccgtatccgtacaggctccgtgtgtggatcaaagctgagcgcttctgccctgaaatatctctag

SEQ ID NO: 45913 - DNA, 2046 bp, Artificial Sequence
  Description of Artificial Sequence: Synthetic coding sequence
atgagcaacctgaagatgaaggaggccgccctgatctacctggaccgctcaggcggactgcaaaagtttatagacgactgtaaatattacaacgactctaaacagtcctacgccgtttatagattcaagattctgattaatccgtcagatgtggtggaactcgatgcggaacttgggaatcacatccttcaccagcctctgaaggccgcggaggtgttccaaagtgtttgttttatcgctgtcaaaactctatctctgattggtcaattacaaactgagacccagataaacatcgtccttaagctcacacatttgccccctctgcccagctacgggctggatttgtgtgaatttcccctggactatactagtcagaggttctatatgatgcagggcatcgtgatagcaatgactacaatcacaaaatatactcagggcgccaggtttctgtgcagtgatgaagcctgcccactgagtaaaggattccaatatatccgcgtccacgttcccggggctaccgagagcgccactatcaggaatgatttcctctgtaacctatgcgcctccagcctccaggaggatcggaagttcagagttttgggtgacaagcagatcgttgagattattgcaaccaaagcccttcgagcattccagggttactccaacaatcagccattcaggttccagtcccttacaattttcttaagagatgaatctgtaaacaagatgaatatcggcaacgagtataagattatcggtatcccgacttgtgtgaaaacatcacagaccgcagtgtgtattgaagccaattcgatcacattctgcaactctaaggtaccatccgggataagcgataactttcggtgtcttctaagcttaacgtctagcagctgctggaagttcactgcgatcctcgcaaatatttttgcctcccaaattactcccccggggacatacaatttgcttaagctctgtctcctcatgtcccttgtccagactacggatagaaataaggagttagaagactgtctcgatatattgattattacaagcgacaccctactgatcgatcgactgctcaacttcagtattaacttggtgccgagaggcatccgccaccttgtctccacagagattttccctaccctgtcacgaaataaatacggaacaggagcagtctccatccaggccggttcagccctgctagctaagggcggcatatgcttcattggtgatctggcctctcacaagaaggacaagctcgagcagcttcagacagtactagaaagtcggtccattacagtctacatacctggcaaaaagttcggggaggacattgatcagcagatgacttttcctgtacagtgcagtttctggagtttcgttgacgtggattcttcgtcaaggagaaatgcccagaaaataaacacattaatagggcagatggactgttctttgatccccgcaaacttagtagaagcattcggacttctgatcaattgtaatgagtcatctccgtgccacccctttctccctacggtacagcacaccctgaataaggcgatcaatcctgaggggcttttctatgctgcctctaggcagtttactaccgaggattttgagaaattgctggcatttgcgaaaaaccttaacgtggaatttagcttggaggcggaaagaatgacacatggctactacctggcttctcggagaatcagaacaggctctgtctgcggctctaaattgagtgctagtgcgctcaaatacctggtgttcctgtccgaggcccacgcacggctgaacctacgcaacaaggtgcttaaggaggacgtgttaatcgcagcactgctgtttgaaacgtcactgacattaaaatatggcgccaccgttttctgtgtggcccctaatgcggtgttcccttttgagctatacaacgaggaatatctggaacagcgtgatttatacctgacgcagtgtcagcaacagctggagcagtttatagcgacctacgggcccggcacaactattttcagctctgacgagtag

SEQ ID NO: 45914 - DNA, 1857 bp, Artificial Sequence
  Description of Artificial Sequence: Synthetic coding sequence
atgatcgccagcaccaccatggtgcggagcgccaaggtgtgcttcatagccgtcaaaaccttgagcctgatcggccaactccaaaccgagacgcagataaatattgtgctgaagctcactcatttaccacccctgccctcctacggactggacctttgtgaatttccccttgactacacaagccagcggttttatatgatgcagggtatcgtaatagccatgaccacaatcacgaagtacacccagggtgctaggtttttgtgtagtgatgaggcgtgcccactgagcaaggggttccagtacattcgcgtacatgtgccaggagccacagagtcagctacaatacggaacgatttcttgtgcaatctctgtgctagctccttgcaggaggatcgaaagtttagagtgctaggagataaacagattgtggaaatcattgccaccaaggctttacgcgcctttcagggctatagcaataaccagccattccggtttcagtccctgaccatcttcctgcgcgacgagagtgtgaacaagatgaatatcggaaatgaatataagattattggtatccccacttgtgtgaagacttcccagacggccgtctgcatcgaggccaattccattaccttctgtaactctaaggtcccctccggaatctctgacaatttccgctgcttattgagcctcacttccagctcatgttggaaattcactgctatactggccaacattttcgcgagccagatcaccccccccggtacctataacctgctcaaactgtgtcttttgatgtctctggtgcagaccacagataggaacaaggaactcgaagactgtctcgatatcctgatcatcacttccgatactttgttgatcgatcggcttcttaatttcagtattaacctagtgccacgcggtattcgacatcttgtctccaccgagatctttccgacactgtcgcgcaacaaatacgggacaggcgccgtgtcaatacaggccgggtcagcattgctggccaaaggaggaatttgtttcatcggcgatctggcgagccataaaaaggataagctggaacagcttcagacagtgctggagagccggtccatcacagtgtacattcccgggaagaaattcggagaggacatagatcagcaaatgacttttccggtccagtgctctttttggagctttgtcgacgtggacagttcaagcagaaggaatgctcagaaaattaatacactgatcggacaaatggactgtagcttaatacctgccaacctggtagaggcatttgggctgctaattaattgcaacgagagttccccttgtcacccttttctacccaccgtgcagcacacgctgaataaagcaattaatcctgagggactcttctacgcggcttcccgtcagttcaccactgaggactttgagaaacttctggcattcgcaaaaaatctgaatgttgaattctccctcgaggccgagcgcatgacccacggctactatctggcctcacgcagaatacgcactggaagtgtgtgtggcagcaagctgtccgccagtgccctgaagtatttggtcttcctgtcagaggcacatgccaggctgaatttgcgtaacaaggtcctcaaggaggacgtgcttatagctgcccttctgttcgaaactagtctcacattaaagtacggcgcaacagtcttctgtgtcgctccaaatgccgtgttccctttcgaactctataacgaggaatatctcgaacagagggatctctacttaacgcaatgccagcagcaactcgagcagttcattgccacatacgggcctggcaccactatattttcatctgatgagtag

SEQ ID NO: 45915 - DNA, 624 bp, Artificial Sequence
  Description of Artificial Sequence: Synthetic coding sequence
atgatgcaccagatctacagctgcagcgacgagaacatcgaggtgtttaccacggtgattccaagtaaggtctctagccccgcccggaggagggccaaatccagccaacatctgttgaccaagaacgttgtgattgagtctgatctctatacgcaccaacctctggagctactcccgcaccggggtgaccggcgcgaccctggcgaccggaggaggtttggcaggcttcaaactgcgcgaccacctacggcgcatcctgctaaagcaagtgctagaccagtgggaattagcgagcccaaaacctccaacttatgtgggaatcgggcgtacggcaagtccttaataccaccggtcccacggatctccgttaagacatctgcttcagccagcctcgaagcaacagcaatgggcactgaaaagggagccgtcctgatgcgggggagtcgacaccttaagaaaatgactgaagagtatcctgctttgccacagggggcagaggctagtctgccactcacaggcagcgcctcatgcggagtacctggaatcctgaggaaaatgtggacaaggcacaagaagaagtcagagtacgtcggcgctaccaacagcgcgtttgaggcggactag

SEQ ID NO: 45916 - DNA, 1125 bp, Artificial Sequence
  Description of Artificial Sequence: Synthetic coding sequence
atgggctgcagcagcagcgccctgaacaaggccggcgacagcagccgctttccttcagttacgtctaatgagcacttttctaccgctgaagagtctgagagttgttttgcgcagcctaagcctcacgccttgggacgggagtctaccgtggatggtaacgtacagcgggagagccgccccccactgcaaaagctcaaggtgtctgctgaacctacagcgaacggcgtaaaaccattacaggagcaaccacttgccaaggatgtggcccccggcagagatgccactgaccaatctggatccaccgaaaagacgcagccaggggagggcctggaagaatctggacctccacagcctggcggtaaggaggatgcacctgctgctgagggtaaaaagaaggacgctggagcagggacagaggctgagtcactgaaaggaaacgcagaagcccagcccctcggtccagaggccaagggccagccactgcaggctgccgttgagaaagacagtcttagagccgtggaggtaacagagaacccacagaccgctgcagagatgaagcccctggggacaactgagaacgttctcacacttcaaattgccggggaactccagccgcaaggaaccgttggaaaggatgagcaggcccctctactggaaactatttcaaaggaaaatgaatctccagagatcttggagggatcgcagttcgttgagacagctgaggagcagcaactgcaggcgaccttgggaaaggaggaacaacctcagcttttggaacggatccctaaggagaatgtcaccccagaagttctggatcgatcacagctggtagagaaacccgttatgaacgacccattccataaaacacctgagggaccaggcaatatggagcagatccaacccgaggggatcgtcggtagtatggaacaccctgcacggaatgtggaggctggagcgtacgtcgaaatgattcgcaacatccatacaaacgaagaggatcaacgcatagagggggagacaggagaaaaggtcgagacggatatggagaatgagaaagtgtccgagggggccgaaaccaaggaggaggagaccggagaggtggtagatctatccgccgccacttag

SEQ ID NO: 45917 - DNA, 171 bp, Artificial Sequence
  Description of Artificial Sequence: Synthetic coding sequence
atgggctgcagcagcagcgccctgaacaaggccggcgacagcagccgcttccctagtggggagacaggtgaaaaggtcgagaccgacatggagaatgaaaaggtttctgagggagctgagacaaaggaagaagaaactggggaagtggtggacttaagcgctgcaacctag

SEQ ID NO: 45918 - DNA, 960 bp, Artificial Sequence
  Description of Artificial Sequence: Synthetic coding sequence
atggccatctgccccgagctggcccagaccgacaagagcgccctggcaaatctctcggatgaaactgaaacactaaagaacagtacagatgaagtgcagacctcctcttcattctcctcatctggaggcagacagagcagcccgttgacttcggggagcaaattggaacgggagaaacagaccccatcacttgagcagggggacactcagtctgagcttctcgactacaagaattatgagaaaaagctgtccaaaaagtggataaactatctgaaactgaaagattctaacttcgagcggcaccagcccgacaccaaactgcctaccgaaatcacacgcgtctcagacgaagagctgaacgctctccagagctactgcaccatgaaaattaatcttatccaccgacgcggtgactccaagaaaaaaacatcttcccgccacaagaaactacatctgggactcgatgtggaagcatcagaaagggacgcatttagctgtaccgtacccgacgagctgctcaataggatctactttaagaacatgagaacaacccctaaacaggaagcagcggctaagcaacatatctcctaccagtgtccttactgtaatcgaaagcgcgccgagttggccctgagcgccttccttaaacaaaaaaagacactgcttgagtcgtttcttttgcaggaaaggatagacgagcatctgcatacaaaggattttctaacacggatcggcgaggctcaccaggactttcctcggctaagtgatgatcctaggatcatctggaaacggctgacagaaaagtcccatatacgatatagtggcttcgaaagaagcgaaaccgaacagaagttgcagcgcgacggtaatagcgcctgccacctgcccttttcgctgcctttcctaaaaaggctgacgctcatcaagccagagctggtcattgtcaatgataatgtgtag

SEQ ID NO: 45919 - DNA, 693 bp, Artificial Sequence
  Description of Artificial Sequence: Synthetic coding sequence
atggagaagccccggctgtaccagaagtacaagatcagccgggtgtggtggagactgcccgtcattcccgctaccggtgaagccgaagacaacagacttaacccagagggacggggttgcggggaaccgagatcgcgtcactgcacccccgcttggactaccaccgccaaacttcaccttaaaacaatcatctcacttcagccattaaacatgtatcagatggaacctggggttggatctattcgaactagtcccgcacttcagtctccacctgcactaacacggggccccagcgcatgggataccgcgatccgtaaagctttgtccttcggagtaggactgggtgtgctggttctcgtctgtttattctatcattttgttacactcgccccgatactgcagtttgcctctctgccctgcctgttggaagccggagcgcagatgagccggcaccccgtgaccacgcaggtttgcgtaatgcctgccaggctgagcctggggtccggaatctcaagaaacctccttagactgagtgtttgccacttcacacttctgctccccttccgttcactccgaccatgccccctttccagtagagatatggtattgtcatatgaactgtggttgctttgcgatttctacatcgcgcctcccgactcttccggaagcggcatttgcaaaaaggccatctag

SEQ ID NO: 45920 - DNA, 318 bp, Artificial Sequence
  Description of Artificial Sequence: Synthetic coding sequence
atgagcctgaagagctggcacccccagagcaagaccaagcgggtgggggccagtgagggtaacccacagtggggctccggaagcatggaggcccccctgctttcttcatttctgccccctcttgcaagcgaagcagaattgacagggaacacttggttcctgcaccggtgtagttgtatcctgaaccttgaggagtcgatggatagcgactggggcgcttggtggggggtgtctctgccacggcgcgctccttttttgatctacggtagtgatggtccgtggtgtacccaagctggatttcctggatgggggcactag

SEQ ID NO: 45921 - DNA, 318 bp, Artificial Sequence
  Description of Artificial Sequence: Synthetic coding sequence
atgagcctgaagagctggcacccccagagcaagaccaagcgggtgggtgctagcgaaggcaatccacagtgggggtctggctcaatggaggctccactgttgtcaagttttctgccaccgttagcttccgaagctgagctcacgggtaatacatggtttctccacaggtgcagttgcatactcaatttggaggaatccatggactccgactggggcgcttggtggggagttagcctgcctaggagagcaccttttcttatttacggttctgacggtccatggtgcacacaggccggctttcccggctggggtcactag

SEQ ID NO: 45922 - DNA, 1098 bp, Artificial Sequence
  Description of Artificial Sequence: Synthetic coding sequence
atgatgggccggcggcgggccttcgccgtggacggccgggacggcgctggggagggattggcaagggggtgcatcgtgcccggagtcacctctacttataggaggattcctgacgctgcccacggctgttccagctgggaaagaggagacaaatttcggggcgtgggtcgcgaagccctttttctcaaattggcatcccgtgactccggggtggagatggcggtgggcgattctcccctagctgcacttcccgggctgtcccaggatagcctcgatttcgagagtagtggcagcagcgaacctccagcccaggttggccgcttgctggctagccagaaattgggcgaggtacttgaaagatccagaaggctgccaaccgccccaacaagcctgagcggtcaacataggagcctgagacttgcatctaaacctgagcgcgaagtgccactgggcgcaggacagcaggagtccatggaggctgataccgacctggaagcggggctggaagaagaagctgtgggcggcctgggccccggagcatgggcttgtctcccgggacaaggcctgcgctacctggagcacctgtgcttagtgcttgaacaaatggccagattgcaacagctctatctgcagttgcgaattcagcggccacccggagatccaggtgaagaggagagtaccagggcccctctgccttcccctcttcacacgcccgggaataggggccagggcccctgggagcttctctcccagaccgagcatacgggggccaaggcggcctctcctccaaaagtggaagtcccgagcgcaaacccacctaggttgcccgagacccccgttgagcccacatatcacctccctagcagtcaggggcacaaaagggacattagccactgggataaggtgaaagtcctgcttaatcggatttgccggagatctcaccatcaccctgagccacctgcccctccagacgggtcagatccacgcatcgagtcaagagacctgcctgagaggccacagtgtcgccctcatcgtaaaacattcatgccctccttggtggtgaagaagcagagagcaaagaatttaagcgtcggatag

SEQ ID NO: 45923 - DNA, 987 bp, Artificial Sequence
  Description of Artificial Sequence: Synthetic coding sequence
atggccgtgggcgacagccccctggccgccctgcccggcctgagccaagatagcctggattttgaaagttccggcagttcagaacctccagcacaagtcggcagactgcttgctagtcaaaagctgggagaagtactggaaaggtctagacgattgccaaccgcgccaacttctttgtcgggccagcacagatctctcaggctggcctctaaacctgaacgggaggtccctctcggagccgggcagcaagaaagcatggaggctgataccgatctggaggcaggcctcgaggaggaggccgttggcggattgggcccaggggcatgggcctgcttacctgggcagggtttgcgatatctcgaacacttatgtttagtgctggaacaaatggctcgcctccaacagctatatttacagctgcgcattcaacgcccaccaggcgatccaggagaggaggagtctacccgggcacctctgccgtctccactgcacactccagggaaccggggccaaggtccctgggaactgctgtctcaaaccgaacataccggggccaaggccgcatcaccccccaaagtcgaggtcccctccgctaaccctccacgccttccagaaacccccgtcgagcctacctaccatctacctagctcgcaagggcacaagagggacatttcacactgggacaaggtgaaggtcctgctgaataggatttgcaggagatcacatcatcaccccgaaccaccggctccacctgacggctcagatcccaggattgagagcagggatctcccagagcggcctcagtgccggccccataggaagaccttcatgccatctcttgtggtcaagaaacagaggaagaaaccattctgccgcctgagacccctgggggctcctggagatccaggctggcggggattggccgtcaaatccagctccccctccgccttattgttactgctacatatcgcccgaaagtcatgttag

SEQ ID NO: 45924 - DNA, 1074 bp, Artificial Sequence
  Description of Artificial Sequence: Synthetic coding sequence
atgatgggccggcggcgggccttcgccgtggacggccgggacggcgcaggcgaaggcctggccagaggttgcatagttccaggagtgacgtcaacctacaggaggattcctgatgccgcacatgggtgctccagctgggagaggggcgacaaattcagaggagttggtcgagaggctctcttcttgaagcttgcttcaagagacagcggcgtggaaatggcagtgggtgatagccccctggccgccctgcccggactatcccaggacagcttagatttcgaatcctctggaagcagtgagcctcccgcccaggttgggcgcctgcttgcctcccagaaactcggtgaggtgctggaaagaagcagacgcctgccaacggccccgacctccctgtccgggcagcaccggtctctgagattggcttcaaagccggaacgtgaggtgcccttgggcgccggccagcaggaatcaatggaggccgacacagacctcgaggcaggactagaggaggaagctgtaggcggactggggccaggcgcttgggcctgtttacccggtcaggggctgcggtatctggagcatctgtgcctggtgctcgaacagatggctaggctgcaacagttgtacctgcagctgcgcattcagcgacccccaggtgatccgggagaggaagaatctacacgggcccccctccccagtcctctccacacacctggcaaccgagggcaaggaccttgggaactgctctcacagacagagcatacaggggccaaggccgcaagtccccctaaagttgaagtcccttctgcaaaccctccgaggcttcccgaaacccctgtggaaccaacgtaccatttgccttctagtcagggacacaaggtaaaggttctcctgaatcggatctgtcgcaggagtcatcaccatcccgagccgccggcccctccagacggaagcgatcctaggatcgaatcaagggaccttccggagcgccctcaatgccgtcctcaccgaaaaacgttcatgccctctctggtggttaagaaacaacgggcaaagaacctgtccgttggttag

SEQ ID NO: 45925 - DNA, 132 bp, Artificial Sequence
  Description of Artificial Sequence: Synthetic coding sequence
atggccaagaacaagctgcggggccccaagagccggaacgtgttccacattgcctcccagaaaaattttaaggctaaaaataaagcaaaaccagtaacaaccaacctgaagaaggtactgcacttcagttag

SEQ ID NO: 45926 - DNA, 297 bp, Artificial Sequence
  Description of Artificial Sequence: Synthetic coding sequence
atggccaagaacaagctgcggggccccaagagccggaacgtgttccacatcgcaagtcagaagaatttcaaagcgaaaaacaaggcaaagccagtcacaactaacttaaagaaaatcaacataatgaacgaagaaaaagtgaaccgcgtgaacaaagcctttgtgaatgtccagaaggaattggcacacttcgcgaaatctattagcctggagccactccaaaaggaattaatccctcaacagagacacgagtccaaaccagttgacgaggcaaccagattaatggcgttgctctag

SEQ ID NO: 45927 - DNA, 297 bp, Artificial Sequence
  Description of Artificial Sequence: Synthetic coding sequence
atggccaagaacaagctgcggggccccaagagccggaacgtgttccacatcgcttcacagaaaaacttcaaagctaaaaataaggccaagcccgtcacaacaaatttgaagaagatcaatatcatgaacgaggagaaagtcaaccgggtgaataaggccttcgtgaacgtgcagaaggaacttgctcacttcgcgaagtcaatatcgctcgagcccctgcagaaggaacttattccccagcaaagacacgaatcgaagcccgtggatgaagcaaccagactcatggccctgctgtag

SEQ ID NO: 45928 - DNA, 297 bp, Artificial Sequence
  Description of Artificial Sequence: Synthetic coding sequence
atggccaagaacaagctgcggggccccaagagccggaacgtgttccacatcgctagtcagaagaattttaaagccaagaataaggccaaaccagtaaccacgaacttaaagaagatcaacatcatgaatgaggaaaaagtcaaccgtgtgaacaaggcattcgtcaatgttcaaaaagagttagcacattttgcaaagtcaataagtctggaacctttgcaaaaagaactgattcctcagcagcgacatgaatcaaagccagtggacgaagccacccgactgatggctttattatag

SEQ ID NO: 45929 - DNA, 297 bp, Artificial Sequence
  Description of Artificial Sequence: Synthetic coding sequence
atggccaagaacaagctgcggggccccaagagccggaacgtgttccacatagctagccaaaagaatttcaaggctaaaaataaggctaagcccgttaccaccaacctgaagaaaatcaatatcatgaatgaggaaaaggtgaatagggttaacaaagccttcgttaacgtgcagaaggaactcgctcatttcgcaaaaagcattagtctggagcctctccagaaggaattgataccacagcaaaggcacgagtctaagcccgtggatgaggccacgagattgatggcgctgttatag

SEQ ID NO: 45930 - DNA, 138 bp, Artificial Sequence
  Description of Artificial Sequence: Synthetic coding sequence
atggccaagaacaagctgcggggccccaagagccggaacgtgttccacattgcatcccagaagaattttaaggccaagaacaaagccaagcctgtgactactaatctcaaaaaaatcaatattatgaatgaggaatag

SEQ ID NO: 45931 - DNA, 297 bp, Artificial Sequence
  Description of Artificial Sequence: Synthetic coding sequence
atggccaagaacaagctgcggggccccaagagccggaacgtgttccacattgccagccagaaaaactttaaagccaaaaacaaagctaaacctgtcactactaacctgaagaagatcaatatcatgaacgaggagaaggtaaatcgcgtgaataaggcttttgtgaatgtgcaaaaggaactcgcccatttcgccaagtccatttcgctggagcctttacaaaaggaactcattccacaacagcgacatgaaagcaaacctgtagatgaggccactcgtttaatggccctcttatag

SEQ ID NO: 45932 - DNA, 132 bp, Artificial Sequence
  Description of Artificial Sequence: Synthetic coding sequence
atggccaagaacaagctgcggggccccaagagccggaacgtgttccacatcgcttcccagaaaaattttaaggccaaaaacaaggcgaaacccgtgacaaccaacctgaagaaggtgcttcacttcagctag

SEQ ID NO: 45933 - DNA, 2160 bp, Artificial Sequence
  Description of Artificial Sequence: Synthetic coding sequence
atggccggcggcgtgtggggccggagccgggcccgggaggcccccgtgggtgctctgaccctcactgctttgaccgagggcattcgggcacggcagggccagccccaaggacccccctccgctggccctcaacccaaaagctgggaggtcaaacccgaggcagagccccagacccaggcactgacagccccttccgaggccgagccgggtaggggagcaactgttcccgaggcgggtagcgaaccttgctctctgaatagcgcactcgaacccgcccccgaagggccacaccaggtcccacagagcagttgggaggagggtgtgcttgcagatctggcgctgtatacagccgcttgtcttgaggaagcaggcttcgcaggcacgcaagccacagtcctgactctgtccagcgccttagaagcccgaggagagcgactcgaagatcaagtgcatgctctggtccgcggactgctcgcccaggttccgagcctggccgagggccggccctggcgcgccgctcttagagtcctctctgcactggctctggagcacgctagggacgtagtatgcgcattgctccctcgcagtttgccggcagatcgggtcgccgctgagctgtggaggagcctgagccgcaatcaacgggttaacggccaggttctggtccagctgctgtgggccctgaagggcgcttcaggcccagaacctcaagcactcgctgccacaagagctctgggtgaaatgctggctgtgagtggatgcgtcggcgcaaccaggggattttacccgcatctcctgctcgctctggttactcaactgcacaaactggctcggagtccatgttctcccgacatgccaaaaatctgggtgctctcacatagaggcccgccacattcccacgcgagttgtgcagtcgaggcgctaaaggccctattgacaggcgacggcggccggatggtggtgacctgcatggaacaggcagggggctggcggagacttgtcggggcacacactcatctggagggggtgcttctgctggccagtgctatggtggcccatgccgaccaccacctgagaggattgtttgctgacctgctgcccaggctcagatccgccgatgacccccaacgtctcaccgctatggctttttttaccggcttgctccagtcaagaccaactgcccggttgctccgtgaggaggtgatcctcgaaagattgctcacttggcagggcgaccccgaacctacagtgaggtggctggggcttctgggactagggcatctggcgctcaaccgacggaaggtccgtcacgtatccacattgctgcctgccctcctgggtgcgctaggggagggcgatgctcggttagtgggggctgcactgggcgccctgcgaagactgctgttgcgacctagggctccagtccgactcctatctgccgagctgggccctcgcttgcctcccctcctcgacgacactagagatagcatccgcgcatctgccgtggggctcctggggaccctggttcgtcgggggagaggcgggctaaggttaggcctgcggggacctctccgcaagttggtgttgcaaagcctggtaccactgttgttaagactgcacgacccgtccagggacgccgctgagtcttcagagtggactctcgctcggtgtgatcacgcattctgctggggcctgctggaggagttggtaaccgtagcgcactacgattccccagaggcgcttagtcacctgtgctgtagattggtccagcgttaccccggccatgtgccaaattttctgtcccagacacagggctacttgcgcagcccgcaagatccactacggagagcagctgcggttctgattggattcctcgttcatcatgcgtcaccaggttgcgtgaaccaagatctcctcgattccctgtttcaagatcttggccggcttcagtccgaccccaagccggccgtcgccgccgcagcacatgtgtccgctcagcaggtggccatgctcgctagagcccgaggctgtccgcgggggccccgcctgctgcgtatagcccctcgccccgctcgccctccacccgtttttgccgactctcctttccaaaggaggtctgtggctggcaggtggggctgttccggcccaagacgggcctag

SEQ ID NO: 45934 - DNA, 885 bp, Artificial Sequence
  Description of Artificial Sequence: Synthetic coding sequence
atggccctgctgaccccccagggcgtgaaggaggtgttccagctgcagcgtcctcagggccgcgagaggctgaggcgtctgctgaattgggaagagttcgatgagcagcgcgattcacggaggtctatcctgctggatacactctatgagtctatcatttttgctgtggggaaaggattcccttgggtggaggtggcccaagttgttaaatttacagaggagctgttgcgagaaacgaagggatgtagcataactgaggccgtcacgatcttaggcaacaagctgcgcgattatagggggcattttaataccacccacttgcttgctctgtgcgactactttcatcacacgttcattaggcattacaagctgtatcagtatgtgctggggcaggaccagcaggtggacctgacagtggcacacttggaggtgtgcatgccacctcatcccctacctctggcagaggggatggaccgggatctgtggattcacgaacagcaggttgcaaccttgaccgaggccgaagctcagaagcgcgcggatgtcctccttcttaaggaggccctaaggctggagagggagaactccctgcagaaggctttcgccgccgcagcccccgcacagccaggtcaggtactggaaagacaagaattggagagcctaatctgtcaggctgtccacacccagatggagctgctgcaggaattattgcagcggcagatacagaacacttttgccatcctggatttgaagctgcagaagaaaaccctgaatctcaatgctcctactcccatccctcccccaattacctcacatgccggtcaggaggaggctttgaagccccaaagagcttcaaagggtaaaaaagccaaagccaggaaatag

SEQ ID NO: 45935 - DNA, 1143 bp, Artificial Sequence
  Description of Artificial Sequence: Synthetic coding sequence
atggacagcggctgctggctgttcggcggcgagttcgaggacagcgtcttcgaagaacgtcctgagcggcgaagcggacctccggcctcctactgtgcgaagctctgtgaaccacagtggttctacgaagaaacagagagctctgatgacgtggaagttttgacactgaagaagtttaagggagatctggcttataggcgccaggaatatcaaaaagccctgcaagagtatagctcaataagtgagaagctgagcagcactaactttgccatgaagcgagatgtccaggagggacaggctagatgtctggcacacttggggcggcatatggaagctcttgagatcgcagcaaatctcgaaaataaggccaccaatacagaccacctaacaacggtgttatacctgcagctcgccatctgctcaagcctccaaaatctggaaaagacaatattctgcctacagaaactgataagcctacatccatttaacccatggaattggggcaagctcgccgaggcttatctaaatctgggtcctgcactgtcagccgctctcgccagttcacaaaagcaacattcctttacctcctccgataagaccattaagtcattttttccgcatagcggtaaagattgcctgctgtgcttccctgagaccctccccgaatcttcgcttttttctgtcgaagccaatagctccaatagtcagaagaacgagaaagccctcaccaacattcaaaattgcatggcagaaaagagggaaacggtgttgatagagacacagctcaaggcttgtgcctccttcatacgcacccgtctgctgctccagtttacgcagccgcagcagacgagctttgcgctcgagcgcaatttgcggacacagcaggaaatcgaggataaaatgaagggcttttctttcaaagaggatacacttttgctgatcgcggaggtaatgggggaggatattccagaaaaaataaaggatgaggttcatcccgaagttaaatgcgtagggagcgtcgctcttaccgccctagtcaccgtgtcctccgaagagtttgaggataagtggttccgaaagattaaggatcacttctgtccatttgaaaaccagttccacacagagattcagatactggcctag

SEQ ID NO: 45936 - DNA, 636 bp, Artificial Sequence
  Description of Artificial Sequence: Synthetic coding sequence
atgctgcggcagagctgcagcttccccgtgaccagcctgcccgccttggggggtgtctgtggtcgtgaaggagcaggcgcagaggtccctccagccgcctgcgggtgcgaaggaagagatcccgatacggaacgctcctgcggccgcagcagcactggtggatgctcgccttgttccggtcccggacccagtagcccgaggacgtctcggggtgcgctttcaccttccctgggacgcctcttcccacacctgcaggtggtcatcaaacttaggattcaactggcaccagccgtccatctcgcactgcccacttgctctttactcacaagttcccctccactggaaggttgctgccaccggctgaacgaagaagccgaggtccagaggggcttccgcccaatcgccgtggagctggaatttgagaatcaaccattaggcgcagagactagattacggaatggtcgccgggctggggtgaaaaggtccgaaggcagaggtcaggtacgaccaggacaggtccgtagcactggccccgaggggggcctcacgagaatggagcgcaaggcagcacgcctacagtgggattccgggtccattaagatgagtgagaatgagcaactgtgggaagaaccctag

SEQ ID NO: 45937 - DNA, 261 bp, Artificial Sequence
  Description of Artificial Sequence: Synthetic coding sequence
atgtggcccccctgcggcaccctgcggaccctggccctggcccggtcccgcggagctcgcgcttgttccggtgatgggggagtcagttatacacagggccaaagcccagagcctaggactcgagaatacttttattatgttgatcatcagggtcagcttttcttggacgacagcaagatgaaaaacttcataacctgctttaagggcaatgctgtgccaccttctccggctcccagcttttccctccctggtagcccatag

SEQ ID NO: 45938 - DNA, 468 bp, Artificial Sequence
  Description of Artificial Sequence: Synthetic coding sequence
atgggccccggcgacttccggcggtgccgggagcggatcagccagggcctgcaggggctgccaggccgggcagaattgtggttccctcctaggcctgcttgcgacttcttcggtgacggccgttccactgacatccaagaagaggccctcgctgcctccccactacttgaggatcttcgccgccgactcacccgcgctttccaatgggctgttcagagagccattagccggagagtgcaggaagcagccgcagccgctgcagcccgagaggaacagagttggacgggcgtggaagctaccctagctaggctccgggccgagctcgtcgaaatgcacttccagaaccatcagctggctcgcactctactggacttaaacatgaaagttcagcaactcaaaaaggagtacgagctcgagatcacatccgatagtcagtcccccaaggacgatgctgcaaatcctgaatag

SEQ ID NO: 45939 - DNA, 672 bp, Artificial Sequence
  Description of Artificial Sequence: Synthetic coding sequence
atgcggcccctgggcaagggcctgctgcccgccgaggagctgatccgaagcaatctgggggtggggcggtccctccgcgactgtctaagccaaagcggaaagctcgctgaggaacttgggagcaaaagattgaagcccgccaaattcggaaccgaaggtaaggagcgcgtggagcagaggacagagagacagagaacaggctccagcaaagaacctcgtatgcaaatcatctgcaggagaaggtggcgcgagcctcctccaagactcctttggggatgtcttatgccacgcgcgcagcccctgctgcatgtcaccgcttacgaaaacactggacattgggaaaggcttgcgtccgtcgtttcatccaaaacacagcagccgactgtcatctcacacagctcaattagcatcacatttagccattatccacccgcgaccctggactcatttctggtgctagagccgatcaagctgttccctgttagctctcttagatctccgctatgtttgaactgcgggtcctgtcgcgagagcatccgcatcagcggtgagctgattggtaacgctcattctcctgcccctccaaggactcctgagctagagacgctcggatgggacaagcaggctgtcctgtctggagcccaggtgatcctcgtgtgtgccgaagtatag

SEQ ID NO: 45940 - DNA, 306 bp, Artificial Sequence
  Description of Artificial Sequence: Synthetic coding sequence
atgcggacccccaagcggacccggagccccaagaccaaggtgagcctgcgcggagaaacactgactttgcagctgactactgtgtcattagacacgagacacatggtgaaaagatgcgacgagcgacatggtagacccctgcctcattcccaggaatctcagcacggcagcgctaccagcaaaaaggccgtgagaggaaccgccgacacggccccactggagagaatcagcgcggctcggggctgggctctgcctatggaagccactgtctctgtgtttcgcgcccaccaatggcagtggaattag

SEQ ID NO: 45941 - DNA, 561 bp, Artificial Sequence
  Description of Artificial Sequence: Synthetic coding sequence
atggagctgagctgccccggcagccggtgccccgtgcaggagcagagggccagatgggagcgcaagcgggcctgcaccgcaagagagctcctcgaaaccgaacgacgataccaggagcagctgggactggtggccacttattttctgggaattttgaaggccaaaggaacactgcgcccaccagaaaggcaggcccttttcgggtcgtgggaactcatctacggagcttcccaggagctattgccctacctggaggggggctgctggggccagggattggagggattctgccgacatcttgaactgtataaccagtttgctgccaacagcgagcggagccagaccactctgcaagagcagctaaagaaaaacaagggcttccgacgctttgttcggctgcaagagggaagaccagagtttggaggactgcaactgcaggacctcttgccgctgccactgcagcggctacagcagtacgagaatcttgttgtggctctggctgagaacacaggccctaacagcccagatcatcagcagctaacccccgttcttccaagctag

SEQ ID NO: 45942 - DNA, 1008 bp, Artificial Sequence
  Description of Artificial Sequence: Synthetic coding sequence
atggagctgagctgccccggcagccggtgccccgtgcaggagcagagggccagatgggagcgaaaacgggcctgtaccgcacgggagttgctggagactgaaaggaggtaccaggagcagctcggcctggtagcaacatatttcctgggtattctaaaagcaaaaggcactctcagaccccctgagaggcaagctctgttcggctcttgggagctgatttatggcgcctcccaggagcttcttccttacctggagggaggctgttggggtcaaggcctggaaggattctgtcgacatctggaactctacaatcagtttgctgcaaatagtgagaggtcacagacaaccctccaggagcagctgaagaagaataagggattcagacgcttcgtacgtttgcaggagggtcggcctgaatttgggggtctgcagctgcaggatctgcttccactgccactgcagcgcctgcagcagtacgagaacctcgtcgtggcgctggccgagaatactggcccaaacagtccggaccaccagcaactgaccagagctgctcggttgataagcgagaccgctcagcgtgtccacactatcggacagaagcaaaagaatgaccagcatctgaggagggtgcaggccctgttatctggacgacaagccaagggcttgaccagtggtcggtggttcctgaggcaaggctggttgcttgtggtcccgccacacggtgaacctcgccccaggatgttctttctgtttacagatgtactgctgatggccaaaccacggcccccacttcaccttctacgatctggcacttttgcctgcaaggcactataccctatggcgcagtgtcacttaagtcgggtgttcggccattccggagggccatgcggtggccttttgtctttgagtttcccgcacgaaaaactcctgctgatgtctactgatcaggaagaattgagccggtggtaccattccttaacctgggccatttcttctcaaaaaaactag

SEQ ID NO: 45943 - DNA, 900 bp, Artificial Sequence
  Description of Artificial Sequence: Synthetic coding sequence
atgctgggcgtgtgccagaccctgaagcagtacttcctgggcatcctaaaagccaaaggaactctacggccccccgagagacaggccctgtttggctcgtgggaactcatttacggagcctcacaggaacttctcccatatctggaaggcgggtgctgggggcaggggcttgaaggtttctgcagacacctggaattgtacaaccagtttgctgccaacagtgaacggtcccaaaccacattacaggaacaactgaagaaaaacaaaggctttaggagatttgttcggctgcaggagggtaggcccgagttcggaggtctgcagttgcaggatttgctccccctgcccttgcaaagattgcagcagtacgaaaaccttgtggtcgccctcgccgagaacactggcccaaattctcccgatcatcagcagctgacaagggcggctcggctcatcagcgaaaccgcccagagagtgcacaccattgggcaaaagcagaaaaatgaccaacacctgcggcgagtacaagcattactgtctggacgtcaagcaaaaggattgaccagcgggaggtggtttctccgtcaggggtggctgctggtggtacctcctcatggggaaccgcgaccccggatgttcttcttattcacagacgtgttgttgatggctaaaccccggccccccctgcacctgctgcgcagtggcaccttcgcatgcaaagcactgtaccctatggcccaatgtcacctctcccgagtgtttggacatagcggagggccatgcggtggattactttcactgagctttcctcacgaaaagttattgcttatgtccaccgaccaggaagagctcagtcggtggtatcatagcctgacctgggccatctcctcacagaaaaattag

SEQ ID NO: 45944 - DNA, 171 bp, Artificial Sequence
  Description of Artificial Sequence: Synthetic coding sequence
atgcggcggccctgggagaagaaggaggccacccggaaccccatcgctgaggtgttggcccgcaaaaagcgtaccgaagaactgatcagtctgcaggagcacggttccaggaagcagaaaattaaggaagcttctatctcctgggcagagacctccagacagatcggctag

SEQ ID NO: 45945 - DNA, 222 bp, Artificial Sequence
  Description of Artificial Sequence: Synthetic coding sequence
atgcagttcgccgactggctgcaccccagcggctggaccatcgagatattgaatgcctatgggatgggggataggaagagaaccaacagtatgtctaaggaagcctttactcccgagcagttacacctagaaaaagaactgggggagatgaggctccggcctaccgtgctgcattcacagaccgaccaccaaggctttaggcctatccctatgatgcagtag

SEQ ID NO: 45946 - DNA, 1131 bp, Artificial Sequence
  Description of Artificial Sequence: Synthetic coding sequence
atggccgagcggggccggaagcggccctgcggccccggcgagcacgggcagcgcatcgagtggagaaaatggaagcagcaaaagaaagaggagaaaaaaaaatggaaggacctgaagctgatgaagaagctggagcgccagagggcccaggaggagcaggcaaagcggctggaggaagaggaagccgccgccgaaaaagaggatagaggaaggccctacacattgagcgtggctttacctgggtctattctcgacaacgcacagtcccctgagctgcggacctatctggcaggacagattgctcgtgcttgtgcgatattctgtgtggatgaaatcgtggtgttcgacgaagaaggccaggacgcaaagaccgtggagggagagttcaccggggttgggaagaagggtcaggcctgtgtccagctggcacgcattcttcagtatctggaatgccctcagtatttgcgaaaagctttcttcccgaaacatcaggatcttcaattcgccgggctgctgaaccctttagattcaccacatcacatgcggcaagacgaggaaagtgagttcagggagggaattgtggtggatcggcccacgcggcctggccacggttcttttgtgaactgcggtatgaaaaaggaagtgaagattgacaagaatctggaacctggcctgagggtaacggtgaggctcaaccaacaacagcatccagattgtaagacatatcacggaaaagtagtttcttcccaggatccacgcaccaaggccggtctttactggggatacaccgtgaggcttgccagttgtcttagtgctgtcttcgccgaggccccatttcaggacggctatgatctgaccattggcacaagtgaaaggggaagcgatgttgccagtgcgcagctgcccaacttcagacatgccctggtggtattcggggggctgcaggggctagaagctggagctgatgcggatccgaacctcgaggtcgccgaaccctcggtgctcttcgatttgtacgtgaatacctgccctggtcagggctccaggaccattcgcactgaagaggcaatcctgatctcgttggccgcgctacagccaggtctgatccaggcgggggccaggcacacatag

SEQ ID NO: 45947 - DNA, 1167 bp, Artificial Sequence
  Description of Artificial Sequence: Synthetic coding sequence
atggccgagcggggccggaagcggccctgcggccccggcgagcacgggcagcggattgagtggcgtaagtggaaacaacaaaagaaagaagagaagaagaaatggaaggacctgaaactgatgaaaaagctggagcgccagagagcacaggaagaacaggccaaacggcttgaggaagaggaagctgctgctgagaaagaggaccggggacgtccctataccctatcggtggctttgcctggatctattcttaccatgctttcccggaggagcttcgcccccacttggccagtgcgacttcccgagcctgtcccttcaagtgtctggatgagaagttggtgcctgatgcgccgcgctaggatgccaaggctttggcgagggaattcacaggaactggaggagggcgcgggggtcagaactgctgggccggaccccgcagttccagaatgccctcagtatctgcgcaaggcattctttcctaagcatcaagacttgcagtttgctggcttgctcaaccctctggacagcccacatcacatgagacaggatgaggagagcgagttccgggaaggcatcgtcgtggacagaccaacaaggccggggcacggaagtttcgtgaactgtggaatgaaaaaagaagtcaaaattgataagaacctggaacctggtctcagagtcactgtgagactgaaccagcaacagcacccagactgtaaaacgtaccatggcaaggtggtgagcagccaagatccacggaccaaagccggcttgtattggggttacactgtgcgcctggccagctgtttatcagccgtgttcgccgaggcacccttccaggacggctatgacctcacgattggaacatcagagaggggttctgacgtggccagtgcctcctttcccacaagtggcatgctactgtggtgcagcggagccagtcgcgtgtggaaattggagcggatgctcaccccgacttggaggtggctgaatccggtaagctccttaacctgcacaagcatccccgtgctcgcaagggttgctgtaccttctgctcggaggaaaccgagctcctccccctggccaccatgctctttggcctcatccagaagagtccctggcactcctgaaagttcaaaggggcctagaacttctgtaaagcaacaatag

SEQ ID NO: 45948 - DNA, 279 bp, Artificial Sequence
  Description of Artificial Sequence: Synthetic coding sequence
atggccgaggagtgcccccgggcctgcgccgagcccgtggcccccaaagctaccgcacctcccgagagaacttctgattattacagagtaagtgccgatcttcccgggcgattcaacaacccaggatggtttaggggctaccggacacaaaaggctgtatcagtctataggaccagcaatcaagcctacggttcacgtgcaccaacggtacatgagatgccccgagtagagtgttctggcactatcctctctatgttcacttggcgtaaagcgtcctag

SEQ ID NO: 45949 - DNA, 279 bp, Artificial Sequence
  Description of Artificial Sequence: Synthetic coding sequence
atggccgaggagtgcccccgggcctgcgccgagcccgtggcccccaaggcgactgccccacctgagaggaccagcgactactaccgggtcagcgccgacctcccagggcgcttcaacaacccaggctggtttagaggctacagaactcagaaagccgtttccgtgtatagaactagtaaccaggcgtacggaagtagagccccaacagtccacgaaatgcccagagtagagtgcagcgggacaattctgtccatgttcacatggcggaaggcctcgtag

SEQ ID NO: 45950 - DNA, 411 bp, Artificial Sequence
  Description of Artificial Sequence: Synthetic coding sequence
atggccgaggagtgcccccgggcctgcgccgagcccgtggcccccaaagccacagcccccccggaaagaacctctgattactacagagtgtctgcagatctgcccgggcgctttaataacccaggatggttcagaggttataggacacagaaagctgtgagcgtgtaccggacgagcaaccaggcatacggaagtagggccccgaccgtacacgaaatgcccaaggtgttctatcccaacagtaacaaattctctcagcagctggcggcaggtggaatgttccgaaataacaccctcaatgtctacctggaaaagagcattgtaactggccccgacaattgcatcaccagctgcgatagactgaacttccatccctcttataacattaataggcccagtatctgcgactag

SEQ ID NO: 45951 - DNA, 381 bp, Artificial Sequence
  Description of Artificial Sequence: Synthetic coding sequence
atgggcaccgaggtgggcatcagctggacccgggtgggcaccggcgcaaccgttgggctcctcccaccccatccacaccagcagatgcaccgtgacgaagaagactccgatgtggatgtcacatttcagccatggcataaggaaatgctgcagcagctgctggttatgttaagcagcaccgtggctaccagaccacagaaagccgcttgtccacaccaggagtcccagtcacatggtccaccgaaagaatccgtcccttgggcgcccacccagcggagcgggaacgcagaacagcgatgtagtggggaaggggcccgtaggagaggcccagagactcggcctctgaggaccccagagggttgggcaggccgggccccatag

SEQ ID NO: 45952 - DNA, 1563 bp, Artificial Sequence
  Description of Artificial Sequence: Synthetic coding sequence
atggcccccaagaagagcgtgagcaaggccggcaaggagctggaggtgaagaaaaagggtggaaaaaaagaaccagttgtggctgtcgaaccacccctggcaaaggaaatgaaggaattctatcatatccagatccgcgatctagaggaccgactggctagatatcagaggaaatgggacgagctggccgtccaagagaaaatgtttagacaggaatttgaacagctggcaaacaacaaaaaggaaatagtcgcattccttaagagaaccctcaaccaacaggttgatgaaattacggatctaaatgagcaactacagaatctgcagctggctaaagagatggaaaaggacgcttttgaagctcagctggcccaagtacgacatgaattccaggagaccaaagatcaactcactacagagaatatcattctaggaggcaagctcgccgcattggaggagtttaggttacagaaggaagaagtgactgacaaattcactttgctcgaagaacaggtgcgcaagcaggaaaatgagttccgagactatgcctataatctggaaaagaaaagcgtactagacaaggaccggcttaggaaggaaattatacaaagggtgaaccttgtggccaatgaattccacaaggtgaccaccaatcgaatgtgggaaactactaaaagagctatcaaggaaaataacgggatcaccttgcagatggctagggtaagccagcagggtatgaagctccttcaagaaaacgagcaacttaaggggagacagaacaacctttgcaaacagttggagctcctggagaatactcagaaagtcatggcaaggcataagcgggggcaccagaaaatcattcttatgctgacgaagaaatgccaggagcagcagcaggacactaaggaagccgaggagcttagattactcctatcacaattggaacaaagaagcctgcagctccaggtggataatcaagctttgaagtctcagagagaccagctatccttgcagctggagcagcagcaggtggacctgcaaagactgcagcaggagctggccaatgaacagaaggtgagggcaagtcttgaagctgctctcgtgcaggctacctcattcctgcagaacattttgcagatgcaccgcgatgaagaggactccgacgtcgacgtgacgttccagccttggcacaaagaaatgctgcaacagctcttggttatgctgtcttctaccgtcgcaacaaggccccaaaaagccgcctgccctcatcaggagtcccagtcacacggtcctccaaaggaatctcgccctagcatacagctgccccggacaggcagtctgttgcctcaactttctgacatcaccccgtatcagcctggcgacctgggattggtgccaaggcaggtgcatatccccccaaatccccaggacctgcgcctcctctcctatatcacacgcgtgggcacctttagggcgcacagttcccccgaaatgcgggcccctggcagcctcaaaagactggagaagttctcattgcccgaggttccacttcgccctaaatag

SEQ ID NO: 45953 - DNA, 210 bp, Artificial Sequence
  Description of Artificial Sequence: Synthetic coding sequence
atgtgctacgtggtgcccggctgcttcatctacatctgcggctgcaccaggatcaagtcgacccacttcaacggaaaaagccagatggtggatttgaagtctcagtcttgggaccttgaacgactagaaaataagccccctccggcagtgtatgacctggctgccactaccagccagctgggggagtgggctaaaagtcgcatttggtag

SEQ ID NO: 45954 - DNA, 906 bp, Artificial Sequence
  Description of Artificial Sequence: Synthetic coding sequence
atggaggcccacgagatcatcgaggagccccacatcaccatggacgcggaaaaacatcccccatccaaagacccatctgcagaagatctgcaggagaaccatataagcgagagcttccttaagcccagtactagtgaaacccctctggaaccccacaccagcgagtcgcctctggtccccagcccttcccagattccacttgaggctcactccccggaaactcatcaggagcctagtatctccgagactccaagtgagaccccaacttacgaagccagcctggactcaccaattagcgtcgtgccagaaaagcatctgaccttacccccacagtcacgcgattacgtctgtctctcttcttctgacaccctcaaagaagacctgtctagcgagagcagctcaaatgaagtaccatggacccgccggagtacccacctctcagagtctgaatccctcccggaacattgtctgtccggccctagctctcaggttcaggtcgatactacagaaaaacaagaagaggaagccggagaggtggagaaaggagtggatgcctccgattccaccgcccacaccgcacagcctgggcaccaacttggtaatactgcgcggcctgtcttcccagcaagacagaccgaactggtggaggtggccaaagcaatgcatcgagaagaattcggggcacaggtaaataatctctttcaatgggagaaggatgccgccctcaatgctatccagactgggctgtatatcggctggcgatgcccccactatctgtgggactgcttccgcattggcgatgaatctcggtgtttctgtggacatcttcttcgggaacatagaattatttcagacatttctgtcccttgcaaagttagtcagtgtaggtgctttatgttctgctag

SEQ ID NO: 45955 - DNA, 1209 bp, Artificial Sequence
  Description of Artificial Sequence: Synthetic coding sequence
atggaggcccacgagatcatcgaggagccccacatcaccatggacgctgaaaagcacccccccagcaaagaccccagcgccgaagacctacaggaaaaccacattagcgagtcatttctgaagcccagcacctctgagactcccctggagccccacacttcagagtcaccactggtgcccagtccctctcagattcctcttgaggcacactctcccgagactcaccaggagccctcaatctcagagactccgagtgaaacccctacctatgaggcgtcccttgatagccctatctcagtagtgccagaaaaacatttgaccttgcccccccagagccgcgactacgtgtgtctgtctagctcagatacgttaaaagaagacctgtcatccgagtcatcttccaatgaagtcccctggactaggcgaagcacccatttgtctgaatctgagtctctgcccgagcactgtctttcaggcccatcctctcaagttcaggtcgacaccactgagaagcaggaggaggaggccggggaggtcgagaagggggttgatgccagtgacagtactgcccataccgcccagccaggccaccaactaggcaacaccgccaggccagttttccccgcccggcagactgagttggtcgaagtcgcaaaagcaatgcatagagaggagtttggagctcaggtcaataacttgtttcagtgggaaaaggacgctgcgctaaatgccattcagacaggcctgtatatcgggtggaggtgtccccattatctttgggactgtttcagaatcggtgatgaaagccggtgtttctgcggccacttactcagggagcaccgtataatctccgatatttccgtgccgtgtaaagttagccaatgccggtgcttcatgttctgcttcatcccatctcgacccgaagaagttggtgagttttggctgaagcgccgtgctacatttgacccaaaagcgtggcgggcgcagtgtcggtgtaagcactcccatgaagaacacgctgctactggtcctcacccatgtaggcaccatggctgttgctgtggttgctttgaatcaaattttctgtgcgcagcctgtgataggaggtgggaagagcatgaaacattctttgacacacaaaagacaagacagagaggaggcagacctaggggcacggacactgtgtctaattggcacaggcctctgtag

SEQ ID NO: 45956 - DNA, 273 bp, Artificial Sequence
  Description of Artificial Sequence: Synthetic coding sequence
atggaggcccacgagatcatcgaggagccccacatcaccatggacgctgagaagcatcctccctccaaagacccgtccgcagaggatctgcaagagaaccatatcagtgaatcatttctcaagcccagcaccagtgagactcctttagagccacacacctccgaaagccctctcgttcctagcccgtcccagatccctttggaggctcatagcccggaaactcaccaagagccgagcatctccgagaccccatccgagaccccgacatactag

SEQ ID NO: 45957 - DNA, 591 bp, Artificial Sequence
  Description of Artificial Sequence: Synthetic coding sequence
atgcccggcatggtgcccccccacgtgcccccccagatgctgaacataccacaaacttcactgcaggccaaacccgtggccccgcaggtgccttcccccgggggcgcaccaggccaggggccatacccatattccctgtctgagcctgccccactaaccctcgatacatctggcaaaaatttaaccgagcagaatagttactccaatatccctcacgaaggcaaacacacgcccttatacgagaggtccctgcctataaatccggcccagtccgggtcccccaaccacgtcgattccgcgtactttccaggctcttccacaagcagctcatcggataacgacgaggggtccgggggtgcaaccaagtataccatttattggggattcagagcaacagaccaccacgtgcagggacgtgactcccaggctagaggtaccgcagcccactggcacggggggcatgtgtgttcacccaatgttttttggagaattagccacggacccgcacaacagctgacatttccgaccgaacaggcagccccaccagtgtgtcctgccccagctagccgcagactctccgcccccggctag

SEQ ID NO: 45958 - DNA, 3240 bp, Artificial Sequence
  Description of Artificial Sequence: Synthetic coding sequence
atggagtggctgctggaggacctgctgggcgccaagggcgacatgggtcttctttgggggcagctcactcacgctctggcctgccggcattgcggctctagctgcttccagagcccagggaacctggtgacactcttcctatttgtggtgtggcagattcagagatggtggcagttgggacggcttcgtcagttgcacccatggtgctctggcaatatggtccaggggaaggaactgccactgttgcacagggtggccttcttggaccatctgtgtaagcagaagagtgaggttgaggaggaaggagaagaagaggaggaaggagaggacgaagcttccctggacccattgaaaccctgtagtcctaccaaagaagctcctacaggtgagcaggccacccccgcacccccacagccctcctgcgggtccgagggtcttctgaaggccatcggcattccagagcagactgttatgcagccagtcagcccctcccgcagtttccctatcttccagatcctgacttcctttccagttcgccataagatcgcatccggaaataggcagcaacagcgcaaaagccagctgttttggggtttacctagtttacactcagaatcgcttgaagcgatctttctcagctcaggcggaccttccccactgaagtggtccgtgtgcagttcggtcttcttcaataagctcgcctttctgccccggtctaatctactcttaccccaataccacagcagcgcgcagttctctactcacggggcgcacacaatggaggatttggaagggatggcacccgatccccaactcctcccgccgccatcctcacccagtgtgtcttcactgttgttacatttgaggccttttccggtggaccataaaggtgtactctccggagcggaagcccccacacagtcaccaggcacttcgccccttgaagtgctcccagggtacgagactcacctcgagactaccggacacaagaagatgccccaggccttcgagccaccaatgcctcctccctgccagagccctgcatccttgagtgaaccgcgaaaggtctcgcccgaaggcggcctggccatctcaaaagatttttggggtactgtaggatacagggagaagcctcaagccagtgagagtagtatgcccgtgccatgtccccccctcgattctctgcctgagttgcaacgggaatcttccctggaagacccttctagatacaagccccagtgggaatgcagagaaaatagcggcaacctttgggctttcgaaagtcccgtgctggaccttaaccccgagctttccggtacctccccagagtgcgtgcccccagcctcagagactccatggaagggtatgcaatcaagggagaacatctgggtgccagctgacccggtgagccccccaagcttgccatccgtccccttgcttgagtcactggtgatgggaccccagggcgtcttgtccgagtccaaggctctctgggagaccatgggacagaaggaaaacttatgggcttcggactctcctgacccagtccacagcactcctcccactactcttatggaacctcatagaatcaaccctggggaatgcctcgcaacctccgaggcaacttggaaagatacagaacactcacgcaatagctctgcatcccgctcaccaagtctggcactatccccccctcccgcgctcgcccccgaattgctgcgggttcgtagcatgggggtgctttccgacagtgaggctcggtgtggtgatatccagaaaactaagaatagttgggcctctaaacatccagcctgtaatttaccgcaggatctccatggagcatcgccgctgggcgttctatcagacagccagtcaatcgtgggcgagatggagcagaaagaaaattgcgtgccagtgtttccaggccggggatccagtccaagttcgaactcggtaagtaagagccacgtctctgagcctatcgccgaccagagcaactataagccagacggagaggctgtggaacaaagaaaaaaccactgggctacagaactgcctgccccatctagtctttctacgcccctgccagagccccacatcgacttggagctcgtatggcgaaacgtccagcagcgggaggtcccacaaggacctagtccactggctgttgaccctctgcacccggtgcctcagccgccaacactggccgaagcggtaaagattgaaaggacacaccctggactgcccaaaggtgttacctgcccaggtgttaaagccgaagctcctttgagccaaaggtggaccgtccccgagctgctgactcaccctgggatccacgcatggcaatggagccgtgaactaaagcttcggctcaagaagttgcgccagagcccggcctccagggcaccaggaccgtcccagagcttctgctcttccccaattctgtcctcaaccattcccgatttctggggactgccctcctgccctccacagcagatttacccacccaacccttgccctcactcctcaagctgtcacccccaagaggtccaaagaaccgtcccccagccagtgcaatcctctcactgtcaccatttccaatcctcctcccaattgcagcctcaggagagcggtcgagcggaacaagggtcacaaaggggtgaaaaaatgaaagggaaaatggtcagtcaggtgcccagccaaggcccatgtgtgcatatggaggccggcgtagactacttgtccccgggtcccggagaaccttctaactcaaaagtactcgtatccggaaaacggaaggataaggcgagcgcatcaagctcagccaagaaacgagaacaccctaggaagcctaaggcaggcgaccataggcgtggtactgccagactaggacttagcacagttactggaaaaaatcatcccgctcaggcccgctcccttgtggaagcccctgtcagtaccttcccccagcggtcgcagcatagaggccaatcaagtcagcacacagcactaccccagctgctgctccctaaagcttctggccctcaggatcagcccgaggcaggcaggcgggcttccgatatcctgactccccgacactgcaagcattgcccatgggcacacatggagaagtatctgtctttcccaactctcaaggcttctttgactaggggactacagaaagtactggcaaagtgtctcgacaaccatcgcccactgcccacaaagtcaagccagtag

SEQ ID NO: 45959 - DNA, 3021 bp, Artificial Sequence
  Description of Artificial Sequence: Synthetic coding sequence
atgctgcggaaggagctgcccctgctgcaccgggtggccttcctggatcacctttgcaaacagaagagcgaggttgaggaggagggagaggaggaagaagagggagaagatgaagctagtctggatcccttaaaaccatgcagccccactaaagaggcaccaactggcgagcaagccaccccggccccacctcagccctcttgtggatcagaggggttgctgaaggctattgggatcccagaacagactgtcatgcagcctgtgtcaccgagtaggagcttccctatatttcagatcctaacgtcctttcctgtgcggcataaaatcgctagtggaaataggcagcaacagcggaaaagccagctcttctggggtctgccctccctgcatagtgaaagcctcgaggcaatttttttatccagcggcggtccgtctcctctcaagtggtctgtttgtagctccgtgttcttcaacaagctggcttttctgcctaggtccaacctgctccttcctcagtaccatagtagtgcccagttttcaacccacggcgctcatacaatggaagatctggaggggatggccccagacccacagctgctgcccccacctagcagcccgtccgtttccagcctactcttgcatctgaggccttttcctgtcgaccataaaggcgtcctctcgggtgccgaggctccaacacagtcacctgggacctctcctctggaagttctgcctggttatgaaacccatctggagacaacaggacacaagaagatgccacaggctttcgaaccgcctatgcctcccccttgccaaagcccagcctcattgtctgagcctcgcaaggtaagtcccgaaggaggactggcgatttccaaagatttctggggaaccgtgggatacagggaaaaaccacaggcctcagaatcctcaatgccagtgccctgcccccccctcgattccttaccggaactccagcgtgaatcttcgctggaggaccctagccgttacaaacctcagtgggaatgcagggaaaacagcggtaacctctgggccttcgaaagtcccgtcttggatctgaatcccgaattgagcgggacatctccggagtgtgttcctccagcttccgagaccccctggaagggcatgcagtcaagagagaatatttgggtgcccgcggacccagtgagtccccctagcctaccaagtgtccccctcttagagtctcttgtaatgggcccccagggcgtgctgagcgagtctaaggccctgtgggaaaccatgggacagaaggaaaacctgtgggcatctgacagtcctgatcccgtgcactcgacccctcctacaaccctgatggagccacaccgcatcaatcccggcgaatgcttagcgactagcgaagccacctggaaggatactgaacactcccgcaacagcagcgcctccagatccccgagtttggctttgtcaccccccccagcactggcccccgagttgcttagagttcgcagtatgggggtcctctcagactcggaggctaggtgtggtgatattcaaaaaacaaagaacagttgggcttcaaaacatccggcctgtaatctgccacaggacctgcacggggcgagtccactaggagtccttagtgactcccagtcaatcgttggcgagatggagcaaaaagagaactgtgtaccagtgttccctggacgtggatcttcacctagtagtaattcagtgagcaagagccacgtgtcagagcctattgccgaccagagtaattacaaaccagatggtgaggccgtggagcaacgcaagaaccactgggccacggagctccccgctccttccagtctcagtacccccctcccagaaccgcacatcgatctcgagctcgtgtggaggaatgttcagcaacgcgaagttccgcagggacccagcccccttgcggtcgacccattgcatccagtacctcaaccacctacgctggcagaggcagttaaaattgagcgcacacatcccggcttgcctaagggggtgacttgcccaggtgttaaggcggaagctccactgtcacagcggtggactgtccccgaactgctgacacaccctggaatccatgcctggcagtggtctagagagctgaaattgcgtcttaagaaacttcggcagagccccgcatctagggctcccgggccatcccagagcttttgttcttcccctatactatccagcactatccctgacttctgggggctgcccagttgcccaccacagcagatctacccaccaaacccttgtccccacagcagttcctgccatcctcaggaggtccaaaggactgtaccacagcccgttcaatcaagccattgccatcatttccagtcatcttctcagctacagccccaggaatccggtcgagcggaacagggttcacagaggggtgaaaagatgaagggcaaaatggtttcacaggtcccaagccagggtccatgcgtgcacatggaagccggcgtggactaccttagcccgggtccaggagaaccgagcaatagcaaggtgttggttagcgggaagcggaaggacaaagcctccgcgtcaagcagcgcaaagaaaagggaacacccccggaagcccaaggctggcgatcaccgccgtgggaccgcacggctgggcctgagtactgttaccggaaaaaatcaccctgctcaggccaggtctctggtggaggctccagttagcactttccctcaaagatcccagcacagggggcagagttcccagcacacagcactcccccaactgctgttgcccaaggcatcagggcctcaggatcagcctgaggcgggcagaagagcgtccgatatcctgacaccccggcactgcaagcactgcccatgggctcacatggaaaagtacctgagttttccaaccctgaaggcatcgctcacccgaggtttacagaaggtgctggctaaatgcctcgataaccatcggcctctccccactaaaagctcacagtag

SEQ ID NO: 45960 - DNA, 3096 bp, Artificial Sequence
  Description of Artificial Sequence: Synthetic coding sequence
atgctgcggaagatccagcggtggtggcagctgggccggctgcggcagttgcatccttggtgtagtggaaacatggtgcagggaaaagaattgccccttttgcatcgcgtggccttccttgaccacctgtgtaagcagaaaagcgaggtagaggaggagggagaggaagaagaagaaggcgaagacgaggccagcctggaccccctgaaaccttgtagcccaacgaaagaagcccccactggcgaacaggcgacccctgctccgcctcagccatcatgcgggtctgagggcttgctcaaggccatcggtataccagaacagactgtgatgcagccagtgtcccccagccgcagtttcccgatctttcaaatactcacaagctttccagtcagacataagatcgcgagcggaaaccgccaacagcaaagaaagtcccagcttttttggggcctccccagcctccatagcgaaagcctggaagccatttttctcagttcggggggacccagccctcttaaatggtccgtgtgcagcagcgtgttctttaataagcttgcattcctgccaagatccaatcttttgctgccccagtatcattcctcggctcagtttagtactcatggagcccacactatggaggatcttgagggaatggccccagacccacaattgctcccgcctccaagttcaccctcggtctcgagccttctgctccatcttaggcctttccctgtcgaccacaaaggggtcctttcaggcgccgaagcccctacacagagccccggcacgagcccactcgaggtgctcccaggctacgagacacacctggagactacaggccataaaaaaatgccacaggcttttgaaccacccatgcccccaccctgtcaatcaccagctagcctaagcgagcctcggaaagtgtctccggaagggggactggcgattagcaaagacttttggggcacagttggctatcgggagaagccacaggcttcagaatcttcgatgccagtgccttgcccacccctagacagtctgcccgagcttcaacgcgagtccagcctggaagacccgtcaaggtacaaacctcagtgggagtgcagagagaacagcggcaacctctgggcattcgagagtcccgtgctcgatttaaaccccgagctgtcaggaacctcacctgagtgcgtcccaccagccagtgagacgccttggaagggcatgcagtcaagggagaatatatgggtgcccgccgatcctgttagccctccgtctctgccttccgtaccactgctagaaagcctcgtcatgggtccccagggtgtgcttagtgagagcaaagccttgtgggagaccatggggcagaaggagaacttgtgggctagtgatagccctgatccggtgcattctacaccaccgacgacactgatggagccccatagaatcaacccaggcgagtgcctggccacctctgaggcaacttggaaagataccgagcatagcagaaactcatccgcttcccgttcaccgtcactcgctctaagccctccacccgcgctggccccggaactgttaagggtcagaagtatgggagtgcttagtgactccgaagcacgctgtggcgacatccagaagaccaagaactcctgggcctccaaacatccggcctgcaacctcccacaagacttgcatggtgctagcccactcggtgtcctgagcgattcacaaagcatcgtcggggaaatggagcaaaaagaaaactgcgtgcctgtttttcctggacgcggatccagtcccagctctaacagtgtgagcaagagccatgtgtctgagccaatagccgatcaatccaactataaacctgacggcgaggccgttgagcagcggaagaaccactgggctacagaactcccagccccaagctccctctccactcctttaccagagccacacatcgacttggagcttgtttggcggaatgtccagcagagagaagtaccacaggggccgtctccgctcgcggtggatccccttcacccagtgccgcagcccccaacactagcagaggcggtgaaaatcgagcgcacccatcccgggttacctaagggggtgacatgtcctggggtaaaagcagaggcgccgctgagccagaggtggaccgttcccgagttactgacgcatcccggcattcacgcctggcagtggagtagggaactgaaactccggcttaaaaagcttcgacagtcaccagcatctagagccccagggccaagccagagcttctgtagcagccctatcctgtcaagcactatccccgatttctggggactgccttcctgcccacctcagcagatctatccccctaacccatgtcctcactccagtagctgtcatcctcaggaagtgcagagaactgtcccgcagcctgttcagtccagccattgccaccactttcaaagtagttcccagctgcaacctcaggagagcggccgagcagaacaggggtcccagcgcggcgagaagatgaaggggaaaatggttagtcaggtccctagtcaggggccgtgtgtgcatatggaggccggcgttgattatttaagccccggcccaggggaacccagtaattcaaaggtccttgttagtgggaaacgtaaggataaggcaagcgcatcatcatctgctaagaagcgggagcacccgagaaaaccgaaggcaggagatcaccggaggggtaccgcacgtctcgggctctcaaccgtgacaggcaaaaaccaccccgcccaggccagatctcttgtggaggcaccggtgtccacctttccccagcgatcacagcacagaggacagtcgagtcagcatactgcactacctcaacttctgctccccaaggcgagtgggccccaagaccagccagaggccggacgtagagctagtgacatcctgaccccacggcattgtaagcactgtccttgggctcacatggagaagtacctgagtttcccgacactgaaggcctcattgactagaggattgcagaaggtgctcgccaaatgtctggacaaccacagacctctgcctaccaagtcaagccagtag

SEQ ID NO: 45961 - DNA, 1665 bp, Artificial Sequence
  Description of Artificial Sequence: Synthetic coding sequence
atggtgcagggcaaggagctgcccctgctgcaccgggtggccttcctcgaccacctctgcaaacaaaaatctgaagtggaagaggagggtgaagaagaggaagaaggggaggacgaggcatcattggatccaccggagctactcagagtgcgctctatgggcgtactatccgactccgaagctaggtgtggggatatccagaagacaaagaatagttgggcttctaagcaccctgcctgcaatctgcctcaagatcttcacggcgcgtcccctctaggtgtactctctgactcgcagtccatcgttggtgagatggagcagaaagagaactgcgtgccagtgttccccggaaggggctctagcccgtccagcaatagcgtgtctaagagccacgtttcagagcctatcgccgaccagtccaactacaaaccggacggcgaagcagtggaacagagaaagaatcattgggccacagaactgcctgcccccagctcactatccacacccctgccagaaccacatatcgatctggagctggtgtggaggaacgttcaacaaagggaagtgcctcagggtcccagcccgttggccgtcgacccactacaccctgtaccacagcctcctactctggccgaggcagtgaagatcgaacggacgcatcccggcctcccgaaaggcgtcacatgcccgggggtgaaggcagaggctcccctgtcccaacgctggaccgtgcctgagctgctgacacaccccggcattcacgcctggcagtggtcaagggagttgaagttaaggctgaagaaactcaggcagagccctgcctcgcgcgctccgggccctagtcagagcttttgttcctcacctatccttagctctaccattcctgacttttgggggttgccctcatgtcctccacaacaaatttatccaccaaatccatgtccccattccagttcctgtcacccacaggaagtgcagagaacggtcccacaacccgtgcagtcctcacactgccaccacttccagtcatcttcccagctacaaccgcaggaatccggaagagccgaacaggggagccagcgaggagaaaaaatgaaagggaagatggtctctcaggtgccttcacaagggccctgtgttcacatggaagcaggagtcgattacttaagtcccggccctggagagcctagtaactctaaagtgttggtttctggcaagaggaaggacaaagcttcagcctcctctagcgccaagaaaagggaacaccctagaaagcctaaggcaggggatcatcggaggggcactgctagactgggtctgtctacggtgacagggaaaaatcatcccgcccaggcccggagtttggtcgaggctcctgtctccacctttcctcaaaggtcacagcatcgggggcaatcctcccagcacacagctctgccacagcttctgttgccaaaagccagcggtccccaggaccagcccgaggccgggcggcgggcctctgatatcctgacgccccgacactgtaagcattgtccttgggctcatatggagaagtatctctccttccctaccctcaaagcttcactgaccagggggcttcagaaggttttggccaagtgtctcgacaaccacaggccattgcctactaagagctctcagtag

SEQ ID NO: 45962 - DNA, 573 bp, Artificial Sequence
  Description of Artificial Sequence: Synthetic coding sequence
atggccctgcggggccaccccgagccccagcccaccaacacccccctttctgcaacagtgggggggccaatcagcctctttacccagccccgctgtcattctgcggccagggaccttgtatggtctcaagcctggcccgaccccgacgtgctggagataagcatgcagacccccggcggatcctcttgccgcaaagaggccgtccttccacgactgcgggtaaccaggccactggttccagaaccagcgatactacccgtgtgcgcagctaggctggctgggtcgctcgccactgacctgtcacgctcacactctctcctccctccatgggttgatctcaaggagcccccacccccttctgctcccagtctgttgctggaggatcctggacaaggcgggtgccatggtgcccagtcttgcgtagggacgtgtgagctggcaaatggcgcccgggggttctgccccgaaatgggacagaacgagtctctctcagaagaacgcaaggggcatgaatcaaaacgtaagtccgggggacgcggcagcccgagctctcatcccacccaggctagttag

SEQ ID NO: 45963 - DNA, 693 bp, Artificial Sequence
  Description of Artificial Sequence: Synthetic coding sequence
atgctgggcacccagtggaccctggcccggtgcctgctgcccagccaccccgatccaggccttgctggcagcctgcgcggcgacagcagcgaggacgggcgacgcgggcagcttctgcctcagtcaccagcaccatgctcacctgtgtggagccccggcacaccagtgggcggccctcaccccgcaggtgacggcccagccactgccccaggtcctccagaaggacctgagctcgcatttccacaggacctttcgccagcctggcctcagaagggggcagggacacatccggccaacgccggccccgggcctctctcacgacggtcctcccagctgagaactcctctagaagcgggtaggaaatggggatggaaaatgacaaggtggcgcctgcgacgggatcaggccccgggtgaaggtactcaggcgaagctgttaggggaagcactgagcacagccgggcgtggacacgccggtcctcccgaaggatgggccggtgaaggtggagtaagccctggacttacaccactgctgggtaccgggcaagggaaagaactggatctagatcttagagagaagtttattagattcgatcaaatcctgggtattagcctcgatcacattccctttcttcctcagacagggcccggcagaccgtgggggtgtggcgttggaaagcaacgccctcattag

SEQ ID NO: 45964 - DNA, 615 bp, Artificial Sequence
  Description of Artificial Sequence: Synthetic coding sequence
atggaccccctgagcccccccctgtgcaccctgccccccggccccgagcctcctcggttcgtatgttactgcgaaggggaagagtctggcgaaggcgacagaggggggttcaatctctatgtcaccgacgccgcagagttgtggtcaacatgctttacccccgactccttggccgcattgaaggcccgatttggactttcagcagccgaagatatcactccccggttccgggctgcgtgcgagcaacaggcggtcgctctgactctgcaggaggacagggcatctctaacactgtccgggggtccatctgctttggcctttgatctgtcaaaagtgcccggcccagaggcagcgcctcgcctgcgcgccctgaccctggggctggccaagcgggtctggtcattggagcgtaggctcgcggcagcggaagagacagctgttagtccacgaaaaagccccaggccggctgggccccagttgtttctcccggaccctgacccacagagggggggaccagggcctggggtccgcagacgatgtccaggcgaaagtctcataaaccctggttttaagtctaagaaaccggccggaggagtcgatttcgacgagacttag

SEQ ID NO: 45965 - DNA, 177 bp, Artificial Sequence
  Description of Artificial Sequence: Synthetic coding sequence
atgcccaaccggcacaagaccaaggaccagaccctgctgcccgcccagcagtacatttggttactgaacagccacacgcagatgaccgctcctgtgccccagttcaagctctcagagactgcctctctcctgtgtaaaaggaagattagcaccgccatgtctagcacatgcctgtag

SEQ ID NO: 45966 - DNA, 459 bp, Artificial Sequence
  Description of Artificial Sequence: Synthetic coding sequence
tgaggccggcccccccacaagggcgccccccggctgggccggggcgtgggcgccttagtgcccgccccaagggcagggtcccacccaccagccggggtctgcgctagcgttcatcgcaatgccgtgggggcaggcgggcccgcccgggcagggcaacccggattggatggtactgggaggcgcggggcccgggccgggggtgaacggcccgagggccgcgcacctaaggtctggaaccccccttctcccctttggtcggaagaagtctattcgactgctccctactacacatcctgggcacgaggacctcggtgtcctcctgagctatgcgctccgcccctgaaacgaaaggagcagacggagcccactccaagcgtgaggcacccaacaatgatgaggtacctggtggaacagacgaacagcgcaactgagaatgatgaatcatgtctgaaaaagtag

SEQ ID NO: 45967 - DNA, 687 bp, Artificial Sequence
  Description of Artificial Sequence: Synthetic coding sequence
atggaggacagccccctgcccgacctgcgggacatcgagctgaagctggggcgtaaggtgcccgagagtctggtgcgttccctgaggggcgaggaacccgttccacgtgagcgggacagggacccttgcggtggctccggcggcgggggcggaggaggcgggggctgttccagttcctcatcctactgtagtttccctccatcactgtcctcttcctccagttcctccccaaccagcggaagtcctcgcggttcgcattcatctgccttggaacggttggagactaaacttcatttgctacggcaggaaatggtcaacctgcgcgcgacagacgtgaggttgatgagacagttattagttatcaatgagagtatcgagtccattaaatggatgattgaagagaaagctaccattacaagtaggggcagcagcctgtccgggtcactgtgttcactgttagagagccaatcgacgtcacttcgtggcagctacaactccctgcacgacggcagcgacggcctggatggtatctccgtgggctcgtacttagacaccctggctgatgacgtgccaggccaccagaccccaagtgatttggaccagttctcagatagctcactgatcgaagatagccaggcactccacaaacgtcctaaactggactccgaatactactgcttcggttag

SEQ ID NO: 45968 - DNA, 720 bp, Artificial Sequence
  Description of Artificial Sequence: Synthetic coding sequence
atggagggcctgccctgcccctgccccgccctgccccacttctggcagctgcgttctcacctgatggccgaagggagtagaactcaggcgccagggaagggccctccactctccatacaatttttgcgtgcccagtatgagggactgaaaagacagcaacgtacccaagcacatcttctggtcctccccaagggaggtaatactcctgcccctgcagagtccatggtaaatgccgtatggattaataaggaacgccgcagttcactatcgttggaagaggccgattcagaagttgaggggagactggaggaagccgcccaaggctgcctgcaggccccaaagtctccttggcatactcacctggaaatgcattgtttagtgcaaacctcaccccaggacactagccaccaggtacatcatcggggcaaactcgtcgggtcagaccagagactgcctcctgagggggatacccacctgtttgagaccaaccagatgacccagcagggcacaggaattcccgaggcagcccagctgccgtgccaagtgggcaatactcagacgaaagctgtggagagcggcctgaagttcagcacccagtgcccactgtctataaagaacccccatcgaagcggaaaacctgcctactacccattcccacagcgtaagacgcctaggatcagccaggccgcgcgcaacctggggctatacggctctgcctag

SEQ ID NO: 45969 - DNA, 288 bp, Artificial Sequence
  Description of Artificial Sequence: Synthetic coding sequence
atgttcctgaccggcgacaccagccccgccgaggacaaccgggaggccaccctgccccaatgttccctccccgaattgtacgcgtgcattgagaatttcaacaaggaatcaaaaaaatccaacctccttaaaatgcatggcattagcctgaatgaggcccaagaggttctggcccggaatctgaatgtcatgagctttacgcgtggcgctgacgtccgaggtgaccttcagccagtgatccggaagacaattcacgagtccaagggcagtggtatggagatattttag

SEQ ID NO: 45970 - DNA, 306 bp, Artificial Sequence
  Description of Artificial Sequence: Synthetic coding sequence
atgttcctgaccggcgacaccagccccgccgaggacaaccgggaggccactcttccccagtgttccctgcctgagttgtatgcatgcatcgagaatttcaataaagagagtaaaaagtctaacttactgaagatgcatggtatcagcctcaacgaagcccaggaagttctggcgcgaaatctgaacgtgatgagctttacccgaggcgcagacgttcggggcgatttgcagcccgtcatctctgtaaataaaatgaacaaacccgggaagcaccgtaaaacccccagccctaagattaacaagtag

SEQ ID NO: 45971 - DNA, 558 bp, Artificial Sequence
  Description of Artificial Sequence: Synthetic coding sequence
atgagctggagccagcccgtgctgcggggcctgcccgccagccgggatgaagactcgaagcaggtgaccactcttccgtggggcaaaaggagctcgcgaggaggggcaatttatctgtctggaatagatatgatccatggcacacccgttcttgatataaagccatatattgcagagtacgattctccccagaatgtgatggagccgttggctgacttcaatctgcaaaacaatcaacacactcctaatactgtgagccaatccgactctaagaccgatagctgcgatcagcgtcaactcagcgggtgcgacgaaccccagcctcaccattcgacaaagaggaaacctaagtgtcctgaagacaggacgtcagaggagaattatcttacacactctgatactgctcggattcagcaagcattcccaatgcatcgcgaaatagccgtggattttggtctggaatctagacgggaccaatcatctagcgtggcagaggaacagattggcccctattgcccggagaaatcattttctgagaaaggtaccgacaggtcttag

SEQ ID NO: 45972 - DNA, 480 bp, Artificial Sequence
  Description of Artificial Sequence: Synthetic coding sequence
cggggcctggaggagagcggcccccggcccaccgccaccccctgcggctgcgtgaagcctgccctggaaactgggaacctgctgacagaacctgtgggctatctcgaaagttgcttttctgcaaaaaacggcacacccagacagccaagcatctgctcctacagccgcgcttgtctcaggattagaaagcgcatctttaataacccagagcattccctgatgggccttgaacagttctcacatgtctggatccttttcgtcttccacaaaaacggacatctgagttgcaaggccaaggtacagcccccccggctgaatggtgccaaaacgggcgttttctccacacgctctcctcaccggccaaatgcaattggcctgacacttgcaaagcttgagaaggtggaagctctcggcaagtggaccgatatcatggccgccgtgctgatgtctaccgtgctttgcggcagatccttgggatag

SEQ ID NO: 45973 - DNA, 888 bp, Artificial Sequence
  Description of Artificial Sequence: Synthetic coding sequence
atgatccacggcacccccgtgctggacatcaagccctacatcgccgagtacgatagccctcagaacgttatggaaccgctggccgattttaacctccaaaacaaccagcacacgcctaacacggtctcgcagtccgactcgaaaaccgacagctgtgaccagaggcagctgtctggctgcgacgagccacaacctcaccatagtacgaagcgaaagcctaagtgccctgaggacagaacgtccgaggaaaactacttaactcattcggatacagcacggattcaacaggcctttccaatgcacagagagattgctgttgactttggtctggagtcccgcagggaccagtcctcctctgttgccgaggagcaaataggcccatactgcccagagaagtcttttagcgagaaggggacggacaagaagctcgagagagtggaaggcgctgctgtgcttcagggtagcagggctgagacccagcccatggcaccccactgtccggcaggacgcgctgatggtgctcctcgctcagttgtgcccgcttgggtaaccgaagcacctgttgctacattggaggtacggttcacaccgcacgctgagatggacctgggtcagctctcctcacaagacgtgggccaggccagtttcaaatattttcagagcgcagaagaagcgaagcgggccatagaggctgtgctatccgctgacccgagatcggtgtatcgccgaaagctatgtcaggaccgattattctatttcaccgtggacatcgcgcatgtgacctgttggttcggagatggttttgctgaagtcttgcggattaaacccgcgtctgagcctgtgcacatgacaggtcctgttggaagcttggtgtcattaggctcatag

SEQ ID NO: 45974 - DNA, 1326 bp, Artificial Sequence
  Description of Artificial Sequence: Synthetic coding sequence
atgcggggcctggaggagagcggcccccggcccaccgccaccccctgtgggtgcgtgaaaccggctttggagacaggcaacctgctcacagagcccgtgggctacctcgaatcatgtttctcagcaaagaacgggaccccaagacaaccatcaatatgtagttattcgagggcatgtctgagaatccgcaaaagaatattcaacaaccccgagcatagcctgatgggcctcgaacaattctcccacgtctggatcctgttcgtgttccacaaaaatgggcacttgtcatgcaaggcaaaggttcagcctccgcggcttaatggcgcgaaaactggagtctttagcacacggtccccccacaggcctaacgccatcgggctgaccctcgcgaagttggagaaagtggaaggtggggcaatctatttatcaggaatcgatatgatccacggcacacccgtgctggacattaaaccgtacatcgctgagtacgatagcccccagaacgtcatggaacccctggcagatttcaacctccagaataatcaacatacgcctaatactgtctcacagagcgatagcaaaacggatagttgcgatcagcgccagctgtctgggtgtgatgagccccagccacaccatagcactaagagaaagccaaagtgcccggaagatcgcaccagtgaagagaattacctgacccactctgataccgcccgcatccaacaggcgttcccaatgcacagggaaatcgctgttgatttcgggttggagtcgcggagagatcagagctcatctgttgcagaggaacaaatcggtccctactgtcccgaaaaatccttttctgaaaaagggactgacaagaaattagagcgggtggaaggggccgcagtgcttcagggaagtcgagcagaaactcagcccatggcacctcattgtccagcagggcgtgctgatggagcccccagatcagtcgtccccgcttgggttacggaagcaccagtggctactttggaggtgagatttacgccccacgctgagatggacctgggccagctgtcttcccaagatgtcggacaggcaagcttcaaatactttcagtctgccgaggaggccaagagggctattgaggccgtgctaagcgccgaccctcggagcgtttataggagaaaactgtgtcaagaccgcctattctattttacagtcgatatcgcccacgtgacgtgttggttcggggacgggtttgcagaagttctccggataaagccagcatccgaacctgttcatatgaccggacccgtgggaagtttggtgagcttgggatcctag

SEQ ID NO: 45975 - DNA, 519 bp, Artificial Sequence
  Description of Artificial Sequence: Synthetic coding sequence
ggcctggaggagagcggcccccggcccaccgccaccccctgcggctgcgtcaagccagctctggagacagggaacctattaacagagccagttggatatctcgaatcttgcttctccgctaagaatggtacccctcgccagcccagcatctgcagctactctcgcgcatgtttgcggatcagaaagagaatattcaataaccccgaacatagcctgatggggctggagcaattttcacatgtgtggatactgtttgtcttccacaaaaacggccatttgagctgtaaagcaaaagttcagcccccgcgcctaaacggtgcgaaaacaggtgtcttctcgacccggtctccgcaccgccccaacgccatcgggctcacgctggccaagctcgagaaggttgaggggaacccgtttcacttttacttctacctgttcccacacccaaagaagccctacaagatcaattccattcaccactggctttttatccagacttcaacgaatgacgtgaatagctag

SEQ ID NO: 45976 - DNA, 252 bp, Artificial Sequence
  Description of Artificial Sequence: Synthetic coding sequence
atgagcggccccaacggcgacctgggcatgcccgtggaggccggcgctgaaggcgaggaggacggcttcggtgaagcagaatacgccgcgattaactcaatgcttgatcagattaatagctgcctggaccacctggaggaaaagaacgatcacctgcacgctcgcttgcaggaactgttagaatccaaccggcagacaaggttggaattccagcagcagttgggcgaggccccctccgatgcttcaccctag

SEQ ID NO: 45977 - DNA, 612 bp, Artificial Sequence
  Description of Artificial Sequence: Synthetic coding sequence
atgcccggccccctgacctgcacccccgcctggcagggccagggcagagccgccgccttcctgtgttgctcctttcagcgggcaggggcagtagttggggtgcccgctcggtggcaccgcgggcgcctttcatctcagcagagattaaggagttctctgggaggcagccatccgtgtcctcagctggggcgccgactggtgcgtgagggtgtgatctccgtcccacggcaacaaggtaggaggcgctgtagggagtctttctcgcccgctgacgtggctccaggacccatttgttcggcgaacatctgtctgagtggagtgcgattccttacatgcctcaacagagtgcgggagcacgttgtgggcccttcgccgagcccagcagcaccaatctgtttcttcccagttgtggaggccctctgcactttgcgtggacgcagatgtcactgcctccccttcccaaagagaggcatgcaacgctggatgttgcctcttcgcagaggggcacggcttctccccctggcctcatccaaaaacccccgcgctcgcagcccaggactggatccattaggcagcagcgagactctgtggagccaccgaggaggccattag

SEQ ID NO: 45978 - DNA, 435 bp, Artificial Sequence
  Description of Artificial Sequence: Synthetic coding sequence
atggacccccaggagatggtggtgaagaacccctacgcccacatctctataccaagagcccacctgcgacccgacctgggacaacaactggaagtcgcctctacgtgctctagcagctccgaaatgcagccgctgccggtcggcccttgcgctcccgaaccaacccatctacttcagcctaccgaggttcctgggccgaaaggcgcaaagggaaaccagggggcggcccccattcagaaccaacaggcatggcaacagcccggtaacccatacagcagctcgcaacggcaggctggcctaacttatgccgggccgccccccgccggaaggggcgatgacatcgcccatcactgctgctgctgtccatgctgccactgctgccactgcccacctttctgcaggtgtcactcttgctgctgctgcgtcatctcttag

SEQ ID NO: 45979 - DNA, 366 bp, Artificial Sequence
  Description of Artificial Sequence: Synthetic coding sequence
atgtggagccggcggggcctgggcgtgagccgggcccccctgcaccttttgctgggagtgtgggggccttccgggagaacaggcggccagcggaagggtgcctctttggctcgcccgggcagaggtggcttggcaagctgttctgttggcgcaaacggaaagcgcgatgtgctcttcttaagaaagacactgaccaataccgttgaggacatacaaattgacaacttccgtagaaaatcggatcttggagtgggcagccccgattggaaaaatctgctgatcgacgtaaccagggaagatcacgagaacagccagaacaatagtaagcggcggtgtaaagttaactgtgaaactgatcaaagatag

SEQ ID NO: 45980 - DNA, 963 bp, Artificial Sequence
  Description of Artificial Sequence: Synthetic coding sequence
atgcccgaggcccggagcagcggccccgacctgacccggtggcggaagcagcagcaacctgtgaggagaacggtctcacaagtctgtccccctcctcggcggccattaactgtcgccgacatcagaagtggtatggagaacgaaagattgggtgtcgtgcgcgacagcatgtttcaaaatcctttgatcgtgaaagccgctggaccagcttccgtcgggacctcctatagcgtgtatgactccagcgccgtgcagaaagtgattccctcactggccggacatcatatcaagggcggcccacaggcagaattgggtaagccccgcgagagaagctactctcttcctggtattaactttaactatggtctatatattcggggactggatggaggggttccagaggccattgggcgatggaacgtttttaaacaacagcctacatgtcctcatgagctgacccggaactacatcgcgatgaacagaggtgccgtcaaagccggactcgtcacagccagagagaacctcttgtacagacagctgaatgatatccgtatctcagatcaggatgataggcgcatgaaaaaggagcctccacctcttccacccaacatgacttttgggattcgtgctagaccatccaccccgtttttcgacctccttcaacacagatatctccagctgtgggtgcaagagcagaaagcgactcagaaggccatcaaacttgagaaaaaacagaaagtggtccttggtaagctttatgaaacacggagcagtcagctgagaaagtataagcctccagtaaagttggacacactctggcatatgccccattttcagaaagtggggcggcacttggataccttcccgactgaagctgatagacaacgggcgctcaaagcccaccgggaggagtgtgccgtccgccagggtacactgcgcatgggaaactatacgcatccgtag

SEQ ID NO: 45981 - DNA, 855 bp, Artificial Sequence
  Description of Artificial Sequence: Synthetic coding sequence
atgcccgaggcccggagcagcggccccgacctgacccggtggcggaagcagcagcaacccgtaagaaggaccgtatcccaggtgtgccccccaccacgcagacccctcacggtcgccgatatccgttccggaatggagaacgagaggttgggggtggttcgggattcaatgttccagaacccgctgatcgtaaaggccgaattgggcaagccccgggagagatcttactctttgccagggatcaactttaactacgggttatatatccggggccttgacgggggcgtgccagaggcaattggacgctggaatgtcttcaaacagcagcccacctgtccacacgagctcacgcgaaattatatcgccatgaaccgaggggctgtgaaggccggtctggtgacagcacgcgagaatcttctctatagacagctgaatgatatcaggatctctgaccaggacgacagacgcatgaagaaagaacccccccccctcccacctaatatgaccttcggcatcagggctcgcccatccacacccttctttgacctactgcagcaccggtacctgcagttgtgggtacaggagcaaaaggccacccagaaggctataaagcttgagaaaaagcagaaggtcgtgttgggtaagttgtatgaaactagatccagccagttaaggaaatataagccacccgtgaagctggataccctctggcacatgccccacttccagaaggttgggcgacacctggatacatttccaaccgaggcagatcgtcagcgagctctgaaagcgcaccgggaagaatgcgcagtccgacagggaaccttgaggatgggtaattacactcatccgtag

SEQ ID NO: 45982 - DNA, 2931 bp, Artificial Sequence
  Description of Artificial Sequence: Synthetic coding sequence
atgacccggaccgacccccccgacctgctggtgagcaccgtgtaccaggatataaaggttgcaacccctggccccgcttctaaatgttccccatgtgagcggtctgtcgccaggccggctgaacccgcccccttcaacaagagacattgcagaagcttcgatttcctggaagccctggacggaccagcaatggagactctgccagagcccccacctcctgaatcagctgttccccgggctagaacccgagaagccgagcctcgacggcgcgcccgcagtaagagcgccccccgcgcccctcccggactgacgccagcacccgcttcaccacctgttctgccacgtagagggagggaagcccagagagcagccagagctgaagcttccccaagaagagagccagcctaccctgctctacgtgcgctcgctaatgaactacacccaattaagctgcagcctcagcgcggcggacctggtcgcgttgcccccctttgcgcagccgctggtagatgtgctcccccagagccgccagcaggacccgcaccacatgtgcgctgccgcctcgatataaagcccgatgacgctgtactccagcatgccacccgcgggtctcggagctgtggaccaaccgaggccgcacattgggctagacctgccccccagttccatggactcactgtgccaggcccacgtcacatggcactgagccggacacctaccccaagcgattcctattgcgctgacccaagagctttttactgtgacggacccctccctgggccccgcgattatgcagagcgtcggtccctgccttttaccacgccaccagggcccacgcagttcttttacactgaagaacctcaaggcttcagaggtagcttcgccgcctctcctggtccgactttcgacgcctattacccgcggccttatccatctgaagaattatctggcccttccccccggcgtatgggtggctattacgctggggaagtacggacgtttccaatacaggagcctccctctcgctcttattatggcgaggcgcctcgggcctatggtctaccctatgggccacggtacgttcctgaagaaccgcgcgcccatagtaccgccagaccattctatacagaagactttggtagatatagggagcgcgacgttctcgctcggacatacccgcatccacgatctagcccagcatgggccgactggggtccaagaccataccgaaccctccaagtagtacctccatccgatcctgaccccctgctggccagttggcacgggggcacaggcacgagtccaccacggctagccaccgattctcggcattatagtcggagctgggataacattctggctcctggtccacgacgggaggaccctctgggacgagggagaagttatgaaaacctcttgggcagagaggtccgggaacctcggggagtctctccagagggaaggagaccccctgtggtggtgaatctgtctacttcccctaggaggtatgccgcccttagcctcagcgagactagcttgacagaaaagggtagagcgggcgaaggcttaggaagaaactggtacgtaacacctgaaatcaccataaccgataatgatctgagggcgaccgagcggcctagcgctcgtgcttgggagctgcccggcgggaggacacgccccccaccacacgccgctccagatgggcctaccagcggaagacagcgatctcttgagcagttggacgagctgatcacggatctggtcattgactctcgccctactgcaggtcaggcctcagaaccagccgctgactgtctgggcccacagctgagaaggctcttggattctcggccggccggcagcggcgcccctgctctggcgcctccaaggagccccccggcaagcgcgggctcggccgaggagcctgcagcacctggagaggccgccgatgctagcccagaaccgtccgccgacgaggacgacctcatgacttgctctaatgccagatgtcgtaggactgagacgatgtttaacgcctgtctgtactttaagtcttgccattcctgttacacatactactgcagccggctctgtcgccgagaggattgggatgcccacaaagccagatgtgtatatggtcgagtaggaagtgtttgtagacatgtcctgcagttctgtagggatagcggcccagtccatcgcgcgttttctcgaatagcccgcgtgggattcttaagccgcgggcgtggggtcttgttcctcggtttcccctcgccaggctctgctgataacttcttgaggtttggacttgagggcctccttctatctcctacatatcttagtttgcgcgagttagcgactcatgccgcccctctgggctcatacgccagagaattagctgctgccgggaggctatatgaacctgctgagtgttttctgttgagcgtctccgtggcggtcgggcccgggaccgctccccctggaactcctgccctccccgcacctgcaccacgatcccatgggcccaccgttcgaaagttcgccaaagtggcattagctgcaggatcccctgctcgtccccctccagccaggagccgcgagcctgatatggagaccctcattcttacccccccacccggcaccgcggggctcgatcaggatggggaagccgggcgtcgcgctagggaggtcgcctttatccacattcaacgggaattgagattacgcggagtgtttctccgccatgagtttccccgggtctatgagcagctttgcgagtttgtcgaagccaacaggcgcttcacccccacaaccatctatcccaccgaccggaggaccgggagacccttcatgtgcatgatcatggcagcctcggaacccagagccctggattgggtggcaagcgcgaatctcttggatgatattatgtag

SEQ ID NO: 45983 - DNA, 1161 bp, Artificial Sequence
  Description of Artificial Sequence: Synthetic coding sequence
atgatgaacagcgaccagaaggccgtgaagttcctggccaacttctacattaatggtgggaagcattggacccacggccacctgcgccaaactcagcctgagcctactcaacccaaggcgagcgttctgcttttggggcctgaaccggggatggcgtgggacgagacacagccacccaagatgaaggaaatccctgtcggacttaggctgcagaccggaacccctcaagagtcactgcctacgtatacacaaacccttcgggaactcctcctagagcagcggccactcattaccgctgaccttgaagttccatccccaactaggtatcaggtgccgagccctagtgtgagggaatccagccctcacccacattactcaataggatgcaaacaccagggccgcgagggtggaggccgcagagcctggcagactttgtggttccagtcagaatccccctttacacagaaggcagattttgatcaggaacagaagtggccttcaccagcccattaccaattgctgagtagacctgcttttcctgccttttcgttcagaggctgtcatagcgccagtaagacacccgagggacacactcatcttggactgccaggggcgagaggcctgggactgagagtccagccgcagagcctcctgcaggcctctctgcaagcacccggaaagcgttgcccggggcccaatacttacaacattctgccaggatcaaggctgcagtctccaaggagcccagctttttccatgagccggtctcctgcattcacaagctggctgtctactagcttcagcttcggcagcccaaatccctggcccagcaggctgcctagagggggtctgcagctgacgctccccttcggagcttggcggggtcatcccggttgcacacagactcaggctcctaggcaccgtccgctgctacacgctttggagcccgctggacataatctgttgggtccggctaccgagtggaatcatggtctaccacggggattcccccgccccccactcggactcggcgctcccgcttggccaagtgacccccttggtacccctatgcatccttctggctggccaacacttttatgggccgtggacaaggccgggcctgcatggatacctcaccttccgatcagcccactgcattag

SEQ ID NO: 45984 - DNA, 927 bp, Artificial Sequence
  Description of Artificial Sequence: Synthetic coding sequence
atgatgaacagcgaccagaaggccgtgaagttcctggccaacttctacatcaatggaggcaaacactggacccatgggcatctgaggcagacccaacctgagccaactcagccaaaggctagtgttctgctgctggggcctgagccggggatggcgtgggacgagactcaacccccaaagatgaaagagatccctgtgggcctacgcctgcagacaggaacgccccaggagagcctgcctacctatacacaaacactcagggaattgctcctcgagcaaaggcccctgatcaccgcagacctggaggttccttccccaacgagatatcaggtgccctctccttccgtgagggagtcatcaccacatccacattattcaattggctgtaaacaccagggccgagaaggaggaggaagaagagcatggcagaccctgtggtttcaatctgaatccccctttacccagaaggctgactttgatcaggagcaaaagtggccttcgcctgcccactatcaattgttgagccgccccgcattccccgcgttttctttcagggggtgccattcagcctccaaaaccccagaaggtcacacccaccttggcctccctggcgcacggggactcggtctccgcgtccaaccgcagtccctgttacaggccagtttgcaggcgccaggcaaaagatgcccaggaccgaatacatacaacatcctgcccggtagtaggctgcagtccccacgcagcccagctttctcgatgtcacgttccccagccttcacatcctggctgtctacctcacgaaccccaggtccggccgcctaccacgtagaagactgtaactctcgattcccatccgctcccggcgtagttatccagggagtgcggagacccaaacggcacgatacaggtccattctgtaccctttag

SEQ ID NO: 45985 - DNA, 549 bp, Artificial Sequence
  Description of Artificial Sequence: Synthetic coding sequence
atggccgcccccgcccccgtgacccggcaggtgagcggcgccgccgcacttgtcccggccccatcaggccccgatagcgggcagcccctggctgccgctgtagctgagctaccggtcctggatgccagaggacaaagggtgccttttggggccctgtttcgcgagaggcgggccgtcgtcgtctttgtgcggcatttcctttgttacatatgcaaggagtatgtggaagaccttgctaagatcccaaggtctttcctccaggaagccaacgtgaccctcatagttatagggcagagctcctatcatcacatcgaaccgttctgcaaactgactgggtactcacacgagatctatgttgaccctgaaagggaaatttataaacggctgggaatgaagagaggtgaggagatagccagttctggtaacaacatccattttatacaccgggatagaaatcggctggatcataagcctatcaactctgtcttgcagctggtgggagtgcagcatgtgaattttactaaccgccccagcgtgattcacgtgtag

SEQ ID NO: 45986 - DNA, 681 bp, Artificial Sequence
  Description of Artificial Sequence: Synthetic coding sequence
atggccgcccccgcccccgtgacccggcaggtgagcggcgccgccgctcttgttcccgctccctctgggcctgatagcgggcagccgctagccgccgctgtggccgagcttccagtgttggatgcacgcggccaacgggtcccttttggtgcgttgttcagagagcgccgggctgttgtcgtctttgtgagacactttctgtgctatatctgcaaggaatacgtggaagacttggcaaagatacctcggagttttctccaagaggccaatgtgactctaatcgtaattggtcagtcgagttaccaccatattgagcccttctgcaagctcaccggatatagccacgaaatctacgttgatcccgaaagggaaatctataaaagacttgggatgaagcgcggggaggagatagcatccagcgggcagtcacctcatataaagtctaatctgctgtcagggtccctgcagtctctctggcgcgctgtgaccgggcctctcttcgattttcagggcgatccagcccagcaagggggcactctgatactgggtcctggtaataacatccatttcatccacagagaccgtaacagattagaccataaaccgattaacagtgtattgcagcttgtgggcgttcagcatgtaaatttcactaaccgaccgtccgtcattcatgtctag

SEQ ID NO: 45987 - DNA, 333 bp, Artificial Sequence
  Description of Artificial Sequence: Synthetic coding sequence
tgatacgtggaggacctggccaagatcccccggagcttcctgcaggaagcaaacgtcacattgatcgtcattggacagtcgtcctatcaccacatagagccattctgcaaattgacaggctatagccacgaaatctacgtggatccggagcgggaaatctataagagactggggatgaaacgcggcgaagagatcgcctcctccggaaataacattcatttcatacaccgcgatcgcaaccgcctagaccacaagccaatcaacagcgtcctgcagctagtaggtgtgcagcatgtaaacttcacaaatagacccagcgtaatccacgtgtag

SEQ ID NO: 45988 - DNA, 543 bp, Artificial Sequence
  Description of Artificial Sequence: Synthetic coding sequence
tgaggcccccggcccccccgggtgatggccgcccccgcccccgtgactcggcagcacttcctgtgctacatttgcaaagaatacgtggaggacctcgccaaaatccctcgatcgtttctccaggaagctaatgtgactcttatcgtgattggacagtcctcctatcaccatatcgaaccattctgtaagctcacgggctatagccacgagatttatgtggatcccgagcgcgaaatttataagcgcctgggcatgaaacggggtgaggagatagctagcagcggccaatcaccgcacattaagtcaaatctgctgtccggttccctgcaaagtctctggcgcgccgtgacaggccctctttttgacttccagggagatcccgcccagcagggcgggacgctgatcctgggacctggtaataatatccattttatacacagggatcgcaatcgcttagaccataaacctataaattccgtgttgcaattggtgggagtccaacatgtgaactttaccaaccgcccgagcgtgattcatgtgtag

SEQ ID NO: 45989 - DNA, 492 bp, Artificial Sequence
  Description of Artificial Sequence: Synthetic coding sequence
atggagcactaccggaaggccggcagcgtggagctgcccgccccctcacccatgccccagttaccccctgacaccctagagatgcgtgttcgggacgggtcgaagattcggaacctcctcggcttagccctaggaaggctggagggaggttccgcacgccacgtggtattctcagggtctggacgggccgctggtaaggccgtctcgtgtgcggagatcgtgaagagacgcgttccaggattacaccaactgaccaagctgcggtttctgcaaaccgaagactcgtgggtgccagccagcccggatacaggtttggatcccctcaccgtgagaagacacgtgccagcagtgtgggttctcctaagcagggaccctctagatcccaatgaatgcggatatcaacctcctggagctcctccagggctcgggtccatgccctcttcctcctgcggtcctcgaagtagacgacgtgcgagggacaccagaagttag

SEQ ID NO: 45990 - DNA, 492 bp, Artificial Sequence
  Description of Artificial Sequence: Synthetic coding sequence
atggagcactaccggaaggccggcagcgtggagctgcccgcccccagtcccatgcctcaacttcctcccgataccctagagatgcgcgtgagagatgggtcaaagatacgcaatctgctgggcttggctctgggacggctagagggcggcagtgccaggcacgtagtgttctccggcagcggcagggctgcaggtaaagcagtgtcatgtgccgaaattgttaagagaagggtgcctgggctgcatcagctgactaagctgagatttctgcagactgaggactcctgggtgccagcttcaccggataccggtctggacccactgactgtgcgcaggcacgtacccgctgtgtgggtacttctgtcccgggaccccctcgacccaaatgagtgcggctatcagccacctggagctcctccgggcttgggatcaatgccctcgagctcctgcggaccccggtctaggcgccgtgctagagatacacggtcatag

SEQ ID NO: 45991 - DNA, 495 bp, Artificial Sequence
  Description of Artificial Sequence: Synthetic coding sequence
atggagaccgccgtgcggggcatgcccctggagtgccccccccggccggaacggctgaacgcctacgagcgcgaggtgatggtcaatatgcttaactccttaagcagaaaccagcaactgccaagaatcacaccgcgatgcggttgtgtggacccactccccggcaggctgcctttccacggatatgaatccgcctgtagtggacgacactactgtctgagggggatggactattatgcatcaggcgccccctgcacagaccgccggctccggccatggtgccgtgagcagcctactgtaaggtgcgttcctccttacgagcatcgcccagggatgcaatgcgcggttacaacccctccacctagctactacccataccctaacttgcggtgggacacgtcccattttaagaaatctggcggacctcagagaaacaactatgtgatccatcccgaattcgtgtcggaaacgtatcccgattatcgttgctggtag

SEQ ID NO: 45992 - DNA, 336 bp, Artificial Sequence
  Description of Artificial Sequence: Synthetic coding sequence
atggagaccgccgtgcggggcatgcccctggagtgccccccccggcccgagcggctgaatgcttacgagcgtgaggttatggtgaatatgcttaactccctctcaagaaatcagcagctccctcgaattactcctcgctgcggctgcgtgcctccctatgagcataggcccggaatgcagtgcgctgtgaccacgcccccaccttcctattatccttatcccaaccttaggtgggataccagccactttaaaaagagcggcgggcctcagcgaaataactatgtcatccacccagagtttgtgtctgagacttatcctgattacagatgctggtag

SEQ ID NO: 45993 - DNA, 495 bp, Artificial Sequence
  Description of Artificial Sequence: Synthetic coding sequence
atggagaccgccgtgcggggcatgcccctggagtgccccccccggcccgagagactcaacgcctatgagcgcgaggttatggtgaatatgctaaattccctgtcgagaaaccagcagctccctagaattactcctaggtgcgggtgcgtggacccattgccaggcaggttacccttccacggttacgagagcgcatgttctggccggcactactgcctgaggggaatggattattacgcttcaggtgctccctgtacggacaggcgcttgaggccttggtgtcgggaacagcctaccgtcagatgcgtacccccatacgagcaccgtcccggaatgcagtgcgctgtgacgacgccacctccctcctactatccttatcccaatctcagatgggacaccagtcatttcaagaagagcggaggtccgcagagaaacaattacgtgatccatcctgagttcgtgagcgagacataccctgactataggtgctggtag

SEQ ID NO: 45994 - DNA, 384 bp, Artificial Sequence
  Description of Artificial Sequence: Synthetic coding sequence
atggagaccgccgtgcggggcatgcccctggagtgccccccccggccagaacgactgaacgcctatgagcgggaagtgatggtgaatatgctgaatagcttatcgcgaaaccagcagctgccacgcatcaccccgaggtgtggctgcgttgaccccctgccagggaggctgccatttcacgggtatgagtccgcttgctccggcaggcactattgtctccgaggtatggattactacgcctccggagccccgtgcacggacaggcgactgaggccttggtgcagagaacagcctaccatgtgtacctcgctcagggccccagctcgcaatgcagtctgttgttacaactcacctgcagtgatcctgcccatctcagagccatag

SEQ ID NO: 45995 - DNA, 381 bp, Artificial Sequence
  Description of Artificial Sequence: Synthetic coding sequence
tgagcctgggaggccaacaagttcctgacccccggcctgacccacacgatggaaaggcatgtggatcccgaagctctgcagaaaatggccaagtgtgccgtacaggactatacctaccgtgggtcaatcagcggacatccttatcttccagaaaagtattggctgtcccaggaagaagccgacaaatgctcaccgaactatctggggtcagactggtataatacttggcgtatggagccctataactcctcctgctgtaataagtacacaacctatctgcccaggctgcccaaagtttcggtggctccatccaccgatgtctggggcctgggccatgcgtatccaactacaagtcagactacagtcacagacatctcttag

SEQ ID NO: 45996 - DNA, 507 bp, Artificial Sequence
  Description of Artificial Sequence: Synthetic coding sequence
atgatggaggagatcgaccggttccaggtgcccaccgcccacagcgagatgcagccccttgatcccgctgcggcttccattagtgacggcgactgtgatgctagagaggaaaaacagcgggagcttgcccgaaaaggcagcttgaagaacggcagtatgggaagccctgtgaatcagcagcccaagaagaataatgtgatggcccgaactagacttgtcgtgcctaataaagggtatagctccctggaccagagccctgacgaaaagcctctcgtggccttggataccgatagtgatgatgactttgacatgtcaaggtacagtagcagcgggtacagctccgcagagcagattaaccaggatctgaatattcagctgctgaaggacggataccgactggacgagatacctgacgacgaagacttggatcttatcccaccaaagagtgttaacccaacatgtatgtgctgtcaggccacctcctccacagcgtgccatatccaatag

SEQ ID NO: 45997 - DNA, 471 bp, Artificial Sequence
  Description of Artificial Sequence: Synthetic coding sequence
atggaggagatcgaccggttccaggtgcccaccgcccacagcgagatgcagcccttagacccagccgcggcgtcgattagcgatggcgattgcgatgctagggagggggagtctgtcgccatgaactacaaaccgtctccgctgcaagtgaaactggagaagcagagagaactcgctcgtaagggtagtttgaagaacggttccatgggttcaccagtaaatcagcaaccgaagaagaacaatgtcatggcgcgtacaaggctggtggtaccaaataagggttatagtagcctcgaccagtctcctgatgagaagcccctggtggcgctggacactgaccggtgtgtctggggtctgggcggcagctgggccgcacagcgcaacctgtactctacatctggactgtaccgaccacatctgttatactgccaaaattgggatattctccaacccgagagcctgcaaggttag

SEQ ID NO: 45998 - DNA, 519 bp, Artificial Sequence
  Description of Artificial Sequence: Synthetic coding sequence
atggaggagatcgaccggttccaggaccccgccgccgccagcatcagcgacggtgactgcgatgcgagggaaggagaatctgtggcgatgaattacaagccttcaccacttcaggttaaattggagaaacagagggagctggcccgaaagggaagccttaagaatggctctatgggttctcctgtcaaccagcagccgaaaaaaaacaacgtgatggcgaggaccagacttgttgttccaaataagggatacagtagcctagatcagtcccctgacgaaaagccgctcgtggccctggatacagactcagatgatgattttgatatgtcacgatattccagttccggctatagctctgctgagattaaccaggatttgaacatccaattactgaaagacgggtaccgcttagacgaaatacccgacgatgaggatcttgacctgattccacctaagtccgtgaatcccacatgtatgtgttgtcaggcgacctccagtaccgcctgccacattcagtag

SEQ ID NO: 45999 - DNA, 471 bp, Artificial Sequence
  Description of Artificial Sequence: Synthetic coding sequence
atggaggagatcgaccggttccaggaccccgccgccgccagcatcagcgacggagattgcgacgcacgagaagagaagcagagggaattggccaggaaggggagtctgaagaacggctccatgggttctccagtgaatcaacagcccaagaaaaacaatgtgatggcacgcacgcggcttgtggtgcccaacaagggttattcctcgctcgaccagtctcccgatgaaaagccactggtagctctcgatactgacagtgacgacgacttcgatatgagtagatactctagttccggatactccagcgccgagcagatcaatcaggatctgaacatacagcttctgaaggacggatatcggttggatgaaattcctgacgatgaggacctggaccttattccacctaaatccgttaatcctacctgcatgtgctgtcaggccaccagttccaccgcctgccatattcagtag

SEQ ID NO: 46000 - DNA, 495 bp, Artificial Sequence
  Description of Artificial Sequence: Synthetic coding sequence
atggaggagatcgaccggttccaggtgcccaccgcccacagcgagatgcagcccctcgacccagccgcagctagcataagcgatggcgattgtgacgccagagaagagaaacagcgcgagctcgctagaaaagggtcattaaagaatgggtctatgggcagtcctgtcaaccaacagcccaaaaaaaataatgtcatggcgagaacccgcttagtggtgcctaacaagggctattcaagcctggaccagagcccagacgaaaaacctctggttgcattggacactgactctgatgatgatttcgatatgagtcgctattcgtcatctgggtactcttccgctgaacagattaatcaagacctgaacattcaattgctaaaggatggctatcgtctggatgaaattccagacgacgaagacctggacctgatacctcctaaccaagtgagcccttgcagtttgatctactttcaagagggtgtgtggaagacatag

SEQ ID NO: 46001 - DNA, 501 bp, Artificial Sequence
  Description of Artificial Sequence: Synthetic coding sequence
atggaggagatcgaccggttccaggtgcccaccgcccacagcgagatgcagcccctggaccctgcggccgcgagtatttcggacggagactgcgatgcacgagaggagaaacagagagaattagctaggaaaggttcactcaaaaacggctctatgggtagcccagtaaaccaacagcccaaaaaaaacaacgtgatggcaaggaccagactggtggtgcctaacaaagggtatagctcgttggaccagtctccagacgagaagccccttgtggctctcgacacagactcagacgacgactttgatatgagcaggtatagtagttcaggatactcttctgccgagatcaaccaggacttaaacattcaactcctgaaagacgggtatcgactggatgaaatccccgatgatgaggatctagacctcatcccaccgaaatcagttaatcccacgtgcatgtgttgtcaggccacgtcttcaaccgcatgtcacatacagtag

SEQ ID NO: 46002 - DNA, 552 bp, Artificial Sequence
  Description of Artificial Sequence: Synthetic coding sequence
atggaggagatcgaccggttccaggtgcccaccgcccacagcgagatgcaacctctggaccccgctgctgcctcaattagtgatggagactgcgatgcaagagagggggagagtgttgctatgaattacaagccgagtccactacaggttaagctcgaaaaacagcgagaactcgcccgcaagggcagtttaaagaacgggtccatgggttcaccagtgaaccagcaaccaaaaaagaacaacgttatggccagaacccgtttggtagtccctaataagggctactcatctctagaccagtcccctgacgagaagcccctggtcgctctcgatacagattctgacgacgatttcgacatgagccgatattccagtagtggctacagcagcgcagagattaaccaggatctgaatatccagcttctgaaagacggttatcgcctggatgaaattcctgacgatgaagatctcgaccttatcccacccaaaagcgtgaatcccacctgcatgtgctgtcaggccacttcctctaccgcctgtcatatccagtag

SEQ ID NO: 46003 - DNA, 510 bp, Artificial Sequence
  Description of Artificial Sequence: Synthetic coding sequence
atggaggagatcgaccggttccaggtgcccaccgcccacagcgagatgcaacccctggatcccgccgctgccagcatctctgatggcgactgtgatgctcgcgaaggcgagtctgtggcaatgaactacaaaccaagtcccttacaagtgaaacttgaaaagcagagagaactggctcgaaaaggctcactgaagaatggaagtatggggtcacccgtcaatcagcagcctaagaagaataacgtgatggcgagaactcggctcgtggttcccaataaaggctacagctccctcgaccagagccccgatgagaaacccctggtggcactcgacacagactcagatgacgatttcgacatgtcccggtacagctcttccggctacagctcggcggaacagatcaaccaggatctcaacatccagttactcaaggacggctatcggcttgacgaaatacccgacgacgaggacttggatcttattcctccgaagtccgtgaacccgacgtag

SEQ ID NO: 46004 - DNA, 558 bp, Artificial Sequence
  Description of Artificial Sequence: Synthetic coding sequence
atgatggaggagatcgaccggttccaggtgcccaccgcccacagcgagatgcaacccctggatcccgccgctgctagcatttctgacggcgattgcgatgcacgcgaaggagagagtgtagcaatgaactataaacccagccccttgcaggtgaagctggagaagcaaagagaactggcccgcaagggttcattaaaaaatgggagtatgggctcccccgtcaaccagcagccaaagaaaaacaatgtcatggcacgaacacggctcgtagtgcctaacaaaggctattcctccctcgaccagtcgcccgacgaaaagcctctggttgcacttgacaccgattccgacgacgatttcgacatgagccgatactccagtagcggttatagtagcgctgagcagatcaatcaagacctgaacattcagctgctgaaggacgggtaccgcctcgacgagattcctgacgatgaagacctggacctcatccctccaaagagcgtgaacccaacatgtatgtgttgccaagccacctcctctactgcttgtcacatacagtag

SEQ ID NO: 46005 - DNA, 153 bp, Artificial Sequence
  Description of Artificial Sequence: Synthetic coding sequence
atgaagctgctgagcgagcagcaggagctgcggaccgtgagcatgaccgcctggaagccgagaatgaataggaaaagcagatctcggatgtctcctatcgaccctcggcactcagggacgccaaattcaaataggatcggcctgtccacctag

SEQ ID NO: 46006 - DNA, 153 bp, Artificial Sequence
  Description of Artificial Sequence: Synthetic coding sequence
atgaagctgctgagcgagcagcaggagctgcggaccgtgagcatgacagcctggaagccccgtatgaatcggaagagtcgtagcagaatgagtcccatcgatccaaggcactccgggactcccaatagtaatcggatcggacttagtacatag

SEQ ID NO: 46007 - DNA, 360 bp, Artificial Sequence
  Description of Artificial Sequence: Synthetic coding sequence
atgaaccggaacatcctggaggagatgctgcagtacctgctgatcgattggattgttggtgatcaatttgagatccaactgaaccagcagctgtggagtctgattcccaacaatgatgtccgtcgcctagtgtcacatgtaatacgcaccctgaagacagattgtaccgagacgcatctacaattggcttgcgcaaaactaatttcaagaactgggctcctcatgaagctgctgagcgaacagcaggagctgcgaacggtgtccatgacagcgtggaaacctcgaatgaaccggaagtcacgcagtcgtatgtccatcccttctggccccgatatggaagagacaaccgatgtgtcttag

SEQ ID NO: 46008 - DNA, 297 bp, Artificial Sequence
  Description of Artificial Sequence: Synthetic coding sequence
atgctgcagtacctgctgatcgactggatcgtgggcgaccagttcgagatccagctgaaccagcaactctggtctttgattccaaataatgacgttaggcgccttgtctctcatgtgatcaggacgttgaaaaccgattgcaccgaaacgcacctgcagctggcttgtgcaaagctcatcagccgcaccggcttgctgatgaaactcctgtctgaacagcaggaacttcggaccgtgagcatgactgcctggaaacctcggatgaacagaaaatctcgaagtcggatgcgaagttag

SEQ ID NO: 46009 - DNA, 2163 bp, Artificial Sequence
  Description of Artificial Sequence: Synthetic coding sequence
atggacatccagctggaccccgcccgggacgacctgcccctgatggcgaatacctcacacatactagttaaacactacgtgctagatctcgacgtggactttgaatcacaggtgattgaagggactatagtgttgtttctcgaagatggcaaccgttttaagaagcagaatagctccatcgaagaggcttgccagagcgaaagcaacaaggcctgcaaatttggcatgcctgagccctgtcacatccccgtcacaaatgcccgcacctttagcagcgaaatggaatacaacgacttcgccatttgctctaagggcgagaaggacacctccgataaagatgggaaccacgacaaccaggagcatgcgtcgggtatctcctcaagcaagtattgctgtgatacaggtaatcatggctcagaagacttccttcttgtcctggactgttgcgacctcagtgtgcttaaagtcgaggaggtagacgttgcagcagtgccaggactggaaaagttcactagatcacccgaactcaccgtggtgtccgaggaattcagaaatcagatagtccgggagctggtgacattgccagccaatcgatggagggagcaattggactattacgcgagatgctcacaggcacctgggtgtggggagcttctgttcgatacagatacctggtccttacaaattagaaagaccggagcccaaaccgcaacggactttccccatgcaattaggatctggtataagaccaagccggaaggtcggtctgttacgtggacgtcagaccagagtggccggccgtgtgtctataccgtgggatcgcccatcaacaacagggccctgttcccctgccaggagccccctgtggctatgtcaacctggcaggctactgtacgagcagccgcttctttcgttgtgctgatgtcgggggagaacagtgctaaaccgacccaactttgggaggagtgttcttcatggtactattacgtaactatgccaatgcctgcctctacattcactattgcagtaggctgttggactgagatgaagatggagacatggagctccaacgatcttgctacagaacggcctttcagcccatcggaggccaattttcggcatgtcggggtgtgttcacatatggaatacccgtgcaggttccagaatgcatccgctacaactcaggagattatcccgcaccgtgtgtttgctcctgtatgtctgacaggagcatgtcaggaaacgctgctaagactgatacctccgtgtctgtccgccgctcactcagtcctcggcgctcatccattcagtcgccttgatgtgctcattgtgccagcaaattttccgagtcttgggatggctcggcccagcaaggataagacaggccataccagcgactctggagcatccgttattaagcacggactgaaccccgagaaaatatttatgcaggttcactacctcaaggggtattttctgttgaggttcctggctaagaggctcggggatgagacctatttcagttttctaaggaaattcgtgcacaccttccatgggcagctaattctgagtcaggactttctgcagatgttgctcgaaaatatacctgaagagaagaggttagagctgtctgtggaaaatatttaccaagactggctggagtcatctggaattcctaaacccctgcagagggagaggcgggccggggcagaatgcgggttagcccgtcaggtgagggcggaagttactaagtggattggcgtcaatcgtcgaccccgaaaacgaaaacgacgagagaaagaagaagtgtttgagaaactcttacctgatcagcttgtgcttctgctcgagcacttgttggagcagaaaaccctgagtccgagaaccctgcaatctctgcagcgaacttaccacctacaagatcaggacgccgaagttagacatagatggtgtgaactgattgtcaaacataaatttacaaaggcttataaatccgttgagcgattcctacaagaagatcaggccatgggagtgtacctgtatggggaattgatggtcagcgaagatgctagacagcaacagttggccagacgatgttttgagaggaccaaggagcagatggacagaagctctgcacaggtcgttgcggagatgctgttttag

SEQ ID NO: 46010 - DNA, 552 bp, Artificial Sequence
  Description of Artificial Sequence: Synthetic coding sequence
gccgaccccggccgggcccagggcgccggcagcggcgccgccgccgccagcagccccgccgcaggcgagccactccagcgcgaaagaagggccggtgccgagtgtgggctggccagacaagttcgggccgaggtgactaagtggataggcgtgaatcgacgacctcgcaagaggaaacggagagaaaaagaggaagtgttcgaaaagttactgccggatcagttggtcctgttgttggagcatttactcgagcaaaaaacgctgtcacctagaacactccagtcactgcagcggacataccatctgcaggaccaggatgcagaggtacgccaccggtggtgtgagctgattgtgaagcataagtttaccaaagcctacaagagcgtggagcgctttctccaagaggatcaagctatgggagtgtacctgtacggagagttgatggtcagcgaggacgccagacaacaacaacttgcaagaaggtgcttcgagcgaaccaaggagcagatggacagaagctcagcgcaggttgtagcagaaatgctgttttag

SEQ ID NO: 46011 - DNA, 2460 bp, Artificial Sequence
  Description of Artificial Sequence: Synthetic coding sequence
atggacatccagctggaccccgcccgggacgacctgcccctgatggccaatactagccacatcctggtcaagcactatgtcctggacttggatgtggacttcgaatcccaagtcattgagggcacaattgtgctttttctggaggacgggaacagatttaagaagcagaattccagcatcgaggaagcctgtcagtccgaaagcaacaaggcgtgtaagttcggcatgccagagccttgccacatcccggtgacaaatgctcggacctttagctccgagatggagtataacgactttgcaatttgctctaaaggagagaaagatacctccgacaaggacggaaatcacgataatcaggagcacgcctctggcatttcttctagcaagtactgctgtgataccggaaatcatggctcggaggattttctcctggtcctggattgctgtgacctgtctgtactgaaggtggaggaggtcgatgttgcagccgtcccgggactcgagaagtttacaaggtctcccgagcttactgttgtcagcgaagaatttcggaaccagatcgtgagagaactcgtcacactccccgccaaccgctggcgggagcagctggactactatgctcggtgttctcaagctcccggctgcggcgagcttctttttgacacagacacatggagcctgcagatcaggaaaaccggagcccagacagccacagactttccgcacgcgattcgcatatggtacaaaactaagcctgaaggccggtccgttacttggacatcagatcaatcaggccgcccttgcgtttatacagtcggatctcctattaacaatagagccctgttcccgtgccaagaaccccccgtggctatgtctacatggcaggcaacggtgcgtgcggctgcctcgttcgtggtgctcatgtctggcgaaaatagcgcaaagcccacgcaactttgggaggaatgctcttcctggtattactatgtaaccatgccgatgccggcaagcacctttacaattgcggtcggatgctggacggaaatgaagatggaaacttggtctagcaacgatctcgctacggagagacccttttccccttcagaggccaattttagacacgttggtgtttgttcacatatggagtacccatgccggtttcagaacgcctccgcgaccacacaggagatcataccccatagagtattcgcccccgtctgccttaccggagcttgtcaggaaacactcctgagacttatacccccatgtctgtccgcagctcactcagtgttgggcgcgcatccattctcccggctcgacgttttgatcgtaccggctaatttcccatctctggggatggctagtcctcacatcatgttcctcagccagtcaattctcacgggaggcaatcatctttgcggcacgaggttgtgccacgagatcgctcatgcatggtttgggctggctattggagctcgggactggacagaggaatggctgagtgaaggtttcgccacacacctggaagacgtcttctgggcaaccgctcagcagctcgctccctacgaagctcgcgagcagcaggagttacgcgcatgcctgcggtggaggcggttacaggatgagatgcagtgtagccccgaagaaatgcaggtccttcgtccttcaaaggataagacaggtcatacgagcgactccggagcatctgttattaaacacggcttgaacccagagaaaatctttatgcaggtccactatttaaaaggctactttctgctgaggttccttgcgaagcgactgggagacgaaacatatttcagtttcctgcggaaatttgttcataccttccatggtcagctgatcctgtctcaggatttccttcagatgctcctggaaaatattcccgaggagaagcggctagaactgtctgttgaaaatatctaccaagattggctggaatcatccggcattcctaagcctcttcagagggagaggcgagctggcgcagaatgtgggctggcacgtcaagtcagagcagaggtgacgaagtggattggggtaaatcggcgaccacggaaacgcaaaaggagggagaaagaggaagtgtttgaaaaactgcttcctgatcagctggtgctgcttttggaacacttgttggaacaaaagactctcagcccccggaccctgcaaagcctacagcggacttaccatctccaggatcaggacgctgaggttcgtcaccgatggtgcgaactcattgttaagcataagtttaccaaagcctacaaatctgtggagcgtttcctacaggaggaccaagccatgggggtttacctctacggtgaattgatggtgtcagaagatgcgaggcagcagcagttggccaggcgctgctttgagaggacgaaggagcagatggaccggtcttcagctcaggtagtcgcagaaatgctgttctag

SEQ ID NO: 46012 - DNA, 495 bp, Artificial Sequence
  Description of Artificial Sequence: Synthetic coding sequence
atgcaggtgcactacctgaagggctacttcctgctgcggttcctggccaagcgcctgggcgacgaaacctacttcagttttctacgtaagttcgtccacacattccacggccagctgattctgagtcaggatttcttacagatgctgctcgaaaacattccagaggaaaaaaggctggaactcagcgtcgaaaacatataccaagactggttggaatcctcaggaatccctaagccgttacaacgcgagcggagagccggagcagagtgtggcctagcaagacaagtgcgtgctgaggtcacaaagtggattggtgttaacaggcggccccggaagcgcaagcgaagagagaaagaagaggtgtttgagaaaacgctaaactggagccatctgcgcaatcgggaaagacggcgtaaaaagtggatcacttttaagactcttggaggcattctctttacggtgaagcagatgcggaacctgtttgctcaagtgtag

SEQ ID NO: 46013 - DNA, 561 bp, Artificial Sequence
  Description of Artificial Sequence: Synthetic coding sequence
atggagtacccctgccggttccagaacgccagcgccaccacccaggagataatcccccatcgggtattcgcccctgtctgtctgaccggggcttgccaagagacgttgctgcggttgatcccgccttgtctcagcgcggctcatagcgttctgggagcccaccccttctcgagactggatgtgttgatcgttccagccaacttcccaagcctcggcatggcatcccctcatattatgttcctttcacaatcaatactgaccggcggcaaccatttatgcggcacgcgcctctgtcacgagatagcccacgcctggttcggtttggccatcggggcacgtgattggacagaagagtggctttctgaggggttcgcaacccatctggaagacgtgttctgggctaccgcccagcagttggctccgtacgaagcacgcgaacaacaggagctacgagcatgcctgcgctggcgccggcttcaggacgaaatgcaatgctctcccgaagagatgcaggtcctaaggtttcctcatgtgggggggtgctcaggttcattctcatag

SEQ ID NO: 46014 - DNA, 1527 bp, Artificial Sequence
  Description of Artificial Sequence: Synthetic coding sequence
gtggtgagcgaggagttccggaaccagatcgtgcgggagctggtgacactacccgccaatcgctggcgcgagcagctggactattacgcaaggtgtagtcaggcgccaggctgcggcgagttgttgttcgacactgacacttggtcactgcagatcaggaaaacaggtgctcagacggccacggactttccccacgcgattcgcatttggtataaaactaagccggagggccgatctgtcacatggacgagcgatcagagcggaagaccctgtgtctacactgtcggatctcccattaataatagggcgctgttcccctgccaagagcccccagtggccatgagcacctggcaggctacagtgagagccgccgcctcatttgttgtgcttatgagcggcgagaacagtgcaaaaccaactcagttgtgggaagagtgctcaagctggtattactacgttacaatgcctatgcctgcttccactttcacgatcgccgtgggatgttggactgaaatgaaaatggagacctggtcttccaacgatctggctaccgaaaggccttttagccccagcgaagccaatttcagacacgtcggcgtgtgctcccatatggagtacccatgccgcttccagaacgcaagcgcaaccacgcaggagatcattcctcaccgtgtcttcgcccccgtctgtctgacaggagcttgccaagagaccctcctacgacttatcccgccatgtttgagcgccgcccactccgtcctgggagcacaccctttctctagactggacgttctcattgtgccagccaacttccccagcctggggatggcaagacccagcaaggacaaaaccggacatacctctgacagcggagcatcggtcattaaacatggactcaatcccgaaaaaatctttatgcaggtgcactacctgaaaggctatttcctcctgcgatttcttgcaaagcggctaggggatgaaacctatttctctttcctgcggaagtttgtccacactttccacggacagctgattctgagccaggacttcctgcagatgctgctggagaatattcccgaagaaaaaagactcgagctgagcgtggagaatatttatcaggattggctcgaatctagtggtatccccaaaccactccagcgagaacggcgggcaggggctgagtgtggcttagcacgacaggttcgggccgaagtcactaagtggataggagtgaatagaaggccaaggaagcgaaagcggcgagagaaagaggaggtgttcgagaagctgctccctgaccaacttgtgctcttgcttgagcaccttctcgaacagaaaactttatcgcccaggacactgcaatccctgcagcgaacctaccatttgcaagaccaggatgcagaggtacgacacaggtggtgtgagttgatcgttaaacataagttcacaaaggcttacaaatcagtggagcgttttctgcaagaagatcaagtgggggtgatatttcagcaaatgggcattctgtag

SEQ ID NO: 46015 - DNA, 546 bp, Artificial Sequence
  Description of Artificial Sequence: Synthetic coding sequence
atgcggatgcggcggcccctggccggcggcggcaagagctggggcatcgcacatttctataagcccctgcagcgggaacgccgcgctggcgcggagtgcggtctcgcaaggcaggtcagggctgaggtgactaagtggatcggggtcaacagaagaccgcggaagcgcaagaggcgggagaaggaggaagtattcgaaaaactactgcccgatcagttggttttgctcttggagcatttgctcgagcagaaaactttaagtccccggacactgcagagtctgcaaagaacgtaccacctacaagatcaggatgctgaggtcaggcatcgatggtgtgaattgatagtgaaacacaaattcacaaaggcctataagtccgttgagcgattccttcaagaggatcaagctatgggcgtatacctatacggggaactgatggtgtccgaggacgctcgtcaacagcagctcgcccgcagatgttttgagagaactaaggagcagatggatcggtcctctgcacaggtagttgccgagatgctgttttag

SEQ ID NO: 46016 - DNA, 423 bp, Artificial Sequence
  Description of Artificial Sequence: Synthetic coding sequence
agcagcaagtactgctgcgacaccggcaaccacggcagcgaggactttctattggtgctggattgctgcgacttatctgtgctgaaggttgaggaggtggatgtggccgccgtgccggggctggagaaattcacacggtctcccgagctcaccgtcgtttccgaagaatttagaaatcagattgtgcgggaactcgtgaccctgcccgctaacaggtggagggaacaactggactactacgcccggtgttctcaggcccctggatgtggcgaactgctgtttgacaccgacacatggagcctgcagatcagaaaaacgggtgcacagacagccacagatttcccccacgcgataaggatttggtacaaaactaaaccggagggcaggtccgtgacatggacctccgaccagtcagggagatag

SEQ ID NO: 46017 - DNA, 1806 bp, Artificial Sequence
  Description of Artificial Sequence: Synthetic coding sequence
ctgttcgacaccgacacctggagcctgcagatccggaagaccggcgctcagactgcgaccgatttcccccacgcgattaggatctggtacaagactaagcccgaaggccgctccgtgacatggacctcggatcagtcaggccgaccgtgcgtatacacagtgggttcgccaatcaataatagggctctgttcccatgccaagaaccaccagtggccatgtccacctggcaggccactgtcagggccgccgcctcctttgtggtgcttatgtctggggaaaatagtgcgaaacccacccaactgtgggaggaatgtagtagttggtattactatgttactatgcctatgcccgcctctacattcaccatcgcggttggatgttggaccgaaatgaaaatggagacctggtcatcgaacgatctcgccaccgagcgcccgttctcgcctagcgaggccaacttcagacatgttggcgtctgctctcacatggagtacccatgtcgattccagaacgcttcagccaccactcaggaaattataccccaccgggtgtttgccccagtctgcctgactggggcttgccaggaaaccctgctcagactaatcccgccatgcctgtccgctgcccattccgtgctgggggcacaccctttttctagactggacgttctcatcgtccccgctaacttcccaagtttagggatggcaagccctcatataatgttcctgtcccagtctatactcacgggagggaatcatttgtgcggcactcggctctgccatgagattgcccacgcctggttcggactcgccatcggtgcacgtgattggacggaagagtggctgtcagaaggtttcgccacccatctagaagacgtcttttgggcgactgcacagcagctcgctccttatgaggccagggaacagcaggaactaagggcctgccttcgctggagacgcctgcaggacgaaatgcagtgctcgcccgaggagatgcaagtacttcgcccttcaaaggacaagaccggtcatactagtgacagcggggcttccgtcatcaagcacgggcttaaccccgaaaagatctttatgcaggtccattacttgaaaggttacttcctgctcaggtttctggccaaaagattgggcgatgagacttacttctctttcttacgcaaattcgtgcacacattccatggacagctgatcctgtcccaggacttcctccagatgctgctcgagaacataccagaagaaaaaaggctcgaactttctgtggagaatatttatcaagattggctggaaagctccgggatccctaaaccgttgcagagagaacgtagagccggagctgaatgcggccttgctcggcaggtgcgcgccgaggtgactaagtggataggcgtaaaccggcggccccggaaacgcaagagacgggagaaagaagaagtgttcgagaagctactgcctgaccagttggtcttgctgcttgagcatctgctggagcagaaaacgctatctcctagaactctgcagtccctccagaggacttatcaccttcaagatcaggacgccgaggtgaggcatcgctggtgcgagctgatcgttaagcacaaatttactaaggcctataagtccgttgaacgcttccttcaggaagaccaggctatgggggtgtacttatacggcgagctgatggtctctgaagatgcccgccaacagcaactggcccgaaggtgttttgaaagaaccaaggagcagatggaccgtagttccgcacaagtggtggccgagatgctgttttag

SEQ ID NO: 46018 - DNA, 483 bp, Artificial Sequence
  Description of Artificial Sequence: Synthetic coding sequence
atgcggatgcggcggcccctggccggcggcggcaagagctggggcattgcccacttttataaagtgacgaaatggatcggtgtgaataggaggcctcgcaaaagaaagcggcgcgagaaagaagaggtcttcgaaaagctactgcctgatcaactggttctattactggaacatttattggagcagaagaccctttctccccggaccctccagagcttgcagagaacctaccatcttcaggatcaagacgctgaggtgagacatcgatggtgtgagctgattgtgaagcataagtttaccaaggcatataaatccgttgagcgctttctccaggaagaccaagcaatgggggtgtatctctatggagaactgatggtgagcgaggatgcccgccaacagcaacttgccagaagatgctttgagcgaactaaggagcaaatggatcggtcatccgcccaagtcgtggcagagatgctgttctag

SEQ ID NO: 46019 - DNA, 555 bp, Artificial Sequence
  Description of Artificial Sequence: Synthetic coding sequence
tgagccgaccccggccgggcccagggcgccggcagcggcgccgccgctgcgtctagccctgccgccggcgagccattgcaaagggaaagaagggcaggcgcagagtgtggtctcgcccggcaggtgagagcagaggtcacaaagtggattggagtgaaccggaggcctcgcaaacggaaacggagggaaaaggaggaggtcttcgaaaagctcctaccagaccaactagtgctgctattagagcatctgttggaacaaaagaccttgtccccacggacactgcaatctttgcagaggacttatcatcttcaggaccaggatgctgaagtacggcataggtggtgtgagcttattgtcaaacataagttcactaaagcatacaagtccgtggagcgcttcctgcaggaggaccaggccatgggggtgtatctatacggggagctcatggtgtccgaagatgccagacagcagcagctagcgcgcagatgttttgaacgcaccaaagaacagatggaccgcagtagtgcccaggtggtggctgaaatgctgttctag

SEQ ID NO: 46020 - DNA, 438 bp, Artificial Sequence
  Description of Artificial Sequence: Synthetic coding sequence
tgagacgagacctacttcagcttcctgcggaagttcgtgcacacctttcacggacagctcatcctgtcccaggattttctgcaaatgctgcttgagaatatcccagaggaaaagcggcttgagctatccgtggaaaacatttaccaggattggctcgagtcctcaggaatcccgaaacctctgcaaagggagcgacgcgccggtgcagaatgcggactggccagacaggtgagggccgaggttactaagtggattggggttaaccgaaggccccggaaaagaaagagaagggagaaggaagaggttttcgaaaagacactaaattggagtcacttaaggaacagggaacggaggagaaaaaagtggattacgttcaaaacattgggggggatactctttacagtgaagcagatgcgtaacctgttcgcgcaggtctag

SEQ ID NO: 46021 - DNA, 546 bp, Artificial Sequence
  Description of Artificial Sequence: Synthetic coding sequence
atgcagaacaacgagatcatcaagcccgccaagtacttcagcgagttggagaaaagtatactcttggccttggtagaaaaatataagtacgttttggaatgcaagaaaagtgacgccaggaccattgctcttaagcagcgtacctggcaagcactggcccacgagtataactctcagcctagcgtgagtctgagggattttaagcagctgaagaaatgctgggaaaacatcaaggcccgcaccaagaaaataatggcacacgagcgaagggaaaaggtcaagaggtctgtaagccccctgttgagcacccatgtgctaggtaaagaaaagatcgcatcaatgctccctgagcagctgtatttcctgcagtctccgccggaagaggagccagagtaccatcctgatgcaagcgctcaggaatcgttcgctgtttctaatagagagctctgtgacgatgaaaaggaattcatccatttcccagtgtgcgaaggtacttcacagcccgaaccctcctgctctgcagtgcgcattacggccaataaatag

SEQ ID NO: 46022 - DNA, 828 bp, Artificial Sequence
  Description of Artificial Sequence: Synthetic coding sequence
atgcagaacaacgagatcatcaagcccgccaagtacttcagcgagctcgaaaaatcaattttgttggcacttgttgaaaaatacaagtacgtccttgagtgcaaaaaatctgacgcacgtactattgctctcaagcagagaacctggcaggccctggcccacgaatataactcgcagccgtctgtcagcctgcgggattttaagcagctcaagaagtgctgggagaacatcaaagccagaacaaagaagatcatggctcacgaacgccgagagaaggtgaaacgctctgtctctcctctgttatctacccacgtgcttggcaaagaaaaaatcgctagcatgttgccagagcagctctacttcctgcagtctccaccggaggaagaacccgagtatcatccggatgcaagcgctcaggagtcttttgccgtcagcaacagggagctgtgcgacgatgaaaaggagttcatccatttccccgtatgcgaagggacctctcagccagaaccttcttgctccgctgtgcgcatcaccgctaacaagaactacagatcaaaaacctctcaagaaggcgcgttaaaaaagatgcacgaagaagagcaccaccaacagatgtctatcctgcagctccagctgatccagatgaacgaggtgcatgtggccaaaatccagcagattgagagagagtgcgagatggccgaggaggaacatagaatcaaaatggaagtactcaacaaaaaaaagatgtactgggaaaggaagctccagacattcacgaaggagtggccagtctcttcctttaaccgcccattcccgaatagcccttag

SEQ ID NO: 46023 - DNA, 405 bp, Artificial Sequence
  Description of Artificial Sequence: Synthetic coding sequence
atgcagaacaacgagatcatcaagcccgccaagtacttcagcgagctggagaagagcatcctgctggcccttgtggaaaagtacaagtacgttctggaatgtaagaaatcagacgcccggactatcgccctcaagcagcgtacttggcaggccctagctcatgagtacaatagccagccatctgtgagcttgcgcgacttcaagcagctgaagaagtgttgggaaaacatcaaggctcgtacaaaaaaaatcatggctcatgagaggagagagaaagtaaagcggtcagtctcaccgctgctgagcacacatgttctcgggaaggaaaagattgcctctatgctgccagagcagctctactttctacaaagccctcctgaggaagaaccggagtaccacccatag

SEQ ID NO: 46024 - DNA, 492 bp, Artificial Sequence
  Description of Artificial Sequence: Synthetic coding sequence
atgacccaccccctgccccacgacagccacaccagcggcgcccccccgttggtgaataagtctcgtgaccttgccaacggtccgccctttttttcgccgctgcaatcactttgggaggagtttttacatttgctgttcatgggaaccctgctgttttataggatcgcaaccaaggccctgagaggaaaagccaccttactgaagagccacagcaaacaacctgcccagccaggttgggagccagggatccgtgcacccagtccagttcccgcctctagtctgcaggatcattctcgtctgacgagtctgtcacgaactggcaaagaacagcgcaggacgttgtcactcatccgtaagacctccggtacgccgactgagtctactgttgctactgctgctgcttccactaccgaggtgccctccagactgccttgggcagcccgagcaggatttaagagaactacaggggtgtgcatcgccctgccgacgtag

SEQ ID NO: 46025 - DNA, 435 bp, Artificial Sequence
  Description of Artificial Sequence: Synthetic coding sequence
atgcccagcagcgcccacgcccacgccatcctgaaggacgcccaggactctccaggagtggtacttggacagggcgtgatacgggcagggaagggatgggaaaatggcccagagtcacatcgggtgcggtaccgagggaaaaagaataccgattggcatacccgctcacctgctttgacctttacagtcttatggccctcctgtccgttggtcccgattgtcctggggctgaaccccggtttctgcccatgcgccagaagttccggagaatgtaaccattctggtcacataatcgagggtacacgctgggaccaagggcagctctgtctacttttcaccctatctcgcgcggatattcgcgcttgctggcgggtgggcgagcagcagtacgtaagcttgttcacccatgtccagatgcagcacccttctttatag

SEQ ID NO: 46026 - DNA, 531 bp, Artificial Sequence
  Description of Artificial Sequence: Synthetic coding sequence
atggagttccactacgtggcccaggccgacctggagctgctgacctcctcgaacccaccagcctcagcttcccagtctactggtattacaggcggtagtcaccgcgctcgccctggcccggtccacttcatcgataaagtcacagacaagccgtctcacagccacccgtttgcgctgaaggaaaactggaatctgaacccggagccctcttcgcccccaagcccactcttcctcgaagcaccaagtcggcaggcttcccagcatcacggagcctccccaggtgccggtactagcgctggatgcccctttgagaagtgttgcagcactgaaccttgccttagcggcctgggcgacgtcggccggggagaggcagcgtcactgcgcgccagacctggctctggcgcgtctcgtggtcaggggcccggtagtagggtctcttgtcggagggatttgggcaagccactacacgcgccagctgggttttctgctggtgaagtgcataccaccccactgggtaacttgggggcctag

SEQ ID NO: 46027 - DNA, 357 bp, Artificial Sequence
  Description of Artificial Sequence: Synthetic coding sequence
atgcccagcaagaccgccgagaacgccaccttctactacatcagcagtctgctaagctctcgttcccccgtctttaaccagtcacccaaggtaaaggcaggtcacatgctggaagccagccagatcagtgctaaaaacagcgccgacttcttccacccaactccatcatgctccgaactcgactttactttgcatcccgagctcgcagatagcctgggggccaaacataactacaaagctacatgcctgatgcggttccttcctctccaacgtcacacccggagctggttcagtctaattttgtggtgtatacagagggacgactatctgattggcttattttcctgctttagttag

SEQ ID NO: 46028 - DNA, 462 bp, Artificial Sequence
  Description of Artificial Sequence: Synthetic coding sequence
atgcagcggcggcggcggccccccccccccaccagccggctgcccgagggctgcgggggcgggggcggggggtcagaggaagtagaagtccagttttcagcagggcgttggggaagtgcagccgccgtctctgctgcggctgctgccgcaacacgctctacagaggaagaagaggagagactggaacgcgaacatttctggaagatcattaatgccttccgatattacggaactagcatgcacgaacgggtgaacagaacggaaaggcagttccggagcctcccagcgaaccagcagaaactgcttcctcagttcctgctgcaccttgataagattaggaagtgcatcgatcacaatcaagaaatcctgctgacaattgtgaatgactgtatacacatgttcgaaaataaagagtacggagaagatgtgtgcgagtcgctattctacttttgccttttttag

SEQ ID NO: 46029 - DNA, 1230 bp, Artificial Sequence
  Description of Artificial Sequence: Synthetic coding sequence
atgcagcggcggcggcggccccccccccccaccagccggctgcccgaaggctgcggaggcggcggcggcgggtcggaggaggttgaggtccagttctccgctggccggtggggatccgctgcggctgtgagcgctgcagccgcagcagctactcggagcacagaagaggaggaggaacgactggagcgggaacacttttggaaaatcatcaacgcattccggtactatggtacatccatgcatgaacgcgtgaacagaactgagcggcaatttcgaagcctgcctgctaatcaacagaagttgctacctcagtttctgttacatctggacaagatccgtaagtgcatcgatcacaaccaagaaatcctgctcacaatagttaatgattgtatccacatgtttgaaaacaaggagtacggcgaggatggcaacggaaagatcatgccagctagcacattcgatatggataaactgaagtcgacgcttaaacaatttgtgcgggactggtcagagaccgggaaagctgagcgtgacgcgtgttatcaacctataatcaaggaaatcctaaagaatttccccaaagaacgatgggacccctccaaagtgaacatcctggtacccggagcgggattagggaggcttgcctgggagatcgcgatgcttggatacgcatgtcaggggaatgagtggtcattctttatgctcttttccagcaactttgtgctgaataggtgctcagaaattaacaaatataaactgtatccctggatccaccagtttagcaataatagaagaagcgcagatcaaatccggcccatctttttccctgatgtagaccctcacagcttacctccaggtagcaatttctcaatgaccgcgggcgactttcaagagatttattcagaatgcaacacctgggattgcatcgctacctgcttctttatagacactgctcataacgtgatagattacattgacacaatatggaagatactgaaaccagggggcatttggattaaccttggtcccctgttgtaccattttgaaaatctggccaacgagttatcaatagagctctcctacgaagatatcaaaaacgtggtactgcaatacggcttcaaagtggaggtagaaaaagaatctgtgcttagcacctatactgtcaacgatctcagcatgatgaagtattactatgaatgtgtgctgttcgttgtgagaaagcctcagtag

SEQ ID NO: 46030 - DNA, 591 bp, Artificial Sequence
  Description of Artificial Sequence: Synthetic coding sequence
atgcagcggcggcggcggccccccccccccaccagccggctgcccgaagggtgtggcgggggaggcggcggctcagaggaggtggaggtgcagttcagtgcaggcagatggggatctgccgccgcggtctctgccgccgctgccgccgcaacccgttcaacggaagaagaggaggaacgtctagagcgggaacacttttggaaaataattaatgcgttccggtactatggaaccagcatgcatgaaagggtgaataggacggagcgccaatttcgatctctgccagctaatcagcaaaagctcctgcctcagttcctgctccacctcgacaagattcggaaatgcatcgaccataaccaagaaatcctgctgacaatcgtgaacgactgtatccacatgttcgagaacaaagagtatggcgaagatgggaacggcaagattatgccagcttcaaccttcgatatggacaagctcaaatcaaccctaaaacaatttgtgcgggattggagcgaaacaggtaaagccgaacgagatgcgtgctatcagcccatcattaaggaaatcctgaaaaatttccctaaagagagatag

SEQ ID NO: 46031 - DNA, 717 bp, Artificial Sequence
  Description of Artificial Sequence: Synthetic coding sequence
gtgctgcggctgcagctggagagcgaccggcacgacctgctgcggtctacctctatgcacgagcgggtcaatcgcaccgagcggcagtttaggagtctccctgccaatcaacagaagctccttcctcagtttctgctgcacctggacaagatacgcaagtgcattgatcataatcaggagattttgctgaccattgtcaatgactgtattcacatgttcgagaacaaagaatacggcgaggatggtaatggaaagataatgcctgcctccacgtttgacatggacaagctaaagtccacattgaaacaattcgtgcgtgactggagcgagactggcaaggccgaaagggacgcctgttaccagccgataataaaagagattctgaaaaatttcccaaaggagcgctgggacccctctaaggttaatatactggtccctggcgcggggttggggcggctagcctgggaaatcgcaatgctcggctacgcctgccaagggaacgaatggagtttcttcatgcttttcagcagtaatttcgtgctcaatcgctgttcagagattaataaatataagctctacccctggatccaccagtttagcaataatcggaggtccgctgaccagattcgtccgatattctttcccgacgtcgatcctcactccctgccccctggcagcaatttcagcatgactgcgggagatttccaagagatctag

SEQ ID NO: 46032 - DNA, 1386 bp, Artificial Sequence
  Description of Artificial Sequence: Synthetic coding sequence
atggacctgcccgacgagagccagtgggacgagaccacctgcggcttggccgtctgtcaacatccccagtgctgggcgaccataagacgaatcgagcgggggcatccccgcatcttggggagcagctgcaagacccccttggatgctgaggacaagctccccgtcctgacagtggtggatattctggactccggctttgctgctcatcaccttccggaatgcacttttaccaaagcacattcgctgctctctcagtctagcaaattttacagcaagtttcatggtagaccgccaaaagggctccccgacaaaagtctcatcaattgtactaataggctccctaagttccccgtgctgaatctcaatgagactcagttaccttgccctgaggatgtgcgtaacatggtggttctgtggatcccggaagaaactgaaatccatgtctcacagcatggcaagaaaaagcgaaagaattccgccgttaaaagtaaaagttttttgggactgtccggaaaccagtcagcggggacccgagtgggaacccccggtatgatcgttcctccccccactcccgtgcagttatctgaacagttcagctctgacttcttgcctctctgggcccagtctgaagccctcccgcaggatctgctaaaggagctcctcccaggcggcaagcagactatgctctgcccggaaatgaaaataaaactcgccatgatgaaaaagaatttacccctggagaagaacagaccagattccgttatctcgtctaagatgttcttgagtatacacagactcacactcgagcgacctgctctcaggtaccctgagcgactcaaaaagctccacaacctcaaaacggagggataccgcaagcagcaacagagacagcagcagcagcagcagcagcaaaagaaggtgaagactcccatcaagaagcaggaggcgaagaagaaagcaaaatctgatcccggaatccagtcaaccagccataaacatcctgtgacaaccgtacacgatcgcctgtacggttataggaccttacctgggcagaatagtgatatgaaacaacagcagcaaatggagaagggtacaacctctaagcaggacagtacagaacggcccaaaatgaattattacgatcacgcggattttcaccacagtgtgaagtcaccagaactgtacgaaacagagccgacaaacaaagacatttccgcacccgtggacgcggttcccgaagcacaggcggccagacagaaaaaaatctctttcaatttctcagaaatcatggccagtacaggctggaattctgagctgaagctgctgagaatactgcaggacacagacgatgaggatgaagaagaccagtcttccggtgctgaatag

SEQ ID NO: 46033 - DNA, 1386 bp, Artificial Sequence
  Description of Artificial Sequence: Synthetic coding sequence
atggacctgcccgacgagagccagtgggacgagaccacctgcggcttagccgtgtgtcagcatccccagtgctgggccactatcaggagaattgagaggggacaccctcgaattctggggagttcatgtaagacacccctcgacgctgaagataaactgccagtgttgacagtggtggacatactggacagcggattcgccgcacaccatctaccagagtgtactttcaccaaggcacattcccttctctcacaaagttcaaaattctattccaaattccatggcagacctccaaaaggcctgcccgacaagtccttgataaattgcactaatcggctcccaaagtttcccgtgctgaatctgaacgaaacacagctgccttgccctgaggatgtgcggaatatggtggtactatggatccccgaagaaactgaaatccacgtctcccaacacgggaaaaagaagaggaagaattctgctgtgaagagcaagagcttcctcggattaagcggtaatcagagtgccggcactagggtgggaacacccggaatgatagtgccacctcccaccccggtgcagctatctgaacagtttagcagtgattttttgcccctttgggcccagagcgaggctctccctcaggatcttctgaaggagctcctgcccggggggaaacagactatgctgtgccctgaaatgaaaatcaagctcgctatgatgaagaagaacctgcctctggaaaagaacagaccggactcagtcattagttctaagatgtttctgagcatccatcgcctgactttagaaagacccgcgttgagatacccagaaaggctcaagaagctccacaatctcaaaaccgagggctatcgcaaacaacagcagagacagcagcagcaacagcaacagcaaaaaaaagtcaagaccccaatcaagaagcaggaggcgaaaaagaaagccaagtctgatcctggcattcagagtactagtcataaacacccagttacaaccgtacacgaccgactctatggttataggacactgcccggccagaatagtgatatgaagcaacagcagcagatggaaaaggggaccacctccaagcaggattcaacagagcgaccaaaaatgaactactatgatcatgccgactttcaccactcagtcaagagcccagaactgtatgaaactgaacctactaataaagatatatctgcacccgtcgacgctgtgcctgaagctcaggccgctcgccagaaaaagatctccttcaacttcagcgagataatggctagtactggctggaatagtgagctcaaactacttcgcatattacaggacaccgatgatgaagacgaggaagaccagagctccggcgccgagtag

SEQ ID NO: 46034 - DNA, 1386 bp, Artificial Sequence
  Description of Artificial Sequence: Synthetic coding sequence
atgagccggatcaacaagaacgtggtgctggccctgctgaccctgacctccagtgctttcctcctttttcaactgtattactacaagcactaccttagcacgaaaaacggtgccggtctgtctaagagcaaaggatcaagaataggatttgatagcacgcagtggagggccgttaagaaattcataatgcttacctccaaccagaacgtgccagtatttctcattgatcccttgatcttagaactgatcaataaaaattttgagcaggtcaagaataccagtcatgggtctacgtcccaatgtaaatttttctgcgttcctcgggacttcactgccttcgccctgcagtatcatctctggaagaacgaggaagggtggttccgcatcgccgagaacatggggttccagtgcctgaagatcgaatcaaaagatccacgccttgacgggatcgacagtctgtctggcacggaaatccccctgcactacatatgcaagttagcaacgcacgcaatacatctggtcgtgttccatgaacggtctgggaactatctttggcacggccacttacgattaaaggaacacattgatcgaaagtttgttcctttccgcaaactgcagttcgggagatatcccggagccttcgatcgcccagaactgcagcaggtgaccgtcgatgggctggaggtgctgatacccaaggatccaatgcactttgtcgaagaggtgccgcacagcaggtttatcgagtgccgctataaggaggctcgagcattttttcagcagtatttggacgataatacagtggaagctgtggctttcagaaaaagcgccaaagagctgcttcaactagcagcaaaaaccctaaataaactgggtgtgccattttggctgtcttcgggaacgtgcctcggctggtacagacagtgtaacataatcccctattcgaaggacgtggacctaggtatattcatacaggattacaaatccgatattattctggctttccaggatgcaggactccctctcaagcataaatttgggaaggttgaggactcccttgagctctcatttcaggggaaagatgacgtcaaattagacgtgttcttcttctacgaagagacagaccacatgtggaacggcggcacgcaggccaagactgggaaaaagttcaaatacttgttcccaaagtttaccctgtgctggaccgaattcgtagatatgaaggtgcatgtgccctgcgagactttggaatatattgaagctaactatggaaagacttggaaaattcccgttaaaacatgggactggaagcggtctccaccgaacgtgcagccaaatggcatctggcccatatcagagtgggatgaggtgatccagctgtattag

SEQ ID NO: 46035 - DNA, 2640 bp, Artificial Sequence
  Description of Artificial Sequence: Synthetic coding sequence
atggccgacggcggcggccccaaggacgcccccagcctgcggagcagcccaggccccgccccccgcgtgcctcgggcggtggggcccagcggaggcggcggcgaaacaccgcggacagccgcacttgccttacgtttcgataagcctattaagcaggctttctacaacaccggggccgtgctgttcgtttgcttgtgctgtggcgcggccgtactagtgtacttcattcttgaggcgttcctacgcccattgctctgggccgtactgtgtgggacttttctgcatccgtttaagtcttccctgactaggctcggaaggcattggctgcagaggctacaccgggcacacacgccgatcgtcctcgccgccctgctgctcccactgtgctttgtggactacggcgttgaggctctgggcgagcaagccctgaggcgacgccggcttctgctgctcttaggggctggaggtcctttgctgtacgggttgtactgcctgggatcttacctgggtgttcaagtgctgctcgtccacgccgcgacactgatctgtcgaggtctagactacttctcttccctgtggatttggacccttgtggtcgggtatgttctgactgtgagctttaaatggaatgccagtactgaacgctatctccgagcagtgtccatccctgtctggataattctactgttccatctggcctcactcgctggctcatggcgcattccagtgttcctggtaatagtattcctgatgagtgtcggaaccttgtatgagaagcagaacggtaaagagagctcgggagctgaactccccggacaagtcatcagcatggcagctagtaccctggccaacctggcaatctcaataactggctatgagtcaagcagcgaggaccagcccagcacacagccagctgaggcagtggataggggggaatcggctcctacactttctacaagtccttcaccgagttctccatcacccacctctccctccccgacgcttggtcgtcgcagaccggagatcgggacgttcctgcgcaaaaagaaaacctcagatatctacttcgtgtctctcgtgtgggcaatcgtcgtgatgcagatctggttaaacctgtggatcgtacagctcctaccagtccctatagccgtctggatacttaagaaacttgtaatccattttggcgttgttgacttcctagagaaacggtatcacgtgtggtggggtataatcgaaagctttcttaaggaacgacagggagcgctcgcaccgtggccaattgtaggcctcgggaagttccttctgaaggttgattctaaactgtggcactggctcaataaaaagatgattatctggttagagaagatgttggataaaattatcagtatcttcattattttcttattggtgattggcaccttattgctggcgctcctgttgaccgccaaagtccatcaggaatctgttcacatgatcgaggtaacctccaacttgattaatgaaacacttgcgaatcatccagaatgggcgaactggctgcccgaagcgcaggtcgttcagagagccctgaactctgccgctaacaatgtgtatcaatatggccgcgagtggataacacacaaactgcataagatcttaggagacaaagtgaacaacactgcagtgatagagaagcaagtcctggaactctgggacagactttatcattcttggtttgtcaagaatgtgacacattccggcaggcacaagggtcagaaactccatgtgtctcggcagaactcttggctgggagacatcctggactggcaggatatcgtttccttcgtgcacgaaaatatagaaacattcctatctattctggaaagcctgtggattgtcatgtcccgtaatgtcagcttactctttacaaccgttacaactctgctcactatcttattctattcaggaaccgccctcctgaatttcgtgctgtctctgatcatatttctgacgaccttattttatctgctctcatcctctgatgagtactacaaacctgtgaagtgggtcattagcttaaccccacttagccagcccggcccatccagtaatatcatcggccagtcagtggaagaagcaatcagaggggttttcgacgcatccctgaaaatggcgggtttctatggcctgtacacttggctgacacacactatgtttggcatcaacatcgtttttatacctagtgcccttgctgccatactgggcgctgtgccgttcctcggaacgtactgggccgcggtccctgccgttctggatctgtggctcacacaaggattgggctgtaaggcgatcctgttactaatattccacctgttgccgacttattttgtcgacacggccatttatagcgacatttctggaggcggacacccctacctgactggactggcagtggctgggggcgcttactacctcggtttggagggggcgatcatcggtccgattttgttgtgcattctcgtcgttgcaagcaatatctactccgcgatgctcgtgtccccaactaattctgttcccacccctaaccagaccccctggccggctcaacctcagaggactttcagggatatcagtgaagatttgaaaagctccgtgggatag

SEQ ID NO: 46036 - DNA, 1509 bp, Artificial Sequence
  Description of Artificial Sequence: Synthetic coding sequence
atggccgacggcggcggccccaaggacgcccccagcctgcggagctctcctggccctgcgcctagagtgccccgggcggtagggcccagtggcggcgggggtgaaactccccgcacagctgctctagccctgcgtttcgacaaaccaatcaagcaggcgttctacaatacaggtgctgtgctgtttgtctgtctgtgttgcggtgccgccgttctcgtgtatttcatacttgaggcgtttttgcgaccactgctgtgggccgtgctgtgtggcacattcctgcacccatttaagagtagcctgacacgtctaggacgccattggctgcagcgactgcaccgggcacatacacccatcgtacttgccgcactgttattaccattgtgtttcgtggattatggagtggaagccctgggcgaacaggcactcagaaggcggcgcctgctattgttacttggggcaggtgggcccctcctgtatggtctgtactgcctagggagctacctgggtgtccaagtcctcctggtgcacgctgccacattaatatgccggggccttgactattttagcagcctgtggatctggaccttagtagtaggctatgttctgaccgtaagtttcaaatggaatgcaagcactgaaaggtatctgagggcggtgtctatccccgtgtggattatccttctcttccacttggcctccctggctggatcctggcgaattcctgtctttttggtcatagtgtttctgatgagtgttggaacactctacgaaaagcagaacggtaaggagagctccggtgccgagctgcctggacaggtcatttctatggctgccagcactctggcgaatctggctatttcaatcaccggatacgagtcaagttccgaagatcagcccagtactcagccagcagaggcagtcgataggggtgagagcgcccctaccctgagcacctctccaagccctagcagtccctccccaacaagcccatcaccgacattgggaaggcgaagaccggagatcggtacttttctaagaaagaagaagaccagtgatatctacttcgtctcacttgtgtgggcaatagtggtgatgcagatatggctgaacctgtggattgtacagttactccctgtgccaattgcggtgtggatactcaaaaaactcgtcattcatttcggcgtagtcgatttcctcgagaagagataccatgtgtggtggggtattattgaatctttcctcaaggaacgacaaggagcactggccccatggcccattgtgggactgggaaaattccttctgaaagttgacagtaaaatgataatttggctcgagaagatgctggataagatcattagcatcttcataatctttctcctggtcatagggaccctcttactcgctcttttgctgactgcaaaagtgcatcaggaaagtgtgcacatgatagaggtgacctctaatctcatcaacgaaactctggccaatcatcccgagtgggcttag

SEQ ID NO: 46037 - DNA, 1296 bp, Artificial Sequence
  Description of Artificial Sequence: Synthetic coding sequence
atgttctggcggcggctgcggcccggcgcccaggacctggcccccaagggtctgcctggcgacggggactttaggagaagctccgatcctagattgcctaaattaacgccgcctgctttgagggccgccttgggcgcacggggatcaggtgattggaggatacccggcggcggcgcagcctggtggccggagggcgacgccaaacccggggttggtgtgggtagacttcctccccggttgccagccctgctgacggcaacccgacgcgccgtacggaagcgaggcctgctgcggtccctgctcccaccccctctgctgagtgcaggagcaagcagagagtctgctccaagacaaccaggacccggggagcgcgagaggccccgcagacgggtggcgcgcgaagacccagacttcttgggggcttttctaggtgaactgttaccttccaggtttagggaattcctgcatcagctacaagagaaatgcgccgaagaaccagagcctttgactagccctgcgccgcaacaccagaggggagttctggagcattgtcctggttcgccacgatgtccgaactgcagtttcttgcctgatctatggggacagtcttcgcacctccaagactcactaacaaagatctccttgcagcagacaccgatattgggccccctgaaaggtgatcactcgcaatttaccacagttagaaaggccaaccatagaccgcatggggcccaggtgcctcgtcttaaggctgcactgacccacaatccctccggagaaggcagccggccttgtcggcagagatgcccttttcgagtgaggttcgctgacgagaccttgcaggataccacgttgagatattgggaacgtcggcggtccgtccagcaatctgttatcgtcaaccagaaagctgccttgccagttgcgagcgagagagttttcggttctgtgggcaaacggctggagagtttgcctaaagccctctaccccggcgccaaggaagagaccctggcttcgtcaagctgttgggattgtgctggtctgtccactcagaaaacccagggctatctatctgaggacacaagcatgaactcctcactgccattctgcagctggaaaaaggccgccgcccaaaggcccagaagtagtctccgcgccttcctagatccgcaccgaaacctggagcaggagtcactccttcctaatagagtgctgcagagcgttttgaaacaggggtgtccgaagggataccatcttcttctggcatccgctacgcttcagccagataagaggtag

SEQ ID NO: 46038 - DNA, 816 bp, Artificial Sequence
  Description of Artificial Sequence: Synthetic coding sequence
atgcgggaccggcggggccccctgggcacctgcctggcccaggtgcagtgggcaggtgggggcgatagcgacaaactcagttatagcctgaaaaagaggatgccaaccgagggcccatggcctgctgatgctcccagctggatgaataagcctgctgtggatggtaactcccagagcgaggccttgagtctggagatggccgggctgtccctcccatcaggaggcccggtgctcccatatgtgaaagaaagtgcccgtagaaaccctgcgtccgccgccacaccctcagcagcagtcggcctgttcccagcccccacggagtattttgcccgcgtcagttgttctggcgtggaggcactcggcagagattggctcggggggggcccacgggctacacatggacaccgcggccagtgtcccaagggggagccaagagtttcccgccttacaagacatcagaagctgccggagatgggctctttttgggacgacccaccaagcgcctttcctagcggattaggctctgagctggagcccagctgtctgcattcaatactcagtgccacacttcatgcctgtcctgaggtgctgttgaaagacgaaacaaagcgcattttccttgacttactgaatcctatgttctccaaacaaactatcgaattcaaaaagatgtttaagtccacatccgatggactgcaaataacactgggcctcctggccctccagcactttgaattagctaactctttatgccactctctaaagtataagcaaaacaatgcatccaggctaatcctgagggtggtcttggagtag

SEQ ID NO: 46039 - DNA, 240 bp, Artificial Sequence
  Description of Artificial Sequence: Synthetic coding sequence
atgcggcagcggggccaggagcacctgcccaccagcgtgaagagcgaaccacgggcttgtaataatcctacagtggctgaaaatcgccgcgtgcctagcggtctggccgcggtaattcggaaccttaccgccctgtggaacccctctctgggggtgtctgagcgccgcgggggagactgggagcccagtcgaattccaaggctgtgggctagggtcggttggattcagcttcctgggtag

SEQ ID NO: 46040 - DNA, 459 bp, Artificial Sequence
  Description of Artificial Sequence: Synthetic coding sequence
atgggcctgagccccggccagaccagcgtgagcttcctgtggcccttactcgaagttagggaccataacaccggacggggactagtgcccgctaccgtcctgacccctggcagtccggaaactctgctggagttgcgccaggctttcctgggttctcggcaggccaggcacggccatgacgcagcccccagctctgggcagcagggctgtagcgtggacagaactgctggcaggccggttctgggatggcgtctgaggaatagcctgactggccaggaaggacgtcagcacctgcatctgagtgggatcaggacgtctcggaaagcaaaggagtacaagccagtcttttttggtgccacagaaattagcgtcctcatggctgtggccgaaagcctgcgggagcctcctccaccccagtggggctggtttttgtcaagtctgttcctaaagattttctag

SEQ ID NO: 46041 - DNA, 603 bp, Artificial Sequence
  Description of Artificial Sequence: Synthetic coding sequence
atgcccctggtggaggagcggcaccggatcctgaacgagaccggcaaaattctgctggaaaaattcggtgggtctttcttgaattgtgtgcgcgagtctgagaacagtgcgcaaaaactcatgcacctggttgtggagtctttcccctcatatcgcgacgtcactctatttgaaggtaaacgagtcagcttttacaagcgagctcaaatccttgtcgctgacacctggtccgtgcttgaaggcaaaggcgatgggtgtttcaaagacatctcgtcgataactatgttcgccgattatagactgcctcaagtactcgcgcatctgggagccttaaaatactcagacgatctgcttaagaaactgctcaaaggagaaatgcttagctacggggaccgacaggaagtggaaattagaggatgttccctgtggtgtgtcgaactcatcagggattgcctcctggagttaatcgagcagaaaggcgagaagcctaatggggagatcaacagcattcttctagactactacctgtgggactacgctcacgaccatcgagaagacatgaagggtattccattccatcggattcggtgcatatattattag

SEQ ID NO: 46042 - DNA, 183 bp, Artificial Sequence
  Description of Artificial Sequence: Synthetic coding sequence
atgcccctggtggaggagcggcaccggatcctgaacgagaccggcaaaatcctgctggagaaatttggaggatcctttctgaactgcgtgcgtgaaagcgaaaatagcgcccagaaactcatgcacctggtggtagagagcttccctagctaccgagatgtcacgctgttcgagtgtacttag

SEQ ID NO: 46043 - DNA, 1026 bp, Artificial Sequence
  Description of Artificial Sequence: Synthetic coding sequence
atggacggcctgctgaacccccgggagagcagcaagttcatcgccgagaattcccgagatgtcttcatcgacagcggaggtgtaagaagagtggccgaactcttgctcgcgaaggcggcggggccagaattgcgggtcgaagggtggaaggccctgcacgagctgaaccccagggccgccgatgaggcagcagtcaattgggtgttcgtgaccgacactctgaatttcagcttttggagtgagcaggacgagcacaaatgtgtggtgaggtaccgcggcaaaacttactctggatattggtcactctgtgccgcagtaaacagggccctcgatgagggaatccctataaccagcgcttcatattatgctacggtgactttggaccaggtccgcaacatactccgctcagacactgatgtatcaatgcccctggttgaagaacgacatcgcattctgaatgagactggcaagatcctcctggagaagtttggaggaagcttcctgaactgcgtgagagagagcgagaacagcgctcagaagctaatgcacctggtggtagaatcttttcccagctatagagatgtcacactattcgagggcaaacgagtttcattttataaacgggcacaaatcctcgttgctgatacgtggtctgtcctcgagggcaaaggcgatggctgtttcaaagacatatcttctataactatgtttgccgattatcgtctcccacaagtgcttgctcacttgggtgcgcttaagtacagcgatgacctcttgaaaaaactactcaagggagagatgctgtcgtatggtgatcgccaggaagtggagattcgaggatgcagtctgtggtgtgtggaacttatccgcgattgtcttctcgaactgatagagcagaagggcgagaagccaaatggtgagattaactccattctcctcgactattacctgtgggattatgcacacgatcatagagaggatatgaaaggtatccctttccatcgcattaggtgtatttactattag

SEQ ID NO: 46044 - DNA, 888 bp, Artificial Sequence
  Description of Artificial Sequence: Synthetic coding sequence
atgcggcacagcgtggcccggcccacccggctgccccggcggctgagccccttttgggaccctgcgacctgtaaaaacctcgaggggggggcgggagaggtcgtccgtgggcgcgacccccggaggctgcggacatctaggtcgaccgaaatcctgggcgaagatttggcaggcccctcagccggagccgccgcccggccagcagctcccccacctcaaccaagagagcctggagctcccggcctgagacgcgcccctcctagaacccggatggattcctctggactaggaccttgttcagaagctccactgcacacaagcgccggcctgtccggtaggaatttaagagctgcagggggggtcctgcccgtcgacctggagcgtgagagggccgctctttgtgctagacaaagcggccatggaccaccagcggtacgctggttattgggttcaagaggtgctgaatccggggggcttgccagaagaagagtggccgccgagcacgcacaacccagtgcgaatcttgtctgcaggtccgcactggagacatcagctttccccccatccaagcctaagtcaccacggggacgggtccgcgcccgatcatccgacggccggcttagacacccagcctggcgcgccggtagcgggggccggggcgggcgcggcccatctgctgagctagcgtcccgctactgggggcgcagaagggcgttgccgggggccgcggacctacgacctaaaggtgctcgggccgacgatcgaagaccattgagggcggggaggaagcttcatctgcccgaggccgctaggctgcccggaaacgttgggaagtccggagaacctcacaaggccggcgaagttggaaatcacccacgagattcttag

SEQ ID NO: 46045 - DNA, 810 bp, Artificial Sequence
  Description of Artificial Sequence: Synthetic coding sequence
atgggcccccggcccctggagaagggctgcttccccggctgcttcttccgaaattcaaaggaggaacgtcatgagagtagaagaccgctcagcacttctcatgagcctattttcccacttaacaccatcaaaatgaaactgaaagagaataatctaaaccggctgcctaaaggaatgcaagcaagggcccctagccagtactctaccaggcacttttttcaggaccagcctgctcagcttaacctgggtaacaattttaagatttccggaggatccaagcctccctttgtggtgagacatgtggactccgccaagccctttggagagaatatttccgagcatcacttgcgaagaagccgaagaaagtccaaattctcagactttcccttccctaccaggcgagcttctagcctcgatagtctcgccgcaaacgttaaggtgatcaaggaaccagatgaaagaatcgttctgagaagcgactcctcttcttgtttagacagttcacaatttggcaagtcctcttccagcaagcagggtgacgccgatttccacggaaaagcctccttcgccacctatcagcactcaaccagccccggcccattagaccaaccgctactgcgggagcgatttcaccctgggagccaaagcacctggaagaatatccacgaacgggtatgctccctccttaccagccaccgggcccaactacaccagaacaaagaggactctacctctgaggtgaactacatcatagagcgcccttcctacccactaaagaagtacagcctccacgagcaacgctacttctag

SEQ ID NO: 46046 - DNA, 1179 bp, Artificial Sequence
  Description of Artificial Sequence: Synthetic coding sequence
atgcccctggaggtggtggtggagctgcagatccgggccatcagctgcccgggcgtgttccttcccggcaaacaggatgtttatctgggagtgtacttgatgaatcaatacctggagaccaacagttttcctagtgcctttccaataatgattcaggagtccatgaggttcgaaaaagtatttgaaagcgcagtggatcccggcgcggtcgtggatctgttggagatgtgggatgagctcgcgtattacgaggagaacacgcgggattttttatttcctgagccaaaactgaccccaagccatccccggaggtgcagagaagtgctcatgaaaacagccctcgggttccctggtattgcacccaaaattgaattctcaactcgtaccgcgatcagagagtgcgtttttctgcaccgcaataggttccttgaggagcggcatgaaagtcggcgccctctcagtactagtcatgaaccaattttccccctgaatacaattaagatgaagttgaaagagaataacttaaaccgcctccccaaagggatgcaggcgagggccccgtcccagtactctacccggcacttcttccaggatcagcctgcccagctgaacctgggaaataacttcaaaattagtggcgggtcgaaacctccatttgtggtcagacatgtggatagcgccaaaccgtttggggaaaatatttctgagcaccatctaaggcgttccaggcgtaagtcaaaatttagcgacttcccgttcccaactagacgcgcttcttccttggatagcctcgcggctaatgttaaggtgattaaggagcctgatgaacgcatcgttctgcgaagcgattctagtagttgcctcgacagctctcaatttgggaagtctagcagctcgaagcagggtgacgctgacttccacggcaaggccagtttcgccacctatcaacacagtaccagccctgggcctttggaccagccgctgctgagagaaagattccatccggggtcgcaatcgacctggaaaaacattcacgagagagtgtgtagcctgcttacatcccacagggcccagcttcatcagaataaagaggactcaacgtcggaggtgaattacataattgaacgcccgtcctacccactgaagaagtacagtttgcatgagcagcgatatttctag

SEQ ID NO: 46047 - DNA, 408 bp, Artificial Sequence
  Description of Artificial Sequence: Synthetic coding sequence
atgacccccacccccaccgccgcctggaccccccccccccccctgcgccccagcgcggctgccgctggagcacagtgccggtcgtgccctttcaggggcgggtgcgctccgtccactgcccgcacaccccctgcttgcatgcggcccgccggaccatgcgcaccccctacatggcccgcgccatccacaaccacttctacatgcactagccgccgggccggctgtaccgcatccagtgcatcatacagtaccctcgccgcggcatgttctctgagacgctcaggcgtgcgatggccaccttccagcgcctattctacctgggcgtttgcgtcctgctgtgcgtcgtctgcttcttgcaggtgctgttgttgctgttgggccgcaggggcgtggacgtccgcatggtag

SEQ ID NO: 46048 - DNA, 870 bp, Artificial Sequence
  Description of Artificial Sequence: Synthetic coding sequence
atgcccgtggtgcggaagatcttccggcggcggcggggcgacagcgaaagtgaagaagatgagcaggactctgaggaagtccggctcaagttggaagagacacgcgaagtgcaaaatctgcgaaagcggccaaacggggtctctgccgtggcactcctcgtgggcgagaaagttcaagaagaaactactctggtggatgacccgttccagatgaagacaggaggtatggttgatatgaaaaaactgaaggagagagggaaggacaaaatatccgaggaggaggatctgcaccttggaacctccttctccgcagaaactaataggcgggacgaagacgctgatatgatgaagtatattgaaaccgagctgaagaagagaaaaggtatcgtcgaacacgaggagcaaaaggtgaagccgaagaacgccgaggattgtctgtacgaactacctgaaaatatccgggtctccagcgccaaaaaaacggaagaaatgctgagcaatcaaatgctgagtggcattcctgaggtcgacctcgggattgatgccaagatcaaaaatatcatcagcactgaggatgccaaggcacgtcttctggccgaacagcaaaacaaaaagaaggactcagagactagcttcgtcccaactaacatggccgtgaattatgtgcagcacaataggttctatcacgaagaactcaatgctcccatcaggcgtaataaagaggagcctaaggcacgcccattgagggttggcgacacggaaaagcctgaacccgagagaagtccacctaacagaaaacggcccgccaatgagaaggctaccgacgattaccactatgaaaagttcaaaaagatgaatcgcaggtattag

SEQ ID NO: 46049 - DNA, 528 bp, Artificial Sequence
  Description of Artificial Sequence: Synthetic coding sequence
atggtggacatgaagaagctgaaggagcggggcaaggacaagatctccgaagaagaagatctgcatctaggcacttcttttagcgccgagaccaaccgacgcgatgaggacgcagatatgatgaagtatatcgaaacagagctgaagaagcgtaagggtatcgtggagcatgaggaacagaaggtgaagcctaagaatgcagaagattgtctatatgaattgccagagaatattagagtgtcgtctgccaagaagacagaggaaatgctgtcaaatcagatgttgtctggcattcccgaggtcgatctgggaattgatgccaaaattaagaacataattagtacagaagacgccaaggcaaggctgctggctgagcagcagaacaagaagaaggattcagagacaagtttcgtcccaacaaacatggctgtgaattatgtacaacataatcgattctatcatgaggaactgaatgctcacaccgagaaacagcgtcgggcccaggggcccgcccttgaaagcagatag

SEQ ID NO: 46050 - DNA, 1086 bp, Artificial Sequence
  Description of Artificial Sequence: Synthetic coding sequence
atgaccggcaagaagagcagccgggagaagcggcggaagcggagctcacaggaggctgcagccgcattggcggccccagacattgttccagcccttgcctccgggtcttctggaagtactagcggctgcggctccgccggcggctgcggcagcgtgagttgctgcggcaatgcaaactttagcggctctgtgacggggggcggaagcggcggatcctgttggggaggctctagcgtggaacgcagtgagaggagaaagcgtcggagtactgactcttctagtgtaagcggatctcttcagcaagaaactaagtacattctccctaccctggaaaaggagcttttcctcgcagagcattcggatctcgaagagggtggcctggacctgaccgtgtctctgaaaccagttagtttctacatctctgacaaaaaggaaatgctacagcagtgcttttgcattatcggcgagaaaaagctgcagaagatgctcccagacgtgctcaagaactgctcaatagaggagatcaaaaaactatgtcaagagcagcttgagctgctctccgagaaaaagatactcaagatactggaaggcgacaatggcatggactcagatatggaggaggaggccgacgacggatccaaaatggggtctgatctggtctctcagcaagatatatgtattgattccgccagctcagttagggagaacaaacagcccgaggggcttgagttgaagcaagggaagggtgaggatagtgatgtactgtctataaacgctgacgcctatgattccgacatcgaaggcccatgcaacgaggaggccgcagcacctgaagcccctgaaaatacagtccaatcagaggcaggtcagatagacgatcttgagaaggatattgagaagagcgttaacgagattctcggtcttgcggagtcaagccccaatgaaccaaaagctgccacactggcggtgccccctccagaggatgtgcaacctagcgctcaacagctggaattgcttgaattggagatgcgcgcacgagcaattaaggcactgatgaaagcaggagacattaaaaagcccgcgtag

SEQ ID NO: 46051 - DNA, 651 bp, Artificial Sequence
  Description of Artificial Sequence: Synthetic coding sequence
atgctgcagcagtgcttctgcatcatcggcgagaagaagctgcagaagatgctgccagacgtgcttaaaaattgctccatcgaagaaataaaaaagctgtgtcaggaacagctggaactcttgtcagagaaaaagattctgaagattctggagggagacaacggtatggattccgatatggaagaggaggcagacgacgggtccaagatgggctccgatctggtcagccagcaggacatttgcattgatagtgccagtagcgtacgggaaaacaagcagcctgagggtctcgaactgaaacaaggaaagggggaggatagtgacgtcctttccataaacgcggacgcttatgattccgatatagaaggcccatgcaacgaggaagctgccgctcccgaggctcccgaaaacactgtacagagcgaggcaggccagattgatgatttggaaaaggatattgagaagtcagttaacgagattcttggactggctgagtcatcccctaatgagccgaaggcagccacactcgcagtgccgccacctgaagacgtgcagccatccgcccagcagctcgaactcttggagttagagatgcgggcccgggcaataaaagccctgatgaaggcgggtgacattaagaagccggcatag

SEQ ID NO: 46052 - DNA, 4335 bp, Artificial Sequence
  Description of Artificial Sequence: Synthetic coding sequence
atgaccgacaccagcgtgctggaccagtggaaggccagcttcttcgtcgaggacttcctggaaaaaaaaacaattactaggatggtgacgcagattaactgcgaattcgaagaggttgtacctagctccaacccagattctcagatcgaggtggaagaagtctcgctctacacccatatggactacaacgaggtgttcacccccgtgtcctgcttggaaaaatgctctgcactgcaaaaccagaaccaagacttgttcatcgatgacaagggaattttgtttgtctcatcccgcaaacacctacccaccctcccaacgcttctgtcccggttaaaactctttctggtgaaggacccgctcttagacttcaaaggccagattttcacagaggcaaatttctcccgggaatgcttttccctgcaggagacactggaagcgtttgtgaaggaggacttctgcatggataaggtgaatttttgccaagagaagctggaggatactatctgtctgaacgaaccgagtagctttctgattgaatatgaattcctgatacccccgtccctcaagcctgagattgatatcccaagtttgtcggaactaaaagaactcctgaatcctgtccccgaaatcatcaattatgttgacgagaaagaaaagctgttcgaacgtgacctgacgaacaagcacgggattgaagatataggggatatcaaattctcctcaaccgagattcttacaatccagtcacagagcgagccagaagagtgttccaagcccggagaactggagatgccattgaccccactcttcctaacttgtcagcactctagcgtgaattccctccgcacagaactacagacctttcccctatccccagtatgcaaaatcaatttgcttacagccgaggagtctgccaacgaatactatatgatgtggcagctcgagcgttgtaggagtccactgaaccccttcctcttaaccgtcccacgcatccaggaaccgcactctcagtatagcgtcactgacctcaaaaagatattcagcgttaaggaggaatccttagtgattaacctagaaaaggctgagtggtggaagcaggcaggccttaacttaaaaatgatggaaactcttgagcacctcaatacatacctgtgccatgacaatctcagttccaatgataccaaaatcgaaatttttctccccactaaggtgctgcagcttgagtcttgtctggaacataagtctcattctagccctattgccttaattgatgagaaaagcacgaatgcacatcttagtctgccacagaagtcccctagccttgctaaggaagtgcctgacttgtgtttttcagacgattatttctctgacaagggggcagcaaaggaggaaaaacccaaaaacgaccaggaacctgtaaatagaatcatccagaagaaagaaaataacgaccacttcgagctggactgtactggtccttcaataaagtctcctagcagctcaataatcaaaaaggcatctttcgagcacgggaaaaaacaggaaaacgaccttgatctcctgagcgatttcataatgctcagaaataagtataaaacgtgcactagcaaaacagaggtcacaaattctgacgagaaacacgacaaggaggcttgcagtctgaccctgcaggaggagtccccaatcgtacacattaataaaacactggaagaaatcaatcaagaacggggcacagatagcgttatagagattcaggcctccgacagccagtgtcaagctttttgcctgctggaagccgccgcatctccaatactgaagaacttagtgtctctctgtaccctacctactgcaaactggaagttcgccacggtgatctttgatcagacccgtttccttctcaaggagcaagaaaaagttgtttctgacgccgtgaggcaggggaccattgatgaacgagagatgacctttaaacatgccgctctgttacacctcctcgtgaccattcgcgatgtgctattaacttgctctctcgacactgccctcggctacctcagtaaggctaaggatatctataatagcatcttgggcccatacttgggtgacatttggagacagcttgagatagtccaattcattaggggcaagaagcctgagaccaattataaaatccaggagctgcagtgccagatcctgagttggatgcagtcgcagcaacaaattaaggttctgattatcatcagaatggattcggacggtgagaaacactttctaattaagattttgaataagatcgagggcctgactttaactgtactgcactcaaatgaacgaaaggatttcctagagtctgagggagttctcagagggacaagttcctgcgtggtggtacataatcaatacattggggctgatttcccttggagcaacttttccttcgttgtggagtataactacgtggaagacagctgttggaccaagcactgtaaggagctgaatatcccctacatggccttcaaagtgatcctgccagatacagttctggagcgcagtacgttgctggatcgatttggtggcttcctgctggaaatccaaataccttatgtcttcttcgcttccgaggggttgttgaacaccccagatatcctgcagcttctagagtctaactataacatctcgcttgtggaaagaggctgttctgagtctctcaaactatttggttccagtgagtgttacgtagtggtcaccattgacgagcacactgcgatcattctgcaagatttagaagaactgaattacgaaaaagccagtgataatatcatcatgcgactgatggctctctctctccaatacaggtattgttggataatcctctataccaaagaaactttgaattcagaatacctgctgaccgaaaagacgctccaccacctagccctgatctatgcagcacttgtgtctttcgggctgaatagtgaggagctggatgtcaaactgatcattgcccccggcgtggaggcaactgctctaattattaggcagattgccgaccattcactgatgacctcaaagcgtgatccccacgaatggctggacaaaagctggctgaaggtctctcctagcgaagaagagatgtatctccttgacttcccttgcattaacccactagtagcccagctgatgctgaataaagggcccagcctacattggatactgctcgctacgctttgccagctccaggaactcctaccagaggtgccagagaaagtgctgaaacacttctgttccattacatcattgtttaagatcggctcttcgagtattacgaaaagcccacaaataagcagtccgcaagagaacaggaatcagatctccaccctgagctcacaatcctctgcgagcgatctggatagcgtcatccaggaacataacgagtattatcagtatctggggctgggcgaaaccgtgcaggaggataagaccactatacttaatgataactcgagcataatggaacttaaggagatcagtagcttcctcccacctgtgacatcgtacaatcagactagctactggaaggactctagctgcaagagtaacatcggacaaaatacgcctttcctcatcaatatagagtcccgacgcccagcctataactctttcctcaatcactccgactctgagtcagatgtgttctccctggggctgactcagatgaattgcgaaaccattaaaagccccactgacacccagaagagggtcagtgtcgtgccccggtttatcaattcacaaaagcgccgcacccacgaagccaaaggctttatcaacaaagatgtttccgaccccatcttctcactcgaaggcacgcagtcaccactccattggaactttaaaaaaaacatctgggagcaggagaaccaccccttcaatttgcagtacggcgcccagcagactgcttgcaataagctctacagtcaaaaaggcaacttgtttacagaccagcagaagtgtctgtctgatgaatccgaaggattaacatgtgaaagcagtaaggacgaaaccttttggcgcgagttacccagtgtcccttctcttgacctctttagggcctcagactctaatgccaaccagaaagaattcaactcactgtatttctatcaacgcgccggcaaaagtctagggcaaaagcgccatcacgagagtagtttcaatagcggcgacaaagaatctctcacaggctttatgtgcagccagctgccacaattcaagaagcggcgcctcgcgtacgaaaaggtccccggacgtgtggatggtcagactcgcttgcggttcttttag

SEQ ID NO: 46053 - DNA, 1467 bp, Artificial Sequence
  Description of Artificial Sequence: Synthetic coding sequence
atgttcagcgccctgaagtaccacgccatcgactacctgtacgagaacgtggtcagaaaaaaattctaccgcgacgcccttttacttcgtatcccttcttgtttgtaccaagatgagtcttaccacgtcgccgtcactgacaacaaatttaggcgaccttggacccgagtaagtgccgtgagcgtgccgggcatgacagatacaagcgttctcgaccagtggaaggcttcttttttcgtggaggactttcttgagaaaaagaccattacccggatggtgacccagattaactgcgaatttgaggaggttgtgcctagcagtaacccagactctcaaatagaagtggaagaagtctcactgtatactcacatggactataatgaggtctttacgcccgtatcatgtctcgaaaaatgcagcgcccttcagaatcagaatcaagatctgttcatcgatgataagggcattctttttgtctcaagcagaaaacacctcccaacactgccaacactcctctctcggctgaaactctttcttgtgaaagaccccctcttggattttaagggacagatctttactgaagcgaatttttcccgtgaatgttttagtctgcaggagacccttgaggctttcgtgaaggaagacttctgtatggataaagtgaatttctgccaggagaagctcgaggacaccatctgcttgaacgaaccatccagcttcctgattgagtatgaattcctcataccaccatcactgaagcccgaaatcgacattccgtccctttccgagctcaaggaattacttaatcctgtgcccgagataataaactacgtcgatgagaaggagaaactctttgaacgagatctcactaacaaacatggtattgaggatatcggtgacattaaattctcctccaccgagattctgactatccagtcacagtcagaacctgaagagtgctcaaagccaggtgaactcgaaatgcccctcactccactgttcctgacatgccaacatagctccgtcaactccctgcggactgaactccagacctttccattgtcccctgtttgtaaaattaacttactgacagccgaggaatccgcaaacgagtattacatgatgtggcagctggagcggtgtcggagtccgctgaacccctttctcttgactgtgccgcggatccaagagccacactcgcagtacagcgtcacggatctcaagaagattttcagcgtgaaggaagagagcttagtgataaacttggaaaaggctgagtggtggaaacaagcaggattaaacctgaaaatgatggagactctggaacacttgaacacttatctttgtcacgacaacttgtcttctaacgatacaaagattgagatcttcttgcctaccaaagtactccagctggaatgcaaatatataacagttaatattagctatgtgaatatatttcgaatgtag

SEQ ID NO: 46054 - DNA, 4335 bp, Artificial Sequence
  Description of Artificial Sequence: Synthetic coding sequence
atgaccgacaccagcgtgctggaccagtggaaggccagcttcttcgtggaggattttttggagaagaagaccatcacacgaatggtgacacaaatcaattgcgaattcgaagaggtagtgccctctagcaaccccgactcccaaattgaggtcgaagaggtgagtctgtatacacatatggattataacgaggttttcacccctgtctcctgtctcgagaagtgctccgcgctgcaaaatcagaaccaggacctatttattgatgacaaggggatccttttcgtgtcatcacggaaacacttgcccactctgccaactctgctcagccggctgaaactctttctggtgaaagaccccctcctggacttcaaaggccagatattcaccgaagcaaactttagtcgcgagtgttttagtttgcaggaaacacttgaagctttcgtgaaggaagatttctgtatggacaaagtaaacttctgccaggaaaaattggaggacactatttgcctcaatgagccttcatcgtttctgatcgaatacgaatttctgatacctccttcgctgaagcccgagattgacattccctccctctccgaactgaaagagcttctcaacccagtgccagaaattattaactatgtggacgagaaggaaaagctgttcgaacgtgatctgactaataagcatggcatcgaggatatcggagacattaaatttagttcaaccgagatccttactatccaatcccagagcgaaccagaggagtgcagcaagcccggcgaactcgaaatgcccttaactcccctgttcctgacatgccaacattcgagcgtgaatagcctcagaacagagctacagaccttcccactgagtcctgtgtgcaaaatcaacctccttacagcggaggagtcagccaacgagtattatatgatgtggcagctagaaagatgcagatctccacttaatcccttcttactgaccgtccctcgcatccaggagccacacagtcagtacagtgtcacagacctcaagaagatcttctccgtaaaggaggaaagtctggtcattaacctcgaaaaggccgaatggtggaagcaagcggggctcaacctgaagatgatggagacattggagcatcttaacacctatctctgccatgacaatttgtctagcaatgatacaaaaattgaaatctttctcccaactaaggtcttacaactggagtcctgcctcgaacacaagagtcactcctctccaatcgcactcatagacgagaaatccaccaatgctcacctatcacttccccaaaagagcccgtcgttggctaaggaggtgccggacttgtgtttctctgacgattatttcagtgacaaaggggccgctaaagaagagaagcctaagaacgaccaagaacccgtgaataggatcattcagaagaaggaaaacaacgatcactttgaactggactgcacaggccctagcatcaaatcacccagttcatccatcattaagaaagcctcatttgaacacgggaagaagcaggagaacgacctggatctgcttagtgactttataatgcttagaaacaagtacaaaacttgcacttcgaagaccgaggttacgaattcggacgaaaagcatgataaagaggcttgcagcttgactctgcaggaggaatctccaatcgtccacatcaataagactttagaggagatcaatcaggagcgagggacagattcggttattgagatccaggctagcgacagccagtgccaggctttctgtctcctggaggccgccgcctcccccatcctgaagaacctggtgtccttgtgtacgctgcccaccgctaattggaaatttgccacagtgatctttgatcagacacgcttcctgctgaaggaacaggagaaggtggtctccgacgcagtccggcaggggacaatagacgagagagagatgacattcaaacacgcggcactgctgcatctgctggtcacgatccgcgacgttctgctgacctgcagtttagacacggctctcgggtatctaagcaaggcaaaagacatctataactctatcctcgggccgtatttaggagacatctggaggcagctggagattgtgcagttcattcggggcaaaaaaccagagactaattacaagatccaggagcttcaatgccagatcttgagttggatgcagagtcaacagcagattaaggtgctcatcatcatccgcatggatagtgacggagagaagcactttctgatcaagattctcaacaaaattgaaggcctaactcttaccgtcctgcactccaacgagagaaaggacttcctagaatctgagggcgtgttaaggggcacctccagctgcgtcgtggttcacaaccagtatataggcgccgacttcccatggtctaacttttccttcgtcgtggaatataattacgtggaagatagctgctggacaaagcactgcaaggagctgaacataccctacatggcatttaaggtgatattacccgatactgttctagaacgctccacactgttagatagattcggtggcttcctcctggagatccagattccctacgttttttttgcaagcgagggtcttctcaacacaccggacattttgcagctgctagaatccaattacaatatctctctggtcgaacgaggatgttcagaatcgctaaaactgtttggcagctccgagtgctatgttgtcgttactatcgacgaacatacagcaatcatcttgcaggatctcgaggaactgaattatgaaaaagctagcgacaatatcatcatgaggctgatggctctctctctacagtacaggtattgctggatcattctctatactaaagaaacccttaacagtgagtacctactgactgagaaaactctccatcacttagccctgatctatgccgctctggtgtcattcggcttaaattctgaggaactcgacgtgaaattaatcattgcacctggcgtggaggccacagccctaattattcgccagatcgccgaccactcccttatgaccagtaagagagaccctcacgaatggctggataagtcttggttaaaggtgtccccttctgaagaggagatgtatctgctcgacttcccgtgtataaatccgttggtagcccagctgatgctgaataagggcccctctcttcattggattttactagccactctttgtcaactccaggagctgctacctgaagttcccgaaaaagtgcttaagcacttttgctctatcactagtctttttaagataggtagcagcagtattacaaagtcaccccaaatcagctccccccaggaaaaccgcaaccagatttctaccctatcctctcagtcctcagcttcggacctcgattcggtaatacaggaacacaacgaatattaccagtatctgggcctaggagagaccgtgcaggaggacaagactaccattctgaacgacaattcatctataatggagctgaaggagatcagctcttttttgccaccagtgacatcttacaatcaaaccagttattggaaagactccagttgtaaatcaaatatcggtcagaacaccccctttctcataaatattgaaagtcgccgcccagcgtataacagctttctgaatcactcagactcggaatccgacgtgttttctctgggcctgactcaaatgaactgtgagactatcaagtcgcctaccgacacacagaaacgagtctcagttgtaccccgatttatcaactcccagaagcgaagaacgcatgaagcaaaaggtttcatcaataaggacgtaagcgatccaatcttctcactggaggggactcagtctccgcttcattggaactttaaaaaaaacatctgggaacaggagaatcacccctttaatctgcagtacggtgcccagcagaccgcctgtaacaaactgtactcccaaaaggggaacctgttcacggatcagcagaaatgtctgtctgacgaaagcgaaggcttgacctgcgaatcttccaaggacgagaccttttggagagaactgccgagcgtaccttctctggacctcttccgagcatccgattcaaacgccaaccaaaaggagttcaactccctctacttctatcagcgggccggaaagtcactggggcagaagcgacaccacgagtcttcttttaatagcggggataaagaatcacttacaggatttatgtgtagccagcttccccagtttaagaaacggcggctggcttacgaaaaagtgccaggccgcgtggatggacagacgcgcctacgctttttttag

SEQ ID NO: 46055 - DNA, 3177 bp, Artificial Sequence
  Description of Artificial Sequence: Synthetic coding sequence
atgatcatctgcctgctgatgaccctgaagctgcggtacctgcccaccaaagtgctgcagttagagtcctgcctggagcacaaatctcacagtagccctattgccctaatagatgaaaagtcaacaaacgctcacctcagtctacctcagaagtctcccagtttagcaaaagaggtacctgatctttgcttctctgacgattacttctcagataagggcgcagcgaaggaggaaaaacctaagaatgaccaagaaccagtgaataggatcatccagaagaaggagaacaacgaccactttgaacttgactgcacaggacctagcataaagtctccctccagctctattattaagaaggctagttttgagcacggaaaaaagcaagaaaacgacctggacctgctgagtgacttcattatgttgagaaacaagtacaaaacatgtacgtcgaagacggaagtgacgaactccgacgaaaagcacgacaaagaagcatgctctctaacactccaggaggaaagtcccattgtgcacataaacaagaccttggaggaaattaatcaggagcgcggaacggactctgtcattgagatccaggctagcgattcccagtgtcaagccttctgcctgctggaggcagccgcttcccccattctgaaaaatctcgtttctctctgtacccttccaacagccaactggaaatttgccaccgtgattttcgatcagacccgctttctgctcaaagagcaagaaaaggtggtgagtgatgccgttcggcagggaaccatcgacgagagggaaatgacgttcaaacacgccgctctgctgcacctcctcgtgacaatccgtgatgtgctgttgacatgcagtctggacacggctctcgggtacctgtccaaggcaaaagacatctataacagcattctcggcccataccttggggacatctggaggcagctggagatagtgcaattcattcggggaaaaaaacccgagacgaactacaaaatccaggagctccagtgccaaatcctcagctggatgcagtcccaacagcagatcaaggtgctcataatcattcggatggatagcgatggcgagaaacatttcttaatcaaaattcttaacaaaatcgagggcctgacacttaccgttctgcatagcaatgaacggaaagacttcctcgagagcgaaggggtcctgcgtgggacttcttcttgtgtcgtggttcataatcagtatatcggagcagactttccgtggagtaactttagcttcgttgtcgagtacaactacgtggaggattcctgttggactaagcattgtaaggaattgaatataccttatatggcctttaaggtcattcttcctgataccgtcttagaacggagcacgctcctggatcgcttcggcggttttctcctagaaattcagatcccttacgtcttttttgcgagcgaagggctactgaacaccccagacatcctacagctgttagaaagtaattacaacatttctctggtcgagcgcggctgttcagagtctctcaagttgttcgggagttctgagtgctacgtcgtagtgacaatagatgagcatactgctattattctccaggacctggaggagttgaattatgaaaaggcatccgataacatcattatgcgacttatggcactttctctccagtaccgctattgttggataatcctctatacgaaagagaccttaaattcggaatatttacttactgagaagaccctgcatcacctggccctgatctatgctgcactggtgtctttcggattaaacagcgaggagctggatgtgaagctgattatagcaccaggtgtcgaggcaacagcgttgattattcgccaaatagctgatcacagtctcatgacttcaaaaagggatccccacgaatggctcgacaaatcttggcttaaagtgagtccaagcgaggaggagatgtacctacttgactttccctgcattaatcctttggtggctcaattaatgctgaacaagggtccctcgctgcactggatccttttggctaccttgtgtcaacttcaggagctcttgcccgaggtaccagaaaaggtcttgaaacacttctgtagcattacatcactgttcaaaatcggctctagttcaatcaccaaatcaccacaaatttccagcccccaggagaatcgaaaccagattagcaccttgtcgagccaatcaagtgcaagtgacctggactctgttatccaggagcataacgagtattatcaatacttgggcctcggcgaaacagtgcaggaggataagaccactatcctcaatgacaactcctctattatggaacttaaagagatatcatctttcctgcctccggtaacatcttacaatcaaactagctactggaaagatagcagttgcaagtctaacatcgggcaaaatactcctttcttgatcaatatcgagtcaaggagacccgcatataatagctttctgaaccattccgactcagaatcagacgtcttttcactggggctcacccagatgaactgtgagacgatcaaatctccaactgatacccaaaaacgggtgagtgtagtgccacggttcattaactcccagaagaggagaacccatgaggcaaaaggtttcatcaacaaggatgtaagtgaccccatattcagtcttgagggcacacagtcccccctgcactggaatttcaagaagaatatttgggagcaagaaaatcacccgttcaacctacagtatggcgcccagcagacggcatgcaataagttatattcccagaaaggtaatttatttaccgatcagcagaaatgcctttccgatgagagcgagggattaacatgcgaatccagcaaagatgaaactttttggcgtgaactgccctccgtgccaagtctcgacttattccgagcctcggactcaaatgcaaaccagaaggaatttaattccctctacttctaccagagagccggtaagagcctggggcaaaagaggcaccatgagtccagttttaactccggtgacaaagagtcactgaccgggttcatgtgctcacagctaccccagttcaagaagaggcggctggcatatgaaaaggtgccggggcgggtcgacggccagacgagactgcggtttttctag

SEQ ID NO: 46056 - DNA, 4218 bp, Artificial Sequence
  Description of Artificial Sequence: Synthetic coding sequence
atgagcgagaccctgggcgacgagctggagatcctgcggggcaagatgatgcagaggcgaccaaggtcagctgaagttaagtatttctatttctttaaaatcttacttcggctgaggctggctatactcaaatatctcttcatcgacgataaaggaattctgtttgtgtcctcacgaaagcacctccccacgctgccaacactgctcagcagacttaaactctttcttgtgaaagatcctcttctcgattttaaaggtcagatattcaccgaagcaaacttttcccgggagtgtttttctctgcaggaaaccctcgaggcttttgtgaaggaagatttctgcatggataaagtgaatttttgtcaggagaaacttgaggatacaatctgtctgaatgagccatcatctttcctgattgagtatgaatttctgattccgccttctctgaaacctgagattgatataccgtctctatccgagttgaaagagcttcttaatcccgtgcccgagattatcaactacgttgatgagaaggaaaagctgttcgagagggatctcaccaataagcatggaattgaagatatcggcgacatcaagttttcttctacggagattctgacgatacagtcccagtcagagcccgaggagtgttcaaaacctggagaattggagatgcctctcaccccactttttcttacctgccaacactcgagcgtcaatagcttgcgcaccgagctgcaaacatttcctctgagtccggtgtgtaaaatcaacctcctcaccgcagaggagtcagctaatgagtattatatgatgtggcagctggagcgatgccgcagccctctcaatcctttcttgctcaccgtcccgaggatccaggagccgcactcccaatatagtgttaccgacctgaaaaaaatatttagtgtgaaggaggagtctcttgtgatcaaccttgagaaggccgaatggtggaaacaggctgggctgaatttaaaaatgatggagacgctggagcatcttaacacatacttgtgtcatgacaacctcagtagtaacgacactaagatagaaatttttctgcccactaaggttctgcagctagagagctgtcttgagcacaaaagccattcttcgcctatcgctctaatagacgagaagtccacgaatgcccacttgagcctgcctcagaaatctccttctctggcaaaggaggtcccggacctgtgcttctccgatgactactttagtgacaaaggagcagctaaggaagagaaacccaaaaatgaccaagagcccgtgaacagaatcattcagaagaaagagaataatgatcactttgagctcgactgtactggaccctcaattaagagcccctcatcttcaataatcaagaaagcttcctttgagcatggtaaaaagcaggagaacgacttggatctcctttccgacttcatcatgctccggaataagtacaaaacctgcacttctaagaccgaggtaacaaactcagacgagaagcacgacaaggaggcctgctcgctcacactgcaggaggagagtcccatagtgcacatcaacaagaccctagaagagatcaatcaggaacgcggaaccgattcagtaatagagatccaggcatctgatagtcaatgtcaggccttttgtctgttagaagctgccgcgtctcccatcctgaagaatctggtttcactgtgcacactcccaacagctaactggaagttcgcaactgtcatttttgaccaaactagattcctgctcaaagaacaggagaaagtcgtaagcgatgctgtccggcagggaaccatcgacgaacgagagatgacgtttaaacatgccgcattgttacaccttctagtgacaatccgagacgtgctcctgacatgttcactcgacacagccctcggatatctgtcaaaagcaaaagatatttataatagtatcctgggcccttacctgggcgacatatggaggcagcttgagattgtgcagttcattcgtggaaagaaaccagagactaattacaaaatccaggagctacagtgccagattctaagttggatgcaatcccagcagcaaatcaaagtgctcattattatcaggatggacagtgatggggagaagcactttctgatcaagatccttaacaaaattgagggcctcactctgaccgtcctacactccaatgaaagaaaggattttcttgagagtgaaggggtgctccggggcacttctagctgtgtcgtggtgcacaaccaatatatcggagcagattttccatggtcgaatttctcttttgtagtcgagtataattatgtggaagactcctgctggactaagcactgtaaggaactgaatataccgtatatggctttcaaagtgattctcccggatactgtgctagaacgaagcactctgctagataggtttggcgggttcttgctggagatccagatcccctatgtatttttcgccagtgagggactcctgaataccccagacatcttgcagcttttggaaagcaactacaacatttccttggtcgagagagggtgtagcgaatcgctgaagctatttggatcaagtgagtgctacgtagttgtaactattgacgagcatacagcaatcattctgcaagatcttgaggagctcaactacgagaaggccagcgacaacattattatgcggctaatggcattaagcctccagtacaggtactgctggattattctttacaccaaggagacactgaactccgagtatctgctgaccgaaaaaactctgcatcacttggctttaatttacgccgccctcgtgtcttttgggctgaactctgaagagctggatgtgaagctcatcattgcccctggggtcgaagctaccgctctgattattcgccagattgcggaccatagtcttatgaccagtaaacgcgatccccacgaatggctggacaagagttggcttaaagttagcccatcggaggaagaaatgtatttgctcgactttccctgtatcaaccccctcgtggcacagctgatgctgaacaaagggccaagcctgcattggatactgctggccaccttatgccagctgcaagaactactgcccgaggtccctgagaaggtgctgaaacacttttgtagtattacatccctatttaaaatcggctcaagttctatcacaaaatctcctcagataagctcaccccaggaaaatcgaaatcagatcagcacactgtcctcgcagagtagcgcaagtgacttagattccgttattcaagaacataatgagtattaccagtacctgggactgggcgagacggtccaggaggacaagacaacgattttgaacgataactcaagcatcatggagcttaaagagatatcctcttttttgccacctgttacaagttataaccagacatcatactggaaggacagcagctgcaagagtaacatcggccaaaacactccattcttgattaacatcgagtcccggagacctgcctataactccttcctgaaccatagtgattcagagagcgatgtctttagtctgggcctgacccagatgaattgcgagactatcaaatccccaaccgatacccagaagagggtgagtgtggtgcccagattcatcaattcacagaaacggcgcacgcacgaagccaaaggcttcatcaacaaagatgtctctgaccccatcttctcactggaggggacacaatcacccctgcactggaattttaagaaaaacatctgggaacaggaaaatcaccctttcaacctgcaatatggcgcgcaacagaccgcctgtaacaaactgtattctcaaaaaggcaatcttttcacagatcagcaaaaatgcttgtcagacgagtccgagggcttgacttgcgaatcctcaaaagacgaaaccttctggcgggagcttccttcggtgccttcactggatctgtttagggcatctgattcgaacgccaaccagaaggagtttaattctctgtatttttaccaaagggcgggcaagtcattgggccagaagcgacatcacgagagttcattcaactccggggataaagagagcttgacgggtttcatgtgtagccaattacctcagtttaagaagcgtagactggcctatgagaaggtgccaggccgtgtcgacggacagacacgtctgcggttcttctag

SEQ ID NO: 46057 - DNA, 474 bp, Artificial Sequence
  Description of Artificial Sequence: Synthetic coding sequence
atgagcagccagaagggcaacgtggcccggagccggccccagaagcaccaaaatacgttctcattcaagaatgacaaattcgacaagagtgtgcagaccaagaagatcaatgccaagcttcacgacggtgtctgccagcgttgtaaagaagtcctggagtggcgagttaagtattctaagtacaaacctctgtcgaagccaaagaaatgcgtgaaatgtttacagaaaactgtgaaagacagttaccatattatgtgccgtccgtgtgcctgcgaactggaggtgtgcgcaaagtgcgggaaaaaggaagacattgtgatccccctgaacaaagaaacagaaaaaatagagcatacagagaacaatttgtcaagcaatcaccgcagatcttgccgtcgtaacgaagagagtgacgacgatctggactttgacattgatctggaggacaccgggggagaccatcagatgaattag

SEQ ID NO: 46058 - DNA, 108 bp, Artificial Sequence
  Description of Artificial Sequence: Synthetic coding sequence
atgagcagccagaagggcaacgtggcccggagccggccccagaagcaccagaatacgtttagtttcaagaacgacaagttcgacaaaagcgtgcagactaagtgctag

SEQ ID NO: 46059 - DNA, 540 bp, Artificial Sequence
  Description of Artificial Sequence: Synthetic coding sequence
atgagcagccagaagggcaacgtggcccggagccggccccagaagcatcaaaatacattctccttcaagaatgacaaatttgataagtctgtgcagaccaaaaagattaacgctaagctgcacgacggggtctgccaacggtgtaaagaggttcttgagtggcgcgtaaagtacagtaaatacaagccactgagtaaacctaagaaatgtgtgaagtgcctccaaaaaactgttaaggactcctaccatataatgtgcaggccatgcgcttgcgaacttgaagtgtgtgccaaatgtggtaaaaaagaggatatcgttatcccttggtccctccctctactgccgagactggaatgttctggcaggattctagcgcaccacaatctgcggctgccttgcagcagtgatagccccgcctctgcttcacgagttgctggcaccactggcgcccatcatcacgcacaactgatattcgtgtttttggtcgagatgggtttccactatgtgggccaagcaggtcttgaacttctcacgtcatag

SEQ ID NO: 46060 - DNA, 507 bp, Artificial Sequence
  Description of Artificial Sequence: Synthetic coding sequence
atgaacgaggtgaaggagagcctgcggagcatcgagcagaagtacaagcttttccagcaacagcagctaaccttcaccgccgctctagagcactgccgagaaaatgctcatgataagatacggcccatttctagcatagggcaggttcagagctatatggaacactactgcaattcttccactgatcgaagggtgcttctcatgttccttgacatatgctctgagctcaataagttgtgccaacattttgaagccgttcattccgggacacctgtaacaaataacctgctggagaaatgtaaaactctggtcagtcagtcaaacgatctgagctccctgagagcgaaatacccccacgacgtagttaaccatctaagctgtgacgaagctagaaaccattatggaggtgtggtctctttgatccccttgatcctcgatctgatgaaagaatggatagctcattcagagaagttaccccggaaggtgctgcagcacgggaccacatag

SEQ ID NO: 46061 - DNA, 669 bp, Artificial Sequence
  Description of Artificial Sequence: Synthetic coding sequence
atgaacgaggtgaaggagagcctgcggagcatcgagcagaagtacaagctcttccagcagcaacagttgactttcacagccgctctggagcattgccgtgagaatgctcatgataagatcagacctatcagttcgattggacaggtccagtcatacatggagcattattgtaattccagcaccgacaggcgcgtgttactgatgttcctggatatttgcagcgagctcaacaagctgtgtcagcactttgaagcagtgcactccggcaccccagttaccaacaatctgctggaaaagtgtaaaacactagtgtcccagagcaacgacctgtcttctctgcgcgccaaatacccacacgatgtcgtcaatcacctgagctgtgatgaagcccgcaaccattacggaggagtggtgtcccttattccgctaatactcgatctcatgaaagagtggatagctcactctgagaagcttccccggaaagttctgcagcatgtctccgaaccccaggcacaccaggagagtacaagaggcgccgcgagaccggcacaagccatcggtactcagcctagggccacaaagcacaagtgccggcaactcacaaaggcaagtctgaagccgaggggctgctcaaaacccccttggagaccgcctggcggtaaactttag

SEQ ID NO: 46062 - DNA, 669 bp, Artificial Sequence
  Description of Artificial Sequence: Synthetic coding sequence
atgaacgaggtgaaggagagcctgcggagcatcgagcagaagtacaagctcttccagcagcagcaactgactttcaccgccgctctcgagcattgtcgagagaacgcccacgacaaaatcagaccaataagcagtattggacaggtgcaatcttatatggagcattattgcaattcctcaactgacagaagggtattgctgatgtttctcgatatttgcagcgagctcaacaaactgtgccaacacttcgaggctgtccactccggtacaccggtaactaacaacctcctggaaaagtgcaaaacacttgtctcccagtccaacgacttgtcctcactcagggccaaatatccccacgatgttgttaaccatctgtcctgtgacgaggcccgcaatcactacgggggcgtggtgtctttaatcccgctaattttggacctaatgaaagaatggattgcccatagcgaaaaactcccccgaaaagtgctgcaacacgtgtctgaacctcaggcacatcaggaatctacacgaggggccgctaggcccgcgcaagcgataggaacacaacctagggccacaaaacataagtgtagacagcttaccaaagcatcactgaaacccaggggttgttcaaaacccccctggagacccccaggcggaaagctttag

SEQ ID NO: 46063 - DNA, 234 bp, Artificial Sequence
  Description of Artificial Sequence: Synthetic coding sequence
atggcccggttccagcggaccaaggagcgggaggaggaccggtgctcgcttaatatctactacgtcaggaatacgactcaaggtacagcacccgcttgtgtgggaaagcgcatgcagccctcccctacaggcaaaggaggtaagtgctgcacagtgcatgggcttacccgcaagatccacaacgtgcagccgaatctgcagagtcccatcttgtctgcggcctgtgtggattag

SEQ ID NO: 46064 - DNA, 327 bp, Artificial Sequence
  Description of Artificial Sequence: Synthetic coding sequence
atggagctgaacaccaacatcaagagcaagaagggcctgggccggagaaatctgaaaccaatgaacggagcttggcccccagcaaggagagagatggcgaggttccagcgcacgaaagagagagaggaagatcgatgttccctcaatatttactacgttaggaatacgacccagggaaccgctcctgcctgtgttggtaagcgaatgcagcccagtccaacaggtaaaggtggtaagtgctgtactgttcatggactgactcggaaaatccataatgtgcaacctaatcttcaaagcccaatcttgtccgctgcgtgcgtggactag

SEQ ID NO: 46065 - DNA, 234 bp, Artificial Sequence
  Description of Artificial Sequence: Synthetic coding sequence
atggcccggttccagcggaccaaggagcgggaggaggaccggtgctcactcaatatttactatgtacgtaataccacccagggcaccgcgcctgcttgtgttgggaagcgaatgcaaccttcccccaccggcaagggaggcaaatgctgcacagtgcacggtctgaccaggaagattcataacgttcaaccgaacctgcaatcacctatcctaagtgccgcctgtgttgattag

SEQ ID NO: 46066 - DNA, 225 bp, Artificial Sequence
  Description of Artificial Sequence: Synthetic coding sequence
tgaaacggcgcctggccccccgcccggcgggagatggcccggttccaaagaacaaaagagagggaggaagataggtgcagtctcaacatctattacgtgaggaatactactcagggcaccgcaccagcatgctcccagggaaggtacattatgtattccaggatttacagcctattgttttgccagctgcttgtgctaattaagacttctatcaaaatcctgtag

SEQ ID NO: 46067 - DNA, 3690 bp, Artificial Sequence
  Description of Artificial Sequence: Synthetic coding sequence
atgaacctgaacaccagcagcaacaccggcgacacccagcggctgaagatcgctagcctggacgtgaagcagattcttaagaatgaaacagagctcgacatcacggataacctgcggaagaaactgcactgggcaaagaaagagaaacttgagattaccacgaagcacaatgcagagttagcctcctacgagagccaaattgccaagctcaggtcagaggtagaaaaaggggaagccctccgacagtctctggagtacgatctggctgtggccaggaaagaagccggccttggaaggagggctgctgaggagaggttggctgaagcacaccgcattcaagaaaagctgtgtgcccaaaactcggagctgcaagccaaaacaaacgagacggagaaggctttccagacaagccagcaaaaatggaaggaggaatgccgtaggttcgaacatgaccttgaggaacgggataacatgatccagaactgtaaccgcgagtatgacttgctcatgaaggagaaatctagattggagaaaactttacaggaggctctggaaaaacaccagcgggagaagaacgaaatggagagccatatcagggagacagcccttgaggagttccgattgcaggaggagcagtgggaggcagaaagacgggagctacagttcattgtgcaggagcaagacaccgctgtgcagaacatgcacaaaaaagtggagaagctcgaaaccgagcacatggactgtagcgacctcctgagacgccaaaccagcgaactggagttttctacacagcgggaagaacgcctgcggaaggagttcgaggccactaccctccgagtccgaaagctggaggaaaatattgaggctgaacgagccgctcaccttgaaagtaaatttaattctgagatcatacagctacggatccgtgatcttgaaggggccctccaagtggaaaaagcttctcaagccgaggcggtcgccgacctggaaattataaaaaatgagttcaaggaggtggagtcagcctatgaaagggagaaacataatgcccaggagagctttgctaaactgaaccttctggagaaggagtacttcagcaaaaacaaaaaacttaacgaagacatagaagaacaaaaaaaagtaataattgacctgagcaagcggttgcagtacaatgagaagagctgcagcgagctgcaggaggagctcgttatggcaaagaagcaccaagcatttttagtcgagacctgcgaaaacaatgtgaaagagctggaatccatacttgattcttttaccgtgagcggccagtggacaagcgggatacacaaggacaaggataaaccaccgagtttcagtgtggtattagaacgtctcagacggacacttaccgattaccagaacaaactggaggatgcttctaacgaagagaaggcctgcaatgagctggatagtacaaaacagaagatcgatagtcacacaaaaaatataaaggagctgcaagacaaactcgcagacgtgaacaaagagctgtcgcatctgcatactaagtgcgctgatcgcgaggccctgatatccaccctgaaggtggagcttcaaaacgtcctccattgctgggagaaagagaaggctcaggctgcccagtctgagtctgagcttcagaaattatctcaggcctttcataaagacgccgaggagaagctgacattccttcatactctgtatcagcatctcgtcgccggatgtgtgctgattaaacagcccgagggcatgttggataagttttcctggtctgagctttgcgctgtgttacaggaaaatgtggatgccctgatcgcggaccttaaccgcgccaatgagaagatccgccatttggagtacatatgtaaaaacaaaagtgatactatgagagagttacaacagacacaggaggacactttcaccaaagtggctgagcagataaaagctcaggaatcctgttggcatagacagaagaaggaactggagctgcagtattccgagcttttcctggaggttcagaaacgcgctcagaagttccaggagatcgctgagaagaatatggagaaattaaaccatatcgagaaaagtcacgagcaacttgtcctggagaactcccatttcaagaaattgttgagccagacacagcgggagcaaatgtcactcctggccgcctgcgcactcatggctggagcactgtatccgttatattctcgatcatgcgctctgtccacacagcgggatttcctgcaggagcaggtgaatacttttgagctctttaagctggagattcgaacccttgcccaggctctttctaccgtggaggaaaaaaaacaggaagaagcaaagatgaaaaagaagacattcaaggggctcattcggattttccggaaaggagtgatcgctgttttagctgctaatcgcctgaaaatattgggacaatcttgcgcttccctgttcacttggatggagtcctttaaggagggcattggtatgctagtatgtacaggcgagccccaggacaagcacaagtttcctaagcaccagaaggagcagcttcgttgtttgcaagccttgtcctggttaacatcatccgacctgctggccgccatcattagcagcatggccgagctgcaggatgtcattggcaaggcggaccccaatagtagaatctgtggccatttgctgatcggggcagccaagaactctttcgccaaactcatggacaagattagcctcgtgatggagtgtattccacttcacagttcgcggtctataacttacgtagaaaaagattcgctggtccaacgcctggcccatgggcttcataaagttaacacactggctcttaagtacgggctgagaggtcacgtcccaataacaaaatccaccgccagcctgcagaagcagattctgggcttcacgcagagattacacgcggcggaggtggagaggcgctctctcagactggaagttactgaattcaaacgcagcgttaatgagatgaaaaaagaactcgataaggcacagggattgcagatgcagcttaatgagtttaagcagtcaaagttaatcactcatgaaaagttcgagagtgcttgcgaggaactcaacaacgcgctccttcgagaagaacaggcccaaatgctcctgaatgagcaggctcagcagctgcaagaactgaactataagcttgaactgcacagctcagaggaggctgacaaaaaccagaccctaggtgaggccgttaagagtctctctgaggctaagatggaactaagacggaaggatcagtctctgcgacagctgaaccggcatctcacccagcttgagcaggataagcggcgactggaagaaaatattcatgatgcagaaagtgcgctgaggatggctgctaaggacaaggaatgtgtggccaaccatatgagggccgtggaaaatacactgcataaggtgcgggaccagatttctctaagctggtctgccgctagtcgcaatgatttcactctgcaactgccaaaactgcacctggagacctttgctatggaaggtctaaagggtggccctgaggttgtagcgtgccaggtcagagtgcagtggtgcgatcactcctccttacagagtcaaatgccgggtctgaaacagtcgtcgtgcctgagcctgctcagtacatag

SEQ ID NO: 46068 - DNA, 411 bp, Artificial Sequence
  Description of Artificial Sequence: Synthetic coding sequence
atgcgggccgtggagaacaccctgcacaaggtgcgggaccagatctctctgtcctggagtgccgcgagccgtaacgatttcactctccaactgcccaagctgcatctggagacctttgcaatggaaggccttaagggaggccctgaggtagtagcgtgccaggccatgatcaaatcgtttatggacgtgtatcagctcgcctctactcgcataatgacacttgaaaaagagatgacatcccaccgatctcatatcgctgctctcaaaagcgaactgcataccgcatgccttcgcgaaaacgcttcgttacaatctgacactttcatcatcagtttcagaagagatggctcaccatgtagtgatagctcgtcgatcgagtgcgagacattccctcaggtgattttaatgtag

SEQ ID NO: 46069 - DNA, 1497 bp, Artificial Sequence
  Description of Artificial Sequence: Synthetic coding sequence
atggccggcgccctgtaccccctgtacagccggagctgcgccctgtctacccaacgggactttctccaggaacaggtgaatacatttgaattgtttaagctcgagatccgaactctggctcaagccttgagtactgttgaggaaaaaaaacaggaggaagctaagatgaaaaaaaagacattcaaagggctcattagaatctttaggaaaggtgttatcgctgtgctagctgctaacagacttaaaatcctgggacagtcctgtgcttctctctttacatggatggagtcctttaaggaaggcatcgggatgttagtgtgcaccggagagccacaagacaagcacaagtttccaaagcaccagaaagagcagcttcggtgtctgcaggcactttcatggctgacttcctctgacctgctggctgcaataatttccagcatggccgagctacaggacgtgatcggtaaggccgacccgaattcccggatctgcggacacctcctgatcggcgccgctaaaaatagtttcgctaagctgatggataaaatttccctcgttatggagtgcattcctctgcatagttctaggagtataacttacgttgagaaggattcactggtgcagcgcttagcccatgggctgcataaagtgaatacccttgccttgaaatacggcctgcgcggacatgtgcctattaccaagagtacggcttcactgcaaaaacagatccttgggtttacccagcgtttgcatgccgcggaggtagagaggcgcagcttgcgcctggaggttaccgagttcaagaggtcagtgaacgaaatgaagaaggaactggataaagcccaggggctccagatgcagctgaatgaatttaaacaaagtaagttgatcacacacgaaaaattcgaatccgcttgcgaggagctgaataacgccctgttaagagaggaacaagctcagatgttgttgaacgaacaagctcagcagcttcaggagttgaattataagctggaactgcacagctccgaagaggctgacaagaatcagaccctgggtgaggcagtgaagtcactctccgaagcaaagatggaacttcgcaggaaagaccaatctttgagacagctcaaccggcaccttacgcagttagaacaggacaaacgccgtctggaggagaacatccatgatgcggagtccgcgctacgcatggccgcaaaggacaaggagtgcgtggctaatcacatgcgggctgtggagaacacgctccataaagttagagaccagatttccctgagctggagtgctgcctctaggaatgacttcaccctgcagttgcctaagcttcatctggaaacctttgccatggaaggcctgaaagggggacccgaagtggtagcctgtcaggtgcgtgtcagggtgcaatggtgcgatcactcaagcctacagtctcagatgcccggcctgaaacagtcctcttgcctgagcctgcttagcacttag

SEQ ID NO: 46070 - DNA, 3981 bp, Artificial Sequence
  Description of Artificial Sequence: Synthetic coding sequence
atgaacctgaacaccagcagcaacaccggcgacacccagcggctgaagattgccagtctagacgtgaagcagatcctgaagaacgagacggaacttgatattactgataatttgaggaagaagttgcactgggccaagaaggagaaactcgagattacaaccaaacataatgccgagctggcctcatatgagtcccagatcgcgaagctgaggagtgaagttgagaagggtgaggctctgcggcagtccctggagtatgacttagcggtggcccgcaaggaggctggcctgggacggcgggcggctgaggagcggctggccgaggcgcacaggattcaggagaaactatgtgcccagaacagtgagctccaggccaaaaccaatgagaccgagaaggctttccagaccagccagcagaagtggaaggaagagtgtcgcaggtttgagcatgatctggaggaaagagacaacatgatccagaactgtaatagagaatacgacctactgatgaaggaaaagtcaaggcttgaaaaaaccctgcaggaagccctcgaaaaacaccaacgcgaaaagaatgagatggaaagtcacatccgcgagacggcgttggaggagttccggttgcaggaagaacagtgggaagccgaacgccgagaacttcagttcatcgtacaggagcaggatacagcggtgcaaaatatgcacaagaaagtcgaaaaacttgagactgagcacatggactgctccgatctcctgaggagacagacatctgaactcgagtttagtacccagagagaagagcgcctcagaaaagagtttgaggcgactactctgagggtgcgaaaacttgaagaaaacatcgaggccgagagagctgcacatttagagagcaagtttaatagcgagataatacagcttagaattagggatctggaaggggcgctccaggtcgaaaaagcctcacaggcagaggctgtcgccgatctggagattattaagaacgaatttaaagaggtggagagtgcctatgaaagagaaaagcacaacgcacaggaatcttttgcaaagttgaatctactggagaaggagtacttctccaagaataagaaacttaacgaagacatcgaggaacaaaagaaagttatcatcgacctgagcaaacgcctacagtacaacgagaaatcctgcagcgagctacaggaggaactggtgatggccaaaaaacaccaagccttccttgtggagacctgcgaaaataatgtaaaagagttggagagcattttggactcctttactgtgtccggccaatggacaagcgggatccacaaagacaaggacaaaccgcctagcttctccgtagtcctcgaaaggctgcgtagaacactgaccgactatcagaataagctggaggatgcctccaatgaggagaaggcatgcaacgagctcgattctactaaacagaagattgactcccacacaaaaaacattaaggaactgcaggacaaattagcggacgtgaataaggaactcagccatctgcacaccaagtgtgcagacagagaagccctgatttcaacattgaaagtagaactccagaacgttctgcactgttgggaaaaagaaaaggcccaggcagcacaatccgaatctgaactgcagaaactttcacaggcatttcacaaagacgcagaagagaaattaacattcctacatactctttaccaacatctggtcgccgggtgtgttctgatcaagcagcctgaagggatgttggataaatttagttggtcagaactttgtgctgtcctccaggagaatgttgacgccctgatcgcagatctcaatagagctaatgagaaaatccggcacctggagtatatttgcaagaataagtccgacacaatgcgggaacttcagcagacacaagaggacactttcacaaaggtagccgagcagataaaagcacaggaaagctgctggcaccgccagaagaaggagctggagctccagtatagcgagctgttcctggaagttcagaagagagcgcagaagtttcaggaaattgcagaaaaaaatatggagaaactgaaccacatcgagaaaagccatgaacagctcgtcctggaaaattctcacttcaagaagctgctgtctcaaacacagagggagcagatgagcctgctagcggcatgcgctcttatggcaggggccctttatcccttgtacagtaggagctgcgctctctctactcagcgggatttcctgcaggagcaggtgaacacttttgaactgtttaagctagaaatcaggacactggcccaggccctgtcaactgttgaggaaaagaagcaggaggaggccaagatgaagaagaagacctttaagggtttgattaggatattccgcaagggtgtcatagccgttctggctgccaaccgtcttaaaatactgggacaatcgtgtgcctctctttttacgtggatggaaagtttcaaggaggggatcggcatgcttgtgtgtacgggggagccacaggacaagcataagttcccgaagcaccagaaggaacagctgaggtgtctgcaagcgctgagttggctaacgtctagcgatctcttggcggccattatctcctccatggccgaactccaggatgtgattgggaaggccgatcccaacagtcgtatctgcggacacctgttgatcggggccgcgaaaaattcttttgctaagcttatggacaagatcagtcttgtgatggagtgtatccccctgcactcatcgcggtcaattacctacgtcgagaaggattccctggtccagcgactggcccacggactgcataaggtcaacaccctagcactgaaatacggccttcgtggtcacgtgcctatcaccaaatccacggctagcctgcagaaacagatcctcggttttactcaaaggctgcacgccgccgaagtggaacggcggagcttgcggctcgaggtgactgagttcaaaaggagtgtgaacgaaatgaagaaggaacttgacaaagcccaggggttacagatgcagctgaacgagttcaagcagtctaagttgatcactcatgaaaagttcgagagcgcctgtgaagagttaaacaatgccctgctgagggaagagcaagcgcagatgctcctgaatgaacaggctcagcaacttcaggaactgaactataagctggaactgcacagcagcgaggaggccgacaaaaatcagaccttgggcgaggctgtgaagtccctgtcagaggccaagatggagcttcgtcggaaagaccagtccctcagacagctaaaccgtcacctgacccagcttgaacaggataaaagacgtttggaagagaatattcacgacgcggagtctgctctgcggatggcagccaaagataaagaatgcgtcgctaatcacatgagagcagtcgagaacactctccacaaggtaagggaccagatatcactgtcatggagcgccgcttccagaaatgactttactttacagttgccaaagctccatcttgaaacatttgcaatggagggcctgaagggcggacccgaggtggtagcatgccaggctatgataaagagctttatggatgtatatcaacttgcttcgacccgtatcatgacattagaaaaggaaatgacttcccaccgctctcacatagcggccctgaagagcgagctacatacggcttgtttgcgagaaaatgcttccctgcagtctatagggtcaagagatcactctaatctctctatcccaagccgggcccctctccctgcagacaccacgggcatcggcgatttcctgccactgaaggcagaactagacactacctacacatttttgaaggagactttcatcaataccgtgcctcatgccctcacaagttcccactcgtctccagtaaccatgagtgcgaatgccaatagacctacccaaattggactgtag

SEQ ID NO: 46071 - DNA, 774 bp, Artificial Sequence
  Description of Artificial Sequence: Synthetic coding sequence
tgacacaaggtgaacaccctggccctgaagtacggcctgcggggccatgttcccatcacaaaaagcacagccagtctccagaagcagattctaggcttcacacagcgtctccacgccgccgaggtcgagcggagatctttgcggttagaggtgactgagtttaagcggagtgtgaatgagatgaagaaggaactggataaggcccagggtctgcagatgcagctgaatgagttcaagcagtctaaacttatcacccacgagaagttcgagtctgcctgtgaagagttgaataacgctctgctgagagaagagcaggctcagatgctgctcaacgagcaggctcaacaactacaggaactgaattataagttggagctgcatagttccgaagaagccgataaaaaccagactctgggcgaggccgtcaagtctctgtcagaggctaagatggagctccggcgaaaagatcagtctctccgccaactgaaccggcatctcacccagctggagcaggacaagcggcgattggaggagaacattcatgacgccgaatccgccctcaggatggccgccaaggataaggaatgcgtggcaaatcatatgcgcgcagtcgaaaacaccctgcacaaggtccgggaccaaatatcactgagctggagtgccgcatcccgcaacgacttcaccctgcagctgcccaagctccatctggaaacattcgccatggagggcctgaagggtggccccgaagtcgtagcatgccaggtccgagtgtag

SEQ ID NO: 46072 - DNA, 1416 bp, Artificial Sequence
  Description of Artificial Sequence: Synthetic coding sequence
tgattcgagctgttcaagctggagatccggaccctggcccaggccttgagtacggtggaagagaaaaagcaggaggaggctaagatgaaaaaaaagaccttcaagggcctcattcgaatcttcagaaaaggggttatcgccgtgctggctgctaaccggcttaaaattcttggccagagttgtgcctccctatttacctggatggagagcttcaaagagggtattgggatgcttgtttgcaccggtgagccacaagataaacacaagttccccaaacatcagaaggagcaactgcgatgtcttcaggccttgtcttggctcacatcttctgatttactggcggccattatcagctccatggcggaacttcaagacgttataggcaaagccgatcccaactccagaatttgcggccatttgctgatcggagctgctaagaattcctttgctaagctgatggataagatcagtctggttatggaatgcattcccctccattcctcccgctctataacttacgttgagaaagatagcttggtgcaacggcttgctcatgggcttcataaggtaaataccctcgccctgaaatatggcctgagagggcatgtcccaattacaaagtccacggccagccttcagaaacaaatactgggttttacacagcggctgcacgctgcagaagtggaaaggagatccctacggctcgaggtgacagagtttaagagatccgtaaacgagatgaagaaggagctggataaggcccaggggctgcagatgcagctgaacgagttcaaacagtctaaattaataacacacgaaaagtttgaatctgcgtgtgaagagctcaataacgccctgctacgagaggagcaggcccagatgttgctaaatgaacaggcccaacagctacaggagcttaactataagctggaattgcactcctccgaggaggcggacaagaatcagaccctgggggaagcagtgaagtccctttcggaggccaagatggagctgcgccggaaagatcagtctttgcggcaactgaaccgccatctcacacagctggagcaggataaaaggaggttagaggaaaacatacatgatgctgaatcagcactcagaatggcagcgaaggacaaggagtgcgttgcaaaccatatgagggccgtggaaaatacactgcacaaggtgagagaccaaatctcactgtcatggtccgccgccagcagaaatgactttacattacagctgcctaaattgcacctggagacatttgccatggaggggctgaagggggggcccgaggtagtcgcgtgtcaggtgcgagtgagagtccagtggtgtgatcactcatccctccagagtcagatgccggggttaaaacaatcaagctgcctgagtttattatcaacttag

SEQ ID NO: 46073 - DNA, 954 bp, Artificial Sequence
  Description of Artificial Sequence: Synthetic coding sequence
atgaacctgaacaccagcagcaacaccggcgacacccagcggctgaaaatcgctagtctggacgtgaaacagattttgaagaacgaaaccgagcttgatataacagacaacttgcggaaaaaactgcattgggctaagaaagagaagctagaaataaccaccaaacacaacgcggaacttgctagctatgaatcccagatagcaaagttacgctctgaagtcgaaaagggcgaagcccttaggcagtcgcttgaatacgaccttgcagttgcacgaaaagaggccggcctgggtaggcgcgccgccgaggagcgattggctgaggcccatcggattcaggaaaaactgtgcgcgcagaatagtgaacttcaagccaaaaccaacgagactgagaaagccttccagacatctcagcagaagtggaaggaggagtgcaggcgcttcgagcatgacctggaggagcgggataacatgattcaaaactgcaatcgcgagtatgatctgctgatgaaagagaaaagccgcctggagaagactctgcaggaggctttggaaaagcaccaaagggaaaagaatgaaatggagtcccatatcagggaaaccgccctggaggagttccgactgcaggaagaacaatgggaggccgagaggcgcgaattgcagttcatcgtgcaggaacaagacaccgccgtgcagaatatgcacaaaaaggtagaaaaactcgagacagagcacatggattgctcagatttgttgaggcgccaaacttccgagctggagtttagcacccagcgagaggagaggctgcgcaaggaattcgaggccacgacactgagggtgagaaaactggaggagaacatagaggccgagagagccgctcacctcgagtcaaaatttaattcggaaataatacaggtgaaatgcaaacaaatcttctggccagctttctcttag

SEQ ID NO: 46074 - DNA, 600 bp, Artificial Sequence
  Description of Artificial Sequence: Synthetic coding sequence
atgaagaccttcatcatcggcatcagcggcgtgaccaacagcggcaagaccacccttgccaaaaatctacaaaaacatctgcccaactgctctgtaataagccaggatgactttttcaagcctgaaagtgaaatcgaaacagataagaacggattcttgcagtatgacgtcttggaggcgctgaacatggaaaagatgatgagcgcaatttcctgctggatggaatccgcacggcacagtgtagtgagtacggaccaggagagcgccgaggagattcctatccttattatcgaggggttcctgctgtttaattacaagccactggacaccatctggaacaggagctacttcctgactataccttatgaggagtgtaagaggagacggtctacacgggtgtaccagcccccagattcacccggctactttgatggacatgtttggcctatgtatctcaaatatcgccaggaaatgcaggacatcacttgggaggttgtctacttagacggcacaaaaagtgaagaggatctcttcctgcaagtctacgaggacttgattcaagagctagccaagcaaaagtgtctgcaggttacagcgtag

SEQ ID NO: 46075 - DNA, 558 bp, Artificial Sequence
  Description of Artificial Sequence: Synthetic coding sequence
atgggcaagcggcggcaccggcggggcaacgtgatcagctgcgtgaccaactcaggcaaaaccacgctcgccaagaatctgcagaaacatctgccaaactgctcagttatttcccaggacgatttctttaagcccgaaagcgagatagaaacagacaaaaacggattcctccagtatgacgtgttggaagccctgaatatggagaaaatgatgtctgcaatctcgtgctggatggaatctgctcggcacagcgtcgtcagcacagaccaggagagtgcagaagagattccgattctcattatcgagggtttcctgctgttcaattataaaccactcgacactatatggaatagatcctactttctgaccataccctacgaagagtgcaagaggcggaggtctactagggtctatcagcctcccgattcccctgggtacttcgacggccacgtctggcccatgtatctgaaatacaggcaagagatgcaggatattacatgggaagtggtgtatttagatgggactaagtccgaggaagatcttttcttacaggtgtag

SEQ ID NO: 46076 - DNA, 528 bp, Artificial Sequence
  Description of Artificial Sequence: Synthetic coding sequence
atgaagaccttcatcatcggcatcagcggcgtgaccaacagcggcaaaaccacattggccaagaacttgcagaaacacctgcccaattgtagtgtaatctctcaggatgattttttcaaaccagagtcggaaatcgagacagataagaacggcttcctgcaatacgacgtattggaagcacttaatatggagaagatgatgagcgcaatcagttgctggatggaatcagcccgtcactcagtggtgtctacagaccaggaatcggccgaagagatcccaatcttaatcattgagggttttctcctgttcaactacaacaccagagtgtaccaacctccagattcgccagggtattttgatggacacgtgtggcctatgtacctgaagtatcgccaagagatgcaggacattacatgggaagtggtgtacttggatggaactaagtccgaggaagatctgtttctgcaagtgtacgaggatctgatccaggaactggcaaagcagaagtgtcttcaggtgacagcatag

SEQ ID NO: 46077 - DNA, 612 bp, Artificial Sequence
  Description of Artificial Sequence: Synthetic coding sequence
atgggcaagcggcggcaccggcggggcaacgtgatcagctgcgtgactaacagcgggaaaacaactctggcaaaaaacctacagaaacacctgcccaattgttctgtgatctcacaggacgacttcttcaagcctgagagcgagattgagactgataaaaatggcttcttgcagtatgacgtgctggaggctctgaatatggagaaaatgatgagcgccatcagctgttggatggagagcgcaaggcactcagtggtttcaaccgatcaggaaagcgcggaggaaatcccaatccttataatagagggtttccttctgttcaattataagccactagataccatctggaatcggagttactttcttacgataccctatgaagaatgtaaacggcggcggtccaccagagtgtatcagcctccagacagtcccggctacttcgacggacacgtctggccaatgtatttgaaatatcgtcaggagatgcaggatatcacctgggaggtggtgtacttggacgggacgaagagcgaagaagatttgtttttgcaagtctacgaagatctgattcaggagctagccaagcaaaagtgtctgcaggtcaccgcctag

SEQ ID NO: 46078 - DNA, 642 bp, Artificial Sequence
  Description of Artificial Sequence: Synthetic coding sequence
atggagctgcacgaccgggtgctggacgtgcagctgtgcgcctgcagcctgcttttgcacctgctcggtcaagggatcatcgtcaacaaggcaccattggagaaagtgcccgacttaatcagccaagtgctggccacttatcccgccgatggcgagatggctgaagcctcgtgtggagtgttctggctcttatccctactggggtgcattaaggagcagcagttcgagcaggtggtcgcactgctgcttcagtcaatcagattatgccaggaccgagctctgcttgtgaacaacgcttaccgtggcctcgccagtctggtcaaagtatctgagctggccgcattcaaagtggtggttcaggaggaaggagggtccggtcttagtctcatcaaagagacctatcagctgcatcgcgacgaccccgaggttgtcgagaatgtgggaatgcttttggtgcacttagccagctatgaggagattctacccgagctggtgtcatcttccatgaaagcattgctgcaggaaattaaggaacgattcacatcttccctggtcagcgatagcagcgctttttctaagcccggcctgcctccaggaggatcgccgcagctggggtgcactacaagcggaggcctggaatag

SEQ ID NO: 46079 - DNA, 2043 bp, Artificial Sequence
  Description of Artificial Sequence: Synthetic coding sequence
atgctgggccccggcagcaaccggcggcggcccacccagggcgagagaggtcctggctcgccgggcgaaccaatggagaaataccaggtgttgtaccagctaaatcccggcgcgctaggtgtgaacctcgtggttgaggagatggagacaaaggtcaaacacgtgatcaagcaagtcgagtgtatggacgatcattacgccagccaggcactagaagagctgatgcctcttctaaagctgaggcatgcccacatatcagtgtatcaagagttattcattacttggaacggagagatttcctccttatacttgtgcctggttatggagttcaacgaactcagcttccaggaggtaatcgaggataagaggaaagctaaaaagatcattgactctgagtggatgcagaatgtgctggggcaggtgctggacgctctggaatatttgcatcacctggacatcatccacaggaaccttaaaccctccaacatcattctgatcagctccgaccactgcaagctgcaggatttaagttctaacgtactgatgaccgacaaggctaagtggaacatccgggccgaagaggaccctttccgtaaatcatggatggcccccgaagccctgaacttctctttttctcagaaatcggacatatggagtctcgggtgtataatcctggacatgacatcatgctcttttatggacggaactgaggccatgcatctgcgcaagtccctgaggcagtcaccaggctctttgaaagccgtcttgaagacaatggaggagaagcagatccccgacgtagagacattccggaacttgttgccattgatgctacagatcgatccatctgacaggattacaataaaggacgttgtgcacataacgttcctccgcgggtccttcaagagctcctgtgtgtcacttacacttcacaggcagatggtcccagcttctataaccgatatgctgctggaaggcaacgttgcatccatcctagaagtgatgcagaagttttctgggtggcctgaggtgcagctgagggcaatgaagcggctgctgaaaatgcctgcagatcagctcgggctaccttggcccccagaactggtggaggtggtggtcactacaatggagctccatgacagagtgctggacgtacaattgtgcgcctgcagcttattgctacatctgctgggacaggccctggtgcatcatccagaggccaaggctccttgcaatcaggcaatcacctctacactcttaagcgctcttcagagtcaccctgaggaagagccacttctggtgatggtatattcgctcctcgctatcacgacgactcaggaatcagagtccctgtctgaagagctccaaaacgccggtctgttagaacatatccttgaacacctgaactcatctttgaaatcacgggacgtttgcgcaagtgggctgggcctcttgtgggcactgctcctggacggcattatagtgaataaagcccctctggagaaagtgcccgatcttatttcacaagtgctggcgacctaccctgctgacggagaaatggccgaggctagttgcggcgtgttttggctgctatctttgctcgggtgcattaaggagcagcagttcgagcaagttgtagctttgctcctgcagagcatacgcctgtgccaggatcgcgctcttctcgtcaacaacgcctacagagggttagcttctctggtgaaggtttcggaattggccgcctttaaggtagtggttcaggaagagggtggatctggcctctccctgatcaaagagacttaccagctgcaccgcgacgacccagaagtggtggagaatgtgggaatgcttcttgtccatttagcctcttatgaagaaattttgccggagctggtgagttcaagcatgaaagctctgctgcaagagattaaggagcggtttactagttccctcgtctcagactcttcggccttttctaagcctgggctcccccctggggggtcgccacagttggggtgcaccaccagcgggggtctagaatag

SEQ ID NO: 46080 - DNA, 486 bp, Artificial Sequence
  Description of Artificial Sequence: Synthetic coding sequence
atgctgggccccggcagcaaccggcggcggcccacccagggcgagcgagggccagggagccctggagagcccatggagaaataccaagtgttgtatcagctcaatcccggagccctgggcgtgaacctcgtcgtggaagagatggagaccaaggtaaagcacgtgatcaagcaggtggagtgcatggatgaccattacgcaagccaagccctggaagagctaatgccgctgctaaagctgagacatgcacacatcagcgtctatcaagagctgtttattacctggaacggggagatttcgagcctgtacctgtgcctggtgatggaattcaacgaactctctttccaggaggttattgaggacaaacgaaaggctaagaagatcattgactccgagattaaaaccgaaggagtacccaacactcgtcgctttccggtgggggatcacgactcaagactgttctgccgttcgctgaaatttctgtag

SEQ ID NO: 46081 - DNA, 906 bp, Artificial Sequence
  Description of Artificial Sequence: Synthetic coding sequence
atgctgagcgagggctacctgagcggcctggagtactggaacgacatccactggtcctgtgctagttataacgagcaggttgccggagaaaaagaggaagagactaacagcgtggcaaccctctcttactcgagtgtggatgagacacaggtgaggtccttgtatgtgagttgcaaatccagcggaaagttcatctcgagcgtccacagtagggaatcccagcactctaggagtcagcgagtgactgttctccagaccaatcctaaccctgtctttgagagccccaatctggctgctgtggaaatctgccgggatgcctcacgtgagacttatcttgttcctagcagttgcaagagcatttgtaagaactacaacgacctacaaatcgccggcggccaggtgatggcgatcaacagcgtgacaacagactttccttccgaaagctcctttgagtatggccctcttctaaagagcagcgagatcccactgccaatggaagattctatttctacccaaccatcggattttcctcagaaacccatacagagatacagcagctattggcgcatcactagcatcaaagaaaagtcaagcctgcagatgcagaaccctataagcaacgccgtgctcaacgaatacctggaacagaaggtggtagagctctacaaacagtacatcatggatacggtttttcacgacagtagtccaacccagatcctcgcttcagagctgattatgaccagcgtcgatcagatttcacttcaggtgagtagggaaaagaaccttgaaacctctaaggcccgggatatcgtcttctctcgcctccttcagttgatgtctacggaaattacagagatctcaacaccctccttacacatatctcagtactctaacgttaatccctag

SEQ ID NO: 46082 - DNA, 2931 bp, Artificial Sequence
  Description of Artificial Sequence: Synthetic coding sequence
atgaacacccagaagggcagcctgaccatcaacgtgcaccggggctcattggcaatgagcattcaacgcggttccctggttcctagggatatggattccagtgggcgggacatgcagctgagagtgatcccagccgaggtgaagtttctagataccatggcaggcagagtgtacagactgccaattactgtccacaacatttgtcggtggaatcaaaagattaggttcaaagaacctgtaaagccccaattcaagttgatgctgacaagcctggacaaggaacttgccagcgggctccagatgaccgctatggtcgagtatcatccagacaaggatgaggatacatttgaccgtctgctcatctctatcgagaataagaccacagaaatcccgctgatcgggctgattccatcctgtcagctcgaaattgaaagcgttgtgaatttcggaactctggtggccaacagcaaagtgtatagcaaagagattacaatcaccaatcacggtaaagctcctgggatttttaaagccgagtaccacggccagctgcccatattaattttccccaccagtggcatcgttgatgctaagtccagcatggtgatcaaagtggacttttgtgctgaccagccacggatcgtggacgaggaggctattgtcatccttcaggggcagcctgagatgctgctgagcataaaggctcatgtagtggaacagattatcgaattgctgagcatgagcagtgatagacgactggaatgtatacactttgggcccgtgtttttcggatcgagcaagatcaagcacgctagagtctacaacaacagtcctgagccaatcaactgggttgcaatcattcaggacgatgccgtcggcgaagagctgggaaccgacattcagcaacgcacagacatcgcactaaacaacttgacatacattcgcaaaatcaagaatattgatactaccatcatcattagctgcctccccaacgaaggaaccctccaaccctaccagaagaccgttatcactttctgctttacacccaaacttatggccgtgggaaaaaaggacattggacctagttacaggcaggactacgcattattcttgcggtttgaatctgtaggctcaaaggacggcttcctgagagatgacgattataaaaccatcaagtctgaaagattccagaaggtagagctcgctctgactgggaccggtctcccagtgctgctgcagtttgatcctggccccgtgctgaacttcaagccctgtttcatgggggaaaggagtgagatccagtgcatcataaagaatcagtgtgaactcctgcccgttacttaccattttaagaaaaccgctaatttcgagatcgatccagaaaaggggaaaatcaccggagggggaatggtcgatgtaatgtgttctttcgtccctcaccaattgggagttttcaaggtcaaacagatgatcgagattatcggcctcgtggcagaggaggaccttcagtccctctcagttaagtccttccaccacgtctacctggcattcaactctatctgtaaggccagtaccaaaaaggtggtcatgaaattcgacccgggcatactgcccagcattaggaacccaaccgggaagttcgtagtgaaagacttagccaaaaggaaaaattacgccccagtggccatgctgcagtccgctatgaccagaacgcacaaccaccgctcatgcgaagagcctgtaaaggacatgctgcttgctttcccaaacgacagggccgcaactatccggagcaaagaccaccacaagcacttccgccctatcttcacaaaagtgcctcgtttcaactatgtgaaccatgacttcgcctatacaacttttgagaagcagcagaagaaactgcacgagaattactacgccatgtatctaaagtatcttcgaagtgtgcggctgcagaagaaacaggccgagcgcgagcgcatgtactcttatgacgacactgatatagggcttgaaccaggatccgggttgaagagcccaagtctgtcagaagccgagatagaagaggagctgagttctgccgccaattcaatcagagctaacagactgctgaccacacgcggaattgcgagccaggaggaggagtccgtaagaaggaaggtgcttaaaggcctcaagagtgagcccagcacccctcaggagaaacacgattgcagtttgatgcttacacctaaacagatacatcaggtcattgtgggaccctcagtactgaacttcggaaatatatgtgtcaacagccctaatactcacttgctgcacgtaatcaacatgttacccatgcacgtgttgctgcaactggacactgatctggaagagctgcagaagactaaccagttctcatatgttattctgccaaccagctcaacttatatctctatggtctttgacagtcccactatagggaaattttggaaatcatttactttcacagtgaataatgtgcctagcggtcatatcctggtggtggcagttgtgcaaccagtaacgctggagctctcttccaatgaactcgtgctgcgcccccggggctttttcatgaagacatgcttccgaggcacagttcgcctctacaaccggcagaactgttgtgctcaatttcagtggcagccagtaaacactggtagaggcatcgcgttttctatctgtcccgctaagggaaccgtggaggcctattcttcactcgagtgtgaagtcacatggcagcagggtttctctagtccagaggagggggagttcattcttcatgtgtttcagggtaacgctttgaaacttaagtgcgtggctcacgtgattatatttctggagcacgggttctgttttgaggggtatgaattcgttggctacacccttgtctacatcgtcacctatatctag

SEQ ID NO: 46083 - DNA, 705 bp, Artificial Sequence
  Description of Artificial Sequence: Synthetic coding sequence
tgaagccagaagctgcccgacgtgaagcccagccccatcaacctgagaaaaaagtcattgaccgtcaaggtcgacgtaaagaagaccgtcgacacgtttcgggtcgcctcctcttactctacagagcgacaaatgtcccacgacctggtagccgtaggacgcaagtctgagaatttccatccagtattcgagcacttggactccacccagaatacagaaaacaaaccaacgggtgaatttgcccaagaaattatcactatcattcatcaagtcaaggccaattatttcccttcccccggtatcactctgcacgaacgttttagcaccatgcaggatatccataaggcagacgtgaacgaaatcccgctcaattccgatccagaaatccatcgccgcatcgatatgtctttagctgagctccaatccaaacaagcggtgatttacgagagtgaacaaacactaatcaagattattgaccctaacgacctcagacacgacattgagaggcgccggaaggagcgcctgcaaaatgaggatgagcacattttccacatcgcatctgcagcagagcgcgacgatcagaactcgagcttctcaaagggcctggccctgtctcctcgactggagtgcggcgtcaccattacagcatactgcagtctgtacctacaggactcttcttacttgccgccacagccccctgaatag

SEQ ID NO: 46084 - DNA, 1878 bp, Artificial Sequence
  Description of Artificial Sequence: Synthetic coding sequence
atggcccggagccggagccggagcccccggtggaagcaccggagcttatcccctgttcctcgaaacgctgaacattataaacagcgccatagtcatggacactacggctgtgagtatagaaaggatcccaaaaggccagtggcttggcgaatggacagtgagaagcatggacaatctaagccgcgcattccatcccggggaaatatctattaccaaagttacgaacaccggagtcccagccccaacatccgcaacagcctggagaatgtctacatgtataagcctcaccgcggctattcacccggccgcggcgatagtaacagaagggctcagtatatgccaaagtactcagaaggcatcccctataaggagcacgagcgcaactcctacccccagaaggtgcagggaggacacagtccagatgaccaccgcgtgagaggctccggaaagggaggaaaaccaccacagcgaagcatcgctgactctttccggttcgaaggcaagtggcatgaggatgagcttcgccaccagcgtattcaagaggagaaatactcccaaagcacgcgccggggttcggaggactttgaaactaggagttccttccaaaagcggtaccccgaggacagagatttccgaaaatatggtcacacgagcaaacgtccaaaggacgtggaacgatacgaatctagagagcccgcccggaatcccaaatggaagcctgagcactccctgccaccataccaagaggacaccgaccaatggaatctaggaccgcagacttataggcacgccgaacgggaacaccctgaaacctccagcgccaccaaggtttcatacgattatagacataagcggccaaagctcctcgatggtgaccaggacttctccgatgggcggactcagaagtactgtaaagaggaagatcgaaagtatagtttccagaaggggccattgaatcgtgagttggactgttttaacacaggccgcggacgggaaacacaagacggccaagttaaggagccctttaagcctagtaagaaagattcaatcgcttgcacttactcgaacaaaaatgacgtggatctgcggtcatcaaatgacaaatggaaggaaaagatcaaaaaggagggggactgtcggaaggaatcaaactcttcatcaaatcagttggataagtctcaaaagctcccagatgtgaagccaagccctatcaacctccggaaaaaaagcctcaccgtgaaggtcgatgtgaaaaagacagttgacaccttccgcgtggcgtcttcgtattcaacagaacgccaaatgagccacgacctagtggccgtagggcggaaatccgaaaatttccaccctgtgtttgaacacctggactccactcaaaacactgagaacaagcccaccggagagttcgcccaggagattattacaatcatccatcaagtgaaagcaaattattttccgagccccggcattaccttgcatgagcgatttagcacaatgcaggacatccataaggccgacgtgaatgaaattccactgaactcagatccagagatccacagacgaatcgatatgtcgctggcagagctccagtccaagcaggcggtcatctatgaatccgaacaaacgttgataaagataattgaccccaacgacctcagacatgacattgagcgaagaaggaaagagcgcctgcagaacgaagatgagcacatcttccatatcgcctctgcagccgagcgggatgatcagaatagctcattttcaaagggcctcgcacttagcccgaggctggagtgcggtgtgacaataactgcatattgttctctctacctgcaagattcttcttatttaccaccgcagccgcccgagtag

SEQ ID NO: 46085 - DNA, 2049 bp, Artificial Sequence
  Description of Artificial Sequence: Synthetic coding sequence
atggcccggagccggagccggagcccccggtggaagcaccggagcctgagccctgtccctaggaatgctgaacactataaacaaagacacagccatggtcactacgggtgtgagtaccgcaaggaccctaaaaggccagtcgcttggagaatggactccgagaagcatggccaatccaagccccggatccccagccgggggaatatttactatcagagttacgagcacaggtctccttcgccaaatattcgaaacagcctggagaatgtttacatgtacaaacctcaccgcggctattctcccggcaggggtgactctaaccgacgggctcagtatatgcctaagtattcggagggaattccctataaggagcatgaaaggaacagctacccacagaaggttcaaggcgggcactcccccgatgatcacagggttcgggggagcggaaaaggcggtaagcccccacagaggtccatcgccgattcttttcggtttgagggcaagtggcacgaggatgaactgaggcaccagaggatccaggaggagaaatactcccagtccacccggaggggctccgaggattttgaaaccaggtctagcttccagaagaggtacccggaagatagggactttaggaagtacgggcacacaagtaagaggcctaaggatgttgaaagatacgagagtcgtgagcctgctcggaatcccaaatggaagcctgaacatagcctgccaccataccaggaggatacagaccagtggaacctcggaccccagacataccggcacgctgaaagagagcacccagaaacttccagtgcgactaaggtgtcttatgactacaggcataagcggccgaagcttctagatggcgatcaggacttttctgacggcaggacccagaaatattgcaaggaggaagacagaaagtattcatttcaaaagggacctctcaaccgggagctcgactgttttaacacaggcagggggcgcgagacacaagacggacaggtgaaagagccattcaagccaagtaagaaggattctattgcgtgtacctattctaacaagaatgacgtcgacctgcggagttcaaatgacaagtggaaggagaaaataaaaaaggagggcgactgccggaaggaaagcaactcctccagcaatcaactggacaagtcacaaaaactgcctgatgtgaaaccatctcccataaatctgcggaagaaatcgttgaccgtgaaagtggatgttaaaaagacagtagacacctttcgcgtcgccagtagctactctacagagcgccagatgagccatgatctcgtggcagtgggccgcaaatcagaaaattttcacccagtcttcgagcacctagacagcactcaaaataccgagaataagcctaccggtgaattcgctcaggagataatcacgataattcaccaagtgaaagccaattatttcccctcccctggcatcaccctgcacgagcgcttctctacgatgcaggacatccacaaagctgatgttaatgagatcccgttgaatagcgacccagaaatacatcggcgcatagatatgtctcttgcggaattgcagagcaagcaggcggttatttatgagagcgagcagacattgatcaaaataatcgatcctaacgacctgagacatgacatcgaacggcggcgcaaggagcgtctgcagaatgaggatgagcacatctttcacattgcatccgcagccgagagagatgaccagaattccagcttttcaaagaattacaccacccagcgcaaagacatcatcacacacaagccctttgaagtggaagggaaccacaggaacactagggtgcgacctttcaaaagtaacttcagaggcggcagatgccaacccaactataagagtgggctggttcagaaatcactatatatccaggccaagtaccagaggctgagatttacgggaccacgcggattcatcactcacaagttccgggaacggctgatgaggaagaagaaagagtatactgacgtggctaccggcatatag

SEQ ID NO: 46086 - DNA, 1467 bp, Artificial Sequence
  Description of Artificial Sequence: Synthetic coding sequence
atgcccaagtacagcgagggcatcccctacaaggagcacgagcggaactcctaccctcaaaaggtgcagggcggacattcgccggatgaccatcgggtgcgaggcagcggcaagggtggcaagcctccccagcggagtattgccgactcattcaggtttgaggggaagtggcatgaagatgaactgcgtcatcagagaatacaggaggagaaatactcacagagtactaggagggggagcgaggatttcgagactcgcagtagtttccagaaacgctatcctgaggaccgcgacttcagaaaatacggccatacatccaagcgcccaaaagacgtagagagatatgaatctcgagagcctgcccgaaaccccaaatggaaaccagagcattcactccccccttaccaagaagacacagaccagtggaatctgggtccacagacttacagacacgccgaaagggagcaccccgaaacgtcgagtgctacaaaggtgtcctatgattacaggcataaacgcccgaagcttctggatggcgatcaggacttttctgatgggcgcactcagaagtattgcaaggaggaggaccggaagtactctttccagaagggcccattgaatagagaacttgactgcttcaacaccggccgcggacgggagacacaggacgggcaggttaaggaaccatttaagccttccaagaaagattcaattgcgtgcacgtactccaacaagaacgacgtcgacctaaggtcttccaatgacaagtggaaagagaagatcaaaaaggaaggcgattgtcgaaaagagtccaacagctcctccaatcagctagacaagagccaaaagctgcccgatgtaaagccaagtcctataaatctgaggaaaaagtcactcactgtgaaagtcgatgtcaagaagaccgtggatacgtttagagtggcctcaagctacagtactgagagacagatgtctcacgacttagtcgccgtgggtcggaagtctgagaacttccatcccgtgtttgaacacttggactcgactcagaatactgagaataagcctaccggagagttcgcccaggaaattattacgattatccaccaggttaaggccaattattttcctagccccggaatcacacttcacgaacgtttctccaccatgcaggacattcacaaagctgacgtaaacgagatacccttgaatagtgaccccgagatccacaggcggatagacatgtctttggcagaattacagtccaaacaggccgttatatatgaatccgagcaaaccctgatcaagatcattgacccaaatgatctcaggcatgatatagagcggagacggaaggagcggctccagaacgaagatgaacatattttccacattgcatccgccgcggaaagagacgatcagaactctagcttcagcaaagtcaacacaagtaagtgcgcgggaatctag

SEQ ID NO: 46087 - DNA, 285 bp, Artificial Sequence
  Description of Artificial Sequence: Synthetic coding sequence
atgggcgccctgttccggctgctgctgcaggagcggggcaaggccgcagagttttatagcagaggtagaaaacagagacgcccttctgcatcctgtacgtttggtggtatatggtcctctggcgtcgacatgctgcccaatggtgccgtgggcagcctgacccagctggggccaagtaggcctgtgctcggcattgactattcgaagaaagaatttcggggaacagcggagaatgtgacagggctgaacactattctccactttagaaagcgtacccggagctag

SEQ ID NO: 46088 - DNA, 699 bp, Artificial Sequence
  Description of Artificial Sequence: Synthetic coding sequence
atggccgccaccagcggcaccgacgagcccgtgagcggcgagctggtttcagtcgctcacgccctctcactccccgctgagtcctatgggaacgacccggatatcgaaatggcatgggcaatgagagctatgcagcacgcagaggtgtattataaactgatttcatccgtggacccccagttcctgaagctcaccaaggtcgatgatcagatctacagcgagtttaggaaaaatttcgaaacccttcggatagacgttttagatccagaggagctgaaatctgagtcagccaaggaaccaccaggctacaacagcctccctctgaaactgctgggcaccggaaaggcaatcacaaagctctttatttccgttttcaggacgaagaaggaacgaaaagagagtacaatggaggaaaaaaaggaactcacagttgaaaagaaacggacccctcggatggaagaaaggaaagaactgattgtcgagaaaaaaaaacggaaagagagcaccgaaaaaacaaaactgactaaagaagaaaaaaagggtaagaagttgaccaagaaatccacaaaagtagtgaaaaagctctgcaaggtttacagagagcaacacagccggagttacgacagcattgagactacctccaccacggttctgctagctcagacacccctcgtcaaatgcaaattcctctataactag

SEQ ID NO: 46089 - DNA, 702 bp, Artificial Sequence
  Description of Artificial Sequence: Synthetic coding sequence
atggccgccaccagcggcaccgacgagcccgtgagcggcgagctggtgtcagtcgcacacgctctgagcctgcccgcggagtcctatgggaatgatccagatatcgaaatggcttgggctatgcgtgctatgcagcatgctgaggtatactataagctgatatcctctgtagacccccagttcctcaaactgacgaaagtggatgatcagatttactctgagttcagaaagaattttgaaaccctgcggattgatgtcctggacccagaggaattgaaatctgaatctgctaaagagaagtggcgcccattttgccttaagtttaacggcatagtggaggatttcaattatggcactctgctccgcctggactgttcacaaggctatacagaggagaacacaatcttcgccccacggattcagttcttcgccatcgagattgctaggaacagggaaggatataacaaagctgtttatatctctgtgcaggacaaggaaggagaaaaaggcgtaaataacggaggagagaagcgcgctgattccggggaagaggagaatacaaaaaacggcggggagaaaggggccgacagcggcgaagagaaggaagagggcataaaccgagaggacaagactgacaaaggcggcgaaaagggtaaggaggcagataaggagatcaacaaaagtggggagaaggcgatgtag

SEQ ID NO: 46090 - DNA, 354 bp, Artificial Sequence
  Description of Artificial Sequence: Synthetic coding sequence
atgagcgagaagaagaactgcaagaacagcagcaccaacaacaaccagactcaagatccaagccgcaacgaattgcaggtgccccggagcttcgttgatcgagtggtacaggacgagagggacgtacagtcccagtcttcaagcacaattaacactctgttaacgctccttgactgtctcgccgattacattatggaacgagtcggactggaggcttctaacaatggttctatgcggaacacaagccaggatagagaacgggaggtggacaacaatagggagccccacagcgcggagagcgacgtgactcgctttcttttcgacgagatgccaaagtcacgaaaaaacgattag

SEQ ID NO: 46091 - DNA, 270 bp, Artificial Sequence
  Description of Artificial Sequence: Synthetic coding sequence
atgggcgagctggccgccagcgccaaccacggccacagcccctgctatccggaaaggaaggggacgccgggcgacctgagtaagcggaaaatgcttgtgcatttttatccccggcggcactctcacccccgagccacccagcagtggatcctgaagaataaaactcaagaagggtctcacctccagacaaagagaagggtcctttcccgtccctggatatgctggcaccccgacctgggactccccgcttctcgaactatgcgcaattag

SEQ ID NO: 46092 - DNA, 189 bp, Artificial Sequence
  Description of Artificial Sequence: Synthetic coding sequence
atgggcgagctggccgccagcgccaaccacggccacagcccctgctatcctgagagaaagggaaccccaggtgacttgtctaagaggaagatgttggtacatttctatcccagacgccactcccaccctcgcgccacccagcagtggattctaaaaaacaaaacactgtgtcgacgcattaaagaatag

SEQ ID NO: 46093 - DNA, 2757 bp, Artificial Sequence
  Description of Artificial Sequence: Synthetic coding sequence
atcctgatcgccagcgacggcagcgtgcccctgcccctgcagttccttcccctgcagagcggaaggtatccatgcaagatcctacttaaatcccgttatgacgtgcgggcctattatgtggaaggcattgtgaatgaggagcaaccagaggctaaatttgaatttgagactcccgcgtttgaggcgctgacccagaatatccctatcaaaaaccagaccaatgacaaatggacattccaggtgacaattgaaggggagtggttctacggtcccgtggatctccatgtcgggcctgacgagatcgtcgagtatcccttgacttttaagcccatcttcgaatgtgtgataaccggcaagctcattctccagaatgaagtggacggtagagagcatatcttcgacatcaaaggggtgggaaaaaagcccagtgctctggaacacattactgtggagtgtcaggttgggaatgtgacccagaagcacattacacttccacattttaccaacaccgcccttacctttaaggtgaccgcagatctgccgatcgtgtggggcaacccacagattactgtgtacccttataaagagatcttgtatctcattcatgtgcgtccctggaagcgcgggatactcaagggcacaatcacctttagtacaaccaggcggtgcacaactcggagaaaacacgatgactacgaagaggataccgaccaggaccaagcactgtcatgcctggactctatcaccgaacagagcagcatactggacgacgccgatacctatggcaactttaacaatctgcggttctggtataatctggagatacacagtacccctggtccacctatagaaatcatggagatgacatgtattgcattggattcgacctgtattgaaattcccctgagcaatcccaaagaccgcggactgcacctggaagttcagctgacaagcgctgctctgaatggcgacaacgaaatcattttgtcgccacttcagtgcaccaaatacatcgtgtggtatagccccgcaacgaccggttatagcgatgaatctatcattttccagcccgagatggccgaagagttctggtacctcctgaagcttactatagaattgcccaaacccactacgatgccagagatacagtgtgatctggggaaacacgtgacccagatcatccctctcgttaattgcacacacgagacgcttaaattacaggttactaattcaaatcctgagaactttgtcctggatattaaccgcaagagtcaacttattatttctcctcactcaacgaccgagcttcctgtgctgttttacccttccgctcttggtagagccgaccatcaggcctgcataaacttttactgtacccaattcaccgagtggaaattctaccttagcggtgtgggcctgtttccccagcccctcgacaccgaacggatcactaccagaatcgggctgcagagtaccatcgtcatcccctttaagaatcctactatggaggatgtcttgatcgacatcatcctgacatctgtggaacatccaagaaatctcgtgatggatcactgctgggattcatttatttacgaatcttctgctttcagattttccagtccttcagaaattcagggaatagctctgcccccgaagggcaacattgatattagcctgctgtttattccacagatcatgaagctacataagaccatggtaattatcgaaatgacaaaagccaacgggaaatactggcctattgataactttgacgagctcgatattaaatttaagagtatcgttggcatcgactcagaagaaattcaagccatccattggatctatcctatagttggcctgccccaggcacctcctcctaagtccccacccgtggttatccaatgccagagtcggaagcgtgctgaggaaaaggtggaaatcatcttgaacgccgggttcttcggattctcccttacacctgacctgacagaggtgctggtgatacccaagcgcaacagtcataatttctgcgaggatccaaatgaaatcccaaaaatacacgagtttgagtatgagatccagtttgagtccgaggcaatgaaatctaagcttgagtcttgcgtggccctgtacatgatagagaaatcatatgatataatggccaagcggatcacttttatattcaatctcgtttttactcccaagaagcccctgcgcagtcacattacgttaaagattgaatgcgtcacggaaggtatttggaagtttccaatcatgctcattgccacagaaccggacacagacgcagtcatcgacattgaaggagttggcttgtttaaggagtcggtgtttgagctccgccttaagagtcaaactagaaaccctgaaccttttacagcgcactttcttcctgggtccgacttggagttctttgtaaaaccccaggctggagagctcctgccctttaatactaatgggacactgattactgtcggattcaagcccaaaatgtactgccgaaagtacaaagccaccctcgttattcagactgaagagatgtactggaagtatgaaatcaatggtcttactcctacaaccgtgccccccaaaaacgccaaagccaagatcgatgccacccacaaaacccacgataacatgcccgtcaggccacataacttcgtgcgtgagaatactaagttaatcaggacaggtgtatctagcaccattaagggtgccccgttagtgaagaaccagtag

SEQ ID NO: 46094 - DNA, 1902 bp, Artificial Sequence
  Description of Artificial Sequence: Synthetic coding sequence
atggagatgacctgcatcgccctggacagcacctgcatcgagatcccgctgagtaaccctaaggataggggcttacatctcgaagtgcagctcacttcagcagcgctcaacggggataatgagatcatcttgtctcccctccagtgcacaaagtacatagtatggtattccccagccacaaccggttactccgacgagtccatcatcttccaacctgaaatggctgaggaattttggtatctgctcaagcttacgatagagctgcccaagccaaccacgatgcctgagatccagtgcgatctaggtaaacacgtgacacagataattcctctggttaactgtacccacgagactttgaaactccaggtgaccaactccaacccagagaatttcgtgctagacatcaataggaagtcccaattaatcatatcccctcattcaactaccgaacttcctgtactgttctacccatcggccttgggtcgggcagaccaccaagcgtgcatcaacttctattgcacgcagttcaccgagtggaaattttatctgtctggcgttggcctgtttccgcaacctctcgataccgagaggattactactaggatcggcctacagagcacaattgtgataccattcaagaaccccaccatggaggatgtcctgattgacatcatcctcaccagcgtggaacaccctcgcaatttagtgatggaccattgctgggattcatttatatacgagtcctctgctttcaggtttagttctccttctgaaattcagggaattgcactaccaccgaaggggaatatcgacatttctctgctcttcatccctcaaataatgaagctccacaagaccatggtaatcattgaaatgaccaaggccaacgggaaatactggccaatcgataacttcgatgagctcgatattaaattcaaatctatcgttgggatagacagcgaagagatccaggcgatccactggatttatcctatcgtgggtctcccacaggccccacctcctaagagcccaccggtggtgattcagtgccagagtaggaagagagcagaggagaaggtggagatcatcctgaacgccggtttctttggcttttccctgacccctgatctgaccgaagtgctcgtcattcccaaaaggaacagccataacttttgtgaagaccccaacgaaatccccaagatccacgagtttgagtacgagattcaattcgaatctgaggcaatgaaaagtaaactggaaagttgcgtggctctctacatgatcgagaaatcttacgatataatggcgaaacgcatcacatttatttttaacttggtgtttactcccaaaaagcccctgcgaagccacatcacactaaaaatcgagtgtgttacagagggtatctggaaattccctataatgcttatcgccacagagcccgataccgatgctgtgatcgatatcgagggagtgggactgtttaaagaatcagtgttcgagctgcggctcaagagtcagactagaaatcccgagccatttactgctcacttcctccctggttctgacttggaattctttgtcaagccccaggcaggtgaactattaccttttaataccaatggcacactcataactgtcggcttcaagcccaagatgtactgtagaaagtataaagccaccctggtgatacagactgaggaaatgtactggaaatacgaaataaacggactgacgccgacaacggtgccaccaaaaaacgcaaaggcaaagatcgatgcgacccataagactcatgataacatgcctgtgcgtccgcacaacttcgtccgggagaacacgaaattgatccgaactggagttagctcgaccataaagggggctcccctcgtgaagaatcagtag

SEQ ID NO: 46095 - DNA, 543 bp, Artificial Sequence
  Description of Artificial Sequence: Synthetic coding sequence
ctggagatccccaagatccacgagttcgagtacgagatccagttcgaatctgaggcaatgaagagcaagctagaatcgtgcgtagccttatacatgattgagaaatcgtatgacattatggccaaacgaattacgtttatttttaacctcgtgttcaccccaaaaaaaccattaaggtctcatattacactgaagatcgagtgtgtcacagagggtatttggaagtttcccatcatgcttatcgcaacagagccagacaccgatgctgtgattgatattgagggtgtgggcctttttaaggagtcggtgtttgaattacgcctgaagtcccagacgcgaaaccccgagccttttaccgcccacttccttcccggatcagacctggaattcttcgtgaaaccacaagccggcgagctcctcccattcaatacgaatgggactttgatcacagtggggttcaagccaaagatgtactgtcgtaaatacaaggcaacgctggtgattcaggtatcatccatccgggcaatcgccaaagacgtatag

SEQ ID NO: 46096 - DNA, 240 bp, Artificial Sequence
  Description of Artificial Sequence: Synthetic coding sequence
atgtaccggatgaagcggagccaggtgcggacccccatccggcggctgatcagaaatgtcaatctggattgggaggacagcatggctctagggtgtaccaccgtcattgagagggggaccctacggcgccttaagcgagccaccttgaatacttttctggacagcccagtccacgtgctgttagttatgcccaagctgataccagaacactgggagaagtgggaggatgtcaagaggtag

SEQ ID NO: 46097 - DNA, 960 bp, Artificial Sequence
  Description of Artificial Sequence: Synthetic coding sequence
atggtgctgagcgagctggccgcccggctgaactgcgccgagtacaagaactgggtaaaggcgggccattgcctcttgcttctgaggtcttgccttcagggctttgtcggacgtgaagtactcagctttcaccgtggcctcttagcagccgcccccggcctgggaccgcgcgccgtctgcagaggcggaagcagatgttccccgcgcgctaggcagttccagccccagtgtcaggtatgcgccgagtggaagcgtgagatactccggcatcacgtgaatcgcaacggtgacgtccattggggcaattgtcggccaggcaggtggcccgtcgacgcttgggaggtagccaaagcctttatgccccggggcctggcggacaagcagggtcctgaagaatgcgacgctgtcgccctgctttccctgatcaatagctgtgatcattttgtcgtggaccgaaaaaaagtgaccgaagtaatcaagtgcagaaacgaaatcatgcattcttccgagatgaaggtctcatctacttggcttagggatttccagatgaaaatccagaatttcctgaatgaattcaagaatattcccgagatcgttgccgtgtacagtcggatcgagcagttgcttacctcagattgggccgtgcatatacctgaggaagaccagcgggatggctgcgaatgcgaaatgggtacttacctgagcgagtctcaggtcaatgaaatagagatgcagctgcttaaagaaaaactgcaggagatttatctgcaggcagaggagcaagaggtgctgccagaggagttaagcaataggttggaggtcgtgaaggagttcctccgcaataatgaagacctccgcaacggcctgaccgaggacatgcagaagctggattcgctgtgtctgcaccagaagttggacagccaagagcctgggaggcagactcccgataggaaagcatag

SEQ ID NO: 46098 - DNA, 468 bp, Artificial Sequence
  Description of Artificial Sequence: Synthetic coding sequence
atggtgctgagcgagctggccgcccggctgaactgcgccgagtacaagaattgggttaaggcaggacattgcctgttgctcttacgcagttgcctgcagggattcgtcggacgagaggttctgagcttccaccggggacttcttgcagccgctccgggactgggacctcgcgctgtgtgcaggggaggatctcggtgctcgccacgcgccaggcaatttcagccacagtgccaggtgtgtgctgaatggaagcgagagattctcagacaccatgtgaaccggaatggtgacgtgcactggggaaattgtcggccggggcgatggcccgtcgacgcctgggaggtggccaaaggtttagaccttctttctcgcttggagtgctccggagagagcgaactgattgccactctgaactcctgggctcaagcaattctgctgccccagcctctcgagtatctggggctctag

SEQ ID NO: 46099 - DNA, 603 bp, Artificial Sequence
  Description of Artificial Sequence: Synthetic coding sequence
atgccccggggcctggccgacaagcagggccccgaggagtgcgacgccgtcgccttactatctctgattaacagttgcgatcattttgtcgtggatcggaaaaaagtgacggaggtaattaaatgtcgcaacgagatcatgcacagctctgaaatgaaagtctccagcacatggttgcgcgatttccagatgaagattcaaaacttcctcaatgagttcaaaaacattccagagatcgttgcagtttattctagaatcgaacagttacttacctcagattgggccgtgcacatccccgaggaagaccagcgcgatggctgcgaatgtgaaatgggcacataccttagcgaaagtcaggtgaatgagatagagatgcagctgctcaaagagaaattgcaggaaatctacttgcaggccgaggaacaggaggtgctgcccgaggaactaagtaacagactcgaggttgtaaaagagttcctgagaaataatgaagatctgcgcaatgggctgacggaggatatgcagaagttggatagtctctgcctgcatcaaaaactggatagccaggagccagggcggcagactccagacaggaaggcatag

SEQ ID NO: 46100 - DNA, 603 bp, Artificial Sequence
  Description of Artificial Sequence: Synthetic coding sequence
atgccccggggcctggccgacaagcagggccccgaggagtgcgacgctgtggccctacttagtctcatcaacagctgcgaccattttgtagttgacagaaagaaagttaccgaagtgataaaatgccgcaatgagataatgcactcttcggagatgaaggtttctagtacctggctgagagattttcagatgaagattcagaattttttgaacgagtttaagaacatacctgagatcgttgcagtatacagccggatcgaacagctacttacatctgactgggctgttcacatcccagaggaggaccaacgggatgggtgcgagtgcgagatggggacatatctcagcgaatcgcaggtgaacgagatcgaaatgcaattgcttaaagaaaagttgcaagagatctacctccaggccgaggaacaagaggttctacccgaagaattgtccaatcgactggaagtggtgaaagaatttctgaggaataatgaagatctgcgcaatggcttaaccgaagacatgcagaaactggattccctgtgtctgcaccaaaaattagatagccaggaacccggacgacagacccctgacaggaaagcctag

SEQ ID NO: 46101 - DNA, 705 bp, Artificial Sequence
  Description of Artificial Sequence: Synthetic coding sequence
atggtgctgagcgagctggccgcccggctgaactgcgccgagtacaagaattgggtcaaagcaggacactgccttctactgctccgcagttgcctacagggatttgtgggacgcgaagtcctttcgtttcaccgaggcttgttggcagcagctccaggtctagggcctcgggccgtgtgtagaggcggtagcagatgtagcccgcgtgcgcgacaggtgataaagtgccgcaacgagatcatgcattcttcggaaatgaaggtttccagcacgtggcttagggactttcagatgaagatccaaaacttcctgaatgagttcaaaaatatccccgaaatcgtagccgtttacagcagaatcgaacagttgctgacttctgactgggccgtgcacattccggaggaggatcagcgggatggctgtgagtgcgaaatgggcacttacctgtcagagtcccaggtaaacgaaatagagatgcagctgctgaaagagaaactgcaggaaatatacctccaggctgaggaacaggaggtgctcccagaagagttatctaacaggctggaagtggtaaaggaattcttgcgcaacaatgaggatctgcgtaacggactaacagaggatatgcagaagctggactccttatgtcttcatcagaaattagattcacaggagccgggaagacagacaccggatcgaaaggcatag

SEQ ID NO: 46102 - DNA, 477 bp, Artificial Sequence
  Description of Artificial Sequence: Synthetic coding sequence
atgaagttcggctgcctgagcttccggcagccctacgccggcttcgtgttaaatggtatcaaaaccgtggagactaggtggcgaccactgctcagctctcagaggaattgtactatcgccgtgcatatcgcgcaccgggattgggaaggagatgcttggcgcgagctgcttgtagagaggctcggcatgacccctgcccaaattcaaacgctgttaagaaagggagaaaaatttggtcgaggcgtaatcgctggactggtagatatcggtgagaccctgcagtgtcccgaggatctaacccccgacgaggtggtggagctggaaaaccaggccgtgctgaccaatcttaaacagaagtacctaactgtgatcagcaatcctcggtggctcttagaaccaatacccaggaagggcggcaaggacgttttccaagttgatatcccagagcatctcatcccgttagggcacgaggtctag

SEQ ID NO: 46103 - DNA, 477 bp, Artificial Sequence
  Description of Artificial Sequence: Synthetic coding sequence
atgaagttcggctgcctgagcttccggcagccctacgccggcttcgtcctgaacgggattaaaaccgtggaaacccgatggaggcctctcttaagctcccagaggaactgcacgatagccgtgcacattgcccaccgggattgggagggggatgcctggagggagctgctggtggaacgtctgggcatgacccctgctcagatacaaacgctgctcagaaagggcgaaaagttcggtagaggagtgatcgcaggcctcgttgatatcggcgagacactgcagtgtccagaagacctcactccagacgaagtggttgagcttgagaaccaggctgtgcttaccaacctgaagcagaagtatctgaccgtgatttctaacccaaggtggctgttggaacctatccccaggaagggaggaaaagatgtcttccaggtggacattccagaacatctgatacctcttggacatgaggtgtag

SEQ ID NO: 46104 - DNA, 477 bp, Artificial Sequence
  Description of Artificial Sequence: Synthetic coding sequence
atgaagttcggctgcctgagcttccggcagccctacgccggcttcgtacttaacggcatcaagactgtggaaactcgctggcggccactgctctcttcgcaacgtaactgcaccatcgcagtgcacattgcccatcgagactgggagggagatgcatggcgtgaactgctcgtggaaagactcggaatgaccccagcccagatccagaccttactgcggaaaggcgagaaattcgggagaggagtcatcgccggactggtggacatcggcgaaactttgcagtgtcccgaggacctcacccctgacgaggtggtagagttggaaaaccaggctgttctgaccaatctcaagcagaagtaccttactgtgattagtaatccccgttggctcctggagccaattccccgtaaggggggcaaggatgttttccaagttgatatcccagagcatcttattcctcttgggcatgaagtatag

SEQ ID NO: 46105 - DNA, 477 bp, Artificial Sequence
  Description of Artificial Sequence: Synthetic coding sequence
atgaagttcggctgcctgagcttccggcagccctacgccggcttcgtattaaatggtataaaaaccgtggaaaccagatggcggccgctgctcagttctcagcgtaattgtaccattgctgtgcatatagcacaccgtgactgggaaggtgatgcctggcgtgagctgttagtcgagcgtttggggatgactcctgctcagattcagactctgttacgaaagggcgaaaaatttggacggggtgtgattgcaggacttgtggatattggagagacgctgcagtgtcccgaagatctcactccagatgaggtcgtcgaactagaaaaccaggccgtactcacaaatttaaagcagaagtacttaactgtgattagtaatccacgctggcttctggaacctatccccagaaaaggcgggaaggacgtcttccaggtggacatccccgaacaccttatccccctgggccacgaggtctag

SEQ ID NO: 46106 - DNA, 93 bp, Artificial Sequence
  Description of Artificial Sequence: Synthetic coding sequence
atgaagttcggctgcctgagcttccggcagccctacgccggcttcgttctgaatggaatcaagacggtagaaacacgctggcgccccctatag

SEQ ID NO: 46107 - DNA, 477 bp, Artificial Sequence
  Description of Artificial Sequence: Synthetic coding sequence
atgaagttcggctgcctgagcttccggcagccctacgccggcttcgttctcaatggcataaagacagtggaaacgagatggcgaccactgctgtctagtcagcgtaactgtacaattgctgtgcacatcgctcaccgagactgggagggagatgcatggcgggaactcctggttgaaagactcggaatgacacccgctcaaatacagacactgttgcgaaagggtgaaaagttcggacggggagtaattgccggtcttgttgacatcggggagacattgcagtgtcctgaagacctgactccggatgaagttgtagagctggaaaatcaggcagtgcttaccaacctcaaacagaagtacctgaccgtgatcagcaacccacgctggctgctagaacccatcccaaggaagggaggtaaggacgtattccaggtcgatataccggagcatctgatccccctgggacacgaagtgtag

SEQ ID NO: 46108 - DNA, 477 bp, Artificial Sequence
  Description of Artificial Sequence: Synthetic coding sequence
atgaagttcggctgcctgagcttccggcagccctacgccggcttcgtcctgaacggtatcaagactgttgagacacgctggcgccctcttctgtcatcccagagaaactgcactattgcagtgcacattgctcaccgggattgggagggagacgcctggcgggagttactggttgaaagactggggatgacaccagcccagatccagactctcttacggaagggagagaaattcgggcgcggcgttattgcaggcctagtggatataggcgagaccctgcagtgcccagaggacctcacacccgacgaggtggtggagctggagaatcaagctgttctgaccaacctgaaacaaaaataccttaccgtgatttccaaccctagatggcttctagaacccatcccaaggaaaggcggtaaggatgtcttccaggtggatatcccagaacatctgattcctttaggtcacgaagtgtag

SEQ ID NO: 46109 - DNA, 441 bp, Artificial Sequence
  Description of Artificial Sequence: Synthetic coding sequence
atgaagttcggctgcctgagcttccggcagccctacgccggcttcgtgttgaatggcatcaaaactgtagaaaccaggtggcgcccacttttatcctcccagaggaattgcacaatagctgtacatatcgcccatcgggactgggagggcgacgcctggagggaattgctggttgagagactgggcatgacccccgcccagatacagaccttgctgcgtaagggagagaaattcgggcgtggcgtcatcgcgggcctcgtggatatcggtgagacactgcaatgccccgaggatctcaccccagacgaagtcgtcgagttggaaaatcaggctgttctcactaacctgaaacagaaatacctgacggtaatcagtaatccacggtggcttctggaacccattccccgaaaggggggtaaagacgtctttcagaacccttag

SEQ ID NO: 46110 - DNA, 477 bp, Artificial Sequence
  Description of Artificial Sequence: Synthetic coding sequence
atgaagttcggctgcctgagcttccggcagccctacgccggcttcgttctgaacggaataaagaccgtggaaacaaggtggcgccctttactgtcaagccagcgcaactgtaccattgcagtgcacatcgcacatcgggactgggagggcgacgcctggcgtgagctgttggtggaaaggctgggcatgacccccgcgcaaattcaagctctcttgcgcaaaggtgagaaattcggacggggcgtgattgctggattggttgatattggagagacactgcagtgtccagaagacctgacccccgatgaagtggtggaattagaaaatcaggccgtcctaaccaatctgaagcaaaaataccttactgtgatttctaatccaagatggctcttagaaccgattcctcgcaagggaggaaaggacgtgttccaggtggatattccagagcacctcatccccttgggccatgaggtgtag

SEQ ID NO: 46111 - DNA, 477 bp, Artificial Sequence
  Description of Artificial Sequence: Synthetic coding sequence
atgaagttcggctgcctgagcttccggcagccctacgccggcttcgtcttgaatggcattaagacagtggagacacgctggaggcccctgttgtcttctcagaggaactgtaccatagcggtacacatcgctcacagagactgggagggagacgcctggagggagctcctggttgagcggctggggatgaccccagcacaaatccaggcattgctgaggaaaggcgaaaagtttggccgtggtgttatcgccgggttagtcgacataggcgaaaccctacagtgtccagaagatcttacacctgacgaagtcgtcgagctggaaaatcaagccgttctgacaaacctgaagcagaaatacctcactgtcataagcaaccctcgctggctgctggagcccattccacggaaaggcggcaaggacgttttccaggttgacatcccagaacacctgatccctctgggtcatgaagtgtag

SEQ ID NO: 46112 - DNA, 477 bp, Artificial Sequence
  Description of Artificial Sequence: Synthetic coding sequence
atgaagttcggctgcctgagcttccggcagccctacgccggcttcgttcttaacggcatcaagaccgtggagactaggtggcggccgcttttgagtagccagagaaattgtacgattgccgtacacatcgcacatcgggattgggaaggtgacgcatgcagggaactgctcgtggaacgcctcggcatgactccggcccagatccaggcgctgttacggaagggggagaaatttggaaggggcgtcattgctggcctggtggatatcggggaaactctacagtgtcctgaggacttgactcccgatgaggtagtggaactagaaaatcaagccgccttgaccaacctgaagcagaagtaccttacagtaatctcaaatcccagatggctgctggagccaattcctagaaaaggcggtaaggatgtgtttcaggtcgatattcccgaacacctcatcccactgggccacgaagtgtag

SEQ ID NO: 46113 - DNA, 477 bp, Artificial Sequence
  Description of Artificial Sequence: Synthetic coding sequence
atgaagttcggctgcctgagcttccggcagccctacgccggcttcgtgctgaacgggatcaagacggtagagacccggtggaggccgttgcttagcagccagagaaattgcactatcgctgtgcacatcgcccacagagactgggagggagacgcatgtcgggaactgttggtcgagcgcctcgggatgactccagcccagatccaggcgctgctgcgaaagggagagaagtttgggaggggcgtgattgcagggcttgtggatatcggtgagaccttacaatgtccagaggacctcacacctgatgaagtcgtggagctggagaaccaggcagcgttgactaacctgaagcaaaagtacctcacagtgatttcgaatccgcgctggttactcgaacctatcccccgcaagggcggcaaggatgtgtttcaggtcgatatcccagaacatttaatcccactcgggcatgaggtctag

SEQ ID NO: 46114 - DNA, 477 bp, Artificial Sequence
  Description of Artificial Sequence: Synthetic coding sequence
atgaagttcggctgcctgagcttccggcagccctacgccggcttcgtgctgaacggcataaagaccgtcgaaactcgctggcgacctctgctgagctcacagcggaactgcacgattgccgtgcacatcgcacatagagattgggagggtgatgcatgcagagaactcctggtggagaggctgggcatgacgcccgcccagatccaggccctacttcggaaaggagaaaagttcggtagaggagtaatcgccgggctcgtagacatcggggagaccctccaatgtcccgaggacctgactcccgacgaagtcgtcgagcttgagaatcaagccgccctaactaatcttaagcagaagtatctaactgtgatatccaaccctcggtggctcctggagcccatcccccgtaaaggggggaaggatgtctttcaagtcgacatccccgaacatttgattcctctggggcacgaggtgtag

SEQ ID NO: 46115 - DNA, 441 bp, Artificial Sequence
  Description of Artificial Sequence: Synthetic coding sequence
atgaagttcggctgcctgagcttccggcagccctacgccggcttcgtgctgaacggcatcaagacggtcgagactcggtggcgccctctgttgagctctcaacggaattgcaccatcgcagtgcatatagcccaccgtgattgggaaggtgatgcttgccgcgaactgcttgtcgagagacttggtatgaccccggctcagattcaggctctcctccgcaagggtgaaaaatttggcagaggcgtcattgccgggctggtggacattggcgaaacgcttcagtgtcccgaagacctgacacctgacgaggtggtcgagctggagaaccaggctgccctcacaaacctaaagcagaaatatttgaccgtgatttctaacccacggtggttgctggaacccatacctaggaagggaggaaaggacgtgttccagaacccttag

SEQ ID NO: 46116 - DNA, 477 bp, Artificial Sequence
  Description of Artificial Sequence: Synthetic coding sequence
atgaagttcggctgcctgagcttccggcagccctacgccggcttcgtcctgaacggtattaagactgtggagactcggtggcggcctcttctgtcctcccagagaaattgcacaattgctgttcatattgcccaccgggactgggagggagatgcttgtagggagcttctggttgagagactgggaatgacgccagctcagattcaggctctgctaagaaaaggcgagaaatttggtaggggtgtcattgctggactggtggatattggcgaaaccttgcaatgcccagaggacctgaccccagacgaggtagtggagcttgaaaaccaggctgcacttaccaatctaaagcagaagtatctgacggtgatctctaatccccgctggctgctggaacccatcccgaggaagggcggcaaagacgttttccaggtggacatccctgaacatttgatcccactcggacacgaggtctag

SEQ ID NO: 46117 - DNA, 645 bp, Artificial Sequence
  Description of Artificial Sequence: Synthetic coding sequence
atggagagcgagaacatggacagcgagaacatgaagaccgagaacatggaatcccagaatgttgactttgagtcagttagcagtgttactgcactggaagctctgtccaagctcctgaaccctgaggaagaggacgacagtgattacggccagaccaatggactgtcaacgataggcgcaatgggacccggcaacatcggcccacctcagatcgaggaactgaaggtaatccctgagaccagtgaggagaacaacgaggatatctggaacagcgaagagattcctgagggcgccgagtatgacgatatgtgggacgtccgtgagattcccgaatatgagataatttttaggcagcaggtgggaaccgaagacatattcctaggtctgagcaagaaggattcaagcactggttgctgttccgagctggtggctaagatcaagctgcccaatactaaccccagcgacattcaaattgacatccaggaaacgattctcgatctccggacaccccagaaaaagcttctcatcacgttacccgagctcgtcgagtgcactagtgctaaagcattctatattcccgaaaccgagacactcgagatcaccatgaccatgaagcgcgagcttgacatcgccaactttttctag

SEQ ID NO: 46118 - DNA, 645 bp, Artificial Sequence
  Description of Artificial Sequence: Synthetic coding sequence
atggagagcgagaacatggacagcgagaacatgaagaccgagaacatggagagtcagaatgtggacttcgagtcagtgtcgagcgtgactgccttagaagcattgagcaagctgttaaatcctgaagaagaggacgattctgactatggacaaactaatgggctgtccactataggagcaatggggccaggcaatattggacctccccagattgaggaattgaaggtgattcccgagacctccgaggagaacaacgaggacatctggaactccgaggaaattccggaaggggcagagtatgatgatatgtgggatgttcgggagatcccagaatatgagatcatctttaggcagcaagtgggtactgaagacatatttctcggcttgtccaaaaaagactcgtccacagggtgttgttctgaactcgtcgccaagattaagctacctaacactaacccgtctgacatccaaattgatatccaggaaactatcctcgatttaaggacacctcaaaaaaagctgctcattacattgcccgagctcgtagaatgcacaagcgctaaggcattttatatacccgaaaccgaaactcttgaaataacgatgactatgaagcgagaactggatattgcaaattttttctag

SEQ ID NO: 46119 - DNA, 645 bp, Artificial Sequence
  Description of Artificial Sequence: Synthetic coding sequence
atggagagcgagaacatggacagcgagaacatgaagaccgagaacatggaatcccaaaatgtggacttcgagagtgtaagctcggttactgcactggaagccctgtctaaactcttaaaccccgaggaggaagatgactccgattatggccagacgaatgggttgtccacaattggcgcaatggggccgggcaacattgggcctcctcagattgaggagctgaaggtgatccctgaaacatccgaggagaacaacgaggatatctggaactctgaagaaatcccggaaggggccgagtacgatgatatgtgggacgttcgcgaaattccggagtacgaaatcatcttcagacagcaggtcggtacggaagacatcttcctgggattgtccaagaaggacagctcgacagggtgctgcagtgaacttgtagcaaaaatcaagctgccaaacacaaatccaagcgatattcaaatagacatccaggaaacaatcttggacctcaggaccccccagaaaaagcttctgatcacccttcctgagttggtggaatgcactagcgccaaggctttttatattcccgagacggagacccttgaaattactatgactatgaagcgtgagttggacatagcgaacttcttctag

SEQ ID NO: 46120 - DNA, 795 bp, Artificial Sequence
  Description of Artificial Sequence: Synthetic coding sequence
atgctgcggctgctgcggctggccctggccttctacggccggaccgccgaccctgccgagcggcaaggaccccaacaacagggcctgcctcagggggacacacagcttaccaccgtgcagggagtagtgacatcattttgcggggactacgggatgatcgacgagtccatctatttttcctctgacgtcgtgacaggcaatgttccgctcaaagtgggccagaaagtgaacgtggtggtggaggaggataagccacactacgggctgagagcaatcaaggtcgacgtcgtgccgcgccatctgtacggggctggtccttcagactccgggacacgcgtactcatcggatgcgtcacaagtataaatgaagacaacatctacataagcaatagcatttatttttcaattgcaatcgtctctgaagacttcgtaccctataaaggcgacctgcttgaggtcgaatactccactgagcccggtatttcaaacatcaaggccacttcagtgaaacccatacgctgcattcatactgaggaagtgtgcatcaccagtgtccatggtcgtaatggcgtgatcgactacactatttttttcactcttgactctgttaaactccctgatggatacgtgccccaggtggacgatatcgtcaacgtggtaatggttgagtccattcagttttgcttcatttggagggccatatcaattacgccagtgcataaatctagttcagggttccaggacgacgggggactgggacgccccaagagggaaagacgctcacagtctatttag

SEQ ID NO: 46121 - DNA, 729 bp, Artificial Sequence
  Description of Artificial Sequence: Synthetic coding sequence
atgctgcggctgctgcggctggccctggccttctacggccggaccgctgaccctgccgaaaggcagggcccgcaacagcagggcctaccccaaggtgacacccaactgactactgtccagggagtcgttaccagtttttgcggcgattatggcatgattgatgaaagtatctatttttcctctgatgttgttactgggaacgtccctttgaaagtggggcagaaagttaatgtagtcgtggaagaagataagcctcactacggactgagggccataaaggtggatgtggtgccacggcacttgtacggagccggtccatcagactctgggacacgggttctcattgggtgcgttacatctataaacgaagataacatttacatttccaattctatctatttctcaattgcaattgtgtctgaggacttcgtaccctacaagggcgacctgctggaagttgaatatagcactgagccagggataagtaatatcaaggcgaccagtgtgaagccgatccgatgtattcacaccgaggaagtctgcattacctctgtgcacggtcgcaacggcgtgatcgactacaccattttttttacgttagacagtgttaagctccctgatgggtacgtgccacaggtcgacgatattgtgaacgtggtgatggtggagtccatccaattctgctttatatggcgagcaatctccattacccctgtgcataagagttag

SEQ ID NO: 46122 - DNA, 522 bp, Artificial Sequence
  Description of Artificial Sequence: Synthetic coding sequence
atgcggccccgggaccggagccgggtgatcgacgccgccaagcacgcccataagttttgtaatacagaagatgaggagactatgtacctccggaggcccgaaggaatcgagaggcaatatcggaagaagtgtgccaaatgcggcttaccgttattttatcagtctcaacctaagaacgctccagtaaccttcattgtggacggagctgttgtcaaatttggacagggcttcggcaaaaccaacatctacactcaaaaacaggaacccccaaagaaggtgatgatgaccaagcgcaccaaagacatgggcaagttctcatcggttacggtgagcactattgatgaagaagaggaggaaattgaggctcgtgaggtcgctgattcatacgctcagaatgctaaagtcattgagaaacagctggagcgcaagggaatgtcaaagcgacgcctccaagaactggcagagcttgaagctaagaaggccaaaatgaaaggcacacttatcgacaatcagttcaagtag

SEQ ID NO: 46123 - DNA, 669 bp, Artificial Sequence
  Description of Artificial Sequence: Synthetic coding sequence
atgcccaaggtggtgagccggagcgtggtgtgcagcgacacccgggatcgagaagagtacgatgatggggagaagcctttgcacgtatactactgcttgtgtggccagatggttctagttcttgactgccagctcgaaaaactgcctatgcgcccacgagacagatcaagagtgatcgacgccgccaagcacgcacataagttttgcaatactgaggatgaagagacgatgtacctgagacggcccgaaggaattgaacgccagtatagaaaaaaatgcgctaagtgcggacttccattattctatcagtcccaaccaaaaaacgctccggtcacattcatagtggacggggccgtcgtcaaattcggccagggttttggcaagaccaatatctacacccagaagcaagaaccacccaagaaagttatgatgactaagcggaccaaggacatgggaaagttctcatcagtgaccgtgagcaccattgatgaggaggaagaagaaatcgaggcccgagaagtcgctgactcatacgcccagaatgcaaaggtgatcgagaagcagctcgagaggaaaggcatgtcaaagaggaggctgcaggaactggctgagctggaagcaaaaaaagctaaaatgaaaggcaccttaatcgacaatcaattcaagtag

SEQ ID NO: 46124 - DNA, 669 bp, Artificial Sequence
  Description of Artificial Sequence: Synthetic coding sequence
atgcccaaggtggtgagccggagcgtggtgtgcagcgacacccgggacagggaagagtatgacgacggcgaaaaaccgctgcatgtgtactattgcctttgtggacagatggttctagtcttagactgtcaattagaaaagcttccaatgcgaccacgggatcgcagccgggttattgatgcagctaagcatgctcacaagttctgcaataccgaggatgaggagacaatgtacttacgcaggcctgaggggattgagcgtcagtataggaaaaaatgtgctaaatgcggtctccctcttttctaccaatctcaacccaagaatgccccggttacctttatagtggatggtgcagtggtaaagtttggccagggctttggcaagaccaacatttatacccagaagcaagagcccccaaagaaggttatgatgaccaaaaggactaaagacatggggaagttttcctcagtcaccgtgtcgaccattgatgaggaggaagaagagattgaagccagggaggtggcagattcatacgcacaaaatgctaaagtgattgaaaagcaactggagcgaaaaggcatgagcaagagacggttgcaggaattggccgagttagaagccaaaaaagccaagatgaagggcacgctaattgacaatcagtttaagtag

SEQ ID NO: 46125 - DNA, 669 bp, Artificial Sequence
  Description of Artificial Sequence: Synthetic coding sequence
atgcccaaggtggtgagccggagcgtggtgtgcagcgacacccgggatcgggaggagtacgatgatggcgagaagccactgcacgtgtattactgtctttgtggtcagatggtgctggtcctggactgccagctggaaaaactgcctatgcggccaagggacaggagtcgggtgatcgatgctgccaaacacgcgcacaagttctgtaatactgaggatgaagaaaccatgtacctccggcgaccagaagggatcgaaaggcaataccgcaaaaagtgtgctaaatgcggcctgccccttttctatcagagccagcccaaaaacgcacctgtgacttttatagtggatggggccgtggtgaaattcgggcaagggtttggcaaaaccaacatctatacacaaaagcaggagccccctaagaaggttatgatgaccaaacgcaccaaagatatgggaaaattctctagtgtgaccgtgagtacgatagatgaagaagaagaagagatcgaagcccgcgaggttgccgactcctatgcccaaaatgcgaaggtaatcgagaagcagcttgagaggaagggcatgagcaagagacggctgcaggagctggctgaacttgaggccaagaaagccaagatgaagggaacacttattgataaccaattcaaatag

SEQ ID NO: 46126 - DNA, 627 bp, Artificial Sequence
  Description of Artificial Sequence: Synthetic coding sequence
atgcccaaggtggtgagccggagcgtggtgtgcagcgacacccgggatagagaggaatatgatgatggagagaaaccactgcatgtgtattattgtctgtgtgggcaaatggtgctagtgctggactgccagctggaaaaattgcctatgaggccacgggaccgatctagagttatcgacgcagctaagcacgctcacaagttctgcaacactgaggacgaggagacaatgtacctgaggcgctgcgggctgcccctcttttatcagtcccagcctaaaaacgcccccgtgacgtttatcgtcgatggggctgtggtgaagtttgggcagggatttggaaaaacaaacatttatacccagaaacaggagccgcccaaaaaggtgatgatgaccaagcggactaaggatatgggtaagtttagcagtgtcaccgtctccactattgacgaagaagaggaagaaatcgaagcacgggaagtagccgactcctacgcccaaaacgccaaagtgattgagaagcagctggagcgcaagggtatgagtaaaaggcgactgcaggagctcgcggagcttgaggccaaaaaagccaaaatgaagggtacattaatcgataaccagtttaaatag

SEQ ID NO: 46127 - DNA, 2277 bp, Artificial Sequence
  Description of Artificial Sequence: Synthetic coding sequence
atgagcggcgagagcggccagcccgaggccggccccagccacgccgggcttgattggcctaaccccgagcgcaaccgggccggtgttcccgggggagtgatcagacgcgctgggagccaaggtccacgatcttggatacagaaagtcctggagcaaatcatggactcaccgaggcagtgcgtgacaccatcggaggttgtcccggtgacggtattagcggtccagagatatctcttggaagatgagccaagggacactgtgccgaaaccccccctctactgctatgatgtgactatctctgatggggtgtatcaggagaagtgctatctggatcctagcctgaactccctagtgtaccagaatatcctgaaagtcgggatccagatgaggatatcccgcgtttcatgcctgtacaatgagaagagaatcgggcagggcatcctttgcattgacaacgtgcattgcggtgaaacatccgatagcatcagcctggagacaccttttaggaatcgagctcaccaagaaaagcccgaaagacccctgcgaggcgggaagagccactacctggcgctgtggaacaacgaggatccgtacggcgatatctggctgaccgataaacagccggaagagcataacttctcagataccaagattataagtcttagccaccttgaaatgacctggaccaatcgacggaattttcctgccttgctggtgaggattctgcacaaaagcaagcttcggtactatggaaaacccgataaaaaaatgattgaaccctaccagacctttctggaggtggccgatagcagtgggacggtgtctgtcattatgtggaacgctctgtgccctgagtggtacaagtccctacgcgtgggcttagtgctgcttcttcaggactatagcgtgaaaaagagttacccattcagaatccagcccgtgccagtggatcctcagatcaaacttatttcaacgatggaaatctgccttaatttacgagaccccccgaccaatattatcataattcccgaaaagcaggtgaagccagaatggaggctgccgaagctcaaccatcgcttcacgacgcgctccgagctagatgacatgcctgaaaattgtatttgtgacgtaattggactcctggtgttcgtcggcagggtgcagaggagtaagaagaaggaaaaccgcgaggacttttggtcctatcggtggatccacatcgccgacggaacctccgagcaaccatttatagtggaactcttctcaacctcccagcccgaaatcttcgagaatatctacccaatggcctatttcgtatgcacacagcttaaagtcgtgagaaacgataatcaggtcccaaaattattatacctcacaactacaaacgaaagcggagttttcatcactggacacagagggcagccgtacacctatgacgcgaaaaatgccaatcgcccttccaccagccaggccgctcgggtggaaatccaggaaagaaacggtaaaaggcaccaggatgacgaaccagtgaactcccagtactttcaaaccacaagtaccaatttatctctgtctaacaagattagaattttacagggcccccacgctaatcctgtcgccgtgcctcaacccggagcttcagtgcagaccaaaggaattaaacccggaatgcccagcatcttcaaccggagagccaacattaatgcaaatctacaaggaaaggcacgtaagaccatatccgacaggtgggagtcacagctctggcgcgagaaaaaattcggtctcattgaccatctccactattcaagggtgtatcctgagagtattcctagaaagttcatgttcgaacatagaaagtttctgtccgaccagtataacagccagcctgccaagtatgtgccgcctgaagggcggcctcccaaacttgatgatttcaaaagcgcgcgctccctaggtcacttcgaggttaccatcctcggcctgaaccacgagatcgcaattgacgttgcattcctacctatgtactgccccgaagatatccgcactagtcaaattgatacactcctgacgtcaatgaactactcttgtgcatacccgcaggacacaactgggaatgatcgcctaccaggacctcgtgcggttgcgggtgacattataaaggctgccacggaattggaccgcgtacacatcgtaggcatccttgatatttgtaatctgggaaacaataaggtcgaagtttacttacataagatctatagtccggagaacacgagttag

SEQ ID NO: 46128 - DNA, 2568 bp, Artificial Sequence
  Description of Artificial Sequence: Synthetic coding sequence
atgagcggcgagagcggccagcccgaggccggccccagccacgccggcctggattggccgaatccagaaaggaaccgagctggggtaccagggggggtgatacgccgcgctggaagtcagggcccgaggtcatggatccagaaggtgctggaacaaattatggactccccaaggcagtgtgtgacaccatctgaggtggtccccgtcaccgttctagccgtgcagcggtatctcttggaggacgagccaagggataccgtgcccaagccacctctctactgctatgatgttactatttcagatggcgtctaccaagagaaatgctaccttgatccatccctgaattcactagtgtatcagaatatcctgaaggtggggattcagatgcgaatctcaagggtttcttgcttatataacgaaaagcgcattggccagggcatcttatgcattgataacgtgcattgtggagagacatcagacagcatctcactcgagaccccttttcggaaccgcgctcaccaggagaagccagagcgccctctcagaggaggcaagtcgcactacctcgcactttggaataacgaagacccttatggagatatctggcttaccgataagcagcccgaggaacacaacttttccgacacaaaaataatttccctttcccacctggagatgacttggacaaatcgccgtaactttcccgctttgctggtgcgcattctacacaagtcaaagctgcgctactatgggaaacctgataagaagatgatcgagccttaccagacatttcttgaagtggccgactcgtccggcacagtttccgtgatcatgtggaatgctctgtgtcctgaatggtacaagtccctgagagttggcctggtactcctgttacaggattatagtgtcaagaagtcctacccttttcgtatacagcctgtcccagtggatccacagataaagttaatctcgaccatggagatctgcctgaatcttagggatccacctacaaatataataataatccctgagaagcaagttaagcctgaatggcggctgcctaagctgaatcatagatttactactcggtccgaactggacgatatgcctgagaactgcatttgtgatgtcatcggcttgctggtcttcgtcgggcgcgttcaacggagtaagaaaaaggagaaccgcgaggatttttggagctacagatggatccatatcgccgacggcaccagtgagcagccctttattgtggaacttttttcaacaagtcagccagaaatctttgagaatatttacccgatggcgtacttcgtctgcactcagttaaaagtggtgaggaatgacaatcaagtgcccaagttgctctacctcacaaccacaaatgagagcggagtcttcatcacaggccacagagggcagccctacacgtacgatgccaaggtgaagaacttcatccagtggataagaaccaagagtgacagtggcgagcagaagaatatggtcatcgggggttattacccatacccccctgtgccagaaactttcagcaaatactctagctccataaaggtcgagagcctcctcactgccattagcgaggtgaggaaagaaattgaagacttgcaataccgcgagcagaaacgtatagctatccagggaattataacagctattaaatacatacctcattcaagcgccacggaaagtgcctcggcgagtgagacgctgcggaatgctaatcggccttctacgtcacaggcggccagagtggagatccaggagcgcaatggtaagcgccaccaggatgacgagccggtgaattcccagtactttcagaccacatcaaccaacctgagcctttctaataaaatccgtattctgcagggacctcacgctaatcccgtggccgtgccccaacccggggcctcagtgcagacaaaggggatcaaacctggtatgccgagcatttttaacagacgagccaatatcaacgcgaacttacagggcaaagcccgtaagactatttccgatcggtgggaaagccaactgtggcgcgaaaaaaagttcgggctgattgaccatctgcactacagtagggtttatccagagtccatcccacgtaagtttatgttcgaacatcgcaaatttctttctgaccagtacaacagtcagcctgccaagtacgtgcctcccgagggtcgccccccaaagctcgatgacttcaagtctgctaggagcttgggacattttgaagtgacgatcctggggctgaaccacgagatcgctattgatgtcgcgttcttgccgatgtattgtcccgaggacattcgcacatctcagatagatactctgctgacatccatgaactacagctgtgcctatcctcaggataccaccggaaatgacagacttcccggaccaagagcagtggctggggacattattaaggcagctacggaactggatcgggtacacattgttggaatactcgacatttgtaacctgggaaataacaaggtggaggtctatctccataaaatctacagtcccgaaaacaccagctag

SEQ ID NO: 46129 - DNA, 1701 bp, Artificial Sequence
  Description of Artificial Sequence: Synthetic coding sequence
aacaacgaggacccctacggcgacatctggctgaccgacaagcagcctgaggagcataacttcagtgacacgaagatcatctcactgagtcatctggagatgacatggactaacagaaggaacttccctgctctgcttgtgcgcattctgcacaaatcaaaacttcgctattacggtaaaccagataaaaaaatgatcgagccctaccagactttcttagaggtagctgattctagcggaaccgtgagcgtaatcatgtggaacgccttgtgcccagaatggtacaagagtttgcgggtcgggttggttctactccttcaggattactccgttaaaaagagttatcctttccgcattcaaccagtacctgtggatcctcaaatcaagctgattagcacaatggaaatatgcctgaatctgagggatcctcccacgaacatcattatcatccccgaaaagcaggtgaaaccagaatggcgactgcccaaactgaaccaccgatttacaacgagaagtgagctagacgatatgcccgagaactgtatctgtgacgtgatcggcctcctagtcttcgttggcagggtgcagcgctcaaaaaagaaagaaaatagagaagatttctggtcatatagatggatccacatcgctgatggcaccagcgagcagccctttatcgtggaactcttttcaacatcacagcctgagatttttgagaacatctatccaatggcatattttgtatgcacacagcttaaggtggtccggaatgataaccaagtcccaaaactactatatctgactaccacaaacgagtccggtgtattcatcactgggcatcgcggtcaaccctacacatacgacgccaagaatgcaaatcggccctcaacctctcaggccgccagagtggagattcaggagaggaacgggaaacgtcatcaggatgatgaaccagttaacagccagtattttcagacgacatcaacaaacctcagcctttccaacaaaattaggattctccagggcccccacgccaacccagtggccgtgcctcagcctggtgcttctgtccagacaaaaggcatcaaacccggcatgccatcaattttcaacaggagggccaatataaatgcaaacttgcaaggcaaagctcggaaaactatcagcgaccggtgggagagccagctttggcgggaaaagaagttcggcctgatcgatcacctgcactactcccgggtgtaccccgagtctattcctaggaaattcatgtttgagcacagaaagttcctgtcggaccaatacaatagtcagcctgccaagtacgtgccacccgagggcagacctcctaaactcgacgacttcaagtcggcaagatccctcgggcatttcgaggtaacaattctgggtttgaatcacgagattgctatcgatgtcgcttttctaccgatgtactgcccagaggatatcagaacctcccagatcgacacattactcacctctatgaattactcctgcgcgtatcctcaagacactacgggaaatgaccgcctccctggaccccgtgccgttgcaggcgacattattaaagctgccactgaattggacagggtgcacatcgtagggatcctcgatatttgcaatctcgggaataataaggtggaggtgtatcttcataaaatttattctcctgagaacacttcttag

SEQ ID NO: 46130 - DNA, 999 bp, Artificial Sequence
  Description of Artificial Sequence: Synthetic coding sequence
atgaaccggagcagcaacgtgccccggaagggcatcctgaagagcggcacaaggtctctgcaaaaagtacgaagggttcattttgccaacgctagaaatgcccgtagcctactgtctatgctgaaggacattagcgcccagataatccaaagagcttggctgtcacatacaaataaaatgatctttagactgcttaagcacgcaatatgtgctgccgagttttatgtgacccacgagattctgaagaaggtggccccacttgaagcgaaacttataaaggacccgacgatgcagtgtaaaattcgattcaggtttaggggcgagacgttccccccatttattgtgttcaagatattcctccacacagacgggcatggatacaaatacttttcagggaagaacgtgctgatgccgtcgtcaaaggcagtagacgatgcctgcaagcttatgggggagcgcaaattccatcggatcatcatggaggacgaacggatatttcccaagtcaaaagtgaccgatatcatggatgtggtcactatgcaggattacgtgcagtatagatcatttttcgatgaggcccctgctttctccgggggtcgcaacaatagctggagaaagcttaacttggagaacatacctcgaactatgctaatgtacgatatcgttcattactctgaaagcggagtgatctctaacagattgcggaatgaaatgaaattcttgctgcagcgacccgttacccaagagattcacaaacatcagcttcggatagtctctgaaatccgagggccatatctcactgttcagcccctgtaccgcccatataaacaacagaaccaggttaaatttctgggtcgccgaagcaagcaggcgcagatgaaagtcgaaaaaatgcgtaaagtgtacctggccaaggagaaaaataccagcgaagtgacagaacccaagactgggccatccgggaccaaagacaactatcacctgcactcaattttttag

SEQ ID NO: 46131 - DNA, 381 bp, Artificial Sequence
  Description of Artificial Sequence: Synthetic coding sequence
tgattcgccaacgcccggaacgcccggagcctgctgagcatgctgaaggacatctctgcccaaatcatacagagggcttggctctctcatacaaataagatgatcttcaggcttctgaaacacgctatatgtgcagcggagttttatgtgacacacgagattcttaagaaggtggcgcccctggaggctaagctgataaaagatcccacaatgcagtgtaagattcggtttcggtttcggggggaaaccttcccaccattcatcgtttttaaaatctttctgcacaccgatgggcatggctacaaatacttctcaggaaagaatgtcctgatgcccagcagcaaagtaacattccatgacgtgcatttcatgctgacgtag

SEQ ID NO: 46132 - DNA, 897 bp, Artificial Sequence
  Description of Artificial Sequence: Synthetic coding sequence
atggcctgcatcgagaacgtgctgggcggccacgcccccagccccctggttgtatccgttgataagaatggcaatcaagaactccatcatgacatgcccttgcagtgtctgagctctaagccagaagatgacgctgagccttggggtcagcctcaggtacctctgcgcccttccgtcaacgtgttaacagacctggattccaaacaacttgagtggccgtctgaacgcacgggcagctgcatccctctgcactcactgcgggctcataggcacccttatggcccccctccagctgtagcagaggaatcccttgcaaccgccgaggtcaattcctcggatgctctcgctggatggcgacaggaagggcaggacgccatcaatgtgagttgggaggtgagcggcggtccccctgctctcatcgtaggaggcactaaggtgaacaatggcggcaccgagcgaggctctaacaacgcaaggctccacgtggcactcccacaaggtaagggctttttcccacctagaggccctcaggttcgcggcccgtcacatatcccaaccttacggtccggaatcgtcatggaggtgccacctggcaatacacgaatagcctgcagaggcaagttagcccatgtgtcatttccgctccgcggtccctgccacccaatgcacaactggcctaggcctattcccctgagctccagtacacctggacttccttcttgttccaccgtgcattgctttattcccccaagaccccccattttcaatcccttcctcaccatgcctctgcctttcgcgcctccaccaatttttggaccaccactcccttcgtacttcgcgcactttcattccggcggaatgcctgcacccgccagccctaacagggagcacagctag

SEQ ID NO: 46133 - DNA, 552 bp, Artificial Sequence
  Description of Artificial Sequence: Synthetic coding sequence
atgttcatcttcatcaagcacggcgacaaccagcagttcctggtgaacacgaattgcgccgtggtggtgctgttatactacatccgatccaaagtcaagctgccaaagaccaataccatcgacttatgcgagcagactggaaaaatgaagatgttgtttctaatgaaacctaaccacgcagagtacgccagcaaatacctcactgcaaggtccacctactacgtctgtaaagtggaaaggggcccccctggcaccagactggaaaatgcgtaccgggcctttgtgcctctattgaaaaacccggagccttggctgttggtggcactgcgcatacaatgcgatgctctagagcggagaaggattcagatgcttaaaatgaaagaagcaaagaaagttgtcatcatcgaaccgcctgcatctgtaccctcaaaacaaagcggtcgaagcgataagaaaaagtccacccgcaaatctcctaccttcagaaataggcccgattttcgcaagaacaagggacgccagctgaataagacaactaagcagaagaagtag

SEQ ID NO: 46134 - DNA, 612 bp, Artificial Sequence
  Description of Artificial Sequence: Synthetic coding sequence
atgttcatcttcatcaagcacggcgacaaccagcagttcctggtgaatacaaactgcgctgtggtcgtcctactctattacataagatctaaggtgaaactccccaaaacaaacacaatagacctctgtgagcagactggaaaaatgaagatgctgttcctcatgaaaccaaatcatgccgaatacgcttccaagtaccttacggctcggagtacatactacgtgtgcaaagtggagcgcgggccccctggaacccgactggagaatgcctaccgagcatttgtgccactcctgaagaaccctgaaccctggttactggtggctctgagaatccagtgcgatgctctagaacgtaggagaattcagatgctcaaaatgaaagaggcgaagaaggttgtcatcatcgaacctccagcctctgtgcccgtgaggctcgcgaaatgcgatttgccacagcaccctccactcccaactagccggttgaattcaaaacagtcgggtagatcagataaaaagaaatctaccaggaagtcacccacatttcggaatcgcccagacttccggaagaacaagggccgacaactgaacaaaactacgaaacagaaaaagtag

SEQ ID NO: 46135 - DNA, 1512 bp, Artificial Sequence
  Description of Artificial Sequence: Synthetic coding sequence
atggccacccagagcgacatggagaaggagcagaagcaccagcaggacgagggtcaggggggcctcaacaatgagactgcattagcaagtggagatgcctgcgggacgggaaaccaagatccagctgcatctgtgaccacggtctctagtcaggcatccccatccggaggggctgccttgtctagttccacagccggcagcagtgccgctgctgctaccagcgctgccattttcattaccgatgaggcatccggattacccattatcgccgcagtgctaacagaaagacactctgaccgccaggattgccgctccccacatgaggtgttcgggtgcgtcgtaccagaggggggctctcaggccgctgtcgggccccagaaagccactggccatgccgacgagcatttggcacagaccaaatctcctggcaatagtcgacgccggaaacagccttgcaggaatcaggcagctcctgcccagaagcctccagggagacgcctgttcccagaaccccttccccccagctctcccgggttcaggccctcctcgtatccttgctccggagcttcaacttcatcacaggccacacagcctggccctgcccttctgtcgcacgccagcgaggcccgcccagccaccaggagcaggatcacactggtagcctccgcactgagacgtcgagctagcgggccggggccagtgatccgcggatgcactgcccagcctggaccggcctttccgcatagggctacccacttagatcccgctcgactgtctcctgagtcagcaccaggcccggcacgacgggggcgagcaagcgtgcccggtccggcacgccgtggctgtgacagtgcacccggacctgcccgaaggggacgggacagcgcacccgtgtcagctcccagggggcgggattccgctccaggctccgcccggcgggggcgtgattctgctcccggtcccgcccttagggtgcgcaccgctcgttccgacgcaggtcacagatctacgtcaaccactcccggaacaggattgaggtctcgatccacacaacagcggtccgcactgctgtccagacgttcactgtcaggcagcgccgatgaaaatccctcctgcggcaccgggagcgagagactggctttccagtcacgctctggcagtcccgacccagaggtccccagtagagctagtcctcctgtatggcatgccgtgcgaatgagggcgtcgagccctagccctccagggagattcttcctcccaatccctcagcagtgggatgagtcatcaagctcttcttacgcatctaattccagcagccctagcaggtcaccaggactgtccccttcttccccctcaccagaatttttgggactgaggtctatcagcaccccgtcacctgaaagtctcagatacgccctaatgcccgagttttacgccttaagccctgtaccgcccgaggagcaggctgagatcgagtctaccgcacaccctgctactccccccgagccgtag

SEQ ID NO: 46136 - DNA, 252 bp, Artificial Sequence
  Description of Artificial Sequence: Synthetic coding sequence
atggaggccctgggcagcggccactacgtgggcggcagcatccggtcaatggctgctgccgccctgtctggattagccgtcagactatcacgacctcaaggcaccagggggagctacggggcattctgcaagaccctaacacgcacgctgctcacattcttcgacctggcctggcgtctgagaaaaaatttcttctacttttacatcctcgcatctgtgatcctcaatgttcaccttcaagtgtatatctag

SEQ ID NO: 46137 - DNA, 549 bp, Artificial Sequence
  Description of Artificial Sequence: Synthetic coding sequence
atgatgcggcggagccccagcggcctgaagagcccccgggtgagccagggtaggaaacctcgcgacccagagtctttactctttctgcgctgctgtctcgggtcggaaccgcataacttgtctagtctgctgagcccagaggcaggacaggaaccgctgccaaagctcttaccccagcctctggccggccacgccgcctgggggatccatggcgtgccgaccagcctattgctcgcgggggaatgttgggggcaaggaatggccgtgcccgctgatccccctccggcgtctccctataggacttctcctcgcccccctcctggccccttaccacgctatcggccccagcagcatctccttttgcccttggggaggttgcatgctttgtgtcctgggtgtcctttgcagcagagtctacagtttgaacgaggcaccttaagtgcgccgagactctggtcctggatgaaattggagactataatactttccaagctcagccagggacagaaaactaaacataggatgttctcacttatttctgaaagctag

SEQ ID NO: 46138 - DNA, 549 bp, Artificial Sequence
  Description of Artificial Sequence: Synthetic coding sequence
atgatgcggcggagccccagcggcctgaagagcccccgggtgagccaagggcgcaaaccacgggatccagaatccctgttattcctccgttgctgcttaggcagcgagccccacaacctgagctcactgctgagccccgaggctggtcaagagccgctgccaaaactcctgcctcaaccccttgcaggccacgctgcgtggggaatacacggagtgccaaccagcctgttgctggccggggaatgttgggggcagggtatggccgttccggccgatccccctccagctagtccataccgcacgtcacctcgccctccgcctggccctctcccacgctatcgacctcagcaacatctgctccttcctctcggccgcctgcacgcactgtgcccaggttgtcctctgcaacagtctctccagttcgaaaggggaaccctttccgccccaaggctgtggagctggatgaaattggaaaccatcatcctcagcaaattgtcacagggtcagaagacaaaacatcggatgttctccctgatcagcgagagttag

SEQ ID NO: 46139 - DNA, 306 bp, Artificial Sequence
  Description of Artificial Sequence: Synthetic coding sequence
atgaacaagctgggccacaacgagctgaaggagtgcctgaagaccgccacggactctttacaaaccgtacagcccagcatttcccaaacatgcacaagctacggcccagcactgggcgccccgctgcccgggcgtaatgaggttgccctgttaacttccttgccacccaactatgagatatcggaaggtaagcctagggcgatatcagcttacgtacgggccggaaaaggtaatgtcacaaggaggagaaaaaaaactcacctggggaatgatgatggtaaaaaagaggctcaggagaagatgtag

SEQ ID NO: 46140 - DNA, 306 bp, Artificial Sequence
  Description of Artificial Sequence: Synthetic coding sequence
atgaacaagctgggccacaacgagctgaaggagtgcctgaagaccgcaactgactccttgcaaacagtacagcccagtatcagccagacgtgcacatcctatggccccgcactgggggccccactgcccggcaggaacgaggtcgcgctcctgacttccctcccacccaactacgaaatcagcgaaggtaagccccgtgcgatctccgcttatgtcagggccgggaaaggcaacgtcacacgtcgccggaagaaaacacacctggggaacgatgatggcaagaaagaggctcaggagaagatgtag

SEQ ID NO: 46141 - DNA, 1416 bp, Artificial Sequence
  Description of Artificial Sequence: Synthetic coding sequence
atgtgcggcgactgcgtggagaaggagtaccccaaccggggcaacacatgtctggagaatggctctttcctactgaacttcaccggatgtgccgtctgcagtaagagagattttatgctgattactaataaaagcctcaaggaggaggacggggaggagatcgttacctatgatcacctgtgtaagaactgccaccacgtcatcgcaagacacgagtacacatttagtattatggatgagtttcaggcaaaggtggaggagaagatccaagaggttttcagctcatacaaatttaaccaccttgtgcctaggctggtgctgcaaagggagaagcactttcattacctgaagcgagggttgagacaactgacggacgcttacgagtgcctggatgctagtagaccttggctctgttactggatcctgcactcattggagctactcgacgagcccattccccaaatcgttgccactgacgtgtgtcagttcctggaactttgtcagagcccagagggagggtttggggggggtcccggacaatacccacatctggctcctacatacgctgcagttaatgcactgtgtatcatcggcaccgaagaggcctatgacattataaaccgggagaagttgcttcagtacctttatagccttaagcagcccgatggttcgttccttatgcatgtgggcggagaagtggatgttcgaagtgcttactgcgccgcctctgtggcctcgctaacaaacataattactcccgacttatttgaaggaaccgcggaatggatagcccggtgtcagaactgggaaggcgggattggaggcgttcctggcatggaggcccacggcggatatacattctgcggtctggcggccctagtgatcctgaagagggagcgaagcttgaatctgaaatctctcctacagtgggttacttctaggcagatgcgatttgagggcgggtttcaaggtagatgcaataaactggtagacgggtgttacagtttttggcaggctggcctcctgccactgcttcaccgcgcgctgcatgctcagggagacccggccttatccatgtctcactggatgtttcaccaacaggctctgcaggaatacatcttgatgtgttgtcagtgtcccgctggtgggcttcttgataagcccggcaaatcccgcgacttttatcacacatgttactgtctttcaggcctcagtatcgctcaacactttgggtccggagccatgctccatgacgtggttctgggtgttccggagaacgcactccagccaacacatcccgtgtataatatcggacctgacaaagtgatccaggccacaacatattttttacagaaacccgttccagggttcgaggaactgaaggatgagacctctgccgagcctgctaccgactag

SEQ ID NO: 46142 - DNA, 582 bp, Artificial Sequence
  Description of Artificial Sequence: Synthetic coding sequence
atggaggcccacggcggctacaccttctgcggcctggccgccctggttatcttgaagagggaaagaagccttaatcttaagagcttactgcagtgggtgacatcaagacagatgcggttcgagggaggttttcaggggcggtgcaacaagctggttgatggctgctattccttttggcaggctggacttcttcctttattacacagagcactgcatgctcagggcgatcccgccttgtccatgagtcattggatgtttcaccagcaagcactgcaggagtacatcttgatgtgctgtcagtgccccgccggtggcctgctcgacaaacctggaaaaagcagagatttctaccacacctgctactgtttaagcggtctctctatcgctcagcacttcggttccggtgcaatgttacacgacgtggttttgggagtgccagagaatgctctgcagcccactcacccagtttacaacatcgggccggacaaggtcatacaagccacaacctattttctccagaaacccgttccaggtttcgaggaactgaaagatgagacctccgccgaacccgctacagattag

SEQ ID NO: 46143 - DNA, 1176 bp, Artificial Sequence
  Description of Artificial Sequence: Synthetic coding sequence
atgatcgccaaggtggaggagaagatccaggaggtgttcagcagctacaaatttaatcacctggtgccacggcttgtgctccagagagaaaaacatttccactacctgaagcgcggcctgcggcaacttaccgacgcctatgagtgcttggacgcttctcgcccgtggctgtgctattggatcctgcacagcctcgaattgttggacgaacccattccgcagattgtagctacagacgtttgccagtttctcgagttgtgccaatcccccgagggcggctttggtggcgggcccgggcagtacccccatctggcaccaacctatgctgccgtgaatgccctctgtataattggtacagaggaagcctatgacattatcaaccgtgagaaactcctgcaatacttgtactctctgaaacaacctgatggctcgtttctgatgcacgttgggggcgaagtggatgtgcgttcggcatactgcgctgcctctgtcgcttccttaaccaacatcataaccccagatctcttcgaaggcaccgcggagtggatcgcccggtgccagaactgggaaggagggattgggggagtgcccggtatggaagcgcacgggggttatacattctgcggactggcagccttggtgatactgaagcgagaaaggagcttaaatttgaaatctctgctgcagtgggtgacgtccaggcagatgagattcgagggtggattccaggggcgatgtaacaagttagtggatggttgctattccttctggcaggctgggttattgccactcttgcacagagcactacacgctcaaggcgatccagcactttccatgagccactggatgtttcaccagcaggcactccaggagtacatcctcatgtgttgccagtgtccggcaggtgggctgcttgacaagccaggaaagtcgagagacttttatcatacctgttattgcctatccggtctgagcattgcccagcattttggttcgggcgccatgctacatgatgtcgtgctgggggtgcccgagaatgcccttcagcccacccatccggtgtacaacatcgggccggataaagttatccaggctaccacctactttctgcagaaacccgtccccgggtttgaggagctgaaggatgagacctctgcggagcccgccaccgactag

SEQ ID NO: 46144 - DNA, 1419 bp, Artificial Sequence
  Description of Artificial Sequence: Synthetic coding sequence
gccatgtgcggcgactgcgtggagaaggagtaccccaaccggggcaacacatgtttggagaacggcagttttttgctgaactttaccggctgtgctgtgtgctctaagagagacttcatgcttattaccaataaaagtttaaaggaggaagatggagaagagattgtcacctatgaccatctgtgcaagaactgtcaccacgttattgcccggcatgagtacactttctctattatggacgagtttcaagctaaggtggaggagaaaattcaagaagttttttccagttacaaatttaaccacctggtcccacgcctggtactgcagcgggaaaagcatttccactaccttaaacgcggccttcgacagctcacggatgcttacgagtgtcttgatgcaagcaggccatggctttgctactggattttacacagcctggaactcctggatgaaccgattccccagattgtggctactgatgtgtgtcagtttcttgaattgtgtcaatcccctgaaggagggttcggaggaggccctgggcagtatccccacctggctccgacatatgccgccgtaaacgcactgtgcatcatagggactgaggaggcttacgatatcattaatagggagaagctgctgcaatatctgtactcattgaagcaacctgacggatcatttctgatgcacgtggggggagaagtagatgtcaggtccgcctattgcgctgcctctgtcgcctctctgacaaacatcatcacgccagacctgtttgaggggactgctgaatggatcgctcgctgtcagaactgggagggggggatcggcggcgttccaggaatggaggcacacggcgggtacacattttgcggcctggcggcgctggtgatcttgaaacgggagaggtccctgaatctgaaaagtctccttcaatgggtgacatctagacagatgcggttcgagggcggcttccaaggccgatgtaataagctcgtggatggatgctattccttttggcaagcaggcctgttgcctctcctgcaccgcgctcttcatgcacaaggtgaccccgccctctccatgtcccactggatgttccaccagcaggccttacaggaatacattttgatgtgttgccagtgtcccgcgggtggcctgctcgacaagccaggcaaatctagggacttttaccacacttgttactgtctttcaggcctgagcatcgcccagcattttggaagcggtgctatgctgcatgacgtcgtattgggtgtcccggaaaatgctctgcagcccacacatcccgtctacaacattggccccgacaaagtcatacaggccaccacttacttcttgcaaaaacctgtgcccgggttcgaagaactaaaggacgagacgagcgctgaaccggctactgactag

SEQ ID NO: 46145 - DNA, 342 bp, Artificial Sequence
  Description of Artificial Sequence: Synthetic coding sequence
atgtgcggcgactgcgtggagaaggagtaccccaaccggggcaacacctgcttagagaacggttctttccttcttaattttaccggctgtgccgtatgcagcaagcgagattttatgctcatcacaaacaaaagcttaaaagaagaagacggcgaggagatcgtgacctacgaccccgacctgtgcaagaattgccaccacgttatagcacgccacgaatatacattttctatcatggatgaattccaggagtacaccatgctttgcctgctgtgcgggaaggccgaagacactattagcattcttcctgacgaccctagacagatgacactgttgttctag

SEQ ID NO: 46146 - DNA, 318 bp, Artificial Sequence
  Description of Artificial Sequence: Synthetic coding sequence
atgcggcagccctacctgagcagccgggaggtgagcagcagccggaagagatggcgcacatttcctgttgactgtgtcgccatgtgtggggactgtgttgagaaagagtaccccaatagggggaatacctgcctcgaaaacgggtcatttctgttaaacttcaccggctgtgcggtgtgctctaagcgggatttcatgttaattacaaacaagagcctgaaggaggaagacggcgaggaaatagttacatacgatcgcgtgtaccacgcagtgtctgtgatgaggcaaagtcggcgctactaccagtatagtccttag

SEQ ID NO: 46147 - DNA, 420 bp, Artificial Sequence
  Description of Artificial Sequence: Synthetic coding sequence
atgcggcagccctacctgagcagccgggaggtgagcagcagccggaagcgatggcgcactttccctgtggactgcgttgcgatgtgcggggactgtgttgagaaggagtacccaaatcggggcaatacctgcctggagaacggctcattcctgctgaactttaccggctgcgcggtctgcagcaaacgggacttcatgctcatcactaacaagagtctaaaagaagaagatggggaggagattgtcacatacgaccacctttgcaaaaattgtcaccatgtgattgctcgccatgaatacaccttcagcatcatggatgagttccaggagtataccatgctgtgcttactgtgtggcaaggccgaggatacgataagcatcttacctgatgacccccgtcagatgaccctgttattctag

SEQ ID NO: 46148 - DNA, 423 bp, Artificial Sequence
  Description of Artificial Sequence: Synthetic coding sequence
atgcggcagccctacctgagcagccgggaggtgagcagcagccggaaaagatggcgtacctttcccgttgactgtgttgccatgtgcggggattgcgtagaaaaggagtaccctaaccgaggtaacacttgcctggagaatggaagcttcctgctgaatttcaccggctgcgccgtttgctcaaaacgggactttatgctgataaccaataagagcctcaaagaggaagacggtgaagaaatagttacttatgatccagacctttgcaagaactgccatcacgtgatcgcacgtcacgaatatactttctcaatcatggacgagtttcaggaatacactatgctctgcctgctctgtggaaaagccgaggacacgatctccattctccccgatgacccacggcagatgacactgctgttttag

SEQ ID NO: 46149 - DNA, 381 bp, Artificial Sequence
  Description of Artificial Sequence: Synthetic coding sequence
tgcggcgtgagcacctacgcccccgacatgagccggatgctgggcggggaagaggcgcggccaaactcctggccatggcaagtctcgctccaatatagctctaacggtcagtggtaccacacttgcgggggatcactcatagccaatagctgggtcctaacagccgcacattgcatccgccaaattattaaagcccacaaagtgctccaaagatgttccctaatcttgtttttcgttcgcgacctctgcagcagccagcttgagctgacaggtgtatcggcaggatctagcggcatctaccgtgtgatgcttggtcagcataatctttatgtcgcagaaagtggttcactcgcagtctctgtctccaagatcgtcgtttag

SEQ ID NO: 46150 - DNA, 813 bp, Artificial Sequence
  Description of Artificial Sequence: Synthetic coding sequence
atgatgctgcggctgctgagcagcctgctgctggtggccgtggcctctggatatggaccaccgagcagccactctagtagccgggtagtccatggagaagatgccgtgccctattcttggccctggcaggtgagcctgcaatacgagaaaagtggcagtttttatcatacatgcgggggaagcctgattgctcctgattgggtcgttaccgccgggcactgcatatcccgtgatctaacttaccaagtggtgctgggcgaatataacttggccgtgaaagaaggaccagaacaggtaattccgattaatagcgaggagctctttgtccatcctctctggaaccgctcctgtgtggcctgtgggaatgatatagcattgatcaaactcagtagatccgctcagctgggcgatgctgttcaactggctagcctgccaccagccggcgatattttgcctaataagaccccttgttacattactgggtggggacgtctctacaccaacggaccgttacccgacaaattgcagcaggcaaggctccccgtagttgactacaagcactgtagtcgttggaactggtggggatccacagtgaagaagaccatggtctgcgcaggtggatacatccggtccggctgtaatggtgatagtggcggaccactgaattgccccacggaagatggcggttggcaggtgcacggcgtcacctcttttgtcagcgccttcggctgtaacttcatctggaaacccacagtgttcaccagggtgagtgcttttattgattggatagaggaaaccatcgcgagccattag

SEQ ID NO: 46151 - DNA, 495 bp, Artificial Sequence
  Description of Artificial Sequence: Synthetic coding sequence
atgcggagctgctacgtggcccaggccggcctgaagctgcccggctcatctgacccacctgcctctgcctcccagagtacccggatcacagcaagcgggtacggaccaccttcctcacattcctctagccgcgtggtccacggtgaggacgcagtcccttatagttggccatggcaggtttcactccagtatgaaaagagtgggagcttttaccatacatgtggcggctccttgatcgcaccagactgggtggttacagcagggcattgcatttctagagacctgacctaccaggtggtgctgggagagtacaacctcgccgtgaaggagggccctgagcaggtgatcccaattaacagtgaggaactcttcgtgcacccgctctggaatagaagctgcgtggcatgcggaaacgacattgctctgatcaagctgtctcgaagtgcacagctcggggatgccgtgcagctcgcctctctgccccccgccgggtag

SEQ ID NO: 46152 - DNA, 366 bp, Artificial Sequence
  Description of Artificial Sequence: Synthetic coding sequence
atgatgctgcggctgctgagcagcctgctgctggtggccgtggcctccggctatggtccaccatccagtcactcatcatcaagagtggtacatggggaggatgctgtgccgtattcctggccatggcaagtgtctctccagtacgagaagagcgggagtttctatcacacctgcggcggctccctgattgcccccgattgggtggtgaccgccggccattgtatctccagggatttgacataccaggtggtgcttggagagtacaatctggctgtgaaagagggcccagagcaggtgattccgataaactcagaagagctgttcgtccacccattgtggaatagatcctgtgtggcctgcgggtag

SEQ ID NO: 46153 - DNA, 228 bp, Artificial Sequence
  Description of Artificial Sequence: Synthetic coding sequence
tggtggggcagcaccgtgaagaagaccatggtgtgcgccggcggctacattcgttcaggctgtaacggagacagcggggggcccctgaactgcccaacagaggacgggggctggcaggtgcacggggttacctcattcgtatcggcattcggatgcaattttatatggaaacctaccgtgtttacccgggtgtctgcctttatcgactggattgaggaggggggctag

SEQ ID NO: 46154 - DNA, 348 bp, Artificial Sequence
  Description of Artificial Sequence: Synthetic coding sequence
atggacaacgtgcagcccaagatcaagcaccggcccttctgcttctctgtgaagggtcacgtgaaaatgctgcggctcgatttaacaaacagtatcatcactgccgtctttttatccgtggttgccattctggccatgcaggagaagaaacgccggcacctcttatacgtcggaggcagcctatgtctgacggcagtaattgtttgctgcatagacgcttttgttgtgactacaaaaatgagaaccaatctgaagaggttccttggagtggaggtggagcgcaagctctcgccagctaaagacgcataccctgaaacaggcccagacgccccgcagcggccagcttag

SEQ ID NO: 46155 - DNA, 195 bp, Artificial Sequence
  Description of Artificial Sequence: Synthetic coding sequence
atcaacagcctggtgaccaccgtgttcatgctgatcgtgagcgtgctcgcactcattcctgaaactaccactctaaccgttggcgggggcgacttgacaaacagcatcattacggcagtgtttctatccgtggtggccatcctggccatgcaggaaaaaaaacgccggcacctgttgtacgtgggggggagatag

SEQ ID NO: 46156 - DNA, 1395 bp, Artificial Sequence
  Description of Artificial Sequence: Synthetic coding sequence
atgcggatcatcgagagcaacagcagcaagatccagagccagatcgatcatatcaaacagtgtcgcgccgagtatgatacgaaggaggtgaagtactgtacattctccaaggaccctagcaaaccaatcccaggaatgacacttcaggagtctatgaacctagatgcccttacaaagtatatgaagcacttggaggataagtatgctgaaatcaagcaggctatgctgatcaagtacgtgcctgctcagaggaaagctgacctagacgaggagatgatagtgctgttaaagaggcgcgatgtggccgaaaacctcaataagaagctgcagttttgccatcagcgtctccagattatttcccaagccctgagttcatgggtcaagtcagatatgagttctcccttccaagacttcgtggaacagatccaaaaaacaaaatatttgcagggcgatcagggtatagtcgaggaactgatggaggacgatccgaggagggctaaggaggccgaaatcatgctccattacatcgaacgtttcaacgaactgatctctttaggcgagtatgaaaaagccgcttgctacgccgctaatagcccacggagaatcctgaggaacatcggcaccatgaatacattcaaagccgttggcaagattcgcggaaaacccctgccactgctcctgttcttcgaggctctttttatcacttctcacgcttttccctgtcccgtggacgctgctctcacacttgaaggcatcaagtgtggtctctctgaaaagaggctagacctggtgaccaactgggtgactcaggagcggctaacattcagtgaagaggccggagacgtaatttgtgattatggtgagcaagatacttataacaaagcaaagtgtttagccctcgcccagatcgtgtactctgaatgtgggctgcacaagaaggcgattctgtgcctgtgtaagcaggggcaaactcatagagtgatggaatatatacaacagcttaaagattttaccacggatgacttgttgcaacttctgatgagctgccctcaggttgaactaattcagtgtctgactaaggaattgaacgaaaagcagccaagcctgtccttcggactggctattttacacttattttcagcagacatgaaaaaggttgggattaagctactccaggagattaataaaggtggcatcgacgcagtcgaaagcctgatgatcaatgatagcttctgtagcatcgagaagtggcaagaagtggcaaacatatgcagtcaaaatgggtttgacaagctctccaatgatatcaccagcatactacggtcacaggccgctgtgaccgagataagtgaagaggacgatgcggtcaatctcatggagcatgtattctggtag

SEQ ID NO: 46157 - DNA, 663 bp, Artificial Sequence
  Description of Artificial Sequence: Synthetic coding sequence
atggccctgatcttccggaccgccatgcagagcgtgggcctgctgctgtcactactgggttggattctgtccattatcacgacctatctgcctcattggaagaatttgaacctggacctcaacgagatggagaactggacgatgggcttatggcagacatgcgttattcaggaggaggttggtatgcagtgcaaggacttcgactcttttttagccctgcctgccgaactgagagtcagcagaattttgatgtttctgagtaatggtcttggcttcctggggctgctggtgagcgggttcggccttgattgtctgcggataggtgagtcccagagggacctgaagcgcaggttgctgattctgggtggaatactgtcctgggcctcaggtatcacagccctggtacctgtgtcctgggtcgctcacaagacagtgcaggaattttgggacgagaatgtccctgacttcgtgcccaggtgggagtttggcgaggccttgtttctggggtggtttgcaggcttgtcgctgctcctgggcgggtgcctcctgaattgcgccgcatgcagcagccatgctcctctggccctcggtcactatgccgtggcgcagatgcaaacacagtgcccatatctcgaggacgggactgccgatccccaggtctag

SEQ ID NO: 46158 - DNA, 630 bp, Artificial Sequence
  Description of Artificial Sequence: Synthetic coding sequence
atggccagcatgggcctgcaggtgatgggcatcgccctggccgtgctcggatggctcgcagtgatgctgtgctgcgccctccccatgtggagagtgaccgcttttatcgggtcaaacatcgtcacctctcaaacaatatgggagggtctgtggatgaactgtgtcgtacagagcaccggacagatgcaatgtaaagtttacgactcccttctggcgctaccccaggatctgcaggcagctagagccctggttattatctccatcatcgtggctgccctaggagtcctcttgagcgtagtgggaggtaagtgcaccaattgcctcgaggacgagtcagctaaagcaaaaactatgattgttgctggggttgttttccttctcgccggtctgatggtgatcgtccccgtctcctggacggcccacaacatcatccaggatttttacaatcccctcgtggctagcggacagaagcgggaaatgggtgcctctctctacgtcggatgggccgcatctggtttattattgctcggcggcgggttgctgtgttgtaactgccctcctagaactgacaagccttattccgccaaatattcggctgcccggtccgctgctgcctccaactacgtttag

SEQ ID NO: 46159 - DNA, 630 bp, Artificial Sequence
  Description of Artificial Sequence: Synthetic coding sequence
atggccagcatgggcctgcaggtgatgggcatcgccctggccgtgctaggctggctggcggtcatgctgtgctgcgcactccccatgtggagggtgaccgcattcatcggctccaatatagtcacctcccagaccatctgggaaggcttgtggatgaattgtgtcgtgcagtccaccggtcaaatgcagtgtaaagtctacgattctcttctggctctaccccaggacctccaagctgcccgcgcccttgtcattatctctataattgtcgccgcactgggtgtgctgctaagtgtggtgggcggaaaatgtaccaactgtcttgaagacgaatctgctaaggccaagacaatgattgtcgccggggtagtcttcctgctagcagggttaatggtgatagtacctgtgtcctggacggctcataacatcatccaggatttctacaacccactggttgcgagtggacagaaacgggaaatgggggccagcctatatgttggatgggcggcctccggactgctcttgctgggaggcgggttactctgttgcaactgcccaccacgtacagacaagccctatagcgcaaagtacagcgcggcgcgaagcgctgccgcatctaactacgtatag

SEQ ID NO: 46160 - DNA, 540 bp, Artificial Sequence
  Description of Artificial Sequence: Synthetic coding sequence
atgcaggaggtgatcgccggcctggagcggttcaccttcgccttcgagaaagatgtcgaaatgcagaagggcacgggcctcctccctttccaggggatggacaagagcgcttccgccgtctgtaacttcttcaccaaggggctgtgcgaaaaaggcaagctttgtccgttccgtcacgaccgcggcgagaagatggtggtctgtaaacactggttgcgcggactttgtaagaaaggggaccactgtaaatttctccaccagtacgacctgacacggatgccagaatgttacttctattcaaaattcggtgactgttcgaacaaggagtgcagcttcctgcacgttaagccagcgtttaaatcacaggattgtccttggtacgatcagggattctgcaaggatggccccctttgcaagtatcggcatgtgccaagaatcatgtgcctgaactacctggtggggttctgccccgaagggcctaaatgccaatttgcacagaaaatcagagagtttaagttgcttccaggaagtaagatctag

SEQ ID NO: 46161 - DNA, 459 bp, Artificial Sequence
  Description of Artificial Sequence: Synthetic coding sequence
atggtggtgtgcaagcactggctgcggggcctgtgcaagaagggcgaccactgcaagttcctgcatcaatatgacctgacccggatgcccgagtgttatttttattctaaattcggcgattgctcgaataaagaatgctctttccttcatgtgaaaccggcctttaagagccaggattgcccctggtatgatcagggcttttgcaaagatgccggcccgctgtgtaagtacagacacgtgccacgcatcatgtgcttgaactaccttgtgggtttctgtcctgagggtcccaagtgccagttcgcgcactgctccctgcctgcaggtcccggaatccagcacttactttttttgctctggaaactggggaacccccacccacagcagtctgcgtgttctcccgcgtggggaagcggagtgaagggcagggcatgtgctactggtcccctgtgccagtag

SEQ ID NO: 46162 - DNA, 678 bp, Artificial Sequence
  Description of Artificial Sequence: Synthetic coding sequence
atgagcaaggagatcttccccttctgccgggtgggcaacatcccctacgaagccacagaggagcagctgaaggatattttttctgaagtgggccctgtggttagcttcagattagtgtatgatagagaaaccggcaagccgaagggatatgggttttgcgagtatcaagatcaggaaactgccctatccgcgatgaggaatctgaacgggagggaattctccggcagagcacttagggtcgataatgccgcctccgaaaagaataaggaggaattaaaatcactgggcacgggcgctccagtgatcgagagcccctacggcgaaacgatcagcccagaagatgctcctgagagcatttcaaaagcagtcgcctccctgcctcctgagcagatgtttgaactgatgaagcaaatgaagctgtgtgtccagaattctccccaggaagcgagaaatatgcttctgcagaacccccagctggcctacgcactgctccaagcgcaggttgtgatgaggattgtcgaccccgagatcgcgctcaaaattcttcataggcaaaccaatatcccaaccctcattgctggtaacccccagcccgtgcacggcgctggacctggctccggcagtaatgtgagcatgaatcagcaaaaccctcaggcccctcaggctcaatccctgtag

SEQ ID NO: 46163 - DNA, 1794 bp, Artificial Sequence
  Description of Artificial Sequence: Synthetic coding sequence
atggccggcctgaccgtgcgggaccccgccgtggaccggagcctgagatcagttttcgtgggcaacattccatacgaggctacagaggagcagctgaaggacatcttcagtgaagtaggccctgtggtcagctttcggcttgtttatgatagggaaacaggcaaacccaaaggttatggattttgtgagtaccaggatcaggaaacagcactgtccgctatgcgaaacctgaatggacgcgagtttagcggccgtgccctacgcgtcgacaatgctgcaagtgaaaaaaacaaagaagaactgaagtccctaggcaccggagcccctgtaatagagagcccatacggggagaccatttcccccgaggatgcccctgaatcaatttccaaggctgtcgcttcattaccccccgagcaaatgttcgaattgatgaagcagatgaaactgtgtgtgcaaaactcgccccaggaagcccggaacatgctcctacagaacccgcagctcgcctatgcccttctccaggctcaggtagtgatgcgaattgtggaccccgagattgcgctcaagatcttgcacagacagacaaatattcccactctcattgcagggaatcctcagcctgtgcatggagccggacccggcagcggcagcaatgtttccatgaatcagcaaaatcctcaggcaccccaggctcagtcgctcgggggtatgcatgtgaacggcgctcctcctcttatgcaggccagcatgcagggaggcgtccctgccccgggacaaatgcccgccgcggttaccgggcccggtccaggatccttggctcctggaggcgggatgcaggcgcaagtcggcatgccagggagtgggcctgtgtccatggagagaggccagggtaccctgcagcactcccccgtagggcctgcgggccccgcctcaattgaaagagtgcaggtgcctatgcaggatcccagagctgccatgcaaaggggcagcttgccagcaaacgtgccaaccccaagaggactgcttggagatgcccccaacgacccgcgaggcgggaccctcctgagcgtgacgggggaggtagaaccgcggggctacctgggtccacctcaccaagggccacctatgcatcacgtgcctgggcatgagtcaaggggtccccctcctcatgagctgcgaggtggtccattaccagagcctcgaccattgatggctgaacctcggggcccaatgctggaccagaggggtccgcccctggacgggaggggaggcagggaccccaggggcattgacgcccgcggaatggaggcccgtgctatggaagccaggggtctagatgcaagaggcttagaagcacgggctatggaggcacgtgcgatggaagcaagggcaatggaagctcgggcaatggaggccagggctatggaggtgcgcgggatggaagcacgcggaatggacaccaggggacccgtgccagggccacggggtcccatcccgtctggcatgcaaggaccttccccaattaacatgggcgctgtcgtgccacaggggagcagacaggtccctgttatgcaaggtactggtatgcagggagcctccatccagggagggagccagcctggggggtttagcccagggcagaatcaggtgacgccacaggaccatgaaaaagcggctctgattatgcaggtattacagttgacagctgaccagattgccatgctgccacctgagcagcggcagagcattctgattctcaaagaacagattcagaagtccactggagcaccttag

SEQ ID NO: 46164 - DNA, 786 bp, Artificial Sequence
  Description of Artificial Sequence: Synthetic coding sequence
atgcacggcgaggccagcgacggcgagggcgagggcgacaccgaggttatgcaacaggaaaccgtgccagtaccggtgcctagcgaaaagacaaagcaacccaaggagtgcttcctcattcagccgaaagagcggaaagaaaacaccaccaagacacgcaaacgccgtaagaagaaaattacagatgttctagcaaagagtgaacccaagccgggtctgcctgaagatctccaaaaactgatgaaggattattactcctcgcgcagattagtgatagaactggaggaactgaacctgcccgatagttgcttcttaaaggcaaatgacctgacccattcacttagctcatacctgaaagaaatttgtcctaaatgggtgaagctacgcaaaaatcactcggaaaaaaaatctgttctgatgttgatcatttgtagcagcgccgtgagagccctcgagctgattaggtccatgaccgcctttcgaggggacggcaaagtgataaagctcttcgcaaagcatatcaaagtgcaggcccaggtgaaactgctcgagaagagggtcgtacacctgggcgttggaaccccaggccgcatcaaggaattggtcaaacaggggggcttaaatctgtcaccactcaaattcctcgtgtttgactggaactggcgggatcagaagctgaggagaatgatggatatacccgagatacgcaaagaggtttttgagctgctagagatgggcgtgttatcactgtgcaagagcgaatcccttaagctgggtctgttttag

SEQ ID NO: 46165 - DNA, 732 bp, Artificial Sequence
  Description of Artificial Sequence: Synthetic coding sequence
atgagccccgaccagttcctgctgaccgtgagcgccctgcagcacgcacgcaattctggcgagttcgcatatccgtgtcgcccccagactgagatcaccgacgtctggggccctagcatcagctatcctaggaaagtgcttaatttcaagggtaagtccatccagcgcgcagttgatcgactccgtctctccaatccacccattgacgtgaagcgtaccagcattccacttgagatccagaagctgcagcccaacctgaaaatcagtctgcacagcccccgggcacaatcaaccattccagaacctatgattattcgaagcagattctcgggctccctgaagggcggcgatcaggtgacgtcaagcatagaacgcgcggtgtgtagcacagggcctctgacttcaatgcaggtgatcaaacccaataggatgctggcgccccaagtgggaacagccacgctatcgctaaagaaggagaggccaaggatctacacagccctggatccattccgggtaaatgctgagtttgttttgttgacggtgaaggaggagaaggagcatcaggaggcaaaaatgaaagaatatcaagcccgggaatctaccggcgttgtggacccggggaaagcatccaaagcggcttggataaggaagattaaggggttgcccatcgacaacttcacaaagcagggcaagactgctgccccggagctggggcagaatgtgttcatttag

SEQ ID NO: 46166 - DNA, 759 bp, Artificial Sequence
  Description of Artificial Sequence: Synthetic coding sequence
atggacctgtgcaagaaccggctggtgagcggcggccgggactgccaggtcaaagtgtgggacgtagacactggcaagtgcctaaaaacatttcgtcataaggaccctattctggccactaggatcaacgacacctacattgtctcctcttgtgaaagaggtttggttaaggtgtggcatatagctatggcccagctcgttaagaccctgagcggccatgaaggggccgttaaatgccttttcttcgaccaatggcatttgttgagcgggagcactgatggcctggtgatggcctggtccatggtcgggaagtacgagcggtgcttaatggctttcaagcatcctaaagaggtcctggacgttagcctgctgtttcttcgcgttataagcgcgtgtgcagatggcaagatacggatctacaacttcttcaacgggaactgtatgaaggtgatcaaggctaacggccggggagacccagtgctgtccttttttattcagggcaatcggatttcggtgtgccacattagcacttttgctaagaggattaacgttggctggaacggcatcgagccatctgccactgcccagggtgggaacgccagtctgaccgaatgcgcccacgttcgactccacatcgccgggcacttgcctgcttcaagactccccgtggcagccgtccaacccatgacaggaggcatggcgcccaccaccgcgccaacccatgtccttgcgatgctgattctcttcagcggggtctag

SEQ ID NO: 46167 - DNA, 2259 bp, Artificial Sequence
  Description of Artificial Sequence: Synthetic coding sequence
atggagaacctggagagccggctgaagaacgccccctacttccggtgcgagaaaggcaccgatagcattccactgtgcagaaagtgcgagactcgtgtgctggcatggaagatcttctccaccaaggaatggttttgtcggatcaatgacatcagtcaaaggcgattcctggtgggtattttgaaacagttgaattcgctgtacctcctgcattatttccaaaatatcctgcagacaactcaggggaaggattttatttataataggagtaggattgacttatccaagaaggaggggaaggtggtgaagtcaagcctgaaccagatgctggacaaaaccgtggagcagaagatgaaagaaatactgtactggtttgcaaatagcactcagtggaccaaggccaactatacactgttgttgttacagatgtgcaatccgaaactcctcctgactgccgcaaacgtgataagggttttgtttctgagggaggaaaacaacatctccggcctcaaccaggacatcactgatgtctgtttctctccagaaaaggaccacagctcaaagagtgccacttcacaggtgtattggactgccaagacacagcacacttccttgccactgtctaaagcccctgaaaacgaacattttttgggcgctgcttccaatcctgaggaaccttggaggaattctttgcgctgcatctcagagatgaacaggctgttttcgggcaaggccgatatcaccaaaccaggatacgacccttgtaatcttcttgtggatcttgatgatataagagatttgagcagtggcttctcaaaatatcgtgatttcatcaggtacctgcctattcacctgtctaagtacatcctgaggatgttagaccggcacactttgaataaatgtgcctcggtgtctcaacattgggcagccatggcgcagcaggttaagatggatctctcagcccacggctttattcagaaccagattacttttctgcaaggctcctatacccggggtatcgaccccaactacgcaaataaagtaagtatccctgtcccaaaaatggtagacgatggcaaatcaatgagagtaaagcaccctaaatggaagctacggacaaaaaacgagtacaacctgtggacggcctaccaaaacgaggagacacagcaagttcttatggaagaacgcaacgtattctgtggaacctacaacgtccgcatcctatccgatacgtgggatcagaaccgagtgattcactattccgggggtgacttgatcgcagtgagctctaacagaaaaattcatctactggacattatccaggtgaaagctatcccggtggaattcagggggcatgcgggctctgttagagccttgttcctttgtgaagaggaaaattttctgttgtcagggagctatgatctgagcatccgttattgggacctgaagtccggagtgtgtacccgtattttcggcgggcatcaaggcactataacttgtatggacctatgcaaaaatagactagtgtcaggaggtagggattgccaggtcaaggtatgggacgtggacaccggcaaatgtctgaagacattcaggcacaaagatcctattctggctaccagaatcaatgacacatacattgtgtcatcatgtgagcgcggcctggtgaaggtgtggcacatcgccatggcccagcttgtgaaaactttatctgggcacgagggagcggttaaatgcctattcttcgatcagtggcacctgttgtccggatccacagatggtctggttatggcctggtctatggtagggaaatacgaacggtgtcttatggcatttaaacaccccaaggaggttctggatgtgtccctgctgtttctgcgagtaatttctgcttgcgcggatggaaaaatacgcatctacaacttttttaatggaaactgtatgaaagtgatcaaagctaatggtcgaggcgaccccgtactgtccttctttatacaaggaaaccgaattagcgtgtgccacatctccacgttcgctaaaaggatcaatgtcggttggaacggcatagagccatccgcaactgcccaagggggcaatgccagcctcactgagtgcgctcacgtccggttgcatatcgcagggcacctgccagctagccgcctgcccgtcgctgctgtacaaccaatgacagggggaatggccccgacaacagcacccacacacgtgttagccatgctcatcctgttctccggcgtctag

SEQ ID NO: 46168 - DNA, 567 bp, Artificial Sequence
  Description of Artificial Sequence: Synthetic coding sequence
atgttcagctgctgcttccccaccagccggggctgctgcttccggaatggaggcagcgagtccctgttcaggcgatgccggagacgcttaataccccaccctcgtcggctgagccctgttgtaatcagacgcattcaagtccctcaggactccctgggacaggcacttgcggggcaggctactcccgagatccccctggggctgcagctgcacacggtgctcgttcaagagatacaggagcttattgaggcacagactctggccccgggcccctgcgctgaagttagagcgctgcccgctcccgctgccgaacctgagcctgcctgggaagaagcccctcccgagcgtgcgctggaacttgagggcgcaccagcgaaggatcaaaccaatgaggaattaccggagattaccgaggtccctgagagcataaaacgcaggctgggccgacgtgtgcccgccgctactccagctccacgcggaaatctgttgctgcaggcgtggatgcgggttcattcctgggccagccggcttttcgcccccaacgtgctgccagggaccggcccttag

SEQ ID NO: 46169 - DNA, 369 bp, Artificial Sequence
  Description of Artificial Sequence: Synthetic coding sequence
atgcccaagaaggcccaccccagcccccagacccccgtggcccggtgcaacaaggcccaccccgccccgggtccctgtgcagaagtgagagctttgcccgctcccgctgccgaaccagaacccgcatgggaagaggcccctccagaacgcgctttggagctggagggggcgcctgcaaaagatcagacaaacgaggaactacctgaaataaccgaagtgcccgaatccattaaacggagactgggcagaagagtccctgccgccacaccagctccaaggggtaacctcttgctccaggcatggatgagagttcacagttgggcctctagactgtttgctcctaatgtactgccaggaactggaccatag

SEQ ID NO: 46170 - DNA, 846 bp, Artificial Sequence
  Description of Artificial Sequence: Synthetic coding sequence
atgttcagctgctgcttccccaccagccggggctgctgcttccggaacggcggatccgagagtctcttcaggcagtgtcggcggcgtcttatcccccacccgaggaggctgtggcccttcgttaggcggaggacacaagtacctcaagacagccccggtcaggcactcgctgggcaggctacccctgaaataccgtccgggctgcctctgcacattgtgcttgttcaagaggagatccgtgagccaatggaagctcagacccacgcccccggtccttatgccgacatcgcggccctagccgcaccagccgtagagcccaagcccgcctgggaggagcctccaccggagagggccttagaagttgagggggctccagcaaaagaccagccatctcaggagctgcccgaaattatggcccccaccgtggctaccgggcttaacgcaggggcggaaaatgtagcaggcgagcggagtggacgagagggagtgacctctaccgcccccgcctctagaagtcatgcagctccgtcccccgggcatggtgggaagcacgggggaggtgatcagggcatacaaactggcctcctctacctggctggagagaggttactgagtttcgccggaaccactgcattactcctgcaggggttatttatcgtgctcatcctggtaggttacatctccgtgaaagtgatgctgaagagcattaaaactagactgggcagacgcgtgccagccgccccacctgcactgcggagaaacctgctgctacaagcctggaagtgtgtgtgtaattgggcatcccgtctttttgctcctaacgtactacctcgcaccggttcatag

SEQ ID NO: 46171 - DNA, 456 bp, Artificial Sequence
  Description of Artificial Sequence: Synthetic coding sequence
atggacgcccggcggatgaagaaggagggcctgaccgagaacaccggcctgcctagaaagctgctggagaagcacgatccttggcctgcttacgtgacatacacaagccaaaccgtcaagagactgattgaaaagtctaaaacgcgcgagttggaatgcatgcgtgctctggaggaacgcccatgggccagccgacagaataaaccttccagcgtgatacaacccaagcgtcgtaagagtagtaagagctcggggaaggcggtttttcgggacacgcttagtgaatctactctgagcatgtggggagcttactccgtccttgcaatggcacccactatgattcccgagcccacccatttgcatgcggactctagagattgccccaccgaaaattataacaaaatcatcttcgcacgcaaacccatgatgcggatgttacctaccgtaaggtactag

SEQ ID NO: 46172 - DNA, 459 bp, Artificial Sequence
  Description of Artificial Sequence: Synthetic coding sequence
atggacgcccggcggatgaagaaggaggagggcctgaccgagaacaccgggctaccccgaaagctgctcgagaagcacgatccatggccggcctacgttacctacacctcccagacagttaagcgcttgatcgagaaatctaaaaccagagaactggaatgtatgagagcccttgaggaacgcccctgggcctcaagacagaacaaacccagctcagtaatccagccaaagcggcgaaaatcttctaaaagctctggcaaggccgttttcagggacaccctgagtgaatctactctgtccatgtggggggcatactctgtcctggctatggccccaaccatgattcccgagcctacgcatctgcacgccgactcacgagactgtccgaccgaaaattacaataagatcatctttgcaaggaagccaatgatgcgtatgctgccgactgtgaggtattag

SEQ ID NO: 46173 - DNA, 75 bp, Artificial Sequence
  Description of Artificial Sequence: Synthetic coding sequence
atggacgcccggcggatgaagaaggaggagggcctgaccgagaacacaggactgcctcgtaaactattggagtag

SEQ ID NO: 46174 - DNA, 627 bp, Artificial Sequence
  Description of Artificial Sequence: Synthetic coding sequence
atgcagcggcccgagtggccccggccccaccccggcgagggcgccgccgctgccgggcggggccccgctcctccggcccgagccggggagccttcgggtctgaggctgcaggagccttctttatatactataaaagctgtgtttattctggataacgacggaagaaggttactggccaaatactatgacgacactttcccttcaatgaaggagcagatggtattcgaaaaaaatgtttttaacaaaacatcacggacagagagtgagatcgctttcttcgggggtatgaccatcgtttataagaatagcattgatcttttcctatacgtggtggggtcctcatacgaaaatgaactcatgctcatgtccgtgctcacatgcctctttgaatcactcaaccatatgcttagaaagaacgttgaaaaaagatggctgctggaaaacatggatggggcctttctggtgctggatgagatagtcgacgggggcgtgatactggagagtgacccgcagcaagtcattcaaaaggtgaacttccgagccgatgatggggggctgacagaacaatcagtggcgcaggtgctgcagtcagcaaaggagcagatcaaatggagcctgctcaagtag

SEQ ID NO: 46175 - DNA, 3702 bp, Artificial Sequence
  Description of Artificial Sequence: Synthetic coding sequence
atgccccccagctggagccccctgatgtgcggccgggccgccgaggctgcggcaagctcaaggacaccaggtcgtgagatgggtcaagcagtgacccgacgactgggtgccggcgccagagctgcccctcgccgcgccatggatggacgaacacctcggccccaagatgcccctgctaggcgggagattgccggttcgtggcgcaaaccaaaggccaaagcccctctccctccagctgagactaaatacaccgacgtgtccagtgctgccgatagcgtcgagagtacagcgttcatcatggagcagaaggagaacatgatcgacaaggatgtcgaactgtcagtggtgttacctggggatatcatcaaatccactacagttcatggatcaaaacctatgatggacctgctgatcttcctgtgcgcccagtaccatctcaaccccagtagctacaccattgatctcttatccgctgaacagaaccatatcaagttcaagcccaacacgcctattgggatgctggaagttgagaaggttatactgaaaccaaagatgttagataaaaagaaacccacaccaattatcccagagaagacagtcagggtggttattaactttaagaagacccaaaagacgatcgtgcgggtatcacctcacgcatcattacaggaactggcccccatcatatgtagtaagtgtgagtttgaccctctccatactttgctgttgaaagactatcagtcgcaggagcctctggacctaacgaaatcgctaaacgacttaggcttacgggagctgtatgctatggatgtgaatcgcgcgacctctgttactgtattttcgaaaagcagtctccaagaaagctgccagatcagtcagaacctggacatcatgaaagaaaaggaaaataagggtttttttagcttcttccaacggtccaagaagaagagagatcagacggcttctgcacctgccactccactggttaataaacaccgccctaccttcactcggagcaatacaatctccaaaccctacatttctaacactcttccaagcgacgcccctaagaagaggagggctcccctacccccgatgcctgcatctcagagcgttcctcaggatttagcccacattcaggagagaccggctagctgcatcgtcaaaagcatgtcagtcgacgagacggacaagagcccctgtgaggccggcagggtcagggctggttccctgcagctgagctctatgtccgcgggcaatagttcacttagaagaactaagagaaaggccccctcccccccaagcaaaatccctcctcatcagtcagacgaaaacagcagggtaaccgcactgcagccagtcgatggagttccacccgattctgcaagtgaagctaacagtccagaagaattgtcctcacctgagacatttcacccagggcttagctcacaagagcagtgtacagctccgaagctgatggaagagaccagcgtgttcgagtgccccggcactccagaggccgctatcacctccttgacatctggcatcagttcagattactcattggaagaaattgatgaaaaagaagaactgtctgaagtgccaaaagtagaggccgaaaacataagtcctaagtcccaggacatccctttcgtgagtactgatatcattaacactcttaagaacgatcccgattcagctttgggaaatggatcaggtgaattcagccagaacagcatggaggaaaagcaggaaaccaagagcaccgacggacaggagccccatagcgttgtctacgatacctccaacggtaaaaaggtggtcgactctatcaggaatttaaaatcactcggtcccaatcaggagaatgtagtccagaatgaaatcattgtgtacccagagaatacggaagacaacatgaagaacggcgtcaagaagacagaaattaatgtggagggtgtggccaagaacaataatatcgatatggaggtcgagaggccctccaattcagaagctcacgaaacggatactgccatcagctataaggagaatcatctggctgcgagctccgtgcctgatcagaagctaaatcagcccagtgccgagaagactaaagacgccgctatacagacaacaccctcttgtaactcctttgacggcaagcatcaggaccataacttatctgactctaaggtcgaggagtgcgtccagacttctaacaataatatctccacccaacactcctgcctgtcctcccaggactctgtcaatacgtcccgggagttccgctctcagggcacacttattatccacagcgaggaccccttaacagtcaaagacccgatttgcgcccatgggaacgatgacttactcccaccagtagatcgaatagacaaaaattctaccgcttcctacctaaaaaattaccccctgtacaggcaggattacaatcctaaacccaaacctagtaatgaaattacgcgggaatacatacccaagattgggatgacaacctacaaaatagtcccccccaagagcctagagatctctaaagactggcaatccgaaaccatagaatacaaggacgatcaggacatgcacgctctcggtaaaaagcacactcatgagaacgtgaaagagacagccattcagacagaagactccgccattagtgagtcccccgaagagcctcttcccaacctcaagcccaaacccaatcttagaactgagcaccaggtgccttccagcgttagtagcccggacgatgccatggtttctcctctcaaacctgctcccaagatgaccagagataccggaaccgccccgttcgcccccaatctcgaagagataaataatattttggagagcaaatttaaatcccgggcttctaacgcccaggcaaagccaagcagttttttcctgcagatgcagaagagagtgtccggtcattatgttacatctgccgcggccaagtccgtacatgcggcccctaacccagctccgaaggaactgactaacaaagaagccgaaagggacatgctcccaagcccggagcagacgcttagccccctttccaaaatgccccattcagtgcctcagcctttggtggaaaagactgatgatgatgtgatcggccaagcgcccgcagaggcatcaccacctcccattgcccccaagcccgtgacgatccccgctagtcaggtttcaacccagaacctaaagacactgaaaacctttggagcaccacgcccgtattcaagttcaggacctagcccctttgccttggctgtcgtgaaaaggtctcagagctttagcaaagagaggaccgaatctccaagcgcaagtgctctggtgcagccacctgctaatactgaggaagggaaaacacacagcgttaacaaattcgtagacattccgcagttaggggtgtctgacaaagagaacaactcagcgcacaatgagcagaattctcagattcccacccctactgacggcccgagcttcactgtgatgcggcagagttcactgacattccaaagctctgatcctgaacagatgcgacagtccctgctcacagcgatcagaagtggggaggcggccgccaagctcaagagggtgactattcccagtaatacaatcagcgtgaatggacggtctcgcctgtcccacagcatgagccctgacgctcaggatgggcactag

SEQ ID NO: 46176 - DNA, 3501 bp, Artificial Sequence
  Description of Artificial Sequence: Synthetic coding sequence
atggacggccggaccccccggccccaggacgcccccgcccggcggaaacccaaggctaaggctcccttgccacccgcggaaaccaaatacactgatgtctcttcggcagctgattcagtggaatctactgcatttatcatggaacagaaagagaatatgatcgacaaagacgtggagttgtctgttgtgctgcccggggatattattaaatcaacgaccgtacacgggagtaaacccatgatggatctgctgatctttctgtgtgcacagtaccacttaaacccctctagctataccattgatctgttatcagcggaacagaatcatatcaagttcaagcccaacacaccaattggcatgctggaagtggagaaggttattctgaaacccaagatgttagacaagaagaagcccacccccattattccagagaagactgttagagtagtcataaacttcaagaagacccagaaaaccatcgtgagagtgagccctcacgcaagcctgcaggaattggccccgataatctgcagtaagtgcgagtttgatccactccatacacttcttttaaaagattaccaatcccaggaacctctagacctgaccaaatccctaaacgacctgggactacgagagttgtacgcaatggacgtaaatagagaatcatgccagatatctcagaacctcgatattatgaaggagaaggagaataagggattcttttcattttttcagcgatcaaaaaaaaaaagagatcagaccgcttcggctccggccacccctctggtcaacaaacaccggccaaccttcactaggagtaatacaatatctaagccttacatctctaacacgctgccgagtgacgcacccaagaaacgacgagctccgctcccgcccatgcccgcttcacagagtgtccctcaggatctcgctcacatccaggagcgccccgcctcatgtatagtgaaaagcatgtctgtggacgaaacggataaatctccctgcgaagcgggccgggtccgcgctggttcattacagttgagcagtatgagcgcgggtaattcgagcctacggcgcacgaagagaaaagcgccgtctcccccaagcaagatccccccccatcagtccgatgaaaattctcgagtcactgcactccaacctgttgacggcgtgccccctgacagtgccagtgaagctaattccccggaggagctctcttcacccgaaacctttcacccaggtctgagtagccaagagcagtgtactgctcctaagctcatggaagagaccagcgtctttgaatgtcccggcaccccggaggctgctattaccagtttgacatcaggaatatcatcggactattcactggaggaaatcgatgaaaaagaggaactctcggaggtgccaaaggttgaggccgagaatatctctccaaagtcccaggacatcccatttgtgtcaactgacatcattaacacattgaagaatgatcctgacagcgccctgggtaatggatctggggagttttcgcaaaatagtatggaggaaaaacaagaaaccaagagcaccgatggccaggagcctcattcagtagtttacgacacttcgaatgggaaaaaagtggtggactctatccgcaatcttaagagtctcggcccaaaccaggaaaacgtccaaaacgaaataattgtgtaccctgagaacactgaagacaacatgaagaacggcgtgaaaaagactgagataaatgtggagggcgtagcaaaaaacaataacatcgacatggaagtggaaaggccaagcaattcagaagcacatgaaacagacacagccataagctacaaggagaatcatcttgcagcctctagcgtgccggaccagaaattgaatcagccttcagctgaaaaaacaaaagatgcagcaatccagaccactccctcttgtaattcctttgacggcaagcaccaggatcataacctctcagactctaaggtcgaagagtgtgtgcagactagtaacaacaacatatcgacacagcattcatgtctgtcttcacaggactcggtcaacacaagcagagaattcaggtcccaagggacactaatcatccatagcgaggaccccttaacggtgaaagatccaatatgcgcacatgggaacgacgacctactgccacctgtggacaggatagataagaacagcaccgcctcttaccttaaaaactacccattataccgacaggattataatcctaaaccaaagccatcaaacgaaattacgcgcgagtacatccccaaaatcggaatgaccacctataaaattgtgccccccaagtcactggagatcagtaaggactggcagagcgaaaccattgaatacaaggacgatcaggacatgcacgcgctcggaaagaagcacacacacgagaatgtcaaggagactgccatacaaaccgaagactccgccatttcagagtcccccgaggagccgctgcccaacctcaagcctaagcccaacctgaggacggagcatcaggtgccctcttccgtgtcaagtcccgatgacgcgatggttagtccactcaagccagcaccaaaaatgacccgggataccgggacagcaccgtttgctcccaacctcgaagaaattaataacatcctagaaagcaaattcaagtctcgcgcaagcaatgcccaggccaaaccatctagcttcttcctgcagatgcaaaagagggtctcaggccactacgtaacttccgcagccgccaagtccgtgcacgcagcccccaaccccgctccaaaagagttgacaaacaaggaggccgaacgcgacatgctcccttccccagaacagacactctcgcctctgagcaaaatgccccacagcgttccccagccactcgtagagaaaacagacgatgacgtgattggccaggccccagcggaggcttcccctcctccaatcgcaccaaagcctgtaactatacctgcctctcaggtgtccactcagaacctgaagacactgaagactttcggggccccaaggccctacagctcttctgggccaagtccctttgccctcgctgtagtgaaacgatcacagtccttctctaaggaacggactgaatctccttcagcctccgcgctcgtgcagcctcccgctaacacagaagagggtaaaactcattcggtcaataagtttgtcgatattccacaactaggagtgagtgacaaagaaaacaattctgcacacaacgagcagaactcacaaatcccaacccccaccgatggcccatcgttcacagtgatgcggcagtcatcacttacttttcagtcaagtgacccggagcagatgcgacagagtctcctgacagccattagaagtggcgaagcagcagcaaagctgaagcgggtgacgatcccctcaaacacaatatccgtcaatggaaggtcacgactcagtcactcaatgtcacccgacgcacaggatgggcattag

SEQ ID NO: 46177 - DNA, 3387 bp, Artificial Sequence
  Description of Artificial Sequence: Synthetic coding sequence
atggacggccggaccccccggccccaggacgcccccgcccggcggaagccaaaagccaaagccccgctgccccctgctgagaccaagtacactgacgtatcctctgccgccgattccgtggaaagtacagcatttatcatggaacagaaagagaacatgatagataaggatgtggaactgagtgtggttctgccaggtgacattatcaagtctacaactgtccacggaagtaaaccgatgatggatttattaatatttttatgtgcccagtatcatctgaacccttcatcctacacgatagacctgttatcagctgagcagaatcacattaagttcaaacccaacactccgatcggcatgctggaggtggagaaagtgatactgaaaccaaagatgttagataagaagaagcccactcccatcatccccgaaaaaactgtccgcgtcgtcatcaactttaagaagacacagaagacgatagtgcgtgtgagtccgcatgcctcattgcaggagctcgcccctatcatatgctccaaatgtgaatttgatcctttgcatacgctgcttctgaaagattaccaatcccaggagccgctggacttgacaaaaagcctcaatgatctgggattacgcgaactctacgcgatggatgtgaacagagaatcttgtcagatttcacagaatctggacatcatgaaggagaaagaaaacaaaggcttcttctcgttttttcagcggtccaagaagaagagggatcagaccgcatccgcaccagccacccccttagtaaacaagcatagacccactttcacacgaagcaacacaatatccaaaccttacatctctaacacgctgccatcagatgctcctaaaaagaggagggctccgctcccccccatgccagcatcccaaagcgtgccccaggacctggcccatattcaggaacgcccagctagttgcattgtcaagtctatgtctgtggatgaaaccgataaaagcccctgtgaggcaggaagggtgagagctgggtctctgcaactgagctcaatgagtgcgggcaatagctccttacgccgtactaagagaaaagccccctcccccccgagcaagatcccacctcatcagagcgacgagaatagccgcgtgaccgccctgcagcctgtggatggggtgcctcccgacagtgcgtcagaagcaaactcccctgaggagctaagttctcctgctggcatcagctcggactactcattagaggaaattgacgaaaaggaggaactaagcgaagttcccaaagtcgaggccgaaaatatctcacctaagtcacaggacattccatttgtctcaacagatatcataaacactttgaaaaacgatcctgatagcgcactggggaacggatctggcgaatttagccagaatagcatggaggagaaacaggagaccaagtcaaccgatgggcaagaacctcattccgtcgtctacgatacatccaacgggaagaaagttgtggattcaataagaaacctgaaatcacttggcccaaaccaggagaatgtcgtgcagaatgaaattatagtgtatcctgaaaacacagaggataatatgaaaaatggggtgaagaaaaccgagatcaacgtcgaaggcgtggcaaaaaataacaacattgacatggaagtggagcgcccatccaactctgaggcacacgagaccgacaccgccatctcttacaaggagaaccacctggccgcctcttccgtccctgatcagaaattaaaccagccttcagctgaaaaaaccaaagatgccgcaattcagacaacaccctcctgcaacagcttcgacggtaagcaccaggatcacaatctctctgattcgaaggtggaggagtgtgtgcaaacctctaataataatatatcaactcagcatagctgtctcagctcacaagatagtgtcaatacatcaagagagttccggtctcaaggaactttgattattcattccgaagaccctttgactgttaaggacccaatttgcgcccacgggaacgatgacctattgccccctgtcgaccggatcgataagaacagcactgcctcatatctcaaaaactacccgctgtatcggcaggactataaccctaagcctaagcccagcaacgagatcactcgtgagtatattcctaaaattggcatgactacttacaaaatcgtgcctccgaaatcattagagatttccaaggactggcagtctgagactattgagtacaaggatgatcaggacatgcacgcactggggaagaaacatactcacgagaacgtgaaggaaacagcaatccaaactgaagactccgctatctcagagtcccccgaagaaccgcttcccaacctaaagcctaaacctaatcttcgcactgaacatcaggtgccctcctcagtctcaagcccagatgatgctatggtgtcccctctgaagccagctccgaaaatgacgagggacacgggtaccgcaccttttgctccaaatctggaggagatcaacaacatcctggagtccaaattcaaatctcgagcatccaacgctcaggctaagcctagcagcttctttctccagatgcaaaagagagtgtcaggtcactacgtcacgagcgcggccgcaaagtcggtacatgctgcacctaaccccgccccgaaagagctgaccaacaaggaggccgaaagagatatgcttccaagcccggaacagacactgagcccactatcgaagatgccgcacagcgtgccacagcccctggtcgaaaagacggatgacgacgttataggtcaagctcctgctgaggcaagtcctccccctatcgcccccaagcccgttactattcctgcgtcccaggtgtccacacagaatctcaaaacgcttaagaccttcggagctccacgcccttattctagttccggcccctccccgttcgcgttggctgttgtcaaaagatcccagagcttttcaaaggagagaaccgaatccccttccgcatccgcccttgtacagcccccagcaaatacggaagagggcaagacccactccgtgaacaaattcgtggacatcccccaactcggcgtgtctgacaaggagaacaattctgctcacaatgaacaaaactcgcagatcccaactccgactgacggtcctagcttcaccgtgatgagacaaagctctctcacattccagagttccgatccagaacagatgcgccagagcttgctgacagccatcagatcgggggaagccgctgctaaattaaaacgcgttacaatcccaagcaacaccatctccgttaatggaaggagccggctgtctcactccatgagccctgatgctcaagacggccactag

SEQ ID NO: 46178 - DNA, 3615 bp, Artificial Sequence
  Description of Artificial Sequence: Synthetic coding sequence
atgtgcggccgggccgccgaggccgccgccagcagccggacccccggccgcgagatgggccaggctgtcacccgccggctgggtgcaggggcccgtgcagcgcctcggagggctatggatggccgcacccctcgccctcaagacgcccctgcacggaggaagccaaaagctaaagcccccctgccgcccgcagaaaccaaatacaccgatgtatccagtgctgccgatagtgttgaaagcaccgcctttattatggaacagaaagaaaatatgatcgataaggatgtcgaactctcagtcgtgctacctggggatattataaaatccacaactgtccacggtagtaaaccaatgatggatctgctaatcttcttgtgcgcgcagtatcatctcaatccgtccagctacactatagacctcctgagtgctgagcagaaccatatcaagtttaaaccaaatactcctatagggatgctcgaagtggaaaaggtcatcctgaaaccaaagatgctggataaaaaaaagcccacaccaattatcccagaaaaaactgtacgcgtggtgatcaactttaagaaaacccagaaaacaattgtaagggtatctccccacgccagcctacaagaactggcgccaatcatctgttcaaaatgtgaattcgatccattgcacaccttgcttctaaaagactaccagtcacaggagccgctcgacctcacaaagagccttaacgacttgggactcagggagctgtacgcaatggacgtcaaccgggaatcctgccaaattagtcagaacttggacattatgaaagagaaggagaataagggatttttctcattctttcagcgctctaaaaagaagcgtgaccagactgcttcagcccccgccacaccgctggtgaataagcaccgcccaacctttactagaagcaacaccataagcaagccgtacatctccaatactcttccttctgacgcccccaagaaacgaagggcgccactgccccccatgcctgcatcacaaagcgtcccccaagacctggcccatatccaggaacgaccggcctcctgcatagtcaagtcaatgagcgtggacgagaccgacaaatctccatgcgaggccgggagagtcagagctgggtccctccaattgagttccatgtcagcaggaaattcatcgctgaggaggaccaagaggaaggctcccagcccaccttccaagattcccccccatcaatctgatgagaatagtcgtgtcaccgccctgcaaccagtggatggggtcccccctgattctgcaagtgaggccaactcccccgaagaactcagcagcccagagacctttcatccaggactgtcgagccaggagcagtgcactgcaccaaagcttatggaagaaacctcagttttcgagtgtcccggaacccccgaggcagccatcacttccctgacctctggaatctcaagtgactatagtctggaggagatagatgaaaaagaggaactctctgaagtcccaaaagtggaggctgagaatatcagtccgaaatctcaggatatcccttttgtaagcaccgacattattaacactctcaaaaacgatccagattctgcactgggcaatggtagcggagagttttcgcaaaactctatggaggagaagcaggaaacgaagagcacagacggccaggagccccatagtgtggtgtatgataccagcaatggaaagaaggtggtggattccattagaaatctcaaatcgctgggaccgaatcaggagaatgttcagaacgagataatagtttacccggaaaatacagaggataatatgaagaacggcgtcaagaaaacagaaattaatgtcgagggagtggctaaaaataataacattgatatggaggtagaaagaccttctaacagtgaggcccacgaaactgataccgccattagctacaaggaaaaccacttggccgcttccagcgtacctgatcaaaaacttaatcagccatccgccgagaagactaaggacgccgctatacagaccactccgtcttgtaattcattcgatggaaagcaccaggatcataacttgtccgactccaaagtagaggagtgtgttcagacttccaacaacaacatatcaactcagcactcgtgcttgagctcccaggattcggtcaatacaagtcgtgagtttcgtagtcaaggaacgctgataatacacagcgaagatcctcttaccgtcaaggaccctatctgcgcgcatgggaatgacgacctccttccacccgtcgaccggattgataagaattctaccgcatcttatctgaaaaactatccactgtataggcaagactacaatcccaaacccaagccgtccaacgaaattacccgggaatacattcctaaaattggcatgacgacttataaaatcgtgcctccaaagtcccttgaaatatcaaaggactggcaatctgaaactatcgagtacaaggatgaccaggacatgcatgctctgggcaagaaacatacccacgaaaacgtgaaggagaccgccattcaaacagaagatagcgcgattagcgagtccccagaagaacctcttcccaacttgaaaccaaaaccgaacttaagaactgagcaccaagtcccatcgtcggtttcttctccagatgacgcaatggtgagccccctgaagccggcacccaagatgactagagacacaggcacagccccatttgcaccgaatctagaggaaatcaacaatattctcgaatcgaagttcaaatcccgggccagcaacgcacaggcgaagccctccagcttcttcctgcaaatgcagaagagggtgagtggccactacgtgacgagcgccgctgccaaatccgttcatgccgcgccgaaccctgcgccaaaagaactgacgaacaaggaagctgagcgagacatgctgccctccccggagcagacgttatcccctctgagcaaaatgccccactctgtgccgcagcctttagtggaaaagactgatgatgacgtgatcgggcaggcaccagctgaggcatcaccccctcccatagccccgaagcctgtcacaatcccagctagtcaggtgtccacacagaacctgaagacgctcaagacctttggcgccccccgcccgtattctagtagtggtccaagcccatttgcactggcagtagtcaaacgcagtcagtctttttctaaagagcgcaccgaatctccttccgctagtgccttagtccaaccaccagcaaatactgaggaaggaaagacccactccgtgaacaaatttgtggacatcccccagcttggggtgtctgacaaggagaacaatagtgcacataatgaacagaactcacaaattcccactcctacagacggcccttctttcaccgtgatgaggcagagctccctgactttccaatcctccgatccggaacagatgcgccagtccctgttaacagctatccgttccggagaagccgccgccaaacttaagcgggtgactattccgtctaacaccattagtgttaatgggaggtcaaggctttcacactctatgagtcctgatgctcaggatggtcactag

SEQ ID NO: 46179 - DNA, 3501 bp, Artificial Sequence
  Description of Artificial Sequence: Synthetic coding sequence
atgtgcggccgggccgccgaggccgccgccagcagccggacccccggacgcgagatgggacaggctgttaccagacgcctaggagcaggggctcgtgcagccccacgaagggccatggatggacgcactcctcggccccaggatgctccagcacgccgcaaaccaaaggcaaaggcacctttgcccccagcagagacgaagtacaccgacgtgagctccgctgcggattctgttgaatcaactgcgtttatcatggagcaaaaggagaacatgattgataaagacgtcgagctatctgtggtgctcccaggagatattattaaaagtacaaccgtccatgggagtaagccgatgatggacttactcatcttcctgtgcgctcagtaccatctcaacccaagctcatatactattgatctgttatcagctgagcagaaccatattaagttcaaaccaaacactcctattgggatgctggaggtggaaaaggtcattctaaaaccgaagatgctcgacaagaagaagcctacccctatcattcctgagaaaaccgtccgggtggtgatcaattttaaaaagacccagaagacaattgtgcgtgtaagccctcacgcatcgcttcaagagctggcccccattatctgctcaaaatgtgagttcgatcctctacatacacttctgctgaaggactaccagtctcaagagccgcttgatttgacaaagagcttgaacgacctgggcttgagagaattatacgctatggacgtgaaccgcgagtcgtgccaaatcagccaaaatcttgatataatgaaagagaaagaaaataaggggtttttcagtttcttccagagaagtaagaagaaaagggatcagactgcgtctgcccccgctaccccactcgtaaataaacatcggcccaccttcacaaggtccaatacgattagcaaaccttatatatctaataccctgccttcagacgcacccaaaaagcgcagagcgcctttacctcctatgcctgcgtcccagtcagtaccacaggaccttgcccatatccaggaacggcccgcatcctgcatcgtgaaaagcatgtcggtggatgagactgacaagtcgccatgtgaggctggtagagtgagagctggctccctgcagctttcctctatgagcgcaggaaacagttctctccggcggaccaaaaggaaagcgccatcaccaccatcaaagatacccccacaccagagcgatgagaacagccgggtgactgccctgcagccagtcgacggcgtaccaccagattcagcctcagaggccaactcccccgaggagctgtccagcccagccggcatctcctccgactattctttagaagaaatcgatgaaaaggaagagctgagcgaggtccctaaggtggaggctgagaacatcagccctaagtctcaggacatcccatttgtgtctactgatataataaacacccttaaaaatgaccctgacagcgctttaggcaatggctccggagaattttctcagaacagcatggaggagaagcaagaaacaaagtcgactgatggacaggagccgcatagtgtggtgtatgacacttccaatggcaagaaggtggtagactcaattcgtaatctgaagagtctgggccctaatcaggagaacgtggtgcaaaatgaaatcatcgtgtacccagagaataccgaagacaatatgaagaatggggtgaaaaagacagaaatcaacgtggagggcgtcgccaagaacaacaatatagacatggaggtcgagcgcccgagcaactctgaggctcatgagaccgacaccgccatatcttacaaggagaaccatctcgcagcctcctccgtgccagaccagaagctcaaccagccttctgccgaaaagacaaaggacgctgccattcagacgactccgagttgtaattctttcgatggcaaacatcaggaccacaaccttagcgacagtaaggttgaggagtgcgtgcagacttcaaacaataatatttccactcaacattcatgcctgagcagccaagatagtgtcaatacttctagagaatttcgctcacagggcactcttattattcacagcgaggaccccttaaccgtgaaagatcccatctgtgcacacggcaacgacgacctattaccacctgttgaccggatcgataagaactccacagcaagctacttgaaaaattacccattatataggcaggactataatccaaagccgaaaccctcgaatgagattactagggaatacatcccaaaaataggcatgaccacttataagatcgtccctcctaaatctctggaaatctctaaggactggcaaagtgagactatcgagtacaaggacgaccaggacatgcacgctctcgggaagaagcacacacacgaaaacgtcaaggaaacagcgatccagacggaagactctgccatcagtgaaagcccagaggagcctcttccaaacctaaagcctaaacccaatctgcggaccgaacaccaagtgccatctagcgtctcttcacctgacgacgctatggtcagtccgctgaagccggctccgaagatgacgagagacaccggtactgctccgtttgctcctaacctcgaggagattaataacatcctggaaagtaagttcaaatctcgtgctagcaacgcacaggctaaaccttcctcgttttttctacagatgcagaagcgtgttagcgggcactacgtcacctccgcagcggccaaaagcgtgcacgcagcaccaaaccctgcccccaaagagctgaccaacaaagaggcggagcgcgatatgctcccctcccctgaacagacactgagcccgctgagcaagatgcctcattccgtccctcagccattggtggagaagaccgacgacgatgtgattgggcaagctccagccgaagcttccccaccaccaatagcccctaagccagttacaattccagcctcacaggtgtctactcagaaccttaagaccttgaagacttttggtgcgcccaggccatactcttcttccgggccctccccgttcgcactagccgtcgtgaaacgttcccagtcattttccaaagagcgaacagagtcaccgtccgcatcagccctcgtgcagcccccagcaaacaccgaagagggcaaaacacactcagtgaacaaattcgtcgacatccctcaactgggagtgtcagataaggagaacaattctgcccacaacgagcaaaattcccagattcccactcccacagatggcccgagctttactgtcatgagacaaagcagtctgacctttcagtcttccgaccctgaacagatgcgccaatcccttctcactgccatacgctcaggagaggccgccgcaaaactgaagcgcgtcaccattcctagcaacacaatctcagtcaacggaaggtcaaggctgagccactctatgtcccccgacgctcaagacggacactag

SEQ ID NO: 46180 - DNA, 420 bp, Artificial Sequence
  Description of Artificial Sequence: Synthetic coding sequence
atggacggccggaccccccggccccaggacgcccccgcccggcggaagcctaaggccaaggctcccttaccgccagcggaaactaagtataccgacgtgagcagcgcggccgactccgtggaatctactgcattcatcatggaacagaaggaaaatatgatcgataaggacgttgagctttctgtcgtcctccccggggatatcatcaagagcactactgtgcacggctccaaaccgatgatggatttgctgatctttctgtgtgctcaataccaccttaaccccagcagttataccatcgacttattgtctgccgaacaaaatcacattaaatttaaacccaatacgcccattggtatgttggaggttgaaaaggttattctcaaaccgaaaatgttagacaaaaagaagccgacctag

SEQ ID NO: 46181 - DNA, 474 bp, Artificial Sequence
  Description of Artificial Sequence: Synthetic coding sequence
atggacggccggaccccccggccccaggacgcccccgcccggcggaagccaaaggccaaagccccactgcctccagcagagactaagtacactgatgtgtcgagcgctgcggatagtgtggagtccaccgcttttatcatggagcaaaaagagaatatgatcgataaagacgtggagctgagtgtggtgctgccaggcgacatcatcaaaagcacaactgtgcacggcagtaaacccatgatggaccttctcatctttctctgtgcccagtaccatttgaacccaagtagctataccatcgatctcctgtcagctgagcagaaccatataaagtttaagccaaacactcctatcggaatgctagaggtcgagaaggttatcctaaagcccaagatgcttgataaaaaaaagcccaccccaatcatcccggagaaaaccgtcagggttgtgattaacttcaagaaaacacagtag

SEQ ID NO: 46182 - DNA, 1080 bp, Artificial Sequence
  Description of Artificial Sequence: Synthetic coding sequence
atgtacttcaagcgggccccccgggccttccccgtgctgctgaccggagccggaaaaaccactctgcttaattatatcctcaccgagcagcacagcaaacgggtggccgtgattttaaatgagtccggcgaggggagtgctcttgagaagagcctggcagtttctcagggaggcgagctatacgaggagtggttggaactgcggaacggatgtttgtgttgttcagtgaaagataacggtctgagggcaatagagaacttgatgcaaaagaagggcaaattcgacgatattttgcttgaaacaaccggtttggcggacccaggagccgtcacttccatgttctgggttgacgccgagctgggatcagacatctatttagatggtattattactatagtcgattcgaagtacggcttgaaacatctgacagaggagaaaccagatgggctgattaacgaggctacccgccaggtggccctggccgacatcatactcattaacaaaactgatctcgtaccagaggaagacgttaaaaagctgagaacaaccatcaggtccattaatgggttgggtcagatcctggaaacccaaaggagccgcgtggacctgtccaacgtgttagatctccatgccttcgattccctgagtgggatctccttacagaaaaagttgcagcacgttccgggcacccaaccccatctcgaccagtctatcgtcaccatcactttcgaagtgccaggaaacgctaaagaggaacatttgaacatgttcatacagaacctgctgtgggaaaaaaatgtgcggaacaaagataaccactgcatggaagtgattagacttaagggactggtcagcataaaagacaaaagtcaacaggtgattgtgcagggagtacatgagctgtatgatctggaggaaacaccagtgtcctggaaggacgataccgaacgcacgaacaggttagtgctcatcgggagaaatctggacaaggatatattaaaacagctgtttattgccaccgtaacagagactgaaaaacaatggactacgcacttcaaggaggatcaagtgtgcacctag

SEQ ID NO: 46183 - DNA, 1188 bp, Artificial Sequence
  Description of Artificial Sequence: Synthetic coding sequence
atgctgcccgccgtgggcagcgtggacgaggaggaggaccccgccgaagaggattgtcccgaattggttcccatagaaaccacacagtccgaggaagaagaaaagtccggactgggagcaaaaatacctgtgacaattatcacaggttatctgggagcagggaagaccacgcttctgaattatatcttaaccgagcagcatagcaaaagggtggctgttatcctgaacgaaagcggggagggctccgccctcgagaagtccctggcagttagccaggggggcgaactctacgaagaatggctcgaactgaggaatgggtgtctgtgttgctccgtgaaagataatggactacgcgccatcgaaaatcttatgcagaaaaaggggaagttcgatgatatcctgctggagaccactggcctcgctgatcctggtgcagtgacgagcatgttttgggtggatgcggagctaggttctgacatttatcttgatggaatcatcaccattgttgattccaagtacggtctgaagcacctgactgaagagaaaccagacggtctgatcaacgaagctacacggcaagtggctttggccgacatcattctgattaataaaacggacttggtgccagaggaagacgtcaagaagctgcggacgactatcagatctatcaatggtctcgggcaaatcctggagacacagagatcgagggtggacctgtccaacgtgctggatctgcacgcattcgactctctatcaggaataagtctgcagaaaaaactgcagcacgtccctggcacacaacctcatctggatcagagcatcgtgacgatcacatttgaggtccccggcaacgcaaaagaggaacacttaaatatgttcattcaaaacctgctgtgggaaaagaatgtgaggaacaaagataaccattgtatggaggtaatccggctgaaaggcctggtatccataaaggacaagagtcagcaagtgatagtgcagggggtacatgagctatacgatctagaggaaacgccagttagctggaaagacgacaccgagcggactaatcgcctagtgctcattggcagaaatctggataaagatatcctgaagcaactcttcattgccaccgttaccgaaaccgagaagcaatggacgacacactttaaagaagaccaggtctgcacgtag

SEQ ID NO: 46184 - DNA, 1044 bp, Artificial Sequence
  Description of Artificial Sequence: Synthetic coding sequence
atgctgcccgccgtgggcagcgtggacgaggaggaggaccccgccgaggaagactgtcccgagctcgtgcctattgaaacaactcagtccgaggaagaggagaagtcaggtctgggcgccaagatccccgtaacaatcattactggatatctcggggccggaaagacaaccctattgaattacatcttaacagagcagcacagcaaaagggttgcagtgatcctgaacgaaagtggagaaggtagtgcattagagaagtccctggctgtcagtcaggggggcgagctctacgaggagtggctcgagctgcgcaacgggtgtctgtgctgctctgtgaaggacaatggactgcgagctatagaaaacctaatgcagaaaaaaggcaaatttgacgatattttgttggagacgactgggctcgccgacccaggggccgtgaccagcatgttttgggtggatgccgagctcggttccgacatctacctggatggtattatcacaatcgttgatagtaaatacgggctgaagcatttgactgaggagaaaccagacgggctgatcaacgaagcaacgcgtagtatcaacggcctgggacaaattctggaaacacagcgatccagtttacagaaaaaacttcagcatgttcctggcactcagcctcacttagaccagagtatagttacgattacatttgaggtgccaggtaatgctaaagaggaacaccttaacatgtttattcaaaatctgctgtgggagaagaacgtccgtaataaagacaaccactgtatggaggttattaggctgaaagggctggtgagcatcaaagacaagtcccaacaggtcatcgtccagggtgtacacgaactgtacgaccttgaggagactcctgtaagctggaaggatgacacagaaaggacaaacagattggtgcttatcgggcggaacctggacaaggacatcctgaagcaactgttcattgctaccgtgaccgaaactgaaaagcaatggaccacacactttaaagaggatcaagtgtgtacctag

SEQ ID NO: 46185 - DNA, 249 bp, Artificial Sequence
  Description of Artificial Sequence: Synthetic coding sequence
atgctgcccgccgtgggcagcgtggacgaggaggaggaccccgccgaggaggattgccctgaattagtgcccattgagactactcagtctgaagaagaggaaaaaagtggcttgggcgccaagattcctgtcactattattaccgggtacctaggcgccggtaaaactacgctcttgaattacatcctgactgagcagcacagcaagagggtggccgtcattctcaatgagagcggggaaggcaagtag

SEQ ID NO: 46186 - DNA, 342 bp, Artificial Sequence
  Description of Artificial Sequence: Synthetic coding sequence
atgctgcccgccgtgggcagcgtggacgaggaggaggaccccgccgaagaagactgtcctgagctggtcccgatcgaaaccacccaatcagaagaggaagagaagtccgggctcggagctaaaatcccggtcaccatcattaccgggtatctcggtgctggcaagaccactctgctcaattatatactcaccgaacagcattccaagagggttgccgtgatcctgaatgaaagcggcgagggcagtgcccttgagaagtcactggcagtaagtcagggcggtgagctatatgaggagtggctcgagttaaggaacggttgcctgtgctgttctgtgaagtag

SEQ ID NO: 46187 - DNA, 729 bp, Artificial Sequence
  Description of Artificial Sequence: Synthetic coding sequence
atgctgcccgccgtgggcagcgtggacgaggaggaggaccccgccgaggaagactgccccgaactggtgcctattgaaactacacagtccgaggaggaagaaaagtccgggttgggcgcaaaaatcccagttacaatcattactggttacttgggcgccggcaagactaccctcctgaattatatcctgacagaacagcactctaaacgggtggctgtgattctgaacgaaagcggtgagggatcagctctggaaaagagcctggccgtttcccagggtggagagctgtatgaagaatggcttgaactgcgtaacggctgcctttgctgcagtgtcaaagataacggtctacgcgcaatcgagaacttaatgcagaagaagggcaagttcgacgatattctcctcgaaacaactggcctcgctgacccaggagctgtagctagcatgttctgggtcgatgcagagttgggctccgacatctacctggacggtattatcacaattgtcgactctaaatacggactgaaacatctcaccgaagagaagccagacgggctgatcaacgaagcaactcgtcaggtggccttagcggatatcattcttatcaacaaaactgacctggtccctgaggaggatgtcaagaaactgcgcactacgctcagatacaagatgatgtgcgttaaatgccttcaaattcatatcgtgtacacggaatgcttcttgctgtag

SEQ ID NO: 46188 - DNA, 1080 bp, Artificial Sequence
  Description of Artificial Sequence: Synthetic coding sequence
atgtacttcaagcgggccccccgggccttccccgtgctgctgaccggcgccggaaagaccacgctgcttaattatattcttacagaacagcatagtaaacgggtggcggtaatccttaacgagagtggggaaggcagtgccctggaaaaatccctggctgtttcacagggcggcgaactttacgaggaatggctggaattacggaatggctgtttatgttgcagcgtaaaagacaacggactgcgagcgatagaaaatctgatgcagaagaaagggaaatttgatgatattctgctcgaaactaccgggctggccgatcccggagcagtcgcttccatgttttgggtcgatgcagagttgggctcagacatatacttagatggaatcatcacaatcgtggactctaaatatggacttaagcaccttacagaagagaaacccgatggtctcataaacgaggcaacccggcaagtagctctggcggatataattcttataaacaagacggatctggtccccgaagaagatgttaagaaattgaggactactcttcgcagtatcaacggactgggacagatcttagaaactcagagaagtagagtagacctttcgaacgtgctggatttgcacgccttcgacagcttgtctggcatcagtctacaaaagaagctacagcacgtgcctgggacccaaccacatctggaccaatctatcgtaaccataacctttgacgttccaggcaatgccaaggaggaacacctgaatatgttcattcagaacctactgtgggagaagaatgtgcgaaacaaggataatcattgtatggaggtgatccgcttgaaagggttggtgtccatcaaagacaagtcccagcaagtaatagttcaaggagttcacgaattgtgtgaccttgaggagacgcctgtgtcatggaaggatgatactgagagaacaaacaggctggtgctgatcggtaggaacctcgataaagatattctcaaacagctcttcatcgccacagtcaccgagaccgagaaacagtggaccacacacttcaaagaagatcaggtttgcacctag

SEQ ID NO: 46189 - DNA, 1044 bp, Artificial Sequence
  Description of Artificial Sequence: Synthetic coding sequence
atgctgcccgccgtgggcagcgtggacgaggaggaggaccccgccgaggaagactgcccagagctggtgccaatcgaaactactcagtcggaggaagaggagaaatcggggctgggcgctaagatccccgtcactataatcactggctacttaggcgctggcaagactacgcttctgaactacattcttacggagcagcacagcaagagagttgctgtgattctgaacgaatcgggcgagggcagcgcattggaaaagagcttggctgtaagccaaggcggggaactatacgaggagtggctcgaactccgtaacggctgcctgtgctgttcggtgaaggataatggacttagagctatcgaaaacctgatgcagaagaaggggaaattcgacgacatcttgctcgaaaccacagggctggctgatcctggggctgtggcaagcatgttttgggtggatgccgagctgggctctgacatatacctcgacggcattatcactatcgtcgattcaaaatatgggctaaagcatctcacagaggagaagccggacgggttgatcaacgaggccacgagatctatcaatgggcttggccagatcctggagactcaaaggagctctctgcagaaaaaactgcagcacgtgcctggaacccagccgcacttggatcagagtattgtgactatcaccttcgatgtgccgggaaacgccaaggaggagcacttgaacatgttcatccagaatctgctctgggagaagaacgtgcggaacaaagacaatcattgcatggaggtcatacgacttaagggcctcgtctccattaaagacaagagccaacaagttatcgtacagggggtgcatgaactgtgcgatctggaagagactcccgtttcatggaaagatgacaccgagcggacaaatcgtctggtgctaatcgggagaaacctggataaagacatcctgaagcagcttttcatcgccaccgtgacagagacggagaagcagtggacaactcattttaaggaggaccaggtgtgcacatag

SEQ ID NO: 46190 - DNA, 1188 bp, Artificial Sequence
  Description of Artificial Sequence: Synthetic coding sequence
atgctgcccgccgtgggcagcgtggacgaggaggaggaccccgccgaggaggattgtcctgaactcgtaccaatcgaaacaactcagagcgaagaggaagaaaagtcaggattgggggcaaagatacctgttacaatcattacggggtacctgggagccggaaagacaactttactaaactatatcctgactgaacagcatagtaaaagagttgccgtaatcctgaatgaaagcggtgaaggaagcgctcttgagaagagtcttgctgtcagtcaggggggggagctgtacgaggaatggctggaacttaggaatgggtgtttgtgttgctccgtcaaggataacggactccgcgccattgaaaacttgatgcagaagaagggaaaatttgacgacattctacttgagacaactgggttggctgaccccggggccgtcgcgtccatgttctgggtcgatgctgaacttgggagcgacatctacctggatggcattattacaatagttgatagcaagtatggtttgaagcatctgactgaagaaaaacctgacggcctgatcaatgaggcgacgagacaggtcgccctggcagacattatcctcatcaataagaccgacctggtcccagaggaagacgtaaaaaaactgcggaccactcttcggtccatcaatggcctgggacagattctggagacacagagaagtcgcgtcgacctgagcaatgtcctcgatttgcatgcctttgacagtctgtccggaattagtcttcagaaaaagctgcagcacgtgcccggtactcaaccacacctggaccagagcatcgtcaccatcaccttcgatgtacccggcaacgccaaggaggagcacctgaacatgttcatccagaacttgctgtgggagaagaatgtgcgaaataaagacaatcactgcatggaggtcattaggctgaaagggctggtttctatcaaagataagtctcagcaggtgattgtgcaaggcgtacatgaactgtgtgacttggaggagacgccggtgtcttggaaggacgacaccgaaagaacaaacaggctggttttgatcggaagaaacttagacaaggacattctcaaacagttgtttattgctacagtaactgaaacggagaagcagtggacaacacattttaaagaggatcaggtctgtacatag

SEQ ID NO: 46191 - DNA, 1128 bp, Artificial Sequence
  Description of Artificial Sequence: Synthetic coding sequence
atgctgcccgccgtgggcagcgtggacgaggaggaggaccccgccgaggaagattgcccagagcttgtcccgatcgaaactacccagagtgaggaagaggaaaagagtgggctaggtgctaaaatccccgtgacgattatcaccggctatctcggagctggcaaaactaccctactaaattatatccttaccgaacagcatagtaagagagtggctgtgatccttaacgagagcggagagggctccgcccttgaaaaaagtctcgccgttagtcagggcggcgagctgtacgaggaatggttagaactgagaaacggttgcctgtgctgcagtgtcaaggacaatggccttcgagcaattgaaaatcttatgcagaaaaaggggaaattcgatgacattctccttgagaccacgggactcgcagatccaggcatcattacaatagtggactccaagtatgggctcaagcaccttacagaagagaagcctgatggactgattaacgaagccaccagacaggtggccctcgccgatataattcttataaacaaaaccgacctggtgcctgaggaggacgtaaagaaacttaggacaactctgcggagcattaatggcttaggacagattcttgagactcagaggagccgtgtagacctgagcaatgtgttggacctccacgcattcgactcattgagtggaatatccctccaaaaaaagctgcaacatgtgcccggcacccaaccccacttggaccagagcattgtgactatcacttttgatgtgcctggtaacgccaaggaagagcatttgaatatgttcatccagaacctgttgtgggagaagaacgtacgtaataaggataatcactgcatggaagtcatcagattaaaaggattggtttcgatcaaggacaagtcccagcaggtgatagtccagggtgtgcacgagctctgtgacttagaggagacacccgtctcctggaaggacgataccgaaaggaccaacagacttgtgctcataggtcgtaatctggacaaggatattttgaagcagctgttcatagccacagtcacagagaccgagaagcagtggaccactcacttcaaggaggaccaagtgtgtacatag

SEQ ID NO: 46192 - DNA, 282 bp, Artificial Sequence
  Description of Artificial Sequence: Synthetic coding sequence
tgactggacctgcacgccttcgacagcctgagcggcatcagcctgcagaagaaacttcagcacgtgcctggtacacagccacacttagatcagtcaatcgtgacaatcaccttcgatgtgcccggcaacgctaaagaggaacatctcaatatgttcattcagaaccttttatgggagaagaatgtccgcaataaggacaatcattgtatggaggtcatacggctgaaggtccaattcacggttgccgatttctggacaaaaagtttcagctggctcttgtag

SEQ ID NO: 46193 - DNA, 543 bp, Artificial Sequence
  Description of Artificial Sequence: Synthetic coding sequence
atgctgcccgccgtgggcagcgtggacgaggaggaggaccccgccgaggaggattgccccgagttagtccccattgagactacgcagtccgaagaagaagaaaaaagcggtctcggtgctaaaatacctgtgactatcatcaccggatatctgggcgcgggtaaaaccacactcctcaactacatcctcactgaacagcatagcaagcgcgtagccgtcattctcaatgagtcaggcgagggtagcgctctggaaaaatcactggctgtgagccaggggggcgaattatatgaggagtggctcgagctgcgaaatggctgtctctgttgctcggtaaaggacaacggccttcgcgccattgagaaccttatgcagaagaaaggaaaattcgatgacattctgctggagactaccggcctcgcagatcccggagccgtcgcatcaatgttttgggtagacgcagagttgggctccgacatctatctggatgggatcattactattgtagactcgaaatatggactcaaggtgtcccatcattag

SEQ ID NO: 46194 - DNA, 759 bp, Artificial Sequence
  Description of Artificial Sequence: Synthetic coding sequence
tgagccgtgaccagcatgttctgggtggacgccgagctgggcagcgacatctaccttgacggaattatcaccatagtggatagcaaatacggactgaagcatctgactgaagagaagccagacggcctaatcaacgaggctacgcgacaggtcgccctcgcagatatcatcctgatcaataaaacagacttagtgcccgaggaagacgtgaagaaacttcgtactaccatccggtctatcaatggactaggtcaaatcctggaaacccaacgctctcgtgtcgacctttcgaatgtgttggacctgcatgctttcgatagcttgagcgggatatcactgcagaagaagctccagcacgtaccaggtacccagcctcacctagatcaatccattgtgacaattacgttcgaggttccaggaaatgccaaggaggagcacctgaatatgttcatccagaacctattgtgggagaagaacgtgcggaataaagataaccactgcatggaagttattcggttaaaaggcttggtcagcatcaaggacaagtcgcagcaggtcattgtgcagggagtgcacgagctttacgacctagaagagactcccgtgtcctggaaggatgacacggaaaggacaaaccggttggtgctgattggaaggaacctagataaagatatcctgaagcagctctttattgcaacggtcacagagactgaaaaacagtggacaacacatttcaaggaagatcaggtctgcacatag

SEQ ID NO: 46195 - DNA, 702 bp, Artificial Sequence
  Description of Artificial Sequence: Synthetic coding sequence
tgagccgtgaccagcatgttctgggtggacgccgagctgggcagcgatatctacctggacggaattatcacgattgtggattctaagtacggactgaaacacctgaccgaagagaagccagacggccttattaatgaagctacccgccaggttgccctggccgacatcattcttatcaataaaacagacctcgttccagaagaagacgtaaagaaacttcgcactaccatccgaagtattaacggattggggcagattctggagacccaacgatccagtctccaaaaaaagctgcaacacgttcctggaactcagccgcacctggaccaaagcatcgtgacaatcacatttgaagtgcccggcaacgcaaaagaagagcacttgaacatgttcattcagaacctgctgtgggaaaagaacgtcaggaacaaagacaaccactgcatggaagtgattaggctcaaggggcttgtcagcattaaggacaaatcccagcaggtcatagttcagggagtgcacgagctttacgatcttgaggagacacccgtgtcttggaaggatgacactgagcggaccaataggttagtgttaattgggcgcaacttggataaagatatcctgaagcagctgttcatcgccacagtgaccgagacagaaaaacagtggaccacccacttcaaagaagatcaggtgtgtacatag

SEQ ID NO: 46196 - DNA, 420 bp, Artificial Sequence
  Description of Artificial Sequence: Synthetic coding sequence
tgagaggaggtgcggaagcgggccatccggatgttcaagaacgagaaaagtatcgttactataacctttgaggtgcctggaaatgccaaagaggagcacctgaacatgttcatccagaatctgttgtgggaaaaaaacgtgcgaaataaggacaaccattgcatggaagtgataagactgaagggtctggttagtattaaagataaatcacagcaggtgatcgttcagggcgttcatgaactgtatgatttagaggagacaccagtgtcctggaaagacgacactgaaaggaccaaccgcttggtgctgattggcagaaacctggataaagatatactaaagcagctgttcatcgctacggtgacagaaacggaaaagcagtggacaacccattttaaagaagaccaagtttgtacatag

SEQ ID NO: 46197 - DNA, 531 bp, Artificial Sequence
  Description of Artificial Sequence: Synthetic coding sequence
atgtacttcaccgagttccccaccgcccacgtgagcttcctgccctttagggtggacctgagcaacgttctggacctgcatgccttcgactccctgagcggtatttctctgcagaaaaagttacagcatgttcctggcacacagccccatctcgaccagagcatagttacaatcaccttcgaagtgcctggtaacgcaaaggaggagcatttgaacatgtttatccagaatttgctctgggaaaagaacgttagaaataaggacaatcactgcatggaggtaattcgccttaaaggacttgtgtctatcaaagataaaagccagcaggtgatcgtgcagggcgtgcatgaattgtacgatctcgaagaaactcccgtttcatggaaggacgacacagaaaggaccaaccgattggtccttatcggaaggaatcttgacaaggacattcttaagcagctgtttattgccacagtcacagaaactgagaagcaatggacaacacatttcaaggaagaccaagtctgcacttag

SEQ ID NO: 46198 - DNA, 2559 bp, Artificial Sequence
  Description of Artificial Sequence: Synthetic coding sequence
atgatgcccggcccccggccccggaagggcccccaggcccggggccagggggtggcagccgcgaagcaaatgggcctgtttatggagtttggacctgaggacatgctgctgggcatggacgaagctgaggacgacgaagacctcgaggcagagttgcttgccctgacaggtgaagcccagaccaccggcaagaagccagccccaaagggccaggccccccttcctatggctcacattgagaaactcgcagcggattgcatgagggacgttgaggaagaggaagaagaggagggcctggaagaagatgccgagcttctgactgagctgcaagaggtacttggcgtcgatgaggagacagagccacttgacggggatgaggtggccgaccccgggggcagcgaggaggaaaatgggttggaagacacagagccccccgtgcagaccgccgtgctgacagcatccgcaccggcggctcaggccggcgcctcccagggcctgcatgctctcctggaagagagaatacataattatagagaagccgcagctagtgccaaagaggccggagaggcggcgaaagcccgcaggtgcgagcggggcctcaaaaccctggagtcacagctggccagcgtgcggcggggccgcaagattaatgaagacgagattccgccgcctgtcgctcttggcaagaggccactcgccccccaggagccagcgaatagatcacccgaaaccgacccccccgccccccctgctctcgagtccgacaatccttcccagcccgagacctccttaccgggcatctcggcccagccggtgagtgacttagaccccgacccccgggccttgctgtcctctcgccagcgcgaatacaaggtagcggccctgtccgccaagcgagccggtgagcttgacagggcgagggaattgatgcgcattgggaaaagattcggagctgtcttagaggcgctggaaaagggacagcctgtcgacctatcagcaatgcctcctgcacccgaggatctgaagccgcagcaggcctctcaggcgcctacagctcccagtgttattcccccagctgtcgaaagagtccaacccgtgatggcccctgacgtgccggctacgccagtagcacccaccgagagtcagacagtattggacgcactccagcagagattgaataagtatcgcgaggcgggtatccaggcgcggtccggcggcgatgagaggaaagcgcggatgcatgagcgaatcgcaaagcagtaccaagacgccattcgtgctcatagggccgggagaaaggttaacttcgccgaactcccagtcccccctgggtttccccctatacccggcttagaaagcacgatgggagtggaagaggatgcggtggccgccacactggccgctgccgagaagctggctagcgctgaagactccgccccggcagacaaagatgaagatgagggtgagccccccgctcaggcgcccgtagcgaaaaagcccgccagaccaaccgtcccaagttctcagaggctgccagagccgcgcgcgtccagctcaaaggaaagcccctcccccagtgtccgggagcagctcgccctgctagaagcccggaaactgcagtatcagcgggctgccctccaggcaaaacggtcccaggatctggaacaggccaaagcctatctgagagtcgcgaaatggttagaagcccaaatcatccaggctcgcagcggacggcctgtggacctgtcgaaagtgccgtcgcccctcaccgacgaagagggggacttcatcttgatccatcacgaggacctgcgcctgtcccaaaaggcggaagaggtctatgctcagctacaaaagatgctgctagaacagcaggaaaagtgcctccttttttccaagcaatttatgcaccaaggaaacgtggcagagaccactcggttcgaaaaattggcacaggacagaaaaaagcaactggagattctgcagttagcccaggcgcagggcctggatccccccacccaccacttcgaactgaaaacctttcaaaccgtgcgtatattttccgaactcaactctacagagatgcaccttataatagtccgtgggatgaacctacccgcccctcccggcgtcacacccgacgacctggacgcttttgtcagattcgagttccattaccctaacagcgatcaggctcagaaatccaaaaccgctgtcgtcaagaacacaaactctcccgagtttgatcagctgttcaagctcaatatcaaccggaatcatcgcggcttcaagagagtcattcagagtaaggggattaagtttgagatctttcataagggatctttcttcaggtctgataaactagtcggcacggcccaccttaagcttgaaagactggagaatgaatgcgaaatcagagagattgtggaggttctagatggtaggaagccaaccggtgggaagttggaggtcaaggtgcgcttgcgggagcctctgtcaggccaagacgtgcaaatggtcaccgagaattggctagtgctcgaaccacgcgggttgtag

SEQ ID NO: 46199 - DNA, 2268 bp, Artificial Sequence
  Description of Artificial Sequence: Synthetic coding sequence
atgcgggacgtggaggaggaggaggaggaggagggcctggaggaggatgccgaactgttgaccgagctccaagaggtgctgggcgtcgacgaggaaacggagccacttgacggcgacgaggtggctgacccgggcggctcggaagaagagaacggtctggaagacactgagccacctgttcagacagcagtcctgacagcctctgctcctgcagcccaggccggggctagccagggcctgcatgccttgctcgaggagcggatacacaattatcgcgaggcagcagcaagtgccaaagaggctggtgaggccgcaaaggccaggcggtgcgagcggggacttaagaccctggaaagtcagctcgcatcagtgaggcggggacggaagattaacgaggatgaaatcccgccgcctgtggcgctagggaagaggcctttagccccccaggaacctgccaatcgatcaccagaaactgaccccccagcgcctcccgcccttgagtctgacaaccctagccaaccagagaccagtttaccgggtatcagtgcacagcctgtcagcgatctggaccctgatccccgtgccctgctatcctcccgccagagggaatacaaggtcgccgcattatcagcgaagcgggctggagagctggatagagcccgcgagctcatgcggatcggaaagagattcggcgctgtgctggaggccctagaaaaggggcagcctgttgacttgtctgccatgccacccgctcctgaagatcttaaaccccagcaagcaagtcaggccccaactgctccaagcgtgatccctccagctgtcgagagagtacaacccgtaatggcccctgatgtgcccgccacgcctgtggccccaactgagtcacagaccgtgctcgatgcgctccaacagaggctgaataagtatagagaggctggcattcaagcgcgctcaggcggtgatgagcgcaaggctcggatgcatgaaagaatagccaaacagtaccaggatgcgattcgggctcaccgggccgggcgcaaggtgaactttgctgaattacctgtgcctcccgggtttccgccaatccccggcctggagtccaccatgggggtagaggaagacgctgtggccgccaccctggctgccgcagagaaactcgccagcgccgaggacagcgcccctgcagataaagacgaagatgagggcgaacctcctgcgcaagccccagtcgccaagaaacccgcgaggcccactgtgcctagttctcagaggctcccggagccccgggcatcgagtagcaaggaaagtccttcaccttcagtacgagaacagttggccctgctggaagcgaggaagctgcagtaccaacgcgcagccttgcaggccaagagatcccaggacctcgagcaagctaaagcatatctcagggttgcaaagtggcttgaggcacagatcatccaggctcggtccggccgaccggttgacttgtcgaaggtccctagccctctaactgacgaagaaggagacttcatcctgatacatcatgaggacctgaggctctcgcagaaagcagaggaagtgtatgctcagctgcagaagatgctacttgagcaacaggagaagtgcctcttgttttccaagcaattcatgcaccagggcaatgtcgccgagaccaccaggttcgaaaaactggcccaggatcggaaaaaacagctcgagatcctgcagcttgcacaagcgcagggcctggacccacccactcaccacttcgagcttaagacgttccaaaccgtgcgaattttctccgaactcaacagtacggaaatgcatctcatcatagtgagaggaatgaatctgccggccccgccaggcgtgacgcctgatgacctggacgccttcgtaaggttcgagtttcactaccctaactctgaccaggctcaaaagtcgaagaccgcagtggtaaagaatacaaatagcccggagttcgatcagctgtttaagttaaacattaacagaaaccatcgagggttcaaaagggtcattcaaagtaaggggatcaagtttgagatctttcacaaggggtcgtttttccggtccgataaactggttggtaccgcccacctgaagctggagaggcttgagaacgaatgcgagatcagagagattgtagaggtcctggacggcagaaaaccaactggtggaaaactggaagtgaaacctatggccagcacccggcggggagtgaggcccagactctgtcgtagatag

SEQ ID NO: 46200 - DNA, 372 bp, Artificial Sequence
  Description of Artificial Sequence: Synthetic coding sequence
atgatgcccggcccccggccccggaagggcccccaggcccggggccagggggtggcggctgcaaaacaaatgggacttttcatggagtttggaccggaagacatgctgcttggcatggatgaagctgaagatgatgaggacctggaggccgagctgctagccctaactggggaggcccaaactactggaaaaaagcccgctcccaaaggccaagcccccctgcccatggcgcatatagagaagctggcagctgactgtatgagggatgtagaagaagaagaggaagaagagggtctcgaggaagacgcaggtagagactgcgccggcgatgacttccccagctttgcgggctttcggtccctgtgcacctag

SEQ ID NO: 46201 - DNA, 2577 bp, Artificial Sequence
  Description of Artificial Sequence: Synthetic coding sequence
atgatgcccggcccccggccccggaagggcccccaggcccggggccagggcgttgccgccgctaaacagatgggcctgtttatggagtttggtcccgaggacatgttgcttggcatggatgaagcagaagacgacgaagacttggaagctgagctgctcgcactgacgggggaagcgcagacgactggcaaaaagcccgctcccaagggccaggcccccctacccatggcccacatcgaaaaattagccgcagattgtatgcgggatgtcgaagaagaagaagaagaggaaggacttgaggaggacgctgagctacttacggagctccaagaagtgctgggtgtggacgaagaaacagagcccctcgatggggatgaggtagccgacccaggcggatctgaagaagagaacgggttagaagataccgagccacccgtgcagactgccgtgttgacagcatccgctcctgccgcgcaagccggcgccagccagggcctacatgcactgcttgaagaaaggatacataactatagggaagctgctgcttcagcaaaggaggcaggagaggctgccaaggccaggcgctgtgagcgcgggttaaaaacactcgaatcccagttagcttcagtgcggaggggaagaaaaatcaacgaggatgaaatccccccacctgtcgctctggggaaacggcctcttgcaccccaggaacctgctaaccggtctccagagactgatccccctgctccaccagcccttgagagtgataatccaagccagcccgagacctccctgccaggaatatctgcgcagcctgtttccgatctcgacccggatcccagggcattgctgtctagtcgtcaacgagaatacaaagtagccgcgctaagcgcaaagagagcgggcgagctggatagggcacgagaactaatgcgaatcggaaagaggttcggcgccgtcctggaggctctggagaaagggcagcctgtggacttgagtgctatgccgccagcccctgaagacttgaagccacagcaagcaagccaggctccaaccgcacctagcgtgatacccccagctgtggagcgggtccagccagttatggcccccgatgtgcccgctacccctgtcgcacccacggagtcacaaaccgtactggatgctctgcagcagcgtctgaataagtaccgcgaagccggtatccaggccaggagtggcggcgacgaaaggaaggctcggatgcatgagagaatagccaaacagtaccaagacgcgatcagagcccatcgggcagggaggaaagtaaattttgccgaactgccagtaccacccggttttcctccgatcccaggattggagtcaaccatgggggttgaagaagacgcagtggcggccaccctggccgctgccgagaaactggccagcgctgaagactctgcaccggctgataaggatgaagacgagcctcctggccatctgcagggcgaaccgcccgctcaggctcccgttgcaaagaaaccagcacgacccacggttccctcctcccagcggctcccagagccccgcgcttcatcttctaaagaatccccttccccttctgtgcgcgaacagttggctctgctagaggcgcgcaagttgcagtatcagcgggctgccctccaagcaaaacgctcacaggatctcgaacaggccaaggcctacctgcgggtcgccaaatggctggaagcacaaattatccaggctagaagcgggaggcccgttgacctcagcaaagtcccatcacccctgaccgacgaggagggagacttcattttgatccaccacgaagatttgcggttatctcagaaagctgaggaggtatatgcacagctgcagaaaatgcttctcgaacagcaggaaaagtgtctgcttttttcaaaacaattcatgcatcagggtaacgtggccgaaaccactaggttcgaaaagcttgcacaagacaggaaaaagcagctggagatactccagttggcacaggcgcaaggcctggatcctccgacccatcatttcgaacttaagaccttccagaccgtaaggatcttctccgaactaaacagcaccgagatgcatctcatcatcgtgcgcgggatgaacctgcccgcacccccgggggtcacacccgacgatctcgatgcattcgtgcgctttgagtttcactatcctaacagcgatcaggctcagaagagtaaaaccgcagtggtgaaaaacacaaatagtcccgagtttgatcagcttttcaaattgaacataaatcgcaatcacaggggctttaaaagagtcatccagtcgaaaggcatcaagtttgaaatttttcacaaggggagctttttcaggtcggacaaactggtcgggactgctcacctcaaactcgaacgcctagagaacgagtgcgaaatccgggagatcgtggaggtcctggacggccgcaaacctacgggaggaaaactggaagtgaaggtgcggcttcgcgagcccctgtccggacaagacgtgcaaatggttacagaaaattggctggtgcttgaaccgagaggactatag

SEQ ID NO: 46202 - DNA, 1887 bp, Artificial Sequence
  Description of Artificial Sequence: Synthetic coding sequence
tgaaagatcaacgaggacgagatccccccccccgtggccctgggcaaacgccctctggcgccgcaagagcccgccaacagatcgcccgaaactgatccacctgccccccctgctctagagtctgataatccgagccagcctgagacctcactccccgggatctctgcccagcccgtgtccgaccttgatccggatccacgtgccctgctgtcaagtcggcaacgggaatacaaggtggctgctctgagcgctaagagggccggggagctcgaccgcgcacgcgagttgatgcggatcggcaaacgctttggcgccgtactggaggctctagagaagggtcagcctgtggatctctcggccatgccccctgcgccagaagatttgaaaccacagcaggcctcccaggcccctaccgcgccaagcgttattcctccagccgtagaaagggtgcaaccagtgatggctcccgatgtgccagccaccccggtggcccctacagagtcacagactgtgctggacgctctgcagcaacgactgaataagtacagagaagccggcattcaggctaggtcaggcggcgatgagaggaaggctagaatgcacgagagaattgcaaaacagtatcaggatgctattcgtgctcatagggctggtagaaaggttaacttcgcagagctgcccgtcccccccggatttccacccatcccggggctcgagtctactatgggggttgaagaggacgccgtagctgccacactggcagctgctgagaagctggcatcggctgaggacagtgcacctgccgacaaagatgaggatgagggcgagccacctgcccaggcccctgtggcaaaaaagcctgcacgccccaccgttccctcctctcagcgcctgccagagcctagggccagctcttccaaggagtcaccgtccccgagcgtccgggagcaactggccctgctggaggcgcgtaaactgcagtaccagagggcagctctccaggctaaaaggagccaggaccttgaacaggccaaggcttaccttcgggttgccaagtggctagaagcacaaatcattcaggctaggagcggtcgacccgtggatctcagcaaggtcccatcccctctaactgacgaagaaggcgatttcattttgattcaccacgaggacctaagactatcccagaaggcggaggaggtctacgcccaactacagaaaatgttactggagcagcaggagaagtgtctgctgtttagcaaacagtttatgcaccagggaaacgttgccgagacgacgcggttcgagaaactcgcacaggatcggaagaagcagctggaaattcttcagctggctcaggctcagggtctggaccctcccactcatcatttcgaattaaaaaccttccagaccgttcgcattttttctgaacttaattctacagaaatgcatctcattatagttcggggtatgaacctccccgcacctccaggggtgacacccgacgacctagatgcatttgttcgcttcgagttccactatcctaatagcgaccaggcacagaagagcaagacagctgtggtgaaaaatactaactctccggagtttgaccaactgttcaaacttaatatcaaccgaaaccatcgtgggttcaaacgcgtgatccagagtaaaggcatcaaattcgagatttttcataaaggatctttcttcaggagcgataagctggttggcacagcacatcttaagctcgaaaggctggaaaatgaatgcgagatccgagagattgtggaagtgttagacggtcgtaagcccacgggtggaaagctggaggtgaaaccgatggcctccactaggcggggcgtgcgtcccaggctctgccggcgctag

SEQ ID NO: 46203 - DNA, 645 bp, Artificial Sequence
  Description of Artificial Sequence: Synthetic coding sequence
atgctgctggagcagcaggagaagtgcctgctgttcagcaagcagttcatgcaccaaggcaacgttgccgaaaccactaggtttgagaagctggcccaggacaggaaaaaacaacttgagatcctgcaactggctcaggctcagggactcgatccacctacccaccactttgaattaaagaccttccagactgtgcgaattttcagcgagctgaactcaaccgaaatgcatctgattatagtgcgcgggatgaatctccctgcaccaccaggggtgacccccgatgacctggatgcgtttgtgcggtttgaatttcattatcccaattcagaccaggcccagaagtccaagacagccgtggttaaaaacacaaactccccagagtttgaccaactgttcaaactgaatattaaccggaatcacagaggattcaaaagagtaatccaatcgaagggtatcaagttcgagatatttcataaaggaagctttttcagatcagacaaactcgtggggactgctcatctgaaacttgaacggctcgaaaacgaatgcgaaatccgtgagatcgtggagatggagagattccggcggtcagagaagtcacacagaggaacccaggagaaagcggcatccctctttccctag

SEQ ID NO: 46204 - DNA, 2319 bp, Artificial Sequence
  Description of Artificial Sequence: Synthetic coding sequence
tgaaccaccggcaagaagcccgcccccaagggccaggcccccctgcctatggctcacatcgagaaattggccgctgattgtatgcgagatgtggaggaagaggaagaagaggaaggtctggaggaggatgcagagctccttacagagctccaggaagtgctgggggtggacgaagaaaccgagccactcgatggagacgaggttgcagatcctggcgggagcgaggaagagaatggcctcgaggatacggagcccccagttcagactgcggtgttgacagcatccgcccccgctgctcaggccggcgcttctcaggggttgcatgccctgctggaagaaagaatccataattatcgtgaggccgctgcttccgcaaaggaggctggggaggctgccaaggcccgaaggtgcgagcgtgggctgaagaccttggaaagtcagcttgccagtgtacgaagaggtcgaaaaattaatgaggatgaaatccctccccccgtcgccttagggaagcgacctctggccccacaggaaccagctaaccgatccccggaaacggatccccctgccccccccgctttggagtcagatccagatcccagggcactgctctcctcacgccaaagagaatacaaagtggctgctctgtctgctaaaagggcgggggaattagaccgggcccgtgagctgatgagaatagggaaaagattcggggcagttctcgaggcgctcgaaaagggacagcccgtggacctgagcgccatgccaccagccccagaggacttgaagccacagcaggctagccaggctcctaccgccccatccgttatccccccagctgttgaacgtgtacagccagtaatggcccccgacgtgccagctactcccgtggctccgacagaaagccaaaccgtactggacgcactgcagcaacggctaaacaagtatagggaggctggtattcaagcccggtccgggggagacgagcggaaggccaggatgcacgaacgtatcgccaagcaataccaagatgccatcagggctcatagggcagggcgcaaggttaacttcgcggagctcccagtaccccccggtttcccgcctatcccagggctggaaagtacaatgggagtagaagaagacgcagtggctgctactttggctgccgccgaaaagctggcctcagccgaggactctgcgccagcggataaggatgaggatgagggagaacccccagcgcaggccccagtcgctaagaagcccgcccgtccaactgtcccttctagccagcgcctccccgagccccgggcatcctcatccaaggagagtcccagcccatcagtgcgcgaacaactcgcactcctggaagctcggaagctgcagtaccagcgcgcggcattgcaggcaaagaggagccaggacttagagcaggcgaaggcctatctaagagttgccaagtggctggaggcacagattatccaggcacgaagtggaagacccgtcgacctgtctaaagttccctctcctctcacagatgaggagggtgactttatcctgattcaccacgaggatctgcgtctgagtcagaaggctgaagaagtttacgcccaactgcagaagatgctgcttgagcagcaggagaaatgcctgctgtttagtaagcagttcatgcaccagggtaacgtcgccgagacaacccgattcgagaagctagcccaggataggaaaaaacagctggagattctccagcttgctcaggctcagggacttgaccctcctacccaccacttcgagctcaaaactttccaaaccgtgaggatcttctctgagttaaactccaccgaaatgcacttgataatcgtccgcggcatgaatctgccagctccccccggagtcacacccgacgatctggacgccttcgttagatttgagttccactatcccaatagcgaccaggcccagaagtctaagaccgctgtggtgaaaaacacaaactcaccagagtttgatcagttatttaagctgaacattaatcggaaccataggggttttaagagggtcatacagtccaagggtatcaagttcgaaatcttccataaaggcagctttttccgctccgataaactggtgggaacagcgcaccttaaactggaacggttagagaacgagtgcgagataagagagatcgtcgaagtgttagatgggcgaaaacctaccggcgggaaattagaggtgaaggtgcgactgagggagcccctcagcggccaggacgtgcagatggtgaccgagaactggctggtactggaaccacgggggttgtag

SEQ ID NO: 46205 - DNA, 969 bp, Artificial Sequence
  Description of Artificial Sequence: Synthetic coding sequence
atgatgaccgagaagcacgaggaccactgcctgaagagctgcagcggacacagctacataaggaagaactggttgggttgcattgtgtttcccttttccgccctcctgcagcagagcgagtttctggaccagaccgaggtgctccagagagctcaaattttcaaaaaaaattgtaaggctatgttccccaatcggcgcatagtgaccaccgttttcaatgacgaaggaatccaatttctcgtgactagatatatcaaagcccttaacccacctcaacagctgctggatatcttcctacataactcaaacgccacgtttgatttgatcgcccggttcgtatccctgatcccattcgtcccaaacactcctgacgagaatgatggtagcgacatttggatgacaagcgagcactgcatcagtctcgcaatcggaaacaaggaggagcacgcaatcttgttgtgcaatttttttctttattttggaaaaaaggcgctggtcctgttaggaacctcagtgctagaaggacatgtggcctacgtcgtgacccaggaaacgaacgaatacctgctgtggaacccatcaaccggacaatgttataagcagttcgaccccttctgtcccctcaaatccgtcgactgcctgtttgatgaccggaacgtgtggtttaatattcaacagaacaacacgcctatggcagtgttcttcgactattctaaggagtctttttggaagcagttattgccgaagaacgtccagggtactaagatccagtcaattcaggtgacaggatttcctattcagatgccttacatcgacgttcaatctattatcgacgccgtctatcagaccggaattcacagtgctgagttcccacagactgaatttgctcttgcggtttatattcatccttatccaaataatatcctctctgtctgggtctatttggccagcctggtgcagcaccagtag

SEQ ID NO: 46206 - DNA, 417 bp, Artificial Sequence
  Description of Artificial Sequence: Synthetic coding sequence
atgcccacctgcctgaagagcagcatcagctgcctgcggcaccgggagaccattaagagtgttgccagcgacgagaccttacatgaagacaccgtgcaccccttcgttgaggtctcgtttcagcacaccgtgtataagactaataccgcctcaggatcccacccttgttggaacgaggaaatcaaagtggactttgtttctcccggccacgactactctttttctagcttgagtaaaatcaaggataacatctacataaatatctttgatgaaatgatgaccgaaaagcacgaagaccattgtctcaagagttgctccggccacagctacatcaggaaaaattggctggggtgtatcgtcttccctttctccgccctcctacagcagtccgaggatcgcaaagattccgaagaatag

SEQ ID NO: 46207 - DNA, 1206 bp, Artificial Sequence
  Description of Artificial Sequence: Synthetic coding sequence
atgatgaccgagaagcacgaggaccactgcctgaagagctgcagcggccatagttacatacggaagaattggctgggttgtattgttttcccttttagcgcgctgctgcagcagtcagaatttttagatcaaacagaggtcctccaaagggcacagattttcaagaagaattgcaaagccatgtttccgaatcgtagaattgtcactacagtatttaacgacgagggaattcagtttctggtgactcggtacataaaagccctgaatcctccacagcaactcctcgacatcttccttcataactccaatgccacgttcgacctcatcgcacggtttgtgagcctcatacccttcgtgcccaatacgcccgacgaaaatgatggcagtgatatatggatgacgtctgaacattgcatttccctagccatcggaaataaggaggagcacgctatcctcctctgcaatttcttcctctattttggtaaaaaagctctggtcttgctaggcacatccgtccttgaaggtcacgtagcatacgtggtgacgcaggagaccaacgaatatctgctgtggaatccatccacagggcagtgttacaagcagtttgaccccttttgccccttgaagagtgtagactgcctgttcgacgaccgcaatgtgtggttcaatattcaacagaataatacccctatggctgtcttcttcgactacagcaaggagtcgttctggaagcagcttcttcccaaaaacgtccaggggacaaagattcagagtatccagcccgaggagatcatttatttcgaaactgataagtcaatggttgaggacttacggaatagaatcgaacggaccctgaagtctaaagtgatggaatggaggcccaagcatcctacacattggaatcgtcagtgcacttttatcctgcgccagatcctacctaaactcgagttcggcattgggagtttcgtctccagtgagggtgataacgaattcgagagaatcctgcaattttattgggtaacagggtttcccatccagatgccttacatcgacgtccaaagcataatcgatgcggtgtatcagaccggcattcactccgccgagttcccacagactgaatttgccctcgctgtctacattcatccctacccaaataacattctgtctgtatgggtttacctcgcatccttagtgcaacaccagtag

SEQ ID NO: 46208 - DNA, 1653 bp, Artificial Sequence
  Description of Artificial Sequence: Synthetic coding sequence
atgagccacggccccagcccccggctggccgagagcccccagctgagtaagggcagcctcctaacaatcctggggagtcccagccctgagcgcatggggcctgctgactcactgccgcctaccccgccatcaggcaccccgagccccgggccaccgccagctctgcctcttccacctgcccccgccctcctggcggatggagactgggaaagccgggaggaattgcgactgcgtgaactcgaggaagctagagctcgagccgcacagatggagaagacaatgcggcgctggagcgattgcaccgcaaattggagagagaaatggagcaaagtgcgtgcggagcgtaacagggccagggaggaggtgagacagcttagacagcggctggacgcgttgacaaaggagctggccggggcccgaagggagaggcaagaggcccagggcgaatgtgaagccaggggccgagaactggcgcggttacggggtgctagaggtgtcgccgatcaaaccagggacgggcctgaacctgaagccgaaagagagcctgtacgtgatgtcggtagcgaacgaccaccagggtcccaggaactggaacttgtcgaatcactgctcaagtccatgcctgaagagagcgaagactgttgggaagcacgatcgttaggagctggagggccccgcggttcttctggcaggcaggaaagatcccgtctcccatgggaagataccgcagccaccgaagaggaggcttcaaagctgacggcgctccgcctcagattggacgagagtcaaaaagtgcttcttaaggagagagaagataagctggccctgagcaggaatattgagaagctcgagggcgagctgagtcagtggaaaattaaatacgaagaactgagtaagactaaacaggaaatgcttaaacaacttagcattctgaaagaggctcatcaggatgaactgggccgtatgtccgaggacttggaagacgagctcggcgcacgaagtagcatggatagaaagatggccgagttgcgaggcgaaatggagcggctccaagcagagaatgcagcagagtggggtcgcagggagagactagagactgaaaagctgggactcgaacgagaaaataagaagctgcgagcccaagtcggagatttagaagaggcgctggctcgtcgccgaagacaaacggccagtgcacttgactgcgatctcagggcttcacaagcagccttgtttgagaagaataaagaactagccgacctgaagcatgtgcacgggaagttgaagaaacagtttcaggagaaggtcgctgagttggcccatgcgaataggcgtgtcgaacagcacgaagcggaagtcaagaagctgcgtctccgcgtggaagaattgaaaaaagaattagctcaggccgaggacgagttagacgaagcacacaaccaggctcgcaaattacagcgctcactcgacgagcaaaccgaacagtcagagaacctgcaggtgcaacttgagcacctgcaatccagactccgcagacagcagcagaatgccccgctgttcggaaaaattcgcagcgcacgcttcggcaccgaagaagccgaagatggaacttcagacctcgacgaggacgaggacctgcagatccaggtggcatag

SEQ ID NO: 46209 - DNA, 1542 bp, Artificial Sequence
  Description of Artificial Sequence: Synthetic coding sequence
atgaacctggacagcatccaccggctgatcgaggagacccagatctttcagatgcagcagtcttccatcaagagtagaggagacatggtcgcacccgcaagccctcctagagatacatgtaacacctgcttcccgctccatgggctacagtcacatgccgcccacaacttttgtgcccacagctacaatacaaataagtgggacatttgtgaggagttgagattacgtgagcttgaggaggttaaagccagagccgcccagatggagaaaacaatgcgctggtggtctgattgcaccgcaaactggagagagaagtggtcaaaagtgagggctgaacgaaattctgctcgagaagaaggaaggcagctcaggattaagctggagatggctatgaaggagttatccacactgaagaagaagcaatcccttcctccccagaaagaagccctcgaagccaaagtgacccaggacctcaaactgccaggatttgttgaggagtcttgtgagcatactgaccagtttcaactgtctagtcaaatgcacgagtcaatcagagagtacctggtgaaaaggcaatttagtaccaaagaagatacgaataataaggaacagggtgtcgtcattgactccttaaagctttctgaagagatgaagcccaatcttgatggggtggacctgttcaacaacggcggatcaggaaacggtgagactaaaacgggccttaggctgaaggccatcaacctccctctggagaacgaggtcactgagatttccgccctgcaggttcacctcgatgagtttcaaaaaattctctggaaagaaagggaaatgcggacagcactggaaaaggagattgaacggctcgagtcggccctctccctgtggaagtggaagtacgaagaactgaaggagtcaaaacctaagaacgtaaaggagtttgacattttactgggacagcataatgacgaaatgcaggaactctcaggcaatataaaggaggagtctaagtcccagaatagcaaagaccgagttatctgcgaactcagagctgaactggaaaggttgcaggcagagaacacttccgagtgggacaaacgagaaattctggaaagagagaaacaggggctggagagggagaacaggcgcctgaagatccaggttaaggaaatggaggaactcctggataaaaaaaacagactgtccgctaactcacagtctcctgattttaagatgtctcaaatcgatctccaggaaaaaaatcaggagctgctgaacctacagcatgcatattacaagctcaatagacagtaccaagccaacatcgccgaactgacacatgccaataaccgggtggatcagaacgaagccgaggtgaagaaactgaggttgagagtggaggagctgaaacagggtctgaaccagaaggaagacgagctggatgacagcctgaatcaaattcggaagctccaaagatccctggatgaagagaaagagcggaacgaaaatctggaaaccgagttgaggcatttacagaactggtag

SEQ ID NO: 46210 - DNA, 1275 bp, Artificial Sequence
  Description of Artificial Sequence: Synthetic coding sequence
atgaacctggacagcatccaccggctgatcgaggagacccagatcttccagatgcagcagagcagcatcaaatcacggggagatatggtggcgccagcttcacctccacgcgatacctgtaatacttgctttccactgcatggcctgcagtctcacgcagcccacaacttctgtgcccattcctacaacaccaacaaatgggacatatgcgaggagctcaggctgcgtgaactggaggaggttaaagcgcgagctgcacagatggaaaagacaatgaggtggtggtctgactgcacggctaactggcgagagaagtggtcaaaggttagggctgagaggaattcagcgcgcgaggaaggcaggcagcttaggatcaaattagagatggccatgaaagaactctctaccctcaagaagaaacaatcgctacccccacaaaaggaggctctcgaggccaaggtcacccaagatctcaagttacctggcttcgtggaagaaagctgcgagcacactgaccagtttcaattaagttcacagatgcacgaatccattcgcgagtatttagtgaagcgacaattcagcaccaaggaagacaccaataataaagagcagggagtggtcattgattctttgaaactgagcgaagagatgaaacctaatctggacggcgtggatctgtttaacaacggaggcagcggcaacggcgaaacgaagaccggcctgcgcctgaaggctataaacctgccactggagaatgaagttacggagattagcgcactacaggtccatctcgacgagttccagaagattctgtggaaggagagagacttatcctttaagtccctgaaaattgttaacaccgacagactgaatgcccattccttcgggaagagaaaccgcgagacaggtgtgggattcgttagcgtagaggtggagttcgatatccttctgggccagcataatgacgagatgcaggaacttagtggaaatatcaaggaagagagcaagagccagaattccaaagatcgagtgatctgcgagttgcgcgccgagttggagaggctgcaggcagagaacacgtccgagtgggacaaaagagaaattctggaacgggagaagcagggactcgaaagggagaacagaaggctcaagatccaagttaaggagatggaagagctgctggacaagaagaatcggctgtccgcgaattcccagtctccggattttaaaatgagccagattgatctacaggagaagaatcaagatgtgaagtag

SEQ ID NO: 46211 - DNA, 1542 bp, Artificial Sequence
  Description of Artificial Sequence: Synthetic coding sequence
atgaacctggacagcatccaccggctgatcgaggagacccagatcttccaaatgcagcagtccagcatcaagtcgcggggagacatggtggccccagcctcccctccccgagacacttgcaacacatgtttccccctgcacgggctgcagagtcatgccgcccacaatttctgcgcacattcatacaacacaaataagtgggacatttgcgaagagctgcgtctgagagagctggaggaagtcaaggccagagcagcacaaatggaaaagaccatgcgctggtggagcgactgtaccgcaaactggcgggagaaatggagcaaggttagagctgagcggaactcagcacgtgaagaaggtcgccaactgagaatcaagcttgagatggcaatgaaagagctttcgactctcaaaaagaaacagtctcttcccccacagaaggaagccttggaggccaaggtcacacaggatctgaagttgcccggattcgtggaggagtcatgcgaacacactgaccagttccagctgtcaagccagatgcacgagtctatcagagagtatctggtgaagagacagttcagcacaaaggaagatacaaacaataaagagcagggggtggtgattgattccctgaaattaagcgaagaaatgaaaccgaatctcgacggcgtcgacttattcaacaatggcggcagtggaaatggcgaaacaaagacaggattgcgactgaaggccattaatctgcccctggagaacgaggtgacagaaatttctgcccttcaggttcatttagatgaatttcaaaagatattatggaaggagagagagatgcgtacggcactagagaaagaaatagaaaggctggaaagtgccctgtccctgtggaaatggaagtacgaggaactcaaggaatcaaaacccaagaatgtcaaggaatttgacatcctgctggggcaacacaatgatgagatgcaagagctttcaggaaatatcaaagaagaaagtaagagtcagaattccaaggatagggtgatctgcgaactgcgagcagagttggaaagactacaagccgaaaacacctcagagtgggataagcgcgagatccttgagcgcgagaagcagggcttggagagggagaatcggaggctgaaaattcaggttaaagaaatggaagaactattggacaagaaaaacaggctttcagcgaatagtcagtcacctgatttcaagatgagccaaatcgatcttcaggagaaaaaccaagaactgctgaacctccaacatgcctattataaactcaaccgccagtaccaggctaacatcgcagagctcactcatgccaataacagagttgaccaaaatgaggcagaggtgaaaaagcttaggctacgagtggaggagctgaagcagggcctcaaccagaaagaagacgagctggacgatagcctgaaccaaattcgcaagttgcaacgaagcttggacgaggaaaaagaaaggaacgagaatctcgagactgaacttcggcacttacaaaactggtag

SEQ ID NO: 46212 - DNA, 714 bp, Artificial Sequence
  Description of Artificial Sequence: Synthetic coding sequence
atggagcggaacgacatcatcaacttcaaggccctggagaaggagcttcaggctgcgttgaccgccgacgagaagtacaagagagagaacgctgccaaactcagggctgtcgagcaaagggtggcctcttatgaggaattcaggggtatcgtccttgcttcccatttaaaaccattggaaagaaaggataagatgggcggcaagcgtactgtcccctggaactgtcacaccatccagggccgaacttttcaggatgtggctacggaaatttcaccagaaaaagcacccctgcagcctgagacgagtgccgacttttacagagattggcgccgtcacttgccgtccggcccggaacggtaccaggccttgttgcagttgggaggtccgcgtctcggatgtcttttccagaccgacgttggcttcggtctgttaggggagctgctcgtcgccctggccgatcacgtgggccccgccgacagggctgcagtgctgggcatcctctgctctctggcatctaccgggcgatttacactaaacttatcactgctgagtagagcagagagagaaagctgcaagggtctcttccagaaactgcaggcgatgggaaaccctaggagtgtgaaggagggtttatcctgggaagaacaaggcctggaagaacagtccggaggattacaggaggaagaaaggcttctacaggagcttctggagtag

SEQ ID NO: 46213 - DNA, 729 bp, Artificial Sequence
  Description of Artificial Sequence: Synthetic coding sequence
atggagcggaacgacatcatcaacttcaaggccctggagaaggagcttcaggctgctctgactgcagacgaaaaatataaacgcgagaatgccgcaaagctcagagcggtggagcagcgagtggccagttacgaggaatttcgcggaattgtcctcgccagccacttgaaaccgttggagcggaaggacaagatgggcggaaagcggacggtgccctggaattgtcacacaattcaggggagaacctttcaggacgtggcaaccgagatcagtcccgagaaggcaccactgcagccggaaaccagcgctgacttctatcgggattggaggagacatttgccaagtggacctgagagataccaggcattgctccagctgggcggaccaaggttaggttgtctcttccagactgacgtggggtttggtctattaggagagctgttggtggccctggcagatcacgtggggcccgccgacagagcagccgttctgggaatactgtgtagcttggccagcacaggacgcttcaccctgaatttaagtctattatcccgggctgaaagggagtcgtgcaaaggtcttttccagaaactgcaggcaatggggaacccccgaagcgtgaaagaggggctttcctgggaggagcaaggtctcgaggaacaatctggcgggctgcaagaagaggagagactgcttcaggaacttttggaactttatcaggtcgattag

SEQ ID NO: 46214 - DNA, 729 bp, Artificial Sequence
  Description of Artificial Sequence: Synthetic coding sequence
atggagcggaacgacatcatcaacttcaaggccctggagaaggagctgcaagccgcactcacggcagacgagaaatacaagcgggaaaatgccgccaagttgcgcgctgttgagcagagggtggccagctatgaagagttcaggggtattgtgttagccagccatctgaagcccctcgaacgcaaagataaaatgggcgggaagcgcacagttccttggaactgtcataccattcaaggacgtactttccaggacgtggccaccgaaatttcccccgagaaagccccgttacagcctgagactagtgccgacttttaccgcgactggcgacgccatctgccgtctggcccagagcggtaccaagcccttttgcagctgggcggtccaagactaggatgcttgtttcagaccgacgtaggcttcggtttgctgggcgaactgttggtggccctcgccgaccacgtggggcctgctgacagggctgccgtgcttggcatcctgtgttccttggcgagcacaggcaggttcactctcaacctgagccttctatctcgcgccgaaagggagtcttgtaaaggtctgtttcaaaaacttcaggccatgggcaatcccaggagtgtgaaagagggactgtcttgggaagaacagggcttggaggagcaatcagggggccttcaggaagaggagcggctgctacaggagttgttggagttatatcaggtggactag

SEQ ID NO: 46215 - DNA, 1104 bp, Artificial Sequence
  Description of Artificial Sequence: Synthetic coding sequence
atggccgccgaggaggaggacgaggtggagtgggtggtggagagcattgctgggtttctgcgaggccctgactggtcgatacccattttggacttcgttgaacagaagtgcgaggtgaattgcaagggcggccatgtcatcactccagggagtccagagccagttatcctcgtggcatgtgtaccattagtctttgacgacgaagaggagagtaagctaacatatacggagattcatcaagagtataaagagctggtggaaaaactgctggaggggtacctgaaagagatcggcatcaatgaagatcagttccaggaggcgtgtacctcgcccctggccaagacacacaccagccaagctatcttgcaacctgtcctcgccgctgaggactttaccatcttcaaagcaatgatggttcagaaaaacattgagatgcaactccaggccatccgaataatccaggagcgcaatggagtgttgccggattgtctgacggacgggtctgatgtcgtgtccgatctggagcacgaagagatgaagatcctcagggaggtgttgcgaaagtcaaaagaggaatatgaccaggaggaagagagaaagaggaaaaaacagctatccgaggctaagacagaagaacccaccgtacatagctctgaggcagccatcatgaacaactcccagggagacggtgagcactttgctcatcctccctctgaagtcaaaatgcattttgccaatcagagtatcgaacccttagggcgcaaggtcgagcgcagcgaaacttccagcctaccccagaaggacttgaaaatccccggtcttgagcacgccagcatcgaaggtcccatcgctaacttgagcgtcctggggaccgaagagctgaggcagagagagcattacctgaaacagaaacgggataaactaatgtcaatgagaaaggacatgcggacaaaacagatccagaacatggagcaaaagggaaaaccaaccggtgaagtggaggaaatgaccgagaagccagagatgaccgcggaggagaagcaaacattgttgaaaagaaggttactggcggagaagctaaaagaggaggttattaataagtag

SEQ ID NO: 46216 - DNA, 1029 bp, Artificial Sequence
  Description of Artificial Sequence: Synthetic coding sequence
atggccgccgaggaggaggacgaggtggagtgggtggtggagagcatcgctgggtttctccggggacccgactggagcattcccattcttgatttcgttgaacagaaatgcgaagtgtttgacgacgaggaagaaagcaaacttacatatacagagatccatcaggagtacaaggagctggtggaaaagctgttggagggctatctgaaggagattggtatcaacgaagatcagtttcaagaggcatgcacctctcccctcgccaaaacccacacctctcaggctatcctacagccagtactggctgccgaagacttcacgatattcaaagcgatgatggtgcagaaaaatatcgagatgcagctccaggcgattaggatcattcaggagaggaacggggttctgcctgattgcctgacggatgggtcggacgtagtgtcagacctggagcacgaggaaatgaagatactccgcgaggtgttgcggaaaagcaaagaggagtacgatcaggaggaggaacggaagcggaaaaagcagctgagcgaggctaaaaccgaggaaccaaccgtacactcttctgaggcggctatcatgaataactcacagggggacggagaacactttgcccatccaccaagcgaggtaaagatgcattttgctaaccagtctatcgaacccttaggtcggaaagttgagcggtcagagacctcatccctgccacagaaggacctgaaaatcccaggacttgagcatgcatccatcgaggggcccattgccaacctgagcgtgctggggaccgaggagctgaggcagagggaacattatttgaaacagaaacgggataaactaatgagtatgagaaaagacatgcgcaccaaacaaatccagaacatggaacagaagggcaagcctacaggggaggtggaggaaatgaccgagaaaccggaaatgaccgccgaagagaagcagacccttctgaagagaaggctgctggcagagaagctgaaggaagaagtgattaacaaatag

SEQ ID NO: 46217 - DNA, 1545 bp, Artificial Sequence
  Description of Artificial Sequence: Synthetic coding sequence
atgtacagccagcggttcggcaccgtgcagcgggaggtgaagggcccaacaccaaaagttgtgattgtgcggtctaagccgccaaaaggtcagggggccgaacatcacctcgagcgtatacgtcgcagtcaccagaagcacaatgcaatcctggccagtatcaaatcaagcgaacgtgatcgcctgaaggccgagtgggatcaacataatgactgtaaaattctcgacagcctagtgagggctcggattaaagacgccgtgcaaggttttatcatcaacatagaagagcggcgcaataagctcagagagctgctggcactagaggaaaatgagtatttcacagaaatgcagctgaagaaagaaactattgaggaaaaaaaggatcgtatgagggaaaaaactaaactcctgaaggaaaaaaacgagaaggagcgtcaggacttcgttgcggagaaactcgaccaacagtttcgagaacgctgtgaagagctgcgcgtcgagctactgtccattcaccagaaaaaggtctgcgaggaacgaaaagcccagattgcctttaacgaggaactgagcaggcagaaacttgtcgaagagcagatgttcagtaaactctgggaggaagaccgcctcgcgaaagagaaacgcgaggctcaggaagcacgaaggcagaaagagctaatggagaatacccgattaggccttaacgctcagattacctcaattaaagctcagcgccaggctacccaactgctcaaagaggaagaagcccggcttgttgaatcaaacaacgcgcaaattaaacacgagaacgagcaagacatgctcaaaaagcagaaagcaaaacaagagactaggaccatcctgcaaaaggctctgcaggaacgcatcgaacacatacagcaagagtaccgtgacgaacaggacctcaacatgaagctcgtgcagcgtgcccttcaggatctgcaagaggaagcagataaaaaaaagcagaagagagaggatatgatccgcgaacaaaagatttaccacaaatatctcgcacaaaggcgcgaagaggagaaagctcaggagaaagaatttgatcgaattctggaggaggacaaggcaaagaagctggctgagaaagacaaggaactgagactggagaaggaagctaggcgccaacttgtagacgaagtgatgtgcacgagaaagctccaggtccaggagaaactccagcgagaagccaaagagcaggaagaaagggccatggagcaaaagcatataaacgaatctttgaaggagctgaattgcgaggagaaggagaactttgctaggcggcagcgcctggcacaggagtatagaaagcagctgcaaatgcagatcgcttaccagcagcagagccaagaggcggagaaggaagagaagagaagagagtttgaggcaggagtcgcagccaacaaaatgtgcttggacaaagttcaggaggtgctgagcacacaccaggtgctcccacagaacatacatcccatgcgcaaggcctgcccttctaaattgcccccttag

SEQ ID NO: 46218 - DNA, 1683 bp, Artificial Sequence
  Description of Artificial Sequence: Synthetic coding sequence
atgaaccggaagtgggaggccaagctgaagcagatcgaggagcgggcctctcattacgagcgtaagccactgagttctgtttacagacccagactgagcaagcctgaggaaccaccatctatttggcgactgtttcaccggcaggcccaggcatttaactttgtaaaatcttgtaaagaggatgtccacgtgtttgcgcttgagtgcaaggtgggcgacgggcagcggatttatctggtgactacatacgccgaattttggttttactacaagtccagaaaaaacctcttacattgttatgaggtaatccctgaaaacgcggtttgtaagctctactttgatctcgagttcaacaagccagccaacccaggtgcagatggcaaaaaaatggttgccttgctaatcgagtacgtgtgtaaggctttacaggagctttatggagtgaactgcagcgccgaggatgtactcaacctggacagcagtactgatgagaaattctcccagcatctcatattccaactccacgatgttgcattcaaggacaacattcatgtagggaattttctgcgtaagatcctgcagcccgccctggacctgttaggatccgaggacgatgacagcgctccagagaccaccggacacgggttcccacacttcagcgaagcccctgcacggcagggctttagttttaataaaatgttcaccgagaaggcaaccgaggaatcatggacttcaaattctaagaagctagaacggctcgggtctgccgaacagtccagcccagacctgtctttcctagtcgtcaagaataacatgggggagaagcaccttttcgttgacctcggggtgtacacaagaaaccggaactttcggctgtataagtcttctaagataggcaagcgcgtagccttggaggtgacggaggataacaaattcttccctatccagtccaaggacgtgagcgatgaataccagtattttctgagttcattggtttctaacgtaaggttttctgataccttgaggattcttacttgtgaacctagtcagaacaaacagaagggagtcgggtatttcaatagcatcggaacttccgtagaaaccattgagggttttcagtgcagcccataccctgaagtagatcacttcgtgctgagcttggtcaacaaggacggcattaaggggggaattagacgctggaattacttctttccggaagagttgttggtctacgacatttgtaagtaccgatggtgtgagaatatcggccgtgcgcacaagtctaataatattatgatcttggtggacttaaaaaacgaggtgtggtatcagaaatgccacgatccggtgtgcaaagctgagaacttcaagagcgattgctttcctcttcccgctgaggtgtgcttactgttcctgttcaaggaggaagaagaattcacgaccgacgaagcagatgaaaccagatcaaacgaaacgcaaaatccgcataaaccatcacctagtcgcttgagtactggtgcttcagccgatgcagtttgggataatgggattgatgatgcctacttccttgaggccactgaggacgctgaacttgccgaagccgccgagaactcactgctttcctataatagcgaggtggacgagattcctgatgagctaattatcgaagtcttacaagagtag

SEQ ID NO: 46219 - DNA, 1590 bp, Artificial Sequence
  Description of Artificial Sequence: Synthetic coding sequence
atggccgccctgaccaccgtggtggtggccgccgccgccaccgccgtggccggcgcagtggcaggcgctggggccgccactggaacaggagtgggcgccactcccgccccacagcaaagtgacggctgtttctctaccagcggaggcatcaggccttttcacttacagaactggaagcagaaggtgaatcaaaccaaaaaagccgagtttgtgcgaaccgctgagaagttcaaaaatcaggtgataaacatggagaaagacaaacattcacacttctacaatcaaaagtccgacttccggatagaacatagtatgctggaggaactggaaaataagcttattcactccaggaagacagaaagagcaaaaatacaacagcagttagcgaagatccacaataacgtgaagaaacttcagcatcagttaaaggatgtaaagccgactcccgactttgtcgaaaaactgcgcgagatgatggaggagatcgagaacgcaattaacacctttaaagaagagcagagactgatctatgaggagctgattaaggaggaaaagacgacaaataatgagctctcagctataagcagaaaaattgatacatgggcactgggaaactcggaaaccgagaaggctttccgtgccattagcagcaaggtgcctgtggataaggtgacaccgtctacactgccggaggaagtgttagacttcgaaaagttcctccagcaaaccgggggtcgccagggcgcttgggatgattacgaccaccagaacttcgtgaaggtaaggaacaaacataagggaaagccaactttcatggaagaggtattagaacacctgccagggaagacccaggacgaagtgcaacagcacgaaaaatggtatcagaagttcctggctctggaagagcgcaagaaggaaagtatccagatttggaaaaccaagaagcagcagaaacgggaggaaatctttaagctgaaggagaaagccgacaatacccccgtactctttcataacaagcaggaagacaatcagaagcagaaggaggaacagcggaagaagcaaaagctggccgtagaggcatggaagaagcagaagtctatcgaaatgtcaatgaagtgtgcatcccaacttaaggaggaggaagaaaaggagaagaagcaccagaaagaaagacagaggcaatttaagctgaagcttctattggagagctatacacagcaaaaaaaggagcaggaggaattcctgcgcctcgagaaggagatccgagagaaggcagagaaggcggagaaaaggaaaaacgccgccgatgaaatatcacgattccaggaacgggatctgcacaaactcgagctgaagattctggatcggcaggccaaagaggacgaaaagtcccagaaacagaggcggctcgctaagcttaaagagaaagtggagaacaatgtcagtcgagacccttcacgtttgtacaagcccacaaaagggtgggaggaacggaccaagaagattgggcctacaggtagcggacctcttctgcatatcccacatagagcgatcccgacatggcgacagggcattcaacggagggtgtag

SEQ ID NO: 46220 - DNA, 1341 bp, Artificial Sequence
  Description of Artificial Sequence: Synthetic coding sequence
atggagaaggacaagcacagccacttctacaaccagaagagcgacttcaggattgagcactccatgctggaagagcttgagaataagcttattcactcgaggaagactgagagagcaaagatacaacagcaactcgctaagattcacaacaacgtaaaaaagctgcagcaccagctcaaggacgtcaagcccacccccgatttcgtggagaaattgagggagatgatggaagagattgagaacgcgattaacacttttaaggaagagcagaggctcatatatgaagagctgataaaggaagaaaagaccacaaataacgagctatcggctattagcagaaagatagacacttgggccctgggcaattccgagactgaaaaggcattccgggccatttccagcaaagtgcctgtcgacaaagtgactccgtcaactctccctgaagaagtgctggacttcgaaaagtttctgcagcagaccggtggacggcaaggcgcgtgggatgactatgaccaccagaacttcgtcaaagtccgtaacaaacacaaggggaagccaaccttcatggaggaagtccttgaacatttgccgggtaaaacccaggacgaggtgcagcagcatgagaagtggtaccaaaagtttctagcactggaagagaggaagaaggagagcattcagatctggaaaaccaaaaaacagcagaaacgggaggagatcttcaaacttaaggagaaagccgacaatactcccgtactgttccacaacaaacaggaggacaatcagaaacagaaagaggagcagaggaagaaacagaaattggccgtcgaggcttggaaaaaacagaagtctatcgagatgtccatgaaatgcgccagtcagctgaaggaggaggaggagaaggagaaaaaacaccagaaagagaggcagcggcagtttaagctgaaactcctcctggaaagctacactcaacagaagaaagaacaggaggaattcttacggctggaaaaggagattcgggagaaggcagagaaggcggagaaaaggaagaatgccgctgatgagatctccaggtttcaggaacgggacctccataagctcgaacttaagatcctcgatcgtcaggctaaggaagacgaaaagagccagaagcagcgacgactggcaaagctaaaagaaaaagtggagaataatgtatcccgcgatccctcacggttgtataagccgacaaagggatgggaagaaaggactaaaaagatcggtccaaccggtagcggccctctgcttcacatcccacaccgggctataccaacctggcgacaaggcatccaacgcagggtgtag

SEQ ID NO: 46221 - DNA, 798 bp, Artificial Sequence
  Description of Artificial Sequence: Synthetic coding sequence
atgagcgccgcccccctggtgggctacagcagcagcggcagcgaggacgagagcgaggacggcatgaggactcggccgggtgacggatctcacaggcgcggccagtctccactcccacgacaaaggttcccagttcccgactctgtactgaatatgtttcccggtaccgaggaggggcctgaggacgattccaccaaacatggcggacgcgtgagaaccttcccgcatgagcgcgggaactgggcgacccacgtttacgtgccttacgaagcgaaggaggagttcctcgacttgctggacgtcctgctgccccatgcacagacctacgttcctcggctggtgcgcatgaaagtgttccacctgagccttagtcaatctgtggttttgagacaccactggatactccctttcgtgcaggcgctgaaggcccggatgacgtccttccacagatttttttttactgctaaccaggtgaaaatctacaccaatcaggagaagacaagaaccttcatcggtctagaagtgacttcaggacatgcccagttcctggacctcgtgtccgaagttgacagggttatggaggagttcaatctaacaacgttctaccaggatccttcattccatttaagcctggcgtggtgcgtgggtgacgcgaggctgcagcttgaaggacagtgtctgcaggagctgcaggcaatcgtcgacggtttcgaggacgcagaggtcctcctgcgggtgcataccgagcaggtgcgctgcaaaagcggcaataagttcttcagcatgcccctaaagtag

SEQ ID NO: 46222 - DNA, 972 bp, Artificial Sequence
  Description of Artificial Sequence: Synthetic coding sequence
atgaccgacgacgagagcgagagcgtgctgagcgacagccacgagggcagcgaactggagctgcccgtgatccaactctgcgggcttgttgaagagctgagctatgtaaattctgcactgaagaccgagacagaaatgtttgaaaaatattacgctaagttggagcctagggaccagagacctccaagattgagtgagatcaaaatctctgcagcggattacgcacaagcaatcattgaagaggccgagatccggtggtcagaagtgtccagagaggttcacgagtttgagaaggacatcctcaaagccattagtaagaagaaagggtctatactggcgacgcaaaaagtcatgaagtacatcgaagatatgaaccgccgtagagacaacatgaaggagaaactccggctgaagaatgtgagcttgaaggtccagagaaagaagatgcttttgcagctgcgccagaaggaggaagttagtgaagctctgcacgatgtggattttcagcagctgaagatcgagaacgctcagttccttgagacgattgaggcccgaaaccaggaactgactcagctcaagctctcctcaggcaacacactccaggtcctgaacgcctataaatctaaacttcacaaggctatggagatatatctgaatctcgacaaggagatcctcttgagaaaggaactcttggagaagatagagaaagagactctccaggttgaggaggatagggcgaaggccgaggccgtgaataaacggctacgaaaacagctggcagagttccgtgccccacaggtgatgacatacgtgagagagaagattctgaacgcagatttggaaaaatccataaggatgtgggagagaaaagtagaaatcgccgagatgagcttaaaaggccatcgaaaggcgtggaaccggatgaagatcaccaacgagcagctccaggcagactacctggcgggcaagtag

SEQ ID NO: 46223 - DNA, 2013 bp, Artificial Sequence
  Description of Artificial Sequence: Synthetic coding sequence
atggagggcgagcggcgggcctacagcaaggaggtgcaccagcggatcaacaagcaactggaggagattcggcggctcgaagaagtgcgcggagatttgcaggtgcagatctcagccgcgcaaaaccaagtgaagagactgagagatagccaaagactggagaatatggaccgtcttctgaaaggcagggctcaagtgcaggccgagattgaggagctgcaggaacagacccgcgccctggataagcagatccaggaatgggaaactcgaatctttactcacagcaaaaacgtacgctcacccggttttattctcgaccaaaaagtgaagattagacggagaataagaatccttgagaatcaattggacagagtgacatgccatttcgacaatcagctcgttaggaatgccgctctgcgcgaggagctcgatctgttgagaattgatcggaatcgttacctgaatgtcgacagaaagctgaagaaagagatccatcacctccaccacctggtctccacgctgatcctgtccagtacatctgcctacgctgtgcgggaggaggcaaaggccaagatggggttgttgcgtgagagagccgagaaagaggaggcccaatcggagatggaagcccaggtcctgcaaaggcaaatcctccatctggaacaactgcatcactttctgaaactgaaaaacaatgatagacagcccgaccctgatgtgttggagaaacgagagaagcaggcaggagaggtcgcagagggagtctggaagacttcccaggagcggctcgttctgtgctacgaagacgccctgaacaagctctcccagctcatgggggaaagtgaccctgatctgctcgtgcaaaagtacctggagatcgaagaaaggaacttcgcggaatttaacttcatcaacgagcaaaacctcgaactcgaacatgttcaggaggagattaaggaaatgcaggaagccctggtgtcagcacgggcctcaaaagacgaccagcacttactccaagaacagcagcagaaggtgctccaacagaggatggataaggtgcacagcgaagccgagcgcttggaagccagatttcaagacgtccggggccagttggagaaacttaaagccgacatccaactgctgtttactaaggcgcactgcgactcctctatgatagatgacctgctcggagtgaagacatccatgggagatcgcgacatgggcctgttccttagcctgattgaaaaacgcttggtcgagttattgactgttcaagcttttttacacgctcagagcttcacatccctggctgatgccgctctgttggtgctcgggcagtccctcgaggacctccctaaaaaaatggcccccttgcagccccccgacacattagaggatccgccagggttcgaggccagcgacgactaccctatgtcacgagaagaacttctcagccaggtcgaaaaattagttgagcttcaagagcaggcagaggcacagagacagaaagatctggccgccgctgctgccaaactcgacggtaccctctcagtggatctggcctctacgcaacgcgcggggtcctcaaccgtgctggtacccacccgccatccacacgctattcccgggagtattttgtcacacaaaactagccgtgaccggggctcgctgggccatgtgactttcgggggcctgtcttcctcaacggggcatttgccgtctcatattacacacggcgaccctaacactggccacgtcacttttggtagcaccagtgcctcatctggcggacacgtgacatttcggccggtgtccgcatcttcatacctgggatccactgggtacgtggggagctcccgaggtggggagaacaccgagggcggagtggagtccggcggaactgcttccgactcatcaggaggcctgggcagcagtcgtgaccacgtcagctccacagggcctgcgagcagtacgggccctggatccagcacttctaaggacagcaggggctag

SEQ ID NO: 46224 - DNA, 1842 bp, Artificial Sequence
  Description of Artificial Sequence: Synthetic coding sequence
atggcccggtgccggcaccacagcggctacctggccgacgacgaggcaagccatagtatgtgctccgctcgtgtgcaattacctaagaaaccattagtacctgaaatgcgaccagcatgcaaaccaggtagggtacctcacccaccttccacctgtggaagttcggcactccaggggcaacgtcgcaacaagcgtcacccccaaccgttcgggcatttcctggacttcttgaccgagagccaggttctggattcccttgagaccgtcgtcgagaaagcaaccgagcgcatggctgccatgaagaccgaggccggcgtccccctagtcgaagtgcaggatcctgttgaagtccccagtgggggtaggcgtgcccatgccagaccatcactgagcaccgtacatcgacacagagtccgaccaaccctgtgtactggtcaccccaataattatcctagcagcagttccagtatgtcaaactgccatagctcactgatggcaggttgccttggctcccattccagggactcggacctcggagcccaggggtccttgccccccgtcagggacaagctgctactcgagaaaaacctaaagcggcttctacaactagagagagaaggaaagggtctgagtcagtcgtgctcccagagagattctctgctatgggattctctggggagccagacgtccttccaatggacccaggagcagcccctctcttggtttagtggactgttggggtcctcgtcgggcgtaccagaagcctcagagcctcgtccaggcgagcaggaacctatatttagaaaacgcgaatttaacaaggagatcaagtctcttttgtcccagcttgagtccttggatctccccggctattgccccctaagagaaccgcatcgtaccttgaacttcttggctgaccacaggctgttccccgccttgcaaagcgtcgttagtcaggcagtcgacaaattgcggggggcccattgtcgcgacggccggccgctatttcctacctctctcgagcccacaagcgacctccctccccttgggtcggaaccagccaaacctaccaacgggggccagccatacgcaagcccgcgaccaaccgtgagctcgccgaagatgctccagaggaagcgaaaggaccgcgggggtagccctagtatgtcttccgcccaggtcgctacgcgcttcaagttgaagtccccctgctcgagttccaggtttacaaaaaagaagcccttaccctccatctcttcgaaaagttctatgtctcacttttcaaaccggctgtatgaggaactggctgattttctgacgcagcaggccgccagcctggtgatcaggaagtatgagtttgaaaaggatctgagcaaacagctgggattcttttctttccctatcacccacgtgctcagagatttgtctctgggattgaagaaggtcaaggggtcccgtatacacctgagctcagagactcatcgtagttgcctcctgcggaagctggaagaatctaaaagggcgagacaagcttctcgcctgtccacgtctcattgctccacggagacacctagtgtgcagcaggaaccagccacgcacacagcccaggatcaagcaactgagccatgtcgcagtctgtacacaaacctccccgcctcccggcagctgagtccactggagccgaaactgtacatgtccgcttgcaccggcatgggatcgagcccaccaaaatctaaagacatggacaacgagggtagggataaagccgagatagaagatgaggacgaggatgagttcaaggacgaggaccaagacgaggacaaagacgaagatggcgtatag

SEQ ID NO: 46225 - DNA, 840 bp, Artificial Sequence
  Description of Artificial Sequence: Synthetic coding sequence
atggccgccctgggccggcccttcagcggcctgcccctgagcggcgggtcagatttcctccaacctcctcaacccgcttttcccggccgggcgttcccacccggcgctgatggtgccgagctcgcgcccaggcctggcccgagggcagtaccttcctcccctgccggcagcgctgctaggggtagagtttctgtccattgtaagaagaaacacaaacgagaggaggaagaagatgatgactgccccgtgcgcaaaaaacgcatcactgaagctgaactttgcgccgggccaaacgattggatcctgtgcgctcaccaagacgtcgaggggcatggggttaacccgtctgtgagcggcctctctatccctggaatcctggatgttatatgtgaggaaatggaccagaccaccggggagcctcaatgcgaagtcgcgcggcgaaagctccaggagatcgaggaccgcattattgacgaggacgaagaagtagaagcagatagaaacgtgaatcacttaccctcactcgtgctttctgacacaatgaaaacaggccttaagcgcgagttcgatgaagtttttaccaaaaagatgatagagagtatgagccggcccagcatggagctcgtactctggaaacccctccctgagctgctaagcgataaaccaaaaccatcatctaacacaaagaactacacaggtgaatctcaggcaaagcatgttgcagccggaacagcgttccctcagcgcaccgagctcttttccgagccgagacctaccgggatgtctctctacaactccctggagaccgcaacttccacagaagaagaaatggagctctag

SEQ ID NO: 46226 - DNA, 615 bp, Artificial Sequence
  Description of Artificial Sequence: Synthetic coding sequence
atggccgccctgggccggcccttcagcggcctgcccctgagcggcggctccgatttcttacaaccacctcaaccggcttttcctggacgagctttcccgccaggtgcagacggcgctgagctggcaccccggcctggtccgcgggcggtgccatccagtcctgcagggagtgcagctagaggaagagtttccgtgcattgcaaaaaaaagcacaagagggaggaagaggaagatgacgagataattgatgaggacgaagaggtcgaagcggatcgcaatgttaaccatctaccatcacttgtgttaagtgatacaatgaagactggcctgaagagagaatttgatgaagtgttcacaaaaaagatgatcgagagtatgtcccgaccttccatggaacttgtgctctggaagccactccccgagttgttgtctgacaagcccaaaccatcaagcaacactaagaactacactggagagtcacaggctaaacacgtggccgctggcacagcttttccccagcggactgaattgttcagcgaaccccgccccactgggatgtctctttataactcactcgaaacggccactagcaccgaagaggaaatggagctctag

SEQ ID NO: 46227 - DNA, 444 bp, Artificial Sequence
  Description of Artificial Sequence: Synthetic coding sequence
atggaccagaccaccggcgagccccagtgcgaggtggcccggcggaaattacaggagattgaagaccggatcatagatgaagacgaggaggtggaggctgatcggaatgtcaaccacctgccctcactggtgctctcagatactatgaagacagggctgaaaagagagttcgatgaagtctttactaagaaaatgattgaatctatgagcagaccatcgatggagctggtgctgtggaaacctctaccagagctactttcagataaacccaaaccatcctccaatacaaagaactacacgggggaatctcaggccaagcatgttgccgctggtactgctttccctcagagaaccgaacttttctccgagcctcgacccaccgggatgtccctctacaattccttggagacagcgacctctaccgaggaggagatggaactgtag

SEQ ID NO: 46228 - DNA, 786 bp, Artificial Sequence
  Description of Artificial Sequence: Synthetic coding sequence
atggccgccctgggccggcccttcagcggcctgcccctgagcggcggatccgactttctgcaacctcctcagccagctttccctggcagggcctttccccccggcgctgacggagccgagctagctcctagaccaggccctcgggcagtcccaagctcaccagccggcagcgcagcccggggtcgctgccctgtccgaaaaaaaagaatcaccgaggcagagctgtgtgcaggcccgaacgactggatcctttgtgcccaccaggatgtggagggccatggcgtgaatccctctgtgtcaggacttagcatcccagggatcctagacgtgatttgtgaagagatggaccagacaacaggagaacctcaatgtgaagtcgccagacgaaagctccaagaaatcgaagaccgcataatagatgaggacgaggaggtggaagctgatcgaaacgtgaatcacttgcccagcctcgtgctctcagatacgatgaaaacgggcctgaagagggagtttgacgaggtgttcaccaagaaaatgatagaaagcatgtcacggccttccatggagttggtattgtggaaacccctgcccgagttattgtcagataaacctaagccaagctcaaatactaagaattacacaggggagtcacaggctaagcacgtcgccgcaggaaccgcgttccctcaaagaaccgaactcttttctgagcctaggcctaccggcatgagcttgtataattcgctcgaaacagcgacctcaacagaggaggagatggagctctag

SEQ ID NO: 46229 - DNA, 540 bp, Artificial Sequence
  Description of Artificial Sequence: Synthetic coding sequence
atgcaggacggccggaagggcggcgcctacgccggcaagatggaggccaccacagcaggggtgggaaggctggaggaggaggcccttcgaagaaaggagaggcttaaagctcttcgcgagaagacgggtcggaaagacaaggaggacggcgagccaaagacaaaacacctgcgagaggaagaggaggaaggtgaaaaacatcgcgagcttcggctcaggaattacgtgccagaggatgaagatttgaagaagaggagggtgccccaggcaaaacccgtcgccgttgaggaaaaagtgaaagagcagctggaggccgcaaagcccgaaccggtgatcgaggaggtcgatctggccaatctcgctccacggaaacctgactgggatttaaaacgggatgtcgctaagaagcttgaaaagttaaaaaaacgaacacaacgcgctatagcagaacttatacgggagcggctaaaaggccaagaggattctctggctagcgccgtggacgctgccacagagcagaaaacctgcgacagtgactag

SEQ ID NO: 46230 - DNA, 540 bp, Artificial Sequence
  Description of Artificial Sequence: Synthetic coding sequence
atgcaggacggccggaagggcggcgcctacgccggcaagatggaggccacaaccgctggcgtaggtagactcgaggaagaagcactgagacgcaaggaacgcttgaaagcactgcgtgaaaagacgggcagaaaagacaaagaagatggcgaacctaagaccaagcatttgcgggaggaggaggaggagggtgagaagcatcgggaactgaggcttaggaactacgtgcccgaagacgaagatctaaagaagagaagagttccacaagcaaaacccgtggcagtggaagagaaagttaaagaacagctggaagctgccaaacccgagcccgttatagaggaggttgacctggcaaatctcgcccccaggaaaccagattgggacctgaagcgggacgtggccaagaagctggagaaactcaagaagcgaactcaacgggcaatcgccgaactgatccgggagcgcttgaagggccaagaagacagcttagcctcagcagtggatgcggcaacagagcagaagacatgtgattcggattag

SEQ ID NO: 46231 - DNA, 309 bp, Artificial Sequence
  Description of Artificial Sequence: Synthetic coding sequence
atgcaggacggccggaagggcggcgcctacgccggcaagatggaggctactactgccggggtcggccggttggaggaagaagcactgagaagaaaggaacggttgaaagctctgagagagaagaccgggcgtaaagataaggaggatggggaacccaagacaaaacacctcagagaggaggaggaagaaggggagaaacacagggaactgagacttagaaattacgtcccagaagacgaagatctcaagaagagaagagtcccacaggctaagcccgtggcggtggaagaaaaagttaaggagcaatag

SEQ ID NO: 46232 - DNA, 501 bp, Artificial Sequence
  Description of Artificial Sequence: Synthetic coding sequence
atggaggccaccaccgccggcgtgggccggctggaggaggaggccctgagaaggaaagagcgtctcaaggccttgcgggaaaagacagggagaaaagacaaggaggacggggagccaaaaaccaaacacctgcgtgaggaggaagaggagggcgaaaagcaccgcgagctcaggctaagaaactacgttccagaggatgaggatttaaagaagcgaagagtaccacaagcaaagccggtcgctgtggaggaaaaagtaaaagaacagctggaagctgctaaacccgagccagtgattgaggaggttgacctggcgaacctggctcctagaaagcccgattgggatctgaagcgtgacgtcgccaaaaaactggagaaactcaaaaaaagaacccaacgagctattgccgaactcattcgggagcggttgaaaggacaggaggatagtttagcaagcgccgtggatgcagctaccgaacagaagacgtgcgattcagactag

SEQ ID NO: 46233 - DNA, 1893 bp, Artificial Sequence
  Description of Artificial Sequence: Synthetic coding sequence
atggaggtgaagggccagctgatcagcagccccaccttcaacgccccagccgctctgtttggggaagccgcccctcaggtgaagtcggagcggctgcgagggctgcttgacaggcagcgcactttacaagaagccctttcacttaagcttcaggagctccggaaagtatgtcttcaagaagcagagttaacaggtcaactgccgcccgaatgcccgctggaacccggggaacggccacagctcgtcagacggaggcctcctactgcgcgcgcctatcccccaccacaccctaatcaggcccaccattcactgtgccccgccgaagagttagctctggaagccctcgaacgggaagtcagtgtgcagcagcagattgccgcagcagcgaggcgcctggcactggctccagatttgagtaccgagcagaggcggagacgccgacaagtgcaggccgatgccttaaggcggctgcatgagctagaagaacagctaagagatgtgcgggctaggctcggcctccctgtgctccccctcccccaaccactgccactaagtaccgggtccgttatcacgacccagggcgtgtgtctggggatgcgattggcccagcttagccaagaagacgttgttctgcactcagagtctagctcactcagcgaatccggggcatcccacgacaatgaggagccgcacgggtgcttcagtctcgccgaacgccctagtccccctaaagcatgggaccagctacgagcagtgtccggcggatcacccgaacggaggaccccttggaagccccctcctagcgacctctacggagacctgaagagtcgccggaattcagtggccagcccaacttcacctactcggtctctgcccaggtcggcatcctcttttgagggccggtccgtgccggctacgcctgtccttactcggggagcaggaccccagctgtgtaagccagaggggttgcattctaggcagtggtcagggagccaggatagccagatgggctttccacgcgctgacccagcttccgaccgggcctctctctttgttgccagaacacggcgcagtaactcttccgaagcgcttctggtagacagagcggctgggggtggggccggtagtccaccagccccgttggcaccatctgcctctggacctccagtctgcaaaagttccgaagtcctgtacgaacgccctcaacctaccccggctttctctagccggacagcagggccgccagatccaccccgcgcggcgcggccatcttccgccgcgccagcctcgagaggtgctcctcgcctgcccccagtctgtggcgatttccttctggactattccctagaccgaggcctaccaagaagcggtggtgggacggggtggggtgagctgcctcctgcagccgaggtccctggccccctaagtagacgagatggcttgttgacgatgctgcctggtcctccaccagtctatgccgcggactcaaacagcccgctgcttagaacaaaagatccacacacaagagccacaaggaccaagccgtgcggcttgccacccgaggcagccgaaggaccagaagttcaccctaacccactgctgtggatgccccctcctacacggataccgtcagctggcgagcggtccgggcataaaaatctcgctcttgagggcctgcgcgattggtacattagaaactccgggcttgcggcaggccctcagaggagacccgttcttccgagcgtcggccctccacaccctcccttcctccacgcccggtgctatgaggtagggcaagccttgtatggtgccccctcacaggctcccctgcctcattcgagatcatttaccgctccgcccgtaagcggccggtatgggggttgcttctactag

SEQ ID NO: 46234 - DNA, 1986 bp, Artificial Sequence
  Description of Artificial Sequence: Synthetic coding sequence
atggaggtgaagggccagctgatcagcagccccaccttcaacgccccagctgctctttttggcgaggccgccccacaggtcaaaagcgagcgattaaggggacttctggacaggcagcgaaccctgcaggaggcactttctttaaaactccaggagctgcggaaggtttgccttcaagaggctgaactaactgggcagcttccccccgagtgccctctggagccgggagagaggcctcaactcgtgcgccggcgaccgcctaccgcccgtgcatatcctcctcctcacccaaaccaggctcaccatagcctctgtcccgccgaggagttggcactggaggccttggagcgcgaggtgtcagtgcagcagcaaatcgccgccgctgctagacggctggctctggctcccgatttgtctacagagcagcgacggcgaaggaggcaagtccaggcggacgccttaagaagactacacgaattggaggagcagttaagagatgtcagggcccgcctcgggttacccgttttgccactgcctcagccactgcctctgagtaccggctcagtgattaccacccaaggcgtgtgcctaggaatgcggctggcacaactctcacaggaggatgtggtactccattccgagagctcaagcctgtcagaatcaggggccagtcatgacaatgaagaaccacacggttgcttctctttagcagagagaccatctccccccaaagcctgggaccaattacgagctgtttcagggggatctcccgagcgaagaaccccttggaagcccccgccctctgacctctatggtgacctgaaaagccgtcgcaacagtgtggcttcccctacatcaccaactagaagtcttccccgatctgccagcagtttcgagggccgcagcgtaccagccacccctgtgctcacacgcggtgccggaccccagctgtgcaagcccgagggactccactcacgccagtggagtggatctcaggacagccaaatgggctttccgagggccgaccctgctagcgaccgcgcctcgctctttgtagcccggactcgaagatctaacagcagcgaggcactactggttgatcgagctgcaggcggaggagccggctctcctccagcccccctggccccttcagcatcaggccctcccgtctgcaagtcttccgaggtactgtacgagcgaccccaaccgacaccggcattcagtagtcggacagccgggcctcctgatcccccaagggccgccaggccgagctctgccgcccctgcctccagaggagccccccgactaccgccagtctgtggtgactttttgctggattactcccttgacaggggcctgcctcggtctgggggtggcaccggttggggcgagctgccgcccgcagcggaggtcccagggccgctgtcaaggagagatggcctgctaaccatgctcccgggcccaccacctgtttacgctgccgatagcaactcccctctcctcaggaccaaggaccctcacacaagggccactagaacaaagccgtgcggcttaccacctgaagcggcagaaggtcctgaggttcacccaaatcccctgctctggatgcctccgcctacacggattccttcagcaggtgaaaggtccgggcacaaaaatctcgctttagagggtctgcgggactggtatatccgaaattctggcctcgcggccgggcctcagcgccgccctgttctgcccagcgtcggccctcctcaccccccttttctgcacgcgcgatgctacgaagttggacaggccctgtacggggctccttctcaggcacccctgccacattcaaggtctttcactgccccgcccgtgtccggccgttactatgcagacttcctgtatcctcccgagctttctgcaaggctttctgacctgaccctggagggcgaacagagctcgagtagcgacacgcagactcccggtacactggtgtag

SEQ ID NO: 46235 - DNA, 1857 bp, Artificial Sequence
  Description of Artificial Sequence: Synthetic coding sequence
atggaggtgaaggccgccctgttcggcgaggccgccccccaggtgaagtctgagcgcctgcgcggactcctagatagacagcgcactcttcaggaagcactcagtttgaaattacaggagctgaggaaggtttgcttgcaggaggccgagctgacaggccaacttcccccagagtgcccactggagccaggcgagcggcctcaactggtgcgcaggaggccaccaaccgctagggcatatcccccccctcacccaaaccaagctcatcactcattgtgtcctgctgaggagctggcacttgaagcgttagaaagagaagtctccgtacagcagcaaattgctgcggctgcgagacggctggccctggcccctgacctcagtacagaacagcgccgccgccgtcggcaggtgcaggccgacgccctccgccgccttcacgaactggaagagcagctcagagacgtaagagcgcgtttggggctgccggtcctgccccttccacaacctttacccctgagcaccggttccgttataacaactcagggagtgtgcttgggcatgagactggcccagctgagccaggaagatgtggtgctgcacagcgaatcctcaagcctctcagagtcaggggcatcgcacgataacgaagagccacatgggtgcttctcattagccgagcggccatctccccccaaagcctgggaccagctgcgtgcggtaagcgggggctcccccgaaaggagaaccccatggaagcctccaccatccgacttatacggggacctcaagtcacgaaggaatagcgttgcatccccaacttctccgacacgctctcttccaaggagcgcatcctctttcgagggcagatccgtgcccgccaccccagtgttaacccgtggagctggaccccagctatgtaagccagagggtctccactctagacagtggtctggaagtcaggacagccaaatgggcttccctagggccgacccagcctccgacagggcatctctgttcgtcgcacgtactagaagaagcaattctagtgaggctctgttggtagatagggccgccggcggcggagcagggagcccacctgcccctctcgctcctagtgcttcgggtcctcccgtttgcaagtcgtctgaggtgctttacgaaagaccacaacccacgccagcattctccagcaggacagccggaccacccgatcctcctcgcgccgctcgcccaagcagcgccgcacccgctagtagaggggcgcctcggctgcctcccgtgtgcggcgactttcttctcgactacagcctggatcggggcctgcccaggagcggcggcgggacaggctggggtgagctaccacccgctgccgaagttccaggccctctctctcgcagagatgggctccttactatgttaccaggaccccccccagtgtatgctgctgattctaatagtccccttctgcggacaaaggacccccacacacgggctacccggaccaagccatgtgggctaccgccagaagccgcggaagggcctgaagtacaccctaacccactgctctggatgcctccccccaccaggattccctctgcaggagagaggtccggacataaaaatctggccttggaagggctgcgtgattggtatattcgaaacagcgggctggctgctggcccacagagacggccagtgctcccaagtgtaggtccgcctcacccgccttttctccacgcgaggtgctacgaagttgggcaggccttatacggggccccaagtcaagcccccctgccacattcacgcagctttaccgcccctcccgtttctgggcggtacggtggctgtttttactag

SEQ ID NO: 46236 - DNA, 837 bp, Artificial Sequence
  Description of Artificial Sequence: Synthetic coding sequence
atgaccgacctgaacaagcacatcaagcaggcccagacccagcggaagcagctgcttgaggaatcgcgggagctgcaccgtgaaaaattactggtgcaagccgaaaatcggttctttcttgaatatctcaccaacaaaaccgaggagtatactgagcagccagagaaggtgtggaacagctatctccaaaaaagcggtgagattgaaaggcgacgtcaggagtccgcatctcgctatgcggagcagatttctgtactgaaaactgcactgttacagaaggaaaacattcaaagcagcttgaagcgcaaactgcaagctatgcgcgacattgccatcttaaaggagaagcaggagaaagaaatccagacactccaagaagaaactaagaaagttcaggctgaaactgcctctaaaacccgtgaggttcaggcacaactccttcaggaaaagcgcctgctggaaaagcagctttccgaacctgaccggcgtctcctgggcaaaaggaaacggcgtgaattgaatatgaaggcccaggcacttaagctggcagcaaaaagattcatcttcgagtattcctgtggcatcaaccgggaaaatcaacagttcaagaaagaactcctgcagttgattgagcaagcccaaaaactcaccgctacccagtcacaccttgagaataggaagcaacagctgcaacaggaacagtggtacctcgagagcttgatccaggcgcgccagagattacaggggagccacaaccagtgtctgaataggcaggatgttccaaagactacaccatctctgccccagggaactaagagccgtatcaacccaaaatag

SEQ ID NO: 46237 - DNA, 1323 bp, Artificial Sequence
  Description of Artificial Sequence: Synthetic coding sequence
atgggcagccggggccagggcagccacagcaagaagacccggagcatgcccgtcatcttgagtccccagagaacaggatctggcgccaccgggggacctgcagcccgagcatacagtgtagcagaggctgttaaacagtttcgggctggaccggccggcaccggcgctgggtgttctttgcaggggtgctgggctgcccctaggcccttcgagcacaggacaaacaaattgcgcgaactatccacactggcccactgcagccgcgagctccaaacccaggttccggacgcctctgcacatagcctggccgttacacttagtgagctacacagttgccgggatctgcaggatgagtgcttggactccagattcgctgagggccccaggagattactgcctccctatcactctttaatcaataactttgttaagcccgagaaactcactaaagttgaaactcggcttaaagagaagatcgtcgccgagatgaccgatcttaataagcatatcaagcaggctcaaacccagcgcaagcaactgctggaagaaagccgtgagctccaccgcgaaaaactcctggtgcaggccgagaaccgcttttttctggagtatttgaccaacaaaaccgaggaatacacagaacagccggaaaaggtgtggaacagctaccttcaaaagtctggcgagatcgaacggcgaaggcaggagagcgcctctaggtacgcagagcagatcagcgtgttgaagacagctttactccagaaagaaaacatccagagcagcctcaagaggaagctccaggctatgcgggacatcgcgatcttaaaagaaaaacaggagaaggagattcagaccctccaggaagagaccaaaaaagtccaagcagagacagcttctaaaacaagggaagtccaagcccagctgctgcaggagaagagactgttagagaagcagttgagcgaacctgatcggcggctgctaggcaagcgcaaacgcagggagctaaacatgaaggctcaggccctcaaacttgccgcgaagagattcatctttgagtacagttgtggcatcaatcgtgaaaatcagcagttcaagaaagaactcttgcagcttatcgagcaggcccagaaattgactgccacccagagtcacctcgaaaacagaaagcagcagctccagcaagaacaatggtatcttgaatcactcattcaggcgcggcagcgcttgcaaggctcacataaccaatgcctaaacagacaggatgtgcctaagaccaccccaagcctcccacaaggcaccaaatccagaatcaatcccaagtag

SEQ ID NO: 46238 - DNA, 672 bp, Artificial Sequence
  Description of Artificial Sequence: Synthetic coding sequence
atgcccaagaagttccagggcgagaacaccaagagcgccgccgccagggcgcgacgcgccgaagctaaggccgcggccgatgccaaaaagcaaaaggagctggaggacgcctattggaaggatgatgataaacacgtcatgcggaaagaacagcgaaaggaagagaaggagaagcgcaggctggaccaactggagcgcaaaaaggaaacacagagactcttagaagaggaggattctaaactgaagggtggcaaagcccctcgtgtcgctactagctccaaggttactagagcacaaatcgaggataccctccgccgggatcatcagcttcgagaggcgccagacacagccgagaaagcgaaaagccaccttgaagtacctttggaagaaaacgttaaccgtagagttctagaggagggctcagtcgaagcacgcactatagaagacgccatcgccgtcttatcagtcgctgaggaggccgcagacaggcatcccgagaggaggatgagagcagccttcactgccttcgaggaggcgcaactgccccgcctgaaacaagaaaatccgaacatgcgcctctcccagcttaaacagctgctcaagaaagaatggttacgctcgcccgataatcccatgaatcagcgggctgtgcccttcaacgcacccaagtag

SEQ ID NO: 46239 - DNA, 672 bp, Artificial Sequence
  Description of Artificial Sequence: Synthetic coding sequence
atgcccaagaagttccagggcgagaacaccaagagcgccgccgccagagcaaggcgcgccgaggcaaaggccgccgctgacgccaagaagcaaaaggagctcgaggacgcttactggaaagacgacgacaaacatgtgatgcggaaggagcaacgcaaagaagaaaaggaaaaacggcgactggaccagctggaaaggaagaaagaaacccagaggctattggaagaggaggacagcaagctgaagggcggcaaggctccccgggtggctacctccagtaaggtgactcgggcccaaatcgaagacacgctgcgccgggatcatcagctgcgtgaagcaccagacacagccgagaaagccaaatcccacctggaggttccactcgaagaaaatgtgaatcgcagagttttggaggagggctccgtggaggcccgaacaatagaggacgccatcgccgtgctctctgtcgctgaggaggcagccgacaggcatccagaaagacgcatgcgggcagctttcacagcattcgaggaagcacagcttccacgcctgaaacaggagaaccccaatatgcggctttcccagctcaaacagctccttaaaaaggaatggctacggtcccctgacaaccctatgaaccaacgggcggtgcctttcaatgcaccgaaatag

SEQ ID NO: 46240 - DNA, 783 bp, Artificial Sequence
  Description of Artificial Sequence: Synthetic coding sequence
atgaacaacctgaacgacccccccaactggaacatccggcccaacagtcgtgccgatggaggcgacggaagtcggtggaattatgcacttctggtgccaatgctgggtctggctgcatttagatggatctggtcccgggagagtcaaaaggaagtggagaaagagcgagaagcctaccgaagacgaactgcagcgttccagcaggacctcgaggcgaagtaccacgcaatgatctccgaaaacaggagagctgtcgcccagctgtcattagagctggagaaagagcagaatcgcacagcctcatacagagaagcactgatctcgcaggggagaaaattggtggaggagaaaaaactgttagagcaagaaagagcccaagtgatgcaagaaaagcgccaggtgcaaccgctgagatctgcctacttgagttgcctgcaaagggaggagaattggcagcggcgcgctcgcctgctgctcaaagaatttgaagcagtgttgacggaacggcagaacatttactgttccctttttctccccaggtcaaaaagactggagattgagaaatccctcctcgtccgggcatccgtggatcccgtggctgcggatcttgaaatggcagcagggctgacagatattttccaacatgatacctactgcggcgacgtatggaacaccaacaagcggcagaacgggcgcctcatgtggttgtacttgaaatactgggagctggtggtcgagctgaaaaaattcaagcgcgtcgaggaggccatcctggaaaaatag

SEQ ID NO: 46241 - DNA, 210 bp, Artificial Sequence
  Description of Artificial Sequence: Synthetic coding sequence
atgaacaacctgaacgacccccccaactggaacatccggcccaactcccgcgcagacggcggtgacggcagcagatggaactatgcgctccttgtccccatgctaggacttgcagcttttagatggatctggagcagggagtcacagaaagaggtggagaaggaacgcgaggcctatcgccggagaacagccgcctttcagcaagattag

SEQ ID NO: 46242 - DNA, 2691 bp, Artificial Sequence
  Description of Artificial Sequence: Synthetic coding sequence
atgatggcccagaagagccagggcagcgacaacctgcaggagggccaggaaaagagcaagcgcgaaatccttaaatgtacgaaatccgcttgggctcccttggacgagtggctgccgcctgatcctgaggaggaaagtcagtcccttaccataccaatgctggaggatagtaagcaggagagtatccagcagtggctggactccggattttttgttagtgccaacgagaattttcagcaagttatcgaccgaaccgttagcctgtacgagcaaggtatggtgcaaatgacggtgaaagactatatgcggtccttacatcagttctctgagacacccatcctgtcgaggggcacctcgttcaactcttgttactccaccgctagtgtcccccagtctatccctgaatggctggagttttgggaaatcgaccccgtagagatcctcctcgatttaggattcggagcagacgagccggatatttgtatgcagattccagcccggttcctggggtgcggatccgccgccagagggattaacatacgagtgtttctggaggctcaaaagcagcggatggatatcgaaaaccctaacctttacggtcgcttccgtcagcttgaaatccttgaccacgtcacaaatgccttcagctccttgttatctgatgtgagtatccttcctaaccgggcagaggaaaaggccggcggcgagtccgttcaacgtactagcgtacagtcctttgaagaggaaaccggcaacccgctggatatgactagtggtaccgtaggagctcgtgtagacagagcgaactcctgccagagtgattcctccggctttttggaggagcccctagagcctctgccacttcaaatgcctagcctccccaactcccagtccccggccgaaaacggggggagaaagccccgggatcagtctcattctctagtcagcagccaggactgtcagctagaaagtgatggtccagatagcaagtctcgcgcctcaatgagtttttcaagccaggaagctaacgctttggaacagagggcgtccgtctcagtaatggaagaggagttcctgttagaggctatggaaggccccccagagctgtatattccagatatggcgtgtgccaaaactactacccgaggcgagtgtccaagaaaagatagccacctgtggcagctgttacctatgcctcacgccgagtacgaagtgactagacccactgccaccagcaagtacgaccacccactcggtttcatggtcacacacgtgactgagatgcaggactctttcgtccgacccgaaggtgccggcaaggtccagtcacatcataacgagtcccaacgaagccccggaaatgaccatactcaagataagttcctccacgtggacagcgaagccccccgagaggaagaatctagtggattctgccctcataccaaccactcgctcctggtgcctgagagcagcagtcagtgcatcccaaagcattcagagattacgccatacgccactgatctcgcccagacctctgaaaaactgattcctcacctgcacaaacttcctggggatcctgctcaggtcaaaagcagatccggtactcttggacaaatccttcccgggacggaggccgaaatggagaatttgccattaaacacgggctcttcacgcagtgtaatgactcagatgtccagttccctcgtgtccgccgctcagagggctgtagctctcgggaccggtcccagaggcacctctctggagtgtaccgtatgtgatcctgtcacagccacagaaacgagactggggactaaagcccgtcagttgaacgacgcaagcattcagacttcggcgctgtccaataagactcttacccatggtccccaacccctgacgaaaagtgtgtcactcgattctggcttctcttctatttgcccaatgggtacatgccatgccatcccggcccattgttgtatctgctgtcaccatcatcctcattgtcacggcgagcgacagtcgcctggtccagagcctagtgtgtgccggcactgtctgtgttctttaaccggacatcaagaggcccagttcatgactaccctgaaagctttacaggacaccacggtccgtgagttgtgttcctgtacagtacacgagatggaagctatgaaaaccatttgtcagtccttcagagaatacctcgaagagatcgagcagcacctcatgggtcagcaggccctattcagtcgtgatatgtcagaggaggagagggaggaagccgagcagctgcagacattgagagaagcgctgcgtcagcaggtggccgaacttgagttccaactgggggacagagctcaacaaatacgggagggtatccttctgcagctggaggtgctcacggccgagccacccgaacattactcaaatttgcaccaatacaattggatagaggaaagtaatgggcaaacctcctgcagtaaaatccaccccggtatggcccctcgaacagtgttccctcctgacgatggccaggaagctccttgttccgggggaacccagctggcggccttcacgcctccaactctcgaaaactccacgcgcatgtctccgagctcctccgcgtgggcaaagctgggtccaacacccctgtctaattgcccagtaggcgaaaaggatgcagatgtgtttttgtag

SEQ ID NO: 46243 - DNA, 3135 bp, Artificial Sequence
  Description of Artificial Sequence: Synthetic coding sequence
atgatggcccagaagagccagggcagcgacaacctgcaggagggccaggagaagtctaaacgcgaaattctgaaatgcaccaaatcggcatgggctccattagatgaatggctgccacctgatcctgaggaagagtctcaatcattaaccataccaatgctggaagatagtaaacaagagagcattcaacagtggttagacagtgggtttttcgtttccgctaacgaaaacttccagcaggtcatcgaccggaccgtgagcctgtatgagcagggtatggtgcagatgactgtgaaagactatatgcgctccttgcaccagttctccgaaacacctatcttgagccgcggaacctccttcaattcctgctatagcacagctagtgtcccgcaatcaattcccgaatggctggaattttgggagatcgatcccgttgaaattttgctggacctgggattcggtgcagacgaacctgatatttgcatgcaaatcccggccagatttctgggttgtggctcggccgccagggggatcaacatccgagtttttctcgaggcacagaagcagaggatggatatcgagaatccgaatttgtatggcaggtttaggcaactggaaatcctggatcatgtgaccaatgccttcagctcccttctgagcgacgtttctatcctcccgaaccgagccgaagagaaagcggggggggaaagtgtccagaggacatcggtctctgccgccaaggagcatagaaggcgaatgggtaaactgttgcgaagagccagcaagcaaaatataagacgcgactgcaatccagaggttagtgagagttttaaagtgaaggatgaggtgttcgtgccctttacaaagccatgggactgcggagccgaattagcagcgacaagcatcaatcacaaacagaatcacttgagtttgagcgtggaacatcagtcactgcaggcatgcgacgacctgctgccgtacccccctcatggcctcctgtcgaaacagtggccttgcagttccatgcccgcaaagcaggccccaccctcatgtgtgtccgagggaagcgtaaagggtcggacgcagaaggaaaacctgttccaaaccaataaactaaaatctctttcccacctggcaggaaagggccctgactcttttgaaatggaagaagttcagtccttcgaggaggagactggcaaccccctagacatgacaagtgggactgttggagctcgggtggacagagctaatagttgtcagtccgactcatcgggtttcttggaagagcccctcgagcctctgccattacagatgccctctttgccaaactcacagagccctgctgagaacggcggcagaaagccgagagaccaatcccattcccttgtgagcagccaggactgccaactcgagtctgacgggcctgatagtaagtcccgggcaagcatgagtttttctagtcaggaagccaatgccctggagcagcgtgcctcagtctctgtaatggaggaagaattcttactggaagccatggagggcccgccagagctgtatattccggacatggcctgtgccaagactacaaccagaggagaatgcccacggaaggacagtcatctctggcaactgctccccatgcctcatgccgaatacgaagtgacacggccaaccgccaccagtaagtacgatcatcctctgggatttatggtgacacatgtgactgaaatgcaagacagcttcgtgcgtcctgagggggctggaaaggtccagagccatcacaatgaaagccagcgatcccccggcaatgatcatacgcaggacaaatttctgcatgttgactcggaagcgcctagggaggaagaaagtagcggattctgtccacacacaaatcacagtctgctcgtgccagaatcttcctcacagtgcatccctaaacatagcgaaattaccccatatgcgacagatttggcacagacaagcgagaaactgatcccccatctccataagcttcctggggatcctgctcaggtcaagtcacgtagcggaaccttgggacagattctacccggaacagaagccgaaatggagaacctcccgctcaatactggatcttcccggtctgtgatgactcagatgagcagctccctggtgtcagcagctcagcgcgccgtggctctggggaccggccctcggggcacctcgttggaatgtacagtgtgcgatcccgtgacagccaccgaaacacgactgggcaccaaagctcgccagctgaatgacgcatccatccagacgtccgccctgtctaacaaaactctcacacacggccctcaaccactgacaaagtcagtctcgcttgattctggcttctcctcaatatgccccatgggaacttgccatgccattcccgctcactgctgcatttgctgtcaccatcacccacattgccacggcgagcgccagagtccaggccccgaaccaagcgtatgtaggcactgtctctgtagtctcaccgggcatcaggaggcccagtttatgacgaccctcaaagccctacaggacacgactgtgagggagctctgcagctgtactgtgcacgagatggaggcaatgaagacaatttgtcaatccttcagagagtatcttgaagagattgagcagcaccttatggggcaacaagccttgtttagtcgtgacatgagcgaggaagagagagaagaggcagaacaactccagacgctgagagaggccctgcgtcagcaagtcgccgaactggaattccagttgggcgaccgagcgcagcagattagggaaggcatcctgctgcagcttgaggttctgactgcggaaccccccgagcattactctaacctacaccaatacaactggatcgaggaatccaacggacagaccagttgttcaaagatacatccaggcatggcgccccggaccgttttcccgccagatgacggacaagaagccccatgcagcggggggacccagctcgcagcctttaccccgccaaccttggagaactcaacccgcatgtcgccatccagtagcgcttgggccaagttaggccctacaccactgtccaactgtccagtcggcgaaaaagatgcggacgtcttcctgtag

SEQ ID NO: 46244 - DNA, 429 bp, Artificial Sequence
  Description of Artificial Sequence: Synthetic coding sequence
atgatggcccagaagagccagggcagcgacaacctgcaggagggccaggaaaagagcaaacgtgaaattcttaagtgcaccaagtcagcatgggcaccactggacgagtggctacctcccgacccggaggaagagagtcaatctctgacaatccccatgttggaagatagtaagcaagagtctatccagcagtggctggattcagggttcttcgtgagtgctaatgagaacttccagcaggtgattgaccgtaccgtgtcgctctacgaacagggcatggtccagatgaccgtgaaggactacatgcgcagcctgcaccagttctccgaaacacccattctcagcaggggaacttcatttaacagttgttattctacagctagtgtccctcagtccataccggaatggctggaattctgggaaatttag

SEQ ID NO: 46245 - DNA, 3189 bp, Artificial Sequence
  Description of Artificial Sequence: Synthetic coding sequence
atgcccaccaccgccagctgcaagaccatcagcctgctgaagctgctgtactcggtgtcactgcagaactattcaccaatgatggcacaaaaaagccagggctccgataatctgcaggagggccaggaaaagtccaaacgtgagatcctgaagtgtaccaaaagtgcctgggcaccgttagatgagtggttgccccccgacccagaggaggagtcccagtctctcactatcccaatgctggaagactcaaaacaggagtccattcaacagtggttagactccgggttttttgtttctgcaaatgaaaactttcaacaagtcattgaccgcaccgtgagtctgtatgagcaaggtatggttcagatgacagtaaaagactatatgaggtctttgcatcagttctccgagacacccatcctttcccgaggtacaagtttcaatagctgttattctaccgcgtcagttcctcagtccattccagaatggctggaattttgggaaatcgatccagtggagattcttctggatcttggtttcggagccgatgaacctgatatctgtatgcagataccagcccggtttctgggttgcgggagcgcagcacgtggaattaacatccgagtatttctggaggcccagaagcagcggatggatatcgaaaaccccaatctctacggaagattcagacagctcgaaatccttgaccacgtgactaacgccttttcctctctgctgagcgacgtctccattcttcctaaccgtgccgaggagaaggctgggggggagtccgttcagcgcacctccgtgtctgctgccaaggaacaccggcggcgcatgggtaaattattaagacgcgcatccaagcagaacataaggagagactgcaacccagaagtgagcgagagcttcaaggtcaaggatgaggtgtttgtgccttttactaaaccatgggattgtggggctgaactagcagctacctcaatcaaccacaaacagaatcacctgtcactttccgtcgagcaccagagtttgcaggcctgtgacgatttactgccctacccacctcacgggctgttatctaaacagtggccctgttcgtcaatgcctgccaagcaggctccaccctcctgtgtgtccgagggcagcgtcaaggggcggacacaaaaagagaacctgttccagacgaacaagctcaagtcactgagccaccttgccggcaaaggcccagacagcttcgagatggaggaggtgcagtcatttgaagaagaaaccggtaaccccctggacatgacaagcggaacagtaggggcacgcgtggatcgggctaacagttgccagagtgatagctcgggtttcctggaagaaccccttgagccactgccacttcagatgccatcacttcccaactcccagtcccccgccgaaaatggtgggcgaaaaccaagagatcagtctcacagccttgtttcttcccaggactgccagctggaatccgacgggccggatagcaagtcacgtgcctcaatgtccttttcatcacaggaagcaaatgccctagagcagcgagcttctgtgagtgtgatggaagaggaatttctgctggaggcaatggaggggcccccagagctgtatattccggacatggcatgcgccaagaccactacaaggggtgagtgcccccggaaagatagtcatctttggcagctgttgcctatgccgcacgcagaatacgaggttacacgccctacagccacaagcaaatacgaccatcctttggggtttatggtaacgcacgtcaccgaaatgcaggactctttcgtacgtcctgaaggtgctgggaaagtccagagccatcacaacgagtcgcagcggagtcctggtaacgaccacacccaggataagtttttacacgttgactcagaggccccccgggaagaggagagcagcggtttttgccctcatactaaccatagcttactagttccagaaagctctagtcaatgcattcctaagcactccgagatcacaccctacgccacggatctggcgcagacaagcgaaaagctcattccccatttgcacaaacttccgggagaccccgctcaggtaaagagtcggtcagggaccttgggacaaatactgccgggcaccgaggccgagatggagaacttaccgctcaatacgggtagttcccgttctgtgatgacccagatgtcatcatcccttgtgagtgcggctcagcgtgctgtggccctgggcactgggcctcgtggcaccagtctggaatgcaccgtatgtgacccagtaactgctacagagaccaggctcggcacaaaggcgcgtcagctaaatgatgccagcatccaaacgtccgccctgagcaacaaaactctgacacatggaccacagcctcttaccaagtcagtgtccctggattctggtttctcttctatctgccccatggggacctgccacgccattccagcccactgctgcatatgctgccaccaccatcctcattgccacggcgaacggcagagcccgggtcctgagcctagcgtctgcagacattgtctgtgcagtctcactggccaccaggaggcccaattcatgactacacttaaagcgcttcaagatacaacggtccgtgagctttgctcatgcacagttcacgagatggaagctatgaagacaatatgccagagcttcagagagtacttagaagagatcgagcagcatctcatggggcagcaagcgctattctccagagatatgtcagaggaggaaagagaggaggcggaacagctccagaccctgcgggaagccttgcggcagcaggtggcagagctcgagttccaactcggcgaccgagcacagcagatcagagaaggcatcctcctacagctggaggtgttaacagccgaaccccctgaacattactcaaatctgcaccagtacaactggattgaagagtctaacggccaaacatcctgtagtaaaatccaccctgggatggcccccaggacagtgtttccgcctgatgatgggcaggaggcaccctgctctggagaactactctctgccgaacttgacccattcttcttttcctctaaagcgaacaactccgcaaaagacgagaaaatcaagtcaaaggacttcctgaagacgcaggacagcggactgctgtag

SEQ ID NO: 46246 - DNA, 492 bp, Artificial Sequence
  Description of Artificial Sequence: Synthetic coding sequence
atgatggcccagaagagccagggcagcgacaacctgcaggagggccaggagaagagcaaacgcgagatcttaaagtgtacgaagtcagcatgggccccgctggatgaatggctaccaccggatcctgaggaggaatcacagtccctaacaatcccgatgctggaggactcaaagcaggagagcattcaacagtggctcgacagcggctttttcgtgagcgctaatgaaaattttcagcaggtcattgacagaacagtcagtctttatgaacaggggatggttcagatgaccgtgaaagattatatgagaagcctgcaccaatttagtgagacaccgatcctgagtcgggggacatcctttaatagttgctactctacggcgagcgtaccccaaagtatccccgagtggctggagttctgggagatcgacccagttgagattcttctggatctgggcttcggggccgatgagccagacatatgcatgcagtag

SEQ ID NO: 46247 - DNA, 507 bp, Artificial Sequence
  Description of Artificial Sequence: Synthetic coding sequence
atgatggcccagaagagccagggcagcgacaacctgcaggagggccaagagaaatccaagcgagaaattctgaaatgtactaaaagtgcatgggctcccctcgacgagtggcttcctcccgaccccgaggaagaatctcagagcctgactatccctatgctggaggattccaagcaagaatcaatccagcagtggcttgatagcggattctttgtgtccgcgaacgagaatttccagcaggtcattgatcgcaccgtcagcctgtacgagcaggggatggttcagatgacggtgaaagactatatgcgttcattacaccagttttccgagacccctatactgtcacgcgggacttcttttaacagctgctatagcacagcttctgttccacaatcgattcctgaatggctggagttttgggagattgacccagtagaaatactcctggatctgggtttcggggcagacgagcctgatatttgtatgcagatcccagcccgtttctag

SEQ ID NO: 46248 - DNA, 3165 bp, Artificial Sequence
  Description of Artificial Sequence: Synthetic coding sequence
atgagcttcagcctgcagaactacagccccatgatggcccagaagtcccaaggtagtgataatctgcaggagggccaggaaaaatcaaaacgggaaattctgaagtgcactaaatcagcctgggccccactggatgaatggttgcctcccgatcccgaggaggaaagccagagtctgacaatccccatgttggaggattctaaacaagagtcaatccaacaatggctggacagtggcttcttcgtgtccgccaatgagaacttccaacaagtgatcgatcgcacagtgtcattgtacgaacaaggaatggtccagatgaccgtcaaagattacatgcgctccctccaccagttttcggagactcccattctgtcaagaggaaccagcttcaattcctgttattcaacagcatcagtaccccagagtatccctgaatggttggagttttgggagatagacccagtcgagatactcttagatctgggttttggggctgatgagccagatatctgtatgcagattccagctcggtttctcgggtgtggctctgctgcccggggaattaatatcagggtgttcctggaggcacagaaacagaggatggatatcgaaaaccctaacttgtatggccgctttcggcagctggaaatactcgatcatgtcacgaatgcattcagctctctgcttagcgatgttagcatcttacccaaccgagccgaagaaaaagctggcggggagtctgtccagcgcaccagtgttagtgcagcaaaagaacacaggcgaaggatgggaaaacttctgcgaagggcaagtaagcagaacattcggagagactgcaaccccgaggtgtcggagagcttcaaggtcaaagatgaagtctttgttccattcaccaaaccatgggactgtggcgccgagctcgccgccacctctattaaccataaacagaaccacctctccctgagcgttgagcaccagagcttgcaggcgtgtgacgatttgctcccatatccaccccacggcttgttaagcaagcaatggccttgttcttccatgccagctaaacaggctcccccatcttgcgtctctgaggggtccgtgaagggcagaacacagaaagagaatttgttccaaacaaacaagctcaagtctctgtctcacctcgccgggaaaggacccgattcttttgagatggaggaagtacaatcatttgaggaagagacaggaaaccccttggatatgacgagcgggaccgttggggctagagtggatcgagccaactcttgtcagtcagatagctcaggcttcctagaggagcccctggagcctctgccacttcagatgccatctctgcccaatagtcaaagcccagccgaaaatggggggcgaaaaccgcgagatcaatctcattccctcgtctcctctcaggattgtcagctcgagtcagatggtcccgactccaagtcgagagccagcatgagcttttccagtcaggaagcgaacgcgctcgagcaacgggcctccgtgtcagttatggaagaggaatttctgctggaagccatggagggccccccagaactctatatacccgacatggcgtgtgcgaaaactaccacgcgcggagaatgtccccgcaaagattcccacctgtggcagctcctgcctatgcctcatgctgagtacgaggtcacaagacccacggctacttcgaaatacgatcacccactggggttcatggtaacacatgtcactgagatgcaggatagttttgtgagaccagaaggcgctggtaaggtgcagagccatcacaacgagtctcagcggtcacccggtaacgatcatacgcaggacaaattcctgcacgtcgattcagaggccccacgcgaagaggagtcaagcggcttctgcccacacaccaatcattctttgctggttccagagagttcttcacagtgcattccaaaacactccgaaataacaccgtacgcaactgatcttgctcaaacaagcgaaaagctgattccacatttgcacaaactccccggggatcctgctcaggttaaatcccgctcaggcactctcggacaaatcctcccaggaactgaggctgaaatggagaacctcccactgaatacaggcagcagtagatcagttatgacgcagatgagctcctccctggtatctgcggctcagagagccgtggcgctgggtactgggccccgagggacatcactcgaatgtacggtgtgtgatcccgtgacggctacagagactcggctgggaactaaggctcggcagctgaatgacgcttcaattcagacgagtgcactcagcaataagactttgacccacggcccccagcccctcactaagtcagtgagcttggattcaggattcagttcaatctgtccaatgggcacctgccatgctatacctgctcattgctgtatctgctgtcaccatcacccccactgtcatggggagcggcagtcacccggacccgaacccagtgtgtgcagacactgcctgtgctcacttaccggccaccaggaagctcagttcatgaccacactcaaagccttgcaagacactacagttcgtgaactgtgtagctgcactgttcatgagatggaggccatgaaaactatttgccagtcattccgggagtatctggaagagattgagcagcacctgatgggccaacaagccctattctcaagagacatgtcagaagaggaacgcgaggaggcagaacaactgcagacgctgcgcgaggccctaagacagcaagtggctgaactggagttccagttgggagaccgcgcccagcaaatcagggaaggcatattgctgcagttggaggtcctgacggctgagccaccagagcactatagtaacctgcaccaatacaactggattgaggaatcaaacggccaaactagttgtagtaagatccaccctggcatggccccacgcaccgtgttccctcctgatgacggtcaggaggcaccctgtagcggcggcactcagctggctgccttcaccccgcccacactagagaattccacacgaatgtcgccttccagctccgcatgggcaaagctaggaccaacccccctgtctaattgcccagtgggagaaaaagacgctgacgtgttcttgtag

SEQ ID NO: 46249 - DNA, 2148 bp, Artificial Sequence
  Description of Artificial Sequence: Synthetic coding sequence
atggccgccgacgagagcagccagaacaccctgcggctgcagttcaaggccatgcaggaaatgcagcacaaacggctccagaagcagatggagaagaagagagagaaggaactctctctgaagagtcgcgcggacgatcaggaagagcccttggaagtctccgacgggctttccttgctccacgcaggagaaccaaacagcaagaactccttcgagaagcgagtgctggaggacgagatcgagcatctacgcaacgagcttcgcgagaccgtagacgagaacggacgcctttacaaactcttgaaggaaagagattttgaaattaagcacttaaagaagaagattgaggaggatcgttttgccttcactggaaccgcgggagtggccggggacgttgtggcgaccaagattgtggagttaagcaagaagaatcggctgctgatggccgaatcagaaggtgctaaaactcgggtgaagcagctgaccaaccgaattcaggagctcgaacgggagctgcagacggcactcacacggttgtcagccaaaggtgccaccgacgccggggcgaaacccccgcgagcacagatgggcgaccgggcattgttagaaacccccgaggtgaaggctctacaggataggctggtggccaccaacctgaaaatgagcgacttgcgcaaccagatacagagtgtcaagcaggagttgagaatggcccagaaagtgctggccagagaggtgggtgaggatattaatgtgcagcagttgttgtcatccccaggtacatggcggggacgggcccaacagatcttggtgttacagtctaaagtccaggagctcgaaaaacaactcgggcaggcgcgatcacaaagcgctggaactgcaagcgacgaactctccgtgtatcccgaccctcggaaactgagtgctcaagagaagaatctgctgaggatccgatcactagaaagggaaaaacaggagggactggaaaaactggcttccgagcgggacgtactgcagagggaattagaagagctgaagaagaagtttgaggggatgagatctagaaacaaactattgagtagtgagatgaagaccctgaagtcccagatgggtacattggtcgaaaaggggcgtcacgatgacgaattaatcgacgccctgatggaccagctgaaacagctgcaagagatactgggaagtctgtctctgcaggaagaaaagaccagggtctcgcagcaccatctcgaccagcagctaaactccgaggcgcagaggagtaacagtctcgtggcccaactgcaggctatggtggctgagcgagaggctaaggttcgccagctggaaatggaaatcggacaacttaacgtgcactacttacgcaacaagggtgttggcgagggttcttccggaagggaggtctcccctgcatatacacagtttctcgaggatccagggttgactaagagccccgcttccgcaggggatcacgtgggtcgcctcgggagttccaggtctgtaacgtcactcggccacaccttggtggagtctgctttgaccaggccctcattaccttcaccgcacagaacctcaccccgattttccgacagccccgagcaaaaggggtggcaggctcaagtaagtgaaatcaaagctctctggcaggcagccgaagttgaacgggatagactaaccgaatttgtaactgttcttcagaagcgggttgaagagtcgaattctaaattgttagaaagcgagcggaagttgcaggaagagcggcacagaacggttgtcctcgagcagcacctggaaaagatccgtctcgaacctggcaaagcatcagcaagtcaacgggctgctcctagaacaaagaccggcttaccaacatctaacaaccgccacaatcccacgggatctgagaaaaaggatccctctttcgctcaattgtccgacgtgccagtcgagtcccaaatggaagagctcaccacacgcctcgcaatccaagtcgaagaaaacgagatgctgaaggctgcccttgggtcggctctgcgcggcaaggaggaggatttccgcatgtatcacgaaattctgggacaggtgaaatccgttttcttacaggctctcagacaacagaaaacaggcaaacaatag

SEQ ID NO: 46250 - DNA, 1947 bp, Artificial Sequence
  Description of Artificial Sequence: Synthetic coding sequence
atggagggcgccggctaccgggtggtgttcgagaagggcggcgtgtacctgcataccagcgcaaaaaaataccaggaccgcgacagtctcatcgctggtgtgattcgtgtggttgagaaggacaatgacgtgctgctgcactgggcgccggttgaagaggccggggacagcactcagatactcttctccaagaaggactcctccggtggagactcatgtgcttccgaggaggagccgaccttcgatcctgactacgagccagactgggccgtcatctcaaccgtgcgaccacagctgtgtcacagcgagcccactagaggcgccgagccgtcctgtcctcagggttcctgggcattctccgtctcattaggcgagctaaaatctattcggaggagcaagcccggcctgtcctgggcatacctggtgctggtcacacaagccggaggaagcctgccagccctgcatttccacagaggaggtaccagggcgctgctgcgcgtgttgtctcgctatctcctgctcgcctcgtctccccaggattcacggctttatctggtgtttccccacgattcttctgccttgagcaattccttccatcatctccagctgttcgatcaagattcgtctaatgtggtgtctaggttcttacaggatccgtattccaccaccttttcatcattctcacgagtgaccaatttttttcgcggggctcttcagccgcagcctgagggcgctgccagcgacctccctccgccccccgacgacgagccggaaccaggcttcgaagtcatttcctgcgtggagctaggaccccgtcccacagttgagaggggccctcctgtgaccgaagaggagtgggcccggcacgtgggacccgaggggagattgcaacaggtgcctgagctgaagaatcgcatatttagcggcgggttaagcccctctctgagacgtgaggcttggaagtttctgctgggatacctgtcctgggagggcaccgccgaggaacacaaagcccatatccggaaaaaaacagacgagtattttaggatgaaactccagtggaaaagcgtctcaccagaacaggaacggcgcaactctctcctgcatggctacaggtcactcatagaacgggatgtgagtaggactgatcggacaaataagttctacgaagggcccgaaaacccaggactgggcctactcaatgacatcctgctcacgtattgcatgtatcacttcgacctggggtacgtgcagggaatgtctgatctcctcagcccaattctgtacgtgattcagaacgaggtggatgcattctggtgtttttgcggattcatggagctggtgcaaggaaattttgaagagagccaggaaacgatgaagaggcagttaggacgattgctcctgttgctgcgtgttctggacccgctactctgcgattttctggactcacaggattccggtagcctgtgtttttgttttagatggctgttgatttggttcaagagagagtttcccttcccagatgtgcttcgtctttgggaggtactctggactggattgccagggccaaatctgcatctactggtggcatgtgcgatcctggatatggagagagatacactcatgctgagcggcttcggttctaacgagatcctgaaacatattaatgagctcaccatgaaactctccgttgaagacgtattaacccgggcggaggctctgcatcgccagcttactgcgtgtcctgagctgcctcataatgtgcaggaaatcctgggcctggcaccccccgccgaaccgcattctcctagtccaaccgcctcgccgctgccactcagccctacgcgagctccccccactcccccaccctcaaccgacaccgcaccccaaccagatagctccctggagattctgcccgaagaggaggacgagggagctgattcatag

SEQ ID NO: 46251 - DNA, 480 bp, Artificial Sequence
  Description of Artificial Sequence: Synthetic coding sequence
atgggcgagcggaagggcgtgaacaagtactacccccccgacttcaatccagagaaacacggttctctgaatcgctatcataactctcatcccctccgggagcgcgcacgtaagctcagtcaggggattctgatcatacggtttgagatgccctataatatctggtgtgacggatgcaaaaaccatatcgggatgggtgtgaggtacaacgccgaaaaaaagaaagtgggcaattactacacaacgcccatatatcggttccggatgaagtgccatctctgcgtgaactacattgagatgcagacagatccagctaattgcgactatgttatcgtgtcaggcgcccagaggaaggaggaacggtgggatatggccgacaacgagcaggtgcttactactggagaacgccacccacttacctgtctaggggctttggccctgtccttgcgatggggaccccagagtcctgccgaactgtag

SEQ ID NO: 46252 - DNA, 984 bp, Artificial Sequence
  Description of Artificial Sequence: Synthetic coding sequence
atgcagaagatcaagagcctgatgacccggcagggcctgaagagcccgcaggaatccctgtcagacttgggagcgatcgaatctttgagagttcccggaaaggaggagttccgggagcttagggagcaaccaagcgatccccaggctgagcaggagctgatcaatagtatagaacaggtctactttagtgtcgactcttttgacattgtcaaatacgaattggagaagctccccccggtcttgaacctacaagaactggaggcctatagagataaactgaagcagcagcaggccgccgttagtaagaaggtcgccgatctaattctcgagaaacaacctgcttacgtgaaggaactcgagcgggtgacgtccctgcaaacaggcttacagctggctgcagtaatctgtactaatggcagacgccacctgaacatcgcaaaggaaggctttacccaggccagtcttggcttactagctaaccagcggaaaaggcagctcctcattggactgctcaagagcctccgcaccatcaagacactgcagagaaccgatgtaaggctcagcgaaatgctggaagaggaagattaccccggggccatacagttatgtctcgagtgtcagaaagctgcctccacattcaaacattattcttgcataagtgagctgaacagtaagctccaggataccttggagcaaattgaagagcaactggatgtggctctctcaaaaatttgtaagaactttgatatcaaccattatactaaggtgcagcaggcctatcgcctcctggggaagacccagacagctatggatcagttgcacatgcacttcacccaggcaatacataatactgtatttcaggtcgtcctagggtacgtcgaactgtgtgctggcaatactgacaccaaatttcagaaactgcagtacaaagacctctgcaccgtgtgttctgatctgataacaatccatatcagcctgttgtag

SEQ ID NO: 46253 - DNA, 2895 bp, Artificial Sequence
  Description of Artificial Sequence: Synthetic coding sequence
atgcagaagatcaagagcctgatgacccggcagggcctgaagagcccccaagaaagcctgtctgacctgggggctatcgagtccctgcgggtccccggaaaggaagagttcagggaattgagggaacaaccatctgatccgcaagctgaacaggaactgatcaacagcatagagcaagtgtatttttcggtggacagtttcgacattgtgaaatatgagctagagaaactccccccagtgctgaacttgcaggagctcgaggcttatcgagataaactgaagcagcagcaggccgccgtgtccaaaaaggtcgccgacctgatccttgagaaacagcccgcttatgttaaggagttggaacgggtgacctcactgcaaaccgggctgcagctggccgctgtcatctgcactaatgggcgccgccatctgaacattgctaaagaaggttttacacaagcaagtctgggcctgctggcaaaccagagaaagcgacagctgcttatcggcctgctcaagtctttgcgcacaatcaaaactctccagagaaccgacgtgcggctgtccgaaatgctggaagaggaggactacccaggcgccatccaactctgcctcgagtgccagaaggcggcgagtacatttaaacattacagctgcatctccgagttgaatagtaaactccaggacacccttgaacagattgaggagcaacttgatgtagcactttcaaaaatttgtaaaaactttgacatcaaccactatacgaaagttcagcaggcttacaggttactagggaaaacacagaccgctatggaccaactccacatgcactttacacaagcaatccacaacaccgtgttccaggtagtgctcggctacgtagagctgtgtgcaggcaacacggacactaaatttcagaaactgcaatataaggacctgtgtactcatgtgacaccagatagctacatcccatgtctggccgacctctgtaaagccctttgggaagtcatgctgagctactaccggacaatggagtggcatgagaaacacgacaacgaggatactgcaagcgcctcggagggttccaatatgatcgggacagaagaaactaattttgacagaggctatatcaaaaagaagcttgagcatggtttgactagaatctggcaagacgtgcagctcaaggttaagacgtacctccttgggacagatttgagtattttcaagtatgatgacttcatcttcgtgctggatattatttcgaggttgatgcaagttggcgaggaattctgcggttccaaatctgaggttctgcaagaaagtattaggaagcagtctgtcaactattttaaaaactatcatagaacccgtcttgacgaacttaggatgtttttggagaacgaaacctgggaactgtgtcccgtgaaatctaacttcagcattctgcagctgcacgagttcaaattcatggagcaatcccgctcccccagcgtatcgccttcaaaacaacccgtgagcacatcttccaagaccgtaactctgtttgagcagtactgctccggtggaaatcccttcgaaattcaggccaaccacaaggacgaagagactgaagacgttctcgcatctaatggttacgaatccgacgaacaggaaaagagtgcatatcaggagtacgactccgatagcgatgtgcctgaggaactgaaaagagattacgtggatgagcagacaggggacgggccagttaagtccgtatctagagagacactgaagagtcgtaagaagtctgactactctctaaataaggtaaacgctccaatcctaaccaataccaccctcaacgtgatacgattggtgggaaagtacatgcagatgatgaatatcctgaagcctattgcattcgatgtgattcactttatgtctcagcttttcgactattacctgtatgccatctacactttctttggccggaacgacagcctggaaagtacaggcctcgggttgagtagctccaggctgcggacaaccctcaatcgcatccaggagagcctcatcgatctggaagtgtcagctgatccgaccgccacgctaaccgctgctgaggagcggaaagagaaagtgcccagccctcacctgtctcaccttgttgtgctgacatcaggggacacactgtacggcctagcggagagagtggttgccacggagtccctcgtgtttctggccgagcaattcgagtttctccagccccatctggatgctgtaatgcccgccgtgaagaagcctttcctgcagcagttttactcacaaactgtgtctactgcatccgagctgaggaagccaatctactggattgtagccggaaaagccctcgattatgagcagatgctattgctgatggccaatgtcaaatgggacgtcaaagagattatgtcccagcacaacatctacgtagatgctctactgaaagagttcgagcagttcaacagacgcctcaacgaagtttctaaaagggtgagaatacccttgcctgtatctaatatcttgtgggaacattgtatccggctggcgaaccgtaccatcgtcgaaggatacgccaatgtgaaaaaatgtagcaatgaaggaagagctctgatgcagctggactttcagcagtttctgatgaaattagaaaagctgactgatatccgtcccattccagataaggaattcgtcgagacctatattaaagcctattatttaacagagaatgacatggagcggtggatcaaagagcatcgtgagtactctaccaagcagttaaccaacttggtaaacgtgtgtctgggctctcatatcaacaaaaaggcgcgccagaagctgctcgccgccatcgacgatattgatagacctaaaaggtag

SEQ ID NO: 46254 - DNA, 1242 bp, Artificial Sequence
  Description of Artificial Sequence: Synthetic coding sequence
atggaccagctgcacatgcacttcacccaggccatccacaacaccgtgtttcaagtagtcctgggatatgttgaactttgcgctggtaatacagataccaaatttcaaaagctgcagtacaaagacctgtgcactcacgtgacacctgattcctatatcccctgcctcgcagatctgtgtaaggctctgtgggaggtgatgctctcctattaccggacaatggaatggcacgagaaacacgataacgaagacacggcctccgccagtgaaggttctaatatgataggtaccgaagaaacaaattttgataggggctacattaaaaagaagctcgagcacgggctcacacggatctggcaagacgtgcagctgaaagtcaagacatacctgctggggacagacctgagtatcttcaaatacgacgacttcatcttcgtcctggacatcatctcacgcctgatgcaagtgggagaagagttttgcgggagcaaaagcgaggtcctacaagagagcatccggaagcagtctgttaattattttaaaaactatcaccggacgcggctggacgagctgcgcatgtttctggagaatgaaacatgggagctttgccctgtgaagtctaatttttcaattctacagctgcacgaattcaaatttatggaacaaagtagaagccccagtgtgagtccctccaagcaaccagtcagtaccagttcaaagactgtcacgctttttgagcaatattgttccggggggaatcccttcgagatccaggccaaccacaaggacgaagaaactgaggatgtcttggcttccaatggctacgagtctgatgaacaggagaagtcagcttatcaggaatatgactctgacagcgatgtgcctgaggaactcaaacgggattatgtggatgagcagactggggacggccctgtgaagtccgtttcccgggagaccctgaagagccggaagaaatctgattacagtctcaacaaggtcaacgcccccatattaaccaacacaactctgaatgtgatcaggcttgtggatggtgtctcgttgtgttgcttgggctggtctacagtggctcatctccattcactgcaagcccccccgcccggttttaaaccattttcctgcttgtctctgcccaggagctgggactaccgtagaccaccacccaggcccgctaatttcctgtacttcctgtttttcagcagggatggagttagtccatgctag

SEQ ID NO: 46255 - DNA, 2055 bp, Artificial Sequence
  Description of Artificial Sequence: Synthetic coding sequence
atgcagaagatcaagagcctgatgacccggcagggcctgaagagcccccaagagagcttatcggacttgggagccattgaatctctgagggtccccggcaagcacgtgacccccgattcttacattccctgcctggcagacctgtgtaaagccctatgggaagttatgttgagttattataggacgatggaatggcacgagaagcacgacaacgaggacaccgcaagcgcctcagagggatcgaacatgatcggcaccgaagagaccaattttgatcgcggttacattaaaaaaaaactggaacacggactcacacggatctggcaggacgttcagttaaaggtgaaaacatatctgctaggcaccgatctatctatcttcaaatatgatgactttatctttgtgctggatatcattagcagactgatgcaggtgggagaagaattctgtggatctaagagtgaagtactccaggagagcattagaaaacaatcagtcaactacttcaagaactatcatagaacgcggctcgatgaattgcgtatgttcctggagaatgaaacatgggaactgtgcccagttaaaagcaatttttctatcctgcagcttcatgaattcaagtttatggagcagtcaaggtcaccgagcgtatctccgtcaaaacagcccgtgagcactagtagcaaaacagtcacactctttgagcagtattgctctggagggaacccctttgagatacaggctaaccacaaagacgaggaaaccgaggatgttttggcaagcaacggctatgagtcggatgagcaagaaaagtccgcatatcaggagtatgactccgattccgatgttccagaggagctgaaaagagattacgtagacgagcaaaccggagacggaccagtcaagtcagtgagtagggaaacgcttaaaagtcgcaagaagagtgactatagtttgaacaaggtaaatgctcccatccttacaaacactactctaaacgtcatccgccttgttggaaaatatatgcagatgatgaatatcctcaagcccattgcattcgacgtgatccattttatgagccagctgtttgattactatctttacgctatctacacctttttcggcaggaacgactcgctcgaatccaccgggctgggattatcctcctctcggcttcgcactaccctcaaccggatccaagagtcattaattgacttggaggtctccgcagaccccaccgcaactctgaccgcggccgaagaaaggaaggagaaggttcctagtccccacctgagccacttagttgtgctgacatccggcgacaccctctatggactcgccgaaagggtggtggccaccgagagtctggtgtttctggctgagcagtttgagttcctgcagccccacctggatgcggtgatgcccgccgtaaaaaaaccctttcttcagcaattttactcacagacagtcagtaccgcctcggagttaagaaaacctatttattggattgtcgccggcaaggctttagattacgagcagatgctcttgctgatggcaaacgtcaaatgggatgttaaggaaatcatgtcccagcataatatctatgtcgatgccctgttgaaagaattcgagcaatttaatcgcaggttgaatgaagtatccaaaagggtgagaattcccctgcctgtgtcaaacatcttatgggaacattgtatacggcttgccaatcgtaccatcgtggagggctatgcgaatgttaaaaagtgcagcaacgaagggcgcgcacttatgcaactggattttcagcagtttctgatgaaactcgaaaagctaaccgatattagaccgatccccgacaaggagttcgttgaaacttacattaaagcttactacctaaccgagaacgacatggagcggtggattaaagagcaccgagaatacagtaccaaacagctcactaacctggtaaacgtgtgcttgggctcacacatcaataaaaaagcccggcagaagctgctggctgctatcgatgatatcgatcgtcccaagcgttag

SEQ ID NO: 46256 - DNA, 1782 bp, Artificial Sequence
  Description of Artificial Sequence: Synthetic coding sequence
atgctggaggaggaggactaccccggcgccatccagctgtgcctggaatgtcagaaggcagcttctacatttaagcactactcttgtatatcagaactcaactctaagctgcaggacacactggagcaaattgaggaacagcttgacgtggccctttcaaaaatttgcaaaaattttgacatcaaccactacaccaaagtccagcaagcctatcgcctgttggggaagacccagacagctatggatcagctgcacatgcactttacacaggcgattcacaacacagtctttcaggttgtgttgggttacgtggagctgtgtgccgggaatactgacacaaaattccagaaactgcagtataaagatctatgtacccacgtgacccctgattcctacatcccgtgtctcgccgacctatgtaaggccctctgggaggtgatgctttcttactacaggactatggagtggcatgagaaacacgacaacgaggacaccgcaagcgcctcggagggaagcaatatgatcggaacagaagaaacaaacttcgacagaggctacatcaaaaaaaagctcgaacatgggctcactcggatatggcaggatgtgcagcttaaagttaagacatacttgttaggcacggacctcagcatcttcaaatacgacgattttatatttgtgctcgacattataagccgtctgatgcaggtgggagaagagttttgtgggtctaaatccgaggttttgcaggagtccatccgcaaacagtccgtcaactatttcaaaaactatcacaggactagactggatgagctgaggatgttcctggagaacgaaacctgggagctttgtccagtgaaatccaattttagcatcctgcagctccatgagtttaagtttatggaacagtcacggtcacccagcgtgtcacctagtaagcagccggtttccacaagttcaaagactgtgacgttatttgagcagtattgtagcggtggtaatccttttgagatccaggcgaatcataaagacgaagaaacggaggatgtgttagcctcgaacggctacgagtccgatgagcaggagaagtccgcttaccaagaatacgatagcgacagtgacgtgcccgaggaattgaaaagggattatgtggacgagcaaacaggcgatggcccagttaagtcggtaagtagggaaacactcaaatcacgaaagaagagcgactactccctgaacaaggtgaatgctccgatactgaccaacaccacactgaacgtaataaggctcgtcggaaagtacatgcagatgatgaacattctgaaacctatagcgtttgacgtaatccacttcatgagccaactgttcgattactatctgtacgcgatttatacattttttggtcggaacgactctctggaatcaactggactggggcttagcagctcacgcttacgaaccactttgaatagaatccaggagagtcttatcgatctggaagtttcagctgaccccaccgcaacccttactgccgctgaggagcgaaaggaaaaggtgccaagcccccacctcagccatttggtggttctgacaagtggtgacacgttatacgggttagctgagcgagtggtcgcaacagagtcccttgtattcctggccgagcaattcgagttcctccaacctcacctggacgcagtcatgcctgcggtgaaaaagcctttcctgcaacaattctactctcagtcgcagccccccgttaactacggcaatcagtttactggactttag

SEQ ID NO: 46257 - DNA, 2805 bp, Artificial Sequence
  Description of Artificial Sequence: Synthetic coding sequence
atgctgaccctggaggagttccgggagctgcgggagcagcccagcgacccacaggcagagcaagaacttataaatagtatcgagcaggtgtatttcagcgtggattcgttcgacattgtcaaatacgagctggaaaaactcccacccgtcctcaacttacaagaactggaggcgtatagggacaaattgaagcagcagcaggcagccgtatccaaaaaagtggcagatcttatcttggaaaagcagccagcttacgtcaaagagcttgagagggtgacaagcttgcagactggattgcaactcgctgcagtaatttgtaccaacgggagacgccacctcaacatcgcaaaggagggcttcacacaggcgtctctgggcctgctggccaatcagcgtaagcgccagctgcttatcggcctgctcaaaagcctgagaaccataaagaccctgcagagaacggacgtacgcctctcagagatgcttgaggaagaggactaccccggagcaattcaactctgcctggagtgtcagaaagccgcttcgacttttaaacactactcctgtatttctgaactgaatagtaagctgcaggacacccttgaacaaatcgaggaacagttagacgtcgccttgtccaaaatttgcaagaatttcgatatcaatcactatactaaagttcagcaggcctaccgactgctgggaaagactcagacggctatggatcagctgcacatgcactttacccaagctatccacaacactgtcttccaggtggtgttaggctacgtagagctctgtgccgggaacactgataccaagttccaaaagctgcagtataaggacctgtgcacccacgtgacccctgactcatacattccgtgtctcgccgacctctgtaaggctctgtgggaggtcatgctgtcgtattacaggacaatggagtggcacgagaaacatgacaatgaagacacggcgagtgcatcagaaggctccaacatgatcggtacagaagagacaaatttcgatcggggttacatcaaaaaaaagctggagcatggcctgacacgtatctggcaggatgtgcaactgaaagtgaagacatatctgctaggaaccgatctttcgatttttaaatacgacgactttatattcgtgctggacatcatatcgagattgatgcaggtgggtgaggaattctgcggcagtaaatccgaggtgctacaggagtctattagaaagcagtcggtgaactatttcaagaactaccaccggacccgtctagatgagctccggatgttccttgaaaacgagacctgggaactatgtccagtcaagtcaaatttctccatcctgcagctacatgagttcaagtttatggaacaatctcgctctccgtccgtgagccccagtaaacaacccgtctcaacatctagtaagaccgtgacactgtttgagcaatactgctctgggggtaacccctttgaaatacaggctaatcacaaagacgaagagacagaagacgtgcttgcttcgaacggatatgagtctgacgaacaggaaaagagcgcataccaggagtatgactctgattcggacgtgcccgaggaattgaagcgcgactacgtggacgagcagaccggagacggccccgtaaaatctgtgtcaagggaaaccctgaagagcagaaaaaagagcgattactctctgaacaaggtgaacgcgcctatcctcaccaacacgacacttaatgtgatcagactggtgggcaagtatatgcaaatgatgaacattttaaagcctatagcatttgacgtcatccatttcatgtcccagttatttgactactatctttacgcaatctacacctttttcggcagaaatgattcccttgagtccaccggactcggattgtcttccagcaggctgcggacgacgctgaatcgcatacaggaatctctcatcgatctggaggtctctgccgatccgactgcgaccctgactgctgccgaggagaggaaggagaaggtcccgtctccacatctgagtcacctcgtggttctgacaagtggagatacactatatggcctggcagagagggtggttgcaaccgagagcctggtatttttagcggaacagttcgagttcctgcagccccatctagacgcagttatgcctgccgtgaaaaagccatttctccagcaattctacagccaaaccgttagtaccgcctccgaactccggaagcctatctattggatcgtggccggaaaagccctggattatgaacagatgctcctgttgatggccaatgtaaagtgggacgtcaaggaaatcatgtcccagcacaatatatatgtggatgcactccttaaagagttcgaacaatttaacaggagactgaatgaggtgtctaagcgtgtgcgaattcccctgcccgtgagtaacatcctgtgggaacactgcatcagactcgcgaatagaaccatagtcgaagggtacgccaatgtcaagaaatgtagcaacgaagggcgggctctgatgcagctggatttccaacagttcctgatgaagttagaaaagctgaccgacattcgacccattcctgacaaggagtttgtcgaaacctatataaaggcgtattatctcacagaaaatgacatggaaaggtggatcaaagaacaccgcgagtattccaccaaacagctcactaacctggtgaacgtgtgcttgggctcccacatcaacaagaaggctcggcaaaagctcctggctgctatcgacgacattgatagaccgaagcgctag

SEQ ID NO: 46258 - DNA, 1998 bp, Artificial Sequence
  Description of Artificial Sequence: Synthetic coding sequence
atggagccccgggtggtgaagccccccggccaggacctggtggtggaaagtctcaagtctaggtatggacttggcgggagctgtcccgacgaatacgatttttccaatttctatcaaagcaaatacaagaggaggactttgacctcaccaggcgacctggacatttactccggtgacaaggttggctcttctttaaagtactccgacgaatctaaacattgccgtactcccctcggaagtctgttcaagcatgttaatgtgaactgcctcgatgacgagctcgattcatttcacgacctgaaaaagcaggaaacagaagaggaactgatcgaaaatgactacagggtatccacaagcaagattaccaaacaatcattcaaggaaattgagaaggtggcccttccaactaataccaccagctctcggcctcggacggaatgctgctccgatgctggggattcacctctgaaacccgtgagttgtcctaagagcaaggcgagtgacaaaagaagccttctcccccaccagataagtcaaatttatgacgagctctttcaaatacatctaaaacttcagtgtgaaactgccgcacagcagaaattcgcagaggagcttcaaaaaagagagcgcttcttgttagagcgggaacagctgttattccggcacgaaaacgcattgtctaaaataaagggagttgaggaggaggtgctgacacggttccagatcataaaggagcaacacgacgcagaggtggaacacctgaccgaggtcctgaaggagaagaataaagagacaaaacggcttcgctcctcattcgatgcacttaaagaattgaacgatactctcaaaaaacagttaaatgaagcctccgaggagaatagaaagattgacatccaagctaagcgcgtgcaagcccgcctcgataacttacagcggaagtacgagtttatgaccatccagcgcctgaagggatccagccatgcagtacacgagatgaagtccttgaagcaggagaaggcccccgtgtccaaaacttataaagttccgctgaacggacaggtgtatgagctcctgaccgtgtttatggattggatctctgatcaccacctaagcaaagtcaagcacgaggagagcggtatggacgggaaaaaacctcagctgaagttcgcttcacagagaaacgacattcaggaaaagtgcgttaagctgctaccactcatgaccgaacaactccagtggatgccttttgtgaacatcaaacttcatgagccattcgtcaaatttatttactggtctctgaggcagctcgacgctggcgcccaacatagtaccatgacgagcactctgcgccggctcggggaggatatcttcaaaggggttgtgaccaaaggcatccaagacaattccccacagcacagtgtggagaacaaacctaaaaccgcagctttcttcaagagtagcaaccttccactgaggttcctgagtaccttaattgtgcttaagactgtgacccaggctgactatctggcccaagcgttcgactcattgtgcctcgatctcaaaactgaggaaggcaagactctgttcttggaatatcaggccgtccccgtgatcctcagtcatctccgcatttcaagcaagggcctcttgtcgaatgttatcgactctttgctgcagatgaccgtggaaagcaaatccttgcaacccttcctggaagcatgtagcaactccctgttcttcagaacctgttccgtgctcctccgagctcctaaactggatctgcagatcttggagaagctcagtatcatacttcagaaattgtccaagataaagagcaacaaaaagctgttcgagctctttacaatacacctcatgctgcaagagattcagagaacaaccaaccctgagcatgcattcctgtgtattaaccttaactccacgcttttcaacctgggattaaccaagtgcaatagtctggtgtcttctgcttcaccatag

SEQ ID NO: 46259 - DNA, 1734 bp, Artificial Sequence
  Description of Artificial Sequence: Synthetic coding sequence
atggagccccgggtggtgaagccccccggccaggacctggtggtggaatccctgaaaagcaggtacggcctcggagggtcctgcccggatgagtacgatttttccaacttctatcagagcaagtataagcgccgcaccttgacctccccaggcgacctggacatctattcaggagataaggtgggcagcagcctcaagtattccgatgagagcaagcactgcaggactcctttaggcagtttattcaagcatgttaacgttaattgtctcgacgacgaactagactcatttcacgacctcaaaaaacaggagactgaggaagagctaatcgaaaacgattatcgggtctccaccagtaagattaccaaacagtccttcaaggagattgagaaagtagcccttcccacaaacacaacgtcctctcggccacgcactgagtgttgtagtgatgccggggatagtcccctaaaaccggtaagctgtcctaaatcaaaggcctcagacaaaagatcattactccctcaccaaataagccagatttatgacgagctctttcagattcatttaaagttacagtgcgagactgctgctcagcaaaaattcgctgaggaactacagaaacgagagcgctttctgctcgaaagagaacagctcctgtttagacacgagaacgccctctcaaaaattaagggagttgaagaggaggttttaacccgctttcagattattaaggagcagcatgacgccgaggttgagcacctgacagaagttttgaaggaaaagaacaaagagacaaagcgcttacgcagtagtttcgacgccttgaaggagttgaatgatacgttaaagaagcaattgaacgaagctagtgaggagaaccgaaagatcgatatccaggcaaagcgcgtgcaagcaagactggacaatctccagaggaagtatgagttcatgacaattcaaagactcaaagggagcagtcacgccgttcacgagatgaagtcccttaagcaggagaaggctcccgtttcgaagacctacaaggtgcccctgaacggacaggtctacgagcttttgacagtgtttatggactggattagtgatcatcacctgagcaaagtcaaacacgaggaaagtggcatggatggaaagaagccacaactgaagtttgcttcccagcgcaatgacatccaggagaaatgtgtaaagctgttgcctctgatgactgagcagttgcaatggatgcctttcgtgaacatcaagttgcacgagccatttgttaagtttatctattggtcccttaggcagctggatgcaggagctcaacattcgaccatgactagcactctgcgaagattaggggaagatattttcaaaggcgtagtgaccaagggcatccaggacaactctccacaacattctgtagaaaacaaaccaaaaaccgctgccttcttcaaaagcagtaatctgcccctgcgctttctctctacactgatcgtgctgaaaacggtcacccaggctgactatctcgcacaggcatttgactcactctgcctcgacctcaagactgaggagggaaagaccctgttcttagagtatcaggcagtccctgtgatcctgtcccatttaagaattagctctaagggattgctgtcaaatgtgatcgactccctcttgcagatgaccgtcgaatcccgggtgattagaagttcattgaatttcttgcgatttatctag

SEQ ID NO: 46260 - DNA, 492 bp, Artificial Sequence
  Description of Artificial Sequence: Synthetic coding sequence
atgggcgacgagtgcagcaaccccgacctgctggccgagcccggcagtagccccccatgggatcacggtaaccagcgccaggaggcggcaaatgaatccaatacacgagtaccccgcgtattgaaggcacacttaggccctgaaactgcacaacccacaaaaaggtcaaaaaggaaccgatggcgccggcagagttgtcagggtccaagtccagcacgctccggacagttcctgggcagcgccgacctggggcttcaaaggggcgtgctgaagagcgcagctagaacttgtctgagcgaaatcagtaattctacgcgcgcatcccccgagtcagcccagtcaaccgatcccggtagggcggccaggccacgaacccgcacactgccaactcctcactcctttaaaatcggggaggaagcggaagaaatgaaaaagaaaaaggaacgcaagcgccggaaagagaggaaaaaagagaggaatttcaagaagtag

SEQ ID NO: 46261 - DNA, 54 bp, Artificial Sequence
  Description of Artificial Sequence: Synthetic coding sequence
atgggcgacgagtgcagcaaccccgacctgctggccgagcccggcagcagttag

SEQ ID NO: 46262 - DNA, 2628 bp, Artificial Sequence
  Description of Artificial Sequence: Synthetic coding sequence
atgcagttccagagcctgaaggagttctacgagaccgagatcccccagaaggagcaggacgacgccaaggctaagcactgcagcgacagtgccgaaaagcagtggcaacttttcttaaaaaaaagctttatcacccaggatcttggtcttgagttcctgaacctgattaatatggccaaagagaatgagatactcgatgtgaaaaacgaggtctacctgatgaagaacaccatggaaaatcagaaagcggagagggaggagctgtctctcctgaggctcgcctggcagctgaaggcaaccgagtcaaaacctggcaagcagcaatgggcggcgttcaaggaacagctgaaaaagacctcccacaacctgaaactcctgcaagaagcacttatgcctgtgtcagctctcgacctcggtggttctctgcagtttatcctggacctgcggcaaaaatggaatgacatgaagccccaattccagcagctcaatgacgaggtgcagtatataatgaaagaatccgaagagctcacaggccggggggccccagtaaaggagaaaagtcaacagctaaaggatctgatccattttcaccaaaaacagaaggagcggatacaagactatgaggacattctttataaagtggtccagtttcaccaagttaaggaagaattaggccgcctcattaaatcacgtgaactggaattcgtagaacaaccgaaagagctgggtgatgcacatgacgtacagattcacctgaggtgcagtcaggagaagcaggccagagtggaccaccttcaccggctggccctttctttgggagtcgatatcatctccagcgtacaacgaccacactgctcaaatgtctcagcaaagaacctccagcaacaactcgagctcttagaggaagattcaatgaagtggagagctaaagctgaggaatatggcagaaccctgtctcgctccgtggaatactgtgctatgagagatgagattaacgagctgaaagatagcttcaaggatataaagaagaaatttaacaacttaaagttcaactataccaaaaagaacgagaaatctagaaacttaaaagccctcaagtatcagattcagcaggtagacatgtatgccgaaaagatgcaggccctcaaacgaaagatggagaaagttagtaataagacatctgactcgtttctgaattatccctccgataaagtgaacgttctgctggaagtcatgaaggatctccagaagcacgttgatgatttcgataaggtagtgacggattacaagaaaaaccttgacctcacggaacattttcaggaggtgattgaagaatgccatttttggtatgaggacgctagcgctaccgtcgtcagggtcggaaagtactctacggaatgtaaaaccaaggaagcagtgaagattctgcaccaacagttcaacaagtttatcgccccatccgtcccacagcaggaagaacgcattcaagaggccacggatctggcccaacatttgtatgggctggaggaggggcagaaatatattgaaaaaattgtaacaaagcacaaggaagtcctggaatcggtgaccgagctctgtgagtcactgacagagttggaagagaaactcaagcagggagatgtattgaaaatgaatccaaatctcgaggattttcactatgattatattgatctgctcaaggaaccggctaaaaataagcaaacaatcttcaacgaagagcgcaacaagggtcaggtgcaagttgcagaccttctcggcatcaacgggactggagaggaacggctaccccaggacctgaaagtgagcacggacaaagaaggcggcgtgcaggacctgctcttacccgaggatatgctgtcaggggaggagtacgagtgcgtgtcacccgatgatatatcacttccgccccttcccggctctccagagagtcctctcgcacctagtgacatggaggttgaggagcctgttagttcctccctcagcttacacatctctagctatggggtgcaggccggcacgagcagccctggcgatgcccaagagagcgttttgcctcctcccgtggctttcgccgacgcatgcaatgacaagcgcgaaacgttttcatcccactttgagcggccgtatttgcagttcaaggcagagccacccttgacctcccgcgggtttgtggaaaaaagcactgcccttcaccggatatcagctgagcatcccgagtcaatgatgagcgaagtccatgagcgcgccctgcagcagcatccccaggcacaaggaggcttgctggagacacgggaaaagatgcacgcggacaataattttacaaagactcaagaccgcctccacgcatcctcagacgcctttagcggactgcgttttcaatcaggcacaagtagaggttatcagcgacagatggtgcctcgcgaggaaattaaaagcacgagcgccaaaagttctgttgtgagcttagcagaccaggctccaaacttttccaggctgctctcaaacgtcacggtgatggaagggagtcccgtaactctcgaggtcgaagtgacagggttccctgagcctacgttgacatggtgggtcgcctacaacgataagccatag

SEQ ID NO: 46263 - DNA, 2685 bp, Artificial Sequence
  Description of Artificial Sequence: Synthetic coding sequence
cggagccaggtgctgcagacctacgtggccttcctgaagagcagcgaagaggttgaaatgcagttccagagcctgaaagagttttacgagacggaaatccctcagaaagagcaggacgacgccaaggcaaaacactgctcagacagtgccgagaagcaatggcagctcttcctgaagaagtcatttataacccaggaccttggactcgagtttctaaacctcattaatatggcgaaagaaaacgagatcctggatgtaaagaacgaggtgtacctgatgaagaatactatggagaatcagaaggcggagcgggaagaactttccttacttaggctggcgtggcagctgaaggccaccgaatctaagccaggcaagcaacagtgggccgcattcaaggagcaactgaagaaaacatctcataaccttaaacttctgcaggaagcactgatgcctgtcagcgcccttgatctaggtgggagcctgcaatttatcttggacctgagacagaaatggaacgacatgaagccgcaatttcagcagcttaatgatgaagtgcagtacatcatgaaggaatctgaggagttgacgggaagaggggcacctgtgaaagaaaagagccagcaattgaaggaccttatccatttccaccagaagcagaaagagaggatacaagactacgaagatatcctgtacaaggttgttcagtttcaccaagtgaaagaggagctgggcaggctgatcaaatccagagagctcgaattcgtggagcaaccaaaagagctcggggatgcccacgacgtgcagatccatctgcgctgcagccaggagaaacaggcccgagtggatcatttgcatcggctcgcgctgagcctgggcgtggacataatatccagcgttcagaggccccactgcagtaacgtgagtgcgaaaaacctgcagcagcagcttgagttgttggaagaggatagcatgaaatggcgcgcaaaagcagaagagtacggacgtaccttatctaggagcgtggagtactgcgcaatgcgggatgaaatcaatgagctgaaggactcctttaaggacatcaagaaaaaatttaataatctgaaattcaattacactaaaaagaacgagaaatccagaaacctgaaggcactgaagtaccaaatccagcaggtggatatgtacgctgagaaaatgcaggccttaaaaaggaagatggagaaagtctcaaataagaccagtgattctttcctgaattatcctagtgacaaagtaaacgtcttgctggaggtcatgaaggatcttcagaaacacgttgacgacttcgacaaggtcgtaacagattataaaaagaatctggaccttacggaacactttcaggaagtcatcgaggagtgtcatttctggtacgaggacgcctcggcaactgtggtgagggtggggaagtattccactgaatgcaagacaaaagaagccgttaaaatcttgcaccaacagtttaataagtttatagcaccaagcgtgccacaacaagaggagcgcatccaggaagcgaccgatctggcacaacatctttacggcctggaggaaggccagaagtatatagaaaagatcgtgaccaaacataaggaggtgttggagagcgttaccgaattatgtgagtccctcaccgaattggaagagaaactcaaacagggggatgtccttaaaatgaatcccaacctggaagatttccattacgactacatcgacttgttaaaggagcccgctaagaataaacagacaattttcaacgaggagagaaacaaagggcaggtgcaggtggccgatctactggggatcaacggcaccggcgaggagagactcccacaagatctgaaagtctctacggataaggagggtggcgtccaagacctccttttacccgaagacatgctatccggagaggaatatgagtgtgtctctcctgacgatatcagtctgcctccgcttcccggatccccagaatcccccctggccccgagtgacatggaagtggaagagccggtgagttccagcttgagtctgcacatttcatcatatggcgttcaggccggcacctcctcacccggcgatgcgcaggaatcagtacttccaccaccagtggcttttgctgacgcgtgtaatgacaaaagggagacattcagtagccatttcgagaggccctatttacaatttaaggctgagccacctcttactagtagaggcttcgtcgaaaaatccacagccctgcatcgaatctccgcagagcaccctgagagcatgatgtcagaggtgcatgagcgggctttacaacaacaccctcaggctcaaggaggtttgttggagacaagagagaagatgcacgccgacaataatttcactaaaactcaggataggctgcatgcctccagtgacgccttttccgggctacgctttcaatcagggacatctcgaggctaccagcgtcaaatggtccctcgagaggaaatcaaatctacaagtgcaaagtccagtgtggtgagtctggctgaccaggcacccaacttctcaaggttgttgtcgaacgtcaccgtgatggaggggtcacccgttacactcgaggttgaagtcacaggctttccagagcctacactaacttggtgggtggcgtacaacgataaaccatag

SEQ ID NO: 46264 - DNA, 4593 bp, Artificial Sequence
  Description of Artificial Sequence: Synthetic coding sequence
atgagcagccagggcagccccagcgtggccctgagcaccaccaccgtgtccagcgtcgcagtgcaggcgggggatagcaagatcgttatagccgtgatcaaatgcggaaagtgggtgcagctgcagctggctgagtcacaacctaacttactggagataggaagctcccaagacgaaactaagaagctgctccatgaccacgaactgctgctcgctaaactaaaggccctagaggatagggtgtgggaattgctgcaggaggctgacaagactgccgaggaaaacaaggaccaaagccaagtgtacgacgcaatggcggagactcttggcgaggcctgggctgcgctagtgtcgatgttggagcgcaggaccgagcttctgagattgacctcagaatttttcgagaatgccctggaattcgccatcaaaatcgatcaggccgaagattttttgcagaatacccacgagtttgagtcagctgagtcgctgaagagcctgttgcagcttcacgaacaccatacgaaagagttgttggagcgatcccttgctctcctgaacaagagccaacagctgaccgattttatcgaaaagttcaagtgtgagggccccaacgtaaacccggagctgacccagggggctcacagctcttgtctgaaagtggaccggctgctcgagctgctgcaggataggaggcgccagctggataaataccttaagcagcaatggcaggagctgagccaggtgctccaaatctgtcagtgggatcagcaagagaaccaggtgacctgctggtttcagaagacaataagaaacctccaggagcaatctctcggcagctccctaagcgataacgaagaccggattcacaagcaggaggagttaatcattaaagcaaaagagtggaatagcgccgttgagaagctcaaatcagaggccctcagaattctgctgtccaaagattacgtggaaaaggaacacttgcaactgagccatcagaagctgtcccagctgcaagaggaatttggacagctgatggtggaacgcaatacttggctcaaaaaggccaatgagttttttaatagcgctaacaaagcgttcgatgtgctgggccgcgtggaggcttatcttaagctgctgaagtcagagggcctgtctttggcagtgcttgctgtcagacatgaggaattgcaccggaagattaaggattgcactacagatgccttgcagaaaggacaaaccttgatctcacaggtggatagctgctcttcccaggtttcaggaatccacgagatgatggggtgcatcaaacgccgcgtcgatcatctgaccgaacaatgcagtgctcacaaggagtacgcgctgaaaaagcagcagcttactgcatctgttgaaggatatctgcgtaaggtcgaaatgagcattcagaaaatttcccccgtcctgtccaatgccatggacgtggggtcgactagatccgaaagtgaaaaaattctgaacaagtatttggaactcgatatacaggccaaagaaacttctcatgagctggaagccgccgccaagacgatgatggaaaagaatgaattcgtctcagacgagatggtgagtctttcatccaaggccagatggttggctgaggagctcaatctatttggccagtctatcgactataggagccaagttctccagacatacgtagccttcctcaagtcctcagaagaggtcgagatgcaatttcagagtctgaaagagttttatgagaccgaaatcccacagaaagagcaggatgacgcaaaggctaagcattgctctgactccgcagaaaaacagtggcagctgtttctgaaaaaaagcttcattactcaggatctcggcctggagttcctgaacctgatcaacatggccaaagaaaacgaaatcctcgatgttaagaatgaggtgtatcttatgaagaataccatggagaaccagaaagcggaaagagaggaactatcccttctgcggctcgcctggcagcttaaggcgacagagagcaaacccgggaagcagcagtgggcagcattcaaggaacagctcaagaaaacatcgcacaatctgaagctcctgcaggaggccctgatgccagtcagtgcattggatttaggaggatcgctgcagtttatacttgaccttcgacagaagtggaatgatatgaagccccagtttcaacaacttaacgatgaggtacagtatattatgaaggagtctgaagaattgacaggtaggggtgctcccgtaaaggagaagagccaacagctgaaagatcttattcattttcaccaaaagcagaaggaaaggattcaggactacgaggacattttatacaaggtggtgcagtttcatcaggtcaaggaggaactaggaaggctcattaagagccgtgaactcgagtttgtcgagcagcctaaggagctcggggacgcccacgatgtccagattcaccttcgttgctcccaagaaaaacaagcccgcgtcgaccacttgcataggctagcactttctctcggcgtcgacatcatctcaagcgtacagcggccccactgttccaacgtttcagcgaaaaacttgcagcagcagctcgagctgctagaagaggactccatgaaatggcgcgctaaggctgaggaatatgggagaactctttcaaggagcgtggagtactgtgcaatgcgcgacgaaattaacgagctcaaggactcttttaaggatatcaagaagaaatttaataatctgaagtttaactacaccaaaaaaaacgaaaagagccgtaacctgaaggccctcaaataccagatccagcaagtggacatgtacgcagagaaaatgcaagctcttaagcgcaagatggagaaagtttcgaacaaaacaagcgactcgttcctgaattatccttcggacaaggtgaacgtgctgctagaggtgatgaaagacctgcagaagcacgtggacgactttgacaaggtcgttacagattataaaaagaatctggacctcacagaacacttccaggaggtaatagaggagtgtcatttttggtacgaggatgcgtcagccacagtggtacgagtggggaagtacagcactgagtgtaagaccaaagaagcagtgaaaattcttcaccagcagttcaataagttcatcgcaccaagtgtcccacagcaagaagagagaatccaggaggctactgacctggcccagcacctctacggactggaagaggggcaaaagtatatcgagaaaattgtaaccaagcacaaagaagtgttagagagcgtgaccgagttgtgcgaatcactgacagaacttgaggaaaagctgaagcagggagacgtccttaagatgaaccccaatctggaggactttcattacgactacattgatttgcttaaagagcctgctaagaacaagcagactatatttaacgaggaacgcaataaaggccaggtgcaggttgccgaccttctggggattaacggcaccggagaagagagactaccccaggatctaaaggtgagcaccgacaaggaaggaggagtgcaggatttactcctgccggaggacatgctttccggagaagagtatgaatgtgtgagtcctgacgatattagcttgcctccccttcccgggagccctgagagccccctggcgcccagtgacatggaagtggaagaaccagtgagttcgagtctgtctcttcacatttcatcctacggcgtccaggcagggacatctagccccggtgatgcccaggaaagcgtgctccccccacccgtggcttttgccgacgcatgtaacgacaagcgggaaaccttctccagtcatttcgagcggccatatctgcaattcaaggctgaacccccccttacaagccggggtttcgtcgagaaaagtacggccctacatcggatctcagctgaacatcctgagtcaatgatgagcgaggtccacgaacgggccctccagcagcatcctcaggcgcaaggtggcctactagagacgcgagaaaagatgcatgccgataataacttcaccaaaactcaggataggctgcatgccagcagtgatgccttttctggactcaggtttcagagcggaacatcccggggctaccagagacaaatggttcctcgcgaagagataaagtctaccagcgcaaagtccagcgtggtgtcactggctgaccaggcaccgaacttctcccggctcctgagcaatgtgactgtgatggaagggtctccagtcaccttggaggtggaggtgacgggttttcccgagcccacactgacgtggtataagaagggccagaaactctcagccgatggccacctccaggtactgcacaaggagacaaggcactcagtgtttataccaaaagtgtgcaaggctgacgctgggctgtacgtggccagagcccagaacagttcaggagccctgtcatctaacgtgatacttcacgtcacgggaaactgtcgtttgcccattacccgggttaattggatcaccctgtgtgtggtttatgtatccgtgtcacttatgtattggttgctgacacagtag

SEQ ID NO: 46265 - DNA, 2253 bp, Artificial Sequence
  Description of Artificial Sequence: Synthetic coding sequence
atggcccaggccagccggagcggcagcctgccccccctggtgatcgtccctcccctgagggctcagcctggcggtacaggcgaagaacagtgggagagaagcagaactggggggcttcgctgggaggttcactgttggcccagcgggacctccggcgggacaccctggtggccaactccagctgacgtgtcagaggactacgaggccgacgctgctgcctggagacgcggacccgccggcgggggacctatcccaccagcactccagcgccttagagcagtgttgctccgcctccacagagagagggagcagctgcttcaggcaagagattgcgcgtatcacctccagagcgccgtgcggcttatgaagacactgagtcccggctccccaagtgggggcccatcgccactccctcaatggtgtcgggaccttcagctgcatccttcccagggggccgtcctccgaattggccccggagaaaccctggagcctctcctgctggcgcggcccattggtctcgccgcacaatgtttggaggccgtgatcgagatgcagctaagagcactgggcagagaacctgccagcccggggttgagctcccaattggcggagctcttattcgccttgcctgcgtaccatacgcttcagagaaaagcccttagtcatgtgcctggtgcagccagaccttttcctacctccagggtgcttcggctgctcaccggcgagcgcggctgccaggtggctagccggctggacgaggcccttcagggaagcgctttgcgggaccagctgcggaggcgctgccaggaagagggcgacctgctgccgggcctactcgggctcgtcggcggcgtggcaggcagcgcctcatgtggtctgggcctgggaggagccggcgctctgtggagtcagtattggactcttctgtgggccgcgtgtgcgcagtccttagacctcaatttgggcccctggcgggaccctcgcgcgacagcccaacaactaagccaagccttaggacaggccagcctcccccaggagtgtgagaaagaactggcctctctgtgccatagactactccaccaatctctgatttggtcctgggaccaggggttttgtcaggcactggggtccgctttgggcgggcagagttccctgcccacaagctctggcaccgccgagctgctccagcaactctttccccctctgctggatgccttaagggaacccagactgaggcgcatcttctgccagcccgccgacccagccccagtggcactggggctatgtactctgcagaccacactcctttggtttctcggaagagctcagcagtatctggccgcatgggatcctgcatccttcctgctgctgatccagaaagatctgccacccctgctgcatgaagcagaggccctgtactctctagccagtgaagagagtctggccctggaagtggagcagcagctcggactggagattcagaagcttacagcccagatacaactgctccccgaagagtccctgtccgttttctctcaggagtgccacaagcaagccatgcaaggattcaagttgtacatgccaaggggtaggtactggagattaagactatgccccgaaccaccatcagccccatcagagtatgcaggcctggtggtacgtaccgtgctcgagccagtgctacaaggcctccaggggctgcctccgcaggcgcaagcacctgccttgggccaggcattaaccgccattgttggagcctggcttgatcacattctaacccatgggatccgatttagtttgcagggcgctctccagctgaaacaggactttggcgtagtacgcgagttgctcgaagaagagcagtggagtctctctccagacctgagacagactctactgatgctgtcaatttttcagcaactggatggggcactgctgtgcctgcttcagcagcccttgccgaagtcccaggttcaccgtcgccctccatgttgttgcgcatgtcaagaggtgcagacgacgaagctgccctcctcctgcctgaactccctggagtcgctcgagcctcccctgcaaccaggaacatcaccagcacaaacaggtcagttgcagtcgaccctcgggggtcggggcccaagtccagaaggctatctggtagggaaccagcaggcgtggctcgccctccgacagcaccagcgtccacgctggcacctgcccttttttagctgtctcgggacttcacccgaaagctag

SEQ ID NO: 46266 - DNA, 2232 bp, Artificial Sequence
  Description of Artificial Sequence: Synthetic coding sequence
atggcccaggccagccggagcggcagcctgccccccctggtgatcgttcctcctttacgagctcaacctggtgggaccggcgaggagcagtgggaacgctccaggacgggtgggctacgctgggaagtccactgttggccttcgggaacctccggaggtacaccgtggtggccaacacctgcagatgtctctgaagactacgaggcagatgctgctgcctggaggcggggacccgcaggaggcggccctatcccccctgcgctgcagcggctgcgggccgtgcttctgcgccttcaccgagagcgcgaacaattgctgcaagcgagagattgcgcctaccatctacagagcgcagtaagactgatgaaaacgttgagtcctggaagccccagcggcggccctagcccgctgccgcagtggtgccgcgacttgcagctccacccgtcacagggcgcagtgcttcgcatcggccccggcgaaaccctggaacctcttctgttagcacgccctatcgggctggctgcgcaatgcctggaggcggtaattgagatgcagctccgcgccttaggcagagagcccgcatctccaggcctgtctagtcagctggctgagctactttttgctctccctgcatatcacactttgcagcgcaaagctctgagccatgtgccaggcgccgcaaggccatttcccaccagccgagtgctgagactgttaacgggggaaaggggatgtcaggtcgcaagccggctggacgaggcattgcagggaagcgccttgagggaccagctgcgacgccgctgtcaggaagagggcgacctcttacctggcctgcttggcttggtcggcggtgtcgctggcagcgccagctgtggtctggggctcgggggagcaggagctctgtggtcacagtactggactttactatgggccgcatgtgctcagtctcttgacctaaatttgggcccctggcgcgatccccgcgctacagcccagcagttatcccaggctctgggtcaagcaagtctccctcaggagtgtgagaaagaactggcctccctctgccaccgccttctgcatcagtctctaatctggtcttgggatcaagggttttgtcaagctctcgggagtgctctgggagggcagtcttcactgcctaccagcagcggaaccgccgagctactacagcagttgttcccaccgctactggatgctctgagagagccccggctgcgccggatcttctgccaacctgccgggttgtgcacactgcagaccaccctgctgtggttcttaggccgggcacagcagtacctagccgcttgggaccctgcttcgtttctgcttctgatccagaaagacctgcccccgctattacacgaggcagaggctttgtatagcttggcctcagaggagagcctcgctctggaggtcgagcagcagctagggcttgagattcagaaactgactgcccagatccagctgctgcctgaagagtcactgtcggttttttcccaagagtgtcacaaacaggcaatgcagggttttaagttatacatgccccgcggtcggtactggagattacgcctctgtcccgagcctccaagtgcaccttcagaatatgcgggcctggtggttcgcacagtgctggagcctgtcctgcaggggctgcaaggcctgccacctcaggctcaggcacccgctctgggccaagctctaactgccatcgtcggggcttggctggatcacattctgacccacggaatccgcttttcattgcagggcgctctacaactgaaacaagattttggggttgtaagagagttgttagaggaagagcagtggtctctatccccggatctccgacagacactgcttatgctgtctatcttccagcagctggacggcgccctgctttgcctgttgcaacagcccctgcccaagtcacaggtccaccggcgcccaccgtgctgctgcgcttgtcaggaggtgcaaactacaaaattgccctccagctgtttgaatagtctcgaatcacttgagccacccctgcagccagggacttctccagcccaaacgggccaattgcagtccacgctgggcggacgcggcccctccccggaggggtacctggtcgggaatcagcaggcatggttggcgctgagacagcatcaacggccccgctggcatctgccgttcttcagctgtttgggaacctcacctgaatcctag

SEQ ID NO: 46267 - DNA, 666 bp, Artificial Sequence
  Description of Artificial Sequence: Synthetic coding sequence
atggccagctggggcggcgagaagcggggcggcgccggcggcagccccaaaccagccgtttatgccaccaggaagacaccatccgtaggtagccaagaagaccagtggtatctcgattaccctggagatcagtggagcctcgggttcagctatagctggtggaaaaatagcgtggggagcgaatccaaacacggcgagggtgccttggaccagctgcagcacgacgtgcggctggaggacctgggcgagctgcatcgcgctgccagatctggagacgtgcccggcgtcgagcatgtgctggcccctggcgacactggggttgataaaagggacagaaagaagagcattcaacagctcgtgccggagtataaagagaagcaaacacccgagagccttccccagaataataatcctgcagcccctagccaggccgaaggaggagaaggaggtgtggcctgcgggacagtggagcaaatgacttggctgtgctcactgcctcacgcagtgggaggcggcgacggcgaccactctagcaccggggcagtaggaggacaccctcgagggcctggcgaatattgccacctgcacgaacaacgggtgcaccaccacatcttcgcacggggaaagagaaaaggtaagaatcatgtgagcaacgtggtgagatag

SEQ ID NO: 46268 - DNA, 2757 bp, Artificial Sequence
  Description of Artificial Sequence: Synthetic coding sequence
tgaaagggctgcgagaacaagcagccccaggtggaggaggagatggagaagcatcggagtaattcaaccgagctgtcaggcacactgacagacggaaccaccgtcggaaacgacgatgacgggcttaatcagcagattccccgaaaagagaacggcgaacacgaccgccccgccgataaaacaagtaacgaaaaaaatgaagttaagaaccaaatctatcctgaggcggattttgctgattctatggaaccatcagagatcgcgtctgaggattgcgagttgtcccactccgtatacgagaacttcatgctcctgatagagcagctcagaatggagtacaaggacagcgctagcctgccacggattcaagacactttttgtctgtgcgaacacctgctgaagttgaaaaacaaccattgtgatcagctaacagtcaagctgaagcaaatggagaatatggtcagcgttttgcaaaacgagttaagtgagaccaaaaagaccaagttacagctggagctccagaaaattgaatgggaaaaggagctgtacgatctgcggctggctctgaagcaggagaatgaggagaagcgtaatgcagatatgctgtataataaggactctgaacagctgcgcattaaggaagaagagtgcggcaaagtcgtcgaaactaagcaacagttgaagtggaatctgcgccggctggtgaaagaattgaggacggttcggaataatctggatctggtcgtgcaggaacgcaacgacgcccagaagcaactctcagaagagcaggacgccagaatcctccaggatcagattcttacctccaaacagaaggagcttgagatggcgcgaaagaagatgaactccgagatcagccataggcaccagaaggagaaggacttattccatgaggattgtatgctgcaggaggagatcgcgttgttacggctggaaatagacacaatcaaaaaccagaacaaacagaaggaaaaaaagtattttgaagatatcgaagcagtgaaagagaaaaatgacaatctgcagaagataataaaactgaacgaggaaacactgaccgaaactattctccagtactctgggcagctcaacaacttgaccgcagagaacaaaattcttaattccgagttggagaatgggaaacaaaatcaggaacggcttgagattgaaatggaatcctatcgctgtaggctggctgcagctgtgcgcgactgtgatcagtcgcagaccgcgagagatctgaagctggacttccagagaacacgccaggaatgggtgagactgcacgacaagatgaaggtagacatgagtggcctgcaggccaaaaatgaaatactttctgagaaactgtcgaatgctgagagcaagatcaactctttgcagatacagttacacaatacgagggatgcactagggcgcgaatctctgattctcgaacgggtgcagcgtgacctgtcacagactcagtgtcagaagaaggagactgaacagatgtatcagatcgagcaatcgaagctcaaaaagtacatcgctaagcaggaaagtgtggaggagcgtttgagccaattgcaatccgagaacatgcttctgcggcagcaattagacgacgcccacaagaaagccaacagccaggaaaagacctcttccactatccaggaccagtttcactccgctgccaaaaacctgcaggctgagagcgagaagcagattctgtctctgcaagagaaaaataaggaactgatggacgaatataaccacctcaaagagcggatggatcagtgcgagaaagagaaggccggcagaaaagtcgtgatgagagagtttcagcaagagtggactgatctcctaaagcaacagcctacctccgaggcaactagtcgctgtcacatcaatttggacgagacacaagactcaaaaaaaaaactcgggcagatcaggagtgagattgatttgaccgaagcacaggagacagtaccgtctcggtgtctccacttggatgccgaaaacgaggtactgcaattgcaacagacgctcttttcaatgaaggctattcagaagcagtgcgagactctccagaagaacaaaaaacagctgaagcaagaagttgtgaacctaaagtcctacatggagcgcaatatgctagagcgtggaaaagctgagtggcacaaacttcttattgaggagcgagcccgaaaagaaatagaggaaaagttgaatgaagctattttgacgctgcagaaacaagctgccgtttctcacgagcagctcgtgcaactgcgggaggataataccacttcaataaaaactcagatggagttaacaatcaaagatctcgagtccgaaatcagccggatcaagacttcccaagcagatttcaataaaacagaacttgaaaggtacaaggagttatacctggaggaagtgaaggtgagagaatctctaagcaatgaactctctaggacgaacgagatgatcgccgaagttagtactcagctgacggtagagaaagagcagaccagatctaggtccttgttcacagcttacgctacgcgccccgtcctggagtcaccgtgcgtgggcaatctcaatgatagcgaaggactcaaccggaagcatatccctcgaaagaagagatctgctctgaaagatatggagtcttatctgttgaaggtgtcttacttgttttcttttggcgtacagatttcagatagaatacttgtgtgttaccttgtcaagtag

SEQ ID NO: 46269 - DNA, 1716 bp, Artificial Sequence
  Description of Artificial Sequence: Synthetic coding sequence
atggccagctggggcggcgagaagcggggcggcgccgagggcagccccaagcctgccgtctacgcgacgcgaaaaaccccttccgtagggtcccagggcgaccagtggtacttaggctaccctggtgatcagtggtcatctggctttccctattcatggtggaaaaacagcgtgggtagcgaaagcaagcatggggagggggcactagaccagccgcaacatgatgtccgcttggaagacctgggggagctgcacagggcggctagaagtggcgacgtccccggcgtcgagcacatattggcacccggagatactggcgttgacaagcgcgatcgtaagaagtctattcagcaacttgtgccagaatacaaggaaaagcaaactcccgagagtcttccccagaacaataaccccgattggcatcccacgaacctgacgttatcggatgaaacatgtcagcggtccaagaatctcaaagtagacgataagtgcccgtccgtgtctccttcgatgcccgaaaaccagtccgccacaaaagagttaggtcagatgaatctcaccgagcgagagaagatggacactggtgtggtcctgctgtcagggaacgacaccctgcacgacctgtgccaaagccagctgcctgagaataaggagagtaaagaggaacaggacagcgagctgacttctgaagaggaacaggaacggttgaagggatgcgagaacaagcagccgcagaagacaagtcaggagccggagatggctaaggattgcgacagagaagacatacctatctatcctgtcctgccgcacgtccagaaaagtgaggagatgtggatcgaacagggaaaactggaatggaagaaccagctgaagctagttattaatgaactcaagcaacgctttggggagatctatgaaaagtacaaaattcccgcctgtccggaggaggagcctctcttggacaatagcacgcgtggaacagatgtgaaagacattccattcaacttgacaaacaatatccctggatgcgaagaagaagacgctagtgagatcagcgtctctgtcgtgttcgaaacattccctgagcagaaagagccgagcctcaaaaatatcatccatccatattaccacccttactccggaagccaagaacacgtgtgtcagtcctcttctaaattccacctgcatgagaacaagctcgactgcgataacgacaataaaccaggcataggccatatcttcagtacagataaaaatttccacaacgatgcctccaccaagaaagcaaggaatcccgaggttgtcatggtggaaatgaaagaggaccaagagttcgacctgcaaatgaccaagaatatgaaccagaattccgattctggcagcactaacaattataagtccctgaagccaaagcttgagaacctttcctctttgccacctgattctgatcgaaccagtgaggtgtacctccacgaagagctgcaacaagatatgcaaaaattcaaaaacgaggtgaataccctggaagaagaatttctggctttgaaaaaagaagatgttcagctgcataaggatgtggaggaggagatggagaagcaccgtagtaacagcacagagttaagcggcacccttactgacggaacaactgtgggcaacgatgacgacggtttaaatcagcagattccccgcaaagaaaacggcgagcacgaccgatag

SEQ ID NO: 46270 - DNA, 2181 bp, Artificial Sequence
  Description of Artificial Sequence: Synthetic coding sequence
atggccagctggggcggcgagaagcggggcggcgccgagggcagccctaagcccgcggtttacgctacaagaaaaacacccagcgtgggtagtcagggtgaccaatggtacctgggttatcctggggatcagtggtcatcaggctttccatatagttggtggaagaatagcgtgggctccgaatctaagcacggggaaggagccctagatcagcctcagcatgacgtgcggctggaggacctgggggaactgcatcgagccgcgcgtagcggagatgtgcccggtgtcgagcatatactcgccccgggagacaccggtgtggacaaaagggatagaaagaaaagtatccaacaactagtccctgaatacaaggagaagcagacccctgagtcactgcctcaaaacaataaccctgactggcacccaaccaacctgaccttatctgatgaaacgtgccagaggagcaagaacctcaaagttgatgataagtgcccctccgtcagcccttctatgcctgagaaccagtcagctaccaaggagctgggtcaaatgaacctcacagaacgcgagaagatggacacgggcgtggtccttttgtcaggcaacgatacacttcatgacttgtgtcagagccagctgcccgagaataaagagtcaaaggaagccgaacaggacagcgaactgacatcagaagaagagcaggaaagattgaagggctgtgagaataagcagcctcagaagaccagccaggaacctgagatggctaaagactgcgatcgagaggacattcccatctatcctgtgctcccacacgtccagaaaagcgaagagatgtggatcgaacagggaaaactagagtggaaaaatcagctcaagctcgtgatcaatgaacttaaacagagatttggagaaatctacgagaagtataagatcccagcatgcccagaggaggagcctctcttggacaacagcacccgaggcaccgatgtcaaggacattccctttaacctgactaataatatccctggctgtgaagaagaagatgcctcagaaatatccgtctctgttgtgtttgagaccttccccgagcagaaggagccgtccctcaagaacatcatacacccctactatcatccatacagcggaagccaggagcatgtctgtcagtcaagctccaaatttcacctgcacgagaacaaacttgattgtgacaatgacaacaagcctgggatcggccacatcttcagcactgataagaattttcacaacgacgcttctaccaagaaggctaggaacccggaggtcgtgatggttgaaatgaaggaggaccaagaatttgacttgcaaatgacaaaaaatatgaatcaaaattcagatagcggttcaaccaataactacaaatctctcaaaccgaagctggagaatctcagctctctgccacccgacagcgacagaactagcgaagtgtacctccacgaggaactacagcaagacatgcagaaattcaaaaatgaggtgaataccctcgaggaagaatttctggccctaaagaaggaggacgtgcagcttcacaaggatgttgaagaggagatggagaagcacagaagtaacagtacggaacttagtggtaccttgactgacgggactacagtgggcaacgatgatgacggcctgaaccagcaaattcctcggaaagagaacggagagcacgacaggcccgcagacaagacttctaatgaaaaaaacgaggtaaaaaaccaaatctatccagaggcagatttcgctgactcaatggagcctagtgagatcgcttccgaagactgcgaactttcgcacagcgtttatgaaaactttatgctgttgatcgagcagcttaggatggaatacaaagactccgcctccttaccaaggatccaggacacattttgcctgtgtgaacatctgttgaagctgaagaacaatcattgcgatcaactgacagtgaagctgaagcaaatggagaatatggtgtcagttctgcaaaacgaattgagcgaaaccaaaaagaccaagcttcaactggagctgcagaaaatcgaatgggaaaaagaactgtacgatctgaggtttcttatcggcatccggaagaagcgaatctcgttcatgaagatcgcttgttgtaggaagaaactcccctgctag

SEQ ID NO: 46271 - DNA, 4284 bp, Artificial Sequence
  Description of Artificial Sequence: Synthetic coding sequence
atggccagctggggcggcgagaagcggggcggcgccgagggcagccccaaacccgcagtttatgccacaagaaagacaccttccgtaggttcgcaaggagatcaatggtatctgggctatccaggtgaccagtggtctagcggatttccgtacagttggtggaagaactcggtcggttcggaaagcaagcacggcgagggggccttggatcagcctcaacacgacgtcagacttgaagatctaggcgagctccaccgcgccgcccggtcgggggacgtacccggggttgaacacatcctggcacctggggatacgggcgttgataagcgagacaggaagaagtcaattcagcaacttgttcctgagtataaagagaagcaaacacccgagtctctgccgcaaaacaataatccggactggcatcccaccaacttaactctcagcgatgagacctgtcaacgatccaaaaatctcaaggtggatgacaaatgtcccagcgtgtccccgtccatgccggagaaccagagcgccaccaaggagctgggacagatgaatctcaccgaacgggagaagatggataccggagtggtcctgctgagcggaaacgacaccctgcacgatctttgtcagtcacagctccccgaaaataaggaaagcaaagaggccgagcaggactccgaacttacttccgaagaagagcaggagagactgaaaggatgcgagaataaacaaccacaaaagacttcccaggaacctgagatggcaaaagactgtgatcgggaggacatccctatctaccctgtattgccgcacgtacaaaaatctgaagaaatgtggatcgagcaaggcaaattggaatggaagaaccagctgaagctagtcattaatgaactgaagcagagattcggggagatctatgagaaatacaagattccagcctgtcctgaagaggagcctctgctggacaatagcacacgaggcacagacgtaaaggacatccccttcaacttgaccaacaacattcctggatgcgaggaggaagacgcaagcgagatcagtgtgagcgtggttttcgagaccttcccggaacagaaggaaccatccctcaagaacatcatccacccttattaccatccatattcaggctcacaggaacacgtatgtcagagttccagcaagtttcatctacatgaaaataagttggattgtgacaatgacaacaagcctggtatcgggcacatcttcagtacagacaaaaatttccataacgacgcgtcgacgaagaaagcgcggaaccccgaggtggtgatggttgaaatgaaagaagaccaggagtttgatctacagatgacaaagaatatgaatcagaacagtgatagcggctctactaacaattacaaatctctaaaaccaaagttagagaacctcagttccctccctcccgattccgacagaacctcagaagtttacctgcacgaagagcttcagcaggacatgcagaaattcaagaacgaggttaacaccctcgaggaagaatttctcgctctgaaaaaggaggatgtgcaactgcataaggatgttgaggaagaaatggagaaacaccgtagcaacagcactgagcttagcggaaccctgaccgacgggactaccgtggggaatgatgacgacggcctgaaccagcagattccgcggaaggagaacggggagcacgaccgcccagcagacaaaaccagtaacgagaagaatgaggtgaaaaatcagatttacccagaggcagatttcgcggacagtatggagccctctgagattgcatccgaggattgtgaactctcccacagtgtctacgagaacttcatgctattgatcgagcagctgaggatggaatacaaggatagtgctagtctgcctcggatacaggatactttttgtctgtgtgaacacctgctcaaacttaaaaacaaccattgtgatcagttaacagtgaagctgaagcagatggaaaatatggtctcagtgttgcagaacgagctttccgaaactaagaaaaccaaattacagcttgagctccaaaagattgagtgggaaaaggagttgtatgatttgagactcgctctgaagcaggaaaacgaagagaaaaggaacgccgacatgctctataataaagatagcgagcagttaagaattaaagaagaggaatgcggcaaggtcgtagaaactaaacagcagcttaagtggaacctgcgacggctggtgaaggagcttaggaccgtgagaaataatctagacctcgtggtgcaagaaagaaatgatgctcaaaaacagctctctgaggagcaagatgctcgcatactgcaggatcagatacttacatcaaaacaaaaggagctggaaatggcacgtaaaaagatgaactcagaaatttcgcaccgacatcaaaaggaaaaggatctgtttcacgaagattgcatgttacaggaggagattgcgctcctccgtcttgagatagacaccattaaaaatcagaataaacagaaggagaagaagtactttgaggacattgaggccgtgaaagagaaaaatgataacctgcagaagattattaagcttaacgaagaaaccttaaccgaaacaatcctccagtacagtgggcaattgaacaatctcaccgcggagaacaagattcttaactctgaactcgagaacggtaagcagaaccaagagcggttggagatagagatggagagctaccgctgtcggctagcagccgctgtcagggactgcgatcaatcccagaccgcaagagacctgaaactggactttcagagaactagacaggaatgggttaggctacatgataaaatgaaggtagacatgtctggacttcaagccaagaacgagatcttgagcgaaaaactgtcaaatgctgaaagcaaaattaatagcctgcagatccaactgcacaacaccagggacgccttaggcagggagagcctcatcctggagcgcgtgcagagggacctgtcccagacacagtgccagaagaaggaaacagagcagatgtaccagatagagcagtcaaagttgaagaagtacatcgcaaagcaagagagcgttgaagagcgcctaagtcagcttcagtccgaaaacatgctgctgcgccaacagctcgacgatgcccacaagaaggcaaatagccaggagaaaacaagctctaccattcaggaccagttccatagcgcagcgaaaaatcttcaagccgagtccgagaaacagatcttatctctgcaggagaaaaataaggagctgatggacgagtacaaccatctgaaggagcgcatggatcagtgtgaaaaagaaaaagctggaaggaagatagatctgacagaggctcaagagacggtgcctagtcgttgtctgcatctggacgcggagaacgaggtcctgcagctgcagcagacacttttcagtatgaaggcgatccagaagcagtgtgagaccctccagaagaataaaaaacagttgaagcaagaggtagtgaacttgaagagttatatggagcgcaacatgcttgaacgcggtaaagctgagtggcacaaactccttatcgaagagcgcgcccgtaaggaaatcgaggagaagctgaacgaagcaatactgaccttgcaaaagcaggccgctgtgtcacacgagcagcttgtgcagctgagagaggataataccaccagcatcaaaactcagatggaactaaccattaaagacttggaatccgagatttcaaggatcaaaacatcccaagctgactttaataagacggagctggaacggtataaagaactgtacttggaagaagtcaaggttagggagtccttaagcaacgaactgtcacgcaccaacgaaatgatcgcagaagtcagcacgcagctgacagttgaaaaagagcaaacccggtcaagatctctgttcactgcttatgcgaccagaccggtgctggaaagcccttgtgtgggaaacctgaatgacagcgaaggcctcaatcgcaagcatattcctagaaagaaaagatccgctctgaaggacatggagtcctatctgctgaagatgcagcaaaaattgcagaacgatttgacggccgaggtcgccgggtcctcgcagactggactccaccgcattcctcaatgttcgagcttcagttcatccagtctgcacctccttctgtgtagcatatgccagccgttctttcttatactccaactgttgctgaacatgaacctggatccaatttag

SEQ ID NO: 46272 - DNA, 681 bp, Artificial Sequence
  Description of Artificial Sequence: Synthetic coding sequence
atggccagctggggcggcgagaagcggggcggcgccgagggcagcccaaagccagccgtgtacgctactaggaaaacaccttccgtggggagccaaggtgaccagtggtacttaggttaccctggcgaccagtggtcatcagggttcccttatagctggtggaaaaactctgtcggaagtgagtccaagcatggagagggagccctagatcagcctcagcacgacgtaaggctggaggacctgggcgagctgcatagagctgccagaagcggagatgtgccaggggtcgagcacatcctggcccccggggataccggtgtggacaaaagggaccgcaaaaagagcatccagcaattggtccccgaatataaggagaagcagacccccgagtctcttcctcaaaataataaccccgactggcatcccacaaacctcaccctgtcagacgaaacctgtcaaaggagtaaaaacttaaaggtggacgataaatgcccttctgtgtctccgtcaatgccagagaaccaatcagctactaaggagctagggcagatgaatttaactgagcgggaaaaaatggatacgggcgtggtgctactttccggcaatgacacactgcacgatctgtgccagtcacagttgccagagaataaggagtctaaagaggggaataaggaagcatag

SEQ ID NO: 46273 - DNA, 4278 bp, Artificial Sequence
  Description of Artificial Sequence: Synthetic coding sequence
atggccagctggggcggcgagaagcggggcggcgccgagggcagcccgaagccagcagtgtacgctactaggaagaccccttccgtggggtctcagggcgatcagtggtatctgggatatcccggggaccagtggtcttctggttttccatattcttggtggaagaattccgtcggttcggagtctaagcacggcgaaggcgcactcgaccagcctcaacacgatgtccgccttgaagatctcggtgagttacatagagctgccaggagtggggacgtaccaggggtcgagcatatcctggccccgggggacactggagtggacaaaagggataggaaaaagtctatccaacaacttgtgcccgagtacaaggagaagcagacccccgagagcctgccccagaataataatcctgactggcatccaactaaccttaccctgagtgacgagacctgccagaggtcaaagaaccttaaagttgacgacaaatgccccagcgtcagccctagtatgccagaaaaccagtctgccaccaaagagctggggcagatgaatttgacggagagggaaaaaatggacaccggggtcgtgctgctcagcggaaatgacacgcttcacgacctgtgtcagagtcagctgccggagaacaaagaatctaaagaagcagagcaggacagcgaattgacttcagaggaggagcaggagagattgaaaggctgcgaaaataagcaacctcaaaagacatcacaggagccagaaatggccaaggattgcgacagggaggacatcccaatctatcccgtactgccccatgtgcagaaatccgaggagatgtggatcgaacaagggaagctagaatggaaaaaccagttgaagctcgtaatcaacgaactgaagcagcgctttggagaaatctacgagaagtacaaaatcccagcatgccctgaggaagaaccactgttggacaacagcactagaggaactgatgtgaaggacatcccatttaaccttaccaataatattcctgggtgcgaagaggaggatgcctcagagatctccgtgtctgtggttttcgaaacatttccggaacagaaagagccctccctcaagaacattatccatccttattatcatccatacagtggatcccaggagcacgtgtgccagtcctctagcaaattccatcttcacgaaaataagctcgattgtgacaacgataacaagccgggaattggccatatcttttctacagataagaacttccacaatgacgctagcactaagaaagcccggaatccagaagttgtgatggtggagatgaaggaggaccaggaattcgatctgcagatgacaaaaaatatgaaccagaactccgactccggctccactaataactacaagagcttgaaaccaaagctcgagaatttaagcagcttgcctccggactctgacagaacatcagaagtgtatttgcatgaggaattacagcaggacatgcaaaagtttaagaacgaagtcaatacccttgaggaggaatttcttgccctgaaaaaagaagatgttcaactgcacaaagacgtggaggaagagatggagaagcaccggtcaaattcaactgaactgtcgggtaccttgacagacggcaccacagttggcaacgatgatgacggcttaaatcagcaaattccacgtaaggagaacggcgaacatgacaggcccgccgacaaaacttccaatgaaaaaaacgaagtcaaaaaccagatatatcccgaagctgattttgctgattctatggagcccagtgaaatagctagtgaagattgcgaactctctcactctgtatacgagaacttcatgctgctgatcgaacagttgaggatggagtataaggattccgcaagcttgcccaggatccaggacaccttttgtctttgtgagcacttgttaaaactcaagaataatcactgtgatcagctgacagttaagctgaagcaaatggaaaacatggtctccgtgctgcagaatgaattgtctgagaccaaaaagaccaaactgcaactagaattacagaagatcgaatgggagaaagagctatacgatctcagactcgcactgaagcaggagaacgaagagaagcggaatgcagatatgctttataacaaagattccgaacagctgagaattaaagaggaggagtgtgggaaagtggtggagacgaagcagcagctcaagtggaacttacgccgccttgtcaaagagttaaggaccgtaaggaacaatctcgatctcgtagtccaggaacggaatgatgctcagaaacagctgtcagaggaacaggacgctcggatccttcaggatcagatccttacatcgaaacagaaagaactagaaatggcaaggaaaaaaatgaacagcgagatttcacatcggcaccaaaaggagaaagaccttttccacgaggactgtatgctgcaggaggagatcgccttgttgcgtctcgaaattgatacaattaagaatcagaataaacaaaaggagaagaagtactttgaagatatcgaggcggtaaaggagaagaacgacaatttacagaagattatcaagctcaatgaggagacactgaccgaaacgattctccagtattctggacagctcaacaacctgactgcggagaacaagattctcaattccgaattggagaacggcaagcagaatcaggaaagactcgagatcgaaatggagagctataggtgtaggcttgcagctgcagtccgcgattgtgatcagagccagactgctcgtgatctgaaactcgactttcagcgcactcggcaggagtgggtcaggttgcatgacaaaatgaaagtcgacatgagcggcctgcaagcaaagaacgagatcttgtccgagaaactgagcaacgctgaatccaagataaattccctgcagatccagctacacaacaccagggacgcactggggcgcgaatctttgatccttgagcgggtacagcgcgacctctcacagacacagtgtcagaagaaagagacggagcagatgtatcaaatagagcagtccaagctaaaaaagtacatagccaaacaggagtcagtggaggaaaggctgtctcagctgcaatccgagaatatgcttctcagacagcaactggatgatgcacataagaaggccaattctcaggagaaaaccagttctaccattcaggatcagttccactctgctgccaagaatctgcaggctgaatctgaaaaacaaatattgtccctgcaggagaagaacaaggagctgatggatgaatacaaccacctaaaggagcgtatggaccagtgtgagaaggagaaggctgggaggaagattgatctcacagaggctcaggagaccgtgcccagccgttgcctccacctggatgccgaaaatgaggttcttcagctccaacagacactgtttagtatgaaggccatccaaaagcagtgtgagaccctccagaagaataagaagcaacttaaacaggaagtagtcaatcttaaatcatatatggaacgaaacatgctggaaagaggtaaagcagaatggcataagctactcatcgaagagagagctcgaaaagaaattgaggaaaaactcaacgaagccattctgacacttcagaaacaagcagccgtgtcacatgagcagctcgtgcagctgcgtgaggataataccaccagtatcaaaacccaaatggagctcactatcaaggacctggaatctgagatcagcaggattaaaaccagccaggcagactttaacaaaactgaactagagcggtacaaagaactttacctggaagaagtcaaggtgcgcgaaagcctaagcaatgagctttccagaactaatgagatgatcgcagaggtcagcacccagctgaccgttgagaaggagcaaacccgatcccgtagcctctttactgcctacgcaacacgccctgtgctggagtccccttgcgtcggaaatctgaacgactctgaagggttgaatcgaaagcatattcctaggaagaaaagatctgccctgaaggatatggaaagttacctgctgaagatgcaacagaaacttcagaacgacctcacggcggaggttgcagcagccaccaagtatgaacccggaagctacattgcctccccactcgggtttactcataaagagaatctgaaccaggatcctgtactagaggtcacaaaggaatacgcccagattctgcgcaggaagtatatattgtag

SEQ ID NO: 46274 - DNA, 984 bp, Artificial Sequence
  Description of Artificial Sequence: Synthetic coding sequence
atggccagctggggcggcgagaagcggggcggcgccgagggcagccctaaacccgcagtgtatgccacccgcaagaccccatctgttggctcacagggcgaccaatggtacttaggctaccctggggaccagtggtcctctggctttccctacagttggtggaagaatagcgtgggtagcgaaagcaaacacggtgagggagcactagatcagcctcagcatgatgtgcgtctggaagatctgggcgaactccacagagctgcgcggtccggcgatgtgcccggcgtggagcatatactggccccaggcgacactggggtcgataaaagggataggaaaaagagcatccagcagttggttcctgaatataaggagaagcagacccctgaatcattaccccaaaataataatccagattggcatcccaccaatctgacccttagcgacgagacatgccaacgatcaaaaaatcttaaggtggacgataagtgcccgtccgtatccccatctatgccagaaaatcaaagcgcaacaaaagagctgggtcagatgaaccttaccgagagggaaaagatggataccggagtcgtgctgctctcagggaacgacaccctgcatgatctctgccagagtcaattgcccgaaaataaagagtcaaaagaagcagagcaggattctgagctcacgagcgaagaagaacaagagcgcctgaaggggtgcgagaacaagcagcctcagaaaacttcgcaggaaccagaaatggctaaggattgtgatcgcgaagatatcccgatctaccccgtgctgccacatgtgcaaaaaagtgaagagataagcctgcctcccgactcggatagaactagcgaagtctatcttcacgaagagttacaacaagacatgcagaagtttaagaatgaagtgaacacactggaggaggaatttctggcgctcaagaaagaagatgtgcagctgcacaaggattag

SEQ ID NO: 46275 - DNA, 783 bp, Artificial Sequence
  Description of Artificial Sequence: Synthetic coding sequence
atggccagctggggcggcgagaagcggggcggcgccgagggcagccccaagccagcagtctatgctacgcggaaaaccccatccgtggggtctcagggggaccagtggtacttgggctatcctggtgatcagtggtcctccggattcccttacagttggtggaagaacagcgtcgggtccgaatcaaagcatggcgagggggccttggaccaaccccagcatgatgtgagattggaggacctaggcgagttgcatcgcgccgcccgttccggggacgtgcctggagtcgagcacatactcgctccaggagataccggggtggataagagagatagaaaaaagtccatccagcagctggtgccggagtataaggaaaagcaaaccccagagagcctcccccagaacaacaaccctgattggcaccctaccaatctgacactgtctgacgagacttgccagcggagcaagaatctcaaggttgacgataaatgccccagcgtgagtccgagtatgccagagaaccagagcgccactaaagagctggggcagatgaatttgaccgaacgggagaagatggacacaggagtcgttctgctgagcggcaacgacactctccatgatctctgtcagtcccagctgcctgagaataaggagtccaaggaggccgaacaggattccgaactgacctctgaggaagagcaggaaagactgaagggatgtgagaataagcagccgcaggacaaggctatcttcaaaacatgcagtcctactgagaaaacgtag

SEQ ID NO: 46276 - DNA, 4284 bp, Artificial Sequence
  Description of Artificial Sequence: Synthetic coding sequence
atggccagctggggcggcgagaagcggggcggcgccgagggcagcccaaagcccgctgtctacgcaacacggaaaacaccgagtgttgggagccagggggatcaatggtacctggggtatcctggtgaccagtggtcatcaggttttccatattcttggtggaaaaatagtgtcggcagcgagagcaaacacggtgaaggggcactggaccaacctcaacacgacgtgcggctggaagacttgggagaactccatagagccgcacgaagcggggatgtgccaggggtggaacatattctcgcccccggggatactggagtcgataaacgggacagaaaaaaatccatccagcagctggtgcctgaatataaggagaagcagacgcctgagagtctgccacagaataataatcctgactggcaccccaccaacctgaccctgagcgacgaaacttgtcagcggtccaaaaatctgaaagtggacgacaaatgcccctcagtgtctccatccatgcctgagaaccaatctgcaaccaaggagctcggacagatgaacctgacggaacgagaaaagatggacactggggttgtcctgctctctggtaacgatactctccatgacttgtgccagtcccaactacccgaaaataaggaaagcaaggaagccgagcaggattcagagctcactagcgaagaagaacaggagagattgaaaggatgcgaaaataagcagccgcagaaaacctctcaggagcccgaaatggccaaggactgcgacagggaggacattcccatctatccagttctcccccacgtgcagaagtcagaagagatgtggatcgagcagggaaaattggagtggaaaaaccagttgaaactggtaattaacgagctgaaacagagatttggagagatctacgaaaagtataagatccccgcatgccccgaggaggagccactgctggataattccacaagaggtactgacgtcaaagatatcccgtttaacttgactaacaacatccccggctgcgaggaagaagacgcatcagaaatcagcgtgtctgtggtatttgaaacattcccagaacagaaggagccatcacttaagaatatcatacacccatactaccatccctattccgggagtcaggagcacgtgtgccagtcttccagcaagtttcacctgcatgagaacaagctcgattgtgacaatgacaataagcccggaattggacacatttttagcacagataaaaatttccacaatgacgctagcaccaaaaaggccagaaaccctgaggtggtcatggttgagatgaaagaggaccaggaatttgatctccagatgacaaaaaacatgaatcagaattccgacagcggttccacaaataactacaaatctctgaagcccaaactcgagaatcttagctccctccctccagacagcgatagaacgtcagaagtctatttacatgaggagctgcaacaggacatgcaaaagttcaagaacgaagtgaacactctggaggaggagttcttagccctcaagaaagaagatgtccaactgcacaaggacgtggaagaggaaatggaaaagcataggagtaatagtactgagctgtcgggcacactgaccgacggaaccactgttgggaatgacgatgatggactgaatcagcagattccgcgtaaggagaacggtgaacacgatcgtccagctgataaaacttctaacgaaaaaaatgaggtgaaaaatcaaatatatccagaagctgatttcgctgattcaatggaacccagtgaaatagccagtgaggattgtgaactgtcgcattccgtgtacgagaatttcatgttgttgattgagcagctgcgtatggaatacaaagattctgcaagtctcccgcgcatccaggacaccttttgcctgtgtgaacacctgctcaagttgaagaataaccattgtgatcaactaacagtcaagttgaaacaaatggaaaatatggtgagtgtcctgcaaaatgagctttctgaaacaaaaaaaacaaagctccagctagaactgcagaaaatcgagtgggaaaaagagctttatgaccttcggcttgccctgaagcaggaaaacgaggaaaaacggaatgccgatatgctttataataaggacagtgaacagctgcgaatcaaagaggaagagtgcggcaaagtggtagaaaccaaacagcagttaaagtggaatctgagaaggctggtgaaggagttacgcacggtaagaaataacctggacctcgtggtccaggaaagaaacgatgcccaaaagcaattgagcgaggaacaggatgcccggatactgcaggatcagatcctgacatcaaaacagaaagagctggagatggcccggaaaaagatgaactctgaaataagtcatcgtcatcagaaggagaaagacttgtttcacgaggattgtatgcttcaggaagagatagcgctgctcagactagaaatcgatacaatcaagaatcagaataaacagaaggaaaagaaatatttcgaagacatcgaggctgtcaaagagaagaatgacaatctccagaagattatcaagttaaacgaggaaactctgaccgagaccatcctgcagtactccggacagctgaataacctaacagccgaaaacaaaatcctgaacagtgaactggaaaatggtaagcagaaccaagagcggctcgaaatcgagatggaaagttacagatgtaggctagccgcagctgtcagagactgcgaccagtctcagacagctcgcgatctgaagttggactttcagcgaactagacaggaatgggtgcgcctgcatgataagatgaaagtggacatgtcaggcctccaggcaaaaaatgaaatcctctccgagaagttgtccaatgctgaatctaagattaactccctccagatacagctgcataacacccgcgacgctctgggaagggaaagcctgatcttagagagagtacaaagggacctgtcccaaactcagtgccaaaaaaaggaaaccgaacaaatgtatcagattgagcaatctaagctgaagaagtacatcgctaaacaggaatccgtcgaggagagattgtcccagctgcagtcggaaaatatgctactcagacagcagctggatgacgcacacaaaaaagcaaattcccaagagaagacatcttccaccatacaggatcagttccattcagctgctaagaacctccaagcagagagcgaaaaacagatcctgtccttacaagaaaagaacaaagaactgatggatgagtataatcatcttaaagaacgcatggaccagtgtgagaaggagaaggctggacgaaaaatcgacctcacagaagctcaggagacagtcccctctcgctgcctgcatctggatgcggaaaacgaggtgctgcagctgcagcagacactgttctctatgaaggcgatccagaagcagtgcgagacactgcagaagaataaaaagcagttgaaacaggaggttgttaacctgaaaagctacatggaacggaatatgctggagaggggaaaggcggaatggcacaaacttctgatcgaagagcgcgcccggaaagagattgaggagaaactgaatgaagccatcctcacactacagaagcaagccgctgtctcccatgagcagctcgttcagctgcgtgaggataatactacaagcatcaaaacccagatggaactgactattaaggatctggagagtgagatttccagaatcaaaacgtcacaagctgactttaacaagacggaactggaacgatataaagaattatatcttgaggaggtgaaggtgcgtgagtctttgtcgaatgagttgagtaggaccaatgagatgatcgccgaagttagcacacagctcaccgttgaaaaggagcagactcgctcgcggagtttatttactgcatacgcaaccaggccggtcctggagtcaccctgcgtcggcaacctgaacgattctgaggggttgaaccgtaagcatatcccacgtaaaaagcggtccgcattgaaagacatggagagttatcttctaaagatgcagcaaaagctgcagaatgacctcactgcagaggtagcagggtccagtcaaactggactgcacaggatccctcagtgttcgagctttagctctagttcactgcacctcctgctctgttcaatttgtcaaccctttttcctcatcctccagctgcttctgaacatgaatctggatccaatttag

SEQ ID NO: 46277 - DNA, 2178 bp, Artificial Sequence
  Description of Artificial Sequence: Synthetic coding sequence
atggccagctggggcggcgagaagcggggcggcgccgagggcagccctaagccagcggtttacgcaacaaggaagactccttccgtcggaagccaaggcgatcagtggtatctgggatatcccggtgaccagtggtcttctggatttccttattcttggtggaagaattccgtgggctctgagagcaagcatggcgagggagctctcgaccagcctcagcacgatgtgcggctcgaagatctaggggagctgcaccgcgcagcccgctcgggagatgtacccggggtagagcatatactggcccccggcgatactggggtcgacaagagagatcgaaagaaatctatccagcagctagtaccggagtacaaagagaaacagacgccggagtccctgcctcaaaataacaatcctgattggcaccccactaatttaacactgtctgatgagacatgccagaggtctaaaaatctgaaggtcgatgacaagtgccccagcgtgagtcccagtatgcctgagaatcagagcgccaccaaggagctgggacaaatgaacttaaccgaaagggaaaaaatggacaccggggttgtcctcctgagcgggaacgacactctgcatgacctgtgtcagagccagcttcccgagaacaaggaatccaaggaagctgaacaggactccgaattgacctccgaggaagagcaggagagactcaaggggtgtgaaaacaagcagccccagaaaacttcgcaagagcccgagatggcgaaagattgtgatcgggaggatatccccatctacccagtgttacctcacgtccagaagtccgaagagatgtggatagagcagggtaagcttgagtggaaaaatcagctcaaactggtgattaacgagctgaagcagcggttcggcgaaatttacgaaaaatataagatacctgcctgtccagaagaagaacccctgctggacaacagcactcggggcacagacgttaaagatatcccctttaacttgaccaacaatattccaggctgtgaagaggaggacgcctccgaaatcagcgtaagcgtcgtgttcgagacctttcctgaacagaaagagccgtccctgaagaatataattcacccctactaccacccatatagcggttcccaggagcacgtctgtcagtctagctcaaagtttcacttgcatgaaaacaaactggattgcgacaacgataacaagcccggcataggtcatatcttctctactgataagaatttccataacgatgcctccacaaagaaggcaaggaatcctgaggtagtgatggtcgagatgaaggaagatcaggaattcgatctgcaaatgacaaagaatatgaatcagaactccgatagcggatcaacgaataactacaagagcctgaagcccaaactggaaaatttgtcttctctgccaccggatagtgatcggactagcgaggtgtacctgcatgaggaactgcaacaggacatgcaaaagttcaaaaatgaggtcaacaccctggaggaggaattccttgcactaaaaaaagaggacgtgcagctgcacaaggaggtggaggaggagatggaaaagcaccgaagtaattctacagaattgtctggaacactaaccgacggcactaccgtgggaaacgatgacgacggactcaaccagcaaattccaagaaaggaaaatggcgagcacgacaggcccgctgacaagaccagcaacgagaagaacgaagttaagaaccagatataccccgaagcagatttcgccgactccatggagcccagcgaaatagccagcgaagattgtgagctgtctcattccgtgtacgagaacttcatgctcctcatcgagcagctaagaatggagtataaggattccgcctctttgcctcggatccaggacactttctgcctctgcgagcacctgctaaagcttaaaaataaccattgtgatcagctgaccgtgaagctgaaacaaatggagaatatggtcagtgtattgcagaatgaactcagcgagaccaaaaaaaccaagttgcagctagaactgcagaagatcgagtgggaaaaggaattatacgatctgagactggccctgaaacaggaaaaccggcgcaaagagatgccaatatgctgcatcataaagatcgtgaactcgtag

SEQ ID NO: 46278 - DNA, 3465 bp, Artificial Sequence
  Description of Artificial Sequence: Synthetic coding sequence
atggccagctggggcggcgagaagcggggcggcgccgagggcagcccgaaacccgccgtttacgctacacgcaagaccccttccgtcggctcacagggagaccagtggtacctcgggtaccccggtgaccagtggtccagcggtttcccgtattcctggtggaagaatagcgttggctctgaatcaaaacacggagaaggtgctttagaccagcctcaacacgacgtccgccttgaagacctgggcgagctccaccgtgccgccaggtctggagacgtgcctggagtcgagcacatactggccccgggggatacaggggtagataaaagagaccggaaaaagtctatccagcagctagttccagaatataaagaaaagcagacccccgagtcactgcctcagaataataacccggattggcaccctacaaacttaacattgagcgatgagacgtgtcagcgatctaagaacctcaaagtcgatgataagtgcccatccgtatctccttccatgccagagaaccaatcagccacaaaggaactggggcaaatgaacctgaccgaaagggaaaagatggatacaggggtggttttgctttccggcaatgacaccctacatgacctgtgccaaagccagctgcccgaaaataaggaaagtaaggaggcagagcaggacagcgagctgacttccgaggaggaacaggaacgcttaaaagggtgtgaaaataagcagccccaggtggaagaggagatggagaaacacaggagtaatagcactgaattgtctggtaccttgacggatggtacaactgtcggtaatgacgacgatgggcttaaccagcagatcccgcggaaggagaacggtgaacacgatcgtcccgctgacaaaacctcaaatgaaaagaatgaggttaagaaccagatctaccctgaggctgactttgctgatagtatggaaccctcagagatagcctccgaagattgcgaactgagtcacagtgtgtacgagaattttatgcttttaatcgagcaattgaggatggagtacaaggatagcgcctctctgcctcgaattcaggacaccttttgcctgtgcgagcatctgttgaagctgaaaaacaatcactgtgaccagctcaccgtgaagctgaagcaaatggagaatatggtgagtgtcctacagaatgagttgagtgagacaaaaaagactaagctccaacttgagctacaaaaaattgagtgggaaaaagaactatacgacctccgactcgcgctcaagcaggagaatgaggagaaacggaacgctgatatgttgtataacaaagattccgaacaactgcgaattaaagaggaggagtgtggcaaggtcgttgagaccaaacagcaattgaaatggaacttgcgcagactcgtgaaggagctccgcactgtgaggaacaacctggacttagtcgttcaggaaaggaacgacgcccaaaaacagctgtccgaagagcaggacgctagaatactgcaggaccagatcttaacatcaaaacagaaggagctggagatggccaggaagaaaatgaacagtgagatttcccatagacaccagaaggagaaggacctattccatgaagactgcatgcttcaagaggagattgctctgctcagactggagattgataccatcaaaaaccagaacaaacagaaagagaaaaaatattttgaggacatcgaggcagtgaaggagaagaatgacaatctgcagaaaattattaaacttaacgaggagacactgacagagaccattctgcagtactccggacaacttaataaccttactgcagagaataagattctgaactccgagctcgagaacgggaaacaaaatcaggagcgtctcgagattgagatggaatcctatcggtgccggctcgctgccgccgtgagagattgtgaccagtctcagaccgcacgcgacctgaaactggacttccagagaacaagacaagaatgggtccgtctccacgacaagatgaaagtggatatgagcgggctccaggccaagaacgagattctgtctgagaaactgtccaacgccgagtccaagatcaacagccttcagattcaactccacaatacccgcgacgccctcggccgagagtccctgattttggagcgagtgcaacgggatctctcacaaacacaatgccagaaaaaggaaactgaacagatgtatcagattgaacagagtaaactcaaaaagtacatcgccaaacaggagagtgtggaagagcgtctgtcccagctccagagcgagaacatgctgctgagacagcagctggacgatgcgcacaaaaaagccaattctcaggagaagacctcctctacgatccaagatcagttccacagcgcagctaagaacttacaagctgagtcagaaaagcagatcctttccctgcaggaaaaaaacaaggagttgatggacgaatataatcacctgaaagagcggatggatcagtgcgagaaggagaaagccgggaggaaagtggtgatgcgggaattccagcaagagtggactgacctccttaaacagcagcccaccagtgaggccacaagtagatgccacataaatctggatgaaacacaggatagcaaaaaaaagctgggccagattcggagcgaaattgacctaaccgaggcccaagagacagtcccttctcgatgccttcatctggacgcagagaacgaggtgctgcagttacagcaaacgttgttcagcatgaaagccatccagaaacagtgtgaaactttgcagaagaataaaaagcagctcaaacaggaagtggtcaatctgaaatcttatatggaaaggaatatgctcgagcgggggaaggcagaatggcacaaactgttaatagaagagagagccaggaaggaaatagaggagaaattaaacgaggcaatcctcactctccagaaacaagccgcagtgtcccacgaacagctagtacaattgagggaggataacaccacctccatcaaaacccaaatggaacttactatcaaggaccttgaatccgagatctcacggattaaaacctcccaagctgacttcaataaaaccgagctggagcggtacaaggaactgtatctggaggaggtgaaggtcagggaatctctgagtaatgagctctcccggactaatgagatgattgccgaggtctctacccagttaaccgttgaaaaggaacagacaaggtcgcggtctttattcactgcttacgctacccgacccgtgcttgagtctccttgcgtgggtaacctcaacgattccgaggggttgaatcgcaagcacattccccggaagaagcgctccgctcttaaggacatggagagctacctactaaaagtgagctacctattttcgtttggtgtgcaaatctccgatcggattctggtttgctatctagtcaagtag

SEQ ID NO: 46279 - DNA, 681 bp, Artificial Sequence
  Description of Artificial Sequence: Synthetic coding sequence
atggtgagctggggcggcgagaagcggggcggcgccgagggcagcccgaagccagccgtgtatgctacccggaagactgggtcggtccggagccaagaagaccagtggtatcttggctacccaggggatcagtggtcttccggtttcagctacagttggtggaagaattctgttggttcggagagcaaacatggcgagggcgcgctagatcagcctcagcacgacgtaaggctcgaggacctcggcgaactgcatagagccgcccgcagcggcgatgttcctggcgtggagcacgtgctggtacctggtgacaccggagttgataaaagagaccgcaaaaagagtatccagcagctggtccctgaatacaaggaaaaacagactcctgagtcgctgccgcagaacaacaatcccgactggcaccctaccaatcttacgttgtctgatgaaacttgtcagaggagcaagaatctgaaagtggacgacaagtgccctagtgtctctccaagcatgcctgagaatcaaagtgctaccaaggaactgggccagatgaacctgacagagcgggaaaagatggacactggcgtcgtactgttatctgggaacgacaccctgcatgatctatgtcagtcacagcttcctgaaaataaagaatctaaggagggaaataaggaggcttag

SEQ ID NO: 46280 - DNA, 3714 bp, Artificial Sequence
  Description of Artificial Sequence: Synthetic coding sequence
atggtgagctggggcggcgagaagcggggcggcgccgagggcagccctaagcctgctgtctatgcaacccgaaagaccggatctgtgaggtctcaggaagaccagtggtaccttggctaccccggggatcaatggtcttctggcttttcttattcatggtggaagaatagcgttggtagcgagagcaaacatggagagggggcactcgaccagcctcagcatgacgtgcgcctagaagatcttggggagctacacagggcagcccggtcgggagacgtgccaggtgtcgaacatgttctcgttccaggagacaccggagtagataagcgagaccggaaaaagagcatccagcagcttgtgcccgagtacaaggagaagcagacacctgagtccctgccacaaaataacaacccagattggcatccaaccaaccttacactgtccgacgagacctgccagcggtcaaagaatctaaaagtcgacgataagtgtcctagcgtctcaccctccatgcctgagaatcagtctgctactaaggagctcgggcagatgaatctgactgaaagggaaaaaatggacaccggggtaaagactagtcaggaacctgaaatggctaaggattgtgatcgcgaggatatccccatctaccctgtgctcccacatgtgcagaagtccgaggaaatgaggatcgaacaaggcaaacttgaatggaaaaatcaactgaaactcgtgattaacgaacttaagcagaggtttggcgagatttatgagaagtataagatccccgcctgcccggaggaggagcctttgctcgacaatagtacgcgcgggaccgatgtgaaggatattccattcaacttaacgaacaatattcccggctgcgaggaggaagatgccagtgagatatcagtctcagttgtgtttgagacttttccggagcagaaagagccctcccttaaaaatatcattcatagctattaccacccctactccgggagccaagagcacgtgtgtcagtcctcatctaagcttcatctgcatgagaataagttagattgcgataacgacaataagcctggcatcggccatattttctctactgacaaaaatttccacaacgacgcctctaccaaaaaagcccgcaatccagaagttgtgaccgtggagatgaaagaggaccaggaattcgacctccaaatgactaaaaacatgaatcagaacagcgattccgggtctactaacaattataaatcactcaaacctaagctggaaaacctaagctctctacctcccgacagcgatcgcacaagcgaagtctacctgcacgaagagctgcagcaggatatgcagaaattcaaaaacgaagtcaacaccctggaggaggagtttctggccttgaaaaaagagaacgtgcagcttcacaaagaagtggaagaagaaatggagaaacacaggtcgaactcaacagagctgtcagggacgctgacagatggcaccacagtgggcaacgacgacgatggacttaatcagcagatcccaagaaaagagaatggggagcatgaccgcctggctttgaagcaagaaaatgaggaaaagcgaaacgctgatatgttgtacaacaaagacagcgagcagctgaggataaaggaagaggagtgcgggaaagtggtggaaactaagcagcaactaaagtggaatttgagacgcctggtcaaggaattgagaacggtagtgcaagaaagaaatgacgcccagaagcagctttctgaggaacaagacgcaagaatcttgcaggatcagattttgacttccaagcagaaggaactcgagatggcccagaagaagcgtaacccggagatcagccatcggcaccagaaggaaaaggatcttttccacgagaattgcatgctccaggaagaaatcgccctgctccggctcgagattgatacaatcaagaaccagaacaagcaaaaggagaagaaatattttgaggatattgaggtggttaaggaaaagaacgacaacctccaaaagatcattaaacgcaatgaggaaaccctgactgaaaccattctacagtacagtggtcagctcaacaacctcacagccgaaaacaagatgctgaactccgagcttgagaatggcaaggagaaccaagagcgcctggagatcgaaatggaaagctatcgatgccgcctcgctgccgcagtccatgactgtgatcagtcccaaaccgcgcgggacctgaaattggatttccagcgcaccaggcaggaatgggttaggcttcatgacaagatgaaggttgatatgtctggactgcaggccaagaatgaaatactgtctgaaaagctgagcaatgctgagagcaaaatcaatagcttacaaattcagctccacaatacccgagatgcccttggtcgtgagagcctgatcctggagcgcgtccagcgcgatctctcacagacccagtgccaaaaaaaagagaccgaacagatgtatcagagtaagcttaagaaatatatcgccaaacaggagtccgtagaggagaggctcagccaattacagtccgagaacatgctcctaagacaacaattggatgacgtccacaagaaagccaactcccaggagaagaccatctccaccatccaggaccagttccattcagctgcaaagaatctacaggcagagtcagagaaacagattctgtcgctccaggaaaaaaataaagaactgatggatgaatacaatcatctcaaagaacgtatggaccagtgtgaaaaggagaaagccggcagaaaaatcgacctcacggaggcccaggagactgttccatcacgctgccttcacctagacgctgaaaatgaggtgttgcagcttcagcagacactgttttctatgaaggctatccagaaacagtgcgaaacactccagaagaacaagaagcagctcaagcaagaggttgtgaacctgaagtcttatatggagaggaatatgttggaacgcggggaggctgaatggcacaagctgctgattgaggaacgagcaagaaaggaaatcgaggaaaagctgaacgaggctatactaactttgcagaagcaggcagcggtaagccacgaacagttggcacagctgcgagaagacaacaccacctcgatcaaaacccagatggaactcaccgtaatagacctagagagcgagatctctaggatcaaaaccagtcaggcagacttcaacaaaactaagctggaacgctataaggagctgtacctcgaagaggtgaaagttagggaatccctctccaatgagctcagcaggaccaacgaaatgatcgctgaagtaagcacgcagttaacagtcgagaaagagcagacacggtcacggtctctgtttacagcttatgccacgaggcccgtgctggagagtccttgtgttgggaacctgaacgatagtgaaggtttgaacaggaagcacattccacgcaaaaagcggtcagctctgaaggacatggaatcatacctgctgaagatgcagcagaaactgcagaacgatcttacagccgaagtggccggctccagtcaaaccgggctgcatcgcatcccccagtgcagctccttcagttccagtagtctacatctcctgctttgcagcatttgccagcccttctttcttattttacagctcttactgaacatgaacctggatcctatctag

SEQ ID NO: 46281 - DNA, 2868 bp, Artificial Sequence
  Description of Artificial Sequence: Synthetic coding sequence
atggaggacagcagcaccgacaccgagaaggaggaggaggaggagaaggacgagaaagaccaggagccgatttatgccattgttccaactatcaacatacaggatgagcgcttcgttgacctttccgagacacccgccttcatcttcctgcatgaacttcacgccatgggaaaactgcctggaaccagaatggcggccctcaaggccaagtacactttactccacgatgccgtgatgtcgactcaagaatcagaggtgcagctcctgcagaacgctaagaggttcacggagcagatccagcaacaacaatttcacttgcagcaggctgacaactttcctgaggctttctcgacagaggtgtcaaaaatgcgggagcagctgctcaagtaccaaaacgagtacaatgccgtcaaagagagggagtttcacaaccagtaccggctgaacagtttgaaggaagaaaagatcatcatcgtaaaggaatttgagaagataactaagcccggggagatggaaaagaagatgaaaatcttgcgagaaagtacagaggaactgaggaaagagatcatgcaaaaaaagttagaaattaagaacctgcgcgaggacctcgctagtaagcagaagcagcttttaaaagaacagaaagagctggaggaactgctgggacaccaagtggtgctcaaggacgaggtggcacatcaccagactattcccgtgcagattggcaaagagatagagaagatcacacgtaagaaggtggaaatggaaaaaaagaaaatcgtattagagcaggaggttaagacacttaatgactcgctcaagaaagtggagaacaaggtatccgctatagtggatgaaaaagaaaacgtgatcaaagaggttgagggtaaaagggccctgcttgagattaaagagcgggaacataatcaactggtaaagctgttggaattagcgcgcgagaacgaggccactagcctgaccgagagggggatactggacctaaatctcagaaactcccttatagacaaacaaaactatcatgatgaactctcaagaaagcagcgcgagaaagagagagacttcagaaacttacggaagatggagctgctcttaaaagtttcctgggatgctcttcgacagacccaggctctccaccaacggttgctgctggagatggaggccatacctaaagatgactcaacactgagtgagcggcgcagagagcttcataaagaggtcgaggtggccaaacgaaatttggcacagcagaagatcatctccgaaatggagtctaagttggttgaacaacagttggctgaagagaataagctgctcaaagaacaggaaaacatgaaagaactggtggtaaaccttcttcgcatgacgcagatcaaaatcgatgaaaaggagcagaagtcaaaagacttcctgaaggctcagcagaagtatactaatattgtgaaagagatgaaggccaaagacctggagattcgtatccacaaaaaaaagaagtgtgagatttacaggagactccgtgaatttgctaagctatatgacacgataaggaacgaacggaataaatttgtgaatctgctgcataaggcccatcagaaggtaaatgagataaaagagcgccacaaaatgagcttgaacgagctcgaaattttacggaatagcgctgtaagccaggagaggaagctgcaaaattctatgctgaagcacgcaaacaatgtgactatacgggagagcatgcagaacgacgtgcggaagatcgttagcaagttgcaggagatgaaagagaaaaaggaggcccaactcaataacatagatcgcctggctaacaccatcaccatgatcgaggaagaaatggtgcagctaaggaaacggtacgaaaaagcggtgcagcaccgaaacgagagtggggtacagctcattgagagagaagaggagatttgtatcttctacgaaaagattaacatccaagagaagatgaaactgaatggtgaaattgagatccatctactggaagaaaaaattcagttcttgaaaatgaaaatcgccgaaaagcaaaggcagatctgcgtgactcaaaaactgcttcccgctaagagaagtttagacgcggacctggcagtcctccagatccagttcagccagtgtacggacagaatcaaggacctcgagaaacagttcgtaaaacccgacggcgagaaccgtgcacgatttctgccaggcaaggacttgacggagaaagaaatgatccagaagctggacaaactagaactgcagctggcaaaaaaagaggagaagctgcttgagaaggactttatatatgagcaggtgagtcgcctaacagaccgcctttgttcaaaaactcagggctgcaagcaggacacactcctgctggccaaaaagatgaacggctaccagagaagaatcaagaacgcgacagagaagatgatggccctcgtggcagaattaagtatgaagcaggctctaacaatcgagctccaaaaagaagtccgcgaaaaagaagactttattttcacctgcaattcaagaattgaaaagggactacccttgaacaaagaaatagagaaggaatggctcaaagttttgagggatgaagaaatgcacgccctggcaatagccgaaaaatcccaggaatttctcgaggccgacaaccggcagctgccgaatggtgtctatacaaccgccgagcagaggcctaacgcgtacatacctgaggccgacgccacactgccactacctaagccatacggcgccttagcaccctttaagccttctgagcccggcgcaaatatgagacatatccgtaaacctgtgatcaagcctgttgaaatttag

SEQ ID NO: 46282 - DNA, 513 bp, Artificial Sequence
  Description of Artificial Sequence: Synthetic coding sequence
atggaggacagcagcaccgacaccgagaaggaggaggaggaggagaaggacgagaaagatcaggagcctatatacgctatcgttcccacaatcaatatccaggatgagagattcgtggacctgagcgagactcctgctttcattttcctgcatgaactgcatgccatgggtaaactgcccggtacgcgaatggctgccctgaaagccaaatacaccttattacacgacgctgtgatgagcacacaagagagcgaggtgcagctcctgcaaaacgctaagcgttttacagagcagattcaacagcagcagtttcaccttcagcaggctgacaatttccccgaggcattttccacagaggtttcaaagatgcgtgaacagctgctgaaataccagaatgaatacaacgcagtaaaggaaagggaatttcataatcagtatagactcaactctctgaaggaggaaaaaattatcattgtgaaggagttcgagaaaataacaaagccgggtgtctag

SEQ ID NO: 46283 - DNA, 2010 bp, Artificial Sequence
  Description of Artificial Sequence: Synthetic coding sequence
atggagaagaagaagatcgtgctggagcaggaggtgaagaccctgaatgactcactgaaaaaagtggagaataaagtgagtgccatcgtggatgaaaaagaaaacgtaatcaaggaggttgagggcaagagggcactcctggaaattaaagagcgggaacacaaccagctcgtgaagttactcgaattagcccgggagaatgaggccacgagcctcacagagaggggaatcctggatctcaacctcagaaattccctgattgacaaacaaaactatcacgacgagctgtcgcgtaagcagcgtgagaaggaaagggacttcaggaacctgaggaagatggagctactcctgaaggtgagctgggacgccctccgacagacacaggccttacaccaacggttactcctggagaaaataatttcggaaatggaaagcaagctggtggaacagcagttggcggaggagaacaaactgctcaaggaacaggaaaatatgaaggaacttgtggtgaacctgttgcggatgacccagatcaaaattgatgagaaggagcaaaaatccaaggacttcctgaaggcacagcagaagtataccaatattgtgaaggagatgaaagcaaaggacctcgaaatcaggattcataagaagaagaagtgtgagatctataggcgtctgagagaatttgccaagctgtatgatacaatcaggaacgagcgtaataaatttgtgaacctgctgcataaggcccaccagaaggtgaatgaaatcaaggagaggcacaagatgtcactgaacgaactggagatactccgaaacagtgcggtttctcaggaacgaaaactgcaaaactccatgttgaagcatgctaataatgtgaccatccgcgaaagtatgcagaatgatgtgagaaagatcgtgtccaagctgcaagagatgaaagagaaaaaagaagcccagcttaataacatcgaccgtctggcaaatacaattacaatgattgaggaagaaatggtgcaactgcgcaaaagatacgagaaggccgtgcagcaccgaaatgaatctggagtacagctaatcgaaagggaagaggagatttgtatattctacgaaaagatcaacatacaggagaagatgaaactgaatggcgagatcgagattcacttactggaggagaaaattcaatttctgaagatgaagatagcagagaagcagaggcaaatctgtgtcacccaaaaactgcttcctgctaagaggtctctcgacgccgacctcgctgttctgcagatacagttttcacagtgtactgacagaatcaaggatctcgagaagcagtttgtaaagcctgacggtgagaaccgcgctcgatttctgcccggtaaagacctcacagaaaaggaaatgatccagaaattagataagctcgaactacagctggccaagaaagaagaaaagctcctggagaaagactttatctacgaacaagtgtctcggctaacagatcgcctgtgcagtaaaactcaaggttgcaagcaggacacactgctgctcgccaagaagatgaatggctatcagaggcgcataaagaatgcaaccgagaagatgatggcactggttgctgaactgagcatgaaacaagctctcaccattgagttacaaaaagaggtccgggagaaagaggacttcatttttacctgcaattctaggattgagaagggtctgcccctgaacaaggagatcgaaaaggagtggctcaaggtcttacgcgacgaggaaatgcatgccctggcgattgcagaaaagagtcaagaatttcttgaggcagacaaccgccagctgcccaatggtgtatatacgacagcggagcagcgacccaacgcctacattccggaggctgacgccacactcccattgcctaagccttatggcgcactggccccattcaagccaagtgaaccaggcgcaaacatgagacacatccgaaagcccgtgattaagccggttgagatttag

SEQ ID NO: 46284 - DNA, 279 bp, Artificial Sequence
  Description of Artificial Sequence: Synthetic coding sequence
atggacgagctgctgcgggagcgggacatcctgaacaagaacatgctgaaggctgtgaacgcaactcagaagcagacagacctggtcaagttgcacgagcaagcgaagagaaatctagaaggtgagatccaaaactataaagacgaggctcaaaagcagcgcaaaatcatctttcatctggagaaggaacgcgaccggtatattaatcaggcttctgatctgactcaaaaggccgactccgtaagaatgccttggcctctcgataagggtaagtggtag

SEQ ID NO: 46285 - DNA, 279 bp, Artificial Sequence
  Description of Artificial Sequence: Synthetic coding sequence
atggacgagctgctgcgggagcgggacatcctgaacaagaacatgctgaaggcggttaacgccacacagaaacaaaccgaccttgttaagctgcacgaacaggccaagcgcaaccttgagggagaaatccagaactataaggacgaagcgcagaagcagcgaaaaattatttttcacttagagaaggagcgcgaccggtacataaatcaggcctccgaccttactcagaaggcggattcagtcaggatgccttggcctctggacaagggaaaatggtag

SEQ ID NO: 46286 - DNA, 2619 bp, Artificial Sequence
  Description of Artificial Sequence: Synthetic coding sequence
atggccgaggagaagggcggcaagcaggtgctggaggagagcgccttcgaggagatggaacgtgatttccagggcgtgttgcacgagctgtcaggagacaagtctctggaaaagttcaggattgaatatgaacggctccatgcagttatgaaaaaatcttacgataacgagaaacgcttaatggcaaagtgtcgggaactgaacgcggagatcgtggtgaattccgcaaaagttgccaccgccttaaaattgtctcaagatgaccagaccaccatcgcatccctgaaaaaggaaatcgagaaagcctggaagatggtggactcggcctatgataaggagcagaaggctaaggaaacaatcctggccctgaaggaggaaatagtgaatctcaccaagctggttgagcaaggcagcggtctctctatggatcagcatagcaacatacgggatttgctgcggtttaaggaggaagtcaccaaggaacgggaccaactgctgtctgaggttgttaagctgcgagagtctctcgcccagaccacagagcagcagcaggagacagagaggtctaaggaggaggcggaacatgctatttctcagttccagcaagagatccagcagagacaaaacgaggcatctcgagaatttcgcaaaaaggagaagctggaaaaagagcttaagcagattcaggccgacatggactcgcgccaaacagagattaaagcactacaacagtacgtgcaaaagtcgaaagaagagctgcagaaattggagcagcagttgaaagagcaaaagattctgaatgaaagggctgcaaaggaactggagcaattccaaatgaggaatgcaaaattgcaacaggagaacgagcagcattcactcgtctgtgaacaactgagtcaggagaatcagcagaaggctctggagctcaaggctaaggaagaagaggtgcaccagatgcggctggatattgggaagcttaacaagatccgtgaacagattcacaagaaactgcaccataccgaggaccagaaggccgaggttgaacagcataaggagaccctcaaaaatcagatcgtgggactggagagagaggtagaggcatctaagaagcaagcagagctggaccgcaaggccatggacgagttgcttagagagagagatatcctcaataagaacatgcttaaagcagtgaatgcaactcagaaacagacagatctggttaagctgcacgagcaggccaaacgaaatcttgagggagagattcagaactacaaggatgaagcacagaagcagaggaagattatatttcacctggagaaggagcgcgaccggtacatcaaccaggctagtgatctgacccagaaggtcctgatgaacatggaggacatcaaggttcgcgaaacccagattttcgattaccgcaaaaaaatcgcagaatccgaaatcaagctgaagcagcagcagaatctctacgaagcggtacgcagtgacaggaatctttactccaagaatttggtcgaggcgcaggacgaaatcactgatatgaagcggaagttgaaaatcatgatccaccaggtggatgagctgaaagaagacatcagtgccaaggaatcagcgcttgtaaagctgcacctggaacagcaacgcattgaaaaggagaaggagacgctcaaagccgaacttcagaagctgagacagcaagcactggagacaaagcatttcatcgagaagcaagaggccgaggagcggaagcttttaagaataatcgccgaagcagatggagagcgcctgaggcagaagaaggaactggaccaggtgattagcgaaagagacatcctcggctcgcagttggtcagacgcaatgacgagctcgccctgctttacgagaagataaagattcagcagagcgtactgaacaagggcgagtcccagtataaccagcggttagaggatatgcggatactgaggttggagattaagaagctgcgaagagaaaaagggattctcgcacgaagtatggcgaatgtggaagagctccggcaagaatttttccatatgcagagagaactcctgaaggagcggacacgctgtagggctctggaagaagagttggaaaatcccttgaacgttcatagatggcggaaacttgaggcatccgaccctaacgcctacgaattgattcagaaaattcacaccctccagaaacgtctgatctctaagaccgaagaggtggttgaaaaagagctcctgctgcaggaaaaggagaagctgtatatggaactaaaacatgtgctggccaggcagcctggccctgaagccgccgaacagctcaaactctacaggcggacactgcacgataaaaagcagcagttgaaagttctgtcttccgagctcaacatgtacgaagtgcaaagcaaagagtataaatacgaggtcgagaagctgacaaacgagctgcagaacctgaagaagaagtatctagctcaaaagcggaaggaacaactgcaaaagaacaaggacacagccccaatggacaacaccttcctgatggtgaagccgaacggcccgggattcactggcgggggatttcccctgaggtctaccaagatgaccttctag

SEQ ID NO: 46287 - DNA, 1776 bp, Artificial Sequence
  Description of Artificial Sequence: Synthetic coding sequence
atgtgcgccgccagcgccagccccgacaacctggtgttccacatgaagaacgaaatgaggaacatcaagtacaagccagttgactaccagcagctgcgggccctgactgaggcaaaaaaactagcttcagcaagtgctaaactgaagattagaaaggcgatgctgacctctaagctttctaaggagcagacactgattaagcagcataagcaagtctggtggcaggagtaccagcgactcaatgaggtgcggtgcaaaatggaatccgaaatcaagagccttctgaacgaggaaaatatcggaaacgagtgcctgtgcgatctaacaaacttcgaacaggaactgagcgagcagcagtgcacatacctgaaaaacgtgattaacccaatccagcagttaagggcagatcttaagtaccggcaacatcacactctgcagcactcccatccccacatcgaattcaatagcatgaaagtgcttgaggaagtggactttgtgaaaaagcagctcaagactgtgttcgagcgcctcagactcgaacaacaaagaatagagaacgacctgtccgattggagtattaaaatcctggatcactccttggaggagaagacaaatcccctgtccgagttgcctattgaattggaatctctggaatgcccctacccggacttgaagtcttcgatcctctctgagttctataaatttactcaaaagtatcagaaaaagctccaggacttcaatctacagctggaggacatctacagaaactgccagctttcggaggaggaccattggatctatcaggcgatattagaccagtaccccggggacttatttggccggagaaccctttatttggacatgctgcaaaggtactttcctcacaaatcccgacacgatttggtcgagcacgagaaatactgtgaccagtatagattcgcgattgagcagcaaaatattctgatcagcaattggaacaaaaacaagaaggactttatccagaaagcagtactcacattgactgaggcttgcgctacacatgaaatggaatcaatgcttgccaaggataaaaagaaacagcaggagctgtgcgccgatctcaaggcaaaggtgagacagtggagagcccaccaagaggaggttgcgagacttgaaatggagatctccgctcgacgccgggaaaaggaggaggagaaggaaaaactatggaaaaaaaaagagctccttcagagagccgaaaaaaagaagaagatcaagaagtattgggctaaaaagaagcagaagtggcaggagatggaaatgagggatcttcagcggcttgaagaactgaagaagttaatcgccgagcagagcctcaaagatcgcgaacgggtaaagtaccgccaagagctgctcgaaaggcgcctgatggagaaaaaggaggtggctttgcaggaggcccacgaggacaaagagagggctagaagactcgaggcactacgcaaacaggtcgcagtcgttgcacagttcgatcccgtcaggatgatgtctgataccatggcatccaaagcgcgcatgggaattgagattgaggaagagttcattctgcaaaaacccctgtttaccttgaacacctataacgagcagcagatcatttccgatcccaggctcagattcgagctggccctgcgggaagctggtcttcaccgtacactgtacgcgaaggaaatactgcctaagatctccccccagaagccgcccaggaaagatatggaaagtactgtcttcaaaatctag

SEQ ID NO: 46288 - DNA, 795 bp, Artificial Sequence
  Description of Artificial Sequence: Synthetic coding sequence
atgaacgtgttcgtgaccctgcagatcctggtggacttcgtgaagaaacagctcaagaccgtgtttgagagacttaggttggaacagcagcgtatcgaaaatgatctgtccgactggtccattaagatcctcgaccatagtttggaggaaaagactaatcccctgtccgaacttccaattgaattggaatctctcgaatgtccctacccggaccttaagtccagtatactatccgaattctataaatttacccaaaaatatcaaaagaagctgcaggattttaacctgcaattggaagacatttaccgcaattgtcaactgagcgaagaagaccattggatttatcaggcaatcctggatcagtatcccggggacctgttcgggagaaggacactctatctggatatgctccaaagatacttccctcacaaaagtaggcatgacttggtcgagcacgagaagtattgtgaccagtaccggttcgcaatagagcagcaaaacattctaatctcaaactggaataagaacaagaaggatttcatccagaaggctgtgctgacattgactgaggcatgtgccacacacgaaatggagtccatgctggcaaaggataaaaagaagcagcaggagctctgcgccgatctcaaggctaaggtgcgtcagtggagagcccatcaggaggaagtggccaggctggaaatggaaatctccgcgcgtcgccgtgagaaagaagaggaaaaagagaaactgtggaagaaaaaggaactcctccaacgagctgaaaagaaaaaatag

SEQ ID NO: 46289 - DNA, 900 bp, Artificial Sequence
  Description of Artificial Sequence: Synthetic coding sequence
atggagagcgagatcaagagcctgctgaacgaggagaacatcggcaatgaatgcctgtgcgacctcacaaattttgaacaggagctcagcgagcagcagtgtacctatctgaagaacgtgattaatccaatccaacaattgagagcagatctaaagtatcggcagcatcacacactgcagcacagccacccacacatcgagttcaacagcatgaaggttcttgaggaagttgattttgtgaaaaagcagcttaagactgtcttcgaaaggctaaggcttgaacagcaacgaatcgagaacgacctcagcgattggtccataaaaatcctggaccactctttagaggagaagactaaccccttaagtgagttacctatagagctggaatcactcgagtgtccttatcccgatctcaagtcttctattctgtccgaattctataaatttacacagaagtatcaaaaaaaactgcaggactttaacctgcagctggaagacatctatcgaaactgccaactaagtgaggaggaccactggatttaccaggccattctggaccagtatcccggagacctgttcgggcgccggactctctatctcgatatgttgcagcgttatttcccccataagtcgcggcacgatctggtcgagcacgagaaatactgtgaccagtaccggttcgcaatcgaacagcagaatatcttgatttctaactggaacaagaataaaaaggactttattcaaaaagcggtgttgactcttacagaagcttgtgcaacccatgaaatggagtcaatgctcgccaaagacaaaaaaaaacaacaggagttgtgtgctgacctgaaggctaagtctcaggtttgcttgtatcaacagcatgagaatggtctgatccagtag

SEQ ID NO: 46290 - DNA, 1362 bp, Artificial Sequence
  Description of Artificial Sequence: Synthetic coding sequence
atggagatccaccacttcctgctgaagcggaagcaggccaacctggcccagttactgagggatagtcaggataggaacaagcatttgggcgaggagattaaagaacttcaacaacgcctaggcgaggtccagggtgataacaagctccttcgcatgaccatcgcgaaacagcgattgggggatgaagcgataggtgtgaggcacttcgcagcacatgaacgggaggacctcgtccagcaactggagagggccaaggagcagatcgaaagcttggaacacgacctccaggcttctgtggatgagctgcaggatgtcaaagaagaacggtcttcttaccaggataaggtggagcgtctgaaccaggagctgaatcatattctttctggtcacgagaaccggatcatcgacgtcgatgccttatgtatggaaaaccgctaccttcaggagcggctgaaacaactgcacgaggaagtcaacttattgaaatctaatatcgccaaatacaaaaacgcgctggaacgcagaaaaaattccaaaggtcaaggcaagtccagcagcagcgcactgactggggtgctcagcgccaaacaggtgcaggacttgctgtccgaggaccacggatgtagtctacctgcaaccccccagtccatcagcgatctgaaatcattagccactgcgctcctcgagactattcacgagaaaaatatggttattcaacaccagagacagacaaacaaaatcctcgggaatagagtcgcagaactggaaaaaaagttacggacgcttgaagtttctgggctgtggagcctacccggtggaaaagacactatcctcttctccgaccccacactgcccagtggccagcggagtcggagcccgctgctgaaatttgtcgaacagcccactgagaacaaggcagatcctaaggacggcgaagcccagaaacaggaagaagacgagagctgtgccgctgctgaagcactgactgccccagaagatgctggcaggccagccgtgaactcccctgcaaaccagtctcgcggtaaccagtgtaagctttttcacccgtccctcccacagctgcctagcgaggaggaggtgaattctttagggagggaaattattaaacttacaaaggaacaggccgccgctgagcttgaagaggttcgccgagagagtccaattgaggggcaaagaagtgagacaggaccagccccacccggtctggccattcaaggggaattacccaagagccacctggattcttttgaggcaagtaggccggccgcaaaagccagcactccagaggacggaaagggcatccccgagggaggaggaatgcgcagcaccgtaaagacctag

SEQ ID NO: 46291 - DNA, 261 bp, Artificial Sequence
  Description of Artificial Sequence: Synthetic coding sequence
atggccaaccagctgcgggagcggcaccagagcctgaagaagaagtatcgagagctgattgatggtgacccctctcttcccccagagaagcgcaagcaagccaacttggcacaactgctgagggacagccaagatcgcaacaagcaccttggggaagagataaaggaactgcagcagcggctgggggaggtacagggtgataataaaggacgattacggtcaaagaagaaaatgaaagtggtgccactccttcggcggtag

SEQ ID NO: 46292 - DNA, 1590 bp, Artificial Sequence
  Description of Artificial Sequence: Synthetic coding sequence
atggaggaggaggccatgaacggcgaccggaccgagagcgactggcagggactagtgagcgaatatctggtgtgtaagaggaagcttgagtccaagaaggaagctctgctaatcttatcaaaggagctggatacctgtcaacaggagagagatcagtacaagctgatggctaaccagcttcgtgaacgacaccaatccctgaagaaaaagtaccgtgagctgatcgacggtgaccccagcctgccccctgagaaacgcaaacaagctaacctggcccagctgctgcgcgactcccaagatagaaacaaacaccttggggaggaaataaaggagctgcagcagaggctcggggaggtccagggcgacaacaaacttttgaggatgactatcgccaaacagcgccttggggacgaggccatcggagtgcggcacttcgccgcccatgagcgcgaagatttggtccagcagctcgaacgtgccaaagagcagatcgagtccctggagcatgatttgcaggcctctgttgatgaattgcaggacgtgaaggaggaacgatctagctaccaggacaaagttgaaagattgaatcaggagctaaatcatatcctttccggccacgagaataggattatagacgttgacgctctatgcatggagaatcgatatttgcaggagagactgaagcagttgcatgaggaagtaaacctgctgaagtccaatatcgccaaatataagaacgctctggagcgtcgcaaaaacagtaaaggtcagggtaagagcagcagttctgctcttacaggagtactctccgccaaacaagtacaggacctgctttcagaagaccatggatgctccttacctgccactcctcagagtattagcgatctgaagagcctggctaccgcgttgctggaaaccattcacgaaaaaaacatggtcattcagcatcagagacagaccaacaaaatcttagggaatcgggtggcagagcttgagaaaaagctccggaccctggaagtcagcggtctttggagtctaccaggaggtaaggacactatcctcttcagcgatcccacattaccttctgggcagagaagtcgaagcccgcttctgaaattcgtagagcaacccactgaaaacaaggcagaccccaaagacggagaagcgcagaagcaagaggaagatgaatcctgcgctgctgccgaggccctcaccgccccggaagacgccggccggccagcagtaaattccccggctaaccagagtcgtggtaaccagtgtaaactgttccatccgagcttaccccagttaccttcagaggaagaagtgaattcactgggacgtgagatcataaagttaaccaaagagcaggccgctgctgagctggaggaggtcagacgggaatcccctatcgaaggccagcgctctgagacaggcccagcgcctcctggcttggctattcagggggagcttcccaagagccaccttgacagcttcgaagcatctcgacccgccgccaaggcttcgacgccggaagacggcaagggcattccggaaggtggcgggatgcggtcgacagtgaagacatag

SEQ ID NO: 46293 - DNA, 1590 bp, Artificial Sequence
  Description of Artificial Sequence: Synthetic coding sequence
atggtggtgatcgtggtggtgatcatcatcatcatcgcccgggccgcaacctgggatagtgaatatttggtatgcaagaggaagttggagtctaaaaaagaggctctgctgatcttaagtaaggaactcgacacatgccaacaggagagggaccagtataaacttatggctaatcagctaagagaacgccatcagtccctgaagaagaaatacagggaactgatcgacggagacccatccctgcctcccgagaaacggaaacaggcaaacctggcccaactgcttagagactctcaggatcgcaacaagcatctcggagaagagataaaggagctccaacagcgtctcggagaagtgcagggtgataataaactgttacgcatgacgatagcaaaacaacgcctgggagatgaggctattggtgttcggcattttgcggcgcacgagcgcgaagaccttgttcagcaactggagcgggctaaagagcagatcgaaagtctggaacatgaccttcaggcgtctgtggacgagttgcaggacgtgaaggaagaaagaagtagttaccaagataaagtggagcgcctcaatcaggagttaaaccacattctgtcgggacacgaaaacaggatcatcgatgttgacgcattgtgcatggagaaccgatacctgcaggagaggctgaagcagctgcatgaagaggtgaacttactgaaatccaacatagccaaatataaaaatgcccttgagagacggaagaactccaaagggcagggaaaatcatccagctccgctctgactggtgtgctgtcggccaaacaggtgcaggacttgctcagcgaagaccacgggtgtagcctcccggctacccctcagtccattagcgatctgaaaagcctcgccacagcactcctcgagacaattcacgagaagaacatggttatccagcatcagaggcagactaataaaattctgggaaaccgcgttgcagaactggagaagaaactgagaacactggaagtttcaggcctgtggagcttaccaggcgggaaggacacgatcctgttctccgacccaacactacctagcggccaacggtcccgctcccctcttctaaagtttgtggagcagcctaccgaaaacaaagctgatccaaaggacggcgaggcgcagaagcaggaggaggacgagtcttgtgcggcagctgaggccctaacagcacctgaagacgccggaaggcccgctgtaaactccccagccaatcaaagccgagggaatcagtgtaagctattccacccctctctgccgcaactgccatcggaggaggaggtcaattctttgggcagggaaattatcaagctcactaaggaacaagccgcagcagaattggaagaggtacggcgggagagccctatcgaggggcagaggtcagaaactggacctgcccctcccggcttggctattcagggtgaacttccgaaatctcacctcgactcttttgaagccagtaggccagccgcaaaagccagcactccggaggacggaaagggaattcctgaaggcggcgggatgcgcagcacggtgaaaacatag

SEQ ID NO: 46294 - DNA, 2247 bp, Artificial Sequence
  Description of Artificial Sequence: Synthetic coding sequence
atgagcctgcacgaggccagcgagaaggcccaggtgctgaacgaccaacttacgaagaagtgctcagaactcagctgcatgcttcagacagtgactatggagaaggcaaggattatcgccgaccaccaggccatcttgcaggtggagcagaaaatgatgactcagacttttcaggaacagaacctcctgctggatgccgctcacgcgtcaattacaaacgagctgcagaccgttcaaaacgagaaaacacagctccaggctcacctggatcaccttatcctcgagcataatcaatgcatccagaaagcccaggacgcggagaagcgtaccgctgtacagaaggagctgttggaatccacgatcgctcgactccgcggagagcttgaagccagtatgcaggaaaaaaagtcactgctggaagaaaaagagagatttcagcgcgaagtcaataagaccgagaaagagatagtgcaagagaggtgcaacctggagaaggagcttgcgaagaacaaggtggatataaacactctcacccacaacctgcagacccttgaggaagagaataaacatctggccgatcagatggcctctctggagctacagcaagtaaccagcgactaccatggcttggcccagcagaaggtggagaaaatcacagaatcaaaaaataaacttgcctatgaaaacgggaagcttcagatcaaagtgaaacagctggaggagcaagttcaatcctttaccgatacctcattgcagaatgaccacttgcgcaagatgaacaaatacctccagactaaatacgcgcaagtcaagtcaatcctggagagatctaaagaagagttgagcaggacagtgaagtgccggaatgctgccttaaaggaatctcagaagctgaaggaagatttagaagctgtggaagatcgagaaaacaagaaagtggggaatttccaacggcagttggcggaagccaaggaagacaattgcaaggtgactatcatgctagaaaatgtgttagcctctcactctaagatgcaaggagcgctggagaaagttcagatcgagctgggtcgaagagacagtgagatcgccggcctgaagaaggagagggaccttaatcagcaacgtgtgcaaaagctggaggccgaagtcgatcagtggcaggcgcggatgttggtcatggaagaccaacacaattctgaaattgaatccctccagaaagctctcggtgtggctcgcgaagacaatcgcaagctggccatgtctctcgagcaggcactgcagaccaataatcacctgcagacaaaactcgaccacattcaggaacagctcgagtccaaggaactggagaggcaaaatctggaaaccttcaaagatcgaatgaccgaggaaagcaaggtggaagctgagctgcatgcggagagaatcgaggctctacggaagcagtttcaaaccgagagggagacaaccaagaaggtggctcagagagaggttgctgagctcaagaaagctctcgatgaagcgaacttccggtcagtcgaggtctctcgtaccaatagggagttgcgccaaaagttagccgaactggagaagattctggagtccaataaggagaaaatcaagaaccagaagacacagatcaagttacacctgagtgccaaggccaacaacgcccagaatatcgagcgtatgaaacagatagagaaggagctgaaacagatggagctgattaaagatcagtaccagaagaaaaactatgagcagagcctgtccatccagaggttcgtgtgtgaaatgacaaatctccaaaaggagatgcagatgctggctaagtcacagtacgacgctagtgtgaggaacaaacagcaggaattacatctggaggccgaacgcaaaattcggcaggagctggagaaccgctgccaggaactcgaagagacggtcagacatctcaaaaaatgcaaggaggcgaccgagaatactttgaaggaagccagtgtagaatccgagcagattacagctaacctggaggaagctcatcgatggtttaagcataggttcgatggcctccagctcgaattaacaaagaaccgcttgcagcgcccatcaggcgaggatcgatggcaggaaaaagaccaggacgtcaagcatgacgtcatgtctaatcaaagtgtccttcaccgctgggaaagaaagcagaatttgagaccaatgcctaagaaataccactccgaagtccagcgcaagtag

SEQ ID NO: 46295 - DNA, 3306 bp, Artificial Sequence
  Description of Artificial Sequence: Synthetic coding sequence
atggactgcaaggtgcacatggagaccaccgtgagccggcccgtgctttcccctacccacataaatgcaaccgctagcgagactttcaccgtgctgcagcagaggatgcgcattgtggaggaacaaacaagttctcttagagatgatcttatcatgctagacttcggggaaaagagaggctacctggaagccccggactgcctggaggacctggattcccagaaggttatttcgcctattcagaacgaggctatttgcgcgggtaaaacagatattctttggaagaattgtgaattcctagttaacagaatgtgtaggctcgaatcacttatgcagagcctgaaaatgaatattttcaggctgcaaaccgaaaaagatcttaaccctcagaaaactgcctttctgaaggatagactgaacgctatccaagaagagcatagcaaggacctgaagttgcttcatctcgaggtgatgaaccttaggcagcagctgagagcagtcaaagaggaggaagacaaagctcaggatgaggtgcaacgcttgactgcaaccctgaaaatcgcttcacagaccaaaaaaaatgccgctattattgaagaagagttgaagaccacgaagcggaaaatgaacttaaagatccaagagttgcggcgccagctcgcccaagagaaatatctgcgcgaatcacttgaaaaatcagcttccgcaatgctgcttaagatccaggagatgggaagtaccgttgaggtggaacgaaaacaggtgcacattttgcagcagaattgcatcgccttaagagactcaatccaaagcgcacaggaactactggcacaggagcagaagaagaaggaagaactcgagattgccactagccaactcaagtctgaccttaccagccgtgatgatcttattagcaaacttgtcgaagagaataagaacttgcagatcagtttcaataaagagcacgaagaaaacgcctaccttaggtcagaaatcatgagcctgcacgaggcgtccgagaaggcccaagtcctgaacgatcagcttactaagaaatgttccgaattaagctgcatgctacaaacagtcacaatggaaaaagctaggattatcgccgatcaccaggccatactacaggtggaacagaagatgatgacacaaacattccaggagcagaatctgttgttggatgctgcacatgcaagtatcactaatgaactgcagacagttcagaacgaaaaaactcagctacaagctcatctggaccatctgatcttggaacataatcagtgtatccagaaggcacaggacgcagagaaacgcactgcggtgcaaaaagagctgctggagagcactatcgcccgcctgcggggcgaactggaagcatccatgcaagagaaaaagagcttgttagaggagaaagaaaggttccagcgggaggtgaacaaaaccgaaaaggagatcgttcaggaaagatgcaatttggaaaaagaactggcaaagaacaaagtcgacatcaacactctgacacacaacctgcaaacacttgaggaggaaaataagcacctggccgaccagatggcatctctggagctccagcaggtcaccagcgattatcatgggctggctcagcagaaagtggaaaaaattactgaaagcaagaacaaactcgcatatgaaaatgggaagctccagattaaggttaaacagctggaggaacaggtacaaagttttacagatacatccctccaaaacgatcacctgagaaaaatgaacaagtatctgcagacaaagtacgcccaggcaaatagcgaactgtccgctaaaagggtgcacctgcaacaggctgatgcacatctgaaagaggtcaaatctatactggagcgtagtaaagaggagctctcacgcacagtgaaatgcaggaacgctgccttgaaggaatcacagaagctgaaggaggatctggaggccgtggaagaccgtgagaacaagaaagtggggaacttccaaagacaacttgccgaagccaaggaagataattgcaaggtaaccatcatgcttgagaacgtgctggcgtctcatagcaaaatgcagggcgccctggaaaaagtgcagattgaactcggtcggagagattccgagatcgctggcttgaagaaagagagggacctgaaccaacaaagggtgcaaaaattggaggcagaagttgatcagtggcaggcccgtatgctggtaatggaagaccagcacaactccgaaattgaatccctacaaaaggccctcggtgtcgctagagaagacaaccgaaaactcgcaatgagcttagagcaagccttacagaccaacaatcaccttcaaacaaagctggaccatatccaggagcagttggaaagcaaagagttggagcggcaaaatctggagacttttaaagatagaatgaccgaagaatctaaagtagaagccgaactccacgcagaacgaatagaggcacttcggaaacagttccagacagaacgggaaacaacgaagaaagtcgcccagcgggaagttgccgagttaaaaaaagccctcgacgaagccaatttcagaagcgtagaggtcagccgcacaaaccgagagcttagacagaagctcgcagaactggagaaaatcctggaatccaacaaggagaagatcaaaaatcaaaaaactcagataaaactccacctgtcagccaaagccaataacgctcagaatattgaaaggatgaaacaaattgaaaaggagctcaaacagatggagctgatcaaggatcagtatcagaaaaagaattacgagcagagtttgagtatccagaggtttgtatgcgaaatgacgaacctgcagaaggagatgcagatgttagccaaatctcaatatgacgcttcggtgagaaataaacagcaggagcttcatttggaagccgagagaaaaatccggcaggagcttgaaaaccgatgccaagagcttgaggagaccgtccggcaccttaagaagtgcaaagaagcaaccgaaaatactcttaaggaggcttccgttgaatctgagcagatcaccgccaacctcgaagaggcccaccgctggttcaagcataggttcgatggtcttcagcttgagctgaccaagaatcgccttcagagaccttctggggaggatcggtggcaggagaaagatcaggacgtcaagcatgatgtgatgagcaaccagagcgtactgcaccggtgggagagaaaacagaacttacggccaatgcccaaaaaatatcatagcgaggttcaaaggaagtag

SEQ ID NO: 46296 - DNA, 1767 bp, Artificial Sequence
  Description of Artificial Sequence: Synthetic coding sequence
atgcccctgcggaagcggaagagccccgagcggaccgccagcagcaaatcacccgagataagtagaagccacgttaattctatcaaggaacgtacttcatccgttggattgccaagcgtgattcccaattccacacggcgggtcagtttcgcaccaaacctgccatccatgaaaacatcacaagatatcggtgacagcagaatcagcctgaagacactgctcaacgcaataaagactatggaaggtcgactcgaaggaaagatcgagattctggcctcacgccctttaatcaatgatgagagcccaaacttcctgaaacaggactcagttaaaagtatattggagaggtcaaaagaggaactgtcccggaccgtgaagtgtagaaacgcagcgctgaaagagtctcagaaattgaaggaggacctcgaagccgtggaggacagggaaaacaagaaggtggggaattttcagagacagttggcggaggccaaggaagacaactgcaaggtcaccatcatgctggagaacgtgctagcttctcactccaaaatgcaaggagccctggaaaaagtgcagattgaactggggcggagagattccgaaatcgccggcctgaaaaaggaaagagacctcaaccagcagcgggttcagaaactcgaagccgaggtggatcagtggcaggcacggatgctggttatggaagaccagcacaactcggagatcgaatcattgcagaaggccctgggtgtggcacgtgaagataataggaaactggccatgtctctcgaacaggccttgcaaactaataatcacctgcaaaccaagttggaccatatccaagaacagctggagagcaaagagctcgaaaggcagaacctggaaactttcaaagacagaatgacagaggaatctaaagtggaagccgaattacatgcagaaaggattgaggctttgagaaagcagtttcagacagaaagggaaacaacgaagaaagtggcacaaagggaggtcgccgaacttaagaaagcccttgacgaagctaattttcgcagtgtggaggtcagccgcaccaaccgagaacttaggcaaaagcttgccgagttggaaaagatcctcgaatctaataaggagaaaattaagaaccagaagacccagatcaaattgcatctctctgcgaaggcaaacaacgcccagaatattgagcggatgaagcagattgagaaagaactgaaacagatggagctgatcaaggatcagtaccagaaaaagaattacgaacagtctctgagcatccagcgctttgtctgtgagatgacaaatcttcagaaagaaatgcagatgcttgccaagagccagtacgacgcaagtgtccggaacaaacagcaggaattgcaccttgaagctgaaaggaaaattcgccaggaattggaaaatcggtgccaagaacttgaggaaaccgttagacacctgaagaaatgtaaagaggccaccgaaaatacattaaaagaggcgtctgtggaatctgaacagatcaccgcaaatctcgaggaagctcaccggtggtttaaacaccgttttgacgggttgcaactggagctcacgaagaatagacttcagcgcccaagcggcgaagacagatggcaggagaaggatcaggatgttaagcatgatgtgatgtcaaaccagagcgtcctgcaccggtgggagcggaaacagaacctgcgccccatgccaaaaaaataccactcagaggttcagcggaaatag

SEQ ID NO: 46297 - DNA, 456 bp, Artificial Sequence
  Description of Artificial Sequence: Synthetic coding sequence
atgagcctgcacgaggccagcgagaaggcccaggtgctgaacgaccagctgactaagaaatgctccgaactctcttgcatgctgcagaccgtgaccatggagaaggcacggatcattgccgatcatcaggcaattctccaggtagagcagaaaatgatgacccagacgttccaggagcagaacctgctgctcgatgccgcgcatgcctctattactaatgagcttcagacagtgcaaaacgagaagacacagctgcaggcccacctagatcatctgattctggagcataaccagtgtatccagaaagcccaagacgctgagaagcgcaccgctgtacagaaagaactgttagaatcgacaattgcgcgcctacggggtgagctggaggctagcatgcaggaaaagaagtctctgctggaagaaaaggaaagattccaacgtgagggatacctgtag

SEQ ID NO: 46298 - DNA, 387 bp, Artificial Sequence
  Description of Artificial Sequence: Synthetic coding sequence
atgtgccggctggagagcctgatgcagagcctgaagatgaacatcttcaggctgcagacagagaaagacttgaacccccagaagacagcctttctgaaggatagactcaatgctatccaggaggagcatagtaaggatctgaaattgcttcatctggaggtcatgaacctgcgtcagcagctgcgtgcggtgaaggaagaagaggataaagcgcaggatgaagtgcagcgactcacagccacactgaaaatagcttcccagactaaaaaaaacgctgcgattattgaagaggagttaaagacaacgaaaaggaaaatgaatctgaaaatccaggagcttctggagatgacctcattcccttcgtggctaaagaaaatccgcttctag

SEQ ID NO: 46299 - DNA, 891 bp, Artificial Sequence
  Description of Artificial Sequence: Synthetic coding sequence
atggactgcaaggtgcacatggagaccaccgtgagccggcccgtgctttcccccacccacattaacgccacggcctcagaaacattcactgtattacagcagagaatgcgcattgtagaggaacaaaccagctctttgcgggatgatctgataatgctggactttggcgaaaagcgcgggtatctggaggcgcccgattgccttgaggatctggacagccaaaaggtgatttcccctatccagaatgaagcgatctgtgccggaaaaaccgatatcctgtggaagaattgcgaattcctggtgaatcgcatgtgtcgattggagagtctgatgcagtcgttgaaaatgaatatcttcaggctgcagactgaaaaggatctcaaccctcagaaaaccgcatttctgaaagacaggctcaatgcaatccaggaggagcattctaaggatcttaagctgctgcacctggaagttatgaatctgagacagcagttgcgggcagtaaaggaggaggaagacaaggctcaagatgaggtacagcgactgactgcaacactgaagattgcctcgcagacaaaaaaaaacgccgctataatcgaggaagagttgaaaacaacaaagaggaaaatgaacctgaagatccaggaactaagacggcagctggcgcaggaaaagtacctgagagagagtcttgagaagagcgcgagtgccatgctgctcaagatccaggagatgggctctacagtggaagtcgagcgtaaacaggttcacattctgcagcagaattgtatcgctcttcgagacagcatccagagtgctcaggaattactggcccaagagcagaagaagaaaaaaagctggcggctcttactgcactcttctaatctgatttag

SEQ ID NO: 46300 - DNA, 1788 bp, Artificial Sequence
  Description of Artificial Sequence: Synthetic coding sequence
atgaccagccccctgtgccgggccgccagcgccaacgccctgcccccccaagatcaggcttccacccccagcagccgtgtcaagggccgagaagcttcaggcaaaccaagccacctaaggggaaaaggaaccgcacaggcctggactccagggcgaagcaaaggtggctccttccatcgaggagcaggcaagccttcagtgcacagtcaagtggccgaactgcacaagaaaatacagctgcttgagggcgaccgaaaagccttcttcgagtcttctcaatggaatatcaagaaaaatcaggaaacaatcagccaactacgcaaggagacaaaggcactcgagctcaaactcctggacctgctgaaaggagacgagaaggtcgttcaagctgtcatccgcgagtggaaatgggaaaagccctatctcaagaatagaacgggccaggcgctggaacatttggaccatcggctcagggaaaaagtgaaacagcagaatgccttgagacatcaggttgtactcaggcagcgccggttagaggagttacaactgcaacacagtcttaggctgttggaaatggcagaggctcaaaaccggcacacagaagtcgcgaaaaccatgcgcaaccttgagaacagactcgagaaggcacagatgaaagcccaagaggccgagcacatcacaagcgtctatttacagctcaaagcctatcttatggacgagagcctgaatctggagaaccgcctcgacagcatggaagcagaggtcgtgagaactaagcatgaactggaagctctgcacgttgtgaaccaggaagctctcaacgcccgggacattgccaagaatcagctgcagtatctagaagaaacacttgttagggaacggaagaagcgagaacgctacatttccgagtgtaagaagagggctgaggagaaaaagctggagaacgaacgaatggaaagaaaaactcatagagaacacctcttactgcaatccgacgacactatccaggacagcctgcacgcaaaggaggaggagttacgacagaggtggagcatgtatcaaatggaggtgatcttcggcaaagtgaaagatgccactgggaccgacgagacccattctctggtgcgcaggtttcttgctcagggggatacatttgcccagctggagacactgaagtccgagaacgaacaaacgctagttcggctcaagcaagaaaagcaacaactgcagcgcgagttggaggacctcaagtattcaggagaggccactttagtctcccagcaaaaactccaagccgaagctcaggaacgactgaaaaaagaagagcggcgtcatgccgaggccaaggaccagctggaacgcgccctcagggccatgcaggttgctaaagattccctcgagcacctggcttctaagcttattcatattaccgttgaagatggcagatttgccgggaaagagttagatcctcaggctgacaactacgtgccaaacttgctcggactcgtcgaggagaaacttctgaagttgcaggcccagcttcagggccacgatgtacaggagatgctgtgtcatatcgcaaacagggagttcctggctagccttgaggggagacttcctgagtacaatacaagaattgcacttccgctggcgacctcaaaggacaaattcttcgacgaagaatccgaggaggaggataacgaagtggtcacgcgtgcgtctctgaagatcagaagccagaagctcatcgaaagtcataaaaaacacaggaggagcaggaggtcttag

SEQ ID NO: 46301 - DNA, 1725 bp, Artificial Sequence
  Description of Artificial Sequence: Synthetic coding sequence
ctgcccccccaggaccaggccagcacccccagcagcggcaagccctcacacctccgaggaaaaggcaccgcccaagcctggacccccgggaggagcaagggcgggtccttccatcgaggcgcagggaaaccaagtgtgcacagtcaggtggccgaacttcacaaaaaaatccagttactggagggagataggaaagcattcttcgagagctcacaatggaatataaagaagaaccaagaaacgattagccagctgaggaaagagactaaggccttagaactgaaactgctggacctcctgaagggggacgagaaggtcgtgcaggccgttattagggaatggaagtgggaaaaaccctatctcaaaaaccggaccggccaggcattggaacaccttgaccatagactcagggaaaaggttaaacaacagaacgcccttcgacatcaagttgtgttgagacaaaggaggctggaggaactgcaacttcagcactcccttcgactcctcgaaatggccgaggctcagaatcggcatacggaggtggccaaaaccatgcgcaatctcgagaacaggttagagaaggcccagatgaaggcccaggaagccgagcatataacctcagtttacctgcagcttaaggcctatctcatggacgaatcgctaaacctcgaaaacaggctcgactccatggaggccgaagtggttcgaaccaagcatgagcttgaagctctccacgtagtgaatcaggaggctctcaacgcaagagatatagctaagaaccagctacagtatctggaggagacactggtgcgcgagcgcaagaagagggagaggtacatttcagaatgcaaaaagcgggctgaagaaaagaaattggaaaatgagcgtatggagcgcaaaactcacagagagcatctccttttgcagagcgatgacacaatacaggactccctgcacgctaaggaggaagaacttcgacagagatggtccatgtaccaaatggaagtgatctttggtaaggtgaaggatgctacgggtacagatgaaacccactcactcgtcaggaggtttctggcgcagggggataccttcgcacaactcgaaacacttaagtctgagaatgagcagacactggttcggttgaagcaagagaagcagcagctccaacgggaactggaggatttgaaatatagcggtgaggccactctggtgtcccagcaaaagctgcaggctgaagctcaggaacgtcttaagaaagaagagcggcgtcacgccgaagctaaggatcaactcgaaagggctctgcgcgcaatgcaggtggctaaggactctctggaacatttggcaagcaagctcattcacattacggtggaggacggccggttcgctggtaaagaattagatccccaggcagataactacgtgccaaatctgctcgggctggttgaggagaagctgctgaagctgcaagcccagctgcaggggcatgatgtgcaggaaatgctttgtcacatcgcaaatcgggagttcctcgccagcctggaggggaggctgcctgagtataacacaaggatcgcacttcccctagccacaagcaaagacaagttcttcgacgaggaaagcgaggaggaagataatgaggtggttacacgcgcctcccttaagatacgaagccagaagttgatcgagtctcataagaaacatagacgctccagaagaagctag

SEQ ID NO: 46302 - DNA, 1626 bp, Artificial Sequence
  Description of Artificial Sequence: Synthetic coding sequence
atgcacccccccgtggccccctgcaagaagctgcggtgcccccccacacggagttttacgccaacacgcggccgatccaaggaaggggatcggaaggccttcttcgagagtagtcagtggaatatcaaaaagaaccaggagaccatatcccagcttagaaaggagactaaagctctggagctgaaactgctcgacctgctgaagggcgacgagaaggtggtgcaagccgttattcgggagtggaaatgggagaagccctatcttaaaaacagaaccggccaagccctcgagcatctggaccataggctaagagaaaaagttaaacagcagaatgctctcagacatcaggtggttcttaggcagcgaaggctggaggagctccagctacaacacagtctgcgcttgctcgagatggctgaagctcagaatcggcacacggaagttgctaagacgatgaggaacctcgaaaatcgactggagaaggcacagatgaaggcccaagaggcggagcacatcacctctgtgtatctgcaactgaaggcttacctgatggacgagtccttgaacctcgaaaatcgtttggacagcatggaggccgaagtggttaggaccaaacatgagctggaagccctccacgtggtgaatcaggaggcattgaatgctagggacatcgccaagaatcagcttcagtacctggaagaaacattggttagagagaggaagaagcgcgagcggtacatcagtgagtgtaagaaacgagcggaagagaagaaattggaaaacgagcgcatggagagaaagacccacagggaacatcttctactgcagtcggacgacaccatccaggactcactccatgccaaagaggaggaactgcgccagcgctggtctatgtatcagatggaggtgatcttcggtaaggtcaaggacgctacagggaccgacgaaacacacagcctggtcagaaggttcctggcccagggggacacctttgcgcagcttgagactctgaaatcggaaaacgaacagaccctggtccggttgaagcaggaaaaacagcagcttcagcgggaattggaggacctcaaatacagcggggaagctactttggtgagtcaacagaaactccaagcggaggctcaagaacgcctgaaaaaggaggagaggagacatgctgaggctaaagaccagctggaacgggccctgagggccatgcaggtggcgaaagactcacttgaacacctggcaagtaagctgatccacattaccgtggaagatggccgcttcgcaggaaaggagttggacccccaggccgacaactacgtcccaaatctgcttggcctggtggaagagaaactgcttaaattgcaagcccagcttcagggtcacgacgttcaggagatgctgtgccacattgcaaaccgagagttcctagccagcctggaaggcagattgcccgaatataacacaagaatcgctctccctctggcaactagtaaggacaaattcttcgatgaggagtcagaagaggaggacaacgaagtggtcacaagggcaagccttaaaatacggtctcagaaacttatcgagagtcataaaaagcaccgccggagccgccgctcatag

SEQ ID NO: 46303 - DNA, 765 bp, Artificial Sequence
  Description of Artificial Sequence: Synthetic coding sequence
atggaccagagcagcgagggctgcatgaagaagatcagcagcgtgaatcttgacaagttaatcaacgacttctcccagatcgagaagaaaatggtggagacgaatggcaagaacaacatcctcgatatccagttggagaaatctaactgcctgctcaaggtcatgcaggcgaaggaggtgagcattaaggaggagtgcgctaccctgcacaatattatcaaagggctgcaacagaccattgaataccaacagaacctgaaaggagaaaacgagcagctgaagatctctgctgaccttattaaagaaaagttaaagagccacgagcaggaatataagaataacattgcaaaacttgttagcgagatgaaaatcaaagaggaagggtataagaaagaaattagtaagctgtaccaagacatgcagaggaaggtggagcttaacgaggaaaagcacaaggagttaattgagaagaaagagatggagataagtgagctcaacgcaaaactgcgctcccaggagaaagagaagcaaaatgagataataaaactgcagctcgaattcgacgcaaaactggcaagggtgcagaccaaaagtaagagttaccaggatagcaccgtgctgcctcagagtatctatcggcgtaagctccagcattttcaggaagagaagaataaagaaatcgccattctgcgcaatacaatcagagatctggaacaaaggctctcggtcggtaaggactcccacttgaaacgcagaagattttag

SEQ ID NO: 46304 - DNA, 633 bp, Artificial Sequence
  Description of Artificial Sequence: Synthetic coding sequence
atgccccccaagaacaaggagaagggcaagaagagcggcgcccagaagaagaagaaaaattggggggctgatgttgtagccgaatctcggcaccgccttgtggtgctcgagaaagaactcctgcgcgaccacctggcactccgtcgcgatgaggccaggcgcgccaaggcatctgaagaccaactccgccagaggctgcagggcgtggaggctgaactggaaggagcccgttctgagggtaaggcgatttacgctgaaatgtcaaggcaatgtcatgccctgcaggaagatatgcaaacgcggagcaagcagcttgaagaggaagtcaagggtttacgggggcagctcgaggcttgtcagagagaagctgctgctgccagagaggaggccgagcaggcactgggcgaacgggaccaggcactggcccaacttagggcacacatggctgatatggaggccaagtatgaggaaatattacatgactcgctggacaggctgctggcgaagctgagggcaattaaacagcagtgggacggcgccgctctgaggctgcatgcaaggcacaaagagcagcagaggcagtttgggttgactccgccaggaagtctccggccacctgccccttctctgtag

SEQ ID NO: 46305 - DNA, 633 bp, Artificial Sequence
  Description of Artificial Sequence: Synthetic coding sequence
atgccccccaagaacaaggagaagggcaagaagagcggcgcccagaaaaaaaaaaagaattggggtgcagacgtcgtggccgagagccgacatcgacttgtggtgctggagaaggaactgttgcgagaccatctggccctgaggcgcgatgaagcccgccgcgccaaggcatccgaggaccagctgcgacagagactccagggagtagaggctgaactcgaaggggctaggagtgaggggaaagccatctatgcagaaatgtccagacaatgtcatgctctccaggaagacatgcagacacgatccaagcagcttgaagaggaggtgaagggcctgcgtggccaattggaagcctgccagcgcgaggcagccgccgcccgcgaggaggccgagcaggcgctgggtgaacgcgaccaggcgttggcacaactgagggctcacatggctgacatggaggctaagtatgaggagattcttcacgattccctcgacaggttgttagcgaagttaagggccattaagcagcagtgggacggggcggccctacgcctgcacgcccgtcacaaagagcagcagcgccagtttgggctcacaccccccggttctctcaggccccctgctccttcattgtag

SEQ ID NO: 46306 - DNA, 2025 bp, Artificial Sequence
  Description of Artificial Sequence: Synthetic coding sequence
atgagcgagctggccgacagcggccccagcggcgccagcgccccctcacagctgcgggcggtcaccttggaagatctcggactcctgctggctggcggccttgcctctcccgaacccctctctctggaagagttatccgaacgatatgaaagctcgcaccctacatccacagccagcgtgccagaacaggacactgctaagcactggaaccaactggaacagtgggtggtggagctccaggccgaggttgcttgcttgcgtgaacacaaacagcggtgtgagcgcgctacccgtagtctcctccgcgagttgctgcaggttagagccagggttcagctgcaggggagcgagcttcgtcagcttcagcaggaagcccgtcccgccgctcaggcacccgaaaaggaggcgcctgaattttcagggctgcagaatcagatgcaggcactcgacaagaggctggtcgaagttcgagaagcgctcacccggctgaggcgacggcaggtgcagcaggaggctgagagaagaggcgcagagcaagaggcaggccttagactggccaaattaacagacctgttgcagcaggaagaacagggacgcgaagtggcttgcggcgccttgcagaaaaaccaagaagattctagccggcgggtcgacttagaggtggcaagaatgcaagcgcaggtgacaaaattaggagaggaagtttctcttaggttcttgaagcgggaagcaaaactgtgcggcttcttacagaagagttttctggcactcgagaaacggatgaaggcaagtgaaagcagccgcttaaagctggaggggtccctgcgaggggaactggagagccgttgggagaagttaagaggactgatggaagagaggcttcgtgccttgcaaggtcagcatgaggtaggaccagggggcaggagagcagaagaaagccacctgctcgaacagtgtcagggactggacgccgccgtggcccagcttaccaagttcgttcagcagaatcaggcatcactaaatcgagtgctgctcgctgaggaaaaggcttgggacgccaaaggccggctggaagaaagccgagccggtgaactggccgcctacgtccaggagaatctggaggccgcacagttggctggagaactcgccagacaggaaatgcacggggagctggtcctactgcgcgagaagagtcgggccctggaggctagcgtcgcccagctggcaggtcaattgaaagagctgtctgggcatctgccggcattaagctccagattagatcttcaggagcagatgctcggcttacggctgagcgaggctaagaccgagtgggagggagccgagaggaaaagtctggaagacttggccaggtggcggaaagaagttaccgagcacctaaggggagtgagagaaaaggtggacggtctgccccagcagatcgaatcagtgagcgataaatgcttactgcacaagtccgattcggacctgcgtataagcgctgagggcaaggctcgtgagttcaaagtaggagcgctgcgtcaggagctggcgaccctgctgtctagcgtgcagctgctgaaagaagataatcccggcaggaaaattgccgagatgcagggaaaactggccaccaatcagattatgaagttggagaactgcgtgcaggctaacaagaccatccaaaatttacggtttaacactgaggccagacttcgtacacaagaaatggcaactctctgggagagcgttctgaggctttggtccgaagaaggtccaaggactcccctgggttcctggaaggcactgcccagcctcgtgcgtccgagggtgtttattaaggacatggccccgggtaaagtggtgccaatgaattgctggggcgtgtaccaagccgtcaggtggctgaggtggaaggcttcattgataaaactgagggccctacggaggcccggcggagtactggagaaaccacattcacaggaacaggtacagcaacttaccccttcgttatttatccagaagtag

SEQ ID NO: 46307 - DNA, 1569 bp, Artificial Sequence
  Description of Artificial Sequence: Synthetic coding sequence
atgcaggccctggacaagcggctggtggaggtgcgggaggccctgactaggctcaggaggcggcaagtgcaacaggaagccgaaagaaggggagccgagcaggaggctggactgaggctggcaaaactgacagatctcctgcagcaggaagagcaaggtcgggaggtggcatgcggcgccttgcagaaaaatcaggaagactcctccagaagagtcgatttggaagttgctcggatgcaggcgcaggtgactaagttaggcgaggaagtgagtcttaggtttctcaagagggaagccaaattgtgcggatttctacagaagtcattcctggctctcgaaaaacggatgaaggcctccgagagctcacgtctgaagcttgagggctcactgcggggcgagctggagtctcggtgggagaagctccggggccttatggaggagcgtcttcgcgctttgcagggccagcatgaagagagccacctgttagagcagtgtcagggcttagacgccgccgtcgctcagctgacaaaattcgtccaacagaatcaggcttctctgaatcgagtcctccttgccgaagaaaaagcttgggatgccaagggcagattggaggagtccagggcaggtgagctggcagcatacgtgcaggagaacctggaagccgcccagctagccggtgagcttgcgcggcaggagatgcatggcgaactggtgttgcttcgagaaaaatcacgtgccctcgaggcttcagtagcacagcttgcaggccagctgaaggagctgagtgggcacctgcctgccctgagttcacggctcgacttgcaggagcagatgctcggactgcggctgtctgaagctaaaaccgagtgggaaggggctgagagaaaatctctggaggacttggcccggtggaggaaggaggttacagaacacctgagaggagttagagagaaggtggacggcctcccacagcagatcgaatcagtgtccgacaagtgtctgttgcacaaaagcgactctgacctgcgtatcagtgccgaagggaaggccagagagttcaaggtgggggctctaaggcaggaattagctacacttttgtcctccgtgcagctgctcaaagaagataaccccggtagaaaaatcgcagaaatgcagggaaaactggccacttttcaaaatcagatcatgaagcttgaaaattgtgtacaggccaataagacaatccaaaacttacggttcaacacggaggcacgccttcgcactcaggagatggctacattgtgggagagcgtcttacggttatggagtgaagagggcccccggacaccgttgggtagttggaaagctctaccctctctcgtgaggccgagagtttttataaaagacatggcacccgggaaggtggttcccatgaactgctggggggtctatcaagctgtgaggtggctgaggtggaaagcatcgttgatcaagctgagagccctgcggagacctggcggcgtgctcgaaaaaccccatagccaggagcaggtgcagcagttgaccccatctctgtttattcagaaatag

SEQ ID NO: 46308 - DNA, 2259 bp, Artificial Sequence
  Description of Artificial Sequence: Synthetic coding sequence
atggcccacctgctgggcagccaggcctgcatggagagcctgcggaccgatctaacagatctgcagggggctatagtcgacgttttctcaagagctggccctgtgcgctttccctcttggaaattccccgacaggatggcgtgcgacctggatatggttgcactgctggaacactacgatcacgtccctggcgatcccgagttcactcagctgtcacatgctgtgctcctggaactcgtcatcgaccgactattgttgttactgcagtcctgcatgagctatctggagaacctgggttccgagcagatgatgcctcccgctcaagctgccggcccttgcatgtccgtaggactgaccgtgcgcagattctgggactccctgctgagattaggtacgcttcatcagcagccattgcctcagaaaggcgcaaaccaaagggagacccctacatctaaacccacgacaaaaggtgagcccgccagaagtccagagtatttgactacgaagttgattaaaccatcttcccctgtgctggggttgcctcagacctgccaggaaccagagagcatacccgtgagggctagcctgcagttccccgcgacaacatttaagaatacccgctcagtccactctcagacaattgaaaccgctcttgtgccatgcgacgcctgtgcatccgttcagggcagccttcagaaggtggggaaggtcgttatctctttgtgtcaatctcagaatcttccctcatccttggggcagtttcagcagctggtgcaagacagcatgggcctgcgccccttgccggctgccacagttggccggtgggccgcggagcagcgcaaggatctaacccgcctgtcgaaacacgttgaggccctgagagcccagcttgaagaagccgagggacagaaggacgggctacgcaagcaagctggtaagcttgagcaagcactgaagcaagaacaaggggcacggcggcggcaagctgaagaagatgaacagtgtttgtcagagtgggagcacgacaaacagcagcttcttacagagacgagcgatctcaaaactaagatggccactctggaaagagagctgaaacagcagcgcgagtcaacccaggccgtcgaggcgaaggcgcagcagctgcaggaggagggagagagacgggccgcagctgaacgacaggttcagcagttggaagaacaggttcaacagcttgaagctcaggtccagttactggtgggaaggttggagggcgccgggcagcaggtctgctgggccagtaccgaactggataaagagaaggccagagttgactccatggtgaggcatcaagagagtctgcaggccaagcaaagggctctgctgaagcagctggacagcttggaccaagaacgcgaagagttacgagggagcctggatgaggccgaagcgcagcgtgctagagttgaggagcagcttcagtctgagagagaacagggtcagtgccaacttcgagcccagcaagaactgcttcagtccctgcagagagagaaacagggcctcgagcaagctaccacggacttgaggttgaccattctggaactcgagcgcgagctggaggaacttaaggaacgggaacggctcctggttgcatttcccgacttgcaccgccccacagagacccaaatccacggggggagatcttcatccgtggagtcacagatcacttgccctacggactccggtaacgtgacagatcacatggaacgtcaggtgcagagcaacgacatcagaatcagggtactccaggaagagaacgggagactccagagcatgctgtctaagattagggaggtcgcacagcagggtggtcttaaactcattccacaggaccgcttatggtctccatctagcaaggggacacaaggcgccacgcctcctgtgcaggccaagagcacaagcccaggaccattgggtagacaacatctgccatcgtctcgaaccggaagaactctgcttggccaaccatgtacctcgccaccccggcagccttgtacgagtccaccaaggcagccctgcacttcccctccccgacagccctgtacgtctccatcgagacagccctgcagtcagccatccaagtctctgttggaaggtgttacccacctcgacacctgtactcagaacccaatcaaggtgcttgtgaggttgaggaagcgtctgagtccaggtcgaggccaagcctcctccgctcaccagcctcaagaacggcccatgtag

SEQ ID NO: 46309 - DNA, 2259 bp, Artificial Sequence
  Description of Artificial Sequence: Synthetic coding sequence
atggcccacctgctgggcagccaggcctgcatggagagcctgcggactgaccttactgacctgcagggcgctatcgtcgatgtatttagtcgggctggcccagtgcgtttccccagctggaagttccctgaccgaatggcctgcgacctcgatatggtggcactgcttgaacactatgatcatgttcctggcgacccggagtttacacagttgagccatgcagtcctgctggagcttgtaattgatcggctcctccttctcttacagagctgcatgtcatacctggagaatcttggctctgaacaaatgatgccacctgcccaggctgcaggcccttgcatgagcgttgggctgacagtaaggaggttttgggattcccttttgcggctcggaacactgcaccagcaacccctgccacagaaaggggcgaatcaacgcgagacccccacaagcaaaccaaccactaagggcgagcctgctaggtccccagagtatttaacaacgaaactgataaagccttcctcgccagtcctggggctgcctcagacttgtcaggagccagaaagcattcctgtgcgcgcctcactacaattccctgccactacatttaagaacacccgaagcgtgcactcccagaccattgaaactgcactcgttccgtgtgatgcttgcgctagtgtgcaaggatccctacagaaagtgggaaaggtggtcatcagtctgtgtcagtcccagaatctcccatcttctctcggtcagtttcaacaactcgtgcaggactccatggggcttcgccccttacccgcagccacggtgggcagatgggccgctgagcagcgtaaggacctgacacggctgagcaagcatgtcgaagccttaagggctcagttagaagaggctgaagggcagaaagacgggctgcgtaagcaagctggcaagctcgagcaagccctgaagcaggaacaaggcgccaggaggcgacaggccgaagaagatgaacagtgcctctctgaatgggaacacgacaagcaacaactgttaaccgagacgtccgacttgaagacaaaaatggctaccctggagagagaactgaaacaacagcgggaatcaacacaggctgttgaagcaaaagcacagcagcttcaggaagagggcgaaaggagagcagccgcggagcggcaggttcagcagctggaggaacaagtccagcagctggaggcccaagttcaattgttagtgggacggctggagggagccggccaacaggtatgctgggctagcacagagttggataaggaaaaggcccgggtggatagtatggtgagacaccaggagtctctgcaggctaagcaaagggccttattgaagcagttagattcgctggaccaggagcgggaggagttgcgagggagcctagatgaagctgaggcgcagagggccagagtcgaagagcagttgcaatccgagagggagcagggccagtgtcagttgcgcgcccagcaggaactgctgcagtctcttcagcgcgaaaagcaggggctggagcaggctactaccgatcttcggttgaccatactggaattggagagagaactggaggagctgaaagagcgtgaacggctgctcgtggccttcccagacttgcaccggccgaccgaaacgcagatacacgggggtcgaagctcttcagtcgaatcccagatcacttgcccaaccgacagcgggaatgttaccgatcacatggaaagacaggtccagtcaaatgatatcaggatacgggtgttgcaggaggagaatggtcggctacaatcgatgttatcaaaaatcagggaggtcgcccagcagggtgggttaaagctcatcccccaagaccggctgtggtccccgagcagcaagggcacacaaggcgccactccccccgtacaggccaaatcaaccagcccaggccctctgggaaggcagcacctgccatcctcccgaacaggcaggacccttctgggccagccctgcacctccccaccacgacaaccctgtactagccctccacgccagccttgtacgagccctccccgacagccatgcacaagcccttctagacagccgtgcagccaaccatccaagtcactgctggagggagttacccatttggacacgtgcacccagaatcctatcaaagtcctcgtgagacttcggaagcgtctctctcccggccgcggtcaagcttccagcgcccaccagccccaggagcgcccaatgtag

SEQ ID NO: 46310 - DNA, 1602 bp, Artificial Sequence
  Description of Artificial Sequence: Synthetic coding sequence
atggagagcaaggcctgggagagcaacaacgaggacctgctgagctcctccggggtcacaagcaacgggggatcctccagttcgttctttgtaagctccatccggggcaccattatcgagaacaccagttccgccgggactctgacgcaggtgccattctttcccaagtacgaagtggagctggacagtcctcgcaagattattccgtcacctgggaaagagcactttgagcgagtactggaggaatattcgcatcaggtcaaggatctgcagcgtcggctgaatgaatctaacgagttacatgaaaaacagaaattctatctgcggcagagcgtgattgatctccagacaaaattacaagagatgcaaatggagagagatgctatggcagacatcaggcgcagagagtcccaaagccaagaggatctgcgcaaccagctgcagaatacggtgcacgagctggaggccgccaagtgcctgaaagaggatatgctcaaggattcaaacacacagatcgagcagctgcgtaagatgatgcttagccatgaaggtgtgctccaggaaattaggtctatcttggttgatttcgaggaggcctctggcaaaaaaatctgcgaacatgatagcatgtcaacactgcatttcaggtctcttggctcggctatctctaagatcctgcgcgagctggatactgaaatatcttacctcaagggtcggattttccctgtggaggaccaactggaagccctgaaaagcgaaagtcagaacaaaattgaactgttgcttcagcagcaccaagacagaatagagcagctcatatccgagcacgaagtggagattacaggcctgaccgagaaggcttcctctgccaggagccaagccaacagcattcagtcacagatggaaatcatccaggaacaggcgagaaatcagaattccatgtacatgaggcaattatctgacttagaaagcacggtgagtcagctcagatctgaattgcgggaggcaaaacggatgtacgaagacaagacagaggagctggagaagcagctggtgctggcaaactctgagctgactgaggcccgaacagagagagatcagtcttcactgcggagcgacatgtgtcaccgcagtaacaattccctgagagattcaaccgagggttctaaaagttcagagacattgagcagagagcctgtaacactgcatgccggcgatagagaggaccctagcggttgcttcacctttacgtccgccgcttctcccagcgtcaagaactctgcttctaggagctttaactctagcccaaaaaagagcccagtgcacagcttgttgacaagctcggtggaggggtccatcggaagcaccagtcagtatcgttccgccaaaccaatccattcgagtgatagcgtgaaagactctcagtccccgcctatcgagacaaccggcaagacatgtcgaaagctacaaaaccgcctggaaagtcttcagactctcgtggaagatctgcagctcaagaaccaggccatgagtagtatgatcaggaaccaagaaaaaaggattcagaaggtgaaggatcaagaaaagatgctgctgaagtag

SEQ ID NO: 46311 - DNA, 3342 bp, Artificial Sequence
  Description of Artificial Sequence: Synthetic coding sequence
atggagagcaaggcctgggagagcaacaacgaggacctgctgagctcctctggggttacctccaatggtggaagctcaagctcattctttgtgtcgagcattcgggggactattatcgagaatactagcagtgcaggcaccctgacgcaagtacccttcttcccgaagtacgaagttgaactcgacagtcccaggaagatcattccatcacctggcaaggagcatttcgaacgcgtgctggaagagtatagccaccaggtcaaagacctccagagacgtctcaatgagtctaacgagctccacgagaagcaaaagttctacttgaggcagtccgtgatagacctgcagactaaactgcaggagatgcagatggagagggacgctatggccgatatcagaaggcgcgagtcgcagagccaagaagacttgcgcaatcaacttcagaacacagttcatgagctcgaggcggctaaatgcctgaaggaggacatgcttaaggactctaacacccagatcgaacagttgcggaaaatgatgctgagtcacgagggcgtgctccaggagattcgctcaatcctggtcgacttcgaggaagcaagtggtaagaaaatttgtgagcatgacagcatgtcaactctccatttcaggagtctcggcagcgcaatctctaagatactgcgggagctggacacagaaattagttacctaaaagggaggatcttccccgtggaagaccagctggaggccctcaagtcagagtctcagaataagattgagctgctcctgcagcagcaccaggatagaatcgagcaattgatctccgagcacgaagtcgagatcaccggactgacagagaaggcttccagcgcacgatctcaggcaaactccatccaatcacaaatggaaataatccaggaacaggccaggaaccagaatagtatgtacatgcggcagctttctgatctggagagcactgtatctcagctcagatcagagctacgggaggcaaagagaatgtatgaggacaaaaccgaagaactcgagaaacagctcgtcttagcaaattcagaactgaccgaagcccgaacagagcgcgaccagttttcacaggagtcgggaaatcttgatgaccagttacagaagctgcttgccgacttgcataagcgcgagaaggagcttagccttgaaaaagaacagaacaaacgactgtgggatcgcgataccgggaattctatcacaattgaccacctccggagagagctggacaacaggaatatggaggtgcagagacttgaggctttgcttaaagccctcaagtcagaatgtcaggggcagatggaaaggcagatggctgcaattcaggggaaaaacgagtctctcgaaaaggtgagcagcttgacggcacagttggagtccacaaaggaaatgctgaggaaggtggttgaggaattaacagccaaaaagatgacactggagagctccgagcgcaccattagcgatctgacaaccagcctgcaggagaaggagcgcgccatcgaggccactaatgccgaaattactaagcttcgctccagagtggatcttaagctgcaggagctgcagcatctgaagaatgaaggcgatcatctcaggaatgtgcaaaccgaatgcgaggctttaaagctccagatgactgagaaggacaaggtgatcgaaatcctccgtcagcagattgagaatatgacgcaactcgttggccagcacggtcgcacggccggggctatgcaagtggagaaggcccagttggagaaggaaatcaatgaccggcggatggaactaaaggagctcaagatcctaaaggacaagaaagatgcaaagatccgcgagctcgaggcgagagtgagtgacctggaactggagaaggtcaagctagtgaacgctggaagtgagcggttacgggccgttaaagatattaaacaggaaagagatcaactcttgaatgaagtgaagacctctagatctgaactgaataatctaagcgaggaatacgaggtgctcaaacgcaactttcgaaacaagtcagaggaaatggagatgaccactaacaaactcaagatgcagctcaaatcagcgcagtcggagttggagcagactaggaacacactgaagagtatggaaggatcagatggccacgcgatgaaagtggccatgggcatgcaaaaacagatcacggctaaacggggacagatcgacgctctgcagagcaagattcaatttctggaggaagcaatgactaatgccaataaggaaaaacactttctgaaagaagagaagagcaaactatctcaagagctgtccacggtagcaactgaaaaaaacaaaatggccggcgaactagaggttctgagaagccaggagagacggctgaaagaaaaggtaactaatatggaagtcgcactcgacaaggcgtccctccagttcgctgagtgtcaagacattatccagagacaggagcaggaaagcgtacggctcaagctgcagcacaccctagatattaaggagctgcagggacccggttatacttcaaactcttctctgaagcctcggctgctgcagcccgcgtctgttacgcgatcgcacagtaatgtgcccagttcgcaatctacagcttcctttttatcacatcattcaactaaagccaacaccctgaaggaggacccgacccgagatcttaaacagcttctccaggagcttcgctctgtgatcaacgaggaaccagcagtgtcgctctctaaaaccgaggaggacggccgcacgagcctgggagcactagaagaccgtgtccgggattgtattacggagtcctcccttcgttccgacatgtgccacagaagcaacaatagtctgcgcgacagcaccgaaggttctaagagcagtgagaccttgtctcgcgagccagttacacttcacgcaggagacagggaggatcccagtggatgcttcacattcaccagtgctgcaagtccaagtgtgaaaaattctgccagtcggagctttaattcttcccccaagaaatcaccagtgcactcactcctcacatcaagtgtggagggctccatcggatcgacctcgcagtatcggtccgcaaagcccatccatagtagcgattcagtgaaagattctcagagcccaccaatcgaaactacgggtaagacctgtcgaaaactgcagaaccgccttgaatccctgcaaaccctggtagaggacctgcaattaaaaaaccaagcaatgagtagcatgattcggaatcaggaaaaaagaatccagaaagtcaaggaccaagagaagatgttgctgaagtag

SEQ ID NO: 46312 - DNA, 1239 bp, Artificial Sequence
  Description of Artificial Sequence: Synthetic coding sequence
atgctgctgcccgccagcgaccccctgctggccggcctgccccgggatccggactattctgtttcatgtctgtacagccctccttcacctagcagtatgtgtcttccggccaacatgaagtgtgataaatactgggggtcctcctccgataaggctctggagcgcacagcccactggtccaggactcctgagcccgagacactgggctgtccggcaagcggagacactgtacggaccgcagattgccgacccggctggggtagtggaccaagtccacacgaagcagcacctagcccttcccccgatcttcagaaacagtgttgcaatgatcaggacattttaaagcggcaccataacgtggccaaaaaacctctggaaacctctagctctaaagtcaaggctaaaaccatagtgatgatccccgactctcagaagcttctgcgctgcgaactcgaaagcctgaaatcccagcttcaggctcagaccaaggcctttgaatttttaaatcacagtgtgacaatgctggaaaaagaatcatgcttgcagcagatcaaaatccaacaactggaagaagtgctgagccccacaggccggcagggggagaaggaagaacacaagtggggtatggaacaaggcaggcaggagctttacggagcactcacccaggggctgcaggggctagaaaagactctgcgcgactccgaagaaatgcagagggcaaggactacgcgctgcctccaactgctcgcccaggaaattcgcgactcaaagaagttcttgtgggaagaactggagctggtacgcgaagaggtcacgtttatttaccagaagctgcaggcccaagaagacgaaatatccgaaaatttggtcaatatccagaagatgcagaagacacaggtgaagtgtcgtaaaatcctcacaaagatgaagcaacaggggcacgaaaccgccgcctgtcctgaaactgaggaaattccacagggggcttctgggtgctggaaagatgatttgcaaaaggaattgagcgatatctggtctgccgttcacgtgttgcagaatagtattgacagcctgacgctatgctccggggcttgccccaaggctagcagcctcagaggacacaagggacaccagtgcttgtctcccccgttaccttcttgggattccgacagcgattgtgatcaagatctctcccagcctcccttttcaaaatccggaaggtcttttcctcccggctag

SEQ ID NO: 46313 - DNA, 894 bp, Artificial Sequence
  Description of Artificial Sequence: Synthetic coding sequence
atgggcgagcacgagcaggtgaagcccctggagaccagcagcagcaaagtgaaggccaaaaccatcgtgatgatcccggactcccagaagctcttgaggtgcgaactggagtcactcaagtctcagttgcaagcgcagaccaaggcttttgagttcttgaaccatagtgtgacaatgctggagaaagaatcctgtctgcagcagatcaagattcagcagctcgaggaggttttgagccccacaggacgccagggtgaaaaggaagagcataagtgggggatggagcaaggaagacaggaactgtatggagcccttacccagggtctgcagggactggagaagaccctgagggattcggaagaaatgcagagagcaaggaccacacggtgtctgcagctcctagcccaggaaatcagagattctaagaagttcctgtgggaggaactggaattagtgcgggaggaggtgacctttatctaccaaaagcttcaggcccaagaggacgaaattagcgaaaatcttgtgaatatacagaagatgcaaaagactcaggtaaaatgtcggaaaattctcaccaaaatgaagcagcagggccatgaaactgcagcctgccccgaaacagaagagatcccccagggcgcaagcggttgctggaaggatgaccttcaaaaggagctatcggacatatggtcagcagtgcatgttctccaaaatagtatcgatagtctgacactctgctcaggggcgtgcccgaaggcatcgagtctgcggggtcataagggtcatcagtgcctcagcccccccctgccatcttgggattccgattccgattgcgatcaggatctcagccaaccccctttttctaagtccggaagaagctttccacccgcctag

SEQ ID NO: 46314 - DNA, 894 bp, Artificial Sequence
  Description of Artificial Sequence: Synthetic coding sequence
atgggcgagcacgagcaggtgaagcccctggagaccagcagcagcaaagtgaaggcgaagacgattgtaatgattcctgacagccagaagctcttgcgttgcgagctggaatctttaaagagtcagctacaagctcaaactaaggcattcgagtttcttaaccatagtgtgaccatgctggagaaggagtcttgcctgcagcagatcaagatacagcagcttgaggaagtcctgtccccaactgggcgccaaggggaaaaagaggaacacaagtggggaatggaacaggggcgtcaggaactgtatggcgcgctgactcagggactgcaaggactagagaagacgcttcgagacagtgaggagatgcaacgtgcccgaaccaccagatgcctacagttgcttgcacaggagattagagacagcaagaaattcttgtgggaggagcttgaactcgtaagagaggaagtgaccttcatctaccagaagctccaggcacaagaagacgagatctctgagaacctggttaacattcagaagatgcagaaaactcaggttaagtgtcggaaaatactcaccaagatgaaacagcagggccatgaaacagccgcatgccccgaaacagaggaaatccctcagggcgcatccgggtgttggaaggatgacctgcagaaggagttgtctgacatttggtccgcagtgcacgtgctgcagaactccatcgacagtctcacactgtgctccggagcatgtccaaaggcgagtagtctgagaggccacaaaggccaccagtgcctgtcacctccccttccgtcatgggactccgacagcgactgcgaccaggatctgagccaacctccattctcaaagtcaggacgctcatttccccccgcttag

SEQ ID NO: 46315 - DNA, 978 bp, Artificial Sequence
  Description of Artificial Sequence: Synthetic coding sequence
atggacgcccggcggaagcactggaaggagaacatgttcaccccctttttcagtgctcaggacgttctggaggaaacctcagagcccgaatccagtagcgaacagactaccgccgattctagcaagggcatggaagagatatacaatctatctagcagaaaattccaagaagaatccaagttcaaacgtaagaaatatatttttcagctgaacgagatcgagcaggagcagaacctgagagaaaataagagaaacatcagcaagaacgaaacagatacaaatagcgccagttacgagtctagtaacgtggacgtcacaactgaggaatctttcaactctactgaggataactcgacatgttcaactgacaacctgcctgctctgctcagacaggacatccggaaaaaatttatggagcgaatgagcccgaagctatgcctcaatctcctaaacgaggaactggaagaacttaatatgaaatataggaagattgaggaagagtttgaaaacgcagagaaggagctcttacactacaaaaaggagatttttactaagcccctgaacttccaggaaactgaaactgacgcatctaagtccgattatgagctgcaggctctgaggaatgacttatccgagaaggccacaaatgtgaagaacctgtccgagcagctgcaacaggcaaaagaagtcatacataagttgaatttggaaaatcgaaatcttaaagaggccgtgaggaagctgaagcaccagacagaagttgggaacgtcctgttgaaagaggaaatgaagagctattacgaactcgagatggctaagatacgcggcgagctgagtgtgattaagaacgaattgagaaccgagaaaactctccaagccagaaacaatcgggcactcgagttgttaaggaagtattatgcctcttctatggtaacctctagctccatacttgatcattttacgggtgatttcttctag

SEQ ID NO: 46316 - DNA, 978 bp, Artificial Sequence
  Description of Artificial Sequence: Synthetic coding sequence
atggacgcccggcggaagcactggaaggagaacatgttcacccccttcttctctgcacaggacgttctcgaggaaacaagtgagccagagtcttctagtgaacagactaccgccgactcaagtaaaggaatggaggaaatttataatctgagcagccgcaaatttcaagaggagtctaagttcaaacgtaaaaaatacatttttcagctgaacgagattgagcaggaacagaatttaagggaaaataagagaaatatttctaagaacgagactgacaccaactcagctagctacgagagttcaaatgtggatgtaacaactgaggaaagttttaattccacagaagacaattccacctgcagtactgataacctgcctgccttgctacgacaggacatcagaaaaaagttcatggagcgcatgagtcctaaactgtgccttaacttgttgaacgaggaattggaggagctgaacatgaaatatcgaaagatagaggaagagttcgaaaacgccgagaaagagttgttgcattataagaaggagatcttcactaagccactgaatttccaagaaaccgagactgacgcctccaaaagcgactatgaactccaagccctaaggaacgatttgtctgagaaagccactaacgtcaaaaatttgtctgagcagctgcaacaggctaaggaggttatccacaagcttaacctggagaaccgcaatctcaaagaagctgtccgcaagctgaaacatcaaaccgaggtcggcaatgtgttgctcaaagaagaaatgaagtcttattatgagctggaaatggctaagatcagaggtgagttaagcgtaattaagaatgagctgagaacggagaagacgttacaggctagaaataatcgcgcgttggaattattacggaaatactacgcgagctcaatggttacctcttctagcatcttagatcattttaccggtgattttttttag

SEQ ID NO: 46317 - DNA, 2223 bp, Artificial Sequence
  Description of Artificial Sequence: Synthetic coding sequence
atgaacccccccggcagcctggaggccctggaccccaacgtggacgaacatctcagcacacaaattttagctcctagtgtccactcggataacagccaggagaggattcaggctcggaggcttcgcatcgctgcccgtctggaagccagacggagagaagctttgggtgagtacttggacggtaagaaggagtcagaagaggaccaatcaaagagctacaagcagaaagaagagtcacgactgaaactagccaaactgctgctttgtgggaccgaattagttactaacattcaggtcgcgatcgacataagagagatccataggagggtggaagaagaggaaatcaagcggcagagaattgagaagctggagaacgaagtgaagacttctcaagacaagtttgacgagataaccagtaaatgggaggagggcaagcagaaacgtatacctcaggaactgtgggagatgttgaatacccagcagctgcactgtgctggcttactcgaagacaagaataagttgatcagcgaattacagcaagagctcaaaactaaggacgatcagtacgtgaaagatctgaagaagcagagcgatgacatttgtctgctcctggagcgcatggaggagcaggtgaagaatgtgatgaagacattccgggaagaactgtacaacattgaaaaagccttcgaggtagagaggcaagagctccttgcgtccaacaagaaaaaatgggaacaggctctgcaggctcacaacgccaaagaactggaataccttaataatcgaatgaaaaaggtcgaagactatgagaaacaactgaatcgccagaggatatgggactgcgaagaatataatatgataaagatcaaactggagcaggatgtacagatcctggaacaacagcttcagcagcgaaaagccatctaccagctgaaccaggagaaacttgagtacaatctgcaggtcttgaagaaaagggacgaggaatcaactgttattaagtcacaacagaaacggaagatcaatagactgcatgacatccttaataatcttagatctaagtatgcaaagcaaataaaacagtttcaggaggaaaaccagagcttgaccagtgattataagcggctggtcatgcagtttaaggagttacagaaagccatgagacatttcgccctgatcgacgacgagaaattttgggagatatggctgatgaatgaggaggaggccaaagatcttatcgcccgggctttcgatgtcgaccgtatcattcatacccatcatctcggccttccttgggccgccccagacttttggtttctgaataacgttggaccaatttctcagcagccacagaagagtgccacccagatagttgaagaaatgcttatgcggagcgaagaggaggaagcagaggaagcggcagctgagccggaatcatatcttgacttgccaaagcaaattagcgagaagacaacaaagcgcatactgatgctactctgtgatgaaagcggctttctgattgaatccaaactgctgagtctcctattgcccctcgagcagaatgagtgttacctcctacgactggacgccatatttagcgcgcttggaatcgagtcagaggatgatctgtataaactagtaaacttctttctaaaatacagagcacaccgtctgagttccagcctccagatcaagccctgttcacaagcctctatggaaaaggcatctatggaagagactagtacacggtctgagctggagttggccgaacagactgaaatggagggcgagaaggaagagtctctcgtggaaggggagaaggaagaagaggaagagactcctccttcaccgtgggttattcaccccaacgatgtcctgaagattctggaagcatttgtgatggggctgaaaaagccccgagatagtcgtgctcctctacgggtacagaaaaacgtgcgagataatagcaaggattctgaatattggcaggccctgacaaccgtgatcccaagtagtaagcaaaatctctgggacgctctgtatactgctctcgaaaagtaccatctagttctgactcagagggctaagctgctgctggagaactccagtctagaacagcagaataccgaacttcaggcattgcttcagcagtatctaaattccaaaataaacagcgagcttcaggtgccccctacacaggtcctgcgggtaccaactaagtag

SEQ ID NO: 46318 - DNA, 522 bp, Artificial Sequence
  Description of Artificial Sequence: Synthetic coding sequence
atgggcagccacagccccagccacttcctggtgcacggctggatcctctctatgatgttccccgaggaggaagaagcggaggaagccgcagccgaacctgagtcctatctggacctgcccaaacagatctctgagaaaacaacgaagagaatccttatgctgctgtgcgatgaatcaggctttctgatcgaatcaaagctactctctctgctgctgcctttagagcagaatgaatgctacctcctgcgtcttgacgctattttttcggcactgggaattgaaagcgaggatgatctgtacaaacttgtaaacttctttcttaagtacagagcccatcgtctttcttccagcttacagatcaaaccttgttcgcaagcctctatggaaaaagcctccatggaagagacttctaccagatccgagcttgaactggctgagcagacagagatggagggcgagaaggaagaatccctggttgagggggagaaggaggaggaagaagaaactcctccatctccatag

SEQ ID NO: 46319 - DNA, 2931 bp, Artificial Sequence
  Description of Artificial Sequence: Synthetic coding sequence
atgcacagcctggccctgcagaacaccctgcacgagcggacctggagtgacgagaagaatctcatgcaacaggaattgagaagcctaaagcaaaatatcttcttgttctacgtgaagctgcggtggctgctcaagcactggcggcagggcaagcagatggaagaggaaggcgaggagttcaccgaaggcgagcaccccgagacgctgtctagacttggtgaactgggagtgcagggcggacaccaagcagacgggcccgatcatgatagcgaccggggttgtggctttcccgttggcgaacatagcccccatagtagggtgcagatcggggaccattctttgaggctacagaccgctgataggggccagccacacaagcaagtagtggagaaccagcaactgttttcagcattcaaagctctgcttgaagattttagagccgaactgcgcgaagatgaacgggctaggcttagactgcaacagcagtacgcctctgacaaggcagcctgggacgtggagtgggctgtcctgaagtgtcggcttgagcagaactgctgtggatatccacgaatcaatattgaagaagaaacccttggctttactagattgccggcagggtccaccgttaaaacactgaaaagcctaggcctgcagaggctcgaactggaagaaaaaaccgaaaataagctaggtgagctcggctcatctgccgaaagtaaaggagccttaaaaaaagagcgcgaggtgcatcaaaaactgctcgccgattcacactccctagtgatggacctgcgctggcaaatacatcattcggaaaagaactggaatagggagaaagtggagctgcttgacagactcgacagggatcgtcaggagtgggaaaggcagaaaaaggagtttctttggcggatcgaacagggcagcttacgaatgccgagacctgtcgccatgtggccctgcgcggacgccgactcaatccctttcgaagacagacctctgtcaaaactgaaggagagcgataggtgttctgctagcgaaaacctttatctggacgcgcttagtcttgacgatgaacctgaggagccgcccgcgcataggcctgaaagggaattcagaaatagactgccggaggaagaagagaaccacaagggaaatttgcagcgagccgtcagcgtgtcgtcaatgagcgagttccagaggctgatggatatctctccctttctgccagaaaaggggctgccctccacttcttctaaggaagacgtcacaccgccactgagcccagacgatcttaagtacattgaagaattcaacaaaagctgggattacacacctaacagaggacacaacggaggcggccccgatctctgggctgaccggactgaagtcggacgcgccggacacgaagactccaccgaaccttttcccgactcttcctggtaccttacaacctccgtgacgatgaccacagatactatgacctcaccggagcattgtcaaaagcaacctctccggtctcacgtgttaactgagcagtccggactgcgcgttttgcatagcccccccgcagtccggcgcgtcgattcaattactgctgccggtggggagggaccattcccaaccagccgggcccgcgggagtccgggagacaccaaaggaggcccgcccgagcccatgctctcacgctggccttgtacctcgccacgccattcccgggattatgtggagggcgcccgccggcctctggatagccctttgtgcacatcccttggatttgcctctcctctgcacagtctggaaatgtctaaaaacctctcagacgacatgaaagaagttgcgttttccgtgcggaacgcaatctgcagcggacctggcgaattacaggtgaaggacatggcgtgtcaaacaaacggtagcaggactatggggactcagacggtacaaactatctctgtcgggctgcagacagaggcgctgcggggttctggggttacttcatccccacacaaatgtctgacaccaaaggccggcggaggggctacccctgttagtagcccatcacgctccttacgatcgcgacaagttgcgccggcaatcgagaaggtgcaggccaaatttgagcgaacttgttgctctccgaagtatgggtccccaaaattgcaaagaaaaccactccccaaagccgatcaaccaaacaataggacctctcccggaatggcgcagaaagggtactcagaatcagcctgggcacgatcaaccacaaccagagagtctcctgtgcatacaaccatcaatgacgggctgagttccctcttcaacatcatcgatcacagccccgttgtgcaggacccatttcagaagggtctgagagccggaagccgcagtcgttccgctgagcctcgccccgagctcggaccgggacaggaaactgggacgaactctcgaggcagatctccaagtcccatcggagtgggctctgaaatgtgtagagaggaaggcggagagggcactcctgtcaagcaggacctcagcgcgcccccgggttacaccttgactgagaacgtagcacgtatccttaataagaagctgctcgaacacgcactcaaagaagaaagacgccaggcggctcacggcccccctggtttgcactcagactcccacagcctgggggacaccgctgaacccggccctatggaagagctcccatgctccgccctggccccttccctggagccttgctttagccgcccagaaaggcccgcaaatcgccgtccgccatccagatgggcaccacatagcccaaccgcatcccagccgcagagtccaggggacccgacctcccttgaagaacacggaggggaagaaccgcctgaggaacaacctcatagagacgcctcacttcacggtctgagtcagtacaactctctctag

SEQ ID NO: 46320 - DNA, 4761 bp, Artificial Sequence
  Description of Artificial Sequence: Synthetic coding sequence
atggaggagatgcgggacagctacctggaggaggacgtgtaccagctgcaggagctgagacgcgagctggacagagcgaataagaactgtcggatcctgcagtatagactccgcaaggcggaacagaagagcctaaaggtcgcagaaacaggccaagtggatggggagctgatcaggagtctggagcaggacctcaaagtggcaaaggacgtgtccgtgagactacatcacgaactgaagactgtggaagaaaaaagggccaaggccgaagacgagaatgagacactccggcagcagatgattgaagtggaaatttccaagcaggccctccagaacgaactggagagactgaaagagagcagtctcaagcggagaagtacacgcgaaatgtacaaggagaagaagaccttcaaccaagacgacagtgccgatcttcggtgtcagttgcagttcgcaaaggaagaggcgttcctgatgcgcaaaaagatggcaaaattgggaagggaaaaagatgagcttgaacaggagctccagaaatataagtctttatatggcgacgtagatagccccctccctactggcgaggccgggggtcccccatccacgcgtgaagcagagctgaagctacggctgaaacttgttgaagaagaagcaaatattctcggtagaaagatcgtggaactggaggttgaaaataggggactgaaagcagagatggaagatatgcgagggcagcaggaacgggagggacccggccgtgaccacgcgccttctattcccacctcaccctttggcgacagcctcgaatcctcgacagagttacggaggcacctgcagtttgtggaggaagaggctgaactcctccgccgaagcatctctgagatcgaggaccataacagacagctgacacacgagttatccaagttcaagtttgagcctcctcgagagcctggctggctgggcgaaggagctagtcctggggcaggcgggggcgctccactccaggaggagctgaaatcagcccggctgcagatctccgaactgtcaggcaaggtcttgaagctgcagcatgagaatcacgctttgttaagcaatatccagcgctgcgatttggccgcacatctcgggctgagagcgccgtcacctcgagatagtgacgctgagagcgatgctggtaagaaagagtcagatggagaagagagtaggctaccccaacccaagcgagaggggccggtggggggcgaatctgacagcgaagagatgttcgagaagaccagtgggttcggctctggaaagccgtccgaggcgagtgagccatgccctacagagctgttgaaggccagagaggattcagaatatcttgtaaccctcaagcatgaggcccagaggctggagaggaccgtggagcgattaattactgacactgattccttccttcacgacgccgggctgcgcgggggagcacccctgccgggcccgggcttgcagggggaggaggaacagggtgaaggcgatcaacaggaacctcagctgctgggaactatcaatgccaaaatgaaggctttcaaaaaggagctgcaagccttcttggaacaggtcaataggattggcgacggactttcccccttaccacatttgaccgagagctcctctttccttagcactgtcaccagcgtgtcccgggactcacccatcggaaatctgggcaaggagctgggaccagacctccagtcacgcctaaaggagcagctggagtggcagctggggcccgccaggggcgacgagagggagagcctgcggctccgggcggctagggaactgcatcgaagggcggatggggataccgggagccatgggctaggcgggcagacttgctttagccttgagttgcggggaccaccggtgctgcccgagcagagcgtgtctatcgaagagcttcagggtcagctggtgcaagccgcacgtttgcatcaagaagagactgagacttttactaataaaattcacaagatggaggaagagcatctctacgcactcaggtggaaagaattggagatgcattcacttgcactgcagaacaccctccatgagcgcacatggtccgacgagaaaaaccttatgcaacaggaactaagatccttaaagcaaaatattttcttgttctatgtcaaactaagatggttattaaaacactggagacagggtaaacagatggaggaggaaggcgaagagttcacagaaggggagcaccctgagacactctcccgcctgggggaactgggagtccagggtggccaccaggctgatggaccagaccatgatagcgacagaggttgcggattccctgtaggggagcactcaccacatagccgcgtgcagattggtgaccactcgttgcgactacagactgccgacagaggccagccgcacaagcaggtagttgaaaaccaacagctcttttccgctttcaaggccctcctggaagactttcgcgcagagcttcgagaggatgaacgggctcggctacgcctccagcaacagtacgctagcgacaaggccgcctgggatgtggaatgggcagtgctgaagtgtagacttgaacaactagaagaaaagacggagaacaaactgggagaactcggtagctctgctgagagtaagggagccttgaaaaaggaacgggaggtgcatcagaaattgctggctgatagccacagtctggttatggacctgagatggcagatccaccattctgaaaaaaattggaacagggagaaggtcgaacttttggaccggttggatagggaccgccaggagtgggaacggcagaaaaaggagttcctttggcgcattgagcaactgcagaaagaaaatagtccacggcggggcgggtcctttctctgcgaccagaaggacggcaacgtgagaccttttcctcaccaggggtctctccgcatgccacgcccagtagcaatgtggccctgcgccgatgctgattctataccatttgaagaccgtccactcagcaagttaaaggagtcagaccgatgcagtgcgtcggaaaatctgtaccttgacgccctgtctctcgatgacgagcccgaagagcccccggcccacagacccgaaagggagtttcggaacaggttacccgaggaggaggagaaccataaaggtaatcttcagagagccgtgtctgtctccagcatgagtgagttccagaggttaatggacatatccccttttctgccggaaaaaggtttaccttcaacgagctctaaagaggacgtcacaccccccctcagcccggacgacttaaagtacatcgaggaatttaataagagttgggactacacacccaatagaggccataatggcggcgggcccgacctctgggcggatcgaaccgaggtgggacgagctggccacgaagatagtactgaaccttttcctgatagctcatggtatttgacaacaagcgtcactatgaccactgacacaatgacaagtcctgagcattgccagaaacagccactgaggagccatgtcctgactgaacagagtgggctgagagtgctgcattccccccctgccgtgaggagagtcgattcgattacggccgctggtggagagggaccatttcccaccagcagagcaagaggaagccccggcgacaccaaaggaggtccacctgaacccatgcttagcagatggccatgcacctcaccaagacattccagagattatgttgaaggggcccggaggcctctggactcccccctgtgtaccagtctgggattcgcttctcccctgcattctttagaaatgtctaaaaacttgtcagatgacatgaaggaggtggcattctctgttagaaatgctatctgctcgggaccaggcgaactgcaggtgaaagatatggcctgtcagacgaatgggtccaggaccatgggcacccagactgttcaaaccatatctgtaggactgcaaacagaagcactgaggggttccggcgtgacgagttcaccacacaagtgtctgacacctaaagctggaggaggtgccactcctgtgtcctcacccagccggtctctgcgcagcaggcaggtggctcctgccatagaaaaagttcaggccaagttcgagcgcacgtgctgctcaccaaagtatggctcaccgaaactccagcggaaacctttgcctaaagctgatcaacctaacaaccgcactagtcccggcatggcccaaaagggatatagtgagtctgcttgggctagatcaacaaccacccgtgagagcccagtgcatactactatcaacgatgggctgtcatccctttttaacattattgatcatagtccggtggtccaggacccattccagaaaggcctccgcgccggttcccgcagtcgttctgccgagccgcgccccgagctgggaccaggtcaagagacaggtacaaactcacgcggccgtagcccttcccccattggcgtgggtagcgaaatgtgcagggaggaagggggagagggcaccccggtaaaacaagacctgtccgcgcctccggggtacacgctaaccgagaatgtggcccgaatcttgaacaagaagctcttggagcacgcgttaaaggaggagcgacggcaggccgcgcatggtcctccaggactgcactcggactcacactctcttggggacactgccgagcccggacctatggagaatcagaccgttttactcactgccccatggggtctgtag

SEQ ID NO: 46321 - DNA, 4638 bp, Artificial Sequence
  Description of Artificial Sequence: Synthetic coding sequence
atggaggagatgcgggacagctacctggaggaggacgtgtaccagctccaagagctacgcagagagctggaccgtgccaataaaaattgtagaattctccaatataggctgcgcaaggcggagcagaagtcgctgaaagtggcggaaactggacaagtggatggcgaactgattcgctccctggagcaggacctgaaagttgcgaaagatgtgtccgttagactgcaccacgaactgaaaactgtcgaggaaaaacgggctaaggcagaggacgagaatgagactctgcgccaacagatgattgaggtagagatttcaaagcaagccttgcaaaacgagttggagaggctgaaggagagtagtctcaagaggcggtcaacaagagagatgtataaagaaaagaagaccttcaaccaggatgacagcgccgacctacgctgtcagctgcagttcgctaaggaagaggcctttcttatgcggaagaagatggcgaagctcggaagagaaaaggacgagctggagcaggaacttcagaagtataaatccctgtacggcgacgtagattctccactccccaccggtgaggccgggggccctccctctactcgcgaagccgagttgaagctgcggctgaagctcgttgaggaggaagctaacatcctggggcgcaagattgttgaactggaggtcgaaaaccgaggcctcaaagcggaaatggaggacatgcgcggtcagcaggagcgtgaagggccagggcgcgaccatgcccccagtatccccaccagtcccttcggggattccctggaaagctcaacagagctgagacggcacctgcagtttgtggaagaggaggcagagctcctgcgtcggtcaatttcagaaattgaggaccacaacaggcagctcacacatgagctttcaaaattcaaatttgaaccacctcgcgagcctgggtggctcggagagggagcttcacccggcgccgggggcggggcgcctcttcaggaggagctgaagtccgcccggctgcaaatctctgagctgagcgggaaggtgctgaagctgcagcatgagaatcacgcattgttgagcaacatccagcgatgtgatctcgccgctcacctgggcctgagggcgccttctcctcgggattcggacgcagaatccgatgcgggaaagaaggagtctgacggggaggaaagccgcctcccacaaccaaagcgggaaggcccagtcgggggagagtccgacagcgaggagatgtttgagaagacttctgggttcgggagcggaaagccatctgaagcaagcgagccatgtccgacggaattgctgaaggctcgggaagattccgaatacctggtgacattaaagcacgaagcccagagactcgagcgtaccgtggagcgtctgataactgataccgacagttttctgcatgacgccggcttacgtggcggggctcccctgccaggccccgggcttcagggcgaagaagagcagggtgaaggcgatcaacaggagccccagctgctgggaaccatcaatgccaagatgaaagcattcaagaaagaactgcaggcatttctggaacaagtaaatcggatcggcgatggactgtctccactgccgcacttaaccgaatcttcctcatttctgagcaccgtaaccagcgtgtcaagagactccccaatcgggaatctgggaaaggagctcggacccgatttgcaatctcgactgaaagaacaactggaatggcagctgggcccagcaagaggagatgagcgggagtcattgcgacttagggccgcccgggaattacaccggagagcggacggcgatacagggtcacacgggcttgggggacagacttgtttcagtttggaaatggaagaggaacatctttatgcgctacggtggaaagaactggaaatgcactcactcgccctccaaaacactctacatgaacgaacttggtctgatgaaaagaaccttatgcagcaagagctgcggtctctcaaacagaatatcttcttattctacgtgaaactcagatggctgttgaagcattggcgacaaggaaaacagatggaagaagaaggcgaggagttcactgaaggagagcatcctgaaactttgagcagacttggcgagctgggggttcaagggggccatcaggctgacggaccggatcatgactccgaccgcgggtgcggttttcctgtgggggaacactctcctcactcacgagtccagattggagaccattccctccgcctgcaaacggcggaccggggtcagccccacaagcaggtggtggaaaaccagcaactctttagcgctttcaaagctcttctggaagatttccgcgcagagctgcgggaagacgagcgggcccgtctacggttgcaacagcagtatgcttcagataaggctgcttgggacgtggagtgggccgtgttgaaatgtaggttggaacagctggaggaaaaaactgaaaacaagctgggcgaacttggatcctccgcagaaagcaaaggtgcactcaagaaagaacgggaagtccaccagaagcttctcgctgatagtcatagtcttgtcatggacctgcggtggcaaattcatcacagtgagaagaattggaatagagagaaggttgaattactggatagacttgatcgggatcgacaggaatgggaacgccagaaaaaagaattcctgtggcgtattgaacaactgcagaaggaaaactcaccaaggcgcggtgggtcctttctctgcgatcagaaagatggcaatgtgcggccctttccccatcaggggagtctgagaatgccacgccctgtggctatgtggccatgcgctgacgccgactccatcccctttgaggacagaccacttagtaagttaaaggaatccgatcgctgtagtgcctctgagaatctatacctagatgctctttctttggacgatgagcccgaggagcctcccgcccatcgtcctgagagagaattccgcaataggttaccagaagaagaagaaaaccacaaagggaatttgcagcgggctgtaagcgtgagttctatgtccgaatttcaaaggctcatggatatctccccgtttttgcctgagaaagggctgccctctactagctcaaaggaggatgtgacaccacccctcagcccagacgacttgaaatacatcgaggagttcaacaaatcttgggactacactcctaatcggggtcataatgggggcgggcccgacctgtgggcagatagaaccgaagtagggagagcaggacacgaggactcaactgagccattccccgactctagctggtatttgacgacgtccgtgactatgaccaccgacactatgacttcacctgaacactgtcagaagcagccacttaggtctcacgttcttacggaacagagcgggctgcgcgtgctgcattctcctcccgctgtaagaagggttgattccatcacggccgcaggtggggaagggccattcccgacctctcgggcccgagggtcacctggagatacaaagggaggaccacctgaaccgatgttgtcacgctggccttgcacatcacctagacactctagggattacgtggagggagcccggaggcctctggattccccactctgtacctccctcggtttcgcctcccctttacattcactggagatgagcaaaaatctgtctgacgatatgaaagaagtagccttcagcgtccgtaatgcaatttgcagcgggcccggagaactccaagtcaaagatatggcctgccagactaatgggagtcgcactatggggacccagaccgtgcagacgatttcagtagggctgcagaccgaggccttgcgcggatcaggtgtgacgtcatccccacacaaatgtctcacacctaaagctggggggggggcgactccagtttcgtctccatcccggtccctgcgaagtcgacaggttgccccggcaatagagaaggttcaagccaagtttgagaggacatgttgtagtcccaaatacggaagcccaaagctgcaaaggaaaccgctccccaaggccgaccaacctaataaccgaacatcaccggggatggcacagaaaggatatagcgaatccgcctgggctcgaagtaccaccacccgggaaagccccgtccatactaccatcaacgacggcctcagcagcttgttcaatattattgaccactcccctgtggtccaggacccttttcaaaagggcctgcgtgctggaagccggtcgcggagcgcggagcccagaccggagctggggcctgggcaggaaactggcacaaactcacgaggcaggtccccgagtcccataggcgttgggagtgagatgtgccgagaggaggggggcgaggggacccctgttaagcaagatctaagcgccccacctggttacactctcacagaaaacgtcgcccgaattttgaacaaaaagctactcgagcatgctctaaaggaggagcgccgtcaggcagcccacggcccccctggtctgcatagtgactcgcatagcctgggggacacggcagagcccggccccatggagaaccagaccgttctgctcaccgccccctggggtctgtag

SEQ ID NO: 46322 - DNA, 1320 bp, Artificial Sequence
  Description of Artificial Sequence: Synthetic coding sequence
atggcccccaagaagaagcggggccccagcgccggcagccagcccgggggtgcggccgctgccggggccgagcagccattaagcgagagagcccagtacctgcagagggagcacgccctgctctctgaacaactggatacctgtgaggaatccgtagatcaggtacttagagaaaacgccttcctggatagagaagcattgcgcctgcgggaggaaaataggctgtacgcttcctatgtgtccgcacgggcgcaacgttgcgcaaaggccatagtgagacttgacgagcaaaatcgtgtagacctggcacagatacactggcagcgggctgagcttgcatctctttaccacgggagggaggacggggttagggcgcagctgctggagatggaagcgagggcagcacagatggctcagcaggttcaagagctgcagccatacaaagtgttgcagctagaacagctggcccgcatcagggcgctagagcgcgagttgctgcatatgcgcgtggagcacacccagctgctgcacagagttaagcggaggttccttgaggacaaggcagcattcgagagggaggcccgacaaagggtgcagagtttagcccgcagagcagagagagaggcggtgcgcgcacttgtggctcacacgcaggctatcaaggcagataacggtagactccggcaggagctcctgctgctcctgcgccgtacgcaactgctccatcacacgaggcggcagcttcttgagcaacgggagcagttgcacagagagcacgaggacaccagggacctcgccagggtgcatggctggctgcgccgtggcccaggcggaccgcccctttgggagagaccggccttctcacagcccacatcgcgccctgggtccctggccgcccccatctccccctcacgcgccgcaagtcaaaccccatctgtggtgccctcccgcgccgcaccgcgggcaagctctgtggtgccctctcgcgaggctagccgggtcccttccctcgtgctctcatcgatggacagcagagtgcctagtcttgccacgagtaaggtcgggagtaggatgcctagcttaacagcctctagagcaggaagccgcgccctgagcctcgtccaaagcttggaaggaagcggcatttcttcaggtagtagcccacgcgtttcttcacaggatacactgcgaagtaccaaatccgggcccaagcttttgagcggactgtcaagggaccgggatccggcattactgcccccgcaaagcgaagactcagtgaatgctgaggcggcagctgaggcttctcctgggcgagcctag

SEQ ID NO: 46323 - DNA, 7359 bp, Artificial Sequence
  Description of Artificial Sequence: Synthetic coding sequence
atggcccagatccagaaggacaaggccaacatcagcgagaagagcgtcatgcacccagagtatatcgccgtcaaggctgaaaagtcccctttgagtcatattctgaaaacgaaagagctgcaggtaaacatcagccagcaaggggagaaagcgcaggaaggagaagttgaaatcgtagtactcctctcaaaaacttgcccttttgttacgtcatcggcctttctcgagcttgacagcattaaggaagaagagggggaaccaaggattactaggagttttatgccacatttagagattcaagaatcacttccaagcaggcagacagcccctactaaaccaactgagagtctggtgaaaaaggagaaacagctgctccctcagaaggaagaccgggtccagactgtgagcatgcacgggttgatgcatcctaacggagctgtgttcaaggctaagaccagtgctcctccgcaggtattttctattaccgaacattctcccctttctaaaaggaaggaacctcagtggggcatgaaggagagagccggacagaaacaggaccgaaccggccgtccccacgtgatcctcaccaaaacgcaccccttcatgccttcactgagtcaccatcgtttttccccctcacagccaaagctgcctatcagctctggcgcaggaaaatctcggctcgctaatagtaatgaaggaatcagcagccacaaggtgatccttaaggctaaccaacaaatgccgtacaaggaagctaaggatcgggtgaagatagaaggacgtgagggccggattcttccgaaaaggatacaccttagagccgaagcactccctttggctctgctctgcaatggcaagaactattccctacacatcgaggagcagggggagggtgttcaggaaagcaagaaggagcccggagtagtgcccagaaaatcagccagcttccctcctccgcctttctacctcaactgtgacactaggagaaatgagaaagaaggaactctcggtaagacacaattctcttttccaccactaaagattcaggactcatccgactctggcaaaaaagcctacacggagagtctccatggctacacgctcagtaactctaagggaccagtgcaacccaccgctcagggtgaagagaaaggtggcctgcggatcgatatggaggacaagatgcttcctaagtgcaccgatctcaaggccaaacaactgcttctaagtgatatcctaaacactaaaaagttgcagtggaagtccaaggaacaaaagcgcaaaatacaggaggataaaaacaaacaggtcaaaggcctgcctagtatcaacacctcactgctgacccccccatacttgaagttcgacaccactgaaggacaagagaacgtcatcagaatcgccaaagtcagcttgccccagtccaggagtaaagagagttctgatgcaggaagaatcgcgtgccctgaagctactcacggtgaattgagtagcgacgttaagcagttgaaagctcacctcttacaaaaggaggaaaaggacagagagaaagtggccgatatgacttctgtcctcgatcctaataaaatgtacctcaaagccaaaaagtcaccagttttacacacacacagtttcagcgaccttcagtggaagaccagagagcaggaggaggaaaaggtgcagaaggtgaagagcggcccgggggtgatgctgtctaagtctccctctagaagtagccccttgcatcttaacgtaaacactgggttccaggaagaaagcatacccattcttactaggccaagtttccctctcgtcaaacttcaggtgtctcctgatactgaaggcggaacctgtatcaggcccatcgccggcgatatcctcatttatctgcagaagggcaaacatgtttcccaaaacaaagaggaggatgatgtccagatcgtgtctatactgatttttcccaaacaccaggaggagaaggtccaagagtgcgagggggagcctggggtggtgcttacaaaatcaactagcctcccgtccctgagtcagctggagctggacaaagaaactcaccttggaaatgagatgctgcgactgaagcgcccaatcctgaggcggatcagccatataggggaaacagtgcatcgtgagagtgtggtgggtgacatccccaaagacgtgaaaaatgagaaacagcacattccccagaaagaggagcgtaaccagaaaaagattatcgacatgcgtgggaccgacattaccctgaagagcaagaaaagccccaggagctgcatgctgcatagaacagagctgcatgtgaacatcggaggacaaggcaggaaagaacatgagggccaggacaagccgcctggaatgatacaacgtaaaatgtgtattttgttctctaagcccctcccgtccaatctgaaactagaacgggctacacatgccgacgaagaacgcctgggagggaaaacaagttttgtgctccctctgatgccttcggctcttcctgacaccgaaaagacggcagatgctgaggcaagaagtggggacgtcagaaagggtaaaccccacagatctcagaaggagaaccgacatgaggtgaagacgatcgatatgagattccgcatccattgtcaggaggcaaggatcagccctatgtctcacattctgaacgcaaaagaactcgtgctgaacattaacaagctcgagaagaaggtacataaagataaggatgaggcctgcgtcgtcctgtcaaggacattcctcagcatcccaagcgctccacccttatacctcgactcagggaacaagacggacaaggacacacccggaatcacagggagcagctgcccccagcgaaccctccacgtgcccagtaatacccaaaagatcaccaacagagactctgttgagggcgttgataagaatgtggtgaagcaggcagaacagtacgtcccccggccagaggcagagcagcagctgacgagcaattttatgatttcagttcaacagcggaaccaaccttccagagtgaggagcgaagaagaccttaaccagctcgtgttgaactcccgtgacgaggacatctatttcaccggattcggtacaattcgttccgggaagcgcccggaatggctcttcactggaaaaaaggcccagcccgtcaagtacaagaccgaaacccttaccgctttcttgtcatacccgaccatggacgcaaccaagatgggtgggttggaagaagacaccgagataatggataacttgaatcataaaatctcacctaaggctagcgttagtctcattagaaaaatctccaaagagctgtatgtcactctgggcacaccagctaactccaaggggtttagcgtttctgagcggtatgctcaccagcaagaaactagctctaaggtaagccccgagctagcaggaagttgcaagttcgacaagcctaaggaggatggccaatccaacgacaggatcagtaaaatgttttcccccaaagtcctcgcgccacaaacaaagggttcgctgaaaaagatttctatcgtaacaaactggaacgccccccagaacatagaggagcaggatattgtgatgaaaaaacaggtgatccgtcgctgtgagcatggacataagaccaggactaacacaatcctgtcgaagtttccgctgcagagcgggaagcagaagacccctagcgaaacagatgtagataagaaaacaaccgcccacctctccctgcagatgctgccaggaattcatatggacatgacagagatcgatccagctaaggggggccggaaacaagccctactaatctctgagcaagaagagggcgtcctggagttcctccctaaatcactctttccaccttggacctttcaatttcagagcggcgacctggaggaaaagcatcagacggacgctaacaccaacatcaatctggagcagaaaaaactggaaatggacaacgactctaccgtcaatcaaaaagaagggaagctcaaaattggaacgaacagagctctccacttgcaggaagagaaaactgaaatgcataaagccaggacagctaacctcgaaaaagagcggggccggatggacacgtccagtagtgctcatccacaccttctctctttgaaggctgaagagagtcagatgaaaacccaggtgatcacgcacagggagaactcgcgactcataatgcagaagcagaagaaggagctggaagcctccaacgctaagcagtccattcagctgcaaaaattgtttcaacgcaacgtcctggactctttttattcctacgtgcccctctcaccaaaacggaaggaccagaagggccgtcttaccattcgggacctcaaacgggagctctctaccaagtatctgacaatgaaaattcagaatcatccaatacctcagatgttgaatatcaccggtaggggcactccttctaatcggaagaaactcgaatatgacgtgaagctgaagaacatcgcttcttggagtaaagacgtatccggcattttcattagatctcttagtattagtatcatgaggagcccccacacagacccaaaaaccaatctggagcgcgagaagaggatctgcctgcctaaatttcaggagaagtctccaaatacatccgaaatgagtaagagggacacattgacaatcgttaagggcgagcagaattttacaaataccgtcccgcaggatccccagcccttcgcggttgataaacaacaaatgcagaagctgccgaacgtgaagagtgaagccaatctgcggagtgagatgaacaaaaagtatttgaaggcacagacaaaagaaagaatcgttccagaacacgacgtgagcagaataataaaaaagcccgacctacgaatcatcgagcaagaggagaaaatcctgaagaggatactgacaccgaccgagtgcccttcgatgctcgaggaccctaagctaccaaagcagagggaccagagcgaacccgtctgggacatgaccacccagaaggttcaacagcagaaagccttccctgggactgtgcctatacccccgcaagtgaaatccagcgaagtcaagattgtggccgacagcacgaacgccgaacacctcctccccatctgcgaggctactaaggctatctcggagagtcaggttaagaacatgatccaggataaagtgtcttccgacaagttagataacatccaggcttacaagcccgacgatcttaaatctccaccctttcccgagggccccgacaccattagtacagccatttatccaaaaacccagcataagagccttctggagcagttcacacctaaggagaagaacaaactaacaagccatctggaatctaaagccctcgagatccaactcaacctcattcccgaaatggcccggaagtcgctgcagatgttcaacttctaccctaaggggaccatttcaaaggataattcctggaggttttatagtcggcataagaccatgaatttcatgtctctggaggggaccgataccatagagccaaactctaaacacaagcatcaaaaggattctcctttggcttccaacatgaagaccctgatagtcgatgtcagcagcgacagtgaggaaactataactaagttgcagtctataaacaagctggagaatggtacgtccgctgttacatcagcttccgaaatgctcctgcctcataccctgcagaaccacagcgtgaaagagaagggtaagctcctaatgcactttagcgtgaagaccctcgaaattcaaatgaaggcattcccccggatcgtccgtgagtcatatgccatgacgagcgcccatgagaggaagaagccgttgagcaattgcatccaccccgggttcaccgggccaaaaaggcagaatcgtatcctgcttttgagtgaggagaagagtctgcaccagatagacttggacctgcaatataaatatctacgattcctgctcggcttgcccgtgggctccaccttccctaaacccaatgtgctgcccaaacatagtaagcttaatacaattgccgtgtgtaagaatgtgaacgctggggggcagagcggatccctctctattgataccgaactgctagagcagcacattagctttaagaaacagagtcctcatgagaactcttctctcatcagaaaatttcctcagcccacactcgtgtgtgcctctgaccgtgaccttcattctccgcgtaaaaaggatacgcaggttcttagcgagtctgaatttcacgtgactccagagaaaaacaagcaatatcacgtgtggttccaggagagaaacacctgtgaatcagtggacctgcgaactcaaaggaacgccactgggtctgcagtgagttgtgagacgcagattagcgaagacttcgtggacatccagaccgatatcgagtctcctgcagacctcgacgaatgttcatgcttggaagtgagtgaatctgaggagtgcgtgttcctggaggctaattcttatttgtcacaggaatccgagaacattctttttgaattgcaaaccggcattcccctagaaaatgtctacaagattaccactgatctgaagagcttctacagtgaggattcaggatcccattgtacccgagagtgccgaaaagagacattgattatcactcccccatcctgtaagtcacataaaagtagaaaatatagatcgagctcaaagatgaagtccccagactggctttgccactcttcctccaatactgcggagatacaatcccgcagtagctccgtcagttttagtgaagaaaaaataagctggaccacaaaatcaagaacatcatactcatccgcccccctgaccgagagtaacataaagagccacctggcaaagaatcagggaaaaagccaccgtcacccggagtcccaggaaagaaagaaggcccgctccgatctgttccgcaagaatagctcccattgggaccacgactactcatgcacacactctaagggtaagcgagacagaaaaaaacgggtgtatgactatgagtcagaaagactcgactgtttccagtctaaacacaagagcgcttctaaaccacaccacgacgacatcaatttctacagtgaaagaaagcagaaccggcccttcttcttcgcctgcgtaccggctgatagtctcgaggtaattcctaagacgatcaggtggacaatcccaccggaaacgttacggaaaagaaactttcgaattccactggtagccaagatttcatcaagctggaacatctggtcctcttccaagaagcttctaggctcgctgtccggaagtctcacaactgtgtttcactcttag

SEQ ID NO: 46324 - DNA, 645 bp, Artificial Sequence
  Description of Artificial Sequence: Synthetic coding sequence
atgaaggaggagcggaactacaacttcgacggcgtgagcaccaaccgcctcaaacaacagcttttggaggaagtaaggaagaaggacgctgtgcagctgtccatttttgagctgcgccataaaatcaccgaactggaggcgaagctgaataccgacaatgagggttcggaatggaaaactcgttatgagactcaattggaactgaacgacgaactcgaaaagcagatcgtatatttgaaggagaaggtggaaaagatccacgggaactcaagcgatcgactcagctcaatcagggtttatgagcgaatgccagtggagtcgttgaacacgttgctgaaacagctggaggaagagaagaagacgttagagagccaggtgaaatattatgccctgaagctggagcaggaatccaaagcttaccaaaagatcaataacgagcggcgcacttatttagctgagatgtcccaaggaagcggcctgcatcaggtttcaaagagacagcaggtggatcaactccctaggatgcaggagaacctggtgaaaacgggtagatacaatcctgccaagcaaaagacagtgtcagcaaagcgcggaccagtgaagaagatcacacgtcccaatcacctcccagaattgcatccctag

SEQ ID NO: 46325 - DNA, 426 bp, Artificial Sequence
  Description of Artificial Sequence: Synthetic coding sequence
atggagaccctgcaggagagcctgaacaccctgctgaagcagctggaggaggaaaagaaaacactggagagccaggtgaaatattatgctctgaagctggagcaggagagcaaagcatatcagaagatcaacaatgaaaggcgcacctatctggctgaaatgagccagggcagtggacttcatcaagtgtctaagaggcagcaagttgaccagctgccacgcatgcaggaaaaccttgtcaaaacgttgctgctgaaggaggaattagacccactcaaggtatcttgtcttgagactctgggtttctctgccgccggcgtggccggaccggagaatcggacctgcctggggcagaaggccctgtggccagcttgcctgcatggcagcagcaccctcgccgtttgccagactcaccttaagtcctag

SEQ ID NO: 46326 - DNA, 339 bp, Artificial Sequence
  Description of Artificial Sequence: Synthetic coding sequence
atgcccgtggagagcctgaacaccctgctgaagcagctggaggaggagaagaaaactctcgaatctcaggtcaagtactatgccttgaagctggagcaggagtcaaaagcctatcagaaaattaataatgagcggaggacctatcttgctgagatgtctcaaggctcagggctgcatcaggtcagcaaacggcagcaagttgaccagttgcctagaatgcaggaaaatctggtgaagacaggacgctataacccggcaaaacagaagaccgtgagtgctaagagaggcccagtgaaaaagataacaaggccgaaccacttacctgaactgcacccctag

SEQ ID NO: 46327 - DNA, 420 bp, Artificial Sequence
  Description of Artificial Sequence: Synthetic coding sequence
atgcccgtggagagcctgaacaccctgctgaagcagctggaggaggagaagaaaactctggaatcccaggtgaaatactatgcactgaaactggagcaagaatctaaggcctatcagaaaataaataacgagcgaagaacctacctggcagaaatgtcccagggctctggactccaccaggttagcaagcgccagcaggttgaccagctgccccgtatgcaggaaaaccttgtcaagaccttgctattgaaagaggagcttgaccccctcaaagtctcttgcttggagaccctaggcttctccgcagccggtgtggcaggtcccgaaaatcgcacttgcctgggacagaaggcactctggcccgcctgtctgcacggttcctctacactggcagtctgccaaacgcatttaaagtcatag

SEQ ID NO: 46328 - DNA, 420 bp, Artificial Sequence
  Description of Artificial Sequence: Synthetic coding sequence
atgcccgtggagagcctgaacaccctgctgaagcagctggaggaggagaagaagaccctcgagagccaggtaaagtactacgcactcaaacttgaacaggagtcgaaagcataccagaaaattaacaatgagcggcgcacctatctggccgagatgtcccaaggctccggattgcaccaggtaagcaaaaggcagcaggtggaccagttacctaggatgcaggagaatctcgtcaaaaccctgcttctcaaagaggagttggaccctctgaaagtttcttgtctcgaaacattgggtttttctgccgcgggcgtggcagggcccgaaaacagaacgtgcctgggccaaaaggcattatggcccgcttgcctgcacggcagttctaccttggccgtgtgccagacacatttgaaaagctag

SEQ ID NO: 46329 - DNA, 339 bp, Artificial Sequence
  Description of Artificial Sequence: Synthetic coding sequence
atgcccgtggagagcctgaacaccctgctgaagcagctggaggaggagaagaaaaccctggagtcccaggtgaaatattacgctctcaaactcgaacaggaatctaaggcatatcagaaaatcaacaatgagcgcaggacgtatctggcagaaatgtctcaaggctctggccttcaccaggtgagcaaaagacaacaggtggaccagctgccaagaatgcaagagaatctggtgaagacaggtcggtataaccctgctaagcagaagacagtgtctgctaagaggggacctgtgaagaaaatcacacggccgaatcacttacctgaactccatccgtag

SEQ ID NO: 46330 - DNA, 726 bp, Artificial Sequence
  Description of Artificial Sequence: Synthetic coding sequence
atgaaggaggagcggaactacaacttcgacggcgtgagcaccaacagactgaaacagcagctgctggaggaggtgagaaagaaagacgctgttcaactgtctatctttgagctgagacacaagataaccgagctggaggctaaactgaacaccgacaatgaaggcagcgagtggaagacgcggtatgagactcagctggagcttaatgacgaactggaaaaacaaattgtttatctgaaagagaaagtggagaagattcacgggaactcttctgacaggctatcatccatccgcgtatatgagcggatgccggttgagtctctcaatacccttctgaaacagctggaagaggaaaagaaaaccctggaatctcaagtgaaatactacgccctgaaattggaacaggaatcaaaggcctaccagaagatcaacaacgagcgcagaacatacctcgctgagatgtcacaggggagtgggctccatcaggtgtcgaaacgccaacaagttgatcagcttccccgaatgcaggaaaatttggtgaaaacactgcttctcaaggaagaactcgacccacttaaggttagttgtctggaaacactagggttctccgctgctggggtcgctggcccagaaaataggacttgccttgggcagaaagctctgtggcccgcatgtttgcatggaagctctacacttgcagtgtgccagactcatttgaaatcttag

SEQ ID NO: 46331 - DNA, 1773 bp, Artificial Sequence
  Description of Artificial Sequence: Synthetic coding sequence
atggacagccacagcggcgagcccgccctgctgccctgcggcacctgtgacatggtgttccgctctagtgccttgttggctactcacacacagagattttgtatcggccatcctacacaggaaatgacattcggcgctcaggcaagcgtcgctacagagccacagcgggccgctgtacaatggctgagactgagtttacaggaaatgaggccctggatcaccgaagtcccacgggtgtttgccgggccctggacccgatccgaggcgagaccacaaagccccatgtcagaggcagttggtagcccaagcgagagacttcgggccctttttagaactagggctcggcgggtagccgagatggaggctcagagcagggctttgcagctgaggggtgaagaactctccaggaggctgcaggtggtggcttgcactagaggcggaatgtcaaggctatttggcctggagcaggaaatccgggagctgcaggctgaagctgggcgcactagaggagcccttgaagttctcggcgcccggattcaagaacttcaggctgagcctggcaacccgctgtcctcgcggcgagaggctgagctatatagtcctgtgcagaaggccaatccaggaacactggctgctgagattagggccttgagggaagcttacatccgtgatgggggccgggatccaggggttctcgggcagatatggcagctgcaggtggaagcttcagctctggagcttcagcgctcccagacgaggcgcgggcgggccggcgcaacttctggtgaactgcccgtggttgaggcggaaaatagaaggttagaggccgaaatccttgcacttcagatgcagcgggggcgggctccgcttggtcctcaggacctgcggctcttaggcgacgcctctctccagcccaaaggccgaagagatccaccactcctgccgcccccggtggcaccgcctctgccccctctgccaggtttttcggagccgcagctgcccggtacaatgacgcgcaatctaggtctcgattcccactttctgttgcccacctcagatatgctgggtcctgcaccttacgatccaggagcaggcctggtgatattctatgacttcttacgcggactagaagcgtcgtggatctgggtgcagttgaggacggggcttgcaagggacggccgcgacactggccggactacagctctgccccctgccttgtgcctccctcctcctcccgccccggggccaatgggcaattgcgcaatcctggcttctcgccagcccgtccccagactgcctccatcttctagcgtctcattggtctgtgagctccaggtatggcagggactcgcgtgggcccgggcccctcaaccaaaggcctgggtgagtctgggacttttcgaccaggatcagcgggtcctgtccggacggtggcggctgcccttgagggcactgcccctggacccttccctgtcattgggacagctgaacggaattccacaggcagggcaggcagagctattcctccgtctcgtgaatgcgcgcgacgcagccgtgcagactctggccgagattaacccggcgagtgtgcacgagtaccagtaccctccccccgtcagtagtacgtcatctctggaggcctccttccttaccccagcagtagggtttgccgatccccccccccgcactgaggagcctctgtcaggcgtaaaggaccgtgacgaagggctcgggccccaccattcttcagatctaccacctgtgtccttttag

SEQ ID NO: 46332 - DNA, 333 bp, Artificial Sequence
  Description of Artificial Sequence: Synthetic coding sequence
atggacagccacagcggcgagcccgccctgctgccctgcggcacctgtgacatggtgtttcggtctagcgcattacttgcgactcatacacagaggttctgtatcggccaccctacccaggagatgacattcggagcccaggcatcagtcgctactgaaccacaacgagccgccgtttcaagcacatcaagcctggaagcttcctttctgaccccggccgttgggttcgccgacccaccaccacggaccgaggagcccttatcgggagtgaaagatagagatgaggggcttgggcctcatcactcatccgacctgcctcctgtaagcttttag

SEQ ID NO: 46333 - DNA, 1842 bp, Artificial Sequence
  Description of Artificial Sequence: Synthetic coding sequence
atggacagccacagcggcgagcccgccctgctgccctgcggcacctgcgacatggtttttcgctcctcagcgctgctggccacacacacccagcgcttctgcatcggccacccaactcaggaaatgaccttcggagcacaagcctcggtcgccaccgaaccccagagggccgccgtggtaccccaagaacaccagggcgttcctcaagagcctcagggcctccctgatcaacaggccagtcggagtgccctgaaaagactgaccgaggaggagatgcgtccctggataacggaagtgcccagagtgtttgctggcccttggaccagatctgaggctcgacctcagagccctatgagtgaagccgtgggttcccctagcgaacggctgcgtgctctgttcaggactcgggctcgacgcgtggctgagatggaggctcaatctcgagcattacaacttagaggggaagaactgtcgaggcgcctccaagtagtagcctgtacgcgtggagggatgtcgaggctgtttgggttagaacaggaaatcagggagcttcaggctgaggctggcaggactcgcggggccctggaagtcctcggcgctcgaatacaagaactgcaggccgagccaggtaacccactttcttcccgtcgagaagccgagctctactctcccgtccagaaagcaaacccaggcactctggcggccgagattcgtgcacttagggaggcatacatccgcgacggtgggcgggatccaggggtccttggccaaatctggcagttacaggttgaggcatccgccctggaactccaacggagtcaaactagaaggggcagagccggcgcaacctcaggagagttgcccgttgtggaggccgaaaatcgcaggctcgaggcagaaatacttgccttgcagatgcagcgcggtagagcccctctcggccctcaggacttacgcctgctgggggatgcatcactacaacccaagggacgccgggatcctccactgctcccaccccctgtcgccccccccttacctcctctgcctggattcagcgagccccagcttccgggaaccatgacccgaaacctgggactggatagtcatttcctcttgcctacttccgatatgctcggcccagcgccgtacgatcctggagcaggtttggttatcttttatgacttcctgaggggactcgaagcctcctggatatgggttcaactgaggaccgggcttgcccgtgacgggagggataccggccggactacagcccttcctcccgccctctgccttcctcctcccccagcccccgggcccatgggcaattgtgccattctggcttcccggcagcccgtgcccagactccccccaagctcgtctgtatccttagtctgcgagctccaggtgtggcagggcctcgcctgggcccgagctccccaaccaaaagcttgggtgagtttagggctcttcgatcaggatcaaagggtgctttccggccggtggagactccccctacgcgctcttccgctggatccttcattatcactggggcagttaaacggcatccctcaggccggacaagccgaactgttcctaagactggtgaacgcgcgagatgccgcagtccaaacgctggcagaaatcaaccccgcatccgttcacgagtatcagtacccaccaccagtatcttccaccagcagtctggaggctagcttcctaactcccgccgtcggcttcgccgaccctccccctagaacagaggagccgttatctggagtaaaagatcgggatgaggggttgggaccacatcacagctccgatctgcctcctgtgtcattctag

SEQ ID NO: 46334 - DNA, 1869 bp, Artificial Sequence
  Description of Artificial Sequence: Synthetic coding sequence
atggacagccacagcggcgagcccgccctgctgccctgcggcacctgcgatatggtcttccgtagctctgctctacttgctacccatactcaacgcttttgcatcggccatcccacacaggagatgaccttcggagcacaggccagcgtggccacagagccccagagagccgccgtggtgcctcaggaacaccaaggggtgccccaggaacctcagggactcccagatcagcaggccagcagatccgctctgaagaggttgacggaggaggtgcagtggcttagactcagcctgcaagagatgcgtccttggatcaccgaagtgccaagggtgtttgcagggccttggacaaggagcgaagccaggcctcagtcccccatgtcagaggccgtgggatccccatccgagagactgcgcgcactgttccgtactagagcacgcagggttgctgaaatggaggcccagagtagagcccttcaactcaggggggaagaactgagtcgcaggttgcaagttgtagcttgcaccaggggggggatgtcaaggctgttcggtctggaacaagaaattcgggagttgcaggcagaggcagggaggacacgcggagccctcgaagtactgggagctagaatacaggagctgcaggcagaaccgggcaatcctttgtccagtcgtagagaagccgagctctattccccggttcagaaggctaacccgggaactctggccgccgagattagggccctccgcgaagcctacattagagacgggggcagggatcctggagtgcttggtcagatttggcaactccaggtcgaagcaagcgccctggaattgcagcgaagtcagacccgacgcggcagagctggagcaaccagcggggagttgccggtagtggaggctgagaacaggcgcctggaggcagagattctagcactgcagatgcagagaggcagggctcccttgggaccccaggatctcagattgttgggcgacgcctccctacaacccaagggtcgacgtgatccccccttattgccccccccagtcgcaccccctctcccaccattaccaggtttttctgaaccgcaactgcctggtaccatgacaagaaatttggggctggacagccacttcttactgcccacatccgatatgctggggccggctccttacgatcccggcgccggactggtgatcttctacgactttttgaggggactcgaggcttcctggatctgggtccaactgcgtaccggattggcaagggacggccgggacaccggtcggaccacagcacttcctcctgctctatgcctgccacccccgcctgccccaggcccaatggggaactgcgccatactggcatctcgccagccagtgccacggctcccaccatctagctctgtgtctttggtgtgcgaactacaagtttggcaggggctagcatgggcacgtgcacctcagcccaaggcatgggtgtctctgggcctgtttgatcaagatcagagagtgctctctggccgttggcgcctccctttgcgcgcacttccactcgatccgtcactcagcctcggacaactcaatgggattccacaggctggacaggccgagctctttctgcgcctggtgaatgcacgcgacgcagcagtgcagactctggccgagattaatcccgcatctgtgcacgaataccaataccccccccccgtaagttcaacatcttcgctagaggcaagctttctgacaccagcagtaggcttcgcagaccccccccctagaaccgaagaacccttatctggggtcaaggatcgcgatgaaggcctcggtcctcaccatagttccgacttgccaccagtgagcttctag

SEQ ID NO: 46335 - DNA, 852 bp, Artificial Sequence
  Description of Artificial Sequence: Synthetic coding sequence
atgaagaaggacgaggccctgaaggccctgcagaaccaggtgagcgaagagaccattaaagtgagacagctggattccgcgctcgaaatctgcaaggaagagttggtgctgcatcttaaccagttagagggtaataaagagaaatttgaaaaacagcttaaaaaaaaatccgaagaggtctattgtctccagaaggagcttaaaatcaagaaccactccctgcaggaaacatcagaacagaacgtgatcctccaacataccctgcagcagcaacagcagatgttacaacaggagaccattcggaacggggaactcgaggacacacaaacgaagttagagaagcaggtttctaaactggagcaagagctccagaaacagcgggagagttcagctgaaaaacttcggaagatggaagagaaatgtgagtcagccgctcatgaagccgatctgaaacggcagaaggtgattgaattaactggaaccgcccggcaagttaagattgagatggatcagtataaggaggagctttctaagatggagaaagagattatgcatctgaaaagagatggtgagaacaaagcaatgcacctgtcccagctggatatgatcctggatcagaccaaaaccgagcttgaaaagaaaactaatgctgttaaggagttggaaaaacttcagcatagtactgaaactgagttgactgaggccaaaaatggcaagtacctgagaactactaaatgctcatggcggattaagaaatacttcaagacaaccccaggtattgaacggtgtaccactgaggggtcaataatcatacgcggcaaaatccactactataaaggcagtcattcatag

SEQ ID NO: 46336 - DNA, 2412 bp, Artificial Sequence
  Description of Artificial Sequence: Synthetic coding sequence
atggtgatcgagaaggagcagagcctgcaggagagcaaggaggagtgtataaaactaaaagtggacctgttagaacaaacaaaacagggcaagagggctgagaggcagagaaacgaggccctttacaacgcagaggagctgtctaaggcatttcagcagtacaagaagaaggtagctgaaaaactggaaaaagtccaggctgaggaggagatcctcgagaggaacctaactaattgtgagaaagagaacaagaggctgcaggaaagatgcgggctctacaaatctgagcttgagattctcaaggagaaactccgtcagctgaaagaagaaaacaacaatgggaaggagaagcttagaatcatggccgtcaagaattcagaggttatggcccaactgacagagtctaggcagtctatattgaaactggaatccgaactggaaaacaaagatgagatcctgagagacaagttttccctaatgaatgagaaccgggaattgaaagtacgggtggccgcccaaaacgaacggctagatctgtgtcagcaagagatagaatcctcacgggtcgagctcagatctttagagaaaattatttctcaactgcccctgaagagggagttgttcgggttcaaatcctacctgtcaaagtaccagatgagctcgttttccaacaaggaggacaggtgtattggatgttgcgaggctaacaagctggtaattagcgagctacggataaaacttgcaatcaaagaagcagaaatccagaagctgcacgcaaacttaaccgccaatcaactgtcccagagcttgattacctgtaatgattctcaagaaagctcaaaactgtccagccttgaaactgaacccgttaaactgggcggtcatcaggtagccgaatcggtcaaagaccagaaccagcatacgatgaataaacagtacgaaaaagagcgacagcgacttgtgaccgggattgaggaactgagaaccaagctcattcaaatcgaagctgagaattctgacctgaaggtcaacatggcccaccggacgtctcagttccagctgattcaagaggaactgcttgagaaggcatctaattccagcaagctcgagtcagagatgactaagaaatgctcacagttacttacactggaaaagcagctcgaggagaaaatcgtcgcctactcgtctatagcagctaagaacgcagaacttgagcaggaactcatgctcgaggctcagctggagaaaaaggatcagcagttcaaagaacaagagaagactatgagcatgctccagcaggacataatatgtaagcagcatcacctcgagtccttagatcgtctgcttaccgagtccaagggcgaaatgaagaaagaaaacatgaaaaaggacgaagccctgaaagccctgcagaaccaggtctccgaggagaccatcaaagtgcgccagctagattcagccctggaaatctgtaaggaggaactggtattacacttgaatcagctggaaggtaacaaggaaaaatttgagaagcagctgaagaaaaagagcgaggaggtatactgtctgcagaaagagttgaagatcaagaaccactccctgcaagagacctcagagcagaacgtgattcttcagcataccctacaacaacagcaacagatgctgcagcaggaaacgattcggaacggagaactggaggacacccagaccaagctggagaaacaggtgtccaaacttgaacaggagctgcagaaacagagggagagctcggctgagaaactgcgcaaaatggaggaaaagtgtgaaagtgcagcccatgaggccgacctgaaacggcaaaaggtcatcgaattgaccgggaccgcccgccaggtgaagatcgagatggatcagtataaggaggaactgagcaaaatggagaaagagatcatgcacctaaaacgcgacggcgagaacaaggctatgcaccttagtcagcttgacatgatcctggatcagactaaaaccgagcttgaaaaaaaaacaaacgctgtgaaggaattggaaaagctccagcattctaccgagaccgagctgaccgaagctcttcagaagagggaggtgttagagaccgagctgcaaaacgcgcatggagaactcaagtcaaccctccggcagctccaagaactgcgggatgttcttcagaaagcccagctgtctttggaagagaagtacaccaccattaaggatctcactgcggagctccgagagtgcaagatggagatagaagacaagaaacaagaactccttgagatggatcaagcactaaaagaacgcaattgggaactcaaacaaagggcagcccaggtcacccatttggacatgaccattcgagagcaccggggagaaatggagcagaaaatcattaagtag

SEQ ID NO: 46337 - DNA, 3900 bp, Artificial Sequence
  Description of Artificial Sequence: Synthetic coding sequence
atggagagcagcagcagcgactactacaacaaggacaacgaggaggaaagtctcctggcgaacgtcgcatctttaagacacgagttgaagatcactgagtggagtctgcaaagcctgggtgaggagttgtctagtgtgagccccagcgagaactcggactatgctccgaatcccagccgcagcgaaaagctgatcctggatgtgcaaccatcgcatccagggctgttgaattattctccctacgaaaacgtgtgcaagatttctggctctagtactgacttccagaagaagccacgagacaaaatgttttccagttcggcaccagtggatcaggaaattaaatcactgcgggagaagctgaataagctgcggcaacagaatgcgtgtctggttacccagaaccacagcctcatgaccaaatttgagtctatccactttgagctgacccagagccgcgcgaaagtgagcatgctggagagcgcacaacaacaggccgcctctgtgcctatcttggaagaacagatcattaatctggaggccgaggtgagcgcgcaggacaaagtgctgagggaagcagagaacaaactggagcaaagccagaaaatggtaatcgaaaaggagcagtctttgcaggagagtaaagaagagtgtataaaactgaaggttgatcttttggagcagactaaacagggcaagagggccgagcgacagagaaacgaagccctttacaacgctgaggagctgtccaaagctttccagcaatacaaaaagaaagtggccgagaaactggaaaaggtgcaagctgaggaggaaattttagagcggaacctaactaattgtgaaaaggagaacaagcgcttacaggagcggtgtggattgtacaagtccgaactggagatcctcaaagagaagcttcgccaactgaaagaagagaataacaacggaaaagagaagctgcgaattatggccgtcaaaaactcagaagttatggcccagctgacagaatctagacaatcaattcttaaactggaatccgaactagaaaataaggacgaaatcctgcgcgataagtttagtttgatgaatgagaaccgagagctgaaggtgagagtggctgcgcagaatgagagactggatctgtgtcagcaagagatcgagagtagcagggtggagctgcgctctcttgagaagattatctcacaattgcccctgaaacgggaactgtttgggtttaagagttatctttccaaataccagatgtcttcattcagcaacaaagaggatagatgcattggatgttgcgaggctaacaagcttgtgatttccgaattgcggatcaaactagccatcaaggaggcagaaattcagaagcttcacgctaacctgacggcaaaccagctgtcacagtctctcattacctgtaacgacagccaggagtcctcaaagttgtcaagtctggagaccgaacccgtgaagctgggcggccaccaggtggccgagtctgtaaaggaccagaatcagcacacaatgaataaacagtatgaaaaggagagacagcgcctggtcaccggcatcgaggagcttcgaactaaactgatccagatcgaagcggaaaattcggacctgaaagttaatatggcccaccggactagccagtttcaattgatacaggaagaattgctggagaaggcttccaactcttctaagcttgagtcagaaatgactaagaagtgttcccagctcctcactctagagaagcaattggaggaaaagatcgtggcctatagcagcatagccgccaagaatgcagaactcgaacaggaattaatggaaaaaaatgaaaaaatcagaagcttagaaactaacattaatacggagcacgaaaagatctgcctggctttcgaaaaggcaaaaaaaatccacttggagcagcacaaagaaatggagaaacaaatcgagcgtctagaagctcagttggagaagaaagaccagcagttcaaggagcaggagaagacgatgagcatgttacagcaggatatcatctgcaaacaacaccatcttgagagcctggatagattgctgactgagtctaagggcgaaatgaagaaagagaatatgaagaaagatgaggctctcaaggccctgcagaatcaagtgtcggaggagactatcaaagtgcggcaactcgattccgcacttgaaatttgtaaggaggagctcgtgcttcacctgaatcagctggaaggcaacaaagagaaatttgagaaacagctaaagaagaaatcagaagaagtctactgcctgcagaaggaactaaaaatcaaaaaccacagccttcaagaaaccagcgagcagaacgttattctgcagcacacactgcaacaacagcagcagatgctgcagcaagaaaccatcaggaacggagagctagaggacacacagacaaaactcgagaagcaggtgtccaaattagagcaagaactgcagaaacaacgggagtcgtccgccgagaagttgcgcaaaatggaggagaagtgcgaatcagccgcccatgaagccgatctcaagagacagaaggtcatcgaacttaccgggacagccagacaggtcaaaatcgagatggaccagtataaagaagagcttagtaagatggagaaagaaatcatgcacctgaaaagggatggagaaaataaagccatgcacctgagccagctagatatgatcttagaccaaacgaaaactgaactcgagaagaaaactaatgcggtcaaagagctcgagaagcttcagcattccaccgagactgagctcactgaagccctgcagaaaagagaggtcctggagactgagctacagaatgctcatggagagctcaagtcgaccctgcgccagctccaggagctgcgtgacgtgttacagaaagcccaactatccctggaagagaaatacaccactatcaaagacctgacggcagagctgcgcgagtgtaaaatggagattgaagacaaaaagcaggaactgttagaaatggaccaggcactcaaggagcggaattgggagctaaagcagcgggccgcccaggttacccacctggatatgacaatccgggaacacagaggggaaatggaacagaagatcatcaaacttgagggcactctagaaaagtcagaactggaactgaaagagtgtaataagcagattgagtccctgaatgacaagctgcagaatgccaaagaacaattacgggaaaaggagttcattatgctgcagaatgagcaggagatttcccagctgaagaaggagatcgagaggacacaacagcggatgaaagagatggaatcggtcatgaaggagcaggaacagtacattgctacccagtacaaggaagcaatcgacctcggacaggaattacgcttgacaagagagcaagtgcagaactctcatactgaactggccgaggccagacaccagcaagtccaggcccaacgtgagatcgaacgactgtcttccgaattggaggacatgaagcaactgtcaaaggaaaaggacgcccacggaaatcatcttgcagaggagctgggagcaagcaaggtccgggaggctcaccttgaggcgcggatgcaggccgaaattaaaaagctttctgcggaagttgagtccctcaaggaggcctaccacatggagatgatatcccatcaagagaaccacgcgaaatggaagatcagcgcggactctcagaaaagcagcgtccaacagcttaacgaacaactggagaaagccaaattagagctggaggaagcacaggatacagttagcaacctgcaccagcaggtgcaggaccgcaacgaagtcatcgaagccgccaatgaagccctcctgacaaaaggcgagaatgtctag

SEQ ID NO: 46338 - DNA, 4254 bp, Artificial Sequence
  Description of Artificial Sequence: Synthetic coding sequence
atggccagccccaccaacggccaccacggcggcaactgcggcaagtgcagtccgggcagagcacctcttgttggttccggtgcgttagcagatcatgacccaagacaagcaccacggctgaggagacgtttgacacagtctgcaccaggcagggggagcgacagagtaggcgcaagtcagagacttcctagaagatttgagttctgcgcagcaggcgtgaggtggttcagcgagctgtgtccccgcctgccaagggctggggcgcgcgaaagggtgcgggggtttctcacccagacgcgcgtccgcagtgctcagagccccggaggaagtctgccatctgatgatctcggcgaaatggaatcatctagttctgattactacaataaggacaatgaggaggagagcttactcgccaacgtagcttccctgcgccacgaactgaagatcacagagtggtcacttcagtccttgggtgaagagctctcgtcagtgtcccctagcgagaattccgattatgcgcccaacccctcccgttctgagaaattaatcttggatgtgcagccttcacaccctggtctgctaaactattcgccatatgagaacgtgtgcaaaatttccggctcctctaccgactttcagaaaaagcccagggataaaatgttctcgtcatcagcaccagtggaccaagagatcaaatccctacgagagaaactgaacaaactgcggcaacaaaacgcttgtctggtaacacagaatcacagtttgatgaccaagttcgagtcaatccacttcgagttgacccagtcacgagccaaagtttctatgttggaaagcgcgcagcagcaggcagcttctgtgcccatcttggaggaacaaattatcaacctagaagccgaagtaagtgctcaggataaggttttacgcgaggctgaaaacaagctcgagcagtctcagaaaatggtcatcgagaaagaacagagcctgcaagagtcaaaggaggaatgcattaagttaaaagtcgatctcctggaacagacgaagcagggcaagcgggcagaaaggcaacgtaatgaggctctgtataatgccgaggagctatctaaagcattccagcagtacaaaaagaaggtggctgagaagctggaaaaggtgcaagccgaagaagaaattctggagagaaacctgacaaattgcgagaaggagaataagagattgcaggagcggtgtggcctgtataagagcgaactggagatacttaaggagaagctgaggcagctgaaagaggaaaataacaatggaaaggaaaaactgaggattatggcagtaaagaattccgaagtgatggctcagctgaccgaaagtagacaatccatcctcaaactggagagcgaattggaaaacaaagacgagattcttcgtgataagttcagcctgatgaacgagaacagagagctgaaggtccgtgtggctgcccagaacgagaggctcgatctctgccagcaggaaatagagtctagtagggtcgagctgcgcagcttggagaagatcatctcacagctgcctcttaagagagagcttttcggatttaagtcctacctgtcaaagtaccagatgtcaagctttagtaataaagaggaccgatgtatcggttgttgcgaggctaacaagctcgtgatctctgaactacggatcaaactggccattaaggaggcagagattcagaagctgcacgccaacctgacagcaaatcagctcagccagagcctcattacatgcaatgactcacaggaatcatcaaagttatctagccttgagaccgaacccgtgaaactaggaggccatcaggtcgccgagagcgtgaaagaccagaatcagcacaccatgaacaagcagtatgaaaaggaaaggcaaagattagttactggcattgaagaactgagaaccaaactcattcagattgaagcggaaaacagcgatctcaaagtgaacatggctcaccggacttcccagtttcaactgattcaggaggagctcctcgaaaaggcaagtaattcttccaaactcgagagtgagatgaccaagaaatgttcgcagctactgaccctagagaaacagctagaggagaagatagttgcatactcttctatcgcagccaaaaatgccgagctcgaacaggaacttatggagaaaaacgagaaaatcagaagccttgagacaaacattaatactgagcatgaaaaaatttgccttgcatttgagaaggctaagaagatacatcttgaacagcacaaggagatggagaagcagatcgaaagacttgaagctcaacttgagaaaaaggaccaacagttcaaggaacaggagaaaactatgtctatgctgcagcaggatatcatctgcaagcaacatcacctggagagtcttgacaggttgcttaccgaatcaaaaggagagatgaagaaggagaatatgaagaaggacgaggcgctcaaggctctccagaaccaagtgtcagaagagactattaaggtgcggcaactggactcagcgcttgaaatttgcaaagaagagctggtcctgcacctgaaccagctcgagggcaacaaggaaaagtttgagaagcagcttaagaagaaatcagaggaggtttattgccttcagaaggagctgaagatcaagaatcacagtctccaggaaacctctgaacagaatgtgatactacagcacacgctgcagcagcagcagcagatgttgcagcaggagacgatccgcaatggggagctggaagatactcagactaagctggagaaacaagtgtctaagttggaacaggaactgcagaaacagagggagtcaagcgcagagaagctgcggaagatggaagaaaaatgtgagtccgccgcccatgaggccgacctgaagagacagaaggtgattgaactgacaggcactgcacgccaggtcaaaatcgaaatggatcagtacaaagaggagctcagtaaaatggagaaagaaatcatgcatctcaaaagggatggcgaaaataaagcgatgcacctgagccagctggatatgatattggaccagactaaaaccgagctggagaagaaaaccaacgctgtgaaggaactcgaaaaattgcagcattcaactgagaccgagttgacggaggccttacagaaaagggaggtactcgaaaccgaattgcaaaatgctcatggcgagctcaaatcaacactccgacagctgcaggagctccgggacgtgctccaaaaggcccagttgagcctggaagaaaagtacacaaccatcaaggacttgaccgctgaactgcgcgaatgcaagatggaaatagaggataagaagcaggaactcctcgaaatggatcaggctcttaaagagaggaactgggaattgaagcagcgagccgcccaggtgacacatcttgacatgaccattcgagagcatcgaggagagatggaacagaaaatcattaagctcgaaggaaccctcgagaagagcgagttggaactgaaggagtgtaataaacagattgaatccttgaatgacaagcttcagaacgctaaagaacagttgcgggagaaagaatttataatgctccagaatgaacaagagatttcgcagctgaaaaaggaaatcgagcgtacccagcagagaatgaaagagatggaaagcgtgatgaaggagcaggaacagtacattgctacccagtataaagaggcaatagacctgggccaggagctgcgcctcacaagagagcaagtccagaactcccacactgagctggcagaagcgcgccatcagcaggtgcaggcacagcgagaaatagaacgcctttctagcgagctcgaagatatgaaacagctgtcaaaggagaaggacgcccacgggaatcatctggcagaggagttgggggctagtaaggttcgagaggcccatctggaggctcggatgcaggccgaaatcaaaaagttatctgctgaggtcgagtccctgaaggaggcataccacatggagatgattagccatcaggagaaccacgctaagtggaaaatttcagccgatagtcaaaaatcatcagtccagcagctcaacgagcagctggagaaagcaaagctcgaactggaggaggcgcaagacacagtgtccaacttgcaccaacaagtccaagatcggaacgaggtgatcgaagctgcaaatgaggcactactgacaaagggagagaacgtttag

SEQ ID NO: 46339 - DNA, 201 bp, Artificial Sequence
  Description of Artificial Sequence: Synthetic coding sequence
atggacccccccgcccggaaggagaagaccaaggtgaaggagagcgtaagtcgcgtagaaaaggccaaacagaaatctgcccaacaggaactgaaacaaagacagcgcgctgagatatatgccttgaaccgggtgatgactgagctggagcaacaacagtttgatgaattctgcaagcagatgcagcctcccggcgaatag

SEQ ID NO: 46340 - DNA, 201 bp, Artificial Sequence
  Description of Artificial Sequence: Synthetic coding sequence
atggacccccccgcccggaaggagaagaccaaggtgaaggagagcgtgagtcgggtcgagaaggccaagcaaaaaagtgctcaacaggaattgaaacagcgccagagagccgagatctacgccctcaaccgggtgatgaccgaactggaacagcagcagttcgatgaattctgcaagcagatgcaaccaccaggcgaatag

SEQ ID NO: 46341 - DNA, 201 bp, Artificial Sequence
  Description of Artificial Sequence: Synthetic coding sequence
atggacccccccgcccggaaggagaagaccaaggtgaaggagagcgtgtctcgggtcgagaaggccaaacagaaatccgcccaacaggagctgaaacaaagacagagagctgagatttacgctttaaatcgggtgatgaccgaactcgaacagcagcaatttgacgaattttgcaagcaaatgcagccccccggtgagtag

SEQ ID NO: 46342 - DNA, 924 bp, Artificial Sequence
  Description of Artificial Sequence: Synthetic coding sequence
atgctgcggcacagccccagcctgtgggagctggtggaggagcacgtgcccctcagagaaagaagagaagtaaaacggatactcggtgaagctgcagtcgatctgagccttgaactgagagccgaggttgctatgctgcgggctctgctgcaggaggcccgatcctctcaagcgccttcatccaggcctattagtgaccctagttccctgctggccccaccacccctccttaaggacctcctccgacaggaactcaggcagttgctgcaaggactgagacacaaggctatctgcgaagggagagaccaagcccaggcatgggtacagtactcccctagagttctgcactttgccctggaagagccgcggtgcgatctccccgagcaagagatttttcaaatgcgtggtggcggcccttcctctggccatcgcgatctttccattatcaaagaccagctgaatgtcagcaacattgaccaggtcgctcgtcacctgcggggcctgctcgaagaggaatgtcacacactagaacgagagatccttattctccaaaggtgtctagaagaagagtacctccggccttgccatccttccgaagccgcgttggagcccaccctcgcagagttaaaggaacagaaaaaggctatggaacaggaactgcaggccagcgtgggtccaagttgcgtctcccctaaccatcgtcagcggcctctgggcagctcgacgcagggattgagacctcctttgcctctttgcggcgtggcccccctgcaatgttgccttcccgcacctccactcgagccttaccttaggcctagaggccagtcagccacccatcgatggggaagacaattgcagtgcagtccccgggagggcccagcatccacccccatgtcatcagccgctccgcaggcacccgcctag

SEQ ID NO: 46343 - DNA, 627 bp, Artificial Sequence
  Description of Artificial Sequence: Synthetic coding sequence
atggtgttctacttcaccagcagcagcgtgaacagcagcgcctacacaatctacatgggcaaggataagtacgaaaatgaggacctcatcaagcacggatggcccgaagacatttggttccacgtagacaaactatcttcagcccatgtgtatctgcgcctgcacaagggcgagaacattgaagatattcctaaggaggtgcttatggattgcgcacatctggtgaaagccaattcgatccaaggctgtaaaatgaacaacgtgaatgttgtgtatacaccctggtccaatctcaagaagacagccgacatggatgtagggcagattggattccatagacagaaggatgtcaagatcgtgacagtcgagaagaaagtcaatgagatcttaaatcgcctcgagaaaactaaagttgagcggtttcccgacctggccgctgaaaaggagtgcagggatagagaggagcggaacgagaaaaaggcacagattcaagagatgaaaaagcgcgaaaaagaggagatgaagaaaaagagggagatggacgagctccgcagttacagcagcttgatgaaggttgagaacatgagctcaaaccaggacggcaacgatagcgacgaatttatgtag

SEQ ID NO: 46344 - DNA, 423 bp, Artificial Sequence
  Description of Artificial Sequence: Synthetic coding sequence
atggactgcgcccacctggtgaaggccaacagcatccagggctgcaagatgaataatgttaacgtcgtgtacactccttggagtaatttaaaaaagactgctgatatggacgtaggacagattggttttcaccggcagaaggatgtgaaaatcgtaacagtggaaaagaaggttaacgagatcctgaatagactggagaaaaccaaggttgaacgttttcctgacctggctgccgaaaaagaatgccgtgatcgggaagagagaaacgagaagaaggcccaaatacaagagatgaagaaacgagaaaaagaggagatgaagaaaaaacgcgaaatggatgaattgagatcatattccagcctgatgaaggttgaaaacatgtccagtaatcaagacgggaacgattctgatgagtttatgtag

SEQ ID NO: 46345 - DNA, 1971 bp, Artificial Sequence
  Description of Artificial Sequence: Synthetic coding sequence
atgttcgaggccatcttccccagcaccccccaggcccggctgaagcgggaccctcgggagaaacctggcctgtctagcttcaggagtacgtttcgtcaacagagcagtctgggcctctgtatcccacggcttatgctgccaaaggaggcttctccgtcgcagcgacacagctcaatgagcagttccatggctcgcgctcttgtgctgctgcaatcgatggccagccgggacgcccgctgccccgaatggaagcctcaccaaaagccacggactcttagcaagtctgtacagacaattagtcgatactaccgcaaaaccagtgaacccaaagatgccgcatctttgactggttttatgagtaagatggagctccgccgggtctttcccactcatcccgattgtcctcagttcagcacccgcgcaacgtctatgtcacactgcggcagcccgacggaggcagacctgtctggcgaaattgacaactcgtcggagacgtggcgggggacacaggacctgtttcttgctcgccgggggtccgacactaacgtcgatggatatctgctaccgttcagcaaaagcatttgcgaattcgactacttgagaaagaggagaaagagccagacactaagtcccgttacttcgtcatccgtggccagccagtcttgtcttagaaagcggatgccgtggtacctgtccgttatccacgagaaagaccactgcctgagcgagctcgagatccaggtacagaagaaggacgaggaaatccttttgctacaagaggaacgggaagcactgaagatgcaactcaagtgtctgctgaaaggtaagggacaagagacttcaatgagtcctggtcgccgggagcaacttagtgatgccagcctcaagctcggccgccttagcctgcttaaggcattctcacgccacgaggaggagctccagcattggtggcaaatgcaagaggaatctgccgctccagagagagggaaggagcccgacctcggaggcggggaagaggatgaggggctagaaggagagccagacggggttgaagataccggtgcgtggggaggtgtgagccagatgggctctgtccacgaagaagggagcgaggaggaagaggaggaagagggtgatcgggatgaggatagtgaggaaagagagttacccgaggaggaggaaattccccgacgtcgcgcttcttcactcgccgaaagcttcgaggaggagctcctcgcccagttagaggaatacgagcaggttattctggacttccagtttaacttagaggctacgagaaccagatattcattagccaccggagtgattgcatccctgcagcaacaggtggattttcaggaaacacagctgcgcaagattaacacagagaatgagacgctgcagaaagagcttcgtgagcgcagacagcaactccaggctatgaccgataagttttcaaatcttcgggaggacaagaagcatcaggaaatgatgggacttatagagaaggacaatcaactgctaaggcaacaggtgagcgagttggaaaggaaattgacaaagagggactgtgtcatttccgagctggacacaaaagtgagtcagttacaggaacaagtggagcttgatcagaaccacctgcaacggtggaagcaactccaggaagacctccagtccaaaaaggagatgatccagcaggccgaacagcacacaagggtggctctcgaatcgagccagtctcgactcgagcggcttcgcaacaaaatcatccaggcgacattttcaatttctggcacaaaaagcctcgccaacgagataagtgataacgacatcctggaagcattgcagcgaatcatatcggaaagatcagactattataatcagttgaagcagaaaggagtgaaggtgccccccttgcaacagtccgaagcctttctgactagcaagtctaaaaagggtacttccaagtag

SEQ ID NO: 46346 - DNA, 486 bp, Artificial Sequence
  Description of Artificial Sequence: Synthetic coding sequence
atgcccaagaacgccatccccgtgagcaagagcaccggcttcagcaatcccgcctcccagtctacctctcagcggccgaaactgaaacgcgtcatgaaggagaagacaaagcctcagggaggcgagggcaaaggggcccagagcacccccatccaacattcctttttgacagatgtcagcgatgtccaggaaatggagaggggattgctttctctgttgaacgactttcactctggtaaactccaggcctttgggaatgaatgttctatcgagcaaatggagcacgtgagaggcatgcaggagaaactggccagacttaatctcgaactgtacggagaactggaggagctgcccgaggacaaaaggaagacagcgtcggacagtaacctcgatcggctcctctctgaccttgaggaactgaacagcagtattcagaagctgcacctggccgacgcccaggacgtgccaaacactagcgcaagctag

SEQ ID NO: 46347 - DNA, 825 bp, Artificial Sequence
  Description of Artificial Sequence: Synthetic coding sequence
atgccccgggccgagccccgggccaccctgggcgagcaggagaaggccgggctccctcttggagcatggcgcctgtatctgcttcggcatttccgcaagcagacggagctgaggagatccggaagtagagatgtgaccggcgccctgttagttgctgccgccgttgctagcgaggctgtgggaagcttgcgggttgcagagggtgggcctaacactttgcttcttcaggtgctgcgttcctggccctggtgcaacaaggagctgaagactatggaggaacgaaaagttaaacgccggtcccctaagtcattctcagcacattgtacacaggtggtaaacgccaagaagaacgccattcccgtgtcaaagtcgacaggattcagtaatcccgcgtcccagtcaacatcccaaaggcctaagctgaaacgcgtgatgaaggaaaagacaaaaccccagggaggcgaggggaagggcgctcaatctaccccaatccaacacagctttcttaccgacgtgtctgatgtccaggaaatggagagagggcttctttcactcctcaacgattttcacagtgggaagctgcaggcatttggcaacgagtgctcgattgagcaaatggagcacgtccggggcatgcaggagaagctggcccgtctaaatcttgagctctatggagaactggaggagcttcctgaggacaagcgaaaaaccgcttccgattccaatctggatcgactcctgagcgatctggaggagctgaactccagcattcagaagctccatctggcagatgcgcaggacgttccaaacacatctgcctcatag

SEQ ID NO: 46348 - DNA, 2352 bp, Artificial Sequence
  Description of Artificial Sequence: Synthetic coding sequence
atgagccaggagaagaacgagatgttcgagagcgagtggagcaaggagagagaacgggaaaagcagctagcttcaggcctggacacagctgagaaggccctaaaagtggagtcagaggagctgcagaaaagcaaaagcgagctcatttgtttgtataacgaagttcataatcttcctggtgagagtgagagtaaggaccattttctgatagcatgtgatctgcttcagcgagaaaactcagaactggaaaccaaagttttaaaactgtcgcaagagtttgcgcaactgaaccactttacactcggcggcaagactgcccccagcaatctcattacctcagaaaacacctgtaaagacccagagtcaaacgagcctattctggagaccgagattcagtctcgtaaggaggaaacggaagagctgtgcccaaagctcggggaaagaaaacagaaggagattcctgaagaaagcgtgaaggagggaagctttccgagggaggggcagaaggaagagggatcccagcaaaatagagatatgaaagacgaagagaaggaacagcagctcaccatgaaacccgaggaaattgtgagactcagggaggaactgagccacattaaccaatctctcttgcagtcccagagttctggcgactccagcgatgattccggtgcccagcacccgagctccggagaaaagctgaagtacaaccagcagggagaggtccagcagctgcaccagaacctccataggcttcagattctttgcaattcagccgagaacgaactccggtacgagaggggacagaatcttgacctcaagcaacacaacagtctacttcaagaagaaaatattaagataaaaattgagctgaaacatgcccagcagaagctcctggactctaccaagatgtgctcctctctgaccgcggaatacaaacattgtcagcagaaaataaaggaactggagttagaggtgctcaaacatactcagtccatcaaatcccagaacaatttgcaagagaaactcgtgcaggagaagtccaaagtggccgacgccgaagaaaagatcctggacctccaacgaaagttagaacacgcccataaggtatgcctgactgatacttgtattagcgaaaagcagcagctggaggaaaaaataaaggaggccacgcaaaatgaggccaaggtgaagcagcagtatcaggaagaacagcaaaagagaaaactattgtaccagaatgtcgatgagctccataggcaggtgcgcaccttacaagataaggaaaatctgctcgaaatgacctgtagtcagcagcagagtcgaatccagcagcaagaggccctgctgaaacaactagaaaatgagaagagaaagtacgatgagcatgtgaagtcaaaccaagagctatccgaaaagctgagtaagttgcagcaagaaaaagaagcgttacgagaggagtacctccgcctgctaaagttgctgaacgtgcacgttagaaactacaacgaaaaacaccatcaacagaaggtgaaactgcagaaagtgaagtatcgactcacaaatgaagtggagttgagagataaacgaatcaaccagtttgaggacgaaatcggtatacttcagcacaagattgagaaagagaaagccatacaggaccagatcaccgcgcagaatgacaccttgctgctggaaaagcgtaaactgcaagaacaagtgatcgaacaggagcaacttattcactctaacaagtggactatatcatccattcagtccagggtgctgtatatggacaaagaaaacaagcagctgcaggagaacagtctgcgtctaactcaacagatcggcttcttggagcgcatcatccgttccatacatatacgccgcggcgaaaacctaaaggagtttccagttcccaagtggtggcatagaggaaagctggcctccctccctccaacaaagaaacaaaaggagatttatagcaccgaggtttttacaagcaataacgccgagttacagcatgaagacgaatccgtacccgaagccaccgaaaaatggaaacattcggagcagatggaaactacaatttctgacatcctggagtccgaagtcgtgaacgaaattctgccacttagcaatagttcatttagtggtaagggactcgttgagagcttcgcctccctccaggagactgaagagattaaatcaaaagaggccatggcctcttcaaaatcgcctgagaaatcacccgaaaatctggtctgctcccagaactccgaggccgggtatatcaacgttgcaagccttaaggaaactcacggcattcaggagcaggaccaaaaatcagaactctag

SEQ ID NO: 46349 - DNA, 2352 bp, Artificial Sequence
  Description of Artificial Sequence: Synthetic coding sequence
atgagccaggagaagaacgagatgttcgagagcgagtggagcaaggagcgagagagagagaagcagttagcttccgggttagacacagcagagaaggcactgaaggtagaatctgaagaactccagaagtccaagtccgagctgatttgtctgtacaatgaggtgcacaacctcccaggggagtccgaaagcaaggaccacttcttgatcgcctgtgacctcctgcaacgggagaattcagagttagaaacgaaggtgctgaagctgtctcaggagttcgcacagctaaatcactttacactgggtggcaagacggcgccatctaacctgattacgtctgagaacacatgtaaggaccctgaatcaaacgaacccattctggagaccgaaattcaatctcgcaaggaggagactgaggaactttgtccaaaactcggggagagaaagcagaaggagatccccgaagagagcgtaaaagaaggatctttccctcgagagggccagaaggaagagggaagccaacagaacagagacatgaaagatgaggaaaaggaacagcagttgactatgaagcccgaagagattgttaggctgagagaggagctgtcccatataaaccaatcactgctgcagtcccaatcctccggggattcttccgacgatagcggggctcaacacccttcctcaggggaaaaactcaagtacaatcagcagggggaagtacaacaattgcatcagaatttacatcgcctacagatcttgtgtaactcagccgagaatgagttaaggtatgagagaggccagaatttggatcttaaacagcataattcccttctgcaggaggaaaacatcaaaattaagatcgagctgaaacatgcacagcagaagctgcttgattcgaccaaaatgtgttcctccttgacagctgagtacaaacattgtcaacagaagatcaaagaactcgagctcgaggtgctcaagcacactcaaagcatcaaatcccaaaacaacttgcaagaaaaactagttcaagagaagtccaaggtcgctgacgccgaggagaaaatcctggatcttcagaggaaattggaacacgcacacaaggtgtgcctaaccgatacctgcatttctgagaaacagcaacttgaagagaagatcaaagaggcaacacaaaacgaagctaaggtaaagcagcagtaccaggaggagcagcagaagagaaaattactctaccaaaatgtcgatgagctgcatagacaggtgcgtaccctccaggacaaggaaaatctgctcgaaatgacctgcagccaacaacagtcccggatccaacagcaggaggcattgctaaagcagcttgagaatgagaaacggaagtatgacgagcacgtgaagtccaaccaagagctgtctgagaagctttctaagctgcaacaagaaaaggaagccctcagagaggaatatctccggctgctcaagttgctgaatgtgcacgtgcgcaattacaatgagaagcaccatcaacagaaggttaaactgcaaaaggtaaaatacaggctgactaatgaggttgagctccgcgataaacggattaaccagtttgaagacgagatcggaatccttcagcacaaaattgagaaggagaaggcaatccaggaccagataactgcacagaatgatacactcttgctggaaaaacgcaaacttcaggagcaggtaatagaacaagaacagctgattcactctaacaagtggaccatctcaagcattcagagccgcgttttatacatggacaaggaaaataaacagcttcaagagaatagcttgcgactgacccaacagatcggattcttggaacgaattatcaggagcattcatattaggcggggagaaaacctcaaggagttcccagtaccaaaatggtggcacagaggtaagctagcgtcactgcccccaactaagaagcagaaagagatctacagcaccgaggtgtttacgagcaataatgccgaactgcagcacgaggacgaaagtgtgccagaggccaccgaaaaatggaaacacagtgaacaaatggaaaccacgatcagcgacattctcgaaagtgaggtggtgaatgaaatactacctctgtctaacagctccttctcaggcaaggggctagtggaaagcttcgccagcctccaggagaccgaagagatcaagtcgaaagaagcaatggctagttctaagtcccctgagaagagtccagagaaccttgtgtgctcgcagaactccgaggccggatatattaatgtcgcttccctcaaggaaactcacggcatccaggagcaggaccagaagtccgagctgtag

SEQ ID NO: 46350 - DNA, 1719 bp, Artificial Sequence
  Description of Artificial Sequence: Synthetic coding sequence
atgatccaccccccccggccccccaaggtgctgggcctgcagcacccgtcatcaggcgaaaaactcaaatacaaccagcagggcgaagtgcagcagctgcaccaaaatcttcacagactccagatcctttgtaactcagccgagaacgaactacgctatgaacgcggacagaacctggatctgaaacaacataactccctgttgcaggaggagaacatcaaaataaagatcgagctaaagcacgcgcagcaaaaattacttgactcgacaaagatgtgctccagtcttacggccgagtacaagcactgtcaacaaaaaatcaaggagctggaactcgaagtgttaaagcacactcagtctataaagagtcagaataatcttcaggaaaaacttgtgcaagagaaatccaaagtggccgacgctgaggaaaaaatcctagacctacagagaaagctggagcacgcgcataaggtgtgccttaccgacacatgtatctccgaaaaacaacagcttgaggaaaagattaaggaggccacgcaaaacgaggccaaggtgaaacagcagtatcaggaggaacagcaaaagcgcaagctcttataccaaaacgtggacgagttacatcgccaggtgcgaaccctgcaggacaaggagaaccttctcgagatgacatgctcccagcaacaaagtagaattcagcagcaagaggccctgttaaagcaacttgaaaatgagaagcgtaaatacgacgaacatgtgaaaagcaatcaggaactgtccgagaaactctcaaagctgcagcaggagaaggaggccctgagggaggaatatctccgccttctgaaactgctgaatgtgcacgtgcgaaactataacgaaaagcatcatcaacagaaggtgaaactgcagaaagtgaagtatcgcctgaccaatgaggtggagctgagggataaaaggatcaaccagttcgaagacgagatcggcattctccaacacaagattgaaaaggaaaaagctatccaggatcagattacagctcagaatgacactctgctactcgaaaagaggaaacttcaggaacaagtgatcgaacaagaacagctcatccattccaacaaatggacgatttcttctatccagtcacgcgtgctgtatatggacaaggaaaataaacaactgcaagagaactctttaagactgacccaacagatcggattcctggagcgaattattcggtccatacacatccgacggggagagaatctaaaggagtttcctgtgcctaagtggtggcataggggaaagcttgccagcctgccacctactaagaagcagaaggaaatctatagcactgaggtgttcacgagcaacaacgcggagctccagcatgaagatgagagcgtgcctgaggctactgagaaatggaaacactccgaacagatggagaccacgatttcagacatattggagagtgaagtggtaaacgaaatcttgcccttgtcgaattctagtttctctggcaagggtctggtagaaagctttgctagcctccaggagaccgaagagatcaaatcaaaagaggccatggcctcttccaagagccccgagaaatcgccagagaatctggtgtgctcccagaactccgaggccgggtacataaatgtggctagtctgaaagaaacacacgggatccaagaacaggaccaaaagagcgagttatag

SEQ ID NO: 46351 - DNA, 2352 bp, Artificial Sequence
  Description of Artificial Sequence: Synthetic coding sequence
atgagccaggagaagaacgagatgttcgagagcgagtggagcaaggagagagaacgggaaaagcagctggcaagcggactggatacagctgagaaagccctgaaagttgagtctgaggagctgcagaagtctaaaagtgaacttatctgcctatacaatgaggtccataatctgccgggagagtccgaatccaaagaccacttccttatcgcttgtgacctcctccagcgggagaattccgaattggagaccaaggtcctaaaactctctcaggaattcgctcagctgaatcacttcacattgggtgggaaaactgccccatccaatttaatcactagtgagaatacttgtaaggatcctgaatccaatgaaccgatcctggaaacagagatccagtccagaaaagaagagacagaggaactctgtccaaaactcggcgagagaaaacagaaggagatccctgaggagagcgtcaaagagggaagctttcctagggaagggcagaaagaggaagggagtcaacagaacagagatatgaaggacgaagagaaggagcagcaacttaccatgaaacccgaagaaattgtccggttgagggaggaactgtcccacatcaatcagtcattattacagtctcaatcatcaggtgacagtagtgacgacagcggagcgcagcacccttccagcggcgagaaattgaaatataatcagcagggtgaagtccagcagctccaccaaaacttgcacaggcttcaaatcttgtgcaacagtgccgagaatgagttgcgctatgagcggggacaaaatttggacctcaaacagcataatagtttgttgcaggaggagaatataaagatcaagatcgagctcaaacatgcgcagcagaagctccttgactccacaaaaatgtgcagctccctgactgccgaatacaagcactgccagcagaaaattaaagaactggaattggaggttctcaagcacacccagtccattaagtcccagaacaacctgcaagagaagctcgtacaggagaagagtaaggtggccgacgccgaagagaaaatcctggaccttcagagaaaactggaacacgctcacaaggtgtgcctgaccgatacctgtatctcagagaaacagcagctggaggagaaaattaaagaggctactcagaacgaagctaaagtcaagcagcagtaccaggaagaacaacaaaagcgtaagctgttgtaccagaacgtggacgaactgcaccgccaggtccgcacactgcaggataaagagaacctccttgagatgacatgttcccagcagcagagtcggatccagcaacaggaagctttactgaagcagctggagaatgagaagcgcaaatatgacgagcatgttaagtctaaccaagaactttcggagaaactatcgaagcttcagcaggaaaaagaagcacttagagaagagtacctgcgtctcttgaaactgctgaatgtgcatgttcggaactacaacgagaaacaccatcaacaaaaagtcaagcttcagaaggtgaagtaccgtctcaccaacgaagtggagttacgagacaagaggatcaaccagttcgaggacgaaattggaatcctccagcacaaaatcgagaaagagaaggccattcaagaccaaattacggcccaaaatgataccttactgttggaaaaaaggaaattgcaagagcaagtgatcgaacaagaacagctgatccacagtaataaatggacgatcagctctatccagtccagagtactctatatggataaagaaaataagcagctacaggaaaattctctgaggttaacgcaacagattggattcctcgagcgcataattaggtccatccacattaggcggggggagaatctgaaggagttcccagtgcccaagtggtggcatcggggtaaactcgcctccttgcctccaacgaaaaagcagaaagaaatttacagtaccgaggtctttacttcaaacaacgcggaactccagcacgaagacgaaagcgttcctgaagctacagaaaaatggaaacactcagagcaaatggaaacaaccatttccgacattctcgagtctgaggttgttaatgagattctgcccttgtcaaactcatcattctccggtaagggcctagttgagtcctttgccagcctccaggagacagaggagattaagagtaaggaagccatggcctcatctaagtcccccgagaagtctccagaaaacctggtctgtagccagaattctgaggctggatatatcaacgtcgcctcactgaaggagacgcatggcatccaggagcaagaccagaagtctgagctgtag

SEQ ID NO: 46352 - DNA, 120 bp, Artificial Sequence
  Description of Artificial Sequence: Synthetic coding sequence
atgagccaggagaagaacgagatgttcgagagcgagtggagcaaggagagagaaagggagaagcagctggcctctggcctggacaccgccgaaaaagccctaaaagttgaatctgagtag

SEQ ID NO: 46353 - DNA, 1104 bp, Artificial Sequence
  Description of Artificial Sequence: Synthetic coding sequence
atgggcgagcccggcccccccagcccccccgcccccaaggccgcccccggattaatcgattccttcagcgagatgaacaattacaggagagcgatgcagaaaatggccgaggacatcctgtctctgcggaggcaagcctctattcttgaaggtgaaaatagaatcctccgatctcggctggcgcagcaggaagaggaggagggccaaggaaaggcttcagaggcccaaaataccgtcagtatgaaacaaaagctcttgcttagcgagttagacatgaagaaactgcgggatagggttcagcatctgcagaacgagctgatcaggaaaaacgacagggagaaggagctcctcttgctataccaggcacagcaaccgcaggcagcactcctcaagcagtatcaggggaaactgcagaaaatgaaggccctggaagaaactgtgcgccaccaagagaaagtgattgagaaaatggaaagggttttagaggataggctgcaggaccggtctaagcccccgccactgaaccgtcagcagggaaagccctacacgggcttccccatgctgtctgccagcggcttacctctgggctcaatgggagaaaatctgcctgtggaattgtattctgtcctgctggcagagaatgctaagttacgaactgaacttgataaaaatcggcatcaacaggctcccattatcctgcaacagcaggcccttccagtggatccaggcgagctgggggcagggggagacctgactgagcgcctgcaggaaacacacggaccaggccacagcgagtgcacagagacactccctgcccaggacctgctgtccggtaccagcgacaagttcaatctactcgccaaactggagcacgcccaatcccggatcctgagcctggagtcacaactggaggattcagccagaagatggggccgcgagaagcaggacctggccacccgactgcaggagcaagagaaaggcttcaggcatccttctaattctattatcatagaacagcctgtaagtgatccaccgggagtggcgcctagggggagcggagggggagccggcagccataggacccccaaagttaccggcccttag

SEQ ID NO: 46354 - DNA, 3072 bp, Artificial Sequence
  Description of Artificial Sequence: Synthetic coding sequence
atggccttccggggccccgagccctgggtgagcgccagcctgctgaggcaacggctgaaagccgaggagaaaacactggatttagagttcgaagtgttaagtgttggttttaatgaggccggcaggtacgccttaaggctgtcggccgagaatcccctccaggtcgggtctggggccggagtccagttacaggtgaacgatggcgacccctttccagcgtgttcggccatcactgatgtgattgagcagcaggagccaggacaatccctcactttaacacgcagtaagttcatattcaccctccccaaaggattctgcaagaacgacggccagcacgacgcacagctgcatgttgaagccctgaggctggacgagcctttaggccgtgccgctcaaagggtgggcgaggctatcttccccatctacccaaggcccgaccagccccgcatgaatcccaaagcacaagatcacgaggacctctacagatactgtggcaaccttgccctattgcgggcctcaaccgatccaacagcaagacactgcgggtcattggcctattcagtggcatttcacgtacacaggggaccccagccgcccgtcagcgatagcccccccagggctggccagcctgaactaatcagtcctgaggagcccctcattgcctcacaatccactgaacccgagatcggacacctgtcaccttcaaaaaaagagacaatcatggttaccttacacggcgcaacaaatctgcccgcctgtaaggacggtagtgagccttggccctatgtcgttgtgaagtccacctctgaggaaaaaaataatcagtctagcaaagcagtcacctcggtgacctccgagcctaccagggctccaatctggggagacactgtcaacgtggagatccaggctgaggacgcaggacaggaggacgtcatccttaaggtagtggataatcggaaaaaacaggagctgctgtcgtacaagattccgatcaagtatctccgagtattccatccttaccacttcgaacttgtgaagccaaccgaaagcggaaaagctgacgaagctacagccaaaacacagctttacgccaccgtggtccggaaaagctcatttattcccaggtatatcggttgcaaccacatggccctggagatcttcttacgcggcgtgaatgagccccttgccaataaccctaacccaatcgtggttattgcccgcgtggtgcctaactacaaagagttcaaagtgagtcaagctaatagagatttagcttcagtgggactgccaatcacccccctgtcttttcctattcctagcatgatgaattttgacgtgccaagggtaagccagaacggctgtccccagctctccaagccaggaggaccccctgagcagcctctatggaaccaaagttttctgttccagggcagagatggggccacctcattttctgaagacactgctcttgtgcttgaatattactcttccacaagcatgaagggaagtcaaccctggacactcaatcaacccttagggatctcggtcttacctctcaaatcccggttgtaccagaagatgctgacgggtaagggtctcgacggcctgcatgtggaaagactgccaatcatggatacatctctcaagactattaatgacgaggcacctacagttgccctgagttttcagcttctcagctcagaacgtcctgagaatttcctgacccctaacaactctaaggccttacccacactcgacccaaagatcctagacaaaaaactgagaaccattcaggagtcctggtcaaaggataccgtgtctagcacgatggatctctcaacctcaacaccccgggaggcggaagaagagcccctggtccccgagatgagtcacgataccgagatgaataattaccgccgggcaatgcaaaagatggctgaagacatcttgtctctcagaagacaggcctccatcctggagggagagaaccgaatccttagatctaggttagctcaacaggaagaagaggaggggcaaggaaaagcctccgaggcgcagaacacagttagtatgaaacaaaaactgctcttatcggaactggacatgaagaaactgagggaccgcgtccagcacctgcagaatgaactgatacgaaagaacgacagagagaaggagttactcctgttgtaccaagctcaacagcctcaagcagcgctactgaaacagtatcaggggaagctgcagaagatgaaggcacttgaagagacggtacgacatcaggagaaggtcatcgaaaaaatggagagggttcttgaggacagactgcaagatcggagtaagcccccccccctgaataggcagcagggtaagccctacacgggcttcccaatgctttctgcctctggactgccccttggatcaatgggggaaaacctccccgtggagctgtactctgtactcctagccgaaaatgctaagctccggactgaactagataaaaaccggcaccagcaggccccaatcatcctgcagcagcaggccctgccagttgaccctggtgaactaggcgcagggggagacttgactgagcgactccaggaaacgcatggcccaggtcactccgagtgcacagagacacttcctgcccaagatttgctgagcggcacctcagacaagttcaacctactcgcaaagctggaacatgcccaaagtaggatcttaagcttagaatcacagctggaagactccgctcgcaggtggggaagggaaaagcaggatctcgctactcgccttcaggaacaggaaaaggggtttaggcacccgagtaattcaattattattgagcagcctccctactcattgccacctgcacctggcgcctcaatattcggaaagccaagagccacagtggatcctggcggctggcgtgaggaggcattccagagccgggggcaaggagacggccctttgcccgatcctgaaaaaaagcaggggcatcagcgccctgctctgctggggaataccagggaagcgtgccctttccacctgcctcagaacatttaccacgtgtag

SEQ ID NO: 46355 - DNA, 2268 bp, Artificial Sequence
  Description of Artificial Sequence: Synthetic coding sequence
atgggcctgaagaacaagaagaacaccgaggaccccgaggagcccttgattgcatcccagagtacagaacctgaaataggacacctgtccccgagcaagaaggagaccatcatggttacccttcatggagccacaaatcttcctgcttgcaaggacggcagtgaaccctggccctacgttgtagttaaaagcaccagtgaagaaaagaataatcagtcttctaaagccgtgaccagtgtcacatccgagcctactagagccccaatctggggtgacaccgtcaacgtcgagattcaggccgaagatgctggccaggaggacgtgatactgaaagttgtagacaatagaaaaaagcaggaactcctaagttataagatcccgataaagtatctgagagtgttccacccataccatttcgagctggttaagcccacggagtcaggaaaagctgatgaagcaacggcgaagacacagctgtatgctacggtcgtgcgtaaaagttcattcatccctcgctacatcggctgtaatcacatggcactggagatcttcctgcggggtgtcaacgagcctttagcaaacaatccaaatcctatcgtggtgatcgcgcgggtcgtgcccaactacaaagagtttaaggtgagccaggccaatcgcgacctggctagcgtgggcctcccaatcacacctttatcgttccccattcccagcatgatgaattttgatgtgcccagagtttctcagaatgggtgtccccagttatccaagccgggcggcccacccgaacagcctctttggaatcaaagcttcctattccagggccgagatggcgctacctctttctcggaggacacggcacttgtgctggagtattattcaagcacttcgatgaaaggttcccagccttggacactcaatcagccactgggcatttcagtcctccctctcaagtctcgactttatcagaaaatgttgactggaaagggccttgatgggctgcacgtggagcgactacctataatggacacaagcctgaagaccattaacgacgaggcacctaccgtcgccctgagctttcagttactctcatctgagcgcccagaaaattttctgaccccaaacaactcaaaggcgctgcctactcttgaccctaagatcctggataagaaacttcggacgatacaggaatcttggtctaaggatacagtatccagtacgatggatctgtctacttcaacgccccgagaagcagaggaagagccactcgtgcccgaaatgtcccatgacaccgagatgaacaactacagacgggctatgcagaagatggctgaggacatcttgagtttgagaagacaggctagcattcttgaaggggaaaacagaattttgagatcacgcctggctcagcaggaggaggaagaaggccagggcaaagcctctgaagcccagaataccgtgtctatgaaacaaaaactgcttttaagcgaactggatatgaaaaagctgcgagatagagtacagcacctgcaaaatgagttgatacgcaaaaacgatagagagaaagagctcttgctcctgtaccaggcacagcagccacaggctgccctgctgaaacaatatcagggcaaactgcagaaaatgaaggctctcgaggaaaccgttcgccatcaggagaaggtcattgagaagatggagcgggttctggaggaccgactgcaggaccgctccaagccaccacctctcaaccggcagcaggggaagccttacacgggtttcccaatgctgagcgcctctggcctgcccttgggctcaatgggggaaaatcttcccgtggaactgtattccgtcctgttggctgaaaatgcaaaactaaggactgaactggacaagaacagacatcaacaagctccaattatcctgcagcagcaggccctacctgatctgctgtcgggcacttccgataagtttaaccttcttgccaaactggaacacgcccagagccggattctctccctggaaagccagctcgaggacagtgctagacgctggggacgagaaaaacaggacctggccacaagactccaagaacaggagaaaggattccgccacccctcaaattctattatcatagagcagccatccgccctgactcactctatggatctcaaacaaccatccgaactggaaccacttttgccatccagcgactccaagcttaataagccgctctctccacagaaggagacagctaacagccaacaaacgtag

SEQ ID NO: 46356 - DNA, 1002 bp, Artificial Sequence
  Description of Artificial Sequence: Synthetic coding sequence
atgggcgagcccggcccccccagcccccccgcccccaaggccgcccccgggctcatcgactcgttctctgagatgaacaactaccggcgcgctatgcagaagatggcggaggacattctttccctacggcgccaagctagcatcttggagggagagaataggatcttgagatcccgtttggcgcaacaggaagaggaggagggacagggaaaggcgtctgaggcccagaacaccgtctctatgaaacagaaactgctcctgagcgagctggatatgaaaaaactgcgcgacagagtgcagcacctgcagaacgagctgatcagaaagaatgacagagaaaaggagctgctgcttctgtatcaggctcagcagccgcaggctgcactgctgaagcagtatcaaggcaaactacagaagatgaaggcactcgaggagaccgtgcgtcatcaagagaaagtgatagagaagatggaacgcgtgctggaggatcgcttacaggaccgatccaaacccccgcccttaaaccgacagcaggggaaaccctacaccggatttcctatgctgtccgcttccgggctaccactgggatccatgggcgagaacctgccagtagaactttactccgtgctcttagcagaaaatgctaaacttcgaactgagttagacaagaacagacaccaacaagccccaattatcttgcagcagcaggctctgccagacctactgtctgggacatcagataaattcaatttactggccaagctagagcacgcacaaagcaggatcctttctttagagagtcagctcgaggattccgctagacggtgggggagagaaaagcaggacctggcaacaagacttcaggagcaggaaaaggggttcagacaccccagcaactccatcatcatcgagcagccggttagcgacccccccggggtggcccccaggggctcaggtggtggagcgggctcccatcgaacaccaaaagtgacaggcccttag

SEQ ID NO: 46357 - DNA, 1785 bp, Artificial Sequence
  Description of Artificial Sequence: Synthetic coding sequence
atgaacttcaacgtgtggaacatcaaggagatgctgagcatccccagcgggtccgggaataagaaaagcagcaactggaataataatcagaatgattattcttccctcagcgacagccaatttctgtttggctctcagttttgtcccgagaatagcgagactctgagcgcgccactagatttcggggcacaccttcggcatagcaagcagagccagcagaactacctagaaggcgagccttcaatattcactaagtaccagaccaaaccacagctgttcggaggcgacataaaagacggagggctgtttccaccccccctaagcgtgggcaaaagtaagggattgctggaacaatttgaggagaagaagaaaagagctaaggataagtgcgactcagagacgctgtataactttgtttcaaatgtgagagagtctatcctccggctgcagaccagtgtcgagaaaagcgaggatcacctgtccagccggagccagagcatccttgactcgttagagaccgtggcaaaaacgcttcaggaaacaattcaagcacaaaacgacctcgtttttgaggccgtccaggacaagggcaacatggaacaagcgatcctggagatgaaaaagcggttcgaggcaagacagggagagtttatcgagatgaagtcgaatctgaagcaccttgaagtcctggtggcccagcagtcacaggagttccagcaactctgtgagcagttagggcagcttaacgtgccatctgtcctggcagaacttaagcgtctcatctcggtccccccggtgaaagatagcgctagtcagactagtcctccattggcccaaagcctgaacctcacccggcaggaaaagtatacctccgaaaaacctgtgttgtggcaggcccaggcactgccagcggcctggaaccctgggatgggatcactgcaacctggggagttcgacgtttggggcgagggagcgaaaaacgatgacctgcaggaagaggccgccctgccggcgttcggctcccatgaaagaaataggcacgtgaaggacaaagtcgtccagacgaattgtaagaactgggcggtgactaagaccggggccaagaaccatggcagttcagtcccaggccacaaaataccgtccgatcgggacttggtgtcccaaggggcaagccagttgaccagcttggagattaatttctccacctctattaaaaatgcctgccaaaagtatcaggctcagagcatgtttttgtgtgaccctcgggagcatttggtaattaaacagaaggatgggaccgtggagatgcgcggcaaggataagaagcagcagccgaggaaagcacatagggcccacagagggcgcctcatcgccagcaaacaaaagcagatccctattcagacatgtaaatttaacagtaagtatcagtctccacagccggccattagcgtcccccagtctccttttcttggacagcaggaaccacgagcccagcccctgcatttgcagtgcccaagaagccctagaaagccagtgtgcccaattcttggcgggactgtgatgcctaacaagacggtgagagccgtgcagggtcggctgctgcaactgagcagatgctcgagccaggacaattggctgctgtctagctccagccaaggggaccaccagatgtcatggttctcagatctgaatctaggatgctccgagacacccctctgcaaagaggccgggaagaaccttctatacgatctgggatttgactccagcgacgatgatggcttctag

SEQ ID NO: 46358 - DNA, 1725 bp, Artificial Sequence
  Description of Artificial Sequence: Synthetic coding sequence
atggcccgggtggacgccaaggccaaggaggccccccgggccagcgagggttgtcagcacgctgtcacctcgcagagaaataagaagagttccaactggaataacaaccagaacgactatagttctctgagcgattctcagtttttgtttggaagccagttctgtcccgagaactctgagacattgtcagctccactggatttcggtgcacaccttagacacagtaaacagagccagcagaactatctggagggtgagcctagtatcttcacgaaataccagactaaaccccagttcgaagagaagaagaagcgcgccaaggacaagtgtgatagcgagacactttacaactttgtctcaaatgtccgagagtccattctgaggttacagacttccgtggagaagtcagaagatcacctctcttcccggagccagtccatcctcgatagcctggagacagttgctaaaaccttgcaagaaaccatccaggcccagaacgacctggtattcgaggcggtgcaggataaaggcaatatggaacaggctatactggagatgaagaaacggtttgaggcaaggcagggcgagtttattgagatgaaatcgaatttaaagcacctggaggtacttgtcgcacagcagagccaggagtttcaacagctgtgtgaacagctggggcaactgaacgtgccgtccgtactcgctgagttgaaacggctgatcagtgtgcccccagttaaagattctgcctctcagacaagtcccccactcgcccagtctctaaatctgactcgacaggagaagtacactagcgagaaaccagtcttgtggcaggcacaagccttgcctgctgcttggaacccagggatggggtcgctgcagccgggagaattcgatgtttggggggaaggcgccaaaaacgacgatctgcaggaagaggctgccctgccagccttcggctcccatgagagaaacagacatgtgaaagataaagtggtccaaacaaactgtaagaattgggccgtgactaaaaccggcgccaagaaccatggctcgagcgttccgggacacaagataccctctgatcgggacctggtcagccaaggggctagccagttgacctcgctggaaatcaacttctctacgtcaatcaaaaacgcttgccagaagtatcaggctcagtccatgttcctgtgcgatccacgggagcacttggtgattaaacagaaagatggaactgtggagatgcgcgggaaggacaagaagcagcagccacgtaaggcccacagagcccaccgcggtcggctgatagccagcaaacagaaacaaattcctatccagacttgcaaattcaattccaagtatcaaagtccacagcctgccatctccgtccctcagagtccatttttggggcaacaggaaccaagggctcaaccgctccatctccaatgccccagatctccacgaaagcctgtgtgccccattttgggcggcactgtcatgccgaacaagacagtccgcgccgtgcaaggcaggctcctgcagttgtcccggtgctcttctcaggataactggctcctatcttcttcgagccaaggtgaccatcagatgagctggttcagcgatctcaatttgggttgcagcgagactccactgtgcaaagaggctggaaagaacctcttgtacgaccttgggttcgatagctctgatgacgatggtttttag

SEQ ID NO: 46359 - DNA, 612 bp, Artificial Sequence
  Description of Artificial Sequence: Synthetic coding sequence
atgaacttcaacgtgtggaacatcaaggagatgctgagcatcccctctgggtccggtaataaaaaatcatccaattggaataacaaccagaatgactactcttccctatctgatagtcagtttttatttggttcccaattttgccctgagaacagtgaaaccctgtctgccccacttgactttggtgcccacttaagacactccaagcagtcacagcagaactatctggaaggcgaacccagcatttttaccaagtaccagacgaagccgcaattgttcggcggagatataaaggacgggggcttattcccaccgccattgagtgtgggcaaatcaaaggggctgctcgagcagttcgaggagaagaagaagcgagctaaggataaatgtgatagctgccgcaggctctggaagtcacttcgcactatcagcgttcaggaggctaatctcttctggatcttgtggaggctatggccccgccatgtatctgcttcatgtctgcgataccagcagagggcattggtaaacgacgaacatgagttgagcgatcccagccttgtgtccagcggagaagtgccacatcgggtctccgacgaacgcatgggtatctag

SEQ ID NO: 46360 - DNA, 1785 bp, Artificial Sequence
  Description of Artificial Sequence: Synthetic coding sequence
atgaacttcaacgtgtggaacatcaaggagatgctgagcatccccagtggaagtgggaataagaagtcttccaattggaataacaaccaaaacgattacagttcactgagcgacagccagttcctgtttggctcacaattttgccccgagaactccgagacattgagtgcgcccctcgactttggagcccatctcaggcacagtaaacagtctcagcaaaactacctggaaggcgagccttctatatttacaaagtaccagacaaagccacagttattcgggggtgacatcaaagacggcgggctgtttcctcctcccctgagcgttggaaaatctaagggcctgttagagcagttcgaagaaaagaaaaagagagccaaggacaagtgcgattcagagacattgtacaacttcgtcagcaatgtgagagaatctatcctgaggttacaaacctctgtggaaaagtcagaggaccacttaagctctaggagtcagtctatccttgatagtctagagacagtggccaagacgctgcaggagacgattcaggctcagaacgaccttgtgtttgaagcggttcaggataaaggcaacatggaacaggctatactggagatgaaaaaacgcttcgaggcgcgccagggcgaattcatcgagatgaaatcaaatctgaaacatcttgaagtgctggtcgcccagcagtcccaggaattccagcaattatgcgaacagttggggcagctcaacgtcccatctgtcctcgcggaattgaaacgactcataagcgtccccccggttaaagactccgctagccaaacgtctcctcctctggcccaaagccttaacctgactcgacaagaaaaatacacaagtgagaaacctgtgctgtggcaggctcaggccctcccagctgcgtggaatcctggaatgggctctctacagcctggtgaattcgacgtgtggggagaaggtgctaagaacgacgacctgcaggaagaagcggccctccccgcgtttggcagtcacgagcggaaccggcacgtcaaggataaggttgtgcaaacaaactgtaaaaattgggcagtgacaaaaacaggtgccaagaatcatggatccagcgtgccagggcataaaatcccatcagatcgcgacctagtatcccaaggcgcatcccagctcacatcactcgaaattaatttctctacctctatcaagaacgcctgtcagaagtaccaggcacagtcaatgttcttgtgtgatcctcgggagcatcttgtgattaaacagaaggatggaacagtggagatgcgcggaaaggataagaaacagcagccaaggaaagcgcaccgcgcgcacagaggccgtctcattgcctccaaacagaaacagatccccattcagacctgcaaattcaacagcaagtaccagagcccccagccggccatttctgtcccacagagtcctttcctgggacagcaagagcccagagcccagcctttgcatcttcagtgcccaagatccccccgcaaacctgtttgtcccatattgggcggaaccgtgatgccaaataaaaccgtccgggctgttcaggggcgcctgctgcagctctcccggtgcagctcccaagacaactggctcctgtcatctagttcacagggcgaccaccagatgtcctggttttccgatctgaacctaggctgcagcgagacacctctctgcaaggaggccggaaaaaacctgctctacgacttaggattcgactcgtcggacgacgacggtttttag

SEQ ID NO: 46361 - DNA, 582 bp, Artificial Sequence
  Description of Artificial Sequence: Synthetic coding sequence
atgctgagcacccccaagagccagggcaacaagaagagcagcaactggaataacaaccagaatgattattctagcctctccgactcacaattcttatttggctcccagttttgtccagagaattctgaaactctctctgcgccgctggactttggtgcccatctgcggcacagcaaacagtcccagcagaactatctggagggcgaaccaagtattttcacaaaatatcagaccaaaccccagctgtttggaggcgatataaaggacggaggactgtttccgccacctctttcagtggggaagagtaaaggactgctggagcagttcgaagagaaaaaaaaacgagccaaggacaagtgcgactcttgtcgacgattatggaagtccctgcggacgattagcgtgcaggaggccaacctgttctggatcttgtggagactgtggcccaggcacgtctctgcctcttgcctgcgttatcagcagcgggcactggtgaacgacgagcacgagctaagcgatccaagtctcgtgtcatccggggaagtgcctcacagggttagcgacgaaaggatgggaatatag

SEQ ID NO: 46362 - DNA, 1785 bp, Artificial Sequence
  Description of Artificial Sequence: Synthetic coding sequence
atgaacttcaacgtgtggaacatcaaggagatgctgagcatccccagtgggtctggcaataagaaatcctcaaactggaataataatcagaacgattatagcagcttgtccgattctcaattcctctttggttcccaattttgccccgaaaatagtgaaaccctgtctgccccgcttgacttcggtgcacatcttcgccatagtaagcagtcacagcagaattacctcgagggagagcccagtatctttacaaaataccaaactaaacctcagctcttcggaggcgacataaaggatggcggcctgttccctccccccctgtcagtcggtaagtcgaaaggcctgcttgagcaattcgaggagaaaaagaagcgggctaaagacaagtgtgactcagagactctctacaacttcgtgtccaacgtgcgcgagtcaattctccgcctgcagacaagtgttgagaagagcgaggaccatctgagctctcggagccagagcattcttgatagtttggagactgtggcgaagaccctacaggagacaattcaggcacagaacgacctcgtctttgaggccgtacaggataaggggaatatggagcaggccatccttgaaatgaaaaagagattcgaggcccgtcagggcgaattcatcgagatgaagagcaacctcaaacatctggaggtgctggtcgcacagcagagtcaggagttccaacagctgtgtgaacaacttgggcagctcaacgtgcctagcgtgcttgcagagctgaaacggctcatcagtgtccctccggtgaaagacagcgctagccagacaagtccgccgctggcccagtccctgaatctaactcggcaggagaaatacacaagtgaaaagcccgtactgtggcaggcccaggccctgcctgccgcgtggaacccgggcatgggatctctacaacccggggaattcgatgtgtggggagaaggagctaaaaatgatgacctccaggaggaggcggcactccccgccttcggcagccacgaaagaaatcgccacgtgaaggataaagttgtgcagactaactgcaagaattgggccgtgacgaaaactggagctaagaaccacggcagtagtgtacctggacacaagattccctctgaccgcgatctagtttcacagggagccagtcagctgactagcctcgagattaacttttcaacatccataaagaatgcctgccagaaataccaggcccagtcgatgttcctgtgtgaccctcgcgagcatctggtcatcaagcagaaagacggcaccgtggagatgaggggaaaagataagaagcagcagccaaggaaggctcatagggcccatcggggtagactgatcgctagtaaacagaaacagatccctatccagacctgcaagttcaattcaaaataccagtcgccgcagccagccatctctgtacctcagagtccattcttaggccagcaggaaccgcgggcccaacctttgcacctgcagtgcccacgctcgccacggaaacccgtctgtcctatactaggcggtacggtgatgcccaataagaccgtgcgcgccgtacaaggccgcttactccaactgagccgctgttcctcacaggacaactggctgctttcatcttctagccaaggagaccatcagatgagctggttctccgacctgaacctgggttgcagcgaaacacccctatgcaaggaagccgggaagaaccttttgtatgatctgggctttgacagcagtgatgacgatggattctag

SEQ ID NO: 46363 - DNA, 1836 bp, Artificial Sequence
  Description of Artificial Sequence: Synthetic coding sequence
atgagcgagatccccagcaccatcgtgagcaagaacatgaccaacgacaagaacagtctcgagtccatgaacatttcctcatcttccagcacggaggaaaatccgaagaagcaggctaggaaaaacgaggaacacgggcctgatccatcagcaaatccgtttcacttatcaggagacgtggatttcttcctgctgcgggaccaggagaggaacaaggcattgtctgagcgacagcaacaaaaaacgatgcgtgttcaccagaagatgacatactcctcaaaggtctcagccaagcatacctcactgcgacgacagcttcagctcgaagacaagcaggaggacctcgaagcccgcgcagaagcagaacaccagagggcctttagagactacactacctggaaactgaccctgacaaaagaaaaaaacgtcgagccggaaaacatgagcggatatattaagcaaaaaaggcagatgtttttgttgcaatacgcattggatgtcaaacggagggaaatccaaagactggagacattggcaaccaaagaggaagcacggcttgagagggctgaaaagagccttgagaaagatgctgcgctgtttgacgagtttgtccgtgagaacgattgctcttctgtacaagccatgcgtgccgccgagaaggagaccaaggctaagattgagaagattctggagatcagagacctgactacacaaatcgtcaacattaagtccgaaatttcccgatttgaggatactctcaaacattataaagtgtacaaggatttcctttataagctcagtccgaaagaatggctggaagagcaggaaaaaaaacactcattccttaagaaagctaaggaagtcagtgaagcgtcgaaggagagttccgtcaactccacaccaggcgataaggggcctggtattaaaggcaaggctagttctatgtgggccaaggaagggcaaggaaccaagaaaccctggcgcttcttacagactatgcggctcggcaggtctccttcttacctaagttcaccacagcagggatcacagcctagtgagtcctcaggcggtgacagcagagggtccaacagcccaattccacctacacaggaggatactgattctgacggagaagaaccacagctttattttaccgagcctcaacagttgctggacgtgtttcgcgaacttgaagagcagaatctcagtctgattcagaatagccaggagacggaaaaaactctggaggaattgtctcacactctgaagcatacgcaaatcaggatggatagagaggtgaaccagctcaagcagtgggtgacaactatgatgatgtcaataacaaaagaggaggatacagcagcagaactcgagctcaaggccagagtatttcactttggggagtacaaaggcgatcagcaggacaagctgttggagtctctcaattgcaaggtgttggacgtgtaccgccactgtacagggacacagcaggaggctaacctggggacagtgcagatgctgactatcatagagcaccagctagacgagctattagagaacctcgaacatgtgcctcaggtaaagattgagcaggccgagcgcgctaaggagaaggaacgccggatccggcttagggaggagaaactgcagatgcagaaaatcctccaggaggaacatttacaacgggccagagctcgcgcgcaggccgagatcaagaaaaagcggggcagaaccttagtctgcaggtctagacctcccgcccatagaattaaacagcagagtgaacacactctcatggataaagaggaagaagaactgctgtttttctttacatag

SEQ ID NO: 46364 - DNA, 1839 bp, Artificial Sequence
  Description of Artificial Sequence: Synthetic coding sequence
atgagcgagatccccagcaccatcgtgagcaagaacatgaccaacgacaagaattcactggagtctatgaacattagctcctccagctctactgaggaaaatcctaagaagcaagcccgcaaaaacgaagagcacggtcctgacccttccgccaacccattccacctgtcgggcgatgtggattttttcctgttgcgggaccaggaacggaacaaagccctgagtgagagacagcaacagaagactatgcgcgtgcaccagaaaatgacttactccagtaaagtgagtgctaagcacacaagtctgcggaggcagctacagctcgaagacaagcaggaagacttagaggctcgggccgaggcagaacatcagagagcctttcgcgactatacaacgtggaagctcaccctcaccaaagccgaaaaaaacgtggagcctgaaaacatgtccggatatatcaaacaaaagcgccagatgttcttactgcaatacgctctcgacgtgaagcgtagggaaatacagagactagaaaccctggctactaaagaagaggctcgtctggagcgggcggaaaagtcgctggaaaaggatgcagctctttttgatgagttcgttcgcgagaacgactgttcaagtgtccaggccatgagagcagcggaaaaggaaacgaaggcgaaaattgaaaaaattctcgagatcagggatctgacgacccagatcgtgaacattaagtcagaaatctcaagatttgaggataccctgaagcactacaaggtctataaggactttctgtataagctgtcccctaaagaatggctggaagagcaggaaaaaaagcatagctttctcaaaaaggccaaagaggtgagcgaagcctcaaaggagagctcagtgaattcaacgcccggggataaaggccctggcatcaagggaaaggccagctcgatgtgggcaaaggagggtcagggcaccaagaagccttggcggttcttacaaacaatgcgcttaggccggtctccctcctacttgtcctcgccccaacagggatcacagcccagcgaaagtagcggaggggatagcaggggttctaactcaccaattcccccaacccaggaggacaccgattccgacggcgaagaaccacaattatattttacggagccacagcagctccttgacgttttcagggagctggaggagcagaatctgtctctgatccaaaatagccaagaaaccgaaaagacccttgaagaattgagccacaccctcaagcatacccaaattcggatggacagggaggtaaaccaactgaaacagtgggtgaccacaatgatgatgtccattacaaaggaggaggacaccgccgccgagctcgagctgaaagcccgtgtgttccacttcggagaatacaaaggggatcaacaggacaagctcctggaatccctcaattgtaaggtgttggacgtttatagacattgcaccggtactcagcaggaggcaaacctggggaccgtccagatgcttaccatcattgaacatcagctagatgagttgttagagaatcttgagcatgttccccaggtgaaaattgaacaggccgagcgagcaaaagaaaaagaaagaagaattaggcttagggaggaaaagttacagatgcaaaagatcttgcaagaggaacacttacaaagagcacgggctcgagcccaggctgaaatcaagaagaaacgaggaagaacgcttgtgtgcagatccaggccacctgctcaccggattaaacagcagagcgagcacaccttgatggataaagaagaggaggaactccttttcttctttacttag

SEQ ID NO: 46365 - DNA, 1692 bp, Artificial Sequence
  Description of Artificial Sequence: Synthetic coding sequence
atgagcagcaacctgctgcccaccctgaacagcggcggcaaggtgaaggacggatcaacaaaagaagatagaccatacaaaattttttttcgggacctttttctggtcaaggagaatgaaatggctgcgaaagaaacggaaaaatttatgaataggaacatgaaagtgtaccaaaagacaaccttctcgagcagaatgaaatcacattcatatctaagtcagcttgccttctatcccaaacggtcaggtcgttcgttcgagaagttcggccccggcccagcgcctatcccccgactaattgagggaagcgatacaaagaggacagtgcacgaatttatcaatgaccagagagatcgctttcttttagagtacgcgttgagcaccaaaagaaacacaatcaaaaaatttgaaaaggacatcgcgatgcgggaacggcaacttaagaaggcggagaagaaattgcaagatgacgcgctggctttcgaggagttcctgagggaaaacgaccaaagatcagtggatgctctcaagatggctgctcaggaaactatcaacaagctccagatgactgctgagttgaaaaaagctagcatggaggttcaggcagtaaagtcagagatcgccaaaactgaattcttactgcgggaatacatgaagtatggttttttcctcttgcagatgagtcccaagcattggcaaatacagcaggcactcaagcgtgcccaggcctccaaaagcaaagctaatataatactacccaaaatcctggccaagttgagtctacactcatccaacaaggagggcatcctggaggagagtggcaggaccgctgtcctgtccgaggatgctagccaaggacgtgatagccagggcaagccctcccgatctctgacccgcacccccgagaaaaaaaagtccaacctggccgaatcctttggttccgaagatagccttgaattcctgctcgacgacgagatggacgtcgatctagagcccgccctgtattttaaggaaccggaggagctcttgcaggttctgcgtgaactggaagagcagaacctcaccctgtttcagtactcccaggatgttgacgagaatttggaggaagtgaacaaacgggagaaggttatacaggataaaacgaatagtaacatcgagttcctgctggaacaggagaagatgctcaaagcgaattgtgttagggaggaggagaaagcagccgagctgcagctcaaatccaagctattctcctttggtgaattcaactccgacgcccaggagatcctgatcgactctttgtcgaaaaagatcacccaggtctacaaagtgtgtataggggatgcagaagacgacggactgaatccaatacagaaactggtaaaggtcgagagcaggctggtagagctttgtgaccttattgagagcatccctaaggaaaacgttgaggctatcgagagaatgaagcagaaagagtggagacagaagtttcgggacgagaagatgaaagaaaaacagcgccaccagcaggaacgattgaaggctgcactggagaaggctgtggctcaacctaaaaagaaattagggaggcgtcttgtgttccattcaaaacctccgtcgggtaataagcagcagctgccacttgtgaacgagactaagactaaaagccaagaggaggagtatttttttacatag

SEQ ID NO: 46366 - DNA, 2106 bp, Artificial Sequence
  Description of Artificial Sequence: Synthetic coding sequence
atggtggtgagcaccttcaccgacatggacaccttccccaacaacttcccccccggaggcgattctggcctgaccgggtctcagtcagaatttcaaaagatgcttatagacgagagattacgatgtgagcatcataaagccaactaccaaaccctgaaggccgagcatactaggctccaaaatgagcatgtcaagttgcaaaatgaactcaaacacctctttaacgaaaaacagactcagcaggagaagctgcaacttctgttggaggaactaaggggtgaactggtcgagaagaccaaggacctcgaagagatgaagctgcaaattctcacacctcagaagctggaactgttacgggcccagatccaacaagaactcgaaacgccaatgcgggagagatttagaaacctggatgaggaagtggaaaaatatcgtgccgtttacaacaaactgcgttatgagcatacttttctcaaaagcgaattcgagcatcagaaggaggagtatgcgcgcatcctggacgagggaaagatcaagtatgaatctgaaatcgcgagactggaagaggacaaagaggaactcaggaatcagctgttgaatgtcgatttaaccaaggattccaagagggtggagcaacttgcaagagaaaaagtgtacctgtgccaaaagctgaaaggtttggaagctgaagtggccgagcttaaggctgaaaaggaaaactctgaggcccaggttgagaatgcccagagaatccaggtgcgccaattggccgaaatgcaggccactgtccgctcactagaagccgagaaacaatccgcaaacttaagagccgagagactagaaaaagagctgcaatccagcagtgaacagaatacgtttttaattaataagttgcacaaagcagagcgcgagatcaacaccctgagttcgaaggtaaaagaactgaaacatagtaacaaactggagatcacagatatcaagctggagaccgctcgcgccaagtcagaacttgagagggagcgtaacaaaattcagtccgaattagacggcctgcagagcgataatgagattcttaaggcagcagtcgagcatcataaagtgctgttggtggagaaagaccgggagctgatcaggaaggtgcaggccgcaaaagaggagggatatcaaaagctggtcgtgcttcaggatgagaagcttgaactagaaaacaggctggcagatttagaaaagatgaaagtcgaacacgacgtgtggaggcaatctgagaaggatcagtatgaagagaaactgcgagcgtctcagatggcggaggagattactcgaaaggagctgcagtctgtccgacttaaactccagcagcaaatagtgactatagagaatgcggagaaggaaaagaatgaaaacagtgacctcaagcaacagatctcaagtctgcaaatccaggtaacctccctggcccaaagcgagaacgacctgctgaactctaatcagatgctgaaagaaatggtggagaggctgaagcaggagtgccgaaattttaggtcccaggctgaaaaggctcaactggaagcagaaaagacactggaggaaaaacagattcagtggctggaggagaagcataaactgcatgaaagaatcaccgatcgagaggagaaatacaatcaagccaaagagaaactccagagggccgccattgctcagaaaaaaagaaaatcattacatgagaacaagttgaagcgcctgcaagagaaggtggaggtcttagaagccaagaaggaggagctcgaaaccgaaaaccaagtgctgaaccggcagaatgtgccatttgaagattacaccagactccagaaacgactgaaagatattcagagaagacacaacgagtttcgaagtctgattctggttcccaacatgcctccaaccgcctctatcaacccagtcagctttcagtcctccgcaatggtgccctctatggagctgccgtttcccccccacatgcaggaagagcagcaccaacgcgagctctcactcttgcgcaagagactggaagaattagagaccacacaacgcaagcagctagaagagctgggtagctccggagagtag

SEQ ID NO: 46367 - DNA, 1707 bp, Artificial Sequence
  Description of Artificial Sequence: Synthetic coding sequence
atgctgatcgacgagcggctgcggtgcgagcaccacaaggccaactaccagacactgaaggcggaacatacacgcctccagaatgaacacgtcaagttgcaaaacgaactaaagcatctgttcaatgagaagcagacccaacaagaaaaactgcagctactgcttgaggaactccgaggagagttagttgaaaagaccaaggatcttgaagaaatgaagttgcagattttgactccccagaagttggaactgttgagggcgcagattcaacaagaattagagacacccatgagggagcgatttaggaatcttgatgaagaagttgagaaatatagggctgtgtacaacaagctaaggtacgagcacactttcttgaagtcagagtttgagcaccaaaaagaagagtacgcacggatcctggacgaaggcaagatcaagtatgaatctgaaattgccaggcttgaggaagataaagaggaactgcggaatcagttgctcaatgttgatctgacaaaagactcaaagcgtgtggagcaattggctcgagagaaagtctacctgtgtcaaaagctcaagggcctggaggctgaagtggccgagctaaaggcggagaaagagaactcggaagctcaggtggaaaatgcccagcggatccaggttcgtcagctagccgaaatgcaagccactgtcagatcactggaagcggaaaaacagtcagctaatcttcgtgctgaaaggcttgaaaaagaattgcagtctagctctgaacagaatacttttcttatcaataagttacacaaagcagagcgcgagattaacaccctcagctcaaaggtcaaagaactgaaacactctaataagctggagattactgatatcaagcttgaaaccgctcgcgccaagtcggaactggaacgcgagagaaataaaatccagtccgagctggacggactccagagcgacaacgagatcttaaaggcagccgtggagcaccataaggtgcttctcgttgagaaagacagggagctgatcaggaaggtgcaggctgcaaaggaggaaggctatcaaaagctggttgtactgcaagatgagaagttagagttagaaaacaggcttgctgaccttgaaaagatgaaggtggagcacgacgtctggcggcagagtgagaaggatcagtacgaggagaagctgcgggcctctcagatggccgaagagattaccaggaaggagctgcagtccgttagactgaaattacagcaacaaattgtcacgattgagaatgctgagaaagaaaaaaacgaaaatagtgatctcaagcagcagatatcaagtttgcagatccaggtgaccagccttgcccaatcagagaacgacctgctgaactcaaatcagatgttgaaagaaatggtggaacggctgaaacaagaatgcagaaactttcgcagccaggcggaaaaggcacagctggaagccgagaaaacacttgaagaaaagcagatccagtggttggaagagaagcacaagctgcacgaacgtatcactgaccgggaggaaaaatacaaccaagcaaaggagaagctccagcgagctgcgattgctcagaaaaagttggaacaggaccttgagctgggatgtccctctgtcacggatacataccgggagtcagtgtttcccccacctccactgaagcgcgatctcctcaagtag

SEQ ID NO: 46368 - DNA, 2106 bp, Artificial Sequence
  Description of Artificial Sequence: Synthetic coding sequence
atggtggtgagcaccttcaccgacatggacaccttccccaacaacttcccgccaggaggcgattccggactcacaggatcccagagcgagttccagaagatgttgattgacgagaggctgaggtgtgaacatcacaaggcaaactaccagactctcaaggcagagcacacacggctgcagaatgagcacgtgaaactgcagaacgagctgaaacacttattcaacgagaagcagacccagcaggaaaagttacagctactgcttgaggagctgcgaggcgaattggtagagaaaactaaggacctggaggagatgaagctccagatcctcaccccccagaaactggaactgttacgggctcaaatccagcaagagctggaaactcccatgagggaacgatttcgcaacctggatgaggaggtcgaaaagtacagagcggtgtacaacaagcttcggtatgagcacacttttcttaagtcggaatttgaacatcagaaggaggagtatgcccgcattctagacgagggcaagataaagtatgagtccgaaatcgctcggctggaggaggataaagaagagttgcgtaatcagctgctgaacgtggacttaaccaaagactccaaacgtgtggagcaactcgctagagagaaagtttatctgtgccaaaaactgaaggggcttgaggccgaagtcgccgaactgaaggccgagaaggagaattccgaggcccaggtcgaaaatgcgcagagaatacaggtgaggcagcttgccgagatgcaggctacagtaagatctctggaagccgaaaagcagagcgctaacctgagagcggagcgtttggaaaaggagttgcagagctcgtcagaacaaaacaccttcttgatcaacaaactgcacaaggctgaaagggaaatcaatacactgagtagcaaggtgaaagagctcaagcatagtaataaattggaaataaccgatattaaactagaaaccgctagggcgaaatcggagctggagagggagcgcaataaaattcagtccgaattggacggcctacagtccgataacgaaattttgaaggccgccgttgaacaccacaaggttctcctcgtggaaaaggatcgcgagctgatccgcaaggtccaggctgctaaggaggaagggtaccagaagctagtcgtactgcaagacgagaagctggagctggaaaaccggttggccgatttagaaaagatgaaggtagagcacgacgtctggcgtcagtccgagaaagaccagtatgaggaaaagctgagggcttcacagatggctgaggagatcaccagaaaagagctacaatctgtgaggttgaaattacagcagcagattgtgacaattgaaaacgcagaaaaagaaaaaaacgagaattccgacttgaagcagcagatctcctccctgcagattcaagttaccagcctggcacaaagtgagaatgatctcctcaactcaaatcagatgcttaaagagatggtggaacgtctcaagcaggagtgccgaaatttccgatcgcaagccgaaaaagcccagctggaggcagaaaagactctagaggaaaaacagatccagtggcttgaagagaaacacaagttgcacgaacggataaccgacagagaagagaagtataaccaggccaaggagaagctccaaagagcagccattgcacaaaaaaagcgtaagtcactgcacgagaataaactgaaacgtctgcaggaaaaagtcgaagtgttagaggccaaaaaagaggaactagagacagagaaccaagtcctgaataggcagaacgtgcccttcgaggactatacccgccttcagaagaggctgaaggatattcaaaggagacataatgagtttaggtcgcttattttggtgccaaatatgccgcccactgcttctatcaatcctgtgtcgttccagtcttccgctatggtgccctctatggagctgcctttcccaccacacatgcaggaagagcagcaccaacgcgagttgtctctcctgagaaagcgcttggaggaacttgaaactacgcagagaaaacaacttgaggagcttggctccagcggcgaatag

SEQ ID NO: 46369 - DNA, 9 bp, Artificial Sequence
  Description of Artificial Sequence: Synthetic coding sequence
atggtgtag

SEQ ID NO: 46370 - DNA, 951 bp, Artificial Sequence
  Description of Artificial Sequence: Synthetic coding sequence
atgagcctgggcatcatggaggaggaggacctggccgagtacttccgactccagtacggggagagattgctgcaaatgctgcaaaagctccctaatgtcgaaggagccagtgagtccccctctatctggctgctggagaagaagaaggaaaccgagatcatgcatcagacaatggtccaaaaaaaaaagatgtttcagcgccggatggaaaccctgaatctccgttgggaagagctgggcgtgaaggaggcccagcttaaggcccacatacagaaatccgagcagttcattcaggaaaacgatcagaagaggattcgtgcaatgaaaaaggcaaacaaggaaagagaacttaagtgccagcacatgcaagaactcaccaaacggaagcaagagatggtggccctccgactggaacaccagcgcctgagcgctaaattaaaagattactatatatttaacaagtatttggagaaggtcgtagaaaatagtgaatttgaggagatccacgaagtgatcgccagatacaagactcttgtgtctatgagacacgacctgatgcagagcgcccaggagggacaggagaagatcgagcgtgctaaggcacggttggcccgttacatggaagagaaagacgacgaaattctccagcagaataatgagctagcccggttgcaaatgcgctttgatcgcgctcgatccaacgtcattttttgggaatcacgttgggcgcatatccagaacaccgcagcaaaaaagacactactgctcggcaccatcaagatggctaccttaaacctgtttcagatcgtgtccaaacatctgaaagaggtcacggaggtggctctggaagatactcacaagcagctggatatgatccagcaattcatacaggacagatcagatatctgggcggaagtgaaaaagaaggagcagcaaagggtgcgaatatag

SEQ ID NO: 46371 - DNA, 729 bp, Artificial Sequence
  Description of Artificial Sequence: Synthetic coding sequence
atgagcctgggcatcatggaggaggaggacctggccgagtacttcagactgcagtacggcgagagactgctgcaaatgcttcagaagctgcccaacgtcgagggcgcttcagagtcgcccagcatttggttactggaaaagaagaaagaaaccgaaatcatgcatcagactatggtacagaaaaaaaagatgtttcagcgtagaatggaaaccctcaatctacgatgggaggaattgggagtgaaggaggcacagctgaaggctcatatacagaaatcggaacagtttatccaagaaaacgatcagaaacgaattagggccatgaagaaagccaataaagagagagagctgaagtgtcaacacatgcaagaattgacaaagaggaaacaggaaatggtggcgctgagactcgagcatcagaggctctctgctaagctgaaggactactacatttttaacaagtatttggaaaaggtggtcgaaaactcagaagagtcccggtgggcgcatatacagaataccgccgctaagaaaactctgctgcttggaactattaagatggctacattaaacctgttccagatcgtgtccaaacacttgaaggaagtgactgaggtggctctggaagatacccataaacagctggatatgattcagcagtttattcaggatagatctgacatttgggcagaagtaaaaaaaaaggagcagcaaagggtgaggatctag

SEQ ID NO: 46372 - DNA, 927 bp, Artificial Sequence
  Description of Artificial Sequence: Synthetic coding sequence
atggccgtgccctgggaggagtacttccggctggccctgcaggagaaactgagtactaaattgcctgagcaggcagaggatcacgtcccccctgtgttacgactgctggagaagcggcaggagctggtggatgcggatcaggctttgcaggcccagaaagaagttttcaggactaagaccgcagctctgaagcagcgctgggagcaactcgagcagaaggagagggaacttaaaggatcatttatcaggttcgataagttcctgcaggattccgaagcacggcgaaatagagcccttcgccgtgccgccgaagaaaggcatcaagctggaagaagggaggtcgaagctcttagactatggacccagctgcaggagcttaggcgcgagcacgccaggctgcagcgacggctcaaacgccttgaaccatgcgctagactcttggagcaggccctcgagctgttgccgggtttccaagaggtgccagaactggtggcaagatttgatgggcttgccgaaacccaggcggcactgaggctcagggagagggaacaacttgctgagctcgaagctgcacgcgcgaggcttcagcagctccgggacgcatggcctgacgaggtactggcccaggggcagcgacgagctcagctgcaggaaagattggaggctgctcgagagcggaccttacagtgggagtccaagtggatccaaatccagaacacggctgccgagaaaactctccttttagggaggtctcgcatggcggtcctcaacctgttccaactggtttgccagcaccagggccagccacctacactggacatcgaagacaccgaaggccagctggagcacgtgaaactctttatgcaggatttgtccgccatgctcgctgggctgggccaagcagagcctgccgctccagcctcctag

SEQ ID NO: 46373 - DNA, 675 bp, Artificial Sequence
  Description of Artificial Sequence: Synthetic coding sequence
atggccgcccccagcgaggtggccgccatcgcccccggcgagggcgacggcggcggtggaggcttcggatcttggctggacggaagactcgaggccctgggggtggatcgagccgtttatggcgcctatatcctggggatcctgcaggaagaagaggaggaagaaaagttggacgccctacaggggattctatccgccttcctggaagaagatagcttactcaatatctgtaaggaaatagtcgaacggtggtccgaaacccaaaatgtagttactaaggtgaagaaagaagacgaggtccaggctatcgctacactgattgagaagcaggcccaaatcgtcgtgaagcctaggatggtcagcgaggaagagaaacagcgcaaggcggcgctcctggctcagtatgcagacgtgaccgatgaagaagacgaggctgacgagaaggacgattctggcgccaccacgatgaacataggttctgacaaactcctgttccggaacacaaatgtcgaagacgttctgaatgcgagaaagcttgagagagattcattacgcgacgagtcccagaggaagaaggagcaggataagctgcaacgagaacgggataagttagcgaagcaggagaggaaggaaaaggagaagaaaaggactcagaggggcgaacggaagagatag

SEQ ID NO: 46374 - DNA, 465 bp, Artificial Sequence
  Description of Artificial Sequence: Synthetic coding sequence
atggccgcccccagcgaggtggccgccatcgcccccggcgagggcgacggtgggggaggtggcttcggctcttggcttgacgggcgccttgaggctctaggggtggatcgcgcagtatacggagcatacatcctggggattctacaggaagaggaagaagaggagaaactggacgctctccagggaattttatctgcgttcttagaagaagacagtctcctgaatatctgtaaagagatagtcgaacgatggagcgaaactcagaatgtggttaccaaagtgaagaaagaggatgaggtgcaagcaattgccaccctgattgagaaacaagcgcagatagtagtgaaacccaggatggttagcgaggaggaaaaacagaggaaagccgctctcttagcccaatacgcagacgtgaccgatgaagaggattctgtgcctaagcaccaatgtgggcgatgcccttag

SEQ ID NO: 46375 - DNA, 486 bp, Artificial Sequence
  Description of Artificial Sequence: Synthetic coding sequence
atgacctacttcggccacttcggcggcgccaaccacgcccacaccttgggagagctggaggcatgtattgccatgttggtcgaacagctcaggacacaggggtgcggaggtaggaccctcggaacaagcgaggaagaggccgagctccagcagaaagtggaagagaatgaacatttgcggctagaactacagatggtggagacggaacgggtgcgcctatctctgctggaggagaagctggtcgatgtgctccagttgctgcagagactgcgcgatctcaatatctcaaagagagctctgggtaagatattgttgtcaaccctcgatgctttccgagacccgacccatgaagggcgcccctcacctgccgcaatcctggacgcattacatcaggctcttgcagcttgtcagcttctgcggagacagccaagtgctcctgcaagcgccgccgctgctctgaccaacccactgctagtcagttgttag

SEQ ID NO: 46376 - DNA, 987 bp, Artificial Sequence
  Description of Artificial Sequence: Synthetic coding sequence
atgtacaccctgcacaccaagcgggtgaaggccgccgcccggcagatgtggacatcaaatctgtcgaaggtccgccagtcgttgaaaaacgtctaccacaagtgtaaaatccgccatcaagactcaaccggctatcctacagtcaccagcgatgattgtaaccaggacgacgattcctatgatggtaaaatgaatcttcctgtggtgttacaggacgtgaagacggcccaggttgagctgttctctcagatgacggatatcgtacacatgattcccaaagtccaagaaaagaccgacctctatcagaagcagatggaggtgttggaaacacggatgaacgttaacgaagataaacagtgtacgactaccaaagacattttgtcaatgaaagaggacatcaaggcgctgaaaaagaaagtgacagaacttgagatccagaactcctgcagcacaatccactgcttagaaatcctggaaggggagcgtgggaaggagataaccgaacttctatacaaactcatacaaccagccactctgaagaacacgctggcttcaaccgatatggagatcagcagcgcagagccagagaaagtcccttcttatccgaagtcgacggatcatttggaaaaaaagacaatttccccgcagatgaagacactaaagaagaggaaccaccagaatgcctctagatcctttgaaaaggcaaagcctaacatctacatttaccctgacttctcgacttggatcaaactgaccttcgtccacggtggcaaatggacttttttcctgtctgcaacaaagctcgaggagttcatccagtggctcctgtcacgtccgaccattctgcccgaagagccacaagtcatcacccagcggtactgtccctttactggtcccattttaagcctcaccacaatttgcctcagtattttcaataacatctacggtttcatatgctcattaaaagaagaggtgaccagactctag

SEQ ID NO: 46377 - DNA, 906 bp, Artificial Sequence
  Description of Artificial Sequence: Synthetic coding sequence
atgggcaaccggctgcgggccgagctgggccggcccgagcggtggttactgcaccatgctctccctccagcacctgaagcaaggaaacctggggaagaaccccggcgtcctttggatagatcccccccactggggcaagtccagcctcacttcaccagtcaggatgccaagagcgccgaggatgaagctccttcccggcatctaggcaaacatcaaccacgctcggctcaggtgggctcgaggctggacgccctgcagggaccaaagacccagcactcaatacatactgtgacttgcaagtcacccagacaaaaggaggaccgaagtccaaagcctccgcaggcaccccagcacccagaagaacacgggcgtcagagtcattcctcaagtagctttgccagtggaacgctccaggacatgtggagacttctggacctaggaagcagcccgagcggcgtaacaagccagggggactctacgcccgagatgggtagccactacgtaacccaggccgggctagagctgcttgggtcatcatccccagcagcgctggccagccagagcgccgagatgaccggcgtcgggcctacaccttccttggcctggtcaggggcgctgcatcctaatatgaatcaggaggcaagtttggtccgttccacctgggcacctggtatgaggggtggcatgaacggggggagcagcagtgtgtgtaagaacatgcagaggggacctcactggagcccatctcagcaaccatgttcagggatcagaaccgtgctgctgagtaggaaggaaaggaccctcctgtcctgcttcagcctgcccgctccagtggtactggtcccactgttattatctggacaggctgtgaccgagagagctggacacgctggtgacatactatag

SEQ ID NO: 46378 - DNA, 2751 bp, Artificial Sequence
  Description of Artificial Sequence: Synthetic coding sequence
atgctgcccctgggcagcgagcccgccctgaacgagctgctgctgagaaaagaggaggaatggagagcgcttcaggcccatcgaactcagcttcaggaggctgcattgcaggacacccgatcacagctggaagaggcccagggaaaacttcgctgcctgcaagaggacttcgtctacaatctccaggtgctggaggagcgtgacctggagttagaacgttacgatgccgcttttgcgcaagctcgggagtgggaggaagccaggcgagctgaggtcagcgaactgaaaattgaagccgcaaagcttaggcaggctctggccagggaggctcgcaaagttgaggaacttcagcagcaacagcagttagcgttccaggaacaccggctggagttggagagggtacatagcgacaagaacggggagatcgaccaccatcgggagcagtatgaaaacttgaaatggactctggagaggaagcttgaggagttagatggggagctggctcttcaacggcaggaactgcttcttgaatttgagagcaagatgaggaaacgggagcacgagtttagactccaggcagacaacatgtctaataccgcattgtcacgggagctaaaggtgaagctcttgcataaggaattggaagcacttaaagaggctggggccaaggcggcagaaagtctgcagagagccgaagcaactaatgccgagctggagaggaaactgcaatcacgggcgggcgagctgcaggacctggaagccatgtcccgcgctcgggtcaaggatcttgaagacaagcttcactcagtccagctaaccaggaaaaaggaggaagagacgtttaaacggaagcacgaagaactggatagactcgctagagaaaaggatgccgtcttagtggccgtgaaaggggcacatgtggaacagctgcaggagttgcagacccgggtgcttgagttgcaggcacattgtgagactcttgaggcccagctacggagagcagaatggagacaagctgataccgctaaagagaaagatgccgccatagatcagctgcgtgaagacgctagcacagtgaaatccgcttgggatgctcagattgcacagctaagtaaggagatggtgtcaagggacttacaaatacagaccctccaggaggaggaagtgaagctcaaggcccaagtggcccgttcacagcaagatatcgagagatataagcaacagttaagcctcgctgtggagcgtgaaaggtccctcgaaagagaccaggtgcagctaggtttggactggcagcgtcggtgtgatgacatcgaacgggatcaaatacagaagtccgaggcattgatccaaggtttaagcatggcaaaaagccaggtagcggctaagctccaggaaaccgagcaggccctgcaggaacaggaagtcgttttgaaggccgtcactctggagcgtgaccaggctgtgcaggctctgcgcatgcatggcttgcccagacctggcgctcagatgctccttcggcagcacgaagaggagatcagtaaagattttccttctagtgagatccagagactgcgcgaacaaaatacctcccttcggaacgctattgcccaaatgcgtaaagaaatggaagccctgtcacatcagatccccccaccgattcagacagctgctgagtccaccgatgccaaccagccagatcctgaagccgggggggatgccgctactcccgattacgtgctcgcactagaggcggagatcagaactctgaaacacaagtttaaaactcttgagaagcatctagaggacgtactcgatcctcttaagatgagttccccacatgctgaatcacagcccagcgtcaggaccagcaccgaaaccaccggaggatcagcccaggcagggcaggcgggcggtagtgtccaagcggggcaagccggaggctcagtccaagccggacccgtgagttcgggcctggccttgagaaagcttggcgatagagtacagctgctcaacctgctggtcacccggttgagacagaaagtgcttagagagccccttgaaccagcggccctccagagggaactgccacgggaagtcgaccaagtgcatctcgaggttcttgaactgcgcaaacaggtggcagaattgggcaaacacctgcggatcgcgcagcacggtggagccgagccctcagggcggaaacaacctccagcttctgatgccgttgcgttgggaagggaacaagacgccaagtcggccgaggacgaggcgccatctcggcatctgggaaagcaccagcctcgcagcgctcaggtcggaagcaggctcgacgccctccagggcccaaagacccaacacagcattcataccgttacttgcaaatctccccggcagaaagaggatcggtctccaaagcctccgcaggccccccagcaccccgaggagcatggcaggcagtcacatagcagctctagtttcgcatctgggacactccaggacatgtggcggttgctggatcttggaagcagccctagcggggtgacatcacagggcgactccacgccagagctaccagcacccccagccgctgataggcggcctgtaaagatgcaggctggcatcgcgaccccaggcatgaagacagctgctcaagctaaggccaaaaccacaggagcctctcgctctcatcctgccaaggccaagggatgccagcggcctcctaagatcaggaattataatattatggattag

SEQ ID NO: 46379 - DNA, 2751 bp, Artificial Sequence
  Description of Artificial Sequence: Synthetic coding sequence
atgctgcccctgggcagcgagcccgccctgaacgagctgctgctgcgcaaagaagaggagtggagggctctgcaggcccatcgaacccaacttcaagaagccgccctacaagacacccgaagtcaactagaagaggcccagggaaaattgcgctgcctgcaggaggattttgtctacaacctgcaggtgctcgaggaaagggatcttgaactggaaagatatgacgccgcgttcgcccaagctcgcgagtgggaggaagcccgccgcgccgaggtctcggaactgaaaatcgaagccgctaaactgcgtcaggcactggctcgtgaggccaggaaagtggaggagctccagcagcagcagcaactagccttccaggaacataggcttgagcttgaacgcgtgcactccgataaaaatggagaaattgatcaccacagggagcaatatgaaaacttgaagtggacgcttgagcgcaaactcgaggagcttgacggagaattagccttgcagaggcaggagttgctgctggaatttgaaagcaagatgcgaaaacgagaacacgagtttaggctgcaggctgataatatgtctaacaccgcactgtctagggaactgaaggtaaagcttctgcacaaggagctggaagctctcaaggaggcaggggctaaggctgcggagtcactccagcgcgctgaggcaaccaacgctgagttggagcgaaaactgcagtcgagggccggtgagctgcaagatctggaagccatgtcccgggcccgggtgaaagatctcgaagacaagctgcacagcgtccagcttacgagaaaaaaggaagaggagacatttaagcgaaaacacgaggaattagaccgtctggccagggaaaaagatgccgtgctcgtggcagtgaagggagcacacgttgagcagctccaggagctgcagactagggtgctcgagttgcaggctcattgtgagacccttgaagctcagctccggagggccgaatggcgccaggccgacacagccaaggaaaaggacgccgccattgatcaactcagggaggatgcctcaactgttaagtccgcctgggacgcacagatcgcgcagctctcgaaggaaatggtgtctcgtgacctacagatacagacgctgcaggaagaggaagtgaaactgaaggcccaggtagcccgcagccagcaagacatcgagcgctataagcagcagctctccctggccgtggagagggagcggtcgctggagcgcgaccaggtgcaactggggctggattggcaacggcgctgcgacgacatagaaagggatcagatccagaaaagcgaggctctgatccagggtctgtccatggctaagagccaggtagccgccaaactgcaggagaccgaacaagccctgcaggagcaggaggtggtcctgaaggctgtgaccctggagcgtgatcaggctgtacaagctctgcgaatgcacggtctgccgcgacctggcgcccaaatgctgctgcggcaacacgaggaagaaatcagcaaggatttcccaagcagtgagatccagaggctccgcgagcagaacacaagtctgcggaacgctattgcccagatgcgcaaggaaatggaggcattgagccaccagattcctccaccaattcagactgccgccgagtctacagacgccaaccagccagaccccgaagcaggtggtgatgccgctacccccgactacgtcctggcccttgaggccgagattcgcacactgaagcacaaattcaagaccctagagaagcaccttgaagacgttcttgacccacttaagatgagctcaccacacgctgagagccaaccctctgtgaggaccagcactgagacaaccgggggtagcgctcaagccgggcaggctggcgggtcagttcaggcaggacaggctggtggtagcgttcaagccgggccagtttccagtgggcttgccctcagaaagttgggagatagggtacagctcctcaatctcctggtgacccggttaagacaaaaggtgctgcgagagccactggagcccgccgctctacagcgcgagttaccaagagaagtggaccaggttcatctggaagttctggagctcagaaagcaggtagctgaactgggaaagcacttacgcattgcacagcacggaggcgctgaaccatccggccgcaaacaaccccccgcctctgatgctgttgcactggggcgcgagcaggacgctaagagtgccgaagatgaagccccttcacggcacctcggcaagcatcagcctcggtctgcccaggtcggcagcaggctggatgctcttcaagggcctaaaacccaacactcgattcacactgtaacttgtaagagcccaaggcagaaggaggacaggtcccccaagccaccacaggccccgcagcacccagaagaacacggcaggcagtctcactcaagctcaagttttgcttctggaacccttcaggatatgtggcggcttctcgatctcggatcatcaccgagtggagtgacatcacaaggcgatagtacgcccgagttacccgctccaccagcggccgacagaagaccagtgaagatgcaggccggcattgccaccccgggaatgaaaacagccgctcaagccaaggccaagacaacaggtgcaagtcggagtcaccccgcaaaagctaaaggatgccagaggcctcctaagatccgtaactataacattatggactag

SEQ ID NO: 46380 - DNA, 1653 bp, Artificial Sequence
  Description of Artificial Sequence: Synthetic coding sequence
atgaccaaggtgcccgccaccaagaagctgcagagcagccccaacagcggcgccgtgagaccgttttacgcgagcgagaatctgaggcaggtgcccgacaagcctatgaaatctataaagtatatggataaggagattattaacctcaaaaaggacctgattcgcagcagatttctgatccagtctgtcaagatagggcgcggctactttgcaatccttcgggaggagaccgctaaaaaaaaaaagcagcagcagctgcaaaagttgaaggaagaagagcggaacaagttccagccggccgaaaagatctccgagatacattatggggacaccctgctgtctacctacgatgacgaaaaactcaaaaccctcggggcccgggtgacccgcaggccttttacccctatacactcatgtatcatttcaccctctctcacagaagctcacgtggagccactgttcagacagctgtgcgccctgcactggttgttagaagccttgacaattgatcatacccaccacaccatgaaaccagttataacttgctggaatcccaaggaccccgggggcagcaaaagtaccatcaaaaagataaacaaagataagtcaatgggccagaagtgggaacacttcataacagcacccaaaactaaaaagtttaagattccgaccatgagggttacaaaccggaaaccctcaaggcgcggctccacccttagcttgtcccgcgcttctgggggcagcagcccccagtcttctatgatcagtgtgaaccctggctccgatgagcctcccagcgtgaacacacaggttaccagcagtaaagacatcgaggataatgagtcgtcctcaactaagcctgatgaggagccattatatatgaatctgcagaaattattagaaatggtgcgggaagacgcgcgtcggaccgtcactattgagaacggcatgcagcgcaaggccccaagcattttgtcagtgctgaaacagaataagtccaatagtgcctataaggaaatgcagaccactctgaagagtagcgagcgttcttcttccacatccgccgagtcgcatatacagcctgtccagaagaagtcaaaaaatcgaacgaattgcgacatcaacatccattacaaaagcggggtctgcaataccatgcgggccaaattttactccgttgcccaggaggctggcttttgcctccaagataagatggaaatcctgatgaagcgtcaggaggaacggggcatccagaagtttcgggccttcgtgttggtcagcaattttcaaaaagacatagctaagatgagacatcacattagtgttgtaaagggggacgcagaagaaattgcagatcattggtacttcgatctgttgagtaagctacccgaggatcttaagaattttcggcctgccaaaaagatcctggtcaaattgcagaagttcggagaaaacctagatctgcgaattagacctcacgtgttactcaaagtcctacaagacctgcgcatatgggagttgtgtagcccagatatcgccgtcgccatcgagttcgttcgggagcatatcatacatatgccccaggaagactacatctcctggctccagagccgcattaacatccccattggaccctattccgcgctacggtag

SEQ ID NO: 46381 - DNA, 1692 bp, Artificial Sequence
  Description of Artificial Sequence: Synthetic coding sequence
atgagcgtgctgaagaagaaccggcggaaggacagcgacaccccccaagaaccttccgagaaagccaaagagcaacaggcagaggccgagctcaggaagctaagacagcagttccgtaagatggtggaaagcaggaagagcttcaaattccgcaatcagcagaaaattgctagccaatataaagagatcaaaacacttaaaaccgaacaggatgaaatcacacttttactaagtttaatgaaatccagcagaaatatgaacagatcagaaaaaaactatatggaactgcgcctcctgttgcagactaaggaagattatgaggcactcatcaagtccttaaaagtgctgttagcggagcttgatgaaaaaatcctccagatggagaaaaaaatcgctaaccagaagcaaatttttgcgaaaatgcaggaggccaataaccccagaaaactccaaaaacagattcacatcctcgaaacaagattaaatcttgtgaccgtgcacttcgataaaatgttgaccacgaacgctaaactgagaaaggaaatcgaagacctgaggtttgaaaaagccgcatatgacaatgtctatcagcagctccagcactgtcttctgatggagaagaaaactatgaacctggccatagaacagagttcacaagcttatgaacagcgggtggaggccatggctcgcatggctgcaatgaaagaccgtcaaaaaaaggatacctcacaatataatctagagataagggaattagagaggctatacgctcacgaaagcaagttaaagtcattcctactggtcaaactaaacgatcggaacgagtttgaagaacaggctaagcgtgaagaggccctgaaagcaaagaagcatgtgaagaaaaataggggcgaatcgttcgaaagctacgaggtcgctcacctcagactgctcaagctggcagagagcggcaacctgaaccagctcattgaagactttctggccaaagaggagaaaaacttcgcacgtttcacatacgtcacagagctgaataatgatatggagatgatgcataagaggacgcagaggattcaggatgagatcatcttgctgaggtcgcagcagaaacttagccatgatgataaccactccgtactgaggcaactggaggacaaactcaggaagaccacagaggaagccgatatgtatgagagcaagtatggggaagtgagcaaaacccttgatcttcttaagaatagcgttgagaaattgtttaaaaaaattaattgtgacgccacaaagatccttgtccagttgggggaaacaggcaaggtcaccgatattaatttgcctcaatacttcgctatcatagagaagaagactaatgatttgctgctcctcgagacttaccggcggatcctcgaggtggagggggctgaggccgaaattccccccccatttattaatcccttttgggggggcagtgccttgcttaaaccacctgagccaatcaaggtgattccgccggttctcggagccgaccctttttccgatcggcttgacgatgtcgaacagccactggaccacagcagtcttagacagttggttctcgataattatatccttaaggagaacagatcaaaagaggtaagaggagacagtctccctgagaaggtcgatgactttagatccagaaagaaagtgaccatgtag

SEQ ID NO: 46382 - DNA, 1527 bp, Artificial Sequence
  Description of Artificial Sequence: Synthetic coding sequence
atgagcagccccgacggccccagcttccccagcggccccctgagcggaggcgcgagcccatcaggggacgaaggatttttcccattcgtgctggaacgacgcgatagtttccttggggggggacccggcccagaagagcccgaggacctagctctacaattgcagcagaaggagaaggacctgctgctagccgcagaactcggaaagatgttgctcgaaagaaacgaagagctgcgtcgtcagctcgagactttgagtgctcagcacctggagcgggaggaaagacttcagcaagaaaatcatgagctgcggcggggcctggccgcacggggcgccgaatgggaagctcgtgctgtagagttggaaggagatgtggaggccctgcgggctcagctgggcgagcaacgaagcgaacaacaggacagcgggagggaacgggcgagagcattatccgagctctcagaacaaaatctccggctgagccagcagttagctcaggcttcacaaaccgaacaagaattgcagcgggagttggatgccctgaggggccaatgtcaggcgcaggcgctggccggagctgaactgagaacacggctggagtcgctccagggggagaaccagatgctgcaaagccggagacaggacttagaagcgcagatacgagggctgagagaggaggtagagaaaggcgagggtcgccttcagactactcacgaggagttactactgcttcggagagagcgtcgtgaacattccctcgaattagagagggcccgcagcgaagccggagaagctttgtctgccctgcgcagactacagcgccgggtctctgaattagaggaggaatctcgcctacaagatgctgacgtgtctgcagctagccttcagtcggaacttgcacacagcctcgatgatggagaccagggacagggtgccgacgctccgggagataccccaaccacgagaagccccaagacccggaaggcttccagccctcagccatcacctccagaagagatcttggagccgccaaaaaaacgaacgtccctcagccctgcggaaatcttggaggagaaggaggttgaagtcgcgaagctgcaggatgagataagtctgcagcaggccgagcttcagtctctgcgcgaagagctacagcgccagaaggaactgagggctcaggaagacccaggagaagcgttgcattccgcactaagcgatcgggacgaggccgtgaacaaagctctggagttgtctctacagctcaatagagtgtccttagaaagagattcactctcccgagagctgctacgagccatcaggcagaaagtggcactgacacaggaattggaagcttggcaggatgatatgcaggtggtgatcggtcaacagcttagatctcagcggcagaaagaactcagtgcctcggctagttcttcaacaccaagacgagccgccccgaggttctcactccgcctcggacccgggcctgccggaggatttctcagtaacctgttccggaggacctag

SEQ ID NO: 46383 - DNA, 2745 bp, Artificial Sequence
  Description of Artificial Sequence: Synthetic coding sequence
atgggcaacaaggccaagatcgccaagtgccccctgcggaccaagacgggccacatattgaaaagtacccaagacacgtgcatcggctccgagaaacttctacagaaaaaacccgttggctctgaaacgtcgcaggccaagggggagaaaaacggcatgacctttagctcaacaaaggacctatgtaaacaatgcattgataaggattgtctgcacattcagaaagaaatatctccagccaccccaaatatgcagaaaaccaggaacaccgtgaacacatctctcgtcggcaagcaaaagccacataagaagcacattactgcggaaaatatgaagtcttcgctggtctgtctaacccaagatcagttacagcaaatcctgatgactgtcaaccaaggaaaccggagtctgagtctcaccgagaatggtaaggaagcaaaaagccagtattcactctatcttaacagcatcagcaatcaaccaaaagatgagaatatcatgggcctgtttaagaaaacagaaatggtgtcaagcgtgcctgctgagaataaaagtgtattgaacgaacaccaggagacctcaaaacagtgtgagcagaagattgccatcgagaacgaatggaagccagcggatatcttcagcactctgggtgagcgcgagtgcgacaggtcctccctcgaagccaaaaaagctcagtggagaaaggagctggacgaacaagtagctctgaagaaaaaggagaaggaggtgtccgagaagtggaatgatccctggaaaaaaagtgagagcgacaaaatcatatgggaaaagcaccaaatcctggatcaaagccgcgagacggtgctgctggagcaccctttcagcgccgttaaacaggagctccagagaaagtggatagaggaactaaacaaacaaatcgaagacgatagacaaagaaagatcgaggaaaagatcatctactccaaaggagaagaacacgaccgatgggccatgcatttcgacagcctgaagagctaccctggctcgcaaagtcagctgttttcccagtccactcacaagcaaccagagtacttttgtgttagtcctgatacgcaggaactcgctgacgtttcgtctgtatgcactcctacgactggttcccaagttgagccatccgaggaggaacacattgcgaagccaatcaaagatgtcgtgatggcaaatagcaagaaaacaaactttttgcgcagtatgacagcgctccttgatcccgcccagatcgaggagagagataggcggcggcagaagcaacttgagcaccagaaagccatcaccgctcaggtggaggagaagagacgcaagaaacagctggaggaagaacagagaaaaaaagaggagcaggaggaggagctgagattggcccaggaaagggaggaaatgcaaaagcaatacgaagaagacatcttaaaacaaaaacaaaaagaggaaattatgaccctgaagaccaacgagctcttccagaccatgcagagagcacaggaacttgcacagcgtctcaagcaggagcagcgaataagagagctcgcccaaaagggccatgacacttctcggctgatcaaaaatctgggggtggacaccatccaaatggagtataatgcttccaatatctctaacagtaggcatgacagcgatgagatttccggtaaaatgaacacttacatgaacagcacgacatccaaaaaggacaccggggtccagacagatgacctgaatattgggatttttaccaatgccgagtcccattgtggatctttgatggagagggacattacaaactgctcctctccagaaatcagtgcggagctgatcggccaattttctacaaagaaaaacaaacaggagcttacacaggacaagggagcctcactggagaaagaaaataaccgctgcaacgaccagtgcaaccagttcacaaggattgaaaaacaaacaaaacatatgaagaaatatccgaagagacccgactggaatataaataaaccccccaaacgctacatcccagccagtgaaaagtatcctaagcagttacagaagcaacgggaggagaagaaggtgagacgacagatggaactactgcacctagtggagaagaacaacccaggccacctgagccaaaatagggggatctcacccgaaatttttcattcttcacaccaagagactgaatccaaactgcgttggcacctcgttaagaaggaggaggagccactgaacattcacagtttctccaaggagcgctccccctcctcacctgtaccagtcgtcaaaaaccgtactcagcagacgcagaatactctgcacctgcctctgaaaaattcgagttacgaaagagaaaaccttatctctggcagcaaccagaccgagctgtctagcggcattagtgagtcaagtcacttcatcccttatgtcagaacaaacgaaatctactatttggacccagacgcaccacttagtggccccagcacacaggaccctcaataccagaattctcaggattgtggccagaaacggcagctgttcgactccgattgtgtgcgcgaccccttgcttaacccaaacatggttaagaatcgagacaggcagcaggctattctgaaaggtttatctgaactaagacagggcttgctgcagaaacagaaagaattggaatccagcctgcttccgcttgccgagaatcaggaagaaagctttggctccagtttttag

SEQ ID NO: 46384 - DNA, 2847 bp, Artificial Sequence
  Description of Artificial Sequence: Synthetic coding sequence
atgaacctgggcgacggcctgaagctggagaccgagctgctggacggaaagactaaactgatattatccccctatgagcacaaatccaaaatcagcgttaagatgggaaataaggctaaaatagccaagtgccctttgcgcacgaagactgggcatattttgaagagcactcaagacacttgcatcggctcggagaaactactgcagaagaaacctgtgggaagtgagactagtcaggctaagggagagaagaacggaatgaccttcagttcaacaaaagacctgtgtaagcaatgcatcgataaggactgcctgcatatacagaaagaaatctcgcctgccacccctaacatgcagaagacaaggaacacggtgaatacctccctcgtcggaaaacagaagccccacaagaagcatatcacagccgaaaacatgaaatcctccttggtgtgcctgacacaggaccagctgcagcagatcctgatgactgttaaccagggaaatcgatcactttcactgactgaaaacggtaaagaggcaaagtcacagtattctctgtacctgaacagcatttccaaccaacccaaggacgaaaacatcatgggactcttcaagaagaccgaaatggtaagctcagttcccgctgaaaataagagtgttttaaatgaacaccaagaaacctccaagcagtgtgagcagaagatagcaattgaaaatgagtggaagcctgccgatatcttttccacgcttggtgaacgtgagtgtgaccggagttccttagaggcaaagaaggctcagtggcggaaggagctggacgaacaggtggccctgaagaagaaggaaaaggaggtgtctgagaagtggaatgacccttggaagaagagcgaatcagataagattatctgggaaaaacatcagattcttgaccagtctagggaaacagtgcttttagaacatccgtttagtgccgttaagcaggagcttcaaagaaagtggatcgaggaactcaacaagcagatcgaggacgaccggcaacgaaaaatcgaggaaaagattatatatagcaagggcgaggagcacgataggtgggccatgcactttgatagtctgaagtcttaccctggctcacagtctcagctgttctcccagtcaacacataaacaacctgagtatttttgcgtgtcccctgacacccaggagcttgctgacgtgtcaagcgtgtgcacccctactaccgggtctcaggtggaaccatctgaagaggaacatatcgccaagcctataaaggacgtagtcatggcaaactccaaaaagacaaatttcctgcgctctatgacggctctgctggaccctgctcagatagaggagcgggatcgacgtagacagaaacagcttgagcaccagaaagccattacagcccaagtagaagagaaacgccggaagaaacagttggaggaagaacagaggaaaaaagaggagcaggaggaagagctccgcctggcgcaggagagggaagagatgcagaagcaatacgaagaagatatcctaaagcagaagcaaaaggaggagatcatgacactgaaaaccaatgaacttttccagactatgcagagggcgcaggaattggctcaacgccttaaacaagaacagcgtattcgagagctggcgcaaaagggccatgatacgagtcgcctaatcaagaacttgggggtcgacaccattcaaatggagtacaacgcatcgaacatctctaactcccgtcacgattctgacgagatttctggcaaaatgaacacatacatgaactctacaacaagcaagaaggataccggcgtacagaccgatgatctcaacattggtatcttcaccaatgctgaaagccactgtggcagcctgatggagagggatattactaactgcagttcacccgagatcagcgctgaactgatcggacaattttcaaccaagaagaacaagcaggagcttacccaggacaaaggcgccagtttagagaaggaaaacaacagatgcaatgaccagtgtaaccaattcactagaatcgagaagcaaactaaacacatgaagaagtaccctaaacggcccgactggaatattaacaagcccccaaagagatatattccagcctccgagaaatatcccaagcaactgcagaaacaacgagaggagaagaaagtgagaaggcaaatggaacttctgcaccttgttgaaaagaacaacccgggacatctcagccagaataggggtatctcccccgagatctttcactcctctcatcaagagactgagtccaagcttaggtggcatctcgtgaagaaggaggaagaaccactcaacattcacagctttagcaaggagagaagtcctagttccccagtccccgtcgttaagaatcgaacgcagcagacccagaatactctgcacctgccgctcaaaaactcttcgtacgaacgtgaaaacctaatctcgggatcaaaccagaccgaactcagctccggcatcagcgagtctagccactttatcccatatgtgaggactaacgagatctattacctcgacccagatgctcccctatccggcccttccacacaggaccctcagtaccaaaactcacaggactgtggccagaagcgccagttgttcgattccgattgtgttcgggaccctctgctgaaccctaacatggtcaagaatagagatcggcagcaggccatacttaaaggacttagcgagctgagacaaggcctgctgcagaagcagaaagagctggaaagcagtcttttgcctctggcagagaatcaggaggagtcgttcggctcctctttttag

SEQ ID NO: 46385 - DNA, 2847 bp, Artificial Sequence
  Description of Artificial Sequence: Synthetic coding sequence
atggacctgctggacggcctgaagctggagaccgagctgctggacggaaagactaaattgattctgtctccctatgagcacaagagtaagatctcagtcaaaatgggcaataaagcaaagatcgccaagtgtccccttcgcacaaagactggccatatcttgaagtcgacacaggatacatgcatcggcagtgaaaagctgttacagaaaaaacctgtagggtcagaaacttcccaggctaagggggaaaagaatggaatgacattcagtagcacaaaagacctctgtaagcaatgcattgataaagactgcctgcatatccagaaggaaatcagtcctgctacgcctaacatgcagaagactcgcaacacggtgaacactagtctggtgggtaagcagaagccgcataagaaacatattaccgctgaaaatatgaagagtagcctcgtttgtttgactcaggaccagttgcagcagatcctaatgactgtgaatcagggaaatcgtagcctttccctgacagagaatggcaaggaggcgaaaagccagtatagcctttacctcaactcaatcagtaatcagcctaaggacgaaaacattatgggcctgttcaagaagactgagatggtgagctcagtccccgctgagaacaaaagcgtgctcaacgaacaccaggaaacctctaaacagtgcgagcaaaagatcgctatcgaaaacgagtggaagcccgccgacatcttttccaccttgggggagcgcgagtgtgaccgctccagcttggaagctaaaaaagcacaatggcggaaggagttggacgaacaggtggccctgaagaagaaggagaaagaagtgagtgagaagtggaatgatccctggaagaagtcagaatccgataagatcatctgggaaaagcatcagatacttgaccaaagccgcgaaactgtgctgttagaacatccctttagtgctgttaagcaggagttgcaaagaaagtggatagaggaattgaacaaacagatagaagacgatagacagcgcaaaattgaggaaaaaataatctattccaaaggggaggaacacgaccggtgggcaatgcactttgattccctaaagagttaccccggaagccagtcacagttattctctcagtccactcataaacaacccgaatacttttgcgtgtctcccgacactcaggagttggccgacgttagcagcgtttgcacgcctaccaccggctctcaggtggagcccagtgaggaagagcacattgcaaaaccaataaaggatgtcgtaatggctaactcaaagaagaccaactttctcagatccatgaccgcattattagaccccgcccagatagaggaacgcgaccgacgtcggcagaagcagcttgaacatcagaaagccattactgcacaggtggaggaaaagcggaggaaaaaacagctggaggaggagcagcgaaaaaaggaagaacaggaggaagaactcagactggcacaggaaagggaagaaatgcagaagcagtacgaagaagacatcctgaaacagaaacagaaagaagagataatgaccttgaaaacgaatgaactgttccagacaatgcagagggcccaggagctggcgcagaggctgaaacaggagcagcgaatccgggagctggctcagaagggtcacgataccagtcgccttatcaagaatcttggagtggatactatccagatggaatacaacgccagcaatatctctaattcaaggcacgacagcgatgaaatatccgggaaaatgaatacctatatgaattccacgaccagcaagaaagacacaggtgtccagactgatgatcttaacatcggcatattcacgaatgcagagagccactgcggctctctcatggagagagacatcacgaactgcagttctcccgaaatttcagcggaactgatcggacagttttccacgaagaagaataagcaggagctgactcaggataaaggggctagcctggagaaggagaataaccgctgcaacgaccagtgcaatcaatttacgcgaattgagaagcagactaaacacatgaagaaatatcctaaaaggcctgactggaacattaacaagccacctaaacgttacataccggcctctgagaaatatccaaaacagctccaaaagcaacgcgaggagaagaaagtcagaaggcaaatggagcttctgcaccttgttgaaaagaacaatcccgggcatctgagccagaataggggcatcagccccgagatcttccactccagtcatcaagaaaccgaaagcaaacttagatggcatctggtaaaaaaagaggaggagccgctcaatatccacagcttctcaaaagagcggagcccaagttcccccgtgcctgtcgttaagaaccggacccaacaaacccagaacactttgcacctgcctctgaaaaactccagctacgagcgcgaaaacctgattagcggaagcaatcaaacagagctctcgagtgggatctccgagagctctcactttattccatacgtaagaaccaatgagatctactaccttgatcctgatgccccactgtctgggccctccactcaggatccccaatatcagaacagtcaggactgcggccagaagcgccagttgtttgattcggactgcgtgcgcgacccccttctgaaccccaatatggtcaagaatcgggatcgacagcaagccatccttaaggggctctctgagttgagacagggacttcttcaaaaacagaaggagctcgagtccagcctgctcccactagctgagaatcaagaagagtctttcggcagctccttttag

SEQ ID NO: 46386 - DNA, 864 bp, Artificial Sequence
  Description of Artificial Sequence: Synthetic coding sequence
atggacctgctggacggcctgaagctggagaccgagctgctggacgggaaaaccaagcttattttgtccccctatgaacataaaagtaagatctcagttaagatgggcaataaggctaagatcgccaaatgcccgctccgcacaaagaccggccacattctcaaaagcacccaagacacgtgtattggtagcgaaaagcttctccagaagaaacccgtgggttccgagacgagtcaagctaagggggaaaagaatggcatgaccttctcatctaccaaagatttatgtaaacagtgcatcgacaaagactgccttcatattcagaaggagatctcaccagccacacccaacatgcagaagacccgcaacacagttaatacctccctggtaggcaagcagaaacctcacaaaaaacacattacggccgagaatatgaagtctagtctcgtgtgcttaacacaagaccagctgcagcagatactcatgacagtcaatcagggaaaccgctcattatcacttaccgagaatgggaaagaggctaaatcccaatacagcctgtacttgaactctataagcaaccaaccaaaggatgagaacattatgggcttatttaagaagacagaaatggtttcctccgtacctgcagaaaacaagagtgtgcttaacgagcaccaggagacatcaaagcagtgcgaacaaaagattgcgattgagaatgaatggaaaccagctgacattttctccacccttggcgagagggaatgcgacaggagttccctggaggctaagaaggcacagtggcgcaaggagctggttctccagacagtacaagcctggtatcagcacctgctcgggttttggtag

SEQ ID NO: 46387 - DNA, 1815 bp, Artificial Sequence
  Description of Artificial Sequence: Synthetic coding sequence
atggagaaccaggcccacaacaccatgggcaccagcccctgcgaggctgaactgcaagagcttatggagcagattgatattatggtcagcaataaaaagatggattgggagcgaaaaatgcgcgctttggaaactagactggatctcagagaccaagaattggccaacgcccagacctgcctcgaccagaagggccaagaagttggactcttgcgccagaagctcgattccttggaaaaatgcaaccttgctatgactcagaattatgaaggacaattacagtcactgaaggcccaattctctaaacttaccaacaacttcgaaaaactcagacttcatcagatgaagcaaaataaagtgcctcgcaaggaacttccacacctcaaggaggagattccttttgaactgtccaatctgaatcagaaactcgaagaatttcgcgctaagagtcgtgagtgggataagcaggagattctgtaccaaacccatctaatttctctggacgcgcagcagaaactacttagcgagaagtgcaaccaattccagaaacaggctcaatcataccagacgcagctgaacggtaaaaaacagtgcctggaggattccagctccgaaatccctcgtttaatctgcgatcccgatcccaactgcgaaattaacgaacgtgacgaatttatcatcgagaagttgaaatcagccgtgaatgaaattgccctgagccgaaacaagctgcaggatgagaaccaaaagctcctccaggagttaaagatgtaccaacggcagtgccaggccatggaggccggtctgagtgaggtgaaatctgagctgcagtcaagggacgatttacttcgcataattgaaatggagcgacttcagcttcaccgggagctgctcaagatcggggagtgtcagaatgcacagggcaacaagaccagactggagagcagctacctgccctccataaaggagcccgaacggaaaattaaggagttattttcagtaatgcaggatcagcccaaccacgaaaaagaactgaacaagattcgcagtcagctccagcaagtagaagaataccacaactcagagcaagaaagaatgaggaatgagatctctgatttaacagaggaactacaccagaaggagatcactatcgccaccgtaacgaagaaggccgctctgctggagaagcaactcaagatggaactggaaatcaaggaaaagatgcttgccaagcagaaggtgtcagacatgaagtataaagcagtcagaactgagaatacacatctcaagggaatgatgggcgaccttgatccaggagagtatatgagtatggattttaccaatcgcgagcagtctagacacacatctatcaataaactgcagtacgaaaatgagaggttacggaatgacttagccaagctgcatgtgaatggtaagagtacttggaccaaccagaatacatacgaggagaccggtcgctacgcctaccagtcccagatcaaggtggagcagaatgaggaaaggctgtcacacgactgcgagccgaataggagcaccatgccccccctcccaccatctacttttcaagcgaaagagatgaccagcccactagtttctgacgatgatgtgtttcctctctccccgccagacatgtcctttcccgcatctctcgcggcacagcattttctcctcgaggaagaaaaaagagctaaagaactcgaaaagttgctgaacacacacatcgatgagctccagagacatacagagttcacgctgaacaagtactccaaactgaaacagaataggcacatctag

SEQ ID NO: 46388 - DNA, 990 bp, Artificial Sequence
  Description of Artificial Sequence: Synthetic coding sequence
atggagaaccaggcccacaacaccatgggcaccagcccctgcgaggctgagctccaagaacttatggaacagatcgatatcatggtgagcaataaaaaaatggattgggaacgcaagatgcgcgcactagaaactcggctcgatctccgagaccaagagctggccaacgcgcaaacttgtttagaccagaagggccaggaagtcgggctgttgaggcagaagctggatagtctggagaagtgtaaccttgcaatgacacagaattatgaaggccagctgcagtcactcaaggctcagttcagtaagcttaccaataattttgagaagttgcgtctgcaccagatgaaacagaacaaagtcccaagaaaagagcttcctcacttgaaggaggagatcccatttgaactgtcgaatcttaaccagaagttggaggagtttcgtgcaaagagccgggaatgggataagcaggaaatactgtaccagactcatttgatttccctggacgctcagcaaaaactactgagtgaaaaatgcaaccagttccagaagcaagcccagtcttatcagacccagttaaacggcaaaaagcagtgtttggaggactcttccagcgaaattccacgactgatctgtgacccagatcctaattgcgagataaatgagcgggatgagtttattattgagaaactaaagtccgccgtgaacgagatcgcattaagccggaacaagctgcaagatgagaaccagaaactgctgcaggaacttaagatgtaccagcgtcagtgtcaggccatggaggcaggcctttctgaagtgaagtctgagctgcagtctcgggacgatctactcagaatcatcgagatggagcggctgcagcttcacagagagctgctgaagataggtgagtgccaaaatgcccagggaaacaaaactaggctggagtcctcttatctgccaagcatcaaagaacccgagcgaaaaatcaaatag

SEQ ID NO: 46389 - DNA, 1815 bp, Artificial Sequence
  Description of Artificial Sequence: Synthetic coding sequence
atggagaaccaggcccacaacaccatgggcaccagcccctgcgaggcggagttacaggaactcatggaacagatcgacattatggtcagcaacaagaagatggactgggagagaaagatgcgggccctggaaacccgtctggatctcagagaccaggaactggccaatgcacagacatgtctggatcagaaaggccaggaagtgggcttactccggcagaagctagattccctcgagaaatgcaatctggctatgactcagaattacgagggtcaactccagagcttaaaagcccagtttagtaagttgacaaataacttcgagaaactgagattgcaccagatgaaacagaacaaggtcccacgaaaagaactgccccacttgaaggaggagatcccattcgaactctcgaacctgaaccagaagcttgaagaattcagagcaaagtcgcgggagtgggataagcaggagatactatatcagacacacctgatctctttagatgcccaacagaagctgctctctgagaagtgtaaccagttccaaaaacaggcacagtcataccagacgcagctgaatggaaaaaagcaatgcctggaggacagttcgtccgagatcccaaggctgatttgcgatcccgacccaaactgtgagattaacgagagggatgagtttatcatagagaagttaaagagtgcagttaacgagatcgctctgagtcggaataaactgcaggatgaaaatcagaagctgttgcaggagttgaaaatgtatcagcgccagtgccaagccatggaagctggtctatccgaagtcaagtccgagctgcagagtagggacgacctgctgcgtatcatcgagatggaacgtcttcaactccaccgggagctgttaaagatcggcgaatgtcagaacgctcagggtaacaagacacggctcgaatcgtcctatctccccagtatcaaagaacctgagaggaaaataaaagaactcttcagcgttatgcaagaccaaccaaatcatgagaaagagcttaataaaataaggtcacagctgcaacaggtggaggagtaccataattccgagcaggaaaggatgcgtaacgaaatcagcgacttgaccgaagaactccaccaaaaagagatcacaatagcgacagtgactaagaaagcagctctgctcgaaaaacagctgaaaatggaactggaaattaaggaaaaaatgctggccaaacagaaggtttctgacatgaaatacaaggctgtaagaaccgagaatacccacttgaaaggtatgatgggagaccttgacccgggcgaatatatgtctatggatttcacgaaccgagaacagtccagacatacaagtataaataagcttcagtacgagaatgaacgcctgaggaatgacctagccaaactccatgtgaatggaaagtctacctggaccaatcagaacacctatgaggaaaccggacgctacgcatatcagagccagattaaggtcgaacagaacgaagaacgtttatcacacgattgcgaacccaaccggagtaccatgcccccacttccaccatccactttccaggccaaagaaatgacctccccacttgtcagtgacgatgacgtctttccgttaagtcctcctgacatgagctttcccgcatctctggccgcccagcactttctcctggaagaggagaagagggcaaaagagcttgagaagctgctcaacactcatatcgatgaactccaacgccatacagaattcactctgaacaagtacagcaaattgaaacagaatcggcacatttag

SEQ ID NO: 46390 - DNA, 1008 bp, Artificial Sequence
  Description of Artificial Sequence: Synthetic coding sequence
atgaccaccgtgaccgtgaccaccgagatccccccccgggacaagatggaagacaattccgccctgtacgagagtacttcagcccatatcatagaggaaacagaatacgtgaagaaaatccgaacaactctccagaagattagaacccaaatgtttaaagatgagataagacacgacagcacaaaccacaagcttgacgctaaacactgcggaaatcttcaacaggggtccgacagtgaaatggaccccagttgttgttccttagacttgttgatgaaaaaaatcaaaggtaaggatctccaactactcgagatgaacaaggagaacgaggtcctgaagattaaactgcaggcatctcgagaggcaggcgctgcggcccttcggaatgtcgcacagcgcttgttcgaaaattaccagacgcagagcgaggaggtgcggaaaaaacaggaagacagtaaacagctgctgcaggtgaacaagctggagaaggaacagaagctcaagcagcatgttgagaatctgaaccaggtggccgaaaaattagaggaaaagcacagtcagattacagagttagagaacctagtccaaaggatggaaaaagagaagagaaccctcctggaaaggaaattgtccttagagaataaacttcttcagttgaaaagtagcgccacctatggcaagagttgtcaggatctccaaagggagataagcattctccaagaacaaatctctcacttacaatttgtgattcacagccagcatcagaatctgcgatcagtcatccaggagatggagggactcaagaacaatctgaaagagcaggacaagaggattgaaaacttacgggaaaaggtcaatattctagaggcacaaaacaaggaactgaaaacacaagtggcgctgagctccgagaccccccgcacaaaagttagtaaggcggtgagtacttccgaactgaagacagaaggggtcagtccctatctgatgctgatccggctgaggaaatag

SEQ ID NO: 46391 - DNA, 1008 bp, Artificial Sequence
  Description of Artificial Sequence: Synthetic coding sequence
atgaccaccgtgaccgtgaccaccgagatccccccccgggacaagatggaggacaactcagctttgtatgaatctacaagtgctcacataattgaggagaccgagtatgtaaagaagatcagaaccacattgcagaaaatacggactcagatgttcaaggatgagattcgtcacgacagcacaaatcataaactcgacgccaagcactgtgggaacctgcagcagggtagtgacagcgagatggatcctagttgctgctctctagacttgctcatgaaaaagattaaaggaaaggacctgcagttgttggaaatgaacaaagagaacgaggtgctcaaaatcaagctgcaggcttcaagagaggctggggccgccgccctcaggaacgtagcccaacgcctttttgagaactaccagacccagtccgaggaggtccgaaaaaaacaggaggactccaaacagctccttcaggtcaataagcttgagaaagagcagaagctaaagcagcacgtcgagaacttaaatcaggttgctgagaagttggaggaaaaacattcgcagataaccgagctggaaaacttagtacaacgaatggaaaaggaaaagaggactctcttggagcgcaaattgagcctggaaaacaagttgctgcagctaaagagctcagccacatacgggaagtcctgccaagacctgcagcgagagataagcattcttcaggagcaaatctctcacctgcaattcgtcatacacagtcagcatcaaaatttgcggagcgtgattcaagaaatggagggcctaaagaataacctgaaagaacaggacaaacggatcgagaaccttcgggaaaaagtcaacatccttgaagctcagaacaaggagttgaagacacaggtggccctttcgtctgaaacaccacggacaaaagtgtctaaagccgtgagcacctctgagctgaagaccgaaggtgtgagtccttacctgatgctgattcgactgcggaaatag

SEQ ID NO: 46392 - DNA, 1008 bp, Artificial Sequence
  Description of Artificial Sequence: Synthetic coding sequence
atgaccaccgtgaccgtgaccaccgagatccccccccgggacaagatggaggacaacagtgcactgtatgagtcaacgtctgcacatatcattgaggagacggagtacgtcaagaaaatccggaccacactccaaaagattcggactcagatgtttaaggatgagatccgacatgactctactaatcacaaattggacgctaagcactgcgggaatctgcagcagggcagcgacagtgagatggatcccagctgctgttccctggaccttctgatgaagaaaattaaaggcaaagatttacaactgctcgaaatgaacaaggaaaacgaggtgctgaagatcaagctccaggcctcacgcgaagctggggcagccgcgctgagaaatgtagcccagcggctgtttgaaaattatcagacgcaaagtgaagaggtgaggaaaaaacaagaggacagcaagcaattactgcaggttaataagctagagaaagaacagaaattgaagcagcatgtcgagaatctgaatcaggtcgctgagaaactggaagagaagcattcccagatcactgagctggagaacctggtgcagcgaatggagaaggaaaagcgcactctactggagaggaaactttctttagagaacaaattgctccagctaaagtcttcagccacatatgggaaatcctgtcaggatctccagcgcgagatctctatcctccaggaacaaatttcccacctgcagtttgttatccactctcagcaccagaacctgcggtctgtgattcaggagatggaaggcctgaagaataaccttaaagaacaggacaaaagaatcgaaaaccttcgtgaaaaggtcaacatactcgaagctcaaaataaagagttgaagacccaggtcgccctgagttctgaaactccaagaacaaaagttagcaaggccgttagcaccagcgagctcaaaacggaaggcgtgtctccctacctcatgctgatcagattgcggaaatag

SEQ ID NO: 46393 - DNA, 891 bp, Artificial Sequence
  Description of Artificial Sequence: Synthetic coding sequence
atgggctgccggcacagccggctgagcagctgcaagccccccaagaaaaaaagacaagagcctgaacccgaacagcccccgaggcctgagcctcacgaactgggacctctcaatggtgacaccgccattaccgtgcagttgtgcgcatccgaagaggcggaacgtcaccagaaggacattacccgtatcctccaacagcatgaggaggagaagaaaaagtgggcgcagcaggtcgaaaaggagcgcgaactcgagctcagagataggttggacgagcagcagagagtgctagagggtaagaacgaggaggcgttacaggtattaagagcttcttacgaacaggaaaaggaggcacttactcattcattcagagaggccagctcaacacagcaagagaccattgatagactgacctcccagcttgaggcattccaggccaaaatgaagcgcgtggaggagtcaatactgagtcgaaactataagaagcatattcaggactacgggtctcccagtcaattctgggaacaggagctggaatccctccactttgtcatcgaaatgaagaacgagcggattcacgaattggacaggagactcattctgatggagacagtgaaggaaaagaacctgatactggaagagaagatcaccactctccagcaggagaatgaagatctgcacgtacggagccgcaatcaggttgtgctgtccaggcagctgtccgaagatttactgctgacgagagaagccttggagaaggaagttcaactccggaggcaactgcaacaggagaaggaggaacttttgtatcgggttctcggagccaacgccagcccagccttcccactagcgcccgtgactccaacagaggtttcttttctggccacatag

SEQ ID NO: 46394 - DNA, 609 bp, Artificial Sequence
  Description of Artificial Sequence: Synthetic coding sequence
atgcggaccagcatgagcgaggccgccacccggtggagctgccagggcagctgtcagaaaacctgtttttcaagagttcgtccatggcggcgtcgatgttcctgcggagatagtagtagtcgaagaagaagatcatgctgtacaggtagtctaggtcctatgcctagactgccttcactgtggccactctccctgcccctgaggtccttgagctctcctcacagggtgcaagggctgggtcctcctagacggctcaaatcacagctactccctagattcttttggcggcggcaacaggaacctttgagctcttttcctggacgtaatgaagggggatccgagatggaaatccttggagtgtgcccagtctctcccggagcccttagctatatggaaagcccgactggcttctggcgtcctcgagaagcctcatcactggagctggccaagggcatctccaagcggcggcacttcctaccagctcccgcactgtgtccaaatcccagaagcagtgaagctttcccaggccaatcggtttctcgctggccctttgacatcaaggaaactgcgccaggaccctctctgtccgcgcttctgccaacctgttag

SEQ ID NO: 46395 - DNA, 1461 bp, Artificial Sequence
  Description of Artificial Sequence: Synthetic coding sequence
atgaagcccgtgaagcacctgctgaccaccagcaacaagagcgccaacgtgcctgccctcaccactaagaaaggcctccataatctacctcttagtcccgagctgaaagagaaacataacgctaaacttatccatgataaaattgagccaatggtcctcagatcgccccctaccggagagtctatcttaaggtatgcactgcctattccatcttctaaaacgaaaaacctgttgccagaagatgagatgatcggaaagattatcaaacacctcaaaatggtggtatccacactcgaggagacttatggtcactgcgaccagaatggggaagaaccgttcgtaaagcatgaacatgaagagctgagcttgtcagtcggagacgacatgaattcgttcctcacctattgtagtcagtttgcagcccagttggaagaagcacttaaggaggagcagaatatcctagagtcccttttcaaatggttccagtggcaggttaaccagatggaggagatttccaaggaccaaaccctgcttcaggctgagccccctaaacctgataagaccgtgatattaaacatagcggagatcgtgcgcctggtgcagcggtttgaagagttgaagaaccgactgaagcagagatccaaaagctccgttaaagtgatgctgtcaaaaaccatggacaaggaaaaccgtcccgaggcagtgaaatcttgcgaggctttggcccagaaaatcgaagaattcctggaggcgcattctaccgacgagttcaaggatgtttcagccacagagcctcagacagcacactccatgacaaatagattcaacgcaatgttaaaggtcttcgaaaatcaggccaacatgctggaaagggcagtgaacgaccaagtgctgctcgatgcagagtataagcagatgcaatgcgacttccaacttctcagtgaggagaagctcgtccttgaaaacgaactccagaagctgaaagacaaggagaagacgaagccaaccaataaccgtactaaaaaagcggtgaaaaccgtaaaaaagaaggacaaaggaaaaagcgaagactctgaaaaaaagatgtctccagagaaggaattcaagatcaaggaggacctggatcaggtgcagaaggttgccagactcgagatcgagaataaagtactgcaggaacagctgaagcaggcattacaagaagctgaaaaggccaaacaccagctcaattactttctaaaccaagagaagctactgaagtcagagggtaagaccgaaactaccatgcaggttggtaacagtcagaccaaggtcaagggcgaggatagcaagaacatccccctggagaaagagactcgcaagtcgctggtgagcgactcaggcggccagcgcactagcgacaagatccaagagtatcctcagataaccgcccagagtggacgcctaatcgagaagcggtgctag

SEQ ID NO: 46396 - DNA, 840 bp, Artificial Sequence
  Description of Artificial Sequence: Synthetic coding sequence
atgaagcccgtgaagcacctgctgaccaccagcaacaagagcgccaacgtgcctgcactcacaactaagaaggggctacataacttacccctttcaccagagctcaaggagaagcataacgctaagctgatacacgacaagatcgagcccatggtacttcgtagcccccccactggggagtccattttgcgttacgctctgccgattccctcaagcaaaacaaagaatcttctgcctgaggatgagatgatcgggaaaattatcaaacacctaaaaatggtggtgtctaccttagaggagacctatggccattgtgatcagaacggagaggagcctttcgtaaagcacgagcacgaggagctgagcctgtccgtcggcgatgatatgaacagcttcttgacatattgctcccagttcgctgcacagctcgaagaggcactgaaggaggagcagaacgtatgtattctgtatattctgtcaatttttctgaagtggttccagtggcaggtgaatcaaatggaggagatttcaaaggaccagaccctgttacaagctgaaccccctaagcctgataagaccgtcatactgaatatcgcagagatagttagactcgtccaaagattcgaagagctcaaaaaccgccttaaacagcgatctaaaagttcagtgaaagtgatgctctctaaaacaatggacaaggagaaccgcccggaggctgtcaaaagttgcgaagccctggcacagaagattgaggagttcctcgaggctcatagcacagatgaattcaaagatgtgtccgcaactgaacctcgtaaattcccactgatcaaagctctatag

SEQ ID NO: 46397 - DNA, 1461 bp, Artificial Sequence
  Description of Artificial Sequence: Synthetic coding sequence
atgaagcccgtgaagcacctgctgaccaccagcaacaagagcgccaatgtgccagcccttaccacaaagaagggactccataatctgcccctgtcacctgaactgaaggagaagcataacgctaaattaattcacgacaaaattgagccaatggtccttcgaagccctcccacgggcgagtctattctccgctatgcactgcccattccctcctccaagaccaaaaacctcctgcccgaagacgagatgatcggaaaaatcattaagcaccttaagatggtggtatccacactggaagagacctatgggcactgtgaccaaaatggcgaagaaccattcgtgaaacatgaacacgaggaattatccctgtccgttggggatgacatgaatagttttctgacgtattgctctcaatttgcggctcagctagaggaagcactaaaggaagaacagaacatcctcgagtccctctttaaatggttccaatggcaggtgaaccagatggaagagattagtaaggaccaaaccttactgcaggcagaaccccctaaacccgataagacggtgatcctgaatatagccgaaatcgtccgtctggtgcaaaggttcgaggagctgaagaatcgcctgaaacagcgatccaagtcgtcagtgaaagtgatgctttccaaaacgatggataaagagaaccgccccgaagctgttaaatcttgcgaagccctggcccagaagattgaagagtttctcgaagctcacagtactgatgagtttaaagatgtctcagcgaccgaaccacaaaccgcccacagcatgaccaacaggttcaatgctatgttgaaagtatttgagaatcaggcaaatatgcttgaaagggccgttaatgaccaagtgttgctggacgctgagtataagcagatgcagtgcgactttcagctgctgtctgaggagaagttagttttggaaaatgagctccagaaacttaaagacaaagagaaaacgaagcccactaataaccgaacgaaaaaagccgtcaaaactgtcaaaaaaaaagataaaggcaaatctgaggattccgaaaagaaaatgtcccctgagaaggaatttaagatcaaggaggacctcgaccaagtccagaaagtcgccaggctcgaaatcgaaaacaaggtgttgcaggagcaactgaaacaggcactccaggaggctgaaaaggccaaacaccagctgaattacttcctcaatcaggagaaactcctgaagtcagaaggtaaaactgaaaccacgatgcaggtcgggaattcacagaccaaagttaagggagaagattccaagaacatccccctggaaaaggaaacaaggaagagtcttgtgtctgatagtggaggccagcgtactagcgacaagatacaggaatacccacagataactgcacagtctggcagactgattgaaaagagatgttag

SEQ ID NO: 46398 - DNA, 483 bp, Artificial Sequence
  Description of Artificial Sequence: Synthetic coding sequence
aagaccaagcccaccaacaaccggaccaagaaggccgtgaagaccgttaaaaaaaaggataaggggaagagtgaggacagcgagaagaagatgtctccagaaaaggaattcaagatcaaggaagatctcgatcaggtgcagaaggtcgcgcgccttgaaatagaaaacaaagtcctccaggagcagctcaaacaggccttgcaggaagccgagaaagctaagcatcaactgaactatttcctcaatcaagagaagctcctgaaatcagagggcaaaaccgaaacgaccatgcaggttggaaacagccagaccaaggtcaagggagaagactctaagaatattcccctcgaaaaggaaacccggaaaagcctggtgtcagactctggaggccagagaacgtcagacaaaatacaagagtaccctcagatgttgattgagtttctcaaatatttcggaaaagtgagccagacgtttagggaatag

SEQ ID NO: 46399 - DNA, 516 bp, Artificial Sequence
  Description of Artificial Sequence: Synthetic coding sequence
atgaagcccgtgaagcacctgctgaccaccagcaacaagagcgccaacgtgccagccctgacaaccaagaaagggctacacaaccttccccttagcccagagctcaaggaaaaacacaatgccaagctgatccacgataagattgagccaatggtcctgaggagtcctcccacaggtgaaagcattctccggtacgctctgccaatcccttcctccaaaacaaagaatttactaccagaggatgagatgatcgggaagattattaaacatctgaaaatggtcgtcagtaccttggaggagacatatggtcattgcgaccagaacggagaggaaccgttcgtgaaacatgagcacgaggagctgtcgctctccgtgggagatgacatgaattcttttctgacgtactgctcccagttcgccgcccaactcgaggaagccctgaaagaggaacagaatatcttggagagcctattcaagtggtttcagtggcaggtgaaccaaatggaggagggctag

SEQ ID NO: 46400 - DNA, 528 bp, Artificial Sequence
  Description of Artificial Sequence: Synthetic coding sequence
atgaagcccgtgaagcacctgctgaccaccagcaacaagagcgccaacgttcctgctctgacgactaaaaaaggcttacataatctgcccctttcgcccgagctgaaagaaaaacataacgccaaacttatacacgataaaattgagccaatggtcctgcggagccctcccacaggtgagtccattttgcgctacgcgctgcctatccctagctccaaaaccaaaaaccttctgccagaggacgagatgattggcaaaatcataaagcatctgaaaatggtggtctccacactggaagagacgtatggacattgcgatcaaaacggcgaggagccctttgtcaaacatgagcacgaggaactgtctctctccgtgggcgacgacatgaactctttcctgacctactgtagccagttcgccgcccagctggaggaggcgctgaaagaggaacagaatattttggagtctctgtttaaatggttccagtggcaggtgaatcagatggaggagaaactcttgattcagtag

SEQ ID NO: 46401 - DNA, 522 bp, Artificial Sequence
  Description of Artificial Sequence: Synthetic coding sequence
atgaagcccgtgaagcacctgctgaccaccagcaacaagagcgccaacgttccagctctgacaacgaaaaagggtttgcataatctgccgctgtccccagaattgaaggaaaagcacaatgcaaagctcattcatgataagatcgaacccatggtcctgaggagccccccaacaggggagagcatcctaaggtacgctctgcctattccatcctcaaagacgaaaaatctcttacctgaggacgagatgataggcaagataataaaacatttaaaaatggtcgttagcacgctggaagaaacatacggacactgcgaccagaatggtgaggagccgtttgtgaaacacgaacatgaagagctctcgctgtctgttggagatgacatgaattcattcctaacttattgctctcagttcgcagcccagctcgaggaggcactaaaagaagagcagaatatcctcgaatcccttttcaagtggttccagtggcaggtgaatcagatggaggagtcttgcaaatag

SEQ ID NO: 46402 - DNA, 516 bp, Artificial Sequence
  Description of Artificial Sequence: Synthetic coding sequence
atgaagcccgtgaagcacctgctgaccaccagcaacaagagcgccaacgtacctgccctgacgacaaagaagggactgcataatctgcctttgagccctgagctgaaggaaaagcataatgccaagctcatccacgacaaaatagaaccgatggtgctgcgtagcccccccactggagaaagcattctgcgttatgccctcccgatcccctcaagtaagaccaagaatctgctgcctgaggacgaaatgatcggcaaaatcatcaagcatctcaaaatggtagtctccactctcgaggaaacttacggtcattgcgatcaaaacggagaagagcccttcgtgaagcacgagcatgaggagctgagcctctccgtgggggacgacatgaactcatttctcacttactgctctcagttcgcagcccagctggaggaagcacttaaggaggaacagaatatcctcgaaagtctgttcaagtggttccagtggcaggtgaaccagatggaggaggggtag

SEQ ID NO: 46403 - DNA, 1404 bp, Artificial Sequence
  Description of Artificial Sequence: Synthetic coding sequence
atgagcgtggtggtgcagcacgtggaggagaaggccgtgcacagctggtcccgcatctcaaccgccgggaagaaagcgctggaagaagcattgctggtgttcaaccctatgagtcaagacctgtctgccaccgaagcccagttggttgcgttcctgcaaggccttcgcgatgatggtttccaacccacaattctgcgatccggcgacgtgtatggatatagttcctgcaccgctaatcccccctcccagactaagttacaagcccgcgctccgaatccgacagctacaagtcctcccgcatccgccccgcgcactgctatgagattaccagccggacgcgcgactttgttgccaatgccgctgtcaggccgcttggccaaagcctctactccagctcttgctaagcatgccactaccaaccttctgctgtcctcgctgaagcagtcctctgccagccacgctcgcggtgccgctgtcgggtttcccacgcatttatatcctggcgtctatccagccatgagactttctgtggtattagaagccctcgtccctttgaagacaccaatgccttgtcttggggccaagcacaaggcccagagtttacagttgagcttggccgattctcctttaaaacttcgaaagagcagcggcaagggaccaggaaatcctaggcctaaggctcccaggaaaaccacctccaaggggccaaaatgtttaacacgcaaaggacctggggctggtccccggcgaggctccggccatcagtctaagaccaaccgcgcaaccggaagtccatctgtgagacgaatgaagggaggcagcgctttgggcaccaagacagcccaggcgaaagtggcacgcacgttagcgaaagctgcgcgagcacaggccaaggtggcccggacacaggcgaaagctgcaaaggctcgcgctaaggccaaggcggcccaggtgaaagcgaaggctaaggccaaagccgctcaggtaaaagctaaggccaaagtgatggctgcctgggccaaagccaaggctaaggcgaaggccgtgcgcgccaaagctaaggtggcaagaacacagcctaggggtagaggccggccaaaagggagcgccaaagcccggaccaccaggaaagggcaaaagaatcgccctgagactgttggacagaagaggaaacgcgccgaggaagccaaagacctgccgccaaaaaagagaactcgactcgggcctcgttcacctaaagcatggctcggccccggcacggcaaaactgctgaaattccgcgccatcaaggtcgatcgacggtccagtgacgatgaagtaaggcagcgggcccagaggattttgcgagtgaacctgagtccagtaattaggttgcagccattactgccatactcagcggtgtag

SEQ ID NO: 46404 - DNA, 708 bp, Artificial Sequence
  Description of Artificial Sequence: Synthetic coding sequence
atgcggcggagcatgaagcggcggcggcggcggcggcccgtggcccctgcaactgccgcacgcgggggtgattttcgcgccgaagacggggcgggcctggaagccagggaggagaaggtagtgtattctagaagccagttatcactggcagattcaaccaaggcgctgggcgacgcctttaaactgtttatgcctagatctactgagttcatgtcgtcagatgctgaactctggagtttcctctgctccttgaagcaccaatttagccctcacattctgaggtctaaggatgtatatggttatagctcctgtcgtgcactggtgcctgaccccccaggcccgccaacggccagaggccaagcacgaagacccgtaccacgggccgctgctagaagacggagacgcggcgcccgagcagccgccgctcgcagacgaaaacctagacctcctcctccccccccaccacctccagaagaaagctgtcccgccaaaccagtcgcccctgggccctgcttcggagggcggactctggaagaaatatggagagcagccacgcccactctgaccacttttcctaccattagggtagggtcggacgtctggggtgaaagaagcctagcagctgcccgtaggagggcccgccaggttctgcgcgtgaatcttgaacccatggttcggctgcgcaggttccctgtacctcgcgcatag

SEQ ID NO: 46405 - DNA, 195 bp, Artificial Sequence
  Description of Artificial Sequence: Synthetic coding sequence
atgagcggccgggagggcggcaagaagaagcccctgaagcagcccaaaaaacaggccaaggaaatggatgaagaggacaaggcattcaagcagaaacaaaaggaagaacagaaaaaactggaagagctgaaggcaaaggctgctggaaagggaccactcgctactggaggcatcaaaaaaagcgggaagaagtag

SEQ ID NO: 46406 - DNA, 1137 bp, Artificial Sequence
  Description of Artificial Sequence: Synthetic coding sequence
atgagcggcgccggcgtggccgccggcacccggccccccagcagcccgactccaggaagccggcgccgccggcaaaggcccagcgtgggagtacaaagtttgcgacctcaaagccctcagctgcgccaatcagatccacaaaaaagaaacttggatctagaaaaatccctgcagttcttacagcagcagcatagtgagatgctggcgaaactgcatgaggagatagaacaccttaagagggagaacaaggacctgcattacaagttgataatgaaccagacgagccaaaaaaaggacgggccgtccgggaaccacctgagccgtgcctcagcgcctttaggggcacggtgggtgtgcatcaatggggtgtgggtcgagccgggtggcccatcacccgccaggctaaaggaaggtagcagccgaacacatcgccctggtggaaagagaggtcgccttgcaggtggttcagctgataccgttcgtagcccggccgactcactatccatgagctccttccagtctgttaagagcatcagcaactccgggaaggcaagaccccaacctggttctttcaataagcaggatagtaaagccgacgtatcacagaaagcagatctcgaagaagagcccttactgcataactctaagttggacaaggtgcccggcgttcagggacaggcacggaaggagaaggccgaagcctcaaacgccggtgctgcctgtatggggaactcacagcaccagggtagacagatgggggctggggcacatcctccaatgatccttccccttcctctccgcaagccaactactttgagacagtgcgaggtgctcatccgcgagctgtggaatacaaatctgttacaaacacaagaactgcgtcacctcaagtccctgttggaaggttctcagaggccccaggctgcccctgaggaggccagtttccctagagaccaagaggcaactcatttcccgaaggtgagcactaagagtctctccaagaaatgcctgagcccaccagtggcggaacgggccatcttaccagcgttgaaacagactcccaagaacaacttcgcggagcggcagaagcgcttacaggccatgcaaaaacgcagactgcataggagcgtgttgtag

SEQ ID NO: 46407 - DNA, 993 bp, Artificial Sequence
  Description of Artificial Sequence: Synthetic coding sequence
atgggccggaacccctgggacagcccctgccccgcccggagcctgccccaaattgccgctgtcgcacgccccagaatatcctcacctatggccctgtcacctcatatgttgggggcgcagggactctggacacacagtatacagggatctctgccagccatttgggccgcgactatgggaactaaggggggaagcagagtgctcttcccctgccacctgtcaaaagctttacctcatccggacagtggcccccaccctgcccaagaccccggactttggtctcaggcccactttccactatccctcggcttgggattgacaagcggcggacatctgacaggcgggtggtcccagcccggaaacatagccgcaggtgcagtgccacgggcccttcctagccagggagacatggaaaagggtgtcgagggcggcccattcccgtcccgttgcggtaacagctcagagctcttctgggccaagtgcggacctagccgccagccccagccttgtagcgcgggtgacgctgatcgcactcgcgaagaagcaatgctcagcctggggacctgttgcagcatgtgccccaaacctagttgctttcccgacggccccagcggtaaccatctgtctcgcgcctcggccccccttggggcacggtgggtgtgcatcaacggggtgtgggtagaacccggcgggccgtctcccgctcgcctcaaggaggggtccagcagaactcatagaccggggggcaaaagaggaagactggccggcgggtctgcagatacagttcggagccccgccgatagcctctcaatgtctagcttccagtctgtaaagtccataagtaattcaggcaaggcccgtccacagccaggctctttcaataaacaggactcaaaggcagatgtgagtcaaaaggctgaccttgaagaggagcccctcctccacaactctaaactcgacaaggtacccggagtgcaggggcaggcccgctag

SEQ ID NO: 46408 - DNA, 939 bp, Artificial Sequence
  Description of Artificial Sequence: Synthetic coding sequence
atgagcggcgccggcgtggccgccggcacccggccccccagcagccccacgcccggcagtaggagacgcagacagcgcccgtccgtgggtgttcagtctttgcgcccacagagccctcagctgcgacaatcagacccacaaaaacggaacttggatcttgagaaaagtttacaattcctgcaacaacagcatagcgagatgctggccaagctgcacgaggagatcgaacacctgaaacgcgaaaacaaggacctgcattacaaactcattatgaatcagacgagccagaagaaggattctctcagcatgtcgtcttttcagagtgttaaaagtattagcaactccgggaaggctaggccacaaccagggtcttttaacaagcaagactctaaagccgacgtcagtcagaaagctgatctagaggaagagcccttgctccacaattccaagcttgataaagttccgggggtacagggccaagcccgcaaagagaaggccgaggcgtcaaacgccggtgccgcttgtatgggcaactctcagcaccagggcagacaaatgggagcaggggctcatcctccgatgatattgcctcttccgcttcggaagccaactaccctgcgacaatgcgaagtgctcatccgtgaactgtggaacaccaacctgctgcagacgcaggagctgaggcaccttaaatctctcttggaggggtctcagagaccccaggccgcccctgaagaagcgtcatttccacgggatcaggaggccacccacttcccaaaagtatctacaaagagtctgtctaagaagtgtctatcaccacctgtcgctgaaagggcaatacttccagcactgaagcagaccccaaagaataattttgccgagcgtcagaagcgcctccaggccatgcagaagagaaggctccaccgcagcgtgttgtag

SEQ ID NO: 46409 - DNA, 1143 bp, Artificial Sequence
  Description of Artificial Sequence: Synthetic coding sequence
atgagcggcgccggcgtggccgccggcacccggccccccagcagccctacacctgggtcacgccgtaggcggcaaagaccaagcgtgggtgttcagtcattgaggccgcagagcccacaactcaggcagagcgaccctcagaagagaaatcttgaccttgaaaagtcacttcagtttctacagcaacagcactctgaaatgcttgccaaactccatgaggagatcgagcatttaaagagggagaacaaagaccttcgatacaagctgataatgaaccaaactagtcagaaaaaagacgggcccagtggaaatcatctgtccagagcgtccgccccccttggcgccagatgggtgtgcattaatggcgtgtgggtggagcctgggggcccatcacctgccagattaaaggagggctcttcaagaacacaccgccccggcgggaagcacggccggctggcaggcggctccgcggacactgtccggagtccagctgacagtttgagcacaagttcctttcagtcggttaaatctatcagcaattctggcaaagcccgaccgcaacccggatcctttaacaagcaggactccaaggccgacgtcccccagaaggccgacttggaagaagaaccactgctgcacaacagcaaattggataaagtaccaggggtgcaggggcaggcccgtaaagagaaggctgaggcctcaaacgcaggagcagcctgtatgggtaatagtcaacaccagggtaggcaaatgggcgcagcagcccacccccccatgatcctgcccctgcctttgaggaagccgactactttgagacagtgtgaggtgttaatccgagagctgtggaataccaaccttctgcagacccaagagctgcaacacctgaagagcctgctcgaaggttcccagcgacctcaggccgtaccagaggaggcctcatttccaagggatcaggaggcaactcattttcctaaggtgagtaccaagtctctcagtaagaaatgtttactgctgtctcctcccgtggctgagcgcgctattcttcctgctctcaagcaaaccccaaaaaacaacttcgcggaacggcagaagcgcctgcaggcaatgcaaaagcgccgcctccaccgcagtgtactctag

SEQ ID NO: 46410 - DNA, 1449 bp, Artificial Sequence
  Description of Artificial Sequence: Synthetic coding sequence
atgggccggaacccctgggacagcccctgccccgcccggagcctgccacaaattgcggcagtggcgaggcccaggatcagctcccccatggcattgtcaccggatatgctgggtgctcaaggattgtggacccacagtatccaggggagtctgccggccatatgggccgctaccatgggcaccaaggggggctcgcgagtcctgttcccttgtcacttgtccaaagctcttccccatccagacagcggccctcacccagcccaggattctgggctgtggtccagagcgcactttcccttatccctgggtctaggcctgacatctggcggtcatctgaccggtggctggtctcagcccggaaatatcgtcgcaggcgccgtaccccgagctctcccgtcacaacgggatatggagaatggagtcgaagggggccccttcccaagcagatgcgggaattcaagcgagctgttttgggcaaagtgtggcccatctcgccagcctcagccatgctctgccggggacgcggacaggacaagagaggaggctatgctgtctctggggacatgttgttctatgtgccccaagccctcatgtttccccgatggcccctcagggaaccatctgagccgggcaagcgctcctctcggcgcgaggtgggtatgcatcaatggtgtttgggttgagcccggtggaccatcgccggcacggctgaaggaggggagctctcgaacccacaggccaggaggaaaacacggccggctggcaggaggatccgctgacaccgtgagatctccagccgactccttgtcaacttcctcttttcaatccgtgaaatctatctccaatagcggaaaggcccgaccacagcctggttcctttaataagcaagactcaaaggctgacgtcccgcagaaggctgatctcgaggaggagccgctgctacacaactcgaaactggacaaagtgccgggcgttcagggacaagcacgaaaggaaaaggctgaagctagcaacgcaggagcagcttgcatggggaactcgcagcaccagggaagacagatgggcgcagctgcccatcccccaatgatcctgccattgccactgcgcaagcctaccacgctgcgccagtgtgaggtgctcatccgagagctgtggaacacaaacctccttcagacacaggagctccagcatctcaaaagtctactggagggctctcagaggccccaagccgtgcctgaagaagccagctttcctcgtgaccaagaagcaacacatttccccaaagtgtcgacaaaatctctgtctaagaagtgcctgctactgtctccccctgtagccgagcgcgctatcctccctgccctcaaacagacaccaaagaacaacttcgctgaacgccaaaaaaggcttcaagcaatgcagaaacgtcgactccatagatccgtcctttag

SEQ ID NO: 46411 - DNA, 945 bp, Artificial Sequence
  Description of Artificial Sequence: Synthetic coding sequence
atgagcggcgccggcgtggccgccggcacccggccccccagcagcccaactccaggcagccggcggcggaggcagcggccgagcgtgggtgtgcagtctctacggcctcagtctccccaactgaggcaaagtgatccgcaaaagcgaaatctggatttagaaaaatccctacaattcttgcagcaacagcatagtgaaatgctggcgaagctgcacgaggagatcgaacacttgaaacgcgagaataaagatctccgctacaaactcattatgaaccagacctctcagaaaaaggacagcctgagcacatcaagctttcagtccgttaagtccatcagcaactccggaaaagcccggccccagccggggtccttcaacaagcaggattctaaagcggacgtgccacaaaaggcggatcttgaagaggaacctttgctacataattctaaacttgataaggtgcctggggtgcaaggacaagcgagaaaggagaaggccgaagctagcaatgcaggtgccgcctgtatgggcaactcccagcaccaagggcggcagatgggtgcggccgcccatccaccgatgatcttgcctctgcccctacgtaagcccaccacactgcgccagtgtgaagtgctgatacgcgaactgtggaacaccaacttgctgcagactcaggagctacagcatctcaagagcctgctggagggcagccagcggccccaggcagttcctgaggaagcaagttttccaagagatcaggaagccacacattttcccaaggtctctaccaaatctcttagtaaaaaatgccttctcctgtcaccaccagtggctgaacgcgcaatcctgcctgcattgaagcagacaccgaagaacaacttcgctgagagacagaaacggcttcaagccatgcagaagagaaggctgcacagatctgtgctttag

SEQ ID NO: 46412 - DNA, 618 bp, Artificial Sequence
  Description of Artificial Sequence: Synthetic coding sequence
tgaagcggcgccggcgtggccgccggcacccggccccccagcagccccactcccggatcccgtcgccggcgacagcgtccttcagtcggagtgcagtctttgagaccacagtccccgcaattgagacagagcgatccacagaaacgcaacctagatctggagaaatctctgcagtttttgcaacagcagcatagtgaaatgctcgctaagttacatgaagagatcgagcacctgaagcgcgaaaataagggcgagcctgccagaggaccaagaccagcactgccacctcaggcccattctactctcccacttcctcaacatcgaaacactgcaataaacagcagcacaagacttgggagcggcggaactcaggacgatcttagatacaaactgatcatgaaccagacgagtcagaagaaagatggacctagtggaaaccacttaagccgggcgtccgcccccctcggagctcggtgggtgtgcattaatggggtctgggtggaacctggaggcccaagtccagcccgactgaaggaagggtcctccaggacacatcgacccggtggcaagcatggacggctggctggaggaagtgccgataccgtaagatctccgtag

SEQ ID NO: 46413 - DNA, 471 bp, Artificial Sequence
  Description of Artificial Sequence: Synthetic coding sequence
atgagccggaagagcggcatcggccacgaggccagcctgaagcggaaggcagaggagaagctcgaatcttataggaagaaaatccatatgaagaatcaggccgaggaaaaagcagctgagcagtttcgcatgagattaaaaaataaacaggatgagatgaaattagagggggaccttcgcaggagtcagcgggcttgtcagcagctcgacgtgcagaaaaacatccaggttccgcgggaagcatggtactggctccgcttagaggaagaaaccgaggaggacgaggaggaaaaggaacaggatgaggatgaatataaaagtgaagacctgtctgttctggagaaactacagatcctgactagctatttgagggaagagcacctttactgcatttggtgtgggacagcctatgaggacaaagaggatttaagctctaactgccctggtcctacttcggcggaccacgactag

SEQ ID NO: 46414 - DNA, 780 bp, Artificial Sequence
  Description of Artificial Sequence: Synthetic coding sequence
atggccgaggaggaggactacatgagcgacagcttcatcaacgtgcaggaagatattcgacccggcttgcctatgctccggcagatcagggaagctcggcgcaaggaagaaaaacagcaggaagccaacctgaagaatcgccagaagtccctcaaggaagaggaacaagaaaggagggatatcggactcaagaatgccctaggttgtgagaataagggattcgccctgttgcagaagatgggatacaagtccggccaagctttgggcaagtcggggggcggcatagtcgagcccattcctctgaatattaagactggaaaatcaggaatcggtcatgaagcgagcttgaagcggaaggcagaggagaagcttgagtcctaccgtaagaaaattcacatgaaaaaccaagctgaggagaaagccgcggagcaatttcgcatgcgcctgaagaataagcaagacgagatgaaacttgaaggagatttgcggaggtcccagagagcttgccaacaactcgacgttcagaagaatattcaggtgcctcgcgaggcgtggtattggttgagactggaagaggaaaccgaagaggacgaggaggagaaggaacaggatgaagacgagtacaagtctgaagaccttagcgttctggagaagctccagatcctgacctcttacctgcgcgaagagcatctgtattgtatatggtgtggaactgcctatgaggacaaggaggacttgtcaagtaactgtcccggacccacgagtgccgatcacgattag

SEQ ID NO: 46415 - DNA, 393 bp, Artificial Sequence
  Description of Artificial Sequence: Synthetic coding sequence
atggtggtggccgccggcaagcggttctgcggcgagcacgccggcgcagccgaggaggaggacgcccgtaaaaggattctatgtcccttagaccccaaacacacagtttacgaggatcagctcgcaaagcatctgaagaaatgcaactcccgggagaagcccaagcccgatttttacattcaggacatcaatgccggccttagggatgagacagagattcccgagcaactggtaccaatttcttccttgagcgaggagcagctggagaagctgatcaaaaaactcaggaaggcctccgaagccctgcacgatgctctgaacgatcccaaaaacggcgactccgccaccaaacacttaaaacagcaggtatgtctgggttatagcaactactag

SEQ ID NO: 46416 - DNA, 1446 bp, Artificial Sequence
  Description of Artificial Sequence: Synthetic coding sequence
atggccaccagcgccaccagcccccacgcccccggcttccccgccgaaggccgatgtggctactatgtggagaagaaaaaaagattctgccggatggtggtggcggctggcaagcgcttttgcggggaacacgcaggagcggctgaagaagaagatgcccggaagcgtattctgtgcccgctggaccctaagcacactgtttacgaagaccagttggcaaaacacttgaagaaatgcaatagcagggaaaaaccaaaacccgatttttacattcaggacatcaacgccggccttcgagacgagacggagatcccagaacagctcgtacccattagctctctgtcagaggagcagttagagaaactgattaagaagcttcggaaggcctccgagggactgaacagcaccttaaaggatcacatcatgtcacacccagcgttacacgacgcactgaacgatcccaaaaatggtgactctgctactaaacatctcaagcagcaggcctctatcctgggcaacatcgagaatctcaagttgctgggccccaggagatgttttgtggaattcggggccgggaagggtaaactgtcccactgggtcgacattgcactgaaggatgcagaaaaggtccacttcatcctagtagagaaggttacgacaaggtttaaggttgatggtaagcaccgcaagaagaattcagtttttgaaaggctgcagatagatatccaacatctctgtctcaacaagatccctgttctcagggaggaaaaattgcctgtagttgggatcggcaagcacttgtgcgggatggccactgacctggcattacgctgccttgtagaaacttacgcggcaagtttcgaggagagaaacgaagagccgctcgccaagcggataaagaatgataagactgaaaaggagatttatacactggctaaagaaggcaatgaaaagaacgtcccggagaaatggaacccagtcgcagggattgtaattgcactgtgctgccatcacaggtgtgactggcggcactacgtgggtaaagaatacttccgtgcactagggctgggtgctgtcgaattccactacttccagcgtatgtcaagttgggcaacctgcggcatgcggaagacgagtctggaaacctccaattctactacaaagcggcaggacaatcagaacgatgactcagaggaacacgacgacgggggatacaggataactgacgacggcgccgactgcttgcccggcctgctgtccgtggaagagaaaaaaaagattgggcatttgtgcaaactcttgattgatcagggccggatccagtatctccagcagaagggctttagtcctgccctgcaatactatacggatcctctcgttagcctagaaaatgttctactgacagccctgcccaaccattcttccagtccagaaactacagcatag

SEQ ID NO: 46417 - DNA, 330 bp, Artificial Sequence
  Description of Artificial Sequence: Synthetic coding sequence
atggccaccagcgccaccagcccccacgcccccggcttccccgccgagggccgctgtggttactacgttgagaaaaaaaaacgattctgtcgcatggtggtcgctgctggaaaaaggttctgtggtgagcacgctggggcagcggaggaggaggatgcacgtaaacggatcctgtgcccgctcgatccaaaacacactgtatacgaggaccagcttgccaaacatctgaagaaatgtaattctcgtgaaaagcccaagcctgatttctacatacaggacattaacgcgggtttgcgggatgaaaccgaaatccccgagcagctggcttag

SEQ ID NO: 46418 - DNA, 1317 bp, Artificial Sequence
  Description of Artificial Sequence: Synthetic coding sequence
atggagcacgccgccaccaccggcccccggcccggcccccccagccgacgcgtggagaatgtcgtactgcgcgccaaagattggctgccgggtgcccccgggggcactgctgtatgggccacatctttagaggccgaagtaccccccgacctggcgctgaataaagagcaacaacttcagatctcaaaagagttagttgacatacagatcactacccatcatttacacgagcagcacgaagcagaaatttttcagctaaagagcgagattctgcgcctcgaatctcgggttctggagctcgagctacgcggagacgggacgtcccagggatgtgctgtgcccgtggagagtgaccctcggcatcctagagctgctgcccaagagctgagacacaaggcacaggtgcccggccactcggacgaccaccggttccaggtccagccgaaaaacactatgaacccagagaacgagcagcaccgcctgggtagtggactgcaaggagaagtcaagtgggctcttgagcaccaggaagcccggcagcaggctctggtgacaagagtggccacacttggccggcagctgcagggggcccgggaagaggccagagctgctgggcagcgcctcgctacccaggcagtggtcctctgctcttgtcagggacagcttaggcaggccgaggccgaaaatgcccgcctgcagctccagctcaagaagctgaaagatgaatacgtcctgcgcctgcagcactgtgcctggcaagcggtcgagcacgccgacggggctggtcaagcgccagcaactactgccttacggacatttcttgaggctacactggaagacattagggctgcgcatcgcagcagagagcaacagttggccagggccgcacgctcttatcataagcggctggtggacctctcccggagacatgaagagctgttggttgcttaccgcgccccgggaaacccacaggctatttttgacatcgcctccctagacctcgaacctctcccagtgcccctcgtcaccgattttagccacagggaggaccagcatgggggccctggcgccctgctgagcagcccgaagaaaagaccgggtggcgcttcccaggggggtacctctgagccccaggggttggacgctgccagttgggctcagatacaccaaaagctgcgggatttttccaggagtacacagagctggaatgggagtggtcactcctgctggtccggcccgcggtggttgaagtcaaacttcctgagctaccgcagtacctggacgagcacatgggccggaacttccactaagagttag

SEQ ID NO: 46419 - DNA, 864 bp, Artificial Sequence
  Description of Artificial Sequence: Synthetic coding sequence
atgcacagcgtggcccacccccaccccggcgtgcccccctgggtgccagcaactctaataatcaccgggaagcggaggggagccgccgctgggggcgctggactcgagcacggtggatccggacgtgcacacctgagagaggtgtccgcagagacatggcgtactcgtggagtcggggccggacgcctggtgaccgggccagcattggcctcaggcccaccttgctctcagctgtacaatgggcagggcagcccccgaacgattagttggggtctcggccacacgcgggttggcgtggcaagcctgttaatgttagagtctctgtctggattggccctgtggtttagccccccacccgcagcatcccgtcccccagggcccggcctttccctctacacagacggctccaaggcttggggggcccctcaagaacacggcggagctcacgcgtccctgacccacagccaggtgtctcctccgggaagtggcaatctaactcagcacggccatgtgtgcccctgtgtcaccatgcccgctcttaaaaccactcctccgtttttgagcccacacagagggctggacgcggcgagctgggctcaaatccatcaaaaactgagagatttctctaggagcacccaggtaggcgggaaaggatggccacgacccattttaaccccctgcccctcatcttggctaacgtcaccttgccaagcagagctcgagcgggagagagcccaactgcttgtgagggccactatggcagaggaacagctcagtgagctgcaggagtacgttgaccaacacttgggaagatgggcagaaggcgctggatgcgacccccgcgcattggtgtggcttgagtag

SEQ ID NO: 46420 - DNA, 1527 bp, Artificial Sequence
  Description of Artificial Sequence: Synthetic coding sequence
atggagagcgaggacaccaagaagacccaggagatgaagaccgacctgaatctgctccttgaatgcctaaagtaccagatggataacgcctttagtcaaaaggaagccctcgtcaccatccactctatttgccagcagaacagtaatgctagcgtttactttcgcgagattggaggactcatgtttgtgaagaatcttgctaaaagcagcgaacactcaatggtgaaagaagccgccctgtatactctaggcgctattgctgagaaaaacgtgtattgccagcagactctgtgtactagtgagctttttgaggatctcacatggttcttgagcaacgatagcaacattaatctcaagcggatgtctgtctatgttatccttgtcttggtttcgaataataggactgggcagacacttgtccgagagactgggtgcattaccgtgctctccagactgttccgcaccgtaattagtaaacatgaacttgatctgtctgataagaacgtgtttcagagctaccagctctggagcagcgtctgtagcacactgtgcgtctgcgtaaataacccgcagaacgacgaaaaccagatgttctgttgctcgctctttcctcacgccaacgagtggctcaagaactgcacgactccggaaattattcgtccaatttgctctttcattggcctgactcttgctaacaatacatacgtccaaaagtacttcgtgtcggtgggcggactagacgtcctgtcacaggtcctgatgcagctagagtcggattctcacgagacactgtcttccgccaaacttgccgtggtcgtgaccaagaccgtagatgcttgcatagctgataacccgaccttcgggattgtgttgtccaagtaccatatcgtctcgaaacttttggccctcctgctgcacgaatccctggatagtggagaaaaattttccatcatgctgactctggggcattgcacagaagattgcgccgagaaactcagccttagccttggcgaatatccctttgatgagaacgaaactcagcagttgaaggatatcagtgttaaagagaacaacctcgaggaacattggaggaaggccaaggagattctgcatcgtattgagcagctcgagagggagggaaatgaggaggaaatccagcgagagaattaccaggataatatctcttctatgaacatttcaatccagaacacatggaaacatttacacgccgatcggattgggcgtggcagcaaagcagaggatgaagacaagtcccattcgagacagctgcaaagctacaaaagtcacggtgtaatgagcaaggcgtgcacaaacgatgatcagatgaagacccccctgaagtccgctaatccggtgcacgcatgctacagagaaagcgagcagaacaagactttgtataaagcaaaaagcagctgcaaccaaaatttgcacgaggaaactactttcgaaaagaactttgtgtcccagtcaaggtctatttacatcatgtttcggtacaacaagtag

SEQ ID NO: 46421 - DNA, 2043 bp, Artificial Sequence
  Description of Artificial Sequence: Synthetic coding sequence
atggagagcgaggacaccaagaagacccaggagatgaagaccgacctcaatctgctgctggagtgtctgaaataccagatggataatgcttttagccaaaaggaggcactcgtcactatccactccatctgccaacagaatagtaacgcaagtgtgtactttagggaaattgggggactcatgttcgtgaagaacttagctaagagctcagagcacagcatggtgaaggaggccgccctgtacaccctgggagccattgccgaaaagaacgtgtactgtcagcagacactgtgtactagcgagctctttgaagacctaacatggttcctatctaacgacagcaacattaacctgaaaagaatgtctgtttacgtcatcctcgtcctggtgagtaacaataggactgggcaaacgttagttcgcgagacagggtgtatcacagtgctaagtaggcttttccgtacagtgatatctaaacacgaactggacttgtcagataagaacgtatttcaatcctatcagctctggagtagcgtctgtagcactctgtgcgtctgcgtgaacaacccacagaacgatgagaaccaaatgttctgttgttctctttttcctcacgccaacgaatggcttaagaactgtaccactcctgaaattatcaggccaatttgctcattcattggactaacgcttgccaacaacacctatgtgcagaagtactttgtgtctgtcggtggcctggatgtcctctctcaagtgctcatgcaactggaatccgatagtcatgaaaccctgtctagtgctaaattggctgtggtggttactaaaactgtcgatgcctgcattgcagacaatcctacatttgggatagtcctgtctaaataccatatcgtttccaagctgctggccctcctcctccacgagagcctggactctggagaaaagtttagtatcatgctgaccctggggcactgcacagaagattgcgaagagaaccagtacgacctcttcaaaaataatggcctgccactcatgatacaggctcttacagaaagtcagaacgaggaactcaacaaggcggctacgttcgtcctgcacaactgcaagaagattactgagaaattaagcctcagcttaggagagtaccctttcgacgagaatgagactcaacagctgaaggatataagcgtcaaagagaataatctggaagaacattggcgcaaagccaaggagattctgcaccgtattgagcagttggagcgggaggggaacgaggaagagatccaaagagaaaactaccaggacaatatctcatctatgaatattagcatccagaacacatggaaacatttacacgctgataggataggcaggggatctaaagcagaagatgaggataagtctcactctcgtcagctgcaatcgtacaagtcacacggggtgatgagcaaggcctgcactaacgatgatcagatgaaaaccccactgaagtctgccaatccagtccatgcctgctaccgggaatccgaacagaataagactttgtataaggcaaaatcctcatgcaaccagaacctgcacgaggaaacgactttcgaaaaaaactttgtctcccagtccaggtacagtctgattattgtttgctgtatagcagtggaaaaatctctgaatagccggaacttctcgaaactgttgcacagctgcccataccaatgtgacaggcacaaggtgatcgtggaggctgaagacaggtacaagtccgagctgaggaagagcttaatttgcaacaaaaaaatcctactgaccccaaggaggaggcagaggctgtctaacgagtcaacaactccaggtggaattaagaagcgcagaatccgaaaaaactttacggaagaagaggtgaattacctcttcaacggcgtcaagaagatgggaaatcactggaactccatcctgtggagtttcccttttcaacaaggccggaaggcagtggatcttgcccataaataccacaaactgaccaagcaccctacctgcgcggcctcctag

SEQ ID NO: 46422 - DNA, 2184 bp, Artificial Sequence
  Description of Artificial Sequence: Synthetic coding sequence
atggagagcgaggacaccaagaagacccaggagatgaagaccgacctgaacctgctgctggagtgcttgaagtatcaaatggacaatgctttcagccagaaggaggcgctggtgaccattcattctatttgtcaacaaaactccaacgcctcagtgtacttccgcgaaatcggggggctgatgtttgtcaaaaatctggcaaagagctccgaacattccatggtgaaggaggctgcactatacaccctcggggcaatagccgagaaaaacgtttactgtcagcagaccctgtgcacctctgagttattcgaggatctgacatggtttctatcaaatgatagcaacatcaatcttaagcgtatgagcgtgtatgtgatcctggttctggtctctaacaaccggacaggccagacactggtgagagaaaccggttgcattacggtcctttcacggctcttcagaacggtaatttccaagcatgagctggatctttccgacaagaacgtgttccagtcttatcagctgtggtcatccgtgtgcagtaccctgtgcgtatgcgtcaacaatcctcagaatgatgagaatcaaatgttttgctgttccctgtttccacacgccaacgagtggctcaaaaactgcactacccctgaaattattagaccaatatgtagtttcataggactgaccctggctaataacacttacgttcaaaagtatttcgtgtcagtgggcggactagatgtcttaagccaagtactgatgcagctggaaagcgactctcatgagactctgagctctgcgaagttggccgtagttgtcaccaagacagttgatgcctgtatcgccgataatcctactttcggtatcgtcctatcaaagtaccacatagtgagtaaactgctcgcgctgttgttgcacgaatccctcgacagtggggaaaagttctccataatgctgactctgggtcactgcaccgaggactgtgaggaaaatcagtacgatctgttcaagaataatgggcttcccttaatgatccaggctttgactgaatcccagaatgaggaattgaataaggcagccacgttcgtgctccataactgtaaaaaaataaccgagaagctgagccttagtttgggagagtatcccttcgatgaaaacgagacacaacagcttaaagatatcagcgtcaaagaaaacaatttagaagagcactggcgcaaagcgaaggagattctgcatcgcatcgagcagctggagagggagggcaacgaggaggaaatccagcgagagaattaccaggacaacatctcctcaatgaacataagcatccaaaacacttggaagcacctgcatgccgaccgcatcggacgaggatctaaagctgaagatgaggacaagtcacattccagacaactccagtcttacaagtcacatggggtaatgtctaaggcctgtacaaacgatgatcaaatgaagactcccttgaagtcagcaaatccagttcacgcctgttatagagagtctgagcaaaataaaaccttgtacaaggccaagagttcatgcaatcagaatctgcacgaagagacaacattcgagaagaatttcgttagccagtcatcagaccacgtattcaagcatcctgtacacatcgccaaaaatatcaagcagcagctgccagtaactgatccgtttacactgtgcagtgacataattaataaagaagttgtgtcattcctggcgacaccatcctgttctgaaatgctcacataccggtgtagcggatgcatagcggtggaaaaaagcctcaattcccggaatttcagtaagctgttgcatagctgcccataccagtgcgaccgccacaaagtcatcgtcgaagctgaagaccgttataagagtgagctacgcaagtctctgatctgcaataaaaagattctgcttacccctaggcggaggcagcgcctcagtaatgaatcaacgaccccaggagggatcaagaaacggcgtatccgtaaaaactttaccgaagaggaagtgaactatctgtttaatggcgtgaagaaaatgggtaaccattggaattctatcctgtggagcttcccctttcagcagggtaggaaggcagtggacctcgcacataagtatcacaaactaacaaagcacccaacttgcgctgcttcctag

SEQ ID NO: 46423 - DNA, 1653 bp, Artificial Sequence
  Description of Artificial Sequence: Synthetic coding sequence
atggagagcgaggacaccaagaagacccaggagatgaagaccgacctgaacctactgctggaatgcctgaaatatcagatggataacgctttttcccagaaagaggcattggtgaccatccattcgatttgccagcagaacagtaacgcatcagtttatttcagggagatcggtggacttatgtttgtgaaaaacctggctaagtctagcgagcactccatggtcaaggaagccgccctttacaccctcggtgctatagccgagaagaacgtttactgtcaacagaccttgtgcaccagtgagctgttcgaggaccttacctggtttctgtccaatgattccaatatcaacttaaagagaatgagcgtgtatgtaattttggtcctagtcagtaataatagaacagggcagaccttagttagggagactgggtgcattactgtgttgtcgagactgttccggactgtaataagtaagcacgagctggaccttagcgacaaaaatgtctttcagtcttaccagctgtggagcagcgtttgcagcactctctgtgtctgtgtcaacaaccctcaaaatgacgagaatcagatgttctgctgcagtcttttcccccacgccaacgaatggctgaagaactgcacaacccccgaaatcattagacccatctgcagttttataggtttaaccctggcaaacaacacttatgtacagaagtatttcgttagtgtgggcggattagacgtgttaagccaggttctgatgcaactcgaatccgatagccatgagaccctaagtagtgcaaaactggcagtggttgtgaccaaaaccgtcgatgcatgcatcgcggacaatccaacctttggaatagttcttagcaagtatcacatcgtctccaaactactggccttgctgctccacgaatcactggatagcggcgaaaaattctcaattatgcttacgctgggccactgcactgaagattgcgaagagaatcagtacgatttgtttaaaaacaatggacttcctctgatgatccaagccctgactgagagccaaaatgaggaacttaataaggcagcaacttttgtacttcacaactgcaaaaagatcacagaaaagctgtctctgtcccttggagagtacccctttgacgagaatgaaacccaacagttgaaggacatttcagtcaaagagaataatctggaggaacattggagaaaagccaaggagatcctccatagaatcgagcagctggaacgggaagggaacgaagaggagattcagcgggaaaactaccaggataacattagcagcatgaatatctctattcagaatacatggaagcacttgcacgccgacagaatcgggcgtggctcgaaagcagaagatgaggataagagccatagcaggcaactgcagagttacaaaagccatggcgtgatgtctaaagcctgtactaatgacgaccagatgaagaccccactgaaatcagctaacccagtgcatgcgtgttaccgtgagtccgagcaaaataaaacactgtataaggccaaatcctcctgtaatcagaatctgcatgaagaaacaactttcgaaaaaaacttcgtgtcgcagtcgcggtccatctacatcatgttccgatacaataaatag

SEQ ID NO: 46424 - DNA, 1164 bp, Artificial Sequence
  Description of Artificial Sequence: Synthetic coding sequence
atggagaacaagctgcccatggagaccctggtggaggagtgcggcgaaaacagggaaaggaagtgtaagcttaaggaccagagcgataaggaagaagggactcgcgatatctcctcacctaaaaggctaagagacagacaggccctgtttcctgccaaggtaacaaatgtgagtctcctagagaaattcgagcggtccgagagtggcggaaagattatgactcccgagtccctcagttacccatcatgtttaaagcatgattcagagatgaaaccacagacaagcccagcatgtcaggaccataataaggcaggccagatgaagtcactggccactagagagcagaatcaaaagaacgcggcctataacctcggtgttgcagaggccatcagaaaccataagaacgagaagccggaattttacaaatcctttctgttcgacaagaggccattgtcccccgccctgaacgccctcaagcaggaagagtattctagatctctgttgaaacaaatggataacaggcaggagaacgagattaaacagcgacagtatcgagagcttatggatcgcctggagcaagtgcagcttaccgaagagctggcagctcaacgagcaaagttcttgaaggacaaaatggaggagacccaatgctacaagcgggctctggacgcccaaataaagaacaaacctagtcggctgccccccttcgaacctgacagcagcgaaccgatttttgggaagaatgaaggagaattgatggtcgagaaacaaaagagagaacaaaattacatgaagcatcagctggaggccgccgctaaccacaaacgaaaggcaatcctgcaccaattggttgaccagcgcagggacctgcagatgttgcaaagaacgcagcgggagcacttggctgaccggaccgcagagctcgagagagtcaatcgcgttaaccaatgcctccaggaggattgggaacgcagtgccgccatgaaaaagcagcgagaccttgaagataaggcatttgaaagggcttcagataagctctttttactagaccagtgcgagaagtatcgtcggtgcaagcagtgccaacgtcgaacttcaaatgtgggtgagagcaacctctggcctctgaacaagttccttccgggctcccggttgttggtttag

SEQ ID NO: 46425 - DNA, 1689 bp, Artificial Sequence
  Description of Artificial Sequence: Synthetic coding sequence
atgctggacaccatcgcccgggccctgcaggacctgggccggcaggtgctgcccacactgccatcactttcgcaggaggaagtttccattatttggggcaatgtgtcagagtttgtacgacgccagctcaccttgcacaaaggcgtgcagatcccagcgtttgggactttcacatttattaggcagaagctcgaggtaggtaacaataagttcatactgatccagcgtcctgtattcatcatggtggaaaagttggtgcaaattcacggccttaagcagaacaagcgaccggggaccgtggacagcgtacttagctccagggaggcgctcagaaaatggccttcgtcggtactggcctttccccggatcgagctgaaggaaatggagaacaaactgccaatggagacactggtggaggagtgtggggagaacagagagagaaagtgtaagctgaaggaccagtcagataaggaggaagggacacgcgacatcagttcacctaaaagactcagggacagacaggcactgttcccggctaaagtgaccaacgtgtcgctgctggaaaaatttgagcggtctgagtccggaggtaagattatgacaccagaatcactgtcgtatccctcttgtttgaaacatgacagcgagatgaaaccacagacgtcccccgcctgccaggaccataacaaggcaggacaggagatgtgttacgtttgtttacagcgcgcccagcgaaacagcctcctgtactattccgaggagaggcgccgggagattgaagacgagcgcctcattcagcaataccaaatgcttaaagaccaagaggccttgtttcggcaccagatgaagtcattggctacccgggagcagaatcaaaagaacgcggcatataacctgggagtggcagaggccatcagaaaccacaagaacgagaagccggagttttataagagctttctgttcgacaagaggccattatcccctgcattgaatgctctgaaacaggaagaatattctagatcactgctgaagcagatggataatcggcaggagaatgagatcaaacagagacagtacagggaactgatggacagactggaacaagtgcagttgaccgaggagcttgcggctcaaagggccaaattccttaaagacaagatggaagaaacacagtgttacaaaagagctctggacgcccagatcaaaaataagccctcccgacttcctccatttgaaccggatagttccgaaccaatttttggaaaaaacgagggggagctgatggtggaaaagcagaagagggagcagaactacatgaaacaccagctggaggccgccgcaaatcataaaaggaaggctatcttgcatcagctggttgatcagaggagagatttgcaaatgctgcagcgcacccaacgcgaacatttggcggatagaacggccgagttggaacgagtaaaccgtgtgaaccagtgtctgcaagaagactgggagagatccgcggccatgaaaaagcagcgggatctggaagacaaggctttcgagcgtgcctccgacaaactttttctactcgatcagtgcgagaagtatcggcgctgtaagcagtgccagcggagaactagcaacgtgggagaaagcaacttgtggccactcaataagttcctacccgggagtcggctcttagtttag

SEQ ID NO: 46426 - DNA, 1959 bp, Artificial Sequence
  Description of Artificial Sequence: Synthetic coding sequence
atgctggacaccatcgcccgggccctgcaggacctgggccggcaggtactgcctacactcccttctctgagccaggaagaagttagcatcatttgggggaacgtgtcggagtttgtgaggcgccagctcacgttgcataagggggtgcaaatcccagcctttggcaccttcaccttcatacgacagaagctggaagtgggcaataacaaatttattctgatccagaggccagtgtttattatggttgaaaaactggtccagattcatggtctgaaacagaataaggtgtatacacccggcgaaattcctattgtgccgttgaattttgttatgatatctcttgaagggccattcaaccgggacgtggttgaaggctgcgtgaaggagacactgttatttttgtcccggagtatatccatgaagcagaatgtggaatttacattcaaaggcattggcgtgcttatgatccgtgattcaaaggtcaaaatgcgcttttacaaggactttctgtgtaccatggatggaagcggtgctcttgcaaaggcccttgccaaccggccagggacggttgacagtgtgttatccagcagggaagccctacgtaagtggccctcctcagtcctggcatttcctcgcattgagctaaaggaaatggagaacaaactacctatggagacactggtggaagagtgcggggagaatagagagaggaaatgtaagctgaaggatcaaagcgacaaggaggaaggcacccgagacatctcgagtccaaagaggctgcgggatagacaagcccttttcccggccaaagtcacaaatgtgagcttgttggagaaatttgagaggtcggaatccggcggcaagatcatgactcccgagtccctgtcctatccttcctgccttaagcatgatagcgaaatgaagccacagacgtcccccgcgtgtcaggaccacaataaagccgggcaggaaatgtgttacgtgtgcttgcagcgagcccaaagaaattcattactgtattactccgaggagcggaggcgagaaattgaagatgaacgcctgatccagcaataccaaatgctgaaggaccaggaagccttatttaggcaccaaatgaaatccttggcaactagggagcagaaccagaagaacgctgcatataacctgggagtggctgaagctatcagaaatcataaaaacgaaaaacctgaattttacaaatcctttctgttcgataagcgtccccttagccctgctctcaatgcactcaagcaggaagagtactcaaggtctctccttaaacagatggacaaccgacaggaaaacgagattaagcagagacagtaccgcgagcttatggatagactagaacaggtgcagctcacggaagaactagccgcccagcgcgccaaattcttaaaggacaaaatggaagagacacaatgctacaaaagagcactggacgcacaaatcaaaaacaagccttcccgcttgccacccttcgagcccgacagtagcgaaccaattttcgggaagaatgagggggagctcatggtcgaaaagcagaaacgagagcagaactacatgaagcaccagctggaggctgctgctaaccacaagcggaaagccatcctgcatcaactggtcgaccaacgccgggatctgcagatgttgcagcgtacccaacgagagcatctggccgaccgaactgcagaactcgagcgagtcaacagggtcaatcagtgcctccaagaagactgggagaggagtgctgccatgaaaaagcagcgcgatttggaggataaagcattcgagcgggccagtgataaactgttcctgctggatcagtgtgaaaaataccggcggtgcaaacagtgccaaaggcgcacttcgaatgtaggtgaaagcaatctgtggcccctgaacaaatttcttcccggcagtcggctactggtctag

SEQ ID NO: 46427 - DNA, 1635 bp, Artificial Sequence
  Description of Artificial Sequence: Synthetic coding sequence
atgatccacgtgcggcggcacgagacccggcggaacagcaagagccatgtgcctgagcaaaaaagccgcgtcgattggcgccgcacgaagcgctccagtatctctcaacttttggatagtgacgaagagcttgacagcgaggaattcgactcagacgaagaactggactcagatgagagtttcgaaaacgacgaggagctggactcaaataaggggcccgactgcaataaaacccccggaagcgagcgggagctgaacctctctaagatacagtcagaaggtaatgattcaaaatgcctgatcaacagcggaaatggttctacatacgaggaggaaaccaacaagatcaagcacagaaacatcgacctccaggaccaggagaaacatctctctcaggaggataatgatctgaacaaacagaccggtcagatcattgaagatgaccaggagaaacacctgtcacaggaggacaacgatctgaacaagcagacaggtcagatcattgaggacgaccttgaggaagaagacataaagagaggtaagcgcaaaagactgtcttcagtcatgtgcgactccgacgagagtgatgactcagacatactggtgcggaaggtgggagtgaagcggccaaggagagttgtagaggatgagggctcttctgttgagatggagcagaagaccccagaaaagacattggctgctcagaagagggagaaactccagaagttaaaagagttatcgaaacagagaagccgccagcgccgctccagcgggagggatttcgaggatagcgaaaaggagagctgtccctcaagtgacgaggtggatgaagaggaagaagaggacaactacgagagtgatgaggacggtgacgattacattatcgacgacttcgtagtgcaggatgaggagggtgacgaggagaataagaatcagcagggggaaaaattgacgacttctcaactgaagctcgttaaacaaaattcgctgtacagcttcagtgatcattacactcactttgaaagagtggtgaaagcactgctcattaacgctcttgacgagagttttctcggcaccctctatgatggtacgcgtcagaagtcttacgccaaagacatgttaacatcgcttcactacctggataataggtttgtgcagccacgcctggaaagcttggtaagcaggtctaggtggaaggaacaatataaagaacgggtagagaactactctaacgtgtccatccacctgaaaaacccggagaattgcagttgccaagcctgcggtctgcacaggtactgcaagtacagcgtgcacttgtcaggtgaactgtataacacaagaacaatgcagattgataacttcatgtcgcacgataagcaggtctttaccgttggtcgaatatgcgccagccggacccgcatctatcacaagctgaagcactttaagtttaagttgtaccaggagtgctgtaccattgccatgacagaggaagtcgaggatgagcaggtgaaagagacggttgaacgaatctttcggcgctcaaaggagaatggttggatcaaggaaaagtatggccagttggaggagtacctgaacttcgccgattatttccaggaggagaaatttgagttgtag

SEQ ID NO: 46428 - DNA, 1635 bp, Artificial Sequence
  Description of Artificial Sequence: Synthetic coding sequence
atgatccacgtgcggcggcacgagacccggcggaacagcaagagccacgtcccggagcaaaagtcccgcgttgattggaggcgaacaaaacgcagctcaatctctcagttactggattcagacgaggaacttgactcagaggagtttgattcagatgaagagctggattcggatgagagctttgagaatgatgaagaactcgatagtaataagggtccagactgcaataagactcccggcagcgaaagagaactgaacctctctaaaattcagtctgaaggcaatgactccaaatgtctgataaactctgggaacggtagtacatacgaggaggagacaaacaaaataaaacatcgcaacatagatttacaggaccaagagaaacacctgtcccaggaagacaatgacttgaacaaacagacaggacagatcattgaggacgatcaggaaaaacacctaagtcaggaagacaacgatctaaataaacagaccggccagatcattgaagacgatctagaggaggaggatattaaacgcggtaagcggaaacgcttgtctagcgtcatgtgtgattccgacgagagcgacgatagcgatatcctggtgcgaaaagtaggggtgaagcgtccccgaagagtggtggaagatgagggctcttcggtggaaatggagcagaagacccctgagaaaacactcgctgctcagaagcgggagaaacttcaaaaattgaaggaactctccaaacagagatcccgtcagcggaggagctcgggccgagacttcgaggacagcgaaaaagagtcgtgcccttcctctgacgaggtcgatgaggaagaggaagaggacaattacgagagtgacgaggatggggacgactacatcatagatgattttgtggttcaggacgaagaaggcgacgaggagaataagaatcagcaaggcgagaagctgaccacaagccagctcaagttagtcaagcaaaacagcctctatagcttttctgaccattatactcattttgagcgggtagtcaaggccctgctcatcaacgcattggatgagtccttcctgggtacgctttatgacgggactcgacagaaaagttatgcgaaggacatgcttacctctctacactatctcgataatagattcgtgcaaccacgcctcgagtctctcgtctcacgatcacgctggaaggagcagtacaaggaaagggtggagaattactcaaatgtctctatccatctgaagaaccccgagaactgttcctgccaggcttgcggccttcatagatattgtaagtatagtgttcacctatccggcgaactgtacaacacaaggactatgcagatcgacaactttatgagccatgataagcaagtatttacagtgggccgcatctgcgcatctcggacccggatttatcacaaacttaagcactttaaatttaaactctaccaagaatgctgtacgatagccatgacagaggaggtggaggacgagcaggtgaaggaaacggtggaaagaattttccgccgctctaaagagaatggctggataaaggagaaatacggccagcttgaggaatatctcaatttcgctgattatttccaagaggagaaattcgagctgtag

SEQ ID NO: 46429 - DNA, 93 bp, Artificial Sequence
  Description of Artificial Sequence: Synthetic coding sequence
atgatccacgtgcggcggcacgagacccggcggaacagcaagagccatgttccagaacagaagtctcgagtggattggaggagaacaaagtag

SEQ ID NO: 46430 - DNA, 789 bp, Artificial Sequence
  Description of Artificial Sequence: Synthetic coding sequence
atgatccacgtgcggcggcacgagacccggcggaacagcaagagccacgtgcctgaacagaagagtcgagtggactggcgccggacaaaacgctcttctatcagtcagttgctggacagtgacgaggaacttgactccgaagaattcgactcagacgaggagctagacagtgacgaatcctttgagaatgatgaggagctggactccaataaaggcccagactgcaacaaaactccgggctcggaaagggaattgaatctgtccaagattcagtccgagggcaatgactcgaaatgtctgattaactcaggcaacggctcaacatacgaggaagagactaataaaataaagcacagaaatatagacctgcaggaccaggaaaaacaccttagccaggaggataatgacctaaataaacagacgggccaaatcattgaagatgaccaggagaagcacttaagccaggaggataacgatctgaataaacaaactggccagattattgaggatgatctggaggaggaggatatcaagcgcggtaaaagaaaaaggctaagttccgtgatgtgtgactctgacgaatccgatgacagcgacattctggtgagaaaagttggggtgaaacgaccacggcgagtggtagaggacgaagggtcttctgttgagatggagcaaaagacccccgaaaagaccctcgccgctcagaaaagagagaagctgcagaagttgaaggaactctccaaacagcggagtcgacagcgtagatccagcggtcgcgactttgaatag

SEQ ID NO: 46431 - DNA, 1635 bp, Artificial Sequence
  Description of Artificial Sequence: Synthetic coding sequence
atgatccacgtgcggcggcacgagacccggcggaacagcaagagccatgtgcccgagcagaagagtcgagtggactggcgccgtaccaagcgctcttccatcagtcaactgctggattccgacgaagagctcgactctgaggaatttgattctgacgaggagcttgattccgatgaatccttcgagaacgacgaagagcttgattccaacaaaggtcctgattgtaacaagaccccaggctccgagcgggagctaaatctgtcgaaaattcagagtgagggcaacgattctaagtgtcttatcaactccggtaatggctctacctatgaggaagagaccaataagatcaagcacaggaatatagacttacaggatcaggagaaacatctcagccaggaggacaacgatttaaataagcagactggacagataatcgaagacgaccaggaaaagcatttgagtcaggaggacaacgatttaaacaagcagacaggacagatcattgaagatgatctagaggaggaagatatcaaacgtgggaagcgcaaaagactgtcaagcgtcatgtgcgacagcgatgagagcgacgacagcgatattttagtccgcaaggttggggtgaagagaccccggcgcgtcgttgaggatgaaggcagcagcgtcgagatggagcagaagaccccggaaaaaacccttgcagcacaaaagcgcgagaagctgcagaagctcaaggaattgtccaaacaacgcagccgacaacggcgctcgtccgggagagattttgaagactctgagaaagagagctgccccagctcagatgaggtggacgaagaggaggaggaggataattatgagtccgacgaggatggcgatgattacattattgacgattttgtggtgcaagacgaggagggggacgaggaaaacaagaaccaacaaggcgaaaagctgaccacatcccagctcaaacttgtcaagcaaaacagcctgtattctttctccgaccactacacgcacttcgaaagagtggtgaaggctctcttaatcaacgccctggacgagagcttcctggggaccctctatgatggcactcgtcaaaaaagttacgccaaagatatgctcaccagcctacactacctcgacaatagattcgttcagccacgtttagaatccttagtgtcaaggtctcggtggaaggaacagtataaggaaagggttgagaattactctaatgtttcgattcacctgaagaacccagagaactgctcctgtcaagcatgtggactgcatcgatattgcaagtactctgttcatctatccggtgaactttacaatacaaggaccatgcaaattgataactttatgtcccatgataagcaagtgtttaccgtcggcaggatatgtgctagccgaacgaggatataccacaagctgaaacactttaaattcaaactataccaggagtgttgcacaattgcgatgaccgaggaagtggaagatgagcaggtcaaggagactgtggaaagaatcttccgccgtagtaaagagaatggatggatcaaggagaagtacggccaactcgaggaatatctgaatttcgcagactacttccaggaggaaaaattcgaactgtag

SEQ ID NO: 46432 - DNA, 1335 bp, Artificial Sequence
  Description of Artificial Sequence: Synthetic coding sequence
atggagaacagcggcaaggccaacaagaaggacacccacgacggcccccccaaggagattaagctccctacctctgaggccctcttggattaccaatgccagattaaagaggatgccgtggagcaatttatgttccagattaagacactacgaaaaaagaatcagaaataccacgaacggaactcaagattaaaagaggagcagatctggcacatcagacaccttctaaaagagctcagcgaggaaaaagccgagggattgcctgtggtaactcgcgaagacgtggaggaggctatgaaggagaagtggaagttcgaacgggatcaagagaaaaatctcagagacatgaggatgcagattagcaatgccgagaaattgttccttgaaaagctgtcagagaaggagtattgggaggagtacaagaacgtcgggagcgagcggcacgccaaacttataaccagcctccaaaacgacatcaacaccgtgaaggaaaatgccgagaagatgagcgaacattataagatcaccctggaggacacaagaaagaagatcattaaagaaacactgttacagctggatcagaagaaagaatgggccacccagaatgccgtcaagctaatcgacaagggatcatatctggagatctgggaaaacgattggttaaaaaaggaagttgcaattcaccgcaaagaagttgaggaactcaaaaatgccattcacgaactggaggccgaaaacctggtcttgattgaccagctttccaattgccggctggtggatttaaagatcccaaggtatcccgtcctgcactcttgccctacatccaacccccggcacctgctgctcctccctctcgagagctgcctcatcagcgcacggcgatgctggaggctttacttgactcaagcggctggcttggaagtgcccccggaagagatgtccctagaactcccagagactcacatcgaagagaaaagtgaactacagccaacagaagtggaaagtcgggatctcatgtccagctcagatgagtcaacaatcctgcacttgagtcacgagaatagcattgaagatctgcagtacgttaagatcgataaagaggaaaactcaggaacggaattcggtgatacagatatgaagtatttgttatacgaagacgagaaagatttcaaggactatgtcaacttgggcccactgggtgtaaagctaatgtccgtggagagcaagaaaatgccgatccattttcaggagaaggagatacccgtgaagctatacaaagacgttcggagccccgagagccatattacctacaaaatgatgaagtcttttctttag

SEQ ID NO: 46433 - DNA, 1242 bp, Artificial Sequence
  Description of Artificial Sequence: Synthetic coding sequence
atggagaacagcggcaaggccaacaagaaggacacccacgacggccccccaaaggagattaaattacctaccagtgaggctctccttgattatcagtgtcaaattaaggaagatgctgtggaacagtttatgtttcagattaagacactgcggaaaaagaatcagaaataccatgaacgaaacagccggctgaaggaggagcagatctggcacatacggcatcttttgaaggagctgtcagaggaaaaagctgagggactgcctgttgtaacacgcgaggacgtggaggaagccatgaaagaaaaatggaagtttgaacgcgatcaggaaaagaatcttcgagacatgcgtatgcagatcagtaacgcggaaaagctgtttctggaaaaattaagtgaaaaggaatactgggaggagtacaaaaatgtggggtccgaaagacatgccaagctgattacctcacttcagaacgatattaacactgtaaaggagaacgccgagaagatgagcgagcactataagatcactctggaagatacccgtaagaagatcattaaagaaacattactgcaactagaccagaagaaagagtgggcaacacagaatgccgtgaaactgatcgacaagggatcatatctcgaaatctgggaaaacgactggctgaagaaagaggtcgctattcacagaaaggaagtagaggaactgaaaaatgctattcacgaactcgaagctgagaacttggtcctcattgatcaactgagcaactgccgactggtggaccttaaaatcccacggagactgtatttaactcaggctgcaggcttggaggttccacccgaagagatgagcttggaactccccgaaactcacatcgaagaaaagtctgagctccagccaaccgaagtggaaagtagagacctgatgtcctcaagtgacgagtctaccatcctgcatctgtcccacgagaacagtattgaggatcttcagtacgtgaaaattgacaaggaagaaaattccggaacggagttcggcgatactgacatgaagtacctactgtacgaggacgagaaagatttcaaagattacgtgaatctgggaccgctgggcgtgaaattgatgagcgtggagtccaagaaaatgcccattcattttcaggagaaggaaatacccgtgaagctatataaagacgtgagaagccctgagtctcacataacatataaaatgatgaagagttttttgtag

SEQ ID NO: 46434 - DNA, 942 bp, Artificial Sequence
  Description of Artificial Sequence: Synthetic coding sequence
atgttccagatcaagaccctgcggaagaagaaccagaagtaccacgaacggaatagcaggctgaaagaggaacaaatctggcacattcgtcatcttctgaaggaattgtcggaagagaaggccgaaggcctgcccgtagtcacccgcgaggacgtggaggaggccatgaaagaaaaatggaagtttgaacgtgatcaggagaaaaacctgagagaacactacaagattaccctggaagacacccgtaagaaaattatcaaggagacattacttcaacttgatcagaaaaaagaatgggccactcagaatgctgtgaaactgatagataagggaagctacttggagatctgggagaacgactggctgaagaaggaagttgccatccatagaaaggaagtggaagagctgaaaaatgccatccacgagcttgaagctgagaacttagtgcttattgatcagttgtcaaattgccggcttgtcgatcttaagattccacggaggctctacctaacacaggctgccggcctggaagtgccccctgaggaaatgtcattggaactgcctgagactcatatcgaaaagagtgagctgcagccaaccgaggtagaaagtagagacctcatgtcctcgtctgatgagtctacaattctgcacctgagccacgagaactccatcgaggacctgcagtacgtcaaaattgacaaagaggagaactcaggcactgagttcggcgacaccgatatgaaatatcttctgtacgaagacgaaaaggattttaaggactacgttaacctgggaccactgggcgttaaactcatgtcagtcgaatcaaaaaagatgccaatccacttccaggagaaggaaatccctgtgaagctgtataaagatgttagaagtccagaatcgcacatcacgtacaaaatgatgaagtccttcctttag

SEQ ID NO: 46435 - DNA, 999 bp, Artificial Sequence
  Description of Artificial Sequence: Synthetic coding sequence
atggcccccgcccagcggtgccccctgtgccggcagaccttcttctgcgggcgcggacacgtgtactctcgcaaacaccagagacagctgaaagaagccctcgaaaggttacttccccaggtggaggctgcccgcaaggccatcagagctgcccaagtggagcggtatgtacccgagcacgaaagatgctgctggtgcttgtgctgtggatgcgaagtgagggagcacctgtcccatggcaacctgaccgtgctatacggcggactcctagaacacctggcttcccctgagcacaagaaagcaactaataaattttggtgggagaataaagcagaagtgcaaatgaaggagaaatttctcgtgacaccacaggactacgcacgctttaagaagtccatggtgaaggggttagattcgtatgaggaaaaagaagataaggtgattaaggaaatggctgcccaaatccgagaagtggaacaatctcgccaggaagtggtcaggagtgtcctggaaccgcaggccgtgcccgacccagaagaaggttccagtgcccctagatcgtggaaagggatgaactctcaggtagcttcaagccttcagcaaccctctaacctggatctgcctcccgcccccgaactggattggatggagacaggcccatccttgacctttatcggtcaccaggatataccaggagtcggaaacatccatagtggagcgaccccaccttggatgatccaggacgaggaatatattgccggtaatcaagaaataggaccaagctatgaggagttcctcaaagaaaaggagaagcagaaactgaagaaattaccgcctgatagagtgggcgccaactttgatcattctagccggacctcagccgggtggctcccctctttcggcagggtttggaacaacggacggcgatggcagtcgcgccatcagtttaagaccgaggcagccgcaatgaagaagcaatcccacacagaaaagagctag

SEQ ID NO: 46436 - DNA, 1662 bp, Artificial Sequence
  Description of Artificial Sequence: Synthetic coding sequence
atgagcaaggccgccggcggcgccgccgccgccgccgccgccgccgaaagctgttcccctgccccagctggcagctcagctgccccacctgctccagtcgaagatctcagcaaggtgagcgatgaagagctccttcagtggagtaaagaggaattaatcaggtctctgaggcgagcggaggcagagaaagtgtctgccatgcttgaccactcaaatcttattcgtgaggttaaccggcgcttgcaattacacttaggggaaatacggggactgaaagacatcaaccagaagttacaggaagataaccaggagctgcgtgatctgtgctgtttcctagacgacgacagacagaaaggaaagcgtgtaagtcgcgagtggcagcggctaggtagatatactgctggcgtaatgcacaaggaggtggcactgtatttgcagaaacttaaggatctcgaagtgaagcaggaggaggttgtgaaagaaaacatggagctcaaggagctctgcgtgctgctggacgaagagaaaggggccgggtgcgctggcagcagatgcagcatagatagccaggcgtcattatgccagctgactgcttcgaccgccccatacgttcgggacgtgggggatggcagcagtacttcttccaccgggagcacagacagtcccgatcaccacaaacatcatgctagttccggctcacctgagcatctgcagaagccccgcagcgaggggagcccggaacactcaaagcacaggtccgcctcaccagagcatccccagaagcctcgggcatgcgggacaccagatagaccaaaagccttgaagggccccagcccagagcaccacaagccactttgtaagggctcacccgagcagcagcggcacccacaccccggtagctctccggagactctgcccaaacacgtgttgtccggcagccccgagcattttcagaagcatcgaagtggatctagccccgagcacgcccgccatagcggagggtctccggagcatctacagaaacacgctctggggggatcacttgaacatctgccacgggcgcgcggtactagccccgagcatctgaaacagcactatgggggctccccggatcacaaacatggaggaggttctggagggagcgggggttctggcgggggttccagggagggcacattgcgacggcaggcccaggaggatggaagcccccaccatagaaacgtgtacagcgggatgaatgaaagtactcttagttatgttcggcagctggaagctagggtccggcaactagaagaagagaatagaatgttgccccaggcctctcaaaacaggcgacagccccctacccgcaacagcagcaacatggagaaaggctggggatcccgagctcggcgcgtgttgcagtggtggcagggatgtcgcggtatcggccggtgcttgcccaccttacctggaagcttccgtctgtcatccggagccgatggctcaaattcatcccccaacagtgccgcctccttctcgggacacgccacaccctctcagcagcccgaacccgtcgtgcactctctgaaggttgtttggaggaaactcggggatgcagctgggtcttgcccagggatccggcaacacttgtcggggaaccagtataagggtccgatgtag

SEQ ID NO: 46437 - DNA, 1260 bp, Artificial Sequence
  Description of Artificial Sequence: Synthetic coding sequence
atggccaagcccgccgccaccgccgccgccgccagcgaggagctgtctcaggtacccgatgaggaattgctgaggtggagtaaggaggagttggccaggaggcttcgcagagccgagggagaaaaggtgggtctcatgttggagcacgggggtctgatgagggacgtgaataggaggctgcagcagcaccttctggagatcagggggctgaaagacgtgaatcagcgcctgcaggacgacaaccaagagctgcgggagctctgctgtttcttggatgatgatcggcaaaagggcaggaaattagctagagaatggcagcggttcggccgccacgccgctggggctgtttggcacgaggtggcacggagtcagcagaaactgagggagctggaggcccggcaagaagcccttttgagagagaatctggagctgaaagagctcgtgttattacttgatgaagagcgagcggcccttgccgctaccggggcggcctcagggggcggcggtgggggtgggggggccggctcccggtctagtatcgactcacaggcctctctgtcgggaccccttagtggcggagcccccggcgctggagcaagagacgttggcgatgggagcagcacatcttcagccgggagcggtggcagccccgatcatcaccaccatgtaccccccccccttttgccccccggaccgcataaggcaccagatggaaaggcaggcgccacacggcgctcgctcgacgacctcagtgcaccacctcatcaccgaagcattccaaacggtcttcacgatccatcctcaacttatatacgacaattggaatctaaagtgcgtctactcgaaggtgataagcttttggcccagcaggccggctcaggtgagttccgtaccttgaggaagggcttctccccttaccacagcgaatcacagttggcctcactccccccgagttaccaggattctctccagaacggcccagcttgcccagcacctgaactgccatcccccccctccgccggctatagtcctgccggccagaagccagaagctgtcgtccacgcgatgaaagtactggaagtacacgagaaccttgaccgacagctacaggatagctgtgaggaggatttgtctgagaaggagaaggccatcgtccgtgaaatgtgcaacgtagtgtggcgaaagctgggtgacgctgcttctagcaaaccatcgatacggcaacacctgagcggcaaccagtttaaaggacccctctag

SEQ ID NO: 46438 - DNA, 2550 bp, Artificial Sequence
  Description of Artificial Sequence: Synthetic coding sequence
atgatggagccccccaagcccgagcccgagctgcagcggttctaccaccggttactgcgtcccctctccctctttcccacccgaacgactagtcccgagccacagaagcggccacctcaggaaggccgcatcctgcaatcatttccactggcaaaactgacagtggctagtctttgttcacaagtcgccaagttactggcggggagcggtattgccgcgggcgtgcctcccgaggctaggctcaggctgattaaggtaatccttgatgagttaaaatgttcttggcgcgagcctccagccgagttgagtttgagtcataagaacaaccagaagctgaggaaacgactcgaggcctacgtattgctcagtagcgagcagcttttcttaaggtacttgcatctgctcgtgacgatgagcacacctagaggggtcttcaccgagtcagccacattgacgcggctggcggcgtcactagcgcgcgactgcacattatttctgacgtccccaaatgtgtatagagggctgcttgccgactttcaggcccttctcagagctgagcaagccagcggcgatgtagacaaactccaccccgtatgtcctgccggtacatttaaactgtgtcctataccttggccacactcgaccggttttgcacaggttcagtgcagcaatcttaacctcaattatctgatccagttgagccgcccgcccgagttcctgaatgaacccggaagaatggaccctgtaaaggagctgaagagtattccccgtttaaaacgaaaaaaaccattccattggcttccgtccattggcaaaaagagggagatcgacatcagtagtagtcagatggtttcgctcccctcatatcccgtggcacccacctctcgtgcgagcccttccccattttgtcccgagttgagacggggacagtcaatgccaagcctgcgagaagggtggcgcctggccgatgagctgggacttcctcctctgccaagcagaccgcttacccccctggtgctcgccactgaatctaaacctgaactcacaggcctgatcgtggcggaggacctcaaacaactgatcaaaaagatgaagctggaagggactcgctacccaccactggattctgggctgccgccgcttctgggggttgtgactagacaccccgccgccggtcacagacttgaggaactggaaaaaatgctgagaaaccttcaagaggaagaagcatcgggacagtgggatccccaacctccgaaatcttttccactacaccctcagcctgtgaccataacattgaaactgagaaacgaagtggtggtgcaagccgccgccgtgcgggtttctgacaggaatttccttgacagttttcatatcgagggcgctggggctctctataaccatctggccggggaacttgaccctaaggccatagagaaaatggatattgacaatttcgtgggcagtacgacacgggaggtctacaaagagctgatgagccacgtgtctagcgaccacctgcacttcgaccagggacctttggtggaaccggccgcagacaaggattggtctacatttctgtcaagcgcattcctgaggcaggagaagcaacctcagattattaaccctgagttggtcggcctgtacagccagagagccaatactcttcagtccaataccaaaaaaatgcccagcctaccgtcgctgcaagctactaagtcatgggagaagtggagtaataaagccagtcttatgaatagttggaagacaactttgtctgtcgacgactacttcaagtacctgacaaaccacgaaactgacttcctgcacgtgatcttccagatgcatgaagaagaagtgccagtcgagatcgttgcccctgcgagagaaagcttagagattcaacatcctcccccactgctcgaggacgaggaacccgactttgtccctggtgagtgggactggaacacagtactcgaacacaggttaggtgccggcaagaccccacacctgggtgagcctcataagattctgagtctgcagaagcatctggaacagctttggagcgtgcttgaggtgccggacaaagatcaagtggacatgacaattaagtattcgagcaaagcccgattgcgtcaacttccttccctggtcaatgcatgggagagagctcttaaacctatccagttgagagaagcactgctagctagattggaatggtttgagggacaggccagcaaccctaacaggtttttcaaaaaaaccaaccttagctcctcccatttcctcgaggagaaccaggttaggtcacacttgcatcgaaagctcaatctgatggagtcctctttggtaagtctgctggaggagatcgaactgatctttggggagcccgttatcttcaaaggccggccttaccttgacaaaatgaagtcagacaaggtggaaatgttatactggctccagcagcaacgcagggtaagacacctggttagcgctctgaaagatccacaccagtcaactctcttccggtcatcagccgcttccctgtag

SEQ ID NO: 46439 - DNA, 741 bp, Artificial Sequence
  Description of Artificial Sequence: Synthetic coding sequence
atgctgagcctgagcctgtgcagccacctgtggggccccctgatcctgtctgccctgcaggctcggagtacagatagtctggacggccccggcgaagggtcagtgcagcccctcccaactgctggcggtccctccgtaaagggcaagcctggaaagaggctgagtgccccaaggggccctttcccgaggctggccgactgtgcccactttcactacgaaaacgtggatttcggccatatccaactgcttctgtctccagatcgcgagggaccctccttgtcaggtgaaaacgaactggtctttggcgtacaggtgacatgccaggggcgcagctggccagtgcttcgctcctacgatgatttcagatctctcgatgcccatctgcatcgttgcatattcgacaggcggttttcgtgcctgcctgaattacctccacccccggagggtgcccgcgccgcccagatgttggtccccctgctcctgcagtacttagagacactgagcggcttggtggatagtaacctgaattgcggcccagttctgacatggatggaagttggcctggggaggggtctcggcgacagcgagtgggtgaggggatgtgtgtgccatcacgcacaacaccgcgagatccttgacggcaatcgagtcgccagtgccgtagaggacgagggtgcggaagtcgacggggaggccttcaggtgggggagtctatgggtcggtgaaagttgggatatgtag

SEQ ID NO: 46440 - DNA, 1542 bp, Artificial Sequence
  Description of Artificial Sequence: Synthetic coding sequence
atggccgccaccctggacctgaagagcaaggaggagaaggacgccgaacttgataaacgcatcgaagccctgagacggaagaacgaagccctcattaggagatatcaggaaattgaggaagacaggaaaaaggctgagctggaaggagtcgccgttacagcccccagaaagggacgcagtgtggagaaggagaatgttgctgtggaaagtgagaagaacctaggccccagccggcgaagcccaggaacccctcggccaccaggcgcttcgaaaggcggtcggaccccaccccagcaaggggggcgcgccgggatgggacgcgcaagccgatcctgggaggggtctccaggagagcagcctaggggcgggggagccggcgacacctctatcagtgaccgcaagagcaaggaatgggaagagcgccggcgtcagaacatcgaaaaaatgaacgaagaaatggagaaaatagcggaatacgaacgcaatcagcgggaaggggtcctggagcctaacccagtccggaacttccttgatgatccacgacggaggtctggacctctggaggaatcagagagggaccggagagaggaatccaggcggcacgggaggaactggggtggccccgattttgaaagggtgagatgcggactcgagcacgagcgccaaggccggcgggctggcctaggatcggctggagatatgaccctctctatgaccggccgcgagcggtcagaatacctgcggtggaaacaggaaagagaaaagattgatcaagaacggttgcagcgacatcgaaaacccacgggccaatggagacgggaatgggacgccgagaagactgacggaatgttcaaagacggacccgtcccagctcatgagcctagtcaccgctatgacgaccaggcctgggccaggcctccaaagcctcccacattcggtgagtttttgtcccaacacaaagctgaggccagcagtcgacgaagaaggaaatccagccggccccaggctaaggccgcacctagggcttatagcgaccatgatgaccgatgggaaaccaaggagggcgccgcaagccctgccccagagaccccacagcccaccagcccagagacgtcccccaaagagacccccatgcaaccaccggaaattcccgccccggcacatagaccccctgaggatgagggcgaagagaatgagggggaggaggatgaggagtgggaggatatctccgaggatgaggaggaggaagagatcgaagtagaagagggggatgaggaggagcccgcacaggaccaccaggctcccgaggcagcccccactggtatcccatgctccgagcaagcccatggggtgcccttcagccctgaggagccactcctcgagcctcaggccccgggcacaccttcatctcccttctcccctcccagcggacaccagccagttagcgattggggggaagaggtggagctgaatagcccccgcaccactcacctggccggtgcactttcaccaggcgaggcttggccttttgagagcgtgtag

SEQ ID NO: 46441 - DNA, 996 bp, Artificial Sequence
  Description of Artificial Sequence: Synthetic coding sequence
atgaccagcccccacttcagcagctacgacgagggccccctggacgtgagcatggcagccacaaatcttgaaaaccagttacattctgcccaaaagaacctcctgttccttcagcgcgaacacgcctctaccctgaagggtttacatagtgagatccgcagactgcaacagcactgcacggaccttacgtatgagttaacagtgaaatcctctgaacagacaggagatggcacaagtaaaagtagcgagctgaaaaagagatgtgaggagctcgaagctcagctgaaggtaaaagagaacgagaacgctgagctactgaaagaactggagcaaaagaacgcaatgattaccgtcttagaaaacaccataaaggaaagggagaagaagtatctggaggagctgaaggcaaagagccacaaacttaccctgttatcctctgagctcgagcagagagcttctacgatagcatatctgacctctcagcttcacgccgccaagaagaaattaatgtcctcctctggaactagtgacgcttcacctagtggttcaccagtactcgcgagctacaaacccgcgccaccaaaagacaagcttcccgaaactcctcgtagacggatgaagaagagtctgtccgccccactccaccctgagtttgaggaggtttaccgctttggggccgaatcccgtaagctgttgcttagagagccggtggacgccatgcctgacccgaccccttttctgttagctcgcgaatccgctgaggtgcacctgatcaaagagcgccccttggtgatcccacccatcgcatcagatcggtctggggaacaacactctccagccagggaaaaacctcacaaagcccacgttggcgtagcccatagaattcatcatgccactcccccccaggcccagccagaggtcaagactctggcagtcgaccaggtaaatggcgggaaggtggtgcgaaagcacagcggcaccgacagaactgtgtag

SEQ ID NO: 46442 - DNA, 291 bp, Artificial Sequence
  Description of Artificial Sequence: Synthetic coding sequence
atgaccagcccccacttcagcagctacgacgagggccccctggacgttagcatggccgcgacaaacctagagaatcaactgcattctgcccaaaagaaccttttgtttctgcagcgagaacacgcatctaccctgaagggcctccatagcgagatccgccgactgcagcagcattgcacagacctcacctacgagcttaccgtcaagagctccgaacagacaggggacggcaccagcaaatcgtccgaattaaagaagcgctgcgaggaacttgaagctcagctgaaatag

SEQ ID NO: 46443 - DNA, 369 bp, Artificial Sequence
  Description of Artificial Sequence: Synthetic coding sequence
atgaccagcccccacttcagcagctacgacgagggccccctggacgtcagcatggccgcaaccaatctcgaaaaccagctgcactcagcacagaagaacctcttatttttgcagcgcgagcatgcctccacgctgaaaggactccatagcgagataagaagattgcaacaacactgtacagacctcacctatgaactgacagtgaaaagctctgagcaaacgggtgatgggaccagcaagagctctgagcttaagaagagatgcgaggagctagaagcgcagcttaaggtcaaggaaaacgagaatgcagagctcctgaaagagttagagcaaaaaaacgctatgattacagtgctggaaaatacctag

SEQ ID NO: 46444 - DNA, 39 bp, Artificial Sequence; identical to SEQ ID NO: 20146
  Description of Artificial Sequence: Synthetic coding sequence

SEQ ID NO: 46445 - DNA, 1896 bp, Artificial Sequence
  Description of Artificial Sequence: Synthetic coding sequence
atgggcctgccccggggccccgagggccagggcctgcccgaggtggaaacccgcgaggacgaagagcagaacgtcaaattaacagaaatcctggaactactggtggccgccggctacttccgggcaaggatcaaaggcctaagtcccttcgataaggtggtgggcggaatgacatggtgtatcacaacatgcaatttcgatgtggacgtggaccttctgttccaggagaattcgacaattgggcagaagatagctttatccgaaaagatagtgagtgttctgccaaggatgaagtgcccacaccagctggaacctcaccagattcagggtatggattttattcatattttccccgtagtacagtggcttgtaaagcgggcaatagagacgaaagaggagatgggggattacatacgctcctactctgtgtcccagttccagaaaacttactcattgccagaggatgatgacttcattaaaaggaaggaaaaggccatcaaaaccgtggtggacctgtccgaggtctacaaacctcggcgcaaatacaaacgacatcagggcgcggaggaactcctggacgaggaatccagaattcacgcaacactactcgaatatggtcgcaggtatggcttttcacgtcaatcaaagatggagaaggctgaggataagaagactgcattacccgctgggctctccgccaccgagaaagctgacgctcacgaagaggacgagctgcgcgctgcagaggaacagagaatacagtcactgatgacgaagatgactgctatggccaatgaagaatcgaggctcactgcaagcagcgtgggacagattgttggtctctgttctgcagaaatcaaacagatcgtttccgaatatgccgagaagcagtccgagctgtctgcggaagaatccccggaaaagctgggtacgagccagttacaccgaagaaaggtaatatcactcaacaaacagatcgcacagaagactaaacaccttgaggagctgcgggcttcccatacaagcttgcaggcaagatacaatgaagctaaaaagacactgacagaactcaaaacttattcggaaaagcttgataaggagcaggccgcgctcgaaaagattgagtctaaagccgatcctagcatcctgcaaaacctccgggcgcttgttgcaatgaacgagaatctgaaatctcaggaacaggagtttaaggctcactgcagggaggagatgaccaggctgcagcaggagattgagaatctgaaagctgagagggctccacgtggcgacgagaagacactgagtagtggagaacctccaggcactctcactagcgccatgacacacgacgaggaccttgacaggaggtataacatggagaaagagaaattgtataagatccggctgctgcaggcgcggagaaatcgagaaatagctatcctgcaccgtaaaattgacgaagtacccagtcgcgcagaacttatccagtatcagaagaggttcatcgaactatacagacagatcagcgctgttcataaggagacaaaacaattcttcactctgtataacaccctggatgataagaaagtgtacctcgaaaaagagataagcctcctcaattctatccacgagaacttttcccaagccatggcatctccagcagccagagatcaattcctccgccaaatggaacagatcgtcgaaggtattaagcagtctagaatgaaaatggagaagaagaaacaggagaacaaaatgcggcgcgaccagttgaacgaccagtacttggaacttctcgagaaacagcgtctttatttcaagacagtgaaggaattcaaagaggagggccgaaagaacgaaatgcttctgtccaaagtgaaggcaaaggcaagctag

SEQ ID NO: 46446 - DNA, 972 bp, Artificial Sequence
  Description of Artificial Sequence: Synthetic coding sequence
atgagcgagcggaaggtgctgaacaagtactacccccccgacttcgatccttcaaaaataccaaaattgaagttacccaaagaccgccaatacgtcgtgaggttaatggctccctttaatatgcgctgtaagacttgcggagaatatatctacaaggggaagaaatttaatgcacggaaagagacggtgcagaacgaagtctacctcggactgcccatcttcagattctatattaagtgtacaagatgtctcgctgaaattaccttcaaaactgaccccgagaacaccgactatacgatggagcacggcgctacccgtaatttccaggctgagaagctgcttgaagaggaggagaagcgggtccagaaggaacgggaggatgaagagctaaataaccccatgaaggtgttagaaaacaggaccaaagattccaagctcgaaatggaggttctggagaaccttcaggagctcaaggatctgaatcaacggcaggcacacgtggattttgaagctatgctgcgacagcatcgcctatctgaagaggagaggagacggcaacagcaggaggaggacgaacaagagacagcagcactgcttgaggaagctcgtaagcggagactgcttgaggattccgattctgaggatgaagcggcaccaagccccctgcagcccgccctccgccctaatcctacagctatcctagacgaggctccgaagcctaaacgtaaagttgaggtgtgggagcagtcagtcggctctttgggcagcagaccacccctgagccggttggtggtggtgaaaaaagcaaaggccgaccctgactgttcaaatggtcagccccaggcggcccccacccctggcgcccctcaaaatagaaaggaagcaaatcctaccccgcttacgccaggcgctagtagcctctcacagttaggcgcatacctcgatagcgacgactcaaacggcagtaactag

SEQ ID NO: 46447 - DNA, 1668 bp, Artificial Sequence
  Description of Artificial Sequence: Synthetic coding sequence
atggacgtgagcagcgagcacaccaaggaccccggcggcgagggcggggacggggaatcactggcagccagaccaagcaaaataaaggcttccagcgggcctcccacgtcccccgaacccggagagctggagagcgaaccggaagaggaggaggaggagcaggctgcctctcagggaggtacagccgctgacgagcaggccgaggccccaaagggtctgactgccgctgaggcagccggcgaggagggacccggagagccagggcgtcccgctgaacctcagcctgaaccggaggagccagccgaagtcggggctgaggagcccgcccagccagaaccaggagccggtccagaagaactcgaggcagaagcaggcgccgaagagttagagcaggctgccgagggaaaagaggtgcgatttcaggcctctctccccctcacacgtattgatgaagaagaagccgcggcagcccctgaagccgaaactgagcgggtggagggcgaagaggaggataaagaggagacccaaagagacggggcggaaagtaaggagcgggatggagaaggcaggcctgctaagtctcaggaagaagggaaacgtctgtatggacgcgatgagttcgaggacctagagtggagtgaggaggttcagaagctacaggaacagcagcttcgatcagacctccttgaccaatatcgtagtctgctagtcgaaagaaacagatcccagcgctataacctctacctgcagcacaagatatttgaggccttacggcgcaaaaagggcctcgaagccgcggaggtggccgatcgtggcgctgaagcagaagctcctgaaaaggaacaggcgtacctcagacacctgggaatgcttgaggaacttaaaaagcagcaggccgacgacctgcagtggtaccatcaggagctgggacaattaaaaagacagtgccaggagaagctcacccgcgtcgagaaagagtggcggcgttttcaggccctgaagaagcaggtggttatgcaggctatgggatcatgcagaatgagaggcggccggcaggccgctctgcgagaggtagaacagattcaggctctggaggacaaaaaggagaaagagatgtctgcagtgagactggaaaatatccagttaaaacagtctctggtgcactttgagacaaggatgcgcacccaggaagatcttacccagggcctcttgctgattgactttgaacagctcaaaatcgaaaatcagaccttcaatgaaaaaatcgaggaacgaaacgaggaacttctgaagctgagatcaaaggtgacaaacagtgtacaagtcattacacacgttaaggagaaattgcactttatggatatggaaaacgcctgtaaaaaaacccagctggccgaaatcgaagcacaggccgccctaggccgggatatcctcacaaaaactaagcaggccagagaaggcctcaggaccgacaatatccgcctgaaccagaaatgcggtctcctgggcaaagactcactactacgcgacctggaggagaaggtagacaaaaccgagctgctacaccgcagactggagtccctaaaaagacaccatgctagcctcacactgagctgtagaggcgttaggcagaaaatccgagaggcaaaggcattccttccctcctag

SEQ ID NO: 46448 - DNA, 1032 bp, Artificial Sequence
  Description of Artificial Sequence: Synthetic coding sequence
atggaggccgtggccaccgccaccgccgccaaggagcccgacaaggggtgtatagaaccgggcccgggccattggggggagctcagccgcacaccggtgccatccaagccccaggataaggtggaagccgctgaagccacccccgtggcgctcgactccgacactagcggcgctgagaacgccgccgtatctgctatgcttcacgctgtggcagccagtcggttgccggtgtgcagccagcaacaaggcgagccagacctcacagagcacgagaaggtggctattttagcacagttgtatcacgagaagcccttggtattcttagaacggtttaggacaggtctccgcgaggaacatttagcctgcttcgggcacgtgagaggagatcatagggctgacttttattgcgccgaggttgcccgccagggcacggcaaggccccgcactctgaggacgaggctcagaaaccggcggtatgccgccctgagagagctaatccagggaggcgaatatttcagcgatgagcagatgcggttcagagcacccctgttgtacgaacaatatatcggacagtacctcacccaggaggagctaagtgcccggacacccacccatcagccacccaagcctggtagtccaggccgccccgcttgcccccttagtaatctgctgctgcaaagctacgaggaacgtgagctccagcaaagactcctgcagcagcaggaggaagaggaggcctgcctggaggaggaagaagaggaggaggactcagatgaggaggaccagcggtccgggaaagactctgaggcatgggtgccagattctgaagaacgcctgattctgagagaagagttcacctcacggatgcatcaacgcttcctagacggaaaagacggggacttcgattacagcaccgttgatgacaaccccgatttcgacaacttggatatcgtcgctcgcgatgaggaggagcggtattttgatgaagaggaacctgaggatgccccatcccctgagcttgacggagattag

SEQ ID NO: 46449 - DNA, 462 bp, Artificial Sequence
  Description of Artificial Sequence: Synthetic coding sequence
atggagcccctgtaccaggccggcagcatcctgatgaccgtgaacaccctgcagggtaaaaaaatgatcgaatcaggcctccagtcaggagacttctctctgtctcaatcctggccgtcttgtctgccccccccagcggacctggagatcctccagcaaaaggtggctggcgtgcaaagggagcttgaggattttaaaaaagaggccctgaagtcgattcactacctggaggatgctttctgtgagatgaatggcgctctcgttcagcaagaggagcaagctgcgcgggttcgccagaggttgcgggaagaggaggatagaggaatcgtgagaaataaagtcctcacttttctcctcccacgggaaaaacagctccgagagcactgtaagcggctagaagacctcctgttagatcggggtagggatgcgctaagggctacgaaaaagtcacaggcagactag

SEQ ID NO: 46450 - DNA, 333 bp, Artificial Sequence
  Description of Artificial Sequence: Synthetic coding sequence
atgcaggccgccctggaggtgaccgcccggtactgcggccgggagctcgagcaatacgggcagtgtgttgctgccaagcctgagtcttggcagagagattgccattatctaaagatgtcaatcgctcagtgcacaagttcccaccccattatacggcaaatccggcaagcatgtgcccaaccctttgaggcctttgaggagtgtctgcggcagaacgaagcagcagtaggtaactgtgcagaacacatgcgaagattcctgcagtgcgcggagcaagtccagccccctagaagcccagctaccgtggaggctcaacccctgccagccagttag

SEQ ID NO: 46451 - DNA, 708 bp, Artificial Sequence
  Description of Artificial Sequence: Synthetic coding sequence
atgggcagcaccgagagcagcgagggccggcgggtgagcttcggcgttgatgaagaagagagggttagggtgctgcaaggtgtgaggctgtccgaaaacgttgttaataggatgaaggagccctccagccccccacctgcaccaacctcctccaccttcgggcttcaggatggaaaccttagagctccgcataaagaaagtacgctcccacgatcaggcagctctggcggacagcagccgagcggcatgaaggagggcgtgaagcggtatgagcaggagcatgctgctatccaggacaagttgttccaggtggccaaaagagaacgggaagccgcaaccaagcactccaaagcatcgcttcccacaggggaaggaagcattagtcacgaggaacagaagtcagtcagactagcccgggagctggaatctcgtgaggcagaactgagaaggcgggacacgttttacaaggaacaattggaaagaatcgagcggaagaatgcggaaatgtacaaactcagttctgaacagtttcatgaagctgcttccaagatggagtctacaataaaacctaggcgggtggagccagtctgtagtggtcttcaggctcagatcttacactgctaccgcgatcggccccacgaggttttgttatgctctgacctcgttaaggcttatcagcgttgcgtatccgccgcgcataaggggtag

SEQ ID NO: 46452 - DNA, 501 bp, Artificial Sequence
  Description of Artificial Sequence: Synthetic coding sequence
tgaaccctgccccggagcggcagcagcggcggccagcagcccagcgggatgaaggagggtgtgaagagatacgagcaggagcacgctgccatccaggacaagctattccaagtcgccaagcgggagagggaggcggctacaaagcattccaaggcatctttacccaccggtgagggttctatctctcatgaagagcagaagagtgtgcgcttggccagagaattggagtccagggaagctgaactgcggaggcgcgatacattctataaagagcagttagagcgtattgagcggaagaacgcagagatgtataaactgagtagtgaacaatttcatgaggcagcttctaagatggagagcaccattaaagtagagccggtgtgctctggccttcaggctcagatcttgcattgctatcgggacagaccccacgaggtactgctctgttcagatctagtgaaggcgtatcaacgctgcgtgtctgccgcccacaagggatag

SEQ ID NO: 46453 - DNA, 600 bp, Artificial Sequence
  Description of Artificial Sequence: Synthetic coding sequence
atgctgctggagctgagcgaggagcacaaggagcacctggccttcctgccccaggtggattctgccgtggtggctgaatttggcagaatcgccgtggagtttttacggcggggagcaaatcccaagatctatgaaggagccgcgcgcaaacttaacgtgtcaagcgataccgtccagcacggggtggagggactcacgtacctgttgacagaatccagtaagctgatgatctcggaactcgatttccaggacagtgtgttcgtgctcggtttttctgaagagcttaacaagttactgctgcagctgtaccttgataatcggaaagaaatcaggaccatcctgagtgaactggcaccgtccctcccaagctatcacaatttagagtggcggctggatgtgcagctggcgagtcgatcactgcgacagcaaattaagcctgctgttacgattaagctgcacctgaatcagaatggggatcacaataccaaggtgcttcagaccgatcctgccactctcttgcacctcgtgcaacagctcgagcaggccctggaagagatgaagacaaatcactgccgtagggtggtgaggaacatcaagtag

SEQ ID NO: 46454 - DNA, 534 bp, Artificial Sequence
  Description of Artificial Sequence: Synthetic coding sequence
atggagctgagcgagagcgtgcagaagggcttccagatgctggccgacccccgttcctttgattcaaatgccttcactttgctcttacgggctgcttttcaaagcttactggacgctcaggctgatgaagctgtgttagatcacccggatttgaagcacatcgatcccgtggtgttaaaacattgccatgctgcagcagcgacctacatcctcgaagctggcaagcatcgcgcagacaaatccacactgagtacttacctggaggactgtaagtttgatcgcgagaggatcgaacttttctgtacggaataccaaaataataagaacagcctggagattctgctgggacgcactctaataccccatccaatccagcggctggtgttggtcgcggcttggaataattacagaacgtggtggggcaacctgaaaatgcttcgcaaggcctggaaggaacaactctcctgtaatttggggaagctaacaatcagacctagcgccgaggagaatcagaagcggctggccttttcttag

SEQ ID NO: 46455 - DNA, 489 bp, Artificial Sequence
  Description of Artificial Sequence: Synthetic coding sequence
atggagctgagcgagagcgtgcagaagggcttccagatgctggccgatcccaggtcgttcgacagcaatgcattcacgcttcttctaagggccgcattccagagcctcctggacgcccaggcggacgaagctgtcctagatcatcctgacctcaaacacattgaccctgtggttctaaaacattgtcacgccgctgccgccacttatatcctggaggctggaaaacatcgcgcagataagtcaacattgagcatcggaagatcattaccacatatcactgacgtgagttggcggctagagtatcagatcaagacaaaccagctgcacagaatgtaccggcccgcgtacttggtaacactctcagtacagaatacggattccccatcctaccctgagatcagtttcagctgttccatggagcagttgcaggaccttgttggtaaactgaaggatgcaagtaagagcctcgaacgtgcaacccagctgtag

SEQ ID NO: 46456 - DNA, 588 bp, Artificial Sequence
  Description of Artificial Sequence: Synthetic coding sequence
atggagctgagcgagagcgtgcagaagggcttccagatgctggccgatcctcggtccttcgactcgaacgcctttacattgctcttgcgtgctgctttccagtcgctgcttgatgctcaggctgatgaggcagtactggatcaccctgacctgaaacatatagatcccgtcgttcttaaacactgtcacgcagccgccgctacgtacattctggaagccggcaaacaccgtgcagataagtctacccttagcacatatcttgaagattgtaagtttgatagggaacgcattgagctcttttgtacagagtatcagaacaataaaaactctttggagatcctactcggttccatcggcagaagtcttccacatatcactgatgtttcctggcggttggaatatcagatcaagaccaatcagctgcatcgcatgtacagacccgcctaccttgtgacccttagcgtacaaaataccgattcaccctcttaccctgagattagcttctcctgtagcatggagcagcttcaggatttagtgggaaagctcaaggatgcctccaagagcctggagagagcaacccagctctag

SEQ ID NO: 46457 - DNA, 534 bp, Artificial Sequence
  Description of Artificial Sequence: Synthetic coding sequence
tgagagctgagcgagagcgtgcagaagggcttccagatgctggccgatcctcgctctttcgattccaacgctttcaccctgttactcagagcagcgtttcagagcctcctcgatgcacaggctgatgaggctgtgctcgatcaccctgatttgaagcacatagatcctgtggtgctcaagcactgccacgcagcggccgctacatacatcctggaagccggcaagcatcgtgcagataaatccaccttatcaacttatctcgaggactgcaagttcgaccgcgagagaatcgagctattttgcaccgagtaccaaaataacaagaattctctcgagatcctgctgggcagaacgttgatcccgcacccgatacagcgattggtgttagttgccgcgtggaacaactacagaacatggtggggcaatcttaaaatgctgaggaaagcttggaaagagcaactttcatgcaatttaggaaaactcacaattcgtccgagtgcggaagagaaccagaagcgtctggcgttcagctag

SEQ ID NO: 46458 - DNA, 450 bp, Artificial Sequence
  Description of Artificial Sequence: Synthetic coding sequence
tgactgcccgacgccggcggcagccccctgctgcggctgcagcggttgcatgcctcccctcccggcggaatacccgaatccgcaggccggccaggtgggcgcggccgggtgtccacttacctggaagactgcaagttcgacagagagcggatagagctgttttgcactgaatatcagaataataagaatagcctcgagattctgctaggctctatcggtagatcactgccccatatcactgacgtttcatggagattggagtatcagatcaaaaccaaccagttacaccgtatgtacagaccagcttacctggtgacactctctgtgcagaacaccgacagtccatcatatcctgagatttccttctcatgctccatggaacagttgcaggacctggtcggaaagctaaaggacgcaagcaagtcccttgaaagagccacgcagctgtag

SEQ ID NO: 46459 - DNA, 492 bp, Artificial Sequence
  Description of Artificial Sequence: Synthetic coding sequence
tgaatggagctgagcgagagcgtgcagaagggcttccagatgctggccgatccccgatcatttgactcaaacgcgttcacccttctgctccgcgccgcatttcagtcattgctcgatgctcaggccgatgaggccgtgctcgatcatccagatctcaaacacatcgaccctgtagtgctgaagcactgtcatgccgcggctgccacgtacatcctcgaagccggcaagcatagagctgacaagtcaactctctcaatagggcgcagcctgccacacataacagacgtgtcatggcgcctcgagtaccagataaagaccaaccagcttcacagaatgtaccgccccgcatacctcgtcactctgtcggtgcagaataccgattcaccttcctatccggagatctcctttagctgttccatggaacaactgcaggacctcgttgggaaactaaaggatgcatctaaatcactagagagggcaactcaactgtag

SEQ ID NO: 46460 - DNA, 603 bp, Artificial Sequence
  Description of Artificial Sequence: Synthetic coding sequence
atgggccggctgcactgcaccgaggaccccgtgcccgaggccgtggggggagacatgcagcagttaaaccaacttggggcccagcagttctctgccctcacagaggtcctgttccacttccttacggagccaaaggaggttgagcggttcctggcacagctaagtgaatttgccactaccaatcagatttcactcggctcgctgcggagcatcgtgaagagcctactgctcgtgccaaatggggccctgaagaagtccctaactgccaaacaggtgcaagctgactttatcacattagggctcagcgaggagaaagccacttacttcagcgagaagtggaagcagaatgcccctacactagcaagatgggccataggccagacccttatgatcaatcagctgatcgatatggaatggaaatttggcgtgacttccgggagttccgaactcgagaaggtaggatctatatttctccagctgaagctggttgtcaaaaaaggcaaccaaaccgagaatgtatacattgagctaactctgccacagttctatagcttcctgcatgagatggagagagttcggacgagcatggaatgtttttgttag

SEQ ID NO: 46461 - DNA, 600 bp, Artificial Sequence
  Description of Artificial Sequence: Synthetic coding sequence
atgggccggctgcactgcaccgaggaccccgtgcccgaggccgtgggaggagatatgcagcaactaaaccagctgggagctcagttctccgctttaactgaggtcctgttccattttttaacagagcccaaagaggtggaaaggttcttggcacagttaagcgagttcgcgacaactaaccagatttctctgggctccctgcggagtatagtgaagtccctgctactggtccctaatggcgccttgaaaaaaagcctcactgccaaacaggtgcaggccgacttcataaccctcggcctgtctgaggagaaagctacatactttagcgagaagtggaagcagaacgctcctacattagcccggtgggctattggacaaaccctcatgatcaaccagctgattgatatggagtggaaatttggcgtgacgagcggtagctcagagcttgaaaaagtcggcagtatttttctgcagctaaagcttgtggtgaagaaaggcaatcagaccgagaatgtgtacatagagttgactctgccccagttctactcgttcctgcacgaaatggagcgtgtgagaacatccatggagtgcttctgttag

SEQ ID NO: 46462 - DNA, 552 bp, Artificial Sequence
  Description of Artificial Sequence: Synthetic coding sequence
atggagcccgaggagggcacccccctgtggcggctgcagaagctgcccgctgagcttgggcctcagctgctgcataagatcatcgatggtatttgcgggcgggcttatcctgtgtaccaggactaccatacagtgtgggagtccgaggaatggatgcacgtccttgaggacattgcaaagtttttcaaagccatcgtggggaagaacctacccgatgaggagatttttcagcaactgaaccagctgaactccctgcaccaggagacgatcatgaagtgtgttaagtccaggaaggacgagattaaacaagccttatctagagaaattgtcgccattagtagtgcgcagctgcaggactttgactggcaagtcaaattggctctgtcctccgacaagatcgccgccttgcgcatgccgcttctgtcattgcatctggacgtgaaggaaaacggagaggtgaagccgtactccatcgagatgtcgagggaggagttacagaatctgatccagtctcttgaggcagccaacaaggtcgttctccaattgaagtag

SEQ ID NO: 46463 - DNA, 597 bp, Artificial Sequence
  Description of Artificial Sequence: Synthetic coding sequence
atggccgccctgaccgccgagcacttcgccgccctgcagagcctgctcaaagcaagttcaaaggatgttgtcagacagctgtgtcaggagagtttcagcagctccgcgctaggacttaaaaagctgctcgatgtgacatgcagctccctgtctgtcacccaggaagaagcagaggaactgctccaggcgctgcacaggctgacccggttagttgccttccgggacctcagctcggccgaagcaatcctcgccttattccccgaaaactttcaccaaaatctgaaaaacctgctaacgaagatcatcctggaacacgtgagtacgtggaggaccgaggcccaggcaaaccagatcagtttaccccggctggtcgacctggactggagggttgacatcaagacatcgagtgattctatttctagaatggcagtgccaacgtgcctcctgcagatgaagatccaggaggacccttccttatgtggcgataaaccctcgatcagcgcggtaaccgtggagctgtcgaaggaaacactcgatacaatgctcgacggcctgggcagaatccgcgaccagttatccgcagtcgccagcaagtag

SEQ ID NO: 46464 - DNA, 510 bp, Artificial Sequence
  Description of Artificial Sequence: Synthetic coding sequence
atggccgccctgaccgccgagcacttcgccgccctgcagagcctgctcaaggcctcatctaaggacgtggtgagacaactctgccaggagtcattcagcagcagcgcgttggggcttaagaaacttctggatgtcacgtgttcctccttgagtgttactcaggaggaagcagaagaactcctgcaagccctgcaccggctgacacgattagttgcctttagggatctaagcagtgctgaagcgatcctggcactgtttcctgaaaactttcatcagaacctcaaaaatctgctgacaaaaatcattctcgaacacgtctccacatggcggaccgaggcccaggctaaccagatttcgttacccagactggtcgacctggattggagggtggatatcaaaactagttcggatagtataagtagaatggccgtgcctacctgcctgctccagatgaagatccaagaggatccgtctctctgcggcgacaagccctcaatctcagcagtatag

SEQ ID NO: 46465 - DNA, 471 bp, Artificial Sequence
  Description of Artificial Sequence: Synthetic coding sequence
atggccgccctgaccgccgagcacttcgccgccctgcagagcctgctgaagctgctccaggcgctgcaccgtctcactcggctggtggccttccgtgacttatcaagcgccgaggccattctggccttgttcccggagaatttccaccagaatctaaaaaatttgctgacaaagattattctggagcacgtctctacctggagaactgaagcccaagccaatcagatctctcttcccaggctcgtggacttagactggcgggtggatataaaaaccagtagcgatagtatcagtcggatggctgtcccaacatgtttgctccagatgaaaatacaggaagatccatctctttgtggagacaagcctagtataagtgccgttactgtcgagctgtctaaggagacacttgacacaatgctggatggcctaggtaggatacgggatcagctgtctgccgttgcatctaaatag

SEQ ID NO: 46466 - DNA, 2067 bp, Artificial Sequence
  Description of Artificial Sequence: Synthetic coding sequence
atgtggtgcatcgtgctgttcagcctgctggcctgggtgtacgccgaacccaccatgtacggggaaatcctcagtcccaactacccacaggcctatccctcagaggtagagaagtcctgggacatagaggtgcctgaaggatacggcatccacctctatttcactcacctggacatcgagttatccgagaactgtgcttacgattccgttcaaatcattagtggggacacagaagaggggcgcttgtgcgggcagaggagttctaataacccacattctcccatcgtggaggagttccaggtcccctacaacaaactccaggttatctttaagtctgatttctctaacgaagagcgtttcacgggctttgccgcctattacgtcgccacagatattaacgagtgcacggacttcgtagatgttccatgctcgcacttctgtaacaacttcattggaggctatttttgctcctgtccacctgaatattttctacacgacgacatgaagaattgcggagtgaattgcagtggggatgtatttactgcccttatcggcgaaatcgcatcaccgaactatcctaagccttaccctgagaacagcagatgcgaatatcagatacgcctagagaagggcttccaagtagttgtgacacttcgtagggaggattttgacgtcgaggcggctgatagcgctggcaactgtctggatagtttggtgtttgtggccggtgacaggcagttcggcccttattgcggtcacggctttccggggccactcaatatcgaaaccaaatccaacgccctggatattatttttcagacggacctgaccggtcagaagaaaggatggaaactccgttaccacggcgatcctatgccttgcccgaaagaagacaccccaaactccgtctgggaacccgccaaggccaagtatgtgtttcgggacgtggtccagataacctgtctggacggctttgaagtggtcgagggcagagtgggagcaacctccttctactcaacctgtcagagcaatggcaaatggagcaatagtaagctcaagtgccagccagtggattgcgggatccctgagtcgatcgaaaatgggaaagtcgaggaccctgagagcacgctgtttggctctgtgattcgctatacatgcgaagagccttattattacatggagaacggagggggtggcgagtatcattgtgcaggcaatggatcctgggtgaatgaggtcctgggacctgagctgcccaaatgtgtgcccgtgtgtggggtgcctcgcgagccttttgaggagaaacagagaattattggaggcagcgacgccgacataaaaaactttccctggcaggttttctttgacaatccatgggcggggggggcgttgatcaatgaatattgggtgcttactgcagcacacgtggtagaaggcaaccgtgagccgaccatgtatgttgggtcgacctcggtccagacatctcgactggccaaaagcaaaatgctcacaccagagcatgtgtttattcaccctggttggaagctacttgaagtgcccgagggacggaccaacttcgataatgatattgccctggtaaggctgaaggacccagtcaagatggggccaaccgtgtcaccaatttgcctcccgggcacctcctcagactacaacctcatggatggcgacttgggcctgatatctggctgggggcggaccgagaaaagggaccgcgccgtgcgcctcaaagccgctcgattgccggtggctcctctgcggaaatgcaaggaggtgaaggtcgagaagccgaccgccgacgctgaagcctacgtgttcacaccaaacatgatttgtgctggcggagagaaaggaatggactcgtgcaaaggtgactcaggtggcgccttcgcagtgcaggaccccaacgataagactaagttctacgccgcaggcttagtaagttggggaccccaatgtggcacgtacggactttatacaagggtgaaaaattacgtggactggatcatgaagacaatgcaggaaaattctacgcctcgcgaggattag

SEQ ID NO: 46467 - DNA, 2067 bp, Artificial Sequence
  Description of Artificial Sequence: Synthetic coding sequence
atgtggtgcatcgtgctgttcagcctgctggcctgggtgtacgccgagccaactatgtatggggaaattctttccccaaattatcctcaggcatatccctctgaggttgagaagtcttgggacattgaggtgcccgaaggctacggcattcacctctatttcacccatctggacattgagctctctgaaaattgcgcatatgattcagttcagattatctctggggatacggaggaaggaagactgtgtggacagcggtcctctaataaccctcactctcctatcgtggaagaatttcaggtgccctacaacaagctccaggttatcttcaaaagcgacttttccaatgaagaacgcttcacagggttcgcagcttactatgtggccacggacataaacgagtgcaccgactttgttgatgttccctgttcccatttttgtaacaacttcatcggaggttatttctgctcatgtccccccgaatactttctgcacgatgatatgaagaattgcggcgtcaattgtagcggcgatgtcttcacagcacttatcggcgagattgccagtccaaactatccaaagccgtatcccgaaaactcgagatgcgaataccagatccggctcgagaaaggcttccaagtcgtcgtcactctcaggcgagaagactttgacgtcgaagcagccgattccgccggtaattgtttggactcgctggtctttgtggccggggatagacagttcgggccatactgcgggcacggatttcctgggcctcttaacatcgaaactaagtctaacgcgctcgacatcatctttcaaaccgatctgacaggccagaaaaagggctggaaactcagataccacggtgaccccatgccatgtccgaaggaggacacgccaaactcagtgtgggagcccgctaaagctaagtacgtgtttcgggacgtcgtgcagatcacctgtttggacggattcgaggttgtggagggtagagtgggtgcaactagtttctactccacttgtcagtctaatgggaaatggtcaaactccaagttgaagtgccagccagttgattgcggcatccccgagtctatcgaaaacggtaaggtggaagatcccgagtcaactctgttcggctccgttatccgatacacgtgcgaggagccctactactatatggaaaatggcggtggcggcgagtaccattgtgccgggaatgggtcttgggttaacgaagtgcttggaccagaactgccgaagtgtgttcctgtttgcggtgtcccaagggagccttttgaggaaaagcagcggatcattggtggatctgacgctgacatcaagaattttccgtggcaggtgttcttcgacaacccatgggccggcggagctttaatcaatgaatattgggtgttgactgcagcccatgtggttgagggtaaccgagagcctacaatgtatgtgggcagcacttccgtgcagactagcagactagcaaaatcaaaaatgttgaccccagagcacgtgtttattcatccgggttggaagctgctcgaggtgccggaggggaggacaaacttcgacaatgatattgcgttagtgcgtctcaaagatccagtgaagatggggccaaccgtgtcccctatttgcttaccagggacaagttccgactataacctgatggacggcgacctggggctgatttccgggtggggtaggaccgaaaagcgggaccgcgcagtgagacttaaggccgccagactccccgttgctccacttaggaaatgcaaggaagtgaaagttgagaagcccacagccgacgcagaagcctatgtatttacaccaaatatgatatgtgccggcggggaaaaggggatggatagttgcaaaggagattctggaggtgccttcgctgtgcaagatccaaacgacaagactaaattttacgcagccgggctggtctcatggggacctcagtgcgggacatatggcctctacacccgtgtgaagaattatgtcgactggatcatgaaaactatgcaagagaattctaccccccgggaggactag

SEQ ID NO: 46468 - DNA, 483 bp, Artificial Sequence
  Description of Artificial Sequence: Synthetic coding sequence
atggccttcctgatgaagagcatgatcagcaaccaggtgaagaacttgggatttggtggagggtcagaggaaaacaaagaagagggcggggcatcggacccggctgccgcccagggaatgacccgggaagagtacgaggagtaccagaagcagatgattgaagagaaaatggagcgcgacgccgcattcacacagaagaaagctgaaagggcctgtttgcgcgtacaccttcgcgaaaagtatagactgccaaagtccgagatggatgaaaatcagatccagatggctggagacgacgtcgacttaccagaggacctgcggaagatggttgatgaggatcaggaggaggaagaagacaaggattccatcctaggacaaatccagaacttacagaacatggacctggatactatcaaggagaaagctcaggcaacatttacagagattaaacagaccgccgagcaaaagtgctccgtgatgtag

SEQ ID NO: 46469 - DNA, 3924 bp, Artificial Sequence
  Description of Artificial Sequence: Synthetic coding sequence
atgggcagcgtgaccggcgccgtgctgaagaccctgctgctgagcacgcaaaattggaatcgagtggaggccggcaatagctatgactgcgacgatcctttagtgagtgccttaccgcaggcttctttcagcagttcatctgaactgtcctcgagccacggtccaggcttcgcgaggctgaatagaagggacggggcaggaggctggagcccgctggtttctaacaagtatcaatggctccagatcgacctcggcgagaggatggaggtgactgcggtcgccacccaagggggctatggctctagcaattgggtgaccagttacctgctcatgttttcagactccggatggaattggaaacagtataggcaggaggattcgatctggggtttcagcggtaacgcgaatgctgactcagtggtctactaccgcctgcagccatcaatcaaggcccgatttctgaggttcatccccctcgagtggaatcccaaagggagaataggaatgaggattgaggtttttggctgcgcttaccgatctgaggtggtggacctggacgggaagtcatctttgctctacaggtttgaccaaaagtctctgtcaccaattaaagatattatctcactcaagtttaagaccatgcagtccgacggaatacttttacaccgggaaggccctaatggcgaccacatcactcttcagctaaggcgcgcccgactctttttgttaatcaactctggggaggcgaaacttccctctaccagcacccttgtgaacctgacccttggaagcttgctggacgaccagcattggcatagtgtcctgattcagagactgggcaaacaagtcaatttcaccgtggatgaacaccggcatcacttccatgcccggggcgagtttaacctcatgaatttggactacgagatctctttcgggggaatcccggctcctggtaagagcgtcagttttccacaccgaaacttccacggctgtctggagaacctctattataatggggtcgatatcatagatctagctaagcaacagaagccacagataatcgccatgggaaacgtgtcatttagctgttcccagccccagagtatgccagttacgttcctcagctcacgctcatacctggccctgcctgatttctcaggcgaagaggaagtgtctgcaacattccagttcaggacttggaataaagccggactcctgctgttttccgaactccagttaatttcaggaggaatactgctattcttgtcagatggcaagctgaagtcgaacttgtaccaaccaggcaagttacctagcgacataactgccggggtcgagttgaacgatggccaatggcactccgtctcactgagtgctaaaaaaaatcatttgtccgtggcagtggacggtcaaatggcttcagccgctccgttgctgggcccagagcagatatacagcggcggcacatactacttcggaggatgccctgataagtcctttggcagcaagtgtaaaagtcctctaggaggttttcaggggtgtatgcggctaattagtatctcaggaaaggtggtcgatcttatcagcgtgcagcaagggagcctgggtaacttctcggaccttcagattgattcctgcgggataagcgaccgttgcctgcctaactactgtgaacatggtggggagtgtagccagtcatggagcacgttccattgcaactgtacaaacactggatacaggggggccacatgtcataacagtatctacgagcaatcctgcgaggcttataagcaccgcggcaacaccagtgggttctattacatagattctgatgggagtggtccacttgagcctttcctgctctactgtaatatgactgaaactgcgtggacaatcatccagcataacgggtccgacttaacaagagtgagaaatacgaaccccgaaaacccttacgctggatttttcgagtatgtggcctccatggaacaattgcaggcaactataaatcgggccgaacactgcgagcaggagttcacctactattgtaaaaaatctcgactggtgaacaaacaggacggcactcctctgtcctggtgggtgggacgtacgaacgagacacagacctactggggtggaagctcgcctgatttacagaagtgtacctgcggccttgagggaaattgtatcgatagtcaatactattgtaattgtgacgctgataggaacgaatggactaatgataccggactcttggcctacaaagagcatctgccagtgactaagatcgttattacagatacaggcaggctgcactcggaagccgcctataaactgggaccacttttatgccaaggggatcgaagcttttggaatagtgctagtttcgatacggaggctagctacctgcatttccccactttccacggagaactctcagccgacgtgtctttcttttttaagacgactgcgtcctcaggcgtttttttggagaatctcggtattgcagattttattaggattgagctgaggtcccctactgtggtgacattcagcttcgatgtaggaaatggaccatttgagatctcagtacaatcacccacacattttaacgacaatcagtggcaccatgtgagggttgaacgcaatatgaaggaagcctcattacaggtggaccagttgacccctaaaacacaacctgcccccgctgacggtcatgttctcctgcaactcaactcccagctcttcgtgggcggcaccgcgacgcgccagcggggcttccttgggtgtatcagatctctccagctgaatgggatgactttggatctggaagagagggcacaagtaaccccggaggtccagcctggatgcagagggcactgctccagttatggcaagctctgccggaacgggggaaaatgtagagaaagacccattggcttcttttgtgactgtacgttcagcgcttacacggggccgttctgcagcaacgagatctctgcctacttcggctcagggagttccgtgatatacaacttccaagagaactacttgctgtccaaaaattcctcctcacacgccgcaagttttcacggagacatgaagctcagcagggagatgataaaattttcatttagaacgacaaggactccctcacttctgctcttcgtgtctagcttttacaaggaatacctcagtgttattatcgcaaaaaacggcgatttgcagatcaggtacaaactcaacaagtatcaggaaccggacgtcgtgaacttcgacttcaaaaatatggcagacggtcagctccaccacatcatgatcaaccgcgaggagggcgtggtattcatcgaaattgacgataacagacgcaggcaggtgcatctttcatccggcactgagttttccgctgtgaaatcgctcgtgctgggtcgcattctggagcattcagacgtagatcaggatactgcccttgcaggagcacaaggcttcactgggtgcctatccgccgtacagttgtcccacgttgctcctctgaaggctgctttgcatcctagccatcctgatcctgtcacagttaccggacacgtgaccgagtcttcatgcatggcacagccaggaaccgacgctacatctcgcgagcgcacacattcatttgcagaccactctggcactattgatgatcgcgagccactggccaacgcgattaagagtgactccgctgtgatcggcggcctgattgccgtcgttatcttcattcttctatgcatcacagccatcgctgtgagaatctatcagcaaaagagactgtacaagcgaagcgaagccaagcgtagcgaaaacgtggactcagccgaggccgtactgaaaagcgagttaaatatccagaatgccgttaacgagaatcagaaggaatatttcttctag

SEQ ID NO: 46470 - DNA, 3780 bp, Artificial Sequence
  Description of Artificial Sequence: Synthetic coding sequence
atgggcagcgtgaccggcgccgtgctgaagaccctgctgctgagcacccagaactggaatcgcgtggaggccgggaactcttatgattgtgacgaccctctggtgagcgctctgcctcaggctagcttctccagcagctctgagctgagctctagtcacgggccaggattcgcaaggctgaaccgcagggatggagcgggcggatggagccctctggtctctaacaagtaccagtggctacagatcgatctgggcgaaagaatggaggtgaccgcagtggcgacccaaggcggctatggatcatcaaattgggtaacaagttatctgctcatgttcagtgatagtggctggaactggaagcagtatcggcaagaagattctatctggggatttagcggtaatgccaatgcggattccgttgtctactacagactgcagccaagcatcaaggcaagattccttaggttcattccacttgaatggaaccctaaggggcgcatcggcatgcggattgaggtgtttggctgcgcatacagatctgaagtggtcgatcttgatggcaaatcaagtctgctgtatcgctttgatcagaagagtttatcaccaataaaagacattatctcactgaagtttaaaacaatgcagagcgatggtatcctgctccatcgggaaggcccaaatggggatcacatcacattgcagctcaggagggcaagactctttcttttgataaacagcggcgaagccaagctgccatctacaagtaccctggttaacctaacgcttgggtcgcttctggacgatcagcactggcactctgtattaatccagagactggggaagcaggtgaattttacagttgacgagcatagacaccactttcacgcccggggcgagttcaacttgatgaacttggactacgaggggaatgtatcattcagctgctcacaacctcagtccatgcccgtgacatttttgtcatctaggtcgtacttagcactacccgatttctccggcgaggaggaagttagtgcaacttttcagtttagaacttggaataaagccggtcttctgcttttttctgagttgcagttgatttctggcgggatcctattgtttctgtcagacggcaaactgaagtctaacctgtatcagccaggcaaactcccgtccgacataactgccggcgtggagctcaacgacggccagtggcattccgtaagtctgagcgcaaagaagaaccatttgagtgtcgccgtggatggccagatggcaagcgcagcacctttgctggggcccgagcagatttacagtggcggaacatactacttcggaggatgtcctgacaaatcattcgggtcgaagtgtaaatctcctctgggtggcttccagggttgtatgcggctgatctcgattagcgggaaggtcgtcgatcttatctcagtgcaacaggggtcccttggaaacttctctgatctgcagatcgatagttgcgggattagcgatcgctgtctgcctaattattgtgaacacggaggtgaatgcagtcaatcatggtcaactttccattgtaactgtaccaacaccggatatagaggtgccacgtgccacaattccatctatgagcagtcctgcgaggcctataagcatcgcggcaataccagcggattttactacatagacagcgatgggtcagggcccctcgagcctttcctcttatactgcaacatgactgagactgcctggactataatccagcacaatgggagtgacttaacgcgagttcgcaacactaaccctgagaacccatacgccgggtttttcgaatatgtggcaagcatggaacagctgcaggcaaccattaatcgggctgagcattgtgagcaagaatttacatactactgtaagaagagcaggctggtcaacaagcaggacggaacacccttgtcctggtgggtgggcagaactaatgaaacccagacgtactggggaggctccagccctgacttgcagaaatgtacctgcggtctggaaggcaactgtattgacagccagtactattgtaactgcgacgcagataggaacgagtggactaatgacacaggcctgctagcttataaagaacatctgccagtgacaaagatcgtgattaccgacacaggtagattacactcagaagctgcctacaagctgggccctctgctctgtcagggtgacaggagcttctggaacagcgcatccttcgatacggaagcctcctatctgcactttcccacattccatggggagctcagtgcggacgtctctttcttctttaaaacgaccgcatcgtcgggcgtttttcttgaaaacctggggatcgccgattttatccggattgagcttcgcagccccacagtggttacctttagcttcgacgtcggaaacggtcctttcgaaatttcagtccaaagccctacccactttaatgataatcagtggcaccacgtgcgcgtggagcgaaatatgaaggaagcctcattgcaagtagaccagcttaccccaaaaacccagcctgctcctgcggatgggcacgtgctgctgcaactcaattcgcagttgttcgtgggcgggactgccactaggcaacgaggctttctgggatgtatccgaagcctacagctgaatggcatgacactggacctagaggagcgggctcaagtaacaccagaagtccaaccaggctgccgggggcactgttcatcttacgggaaactgtgccgcaacggcggcaaatgccgggagcggcctatcggcttcttttgtgattgtaccttctccgcgtacaccggcccgttttgctccaacgagatttccgcttacttcggcagcggctcatctgtgatctacaatttccaggagaactacttgttgtctaagaattcatcttcccatgccgcctcttttcatggcgacatgaaactttcccgcgagatgatcaaattcagcttccgcaccacgcgcacaccctccctgctcctgtttgtcagcagtttttataaggagtacttgtctgtgatcatcgccaaaaatggcgatcttcagatcaggtataagctcaacaaataccaagagcctgacgtagtgaattttgacttcaaaaacatggccgacggccaactgcatcatatcatgatcaatcgagaagaaggtgtcgtctttattgaaatagatgacaatcgccggcggcaagtgcacctaagctccgggactgagttctctgctgtgaaaagccttgtgttgggacggatcctcgaacacagtgatgtggaccaggacaccgccctggccggagcccaaggttttacgggatgcctgtcggctgtccagctaagccacgtggcccctttaaaagcagcgctgcacccttctcaccccgacccagtcactgtaaccggacacgtgaccgagtcttcttgcatggcccagcccggcaccgatgcaacctcaagggagcgcactcatagcttcgctgaccacagtgggactatcgatgatcgtgagcctctcgccaacgcaatcaagagcgacagcgctgtcattggcgggttaattgccgtcgtcatctttatcctgctctgcattactgccattgccgtacgtatctatcagcagaaacgactgtataaacgctctgaggctaaacgctccgagaacgtggactctgccgaagctgtcttaaaatctgaattgaacatacagaatgcagttaacgagaaccagaaggaatattttttttag

SEQ ID NO: 46471 - DNA, 3708 bp, Artificial Sequence
  Description of Artificial Sequence: Synthetic coding sequence
atgtggaactacgactgcgacgaccccctggtgagcgccctgccccaggcctccttctcttctagtagcgagcttagtagctcccatggtcctggcttcgcgcgcctgaataggcgcgatggagcgggtgggtggagtcctctggtgagcaacaagtatcagtggctgcagatcgatttgggcgagcgcatggaggttacagccgtggccactcagggtggttatggcagcagtaactgggtgacatcgtatttgctgatgttctctgatagtggctggaactggaaacagtacagacaagaggactccatctggggatttagcggtaacgccaatgcagatagtgtagtgtattacaggctgcagcccagcatcaaagctagatttctgcgctttattcccctggagtggaacccaaaagggcggatcggaatgaggatagaggtgttcggttgtgcgtaccgatccgaagtcgttgaccttgatggaaaaagctcactactgtacagatttgatcagaaatctctcagccccatcaaggatattatttccttgaagtttaagaccatgcaatctgacgggatcctccttcaccgagagggtccaaacggtgatcatattacgcttcaactgcgaagagcccgactcttcctgctcattaattctggggaggcaaagttgccctccactagcacattggtgaatttgacgctgggttcattattggacgatcagcattggcacagtgttttgattcagaggctaggaaagcaagtaaatttcacagtagatgagcatcgtcaccacttccacgctaggggcgagttcaacctgatgaaccttgattacgaaggcaacgtttcctttagttgctctcagccccaatccatgcccgtgacttttctgtcgtctcgatcataccttgcgctgcctgactttagtggcgaagaagaagtgtctgctacattccagttcagaacctggaacaaggctggccttctgctcttctcggagctgcagctgatctctggcggcatacttttgttcctgtcggacggtaaattaaagagcaacctataccagcccggaaagctcccatcagacatcacagctggcgtggagttgaatgacgggcagtggcactcagtgagtctgtctgctaagaagaaccatctgagtgtcgctgtcgacggccagatggcgagtgcagcaccccttctggggcccgagcagatctacagtggtggcacctactatttcggcgggtgtccagataagtcttttggcagtaagtgtaagtctcctctggggggcttccaggggtgcatgcgtctgattagcatcagtggtaaagtggttgacttaatatccgttcagcagggttctctaggtaatttctccgacctgcaaatcgattcgtgtggaattagcgaccgttgtctacccaactactgtgagcatggcggcgaatgcagccagagttggagtacattccactgtaactgcaccaatactggataccggggggcaacatgccacaattccatttatgagcaatcctgcgaagcctacaagcacagaggaaacaccagcgggttttattatatcgattcagacggcagcgggccgctggaaccgtttctgctctactgcaacatgactgagaccgcttggactatcatccaacataacggttcggacctgacgcgagtccgcaacaccaaccccgagaacccatacgcaggattttttgagtacgtcgcatccatggaacagctgcaggcaacaattaatagggccgagcactgtgagcaggagttcacatattactgcaagaagtcccgactcgttaataaacaggatggaacccctctgagctggtgggtggggcgcacgaatgaaacccaaacttattgggggggtagtagccctgatctgcaaaaatgcacttgtggtctcgagggcaactgcatcgattcccagtactactgcaactgcgatgccgacaggaacgaatggaccaacgacactggactgttggcctataaggagcacttgccagttactaagattgtgatcaccgataccgggcgccttcattctgaggccgcctacaaactcggacccctactgtgccagggagacagaagcttctggaactcagcttctttcgataccgaggcatcctatctgcactttcctacatttcacggcgagttgtctgccgatgtgtccttttttttcaaaactaccgcaagttcaggtgtttttctggagaacctcggtatagcagacttcatcaggattgagcttcgatcacccaccgtcgttacatttagcttcgacgttggcaatggcccatttgaaattagcgtgcagagccccactcacttcaacgataatcagtggcatcacgtgagggtcgagagaaacatgaaagaagcctctttacaggtcgaccagctgacccccaagactcaacctgctccggcagacggtcatgtgctgctacagttgaatagtcagctgttcgtcgggggtactgcgacccgccagcggggatttctgggttgcatccgcagcctgcaattgaacgggatgactctggatctcgaggagcgggctcaagtgacccctgaagtgcagccaggctgcagaggccactgttcgagctatgggaaactgtgtcggaacggtggaaagtgtcgtgaacggcctatcggatttttttgcgattgtacctttagcgcgtacacgggaccattttgctctaacgaaattagcgcatactttggcagcggctcctcagtgatatacaactttcaagaaaattacttgctgagtaagaactcgtcaagccatgctgcctcattccacggagacatgaagctttcaagagaaatgataaagttttcattccggacgacaagaaccccctcattgcttctatttgttagcagtttttacaaggaatatctaagtgtaataatcgccaaaaacggctctctgcaaatccgatacaaattgaacaaatatcaagaacccgacgtggtgaactttgatttcaagaatatggccgatggtcaattgcaccatatcatgatcaaccgggaggagggcgtagtgtttattgagatcgatgataataggcggaggcaggtccacttaagtagtggaacagaattttcagccgtcaagtcgctggtgcttggacgcatcctggaacacagtgacgtagaccaagataccgccttggcgggcgctcaaggctttaccggttgcttgtctgctgtccagctgtctcacgttgctcctctgaaggccgctcttcacccatctcaccccgatccagtcacagtcacaggacatgtcacagagagcagctgtatggcacagcctgggacagatgccaccagccgagaaagaacccactcgtttgccgaccatagcggcaccatagatgaccgggagcccctagctaacgctattaaaagtgattcggcagtgataggggggttaatagcagtcgtcatcttcatcctgctgtgcattacagcgatcgccgtgaggatttaccaacagaagcgcctgtacaagcgatccgaagccaaacgctctgagaacgtggactccgctgaagctgtgctcaaatccgagctgaacatccagaatgccgtcaatgaaaatcaaaaggaatattttttttag

SEQ ID NO: 46472 - DNA, 1512 bp, Artificial Sequence
  Description of Artificial Sequence: Synthetic coding sequence
atgagcctgggcggcgccagcgagcggagcgtgcccgccaccaagatagaaataacagtctcttgtcgtaacctcttagacctcgacacgtttagcaaatcggatccaatggtggttctgtatacacagagccgtgcatctcaggagtggagggagtttggccgcacagaggtgatcgataacactctgaacccggacttcgtgcgcaaattcgttctcgattacttctttgaggagaaacaaaatctgcggtttgatgtatacaatgtcgactccaaaaccaatatatctaaacctaaagactttctgggccaggcatttctcgcactgggagaggtgattgggggacaaggctctcgagtggagagaacacttacaggtgtaccgggcaagaagtgtggcacgatcttgctcacagctgaagaactgtctaattgccgagatatcgcaaccatgcaattgtgcgctaacaaacttgacaaaaaagactttttcggtaaatctgacccgtttttagttttctacagatccaacgaggacggtaccttcacgatttgccacaaaacagaggtggttaagaacaccctgaaccccgtgtggcaaccattcagcatcccagtgagggcactgtgcaacggcgattacgatcggaccgttaaaatcgatgtgtacgactgggatcgagacggatcacacgactttataggcgagtttaccacaagctaccgcgagctgagcaaggctcaaaaccagtttaccgtgtatgaggtgctcaaccctcggaagaagtgcaagaagaagaagtacgtgaattccggtacggtaacactcttgtcattcagcgtggactcagagttcactttcgtggattatatcaagggaggaacacagcttaactttactgtggcgattgatttcaccgcctcaaacgggaatccactgcagcccacatcactgcactatatgtccccttaccagctgtcagcttatgccatggctttaaaggcagtcggggagatcattcaagactatgatagtgacaagcttttccccgcctatggtttcggagctaagctcccccctgaaggtcggatctcccaccagtttcctcttaataacaatgatgaagatccaaactgcgctggaattgaaggcgtgctagagtcctacttccagtcacttcggacggtgcagttgtatgggccaacttactttgctccagtgataaaccaagttgcccgtgctgcagccaagatcagcgatggctctcaatactacgttctcctgattatcacagatggggttatttctgacatgactcagacgaaggaagccattgtttctgcatcctcactccctatgtccatcataattgtcggagtggggccagccatgttcgaggccatggaggagctggatggtgacgatgtaagagtctctagcagaggtaggtacgcagagcgtgacattgtccaagaagggtgttgcagtcttgggacgtctgttgtatag

SEQ ID NO: 46473 - DNA, 1662 bp, Artificial Sequence
  Description of Artificial Sequence: Synthetic coding sequence
atgagcctgggcggcgccagcgagcggagcgtgcccgccaccaagatcgagatcaccgtgtcttgtaggaaccttctggatctcgatacattttctaaaagtgaccccatggtagtcctctacacacagtcccgcgcatcccaggagtggagagaattcggacgaacggaggtgatcgacaacactcttaaccccgattttgttcgaaaatttgtgttggactacttttttgaggaaaaacaaaatctgagattcgacgtctacaacgtggactcaaaaaccaatatttccaagcctaaggatttcctggggcaagcattcctcgctttgggcgaagttatcggtgggcagggctcgagagttgagagaaccctgactggggtcccagggaagaagtgtggaaccatccttcttaccgctgaagaattaagtaactgtagggatatcgccaccatgcagttgtgcgcaaataagttagacaagaaggacttttttggcaagagtgatcctttcctcgtcttttatcggtcaaacgaggacggcacatttacaatctgccataagactgaagtcgtcaagaatactttgaaccctgtgtggcagccattcagcatccctgtcagggccctgtgtaacggagattatgaccggactgtgaagattgatgtctatgattgggacagggatgggtcacatgacttcatcggcgaattcaccaccagctaccgggagctgagtaaggcccagaatcagtttaccgtgtacgaggttctgaacccccggaaaaagtgtaagaagaaaaaatacgtgaacagtggaaccgtgacactgctaagcttctcagtggattctgagttcacattcgtggattatatcaagggcgggacccagctgaacttcactgtcgcgatcgactttactgcctctaacggtaaccctttgcagcctacaagtctgcattatatgtccccgtatcagctttccgcctacgcaatggcattgaaggctgtgggcgaaattattcaggattatgattcagataagctttttcccgcttatggattcggcgcgaaactcccacctgagggaagaatctctcatcaattccccctcaacaataacgatgaagatccaaactgtgcagggatagaaggagtactggaatcctatttccagtcattgagaactgtgcaactgtatggacctacctattttgcccccgtgatcaatcaggtagctagagccgcagctaaaatatctgacggaagccagtactatgttctgctgattataaccgatggtgtcattagcgacatgactcagacaaaggaagcaatcgtgtcagcatcttccctgccaatgagtattataattgtgggcgttggaccagctatgtttgaggctatggaggagttggatggtgacgatgtgcgggtgtcgagtagaggccgttacgcagagcgggacatagttcagttcgtgccatttagggattatgtggaccggtccggcaaccaggtgctctcaatggcccggttagccaaggacgtcctggcggagatcccagaacagctgctgtcctatatgagaactagggatatccagccacgacccccgccccccgccaatccaagccctatccctgccccggagcagccttag

SEQ ID NO: 46474 - DNA, 1614 bp, Artificial Sequence
  Description of Artificial Sequence: Synthetic coding sequence
atggcccactgcgtgaccctggtgcagctgagcatcagctgcgaccacctgatcgacaaggatattggtagcaaatcggaccctctgtgcgtgctactgcaggacgtaggcggcggcagctgggctgagctggggcggaccgagcgggttcgcaactgctctagccctgaattcagcaaaacgttacagctggaatatcgtttcgaaactgtgcagaagttgaggtttgggatttatgacatcgataacaagactcctgagctgagagatgatgactttctgggcggcgccgaatgtagtttgggacaaatcgtgagcagccaggtgctaaccctcccattaatgctgaagccagggaaaccggccggtcgtggcaccataaccgtgagcgctcaagaattgaaagataaccgggttgtgactatggaagtggaggccaggaacctcgacaagaaagactttctgggcaaatccgatccattcctcgagttctttcgccagggtgatgggaaatggcacctggtttatcgatccgaggtgatcaaaaacaacttaaacccaacctggaagagattctctgtgccagtacaacacttttgcggcggaaacccctcgacaccaattcaggtacaatgtagcgactacgactccgacggcagtcatgatttgataggaacatttcacacaagtctggcccagttgcaggcggtgcccgctgaatttgaatgcatccacccagagaaacagcagaagaagaaaagctacaaaaattctggtacgattcgcgtgaaaatttgccgtgtggagactgagtactccttcttagactatgtgatgggtggatgtcagatcaatttcactgttggcgtagatttcaccggaagcaacggagacccttctagccccgattccctgcactacctttcgcctacaggggtcaacgaatacctgatggcgttgtggtccgttggatcagttgtgcaggactatgacagcgacaagctgtttcctgcgtttggcttcggagctcaagtgcctcccgactggcaagtgtctcacgagtttgcactgaatttcaacccatcaaacccatactgcgccggtatacaagggatcgttgacgcgtatcgtcaggcattgccgcaggtgaggctctacggcccaaccaacttcgcaccgattattaaccacgtagccaggttcgcagcacaagccgcccaccagggaactgccagccaatacttcatgctcctgctgcttactgatggcgctgtgaccgatgttgaagctacacgggaggcggttgtgagagcgagtaacctgcccatgagtgttatcattgtaggagtcggtggggctgattttgaagccatggaacagctggacgcagatggcggacccctccacacaagatctggccaggccgcagcaagggacattgtacagtttgtgccttacaggagatttcagaacgcaccacgagaggccttggcacaaacggtcctagctgaggtgcctacacaactagtatcttacttcagagcgcagggatgggccccgctaaaaccccttcctcctagtgctaaggaccccgcacaggcaccgcaagcctag

SEQ ID NO: 46475 - DNA, 1629 bp, Artificial Sequence
  Description of Artificial Sequence: Synthetic coding sequence
atgaagatgatgcacatggcccactgcgtgaccctggtgcagctgtccatcagctgtgatcaccttatcgacaaggatatcgggtctaaatcagacccactctgcgttttgttgcaggacgtgggcggcggatcttgggccgagctggggagaactgaaagagttaggaactgctcttcacccgagttcagtaaaaccctccagctggagtaccgtttcgagaccgtgcagaaacttagattcggtatttacgacatagataacaagactccggaactcagggatgacgatttcctgggcggcgctgagtgtagccttggacaaatcgttagttcccaagtccttactctgcctttgatgctcaaaccgggcaaaccggccggcagaggaacaattactgtctcagcccaggagctcaaagacaacagggtcgtgaccatggaagtggaagctaggaatttagataaaaaggatttccttgggaagtcagaccccttcctggagttctttcggcaaggcgatgggaaatggcacctggtttacagatccgaggtgattaagaacaatctgaaccctacctggaagagattctccgttccagtgcaacatttctgtggaggaaatccctctacacctatccaggtccagtgtagcgattacgacagcgacggttctcatgatctgattgggactttccacacttctctagcacagctgcaggcagtcccagccgaattcgaatgcattcatcctgaaaagcagcagaagaagaagtcatataaaaattctgggaccatacgcgtgaaaatttgccgagtggagacggagtattcctttcttgattacgtgatgggaggctgccagatcaactttaccgtgggggtggattttacaggatctaacggagacccaagtagccctgactctctgcattatctgagcccaacaggcgtgaatgaatacctaatggccttatggagtgtgggaagcgtggtgcaagattacgactccgacaaactgttccccgcctttgggttcggggctcaggttccccccgactggcaggtgagtcacgaatttgcactgaattttaacccttcaaacccatactgcgctggtatccaggggatcgtggatgcatatcgacaggccttgccacaggtgcgtctgtacggaccaactaactttgcaccaatcatcaatcatgtcgctcgttttgctgcccaggctgcacaccagggcactgcatctcaatactttatgctacttctactgaccgacggtgccgtcacagacgtggaggccactcgagaggccgtcgtgagagcgtcaaacctgcccatgtctgtgattattgtgggggttggaggagcggatttcgaagcaatggagcaactggacgccgatggtggtcctctccacacaaggagcggccaggcagccgcacgggatattgtccagtttgtgccctaccgaaggttccagaacgccccccgagaagccctggcccagaccgtgctggccgaagttccaacacagctggtcagttatttccgcgcgcagggatgggcccccctgaagccactgcctccgtctgcaaaagacccagctcaggcgcctcaggcttag

SEQ ID NO: 46476 - DNA, 1614 bp, Artificial Sequence
  Description of Artificial Sequence: Synthetic coding sequence
atggcccactgcgtgaccctggtgcagctgagcatcagctgcgaccacctgatcgacaaggatattggaagcaagagtgaccctctctgtgtgcttttgcaggacgttgggggcgggtcttgggccgaactcggaagaacagagcgagtgaggaattgtagtagcccagagtttagcaaaaccctgcaactggaatatcggtttgaaaccgtgcagaaattgcgttttggtatttacgacattgataacaagacacccgagttaagggacgacgattttttggggggtgcagaatgctccctcggccagatcgtaagcagccaagtgctgacgcttcctctaatgctgaagccagggaagccagctggccgggggactatcactgtgtctgcccaggagcttaaggataaccgcgtggtcactatggaagtggaggcgcggaacttagacaaaaaggactttctgggcaagtctgatccatttcttgagttttttcgccagggcgatggcaaatggcacctcgtgtatcgaagcgaggtgattaagaataacctcaacccgacctggaaaaggttcagcgtgcccgtacagcatttttgcggtggcaaccccagcactcccattcaggtccagtgctcagactacgacagtgacggctcccacgatttaatcgggacgttccatacttccctggcacagcttcaagcagtgcccgccgagtttgagtgcatccaccctgaaaaacaacagaagaagaaatcttataagaattccggcaccataagggtgaagatatgtcgtgtcgagacggaatatagttttttggactatgtaatgggcggttgtcaaattaacttcacggtcggagtcgatttcacaggctccaacggtgatccctcctccccagattctctgcactatctgagccctaccggcgtaaatgaatacttgatggccctttggagtgtcggcagcgtggtccaagattatgatagtgacaaactgttccctgcctttgggttcggggctcaagtcccacccgattggcaagttagtcacgaattcgcacttaacttcaacccttcgaacccctactgcgctggtattcagggaatcgtggatgcctatagacaggccctccctcaagtgcgcctgtacggacctacaaacttcgccccaattatcaaccacgtagcccggtttgccgcccaggcagcacaccagggaacggcttcccagtatttcatgctgctgttgctcacagacggggccgtgacagacgtcgaggctaccagagaagcagtcgtgcgggctagcaacctgcccatgagcgttataattgtcggggtaggaggcgcggatttcgaggccatggaacagctggacgccgacggcgggccgctgcatacgcgttccgggcaggccgctgccagggatatagtccagtttgtcccatataggagattccagaatgccccccgagaggcccttgcgcagacagttctagccgaagtaccgacacagttggtgtcctacttccgtgcccaggggtgggctccgttaaagccactgccacctagcgccaaagatccagctcaggcacctcaggcctag

SEQ ID NO: 46477 - DNA, 1614 bp, Artificial Sequence
  Description of Artificial Sequence: Synthetic coding sequence
atggcccactgcgtgaccctggtgcagctgagcatcagctgcgaccacctcatagataaagacataggttccaaaagtgaccccctttgtgtattactgcaggatgtcgggggaggcagttgggcagagttagggcggaccgaaagagtccggaattgctcctccccagaattttccaagaccctccagctcgagtaccggtttgaaaccgtgcagaagctgagattcgggatatacgacatcgacaataagacccccgaactgcgagatgacgactttctggggggcgcagagtgctctctgggacagatcgtttcttctcaagtccttaccctgccgttgatgctgaaacctggtaagcctgccggccgggggacaattactgtgagcgctcaggaactgaaggataatcgagtcgtcaccatggaggtagaggcccggaacctggataaaaaagatttccttggcaagagtgaccccttcctggaattcttcaggcagggcgacggaaaatggcacctggtttaccgcagcgaagtgataaagaataatctgaacccgacatggaagcggtttagcgtgcccgtccaacacttctgtgggggcaacccctcaacccctatccaggttcagtgtagcgactacgactccgacggcagtcatgacctgatcggcacgtttcacacttccctggctcagcttcaggctgtgccggcggagttcgagtgcatccatcctgagaaacagcagaagaagaaatcctacaagaattcaggcaccattcgggtaaagatctgtagagtagaaaccgaatattcgttcttagattacgtcatggggggctgtcaaatcaacttcacagttggggtcgattttaccggcagcaacggggacccatcatccccggattctctgcactacctgtctcccaccggcgtgaatgagtacctcatggcactttggagtgttggttcagtggtgcaagactatgactctgataaactgtttcctgctttcggctttggcgcccaggtgccccctgactggcaagtgtctcatgaattcgccctgaacttcaatccttccaacccctactgtgcaggtatccagggaatcgtcgatgcttaccggcaggcgctgcctcaggttaggctgtatggccccacaaattttgcccctataatcaatcacgtggctagattcgctgctcaagccgcccaccaggggactgcgagccagtacttcatgctcctgcttctgaccgacggggccgtcacagacgttgaggccacgagagaagccgtggtgcgcgccagtaatcttcccatgtccgtgatcatcgttggcgtggggggcgccgactttgaggctatggaacagctagacgctgacggagggcccctgcatacgcgaagcggccaggctgcagcccgggatatagtgcagttcgtgccatatcgccgctttcaaaatgcccctagagaagccctcgcacagaccgttctggcggaagtgcccacacagttagtatcctattttcgggcacaggggtgggctcccttgaagccactgccaccttctgcgaaagatcccgctcaagctcctcaggcctag

SEQ ID NO: 46478 - DNA, 1614 bp, Artificial Sequence
  Description of Artificial Sequence: Synthetic coding sequence
atggcccactgcgtgaccctggtgcagctgagcatcagctgcgaccacttgattgacaaagatatcggaagcaaaagcgacccattgtgtgtactcctgcaagatgtggggggcggcagttgggcagagcttggcaggaccgagcgggtgagaaactgcagcagtcccgaattctcaaagaccttacagctggaatataggtttgagacagtgcaaaagttgcgctttgggatttatgatattgacaataagacccccgagctgcgggatgatgattttttgggcggagccgagtgctctctaggtcagatagtgtcatctcaggttttgacgttgcccctgatgctcaagccgggaaaacctgctggcaggggcacaattactgtgtccgcccaggagttgaaggataatagggtagtgaccatggaagtggaggccagaaacctggacaaaaaagacttcctagggaaaagcgaccctttccttgaattcttccggcaaggggacggcaaatggcatctggtgtatcggtctgaagtcatcaaaaataatcttaaccctacctggaaaaggtttagtgtaccggtccagcatttctgcggaggcaacccttctacccctattcaggtgcagtgtagtgattatgacagcgacggtagccatgacttgataggaacattccacacaagcttagcacagcttcaagcagtgccagctgagtttgaatgtattcatcccgaaaaacagcagaagaaaaagtcatataaaaattcaggcaccatcagagtgaagatctgtcgagtggaaacggagtacagtttcctggattatgtcatgggcggttgccagattaatttcacagtaggcgtcgatttcaccggatccaacggagatccatcttctccagactcacttcattacctttcccccaccggcgtgaacgagtatctaatggcactgtggtcagtgggttccgtggtccaggattacgacagcgacaagcttttccccgctttcgggttcggcgctcaggtacctcccgactggcaggtctcacacgaattcgcgctgaactttaatccctccaacccttattgtgcagggatccagggcattgtagacgcctaccgccaagccttgcctcaggttcgcctctacggaccgaccaactttgctccaatcattaaccacgtcgcccggttcgcagctcaggccgcacaccaggggacagcgagccagtattttatgcttctcctgctaaccgatggagccgttactgatgtggaagccacaagagaagccgttgtacgggcctctaacctcccaatgtcagtcatcatcgtgggtgtgggaggagccgactttgaagccatggagcaactggatgccgacggcggcccactgcataccaggtcaggccaggcggcagccagagacattgtacaattcgtgccataccggagattccagaatgctccacgcgaagccctggctcaaaccgttctggccgaggtaccgactcaactggtgtcttacttcagggctcagggctgggccccactcaagccgctgccaccatcagcgaaggatccggcccaggctcctcaggcatag

SEQ ID NO: 46479 - DNA, 1614 bp, Artificial Sequence
  Description of Artificial Sequence: Synthetic coding sequence
atggcccactgcgtgaccctggtgcagctgagcatcagctgcgaccatctcattgacaaagatatcggatcgaaatccgatcctctttgtgtactgctccaagatgtaggtggaggatcttgggcagagctggggcgtacggaacgcgtccggaactgtagttctcccgaattctccaagacccttcagctggaatacaggttcgagactgtgcagaagctccggttcgggatttacgacattgacaataagacccccgagctgcgtgacgacgactttctgggcggggcagagtgctcactgggccagatcgttagctcacaagtgctcactctgccattgatgctcaagcctggcaagcctgcaggacgcggaacaattaccgtttcagctcaggaactgaaagataaccgagtagtgactatggaagtcgaggcccgcaatctcgacaaaaaagacttcctggggaaatccgaccctttcttagagtttttccgacagggtgacggcaagtggcacctcgtgtaccgatccgaggtaatcaagaacaatttgaatcccacctggaaacggttctcagtgccagtccagcacttctgtggcgggaatccctcaacacctatccaggtgcagtgttcagattacgatagtgacggctctcatgacttgattgggacatttcataccagtttggcccagcttcaggcagtgccagcagagttcgaatgtatccaccccgagaaacaacagaagaaaaagagctataaaaatagcggcacaatcagggtgaagatctgcagggtggagaccgagtactctttcctggactacgtaatgggtggctgccagatcaattttaccgtgggcgtggatttcaccggatctaatggcgacccctcaagccccgatagcctgcactacttaagccccactggagttaacgagtatctgatggcactctggtctgtgggcagcgtcgtccaggattacgacagtgacaaattgtttccagcgttcgggtttggcgcccaagtgcctccagattggcaggtttctcacgagtttgccctcaacttcaaccctagtaacccttattgtgcagggatccaggggatcgttgatgcctacagacaagcccttcctcaggtgaggctctacggcccaaccaatttcgcccccatcatcaatcacgtggcccgatttgctgctcaggccgctcaccaaggaactgccagccagtacttcatgctgctcctgcttacggacggcgccgtcaccgatgttgaggccacccgggaagctgtggtacgtgcaagcaatttgcccatgagcgtcatcatagtcggcgtgggaggagcggacttcgaggctatggagcaattagatgctgatgggggaccactccatactcgcagcgggcaagccgcagctcgggatatagttcagttcgtgccatacaggcggttccagaacgcgccaagagaagcacttgcgcagacagtgttggccgaagtgccaactcagctggtgtcctacttcagagctcaaggatgggctcccctcaaacccctgccccccagtgctaaagacccagcgcaggcaccgcaggcctag

SEQ ID NO: 46480 - DNA, 915 bp, Artificial Sequence
  Description of Artificial Sequence: Synthetic coding sequence
atggcccactgcgtgaccctggtgcagctgagcatcagctgcgaccacctgatcgacaaggatattgggagcaaatccgatcctctgtgtgttctcttacaggacgtcggtggaggctcgtgggccgaactgggacggaccgagagagtccgcaactgctcttcccctgagttttccaagaccctccaattggaatatagattcgaaaccgtgcagaagttgagatttggaatctatgacatcgataacaagacccctgagttgagagatgacgacttcctcggcggcgccgagtgctcactgggtcagattgtctcttcccaggtactgacactgccactgatgctgaagcccggtaagcctgctggccggggcaccattaccgtgagcgcccaggaactcaaagataatcgagtcgtgacgatggaagtggaagctagaaatctggacaaaaaggattttctgggaaagtccgatccttttctcgagtttttccgccagggggacggcaagtggcacctggtttatcgcagcgaggttattaaaaacaatctcaatcctacatggaagcggtttagtgtgccggtgcagcacttttgtggaggcaaccccagcactccaatacaagtacagtgctcagactacgacagcgatggtagtcatgatcttattggcacctttcatacatccttggcccagctacaggcagtgcctgctgagtttgaatgcatacatcccgagaagcaacaaaagaaaaagagttataagaattctggcaccattcgagtaaagatctgccgcgtggagaccgagtatagtttcctggactatgtcatggggggttgtcagatcaacttcaccgtgggtgtcgacttcaccggctcaaacggagatccctctagtcccgacagctag

SEQ ID NO: 46481 - DNA, 411 bp, Artificial Sequence
  Description of Artificial Sequence: Synthetic coding sequence
atggcccactgcgtgaccctggtgcagctgagcatcagctgcgaccacctgatcgataaagatattggctccaaatccgatccactgtgtgtattactgcaagatgttggtggagggagctgggccgagttaggacgaaccgaaagagttcgaaactgttccagccccgaattttcaaagacccttcagttagagtaccgcttcgaaacagtgcaaaagctacgtttcgggatttacgacattgacaataaaacccctgagctgcgtgacgacgatttcctcggcggggctgaatgtagccttggccagattgttagttcccaagtactgacactgcccctgatgcttaagccagggaaacctgctggaagaggcactatcacagtgtctgctcaggagctgaaggattag

SEQ ID NO: 46482 - DNA, 630 bp, Artificial Sequence
  Description of Artificial Sequence: Synthetic coding sequence
atggcccactgcgtgaccctggtgcagctgagcatcagctgcgaccacctgattgacaaggacataggatccaaatctgatcccctatgtgttcttctgcaggacgtcggtggtggctcttgggctgagctgggccgcacagaacgggtccgcaactgttcaagcccggaattttccaagaccctccagctcgaataccgatttgagaccgtgcagaaactcagatttggaatctacgatatcgacaacaaaacacccgagctcagggacgacgacttcctggggggcgccgaatgctccctcggccagattgtgtcttctcaagtgctcaccctcccgctgatgctgaagcctggaaagcctgccggacggggtacgataacagtcagtgcacaggagttgaaggacaacagagtggtgacaatggaggtagaagctcggaacctggacaaaaaggatttcctcggaaagtcagacccattccttgagtttttcaggcagggcgacggtaaatggcatttagtctatcggagcgaagtaataaagaataatcttaaccctacatggaagcggttctctgtgcctgttcagcacttctgcggagggaacccttcgacgcccattcagtag

SEQ ID NO: 46483 - DNA, 609 bp, Artificial Sequence
  Description of Artificial Sequence: Synthetic coding sequence
atggcccactgcgtgaccctggtgcagctgagcatcagctgcgaccacctgattgacaaagatatagggtccaaaagtgacccactgtgcgtgctgctgcaggatgtcggcggtggctcgtgggcggagctgggccgtacagaaagggttagaaattgttcgtctcctgaattttccaagaccttacagctggagtacaggtttgagacagtgcaaaagttacgcttcgggatttacgatatcgataacaagacacctgagcttagagacgatgacttccttggtggcgccgaatgcagccttgggcagatcgtttcctcacaggtgctgacccttccgctaatgctaaagcctggaaagcctgccgggaggggcacaattaccgtgagcgcccaggagcttaaggataacagggttgtcaccatggaggtagaagccaggaatctggacaaaaaggactttctgggaaagtcggatcctttcctcgaatttttccgccagggagacggcaaatggcatctggtgtataggtctgaggtgatcaaaaacaacctgaaccctacttggaagaggttcagtgtgcctgtccaacacttctgtggcggctag

SEQ ID NO: 46484 - DNA, 204 bp, Artificial Sequence
  Description of Artificial Sequence: Synthetic coding sequence
atggcccactgcgtgaccctggtgcagctgagcatcagctgcgaccatttgattgacaaggacattggctctaaatctgatccactgtgtgtcctgctgcaggatgtgggtggcggatcttgggccgagttggggcggacagaacgggtgcgaaactgtagttcgcctgaatttagtaagaccctccaactcgagtaccgttag

SEQ ID NO: 46485 - DNA, 459 bp, Artificial Sequence
  Description of Artificial Sequence: Synthetic coding sequence
atggcccactgcgtgaccctggtgcagctgagcatcagctgcgaccacttgatcgacaaggatatcggctctaaatctgatcctctgtgcgtcctcctacaggatgttggtgggggcagctgggctgagctcggcagaactgagagggtgcggaattgctcttccccagagttcagtaagacattgcagctcgagtacaggttcgagaccgttcaaaagctcagattcgggatctacgatatcgacaataagactcccgaactccgcgacgatgatttcctgggtggagccgagtgttcgctcggccagatcgtttcttcacaggtccttaccctcccgcttatgctgaaacctggaaaaccggccggcagaggtaccataaccgtatctgcccaggaactgaaagataaccgtgtggtgacaatggaggtcgaagcacgcaacttggacaagaagtag

SEQ ID NO: 46486 - DNA, 696 bp, Artificial Sequence
  Description of Artificial Sequence: Synthetic coding sequence
atggcccactgcgtgaccctggtgcagctgagcatcagctgcgaccatctcattgataaggacatcggatccaagagcgaccctctctgcgttctgctacaagacgtgggtggtggatcttgggctgagcttggccgtactgaaagagtgagaaattgttcttcaccagaatttagcaaaactcttcagttggagtatcgtttcgaaacggttcagaagttgcgttttggaatctatgatatcgataataaaacaccagagcttagagacgatgattttctcggcggcgcagagtgcagcctgggccagattgtttcatctcaggtactgacattgccactcatgcttaagcctggaaagccagctggccgaggaacaattaccgtgagcgcccaggaactcaaggacaacagggtcgtgacaatggaggtggaagcaaggaacctggacaagaaggacttcctgggcaaaagtgatcccttcttggaatttttccgccagggagacggcaagtggcatctggtctataggtccgaggttataaaaaataacctgaatcctacttggaagcggtttagcgtgccagtccagcacttctgtggcggaaacccatccacccccatccaggtgcagtgctccgactacgatagcgacggtagccatgatctgatcggcacctttcacactagcctgtag

SEQ ID NO: 46487 - DNA, 525 bp, Artificial Sequence
  Description of Artificial Sequence: Synthetic coding sequence
atggcccactgcgtgaccctggtgcagctgagcatcagctgcgaccacttgatcgataaagatatcggaagcaagagcgatccactgtgcgtgctccttcaagacgtggggggcggttcctgggcagagctgggccggacggaacgggttcgcaactgttcatctcccgaattttctaaaacactacagctcgaataccgattcgaaactgtccagaaactacgttttgggatttacgatattgacaataagacccccgaattgagggacgatgatttcctcggaggggcagagtgttccctcggccagatcgtcagtagccaagtcctgacccttcccttaatgcttaaacccggcaaacctgcaggcagaggcaccattacagtgtctgcccaggagcttaaggacaaccgcgtggtgaccatggaagtcgaagcaaggaatttggataagaaggattttctgggaaaaagcgacccatttctggaattcttcagacagggggatggaaagtggcacttgtag

SEQ ID NO: 46488 - DNA, 1647 bp, Artificial Sequence
  Description of Artificial Sequence: Synthetic coding sequence
atggcccacatccccagcggcggcgcccccgccgccggcgccgccccaatgggacctcagtattgcgtatgcaaggtcgaattgtcagtgtctgggcagaatcttttggaccgagacgtgacctctaaaagtgatcccttctgtgtgctctttactgaaaacaacggccgatggatagagtacgataggactgagaccgcgatcaacaatctgaaccccgccttctcaaaaaagttcgtgctagattatcacttcgaagaggtccagaagctgaagtttgcacttttcgatcaggataagtcctctatgcggcttgacgaacacgactttctgggacagtttagctgctctctcggcacgatcgtctccagcaagaagataacccgccctctactcctgctcaatgacaagcccgccggcaagggccttatcaccatcgccgcacaggagctgagtgacaacagggtaattaccctgagccttgccggacggcgattagacaaaaaagacctgttcggcaagtctgaccctttcctggaattctacaagcctggcgatgacgggaagtggatgctggtgcataggacagaggttataaagtatactttagacccggtgtggaaacccttcaccgtgcccctggtctcgctatgtgacggggacatggagaaacccattcaagtgatgtgctacgactatgataatgatggtggccacgattttattggcgaatttcagacaagcgtatcacagatgtgtgaagcgagagattccgtaccactggagttcgaatgtatcaatcccaaaaagcaaagaaagaagaagaattataagaattccggcataatcatccttagaagctgcaaaatcaaccgcgattattcattcctggactatatcctgggtggctgccaactcatgtttacagttggaatagactttaccgccagcaatggaaatccgctcgacccttcatccctgcattacattaaccctatgggaactaatgagtaccttagcgccatttgggccgtggggcagattatccaggactatgacagcgacaaaatgttccccgctctcggtttcggagcgcaactgccaccggattggaaggtctctcacgaattcgcaattaactttaaccctacaaaccccttctgctctggagtggacggtatcgcacaagcttattccgcttgcctaccacacatacgcttctacggccctactaatttcagtccaatcgtaaatcacgttgctcgatttgctgcccaagccacgcagcaacgaaccgctacccagtatttcatcctgctcatcataaccgatggcgtcatatccgacatggaggagacccgacatgcggttgttcaggcatccaaactgccgatgtcgattattatcgttggagtaggcaatgctgatttcgccgccatggaattccttgatggggactctaggatgttaagatcccacaccggggaggaggctgcaagagatatcgtgcaatttgttccgttccgggagttcaggaatgcagcaaaggagacactcgccaaggcagtgctagctgagttacctcagcaggttgtccaatatttcaagcacaaaaacctgccacctacaaattccgagcccgcctag

SEQ ID NO: 46489 - DNA, 1647 bp, Artificial Sequence
  Description of Artificial Sequence: Synthetic coding sequence
atggcccacatccccagcggcggcgcccccgccgccggcgccgcccctatgggcccacagtattgcgtttgtaaggtggagctgagcgtttctgggcagaatttgctagacagggatgttacttccaaatcagatcccttctgtgttcttttcactgaaaataatggccgctggatagagtatgatcgcacagagaccgccattaataaccttaacccagcatttagcaagaagttcgtcttggactatcattttgaggaggttcagaagctgaagttcgctctgtttgatcaggacaagagctccatgaggctcgatgagcatgattttttgggccagttttcttgttcactcgggacaatcgtctccagtaagaagatcactaggcccctgctgttgcttaacgacaagccagcgggtaaagggttgatcacgatcgccgcacaagaactgtctgacaatagggtaattactctgagtttagccgggcgccgcctcgataagaaggatctatttgggaagagcgatcccttcctggagttttacaagcctggtgatgatggcaaatggatgctcgtgcaccgtacagaggtcattaagtatactttggatccggtctggaaaccttttaccgtgccattggtgagcttatgtgacggagacatggaaaaaccaattcaggtaatgtgttatgattacgataacgatggcgggcacgatttcattggagaatttcaaactagcgtgtcccaaatgtgcgaagcaagagattctgtacccttggaattcgagtgcattaaccctaagaaacagagaaaaaagaagaactataaaaatagcggcatcatcattctgcgatcctgcaagattaacagggactactctttcctcgactacatactgggcgggtgtcagctaatgtttaccgtaggcattgatttcaccgcctcaaatgggaatcccctggacccaagctcactccattacattaaccccatgggtaccaacgagtatctgagtgccatttgggcagtcgggcagattatccaggactacgatagcgacaagatgtttcctgccctcgggttcggcgctcagctcccacctgactggaaggtctctcatgaatttgccatcaattttaacccgactaaccccttttgctcgggcgtggacggaattgctcaggcatattccgcctgtctccctcacattcgcttttatggtccaacaaatttttcccccatcgtcaaccatgtggcccgcttcgccgctcaggctacccagcagcggactgccacgcaatatttcatactcctgatcattaccgatggagtgatctctgacatggaagaaactcgacacgccgtggttcaagcctcaaagttgcctatgtcaatcattatcgtgggagttggaaacgcagactttgctgccatggaattcctagacggggacagccgaatgctacgctctcacaccggagaggaagccgcgcgagacatcgttcagtttgttcctttccgtgagtttcggaatgcagccaaagagacactcgcgaaagccgtgctggcggaattgcctcagcaagtggtgcagtacttcaaacacaagaatttaccccctaccaacagcgagccagcatag

SEQ ID NO: 46490 - DNA, 1341 bp, Artificial Sequence
  Description of Artificial Sequence: Synthetic coding sequence
atgcggctggacgagcacgacttcctgggccagttcagctgcagccttggcacaattgtatcttctaaaaaaataacgagacccttgttactcctcaacgataagcccgccgggaaaggattaatcaccattgcagcccaggaactgtctgacaacagggtcatcaccctgagcctagctggccggcgacttgacaagaaagatctgtttgggaagtcagaccccttccttgagttctataagccgggggatgatggaaaatggatgttagtacatagaaccgaagttatcaaatacactttagacccggtttggaagcccttcacagtgcctcttgtctctctgtgcgatggggatatggagaagcccattcaggtgatgtgttacgactacgacaatgacgggggtcatgacttcatcggggaatttcaaacctccgtgagccagatgtgcgaggctcgggactctgtccctttagagtttgagtgcatcaacccaaaaaaacagaggaagaaaaagaattacaagaactcaggaattatcattctacggtcttgtaagatcaaccgcgattatagcttcttggattacatcttaggcggctgccagctgatgtttacagtgggaattgactttactgcctcaaatgggaaccctctggacccctctagcttgcactatattaatccaatgggcacaaatgagtatttgagcgctatatgggctgtgggccaaatcatacaagactatgactccgacaaaatgtttcctgctctggggtttggcgctcaactcccgccagattggaaagtgtctcacgaatttgccatcaatttcaaccctaccaaccccttttgctccggagtcgatggcatcgcccaagcttatagtgcatgtttgccgcacattaggttttatggccccaccaacttttcaccgatcgttaatcatgtagccaggtttgctgcacaggccactcagcagcggaccgccactcagtacttcatccttcttatcatcaccgacggcgttattagcgacatggaggagacgcgccacgcagtcgttcaggcaagtaagctacccatgagcatcatcatcgtgggagtgggaaatgcggactttgcagcaatggagtttctcgatggggacagtagaatgctgcggtctcataccggtgaggaggcagctagagacattgtacagttcgtaccttttagagagtttaggaacgccgctaaggaaacattggctaaggccgtactcgcagaactccctcagcaggttgtgcagtactttaagcataagaatctaccccctaccaacagtgagccagcgtag

SEQ ID NO: 46491 - DNA, 1674 bp, Artificial Sequence
  Description of Artificial Sequence: Synthetic coding sequence
atgaagaagatgagcaacatctacgagagcgccgccaacaccctggggatctttaattcaccctgtctgaccaaagtcgagctaagggtggcctgcaagggaatatccgatcgggacgctcttagtaaacctgacccatgcgtgattctgaaaatgcaaagtcacgggcagtggttcgaagtggatagaaccgaagtaatccgtacctgcataaacccggtgtactcgaagttatttacagtagatttttacttcgaagaagtgcagcgattacggtttgaggttcatgacatctcaagtaaccacaatgggctgaaagaggctgacttcctcgggggcatggagtgcactcttggccagatcgtatcccagcgtaagcttagcaagagcctgcttaaacacggaaacaccgcagggaaaagctctatcaccgtcattgccgaggaactctctgggaacgacgactatgtggagctggcgttcaatgcccgcaagctggatgataaagatttcttttctaaaagcgatcccttcctggaaatctttagaatgaacgatgacgcaacacaacagctcgtacacagaaccgaagtggttatgaataacttaagcccagcctggaaatcattcaaggtgtccgtgaacagcctatgttccggagacccagacaggcgtctgaagtgcatcgtgtgggactgggacagcaatggtaagcacgactttattggcgaatttacttccacattcaaggaaatgcgcggagcgatggaaggtaaacaagttcaatgggagtgtattaaccccaagtataaagctaaaaagaaaaattacaaaaattctggcacagttatcctgaacctttgcaagattcacaagatgcacagcttcctcgactatatcatggggggatgccagattcagtttacagtggcaatcgatttcactgcttcaaacggcgatcccaggaattcctgcagccttcactacatccacccctatcagccaaatgagtacctgaaagcactcgtcgccgtgggagaaatctgtcaggattatgatagtgacaaaatgtttccagcgtttggctttggagcaaggattccgcccgaatacactgtaagccacgatttcgccatcaatttcaacgaggacaatccggagtgtgccggcatccagggggttgtagaggcataccagagctgccttcctaaactccagctgtatggacccacaaacattgctcccataatccaaaaagtggcaaaatccgcttcagaagagacaaatactaaagaggcctctcagtatttcatcctcctgattctgacagacggcgtcatcaccgatatggctgatacccgcgaagccatcgtgcacgcctcccatctgcccatgtccgtcattatcgtcggagtgggaaatgcagactttagcgacatgcagatgctggacggggacgacgggattttaagaagcccaaagggtgagcccgttttgagagatattgtgcagttcgtcccatttcgcaattttaagcacgccagcccagcagccttggcaaaaagtgtcctggccgaagtgccgaaccaagtggtggactactacaatggtaaaggaatcaaacccaagtgttccagcgagatgtatgaaagttcacgcacactcgctccctag

SEQ ID NO: 46492 - DNA, 1728 bp, Artificial Sequence
  Description of Artificial Sequence: Synthetic coding sequence
atggccgtggagcccagcagcagcgagagcatcaagcggcgggccggcaggcggatgaagaagatgagcaacatttatgagagtgccgccaacactctgggaatattcaatagtccctgtctgactaaggtggagctgagggtggcatgcaagggaattagcgaccgcgacgcgctaagcaagccagatccttgcgtgatcctgaaaatgcagtcccacgggcagtggtttgaggtggacagaacagaggtgattcgtacctgtataaaccccgtgtactcaaaactttttactgtggatttttactttgaagaggtacagaggctgcgctttgaggtgcacgatatctccagcaatcacaatggtttgaaggaggccgatttccttggaggaatggagtgtaccctcggccagattgtgagccagaggaaacttagcaagtccctcttaaagcatggcaacacggcaggcaagtcctctattactgtgattgcagaagagctgtccggcaatgatgattacgttgaactggctttcaatgcacgaaagctcgacgacaaggatttcttttccaagagtgatccatttttggaaatatttagaatgaatgatgacgctacccagcagttagtccatcggaccgaggtggtgatgaacaatctttctccagcttggaaaagctttaaggtgtcagttaactcgctgtgtagcggcgatcccgatcgaagattaaagtgtatagtttgggactgggacagtaatggtaagcatgacttcattggcgaatttactagtacattcaaggaaatgcgtggagccatggaaggcaagcaagtccaatgggagtgcatcaatcccaaatacaaggcaaagaagaagaactacaagaactcaggaacagtaatactgaacttatgtaagattcataaaatgcattcgttcctagactacattatggggggatgtcaaattcagttcactgtggccatagactttacagcatccaacggggacccacggaatagctgctcgctccattatatccatccctaccagccgaatgaatatctgaaggcactggtagcggtgggcgaaatatgccaggattatgacagtgataagatgtttcctgcctttgggttcggagccagaatcccgccagagtacacagtgtctcacgacttcgcaattaactttaatgaagacaatcccgaatgcgccggaatacagggagttgtggaggcatatcagtcatgcctgccaaagctccagttgtacggaccaaccaacatcgcccctattattcagaaggtggctaagagtgcctccgaagaaaccaatacaaaggaggcgtctcaatattttatactcctgatcctgactgacggagtgattacagacatggccgacactagggaagcaatcgtacatgcctcgcatttgcctatgtccgttattatagtgggagtagggaacgcggatttctcagatatgcagatgctggacggcgacgatggcattttgcggtcccctaaaggcgagccagtgcttcgggacattgtgcagtttgttccctttaggaacttcaagcacgctagtcccgcggccttggccaaatccgtgctcgctgaggtccccaatcaggtcgtggattactacaatggcaaagggatcaagcctaagtgctcctcagagatgtatgaatcgagccgcaccctagccccatag

SEQ ID NO: 46493 - DNA, 510 bp, Artificial Sequence
  Description of Artificial Sequence: Synthetic coding sequence
atgaagaagatgagcaacatctacgagagcgccgccaacaccctggggatttttaacagcccgtgcctgactaaggttgaactccgcgtcgcatgcaagggaatctctgacagggatgccctaagcaagccggatccctgtgtcatcctcaagatgcagtctcatgggcagtggtttgaagtggaccgaaccgaggtgattcgaacatgtatcaatcctgtctactccaaactttttactgtagatttttatttcgaggaggtgcaacgtctgcgattcgaggtccacgacattagcagtaaccataacggtctaaaggaggcggattttctggggggcatggaatgcacactagggcaaattgtgtctcagcgcaaactgtccaagtcacttctaaaacacggtaacaccgcaggaaaatccagtatcacagttatcgctgaggagctgtctggtaacgacgattatgtggagctggccttcaatgcacgcaagctggacgataaatag

SEQ ID NO: 46494 - DNA, 1674 bp, Artificial Sequence
  Description of Artificial Sequence: Synthetic coding sequence
atgaagaagatgagcaacatctacgagagcgccgccaacaccctggggatcttcaatagcccgtgcctcactaaggttgagttgcgcgtcgcctgtaagggtatttcagatcgagatgcactctctaagccagatccatgcgtcattctcaagatgcaatctcatgggcagtggttcgaagtcgaccgaaccgaggtgatcaggacgtgtataaaccccgtgtatagtaaattgttcactgtggacttttatttcgaagaggtgcagcgactacggttcgaggttcatgacatcagttctaaccataatggcctcaaggaggcagattttctgggcggtatggagtgcaccctgggccagatcgtgagccagcggaaactcagcaagtccctcttgaaacatgggaataccgccggcaaaagttcgattacagtcatcgccgaagagcttagcggtaatgacgattatgtcgagctggcatttaacgcaagaaagctcgatgacaaagacttcttctccaagtccgaccccttcttggagatatttcgaatgaacgatgatgctactcagcagttagtgcaccgcaccgaagtggttatgaataacttaagtcctgcgtggaaaagtttcaaggtgtccgttaatagcctgtgcagtggcgaccctgataggcggctcaagtgtatagtttgggactgggattcgaacggcaaacacgacttcatcggtgaatttacctctaccttcaaagagatgaggggggctatggagggaaagcaagtccagtgggagtgcatcaaccccaaatacaaggctaagaagaagaattacaaaaattcgggtacagtgattctgaacctgtgtaaaattcataaaatgcactctttcctggactatattatgggcggctgtcagatccaatttacagtggcaatcgactttaccgcctccaacggcgaccctcggaacagctgctccctccactatattcacccctaccagccgaatgagtacttaaaggcattggttgcggtgggtgagatttgtcaagactatgattctgataagatgtttcctgcttttggattcggcgcaagaattcctcccgaatataccgtctcccacgactttgccattaattttaatgaggataaccccgagtgtgcgggaattcagggggtggttgaagcctaccagtcctgtctgcccaaactacagttgtacgggcctactaatattgcacccattattcaaaaggtggcgaagtcagcatctgaagaaacaaataccaaagaggccagccaatatttcatcctgctcatcctgacggacggggttattacagacatggcggatacgagagaggcgatagtacacgcctcacacttgccaatgtccgttatcattgtcggagtgggcaatgccgacttcagcgacatgcagatgctggatggtgatgacggaatactccgctcccccaagggagagcctgttttgcgggacattgtgcagtttgtaccttttaggaattttaaacatgccagcccagccgcactcgctaaatctgtattagccgaagtccccaatcaagttgtggattattacaacgggaaggggatcaaaccgaagtgttcctcagagatgtacgagagctcacgaaccctcgcaccgtag

SEQ ID NO: 46495 - DNA, 1728 bp, Artificial Sequence
  Description of Artificial Sequence: Synthetic coding sequence
atggccgtggagcccagcagcagcgagagcatcaagcggcgggccggccgacgcatgaaaaagatgtcgaacatctatgaaagcgccgccaatactctgggaatctttaacagcccgtgtttgacaaaagtggagctgagagtagcttgcaagggcatttccgatagggatgcactctctaagcccgatccatgtgtgatactgaaaatgcagagccacggccagtggttcgaggtggaccgaacagaggtgattagaacatgcattaatcccgtttattctaagctgtttactgttgatttttatttcgaggaagtacagcggttacggttcgaggtccatgacatctcatcaaaccacaatgggcttaaggaggccgacttcctcggcggcatggaatgtaccttgggtcagattgtcagtcaacggaaactgagcaagagcctactcaagcacggcaatactgccggtaagtcaagtatcaccgtaatcgctgaagagctgtcaggtaacgacgactacgtggagcttgccttcaatgcacgtaagctggacgataaagacttctttagcaagagtgatccctttctggagatatttcgtatgaacgatgatgcgactcagcaactggttcaccgcacagaggttgtgatgaacaatctttcgccagcctggaaaagcttcaaggtaagtgtcaactcattgtgtagcggggacccagatagacggttgaaatgtatcgtgtgggactgggactcaaatgggaagcatgacttcatcggggagttcacctcaacattcaaggaaatgaggggggccatggaagggaaacaggtacagtgggagtgcattaatccgaaatataaagccaaaaaaaagaattacaagaattcagggaccgtgatcctcaatttgtgtaagatccacaaaatgcattccttcctggactatattatggggggctgtcaaattcagtttacagtggccattgattttacggcctccaacggggatccgcgtaactcttgctccttgcattatatacacccgtatcaaccaaatgagtacctgaaggctctcgttgctgtcggagaaatttgtcaggactacgactcagacaagatgtttccagccttcggcttcggcgctaggattcctcccgaatacactgtctctcacgactttgctatcaacttcaacgaagacaaccctgagtgcgctggaatacagggcgtggtcgaggcctatcagagctgcttgcctaagctgcaactgtacggccccaccaacattgcccctataattcaaaaggtggccaagagtgccagcgaagagaccaataccaaagaagcatcacaatattttatcctactcatccttactgacggggtgattaccgacatggctgacaccagagaggcaatcgtgcacgcttctcatctccctatgtctgttattatcgtaggcgtaggaaacgcggatttttccgatatgcaaatgctggacggggacgacggaatcttaagatctccgaagggggagccagtgctgagggacatagttcaattcgttccttttcgcaatttcaaacatgcatccccagccgccctggccaagtccgtgttggctgaggtccctaatcaggtggtagactactataacgggaagggcatcaagcccaaatgtagcagtgagatgtacgagagttcacgtactctggccccctag

SEQ ID NO: 46496 - DNA, 1695 bp, Artificial Sequence
  Description of Artificial Sequence: Synthetic coding sequence
atggacagccggtacaacagcaccgccggcatcggcgacctgaaccagctctccgcagccattcccgcaactcgcgtggaagtgtcagtctcctgccggaatttgctggaccgtgacacattctcaaagtccgaccctatttgcgtcctatacgtacagggggtgggtaataaagagtggcgcgagttcggacggactgaggtgattgacaatacccttaatcctgatttcgttagaaagttcatactcgactatttcttcgaagaacgcgagaatcttcgttttgatctttacgacgtcgattcgaaaagtcctaatttgtcaaagcatgactttttagggcaggtcttttgtaccttaggagaaatcgtagggtcacaagggtcaagactcgaaaagccaattgtgggtatacccggaaagaagtgtggcactatcatcttgacagccgaggagctgaattgttgcagggacgccgttttgatgcagttttgcgcgaataagctagataagaaggacttctttgggaagagtgatcccttcctcgtcttctaccggtcaaatgaagacgggagttttaccatctgccacaagaccgaggtggtgaaaaatactctgaacccggtgtggcaagctttcaaaatcagcgtgcgcgcattatgtaacggagattatgacagaaccatcaaggtggaggtctatgactgggatagagacggctctcacgactttattggtgaattcacaacaagttacagggaattatctcgtggccagtcccaattcaacgtgtatgaagtggtgaacccaaagaaaaaaggcaaaaaaaagaaatatacaaattctgggaccgtgacgctgttgtctttccttgtggaaacagaggtttcatttctggattacataaaaggtggaactcagataaattttactgtcgctattgatttcactgcaagcaacggaaacccagcgcaacctactagccttcactacatgaacccataccaactgaacgcgtacggaatggcactgaaagccgtcggggagattgtgcaggattatgatagcgacaaaatgtttccggcattgggtttcggcgccaagctgccaccagatgggcgaatcagccacgagttcgcactcaacgggaatccacagaacccttactgcgacggaattgagggcgttatggaggcgtattacagatccctcaaatcggttcagctttatggccctacgaactttgcgcccgtgattaaccacgtcgcgagatatgcatctagcgttaaggatggctctcaatactttgtgctccttattgtcacagacggggtgatcagcgatatggcccagacaaaggaatctatcgtgaatgccagcaagctgccgatgtcaatcattattgttggagttgggcccgccgagttcgacgcaatggtggagctggatggcgatgatgttagggtctcgagtcgggggaagtacgccgagcgtgatattgtgcagtttgtcccctttagggattatatcgacaggtctggtaatcacatcttgagtatggctcggttggcgaaggatgttttggccgagattccagagcaatttctgagctacatgcgggccaggggtattaagccttccccggcacccccgccctatactcccccaacccatgtcctgcagactcagatctag

SEQ ID NO: 46497 - DNA, 3786 bp, Artificial Sequence
  Description of Artificial Sequence: Synthetic coding sequence
atggacgccccccgggccagcgccgccaagccccccaccggccggaaaatgaaggcacgggcacccccaccccctggcaaggctgcaactctgcatgttcacagcgaccagaagcctccacatgacggcgctttgggaagccaacaaaatctcgtgcggatgaaagaagctttacgtgcttcaaccatggatgtaacagtggtcctgccatcagggttggagaagagaagtgtgcttaacggcagtcacgccatgatggaccttctagtggagctctgtctgcagaatcatttgaatccttcacatcacgctctggaaatcagatcttcagaaacccagcagcctttgtctttcaaaccaaatactctgattggaacactaaatgttcacacagtgttccttaaagaaaaagtgcctgaggagaaagtgaaacctggcccacctaaggtgcccgaaaaatcagtgaggctcgtcgtgaattacctgcgcacacagaaggccgtggtccgagtaagtcccgaggtcccactgcagaatattttgccggtgatttgcgccaaatgtgaagtttctcccgagcatgtggttctgctgcgcgacaacatagcaggtgaggaactggaattgtccaagtcacttaacgagctgggcattaaggaactgtacgcgtgggacaatagacgtgaaactttccgaaaatcctccctcggaaacgacgaaaccgataaggagaagaagaagtttctggggttttttaaagtgaacaaacggtctaactctaagggctgcctgaccacccccaattcgccttctatgcactcccgttccttgactctggggcccagcctttccctggggtctattagcggggttagcgtcaagtcggagatgaagaaacgacgggccccccccccccccgggtccggcccaccggtccaggacaaggcgagtgagaaagtatctcttggctcgcaaatcgatctgcaaaaaaaaaagagaagggctcccgcccccccccctcctcagccgccacccccgtctcccctgatccccaaccggacagaggataaggaagaaaacagaaagagcacaatggtctccctcccactgggtagtggtagccattgctctcccgatggcgcacctcaggtattaagtgaagccgaagaaactgtgtctgtgggcagctgtttcgcctctgaggatactaccgaggacagcggggtaatgagctcaccgtcagatattgtgagcctagactcacagcaggactctatgaaatataaggataaatgggccactgatcaagaggactgtagcgatcaggacctcgctggtacccccgacttgggccctcaaaaatcccccctgtgggagaagaatggctctgagaattcccacctgagaactgaaaaagccgttaccgcctctaacgacgaagaagatttgttgattgccggagagttccgcaaaacccttgctgagctggatgaagatctggaggaaatggaggattcttacgaaaccgacacctcaagcctgacatctagtatccacggagcatcgaaccactgcccccaggatgccatgatcccccacggggatactgatgccattcccgttaccttcatcggggaggtctccgatgacccagttgacagtgggctgttctccaatcggaacaataatgcaggctcttttgattccgagggcgtggctagccgcagagattctctcgccccactacaggccgaacacagccaaccccacgagaaggcccgggaggaggtgcccgcgctgcaccctgcaagccacgatgtaggcaagggaatacgtgtggctctcagtaacattagcaaagacgggaacttgatggagaccgcgccaagggtgacttcctttgccagcaacctccatactgataacctcaatgccaaagtaaaggataaagtgtatggctgtgccgatggagagcggacacaagccaccgagagagttaattcccagccagttaatgagaaggactctaacgataaaaatgcagccctcgcccctacctcttggcatcaacgtggccagaatccaggcaaatcgtaccgcctaaaacacggtctgacaacatacaaaataattcctccaaagtccgaaatgcgatgctatgacagggacgttagcctttccactggagcaattaaaatcgacgagctgggaaatcttgtctcccctcacgctactggtatccggatcatctcactttcttcttccgtgccagaagccgagtcacaacccataggcaaggtgcgtgagttttggagatgcaacagcgtagagaagcacctcggacgtccatctgagagtagcgctaggggacccccctcgacccctgttcccacccagacacaaaaccctgaaagccgtctacaggctgatcctaaacccataagcccacagcaaaaaagcgcacaccacgagggacggaaccctctgggcgaaggccggaaccagcctcctaccatggggatgggacacgtgcgagtaccagccgcccatacaactgaggtgacattcttgaaacctcagcgccggacaagctcccagtacgtggcctcagctatcgcaaaaagaataggagcacctaaggtccacgccgacgtggtacgacctcacggctatgctgaaaaaggctatgcagggaaagcgccagtactagctgcaccacctgtgaccgttaaggatgaccggacctcttcaccgcatagcgagacacagggatggaaggatggagctcagtggccatgcgtgaccccccccaataaccacggtgaggacttggccgttggggcgcctccaagaggagaagtgattggcccgcacagaaaactgagcacccaggatagaccagctgccatccaccgcagttcatgcttttccctggtgcaatcctcccaaagagaccgtgttagcgtaggtcagtcctgtggattctcaggcaagcagagcacctcgtcacaggaggcaagcagcgcctctgagccgaggcgagcacccgacggtactgaccctcctcccccccacactagcgacacccaggcctgctctcgggaattagtcaatggcagtgttagggctcccggccacggagagccaagtcaccctcctgggggctctggcactgaaagtcacatcctgctcgagcgggaagaaaaaccctcagtattcagcactgacggaaacgagaccgacagtatctggccaccttccatcttcgggccaaaaaaaaaattcaaacccgtggtccagcggccggtgcctaaagacacaagcctgcatagcgctctcatggaagcgatacactccgccggaggaaaggatagattaagaaaaactgcggagcacacgggggaaggccgccccgccaagcttagctacacagaggctgagggcgaacggtctgcccttttagcagctattcgtggccacagtggtacctgctcacttaggaaggtagctagttcggcctcagaggagctgcagagctttagggatgcagccctgagtgcccagggttcggagtctcccctgttggaggatctcggcctgctgtcaccgcctgcgattcccccgccaccaccgccaccctcgcaagcgctgtctgctccccgcacggcctctagattttccaccggaaccctctcgaacaccgctgacgcccgccaggcattgatggacgcaatacgatccggtacaggcgccgctagactcaggaaggttcctttactcgtgtag

SEQ ID NO: 46498 - DNA, 1410 bp, Artificial Sequence
  Description of Artificial Sequence: Synthetic coding sequence
atggacgccccccgggccagcgccgccaagccccccaccggccggaagatgaaagcacgcgcgccgccaccacccggaaaggccgccaccctgcacgttcactcagatcagaagccgccacatgacggcgcattgggcagtcaacagaatctggtaagaatgaaggaagcgctgcgggcctcgacaatggacgtgacagtagtgctgccttctgggctggagaaacgctctgtcttaaatgggtcccacgccatgatggacctgctcgttgagctctgcctgcaaaatcacctcaacccatcacatcacgccctggaaattagatcctcagaaacgcagcaaccattgtcctttaagcctaatacactaatcggaacactgaatgtgcatacagtgttcttaaaagagaaagtgccagaggaaaaagtgaaacccggccctcccaaggtgcccgagaagagcgtgagacttgtcgttaattacctaaggactcagaaggctgtggtgcgggtgtcgcctgaggtgcccttacagaacatcctgcctgtaatctgtgcaaagtgtgaggtgtcccctgaacacgtggtgctgctgcgagataatatcgccggggaagagctcgaattaagcaagagcctgaacgagctgggaattaaggagctttacgcttgggacaacagacgggaaacctttaggaagtcgtcattaggaaacgacgaaacggataaggaaaaaaaaaagtttctaggctttttcaaggtaaacaagaggtctaatagcaaagggtgtctgacaacacctaacagtccatctatgcattctagatctctgacgttgggcccctctttatctctcggatctatttctggggtgagcgtaaagagcgaaatgaaaaagcgccgggccccgcctccacccgggtctgggcctcctgtacaggacaaagcatccgagaaggtgtccctgggatcccagatagacctgcagaaaaagaagcggcgtgctccagctccacctccgccccaaccaccgcctccaagtcccctcattcccaataggacagaggacaaagaggagaacaggaaatccactatggtttatggcgccgccgaggctgtgatcaggcttctgagcctcctgctcaataccacggctcctggcactgccaagccccggactctttggatgtctgagggccggagctccctccacaatccagagattaaatgttcgtgtttttccagcagctccccattcccacagtccctgctctcccttctcttgggtctgtcgtctatctgcgaatgcatgtgcaccctgcggcatacccacgcccacacccacaatccaagctgcgttctgccgaccagtgagatattagccttcggccgccagtcactgataagttag

SEQ ID NO: 46499 - DNA, 4032 bp, Artificial Sequence
  Description of Artificial Sequence: Synthetic coding sequence
atggacgccccccgggccagcgccgccaagccccccaccggccggaagatgaaggcacgggccccaccacctccaggcaaagctgcaaccctccacgtgcacagcgatcagaaacccccccatgatggcgcccttggttctcagcagaacctggtcagaatgaaagaagccctacgcgcctcaaccatggacgtgaccgtcgtcctgccatctggattagaaaagcgcagcgtgctgaacggatcacatgccatgatggatctcctggtagagctatgtctacaaaaccaccttaacccgtcgcaccacgccctggaaatcagatctagcgagacacagcaaccattgagcttcaaacctaatacgctcatagggactctgaatgtgcacaccgtgtttctgaaggaaaaagtccccgaggaaaaagtaaagcccggcccccctaaggtgccagagaaatcagttaggctggttgtcaattatttaagaactcagaaggccgtggtcagagtgtctcccgaggtgccattacaaaacattctcccagtgatctgtgccaaatgtgaggtcagcccggaacatgtggttctgctgcgcgataatatagctggcgaggaactagaactctcaaaatctcttaatgagctgggaatcaaagaactctatgcttgggataacaggagagagactttccggaagagctccctcggtaatgatgaaaccgataaggagaagaagaaatttctcggttttttcaaggtgaacaaaaggtccaattcaaaggctgaacagctggtgctgtccggagctgatagcgatgaggatacatctcgcgccgcgcccgggaggggtctgaatggctgcctgactacccctaacagcccttccatgcactcacggtccctcacactaggaccctccctctctctagggtctatatccggggtctcagttaagtcggagatgaagaaaagacgtgcccctccacctccaggaagtgggccacccgtgcaggacaaagcatccgagaaggttagcttgggatctcagattgatcttcagaaaaagaagaggagagctcccgcaccccctccccctcagccaccaccgccatccccacttattcccaaccgcaccgaagataaggaggaaaacaggaaatcgactatgggcggaggcaggcaggttccgcagaagcctccaagaggcacggctcgcggcccgccccagttggtgctgccccctccccccccatacccgccacctgacaccgacgtggtggagccactgtcctttcctggagagggggctggaagcgaggcatcagaccctatcccgaaattatcccttcctttgggttctggatctcattgttctcctgatggggcgccgcaagtcctatcagaagctgaggagacggtatcggtagggtcatgctttgcttcagaggatacgacagaggattcaggggtgatgtcaagcccttcagacattgtgtctcttgattctcagcaggacagcatgaagtataaagacaagtgggctacagatcaggaagactgttcggatcaggaccttgcggggacgccagaccttgggccacaaaagagcccactctgggagaagaacggctccgaaaactcgcacctgagaactgagaaagccgttaccgccagtaacgatgaggaggatttactaatcgctggtgagttcagaaaaacgctggccgaactggatgaggacttggaggaaatggaagactcctacgaaacggatacctcctccctgacaagcagtattcacggtgctagcaaccattgcccacaagatgctatgattcctcatggcgatacagatgccattcctgtgactttcatcggagaggtctccgacgaccccgtggattccggcctgttcagcaatcgtaataataacgccggttccttcgatagtgagggcgtcgctagccggcgtgactcactggccccgctacaggctgaacacagtcagccacacgaaaaagcccgcgaagaagtcccagcgcttcacccagcgtcgcatgatgtaggtaaaggaatccgagtcgccctttcgaacattagtaaagatggtaacctgatggaaacagcgccccgggtgacctcgttcgcttccaatctgcacacagataatctgaacgccaaggtgaaagacaaggtttatggctgcgcagacggcgagagaacgcaggcgacagaacgggtcaattctcagcccgtcaacgagaaagactccaatgataaaaacgcagcactcgctccaacttcctggcaccagaggggccaaaatccaggcaagagttatcgacttaagcacgggttaacaacctataagattatcccacccaaaagcgaaatgcgatgctatgaccgtgacgtgtccctcagcacaggagccattaaaatcgatgagttgggcaatttggtatctccccacgctaccggtatccgaataatctctctttcaagcagcgtccccgaggccgaatctcaacctattgggaaagtgcgtgaattttggcggtgtaactcagtagagaagcacctaggtcggcctagcgagagcagcgcccggggccccccctcaacgcctgttcctacgcagacgcagaatcctgaaagtaggctgcaggctgaccccaagcccatttcaccacaacaaaagagtgcgcaccacgaaggtaggaacccccttggggagggccgtaatcagccccctaccatgggtatggggcacgtgcgggtgccagcagcacatacaacagaggtgaccttcctgaagccgcagcgacggacgtcgagtcagtatgtagcatccgccatagccaaaaggatcggtgcaccaaaggttcatgctgatgtggtgcgtccccacggatacgctgagaagggctacgctggcaaggcacccgtactggccgctcccccggtgacagtgaaggacgacagaacttcatccccgcacagcgaaacacagggctggaaggatggcgcacagtggccctgcgttactccccctaataaccacggtgaggatctagccgtgggcgccccacctagaggagaggtgatagggccccaccgtaagctgtctacccaagaccgaccagccgccatccatcgcagctcctgcttctcactggtgcagagctcacagcgagacagggtctccgttgggcagtcctgtggcttcagcggaaagcagtctacttcctcccaggaagcctctagtgcatccgaaccccgaagagctcctgatggaaccgaccccccacccccccacacctccgacacacaagcgtgcagcagagaattggtgaatgggagcgtgcgcgctccaggccatggtgagccaagccatccacccggagggagcggcacggaatcccacattctgctggagcgggaggagaaaccctcagtcttttccacagacggaaacgaaacagatagtatttggccaccgtcaatatttgggcccaaaaagaagttcaaacctgtggtgcaacggcccgtccctaaagacacgtctctgcactctgccttgatggaggcgattcatagtgccggaggtaaagatcgcctcaggaagaccgccgaacatactggtgaaggtcgccccgcaaaactttcctataccgaggccgagggcgagagatcagcactgctggctgcaatccgagggcacagcggaacatgctcactcagaaaggtggcaagctctgcttccgaagagctacagtcattccgtgatgcagccctgagtgcccagggatccgagtcccctctcctggaagacctcggcctcttatcccccccagccatccctccaccaccaccgcccccctcacaggccctgtctgcacccaggacagcttcacggttcagtaccggcactctgagcaatacagccgacgcccgccaggctttgatggatgctatccgaagtggcaccggggccgccagattgcgcaaggtgcctcttttggtgtag

SEQ ID NO: 46500 - DNA, 3441 bp, Artificial Sequence
  Description of Artificial Sequence: Synthetic coding sequence
ctgcgggacaacatcgccggcgaggagctggagctgagcaagagcttaaatgaattggggatcaaggagttgtacgcctgggataaccggcgggaaacatttagaaagtctagcctagggaatgacgaaacggacaaagagaagaaaaagttcctcggcttcttcaaagtgaacaagcgaagtaactctaaagccgagcagctcgttctgtccggcgctgatagcgatgaggacacttcccgcgccgcgccgggccggggtttaaatggttgccttacaaccccgaatagtcccagtatgcactcaaggtccctgacccttggcccaagcttatcgcttggcagtatatcaggggtgagtgtgaagagcgaaatgaagaagagacgcgctccacctccaccggggtcaggcccacccgtacaggataaggccagtgaaaaggtcagtctgggatcccagatcgacttacagaaaaagaagcgcagagctcccgcgccacctccaccacaaccccccccccctagtcccctgatcccaaatcgcaccgaggataaggaggaaaaccggaagagcaccatggggggcggccgtcaagtgccacagaaaccgccacgaggtactgcccgaggacccccacagttagtcctgcccccccctcccccgtacccaccgccggatacagatgtagtggagccactgtcattcccgggggagggagctggatccgaggcctccgatcctatccccaagctaagcttgcccctaggcagtggctctcactgcagccccgacggagctccacaggtgctcagtgaagccgaggagacagtatcagtgggttcatgttttgccagtgaagatactacagaagacagcggagtgatgtccagcccatcagacatcgtgagcctcgacagccagcaggattccatgaagtataaagacaagtgggccacagaccaagaggactgtagtgaccaggatctagccggtaccccggacttgggccctcagaaatccccattgtgggaaaagaacggatctgagaactctcacctgcgaacggaaaaggcagttactgcctctaacgatgaggaagacctcctgatcgccggagaatttagaaagactctcgcggaactcgacgaggatctggaggagatggaggactcctatgagactgatacatcctcactgacctcctctattcacggggcatctaaccattgcccccaggatgccatgatcccacacggtgatactgatgccatccccgtgacctttatcggggaagtcagtgacgacccggtagactctggtctgtttagcaataggaacaataacgctgggtcattcgattctgaaggcgtggccagtagacgtgacagcctggccccactgcaggctgagcactcccagccacacgaaaaggcgagggaagaggttcctgctcttcaccctgcaagtcatgacgtgggtaagggtattcgggtggccttatctaacatctccaaagacggaaaccttatggagaccgctcctcgggtgacctcgtttgctagtaacctgcatactgacaacttgaatgctaaggttaaagacaaggtgtatggatgcgctgacggtgagcgcacccaagccactgagagagtgaactcacagccagttaacgaaaaagatagcaacgataagaacgctgctctggctcccaccagttggcaccagaggggacagaatccgggcaaatcataccggctcaaacatgggctgaccacttataagatcatacccccaaaatcagagatgagatgctacgaccgagacgtgagcctgtcaacaggtgctattaagatcgacgagttgggcaatctggtgtccccccatgccaccggaatacgcataattagcctgtcctcttccgtccccgaggccgaatcccagcccataggcaaggtcagggagttttggcggtgcaacagtgtggaaaagcacctcggcagaccttccgaatcgagcgcacgtggccctccgtctacaccagtccccactcagacacagaaccctgagtcgcggctgcaagctgaccccaaaccaatcagtcctcagcaaaagtccgcgcatcatgagggccgcaatcctctgggcgagggccggaatcagcctcccaccatggggatgggtcatgtgcgcgtgcccgcggcgcataccactgaagtgacctttctgaaacctcagcggcgcacaagtagtcagtacgttgcatccgccattgccaagcgaataggagcgcctaaggtgcatgccgatgtagtgagaccccacgggtatgccgagaagggctatgccggaaaggcccccgtgctcgcggcaccaccagtaacagtgaaagatgatcgcacgagctcaccccactccgagacgcagggttggaaggacggggcacagtggccatgtgttaccccgcctaataaccatggagaagacctggcggtaggagctcctcccaggggtgaagttataggacctcatcgtaaactgagcacacaggatcgtccggctgcaatccaccgaagcagctgtttctcattagtgcaatcaagtcagcgggatcgggtcagcgtgggccagtcatgtggcttcagtgggaagcagtctacatcatcccaagaggcgtcatcagcttccgagcccaggagagcaccagacgggacagatccaccccccccgcatacctccgatacccaggcatgttcccgcgaactggtgaatggttcagtgagagctcccggccacggcgaaccaagtcacccacccggcgggtccggaacagaatctcacatcttgctagagcgggaagaaaaacccagcgtgttttccactgatgggaacgagacagactcgatttggcccccatcaatcttcgggccaaagaagaagtttaagcccgtggtgcaacgcccagtgcctaaagatacttcactccattccgcgctgatggaggctatccattcggcaggcggtaaggaccgcctccggaaaaccgccgaacataccggtgaaggccgtccagctaaactgtcctataccgaagccgagggggaacgcagcgccttgctggccgcaatcaggggacattccggaacatgttccttgaggaaggtcgcttcaagcgcatctgaggaactccagtcttttcgcgatgccgccttaagtgctcagggtagtgaatcccccctgctggaagacttagggttgttatcccccccagctattccgcctccccctccccctccatcacaggctctctcggcacctcggacagcctccaggttctctactggaaccctgtctaacaccgccgacgccagacaggcccttatggatgccattcgctccgggacaggggcagctcgcttgaggaaggtcccccttctcgtctag

SEQ ID NO: 46501 - DNA, 1140 bp, Artificial Sequence
  Description of Artificial Sequence: Synthetic coding sequence
atggacgccccccgggccagcgccgccaagccccccaccggccggaagatgaaggcgagagcccctcctccccccgggaaggccgccaccttgcacgtccattctgaccaaaagcctccacacgatggcgccctgggaagccagcagaatctcgtgcgcatgaaggaggctctgcgcgcatcaacgatggacgtgacagtggtcctgccttcagggttggagaaacggtcagtcttaaacgggtctcacgctatgatggatctccttgttgaactttgtctgcagaaccacctgaatccttctcatcacgccttggaaattcgctcaagtgagacacagcagcctctgagctttaaacccaatacgttgattgggactctgaatgtgcacaccgtcttcctcaaagagaaggtgccagaggagaaagtaaagcccggcccacctaaggtccccgaaaagagcgtccgcctggtggtaaactatcttaggacccaaaaggccgtggtccgagtcagtcccgaagtgcccctgcagaacatcctgcccgtgatttgcgccaagtgcgaggtgagccctgagcacgtcgtgctgctaagggataacatcgcaggcgaggagctggagttatctaagagcctcaacgagcttggaatcaaagagttgtatgcatgggataatcgcagggagacgttccgcaagtctagtcttggaaacgacgaaactgataaggagaagaagaagttcttgggattctttaaagtgaacaaacgcagtaacagtaagggatgtctgaccacacctaactccccatccatgcacagtcggtcccttaccctaggcccatcactttccctcgggtcgatcagcggagtttcagttaaaagtgaaatgaaaaaaaggagggcacctcctccacccggctcgggtcccccggtgcaggataaagcatctgagaaagtttccttaggatcgcagatcgacttacaaaagaagaagcgcagagccccggcaccgccaccacctcagccccctcccccctcccccctgatacctaatcgaaccgaggataaagaggagaacaggaaatctaccatggtttattgctgtgcttcatttcccactcaggcaaagcgattctag

SEQ ID NO: 46502 - DNA, 825 bp, Artificial Sequence
  Description of Artificial Sequence: Synthetic coding sequence
atggaggacagctacgagaccgacaccagcagcctgaccagcagcattcacggggcgtccaaccactgcccccaggacgccatgattccgcacggggacacagacgctatccctgtcaccttcatcggagaagtgtccgatgatcctgtcgactccgggctcttctctaacaggaacaataatgccgggtctttcgattccgagggtgtcgcctctcgcagggattcactggcccccctgcaggcggagcattcgcagcctcatgagaaggcacgagaggaggtgcctgccttgcatccggcgtcgcacgacgtggggaagggcattcgggttgccctctcaaacatatccaaagatggaaaccttatggaaaccgctcccagagtgaccagctttgctagcaatctgcataccgataatctaaatgctaaggtgaaggataaagtttatgggtgcgccgacggggaacgcacgcaggctaccgagcgcgtcaattcacagccagtaaatgagaaggactctaacgataaaaatgcggctctcgccccaactagttggcatcaacgcggccaaaacccaggcaagagctaccgactgaaacatggcctgacaacatacaaaatcatcccacccaagtccgaatcctccgggggagctactctgtggaagaatacttgggctgatcctcagcgggccctacctggggatcctcccccccctctgtgtccccgcaggcgccggattcagcgcgcagattcgaagcaaaccccgtctcagtaccgtccctcccgtagcctgcctacgatgagggctggcaccccttag

SEQ ID NO: 46503 - DNA, 2523 bp, Artificial Sequence
  Description of Artificial Sequence: Synthetic coding sequence
atgaaccggttccgggtgagcaagttccggcacaccgaggcccggcctcctagacgggagtcatggatcagcgacattagagccggcacggctccctcatgccggaaccatattaagtctagctgttccctgatagctttcaactcagatcgccctggagttctggggatcgtgcctctccaggggcagggtgaggataagcgccgggtagctcatctgggttgtcattccgaactcgccgctcatggagatttggtccagtcagctgtgtggagtcgcgacggcgccttagttggcacagcctgtaaagacaaacagttaagaatatttgatcctagaacgaagccccgagcctctcagtcaacccaagcccacgagaatagcagagatagcagactggcatggatgggaacctgggaacatctagtctccacggggttcaaccagatgcgcgagcgtgaagtgaagttgtgggatacaaggttctttagctctgcccttgcttcgctgaccctcgacacaagcttaggatgtcttgttccactgcttgatcctgattcaggtctactggttctcgccggtaagggcgagaggcagctgtactgttatgaagtggttcctcagcagccagccctctcgccagtcacccagtgtgttctggaatcggtccttagaggggcagccctcgtgccccgtcaggccctcgcggtcatgtcatgcgaagtcttgagggtcctgcagctgtccgatacggctattgtacctatcggctatcacgttcccagaaaggcggtggagttccacgaagatctcttcccagatactgctggctgtgtcccggccactgaccctcactcatggtgggcaggcgataaccagcaggtgcagaaggtatcgcttaatccggcttgccgaccacatccaagctttacaagttgtcttgtgccacctgctgagcccctgcctgacaccgctcagccagccgtgatggagactcccgtcggagatgcggacgctagcgaaggtttttcttctcccccgtcctctttgacctccccctctacacctagctcactgggaccttccctttcttcaaccagtgggattggcacatctccatctttgcggtctctgcagtcgctattaggaccgtctagtaaatttcgacacgctcagggcactgtcctgcaccgcgactcacacatcactaacctgaagggactcaacttgacgacacccggagaaagcgacggtttctgtgctaataagctacgggtggccgtgccgctgctgtcatccggggggcaggtggcagttctggagttgagaaagccgggcagactccctgatacagcactacccaccctccaaaatggcgccgcagtgacagatcttgcttgggaccccttcgacccccaccgcttagctgtggccggtgaagatgcacgaatacggttgtggagggtcccggcggaggggcttgaagaagtcttgaccaccccggagacagtcctgacaggacatactgaaaagatttgttcattgagattccaccctttggccgcaaacgtactcgcgtcgagttcgtacgatctgacagtaaggatatgggacctccaggccggcgctgacaggctcaaattgcaggggcatcaggaccaaatattctctctcgcatggagtccagatgggcagcagcttgcaaccgtgtgcaaggacggccgtgtcagggtgtacagaccacgcagtgggccagagcctctacaggaggggccaggtcccaagggaggcaggggagcccgaatcgtgtgggtgtgcgacgggcggtgtctcctggttagtggtttcgactcccagtcagagaggcagttactgctgtacgaggcagaagccctggccggggggccactggcggtgttgggtctggacgtagcccctagcacccttctcccatcttatgaccccgacactggcctggtacttttaactggaaagggtgacactcgggtgttcctatatgagcttctgcctgaatcccctttcttcctggagtgtaattcattcactagtcctgatccacacaagggcctggtgctcttgcccaagacggagtgcgacgtgcgagaagttgagctcatgcgctgtttacgacttcgccagagcagcctggaacccgtcgcattccgcttacctcgagttcggaaggaattttttcaggatgacgtctttcctgacactgccgtgatctgggagcctgtgctttccgccgaggcttggctgcaaggagcgaacggccaaccttggcttttgagtctccagccaccagacatgagcccagtttcccaagctccccgtgaggctccggcccgacgtgccccgagctcagctcagtacttagaagagaagtccgaccaacagaaaaaggaggagttgctgaatgcaatggttgccaagctcggaaaccgagaggacccacttcctcaggactctttcgagggagttgacgaggacgagtgggattag

SEQ ID NO: 46504 - DNA, 246 bp, Artificial Sequence
  Description of Artificial Sequence: Synthetic coding sequence
atgagcagcacctactgcggcaacagcagcgccaagatgagcgtgaatgaagtgagcgcattcagtttgacactcgaacagaagactggcttcgctttcgtagggattctatgcatctttctgggccttctgataatccgctgcttcaagattctgctcgacccctattcatccatgcccagtagtacatgggaggacgaggtagaggaatttgacaaggggaccttcgaatacgccctggcctag

SEQ ID NO: 46505 - DNA, 246 bp, Artificial Sequence
  Description of Artificial Sequence: Synthetic coding sequence
atgagcagcacctactgcggcaacagcagcgccaagatgagcgtgaatgaggttagcgccttcagtcttaccctcgaacagaagacggggtttgcattcgttggcatactttgtatattcctgggtctgttgattattagatgctttaagatcttgctggacccatattcatccatgccctcaagcacctgggaggacgaagtagaggagttcgacaagggaacattcgaatacgccctggcctag

SEQ ID NO: 46506 - DNA, 906 bp, Artificial Sequence
  Description of Artificial Sequence: Synthetic coding sequence
atgagctaccccaccaaggagggcagcgacaccgccggcaacgcccataaaaatagcgaaaatgaaccaccaaatgactgctcaaccgacatcgagtcacccagcgccgaccctaatatgatctaccaggtagaaactaatcccattaatagagaaccagggacagcaactagtcaggaagacgttgtgcctcaagcggccgaaaacagtgagctagagactgaaatccaaaaagatcagagggaggaggatctaaaagaagagctccttctcctgcagaccccaatcccgaggaagctagtttctcacaagcccctgaatgatcgatcccggtcacatagtggcaaggttgaaatgaaggccaacaacttccctattaatcacaaaaccagatttaggttatcaacctcttggagggtgccctttatcaactcacatgagatacggtccatgatattgcacctgctgtgtgaccgctatttttcccaggccgccggctgtcagaataccatgtgggtcaagcgaaagtacattgcctgcttgtaccaccccaactccttcactcaccacgaacgggccataactttcagaaggccttctagagtgcattattaccggcccctgactgaacggatgacaagcgggaaattctgtaaatcaactgacacaaaggggaagtgtcggttcagagctatagtacgatctgtactgtttgtctctcagattcaaatcgagtctattttcaatattaagggcttcgtggacattctcacctatatccacactatgaatgtgatgataaccaatacaaataacggctggaagtacttctgccccatttgtggccggctgtttaatacatactctgagcttcgccagcatagttgtagctccagcgggaactag

SEQ ID NO: 46507 - DNA, 906 bp, Artificial Sequence
  Description of Artificial Sequence: Synthetic coding sequence
atgagctaccccaccaaggagggcagcgacaccgccggcaacgcccacaagaattccgaaaacgagcctcctaacgattgcagcactgacatcgaatctccttccgccgaccctaatatgatttaccaggtcgaaaccaaccctattaaccgagaacccggcactgcaacctcccaggaggacgttgtccctcaggctgccgagaactccgaacttgaaacagagattcagaaagaccaacgggaggaagatctaaaagaggagctcctacttctccagacccctatccccaggaagctggtaagccataagcccctgaatgaccggtctaggtcccattcgggtaaggtggaaatgaaggccaacaactttcccatcaatcataaaacaaggtttcggctttccacgtcctggagagtgccatttataaattcccacgagatcagatccatgatcctgcacttactgtgtgacagatacttttcccaggccgcgggttgccaaaataccatgtgggtgaagcggaagtacattgcctgcctttaccatcccaacagtttcacccatcacgagagggcgatcacattccggcgaccgtcacgagtccattactaccgccctttgacagaaaggatgactagcggcaagttttgcaaatctactgataccaaaggcaagtgccggtttagagccatcgttaggtctgtcctctttgtctcgcagatccagattgaatccatttttaacatcaaaggattcgtcgacattcttacatatatccacacaatgaatgttatgattacaaacaccaacaatggctggaagtacttctgcccaatctgcggtcgcttattcaatacctactccgagcttcgccaacatagctgctcctcatctggcaactag

SEQ ID NO: 46508 - DNA, 1935 bp, Artificial Sequence
  Description of Artificial Sequence: Synthetic coding sequence
atgctgcggaccgacgccggcgaggacctggccgacgcccccgccgaggagttgcaagaaaagggatcacccgcaggccccccacctagccagggccagccagccgcacgaccgccaaaggaggtgcctgcttcccgtcttgcgcagcagctgagggaagaaggatggaaccttcaaacctctgaaagtctcaccctggcagaggtatatctgatgatgggtaaaccatctaagttgcaattagagtacgattggcttggccccggtagacaggatcccagacccgggagtctgcccacagctctccacaaacagcggctactttcgtgcctgttgaaactgattagcacagaggtgaatcccaagctggctttagaggccaataccataagtactgctagcgtgcggcccgcacaggaggagcaatccatgaccccgcccggaaaggtggtaaccgtgtcatcaaggtcaccccggtgtcctcgtaaccaagcctctctgcgtagttcaaagacatttccaccatccagcgccccatgctcaagtggattacggaacccgccgcgcccgcttctcgtgcccggccctagcagcacaggatccaacgatagtgacggggggctgtttgctgtcccaacaacattgccaccgaattcacgacacgggaagcttttctctccctcaaaggaggctgaactaaccttcaggcagcacctgaattccataagcatgcaatctgacttttttctccctaagccccggaagctgagaaacaggcatctcagaaagcccctggtcgtccagaggactctcctgccgcgtccttcagagaatcagtctcataatgtgtgtagcttctccattctctcaaactccagcgtgactggcaggggatcatttagacccattcaatccagcctaacgaaagctgcactctcccgcccgattgtgccaaaggtattgccaccgcaggccacttcccatctggctagtgccattgacctggccgccacaagcgcagggattctctcagggaaccctctgcctgccctggacactgaagggctgagcggaattagccccctgagctcagatgaggttacaggggcaatctccgggcaggactccacaggaactcatcaggacggcgataccctgcccacagttggtggtagtgacccatttgtttcaatcccctctcgacctgaacaggaacctgtagccgattcatttcagggcagcagtgtcctgtccctgtccgagcttcccaaagccccgttacaaaacggtctgtcaatccctctatcaagcagcgagtcctcctctacacggctgagtccccccgatgtgtctgccctgctggacatcagcttgccaggccctcccgaggacgccctatcgcagggggagcctgcaacccacatctcagactccatcatagagatcgccatctcctccggcgagggagttccactgtcgccggccaaactcaacggatcagactcgtcgaagtcgctccccagtcctagctcctcgcctcagccacattggatcgcatctcctactcatgatccacagtggtatccttctgatagcaccgattcctctctctcttcgctcttcgcttcatttatcagcccggaaaagtcccggaaaatgttaccaacccctatagggactaactctggcacttcattgctcgggccctcccttttagatggcaattccagggactctttcgtttctaggtctctggctgacgtggccgaagtcgtcgattcccagctcgtgtgtatgatgaatgagaactccatcgattacataagccgcttcaacgacctggcccaggaactgagcattgccgagccaggtagaagagaggccctcttcgatggaggaggcgggggaccggcggttagtgatctatctcagtag

SEQ ID NO: 46509 - DNA, 3810 bp, Artificial Sequence
  Description of Artificial Sequence: Synthetic coding sequence
atgaccgtgaagctgggcgacggcggcagcggcgaggacggcctgaagaagctgggcaaaagagccgctgacgaggaatcgctggagggggaaggtgctggtggcgcagatgcagctgaggagtcttccggcaccaaacgcgacgagaagacgcctagagcaggcgccgatggaccacccgcgccaccaggcgcgcctcaagcgccaagtcccccacagggctcaccccaagatcaacatcactttctgagaagttccgtgcgccctcagtccaagagaccaaggaaggacccccccagtgccgttgggtccggaaacgcgggaggctcaggtccccgcggaaagggtgcagaaggtggtggatcgtccagcggcaacgtgtccggcgtggctccggctgccccagccggaggcagccggtcatcttctcgaaatctcggctcatccgggggggaaaaggaggaggggaagaaagtccgaaggcagtgggagagttggagcaccgaggacaagaatacattcttcgagggcctatatgaacacggcaaggacttcgaggcaattcagaacaatatagcattgaagtataaaaaaaagggcaagcccgcctcaatggtgaagaacaaggaacaggtgcgtcatttttattaccgtacttggcataaaatcactaaatacattgatttcgatcacgtcttcagtcggggcttgaagaaatcaagtcaagaactttacggcttgatctgttatggcgagctgcggaagaaaatcggaggctgtatggacgacaagaatgcaaccaagttaaatgagttgatccaagtgggtgcaaccacagtgagatacaagggcagaaacctgcggattaaggcacccatgtgtagagctcttaaaaaactctgcgaccctgatggcctttccgatgaggaggaccagaagcccgtgcggctaccgctaaaagtgcccattgaacttcagccacgcaacaaccatgcgtgggcgagagtccagtccttggcacagaaccctaggctgagaatgattgttgagctgcataggaaagtgtcatcactgatcgagttcttaaaacagaaatgggccttacacgaagtgagagtgcgcaagacactggaggagcgccaacttcaggatagctgctccgcaccaatgcaggagaaagtgacactgcacctgtttcctggcgagaactgtactctaacgcctctaccgggagtcgccagggtggtgcattctaaggccttttgcacagttcactggcaggaagggggtcgttgcaagcagtccgccaaggacgcacacgttctgcccccagcgcagatcttgggcatccagagcgggcaggggactgctcgtggccaggtgaagtgcccgcgctccggcgctgagggcaaaggggtcgggcggccccccccagctgcagatgctctgcagtcctctggagagtcatcgcccgagagcgcaccgggcgaaggggcggctcttagcttatcctcccctgatgcaccagaccgacccccacctcggcatcaggataccggcccctgtctggagaaaacaccggccgaaggccgagattcaccgacccgagaaccaggcgctctgccgtgtgcatgcggtcagctgccagatctggaggacgaactatcattgttggatccccttccgcggtacctgaagtcttgccaggaccttatcgtgccggagcagtgccgctgtgcagacacaaggcccggctctgaacagccccctctcgggggagcggcctcccccgaggttctggcccctgtgtctaaagaggctgcagacttagctcccacaggcccaagtcctcggccaggtcccgggctcttgctcgatgtgtgtacaaaagatctagcagacgcccccgctgaggagctccaggagaagggaagtcctgctggcccacccccgagtcagggacagccagcagcaaggcccccaaaagaggtacctgcatcccgtctggctcagcagctgagggaagaagggtggaacctccaaacatccgagtctctgactctggcagaagtgtacctgatgatgggaaaacccagcaaactgcaattggaatacgattggttgggtcccgggaggcaggatcctagacccgggtcgctcccaacagctctgcataagcaacgcctcctgagctgtctgctcaagctcataagtactgaggttaatccgaagctggcgctagaggcaaacacaatttctaccgcatcagttagacccgcacaggaagaacaaagcatgacaccccccggaaaagtagtcactgtgtcatcgcggagcccaaggtgtcctaggaaccaggcaagcttgaggtcatccaagacatttccaccatccagcgccccatgtagctcaggcctcaggaaccccccccggcccttgctcgttccaggcccctccagcactggcagtaacgactcagatggaggcctgtttgccgtgccaacaactctcccacccaattcgcgccacggcaagttgttcagtccttctaaagaagcggaactgacatttagacagcacttgaacagcatttccatgcagagtgacttcttcctccctaagcctcggaagctccgaaatagacaccttcgcaaaccattagtcgtacagagaactctacttccgaggccttccgaaaatcagagccacaatgtctgtagtttctctatcttgtctaactcctcagtcactggcagggggagcttccggccaattcaatcctcccttaccaaggccgccctgtcacggcctatcgtccctaaggtgctccctccacaggctacttcacatctggcctccgccattgacttagctgctacctctgctgggattctttccggtaatcctctgcctgccctggatactgaagggttgagcggaatctccccactcagctctgatgaggtgaccggcgccatcagcggtcaggattccaccggcactcatcaggacggggacactctgcctaccgtgggagggtccgatcccttcgtgagcatcccaagccggccagaacaggagccagtggccgattcatttcaaggttcctccgtgctgtccctgtctgaactccctaaggcaccactgcagaatggactgtcaatccctttatccagctctgaatcctcctctaccaggctgagccccccagatgtctccgccctgctcgacataagcctgcccgggcctccagaagacgcactgagccaaggggaacccgccactcacatctcagattccattatagagatcgccatcagcagcggccagtacggcgagggcgtgcccctgtcccccgcaaagttgaatggctccgacagctccaagtccctccccagccccagctcgagtccacaaccacattggatagcctcaccgacacatgacccccagtggtaccccagtgacagtactgatagttccctatcttccctctttgcatccttcattagccccgagaagagcaggaaaatgctccccacccctatagggacaaactctgggacgtccctgctgggccctagtttattggacggaaactcccgcgattcttttgtgagccgatccctggccgatgttgccgaggtcgtggattcccagctggtgtgtatgatgaacgagaacagcattgactacattagccgctttaatgatttggctcaggagctatcaattgcggagcctggaagaagggaagctctgttcgacgggggaggagggggcccagctgtctctgatctgtcacagtag

SEQ ID NO: 46510 - DNA, 3810 bp, Artificial Sequence
  Description of Artificial Sequence: Synthetic coding sequence
atgaccgtgaagctgggcgacggcggcagcggcgaggacggcctgaagaagctaggtaaacgggcagccgatgaggaaagtctcgagggcgaaggtgcaggcggcgccgatgcagcagaggagtctagtgggactaagcgtgatgaaaagactcctcgtgcgggagccgacggcccccctgcaccaccgggcgcaccacaggcccccagccctcctcagggatccccccaagatcaacatcattttctgagaagcagtgtccgccctcaaagcaagagacctagaaaggatcccccaagtgcggtgggctcagggaatgctggcggcagcgggccacggggcaagggcgccgagggcggtggctcttcttctggaaacgtgagcggagtggctcccgcagcccccgctggaggtagccgctcctcctcacgtaacttgggatccagcgggggagagaaagaagagggcaaaaaggtccggcgtcagtgggaatcgtggtccacagaagataagaacacgtttttcgaggggctctacgaacacggcaaggattttgaagcaatacaaaataacattgcattgaagtacaaaaaaaaggggaaaccagcctccatggtgaagaataaggagcaggtacgacacttctattaccgcacctggcacaagattacaaagtatatagactttgatcatgtgtttagccgcggcctaaaaaaaagctcccaagaattgtatgggctaatctgctatggcgagctgcgaaagaaaattggtgggtgcatggatgataagaatgccacaaagctcaatgagctgattcaggtgggagccaccacagtcagatataagggcagaaatctgcgcattaaggcccctatgtgcagagctctgaaaaaattgtgtgatcctgacggactctctgatgaggaggatcagaaacccgtacgattgcctctcaaagtaccgatagaacttcaaccgaggaataaccacgcctgggcgagggtgcagagcttagcacaaaaccctcggttgaggatgatcgtggaactccatcggaaagtctccagcctaattgaattcttaaagcagaaatgggcattacacgaagtgagagtgcgaaaaaccctggaggaacggcagttacaggactcatgtagcgcccccatgcaagaaaaggtaacactacacctgtttcccggcgagaactgcacactaacacctctcccaggagtggctcgagtggtgcattctaaggccttctgtacggtgcattggcaggagggaggcagatgcaagcaatccgccaaggacgcccatgtactcccaccagcccagatccttggcattcagtctggccagggaaccgcgcgcggacaagtgaaatgcccacgctccggcgcagaaggaaagggagtggggagaccgcctcctgccgcggatgcactccagtccagtggagaatcttcaccggaaagcgctccaggagaaggagctgctcttagtctgagcagccccgacgctcccgaccgtccacctccccgacaccaggacacggggccttgcctggaaaaaacccccgctgagggtcgggatagtccaacccgggagcccggggctcttccctgcgcttgcgggcaactgcctgacctggaggatgaactgagcctgctggacccactaccccgctatttgaagtcctgccaagacctgatcgtgcctgagcaatgtaggtgcgccgacactcggcccggatcagagcagccacctctcggaggcgcagcgagtcctgaggtgctcgccccagtgtctaaagaagcggctgatcttgcccctacaggtcccagtccacggcccgggcccgggttgctgttggacgtctgcactaaggatctggccgacgctcctgccgaagaactgcaggagaaaggtagccccgcaggtcccccaccttctcaaggacagcccgccgccaggcctcccaaagaagtgccagcttcgagactggctcagcagctgcgggaggaggggtggaatttgcagacgtccgaatcactgactcttgccgaagtgtatctgatgatgggcaaaccttccaaattgcagctggaatacgactggctcggccctggacgtcaggacccacgacccggtagcctgcctacggctttgcacaaacagagactgttgagttgcctgctgaagctaatctccaccgaagtgaatccaaagctcgctcttgaggctaatactatcagcaccgcttcggtccgtcccgcccaggaggagcagtcgatgactcccccaggcaaggtcgtgactgtcagttccagatccccgcgctgccctcgtaatcaggcctccttgaggtcatctaagaccttccccccatcaagtgcaccctgctcttctggtctcagaaatcctccccgcccgctgctcgtgcctggtccgtcctcaacagggtcaaatgacagcgacggtggtctgtttgccgttcctactacgctacctcctaacagtcgtcacggaaagctgttctctccatctaaggaggcagagctgacctttaggcagcaccttaactcaatcagcatgcaaagtgattttttcctcccgaagccccggaagttaaggaatcggcatttgagaaagcctctggttgtgcagcggacgctgttacctcgaccttccgaaaaccagtcccacaacgtgtgctcgtttagtattctgtctaattcctccgtcactggacgtggcagtttccgtcctatccaaagcagccttactaaagccgccctgtcaagacctatcgtcccgaaggtcctcccgcctcaggccacgagccatctggctagcgctattgatctcgctgctacctccgccggaatcctgtctgggaatcctctacctgcgctggatacagagggactcagcgggatctcacctctgagttcagatgaagttaccggcgcaatctctggccaggattctaccggcacccaccaggacggagacacacttccaaccgtcggcggatctgatcccttcgtctccatcccctcgaggccagaacaggagcccgtagccgacagctttcagggctcttcagtcttatccctatcagaattgcctaaggccccgcttcagaacggactgtctattccactctcttcgtccgaatcatcgtctacacggctgagcccacctgacgtttctgcgctgttggatatctctttaccaggtccgcccgaagacgcgctctctcagggagagcccgcaacccatatctccgactctattatcgagatcgccattagctccggacagtacggggaaggggttcccctgtcccctgccaagctaaacgggtccgacagcagcaagagtctgccttctcctagctctagcccacagcctcattggatagcctccccaacacatgatccccagtggtatccatctgacagcactgatagtagcctgagttccctctttgcgtccttcattagccccgaaaagagtaggaagatgctgcctacgcctattggcactaacagcgggacatctcttctgggacctagtcttcttgacggcaacagccgcgacagcttcgtcagcagaagtctggctgacgttgccgaggtggtggatagtcagctagtgtgcatgatgaatgaaaactccattgactacatttccaggttcaatgatttagctcaagagctttctatcgctgagccagggcggagagaagccttattcgacggaggtgggggggggcccgcggtgtccgatctgagtcaatag

SEQ ID NO: 46511 - DNA, 3801 bp, Artificial Sequence
  Description of Artificial Sequence: Synthetic coding sequence
atgaccgtgaagctgggcgacggcggcagcggcgaggacggcctgaagaagctgggaaaaagagccgccgacgaggagagcttggagggagagggcgctggcggcgccgatgccgctgaggagtctagcggcactaaacgcgatgaaaaaacaccccgggctggcgccgatggcccaccagcgcctcccggcgctcctcaggctcccagccctcctcagggaagccctcaagatcagcaccactttctgcggagcagtgtgcgcccgcagagtaagagaccaaggaaagatcctccaagtgcggtagggtccggcaacgccggcgggagcggtcctaggggaaaagacagacaccttcctaaggcccaactgtggctctcgatctcacgggtgccatttggagggtctagatcctcttcccgcaacttgggatcctccggtggggagaaagaagagggcaagaaggtaagacgccagtgggagagctggtcaaccgaagataagaatactttcttcgagggcttgtacgagcacggtaaagacttcgaagcgattcagaataatattgccctaaagtacaagaagaagggaaaaccagcatctatggtcaagaataaggagcaggtgcggcatttttattatagaacttggcacaaaattacaaagtacatcgacttcgatcatgtattctccagggggctcaaaaagtcttcccaggagctgtatgggctgatctgctacggagaactgagaaagaaaatagggggttgtatggatgacaagaacgcaaccaagttgaatgaactgattcaggttggcgccaccacagtaaggtataaaggccgcaatctgcgcatcaaggctcctatgtgtcgagccctgaaaaaactctgtgaccccgacggtctgagtgatgaagaagaccaaaagcccgtaaggctgcccttgaaagttcctattgaactgcaacccaggaacaaccacgcgtgggctcgagtgcagagcctggctcagaacccaagactccgaatgatcgtggaattgcacagaaaggtgagctctttgatcgaattcctcaagcaaaaatgggcgttacatgaggtccgggtgcgcaagacgctcgaggagcggcagctgcaggactcctgcagcgctcccatgcaggaaaaggtaacattgcacctgttcccgggagaaaattgcactctaactcccctccctggcgtggctagggtcgtgcactcaaaagccttctgcactgtacattggcaggaaggcggccgatgcaagcaatctgccaaagacgcacacgtgctccctccagcacagattctggggatccagagtggtcagggcaccgctagaggccaagttaaatgtcccagatccggagccgagggaaagggagtcggcagacctcctcctgccgccgacgccctccagagttccggggagtcgagccccgaatctgctcccggcgagggtgccgccctctcactttccagtcctgacgcccctgacaggccgcccccgagacaccaggacacgggcccttgcctagagaaaactccagcagagggccgcgatagtccaactcgcgagcccggcgccctgccttgtgcatgtggacagttgccggatcttgaagacgagctcagccttcttgacccacttccacggtacctgaaaagctgccaggacctgatagtgcctgaacagtgcaggtgtgccgataccagaccaggcagtgaacaaccacctttggggggcgccgcaagcccggaagtcttggctccagtgtccaaagaagcggcagatctggcccccacaggtccttccccaagacctggcccaggtctgttgttggatgtttgcaccaaggacctggccgatgcccccgctgaggagctgcaggagaagggaagccccgctggacctcctcccagccaggggcagcccgccgctcgtcctcccaaagaagtgcccgcatctcggttagcccagcagctgcgagaggaaggttggaatttgcagacttccgaaagtttgactctggctgaagtgtaccttatgatgggtaagccttccaaactgcagttggaatatgactggctgggaccagggcggcaggacccacggcctggtagcctccccacagctctacacaaacagaggctccttagctgcttgcttaagctgatctccaccgaagtgaatccgaaactggctctggaggccaatactatttccacagccagtgttcgcccagcccaggaggaacaatcaatgacacctccaggcaaagtggtgaccgtcagcagccgaagccccagatgtcctcggaatcaggcatctcttcggtcttccaagaccttccctccttcaagcgccccctgctcatccggcttaagaaatccccctaggccactgcttgttccaggcccctcttccaccgggagcaatgactccgacgggggactcttcgccgtgcccacaaccctgccccctaactctcggcacggtaagctcttctctccgagtaaagaggcagagctcactttccggcagcatcttaattccatttctatgcagagtgattttttccttcctaagccccgcaagctgagaaatcgacacctgcggaagccattggtcgtccaaaggactctgttgccgagaccctctgaaaaccagagccacaacgtgtgcagtttctctatcctcagcaacagtagcgtgacaggtagggggagcttccgccctattcagtcaagtctgactaaggccgcactgtcccggccgattgttccaaaagtgctgcccccgcaggccacttcccacctggcatccgcaattgaccttgcagccacttccgccggaatcttatccgggaatccccttccagctttggatacagaaggcttgagtggaatctccccactgtcaagcgacgaagttaccggggccattagcggacaggactctaccggcacacaccaggacggagacactcttcccaccgtgggaggctccgatccctttgtatccatccccagccggccagagcaggagcctgtcgccgacagcttccagggatcatcagtgctgtctctctcagaactccccaaagccccactacagaacggcctctccatccctctttcaagtagtgagtcctccagcacgcggctgagccctcctgacgtgtctgcactgctagacatcagcctgcccggaccacctgaggatgccctgagccaaggggagcctgccacgcatattagcgactctataatcgaaattgctataagctccggccaatatggcgaaggtgtcccattatctccagccaaactcaacggctcagacagcagcaagtctctgccctcccctagcagctctccacaaccgcactggatagcctctcccacccacgacccgcaatggtacccatcagattcaaccgatagcagtttgtcttcgctgttcgcttcctttatcagccccgagaagtcccgaaaaatgcttcctacaccaatcgggactaattcaggaacgtcgttgttgggaccttccctgctggatgggaatagcagggatagctttgtcagcaggtctctggctgacgtcgccgaggtcgtcgacagccaactggtgtgtatgatgaatgagaatagcattgattatatctctcgctttaacgacctggctcaggaactcagcattgcagaacccggccggcgcgaggcgctcttcgatggcggcggaggtgggcccgccgtcagcgatctatctcagtag

SEQ ID NO: 46512 - DNA, 528 bp, Artificial Sequence
  Description of Artificial Sequence: Synthetic coding sequence
atggacatcgccatccaccacccctggatccggcggcccttcttcccttttcacagcccatctcgcctcttcgaccagtttttcggtgagcatctactagaatcggacttattcccaacctctacgagcctgtccccgttctatctccgacccccctcatttctgagagcaccctcatggttcgacaccggcctgtccgagatgagacttgagaaggaccggttctccgtgaatcttgacgttaagcacttcagccctgaggagcttaaagttaaggtattgggagacgtaatagaggtgcacggcaagcacgaggaacggcaggacgagcacggctttatcagccgtgagtttcatcggaagtatcgtatcccggccgatgtggacccactgactattacctcttccttgagtagcgacggcgtgttgaccgtgaatggtccgagaaagcaggtgtcagggccggagaggactatccctatcactcgggaggagaagccagcggtcaccgccgctccaaagaagtag

SEQ ID NO: 46513 - DNA, 528 bp, Artificial Sequence
  Description of Artificial Sequence: Synthetic coding sequence
atggacatcgccatccaccacccctggatccggcggcccttcttcccgtttcatagtcccagtagattgtttgatcagttcttcggcgagcaccttttggaatctgacctgttccctactagtacatccttgtcgccgttttatttgcgcccgccaagtttcctgagggccccttcctggtttgatactggcctgtccgagatgaggctcgagaaggacagatttagcgtgaatctggacgtgaaacacttcagcccagaggaactcaaagtgaaggtgctgggggatgtgatcgaggtccatggcaaacacgaggagcgccaagacgagcacggtttcatttcccgagaattccaccggaagtacagaattcccgcagatgtggatccgctgacgatcactagttccctgtccagcgatggagtgctcaccgtgaacgggccaagaaagcaagtgtcaggccccgagagaacaattcctattacccgggaggagaagcctgctgtgacagctgctccaaagaagtag

SEQ ID NO: 46514 - DNA, 528 bp, Artificial Sequence
  Description of Artificial Sequence: Synthetic coding sequence
atggacatcgccatccaccacccctggatccggcggcccttcttcccctttcactcccccagcaggctgtttgatcagtttttcggggagcacttgctggaatccgacctgtttcctacctccacgtctctgtcgcctttctatttgaggccgcctagctttctccgcgcacctagttggtttgatactggtctgtcagaaatgcgcctcgagaaggatcggttttccgtgaacctcgatgtgaaacacttttcccccgaagaactcaaagtgaaggtgctcggggacgtgatcgaggtccacgggaagcacgaagagcggcaggatgagcacggattcatctcgcgagaattccatagaaaatatcgtatccctgctgatgtggatcctttgacgattacctccagcttgtcttcagacggggtcctgacagttaatggacctaggaaacaggtcagtgggcctgagcgcacaatacctattacaagggaggaaaagcctgctgttaccgcagcacctaagaagtag

SEQ ID NO: 46515 - DNA, 549 bp, Artificial Sequence
  Description of Artificial Sequence: Synthetic coding sequence
atggcccagcggagcggcaagatcaccctgtacgagggcaagcacttcactggacaaaaactcgaggtctttggtgactgcgacaatttccaggaccgcggcttcatgaatagagtgaatagcatccatgtggagagcggcgcttgggtgtgttttaatcatcccgacttccgtggtcaacaattcattctggagcacggtgactaccccgatttcttcagatggaatagtcactcagaccatatgggttcatgtcgccctgtcggtatgcatggtgaacactttagattagaaatcttcgagggttgtaacttcacaggccaatgccttgaatttctggaagattccccatttctgcaatctcgtggatgggtgaagaattgtgttaatactatcaaggtgtacggcgatggtgcagcctggagcccgcgctcttttggagctgaggactttcagctttcttcaagtctacagtctgatcaggggcctgaggaagccactaccaaacctgcgaccacacagccaccatttcttacggctaacctgtag

SEQ ID NO: 46516 - DNA, 447 bp, Artificial Sequence
  Description of Artificial Sequence: Synthetic coding sequence
atgggccgggccggcccccggagcaccgccgacacccggccccgggctaccgtgatcaccaccagaaggcccagaccctggcagaaaccaacatcccctcgtcgcctgcatcgccgccggccacggggtcagccagcctctgagaatgcagccgagccctcacaggtggcgatttctaagggcaaatcccctgattatgcgaacgggggaaaagctgccatggactcccgggctagcgacgcaataaacaagagcaaggtcgatacatccgcttctaatccgtcccaacgaaggccaagcaggcttagaggtaagaggtccctggccctcccacctagactggaatgcctgtttccgtcttcatgtggaagtcgccgggcaacaagcaggccaggcttcccaccccttgaaggctcccacctaggctgccagcttctgccattgtag

SEQ ID NO: 46517 - DNA, 2415 bp, Artificial Sequence
  Description of Artificial Sequence: Synthetic coding sequence
atggaggagcccggcgtgaccccccagccctacctgggcctgctgttggaggaactccggcgcgttgttgctgccctgcctgagggcatgcgtccagacagcaacctgtacggcttcccatgggaactggtgatttgtgccgctgtagtgggattcttcgccgtcctgttttttctttggaggtcctttcgctcagttcgcagcaggttgtacgtgggaagagagaagaagcttgcacttatgttgtctggactgattgaagaaaaaagcaagttacttgaaaagtttagcctggtccagaaagagtatgaaggatacgaggtcgaatcaagtctcaaggacgcttcgttcgaaaaagaggctactgaggcacagtccctcgaagcaacgtgcgaaaagctaaacagatcaaactcagaacttgaagatgagatactttgtctggagaaggagctaaaagaagagaagtctaagcacagtgaacaggacgagctgatggccgacatctccaaaaggattcagtccttggaggatgagtccaaaagtctcaagtctcaagtggcagaggctaagatgacttttaagatcttccagatgaacgaagaacgccttaaaattgccataaaggatgcactcaacgaaaattcgcagctgcaggaatctcaaaaacaactattacaagaggctgaggtttggaaggagcaggtgtccgagttaaacaagcagaaagttactttcgaggactccaaagttcatgcagaacaggtattaaatgataaagagtcccatatcaaaaccctcactgaaaggctcctcaaaatgaaagactgggccgcaatgcttggagaagacatcacagatgacgacaatctagaactcgagatgaatagcgagagtgagaacggcgcttatctggacaatccaccaaagggcgccctcaaaaaactgatacacgccgcaaagcttaacgcttctctcaagaccctggagggggagagaaatcaaatctacatacagctgagcgaagtggacaagaccaaggaagaactcaccgagcacatcaagaatctacagacagaacaggcctctttacaatctgagaatacgcacttcgagaacgaaaatcagaagctgcaacagaagctgaaggtgatgactgagctgtaccaggagaatgagatgaagctgcacagaaaactgacagtcgaagagaattaccggctggagaaggaggagaagctcagcaaggtcgacgagaagatttcccacgcaacagaggagcttgagacttaccgcaagcgtgccaaggacctcgaggaggagctagaacggaccattcatagctatcagggccaaattatctcacatgaaaagaaggcccatgacaactggctggccgccagaaacgctgagcgcaatctgaatgacctcagaaaagagaacgctcataatcgacagaagcttactgagacagaattgaaattcgaactgctggaaaaggacccttacgcactggacgtccccaatactgcttttggacgcgaacactccccctatgggccctctcctcttggttggccatcctccgagactagagcctttctgtcccctcctactctgctggaagggcctctccgcttatcaccgctcctgcctgggggagggggtaggggatctcggggacccggtaaccctttggatcaccagataaccaatgagcggggggagtcctcatgcgacaggctcaccgaccctcatagagccccctccgacacaggttcccttagtcctccttgggatcaggataggcgtatgatgttcccccccccaggccagagctatcccgacagcgctttgccgccccagcgccaggacagattctgttctaacagcggtcgattgtccgggccagccgagctgaggagcttcaacatgccatccctggataaaatggatggctctatgcccagcgaaatggagagctcgcgtaatgatacaaaagacgatctgggcaacctgaacgttcctgattcatcactgcctgccgaaaacgaagcaacaggccccgggttcgtgcctccacctttggcgcccataaggggaccactgttccctgtcgatgctcggggtccatttcttcgacggggaccaccctttccgccacctccccccggagctatgttcggagccagcagggactacttcccacccggagattttccaggtcccccgcctgccccctttgctatgaggaacgtgtacccaccaagaggcttccccccgtatctgccccccaggcccgggttctttccaccgccgccacattccgagggccgttcagagttcccatctggacttatacctccctccaacgagcctgcgacagaacaccctgaacctcagcaggagacctag

SEQ ID NO: 46518 - DNA, 2316 bp, Artificial Sequence
  Description of Artificial Sequence: Synthetic coding sequence
atggaggagcccggcgtgaccccccagccctacctgggcctgctgctcgaggagttgcggcgagtggtggcagcgcttccagaggggatgcgcccagacagcaatttgtatggctttccctgggagttggttatatgtgccgctgtggtcggtttctttgccgtacttttttttctttggcggagctttcgatcagtgagatcacgactgtacgtcgggcgcgaaaagaagctcgcgctgatgttgtccggtcttattgaggagaaatccaaactactggaaaagtttagcctggtgcagaaagaatacgaggggtacgaggtcgaaagtagtcttaaggacgcatctttcgaaaaggaggccactgaagctcaatccctggaggcgacgtgcgaaaaactgaataggagtaactcagagctggaggacgaaattttgtgcctcgagaaagagctcaaggaggaaaaaagcaaacacagtgagcaggatgaactaatggctgatatttctaaacgcatccagtcattggaagatgaaagtaagtcactcaagagccaggtcgcagaggctaaaatgacctttaagatcttccagatgaacgaggaacgcctgaaaattgctattaaggacgccctgaatgagaacagtcaactgcaagaatcgcagaaacagctgctgcaggaggcagaggtatggaaggaacaggtctcagaactaaataagcagaaagtcactttcgaagactccaaagtgcacgctgagcaggtcctcaatgacaaggaatctcatataaaaactctgaccgaacgcctactcaaaatgaaagattgggccgccatgctgggggaggatataaccgacgacgacaacttggaactcgaaatgaattctgagagtgagaacggtgcataccttgacaacccccctaaaggtgccctcaagaagctcattcacgctgccaaactgaacgcgtcactgaagacccttgagggtgagagaaaccaaatctatatccagctcagcgaggtggataaaaccaaggaggagttaaccgagcatattaaaaatcttcagactgaacaggctagtttacaatccgaaaacacacacttcgagaacgaaaatcagaagttgcaacaaaagttgaaggtgatgaccgagctctaccaggagaacgaaatgaagctccatcgtaaactcaccgtggaagaaaactatcgattggagaaagaagaaaaactgagtaaagtggacgagaagatttcccatgccacagaggagctggaaacataccggaagagagccaaagatctggaagaagaactggagcgtaccatccactcctaccagggtcaaatcatatcacatgagaagaaagcacacgacaattggttagccgcgagaaacgctgaaaggaacttgaatgacctcaggaaggagaatgcccataaccggcaaaagctgacagagacggagctgaagttcgagctgttagagaaggacccgtacgcactcgacgtgcccaacacagctttcggaagagagcattctccatacggccccagcccactggggtggccatcaagtgagactagggcatttctgagccctccaacgttactcgaaggaccacttaggctatccccgctgctgccgggaggcgggggacgtggatcccgggggcctggtaatccactggaccatcagataaccaacgagagaggggagtctagttgtgaccgactgacagacccccaccgagcacctagcgatactgggagtctctctcctccttgggaccaagatcgaaggatgatgtttcctccgcctggccagtcataccctgactcagctctgcccccgcagaggcaagaccgtttctgcagcaatagcggacggttatccggcccagctgagcttaggtcttttaacatgccctctctcgataagatggacgggagcatgcctagtgagatggaaagttcgcgcaatgatacaaaagacgaccttggcaacctaaatgtgcctgacagcagccttccggccgaaaacgaggctactgggcctgggttcgtgccacctcctctagcgccgatacgggggccgctgtttcctgtcgacgcgaggggacctttcctgcgcaggggacctccatttccgccaccccctcctggagccatgtttggagctagccgggactattttcctcccggcgattttcctggcccccctccggcgccgttcgccagcgcaagatctcctccaggagccggtgctcccgccagcggtcgcggtctcggcgggccgcagaaatag

SEQ ID NO: 46519 - DNA, 2379 bp, Artificial Sequence
  Description of Artificial Sequence: Synthetic coding sequence
atggagctgaagagccccgaggaggaggtggtggccgccctgcccgaaggtatgcgcccagattctaacctctacgggttcccttgggagcttgtgatctgcgccgcggtggttggcttcttcgctgtactgttctttctctggcgctcattccggtctgtgagaagccggctttacgtgggacgggagaagaaactcgccttaatgttgtccggtttaattgaggagaaaagcaagctgttggaaaagttctcccttgtccagaaggaatacgagggttacgaggtggagagctccctgaaggatgcttctttcgagaaagaggccactgaggcacagtctctggaagccacttgcgagaagctgaacaggagtaattccgagctcgaagatgaaatactctgtctagagaaagaactgaaagaggaaaaaagtaagcattccgagcaggacgagctaatggctgatatctctaaaagaatccaaagtttagaggacgaaagcaaaagtcttaaatcgcaggtggccgaggctaagatgacctttaagatctttcagatgaatgaagagcggctcaagatagctattaaggacgccctcaatgaaaacagccaactgcaagaatctcaaaagcagcttttacaagaggccgaagtgtggaaggaacaggtctccgaactcaacaagcagaaggtcacttttgaggatagcaaggtgcacgctgagcaggtgctgaacgataaagagtcgcacatcaagaccctaaccgagaggcttcttaagatgaaggattgggctgcaatgttgggcgaagatatcacggatgatgacaatttagagcttgagatgaattcagagtctgagaatggagcttacttagataacccgcccaagggagcgctgaagaagctgatacacgccgcgaaactcaatgccagccttaagacacttgaaggtgagcgaaatcagatatatattcagctcagcgaagtcgataagactaaggaggagctgaccgagcacatcaagaacctgcagacagaacaagcatctctgcagagcgaaaatacacactttgaaaacgagaatcagaaacttcagcaaaagcttaaggtgatgacagagttgtatcaggagaacgagatgaaactacacagaaaattgactgtggaggagaattaccgcctagagaaagaagaaaagttatcaaaggtggacgagaagattagccatgctacagaggagctggagacttatcggaagcgggccaaggacctggaggaagagctcgaacgaaccatacacagctatcaggggcaaatcatctctcatgagaaaaaggcacacgacaattggctggctgctaggaatgcagaacgaaatctgaacgacctgcgtaaagagaatgctcataaccgccagaaactaaccgagaccgagctgaagttcgaactcctggagaaagacccatacgctttagatgtccctaacacggcttttggacgggaacatagcccttacggaccttcgcccctgggctggccttcgagtgaaacaagagctttcctttctcctcctactctgttggaggggccattgaggctgtcaccacttttgcctggcggaggcggccgcggctctcgcgggccggggaaccctttggaccaccagatcacaaacgagcgcggagagagttcctgcgatcgtctgacagacccccacagagccccatcagacacagggtccctctctccaccttgggatcaggacagacgcatgatgttcccaccaccagggcagtcctaccctgactccgccctgccacctcagagacaggacaggttctgcagtaacagtggaagattgagtgggcctgccgaactgaggagttttaacatgccgtccttagataaaatggacggatccatgccatcagagatggaatcttcgcgcaacgataccaaggatgacttgggaaacctaaatgtgcccgattcatccctacccgcggagaatgaagccaccgggcccggttttgtacctccacctctggctcccataagaggccctctgttcccagttgacgcccgaggccccttcttgcggcgcggtcccccatttccgccccccccccccggagccatgttcggcgctagtcgggattattttccccccggcgactttccagggcctccccctgctccattcgccatgcggaatgtgtaccctccaagagggttccctccgtacctcccgcctcggcccgggttcttcccacctccgcctcactcggaagggaggagtgagtttcccagcggcttgatacctccgtcgaatgaacctgccacagagcacccagagccgcagcaggagacctag

SEQ ID NO: 46520 - DNA, 2286 bp, Artificial Sequence
  Description of Artificial Sequence: Synthetic coding sequence
atggaggagcccggcgtgaccccccagccctacctgggcctgctgctggaagagctccggcgcgtagtggctgccctgcccgagggtatgcgccccgactctaacctgtatgggtttccatgggaactagtgatttgcgccgcagtggtcggattcttcgcagtcttgttctttttgtggcggagcttcaggagcgtgcggagcagattgtacgtgggacgcgagaaaaaactggccctcatgctaagcggactgattgaggagaaatcaaaattgctcgagaagttcagcctggttcagaaggaatacgagggctacgaggtcgagtcttcactcaaggatgccagtttcgagaaagaggcaaccgaagcccagagcctagaggccacctgtgaaaaactcaacagatccaatagcgaattggaggatgagatcttgtgcttggaaaaagaactgaaagaggaaaaatcgaaacattccgagcaggatgagctgatggccgatatctcaaagaggatacaaagtcttgaggacgaatcaaagtctctaaagtcacaggtggccgaagctaagatgaccttcaagatatttcagatgaacgaggaaaggcttaaaattgccatcaaagacgccctaaacgaaaatagtcagctgcaggagagccagaagcaattgcttcaggaggccgaggtctggaaggaacaagtgtcagaactgaacaagcagaaggtgaccttcgaggatagtaaagtgcatgcggagcaggtgctgaatgacaaagagtcacatatcaagacgctcacggagagactgcttaagatgaaggattgggccgctatgcttggagaggacatcacagacgacgacaatcttgaactggagatgaacagcgagagtgagaacggcgcttacttggataacccccctaaaggcgccttaaagaagctgatccacgccgcaaaattgaacgcttctcttaaaacactggagggggagcgaaaccagatttatattcagttatccgaggtagataaaaccaaggaggagctgactgagcatatcaagaacctgcagactgaacaggcatccttgcagtcagagaatacacactttgagaacgagaatcaaaagttacagcagaagctgaaggtgatgactgaactgtatcaggagaatgaaatgaagttgcacagaaaattaactgttgaggagaattacaggctggagaaagaagagaaactcagcaaggtggacgagaagattagccatgccacggaagagctggagacctaccggaaaagagccaaggatctggaagaggagctcgaaaggaccatccactcatatcagggtcagattatctcccacgagaagaaagcccatgataattggctggctgctcgcaacgcggaaagaaacctgaacgatctgcgtaaggaaaacgcacacaatcgccagaaactgacagagactgaactgaaatttgaactgctagagaaagacccatatgctctggatgtccccaacaccgccttcggccggggatcacggggccctgggaaccccctggaccaccagatcacgaatgaaaggggcgagagctcctgcgacaggctaaccgatccacatagagcccccagtgacaccggttcactctcaccaccttgggatcaggatagacggatgatgtttcctccaccaggccagagctatcccgattctgccctccccccacagagacaggatcggttttgctccaacagcggacggctctccggaccagcagagttgcggtcattcaatatgccaagcctggacaaaatggacggatcaatgcctagtgagatggagagtagcaggaatgacaccaaggacgatttaggcaacttaaatgtgccagacagtagcttacctgccgagaacgaagccactggaccagggtttgtgccacccccactcgcacccattaggggccccctcttccctgtcgacgccaggggaccatttttgcggcgaggccccccctttccgccccctcctccaggcgctatgtttggggcctcacgggattactttcctccaggggacttccctggaccaccacccgcaccctttgcaatgagaaacgtgtacccacctaggggttttccaccgtacctgcctcctcggcccgggttcttcccaccaccaccacactcggaggggcggtctgagttcccctctgggttgatcccaccatctaacgagcctgccaccgagcaccctgaacctcagcaggaaacatag

SEQ ID NO: 46521 - DNA, 2019 bp, Artificial Sequence
  Description of Artificial Sequence: Synthetic coding sequence
atggagctgaagagccccgaggaggaggtggtggccgccctgcccgagggcatgaggccggacagcaacttatacggatttccatgggagttggtcatttgcgctgcagtcgttggatttttcgccgttctgttcttcctgtggcgctccttccgcagcgtgcgttctcgcctgtatgtggggcgagagaagaaactcgccttaatgcttagtgggctaatcgaggaaaagagtaagctacttgaaaaattctctctagtgcagaaagaagcgacatgcgagaagctgaaccggtccaatagtgaactggaagacgagatcctgtgtctcgagaaggaattgaaagaagaaaaaagcaagcactccgaacaggacgaattgatggccgacatcagcaagcggatacagtcactggaggacgaaagcaagagcctcaagtcgcaggtggcggaggctaaaatgacttttaaaattttccagatgaatgaggagagattgaagatagcaattaaagacgctttaaatgaaaactctcagctgcaggagtcgcagaagcagctcctccaagaagcggaggtgtggaaagagcaggtgagcgaattgaacaagcagaaagtgaccttcgaagacagcaaagtacacgcggagcaggtgctcaatgacaaggaatcccacatcaagactctcacggaacggctgcttaagatgaaggattgggcagcaatgttgggagaggacattaccgacgacgacaacctagagctggaaatgaactctgaaagcgagaatggggcgtacttggataaccctcctaagggcgcactcaaaaaactgatccatgccgccaagctgaacgctagcctgaagacgctagagggcgagcgcaatcaaatatatatacagctctcagaagtagacaagactaaggaggagctgacagaacatatcaagaatctgcaaacagaacaggcgtcactacagtccgaaaacactcattttgagaatgaaaatcagaagctgcaacagaaattgaaggtaatgactgagctgtatcaggagaatgaaatgaaactacacaggaagttgacagtagaagagaactacaggctggagaaggaagagaaattgagtaaggtcgatgaaaagatctcgcacgccactgaagaattggaaacttaccgaaaacgcgctaaggatctggaggaagagctggaacggacaatccacagttatcaagggcaaatcatctcgcatgagaagaaggcgcacgacaactggctagcagcacggaatgctgagagaaacctcaacgatctgagaaaggagaacgcccacaatcggcagaagctgactgagaccgaattgaaattcgaactgttagaaaaggatccctacgcccttgacgtgcccaacactgccttcggcagggagcactccccttacggccccagccccctgggctggcccagctctgaaactcgcgcctttctgtccccccccaccttgctggaggggcctttgagactgtcgccactgctgccgggaggtggaggtcggggctcccgtggccctggcaaccccctggatcatcaaattactaacgaaaggggggagtcttcgtgtgataggctgactgatccccacagggcaccttcagacaccgggtccctgagccccccttgggatcaagatcggcgcatgatgttccccccgcccggccaatcttacccagactctgcactgccaccgcagcgccaggataggttctgctcgaattcgggaaggctgtctgggcccgctgagttacgtagcttcaacatgcccccgggcccaccacctgccccattcgctatgaggaacgtttatcctccccgcggattccctccctacttgccacctcgtccgggtttttttccaccccctcctcacagtgaagggaggagtgagtttcctagcggcttgattcccccttcgaacgagccagccacagaacatcccgaaccacagcaggagacttag

SEQ ID NO: 46522 - DNA, 2430 bp, Artificial Sequence
  Description of Artificial Sequence: Synthetic coding sequence
atggaggagcccggcgtgaccccccagccctacctgggcctgctgctcgaggaactgagacgggtcgtagccgcattgcctgaggggatgcgccctgacagcaatttgtatggctttccctgggagctagtaatctgtgctgccgttgtgggcttttttgccgtgctctttttcttgtggaggagctttagatcagtaaggagccggctgtatgttggaagagaaaaaaagctcgcgctcatgctatctgggttgattgaagaaaaatctaaactgctcgaaaaattttcactggtccagaaagagtacgagggctacgaggtggagagcagcctgaaagatgcttcctttgagaaagaggccaccgaagctcagagcttagaagtggaaaaccaaatggccacttgtgagaagctcaaccgctccaatagcgaactggaagatgaaattttgtgcctggagaaggaactgaaggaagagaagagcaaacattcagagcaagatgagctgatggctgacatctcaaagcgaatccaaagcctggaggacgaaagcaaatctctgaaatctcaagtagctgaggcaaagatgacatttaaaatatttcagatgaacgaagagcggctgaagatcgcaatcaaagacgccctaaatgaaaattcccagctgcaggagtctcagaagcaactgcttcaggaagcagaagtatggaaagagcaggtcagtgagctgaataaacagaaggtcacgttcgaggatagcaaggtgcatgctgagcaggttctcaacgataaagagagtcacattaagaccttaaccgagcggcttctcaaaatgaaagactgggctgctatgcttggcgaggacatcactgatgatgataatcttgaacttgagatgaattctgagtcagagaacggtgcgtatttggataatcctcccaagggtgccttaaagaaactgatacacgccgccaagctcaacgcttcgctgaagacacttgagggtgagcgcaaccaaatttatatacagctgtccgaagtggacaaaaccaaagaagagctgaccgagcatatcaaaaacctccagactgagcaggcgtctttgcaaagcgaaaacacacactttgagaatgaaaatcagaagttacaacagaagcttaaagtcatgaccgagctctatcaggagaacgaaatgaaactgcatcgcaagcttactgtggaagaaaattatcggctggagaaagaggagaagcttagcaaggtggacgaaaagatctctcatgccacagaggagttagagacctatagaaagagagcaaaagaccttgaggaagagctggagagaacaatacacagctaccagggacagataatcagtcacgagaagaaggctcatgataactggcttgccgcacgaaacgctgaacggaatctgaacgacctccggaaggagaacgcacacaacaggcaaaagcttactgaaacagaattaaaattcgagcttcttgaaaaagatccctacgcactcgacgtccccaatacagccttcggccgtgagcatagtccgtatggcccatctcccctgggttggccctcttctgagacacgagccttcttatctccacctaccttattagaaggtccacttcgtctcagtccattactgcccgggggcggaggacgtggcagtaggggacctggaaatcctctcgaccatcagattacgaacgagcgcggtgagagctcatgtgaccgcctgacagatccccatcgcgccccaagcgataccggctctctcagcccaccctgggaccaagatcgacgcatgatgtttccacccccagggcaatcatatcccgacagtgcacttccaccccagcgtcaggatcgtttctgttcaaatagcggccgactcagcggcccggctgaactgagaagttttaacatgccctcactagataaaatggatggaagcatgccctccgaaatggaaagcagccggaatgacaccaaagacgacctgggaaacctcaatgtgccagattcatcactgcctgctgagaacgaagctacgggcccaggctttgtaccaccaccactggctcctattaggggacccctgtttccagtcgatgcaagggggccattcctgcgaagaggtcccccatttcctccacctccccccggagcaatgttcggggcctcaagagattactttcctcctggtgactttcccgggccgccgccagccccctttgcgatgagaaatgtgtaccctccaaggggtttccctccttacctgcctccgagacccggctttttcccacctccgcctcactctgagggccgctctgagtttccctccgggttaatcccaccttcgaatgaacccgcaaccgaacaccccgagccacagcaggagacatag

SEQ ID NO: 46523 - DNA, 2328 bp, Artificial Sequence
  Description of Artificial Sequence: Synthetic coding sequence
atgcggcccgacagcaacctgtacggcttcccctgggagctggtgatttgtgctgcagtggtgggttttttcgccgtgctgttcttcctttggagatcctttagaagtgtgcggagccgtctctatgtgggtcgagaaaagaagcttgctctgatgcttagcggcctcatcgaagaaaaatccaaattactggagaaattctcactggtccagaaggagtatgaaggctacgaggttgaatcaagtctgaaggatgcatccttcgaaaaagaggccactgaggcgcaatccttggaggcgacctgcgagaaactgaatcggagcaactcggaactggaagatgagatcctgtgtctggaaaaagagctcaaagaagaaaagtccaagcattccgaacaggacgaactgatggccgacattagtaaacgaattcaatctttggaggatgagagtaaatctcttaagagtcaagtagctgaagctaaaatgactttcaagattttccagatgaatgaagagcggctgaagatcgccatcaaggatgccctcaacgagaacagtcaactccaggagtcccagaaacaactcttgcaggaagctgaagtgtggaaggagcaggtgtccgaactgaacaaacagaaggtaacattcgaagacagtaaggtgcatgctgagcaggtgctcaacgataaggagagtcatatcaagacgctgactgaaaggttgcttaagatgaaggactgggctgcaatgctgggagaggacattactgatgatgacaatctggagttggagatgaatagcgaatccgagaacggtgcatacctggataatcctcctaagggcgcccttaagaagctgatccacgctgccaagttaaatgcctccctgaagaccctggaaggtgagaggaaccagatctacatccaattgtctgaggtcgataagaccaaggaggaactgacagagcacatcaaaaacttgcagactgagcaagcaagcctgcagtccgagaatacgcacttcgaaaatgaaaaccaaaagttgcagcagaaactgaaggtcatgacagaactgtaccaagagaacgaaatgaagttgcatcggaaacttactgttgaagagaactaccgactggaaaaggaggaaaaacttagcaaggtggacgagaaaatcagtcacgctaccgaagagctggagacctaccggaagcgtgctaaggatctcgaggaagagcttgaacgcacaattcactcctaccaggggcaaataatttctcacgagaagaaagctcatgataattggctggctgctagaaacgcggaaagaaacctcaacgaccttcgcaaggagaatgcacacaatcgacaaaagctaaccgagacggaactgaagtttgaattgttggaaaaggacccgtacgctctggacgttcccaacactgcattcgggcgggagcacagcccttatggcccctccccactgggatggcccagctctgagactcgggcgttcttgagcccccccaccctgctggaggggcccctgcgcctttccccacttctgcctggggggggtgggcggggctcacgcggcccgggtaaccccctggaccatcagatcactaacgagagaggagaaagcagctgcgataggttgacagatcctcatcgggccccctcagacactggctcactgtcgcctccctgggaccaggaccgcaggatgatgtttccacctcctggacaatcttacccagattctgctttaccgccccagagacaggatcggttttgctcgaacagtggaaggctatcagggccggcagaacttagatcttttaacatgccctccctcgataaaatggacggttctatgccctctgagatggaatcaagcagaaacgatacaaaagacgacctgggcaacctgaacgtgcctgattctagtcttccagcagagaacgaggcaacagggcccggctttgttccaccacccctcgctccaatccggggaccactctttcctgtagacgctcgggggcctttcctgcgtcgtggcccgccttttcctccgcccccacctggtgccatgtttggcgcctcccgcgattactttccacccggagacttcccgggtccgccaccagcgccttttgcaatgagaaacgtgtatccacctaggggtttccctccatacttgcctccacgtcccggtttctttccccctccgccccacagtgaggggcgctccgagttcccgtccgggcttatccctccttccaatgagcccgcgaccgaacatccggagccccagcaggagacctag

SEQ ID NO: 46524 - DNA, 1401 bp, Artificial Sequence
  Description of Artificial Sequence: Synthetic coding sequence
atgcggctgcggacccggaaggccagccagcagagcaaccagatccaaacccagaggaccgcacgtgccaagaggaagtactcggaggtggacgactcgcttccaagcggcggggagaaacctagcaaaaacgaaaccggtctgctctcttctattaaaaaattcataaagggcagcacgcccaaggaggaaagagaaaacccgtccaagaggagtagaatcgagcgcgatatagataataacctcatcacaagcacccctagagccggtgagaagccaaataaacaaatctcccgggttcgccggaaaagccaggtaaacggggaggcaggtagctacgaaatgacaaaccagcacgtgaagcagaacggcaaactggaggacaaccctagctctggatctccacctcggaccacgctcctggggacgattttctctccggtgtttaatttcttttccccagcaaacaagaatggcactagtggaagcgattcccccgggcaggccgtggaggcagaagaaatcgtgaagcagctggatatggagcaagtggatgaaattacaaccagcaccactacttccacaaacggtgcagcatatagcaaccaggcagttcaggtgcgaccatctctaaataacggcctcgaggaggccgaagagactgtgaacagagacattccccccctaacggctccagtcacgcccgactccggatactcctctgcacatgcagaggctacctacgaagaggattgggaagtgttcgatccgtactattttattaagcacgtcccaccgctgaccgaagaacagctaaaccggaagccagccctgcctcttaagacccgatccacccctgaattttccttggtgttagacttggatgaaacactcgtccattgttcactgaacgagttagaggacgccgcattgactttcccagtgctttttcaagacgtcatctaccaggtatatgtgaggctccggccattttttagggaatttctcgagagaatgtcacagatgtatgaaattattctttttactgcctccaagaaggtgtacgccgacaagcttttaaatatactcgatcccaaaaaacagttggtgcggcaccggttgttccgagagcactgtgtgtgtgtgcagggaaactacatcaaggaccttaatatattgggtagggacctgtccaagacaattattatagataattctcctcaggctttcgcatatcagctctccaatggtatccctatcgaatcctggttcatggacaagaatgacaatgagttgctgaagttgatccccttcctggaaaaactggtagaacttaacgaggacgtgcgcccccatattagggatcgtttccgcttgcacgacctcctcccacccgattag

SEQ ID NO: 46525 - DNA, 1185 bp, Artificial Sequence
  Description of Artificial Sequence: Synthetic coding sequence
atgcggctgcggacccggaaggccagccagcagagcaaccagatccagacacagcgcacagcccgcgccaagcgtaagtactcggaagtggatgacagcctcccaagcggtggagagaaaccttcgaagaatgagaccggtttactatccagtattaagaagttcatcaaaggatcaacgcctaaagaggaaagagagaacccgtccaagcgctctcgtattgagagggacattgacaataatctgatcaccagcacgccacgggctggagaaaagccaaacaaacagatatccagggtacgacggaagtcacaggtcaatggcgaagccggctcctatgagatgacaaaccagcatgttaagcaaaacggaaaattggaggataacccttcttccggcagtccccctcgaacgaccttgctgggcaccatcttctcaccagtgtttaatttttttagcccagccaacaaaaatgctcctgtgacgcctgatagcggctacagcagcgcccacgccgaagccacatatgaggaagactgggaggtcttcgatccttactacttcatcaaacacgtcccaccactgactgaagagcagcttaatagaaaacccgcccttcctctgaaaacacgcagtaccccagaattctcactggtccttgacctggatgagacgcttgtgcattgcagcctcaatgaattagaggacgcagccctgaccttcccagtcttattccaggatgtcatttatcaggtttacgtgaggcttagacccttcttcagggagttcttagaaagaatgtctcaaatgtacgaaataatcctatttaccgccagtaagaaagtctatgctgacaagcttttaaacattctggaccctaagaaacagctagtccgccaccgcctgttccgggagcattgtgtgtgcgttcagggcaactatattaaagacctgaacattttgggcagagacttgagtaaaacaatcatcatcgacaactccccgcaggctttcgcttatcagttgagcaacgggattccaatagaatcctggttcatggacaagaatgataatgaacttctgaaactgatcccattcctcgagaaacttgtggagcttaatgaggacgtgcgccctcacatcagggaccgcttccgcctgcatgatctgctgccgcctgattag

SEQ ID NO: 46526 - DNA, 1185 bp, Artificial Sequence
  Description of Artificial Sequence: Synthetic coding sequence
atgcggctgcggacccggaaggccagccagcagagcaaccagatccagacccagaggacagcccgagccaagagaaaatacagtgaggtcgatgactcactcccttcaggtggtgagaaacccagcaagaacgagactggactgctgtcctccatcaaaaagtttattaagggtagtacgcccaaggaggaacgggaaaatccaagtaagaggagccgaattgaacgagatatcgacaataatctcattacctccacccctcgtgctggcgaaaaacccaataagcagatcagtagagtcagacggaaatctcaggtgaatggggaagcgggatcctacgagatgaccaaccaacacgtgaaacagaatggaaagctggaggataaccctagtagtggtagtcctccccgtacaacacttcttggaaccattttctctcccgtcttcaacttcttttctccggccaataagaatgctcctgtgactcctgattctggctactcaagcgcgcacgcagaggcaacctacgaggaggactgggaggtctttgacccctactatttcattaagcacgtgcctccactaaccgaagagcagcttaatcgcaagcccgccttgcccctaaagacacgctctaccccagagtttagcctcgtcttagatctagacgagaccttggtccactgttctctcaatgaactcgaggatgcagcactgacctttcctgtgctgttccaagatgtgatttatcaagtgtacgtgcggctgcgacctttcttcagagagttcttggagcgaatgagccagatgtatgaaatcattctgttcactgctagtaagaaggtgtacgctgacaaactgttgaacattcttgatccaaagaagcagctggtgaggcacagactgtttagggaacactgtgtgtgtgtccaggggaactatatcaaagacctgaacatcctcggccgagatttgagtaaaactatcatcatcgataacagcccacaggcttttgcctatcagctgagtaatggtatccccatcgagtcatggttcatggataaaaatgataacgaactgttaaagctaataccctttttggaaaaacttgttgagctcaacgaggacgtgcgcccacatataagagatcggtttagacttcatgatctgctgccccccgactag

SEQ ID NO: 46527 - DNA, 498 bp, Artificial Sequence
  Description of Artificial Sequence: Synthetic coding sequence
atgcggctgcggacccggaaggccagccagcagagcaaccagatccaaacacagagaacagcccgcgctaaaaggaagtatagtgaagtggatgactctctcccctccgggggagagaagcccagtaagaatgagactggcctcctgtcctccattaaaaagtttatcaagggttccacacccaaagaggagagagaaaacccatcaaagcgctccaggattgagagggacatagacaataatctgataacttcaaccccacgtgctggggaaaagcctaataagcagatctcacgcgtcaggaggaaaagccaagtgaatggcgaggcaggctcgtacgaaatgacaaaccagcatgtgaagcagaatgggaagctggaagacaacccctcgtcgggtagtccacctagaacaactctcttgggaaccattttctcccctgttttcaactttttttcacctgcaaacaaaaacggtacctctggctcggattcctag

SEQ ID NO: 46528 - DNA, 1401 bp, Artificial Sequence
  Description of Artificial Sequence: Synthetic coding sequence
atgcggctgcggacccggaaggccagccagcagagcaaccagatccaaacccagcgaaccgcccgcgccaaaagaaagtattccgaggtggacgacagcctaccatccggcggcgagaaaccttcgaagaatgaaaccgggctgctgtcaagcataaaaaagttcatcaaggggagtaccccaaaggaagagagagagaatcctagcaagcggtcgcggattgaacgagacatagacaataatctcatcacttctacacctagggccggggagaagcctaataaacagatctccagagtgcgcaggaagtcacaggttaatggcgaggcaggaagctacgagatgacgaatcagcatgttaagcagaacggtaagctcgaggacaatccgtccagtggctctcccccaagaacaacactgctaggcactattttcagtccggttttcaatttcttttctccggcaaataagaacggaactagtggcagtgatagcccagggcaagcagtggaagctgaggagattgtcaaacagctcgatatggagcaggttgatgagattactacctcgactacaacatctacaaatggcgccgcctactctaaccaagctgttcaagttaggcctagtcttaataatggcctagaggaggcggaagaaactgtcaatagagatatccctcccctgaccgccccagtcacacctgattccgggtactcctctgcccatgcagaagcgacttatgaggaggactgggaggtctttgatccctactacttcattaagcacgtgcctccactgacagaagagcagctcaatagaaagccagcgctgccactaaaaacccgatccactccagagttttccctcgtgctggacttggacgagacccttgtccactgttccttgaatgaactcgaggacgccgcactaaccttcccagtgctcttccaggatgtgatctaccaggtctatgttcggcttagacccttttttcgcgagttcctggaaagaatgtcgcagatgtacgagatcattctgtttaccgcctccaagaaagtgtacgcagacaaactgcttaacatcttggatcctaagaaacagctcgtccgccatcgtctgtttagagaacattgcgtgtgcgtacagggaaactacattaaggacctgaatattctggggcgggatctgtccaagaccatcatcatcgacaactctccccaggcttttgcttatcagctgagtaatggcatcccgattgagagttggttcatggataaaaacgacaatgagctgctgaaactgatcccttttttagaaaaattggtggaattgaacgaggatgtccgcccacatatcagggatagatttagactccacgacctgctcccaccagattag

SEQ ID NO: 46529 - DNA, 279 bp, Artificial Sequence
  Description of Artificial Sequence: Synthetic coding sequence
atgcggctgcggacccggaaggccagccagcagagcaaccagatccagactcagcgcacagcccgggccaagagaaaatattccgaggtggatgattccctgccctcagggggcgaaaagccttccaagaacgaaactggcctcctgtcatcaattaaaaaatttatcaaggggtcaaccccgaaagaggagcgcgaaaatccaagtaagcgatcgagaatcgaacgtgacatagacaataacctgatcacatcaacccctagggcgggagagaaatag

SEQ ID NO: 46530 - DNA, 354 bp, Artificial Sequence
  Description of Artificial Sequence: Synthetic coding sequence
atgcggctgcggacccggaaggccagccagcagagcaaccagatccagacccagaggacggcccgcgctaagaggaagtactctgaggtcgacgacagtctgcccagtggcggtgagaagccctccaagaacgaaactggattgctgtccagtatcaagaaattcattaaggggtctacacctaaggaggagcgggagaacccttccaaacggagccgaatagaaagggacattgataacaatcttatcacttccacccctagagctggagaaaagcccaacaagcagatctcaagagtgcgacggaaatcccaggtgaatggtgaggccgggagctacgagatgactaactag

SEQ ID NO: 46531 - DNA, 522 bp, Artificial Sequence
  Description of Artificial Sequence: Synthetic coding sequence
atgggcgacctgccctgggccccccccgaggcccaggcccccagcaccgccggggcaggggacgtggcagagcatcaggtcgctccagcaagattcctgcagggagcttggcgccaggcagctggttggttatgccgggaaaccggggctgcgcccgggagcgctcaggctggccctccagagaccgcgcacgcggctgaccctcaaccccgggggccccaggcaccccccaggctgccgcctagtttatcccccgagagggttcacccaggtcagcccgctgccccagccgagccagccccaggagcgcccgctttaaggtcaggacctagtcaacctaggggtctaagactccccgtccctgtgcctgcctgtgcgggcagtagcgctcccgggtccccagccgcactgcctgactcctacccatggccccctcccgcgagaaatcggccagccactctgcccccaacctcacgagtgtctcctctggctgcatttcttgcttctgcacctcaaagatag

SEQ ID NO: 46532 - DNA, 252 bp, Artificial Sequence
  Description of Artificial Sequence: Synthetic coding sequence
atggccagcacccccatgggcaacgagggcgagaagaagagcagctggccttcccaagctgctccaagcctgaggggcggacctgcgagccttagccggagcgaagagtacctgtcacagattagcgccgagctgatggaggaggcactatgcaccgcctgttgccatctgaatccggtccccatcaaaaaaaagcagagtcaggaccaggctacccagatctcaaagcgcgccttcttcaccaaaacttag

SEQ ID NO: 46533 - DNA, 606 bp, Artificial Sequence
  Description of Artificial Sequence: Synthetic coding sequence
atgttcctggtggtggccgtgaacagcctgaccctgtaccagccctctttcaggccattactgggcgacgcctgctgcctctgtgtcgccgcggcggcaggtgccctttgccgtgacctaggacctcaccacacgcacacacgggggccaaatgatggttcatgcggtctgtcacggtggcggcatcgacagcacggtgactcaccagaggacttcttcctggcccggggtgcgcatctagctagcacccgaggaaggaatgaacactcgccgaagggttctttgcaaaagtgcctgctctctatccgagtgcagaccacccggctgtcccatctacgcgcaggtgtcactctgcgatgcgtgctgctgtgcgtgagcgagagtccagtgggcctgcgctctgtggcatgctcaggcgatctcttgggtgatcccctgaccggattcctcgcttttctggtcagctgcctgaccccttctggaacaccgggcaacacgtctctcactaaactcagccctacctctagctctcaggggctggcattaggtcctctctctcccagctcttgtgacgccgccagtccatccatctctctcggcttgtag

SEQ ID NO: 46534 - DNA, 645 bp, Artificial Sequence
  Description of Artificial Sequence: Synthetic coding sequence
atggagcccgcccgggagccccccagccgggcccggccccccccccccctggcagcgagacctgcgcctgctcctgcggcccctagacccaggtccccagctgaagcagaggctcggggacctgagggtctgctaaggcgctctggaagcggctacgagggatccacaagttggaaggccgcattggaggacactacaactcgcctgctcctcggagctattgcggtgctgttgttcgccattctggtggtcatgagtatcctggccagcaagggttgtattaagtgcgaggctccttgtcccgaggattggctgctgtatggacggaagtgctacttcttctccgaggaaccccgggactggaacacaggccggcaatactgtcatacccacgaagcagtattagcggtgatccagtcccaaaaggaactggagtttatgtttaagtttaccagaagagagccttggattggacttaggcgggtgggggatgaattccattgggtgaatggagacccatttgacccggatacatttaccattgccgggcccggagagtgcgttttcgtggaacccactcggctggtctcaaccgagtgcctaatgacccggccttgggtttgttcgaagatggcctacacatag

SEQ ID NO: 46535 - DNA, 1824 bp, Artificial Sequence
  Description of Artificial Sequence: Synthetic coding sequence
atggagctggtgcggcggctgatgcccctgaccctgctgatcctgtcctgtctggccgaactgacgatggccgaggctgaggggaacgcctcctgcacagtgtcccttggtggggccaatatggccgagacccataaggcaatgatactgcagctcaacccttcagaaaattgcacgtggactatagagaggcccgagaacaagtctattaggatcatcttctcctatgttcagttggatcccgacggaagttgtgagagcgagaacataaaagtgtttgacggcacctcctccaacgggcccctgctgggccaggtgtgcagcaaaaacgattacgtgccggttttcgagagcagctcctcaactctcacatttcagattgtgaccgattctgccagaatccagcgcaccgttttcgtgttctactactttttcagcccgaacataagcattccgaactgtggcggctacctggacaccctggagggatcctttacatcacctaattaccctaaaccacatcccgaactcgcctactgcgtctggcatattcaggtagaaaaggattacaaaattaagcttaattttaaggagatcttcttggaaattgacaagcagtgcaagttcgactttttagctatctacgacggtccaagtaccaactccggcctcattggtcaagtctgtggacgcgtgacgcctactttcgaaagctcgtctaatagtctgacggtagtgttgagcaccgattacgccaattcctatcgtgggttttcagcatcctataccagcatttacgccgaaaacatcaatactacctcactgacctgcagctccgaccgcatgcgggttatcatctctaagtcttacctagaagccttcaattcaaatggaaacaatctccagctcaaggatcctacctgcagaccaaagttgagtaacgtcgttgagttctcagtgcctcttaacggctgcggtactatccgcaaggttgaggaccagagcatcacctatacgaatattatcaccttctccgcctctagcacatcagaggtgattacgcgtcaaaagcagttgcagattatagtgaagtgcgagatggggcacaactcaaccgtagagatcatttatatcaccgaagatgacgttattcagagtcagaatgcacttgggaagtacaatactagtatggccttattcgaatctaacagttttgagaagacgatccttgaaagcccctattacgtggacctaaatcaaactctgtttgtgcaggtcagtctacatacctccgatcctaacttagtggtgtttttggacacatgccgcgcatcacctacctccgactttgcctcccctacttacgatctgatcaagtcaggctgcagtcgagacgagacatgtaaggtctatcccctttttggccattatggccgattccagtttaatgccttcaaattcctacgttctatgagtagtgtgtatttacagtgcaaagtgctgatctgtgactcctcggatcatcagagtcgctgcaaccagggctgcgttagcagatctaaaagggacatttccagctacaagtggaaaactgattctattattgggccaatcaggctgaagagagatcgaagtgcaagcggaaattctggcttccaacatgaaacccacgctgaggagacccccaaccagccatttaactcagttcatttattctctttcatggtgctagcactgaacgtggttacggtggcgaccattaccgtacggcattttgttaaccaaagagctgactacaagtaccaaaaactccagaactactag

SEQ ID NO: 46536 - DNA, 1824 bp, Artificial Sequence
  Description of Artificial Sequence: Synthetic coding sequence
atggagctggtgcggcggctgatgcccctgaccctgctgatcctgtcatgtctggcggaactaacgatggccgaagccgaagggaacgcctcatgtacagtgtccctcggcggtgccaacatggcagagactcataaggccatgattcttcagctcaacccgtccgaaaactgcacctggaccattgagaggccagaaaacaaaagtatcaggattattttttcatacgtacagcttgaccccgacggctcctgtgagagcgagaatatcaaggtctttgacgggacatcctcaaacggccccttgctcgggcaagtatgcagtaagaatgattacgtacctgtgttcgagagctctagcagtaccttgaccttccagatcgtgaccgactctgctagaatccagcgcacggtatttgtgttttactatttcttcagcccaaacatttcgatacccaactgcggaggatacctggatactctggagggctccttcaccagcccgaattaccccaagccccacccagagctagcatactgcgtatggcacatccaggtggagaaggattataaaatcaagctgaacttcaaagaaatctttctggagatcgacaaacagtgcaagttcgattttctggcaatctacgatggaccctctaccaattccggtctcatcggacaagtttgtggccgagtaactccaacatttgagagcagcagcaattctctgactgtggtcctgagcacagactatgctaatagctacagagggttttccgcaagttatacgtctatctacgcagaaaacattaataccacctcactcacctgtagcagcgacagaatgcgtgtcatcatctccaaatcatacctggaagcctttaactctaacggaaataacctgcagctcaaagacccgacttgcaggcctaaattgtccaatgtcgttgaattcagcgtgcccctgaatggatgtggaactattaggaaggtggaggatcagtctattacctatactaatatcatcaccttctccgccagcagcactagcgaagtgatcacccgccaaaaacagctgcaaatcatcgtgaagtgcgagatgggacacaacagcacggtggaaatcatctacattactgaggatgacgtaatccagtcacagaatgccctgggaaagtacaacactagtatggccttgtttgaaagtaattcatttgaaaaaaccatcctcgagagcccatactacgtcgaccttaatcagaccctgtttgtgcaagttagtctacacacttccgacccgaaccttgtggtgtttttggacacgtgcagggcgagtcccacaagcgatttcgccagtccaacctacgacttgatcaaatccggctgctcacgggacgagacatgcaaggtctaccctttgtttggccactatggacgcttccagtttaacgccttcaaattcctgcggagcatgagtagcgtataccttcaatgtaaagtactcatttgtgatagctctgaccaccagagccggtgcaatcaaggctgtgtgagccggagcaagagagatatttcgtcttacaaatggaagaccgatagtatcattggccctatcaggctaaaacgggacaggtcggcatccgggaattcaggcttccaacatgagacccacgcggaggaaacccctaatcagccgtttaactccgtccatctgttctctttcatggttctcgctctcaacgtcgtgacggtggcaaccataaccgtcaggcattttgttaaccagcgggcggactacaaataccagaaactccagaattactag

SEQ ID NO: 46537 - DNA, 1161 bp, Artificial Sequence
  Description of Artificial Sequence: Synthetic coding sequence
atgaccagcctgttccggcggagcagcagcggcagcggcggcggcggaacggctggggccaggggcggtggcggtggcaccgccgcacctcaggagttaaacaattcccggcctgcgaggcaggttaggcgactcgaatttaaccaggccatggacgatttcaaaactatgttccccaacatggactatgatatcatcgagtgtgtgttacgcgctaactccggggctgtggacgctaccatcgatcagctcttacaaatgaaccttgagggcggggggtccagtggaggcgtgtatgaagattcctcagatagcgaagactcaatccccccagagatcttagagaggacactcgagcccgattcctcggatgaagaacccccacccgtttactcccctcccgcctatcacatgcacgtctttgatcggccataccctctagcacctcctactccccccccccgaatcgacgccctgggaagtggcgcaccaacctcccagaggcgttataggaactggaaccctcccctattgggcaacctgcccgatgacttcctgcgcatcctgccccagcagttggatagtattcaagggaacgctgggggccccaagcccgggtccggggaaggatgcccccccgctatggctggacctggccctggggatcaagaaagcagatggaagcagtaccttgaagacgagagaatcgccctgttcctgcagaacgaagaatttatgaaggaactgcagaggaatcgggactttctcttggcactcgagagagaccgattgaagtacgaatcccaaaagtccaaatctagttcggttgccgtgggaaatgacttcgggttcagtagtcctgtgcctgggacaggcgatgctaaccctgcagtgagcgaggacgccctgtttcgagacaaactcaaacatatggggaagagtacaagaaggaaacttttcgaactggcaagagccttttctgaaaagacgaagatgcggaaatccaagaggaagcacctgctgaagcatcagtctctaggagccgccgcctctactgccaacctgttggatgatgtggaaggacacgcttgcgatgaggatttccggggaagaaggcaggaagcaccaaaagttgaagaggggttgagggagggacagtag

SEQ ID NO: 46538 - DNA, 1161 bp, Artificial Sequence
  Description of Artificial Sequence: Synthetic coding sequence
atgaccagcctgttccggcggagcagcagcggcagcggcggcggcggtacggctggcgcccgcgggggtgggggcggaacagccgcacctcaggaactgaataacagccgacctgcccggcaggtccggcgtctggagttcaaccaggccatggatgactttaagacaatgttcccgaatatggattatgacatcattgagtgtgtgctgcgcgccaatagtggtgccgtggacgctacaatcgatcagctgctccagatgaatctggagggcggtggctcgagcggcggggtgtacgaagactcctcagatagcgaagacagcattccccctgaaattctggagaggaccctcgaaccagactcgtcagacgaagagcccccaccagtttactcaccaccggcatatcacatgcatgtttttgacagaccttatcctttggctccaccaacaccacccccgcggatcgacgcactgggctcaggagctcctacaagtcaacggcgctatcgcaactggaatccaccacttctaggcaaccttcctgacgattttctccggatcctgcctcagcagctggattctatccaaggtaatgccgggggtcctaagcctggctccggtgaagggtgtccccccgcaatggcagggccaggacccggagaccaggaaagcagatggaagcagtacctggaggacgaacggattgcactttttctccagaatgaggagttcatgaaggagctgcagcgaaaccgggacttccttttagcgctcgaaagagatcgcctgaagtacgaaagccagaagagtaagtcgagcagtgtcgccgtcggaaatgatttcggcttctcgtctcccgtgcctggtacaggggacgcgaaccccgccgtgtctgaggacgcactgttccgtgacaagctaaagcacatgggaaaatccacgcgaagaaagctgttcgaacttgcccgcgctttttccgaaaagaccaagatgcgcaaaagcaagagaaaacacctgctgaaacaccagtccctgggtgcagccgctagtacagcaaacctgctcgatgacgtagagggccatgcctgtgatgaagacttccgtggacgaaggcaggaagctcccaaggtggaggaaggtctgcgtgaaggccaatag

SEQ ID NO: 46539 - DNA, 471 bp, Artificial Sequence
  Description of Artificial Sequence: Synthetic coding sequence
atgcccgccctgctgcccgtggccagccggctgctgctgctgcccagagtgctcctcaccatggcatccggatctcctccaacccagcccagccccgcatccgacagcggatccggctatgtcccgggctctgtgagcgctgccttcgttacctgcccaaatgaaaaggtcgctaaggaaattgcccgcgctgtagtggaaaaacggttggctgcctgtgtgaacctgattccccagatcactagtatatacgaatggaagggaaaaatcgaagaggatagcgaagtcctcatgatgattaagactcagtcctctctggtgcccgcgctcactgatttcgttcgcagtgtgcacccttatgaggtcgcggaagtcatcgccctaccagtggaacagggcaattttccatatctgcagtgggtgcgccaggtgactgagtcggtctctgattccattacagtcctcccttag

SEQ ID NO: 46540 - DNA, 597 bp, Artificial Sequence
  Description of Artificial Sequence: Synthetic coding sequence
atgatcggcagcggcctggccggcagcggcggcgccggcggcccctcctccacggtgacatggtgcgctctgttttccaatcacgtcgccgccacacaggccagcttgctcctgagttttgtgtggatgcccgccttgctccccgttgctagtcggctgctgctccttccgagggtgcttctaaccatggcgagcggctcaccccctacccaacctagccccgcgagcgactcaggaagcggctatgttcccggatccgtttctgcggccttcgttacctgtcctaatgagaaagtcgctaaggagatcgcacgtgcggtcgtggaaaaacgactggccgcatgtgtgaatttaattccacagatcactagcatatacgaatggaaagggaaaatcgaagaggactcagaggtgctcatgatgataaagacacagtccagtttagtcccagcactgactgactttgtccgttccgttcacccatatgaagttgcagaagtgattgcactcccagtggaacagggtaactttccctacctacagtgggtgcgacaggtgacagagtcagtgagcgatagcatcacagtcctgccatag

SEQ ID NO: 46541 - DNA, 471 bp, Artificial Sequence
  Description of Artificial Sequence: Synthetic coding sequence
atgcccgccctgctgcccgtggccagccggctgctgctgctgcccagagttctgttgacaatggcttctgggagccctcccactcaaccgagtcctgcttccgactccgggtctggatatgtacccggcagtgtaagcgccgcattcgtgacttgcccaaacgagaaagtggccaaggagatcgcccgcgccgtagtcgagaaacgtctcgccgcctgcgtgaacctgatccctcaaattacgagcatatacgagtggaagggaaaaattgaagaggacagcgaagttctgatgatgatcaagacgcagtcctcacttgtgccagctcttacagacttcgtcagatctgtgcacccatacgaggtggccgaagttatagcgctgcctgtggagcaaggaaactttccctaccttcagtgggtacggcaagtcactgagagcgtctcagactctattactgttctgccttag

SEQ ID NO: 46542 - DNA, 540 bp, Artificial Sequence
  Description of Artificial Sequence: Synthetic coding sequence
atgagcggcggccgggcccccgccgtgctgctgggcggcgtggcctctctgctgctttcttttgtctggatgcccgctctgctgcctgtggcgagtcgcctattgttactgcctagggttctcttaactatggcctccgggagcccccctacacagccttcccccgcatcagactctggttccggttatgttccaggctccgtgagtgcagccttcgtgacttgcccgaacgagaaagtggcaaaggagatcgcacgggccgtggtcgagaaacgacttgccgcatgcgtgaacctgattccccagattacctccatatacgaatggaagggcaaaattgaggaggactcagaggtgttgatgatgatcaagactcagtcctcactggttccagccctaaccgatttcgtacgctccgttcatccgtatgaggtagcagaggtgatagctctacctgtggaacagggaaattttccctacctccaatgggtgcggcaggtaactgaatctgtgtccgatagcatcaccgtcctgccttag

SEQ ID NO: 46543 - DNA, 540 bp, Artificial Sequence
  Description of Artificial Sequence: Synthetic coding sequence
atgagcggcggccgggcccccgccgtgctgctgggcggcgtggccagtctgttgctgtccttcgtgtggatgcccgccctgttacccgtggctagcaggctcctgctgctgccacgggtcttgctgacaatggcatcagggagtccacccacgcaaccatctcccgcgtccgattcagggtcagggtatgtgccaggcagtgtctccgctgccttcgtgacctgtcctaatgaaaaggtcgctaaggagatcgctcgggccgtggttgagaaacgtctcgcggcctgcgtcaacctcatcccgcagattaccagcatttacgaatggaaggggaaaatcgaggaggactcagaagtccttatgatgatcaagactcagagctctttggtcccggccttgaccgattttgtgagatcggtgcatccctacgaagtggccgaggtgatcgccttgccagtggagcagggaaattttccataccttcaatgggtcaggcaggtgacagagagcgtgtcggattccattaccgtacttccttag

SEQ ID NO: 46544 - DNA, 129 bp, Artificial Sequence
  Description of Artificial Sequence: Synthetic coding sequence
atgagcggcggccgggcccccgccgtgctgctgggcggcgtggtgtccgacagaccacgccccgcgccatcaggccccaggtcacttgataggtatccccacccaaagtctcagagattggcaccctag

SEQ ID NO: 46545 - DNA, 690 bp, Artificial Sequence
  Description of Artificial Sequence: Synthetic coding sequence
atgaccaccgccgcccggcccaccttcgagcccgcccggggcggcagagggaaaggagagggcgatttaagtcagctttcgaaacagtatagttctagagacctgccatcccataccaaaatcaaatataggcaaaccacccaggacgcacctgaagaagtgcgtaatcgcgattttcgcagggaactggaggaacgagagagagcagcggctcgggagaaaaacagggatagaccgacgcgggaacatacgacctcctcctccgtttcaaagaaaccacggttagaccagattcccgctgccaacttggacgctgacgatccactgaccgatgaagaagacgaggacttcgaagaagagtctgatgacgacgacactgccgccttactggccgagctcgaaaaaataaagaaagaaagggctgaagagcaggcccgaaaggaacaagaacaaaaagctgaggaagagcggatcagaatggaaaatattttgtcgggcaatcccttgctaaatctgaccggaccctctcaaccccaggccaatttcaaagtgaagagacgctgggatgatgatgtggtcttcaaaaattgcgcaaagggggtggatgaccagaagaaagataagagattcgtgaacgatactcttcggtcagaattccacaagaaattcatggaaaaatatataaaatag

SEQ ID NO: 46546 - DNA, 618 bp, Artificial Sequence
  Description of Artificial Sequence: Synthetic coding sequence
atgagcatcatgagctacaacggcggcgccgtgatggccatgaagggcaaaaactgtgtcgcaatagccgcagatagaaggtttggcatccaggcccaaatggtgaccacagacttccagaagatctttcctatgggtgatcgactttacatcggcctggcgggtctggcaactgacgtacagactgtggcacagcgcctcaagttcaggctgaatctctatgagctgaaggagggccgccagatcaaaccatacaccctcatgtccatggtggctaacctgctatacgagaagcgtttcgggccctactacacagagcctgttatcgccgggcttgaccccaagacgttcaagcctttcatatgtagcctcgatctgatcggctgcccaatggtcacagatgacttcgtggtgagtggtacctgtgccgaacaaatgtacggaatgtgtgagtccctgtgggaacctaacatggacccagatcacctctttgagacgatctcgcaagctatgttaaatgcggtggaccgggacgccgtatcagggatgggagtgatcgttcacattatcgaaaaggataagatcaccacccggacattaaaagcgagaatggattag

SEQ ID NO: 46547 - DNA, 1089 bp, Artificial Sequence
  Description of Artificial Sequence: Synthetic coding sequence
atgaagaaggaggagaagctggactggatgtaccagggccccggcggcatggtaaacagagacgagtatctgctcggcaggccgattgataagtatgtcttcgaaaagatggaggaaaaagaggccgggtgttcctcagagacgggcctcttgccaggatctatctttgcaccaagtggtgcgaactctctgctcgatatggcgtcaaagatacgtgaggatcccctgttcataattaggaagaaggaggaggagaagaaaagagaagtgctcaacaaccctgttaagatgaagaagatcaaagaactgctacagatgtccttagagaagaaagagaagaagaagaagaaagagaaaaagaaaaagcacaagaagcacaaacatcggtcatctagctcagaccggtcctcaagtgaagatgagcacagtgcaggcagatctcagaagaagatggctaacagcagcccagtgttgtcaaaagtccctggttacggactgcaagttcggaactcagataggaatcaagggctccagggcccgcttaccgccgaacaaaaaaggggacacggaatgaagaatcattctcgcagccgctcaagctcacatagtccccccagacacgcatctaagaagtccaccagggaagccggatcacgcgatcggaggtcaagatccctgggacggcggagccgctcgcctaggccgagtaagctgcataattccaaagtcaataggagagagactggtcagacacgttccccctcgccaaagaaggaggtgtaccagcgccggcacgcacccggctacaccaggaagttgtctgccgaagagctggagagaaagcggcaagaaatgatggagaacgccaaatggcgggaagaagaacgcctgaacattctcaaacgacatgcgaaggatgaggagagagaacaaaggcttgaaaagttggattccagagacggaaagttcatacacagaatgaagctggaaagcgcgagcacctcctctttagaggacagagtgaaaagaaacatctatagcctccagagaacttctgttgcactcgagaaaaattttatgaagcgctag

SEQ ID NO: 46548 - DNA, 1617 bp, Artificial Sequence
  Description of Artificial Sequence: Synthetic coding sequence
atggcccagaagcccctgcggctgctggcctgcggcgacgtggagggaaaatttgacatactatttaatagggtgcaggctatacagaaaaagtcaggcaatttcgatttattactgtgcgtgggaaacttctttggctctacccaggacgccgagtgggaagagtataagactggtattaaaaaagcgcccattcaaacatacgtccttggcgcgaacaaccaggaaactgtcaagtattttcaggatgcggatggatgcgaactagccgagaatatcacctacctgggtcgaaaaggaatctttactggatctagtggcctgcagatagtctacctgtccggcacagaatcgcttaatgaacccgttcctggctacagcttcagccccaaggacgtaagcagcttgcggatgatgctgtgcacaactagtcagtttaaaggagtggatattttgcttacatcaccatggcccaagtgtgttggcaatttcggtaactctagcggagaggtcgacaccaagaagtgcgggagtgcattggtttcgtccttggcgactggtctgaagccgaggtatcatttcgcggccctggaaaagacttactatgaacgccttccttacagaaaccatatcattttgcaggaaaatgctcagcacgctacccggtttattgctctggctaatgtgggcaaccctgaaaaaaaaaagtacctgtatgcatttagcatcgtccctatgaaactgatggacgctgctgaattggtgaaacaacccccagatgtgaccgagaacccataccgcaagagtggtcaggaggcctccatcggaaaacagattctcgccccagtggaagagagcgcctgccagttctttttcgaccttaacgagaagcagggacgtaaaaggagtagcacaggccgggattctaagtccagccctcaccctaagcaaccccggaagcccccgcagccaccaggaccttgctggttctgcctggccagccctgaagtggagaagcacctggttgttaacattggaacacattgttatctcgcactcgccaagggaggcttgagtgatgaccacgtgttaattttgcctattggccattaccagtcagtggtagagttgagcgccgaggtcgtggaggaagtggagaagtataaggctaccctcaggagatttttcaagagtaggggcaaatggtgcgtagtctttgagcggaattataagagccaccatctccaacttcaggtcataccagtgcccatctcctgcagtaccacagatgatattaaggacgcctttatcacgcaagcacaggagcagcaaattgaactgctggagattccggaacatagtgatataaagcaaatcgcccagccaggcgctgcttacttttacgtcgagctggacaccggagaaaagcttttccataggattaaaaagaatttccctcttcagttcggcagagaagtattagcctcagaagctatactgaacgttcccgataagtccgattggagacagtgccagattagcaaagaagatgaggagactctcgccaggagatttcgaaaggacttcgagccttatgatttcacccttgacgattag

SEQ ID NO: 46549 - DNA, 762 bp, Artificial Sequence
  Description of Artificial Sequence: Synthetic coding sequence
atgaagctgatggacgccgccgagctggtgaagcagccccccgacgtgacagaaaacccgtatcggaagagtgggcaggaagcctcgatcgggaagcaaatcttggctcccgtggaagagtctgcttgtcagtttttctttgacctcaacgagaaacaggggcgcaagcgctcaagtactggacgggacagtaaaagctcgccccaccccaagcagccgagaaagccaccccagcctccagggccttgctggttctgcctggccagccctgaagtggagaagcacctcgtagttaacataggcacccactgttatctggccctggccaaagggggcctgtccgacgatcatgtcttaattcttcctatcggacattaccagagtgtggtggaactgtccgccgaggttgtggaggaagttgagaagtacaaagcaaccctgcgaaggttttttaagagtcgcggcaagtggtgcgtagtttttgaaaggaattataaatcccatcacctgcagctccagattgcccagcccggagccgcttacttttatgtggaactcgacactggggaaaaactttttcaccggataaaaaagaactttcctcttcagttcggcagagaggtgctggcttctgaagctatcttgaacgtgcctgacaagtccgactggaggcagtgccaaattagcaaggaagacgaagagaccctggctagaagattccggaaggacttcgagccatacgatttcacgctggacgactag

SEQ ID NO: 46550 - DNA, 1617 bp, Artificial Sequence
  Description of Artificial Sequence: Synthetic coding sequence
atggcccagaagcccctgcggctgctggcctgcggcgacgtggagggaaagtttgatattctcttcaatcgcgttcaggcaattcaaaaaaaaagcgggaacttcgacctattgctttgtgtgggaaatttctttggtagcacccaggacgccgaatgggaagaatacaagacgggtattaaaaaagcccctatacagacctacgttctgggggcaaataaccaggaaacagtgaagtacttccaggacgcggacggctgtgagttggccgagaatatcacatacttgggcaggaaaggcatctttacgggcagctccggattgcagatcgtgtacctgtctggtaccgagtctctgaatgagcctgtgcccgggtattcattctccccaaaggatgtgtcttctcttcgaatgatgctctgcaccacctctcagttcaagggcgtggacattttactgacaagtccgtggcccaagtgtgtggggaactttggaaactccagcggagaggttgacacgaaaaagtgtggttccgctcttgttagttcgttagccacaggactgaagccacggtatcacttcgcagctctggaaaagacctactatgaacggttgccctatcggaatcatatcattcttcaagagaatgcccaacatgccactagatttatagctcttgcgaatgtggggaatcctgaaaagaagaagtatctgtatgcattctctattgtccccatgaaactgatggatgccgccgaactagtgaagcagccccctgatgtaacagagaacccatatcgaaagtccgggcaggaggcctctattggaaagcagattttggcaccggttgaagagagtgcctgtcagtttttctttgatttaaacgagaagcagggaaggaagagaagctctactggccgtgattctaagagttccccccatccaaagcagcctcgcaaacctccacagccccccggaccttgttggttttgcctggcctcgcccgaagtggaaaagcacctcgtggtcaacatcggcactcactgctatttggcacttgcaaaaggagggctctctgatgatcatgtgctgattttaccgattgggcactatcagtctgttgtggagctttccgccgaagttgtagaagaggtggaaaagtacaaggccacgctaaggcggttctttaagagcaggggaaagtggtgcgttgtttttgaacggaattacaaatcccatcacctccagttgcaggtaattccagttccaatttcttgtagcactaccgatgacattaaagatgcttttattacccaggcacaggaacagcaaattgagttgctggagatccccgaacactcagatattaaacagattgctcagcctggggcagcgtacttctatgtcgaactggatacgggcgagaagctctttcatagaattaagaaaaatttccctctgcagttcgggagggaggtgctggcctccgaggctattctgaatgtgcctgacaagagcgactggagacaatgccagattagcaaagaggacgaggagacgctcgctcgccggtttcgcaaggattttgaaccttacgactttaccctagacgactag

SEQ ID NO: 46551 - DNA, 2685 bp, Artificial Sequence
  Description of Artificial Sequence: Synthetic coding sequence
atggccaccagcatggccgccgccagcggccggttcgagagcgccaaaagcatcgaagagcggaaggaacaaactagaaatgcaagggctgaggtcctcaggcaggcgaaggccaactttgaaaaagaggaacgtcgtaaagagctaaagaggcttcgaggagaggacacatggatgctccccgacgtgaacgagaggatcgaacagttctcgcaagaacacagtgtgaagaagaagaaaaaaaaagacaaacacagcaaaaaggccaagaaggaaaagaagaaaaagtctaagaaacagaagtatgaaaaaaacaatgagtccagcgactcctcttcttcctctgaggacgaatgggtcgaggccgttcctagtcagacaccagacaaagagaaggcgtggaaagtgaaggacgagaagagcgggaaagatgacacccaaataattaagcgcgacgaatggatgacagtcgacttcatgtccgttaagaccgtctcaagctcaagtttgaaggcagaaaaggagacaatgcgcaaaattgaacaagagaagaaccaggccttggagcagtctaagctgatggaacgggagttgaacccttattggaaagacggcggcacaggcctgcctccagaggactgctcggtatctagtatcaccaaggtaagcgtggtggaagacgggggccttagttggctccgcaagtcttacctgagaatgaaggaacaggccgaaaaacagtcgcgaaatttcgaggacattgtggccgagagatatggaagtatggagatcttccagagtaagctggaggatgccgaaaaggcggccagcacgaaggaggattacaggagggagcgatggcggaaacccacatattctgataaggcacagaactgtcaagagagcagagaatcagacctagtgaagtatggaaactcctctcgtgaccggtacgccaccaccgacaccgccaagaacagcaacaatgagaagttcattggtgatgaaaaagataagcgaccaggctctctggagacttgtagacgcgaaagcaatcccagacaaaaccaggagttttccttcggtaaccttagggctaaatttcttcggccttcggatgatgaggagttgtcctttcactcaaagggacggaagttcgaacctctttcatctagctccgctctggtggcccaaggttctctctgtagtggcttcagaaagcccaccaaaaacagtgaggaaaggttaacatcttggagccggtctgatggcagaggagacaaaaagcacagcaatcaaaagcctagcgagacaagcactgatgagcaccagcatgtgccagaggatccgagagagaagagccaggatgaagtgctgagagatgatcctccgaaaaaggagcacctacgcgacactaaatcgacgttcgcgggaagtccggaacgagaatctatccacattctgtcagttgatgaaaaaaataagctgggcgcaaagattattaaggcggagatgatgggtaatatggaactcgccgaacagctcaaggttcaattagaaaaggccaataaatttaaagagacgatcacacagatccctaaaaagagcggggtcgagaacgaggatcaacaggaggtgatcctggtacggactgatcaatcgggacgtgtgtggcccgtcaacaccccgggcaagagcctggagagccagggaggaagaagaaaacggcagatggtgtctacacatgaagaaagagaacgcgtgcggtacttccacgatgacgacaacctgagtctgaacgacctggtgaaaaacgaaaagatgggcactgccgagaaccagaacaaactctttatgaggatggcaagtaagtttatggggaagaccgatggagactattatacactagacgacatgtttgtgagtaaggccgctgaacgggaacgtctgggtgaggaagaggaaaaccagcggaaaaaggccatcgcagagcaccgctccctcgccgcccagatggaaaagtgtctgtattgctttgatagtagccagttcccgaagcatcttatcgttgcgataggcgtgaaggtctatctgtgccttccaaacgtgcggtccctgactgaaggccattgtctgattgtgcccctgcagcaccatagagccgcaaccctgcttgatgaagacatatgggaggaaattcaaatgttcaggaaaagtctggtcaaaatgttcgaggacaagggcctcgattgcatctttctagagaccaacatgtccatgaagaaacagtatcacatggtgtacgagtgcatccctctccccaaggaagtaggggatatggctcccatctattttaagaaggctattatggagtcggatgaggagtggagcatgaacaaaaagctcatagatctcagttccaaggatatccgtaagagcgtgccgagggggctcccttacttctccgttgattttggactgcatgggggatttgcacatgtgattgaggaccaacacaagttcccccattactttggaaaggaaattatcggcggaatgttagatattgagccaagactgtggaggaagggcataagagagtcttttgaagatcagcgtaagaaagccctgcagtttgcgcaatggtggaaaccttacgattttaccaagagcaagaactattag

SEQ ID NO: 46552 - DNA, 291 bp, Artificial Sequence
  Description of Artificial Sequence: Synthetic coding sequence
atgttcgaggacaagggcctggactgcatcttcctggagaccaacatgtcgatgaagaaacaataccacatggtctatgaatgtattcctttacctaaggaagtcggggacatggctccaatttacttcaagaaggccattatggagtcagacgaggaatggtccatgaacaaaaagctgattgatctaagtagcaaggacatccgcaagtcagtcccccgtggattaccatacttttccgtcgactttggcctgcatggggggtttgcccacgtgattgaagatcagtag

SEQ ID NO: 46553 - DNA, 2229 bp, Artificial Sequence
  Description of Artificial Sequence: Synthetic coding sequence
atggccaccagcatggccgccgccagcggccggttcgagagcgccaagtccattgaggaacggaaagaacagactcgaaacgcccgagcggaggttctgaggcaggctaaggctaactttgaaaaggaagagcgtaggaaggaattgaaaagactccgaggagaggatacctggatgctgcctgatgtgaacgagaggattgaacagttttcgcaggagcactccgtgaagaagaagaagaaaaaagataagcatagcaagaaggcgaaaaaagaaaaaaaaaagaagtcaaaaaaacagaaatacgaaaagaataatgagagctccgattcttcatcctccagtgaggacgagtgggtcgaggcagttccttcgcagacccccgataaggagaaggcctggaaagtcaaggacgagaagtccgggaaggatgacacccagatcatcaaacgggatgaatggatgacagtggatttcatgtctgtgaaaacagtctcttcaagctccctcaaggctgaaaaagagacgatgaggaagattgaacaggagaagaaccaggctctggagcagtccaaattgatggaaagggagctcaatccctattggaaagacggcggaaccgggctaccgccagaggactgctcggtgtcctccatcacgaaagtgtcagtggtcgaggatgggggtctgtcatggctccggaaatcctatctccggatgaaggagcaggcggagaagcagtcaagaaacttcgaggatattgtggctgagaggtacgggtccatggagatctttcagagcaaacttgaggatgcagagaaagctgcttctaccaaagaggactaccgtcgagaacgctggagaaaacccacatactccgacaaagctcagaattgtcaggaaagtagagagtctgacttggtgaaatatggtaacagcagcagggataggtatgccaccacagatacagcgaagaacagtaacaatgagaaatttatcggggatgagaaggataagcgcccaggcagcctagagacctgccgacgcgaatctaaccccaggcagaaccaagagttttcttttggcaacctccgcgccaagtttctgcggccctctgacgatgaggaactcagttttcacagtaagggtagaaaatttgagccactttcctcttcttccgcattagtcgcccaggggtccctgtgcagcggatttaggaaacctacaaaaaactccgaagaacgtctgacatcctggtcaagaagcgatggacgcggggataaaaagcacagtaatcagaagccgagcgagacttcgaccgacgagcatcagcacgttcccgaggacccgcgcgaaaagtcccaggacgaggtgctcagagatgaccctccaaaaaaggaacacctgagggatactaaaagtaccttcgctggttctccagaacgcgagtcaatccacatcctctcagtggacgaaaagaacaaactgggcgccaagataatcaaagccgaaatgatgggaaatatggagttagcggaacaattgaaggtgcagctggagaaagccaataaattcaaagagaccattacacagattccgaagaaatcaggtgttgaaaatgaagaccagcaggaagtgattcttgtgagaactgaccagtccggacgggtgtggcccgtgaacactcccgggaaatcactagagagtcaagggggcaggcgcaagagacagatggtgagcacccatgaagaacgggagagggtacgctatttccacgacgatgataatctgagcctcaacgacctggtcaagaacgagaagatgggcacagcggaaaaccagaacaagttgttcatgagaatggcctccaaattcatgggaaaaacggacggagactattatactctcgatgatatgtttgtctctaaggccgccgagagagagaggctcggggaggaagaagagaatcaacggaaaaaggcaatcgcagaacacagaagcctggccgctcagatggagaagtgtttgtactgcttcgacagtagtcaatttcccaagcatttaatcgtggccattggggtgaaagtctatctgtgcctccccaatgttcgctccttaaccgaaggacactgcctcatcgttccactgcagcatcatagagccgcaaccctgctggatgaggacatttgggaggaaattcagataaagtcacgaacagtgattcagtag

SEQ ID NO: 46554 - DNA, 207 bp, Artificial Sequence
  Description of Artificial Sequence: Synthetic coding sequence
atgccccagaaggacccctgccagaagcaggcctgcgagatccagaaatgtctgcaggctaactcatatatggaaagtaagtgtcaggccgtcatccaggagctgcgcaagtgttgtgcgcagtatcccaagggaaggagtgttgtgtgttcaggctttgagaaggaagaagaggagaacctgacccgcaaatctgcctcaaagtag

SEQ ID NO: 46555 - DNA, 1311 bp, Artificial Sequence
  Description of Artificial Sequence: Synthetic coding sequence
atgcccatgagcagcctgcccgccgccatcctgagccacatgaccgccataaacaacgtaccaccgccgcccctacattctataccgaatttaaagaagagtaaacacattaactatggccagctaaatgcgctgtgccacatacgaggtcagcactctcgctctatgagcaatattctcagtgcgcacgatacgttcatgaagcagtatccgaaagtgtttctacatcagaagccacgcctacccaaactgttcaagcaggaagagcaacgcgagctgaatgagggtaaggaggagagccagcaccagcagcccgatgactccaacaacattgccgtgcacgttcagagggcacacggcggtcacattttatatagacccaaacgcgcaacagaaaagttcgaggagtttctggcaatcctcaagaagctgccaatccataggacaccgtacgagcataaaacggtctggaagttcctgaaaaccatccctgacctgacctttcaattgaacgataaacacctgaagacactgtccaaaaccgttttttcagaaacctggctcaagggctctactgtggtggcgaacgacggtttttacgtcatcctcaagggactcgctaggccccaaactaacgtatacaagaacctgatcgaggggtctgatagcccggattcctttatctcccagtcctttcactccttcatctggtccgaggaatttaagaattccactctggctgaaatgtacttgccctcttacgactccatgctcagcaaatggtccacgtttggcactctcgaggtgatgcctcaaaacgaatcagaaacccagatgttctccgtggtaacggaagatgattgcgagatcctgaaaattccagctaagggttatgcaaaaattaaggaagagaaaattaaattggagaatatgcagaagcttaaacttattagaatgtgcccttactacgaagagtggcccactctgtccatctatgagctaatcgccctcctcaaatggaaaaagttccctccgggccatgtaattgttgagtctggcaacatcattagttttgtcggctatattaacagtggctgctgcaatatttacagatccatcattggttttgtcaagctgcgaagcaataaggtgaaacgctctcagaagttggtgtacatgggcaaattgaaagagaaagaatccttcggggagatctcggtgctgctccaggtgccattcacctgtaccataataacaaagaaagaagtggaaatggctataatcgaggacaaggacttgtttgttgcgtag

SEQ ID NO: 46556 - DNA, 876 bp, Artificial Sequence
  Description of Artificial Sequence: Synthetic coding sequence
atgctgctgcccctgcccccccagagcagcaagcccgtgcccaagaagagtcagtccagcaagatcgtcccatcgcatcatgatcccagtgaaaaaaccggcgagaattgccaaaccaagattagtcctagtagtcttcaggagagcccaagctcgctgcaaggggcgctgaaaaagaggtccgccttcgaggatctaacaaacgtgtcatttgaaatgactcacgaaacactgtacctggccgtgaagttagttgatctctacctgatgaaggcagtgtgcaagaaagacaagctgcagttattaggggccaccgcttttatgatcgcagcaaagtttgaggagcataatagccctagagtggacgatttcgtttatatctgtgatgataactatcagcgaagcgaagtgctctcgatggaaataaatatactgaacgtgctgaagtgtgatatcaatatacccatcgcgtatcacttccttaggaggtacgctcgctgcatccatacaaatatgaagaccctcactttgtcaaggtacatctgcgagatgacacttcaagagtatcattatgttcaggagaaagcttccaaattagccgccgcttccttgctgctggccctctatatgaaaaagttgggctactgggtgcctttccttgaacactattctgggtactctatctccgaactccaccccctggtccgtcagttgaataagctcctgaccttctctagttacgattccctcaaggctgtgtactacaagtactctcatccagtattcttcgaagttgccaaaatcccagctcttgacatgctgaaactggaagagatacttaattgcgactgcgaagcccaggggctggttctttag

SEQ ID NO: 46557 - DNA, 4188 bp, Artificial Sequence
  Description of Artificial Sequence: Synthetic coding sequence
atgctgctgcccctgcccccccagagcagcaagcccgtgcccaagaagtcacaatcaagcaaaatagtcccctcccatcatgatccatcggaaaaaacaggtgagaactgtcagacaaagatctccccttctagtctccaagagagtcccagctccttgcaaggcgcactgaaaaaacggtcagcctttgaggacctaaccaatgccagtcagtgccaacccgttcaaccaaagaaggaggctaacaaggaattcgtgaaggtcgtgagtaagaaaatcaaccggaacacacatgccctgggactcgccaagaaaaataaaagaaatctcaagtggcacaagttggaggtcactcccgtcgttgccagcaccaccgttgttcctaatatcatggagaaaccactgatcctcgatatcagcaccacctctaaaacaccaaacaccgaggaggccagcttgttccgtaagcccctggtactgaaagaggaacccaccattgaagatgagaccctcatcaataagtcactttctctgaaaaagtgttcgaatcatgaagaggtcagccttctcgaaaagctgcagcccctgcaggaggagtcagacagcgacgacgcctttgtgatcgaaccaatgactttcaaaaagacacacaagaccgaggaggccgcgatcaccaaaaagaccctgagcttaaaaaagaagatgtgtgcttctcagcggaaacagtcctgccaggaggagagcctggccgttcaggatgttaacatggaggaagatagctttttcatggagtccatgagcttcaaaaagaagcctaagaccgaggaaagcattcccacccataagctttcctccttgaagaaaaagtgcacgatttacggaaagatatgccattttcgaaaacccccagtgctgcaaacaactatatgtggagctatgtcttcgatcaaaaagcccaccacggaaaaagaaaccctttttcaggaactgagcgttctgcaggagaaacacacgaccgagcatgagatgagcatcctgaaaaagtccctagctcttcagaagacaaacttcaaagaagacagcctcgtgaaagaaagcctcgcattcaagaagaagccttcaaccgaggaggcaattatgatgccagtgattctgaaggaacagtgtatgacagaagggaagcgatcccgtctcaagccgctcgttctgcaagagatcactagcggtgagaaatccctcattatgaagcctctgagtattaaggagaaacccagtactgagaaggagagtttctctcaggaacccagcgctctgcagaagaagcatacaacccaggaggaagtgtccatcctaaaggaacctagcagtcttctcaaaagtcctacggaggaatcccccttcgatgaagcactggcttttactaagaaatgcacaatagaggaagcaccgccgacgaagaagccacttatcctgaagcggaaacatgctacacagggcactatgtcgcacttaaaaaaacccctgattcttcagactacctcaggcgaaaaatctcttattaaagaacccctaccttttaaagaggaaaaagtctcccttaaaaaaaaatgcaccacccaggaaatgatgagcatctgtccggagcttctcgatttccaagacatgatcggcgaagataagaatagcttcttcatggaacccatgtcgtttagaaaaaatcccactaccgaggaaaccgtgttaacaaagacaagcctgtctctacaagagaaaaagatcactcagggaaagatgtcgcacctgaagaaacctctggtattacagaagataacgtctgaagaagagtcattttacaaaaagctgctgcctttcaagatgaaatcaacaacggaggaaaagttcctgtctcaggagccgagcgctcttaaagagaagcatacaacccttcaggaagtgtccctgagtaaggagagtcttgccatccaggaaaaggcaactaccgaggaggagttcagtcaagagctctttagcttgcacgtcaagcataccaataaaagtggtagcctctttcaggaagccctggttctccaggagaaaacagacgcagaggaggactcgcttaagaaccttctggccctgcaggaaaaatctactatggaggaggaatccttgatcaataagttactcgccctaaaagaggagcttagtgcggaggcggcgactaacatacagacccaattgagtctaaagaagaagagcacgagccatgggaaggttttctttttgaagaagcagttagcactaaatgaaacgataaatgaagaagagttcctaaataagcagcctctggccctggagggttacccctccattgccgagggcgagacactgttcaagaagctgctagccatgcaggaggagccgagtatcgagaaggaggcagtgctcaaggagcccacaatagataccgaggcccatttcaaggaacctctcgccttacaagaagagccttccaccgagaaagaggccgtcctgaaagaaccttcagtggatactgaggcccactttaaagaaacgcttgctctgcaggaaaaaccatccatagaacaggaggcactgttcaaaagacactccgccttatgggaaaagccatctactgagaaggagacaatcttcaaagagagcctggaccttcaggagaaaccctccataaagaaagagactctgctgaagaagccactagctctaaaaatgtctactattaacgaagctgtcctttttgaggatatgatagcactaaacgagaaacctaccacaggcaaagagctctcttttaaggagccactcgcattgcaggaatctcccacgtacaaagaagatacatttctcaagaccctgctcgtgccacaagtaggtacctcccctaatgtaagttctacagcgccagagtcgatcaccagcaagtcgagcattgccacaatgacatcggttggaaaatctgggaccatcaatgaggcatttcttttcgaagacatgatcacactgaacgaaaagcctacgacagggaaagaactgtcctttaaggagcccttagctctgcaggagtcgcctacctgcaaagaggacaccttcctggaaacattcctcatccctcagattggtactagtccgtacgttttctctacgactcccgagtcaattacagagaagagtagtatagccaccatgacctcggtggggaagagcaggacaaccaccgaatcatcagcctgcgaaagcgcgtcagataaacctgtttcgcctcaggctaagggcacccccaaagagattactccaagggaagacatcgatgaagattcctcagacccaagcttcaaccccatgtacgcgaaggagattttctcatatatgaaggagagagaagaacagtttatcctcacagactatatgaaccgacaaatagagataacgtcagacatgagggcgattctggtggactggctggtggaggtgcaggtgagttttgaaatgacccatgaaactctctacctggccgtgaagctcgtagacctctacttaatgaaggcggtctgtaaaaaggataagctgcagctcctcggcgctacagcttttatgatcgccgctaaattcgaggagcataatagtccgagagttgacgattttgtgtacatatgcgacgataactaccagagatccgaagtcctttccatggagataaatatcctcaatgtgcttaaatgcgacattaacattcctattgcttaccattttctacggagatatgcacgctgtatccatacgaacatgaaaaccttgactctgtctcgatatatttgtgaaatgacgctccaagagtaccattacgttcaagagaaggcaagtaagctcgcagccgccagtctcttactggccctgtatatgaagaagttgggctactgggtcccattcctggaacattactccgggtatagcataagtgaattgcacccactggttagacaactgaacaagctactgaccttctccagctacgattctctgaaagctgtctattataagtactcccaccctgtttttttcgaagtggctaaaattcccgcactcgacatgttaaagctagaggaaatccttaactgcgactgcgaggcccagggtctggttttatag

SEQ ID NO: 46558 - DNA, 4188 bp, Artificial Sequence
  Description of Artificial Sequence: Synthetic coding sequence
atgctgctgcccctgcccccccagagcagcaagcccgtgcccaagaaatctcaaagcagcaagatcgtgcccagtcaccacgatccatctgaaaagaccggggaaaattgtcagaccaaaatcagtccaagctccctgcaagaatccccttctagcctgcagggcgccctgaaaaagagaagcgcttttgaagacctgacgaatgccagccagtgccagccggtccagccaaagaaagaagcgaacaaggagttcgtcaaggtggtgagtaaaaagatcaatcgcaacacacacgccctgggactcgctaagaagaacaagagaaacctgaagtggcacaaacttgaggtaacgcctgtggtcgcctcaacgactgttgtgccaaacatcatggaaaaaccactaatactggacatctcaaccacatcaaaaacccctaatactgaggaggcctccctgttcaggaagcctttggtactaaaggaagaacctaccatcgaggacgaaactttaatcaataagagtctcagcctgaagaaatgcagcaaccacgaggaggtcagcttgctggagaaacttcagccattgcaagaggaatcagacagcgatgatgcttttgtcatcgagcccatgactttcaagaaaactcacaaaacagaagaagcagccattaccaagaaaacgttgagcctgaagaagaagatgtgcgcctcgcagagaaagcaatcttgccaagaagagagcctcgccgtgcaggatgtaaacatggaagaggactctttctttatggagtctatgtcctttaagaagaagccaaaaaccgaagaatccatccccacgcataaactttcctcacttaagaagaaatgtactatctacggcaaaatctgccacttccgcaagccaccagtccttcagacaaccatatgtggcgccatgtcgtccatcaagaagcccactaccgaaaaggagactttattccaagagctatctgtcctgcaggaaaagcacaccaccgaacatgagatgtccatccttaaaaagagtctcgctctccagaagacaaattttaaagaagactctctggttaaggaatcattggcctttaaaaagaagccctccaccgaggaagccatcatgatgccagtaattcttaaagaacaatgtatgactgagggaaaaaggagcagactgaagcctctggtcctccaggaaattacctctggtgagaaatctctgattatgaaaccactctctataaaagagaagccatccacagagaaggagagtttcagccaggagccaagtgccctgcagaaaaaacacaccacccaagaagaggtgagcatcctgaaagagccttcatccctgctgaaaagcccaaccgaggaatccccatttgatgaagccttagccttcactaagaaatgcactatagaagaggcgccccccactaaaaagccattgatcctgaaacgtaaacatgctacacagggcactatgtcacacctgaagaagcctctgattttacagaccacctccggagaaaaatccctgattaaggagccgttgcccttcaaagaagagaaggtgtccctcaagaagaaatgcacaactcaagagatgatgtcaatatgcccagagctactggactttcaggatatgataggtgaagataagaattctttttttatggaaccaatgtccttcaggaagaaccccacaacagaagaaaccgtgttgaccaaaaccagcctaagcttacaggagaagaaaataactcaaggcaaaatgtcacaccttaagaaaccgctggtactgcagaaaatcacatccgaggaagagtccttttataagaaacttctgcctttcaagatgaagtccactacagaagaaaagttcttgtcccaggagccgtctgcgctgaaagagaagcacactactctgcaggaagtttcactttctaaagaaagtctggcaattcaggagaaggcaactacagaggaggagttctctcaggaattgttctcgctgcatgtcaaacacactaataaatcgggcagcctgtttcaggaagcactggtcctacaggagaagactgacgccgaagaggactccctgaaaaatctgctggcactacaggaaaagtccaccatggaggaagagagtttgataaacaagctgctggctttgaaagaggagctcagcgcagaagcagctaccaacattcagacccaactgtccctgaagaaaaaaagcacgtctcacggaaaagtgttttttttaaaaaaacagttggctctgaacgaaacgatcaacgaggaagaattcctcaacaagcaaccactcgctttagagggctatccatccattgccgaaggagagacgttgttcaagaaactattggcgatgcaggaggagccttccatagagaaggaagcagtactcaaggagcccaccatagacaccgaggcccattttaaggagcctttagccttgcaggaagaaccatccaccgaaaaggaagccgtactgaaagagccttcagtggacaccgaggcacattttaaggagaccttggcccttcaggagaaaccctccatcgaacaggaagctttatttaagcggcatagcgcgctgtgggagaaaccctcaacagaaaaagagactatattcaaggaatctctggacctccaagaaaaaccctctatcaagaaggagacactgctgaagaagccattggcactcaaaatgagtaccatcaatgaagccgtcctgtttgaagatatgatcgcactaaatgagaaacctactactggtaaagagttgtcttttaaggagcccctagcacttcaggaaagtccaacgtacaaggaagataccttcctaaagaccctgctggtgccacaggtgggaacctcacccaatgtgtcctctacggcaccagagtctatcacctccaaaagttctattgccactatgaccagtgttggcaaatctgggactattaacgaggcattcttgttcgaagacatgatcacgctgaatgagaagccaacgactggaaaggaactcagtttcaaggagcctctcgctctgcaagagagcccaacttgtaaagaagacacatttctggaaactttcctcatcccgcagattggtaccagcccttacgtcttctccactacccccgaatccattaccgagaagtcatctatcgccacgatgacctccgtgggtaagagtcgcaccactaccgagtcatccgcttgtgagtccgcatccgacaagccagtgtctccacaggctaaaggcacccccaaggaaataacgcctcgagaagacatcgatgaagattcatccgacccttcatttaatccgatgtacgccaaagaaatcttctcctatatgaaggagagagaagagcagtttatcctcaccgattatatgaatcggcagatcgaaattacctccgacatgagagccatcctagtcgactggctcgtggaagtccaggtgagtttcgaaatgacacacgagactctgtatctggctgtgaagctggtagacttgtatctcatgaaagccgtttgcaaaaaagacaagctccaactgctgggggcaacagccttcatgatcgccgcaaaatttgaagaacacaacagtccacgggtagacgacttcgtttatatctgtgacgataactaccagcgctcagaagtactgtccatggaaattaacatattaaatgtactcaagtgtgatataaacatccctattgcctatcacttcctgcggaggtatgcccggtgtattcatactaacatgaagacactgacgctgagtaggtacatatgtgaaatgactctccaagagtatcactatgtgcaggagaaggccagtaaactggccgccgccagtctgctcttggccttgtacatgaaaaaactgggctactgggtcccctttttggaacattactccggttactctatcagtgaattacaccctctggtgcgccaactcaacaaattactcactttctcaagttacgactctctcaaagctgtctactacaagtactcacacccagttttctttgaggtggctaaaattcccgctctagatatgctgaagttggaagagatattaaattgcgattgtgaggcccagggactggttctgtag

SEQ ID NO: 46559 - DNA, 4188 bp, Artificial Sequence
  Description of Artificial Sequence: Synthetic coding sequence
atgctgctgcccctgcccccccagagcagcaagcccgtgcccaagaagagccaaagtagcaagatagtacccagccaccatgacccatccgagaagaccggcgaaaattgccagaccaaaatcagccctagttctcttcaggaatccccctcgagtctacaaggcgccctgaaaaaacgcagcgcattcgaggatttaacaaacgcttcgcaatgtcagcctgtgcagcctaagaaagaggctaacaaggagttcgtcaaagttgtcagcaagaagataaaccggaatacacacgccctgggcctcgcaaagaaaaataagagaaacttgaagtggcataagctcgaggtaacgcctgtggttgcctccactacagtcgtcccgaacattatggagaagcctctaattctggacatatctactacaagcaaaacccctaacaccgaagaggccagtttatttcggaagcccctggtattaaaagaagagccaaccatcgaagatgaaacactcataaataaaagcctgtccctcaagaaatgcagtaatcacgaggaagtctctctgctcgagaaactgcaaccactgcaggaagagagcgactccgacgatgccttcgttatcgagcccatgacctttaagaagacacataagaccgaagaggctgcaatcaccaagaaaaccctcagcttgaagaagaaaatgtgtgccagtcaacggaagcagtcttgccaggaggaatccctcgccgttcaggatgtcaacatggaggaagactcattttttatggaatctatgagttttaagaaaaaacctaagaccgaggagagcattcctacgcataaactttcatcgctgaagaagaaatgtactatatacggaaagatctgccactttaggaaacccccagtactgcagacaacaatttgtggcgccatgtctagtatcaagaaaccaaccacggaaaaggaaaccctatttcaggagctttcggtactccaggaaaagcacacaacggagcacgagatgtcaattcttaagaaatccctggcccttcagaaaacaaatttcaaagaagactccctggtgaaagaaagtttagctttcaaaaagaagcccagcaccgaagaggctataatgatgccggtgatactgaaagaacaatgtatgacagagggcaaaaggagcagactaaagcccttggtgcttcaggaaattaccagcggcgaaaagtcattgataatgaagccactaagcattaaagagaaacctagtaccgaaaaagagagcttttcccaggagccatctgcactgcaaaagaaacatactacccaagaggaagtgtcaattctcaaggaaccttcatctctcttaaagtccccaacagaagaatcccctttcgacgaagctctcgcgtttacaaaaaagtgtacgatagaggaagctccacccactaaaaagccattgattttaaaacggaagcacgccacccagggcacaatgtctcaccttaagaagccgcttatcctccagaccaccagcggcgaaaaaagtctgatcaaggagccgcttccattcaaggaagaaaaagtgtcactgaagaagaagtgtaccacccaagagatgatgtccatctgcccagaacttctcgattttcaggatatgattggagaggataaaaacagtttttttatggagccaatgtctttccgaaagaaccccacaacagaagaaactgttctcacaaaaacatcactcagcctacaggagaaaaagattacacaaggaaaaatgagtcacctgaagaagcccctggttctgcaaaagatcacctctgaggaagaatccttttataaaaagcttctcccattcaaaatgaagtcaaccacggaagagaagttcctctcccaagaaccatccgctctgaaagagaagcataccaccctccaggaggtatcactgtccaaggaatccctggcaatacaggaaaaggccaccactgaggaggaattctcacaggagctgttctcattacatgtcaagcacacaaacaagtccgggagcctgtttcaagaggcactggttctccaggagaagacagatgccgaagaggattctctgaagaacctgcttgcgctgcaggaaaaaagcacaatggaggaagaatctctcatcaataaattgctggccttgaaagaggaactgtctgccgaagcggcaactaacattcagactcaactctcactgaaaaaaaagtcaacttctcatggcaaggtgttctttctcaagaaacagctggcactaaatgaaacaattaatgaagaggagttcctcaataagcagccactggccctggagggataccccagtatcgctgaaggcgagacgctatttaaaaagctccttgccatgcaagaggagccatctattgaaaaagaagcggtgctcaaggaacccactattgacactgaagctcattttaaggaacctctagctctgcaagaggaacccagcaccgagaaggaagcggtcctcaaggagccaagtgtcgatacagaggctcacttcaaggaaaccctcgcgttacaggaaaaaccgagcatcgaacaagaggctttgtttaagagacattctgctctgtgggagaaacccagtacagagaaggagactatctttaaggagagtttggacctgcaggaaaagccctcaatcaagaaggaaaccctgctgaagaagcctctcgcactgaagatgtccacaattaatgaagccgtgcttttcgaagacatgattgctcttaacgaaaaaccaaccacagggaaggagctctcttttaaggagcctctcgctctacaggagagtccgacatacaaagaggacacattcctcaaaaccctcctagtgccccaggtgggcacttcgcccaacgtgagctctacagcacctgagtctatcacttctaagtcgtctatagcgaccatgacaagtgtgggtaaaagtggcacaatcaatgaggcgtttctcttcgaagatatgattacccttaatgagaagccaacaaccggcaaagagctgagttttaaagaacccctcgccctgcaggaatcaccaacatgcaaagaggatacctttttagaaactttcttaataccccagattggaacaagtccctatgtgtttagcaccacgcctgaaagtataactgagaaatcctctatcgccactatgactagcgtggggaagagccgtactaccaccgagagctcggcctgcgagtctgcatccgacaaacctgtgtctccccaagctaagggaacacctaaggagatcacacctcgcgaagacatcgatgaggactccagcgacccaagctttaacccaatgtatgccaaggaaattttttcttacatgaaagagagggaagaacagtttattctcaccgactacatgaaccgacagatcgagataacatccgacatgagagcaatcctggtcgactggctggtggaggtgcaggtgtccttcgagatgacccatgaaacactgtatttagccgtgaagctcgtggacctatacttgatgaaagctgtttgtaagaaagataagttacagttgctgggtgccaccgcctttatgatagccgcaaaatttgaagaacataattctccccgggtcgacgattttgtctatatttgtgacgacaattatcagaggtccgaggtgctgtccatggagataaatattctgaacgtgctcaaatgtgatattaacatacctatagcctaccacttcctgagaaggtacgccaggtgtattcataccaacatgaaaacgttaacattgtctcgctatatttgtgagatgaccctccaggagtaccactacgtgcaggaaaaggcgtcgaaactggccgccgctagcctcttgttggcgctgtatatgaagaaactgggctactgggtgccatttctggagcactattccggatatagtatcagcgagcttcaccccctggtcagacagctcaataagctgcttactttctcctcttatgattccctcaaggctgtgtattacaagtatagtcatcctgtcttcttcgaggtggcaaagatacccgctctggatatgctcaaactggaggagattctcaattgtgactgcgaagcccagggcctggtgttgtag

SEQ ID NO: 46560 - DNA, 876 bp, Artificial Sequence
  Description of Artificial Sequence: Synthetic coding sequence
atgctgctgcccctgcccccccagagcagcaagcccgtgcccaagaagtcccagtctagcaaaatcgtccctagtcatcacgacccttctgaaaagacaggtgagaattgccagaccaagatctctcctagtagcttacaagagtctccgtcttccctgcagggagcacttaagaaacgctccgcatttgaggatttgacaaatgtcagtttcgagatgactcacgaaaccctgtatctggccgtcaagcttgtggacttgtacctgatgaaagccgtttgcaaaaaagataaattgcagctcctgggagcaactgccttcatgatagctgctaagttcgaagagcataattctcctcgcgtggacgactttgtctatatctgtgacgacaactaccagagatctgaggtcctgtctatggagatcaacattctgaatgtcctgaagtgtgatatcaatatccccattgcatatcacttcctgcggcgttatgccaggtgtatacatactaacatgaagaccctgacattgtcccgctacatctgtgagatgacacttcaggaataccactacgtccaggagaaggcttctaaattagcggccgcttctctcctgctcgccctgtatatgaaaaaattggggtactgggtgccctttttggaacactacagtggctactcaattagcgagcttcatcccctggtgcgtcagctgaataagctgctgaccttctccagctatgattcactgaaagctgtctactacaagtactcgcacccagtcttcttcgaagtggccaagattccagcactggacatgcttaaactcgaggaaatactgaactgcgactgcgaggcccaggggttagtattatag

SEQ ID NO: 46561 - DNA, 4188 bp, Artificial Sequence
  Description of Artificial Sequence: Synthetic coding sequence
atgctgctgcccctgcccccccagagcagcaagcccgtgcccaagaagagtcagtcctccaaaatagtccctagccaccacgaccccagcgaaaagacgggggaaaactgtcaaaccaaaatctccccctcttccctgcaagagagtccttcctctctgcagggagccctgaaaaaacgaagcgcattcgaggatctcacaaacgccagccagtgccagcccgtgcagcctaagaaagaggccaacaaggagtttgtgaaggtggtgtctaaaaaaatcaacagaaatacccatgcactcggtctagccaagaaaaacaagcggaacctgaagtggcataaactggaggtcactccagtggtggcttccacaacggttgttccaaacatcatggagaaacccctgatcctggatatcagcaccacttccaaaacacctaacactgaagaggcttcgctctttaggaagccactcgtactgaaggaagagccgactattgaagacgagactctgatcaacaagagcctgtccctcaagaagtgttccaatcatgaagaggtcagcctccttgaaaaactgcagcccctgcaggaggaaagcgactccgacgatgcttttgtaatcgaaccaatgacctttaagaagactcacaagacggaggaggcagctattactaagaagacactgtcgctgaaaaaaaagatgtgtgcttctcagcgaaaacaatcctgtcaggaagaatccctagccgttcaggacgtcaatatggaagaagattccttctttatggaatcgatgtcattcaaaaagaagcccaaaaccgaagagagcatccctacgcataagcttagttctctgaagaaaaagtgcacaatctacggcaagatctgtcactttaggaaaccaccagtcctgcagactacaatctgcggcgccatgtcttctatcaagaagcccacaacagagaaggaaacgctgttccaagagctgtcagtgctgcaagagaagcataccaccgaacacgaaatgtccatacttaaaaagtcactcgcactgcagaaaaccaattttaaagaggactccctggtcaaggagtctctcgccttcaaaaagaagccgagcactgaagaggccattatgatgccggtcattctgaaagagcagtgtatgacagaaggcaagcggtccagactgaaaccccttgtactacaggagatcacttcgggcgagaagagcctcataatgaaaccgctcagtattaaggagaaacccagtacagaaaaggagtccttctcacaagaacctagtgctcttcaaaaaaaacacacaactcaagaggaggtaagtatccttaaggagccctcctcactcctgaaatcccctacagaagagtctccgttcgatgaagccctggctttcacaaagaaatgcactatcgaggaggctccccctactaagaaaccactcattctcaaaagaaagcacgccacacagggcactatgtcacatctgaaaaaaccactgatccttcagactacgtctggcgagaaaagtctgattaaggaacctctcccgtttaaggaggagaaggtctctctgaaaaaaaaatgtactacgcaggagatgatgtccatctgtcccgaactgctagatttccaggacatgatcggggaggacaaaaattctttttttatggagccaatgtcgtttaggaaaaaccccaccaccgaagagaccgtcctcaccaagacatccctctcactgcaggagaaaaagatcactcaaggcaagatgtctcatctgaagaaacctttggttcttcaaaaaatcacatccgaagaggaatccttttacaaaaaactgctcccctttaaaatgaagtccaccacagaagagaagttcttatcacaggagccatctgccctgaaagaaaaacatactaccctgcaggaggtgagtctctccaaagagtctctggctattcaggagaaggccaccactgaggaggaattttcccaggagctcttttccttgcatgtgaaacacactaacaagtccggatctctgttccaggaggccctggtcctccaggagaagacagacgcagaagaggactcactgaagaacctcctggccttgcaggagaaaagcaccatggaggaggagagtctgattaataagctactggccctcaaagaagaactgagcgcggaagctgcaacaaatatacaaacccagctctccctgaaaaaaaaaagcaccagtcatggaaaggtgttcttcttaaaaaaacagttggcgctgaatgagacgataaacgaagaagagttcttaaacaaacaacccctggctctggaagggtacccgagcatcgccgaaggggagacgctcttcaagaagctcttggcaatgcaggaggagcccagcatcgagaaggaagccgtgctgaaggaacccaccatcgatactgaagcacatttcaaggaacctctggcactgcaggaagagccaagtaccgagaaagaggccgtgctcaaggagccatcggtcgacacagaggcccatttcaaagaaacactcgctctgcaggaaaagccttccatcgaacaggaggcactgttcaagcgacactcagctctttgggagaaaccaagcacagagaaagagactatttttaaggaaagcctggacctccaggagaagccatccattaaaaaagagacactgctgaagaaaccacttgccctgaagatgagcacaattaacgaggccgtactgtttgaggatatgatagccctgaacgaaaaaccaacgaccggaaaagagcttagttttaaggagccattggccctgcaggaaagtccgacgtacaaagaggacactttcttaaaaaccctgctcgtgccgcaggtgggaacatccccaaacgtgtcaagcacagcccctgagtcaattacttccaaatcttctattgccaccatgacaagtgttgggaagtcgggcacaatcaacgaagctttcttgttcgaagacatgatcaccctgaacgagaaacctacaacaggtaaagagctgtccttcaaagagccacttgccctccaggagagtccaacctgtaaggaggacaccttcctggagacattcctcatacctcagatcggcaccagcccatatgttttttcaacaactcccgagtctattactgaaaagagtagtatcgccaccatgacaagcgtaggtaaaagtcgaacaactactgaatcttccgcgtgtgaaagtgcctcagacaagccggtctctcctcaggccaaggggacacccaaagaaattaccccacgggaagacattgacgaggacagttcagacccgtctttcaacccaatgtatgcaaaagaaatcttctcttacatgaaggagcgcgaagagcagttcatcctcacagactacatgaatcggcaaatcgagattacctctgatatgcgcgctatacttgtcgactggcttgttgaggtacaggtgagcttcgagatgacgcacgaaactttgtacctggcagttaagctggtagacctttatcttatgaaagccgtctgcaaaaaagataaacttcagttgcttggcgcgacggcttttatgatcgccgcaaagtttgaggaacataacagccctagagtggatgattttgtttacatttgtgatgacaactatcaaagatcagaagtgctaagcatggaaatcaatatactcaatgtgctgaagtgcgatattaacatccccatcgcttaccattttctgaggcggtacgcccgatgcatccatacaaatatgaaaacactgaccctgtctagatacatctgcgagatgactttacaggaatatcactacgttcaggaaaaggccagtaagctggcagccgcatccctgctgcttgccctctacatgaagaaactgggatattgggttcccttcctggagcactacagtgggtatagtatcagcgagctccacccgctggtccgtcagctgaataaactccttacgtttagtagctatgattctttgaaagcagtttactacaagtacagccacccggtgttctttgaggtggcgaagatcccggctttggatatgctcaagcttgaggaaatcctgaactgcgattgtgaagcacagggcctggttctctag

SEQ ID NO: 46562 - DNA, 876 bp, Artificial Sequence
  Description of Artificial Sequence: Synthetic coding sequence
atgctgctgcccctgcccccccagagcagcaagcccgtgcccaagaaatctcagagctctaaaattgttccatctcatcacgacccgtcggaaaagactggggaaaattgccagaccaaaatcagtcctagttccctgcaagagagtccatctagcttgcagggcgctttgaagaagagaagcgcttttgaagatttaaccaatgtttcttttgagatgacccacgaaacactgtacttggccgtgaagctggtggatctatatctgatgaaagctgtttgtaagaaggacaagctccagttgcttggggctacagctttcatgatcgctgcaaagtttgaagaacataactctccgcgggttgacgacttcgtctacatttgcgacgacaactaccagagaagtgaagtactctccatggaaataaacatccttaacgttttgaaatgtgatatcaatataccaatagcttatcactttctcagaaggtatgcacggtgcatccataccaatatgaagactttaactctatcacggtacatatgcgaaatgactctgcaggagtatcactacgtgcaggaaaaagcctcaaagctggctgccgcctcactactgttagccctttacatgaagaagctagggtactgggtgccctttctcgagcattattctggctacagtatctctgagctacatcctcttgttcggcagctaaataagctactgacctttagcagctatgatagtctcaaagctgtctactacaagtactcacaccccgtattcttcgaagttgccaagatacctgctttagatatgcttaaactcgaagagatactgaactgcgattgtgaggcccaaggactcgtactctag

SEQ ID NO: 46563 - DNA, 876 bp, Artificial Sequence
  Description of Artificial Sequence: Synthetic coding sequence
atgctgctgcccctgcccccccagagcagcaagcccgtgcccaagaagtctcagtcttccaaaatagtgccatcacatcacgaccccagcgaaaagaccggtgaaaactgccaaacaaaaataagccccagctctctccaggaatccccttcatcattgcagggcgccctgaagaagcgctcagctttcgaggacttgaccaacgtttcctttgagatgacccacgagaccctttacctggcagttaaactggtggatctgtatcttatgaaagcagtgtgcaagaaggacaagcttcagctgctcggcgccactgcctttatgatcgccgcgaagttcgaagaacataactcaccaagagtggacgatttcgtgtatatctgcgacgataattatcagaggtcagaagtgttgtctatggaaatcaacatcctgaacgtgcttaagtgtgacatcaacattcctatagcttaccattttctgcgccgctatgcaagatgcatacatactaacatgaaaactctgacactttcaagatatatctgcgagatgactcttcaagagtatcattacgtgcaagaaaaggccagcaagctcgcggctgcttccctgttgttggccttatacatgaaaaagctgggctattgggtgccattcctggagcattacagcgggtattctatttctgaactgcaccccctcgtccgacaattgaataagctgttgactttcagcagctacgattcactgaaggcagtgtactataaatatagtcacccagtgttcttcgaagtagcgaaaattcctgctttagatatgctgaaactcgaagagattctgaattgcgactgcgaagcccagggactggtgctgtag

SEQ ID NO: 46564 - DNA, 1215 bp, Artificial Sequence
  Description of Artificial Sequence: Synthetic coding sequence
atgagccggcggagcagccggctgcaggccaagcagcagccccagccatcccagacagagagtcctcaggaggctcagataatacaggccaagaaaaggaagacgactcaggacgttaagaaaaggcgagaggaggtgacaaagaaacatcaatatgagatccgaaattgctggcctccagttttaagtggcgggataagtccctgtatcattattgaaacaccacataaagaaatcgggactagcgactttagccgctttactaactatcgcttcaagaacctttttattaatccctccccactccccgatctctcttgggggtgcagcaaagaggtgtggttgaacatgcttaaaaaagagtcccgatacgtgcacgataaacacttcgaggtccttcattctgatctcgaaccacagatgaggtctatcctcctcgattggttactcgaagtgtgcgaagtgtacacattgcaccgggaaacattttacctggctcaggacttcttcgatcgttttatgttaacacagaaagatatcaataaaaacatgctccagctgatcggcataacttcgctgttcattgccagtaaactagaagaaatttatgcaccgaaattgcaggaattcgcatatgtgactgatggagcctgctcagaagaagatatacttcgcatggagttgattatcctgaaagctcttaagtgggagctgtgtcccgtcacaattatttcgtggctgaacttattcttacaggttgatgctctgaaggacgctcctaaggttttacttcctcagtactcgcaagaaacattcattcagatcgcccagctcttggacctgtgtattttggccatcgattctctggagtttcaataccgaatattgacagccgccgcactctgtcatttcacatctattgaagtggtgaagaaggcctctggcctggagtgggactcaataagcgaatgtgtcgattggatggtgccgtttgtcaacgtcgttaaaagcacatcaccggttaagctcaagacatttaagaaaatcccaatggaggacagacacaatatacagactcacacaaattacctcgccatgctggaggaggtgaactatatcaacacgttcagaaagggggggcagctgtcccccgtatgtaatgggggtatcatgacacctccaaaaagcacagagaagcctcccggaaagcactag

SEQ ID NO: 46565 - DNA, 1125 bp, Artificial Sequence
  Description of Artificial Sequence: Synthetic coding sequence
atgagccggcggagcagccggctgcaggccaagcagcagccccagccatctcagacagagagcccccaggaggcccaaattattcaggctaagaagcgaaagacaacccaagacgtaaagaaacggcgcgaggaagtcacaaaaaagcaccagtatgaaattcgaaattgttggcctcctgtcctttcaggaggcatcagcccatgtatcattatagaaacccctcataaagagattggtacaagtgattttagcaggtttaccaactatcgctttaagaacctcttcatcaatccgtccccgctgcctgacttaagctggggctgctcgaaagaggtctggttaaatatgcttaaaaaggagtctcgctacgtgcatgacaagcatttcgaggtcttgcatagtgatctcgaaccccagatgcgctctattctgttagactggttgctcgaggtgtgcgaagtgtataccttgcatcgagaaacgttctacctagctcaagatttttttgaccggttcatgctcacacagaaggatattaacaagaatatgttacagttgattggaattaccagcctgttcattgctagcaaactggaggagatatacgcacctaagctgcaagaattcgcgtacgtgactgacggcgcatgtagcgaagaggacatcctgaggatggagctgataatcttaaaggcccttaaatgggaactgtgcccagtgactattataagctggctgaatctgtttctccaggtggacgccctcaaggatgcaccaaaggttttactgccccaatacagccaggagactttcatccaaatcgcccaactgttggacctatgtatattggccatcgatagcctggaattccaataccgcatcctgacggccgctgccttgtgccactttaccagcattgaagtagtcaaaaaggcatcaggattagagtgggactctatctccgaatgcgtggactggatggtaccgtttgtgaatgtcgtcaagagcaccagtccagtgaagctgaagacttttaaaaagatacccatggaagaccgacacaatatccagacacacaccaactaccttgcgatgctgtgtatgatctcttcccatgtgtag

SEQ ID NO: 46566 - DNA, 1215 bp, Artificial Sequence
  Description of Artificial Sequence: Synthetic coding sequence
atgagccggcggagcagccggctgcaggccaagcagcagccccagcctagccagactgagtctccccaggaggcacaaatcatccaggcaaagaaacgaaagaccacacaggatgtaaagaagcgcagagaggaggtaaccaagaaacaccagtacgagattcgtaactgctggcctcccgttctgtcaggaggtatctccccctgtatcatcattgagaccccacacaaggaaatcggaacctctgacttttctcggtttacgaattatagattcaagaatctgttcatcaacccttccccactgcctgacctcagttggggctgttccaaggaggtatggctgaatatgctcaagaaagaatcaagatacgttcacgataaacacttcgaggtcctgcactcagatcttgaacctcagatgcggtccatcctgctggactggttgttggaggtgtgcgaggtgtacacgctgcaccgcgaaacattctacttggcccaagacttcttcgaccgctttatgctgactcagaaggatatcaataagaacatgctgcagcttataggaattacaagcctgtttatagcctccaagctggaggaaatatatgcaccaaagttgcaggaatttgcgtatgttactgacggcgcttgctctgaggaggatatactccgcatggagttaatcatcctcaaggccctgaaatgggaactctgccctgtcacgattatcagttggcttaacctctttctgcaggtggatgctcttaaagatgctccgaaagtgctccttccccaatattcccaggagactttcattcagatcgcccagttactggatctctgtatcttagcaatcgacagtctggaatttcagtataggatcctcaccgccgctgcactgtgtcatttcacttccatcgaggtcgtgaagaaggcctctggtttggaatgggatagtatatctgaatgcgtggactggatggtcccatttgtaaatgttgttaaatccacaagccccgtgaaactgaaaactttcaagaagattccaatggaggaccggcacaatattcagacgcacactaattacctcgcgatgcttgaggaagtgaattatatcaacactttccgcaagggggggcagctgagccccgtgtgcaacggggggataatgacgcctcccaagagtaccgaaaagccacccggcaaacactag

SEQ ID NO: 46567 - DNA, 891 bp, Artificial Sequence
  Description of Artificial Sequence: Synthetic coding sequence
atgagcaaggaggtgtggctgaacatgctgaagaaggagagccggtacgttcacgataaacacttcgaggtcctacatagcgacctggaaccccagatgagatcaattttgctggattggttgttggaggtgtgcgaggtatacacgcttcaccgggagactttctatctggcccaggactttttcgacaggttcatgctgacacagaaagacatcaacaagaacatgcttcagttgattggtataacatccctcttcatagcctctaagctcgaagaaatatacgctccaaagctccaggaatttgcctacgtgacggatggcgcctgctcggaagaggatatcctccggatggagctgatcatcctgaaggcgctcaagtgggagttgtgcccagtgactataatatcctggcttaacctgtttctacaggttgacgctctgaaagatgccccaaaggtcttattgccccagtactcccaggagaccttcattcagatagcacagctcctcgacctatgtatcctggccatcgactccctagagttccaatatagaatcctcacagcagctgccctgtgtcacttcacaagcatcgaggtggtgaagaaggcctcaggtcttgaatgggactctattagtgagtgcgtagactggatggtaccgtttgtgaatgtcgtgaaatctacttccccagtgaaactcaagacattcaaaaaaattcctatggaggatagacacaatatccagacccatacgaactaccttgccatgttggaagaggtgaattacattaacacttttcgtaaggggggacagttgtcccccgtttgcaatggtgggattatgaccccccctaagtccacagagaaacctcctggcaagcactag

SEQ ID NO: 46568 - DNA, 1134 bp, Artificial Sequence
  Description of Artificial Sequence: Synthetic coding sequence
atgaagttccccggccccctggagaaccagcggctgagcttcctgctggagaaagccatcacgagagaagcgcagatgtggaaagtgaacgtgcgcaagatgccttcaaaccaaaatgtgagcccttcccagcgagatgaggtgatccagtggctcgccaagctgaaatatcaattcaacctttatccagaaacattcgccctcgcaagttcactcctggaccgatttcttgctacagtcaaggcccaccctaaatatttgtcttgtatagccatttcttgtttttttctggcggccaagaccgtggaggaggatgagagaattcccgtgctgaaggtgttggcccgcgacagcttttgcggctgcagcagctctgagatccttcgcatggagagaatcatactggacaagctcaactgggacctgcacaccgcaacccccctggattttctgcacattttccatgctattgcagtgagtacgaggccccagctactattcagcctgccgaaactgagcccatcccaacacttggcagtactgactaaacagctccttcactgtatggcttgcaatcagctgttgcagtttcgggggagcatgctggcgctggcgatggtctcactcgaaatggagaaactgattcccgattggctatctctcaccattgagttattgcagaaagcccagatggatagcagtcagcttattcactgccgcgagctcgtcgcccaccacctgtccacactgcagagcagtctcccactgaattccgtctatgtgtatcgtcccctcaaacataccctagtgacctgcgataaaggggtattccgccttcacccctcgagcgtgccgggccccgatttctctaaggataactcaaagcctgaggttcccgtccgaggcactgcagcattttatcatcacttgcctgcggcctccggatgcaaacagacttccaccaaacgtaaggtcgaggagatggaagtggatgacttctacgacggcataaagcgcctctataacgaggataacgtctcagagaatgtaggatcagtctgcggtaccgatctctcccgccaggaggggcatgcgagtccgtgcccaccactccagccagtatctgtgatgtag

SEQ ID NO: 46569 - DNA, 378 bp, Artificial Sequence
  Description of Artificial Sequence: Synthetic coding sequence
atgaagttccccggccccctggagaaccagcggctgagcttcctgctggaaaaagcaataactcgagaagcgcagatgtggaaggtcaatgtgcggaagatgccttccaatcagaacgtgagcccctcacagagagacgaagtcattcagtggctggctaaactaaaatatcaatttaatttgtatcctgagacgttcgctctggctagctctctgcttgaccggtttttagccacagtgaaagcccaccccaagtatctgtcctgcatcgctatcagttgtttcttcctggcggcgaaaacagtggaagaggatgaacggatcccagttctcaaggtgttagcccgcgactctttctgcggatgctcaagtagttag

SEQ ID NO: 46570 - DNA, 243 bp, Artificial Sequence
  Description of Artificial Sequence: Synthetic coding sequence
atgaagttccccggccccctggagaaccagcggctgagcttcctgctggaaaaagctataacccgagaggcccagatgtggaaggtgaatgtacggaagatgccaagtaaccaaaatgtgagtcccagccagagagatgaggtgattcagtggctggccaagttgaagtatcaattcaatttgtaccccgaaacatttgcgttagcctccagcttgctcgaccggtttctcgcaacagtgtag

SEQ ID NO: 46571 - DNA, 1092 bp, Artificial Sequence
  Description of Artificial Sequence: Synthetic coding sequence
atgaccccccggcaccactgcgaggcctacagcagcgccggcgaggaagaggaagaggaggaggaggaaaagaatgtgtcaccctctcagcgtgacgaggtaattcaatggctcgccaaactaaaatatcagttcaatttgtaccccgaaacgtttgcccttgcctccagtctgcttgacaggtttttggctaccgtgaaggcccatccaaagtacctaagctgcatcgccatttcttgtttctttctggccgccaagaccgtggaggaagacgagcgaatacctgtgctcaaggtgctggcacgggacagtttctgcggatgttcctcgagcgagatactgcgcatggaaagaataatcctggacaagctcaactgggatctgcatacagcaactcctctggacttcctgcacatcttccatgccattgcagtctccactcgaccccagctgctcttctccctcccaaaacttagtccatctcagcacctagctgttctaacaaagcagctcctgcactgcatggcttgtaaccagctcctgcagtttaggggcagtatgctggcactggccatggtttctctggagatggagaaactgatcccagattggctctcactcacaatcgaactgctccagaaggcacagatggatagctcacagctgatccactgtagagagctggtcgcgcatcatttgagtacactccagtccagcctccctcttaattcagtgtatgtctatcgaccgctcaagcatacactggtgacttgtgacaaaggcgtgtttcggctccacccctcgtcggtacctggcccagacttcagtaaggacaactctaagcccgaagtgccggtgcggggcacagctgcattctaccatcatctcccagccgcgtcaggctgcaaacaaacatcaaccaaaaggaaagtggaggagatggaggtggacgacttctatgatggtattaaaagactgtacaacgaggacaatgtctctgagaacgtagggtccgtttgtgggacagacctcagtagacaggagggtcatgcaagcccttgccccccgctccagcccgtcagcgttatgtag

SEQ ID NO: 46572 - DNA, 1110 bp, Artificial Sequence
  Description of Artificial Sequence: Synthetic coding sequence
atggccagcggcgcccagctgcccccccagcccagcagcagcgaggttagcgccgtgcaatcccccggtggcaggccgggagccggcttggaagaaacagctctgggggtaccactcccacccagtcctggagaggctccccttccccgcagtaacaggtcacggtgccctggcactaggcagcctggcgccgcatctttgcacgccgcatcggcagccgtacccgtgcggcctcgcaggggtactgctcccgcaggcaaaacagctgatgcggttcctgccgccgcacccgagcaggcccccaggccagccccacaatcgcgtaaacctagaaatctcgagggcgatcttgacgaacggcgattgctgtgtcacctgcaacttgctcaggatagagaggcccgtttatggagaggaggcaaaccccaggatgagatctgtgacgctttcgaggaggtcgtgctatggttgttaaggctccagaacaccttctactttagtcagtccacgttcaacctggccttgaccatttttggcagactcctcattagtgtgaaagtcaaggagaagtacctccactgtgctactatcacttccttgaggctggccgccaaggtaaacgaagaggaagagttcattcctcaggtaaaagactttaccaagcactacgggagcgactatagtcccaacgaactcctgagaatggagctagctatcctggataggctgcactgggatctgtacattggtacgcctctcgacttccttactatatttcatgctctagttgtcctctcatggccccatgtccttgaattgctcccacagagaaaccctagcctgcacgtcgcatctctcactcgtcagctccaacattgcatggccggacatcagctattacagttcaagggcagcaccctggcactggtcatcattaccttagagctcgagcggttaatgcccgggtggtgcgcaccaatatctgacctgctgaaaaaagctcaggtaggagatatgcagtatagctgttgtaaggagctagtgatgcagcagctgcggtccctgcagtccagttcttgtaccgataatttcgtgtcacctgcgaactag

SEQ ID NO: 46573 - DNA, 993 bp, Artificial Sequence
  Description of Artificial Sequence: Synthetic coding sequence
atggacggccccatgcggccccggagcgccagcctggtggacttccagtttggagtagtcgccacagagacgattgaggatgctcttcttcatttagcccagcagaatgagcaggcggttagggaggcctccggaagactgggccggtttagagagcctcagatagtcgagtttgttttcctactttcagagcagtggtgcttggagaaaagcgtcagctaccaggcagtcgagatactggagagattcatggtgaagcaggctgagaacatttgcagacaggccactattcaaccccgggacaataaacgggagagccagaattggcgcgctctcaagcagcagttagtgaacaagtttacacttcggttggtgagttgcgtccagttggcgtctaaactaagcttccgcaacaagattatttctaatattactgtgctgaacttcctgcaggcacttggatatttgcacacaaaggaggagctcttggagtctgagttggatgtgcttaagagtttaaattttcgcatcaacctccctacccccttggcatacgtagaaacattgctcgaagtgctcggttataacggctgccttgtgcccgccatgcgtctgcacgcaacttgtctgacactccttgacttggtatatctgctgcacgaaccaatctacgaatctctattgagagcatcaattgaaaacagcacgccctcacagttgcagggcgagaaattcaccagcgttaaggaggactttatgttgcttgctgtaggtattattgccgcaagcgcattcattcagaaccatgagtgttggtctcaagtagtgggtcatctgcaatcgataaccggcatcgctctagccagcatagccgagttctcctatgcaattctgacacacggagtcggggctaatactcctgggcgccagcaaagcattcctccccacctggcagcccgggcccttaaaaccgttgctagcagcaacacgtag

SEQ ID NO: 46574 - DNA, 993 bp, Artificial Sequence
  Description of Artificial Sequence: Synthetic coding sequence
atggacggccccatgcggccccggagcgccagcctggtggacttccagttcggtgtggtcgccacagaaacgatcgaggacgccttgttgcaccttgcccagcagaacgagcaggcggtacgggaagcatctggcaggctgggccggtttagggaacctcagatcgttgagtttgtcttcctcctcagcgagcagtggtgcttggagaagtccgtgtcttatcaggccgtggagatcctcgagcgattcatggtgaagcaagctgaaaacatctgtcggcaagctactattcaaccacgagacaataaaagagagagccagaattggagagccttgaagcagcagctagttaataagtttaccctgcggctcgtgtcctgtgtccagctggcatccaagctttccttcaggaacaagattatttcgaacataactgtattaaactttttgcaggccctaggatatctgcataccaaagaagagctgttggaatcagaactcgacgtgttgaagagtttgaactttcggatcaatttacctaccccactggcctatgtcgaaaccttacttgaggttctcggatataacggatgccttgtgccggccatgcgcttgcatgccacctgcctcacactgctggatctggtatacctcctccatgagcccatttacgagtctcttctcagagcctcaatcgagaatagcacgccctctcaactgcagggagaaaagtttacatcagtcaaggaggactttatgctgttggccgtcggcatcattgcagccagtgctttcatccaaaatcacgagtgctggtctcaggtagttgggcacctgcaaagcattacaggcatcgcgttggcgagcatcgccgaattttcatatgccatcttgactcacggagttggggccaatacaccgggcaggcagcagagcataccccctcaccttgccgcccgggccctaaagactgtcgcaagctccaatacttag

SEQ ID NO: 46575 - DNA, 924 bp, Artificial Sequence
  Description of Artificial Sequence: Synthetic coding sequence
atgctggtgcggggccgggaccagggcagcggcagccggctgggccccatagttcggagatgggcccccaggcccagccctcttcagtccctggcagcctcacttgacgcggagccttcctccgccgctgtccccgacggatttcccgctggccctacagtgagtcctcgcaggctggctcggcccccagggcttgaggaggccctgagtgccctgggacttcagggagagagggagtatgccggggatatattcgcagaagtgatggtctgtcgggtcctgcccctacgcgctctgcctagggccgtgactccagagatgagagccctagtggtggattggctcgtgcaagtgcacgagtatttagggctcgctggggacactctgtatcttgccgtgcacctcctcgattcatatctgtccgctggacgggttcggctgcataggctgcagctgctgggagtggcctgtttgttcgtggcctgtaaaatggaagagtgcgtgctcccagagcctgccttcctgtgtctcctgtcggccgactctttctcccgggctgaactgcttagggctgagagaagaatcctgagtaggttggactttcgactacatcatcctgggcctctactctgtttgggcctgctggcagcgctggccgggtcgtcaccccaggtaatgctcctcgccacttacttcctcgaactatcactgctggaggccgaagccgccggttgggagccggggcgtcgagccgcagcagcactttcactagcccacagacttctcgacggtgccgggtctcgactgcagcccgaactgtaccgctgtagtttgggcggggggtcagtttgggggcacaggtccttcagggatctgccaagttggagcttcctgagatcccgccggatgcgggataactactag

SEQ ID NO: 46576 - DNA, 468 bp, Artificial Sequence
  Description of Artificial Sequence: Synthetic coding sequence
atgctggtgcggggccgggaccagggcagcggcagccggctgggccccatagtgcgaaggtgggcccctcgtccttcccctcttcaaagcctggccgcctccctcgatgccgaaccaagctctgccgctgtgccagacggttttccagcagggcctacagttagcccaaggcgcctagctagacccccagggctggaggaagcacttagtgctttgggcctccagggggagagagagtacgcaggggacatctttgcagaggtcatggagtacctcggactcgcaggcgataccttatacctggctgtccatctccttgacagctatctgtcggctggtagggtgaggctgcatcggctgcaacttctgggggtggcctgtttatttgtagcctgcaagatggaagagtgtgtgctgccagaagagacagaggttcggaaccttggaccgtttcaggggcgggaatag

SEQ ID NO: 46577 - DNA, 1080 bp, Artificial Sequence
  Description of Artificial Sequence: Synthetic coding sequence
atgggcaacaccctgacctgctgcgtgagccccaacgccagccccaaactcggccggagagctggctcggcggaactttattgcgcaagtgatatctatgaagcggtgtctggcgatgcagtggccgtggcccccgccgtggtggagcctgctgagctcgattttggcgagggtgagggacaccatttacaacatataagtgaccgcgaaatgcctgaagacctggcactggagagcaatccaagtgatcatccacgtgcctccacaatttttctgtcaaagagccaaaccgatgtccgcgaaaaacgcaagtcgaatcacctcaaccatgtgtcacctggccagctcaccaaaaagtacagtagttgctctaccatctttttagacgactctactgtgagtcaacctaacctcagaacaactgtcaagtgtgtcactctggctatttactaccatattaaaaacagggatgctaataggtctctggacattttcgatgagcgaagccacccgcttacaagagaaaaggtccccgaagaatattttaaacacgaccctgaacacaaatttatctacaggtttgtgcggaccctgttttctgcggctcagctgacggcagagtgtgccattgtgaccctcgtgtacttggaacgactgctgacctatgcagagatcgatatttgtcccactaattggaagaggattgtgctcggggcaattctcctggcttccaaggtgtgggatgaccaggcagtgtggaatgtggactactgccagatcctgaaagacattacagtcgaggacatgaatgagatggagcgccacttcctggaactgctacagtttaacattaatgtgcccgcgagcgtctacgcaaaatattacttcgacctgcgatctctggccgatgacaataaccttaattttcttttcgcacctctaagtaaggaacgggcccaaaaccttgaagcaatatcccggttgtgtgaggataaagacctctgtagggctgcaatgcgccggtccttcagcgcagacaacttcataggcatccaacgaagcaaggccatcctgagttag

SEQ ID NO: 46578 - DNA, 927 bp, Artificial Sequence
  Description of Artificial Sequence: Synthetic coding sequence
atgggcaacaccctgacctgctgcgtgagccccaacgccagccccaagttgggtagacgcgccggatcagctgaactctattgcgccagcgatatctacgaggcggtgagcggagacgcagtggctgtcgcgcctgctgtcgtggagcctgcagaacttgatttcggtgaaggcgagggtcatcatcttcaacatattagtgatcgtgagatgccggaggatcttgccctcgaaagcaatccctctgatcaccctagggctagcacaatatttctatccaaatcgcaaaccgacgttagagaaaagcgcaagtcaaaccacctgaaccactgtgatctcagcaacatacttcctcacaaggagcagcgcgagaaagtgccagaagaatattttaaacacgatcctgagcacaaattcatttaccgctttgtaagaacattgttcagcgctgcacagctcacagccgagtgtgccatcgtaacactcgtatatctcgagcgtctactgacctacgccgagattgacatctgccccactaattggaaaagaatcgtacttggggcaattttactggcctccaaagtgtgggatgatcaagcagtctggaacgtagattattgccagattctgaaggacatcacagtggaagatatgaacgagatggaacggcattttctggagctgcttcagtttaacatcaacgtgccagcaagtgtgtatgcaaaatactacttcgacttgcgcagtctggccgatgacaacaatttaaactttctcttcgcacctctttccaaggagcgcgcccagaatctggaagcaatcagtagactgtgcgaagacaaagatctctgtagagctgccatgcggcggtcatttagcgctgacaactttatagggatccagcgctccaaagccattctgagttag

SEQ ID NO: 46579 - DNA, 870 bp, Artificial Sequence
  Description of Artificial Sequence: Synthetic coding sequence
atgcccgaggacctggccctggagagcaaccccagcgaccacccccgcgcctctaccatctttctcagtaaatcacaaaccgacgtaagggagaaaaggaaatcaaaccatctcaatcacgttagcccaggccagctcactaaaaagtatagctcctgttctacgatctttctagatgattcaaccgtgagccagccaaatctgcggacaactgtaaaatgtgtgaccttagctatttactatcacatcaaaaatcgggacgcaaatcgaagtctagatatttttgacgaaagatcacacccacttactcgtgagaaggtgccagaggagtattttaagcatgaccccgaacacaaattcatttacaggtttgttagaacactctttagcgcagctcaactgacagccgagtgtgccatcgtgacactcgtttacctcgaaagacttctgacctatgccgagattgacatttgcccaaccaactggaagcgtattgttctaggagcgatcctgctggcctcgaaagtttgggatgaccaagctgtgtggaacgtcgactactgtcagattttgaaggacataaccgtggaggatatgaatgaaatggaacgtcactttctggagctccttcagtttaatattaacgtgcctgcctccgtttacgccaagtattactttgatcttcggtctttagctgacgacaacaatttgaactttctcttcgccccgctgagcaaagagcgggctcagaatcttgaagctatcagtcggctgtgtgaggacaaagacttgtgccgcgccgcgatgcggaggtccttttccgccgacaacttcatcgggattcaacgtagcaaagcgatattgtcttag

SEQ ID NO: 46580 - DNA, 1086 bp, Artificial Sequence
  Description of Artificial Sequence: Synthetic coding sequence
atgggcaacatcctgacctgctgcgtgtgcccccgggccagccccgggcttcatcaacatcagggcctcgtctgccattgcgagtctgaaatctatgaggcggcagcaggtgatctgatcgctggggttcctgtcgcagcggctgtcgagcccggcgaggtgacctttgtggcgggtgagggactgcacatgcaccacatttgcgagagagagatgcccgaggatatacccctggaacccaacccgtctgaccatcctaaggcttccactatattcctgagaaagtctcagaccgatgtgcaggagaaaaaaaaaaaacaactttgtaaggtgagtaccgagcattttacacaacaatacagcagctgtagtactatctttctggacgactcaattgcctcccagcctcacctgaccatgactctgaaatcatgcgatctgggtactatcctatcttatcaagccaagagagacgcccaccgctcactcggaattttcgatgagcagctccaccctctgacagtgcggaaggaagtgttggaggagtactttaagtacgatccagagcacaaactgatatttcgattcgttagaacactgttcaaggcgatgcgtttgaccgctgaatttgcaatcgtcagcctgatctatattgagaggctggtttcttacgctgacatagacatctgccccacaaactggaagaggattgtgctgggtgccattctgcttgcctctaaagtatggagcgacatggcggtgtggaacgaagactattgtaagctttttaagaatatcactgtcgaggaaatgaacgagctcgagcgtcagttcctgaaactaataaattataacaactcgattaccaatagcgtgtactctcggttctattttgaccttcgcacgcttgctcacaataacgggctatattcccccgtgtacctactggacagggaacgcgcttggaagctcgaagcgttttcgagaatggaacaagacaaggttttttactccgcggctaaaaacggatcactgtctgcggacgatctaattcacctacagcgggccaaagcgatcctgttctag

SEQ ID NO: 46581 - DNA, 864 bp, Artificial Sequence
  Description of Artificial Sequence: Synthetic coding sequence
tgaatccccctggagcccaaccccagcgaccaccccaaggccagcaccatcttcctgaggaagtcccagacagacgtgcaggaaaaaaagaagaagcaactctgtaaagtgtccactgaacacttcacacagcagtatagttcttgctctaccatcttcctcgatgactccattgcctcgcagccccacctgactatgacgctcaagagttgcgacctagggacaattttgagctaccaggccaaacgggacgcacataggtcactcggcatttttgacgaacaactgcatccactgactgtgcgcaaggaggtcctggaagaatactttaaatatgaccccgagcacaagctgatctttcggtttgttaggacgctgttcaaggccatgcggttaacagctgagttcgctatcgtctcactcatttatattgaacgtttggtgtcatacgccgacatcgatatatgtcctactaattggaaacggatcgtcttaggggccatactgctcgcttcaaaagtgtggagtgacatggccgtatggaacgaggattactgcaagctgttcaagaacataaccgttgaggaaatgaacgaactcgagaggcagtttctgaagttaattaactataacaacagcattacgaatagtgtgtattctagattttatttcgaccttcggaccctggctcacaacaatggtctgtattcccctgtctacctcctcgatcgcgaacgggcttggaaactagaagcattctcaaggatggagcaggataaagtcttctactctgctgcaaagaacggttcccttagcgcggatgacctcattcatctacagagggcgaaagccattctcttttag

SEQ ID NO: 46582 - DNA, 1032 bp, Artificial Sequence
  Description of Artificial Sequence: Synthetic coding sequence
agctgcgtggtgatccagatccccccctggcacctggaccggaagtatggctcgtgttcgactatacttctcgacaattcaactgccagtcaacctgatctgaggcacacactggagcggtacgccaatcgcagcttagccatatttgaggagcccgttcacccacttccacaggagaagctcccagggaagtccttcaagcacgacccaaagcgcaactgtatcttcagacacttttgcacactgtttcaggtgataaagctcacggctccatgtgccatcgttgccctcgtgtatattaagagactactgaccagtgcaaacattgatttgtgtccaaccaattggaagaaaatcgttctgggtacgatgttgctagcgtcaaaagtctggagaaatcacggactgtggagtgtggacgattcccagaattccaaggacactgcggtggagaacatgagcaagatggaaaagtgctttctcgagctgctcgagttcaatatccacgtttctgctagcgtttatgcgaagtattattttgatctctgcgcccttgccaatgatcacgatctgtacttcctcttcagcttcctccataaagataaggctcaaaaactcgagggccacacaagtcaacactctctcagccttgggccatgtagagtgggcatggagaactatgccacctactcccccctaagcagccagcccgtgctcggtgctctgagcttagctgaagtgctgcctcaagaaatcaagcaggagattcatcaagtgcttatggatcatggagtgccctgccactacacatgcttcctgctccaccccgaagattcgactctggagcggtttttagtgctgcactccattcaaggtctccaagaggacagcgtgttgtgcaaagttgaaattcacggcttaagcccccagccccaaacctatcaatcacactttcgtagcccgtcactggcagagctgctgaatcggatttcagggacatgtagaaatcatttcgctggaatgcagaagtag

SEQ ID NO: 46583 - DNA, 1155 bp, Artificial Sequence
  Description of Artificial Sequence: Synthetic coding sequence
atgaccagcttccacccccggggcctgcaggccgcccgggcccagaaattcaagagtaagcgcccacgttccaatagcgactgctttcaggaggaagatctccgccagggtttccaatggcgcaaatccttgcccttcggggcagctagctcttaccttaatctggagaagctcggggagggaagctacgcaactgtgtataagggaatcagtaggattaatgggcagttggtggctttgaaagtgattagcatgaacgcagaagagggggtgccatttacagcaattagagaggcctccttgctgaagggcttgaaacacgcaaatatcgttctgctccacgacattatacacaccaaggaaacgctaactttcgtattcgaatacatgcataccgacctagcccagtatatgtcccagcacccgggagggcttcatcctcataacgtgcggttatttatgtttcagctactgcgtggtttggcttatatccatcatcagcacgtcctgcacagggacctgaaacctcagaaccttctgatatcacatctgggcgaactgaagctcgccgatttcgggttagccagggccaagtctattccatcacaaacctattcctccgaagtggtcacgttatggtacaggcccccagacgctctcttgggagccaccgagtattctagtgagttagatatatggggcgctgggtgcatattcattgaaatgttccaggggcagcctttgtttcccggtgttagtaacattttggagcagctggagaagatctgggaggtgctgggcgtacccacagaggatacttggccaggggtgagtaagctacctaactataaccctgagtggtttccattaccaacaccacggtctctacacgtggtttggaataggctgggaagggtacccgaagctgaggatttggccagtcaaatgctcaaggggtttcctcgtgaccgtgtgagcgcccaagaggcccttgtgcatgattactttagtgccctgccaagccagttataccagctgcccgacgaggaatctctctttaccgttagcggagtccgattaaaaccagagatgtgtgaccttttagccagttaccagaaaggtcaccaccctgcccagttttccaagtgctggtag

SEQ ID NO: 46584 - DNA, 1308 bp, Artificial Sequence
  Description of Artificial Sequence: Synthetic coding sequence
atgggccaggagctgtgcgccaagaccgtgcagcccggctgcagctgttatcattgtagcgaaggtggggaggcacacagttgcagaagatctcagcccgaaaccacggaggcggccttcaagctaactgacctgaaggaggccagctgttcaatgaccagcttccatcctcgcggcctgcaagccgccagagcacaaaagtttaaatcaaagcgtccgaggagtaatagtgattgtttccaggaagaggatctccgccagggtttccagtggaggaaatctttacccttcggagcggcctccagctacctgaacctggaaaagctgggcgagggcagttacgcaacagtttacaagggcattagtaggataaatggacaactggttgcactgaaggtgattagtatgaatgccgaagagggtgtaccgtttactgctattagagaagccagcttgcttaaagggctcaagcacgctaatatagtgctgctccatgatatcatccatacaaaggagaccctgacttttgttttcgaatatatgcatacagacctcgcacaatacatgagccagcacccaggcggtcttcatcctcacaatgtgagactattcatgttccagctcctgcggggcctcgcgtatatccatcatcaacatgttttgcatcgggacctgaagccacaaaatttgcttatcagtcatctcggcgaactaaagctcgccgacttcggcctagcccgggctaagtctataccttcccagacctattcctctgaagtcgtgacgctgtggtaccgtccacctgatgctctgctgggcgctacagagtattcgtccgagttagatatatggggcgccgggtgcatcttcatcgagatgttccagggccagcctctattccccggcgtcagtaacatactcgagcagcttgaaaaaatttgggaagtgctgggagttcccactgaagatacatggccaggcgtgagcaagctgccaaactacaatccagaatggtttccactgccaaccccaagatctctgcacgtggtatggaaccggctaggccgggtaccagaggccgaggacctcgccagccagatgctaaaaggattcccccgcgacagggtctctgctcaggaagccctcgtgcacgactatttttctgccctgccgagccagctctaccagctgcccgacgaggagagcctgtttacagtcagtggagtccgcctgaagcccgagatgtgcgatcttctagcttcttaccaaaaaggacatcaccctgcacaatttagtaagtgttggtag

SEQ ID NO: 46585 - DNA, 1155 bp, Artificial Sequence
  Description of Artificial Sequence: Synthetic coding sequence
atgaccagcttccacccccggggcctgcaggccgcccgggcccagaaattcaaatctaagcggcctcggagcaactcagactgtttccaggaagaggacctccggcagggatttcagtggaggaaatccctgcccttcggggctgcctctagctacttgaacctggaaaaattgggagagggctcctatgccaccgtatacaaggggatctccagaataaatgggcagcttgtggcgctgaaggtaatatccatgaatgccgaggagggggtgccgttcaccgctatacgtgaggccagtttgttaaagggattgaaacacgctaacatagttcttctccacgacatcatccacacaaaggagacactcacctttgtcttcgagtatatgcacaccgatctggcacaatacatgtctcagcaccctggaggactccacccacacaatgtgagacttttcatgttccaactcctgcgcggactcgcctacattcaccaccagcacgtcctacatcgcgatctgaaacctcagaatctcctgatatctcatctcggagaactgaaactagccgatttcgggttggcaagagccaagtctattccttctcaaacatactcctctgaggtggttaccctgtggtacaggccccctgacgcattgctgggtgccacagaatactcctcggagcttgatatttggggggcgggttgtatatttatcgaaatgtttcagggccaaccactgtttcctggggtatccaacattttagaacagttggagaaaatctgggaagttctaggcgttcctacagaggacacctggcctggggtcagcaagctccctaactacaatcctgaatggttcccgcttcctacacccaggagcctgcacgtggtatggaacagactcggacgtgtcccagaggctgaggacttagcatcccagatgctgaagggcttccctcgggatcgggtctctgcacaggaggccctggttcacgactacttcagcgcactcccctctcagctctatcagctgcccgacgaggaaagcctgtttaccgtgtctggggtgcgcttgaagccagaaatgtgcgacctcctggcatcatatcagaaggggcaccaccccgcgcagttttccaagtgctggtag

SEQ ID NO: 46586 - DNA, 1203 bp, Artificial Sequence
  Description of Artificial Sequence: Synthetic coding sequence
atgggccaggagctgtgcgccaagaccgtgcagcccggctgcagctgttaccactgttctgagggtggggaagcccattcctgtcggcggagccagccagagaccaccgaagcagccttcaagctgacggatctgaaggaagcctcatgtagtatgacctcatttcatccaagaggactgcaagcagcccgtgcccagaagttcaaatccaaaaggccaagaagtaatagtgactgtttccaggaggaggacctaagacagggtttccagtggagaaaatccctgccctttggcgccgcatcgtcttatctcaatcttgagaagctgggcgaaggctcctatgctacagtgtataagggcattagtcgcataaatggacaactcgtggccctcaaagttatttccatgaatgcagaagaaggggtgccatttaccgccatccgggaggcgagccttcttaaaggtcttaagcacgcgaacatcgtcctcctgcacgacatcattcacacgaaagagacactcacttttgtgttcgaatacatgcataccgaccttgctcaatacatgtctcagcatcctggtggtcttcacccccataacgtcaggttgtttatgttccagttacttagaggccttgcctacatacaccaccagcatgtgctgcacagagaccttaagccccagaatttgctcatctcccacctcggagaactgaagctggctgatttcggactcgccagggctaagagcatccccagccagacatactccagcgaggtggttaccctgtggtaccgaccacccgatgcactcctcggggccaccgagtactctagcgagctggatatatggggcgcaggttgcatttttatagagatgttccaggggcaacccttatttcccggcgtttccaatatcctcgagcagctggaaaaaatttgggaagttctcggagtgccaaccgaagacacctggcccggtgtcagcaagttgcctaactacaacccagaatggtttccactgcccactcccagatctctccacgtagtctggaatcgcctgggaagagtccctgaggcagaagacctagctagtcagatgttaaaagggtttccccgggaccgagttagcgcacaggaagcactggttcacgattacttttccgcgctgcccagtcagctctatcagctcccagacgaatag

SEQ ID NO: 46587 - DNA, 1290 bp, Artificial Sequence
  Description of Artificial Sequence: Synthetic coding sequence
atgggccaggagctgtgcgccaagaccgtgcagcccggctgcagctgttatcattgttctgaaggtggagaggcccacagctgtagacgtagccagcccgagactaccgaggctgccttcaaactcacagacctgaaagaagcatcctgttcaatgactagctttcatccacgggggttgcaagctgcaagagcacagaaattcaagtccaagcggcccagatccaacagcgattgtttccaagaagaagatctcaggcagggcttccagtggcgaaaatctcttccattcggcgcagcctcctcttacctcaacctagagaagctcggtgagggctcgtacgccactgtatataaaggtatttctcggataaacggccagctggttgctctaaaagtcatcagcatgaacgctgaagagggggtcccttttacagcgatccgggaagccagcctccttaagggcttgaagcatgccaatatagttctgctgcacgacattatacatacgaaggagacactgacttttgttttcgagtacatgcacacagacctcgctcaatacatgtcccagcacccaggggggcttcacccgcacaacgtgaggctctttatgttccagcttttgaggggtttagcatacatacaccatcaacacgtgctgcaccgggatctaaaaccacagaacttgttgatttcacacctaggggagcttaaactggcggatttcggcctggctagagccaagtcaatcccttcccagacctacagcagtgaggtcgtaactttatggtaccgtccaccggacgctcttctcggcgcgaccgagtattcgtctgagttggacatatggggcgcgggctgcattttcattgaaatgtttcagggccagccactttttcccggtgtttctaatatcctcgagcagctggagaagatctgggaagtcctgggggtgcccacagaggatacttggccaggggtctcaaagttgccgaactacaatcccgagtggttccccctaccaacccctagatcactgcatgtggtgtggaataggctggggagagtgcccgaagcagaagacttagcttcacagatgctgaaaggcttcccaagagatcgtgtgagcgcacaggaggccctggttcacgattattttagcgccctccccagtcagctctaccaactgccagacgtctcaggcgtcagactcaagcctgaaatgtgtgacttactcgcttcataccagaagggccatcaccccgcacagttctctaagtgttggtag

SEQ ID NO: 46588 - DNA, 1713 bp, Artificial Sequence
  Description of Artificial Sequence: Synthetic coding sequence
atgcccctgtacggccgggcccgggaccacgtgacccaccccagcatactcggcacaagacccgggaggcccatggccggccccattacagctgcagtgccagaaaagatttgcaatggcgctttctgctcttgtagtggggctttccctctcgatcccaataaccccagcctagggcctctgcccagcatcagccatttaaatcttagaacccaaattgctatggaccggatgaagaagattaagcgccagctgtctatgaccctgcgcggaggacgaggaattgataagactaacggagcccccgagcagattgggctggatgagagcggaggcggcggcggatccgaccccggcgaggccccgacaagagcagcgcccggcgagctacgtagtgccagaggccctctttccagcgctccagagattgtccacgaggacctgaaaatgggaagtgatggagaatctgatcaagcgtcagccacctcatccgacgaagtgcagtcaccagttcgggtgcgaatgcggaaccaccccccacggaaaataagcacagaggacatcaataaaagactaagtcttcccgcggatatccggctcccagaaggatatctagaaaagctgactctgaattctccaatattcgacaagcctctatcaaggcgcctgcgccgcgtgtcactatccgagataggttttggcaaattggagacttacatcaagctggataaactcggtgaaggaacctacgccaccgtttataagggcaaatcaaagctcaccgacaacctcgtcgccctgaaagaaatacgcctggaacacgaggagggcgctccttgcaccgcgattagagaggtctctctccttaaggatctgaaacacgccaatatcgtaacgctacacgatatcatccatacagaaaaatcactgacattggtatttgaatacttagacaaagacctgaagcagtatctggatgattgtgggaacatcataaacatgcacaacgtgaagctgtttttattccagttgttacgcggactggcgtactgtcatagacagaaagtccttcaccgtgacctaaagccacagaacctactgattaacgaacggggggagctaaaattggccgatttcggtttggccagggctaagagcatacctacgaaaacatactctaacgaagtggtgacgctttggtatcggcctccagatatcttgcttggatcgactgactactccacacagatcgatatgtggggggtagggtgcattttctacgaaatggctactggaagaccactcttccccggttctactgtcgaggagcagttgcatttcatcttcagaatactgggaactcctactgaggagacttggccaggcatcctgtccaatgaggagttcaagacgtataattaccctaagtaccgggcagaagccctcctatcccacgcaccccggttggactccgatggggccgaccttctgacaaagctcctgcagtttgagggaagaaataggattagtgctgaagatgccatgaaacatcccttttttctatccctcggcgaaaggatacataaactgccagatactaccagcattttcgctttgaaagaaattcagctccagaaagaggcaagcctgaggagttcttcgatgccggactcgggacgcccagccttcagagtggtcgatacagagttctag

SEQ ID NO: 46589 - DNA, 1491 bp, Artificial Sequence
  Description of Artificial Sequence: Synthetic coding sequence
atggaccggatgaagaagatcaagcggcagctgagcatgaccctgcgcggtggccgaggcatagataaaacgaacggcgcccccgagcagattgggctcgacgaatccggaggaggtggaggctcagaccccggagaagctcctacccgggccgcccctggcgagttaagatcggcacgggggccgctgtcatctgcacccgagattgttcatgaagacctgaagatgggctccgacggggagtcggaccaggcatctgcaacgtccagcgacgaggtgcagagcccagtaagggtacgaatgaggaatcaccctccacgcaagatctctacagaggatataaataaaagactcagccttcccgctgacatccgactccctgaggggtatctggagaagctgaccctgaacagcccaatcttcgacaagcctcttagccgtcgcttacgtcgcgtgagtctgagcgagatcggtttcggtaagctggagacatacattaagctcgataagttgggtgaaggtacctacgccaccgtgtacaagggtaaatcaaagttgacagataatctggtggcattgaaggaaattagacttgaacacgaagaaggtgccccctgtaccgctatcagagaggttagtttactgaaagacttaaagcatgcaaacattgtaacgctgcatgacattattcatactgagaagtctcttacgctcgtgtttgaatatctcgataaggacttgaaacagtacctcgatgactgtggtaatataattaatatgcacaatgtcaagctgtttctattccagctgctacgagggctggcctattgccacaggcaaaaggttctccaccgtgacctcaaaccacagaatctgctaatcaatgaacgaggcgagcttaaactggcagacttcggacttgcgagagctaagtctatcccaactaagacttactccaatgaggtcgtcaccctctggtataggcccccggatattctgctaggcagcacagattacagtacccagatcgatatgtggggtgtgggctgtattttttatgaaatggccaccggcagacctttgtttccaggctccactgtagaagaacagttgcatttcatcttccgtatactaggtaccccaaccgaagaaacctggcctggcatcctaagtaacgaggagtttaagacctataattatccgaaataccgggccgaggcccttctatcacacgcacctagacttgactccgatggcgctgacctgttaaccaagctgctgcaattcgaaggtaggaaccggatttccgctgaagacgcaatgaaacacccatttttcttgagtctcggggaacgcattcacaagcttccggatacaacttccatctttgccttgaaggaaattcagctgcagaaagaagcttcactaaggtccagcagtatgccggactctggccggcccgcttttagggtggtggacacagagttttag

SEQ ID NO: 46590 - DNA, 1509 bp, Artificial Sequence
  Description of Artificial Sequence: Synthetic coding sequence
atgcagagcgagatcgccatggaccggatgaagaagatcaagcggcagctttccatgacactgagggggggccgtggaattgataagactaacggcgctcccgagcagatcggactggacgagagtggcggcggaggtggatctgaccccggtgaagcaccaacccgtgcagcgcccggagagcttcggagtgcgagaggccctttatcaagcgccccggagatagtgcacgaggacctgaagatgggctcagacggggagtccgaccaggctagcgctactagcagcgacgaagtccagagtccggtacgggtgagaatgagaaatcacccccctcggaagatctctaccgaggatattaataagagactatctttacctgcggacatccgattgccagagggatacttggaaaagttaacattgaactcccctatctttgataaacccctgtcaagacggctgcgccgcgtctcattgtctgaaatcggatttggtaaactcgaaacctacattaaactcgacaaactgggcgagggtacctacgcgaccgtctacaaggggaagagtaaattaaccgacaacctcgtggctcttaaagaaatacggcttgagcatgaagaaggcgctccctgtacagctatacgtgaagtaagcctgctcaaggacttgaagcacgcgaacatcgtgactctccatgatatcatccacacagagaagagcttgaccttggtttttgaatatcttgataaggacctgaagcagtatttggatgactgtgggaacattatcaacatgcataacgtcaagttgtttctgtttcagctgttacgcgggctcgcgtactgccacaggcagaaggtcttgcaccgcgacctgaagcctcagaacctgttaataaatgaacggggtgaactgaaacttgctgactttgggctggctagagccaagtctatcccaactaaaacatactctaatgaggtggtgacgttgtggtacaggccaccggatatcctccttggtagcacagactatagcacccaaattgatatgtggggagtagggtgcattttttatgaaatggctaccggacgacccctgtttcccggatctactgttgaagagcagctccacttcattttccgcatccttggcactcccacagaagagacctggccaggtattctcagcaacgaagaatttaagacctacaactacccaaagtacagggctgaggcccttttgagccacgcgccccggctggactccgatggcgccgatctgctcactaaactcctgcagttcgagggacggaaccgaatttccgcagaggatgccatgaagcatccatttttcctgagtctgggggagaggattcataagctcccagataccacaagcatttttgccttgaaggaaatccagctgcagaaggaggcctctctccggtcctcttctatgcctgattctggtcggccagcattccgcgttgtggataccgagttctag

SEQ ID NO: 46591 - DNA, 1491 bp, Artificial Sequence
  Description of Artificial Sequence: Synthetic coding sequence
atggaccggatgaagaagatcaagcggcagctgagcatgaccctgcggggagggagaggaatcgataaaactaatggggcccccgaacagatcggccttgacgagtcaggggggggtgggggaagtgatccaggggaagcgcccaccagagcagcaccaggtgagttgcgttctgctaggggcccgctgagcagcgcacccgaaattgttcacgaggatttgaagatgggctccgacggtgaatccgaccaggccagtgcaacctcaagtgacgaggtgcagagtcctgtgcgggttaggatgcgcaatcaccctccccggaagatcagcaccgaggacatcaacaaaagactttcccttcccgccgatatccggctgccggaaggctacctcgaaaagttgactctgaattcgcccattttcgacaagcctttgtctaggcgcctgcggagggttagcctttccgagattggctttggtaagttggagacatatatcaagctggacaaattgggcgaggggacgtatgctactgtctataagggcaaatctaagctgactgataacctggtggcccttaaggaaatcaggctagagcatgaagaaggggccccctgcacagcaatccgcgaagtttcactcttaaaggatctgaagcatgccaatatcgtgacgttacacgatatcattcacacagaaaaatccctgactctcgtattcgagtatctggacaaagacctgaagcagtacctcgatgattgcggtaatatcatcaatatgcataacgtgaagctttttttgtttcagctactgcgaggactggcatattgtcatcgacagaaggtcctgcatcgagatcttaaacctcagaacttgctgatcaatgagagaggcgagcttaaactcgcagacttcggcctagcacgggctaaatccattcccactaaaacatattccaacgaagtggttaccttatggtaccggccgccggatatcctactggggagcacagactattccactcagatagacatgtggggagtggggtgtattttctatgaaatggctaccgggcgcccactctttcctggaagcaccgtggaggagcagttgcactttatcttccgcattcttggcactccaaccgaggaaacctggccaggtattctctcaaatgaagaatttaagacttacaattaccctaaatacagagcagaggcactgctgtctcatgcgcccagattagattccgacggcgccgacctcctgactaagctcttacaatttgaaggcaggaatcggatctccgctgaagacgccatgaagcaccctttttttctctccctcggcgagcgcatacacaaactgcctgatacgacttcaatcttcgcgctgaaggaaattcaactccaaaaggaggcgagcttgcggtcatcctccatgcctgatagcggccgcccggcttttagagtcgtagacacggagttttag

SEQ ID NO: 46592 - DNA, 570 bp, Artificial Sequence
  Description of Artificial Sequence: Synthetic coding sequence
atggaccggatgaagaagatcaagcggcagctgagcatgaccctgaggggagggcggggtattgataagactaacggggcaccagagcaaatcggtctggatgaaagcgggggggggggaggcagcgatcctggggaagcgccaacccgggccgcaccaggggagctgcggtccgctaggggtcccctgtcatccgcacctgaaattgtccacgaggacctgaaaatggggagtgatggggaaagcgatcaggcgagcgccaccagctccgacgaagtacagtcccctgtacgcgtgcggatgcggaaccaccctccacgaaaaatcagcactgaagacatcaataaaagattgagtcttccagcggacattaggctgccagaaggctatcttgaaaagctgacactgaactccccaattttcgataaacctctcagtcgaagattgaggcgggtctcactgagcgaaatcggctttggtaagcttgagacctacattaagttggataagcttggggaagggacatatgctactgtttacaagggtaagtcaaagctcaccgacaattag

SEQ ID NO: 46593 - DNA, 453 bp, Artificial Sequence
  Description of Artificial Sequence: Synthetic coding sequence
atggaccggatgaagaagatcaagcggcagctgagcatgaccctgaggggagggagaggtattgacaaaaccaatggtgcgccagagcagatcggccttgacgagtcaggtggcggcggcggcagcgatccgggtgaagccccaactcgagctgcacccggagaactgcgcagtgctcggggacctctcagctcggccccggagatcgtgcacgaggacctcaagatgggatccgatggggagtccgaccaggcctccgcaacttcaagtgacgaggttcagtcccctgtaagagtccggatgcgtaatcaccctccaagaaaaatatctaccgaggacatcaacaaacggctgtcactgcccgccgatattagactgccagagggctacctcgagaaactcacattgaattcccccatattcgataaacctttgtcaaggagattaagatag

SEQ ID NO: 46594 - DNA, 462 bp, Artificial Sequence
  Description of Artificial Sequence: Synthetic coding sequence
atggaccggatgaagaagatcaagcggcagctgagcatgaccctgcgaggcggacgtggcatcgacaaaactaacggcgcccctgagcagattggcctcgacgaatctggaggaggcggcggaagcgatcccggagaagcccccacaagagccgctccaggcgagctgcgctcagcaaggggcccactgagcagtgccccagagatcgtgcacgaggatttgaagatgggatccgatggtgagtcagaccaggcttctgccacttcctccgatgaggtgcaatcacccgtgagagtcagaatgcgaaatcacccgccccggaagattagcaccgaagacattaacaaaagacttagtctccctgcagacattagactcccagaaggctatcttgaaaagctgactctgaattctcctatcttcgataagcccctctcaaggcgattgcgaagggtatcttag

SEQ ID NO: 46595 - DNA, 174 bp, Artificial Sequence
  Description of Artificial Sequence: Synthetic coding sequence
atggaccggatgaagaagatcaagcggcagctgagcatgaccctgagaggagggcggggcatcgacaaaaccaacggtgctccggagcagattgggcttgacgaatcgggagggggcggaggaagtgatcccggtgaagctccaactcgggccgctcctggggagctacgatag

SEQ ID NO: 46596 - DNA, 1347 bp, Artificial Sequence
  Description of Artificial Sequence: Synthetic coding sequence
atggaccggatgaagaagatcaagcggcagctgagcatgaccctgcggtctgctccagagatcgtacacgaggatctgaaaatgggaagcgatggtgagtctgaccaggcatccgccactagcagcgacgaagtacagtctcctgtacgggtgagaatgcggaatcatccaccccgcaagatttcaacagaggatatcaataagagactgtcattgcctgcagatattaggttacctgagggatatctcgagaagctcaccctgaattctccaatcttcgacaaaccactgagccgcagattgaggcgcgtatcactgtccgagatcgggtttggcaagctcgaaacctacatcaagttggacaagttaggagagggaacttacgccaccgtgtataagggtaaatctaaattaaccgataacttagtggctctcaaagagatcagactggaacatgaggaaggcgccccgtgcactgctatcagagaggtgagtttgctgaaggatctcaagcatgcgaatatcgtcacgctacatgatatcatccataccgaaaaatcgttaacattagtcttcgagtatcttgataaggatctcaaacagtacctggacgattgcgggaacattattaacatgcataacgttaagctgtttctctttcagttactgcgagggctagcctactgtcatcggcagaaggtgctgcaccgcgatctgaaaccacagaacttactcattaacgagcggggagaactgaagctggctgattttgggcttgccagagctaagtcaatccccaccaagacatactccaatgaagtagttacgttgtggtacaggcctccagatattctgttggggtctacagattattcgacacaaattgacatgtggggcgttggctgcattttctatgaaatggccaccggtcgcccacttttcccagggtccacagttgaggagcagctccacttcatcttccggatactgggcacacccaccgaagaaacatggcctggaattcttagtaacgaagaattcaaaacctataattatcccaagtaccgcgcggaggcactgctcagtcatgctcctcgactcgactctgacggtgccgatctcctgactaaactgctccagttcgaggggcgcaatagaatttccgccgaggacgcgatgaaacacccgtttttcctgagcttgggcgagcgtattcataagctcccagacaccacttcaatttttgccctgaaagagatccaactgcagaaggaagcaagtctccgctcgtcttccatgcccgactccggtcgtcctgcttttcgtgtggtggacactgagttttag

SEQ ID NO: 46597 - DNA, 1806 bp, Artificial Sequence
  Description of Artificial Sequence: Synthetic coding sequence
atgcggggcgcccggcgggcccggcggctgggccggtggctgttcggccctggcatcagacgccactcggccataaggcctctgtgcgcagccagcagacgcgaacacagtgattcaagcaggcggcagagagtacgtggacaccgtccacaacgccccagctcctggccagccgagagggatgccgctagtgcctcagctaccgccgcagccgccgcctcctcatcctcagcggggggcggacccggacccgccactatggctgaggtggctcgggcgcccccaccaattgctatggataggatgaaaaagatcaaacggcagctgtcaatgaccctacgaggtggtcgtgggattgataagacaaatggagcacccgagcaaattggcttagatgagagtggaggcggcggcggcagcgaccccggtgaggcccccacaagggccgctcccggtgagctccgctctgccaggggtccattatctagtgcgccagaaatcgtccacgaagatctcaagatggggtccgacggcgagtcagatcaggcctctgccactagctcagacgaggtgcagtcccctgttagggtaaggatgaggaatcacccgccccgaaagatctcgacagaggatattaataagcgactgagcttgcccgccgacatacgcctccctgaagggtatttggaaaagctgacgttaaattcccctatctttgacaaacctctgtcccgaagactgaggcgcgtgtccctatccgagatcgggttcggtaaattggaaacctatattaagttagacaagctgggtgaaggcacgtatgccacggtgtacaagggcaagtcaaagctcactgataacttggtggccttaaaagagattcgcttggagcacgaggaaggagcaccttgcacagctataagggaggtgtcgctcctaaaagacttaaaacatgccaatattgtgactctgcatgatattatacacaccgaaaaaagtctcacgctcgtctttgagtatctagacaaggatttaaagcagtatctggacgactgcggtaacattatcaacatgcataacgtcaaacttttcctcttccaattgctgagagggctggcgtattgccaccgtcagaaggttttgcaccgcgatctcaaaccacaaaacctcttgattaacgagagaggcgaactgaaactggccgactttgggctcgccagggctaagagtattccaacaaagacatacagcaatgaagtggtaactttgtggtacagaccccccgatatcctgttgggcagtaccgactattctactcagatcgacatgtggggcgtgggttgtatattttatgaaatggcgactggccggcctctgttccccggatccactgtggaagagcagctgcacttcatcttccggattctcggcaccccaaccgaagagacctggcccggcattctgagcaacgaggagttcaagacgtacaattatcccaaatatagggctgaggccttgctcagtcatgccccacgatcgttgtgtccttgtggccggctcgactccgacggagctgacctgctgacaaagctgcttcagttcgagggacgaaacaggatcagtgcggaggatgccatgaagcacccctttttcctctccctgggagaaagaatccacaagctccccgacacgaccagtattttcgctttgaaagagatccagctccagaaagaggcttcactgagatcttcatccatgcctgactcagggaggcctgcctttagagtcgtagacactgagttttag

SEQ ID NO: 46598 - DNA, 1572 bp, Artificial Sequence
  Description of Artificial Sequence: Synthetic coding sequence
atgaagaagttcaagcggcggctgagcctgaccctgcggggcagccagactatcgacgaaagcctgtcggaattggccgagcaaatgaccatcgaagaaaattcgagcaaagacaatgaacctattgttaagaacggccgacccccaacatcccactctatgcactctttccttcaccaatacactggcagcttcaagaagccgccactccggcgaccacactctgtcatcggtggaagtcttggctcttttatggctatgcccagaaatggctccagactcgacatagtacatgagaaccttaagatgggatccgatggggagtccgatcaggcctcaggaacatccagcgatgaggtccagagcccaacaggtgtctgtcttcggaatagaatccaccgcaggatctcgatggaggacttgaacaagcgcctgtctctccccgccgatatccgcattccggatggctatctcgagaagctgcagatcaattcaccaccctttgaccagcctatgtcccgacgtagtcggagagcttccctcagtgaaatcggtttcggcaaaatggagacatacatcaagctggaaaagctgggcgaagggacctatgccacagtctataagggtcgctcaaagttgaccgaaaacctggtggccctgaaagagatccgtttggagcacgaagaaggagccccttgtacggctattcgggaggtgagcctgcttaaggacctgaagcacgctaacattgtgacactgcacgacatcgtacatactgacaaaagtctgacgctcgtgttcgagtacctggacaaagacttaaaacagtatatggacgactgtggcaacatcatgagtatgcacaacgtgaaactctttctctatcagattcttaggggactagcctactgccataggcgaaaagtgctgcatagggacctcaagcctcaaaacttgctaatcaatgaaaagggcgaactaaagcttgccgacttcgggctggcgagggccaagagtgtgcctaccaaaacatattccaatgaagtcgtgacactctggtatagaccccctgacgtgttattgggatcatctgaatacagtacacagatagacatgtggggggtaggctgtattttctttgagatggcaagcggaaggccgctgttcccaggatccaccgtcgaagatgagctccacctgatcttccgcttgctgggcacgccgagtcaagagacctggcctggaatatcttccaacgaagaatttaagaattataactttcccaaatacaaaccccagcccttgatcaaccatgcacctcggcttgatagcgaggggattgaactcatcacgaagttcctccaatacgaatcaaaaaagcgggtgtcagcagaggaggctatgaaacatgtgtacttccgcagcctaggaccacgaatccacgcactgcccgagtcggtgtcaatcttcagcctcaaagaaattcagttgcagaaggacccagggttcaggaattccagttaccccgagaccgggcacgggaaaaatagaaggcagtccatgctgttctag

SEQ ID NO: 46599 - DNA, 1572 bp, Artificial Sequence
  Description of Artificial Sequence: Synthetic coding sequence
atgaagaagttcaagcggcggctgagcctgaccctgcggggcagccagacaatcgacgagtcactcagcgagctcgccgagcagatgacaatcgaggagaattcttcaaaagataatgaaccaattgtgaagaatggacgccctcctacctcccattctatgcattccttcctacatcaatatactggaagttttaagaaaccacccctgcgccggccccactccgttatcgggggcagcctcggcagcttcatggctatgccacgcaacggctctaggctggacattgtccacgaaaaccttaagatgggctctgacggcgaaagtgatcaggccagcggcacctccagtgatgaggtgcaaagccccaccggcgtgtgtcttagaaatcgaattcaccgtcgcatttctatggaagacttaaacaagaggctgtccctccccgcagacattcgaatcccggacggttatcttgagaaactccagatcaatagccctccatttgatcaacccatgtcccgccgaagccgaagagcatcactgagtgagattggtttcggcaaaatggaaacatatattaagttagaaaagctaggtgagggaacttatgcgaccgtgtataaggggcgcagtaagctgactgagaatctggtcgctctcaaggagatccgactggagcatgaggaaggcgccccatgcacagccatcagggaggtaagcctgttgaaggatctcaagcacgctaacatcgtcaccctccacgatatcgtgcacacagacaaatctcttacgctggtgttcgaatacctagacaaagacctcaagcagtacatggacgattgtggcaacataatgagtatgcacaacgtgaaactgtttctgtaccagattttaagggggctagcctactgtcatcgccgcaaagtcctgcaccgtgatctcaagccccaaaacttgttgatcaacgagaaaggcgagctaaaactagccgacttcggtctggcccgggcgaaaagtgtacctacaaaaacatactccaacgaggtggttaccctctggtacagacccccagatgtcttgcttggctcctctgagtacagcactcaaatcgatatgtggggcgtggggtgcattttcttcgagatggcatctggcagacctttattcccaggttcaacagttgaggacgaactgcacctgattttcagactcctcggtacaccctcccaggaaacgtggccagggatctcaagcaacgaagagtttaagaactataactttccgaaatacaaacctcagccactcatcaatcacgctccaaggctggactccgagggaattgagttaataacaaagttcttacagtacgagtcgaaaaagagggtttcagccgaagaggcaatgaaacacgtgtactttagaagcttagggccccgcatccatgcattgcccgagtctgtgtccatattttccctgaaagagatacagcttcaaaaggatcctggatttcgaaacagttcatacccagagactggcgtttttgttattaatcactttacgtgcaggagctag

SEQ ID NO: 46600 - DNA, 540 bp, Artificial Sequence
  Description of Artificial Sequence: Synthetic coding sequence
atgaagaagttcaagcggcggctgagcctgaccctgcggggcagccaaacaatcgacgaatcactgtcggaactagcggaacagatgactattgaggaaaacagcagtaaagataacgagcccatagtgaaaaatggaagacctccgacatcgcactcaatgcattccttcctacaccagtatacgggatccttcaagaaaccccctctgagaagaccacactctgtaatcgggggctcattaggaagttttatggccatgccgcgcaatggatccaggcttgacatcgttcatgaaaacctcaagatgggatccgacggtgagtctgatcaggcgtccggcacgagtagtgatgaggtgcagtccccaactggtgtgtgcttgagaaatcggattcatagacgcatatccatggaggacctcaataagaggctctccctccctgcagacatcagaattcccgatggatacttagagaagctacagatcaatagccccccttttgaccagcccatgagtcgtagatctcggcgcgcctag

SEQ ID NO: 46601 - DNA, 267 bp, Artificial Sequence
  Description of Artificial Sequence: Synthetic coding sequence
atgaagaagttcaagcggcggctgagcctgaccctgcggggcagccagaccattgatgagtccctgagcgagctggctgagcagatgacaatcgaagagaatagcagtaaggacaacgaacctatcgtcaagaacggccggccgcctaccagccacagcatgcacagtttccttcaccaatacaccggtagttttaagaagccacctctgcgaagaccccactcagtcatagggggcagcctgggctccttcatggcaatgccatag

SEQ ID NO: 46602 - DNA, 486 bp, Artificial Sequence
  Description of Artificial Sequence: Synthetic coding sequence
atgaagaagttcaagcggcggctgagcctgaccctgcggggcagccagacgattgatgagagcctgtcggagcttgcagaacagatgaccatcgaagagaacagctcaaaggacaacgaaccaatcgttaagaatggcagaccgccaacttcgcatagcatgcatagcttcctccaccaatatactgggagctttaagaagcctcctctgagacgtccccactctgtgataggtggatccctgggctcatttatggcaatgccaaggaacggttcacgattggatattgtccacgagaatctcaaaatgggcagtgacggtgaatcagaccaggctagcggaacgtccagtgacgaggtccagtccccaacaggcgtctgcttacggaaccgaatccacaggcgcatcagtatggaggacctcaataagcgcctttctctgcccgccgatatcagaattccagatggctaccttgagaaattgtag

SEQ ID NO: 46603 - DNA, 1425 bp, Artificial Sequence
  Description of Artificial Sequence: Synthetic coding sequence
atgatcatgaacaagatgaagaacttcaagcggcggttcagcctgtcagtgcctagaactgaaacgatcgaggagagtctcgcggagttcacagagcaattcaaccaactccacaaccgccgaaacgagaacctgcagctcgggccactcggtcgggatcccccacaggaatgtagcactttttccccaacagactctggggaggagcccggtcagctctcccccggggttcaatttcagagacgccagaaccagcggcgcttctcgatggaggacgtttctaagaggctaagcctgccaatggacattcgactgcctcaagaattcctacagaaactgcagatggaaagtcctgatcttcccaagccactgtcacggatgtccagaagggcctcattgagtgacatcgggtttggcaagcttgagacctatgtgaagctggacaaattgggggaaggcacctacgcaacggtttttaaaggccggtctaagctcacagagaacctggtagccctgaaggaaatccgtctggaacatgaagaaggggcgccttgcacagccatacgcgaagtatcactactcaaaaatctcaaacacgccaatatcgtgactctgcacgacttaatccatactgaccgctctctcactcttgtgttcgaatatcttgactccgatttaaagcaatatttagatcactgcggaaacttgatgtcaatgcataatgtgaagatcttcatgttccagcttctgcgcggtctggcctactgccaccaccggaagatcctccacagggatctcaaaccccagaacctgcttataaatgagcggggtgaactgaagctggccgacttcggattagccagggccaaatctgtgcccacaaaaacatactctaatgaggtcgtgacgctctggtacaggcctcccgacgtgttgctggggagcacggagtacagtaccccaattgacatgtggggggtggggtgtatccattatgagatggccacaggccgacccttgttcccaggctccaccgttaaggaggaattgcacctgatcttccgactattaggaacaccaaccgaggaaacttggcctggcgtgaccgcattttctgaatttagaacatatagtttcccttgctacctgccccagcctttgattaatcacgctcctcggctcgataccgacggaatccaccttctgtcgagcttgctcctatacgaaagtaagagtaggatgagcgctgaggctgcactgtcacattcatatttccgcagtctgggagagcgtgtccaccagcttgaagacacggcgtccatttttagcctgaaagagatccagctgcaaaaagatcccggctaccgtggtctcgcgtttcagcagccgggccgtggcaaaaatcggcgccagtcaatcttttag

SEQ ID NO: 46604 - DNA, 855 bp, Artificial Sequence
  Description of Artificial Sequence: Synthetic coding sequence
atgatcatgaacaagatgaagaacttcaagcggcggttcagcctgtcagtcccccgtaccgagaccatagaggaatctctcgccgaattcacagaacaatttaatcagctacataatcgacgtaacgagaacctgcagttaggccctctcggccgcgacccacctcaggagtgctctactttctctcccaccgattcaggtgaggagcccgggcagctgagccccggcgtacagttccagcgaaggcagaatcagcgcaggttctctatggaggttcgagccagtggagccctccctcggcaggttgctggctgtacccacaagggtgtgcacagacgggccgccgctctccagccagacttcgacgtgtcgaagcgactttcactaccaatggatatcagattgccacaggagttcctgcagaaactgcagatggagtctccagacctgccaaaaccgttatcaaggatgtccagaagggcaagcctgtccgacattggctttgggaaactagagacctacgttaaactggacaaactcggagagggcacatatgccaccgtattcaagggaagatccaagctgacagagaacctggtcgcactcaaagaaataaggctcgaacatgaagagggggcaccatgcacagcaatccgagaggtgtccctcttgaaaaatctcaagcatgctaatattgtaaccctacacgatcttattcatacagatcggtcccttacacttgtgttcgagtacctggattctgatctcaagcaataccttgaccattgcggcaatctgatgagtatgcataacgtgaagatctttatgttccagcttctacgaggcctcgcttag

SEQ ID NO: 46605 - DNA, 1425 bp, Artificial Sequence
  Description of Artificial Sequence: Synthetic coding sequence
atgatcatgaacaagatgaagaacttcaagcggcggttcagcctgtctgtgcccagaactgagaccattgaagaatcattggcggaattcaccgagcagtttaaccaactgcataatagaaggaacgagaatcttcagctaggaccactggggagggacccccctcaggaatgttccactttttctccaactgatagtggcgaggagcccggccaactgtctccaggcgtgcagttccagagacgtcagaatcagagacgtttttcaatggaagatgtcagcaagagactctccctgcccatggacatacgccttccccaggagtttttacagaaattacagatggaaagccccgatctgcctaagccacttagtcgcatgtcaagacgcgcatcactaagcgacatcggcttcggaaaacttgagacttatgtgaagcttgataagctgggcgaaggaacctacgccactgtttttaaaggcaggtctaaactcaccgaaaatttggtggccttgaaagagattcgccttgaacacgaggagggggctccctgcaccgcaatcagggaagtctcattgttgaagaacctgaagcacgccaatatagtaaccctccacgacttgatacatactgaccgctcgcttaccctagtgtttgaatacctggacagcgacctgaagcagtacctggaccactgcggtaacctgatgtcgatgcataatgtcaagatttttatgtttcaattgttgcgcgggctcgcatactgtcaccacagaaagatcttgcacagagatctgaagccccagaacttgctcattaacgaacggggggaactcaaattggctgacttcggtcttgctagagcgaagtcagtgcccactaaaacatatagcaacgaggtggtgactctgtggtatagacccccggacgtgctactgggttccaccgagtatagcactcctattgacatgtggggggtagggtgcattcactacgaaatggcaaccggccgccccctctttccaggatctacagtaaaagaggagctgcatctgatcttcaggctgctgggcacccctactgaagaaacatggcccggcgttacagccttctccgaatttcgtacctactctttcccctgctacctacctcagccgctcattaatcacgcccccagacttgataccgatggtattcatctgctgtcctcactcctgctgtacgagagcaagtcacgaatgtcagctgaagccgcactgagtcattcatacttccgctccttgggtgagcgggtccatcaactcgaggacacagctagcattttctccttgaaagagatccagctgcaaaaagaccccggctaccgcgggttggcgttccagcaacccggtcggggcaagaaccgtcgtcagagcatcttctag

SEQ ID NO: 46606 - DNA, 474 bp, Artificial Sequence
  Description of Artificial Sequence: Synthetic coding sequence
atgagcatgcacaacgtgaagatcttcatgttccagctgctgcgggggcttgcttattgccatcatagaaagatcctgcaccgagatcttaagccccagaatctgcttatcaatgaacgtggcgagttgaaactggcagatttcgggctggctagagctaagtcggtgcccactaaaacctactccaatgaagtcgtgacactgtggtaccggccccccgacgtgcttctagggtctactgagtattctaccccgatagatatgtggggcgtgggctgcattcactacgaaatggccactgggcggcccttgttccctgggtcgactgtgaaagaggagctgcacttgatcttcaggctcctgggcacccccacagaagagacatggcccggtgttactgcgtttagcgaatttcgcacgtattcattcccctgctaccttcctcagccactgattaatcatgccccccggtag

SEQ ID NO: 46607 - DNA, 1515 bp, Artificial Sequence
  Description of Artificial Sequence: Synthetic coding sequence
atgatcatgaacaagatgaagaacttcaagcggcggttcagcctgagcgtcccacgaacagaaactattgaagaaagcctggccgagtttaccgaacagtttaatcagttacataaccgacgaaatgaaaatcttcagctgggtccactgggtagagaccctccccaggagtgttcaacgttcagcccgacagatagcggtgaagagcctgggcagctgtcacccggcgtgcagtttcagagacgccaaaaccagagaagattctcaatggaggtgagggcaagtggtgccctacctcgccaagtagccggatgtactcacaagggggtgcaccggagggccgcagcactgcagcctgacttcgatgtatccaagcgtctgtcacttccgatggacatccgcctaccacaggaatttttgcagaagcttcagatggaatctcctgacctgccaaagccactgtccaggatgagccggagggcgagcttgtctgacatcggtttcggcaaactggaaacatacgtgaaactagataagctgggagagggcacctacgccacagtcttcaagggaaggtctaagctcactgaaaacttggtggccctgaaggaaatccgtctagagcacgaggagggtgcgccatgcacggctataagagaggtgtcattgttgaaaaacctcaagcatgccaacattgttaccttacacgaccttatccacaccgatcggtctcttacgctagtctttgaatacctagattcagacctaaaacagtacctcgatcactgtggtaatctcatgtccatgcataatgtgaagatcttcatgtttcagctgctgaggggactggcgtactgccatcaccgtaagattcttcacagagatctgaagccacagaatctgctcatcaacgagcgaggggagctaaaattggcagattttgggcttgccagagccaaatccgtgcccacaaagacatactctaatgaggtggtgaccctctggtatcgccctccagatgtcctcctggggtctactgaatacagtaccccgatcgacatgtggggggtcgggtgtatccattacgaaatggccaccggaaggccgctcttccccggtagtaccgtgaaggaggagctccacttaatttttcgtctgctgggcacaccaactgaagaaacatggcccggggtgacagcgttttcagaatttagaacctattccttcccctgctacctgccacaacctctcatcaatcatgctccacggctcgacaccgacggcattcatcttttgtcatcactgctgttgtatgaaagcaaatccagaatgtcagctgaggctgctctctcacattcatatttccggtcgctgggcgagagggtgcatcaactggaggatacagctagcattttttccttgaaggagatccagttgcagaaagaccccgggtatcgaggtctggcattccaacagcctggccggggaaagaaccgtcgacagtccatcttctag

SEQ ID NO: 46608 - DNA, 1329 bp, Artificial Sequence
  Description of Artificial Sequence: Synthetic coding sequence
atgagcgcctgccgggagatcgccctgctgcgggagctgaagcaccctaacgtgatcgcgctccagaaagtgttcctgtcacacagcgaccggaaagtctggctcctttttgactacgcggaacatgacctgtggcacattattaagttccatcgcgctagcaaagcaaacaagaagcctatgcagcttccgcgtagcatggtcaaaagtctgctttaccagatccttgatggcatccactatttacacgctaactgggttctgcacagggacttaaaaccagccaacatcctcgtcatgggcgaaggccccgagagaggacgggttaaaattgcagacatggggtttgctagattgttcaattccccattgaaacctttagctgacctggatccagttgtggtcacattctggtaccgcgctcctgaactgttgctcggggctcgtcactacaccaaagcaatagacatttgggccatcggctgtatcttcgccgaattgttgacatccgaacccattttccattgtcgacaagaggacataaagacatctaatccgttccatcacgatcagttggacaggatcttttcggtcatgggatttcccgctgataaggactgggaggacatccggaagatgccagaataccctaccctgcagaaggacttcaggcggacaacctacgcaaatagcagcctgataaaatacatggagaaacacaaggtcaagcccgactctaaggtctttttattgctacagaagcttctgacaatggacccaacaaagcggattaccagtgagcaagcactccaagatccctattttcaggaagacccgttgccaaccctggacgtcttcgcggggtgccaaatcccctaccccaagagagagttcttgaatgaagatgatcccgaggaaaaaggtgacaagaaccagcagcagcagcagaaccagcaccaacagcccacagctccacctcaacaggccgctgctcccccacaggctcccccacctcagcagaactctactcagactaacggaactgccggcggggcaggtgccggcgttggaggtaccggagccgggctgcagcacagccaggactcttcactaaatcaggtgcccccgaataagaaacctaggcttgggcctagcggcgccaacagcggggggccagtgatgccgtccgattatcagcactctagttcccgtctaaactaccagagtagcgtgcagggcagctctcagtcacagtctactcttgggtactcatcctcctcacagcagagctcacagtaccacccgagtcatcaggctcacagatactag

SEQ ID NO: 46609 - DNA, 1509 bp, Artificial Sequence
  Description of Artificial Sequence: Synthetic coding sequence
atggactacgacttcaaggccaagctggccgccgagcgggagcgggtagaggatttatttgagtatgagggctgtaaggtgggccgcgggacgtacggtcacgtctacaaggcccgacgaaaggacgggaaggatgaaaaggagtatgcactaaagcaaatcgagggcaccggaatctcaatgtcagcttgcagggagatcgccctgctgcgcgagctaaaacatcccaatgtgattgccttacagaaagtgtttctgtcccactcagacagaaaagtgtggctgctcttcgactacgctgagcatgatctctggcatatcatcaaatttcaccgcgcttcgaaggctaataagaagcccatgcagttaccacgaagtatggttaagtcactgctgtatcaaatactggacggaattcattacctccatgccaactgggtgctgcaccgggatcttaagcccgctaatatcttggtcatgggggagggccccgagcgcggacgggtaaaaatagcagatatgggattcgccaggctgtttaattcacctctgaagccactggcagatctggaccctgtggtggtgactttctggtatcgcgcccccgagcttctgttaggggctagacactataccaaagcgatcgacatatgggcaattggctgcatatttgcggagctgctaacatcggagccaattttccactgtagacaggaggatatcaaaacgtcaaatccatttcaccatgaccagctggaccggatattttccgtgatgggtttcccagcagacaaagactgggaagacattcggaagatgccggagtaccccacattgcagaaggacttcaggagaacaacatatgccaattccagccttatcaaatacatggagaaacataaggtgaaacctgactctaaagtgttcctgttactccaaaagcttttgacaatggatcccactaagaggataactagcgagcaggccctgcaagacccatattttcaggaggatcctttacctacccttgacgttttcgccggctgccaaattccatacccaaagcgggaattcctgaacgaggatgatcccgaggagaaaggagacaagaatcagcagcaacagcagaatcagcatcagcaaccaactgcgcccccccagcaggctgccgccccgcctcaagcacccccccctcagcagaactcaacacagacaaatggtacagcagggggcgccggagccggagtggggggtacaggggccgggctgcagcatagccaagactccagccttaatcaggtgccgccaaataaaaagccacgactcgggccgtcaggagccaactctggtggccccgtcatgccctcagattatcagcactcaagttctcggctgaactaccaatcttctgtacaaggtagctcccagagccagagcaccctcggctacagctcaagttcacagcagtcatcgcagtaccacccaagtcaccaagcccatagatattag

SEQ ID NO: 46610 - DNA, 1326 bp, Artificial Sequence
  Description of Artificial Sequence: Synthetic coding sequence
agcctgacccggaacatccagctgctgcgggagctgaagcaccccaacgtgattgcgctccagaaggtgtttctgagtcactcagacagaaaggtgtggctgttgtttgattacgccgaacacgatctttggcacattatcaagttccaccgtgcgtccaaggccaacaaaaagccaatgcagttgcctaggagcatggtaaaatccttgctttaccagattctcgatgggattcattacctccacgccaactgggtgctgcaccgggacttaaagccagccaacattcttgtgatgggtgagggtccggagaggggtagggtcaaaatcgcagacatggggtttgccaggttgttcaattctccactgaagccactcgccgaccttgacccggtggtggtaaccttttggtatcgggcgccggaacttttgctgggcgccagacactacacgaaggccattgacatatgggcaatcggctgtattttcgccgaattactcacttcagaaccgatattccattgccggcaggaagatatcaagacctccaatccttttcaccacgaccaactcgacagaatattctctgtgatggggtttcccgctgacaaggattgggaggacataaggaagatgccggagtacccgacactccagaaggattttaggaggactacctacgcaaattcgtcgctcatcaagtacatggaaaagcataaagttaagccggattcaaaagtcttcctgctcttgcagaagctcttgaccatggaccccacaaaaaggattacgagcgaacaggcactgcaggatccctactttcaggaggatcccctgcccaccctggatgtgtttgccgggtgtcagatcccctaccctaagagggagtttcttaatgaggacgaccccgaggaaaaaggtgacaaaaaccagcagcagcaacagaaccagcatcagcagcctaccgcgccgcctcagcaggccgctgcacccccacaggcccctcccccgcagcagaattctacccagaccaatgggaccgctgggggggcaggagctggagtagggggcaccggagccggcctgcagcatagccaggatagctcattgaaccaggtgccaccgaacaagaaacctcgtttgggaccaagcggggcaaattctggcggcccagtgatgccttctgactatcaacattccagttctaggctgaactatcaaagctcagttcagggctcatcgcagagtcagagcactttaggctatagcagctccagtcagcagtctagtcagtatcacccttcccaccaagctcacagatactag

SEQ ID NO: 46611 - DNA, 1137 bp, Artificial Sequence
  Description of Artificial Sequence: Synthetic coding sequence
atggacttcgtgttcaaccccctgtggaagtacctgtgcctgctggccgggaagtgtatcgtcctgctggtccgccctaagctcaaacccgcaaatattcttgtgatgggggaaggacccgagaggggccgggttaagatagctgatatgggcttcgctcgccttttcaactctcctcttaaaccgctggctgatctcgaccccgttgtggttacattctggtaccgggcccccgagttattattgggcgcgagacattacaccaaggctatcgatatctgggccatcggctgcattttcgccgagctcctgacatctgaacctatttttcactgcaggcaagaagatatcaagacaagtaatcctttccaccacgatcagcttgaccgaatattctcagtaatgggattccctgctgacaaagactgggaagacattcgaaagatgcctgaatacccaacattgcaaaaggattttagaaggaccacatatgccaactcttcattgatcaaatatatggaaaaacacaaggtgaaacctgattccaaggtatttcttctgcttcagaagctcctgactatggaccccacgaagcggataaccagcgaacaagcattacaggatccttactttcaggaggaccccttacccaccctggacgtgttcgccggctgccaaattccctacccaaagcgcgagtttctgaatgaggacgacccagaggagaagggggacaagaaccagcagcagcagcagaatcagcaccagcaacccaccgcacctcctcagcaagctgctgcacccccccaggctccaccgccccaacagaactctacacagactaatgggaccgcgggaggagcaggtgctggtgtgggggggaccggcgctggtttacagcatagccaggatagttcactgaatcaggtcccacctaacaaaaagccaaggctcggaccttcaggggccaattctggggggccagtcatgccgagcgactaccagcatagcagctcccggcttaactatcagtcatctgtgcagggtagtagtcagtctcaatcgactcttggctattccagctctagtcagcaatccagccagtatcacccctctcaccaggcacacaggtactag

SEQ ID NO: 46612 - DNA, 756 bp, Artificial Sequence
  Description of Artificial Sequence: Synthetic coding sequence
atgagcgcctgccgggagatcgccctgctgcgggagctgaagcaccctaacgtgattgccttgcagaaggtgtttctgagccatagcgacagaaaagtctggcttcttttcgattacgcggaacatgatctctggcacatcatcaaatttcacagagcatccaaagccaacaaaaaacctatgcaactgcctagaagcatggtgaagagtctcctttaccagatactcgacgggatccactatttacacgccaattgggtcctgcacagggatctgaaaccagctaatattctggtcatgggtgaggggcctgaaaggggtagagtcaagatagccgacatgggatttgctaggctgtttaactcaccactcaaacccctcgcagacctggaccccgttgtggttacattctggtacagagcccctgaactgctgttgggcgcacgccattataccaaggcaatcgatatctgggcaattggatgcatattcgctgaattgctgaccagcgagccaatctttcattgcaggcaggaggacataaaaacgagtaacccgtttcaccacgatcagctcgatagaattttcagcgtgatgggcttccctgcagataaagattgggaggacatcaggaagatgcccgagtaccctactctacagaaagattttagacgtaccacctacgctaattcttccttaattaagtacatggagaagcataaagtgaagcctgattccaaagtttttctgctctag

SEQ ID NO: 46613 - DNA, 381 bp, Artificial Sequence
  Description of Artificial Sequence: Synthetic coding sequence
atgagctacaagcccatcgcccccgcccccagcagcacccccggcagcagcactccagggccaggtacccccgtacccactggatctgtcccttctccttctggatccgtgcctggtgctggcgctccctttcgccctctattcaacgattttggccccccttccatggggtacgtccaagctatgaagcccccaggagcacaggggtcacagtccacgtacacagatctcctttccgtgatcgaagaaatggggaaagagattcgcccgacttacgctggttccaagtcggctatggaacggctgaaaaggggcatcatccacgctcgagcgctggtcagggaatgccttgccgagaccgaacggaatgccagaacgtag

SEQ ID NO: 46614 - DNA, 1077 bp, Artificial Sequence
  Description of Artificial Sequence: Synthetic coding sequence
atgatggagaagtacgagaagatcggcaagatcggcgagggcagctatggcgtggtgttcaaatgcagaaatagggacacggggcagattgtcgcaataaagaaatttctggaatcagaagatgacccagtgattaagaaaatcgctctcagggaaatcagaatgttgaaacagctcaagcaccctaatctggtgaacctcctggaggtgtttcgcagaaagcgtcggctgcacctggtttttgaatattgcgatcatactgtcctccacgagttagataggtatcagagaggcgtccccgaacaccttgttaagtctatcacctggcagacattgcaagctgtgaacttctgtcacaagcataattgcatccacagggacgttaaacccgagaacattctgattactaagcactcagtcatcaaattatgcgacttcggtttcgctcgattgctgactggaccttccgactattacacggattatgtggcaactaggtggtaccgttcacctgaactgctggtcggagacacacagtatgggcccccagtggacgtgtgggccattggatgtgtctttgccgagctcctgagtggagtgccactttggccaggtaaatctgacgtggaccagttatacctgattagaaagacgctgggggatttgataccacgccaccagcaggtgttcagcaccaatcagtatttctctggagtgaagattcccgacccagaggacatggagcccctagagctaaagttcccgaacattagctaccccgctttaggcctcttgaagggatgcctccatatggaccctacgcagagactaacctgcgagcagctactgcaccacccatactttgagaacatccgggaaatcgaagatctggcaaaagagcacaataagccaacccgcaagaccctgcggaagtctcgcaagcatcactgtttcactgagacctctaagctccaatatctgccccagcttactggcagcagtatacttcccgcccttgataataagaaatattactgcgacacgaagaagctgaattatcgattccccaatatatag

SEQ ID NO: 46615 - DNA, 747 bp, Artificial Sequence
  Description of Artificial Sequence: Synthetic coding sequence
atggaggcccccgagggcggcggcggcggccccgccgcccggggccctgaagggcagcccgctcctgaggcacgggtacattttagggtggcccgcttcataatggaggcaggcgtgaaactcggtatgagatcaatccctatcgccacggcttgtaccatttatcacaagtttttctgcgaaactaacctggatgcgtacgacccctatttaatcgccatgagttctatctacctagccggcaaagtggaagagcaacatctaagaactcgagatatcatcaacgtctcaaatagatatttcaacccgtccggagaacctctcgagttggactctcgtttttgggagttacgcgacagcatcgtccaatgcgagctgctaatgctgagggtcttgaggtttcaggtaagtttccagcatccacataagtacttgctccattatctcgtctccctgcaaaactggctaaatcgacacagctggcagcgaactccagtcgctgtaacagcatgggcactgctgagggattcctaccatggggccttgtgtctaagatttcaggcccagcatatagccgttgccgtcctctatctggctcttcaggtgtacggggtcgaggtgcccgcagaggttgaagctgaaaagccctggtggcaagtgtttaacgacgaccttaccaaacccataatcgacaacatcgtttccgatcttatacagatctatactatggacactgagattccgtag

SEQ ID NO: 46616 - DNA, 1134 bp, Artificial Sequence
  Description of Artificial Sequence: Synthetic coding sequence
atggagctgagcgtgctgctgttcctggccctgctgaccggcctgctgcttttgctggttcagcgccaccctaacagtcatggaacccttcctccagggcctcgtcctctgccgctactggggaatctgcttcagatggaccgcaggggcctgctcaagtcgtttttgcgcttcagagaaaaatatggcgatgtatttaccgttcacctgggccctcgtcctgtcgtgatgctgtgtggtgttgaagccatcagggaggcactcgttgataatgcagaagcgtttagtgggagaggcaagatcgtgatcatggatccagtgtaccaggggtatgggatgctcttcgcaaacgggaacagatggaaggtgttgagaaggttttcagtgaccactatgcgagacttcggtatgggcaagagaagcgtcgaagagcgtatccaggacgaagcccagtgcctaatcgaggaactgcgcaagtcaaaaggtgctctagttgaccctacctttttatttcacagtatcacagccaatattatctgcagcattatctttgggaaaagattccactaccaggatcaggagttcctcaagactctgaatctgttctgtcagagctttttacttatttcatccatctcaagtcagctgttcgaactatttagtgggttccttaaatatttccctggagcacatagacaagtctataagaacctgcaagagattaacgcctacatagggcacagtgtcgaaaaacatagggagacgctagacccgtccgctccacgcgacctgattgatacttacctgctgcacatggagaaggaaaaatcaaacccacattccgagttctcccaccagaacttgatcattaatacgctgtcgctgtttttcgcaggaaccgagacaacttctacaacactgcgctacggtttcctgttgatgctcaagtacccccacgtggccgaacgtgtatacaaggaaatcgagcaagttgtggggccccaccgacctcccgctctggacgatcgcgcaaaaatgccttatacggaagcggtcatccgggagatccagcgatttgctgaccttctgcctatgggcgttccccacatcgtgacacaacacacttccttctag

SEQ ID NO: 46617 - DNA, 999 bp, Artificial Sequence
  Description of Artificial Sequence: Synthetic coding sequence
atggccctgctgtgctacaaccggggctgcggccagcggttcgacccagagactaactctgatgacgcatgtacctaccatcctggagtaccagtgttccatgatgccctcaaggggtggtcatgctgcaaacgaagaaccaccgacttttcggactttctgagcatcgtaggttgcaccaaaggcagacataacagtgaaaaacctcccgagcccgtaaagcctgaggttaaaactacagaaaagaaagaactctgtgagctaaaacccaaattccaagagcatattatacaggcccccaagcctgtagaagccattaagaggcctagtccggatgaaccaatgaccaaccttgagttgaaaatttctgcatcactgaagcaggccctagacaagctcaaactgagctctggtaacgaggagaacaaaaaagaagaggataatgacgagatcaagatagggacgtcttgcaagaatggcgggtgctccaagacttaccaggggctggaaagcctcgaggaagtctgtgtatatcatagtggagtccctattttccatgaagggatgaaatactggtcctgctgtcggcggaagacctccgacttcaacactttccttgcccaagaaggttgtactaaaggcaagcacatgtggaccaagaaggatgctgggaaaaaagtggtgccttgccgacatgattggcaccagacaggaggcgaagtcactattagcgtgtacgcaaaaaacagcctgcccgagttgtccagggtcgaggctaacagcactctcttgaacgtccacatcgtattcgagggagagaaggagttcgatcagaacgttaaactgtggggagtgatcgatgttaagaggtcatatgtcacaatgacagctactaaaattgaaattacgatgagaaaggccgagccaatgcaatgggccagcctggagttgcctgcagccaaaaagcaggagaagcagaaggatgctaccacagattag

SEQ ID NO: 46618 - DNA, 942 bp, Artificial Sequence
  Description of Artificial Sequence: Synthetic coding sequence
atggccctgctgtgctacaaccggggctgcggccagcggttcgacccggaaactaactctgacgatgcgtgcacttaccacccaggtgtgcccgtatttcacgacgcactgaaagggtgtacaaagggccggcataatagcgagaaacctccagaaccagttaaaccagaggttaagacgaccgagaaaaaagaattgtgtgaacttaagccaaaattccaagagcacatcatccaagcgcccaagcccgtcgaagcgataaaaagaccttcccccgacgagcccatgacaaacctcgaactgaagatatccgcctccctaaagcaggctctggacaagctgaagctatcatcaggtaacgaggaaaacaaaaaggaggaggacaacgatgaaattaagattggcacgagttgcaagaacggtgggtgcagtaaaacatatcagggcctcgaatcccttgaagaagtatgcgtttatcactctggagtgccaatattccacgagggaatgaagtattggagttgctgcaggcggaagacatcagacttcaacacgtttttagcacaggagggctgtactaaagggaagcacatgtggaccaaaaaagacgcaggcaagaaagttgtcccgtgtcgccacgactggcaccaaactggcggagaagtgacaatctcagtttacgccaaaaactctttaccagaattgtcacgagtcgaggccaattccactctgctgaacgtgcatattgttttcgaaggcgaaaaagagtttgatcagaatgtcaagctctggggtgtgatcgacgtgaagcgaagctatgtaaccatgacagctactaagatcgaaattaccatgaggaaagcagagccaatgcagtgggcatccctggaactgcccgccgccaagaaacaggagaagcaaaaggacgcaacaaccgattag

SEQ ID NO: 46619 - DNA, 1563 bp, Artificial Sequence
  Description of Artificial Sequence: Synthetic coding sequence
atgagcatccccctgaagagcagcttcctgctgagctacctgtgcacgctaccgcctgctttgctgtctagggagattcttatggccgattccgaggccttgccaagtcttgctggcgatcctgttgctgtagaggcccttctgcgggccgtttttggagttgtggtggacgaagctatccaaaagggcaccagcgtgtcacagaaggtgtgtgagtggaaggaaccagaagagctgaagcagctgctcgacctggagctgaggtctcaaggcgagagccagaagcaaatacttgagagatgccgggcagtgatcagatacagtgtgaagacagggcaccccagattctttaaccagctgttcagtggactggaccctcacgcgctggctggacggattatcacagaatcactgaacacctcacaatacacatacgagatcgctcctgtattcgtgctgatggaggaagaggtgctgaggaaattgagagctctcgttggctggagcagcggagatgggatcttttgtccgggcggtagcatttctaatatgtacgccgtgaacctggcaagatatcaaaggtaccctgactgcaagcaaagagggctccgcacgctccccccattagcccttttcacaagcaaggaatgccactactctatacagaaaggcgctgcgttcctaggactgggcactgactcggttcgggtggtgaaggccgatgaaagggggaagatggtgccagaggatttagaaagacaaattgggatggcagaggctgaaggtgctgtgccattcctggtctctgctacgtctggcaccacagtactgggtgccttcgacccattggaggcaattgctgacgtttgtcagcgacatggactctggctacacgtagacgcggcctgggggggaagcgtcttgctgtctcagacacacagacaccttttagacggcattcagagggctgactccgtggcctggaacccgcacaagctgttagccgccgggctccagtgctctgccctgctgttgcaggatacctcaaatctgctcaaaagatgtcatggatcacaggccagctacctttttcagcaagataaattttatgacgttgcactcgacaccggggacaaagttgtacagtgcggtcggagggttgactgcctgaagctgtggctcatgtggaaggcccaaggcgatcagggacttgaacgccggatagaccaagcctttgtgttggcgcggtacctggtcgaggaaatgaagaaaagagaggggtttgagctggtgatggaacccgagttcgttaacgtctgcttttggtttgtccccccctcactgcggggtaaacaggaaagtccagattatcacgagcggctgtcaaaggtggcaccggttctcaaagagcgaatggtgaaggaagggtccatgatgataggataccagccccatggaacgcgcggaaactttttcagagttgtagtggcaaactccgccctgacctgtgctgacatggatttcctgcttaatgaactggagcggttgggccaggacctgtag

SEQ ID NO: 46620 - DNA, 1749 bp, Artificial Sequence
  Description of Artificial Sequence: Synthetic coding sequence
cacggcctgcgggccaccgaggccctgcccagcgtgcggaccaccctgcggtcccttggtctcgctcccacctgccaggcccgccctcccgctggctccctggccgcaaggaggctgttgcaggcaccggcccacccagcgaaccctaccgccgccgccgcccccactgggaccgaagccactagtcagatgtgggcgacacactcgggaaggccgcgcagctacctgtgcactctgccgccagcccttctctcccgagagattctgatggccgactctgaagctctaccctcactggctggtgatccagtcgctgtggaagccctgctgcgggccgtgtttggggtggtggttgacgaggcaatacagaaaggaactagcgtctcacagaaggtgtgcgagtggaaggaacctgaagagttgaagcaactgctggacctggagctgcgcagccagggagagtcccagaagcagattttggagcgctgtcgggctgttatccggtactcagtcaaaaccggacaccctagattttttaatcagctcttctctggcttggatccacatgccctcgcagggcgcatcattactgaatctctgaatacctcacagtatacctacgaaattgcaccagtatttgtactgatggaggaggaagtgctccgcaaactacgagctctcgttggctggagcagtggggacggtatcttttgccccggcggctctatctctaacatgtatgctgtcaatcttgctagataccagcgctaccctgattgtaaacagcgggggctcagaaccctcccgccgctcgccctcttcacttccaaagaatgtcactattccatccagaagggggcagcgttcctgggattaggcactgactccgtgcgcgttgtgaaagctgacgaacgtggtaagatggtgcctgaggacttggagcggcagataggtatggccgaagccgaaggggcagttcccttcctcgtatcggcaacatcaggaacaactgtgctgggcgcctttgacccgctggaggctatagccgacgtttgtcagagacacgggctctggcttcatgtggatgcagcctggggggggtcagttctgcttagccagactcatcgacacctgcttgacggaatccagcgggctgattctgttgcttggaatccacacaaactgctggctgccggcttgcagtgcagcgccttgctgctgcaagacacatccaacttactgaaaaggtgccacggctcccaggcctcctacttgttccagcaggataaattctatgatgtcgctcttgacaccggtgataaagtggtgcaatgtgggaggcgagtggactgtctgaaactctggctgatgtggaaagcccaaggagatcagggtttagagcgtcggattgatcaggccttcgtactggctagatatttggtagaggagatgaagaagcgggaaggctttgagttggtcatggagcccgagttcgtgaacgtgtgcttttggttcgtcccaccttctctgcggggtaagcaagagagtcctgactaccatgagcgcttatctaaggtggcccccgtcctaaaggaacgtatggttaaggaaggaagcatgatgattgggtaccagccgcatgggacaagagggaacttcttcagggtggtggtcgctaacagcgctttgacatgtgcggatatggactttctgctgaacgagttggagcgtttgggacaagacctgtag

SEQ ID NO: 46621 - DNA, 1041 bp, Artificial Sequence
  Description of Artificial Sequence: Synthetic coding sequence
atggccgacagcgaggccctgcccagcctggccggcgaccccgtggctgtggaagcattgctgcgagccgttttcggcgtggtcgtggacgaggcaatccaaaagggaacctctgtgtcacagaagtgccactattccattcagaagggagccgccttcctaggactcggtaccgattccgtccgcgtggttaaagctgatgagcgaggtaaaatggtcccggaagacttagagcgtcagatcgggatggctgaagccgagggtgccgtgcctttcttagtgtccgctacctcagggaccacagtgctgggagcctttgatccacttgaggctatcgcagacgtgtgccagcggcacgggctgtggctgcacgtcgatgccgcttggggcggctcagttctgctgtcacagactcaccgccatttgcttgacggcattcagagggcagactccgttgcttggaatccgcataaactcctagcagcagggctccagtgcagtgctctactgttgcaggacacatcgaacctgctgaagagatgtcacgggagccaggcctcctatttgttccagcaggataaattctatgatgtagcactggacactggagataaggtggtccagtgcggcaggcgcgtggactgtttaaaattatggctcatgtggaaagctcagggcgatcaagggctcgaaaggcgtattgaccaggcattcgtgctggcccgctatttagtggaggaaatgaagaagagagaaggatttgaactcgtcatggaacccgagtttgtcaacgtgtgcttttggttcgtccccccttcgctacgaggtaagcaggagtcaccagactaccacgaacggctatccaaagtggcccccgttttaaaggaaaggatggtcaaggagggctcaatgatgatcggataccagccccacggaactcgcggaaatttcttcagggttgtggttgcgaattctgcattgacctgcgccgacatggacttcttactcaacgagttagaacgtctcggtcaggatttgtag

SEQ ID NO: 46622 - DNA, 1041 bp, Artificial Sequence
  Description of Artificial Sequence: Synthetic coding sequence
atggccgacagcgaggccctgcccagcctggccggcgaccccgtggctgtggaggcccttttgcgcgctgtgttcggagttgttgttgacgaggctatccagaaggggacttccgtgagccagaaatgtcattactccattcagaagggtgctgcctttcttggactgggcaccgattctgtgagggtggtgaaggctgacgagagaggcaaaatggtgccggaggacctcgagcggcagattggtatggcagaggcagagggagcggtgccttttctggtcagcgcaacttccggaactactgttctcggggcattcgatccactagaagccatagctgatgtgtgccaacgccacgggctgtggctccacgtagacgcagcctggggcggttctgttctcctgtcccagacacatcgtcacctcctggatggaatccagcgagctgactccgtggcgtggaatccgcataaactgctggcagctggactgcaatgcagcgctctgctcttgcaggatacctccaatctgctgaagcggtgtcacgggagccaggcctcttaccttttccagcaggacaaattttatgatgtcgcactagatactggtgacaaagttgtacagtgtggacgccgtgtggattgcctgaaactttggctgatgtggaaagcgcagggggaccagggcctggagagacgaattgaccaggcctttgtcctagctcgatacctcgttgaggagatgaagaaacgtgaagggtttgagcttgtaatggaaccagagttcgttaacgtgtgcttttggtttgtgcccccatctttgcgaggcaaacaggaatcccccgactaccacgaaaggcttagcaaggtggcgccggtactgaaagagcgaatggtcaaggagggctccatgatgattggttatcagccgcatggaacccggggtaatttcttccgggttgttgtggccaattccgcactgacatgcgctgacatggatttcctcttgaatgagctagagcggttgggtcaggacctctag

SEQ ID NO: 46623 - DNA, 1365 bp, Artificial Sequence
  Description of Artificial Sequence: Synthetic coding sequence
atggccgacagcgaggccctgcccagcctggccggcgaccccgtggccgtagaagctttactccgtgccgtcttcggggtggtagtcgacgaggcaatacaaaaagggacctcagttagtcagaaagtatgtgaatggaaggaaccggaggagctgaagcagctcctggatttagagcttcgctctcaaggcgagtcacagaagcagatcctggagcggtgtcgggccgttatccggtattctgttaagaccggacaccccaggttcttcaaccagctgttttcaggattagacccacacgccctagcaggaaggatcatcaccgaaagcttgaacacctcacagtatacctacgagatcgcacccgtttttgtgcttatggaagaagaggtgcttagaaagctgagggccctcgtgggctggagcagcggggatgggatttctgcactgtgccattactcgattcaaaaaggcgccgcattcctcggactcggtaccgactcagtacgggttgtcaaggcggatgagcggggcaagatggttcccgaagacttggaacggcagattggcatggctgaggctgagggcgctgttccctttttggtgtctgccacctccggcaccaccgtgctcggcgcctttgacccattagaggccatcgctgatgtctgtcagcgccatgggctgtggttacacgtagatgctgcctggggagggtcagtccttctctcccagacccatagacacttactggacggcatacagcgcgccgattcggtagcgtggaaccctcataaactgctcgccgccggattacaatgcagtgcgcttctgttgcaggacacctccaatctgctcaagaggtgccatggtagccaggcctcttacctgttccaacaagacaagttctacgacgtcgccctcgatacaggagacaaagtcgtgcaatgtggacgccgagtggattgtctgaaactgtggctgatgtggaaagcccagggagatcaaggactggaacggaggattgaccaggcttttgtgctcgctcgctatctagtagaagagatgaaaaaaagggaaggctttgagctagtgatggagccagagttcgtaaatgtgtgtttttggtttgtgccgccttctcttcgagggaaacaggagtctcctgactaccacgaaaggttgagcaaggttgctccggttctcaaggagcgcatggtgaaggagggctccatgatgatcggctaccagccacatggaacgcgaggcaacttttttcgggtagtggtagctaatagcgctttaacgtgcgcagacatggacttcctactgaacgagctagagaggctgggacaggatctgtag

SEQ ID NO: 46624 - DNA, 1482 bp, Artificial Sequence
  Description of Artificial Sequence: Synthetic coding sequence
atggccgacagcgaggccctgcccagcctggccggcgaccccgtggccgtggaagctctcctgcgggccgtattcggcgtcgttgtagacgaggccatccagaaggggacgagcgtctcgcagaaagtgtgtgagtggaaagagcctgaggagctcaaacagctgctggacttagagctgcgctcccagggagagtcccagaagcaaattctggaacgctgcagggcagttatcaggtacagcgttaaaaccgggcatcctcgcttcttcaaccagctctttagcggcttggatcctcacgccctggccggccggataatcaccgaatcacttaacactagccagtacacttacgagatcgcccccgtgtttgtgctgatggaagaggaggtgctaagaaagctgcgagctctggttggctggtcttctggggatggaattttctgccccggtgggagtatctcaaatatgtacgccgtgaacctggccagataccagcgctaccccgactgtaagcagcgggggctgcggaccctgccaccgctggccctctttacctcaaaggaatgccactacagtattcagaagggtgcagctttcttaggccttgggactgattcagtgcgtgtggtaaaggccgacgagaggggcaaaatggtgcccgaggatctagaacgtcagatcggcatggctgaggctgagggcgcagttccttttctggtgtcagccactagcggcaccacagtactgggagctttcgatcctctggaggcgattgctgacgtttgccagcgccatggtttgtggctccacgtagatgcagcctgggggggctctgtactcctgagccaaacacatagacacctcctcgatggtatccagcgggctgactctgtagcttggaacccacacaagctgctggcggccggcctccagtgtagtgcactgctcttacaagacacctcaaatctcctcaagaggtgccacggtagccaggccagctacctgttccaacaggacaagttctacgatgtcgctctggacaccggcgacaaggtagttcagtgcggtcgcagggtggactgtctgaaactgtggctgatgtggaaagctcagggcgaccaggggctggaacgccgtatcgaccaagccttcgtcttggcacgctacctcgtagaggagatgaaaaagcgggaaggctttgagctcgtgatggagcctgagttcgtgaatgtgtgcttctggtttgtacccccatctctccggggcaagcaggagtccccagactaccacgaacggttgtcaaaagtggctcccgttctgaaagagcggatggttaaggaaggatccatgatgattggctaccagccccatggcacaaggggtaatttctttagggtagtggtggcgaacagtgcacttacatgcgccgatatggacttcctccttaatgagctcgaaagacttggtcaggacctctag

SEQ ID NO: 46625 - DNA, 459 bp, Artificial Sequence
  Description of Artificial Sequence: Synthetic coding sequence
atggccgacagcgaggccctgcccagcctggccggcgaccccgtggccgtcgaagccttactgcgggcagttttcggagtggtcgttgacgaggctattcaaaaagggacaagcgtctcacagaaagtctgtgaatggaaggaaccagaagaactaaaacagctcctagatctcgagctgaggtcacagggcgagtcccagaaacagatactcgagcggtgccgggccgtgatcagatattccgtaaagaccggacatcctcggttcttcaaccagctgttctccggtctggatccccacgcccttgccgggcgaattatcactgagagtcttaataccagtcagtatacgtacgagattgcccctgtttttgtgctcatggaagaagaggtgctgagaaaattaagagccctggtcggttggtcctcaggggacggcattttctgcccaggactgtag

SEQ ID NO: 46626 - DNA, 804 bp, Artificial Sequence
  Description of Artificial Sequence: Synthetic coding sequence
atggccgacagcgaggccctgcccagcctggccggcgaccccgtggccgttgaagcgctgctgcgtgcagtgttcggagtcgtcgtggatgaggcaattcagaaagggacctcagtcagccaaaaggtgtgcgaatggaaagaacctgaggaacttaagcagctcctcgatcttgagttacgctcccaaggtgagagccaaaagcaaatccttgagcgatgccgcgctgtaatccgttacagcgtgaagaccggccatccaaggtttttcaaccaactcttctcaggattagatccgcacgcgctcgccggcagaatcatcacggaatcactgaacacttcacagtacacttatgagatcgcacccgtatttgttcttatggaggaggaggtgctgcggaagctgcgtgctttggtggggtggtcaagtggggatggcattttttgtcccggcggttccatctctaatatgtacgctgtcaacctcgcacggtaccaacgttaccccgactgtaaacagcgaggattaaggacacttccgccacttgcgctgttcaccagcaaagaggtggggaagcgtcaccggcccaatcctggcttgcttattctaatcagttctcatgtcaccactccttcacgccgagagttgcgattctgggacctagcacccacagtctcagagtggtcgaggcttatgcgggaagggaagtggagtccgcggatttggcgcggtcgtttggtttggccaagactgcgtgtgctttgtcggtcttggtccgtgccaccactggcacctctatgttag

SEQ ID NO: 46627 - DNA, 300 bp, Artificial Sequence
  Description of Artificial Sequence: Synthetic coding sequence
atgagcagccagcagagcgccgtgagcgccaagggcttcagcaagggcagtagtcagggacctgccccatgtccggctcctgcacccactccggctccagcatcaagcagctcctgttgcggcagcggcagaggctgctgcggggactcaggttgttgcggatcatcatccaccagttgttgctgttttccccgacgccggaggcgccaacgatcttctggttgttgctgctgtggcggagggtcacagcgctctcaacggtcaaacaatcgctcttcgggatgctgttcaggctgctag

SEQ ID NO: 46628 - DNA, 372 bp, Artificial Sequence
  Description of Artificial Sequence: Synthetic coding sequence
atggccagccacgtggagtgccggcccctgggcgtgttcgagtgcgaactgtgtacactgactgctccctattcttacgtcggccagaagcccccaaatacacagagcatggtcttgctcgaagaaagctacgtgatgaaagaccccttcacaagcgacaaggataggttcctggtgctgggatcctgctgtagtctctgcagccggctcgtctgcgtgggtccagaatgttccctgttctatagtaaacgtttctgtctcccatgtgtgagggaaaacattaacgcttttcctcaagagattagacaggacctcgagaaacggaaagcaccatctaagaggaccccgtcgcagcccggcagccgtacctag

SEQ ID NO: 46629 - DNA, 1545 bp, Artificial Sequence
  Description of Artificial Sequence: Synthetic coding sequence
atgaaggaggccggccagatgcagaacctggagagcgcccgggccggaagatccgtgtctacccagaccggaagcatgacaggacagattccgcggctgagcaaggttaacttgttcaccctgctgtcattatggatggagctgtttcctgctgaggctcagcggcagaaatcacagaaaaatgaagagggaaagcacggccctttgggggacaacgaggagaggacaagggtgagtaccgacaaacggcaggtcaaacggaccgggctagtcgtcgtgaaaaacatgaaaatcgtcgggctgcactgttcatctgaagaccttcatgcagggcagattgccctcatcaaacatggatccagattgaagaactgtgacctatattttagccgcaagccttgcagtgcatgcttaaagatgatagtgaacgccggggtcaaccggatttcatactggcccgcagatccagagatcagtctgctgactgaagcgtcgagtagcgaagacgccaaactggacgccaaagctgttgagaggttgaaaagcaactctcgcgcccatgtctgcgtcctgctccaaccccttgtgtgttatatggtgcagtttgtggaagagaccagttacaaatgtgacttcattcagaaaataacgaaaacacttccggacgcaaacacggacttctactatgagtgtaagcaagaaaggataaaggagtacgagatgctttttctggtgagtaatgaagagatgcataagcagattctcatgaccattgggctcgaaaatctgtgcgagaacccatatttctcaaatctgcggcagaacatgaaggacctgattctgttattggctacggtcgcctccagcgtgcccaatttcaagcactttggattctataggagtaacccggaacagatcaacgagattcacaaccagtcactccctcaggagatcgctagacattgcatggttcaggccagactgcttgcctacaggaccgaagatcataagactggggtgggcgccgtaatttgggctgagggaaaaagccggtcctgtgatggaacgggcgccatgtacttcgtggggtgtgggtacaatgcgttccccgtgggatcagaatacgccgacttcccacatatggatgataaacagaaagaccgagagattcgtaagtttaggtacatcatccacgcggagcaaaatgcgttgacgtttaggtgccaggaaatcaagcctgaagaaaggagtatgatattcgtcactaaatgcccatgcgacgaatgtgtccctctgattaaaggagcaggaattaaacagatttacgccggagacgtggacgtgggaaaaaaaaaggccgatatctcctacatgaggttcggggagctggaaggcgtttctaagtttacgtggcaactgaatccatcaggcgcctacgggctagagcagaacgaaccagagaggcgcgagaacggtgtgctgcgtcccgtgccccagaaggaggaacaacatcaagataagaagttacgattggggatccactag

SEQ ID NO: 46630 - DNA, 951 bp, Artificial Sequence
  Description of Artificial Sequence: Synthetic coding sequence
atggtgcagttcgtggaggagaccagctacaagtgcgacttcatccagaagataactaagaccctcccggacgctaacaccgatttttactacgagtgtaagcaggagcggattaaggagtacgagatgctgttccttgtgtccaatgaggaaatgcacaagcagatccttatgactattggcctcgagaatctatgcgagaatccttacttctccaacctcaggcaaaacatgaaagacctgattctccttttagctaccgtcgcaagttcggtgccgaatttcaaacactttgggttctaccgctcaaacccggagcagataaacgagattcacaatcagagtctacctcaggagatcgcaagacactgtatggtacaagctcgtctgttggcatatcgaaccgaagaccataaaaccggtgtgggtgccgtgatctgggccgaaggcaaatctagatcgtgtgacggtactggagctatgtactttgtcggctgtggctacaacgcatttcccgttggatccgagtacgctgatttcccgcacatggacgataaacagaaagatagagagatcaggaaatttagatacatcatccatgctgaacaaaacgcccttacatttaggtgtcaggagatcaaacccgaggaaagatcgatgatctttgtcactaagtgtccttgcgacgagtgtgtgcccctcataaagggagccgggattaaacagatttacgccggggatgtggacgtgggaaagaagaaagctgatatctcttacatgcgtttcggagagcttgaaggcgtgtcgaaattcacgtggcaactgaacccaagtggagcttacgggctcgagcagaacgaaccggaacgtcgggaaaacggcgtgctacgccctgtgccgcagaaggaagagcaacatcaagacaagaagttaaggctgggtatccactag

SEQ ID NO: 46631 - DNA, 462 bp, Artificial Sequence
  Description of Artificial Sequence: Synthetic coding sequence
atgaaggaggccggccagatgcagaacctggagagcgcccgggccggcaggagcgtctctacccagaccggctccatgaccggtcaaattcctagactatctaaagtgaatctgtttacgctcctgagcctttggatggagttgtttcctgctgaggcacaacgacaaaagtcacagaagaatgaggaggggaagcatggccccctgggcgataatgaggagaggacgcgagtctccacggataaacgccaagttaaacggaccggcctggttgtggttaagaatatgaagatcgtaggcttacactgctcatctgaggatctgcatgcgggccaaattgctctcatcaaacacggaagtcggctgaaaaattgtgatctgtacttcagcagaaagccctgctctgcctgtttgaaaatgatcgtaaacggccttttggaggccgcaaaaatgccccgctag

SEQ ID NO: 46632 - DNA, 1506 bp, Artificial Sequence
  Description of Artificial Sequence: Synthetic coding sequence
atggacgagaacaacggcctgctgctgctggagctgaacccccccaatccgtgggacttgcaaccacgctcgcccgaagagctcgcctttggggaggtccagataacatatctcacccatgcatgtatggatctgaagctgggagataagagaatggttttcgatccttggctgattggccccgcttttgcaaggggatggtggctgctgcacgagccaccgtccgattggcttgagagactgtgccaggccgaccttatctatataagccatctgcacagcgaccacctgagctaccctacccttaagaaactcgccggacggcggccagatattcccatttatgtggggaatacagagaggcctgtgttttggaatttgaaccaaagcggggttcagttaacaaacataaacgttgttcccttcggaatttggcagcaggtggataaaaatttgcgcttcatgattctgatggacggggttcatccagaaatggatacgtgcattattgtagagtataaaggacataaaattctgaatatcgttgactgcactagaccgaatggcggacggctccccatgaaggtggctctgatgatgagtgacttcgccggcggagcctcaggctttcccatgactttctctgggggcaaattcactgaagagtggaaagcccagtttatcaaaacggagagaaagaaactgcttaactataaggcccggcttgttaagaacctgcagccacgtatttactgtcctttcgctgggtacttcgtggagagccacccatccgataagtatatcaaagaaacaaacaccaagaatgaccctaacgaactgaataatttgattaagaagaacagcgacgtcatcacctggacaccaaggcctggcgcaactctggacctgggacgaatgctaaaagaccgcaccgactccaaggggatcatcgagcctcctgagggtactaaaatttacaaggactcttgggatttcgagccttacctggaaattcttaacgcagccctgggggacgaaatatttcttcattctagctggataaaagagtactttacttgggcaggctttaaagattacaatctggtggtacggatgatcgaaaccgatgaggattttaatccctttcccggggggtacgattatctggtggacttcctcgacctttctttccccaaagagcgtccacagcgcgaacatccctacgaagagatacactctcgggtggatgtgatccgtcatgtcgtcaaaaacggtctcttatgggacgaactgtacatcggcttccaaacacgtctgcagagagacccagacatttatcaccatctcttttggaatcactttcaaattaaactgccgttgaccccgcctaattggaagtcttttcttatgtgttgtgagcaaaacgggcccgtaattctgcaattcagcactgaaaggacaaatgaacctaatagaaacaagttttcagttgagaataaggcatag

SEQ ID NO: 46633 - DNA, 1461 bp, Artificial Sequence
  Description of Artificial Sequence: Synthetic coding sequence
atggacgagaacaacggcctgctgctgctggagctgaacccccccaacccatgggaccttcagccccgctcacccgaggaactcgccttcggcgaagtccaaattacttatctcacgcacgcttgcatggaccttaaactcggcgataagcggatggtattcgacccttggcttatcggcccagcctttgcaaggggctggtggctgctccacgaaccgccgtctgattggttggagaggttgtgccaggctgatttgatttatatctcccacctgcacagcgaccacctcagctaccccaccttaaagaagctagccgggaggagaccagatatacctatttacgtgggcaacactgaaaggccagtgttttggaacctcaatcagtcaggcgtccagctcactaacatcaatgttgtgccattcggcatctggcagcaggtggacaagaacctacgtttcatgatcctcatggacggggttcacccggagatggacacctgtataatcgtagagtacaaaggccacaagattctgaatatcgtcgactgtactagacccaacggaggacggctaccgatgaaagttgccctcatgatgtctgatttcgcgggaggcgcgtccggcttccctatgacgttttcaggaggtaagttcacagaggagtggaaggcgcagttcatcaagacagagcggaaaaaactcctcaattacaaagcccgcctggtgaagaacctgcagcctcgcatatattgccctttcgctggctactttgtggagagccatccttcagataagtacattaaagaaacgaacactaagaatgatcctaacgaacttaataatctgatcaaaaagaactccgacgtcatcacatggacccctcgccctggcgcaaccctagacttgggtcggatgctgaaggacagaactgatagtaagggaatcatcgaacctcccgagggtacaaagatctacaaggattcttgggacttcgaaccctacctcgagattctgaatgctgccctgggagacgaaatctttctgcactccagttggataaaagagtattttacctgggccggctttaaggactacaacctagtcgttaggatgattgaaactgacgaagattttaacccgttccccggaggttacgattaccttgtggacttcctggacttgtctttccctaaggagcggccccagagagagcacccctacgaggagatccactctagggttgatgttattaggcacgtggtgaagaatggattactgtgggatgagctgtatattgggttccaaacccgcctgcaacgtgacccagacatctaccatcacctattttggaaccacttccagataaagctgcctctcactccgcctaactggaaatcatttctcatgtgctgcgagcagaatggtccggtgatcttgcaggaatgtaaaacaacgtag

SEQ ID NO: 46634 - DNA, 663 bp, Artificial Sequence
  Description of Artificial Sequence: Synthetic coding sequence
atggacgagaacaacggcctgctgctgctggagctgaacccccccaatccatgggacctccaaccccgatccccagaggagttagccttcggcgaggtccagatcacttatttgacacatgcctgtatggatttgaaacttggtgacaagcgaatggttttcgacccgtggctcatcggcccagcgttcgcgagaggatggtggctccttcatgagccaccgagcgactggcttgagcgactgtgtcaggcagatctcatctatatctcccacctacattccgatcacctgtcctatcccacgctgaagaaacttgccggccgaaggcccgatataccaatttacgtggggaacaccgagagacctgttttttggaatctaaatcagtccggcgtgcagctgactaacataaatgtcgtcccattcggtatttggcagcaggtagataaaaatctgaggtttatgatactgatggatggagtccaccccgagatggatacctgcataatcgttgagtacaagggccacaaaatcctgaatattgtcgattgtacaaggcccaatggaggcagattaccaatgaaggtggctctgatgatgagtgacttcgctggtggtgcaagtgggtttcctatgacgtttagcggtggcaagttcacttag

SEQ ID NO: 46635 - DNA, 681 bp, Artificial Sequence
  Description of Artificial Sequence: Synthetic coding sequence
atggacgagaacaacggcctgctgctgctggagctgaacccccccaacccgtgggatctgcagcctcggtctccagaggaactggctttcggagaagtgcagatcacctacttgacccatgcttgcatggatctcaagctgggggacaaacgaatggtgtttgatccctggcttatcggcccagccttcgccaggggctggtggctgttgcacgaacccccctccgattggctggagagactgtgccaggctgatttgatctacatttctcatttgcactctgatcatctgagctatcctacactgaaaaagcttgcaggcagacgccccgatatccctatatacgtcgggaataccgagagaccagtgttctggaaccttaaccaatcgggtgtacagctgaccaacattaatgtcgtgccgtttggaatttggcagcaggtggacaaaaatctgaggttcatgatccttatggatggagtacaccctgaaatggacacgtgtattatcgtggagtacaagggccataaaatcttgaatattgttgattgcaccaggcctaacggaggtaggctgcctatgaaggtggcgctgatgatgtcagacttcgccggaggcgcttccggctttcctatgactttttccggggggaaatttacagccgaggaaactctgatttag

SEQ ID NO: 46636 - DNA, 1506 bp, Artificial Sequence
  Description of Artificial Sequence: Synthetic coding sequence
atggacgagaacaacggcctgctgctgctggagctgaacccccccaatccatgggatctacagccgcggtcgccagaagaactggcgtttggcgaggtgcaaatcacatatcttacccacgcttgcatggatttgaaactgggggataaaagaatggtgttcgatccgtggctgatcggcccagcctttgctcgaggctggtggctcctgcatgaacctccctctgattggctggaaaggctgtgccaggcagatctgatctacatttcccatcttcatagcgaccacctatcctaccccaccttgaaaaaactggccggacggcgtcccgacatccctatctatgtcgggaacaccgagcggccagtgttttggaaccttaatcagagcggcgtgcagctgaccaacatcaacgtagttcctttcggcatttggcagcaggttgataaaaatcttcgcttcatgatactgatggacggcgtgcaccccgagatggatacatgcatcatcgtagagtataagggccataagattctgaatatcgtcgactgcaccagacctaacggtggccgccttcccatgaaggtggcacttatgatgtccgattttgcagggggcgccagcggcttcccaatgactttcagtgggggaaagtttaccgaggaatggaaggctcagttcataaagacagaaagaaaaaagttactcaattacaaggcaagactggtaaagaatctgcagcccagaatttactgtccattcgcagggtattttgttgagtcccacccaagcgataagtacataaaggaaaccaatactaaaaatgatccgaacgaactgaacaacctcataaagaagaattcggatgtgatcacttggacgccccggcccggtgccaccctcgacttgggaagaatgctcaaagaccgtacggattctaaaggaatcatcgaaccacccgagggaaccaagatctacaaagatagctgggacttcgagccctaccttgagatcctcaatgcagccttgggggacgaaattttcctgcattctagctggattaaagaatattttacatgggccggctttaaggactacaacctggtcgtaaggatgatcgagacagacgaagacttcaatcccttccctggcgggtacgactacctagtggactttctcgacctttcattccccaaggagaggccccaacgcgaacacccctatgaagagattcatagcagagtggatgtaatcagacacgtggtaaagaacgggcttctgtgggatgaactatatattggtttccagaccaggctgcaaagggacccagatatttaccaccacctcttttggaaccatttccagatcaaactgccactcaccccacccaactggaagtcatttctgatgtgctgcgaacagaatggacctgttatattacagttctccaccgagaggaccaatgaaccaaaccgtaacaaattctctgtagagaataaagcctag

SEQ ID NO: 46637 - DNA, 522 bp, Artificial Sequence
  Description of Artificial Sequence: Synthetic coding sequence
atggacgagaacaacggcctgctgctgctggagctgaacccccccaatccctgggatctgcagccaaggagtccagaggagctagcttttggagaggtgcagattacctacttgacacatgcctgtatggatctcaaactgggggacaaacggatggtctttgacccttggcttatcggacccgcctttgcgcggggttggtggttgctgcacgaaccaccttcagattggcttgaacggctgtgccaggctgatttaatctatattagccacttgcatagcgaccacctctcgtacccaaccctcaagaagttggccgggagacgtccagacatcccaatatatgttggaaatactgagcgtccagtcttctggaacctaaaccagtcaggtgtgcagctgaccaatatcaacgtggtgcccttcggaatctggcagcaggtggacaagaatttaaggtttatgattttgatggatggtgtgcaccccgaaatggacacttgtattattgtggaatattag

SEQ ID NO: 46638 - DNA, 687 bp, Artificial Sequence
  Description of Artificial Sequence: Synthetic coding sequence
atgccccggcggggcctggtggccggccccgacctggagtacttccagagaagatacttcacacccgcagaagtggctcagcataaccggccagaagacctgtgggttagttacctggggcgggtttatgatctgaccagcttagcacaagaatacaaaggcaatctgctgcttaagcctatcgtagaggtggctgggcaagatatctcccactggttcgaccccaagaccagagacattcgtaaacacatcgatccgctcacaggatgcttgcggtactgcactccgcgcgggcggttcgtgcacgtgccccctcagctaccctgtagtgactgggctaatgacttcggaaaaccttggtggcaaggctcctattacgaggtggggcgactgtccgccaaaaccagaagcatacgcatcatcaacaccttgacatctcaggagcacacgctggaggttggggtcctagagtctatctgggaaatcttacacagataccttccttacaacagccacgcggcctcatatacgtggaaatacgagggaaaaaacttgaatatggactttaccctggaggagaatggaattcgcgatgaagaggaagagttcgattatctgtcaatggatgggaccctgcacacccccgcaattctcctgtattttaacgatgatctgactgagctgtag

SEQ ID NO: 46639 - DNA, 474 bp, Artificial Sequence
  Description of Artificial Sequence: Synthetic coding sequence
atgccccggcggggcctggtggccggccccgacctggagtacttccagcgacggtatttcacaccagccgaggtggcccagcataacaggccagaagatctgtgggtgagttatttagggagggtgtacgacttaacttcactggcgcaggaatacaagggaaaccttcttctgaagcccatcgtcgaagtggctggtcaggatatttctcattggtttgacccaaagacacgcgatattcgaaagcatatcgaccctctcaccgggtgtttgaggtattgcactccccgcggccgattcgttcacgtaccaccgcaattgccctgtagcgactgggccaatgattttggcaagccctggtggcagggctcgtactacgaggtggggaggcttagcgctaaaactaggtctatcaggataatcaatacccttaccagtcaagaacacactcttgaaatccatgaggagttgtag

SEQ ID NO: 46640 - DNA, 744 bp, Artificial Sequence
  Description of Artificial Sequence: Synthetic coding sequence
atgatggccgagcgggaggaggacgacgacaccgaggaggcctggatgcaactgcggcctacggaaccactgccaagtcagtgctgtggtagtgggtgcagcccttgtgtcttcgatctgtatcacagggacctcgcccgttgggaggccgcccaggctagcaaagatcggtcactgctgcggggccccgagagccagagttgcccctcaaagttgaacccggagacattcgttgctttctgtattatcgctatggatcgactgaccaaagacacctacagagtcaggttcgctctacctggaaatagccagctgggcctacgaccagggcaacatcttattctccggggtatcgtagacgatctagagatccagcgggcatataccccaattagtcctgcgaatgcagaagggtattttgaagtgttaatcaaatgctatcagatgggcctgatgtctcgttacgttgagtcgtggcgcgtgggagatactgctttctggcgaggaccatttggagactttttctacaagcccaatcaagaatcaagctccgagcagctaccatggtcataccaagagaagacacacttcggccacctgggtcaagatctaataaaagagctagtgtcatgttgcagacggaaaccattcgcactggtctgtggttccgccgagttcaccaaagatatcgccaggtgtctgctgtgtgcggggctcacagaggattcgtactttttgttctag

SEQ ID NO: 46641 - DNA, 504 bp, Artificial Sequence
  Description of Artificial Sequence: Synthetic coding sequence
atgggcctgatgagccggtacgtggagagctggcgggtgggcgacactgcattctggaggggtccctttggtgatttcttctataagcctaatcagtatggagaactgctgctcctcgcggccggtacaggactggccccaatggtcccaatcttgcagagcattacagataatgagaatgatgaaacctttgtgacactcgtggggtgcttcaagacattcgagagtatataccttaaaacattcctgcaggagcaggcgcgcttctggaacgtgagaacattcttcgtgctcagtcaagagagcagctccgaacagctcccgtggagctatcaggagaagacccactttgggcacctcggacaggatctgattaaggaattagtcagctgctgccgaagaaagccatttgctctcgtatgtggatctgctgagtttaccaaagatatagcacgttgtctgctctgtgccgggctcaccgaagacagttactttctgttttag

SEQ ID NO: 46642 - DNA, 948 bp, Artificial Sequence
  Description of Artificial Sequence: Synthetic coding sequence
atgatggccgagcgggaggaggacgacgacaccgaggaggcctggatgcagctgaggccaaccgagcccctgccctcacagtgctgtggctctggctgttctccatgcgtgtttgacctgtaccatcgcgacttagccaggtgggaagccgcccaggcctccaaagacaggagcctgctgcgcggacctgaaagccagtcttgtccaagcaaactgaatcctgaaacatttgtcgccttctgtatcattgctatggaccgcctgacaaaggatacataccgggtaagattcgcccttcctgggaattcccagctgggcctgagaccaggccagcacctaatactgcgggggatcgtagatgacctggagatacagagggcctacaccccaataagccctgcgaatgcagaaggttactttgaggtgctcattaaatgctaccagatgggccttatgtcacgctatgtggagagctggagagtaggtgacaccgcgttttggcgcggaccttttggggatttcttttacaagcctaaccaatatggcgagctactactgctggcagccggaacaggactggctcctatggtcccgatacttcagagtatcacagacaacgaaaacgacgagacatttgttactctggtgggatgttttaagacctttgagagcatatacttaaagactttcctgcaagaacaagcccgcttctggaacgtccgcacttttttcgttttgtcccaggagagttcctcagaacaacttccgtggtcttaccaagaaaaaacccattttggccatttgggccaggatctcataaaagaactggtttcctgttgtagacggaagccctttgctctggtgtgcggctcagcagagtttacaaaggacatagcccggtgtctactgtgcgccggtcttactgaggatagctactttttattttag

SEQ ID NO: 46643 - DNA, 417 bp, Artificial Sequence
  Description of Artificial Sequence: Synthetic coding sequence
atgatggccgagcgggaggaggacgacgacaccgaggaggcctggatgcagctgcgccctaccgagcctttgccctcccagtgctgtggtagcggatgttctccatgtgtctttgacctgtaccatcgggatcttgccagatgggaagcagcacaggccagtaaggaccgttcactgctccggggccccgagtcacagtcgtgtccatcgaaactgaatcctgagaccttcgtcgccttttgcataatagctatggatcgtttgactaaagatacttatagggtgcgcttcgccctgccggggaacagccagctcggtctccgtcccggccagcatctgattttacgctatacacaggtcgccggtggtcctaagctgcatagtccggctctcctctttgcatcctgttggccgtag

SEQ ID NO: 46644 - DNA, 948 bp, Artificial Sequence
  Description of Artificial Sequence: Synthetic coding sequence
atgatggccgagcgggaggaggacgacgacaccgaggaggcctggatgcaactgcggcccacagaacctttgccctcccagtgttgcggttccgggtgctcaccgtgtgtgttcgatctgtatcacagagaccttgccagatgggaggccgcccaggcaagtaaggataggtcactgctccgagggcccgaatcgcagagctgtccaagcaagctgaatccagagactttcgtggctttctgcataattgctatggacaggcttactaaggacacctaccgggtgcgctttgcactgcctgggaattctcagctgggactcaggcctggacaacacctcatcctgagaggcatagttgacgaccttgagatccagcgcgcttacactccaatcagccccgccaatgctgaaggttatttcgaagtcttaataaagtgttatcagatgggccttatgtctcggtatgtcgaatcttggcgggtcggggacacagcattttggcgcggtccgttcggggacttcttctacaaaccaaatcaatacggagagctgctgttgctggccgctggcacagggctggctcccatggtccccattctgcagtccatcacagacaacgaaaatgatgaaactttcgttactttggtgggatgctttaagactttcgagtcaatctacctgaaaactttcctgcaagagcaggccaggttctggaacgtgagaaccttcttcgtcctgagccaagaaagctcctcagaacaactgccctggtcctaccaggaaaagacccacttcggccaccttggtcaggaccttattaaggagctcgtgagttgctgtcggcgcaaaccctttgctcttgtttgtgggagtgctgaatttacaaaagatatagctcggtgtcttttgtgcgcaggattgacagaagacagttactttctattctag

SEQ ID NO: 46645 - DNA, 744 bp, Artificial Sequence
  Description of Artificial Sequence: Synthetic coding sequence
atgatggccgagcgggaggaggacgacgacaccgaggaggcctggatgcagctgaggcctactgaaccactaccaagtcagtgctgcggatcgggatgctctccatgcgtttttgacctgtaccaccgagacttggcaaggtgggaagctgcacaggcctccaaggacagatcactcctgcggggcccagagagccagtcctgcccaagcaaactgaatccagaaacctttgtggcattctgtatcatagccatggaccgcctaacaaaagacacctacagggtgcgcttcgcccttccaggtaatagccaactgggcctgagaccaggacagcatctcatcctgcgaggtatcgtggacgacctggaaatacagagggcttataccccaatctctcccgcaaatgcggaaggatactttgaggtgctgatcaagtgctaccagatgggactgatgagccgctacgtcgagtcctggagggtgggggacacagcattttggcgcggtccattcggggattttttctataaacctaaccaagaaagttcaagcgagcagcttccctggtcatatcaagaaaagacccacttcggacatctcggccaagaccttatcaaggagctagtgtcgtgttgccgccgcaagccctttgctctggtatgcgggagcgccgaattcaccaaagacatcgctaggtgtctgctttgcgctgggcttaccgaagatagctacttcctgttctag

SEQ ID NO: 46646 - DNA, 948 bp, Artificial Sequence
  Description of Artificial Sequence: Synthetic coding sequence
atgatggccgagcgggaggaggacgacgacaccgaggaggcctggatgcagctccggcctactgagccgcttccatctcagtgctgtggcagcggatgctctccttgtgttttcgatctataccacagagacctggcccggtgggaagcagcccaggcctcaaaggacaggtctctgctgagaggaccagagtcccagtcatgcccctctaagctcaatccggaaacctttgtagcattttgcatcatagccatggaccggctgacaaaagatacatatcgtgtgagattcgcattaccaggaaatagccagctgggcctgcgacctggccagcatctcattctgagagggattgtggatgacctggaaatccagagggcctacactcctataagtcctgcaaacgccgagggttatttcgaggtactcattaaatgctatcaaatgggactgatgagccgatatgtagagagctggcgtgttggtgataccgcattttggcgcgggccatttggcgattttttctataaacctaaccagtacggcgaactgttgttactagcggccggaaccggactggccccgatggtgcccattctgcagagtattactgacaacgaaaacgatgaaacttttgtcactctggttggttgtttcaagacatttgagagcatttacctcaaaaccttccttcaggagcaggctagattctggaacgtgagaacttttttcgtgctcagccaggaatcctcatctgagcagctgccatggtcctaccaggagaagacacatttcggccatctcggccaagacctgattaaggagctggtaagctgctgtaggagaaagccgtttgcattggtctgtggctcagccgagtttacaaaggacatcgcacgatgcttgctgtgtgctggcctgaccgaggattcctactttctgttctag

SEQ ID NO: 46647 - DNA, 246 bp, Artificial Sequence
  Description of Artificial Sequence: Synthetic coding sequence
atgagccggagcagcaaggtggtgctgggcctgagcgtgctgctgaccgcagcaacagtggctggcgtgcatgtcaaacagcagtgggaccagcagcggttgagagatggagtcatacgcgacattgaaaggcagatcaggaagaaagaaaacatccggctccttggagagcagattatcctgactgagcagctcgaagccgaacgggagaagatgctgctggccaagggaagccagaagtcctag

SEQ ID NO: 46648 - DNA, 810 bp, Artificial Sequence
  Description of Artificial Sequence: Synthetic coding sequence
ggcctgctgctggtggccctgctggccagcctgaccgtgatggtgcttatgagtgtctggcagcagcgaaaatctcgcggcaagcttcctctcgggcctactcccttgctgttcatcgggaactatcttcagttaaataccgagcatatctgtgatagcatcatgaaaataagcgaaagatacgggcccgtgtttaccattcacctgggtccccgcagagtggtcgtgctttgtggccacgatgccgtgaaggaggcgcttgtggaccaggcagaagaattctctggacggggggagcaggccacatttgactggctgttcaagggatatggggtgacttgcagaacatgggagaggaccaaaccgttgagaagatttagcatcgcaacactgcgcgatttcggagtgggtaaacggggtataaaagaaatccaggaaaaggcaggttttttaatcaaggcacaccagtccagcgatagctcgatttaccccacttttttcctctcccggacgacatccaatgttatctcctcaattgtgttcggggacaggttcgactacgaggacaaatttttgtccctcttgtgtatgatgctggagtcttttcaattcaccgcccctagcactggccagctctacgaaatgttctcatccgtgatgaagcatctacccggcccccagcagcaggcatttaaagaacttcagggcctcgaagattttattgcgaagaaggtggagcacaaccagtgtacccttgatccaaattccccgcgggactttatcgacagttttctcataaggatgcagtag

SEQ ID NO: 46649 - DNA, 1338 bp, Artificial Sequence
  Description of Artificial Sequence: Synthetic coding sequence
atgggcctggaggccctggtgcccctggccatgatcgtggccatcttcctgctgcttgtggacctcatgcaccgccatcagaggtgggctgcccgctacccacctggccccctacccttgccaggtttagggaatcttcatgtggattttcagaacacgccctactgctttgaccaattgcggagaaggttcggggatgtgttttcccttcaactggcctggacacccgtggtggtcctcaacggactggcagccgtcagggaagccatggtgactcgcggtgaggacaccgctgatcggccccccgccccaatttaccaggtcctaggattcggcccacgaagtcagggaagaccgttccgtcctaacggcctgctcgataaggccgtgagtaatgttatcgcttccctgacctgcggaaggcgctttgaatatgacgatccccgtttcctcaggttgctcgacctggctcaggaagggttgaaggaagagagtggcttccttcgagaggtactgaatgccgtgccggtcttgctccacataccggctctggccggtaaggtactaaggttccagaaagcttttttaacacagttagatgagttactgaccgaacacaggatgacctgggatcccgcccagcctcccagagacctaacggaggcctttctggccaagaaagaaaaggccaaaggctcaccagaatctagcttcaatgatgagaatctcaggatcgtggtcggaaaccttttcctagccgggatggtgactactcttactactctggcctggggcctgctcctgatgatccttcacctggatgttcagctgagggtgcaacaagagatagatgacgtgatcggtcaggtccgccgtcctgaaatgggcgatcaagcgcacatgccttacacgactgccgtcatacatgaggtgcagaggttcggagacataatcccactctcagtaacgcacatgaccagccatgacatagaagtacaagggttcagaatcccgaagggtacgaccctcatcactaacctctctagcgtgctgaaagacgaagcagtatggaagaagccttttcggttccatccagagcattttctcgacgcccaaggacattttgtaaaacccgaagccttcctgccatttagcgctggcaggcgggcttgcctgggcgaaccactagcccgcatggagctcttcctttttttcacctctctcctccagcacttttctttctcagtggccgctggacagcctaggccgtctcacagcagggtggtgagctttctggttactccctccccgtacgaactgtgcgctgtgccacggtag

SEQ ID NO: 46650 - DNA, 1332 bp, Artificial Sequence
  Description of Artificial Sequence: Synthetic coding sequence
caggaggccctgaccctgcccctgcagctgcggcggcggttcggcgatgtattctccctgcagcttgcctggacgccagtcgtggtgctgaatggactggcagccgtgagagaagcaatggtgactagaggtgaagatacggccgacaggccgcctgcaccaatttaccaagtgttaggattcggacccagggagcagtgggtgttcctctcacggtatggtcctgcttggcgggagcagcgccgattctcagtgagtaccctccgaaacctcggcctgggcaagaagagcctcgaacaatgggttaccgaggaggccgcctgtctgtgtgcggccttcgcagatcaggatgcaccttttgcccccaccgtgtcctggacaaagccaaatgtgatcgccagtctgacttgtggacggcgcttcgagtatgatgatccacgctttctgagactcctggaccttgcacaggagggtttaaaggaagaatccgggttcctgcgcgaggtgctgaacgctgtgcctgtgctgcttcacatccccgccttggcaggaaaggtcttacggtttcagaaagcttttctcacgcagctggacgagctgcttaccgagcataggatgacctgggatcctgcccagcctccacgcgatttaaccgaagcctttcttgctaaaaaagaaaaagctaagggaagccctgagagctcattcaacgacgagaatcttcgcatcgtcgtcggcaatctattcctcgctgggatggtgaccactctaacaacactagcctggggtctcctgctaatgatactccacttagacgtacagttgagggttcagcaggaaatcgacgatgtgattgggcaggttcggaggccagagatgggggaccaggcccatatgccttacaccaccgccgtgatccacgaggtgcagagattcggggatatcatcccactgtccgtaacccacatgacctcacacgatatagaagtgcagggctttaggatacccaagggtacaacattaatcacgaatctgtccagcgtccttaaggacgaggccgtgtggaagaaaccttttcgctttcatccggagcactttctggacgcccaggggcactttgtgaaaccggaagctttcctgccatttagcgcaggacggagggcatgtctcggtgagccgttggccaggatggaactttttttgttttttacaagcctgctgcagcactttagtttcagcgtggccgccggccagccaaggcccagtcattccagagtggtcagcttccttgtcaccccgtccccatatgaattgtgcgctgtgcccaggtag

SEQ ID NO: 46651 - DNA, 1491 bp, Artificial Sequence
  Description of Artificial Sequence: Synthetic coding sequence
atgggcctggaggccctggtgcccctggccatgatcgtggccatcttcctgctccttgtcgacctaatgcacagacaccagcgttgggccgcacgataccccccaggcccacttcccctgccgggcttagggaatcttcacgtggactttcaaaacacaccttactgctttgatcagctgaggcgtcgtttcggcgatgttttctcactacagctagcatggactcccgttgtggtcttgaacggactagcagctgtgcgtgaggccatggtcaccagaggcgaggacactgccgataggccacctgcacctatttaccaggtgctgggcttcggccccagggaacaatgggtttttctatcacgctacggccccgcctggagggagcagagaaggttttcggtgtctactctgcgtaaccttggcttgggcaagaagtccttggaacaatgggttacagaggaagcggcctgcctgtgcgccgccttcgccgatcaggccggtaggccctttcgccctaacggcctgctcgataaagcagtgtcaaatgtgatcgcttctctaacctgtgggcgcagatttgaatatgatgatccaagatttcttaggctgctggacctagcccaggagggacttaaagaggagtcgggcttcctgcgagaggttctcaacgcagtgcctgtcttattgcacatccccgctctggcgggtaaggtactgcgctttcagaaagcctttcttactcagctcgacgagctgctgaccgagcatcggatgacttgggatcctgcgcagcctccacgcgacctcaccgaggcgttcctcgctaagaaagaaaaagccaagggcagcccagagtcatcattcaatgatgaaaatcttagaatcgttgttggcaacctcttcctggcaggcatggtaacaacccttaccactctggcctggggcctgctgttgatgatcctgcaccttgatgtacaactgcgcgtccaacaagagatcgatgatgtcatcggccaagtgcggcgcccggagatgggcgaccaggctcatatgccatacacgacggctgtaatccacgaggtacagagattcggagatattattccattatcagtcactcatatgacttcccacgacatcgaggtgcagggcttccgaattccaaaggggactacccttatcactaacctctccagcgttctgaaggatgaggctgtgtggaaaaaacctttcaggtttcaccccgagcattttctagacgctcaaggacattttgtcaaaccagaggccttcctcccattcagcgccggacgccgagcctgcctgggtgagccactggctcgcatggagctgttcctgttcttcaccagcctgctgcaacatttctctttcagcgttgccgccggccaacctagacctagccattctagggtggtttctttcctggtcacgccatctccctacgagctctgcgccgtgcccaggtag

SEQ ID NO: 46652 - DNA, 1224 bp, Artificial Sequence
  Description of Artificial Sequence: Synthetic coding sequence
atggtgacccggggcgaggacaccgccgaccggccccccgcccccatttaccaggtcctgggatttggcccacgctcccagggagtcttcctgagtagatacggccctgcatggcgggaacaaagacgtttttccgtatctacactgaggaatttagggctgggcaagaagagtctggagcaatgggtgaccgaggaggccgcttgcctgtgcgctgccttcgctgatcaggccggcaggccatttagaccaaacggcctgttagacaaagcagtcagtaatgtgattgcttcgctgacctgcggacgcagattcgagtatgatgaccccagatttctgcggcttttagacttggctcaggaaggactcaaggaagagagtgggttcctcagagaggtgttgaacgccgtaccagtgctgcttcacatcccagccctagccggcaaggtacttcggtttcaaaaggcttttctaacccagctcgatgagctgctaacagagcacagaatgacttgggatcctgctcagccccccagggaccttacagaggccttcctggccaaaaaggaaaaggcaaaaggctccccagagagctccttcaacgatgagaacctgagaatcgtggttgggaacctttttctggcggggatggtgactaccctcacaactctggcctggggcctcttgctaatgatccttcacctggacgtccagctccgtgtccaacaagagatagatgatgtcattgggcaagttagacgaccagaaatgggtgatcaggcgcacatgccctacacaacggcagtgatccacgaagttcagcgatttggcgatatcattcctttgtccgttacacatatgacaagccatgacatcgaggtacagggttttaggattccaaagggtactacactgattacaaatctcagtagtgtacttaaagatgaggctgtgtggaaaaaacccttccgcttccaccccgaacatttcctcgatgcacaaggacattttgtgaaacccgaagcatttctgccattcagcgctggccggagagcttgtttaggggagcctttggctcgcatggaattgtttctgttctttacgagcttgctgcagcacttctccttcagcgtggcggcagggcagcctcgcccgagccattcacgggtggtatcctttctcgtcaccccaagcccgtacgagctatgcgctgtgcctcgatag

SEQ ID NO: 46653 - DNA, 429 bp, Artificial Sequence
  Description of Artificial Sequence: Synthetic coding sequence
cagctgcggcggcggttcggcgacgtgttcagcctgcagctggcctggacgcccgtcgttgtccagtgggccggcggaagggctaggggggacggcgacccccgaagggggcatggtagaccaccggcttgcgctcatctcccaggggaccccctgcccgcgtccccgaccccacgcaccccgctgagccctcagcgctcactgggccagtcaagggagcagcgggaccggctgccacacctgagggccccgctgagggtgaggaggcccagcctgccccaggccgctgggccctcatctggtgggactgaaggaggagtcggacttccagcacggggcgcagagtgttgcccacggccgcccgctcacccgagtgcaggatggcaaggcccaacacttcctaagggcttcccagatccagctggttag

SEQ ID NO: 46654 - DNA, 510 bp, Artificial Sequence
  Description of Artificial Sequence: Synthetic coding sequence
aagatccacgaggagatcaaccaggtgatcggcccccaccggctgccccgtgtggacgatcgggtgaagatgccatacacagatgtggtgatccatgagatccagcgcctagtggacatagtacccatgggcgttccccacaacattatccaagacactcagttccgtggttacctgttgccaaaaggcacggacgtatttccactgctcggtagcgtcctgaaggatccgaagtactttcgctacccggacgccttctacccccagcattttctggatgagcagggcagattcaagaagaacgaggcctttgtgcctttctcatccggcaagcgtatatgtttgggtgaggcgatggcccgaatggaacttttcctgtatttcacctccacacttcagaatttctccttgtgctcgctggtacccctagtagacatcgacatcacccctaaactttccggatttggcaacattacccccacgtacgagctctgccttgttgcgcggtag

SEQ ID NO: 46655 - DNA, 1119 bp, Artificial Sequence
  Description of Artificial Sequence: Synthetic coding sequence
atgcggagcgtgctgcggcagcggatcctgaagcccaaggacgtggccatctactctggcgaggttaaccaggtgattgccgacctgattaaacgaatctaccttctgagaagtcaggctgaagatggggagaccgtgactaatgttaatgacctgttctttaagtattccatggaaggtgtggccacaatcctgtacgagtcccggctggggtgcctagagaattctatcccgcagttgaccgtagagtacatcgaagccctggagctgatgttctcgatgttcaagacttcaatgtacgccggtgccattcctcgatggctgcgcccatttattcccaagccttggcgcgagttctgcaggtcatgggacggcctctttaaattcagtcaaatccacgttgacaacaagcttcgtgacatccaataccagatggaccggggaaggagggtcagtggcggcctcctgacatacctgtttttgtcacaggcacttacactgcaagaaatttatgcgaacgttactgagatgctgctcgctggggtcgatacaacctccttcaccctgagctggaccgtgtaccttttggcgcgacatcctgaagtacaacagacagtctaccgggaaatcgtcaagaacctaggcgaacgccatgtgcctactgctgcagacgtaccaaaggtgcccctggtgagagccctactaaaggagaccctgcgtctgttcccggttctacctggtaacggtagagttacacaagaggatctggtgatcgggggctatttaattccaaaaggaacacagcttgccctgtgtcactacgcaacaagctatcaggatgagaactttccacgcgctaaggagtttcggccggaacgctggttgcgcaagggcgatctggaccgcgtggataacttcggctctattccattcggccatggtgtgaggtcctgtattggacgtcggatagccgagttggagatacacctggtcgtgattcagttgctccagcattttgaaattaaaacctcgtcccagacaaacgccgtccacgccaaaactcatggactgctcacacctggaggccctattcacgtgcgttttgtgaatagaaagtag

SEQ ID NO: 46656 - DNA, 1119 bp, Artificial Sequence
  Description of Artificial Sequence: Synthetic coding sequence
atgcggagcgtgctgcggcagcggatcctgaagcccaaggacgtggctatctatagcggcgaggtgaaccaggtcattgccgaccttatcaagcggatctatctgctcagaagtcaggccgaggatggcgagactgtcacaaacgttaacgacctgttcttcaagtattctatggaaggagtggccacaatcctatatgaaagccgcctgggctgcctggaaaactctattcctcagctgacagtggaatatattgaagctctagagctgatgttttctatgtttaagacatcaatgtacgccggagcaatccccaggtggctgcgcccatttattccgaagccctggagggaattctgcaggagctgggatggactgttcaaattctctcagattcacgtggacaacaaactgcgcgatatccagtatcagatggaccgggggcggcgcgttagtggaggactgctaacgtaccttttcctgtcacaggctctgaccctgcaggagatttatgccaatgtgacggagatgctgcttgccggcgtcgacacaacgagttttaccctctcatggaccgtttacctactagcccgccaccccgaagtgcaacaaaccgtctaccgagagattgtaaaaaatctcggcgaacgtcacgtccctactgcagcagacgtcccgaaggtgccgctggtgagggcactgctcaaggagacactccgactgtttcctgtattaccaggaaacggacgtgtaacacaagaggacctcgttattggcgggtacctgatcccgaaggggacccagctggcactttgccactacgctacctcataccaagacgagaacttccctcgagcgaaggaatttcgccccgaaagatggctgaggaagggggatcttgaccgcgtggacaacttcgggagcatccctttcgggcacggcgtgcgttcttgcataggccgcaggatagctgagctcgagatccatctagtggtgattcagttgctgcaacactttgagatcaagacgtctagtcaaacaaacgcggtacacgcgaaaacccatgggctcctgaccccgggaggccccattcacgtccgtttcgttaatcgcaagtag

SEQ ID NO: 46657 - DNA, 357 bp, Artificial Sequence
  Description of Artificial Sequence: Synthetic coding sequence
atggtgacccccgccggctgcctgggcggccggaaccagggcccccgggagatccccggaactgctttccccaggtctagccgagccggccaaactggacaggcagtgtcgggagcccaggtgagcagttggagagaacggcaaccctgcagcggctcgcgggggcccctccatatactgggcactgatggaaatgttgacaccactggcaaactcggtttagtacctacacctcctcgcatccagaaggaaactaaacagggagcgttgtgtggaatgaagcctcccttcttgccggaggctttgctgatcgtatggtggttgccctttgtggcagtaagcccatgcttattttag

SEQ ID NO: 46658 - DNA, 1194 bp, Artificial Sequence
  Description of Artificial Sequence: Synthetic coding sequence
atggaggaggacgacagctacgtgcccagcgacctgaccgccgaggaaaggcaggaactggaaaacattcggagacgaaagcaggagttgcttgcagacattcaacggctgaaagacgaaattgctgaggtggccaacgagatcgagaatcttggatctaccgaagagagaaagaacatgcagcgcaacaagcaggtcgccatgggccgcaaaaaatttaatatggacccaaaaaaaggaatacagttcctgattgagaatgacctgctcaaaaacacctgtgaggatattgcacaattcctgtataagggcgagggattgaacaagaccgcgatcggtgactacctgggcgagcgtgatgagtttaacatccaagtgctccacgccttcgttgaattgcatgagtttacggaccttaatctggtgcaagcactgaggcagttcctctggtcattcaggctccccggggaagcccaaaaaatcgatcggatgatggaggcttttgcccagaggtactgtcagtgcaacaatggggtttttcagtctactgacacttgctatgttctttcttttgcaattattatgcttaacaccagcctgcataaccccaacgtgaaggataagccaacagtcgagagattcatcgcaatgaacaggggaatcaatgacggaggggacttgccggaagaacttctccgtaacctgtatgaatccatcaaaaatgagcctttcaaaattccagaggacgacgggaacgacttaacccatacatttttcaaccctgatcgcgagggctggctgttgaagctgggtggacgcgtgaaaacttggaagcgccgttggttcatactgactgataactgtctgtattattttgaatatacaaccgataaggagccaaggggcatcatcccattagaaaacctctctatacgtgaggttgaggattcaaagaagccaaactgtttcgagctgtatatccccgacaataaggatcaggtgatcaaggcttgcaagacagaggccgacggccgggtggtagagggtaatcataccgtataccgcatatccgctcccacccctgaagagaaagaggagtggatcaagtgtataaaggctgccatcagtagagaccctttttacgagatgctcgccgcgaggaaaaagaaggtttcaagtaccaagagacattag

SEQ ID NO: 46659 - DNA, 465 bp, Artificial Sequence
  Description of Artificial Sequence: Synthetic coding sequence
atggacctgtgccaccccgagcccgccgagctgagcagcggcgagactgaggagctgcagagaataaagtggcataggaagcagttgcttgaggatattcagaaactgaaagatgagatagcggatgttttcgcccaaatcgattgctttgaatccgcagaagagtctcgtatggcgcaaaaggagaaggagctctgtattggacgcaagaagtttaatatggatcctgccaaaggcatccagtatttcatcgagcacaagctgctgacaccggacgtccaggatatcgcccgcttcctatacaaaggtgaaggtctgaacaagacggccattggaacatacctgggggagagggaccccattaatctgcaagtactgcaggcattcgtcgactgtcatgaattcgcaaatctaaacctggtgcaggccctgcgcgtggtgaaaactaaatgggaatccgtttag

SEQ ID NO: 46660 - DNA, 777 bp, Artificial Sequence
  Description of Artificial Sequence: Synthetic coding sequence
atggccgagtacagctacgtgaagagcaccaagctggtgctgaagggaacaaagactaaatcgaagaagaagaaatccaaggataagaagcgtaaacgggaggaagatgaagagacgcagctcgatattgtaggaatttggtggactgtgaccaacttcggagagatatccggtacaatcgcaatagaaatggataagggaacatatattcacgccctggataatggcttattcacactgggtgcccctcacaaggaagtcgacgagggcccttcccccccggaacagttcacagcagtcaaactgagtgattctagaattgcccttaagtccggatacgggaagtatctgggaatcaactccgatggccttgttgtaggccgctctgacgcaattggtcctcgggaacagtgggagcctgtttttcagaacggaaagatggcactgctggctagcaatagctgctttattcgctgcaacgaagccggcgacattgaggctaagtcaaagaccgccggtgaagaagagatgatcaaaataaggagctgcgcagaaagggaaacgaaaaaaaaagacgatatcccagaggaggataagggtaacgtcaagcaatgcgaaatcaactatgtgaagaagtttcagagtttccaggaccataagcttaagatctcaaaggaggattccaagattctgaaaaaagcacgaaaggacgggtttctccacgagaccctgttggataggcgcgcaaaactgaaagcggatcgctactgcaaatag

SEQ ID NO: 46661 - DNA, 1179 bp, Artificial Sequence
  Description of Artificial Sequence: Synthetic coding sequence
atgaacccccggggcaaccggaagaccaccaaggagggcagcaacgacctcaagttccagaacttctcactgcctaaaaataggagctggcctaggattaacagcgcaacaggccaataccagcgcatgaacaaacccctgttagattgggagagaaatttcgccgccgttctcgacggggctaaaggacacagcgacgacgattacgacgatcccgagctgcgtatggaagaaacatggcagtctatcaagatattgccggcccggcccatcaaagaaagcgagtatgccgatactcactactttaaggttgccatggacacaccccttccgctcgacacgcgcacgagtatctcaatcggacaacccacttggaatacacaaaccaggctggagcgggtggataaacccattagcaaggatgttaggtcacaaaatattaggccacctctgagccagcgacacactttccccgaagtccaaagaatgccgagccagatctccctcagagatctgtccgaatcccttgaggctaagaaagttccccacaaccagaggaaaccagaatccacccatctcctcgaaaaccaaaatacacaggagatccctttggcaattagctcgagttcctttaccacaagtaaccacagcgtgcagaatagggaccatcgtggaggaatgcagccttgtagcccccagaggtgtcaacctcccgcctcctgctccccccatgaaaatattttgccttataaatatactagttggagacccccattccctaaacggagtgaccggaaggatgtgcagcacaatgaatggtacatcggcgagtacagcagacaagccgttgaagaggcatttatgaaggagaataaagatggttcttttttggtgagagattgcagcactaagtcaaaagaggagccatacgtgctggccgtcttctacgaaaacaaggtttataacgtgaagataagattcctggagcgaaaccagcaatttgccttgggcactgggctgaggggcgatgaaaagttcgatagcgtggaggacataatcgaacactataaaaattttccgattatcctgatagacggcaaggacaaaactggggttcaccgcaagcagtgccacctgacccagccccttcctctcactaggcacctgttgccactgtag

SEQ ID NO: 46662 - DNA, 510 bp, Artificial Sequence
  Description of Artificial Sequence: Synthetic coding sequence
atgaacaagcccctgctggactgggagcggaacttcgccgccgtgctggacggcgccaaagggcattccgacgacgactatgacgacccagaactgcgaatggaggagacgtggcagagcattaaaattctgccagctaggcctatcaaggagagtgaatatgcagatacacactattttaaggtcgcgatggatacccccctccctctggacacccgcacttcgatatctataggtcagccaacctggaacacacaaacgaggctggagcgggtggacaaaccaatctcaaaagatgtgcgttctcagaatattaagggcgatgcctccgtacgaaagaataaaatcccactgccccctccccgcccattaataacacttcctaagaagtaccaacctcttccaccagaacctgagagctcaaggcctccactgtcccagcggcacaccttcccagaagtgcagcggatgccttctcagatcagcttgagggatttatccgaaccgtag

SEQ ID NO: 46663 - DNA, 510 bp, Artificial Sequence
  Description of Artificial Sequence: Synthetic coding sequence
atgaacaagcccctgctggactgggagcggaacttcgccgccgtgctagatggcgctaagggtcattccgatgatgattacgatgatccagagttgcgaatggaagagacttggcagtcaataaaaattctgcccgctagacccataaaagagagcgaatacgcagacactcattactttaaagtggctatggacacccccctcccccttgacaccagaacctcaattagtattggccaacctacctggaacacccaaacaagactggagagagttgacaagcccatttctaaagacgttaggagccagaatatcaagggggacgcaagtgttcggaaaaataagatccccctcccacccccaaggccactcataacattgccaaagaagtaccaaccgctgcctccggaaccagagagttcccggccgcctctgagtcagagacatacctttccagaggtccagaggatgccctctcagatttccttacgagacttgtccgagccttag

SEQ ID NO: 46664 - DNA, 1695 bp, Artificial Sequence
  Description of Artificial Sequence: Synthetic coding sequence
atgcccgagtgcctgtggacccagggcgtgctgcaggaggtgctgaactcatacttctgcggcagcattatactgagtaccttaccatgggaagttccagggggtcacgcgtcacgcatctgtcttttgttgttggcaacaggggagaacaaacaagtggaatgttaccagctgagcccgggcttgtcaagcctgcccgacttccaagactctgaagagacggtaacatcccggatgctgttcccaacaagtgcccaggaatcctctaggggactgcccgatgcaaacgacctgtgtttgggactccaatccctcagcttaaccgggtgggaccgcccgtggtcaacacaggacagcgacagcagcgcccagtctagtacgcactcagtgctgtcaatgctccataacccactggggaacgtcctgggaaagcctccactaagctttctacctctggaccccttaggaagcgacttggtcgataaatttccggccccctccgttcgggggtcccggttagatacccgtccaatcctggattctcgctcgtcttcaccaagcgacagcgacacatcaggattcagctccgggagcgaccacctgtcagacctgatttcctcccttcgtatatcaccgcccttgccgttccttagcctttcagggggcggccccagggaccctcttaagatgggagttggctcccggatggatcaggagcaagcagctcttgcagccgttacgccttcccccactagtgcaagcaagagatggccaggcgccagtgtctggccttcttgggacctgttggaggctcccaaggatccatttagcatcgagcgagaggcccgtcttcaccgacaggccgctgcggttaacgaagccacgtgtacttggagcggccaactgccccctagaaactataagaaccccatctacagttgcaaggtgttcctaggcggcgtaccatgggatataaccgaagctgggctggtcaatacatttcgcgtatttggatctctgagcgtcgagtggcccgggaaagacgggaagcaccctagatgccctcctaaaggatacgtgtatctcgtgtttgagctggagaagtcagttcgatccttgctgcaagcctgctctcacgatcctctctccccagacggactgtctgaatattatttcaagatgagcagtcggcggatgcgatgcaaggaggtgcaggtgatcccctgggtattggctgactctaacttcgtgaggtcacctagccagagactggacccttcccgcaccgtgttcgtgggtgctcttcatggaatgcttaacgccgaagctctcgccgccatcctgaacgatcttttcgggggagtcgtctatgctggcattgataccgacaagcataagtatcccataggctctgggagagtcacattcaacaaccagcggagttacctgaaggccgtctctgccgccttcgtcgaaataaaaaccactaaatttactaagaaggtgcaaatcgacccctacctcgaggactcactctgccacatttgttcttcccaacctggtcctttcttctgccgggatcaggtgtgctttaagtatttttgccggtcctgctggcattggcggcactccatggagggcctgagacatcattcccctttgatgcggaaccagaagaaccgcgatagcagttag

SEQ ID NO: 46665 - DNA, 1476 bp, Artificial Sequence
  Description of Artificial Sequence: Synthetic coding sequence
atgctgttccccaccagcgcccaggagagcagccggggcctgcccgacgctaatgacctctgcctgggattgcagtcgctgtccctcacgggctgggaccggccgtggagcacccaagactccgactcatcggcccagtcctcaactcactctgtgctctccatgttgcacaaccctctgggcaacgtgttggggaagccacccctgagtttccttcctctggatccgcttgggagtgaccttgttgacaagtttccggcaccatcagtgcgaggtagcagattggacacaagacctattttggattcacggtctagctcaccatcagattccgacacgagcgggttctcaagcggtagtgaccacctcagtgacctcatcagttctctgaggattagtccacctttgccctttctctccctgtccggtggcggtccaagggacccgctgaagatgggcgtgggcagccgcatggaccaggagcaggctgccctcgccgctgtgactccgtctccgacgagcgcatctaaaagatggccaggggcatcagtttggccctcttgggacctcctggaggcaccgaaggatccattcagcatcgagagggaggctcgcttgcataggcaagccgccgccgtgaacgaagctacgtgtacatggagcggacagttgccacctcggaattataaaaacccgatctatagctgtaaagtgttcctaggaggcgtcccttgggatattacagaagcaggtctcgtaaatacgtttcgggtgttcggctctctgagtgtagagtggcctgggaaagatgggaaacatccgcggtgcccacctaaagggaatatgccgaagggttacgtgtacttagtgttcgagctcgaaaaaagcgtcagatctctgctgcaggcttgcagccacgaccccctgtcccctgatggactttccgaatactacttcaagatgtctagccggagaatgagatgcaaggaagtgcaagtgattccttgggtccttgctgacagcaacttcgtgcggagccccagtcagcgcctggacccttcaagaacagtttttgttggcgctctccatggcatgctcaatgcggaggcactggctgctattctgaatgacctgtttggcggagtcgtttatgccggcatcgatacagacaaacacaaataccctatcgggtcggggcgagtgacctttaacaaccagaggagttacctcaaggctgtgagcgccgcattcgtagagatcaagaccacgaaatttactaaaaaggtccagatagacccatacctagaggacagcctttgtcacatatgttcgagccagcccgggccctttttctgtcgggaccaggtgtgctttaaatacttttgcaggagctgctggcactggagacacagcatggaaggcctgagacaccactctcctctgatgaggaatcaaaagaacagagattctagctag

SEQ ID NO: 46666 - DNA, 1008 bp, Artificial Sequence
  Description of Artificial Sequence: Synthetic coding sequence
atgggcgtgggcagccggatggaccaggagcaggccgccctggccgccgtaacgccttctccaactagtgcttcgaaaagatggcccggggcatcggtgtggcctagctgggacctgctggaagcacccaaagaccctttcagtatcgagcgggaggccagactgcatcgtcaggccgcggcagtgaacgaagcaacatgcacatggtccggccaactccctcctagaaactataaaaatcccatatactcgtgtaaggttttcctgggcggcgtcccttgggacattacggaggcaggccttgtcaatactttccgggtcttcggcagcttatcagtagaatggcctggcaaggacgggaaacacccacgctgtccacctaaggggtatgtctacctggtcttcgagttggaaaagagcgtgagatcattgttgcaggcttgttcccacgacccactctcaccagatggacttagcgagtactactttaaaatgtctagtagacgtatgcgatgcaaggaggtgcaggtgattccatgggtgctcgccgactctaattttgtgagatcaccttctcagaggttagacccaagtaggacggtgttcgtgggagccttgcacggaatgctcaacgctgaagccttggccgctatcctcaatgatttgtttggtggcgttgtctatgcggggatcgacaccgataagcataagtatccaataggctcaggccgagttacttttaataatcaaagaagctatctgaaagcggtgagtgcagcttttgtggaaataaagactaccaagttcactaagaaggtgcagatagatccctacctggaggacagcctgtgccacatttgctccagccaacccggcccttttttctgcagagatcaggtatgttttaaatacttctgccgctcttgttggcattggcgacactctatggaaggtttacggcatcactctccccttatgaggaatcagaagaatagggacagttcctag

SEQ ID NO: 46667 - DNA, 1686 bp, Artificial Sequence
  Description of Artificial Sequence: Synthetic coding sequence
atgagcatgcccctggaggaggaggccggccggatcaaggactgctgggacaaccaggaggccccagcgctgtcaacatgctccaacgcgaatattttccgccggattaacgcaatattggacaattctcttgacttcagcagggtgtgtacaaccccgataaatagagggatccatgaccacctgccggatttccaggactcggaagagaccgtcacgtctcgcatgctgtttcccaccagcgcacaggagtcctctcgggggttgcctgacgcaaatgatctgtgcctggggttgcagtccctgagcctgacggggtgggacaggccatggtccacgcaggacagcgattcaagcgcccagtcgagtacacactccgtgctgtccatgttgcacaatcccttgggtaacgtgctcggcaagcctcccctgtcatttttgccattagaccctctgggcagtgacctagtagacaagttcccagcccccagtgtgagaggttctaggcttgacacgagacctatccttgactccaggagttccagcccgagtgactccgataccagtgggttctcttcaggaagtgatcatctgtcagatctgatatctagcctgcgtatctctcccccactgcccttcttgagcctgtccggtggcggacctagggatccccttaaaatgggcgttggaagccggatggatcaggagcaggctgccttagccgccgtcaccccgagcccaacttcagccagtaaaagatggccaggtgcctctgtgtggccatcatgggatctgctggaggctccaaaagacccttttagtatcgagcgggaggcgcggcttcatagacaggccgcggcagtgaatgaggccacatgcacctggagcggtcagctccctccaagaaattacaagaatccaatctacagctgtaaagtgtttctgggcggagtgccctgggatatcaccgaggccggtctggtgaacacatttcgggtctttggctccctgagcgtggagtggccaggaaaagacggcaagcatcccaggtgcccccctaaggggtacgtgtacttggtctttgaattagagaaatctgtccgcagcctgctgcaggcatgttcacatgaccccctcagtcccgacggactgtcagagtactactttaagatgtctagccggagaatgagatgtaaagaggtacaagtaattccttgggtcctggctgatagcaactttgtgcgttcgcctagtcagaggctcgacccaagtcgcacagtgttcgtcggtgccctacatggcatgctaaacgccgaagccctagctgccatactcaacgacctttttggcggcgtggtatatgcagggattgacaccgataaacacaaatatcccatcggctcaggtagagttacattcaacaatcagagatcatacctcaaagcggtgagcgccgcatttgtggagattaagaccacgaagtttacaaaaaaggtgcaaattgatccctatctggaggattccttgtgccatatttgtagcagccagcctggcccatttttctgcagagaccaggtctgttttaagtacttttgtaggtcttgctggcattggaggcattctatggagggtctgagacatcatagtccgctcatgagaaatcaaaaaaaccgtgactcctcctag

SEQ ID NO: 46668 - DNA, 1461 bp, Artificial Sequence
  Description of Artificial Sequence: Synthetic coding sequence
atgctgttccccaccagcgcccaggagagcagccggggcctgcccgacgccaacgacctttgcctcggacttcagagtctgagtctgacaggatgggatcgaccatggtcaacgcaggactctgactccagcgcccagtccagtacccatagcgtactgtccatgttacacaaccctttgggtaatgtgctaggcaagcctcccctgtctttcctgcctttagatcctctcggatctgatctggtggataagtttcccgctccaagtgtgcggggcagccgcctggacacacgtcccatcctggattcccggtcctcatctccatctgacagcgatacaagcggcttttcctcagggagcgatcacttgtcggatctgatctcaagcctccgcatatctcctcccctgccattcctctctttatctggcggcggacctcgggatccactcaagatgggggttggctcacgcatggatcaggagcaggcagctctcgctgcagttaccccatcaccaactagcgcttccaaaagatggcccggcgcgagcgtgtggccctcttgggatcttctcgaggctcccaaggatcctttttcaattgagagagaggcccgcttgcatcggcaggccgccgctgtgaatgaagccacttgcacgtggagtggacagctgcctccccgcaattacaaaaaccccatttattcctgcaaggtgtttcttgggggcgtcccctgggatattacagaggcggggttagtaaatactttcagagtgttcggatctctgtccgtggaatggcccggaaaagatggcaaacaccctcgttgtcctcctaaaggttatgtgtatttggtgttcgagctggagaagagcgtacgtagcttattgcaagcgtgctcacacgacccgctgagccccgacggactatctgagtattatttcaagatgagcagccgtagaatgaggtgcaaggaggttcaagtgatcccctgggtgctggccgactcaaacttcgtgaggtctcctagtcagagacttgacccttctaggacagttttcgtcggcgccctgcacggaatgctgaatgccgaagcactggccgcaatcctgaatgacctcttcggtggtgtagtatatgccggtattgacaccgataagcataagtaccccattgggtctggacgcgttacattcaacaatcagaggtcctatttgaaggccgtcagcgctgcgtttgtcgagatcaagaccaccaaattcacaaagaaggtgcaaattgatccttatttggaagactccctctgtcatatttgtagctcccagcccgggccttttttctgtcgtgaccaggtgtgttttaaatatttctgtcgcagctgctggcattggagacattctatggagggcctgagacaccactccccattgatgcggaatcagaaaaatcgtgactctagctag

SEQ ID NO: 46669 - DNA, 1686 bp, Artificial Sequence
  Description of Artificial Sequence: Synthetic coding sequence
atggccttccccctggaggaggaggccggccggatcaaggactgctgggacaatcaggaagcccccgccttgtccacgtgtagtaacgctaatattttccggagaatcaacgccatactggacaatagcctagatttctctagggtgtgcaccactcccattaatcgaggcattcacgaccaccttccagactttcaagactcagaagagaccgtgacatctaggatgctcttccctacatcagcacaggagtcatcacgaggcctgcctgacgccaacgatctgtgcctgggtcttcaatcactgtcgctaaccggctgggacaggccctggtctacccaggacagcgattccagtgcccagtcgagcacccactcggtattgagtatgctgcacaatccattgggcaatgtacttggcaaaccgcctctgagcttcctgccccttgatccactggggtccgacttagtggacaagtttccagctccgagcgtgagggggagccgcctagacacgcgccccatccttgacagccgcagtagtagcccaagtgactccgatacctcaggattttcatctgggtctgaccatctctctgatttaatctccagccttagaatctcaccgccactgccttttctaagcctcagcggaggaggccctagggaccctctaaagatgggggtgggatccagaatggaccaggaacaggctgccctggcagcagtgaccccctcccctacatcagcctcaaaacgatggccaggagcctctgtctggccaagttgggacctgctggaggctccaaaggacccgttttctattgagcgcgaggctcgacttcacagacaggccgcagctgtgaacgaagccacttgtacatggagcggacagttacctcctagaaactataagaatcccatttacagttgtaaagtctttctcggcggcgtgccttgggatattacagaggctggcctggtcaacaccttcagggtatttggctccctttccgtggagtggcctggcaaagacggaaaacatcccaggtgcccccccaagggttacgtttacctcgtttttgaattggagaagagcgtgcggtctctgctacaagcttgcagtcacgaccctctgtcgcccgacggcctgagcgagtactactttaaaatgagttcccggcgcatgcgctgtaaagaagtccaggtgatcccgtgggtactggccgatagtaacttcgtgcggtctccttcccagcgcctcgacccttcacggacagtcttcgtcggtgctctccatggcatgctgaatgccgaagctctggctgctattctgaacgacctgttcggcggagtggtctatgctggtattgatacagataaacacaaataccccatcggcagcggccgcgtcaccttcaataaccagcgcagttacctgaaagcagtgagcgctgcttttgtggaaatcaagacgactaaatttacaaaaaaggtccagatcgatccatatcttgaagattccctctgtcacatctgcagctcccaaccaggtccatttttttgcagggatcaggtttgctttaagtatttctgccggagctgctggcactggcgccactccatggaggggctcaggcaccacagcccactgatgcggaaccaaaaaaaccgagactccagctag

SEQ ID NO: 46670 - DNA, 1686 bp, Artificial Sequence
  Description of Artificial Sequence: Synthetic coding sequence
atggccttccccctggaggaggaggccggccggatcaaggactgctgggacaatcaggaggcacctgctctctcaacttgctccaacgctaatattttccgcagaattaacgcgattttagacaatagtctcgactttagcagagtgtgcacgaccccaatcaacagaggcatacacgaccatctgccagacttccaggattccgaggaaacagttacctctagaatgctgttccccacgagcgcccaggaaagctcccgcgggttacccgatgccaatgatctgtgcttgggcctgcagtctctctctctgactggttgggatcgaccctggtccacgcaggattccgactccagtgcccaatcatccactcactctgtcctgagtatgctgcataacccactggggaatgtgcttggtaaaccacctctctccttcctgccacttgatcctttaggcagcgatcttgtggataagttccccgccccatcagtaagggggtctcgactggatactcgccccatccttgatagtcgctcaagttcaccatccgacagcgacacctccggcttctcctcgggcagcgatcatctctccgacttaatctcatccctgcggatctctcccccactccccttcctgtccctatcaggtggggggcccagagaccccctcaaaatgggcgtgggatcccgaatggaccaggagcaggctgctcttgccgccgtcaccccttcgccaacatccgccagcaagagatggcccggagcgtcagtttggccctcttgggacttattagaggcgcctaaagaccccttttctatagaaagagaggctcggctgcatcggcaggctgccgccgtgaacgaggccacctgcacttggagtgggcaactgcctccaagaaattacaagaatccgatatactcatgtaaggtgtttcttggcggtgttccatgggatatcacagaagccggcctagtgaacacctttcgcgttttcggctctctctctgtggaatggccaggcaaagacggcaagcaccccaggtgtcctcccaaaggctatgtgtacctcgtgtttgaactggaaaagagtgtaagaagcttactgcaggcatgtagccacgatcccctgagtcccgatgggttaagcgagtactattttaagatgagtagtcgtaggatgcggtgcaaggaagtgcaagtcatcccctgggtactagcggactcaaactttgtacggtcaccctcccagcgcttagatccttcccgtactgtctttgtgggcgcactgcacgggatgctgaatgctgaggctctcgcggctattctaaacgatctgttcggcggggtcgtgtacgccggcattgacacagataaacacaaatacccaataggatctggtagagtcacctttaataatcaacgcagttacctgaaggcggtatctgcagcatttgtggaaatcaagactactaaatttacgaaaaaagtacagatagatccatacttagaggactccctttgccatatctgcagctcacaaccagggccctttttctgtcgcgatcaggtgtgcttcaagtacttttgtcgaagttgttggcactggaggcatagcatggagggtctgagacatcactcacctttgatgcggaatcagaagaatcgcgatagtagctag

SEQ ID NO: 46671 - DNA, 1131 bp, Artificial Sequence
  Description of Artificial Sequence: Synthetic coding sequence
atgctgaccttcctgcagcagctgcgggtggactggcccgccgcctccgagcgagcctcaagtcacacactgcgctcccatgccttggaggaactgacatccgcaaacgacggacgaacgctgtcaccaggcatccttggcaggctatgtctgaaggagttagttgaggagcagggaagaacagcaggctatgacccaaacttggataattgtctggtgaccgaggacctcctctcagtgctcgccgaactgcaggaggctctgtggcattggcctgaggactcacatcctggactggcaggagcatcagatacaggcactggaggttgtctggtagttcatgtcgtgagttgcgaagaggagttccaacaacagaagctcgaccttctctggcagaaactcgtggataaggccccgctcaggcaaaaacacctgatctgtggcccagtgaaggtcgcaggggctcctggtactctaatgacggcaccggagtactacgaatttagacacactcaagtctgtaaggcatctgctctcaagcacggtggtgacctggcacaggatccagcgtggaccgagatctttggagtgctctcggtagctactatcaagtttgaaatgctctcaactgctccccagtctcagttgtttctggccctagcagactcaagcatttctacaaagggcaccaaatctgggacctttgtaatgtacaattgcgcgaggttggcgactctgttcgaaagctataaatgctctatggagcaggggctatatcctacctttccccctgtgtcttcccttgacttcagtctcctgcatgacgaaggcgagtggcttttactctttaactccatcctaccattccccgacttgctgagccggaccgcagttcttgattgtactgcacccggtctacatatcgccgtaaggaccgagatgatctgcaagtttctggtccagcttagcatggacttcagttcctattacaaccgggtgcacattctgggggagcctagaccccatctgtttggtcagatgttcgtgcgtttgcaactcctgcgggctgtgagggaggttctccacaccggccttgctatgctgggccttcctccactgtctcatatttag

SEQ ID NO: 46672 - DNA, 1551 bp, Artificial Sequence
  Description of Artificial Sequence: Synthetic coding sequence
atggccacccggcggctgggcgtgggcgagaccctgggcgccctgaatgctgccttaggtcctggggggccggtttggattaaagagacacgcaccaggcatctaaggagtagggactttctggctccccaccgcgccctgcaagcaaggttcgatgatggacaggtccccgaacacttactgcacgcattggcctgtctgcaaggacctggagtggctcccgtgctgaggtgtgctcccactcccgcaggcctctcactccagctccagaggtcagcggtgtttgagcgggtgcttagcgctgtagccgcctatgccacacctgcctcacctgccagcttaggtcaacgcgtgctcctccattgtcctgccctccgttctagtccgtgtgcccttaggctgtcccagctgcgcaccgtacttgtcgctgatcatctcgcgcgagccctccgagctcatggtgtatgcgtcaggctagttccagcagtacgagaccctcacatgctcacatttctacaacagctgagagtagactggcccgcggcaagcgaaagagcttcaagccatacccttcggtctcacgctctggaggaacttacttccgctaacgatggacgcacactgagccccggtattttggggagactgtgcctcaaagagctggtggaggaacagggcaggacagcaggctacgaccctaatctcgataactgcttggttactgaggatcttctaagcgtgctggctgagttgcaggaggccttgtggcactggccagaggatagccatccaggcctggcaggcgcatcagataccggcactggcggttgtctggtagttcacgttgtgtcctgtgaggaggagttccagcagcaaaagctcgacttgctttggcagaaactggtagataaagctccgctgcgccaaaagcacctcatctgcggcccagtgaaggtcgcaggtgcgcccggaacactgatgactgcacccgaatactatgaattcagacatactcaggtgtgtaaggcctccgcacttaagcatgggggggacctagcgcaggaccccgcgtggacggagatctttggggtccttagtgttgccaccatcaagtttgaaatgctgtcaactgccccacaatcccaactatttcttgccttggctgatagttcaattagcaccaagggaacaaaatcaggaacgttcgtcatgtataactgtgcccggctggcgacgctctttgaaagttataaatgctctatggagcaggggttgtatcctacattccctcccgtgagctccctggatttttcactcctgcacgacgaatatccacccttgtctggttccgcggagcccgacagtagcgccggtctacattcccctggcgccccacattgctgtacccacagggatgatatgcaggttccaggcactgcacaacatgggtttcagctgctattacagcctggaacccaccccggtggcgcttccaccacaccgctctggagcgacgttcggccaccagcagcatcagagagttgcgcttag

SEQ ID NO: 46673 - DNA, 507 bp, Artificial Sequence
  Description of Artificial Sequence: Synthetic coding sequence
atgaacagcaagggccagtaccccacccagcccacctaccccgtgcaaccccctggaaacccagtttacccgcagactctccacttaccgcaggccccaccctacaccgacgccccacctgcatattcagaactctaccggcctagctttgtacaccctggggctgccactgtcccaactatgtcggccgcatttccaggtgctagcttgtacttacccatggcccaaagcgtcgccgtggggccgctcggctccactatccccatggcctactatcccgtcggaccaatctatccacccggcagtacagtgctcgttgagggaggttacgatgcaggcgcccggtttggagctggggcaaccgcggggaatattcctccgccaccccccggctgccctccaaatgcggctcagctggccgtcatgcaaggcgctaacgtgttggtgacccagcgcaagggcaattttttcatggggggctcagatggtggctatacgatttggtag

SEQ ID NO: 46674 - DNA, 462 bp, Artificial Sequence
  Description of Artificial Sequence: Synthetic coding sequence
atgaacagcaagggccagtaccccacccagcccacctaccccgtgcagccacccggaaatcccgtttacccacagacattgcatctccctcaggctcctccctatacggacgctccgcctgcgtacagtgagctttatcggcccagctttgtgcaccctggcgcagcgacggttcctacgatgagcgctgcattccctggtgcctctctgtacctccccatggctcagagtgtggcagtgggccctctgggaagcacaatcccaatggcctattatcctgttgggcctatatatcccccaggctcgaccgtgttggttgagggggggtacgacgccggggcccggtttggtgccggggcgacagccgggaatataccagtgaaagaagaccaggatcatgatcgcgaacagggcgaggaggacaatggagataacaatctcgagagacgagggaagatgtag

SEQ ID NO: 46675 - DNA, 261 bp, Artificial Sequence
  Description of Artificial Sequence: Synthetic coding sequence
atgaacagcaagggccagtaccccacccagcccacctaccccgtgcagccaccagggaatcctgtgtatccgcaaaccctccatctgcctcaggcacccccatacactgacgccccgccagcctactcagagcctcctccacccggctgtcctcctaatgcagcacagctcgctgtcatgcaaggagctaacgtcttagtcacacagcggaagggcaacttttttatgggtgggagcgacggaggatataccatatggtag

SEQ ID NO: 46676 - DNA, 441 bp, Artificial Sequence
  Description of Artificial Sequence: Synthetic coding sequence
atgaacagcaagggccagtaccccacccagcccacctaccccgtgcaacctcccggaaacccagtttacccacagaccctacatttgcctcaggcgcccccatacactgatgctcctcctgcgtacagtgaactgtatcgcccaagcttcgtccacccaggtgcggctaccgtgcccactatgagtgcagccattcccatggcttattaccccgttggtcccatctatcctcccgggagtacagtgcttgtggagggcgggtacgacgcaggggcaagatttggggccggggccacagccggcaacattcctcctcccccaccggggtgccctccaaacgcagcgcagcttgcagttatgcagggcgcaaacgtgttagttacacagagaaaagggaacttcttcatgggcggatccgatggtggttataccatatggtag

SEQ ID NO: 46677 - DNA, 624 bp, Artificial Sequence
  Description of Artificial Sequence: Synthetic coding sequence
atgaacagcaagggccagtaccccacccagcccacctaccccgtgcagccacctggaaatccggtatatccacagaccctgcacctcccccaggcaccgccctataccgacgcgccgcctgcgtacagtgaattgtataggccctcattcgtgcacccgggcgcagcgaccgtgcctacaatgtcggcagcgttccctggggcctctttgtatctacctatggcacagtctgtcgcagtaggacccctgggcagtacaataccaatggcctattatccagttggcccaatatatccccccgcatctacgtcctggatgccgagtcagtgctgttctgcgtgtagccacgctggctcccagcgcccaagaaacagtgccgaaggagagctgctgcatgggtggttcagatggtggttgcatcatctagtgagaaatcaaggccatctatgtgctggcaaagacattacgtatcttcagcatttctctcagtgcaactgcttcagccacatcaatctgaagcttcagttccggcatatgttgttgggatgtctgagcggcgctcaaacgtttaggcacttctcgaatttgatccgcaaccatgttatggtcgccgtgcccccttag

SEQ ID NO: 46678 - DNA, 411 bp, Artificial Sequence
  Description of Artificial Sequence: Synthetic coding sequence
atgaacagcaagggccagtaccccacccagcccacctaccccgtgcagcctcctggcaacccagtgtatccacaaaccctgcacctgccgcaggcacccccatacaccgacgccccaccagcttacagcgagtcagttgccgtcggccccttgggatccacgatacccatggcctattacccagttggacccatctacccacccggtagcactgtgctcgttgagggtggatacgatgctggcgcccgatttggagccggtgcgactgccggaaatatacctcctcccccaccaggatgtccacctaatgccgcccaactggctgtcatgcagggtgcaaatgttcttgtcactcaacgcaagggtaattttttcatgggcggtagtgacggcggctacaccatatggtag

SEQ ID NO: 46679 - DNA, 2304 bp, Artificial Sequence
  Description of Artificial Sequence: Synthetic coding sequence
atgcagagccccgccgccaccgccgagggcctgagcggccccctgttcggagcctatacttttccaactttcaagttccaaccgcgccatgacagcatggactggagacgtatctctacacttgatgtggatagggtagccagggagctggatgttgccactcttcaggaaaacatcgccggtataaccttttgcaacttggaccgtgaggtatgctcccgctgcggacagccggtggaccccgctttgctgaaagtgctccggctggctcagctaatcatcgagtacctgctgcattgtcaggattgcttaagtgcatctgtcgcacagctcgaagcccgccttcagacctcgctcggccagcagcagagaggccagcaagaactcggcaggcaagctgacgagctgaagggcgtgagagaggagtctcggcggaggcgaaagatgattagcacgctgcaacagctgcttatgcagacgggaacccattcttaccatacttgccacttgtgcgacaagacctttatgaacgccacttttctgcggggacacatccaaagacgacacgccggggtcgccgagggtggcaaacaaaaaaaacaggagcagccagttgaagaagtgttagaggaactgcgggccaagctgaaatggactcagggcgagttagaagctcagcgcgaggctgagagacagcgccagctgcaggaggcggaattgatccaccagagggagattgaggcgaaaaaggaattcgacaaatggaaagaacaggagtggactaaactgtatggcgaaatcgacaagctgaagaagttgttttgggacgagttcaagaatgttgccaaacaaaatagcaccctcgaggagaaactgcgcgcccttcagagtcacagtgtgatggagagcaagttgggttcattacgcgacgaagagtcagaagaatggctccgccaggccagggaactgcaggcattgagagaaaagactgaaatacagaaaacggaatggaaacgaaaagtgaaagaactgcacgaagaacatatggcagagaagaaagaactgcaggaagagaaccagcggctccaagcgtccctgtcacaagatcagaagaaagctgccgcccagtcacagtgccaaatttccactttacgcgcgcagctgcaggagcaggcgagaataatagcaagccaggaggaaatgatccagtccctgagcctccggaaggttgagggaatccacaaagtgcctaaagcggtggacacagaggaggacagccccgaggaggagatggaggattctcaagacgaacagcataaagtgctggccgctctccgtaggaatccaacactgttgaaacatttcaggccaattctcgaggacaccctggaggagaagctggagagcatgggaattcgcaaagacgcgaaaggaatatccatccaaactctcagacacctggagtcactcttacgagtccagcgagagcagaaagctaggaagttctccgaattcctgagtctaaggggtaagctggtcaaggaagtcactagtagagccaaggagcgccaggagaacggcgccgtggtctcgcagcctgatggccagccttcagtgaaatctcaacagagcacgctcgtgactcgggaggctcagcccaaaacccgaacacttcaggtggctcttccaagcacgcccgctgagccccctccccctacgaggcagtcccacggctcgcatggctcatccctcacacaggtgtcggctccggcccccaggccgggacttcatgggccctcatctacaccaccctcatccgggccaggcatgagtacaccccctttttcctccgaagaagactcagagggcgaccgcgtacagcgggtctccttacagccccctaaggtgccgtctcgaatggtgccacgccccaaggacgattgggactggtccgatactgaaactagtgaggagaatgcccagcctcccgggcagggatcaggcactctcgtccagagcatggtcaagaaccttgagaagcagctcgaagctcctgctaagaaacccgctggtggggtctcactgttttttatgcccaacgcaggaccgcaaagggctgccacaccgggtcgcaagcctcaattgtcggaggatgagagtgacctggaaatttcatccctggaagacctccctcttgacctcgatcaacgagaaaaacccaaacccctgtcgagatcgaaactccccgagaaattcggcaccggacctcagagttctgggcagccgagggtgccggcgtggtag

SEQ ID NO: 46680 - DNA, 204 bp, Artificial Sequence
  Description of Artificial Sequence: Synthetic coding sequence
atgcagagccccgccgccaccgccgagggcctgagcggccccctgttcggtgcctacacttttccgactttcaagttccagcctcgacacgatagcatggactggaggaggatttcaacgctcgacgttgaccgggtggcccgggaactggatgtcgccactctgcaggagaatatagccggaatcactttctgcaatctgtag

SEQ ID NO: 46681 - DNA, 1620 bp, Artificial Sequence
  Description of Artificial Sequence: Synthetic coding sequence
atgcagagccccgccgccaccgccgagggcctgagcggccccctgtttggagcatatacttttcccactttcaagttccagccaaggcacgacagtatggactggagacgcatttcgacactggacgtcgacagagtggcaagagagctggatgtcgcaacactacaggaaaatattgccggcatcactttctgtaatctggaccgtgaggtatgtagccgttgtgggcagcccgtagaccccgccctgctcaaggtgttgcggttggctcagttaataatagaatatctgcttcactgccaggactgcttatcagcaagcgtcgctcagctggaggctcggcttcagactagcctgggccagcaacagcgcggacaacaggaactggggagacaagcagacgagttgaagggcgttagggaggagtccaggcggaggaggaagatgattagcacgcttcagcagctgctcatgcagaccgggacacactcctaccacacttgtcacctttgtgacaaaacatttatgaacgctacattcttgaggggacacatacagagacgacacgccggggtggctgaggggggcaaacagaaaaagcaggagcagcccgttgaagaggttctggaggaactgcgggccaagctgaaatggactcagggagagctcgaggcccagcgggaggctgaaagacaacggcagctccaagaggctgagcttattcatcagcgggaaatcgaggcaaagaaagagttcgataaatggaaagagcaagagtggaccaaattatatggtgagattgataagctgaaaaagttgttttgggatgaattcaagaacgttgctaagcagaatagcactctggaggaaaaactgcgggccctgcagagccattctgtgatggagagtaagttaggctccctacgagacgaggagagcgaagagtggttgcggcaggcacgcgagctgcaggccttgagagaaaaaacagaaatacagaaaaccgagtggaaacgcaaggtcaaggagctgcacgaggaacacatggcagaaaagaaggagctgcaggaagaaaaccagcggctgcaggcctccctgtctcaggaccaaaaaaaagctgctgcccagtcccagtgccagatctccacactgcgggctcagctccaggaacaggcaagaattatcgcatcccaggaggaaatgattcagtccttatctttacgtaaggtcgaaggcatccataaggttccaaaagccgtggacaccgaagaggatagtcccgaagaagagatggaggacagtcaagacgagcagcataaggtcttggccgccctgaggaggaaccctactctcttaaagcacttccggccaattctggaagatacattagaggaaaagcttgagtctatgggcataaggaaggatgcaaagggtatttccatccagaccctgagacatttagaatctctgcttcgggtccagcgtgaacaaaaggctcgtaagttctcggaatttctgtccctccgggggaaactcgtgaaggaagtgacatcccgggcaaaggagagacaagagaatggcgccgttgtaagccagccagacggacagccatccggctag

SEQ ID NO: 46682 - DNA, 120 bp, Artificial Sequence
  Description of Artificial Sequence: Synthetic coding sequence
atgcagagccccgccgccaccgccgagggcctgagcggccccctgtttggcgcctacaccttcccgactttcaaattccaaccaagacatgactccatggattggcggcgcattagttag

SEQ ID NO: 46683 - DNA, 1620 bp, Artificial Sequence
  Description of Artificial Sequence: Synthetic coding sequence
atgcagagccccgccgccaccgccgagggcctgagcggccccctgttcggtgcctacacttttcctacctttaagttccagccacggcatgactctatggattggcgccgaatttcgaccctagatgtggacagggtagccagagagctggacgtggccaccctgcaggaaaacatagctgggattactttttgcaacctcgacagagaagtgtgcagccgctgcggacagcctgtggaccctgcactcctaaaggtactgagactggctcagctcattatcgaatatctgctccactgtcaggattgcctaagcgccagtgttgcccagctcgaggcccgcctccagacttccctcggccagcagcagagaggacaacaggagcttggcagacaggcagatgaactcaaaggcgtcagggaggagagccgaagacggcgcaaaatgattagcaccttgcaacaattgttaatgcagacagggacgcacagctatcatacctgccacctttgcgacaagacattcatgaacgccaccttcttacggggtcacatacaacgccgtcatgctggtgtggcagagggcggcaagcagaagaagcaagaacagcctgtagaagaggtgcttgaggaacttagagctaagctgaagtggacacagggcgagttggaggcacagcgcgaggcggaaagacagcgccagctacaagaggctgagttgattcaccaaagggagattgaagccaaaaaggagttcgataaatggaaggagcaggagtggactaaattgtacggagagatcgataaacttaaaaagctgttctgggacgagtttaagaacgtagccaaacagaattctaccctcgaggagaaactcagagccctgcagtcccacagcgtgatggaaagcaagctaggctccctacgcgatgaggaatctgaagagtggctccgtcaggctcgcgagctccaagccctgcgggagaagacagagattcaaaagacggagtggaaacgcaaggtaaaagagctccacgaggagcacatggccgagaaaaaagagctacaggaagaaaatcagagattgcaggcatctctgtcacaggatcagaagaaggcggctgctcaaagtcaatgccagatttctacactgcgagcccagctgcaagaacaagcaaggatcattgcatcccaggaggagatgatacagagtctgagtctgcgaaaagtagaaggaatacataaggtgccaaaagcagtggacacggaggaagattcacccgaggaggagatggaggactctcaggacgagcagcacaaggtgctggccgcactgcggaggaaccccacactgctcaagcacttccgtccaatcctggaggataccctcgaagagaagctggagagcatgggcatccgtaaagatgctaaggggatctcaatacagactctgcgtcatctcgaatcactcctcagagtgcagagggagcagaaggctcgaaagttctcagaatttttgagtctgaggggtaagctggtgaaagaggtaacctccagagccaaggaaagacaggaaaacggagccgtcgtgagccagccagacgggcagccttcgggctag

SEQ ID NO: 46684 - DNA, 561 bp, Artificial Sequence
  Description of Artificial Sequence: Synthetic coding sequence
atgcacaagctgaagagcagccagaaggacaaggtgcggcagttcatggcctgcacacaggccggcgaaagaactgcgatctactgtctcacacagaatgagtggcgactagacgaggccactgatagctttttccaaaaccctgactccctccatagagagtctatgagaaacgcggtcgacaagaagaaactggaaaggctgtatggtcggtacaaggacccgcaagacgagaacaagattggcgtggacgggattcagcagttctgtgatgatctttcactggacccagcctctatctccgttttggttatcgcatggaagttccgagccgccacccagtgcgagttctctaggaaggaattcctcgatgggatgacagagctgggatgtgactctatggagaaactcaaggccctgctcccacgccttgagcaggaactcaaggataccgctaagttcaaggatttttaccaattcacattcacattcgccaagaatcctggccagaaagggctcggatctcccccattcttaaatgttaaggcactccatcattag

SEQ ID NO: 46685 - DNA, 780 bp, Artificial Sequence
  Description of Artificial Sequence: Synthetic coding sequence
atgcacaagctgaagagcagccagaaggacaaggtgcggcagttcatggcctgcactcaggcaggcgagcgtactgccatctattgtctaacccagaatgagtggcgactggacgaggcgactgattcgttcttccagaacccggatagcctccacagggaatccatgagaaacgctgtggataaaaaaaagctggagagactgtacgggcgatacaaggatccgcaagacgaaaataaaattggtgtggacgggatccagcagttttgcgacgatctgagtctggacccagcctctatctcggtcctcgtgattgcctggaagtttcgcgctgccacccaatgcgagttcagccggaaagaattcctagatggtatgaccgaattaggttgcgatagcatggagaagttgaaggctctcctgccacggctggaacaagagttaaaggatactgccaaatttaaagacttttaccagtttaccttcacgtttgcgaagaaccccggtcagaaaggcctggatctggagatggccgtggcctattggaaactggttctcagcggccgttttaagttcctcgatctgtggaataccttcctgatggagcaccacaaacgctccattcctcgcgacacctggaatctcctactcgattttggcaatatgattgctgacgatatgtccaattatgacgaagagggcgcctggccagtcttgatcgatgacttcgtggagtatgccagacctgtggtgactgggggcaaaaggtcgctcttctag

SEQ ID NO: 46686 - DNA, 714 bp, Artificial Sequence
  Description of Artificial Sequence: Synthetic coding sequence
atgcccgtgaagaagaagcggaagagccccggcgtggccgccgccgtggctgaggatggcggtttgaaaaaatgtaagatcagttcttactgcagatcacagccccccgcccgacttatctctggagaggaacacttttcatcgaaaaagtgcctggcctggttctacgagtacgcgggacctgatgaagttgtcggcccagagggcatggagaaattttgcgaggacattggtgtggagcccgaaaacatcattatgctggtcctggcatggaaactcgaagccgagagcatgggattttttaccaaagaagaatggttgaaaggtatgacaagcttacaatgtgactgcaccgaaaagctccaaaacaagtttgacttcctgagaagccagctgaatgatatcagcagtttcaaaaacatttatcgctatgcatttgacttcgcgcgagataaggaccaaagatcccttgacatcgacaccgcaaaatccatgttggccctcctcttgggtaggacgtggcccctgttctccgtgttttatcagtatctggaacagagtaagtatcgggtgatgaataaggatcagtggtacaacgtgctagagttcagcaggacggtgcatgctgatctatccaattatgatgaagatggcgcctggcctgttctcctcgatgagtttgtggagtggcaaaaggtgcgtcagacaagctag

SEQ ID NO: 46687 - DNA, 1749 bp, Artificial Sequence
  Description of Artificial Sequence: Synthetic coding sequence
atggaggccctgagccgggccggccaggagatgagcctggccgccctcaagcagcacgatccatacattacgagcatagccgacctcactggccaggtcgccctttatactttttgcccaaaggccaaccagtgggagaagactgatatcgaaggaacactgtttgtataccgcaggtccgctagcccataccacgggtttaccattgtgaatcgccttaacatgcataacctggtagaaccagtcaacaaagatctggagtttcagctgcacgagccctttctgctctaccgaaacgcctccttgtcaatttacagcatttggttctacgacaaaaatgattgccatagaatcgctaagctcatggccgacgtggtggaagaggaaaccagacgcagccagcaagcggccagggataagcagagcccttcccaggcgaatggctgtagcgaccacagacctatcgacatcctggagatgctaagtagagctaaggacgaatatgagaggaaccaaatgggagacagtaatatatcatcccccggactccaaccatcaacacaactttctaatctcggctcgactgagactctcgaggaaatgccatccgggagccaagacaaatctgcgccatcaggtcacaagcatctgaccgtggaagagctgttcggcacttccctgccgaaggaacagcctgccgtggtgggcctagacagtgaagagatggaaagactgcctggcgacgcctcccagaaggagcccaactcctttttaccctttccattcgagcagcttgggggcgctcctcagtctgaaactctgggggtcccaagcgccgcacaccacagcgtccagcccgagattaccacaccagtcttgatcacaccagcatccattactcagtccaatgaaaaacatgcccctacctataccattcctttgtcaccagttctgagcccaaccttgccggcggaggcgcccaccgcgcaggttccaccaagtcttcctcgcaacagtactatgatgcaagccgtcaagacaaccccccggcagagatcccccttacttaatcagccagttcccgaactgagtcacgctagcctgattgccaatcaaagccccttcagagccccgttgaacgtcacaaataccgccggaacctcactgcctagcgtggatcttctgcagaagctccggttgaccccccaacatgatcagatccagacacagccgctggggaagggtgccatggtggcgagcttcagccccgccgcgggccaactagccacaccagaatcttttatagaaccaccttctaaaaccgctgccgcacgcgtcgctgcttctgcctcactctctaacatggtacttgctccactacaatccatgcagcaaaaccaggacccagaggtctttgtgcaaccaaaggtgttatctagcgccaagcgggtggctggagcgccactggtgacagctaccaccactgccgtcagctctgttctccttgcaccatccgtctttcaacaaaccgtcacgaggtctagtgacctggagaggaaggcaagctctcctagtcccctaacaattggtacgccggagtcccaacgaaaaccctcgataatcttatccaagagccagctgcaggatacgctgatccaccttattaaaaacgactccagcttcctcagtacattacatgaggtgtacctacaggtgctgaccaagaataaggacaaccataacctgtag

SEQ ID NO: 46688 - DNA, 1569 bp, Artificial Sequence
  Description of Artificial Sequence: Synthetic coding sequence
atgttccccttcggcccccacagccccggcggcgacggcagcgccggggccggtgccgaagagccaacaccccacgaaggccaggctgccgcgacggggccccctagtccacttcaccccggagcggacgccacgcatcccccccccccagcaaggagtccccggagaccaggagccccctcactctcccctgccccaagatccggcgaactgggcttgcctggcgctccagagtcatctaccgctagcgcccccggagaacccagcccgccttcccctccgtgccggcggcccgggcctgattgcagggctaagtcccgcggcaggcacggtctaggagcgggcctcggaggtccgggagcccgcctcttcgggtggctgaaggagcgttcgttaggccgcgggctgtttgtcgatccagccagggataattttcgcacaatgacatcactttacggatcaattcaccccgcagattcagtgtatctaagtacgagaacccatggggcagtgttcaacctagagtatagtcctgatgggtccgtcctgaccgttgcctgcgaacagaccgaggtgctgctttttgatccgatatcttctaaacatatcaaaactctcagtgaggctcacgaggattgtgtcaacaacatacgctttctggataatcggttgtttgctacctgctcggacgacaccactatagcgttatgggatctccggaaactgaataccaaggtttgcactctgcacggccacacgagctgggtgaagaatattgaatacgataccaatacacggctcctcgtgacttcaggattcgatgggaacgtgattatctgggacactaacagatacaccgaggatggctgccctcacaaaaagtttttccataccaggtttctgatgaggatgaggctgacacctgattgcagcaaaatgttgatctctacatctagcggataccttctgattctgcatgatctggaccttacaaagtcactagaggttggctcctatccaattctgagagcccgtagaacaacatcctcttccggcgtgtcacctcgtaattctctggaggtcgtgaccccagaggttctcggcgagtcagaccacggcaattgtatcacatctctgcagttgcaccctaaaggctgggccacattgctgcggtgcagcagcaactcagatgacgaggaatgcacatgtgtgtacgagttccaggagggagctcccgtaaggcctgtgagccccagatgttcactgagactgacacactacatcgaggaagccaatgtcgggagagggtacataaaggaactgtgcttttcaccagatggaaggatgatctccagtccacacgggtatggaatccgcctgctgggctttgacaagcagtgttctgagttggtggactgcctgcccaaggaagcctcaccgcttcgggtcatccgatctctctacagccacaatgacgtggtgctaactacaaaattttcgccaacacattgtcaaatcgccagtgggtgtctttcgggtagggtctccttgtatcaacccaagttttag

SEQ ID NO: 46689 - DNA, 1680 bp, Artificial Sequence
  Description of Artificial Sequence: Synthetic coding sequence
atgttccccttcggcccccacagccccggcggcgacggcagcgccggcgctggcgcagaagaaccaaccccccacgaaggtcaggcagctgccacggggcccccatcccccttgcatcccggggccgacgcaacgcatccgcccccccccgctaggtccccacgccggcctggcgctcctagcctgagcccagcaccgcgaagcggcgagttgggcctgccaggagcccccgaaagtagcaccgctagtgcgcccggggagccgagcccacccagccccccctgtagacggcccgggcccgattgcagggcaaaaagtaggggccggcatggactgggggcgggactcgggggacctggagcaaggctgttcgggtggctgaaggagcgttccctaggtcggggcctgtttgtcgacccggcgcgggacaacttcaggactatgacttcactgtacggctctatccatcccgcggactctgtgtatttgtcgacacggacccacggggccgtgtttaacctcgagtattcccctgatgggtctgtgttgactgtggcttgcgaacaaacagaagtgctcctttttgaccctatttcctctaagcacatcaaaacactctccgaggcccacgaggattgtgtgaacaatatcagatttctcgataacaggctttttgccacttgttctgatgacacaactatagctctatgggatcttaggaagcttaacacaaaagtgtgtaccctgcatggacatacatcctgggtgaagaacattgaatatgatacaaacacacgtctcctagttacatctggcttcgacggcaacgtgatcatttgggacaccaatcgatacaccgaggatgggtgtccacacaaaaagttcttccatactcgttttttaatgagaatgagactgacgccggactgctccaagatgttgatctctacctcctcaggatatctgctgattttgcacgatcttgacctgacaaaatcattggaggtgggcagctatccaatcctcagagccagaaggacgaccagcagcagcgatcttacaacgagcagcagttcttccgggccccgggtcagcggttctccctgtcatcattctgatagcaattcaagcgaaaagcacatgagtcgggcatcccagcgcgagggtgtaagccctcgaaacagtctcgaagtggtgacccccgaggtgcttggggaatccgaccatggcaattgtatcacttccctgcagctgcatcctaaggggtgggcaactctccttcgctgtagttcaaactccgacgatgaggagtgcacttgcgtgtacgagtttcaggaaggcgctccagttcgacccgtttcacctcgctgctcgctgcgcctcacccattatatcgaagaggctaatgttggccgtggatacatcaaggagctatgtttctctcccgatgggcgaatgatatcatccccgcacggatacgggataaggctgctgggcttcgacaagcagtgctccgagctggtggactgcctgcctaaagaagcctcccctctgcgggtgattaggtcactctattcacataacgatgtcgtcctgacaaccaagttttctcctacccactgccagatcgctagtggatgcctgtcaggtcgcgtcagcctctatcaacccaagttctag

SEQ ID NO: 46690 - DNA, 1392 bp, Artificial Sequence
  Description of Artificial Sequence: Synthetic coding sequence
atggcccagcagcagaccggcagccggaagcggaaggcccccgccgtagaggctgatgcagagagcagccccagtcaggggctcgctgctgcagatggtgaaggaccgttgctgctgaagagacagcgtcgacctgccacctaccggtccatggcacattacctaaaggtccgagaggtcggaggatggggcccagccaggctgcagggttttgacggggagctgagggggtacgcagtccaacgactgcccgagctgttaacagagcgacagctggaactgggaactgttaacaaagtcttcgcttcacaatggctcaactctcgtcaggttgtgtgcggaacgaaatgcaatacgctttttgtcgtggacgtcgagagtggccacattgcgagaattccactgcttcgagactctgaggcacgccttgctcaggatcaacaaggttgcggcatccacgctatcgagctgaacccaagcaagaccctccttgccactggtggagaaaaccctaatagcctggccatctatcagctgccgtccctcgaccctctctgcctgggcgatagacatggtcataaggactggatttttgcggtcgcctggttgtcagatactgtcgcggttagcgggtccagagatgggaccgtggcgctttggcggatggaccccgacaagttcgatgacaccgttgcttggcactccgaggtgggcctccccgtgtacgcccatattcgcccccgggacgtagaggccatcccccgggccatcatcaacccctctaatcggaaagtccgcgccttggcctgtggagggaagaaccaggagctcggcgctgtaagccttgacgggtatttccatctgtggaaagcaggaagtgccttgtcaaggttgctttctatcaggctcccctattttcgtgataacgtctgtctgacgtactgtgatgacatgtctgtctatgccgtagggtcccactctcacgtgtcgttcctggaccttagacaggaccaacagaatattagacccctgtgcagtagggagggcggcacaggtgtgcgtagcttaagcttctatagacatattataacagtagggacaggccaaggctccctcctgttttacgacgttcgggcccagaagtttctcgaagagcgcgcttctgccactttggaaagctcctccggtcccgcgcggaggaaacttaggctcgcctgtggacggggctggctcaaccacaacgacttttgggttaactattttggcggaatggaggtatttcccaacgccttatacactcactgctacaattggccagaaatgaaattatttgtggctggcggacccctcccagcggggctccatgggaattacgccgggctttggtcttag

SEQ ID NO: 46691 - DNA, 1392 bp, Artificial Sequence
  Description of Artificial Sequence: Synthetic coding sequence
atggcccagcagcagaccggcagccggaagcggaaggcccccgccgtcgaagctggcgccggatcgtcttcttcacagggactcgctgcggcggatggagagggcccactgttgcccaagaaacaaaaaaggcctgctactcggagacgcctggtccactatttgaagggccgcgaggtcggtgcgcgtggaccagcagggctgcagggattcgagggtgagttgagaggctatgcggtgcaaaggctgcccgagctgctgaccgagcggcagctggatcttggaaccctcaacaaagtattcgcctcacagtggcttaatgctaggcaggtggtgtgtggaaccaagtgtaatacattatttgtagtcgacgtgcagtccggacatatcacacggatacccctgatgagagacaaagaggcaggtctcgctcaggctcaccagggttgcggtatacacgcgatcgagctcaatcccagcaagacactgctggccaccgggggagaaaatcctaactcactggcaatatatcagctgcccaccctcgatcctctatgcctgggagatcggcatggccacaaggattggattttcgctgtagcctggctgtctgacactgtcgcggtctcaggttcgagagacgggaccgtggcactgtggaggatggaccccgatatgttcaacgggtctatcgcctggcattcagaggtgggactgcccgtgtacgcgcatatccgaccgcgggatgtggaagccattccccgcgccagtaccaacccgtcgaacaggaaggtgagggcccttgccttctccggaaaaaaccaggaactcggagccgtttcactagacggttatttccatctctggaaagcacggagcacgctgtctagactcctgtcaattaggcttccgtattgtcgggagaacgtttgcctgacgtactgcgatgaactgtccctgtacgccgtgggctctcaatctcatgtcagttttctggatcctcgccaacgccaacaaaacattcggccattgtgttctcgggaaggtgggaccggggtgcgctcactatccttctatcagcatattattactgtggggactggacacggctcgcttctgttttacgacatcagagcacagaagttcctagaggaaagagcctcgagcagcctggacagcatgcctggtccggccggacgcaaactcaagctggcttgtggtcgaggctggctgaaccaggacgatgtttgggtcaattatttcggtggaatgggtgaatttcctaatgctctctacacgcactgctacaactggcccgaaatgaaattgtttgtggccggtgggccgctcccctctgggctgcacggcaactacgccggattatggtcctag

SEQ ID NO: 46692 - DNA, 1392 bp, Artificial Sequence
  Description of Artificial Sequence: Synthetic coding sequence
atggcccagcagcagaccggcagccggaagcggaaggcccccgccgtggaggccggcgccggaagttcttcatctcagggcctcgctgcagcagatggagagggccctctcctgcctaagaagcagaagagacctgccacgcggcgcagactagtgcactatcttaaggggagagaggttggggccaggggtcccgctggcctgcagggatttgagggcgaattgaggggctacgcggtacagcgtctgccagagttgctgacggaacggcagttagatttaggaacactcaataaggttttcgcatctcagtggctgaacgctcgacaggtggtgtgcggtacaaagtgtaacaccttgttcgtcgttgatgtgcagtcaggacatattactcgcatccccttgatgagggacaaggaagcaggcctggcgcaggcacaccagggctgtggcattcacgccattgaactgaatccctccaagactttattggccacaggaggcgagaaccccaattccctggccatatatcagctgcctacactggatcctctttgtcttggagatcggcatggacataaagattggatttttgccgtggcttggctctcggacacagtcgccgtgtccgggtctcgcgatgggacagtggctctgtggcgtatggatccagacatgttcaacggctcaatcgcctggcactccgaggtcggactccccgtctatgcacacataagacctcgggatgtcgaggctattcctagagcttcaaccaacccctccaataggaaagttagggcactcgcattcagcggcaaaaatcaggagcttggtgcggtatcactggacggttactttcacttatggaaagcacgtagtacgttatctcggctcctgtcaatccggctgccctattgccgggaaaacgtgtgcctgacttattgcgacgaactcagcttgtatgccgtgggcagccagtctcacgtcagctttctggacccaaggcagaggcagcagaacatccggcccctgtgtagccgtgaggggggaacgggagtccggtcattatcattctaccaacacatcattaccgtgggaacaggccacgggtccttgttgttctatgatattcgggcccagaagtttttggaagagcgagcttcaagtagcctggattctatgccaggccccgccggtcgaaagctgaagctcgcgtgcgggaggggatggctaaatcaggacgatgtctgggttaattacttcggcgggatgggcgaattccccaacgcactctacacccactgttataattggccagaaatgaaactgttcgttgctggtggacccctcccatccggattgcacggcaactacgctggcttgtggtcttag

SEQ ID NO: 46693 - DNA, 1803 bp, Artificial Sequence
  Description of Artificial Sequence: Synthetic coding sequence
atggcccccagcagcaagagcgagcggaacagcggcgccggcagcgggggcggaggtcctggaggtgccgggggaaaacgggcagcagggcgccgcagagagcacgtactaaaacagctggagagagtgaagatttccggccagctcagcccaaggttgtttcggaaactacctcctagagtatgcgtgtctctgaagaatatagtcgatgaagatttcttatacgccggccatatttttttagggttctcgaagtgcgggcgatacgtcctctcttacacttcctcttcaggtgatgatgacttctctttttacatttatcatttgtattggtgggaattcaacgtccatagcaagttaaaactcgtacggcaggtgaggctgtttcaagatgaagaaatctattcagacttatacctcaccgtgtgcgagtggccttctgatgcaagcaaggtgatcgtctttggatttaatacgcgctccgctaacgggatgctgatgaacatgatgatgatgagtgacgaaaatcaccgggacatctatgtgagcacggtggctgtccctcctcctgggcgctgtgccgcctgccaggacgctagcagggctcacccaggggatcccaatgcccagtgtctgagacatggatttatgttacacaccaagtatcaagtggtctaccctttccctacattccaaccggccttccagctgaagaaagaccaggttgtactgttgaacacatcatatagtctcgtcgcctgcgccgtgtctgttcactcagccggggaccgcagtttctgtcagattttgtacgaccattcaacctgtccgctcgcccccgctagcccacctgaaccacagtccccggagctgcctccagctctcccatccttttgccctgaggccgccccggctcggtcctcaggaagcccggaaccttctccggcaatagccaaagcaaaggagtttgtcgcagacatcttccgtcgcgcgaaagaggccaagggaggtgttccggaggaggcgagacctgcactgtgtcccggacctagcggatcgcggtgcagggctcactccgaaccactggcgctttgtggggagaccgcaccccgtgattcgccccccgcatctgaagctcccgctagcgaaccgggatatgtgaactacaccaagctgtactatgtcttagaaagtggtgagggaacggagcccgaggacgaacttgaagatgataagatctcccttcccttcgtagtgacagacttgcgagggcgcaatctcagacccatgagggaacgaactgctgtgcagggccagtacttgacggtcgagcagttgaccctggactttgaatacgtgataaacgaggtaatcagacacgacgcgacttggggtcaccagttctgctccttctccgattacgacattgtcatcctcgaggtgtgtccggaaaccaatcaagtactaatcaatatagggttactcctgctcgcctttccctcaccgactgaggagggacaactgcggccaaaaacttaccacacaagtctgaaggtcgcctgggaccttaatactggcatcttcgaaaccgtgtccgtgggagacctaaccgaagtgaaggggcagacctcagggtctgtctggagctcttatcgcaagtcgtgcgtcgacatggtgatgaaatggctagtccccgaatcgtccgggcgctacgtcaacagaatgaccaatgaagccctgcataagggttgctctttaaaagtcctcgcagactctgaaaggtacacctggattgtgctatag

SEQ ID NO: 46694 - DNA, 651 bp, Artificial Sequence
  Description of Artificial Sequence: Synthetic coding sequence
atgggcccccggaaccccagccccgaccacctgagcgagagcgagtcagaggaagaggaaaacataagttacctaaacgaatcttcgggtgaggagtgggattcctctgaggaagaggactccatggtgccaaacctgtctccgttggagagtctcgcatggcaggtgaagtgtctgttgaaatacagcactacgtggaaacccctcaaccccaacagctggctgtaccacgctaagctcctggaccccagtacaccggtccatattttgcgagaaatcggattgcgcttgagccattgctcacactgcgtgccgaagttggagcccatccccgagtggcccccactggcctcttgtggcgttcccccctttcagaagccactgactagtccttcaaggctgtctagagaccatgccacattgaatggcgccctgcagtttgcaactaaacagttgagcaggacactctcaagggcgacccctatcccagagtacctgaagcagattccaaattcctgtgtatctggatgttgttgcggttggctgacaaagactgtgaaagaaacaacaaggactgagcccattaatacgacatattcctatacagactttcagaaagcagtcaacaaactccttacggcttccctttag

SEQ ID NO: 46695 - DNA, 651 bp, Artificial Sequence
  Description of Artificial Sequence: Synthetic coding sequence
atgggcccccggaaccccagccccgaccacctgagcgagagcgagagtgaagaggaggaaaatatctcttacttaaacgaatcgagtggcgaagaatgggactcatccgaggaggaagactcaatggtgcctaacctgtccccccttgaaagcctagcctggcaggttaagtgtctacttaagtatagcactacttggaaaccactgaaccccaatagttggctctatcacgcgaagttactggacccctcaacccctgtgcatatcctgcgggagatcggccttagattgagccattgtagtcactgcgtccccaagctggagcccattccagaatggccaccactggcttcttgcggtgtcccccccttccagaaacctctgacatcaccctcacggctgtcaagggaccacgccacacttaacggagcactgcaatttgcgactaagcaactgtcacggaccttgtcaagggccactcccattcccgagtatctgaagcaaatacctaattcctgcgtgagtgggtgctgttgcggctggttaactaaaacagtgaaagagacgacccgcacagaacccataaatacgacctactcttacaccgactttcaaaaggctgtcaacaagctcctaaccgcgagtctgtag

SEQ ID NO: 46696 - DNA, 1488 bp, Artificial Sequence
  Description of Artificial Sequence: Synthetic coding sequence
atgaacaagagccggtggcagagccggcggcggcacggccggcggtctcatcagcagaacccgtggttccgcttaagggactctgaggatcgctctgacagtcgggccgctcagcctgctcacgattcagggcacggggatgatgaatcaccaagcacatcaagcggtaccgcaggtacaagctcggtcccggaactgccaggcttctactttgatccagagaagaaacgctactttcgtctcctgccagggcacaacaactgcaacccactaaccaaggagtccatcaggcaaaaagagatggaaagcaaacggctgaggctgctacaggaggaggataggcggaaaaagatcgcccgaatggggtttaacgcgagcagcatgctgcggaagagccagttagggttcctgaacgtcacaaattactgtcatctggctcatgagctgagactgtcctgtatggagaggaaaaaggtgcagattaggagcatggacccctcagcactggccagcgatcgctttaacctcatcctggccgatacaaattccgataggctttttacagtaaacgacgttaaggtgggaggctcaaaatatgggatcatcaacctgcagagcctgaagacaccaaccctgaaagtgttcatgcatgagaacttgtactttactaaccgaaaggtgaattctgtctgctgggccagcctgaaccacctggacagccacatcttgctgtgcttgatgggcctggcagaaacccccggatgtgctacattactgcctgctagtctctttgttaactcacatccaggcatagaccgtcctggcatgctatgctctttcagaattcccggagcctggtcatgtgcctggagtttaaatattcaggcgaacaattgcttctccacgggactcagcaggagggtactgctgactaatgttgtgacagggcaccgccaatcgtttggtactaatagtgatgtgctggcacagcagtttgctctgatggcccccctcctcttcaatgggtgtaggagcggcgaaatctttgcaatcgacctcaggtgtggcaaccagggaaaaggatggaaggctacccggcttttccatgacagcgccgtgacgtcggtgagaattttgcaagacgaacagtatttaatggcatcagatatggccgggaagatcaagctgtgggatttacgcacaactaagtgtgtccggcaatacgaaggacatgtcaacgaatacgcttacctgcccctgcacgtgcacgaagaagagggtatcctggtcgcggtggggcaggactgttatactcggatttggagtctacatgacgcacgactcctccggacaattccaagtccatacccagctagcaaagccgacatccccagcgtagcattttcatccagacttggtggatcgcgcggtgccccaggattgctcatggccgtcggccaggacctctattgttacagctattcttag

SEQ ID NO: 46697 - DNA, 1188 bp, Artificial Sequence
  Description of Artificial Sequence: Synthetic coding sequence
atggagagcaagcggctgcggctgctgcaggaggaggaccggcggaagaaaattgctcggatgggattcaatgccagtagtatgctccgcaaaagtcagctgggctttttgaacgtgacaaactactgccaccttgctcacgagcttcggctgtcctgtatggaacgaaagaaggtgcagatccggagcatggatccatcagctttggccagtgaccgtttcaatctcatacttgccgacaccaactcagacagactgttcacggtaaacgatgtgaaagtaggcgggtctaaatacggcatcatcaatctgcagtcgctgaagactccaactctcaaggtgtttatgcacgagaacctatacttcaccaatcgaaaggtgaatagcgtgtgttgggcctctctcaaccatctggattctcacattcttttgtgcttaatgggccttgctgagactcctgggtgcgctacgctgctgcctgcatcactgtttgtgaactcccacccaggtattgatcggcccgggatgttgtgctccttccgtatcccaggggcatggagctgtgcttggagtttaaacatacaggcaaataattgtttctccacggggctgagccgcagagtgctcctgacgaatgtggtgaccggccaccggcagtccttcggaactaactccgatgtgttagctcagcaattcgctcttatggctccccttcttttcaacggatgccgaagcggggagattttcgccatcgaccttcgttgtgggaatcaaggtaagggctggaaagccacaagactcttccacgactccgctgttacctccgtgaggatactgcaggacgaacagtatctcatggccagcgatatggccggcaagataaagctctgggatcttcgaactacaaaatgtgtacgccaatacgagggccatgtgaacgagtacgcctacctcccccttcatgttcacgaggaggaaggcattctcgttgcggtggggcaagactgttacacaaggatttggtccctgcatgacgcgaggctcttgcgcacgataccgagcccataccccgctagcaaagccgacatcccgagcgtcgcattctcatcccgcctggggggcagcagaggagcacctgggctactgatggccgtgggacaggatctttattgctattcctatagttag

SEQ ID NO: 46698 - DNA, 1308 bp, Artificial Sequence
  Description of Artificial Sequence: Synthetic coding sequence
atgaacaagagccggtggcagagccggcggcggcacggccggcggtctcaccagcaaaacccatggttccggttgagagacagcgaggacaggagcgattccagggcagcccagcccgcccacgactccggccatggcgatgacgaatcaccgtcaacttcctcaggcacagctgggacaagcagtgtcccggagctgcccggcttctatttcgacccggagaaaaaacggtacttccgccttctgcccggccataacaattgcaatccactcactaaagaatccattagacaaaaagagatggaatccaaaaggctgagactgcttcaggaagaagatcgtaggaagaaggccgacactaatagtgaccgcctcttcaccgtgaatgatgtcaaggttggtggttctaagtacgggatcatcaacctgcagagcttgaagaccccgacgctgaaggtgtttatgcatgagaatctttattttaccaaccggaaggtgaattctgtgtgttgggcctctcttaaccatctggattctcacatcctcctctgcctcatgggcctggccgaaactccggggtgcgccacactgctgccagccagcctcttcgtgaactcacatcctgccggtattgatcggccagggatgctgtgtagcttccgcatcccgggtgcatggagttgtgcgtggtccctcaatattcaggcgaacaattgcttctccacaggactaagtcgcagggtgctgctgacaaacgtcgtgaccggccaccggcagagctttggcaccaattccgatgtgctcgcacagcagtttgccctcatggcccctttattgtttaacggttgcagaagtggcgaaatttttgctatagatcttagatgcggcaaccagggcaagggctggaaagccacccgattgtttcacgatagcgccgtaacatccgttcgaattctgcaggacgaacagtacctaatggcgtctgatatggccggcaagattaaattgtgggacctgagaacgacgaaatgcgtgaggcagtatgaaggtcacgtgaatgagtacgcttacttgcctttacatgttcatgaggaagagggaattctggtcgcggtcggccaggactgttatacccgtatctggagtcttcatgacgccaggctgttaaggacgatccccagcccatatccagcttctaaagccgatattcctagtgttgcattttcgtctaggctgggaggatctcggggcgcgcccggcctcttgatggcagtagggcaagatttgtattgctactcttattcttag

SEQ ID NO: 46699 - DNA, 1470 bp, Artificial Sequence
  Description of Artificial Sequence: Synthetic coding sequence
atgaacaagagccggtggcagagccggcggcggcacggccggcggtcccatcaacaaaatccctggttccggctacgcgactcagaagaccggagtgattctagggctgcacagccggcccacgacagcggccacggggatgatgagtccccttctacatcttccggcaccgctggaacgtcctctgtgccagagctgcccggcttttattttgatccagagaaaaaacgatatttccgactgttaccaggccacaacaattgtaaccctctaaccaaggagtcgattcgtcagaaagaaatggagagcaaaaggttgcgcttgctccaagaggaagacagacgcaagaagatcgctcggatgggtttcaatgccagcagcatgctccggaagagccagctagggtttcttaacgtgacaaattattgccaccttgctcacgagctgagactttcatgtatggaacggaagaaagttcagatcagatctatggacccctctgctctggcgagtgatcgatttaacttaattctcgccgataccaactccgatcgtctcttcactgtcaatgatgtcaaggtgggagggtcaaaatatggaattatcaatttgcaaagcctgaaaacccctacactgaaagtatttatgcatgaaaacctgtactttacgaacaggaaggtgaactcagtttgttgggctagcctcaatcacctagattcccacatattgttgtgcctcatgggactagccgagactccaggctgtgccaccctgctgcccgctagcttgtttgtgaacagccatcccgccggaattgatcggccggggatgctctgttcgtttaggatcccaggcgcctggtcctgcgcctggagccttaatatacaggcaaataactgcttttccaccgggctgtcccggagggtgctgctgactaatgttgtaacaggccaccggcagtcttttgggactaattctgacgtgctggccccactgctcttcaatggctgcaggagcggagaaattttcgcaatcgatctccgctgcggaaatcagggtaagggctggaaagccactcgcctatttcacgactccgccgtgacaagcgtgagaatcttgcaggatgagcagtacctgatggcttccgatatggcgggaaagataaaattgtgggatttgcgtacaacaaagtgtgtgaggcagtatgaaggccacgtcaatgaatatgcctatttaccgcttcatgttcacgaggaggagggcatattggttgcggtagggcaggactgttataccaggatttggagtctccacgacgcaaggctcctacggactatcccatctccgtatcctgcttctaaggccgacatccctagtgttgcgttttcttctagactgggtgggtccagaggcgcccctggtttattgatggccgttgggcaagatctgtactgctattcctactcctag

SEQ ID NO: 46700 - DNA, 1191 bp, Artificial Sequence
  Description of Artificial Sequence: Synthetic coding sequence
atggaggccgagcggctgcggctgctggaggaggaggccaagctgaagaaagtagcccggatgggctttaacgcctctagtatgctgcgcaaatcccaacttggatttctcaacgtgaccagctattcacgtttggccaatgagctgcgcgtctcatgtatggagcgcaaaaaggttcaaatcagatcactggatccatctagcctagcaagtgacaggttcaacttcatcctcgccagtaccaactccgatcagctcttcgtggtgaatcaggtggaagtcgagggaagtaaatacggcataatctctctccggactctgaagataccctcctttcacgtgtatgtcctgcggaacctgtatgttcccaatcggaaggtcaaatccctgtgttgggccagcctgaatcagctggactcacacgttctgttatgcttcgaagggattactgacgctccttcctgcgccgtgttgctgcccgcctcacggttccttagtgtgcacacccgcgtgaaccaacccggaatgctatgtagtttccaaattcccgaggcatggtcgtgcgcctggagcctgaatactcgggcctaccactgtttttcagcggggttgtcccagcaggtgcttttaaccagcgtcgccaccggtcaccagcagtccttcgacacatcatctgacgtgctggctcaacagttcgcttccacagcccccctgctgtttaacgggtgtcgctcaggcgaaattttcgctattgacctcaggtgccgaaatcgagggaaggggtggcgcgcgacacggctctttcacgattctgccgtgaccagcgtccagatcctgcaggaggagcagtgtcttatggcgtccgatatgacggggaaaatcaaactgtgggacctgagagctacgaagtgtgtgcggcagtacgaggggcatgtcaatgaaagcgcctacttgcctctccacgtacacgaggaagagggcattgtcgtggcagtaggacaggattgttacacgcgtatttggtcactgcacgacgcacacctcctcagaacaatccccagtccttactctgcctctgaagatgatatcccctccgtcgccttcgcttctagactcggggggattcgaggagccgcacctgggctgctcatggcggtgcgccaggacttgtactgtttccctttctcttag

SEQ ID NO: 46701 - DNA, 1188 bp, Artificial Sequence
  Description of Artificial Sequence: Synthetic coding sequence
atggagagcaagcggccccggctgctggaggaggccgacaagcagaagaaaactgtgagggtgggtctgaacgcaccaagcatgctgcgaaagaatcagttaggattcctgagattcgccaattattgtaggattgctcgcgaactcagagtctcatgtatgcagaggaaaaaggttcagatccacagctgggacccttcttcgcttgcctcagaccgattcaaccgaatcttagctaacacgaacacagatcagctgtttacagtcaatcaggttgaggcaggaggttccaagtacgggataatcaccatgcgggggctgacaacccccgagctcagggtgtatccgcataagacgctgtacgttcccaatagaaaagtgaactccatgtgttgggcctccctcaaccaccttgattctcatctgctactgtgttttgtgggactggccgacacgccctcctgcgcagttctgcttcccgcctctctgttcataggcagtttcccaggtatgcgtcggccaggaatgctctgcagcttccagatacctgatgcatggtcctgcgcctggtctctgagtatccatgcgtatcattccttttccactggactgtcccagcaggtgctcctgacaaatgtggtgacgggccaccagcagagcttcgggacttcttcagatgtgctggctcagcagtttgctataatgacacctctcctcttcaatgggtgtaggtcaggcgaaatatttggcatagacctcaggtgtggtaaccaagggtctgggtggaaagcaatctgccttagccatgattccgcagtgacatctctgcagatattgcaggatgggcagttcttagtatcctccgatatgaccgggaccatcaagctgtgggatctgagagctacaaagtgcgtgacccagtatgaagggcacgttaataactcggcatacttgcccgtgcatgttaacgaggaagagggtgtcgtcgccgccgttggtcaagactgctatacccgaatatggagcttgaggcacgggcacctgttgacaaccattcctagtccttaccccgcgtccgagaatgacatccctagcgtcgcattcagcagccggctaggaggcttcagaggggccccaggcctgctcatggctgtgcgtgaggacctatattgctttagttatggctag

SEQ ID NO: 46702 - DNA, 1803 bp, Artificial Sequence
  Description of Artificial Sequence: Synthetic coding sequence
atgagccaccaggagggcagcaccggcggcctgcccgacctggtgacagaaagtctattcagctctcccgaggagcagtccggagttgccgcggtgacagcagcttcctccgacattgagatggctgctactgagccttccacgggggatgggggagatacgcgcgacggtggctttctgaacgacgcttccactgagaaccagaataccgacagtgagagttcctctgaagacgtcgagctggaatccatgggcgagggcttgttcggctatccgctagtgggtgaggagactgaaagagaagaggaggaagaggaaatggaggaggaaggagaagaagaagagcagcctcgcatgtgccccagatgcggggggacaaatcacgaccaatgccttctggacgaggaccaggcactagaggaatggataagtagcgaaacatccgctctgccccggtctcgttggcaagtcttaacagccctccgacaacggcagctgggttcttcggccaggtttgtgtacgaggcctgcggagctcgaacatttgtacaacgattccggcttcagtatcttctggggtcccacgccggaagcgtctctaccatccactttaaccagcgcggaacacgcctggcatcttccggcgatgacctgagagtgatcgtgtgggactgggtgcgccagaagcctgtactgaattttgaatcaggccatgacattaatgtcattcaagctaagttttttcccaattgcggtgacagtaccctggctatgtgtggccatgatgggcaagtcagagttgccgaattaattaatgcatcgtattgcgaaaacacaaaaagagtggccaaacaccgcggccccgctcatgagctggctctggagccagactcaccctacaagttccttacaagtggggaggacgcggtggtgtttaccattgacttgcgccaggaccgccccgctagtaaagtggtcgtgaccagagagaatgataagaaggtcggactgtataccatctccatgaacccagccaatatataccagtttgccgttggcggtcacgaccagttcgtgcggatatacgaccagcgccgaatcgataagaaggagaataacggtgtccttaagaagttcacccctcatcacctcgtgtactgtgattttccaacaaatattacctgtgtcgtctactctcacgacgggacggaattgttagcatcctacaacgacgaggacatctacctgttcaacagctctctgtccgatggcgcccaatatgtgaagcggtacaaggggcaccgaaataatgatactattaagtgtgtgaatttctatggcccccgcagtgagtttgttgtgagtggcagtgattgcggtcatgtctttttctgggagaaaagctcaagccagattattcagtttatggagggagacagaggcgacatcgttaattgtcttgaaccccacccctacctgcccgtcctggcaaccagtggcctggatcagcatgtgcgtatttggacccctactgccaaaacagcaacggagctaaccggtctgaaggatgtcatcaagaagaacaagcaagaacgggacgaggataacctgaactacacagactctttcgacaaccgaatgttgaggttttttgttcgccacctcctccagcgagcgcaccagcccggctggcgggatcatggagctgaatttcctgatgaggaagagctggacgagagtagttcaaccagcgatacatctgaagaagagggccaggaccgagtgcagtgtatcccatcctag

SEQ ID NO: 46703 - DNA, 1896 bp, Artificial Sequence
  Description of Artificial Sequence: Synthetic coding sequence
atgagccaccaggagggcagcaccgacggcctgcccgacctgggcacagagtcgctgtttagctctcctgaggagcaatctggggctgtcgcagcgactgaagccagcagcgatatcgatatcgccacttcagaattatctgtcacagtgacgggtgacggatcagacagccgggacggaggatttcctaatgacgcatcaacagaaaatagaagtagcgatcaggagtcagcaagcgaggatatagaactggagtctctcgaggacttcgagcatttcctgatgagtggagagagcctgttccactaccccctggtcggggaagaggagacagaaagggaagaggaagatgaagagatccaggaagagggcggagaggaggaagaagaggaggaggaggaggaagaagaggaggaggaagaggaagaggaggaagaggaacaaccacgggccggtcctcagggaagtggaggaaaccacgagcagtattcactggaagaggatcaggctctggaggaatgggtttccagcgagacaagcgcgctgccaagaccaaggtggcaggtcgtaacggccctgcatcagcgtcagctgggcagtcggcctcgattcgtgtacgaagcctgtggtgcccgggcatttgtgcagcggtttcgcctccagtacaggttggccgaccacgtggggtgcgtgaacaccgtgcacttcaaccagcggggcactaggttggccagcagcggcgacgatctgaaagtcattgtatgggactgggtgcggcaaaggcccgtactgaactttgagtcagggcacacaaataacgttttccaggccaaatttctgccaaattgtggcgattccacactggccatgtgcgccagggacggccaggttcgagtggccgagttgatcaacgccagctattttaacaacaccaaatgtgtggctcagcaccgggggcccgctcataagctggctctcgaaccagattctccttataagtttctcacttccggagaagatgccgtcgttttcacaatcgacctcagacaggaccgtcccgcaagtaaggtggtagtcactcgcgaaaacgacaagaaagttgggttgtatacaattacggtcaatccagcgaacacttatcagttcgccgtcggcggacaagaccaatttgtgcggatatatgaccagaggaaaatcgataagaaagagaacaacggcgtcctgaaaaaattcacgccccaccacctagtgaactgtgattttccgacaaacatcacctgcgtggtgtactctcatgatggcacagagcttctagccagctacaatgatgacgacatttatctgtttaattcttcacacagtgatggggcccagtactccaagcgttttaagggacatagaaacaatacgactgttaaaggcgttaacttctatggacccaggagcgagtttgtagtcagcggaagcgattgcggccacatcttcttctgggaaaagtcttcatgtcagatcattcagttcctgaaaggatctcgggagggaaccatcaattgtcttgagcctcacccctacctcccagtgcttgcctgctcaggactggaccacgatgttaaaatctggaccccgactgccaaggccgcaaccgaactcacaggactcaagaaagtaatcaagaaaaacaagtgggagcgtgatgaggactccctgcaccatggtagcctcttcgaccagtacatgctgtggttcttgcttagacatgtgacccagcggggtaggcatcaagattggagaagtggggaagccgagtttcccgatgaagaaagcgatgagtctagttccacatccgaaacctcggaagaagaggttcaagaccgcgtgcaatgtatgccttcctag

SEQ ID NO: 46704 - DNA, 1452 bp, Artificial Sequence
  Description of Artificial Sequence: Synthetic coding sequence
atgagcaccgcccggaccgagaaccccgtgatcatgggcctgagctcccagaacggccagctgagaggccctgtgaaacctaccgggggcccaggtggaggcgggacccagactcagcagcagatgaaccagctgaagaatacgaacacgatcaacaatgggacccagcagcaggctcagtctatgaccacaactatcaaacccggagatgattggaagaagacactgaaactaccgcctaaagatctgagaataaaaacctccgatgtgactagtactaaagggaatgagtttgaagactactgcctgaagcgggaactgttaatgggaatctttgagatgggctgggagaaacctagcccaatccaagaggagtctattcctatcgctctgtctggtcgagatattttagcccgcgccaaaaatggcacgggaaaaagtggggcttacctgattccacttctcgagaggctggatctgaagaaagacaatattcaggcaatggtgatagttccgactcgggaactagctttgcaagtctctcagatatgtattcaagtgtccaagcacatgggcggtgctaaggtcatggccacaacggggggtacgaacctgagagatgatattatgaggctggatgatactgtccacgtggtgatagccactccagggcggatcctcgatctcatcaaaaaaggtgtggcaaaagtagatcacgtacagatgatcgtgcttgatgaagctgacaagctgttgtctcaagactttgtgcaaattatggaggacattatcctgaccctacctaagaatcgccaaatcctcctttattcagccacattccccctgtccgttcagaagtttatgaactcccatctccaaaagccctacgagattaacctaatggaagaactaactctcaaaggggtcactcagtactacgcttatgtcaccgaacgtcagaaagtgcattgcttgaacactctgttttcacgactacagatcaaccaatctatcatattttgtaactcgtctcagcgggtggagctgctggcaaagaagatctcccagcttggttactcttgtttctacatccacgccaaaatgcggcaggaacaccggaaccgggtcttccatgatttccgtaatggcttgtgtcgtaatctggtttgcaccgatctctttacgagggggattgatatccaggcagtcaatgtggttatcaatttcgatttccctaagctggccgagacctatttgcatcgtataggaaggagcggtcggtttggacacctcggactcgctattaacctgatcacctacgacgatagattcaacttgaagtccattgaggagcagctgggtacggagatcaaacccattccgagtaatattgataaatctttatatgtggcagaatatcactcagagcctgtggaggatgaaaaaccctag

SEQ ID NO: 46705 - DNA, 1452 bp, Artificial Sequence
  Description of Artificial Sequence: Synthetic coding sequence
atggccggcttcgccgagctgggcctgagcagctggctggtggagcagtgccgccagctcggtcttaagcagccaacccccgttcagctgggttgcatacccgcgattcttgagggtcgggactgcctcggctgtgctaagacaggtagcgggaagacagcagccttcgtccttccaatcttgcagaaactgagcgaggatccttatggaatcttctgcctcgtactgacaccaactagggagttagcatatcagattgccgagcagttcagggtcttggggaaaccgctgggtctgaaagactgtattatcgtgggcgggatggacatggttgcgcaggcgttggaactgagtcgcaaaccacacgtcgtgatcgctactccaggccgccttgcggatcacctgcggagcagcaatacattttcaataaagaaaattcgcttcctggtgatggacgaagctgacagacttttggagcagggatgcaccgacttcaccgtcgatctcgaggcgatcttggccgctgtgcctgcccgacgtcagaccttgttgttctctgctacattgactgacacactgcgggagctccagggactggccaccaatcagccttttttttgggaggctcaggcccccgtgagcacagtagaacagcttgatcagcgatacctcctcgtgcccgagaaagtcaaggatgcatatcttgttcatctcatacaacgctttcaggatgaacacgaggactggagtatcattatcttcactaacacgtgcaagacctgccagatcctgtgcatgatgttaagaaaattctcctttcccaccgtggccctgcactccatgatgaagcagaaagagagattcgctgcactcgcaaagtttaagagctctatctataggatcctgatagccacggatgtggcttcccgcggactcgatatcccgacggtgcaggtggtgatcaaccataataccccaggtctgcccaaaatctatatccaccgtgttggccggaccgcgagagcagggcgacaggggcaggccatcactttggtgacacagtacgatatccatctcgtgcatgccatagaggagcagataaaaaagaagctagaagagttctccgtggaggaggccgaagtgcttcagatccttacccaagtgaatgtcgttcggcgggaatgcgagattaagttagaagccgcccacttcgatgaaaaaaaagagatcaacaagcgcaagcagctgatcttagagggaaaggatcccgatctcgaagccaaacggaaagccgaactcgccaaaatcaagcagaagaaccgccgtttcaaagaaaaagttgaggagacgctgaaacgtcagaaagccgggcgcgccggacataaagggaggccaccacgaactccttcaggcagtcacagcggaccagtacctagtcagggcctggtatag

SEQ ID NO: 46706 - DNA, 765 bp, Artificial Sequence
  Description of Artificial Sequence: Synthetic coding sequence
atggacatggtggcccaggccctggagctgagccggaagccccacgtagttatagccaccccaggacgcttggcggatcatctgcgctcgagcaacacattctctattaagaagattcgattcctggtcatggatgaagcagaccgtttgctcgaacagggatgtactgactttactgtcgaccttgaggctatactcgccgccgtgcctgcacgacgccagacgttgttgttctccgccacgctgactgacacactgcgcgaattgcagggacttgctaccaaccaaccatttttttgggaggcccaggccccagttagcaccgtggaacaactcgaccaaaggtatctgttagtgcctgagaaagtgaaggatgcatatttagttcacctcatccaacgatttcaggacgaacatgaagattggtcaatcatcattttcaccaacacatgtaagacttgccaaatcctgtgtatgatgttacggaaattctcgttcccaactgtggcccttcacagcatgatgaaacagaaagagcggttcgcggcgctggctaaatttaagagcagcatatatcgaattcttatcgctaccgacgtcgcctccaggggagccgaccagcctcccctcccgccaggcgcctggacctcgcttagatatcggtggagcagcaccacgaccccgcctggaagcccccgtagtactagtaccgagtcagcaggaagaccggtgcaaggcggccgggtgaggccgtctcgttggtag

SEQ ID NO: 46707 - DNA, 1803 bp, Artificial Sequence
  Description of Artificial Sequence: Synthetic coding sequence
atggagcacgtgaccgagggcagctgggagagcctgcccgtgcccctacacccccaggtgctgggcgcgctcagagagttgggcttcccatatatgaccccagtccaatctgcgaccatacccttgttcatgcggaacaaggacgtggccgctgaagccgttacaggcagtggaaaaaccttggcattcgtcattcctatcctggagatacttctgaggagggaggaaaaattaaagaaaagccaggtcggggcgattatcataacccctacaagagaattggcaatacagatagacgaggttctgtcacactttaccaaacacttccccgaattcagccagatcctatggatcggcggtaggaaccccggcgaagatgttgagagattcaagcagcagggaggcaatattatcgtcgcaaccccaggtaggctcgaggacatgtttagacggaaggctgagggactggacctcgccagttgcgtgcgatccttggacgttctggtgctggatgaagctgacaggctcttagatatgggtttcgaggctagtatcaatacgattctcgagtttttaccgaaacagaggcggaccgggttgtttagcgccacacaaacccaggaagttgagaacctggtccgcgcgggattgagaaatcctgtacgagtcagcgtgaaggaaaagggcgttgctgcttcttcagcgcagaaaactccgtcaaggctcgagaattattatatggtctgtaaggcagatgaaaagttcaaccagttggtccactttctaagaaaccacaagcaagagaagcacttagtgtttttcagcacctgtgcctgtgttgagtactacgggaaggccttagaagtgcttgtgaaaggcgttaagatcatgtgtatccacgggaagatgaaatacaagaggaacaaaatttttatggagtttaggaaactgcagtccgggatcttggtgtgcacggacgtgatggctcgcgggatcgacatccccgaggtgaattgggtgctacagtatgaccccccgtccaatgcctccgcctttgttcatcgctgcggcaggacagcccggatcgggcacggcggcagcgcattggtgttcctgctccccatggaggagagctacatcaactttctggccattaatcagaagtgtcctctccaggaaatgaaaccccagaggaacactgccgacctgctgcctaagctgaagagtatggcacttgctgatcgcgctgtgtttgagaagggaatgaaggcttttgtgtcttatgtacaggcatacgccaaacacgagtgtaacctcatctttcgcctgaaggacctggattttgcatcgctggcgcgcggatttgcccttctccggatgccaaagatgccagagctacggggcaagcaatttcccgactttgttcctgttgatgttaataccgacaccatccctttcaaggataagattagagaaaagcagaggcagaagctcctggagcaacagcggcgcgaaaagacggaaaacgagggccgccgtaagtttatcaaaaataaagcttggagcaaacagaaggccaaaaaggagaaaaagaagaagatgaacgagaagagaaaaagggaggaaggcagcgatattgaagatgaggatatggaggagcttctcaacgacacgcgtttactgaagaagctcaaaaagggtaagatcacagaagaagaatttgagaagggtctactaaccacgggcaaacgaaccatcaaaacagttgatttgggcattagtgatctcgaagacgattgttag

SEQ ID NO: 46708 - DNA, 1062 bp, Artificial Sequence
  Description of Artificial Sequence: Synthetic coding sequence
atggagcacgtgaccgagggcagctgggagagcctgcccgtgcccctgcatccacaagtattgggggcactgcgggagttagggttcccgtatatgactcctgtgcagtccgccacgatccctctttttatgagaaataaagacgtggccgccgaggccgttaccggatcagggaagacacttgccttcgtcattcctatcctggaaattctcttgagaagagaagaaaaacttaagaaatcccaggttggggcgattatcataacgccgactcgggagctggccatccagatcgacgaggtcctgagccacttcactaagcattttccagagttcagtcaaatcctgtggatcgggggaaggaaccccggggaggatgtggaaagatttaaacagcaggggggcaatatcatcgtcgcaactcctggaagattggaagatatgtttagaagaaaggctgaaggccttgatctcgcatcctgcgttcgctctcttgacgtattagttctggacgaggctgacaggctgctggatatggggtttgaagccagtataaacacgatcctggagtttctcccgaagcagcggcggactggcttgttttctgcgacgcagacccaggaggtggaaaatctcgtgcgggctgggctgcgcaatcccgtcagggtcagtgtaaaggagaaaggagtcgctgcatccagcgcccaaaaaactccaagccgcctcgaaaactactatatggtgtgcaaggcagacgaaaaatttaatcagctggtgcactttctgcgaaaccacaagcaggaaaagcatctggtgtttttcagcacatgcgcgtgtgtggagtactacggaaaagctctggaggttctggtcaaaggcgtaaagattatgtgtattcacggcaagatgaagtataagagaaataagatctttatggaattccggaaactgcagagcggcatcctcgtctgtacagatgttatggcccgcggcattgacattccagaggtgaattgggttttacagtatgatcctccctctaatgctgtgctcccttgctag

SEQ ID NO: 46709 - DNA, 1860 bp, Artificial Sequence
  Description of Artificial Sequence: Synthetic coding sequence
atgttcgtgccccggagcctgaagatcaagcggaacgccaacgacgatggtaaatcatgtgtcgctaaaatcattaaaccagatccagaggacctccagctcgataagtctagggatgttcctgtcgatgctgtcgccaccgaggcagcgaccatagatcgacacatcagtgagtcttgccccttccccagccctggcggccagctagccgaggtgcattccgtaagtccagagcagggtgcaaaagattcacacccaagtgaggaaccggtgaaaagcttttccaaaacccagcgctgggcagaaccaggggagcccatctgcgtggtgtgcggaaggtacggggagtacatctgtgataaaactgatgaagacgtctgcagtctggagtgtaaggccaagcacctgctccaggttaaggagaaagaggagaagagtaagttgtctaatcctcagaaagctgatagcgagccagagagtcccttgaatgcatcctacgtctataaagagcacccttttatcctcaacctccaggaagaccagattgagaacctcaagcagcagttggggattctcgttcagggccaggaggtcaccagacctatcatcgactttgagcactgctccctgcctgaagtgctgaatcataatctcaagaaatctggctacgaggtgcctaccccgatccaaatgcagatgatacctgttgggctcttgggacgcgacatcctcgcaagcgccgacacagggtcaggcaagactgccgccttcctgctccctgtgatcatgagagccctatttgaaagcaagactccgtctgccttgattttgacgcctaccagagagctggctatacagatagagcggcaggccaaggaactgatgtccggcctcccgcgtatgaagaccgtgctcctggtgggcggtttaccattaccacctcaactgtaccggctgcagcagcacgttaaagtcatcatcgctacacccgggcgacttctggatatcataaagcaatcatctgtcgagttgtgcggagtcaagattgtggtggttgatgaagccgatactatgctgaagatggggtttcagcagcaagtcctggatatccttgagaatattccaaatgactgtcagaccattttggtgtctgctacaatcccgacctctatagagcagctggcctcccagctcctgcataaccccgtgcgcattattactggcgaaaagaatctgccatgtgcaaatgtgaggcagatcatcctttgggtggaggacccagctaagaagaaaaaattatttgaaatcctgaacgataaaaaactgtttaagccacccgtgctggtctttgtcgattgcaaactcggcgccgacctgctgtcagaggctgtgcagaaaattactggcctgaagtcaatctccatccatagtgagaagtcacagattgaaaggaagaacatccttaaaggtttgctagaaggagattacgaggttgtggtttcaactggggtgctgggtagaggcttagatctgatttctgtgcgcttagtggtcaactttgacatgccctccagcatggacgagtatgtacaccaaatcggtagggtaggacgcctgggacagaatggcactgcaattacctttattaacaacaatagcaagaggctgttctgggacatcgccaaacgggttaaacccaccgggagcatcctgccccctcagctgctcaacagtccatacctgcatgaccagaagcgaaaggagcagcaaaaagataaacagacacagaacgatctggttaccggggctaatctcatggacattatcaggaagcacgataagtcaaactcacagaagtag

SEQ ID NO: 46710 - DNA, 618 bp, Artificial Sequence
  Description of Artificial Sequence: Synthetic coding sequence
atgaagaccgtgctgctggtgggcggcctgcccctgcccccccagttgtatcgcctgcagcagcacgttaaagacaagaaacttttcaagccccctgtgcttgtgttcgtggactgcaagttaggcgccgaccttttgtcggaggctgttcaaaaaattacaggccttaagtccatttctatacactcagagaaaagtcagattgaacgcaaaaacatactcaagggcctgctggaaggtgattacgaagtagtcgtctccaccggcgtgcttggcaggggactggatctgatcagcgtccgactggtggtaaacttcgatatgccatcaagtatggatgaatacgtgcatcagatcggtagagtgggaagactgggccagaacgggacggctataacatttatcaacaataactccaaaagacttttctgggacatcgccaaacgagtgaaacctacagggagtattctgcctccccagctccttaacagtccgtacctccacgatcagaagagaaaggagcagcagaaagacaagcagacacagaacgatctggtcacaggcgccaacctgatggacataattagaaagcatgataagtccaactcgcagaaatag

SEQ ID NO: 46711 - DNA, 1704 bp, Artificial Sequence
  Description of Artificial Sequence: Synthetic coding sequence
atgttcgtgccccggagcctgaagatcaagcggaacgccaacgacgacggtaaatcctgtgtggctaaaatcatcaaacctgaccccgaggacctgcagctcgacaagagccgggatgttcctgtcgatgcggtggctaccgaagccgccaccattgatcgccatattagtgagtcctgcccttttccatctcccggcgggcagctggccgaagtccactctgtgtcacctgagcaaggtgccaaggactctcatccatccgaggaacctgtgaagagcttttctaagacgcagcggtgggccgagcctggcgagcctatctgcgtcgtctgtggaaggtacggcgagtacatttgtgacaagaccgatgaggacgtgtgctcactcgagtgtaaagccaagcatcttctgcaggtgaaggagaaagaagagaagagcaaactgtcaaatccacagaaggcagattcagaacccgaaagccctctgaatgccagctacgtgtacaaagaacatcctttcatcctgaacctacaagaggaccaaatcgagaacttaaagcagcaacttgggatactggtgcaggggcaggaagtgactaggcccataattgatttcgaacactgttccctgccagaagttctgaatcacaatctgaagaagagtggatatgaggtccccacccccattcagatgcagatgattccagtgggactattggggagggacatcctcgcaagcgccgataccggatctgggaagaccgccgctttcctgctcccagtgattatgcgggctctcttcgagagcaaaaccccttctgctctgattcttactcccaccagggagctggcaatccagattgagaggcaggccaaggagctgatgtccggactaccccggatgaaaacagtgctccttgtgggcgggctccctctgccaccccagctgtatcgtctacagcaacacgtgaaggttatcatagccactccagggaggctgttagatataataaaacagagcagcgtggagttgtgcggtgtgaagatcgtggtggtagacgaggctgacaccatgctgaaaatggggtttcaacagcaggtgcttgacatcctggagaatatccctaatgattgtcagacaattttagtatccgccacgatacctaccagtatcgagcagcttgcctcgcaactgctccacaaccccgttcggattattactggggaaaagaatctgccctgtgccaatgtgaggcagatcattctgtgggtagaagaccccgccaaaaaaaaaaaactgtttgaaattcttaatgataagaagcttttcaagccgccagtgctggtttttgtggattgtaaactgggggccgatttgcttagcgaagcagtacagaagatcacagggctgaagagtatcagtattcactctgagaagagccagattgagcgcaaaaacatcttaaagggcttgcttgagggagattacgaagtggtggtttccactggcgtgctcggccgcggattggacctaatctctgtgcgtctggtggtgaatttcgacatgccttcgtccatggacgagtacgtgcaccaactcaacatcatctgggtcgtgcccttttccggcatcaacataaacgcttctctaattgccctgttgtattcactgctgacaaccataaatatgaaattcacaccctag

SEQ ID NO: 46712 - DNA, 486 bp, Artificial Sequence
  Description of Artificial Sequence: Synthetic coding sequence
atgttcgtgccccggagcctgaagatcaagcggaacgccaacgacgatggtaaaagttgtgtggctaagatcatcaagcccgatccagaggaccttcagcttgataagagccgtgacgtgccagtggacgccgtggccacagaggcagctacaattgatcgacatatttccgaaagctgcccatttccttcccctggcgggcagctcgcagaagttcactcagtgtctcccgagcaaggggctaaggattctcacccatccgaggagcctgtgaagtctttttcaaagacacaacggtgggccgagccaggggaacccatttgcgtggtttgcggccgttacggtgaatacatttgcgataaaacagatgaggacgtctgttcgctggaatgtaaagccaaacacctgctccaggtgaaagaaaaagaggagaagagtaagctgagcaatccccagaaggccgactccgaacctgagtcaccctag

SEQ ID NO: 46713 - DNA, 1743 bp, Artificial Sequence
  Description of Artificial Sequence: Synthetic coding sequence
atgttcgtgccccggagcctgaagatcaagcggaacgccaacgacgacggcaaaagttgtgtcgcaaagatcattaagccagatccggaggatctacagctggataagtcgcgcgatgtcccagtggacgcagtggctacagaagcggccacaatagatagacacatctctgagagctgcccattccctagtccagggggccagttggccgaggtccacagcgtttcacctgaacagggggctaaggactcccacccctcagaggagcccgtgaaatcctttagcaagacccagagatgggcagaacctggcgaacccatttgcgtggtttgcggcagatatggggaatatatctgcgacaagactgatgaggatgtgtgctcgctggagtgcaaggccaaacatttgttgcaggtgaaagagaaggaggagaagtctaaattatccaatcctcagaaggcagactctgagcccgagagtccgctgaatgcttcttatgtatataaggagcaccctttcattcttaatctgcaggaggatcagatagaaaacctgaagcagcagctcggtatattggtgcaagggcaggaggtcacacgccctatcatcgacttcgagcattgttctcttcccgaggttctgaaccacaacctgaagaagtctggttacgaggtgcccacacccatacagatgcagatgatcccggtgggactgctgggtcgggatattctggctagcgcagataccggatcaggcaaaaccgcagccttcctgctgccagtcatcatgcgcgctctgtttgaaagtaagactccatcagcactaatcctgacacctactagagaacttgccatccaaatcgaacggcaagctaaagaactgatgtccggccttccaaggatgaaaacagtgctgctcgtagggggtcttccgttgccaccacagttatatcggctacagcaacatgtgaaagtaataatcgcaaccccgggccggctgctggatatcataaaacaaagttcagtcgaactttgcggtgtcaagattgtcgtggttgatgaggccgacactatgcttaaaatggggttccagcagcaggttcttgacatccttgaaaacatcccaaacgattgtcagacaattcttgtttccgcaaccatccctacatcgattgagcagctggcttctcagctgctgcataatcctgtgcgaatcatcactggagagaaaaatctaccatgtgccaatgttcgacaaatcatcctatgggtggaggatccagccaagaagaaaaagttattcgaaattctcaacgataagaaactgtttaaaccaccggtgttggtcttcgtggactgtaagctgggagccgatttgctctccgaagccgtgcaaaagatcacgggccttaaatcaatcagcattcattctgaaaagtcgcaaatcgaaagaaagaatatcctcaagggattgctggagggggactacgaggttgtggtgtctactggtgtgctaggccggggcttggatctcatttcagttaggcttgtcgtgaacttcgatatgcccagctccatggatgaatatgtgcaccaggagaacacctacaagtccacctggagaaacccacaacactttcaacaggacgttagaatgacgctcggctacgtgggcaaggcgcagtgggaagaagacaaccaactcaaggtgaaactgggacttaagaagaactgctcaagctag

SEQ ID NO: 46714 - DNA, 5121 bp, Artificial Sequence
  Description of Artificial Sequence: Synthetic coding sequence
atgggcagcaaggaccacgccgtgttcttccgggagatgacccagctgatattgaatgaaatgcccaaggcgggctactcaagtattctgaacgattttgtcgaaagtaatttttttgttattgatggagattccttgctggtcacctgtctgggggtgaaaagttttaagtggggacagaatcttcactttttctacttggtcgaatgttatctggtggatctcctttctaacggagggcaatttactatcgttttttttaaggacgccgaatatgcctactttgacttccctgagctgctgtcgctgagaacagctctcattttgcacctgcagcacaatacaaacatcgatgtgcaaacagagttctcaggttgtctgagccaggactggaaattatttctggagcagcattacccgtacttcctcatcgtctctgaagaaggtctgtcagacctgcagacttacttgtttaacttcctcatcattcacagctggggcatgaaggtgaatgtcgtcctgtcctccggccacgagagtgacaccctccggttttatgcctacaccatggagtctaccgacagaaatcagactttctcgaaggaaaatgagacagtgattcagtcagcttacaagagcctgattcagcacctcgaggagatacgtgtactcgtgctggcaacacactttgagcatttaaaatggaacgatatgatggaagaagcctatcaaaccctgtttttgctccagcacttgtggtctgagggttcggatatacagagggtgctgtgtgtgacctcctgttccctttcactgcgcatgtaccatcgagttttggttcactcgaactgtctaagcctccaagaagtggaagatttttgtcgactcaggtgtctttgtgttgctttccagttgcacctccctttgtcccaacgggcttgttcacgagtaatcacatgtagctggattcgcaattcagattcttttttaaagatgaacaagtggtgcgaatattttatactaagcaatctgaatgtgtttggttgctggaatttaaatttgaaccatgtttcggatctgtatgacgaacaactgttaaaaaacattgcattttactacgagtttgaaagcacccaggaacctcacctgaacctgggcgatagcattaggcgtgattacgaggatctgtggaacgttgtgtcccatttagtgaaggaattcaatgttgggaagtcattcccattgcgaaccactaggcgccactttttaagacaggagaagagtgtgattcaggagatctctctggagaagatgccatcagtggggttcatccccatgactagtgcggtgatagacgagtttgtgggcgacatgatgaaagacctgcctattctcaagtcggacgatcctgtggtcccttcattgttcaagcaaaagacatcagatgaacttctgcattggcatgcccagagactactgagcgatgattacgacagaataaaatgccacgtcgacgagcagtcccgtgaccctcatgtgttagacttcctgaaaaagattcaggactaccagcagttttacggaaaaagcctggagagtatctcaaccaaggtgatcgttacccaaacaacgcgccctaaagaggattcgagtggggcttccggcgagatcctccagaacacaaagccccatcagatcaccaaaaagagtaagaagaaatcattcctgaaagaggatcagaataaggcgcagcagaatgacgacttgctgttctccatcgaggaggagatgaaaaataatctgcattctggtatcaggaaacttgaggactatctcacttcctgcgctagtaactctgtgaaatttggtgtggagatgctggggctcatcgcttgtttcaaggcctggaagaagcattgtcggggggagggaaagatatcaaaggatctttcaatcgcggtgcagatgatgaaaagaatccattcgttactggaacgctaccctgaaatcctggaggcggagcaccaccaatatattgccaagtgcctgaagtacctgggatttaacgatcttgcgaattctctcgaccccactctgatcggcgatgataagaataaaaagaagtattccattgatatcggccccgcccgatttcagctgcaatacatgggtcactatctaatccgcgatgagcgcaaggaccgagacccgagagtacaggatttcattcctaatgcgtggcaacaggagctcttggatgtcgttgataaaaatgaatccgctgtcatagtggcgccgacatcatctgggaagacctatgccagctactattgcatggaaaaggttttgcgagaatcagacgtgggtgtggtggtatatgttgcacctgcaaagagtcttgtggggcaggtggcagcaacggttgagaaccgattcactaaaactctgcccgcgggacgcaccctatgtggcgcatttactagagattactgccataatgttttgaattgccaagtgttaattacagttcctgagtgttttgagatcctcctgttggctccccaccgccaaaaatgggttgagagaatcagatacgttatcttcgatgaggtccattatctcggccgagaagtcggagccaagttttgggagcttctccttgtcataatcaggtgtccctttttagtcctgtctgctacgattaataatcccaacctgctaacgaaatggttgcagtccgttaagcagtactggaaacaggccgataaaatcatggaagagaagtgtatcagcgaaaaacaggccgataaatgtctgaattttttgcaggaccactcgtacaagaaccagtcctacgaggtgcgacttgtgctgtacggcgagcgctataatgatctggaaaaacatatatgttccgtgaagcacgatgacgtatatttcgaccattttcacccctgtgccgcattgacaacagatataatcgagaagtacggatttccccctgacctcacactgaccccacaggaatccatccagctgtatgatacaatggctcaagtctgggagacgtggcctcgcgctcaggagctgtgtccggaggaatttattctttttaagaacaagattgtcattaagaaactcgacgcgcggaaatacgaggagaacctcaaggctgaattgaccaactggatcaagaacggtcaagtgaaaaaggtaaaaagggtgctgaagaacctgtcacccgacagtctatcgagctcaaaggatatggtcaagatgttcccactccttgtggagaagctgagacagatggataaattgccagccatcttcttcttgttcaaaaacgatgatgtgggcaaaagagcaggatcagtgtgcacattcctggagaaaaccgaaacaaagtcgcacccccataccgagtgtcattcctatgtctttgcaatcgatgaagtcctagagaaggttcgaaagactcagaagaggataacgaagaaaaaccctaaaaaggctgaaaaactcgagaggaagaaagtctacagagcggaatacattaatttcctagaaaaccttaaaatcttggagatttctgaggactgcacttacgccgacgtaaaggccctgcacaccgaaatcaccaggaacaaggattccaccctggagcgcgtcctgcccagagtgcggtttactcgccatggtaaggagctcaaagcccttgcccaaagaggtatcggctatcaccattccagcatgtatttcaaggaaaaggagtttgtggagatcttgtttgtcaaaggcctgataagggtagtgacagccaccgaaacactcgcactgggaattcacatgccttgtaagtcagttgtcttcgcgcaggacagcgtgtatcttgatgcccttaattaccgtcagatgtccggacgagctggacggaggggccaggacctcctgggcaacgtctattttttcgacatcccgttgccaaaaattaaaagactcctggcgagttcagttcccgagctgaggggacagtttcctttgtcgatcaccttggtcctcagacttatgctgcttgcaagcaagggggacgaccctgaggacgcaaaggcgaaagtgctgtccgtgctcaagcactccctgctgagcttcaagcggcggcgcgcaatggaaactttaaaactctattttctcttttcactgcaattattgattaaagaagactacctcaacaagaagggcaatcccaagaaattcgctggtctcgctagctacctgcacgggcacgaaccctccaaccttgtctttgtcaactttctgaagcgcggcctatttcacaacctgtgtaagcccgcctggaagggatcacaacagttttcccaggacgtgatggagaaactggtgctagttttggcgaacttattcggccgtaaatacatccctgctaagtttcaaaacgctaatttgagtttctcacaaagcaaggtcatcctggcagaactgcctgaggactttaaagccgccttgtatgaatacaatcttgctgtcatgaaggattttgcaagcttcttacttatagccagcaagtccgttaatatgaagaaagagcaccaactccctttgagcagaattaagttcaccgggaaggagtgcgaagatagccagctggtctcacatctcatgtcctgtaagaagggcagggtcgccatctcccctttcgtctgtctcagtggcaataccgacaacgatctgttgcggcccgaaacaatcaatcaggttattctgcgtaccgtgggcgtgagcggcacccaggctcccctgctctggccctggaagttagacaatcggggaagaaggatgcctctcaatgcgtacgtactgaacttctacaaacataattgtcttaccagactggatcaaaagaacggcatgcgtatggggcagttacttaaatgtctaaaagacttcgctttcaacattcaggcgatctccgactctctgtcagaactgtgtgaaaacaaacgcgataacgtcgtgcttgccttcaagcagttgtctcagactttctatgagaagcttcaggaaatgcaaatccaaatgagccaaaaccatctcgaatag

SEQ ID NO: 46715 - DNA, 378 bp, Artificial Sequence
  Description of Artificial Sequence: Synthetic coding sequence
atgggcagcaaggaccacgccgtgttcttccgggagatgacccagctgatcttaaacgagatgccgaaagccggctatagttctattctgaacgattttgttgagtccaattttttcgtaattgatggggattccctcctggttacatgtctgggcgtgaaatcgtttaagtgggggcaaaatctgcactttttctacttagtggagtgttatttagtcgacctcctgtccaatgggggtcagtttactattgtgtttttcaaagacgccgagtatgcttacttcgactttcccgagctgctttccctgcgcaccgctctgatcctacacctgcaacataacaccaatatagacgtccagacagaattctctggatag

SEQ ID NO: 46716 - DNA, 3927 bp, Artificial Sequence
  Description of Artificial Sequence: Synthetic coding sequence
atgggcagcaaggaccacgccgtgttcttccgggagatgacccagttaattctcaatgagatgcccaaagctggatattcatctatcctcaatgattttgtggaaagtaacttttttgtcattgacggcgattcacttcttgtgacctgcctgggcgtgaaatcgtttaagtggggacagaatcttcactttttctatttagtggagtgttacctcgttgacctattaagcaacggaggccagttcactatcgtattcttcaaagatgccgagtatgcgtatttcgactttcctgaacttctttctcttaggaccgctcttattctgcacctccagcataatacaaatatcgatgtccagaccgaattttctgggtgtctctcgcaggactggaaactgttcctcgagcaacactacccttatttcctgatagtgtcggaagaaggactttccgacctccaaacgtatttatttaattttctaattatccatagctggggcatgaaagttaacgtggtgctcagttcaggccacgagtccgataccctcagattttacgcttacaccatggagtccacggatcggaaccagaccttctccaaggagaatgagacagtcattcaaagtgcctataaatccctgatccagcatctcgaggaaatacgggtgctggttctggctactcatttcgagcacctgaaatggaacgatatgatggaggaggcctatcagacactattcctactacagcacctgtggtctgagggctctgacatccagagagtgctgtgcgtgacaagctgttctctctctttgcgaatgtaccatcgggtgctcgtgcactccaattgtctgtctcttcaggaagtagaagacttctgtaggctcagatgcctgtgtgtggctttccagctgcacctcccgttgtcacagagggcctgttctcgggttatcacatgttcatggattaggaattctgattctttcctcaaaatgaataagtggtgcgagtacttcatcctgtccaacctaaacgtgttcggatgctggaaccttaatctcaatcacgtctctgacctctatgatgagcagctactaaagaatatcgccttttactatgaattcgagagcacccaagagccacacttgaacctgggtgattccatcagacgtgattacgaggatctgtggaatgtggtctctcacctggtaaaggaattcaacgtgggcaaatcatttccccttagaaccacgagacgccactttttgcggcaagagaagtccgtgattcaggaaattagcctggaaaaaatgccctccgtgggctttatccccatgacttcagcagtaatcgacgaatttgtgggagatatgatgaaggatcttcctatcctcaaatcagacgacccagtggttcctagcctgtttaagcagaaaacttctgatgagctcttacactggcatgcacagcggctcctgtccgacgactacgacaggattaagtgccacgtggacgagcagtccagggatccacatgtgttagatttcctgaagaaaattcaggattatcagcaattctatggcaaatccctcgagtccatttctaccaaagtgattgtgactcagactacccgacccaaagaggattcttccggggcaagcggggagatactccaaaataccaagccccaccagatcaccaagaaaagcaagaagaaaagcttcctgaaagaagatcagaacaaggcccagcaaaatgacgacctgctcttcagcatcgaagaggagatgaagaacaacctgcactctgggatcagaaagttagaagactatttgacatcctgcgcgtccaactccgtgaagtttggagtggaaatgcttggccttatagcgtgctttaaggcctggaaaaaacactgccggggtgaaggaaagatctccaaggatctatccattgccgtgcaaatgatgaaaaggatccacagccttcttgagcgttatcctgagattttagaagccgagcaccaccagtatatcgcaaaatgcctgaagtatttaggattcaatgacctcgctaattcgctggaccccacgctcattggcgatgataagaacaaaaagaagtattctattgacatcggcccagctaggtttcagcttcagtatatggggcactatcttatccgcgacgaacgcaaggatcgcgatcctcgcgtccaagattttattcccaatgcctggcagcaggagcttctggatgtagtggacaaaaatgaatcagcagtcattgttgccccaacctcgagcgggaagacgtatgcctcatactattgtatggagaaagtgctgcgagagtcagacgtgggcgttgtggtgtatgtggctccagccaaaagtttggtcggtcaggtggcggccacggttgagaaccggttcacaaagacgctccccgcaggaagaacactttgtggtgccttcactcgggattactgccataatgtactaaactgtcaggtcttgatcaccgtgcctgaatgtttcgagattctgctgcttgcaccccacaggcaaaagtgggtggagcgcatacggtacgttatttttgatgaggttcattatctgggtcgcgaggtaggagccaagttttgggagcttcttctggtgattattaggtgcccctttctggtcctctctgccaccatcaacaaccctaatctcctcacaaagtggttgcagtcagttaagcagtattggaaacaggcggacaagattatggaggagaaatgcattagtgaaaaacaagccgacaagtgcctgaacttcctgcaggaccactcatataagaatcagtcttacgaagtgcgcctcgtgctgtatggcgagagatacaatgatctagagaaacacatctgctctgttaagcacgacgacgtttactttgaccattttcacccatgtgcagcactcacaacggatatcattgagaaatacggatttccgcccgatcttactctcacaccccaagaaagcattcagctgtacgacaccatggcccaggtgtgggagacctggccaagggcccaggagctctgccctgaggagtttatactattcaaaaacaagattgtgataaagaagctggatgcccggaagtacgaggaaaatctgaaggccgaactgaccaactggataaagaatggacaggtcaagaaggtgaagagagtactgaagaatctgagccctgactccttgagtagttctaaagatatggtgaagatgtttccactgctggtggagaagctgcgacagatggataaactgcctgcgattttctttctttttaagaacgatgacgtgggtaagcgggccggctctgtatgtaccttcctggagaagaccgagacaaaaagccacccacataccgagtgccattcctacgtcttcgctattgacgaggtgctggaaaaggtgcgcaagacccaaaagcggatctccaccaaaaagaaccccaagaaggccgaaaagctggaaaggaagaaagtgtaccgcgccgaatatattaattttctcgaaaacctcaagatactagagatctcagaggattgtacctatgccgatgtcaaggcccttcacacagagataaccagaaacaaggacagcactctggagcgagtactgcccagagtcagatttacgcgacacggcaaggaattgaaggcgctcgcccagaggggcataggctaccaccacagctctatgtacttcaaagaaaaagagttcgtggagatcctatttgtcaagggtctcataagggtggtgacagccactgagacgctggctctgggcatccatatgccttgcaaatcagtcgtgttcgcccaagattccgtatatctggacgctctgaattatcgccaaattatgtag

SEQ ID NO: 46717 - DNA, 5121 bp, Artificial Sequence
  Description of Artificial Sequence: Synthetic coding sequence
atgggcagcaaggaccacgccgtgttcttccgggagatgacccagcttatactgaatgaaatgcctaaagcaggttacagttctattctgaacgacttcgtcgaatccaatttctttgtgatcgatggcgactctcttctggtgacctgcttgggggtgaaatctttcaagtgggggcagaatctgcactttttctacctggtggagtgttacctggttgacctgctgagcaatggtggccagttcactattgtctttttcaaagatgctgaatatgcttactttgacttcccagagctgctctcattgcgaactgccctaatcctccatcttcagcacaacacaaatatcgatgtgcagacagaattctcagggtgcttatcacaagattggaaactgtttttggagcagcattatccctacttcctcattgtgtctgaggagggactgagtgatctccagacttatcttttcaatttcttaataattcatagttggggtatgaaagtgaatgtcgtcctgtcctctggccacgaatctgatactctgcgcttctatgcctatactatggaatcaaccgatcgaaaccagaccttctctaaggaaaacgagaccgtgatccagtctgcctacaagagccttatacagcacctggaagagatcagggtcttagtcctggctacacacttcgagcacctgaaatggaatgacatgatggaagaggcctatcagacattgtttctactgcagcacttgtggtccgaagggtcagatatccagagggtgctctgcgttactagttgttccctctccctgcgaatgtaccatcgggttcttgtgcatagcaattgtctgtctctgcaagaagtagaggacttctgccggttgagatgcctatgtgtagctttccagctgcatctgcccctgtcacaaagggcatgttcacgagtgattacttgttcctggatacggaatagtgactccttcctgaagatgaacaagtggtgcgaatatttcattttgtctaacttaaacgttttcggctgctggaacctcaatcttaatcatgtctctgacttatatgacgagcagctacttaaaaacattgccttctattacgagttcgagagtacacaggaacctcacctcaacctcggggattccattcggcgagactatgaggacctatggaatgtcgtgagccatttggtgaaggaatttaatgtcggtaaaagtttccctctgcggactacccgaagacatttcctgaggcaggaaaaatcagtgatccaggagatctctctggaaaagatgccaagcgtcgggttcatccctatgacctctgcagttattgatgagtttgtaggggacatgatgaaagatctaccgatccttaagtctgatgatccagtcgtacccagtctgttcaagcagaagacatccgatgagctgcttcattggcacgctcagagattactatcagatgattatgatagaattaaatgtcatgtggacgagcagagtagagatccgcatgtcctggattttcttaagaaaatccaagattaccaacagttctacggcaaaagccttgagtcaatatcgactaaggtgatcgtcacccaaactacgcgcccaaaggaggattccagcggggcgtcaggcgagattcttcaaaatacaaagccgcatcagattaccaagaagtcaaaaaagaaaagctttttgaaagaggaccagaacaaagctcagcagaacgacgacctgttgtttagtattgaagaggagatgaaaaacaatctacacagcggtattcggaagctggaggactacttaaccagttgcgccagcaatagtgtcaagttcggtgtcgagatgctgggcctgattgcttgctttaaggcatggaagaagcactgtagaggcgagggcaagatcagcaaggatctgtccattgctgtgcaaatgatgaaaagaatccacagcctgttggaaaggtacccggaaattctggaagccgaacaccatcagtacatcgccaaatgtctgaaatacctcggatttaacgacctggcgaactcactggatcccaccctgattggcgacgacaagaataaaaagaaatacagtatagatattggcccggcgcgatttcagctccaatatatgggccattatctgattcgcgatgaaaggaaggatcgggacccccgggttcaggattttatccccaacgcctggcaacaagaactgttggatgttgtcgacaagaacgaatccgcagtgatcgtggcccccacgtcctccggtaagacttatgctagttactactgcatggaaaaagtgctcagagagagcgatgtaggggttgtggtctacgtagcgcccgcaaaaagtttagtgggtcaagtcgctgctaccgtggaaaacaggttcactaaaaccctccccgccgggcggaccctctgtggcgcttttactagggattattgtcacaacgttcttaattgtcaggtcctcattacagtgccagagtgttttgaaatactgctcctagcgccccaccgtcagaagtgggtcgaacgaatccggtacgtaatttttgacgaggttcactatctggggagggaagtcggtgctaagttctgggaactgctcctcgtcatcatccgctgcccttttttggtcctaagcgcaactattaacaaccccaacttgctgacgaaatggctccagagcgttaagcagtactggaagcaggccgacaagatcatggaagagaaatgtatctctgagaagcaggccgacaagtgcctgaacttcctgcaggatcacagctacaaaaaccaaagttacgaggtaagactggtcctctatggcgaaagatacaatgatcttgagaaacatatctgctccgtgaaacatgatgacgtgtatttcgaccattttcacccctgcgccgctctgaccaccgatattattgagaagtacggcttcccacctgatctgacactgaccccccaagagtcgatccaactgtatgatactatggcgcaggtctgggagacgtggccacgagctcaggagttgtgtcccgaggagtttattttgtttaaaaataagatagtgatcaaaaaactcgacgcacggaaatatgaagagaacctgaaagctgaattgaccaactggatcaaaaacgggcaggttaaaaaggttaagcgggtgcttaagaacctcagcccagacagccttagttcttcaaaagatatggtcaaaatgtttccactgcttgtggagaaactccgccagatggacaagctccccgctattttctttctcttcaaaaacgatgacgtgggtaaacgggcgggctccgtgtgtaccttcctggagaaaacagagactaaatctcacccgcataccgaatgccactcctatgtgttcgctatcgatgaggtgcttgagaaggtacgcaagacccagaaaagaattacaaaaaagaaccccaagaaagctgagaaactggagcgtaagaaggtatatcgagccgaatacataaacttcctcgagaatttgaagatccttgaaatctctgaagattgcacatacgccgatgtgaaggctttgcatacagaaatcaccagaaataaggattcaacgctggaacgagtcctgcctcgagtgcgttttacacggcacggcaaagaactaaaagccctcgcacagcgaggaataggttaccaccactcatctatgtatttcaaggagaaagagtttgttgaaattctctttgtcaaaggcctgatcagagtggttacggccactgagacactggccctgggcatccacatgccctgcaaaagtgttgtcttcgcccaagattccgtgtaccttgatgccttgaactacagacagatgtctgggcgagccgggagacggggccaggatctcctgggtaacgtctatttttttgacatccccctcccaaagataaagcgcctgttggcctcgagtgtcccagagctccgaggccagttccccttgagcataacactggttctgcgcctgatgctgctcgcttccaaaggggatgatcctgaggacgctaaggcaaaggtgctctcggttttgaaacatagtcttctgtcttttaaaaggcgtagagcaatggagactttaaagctatactttcttttctcattgcagctactcataaaggaagactacctaaacaaaaagggcaaccctaaaaaatttgcaggactcgcaagctaccttcacgggcatgagcccagcaaccttgtgtttgtcaactttctgaagcgtggactgtttcataacctgtgcaaaccagcctggaagggctcccagcagttctcacaggacgttatggagaagctggtacttgtgctggccaacctgtttgggaggaaatacattccagccaaattccagaatgccaatttgagtttttcacagagcaaagtcatattggctgagctaccagaggacttcaaggcagcactctacgaatacaacctggccgtgatgaaggattttgcctcattcttactaatagcctctaagagcgtgaacatgaagaaagaacatcagctcccacttagtcgtattaaatttacaggaaaggagtgtgaggactcacaactagtgtcacacctaatgtcgtgtaagaaaggtagggtggcaatttctccatttgtgtgcctgagtggaaatactgacaacgatctgctaaggccagagaccataaatcaggtgattttacgcaccgttggggtctccgggacacaggccccactgctgtggccatggaagctggataataggggtcgacgcatgcctctcaacgcttatgtcttgaacttctataaacataattgcctgactcgcctggatcagaagaatggcatgaggatggggcagctgctgaaatgcctgaaagacttcgcgttcaatattcaagccatctctgactccctgagcgagctctgcgaaaacaagagggacaacgttgtattggccttcaagcaactgagtcaaacattctacgagaaactgcaggaaatgcaaattcaaatgagtcaaaatcacttagaatag

SEQ ID NO: 46718 - DNA, 234 bp, Artificial Sequence
  Description of Artificial Sequence: Synthetic coding sequence
atgggcagcaaggaccacgccgtgttcttccgggagatgacccagctcattttaaacgagatgcccaaggccggatactcaagcatcctcaatgactttgttgagtctaactttttcgtgatcgacggcgacagtctgctggttacgtgtcttggagttaagagcttcaagtgggggcagaacttgcatttcttttatcttgtggagtgctatctggtcgatctgttatcatag

SEQ ID NO: 46719 - DNA, 297 bp, Artificial Sequence
  Description of Artificial Sequence: Synthetic coding sequence
atgggcagcaaggaccacgccgtgttcttccgggagatgacccagcttatattgaacgaaatgcccaaagccggttactcaagcattctcaatgatttcgtcgagagcaacttcttcgtgattgatggagacagtctgctggtgacctgtcttggtgtaaagtccttcaaatggggacagaacctacatttcttctaccttgtggagtgttacctcgtcgatctactctccaacggaggccagttcacaatagtgttcttcaaagatgctgagtatgcgtattttgatttcccttag

SEQ ID NO: 46720 - DNA, 2586 bp, Artificial Sequence
  Description of Artificial Sequence: Synthetic coding sequence
atgcccatcctgctgttcctgatcgacaccagcgccagcatgaaccaacggacggatctaggcacatcctacctcgacatagctaagggcgccgtagagctgtttctgaaattaagggctcgcgatccggcctccagaggagacaggtacatgttggtcacatatgatgagcctccatactgcataaaagctggctggaaagaaaaccacgcgacatttatgtcagagctaaagaatctacaagcatctggcctaacgactctaggccaagctctccgttctagcttcgacttacttaacctgaatcggctgatctcgggaatagataactacggacagggtcggaaccccttcttcctggagcccagcatcttaataaccataacagacggaaataagcttaccagcacagctggcgtgcaggaggagttgcatctgcctctgaatagcccactacctgggagtgagctcacgaaagagcccttccgatgggaccagagactgtttgcacttgtgctccgcttgcctggcgtggccagcactgagcctgaacagcttggttctgttcctactgacgagagcgccattacccagatgtgcgaggtgaccggtggccgcagctactgtgttcgcacccagcgtatgctcaaccagtgtctagaaagtttggtgcagaaagtacagagtggagtggttatcaacttcgaaaaaacaggacccgacccactccccatcggggaagacgggctaatggactcctccagacccagcaattcttttgctgcgcagccatggcattcctgccacaagctgatatatgtgcgtccaaattcaaagactggagtaccagttggccattggccaatacccgaatctttctggcccgaccagaatctcccaagcctcccgcctcgtacctctcaccctgtcgtgcggttcagctgcgtggattgcgagcccatggtgatagataagcttccatttgacaagtatgagttggagcctagccctctgactcagtacattctggaaagaaaaagcccccacacctgctggcaggtgttcgttacctcaagcgggaagtacaacgagctgggctatccctttggttacctgaaagcaagtacgacactaacctgcgtaaacctattcgttatgccctacaattaccccgtcctgcttcctttattagatgacttgtttaaagtgcacaagctgaagccgaacctaaagtggcggcaagcatttgacagctatctgaagaccctccccccttactacctgttgaccaaactggagagtgaacggatcctggcatccgtgggcaagaagcctccacaggaaattggaattaaggtcaagaatcattcagggggcggcatgagtctgactcacaacaagaatttccggaagcttcttaaggaaattacaggggaaacagccctgagactcaccgaattgaacactaaagaatttgctgggttccagattggactgctcaacaaagacctaaaaccacagacctatagaaatgcatatgacatacctcggcgaggtcttttggaccaactgacgagaatgaggagtaatctcttaaagactcacaagttcatagtcggccaggacgaggacagcctgcattctgtacccgtcgcccaaatgggtaactatcaagaatatttgaaaaccctggcttctcccctcagagagattgacccagaccagccgaaaaggctccatacattcggcaacccttttaagcaggataagaagggcatgatgatcgacgaggccgacgagtttgtggctggcccccaaaataaagtaaagagaccaggagagccaaactcccctatgagttcgaaaagacgaagaagcatgtccttgctcttgagaaaaccccagaccccaccaactgttacaaaccatgtcggcgggaagggccccccatctgcctcttggtttcctagctaccctaacctgataaagcccacgttagtccacactgatgccaccatcatccatgacgggcacgaggaaaagatggaaaacggtcaaattaccccagatggattcttgtcaaaatccgccccctctgaactcataaacatgacaggggacctaatgcctccaaatcaggttgactcactgtcagatgatttcacttccctcagtaaggatgggctcattcagaagcccggcagcaacgcgttcgtcggaggggccaagaactgtagtctgtcagtcgacgaccagaaggatcctgttgccagcacccttggcgcaatgcccaacaccctgcagatcaccccggcaatggcgcaggggattaatgccgacataaagcaccaattgatgaaggaggtccgaaagttcggacggaaatacgaacgcattttcattctcctcgaagaggtccagggaccactggaaatgaagaagcagttcgtcgagttcactattaaggaagccgctcgatttaagagacgagtcttaattcagtacctagaaaaagtgctggagaagattaactcacatcatctacacaataacatctcgcacatcaatagtaggtcttcctgttag

SEQ ID NO: 46721 - DNA, 4161 bp, Artificial Sequence
  Description of Artificial Sequence: Synthetic coding sequence
atgagcagcagcgtgcggcggaagggcaagcccggcaagggcggcggtaagggaagctccagaggaggtcgaggggggcgcagccacgcgtccaagagccacgggtccggggggggtggcggaggaggggggggaggaggtggtggcaataggaaagcctcatctaggatttgggacgatggcgatgacttttgcattttcagcgaaagtcgcagacctagtaggccatctaactcgaatatatccaaaggagagtcgcggccgaaatggaagccaaaggcgaaggtgccccttcaaaccctgcatatgaccagcgagaatcaggaaaaggtgaaagcactgctgcgggacctccaagagcaggacgctgacgcaggaagcgaacgagggttgtctggggaggaagaagacgacgaaccagattgttgcaacgacgagaggtattggcctgctggacaggaaccatccctagttccagacctggatccactggagtacgccggtctggcctctgtggagccctacgtgcccgagtttaccgtcagtccctttgctgtccagaagctgagccgctacggattcaacactgaacgctgccaggccgttctcagaatgtgtgacggagacgtcggggcaagcctagagcacttgttgactcaatgcttctccgagacctttggcgaacggatgaagatctctgaggccgtgaaccagatctcactggacgaatgcatggagcagaggcaggaagaggcattcgctcttaagtcaatttgtggagagaagtttattgaaagaatccaaaatcgagtctggaccattggactggagctagagtacctcactagtcggtttcgcaagtcaaagccaaaagaatcaacaaagaatgtgcaagagaactcgctggagatctgtaaattttacctcaagggtaactgtaaattcggcagcaaatgcagatttaagcacgaggtgccccctaaccagatcgtaggccgtatcgagcgctccgtggatgattctcacctgaatgccatagaagacgcatccttcctgtacgagctcgaaatcagatttagcaaggaccataaatatccgtaccaagcaccattagtggccttctacagcactaacgaaaatctgccactcgcctgccggctgcacatctccgagtttctgtatgacaaggccctgacattcgcagaaacctcggaacctgtcgtctacagcttgattaccctgctggaagaagagtccgagattgtgaaattattgactaatacgcaccacaaatacagtgacccacccgtgaattttctgccagtccctagcaggacccggatcaacaaccctgcttgccataaaaccgtaatcccaaataacagtttcgtctctaaccagatccccgaggtggagaaagcatctgagagcgaggagtctgacgaggatgacggtccagcgcccgtgatcgtggagaatgagtcctacgtgaacttaaagaagaagatcagtaagagatatgattggcaggccaagtcagtccacgcagaaaacggcaaaatttgcaagcaatttcggatgaaacaggcctcccggcaattccagtctatcctgcaggaaagacaatcactaccagcctgggaggagcgagagactattctaaatctactgaggaaacatcaggtagtagtgatttctggcatgacaggttgtggaaagacaactcagatcccacagttcatccttgatgacagcctgaacggtcccccggagaaagtggccaatatcatatgcacacagccccggcggatttccgccatttcagtcgccgaacgcgtggcgaaggagagggccgaaagggtagggctaacggtgggttatcagatcaggttggaatctgtaaagtcctcggcaacacgcctgctctactgtaccaccggcgtgttactgcgccgtctcgagggcgatactgctctccagggagtgagccatataatcgtcgatgaagtgcacgaaaggacggaggagtccgacttcttgctcctcgtcctgaaagacatcgtgagccagagacctggcctgcaggtgattctcatgtctgccaccctcaacgccgagcttttcagcgattacttcaattcctgcccagttattaccatccctggtcgtaccttccctgtcgaccaattcttcctggaggacgccattgctgtcacacgttacgtgttacaggatggatctccctacatgaggtccatgaaacagattagcaaagagaagctgaaggcacgccggaatcggacagcgttcgaagaagtggaggaagatttgagactgagcttacacctgcaggaccaagattctgtgaaggatgctgtgcctgaccagcagctggactttaaacagctccttgctaggtataagggtgtgtcaaaatccgtcattaaaactatgagtatcatggatttcgagaaggttaacctggagctcatcgaggccttgctagagtggatcgtcgatggcaaacattcatatccaccaggggcaattttggtgttccttcccggtctggcggagataaagatgctctatgagcagctacagtctaacagtctgttcaataaccgccgttcaaataggtgcgtcatccacccactgcattctagcctatccagcgaggagcagcaggctgtgttcgtgaagcccccggcaggggtgacaaagatcatcattagtaccaacattgcagagacctccatcacgatagatgatgttgtctacgtgatcgacagtggcaaaatgaaggagaagcgctatgacgcatccaaagggatggagtcactggaagatacttttgtgagtcaggctaacgcactccagcgaaaaggccgcgccggtagggtggcgagcggcgtgtgtttccatctgttcaccagccatcactataaccaccagctgcttaagcagcagctcccagaaatacagcgggtgcctctggagcagttgtgccttcgaataaagatcctcgagatgtttagcgcccataacctacagtctgtgttctctcgcctcattgaaccgcctcacaccgacagcctaagggcctccaaaatccggttgagagacctgggcgccctgactcctgacgaaagactgactccactggggtatcacttggccagtctgccagtagatgtgcgcatcgggaaactcatgctgttcggctcaattttccgatgtttggacccggcactgacaattgctgcttccctcgctttcaagagcccctttgtttctccatgggataaaaaagaggaggcaaaccagaagaaactggaattcgctttcgccaattctgactatctggcgctgctccaggcttataaaggttggcaactcagtaccaaggagggtgtacgagcctcttacaactattgcaggcagaattttttatccgggagggtgctgcaggagatggcatccttgaaacgacagttcacggagcttcttagcgatattggcttcgcacgagagggcctgcgagcgcgggagatagagaaaagagcacagggaggcgacggtgtcctcgatgctacaggagaggaggccaacagcaacgcagagaacccgaaacttatctcagctatgctgtgcgcagctctctaccctaatgtggtgcaggttaaatccccggaggggaaatttcaaaaaaccagtacgggtgccgtgcggatgcagccaaagagcgccgagttgaaattcgtgaccaagaacgatgggtatgtgcacatacacccctcttcagttaattaccaggtccgccacttcgatagcccttatctcttatatcacgaaaagattaaaactagcagagtgtttatccgtgactgcagtatggtctccgtgtaccctcttgtgctttttgggggcgggcaagttaatgttcagcttcagcgtggtgagttcgtggtttccctcgacgacggttggatccgcttcgtggcagctagccatcaagtggccgaactggtgaaggaattacggtgtgaactcgatcagctactccaggacaagatcaagaacccttccattgacctgtgcacctgcccccgtggaagccgtataatcagtacaatcgtcaaacttgtcaccacccaatag

SEQ ID NO: 46722 - DNA, 1302 bp, Artificial Sequence
  Description of Artificial Sequence: Synthetic coding sequence
atgaccagcgagaaccaggagaaggtgaaggccctgctgcgggacctccaggagcaggacgccgacgctggtagcgagcgggggctctctggtgaggaagaggacgatgaacccgactgttgtaacgacgagaggtactggcccgccggccaagagcctagcctagtaccagatctcgacccactggaatatgcgggtctagcatccgtggagccatacgttccagaatttactgtcagcccctttgctgtgcaaaaactttcccggtatgggttcaacactgagcgttgccaagcagttctgagaatgtgcgatggagacgttggagcatccttagagcatctgttaacccagtgctttagcgagacattcggcgagcgcatgaagatcagtgaagcagtgaaccaaattagcctggacgaatgcatggagcagaggcaggaggaggcgtttgcccttaagtccatatgtggcgaaaaatttatagagaggattcaaaaccgagtctggactatcgggcttgaactggagtatctcacgagtcgcttcaggaagtccaaaccaaaagagagtaccaaaaatgtgcaggaaaacagcctggagatttgcaagttctacctcaaagggaactgcaagtttggatccaagtgtcgctttaaacatgaagtgccgccaaatcagatcgtgggcagaatcgaaagaagtgtagatgactcccacttgaatgcgattgaagacgctagttttttatacgaactggaaatacgattttcgaaggatcacaagtatccttaccaggcccccctggtggccttctactccactaatgaaaatcttccacttgcgtgccgcctgcacatcagcgagtttttgtatgacaaggccctgacgtttgctgaaacctctgaaccagtggtgtacagtctgatcaccctgctagaggaagaatcggaaattgtaaagctgctcacaaacacccaccacaaatatagcgatcctcctgtgaacttccttcccgtaccgagcaggacgcggataaacaatcctgcgtgtcacaagaccgtgatccccaacaattctttcgtcagcaaccagattcccgaagtggaaaaggcgtcagagagcgaggaatctgatgaggatgatggcccggccccagttatagtcgagaatgagagctacgtcaacctaaaaaaaaagatcagcaaaagatatgactggcaagccaaatctgtgcacgctgagaacggcaagatctgcaagcagtttcgtatgaagcagatactgcagtcccacctgtag

SEQ ID NO: 46723 - DNA, 1731 bp, Artificial Sequence
  Description of Artificial Sequence: Synthetic coding sequence
atgccccccccccggacccgggagggccgggaccggcgggaccaccacagagctccgtccgaggaggaggcactggagaaatgggactggaattgtcctgaaactaggcgccttctggaagatgccttctttagagaggaggactatattcgacagggaagcgaggagtgccagaaattctggacctttttcgaacgccttcagcgcttccaaaacctgaagacttctaggaaagaagagaaagacccaggccaacccaaacactcaattccagctctcgctgacctgcctaggacgtacgatcccagatatcgtattaatttgtctgtgctcggccctgctacccgcggttcccaaggacttggccgccacctgcctgccgagcgggttgctgaattccgtagagcactgttgcattacctggactttgggcagaaacaggccttcggaaggttggccaaacttcagcgcgagcgcgcggcactgcccatcgctcagtacggcaatcggatccttcagactctgaaggagcaccaggttgtcgtcgtggcgggagatacaggatgtggaaaaagcacccaggtgcctcagtaccttctcgccgccgggttcagtcacgttgcgtgcactcaacctaggagaatcgcatgtatctctttagcaaagagggtgggcttcgaatctctctcacagtacggcagtcaggtcggctaccagatcagatttgaatcaacccgcagtgcagccaccaagattgttttcctcacagtggggctgctcctgcggcaaatccagcgggaaccatcccttcctcaatatgaagttttgattgtggacgaggtccatgaaagacacttgcataacgattttctgttgggtgtgcttcagcggctcctgccaactcgtcctgaccttaaggtgatcctgatgtcagctaccataaacatttccttgttcagcagttacttttctaacgcacccgtggtacaggttcctgggagattgttcccgatcacagtatttgacgtcgctccgcctggagtccggaaatgcattttgagtacaaatattgccgagacatcagttaccattgatgggatcaggtttgtcgtggatagtggcaaggtgaaggagatgagctatgatccgcaggccaaactccagcggctgcaggagttctggataagtcaggcttccgctgaacagaggaagggcagagccgggcgcaccggaccaggtgtctgcttcaggctgtacgccgagtcagactatgacgcatttgctccctatcccgtccctgagatccgccgagtggcgctggacagcttggtgctccagatgaaaagtatgtccgtgggggatcctagaacattccctttcatagagccccctccacccgccagcttggagacagcaattttgtacttaagagatcagggggctctggatagctcggaggcgctgaccccgatcggatccctccttgctcagcttcccgtcgacgtggtcattgggaagatgttgatcttgggctctatgttctcgctggttgaacctgtgctgacgatagccgctgcccttagtgttcagtctccattcactcggtcggcgcagagctcccccgagtgctgtacccctcccgccagtagcctggcggcacctcgctgctgtacccaccgttcatggaggcctgctacggcaactgaagcagagaccactcgcactcgctag

SEQ ID NO: 46724 - DNA, 3432 bp, Artificial Sequence
  Description of Artificial Sequence: Synthetic coding sequence
atgccccccccccggacccgggagggccgggaccggcgggaccaccatagagccccatccgaggaagaggcacttgaaaaatgggattggaattgcccagaaactcgtcggctgctggaagatgctttttttcgagaggaagattacatcagacaaggcagtgaggagtgtcaaaagttttggaccttctttgagaggctccagcgcttccagaatttgaagacgtcccgtaaggaggaaaaagatcccggtcagcccaagcactctatcccggcacttgccgacctgcctagaacatatgacccaagataccgcatcaatttatccgtgctgggtccggccacaaggggttctcagggcctgggacgccatttgcctgccgagcgggtggctgaattcaggcgcgccctgctgcattacctggacttcggtcagaaacaggcatttgggcgtctggccaaactgcaacgggaacgcgccgcgttacctattgctcagtacgggaatagaatcctgcagacacttaaggagcatcaggtagtagttgtcgctggggacaccgggtgcgggaaaagcacacaggtgccacagtacttgctggcagctgggttttcccacgtggcatgcacccaacctcgccgtatcgcttgcatatccctggctaaacgcgtgggtttcgaaagtctaagccaatacggaagccaggtcggataccagatccgctttgagtccactcgttcagctgctacgaaaatcgtgtttttaacagtgggattgctgctaaggcagatccagagggagccctcactgccacagtacgaagttctgattgtggacgaggttcatgagcggcacctccacaacgactttttgctcggggtgttgcaaaggctgcttccaacacgccctgacctgaaagtgattctgatgagcgcaactatcaatattagtctgttcagttcctacttttctaatgcccccgtggttcaggttcccgggcggctcttccccataacggtcgtctaccagcctcaagaagcggaacccactacctcaaagagcgaaaagctggatcccagaccattcttgcgtgtgctggaatcaatcgatcataagtaccctcccgaggagcgtggcgatctattagtctttcttagtggaatggctgaaatttcagcggtcttggaggcggcccaaacatatgcctcccacacccagagatgggtcgttttgcctttgcactccgcccttagtgttgccgatcaagacaaagtctttgacgtggcccccccgggcgtgcgaaaatgtattctgtccacgaacattgccgagacttcggtgacgatcgacggaatccgtttcgtcgtggattccgggaaggtcaaggagatgagctatgatccccaggccaagctgcaacggcttcaggagttctggatttcccaggcttccgctgagcaacgcaaaggtagagccgggcgaacagggcccggcgtctgtttccgcttgtatgcagaaagtgactacgatgcgtttgccccatacccggtgcctgagattcgccgcgttgccttggattcactagtgcttcagatgaagtctatgtctgtgggcgatccgagaacgtttccctttatcgaaccgccccctccggctagcctggagacggctattttgtacctgagggaccagggcgcattagacagctctgaggccctgacaccaatcggtagcctgcttgcacagctgcccgttgatgtggtgattggaaagatgctgatcctgggatctatgttctcactggtcgagcccgtgctgacaatcgcggccgccctcagtgtccagagcccttttaccagatccgctcaatctagccccgagtgtgctgccgcaagaagacctctagagagtgatcagggcgatccatttacactgtttaacgtattcaatgcttgggtgcaggttaagagcgagcggagtcgtaattctcggaagtggtgtaggaggagggggattgaggaacaccgcttgtatgagatggcaaacttgcgccgccagtttaaggaactgttagaggatcacgggttgctggcaggggcacaggcggcccaggttggagactcatactcccgtctgcagcagcgccgcgagagacgggccctgcaccagctcaaacgccagcatgaagagggggccggacgacgaagaaaagtgctgcggctgcaggaggaacaggatgggggctcaagtgatgaagatagagctggcccagcaccaccaggtgcgtcagatggcgttgacatacaagacgtcaagttcaagctgaggcatgaccttgcccagctgcaggctgcagcttccagcgcccaggatttgtctagagagcagctggcgctcttaaagctggtactgggtcgggggttgtacccccaactggcagtgcctgacgcctttaacagtagtcgaaaagacagcgaccaaatcttccacacacaagcaaaacagggcgctgtgttgcacccaacctgtgtgtttgccggcagccccgaggtgctgcacgcacaggaactagaagcgtccaactgtgacggctcacgggatgacaaagataaaatgagctcaaagcaccagctcctgtcgttcgttagtttgctagagaccaataaaccatacctggtgaactgcgtgaggatccccgctctgcagagcctactcctttttagtcgaagtctggacacaaacggcgactgcagccggctagtggccgatggatggctggaactccagctggcagattccgaatcagcaattagactgttggctgcttcactgagactcagggctcggtgggagagcgcccttgaccgccaactcgcccaccaagcacagcagcagctcgaggaggaagaggaagacacaccagtaagtcccaaagaagtcgctactctgagcaaagaactcctgcagttcacggcttctaagataccgtattctctgcgccggctcaccggcttggaagtccagaacatgtacgtaggcccccagaccattccggccacgccacacctgcctggattgttcggctcttcaacgttatctccacaccctactaaaggaggttacgctgtgaccgacttccttacctataactgtctaaccaacgacactgacttgtactctgattgtctacgaacattctggacctgtccgcattgtggactgcacgccccactgacccctttagaaaggattgcccatgagaatacatgtccccaggcaccgcaggacggccctccgggtgctgaggaggccgctctggaaaccctccagaaaacatcagttctgcagagaccatatcactgcgaggcatgtggcaaagattttttatttaccccaactgaggtgctcaggcatcgcaaacagcacgtgtag

SEQ ID NO: 46725 - DNA, 3474 bp, Artificial Sequence
  Description of Artificial Sequence: Synthetic coding sequence
atgggcaagctgcggcggcggtacaacatcaagggccggcagcaggcggggcctggaccatctaagggaccaccggagcctcctcccgttcagctcgagctggaagataaggacaccttgaaaggtgtagatgcttcaaacgctctggtattgcctggaaaaaagaaaaagaagactaaagccccaccactgtccaagaaggagaaaaaaccactgaccaagaaggagaaaaaagtcctccagaagattctggaacagaaggagaagaaatcccaacgggctgaaatgctacaaaagctgagcgaagtgcaggcaagcgaagcagaaatgcgcctgttctatacaaccagcaaattgggcaccggcaaccgtatgtatcacactaaggagaaagccgatgaggtagtggcccccggacaggaaaagatttcatccctcagcggcgcccacagaaagcgaagacgatggccttcggccgaagaggaggaagaggaggaggaggagtctgagagtgaactggaggaggagagcgagttagatgaagatccggccgcagagcccgccgaagcgggcgtgggaaccactgtggccccactccccccagcgccagctccctcaagccagccagttccagccggtatgacagtgccccctcctcccgcggcggctccccctctgcccagggctttggctaagccagccgttttcatcccggtgaaccgatcaccagagatgcaggaggagaggctgaaactgcctatcctctcagaggagcaggtgataatggaggccgtggcagaacatccaattgtcattgtgtgtggagagacaggctcagggaaaaccacccaggtgcctcaattcctgtatgaagcaggcttctccagtgaagacagcattattggtgtcaccgagccaagaagagtcgccgcagtggccatgagccaacgggtcgcaaaagagatgaacctgagtcagcgagtcgtttcttaccagattagatatgagggcaatgtaacggaggaaactaggattaagttcatgactgatggcgtgctcctcaaagagattcagaaggacttcctactgctgagatacaaggttgtgatcatcgacgaggcccacgaacgctccgtctacaccgacatcctgatcggactgctcagccgcattgtgacactgagggccaaaagaaatttaccactgaaacttttaataatgagtgcgacactccgggtggaggactttacccaaaacccccggctctttgcgaaaccccctccagtcattaaggtggagagtcggcagtttcctgtgacagtccactttaataaacgcactccactggaggattacagcggggaatgtttcagaaaagtgtgtaaaatccatcgaatgctgccagcgggcggtattctggtctttcttacagggcaagctgaagtgcacgcgctctgtagacggctgcgcaaggcgttcccgcccagcagggccagaccacaggagaaggatgacgaccaaaaggactctgtagaggaaatgagaaaattcaaaaaatcccgagctagggccaaaaaagcccgggccgaggtcctccctcagattaatttagaccactactcagttcttcctgctggggaaggtgatgaggatcgggaggcggaggtagacgaagaagagggagcgttggacagcgatctggacctggatttgggagatggaggacaggatgggggtgaacagcccgatgcctcacttccactgcacgtgttacccctctactcccttctggcccccgagaagcaggcccaggtgttcaagcctccccctgagggaaccagactttgcgtggttgcaaccaacgttgctgagacctcactaaccatccctggaatcaagtacgttgttgactgtggcaaagtcaaaaagcggtactatgatcgggtcactggtgtatcttcttttcgggtgacttgggtgtctcaagcctcagcagaccagagagccggaagagcgggcagaacagaaccgggtcattgctaccgcctctactcatcggccgtattcggcgattttgagcagtttcccccgccagaaattacccggcgcccagttgaagatttaatcctgcagatgaaggccctgaatgtggagaaggtgattaattttccctttcccactcccccgtctgtggaagccctgctggctgccgaagaattattgatcgccctcggggccctacagcctccgcagaaagcagaacgcgtaaagcagttgcaggagaatagattatcttgtccaatcaccgccctgggcagaaccatggcgactttcccagtggcccccagatacgcaaagatgctggctctgtcgaggcaacatggctgcctcccgtacgccatcactattgtggcttccatgactgtaagggaactgttcgaagagttggataggccagccgcctctgacgaggagctgacccgacttaaaagtaaaagagcacgcgtggcgcaaatgaaaagaacttgggcaggccaaggtgcatccttgaagctcggcgatttgatggttctattgggggcagtgggcgcatgtgagtatgcttcctgcacaccccagttttgcgaagccaacggactgcgttacaaagcaatgatggagatccgccgcctgcggggacaactgacaacagccgtgaacgctgtctgtcccgaggccgaattgttcgtggatcctaagatgcagcccccaaccgaatcccaagtgacatatctaagacaaatagttaccgctgggctcggggaccacttggcacggagggttcagagcgaagagatgctcgaggacaaatggcgtaacgcctataaaacaccattgcttgacgatccagtctttatccaccccagctcagttcttttcaaagaattgccagaattcgttgtgtatcaagaaatcgttgaaacgactaaaatgtatatgaagggggttagcagcgtcgaggttcaatggattcctgctctgcttccctcttactgtcagtttgataagcccctggaggaaccggctcctacgtactgcccagaaaggggccgggtcctgtgccatcgggctagtgtgttttacagggtgggttggcccctgcccgccatagaagtggattttcccgagggcatagaccgctacaagcacttcgctagatttctgctggaaggacaggtttttagaaagctggcctcttataggtcttgcctcctcagcagtcctggcacgatgcttaaaacttgggccagactccagcccaggacggagtccctgttgcgtgcgttggtagccgagaaggctgactgtcacgaggctctgttagctgcctggaagaaaaaccccaagtacctgcttgccgagtactgcgaatggcttcctcaagccatgcatcccgatattgagaaggcctggccccccacaaccgttcactag

SEQ ID NO: 46726 - DNA, 1851 bp, Artificial Sequence
  Description of Artificial Sequence: Synthetic coding sequence
atgtgcctggagaagcggtacctggacgtgctgagcgacgtgaccggacctcaggtgagctgttacatcaccgcaccttcatacgttttacaacaactggaatgccgcattattaatcacatgtcatccctcatcgttggtgacaatgaagagctggtgtccaacgtaatcacaattgaatgctcagataaggagaagcgcgttcccttcccaatcggtatcgctatcccttttactgccaggtacagaggcaattatcgggatattatggtaaaggtctgtgacatcaacttgcaaagctcctacttgaaccccaacagtttggaaggcatgaagggaggatacaaaggcacctgcgcaagtgtgaaggtctacaagctgggtatattctcagtagtgtcctgccttaagaaggaaagcttcactgtgaccaaaaagggcctggcgctgaaatcatccatggattccagaatttcgcttaattatcctcctggtgtgtttacaagcccagttttggttcagcttaaaatacagcccgtggatcccgctctcgtggcccaccttaaagcacaacaagacactttttattccgtgcagagcactagcccactcatccacattcagcatccgagtacttatccatttcagaagcctgtgacgctttttctcccatgttctccctacctcgacaaaaataaccttggctcggagattgaccacaagcgccgcgcgagcgcaaccataaaccgtattaccccttcctacttcaaccgcacaaaaatcgctagcatcaggaagccacggaagaacgcttccgaatgcctgaaattattaggctttcgcagtcaagactcaggatggtgtggactggacgatgtggtgaagactatccagtctggcctggtgagtgtggagctgtacgagcacctcgaaagattcatcgtgttacatttaagtagtactatggataatagtcatctggtgacctttgttaagagcttggaggaagctatgctctctactacagcttgcattgtactgtcccatcagaaagataatcctcataggattgccgtgctcgttgttccaagtaaagacctgtcgcaggtgcttaaagatcttcatttggagggttttggcggcccccctgaacccagtaggcattttcaggtccgagagggcgagcagctactgcttagattcactggtaacatttttgcttcctcaaacggcaaggattatgggaaggattatactctgatattccacctgcagaggaaacctagattggaacttcagataaaggaagtcgacgagttcgggaactattcgtgcccacactacaaggggactatagttgtgtacaaagtccccaaaggtaagatcgtgccgaacctcaatcagtcactagtgataaacgagaatcatagtcagttgccaatttgcaaactccccctaaaactacctaaacataagaaattaataaatcggccgcagtcgacaaaacgagtttccaaggacccagttgaggcgctatgggacaatttgttgcactggctcgccgaggaactgtctgaggagaacgctgaatccctgtcctcgacattgcctcttcgacgcagtacgatccagctgattaagcttaaaaacccagatgatttgacagagcaaatccacgagttcctatgcttttggaaaaaatcgcttcccaccttcaccgacaaactcagattgctggctcggcatctgaggaagataggcaggagcgacctcgccgaggaactaaagtttaaatgggaaaacaaggtgtttacagaaccccaacagtgttttgacgtcgctcctgagtag

SEQ ID NO: 46727 - DNA, 2346 bp, Artificial Sequence
  Description of Artificial Sequence: Synthetic coding sequence
atgcacgacgagtgcaccccccagcagaccatgagcagcatccaggacaccaaagccgccgatattgccgcccggggtgaactcaacgtgatcgagaccgcaaccgtgagccctaccaacggcgaggaaagccattataccaaccaggtccagttagaaaagaacaaaactcatatgtcttctgcacttgtcgagaaggagaataacacaagtctgaatggtcgggtcctagggcaagaggagagccaaaacaagatgttcccagataacgccgaaaatgaagacgataagcagattgagcacatgaccgtcgaaaatatcaacggaaacagggaggagacacacggcattatccaaaccacagagacagagattcaggaaacctctgaatcacctcgggaagaaatgaccacctcaagcattatctgcgatatctctaagaaatatattaattccacattgcccaatgactcagaaaatattaaacataagaacaatattatggaaaaggagtatctggatgttctgagcgatgtcaccggaccacaagtgtcttgctacattaccgccccctcctatgtgttgcagcagctggagtgtcgcattattaaccacatgagctcgctgattgtgggcgacaacgaggagctcgtgtcaaatgttataacaatcgagtgttcggataaagaaaaacgggtaccgttccccatcggtatcgcgattccattcaccgcgagatacagaggaaattacagagatatcatggtcaaggtttgtgacataaatctccagagcagttacctgaaccctaacagtctcgagggcatgaagggcggatacaaaggaacgtgcgcttcagtgaaagtttacaaactggggatcttctccgtagtgagctgcctgaaaaaggaaagcttcacggtgacaaaaaaaggacttgctctcaagagcagcatggactctaggattagcttaaactacccccctggagtgttcacaagccctgtgctcgtccagctcaaaatccagcccgttgaccctgcactggtcgctcatctgaaggcccagcaggacacattctattcagtccaaagtaccagcccgctgattcacatccagcatccatcaacctatcccttccaaaaaccagtgacactgttcctcccatgcagtccatatcttgataagaataaccttggcagcgagatagaccacaaaaggcgtgccagcgccactataaaccgcatcacccccagctattttaatcgtaccaagattgcaagcattcgtaaaccacgcaagaacgcctctgagtgtctgaagctcctggggttcagatcccaggactccggctggtgcggtctcgatgatgtagtgaaaacgattcaatcaggactggtgtccgttgaactttacgaacatctcgagcggttcattgtactccacctgagttccaccatggacaactcccaccttgtgacttttgtgaaaagcctagaagaagctatgctgagcaccaccgcttgtattgttctctcacaccagaaagataacccacatcgaatagctgtcttagtcgttccctccaaagatctgagccaagtcttgaaggatctgcatctagaagggtttggaggaccacccgaaccatccagacatttccaagtgagggaaggagagcagctgctcctgcgcttcaccgggaacatttttgcttctagcaatggtaaagactacgggaaggactacactctgattttccacttgcagagaaaacctcggctggagctgcagataaaggaagtggacgaattcggtaactattcctgcccacactataaaggaacaatcgtcgtgtacaaggtgcctaaggggaaaatcgtgccaaatctgaatcagtccctagtgattaatgagaaccatagtcagctgcccatctgcaagctccccctgaagcttcctaaacacaagaagctgatcaatcggcctcagagtaccaaacgagttagcaaagaccctgtcgaagccctgtgggataacctcctgcattggttagcggaggaactcagcgaggaaaatgcggagtcactgtccagcacgctaccgcttcgccgtagcaccattcagctgatcaagctgaagaatccagacgatctgaccgagcagatccatgagttcctctgtttttggaaaaaatctctgccgacattcaccgacaaactaaggctcctggcccggcatttgcggaagataggccgctctgacctcgccgaagagctgaagttcaagtgggagaataaggtctttacggaaccgcaacaatgcttcgatgtcgcaccagaatag

SEQ ID NO: 46728 - DNA, 6390 bp, Artificial Sequence
  Description of Artificial Sequence: Synthetic coding sequence
atggccgagcggcgggccttcgcccagaagatcagccggaccgtggccgcagaggtgcggaagcagattagcgggcagtacagcgggagtccacagttacttaaaaacctcaatatcgtgggcaatatatcacaccatacaacagttccacttactgaggcggttgaccccgttgacctggaggattacctgatcacccaccctctggccgtggattctgggccacttcgggacctcatagaatttccacccgacgatattgaagttgtgtacagtccaagagattgccgcaccctggtgtcagccgtgcccgaggagagtgagatggatccccacgtgagggattgcatccgctcctacaccgaggattgggccatagtcatccgcaagtaccacaaacttggcacaggctttaaccctaacactttggataagcaaaaggagcgccaaaagggcctgccaaagcaggtcttcgagtcagacgaggctccagacggcaatagctatcaggacgatcaggacgatcttaagcgccggagtatgagtattgatgacacccctagggggtcatgggcttgctccattttcgatctgaagaatagtttgcccgatgcattgctacctaacctacttgataggacccctaatgaagaaattgatcgtcaaaatgatgatcagaggaagtcgaatagacacaaggagctgtttgccctccacccttcgccagacgaggaggagccgattgagcgcctcagtgtccccgatatcccaaaagaacacttcggccagaggctgcttgtgaaatgcttgtcccttaaatttgaaatagaaatcgaacccatttttgcaagtctcgctctgtacgatgttaaagagaaaaagaagatcagtgagaatttttatttcgacctgaatagcgagcagatgaaaggtctgctgcggccccatgtacctccagcagctatcaccactttggccaggtcagcaatatttagtattacttatccttcgcaggacgtgttcctggttataaaacttgagaaagtgctccagcagggagatattggtgaatgtgcagaaccctatatgatcttcaaggaggccgacgcgacgaagaacaaggaaaagctggaaaagctgaagagccaggcagaccaattctgtcagcggcttgggaaatatagaatgcctttcgcatggaccgcaatacatctcatgaacattgtgtccagcgccggtagcctggagagagactccaccgaggttgaaatttcaaccggcgaacgaaagggatcctggtcggaacgtaggaattcaagcattgtagggcgtagatctctcgagcgaaccacctctggtgatgatgcctgtaatctcacaagtttccggcctgccaccctgaccgtgaccaacttttttaagcaagagggcgataggttatccgatgaagatctgtacaaatttctggcggacatgagacggcccagttcagtgctgcgtcgcttgcggcctattaccgcacagcttaaaatcgatatctctccggcacctgagaatccccactactgcctcacgcctgagttactccaggtgaaactttatcccgactcgcgagttcggccaacacgagagatccttgagttccctgcacgtgacgtgtacgtgccaaacactacgtacaggaatttattgtacatctacccccaaagtctgaattttgctaaccgccaggggtccgctcgcaatattactgtgaaggttcagttcatgtacggtgaggatccgtctaatgccatgcccgtgatttttggaaagagctcctgctctgagttcagcaaggaagcctacactgcggtcgtctatcataataggtctccggattttcatgaagaaattaaagtgaagctgcccgccaccctgaccgaccatcaccacctgctattcacgttttatcacgtgtcctgccagcagaaacagaatacaccattggaaacgcccgtcggctacacctggattcctatgctgcagaacggccggcttaaaacgggacagttctgtctccccgtctcactagaaaagcctcctcaggcttactctgttttgtcacccgaggtgcctcttcccggcatgaaatgggtagacaatcataaaggcgtcttcaatgttgaggtagtcgccgtcagctcgattcacacacaggacccttatctagataagttttttgccctagtgaatgctctggacgaacaccttttccctgtcagaattggggacatgaggatcatggagaacaacttagagaatgagttgaagtcgtctattagtgcgctgaattctagccagctcgagcccgtggtcagatttttgcatctcctcttggataagcttatcctgctggtgattcgaccccctgttattgctggccagatcgtgaatctggggcaagccagcttcgaggctatggccagcatcattaatcgcctgcacaagaatctggaaggcaatcatgaccagcatggacgaaactccctgctcgcatcatacattcattatgttttcagacttccaaacacctacccaaactccagcagcccaggacctggcggtctggggggctccgtgcactatgcaacaatggcccgctctgcagttcggccagcatcccttaatctgaacaggtcccggtcactctctaactcaaaccctgacattagcggaactcctactagtccagatgacgaagtacggtccattatcggctccaaggggctcgatcgcagcaacagctgggtgaacacgggtggccccaaagctgccccctggggcagcaacccgagccctagcgctgagagtactcaggcaatggatagaagctgcaatagaatgagctcacatactgagacttctagtttcctgcaaactctcactggaagattgccaaccaaaaagctgttccacgaggagctggccctacagtgggtggtttgctcagggtccgtgcgtgaaagtgcactacaacaggcttggttcttctttgaactaatggtgaagtcaatggtccaccatctatactttaacgataagcttgaggccccccggaaatcccgatttcccgaacggttcatggatgacatcgcggctctggtatctactattgcctcggacatagtgtccaggttccagaaggacacagaaatggtagagcgccttaatacttccttggccttctttctgaatgatttgcttagtgtgatggatagaggctttgtctttagcctgattaaatcatgttacaagcaggtcagcagcaaactttatagcctgccaaacccatcagtgctcgtttcccttcgtctcgatttcctacgtatcatttgcagccatgaacactatgtcaccctcaacctgccctgctcgctcctgactccacccgcaagcccctccccaagcgtctcttccgcaacctcccagtcatccggtttcagcaccaacgtacaggatcaaaagattgccaatatgtttgagcttagtgtaccgtttcgacagcagcattatcttgccggacttgtgctgacagagctggcagttattctggacccagatgctgaaggactttttggactccacaaaaaggtcattaatatggtccacaacctactgtcttcgcatgattcagaccctcgctacagcgaccctcagattaaggcccgcgtcgccatgctctacctccctctgatcggcattataatggaaacggtaccccagctgtatgacttcacagagactcacaaccaacgcgggaggcctatttgcatagctacggatgattacgagtccgagtcaggctcaatgatcagccagacggtggcgatggccatcgcggggacttccgttccgcagctgacccgccccgggagctttctactaacttctacaagcggcagacaacacaccaccttctcagcagaatcctctaggtccctgctgatctgtttactctgggtgctcaagaacgccgatgagactgtcttgcagaaatggttcaccgatctgtcggtgctgcaattaaacagactattggatctgttatacctgtgcgtgagctgttttgagtataagggaaagaaagttttcgagagaatgaacagtctaacatttaagaagtctaaggacatgcgggctaagttagaggaagctatcctcgggtcaattggagccaggcaggagatggtgcggcggtctcgcggccagttggaaaggagtcccagtggtagtgcatttggatctcaggaaaacctccgctggagaaaggacatgactcattggcgccagaacactgaaaaactcgacaagtctagggctgaaatcgagcatgaggctctcattgacgggaacctggccaccgaggcgaatctgatcatcttagacacattagagatcgtagtgcagacagtatccgtgactgaaagcaaggaatcaatcctgggcggagtgctaaaagttctgttgcactccatggcctgtaaccagtcggctgtttacttgcagcattgtttcgcgacacaacgtgcattagtttctaagttccctgagcttctgttcgaggaggagaccgaacagtgtgcggatctctgcctaaggcttctccgccattgctcgtcaagcatcggcacgattagatctcacgcgtcagcatcgctgtatctcctcatgcgacagaattttgagattggaaacaattttgcacgggttaaaatgcaggtcactatgtcactctcatctctggtaggtacatcacagaattttaatgaagagttcctccgccggtctctcaaaacgatcctgacatacgctgaggaggacttggaacttagggaaaccacattcccggatcaggtccaggatctggtgtttaacctgcacatgattctatcggatacagtgaagatgaaggagcaccaggaagatcccgaaatgctgatcgacctgatgtataggatcgctaaggggtatcagaccagtcccgatctgcgcctgacgtggttgcagaacatggcaggcaagcactccgagcgatccaaccatgcagaggcggcccagtgcctggtgcactccgccgcattagtggctgagtatctctctatgctcgaagatcgtaagtacctgcccgtgggctgcgtgactttccaaaacatctctagcaatgtcctggaggagtcagcagtgtcagacgatgtcgtgtccccagatgaggagggcatttgctccggcaaatactttacagagtcaggcctagtcggtctcctggagcaggccgctgccagcttcagtatggccggcatgtatgaggccgtcaatgaggtttataaggtgctaatcccaatacacgaagccaatagagacgcaaaaaagctgtctaccatccacggcaaactgcaagaagccttcagtaagatcgtgcaccaggacggtaagagaatgtttgggacctatttcagagttgggttttatggcaccaaattcggtgatttggacgaacaggagttcgtgtacaaggagcctgccatcaccaagctcgccgaaattagccatcgactggaaggattctacggtgaacggtttggtgaggatgtcgtggaagtcatcaaagactcgaaccctgtagataagtgtaagctggatcccaataaggcttatattcaaattacctatgtggaaccttatttcgatacctatgagatgaaagacaggatcacatactttgacaaaaactacaacttgcgacgattcatgtactgcacgcccttcaccttagacggtagggcacacggcgagctacatgagcaattcaagcgtaagacaatattaaccaccagccacgcttttccgtatatcaagaccagggtcaacgtcacccacaaagaggagatcatcctcacacccatcgaagtcgccatcgaggatatgcagaaaaaaacccaggaactggcctttgctacccaccaggatcctgctgatcctaaaatgcttcagatggtgctgcaggggagtgtcggaaccacggtcaaccaggggcctcttgaagtggcccaggtctttctgagcgaaatcccttccgacccgaaactgttccgacaccacaataaactacggctgtgtttcaaagatttcacaaaacgttgtgaggacgcactacgaaaaaataagtcactcattggccccgatcagaaggaatatcagcgagagctggagcggaactaccacaggctgaaagaggcactccaaccccttattaatagaaagatccctcagctttacaaggctgtgttgcctgttacgtgccaccgcgactctttcagccgcatgagcctgagaaagatggatctgtag

SEQ ID NO: 46729 - DNA, 6330 bp, Artificial Sequence
  Description of Artificial Sequence: Synthetic coding sequence
atggccgagcggcgggccttcgcccagaagatcagccggaccgtggccgcagaggtccgtaagcagatctccggacagtactcagggtcacctcagcttcttaaaaatctgaatatcgtcggcaacatctcccatcataccactgttccgctcactgaggccgtggatccagtcgacctggaagactacttgattactcatcctttggctgtggattcaggcccgctaagggacctgatcgagtttccaccagatgatattgaggttgtttattcccctagagattgtaggacgttggtatccgctgtgccagaggaaagcgaaatggatccccacgtcagagattgcattcggtcctacacagaagattgggctattgtaattcgcaagtaccacaaacttgggaccggctttaaccccaatactctcgataaacaaaaagagcggcagaaaggcctcccaaaacaggtgttcgaaagcgacgaggctccagatggcaattcttaccaagacgaccaggatgatctgaagaggagaagcatgtcaatagacgacactcctagaggctcctgggcttgctcaatatttgatctaaaaaacagtttacctgacgccctcctgcctaatcttctggacagaacaccaaatgaggagatcgaccggcaaaatgacgaccagaggaaatccaataggcacaaggaactgtttgcgctacatccttcacccgacgaggaggagccgattgagagactgtccgtcccagatatccccaaggagcacttcgggcagaggctgttggttaaatgtctatccctgaaattcgaaattgagatcgagcccattttcgccagcctggctctctacgacgtgaaggagaagaagaaaatcagtgagaatttctacttcgacctgaacagcgagcagatgaaaggcttacttcgccctcacgtgccccctgctgccattactacattggcccggagtgcgatctttagcatcacatacccctcacaagacgtcttcctggtgattaagcttgagaaggtgctacagcagggtgacatcggtgagtgtgccgagccctacatgattttcaaagaagctgatgcgacaaagaacaaagagaagcttgaaaagctgaagtcccaggccgaccagttctgtcagagattggggaaataccgcatgccgttcgcttggaccgccattcatcttatgaatatcgtatcatcggcaggttccttggagcgtgactcaaccgaagtcgagatctccactggcgagcgcaaagggagctggtctgagagaagaaacagctcaattgtgggcaggcgctccctggaacgtaccaccagtggagatgatgcttgcaacctgacctcctttcgtcctgccaccttaacagtgaccaactttttcaaacaggaaggagaccgtctcagcgacgaggatctgtacaagtttcttgctgacatgcgccggccttcatctgtgctgagaagacttcgcccaattacagcacagttgaagatcgacatctcacctgcacccgagaatccacactattgcctgacgcctgaacttctccaagttaagttgtatccggacagccgggtgagacccacacgggagatccttgagttccctgcacgagatgtgtacgtaccaaatacaacttaccgaaacctgttgtacatttacccccagtcgcttaattttgctaatcggcaaggctctgcacgcaacataaccgttaaggtgcagttcatgtatggagaagacccaagcaacgccatgcccgtcatttttgggaaatcatcatgctcagagttctctaaggaggcttacactgcagtggtatatcataacagatcaccagacttccatgaagagatcaaggtgaagcttcccgccacactgaccgatcaccatcatctcttgttcacattctaccacgtaagttgtcagcagaagcagaacacgcctctcgagactccagttgggtacacgtggataccaatgttgcagaatgggcggctcaaaacagggcagttttgcttgcctgtttcattagaaaagccacctcaagcatatagcgtgctctcccccgaggtgccactgccgggtatgaagtgggtggacaaccataagggagtcttcaatgttgaggtggtggccgtcagctctatccacacccaggatccttacctggataagttctttgctctcgtgaatgcccttgacgaacatttattcccagtccgcatcggagacatgaggattatggagaataacctggagaatgaattaaagtctagcatcagtgccttgaacagcagccagctggagcccgtagttcgatttctccacctcctgcttgataagttgatcctgttagtaatacgcccacccgtgattgccggccagatagtgaatttgggacaggccagctttgaggctatggcctctattattaaccgactgcacaaaaatctggaaggtaatcacgaccagcacggccgcaactcgctgttagcttcttacatccactacgtgtttcgcctgcccaatacatatcccaattctagcagccccgggcctggaggcttggggggctctgtgcactatgcaacaatggcccgctccgctgtacggccggctagtttaaacttgaatagaagccgctcgttgtctaattctaacccagacatatcagggaccccaacatctccggacgatgaagttcgctctatcatagggtctaaagcaatggatcgttcctgtaaccggatgtcaagccatactgaaacctctagctttctgcagacattgacgggccgcctgccaacgaagaaactgttccacgaggagttggcactgcagtgggtagtctgcagtggtagcgtcagggagtccgccctccaacaggcttggtttttctttgaactgatggtcaagtccatggttcaccatctgtacttcaatgataaactggaagctcctcggaagtctcgctttccagagagatttatggacgacatcgctgctctggtgtctaccattgcatctgacattgtgtctcgcttccaaaaagacaccgagatggtcgaacggctgaatacgtcccttgctttcttcctcaacgacctgttgtccgtgatggaccggggctttgtgttctctctgataaagtcatgctacaagcaggtctcctctaagttgtactccttacctaacccatcggtattagtgtccctgaggcttgatttcctgcggataatctgctctcatgaacactatgttaccctgaacctcccttgcagccttctcaccccaccagcttcaccgagcccctccgtgtccagcgcaacgtcacagtcttccggatttagcactaatgtgcaggatcagaagatcgcgaatatgtttgagctcagtgtaccttttcgccagcagcactacctcgccggattggttctcaccgagttagcggtcattcttgatcccgatgccgagggtctcttcggactgcataaaaaggtgattaatatggtacataacttgctgtcctcccatgattcggaccctcgatactccgatccgcagatcaaggcccgcgtggccatgctctacctgcccttaatcggcataatcatggaaaccgttccgcagttgtatgattttaccgagacacacaaccagaggggccggccgatatgcatcgccacggatgattatgaaagcgaatccggttcaatgatcagccagacagtcgcaatggcaatcgcgggaacgtctgtaccccagctgacaagaccaggtagcttcctcctcacctccacaagtggtcgccagcacaccacgttcagcgccgagtcttcaagatctttgctcatatgtttgttgtgggtgctgaagaacgccgatgaaacagtgctgcaaaaatggtttaccgacctcagtgtcctgcagttaaatcgtctgttagatttgctctatctgtgcgtgtcctgctttgagtacaaaggaaagaaggtgtttgagaggatgaactctctcactttcaaaaagagtaaggatatgcgagccaaactggaggaagctatactcggttccataggcgctaggcaggaaatggttcggagatcgcggggacaattagggacttacaccattgccagcccgcctgagcgcagcccctcaggctccgcttttggctcacaagagaacctcaggtggagaaaagacatgactcactggaggcagaatacggagaagctagataagtctcgcgctgaaatcgaacacgaagccctcattgatgggaacctggctacagaggccaacctaatcatactggataccctggaaatcgtagtgcagacggtgtccgtaacagaatccaaggaaagtatcctagggggggtgctaaaggtacttctgcactcaatggcctgtaaccaatcagcggtataccttcagcactgtttcgccacacagcgagccctcgtttctaagttcccggaactgctgtttgaggaggaaacggagcagtgcgcagacctttgtcttcgactgcttcgccactgctccagctcaattgggacaatccgaagtcatgcaagcgcctccttgtacctattaatgcggcagaacttcgaaatcggcaataacttcgcaagggtgaaaatgcaggtgacaatgtctttgtcctccctcgtgggtaccagccagaacttcaatgaagaatttctccgccggtccctcaaaactattctgacatacgccgaagaagatctcgagttgagagaaaccacatttccagatcaggtccaggacctcgtcttcaatctgcacatgatactgtctgatacggttaagatgaaggagcaccaggaggacccagaaatgcttatagacctgatgtataggattgctaaggggtaccagacttctccagatctacgactgacttggcttcaaaacatggccgggaagcactccgaacggtcaaatcacgcagaggccgctcagtgcctcgtgcactctgccgcccttgttgccgagtatctttcaatgctggaagatcgaaaatatcttccagtggggtgcgtcacttttcagaatatcagttctaacgtgttggaggaaagtgcagtctctgatgatgttgtgtcccccgatgaggaaggcatatgtagcggcaaatacttcacagagtctggacttgtgggtttgttagaacaagctgcggcctcctttagtatggcaggtatgtacgaggcagtcaatgaagtctacaaggtcctcatccccatccacgaggccaacagagatgccaaaaagctctcaaccatccacggtaagcttcaagaggcttttagtaaaatcgtgcaccagtccactggttgggagcgaatgtttggcacatatttccgagttggattctacggcactaaattcggtgatcttgatgaacaggaatttgtgtacaaggagcctgccatcaccaaactggcagaaatttcacataggcttgaaggattctacggcgagagatttggcgaggacgttgtcgaggtcataaaggattcgaacccggtcgacaagtgtaaactggaccctaataaggcctatatccaaattacctacgtcgaaccatatttcgatacctatgaaatgaaggatagaataacttacttcgataagaattacaacctccgccggttcatgtattgtacgcccttcaccttagatggcagagcacacggcgaattgcatgaacagttcaagcgcaaaaccattctcacaacatcccacgcgtttccctacataaaaacaagggtcaatgttacacataaagaggaaatcattctcactccaatcgaagtcgccatcgaagacatgcagaaaaaaacgcaagagctcgcatttgccacacaccaggaccctgctgacccaaagatgctgcagatggtactgcaggggtcagtcggtacaacagtaaatcagggaccactcgaagtggctcaggtcttcctgagcgaaattcccagcgatcctaaactgtttcgtcatcacaacaaactgcgtctttgttttaaagacttcacaaaacgttgcgaggacgccctaagaaaaaataaatcccttatcggacccgatcagaaggagtatcagcgggaactggaacgaaactatcaccgcctaaaggaggccctccaacccctcattaacagaaagataccgcagttatataaagccgtgctgcctgttacgtgccaccgggattcattcagtcggatgtcactccgtaagatggacctgtag

SEQ ID NO: 46730 - DNA, 6423 bp, Artificial Sequence
  Description of Artificial Sequence: Synthetic coding sequence
atggccgagcggcgggccttcgcccagaagatcagccggaccgtggccgccgaggtgcggaagcagatttctggccagtattctgggtctccccagcttctgaaaaatctgaatatcgtaggcaatattagtcatcatacaaccgtccctctcacagaggccgtcgacccagtagatttagaggactacctcatcacacatcctctggctgtcgattctggcccactgagagatcttattgagttcccgccagacgatatcgaggtagtatactcacctagggactgcaggactcttgtgtccgccgtgcccgaagagtcggagatggaccctcacgtacgggattgcatcagatcttacacagaggattgggccatcgtgatcagaaagtatcacaaactcggtacaggatttaatccaaacactctagataaacagaaggaacggcagaagggactgccgaagcaggtatttgagagcgacgaagctccagacgggaactcataccaggatgatcaggacgatctgaaaaggaggagtatgtctatcgatgatactcctagaggatcttgggcgtgctcaatctttgacctcaaaaactcactccctgacgcccttcttcccaatcttcttgaccggaccccaaatgaagaaatcgacagacagaatgatgatcagcggaagagcaaccgtcacaaggagctctttgccctccatcctagccctgatgaggaagagccaatcgaaagactatcagtccctgacatccctaaggaacacttcgggcaacgcctgctggtaaaatgtttgagtctgaagttcgagatcgagatagagccgatctttgctagtcttgcattgtatgacgtgaaagaaaagaagaagatctcagagaacttttactttgatcttaacagcgagcagatgaaggggttactcaggccacacgtgccccccgctgcgatcaccaccctagcgcgcagcgcaatattctccatcacctacccatctcaggatgtgtttctggtgattaaactcgaaaaggtcttgcagcagggggacattggggaatgcgctgaaccttatatgatttttaaagaggcagatgccaccaaaaataaagaaaaactagaaaaactgaaatctcaggccgatcagttttgccaacgcctggggaagtacagaatgccatttgcctggactgccattcacttaatgaatattgtgtcttccgctggctcgttggaaagagattccactgaggtagaaatttcaacaggtgaaagaaaagggagctggtcagagcgaagaaattccagtatagtggggcggagatctctcgaaaggacgaccagcggagacgacgcttgcaacctaacatcattccgtcctgccactctaacagtaaccaattttttcaaacaggagggagatagactgagcgacgaggacttgtacaagttcctggctgatatgaggagaccatcctcggtgttacgacgtctgagaccaatcaccgcccagctgaaaattgacatctctccggcgcccgaaaaccctcactactgcttgacacctgaattgctgcaagtgaagttatatcccgattccagggtgcggcctacccgagagatattggagttccctgcaagagatgtatatgttccaaataccacctacagaaacctcctgtacatctacccgcagagcctgaatttcgccaatcgccaggggagcgcccgcaatatcaccgtgaaggtgcagttcatgtatggcgaggacccttctaacgctatgccagtgatcttcgggaagtcttcttgcagtgagttctctaaggaggcttatacagcggtagtgtatcacaaccggtctcccgatttccacgaagaaatcaaggtaaagttgccagctacactgacagatcaccatcatctccttttcactttctaccatgtgagctgtcagcagaaacaaaatactcctctagaaactcctgtaggatacacatggatcccaatgcttcagaatggtcggctaaaaacaggccagttctgcctgccagtctccctcgaaaagccacctcaagcatactctgtcctgagcccggaggtccctctcccaggcatgaagtgggtggataatcacaaaggcgtctttaatgtggaagtggtagcagtgagctccatacatactcaggatccatatcttgataaattctttgcactggtgaacgctctggatgagcatttgttccctgtcagaatcggcgatatgcgaatcatggagaataatctcgagaatgagctcaagagttctatctccgccctgaactccagccaactggagcccgtggtgaggttcctgcacctgctgcttgataaactgattctgctggtaatccgccctcccgtgattgcagggcagatcgtgaatttgggacaggcatcctttgaggctatggcatcaattatcaaccggttacacaaaaacctggagggaaaccatgatcagcacgggaggaactccctgttggcatcttatatccattacgtttttcggctgcccaatacctaccctaattctagtagccccgggcccggcggattgggaggttctgtccactacgctacaatggcccgctcggccgtgcgaccagccagcttgaacctgaaccggtcccgttcactctctaactcgaatcctgatatctctggaactcctaccagccctgatgacgaggtaagatctataattggatccaaaggcctggatcggagcaactcatgggtgaatactggcggccccaaagccgcgccctgggggagtaaccccagccccagtgccgaaagcacacaggccatggataggagctgcaacaggatgagcagtcatacagaaactagctctttcctccagacacttactgggcgtctccccacaaagaaactgttccacgaagagttagcactgcaatgggtagtttgctcaggtagcgttagggagtccgctctccagcaggcctggttctttttcgaacttatggtgaagagcatggtgcaccatctttacttcaacgataaactggaggccccacgtaaaagcaggtttccagaacgcttcatggacgatatcgccgcccttgtctcaaccatcgcttccgacattgtgtccagatttcagaaggacaccgaaatggtagaaaggttgaatacctcactggccttcttcctcaatgacctgctaagtgttatggacagggggttcgtgttttccctgattaagagctgctacaagcaggtttcgtctaaactttacagcctaccaaacccatcagtcctcgtctccctaagactggatttcttgcgtatcatctgttcccacgaacactacgtaaccctgaacctcccatgctcccttctcactccgccagccagtcccagtccatctgtctcctcggctacctcacagagttccggcttctcaacaaatgtccaggaccagaagatagccaacatgttcgaactgagtgttccctttaggcaacaacattacttagcagggttagttctaactgagttggcagtcatcctggacccggacgctgaagggctgttcggtttgcacaaaaaggtcatcaacatggtacacaacttgctctcaagtcatgattcagacccgaggtattcagaccctcaaatcaaggccagggtggctatgctctatctacccttaattgggattattatggagacggtgcctcagttgtatgatttcactgagacacacaaccaacgcggcaggcctatctgcattgcaaccgatgattatgagtctgagagcggcagtatgatctctcagacagtggccatggctatagcaggaaccagcgtcccgcagttgacgcggccgggctcattcctgctaacttcaaccagtgggaggcaacatacaaccttcagcgccgagtccagcagaagtctcctgatatgcttattgtgggttttgaaaaatgccgacgagacagtactgcagaaatggtttacagatctcagtgtgcttcagctgaacagactgttggatttgttgtacctgtgcgtgtcatgttttgagtacaaagggaagaaggtattcgagcgaatgaactcactgactttcaaaaaatcaaaggatatgagggccaaactggaggaggccatcctggggtctattggtgctagacaggagatggttcgacggtcgcgtgggcagctgggtacatacactatcgccagcccgcccgaacgcagcccatctgggagtgctttcggctcacaggagaatttgcgttggcgaaaagacatgacccattggaggcaaaacacagaaaagctggataagtcccgagcagaaatcgaacatgaggcccttattgacgggaatctggcaacggaggccaatctgatcatcttggatactctcgaaatagtggtgcagactgtgtctgtcactgaaagcaaggagagtatactggggggggttctgaaagtgctcctgcattcaatggcttgtaaccaaagcgccgtgtacctccagcattgcttcgcgacccagagggcccttgtttcaaagttccctgagcttttatttgaggaggaaaccgagcagtgtgccgacctgtgtctgagactgctgcggcactgttcgtccagcatcggaacgattcggtcccatgccagcgcatccctgtacctccttatgcgccagaattttgagatcggtaataattttgctcgggtaaagatgcaagtgacaatgtccttgtcgagcctggtggggacatctcagaacttcaacgaagaatttctcaggcgctctttgaaaacaatccttacctacgcagaagaggacctcgagctacgcgaaacaaccttccccgatcaggttcaggatctggtctttaacctgcatatgatcctcagtgacaccgtcaagatgaaggagcaccaggaggatcccgagatgctgatagacctcatgtacagaatcgcaaaagggtatcagacatctcctgatttaagactaacatggttgcagaatatggctggcaagcacagtgagagatccaatcacgccgaggcggcccaatgtttagttcactcggcagctctggttgccgaatacctgtctatgcttgaggacagaaaatatctccccgtcggctgcgtgactttccagaatatatcatcaaatgtgctcgaggaaagcgctgtgtccgacgacgtcgtttctcctgacgaagaaggaatctgtagcggcaagtacttcaccgaaagtgggctggtgggcctcctagaacaggctgccgcctccttctcaatggccgggatgtatgaggccgtgaacgaagtgtacaaagtactcatcccaatccacgaagcgaacagggacgccaaaaagttaagtacgattcacggtaaactccaggaggccttttcaaagatcgtccaccagacaaccatctggaagcggatgtttggtacttatttcagagtgggattctacggcaccaagttcggtgacctggacgaacaagaattcgtgtataaggagcctgctatcactaagctggcggagatctctcaccgactcgagggcttctacggcgagcggtttggtgaggacgttgtggaggtgatcaaggattctaaccctgtggacaagtgcaaacttgacccaaacaaggcatacatccagatcacctacgtggagccttacttcgatacctatgagatgaaggatcgcatcacttattttgataaaaactacaacctgaggcgatttatgtattgtacgccatttacactcgacgggagggcccacggggaactccatgagcagtttaagcgaaaaaccatcctgaccacttcgcacgcttttccctatatcaagactagggttaacgttacccacaaagaagagataatcctgacgccgattgaggtggcaattgaagacatgcagaagaagacccaggaattggcttttgctactcatcaggatcctgcggacccgaaaatgctgcaaatggttctgcaaggcagtgtcggtaccaccgttaatcagggcccattggaagtggcacaggtcttcctgagtgagatccccagcgaccctaaacttttcagacaccataataagctacggctctgcttcaaggactttactaagcgatgcgaagacgcgctgcggaaaaacaagtctctgattggcccagaccagaaagagtaccagagagagttagaacgcaattaccaccgcttgaaggaggccttgcagcccttgattaaccgaaagattccacagctttacaaggccgtgctaccagttacctgtcacagggattctttctcacggatgtccctcagaaagatggacctctag

SEQ ID NO: 46731 - DNA, 2799 bp, Artificial Sequence
  Description of Artificial Sequence: Synthetic coding sequence
atgttcgagctgagcgtgcccttccggcagcagcactacctggccggtctggtgctgaccgagcttgcagtcatactggatcctgatgctgaggggttattcggactgcacaaaaaagttattaacatggtgcataatctactgtcttctcatgatagtgacccgcgatattcagatcctcagatcaaagcgagggtagctatgctgtacctacccctcatcggaattataatggagactgtcccccagttatacgacttcaccgatttaagtgtgctgcagctgaatcgtctgctggacctgctttacctatgtgtgtcctgcttcgagtataagggaaagaaagtgtttgagaggatgaattctctgactttcaagaagtcaaaagatatgagagccaagctggaggaagcgatcttgggaagtattggtgccagacaggaaatggtgagaaggagtcgaggccagctcgaacgatccccaagcggttccgcttttggatcccaggagaacctccgctggaggaaagacatgacccactggaggcaaaataccgaaaaattggacaagagtagagctgagatagagcacgaggccctcatagacggtaatctggctactgaagctaacctgattatccttgacactctagaaatcgtggtccagaccgtgagcgtgactgagagcaaggagtctattctcggcggcgtattgaaggtgctgctgcactccatggcgtgtaaccagagcgccgtatatttacagcactgtttcgccacccagcgggcactggtgtcaaaattccctgagctgctgttcgaggaagagactgagcagtgcgccgatctttgtttgcgtctacttcggcactgcagctcctctatcgggaccattcggagccacgcttctgcaagcctgtacttgctgatgagacagaatttcgagattggcaataactttgccagggttaaaatgcaagtgacaatgtcactcagtagcttagtgggcacatctcagaattttaacgaggaattcctgaggcgctctctgaagacaatactgacttacgctgaggaagacttggagctgcgcgaaactacatttcctgatcaggtccaggacttggtgtttaatctccacatgattctctcagacactgtgaagatgaaggagcaccaggaggaccccgagatgctcatcgatcttatgtacaggattgcaaagggatatcaaaccagcccagacctgcggctgacttggctgcagaacatggcaggcaagcacagcgagaggtccaaccacgccgaggccgcacagtgtctggtacactcagctgctttagttgcggagtatttgtcaatgctggaggataggaaatacctgcccgtggggtgcgtgaccttccagaatatttcctcgaatgttctggaggagagcgcggtttccgatgatgtcgtgtcgcccgatgaagagggaatctgtagcggcaagtactttacagaatcagggctggtgggattgctggagcaggcagccgcatcattctcaatggctggtatgtacgaagccgtgaacgaagtctataaggtgctgataccaatacacgaagccaatcgggacgcgaagaagttgagcacaatccatgggaaactccaggaggccttctctaagatcgtgcaccaatctactggctgggagcgcatgttcggcacttatttcagggtcggcttttacgggacaaaatttggcgacttggatgaacaggaattcgtgtataaggaaccagctattacgaaattggcggagatttctcaccggctggagggcttttatggagaacgctttggcgaagacgtcgtcgaagttataaaagacagcaaccccgttgacaaatgtaagttggaccctaacaaagcctacatccagataacctatgtggagccatattttgacacctatgagatgaaagataggattacgtacttcgataagaactacaacttacgacggtttatgtactgcactccctttacactggatggtcgggcccatggggaactgcatgagcagttcaaacggaaaacgatcctgaccaccagtcatgcgtttccttacattaagacacgggtgaacgtgacacataaagaggagatcatcctgacacccattgaggtggccattgaagatatgcagaagaaaacacaggaacttgcatttgccacgcatcaggatcctgccgatccaaagatgctgcagatggtcctccagggatctgtgggcaccacggtcaatcagggacctctggaggtggcccaggtgttcctgtccgagataccatccgacccaaaattgtttcgccaccacaacaaactgagactttgttttaaagatttcacaaagcgttgtgaggacgccctgaggaaaaataagagtctcattggtccagatcagaaagagtatcagagggagttagaacggaattaccacaggttaaaagaagccttgcagccgcttataaataggaagattccacagctgtataaggctactaactatgtgctaagtttcttcagtcagcggtttctgcagagtaacgaaccatctcagaatgggtccctcgagtgtacatgcttcatccatttgcagagggccatgtacagcaccagttccgtaaaacgctctatcggcaagcagcacgggatggaattttggaagctgcttttcatcgaggagtgtagcggacaggaaaacattaagtgtaggctcctgactcttgaaaatcacggatatggattctag

SEQ ID NO: 46732 - DNA, 1899 bp, Artificial Sequence
  Description of Artificial Sequence: Synthetic coding sequence
atggccgagcggcgggccttcgcccagaagatcagccggaccgtggctgccgaagtgaggaaacagatctcagggcagtacagtggaagcccacagttgctgaagaacctgaacattgtgggtaacatctcccatcatactaccgttcccctaacagaagcggtcgatcctgtagacctggaagactatctgatcactcacccgcttgccgttgattctggtcccctgagggatcttatcgagttccctccagatgacatagaagtggtttatagcccacgcgactgtcggacactggtgagcgcggtacccgaggaaagcgagatggaccctcatgtgcgcgattgcattcgttcatacacggaggactgggcaattgttattcgcaaataccataagttggggaccggcttcaaccctaatacactcgacaaacaaaaggaacgccagaagggattgcccaaacaggtgtttgagtccgacgaagcaccagacgggaattcctatcaggacgaccaggacgatttgaaaaggagaagcatgagcatcgatgacacgcccaggggatcctgggcatgcagcatctttgacctaaagaattctctcccagacgccctgcttcctaatctgctagatcggacccctaacgaggaaattgatcgccaaaacgacgaccagcggaagagcaacaggcacaaggagctgtttgccttgcatcctagtcccgatgaagaggagcccattgaaaggctttccgtgcctgatatcccaaaagagcacttcggccagaggctgttggtgaagtgtctgtctttaaaattcgaaattgaaatcgaaccaatttttgccagccttgccctgtacgacgtgaaagagaagaagaagattagcgagaacttctacttcgatctcaatagcgaacagatgaagggcttgctgcgaccgcacgttcccccggccgctatcacaacactcgctcgatctgcaatcttctccattacctatccaagccaggacgtgtttcttgtcatcaagctcgagaaggtcttgcagcagggtgacatcggcgagtgtgccgagccctacatgatttttaaagaggccgatgcaacaaaaaataaagaaaaattggagaagctgaaaagccaggcagaccagttctgtcagcgattgggaaaatatcgaatgccttttgcttggactgcgattcaccttatgaatatcgtatccagtgctggatctttagagcgtgactcgacagaggtggaaatttcgacaggagaacgcaagggctcatggtccgaacgaagaaactcttccattgtgggtcgccgctctctggaaagaactacatccggagatgacgcttgtaatctcactagcttccgccccgcgacattgacagttacaaactttttcaaacaggagggcgataggctgtccgatgaagacctgtacaaattcctggcagatatgcggaggcccagcagcgtgctgaggaggctgcgcccaatcactgcacagctcaaaatcgatatcagtcccgcgccagagaacccacactactgcctcacacctgaactgctgcaagtaaagctctaccctgactcacgagtgcgtccaacgcgagaaatcctcgagtttcctgctcgcgacgtgtatgtgcccaataccacttatcgcaatctgttgtacatttatcctcaaagcctgaacttcgccaatcggcaaggcagtgctcggaacattaccgtgaaggtgcaatttatgtatggggaggacccttctaacgccatgccttcaccctcatgtactcacccaatacctaccgtccggccgcttcccctgtggtgctaccactccatcttctccctgctctcctgggacttcatcacatag

SEQ ID NO: 46733 - DNA, 3912 bp, Artificial Sequence
  Description of Artificial Sequence: Synthetic coding sequence
tgaaagaacctggagggcaaccacgaccagcacggccggaacagcctcctggcgtcctacatacactatgtgtttaggcttccaaatacatatccgaactcaagctcacctggaccaggcggcttgggtggctccgtgcattacgcaacaatggcgcggtcggctgttcggcctgctagcttgaatctcaataggagccggagcttgagtaacagtaatccagacatttcagggaccccaacgagtccagacgacgaagtccgcagcattatcggttccaagggcctggacagatccaatagctgggtaaacacaggcggtccaaaggccgcaccatgggggtctaacccctccccctccgccgaatccacacaagcaatggataggtcatgcaataggatgagctctcacaccgagacaagctcattcctgcagacgttaacaggcagactccccaccaagaagcttttccatgaggagcttgcactacagtgggtggtgtgttccgggtctgtgcgggagtcagccctgcagcaagcatggttcttcttcgaactcatggtgaaatcgatggtgcatcatctctattttaatgataaactggaggcaccacggaagagccggttccctgaacgattcatggatgacatcgctgccctagttagtacaatcgccagcgatattgtatccaggttccagaaagacactgagatggttgagcggctgaacaccagtctggcctttttcctgaatgacctgcttagtgtgatggacagaggctttgtctttagcctgatcaaatcgtgttataagcaggtgagttccaagctgtatagcctgcctaacccttctgtactggtgagtcttcggctggatttcctgagaatcatttgcagccacgagcattacgtaactctgaacttaccatgtagcctcctgacaccccctgccagccccagtccctccgtgtcaagcgcgacgtcccagagctcggggttcagcaccaacgtacaagatcagaaaatcgccaacatgtttgagttgagcgttccctttcgccagcagcactacctggcaggcttggtcttaaccgagctagctgtgatcttggaccccgatgccgaaggactattcgggttacacaaaaaagtgatcaacatggttcacaaccttctgagttctcatgatagtgatccacggtactctgatcctcaaatcaaggcgcgcgttgccatgctgtacctgccactgattggcataatcatggagaccgttcctcagctctacgactttaccgaaacccataatcagcgcggcaggcccatctgtatcgctactgacgactatgaaagcgaaagcggatctatgatctcccagacagtcgctatggccattgccggaacttcagtgcctcagcttacgcgccctgggtctttcttgcttacaagtaccagcggccgtcagcatacaaccttttctgcagagtcatcaaggtctctactcatctgtttgctgtgggttctgaaaaacgccgatgagactgtgctacagaagtggttcaccgatcttagcgtgctccagctaaaccggctgcttgacctcctctacctttgcgtgtcatgttttgaatataagggcaagaaggtatttgagcgcatgaattccctgaccttcaaaaaatctaaggacatgcgcgccaagttagaggaagcaatcctcggctctatcggagccaggcaggagatggtgcgccgctcccgtggtcaactggaacgctctccttctggaagtgcattcggctcccaggaaaacctccgctggcggaaggacatgacccactggcggcagaataccgaaaagctggataaaagtcgcgcagagattgagcacgaggctttaattgatgggaacctggctactgaggccaacctgattatcctggacacacttgaaatcgtcgtccagaccgtcagcgtgacagagtcaaaggaaagcatcctaggtggggtcctcaaggttctgctgcactctatggcctgtaaccagtctgccgtgtatctgcaacactgtttcgccacgcaaagagcactggtgtccaaattccctgaactgctttttgaagaggagacggaacagtgcgcggatttgtgtcttcgtctgctccgacactgcagctctagcatcggaactataaggtcacacgcttcagcctctctttaccttctgatgagacagaacttcgagataggcaacaacttcgccagggttaaaatgcaggtcacaatgagcctgtcctcgttagtgggcacctcccaaaactttaatgaagaattccttcgccggtctttaaaaacgatattaacctacgcggaagaggaccttgaactcagggagactaccttccccgatcaggtgcaggacctggtgtttaacctccatatgattctgagcgatactgtcaagatgaaggagcaccaggaggacccagagatgcttattgatctgatgtaccgaattgccaaggggtatcaaacctccccagatctgcgcttgacctggttgcaaaatatggcgggtaaacacagtgagaggtcaaatcatgcagaggcggcacagtgtctcgtacactctgcagccctcgttgctgagtacctttccatgttagaagacagaaagtatctgcctgtaggatgtgtgactttccagaatatcagctctaatgttttagaagagtcagctgtctctgatgacgtggtgtcacccgacgaggaagggatttgtagtggcaaatatttcacggagtcggggttggtaggcctgttggagcaggccgcagccagcttttcaatggctggtatgtatgaggctgttaacgaggtctacaaggtgctcattcccatccacgaggctaatcgggacgcaaagaaactgtctaccatccatgggaaactccaggaggccttttcaaagatcgtccaccagtccacagggtgggagaggatgtttggcacgtactttagggtgggattctatggcaccaaatttggcgatctggacgaacaggagtttgtgtataaggaacccgctattacgaagctcgcagaaattagtcatcggctcgagggcttctatggggagcgctttggagaagacgttgttgaggtgattaaggatagcaatccggtcgacaagtgtaagctagaccctaacaaagcgtatattcagatcacctatgtggagccctattttgacacatacgagatgaaggacaggatcacctatttcgataaaaattacaatctgcgccggttcatgtactgtacacccttcaccctggacgggcgcgcgcatggagagttacacgagcaattcaagcggaaaacgattttaactacatcccatgctttcccctatattaaaacccgagtcaacgtcacccacaaagaggaaataattctgacgcctattgaggtagccattgaagatatgcagaagaagacccaagagctcgcctttgccacacaccaggatccggccgatcccaaaatgctccagatggtgctgcagggatctgtaggaacgacagtgaatcagggccccctggaggtggcacaagtgttcctgagtgagattccctcggacccgaaactgtttcggcatcacaacaaactccgcctttgtttcaaggactttacaaagaggtgcgaagacgctttacgcaaaaataaaagtctgattggacccgaccaaaaagagtatcagcgggagctggaacgaaattatcatcggctgaaagaagcactacagccgttaatcaatcgcaagattccgcaactatacaaagctgtgctccccgtgacatgccaccgggacagcttttcaaggatgtccttacgaaagatggacctgtag

SEQ ID NO: 46734 - DNA, 6282 bp, Artificial Sequence
  Description of Artificial Sequence: Synthetic coding sequence
atgagccagccccccctgctgcccgccagcgccgagacccggaagttcacccgcgccctgagtaaacctggaacagcagccgagctaaggcaatccgttagcgaagttgtgcggggtagcgttcttctcgccaagccaaagttaattgagcccctggactacgaaaatgtgattgtccaaaaaaaaacccagatcctgaatgactgccttcgcgagatgctgctgtttccctacgacgactttcaaactgccattttaaggaggcagggccgttacatttgttcaacagtgcctgcaaaggccgaggaggaggctcagtccctgttcgtcacggaatgtattaagacatacaactccgattggcatcttgttaattacaagtatgaagactacagtggtgagtttcgacagttgccaaacaaggtcgtaaaattggacaagctccccgtccacgtttatgaagtggatgaagaagtggacaaggatgaagatgctgctagcctggggtcccagaagggagggatcactaaacacggctggctgtacaaggggaatatgaattcagcaatcagcgtgacgatgcgtagctttaagcggcggttcttccaccttatccagctgggtgatggaagttataatctgaacttctataaggatgaaaaaatctctaaggaacctaagggatccattttcctagactcttgtatgggagtcgtgcaaaataataaagtgagacgattcgcatttgagctgaaaatgcaggacaaatctagttaccttctggctgcggactctgaggtggagatggaagaatggattactattctgaacaagatactccagttgaatttcgaggctgcaatgcaagagaaacgcaacggcgacagtcatgaagatgacgagcagtctaagctggagggctctgggtctgggttagattcatatctcccagaactagccaagtcagcccgcgaagcagagatcaaactcaagtccgaatcacgcgtgaagctgttctacctggatcctgacgctcagaagctagatttttctagcgcagaacccgaggttaaaagctttgaagaaaagtttggaaagcgcatcctggttaaatgcaatgatttgtccttcaaccttcagtgctgtgttgccgaaaatgaagagggtccaacaacgaatgtggaaccgttctttgtgactttgagtctgttcgatataaaatataaccgtaaaatttcagccgatttccacgttgatttgaaccatttttcagtgaggcagatgctcgccacaaccagtcccgccttgatgaacggctcaggacagagcccctctgtactaaagggcatcctccacgaggcagccatgcagtatcccaaacagggtatttttagcgtgacgtgtcctcacccagacatttttctagtggccagaattgagaaagtcctccagggttcgatcacccattgcgccgagccttatatgaagagtagtgacagtagcaaagtggcacagaaggtgctgaaaaacgctaagcaggcatgtcagaggctaggtcagtaccgtatgcctttcgcttgggccgcccgtactctgttcaaggatgcctccggtaacctggacaaaaacgcgcgattttctgcaatctaccgtcaggattctaacaagctgtccaatgacgatatgctgaagctgctcgctgacttccgtaaaccagaaaagatggccaaactgcccgtcatactgggcaatctggacataactatcgataatgtatctagcgattttccaaattatgtaaactccagctatatcccaaccaagcagttcgaaacctgcagtaagacaccaataacttttgaggtcgaggaattcgtgccatgcattcccaaacatactcagccttacacaatctacacaaatcacttatacgtatatccaaagtaccttaaatacgacagccagaaatcattcgccaaagctcgcaacattgccatctgtatcgaatttaaggactcagatgaggaggactcccagcctctcaagtgtatttatggacgacccggaggaccagtgttcacacgcagcgccttcgccgcagtgctccatcatcaccagaatccagaattttatgacgagatcaagatcgaactgcccacccaactgcatgaaaagcaccacctccttctgacctttttccacgtcagttgtgacaactcaagcaaaggcagcaccaagaaacgagatgtggtagaaacgcaggtcgggtactcttggttaccactgttgaaagatggacgggtggtgaccagtgagcagcacatccctgtgtctgcaaacctgccctcggggtacttgggctaccaggagctgggtatgggccgacactatgggcctgagattaagtgggtggacggagggaagccccttcttaagataagcacgcatctcgtcagtactgtctatacgcaagaccagcatctgcacaatttctttcagtattgccagaaaaccgagtccggagcccaggcactcggcaacgaactagtgaagtacctgaaatcgctgcacgctatggaaggacacgttatgatcgcattcctacccaccattctgaatcagctgttcagggtccttacccgagccactcaggaagaggtagcagtcaatgttacccgggtgattatacatgtagtggcccagtgccacgaagagggcttggagagccacctaaggtcctatgtaaagtacgcatataaggctgaaccctatgttgcatccgaatacaaaacggttcatgaggagttaactaagtctatgacaacaatattaaaacccagcgcagactttctaacttctaataaacttctgaaatacagctggtttttctttgacgtcctcataaagtcaatggcacagcatcttatagaaaactctaaggtgaagctgctacggaaccagaggttccccgcaagctatcaccacgcagtggagactgttgtcaatatgctcatgccccacataacacaaaagtttcgcgacaatccagaggcaagcaaaaacgcaaatcactcgttggccgtgttcattaaaaggtgcttcacattcatggaccgaggattcgtgtttaagcagattaataattatatttcttgctttgcccccggcgaccctaaaactttatttgagtataagtttgagttcctgcgggtagtctgtaatcacgaacattatatccctctgaatctgccaatgccatttggaaaagggcgcatacaaaggtatcaggacctccagttggactactctttgaccgacgaattctgcaggaaccacttcctggtgggactgctgctgagggaagtgggcaccgcactccaggagttccgcgaggtgaggctcatagcgatcagcgtgttgaagaacctgctcatcaaacactcctttgacgataggtatgcttccaggagtcatcaggccagaatagccactttatacttacccttatttgggctgctcatagaaaacgtgcagcgcatcaatgttcgggatgtgtctccatttcctgtcaacgctggtatgactgtgaaagatgaatctctcgctcttcccgctgttaacccgctggtgacaccacaaaaaggctcaaccttagataactccctgcacaaggaccttcttggggctattagtggcattgcgtccccttataccacatctacaccaaatattaactctgtaaggaatgctgattctcgaggctcgctgatttccacggacagtggcaatagcttgcccgagagaaactcggaaaagtccaattctctggataagcaccagcaaagttccacactgggcaactccgtggtgagatgcgataaattggatcaatcagagattaaatctctgctgatgtgcttcctatatattctcaaaagcatgagcgacgacgccctgttcacttactggaacaaggcctcgacatccgagctgatggattttttcactatcagtgaggtgtgtctgcatcagttccaatatatgggcaaacgctacatagcccgaacaggtatgatgcatgccagactacagcagttaggtagtctagacaattctctcaccttcaatcactcatacgggcattcagatgcagacgtcttgcaccaaagtctgctggaggctaatatcgccaccgaggtgtgcttgaccgctttagataccttgagccttttcacactggccttcaaaaatcagcttctggccgatcacggccacaatcctctcatgaagaaggtctttgatgtgtacttatgtttcctccagaaacaccagagcgagactgcactaaagaacgtcttcactgcattgaggagccttatttataagttccccagcacattctacgagggacgagcagatatgtgcgcggccctctgctatgagatcctgaaatgttgcaactccaaactctctagtatcaggacagaggcttctcaactgctgtatttcctgatgcggaacaatttcgattatacaggtaagaaatctttcgtcagaactcatcttcaggtaattattagtgttagtcaacttatcgctgatgttgtgggaataggtggtacccggtttcagcagtcactatctattatcaataattgcgccaactccgatcggctcattaagcacaccagcttttcatcggacgtgaaggacctgaccaaaaggattcggaccgttcttatggccacggcccaaatgaaggagcatgaaaatgaccccgagatgctggtcgacttacagtactccctggcaaagtcttacgccagtactcctgaactgagaaaaacctggttggacagcatggcaagaatccacgtgaaaaacggggatttgtccgaggccgctatgtgctatgtccacgtcacagccctggtagctgagtatctcactcgtaaggaggcagtccaatgggaaccccccctcctgccacacagccactcggcgtgcctcagaaggagcagagggggcgtgttcagacagggatgcacagcctttcgagtcataactcccaacattgatgaagaggcttctatgatggaggacgtagggatgcaggacgtacattttaatgaggacgtgcttatggaattattggagcaatgtgcggacggtctatggaaggctgagcgctatgagctgattgccgacatttacaaattgatcattcccatttatgaaaagaggcgggatttcgaaaggcttgcgcacctgtacgatacccttcatcgggcctacagcaaggtgaccgaggttatgcacagcggccgccgactgctgggaacttatttccgcgttgcttttttcggacaaggctttttcgaggacgaagacggaaaggaatatatttacaaggaacctaagctgacgccactcagcgaaatctcccaaagactgctcaaactttactccgacaagttcgggagcgagaacgtgaaaatgatccaggattccggaaaggtcaatccgaaggatctcgacagtaagtacgcctatatccaagtgacgcacgtaatcccattcttcgacgaaaaagaactccaggaacggaagaccgagtttgaacgaagccacaatatacggcgattcatgtttgagatgccttttacccagactggcaagcggcagggaggcgttgaagagcagtgcaaaagacgtaccatactgaccgccattcactgcttcccttacgtcaagaagcgaatcccagtaatgtaccaacatcatactgatcttaacccgatagaggtggcaatcgatgaaatgtcaaagaaggtggcagaactgagacagttatgctctagcgcagaagttgatatgataaaactacagctgaagctccaaggcagcgttagcgtccaggtgaacgctggacccctggcctacgccagagccttcttggatgatacaaacacaaaaaggtacccggacaacaaagtcaagctgctcaaagaggtcttcagacagtttgtggaggcctgcggtcaggccctcgctgtgaacgaaaggctcatcaaggaagaccagctagagtaccaggaggagatgaaagctaactatcgagagatggcgaaggagctgtcagaaattatgcacgagcagatttgccctctggaagagaaaacctctgtcctcccaaacagcctgcatatttttaacgcgatctctggcacaccaacaagcaccatggtacatggcatgacatctagctcctccgtggtgtag

SEQ ID NO: 46735 - DNA, 1275 bp, Artificial Sequence
  Description of Artificial Sequence: Synthetic coding sequence
atgatgcacgcccggctgcagcagctgggcagcctggacaacagcttaactttcaatcattcttacggtcattcagacgctgacgtgctacatcagtcattgctggaggccaatatagcaacggaagtctgcttaaccgccctggatacgctgtccctttttactctggccttcaagaatcagctcctcgccgatcacggtcataacccgctgatgaaaaaagtgtttgatgtgtacttgtgttttctgcaaaagcatcagtctgaaacggccctgaagaatgttttcaccgccctgcggagccttatctacaaattccctagcacattctatgaaggaagagctgatatgtgcgcggccctttgttacgagatactcaagtgctgtaacagcaagctgtctagcattaggaccgaggcaagccagctcctctacttcctgatgcggaacaatttcgactacactggcaaaaagtctttcgtgcgtacacacctgcaggtcataatctctgtttcccagctgattgctgatgtcgtggggatcggtggaactcggttccagcagtccttgagcataatcaacaactgtgctaattcagacagacttataaagcacactagtttctcatctgatgttaaggacctcacaaaacggatccggaccgtcctgatggctaccgcgcaaatgaaggagcacgagaacgatccagagatgcttgttgaccttcagtacagcttggcaaaatcctatgcgagtacccccgagttaagaaagacttggttagattcaatggcccgaatccatgtgaagaacggcgatctgtccgaagcggctatgtgctacgttcatgtaactgcccttgtcgcagaatacctgactcggaagggagtgttccgtcagggctgcacggcatttcgtgttatcactcctaacatagatgaggaagcctctatgatggaggatgttggaatgcaggatgtacattttaatgaggacgtgcttatggagctactggaacaatgtgccgacggcctgtggaaagctgagaggtatgaactgatcgcagatatatataagcttatcattccaatctatgaaaagagacgcgacttcgaaagattggcccacctctacgacactcttcatcgcgcctattctaaagtaactgaggtaatgcatagcggccggcgcctcctgggcacctactttagggtagctttctttggccaagtgtccctcttatcaatccttcagaccgtgttatcacccctgtag

SEQ ID NO: 46736 - DNA, 6309 bp, Artificial Sequence
  Description of Artificial Sequence: Synthetic coding sequence
atgagccagccccccctgctgcccgccagcgccgagacccggaagtttacgcgagcgctgtctaaaccagggacagctgccgaactgcgccagagtgtctccgaagtggtgagaggcagtgttctgctggcgaaacctaagcttatcgagccactggactatgaaaacgtcattgtgcaaaagaaaactcagattctgaatgattgtctccgcgagatgttgctttttccttacgacgacttccagacagctattctgaggcgccagggaaggtacatttgcagcaccgtcccggctaaggccgaagaggaagctcaatctctgttcgtgaccgagtgtatcaagacctataacagcgactggcaccttgtgaactataaatacgaagattattctggcgaattccgccaactgcccaataaggtggtgaagctagacaagttgcccgtgcacgtttatgaagtcgatgaggaagtagataaagacgaagatgctgcctccttgggaagtcagaaggggggtatcactaaacatggatggttgtacaaggggaatatgaactccgctattagtgtgacaatgcgatcctttaagcgccgcttcttccatctgattcagcttggtgacgggtcctacaatcttaacttctacaaagacgaaaaaatcagcaaggagccgaagggatcaatttttctcgactcctgcatgggagtcgtgcaaaataacaaagtgcgccggttcgcattcgaacttaagatgcaggacaagtccagctatctgttggcggccgactccgaagtcgaaatggaggagtggattaccatacttaacaaaatcctccaactgaattttgaggcagctatgcaggagaagagaaacggcgactcgcacgaagacgacgaacaatctaagctggaggggtcgggctctggactggactcttatctccccgagttagcgaaatcagcccgagaggctgagattaaactgaagtccgaatcgcgggttaaacttttttacctggatccagacgcccagaaattggatttctccagcgctgagccagaggtgaagagctttgaagagaaatttgggaagcggatcttggtcaagtgcaacgatctgtcctttaacctacagtgctgcgtggctgaaaatgaggagggccccactaccaacgtggagcctttcttcgtgaccctcagcctctttgacatcaaatataatagaaagatctcagctgactttcatgttgatctgaaccatttttccgtaagacagatgctggccacaacgtcccctgccctgatgaatgggtctggccaatccccctcagtgcttaaaggaatccttcatgaagctgctatgcagtacccaaaacaaggaatctttagcgtgacctgtccccacccagacatttttctcgtggcacgaatcgagaaagttttacaaggatcgatcacacactgtgccgagccctatatgaagtcttccgactccagcaaggtggcgcagaaagttctgaagaatgccaaacaggcctgccagaggctcggtcaataccggatgccttttgcttgggccgccaggacactcttcaaggacgcttctgggaatctggacaagaatgcgcggtttagcgctatctaccggcaggacagcaataaactgtccaacgacgacatgttgaaactcctggcagacttcagaaagccggaaaagatggccaaattgcccgtgatccttggcaacctggatattacgatcgataacgtgtcttctgattttcccaattacgttaatagctcctacataccaaccaagcagttcgagacatgctctaagactccgattaccttcgaagtagaagagtttgtgccttgcattcctaaacacacacagccgtatacaatctatactaaccatctgtacgtgtaccctaagtatctcaagtacgattctcaaaagtcgttcgcgaaggctcggaatatcgcgatctgcattgagttcaaggattccgatgaagaggactcccagccattgaaatgtatttacggtcggcccggcggtccggtattcacgcgaagcgcctttgcagccgtactgcaccaccaccagaatccagagttctacgatgagattaaaatcgagttacctacacagctgcacgagaagcatcatcttctgctgaccttcttccacgtaagctgcgacaacagtagcaagggctctactaagaagagggatgtggtggaaactcaagtcggctactcttggctgcctcttctaaaagacgggcgcgtcgtcaccagcgaacagcacatacccgtgagcgctaatctgccgtccggatatctgggctaccaggaactgggcatgggacgtcactacggcccggaaatcaaatgggtggatggcggaaagcccctgttgaaaatttctacccacctggtttccaccgtctatacacaggatcagcacctgcataatttcttccagtattgccagaagacagagagtggggcacaggccctcgggaacgaactcgtcaagtacttgaagtcattacatgcaatggaagggcatgttatgattgcattcctgcctacgattctcaaccagctgttccgagtcttaactagagctacccaggaagaagtggcagtaaatgtcactagagtgataattcatgtcgtcgctcagtgtcacgaggagggattagaatcccatctacggtcctacgtgaagtacgcttacaaggccgaaccttatgtggcatccgaatataaaaccgttcacgaagagctgacaaaatctatgactaccatcttgaaaccatccgcagacttccttacaagtaacaaattactgaaatactcttggttcttttttgacgtgttgattaagagcatggcccagcacctgattgagaattccaaagtcaagctactacggaaccagagattccccgctagctatcatcatgccgttgagacagtcgtcaatatgttgatgccccacatcacccagaagtttagagataacccagaggcaagcaaaaatgccaatcattcattggctgtattcattaagcgctgttttacattcatggatcgcggcttcgttttcaagcagattaacaattacatctcctgtttcgcccccggcgatccgaagacacttttcgaatacaagttcgaattcctccgggtggtgtgcaaccacgaacattacattcccctcaatttacctatgcccttcggtaaggggcgcattcagcgctaccaggatctgcagctcgattatagcctaaccgacgaattttgtagaaaccactttcttgttggcttgcttctgcgggaagtgggcacagctctgcaagaatttagggaggtccgactgatagcaatctctgtcctgaaaaacctgttgatcaagcactcttttgacgacagatatgcctcaaggtctcatcaggcccggattgccaccctttatctgcccctttttgggctcttgattgagaacgtgcagagaattaacgtgcgagatgtgagtcctttccccgtgaacgccggtatgaccgtgaaagacgagagtcttgcattacccgcagtgaaccccctggtcacacctcagaaaggctcaacattggataattctttgcataaggatttgctgggcgctattagcggtatagcaagcccctacaccacaagcacccctaatataaactccgtccggaacgctgatagcagaggctccctgatatcaactgactcagggaactcactgcccgagcgcaatagcgaaaaatccaattcgctagacaagcatcagcagtcttcaacgctgggaaatagtgttgtccgttgcgacaagctggatcagtcagaaatcaagtccttgctgatgtgtttcttgtacatactgaagtcaatgtccgatgacgccttattcacatattggaataaggccagcacaagcgaacttatggattttttcacaatttccgaggtatgtctgcaccaattccaatacatgggtaaacggtatatcgctagaaccggaatgatgcatgcccgcctgcagcagctggggtccctggacaattctcttacatttaatcactcctacggccactcggacgcagatgtgctccatcagagcttgctggaagctaatattgctaccgaggtttgcctcaccgccctggacacattgagtctcttcacactggcatttaaaaatcagctgctggcagatcatggccataacccactgatgaagaaagtcttcgacgtttacctgtgtttcctgcagaagcaccagtcagagaccgccctcaaaaacgtgttcaccgcattgcgcagcctgatttacaaatttccatctaccttttacgagggaagggcggacatgtgcgcggccctgtgttacgaaattctcaagtgctgtaatagcaaactgtcctccatacgtactgaagcctctcaattactatacttcctaatgcgaaacaactttgattatacaggaaaaaagagctttgttcggacgcacctccaggtgatcatctcagtgagccaactgatcgccgatgttgttggcatcggggggaccaggttccagcagtctctcagcatcataaacaattgcgccaactccgacagattaatcaaacacacctccttttccagtgatgtgaaagatctaactaaaagaatcaggacagtactgatggctaccgcccagatgaaggagcacgagaacgaccccgagatgctggtggacttgcaatattctttggccaaatcctacgcttcgactcctgaactgagaaagacatggttggactctatggccagaattcatgtcaagaacggtgatctgagtgaggcggctatgtgctacgtccatgtgacagccctcgtggccgaataccttactcgcaaggaggccgtacagtgggagccccctttgctgcctcatagccactcagcgtgcctcagaagatcccgggggggagtttttcggcagggttgcactgcatttagagtaatcacaccaaacatcgatgaagaagcttctatgatggaagatgtcggaatgcaggatgttcactttaacgaagatgtgcttatggagctgctggaacagtgcgccgatgggctgtggaaggctgaaagatacgaactgattgccgatatctataaactcatcattccaatctatgagaagcggagggactttgaacggctcgctcatctatacgacacattgcacagagcttattctaaggtgactgaggttatgcatagcgggcgtcggctgctgggcacgtacttccgtgtggcttttttcgggcaggcagcgcaatatcagttcactgatagcgaaaccgatgtggaggggttcttcgaggatgaggatggcaaggagtacatttacaaagagccaaaattaacccctctatccgaaatttcacagcgtctgttaaaattgtacagcgacaagttcgggtcagaaaacgtgaagatgatccaagacagcggcaaagtgaatcctaaggacctggatagcaagtacgcctatatccaggtcacacacgtcataccattttttgatgagaaggagctgcaggagcgcaaaaccgagttcgaacgctcgcacaatatccgcaggtttatgtttgaaatgcccttcacacagaccgggaagcgccagggcggcgtcgaggagcaatgcaagagaagaacaatactgactgccatacactgttttccatacgtcaagaaaagaataccggtgatgtatcagcaccacaccgatcttaatcccattgaggttgccatcgacgaaatgagcaagaaggtagcagaactccggcagctctgctcctctgccgaagtagatatgatcaaattgcaacttaagctacagggtagtgtttctgtgcaggtcaatgcgggtccgctggcctatgcgcgcgcgttcttagatgatactaacaccaagcggtaccctgataacaaggtgaagctgttgaaggaggtcttcagacaatttgtggaggcctgtggacaggctctggccgtcaatgagcggctgatcaaagaggaccagctggaatatcaggaagaaatgaaggccaattatcgcgagatggccaaggagctctccgaaataatgcacgaacaggtgcgcagatcagcaccatggcgtcgcaggagagccagctaccgcatcccctttacatcctcgacgccaagcgtaggccttcaacaggctcaatggtttaccggatag

SEQ ID NO: 46737 - DNA, 2175 bp, Artificial Sequence
  Description of Artificial Sequence: Synthetic coding sequence
atgcacgcccggctgcagcagctgggcagcctggacaacagcctgacgttcaaccactcttacggtcactctgatgctgatgtcctccaccagtcactgcttgaagcgaatatcgcgactgaggtttgcctcacagctttggatactttgtcactgttcactctggcttttaagaatcagctgcttgctgatcatgggcacaatccactcatgaagaaagtctttgacgtgtacctgtgctttctgcagaagcatcagtctgagacagcactcaagaacgtttttacggctcttcggtcactaatctataaattccctagcacgttctatgaaggtcgcgcagatatgtgtgccgccctctgttatgaaatcctgaaatgttgcaattctaagctcagcagtataagaaccgaggcaagtcagctcctgtattttttaatgaggaacaatttcgattacactggaaaaaaatctttcgtcagaacacacctgcaggtgattatcagcgtgtcacagctgatcgccgacgtcgtcggtatcggaggcactcggtttcagcagtccctgtctatcatcaacaattgcgccaactccgacagactgattaaacacacatctttctcttcagacgtcaaagatctcacaaaacgtattcggacggtgctgatggccaccgcacagatgaaagagcatgagaatgaccccgagatgttagttgacctgcaatatagcctggcgaaatcttatgcatcaacgcctgagcttagaaaaacatggctggatagcatggccagaattcacgtcaagaacggggacttaagcgaagctgccatgtgctacgtccacgtcacagcattagtggctgagtatctaacaagaaagggcgtatttcgtcagggatgtacagcgtttagggtaatcacccccaatattgatgaagaagcctctatgatggaagatgtgggtatgcaggatgtacacttcaatgaagacgttcttatggaattactcgagcaatgtgctgatggcctgtggaaagccgagcgctatgaactgattgccgatatctacaagctgatcatcccaatctacgagaagcggcgtgattttgaacgtctggcgcacctgtatgacacgctgcatagagcctactcaaaagttaccgaggtgatgcattctggccgccgcttattgggtacttactttcgtgtggccttcttcggtcagcaataccagttcaccgactctgagaccgatgtggagggatttttcgaggacgaagatggaaaggaatacatatacaaagagcccaagcttacgccattgagcgaaattagccagagactgcttaaattgtactcagacaagtttggcagcgagaacgtgaagatgattcaggacagcggtaaggtgaaccctaaggacctcgactctaagtacgcctatattcaggtcacgcacgttatcccattctttgacgagaaggagctgcaagagcgtaagactgagttcgaacgctcgcacaatataagacgtttcatgttcgagatgccgttcacccagaccggcaagagacagggcggggtagaggagcaatgcaaacggcgcacgattttaaccgcaatccactgctttccatacgtcaaaaagcgcattcccgtgatgtaccaacaccacactgacctaaaccctattgaggtagccatcgatgagatgtcaaagaaagttgctgaattgcgccagttgtgttcttcggccgaggtagatatgattaaactccagttgaaactccagggctccgtctcagtgcaggttaacgccggaccactggcatacgctcgagctttcctcgacgatacaaacaccaagagatacccagacaataaagtgaagctgctgaaggaagtctttcgccagttcgtcgaggcatgcggtcaagctctcgcggtgaacgaaagactcatcaaggaagatcaattggaataccaggaagaaatgaaggctaactacagagagatggctaaggaactctcagaaatcatgcatgagcagatctgccctctggaagagaagactagcgtgctgcccaatagcctgcacatattcaacgcaataagtggcacccccacatcgacaatggtgcatgggatgactagttctagttccgtggtctag

SEQ ID NO: 46738 - DNA, 6285 bp, Artificial Sequence
  Description of Artificial Sequence: Synthetic coding sequence
atgagccagccccccctgctgcccgccagcgccgagacccggaagtttaccagggctttgtccaagccggggacagccgctgagctgagacaaagtgtgagcgaagtggtgcgaggatcagtgctgctcgcaaagcctaagctcattgaaccgttggactatgagaacgtgattgtgcagaaaaagactcaaatcttgaatgactgcctacgggagatgcttctgttcccttacgatgactttcagaccgccattctccgacgccaaggacgctatatatgcagcactgtgcctgccaaggccgaagaagaggctcagtcccttttcgtgaccgagtgtataaaaacctacaacagcgattggcaccttgtcaactacaagtatgaggactactcgggtgagtttagacaactgcccaataaagtggtcaagctggacaaactgccagtccatgtgtacgaagtggatgaagaagtagacaaagacgaagacgcagcatctctggggtcacaaaagggcggcattacgaaacacggatggctttacaaaggtaacatgaactccgccatctcagtcacaatgagaagctttaagagacgattcttccacctcatccagctgggggatggcagctacaatctaaacttctataaggacgaaaagatctcaaaagaaccaaagggatctatcttcctagacagctgtatgggcgtggtacagaataacaaggttaggaggttcgccttcgaactgaaaatgcaagataaatcttcctacctgctcgctgcagatagcgaagttgaaatggaagagtggattaccatactcaataagattcttcaattgaatttcgaggctgccatgcaggaaaaacgtaatggtgacagtcacgaggacgacgaacagtcaaagttggaggggtccggatctggcctggactcctacctgcccgaactagccaagagtgcgcgcgaggcagaaattaagctgaaaagtgagtctagggtcaaacttttctaccttgatccagacgcacagaagttggacttctcaagcgccgaacctgaggtcaagtcattcgaggaaaaatttgggaagcgaattcttgtcaagtgcaatgacctgtctttcaacctgcagtgctgtgtcgccgagaacgaggagggacccaccacaaacgtcgaaccattcttcgtgactttgtctcttttcgatattaaatataataggaagatttcagctgatttccacgtagatctgaaccacttctctgtccggcagatgcttgccactactagtcccgctttgatgaacggctctgggcagagccctagcgtgcttaaaggcatccttcatgaggccgcaatgcagtatcccaaacagggaatctttagcgtgacatgtcctcatccagacatctttcttgtcgcccggattgagaaagtcctgcaggggtccattacccactgtgcagagccatacatgaaatccagtgattcatcaaaggtggcccagaaggtcctcaaaaacgccaaacaagcctgccagcgactgggtcagtatagaatgcccttcgcgtgggctgctcgcactctgtttaaggacgccagtgggaacctggacaagaacgcccgatttagcgctatctatcggcaagatagcaataagttgtcaaacgatgacatgctcaagctgcttgcagacttccggaagccagagaagatggctaaattgccagttattctgggaaatctggacatcaccatagacaatgtatcgtcagacttccccaattacgtgaactcttcctacatccccactaaacagtttgagacgtgcagtaaaacccccatcacatttgaagtggaggagttcgttccgtgtatacctaaacacactcagccttacaccatctacaccaatcatttgtacgtgtaccctaaatacctgaagtatgactcacagaagagcttcgcgaaagctcgtaacatcgccatctgcatcgagtttaaggattccgacgaagaagactcccaacctctgaagtgtatctacggtcggccaggcggccccgtgttcacccggtctgcatttgccgcagtgctccaccatcatcaaaaccccgagttttacgacgagatcaaaatagaactgcctacacagctccacgagaagcaccacctccttctcacattctttcacgtcagctgtgacaactccagcaaaggcagcaccaagaagcgcgatgtggtcgagacacaagtgggctacagctggctgcccctcttgaaagatggccgcgttgtgacgagtgaacagcacatccctgtttccgccaacctccctagcggatatctagggtaccaagagctcggcatgggcaggcactatggtcccgagatcaaatgggttgatggaggaaagcccttgttgaagatcagtactcacctcgtgtccacagtgtacacccaggatcagcatctgcataacttctttcaatattgccagaagactgagtcgggtgctcaagctctgggaaacgagctggtgaaataccttaagtcgttgcacgcaatggagggacacgttatgatcgcctttcttcccacgatcctcaaccagctgtttcgagtcttgactagagctacccaggaagaggtcgcagtgaatgtcacccgggtcatcatccatgtggtggctcaatgccatgaagaaggattggaaagtcatcttcggtcctacgttaagtacgcgtataaggccgagccctatgtggccagcgaatacaagaccgtgcatgaagagctaacaaaatcaatgaccaccattttgaagccaagcgcagattttctcacaagcaacaagcttctgaagtatagttggtttttctttgatgtgctgattaagagcatggctcagcatttgatagagaatagcaaggtgaagctgctccgcaatcaacgatttcctgctagctaccatcatgccgtggaaacggtcgtaaatatgttaatgcctcatatcacccagaagttcagggataacccagaggccagcaaaaacgcgaatcattcactggccgtgtttatcaagcgttgttttactttcatggatcgcggattcgtgttcaagcagattaataattacatcagttgcttcgcacccggggacccaaagacactcttcgaatataaatttgaattcctgagggtggtatgtaaccatgagcattacattccactgaacttgccgatgcctttcggcaaggggagaatacagcggtatcaggacctgcagctggattacagcctcaccgatgagttctgcagaaaccatttcctagtgggcttgttactgcgtgaggtgggaactgcgctgcaggaattccgagaggtgcgcctaatcgcaatttcagtgttgaagaacctcctaataaagcattcatttgacgatcggtatgcgagtcgaagccaccaggcaagaattgccaccctatatcttccactctttggccttttaatcgagaacgtacagcggatcaacgtcagggacgtgtcaccattcccagtgaatgctggtatgacagtgaaagatgagtccctcgcactgccggcggttaaccccttggtcactcctcagaagggcagtacactggataattcactgcataaggatttgttgggtgctattagtggcatcgcctctccatataccacatccaccccaaatatcaactcagtcaggaatgccgacagtcgcggctctcttatttctacagattctggtaactctttgcctgagcgcaactcagagaagtcaaactcactagacaaacaccagcaaagctcaaccttagggaattcagtggtgcggtgcgataaattagatcagagcgagataaagtcgctactcatgtgttttctatacatactcaagtcaatgagtgatgatgccctgttcacttactggaacaaggcttcaacaagcgagctgatggactttttcacaatttctgaagtctgcctacatcagttccagtacatgggcaaaagatacatcgcttccgttcgtaagatttcgtccgtcctggggatttctgtggataacgggtacgggcactccgacgctgatgtgctgcatcagtccctgctggaagccaatatagcaaccgaagtgtgtctgactgctttggacactctgtccctgttcaccttggcatttaagaaccagctactagccgaccacggccacaatccgctcatgaaaaaggtgttcgatgtatatctgtgtttccttcagaaacatcagagcgaaaccgccctgaaaaacgtatttaccgccctcagatccctgatctataaattccctagcacgttttacgaagggcgggcggacatgtgtgctgcactgtgctatgaaattctcaagtgctgtaattcaaagctgagctctatccggaccgaggcctctcagcttctctattttctcatgagaaataatttcgattacactggcaaaaagagtttcgttcgcacgcaccttcaggtgatcatctccgtctcacaactgattgccgatgtcgtgggcatcggaggtacaagatttcagcaatccctttccataatcaataattgtgccaactcagacagattaattaaacataccagttttagctcagacgtgaaggacctgaccaaaagaattagaacagtcctgatggctacagcccagatgaaagaacacgagaacgatccagagatgctcgtagacctgcagtactcccttgccaagtcatacgcatccactccggagctgcgaaagacttggctggattcaatggcacggattcatgtaaagaacggcgacctcagtgaagctgccatgtgttatgttcacgtgaccgcgctggtcgccgagtatctcacacgaaaggaggcagtgcagtgggaaccccctctcttgccccatagccactctgcatgcttgagaaggtcccggggcggcgtgttcagacagggatgtacagctttcagggtgattacccccaacattgatgaagaggctagcatgatggaagatgtgggaatgcaggatgtgcactttaatgaagatgtcctgatggaactgctagaacaatgcgcggatgggctgtggaaggcggaacgatatgagctgattgctgacatctataagttaattatacccatatatgaaaaaagacgagacttcgagcggctcgctcacttgtatgatacacttcatagagcttactcaaaggtgactgaggtaatgcatagcggtaggcggctgctggggacctatttccgggtagcgttcttcggccaggcagctcagtaccagttcaccgattctgaaaccgacgtcgaggggtttttcgaggatgaagacggcaaggagtacatatacaaggaaccaaaattgacgccactgagtgagatttctcagaggctcctcaagctatattccgacaagttcggctcagaaaacgtgaagatgattcaggacagcgggaaggtgaatcctaaagatctcgactccaaatacgcatatattcaggtcacccacgtgatcccattctttgatgaaaaggagttgcaggaacgcaaaacagaatttgagcggtcgcacaacatccgcaggtttatgtttgagatgccttttacccagaccggcaagcggcagggcggcgtcgaggagcagtgcaaaagaaggacgatcttaacggccatccattgcttcccctacgttaaaaaacgcattccagtgatgtaccaacaccatacagatctgaacccaattgaggtggctatcgatgagatgtccaagaaagtcgccgaactcagacagctctgcagctccgccgaagtggacatgatcaaattgcagcttaagctccagggctctgtcagcgtgcaggtgaatgccggacccctggcatacgctcgagccttcctggatgacactaacacgaaacgttaccctgacaacaaggtcaagctcctgaaggaagtgttccgtcagtttgtggaggcttgcggccaggcactcgcagtaaacgaacgtttaatcaaagaggaccagctggagtaccaggaagaaatgaaggccaattacagagaaatggccaaggaactgagcgaaatcatgcacgagcaggtgcggcgaagtgcaccttggcgccggcggagggcgtcgtaccgaatcccttttacttccagcacccccagcgtcggactccagcaggcgcagtggttcacagggtag

SEQ ID NO: 46739 - DNA, 6207 bp, Artificial Sequence
  Description of Artificial Sequence: Synthetic coding sequence
atgcaggccgacaagtgccggaccagcagccggagcgtgaagaaggaactcgtgattgagtccccactgcagtataaagacgccgcacagggagaggtggaggcggaaagtcctgggcccgtgccagccaaaccaaaattaatcgagccactcgactatgagaatgttattgtgcagaagaaaacacagatcctgaatgattgcctgcgggagatgttactgtttccgtatgatgactttcagactgctattttgagacgccagggccgctacatctgctccaccgtgcccgccaaagccgaagaagaggctcagagtttgttcgttactgagtgcattaaaacctacaattctgactggcaccttgtgaattataagtacgaggattacagcggcgagtttcgccagctgcctaacaaggtggtgaaattggacaagcttccagttcacgtctatgaggttgacgaagaagtggacaaagatgaagatgcggcaagcctgggaagccagaaaggtggcattaccaagcatgggtggctctacaagggcaacatgaactccgccattagtgtgacgatgaggtcgtttaaacggagattctttcacttaatccagttgggagatggttcgtataacctcaatttttataaggatgaaaagatctcgaaggaaccaaaagggtctatctttctagacagttgcatgggcgttgttcagaataataaggtgaggagattcgcctttgagctgaagatgcaggacaaatcctcctatctgctcgccgccgactccgaagtggagatggaggagtggataacaatcctcaacaaaatcctgcagctgaatttcgaggcagctatgcaggagaagcggaacggcgactctcacgaggatgacgagcagagcaagctagagggatcaggctccggactcgactcatatttacctgaactggcaaagtctgctagagaggccgaaatcaaactgaagtcagagagtcgcgtgaagttattctatctcgacccggatgctcagaagctcgatttttctagtgccgaaccagaggtgaagtcctttgaagaaaaatttgggaagagaatactagtcaaatgcaacgacctgtcgtttaatctccaatgttgcgtagccgaaaatgaggaaggccctactaccaatgtcgagccttttttcgtgaccctgagcctctttgatataaagtataacagaaagatttcagcggattttcacgtcgatctgaaccattttagtgttagacagatgctggcaacaacttcacccgcgctgatgaacgggtcaggacagtccccgtccgtgcttaagggcattctccacgaggcagccatgcagtatccaaagcaggggatcttttctgtcacatgtccacatcccgacattttcctggtggcccgtattgaaaaggttctgcagggcagcattactcattgtgcagaaccttatatgaagagctctgacagctcaaaagtcgcccagaaggtgctgaaaaatgcgaagcaggcatgccagagactaggacagtaccgcatgccattcgcctgggccgcccgtaccctattcaaagatgccagtggcaacctggacaaaaacgctcggttctcagcaatttacagacaggatagtaacaagctttctaacgacgacatgttgaagctgttggcagacttcaggaaaccagagaagatggccaagctccctgtgatcctcgggaatctagacattaccatagacaatgtgtcctctgatttccccaattacgtgaactcctcttacatcccaacaaagcagttcgaaacatgctcaaagacacctataacgttcgaagtcgaggaattcgtgccttgtatcccaaagcacactcagccgtatactatctatactaatcacctctatgtgtaccctaaatacctaaaatatgactcccaaaagagctttgcaaaggcccgcaacattgctatttgtattgaatttaaagactctgacgaggaagatagccagcctctcaagtgcatctacggaagacccgggggccctgtctttacgaggagtgcctttgcagccgtgttgcaccaccatcagaatcctgagttctacgatgaaattaaaatcgagctgcccactcagctgcacgagaagcatcacctgctcttgactttcttccatgtgagctgcgacaacagcagcaagggctccacaaagaagagagatgtagtagaaacccaagtaggatactcttggctcccattactgaaagacggtcgagtcgtgacctccgaacaacatatccctgtgagcgctaatctcccttctggctatctgggctatcaagaactcggtatgggacggcattatggacccgagataaagtgggtggacggtggtaagcccctgctgaagatctcgactcatctcgtgtccaccgtatatacccaggatcagcatctccacaatttttttcagtactgtcaaaagactgagtccggggcccaagccctgggcaacgaactggtgaagtacctgaaaagtctgcacgccatggaagggcacgtgatgatcgcattcctgcccacaatcctcaaccagctgttccgcgtgttgaccagagccacccaggaggaggtcgccgtcaatgtgactagagttataatccacgtggtggcccagtgtcatgaggaggggttagagtctcatctgcggtcatacgtcaagtacgcctacaaagctgaaccgtacgttgccagtgaatataagactgtccacgaggaattgacaaagagcatgaccactatactcaagccaagcgcagacttcttgacgtctaataagctgctgaagtactcgtggttcttcttcgacgttctgatcaagagtatggctcagcatcttatagaaaactctaaggttaaactgcttaggaatcagcggtttccagcaagctatcatcatgccgtggagacggtggtcaatatgctcatgcctcacataacccaaaagtttagagataacccggaggcaagcaaaaacgccaatcatagcttggccgtgtttattaaacgctgtttcaccttcatggatcgaggatttgtgttcaagcaaattaacaattatatcagctgtttcgcaccaggggacccaaaaaccctatttgagtacaaatttgaatttcttagggtggtgtgtaatcacgagcactatatccccctcaacctccctatgccttttggcaagggacgcattcagaggtaccaagacctgcagctggattactcactgacggacgagttctgccgcaatcatttcctggttggattgctgttgcgggaagtgggaaccgcactacaggaattcagggaagtgaggttgatcgcaatttccgtgttaaaaaatctcttgattaagcactcctttgatgatcggtacgcatctcgttctcaccaggctcggatcgccaccctttatctgcctctctttggcctcttaatagagaatgtgcaaaggatcaatgtgagggatgtgagccccttccccgtcaacgccggtatgacggtgaaagatgaatctctggctcttccagcagtgaatccactggtgacccctcaaaaaggtagtacactggacaactcgctccataaggatctactcggcgccatcagtggaattgctagcccatatacaaccagcaccccaaacatcaactctgtgcgaaacgccgactcaaggggttccttaatcagtacagatagtggcaactcattgcccgagcgaaacagcgagaagagcaactcactggacaaacatcagcagtcttcaaccctcggcaacagtgtggtgcgttgtgataaactcgatcagtctgaaatcaaaagcttgttgatgtgctttctgtatattttgaaatctatgagcgatgatgccctttttacatattggaacaaggccagtacctctgagctgatggacttctttactatttctgaggtgtgtttgcatcagttccaatacatgggtaaaagatacatcgctcggactgggatgatgcacgcccgtctgcaacagctgggcagcctggataatagtctgaccttcaaccactcctatgggcattcggatgccgatgtgctccatcagtccttactagaggcaaatattgccactgaggtttgcctcaccgcacttgacactttgagcctcttcactctggcgttcaagaaccagctcctggcggatcatgggcacaaccccctgatgaagaaggtgtttgacgtctacttatgctttcttcaaaaacaccagtccgaaactgccctgaaaaacgttttcaccgccctgcgcagcctcatttataaattcccttccactttctacgaggggagggccgacatgtgtgctgctctttgttatgaaatcctaaagtgttgcaactctaagctgtcatctataaggacagaagccagtcagcttctctatttcctaatgcggaacaacttcgactacacagggaaaaagtccttcgtccgcacacatctgcaggtgatcatcagcgtgtcccagcttattgccgatgtggtaggaattggcggtacacgatttcaacagtcattgagcataattaataattgtgctaatagtgatagactcattaagcatacgtccttttcatctgacgttaaagacttgacaaaacggattaggacggtcctcatggcaaccgcacagatgaaggagcatgaaaatgacccagagatgctggtggacctgcagtactcactcgctaagagttacgcaagcactccagagctgcggaaaacctggctggattctatggctcgcatacatgttaaaaatggagacctgtccgaagccgccatgtgttatgtccacgtaaccgctcttgttgccgagtatctgacgaggaaggaagccgttcagtgggaacctccccttctgccacactcgcatagcgcttgcctgcggcgctctcggggtggagtgttcagacaggggtgtaccgcctttagggtaattaccccaaatatcgatgaagaggcttccatgatggaagatgtaggaatgcaggacgtccatttcaatgaagacgtcctcatggaacttcttgaacagtgtgctgacggtctgtggaaggccgagcggtacgagctgatcgcagatatttataaactgatcatacccatttacgagaagaggcgcgatttcgagaggctggcccatctgtatgacacccttcatcgagcgtatagcaaggtaacagaggtgatgcactcaggtcgcaggcttctcggaacctactttcgagtggcattctttggccaggccgcacagtaccagtttacagattccgagaccgacgtcgagggcttcttcgaggacgaagacggaaaagagtacatctacaaagaacccaaattgactcccctttctgagatatctcagcggctcttaaagctgtactctgacaagttcggttccgaaaacgtaaaaatgatacaagattcaggcaaggtgaaccctaaagacttggactccaaatacgcttatatacaggtgacccatgtaattcctttcttcgatgagaaagagctgcaggagcgcaagactgaatttgaacgtagccataatattcgacgatttatgtttgaaatgcccttcacccagacagggaaaagacaagggggggtggaagaacagtgtaagcgtcgcaccatactaacagccatacactgcttcccgtacgtgaaaaagcgtatcccggtgatgtaccagcaccatacggacttaaatcccattgaagtggccatcgatgagatgtcaaagaaggtggccgagctccggcagttgtgctcaagtgccgaggttgacatgatcaagttgcagctaaaattacagggcagtgtgagtgtgcaggtgaatgcaggcccgctcgcgtacgcaagagctttcctcgatgacacaaacactaagcgttacccagacaacaaggtgaagctcttaaaggaggtttttcggcagttcgtggaagcctgcggacaggctctcgcagtgaacgaaagactcatcaaagaagaccagcttgagtaccaggaggaaatgaaagccaattatcgcgagatggctaaagagctcagcgaaatcatgcacgagcagctaggctag

SEQ ID NO: 46740 - DNA, 3030 bp, Artificial Sequence
  Description of Artificial Sequence: Synthetic coding sequence
atgcccttcggcaagggccggatccagcggtaccaggccttcctgagccctactgtcgaatccaatgacacacctgtggaccttcagctcgactactcactgaccgatgaattctgcagaaatcattttttagtgggcctcctgttgcgggaggtcggaactgccttgcaggaattcagggaagtgcgcctcattgcaatttccgtgctgaagaatctgctgatcaaacatagcttcgatgacaggtatgccagcagatctcatcaggccagaattgccacactctacttacccctcttcgggctgttgatcgagaacgtccagcgcatcaacgttagggacgtttcacccttccctgtgaacgccggaatgacagtgaaagatgaaagtctggctctcccggccgtgaacccactcgtgactcctcagaaaggcagtactcttgacaactcactgcacaaggatctcctgggagctatttcaggcatcgcaagtccttatactacaagcaccccaaatatcaactcagtccggaacgccgattccaggggaagtctgatatccacagactctggaaattctttgcccgagagaaactctgaaaagagcaatagcctggataaacatcagcaaagctctacgttaggtaacagcgtcgtgagatgtgataagcttgaccagtcagaaattaaatctctgctcatgtgcttcctctacatactgaaatcgatgagcgacgacgcattgtttacttactggaacaaggcatccacatctgagctgatggacttcttcactattagcgaggtgtgcctgcatcagtttcagtatatgggcaaacgttacatcgcaagaactggtatgatgcatgcccgactgcaacagttgggttctctggacaacagtcttacattcaaccattcatacggtcactctgacgcagacgtgctgcatcaatctttactagaagccaacatcgctactgaggtttgcctgacagctcttgatacactgagtctctttacattagcctttaaaaaccaactactggcagatcatgggcacaatcccctcatgaagaaggtattcgacgtgtatctctgcttcctccagaagcatcagagcgagaccgcgctgaaaaatgtgttcacagcactcaggagcctcatttacaaattcccttctactttttatgaagggcgcgctgatatgtgcgcagcactttgctacgaaatcctgaagtgctgcaatagcaagctgtcaagcatccgaacggaagccagccaactgctgtatttcttaatgaggaacaatttcgattacactggtaaaaagtcatttgtccgaacacatttacaggtgatcattagtgtgtcgcagctcatcgctgatgtggtgggcattgggggaacccggtttcagcagagcctgagtattatcaataattgtgctaactcagaccggctaattaagcatacgtctttctcttcggatgtaaaagatctaacaaaacggattaggactgtgctcatggccacggctcaaatgaaggaacatgaaaatgacccagaaatgctggtggacctgcagtactcccttgccaagtcatatgcatcgacaccagagttgagaaaaacctggcttgactctatggcgcgcattcacgttaagaacggcgatctgtcagaggcagccatgtgctacgttcacgtaacagccctggtcgcagagtatctcaccagaaaaggagtcttcaggcaaggatgtacggcttttcgggtaatcactcccaacattgatgaagaggcttctatgatggaggacgtcgggatgcaggacgtgcatttcaacgaggatgtcctgatggaattattagagcagtgcgcggatggtctatggaaggccgagcggtatgaactcatcgctgacatttacaaattaattatccccatttatgagaagcgtagagatttcgagagactagcccacctctacgacaccctacacagggcttacagtaaagtcactgaagttatgcacagtggccgacggctcttgggtacctatttccgagtagctttttttggtcaggccgcacagtaccaattcacagactctgagactgatgtggaaggattctttgaagatgaagacggcaaggaatatatttacaaagagccaaaactgacgcccctctcagaaataagccaaagattgctgaagctctactctgacaagttcggttccgagaatgttaaaatgatccaggattctggaaaagtgaacccaaaagatcttgattctaaatatgcatacattcaagtcacccatgtgatccccttcttcgatgaaaaggagctgcaggagcggaaaacggaattcgagcgaagtcacaacattcgcagattcatgtttgagatgccctttacccaaacaggcaaacgccaggggggcgtagaggagcagtgcaagcgccgtacgatcctgacagctatacattgttttccctacgtgaagaaacggattcctgtaatgtaccagcatcacactgatcttaatcctatcgaggtcgctattgacgaaatgtctaaaaaagtggctgaactgagacagctttgtagctccgcggaggtggatatgatcaagctgcagctgaaacttcaggggagcgtgtctgtgcaagtaaacgctggacccttggcttacgccagggcctttctggacgacaccaatactaagaggtaccctgataataaggtcaagttactcaaagaagtttttcggcagttcgtcgaggcttgcggccaagcattggctgttaatgagaggcttataaaagaggatcagttggaataccaagaggagatgaaggcaaattaccgggaaatggccaaggaactgtcggagatcatgcacgagcaggttcggcggagcgcaccctggcgccggcggcgcgcgagctatagaatcccttttacttctagcaccccatctgtcggactgcagcaggcccaatggtttacgggatag

SEQ ID NO: 46741 - DNA, 2010 bp, Artificial Sequence
  Description of Artificial Sequence: Synthetic coding sequence
tgattcaagaaccagctgctggccgaccacggccacaaccccctgatgaagaaagtctttgacgtctacctatgctttctgcagaagcaccagtccgaaaccgcactcaaaaatgtgttcactgccctccgctccttaatctacaagtttccgtcgacattttacgaaggaagagcagacatgtgcgccgcactgtgttacgaaattttaaaatgctgtaattcaaaactttcatctatcaggacggaggcatcacaacttctgtatttcctgatgagaaataatttcgattacaccgggaagaaaagcttcgtaaggactcatctccaggtgataatcagtgtgtcgcagctcatcgcagatgtcgtgggaattggaggaaccagattccagcagtctctgagcattatcaataactgcgctaactctgacaggctcattaagcacacaagcttctcatctgatgtaaaggatttgacgaagcggatccgcactgtgctcatggcaactgcacagatgaaggaacacgagaatgaccccgagatgctggttgacctgcagtactctctcgctaagtcttacgcatccacacctgagctgcgaaagacctggctagatagcatggccagaatccacgtgaagaatggcgacctatccgaggccgctatgtgttacgtgcacgtcactgcgctagtcgccgaatatttgacccgaaagggcgtgtttcgtcagggctgcacagcatttcgggtcatcaccccgaacatcgacgaagaagcctccatgatggaggacgtgggcatgcaagacgtgcattttaatgaagacgttctgatggagctgcttgagcagtgcgccgatgggctctggaaagcagagaggtatgaattaattgccgacatttacaagctgattatccctatttacgagaaaaggagagacttcgagaggctagcgcacctgtatgacacactgcaccgggcctattctaaggttaccgaagtcatgcacagtgggcgtcggctgctgggcacatattttagggtggcattctttgggcaacagtaccagttcacagactcagaaactgatgtggaaggcttcttcgaggacgaagatggcaaggaatacatctacaaggagcctaagctcacacccttgagcgaaatatctcaacgccttctcaagctctactccgacaagttcgggagcgaaaacgtcaagatgattcaggacagtggcaaagtcaatcctaaggatctggattctaagtacgcctatattcaggtgacacatgtaatcccgttcttcgacgagaaggagctgcaggagagaaaaaccgagtttgagaggtctcataatatcaggaggttcatgttcgagatgccattcacccagaccggcaagcgccaaggtggcgtggaagagcaatgtaagcgccgaactattctcacagccatccactgcttcccctatgtcaagaagagaatcccagtgatgtatcagcatcacaccgacctgaaccctatagaagtcgccattgatgaaatgtccaagaaagtggcagagctgaggcagctatgctcctccgctgaagtggacatgatcaaactccagttaaagctgcagggctcagtatctgttcaggttaacgcaggccctctcgcttacgccagagccttcctggatgatacaaacactaaacgttatcctgataacaaagtcaaactacttaaggaggtgttcaggcagttcgtagaagcctgcggccaggccttggccgtaaacgagcgcctcataaaagaggatcaacttgagtatcaagaagagatgaaggccaattatcgggaaatggctaaggagcttagcgagatcatgcatgagcaaatctgtcccctggaagagaagacctcagtccttcctaattccctacacatcttcaacgccatctcaggcacaccaacttctaccatggtgcacggcatgacatcatcatcatctgtggtgtag

SEQ ID NO: 46742 - DNA, 6240 bp, Artificial Sequence
  Description of Artificial Sequence: Synthetic coding sequence
atgagccagccccccctgctgcccgccagcgccgagacccggaagttcacccgagccctgtcaaagcccggcacagcagccgaattgcggcaaagtgtgagcgaagtcgtccggggttccgttcttctcgccaaacctaagctgatagagccccttgattatgaaaatgtgatagtgcagaaaaagactcagatcctcaacgattgtttaagagagatgctgctatttccctatgatgactttcagactgccatactgcgccggcagggacgatacatatgctcaactgtccccgctaaagcagaagaggaggctcaatctcttttcgtcacagagtgtatcaaaacctacaactcagactggcacctggtaaattacaagtatgaggactacagcggggaatttagacaacttccgaataaggttgttaaactcgacaaactgcccgtccacgtctatgaagtggatgaggaagtggataaggacgaggacgcggccagccttggttctcaaaagggggggatcactaagcatggatggctctataagggcaatatgaactcggccatcagtgtaacgatgaggagcttcaaacgccgtttcttccacctgattcagctgggagacggttcttacaatctgaacttctataaagacgagaaaatatcaaaagaaccaaaaggcagtatcttcctcgattcgtgtatgggagttgtgcagaataacaaggtccggcggtttgcattcgaactcaagatgcaggacaagagctcttacctattggctgcggacagcgaggtggaaatggaggagtggatcacaattctcaataagattctacagctcaacttcgaagccgctatgcaggagaagagaaacggcgactcccacgaggatgacgagcagtcaaagctcgaggggagtggtagtggactggattcatacttaccagagctcgcgaaaagcgccagagaagccgaaatcaaacttaagtcagaaagcagagtgaagctgttctacctggatccagacgcgcaaaagttggatttctcgagcgctgaacccgaggtcaaaagcttcgaggagaagttcggaaagcggattttagtgaagtgtaacgacctaagctttaatcttcaatgttgcgtagccgaaaatgaggaaggtccgactacaaatgtggagccctttttcgtgacacttagcttattcgatattaagtacaatcgtaagatatccgctgattttcatgtggacctcaatcatttctcagttcgccagatgttggccactacgtcacccgccctgatgaatgggagtggccagagcccaagcgtgctcaaggggattctgcacgaagcggccatgcagtatccaaagcagggcatcttctctgtgacatgcccccatccagatatttttctggtggcaaggattgagaaagtgcttcaaggatcgatcactcattgcgctgagccgtatatgaagagttctgactcgagcaaagtagcccagaaagtccttaaaaatgcaaagcaggcatgccagcgtctgggacagtataggatgccatttgcttgggcagcccggaccctgtttaaagacgccagtggtaatttagataagaacgcccggttttctgccatctacagacaagatagcaacaaactgtccaacgatgatatgctgaaactgctggcagattttcgcaagcctgagaaaatggcaaaattgcctgtgatcctgggcaacctggacattactattgacaatgtctccagcgattttcccaactacgtaaattcatcctacatccctactaaacagttcgagacgtgttccaagaccccaatcacattcgaggtggaagagttcgtcccttgtatcccgaagcacacccagccttacactatctatacaaatcatctgtatgtctaccctaagtatcttaagtatgactcgcaaaagtcttttgcaaaggcccgaaacatcgctatttgcatagaatttaaggacagcgatgaagaggattcgcaaccattaaagtgcatctacggaaggcccggaggtccagtcttcacccgctccgccttcgcagccgttctgcatcaccatcagaaccccgaattctacgacgagattaagatcgagttgcccacccagctgcacgaaaaacatcacctcttactgaccttctttcatgtttcttgcgacaattcaagcaagggcagcacaaaaaagagggatgtggttgagacacaggtcggatacagttggctccccctgttgaaggatggacgggtggtcacatcggaacagcatattcctgtgtccgccaatctcccgtcaggctatctcggctaccaggagcttgggatgggtcggcattatggaccagaaattaaatgggtggatggcgggaagcccctcctgaaaattagcacacaccttgtgtccacggtgtacacgcaggaccaacacttacacaacttcttccaatactgccagaaaacagagtctggagcacaggcactgggtaacgagctcgtgaaataccttaagtcgctccatgcgatggaggggcacgtcatgatcgctttcctgccaacgattctgaatcagctttttcgggtcctcactagggcaactcaggaagaggttgccgttaacgtgacccgggtgatcatccatgttgttgcgcagtgtcacgaggagggcctggaatctcatctcagatcttatgtcaagtacgcatacaaagccgaaccatacgtggcgtcagagtacaaaaccgtgcacgaagagctaactaaaagtatgaccaccatcctaaagccgagcgccgacttcctcacaagcaataaattgctgaaatactcctggttcttcttcgatgtcttgattaagtccatggctcaacacttaatagaaaactcaaaagtcaaacttctgcggaaccaaaggtttcctgcttcttatcatcacgccgtcgaaactgtggtgaacatgttaatgcctcacatcacgcagaaatttagggacaaccccgaagcctcgaaaaacgccaaccacagcctcgcggtcttcatcaaacgttgtttcacattcatggaccgcggctttgtctttaagcagattaacaattacatctcctgcttcgcgccgggtgaccctaaaacactttttgagtacaagttcgagtttctgagagtcgtttgcaatcacgagcactacattcccctgaacctgccaatgccgttcggcaaggggaggattcagcggtatcaggatctgcagctggattattctctgaccgatgagttttgtcgaaatcacttcttggtcggtctgcttcttagggaggtcggcaccgctctgcaggagtttcgcgaggttcggttgatcgccataagtgtgttgaagaatttgctcatcaagcacagcttcgacgaccggtacgcaagccgctctcaccaggcccgcatcgcgaccctttatctgcccctcttcggtctgctcattgaaaacgtgcaaaggatcaatgtgcgggatgtgagtccattcccagtgaatgccggcatgacagttaaagacgaatccttggcactgccagccgtgaatcctctggtcactccacagaagggtagcacactggataacagcctgcataaagacctgttaggtgccattagcgggatagcgtccccctataccactagtaccccaaatattaacagtgtgcgaaacgcagactcacgtggcagtttgatttctacagattcaggcaattccctcccagagaggaattccgaaaagtcaaattctctcgataaacaccagcagtcgagcacactcggcaatagcgttgtccgctgcgacaagctagaccaatccgagatcaagtctctgttgatgtgcttcctgtacatcctgaaatcgatgtcagatgacgcattgttcacgtactggaacaaggctagcacttctgagttgatggatttctttactatctcagaagtgtgtctccaccaatttcagtacatgggcaagaggtacatagctcgtactggaatgatgcatgccaggctgcagcagctgggcagcctggacaacagtttgaccttcaaccatagctacggccattccgacgctgacgtactgcatcaatctctcttagaagcaaacatcgccaccgaggtctgccttactgcccttgacaccttgagcctgttcaccttggcgtttaaaaaccagttgctcgccgaccatggccacaacccgctgatgaagaaagtctttgatgtttacctgtgttttctgcagaaacaccagtcggaaacggctctgaaaaacgtgtttacggcacttcgtagtcttatttataagttcccctctactttctatgagggccgcgctgacatgtgcgccgcgctatgctacgagattctgaagtgttgcaatagtaaactgagctctatcaggacagaagcctcgcagctgctgtattttttgatgcgcaataattttgactacacgggcaagaaatccttcgtgaggacgcacctgcaagtgatcatctcggtgtcacaactgattgcggatgtggtgggcataggaggtactagattccaacaaagccttagtattataaataactgcgccaatagcgatcgactgatcaaacacactagcttttcttctgatgtgaaggaccttactaaacgcatcagaactgtgttaatggcaacagcccagatgaaggagcacgaaaatgatcctgagatgctggtagatctgcagtattctttggccaaatcctacgctagcactcctgagctaaggaaaacatggcttgactctatggccagaatccacgtgaagaacggtgatctatcagaagctgctatgtgttatgtccatgtgactgcgcttgtggctgagtacctgacccgcaaaggcgtgtttcgccagggctgtacggccttccgtgttattacccccaacatcgacgaggaggcctcaatgatggaagatgtgggaatgcaggatgtccacttcaacgaggatgttctcatggagctgctggagcagtgcgccgacggcttgtggaaagcagagaggtatgagctgatcgctgatatttataagcttatcatccccatctatgaaaaaagacgggactttgagcggttggcacatctgtatgacaccctgcatagggcctattctaaagtgacagaggtgatgcacagcggcaggcgcttgctcggcacgtatttcagggtcgcgttcttcggacaggcagctcagtaccagttcacggactcagagacagacgttgagggtttctttgaggatgaggatggcaaagaatatatttataaggaaccaaaactgacaccccttagcgagatttcgcagcgcctgctaaagctgtatagtgataagtttggcagcgagaacgtgaagatgatccaagattccggcaaggtgaatcccaaggatctggacagcaagtatgcatacatccaggttacacacgtgattcctttttttgatgagaaggaactgcaagagcgcaaaactgaattcgagaggtcacacaacatcaggagatttatgtttgaaatgccttttacccaaacggggaagcggcaggggggcgtggaagaacaatgcaaaaggcgcacaatcctgacggctattcactgcttcccatacgtcaagaagcgcatccctgtcatgtaccagcaccataccgacctgaacccaatcgaagtcgcaatcgatgagatgtctaagaaagtcgctgagctgcgccagctctgcagtagcgcagaggtggacatgatcaaactccagctgaagctccagggatccgtcagcgtgcaggtgaacgcgggacccctggcatatgcccgggctttcctcgatgataccaatacaaaaaggtacccggacaacaaagttaagttgctgaaggaggtttttagacaattcgtggaggcatgcggccaagccctggcggtgaatgagcgactaatcaaagaggaccagctagaataccaggaagagatgaaggcaaactatagagaaatggctaaggagctctccgaaattatgcatgagcaggttcggagatctgccccctggagaagacggcgcgcatcctatcggattccatttacctcgagcacaccgtccgtgggcttgcagcaggcccaatggttcaccggctag

SEQ ID NO: 46743 - DNA, 1173 bp, Artificial Sequence
  Description of Artificial Sequence: Synthetic coding sequence
tgacagatgaaggagcacgagaacgaccccgagatgctggtggaccttcagtactctctcgccaagtcatacgcatctactcccgagctgaggaaaacctggctggattcgatggcccggatacacgtgaaaaatggtgacctgtccgaggccgctatgtgctacgtgcacgtcactgccctggtcgcagaatacctgacccgtaaagaggccgttcagtgggagccccccctgctgccccatagccactccgcttgtttgcgccgcagcagaggcggtgtctttcggcagggctgtactgcttttcgggttatcacccctaatatcgacgaagaggcgtcgatgatggaggacgttggtatgcaggatgttcattttaatgaggacgtgctgatggaattactagagcagtgtgctgatgggctgtggaaggcggaaaggtacgagctgattgccgatatatacaagctgatcatacccatctacgaaaagagacgtgactttgaacgcctggcccatttatacgataccctgcacagggcatatagcaaagtcacagaggtgatgcactccggccgcaggctcctcggcacctacttccgcgtggccttcttcggacaaggcttttttgaagacgaggatggcaaagaatacatctacaaagaaccaaaactcacacctcttagcgagatcagccaacgactcttgaaactgtattctgataaattcggcagtgagaatgtaaaaatgatccaggacagtggcaaggtgaacccaaaagacttagattcaaaatatgcttatatccaggtgacgcacgttatccctttttttgacgagaaagaactgcaggagcggaaaacagagttcgagagaagtcataacatacgtcggttcatgttcgaaatgcccttcacgcaaaccgggaagcggcaagggggcgtagaggaacagtgcaaacgccgaacgattctcactgcgatccattgcttcccttacgtgaaaaagagaatacctgtgatgtatcagcatcacactgacctgaatcctattgaagtagcaattgatgagatgtccaaaaaagttgctgaacttaggcagttatgctcaagcgcggaggttgacatgataaaacttcagctgaagctccaggggagcgttagtgttcagtag

SEQ ID NO: 46744 - DNA, 588 bp, Artificial Sequence
  Description of Artificial Sequence: Synthetic coding sequence
atgagccagccccccctgctgcccgccagcgccgagacccggaagttcacaagggctctgagtaaaccagggaccgccgccgaactgcggcagagcgtgtccgaagtagtgcgggggagcgtgctgctagccaaaccaaagttaatagagccactagactatgaaaacgtcatcgtacaaaagaagacacagatactcaatgattgcctgagagagatgcttctgttcccttacgatgatttccaaaccgcgatcttgcgacggcaggggcgctacatctgttcaactgtacctgcaaaggcagaagaggaggcgcagtcattgttcgtaacggagtgcatcaaaacatacaattccgattggcacttggtcaattacaaatatgaagattacagcggagagttccgacagctgcctaacaaggtagtgaaactagataaattaccggtacatgtgtacgaggttgatgaggaagtcgacaaggacgaggatgcagcatcactgggatctcagaagggaggaattacgaagcatggctggctctacaagggtaatatgaattcagctatctcagtcaccatgagatag

SEQ ID NO: 46745 - DNA, 6306 bp, Artificial Sequence
  Description of Artificial Sequence: Synthetic coding sequence
atgcaggccgacaagtgccggaccagcagccggagcgtgaagaaggaactagtgattgaatcccccctgcagtataaggatgctgcgcagggggaggtggaagctgagagtcctgggccggttccggcaaagcccaagctaattgagccactagattacgaaaacgtgattgttcagaagaagacccagatcctgaacgactgtctccgggagatgctcctgtttccttacgacgatttccaaaccgccatcctacgccgacagggtcgatacatttgttcaacggtgcctgccaaagccgaggaggaggcccaatcgctttttgtgactgaatgtatcaagacttacaattccgactggcatctggtcaactataaatacgaggattattcaggtgaattcaggcagctgccaaataaggtagtcaagcttgataagctgcctgtgcacgtctatgaagtcgatgaggaggtagacaaggacgaagatgcggcatcacttgggagccagaaaggggggattactaagcacggttggctttacaaaggtaacatgaatagtgcgatctccgtgactatgagaagcttcaagcggcggttctttcacttgatacagctgggagacggcagttataacctgaacttttacaaagacgagaaaatctcaaaggagcctaagggttctatcttcctggatagttgtatgggtgtggtgcagaacaacaaagtcagaagattcgctttcgaactcaaaatgcaggataaatcctcgtatctcctcgccgcagattccgaagtcgagatggaagagtggataacaattctaaacaaaatcttacaactcaactttgaggcagccatgcaggagaaacgtaacggggactctcatgaagacgacgagcagagtaagctggaagggagtgggtccggcttggattcatacctcccagagctggctaaatctgcaagggaggccgaaatcaagctgaaaagtgagagtagagttaagctgttttaccttgaccctgatgcacagaagctcgactttagttctgcagaacccgaagtgaagagctttgaggagaagttcggtaagcggatattagtcaagtgtaatgacttgtccttcaaccttcaatgctgcgtcgccgagaacgaagagggtcccaccactaatgtggagccatttttcgtgaccttgtctctgttcgatattaagtacaatcgtaagataagtgctgacttccacgtggacctcaaccatttttccgttagacaaatgttagcgacaacttctcccgcactgatgaacggatccggtcaaagtccctcagtactgaagggaattttgcacgaggccgcgatgcagtacccaaagcagggaatcttctcagtaacctgcccgcatccagatatctttctggtagcccgcatcgaaaaggttttgcaaggctcaatcacacattgcgccgagccctatatgaagtcgtctgatagttcgaaggtggcacaaaaggtgctcaagaatgcaaagcaggcctgtcagcggttaggccagtatcggatgcccttcgcttgggccgcacggactctgtttaaggatgccagcgggaatctggataaaaatgcccgattttccgcgatatacagacaggatagtaacaagcttagcaacgatgatatgctgaagctgctggccgattttcgaaagccagagaagatggccaagctgcctgtgatcctaggaaatctggacattaccattgataatgtctcttccgacttcccaaactatgtgaactcctcgtacataccaaccaagcagttcgaaacatgttccaaaacccccattacttttgaagtcgaagagtttgtcccatgtattcccaaacacacccagccctatacaatttataccaatcacctgtatgtctaccccaaatatttaaagtatgattcacaaaaaagttttgcaaaagcgagaaacatagccatttgcattgagttcaaagactccgatgaggaagacagccaaccattaaaatgcatctacgggagaccgggaggccctgtctttaccaggtctgcgtttgccgcagtcttacatcatcatcagaatccagagttttacgacgagattaaaatcgagctgccaacacagcttcacgagaaacatcacctgctcctgactttcttccacgtgagttgtgacaattcctccaaaggttctactaagaagagggacgttgtggagacacaagtgggttacagttggctgcccctactgaaggatgggcgtgtagtgacaagcgaacagcacatccctgtatctgccaacctcccttccggctaccttgggtaccaggaacttggaatgggacgccactacggccccgagatcaagtgggttgatggcgggaaacctcttctgaagatttctactcacctggttagtacagtgtacactcaggaccagcatctgcacaattttttccaatattgccagaaaacagaatctggcgcccaagcacttggaaatgagctggtgaaatacctgaagtccttacacgccatggaggggcatgttatgattgcctttctcccaactatactgaaccagttgtttcgggtcctgactcgggctacacaggaagaggtcgctgtcaacgtgacaagggtgattattcatgtggttgcacaatgtcacgaagaaggccttgagagccacctgcgtagctatgttaaatacgcctacaaggccgagccgtacgtcgcttctgaatacaaaaccgtccatgaggagctcactaaaagcatgacaacaatactcaaaccatcagccgacttcctgacgtccaacaaattgttaaaatatagctggttctttttcgacgtgctcatcaagtctatggcccagcatttgattgaaaattctaaggtcaagctgctccgcaatcagcggtttcctgcctcttaccatcacgcagtcgagaccgttgttaatatgctgatgccgcatattactcagaagttcagagacaaccctgaggcgtctaaaaatgccaatcactctcttgcagtattcattaaaagatgtttcacctttatggaccgcggcttcgtctttaaacaaattaacaactacattagttgctttgctcccggggatccgaaaacgctgttcgagtacaagttcgagttcctacgcgtcgtgtgtaatcatgaacattatatccccctgaatctgcctatgccatttggcaaaggtcgaatccagaggtaccaggatcttcagttagactacagcctgactgacgagttctgcaggaatcactttctcgtgggtctgctgctgcgagaggtgggcacagcattgcaggagtttcgggaggttcgtctgatcgcgatatcagtgctcaagaacctcctcataaaacactcattcgacgacagatatgctagtcgtagccaccaagcgcggattgcaaccctttaccttcccctgttcggcttgcttatcgagaatgtccaaagaatcaacgtcagagatgtgtcccccttccccgtaaatgcagggatgacagtcaaagatgagtctctggcccttcctgccgtcaatccattagtgacccctcagaagggaagcactctggacaattcgctccataaagacctgctgggtgcaattagtgggattgcatccccgtataccacatcaacccccaatattaattcggttcggaacgctgattcaaggggcagtcttatttctaccgatagtggaaatagtctgcccgagcggaattctgaaaagtccaatagtctggacaaacatcaacaatcctccacattaggaaactcagtggtccgttgcgataagctggaccaaagtgaaataaagagcctattgatgtgctttctttacattttgaaatctatgtcagacgatgccttgtttacctattggaataaagcgtccacttccgaactgatggacttctttaccattagcgaggtttgtttgcatcagtttcaatacatgggcaagcgttacattgctagaaccggtatgatgcacgccaggctgcaacagttaggctctcttgataatagcctcaccttcaaccattcctacggacattcagatgcggatgtactgcaccaatccctcctcgaggcgaatatcgcaaccgaggtttgcctcacagcactggacacgctgtcactgttcaccctggccttcaaaaatcaactgctggctgaccacggacataacccccttatgaaaaaagttttcgatgtctatctgtgtttcctgcagaaacatcagtccgagacggccctcaagaacgtgtttacagccctgagaagcctgatatataagtttccttctactttttatgaaggccgagccgacatgtgcgcagcactgtgctatgaaattcttaagtgctgtaactctaagctctccagcattcgcaccgaagcctctcaactcctctatttcctgatgagaaacaattttgattataccgggaaaaaaagcttcgtgcgaactcatctccaggttataatttctgttagccaactgatcgccgacgtcgtgggaatcggcggtacgaggttccagcagtctctgtccatcatcaataactgcgccaattctgatcgcctgataaagcacaccagctttagctccgacgtcaaagacctgaccaagcgaatcagaaccgtgcttatggccaccgctcagatgaaggagcatgagaacgacccggagatgctggtggatctgcaatactccctggctaaaagctacgccagcactccagaactgaggaagacctggctggacagtatggccaggatccacgtaaaaaacggtgacctaagcgaagccgccatgtgctatgtgcacgtgaccgctctggtcgctgaatatctcacgcgaaaggaggccgtccagtgggaaccccccctcctgcctcattctcacagtgcgtgtctgcggaggagcaggggaggcgtttttcgtcaggggtgcactgcttttcgggttattacacctaacatcgacgaggaggccagcatgatggaagacgtgggcatgcaggatgtgcatttcaatgaagatgttctcatggaactgcttgagcaatgtgccgatggtctgtggaaggccgaacgttatgaactgatcgccgatatttacaaattaattataccaatatacgagaagagaagggattttgaacggctagcacacctttacgacacactccatagggcttattcaaaagtgacagaagttatgcactccggccgacgcttgctggggacctacttcagagtagccttttttggtcaggccgcccaatatcagttcaccgattctgaaactgacgtagagggattctttgaagatgaggatggaaaggagtacatttataaggagcccaaactgacccccctgtcagagatatcacaacggcttttgaaattgtactcagacaagttcggttcagagaacgtgaaaatgatccaggattcaggcaaagtaaaccccaaggacttggattccaagtatgcctatatccaggtgacgcacgtgattccattttttgatgagaaggagcttcaggaacggaagaccgagttcgagcgcagtcacaatatcagacggtttatgtttgagatgcctttcacacagacgggaaagcggcagggaggcgtagaggagcagtgcaagaggaggacaatcctgacagccattcactgttttccttacgtgaagaagcggatccccgttatgtaccaacatcacaccgaccttaaccccattgaggttgccatcgatgagatgagcaaaaaggtcgccgaactccgccagctgtgtagttccgctgaggtagatatgatcaaattgcaactgaaactgcagggctcagtctcagtgcaggttaatgctggcccgctagcatacgcccgcgccttcctcgacgacaccaatactaagcggtacccagataataaggtcaagctgcttaaggaagtgttccggcagtttgtcgaagcatgtggccaagccctggccgttaatgagcgcctcatcaaggaggatcagctggagtaccaagaagagatgaaggcaaactatcgggaaatggccaaggaattatctgaaattatgcatgaacaggtccgccgctccgccccttggagacgtaggcgagccagctatcggataccctttacgtcctcaactccatcagtgggcctccagcaggcccagtggtttacaggatag

SEQ ID NO: 46746 - DNA, 3762 bp, Artificial Sequence
  Description of Artificial Sequence: Synthetic coding sequence
atgcaggccgacaagtgccggaccagcagccggagcgtgaagaaggagttggtaatcgaaagtcccctgcagtacaaggatgccgcacaaggcgaggtcgaggccgagtctccaggacctgtgcctgccaaacctaaacttattgagccattagattacgagaatgtgattgtccagaagaaaacgcagatcctgaacgattgcctgcgagagatgctgttgttcccatatgacgattttcagaccgccatcttacggcgtcaaggaagatatatctgctccactgtcccggccaaagccgaagaggaggctcagtcactgtttgttactgaatgcatcaaaacctacaatagcgactggcacctggtcaattacaagtatgaagattattcgggcgagttccggcaactgccgaataaggtggttaagctggataaattaccagtgcacgtgtacgaagttgacgaagaagtggataaagatgaagatgctgcttctctgggttcccagaaaggcgggattactaagcacggatggctttataaaggcaatatgaacagtgcgatctctgtcaccatgaggtcatttaaaaggcgtttcttccatctcatccagcttggcgatggctcttacaacctaaacttctataaagatgagaagatctctaaagaacctaagggctcaatctttcttgattcgtgtatgggcgtcgtgcagaacaataaagtccgacggttcgcctttgagttgaaaatgcaggacaagagttcctatctgttggctgccgattctgaagtagagatggaggaatggataaccattctcaacaagattctgcagctgaacttcgaggcagccatgcaggagaaacgaaacggtgacagccacgaggacgatgagcagtcaaagcttgaaggctccggtagcggattggactcgtatctgccggagcttgcaaaatccgcaagagaggcagagataaaacttaaaagcgagtccagagtgaagttgttctacctggatccagacgcccagaagctcgatttcagctctgcagagcccgaagtgaagtccttcgaggagaagtttgggaaaagaatcttggtgaagtgcaatgacctgtcctttaacctgcaatgttgcgtggctgagaacgaggaggggcctactactaatgtggagcccttcttcgtgactctgagcctcttcgacatcaagtataatcggaagatttccgctgattttcacgtggacctcaaccatttcagcgtgcgtcagatgctggccaccacatcacctgccctgatgaacggaagcgggcaatctccatccgtgctcaagggcattttacacgaggcagcaatgcagtaccctaagcaaggaatcttttctgtcacgtgcccgcaccccgacatattcttggtggctcgaatcgaaaaggtgctccagggttccattactcattgcgccgagccttacatgaaaagcagcgatagcagtaaggtggcccaaaaagtcttgaagaacgctaagcaggcttgtcaacgcttaggacagtaccggatgccctttgcctgggctgctcgaactctctttaaagacgcttccggcaatttagataaaaacgccaggttttcagccatctaccgccaggattctaataaactgtctaacgacgacatgttgaagctgctagctgactttagaaagcccgaaaaaatggccaagctgccagtgatcctagggaacttagacatcaccatcgacaacgtttcatctgatttccccaactatgtgaactcaagctatatccctactaaacagtttgaaacgtgttccaagaccccaatcacctttgaggtggaggagttcgttccatgtatccctaagcatactcagccctacacgatttatacgaatcatctttacgtttatcccaagtacttaaaatacgattcacaaaaaagtttcgctaaagcaaggaacatcgccatttgcattgagtttaaagattccgatgaggaggattctcagccgcttaagtgcatatatggcaggcctgggggcccagtcttcactcgaagtgcctttgctgcagttctacaccatcaccagaatcccgagttctatgacgagatcaaaattgagctcccgacacagctccacgaaaagcaccatctcctgctgaccttctttcatgtgagctgtgataatagttctaagggcagcacaaaaaaacgagatgtggtcgagacccaagtaggttattcttggctgccactactaaaagatgggcgcgtggtgacgagcgaacagcacattcctgtcagcgctaacctgcctagcgggtatctcggttatcaagagctgggtatgggccggcactacggccccgagatcaagtgggtagatggcggcaagcctcttttgaagatctcaacccacctggtgtctactgtctatacacaggatcagcatttgcacaactttttccagtactgtcagaagaccgagagtggcgcacaggcactgggcaacgagctggtgaagtatcttaaatcactgcatgccatggagggacacgtcatgatcgcctttctcccaaccatcttgaatcagttgtttagagtcctgactagagccacacaggaagaggttgcagttaacgtgaccagggtgataatacacgtggttgcacaatgtcatgaagagggactggaatcccacctgcggtcatacgttaagtatgcatacaaagcagaaccctacgtggcctcagaatacaagacagtgcacgaagagctgacaaaaagtatgaccaccatactgaagccaagtgccgacttcctgacttccaataagctactgaagtactcctggttcttcttcgacgtgctgatcaagagcatggctcaacatctgatcgaaaacagcaaggtaaaactactgagaaatcaaaggttccccgcaagttaccaccatgcagtggaaaccgtggtgaatatgctgatgccacatattacacagaagttccgggataaccctgaagcctctaagaacgccaaccacagcctggctgtgttcattaagcgctgctttacatttatggaccggggattcgtgtttaaacagatcaataactacatcagctgcttcgctccgggagaccccaagacgttattcgagtataagttcgagttcttaagggtcgtatgcaatcacgaacactacataccccttaacctgcccatgccctttggaaagggtagaatccaaagatatcaggatctccaactggattattcactgactgatgaattctgccggaatcacttcctggtgggcttattgctaagagaggtggggaccgccctccaagaatttagggaggtgagactgatcgccatatccgtgctgaagaacctcctcattaaacacagttttgatgatcggtacgcttctagatctcatcaggcccggattgcaaccctatatcttcccctgttcggactcctcatagagaacgtgcagcgcattaacgtgagagacgtatccccctttcctgtaaacgcggggatgactgttaaggacgagtctttggcattacccgccgtcaaccctctcgtgactccacagaaggggagtacactggacaatagcttacacaaagacttgctcggagctatttctggaatcgggaacgccccttgttcttgcggactcttatcaaccatcacccttaaggtgtcgtggtcccagtag

SEQ ID NO: 46747 - DNA, 4182 bp, Artificial Sequence
  Description of Artificial Sequence: Synthetic coding sequence
atgggctgcaccaccagcgtgatcctgttcaagggcatccggaccgtgttcgagcgcaactgtgcctacatgtgtaagcagcagggcgagaataacgctcttgaatacacggcctacaattggactaaagaggactccgagctgctcatttctagctggttggccaaacctaaattgattgaacctctcgactatgagaatgttattgttcagaaaaagactcagatcctcaacgactgccttcgggagatgctcctgttcccttatgatgacttccaaactgccattctaaggaggcaggggcggtacatctgttctactgtgcccgccaaggccgaggaagaagcccaatcccttttcgtgacggagtgtatcaaaacctataacagcgactggcacctggtcaattacaagtacgaggactatagcggcgaatttcgccagcttcctaacaaggtcgtgaaactggacaagcttccggtgcatgtctatgaggtggatgaagaggttgataaagatgaagatgctgcctcactgggatctcaaaagggtggcatcacaaaacacggttggctttacaaggggaatatgaactccgccatctccgtgaccatgcgctcttttaagcggcgctttttccacctgattcagttgggggatggctcttataatctgaatttttacaaggatgagaagatctctaaagagcctaagggaagtatcttcttggacagttgtatgggcgtggtccagaacaacaaggtgcgccggtttgcgttcgagctcaagatgcaggacaaatccagctatttgctcgcagccgattcagaagtggaaatggaagagtggattaccatactgaataagatactgcagctcaatttcgaggcagctatgcaggaaaagaggaatggcgacagccatgaagacgatgagcaatccaaactggagggcagtgggtctggcctagacagctatctccccgagctggcaaaaagcgcgcgagaggctgagatcaaactgaagagcgagtctagagtgaagctcttttacctggatcctgatgctcagaagctggactttagctccgccgaacccgaagtgaaaagcttcgaggagaagttcggcaaacgaatactggttaaatgcaatgatctgtcattcaaccttcagtgctgtgtggctgaaaatgaggagggacctaccaccaacgttgaaccatttttcgttacactgagccttttcgacataaagtacaacaggaagatatcagcagatttccatgtagatttgaatcacttctctgtgcgacaaatgctggctacgacaagccccgccttaatgaacggctccgggcaatcacccagcgtcttgaagggtatcctgcacgaagctgcgatgcagtatcccaagcagggtatcttcagcgtgacatgtccccaccccgatatcttccttgttgccaggatagagaaggtgctacagggctccattactcactgcgcggagccctatatgaagtccagcgactcttcgaaagtggctcagaaagtcctcaagaatgcaaaacaggcttgtcagagattaggccagtatcgtatgcccttcgcctgggccgccagaacactgtttaaggacgccagcggaaacctggataaaaacgcaagattcagcgccatctacaggcaggactctaacaagctttccaatgacgacatgctgaaacttttagctgactttcgtaagcctgagaagatggcaaagctcccggtcatcctgggcaacctggacatcacaattgacaacgtgtcttccgatttcccaaactacgtaaatagtagttatatccccaccaaacagttcgagacttgctctaagaccccaatcaccttcgaggtggaggaatttgttccctgcatcccaaaacacacacaaccttacaccatttacacaaaccatctgtatgtgtatccaaaatatctgaaatacgactctcaaaagagtttcgccaaggcacgcaatatagccatctgtattgagttcaaagactccgacgaggaagattcacagccactgaagtgtatctacggacgcccaggaggcccagtgttcaccaggagtgcattcgcagccgtgcttcaccaccatcagaatcccgaattctatgatgagatcaagattgagctgcctactcagctgcacgagaaacaccatctgttgctgaccttttttcacgtgtcatgcgacaatagtagcaagggttctactaaaaagcgggacgtggtggaaactcaggtgggctacagctggctgccactgctcaaggatggtcgcgttgtgacctcggagcaacatatccccgttagtgcaaacctcccaagtgggtacttaggctatcaagaactggggatggggcgtcactacgggccagaaatcaagtgggtggacggaggtaaacccctgctcaaaatatctactcatcttgtgtctacggtgtatacacaagaccagcacttgcataactttttccagtactgtcaaaaaaccgagtctggggctcaggccctgggaaacgagctcgttaagtacctaaaatctctgcacgccatggagggtcatgtgatgatcgcatttttacccactattttaaatcagttattcagagtgttaaccagagccactcaggaggaggtcgcagtgaatgtcacccgtgttatcatccatgtcgttgcccaatgccacgaggaaggtcttgagagtcatctgaggtcatacgttaaatatgcatacaaggcggagccgtacgtcgcttctgaatacaaaacggtacacgaagaactgaccaaaagtatgacaacaatcctgaagccttcagcagatttccttacatctaacaagttgctgaagtattcttggtttttctttgatgtattgatcaagtctatggcacaacacctgatcgagaactccaaggtcaaactgttgcgcaaccagaggttccctgcgtcctatcaccacgctgtggagactgtggttaatatgctcatgccccatataactcagaagttcagagataatcctgaagcgagtaaaaacgcgaatcatagcttggcagtgtttattaagcggtgctttacctttatggatcgaggattcgtcttcaagcagatcaacaactatatttcatgtttcgcccccggtgacccaaagaccctgtttgaatacaaatttgagttcctgagggtcgtatgcaaccatgaacactacatacccctgaatctgcctatgccatttggtaaaggtcggattcagaggtaccaggacctgcaattggactattcactgacagatgagttttgccgtaaccactttttagttggcttgcttctccgtgaagtggggaccgcccttcaggaatttcgcgaagtaagactgattgctatatccgtgctcaaaaacctcctcattaaacattcttttgacgaccgttacgcgtcgcgctcccaccaggctcggattgccactctctacttgcccctctttggcctgctgattgaaaacgtgcagaggatcaatgtgcgggacgtcagtccctttcccgtgaatgcagggatgactgttaaagacgagtctttggcattgcccgccgtgaatccgttggtgactccccaaaagggcagcactctggacaattcactccataaagaccttcttggcgccatcagtggcatcgcttccccttacaccactagcacccctaacatcaacagcgtcaggaatgctgactcaagggggagcctgatctccaccgattcaggcaacagcctcccagaacgcaattccgagaagtctaactctctggacaagcatcagcagtcatctactctggggaatagcgtcgtgcggtgcgataagctggaccagtctgagataaagtcactcctaatgtgcttcctatatattttgaagtctatgagtgatgatgccctcttcacgtattggaataaggctagcacctctgagttgatggacttcttcaccatcagcgaagtctgcctgcatcagttccagtacatgggtaaacggtacattgcgagtctcacaaagtgcgtcgccctccttctgcccgcatggaatcgcaacgatgcctgccagatagcagcagccgggcagccggggtag

SEQ ID NO: 46748 - DNA, 753 bp, Artificial Sequence
  Description of Artificial Sequence: Synthetic coding sequence
gccgacagccggggcagcctgatcagcaccgacagcggcaacagcctcccggagaggaactcagagaaatccaatagcttagacaagcatcagcagtcaagcaccctcggaaattccgttgtacggtgcgataaattagatcaatcagagatcaagtctctcctgatgtgcttcctatatatcctgaaaagcatgtcagatgatgcactgtttacctattggaataaagcttcaacctccgaactcatggacttttttaccatctccgaggtgtgcctgcatcagttccagtatatggggaagcgctacattgcatctgtgaggaaaatctcatcggtcctagggatctcagtggataacggttacgggcattctgacgccgatgtgttgcatcagagtctgctggaggccaacattgcgaccgaggtctgcctcactgctctggacacactgtcgctttttaccttggcctttaagaaccagcttctggcagatcatggccataatcccctgatgaagaaagtgttcgacgtctacctatgtttcctacagaaacaccagtcagagactgccctgaaaaacgtctttacggcgctccgctcactgatatataagttccccagtactttctatgaaggccgcgcagacatgtgcgctgctttgtgttacgaaatcctgaagtgctgcaacagtaaactttcttctattcggaccgaagcctcccaactgctgtacttccttatgcggaattag

SEQ ID NO: 46749 - DNA, 351 bp, Artificial Sequence
  Description of Artificial Sequence: Synthetic coding sequence
tgaagcgagctgatggacttcttcaccatcagcgaggtgtgcctgcatcaatttcagtacatggggaagaggtacatagcaaggaatcaggaggggcttgggcccattgtgcacgataggaaatcccagactctaccagtgtcaagaaatcggacgggaatgatgcacgctcgactgcaacaactgggtagcctggacaacagtctgaccttcaatcactcctacggacactccgacgcagatgttcttcaccagtccctgctggaggcaaacatagccactgaggtgtgccttacagcgctcgacactctgtcgctgttcacactcgctttcaaaaaccagctcctgtag

SEQ ID NO: 46750 - DNA, 612 bp, Artificial Sequence
  Description of Artificial Sequence: Synthetic coding sequence
cggaagacctggctggacagcatggcccggatccacgtgaagaacggtgacctctccgaagcagctatgtgctatgttcacgtgaccgctttggtggcggagtacttaacacggaaaggagtatttagacagggatgcaccgcgtttcgggtgattacgccgaacatagacgaagaggctagtatgatggaggacgttggaatgcaggacgtgcatttcaatgaggatgtgctgatggagttgctggagcagtgtgctgatggcttatggaaggcagagcgatacgaactgatagctgacatctacaagcttattattccgatttatgagaagaggagggatttcgaaagactcgctcacctgtatgacacacttcaccgagcttactctaaagtgacagaggtgatgcactcaggccgccgactactaggcacctattttcgggtggctttcttcggacaagggttttttgaagacgaggacggaaaggagtacatttataaagagccaaaactgacccccctcagcgaaatttctcaacgactactgaaactgtacagcgataagttcggatcagagaacgtgaaaatgattcaggactcaggtaagtag

SEQ ID NO: 46751 - DNA, 1122 bp, Artificial Sequence
  Description of Artificial Sequence: Synthetic coding sequence
atggccgagacccgggaggaggagaccgtgagcgccgaggccagcggatttagtgacttatccgattccgaattccttgaattcttagatctggaagatgctcaggagtctaaagccctggtgaatatgcccggacctagctccgaaagcttgggcaaagatgataagcccatcagcctgcagaattggaaacgaggcctggatatcctcagcccaatggagagattccaccttaagtatctttacgtgaccgatctcgcaactcaaaattggtgtgaattacagaccgcttacggaaaggaattgcccggcttcctggcccccgaaaaagccgccgttttggacaccggcgccagcattcacctcgctcgcgagcttgaacttcatgatctggtgacagtccccgtaactacaaaggaggatgcctgggccattaagttccttaacattctcctgctgatacccactctgcaatccgagggacatatccgggagttcccagtgttcggagagggggaaggtgtgttgctggtgggggttattgacgagctccattacacagccaagggtgagctggaactcgctgaactgaagacccgcaggcgacctatgttgcccctggaagctcaaaagaaaaaggattgttttcaagtgtctttgtataagtacattttcgatgcgatggtccagggcaaggtgacaccagccagcctgattcaccatactaagctctgtctcgagaagcccctgggcccgtcggtgctccgacatgcccagcaagggggcttctcagtgaagagcctgggtgatctgatggagcttgtctttctctctctgacactctcagacttaccagtgatcgatatcctgaagatcgaatacatccaccaggaaaccgccaccgtactgggtaccgaaatcgttgcattcaaggaaaaagaggtgcgagcgaaggttcagcactacatggcctattggatgggccatcgtgagccccaaggagtggatgtggaggaggcctggaagtgccggacatgcacgtatgctgacatctgtgagtggcgcaaggggtccggcgtgctgtcgtctaccttggcacctcaggtgaagaaagccaagtag

SEQ ID NO: 46752 - DNA, 1122 bp, Artificial Sequence
  Description of Artificial Sequence: Synthetic coding sequence
atggccgagacccgggaggaggagaccgtgagcgccgaggccagcggcttttctgatctcagtgattctgaatttctggagttccttgatctcgaggacgcacaggagtcaaaagcgctcgtaaacatgccagggccgagctccgagagtttgggcaaggatgataaaccaataagcctgcaaaattggaagcggggcctcgatattctgtcccctatggaacggttccacttaaaatatctgtacgtgacggacttggcaacgcagaattggtgtgaattgcagactgcctatggaaaggagctgccggggtttctcgcacccgagaaagccgccgtcttagatactggcgccagtatccacttggctagggagctggagctacacgatctggtgaccgtccctgtgacaacaaaggaggacgcatgggccataaagttcctcaacatactgcttctgattcctacactgcagtccgagggtcacatcagagagttccccgtgtttggtgagggcgaaggagtgctgttggtcggggtgatcgacgaactgcactatactgccaagggggaactggagcttgccgagttgaaaaccaggaggcgccccatgctgcctctcgaggcacagaaaaagaaagattgtttccaggtctccctttacaaatatatctttgatgccatggttcaggggaaggtcactcccgccagccttatacaccacaccaaactatgtcttgagaagcctctgggcccttccgtgcttcggcacgcacagcagggcggctttagtgtgaaatcactgggggatctgatggagctcgtcttcctgagtcttaccctctcagacctacctgtgatagacattctgaagatcgagtacatccatcaagagacagcaaccgtgctagggacggaaatcgtggctttcaaagagaaagaggtccgcgcaaaggtccagcactacatggcttactggatgggtcaccgcgagcctcagggtgtggatgttgaagaagcttggaagtgtcgtacttgcacatatgccgacatttgtgagtggcgaaaaggctcaggcgtgctgtcgagcacactggctcctcaggttaaaaaagcgaagtag

SEQ ID NO: 46753 - DNA, 1122 bp, Artificial Sequence
  Description of Artificial Sequence: Synthetic coding sequence
atggccgagacccgggaggaggagaccgtgagcgccgaggccagcggcttctcagacctttccgactctgagttcttagagttcctggacctcgaggacgcccaggagagcaaagccctggtaaacatgcccggacctagcagcgaatccttgggtaaagatgataagcctatcagtctacaaaattggaagagggggttagatatcctgtcccccatggaacgttttcatttgaagtatttgtacgtcactgacctggcaacccagaactggtgcgaactccaaactgcatatggcaaggagctccctggcttcctcgctcccgagaaagccgcagtgctcgataccggcgcctccattcacctcgcccgcgagttagagctacacgacctcgtgaccgtgcctgtgacgacgaaggaagacgcttgggcaatcaagttcttaaacatcttgctgctcattcctactctccagagcgaggggcacatcagggagtttcctgtgtttggcgaaggcgagggcgttttactggttggtgtaatcgacgagttgcactatacagcaaagggcgaactggagctggctgaactgaaaacacgccgacgacccatgttgcccttggaggctcagaagaaaaaggattgttttcaagtctcactgtacaagtacatctttgacgcaatggtgcagggcaaggtaactccagcttccctcattcaccacacaaaactttgccttgagaaacccttgggtccgagtgtgctccggcacgcgcaacagggcggattttcagtaaaatccctgggcgatcttatggaactcgtatttctctccctaactctttccgatctgccggttatagacattcttaaaattgaatacatacaccaagagactgctaccgttttgggaactgagattgtagctttcaaagaaaaggaagtacgcgcaaaggtgcaacattacatggcatactggatgggtcaccgcgaaccccagggcgtggatgtggaggaagcctggaagtgcaggacatgcacatatgctgacatctgcgagtggaggaaaggctccggcgtgctctcttccacactggcacctcaggtgaaaaaggctaaatag

SEQ ID NO: 46754 - DNA, 486 bp, Artificial Sequence
  Description of Artificial Sequence: Synthetic coding sequence
atggccgagacccgggaggaggagaccgtgagcgccgaggccagcgggttctccgatcttagtgacagtgagttccttgaatttctggaccttgaggacgctcaggagtccaaagcactggtcaatatgccaggaccttccagtgagtccctcggaaaggatgacaagccgattagcctgcaaaattggaaacgcggcctggacatccttagccccatggaacgattccacctgaagtatctatatgtgaccgacttggccacccagaattggtgtgagcttcagactgcctatggcaaagagttacccggttttttagcccccgaaaaggccgcagttctcgatacgggggcttctatccatctcgcccgtgagctggaactacacgaccttgtcacagttcccgtgactacgaaggaagacgcctgggccatcaagtttctgaacattctactgcttataccgacactgcaatctgaaggttag

SEQ ID NO: 46755 - DNA, 675 bp, Artificial Sequence
  Description of Artificial Sequence: Synthetic coding sequence
atggccgagacccgggaggaggagaccgtgagcgccgaggccagcggcttctctgacctttctgactcagagttcttggagtttctggacctcgaggacgcccaggaatcaaaagccctcgtaaatatgccaggccccagctctgagtccctcggtaaggacgataagcctatatccttacaaaattggaagcgtggcctagatatcctgagccctatggagagatttcatctgaaatatctgtacgtgactgacctggctacacagaattggtgtgagctgcaaacggcctacggcaaggagctcccaggattcctcgctccggaaaaggccgcggtgttggataccggcgccagtatccatcttgcccgagaactggagctgcatgacctggttacagtacctgtgaccaccaaagaggacgcgtgggccatcaagtttctgaacattttactgttaatcccaacacttcaaagtgagggacacatcagggagtttcccgtgtttggagaaggagagggcgtcctcctggtcggggtcatcgacgaactccattatacggctaaaggcgaactcgaacttgccgagctgaagaccagacggaggcctatgctgcctctagaggctcagaagaaaaaggattgtttccaggtgtctttgtacaagtatatttag

SEQ ID NO: 46756 - DNA, 744 bp, Artificial Sequence
  Description of Artificial Sequence: Synthetic coding sequence
atggccgagacccgggaggaggagaccgtgagcgccgaggccagcggattctccgatctgtctgattccgagtttctggaatttctcgatcttgaggacgcccaagagtccaaggctctggtgaacatgccaggaccttcttcagaatccttggggaaggatgataagcccattagcctgcagaattggaaacgtggcttagatatcctgtctcccatggaacgttttcatttgaaatatttgtacgttacggatctggcaacccagaattggtgtgaattgcagaccgcgtatggcaaggagctgccaggattcctcgcacccgaaaaagctgcggtcctggacaccggagcgtctatccacctggctagggagctggagctgcatgatctggttacagttccggttaccaccaaagaggatgcttgggccatcaaattcctgaacattctgcttttaatacccacgctccagagcgagggccatattagggaatttccagttttcggcgagggcgaaggcgtgcttctggttggggtgatcgacgagctgcattacactgccaagggcgaactggaactggcagaacttaaaactcggcgacggcccatgttaccgttggaagcccagaaaaagaaggattgtttccaggtcagcctttacaagtacatcttcgatgcaatggtccagggaaaggtcacgcctgcatctctgatccatcacacaaagctgtgtctcgaatag

SEQ ID NO: 46757 - DNA, 681 bp, Artificial Sequence
  Description of Artificial Sequence: Synthetic coding sequence
atggccgagacccgggaggaggagaccgtgagcgccgaggccagcggcttcagcgacttgtcggactcggagttcttggaattcctggacctagaggatgcacaggaatcaaaggcactcgtcaacatgcctggcccaagctctgagtcccttggcaaggacgacaaacccatttcactgcagaactggaaaagggggctagatattctcagccctatggaacgcttccatctgaagtacctgtacgtgacggatttggccacacaaaactggtgtgagttacaaaccgcctatgggaaagaattgccagggtttcttgctccagaaaaagcagccgttctcgataccggcgcctctatccatttagctagggagctggaactgcatgacctggtcaccgttcccgttaccacaaaggaggacgcgtgggcaatcaaatttctgaatatcctcctgctgatcccaacgctgcagtccgagggccatatcagggagttccctgtgtttggcgagggcgagggcgtgctcctcgtaggggtcatagatgaactccactataccgctaagggggaactagaactggccgaactgaagacgagacgccgaccaatgttgcctctggaagcgcagaaaaaaaaagattgctttcaagtatcactgtataagtacatttttgattag

SEQ ID NO: 46758 - DNA, 303 bp, Artificial Sequence
  Description of Artificial Sequence: Synthetic coding sequence
atggccgagacccgggaggaggagaccgtgagcgccgaggccagcggcttctccgacctctctgatagtgagttcctcgagttcttggacttagaagacgcacaggaatcgaaagccctggtcaacatgcccggtccatccagcgagtcactcggaaaagacgacaaacccattagtctacaaaattggaaacggggcctggacatcttgagccccatggagagattccacttgaagtatctgtacgtcacggacttagccacacagaactggtgcgaactgcagaccgcttacggcaagtag

SEQ ID NO: 46759 - DNA, 744 bp, Artificial Sequence
  Description of Artificial Sequence: Synthetic coding sequence
atggccgagacccgggaggaggagaccgtgagcgccgaggccagcgggttctcggacctgtccgacagtgagttcctggaattccttgatttggaagacgcccaagaatcaaaggctcttgttaacatgcctggtccatcgtcagaatctctcggaaaggacgacaaaccaatttccctgcagaactggaaaagaggcctcgatatcttatcccccatggagaggttccatctgaagtacctatacgtgaccgatcttgcaacacagaactggtgtgaactgcagacggcttacggcaaagaattgccaggattcctggcaccggagaaggccgcagtgctagacactggagcttcaatccacctggctcgcgagctcgagctgcacgacctagtgactgtgccagtaactactaaggaggacgcctgggcaattaagtttctgaacatcctcctcctgatcccgaccctacagtctgagggacatataagggagttccccgtttttggagaaggcgaaggcgtgttactggtaggagtaatcgatgaactgcactacaccgctaagggcgaacttgaactggctgagctgaagaccaggaggaggcccatgttacccctggaagcccaaaagaaaaaagactgcttccaggtgagtctatataagtatatatttgatgccatggtgcagggtaaagttacaccagcaagccttattcatcataccaaactttgcttagaatag

SEQ ID NO: 46760 - DNA, 129 bp, Artificial Sequence
  Description of Artificial Sequence: Synthetic coding sequence
tgccggagccagaagagctgctggatcatcaagggccactgccggaagaactgcaaaccaggagaacaggtgaagaagccctgcaagaacggtgactactgttgtatccccagtaacactgattcctag

SEQ ID NO: 46761 - DNA, 876 bp, Artificial Sequence
  Description of Artificial Sequence: Synthetic coding sequence
atggtgcgggagcagtacaccaccgccaccgagggcatctgcatcgagagacccgaaaatcagtatgtgtataaaataggaatctacggttggcgaaaacgctgcctgtatttattcgtgttgctgttgctcatcattttggtggtgaatctcgccctgaccatctggatcctgaaagtgatgtggttttctcctgctggcatgggccacctatgtgtgaccaaagatggcctgcgcttggaaggagaaagtgagtttttgttccccctctacgctaaggaaatccactctagagtggactccagtttgcttttgcagtcaacgcaaaatgtgactgtgaacgccagaaactcggagggtgaggttactgggcgactaaaagtaggccccaagatggtggaggtgcagaaccagcagtttcagattaacagtaatgacgggaaacctttatttactgtggacgagaaggaagtggtcgtaggcacagataagttgagggtcaccggtcctgagggtgctctgttcgaacactccgtcgagactcctctggtaagagcagacccattccaagacctgagacttgagtcgccaactcgctccctaagcatggatgctccacgcggcgtgcatattcaggcccacgccgggaagatcgaagccctgtcacagatggatatcctatttcacagctctgacgggatgctcgtactcgacgccgagacagtatgcctccctaagcttgtgcagggaacttggggcccgtccggcagctctcagtctctatacgaaatctgcgtctgtccagacgggaaactgtatctgtcagtcgcgggggtctctaccacatgccaagagcacaaccatatctgcctgtag

SEQ ID NO: 46762 - DNA, 816 bp, Artificial Sequence
  Description of Artificial Sequence: Synthetic coding sequence
atgaacctgcacgtgaagaccctgagcctgatgacctggcggagcaggttcttagaagaatctttttggagtcttgaggagacagctgctctggcaaagcagttacccttgaagtctcctagcgagaatatctttctgcacatagttgatttgagcgacccaaaacagatatggaagttcgtagagaactttaagcaagagcataagcttcacgttctcattaataacgccggatgcatggttaataaacgcgagctgacggaggatggtcttgagaagaattttgccgccaataccttgggcgtgtatattctgaccacaggactaattcctgtgctcgaaaaggaacacgatccccgggtgatcacagtgtcttccggtggcatgctcgtccaaaagctcaataccaatgacctacaatctgaaagaaccccatttgatggcactatggtatatgcccagaataagcgtcagcaggtggtgttgacagaaaggtgggctcaagggcatcccgcgatccacttttcaagtatgcatcccggctgggccgacacgcccgataggaacgagcaggaactaagaaaggttgttggagaagcccaaactgcatccccactgccacgcttcctcgagattatgatgcacgagggaaaatgtcagccccaggggcatagctcaaacgacctggaagcttgctggtcatctgggggcggggagcagaactcattgccagattggccacaccaacttcatgatctgaggcagttaacttgggccttatgttccagtttccttttgtacaaacagggcaattag

SEQ ID NO: 46763 - DNA, 954 bp, Artificial Sequence
  Description of Artificial Sequence: Synthetic coding sequence
atgagcctgtaccggagcgtggtgtggttcgccaagggcctgcgggaatacaccaagtccgggtatgaatccgcctgtaaagacttcgttccacacgacctcgaggtgcaaattccagggagagtcttcctggtgaccggcggtaactccggaatcggcaaggctaccgcactcgagattgcgaaaagaggaggtacggtgcacttagtttgtagggaccaggctccagcggaggatgcccggggcgaaataatccgagaatccggtaaccaaaatattttcctacatattgttgatctgtctgatccgaaacaaatttggaaattcgtagagaatttcaaacaagaacacaagctccacgtgctgatcaataacgccgggtgtatggtgaataaacgggagctgactgaagacgggctggaaaaaaacttcgccgctaacacgctcggtgtttacattctgactacgggcctgatcccagtattggagaaagagcatgacccgcgggtcatcaccgtgagctctggcggcatgctggttcagaaattgaataccaacgacttgcagtctgagcggacaccgttcgatggtacaatggtctacgcacagaataaaaggcagcaagtggtacttacagagagatgggcacagggtcacccagccattcacttctcctctatgcaccctggctgggcagatactcccggtgtcaggcaagcgatgcctggattccacgcccggttcggggataggctgaggtccgaggctcagggagctgataccatgctttggctcgcgctgagtagcgcagccgctgctcagccttccggtcgatttttccaggacaggaaaccggtctccacccacctcccgcttgcgacggcatcctcctcaccggccgaggaagaaaaattaatcgagatactggagcagctggcccagacttttaagtag

SEQ ID NO: 46764 - DNA, 699 bp, Artificial Sequence
  Description of Artificial Sequence: Synthetic coding sequence
atgcagatggcccggctgctgggcctgtgcgcctgggcccggaagagcgtcagaatggccagttccagaatgactcgtagggacccgctgaccaataaagtcgctctcgtgactgcttctaccgatggcataggctttgccatcgcccgtcgtctagcccaggaccgggcacatgtcgtcgtgtcttcacgcaaacagcagaacgtggatcaggccgtggcaactctccagggagaggggctgagtgtcaccgggacagtgtgccacgtaggtaaggccgaagatcgagagcgactggtcgcaatggccgtgaaattgcacggggggatcgacatactggtttcaaacgcagctgtgaaccctttctttgggtccttaatggatgtaactgaggaagtctgggacaagacccttgacattaacgttaaagctccagccctcatgactaaggcagttgtacccgagatggaaaaaagaggcggtgggtctgtggtgatcgtcagctcaatagccgccttctcaccatctccaggattcagtccatacaacgtgtctaagacagccctgctgggcctgaacaacactctcgccattgaacttgctccaagaaacatcagagtcaattgtttgcatctggacctcagccggctcgctagtgccgggtgtagcggatggaccagaaaaaagcgaaaagcttag

SEQ ID NO: 46765 - DNA, 648 bp, Artificial Sequence
  Description of Artificial Sequence: Synthetic coding sequence
atgcccttcccctgcctgagcctgcccagcagctgggactaccggatcggattcgctatcgctcggcgacttgctcaggacagggcgcacgttgtggtaagttctcgcaagcaacagaatgtcgatcaggcggtcgcaaccctgcaaggtgaaggcctcagcgtcaccggtacagtgtgtcacgtaggaaaagcggaagatagggagcgcctggtggccatgaccctggatatcaatgtcaaggcccctgccctgatgaccaaagctgtagtgccagagatggagaagagaggtggcgggtctgttgtgatcgtcagttctatcgcagcttttagccccagccctgggtttagcccttacaatgtttccaaaaccgcgctcttgggattaaacaataccctagccatagagctagcccctcgtaacatcagggtcaactgcctgccgggcctaatcaagacctccttcagtcggatgctgtggatggataaggagaaggaagagtccatgaaagagaccttgaggatcaggcggctgggagagcccgaagattgcgccgggatcgtatcattcctttgcagcgaggacgcctcctacataaccggtgaaaccgtggtggtgggaggtggcacgccatcacgcctttag

SEQ ID NO: 46766 - DNA, 774 bp, Artificial Sequence
  Description of Artificial Sequence: Synthetic coding sequence
atggcccggctgctgggcctgtgcgcctgggcccggaagagcgtgagaatggccagctcacggatgacgagacgggatcccttgactaacaaggtggcccttgttactgcttctactgatggcattgggttcgccattgccagacgcttggcccaggaccgcgcacacgtagtcgtgtctagcagaaaacagcagaatgtggaccaggccgtggccaccctgcaaggcgagggcttatctgtcacaggtactgtgtgccatgtcgggaaggccgaagatagggagagactcgtcgctatggccgtgaagctgcacggtggcatcgacatcctagtgtctaatgcagcagtcaacccgttctttggaagcttgatggacgtgaccgaagaagtctgggataaaacacttgatataaacgtcaaggccccagccttaatgactaaggccgtcgtcccagagatggaaaaacggggtggcggctcagtggtcatagttagcagcatagctgcctttagtccctcacccgggtttagtccctacaacgtaagcaagaccgccttactcggcctgaataacaccctcgcaattgaactggccccgcggaacattcgcgttaactgcctccacttggatttatcccgcctggcaagtgccgggtggctcggggagcctgaagactgcgcgggcatcgtgagttttctctgcagtgaggacgcttcctacataaccggtgagactgtggtggtgggtggaggcaccccttcccgcttgtag

SEQ ID NO: 46767 - DNA, 276 bp, Artificial Sequence
  Description of Artificial Sequence: Synthetic coding sequence
atggccgtgaagctgcacggcggcatcgacatcctggtgagcaacgccgccgtgaatcccttttttggatctcttatggatgtcactgaagaggtgtgggataagctctggatggacaaggagaaggaagaaagcatgaaagaaaccctacgcatccggcggctcggcgagcccgaagattgtgcagggatcgtatcttttctatgctccgaggatgcgagctatattaccggagaaactgtggtcgtgggaggtggaaccccgagccggctgtag

SEQ ID NO: 46768 - DNA, 174 bp, Artificial Sequence
  Description of Artificial Sequence: Synthetic coding sequence
atgctgtggatggacaaggagaaggaggagagcatgaaggagaccctgaggatccggcgtctgggagaacccgaggactgtgccggtattgtgtcatttctgtgttctgaggatgcatcatatatcaccggtgaaacagtagtggtcggcggcggtaccccatcaaggctgtag

SEQ ID NO: 46769 - DNA, 468 bp, Artificial Sequence
  Description of Artificial Sequence: Synthetic coding sequence
atgcagatggcccggctgctgggcctgtgcgcctgggcccggaagtctgttcgaatggcgtcgtctagaatgacacggcgcgacccccttaccaacaaggtggcactggtgaccgcctcaaccgatggcatagggttcgctattgctcgtaggcttgctcaggaccgagcgcacgtggtggtgtcctctaggaagcagcaaaatgtggaccaggccgtggcgaccctccaaggcgagggtcttagcgtcactggaaccgtgtgccacgtaggcaaggcagaggacagggaaaggctcgtggcgatggccgtcaaattacatggggggatagacatcttggtgtccaatgctgcagtgaatcccttctttggcagccttatggacgtgacagaagaggtgtgggataagttgtggatggacaaggaaaaagaagagtcaatgaaggagaccctgaggatacggagatag

SEQ ID NO: 46770 - DNA, 993 bp, Artificial Sequence
  Description of Artificial Sequence: Synthetic coding sequence
atgagccccctgagcgccgcccgggccgccctgcgggtgtacgccgtcggagcggcagtgattttggctcagctgctcagaagatgtagaggagggttcctggaacctgtgttcccaccccgccccgaccgtgttgcaatcgtaacaggagggacagatggaattgggtactcaactgctaagcacctggctaggctcgggatgcacgtcatcatcgccggaaataatgattcaaaggccaaacaggtcgttagcaaaatcaaagaagaaactttaaatgataaagttgaattcctatattgcgatctggcctctatgacttctattcgacagttcgtccagaaatttaagatgaaaaaaatccctctacacgttttgatcaataacgccggtgttatgatggtccctcagcgaaagacccgagatggattcgaggaacatttcggcctcaattacctggggcacttcctgctgactaatctgttgctcgacaccctcaaggagtctgggtctccaggccactctgccagagtcgtgaccgtctctagtgcaactcattacgtggcagaacttaatatggacgacctccaatctagtgcctgttactcgccccacgccgcatacgcccagagcaagttggccctggttctgtttacataccacctgcagcggctccttgccgctgaaggcagccatgtcacagcaaacgtagtggacccaggcgtggtgaatacagacgtgtataaacacgttttctgggctacccgattagcaaaaaagctgcttgggtggctccttttcaagactcccgatgagggggcctggacgtccatctacgccgccgtaacgcccgagctcgaaggcgtcggaggtcattacttgtacaacgagaaggagaccaagagtcttcatgtgacatacaaccagaagctgcagcagcaactctggtcaaagagctgcgaaatgactggggtgctggatgtgacgctctag

SEQ ID NO: 46771 - DNA, 168 bp, Artificial Sequence
  Description of Artificial Sequence: Synthetic coding sequence
atgaagatgagcttcgagcggtgcaccgcccggaacaagatgttcgtgaattctgcttttacaaaggtcgataactactgtacattcctgatggaaaaggtcctgtttaaagtgctctttctggtggagtattaccagaaagggaagaagaacgatctcaacttctag

SEQ ID NO: 46772 - DNA, 168 bp, Artificial Sequence
  Description of Artificial Sequence: Synthetic coding sequence
atgaagatgagcttcgagcggtgcaccgcccggaacaagatgttcgttaactccgcctttacaaaggttgataattactgtacatttctgatggagaaggttctgttcaaagtgctctttctggtggagtactaccagaaaggaaagaaaaacgatctgaacttttag

SEQ ID NO: 46773 - DNA, 483 bp, Artificial Sequence
  Description of Artificial Sequence: Synthetic coding sequence
atggccagccccgcccccctggtggccagcatcagccaccagatggtcgctttgcagacactgcaacttcttcagcaagaatgggggtggggggacggcccagtggcgcccggaaatccccgcgacccagatcatgtgtccaccgccccagctaggagatcgggccccccccgggcccgacccggccccgggagggaagagcggggcgggggagtgggaaccaggtctcgcagaacggctgcacgtgctaattcacccgaagaggaggtggtgcgcggagcagagggaggtgccgagctactgccgttccccagggataggggaccatgcacccttgcccaaatggctatgcggagtgctctggccagagtggtggacagtacctcagagctagtgtccgtggagcagacactactagggccgctccaacaggagaggtccttccctattcacctgaagctacagctgttggccaatgagtag

SEQ ID NO: 46774 - DNA, 525 bp, Artificial Sequence
  Description of Artificial Sequence: Synthetic coding sequence
atggccagccccgcccccctggtggccagcatcagccaccagatggttgctctccaaactcttcaattgctacagcaggagtggggctggggggatgccgcccgtgccaactcgcccgaagaagaagtagtgcgcggagccgagggtggagccgagttgctcccttttcccagggaccgtgggccatgtacactggcccagatggccatgaggtcagctctcgccagggtggtagattccacctctgagttggtgtcggtcgaacagactttgctgggccctctgcagcaggagcggtctttccctatacatctaaaagattcggtcgaatttagaaatatctgctctcatctagcgctgcaaattgaaggccagcaattcgatcgggacctcaacgccgcgcatcagtgcctgaaaacgatagtaaaaaaattaatacagagcttggccaacttcccctcagacgcccacatggtggcatgtgcttcgctgcggcaaatcttgcaaaacctgcccgacatctag

SEQ ID NO: 46775 - DNA, 666 bp, Artificial Sequence
  Description of Artificial Sequence: Synthetic coding sequence
atggccagccccgcccccctggtggccagcatcagccaccagatggttgccctgcaaacactgcagctgttgcagcaggaatggggttggggagacggccctgtggcacccggcaaccccagggatcctgaccatgtgtccactgcacccgcccgcagatcaggccctccccgggcacgcccaggacctggacgggaagaaaggggaggcggggtgggtactagaagcagacggaccgctgcccgagcgaattctcccgaggaagaagtcgtgaggggggctgagggaggagccgagttgctgccatttccaagggacagaggcccctgcaccctcgcccagatggctatgagaagtgccctagctcgagtcgtcgattcgaccagcgaactggtgtccgtggaacagacattgcttggaccactgcagcaggaacgatcttttcccatccatcttaaggactccgtagagttccgtaacatctgctctcacttagccttacagatcgagggccagcagttcgatagggacctgaatgcagctcatcagtgtctcaagaccattgtgaagaagcttatccaatccctggccaatttccccagtgacgcacatatggtggcctgtgcctcgcttcgccagatcctgcagaacctgcccgacatctag

SEQ ID NO: 46776 - DNA, 513 bp, Artificial Sequence
  Description of Artificial Sequence: Synthetic coding sequence
atggccgtgaccggctggctggagagcctgcggaccgcccagaagacggcgcttctgcaggacggtcgtcgcaaggttcattaccttttcccagacggaaaagagatggccgaagaatacgacgaaaagacatccgagctgttagtaagaaaatggagggtgaaatccgcccttggcgctatggggcagtggcagctcgaggtgggggacccagcccccctgggggctgggaatttgggcccagaactgattaaggaatccaatgcaaatcccattttcatgagaaaggacacaaaaatgagcttccaatggaggattaggaatctgccttatcccaaggatgtgtatagtgtgtctgtggaccaaaaggagagatgcattatagtgagaaccactaataaaaaaagaacaggctggagactgttgtggacgccgttggctatgcggtgtgccggcgtgcacggcacaccttccgaaattgatactagctacctttggatgacaccctgttag

SEQ ID NO: 46777 - DNA, 513 bp, Artificial Sequence
  Description of Artificial Sequence: Synthetic coding sequence
atggccgtgaccggctggctggagagcctgcggaccgcccagaagaccgccttgctgcaggacggtagacggaaagtgcattacctgtttccagacggaaaggagatggccgaggaatatgatgagaaaacgtcagaactgcttgtgaggaagtggcgggtgaagtcagccctgggcgcaatggggcagtggcagctggaagtcggcgatcccgcgccactaggtgcaggtaatctgggtcccgaactgataaaagagtccaatgccaaccccatatttatgaggaaagataccaaaatgtcattccaatggcgtattaggaatcttccataccccaaagacgtgtacagcgtcagcgttgatcagaaagaacgatgcattattgtacgaacaaccaataagaaacgcaccgggtggcgtctcctttggaccccactggcgatgcggtgcgctggggtccatggtacgcccagtgaaattgatactagctacctatggatgacaccatgttag

SEQ ID NO: 46778 - DNA, 354 bp, Artificial Sequence
  Description of Artificial Sequence: Synthetic coding sequence
atggccgaggagtacgacgagaagaccagcgagctgctggtgcggaaatggcgggtcaaatcggctctcggagcaatggggcaatggcagctggaggtgggagaccctgcacccctaggagccggcaatctcggcccagagctcatcaaggagtccaatgccaacccaatttttatgcggaaagacactaaaatgtcttttcagtggcggattcggaacctgccgtaccctaaggacgtctatagcgtatccgtggaccagaaagagaggtgcattattgtcagaacaaccaataagaacactcgttcacaaagaagactttggtggccctcactgtcctacagacgtaactag

SEQ ID NO: 46779 - DNA, 612 bp, Artificial Sequence
  Description of Artificial Sequence: Synthetic coding sequence
atggccgtgaccggctggctggagagcctgcggaccgcccagaagacagccctgttacaggatgggagaagaaaggtgcattatctcttcccggacggcaaagaaatggctgaggagtatgatgagaaaaccagtgagttactggtgagaaagtggagggtgaaaagcgcccttggtgctatggggcagtggcagctcgaggtcggagacccagctccgctaggggctggcaatctgggtcctgagctcattaaggagtccaatgcaaatcctatctttatgcgcaaggacacaaagatgagtttccagtggaggattcgcaacctcccctatccgaaggacgtgtacagcgtgtccgtcgaccagaaggaacgatgcataatcgttcgtacaactaataaaaaatactacaaaaagttcagtattcccgatctcgacagacaccagctcccgcttgatgacgctctcctgtctttcgcccacgctaattgcaccctgattatttcttaccagaagcctaaggaagttgtggtggccgagtcagagctgcagaaagaattgaagaaggtaaagaccgcccatagtaacgatggcgactgcaagacgcagtag

SEQ ID NO: 46780 - DNA, 741 bp, Artificial Sequence
  Description of Artificial Sequence: Synthetic coding sequence
atggagacccggcggggccggcggcggaccttcggcggcgagtgggaacgaccagcgccagttctcgtcagtgcttcgaggcacgggggcgcgcagcgacggtcgtgcggcgaaatgggtcacggtagaagccgttgcggcgagccatctggcaacggcggcgtcagccagttgagagtgaagagcagagcaggggctgtatactctccttgtactcagcttgcacaggcccgtgagtcacagcttggcgcgagaagaaagctcgagtgtcctacccccgccccacgtgtgagcccaacgccccgcgtgggcccccgggttggttcaacaaccgggcaggcctcccatcctggggtgggccgtaatcgcccccttaccagtcgggccaatgagagcggtcgaaggggggagggcggacagatggcccgcatcgcatctgaaagcgcaggtagcgacccattggagcggctgccctggcagcgcctcggggtgctcctctcaagaggcaaaatggcggtgacaggctggttggagtcactgaggaccgcacagaagactgcactgctacaggacggcaattccagggtgcccaccgggagcttcgtgttttttccacagggcccggccctgagagagggtccgcagggcttaggaagacagtcatggaaaggattgggcggccaacctggccaggtactccacctccagatgagaaggcttcgcttcaccgagatgacttag

SEQ ID NO: 46781 - DNA, 351 bp, Artificial Sequence
  Description of Artificial Sequence: Synthetic coding sequence
gccgaggagtacgacgagaagaccagcgagctgctggtgcggaagtggagggtgaagagtgccttaggtgctatgggccagtggcagttggaagtgggtgatcccgcccccctgggggcgggtaatctcgggcctgagctgattaaagagtccaatgcaaatccaatctttatgaggaaagacacaaagatgtcatttcagtggcggatacgaaacctgccctatcctaaggatgtgtactcagtgtctgtggatcagaaggagcgctgcattattgttcggacaaccaacaagaatacccgctcacagagaaggctgtggtggccctcgctgagctacaggcgcaactag

SEQ ID NO: 46782 - DNA, 3030 bp, Artificial Sequence
  Description of Artificial Sequence: Synthetic coding sequence
atggacatgttcagcctggacatgatcatcagcgaccccgccgccgaggcctcccgcgcagggaaaaaacagctgcgtggggttcagaatccctgcccttccgcacgtgcgaggccccgacacaaaagcctcaatataaaggataagatttcggagtgggagggaaagaaggaggtgccaacccctgcaccaagccggagagccgacggccaggaggactacctgccctccagcacagtggaacggcggagctctgacggcgtccgcacacaagtgacagaagccaagaatggtatgaggccaggtaccgagtctaccgagaaggaacgcaacaagggcgcagtcaacgttggcggacaagatccggaacctgggcaggatctcagtcagcccgagcgggaagtggatccatcttggggcagaggccgcgaacccagattgggcaaattaaggttccaaaatgaccccctgtcagtgctcaaacaggtgaagaagctggaacaggccctaaaagatggtagcgccggcctggaccctcagcttcctggtacgtgttactcgcctcattgcccccccgacaaagcagaggctgggtccacacttcccgaaaacttgggaggcggctcaggcagcgaggtgtcccagagggttcaccctagtgacttggagggtagagagccaacaccagagctcgtggaagatcgaaaggggtcttgccgtcgtccctgggacagaagcctcgaaaatgtctatagggggtcggagggctcaccgacgaagcctttcatcaaccccttacctaagccccgacgcacttttaaacacgctggagaaggcgacaaggacggcaagccaggaattggatttagaaaggaaaaacggaacctacctcccctcccgagccttcctccgccacctttaccctcctctccacccccgagctccgtaaaccgcaggctgtggacagggcgccaaaaaagcagtgctgaccacagaaaatcatacgaattcgaggatctgcttcaatccagctctgaatcatcgcgtgtcgattggtatgcgcaaaccaagcttgggcttacgcgcaccctctctgaggaaaacgtgtatgaggacatcctggatcctcccatgaaagaaaacccttatgaagatatcgagttgcatgggcgctgtcttggaaagaagtgtgtgcttaacttccctgcgagccctacaagttcgataccagacactctgacaaagcaatcactgtccaagcccgcattcttcagacagaatagcgagaggagaaacttcaagctgctggacactagaaaactgtcccgggacgggacaggcagtccatccaagatctccccaccctctactccctccagtcccgacgacatcttttttaatctcggggatccacagaacggacgaaaaaaaagaaagattccgaagctggtcctgaggattaatgccatttatgaagttagacgaggtaaaaaaagagtgaaacggctgagtcagtcaatggaaagtaattcgggtaaggtcacggatgaaaacagcgagagcgacagcgataccgaggaaaagctgaaggcccattcccaacggctggtgaacgttaagagcaggctgaaacaggccccacggtacccaagtctcgcaagagagcttattgagtaccaagagaggcagctgttcgagtacttcgttgttgttagcctccataagaagcaggccggtgcagcttacgtaccagagctcacgcagcagttcccacttaaactggagcggtctttcaagttcatgcgcgaagctgaggaccagctgaaggcgattccacagttctgttttcctgacgccaaggattgggtgccagtgcagcagtttacatccgagacgttctcgttcgtactgactggggaagatggctctaggagattcggctactgcaggagactgctgccaggcggcaagggcaagagactacccgaagtctattgtattgtgtcccgtctcggatgcttttctcttttctcccgcattttagacgaggtcgaaaagcggcgggggatcagtccagcacttgtgcagcccctgatgagaagcgtcatggaggccccctttcccgcgctcggcaaaactatcctggtgaagaactttctgccagggtccggcacagaggttattgagctctgtcgcccgttagactcacgcctggagcatgtggacttcgagagccttttctctagtctcagtgtgcggcacctcgtgtgcgtttttgcgagtttgcttttggaacggagagtcatttttatcgcagacaagttgtcaattctgtctaagtgttgtcacgctatggtcgctctgatatacccatttgcttggcagcacacatacatcccagtattgccccctgctatggtggacatcgtgtgttctcctacaccgtttctgatcgggctccttagctcctcacttcctctgctgagggaactaccattagaggaagtcctggtggtggatcttgtgaactcccgatttctcaggcagatggacgatgaagacagcatcctgcctcgcaagctgcaggtcgccctcgaacatatcttagagcagagaaatgaactggcttgtgagcaagatgagggcccgcttgacgggagacatggccctgagtcatcaccattgaacgaagtcgtgtcagaggccttcgtgcgctttttcgtagagattgttggacactactctctgtttcttacctccggtgaaagggaagagaggactcttcagcgggaggcattccggaaggcagttagctccaaaagccttaggcacttccttgaagtttttatggaaactcagatgtttcggggcttcatccaggagcgagagttgagaagacaggacgccaaaggactttttgaggtccgggcacaagaatacttggagacacttccttccggggagcacagtggcgtaaacaagtttctgaagggcctgggaaacaagatgaaatttttgcataaaaagtag

SEQ ID NO: 46783 - DNA, 240 bp, Artificial Sequence
  Description of Artificial Sequence: Synthetic coding sequence
atggacatgttcagcctggacatgatcatcagcgaccccgccgccgaggcctcaagagccggaaaaaaacaactacggggagtacagaacccttgtccatcagctcgcgcccgtccacgacacaagagccttaatatcaaggataagattagcgaatgggaaggcaagaaggaagtgccaacccccgccccttcaagacgcgcggacggccaggaggactatctgccatcttctacttag

SEQ ID NO: 46784 - DNA, 273 bp, Artificial Sequence
  Description of Artificial Sequence: Synthetic coding sequence
atggacatgttcagcctggacatgatcatcagcgaccccgccgccgaggccagccgagcagggaaaaaacaactcagaggcgttcagaacccctgtcctagcgctagagccaggccaaggcacaaatcactgaacataaaggataagatatctgaatgggagggcaaaaaagaggtgcccacccccgcaccttctaggagagccgatgggcaagaagattatctgccttcgagcaccgtggagagaaggagttctgatggagttcgtacctag

SEQ ID NO: 46785 - DNA, 477 bp, Artificial Sequence
  Description of Artificial Sequence: Synthetic coding sequence
atggacatgttcagcctggacatgatcatcagcgaccccgccgccgaagcatcccgcgcggggaagaagcagctgcggggagtgcagaacccttgcccgtctgcgagagcacgcccacgacacaaatccctgaacattaaagataaaatcagcgaatgggaaggaaagaaagaggtccctactccggccccatcccggcgcgccgatggacaggaggattacctgccctcgagtaccgtggagagacgcagcagtgatggcgtccggacacaggtgacggaagccaagaatggcatgcgacccggcacagagtctaccgaaaaagaaagaaataaaggcgctgtgaacgtgggtggccaggatccagaaccagggcaggacctcagccagcccgaacgggaggtcgacccatcctggggccgcgggcgtgagccaaggttaggcaagctccgttttcagaacgaccccctttcatag

SEQ ID NO: 46786 - DNA, 2388 bp, Artificial Sequence
  Description of Artificial Sequence: Synthetic coding sequence
atggacatgttcagcctggacatgatcatcagcgaccccgccgccgaggcatctagagctggcaaaaagcaactgcgcggcgtgcagaacccatgcccatccgcccgcgccaggccgcggcacaagtcattgaacattaaagacaagattagcgaatgggaaggtaaaaaggaggtgcctacacctgcaccctcacgcagagccgatggccaggaagattatctgccttcatcgacagtagaacgaaggtcctccgatggtgttagaacccaggtgacagaggccaagaatggcatgcgtccaggcaccgaaagtactgaaaaggaaagaaacaagggcgccgttaatgttggtggacaggacccagagcctggacaagacttgtcccagcccgaacgggaggtggatccaagctggggtcgcggaagggagcctagactcggaaaattaagatttcagaacgatcccctgagcgtgctgaagcaagtgaagaagctggagcaggctctgaaagatggaagcgccggcttggatcctcagttacctggtacctgctatagcccgcattgccccccggataaggcagaagctggcagtactctaccagaaaacttggggggaggaagtggttccgaagtctcccagcgggtccatccctctgacttagaaggaagagaacctacacccgagttggtggaggaccgaaaggggtcttgtagaagaccgtgggacaggagtctggagaatgtctaccgcggatccgagggctccccaacaaaaccatttatcaaccccttacccaaacctagacgtacctttaaacacgccggagagggagacaaggatgggaagcctgggatcggattccggaaggaaaaacgcaacttacctcccctcccatcactaccgccccccccactccctagctcccccccacctagtagcgtgaaccgacgcctgtggactggcaggcagaaatcatcagcggatcataggaaatcttatgaatttgaggatctacttcaatcctcttcggagagctccagagtggactggtacgcgcagacaaagctcggactcactagaaccctgagtgaggagaatgtttatgaagacatcttggacccgccaatgaaggagaacccgtacgaggacatcgaactgcacggacgttgcttgggaaagaaatgcgtgttgaactttccagcatcccccacatctagcatccccgacactctgactaaacagtccctttcaaagcctgccttctttcgccagaacagcgagagaaggaatttcaaactgctggatacacgaaaattgtcacgggatggaaccggcagcccatctaagataagcccccctagcacaccctcatcacctgacgacatctttttcaatttaggtgatcctcagaatgggcggaaaaaaaggaagatccccaagcttgtgcttaggattaatgcaatctacgaggtgagacgcggtaagaagcgcgtcaaacgcctcagtcagagcatggaaagcaatagtggtaaagtcactgatgagaatagtgagagtgacagcgacaccgaggaaaaactaaaggcacattctcaacggctcgtgaacgtgaaatctcgccttaaacaggccccccggtatcccagcctggcccgggagttgatcgagtatcaggagaggcagctgtttgaatattttgtcgtggtgagtctgcataaaaagcaagcaggcgcggcatatgtgcctgagctgacacaacagttcccactgaagttggaacgctcattcaaatttatgagagaggcagaagaccaacttaaggccattccccagttttgcttcccggacgcaaaggactgggtcccggtgcaacagtttacaagcgaaaccttctccttcgtcttaaccggagaggatggatcaaggcgcttcggctactgtcgacgtctgctcccagggggcaaaggtaagagactaccagaagtttattgtattgtttctagactgggctgtttttctctgttctcaagaatcctcgacgaggtggagaagcggagaggcatatcaccagccttagtgcagccactgatgcgcagtgtgatggaggcgcccttccccgccttgggcaagaccattctagtgaaaaacttccttccaggcagcggtacagaagtcatcgaattgtgtcgccccttggactcccgactcgagcatgtggattttgagtccctgttttccagcctgtcagttcggcatctcgtctgtgtgttcgcttcgcttttgttggaacggagggttatatttattgctgataagctgaggtaccccccctggcttttgttattgaagcgcttgaacgatagtagaagctggaccctgtag

SEQ ID NO: 46787 - DNA, 3030 bp, Artificial Sequence
  Description of Artificial Sequence: Synthetic coding sequence
atggacatgttcagcctggacatgatcatcagcgaccccgccgccgaagccagccgtgccgggaaaaagcaacttaggggcgtgcagaatccatgcccatccgcccgcgctcggcctcggcacaaatcacttaacattaaggataaaatcagcgaatgggaaggaaagaaggaagtcccaacacccgccccaagtcggcgcgctgatggacaagaggactatcttccttcgtcaaccgttgaacgcaggtcctccgacggggtgcggacacaggtcaccgaggccaagaacggcatgagacctggcacagaatcaactgagaaggaaaggaacaagggcgcagtcaacgtaggaggacaagaccccgagccgggacaagatctgagccagccagaaagagaggtagacccttcatgggggagggggagggagcctcggctgggtaagctccgttttcaaaacgatcctctctccgtgctgaagcaagtgaagaaactggaacaggctctgaaagatgggtctgctgggctcgatccccagttaccaggaacgtgctacagtcctcactgcccaccagataaagcagaagcgggaagcacccttcccgagaacttagggggggggtccgggtctgaggtgagtcagcgcgtgcatccttctgaccttgaaggcagggagcctactccagagctggtggaggatcgcaagggcagttgccgcagaccatgggacaggtccttggaaaatgtgtacaggggcagcgaaggatcccctactaagcctttcatcaacccgctccccaaaccacgtcgtaccttcaagcacgcaggcgagggtgataaggacggcaagcctggaatcggatttcggaaggagaaacgtaatctgccacccctaccctctctcccccctccccccctgcctagtagcccacctccctcctctgtgaaccggcgcctttggactgggaggcagaagtcgtctgccgaccacagaaaaagttatgaatttgaggacctcctccagtcgagcagcgaatccagccgagtggactggtacgcccagactaagctcggtttgaccagaactctcagcgaggaaaacgtttacgaagacattctggaccctcctatgaaggaaaatccgtacgaggatatcgagctacacggaaggtgtctgggcaagaagtgtgtacttaatttccctgctagccctactagttctattcccgacaccttaacaaagcagtcactgagcaagcccgccttcttccgccaaaactccgaaaggagaaacttcaagttgctggacactagaaagttgagccgcgatggaaccgggtctcccagcaagattagcccgccctctacgccatcctcccccgatgatattttcttcaatttgggagatcctcagaacggtcgcaagaagcgtaagatcccaaaattagtactgagaatcaatgcaatttatgaagtcaggcgcggaaagaaacgcgtcaaaaggctcagccagtctatggaaagcaattccgggaaggtaaccgatgagaacagcgagtccgactctgacactgaggaaaaattaaaagcccacagccagcgtctcgtcaatgtcaaatctaggcttaagcaagcaccgaggtatccctctctggctagggagctgatcgagtatcaggaacgtcaacttttcgagtacttcgtggtggtaagcctccacaagaagcaggctggcgcggcctatgtccctgagctgactcagcagttcccactgaagttggagcggagtttcaagtttatgcgggaagctgaggaccagttgaaggccatccctcagttctgctttcctgatgccaaagattgggtaccagtgcaacaattcactagcgagacgttctccttcgttctgacaggagaggacggctctaggcgtttcggctactgtagaagactactgcccggggggaagggcaagaggctccccgaagtgtactgtatagtgagccgactgggctgcttttccctattcagtagaatccttgacgaggtggaaaagcggcgagggattagtcccgctctagtgcagccgttgatgcgcagcgtaatggaggcacccttccccgcgttgggcaaaaccattttggtgaaaaattttctgccaggatctgggaccgaggtcatcgagctctgccgtcctctggattcaaggctggaacacgtggacttcgagtcactattttcatcactgagtgttcgacaccttgtgtgcgtctttgcttccctgctcctagagcggagggtaatatttatagctgacaaactgtcgattctatccaagtgctgtcacgcaatggtcgccttgatttacccatttgcctggcaacacacatatattcctgtgctgccaccagccatggtggatatcgtatgctcccccaccccattcttaatcggccttctgtcatcttcgctgccgctccttcgcgagctgcccttagaggaggtgctggttgtggacctggtaaactccagatttctacggcaaatggacgacgaagacagcatcctcccgcgtaagttacaggtggcccttgagcacatcctggagcaacgaaacgagctcgcttgcgagcaggacgaagggccactggatggccgccatggacctgagtccagtcctctcaacgaagtggtgtctgaggcatttgtgaggttttttgtcgagatagtcgggcactacagtctcttcctcacgagcggcgaacgggaggaacggaccctgcagcgggaagcgttcaggaaggccgtgtcctctaagtcgttgagacactttctggaggtgtttatggaaactcaaatgttccgaggttttattcaagaacgggagttgcgccgtcaggacgcaaaggggttatttgaggtgagagcgcaggaatatttggaaactctgcccagcggggagcactctggcgtcaataaatttctgaagggcttgggaaataagatgaaattcctgcacaagaaatag

SEQ ID NO: 46788 - DNA, 3030 bp, Artificial Sequence
  Description of Artificial Sequence: Synthetic coding sequence
atggacatgttcagcctggacatgatcatcagcgaccccgccgccgaggcatcacgggccggaaagaaacagcttaggggcgtgcagaacccttgtccatcagcccgtgcacgaccccgtcataaatccctcaatatcaaagacaagattagtgaatgggaaggaaagaaggaggtgccaacaccagcaccatcaagaagggccgatggccaggaggattacctgcctagttccaccgtggagcgccggagttccgacggcgtccgaacacaggttacagaagccaaaaacgggatgaggcccgggaccgaaagtactgagaaggaacgtaacaaaggcgctgtgaacgtgggaggacaggaccccgaacccgggcaggacctgtctcaacccgagcgtgaagtggatccctcttggggacgggggagagagcctcgtctcggcaagctgcggttccagaatgacccactgtctgtactcaagcaggtgaaaaaactcgaacaggctttgaaggacggctccgccgggcttgatccacagctgcctggcacgtgctactcccctcactgtcctcctgacaaggctgaggccggatctacactgccggaaaatctaggtggcggctctggtagtgaagtgtcccagcgcgtccatccaagcgatctggaaggacgtgaacctacaccggagttggtggaggataggaaagggtcatgcaggcgcccatgggataggtccctggagaatgtatatcggggatccgagggatcgcccacaaagcccttcatcaatccgctgcccaaacctcggcggactttcaagcacgccggcgaaggcgacaaagatggcaagccaggaattgggtttagaaaagaaaaacgcaatctaccgccgctaccatccctgccaccgccccccctgccgtccagcccacctccttcgtctgtgaaccggcgcctgtggactggcagacaaaaatcttccgcagatcaccgaaaaagttacgagttcgaggacttgctacagagcagcagcgagtcatcccgcgtggattggtacgcgcaaaccaagttaggtcttacccgaactctcagcgaagagaatgtatacgaagatatattggaccccccaatgaaggaaaacccatatgaggacatcgagctacatggtaggtgcttaggaaagaagtgcgtgctcaacttcccggcttcccccacaagctcaataccggatactctgactaaacagtcccttagcaaacctgctttcttccgacaaaacagcgagcgcagaaactttaagctcctggacactcggaaactgtctagggacggcactggctcaccctctaagatttctcctccctctacaccaagctcacctgacgatatattttttaatctgggcgacccccagaatggccgaaagaaaagaaaaattcctaaactcgttttgcggatcaacgccatatacgaggtgcgccgcggcaaaaagagagtgaaacggctgtctcagtccatggagagcaactcaggtaaagtgaccgatgagaactccgagagtgattctgacacagaagagaagctgaaagctcactctcagcggttggtgaacgtcaaaagtagattaaaacaggcaccgaggtatcctagtctcgctcgggagcttatcgaataccaagagcgtcagctgtttgaatatttcgtggtggtaagcttgcataaaaagcaagctggcgctgcgtatgtgcccgagttgacccagcagtttcctctgaagttggagcggagctttaaattcatgagggaggcagaggaccagttgaaagccattccgcagttttgcttccctgatgctaaggattgggtgcctgtgcagcagttcacgagcgagacgttcagcttcgtcttgaccggcgaggatgggtccagacggtttggttattgccggaggttgctgccgggaggcaaaggtaaacggttgccagaagtgtattgtattgtgagcaggctgggttgttttagcctgttttcaagaattctcgacgaggtagagaagagacgagggatctcacccgccctcgtacagccacttatgaggtctgttatggaagccccttttccagccctcggcaaaacaatacttgtcaaaaacttcctgcccgggagtggaactgaagttatcgaactgtgccgtcctctggactctaggctcgagcatgtggatttcgagtctctcttcagttccttatcagtgcggcacctggtgtgcgtgttcgcctctctgttacttgaacggcgagtgatcttcatagctgataagctgtcaattctgagtaagtgctgccatgccatggtggccttaatttatccattcgcctggcagcacacctacatcccagtgcttccacccgccatggtagacattgtctgctcgcccactccttttctcatcggcctgctgagttccagtctccctctcctgagggaattgccgttggaggaagttctagtggtggaccttgtgaattcccgctttctccgacagatggatgacgaggattccatcctaccgaggaagcttcaagtcgccctggagcacatcttggaacagaggaacgagcttgcttgtgagcaggatgagggtccactggatggcaggcacggacccgaatcctccccactgaatgaggtagtgagcgaagcctttgtgcgattcttcgtcgagattgtgggtcattatagcctgtttcttacaagcggggaacgcgaagaacggactttacagcgggaggccttcaggaaggcggtgagcagtaaaagcctcagacactttcttgaggtgtttatggagacccagatgttcagaggctttattcaggagagggagttaagacgacaagatgccaagggcctattcgaagtacgtgctcaagagtacctcgaaacgctgccgtccggcgagcactccggagtgaataagttcctgaaggggctgggtaacaaaatgaaatttctacacaaaaaatag

SEQ ID NO: 46789 - DNA, 2787 bp, Artificial Sequence
  Description of Artificial Sequence: Synthetic coding sequence
atggacgtgggcttcagccggaccaccgtgcagaccctgagccggtctcactgcaaaaatatcaagcaaaaaatcagtcagtgggagggccgcgccaatggtatatcaaatcctgagaagtggtgtccgaaagattttggagtacggtacaactgccaccaggaaatccggctgaaaaaaaatcccatcgccgagagaaaatcaaaaaatctggacgtgacctcccgggagaatgtaggactggacatcaatgaaaataccaaaagccatgaccaatccgaaaacgagaacaagaagcatgaatatgacgacacacacttctttaaaaacgaaagcgaatccaattgggtttgctcccgtgtgaaggagattgagtcctgtaaggaggacgtgctggatccggagactagcttgccacccggcaacttttacaccagccagatattgtggaaaaaaattgaggccctgccccctgacaaacttcttaatctcgcgctggaacattgcgattcaagcgagaaagagctgaactttagagtgttagactccagctacgggattacgaaatctctggagaacatatatagtgagcctgaggggcaggagtgcggtcccagcatcaaccctcttccaaaacctagaagaaccttcagatatttaagtgagtctggtgtaacgccttacaaggagcgcaactgtgacaagaagtactgcgagaataactcttgtgcccaaagttccctggcctcgtctcaagagcctgagccaaaaaaatacggcgggaagatacgaggacgcagtaaaaggaagtcttttgagttcgaggacatccagcacttcagaaacagaaattcgcaaacaattcgggaagagcttggcaggaactccgggtccgccctgtactacactcagagcgaggataacatttacgaggacattatctatcctactaaagaaaacccttacgaggatattcccgtccagccactccccatgtggcgctcaccttctgcctggaaattgccacccgccaaatccgcattcaaagctcccaagttgcctccaaaaccccagtttcttcatcgcaagaccatggaagtaaaaaactctcaggcctatctgcggtccaagctcaccaaagatacaaccctgcccgtgacactgaccgaatggaaattgttccgggccggagaggttgccaataccaaacgcaagaatctcccgcgattggttcttaagattgacgatatttttgagtctaagcgtgggaagaagaaagtgaagttgcatagctatacgggaaaggaacttccacccaccaagggggagacatctggcaacgaaagtgacgccgaatacctgccaaagaatcgccacaagcgcttagcccagctgcaaccgtcctctaagagaaacccccattatcaaaccctggagagagacttgatcgagcttcaggaacagcaactcttcgagctgttcgtggtggtgtccctgcagaaaaaaccctcaggtatctcttatattccccaggtgattcagcaattccccgggaaagatgaccacggttataaacagtctaaggatatggaagaaagattgaaggtgatccccaaattctgttttcccgacagcaaagattggatgcccacctctgagctgaaaagtgagacattttcatttgtgttaaccggggaagatggctcgcgatggttcggatattgcaaaaaattgctacccgtaggcaaggggaagagactccccgaagtgtactgtatggtgtcccgcttgggatgctttaacttgttttccaagatcctcgatgaagtggaaaagcgcagggagatgagccctgctctcgtgtacccatttatgcgatccgtgatggaggcacccttcccagccccaggccgcacgattactgttaagtcatatcttcctggtgccggcgacgagtcgattgaactatgtcgacctctcgattctcggctggagcatgtggactttaagtgcctgttcaagtgcctctcagtctgccatctgataagagtgtgtgcttccttgctcctggaaagaagggtaatcttcgtcgcaaacagtctttcgacattgagcaaatgtggccacgcggtagtggccaccctatacccatttacctggcagcatacttacatccctgtactccccgcgagcatgattgatatcgtctgctccccaactccattcttgatcgggatcctgtcctgtagtcttccccagctacaggatctgccaatcgaagaggtccttatcgtcgacctctgtgcagacaaattcctgcaggaggtatctgacgaggatgaaattctcccccccaagctccaggcagcgttgatgcagatactggaggaacggaatgaaattctcactcaagaacagaatttcagtcaggacgtgacacttaatagtctggtgagtgaagccttcgttaggttttttgttgagcttgtcggccactattctcttaatatgacagtcacagagcgtggcgagcgcgttttccaaagggaaccctttcgcaagtcgcacaccagcagatccgtcaggcacttcctggatttatttatggaaacacagatgttcgccggattcatccaggatagagagctgagaaaatcaggcgtcaagggcctattcgagattagggccattcagtacttggaaacaatccccgagagcgaaccaagcggcatgaataggatcctccggtcactggggtctaaaatgaagtttctacaaaagaaatag

SEQ ID NO: 46790 - DNA, 2787 bp, Artificial Sequence
  Description of Artificial Sequence: Synthetic coding sequence
atggacgtgggcttcagccggaccaccgtgcagaccctgagccggtctcactgcaagaacatcaagcagaaaatctctcagtgggaggggagggctaatggcatttctaatcctgagaagtggtgtcccaaggacttcggggtgagatataattgtcaccaggagattagactgaaaaaaaaccccatcgcagagcgaaaaagcaaaaacctagatgttacctcgcgggaaaatgtgggtttggatataaatgaaaataccaagtctcatgaccagtccgagaatgagaacaagaagcacgaatatgacgacactcacttttttaagaacgagagcgagtcaaattgggtgtgtagcagggtcaaggagattgagagctgcaaagaggatgtactcgaccccgaaacatcactccccccagggaatttctatacatcacagatcctgtggaagaaaatagaggctctgccacccgacaagttgctcaacctcgcgttagaacattgcgattccagcgagaaggaactgaatttcagagtgctcgactcctcttacggcatcaccaagagcctagaaaatatatacagcgagcccgagggacaagaatgcggtcctagcatcaaccctctccctaagccacgacgcacattcagatacctgtccgaaagcggagtcactccctacaaggaaagaaactgtgacaagaagtattgcgaaaataatagttgcgcacagagctccctggcctcctcacaagagcccgagcctaagaagtatggcgggaagatccgcgggaggtccaaacgcaaaagcttcgagttcgaagacatccaacacttccggaaccgaaatagccagactattcgagaagaactgggccgaaactcaggctctgccctgtattatacacagagcgaagataacatctatgaggacatcatctaccctacaaaagaaaacccctacgaggatattccagtccaacctcttcccatgtggaggagtcccagcgcttggaaactcccccccgcgaaatccgcgttcaaagcccccaagctgcccccgaaaccacagtttcttcataggaaaaccatggaggtgaaaaattcccaggcatatctccggtccaaactgactaaggacactactctgcccgtcacgttgaccgagtggaaactgtttagggctggcgaagttgcgaatacgaagcgaaaaaatctgccccgtctagtcttgaagatcgatgatatctttgaaagtaagagaggaaagaaaaaggtcaagctgcacagctatacagggaaggagctgcctccaactaagggtgaaacctctggaaacgagtcagacgccgaatacttgcccaaaaaccgccacaaaaggttagcccagcttcagccctcctccaaacgaaaccctcactaccaaacgctggagagggacctcatcgagcttcaagaacagcagctatttgaactgtttgttgtcgtctcacttcaaaagaagccctcagggattagctacattccccaggtaatccaacagttccctggcaaagacgaccatggatacaagcagtctaaagacatggaggagaggctgaaagtcattccaaagttttgcttccctgactcaaaagactggatgcctacatccgagcttaaaagcgaaactttcagtttcgttttaacaggggaggatgggtctcggtggttcggctattgtaagaaactgctcccagttggcaagggtaagcgacttcctgaagtgtactgtatggtgtcccggctcgggtgttttaatcttttctctaagatcctagacgaggtggagaagagaagagagatgtcccctgcccttgtttacccttttatgaggagcgtgatggaggccccatttcccgcccctggccgaacgatcaccgtgaaatcttatctccccggagcgggagacgagagcatcgaactttgcaggccactggattccagactagaacacgtagactttaagtgtctgttcaagtgtctctcagtgtgccacctgatccgagtttgcgcttccctcctgctggaacgccgtgtaattttcgtggcaaacagcctgtcaacgttgagcaagtgcggccatgcggtcgtggctacgctgtaccctttcacctggcagcatacttatattcctgttctgccagcctcaatgatagacattgtctgctcacccactcctttcttaattgggatcctgagttgctctcttcctcagctgcaggatttgcccatcgaagaagttctgatcgtagatctttgcgccgataaatttttgcaggaggtgtcagatgaggacgaaattctgcctcctaagctccaggctgcgttgatgcaaattctggaggagaggaacgaaatccttacccaagagcagaacttctctcaggatgtgacactgaatagcctggtaagcgaggccttcgtgcggtttttcgtcgaattggtcgggcactacagcctcaacatgacagtgaccgagagaggggagcgagtgttccagagggagccattccgcaaatcgcatacttcccgatccgtgaggcactttctggatctctttatggaaactcagatgttcgccggctttattcaagatcgagagttaaggaaatccggagtgaagggactcttcgagattcgcgcaatacagtatcttgagactataccagagtctgagcctagcggaatgaacaggattttgcggtccctggggtccaagatgaaattcttacaaaaaaaatag

SEQ ID NO: 46791 - DNA, 2616 bp, Artificial Sequence
  Description of Artificial Sequence: Synthetic coding sequence
atggacgtgggcttcagccggaccaccgtgcagaccctgagccggtctcactgcaaaaacatcaagcagaagatctctcaatgggagggccgggccaacggcatctccaacccagagaaatggtgccccaaagatttcggagtgcgatacaactgtcaccaggaaattcggctaaagaaaaaccccattgcagagagaaaatctaaaaacctggacgttacgtcgcgtgagaacgtgggacttgatatcaacgagaatacaaaatctcatgaccagagcgaaaatgaaaacaaaaagcacgagtatgatgatacacattttttcaaaaacgaaagcgaatccaattgggtatgttctagggtcaaggaaattgaatcttgtaaggaggatgtcctggacccagaaactagcctgccgcctgggaacttttacacctcgcaaatcctctggaagaagatagaggcacttccgcccgataagctgctgaacctcgcccttgagcattgcgactcaagcgagaaggaactgaatttcagagttcttgacagcagctatgggattacaaaaagtctggagaacatatacagtgagccagaaggacaggagtgtggtccttccataaatccgctgccaaagcctcgtagaacgtttaggtacctctccgaatctggggtgactccgtacaaggagagaaactgcgacaagaaatactgtgagaacaacagctgcgcccaatccagcttggcctcaagtcaggagcctgagccaaagaagtatggagggaagatcagaggaagaagtaagcggaagagctttgaatttgaggacattcaacatttcagaaaccgtaactcccagacaattcgagaggagctgggtcggaattctggttcagctctgtactacacccagtctgaggataatatctatgaggatatcatataccccactaaggagaacccttatgaggacatacctgtccaacctcttcccatgtggagaagcccctctgcttggaagcttccccccgccaagtccgcctttaaggcaccgaaactcgtgcttaagattgacgatatctttgagtccaagcggggtaaaaagaaagttaaactccactcgtacactggaaaggaactccccccaacaaaaggagagaccagcgggaatgagtctgatgccgaatacctgcccaaaaaccgtcacaagaggctggctcagctccagccctcgtcaaagaggaacccccattaccagacacttgagcgggatttaatcgaactgcaagagcagcagctgttcgaactctttgtcgtggtcagtctgcagaagaagccatccgggattagctatattccccaggtgatacaacagttcccaggcaaggacgatcatggctataagcagagtaaggacatggaggaacgtttaaaggtcatccctaaattttgttttccagatagcaaggactggatgccgacctctgaactgaagagcgaaaccttcagcttcgtcttaaccggcgaggacggaagcaggtggtttggctattgtaagaaactactgcctgtgggcaaaggtaagagactgcctgaagtctattgtatggtcagcagattggggtgttttaatctgttcagcaagatcttggacgaggttgagaaacgccgcgagatgagccccgcgttggtgtatcccttcatgcggtccgtaatggaagctcccttccctgcaccaggaaggaccatcactgtgaaatcatatctgccgggggccggggacgagtccatcgagctatgtcgccctctcgattctaggttggagcacgttgacttcaagtgtctgttcaagtgcctgtccgtatgtcatttgattcgggtgtgcgctagtttgctactggagcgccgcgtgatctttgtcgctaattccctgtctaccttgagtaagtgcgggcacgccgttgtggcaacgctctaccccttcacatggcagcatacctatatccctgtgctgcccgcatccatgattgacattgtttgctctccaacgccgtttctgataggaatcctatcgtgtagtcttcctcagttgcaggatttgcccatcgaggaggtgttgatcgtggacctgtgtgcggacaaatttctgcaggaagtatccgatgaagacgaaatactgccccccaagctgcaggctgcactgatgcaaatcctggaggaacgcaacgaaatccttacgcaggagcagaatttttcccaggacgtcactctgaactcactcgtgagcgaggctttcgtccgcttttttgtggagctcgtggggcactactctttgaatatgacggtcacagaaaggggcgaaagagtgttccagcgcgaacccttccgtaagtcgcacaccagtcgctctgtacgccacttcctcgacctatttatggaaacccagatgttcgccggtttcatacaggatcgggagctgagaaagagtggggtgaaaggccttttcgagattagagcaatacagtatctggagacgatccccgaatctgaaccctccgggatgaaccggatacttcgctctctcggcagcaaaatgaagtttctccaaaagaagtag

SEQ ID NO: 46792 - DNA, 2451 bp, Artificial Sequence
  Description of Artificial Sequence: Synthetic coding sequence
atggacgtgggcttcagccggaccaccgtgcagaccctgagccggtcacattgcaagaacataaagcaaaaaatctctcagtgggagggaagagcaaatgggatctccaaccccgagaaatggtgcccaaaagactttggtgtgagatacaattgtcaccaggagatcagactgaagaagaatccaatcgccgaacggaagagtaaaaatctcgatgtgacttcgcgcgaaaacgtggggctcgacatcaatgagaacacaaaaagccacgaccagtccgaaaacgagaacaagaaacacgagtatgatgacacgcacttttttaagaatgagtccgagtctaattgggtgtgttctcgcgttaaagagattgagagctgcaaggaggacgttctcgatccagagacttctctccccccgggtaacttctatacgtcacaaatcctgtggaagaagattgaagcattgcctccagataaattgttgaacttagccctggagcactgtgactccagcgaaaaggagctgaacttcagggtcctggattcatcttacggaatcactaagtctttggagaacatctattctgagcccgaaggccaggagtgtggaccttccattaatccactcccgaaacctcgcaggactttcaggtacctgagcgagtctggagtgactccttataaggagcgtaactgcgacaagaaatattgtgagaacaacagctgcgctcaatccagccttgcctcgagtcaggaaccggagcccaagaaatacggaggaaagataaggggccggtctaaaaggaagtcgttcgagtttgaggacatccagcacttccgcaacagaaattcacaaactatcagagaggagctgggcagaaattccggcagtgccctttactacacccagagcgaggacaatatctacgaagacatcatttacccaaccaaagaaaatccatatgaagacatccctgtgcaaccgctgcccatgtggcgctctccctctgcatggaaacttcctcccgccaaatctgccttcaaggctccaaagctgccacccaaaccacagttcctacacagaaagacgatggaagtcaagaacagtcaggcttatcttcgttccaaactcactaaagacacaacccttccggtgacattaacagagtggaagctgttcagagcgggcgaagtcgccaacaccaagcggaaaaatctgcccagactggtgcttaaaattgacgacatatttgaatctaagagaggtaaaaagaaagtgaaactgcattcttatacggggaaggaactgccaccaacaaagggagagactagcggcaacgagtcagacgcagagtacctccctaaaaataggcataagaggctggcacagcttcagccgtcttcgaagcgtaacccacactaccagacattagagagggatttgatcgagctgcaggaacagcaactcttcgagctctttgtggtcgtcagcttacaaaagaagcctagcgggatttcatatatcccacaggtcattcaacaatttcctggcaaggatgaccacggatataaacagtctaaggatatggaagagcgtcttaaggtgatcccaaaattctgtttcccagattcaaaagattggatgcccacctccgaattgaaaagtgaaaccttcagcttcgttcttaccggggaagacggttcaagatggttcggctactgcaaaaaactgcttcctgtagggaagggaaagagattaccagaggtgtattgcatggtttcgcggctggggtgctttaacctcttcagcaagatcttagatgaagtcgagaagcgtagagaaatgtccccagcccttgtgtacccattcatgcgttccgtaatggaagcccctttccctgcgccaggccgaaccatcaccttgcaggatttacctatcgaggaagtactgattgttgatctgtgtgctgataagtttctccaggaagtctctgacgaagacgaaatcctgccccctaaactgcaagcagcccttatgcagatcctggaagaaagaaacgagatcctgacccaagagcagaacttctcgcaagatgttaccttaaacagccttgttagcgaggccttcgtgcgattcttcgttgagctagtaggccactatagtctaaatatgacagtgactgagcggggggagagagtctttcagcgcgagcccttccggaagagccatacttctcgaagtgtgcggcactttctggacctctttatggaaacccagatgttcgcgggcttcattcaggacagagagctgaggaaaagtggggtaaaagggttatttgagattcgtgcgatccaatacctggagaccatcccagagagcgagccttcaggtatgaaccgcattctgcgcagcctcggatataagatgaagtttctgcagaagaaatag

SEQ ID NO: 46793 - DNA, 1416 bp, Artificial Sequence
  Description of Artificial Sequence: Synthetic coding sequence
atggagggccaggtggtgggccgggtgttccggctgttccagcggcgtctactccagctgcgggctggacccccacaggataattctggagaagcgcttaaggagcccgagagggcccaagaacattccctgccaaacttcgccggcgggcagcacttctttgagtatcttctggtagtgagcctaaagaaaaagcgctcggaggacgattatgagcccatcatcacttaccaattccccaagcgagaaaacctgctaagggggcaacaggaggaggaggagcggctattgaaagccatccctttgttttgcttccccgacggtaacgaatgggcgagcctgacagaatatcctcgcgagacctttagtttcgttctgactaacgtggacggaagccggaagattggatactgcagacgcctgcttccggccggtcctggaccaaggctacccaaggtttactgtataattagctgcattggctgctttggcctgttttccaagatcctggatgaggtagagaaacggcaccaaatttccatggccgtcatctacccatttatgcagggcttgcgggaggcagcatttcccgcacccggcaagacagtgacgctgaaatcatttattcctgactctggaactgaatttatcagcctgacacgaccccttgattcccacctggagcacgtggacttttctagcctgctgcattgcttgagttttgagcagatcctgcagatctttgctagcgccgtgctggagcgtaaaatcattttcctggccgaaggcctcagtaccctcagtcagtgcattcacgctgccgctgctctgctgtacccattttcttgggctcacacatatatcccggttgttcctgaatcactcttggctaccgtctgctgtcctacacctttcatggtgggggtgcaaatgagatttcaacaggaggtaatggattctcccatggaggaagtcttgctagtgaacctctgcgaagggacttttctcatgtcagtcggcgatgaaaaggatattctgcctccaaagcttcaggacgacatattggactccctgggccagggcataaatgaactgaaaactgctgagcagattaatgaacatgtgagcggaccctttgtacagtttttcgtgaagatcgtggggcattacgcctcgtacattaagcgcgaggccaatggacagggacactttcaagagaggtcattttgtaaagctctgacttccaaaactaaccgtagatttgtgaagaaatttgtgaagacccagctgttttcgttgttcattcaggaagccgagaagagtaagaatcctcctgccggttattttcaacaaaagatcctcgagtatgaggaacagaaaaagcaaaaaaaacccagggaaaagacagtaaaatag

SEQ ID NO: 46794 - DNA, 1407 bp, Artificial Sequence
  Description of Artificial Sequence: Synthetic coding sequence
atggacggcctgggccggcggctgcgggccagcctgcggctgaagaggggccacgggggacctccgcaggacaatagtggagaggccctgaaagagcctgagagggctcaggaacatagcctgccgaacttcgccgggggccagcacttttttgagtacctgctggttgtgtctctaaaaaaaaaaaggtcagaggacgactacgagcctattatcacttatcagttccccaagcgggagaatctgttgcgcggacagcaagaagaagaggagcgactcttgaaggctatccctctattctgcttcccagacggtaacgaatgggcatcactcacagagtacccccgggagacattctcattcgtgctcaccaacgtcgacgggtcacggaagatcggctactgccgcagactcctgcccgccggccccggcccacgactgccaaaagtttactgcattatttcctgtatcggctgcttcggcctgttttccaagatcttggacgaggtcgagaagagacatcagattagcatggccgttatctatccctttatgcagggcctccgggaggcagcattcccggctcccggcaagaccgttacacttaagagcttcattcctgacagcggaacagaatttatctctctgacacgccccctcgatagccacctggagcatgttgatttcagcagtctcctgcactgcctgtcatttgagcagattctacagatattcgccagtgcagtgttagagcgaaaaataatttttctggcagaaggattgagcaccctgagtcaatgcatacatgccgctgcagccctgctgtatccgttctcatgggcgcatacctacatccccgtggttccggagagtctgcttgccacagtctgctgcccaactcccttcatggtcggggtgcaaatgcgcttccagcaggaagtcatggatagtcccatggaggaggtactgttggtgaatctctgcgaagggacatttctcatgtccgtgggggacgaaaaggatatccttcctccaaagctccaagatgacatcctggacagcctgggccaaggaatcaatgagttaaaaaccgccgaacaaatcaacgagcatgtgtcaggccccttcgtacagttttttgtaaagatcgtcggtcattacgcttcatatatcaagagagaggctaatgggcaggggcacttccaggaacggtcattttgcaaggcgcttacatcaaagacgaataggcggtttgtgaagaaatttgtgaaaacacagctctttagtttatttattcaggaggccgagaagtctaaaaatccacctgccggctattttcaacaaaagattttggagtacgaagagcaaaagaaacagaagaaacctcgggagaagacggtaaagtag

SEQ ID NO: 46795 - DNA, 3597 bp, Artificial Sequence
  Description of Artificial Sequence: Synthetic coding sequence
atgcggagcctgcggaagaagcgggagaagccccggcccgagcagtggaagggcttaccggggcctccaagggcacccgagccggaagacgtggcggtacccgggggagtcgacctgctgacgttacctcagctgtgtttccccgggggtgtttgtgtggcaactgagcccaaagaggactgcgtacactttttggtgctgacggatgtttgcgggaatcgcacttatggggtagttgcgcaatattaccgaccgttgcacgacgagtattgcttttacaatggaaagactcacagagaatgtcccggctgtttcgtcccgttcgctgtgtgtgtcgtcagcaggtttccttactataactcccttaaggactgtctctcctgtcttctggcgcttctgaaaccatgtaaagacttcgaggtggattcccacataaaggacttcgcagccaaattgtcactgatcccctctcctccccctggacccctacacctggtcttcaatatgaagtctctgcagatcgtattgcctgccagggcagacccagagtctccaattctggatctggacctgcatctgcctctcttatgttttcgcccagagaaggtactgcaaattctgacttgtattcttacggagcagagaattgtgtttttcagcagcgactgggctctgctcacattggtgacagaatgcttcatggcctacctgtaccctcttcagtggcagcatcctttcgtcccaattctgagcgaccagatgctggatttcgtgatggcacctacctccttcctgatgggttgtcatctcgatcactttgaggaggtgtctaaggaagccgacggtctcgtgctaattaatattgaccatggttccattacatacagtaagtcaacggatgacaatgttgatattcccgatgttcctttgctggctgcacagacttttattcagagggtgcagagcctccaactacaccacgagctgcacgcggcacacctgctgagtagcactgacttgaaagaaggccgagcacatcggaggtcctggcaacagaaactaaactgccagatccaacagactactctacagctgctggtgtcaatatttcgggacgtgaagaaccatctaaattatgaacaccgcgtgtttaattctgaagagttcttaaaaactcgcgcccctggggaccatcaattttataaacaggtccttgatacctatatgttccactcgttcctaaaggcacgactgaaccggagaatggacgctttcgcccaaatggaccttgacactcagagtgaggaggacaggataaacgggatgctgctcagcccccgacggccgaccgtagagaagagagcatcaagaaaaagctcccatttgcacgtcacacaccgccgtatggtggtcagcatgcccaatttgcaggacattgccatgccagagctggcgcctcgaaactcctctcttagacttactgacacggctggctgtaggggcagctctgcggtgcttaatgtgactcccaaatcgccctacactttcaagataccggagatacatttcccacttgaaagtaaatgcgtacaggcctaccacgctcactttgtcagcatgctgagcgaggccatgtgctttttagcacctgataattccctgctactggcaagatatctgtacctgcggggtctggtgtatctgatgcaaggccagcttctgaatgctctcctggacttccagaacctgtataagaccgatattcggatcttccccaccgatctggtgaaaaggacagtggaatcaatgtctgcaccagaatgggagggtgccgaacaggcaccagaactgatgcggcttatcagtgaaatcctggacaaacctcatgaagcatctaagctggatgaccatgtcaaaaaattcaagttgcctaaaaagcacatgcagctgggggactttatgaagcgcgtccaagaatctgggatcgtcaaggatgcatctatcattcatagattattcgaggctttaacagtggggcaggagaaacaaatcgacccagagacattcaaggacttttataattgctggaaagaaacggaggccgaggcccaggaggtatccctaccttggttggtgatggagcatctggataagaacgagtgcgtttgcaaactgagtagcagcgttaaaacaaacctgggggtggggaagattgccatgacacaaaagcggcttttcctactgactgagggccgcccggggtatctcgaaattagcacctttcgcaacattgaagaggtgaggagaaccacgacaacgttcttattgcggcgaattcctaccctgaagattagggttgcttctaaaaaagaggttttcgaggccaacctaaaaaccgaatgcgatctatggcacctgatggtgaaggaaatgtgggccggcaagaagctggctgacgatcacaaggacccccattacgtgcagcaggctttgactaatgttctcctgatggacgctgttgtaggcacacttcaaagccccggtgctatatatgcagccagcaaactttcctacttcgacaagatgtccaatgagatgccaatgacattgcccgaaaccacattagagactctgaaacataaaatcaatccatctgctggggaggcatttcctcaagcagtcgacgtgctcctgtacacacccgggcacctcgatcccgcagaaaaggtagaggatgcacaccctaagctgtggtgtgccctgtccgaggggaaagtcaccgtctttaacgcgtcgtcatggactattcatcagcattctttcaaggtgggtacagccaaagtgaattgtatggttatggctgaccagaatcaagtttgggtaggatccgaggacagtgttatctatattatcaacgtgcactcgatgagttgcaacaagcagttgaccgcccactgttctagcgtaacagacttgattgtgcaggatggccaggaagctccctcgaacgtgtacagttgttcaatggacgggatggttctagtgtggaacgtatcaactcttcaggtgacttccaggtttcagcttccgagggggggactcacatctatacggctgcatggtggcagactgtggtgttgcactggaaactctataatggtgatgaagatgaacggcagcctgcaccaggagctcaagatagaggagaattttaaggacacctcaacatcgttcctggctttccagcttcttcctgaggaggagcagctttgggccgcctgcgctggaagaagcgaggtgtacatctggtccctcaaagatttagctcaacctccgcaacgggtacctctcgaggactgcagcgagattaactgtatgatccgggttaaaaaacaagtatgggttggatcgcgcggtctgggccagggcactcctaagggcaagatctacgtgattgatgcagagagaaaaaccgtggaaaaagaactggtggcacatatggacactgttcgtacactgtgttctgccgaggatagatatgttctgtccggttctgggcgtgaagaaggaaaagttgcaatctggaagggcgaatag

SEQ ID NO: 46796 - DNA, 3441 bp, Artificial Sequence
  Description of Artificial Sequence: Synthetic coding sequence
atgcggagcctgcggaagaagcgggagaagccccggcccgagcagtggaagggccttcccggccccccccgcgctcccgaacccgaagatgtggcagtgcctggcggggtagatctgctgaccctgccccagctgtgttttcccggaggagtttgcgtagctactgaaccgaaagaagactgtgtgcattttcttgtgctcaccgacgtctgtggtaataggacctatggggtggtggcccaatactaccggcctctgcatgatgagtactgcttttacaatggcaagacgcaccgcgaatgccccggatgctttgtgccgtttgccgtgtgtgtggtgtccagattcccttattataatagcctaaaggattgtctatcatgtctactcgccctgcttaagccatgtaaagatttcgaagtggatagtcatattaaagacttcgctgccaaactgtcactgatacctagccctccacctggcccgctgcacctggtgttcaatatgaaaagcctgcagatcgtcctgcccgcccgcgcggatcccgagtctcccattctggacctggacctgcacttgcccctactgtgcttccggcctgaaaaagtcctgcagatccttacctgtatccttactgaacagaggatagtgttttttagcagtgattgggccctgttgactctcgtcaccgagtgctttatggcgtacctataccctctccaatggcagcatccatttgtccccattctatctgaccaaatgctagactttgtgatggcccctactagcttcctcatgggctgccacctggaccatttcgaggaagtgagtaaagaggccgacggattggttctgattaatattgaccatggaagcatcacctactcaaagagcactgacgataatgttgacatcccagacgtacctctcctcgctgcccagaccttcattcaaagagatgtcaaaaatcatctgaactatgagcaccgggttttcaactctgaggagttcctgaaaacaagagccccaggcgatcatcagttctacaaacaagtgttagatacctacatgttccactcgtttctgaaggctagattaaaccggaggatggacgcctttgcccaaatggacttggatactcaatctgaagaggatcggataaacggaatgctgctgagccctagaagacccaccgtggaaaagcgcgcatcacgaaaatcgagtcatcttcatgttacacaccgtcggatggtggtcagcatgccgaacctgcaggatatcgccatgccagagctcgctccacggaattccagccttcgcctgaccgataccgctggttgtcgcggttcttccgctgtcctcaacgttacgcctaagtctccgtataccttcaagattcctgaaattcacttccctctcgagtccaagtgcgtccaggcgtaccacgcacactttgtatccatgttgtccgaagcaatgtgtttcctcgcacccgataatagtttactgctggcccgctatttgtacctgcgagggcttgtgtatctgatgcaaggacagctgctgaatgccctccttgactttcagaacctctataagacggatatcagaattttccctacagatctagtgaaaagaaccgttgaatctatgtcggctcccgaatgggagggagctgaacaggccccagaactgatgcgtctcatctcagagatattggacaaaccacacgaggcaagcaagctggacgatcacgtcaagaaattcaagcttcctaagaagcacatgcaactcggtgacttcatgaaacgtgttcaggagtctggcatagttaaggacgcctccatcatccacaggctgttcgaagccttaactgtcggacaagaaaaacagattgatcccgaaacgtttaaagacttctacaattgttggaaagagaccgaggccgaagcccaggaggtgtctttgccttggctagttatggaacatctggacaaaaatgagtgcgtttgcaagctctcctcatcagtgaaaacgaacctcggtgtcggcaaaatcgccatgacacagaaacgcctttttctacttaccgaaggcaggcccggatatcttgagatcagcacgtttagaaatattgaggaggtgcgacgtacaacgaccaccttcctgcttcgacgcatcccaacactcaaaatccgggtggcctctaaaaaggaagtgtttgaagcaaacctcaaaacagaatgtgacctttggcacctcatggttaaagagatgtgggccgggaaaaagctagctgatgatcacaaggaccctcactacgttcagcaggctctgactaacgtcctcctgatggatgctgtcgtcggcacactccaatctccaggagccatctatgccgccagtaaattgtcttacttcgataaaatgtctaacgagatgccgatgaccctcccggaaactacgctagagacactgaagcacaaaattaacccaagcgcaggggaagcctttccacaggcagtagatgtcctgctgtataccccggggcatcttgatcctgccgaaaaagtggaggacgctcatccaaagctctggtgcgccctgtccgaggggaaggttacggtgttcaatgcttcatcctggacaattcaccagcattcattcaaagtgggtaccgctaaagtgaactgtatggtgatggctgaccaaaatcaggtgtgggtgggctctgaggactcagtgatatatatcatcaacgttcactcgatgagctgcaataagcagctcacagcccattgctcctcagtcaccgacttgattgtgcaggacggtcaggaggccccaagcaatgtgtacagctgttctatggatggaatggttcttgtctggaatgtcagcaccctgcaggtgaccagtagattccagctccctcggggggggttgacctccatccggcttcatgggggccggctctggtgctgcacaggaaatagcattatggtgatgaagatgaacggcagcctgcatcaagaactgaaaatcgaagaaaattttaaggacacatcgaccagctttctggctttccagttgctgcctgaggaagaacagctgtgggctgcatgtgccggacgttccgaagtgtatatctggtccttaaaggatctggctcagccacctcagagagttcccctggaggactgctctgaaatcaattgtatgatccgcgtaaaaaagcaggtgtgggtaggatcacgggggcttgggcagggcacccccaagggtaaaatctatgtgatcgacgccgagcgcaagaccgttgagaaagagctggtagcacatatggacaccgttcgcactctttgttccgcggaggatcggtacgtgcttagcggtagtggaagagaagagggcaaggtggcaatctggaagggagagtag

SEQ ID NO: 46797 - DNA, 4491 bp, Artificial Sequence
  Description of Artificial Sequence: Synthetic coding sequence
atggccgaggagcggcccccccggctggtggactacttcgtggtggctggcctggcaggcaacggagcgcccattcctgaggaaacgtgggttcccgaaccctccggacccctgcgtcctcccaggcccgccgagccaattactgacgtggcagtgatcgctcgggccttgggagaagaggtacctcagggctacacgtgcatccaggcttccgctggagggcacccactggagctctccgctgggttgctgggaggaacacagcccgtcatctgctacagaaggggtagggataaaccacctctggtggaattgggcgtgctgtacgagggtaaagaacgcccaaaaccagggttccaagtcctggatacaacaccttatagtcacagtgctaacctggccccacccgggccaggtcatccaaggacctatctcacttacagaagagcagcggagggcgctggcctgcacgcattaggtataacagacctttgcttggttttaccaagtaaaggtgaaggtacgccccacacctactgccggctgcctaggaacctaaatccaggaatgtgggggccagccgtgtacctgtgttacaaggtgggccttgctaaagctaacactctcgtgtatgaggctgaattactagggagataccccgaggaggacaacgaagcttttccgctgccagagtccgtgcccgtgttttgtctgcccatgggcgctacgattgagtgctggccggcccaaacgaaatacccggtgcctgtattcagcacattcgtgctgaccggagcggccggcgataaggtttatggtgccgcactccagttctacgaggctttcccccgcgcccgcctctccgagaggcaagcccgcgctctgggattattatccgcggttgagagaggcagggccctcggagggcgagcagtgcgctcccgacgagcaatagcagtcctctcccggtggcccgccttccccgcatttcgcgcctttctgacgtttctgtatagatattcagtctcagggcctcaccggttgcccctcgaagctcatatttcacactttattcacaatgtgccttttcctagtccacaacgaccaagaattttggtgcagatgtctccgtatgacaatctactcctgtgtcagcctgtttcctcgcctctcccactgtcaggcgcttccttcctccagttattacaatctctgggcccggagttagccattactctcctcttagctgtcttgacagagcataaactcttggtgcactcgctacgcccggatctcctgacctccgtgtgtgaggcgctggtgtctatgattttccccctccactggcagtgcccatacatccctctttgccccctggtcctcgccgatgtgctgagtgccccagtgccatttattgtcggaattcattcatcctatttcgacctgcacgatcctcctgctgatgtcatatgtgtcgacctcgacacaaacaccctgttccagacagaggaaaagaaactattgtcacctagaaccctacctcgccgtccttataaagtactcctcgccactctgacaaatctgtaccaacaactggatcagacttatactggaccagaagaagaagcttccctggagtttctgctaactgactacgaagccgtgtgcggtcgcagggcgaggctggagcgtgaggtgcaaggcgcttttctccgttttatggcatgtcttctcaaaggctacagggtgttcctccgcccgctcacccaggcaccctcagaaggtgcccgggacgtcgataacctgttttttctccagggattcctgaaatcaagagaacgctcatcacataagctctattcccaactgttgcatacccagatgttttctcaatttatcgaggaatgttctttcggatccgccaggcacgccgcccttgaattcttcgactcttgcgttgagaaggtgcatcctgagcaggaaaagcccgaaccaacccctctcgtcgagctggaagaactttcagggtcggagctgaccgttttcatcacacccccagaggaacccgctctccctgaaggtagtgagtctacccctcagtattgttacgacggattccctgagctgcgtgccgagttgtttgagtcattgcaggagcagcctggagctctgccagtgcccggccccagccgctcagccccctcatcccctgccccaaggcgaactaagcaggagatgaaggttgcccagcggatggctcagaaaagcgcggccgtgcctgagctttgggcaaggtgcttgttaggacactgctacggattgtggtttctgtgcctccccgcatacgttaggagcgctccaagcagagtccaggccttacacaccgcctaccacgtccttcggcagatggaatctggcaaggtggtgctgccagatgaagtgtgctatcgcgttctaatgcagctgtgttcacactatggccagcccgtgctgtccgttcgagtgatgctggagatgaggcaggctgggattgttcctaacacaatcacttacggttactataataaggcagtcctggaatctaaatggccctctggcacccctggagggagacttcggtgggcaaaattgcgaaacgtggtacttggcgccgcacagttcagacagccacttcgggaaaggcaacagcagcagcaacagcaacaacagcagcagcagcagcagcagcaggagcaggttagtgcacatcaggaagcaggaagcagccaagctgaaccctaccttgagcgaccctctcctacccggcccctccagaggcagactacatgggctggccggtcgctgcgagatcctgcatctccacccggccgccttgtaaaatccggcagcttaggttcagcccgcggggctcaaccgacagtggaagccggagtggcacatatgattgaagcgctcggcgtgctagaacccaggggatctcccgtcccatggcatgacggcagcttgagcgatctttcattgactggcgaagagccactcccagggggctcaccaggcggatcagggtcagctctgagcgcgcagagtactgaagctttagaagggttatctggccgcggccccaaagccgggggacggcaggacgaagccggaacaccacgacggggtctcggagccagactgcaacaacttttgacaccctcgaggcattcacctgcctcacgtatccctcccccggagttacctccggacttacccccccctgctcgccggagccctatggattctctgttacaccctcgagagcggccaggctccaccgccagcgaaagctctgccagcctcggttcagagtgggatttgtccgagagcagtttgtctaatctgtcactgcggcggtcaagtgaacgattaagcgacacaccaggcagcttccaaagcccgagcctggagattctgctgtcttcatgtagtctctgtcgagcgtgcgactctttagtctatgacgaggaaatcatggccggctgggccccagatgatagtaacctcaacacaacatgtccattctgcgcatgtccctttgtgcccctcctcagcgtccaaacgctcgactcacgcccttccgtgcctagccctaaaagcgcaggagcctctggaagtaaggacgcccccgtaccaggcgggcctgggcccgttctatccgacaggagactttgcctggcccttgatgaacctcagttatgcaatggccacatgggtggggcaagcaggagagtggaatccggagcatgggcctatctgtcccctttggtgctgagaaaggagcttgaatccctggttgagaacgagggcagtgaggtgctcgcacttcccgaactcccatcagcgcatcctataatcttctggaaccttttgtggtacttccaacgccttaggctcccctctattctgcctggactggttctggccagttgcgacgggccttctcattctcaggcaccatccccttggctcacacccgatcccgcgtccgtccaggtgaggctactttgggacgtactgacgccagaccccaattcatgccccccactctacgtgctctggcgcgtgcacagccaaatcccccaacgagtggtgtggcctggacccgtccccgcctcattatcactggcgttgctggagagcgtcctcagacacgtgggcttgaacgaagtgcacaaggccgttggcctattgctcgagacgctgggccctcctccgacaggactccacttacaacggggtatctaccgagagatactgttcctgaccatggcagccctcgggaaagaccatgtcgacatcgtggcatttgacaagaagtataaatccgccttcaataaattggcttctagtatggggaaagaggaactgcgccataggcgcgcccagatgccaacgcccaaagctattgactgcaggaaatgctttggggctcccccagagtgctag

SEQ ID NO: 46798 - DNA, 1002 bp, Artificial Sequence
  Description of Artificial Sequence: Synthetic coding sequence
atggtgcccggcgaggagcccgcccgggagctgatggccgtgctgctgacacccagatttaggcgtttggtgtcccagaatgagctccctggaccagggcttaacggcccgagctcgaggaacagacgggatgggttttgccgcaagcgccggaccggtgtccatctgtgccaggtcctgatgaaccataaagttttcgagcccgttggaatgaagaagctcttcaaaaaagagaaagagttagagttcgaagactccaatatcagcctataccgtttcttgggaaataaaagctcctatgactgttgtaagaggcagaaagatgccgaaaacgaatttaacgagacattgcggcctggctatgagatgatttctaaccccctcgcacaggagatcggcgaggaacgcatcgaagagctgatacataccataaacggcaaccccgcgttgtgcccgaacattacggtgcaaaagccctttctgaggttgagcaaagagggagtatccttctacacagccatcacaagtgacaagaccgatgtctggaaagagcagacactgctgtgcctactgcagttgattcacctgccattcttggataatatattggagccgcctgtcaagacccagaatctccagctaaataaggaggaggatctggtgatcaccaacacctgcttggatcgtgagctcatcccctctctctgtctccctgagattgacaactggctaaacgcagccattgaatgcctggagtactttcctgaccagttgattgtgaccgtgagtcagcagctcatgcagaaccggaacgaggagacgagactgaattcacagaaaaagattctgtttgatgttattgcaaagtactatgcgcaagagcgagactgcttgctcaccgacgagtatttcgacattcacagcgggattattgagctgctggagaatgagaagagggcagaggccctcgaggcaactcaactgtatctcaggctcctttag

SEQ ID NO: 46799 - DNA, 885 bp, Artificial Sequence
  Description of Artificial Sequence: Synthetic coding sequence
atggtgcccggcgaggagcccgcccgggagctgatggccgtgctgctgacgccacggtttagacgtttggtgagccagaatgaactgccagggcctgggttgaacggacctagcagtcggaaccgtagggacggattctgtcgcaagcgccggacagggtgttccggaccattccaggccactcagttgtgggatggcattattcattctctgcaggcgcaggtggagataaagagacgtcgtcaccatctccagacctacaaggattgtttcacgggcagcgatgccgttgacgttgtgcttagtcacctgatgcagaatacgtgcctctccagcaacgatatctcatgcttgaagggtgtccacctgtgccaggtgctgatgaaccacaaagtctttgagcccgtgggaatgaaaaagcttttcaaaaaagagaaggagctggagtttgaagacagtaacatatcactctacaggtttctgggtaataagtccagctacgattgctgcaaaagacagaaggacgcagagaacgagtttaacgagactcttagaccaggatatgagatgataagcaatcctttggcacaggaaattggtgaggagcgcattgaagagctgatacataccattaatggtaatccggccctttgccctaacattaccgtacagaaaccattcctgcggctaagcaaggaagacgtgtggaaggaacagacattgctgtgtctgctgcagttgatccatctaccattcttggacaatatactggagccacctgtcaagacacagaatctccagctaaacaaagaagaagatctggtgattactaatacttgcctggacagagagctgattccatcactttgcctgccagaaaagtag

SEQ ID NO: 46800 - DNA, 1164 bp, Artificial Sequence
  Description of Artificial Sequence: Synthetic coding sequence
atggtgcccggcgaggagcccgcccgggagctgatggccgtgctgctcacccctaggtttcggagacttgtctcgcagaatgaactacccggccccggccttaatggaccctcttccagaaatcgtagagatggattttgtcgcaagagaaggactggatgcagcggtccctttcaggcaacacagctctgggatgggattatccactcactccaggcgcaagtagaaattaagaggcgaagacaccaccttcagacttacaaagattgcttcactggcagcgacgccgtcgacgtggtcctctctcacctaatgcagaacacctgcctcagcagcaacgatatatcatgcctaaaaggggtgcatctgtgtcaggtcctaatgaatcacaaagtattcgagcccgtaggcatgaaaaagcttttcaagaaagagaaagaactcgagttcgaggactctaacatcagtctatacaggttcttggggaacaaatctagttatgactgctgcaagaggcagaaagacgccgagaacgaattcaacgagacactccgccctgggtatgaaatgataagcaatcctctggcgcaagaaattggggaggagcgcatcgaggagcttatccataccatcaacgggaaccctgctctttgccctaatattacagtgcagaaaccctttctaagactctccaaagaggatgtatggaaggagcagaccctgctgtgtttactccaattaattcacctgccttttctcgataatattctcgagccacctgtgaagactcaaaaccttcagttgaataaggaagaggatttagtcattaccaatacctgcctcgatcgcgagctaattccaagtctgtgcctgccagagattgacaactggctcaacgccgccattgaatgccttgagtactttcccgaccaactcattgtgaccgttagtcagcagctgatgcagaaccgaaacgaagagactcgcctgaatagtcagaaaaagatactgttcgatgttatcgccaagtactatgcacaagaaagagactgtcttctgacagatgagtacttcgatatccactcgggcattatcgaacttcttgagaacgaaaagcgcgccgaggctttggaagcgacgcagctgtatctccgattgctgtag

SEQ ID NO: 46801 - DNA, 309 bp, Artificial Sequence
  Description of Artificial Sequence: Synthetic coding sequence
atggccgacttcctgaagggcctgcccgtgtacaacaagagcaacttttctaggtttcatgctgatagcgtctgcaaggcctccaataggagacccagcgtttacctgcccactcgagaatatccctccgagcaaatcatcgtcacagagaaaacaaatatactgcttagatatcttcaccagcaatgggacaaaaaaaacgctgcaaaaaagagggatcaggagcaggtggagctggagggagaatcgtcagccccgccacgtaaggtggctagaacagactcccctgacatgcatgaggacacctag

SEQ ID NO: 46802 - DNA, 528 bp, Artificial Sequence
  Description of Artificial Sequence: Synthetic coding sequence
atggacatcgccatccaccacccctggatccggcggcccttcttccccttccatagcccaagtaggttgttcgaccagttttttggggagcacctgctcgagagtgacctatttccaacgtcaacttcactgagtccgttttacctgagacctccctcatttctgagagcgcccagctggttcgacacaggactgagcgagatgcgcttggaaaaggatcggttctccgtgaatcttgacgtcaaacacttttcaccagaagagcttaaagtgaaggtgcttggagacgtcatcgaagtccacgggaagcacgaagaaaggcaggacgagcacggcttcatctcgagggagtttcatagaaagtaccgtatccctgcagacgttgacccactgactattacttcgtctctgagttctgacggtgtactgacagtgaacggtccacggaaacaggtatcggggcccgagcgaacgatccctatcacaagagaggagaaacctgccgtgaccgccgccccaaagaagtag

SEQ ID NO: 46803 - DNA, 1032 bp, Artificial Sequence
  Description of Artificial Sequence: Synthetic coding sequence
atgatgttccccggcctgctggccccccccgccggctaccccagcctcctcagacctacccccactctgacactacctcagtccctccaatctgcgttctcgggccactcctccttccttgtggaagacctaatccgaattagccggcccccagcatatctgccccgaagcgtcccgacagcatctatgtctcctcccagacagggagctcctacggctctcactgatacaggagcctccgaccttggaagcccaggacctgggtcccgccggggaggatctcctcctacagccttcagcccagccagtgaaactaccttcttgaaattcggcgtcaatgcgatactgtcttctggtccccgtaccgaaacctcccccgctcttctccagagcgttcctcctaaaacctttgctttcccctactttgagggaagcttccaaccttttatcaggtcctcttattttccggcgtccagtagcgtggttccaatccccggcaccttctcctggcccctggcagccagagggaagccgcggcgcggcatgctccgacgggccgtctttagcgatgtacagcgaaaagccctagaaaagatgtttcagaaacagaagtatatctccaagcccgacagaaagaaattagccgctaagctggggttgaaagactcacaggtgaagatctggtttcagaacaggaggatgaaatggcggaatagtaaagagcgtgaacttctgtctagcggaggctgccgcgagcagactttgccaactaagctgaatccacaccccgatctgtctgatgtggggcagaagggccctggcaatgaagaagaagaagaaggcccaggtagtccttcccatagactagcataccatgcttccagtgacccccagcacctgagagatccaaggctgcctggccctctccccccctcccccgctcactcgagcagccctgggaaaccaagtgacttctccgactctgaggaagaggaagaaggagaggagcaagaggagatcacggtgagctag

SEQ ID NO: 46804 - DNA, 288 bp, Artificial Sequence
  Description of Artificial Sequence: Synthetic coding sequence
atgctgggcgcccgggtggccgcccacctggacgccctgggccccctcgttccttacgtccccccccctttactaccctccatgttttacgtaggcctgtttttcgtcaacgtactgattctttattatgcctttctgatggagtacatagtgctgaatgtcgggcttgtgtttctacccgaagatatggaccaggcactggtcgacctgggggtactgtcggacccaggaagtggactgtacgacgctgacagcgaactggatgtgttcgacgcatatctggagtag

SEQ ID NO: 46805 - DNA, 3816 bp, Artificial Sequence
  Description of Artificial Sequence: Synthetic coding sequence
atggaccggggcgccgccgccgcccagggcaccgcccccccccaggacggggaacagcccgctgagagtccggaaccgccccctccatggcccccaccccctcctccccccgcccccccaccagcgccccctttactgtccgaagcatctccagaaccaattcctgaaccttgcccagagctcgcacccgggccgtgccctgaggcgacatcagagtccgccaccgagttgtatacggagccaacccctgagccagcaaccgagccagccagtgaacctgcccctgaaccagctacagagcccgccccggagccagctaccgagccagcacccgaacctgcacctgaacctgcaactgagagtgcccccgaacctacacccgaacctgcccttgaatctgtccctgagcccgcccccgagctgaccccagaagtcgctcctgagctggcccccgagccgaccccagaacctgtgacggagctcgccccagagttctgcccagaggccgctcctgagttcagaccttcccctgccccgtgcctgctccaatgtcccgtcgacactcgggagaggggactgaagacctcaccctcaccatctccctccccaagccccagaacccccatgtcctggagccggattaagaaaattcttaaagagggccctatgctgaagaactgcaatagttttaagcggtggaagttgcgatattttctcgtgcaagggcagaagctgtacttcgctcaccatcctgcgttcgcccactttgaaacaatagacttgagccaagctacagtggccgaaagttcttgccgaaatctatgccattctttttgtgtgatcaccccacagcgaaagatcaccctagcagcacctaataggaaggatatggaggagtggatcaacatcataaagaccatacagcagggcgagatctacaagattccggctgcggagaataatcctttcctggtgggtatgcattgttggtattcttcttactcccacaggacacaacattgcaatgtgtgtcgggaatctattcctgctctttcccgcgatgctattatctgtgaggtgtgcaaggtgaaaagccatcggctctgcgcattgcgtgcctcaaaggactgcaagtggaacacgttgtccattaccgacgacttactgcttcccgctgatgaagtgaacatgccgcaccaatgggtcgagggaaatatgccggtgtccagtcagtgtgctgtgtgccacgagtcttgcgggagttaccagcgcctccaggacttccggtgtctgtggtgcaattccaccgtgcacgatgactgccgcagaaggttttcaaaagagtgctgctttcgcagccacaggagttccgtcatccctccaacagcactgagtgatccaaaaggtgatggccagttggtggtctcaagcgacttctggaacctcgactggagcagtgcgtgttcctgtcctctgctaattttcatcaatagtaagagcggagatcaccaaggaattgtattcctccggaagttcaaacaatatctgaaccccagtcaggtgttcgacctcttgaaaggcggccctgaagcgggcctctccatgtttaaaaattttgcccgttttaggatcttagtgtgtggcggcgatgggagcgtctcttgggttctctctttgattgacgccttcgggctgcatgaaaagtgtcagcttgctgtaatccccctaggaacaggcaacgacttggctcgggtgctgggatggggtgccttttggaacaagtccaagagccctttggatatcctcaatcgcgtggaacaggcatccgtccggatccttgatagatggagtgtgatgattagagagacccccagacagacaccactccttaagggtcaagtggaaatggatgtccctagatttgaagccgccgctattcagcacttggaaagtgctgcaacggagcttaataagatactgaaagcaaagtatccaactgagatgattattgcgactagatttctttgcagcgcagtagaggacttcgtggtggacatcgtaaaagcctggggacaaatcaagcagaacaacactgctattgtgtcagtaattctaaaatccgacctcatgtacgatagattatccgtgcttatcgatgtgctggcggaggaggcggctgcaacatccgctgaaaagtctgctaccgagtacgcggactcttctaaagctgacagaaaacccttcatacctcagatagatcacatcgccaagtgcaagctcgaactagcaacaaaggcacaatccctccagaagtccctcaaactgatcattttccaagtggaacaggccctcgatgaggaaagccggcaaaccatttccgttaagaattttagtagcacgtttttcctcgaagacgaccctgaggatattaaccaaacctcgcctcgaaggcgatcacggcgaggtaccctttcatccatcagctctttgaaatcagaagaccttgataacctgaacctggaccacctacactttacaccagaatcaatacgttttaaagaaaaatgcgtgatgaacaattatttcggaatcgggctggatgcaaaaatcagcctcgacttcaacactcggcgggatgagcaccctggacagtacaactcgcgcctcaaaaataagatgtggtacgggttgctcgggacaaaagaattattgcaaaggtcatacagaaagctagaagaacgagtgcatcttgagtgtgacggggagacaatttcactgccaaatctccagggcatagtggtgctgaacatcacatcatatgccggcgggataaatttctggggctctaatactgccaccacagagtacgaagcccccgctatcgacgacggaaagctggaggtggtcgcaatttttgggagtgtgcagatggcaatgtcccgcattattaatcttcaccatcacaggatcgctcaatgccatgaggtgatgattacaattgatggagaagaaggcatcccagtgcaagtcgacggtgaggcctggattcagcgcccaggcctgattaaaattcgatataagaacgctgcccaaatgctcaccagagacagagatttcgagaattcaatgaaaatgtgggaatacaaacacaccgagattcaggcagcccctcagcctcaactagatttccaagacagtcaggagtcattgagcgatgaggaatatgctcagatgcagcatctggccaggcttgctgaaaacttgatatctaaactgaacgacctaagcaagatccaccaacatgtctctgtcctgatgggaagcgtcaacgctagtgccaacatcctgaacgacatcttctacggacaagatagcgggaacgagatgggagctgccagctgtatacctatagagacactcagcaggaacgatgccgtggacgtcaccttctctctaaaaggactgtatgacgatacaaccgcctttctcgatgagaaacttctaagatctgctgaagatgagacagccctgcagagcgctctggacgcgatgaacaaggaatttaaaaaactttctgagattgactggatgaacccgattttcgtccccgaggagaagtcctccgatactgattccagatcactccgcctgaaaattaagttcccaaagttagggaaaaagaaggtcgaggaggagcggaaaccaaagtcagggcagtctgttcagagcttcattggcaatttgtggcacaggagacaccgtgaggatgaagcagaaggggacgatccattgactccaagcaggagtcagctgtag

SEQ ID NO: 46806 - DNA, 2550 bp, Artificial Sequence
  Description of Artificial Sequence: Synthetic coding sequence
atgagcgaggagcggagcctgagcctgctggccaaggccgtggacccaaggcatcccaacatgatgacagatgtggtaaagctgctgagtgccgtgtgcatcgtcggcgaagaatccattctggaggaggtcctggaggcccttacgagcgcgggagaggagaagaaaatcgatcggttcttctgcatcgtagagggactcaggcataattcagttcaactgcaggtggcatgcatgcagctgattaatgcccttgtgacaagccccgatgatctcgattttcgcctgcacattcgcaatgaattcatgagatgcggtttaaaagaaatacttcccaacctaaagtgcatcaagaatgacggactggacattcagcttaaagtctttgacgaacacaaggaagaggatttattcgagttaagccaccggcttgaggacatcagggccgagttggatgaagcctacgacgtgtacaacatggtttggtctacagttaaagaaacccgcgccgagggctacttcatttctatcctacagcacttgctgcttatccgcaacgactatttcatcagacaacagtacttcaagctcatcgatgagtgcgtgagccagatcgtgctacatcgggacggcatggatcccgatttcacttataggaagcgattagatttggatctgactcagttcgtcgatatctgtatagaccaggcaaagttggaagagttcgaagagaaagccagtgagctgtacaagaagtttgagaaagaattcaccgatcatcaagaaacccaggccgagctacagaaaaaggaggcgaaaattaacgaattgcaggcagaactccaggccttcaagagtcagtttggcgctctgccagcagactgcaacattccactcccaccctccaaagagggaggcaccggacactccgctctgccgcccccaccaccgcttccttcgggcggtggggtgcccccacccccaccccccccccccccgccccccttgccaggaatgcgaatgccattcagtggaccggtccccccaccaccccctcttggcttcctgggtggccaaaactcacctccactgcctatcttacccttcggcctcaaacccaaaaaggagttcaaaccagaaatttcgatgcggagactcaattggcttaagatcaggcctcacgagatgaccgaaaactgcttctggattaaagttaacgagaacaaatatgagaatgtagacctgctgtgtaagctggagaatacattttgctgtcagcagaaggaacgacgagaagaggaggatatcgaggaaaagaaaagcataaaaaagaaaatcaaagagctcaagtttctggattctaagatcgcacagaatctaagcatcttcctgagctctttccgtgtgccgtacgaggagatccgcatgatgattttggaggtggatgaaacccgcctggctgagtccatgatccaaaatctgatcaagcatctgccagaccaggagcaacttaatagtctgtctcaatttaagagcgagtacagcaacctttgcgaaccagagcagttcgtggttgtcatgagcaacgtcaaaagactccgaccaagactatccgcaattctgtttaagctgcagtttgaggagcaggtgaacaacataaaaccggatatcatggccgtgtccactgcttgcgaagagatcaagaagtccaaatctttcagcaagctgctggagctggtgcttctcatgggaaactacatgaacgccggctctcgcaacgctcagacattcggttttaacctgtcctctctctgtaagctcaaagataccaagtccgcagaccagaagacgacccttctacatttcctggttgagatttgtgaggaaaaatatcctgatatcctaaacttcgtagacgatctggagccactggacaaagcaagtaaagtaagcgttgagaccctggagaaaaacctgaggcagatgggccgccagctgcagcaactggaaaaagagcttgagacttttcccccacccgaggacctccatgataaattcgtcaccaagatgtccatcttcgtgatctctgccaaagaacagtacgagacactttcaaagttacatgagaatatggaaaaactttaccaatccatcataggctattacgccatcgacgtcaagaaagttagcgtggaggactttcttacggacctgaacaactttcggaccactttcatgcaggcaataaaagagaacatcaaaaagcgggaagccgaagaaaaagaaaaacgcgtacggatagcaaaggaacttgccgagagggagcggttggagaggcaacagaaaaagaagcgtctgctcgagatgaaaacagaaggagacgaaaccggggtaatggataatctcctcgaggccctccaatctggcgcagcattccgcgaccggcgcaaacgcactcctatgcctaaagacgtccggcagtctctgtctcctatgtcccagcgccccgtgcttaaggtgtgtaatcatgggaacaaaccctacctatag

SEQ ID NO: 46807 - DNA, 3582 bp, Artificial Sequence
  Description of Artificial Sequence: Synthetic coding sequence
atggagcggcaccagccccggctgcaccaccccgcccagggcagcgccgcgggtactccctacccatcatccgcctctttacgggggtgtcgcgagtcaaaaatgcccagacggaaagggccccagcatccaccgccaccgagcggccctgaagaaccgggagagaagagacccaagttccatctgaatatacggactctaactgacgatatgctggacaaattcgcgtccatacgcattccgggcagcaaaaaggagcggcctcccttacccaacctcaaaacagcctttgcaagttcagattgctccgccgcgcccctggagatgatggagaattttcctaaaccactgtccgagaacgagctccttgaactattcgaaaagatgatggaggacatgaatctgaacgaagacaagaaagcccccttaagggagaaggattttagcattaaaaaggagatggtcatgcagtatataaacaccgcctccaagacggggtcactgaagcgctctcggcagattagtccacaggagtttatccacgaactaaagatgggttccgcagatgagaggctcgtcacgtgcctggaaagcctgagagtgagtttgacgtctaacccggtgtcctgggtcgaatcttttggccacgagggcctgggattgctgctggacattctcgagaagctcatcagcgggaagatccaagagaaggtagtaaaaaaaaaccagcacaaggtgatacaatgcctgaaggccctgatgaacacccagtatggcctggaacggatcatgtctgaagagaggagtctgagtctgttggctaaggccgtggacccccgacacccgaacatgatgaccgacgtggtaaagttgctgtcggcagtgtgtatcgttggagaggagtcaatcctggaggaggtactggaagccttaacgagcgctggcgaggagaaaaaaattgacaggttcttctgcatcgtagaggggttgcgccataattccgttcaattacaggtggcctgcatgcaacttatcaatgcacttgtgacaagccccgacgaccttgactttagactgcatattcgcaacgagtttatgagatgtggcctgaaagaaatcctgccaaatctgaaatgcattaagaacgacggcctcgacatacagcttaaagtttttgacgagcacaaagaagaagacttattcgagctcagccaccgcctcgaggacattcgggccgagctcgacgaagcatatgacgtgtacaatatggtgtggtcaaccgttaaagagacaagagccgaggggtatttcattagcatcctgcagcacctgctcctcatcagaaacgactattttattcgccagcaatactttaagttgatagatgagtgcgtgagccagattgtgttacacagggacggcatggaccctgacttcacctataggaagcgactggacttagacctaacccagtttgtggatatttgcatagatcaggcaaagctggaggaattcgaagaaaaggcctccgagctatacaagaagttcgagaaggagttcacagaccaccaggagacccaggccgagttacagaaaaaggaagccaagattaacgagctccaagccgagctacaggcgtttaagtcccagttcggtgccctgcctgctgattgtaacataccacttcccccgagtaaggaaggtggaacagggcactctgctctcccccccccaccgccacttcccagcggggggggagtccctcctccgcccccaccgccaccccccccaccactccccggaatgagaatgcctttttctggccccgtacctcccccaccccccctgggattcctcggcgggcaaaatagtcccccattgccaattttgccctttggcctgaagccaaagaaagagttcaagcctgagatctctatgcgtcgcctcaattggctgaagatccgacctcatgagatgacggagaattgtttttggatcaaagttaacgagaataagtatgagaacgtggatctgctgtgcaagttggagaacactttttgctgccagcaaaaggagagaagagaagaggaagacatcgaagaaaagaaatctatcaagaagaagatcaaggagctgaagtttctggattccaaaatcgcccaaaacctgagcatttttttgagctcctttagagtgccatacgaggagattagaatgatgatccttgaggtggacgagacgcgcctggctgagtccatgatccagaatttaatcaaacacctgcctgatcaggagcagctgaatagcttgagccaattcaaatccgaatatagcaacctctgtgaacccgagcagttcgtggttgtaatgagcaatgtaaagaggctaagaccaaggttgtctgctatcttgttcaagctccagttcgaggaacaggttaacaatatcaaaccagatatcatggcggtgtctacagcttgtgaagagatcaagaaatcaaagtcctttagcaaattactggagctggtacttttgatgggaaactatatgaacgccggcagtcgaaacgctcagacatttggctttaatttgtcctctctgtgtaagctgaaagacacaaagagcgctgaccagaagactacattactgcactttctggtggagatttgcgaggaaaaataccccgatattctgaacttcgtggacgatctcgagcctcttgacaaggccagcaaggtttcagttgagaccttggaaaaaaacctgcggcagatgggcaggcagttacagcaattagaaaaggaattggaaacatttcccccccccgaagatttgcatgataagttcgttactaagatgagccggttcgtgattagcgcaaaggaacagtacgagactttaagtaagctccacgaaaacatggagaagctgtaccaatctataatcggttactacgctattgacgtcaagaaagtgtccgtcgaggatttccttaccgaccttaacaattttaggactacgttcatgcaagcaattaaagagaatatcaagaagcgcgaggcagaagagaaggaaaagcgcgtgaggattgctaaggagctggccgaaagggagagattggagcgccagcagaagaagaagcggttgctcgaaatgaagacagagggagatgagaccggggtaatggacaacctcctggaagctctgcagtcaggggctgcttttcgggacagaagaaagagaactccaatgcccaaggatgtgcgccagtcgctgtcaccaatgagccagagacctgtgctcaaggtgtgtaatcatgagaaccagaaggtgcagctcacagagggttcgcggtcgcattacaacatcaattgtaactctacaaggactcccgtcgccaaggagttaaattacaacctggacacccacacaagcaccggccgaatcaaagcagccgagaagaaggaggcctgtaatgttgagagcaatagaaaaaaggagaccgaactgctcgggtcattcagcaaaaacgaatccgtacctgaagttgaggccctcctcgcaaggctgcgcgctctctag

SEQ ID NO: 46808 - DNA, 3549 bp, Artificial Sequence
  Description of Artificial Sequence: Synthetic coding sequence
atggagcggcaccagccccggctgcaccaccccgcccagggcagcgccgccggaactccctatcccagcagcgcttcattgaggggttgtagagagtctaaaatgcccaggaggaagggcccccagcaccctcccccaccaagcgggcccgaggaaccaggcgaaaagcgccccaagttcctcgacaaattcgcaagcatacgcatacctgggtctaagaaggagaggcctccactgccaaatctcaaaactgctttcgcatcctctgattgctccgccgcaccactcgagatgatggagaattttccaaaacccctgagcgaaaatgaactgctggagctgttcgaaaaaatgatggaggatatgaatcttaacgaggacaaaaaggcccctctgagagaaaaagatttctccattaagaaggagatggtgatgcagtacataaacactgccagcaagacaggctctctcaagcgttcaagacagatttctcctcaggaatttatccatgagttgaagatgggcagcgctgacgagcgactagtaacttgcttggaaagtttaagggtcagcctaacttctaaccctgtgtcttgggtagagtcattcggacacgaaggactgggtcttctgctggatatattggagaaacttatttctgggaagattcaggagaaagtcgtaaagaagaaccagcataaagttattcagtgtctgaaggccttgatgaatacacagtatgggctggaaagaatcatgagtgaggagcggtccctgtccctgcttgccaaagccgtggatccccggcacccaaatatgatgaccgacgtggttaaactgctgtcagcagtgtgtatcgtcggtgaggagtcgatcctggaggaggtgctggaggccctaacttctgccggggaagaaaagaaaatagacaggttcttttgtatagtagaaggactgagacataattctgttcagctgcaggtggcctgtatgcagctgattaacgcactggtgacctcacccgacgacctggattttagactgcacattagaaacgagtttatgcggtgcggactgaaagagatcctgcctaatctgaaatgcatcaagaatgacggactagatatacaattaaaggtttttgatgaacacaaggaagaggatctgttcgaacttagccatcgattagaggacatccgcgccgagctggatgaggcttacgacgtgtataatatggtttggagcacggtgaaggagactcgtgccgaggggtacttcattagcatcttgcagcatttgctgctgatcaggaacgactatttcatcaggcagcagtattttaaactgattgacgaatgtgtgtctcagatcgtgctccaccgggatggcatggacccggacttcacatacagaaagagactcgacttggacctgactcaatttgtggatatctgtattgaccaggccaagctggaagagtttgaggaaaaggcgtcggagctttacaagaagttcgagaaggaattcactgatcatcaggagactcaggcggagctgcagaaaaaggaggccaagattaatgaactgcaggcagagcttcaggcctttaaatcccagtttggggcccttcctgccgactgtaatattccacttcctcctagcaaggaggggggcaccggccacagcgccctccctcctcccccacccctgcccagtgggggcggtgttcctcctcccccaccacctcctcctcccccaccattaccaggtatgcgcatgcctttttcagggccagtccctccacccccccccctggggtttctgggcggtcagaatagtccaccccttccaattctcccttttggactcaagcctaagaaggagtttaagcctgaaatctccatgcgccgactcaactggctgaagattcggccgcacgaaatgacagagaactgtttctggatcaaggtcaatgaaaataagtatgagaatgttgacctcttatgtaagctggaaaatactttctgctgccagcaaaaagagcgaagagaagaggaggacattgaagagaaaaagagcatcaaaaaaaaaattaaggaactgaagttcctggatagtaaaatcgcacaaaatctgagtatatttctctctagttttcgtgtcccgtatgaggaaattcgcatgatgatactggaggtggatgagacgcgtcttgccgaatccatgattcagaatctcattaaacacctaccggaccaggaacagctgaatagcctcagtcaattcaaaagcgagtactctaacctatgcgagcctgagcagttcgtggtggtcatgtccaatgtcaaacggctaaggcctagactgtcagccatcttgttcaagctccagtttgaggaacaggtcaataacataaagcccgatattatggccgtgtccactgcatgcgaagaaataaaaaaatctaagtccttctcgaaacttctggagctcgtgttattgatgggaaactatatgaatgccggcagcaggaatgcccaaactttcggcttcaatttaagctctttatgcaaattgaaagacacgaagtctgctgaccagaaaaccacgctactgcacttccttgtggagatttgtgaagagaagtatcctgatattttgaatttcgtggacgatctcgaacctttagataaggcttccaaggtcagtgtcgagaccctggaaaagaatttgcggcagatgggccgtcagctgcagcagctcgaaaaggagctcgagactttcccacccccagaagatctgcatgataagttcgtcacaaagatgtccatttttgtgatctctgccaaggagcaatatgaaacgcttagtaaactgcatgaaaacatggaaaaactctaccagtcaatcataggatactacgccatcgatgttaagaaggtcagtgtggaggacttcctgacagacctcaacaatttccggaccacgttcatgcaagccatcaaagagaatattaaaaagcgggaggccgaggagaaagaaaagcgcgtgaggatagctaaggaactagccgaaagggagagattggaacggcagcagaaaaaaaaaaggctgctggaaatgaagacagaaggcgatgagacaggagtcatggataacctgctagaggcactccagagtggcgccgctttcagagacaggagaaagagaacccccatgcctaaagatgtccgccaaagcctatcccctatgtctcagagaccagtgctaaaggtttgcaatcacgaaaatcagaaggtccagttgacagagggaagccggtcacattacaacatcaactgtaacagcacacgcacccctgtcgcaaaggaattgaattacaaccttgacacacatacatccacagggaggatcaaggcggccgagaagaaggaggcttgtaacgtggagagcaacaggaagaaagagacggaacttctgggatccttctccaaaaacgaatcggtgccagaggtggaggccttgctcgcccgcctgcgcgctctgtag

SEQ ID NO: 46809 - DNA, 3372 bp, Artificial Sequence
  Description of Artificial Sequence: Synthetic coding sequence
atggagcggcaccagccccggctgcaccaccccgcccagggcagcgcagcgggtactccatatcctagttcagcgtctctgcgcggatgtcgggagagcaagatgccacgcaggaaaggcccccagcacccccccccccctagcggccccgaagaacccggcgaaaagcggcccaagttcgaggacatgaacctgaacgaggataagaaggcaccacttcgggaaaaggacttttccataaaaaaggagatggtcatgcagtacataaatacagcctctaaaacggggtctttgaaaaggagccggcagatttcgccccaagagtttattcacgagttaaagatgggttctgcagatgaacggctggtgacgtgtctcgagtccctgagagttagccttacatcaaatcccgtcagctgggtggaaagcttcgggcacgaggggctgggcctgttgctagatatcctggagaaactcatttctggcaagatccaggagaaggtggtcaagaagaaccagcacaaagtaatccagtgcctgaaggctctgatgaatacccagtacggcctcgagcgcatcatgagcgaggaaaggtccctaagcctgctagccaaggctgtggatcctcgccaccccaacatgatgaccgatgtcgttaagctgctatccgccgtctgcattgtgggcgaggagagcatattggaggaagtgctggaagcgttaacgtctgcgggggaagagaaaaaaattgataggttcttttgtattgtggagggcctgagacacaattcagtgcagttgcaggtcgcatgtatgcagttaatcaacgccttagtcacctccccagacgacctggattttaggcttcatatacgcaatgagtttatgcggtgtggccttaaagaaatattgccaaacctgaagtgtatcaagaatgacggactggacatccagctcaaggtctttgacgagcacaaagaggaagatctctttgagcttagtcatagactggaagatatcagagctgaactagacgaagcatatgacgtctataacatggtgtggtcaactgttaaagagacacgagctgaaggttactttatctcgatcctccagcacctcttactgatcaggaacgactatttcatcaggcagcagtattttaaactgatcgacgagtgtgtgagtcagattgtgctgcaccgcgacggtatggatcctgatttcacataccgtaagcgcctggacctcgacctcacccagtttgtcgacatttgtattgatcaggctaagcttgaggagttcgaggaaaaggcttccgaactgtataagaaatttgaaaaggaattcaccgaccaccaagagacccaggctgagctgcagaagaaagaagctaaaatcaacgagctgcaggctgagctgcaggccttcaaaagtcagttcggtgcgctgcctgccgactgcaatatccctcttcccccttcaaaagagggcggcacaggccattcagcattgcccccacctccccccttgcccagcggagggggagtcccacccccccctcccccacctccaccgcctcccctcccagggatgagaatgcctttttcgggacccgtgccccctccccccccactgggttttcttggcgggcagaacagccctccactccctatactgccatttggacttaagcccaaaaaggaattcaaacctgagatctccatgcgccgtctaaattggctgaaaattagaccacatgagatgactgagaactgcttctggattaaggtgaacgagaataagtatgaaaatgtggacctcctttgcaagctcgaaaatactttctgctgccagcagaaagaacggagagaggaggaagatatcgaggagaaaaagagtatcaaaaagaaaattaaagagctcaagttcctggattctaagatcgcacagaacctctctatattcctaagcagtttcagggtgccttacgaggaaatccgcatgatgattctagaggtcgatgagacccggctggccgagagtatgatccaaaatctgatcaaacacttgcccgatcaggaacagctgaattccctcagccagtttaaaagcgaatatagcaatctttgtgaaccggagcaattcgtggtagtcatgtccaacgttaagagactgcgtccccgactttcagcaatactattcaaattacaattcgaggaacaagtcaataacatcaagccggacatcatggcagtcagtacagcatgtgaggagattaagaagtcaaaatctttctccaaactcctcgagctggtgctgttaatgggaaattatatgaacgctggatccaggaatgctcagacatttggctttaatctcagttccctttgcaaactcaaggacaccaaaagcgccgatcagaaaactaccctcttgcactttctcgtcgagatttgtgaagagaaataccccgatatcttaaactttgttgatgacctagagcctttagataaggcgtccaaggtgtctgtggaaacattagagaagaacctccgccagatgggacggcagcttcagcagctagagaaggagcttgagacttttccaccacccgaagacctgcacgacaagttcgtaacgaaaatgtcaatcttcgtgatttccgctaaagaacagtacgagactctgagcaagttgcacgagaacatggaaaagttgtatcagtcaattatcggatattacgccattgacgtcaaaaaagtcagtgtcgaagatttcctcaccgacctgaataattttcgcacaaccttcatgcaggcaatcaaggagaatattaaaaaacgggaagcggaagaaaaggaaaaaagggtacggatagcgaaggagctggccgaacgtgaacgattagagcggcaacagaaaaaaaagcggctgctcgagatgaaaactgaaggcgacgaaaccggggtgatggataacctgctcgaggcactgcaatcaggcgccgccttccgcgaccgccgtaaacggacccccatgccaaaggatgtgcgccagtctctgtccccaatgtcacagagacctgtgctgaaggtctgtaatcacgagaaccagaaggtccagctgaccgaggggtctcggtcccactacaacataaactgcaactccactcggactccggtggcaaaggaactgaactacaatttggacacgcacacgtctactggtagaatcaaggccgccgagaaaaaggaagcttgtaacgttgaatccaacagaaaaaaagaaaccgagctgctaggcagcttcagcaaaaacgagagtgtgcctgaagttgaagccctgctggctcgcctgcgagctttgtag

SEQ ID NO: 46810 - DNA, 3582 bp, Artificial Sequence
  Description of Artificial Sequence: Synthetic coding sequence
atggagcggcaccagccccggctgcaccaccccgcccagggcagcgctgcagggaccccatacccctctagtgccagtctccgagggtgccgggagtccaagatgccgcggagaaaggggccccagcacccaccgccaccttcgggacccgaagaacccggcgagaagcggccaaagtttcacttaaatatccgtaccctgaccgacgacatgttggataaattcgcaagcataagaattcccggaagcaagaaagagagaccaccccttccgaacctgaaaaccgcgttcgcgagttctgactgctccgccgctcccctggagatgatggaaaacttccctaaacctttgtctgagaatgagctgctcgagctgttcgaaaaaatgatggaagatatgaaccttaatgaagacaagaaggctccattaagagaaaaagatttcagtatcaagaaggaaatggtgatgcagtacattaatactgccagtaaaacaggctcgctgaagagaagtcggcagatcagccctcaggagttcattcatgagctgaagatgggtagcgcagacgaaaggctcgtgacctgcctcgaaagcctaagagtgtcactcacttcgaatcccgtgtcatgggtggaaagcttcggccacgagggcctcggactcttgcttgacatcctagaaaagctgatatcaggaaaaatccaggaaaaagtagtcaagaagaatcaacataaagtgattcagtgcctaaaagcactgatgaacacccagtacgggttagaaagaatcatgagcgaggagcgttccttatccttgttggcgaaagccgttgatccccgccatcctaacatgatgactgatgtagtgaagttactttcggctgtgtgcatcgtgggtgaggagtctatcttagaagaggtcttggaagctctgacctccgcaggcgaagagaaaaaaatagaccgctttttctgcatcgtggaagggcttcgccataactcagttcagctgcaggtggcgtgtatgcagctgatcaacgcccttgtaaccagcccggatgacctggatttcaggctccacattcgaaatgagttcatgcggtgcggcctgaaagagattctacccaaccttaaatgtattaaaaacgacgggcttgacatccagttaaaggtgttcgacgaacataaggaagaagacctgttcgagctgagtcacaggctcgaagacattagagccgaacttgatgaagcgtacgatgtatataacatggtttggtccacagtaaaagaaactcgggcagaaggctactttatctctatcctgcagcatctacttctgattcgcaacgactatttcatccgccagcaatactttaagttaatagacgagtgcgtgtcacaaatagtcctacatcgtgatggaatggacccagactttacgtaccggaaaagactcgatttagatctcacccagttcgtggatatctgtatcgatcaagcaaagctcgaagaattcgaggaaaaagcttctgagctctataagaaatttgagaaggaattcacagaccatcaggaaacgcaggccgaacttcagaaaaaggaagctaagatcaacgaactgcaggcagagctacaagcgttcaaaagccagttcggggctctccccgcagactgcaatatcccacttcctccttcgaaagaaggtggtacgggccattctgccctccccccccctccccccttgcccagcgggggcggtgttccccccccgcctcctccacctccacctccaccacttcccggaatgagaatgcccttcagcgggccagtccctccaccacctcccctgggattcctgggggggcagaattctcccccccttccaatcctcccgttcgggctgaagccaaagaaggaattcaagccagagatcagtatgcgacgcttaaattggttgaaaatccggccacatgagatgaccgagaattgcttctggatcaaagtgaacgaaaacaagtacgagaatgtggatttgttatgtaagcttgaaaacactttctgttgccagcagaaagaaagaagagaagaggaagacatcgaagagaagaagagcattaaaaaaaagatcaaagaactgaagtttctcgactcaaagatcgcacagaatctcagcatcttcctgtcttctttccgcgttccttatgaagaaatccggatgatgatactagaagtggacgaaacccgccttgcagagtcgatgattcaaaaccttataaagcatctgcccgatcaggaacaacttaacagccttagccagtttaaatctgaatacagcaacctgtgtgaacccgaacaatttgttgttgtcatgtccaacgttaaaaggctaaggccacggttgtccgcgatattgttcaagttgcaatttgaggagcaggttaataacattaagcccgatatcatggccgtgtccaccgcctgcgaggagataaaaaagtccaaatccttcagtaaactgctggagctggtcctcctgatgggaaactacatgaacgctggtagtcgcaatgcccagaccttcggttttaacttatccagcctttgtaagctgaaagacaccaagagcgctgaccagaagaccactctgctgcatttcctcgtcgagatctgcgaggagaaataccccgatatcttaaatttcgtcgacgacctggaacccctagacaaagcctccaaagtcagtgttgaaaccctggagaagaatctccgacaaatgggccgtcagctgcagcaactggaaaaagaattagagacctttccccccccagaggatctccatgataagtttgtaaccaagatgagcatctttgtcatctcagccaaggagcagtacgaaacactgtcgaagctgcacgaaaatatggaaaaactgtaccagtccatcattgggtattatgcaattgatgtgaaaaaagtgtctgtcgaagatttcctgaccgatcttaacaatttccgaactaccttcatgcaagccatcaaagagaacatcaagaagagagaggctgaagaaaaagagaaacgcgttagaatcgccaaagagttagccgagcgcgagcgtttggagaggcaacagaaaaaaaaaaggttgcttgagatgaagaccgagggggatgaaaccggggtgatggataaccttctggaagctctgcagtcgggcgccgctttccgagacagacggaagcgaaccccaatgcctaaagatgtcagacagtccctgagccccatgtctcagcggccagtgctgaaggtgtgcaatcacgaaaaccaaaaagtgcagttgaccgaagggtcacggtcccattataatattaattgtaactccacaagaactcccgtcgccaaggagctgaattacaatttggatacccatacctctaccgggaggatcaaggctgcagagaaaaaggaggcctgtaacgtggaaagtaatcgaaagaaagagaccgaattactggggtcctttagtaaaaacgagtcggttcctgaggtagaggccctgcttgcccggctaagagctctctag

SEQ ID NO: 46811 - DNA, 3444 bp, Artificial Sequence
  Description of Artificial Sequence: Synthetic coding sequence
atggagcggcaccagccccggctgcaccaccccgcccagggcagcgctgcgggcacaccctatccctcctcggcatctctccgcggctgccgagagtctaagatgccccgtagaaagggccctcagcacccaccaccgccatccggcccagaagagccaggggagaagagacccaagttccttgataagtttgcttctattaggatacccggttccaaaaaggagcgacctcccctaccaaatttgaagacggcattcgcctcctctgattgttcagcggctccattggaaatgatggaaaatttccctaaacctctgtctgaaaatgagttgcttgaactgtttgaaaagatgatggggtcactgaagcggagccggcagatcagtccccaagagttcatccacgagttgaagatggggtctgctgatgaaagactggtgacatgcctggagtcccttcgggttagcttgacatctaatcccgtgtcttgggttgagtccttcggtcacgaaggtctaggcctgctcctggatatcctggagaagctgatctctggcaagatccaagagaaagtggtaaagaagaaccagcacaaagtgatccaatgtctgaaggctctgatgaatacccaatacggattggaacgtattatgtcagaggaacgttcattgtctctgctcgccaaagcagtcgacccaagacatccaaatatgatgaccgatgttgtgaagctgctgtctgcagtgtgtattgtcggagaggagagcattctagaagaggtcctcgaggctcttaccagtgctggggaagagaaaaagatcgacaggttcttctgcatcgtagaaggccttcgccataactccgtgcaactgcaggttgcttgcatgcaactgattaacgctctggtaacttccccagacgaccttgacttcaggctgcatatcaggaacgaatttatgcggtgtggtcttaaagagattcttccgaatttaaagtgcattaagaacgatggtctggacatccagttgaaagtgtttgatgagcataaggaggaagatctgttcgagctgtcccacagattggaagacattcgggccgaactcgatgaagcctatgacgtctacaatatggtatggtccaccgtgaaagaaaccagggccgaaggctattttatttccattctacagcacctgcttttaatccgcaacgactacttcatcaggcagcagtacttcaagctcattgacgaatgtgtatcacagatcgttcttcatagagacggcatggaccctgacttcacctaccggaaaaggctggacctcgacctgacccagtttgtggatatctgtatcgaccaggctaaactggaggaatttgaggaaaaagctagcgaactttacaagaagttcgagaaggagtttacagaccaccaagagacccaggccgagcttcagaagaaagaggccaaaataaatgaattgcaagcagaattgcaggccttcaagtctcaatttggagcattgcctgcagactgtaacattcctttacccccttccaaggagggagggaccggccattccgcactgcctcctccgcctcccctgcccagcgggggaggtgtcccaccccctccgcctccccctcctcctccccctctcccaggcatgcggatgccattctccggcccagtgccaccccctcctcctttaggcttcctcggcgggcagaatagccctccattgcctatcctgccctttggattgaagcccaagaaggagttcaagccggaaatctcaatgcgccggctgaattggctaaagattagaccacacgaaatgacagaaaattgtttttggatcaaagttaatgaaaacaagtatgaaaacgtcgatcttctatgcaagctcgaaaataccttctgctgtcagcaaaaggagcggagagaggaggaggacattgaggagaaaaaatctatcaagaagaagattaaggagttgaagttccttgattccaagattgcgcaaaacttatcaatattcctgagctcctttcgggttccgtatgaagagataaggatgatgattttggaggtagatgaaacccggctcgccgagagtatgattcagaatcttatcaagcatttgcccgatcaagagcagcttaattctttatctcagtttaaatctgaatattcaaacctgtgtgagcctgaacaatttgtagtggtgatgtccaacgtgaagcgcctgcgacccagactaagcgccattcttttcaaattgcagttcgaggaacaggtgaataacatcaaaccagatatcatggcagtttccacagcgtgcgaagagattaaaaagtctaagtccttctctaagcttctcgagctcgtgctattgatgggcaactatatgaacgccgggagccgtaatgcacagacgtttggcttcaatctgagttcactttgcaagctcaaggacacaaaaagcgccgatcagaagacaacgcttttgcattttctggtggaaatctgtgaggagaaatacccagacatactcaacttcgtagacgacctggaaccccttgacaaggcatccaaagtgtctgtggagacattggagaagaatctgagacaaatggggcgccagctgcagcagcttgaaaaggagctcgagacattccccccccccgaggacttacacgacaaattcgttacaaaaatgtcaatcttcgtcatttccgcgaaggagcagtacgaaaccctgtcaaagctgcacgaaaacatggagaaactttaccagtcaattattgggtattatgctatcgacgttaaaaaagtttctgtcgaggacttcctgaccgacttgaataattttagaaccacgttcatgcaggcaattaaggagaacatcaagaagcgcgaggccgaagagaaggaaaaaagagtgagaatcgctaaagaactggctgagcgggaacggctggagcggcagcagaagaagaaacgattgctggagatgaagaccgaaggagatgagacaggagtgatggataacctcctggaagcactgcaatcaggcgcagcttttagggatcgaagaaaaagaacgccgatgcccaaagacgtgagacagtcactgtctcctatgtctcagagacccgttttgaaggtctgcaaccatgagaaccaaaaagttcagctgacggagggctcaaggtctcactacaacattaactgcaatagcactcgaaccccagttgctaaagaactcaactataatctagacactcacacctctactggtagaatcaaggctgcagaaaaaaaggaagcttgtaatgtggagtccaatcgaaagaaagagactgagctgctaggatccttctctaagaatgaaagcgtaccggaagtggaagctctgctggcaaggctgcgagctctgtag

SEQ ID NO: 46812 - DNA, 3051 bp, Artificial Sequence
  Description of Artificial Sequence: Synthetic coding sequence
atggagcggcaccagccccggctgcaccaccccgcccagggcagcgctgccgggaccccttacccctcatcagcatctctgcgcgggtgtagggaaagcaagatgccaaggcgtaaaggccctcaacaccctccccctcctagcggccctgaagagcctggcgagaagcgccccaagtttcaccttaacattcgaaccctcaccgatgatatgcttgacaaatttgcatcaatacggattcctggatccaaaaaagaaaggccccccctgcccaatctcaagacagcctttgccagtagcgattgttccgctgcccccttggaaatgatggaaaatttccctaaacctctgagcgagaatgagcttctcgaacttttcgagaaaatgatggaggacatgaacctgaacgaagacaagaaggccccgttaagagagaaagacttcagtattaaaaaggagatggtcatgcagtatatcaacacagcctcgaaaaccggctctctgaaaagatcacggcagattagcccgcaggagttcatccacgagctgaagatgggctcagcagacgaaaggcttgtgacctgtttagaaagtctccgcgtgagccttactagcaatcccgtcagttgggtggaatccttcggacatgaagggctcgggttgttattggatattctcgagaaattaatctccggcaagatccaggaaaaggtggtcaagaaaaatcagcataaggtaatccaatgtctgaaagccctgatgaacacacagtacggactggaaaggattatgagcgaagagagaagcctgtccctcctggccaaggcagtggacccacgccatccaaatatgatgacagacgtggtgaaattgctctcagccgtgtgcattgttggggaggagtcgatcttggaggaggttttagaggccctcacttctgcaggagaggagaaaaaaattgataggtttttctgcattgtagaaggactgaggcacaattctgtccagcttcaagtcgcatgcatgcagctcattaatgcccttgtgacttccccggatgatctggactttcgcttacacattaggaatgaatttatgagatgcggactgaaagaaatcctaccaaatttaaaatgcatcaagaatgacggactggatatccagttaaaggtttttgatgaacataaggaggaggatctctttgagctcagccaccggttagaggacataagagccgaactggatgaagcatacgatgtgtacaatatggtatggtcaaccgtgaaggaaactcgagcagaaggatactttatcagtatcctccagcacctactgctgatccgtaatgattacttcattaggcaacagtattttaaacttatcgatgagtgcgtgtcccagatagtgctccatcgagacggcatggatcctgattttacatatcgcaaaagactggacctggaccttacccagtttgtggacatttgcattgaccaagcgaagctggaggagtttgaggagaaagcaagtgagctttacaaaaaatttgagaaagagttcactgatcaccaggaaacacaggccgagcttcaaaagaaagaagccaagattaatgaactgcaggccgagctgcaggccttcaaaagtcagtttggtgcccttccagctgattgcaacatccccttgcctccctctaaagagggaggcacaggtcattccgcccttccccccccgccacctctgccgtccggtggcggtgtacctcccccgcctccaccacccccccctcctcccctacccgggatgcggatgccgttctccggccccgtgccccctcccccccccctcggatttctcgggggccagaatagtcctccactccccattttaccttttggcttgaaacctaaaaaagaattcaagccagagatttcaatgcggagactgaactggctgaagataaggccccatgaaatgaccgagaactgcttttggattaaggtgaacgagaataagtacgaaaatgtggatttgctttgcaagctggagaacaccttttgctgtcagcagaaggagcgtcgggaggaagaggacatagaagagaagaagtccatcaaaaagaagatcaaggaactgaaattcctggattctaagatagctcaaaatctgagtatttttctgtcatcttttagagtgccttacgaggagatccggatgatgattctggaggtcgatgagacgcgactggcggaatccatgattcagaacctcattaagcatctgccagaccaggaacagctgaacagtctgtctcagtttaagtctgagtactcaaatttgtgtgaacccgagcagtttgtggtggtcatgagcaacgtgaagaggctgcgacctcgtctgagtgcaattttatttaagcttcagtttgaggaacaagtgaataatatcaagcctgacataatggccgtatccaccgcttgtgaagagatcaagaaaagtaagtcgttttctaagcttctggaactggttctcctaatgggcaattacatgaacgcggggtccagaaatgcacagaccttcggatttaacctgtcctccctctgtaagctgaaagacacgaagagcgctgatcaaaagacgacactgctgcacttcctggttgaaatttgcgaggaaaagtatcccgacatcctcaattttgtggatgatctcgaaccccttgataaggcctcaaaggtgagtgtggaaacattagaaaaaaacctgaggcaaatggggagacagcttcagcaattagagaaggaacttgaaactttccccccccctgaggacctgcatgacaaatttgtgaccaagatgtcaattttcgtgatttccgcaaaagagcagtatgaaacattgtctaaactgcatgaaaacatggagaagctctatcaatcaatcataggttactacgccatagatgtcaaaaaagttagcgtcgaggactttcttacagaccttaacaattttcggaccacctttatgaaggccattaagttccagatctag

SEQ ID NO: 46813 - DNA, 3339 bp, Artificial Sequence
  Description of Artificial Sequence: Synthetic coding sequence
atggagcggcaccagccccggctgcaccaccccgcccagggcagcgctgcaggcactccataccccagtagtgcctctctgagaggttgccgcgagtctaagatgccccggcgaaagggacctcagcaccctcccccaccatccggaccggaggaacccggcgagaagcgcccaaagtttcatctgaatattcgcactctgaccgacgatatgctggataaatttgctagcataaggattccagggtcaaagaaagaacgcccacctttgccaaatctcaaaaccgcttttgctagcagtgactgcagtgccgcaccgctggaaatgatggaaaatttccctaaaccgctctccgagaatgagctgctggagttgttcgaaaagatgatggaggacatgaacctaaacgaggataagaaggctcctcttagagaaaaggattttagcatcaagaaagagatggtcatgcaatacatcaatacagcgagcaagacgggcagtctaaagcggtctcggcagataagccctcaggagtttattcacgagttgaagatgggttctgcggacgagcggctggtgacctgtttagagtccttacgggtctctctgacgagtaatcctgtgagttgggtggagtccttcggccacgagggtctcgggctgctgttagacattctggagaaactgatctccgggaagatccaagagaaggtagtgaagaaaaatcaacataaggtgatccaatgtctcaaagctctaatgaacacccagtacggcctggaaagaatcatgagcgaggagagaagcctttcactgttagcaaaagcagtggatcctcggcaccccaacatgatgacagacgtagtcaaacttcttagcgccgtgtgcatagttggagaggagtcaatcctcgaagaggtgcttgaggctctgacatcggccggagaagagaagaagatcgataggttcttttgcatcgttgaagggttaagacataattcggtccagctgcaggtagcgtgcatgcaactgatcaacgcgttagtgacgtccccggatgacctggacttcagactgcatattagaaacgagttcatgcgatgcgggcttaaagaaatactgcccaatcttaaatgtatcaaaaacgacgggctggacattcaacttaaagttttcgacgaacacaaggaagaggacctgttcgaacttagccatcgactagaggatattagggccgaattagatgaagcatatgacgtatacaatatggtgtggagtacggtgaaggaaacgcgcgctgaaggttacttcatcagcattcttcaacacttgttactcatacgaaacgactatttcatccgtcaacagtacttcaagctcatcgatgagtgtgtttcacagatcgtgctccaccgagatggcatggaccctgatttcacctaccggaaaagactggatttagatcttacacagttcgttgatatctgcattgaccaggctaaactggaggagtttgaggaaaaggcttcagagctctataagaaattcgagaaagagtttacggaccaccaggagacccaggcagagctgcaaaagaaggaggccaagatcaatgagttgcaggccgaactccaagccttcaaatcccagttcggggcactacctgccgactgcaacattcccctgcctccgtccaaagaggggggcacaggacattcagcactccctcctcctccaccccttccctcgggcgggggagtacctccaccgcccccccccccaccaccccccccactaccaggtatgagaatgcccttctcaggacctgtcccaccaccaccccctttgggatttcttgggggacaaaacagccctccgctgcctattcttccattcggtttgaaaccaaagaaagagttcaagcctgagatatctatgcgtcgactgaattggctgaaaattcggccccacgagatgaccgagaactgcttttggattaaggtgaatgagaacaagtacgagaacgttgatctgctctgtaagctggaaaacacgttctgttgtcagcagaaagagcgcagggaggaggaagatattgaggagaaaaaatcgattaagaaaaagattaaagagttgaaatttctggacagcaaaatcgcccaaaacctgtcgatattcctgagttcctttagggtgccgtacgaagaaattcgcatgatgatcctggaagtcgacgaaacgcggcttgcggagtccatgatacagaatctgatcaaacatctccccgaccaggagcagctgaacagcctgtcacagttcaaaagcgagtattcaaacctctgtgagcctgagcagttcgtggttgttatgtcgaacgtcaagaggttgaggccacggcttagcgccatcctgtttaagctgcagtttgaagagcaggtgaacaacatcaagccagatatcatggctgtaagtactgcatgcgaggaaattaagaagagcaagtccttctccaagctcctggaacttgtgctgttgatgggcaactatatgaatgctgggagtagaaacgctcagacattcggttttaatttaagtagcctctgtaaattgaaagataccaagagcgcggaccaaaagacgacgttgttgcacttcctggtagagatctgtgaggagaagtacccagatatcctgaactttgtagatgacttagagccccttgataaagcaagtaaggtctcggtcgagacgctggagaagaacctgagacagatgggaagacagcttcaacagctggagaaggaactggagacgtttcctccacctgaagacctccacgataaattcgtgacaaaaatgtctcgctttgtaatcagcgccaaggagcagtacgagaccctgtctaaattgcatgagaacatggagaaactgtatcagtcaatcatcggttattacgcaattgatgtgaaaaaggtgtcggtggaggacttcctaacagacttaaataacttccgtaccacgttcatgcaggccattaaggaaaacattaagaaacgcgaggcagaagagaaagaaaaaagagtccgaatagcaaaggaactcgccgaaagagaacggttggaacgtcagcagaagaagaaacgccttctggaaatgaaaaccgaaggtgacgagactggagtgatggacaacttactggaggccctccagtcaggagccgcctttcgagaccggcgcaaaaggacacctatgcctaaggacgttcggcagtcactgtcgcctatgtcccagcgcccagtgcttaaggtgtgtaatcatgggaacaaaccgtacctgtag

SEQ ID NO: 46814 - DNA, 1866 bp, Artificial Sequence
  Description of Artificial Sequence: Synthetic coding sequence
atgtgcagcggctggagcagcagcgtgatctggcggcacacccagtttgcggtggagcggtgtggcttctgcgggtcctctgggcccggggcccccctggaaccttccactttggggtccaaacacctgccatgggaagcagtgagcgctggtttcgcagaccgcaaccgtaatatggatggagccatgtggcttagtctgtgtcctgataacgaggatctactttggaggaagaaacacaagctcttgcaagctcgcggcaaaggggacctcgccctgcagagacgagcggatgctaagttatggaagaattaccagttacagagactggcggaggaactgaggaggggataccaggaggcccagcatctgcacgtcggggggcttgaccgcctacagtctgcccggctactgggatggggcgggggaagggcaagagagaacgagccagattcccaggggcctattcaacgcaggtctgctcggcccccccgcgcaaaggagaaacacagggccgccttaagcgaagagagatcatgtcgagaggaactcgggcagcagcatccccggcattcacgacctagaaaaaccgcagcttcaccagagaagccccaaaccactaaggctactggcagaatgaactctcaccttgctcctcccgagaaacgaaaaggcagacccgagcccagcacaaaatcaggcggtggcaggtgcgcgatccatcctagacggagcaagggagctgacttggagcggagtaaccccctggtggccgccgtgggggagattggcctggtggaggagaaggagaaaggaacagcccgcgcggggcggcgtcagctaggaaagggcgctgtgtgcttcgtgcccgcactaaccagcagaagccaagggcagagcctagaggggaagctgcgcgacctggggcagctgtggcccgctgacagcagctgtaggagggaagcagtttcccctgcgagtcaatgcacccttagagaaaagaataagtggcagaaagaattagaattggctttcgaagagcttttcaacatcaatcgtaagctgaagaaacacctatgtctttacttggctctcaagcccaggatggatcagaggcctggtgaaggccatgccttttctgagatgcaggagtgcggggcgggaacaccgcgcggcaaaaaaatggccgaccccgagatgctgcccgcaggggagcccaggagccccgcagaggaggaagctcagcaggctgcttccaaaaccgacctgaagaccttcatgggtaaagcccaaaaccagaaataccagggtacagtaaaaccaacctttcggaacggcagtcagactctgtcacctgaggccggcatcttcattaacaaggaagactcgctcctgtactctaccgaaagcggccaggagacccccaagttgggtactctggcagaagggtccttacaactgcatctacaggatcaggctgatcgcgtggggtctaccgcgagcagacagagacaaaaagcagaaatggagcaacggcgccagaagcagctggagtccctagaacagatggaacatcccgacatgagtctggaaattcactataaggccgagctggagaaggaacgtagagagcagaggcgcgcacggctggcccacctcaaatctagctcaacgagggcacaagaaagagagcgtggcagcgaactctcaacgacctccccgtcagggaccagcctggccgatgatgacagacacagccagatgattcgcgatcaacagcagcaaattcttcagcaaaacaggctgcacaaacagttcttggaggaagcacgaaagtgcttacgggagttccaaaacatctgttag

SEQ ID NO: 46815 - DNA, 1539 bp, Artificial Sequence
  Description of Artificial Sequence: Synthetic coding sequence
atggccatcctgagcctgcgggcccccggcccctggcaggccatgcaggtgtgggctgatagaaccctactaacccctcacacaggggtgactagtcaggtgttgggcgttgctgcagcagtgatgaccccactccctggcggccacgccgccggcagaacccgcgaagcaagatgggatgcgatggagtacgacgaaaagctggcaagattcagacaggcccacctgaatccttttaacaagcagtccggaccccgacagcatgaacaaggccccggagaagaggtgcccgacgtgaccccagaagaggctcttcctgaattaccccctggtgagcccgaattccggtgtcccgagagggttatggacctggggctgagcgaggaccatttctcccgccccgttgggttgtttctggcttccgatgtgcaacaactgaggcaggcaatcgaggaatgcaagcaggtgatccttgaactcccagaacagtcggaaaaacagaaagatgccgtggtccgcttaattcatctaagactgaaactgcaggaactgaaggaccctaacgaagatgagcctaatattcgtgtattactggagcacaggttctacaaggagaaaagtaaatccgtaaagcagacttgcgacaagtgcaacactataatttggggcctgatccagacctggtacacctgtaccggctgctactaccgatgccatagcaagtgcctgaacctgatatccaagccttgcgtgtcaagcaaggtgtcccaccaggccgaatacgagctgaatatctgcccagaaactggattggattcacaggattacagatgtgcagagtgtagggctccaatctcgctccgcggggtgccctccgaggctcgccagtgcgattacaccgggcaatattattgttcgcactgccattggaatgatctggctgtgattcctgcacgggtggtacacaattgggacttcgagcctcgtaaggtctccagatgctctatgaggtatctggcgttgatggtgtctaggccagtgttaagacttagagagattaatccccttctgttttcctatgttgaagaactcgtcgagattcgcaaactccggcaagacattttacttatgaaaccatacttcattacctgtcgtgaagccatggaagctagacttctcctgcagcttcaggaccggcagcattttgtcgaaaatgatgagatgtactcggttcaggacctgctagacgtgcatgccggcaggctgggctgttcattgacagagatacacactctctttgccaaacatataaagctggactgcgaaaggtgccaggctaagggctttgtgtgtgagttatgtagagagggcgacgtgctgtttcccttcgattctcacacctccgtgtgcgcagactgttccgcagtgtttcacagggattgctattacgacaacagcacaacatgtcctaaatgtgctcgactcagtctccggaaacagagcctattccaggagcccggtcccgacgttgaggcgtag

SEQ ID NO: 46816 - DNA, 594 bp, Artificial Sequence
  Description of Artificial Sequence: Synthetic coding sequence
atggagtacgacgagaagctggcccggttccggcaggcccacctgaacccatttaataagcagagcgggccccgtcagcacgagcagggtccgggagaagaggtaccagatgtcacgcctgaagaggctctcccagagttgccaccaggcgagcccgaatttaggtgccctgaaagagtgatggacctcggtttgtcagaagatcacttttctaggccagtgggactgtttctggcgtcggacgtccaacagctacgtcaggccatcgaagagtgtaagcaagtgattctagagcttcctgagcaatcagaaaagcaaaaggatgctgtagtccggctcattcatctcaggctgaagctgcaggagctcaaggatccaaacgaagacgaacctaatataagggtcttactggagcatagattttataaagaaaaaagtaagtcagtgaagcagacctgtgacaagtgcaacactatcatttggggcctgattcagacctggtatacatgtacgggcgggcctagaccacgccgaggagtgcgcaacgagcgcgatcagagttcttgcctgcgatgggcgcatattcagatgtag

SEQ ID NO: 46817 - DNA, 1356 bp, Artificial Sequence
  Description of Artificial Sequence: Synthetic coding sequence
atggagtacgacgagaagctggcccggttccggcaggcccacctgaaccccttcaacaagcagtcaggtccccggcagcatgagcagggccctggggaagaggtgcccgatgtcacccctgaggaagccctccctgaactcccacccggggaacccgaattcaggtgtcctgagcgggttatggatttaggactttcagaagatcatttctccagacctgttggcctatttctggcgtcggatgtgcagcagctccggcaggccatcgaggagtgtaaacaggttatcctggaactgcctgagcagtctgagaagcagaaggacgccgtcgtgaggctgatccacctgaggttaaaattgcaagagctgaaggatcccaatgaggatgaacccaacattagggtactgttagagcacagattctacaaagagaagtcaaagtcagtaaagcagacctgcgacaagtgcaacacaataatctggggcttaatccagacatggtacacctgcacgggttgctattaccggtgccacagcaagtgtttaaacctaattagcaagccgtgtgtcagttccaaagtgtcccaccaggcagaatatgagctcaatatttgcccagaaaccggcctggactctcaggactatagatgcgcggaatgcagagccccgatctctctacggggagtgccaagcgaggctcgacagtgtgattacacagggcaatattattgctcacactgtcactggaacgatttggccgttattcctgcaagggtagtacataattgggacttcgagcctagaaaggttagccgctgctccatgaggtacttggctttgatggtgagccggccagtactgagactacgggaaataaacccactgctgttctcctacgtcgaagaattagtggagattcgcaaattgcgtcaggatatcctgctgatgaagccatacttcatcacctgtagagaggctatggaagccaggctgctgctgcaactgcaagacagacagcactttgtggaaaatgacgagatgtactctgtgcaggatctcctcgacgtccatgccggcaggctgggttgcagcttgacagagattcatacactgtttgccaagcatattaagcttgactgcgagcgctgccaggctaaaggtttcgtatgtgaactgtgcagagaaggggacgtgctatttcccttcgactctcacaccagcgtatgtgcagattgctcagctgtgtttcaccgcgactgctattatgacaacagtacaacctgccccaagtgtgctagactatctctacggaaacaaagtctgtttcaggaaccaggccctgacgtggaagcctag

SEQ ID NO: 46818 - DNA, 1326 bp, Artificial Sequence
  Description of Artificial Sequence: Synthetic coding sequence
atggagtacgacgagaagctggcccggttccggcaggcccacctgaacccattcaacaaacagagcggacccagacagcatgaacagggaccaggggaggaggtccctgacgtgacccctgaagaggccctcccagaactgccccctggcgagccagagtttcgctgtccagaaagggtcatggatctgggtctcagcgaggaccattttagcagacctgttctgcggcaggctatcgaggagtgtaagcaggttatactggagctgcctgaacaatcagagaagcagaaagacgcagtggtgagattgatccacctcaggctgaaactgcaggagctcaaggacccaaatgaggacgagccaaacataagggtgctattagaacaccggttttataaggagaaaagcaaatctgtgaagcagacctgcgacaagtgtaatacaattatctggggcctcatacagacgtggtatacgtgcaccggatgttactacagatgtcactcgaaatgccttaatttgatctctaaaccttgtgtgagctctaaggttagccatcaggccgaatatgaactcaatatctgtccagaaactggactggattcacaagactatcgctgtgcggaatgtagggcccccatctcactcaggggcgtgccctcagaggcccgtcagtgtgattacaccggacagtactactgcagtcactgccactggaatgacttagctgtaatccccgcacgcgtggtccacaactgggactttgaaccccgaaaggtttctcgctgcagcatgaggtatcttgctttaatggttagtaggcccgtgctgagactgcgcgaaataaatcccctccttttctcgtacgtagaagagctcgttgaaatcaggaagctgcgccaggatatcctcctgatgaagccctacttcatcacatgccgagaagcgatggaggcccggttgttactccaattacaggaccggcaacactttgtggagaatgacgaaatgtacagtgtccaggatttgctcgatgtgcacgctggccgattgggttgttccctgacagagattcatacactttttgccaagcatataaagcttgattgtgaaagatgccaggctaaaggctttgtatgtgaactgtgccgggaaggggatgtgttgttcccattcgacagtcacacttcagtatgtgccgactgtagcgctgtgttccacagggattgttactacgacaactccacaacatgtccgaagtgcgcccggctatcccttaggaagcaaagtcttttccaggagccaggacccgacgtagaagcctag

SEQ ID NO: 46819 - DNA, 1563 bp, Artificial Sequence
  Description of Artificial Sequence: Synthetic coding sequence
atgagccaggacaacgacaccctgatgcgggacatcctgggccacgaactggctgccatgcggctccagaaacttgagcaacagcgccgactcttcgaaaaaaagcagcgccagaagaggcaggaactgctcatggtgcaggctaaccccgacgcatccccttggctgtggcgctcctgtctgcgggaggagaggctcctgggggacaggggcctgggaaacccttttcttcgcaaaaaggtgtcagaggcccacctgccgagcgggatccattccgctctggggaccgtgagctgtggtggcgatggccgaggagaacgtggactccccacacccagaacagaagccgtcttccggaatttgggacttcagagcccatttctgagttggctgccagacaactcagacgcagaactggaggaggtgagcgtcgagaatggctccgttagtcctcccccgttcaaacaaagtccaaggatccggcgcaagggctggcaggcacatcagaggcctggcacccgcgctgaaggggagagcgattcccaggatatgggcgacgcccacaaaagccctaacatgggtccgaaccctggcatggacggggattgtgtgtatgagaacttagccttccagaaggaagaagacctagaaaagaaaagagaggctagcgaatccaccggaacaaatagttccgctgcacataacgaggagctgtcgaaggccctcaagggagaaggtggtacagactctgatcacatgagacacgaagctagcctcgccatccggtccccctgcccaggactcgaggaggacatggaggcctatgtcttgcgccctgcgttaccaggaaccatgatgcagtgctacctcactagggataagcatggtgtagacaaggggctgtttccactctattatctgtatctggagaccagcgactccctgcagaggttcttactcgcagggagaaagcgccggaggtctaagacctctaattatctaatctccctggatcctacacatctgtctcgcgatggggacaattttgtcggaaaggtaaggtcgaacgttttttcaactaaatttacaatattcgacaacggggtcaatcctgaccgcgagcacctgactcgcaacaccgcgcgaattaggcaggaactgggcgcagtatgttacgagcccaacgtactgggatatctgggtcctcggaagatgaccgtgatccttccaggtactaactcacagaaccagagaattaatgtccagccccttaatgagcaagagtcactgctgtcccgttaccagcgcggggacaagcaaggactgctccttttacacaataaaactccatcttgggacaaggaaaacggtgtttatacactcaactttcatggacgcgtgaccagagcatcagtgaagaacttccagatcgttgaccccaagcatcaggagcatcttgtcctgcaattcgggcgggtaggaccagacacatttaccatggacttttgtttccccttctccccattgcaagctttctctatctgtctctccagctttaattag

SEQ ID NO: 46820 - DNA, 1422 bp, Artificial Sequence
  Description of Artificial Sequence: Synthetic coding sequence
atgcccaagctgcagggcttcgagttctggagccggaccctgcggggcgctcgtcacgtcgtggcccctatggtagaccagtccgaacttgcttggaggttgctgagtcgccgccacggagcccaattgtgctacacacctatgctgcacgctcaggtgtttgtgagagatgcaaactaccgaaaagagaatctctactgcgaagtgtgtcctgaggaccgccctctgattgtgcaattctgtgccaatgacccagaagtctttgtgcaagccgccttgttggcacaggactactgcgacgccattgatctaaacctgggttgccctcaaatgattgccaagcggggccactacggagctttccttcaggatgagtgggatctgctacagagaatgattctacttgctcacgagaagctgagcgttccagtcacatgtaaaatcagggtgttcccagagatcgataagaccgttagatatgcgcagatgctggagaaggccggatgtcagctgctgactgtgcatggccggacaaaggagcagaaaggccccttatctggcgctgctagttgggaacatataaaagccgtgcgcaaggccgtggcaatccccgtgtttgctaatggcaatatccagtgcctgcaagacgttgaacgttgcctgcgagacacgggcgtgcagggggtcatgagtgctgagggcaatctgcacaatcccgccctgttcgagggcaggagcccagcagtctgggagcttgccgaggagtatctggacatcgtacgcgagcacccctgccccttatcatacgtgagagcccacctgttcaagctctggcaccacaccttgcaggtccaccaggaactgagagaagaattggccaaagtcaagacgctcgagggcatcgccgcagtgtcccaggaacttaagctgcggtgtcaggaagagatctctcgtcaggaaggggccaaaccgactggagacctgccctttcattggatttgtcaaccatacatccgcccgggccccagagaaggtagcaaggagaaagcaggggcccgcagtaagcgagccttagaggaggaggaagggggcactgaagtgctctcaaagaacaaacaaaaaaagcagctcagaaacccacacaagactttcgaccctagcctgaagcctaaatacgccaaatgcgaccaatgtggaaatccaaaggggaatcgttgtgtgttttccctgtgtaggggctgttgcaaaaaacgcgcaagcaaggagacagccgattgcccaggacatggcctgctctttaagacgaagctcgagaagtctctcgcctggaaagaagcgcagcctgaactccaagagccccagccggccgctccagggacacctggcggattctctgaggtaatgggtagtgcactggcatag

SEQ ID NO: 46821 - DNA, 1422 bp, Artificial Sequence
  Description of Artificial Sequence: Synthetic coding sequence
atgcccaagctgcagggcttcgagttctggagccggaccctgcggggggccaggcacgtggtggcccccatggtggatcagagcgagcttgcttggagattactctcccggcgccacggcgcccaactctgttacacacccatgttacacgctcaggtgttcgtgcgggacgccaactaccgcaaggagaacctatactgtgaggtgtgcccggaggacagaccactcatcgttcagttctgcgccaatgatcctgaggtctttgtccaagcagccttacttgcgcaggactactgtgacgctatcgacctgaacctgggctgcccacagatgatcgccaagaggggacactacggcgccttcctgcaggatgagtgggatctactacaacgtatgattctgctggctcacgaaaagctcagtgtaccagtgacgtgcaagataagggtcttcccggaaattgacaagactgtcaggtatgcacagatgctggagaaggccggttgtcaactgcttactgtccacggacgcactaaagagcaaaaagggcccctctcgggagcagcctcctgggagcatatcaaagcagttaggaaagcagtggctatcccagtgttcgccaatggaaatatacagtgccttcaggacgtagaacgatgcctcagagacaccggtgtgcaaggagtgatgtcagccgaaggaaacttgcacaaccccgcactgtttgaaggacgctcccctgcagtatgggaactggccgaagaatacttagacatcgttcgcgagcacccctgccccctgagctatgttagagcgcatctttttaaactgtggcaccatacactccaagtgcatcaagagctgagagaagaactcgccaaggtgaagaccttagagggcattgctgctgtgtcccaggagctgaaactgcgttgccaagaagaaatctctcggcaggaaggagcaaaaccgacaggagatctgccgttccattggatctgccagccctacatacgacctgggcctagggaaggcagtaaggagaaggcaggcgcacgaagtaagagggccctggaggaggaggagggagggactgaagttcttagcaaaaacaaacagaagaagcagctcagaaacccacacaaaacattcgatccatcattgaagcccaaatatgcaaagtgtgaccagtgcggaaacccgaagggcaacagatgcgtcttctcactctgccgaggatgctgcaagaaacgcgcatcgaaggagaccgcagactgccccggccacgggctgctgttcaaaacaaagctggaaaaaagcctggcatggaaagaggctcagcctgagctgcaggagccccagcccgccgccccgggaacccctggtggctttagcgaggtaatgggaagtgctctcgcttag

SEQ ID NO: 46822 - DNA, 894 bp, Artificial Sequence
  Description of Artificial Sequence: Synthetic coding sequence
cccagcttcgccggcccccgggagaccctgcccgtgacctgcaagatccgagtgttcccagagattgataagacggtgcgttacgcgcaaatgctagagaaggcaggctgtcagttgttgaccgttcatggtaggaccaaggagcagaaggggcctttgtcgggagctgcgagttgggaacacatcaaggctgtgagaaaagccgtggcgatcccggtgtttgccaacggcaacattcagtgcctccaagacgtggagcggtgtttgcgcgataccggcgttcagggtgtgatgtctgccgaggggaacctacacaacccagcgctgttcgagggacgatctcccgccgtctgggagctagctgaggaatacctggacattgtgcgcgagcacccttgtccgttaagctatgttcgcgcccatctgttcaaactgtggcaccacaccttacaggttcaccaggaactgcgtgaggagctggctaaagtcaagaccctggaaggtatcgccgccgtgtcgcaggagctgaaattacggtgccaggaaattagccgccaggagggagcaaaacccactggcgatctccccttccattggatctgtcagccgtatatccggccaggcccaagggaaggctccaaagaaaaggccggtgcaaggtccaagagggctctcgaggaggaggaaggaggtactgaggtgttgagtaagaataagcaaaagaagcaactccgcaaccctcacaaaacatttgatccttctctgaagcctaagtatgctaagtgcgaccaatgcggcaatcccaaaatgtgcgtccagcccgtgccacgtttgctccaagaggcctccctgcagagggactgcaggcttccacgcagtcgaatcgcattttag

SEQ ID NO: 46823 - DNA, 1011 bp, Artificial Sequence
  Description of Artificial Sequence: Synthetic coding sequence
atgatcgccaagcgggtgctgctggcccacgagaagctgagcgtgcctgtgacttgcaagattagagtgttccctgagatcgacaagacagttcgctatgcccagatgctggagaaagcaggttgccagttgctcacagtgcacggccgcaccaaggaacaaaaagggccacttagcggagctgcttcttgggaacacatcaaggcggtgaggaaggcagttgctattccagtgttcgccaatgggaacatccagtgtctccaagacgtggaacggtgcctaagggacactggcgttcagggcgtcatgtcagcagagggcaatctccataaccctgccctgtttgagggccgcagtcctgctgtgtgggagttggccgaggagtacctggatatcgttagagctcatctgttcaaactgtggcaccacaccctacaagtccaccaggaactgagagaagaattggctaaggtgaagacccttgaggggatagctgccgtgtcccaggaattaaagctgcgctgtcaggaagagataagtcgccaggaaggtgcaaaaccaacaggagatctgccattccattggatatgccagccctatatccgtcccggaccaagagaaggaagcaaggagaaagcaggagcaaggtcaaagcgggctttggaagaagaggaaggtgggaccgaggtgctgtcaaaaaataaacagaagaaacagttgcgaaatcctcataagactttcgacccctccctaaagccaaagtacgccaagtgtgatcagtgtggcaaccctaaaggcaaccgatgcgtctttagcttgtgtaggggatgttgcaagaaacgtgcaagtaaggaaactgcagattgcccagggcacgggctccttttcaagactaagctcgagaagtcactcgcctggaaggaggcacaaccagagctgcaagaaccccaaccagccgcaccaggaacaccgggtgggtttagtgaggtgatgggctctgctctcgcctag

SEQ ID NO: 46824 - DNA, 1953 bp, Artificial Sequence
  Description of Artificial Sequence: Synthetic coding sequence
atggccgagggcaccgccgaggcccccctggagaacggcggcggcggggatagtggtgcaggggctctggagcggggcgtggcacctattaaacgacagtatctgaccaccaaggaacagtttcaccaattccttgaggctaaaggccaggaaaagacttgtcgggagactgaggttggggatcccgccggcaacgagctggccgaacctgaggctaagcggatcagattagaggacggtcaaaccgccgacggccagactgaggaggctgccgaaccaggcgaacagctccagacgcagaagcgggcacgaggccagaacaaggggcgcccacatgtcaaaccgaccaattacgataagaatcgactctgccccagcctcatccaggagtcagctgctaaatgtttcttcggcgaccggtgtagatttttgcatgacgtcggaaggtatttagaaactaaacccgccgatctgggaccacgttgcgtcctgttcgaaacattcggaaggtgcccttacggagtgacttgccggtttgctggggcccacctgcgacctgagggacagaacctggttcaggaagaactggccgcacggggcacgcagcccccctccattcgcaacggcctagacaaggcgctgcagcagcagttaagaaaacgtgaggttagatttgagcgagcagagcaagcgctgcgcagattttctcaaggaccaacccccgcagccgctgtgcctgaagggactgctgcagagggcgccccgcggcaagagaactgcggcgctcagcaggtcccagctgggcccggcactagcacacctccttcctctcctgttcgcacctgtggccccttgacagatgaggacgtcgtgcggttgagaccatgcgagaagaagcggctggatatccgtgggaaactgtaccttgcacccctgacaacttgtggcaatttaccatttcgacgcatttgcaagaggttcggagccgacgtcacctgcggtgagatggccgtgtgtaccaacctgttacagggacagatgagcgaatgggccctgctcaaaaggcatcaatgcgaagatatcttcggagtccaactcgaaggagcttttcctgataccatgacaaagtgcgcggaactactgtcccggaccgtggaggtggactttgtagacatcaatgtggggtgccccatcgacctcgtctacaaaaaggggggcggatgcgctctgatgaataggagcaccaagttccagcaaattgtacggggaatgaaccaggtgctggatgtcccactcacagtaaagattaggaccggcgtacaggagcgagtgaatctggcgcacagattgttgcctgagctgcgggactggggagtcgccctggtcacgctgcatggcaggtcaagagagcagcggtacacaaagctcgctgattggcaatacatcgaggaatgcgtccaggcggcctcgcctatgcctctgtttggcaacggggatatcctgagttttgaggatgctaaccgggccatgcagaccggagtgacaggcataatgatcgctagaggcgcccttcttaaaccttggctcttcactgagataaaagaacagcggcactgggatatttccagcagcgagagactagacatcttgcgcgactttacaaactacggcctggaacactggggcagtgatactcagggggtggagaagacgcgaagatttctgcttgagtggctgtccttcttgtgcagatatgtgccggtcggcctcctggagaggttgccccagaggattaacgagagaccaccatactatctcgggcgggattacctcgagactctgatggcgtcacaaaaagctgccgactggatcaggatctccgagatgctcctgggtcccgttccccctagctttgcatttctgcctaagcacaaggcgaacgcctataagtag

SEQ ID NO: 46825 - DNA, 1227 bp, Artificial Sequence
  Description of Artificial Sequence: Synthetic coding sequence
atggccgagggcaccgccgaggcccccctggagaacggcggcggcggagactccggagcgggagcgttagagagaggagtagcaccgattaagcggcaatatctgaccacgaaagaacagttccatcagttcctggaggctaagggccaggagaaaacatgccgtgagacagagctcgatatcagaggaaagttgtatttggcaccactgactacttgcggcaacctgcctttcaggcgaatctgcaaacggtttggcgctgatgtgacatgcggggagatggctgtatgtactaatctcctgcaagggcagatgagcgagtgggcactgctgaagagacatcagtgcgaggatatatttggcgtgcagctggaaggggccttccctgacacgatgactaaatgtgccgaattgctgagtaggactgtagaggtggattttgtagatatcaacgtcgggtgccccatcgatctggtttacaaaaagggcggcgggtgtgctctcatgaatagatcgaccaaatttcaacagatcgtgagagggatgaaccaagtgttggatgtgccactcacggtgaagattagaaccggggtgcaagaaagagttaatctcgctcaccgcttgcttccagagcttcgcgactggggagtggctcttgtcaccctgcacgggcggtctagagaacaacggtacacgaaactggcagactggcagtatatagaggaatgtgtgcaggctgccagccctatgcctctgttcgggaatggagatatccttagttttgaggatgctaatagagcgatgcagaccggggttactgggataatgatcgcaagaggagccctcctgaagccatggctctttacggaaattaaagagcaacgtcattgggacatcagttcttccgagagactagatatactcagggactttacaaattacggcctggaacattggggctctgatactcagggcgtggagaaaactcgtagattccttctggaatggctctcattcctgtgccgttacgtgcccgtaggccttctggagcgactcccccaaaggataaatgagcggccaccttactatttggggagagattatctcgaaaccctgatggcgtcgcaaaaggccgccgattggattcggatcagcgagatgcttctgggccctgtcccacccagctttgcttttctgcccaaacataaagctaatgcctacaagtag

SEQ ID NO: 46826 - DNA, 954 bp, Artificial Sequence
  Description of Artificial Sequence: Synthetic coding sequence
atgaagagcgactgcatgcagaccaccatctgccaggagcggaagaaggacccaatcgaaatgtttcatagcggtcaattggtcaaggtctgcgcccccatggtgagatactcaaagctagcctttcgtaccctggtgcgaaagtacagttgtgatctgtgctatacacccatgatagtcgccgcagactttgtgaaaagtattaaagcacgtgacagtgaattcacaactaaccagggtgattgccccttgattgtgcagttcgctgcaaatgatgctagattgctctccgacgctgcccggatcgtgtgcccttatgcaaatgggattgacatcaactgcggatgcccccagaggtgggcaatggcagaaggctacggtgcatgcctgataaataagcccgaactggtccaggacatggttaagcaagtcaggaaccaggtggagactccagggttttctgtctccatcaagattcgcatccatgacgaccttaagagaaccgttgatctttgtcaaaaagccgaggccacaggagtgtcatggatcactgttcacgggcgcacagctgaggaaaggcatcagccagtgcattatgactcaatcaaaattattaaggaaaatatgtccatccccgtgatcgcaaatggcgatataagatcccttaaggaagcggagaacgtctggcgcatcactggaacagatggagtgatggtagctaggggtctgctggctaaccccgccatgtttgcaggatatgaagaaactcccctcaagtgcatttgggattgggttgatatcgctctcgaactcggcacaccatatatgtgcttccatcagcacctgatgtatatgatggaaaaaatcacgtcccggcaggagaaacgcgtctttaacgcattgtcctccactagtgcaataatcgattacctgactgaccactatggaatttag

SEQ ID NO: 46827 - DNA, 591 bp, Artificial Sequence
  Description of Artificial Sequence: Synthetic coding sequence
atggccgagggctacggcgcctgcctgatcaacaagcccgagctggtgcaggatatggtcaagcaggtccgtaatcaggtggagactccgggatttagcgtctccataaagatacggattcacgacgacctgaagagaacagtcgacctgtgtcagaaagccgaagcaacaggcgtatcctggatcacagttcacggccgtaccgccgaggaacgccaccaaccagtccattatgactctatcaagattattaaggagaatatgtccatccctgtaatcgcaaatggcgacatcaggtctttgaaagaggcggaaaacgtgtggcggatcacgggaaccgacggcgtcatggtcgcgcgtggattactggcaaacccagcaatgtttgctggctacgaggaaactcccctgaagtgcatctgggactgggttgacattgctctcgaactcggaaccccttacatgtgtttccatcagcacttaatgtatatgatggagaagattacctcacgccaagaaaagagggttttcaacgccctgtcatcgacaagtgctataattgactacctcactgatcattatggcatttag

SEQ ID NO: 46828 - DNA, 3669 bp, Artificial Sequence
  Description of Artificial Sequence: Synthetic coding sequence
atgagcgaggccccccggttcttcgtgggccccgaggacaccgagatcaaccccgggaactatcggcactttttccaccatgcggatgaggatgatgaagaggaggacgactcccctccagaacgtcagattgtcgtggggatatgctccatggctaagaagtccaaaagcaaacccatgaaggaaatactagaaaggatatccttgttcaagtatattacagtggtggttttcgaggaggaagtgattctcaatgagccagtggagaattggcccctttgcgactgcctgatctccttccacagcaaggggtttcccctggataaggctgtggcctatgcaaagctaaggaaccccttcgtgattaacgacctcaatatgcagtacctgatccaagatcgcagggaggtgtattcaatcttacaggccgaaggtatcctattaccaaggtatgccatcttaaatagagacccgaataaccctaaagaatgtaatctgattgagggggaagaccatgtggaggtgaatggcgaagtttttcagaaacccttcgtcgagaagcctgtctctgcagaagatcacaatgtttatatctactaccctaccagtgcgggtggcggtagtcaacgattgttccgcaagatcgggtccaggtccagcgtttattccccagagagtaacgttcgcaagaccgggagctacatctatgaagaatttatgccaactgacggaacagatgtgaaggtatatacagtaggcccagactatgcgcatgcggaagcgagaaagtctccagcgctggatggaaaggttgaaagggacagtgagggaaaggaggtccgctatcccgtaatcctaaatgccagagagaagctgatagcttggaaagtgtgcctcgcctttaagcaaacagtatgtggctttgacctgttaagggccaacggacaatcctatgtgtgtgatgtgaacggcttctcctttgtgaagaacagcatgaaatactacgacgactgtgctaagattctggggaatatcgtgatgcgggaactggccccacaatttcatattccgtggagcattccactcgaggccgaggacatccccattgttccaactacctctgggacgatgatggagctgcgctgcgtgattgctgtaatacgtcacggagacaggactcccaagcagaagatgaaaatggaggttagacaccagaagttttttgatctgtttgagaaatgtgatggatacaagagcgggaagctcaagctcaagaagcctaagcagttacaggaggtgctcgatatcgctcgccagcttcttatggaattggggcagaacaatgatagcgagatagaagaaaataagcccaagctggagcaactgaaaaccgtactggagatgtatggtcatttcagcggaattaatagaaaggtgcaactcacttacttgccacatgggtgccctaagacttcttctgaggaggaagattcccggagggaagaaccgagcctgctcctggtgcttaaatggggcggcgagctgacgccagcaggaagagtgcaggcggaagaactggggcgagcctttagatgcatgtaccccggaggtcagggtgactatgcaggttttccaggctgtggacttttgcgtctccactctacctaccggcatgatctgaaaatttacgcttccgacgaaggacgagtgcaaatgacggctgcagcctttgccaaaggtctcttagccctcgagggtgagctgacccctatcttagtgcagatggtgaagagcgcaaatatgaatggcttacttgactccgactcagactcactcagttcgtgccagcagcgtgtcaaggctcgcctgcatgaaatactgcaaaaggatcgagacttcactgccgaggactacgagaaactcacacctagcggctcaattagcctcattaaatcaatgcatttgattaaaaaccctgtcaagacctgtgataaagtgtacagcctgatacagagtctgacctcacagattagacatagaatggaggatcccaaaagctcagatattcagctataccattccgaaacacttgaactaatgttaaggcggtggtctaagctggagaaagattttaagacaaagaacggccgctatgatataagtaagatacctgacatttacgattgtataaagtacgatgtgcaacacaatggctccctgaagctggaaaacactatggagctgtatcggctttccaaagcactggcagatatagttatcccccaggagtacgggataaccaaggccgaaaagctggagatcgctaaggggtactgtactccactggtgaggaagattcgaagcgatcttcagcggactcaggacgacgacactgtgaacaaactccaccccgtctacagtcgtggcgtgctctcgccggagaggcatgttaggactcggctttactttacgtccgagtcccatgtccactcactcctcagtattctgcggtatggcgcactatgtaacgagtctaaagacgagcagtggaagcgtgctatggactacctcaatgtagtgaatgagctcaattatatgacacagattgtgataatgttatatgaggatccgaataaggatctctcatccgaggagcggtttcacgtggagttacatttcagcccaggcgccaaaggttgcgaagaggataaaaaccttcccagtggatacggatataggcccgccagcagagagaatgaaggccgccgtcctttcaagatcgataacgacgacgagccacacacctcgaagcgggacgaggtggacagggcggtaatactgttcaaacccatggtgtctgagcccatccacatccaccgtaagagtcctctcccaaggtctcgtaaaacagccacaaatgacgaagagtccccgttatccgtgtcgtcccctgagggaactgggacatggctccactacactagcggcgtcggcactgggcgccgccgccggcgttccggagaacagattaccagctctcccgtgtcaccgaaatccctagcgtttacaagctccattttcgggtcttggcagcaggtggtgtccgaaaatgccaactacctgcgaacccctaggactttagtcgagcagaaacagaacccgacggtgggaagtcactgtgccgggcttttctctacaagcgtacttggaggatctagcagtgctcccaatctgcaggattacgctaggacacacaggaagaaattgacatcttctgggtgtatagatggcttcgaactctacagcatggtccccagcatatgccccctggagaccctccataacgctctgagtcttaagcaggtcgatgaattcctagcttctatcgctagcccctcaagtgatgtacctcggaaaacagcggagatctcctccaccgcgctccgctcaagccccataatgcgcaaaaaagtctctctgaatacctatacgcctgccaagatactgcccacaccgcctgcaactctcaaaagcaccaaagcctcatcaaagccagccacatcaggcccttccagtgcagtcgtcccaaatacctcatcgcgtaaaaagaatatcacaagcaagacagaaacacatgagcataagaaaaacactgggaaaaagaagtag

SEQ ID NO: 46829 - DNA, 2970 bp, Artificial Sequence
  Description of Artificial Sequence: Synthetic coding sequence
atgaagggcctgggcgacagccggccccggcacctgagcgacagcctggatcccccacacgagccgctgttcgctggaactgacaggaatccttatctgctgtcgcctacggaagccttcgcaagggaggcgagattcccaggccagaacactctacctggagatggcctgtttcccctcaataatcagctacctccaccatcttcaaccttccccagaattcattacaattcacacttcgaggtccccgaggagtccccattcccctcacatgcccaggctacaaaaatcaacagactaccggccaatctcctggatcaatttgagaaacaacttcccatacacagggatggcttttcaacacttcagttcccacgaggagaggctaaagccagaggcgagagccccgggagaattcgccacctggtgcattcggtacagagactattcttcacaaaagccccctccttggaaggaaccgccggtaaggtcggtgggaacgggtccaaaaagggcgggatggaggacggtaagggtaggcgagccaagagcaaagagcgcgctaaggcgggggagcccaaacgccggtcacgaagcaatatctctggatggtggagttctgacgacaatctggacggggaagcaggagcttttcggagcagcggccctgcttcaggactgatgacactagggaggcaagcagaaagatctcagcccagatatttcatgcacgcctacaacacaatttctgggcacatgctcaagactaccaagaataatacaacagagctgaccgcaccaccacctccccctgcccctccagcgacttgtccttcactcggagtaggcacagacaccaattatgtgaaaagggggtcttggtcaacactcacgctatcacacgcccacgaagtgtgtcaaaagactagcgccacacttgacaaatccctgctgaagagtaagagttgccaccagggcttggcatatcactacctccaggtcccaggaggaggtggtgaatggtcaacaaccctgcttagcccccgcgagactgatgcggccgctgaaggccccattccctgccgtagaatgcgttctggatcttacataaaggcaatgggtgacgaagatagtgatgagagcgggggaagccctaaaccctcaccaaaaaccgccgcccggcgacagagctaccttcgggccacgcaacagtcactcggggaacaatctaacccacgaaggagtctggatagacttgatagtgtcgatatgcttctgcctagcaagtgtccctcatgggaagaggactacacccctgtgtccgattctttgaacgactcatcctgtatctcacagatctttggccaagcctcactcatacctcagctgttcggccatgagcagcaagtacgagaggcagaattgagcgaccagtatgaggccgcctgtgagagcgcgtgcagtgaggctgagagcaccgccgcagagacactggacctcccgttgcccagttacttcaggagccgctcgcatagctatttgagggcaatccaagctggctgctctcaggaggaggatagcgtctcgctccagtctctttctccccctcccagcaccggctctttgtccaatagccgaaccttaccgagctcatcttgcctcgtggcctataaaaagaccccacctcctgtacctccaagaaccaccagtaaaccgttcattagtgttacagtgcagagttcaactgaatcagcccaggatacgtatctggactcacaagatcataagagtgaagtgactagccagtctggcctgagtaactcttcagactctctggactcttctactcggccaccctccgtaaccagagggggggtggctcctgcgcccgaggccccagagcctccccccaagcatgcggccctcaaatccgagcagggaacactaacaagttcagaaagtcaccccgaggccgcccctaagagaaagttatcctccatcggcattcaggagaggacccggagaaacggcagtcacctgagcgaagacaatggacctaaagccatcgatgtgatggctccttcatcagagagcagcgttccatctcactccatgagctcacgaagagatacggactcagatacccaggatgccaacgatagcagctgtaaaagcagtgagagaagtctccccgactgcacccctcaccccaattctatcagtattgatgctggcccccgacaagcccccaagatcgcgcagattaagagaaatttatcatatggagataattctgatcccgcactggaggcctcctctctgccgccacccgatccttggttggagacatcatcttcttctcccgccgaacctgcccaacctggggcctgtagaagggacggatattggttcctcaagctgctgcaagcggagacagaacgcctggagggttggtgttgccagatggacaaagaaactaaggagaacaacttgtcagaggaagtgctcgggaaggtcctgtctgcggttggcagcgcacagcttctgatgagccagaaatttcagcaatttcgaggcctctgcgagcagaacctcaaccctgacgccaaccctcgccccactgcgcaggatcttgccggattctgggacctgctccagttgagcatcgaagatatctcaatgaaatttgacgaactgtaccatctgaaagcaaattcgtggcagctggttgaaacccctgagaaaaggaaggaggagaagaaacctcctcctccggtgccaaagaagcccgctaaaagcaaacctgcagtgtccagagataaggctagcgacgcttccgacaagcaaagacaggaggcccggaaacgacttttagccgcaaaacgggcggcttctgtacgccagaactctgctacggagtccgcagattcaatcgagatttacgtgcctgaagcccaaacgagactgtag

SEQ ID NO: 46830 - DNA, 2979 bp, Artificial Sequence
  Description of Artificial Sequence: Synthetic coding sequence
atgaagggcctgggcgacagccggccccggcacctgagcgacagcttagatccccctcacgagccattgtttgcaggtaccgaccgaaacccgtacttactgagtccaaccgaagcttttgcccgcgaggctagatttcccggccagaacactttgcccggagacgggctcttcccccttaataatcagctgccccccccctcttccacctttccccggattcattataacagccacttcgaggtgccggaagagtcacctttcccttcacatgctcaagcaacaaaaatcaacagacttcctgcaaatctgttggaccagttcgagaaacagcttcctatccaccgagacggcttctcaacactacagtttccgaggggggaagcgaaagcccgaggggaatctccgggacgtatcagacatttggtccactccgtgcagcgcctgttttttactaaagccccaagcttagagggaacagccggaaaagtcggcggtaacgggtcaaaaaaggggggtatggaggacggcaagggccgccgagccaagagcaaggagagagccaaagcaggggagcctaaaagaaggagcaggtcaaatatctctggctggtggtcaagtgacgacaacttggacggtgaggccggggcctttaggtcgagcggcccagccagtggactcatgacactaggaaggcaggcagagaggagccagccacgctattttatgcacgcctacaacaccatttccgggcacatgctgaagaccacaaagaacaataccactgagcttacagccccccctcccccgcccgccccacctgccacatgtccatcactgggcgtcggaactgacactaactatgtgaaacgggggtcttggtctacacttacactgtcgcatgcccatgaggtttgccagaaaacaagcgccacattggacaagtcactcctgaaatccaagtcgtgccatcaaggacttgcctatcattatttacaggtgcccgggggcggtggcgagtggtctactacactgttgagtcctcgcgagaccgacgccgcagcagaagggcctattccctgtcgacgtatgagaagcggatcttacatcaaggccatgggcgacgaggactctgacgaaagcggcggttctccaaagccaagtccaaaaactgctgcccgccgccagtcctacctacgggctactcagcagtctctgggtgaacagtcaaatccacgtaggtccctagacagactcgactcagtagacatgttgcttccatcgaaatgcccctcatgggaggaagattatacacctgtttccgacagtctgaatgactccagctgcatctcacagatctttggtcaggcaagcttgattccacagctatttggacatgagcagcaggtccgcgaggctgagctcagtgaccagtatgaagccgcatgcgagtccgcttgctcggaggccgaaagcacagcggcagaaacacttgatttgcctctcccaagctattttcgcagcagatctcattcatacctgcgggccatccaagcgggatgcagccaggaggaggattctgtgtctctccagagcctgagccctccgccatccacagggtcgctgtctaactctaggactcttccgtcatcatcctgcttggtggcctacaagaagactccgccacctgtgccccccagaaccacaagcaagcctttcatctccgtaaccgtacagagcagcacggaaagtgcacaggatacttatctggactcacaggaccataagtctgaagtgacgtcccagtccggactgtcaaatagctctgacagtttagattcctcaacacgccctccgtctgtcactcgcggcggcgtggcccctgccccggaagcccccgagccccctcctaaacacgcagcactcaagtcagaacagggaacgctcacaagcagcgagagccatcctgaggccgctccgaagcggaagctctcaagcattgggattcaggtggattgtatccagcctgttccgaaggaggagccctcccctgcaacaaagtttcagtccatcggcgttcaagtcgaagatgattggcggagtagtgtgccatcccactcaatgtcatcgcgtcgagataccgattcggacacccaggatgctaacgactcgagttgcaaaagtagtgagcgtagcttgcccgattgtactccacatcccaattcaatttcgatcgacgcagggcccaggcaggcgccaaaaatcgcccagattaaacggaatctgtcttatggagacaatagcgatcctgccctggaggcatcaagccttccccctccagatccatggctcgaaactagttctagctcccctgcagagccagcccagcctggcgcttgccgccgggatggctattggttcctgaagctgctccaggctgagacagagagacttgaagggtggtgctgtcaaatggacaaggagacaaaggaaaataatctgtcagaggaggtgctgggaaaagtgttaagcgctgtcggatcagcccagttactcatgagtcagaagtttcagcagtttcggggcctgtgcgagcagaatctgaaccccgatgccaacccacgcccaaccgctcaggatctggccggcttttgggatcttttacaactcagcattgaagacatttccatgaagtttgacgaactatatcatttaaaagctaacagttggcagctggtggaaaccccagagaagcgaaaagaagagaagaaaccgcctccacctgttccaaaaaagcctgccaagtctaaaccagccgtaagccgagataaagcctcagatgcctcggataagcagcgccaggaggcccgaaaaaggcttctggccgcaaagcgcgccgcctctgtgcggcagaattctgccactgagtccgccgacagcatcgaaatatacgtgcccgaggcccagacgcgactgtag

SEQ ID NO: 46831 - DNA, 2979 bp, Artificial Sequence
  Description of Artificial Sequence: Synthetic coding sequence
atgaagggcctgggcgacagccggccccggcacctgagcgacagcttggaccccccccatgagcctctttttgctgggactgacaggaatccctacttactgtcacccacagaagcattcgccagggaagcccggttccccggccagaacactctgcccggcgatggactgttccccctgaataaccaactgcccccacctagcagcactttcccgaggatccattacaactcacacttcgaggtcccagaagagagtccctttccctcccatgcacaggctacaaagatcaacagactacccgcaaatcttctggaccagtttgagaaacagctgcccatccacagggatggcttcagtactttgcaatttccaaggggcgaggcaaaagccagaggcgagagcccaggtaggattcgacacctcgtgcatagtgttcagcgcttgttttttactaaagcgccttctctcgagggtaccgctggtaaggttggcggcaacggaagcaagaaagggggaatggaggatggcaaggggaggcgtgcgaagtccaaggagcgcgcaaaagctggcgaaccaaagcgccgaagcagatcaaatatatctggctggtggagcagcgatgacaacctcgacggtgaagcgggggccttccggagctcagggccagccagtgggcttatgaccttggggaggcaggcagagcgcagtcagcctaggtatttcatgcacgcctataacacaatcagcgggcacatgcttaagactacgaagaataacacaactgaactgaccgcacccccgccacctccagcccctccagcaacttgtccttcgttaggggtaggcacagacaccaactatgtgaagaggggaagctggtccacactgaccctgtcacacgcccacgaagtgtgccagaaaaccagcgcaacgctggacaagagccttctcaagagcaagtcttgccaccaaggcttggcctatcactatctgcaagtgcccggtggtggtggtgagtggtcaacgacactgctgagtccacgcgaaaccgacgctgccgccgaagggccaattccctgtagacgtatgaggtcgggctcgtatatcaaagctatgggggatgaggattcagatgagtcaggaggaagtcccaaaccttctcccaagacagctgcccggcgccagtcttatttgagagcaacccagcaaagtttaggagagcagtctaacccaaggagaagcctcgatcggctggattcggtggacatgcttctgccctcaaaatgcccgagttgggaggaggactacacacctgttagcgatagtcttaatgactcaagttgcatctcccagatcttcggccaggcatctctgataccacagctgttcggccacgaacagcaggtgagagaggccgaattgtctgaccagtatgaggcggcatgtgaaagcgcgtgtagcgaagcggagtctactgccgccgagaccctggacctgccattgccctcatacttccggagtcgatcgcattcttatctgcgggccatccaggcaggctgtagccaggaggaagatagtgtgagcctacagtccttgtcaccccctcccagcactggatctctttctaattcccggaccttgccaagcagttcttgcctggtggcctacaagaaaacacctccacccgttccaccccgtacgacttctaagccgttcatatcagtcaccgtacagtccagcaccgaatccgcacaagatacctatctcgattcacaggatcataagtccgaggtgacttcccagagcgggttatccaattcgagcgattccctcgattcttcgacgaggccacccagcgtaacacgtggtggagtagcacccgcgcctgaagctccagaaccaccacctaaacacgccgccttgaagagtgagcagggcactcttacttcttccgagtcccatcctgaggctgcaccaaagcgcaaactatcatccattggcatccaggtcgactgtattcaacctgtgccgaaggaggaaccctcaccagctaccaaattccagtccattggggtgcaggtggaggatgactggcgttctagcgtgccgtcccattcaatgtcttcgcgacgggatactgacagcgacacacaggatgccaacgactcctcttgcaaatcttcagagcgctctttgccagattgtaccccacatcctaactcaatctccattgacgccggtccccgccaggcccccaaaatcgcgcagattaagaggaatctgtcttacggggataattcggatccagctttggaggcatcctcccttccgcctccagatccatggctcgagaccagctcatcctctccagcagagcccgcccagccaggggcttgcagacgagatgggtactggttcctcaagctccttcaggctgaaactgaaagactggaagggtggtgctgtcagatggataaggagactaaggaaaacaacctgagcgaggaagttctcggcaaagttttgtctgctgtgggatccgcccagctccttatgtcccagaagtttcaacagtttaggggtctgtgtgagcaaaaccttaatccggacgcgaaccccagacccaccgctcaggacttggcagggttttgggacttactgcaactgagcatcgaagacatctcaatgaaatttgacgagctataccacttgaaggcaaattcttggcagctggtggaaacaccagagaagagaaaggaggagaagaaaccccccccccccgtaccgaaaaagcccgcaaagagtaagccagccgtctcccgtgacaaagccagtgacgccagtgacaagcagaggcaggaagcccgcaagcggcttttggccgcaaagagggcagcatcagtgagacagaactccgctaccgaaagtgctgattctattgagatctacgtccccgaagcacagacccgactctag

SEQ ID NO: 46832 - DNA, 1362 bp, Artificial Sequence
  Description of Artificial Sequence: Synthetic coding sequence
atggccctgtgcctggagctgctgaagcagtgcagcagctgcctggtcgcttataaaaagacacctccacccgtgccccctagaactacctccaagccgttcatatccgtaacggtgcaatcctcgaccgagtcagcccaggatacctatcttgactctcaggatcataaatccgaagtaaccagtcaatctggactgagtaactcatctgatagcttggatagttctaccaggcctccttcagtcacaaggggaggcgttgcccctgcccctgaggctcctgaacctccacctaaacatgcggctcttaagagcgaacaggggactctgaccagttctgagagccatccagaagctgcacccaagcggaagctttcctcgatcggcatacaggtcgactgcatccagcccgtacccaaagaggaaccaagtcccgccacaaagttccagtctatcggggtgcaggtcgaggatgattggcgctctagcgttccctctcattcaatgagctcaagaagggataccgactcagatacccaggacgcaaacgactcatcatgcaagtcttcagaacgctccctgcctgactgtacgccccacccaaatagcattagcatcgatgcgggacctaggcaggccccgaaaatcgcacaaataaagcggaatctgagctatggagataactccgaccccgccctggaggcgtctagcctgcctccacccgacccctggctggagacgtcttctagtagcccagcagagcccgcacaaccgggcgcttgtagacgggatggttattggttcctcaaactgctccaagcggaaaccgaacggcttgagggctggtgttgtcaaatggacaaggagaccaaggagaacaatctgagcgaagaagttctgggaaaggtgctcagtgccgtcgggtctgctcagctcttgatgagtcagaagtttcagcagttccgggggctgtgcgagcagaatctgaatccggacgccaatcctagaccaacggcccaggacttagccggattctgggacctgttacagctcagtattgaggacatttcaatgaagttcgatgagctttaccatctgaaggccaatagctggcagttggtcgaaactcccgagaagaggaaggaggaaaaaaagccgcctcccccggtacccaaaaagcccgccaaatctaagcccgcggtgagccgggacaaagcctccgatgcatccgataaacaaaggcaagaagcccggaagcgtctcctggccgcaaagagggccgcttctgttcgccagaactcagcgacagagtcagcagattccatcgagatatacgtgcccgaggcccagactcggctgtag

SEQ ID NO: 46833 - DNA, 2979 bp, Artificial Sequence
  Description of Artificial Sequence: Synthetic coding sequence
atgaagggcctgggcgacagccggccccggcacctgagcgacagcctcgaccctccgcacgagcctctttttgctggcactgaccgcaatccctacttgctgtctccaacagaggcatttgctagagaggcgaggttcccggggcagaacactctgccaggggacggattgtttcctctaaacaaccagctaccccccccctcctcaaccttcccaagaatccactacaactctcactttgaagtccccgaggagtctcctttcccgtctcatgcccaggccactaagatcaatcgactgccagccaatctccttgaccaattcgagaagcagctgccaatccaccgagatggtttcagcacactgcagttcccgagaggcgaagctaaagcccgaggggagagccccggccgtattcgacatctggtccactcagtccagcggctgtttttcaccaaagcacctagcttggagggtactgccggaaaagttggtgggaatggatcaaagaaaggaggaatggaggatggtaagggcaggagggctaaatcaaaggagcgggcaaaggcgggcgaacctaagagaagaagtagatcaaacatatctgggtggtggagctctgatgataacctcgatggggaagctggtgcctttcgaagttctggcccagcaagtgggctaatgacactcggtcggcaagcggaacgctcacagcccaggtactttatgcacgcatataacactatctcagggcacatgctcaagactactaagaataacacaaccgagctgactgcaccaccccctccacctgcacctcctgcaacatgcccttcattgggcgtcggcacagatactaattatgtgaagcgtggcagctggtccaccctaacactgtcccatgcgcacgaggtatgtcaaaaaacaagtgccaccctggacaagtccctgctaaagagcaagtcatgccaccaaggactggcctaccactatcttcaggtccccggcgggggaggagaatggtccaccacactgctgtccccccgggaaactgacgctgcagccgaaggaccaattccctgtcgaagaatgcggtctggctcctacatcaaggctatgggagacgaggattctgacgagagcggaggatccccgaagccttcacctaagaccgccgcacgtaggcagtcatacctgcgcgccacacagcagtcccttggggagcaatccaatccgcgtcgctccctggatagactggatagcgtggatatgttgctcccatcaaagtgtccttcttgggaggaagattacacccctgtctcagattcactgaacgattcatcttgtatttcccaaatattcggacaagcctctttaattcctcaactctttggccacgaacaacaggtccgcgaagctgagttgtcggatcagtatgaggcagcatgcgaaagcgcatgttcggaggccgaaagtacggcggccgaaaccctggatctcccgctaccctcatacttccgaagccgcagccattcttatctgcgagccattcaggcaggctgtagtcaggaggaagactcagtgtctcttcagtccttgtcaccccccccgagcaccgggagcctctctaactcccggacccttccaagctcttcctgcttggtggcctataaaaaaacgcccccaccggtccctccaaggacaacttccaagcctttcatcagtgtcacagtgcaatcatctaccgaaagtgcgcaagacacctacttggacagccaggatcataaatctgaggtcaccagtcagagcggcctcagcaactcaagtgactctcttgatagcagcaccagacccccctccgtgacgagggggggcgtcgctccggctcccgaagccccagaaccaccccccaaacatgctgcgttgaaatctgaacagggtacccttacatcaagcgaatctcaccccgaggcagcccctaaacggaagctcagttctatcgggatacaggtcgactgtatacagccagtcccaaaggaggagccgtcacccgccactaagtttcagagcattggtgtgcaggtcgaggacgattggcgctcttccgtcccctcccattcaatgtcatctcgcagagacacagactcagatacccaggatgctaacgacagtagctgtaaaagcagcgaacgctctcttcccgactgcacaccacatccaaactctatatctatcgacgccggacctcggcaagctccaaaaattgctcaaattaagcgaaatctgtcgtacggagataactcagatccagccttggaagcgagctcgctgccaccacctgatccctggctcgagacctcctcaagctccccagccgagcctgcgcagccaggtgcttgccggagagatggctattggttccttaagcttctgcaggccgagacagaacggttagagggctggtgttgtcaaatggacaaggagacaaaagaaaacaacctgtccgaagaagtgctgggcaaagtgctttccgcagtagggtccgctcagctgctgatgtcccagaaatttcagcagtttagagggctctgcgaacagaacctgaacccagatgctaaccccagacccaccgcccaggaccttgccggcttctgggacctactgcaactgagtattgaagacatctcaatgaaattcgatgagctgtaccacctcaaggccaacagttggcagctggtggaaactccagagaagagaaaggaggaaaagaagccccctccccccgtgcccaaaaagcctgccaagagcaaacccgcggttagccgggacaaagctagcgacgccagtgacaaacagcggcaagaggcccggaagaggctcctcgccgcaaagagagcagccagtgtgaggcagaacagcgccactgagtccgcggactctattgagatttatgtgcctgaggctcagacacgtctgtag

SEQ ID NO: 46834 - DNA, 2970 bp, Artificial Sequence
  Description of Artificial Sequence: Synthetic coding sequence
atgaagggcctgggcgacagccggccccggcacctgagcgacagcttggacccacctcatgaacctctcttcgccggaacggatcgaaacccttatctcttgtctccgactgaagcttttgcccgggaggcccgctttccaggccagaataccctgcctggagatgggctgttcccgcttaataatcagctgcccccgccgtccagcactttccccagaatccactacaattcccatttcgaggtgcccgaagaaagccctttcccgagtcacgctcaggctaccaagataaaccgtctgcctgccaacctccttgaccagtttgagaagcaattgcctatacatcgcgacggtttcagcaccctgcagttcccacgcggagaagctaaagcaagaggagagtcacccggaagaatcaggcacctagttcactctgtgcagagacttttctttacgaaagcacccagtttggagggaaccgctgggaaagtcggcggtaatggaagcaagaagggcggcatggaagatgggaaaggcaggcgcgctaaaagcaaagaaagggccaaagcgggcgagcccaagaggaggtctcgaagcaacatctccggctggtggtcctctgacgacaatctggacggcgaggcaggcgccttccgatccagtgggccagcatccgggttgatgacactcgggcgacaggctgagaggtcccagccacggtacttcatgcacgcctataatactatctccggtcatatgctgaagacgacgaaaaataatactacagaactgactgctccccccccaccgccggcaccgcctgctacgtgcccctcccttggggtgggcaccgatactaattacgtgaagagaggatcttggtctactttaacactgtcccacgctcacgaagtctgccaaaaaacctccgccaccctcgacaagagcctgcttaaaagcaaatcctgtcaccaggggttggcataccactatttgcaggtgcctggaggcggaggtgagtggtctaccactcttctatccccgcgggagaccgacgccgccgccgagggcccaattccatgcaggagaatgcgctcaggctcctatataaaagccatgggtgacgaggattcggatgagtctggaggctcgcccaaaccaagccctaaaacggcagctaggcgtcagagctacctgagagcaacccagcagtcactgggagagcagtctaacccacgccggagtctggaccggctggactccgtggatatgctcctgccgtcaaaatgcccgtcctgggaggaagactacacccctgtcagtgactcgctgaatgattctagttgcatcagccagatcttcggacaggcctctttgatacctcagctgttcggacatgagcaacaggttcgtgaagctgagctcagcgatcagtacgaagccgcttgcgagtctgcctgttctgaagctgagtcgaccgcggccgagaccctggatttaccactgccatcatattttcggtcccggtcccattcttatctgcgtgctattcaggctggctgtagtcaagaggaggactctgtctcacttcagtccctgagtcccccgccctcaactggcagtctgagtaatagcaggactttgcccagttcctcatgcctggtagcatataagaagacaccaccacctgtgccaccacgaactaccagtaaacccttcatctctgtcaccgtgcaaagtagtactgagtcagctcaagatacctatctggatagtcaagatcacaaatccgaggttaccagccagagcgggctttccaatagcagcgattccctcgacagctctacacgcccaccctcggtgacccgcggcggggtagcacctgctcctgaagctcccgaaccccctcccaagcacgccgctctcaagtcagagcagggcacgttaacaagctccgaatcccaccccgaggccgctcccaagaggaagttgtcgtcaatcggaatccaggagaggactcggaggaatggtagtcacctgagtgaggacaatggccctaaagcaattgacgtcatggccccctcatccgagagcagcgtgccatcacacagtatgtcctccagacgggatacagatagtgacacccaggacgctaacgattcaagctgcaaatcgtccgagaggtccctccctgactgtacacctcaccctaactcaatcagtatcgacgcgggccccaggcaggctccaaaaattgcccaaatcaagaggaacctgagttacggggataatagtgaccctgccctggaagcctcatcactcccgcccccagacccctggctggagacatcaagttcatcgcccgccgagcccgctcaaccaggcgcatgcagacgcgacggctattggttccttaaacttctgcaagctgagactgagcgcctggaaggatggtgctgccagatggacaaggaaaccaaggagaataatctgtctgaagaagtgcttgggaaagtgctatcagcggtgggatccgcgcagctactcatgtcccagaagtttcaacagttccgcgggttgtgtgagcagaatttaaatccggatgctaacccccgtcccactgctcaagacctggcagggttctgggacctcctgcagctgtcaatcgaagatatcagcatgaagttcgacgagctataccacttgaaagccaacagttggcaattagtcgaaacgcctgagaagcgtaaagaagagaagaagccgcccccacccgtgccaaagaagcctgccaagagtaaacctgccgtgtcacgtgacaaggcctccgacgcctctgataagcagcgacaggaggcaaggaagcgcctcctcgcggcaaaacgagcagctagcgtccgtcaaaactcagccaccgaatccgccgatagcattgagatttacgtgccagaggcacagacaagactgtag

SEQ ID NO: 46835 - DNA, 2970 bp, Artificial Sequence
  Description of Artificial Sequence: Synthetic coding sequence
atgaagggcctgggcgacagccggccccggcacctgagcgacagcctggacccaccccacgagcctctgttcgcaggcacagatcggaatccctatttgttatctcccactgaagcctttgccagagaagctaggtttccaggccagaacacacttcccggggatgggctgttccctctcaacaatcagcttccacctccctctagtacattcccgagaatacattacaatagccattttgaagtgccagaggagtctccttttccatcgcacgcccaggctacgaagatcaaccgcttacctgcaaatctcctggaccaattcgaaaagcagctacccatccatcgcgatggcttcagcaccctccagttcccccgaggggaggccaaggcacgaggagaatcccctggacgcatacgacacctggttcactcagtgcagcgcctctttttcacaaaggcaccctcccttgaaggaactgctggaaaggtgggcggcaacgggagcaagaagggcgggatggaggacgggaagggtcgccgggccaagtctaaggagcgtgccaaagccggcgaaccaaagcgaagatctcgttccaatatcagtgggtggtggagtagcgatgataatctcgacggcgaagctggggcctttcgcagcagcggcccagcctcgggcttaatgacgttggggcgacaggctgagcgaagccaaccaaggtactttatgcatgcatataatacaatctccggacatatgctgaagaccacaaaaaacaatactaccgagcttacagctccacctccgccgcccgccccccccgcaacgtgcccttcgcttggagtcgggacagacaccaattatgtaaagagaggaagttggtccaccctaaccctgtctcacgcccacgaagtttgccagaagacatcagcaaccctggacaagtcccttcttaagagcaaatcatgtcaccaggggcttgcctaccactatctacaagttcctggtggaggcggtgagtggagcacaacattgttgagccctagggagaccgacgccgccgcagagggccctataccctgtaggcgtatgcgttccgggtcttatattaaggcgatgggagatgaagattctgacgagtctgggggatcccctaagcccagccccaagaccgcggcgaggcgtcagagctacttgagagcgactcagcaaagtctcggagaacagagcaatccgcgacgcagcctggatagattagactccgttgatatgctgctgcccagtaaatgtcccagttgggaagaggattacacgcccgtcagcgacagtctgaacgatagctcctgtatctcccagattttcggccaggccagcctcatcccccagctttttggccacgagcagcaggtgcgcgaagctgaattatccgaccagtatgaagcagcgtgtgagtctgcatgctctgaagccgagtccactgccgcagagacactcgacctacctctgccctcctactttcggtccagaagccacagctatctgagggccatacaggctggatgcagccaggaggaagacagcgtgtccctgcagagcctgtccccaccgccctctacaggctccctttctaactcccggaccctccccagctcctcttgcctcgtagcctacaaaaagactccgccgccagtcccacccaggacgaccagtaagcctttcataagcgtaacagttcaatcatctaccgagtccgcccaggacacatatctggattcacaggatcacaaaagcgaagtcacaagccagtcgggtctgtccaattcctctgacagcctggattcttccacccggcccccgtcagtaacacgcggcggagtcgctcccgctccagaggctccagagcctccaccaaagcatgctgctctcaagagtgagcagggcaccctgacttccagcgaatcacatcccgaagcggccccaaaaagaaagctgtcttccattggtattcaggaaaggacaaggcgcaacgggtcacacctcagcgaggacaatggcccaaaggccattgacgtgatggcgccatcgtccgagtcatctgtgccctcacatagtatgtctagtcggagggataccgacagcgacacccaggacgccaatgatagtagttgtaagtcctctgagcgtagtctgcctgactgtacaccccaccccaatagtatttccatcgacgccgggcctcgacaggcccctaagattgcacaaataaagcggaatttgtcttacggtgataattcagatccagccctggaagcttcgtctttaccaccaccagatccctggctcgagactagtagctcaagcccagccgaacccgctcaaccaggcgcgtgcaggagagatggatactggtttcttaagctcctgcaagccgagacggagagactggaaggttggtgttgtcagatggacaaagagaccaaagaaaacaacctcagtgaggaggttcttggcaaagtcttgagcgcggtcggctccgcgcagttactgatgtcccagaaattccagcagttcagaggcctttgtgagcagaatctgaatcccgacgccaacccccggcccaccgcccaagacctcgccggtttttgggatctgcttcagctgagcatagaagacatttcaatgaagttcgacgagctttatcatctcaaagctaattcttggcaattagttgaaacccccgaaaagagaaaggaggaaaaaaagcctcccccgcctgtccccaaaaagcctgcgaagagcaaaccagctgtcagccgggacaaggccagtgatgccagcgataagcaaaggcaggaggccaggaaacgtctcctggctgcaaaacgcgctgcctctgtcaggcagaactcggctaccgagtccgcagacagtattgagatctatgtgcccgaggcgcagactcgcctgtag

SEQ ID NO: 46836 - DNA, 576 bp, Artificial Sequence
  Description of Artificial Sequence: Synthetic coding sequence
atgcccggcagcgaggacctgcggaagggcaaggaccagatgcacagccatcgcaagagaaccatgtttactaagaaacaactggaagacctgaatatcttgttcaacgaaaatccttaccctaatccttctctccagaaagagatggcctcgaagattgacatccatcctaccgttctacaggtatggttcaagaatcatcgggccaagctgaagaaagccaagtgcaagcatattcaccagaaacaagagaccccgcagccccctatccctgagggtggcgtatcaacctccgttggcttacggaacgccgatactctgcctaggttgcccaacgctgcccaccctatcggtctggtttacacaggacatcgcgttccttccttccaattgattctttatccaaatcttaaggtccctgcaaacgatttcattggccacaggatcgtccacttcggatgttgcagagacccaaacatttattgcctctatccaatcctggaatcccaggtatgtgcccctagtttccactcagggtctccagcttgcagttcaaaccagtcgagggagcgctag

SEQ ID NO: 46837 - DNA, 2052 bp, Artificial Sequence
  Description of Artificial Sequence: Synthetic coding sequence
atgctggcctgcctgacccggggcaacctgctggacgtgctgcaggaggggttcaatgagcagcagctgcaggcctacgtggcatgggtcaacgctcagcttaaaaagcggccagccgtcaagcccgtgcaagacctgcggcaggatctgcgggacggggtaattctcgcttacctcattgaaatcgtagccggagagaaactgtcgggtgtccaactttctcccgggaatcagcaagaaatgaaaaataacgtggaaaaggtgttgcagtttgttgcatctaaaaagatccgtatgcatcagaccagtgctaaagacattgtcgatggaaaccttaaaagcattatgaggctggtactagccctggccgcccatttcaaacccggaagttctcgcaccgttaatcagggaagggactcgcgagcgcccctgcaatcacatcgccctcattgtgcaactgccgtcgcccaaggcgctgcagctgccctcgcagacgtttgccacgatatgtcaagaagcggccgagatgtttttagatatcggcagagaaattcatcaatggacgaggagattgagaatccctactggtcagttagagcattggtgcagcagtatgaaggccagcagaggtccccatcagaaagctcctgtagctcacttaccagcccgtccccaatccattcggcaaagagtgagtctatcatcacccagtcggaggagaaggctgatttcgtgatcataccagccgaggggattgagaatcggactgaaggcacagacagtcctctctccagagactggcggccgggcagccccgggacctacctcgagacgtcctgggaggagcagctgcttgaacagcaagaatatctcgaaaaggagatggaggaggctaagaagatgattagtggcttgcaagctctgctgcttaacggctcactacccgaggatgagcaggaacggcctcttgccctgtgcgaacctggtgtgaatcccgaagagcaactgataattatccagtctaggctcgatcagagcatggaagaaaatcaggacctgaagaaagagctgctaaagtgtaaacaggaggccaggaatctgcagggaattaaagatgccctccaacaacggcttacacagcaggacaccagtgtgcttcagctgaaacaggagctcctgcgcgcgaacatggataaagacgagctgcataaccagaacgtggatctgcagaggaaattagacgagcggaacagactactgggcgaatataaaaaagaattgggtcaaaaggacagattgctgcagcaacatcaggccaagctggaagaggctcttcgcaaactgtcagatgtcagttaccatcaggttgacctggagagagagctggaacacaaagacgttctgctggctcattgcatgaaacgtgaagcagatgaggccaccaattataattctcacaactctcagagtaatggttttttgctccccacagccggcaaaggcgctacatcagtatccaaccggggcacctccgatcttcagctggtccgtgacgccctgagatctttgagaaactcgttctcgggtcatgacccacaacaccacacgattgatagcctggaacagggaatatcctcccttatggagcggcttcacgtcatggagactcagaagaagcaggagcggaaggtgcgagtgaagagcccaagaacacaggtgggatcagagtaccgcgagtcctggccacctaatagtaaactccctcactctcagagcagccctacagtgtccagcacctgtacaaaggtgctgtactttaccgatcgctctcttacccccttcatggtgaatattccaaaaagactggaagaagttaccctaaaagacttcaaagctgccattgacagagagggcaaccaccgttaccatttcaaagccctagatccagaattcgggacagtaaaggaggaaatctttcatgacgatgacgccattcccggctgggaaggaaaaatcgtggcttgggtggaggaagatcatggggagaattag

SEQ ID NO: 46838 - DNA, 384 bp, Artificial Sequence
  Description of Artificial Sequence: Synthetic coding sequence
atggccgccccccccaaggcccccatccgggtgcggaacctgaccatacgggctggagccctgactggtaaggaaaataacatgttgcagcccgagacacatatctttacagcccccgaggaggttcctaaagtgtccgaccaggcactggtgagcgcccatagcgaatggcagcggaaactggaagctgccgaagcgttgctgacactgcggaattccgctcaggctccccccgactccatctccctgcatcagccctgcaatcccccggcccccgccggtgataagggcttccagccaccgagtccctccctgcgacctaggcccgccagcagcatcagtctgcccatcggccacctgggctgcattagtctactgagctag

SEQ ID NO: 46839 - DNA, 579 bp, Artificial Sequence
  Description of Artificial Sequence: Synthetic coding sequence
atggccgccccccccaaggcccccatccgggtgcggaacctgaccattcgggccggtgcactgactggtaaggaaaataacatgttgcaaccggaaacccacatcttcacggcacctgaggagggctcgagccaaggcgcactgttactcggacaggcgcccgagccacttagcctgccatgcacgcctgttacgctggaacagcagcttgtgtcaccgtccggggacccccatagggctccagctcttccttcaatttgtagtaccctgatactgcagccgtgcgccaccctggaccccttgctgctccagccgcaagtgcccaaggtgtctgaccaggctctggtgagcgcccatagtgaatggcagagaaaattggaagctgcagaggcgctactcaccctacggaattccgcacaggctccccctgacagcatttcacttcatcaaccttgtaaccctccagctcccgccggagataaaggcttccagccaccttcgccctctctgcgacctcggcccgcatcctctatctccctccccattggacacctcggctgcatctcactgctcagttag

SEQ ID NO: 46840 - DNA, 384 bp, Artificial Sequence
  Description of Artificial Sequence: Synthetic coding sequence
atggccgccccccccaaggcccccatccgggtgcggaacctgaccattcgcgccggagcacttaccggcaaagagaataatatgctccaacccgagacgcatatcttcaccgcccctgaagaagtgcccaaagtgagcgatcaggccctagtgagtgcacattccgagtggcaaaggaaactggaggccgcagaagccctgctgaccttgcggaattccgctcaggctccccctgattccatatctctgcaccagccttgcaatccacccgctcccgccggtgataagggctttcagcctccgtctcctagcctcagaccccggcccgcttcctctataagcctgcctatcgggcatctgggctgtatctcactgctctcctag

SEQ ID NO: 46841 - DNA, 579 bp, Artificial Sequence
  Description of Artificial Sequence: Synthetic coding sequence
atggccgccccccccaaggcccccatccgggtgcggaacctgaccattcgcgccggagcactgacggggaaagagaataatatgttacagcccgagactcacatttttacagcccctgaagagggctccagccagggagccctcctcctggggcaagccccagagccactctctttgccgtgcactccagtcaccctggaacagcaacttgtttcacctagtggggatccacatcgggcacctgcactcccctccatctgtagtaccctgattcttcagccttgcgcaacgcttgacccccttctgctccagccccaggtgcctaaagtgtctgatcaggctttagtgtcggcccacagtgagtggcagcgcaagctcgaggcggcggaggccttgctgactctcaggaactccgcccaggcccccccagactccatttctctccatcagccttgcaatccccctgcgccagcgggtgataagggctttcaaccaccatcgccttcactgagaccgcggcctgcatcgtcgataagccttccgatcggacacctcgggtgcatcagcctcctgagctag

SEQ ID NO: 46842 - DNA, 579 bp, Artificial Sequence
  Description of Artificial Sequence: Synthetic coding sequence
atggccgccccccccaaggcccccatccgggtgcggaacctgaccatccgggctggcgcccttaccggtaaggaaaataacatgttgcagcctgagacccacatctttaccgcacccgaggaagggtcttcccaaggggctctgctgctagggcaggctcccgagcccctgagtttgccgtgcaccccagtgaccttggagcaacagctggttagccctagcggagaccctcaccgagcacccgccctgccctcaatttgctcgactctgattctgcagccatgcgccactctggatcctctgctgctgcagccgcaggtgcccaaggtgtccgatcaagctctagtgagcgcgcactcagaatggcagcgaaagctcgaagcagctgaggctctgcttactctccgcaattcagctcaggccccgcccgattctatctccttacaccagccatgcaatcccccggcccccgccggagataagggatttcaacctccttcgccatcgcttcgaccccgccccgctagctccatttcgctgcctataggccaccttggctgcattagtctcttgtcatag

SEQ ID NO: 46843 - DNA, 384 bp, Artificial Sequence
  Description of Artificial Sequence: Synthetic coding sequence
atggccgccccccccaaggcccccatccgggtgcggaacctgaccatacgtgccggagctcttactggcaaggagaacaatatgctccagccagagacacatatatttacagcccccgaagaagtccctaaagtctccgatcaagcactcgtctccgcccacagcgagtggcagagaaagctcgaggctgccgaggcacttctgaccctgaggaactctgcccaagcacctcctgactctatctctcttcatcaaccgtgtaatccaccagccccagccggcgataagggcttccagccacccagcccttctcttcggcctcggccagccagctccatttctcttcccatcggacacctaggttgtataagtctgttgagctag

SEQ ID NO: 46844 - DNA, 195 bp, Artificial Sequence
  Description of Artificial Sequence: Synthetic coding sequence
atggccgccccccccaaggcccccatccgggtgcggaacctgaccatacgtgcaggagctctcaccgggaaggaaaataatatgctgcagccagagacccacatattcaccgctcctgaagaaggatcctcccaaggcgccttactgctcgggcaggccccagagcccctgagccttccatgcaccccagtgtag

SEQ ID NO: 46845 - DNA, 306 bp, Artificial Sequence
  Description of Artificial Sequence: Synthetic coding sequence
atggccgccccccccaaggcccccatccgggtgcggaacctgaccattagggctggagcactcaccggaaaggaaaacaatatgcttcagccggagacccacatcttcaccgcacccgaggaggggtcgagtcagggggccttgctcctaggccaggcccctgagccgctgtcactgccgtgcactcctgtaacattagaacagcagctggtctccccaagtggggatccccatagagcccccgcccttccctccatctgctcgacccttattcttcagccttgcgcgacactggacccactctag

SEQ ID NO: 46846 - DNA, 579 bp, Artificial Sequence
  Description of Artificial Sequence: Synthetic coding sequence
atggccgccccccccaaggcccccatccgggtgcggaacctgaccatacgggccggagccctaaccggcaaagaaaacaatatgcttcagcccgaaacccacatatttacggctccagaggaaggatcatcccagggcgctctactcctcggacaggcacccgagcccctgagtctcccttgtactcccgtgactctcgaacagcagctcgtttctccttccggagaccctcacagggcccctgcccttccatccatttgttctacgcttattttacaaccatgtgctactcttgacccactgctgctgcagccacaagttcctaaggttagtgaccaggcactggttagtgcccactccgaatggcagcgcaaactggaagccgcagaggctctgctgactctcaggaattctgcacaagcacctcctgatagtataagcctccaccagccatgcaatcctccagcacctgctggtgacaaggggttccagccccccagtccctccctgagacctaggccagccagttctatcagtctccccattggccatctcggctgtattagtctgctgtcctag

SEQ ID NO: 46847 - DNA, 1191 bp, Artificial Sequence
  Description of Artificial Sequence: Synthetic coding sequence
atgctgatcaccgtgtactgcgtgcggcgggacctgagcgaggtgacattttccctgcaagtgtctcctgacttcgaactgaggaatttcaaggttttgtgcgaagcagagtcacgcgtcccagtagaagagattcaaatcattcatatggaacgcctgctgattgaggaccactgtagcctcgggagctacggactgaaggacggcgatatcgtagtcctcctgcaaaaggacaacgtgggtcctagagccccaggccgtgcaccgaaccagccccgggtcgacttctctggcatcgctgtacccggcacgtctagtagtaggccccaacaccccgggcagcagcaacagcgcacaccagctgctcaacgttcacaaggtctggcttctggcgagaaggtggcaggactccagggcctggggagccctgccttgatacgatcgatgctgctatctaatccccacgacctgagtctgttaaaggaacggaaccccccgcttgccgaagcgttgctctcaggtagcctggagaccttcagtcaggttctgatggaacagcaaagggagaaagcacttcgcgagcaggaacgcctgcggttgtacaccgcagacccacttgaccgagaagcccaggcaaagatcgaagaggagatcaggcagcaaaacattgaagaaaatatgaatattgccatcgaggaagcccccgaaagcttcggccaagtcaccatgttgtatatcaactgcaaggttaacggacaccccctcaaggccttcgtggacagtggcgcccaaatgaccatcatgtcccaggcttgtgccgagaggtgcaatatcatgagacttgtggaccgaagatgggccggcgtagctaaaggcgtgggcacccagcgcatcattggtcgggtgcatctggcacagatccagattgagggcgatttcctccagtgttctttctctatacttgaagaccagccaatggatatgctactgggcttggatatgcttagacggcatcagtgctccatagatctgaagaaaaatgtcttggtgatcgggaccacaggcactcagacatattttttgcccgagggagaactccccctgtgttccagaatggtgtccgggcaggatgagagttctgataaggaaattactcatagcgtgatggacagcggcagaaaagaacattag

SEQ ID NO: 46848 - DNA, 1200 bp, Artificial Sequence
  Description of Artificial Sequence: Synthetic coding sequence
atgctgctgaccgtgtactgcgtgcggcgggacctgagcgaggtgaccttttcgttgcaggtcgatgccgacttcgagctccacaactttagagccttgtgcgaactggagtcaggcatcccagcggcagaatctcagattgtatatgccgaaagaccactgacggataaccaccggtcactggcttcctacggcctcaaggacggtgacgtagtgattcttcgccaaaaggaaaacgctgacccaagaccacccgtgcaattccctaatctaccccgcatagatttctcatccatcgcggtaccagggacaagttccccacggcagagacaacctccaggtactcaacaaagccactctagccctggcgaaattacgagcagtccacaggggttagacaatcccgccttgttgagggacatgctgctcgccaatccgcatgaactgagcctgctcaaggagcggaacccacctttggctgaagctcttttgtccggagacctggaaaaattctcacgggtgcttgtggagcagcagcaggacagagctcgccgggaacaggaaagaattcgcctgttttctgccgatccttttgatctggaagcccaggcaaagattgaggaagatatacggcagcagaacatagaggaaaatatgacaattgccatggaggaggcccctgagagtttcggccaagttgtgatgctgtacattaattgtaaggttaacgggcacccggtaaaagcatttgtggacagtggggcccaaatgaccatcatgtcccaggcctgtgctgagcgctgtaacattatgagactcgtagatagaaggtgggccgggattgctaagggggtcgggacacaaaagattattggcagagtgcacctggctcaagttcagatagagggggactttctcccatgttcattttctattctggaagagcaaccaatggacatgctgctcggtttggatatgttgaagagacatcagtgttcaatcgatctgaagaagaacgtgctggtcataggtaccacagggtctcagaccacattcctgccagaaggagaactgcctgagtgtgccagacttgcctacggcgccggaagagaggacgtaaggcctgaggagatcgccgatcaggagctcgctgaggctctgcagaaatctgcagaagacgccgagcgccagaagccatag

SEQ ID NO: 46849 - DNA, 1167 bp, Artificial Sequence
  Description of Artificial Sequence: Synthetic coding sequence
atgaacaccatgtacgtgatgatggcccagatcctgcggagccacctgatcaaggccaccgttattcccaatcgggtaaagatgctcccctatttcggaatcataaggaaccggatgatgagcactcacaagtccaaaaagaagattcgggagtattacaggcttcttaatgttgaggagggatgttccgcagatgaagttcgcgagagctttcataaactagcgaaacagtatcatcctgatagtggttcaaacacagccgacagcgctacttttattagaatcgaaaaggcgtaccggaaagtactgagtcatgtgatcgagcaaacaaatgcctcacagtctaagggtgaagaagaagaagacgtggaaaaatttaagtataagactccacaacatagacactatttatctttcgaaggcatcgggtttggcactcctactcagagagaaaagcattatcgacagtttagagcagaccgagcagccgaacaggtcatggaataccaaaagcagaagctccagtcccagtactttcctgattcagtgattgtgaagaatatccggcaatcaaaacagcagaaaatcactcaggctattgaaaggctggtggaggatttgattcaggaatctatggcaaaaggcgactttgacaatctgtctggtaaggggaaaccactcaaaaaatttagcgactgctcttacatcgaccccatgactcacaatcttaatcggatcctcatcgataatggatatcagccggaatggatacttaagcagaaagaaatttctgacaccatcgagcagctcagagaagcaattcttgtctctcgtaagaagctggggaatccaatgacccctactgagaagaagcagtggaaccacgtgtgcgagcagttccaggagaatattagaaaactgaacaagcggattaatgattttaatctgatcgttcccatactgacgcggcagaaagtacactttgatgcccagaaggagatcgtgagagcccagaagatatacgagaccctgattaagacaaaggaggtgaccgataggaatcctaacaacctagaccaaggggagggggagaagacgcccgagattaagaaggggtttctgaattggatgaacttgtggaaatttattaaaataagaagcttttag

SEQ ID NO: 46850 - DNA, 1167 bp, Artificial Sequence
  Description of Artificial Sequence: Synthetic coding sequence
atgaacaccatgtacgtgatgatggcccagatcctgcggagccacctgatcaaggctaccgtaataccgaaccgtgtcaagatgctgccttacttcgggatcatccgaaacagaatgatgtcaactcataagtcaaaaaagaagatccgcgagtattacagactgctgaatgtcgaggagggctgctccgccgatgaggtgcgtgagagctttcacaagcttgctaagcagtaccaccccgattccggtagtaataccgcggactctgccacattcattcgtatcgagaaggcttaccgcaaagttctttcccatgtcattgagcagaccaatgcatctcagtctaaaggcgaagaagaagaggacgtggagaagtttaaatataaaacccctcagcacagacactatctgtcgttcgagggaataggatttggcactcccacccagagggaaaagcactaccgacagtttcgcgcagatcgggccgccgagcaggtgatggaataccaaaagcagaagctgcaatcgcaatactttcccgacagcgtgattgtcaaaaacatccggcaaagcaaacaacagaagatcactcaggccatcgaacgcttggtcgaagacctgattcaggaatccatggctaagggagactttgacaatctcagcggtaagggcaagccattgaaaaaattctcagattgttcctatatcgaccctatgactcataaccttaacaggatcctgatagacaacggctaccaaccagagtggattctcaagcaaaaagaaatcagcgacacaatcgaacaactccgtgaagctattctcgtgagtcgcaagaagctgggtaatcccatgactccaaccgagaaaaagcagtggaaccacgtgtgcgaacaattccaggaaaacatccggaagctaaataaaaggattaatgacttcaatttaatagtgcctatcctgacaaggcagaaagtccactttgacgcgcagaaggagattgtacgggcccagaaaatctacgagaccctcatcaaaacaaaggaagtgactgaccggaaccctaataatctggaccagggcgagggcgagaaaacccccgagattaagaagggatttttgaactggatgaacctgtggaagttcatcaagatcagatcattctag

SEQ ID NO: 46851 - DNA, 1194 bp, Artificial Sequence
  Description of Artificial Sequence: Synthetic coding sequence
atggtgaaggagaccacctactacgacgtgctgggcgtgaagcccaacgcaacccaggaggaactgaaaaaggcctacagaaagttggcgttgaaataccaccccgataaaaaccccaatgagggcgagaaatttaagcagattagccaggcctatgaagtcttgagtgatgccaaaaagagggaattatacgacaaaggcggcgaacaggctattaaggaaggtggtgcaggaggcgggttcgggtcaccgatggatatttttgatatgttcttcggcggaggcggcagaatgcagagggaaaggcgaggtaagaatgtggttcatcagctctccgtcaccctcgaggatctgtacaacggggctactaggaagttggctttgcaaaagaatgtcatctgcgacaagtgcgaaggccgcgggggaaagaaaggcgccgtggagtgttgcccgaattgtaggggtacaggcatgcaaatccgtattcatcaaattggccccggaatggtccaacagatccagtcagtttgcatggagtgtcaggggcacggggagcggattagtcccaaggatcgatgcaaatcttgcaacggccgcaaaatcgtcagggagaagaagatccttgaggtccatatcgataaagggatgaaggatggccagaaaattacttttcacggcgaaggagaccaggagccaggtctggaaccaggcgatattattatcgtattagatcagaaagaccacgccgtgtttacacgccgcggagaagatttgttcatgtgcatggatatccaactagtcgaagcattgtgtggatttcagaagcccatatccacactggataaccgtactatagttattactagtcatcccgggcaaatcgtgaaacatggagacatcaagtgcgtactgaatgaggggatgcctatttatcgccgaccttacgagaagggccggttaattatcgaatttaaagtgaacttcccggagaatgggttcctatcgccagacaagctgtccctgctcgaaaagttgctaccggaaagaaaggaggttgaagaaaccgacgagatggatcaggtcgagctagtggattttgatcccaaccaggaaaggaggaggcattataacggcgaggcctatgaagatgatgaacatcaccccaggggaggagtccagtgccaaaccagctag

SEQ ID NO: 46852 - DNA, 774 bp, Artificial Sequence
  Description of Artificial Sequence: Synthetic coding sequence
atgcagatccggatccaccagatcggccccggcatggtgcagcagatacaatccgtgtgcatggagtgtcagggccatggggagcgcattagcccaaaagaccggtgcaagagttgcaacggaaggaagatcgtgcgggaaaaaaagatccttgaggtacacattgacaagggcatgaaggatggccagaaaatcacgtttcacggcgagggtgaccaggagcctggattggagccaggagatattattatcgtgttggaccagaaggatcatgccgtgttcaccagacggggagaagacctgtttatgtgtatggatattcagcttgtcgaagccctgtgtggcttccaaaagccgataagtacattagacaatcgtacaattgtgatcacatcccatcccggtcagattgtcaaacatggagatattaagtgcgtgcttaatgagggcatgcccatctatcgccggccctatgagaagggacgcttgatcattgagtttaaagtgaactttcctgagaacggttttctcagccccgataagttatctttgctggaaaaactcttacccgagcgaaaagaggttgaggaaacagacgaaatggatcaggttgaattagtggatttcgatcccaatcaggaacggagaaggcattataacggagaggcttatgaggacgacgagcaccatccccgcgggggcgtgcagtgtcagacatcaaatggacctgttaacaatacccactgctggcatcttatgtgttcttccgaatag

SEQ ID NO: 46853 - DNA, 723 bp, Artificial Sequence
  Description of Artificial Sequence: Synthetic coding sequence
atgcagatccggatccaccagatcggccccggcatggtgcagcagatccagtccgtttgcatggaatgtcagggccatggagaaagaatcagtccaaaagatagatgcaagtcttgcaatgggcgcaagatcgtgcgcgagaaaaaaattttagaagtgcacattgataagggaatgaaggacggccaaaagataacatttcatggcgagggcgaccaggaacccggacttgagcctggcgacatcatcatcgtgctggatcagaaggatcatgcagtcttcacccgcaggggagaggacttgtttatgtgtatggatattcagttggtggaagctctctgtgggtttcagaaacctatttccacattggataatcgcactatcgtgatcacgtcacaccctggacagatcgtgaagcacggcgacataaagtgtgtgctgaacgagggcatgcccatctatagacgtccttacgaaaaggggcggctaatcatcgaatttaaggtgaatttcccagagaacggtttcctctcccccgacaagctcagccttttggagaagctgctgcccgagcggaaagaggttgaggagactgacgaaatggaccaagttgagttagtggatttcgacccaaatcaggaaagaaggcggcattacaacggggaggcctacgaggacgatgagcaccatccccgcggaggtgtgcagtgtcagaccagctag

SEQ ID NO: 46854 - DNA, 1194 bp, Artificial Sequence
  Description of Artificial Sequence: Synthetic coding sequence
atggtgaaggagacccagtactacgacatcctgggcgtgaagccctcagcttcccccgaggaaatcaagaaggcctaccgaaagctggcccttaaataccaccccgacaaaaatcccgacgaaggcgaaaaattcaaactgatttcacaagcctatgaagtactgtctgatcctaagaagcgagacgtttatgatcagggcggtgaacaggctattaaggagggcggctccggaagtccatctttttcttcacctatggatatcttcgacatgttcttcggcggtggaggcagaatggcgcgcgagaggcgaggtaagaacgtggttcaccagctgagcgtaaccctcgaggatctctataatggcgtcaccaagaaacttgcacttcagaagaacgttatttgtgagaagtgtgagggagtgggtggtaagaagggtagtgtcgaaaaatgccctctctgcaaaggaaggggcatgcaaatccatatccagcagattggtcccgggatggtccaacagatccagacggtctgtattgagtgtaaggggcagggggagcggataaacccaaaagatcgctgtgagagctgctctggggccaaggtcattcgggaaaaaaagattatcgaggtccacgtggagaagggcatgaaagacggccagaaaatcttgtttcatggggaaggggaccaggaaccagagctggagcctggtgacgtgattatcgtcttggaccagaaagaccattccgttttccagcgtcgcggacacgacttgattatgaaaatgaagattcagctctccgaagctctttgcgggttcaagaagacgatcaagacactcgataacagaattttggtgattacctctaaggctggcgaggtgataaaacacggagatctccgctgtgtgcgggatgaaggcatgccaatctataaagcccctctggagaaggggattctcattatccagtttctggtgatattcccagagaaacattggttatctctggaaaagctaccccagcttgaggctctgctgccgcccagacagaaggtccgcattacagacgacatggaccaggtcgagctaaaggaattctgtcccaatgaacagaattggcggcagcatcgcgaggcttatgaagaagacgaagatggcccccaggccggggtgcaatgccagaccgcttag

SEQ ID NO: 46855 - DNA, 1194 bp, Artificial Sequence
  Description of Artificial Sequence: Synthetic coding sequence
atggtgaaggagacccagtactacgacatcctgggcgtgaagccctccgcatcccctgaggagattaaaaaagcttatcggaaattggctctgaaataccaccccgataagaaccctgacgagggcgaaaagtttaaactcataagccaggcgtacgaagtgctctccgatccaaaaaaacgggacgtgtatgatcaggggggagaacaggcaatcaaggagggaggctcagggtccccttcttttagcagtcctatggacatatttgatatgtttttcggaggggggggcagaatggcgcgcgaaaggaggggcaagaacgttgtgcaccagctaagcgttactctggaggacttgtacaacggcgttacgaagaagttggccctgcaaaaaaatgtgatctgcgagaaatgcgaaggtgtcggaggaaaaaaaggcagcgtggagaaatgccctctgtgcaaaggacgcggaatgcaaattcacatccaacagattggccctggtatggtgcagcaaatccagaccgtctgcatagagtgcaagggccagggggagcgcatcaaccctaaggaccgctgcgaatcttgctcaggggctaaagtgatcagggagaaaaaaatcattgaagtccacgtggaaaagggtatgaaggatgggcagaaaattctttttcacggcgagggtgaccaggagcctgagctcgagcccggagatgtgataatcgtgctcgatcagaaggaccatagtgtgttccaacggcgcggccatgatctcatcatgaagatgaagatccagctcagcgaagcgctctgcggctttaagaaaacaattaagacccttgataacaggattctggttattacctcaaaggccggcgaggtaataaagcacggcgatctaaggtgcgtgcgagatgaaggtatgcccatctacaaggcacctctcgagaaaggtattctcattatccaattcctggttatatttcctgagaagcactggctcagcctggagaaattacctcagcttgaagccttgttgccaccccgccaaaaagtaagaattacagatgatatggatcaggtggaactgaaggaattttgccctaacgaacagaactggcgccagcatagagaggcctacgaagaggatgaggacgggcctcaggctggcgtacaatgccagaccgcttag

SEQ ID NO: 46856 - DNA, 1281 bp, Artificial Sequence
  Description of Artificial Sequence: Synthetic coding sequence
atggcccggggcggcagccagagctggagcagcggcgagagcgacggccagcctaaggagcagacccctgaaaagccccgccataagatggtcaaggagacccagtattacgacatcctgggggtcaaacccagcgcgagccctgaggaaattaagaaggcctatcgcaaactcgctttgaaataccaccccgacaaaaatccggacgaaggagagaaatttaagttgatatcgcaagcatatgaagtgctcagtgatcccaagaagagggacgtatacgaccagggcggagagcaggcaataaaagagggaggttccggttcaccatccttctcttctcctatggatatctttgacatgttcttcgggggggggggacgtatggcgagagagcgacgcgggaagaatgtagtccaccagctttcagtgacactggaagacctctataacggtgtaaccaagaaactcgccctccagaaaaacgtaatctgcgagaagtgcgagggcgtgggcggcaaaaaaggctccgtcgaaaagtgtcccctgtgcaagggacgaggcatgcaaatacatatacaacagattggacccgggatggtgcagcagatccaaaccgtttgtatcgagtgcaaggggcaaggcgagcgtatcaatccaaaggaccgttgtgaaagttgcagcggggccaaggttatacgggaaaaaaagataatcgaggtgcacgtggagaaaggaatgaaagacggtcaaaagatcttgtttcacggggagggggatcaggaacctgagctcgagcccggggatgtcatcattgtgctagatcagaaggaccattcagttttccagaggcgcggtcatgatctgatcatgaagatgaaaatacagctctccgaagccctgtgtggatttaaaaagactatcaaaaccttggacaaccggattttagtcatcactagcaaagctggcgaagtgattaagcacggtgatttgcggtgtgtcagggacgagggaatgcccatttataaagcaccgctggaaaaaggaattctgattatccagttcttagtcatttttcctgagaagcactggctgagtttggaaaagcttccccagctggaggctcttctaccacctagacagaaagtgaggatcacagacgacatggatcaagtggagctgaaggaattttgtccaaatgagcagaactggagacagcacagggaagcctacgaagaagacgaagatgggccacaagccggtgtgcagtgccaaactgcctag

SEQ ID NO: 46857 - DNA, 1113 bp, Artificial Sequence
  Description of Artificial Sequence: Synthetic coding sequence
atgtgggagagcctgaccctggacagcggccagatcagcgccctgactaggttcaaactgattagtcaggcatatgaagtactatccgatcccaaaaagcgggatgtgtacgatcaggggggcgagcaggcgatcaaagaagggggttcaggctcaccctcgttttcctctccgatggatatttttgacatgttcttcggtggtgggggtcggatggcgcgggagcggcgggggaagaatgtagtgcaccagctgtcagtcacactggaggacctgtataatggagtgaccaagaagctggccctgcaaaagaacgtgatttgtgaaaagtgtgagggtgtgggcggcaaaaagggaagcgtcgagaaatgccccttgtgcaaagggcgcgggatgcagatccatatccagcagatcggccctggcatggtgcaacagattcagaccgtgtgtatcgagtgcaaaggccagggtgagaggattaatcccaaggaccggtgcgagtcatgcagtggggctaaagtgattcgcgaaaagaagatcattgaggttcacgtcgaaaaaggaatgaaggatgggcagaagatcctttttcacggggaaggggatcaagaacccgaactggagcctggcgatgtaattattgtgctggatcagaaggatcattctgtgttccagagaaggggacacgacctgatcatgaagatgaaaatacagctcagcgaggccctgtgcggtttcaaaaagaccattaagacccttgataataggatcctggtgatcacatccaaagccggtgaggtgattaagcacggggatttgaggtgcgtgcgggacgagggtatgccaatatataaggccccactggaaaagggaattctcataattcagttcctggtcattttccctgagaaacattggctgagtctagaaaaactgccccaactggaagcgctgctgccaccccgccaaaaggtgcggatcaccgatgacatggatcaggtggaactcaaggagttttgccctaatgagcagaattggagacagcatcgcgaagcttacgaggaggatgaagatggtccacaggcaggggtgcagtgtcagacagcatag

SEQ ID NO: 46858 - DNA, 951 bp, Artificial Sequence
  Description of Artificial Sequence: Synthetic coding sequence
atgggccaggactactacagcgtgctgggcatcacccggaacagcgaggacgcacagattaagcaagcctaccgccgcctcgcccttaaacaccatcctctgaagagcaacgagcctagcagtgcagaaatcttcagacagattgctgaggcttatgacgtgctcagtgatcccatgaagagaggaatttacgataagtttggagaggagggcctcaagggaggaattcccctggaattcggatctcagacgccatggaccaccggttatgtgtttcacggaaagcccgagaaagtatttcatgaattttttggaggcaacaatccattctccgagttttttgatgccgaaggtagcgaggtcgatttaaattttggagggctgcaagggaggggggtaaagaagcaagacccacaagtcgaaagagatctatatctatcacttgaagacctctttttcggttgcaccaagaagatcaaaatctcaaggcgtgtgctgaatgaggacggctacagctcaacaatcaaagataagatcctaactattgatgtgaagccaggttggcgccagggcacgcgcatcacattcgaaaaagagggagatcagggtcccaatattatccctgcagatatcattttcattgtaaaggaaaaactacacccccgcttcagacgcgagaatgacaatttattttttgtgaacccgatccctttgggtaaggccctgacttgttgtactgtggaagtgcgcactctcgatgataggttactgaatattcccatcaacgacattatacatcccaagtactttaagaaagtgcccggcgaaggaatgccccttcccgaggacccaaccaagaagggggacctcttcatcttctttgacattcagtttcccacacgcctaacgcctcagaaaaaacagatgctccggcaagccctgttaacgtag

SEQ ID NO: 46859 - DNA, 426 bp, Artificial Sequence
  Description of Artificial Sequence: Synthetic coding sequence
atggagaccagccggggccggaacctggccaaggtgacccggcccacttcaccgtgtcatctgttggcttcgcctgcacagggtccaaatataatcccggccgatattatcttcatcgttaaagagaagctacacccccgattccgcagagagaatgataacttattctttgtgaaccctatccccttaggtaaggcccttacgtgttgcactgtcgaagtccgcacattagatgatagactgctaaatattccgataaacgatataatacaccccaaatatttcaaaaaggttcccggcgaaggcatgcctctgccggaagaccctacaaaaaaaggggatctgttcatcttctttgatatccagtttcctacacggctgaccccgcaaaaaaagcagatgctgcggcaggcgctgttgacttag

SEQ ID NO: 46860 - DNA, 426 bp, Artificial Sequence
  Description of Artificial Sequence: Synthetic coding sequence
atggagaccagccggggccggaacctggccaaggtgacccggcccacatccccttgtcatcttctggcatccccggctcaaggcccgaacataattccagcggacattatctttattgtgaaagagaaactccatccacgtttcagacgggagaatgataacttgttctttgttaatccaatccccctagggaaggccctgacttgttgcaccgttgaagtgcgcacactggacgatcgccttctgaatattcccattaacgatattatacacccaaagtacttcaagaaggtgccaggggaaggtatgcctctgccggaggatcctacaaaaaaaggggacttgtttattttcttcgacatccagtttccaacccgtctgacaccccagaagaaacaaatgctccggcaggctttgctgacttag

SEQ ID NO: 46861 - DNA, 930 bp, Artificial Sequence
  Description of Artificial Sequence: Synthetic coding sequence
atggtggactactacgaggtgctgggcctgcagcggtacgccagccctgaggatatcaagaaggcttatcacaaagttgcccttaaatggcacccagacaagaatcccgaaaacaaggaagaagccgaaaggaaatttaaggaggtggccgaggcttacgaggttctgtccaatgacgaaaaacgggacatttatgacaagtacggcacggaaggactgaacggaggtggaagccacttcgatgatgagtgcgagtatggcttcacattccacaaaccagatgatgtatttaaagagatcttccacgagagggatccgttttcgttccatttttttgaggactcattagaggatttgcttaataggccaggctccagttacggtaatagaaaccgcgatgctggctatttctttagcactgccagcgagtatccgatattcgaaaagtttagcagctacgatacaggatacacctcccagggctccttaggccatgaaggcctcaccagctttagtagcctcgccttcgataacagtgggatggataactatatttccgtgaccaccagtgataaaatagtgaacgggcgaaatataaataccaaaaagattatagagagcgaccaagaacgcgaggctgaagacaacggtgagctgacgttctttctggtcaacagcgtggcgaacgaggaaggctttgcaaaggagtgttcatggaggacacagtcttttaacaattattccccgaatagtcatagcagcaagcacgtgagtcaatatacttttgtggataacgacgagggggggatctcctgggttacttctaaccgtgaccccccaatcttctcagcaggtgtcaaagagggcggtaaacggaaaaagaaaaagaggaaagaggtgcagaaaaagtctacaaagaggaattgctag

SEQ ID NO: 46862 - DNA, 699 bp, Artificial Sequence
  Description of Artificial Sequence: Synthetic coding sequence
atggccaactactacgaggtgctgggcgtgcaggccagcgccagccctgaggacatcaaaaaggcttaccggaaacttgccctaaggtggcatcccgataaaaatccggacaataaagaagaggctgagaaaaagttcaagctggtcagcgaggcttacgaggtgttgagcgattcgaaaaaacgcagcctgtacgaccgcgctggttgcgacagttggagggccggcggtggtgcctcaacgccttaccactctcctttcgacacgggctatacattccggaatccagaggacatattcagggaatttttcggcggactggatcccttcagcttcgaattctgggatagtccctttaattcggatcgcggcgggagaggacacggcttgcggggagctttttctgccggctttggggaattccctgcttttatggaagctttctccagctttaatatgctgggctgcagcggaggatcacacaccacatttagctctacatcctttggcggaagtagctccggatcctccggttttaagtcagtcatgtcttcaaccgaaatgataaatggacacaaggtgacaaccaaacgtatagtggaaaacggacaggaaagagtggaggtcgaggaagatggtcagctgaagtccgttacagtcaacggtaaagaacagttaaagtggatggacagtaaatag

SEQ ID NO: 46863 - DNA, 699 bp, Artificial Sequence
  Description of Artificial Sequence: Synthetic coding sequence
atggccaactactacgaggtgctgggcgtgcaggccagcgccagccctgaggacataaaaaaggcgtataggaaactcgctctcaggtggcaccccgataaaaatccagacaacaaggaggaagcagagaagaaatttaagcttgtatcagaagcatacgaggtactcagtgatagcaagaaacgaagtctgtatgatcgtgccggctgtgactcctggcgcgccggaggaggggctagtacaccttatcattctccctttgacactggctataccttccgaaaccccgaagacatttttcgtgagttttttggagggttggacccttttagttttgagttctgggatagtccatttaacagcgatcgaggaggacgggggcacgggttgcggggcgcatttagtgccgggttcggtgaatttccagctttcatggaggcattttctagtttcaacatgttgggctgttctggcggcagccacacaacgttcagttctacttcttttggggggtcaagtagcggctcatctgggtttaaaagtgtgatgagttccacagaaatgattaatggacataaggttaccactaagagaatcgtagagaacgggcaagagagggttgaagttgaggaagacgggcagctcaagagcgtgactgtcaacggaaaagaacagttaaaatggatggattccaaatag

SEQ ID NO: 46864 - DNA, 1107 bp, Artificial Sequence
  Description of Artificial Sequence: Synthetic coding sequence
atgcagcccggcagcagccggtgcgaggaggagacccccagcctgttatggggtttggatccagttttcctcgcgtttgcaaagctttacatacgggatatcttagacatgaaggagagtcggcaagtgcccggggtcttcttatacaacggccatcctattaagcaggttgatgtccttggtaccgtgattggcgtccgtgagcgcgacgccttctattcgtacggggttgatgattctacaggagtcatcaattgtatctgctggaagaaattaaacacagagtctgtgtcagctgcaccaagtgccgcccgtgaactcagcctgacctctcaactaaagaaactccaagaaacaatcgagcagaagaccaaaattgaaattggagatacgattcgagtgagggggtcaattcgaacataccgcgaggaacgtgagatacacgctaccacatactacaaggtggatgatcctgtttggaacatccaaattgcccgcatgctcgagttgcctaccatctatcgcaaggtgtacgaccagccattccactcgtctgcgctggagaaggaggaggctctgtcgaaccccggggcgctagatctgccaagtctcactagcttgttatctgagaaggccaaggaattcctcatggaaaatagggtgcagagtttctatcaacaggaactggaaatggtggaatctttgctgtccctggcaaaccagcctgtcatccacagcgcatcttccgatcaagtgaactttaagaaggacaccacttcaaaggcgatacactcaatattcaagaacgctatccagctcctgcaagaaaaggggctggtcttccagaaggacgatgggttcgacaatctgtactacgtaacccgggaggataaggacctacatcggaaaatccaccggatcatccagcaggactgccagaaaccgaaccacatggaaaaggggtgccacttcttacacattctagcctgtgcccgcttgagcatccgaccagggctgagcgaagcggtactgcagcaggtgctggagttgctggaggatcagtcagatattgtctccacaatggagcattactacacagcattctag

SEQ ID NO: 46865 - DNA, 324 bp, Artificial Sequence
  Description of Artificial Sequence: Synthetic coding sequence
atggacgccatcctgaactaccggagcgaggacaccgaggactactataccctattggggtgcgatgagctgtcgagtgttgaacagatactggccgagttcaaggtcagggcattggagtgccaccccgacaagcatccggagaaccccaaagctgtggagactttccagaagcttcagaaagcaaaggagatcctgactaacgaggagtctagggctcgctatgatcactggcgccgctcccagatgtcaatgccctttcagcagtgggaggcactgaacgattcagttaaaaccgtcgggttctcgttaggggctacctag

SEQ ID NO: 46866 - DNA, 1407 bp, Artificial Sequence
  Description of Artificial Sequence: Synthetic coding sequence
atgggcttcctgggcaccggcacctggatcctggtgctggtgctgccaatacaagcatttcctaaacccggcgggagccaagataaaagtttacacaatagagagctgagcgcagaaaggcccctcaacgaacagatcgcagaagccgaggaagacaagatcaaaaaaacctaccctccagaaaataaacccggccagagtaactattcatttgtggataacctcaatctcctgaaagcaatcacagaaaaagaaaagatagagaaggagcggcagtcaatccggagctcccctttagacaacaagctcaatgtcgaggatgtggacagcaccaaaaacaggaaactgatcgatgattatgacagcactaagtccgggttagatcacaaatttcaggatgaccctgacggactccatcagcttgatggtacccctctcaccgcagaggacatcgtccacaagatcgccgccaggatatatgaagaaaatgatagagcggtgttcgacaagatagtgtccaaactgctcaatttaggcctcataaccgagtcacaagcgcataccctggaggacgaagtggcagaggtgctccagaagctcatctctaaagaagctaacaactatgaggaggatcccaacaaacccacatcctggactgagaaccaggctggaaagatacctgaaaaagtgacaccaatggcggccattcaggatgggctggccaagggcgaaaacgatgagacagtgagcaacaccctgacactgacaaatggactggagagacggacaaagacatattccgaagacaacttcgaagagctccagtatttccccaacttttacgcgctgcttaagagcatcgacagtgagaaggaagccaaggaaaaagaaaccctcataactatcatgaagacccttatagacttcgttaagatgatggtgaagtacggcacgatctctcctgaggagggagtctcctatcttgagaatctagatgagatgatcgccttgcaaaccaagaacaagctagaaaaaaacgccacagacaacatttcaaaactctttccagcgcccagcgagaaatcccatgaggagactgactccactaaagaagaagccgcaaaaatggagaaagagtatgggtcactgaaagactcaaccaaagatgataacagtaatcctggcgggaagaccgatgagccgaagggaaagacggaggcttacctggaggcaatcaggaaaaatatcgagtggctgaaaaaacatgacaagaaaggcaacaaggaggattacgacctgagcaagatgcgggactttattaataaacaggctgacgcttacgtagagaaaggtatccttgacaaggaggaggccgaagctatcaaacggatttactctagtctgtag
